United States Patent 7,901,882 (ANALYSIS OF METHYLATION USING NUCLEIC ACID ARRAYS) - sequence listing, part 7

SEQ ID NO: 236404 - DNA, 25 bp, Mus musculus
acctctccgggcaaatactgtcttt

SEQ ID NO: 236405 - DNA, 25 bp, Mus musculus
aaatactgtctttggtcgtcacgca

SEQ ID NO: 236406 - DNA, 25 bp, Mus musculus
tggtcgtcacgcaccagcaccttta

SEQ ID NO: 236407 - DNA, 25 bp, Mus musculus
ctttacggccactttcttggcggcg

SEQ ID NO: 236408 - DNA, 25 bp, Mus musculus
ccatctgccggcgtttggtcttgta

SEQ ID NO: 236409 - DNA, 25 bp, Mus musculus
cttgcgtctctgtgagcttcagcga

SEQ ID NO: 236410 - DNA, 25 bp, Mus musculus
gcttcagcgaagctgccaggtctgc

SEQ ID NO: 236411 - DNA, 25 bp, Mus musculus
cccggacaggtagcgctgatggtta

SEQ ID NO: 236412 - DNA, 25 bp, Mus musculus
cgctgatggttaaagcggcgctcca

SEQ ID NO: 236413 - DNA, 25 bp, Mus musculus
ctccagctcgaagacctgggcgtgc

SEQ ID NO: 236414 - DNA, 25 bp, Mus musculus
cgggagcgcttctttcgcggtttag

SEQ ID NO: 236415 - DNA, 25 bp, Mus musculus
cgtgcacctccagggctaacgctgt

SEQ ID NO: 236416 - DNA, 25 bp, Mus musculus
agggctaacgctgtcatcctcgcct

SEQ ID NO: 236417 - DNA, 25 bp, Mus musculus
cccagcccgggagacagtagtaagg

SEQ ID NO: 236418 - DNA, 25 bp, Mus musculus
ccgcctcagagtgcttgacctctta

SEQ ID NO: 236419 - DNA, 25 bp, Mus musculus
gacctgaaacgctggctgacatctc

SEQ ID NO: 236420 - DNA, 25 bp, Mus musculus
ccggcgagaattgtcaagggtcctc

SEQ ID NO: 236421 - DNA, 25 bp, Mus musculus
ggaatccagcgccagatgctcttct

SEQ ID NO: 236422 - DNA, 25 bp, Mus musculus
ggacagcttcgagcctgacacggag

SEQ ID NO: 236423 - DNA, 25 bp, Mus musculus
tcttgttgaggatcgcctggatgga

SEQ ID NO: 236424 - DNA, 25 bp, Mus musculus
cgccgcgctcctctttcttgttgag

SEQ ID NO: 236425 - DNA, 25 bp, Mus musculus
tgacatctcgctgtcgctgcggacc

SEQ ID NO: 236426 - DNA, 25 bp, Mus musculus
aggcgcaccgcccaaagtcactttt

SEQ ID NO: 236427 - DNA, 25 bp, Mus musculus
cgaagatccgccagcagcagacggc

SEQ ID NO: 236428 - DNA, 25 bp, Mus musculus
cgggagatgccagaagagagtcctc

SEQ ID NO: 236429 - DNA, 25 bp, Mus musculus
tacagcccggccgattatctcttcg

SEQ ID NO: 236430 - DNA, 25 bp, Mus musculus
cctcgttctcttcgctcagggctga

SEQ ID NO: 236431 - DNA, 25 bp, Mus musculus
gcgtcgtgttcccacagtaggccca

SEQ ID NO: 236432 - DNA, 25 bp, Mus musculus
cggggccgccatgggcaacctgttc

SEQ ID NO: 236433 - DNA, 25 bp, Mus musculus
ccggaaagaccgggattgtgtctcg

SEQ ID NO: 236434 - DNA, 25 bp, Mus musculus
cgcccagctgcagactcctggacca

SEQ ID NO: 236435 - DNA, 25 bp, Mus musculus
ccgagtcaccgaacaggacagggcc

SEQ ID NO: 236436 - DNA, 25 bp, Mus musculus
agcagagccgagtcaccgaacagga

SEQ ID NO: 236437 - DNA, 25 bp, Mus musculus
ccgcaagaagcagagccgagtcacc

SEQ ID NO: 236438 - DNA, 25 bp, Mus musculus
tgggcaacctgttcggccgcaagaa

SEQ ID NO: 236439 - DNA, 25 bp, Mus musculus
cttcgcgttctgaggcgcgtggctc

SEQ ID NO: 236440 - DNA, 25 bp, Mus musculus
tgcgctagggacgaagctgcttcgc

SEQ ID NO: 236441 - DNA, 25 bp, Mus musculus
taagtccagcggtgcgctgcgctag

SEQ ID NO: 236442 - DNA, 25 bp, Mus musculus
gcctagtaagtccagcggtgcgctg

SEQ ID NO: 236443 - DNA, 25 bp, Mus musculus
gttcgcatcgcctagtaagtccagc

SEQ ID NO: 236444 - DNA, 25 bp, Mus musculus
ggagggcgttcgcatcgcctagtaa

SEQ ID NO: 236445 - DNA, 25 bp, Mus musculus
ctgttcggccgcaagaagcagagcc

SEQ ID NO: 236446 - DNA, 25 bp, Mus musculus
ggcggtgacagcagcaactcaagtc

SEQ ID NO: 236447 - DNA, 25 bp, Mus musculus
aattccagccgcctcgaggcgcggg

SEQ ID NO: 236448 - DNA, 25 bp, Mus musculus
caacgggatgttgttacggaaccag

SEQ ID NO: 236449 - DNA, 25 bp, Mus musculus
cagtccctgcggaactggtcgaaga

SEQ ID NO: 236450 - DNA, 25 bp, Mus musculus
caggagtgaagcgttggtttagttt

SEQ ID NO: 236451 - DNA, 25 bp, Mus musculus
gctggctctccacctgtagcttcag

SEQ ID NO: 236452 - DNA, 25 bp, Mus musculus
gcaactcaagtctggctaccggggc

SEQ ID NO: 236453 - DNA, 25 bp, Mus musculus
tttagtttcactgttgcggctgccc

SEQ ID NO: 236454 - DNA, 25 bp, Mus musculus
cggaaccagcggatctagagcaacc

SEQ ID NO: 236455 - DNA, 25 bp, Mus musculus
aggaaggcggctacacaggtcccgc

SEQ ID NO: 236456 - DNA, 25 bp, Mus musculus
atcatggcaacgagctgcgggtccc

SEQ ID NO: 236457 - DNA, 25 bp, Mus musculus
gtttacgatcatggcaacgagctgc

SEQ ID NO: 236458 - DNA, 25 bp, Mus musculus
tggctcttgaggtggtttacgatca

SEQ ID NO: 236459 - DNA, 25 bp, Mus musculus
tagcttcagctcagaggaggcagga

SEQ ID NO: 236460 - DNA, 25 bp, Mus musculus
ccgtgcaggatgagctactgctcgg

SEQ ID NO: 236461 - DNA, 25 bp, Mus musculus
tcgcccagcgctctcagccgttcag

SEQ ID NO: 236462 - DNA, 25 bp, Mus musculus
tgataaatgcgggacttcgggttcg

SEQ ID NO: 236463 - DNA, 25 bp, Mus musculus
gttgcctgtcaccggcttctccgag

SEQ ID NO: 236464 - DNA, 25 bp, Mus musculus
cgccggcctgataaatgcgggactt

SEQ ID NO: 236465 - DNA, 25 bp, Mus musculus
tgagctactgctcgggctgacacag

SEQ ID NO: 236466 - DNA, 25 bp, Mus musculus
gctgacacagcagccgacgaggccg

SEQ ID NO: 236467 - DNA, 25 bp, Mus musculus
gcacgaacgcgggtgtgacccacct

SEQ ID NO: 236468 - DNA, 25 bp, Mus musculus
ctcccaggacttcaaaccgagtctg

SEQ ID NO: 236469 - DNA, 25 bp, Mus musculus
ggacttcaaaccgagtctgcaccac

SEQ ID NO: 236470 - DNA, 25 bp, Mus musculus
aggacttcagtaagcggcagcagca

SEQ ID NO: 236471 - DNA, 25 bp, Mus musculus
ccagaagaggaaagagttgagcccg

SEQ ID NO: 236472 - DNA, 25 bp, Mus musculus
aggaaagagttgagcccgccacacc

SEQ ID NO: 236473 - DNA, 25 bp, Mus musculus
ggttcggggtgctgcacactgccct

SEQ ID NO: 236474 - DNA, 25 bp, Mus musculus
tgctgtggctgcgagtaaccgcaga

SEQ ID NO: 236475 - DNA, 25 bp, Mus musculus
cgcgctcctttaccttgtcgcagta

SEQ ID NO: 236476 - DNA, 25 bp, Mus musculus
tcctttaccttgtcgcagtagcgcc

SEQ ID NO: 236477 - DNA, 25 bp, Mus musculus
cagctgcttcatccgccagtgcggg

SEQ ID NO: 236478 - DNA, 25 bp, Mus musculus
cggggcggtgaagacgtccacttca

SEQ ID NO: 236479 - DNA, 25 bp, Mus musculus
cacttcatcggggaagggcgccatc

SEQ ID NO: 236480 - DNA, 25 bp, Mus musculus
cagagctctctcctccggtgggcat

SEQ ID NO: 236481 - DNA, 25 bp, Mus musculus
tgggcatggtcgtccctggtccctt

SEQ ID NO: 236482 - DNA, 25 bp, Mus musculus
ctggtcccttgcgttacatctctta

SEQ ID NO: 236483 - DNA, 25 bp, Mus musculus
ttaaaaaatcgcactgtcccagggc

SEQ ID NO: 236484 - DNA, 25 bp, Mus musculus
tctccgggtgcctggccttgaggca

SEQ ID NO: 236485 - DNA, 25 bp, Mus musculus
tgcgagtaaccgcagaagcggcctg

SEQ ID NO: 236486 - DNA, 25 bp, Mus musculus
ctgcgtgaccagatcgagcctgcgt

SEQ ID NO: 236487 - DNA, 25 bp, Mus musculus
aggcagggacctgcgtgaccagatc

SEQ ID NO: 236488 - DNA, 25 bp, Mus musculus
atcctggaagcggagtggatccacc

SEQ ID NO: 236489 - DNA, 25 bp, Mus musculus
ccgaggacttcgtgcatgcgctcag

SEQ ID NO: 236490 - DNA, 25 bp, Mus musculus
tggagccgccgaggacttcgtgcat

SEQ ID NO: 236491 - DNA, 25 bp, Mus musculus
taacgcggcgagaacgcctggagcc

SEQ ID NO: 236492 - DNA, 25 bp, Mus musculus
agaggagatgcttccgcggtaacgc

SEQ ID NO: 236493 - DNA, 25 bp, Mus musculus
ctcccgcgagaggagatgcttccgc

SEQ ID NO: 236494 - DNA, 25 bp, Mus musculus
cgggcttcaaatcactcccgcgaga

SEQ ID NO: 236495 - DNA, 25 bp, Mus musculus
gctcggagctgcagctcgcgaccgt

SEQ ID NO: 236496 - DNA, 25 bp, Mus musculus
cagctccgcactagccggcgtttgg

SEQ ID NO: 236497 - DNA, 25 bp, Mus musculus
ttgttcatcagcagctgcttctccc

SEQ ID NO: 236498 - DNA, 25 bp, Mus musculus
gagagcccttgttcatcagcagctg

SEQ ID NO: 236499 - DNA, 25 bp, Mus musculus
agcccgcctgagagcccttgttcat

SEQ ID NO: 236500 - DNA, 25 bp, Mus musculus
accatcagccggtggctctggcgct

SEQ ID NO: 236501 - DNA, 25 bp, Mus musculus
ggagtggatccaccatcagccggtg

SEQ ID NO: 236502 - DNA, 25 bp, Mus musculus
tttccttaccgcaaaagagttctca

SEQ ID NO: 236503 - DNA, 25 bp, Mus musculus
aagcgccggtacctttgctccgctg

SEQ ID NO: 236504 - DNA, 25 bp, Mus musculus
ccagtagcactgtgagctgcacata

SEQ ID NO: 236505 - DNA, 25 bp, Mus musculus
aaattctcggtgctgtgtgacccta

SEQ ID NO: 236506 - DNA, 25 bp, Mus musculus
tccatctctaggaaagctgaaattc

SEQ ID NO: 236507 - DNA, 25 bp, Mus musculus
ctgtcaaggtatgccctgagcgctc

SEQ ID NO: 236508 - DNA, 25 bp, Mus musculus
acattcctctttgttgtccctggtc

SEQ ID NO: 236509 - DNA, 25 bp, Mus musculus
ctcccggaggaagcagtagctgcag

SEQ ID NO: 236510 - DNA, 25 bp, Mus musculus
cacgaagctctgctcagtccacatt

SEQ ID NO: 236511 - DNA, 25 bp, Mus musculus
acccattctcgggaacttagctcga

SEQ ID NO: 236512 - DNA, 25 bp, Mus musculus
ggattggaacctctccgacccattc

SEQ ID NO: 236513 - DNA, 25 bp, Mus musculus
cagtcctgtttgaacgccgggttga

SEQ ID NO: 236514 - DNA, 25 bp, Mus musculus
tcccgggctgcggaacacaaaagaa

SEQ ID NO: 236515 - DNA, 25 bp, Mus musculus
ggtggcctgaaagtctcaccgcctc

SEQ ID NO: 236516 - DNA, 25 bp, Mus musculus
agttctcggaagagtgcggtgctcc

SEQ ID NO: 236517 - DNA, 25 bp, Mus musculus
tggtagcgtcctcttgagtctgtgg

SEQ ID NO: 236518 - DNA, 25 bp, Mus musculus
gtggtagcgtcctcttgagtctgtg

SEQ ID NO: 236519 - DNA, 25 bp, Mus musculus
ggtggtagcgtcctcttgagtctgt

SEQ ID NO: 236520 - DNA, 25 bp, Mus musculus
ccgggtggtagcgtcctcttgagtc

SEQ ID NO: 236521 - DNA, 25 bp, Mus musculus
gcctgagtccggtccgggtggtagc

SEQ ID NO: 236522 - DNA, 25 bp, Mus musculus
ctccggatgcctgagtccggtccgg

SEQ ID NO: 236523 - DNA, 25 bp, Mus musculus
gctccggatgcctgagtccggtccg

SEQ ID NO: 236524 - DNA, 25 bp, Mus musculus
tctcggaagagtgcggtgctccgga

SEQ ID NO: 236525 - DNA, 25 bp, Mus musculus
cagttctcggaagagtgcggtgctc

SEQ ID NO: 236526 - DNA, 25 bp, Mus musculus
ccaagagcacccgcagcagcagcct

SEQ ID NO: 236527 - DNA, 25 bp, Mus musculus
cacgtgaggtaggcagttctcggaa

SEQ ID NO: 236528 - DNA, 25 bp, Mus musculus
aggaaacccggaggtggcacgtgag

SEQ ID NO: 236529 - DNA, 25 bp, Mus musculus
tgctccggatgcctgagtccggtcc

SEQ ID NO: 236530 - DNA, 25 bp, Mus musculus
gcctggccttggctgcacggcgact

SEQ ID NO: 236531 - DNA, 25 bp, Mus musculus
gcgcgcgccattggcgtcagcggcg

SEQ ID NO: 236532 - DNA, 25 bp, Mus musculus
agccgccatccgtagcccgccggcc

SEQ ID NO: 236533 - DNA, 25 bp, Mus musculus
catgttccgagagccacacactgtc

SEQ ID NO: 236534 - DNA, 25 bp, Mus musculus
gccatgttccgagagccacacactg

SEQ ID NO: 236535 - DNA, 25 bp, Mus musculus
gccgcgtcgcagacgcccgccatgt

SEQ ID NO: 236536 - DNA, 25 bp, Mus musculus
tcgtagaagcccagcgtctcggtgt

SEQ ID NO: 236537 - DNA, 25 bp, Mus musculus
gccggtcgctctcgtagaagcccag

SEQ ID NO: 236538 - DNA, 25 bp, Mus musculus
tagctgtcaccggccgtggggacat

SEQ ID NO: 236539 - DNA, 25 bp, Mus musculus
gactcggcccgacgggcaaagtgct

SEQ ID NO: 236540 - DNA, 25 bp, Mus musculus
agaagcccagcgtctcggtgtgttg

SEQ ID NO: 236541 - DNA, 25 bp, Mus musculus
gctccgcgcgcagagggaaggcgct

SEQ ID NO: 236542 - DNA, 25 bp, Mus musculus
ctagccgccggggtagctgtcaccg

SEQ ID NO: 236543 - DNA, 25 bp, Mus musculus
gctctcgtagaagcccagcgtctcg

SEQ ID NO: 236544 - DNA, 25 bp, Mus musculus
tcctgacagactcgcgcggtactga

SEQ ID NO: 236545 - DNA, 25 bp, Mus musculus
tgcagcctagtcacgcgtgcacatg

SEQ ID NO: 236546 - DNA, 25 bp, Mus musculus
tctgcagtgcagtgaaccctaccta

SEQ ID NO: 236547 - DNA, 25 bp, Mus musculus
gccgtcacgcagtgttacccagttg

SEQ ID NO: 236548 - DNA, 25 bp, Mus musculus
cggacagatgctaagttccgccctc

SEQ ID NO: 236549 - DNA, 25 bp, Mus musculus
cggcgagcccaaacgcacttcgagg

SEQ ID NO: 236550 - DNA, 25 bp, Mus musculus
gaactcagaaaggttgcccagaaca

SEQ ID NO: 236551 - DNA, 25 bp, Mus musculus
ccaaagctccgcctcgaggtggaga

SEQ ID NO: 236552 - DNA, 25 bp, Mus musculus
gaccaataggcttgcgaaatccgga

SEQ ID NO: 236553 - DNA, 25 bp, Mus musculus
gtaaaccacgcctttcttctgtgga

SEQ ID NO: 236554 - DNA, 25 bp, Mus musculus
tctgtggacctctagaaactaagcc

SEQ ID NO: 236555 - DNA, 25 bp, Mus musculus
cttcacctccctggagccaatagga

SEQ ID NO: 236556 - DNA, 25 bp, Mus musculus
ctaggctcgtgctctaagctgtgcc

SEQ ID NO: 236557 - DNA, 25 bp, Mus musculus
ctactcctagagtctgccgcttgca

SEQ ID NO: 236558 - DNA, 25 bp, Mus musculus
gacgccggcccgcaagaacagaagc

SEQ ID NO: 236559 - DNA, 25 bp, Mus musculus
taaggctcagtagcgggtctccgcc

SEQ ID NO: 236560 - DNA, 25 bp, Mus musculus
gcacaggtccggctttccaagcgcg

SEQ ID NO: 236561 - DNA, 25 bp, Mus musculus
ggccgagccgagaagatgtacttgc

SEQ ID NO: 236562 - DNA, 25 bp, Mus musculus
agccgagaagatgtacttgctgccc

SEQ ID NO: 236563 - DNA, 25 bp, Mus musculus
cggggtctgtccaccgcagacatga

SEQ ID NO: 236564 - DNA, 25 bp, Mus musculus
accgcagacatgacgaaggtgagtg

SEQ ID NO: 236565 - DNA, 25 bp, Mus musculus
acccggcgtatccaggccgcgatgt

SEQ ID NO: 236566 - DNA, 25 bp, Mus musculus
gcgatgtgtcggacggacgcatcaa

SEQ ID NO: 236567 - DNA, 25 bp, Mus musculus
cggacgcatcaagttgcagaaatga

SEQ ID NO: 236568 - DNA, 25 bp, Mus musculus
gcccttccctaaggctcagtagcgg

SEQ ID NO: 236569 - DNA, 25 bp, Mus musculus
tttgcaggacaccagcctgggcccg

SEQ ID NO: 236570 - DNA, 25 bp, Mus musculus
agttccctgggtttgcaggacacca

SEQ ID NO: 236571 - DNA, 25 bp, Mus musculus
aatgagctgaacagaaaagttccct

SEQ ID NO: 236572 - DNA, 25 bp, Mus musculus
tttccgcccgccgttgcagacatgg

SEQ ID NO: 236573 - DNA, 25 bp, Mus musculus
aggcctgccacgtgatcaggctgcc

SEQ ID NO: 236574 - DNA, 25 bp, Mus musculus
gagggatgttcactgggcagcctcc

SEQ ID NO: 236575 - DNA, 25 bp, Mus musculus
cccgagaccatctaacagcactttg

SEQ ID NO: 236576 - DNA, 25 bp, Mus musculus
ctttggtggacgagttggagtcatc

SEQ ID NO: 236577 - DNA, 25 bp, Mus musculus
ggagtcatccttcgaggtaagccga

SEQ ID NO: 236578 - DNA, 25 bp, Mus musculus
gggcgtctctgtgcagccctcacag

SEQ ID NO: 236579 - DNA, 25 bp, Mus musculus
cggaaggcgcgcaggttaactcctt

SEQ ID NO: 236580 - DNA, 25 bp, Mus musculus
caccggagaatggaagtcgcctgcc

SEQ ID NO: 236581 - DNA, 25 bp, Mus musculus
cgcctgccgtagattgggtactacc

SEQ ID NO: 236582 - DNA, 25 bp, Mus musculus
cccgcaaccgcgacatttctggaga

SEQ ID NO: 236583 - DNA, 25 bp, Mus musculus
agaccgtggccttgaagttcgccca

SEQ ID NO: 236584 - DNA, 25 bp, Mus musculus
gcgaataggcgaactgcccgtcatg

SEQ ID NO: 236585 - DNA, 25 bp, Mus musculus
gccaggcgtcgcttctgcaagcagc

SEQ ID NO: 236586 - DNA, 25 bp, Mus musculus
gtggggccttcagcggctataaaag

SEQ ID NO: 236587 - DNA, 25 bp, Mus musculus
accgatcttccgttggtcacaggtg

SEQ ID NO: 236588 - DNA, 25 bp, Mus musculus
ccctaggtcttcaggcccgagcagg

SEQ ID NO: 236589 - DNA, 25 bp, Mus musculus
tgcaccggctcacggaaaatgtcta

SEQ ID NO: 236590 - DNA, 25 bp, Mus musculus
ctttcacgctcggaggagatgcacc

SEQ ID NO: 236591 - DNA, 25 bp, Mus musculus
gggacccaggaccatgtcgctttca

SEQ ID NO: 236592 - DNA, 25 bp, Mus musculus
tgcgcgccttttcctgttgctgcag

SEQ ID NO: 236593 - DNA, 25 bp, Mus musculus
ctaccaatagaaaagacggcgcagg

SEQ ID NO: 236594 - DNA, 25 bp, Mus musculus
ccgcctccgaaatctaccaatagaa

SEQ ID NO: 236595 - DNA, 25 bp, Mus musculus
tcgcgcactcctgagggacccttga

SEQ ID NO: 236596 - DNA, 25 bp, Mus musculus
tcacctgcaatagcgcgggagccac

SEQ ID NO: 236597 - DNA, 25 bp, Mus musculus
gaagaccgtccagggtcgacgcacg

SEQ ID NO: 236598 - DNA, 25 bp, Mus musculus
agggttctcccgctagagttcagca

SEQ ID NO: 236599 - DNA, 25 bp, Mus musculus
gttgctgcagttgtcgctttcctca

SEQ ID NO: 236600 - DNA, 25 bp, Mus musculus
ccttaccttagtgagctgagcgatc

SEQ ID NO: 236601 - DNA, 25 bp, Mus musculus
cgccttgcacgtgaggtttaccatc

SEQ ID NO: 236602 - DNA, 25 bp, Mus musculus
tcgttcgcgagctagctggctcacg

SEQ ID NO: 236603 - DNA, 25 bp, Mus musculus
ttcctctgctcgtgctcgttcgcga

SEQ ID NO: 236604 - DNA, 25 bp, Mus musculus
ctctctttccggaggtgtctccttc

SEQ ID NO: 236605 - DNA, 25 bp, Mus musculus
ctccagagaggtggcactgcagtcc

SEQ ID NO: 236606 - DNA, 25 bp, Mus musculus
cgggcgtgagagctttctccagaga

SEQ ID NO: 236607 - DNA, 25 bp, Mus musculus
aaatgctctgactcgcgcgctctca

SEQ ID NO: 236608 - DNA, 25 bp, Mus musculus
ggagccctgcactgaaatgctctga

SEQ ID NO: 236609 - DNA, 25 bp, Mus musculus
ggcagatgccatcgctttaaggagc

SEQ ID NO: 236610 - DNA, 25 bp, Mus musculus
attttgctgttgagggcagatgcca

SEQ ID NO: 236611 - DNA, 25 bp, Mus musculus
ttcctggcgggtgaattttgctgtt

SEQ ID NO: 236612 - DNA, 25 bp, Mus musculus
ttaccatctgcggatgcttccgaga

SEQ ID NO: 236613 - DNA, 25 bp, Mus musculus
gtgcatctccggatcacagtccatt

SEQ ID NO: 236614 - DNA, 25 bp, Mus musculus
cacagccagtgagcagaacgcccgg

SEQ ID NO: 236615 - DNA, 25 bp, Mus musculus
gggaaactgagtcctcctcggatcg

SEQ ID NO: 236616 - DNA, 25 bp, Mus musculus
gacgccctcggaaagtttgacatcc

SEQ ID NO: 236617 - DNA, 25 bp, Mus musculus
gccgcaccagaaccaggcgaagctg

SEQ ID NO: 236618 - DNA, 25 bp, Mus musculus
tcggatcgcgaaccacagtctctct

SEQ ID NO: 236619 - DNA, 25 bp, Mus musculus
tcccgcgatagttgtttgaaaactc

SEQ ID NO: 236620 - DNA, 25 bp, Mus musculus
gcgagatctcatcctcccgcgatag

SEQ ID NO: 236621 - DNA, 25 bp, Mus musculus
accttttcctattgggagagcggca

SEQ ID NO: 236622 - DNA, 25 bp, Mus musculus
ttcagaaagctgaacgcccacttca

SEQ ID NO: 236623 - DNA, 25 bp, Mus musculus
gcaccgaaggccaccagtttaattc

SEQ ID NO: 236624 - DNA, 25 bp, Mus musculus
acaagatcccgcaaggcaccgaagg

SEQ ID NO: 236625 - DNA, 25 bp, Mus musculus
gggatttacccgttctcagccagtc

SEQ ID NO: 236626 - DNA, 25 bp, Mus musculus
ccaaacgactccttcgctcgggatt

SEQ ID NO: 236627 - DNA, 25 bp, Mus musculus
ggcagcgcagaagaagcggctttct

SEQ ID NO: 236628 - DNA, 25 bp, Mus musculus
gtttgaagcaaaaccgatcagaccc

SEQ ID NO: 236629 - DNA, 25 bp, Mus musculus
ccgaaacggaaaactgaactgcatt

SEQ ID NO: 236630 - DNA, 25 bp, Mus musculus
tctgagtgaggaaaagcagcgaccg

SEQ ID NO: 236631 - DNA, 25 bp, Mus musculus
tccatcacatgacagcgaaaagagg

SEQ ID NO: 236632 - DNA, 25 bp, Mus musculus
ggctacgcgagtccatcacatgaca

SEQ ID NO: 236633 - DNA, 25 bp, Mus musculus
ggagggctacgcgagtccatcacat

SEQ ID NO: 236634 - DNA, 25 bp, Mus musculus
ctgcatttgaacaggaatgggaggc

SEQ ID NO: 236635 - DNA, 25 bp, Mus musculus
ccgggagcgcgcaagtttgaagcaa

SEQ ID NO: 236636 - DNA, 25 bp, Mus musculus
ccactgaatgacagccgggagcgcg

SEQ ID NO: 236637 - DNA, 25 bp, Mus musculus
ctacccggagcagcccactgaatga

SEQ ID NO: 236638 - DNA, 25 bp, Mus musculus
cgcaacaaggtaagggagtcccagt

SEQ ID NO: 236639 - DNA, 25 bp, Mus musculus
gaaaagcagcgaccgcaacaaggta

SEQ ID NO: 236640 - DNA, 25 bp, Mus musculus
agcgaaaagaggaccggagtcagtc

SEQ ID NO: 236641 - DNA, 25 bp, Mus musculus
ctgaactgcatttgaacaggaatgg

SEQ ID NO: 236642 - DNA, 25 bp, Mus musculus
aagagagcgacgctgtgccctctgg

SEQ ID NO: 236643 - DNA, 25 bp, Mus musculus
cgtccacgaaaaccctgagcgggag

SEQ ID NO: 236644 - DNA, 25 bp, Mus musculus
gagcgagaaacccggaggccagcca

SEQ ID NO: 236645 - DNA, 25 bp, Mus musculus
gccagccaggaacccgcgtgctgaa

SEQ ID NO: 236646 - DNA, 25 bp, Mus musculus
acccgcgtgctgaaggagcggacca

SEQ ID NO: 236647 - DNA, 25 bp, Mus musculus
tgaaggagcggaccagcaacgcctc

SEQ ID NO: 236648 - DNA, 25 bp, Mus musculus
cccttctgccctcgcgcggagcgct

SEQ ID NO: 236649 - DNA, 25 bp, Mus musculus
cggagcgctggaagtccgaagactt

SEQ ID NO: 236650 - DNA, 25 bp, Mus musculus
atttcccagcctccattgcgtgcag

SEQ ID NO: 236651 - DNA, 25 bp, Mus musculus
cattgcgtgcaggtcccgtagagga

SEQ ID NO: 236652 - DNA, 25 bp, Mus musculus
ctttgtagtcctctcgcgttgagcg

SEQ ID NO: 236653 - DNA, 25 bp, Mus musculus
gctgtgccctctgggctttgtagtc

SEQ ID NO: 236654 - DNA, 25 bp, Mus musculus
cgaaaaccctgagcgggagcgagaa

SEQ ID NO: 236655 - DNA, 25 bp, Mus musculus
agcctccattgcgtgcaggtcccgt

SEQ ID NO: 236656 - DNA, 25 bp, Mus musculus
gcgcacactctactgccattcggtt

SEQ ID NO: 236657 - DNA, 25 bp, Mus musculus
ttgtttagacacttgcctggggctc

SEQ ID NO: 236658 - DNA, 25 bp, Mus musculus
gctgcggagtccgtcctattgttta

SEQ ID NO: 236659 - DNA, 25 bp, Mus musculus
gaagccaagcgctgcctagtctgtg

SEQ ID NO: 236660 - DNA, 25 bp, Mus musculus
atcccggagaccagagtggctgaca

SEQ ID NO: 236661 - DNA, 25 bp, Mus musculus
tcgctgttggctgttgtttcttcta

SEQ ID NO: 236662 - DNA, 25 bp, Mus musculus
tgcactttgaggctgaggacccact

SEQ ID NO: 236663 - DNA, 25 bp, Mus musculus
cctggggaaacttcctgcactttga

SEQ ID NO: 236664 - DNA, 25 bp, Mus musculus
ggctgccgcagacggtggtttaaaa

SEQ ID NO: 236665 - DNA, 25 bp, Mus musculus
tgaccggatccaacgcctggggaaa

SEQ ID NO: 236666 - DNA, 25 bp, Mus musculus
gggtctttttgtttggctgcgctca

SEQ ID NO: 236667 - DNA, 25 bp, Mus musculus
ggggctccggctgctatataaagac

SEQ ID NO: 236668 - DNA, 25 bp, Mus musculus
atttatttacggagcgcctggacgg

SEQ ID NO: 236669 - DNA, 25 bp, Mus musculus
gggctaagcggcatctcaacgtctg

SEQ ID NO: 236670 - DNA, 25 bp, Mus musculus
cggggttgacggaccacgcgctcct

SEQ ID NO: 236671 - DNA, 25 bp, Mus musculus
atgaagaaataaacgcagacccggg

SEQ ID NO: 236672 - DNA, 25 bp, Mus musculus
tgcgcgagtctttaatgaagaaata

SEQ ID NO: 236673 - DNA, 25 bp, Mus musculus
tgtctgcgcgagtctttaatgaaga

SEQ ID NO: 236674 - DNA, 25 bp, Mus musculus
ccctgtctgcgcgagtctttaatga

SEQ ID NO: 236675 - DNA, 25 bp, Mus musculus
gcctccctgtctgcgcgagtcttta

SEQ ID NO: 236676 - DNA, 25 bp, Mus musculus
agcgccgaagccactctctttgtga

SEQ ID NO: 236677 - DNA, 25 bp, Mus musculus
ttagggaagcaaagcgccgaagcca

SEQ ID NO: 236678 - DNA, 25 bp, Mus musculus
agcaaagcgccgaagccactctctt

SEQ ID NO: 236679 - DNA, 25 bp, Mus musculus
tctctttgtgaagccgagtcctccg

SEQ ID NO: 236680 - DNA, 25 bp, Mus musculus
tcccgagttagggaagcaaagcgcc

SEQ ID NO: 236681 - DNA, 25 bp, Mus musculus
accacgcgctcctggtggggcactt

SEQ ID NO: 236682 - DNA, 25 bp, Mus musculus
gaagccactctctttgtgaagccga

SEQ ID NO: 236683 - DNA, 25 bp, Mus musculus
tcctggtggggcacttcccgagtta

SEQ ID NO: 236684 - DNA, 25 bp, Mus musculus
ccaacacgcgcgtgaagttcaggtg

SEQ ID NO: 236685 - DNA, 25 bp, Mus musculus
ccctggcggcgagggcgacacgctg

SEQ ID NO: 236686 - DNA, 25 bp, Mus musculus
aacacgcgcgtgaagttcaggtgag

SEQ ID NO: 236687 - DNA, 25 bp, Mus musculus
ctgcggccaacacgcgcgtgaagtt

SEQ ID NO: 236688 - DNA, 25 bp, Mus musculus
cggcgagcaaagtccaggtctgcgc

SEQ ID NO: 236689 - DNA, 25 bp, Mus musculus
gccgcggcgagcaaagtccaggtct

SEQ ID NO: 236690 - DNA, 25 bp, Mus musculus
acgagccgcggcgagcaaagtccag

SEQ ID NO: 236691 - DNA, 25 bp, Mus musculus
agcaaagtccaggtctgcgcgccac

SEQ ID NO: 236692 - DNA, 25 bp, Mus musculus
cgacacgctggtggcgctggggcct

SEQ ID NO: 236693 - DNA, 25 bp, Mus musculus
ctgcagctggtgctgcgttgcgggc

SEQ ID NO: 236694 - DNA, 25 bp, Mus musculus
cgagcaggcttatcggctgcagctg

SEQ ID NO: 236695 - DNA, 25 bp, Mus musculus
aagggaccgagggaaggcagttgcg

SEQ ID NO: 236696 - DNA, 25 bp, Mus musculus
aaggcagttgcggtgggacctgccg

SEQ ID NO: 236697 - DNA, 25 bp, Mus musculus
cttgcgggagctctcctgcgggccc

SEQ ID NO: 236698 - DNA, 25 bp, Mus musculus
ctacttgaagttggtttcctgaatc

SEQ ID NO: 236699 - DNA, 25 bp, Mus musculus
ctcacgccggcttccggtggctgga

SEQ ID NO: 236700 - DNA, 25 bp, Mus musculus
tgtggggctctctcacgccggcttc

SEQ ID NO: 236701 - DNA, 25 bp, Mus musculus
caccagaggccggagcctcggtgtg

SEQ ID NO: 236702 - DNA, 25 bp, Mus musculus
tgcagctgtagcagagggctttggt

SEQ ID NO: 236703 - DNA, 25 bp, Mus musculus
gtttcctgaatcaccgctgcctgca

SEQ ID NO: 236704 - DNA, 25 bp, Mus musculus
tgaagttggtttcctgaatcaccgc

SEQ ID NO: 236705 - DNA, 25 bp, Mus musculus
tctatgctacttgaagttggtttcc

SEQ ID NO: 236706 - DNA, 25 bp, Mus musculus
cggatgtctatgctacttgaagttg

SEQ ID NO: 236707 - DNA, 25 bp, Mus musculus
gccggatgtctatgctacttgaagt

SEQ ID NO: 236708 - DNA, 25 bp, Mus musculus
gcgccggatgtctatgctacttgaa

SEQ ID NO: 236709 - DNA, 25 bp, Mus musculus
atgacgtcactgtgcggcgccggat

SEQ ID NO: 236710 - DNA, 25 bp, Mus musculus
gcgtatgacgtcactgtgcggcgcc

SEQ ID NO: 236711 - DNA, 25 bp, Mus musculus
gttggtttcctgaatcaccgctgcc

SEQ ID NO: 236712 - DNA, 25 bp, Mus musculus
ctttaaggacactggatgccggagc

SEQ ID NO: 236713 - DNA, 25 bp, Mus musculus
tgtaccgccagacagagcgaggcgc

SEQ ID NO: 236714 - DNA, 25 bp, Mus musculus
tcggtgcgctgtaccgccagacaga

SEQ ID NO: 236715 - DNA, 25 bp, Mus musculus
ctgagaagtcggtgcgctgtaccgc

SEQ ID NO: 236716 - DNA, 25 bp, Mus musculus
tctgtcctgggcgaccaagacgctg

SEQ ID NO: 236717 - DNA, 25 bp, Mus musculus
ggtccgctacgggagcgcacagcca

SEQ ID NO: 236718 - DNA, 25 bp, Mus musculus
atgccggagcgacactcttagagtc

SEQ ID NO: 236719 - DNA, 25 bp, Mus musculus
ctcacgttcatctttaaggacactg

SEQ ID NO: 236720 - DNA, 25 bp, Mus musculus
agatgctttccacccttctcacgtt

SEQ ID NO: 236721 - DNA, 25 bp, Mus musculus
tcctccagctgagccgagatgcttt

SEQ ID NO: 236722 - DNA, 25 bp, Mus musculus
ggacgcccgctccaaagcccatcgc

SEQ ID NO: 236723 - DNA, 25 bp, Mus musculus
ccatcgcgtcctaccgcctgtggag

SEQ ID NO: 236724 - DNA, 25 bp, Mus musculus
acactcttagagtccactgacccag

SEQ ID NO: 236725 - DNA, 25 bp, Mus musculus
cagctgagccgagatgctttccacc

SEQ ID NO: 236726 - DNA, 25 bp, Mus musculus
ccggagcacagcaaaagcagggatg

SEQ ID NO: 236727 - DNA, 25 bp, Mus musculus
gactagtctaactccagcagccctg

SEQ ID NO: 236728 - DNA, 25 bp, Mus musculus
cggaagaaagttctagactagtcta

SEQ ID NO: 236729 - DNA, 25 bp, Mus musculus
ctcctggacccagcggaagaaagtt

SEQ ID NO: 236730 - DNA, 25 bp, Mus musculus
aggtcctggccggaactccgctgct

SEQ ID NO: 236731 - DNA, 25 bp, Mus musculus
gacgacatgctcctttgtccgcggc

SEQ ID NO: 236732 - DNA, 25 bp, Mus musculus
gatcggtcccgcttcgcgacgacat

SEQ ID NO: 236733 - DNA, 25 bp, Mus musculus
cacagcagagcgagcagcgccagcg

SEQ ID NO: 236734 - DNA, 25 bp, Mus musculus
tactcacagggtgaccgtgcggttg

SEQ ID NO: 236735 - DNA, 25 bp, Mus musculus
cgtcgtgggttactcacagggtgac

SEQ ID NO: 236736 - DNA, 25 bp, Mus musculus
caaaggagcgtgtatacccgggaga

SEQ ID NO: 236737 - DNA, 25 bp, Mus musculus
cgcgcacacaaaggagcgtgtatac

SEQ ID NO: 236738 - DNA, 25 bp, Mus musculus
tggtcccacactaagccacagggct

SEQ ID NO: 236739 - DNA, 25 bp, Mus musculus
tttctttgcaaaactagcagagggg

SEQ ID NO: 236740 - DNA, 25 bp, Mus musculus
ccagggctactgaagagcggcaaca

SEQ ID NO: 236741 - DNA, 25 bp, Mus musculus
catcgctccggaggttgtagccgcc

SEQ ID NO: 236742 - DNA, 25 bp, Mus musculus
tgcactaatagcactgccggtctcc

SEQ ID NO: 236743 - DNA, 25 bp, Mus musculus
agagcccactttggacttggggtga

SEQ ID NO: 236744 - DNA, 25 bp, Mus musculus
agccgccggctgacagtctgtccag

SEQ ID NO: 236745 - DNA, 25 bp, Mus musculus
tcctttggcaaacaggcacgcgcgg

SEQ ID NO: 236746 - DNA, 25 bp, Mus musculus
ctgagaaagtttccagtggggtctc

SEQ ID NO: 236747 - DNA, 25 bp, Mus musculus
gcaggaccgtatcccggcaggcaac

SEQ ID NO: 236748 - DNA, 25 bp, Mus musculus
cttggggtgaagttttccagccgcg

SEQ ID NO: 236749 - DNA, 25 bp, Mus musculus
tcccgcgacatctgggtcagcacag

SEQ ID NO: 236750 - DNA, 25 bp, Mus musculus
tgccggtctcccgagcggtcggaaa

SEQ ID NO: 236751 - DNA, 25 bp, Mus musculus
agcacgcgtacagccgggtggctct

SEQ ID NO: 236752 - DNA, 25 bp, Mus musculus
agccagcgaaccaggcaccgtactg

SEQ ID NO: 236753 - DNA, 25 bp, Mus musculus
ctcaggtgagcgagcgcaccgacct

SEQ ID NO: 236754 - DNA, 25 bp, Mus musculus
gaaagacgaggcagcggtgagctcc

SEQ ID NO: 236755 - DNA, 25 bp, Mus musculus
tgaaccgctccagcagcgggaaaga

SEQ ID NO: 236756 - DNA, 25 bp, Mus musculus
agccgtcgctggtgaaccgctccag

SEQ ID NO: 236757 - DNA, 25 bp, Mus musculus
acgtgaaagccgtcgctggtgaacc

SEQ ID NO: 236758 - DNA, 25 bp, Mus musculus
actgtccacgtgaaagccgtcgctg

SEQ ID NO: 236759 - DNA, 25 bp, Mus musculus
gtcagcacgtcatcactgtccacgt

SEQ ID NO: 236760 - DNA, 25 bp, Mus musculus
ggcttgtctccgtgaccgtcagcac

SEQ ID NO: 236761 - DNA, 25 bp, Mus musculus
aaagttgaggccgtggcttgtctcc

SEQ ID NO: 236762 - DNA, 25 bp, Mus musculus
tattcaaagttgaggccgtggcttg

SEQ ID NO: 236763 - DNA, 25 bp, Mus musculus
ccagcctcccacttgtattcaaagt

SEQ ID NO: 236764 - DNA, 25 bp, Mus musculus
cgtgaccgtcagcacgtcatcactg

SEQ ID NO: 236765 - DNA, 25 bp, Mus musculus
gtcaggcgcgcacaactcctgcagg

SEQ ID NO: 236766 - DNA, 25 bp, Mus musculus
cggtgaactgtcaggcgcgcacaac

SEQ ID NO: 236767 - DNA, 25 bp, Mus musculus
agcctgggcttgatgcagcccccga

SEQ ID NO: 236768 - DNA, 25 bp, Mus musculus
ccctgcttttgcctggagttgtccg

SEQ ID NO: 236769 - DNA, 25 bp, Mus musculus
ggactgagcagttcccttcggcacc

SEQ ID NO: 236770 - DNA, 25 bp, Mus musculus
cagatgcctgtagactttcaccaaa

SEQ ID NO: 236771 - DNA, 25 bp, Mus musculus
ggggcagcagactacaacagttatt

SEQ ID NO: 236772 - DNA, 25 bp, Mus musculus
tctggctcctggaatagctttggca

SEQ ID NO: 236773 - DNA, 25 bp, Mus musculus
tccagaacctgagcacaagcctgtc

SEQ ID NO: 236774 - DNA, 25 bp, Mus musculus
tctctctccaggtaatcagtggccg

SEQ ID NO: 236775 - DNA, 25 bp, Mus musculus
ctgcctctttctcgggttccctttg

SEQ ID NO: 236776 - DNA, 25 bp, Mus musculus
tggccggaggacacagatctctttc

SEQ ID NO: 236777 - DNA, 25 bp, Mus musculus
tacacacctacaggccggcagcggg

SEQ ID NO: 236778 - DNA, 25 bp, Mus musculus
tgcagccggactgcattgcacagtc

SEQ ID NO: 236779 - DNA, 25 bp, Mus musculus
tcaggggacgcatctacttgaggtt

SEQ ID NO: 236780 - DNA, 25 bp, Mus musculus
cttgaggttgcagccattttaggga

SEQ ID NO: 236781 - DNA, 25 bp, Mus musculus
gtccaccgagttggtgccgctttca

SEQ ID NO: 236782 - DNA, 25 bp, Mus musculus
gcttcttgccggaggggtaatcctc

SEQ ID NO: 236783 - DNA, 25 bp, Mus musculus
ccaggtccaaccgatgcctcttgga

SEQ ID NO: 236784 - DNA, 25 bp, Mus musculus
gatgcctcttggacatcctcgcact

SEQ ID NO: 236785 - DNA, 25 bp, Mus musculus
tcgcactcccagaagcggacgctta

SEQ ID NO: 236786 - DNA, 25 bp, Mus musculus
aagaagagagactccggcagccgga

SEQ ID NO: 236787 - DNA, 25 bp, Mus musculus
gcagccggatccacgcacaagaggc

SEQ ID NO: 236788 - DNA, 25 bp, Mus musculus
ggcccgaaccaggagctaaaatggc

SEQ ID NO: 236789 - DNA, 25 bp, Mus musculus
gcccgctgtgcgattggctgaaatg

SEQ ID NO: 236790 - DNA, 25 bp, Mus musculus
cgattggctgaaatggctctgagtt

SEQ ID NO: 236791 - DNA, 25 bp, Mus musculus
cgtctctctgagagctgatctgagc

SEQ ID NO: 236792 - DNA, 25 bp, Mus musculus
tgagctgctgctaaggaccgaaacg

SEQ ID NO: 236793 - DNA, 25 bp, Mus musculus
cgaaacgcgcctcaagctgtcactt

SEQ ID NO: 236794 - DNA, 25 bp, Mus musculus
aagctgtcacttgccgcctggagtt

SEQ ID NO: 236795 - DNA, 25 bp, Mus musculus
ccagccggccgacggcagacaaagg

SEQ ID NO: 236796 - DNA, 25 bp, Mus musculus
tacaacccgatggaggtgccgcacc

SEQ ID NO: 236797 - DNA, 25 bp, Mus musculus
tagatgttctcccatgtcccggaca

SEQ ID NO: 236798 - DNA, 25 bp, Mus musculus
atgcacgccagacacctctgtatgg

SEQ ID NO: 236799 - DNA, 25 bp, Mus musculus
gcgtcctagacagaggcctcccaga

SEQ ID NO: 236800 - DNA, 25 bp, Mus musculus
cccagaggcctctaggcgtcctaga

SEQ ID NO: 236801 - DNA, 25 bp, Mus musculus
gccgctgcacgcatagatgtctcca

SEQ ID NO: 236802 - DNA, 25 bp, Mus musculus
ttaagcctcactcagggcctccgag

SEQ ID NO: 236803 - DNA, 25 bp, Mus musculus
gcgagtgcaagaccacttaagcctc

SEQ ID NO: 236804 - DNA, 25 bp, Mus musculus
ggccagcctgcagaacggcaatgca

SEQ ID NO: 236805 - DNA, 25 bp, Mus musculus
cagcacccgggcgactttggcaact

SEQ ID NO: 236806 - DNA, 25 bp, Mus musculus
tgccatccacgtgcatgagttcggg

SEQ ID NO: 236807 - DNA, 25 bp, Mus musculus
caacggccagctctggaggcatcgc

SEQ ID NO: 236808 - DNA, 25 bp, Mus musculus
tttggcaacttcgtggtgcgcaacg

SEQ ID NO: 236809 - DNA, 25 bp, Mus musculus
cgccgcctgggagagccagacaaag

SEQ ID NO: 236810 - DNA, 25 bp, Mus musculus
cccaaagcctggcaccagatggtgc

SEQ ID NO: 236811 - DNA, 25 bp, Mus musculus
tgcctccacgtcagcctccgcggag

SEQ ID NO: 236812 - DNA, 25 bp, Mus musculus
cgcgccgctgcctccacgtcagcct

SEQ ID NO: 236813 - DNA, 25 bp, Mus musculus
agagggccaggaacctccgagcctc

SEQ ID NO: 236814 - DNA, 25 bp, Mus musculus
cgggctgcacaaccgcctcccttct

SEQ ID NO: 236815 - DNA, 25 bp, Mus musculus
tctcggtccgatcgccgtccatgtc

SEQ ID NO: 236816 - DNA, 25 bp, Mus musculus
tgccagtcgctctcggtccgatcgc

SEQ ID NO: 236817 - DNA, 25 bp, Mus musculus
cccggcctcacctcgctcaccagcc

SEQ ID NO: 236818 - DNA, 25 bp, Mus musculus
agcggctcaggaggccgatccggag

SEQ ID NO: 236819 - DNA, 25 bp, Mus musculus
cttggggacctgctgcagcggctca

SEQ ID NO: 236820 - DNA, 25 bp, Mus musculus
ggccacctgctacccgggctcacag

SEQ ID NO: 236821 - DNA, 25 bp, Mus musculus
cacctgcaggtcctgccgcggccac

SEQ ID NO: 236822 - DNA, 25 bp, Mus musculus
ctgccctacagtggctcggggccgg

SEQ ID NO: 236823 - DNA, 25 bp, Mus musculus
aacgtgaggggtggaccgtgcacct

SEQ ID NO: 236824 - DNA, 25 bp, Mus musculus
gcctggcaggctccgggacgcaatc

SEQ ID NO: 236825 - DNA, 25 bp, Mus musculus
gatccgcctctagctcggctggctg

SEQ ID NO: 236826 - DNA, 25 bp, Mus musculus
tctagctcggctggctgccaatcag

SEQ ID NO: 236827 - DNA, 25 bp, Mus musculus
ggctgccaatcagccgggcaacagg

SEQ ID NO: 236828 - DNA, 25 bp, Mus musculus
ggaaggaagttccacttcccgctga

SEQ ID NO: 236829 - DNA, 25 bp, Mus musculus
aaccgcgcagaggtgcttggagcca

SEQ ID NO: 236830 - DNA, 25 bp, Mus musculus
cactgagtggggctgatgaccgcct

SEQ ID NO: 236831 - DNA, 25 bp, Mus musculus
tctgtcaccactgtagcgagtagca

SEQ ID NO: 236832 - DNA, 25 bp, Mus musculus
ccactgtagcgagtagcacgtactg

SEQ ID NO: 236833 - DNA, 25 bp, Mus musculus
agtagcacgtactggggcgatgatt

SEQ ID NO: 236834 - DNA, 25 bp, Mus musculus
acgtactggggcgatgattgtgctt

SEQ ID NO: 236835 - DNA, 25 bp, Mus musculus
cgatgattgtgctttgggacgtatg

SEQ ID NO: 236836 - DNA, 25 bp, Mus musculus
ctttgggacgtatgcacggagcgct

SEQ ID NO: 236837 - DNA, 25 bp, Mus musculus
ggctccgggacgcaatctgtcacca

SEQ ID NO: 236838 - DNA, 25 bp, Mus musculus
cacgatcctaggcacccaagaggag

SEQ ID NO: 236839 - DNA, 25 bp, Mus musculus
ctcacccgcgctggcctgacatcag

SEQ ID NO: 236840 - DNA, 25 bp, Mus musculus
agccgcagccgagcagcatgctggc

SEQ ID NO: 236841 - DNA, 25 bp, Mus musculus
tctccatagcgccatgccgggtccc

SEQ ID NO: 236842 - DNA, 25 bp, Mus musculus
aaccgcctcacctgcgcgctcggcg

SEQ ID NO: 236843 - DNA, 25 bp, Mus musculus
ctccttggtacagctgcaagtggcg

SEQ ID NO: 236844 - DNA, 25 bp, Mus musculus
gatggactccttggtacagctgcaa

SEQ ID NO: 236845 - DNA, 25 bp, Mus musculus
cgcagatgatggactccttggtaca

SEQ ID NO: 236846 - DNA, 25 bp, Mus musculus
ctgacatcagcacccgcgcctgccg

SEQ ID NO: 236847 - DNA, 25 bp, Mus musculus
ccaagaggagcccacgcagatgatg

SEQ ID NO: 236848 - DNA, 25 bp, Mus musculus
aggcacgatcctaggcacccaagag

SEQ ID NO: 236849 - DNA, 25 bp, Mus musculus
cccactcacagggagctgatgtcgc

SEQ ID NO: 236850 - DNA, 25 bp, Mus musculus
gctgatgtcgccaggcacgatccta

SEQ ID NO: 236851 - DNA, 25 bp, Mus musculus
gcccacgcagatgatggactccttg

SEQ ID NO: 236852 - DNA, 25 bp, Mus musculus
gggtggcagtcattaaccggctgtc

SEQ ID NO: 236853 - DNA, 25 bp, Mus musculus
cgaggcgacaactttgagcatggcg

SEQ ID NO: 236854 - DNA, 25 bp, Mus musculus
cgacaactttgagcatggcgcagct

SEQ ID NO: 236855 - DNA, 25 bp, Mus musculus
gctgctcctggcgtgccaaagccgg

SEQ ID NO: 236856 - DNA, 25 bp, Mus musculus
atagcgcgctatagatagcagcctc

SEQ ID NO: 236857 - DNA, 25 bp, Mus musculus
ctcggctgatgcagctaaaaatagc

SEQ ID NO: 236858 - DNA, 25 bp, Mus musculus
tcctcggctgatgcagctaaaaata

SEQ ID NO: 236859 - DNA, 25 bp, Mus musculus
caggttcctcggctgatgcagctaa

SEQ ID NO: 236860 - DNA, 25 bp, Mus musculus
gctgtcaggttcctcggctgatgca

SEQ ID NO: 236861 - DNA, 25 bp, Mus musculus
ttaaccggctgtcaggttcctcggc

SEQ ID NO: 236862 - DNA, 25 bp, Mus musculus
tcattaaccggctgtcaggttcctc

SEQ ID NO: 236863 - DNA, 25 bp, Mus musculus
ggcagtcattaaccggctgtcaggt

SEQ ID NO: 236864 - DNA, 25 bp, Mus musculus
agcgcgctatagatagcagcctccc

SEQ ID NO: 236865 - DNA, 25 bp, Mus musculus
ggctgatgcagctaaaaatagcgcg

SEQ ID NO: 236866 - DNA, 25 bp, Mus musculus
ctacgtccgtctgcgacgttcaggc

SEQ ID NO: 236867 - DNA, 25 bp, Mus musculus
tccggctccacgcaggggagcaagc

SEQ ID NO: 236868 - DNA, 25 bp, Mus musculus
agcaagctcacccacgcggccaccg

SEQ ID NO: 236869 - DNA, 25 bp, Mus musculus
caggggagcaagctcacccacgcgg

SEQ ID NO: 236870 - DNA, 25 bp, Mus musculus
cggctccacgcaggggagcaagctc

SEQ ID NO: 236871 - DNA, 25 bp, Mus musculus
ccggctccacgcaggggagcaagct

SEQ ID NO: 236872 - DNA, 25 bp, Mus musculus
gacgttcaggcttctccggctccac

SEQ ID NO: 236873 - DNA, 25 bp, Mus musculus
ctgcgacgttcaggcttctccggct

SEQ ID NO: 236874 - DNA, 25 bp, Mus musculus
acgtccgtctgcgacgttcaggctt

SEQ ID NO: 236875 - DNA, 25 bp, Mus musculus
tctacgtccgtctgcgacgttcagg

SEQ ID NO: 236876 - DNA, 25 bp, Mus musculus
tcatctacgtccgtctgcgacgttc

SEQ ID NO: 236877 - DNA, 25 bp, Mus musculus
caagctcacccacgcggccaccgct

SEQ ID NO: 236878 - DNA, 25 bp, Mus musculus
catcatctacgtccgtctgcgacgt

SEQ ID NO: 236879 - DNA, 25 bp, Mus musculus
catctacgtccgtctgcgacgttca

SEQ ID NO: 236880 - DNA, 25 bp, Mus musculus
gctccgcacacaccaaggcgccgcg

SEQ ID NO: 236881 - DNA, 25 bp, Mus musculus
accgaggcccaggatgcaacgcgct

SEQ ID NO: 236882 - DNA, 25 bp, Mus musculus
gcccttggactttgacagctccgca

SEQ ID NO: 236883 - DNA, 25 bp, Mus musculus
gccgagtacctgctctagaagcagc

SEQ ID NO: 236884 - DNA, 25 bp, Mus musculus
ggcgcccactgaacacacaccgagg

SEQ ID NO: 236885 - DNA, 25 bp, Mus musculus
cggcggaccaagcccttggactttg

SEQ ID NO: 236886 - DNA, 25 bp, Mus musculus
tggactttgacagctccgcacacac

SEQ ID NO: 236887 - DNA, 25 bp, Mus musculus
ccgagcgccgagtacctgctctaga

SEQ ID NO: 236888 - DNA, 25 bp, Mus musculus
agccctgcctcacgtaagccggaga

SEQ ID NO: 236889 - DNA, 25 bp, Mus musculus
aagctctccgggttcatgacggcgc

SEQ ID NO: 236890 - DNA, 25 bp, Mus musculus
ccgggttcatgacggcgcccactga

SEQ ID NO: 236891 - DNA, 25 bp, Mus musculus
atgcaacgcgctgcccggacggtac

SEQ ID NO: 236892 - DNA, 25 bp, Mus musculus
taagacgccgccttcgacttccgcg

SEQ ID NO: 236893 - DNA, 25 bp, Mus musculus
gtctaccggccgcatgcgatctatc

SEQ ID NO: 236894 - DNA, 25 bp, Mus musculus
aggtgcgacccatgcgcgcgcgcaa

SEQ ID NO: 236895 - DNA, 25 bp, Mus musculus
gcgagcttgtccaccgagctggatc

SEQ ID NO: 236896 - DNA, 25 bp, Mus musculus
actacgagctcaggtgcgacccatg

SEQ ID NO: 236897 - DNA, 25 bp, Mus musculus
atcggacccgcactacgagctcagg

SEQ ID NO: 236898 - DNA, 25 bp, Mus musculus
accgagctggatcggacccgcacta

SEQ ID NO: 236899 - DNA, 25 bp, Mus musculus
cttgtccaccgagctggatcggacc

SEQ ID NO: 236900 - DNA, 25 bp, Mus musculus
gatctccgcgagcttgtccaccgag

SEQ ID NO: 236901 - DNA, 25 bp, Mus musculus
aagggtcgatctccgcgagcttgtc

SEQ ID NO: 236902 - DNA, 25 bp, Mus musculus
tccgcgagcccgctaccgacgagcc

SEQ ID NO: 236903 - DNA, 25 bp, Mus musculus
acgagggcgcggatgtcctccgcga

SEQ ID NO: 236904 - DNA, 25 bp, Mus musculus
tgctgcctcgcgttgcctgggccca

SEQ ID NO: 236905 - DNA, 25 bp, Mus musculus
cgcaggcgtaaggaaggcgtcccgg

SEQ ID NO: 236906 - DNA, 25 bp, Mus musculus
gcgccgtgagaatgcaggcggacga

SEQ ID NO: 236907 - DNA, 25 bp, Mus musculus
ccgggacatcatggcggaggcctgc

SEQ ID NO: 236908 - DNA, 25 bp, Mus musculus
gcctgggccggcgttccggcatcat

SEQ ID NO: 236909 - DNA, 25 bp, Mus musculus
actcacccgggtcgaagtgggagct

SEQ ID NO: 236910 - DNA, 25 bp, Mus musculus
ctgaaggcaaagctggggttgaaga

SEQ ID NO: 236911 - DNA, 25 bp, Mus musculus
aaggacgacgacatggccagggcca

SEQ ID NO: 236912 - DNA, 25 bp, Mus musculus
cgcgcggactcacccgggtcgaagt

SEQ ID NO: 236913 - DNA, 25 bp, Mus musculus
cttaagctcagaacgccggcggcct

SEQ ID NO: 236914 - DNA, 25 bp, Mus musculus
gttgaagaaggacgacgacatggcc

SEQ ID NO: 236915 - DNA, 25 bp, Mus musculus
gcgttccggcatcatcgtccagcgg

SEQ ID NO: 236916 - DNA, 25 bp, Mus musculus
ggcggcgacagactaggcgcctccg

SEQ ID NO: 236917 - DNA, 25 bp, Mus musculus
tctggctggtgcagtccgaaaacac

SEQ ID NO: 236918 - DNA, 25 bp, Mus musculus
tggtgcagtccgaaaacacgcggga

SEQ ID NO: 236919 - DNA, 25 bp, Mus musculus
agtccgaaaacacgcgggagcgcgc

SEQ ID NO: 236920 - DNA, 25 bp, Mus musculus
gctgcgcttaagctcagaacgccgg

SEQ ID NO: 236921 - DNA, 25 bp, Mus musculus
cgggcgctgcgcttaagctcagaac

SEQ ID NO: 236922 - DNA, 25 bp, Mus musculus
gcgctcagccttgccggcggcgcca

SEQ ID NO: 236923 - DNA, 25 bp, Mus musculus
tttctccgcctccttggttgggaca

SEQ ID NO: 236924 - DNA, 25 bp, Mus musculus
tccgcctccttggttgggacagagg

SEQ ID NO: 236925 - DNA, 25 bp, Mus musculus
gcctccttggttgggacagaggctt

SEQ ID NO: 236926 - DNA, 25 bp, Mus musculus
gacagaggctttcgggacttcggca

SEQ ID NO: 236927 - DNA, 25 bp, Mus musculus
gaggctttcgggacttcggcagaaa

SEQ ID NO: 236928 - DNA, 25 bp, Mus musculus
ctttcgggacttcggcagaaagatg

SEQ ID NO: 236929 - DNA, 25 bp, Mus musculus
cggcgcccatggactgtcttgagtc

SEQ ID NO: 236930 - DNA, 25 bp, Mus musculus
gcccatggactgtcttgagtccctg

SEQ ID NO: 236931 - DNA, 25 bp, Mus musculus
actgtcttgagtccctggagggtga

SEQ ID NO: 236932 - DNA, 25 bp, Mus musculus
tagaggtggcgcttccctcgaaccc

SEQ ID NO: 236933 - DNA, 25 bp, Mus musculus
gcgccaatggcgaggcttgggctag

SEQ ID NO: 236934 - DNA, 25 bp, Mus musculus
ccgcggcggcgctctttctccgcct

SEQ ID NO: 236935 - DNA, 25 bp, Mus musculus
ggctaggtgctctgcgggtttttcg

SEQ ID NO: 236936 - DNA, 25 bp, Mus musculus
gcgcggctgctgtgccactcacttc

SEQ ID NO: 236937 - DNA, 25 bp, Mus musculus
gttgcagggccgcacccatgctgcg

SEQ ID NO: 236938 - DNA, 25 bp, Mus musculus
ttctcgcgcacgtcgttgcagggcc

SEQ ID NO: 236939 - DNA, 25 bp, Mus musculus
ccagagctttgtggccgggtgctcc

SEQ ID NO: 236940 - DNA, 25 bp, Mus musculus
ccgctgctggcagggctttgtgcca

SEQ ID NO: 236941 - DNA, 25 bp, Mus musculus
caggtaccgctgctggcagggcttt

SEQ ID NO: 236942 - DNA, 25 bp, Mus musculus
gagtctgcgactctggcaggtaccg

SEQ ID NO: 236943 - DNA, 25 bp, Mus musculus
gccgagtctgcgactctggcaggta

SEQ ID NO: 236944 - DNA, 25 bp, Mus musculus
aggagtaggccgagtctgcgactct

SEQ ID NO: 236945 - DNA, 25 bp, Mus musculus
ccggaagctttctccgagcgcggag

SEQ ID NO: 236946 - DNA, 25 bp, Mus musculus
tcggcgccggaagctttctccgagc

SEQ ID NO: 236947 - DNA, 25 bp, Mus musculus
tctcgcgaagacgtcccggcgtcgg

SEQ ID NO: 236948 - DNA, 25 bp, Mus musculus
ggccgcacccatgctgcgctttccg

SEQ ID NO: 236949 - DNA, 25 bp, Mus musculus
gtgccactcacttcctctcgcgaag

SEQ ID NO: 236950 - DNA, 25 bp, Mus musculus
gatgggctcactaagccggcaggta

SEQ ID NO: 236951 - DNA, 25 bp, Mus musculus
ccgcgatgggctcactaagccggca

SEQ ID NO: 236952 - DNA, 25 bp, Mus musculus
tgagtacaccggtcggccgctaccg

SEQ ID NO: 236953 - DNA, 25 bp, Mus musculus
actaagccggcaggtaggcagtgcc

SEQ ID NO: 236954 - DNA, 25 bp, Mus musculus
ctctttgcgcaacaccttcgctgta

SEQ ID NO: 236955 - DNA, 25 bp, Mus musculus
gcgcaacaccttcgctgtatatata

SEQ ID NO: 236956 - DNA, 25 bp, Mus musculus
ttcgctgtatatataccgggcgctc

SEQ ID NO: 236957 - DNA, 25 bp, Mus musculus
agctgcgctccacctgggtgcctcc

SEQ ID NO: 236958 - DNA, 25 bp, Mus musculus
ttcggccgttcctactgcgggcctg

SEQ ID NO: 236959 - DNA, 25 bp, Mus musculus
tgtcccttacctgcgaagggagcgc

SEQ ID NO: 236960 - DNA, 25 bp, Mus musculus
ccttacctgcgaagggagcgctggt

SEQ ID NO: 236961 - DNA, 25 bp, Mus musculus
ctggtgagtacaccggtcggccgct

SEQ ID NO: 236962 - DNA, 25 bp, Mus musculus
atataccgggcgctcagctgcgctc

SEQ ID NO: 236963 - DNA, 25 bp, Mus musculus
cctactgcgggcctggtctgaggtt

SEQ ID NO: 236964 - DNA, 25 bp, Mus musculus
tccggtccacgcacccgggtactca

SEQ ID NO: 236965 - DNA, 25 bp, Mus musculus
cctcctggccgtaggcgcccacaca

SEQ ID NO: 236966 - DNA, 25 bp, Mus musculus
gatcccggccggaacaggtcacctg

SEQ ID NO: 236967 - DNA, 25 bp, Mus musculus
gcagagaaagagcaatgcgctggta

SEQ ID NO: 236968 - DNA, 25 bp, Mus musculus
ccggcgctcaccaggtagcagagaa

SEQ ID NO: 236969 - DNA, 25 bp, Mus musculus
gaccctaatagggtccggcgctcac

SEQ ID NO: 236970 - DNA, 25 bp, Mus musculus
cacctcctgcggttggggtcccagg

SEQ ID NO: 236971 - DNA, 25 bp, Mus musculus
aaagagacaaactcgcggcgacgtc

SEQ ID NO: 236972 - DNA, 25 bp, Mus musculus
cccgggtactcatcccaagggctgg

SEQ ID NO: 236973 - DNA, 25 bp, Mus musculus
gagagtagcccgcaagtccggtcca

SEQ ID NO: 236974 - DNA, 25 bp, Mus musculus
cacacaggtggggacctcgtggtcc

SEQ ID NO: 236975 - DNA, 25 bp, Mus musculus
cgcccacacaggtggggacctcgtg

SEQ ID NO: 236976 - DNA, 25 bp, Mus musculus
acgcagtggcaaggaaaagagacaa

SEQ ID NO: 236977 - DNA, 25 bp, Mus musculus
gaacaggtcacctggtgcagggacc

SEQ ID NO: 236978 - DNA, 25 bp, Mus musculus
tcgcgaccttgaggccgggaatcga

SEQ ID NO: 236979 - DNA, 25 bp, Mus musculus
ccgcctccgagctcagaggctcctc

SEQ ID NO: 236980 - DNA, 25 bp, Mus musculus
actccgatcccggaagcgagctctg

SEQ ID NO: 236981 - DNA, 25 bp, Mus musculus
tgctccgcctcttccgagctgggtc

SEQ ID NO: 236982 - DNA, 25 bp, Mus musculus
cttgaggccgggaatcgagtttcca

SEQ ID NO: 236983 - DNA, 25 bp, Mus musculus
ggaacctgcgcaccgcgctcatatt

SEQ ID NO: 236984 - DNA, 25 bp, Mus musculus
tgcgcaccgcgctcatattcggagg

SEQ ID NO: 236985 - DNA, 25 bp, Mus musculus
cgcgctcatattcggaggcttcatc

SEQ ID NO: 236986 - DNA, 25 bp, Mus musculus
gaggcttcatctccatggtcggcgc

SEQ ID NO: 236987 - DNA, 25 bp, Mus musculus
gcgccgccttctatcccatctactt

SEQ ID NO: 236988 - DNA, 25 bp, Mus musculus
cccttatgcggctggaggaataccg

SEQ ID NO: 236989 - DNA, 25 bp, Mus musculus
tggaggaataccgtgagtgacctct

SEQ ID NO: 236990 - DNA, 25 bp, Mus musculus
ttatgccgcgcccttcctcggatga

SEQ ID NO: 236991 - DNA, 25 bp, Mus musculus
cgggaatcgagtttccaaacgtgcg

SEQ ID NO: 236992 - DNA, 25 bp, Mus musculus
ctcgcgaggcttaggaaatttccca

SEQ ID NO: 236993 - DNA, 25 bp, Mus musculus
ttggaaaacacccactcgaggaggc

SEQ ID NO: 236994 - DNA, 25 bp, Mus musculus
cgagcgggaagccacttggaaaaca

SEQ ID NO: 236995 - DNA, 25 bp, Mus musculus
tgtccagtgaacgtcggaatgaatg

SEQ ID NO: 236996 - DNA, 25 bp, Mus musculus
tccggcacctgatactgagattagc

SEQ ID NO: 236997 - DNA, 25 bp, Mus musculus
ctgacgtgtgggtgcaaagtgaaca

SEQ ID NO: 236998 - DNA, 25 bp, Mus musculus
tctggggacaaccattcggggctct

SEQ ID NO: 236999 - DNA, 25 bp, Mus musculus
cggaggagctgtttctaggcagtta

SEQ ID NO: 237000 - DNA, 25 bp, Mus musculus
caggcaagacaagcatcgggcgaca

SEQ ID NO: 237001 - DNA, 25 bp, Mus musculus
acctgccgagaggtgtcccaggcaa

SEQ ID NO: 237002 - DNA, 25 bp, Mus musculus
caggcaatgcaggagctgggaaatc

SEQ ID NO: 237003 - DNA, 25 bp, Mus musculus
ctgatccagttctccgggttttttg

SEQ ID NO: 237004 - DNA, 25 bp, Mus musculus
aggcgtctcctctaggcctgtgaga

SEQ ID NO: 237005 - DNA, 25 bp, Mus musculus
acggcccgtgttgtgtctgagccga

SEQ ID NO: 237006 - DNA, 25 bp, Mus musculus
ttaggctctctgtgggagccgctgc

SEQ ID NO: 237007 - DNA, 25 bp, Mus musculus
cgcgtcgcctgtcctcccagccgct

SEQ ID NO: 237008 - DNA, 25 bp, Mus musculus
tgcacctccactccgcccgctgtcc

SEQ ID NO: 237009 - DNA, 25 bp, Mus musculus
cgtggcccgcgtcgcctgtcctccc

SEQ ID NO: 237010 - DNA, 25 bp, Mus musculus
ccgcatcccgtctgcacctccactc

SEQ ID NO: 237011 - DNA, 25 bp, Mus musculus
ccggagcgctttgtctgtgtgcgct

SEQ ID NO: 237012 - DNA, 25 bp, Mus musculus
agcgctttgtctgtgtgcgctgccc

SEQ ID NO: 237013 - DNA, 25 bp, Mus musculus
cagccctttgtttcgccgccttagg

SEQ ID NO: 237014 - DNA, 25 bp, Mus musculus
gtttcgccgccttaggctctctgtg

SEQ ID NO: 237015 - DNA, 25 bp, Mus musculus
ttcgccgccttaggctctctgtggg

SEQ ID NO: 237016 - DNA, 25 bp, Mus musculus
gccgccttaggctctctgtgggagc

SEQ ID NO: 237017 - DNA, 25 bp, Mus musculus
ccttaggctctctgtgggagccgct

SEQ ID NO: 237018 - DNA, 25 bp, Mus musculus
agctttgttccccgtgcgtggcccg

SEQ ID NO: 237019 - DNA, 25 bp, Mus musculus
ttgtttcgccgccttaggctctctg

SEQ ID NO: 237020 - DNA, 25 bp, Mus musculus
ttccgccctcggaacgcatgtgcga

SEQ ID NO: 237021 - DNA, 25 bp, Mus musculus
agtgggaccctgcagcgcattcttt

SEQ ID NO: 237022 - DNA, 25 bp, Mus musculus
aaaaggtccgggagaagtgtcagcg

SEQ ID NO: 237023 - DNA, 25 bp, Mus musculus
gcccgctggaggagtcccgccgaaa

SEQ ID NO: 237024 - DNA, 25 bp, Mus musculus
gcacggcccagcagttgcctggcaa

SEQ ID NO: 237025 - DNA, 25 bp, Mus musculus
cagagagggacggacgcacggccca

SEQ ID NO: 237026 - DNA, 25 bp, Mus musculus
tctttcagatgcggaggggaccaga

SEQ ID NO: 237027 - DNA, 25 bp, Mus musculus
atgtgcgaggtctttcagatgcgga

SEQ ID NO: 237028 - DNA, 25 bp, Mus musculus
tctttccgccctcggaacgcatgtg

SEQ ID NO: 237029 - DNA, 25 bp, Mus musculus
ctcggaacgcatgtgcgaggtcttt

SEQ ID NO: 237030 - DNA, 25 bp, Mus musculus
tgcagcgcattctttccttgccggc

SEQ ID NO: 237031 - DNA, 25 bp, Mus musculus
gcattctttccttgccggcggccgt

SEQ ID NO: 237032 - DNA, 25 bp, Mus musculus
aacgcatgtgcgaggtctttcagat

SEQ ID NO: 237033 - DNA, 25 bp, Mus musculus
gaccctgcagcgcattctttccttg

SEQ ID NO: 237034 - DNA, 25 bp, Mus musculus
gaggcccacggctcagcctgctttt

SEQ ID NO: 237035 - DNA, 25 bp, Mus musculus
agctcggcttcctgctactgcaata

SEQ ID NO: 237036 - DNA, 25 bp, Mus musculus
gcacagccctgtggctgcgtaagga

SEQ ID NO: 237037 - DNA, 25 bp, Mus musculus
actctcgggcacagccctgtggctg

SEQ ID NO: 237038 - DNA, 25 bp, Mus musculus
gtccagagatctacccactctcggg

SEQ ID NO: 237039 - DNA, 25 bp, Mus musculus
ctgcgggagattggcctccgtccag

SEQ ID NO: 237040 - DNA, 25 bp, Mus musculus
agcttccttccggatgctgcgggag

SEQ ID NO: 237041 - DNA, 25 bp, Mus musculus
ttctcgggctctggtggcgtcctag

SEQ ID NO: 237042 - DNA, 25 bp, Mus musculus
gctgtcgaggcttgctggtcccgcc

SEQ ID NO: 237043 - DNA, 25 bp, Mus musculus
tcctgaggccggaccagaacggaaa

SEQ ID NO: 237044 - DNA, 25 bp, Mus musculus
gcctgcaggctctgggctgtcctga

SEQ ID NO: 237045 - DNA, 25 bp, Mus musculus
ttgtccctctgcgtcggcctgcagg

SEQ ID NO: 237046 - DNA, 25 bp, Mus musculus
ttcctgctactgcaatacccttcga

SEQ ID NO: 237047 - DNA, 25 bp, Mus musculus
cgggaacgcagcagaaagtcagata

SEQ ID NO: 237048 - DNA, 25 bp, Mus musculus
ctgctacggggaggctcctgagctc

SEQ ID NO: 237049 - DNA, 25 bp, Mus musculus
cctgggtgatactttcatcccgcct

SEQ ID NO: 237050 - DNA, 25 bp, Mus musculus
ggtgatactttcatcccgcctcacg

SEQ ID NO: 237051 - DNA, 25 bp, Mus musculus
tttcatcccgcctcacgcccacagc

SEQ ID NO: 237052 - DNA, 25 bp, Mus musculus
acgcccacagcgctccctcctagag

SEQ ID NO: 237053 - DNA, 25 bp, Mus musculus
ctccctcctagagctactgcgcccg

SEQ ID NO: 237054 - DNA, 25 bp, Mus musculus
actgcgcccgcccacgcggtgatgt

SEQ ID NO: 237055 - DNA, 25 bp, Mus musculus
cggtgatgtcatcacccgggtgtcg

SEQ ID NO: 237056 - DNA, 25 bp, Mus musculus
ctctgtgccagagtcgcgcacctgt

SEQ ID NO: 237057 - DNA, 25 bp, Mus musculus
tcctgagctcgcaagcggagatccg

SEQ ID NO: 237058 - DNA, 25 bp, Mus musculus
agtccgtgggcatgcgcgctgctac

SEQ ID NO: 237059 - DNA, 25 bp, Mus musculus
aggctcctgagctcgcaagcggaga

SEQ ID NO: 237060 - DNA, 25 bp, Mus musculus
cgacctcagtcggaattcccctggg

SEQ ID NO: 237061 - DNA, 25 bp, Mus musculus
ctgtgccagagtcgcgcacctgtgg

SEQ ID NO: 237062 - DNA, 25 bp, Mus musculus
cgttactccacagcaagccggaatc

SEQ ID NO: 237063 - DNA, 25 bp, Mus musculus
ttagttcgtctcctgcaggcatggg

SEQ ID NO: 237064 - DNA, 25 bp, Mus musculus
gttggtcacattggcgcagacagcc

SEQ ID NO: 237065 - DNA, 25 bp, Mus musculus
ggcggtcagggagaccgttactcca

SEQ ID NO: 237066 - DNA, 25 bp, Mus musculus
aagccggaatccgtgtccatccgtc

SEQ ID NO: 237067 - DNA, 25 bp, Mus musculus
cgccatgccggagaacgtagcttcc

SEQ ID NO: 237068 - DNA, 25 bp, Mus musculus
ggaaaagcgcctaccaggaccgcga

SEQ ID NO: 237069 - DNA, 25 bp, Mus musculus
aggaccgcgacaagccagcccagat

SEQ ID NO: 237070 - DNA, 25 bp, Mus musculus
gcccagatccgcttcagcaatattt

SEQ ID NO: 237071 - DNA, 25 bp, Mus musculus
tatttccgcggccaaaggtatcacc

SEQ ID NO: 237072 - DNA, 25 bp, Mus musculus
caaggtggtctcgtttgcagctttc

SEQ ID NO: 237073 - DNA, 25 bp, Mus musculus
tttctgctaagcactcggagcgtgg

SEQ ID NO: 237074 - DNA, 25 bp, Mus musculus
gggacgccgagctccttagttcgtc

SEQ ID NO: 237075 - DNA, 25 bp, Mus musculus
cgtcgctttctggaaggttcgtgga

SEQ ID NO: 237076 - DNA, 25 bp, Mus musculus
ataaccggaaccaatgaacgcggcg

SEQ ID NO: 237077 - DNA, 25 bp, Mus musculus
ggacgccttcctagtccaccgactg

SEQ ID NO: 237078 - DNA, 25 bp, Mus musculus
gcaatgctgctcttcgggttgttgg

SEQ ID NO: 237079 - DNA, 25 bp, Mus musculus
ccggaaccaatgaacgcggcggcga

SEQ ID NO: 237080 - DNA, 25 bp, Mus musculus
tcggaagacgccgtaccactgcgct

SEQ ID NO: 237081 - DNA, 25 bp, Mus musculus
ctgggtcggaagacgccgtaccact

SEQ ID NO: 237082 - DNA, 25 bp, Mus musculus
ggcccacgaccacgcacgcgcagtg

SEQ ID NO: 237083 - DNA, 25 bp, Mus musculus
ctcctgaagcacagcctgggcggct

SEQ ID NO: 237084 - DNA, 25 bp, Mus musculus
gcgtgggcgagactcactccttcct

SEQ ID NO: 237085 - DNA, 25 bp, Mus musculus
tcagatcacggcgtgggcgagactc

SEQ ID NO: 237086 - DNA, 25 bp, Mus musculus
tgcccatcatcagatcacggcgtgg

SEQ ID NO: 237087 - DNA, 25 bp, Mus musculus
gatacgctttatccaggtctccagg

SEQ ID NO: 237088 - DNA, 25 bp, Mus musculus
gacgtcgatacgctttatccaggtc

SEQ ID NO: 237089 - DNA, 25 bp, Mus musculus
cggcgctgggcagcaatgctgctct

SEQ ID NO: 237090 - DNA, 25 bp, Mus musculus
accgtgtgtgactccaccgtgtgtg

SEQ ID NO: 237091 - DNA, 25 bp, Mus musculus
gtgtgtgactccaccgtgtgtgact

SEQ ID NO: 237092 - DNA, 25 bp, Mus musculus
tgtgtgactccaccgtgtgtgactc

SEQ ID NO: 237093 - DNA, 25 bp, Mus musculus
gactccaccgtgtgtgactccaccg

SEQ ID NO: 237094 - DNA, 25 bp, Mus musculus
tgactccaccgtgtgtgactccacc

SEQ ID NO: 237095 - DNA, 25 bp, Mus musculus
gtgactccaccgtgtgtgactccac

SEQ ID NO: 237096 - DNA, 25 bp, Mus musculus
tgtgactccaccgtgtgtgactcca

SEQ ID NO: 237097 - DNA, 25 bp, Mus musculus
ccaccgtgtgtgactccaccgtgtg

SEQ ID NO: 237098 - DNA, 25 bp, Mus musculus
tccaccgtgtgtgactccaccgtgt

SEQ ID NO: 237099 - DNA, 25 bp, Mus musculus
caccgtgtgtgactccaccgtgtgt

SEQ ID NO: 237100 - DNA, 25 bp, Mus musculus
gtgtgactccaccgtgtgtgactcc

SEQ ID NO: 237101 - DNA, 25 bp, Mus musculus
ctccaccgtgtgtgactccaccgtg

SEQ ID NO: 237102 - DNA, 25 bp, Mus musculus
ccgtgtgtgactccaccgtgtgtga

SEQ ID NO: 237103 - DNA, 25 bp, Mus musculus
cgtgtgtgactccaccgtgtgtgac

SEQ ID NO: 237104 - DNA, 25 bp, Mus musculus
ctcgccgcgctcctccaaacaaccg

SEQ ID NO: 237105 - DNA, 25 bp, Mus musculus
ctccttcagactgcggcggtgcgca

SEQ ID NO: 237106 - DNA, 25 bp, Mus musculus
ttactgccacttcgtcggccgctga

SEQ ID NO: 237107 - DNA, 25 bp, Mus musculus
tgcgcgccaggcttttctcgctgat

SEQ ID NO: 237108 - DNA, 25 bp, Mus musculus
agcttttggaaaccactgtcgctcc

SEQ ID NO: 237109 - DNA, 25 bp, Mus musculus
ctcctgggagagcttttggaaacca

SEQ ID NO: 237110 - DNA, 25 bp, Mus musculus
ggcacatactactcacggttccgtc

SEQ ID NO: 237111 - DNA, 25 bp, Mus musculus
gaaatattcgttagctcctggcaca

SEQ ID NO: 237112 - DNA, 25 bp, Mus musculus
gggacagggaaatattcgttagctc

SEQ ID NO: 237113 - DNA, 25 bp, Mus musculus
ctgctttatgggacagggaaatatt

SEQ ID NO: 237114 - DNA, 25 bp, Mus musculus
ccctcccggaaagatgctgctttat

SEQ ID NO: 237115 - DNA, 25 bp, Mus musculus
gctgcagatacagagctgagagctc

SEQ ID NO: 237116 - DNA, 25 bp, Mus musculus
ttctcgctgatgctgcagatacaga

SEQ ID NO: 237117 - DNA, 25 bp, Mus musculus
agctcctggcacatactactcacgg

SEQ ID NO: 237118 - DNA, 25 bp, Mus musculus
cttcccggctgcttaagaggagtca

SEQ ID NO: 237119 - DNA, 25 bp, Mus musculus
ctccggcgaggtgactttcagcctt

SEQ ID NO: 237120 - DNA, 25 bp, Mus musculus
cgggcgattagcacccattgcatga

SEQ ID NO: 237121 - DNA, 25 bp, Mus musculus
ccgtgaactgtgagtactgcgagta

SEQ ID NO: 237122 - DNA, 25 bp, Mus musculus
gatctcagtatcttcccactgcggg

SEQ ID NO: 237123 - DNA, 25 bp, Mus musculus
cccagggcttggagactggatctca

SEQ ID NO: 237124 - DNA, 25 bp, Mus musculus
gcaggtttgttctagtccgctacca

SEQ ID NO: 237125 - DNA, 25 bp, Mus musculus
ctggaacgtgaattggacttaactc

SEQ ID NO: 237126 - DNA, 25 bp, Mus musculus
agccttgagtctggttctgagtatc

SEQ ID NO: 237127 - DNA, 25 bp, Mus musculus
tttgtctggacctcgggagcctaaa

SEQ ID NO: 237128 - DNA, 25 bp, Mus musculus
aagcgacctgccgtggaatttttca

SEQ ID NO: 237129 - DNA, 25 bp, Mus musculus
aagatatgttgagtggcttcccggc

SEQ ID NO: 237130 - DNA, 25 bp, Mus musculus
ggagcctaaacagagcctgggtcta

SEQ ID NO: 237131 - DNA, 25 bp, Mus musculus
cgaggcgtcttttcgctgcaccttg

SEQ ID NO: 237132 - DNA, 25 bp, Mus musculus
cgtgcgggtcaaatcccagaagcaa

SEQ ID NO: 237133 - DNA, 25 bp, Mus musculus
ttacagatacacgttgctgggactg

SEQ ID NO: 237134 - DNA, 25 bp, Mus musculus
cctcgctgggttacagatacacgtt

SEQ ID NO: 237135 - DNA, 25 bp, Mus musculus
ccgctgagaccctcgctgggttaca

SEQ ID NO: 237136 - DNA, 25 bp, Mus musculus
cgtctgcccagtggcgaccctggaa

SEQ ID NO: 237137 - DNA, 25 bp, Mus musculus
cacctggagcgcgtctgcccagtgg

SEQ ID NO: 237138 - DNA, 25 bp, Mus musculus
ttgcgcagctgagtcagcccgcctg

SEQ ID NO: 237139 - DNA, 25 bp, Mus musculus
gcattgttgcgcagctgagtcagcc

SEQ ID NO: 237140 - DNA, 25 bp, Mus musculus
ttcggcagcattgttgcgcagctga

SEQ ID NO: 237141 - DNA, 25 bp, Mus musculus
caggccgtcccggttcggcagcatt

SEQ ID NO: 237142 - DNA, 25 bp, Mus musculus
gctttctaatcacttaccgcctttg

SEQ ID NO: 237143 - DNA, 25 bp, Mus musculus
gcaagcgcagctttctaatcactta

SEQ ID NO: 237144 - DNA, 25 bp, Mus musculus
ggtcaaatcccagaagcaagcgcag

SEQ ID NO: 237145 - DNA, 25 bp, Mus musculus
ttgctgggactgtgtgcgctgacct

SEQ ID NO: 237146 - DNA, 25 bp, Mus musculus
ttcgagggaggatagcaggaatctc

SEQ ID NO: 237147 - DNA, 25 bp, Mus musculus
ggcggcgttctctggtaatctcacc

SEQ ID NO: 237148 - DNA, 25 bp, Mus musculus
gctccgagcgactctgagctgcttc

SEQ ID NO: 237149 - DNA, 25 bp, Mus musculus
taggaggcgacaacaactggggacc

SEQ ID NO: 237150 - DNA, 25 bp, Mus musculus
ctcctaaactttgacctgctctggt

SEQ ID NO: 237151 - DNA, 25 bp, Mus musculus
acctttctcaatgcctggagcttta

SEQ ID NO: 237152 - DNA, 25 bp, Mus musculus
gccgcgttgtttctgagagtcctga

SEQ ID NO: 237153 - DNA, 25 bp, Mus musculus
tcccttggcgctttaagtaggtctg

SEQ ID NO: 237154 - DNA, 25 bp, Mus musculus
atgcacagagctggtttgaccttta

SEQ ID NO: 237155 - DNA, 25 bp, Mus musculus
agatcgatctcctgtccttcactga

SEQ ID NO: 237156 - DNA, 25 bp, Mus musculus
gcgtccgggtcttcatcagcgccaa

SEQ ID NO: 237157 - DNA, 25 bp, Mus musculus
tcagcgccaaccctgaaggtaagtc

SEQ ID NO: 237158 - DNA, 25 bp, Mus musculus
ccgcgcgactggattcccgcaaatg

SEQ ID NO: 237159 - DNA, 25 bp, Mus musculus
tgcgagtcctcctaggaaaccaaga

SEQ ID NO: 237160 - DNA, 25 bp, Mus musculus
ggcgacaagcaatgtgcgctcgatc

SEQ ID NO: 237161 - DNA, 25 bp, Mus musculus
acgcccgaggcccacgaagccatgg

SEQ ID NO: 237162 - DNA, 25 bp, Mus musculus
gcccaatgaccgcagcccgggctga

SEQ ID NO: 237163 - DNA, 25 bp, Mus musculus
gttacccttgcctgggaggctcgcc

SEQ ID NO: 237164 - DNA, 25 bp, Mus musculus
tcaaacatagatcaccggacgtccc

SEQ ID NO: 237165 - DNA, 25 bp, Mus musculus
ctgaccactcactcaaacatagatc

SEQ ID NO: 237166 - DNA, 25 bp, Mus musculus
aatgcgggctggctcgctgaccact

SEQ ID NO: 237167 - DNA, 25 bp, Mus musculus
tgtgcgctcgatctagcaactaatg

SEQ ID NO: 237168 - DNA, 25 bp, Mus musculus
ttgtctagccatcgggcgggcgaca

SEQ ID NO: 237169 - DNA, 25 bp, Mus musculus
tgagcagattgtctagccatcgggc

SEQ ID NO: 237170 - DNA, 25 bp, Mus musculus
ctgcagcgtctgagcagattgtcta

SEQ ID NO: 237171 - DNA, 25 bp, Mus musculus
cgaccgtcactgcagcgtctgagca

SEQ ID NO: 237172 - DNA, 25 bp, Mus musculus
tcgctgacccactcgcgtgtcccag

SEQ ID NO: 237173 - DNA, 25 bp, Mus musculus
tctagcaactaatgcgggctggctc

SEQ ID NO: 237174 - DNA, 25 bp, Mus musculus
cgacatcctgaagaatccgagttgg

SEQ ID NO: 237175 - DNA, 25 bp, Mus musculus
tgctgggcgggctaaccctgcccag

SEQ ID NO: 237176 - DNA, 25 bp, Mus musculus
cctctaaacccttgggtcgcgtcag

SEQ ID NO: 237177 - DNA, 25 bp, Mus musculus
tggattgaatgcaggagctcggccc

SEQ ID NO: 237178 - DNA, 25 bp, Mus musculus
ctgaagcagcaagcacagcggaccc

SEQ ID NO: 237179 - DNA, 25 bp, Mus musculus
tcccacgaacactgaagcagcaagc

SEQ ID NO: 237180 - DNA, 25 bp, Mus musculus
tgcgcagacccaactcaccaggcgt

SEQ ID NO: 237181 - DNA, 25 bp, Mus musculus
ttgtgggctcgaccgactcgtcgag

SEQ ID NO: 237182 - DNA, 25 bp, Mus musculus
cagatccggtagcacagcagggcgc

SEQ ID NO: 237183 - DNA, 25 bp, Mus musculus
tcagagccagatccggtagcacagc

SEQ ID NO: 237184 - DNA, 25 bp, Mus musculus
cagatgttcagagccagatccggta

SEQ ID NO: 237185 - DNA, 25 bp, Mus musculus
ccgggacacccagatgttcagagcc

SEQ ID NO: 237186 - DNA, 25 bp, Mus musculus
taaccctgcccagccaagtggcggg

SEQ ID NO: 237187 - DNA, 25 bp, Mus musculus
tgaagaatccgagttggggtcccgc

SEQ ID NO: 237188 - DNA, 25 bp, Mus musculus
tgcctgctcggcataagctgttgcg

SEQ ID NO: 237189 - DNA, 25 bp, Mus musculus
tccggctctctgactacgcctcttt

SEQ ID NO: 237190 - DNA, 25 bp, Mus musculus
ctccgcccggttgtgactgctgcgg

SEQ ID NO: 237191 - DNA, 25 bp, Mus musculus
ggcggcgacaccgacagagacaccg

SEQ ID NO: 237192 - DNA, 25 bp, Mus musculus
agagacaccggctccggaaggcagt

SEQ ID NO: 237193 - DNA, 25 bp, Mus musculus
acgcgcgactggaccaggagaccgc

SEQ ID NO: 237194 - DNA, 25 bp, Mus musculus
cgactggaccaggagaccgcgcagt

SEQ ID NO: 237195 - DNA, 25 bp, Mus musculus
ttgggaccaggtaagggccgatctc

SEQ ID NO: 237196 - DNA, 25 bp, Mus musculus
ggtaagggccgatctccggctcttc

SEQ ID NO: 237197 - DNA, 25 bp, Mus musculus
gatctccggctcttcggttctcggg

SEQ ID NO: 237198 - DNA, 25 bp, Mus musculus
gccacacggtgcctgctcggcataa

SEQ ID NO: 237199 - DNA, 25 bp, Mus musculus
ctcggcataagctgttgcgggactg

SEQ ID NO: 237200 - DNA, 25 bp, Mus musculus
ggcggggctgctgcacgtcctcttc

SEQ ID NO: 237201 - DNA, 25 bp, Mus musculus
cccggctgctagacccggtagagga

SEQ ID NO: 237202 - DNA, 25 bp, Mus musculus
cagacctctgttcggggagacgtct

SEQ ID NO: 237203 - DNA, 25 bp, Mus musculus
gggccagagtgcgagaatcccgcct

SEQ ID NO: 237204 - DNA, 25 bp, Mus musculus
agaaccctgctttagccactacgtg

SEQ ID NO: 237205 - DNA, 25 bp, Mus musculus
cgcgcagccgccaattgccaagagg

SEQ ID NO: 237206 - DNA, 25 bp, Mus musculus
ggacgacccgcacctctgtaaataa

SEQ ID NO: 237207 - DNA, 25 bp, Mus musculus
tgtaaataaagctctgcagcccagg

SEQ ID NO: 237208 - DNA, 25 bp, Mus musculus
gggactcgcgccaggcaaactttct

SEQ ID NO: 237209 - DNA, 25 bp, Mus musculus
cggacttcgcgagctgatgcggact

SEQ ID NO: 237210 - DNA, 25 bp, Mus musculus
actcgcttttgagcgtccggggacg

SEQ ID NO: 237211 - DNA, 25 bp, Mus musculus
ggacgagcgaagcagccctaaaatg

SEQ ID NO: 237212 - DNA, 25 bp, Mus musculus
gccctaaaatggaggactttgctac

SEQ ID NO: 237213 - DNA, 25 bp, Mus musculus
gacgccaaattcgagtcggtcttca

SEQ ID NO: 237214 - DNA, 25 bp, Mus musculus
accagcggcctggataacagacctc

SEQ ID NO: 237215 - DNA, 25 bp, Mus musculus
tttgctaccaggacctacgggacca

SEQ ID NO: 237216 - DNA, 25 bp, Mus musculus
ggcctctccggtgccttggcaggac

SEQ ID NO: 237217 - DNA, 25 bp, Mus musculus
gtactgggcacaggccgacctcgct

SEQ ID NO: 237218 - DNA, 25 bp, Mus musculus
ccagctgactcgcagaggcagagcc

SEQ ID NO: 237219 - DNA, 25 bp, Mus musculus
agcccttgagcagcgcactgctgtg

SEQ ID NO: 237220 - DNA, 25 bp, Mus musculus
cctaggtctcttgaggtttaaggca

SEQ ID NO: 237221 - DNA, 25 bp, Mus musculus
gaatggagcccacggcgaccttccg

SEQ ID NO: 237222 - DNA, 25 bp, Mus musculus
ctccgccgtgggtgacaataaaacg

SEQ ID NO: 237223 - DNA, 25 bp, Mus musculus
acaataaaacgctgtccgcaggggc

SEQ ID NO: 237224 - DNA, 25 bp, Mus musculus
ggcggctagcaaccagcctggtgcc

SEQ ID NO: 237225 - DNA, 25 bp, Mus musculus
gcgccgctcagggattggctctccg

SEQ ID NO: 237226 - DNA, 25 bp, Mus musculus
cgccctgatcttcgggtagttcatt

SEQ ID NO: 237227 - DNA, 25 bp, Mus musculus
attgggccgttaggctgtcctgtaa

SEQ ID NO: 237228 - DNA, 25 bp, Mus musculus
aggagctgccgaaagccaaagtgga

SEQ ID NO: 237229 - DNA, 25 bp, Mus musculus
ctgtcctgtaagtcccggagtggga

SEQ ID NO: 237230 - DNA, 25 bp, Mus musculus
cgggagggccataatcacttgtgag

SEQ ID NO: 237231 - DNA, 25 bp, Mus musculus
gactcactagggagattccggctgc

SEQ ID NO: 237232 - DNA, 25 bp, Mus musculus
caacccgcaagagaagcagagactg

SEQ ID NO: 237233 - DNA, 25 bp, Mus musculus
gggcatctactcctgttcttggctc

SEQ ID NO: 237234 - DNA, 25 bp, Mus musculus
agtcgcctagccagagtcgcttggt

SEQ ID NO: 237235 - DNA, 25 bp, Mus musculus
cttgtgagcacgcagggaatattcc

SEQ ID NO: 237236 - DNA, 25 bp, Mus musculus
gcctgttgctgcaagccacctcgga

SEQ ID NO: 237237 - DNA, 25 bp, Mus musculus
tgtgtgaccacacatcccgccggga

SEQ ID NO: 237238 - DNA, 25 bp, Mus musculus
gcagggctacctgctataaataagc

SEQ ID NO: 237239 - DNA, 25 bp, Mus musculus
tgagaacctcgcacgccaaaacagc

SEQ ID NO: 237240 - DNA, 25 bp, Mus musculus
tgcgtgcagagaagcaggatccctc

SEQ ID NO: 237241 - DNA, 25 bp, Mus musculus
ctaatccgcggagggcacttcatcc

SEQ ID NO: 237242 - DNA, 25 bp, Mus musculus
cacctggccagagatgggtttagta

SEQ ID NO: 237243 - DNA, 25 bp, Mus musculus
aatattccgggccaggacttcgcgc

SEQ ID NO: 237244 - DNA, 25 bp, Mus musculus
gcgcggagccacttttcattcattc

SEQ ID NO: 237245 - DNA, 25 bp, Mus musculus
tcccagaaggcgtcgcgcctgtttc

SEQ ID NO: 237246 - DNA, 25 bp, Mus musculus
ttttcattcattcttcctctcagcc

SEQ ID NO: 237247 - DNA, 25 bp, Mus musculus
agacgccaggccgttccagcgagcg

SEQ ID NO: 237248 - DNA, 25 bp, Mus musculus
gaggcagacgccaggccgttccagc

SEQ ID NO: 237249 - DNA, 25 bp, Mus musculus
ggcgctccaactgccggatcgcggc

SEQ ID NO: 237250 - DNA, 25 bp, Mus musculus
accattgttcagctgggtggccaag

SEQ ID NO: 237251 - DNA, 25 bp, Mus musculus
ggcccgcgatgtcaccattgttcag

SEQ ID NO: 237252 - DNA, 25 bp, Mus musculus
ccgtctcgggacgatgcccgcaccc

SEQ ID NO: 237253 - DNA, 25 bp, Mus musculus
cgacctctcaggctgtgacgcgcgg

SEQ ID NO: 237254 - DNA, 25 bp, Mus musculus
cgggcgcgacctctcaggctgtgac

SEQ ID NO: 237255 - DNA, 25 bp, Mus musculus
acttcccgcgtgagcaggtccgggt

SEQ ID NO: 237256 - DNA, 25 bp, Mus musculus
cctccgtcaacaggaattgaacacc

SEQ ID NO: 237257 - DNA, 25 bp, Mus musculus
gcccacttccctttctcgctgcctg

SEQ ID NO: 237258 - DNA, 25 bp, Mus musculus
gtgactgtggctcacaagaaggccc

SEQ ID NO: 237259 - DNA, 25 bp, Mus musculus
ccacccgcactgattgacgagtgta

SEQ ID NO: 237260 - DNA, 25 bp, Mus musculus
aagattgcccgccaggaagagctgc

SEQ ID NO: 237261 - DNA, 25 bp, Mus musculus
cgagttcgacgataccttcgccaaa

SEQ ID NO: 237262 - DNA, 25 bp, Mus musculus
cttcgccaaaaagttcgaggtgctc

SEQ ID NO: 237263 - DNA, 25 bp, Mus musculus
gacgagtgtatcgagaagttcaacc

SEQ ID NO: 237264 - DNA, 25 bp, Mus musculus
gccgggtgactgtggctcacaagaa

SEQ ID NO: 237265 - DNA, 25 bp, Mus musculus
gcccgccaggaagagctgcgttgcc

SEQ ID NO: 237266 - DNA, 25 bp, Mus musculus
tcgagaagttcaaccatgtgagctg

SEQ ID NO: 237267 - DNA, 25 bp, Mus musculus
accatgtgagctgtggtcgcagaac

SEQ ID NO: 237268 - DNA, 25 bp, Mus musculus
caggcccatgcgcaaatccttctca

SEQ ID NO: 237269 - DNA, 25 bp, Mus musculus
aatccttctcacagcctggactgcg

SEQ ID NO: 237270 - DNA, 25 bp, Mus musculus
gcccaccgggcagccatcagcgcct

SEQ ID NO: 237271 - DNA, 25 bp, Mus musculus
aagttcgaggtgctcttctgtggcc

SEQ ID NO: 237272 - DNA, 25 bp, Mus musculus
cccagagttggtgccaaggagccag

SEQ ID NO: 237273 - DNA, 25 bp, Mus musculus
cccttcggagaaagcaggacgcgga

SEQ ID NO: 237274 - DNA, 25 bp, Mus musculus
tttcccttcggagaaagcaggacgc

SEQ ID NO: 237275 - DNA, 25 bp, Mus musculus
ttgcgccgcatctgcttgcttctct

SEQ ID NO: 237276 - DNA, 25 bp, Mus musculus
caccgcgcttggcagagtaagtccc

SEQ ID NO: 237277 - DNA, 25 bp, Mus musculus
ctcggcaccgcgcttggcagagtaa

SEQ ID NO: 237278 - DNA, 25 bp, Mus musculus
gtgcggtcgcggtccctatcccgga

SEQ ID NO: 237279 - DNA, 25 bp, Mus musculus
catgtgactgcccagagttggtgcc

SEQ ID NO: 237280 - DNA, 25 bp, Mus musculus
cgccggcgtcatgtgactgcccaga

SEQ ID NO: 237281 - DNA, 25 bp, Mus musculus
ggcggctgcctccacccaagtgggt

SEQ ID NO: 237282 - DNA, 25 bp, Mus musculus
ataatgagtgtctgtcaggctggcc

SEQ ID NO: 237283 - DNA, 25 bp, Mus musculus
cccggctccggggaataatgagtgt

SEQ ID NO: 237284 - DNA, 25 bp, Mus musculus
cctgggtttcttggccgctgcgctc

SEQ ID NO: 237285 - DNA, 25 bp, Mus musculus
tgcgtgtttgccagtgactcgccga

SEQ ID NO: 237286 - DNA, 25 bp, Mus musculus
gtccgcccattaagaagtactcgcc

SEQ ID NO: 237287 - DNA, 25 bp, Mus musculus
gtcattcagcccgtcgtggtccagc

SEQ ID NO: 237288 - DNA, 25 bp, Mus musculus
cagacacggaatccggagcccaggc

SEQ ID NO: 237289 - DNA, 25 bp, Mus musculus
agccgcgctgtccagacacggaatc

SEQ ID NO: 237290 - DNA, 25 bp, Mus musculus
cctgtgatggcagccgcgctgtcca

SEQ ID NO: 237291 - DNA, 25 bp, Mus musculus
tgtctatgccgcctgtgatggcagc

SEQ ID NO: 237292 - DNA, 25 bp, Mus musculus
cttctcctggcgtgcagccctttgg

SEQ ID NO: 237293 - DNA, 25 bp, Mus musculus
ctccagtccgcccattaagaagtac

SEQ ID NO: 237294 - DNA, 25 bp, Mus musculus
agagcgtcacctggcctcagcatgc

SEQ ID NO: 237295 - DNA, 25 bp, Mus musculus
gttcccgtcccaccggagagcgtca

SEQ ID NO: 237296 - DNA, 25 bp, Mus musculus
gcggttctccttcctctctgaagtt

SEQ ID NO: 237297 - DNA, 25 bp, Mus musculus
ctcacggtgaacaagcggggctccc

SEQ ID NO: 237298 - DNA, 25 bp, Mus musculus
agccggtggacctcacggtgaacaa

SEQ ID NO: 237299 - DNA, 25 bp, Mus musculus
tggcgtgcagccctttggagtaccc

SEQ ID NO: 237300 - DNA, 25 bp, Mus musculus
ccgaccaccgatctgggacggcgga

SEQ ID NO: 237301 - DNA, 25 bp, Mus musculus
gtgtcgctccaagtccacgctcatg

SEQ ID NO: 237302 - DNA, 25 bp, Mus musculus
gagtgtgtgtcgctccaagtccacg

SEQ ID NO: 237303 - DNA, 25 bp, Mus musculus
aagcaacttgcttgggcacgaaggt

SEQ ID NO: 237304 - DNA, 25 bp, Mus musculus
ccgtcccgagaaagcaacttgcttg

SEQ ID NO: 237305 - DNA, 25 bp, Mus musculus
gaaccgtcccgagaaagcaacttgc

SEQ ID NO: 237306 - DNA, 25 bp, Mus musculus
tgtgagaaatcaccggcggggaacc

SEQ ID NO: 237307 - DNA, 25 bp, Mus musculus
tccgctgtagggtgtgagaaatcac

SEQ ID NO: 237308 - DNA, 25 bp, Mus musculus
gacccttgtccgctgtagggtgtga

SEQ ID NO: 237309 - DNA, 25 bp, Mus musculus
ctgcaccctcgtccggcctggagct

SEQ ID NO: 237310 - DNA, 25 bp, Mus musculus
tcggccggccaagcggtaagagccc

SEQ ID NO: 237311 - DNA, 25 bp, Mus musculus
cactcggccggccaagcggtaagag

SEQ ID NO: 237312 - DNA, 25 bp, Mus musculus
gagttcggagttcgcagcaggtcag

SEQ ID NO: 237313 - DNA, 25 bp, Mus musculus
ccaccgatctgggacggcggagttc

SEQ ID NO: 237314 - DNA, 25 bp, Mus musculus
cgccctggagttgcccaaagttctc

SEQ ID NO: 237315 - DNA, 25 bp, Mus musculus
tctcggtctttggacccagctgcga

SEQ ID NO: 237316 - DNA, 25 bp, Mus musculus
cttttgagctgcaaccgggactcga

SEQ ID NO: 237317 - DNA, 25 bp, Mus musculus
tgacttgcccaccttaggagccggc

SEQ ID NO: 237318 - DNA, 25 bp, Mus musculus
actcgctggccagggtgacttgccc

SEQ ID NO: 237319 - DNA, 25 bp, Mus musculus
ccttccgggtccgaggactcgctgg

SEQ ID NO: 237320 - DNA, 25 bp, Mus musculus
tctggagaacggaattctcggtctt

SEQ ID NO: 237321 - DNA, 25 bp, Mus musculus
caacatacatgcgacccttccgggt

SEQ ID NO: 237322 - DNA, 25 bp, Mus musculus
tgggctaaggccagctcccaacata

SEQ ID NO: 237323 - DNA, 25 bp, Mus musculus
cggtaagtgcgacttcctcctcggc

SEQ ID NO: 237324 - DNA, 25 bp, Mus musculus
caagtttgactcctggcctggcgtc

SEQ ID NO: 237325 - DNA, 25 bp, Mus musculus
ggctgcgggacaagtttgactcctg

SEQ ID NO: 237326 - DNA, 25 bp, Mus musculus
actaaccggcgagcgtgtgcccgac

SEQ ID NO: 237327 - DNA, 25 bp, Mus musculus
ttctccacgcggcactgagatggcc

SEQ ID NO: 237328 - DNA, 25 bp, Mus musculus
ctcggagccctctgcatcgtcctcc

SEQ ID NO: 237329 - DNA, 25 bp, Mus musculus
ggaccacagccctagcaaccggagg

SEQ ID NO: 237330 - DNA, 25 bp, Mus musculus
gggtgcaggaccacagccctagcaa

SEQ ID NO: 237331 - DNA, 25 bp, Mus musculus
gctgcgcactgggtgcaggaccaca

SEQ ID NO: 237332 - DNA, 25 bp, Mus musculus
ttctcccgcgaagtagcagaagcgc

SEQ ID NO: 237333 - DNA, 25 bp, Mus musculus
gcaaccggagggttgctaccttgta

SEQ ID NO: 237334 - DNA, 25 bp, Mus musculus
gccaacaacttctcccgcgaagtag

SEQ ID NO: 237335 - DNA, 25 bp, Mus musculus
tcgggatccattggcgccaacaact

SEQ ID NO: 237336 - DNA, 25 bp, Mus musculus
tcgttatcggggctcgggatccatt

SEQ ID NO: 237337 - DNA, 25 bp, Mus musculus
ccgtggctggggtaattcgttatcg

SEQ ID NO: 237338 - DNA, 25 bp, Mus musculus
cccacgaccgaacaggagcaggtgg

SEQ ID NO: 237339 - DNA, 25 bp, Mus musculus
aaagcctctgtagctgcacggcctc

SEQ ID NO: 237340 - DNA, 25 bp, Mus musculus
cgcctgcaaagcctctgtagctgca

SEQ ID NO: 237341 - DNA, 25 bp, Mus musculus
tgctaccttgtaggacggcgagtgc

SEQ ID NO: 237342 - DNA, 25 bp, Mus musculus
ctggcgactatccatcggttatgaa

SEQ ID NO: 237343 - DNA, 25 bp, Mus musculus
cgagcgcttcctccagtttgagatc

SEQ ID NO: 237344 - DNA, 25 bp, Mus musculus
tcgcctccaagaaccagcgagggct

SEQ ID NO: 237345 - DNA, 25 bp, Mus musculus
taacaccctggggagtgcgcaagct

SEQ ID NO: 237346 - DNA, 25 bp, Mus musculus
ccgctcttcaagactggcgactatc

SEQ ID NO: 237347 - DNA, 25 bp, Mus musculus
cggttatgaaggaatacatcgcctc

SEQ ID NO: 237348 - DNA, 25 bp, Mus musculus
agggctgtctagctcagtcctgccg

SEQ ID NO: 237349 - DNA, 25 bp, Mus musculus
cttcaccgcgaaggagagcaggctg

SEQ ID NO: 237350 - DNA, 25 bp, Mus musculus
ggtaccgtcgacttctacgcactga

SEQ ID NO: 237351 - DNA, 25 bp, Mus musculus
ccacttcactacgaggttcgtgata

SEQ ID NO: 237352 - DNA, 25 bp, Mus musculus
ttcgtgatacacaagcagctgaaca

SEQ ID NO: 237353 - DNA, 25 bp, Mus musculus
cagctgaacaccaaccgctcagttg

SEQ ID NO: 237354 - DNA, 25 bp, Mus musculus
ttgcagacagggacgtccagttcct

SEQ ID NO: 237355 - DNA, 25 bp, Mus musculus
gcctggtttgcagatccgctcttca

SEQ ID NO: 237356 - DNA, 25 bp, Mus musculus
gcagcgttccgctcccaacgggaat

SEQ ID NO: 237357 - DNA, 25 bp, Mus musculus
gatcccttgacactcctgagaccta

SEQ ID NO: 237358 - DNA, 25 bp, Mus musculus
gtgctgttccctcgatcccttgaca

SEQ ID NO: 237359 - DNA, 25 bp, Mus musculus
gcgacgacgtatcgcgtcatgactc

SEQ ID NO: 237360 - DNA, 25 bp, Mus musculus
ctttaaggcggaactactcgattgc

SEQ ID NO: 237361 - DNA, 25 bp, Mus musculus
gtcacgacccgagcgacggctttaa

SEQ ID NO: 237362 - DNA, 25 bp, Mus musculus
ttcttgtaatccgtcagggccctgc

SEQ ID NO: 237363 - DNA, 25 bp, Mus musculus
cgtctttcgtcatcacgttcttgta

SEQ ID NO: 237364 - DNA, 25 bp, Mus musculus
ctcacctcgcagtagatggggcaaa

SEQ ID NO: 237365 - DNA, 25 bp, Mus musculus
ccaaacagaggatgggttcagattc

SEQ ID NO: 237366 - DNA, 25 bp, Mus musculus
aaagccttggggcatcggctccatg

SEQ ID NO: 237367 - DNA, 25 bp, Mus musculus
ccggcaacaaggacccaggtgtgtc

SEQ ID NO: 237368 - DNA, 25 bp, Mus musculus
gatggctctacgctgctgggataca

SEQ ID NO: 237369 - DNA, 25 bp, Mus musculus
aacgggaatcgccagctacgaaagc

SEQ ID NO: 237370 - DNA, 25 bp, Mus musculus
tgttcacgcgttcgactccggaaga

SEQ ID NO: 237371 - DNA, 25 bp, Mus musculus
gtcatctctgtctggcgtcctcttt

SEQ ID NO: 237372 - DNA, 25 bp, Mus musculus
gcgtgtccctgctacgtcatctctg

SEQ ID NO: 237373 - DNA, 25 bp, Mus musculus
aggccgcctgagtaaggacctctgc

SEQ ID NO: 237374 - DNA, 25 bp, Mus musculus
ctcaggcctcggcttatggcaagtg

SEQ ID NO: 237375 - DNA, 25 bp, Mus musculus
tcaggtccctgtactgtcccgtctt

SEQ ID NO: 237376 - DNA, 25 bp, Mus musculus
cggcgccctcgagagcctaaaagga

SEQ ID NO: 237377 - DNA, 25 bp, Mus musculus
tgcgtctcagccaatccaaagtctc

SEQ ID NO: 237378 - DNA, 25 bp, Mus musculus
cgctaatctagcgaggttcccgggc

SEQ ID NO: 237379 - DNA, 25 bp, Mus musculus
tcacggcaggcacactcattctcgg

SEQ ID NO: 237380 - DNA, 25 bp, Mus musculus
ttggggttaaccttctgctatcacg

SEQ ID NO: 237381 - DNA, 25 bp, Mus musculus
ggcacagctgccatggtccaggtaa

SEQ ID NO: 237382 - DNA, 25 bp, Mus musculus
aaaggaccgctcatgtctgtgaacg

SEQ ID NO: 237383 - DNA, 25 bp, Mus musculus
gacggacaagaacggcgaccaatta

SEQ ID NO: 237384 - DNA, 25 bp, Mus musculus
tatttggcccgcgagtcacacacag

SEQ ID NO: 237385 - DNA, 25 bp, Mus musculus
gatcgaatacgccaccaggtttccc

SEQ ID NO: 237386 - DNA, 25 bp, Mus musculus
aggtttcccgtcactggatgccatc

SEQ ID NO: 237387 - DNA, 25 bp, Mus musculus
ggatgccatcttgccggctctagtc

SEQ ID NO: 237388 - DNA, 25 bp, Mus musculus
ccgcgctcctctgagtccaataaga

SEQ ID NO: 237389 - DNA, 25 bp, Mus musculus
accaggcgtgctaggattggctgaa

SEQ ID NO: 237390 - DNA, 25 bp, Mus musculus
catcgacgatcatctcctgagagcg

SEQ ID NO: 237391 - DNA, 25 bp, Mus musculus
cctgatcgatgttctcgggttccga

SEQ ID NO: 237392 - DNA, 25 bp, Mus musculus
cgctctccggtgagagttgaacctt

SEQ ID NO: 237393 - DNA, 25 bp, Mus musculus
gacaatgtggagcagcgatcgctta

SEQ ID NO: 237394 - DNA, 25 bp, Mus musculus
cttcacgaatgctcgggactgcttc

SEQ ID NO: 237395 - DNA, 25 bp, Mus musculus
ggactagggtcagctgacacctttt

SEQ ID NO: 237396 - DNA, 25 bp, Mus musculus
ccttttcctgcagggacatcgtctg

SEQ ID NO: 237397 - DNA, 25 bp, Mus musculus
ccgtctggacgtggtgatcgaatac

SEQ ID NO: 237398 - DNA, 25 bp, Mus musculus
tccgggcactttggaagaaccagga

SEQ ID NO: 237399 - DNA, 25 bp, Mus musculus
tctctaaagagaaagtccgactggc

SEQ ID NO: 237400 - DNA, 25 bp, Mus musculus
gcaaccatgacttccttcgctgagt

SEQ ID NO: 237401 - DNA, 25 bp, Mus musculus
ggacctgaaggttccatcgcactta

SEQ ID NO: 237402 - DNA, 25 bp, Mus musculus
tcgcacttacttcctgttttgggtc

SEQ ID NO: 237403 - DNA, 25 bp, Mus musculus
ataccaggatggaggaagcagccgc

SEQ ID NO: 237404 - DNA, 25 bp, Mus musculus
acgtcacttccgtctgcgtcggcaa

SEQ ID NO: 237405 - DNA, 25 bp, Mus musculus
gctgcggaatcgagcgccattctca

SEQ ID NO: 237406 - DNA, 25 bp, Mus musculus
gccattctcagcgagcgatagggtc

SEQ ID NO: 237407 - DNA, 25 bp, Mus musculus
agggtctttcccttggcaggcgtct

SEQ ID NO: 237408 - DNA, 25 bp, Mus musculus
aggcgtctgcaccatctgtctttta

SEQ ID NO: 237409 - DNA, 25 bp, Mus musculus
ttagtttccgcaatctccgaagcga

SEQ ID NO: 237410 - DNA, 25 bp, Mus musculus
acgtcccgcgcggtctctaaagaga

SEQ ID NO: 237411 - DNA, 25 bp, Mus musculus
agcgcaaccagccaccggaaacgga

SEQ ID NO: 237412 - DNA, 25 bp, Mus musculus
tgaagacgcgcgagttgcgaaatta

SEQ ID NO: 237413 - DNA, 25 bp, Mus musculus
tcagctccagctaagtcacgggctc

SEQ ID NO: 237414 - DNA, 25 bp, Mus musculus
cccttgaggagcagggcgaatcagc

SEQ ID NO: 237415 - DNA, 25 bp, Mus musculus
ggcgggatccgaactgtatgaccac

SEQ ID NO: 237416 - DNA, 25 bp, Mus musculus
gggcaggcctctatttccttctgga

SEQ ID NO: 237417 - DNA, 25 bp, Mus musculus
ccgcggccgtatttaaatacttctg

SEQ ID NO: 237418 - DNA, 25 bp, Mus musculus
cgtgcagatcccgttctctcggaca

SEQ ID NO: 237419 - DNA, 25 bp, Mus musculus
acttccaaagcagggacacagcggc

SEQ ID NO: 237420 - DNA, 25 bp, Mus musculus
gatcggtgcttacccacttccaaag

SEQ ID NO: 237421 - DNA, 25 bp, Mus musculus
ggcatcccgaaaggatcggtgctta

SEQ ID NO: 237422 - DNA, 25 bp, Mus musculus
accaggatggtgcagtagagagccc

SEQ ID NO: 237423 - DNA, 25 bp, Mus musculus
ctcctgcaagcgcacgacgtgattc

SEQ ID NO: 237424 - DNA, 25 bp, Mus musculus
ctggtcccgctaggctgactagctg

SEQ ID NO: 237425 - DNA, 25 bp, Mus musculus
cgaaattaaaagctcggctcggctg

SEQ ID NO: 237426 - DNA, 25 bp, Mus musculus
gtcttccgtggtcatgatcatctga

SEQ ID NO: 237427 - DNA, 25 bp, Mus musculus
ctgtccacggcggtgtttagtcata

SEQ ID NO: 237428 - DNA, 25 bp, Mus musculus
caggcacgcgtgaaaatcggaactc

SEQ ID NO: 237429 - DNA, 25 bp, Mus musculus
ggagttcatcatcaggcacgcgtga

SEQ ID NO: 237430 - DNA, 25 bp, Mus musculus
tgagacccggtctacctgcagaggt

SEQ ID NO: 237431 - DNA, 25 bp, Mus musculus
tttagtcatacttaggcggaggggc

SEQ ID NO: 237432 - DNA, 25 bp, Mus musculus
tctgtttgtcgagggaatggcttct

SEQ ID NO: 237433 - DNA, 25 bp, Mus musculus
caacagattgtagcacccggagccg

SEQ ID NO: 237434 - DNA, 25 bp, Mus musculus
ggggcgcgcgcacaaattgatgact

SEQ ID NO: 237435 - DNA, 25 bp, Mus musculus
ctcttagccacgagacccggatctg

SEQ ID NO: 237436 - DNA, 25 bp, Mus musculus
ccggctgttaagttgtcccacgtcg

SEQ ID NO: 237437 - DNA, 25 bp, Mus musculus
ttggattcgatagaccacgtcactc

SEQ ID NO: 237438 - DNA, 25 bp, Mus musculus
ctatggggccctaaaagtgaaagca

SEQ ID NO: 237439 - DNA, 25 bp, Mus musculus
gtgacttcatcgaacccaccaggca

SEQ ID NO: 237440 - DNA, 25 bp, Mus musculus
tgcgggcagagacatggccaacatc

SEQ ID NO: 237441 - DNA, 25 bp, Mus musculus
ggactggaggtctctctgtaaagga

SEQ ID NO: 237442 - DNA, 25 bp, Mus musculus
agacgtatggggctcccactggagc

SEQ ID NO: 237443 - DNA, 25 bp, Mus musculus
ttctacagtgaggaggaacgcgacg

SEQ ID NO: 237444 - DNA, 25 bp, Mus musculus
agcgttcgtgtgctcgggtctgaat

SEQ ID NO: 237445 - DNA, 25 bp, Mus musculus
acatctggaagtgtgactaggcggt

SEQ ID NO: 237446 - DNA, 25 bp, Mus musculus
cgtgtgctcgggtctgaatcgctga

SEQ ID NO: 237447 - DNA, 25 bp, Mus musculus
gccaacatcgcggtgcagcgaatca

SEQ ID NO: 237448 - DNA, 25 bp, Mus musculus
tgcagcgaatcaagcgggagttcaa

SEQ ID NO: 237449 - DNA, 25 bp, Mus musculus
aggtctctctgtaaaggaggccgag

SEQ ID NO: 237450 - DNA, 25 bp, Mus musculus
tgctggagacgtatggggctcccac

SEQ ID NO: 237451 - DNA, 25 bp, Mus musculus
agggccgatgccgaagcactcgtcg

SEQ ID NO: 237452 - DNA, 25 bp, Mus musculus
tggcggcaacatctggaagtgtgac

SEQ ID NO: 237453 - DNA, 25 bp, Mus musculus
gtcaggaacgagctaccggacgccc

SEQ ID NO: 237454 - DNA, 25 bp, Mus musculus
gcacttcacatttttgttccttaac

SEQ ID NO: 237455 - DNA, 25 bp, Mus musculus
tgccgctctccgtcgggctgaggaa

SEQ ID NO: 237456 - DNA, 25 bp, Mus musculus
gggctgcacacaaagcggctccgtc

SEQ ID NO: 237457 - DNA, 25 bp, Mus musculus
gcctctgtcaggtggttgcgccgcc

SEQ ID NO: 237458 - DNA, 25 bp, Mus musculus
gttccttaacttcagcaaccgagcc

SEQ ID NO: 237459 - DNA, 25 bp, Mus musculus
ggaagcgaaggacccggctccgcac

SEQ ID NO: 237460 - DNA, 25 bp, Mus musculus
cctcgccaggaagcgaaggacccgg

SEQ ID NO: 237461 - DNA, 25 bp, Mus musculus
gagcagaacgccatagccgtgccga

SEQ ID NO: 237462 - DNA, 25 bp, Mus musculus
cagcttaggccgcaaaactaggtac

SEQ ID NO: 237463 - DNA, 25 bp, Mus musculus
cctagagggttcagcttaggccgca

SEQ ID NO: 237464 - DNA, 25 bp, Mus musculus
tccgggaaaggagactcgaggccta

SEQ ID NO: 237465 - DNA, 25 bp, Mus musculus
gtcacctccgggaaaggagactcga

SEQ ID NO: 237466 - DNA, 25 bp, Mus musculus
cccgagcacctaggacggaagtttg

SEQ ID NO: 237467 - DNA, 25 bp, Mus musculus
tttacctcctcctcatgcgggcgga

SEQ ID NO: 237468 - DNA, 25 bp, Mus musculus
atcccggcagcctccgtcccggttg

SEQ ID NO: 237469 - DNA, 25 bp, Mus musculus
agcggcagtgtgtcctcgctccgca

SEQ ID NO: 237470 - DNA, 25 bp, Mus musculus
ctacgtggcagccattgcggcggcc

SEQ ID NO: 237471 - DNA, 25 bp, Mus musculus
cacctggctacgtggcagccattgc

SEQ ID NO: 237472 - DNA, 25 bp, Mus musculus
cgggccgacgcatcctggagagccc

SEQ ID NO: 237473 - DNA, 25 bp, Mus musculus
tcgtaacggagccagcgaggcgcca

SEQ ID NO: 237474 - DNA, 25 bp, Mus musculus
tcacttctcgtaacggagccagcga

SEQ ID NO: 237475 - DNA, 25 bp, Mus musculus
cgggactcacttctcgtaacggagc

SEQ ID NO: 237476 - DNA, 25 bp, Mus musculus
caggcccgggactcacttctcgtaa

SEQ ID NO: 237477 - DNA, 25 bp, Mus musculus
caccggggcgcttacacgggcagca

SEQ ID NO: 237478 - DNA, 25 bp, Mus musculus
cagggccagaacgaccttgttttgc

SEQ ID NO: 237479 - DNA, 25 bp, Mus musculus
ctgcccagggccagaacgaccttgt

SEQ ID NO: 237480 - DNA, 25 bp, Mus musculus
acccgcggcgcttactcgacgacac

SEQ ID NO: 237481 - DNA, 25 bp, Mus musculus
gccgacctcgcagctgcagtcccgc

SEQ ID NO: 237482 - DNA, 25 bp, Mus musculus
tgacctcgcgcccatgcgagcgccc

SEQ ID NO: 237483 - DNA, 25 bp, Mus musculus
cctgcccgggctggtagtgcccgta

SEQ ID NO: 237484 - DNA, 25 bp, Mus musculus
gtagtgcccgtagagctgtttattt

SEQ ID NO: 237485 - DNA, 25 bp, Mus musculus
gcccgtagagctgtttatttactca

SEQ ID NO: 237486 - DNA, 25 bp, Mus musculus
agctgtttatttactcacttccaaa

SEQ ID NO: 237487 - DNA, 25 bp, Mus musculus
tatttactcacttccaaaccacacg

SEQ ID NO: 237488 - DNA, 25 bp, Mus musculus
cgctcgctcgcaagctcactccaca

SEQ ID NO: 237489 - DNA, 25 bp, Mus musculus
atccgtaactttccctctcgctctc

SEQ ID NO: 237490 - DNA, 25 bp, Mus musculus
tcgctctccgaaaaccgggcttcga

SEQ ID NO: 237491 - DNA, 25 bp, Mus musculus
aaccgggcttcgagagacggagtca

SEQ ID NO: 237492 - DNA, 25 bp, Mus musculus
cttcgagagacggagtcagaccgcg

SEQ ID NO: 237493 - DNA, 25 bp, Mus musculus
cagaccgcggggcagtttatcccgc

SEQ ID NO: 237494 - DNA, 25 bp, Mus musculus
cgcggggcagtttatcccgctcgcg

SEQ ID NO: 237495 - DNA, 25 bp, Mus musculus
ccaggccgagccttgtgggaacttg

SEQ ID NO: 237496 - DNA, 25 bp, Mus musculus
gagagctcggcctgagcagtgtccc

SEQ ID NO: 237497 - DNA, 25 bp, Mus musculus
gggacccagagctccgctttctttc

SEQ ID NO: 237498 - DNA, 25 bp, Mus musculus
tccgggacggtcacgagaagtgtcc

SEQ ID NO: 237499 - DNA, 25 bp, Mus musculus
ccttagggacccagagctccgcttt

SEQ ID NO: 237500 - DNA, 25 bp, Mus musculus
tgtggctgcacttaaaccaaacggc

SEQ ID NO: 237501 - DNA, 25 bp, Mus musculus
agctccgctttctttcagggacccg

SEQ ID NO: 237502 - DNA, 25 bp, Mus musculus
tccatcgccccaagtgcagaggctg

SEQ ID NO: 237503 - DNA, 25 bp, Mus musculus
ccagagctccgctttctttcaggga

SEQ ID NO: 237504 - DNA, 25 bp, Mus musculus
ggctgcacttaaaccaaacggcctc

SEQ ID NO: 237505 - DNA, 25 bp, Mus musculus
gggtggtgtggctgcacttaaacca

SEQ ID NO: 237506 - DNA, 25 bp, Mus musculus
cctcagggaccctggacgtagctgg

SEQ ID NO: 237507 - DNA, 25 bp, Mus musculus
aggaggcagcgtctccctcagggac

SEQ ID NO: 237508 - DNA, 25 bp, Mus musculus
ttctttcagggacccggagagagcc

SEQ ID NO: 237509 - DNA, 25 bp, Mus musculus
agggcctgttacctcctccatcgcc

SEQ ID NO: 237510 - DNA, 25 bp, Mus musculus
caaatgtcatttctggcgtctgagc

SEQ ID NO: 237511 - DNA, 25 bp, Mus musculus
ccgcgagggcacaagcagccaagct

SEQ ID NO: 237512 - DNA, 25 bp, Mus musculus
ttaaaaacgctctcggcgttgcaga

SEQ ID NO: 237513 - DNA, 25 bp, Mus musculus
tgaccgccagaaaccgagcagcagc

SEQ ID NO: 237514 - DNA, 25 bp, Mus musculus
gacgcctgctgcagatgcgacggca

SEQ ID NO: 237515 - DNA, 25 bp, Mus musculus
gtccgctgagcacccggatcagctg

SEQ ID NO: 237516 - DNA, 25 bp, Mus musculus
ggtctctgagtctcccgcaagagcg

SEQ ID NO: 237517 - DNA, 25 bp, Mus musculus
cccgggagacgctggccaggtctct

SEQ ID NO: 237518 - DNA, 25 bp, Mus musculus
tcctttctgcagagctgggttctct

SEQ ID NO: 237519 - DNA, 25 bp, Mus musculus
ctgcagcacgcgagcttcctactta

SEQ ID NO: 237520 - DNA, 25 bp, Mus musculus
agctagttttcgtcgcacaaatgtc

SEQ ID NO: 237521 - DNA, 25 bp, Mus musculus
ttcctacttagagcagcactggctc

SEQ ID NO: 237522 - DNA, 25 bp, Mus musculus
ttctggcgtctgagccaccattcct

SEQ ID NO: 237523 - DNA, 25 bp, Mus musculus
gggacaggaactttgccctctcctc

SEQ ID NO: 237524 - DNA, 25 bp, Mus musculus
aggaccggcatgcttccgtgccatg

SEQ ID NO: 237525 - DNA, 25 bp, Mus musculus
gagctaggcgtaactctggccaata

SEQ ID NO: 237526 - DNA, 25 bp, Mus musculus
actagaagtaggtgtgtatgcccga

SEQ ID NO: 237527 - DNA, 25 bp, Mus musculus
cgggacgccagccaactagaagtag

SEQ ID NO: 237528 - DNA, 25 bp, Mus musculus
tcggagcctactctaccaggaagtg

SEQ ID NO: 237529 - DNA, 25 bp, Mus musculus
agcgccgcaggcaacgctagcaaca

SEQ ID NO: 237530 - DNA, 25 bp, Mus musculus
cgcagcagcctcatagccatggttc

SEQ ID NO: 237531 - DNA, 25 bp, Mus musculus
gacagagcgaccctagataacccta

SEQ ID NO: 237532 - DNA, 25 bp, Mus musculus
acgatgctgttcaccacgttcgtga

SEQ ID NO: 237533 - DNA, 25 bp, Mus musculus
gacgttgcttgggtctcttcccgac

SEQ ID NO: 237534 - DNA, 25 bp, Mus musculus
tgagcaaccgctgagcgcgcagatc

SEQ ID NO: 237535 - DNA, 25 bp, Mus musculus
tgtgcctttccgtacagtgtgagca

SEQ ID NO: 237536 - DNA, 25 bp, Mus musculus
atccgctaacgtatccttctctgtg

SEQ ID NO: 237537 - DNA, 25 bp, Mus musculus
gccatgcagtcggtcagagtcaaaa

SEQ ID NO: 237538 - DNA, 25 bp, Mus musculus
cagagcctaccctaccacccgattc

SEQ ID NO: 237539 - DNA, 25 bp, Mus musculus
ccagcccgccaacgtccagagccta

SEQ ID NO: 237540 - DNA, 25 bp, Mus musculus
ggctaccacaccaacttgcaccttg

SEQ ID NO: 237541 - DNA, 25 bp, Mus musculus
gcggcgatctcagcaggctaccaca

SEQ ID NO: 237542 - DNA, 25 bp, Mus musculus
cgaatccttcatcgcggcgatctca

SEQ ID NO: 237543 - DNA, 25 bp, Mus musculus
tactcggacgcgcaggaaaacccgc

SEQ ID NO: 237544 - DNA, 25 bp, Mus musculus
aggctcattcccttggcggcctgcg

SEQ ID NO: 237545 - DNA, 25 bp, Mus musculus
gcttcctaggctcattcccttggcg

SEQ ID NO: 237546 - DNA, 25 bp, Mus musculus
ggatcaccgcggaaacgcttccttg

SEQ ID NO: 237547 - DNA, 25 bp, Mus musculus
agggtctccaggatcaccgcggaaa

SEQ ID NO: 237548 - DNA, 25 bp, Mus musculus
gatgcaatcacccttccggaaaccg

SEQ ID NO: 237549 - DNA, 25 bp, Mus musculus
aggaggcgccctgctccacacctga

SEQ ID NO: 237550 - DNA, 25 bp, Mus musculus
cgcgcaggaaaacccgcgctggagt

SEQ ID NO: 237551 - DNA, 25 bp, Mus musculus
tccaggcggtctactcggacgcgca

SEQ ID NO: 237552 - DNA, 25 bp, Mus musculus
gctgagctttgtgctgtgtcactgc

SEQ ID NO: 237553 - DNA, 25 bp, Mus musculus
ggctgccctgtctttttcttgcagg

SEQ ID NO: 237554 - DNA, 25 bp, Mus musculus
gacggcccgcggactctagtccgag

SEQ ID NO: 237555 - DNA, 25 bp, Mus musculus
gctcctcccagactcgggtggggac

SEQ ID NO: 237556 - DNA, 25 bp, Mus musculus
ttgtctggctttttcggtctggctg

SEQ ID NO: 237557 - DNA, 25 bp, Mus musculus
tctttttcttgcaggtgttggccaa

SEQ ID NO: 237558 - DNA, 25 bp, Mus musculus
actctagtccgagggcttcgcgcga

SEQ ID NO: 237559 - DNA, 25 bp, Mus musculus
aggatggacccggacagcaacgagc

SEQ ID NO: 237560 - DNA, 25 bp, Mus musculus
tttgggagtgactgagagatcgatc

SEQ ID NO: 237561 - DNA, 25 bp, Mus musculus
ctgccctgagttatctaggggtttg

SEQ ID NO: 237562 - DNA, 25 bp, Mus musculus
gggtgtcgtctctgccctgagttat

SEQ ID NO: 237563 - DNA, 25 bp, Mus musculus
agagcatcgttggagacgcccagcc

SEQ ID NO: 237564 - DNA, 25 bp, Mus musculus
tgtccctatcctccaagagcatcgt

SEQ ID NO: 237565 - DNA, 25 bp, Mus musculus
ctagcaggtgcccattatttgtctg

SEQ ID NO: 237566 - DNA, 25 bp, Mus musculus
tgtaagcgtgcagatcagcccagtt

SEQ ID NO: 237567 - DNA, 25 bp, Mus musculus
agtttgggctggagactcgtcctcc

SEQ ID NO: 237568 - DNA, 25 bp, Mus musculus
ccgcctggatttgctgctgggcgct

SEQ ID NO: 237569 - DNA, 25 bp, Mus musculus
gctgctcaccctgcggcgggcgaaa

SEQ ID NO: 237570 - DNA, 25 bp, Mus musculus
agtccattcagtgccgggatgctgc

SEQ ID NO: 237571 - DNA, 25 bp, Mus musculus
aagagcacggtcctcgcttcccaga

SEQ ID NO: 237572 - DNA, 25 bp, Mus musculus
ccagaggaggcaagagcacggtcct

SEQ ID NO: 237573 - DNA, 25 bp, Mus musculus
ctgagcccagaggaggcaagagcac

SEQ ID NO: 237574 - DNA, 25 bp, Mus musculus
agcgtgcagatcagcccagttgagc

SEQ ID NO: 237575 - DNA, 25 bp, Mus musculus
ggccgagctgtaagcgtgcagatca

SEQ ID NO: 237576 - DNA, 25 bp, Mus musculus
cttcctgcgtgccaagaggtgagca

SEQ ID NO: 237577 - DNA, 25 bp, Mus musculus
caagaggtgagcagcaccgggtccc

SEQ ID NO: 237578 - DNA, 25 bp, Mus musculus
tcagcccagttgagctgagcccaga

SEQ ID NO: 237579 - DNA, 25 bp, Mus musculus
ttgggctggagactcgtcctcctct

SEQ ID NO: 237580 - DNA, 25 bp, Mus musculus
gagcgctccagtactcgccgggctt

SEQ ID NO: 237581 - DNA, 25 bp, Mus musculus
gtgttcctcccacggtccttgcatg

SEQ ID NO: 237582 - DNA, 25 bp, Mus musculus
cgctctgggtctggaagtccttcaa

SEQ ID NO: 237583 - DNA, 25 bp, Mus musculus
cttcgccgaggcacagaagtggatc

SEQ ID NO: 237584 - DNA, 25 bp, Mus musculus
cgagagcagcgacctcaggtccagc

SEQ ID NO: 237585 - DNA, 25 bp, Mus musculus
atcctccgcggccttcggaagactg

SEQ ID NO: 237586 - DNA, 25 bp, Mus musculus
ggaagactgagatcccttggcgttg

SEQ ID NO: 237587 - DNA, 25 bp, Mus musculus
gagctcgcaatctccgcttggtttg

SEQ ID NO: 237588 - DNA, 25 bp, Mus musculus
ccgcttggtttgcaagtgctgctac

SEQ ID NO: 237589 - DNA, 25 bp, Mus musculus
tgctgctacggaaagcgcagtgcga

SEQ ID NO: 237590 - DNA, 25 bp, Mus musculus
gagccgtagcgctgcaaaggctaca

SEQ ID NO: 237591 - DNA, 25 bp, Mus musculus
ctacaggggctcgagcttccagagc

SEQ ID NO: 237592 - DNA, 25 bp, Mus musculus
acactgcggtctagctgtgcgccca

SEQ ID NO: 237593 - DNA, 25 bp, Mus musculus
gctcctggcaggttatttttagttg

SEQ ID NO: 237594 - DNA, 25 bp, Mus musculus
cgcgctcctgcttgcgaaacttagc

SEQ ID NO: 237595 - DNA, 25 bp, Mus musculus
ctgtcgggatcagtgctcttggcct

SEQ ID NO: 237596 - DNA, 25 bp, Mus musculus
tcttggcctctttgctctcgtcgtc

SEQ ID NO: 237597 - DNA, 25 bp, Mus musculus
ctctttgctctcgtcgtcccgggag

SEQ ID NO: 237598 - DNA, 25 bp, Mus musculus
ttgctctcgtcgtcccgggaggagt

SEQ ID NO: 237599 - DNA, 25 bp, Mus musculus
tcgtcccgggaggagtcagacttct

SEQ ID NO: 237600 - DNA, 25 bp, Mus musculus
tcccgggaggagtcagacttcttcc

SEQ ID NO: 237601 - DNA, 25 bp, Mus musculus
aggagtcagacttcttcccggagga

SEQ ID NO: 237602 - DNA, 25 bp, Mus musculus
cagtgctgtcgggatcagtgctctt

SEQ ID NO: 237603 - DNA, 25 bp, Mus musculus
gctcctgcttgcgaaacttagcccg

SEQ ID NO: 237604 - DNA, 25 bp, Mus musculus
ggagtcagacttcttcccggaggag

SEQ ID NO: 237605 - DNA, 25 bp, Mus musculus
ctgcgcgctcctgcttgcgaaactt

SEQ ID NO: 237606 - DNA, 25 bp, Mus musculus
tgcgcgctcctgcttgcgaaactta

SEQ ID NO: 237607 - DNA, 25 bp, Mus musculus
cctgcttgcgaaacttagcccggcg

SEQ ID NO: 237608 - DNA, 25 bp, Mus musculus
cgctcgtgcgcataacactccaaat

SEQ ID NO: 237609 - DNA, 25 bp, Mus musculus
gccgctgcttgcgtttctcgttgag

SEQ ID NO: 237610 - DNA, 25 bp, Mus musculus
aatcccatttctgtgacgggcctgg

SEQ ID NO: 237611 - DNA, 25 bp, Mus musculus
ccctttggaaccgtaagcgtcagca

SEQ ID NO: 237612 - DNA, 25 bp, Mus musculus
cgtacctggactctcgcctcggtga

SEQ ID NO: 237613 - DNA, 25 bp, Mus musculus
ctcgcctcggtgaggtcgatcttca

SEQ ID NO: 237614 - DNA, 25 bp, Mus musculus
tgaggtcgatcttcagtgctagctc

SEQ ID NO: 237615 - DNA, 25 bp, Mus musculus
agtgctagctcttccctggtgtaga

SEQ ID NO: 237616 - DNA, 25 bp, Mus musculus
cttccctggtgtagatgtcagggta

SEQ ID NO: 237617 - DNA, 25 bp, Mus musculus
gtagtgcgtctcagcgaagaccctc

SEQ ID NO: 237618 - DNA, 25 bp, Mus musculus
tccaactctttgagctgcgcgcttg

SEQ ID NO: 237619 - DNA, 25 bp, Mus musculus
gcgcataacactccaaatcccattt

SEQ ID NO: 237620 - DNA, 25 bp, Mus musculus
ttgcgtttctcgttgaggccgccgt

SEQ ID NO: 237621 - DNA, 25 bp, Mus musculus
actctttgagctgcgcgcttgtgaa

SEQ ID NO: 237622 - DNA, 25 bp, Mus musculus
tcgcccttgctctggctcggttcaa

SEQ ID NO: 237623 - DNA, 25 bp, Mus musculus
tggctcggttcaacccgcgaacacc

SEQ ID NO: 237624 - DNA, 25 bp, Mus musculus
gctctggctcggttcaacccgcgaa

SEQ ID NO: 237625 - DNA, 25 bp, Mus musculus
agctccaagggcctcgcccttgctc

SEQ ID NO: 237626 - DNA, 25 bp, Mus musculus
cctgggttgcgagctccaagggcct

SEQ ID NO: 237627 - DNA, 25 bp, Mus musculus
ccacccgcctgggttgcgagctcca

SEQ ID NO: 237628 - DNA, 25 bp, Mus musculus
tgctcattagcatgctccccgagcg

SEQ ID NO: 237629 - DNA, 25 bp, Mus musculus
cctgcgcgctgctcattagcatgct

SEQ ID NO: 237630 - DNA, 25 bp, Mus musculus
tccctgcgcgctgctcattagcatg

SEQ ID NO: 237631 - DNA, 25 bp, Mus musculus
tgagtggcaccgtgtgcccccgccg

SEQ ID NO: 237632 - DNA, 25 bp, Mus musculus
cccgccggggcgcattccctgcgcg

SEQ ID NO: 237633 - DNA, 25 bp, Mus musculus
attccctgcgcgctgctcattagca

SEQ ID NO: 237634 - DNA, 25 bp, Mus musculus
tctggctcggttcaacccgcgaaca

SEQ ID NO: 237635 - DNA, 25 bp, Mus musculus
tgcgcgctgctcattagcatgctcc

SEQ ID NO: 237636 - DNA, 25 bp, Mus musculus
gcgattggatccgtattcctagttg

SEQ ID NO: 237637 - DNA, 25 bp, Mus musculus
tctccttagtaatcgcgcgggtcgg

SEQ ID NO: 237638 - DNA, 25 bp, Mus musculus
cagaggccgcgtctccttagtaatc

SEQ ID NO: 237639 - DNA, 25 bp, Mus musculus
ttcaaacggcgcagggccagcagcc

SEQ ID NO: 237640 - DNA, 25 bp, Mus musculus
tccgttttcaaacggcgcagggcca

SEQ ID NO: 237641 - DNA, 25 bp, Mus musculus
acccgctgatggatccgttttcaaa

SEQ ID NO: 237642 - DNA, 25 bp, Mus musculus
tttaaacgccgagtacccgctgatg

SEQ ID NO: 237643 - DNA, 25 bp, Mus musculus
tcccacaagttccttcagaaagacc

SEQ ID NO: 237644 - DNA, 25 bp, Mus musculus
gtcctttcccacaagttccttcaga

SEQ ID NO: 237645 - DNA, 25 bp, Mus musculus
gtcagctgaatagggccgcccgctt

SEQ ID NO: 237646 - DNA, 25 bp, Mus musculus
gcgtctttgactcgtcagctgaata

SEQ ID NO: 237647 - DNA, 25 bp, Mus musculus
cccatttagcgtctttgactcgtca

SEQ ID NO: 237648 - DNA, 25 bp, Mus musculus
tagttggggcgccttttgatgtccc

SEQ ID NO: 237649 - DNA, 25 bp, Mus musculus
gatccgtattcctagttggggcgcc

SEQ ID NO: 237650 - DNA, 25 bp, Mus musculus
ttctagaagccgctgcctgccggac

SEQ ID NO: 237651 - DNA, 25 bp, Mus musculus
tctttctagaaaggcagcttcggtc

SEQ ID NO: 237652 - DNA, 25 bp, Mus musculus
tgccggttaagacgaaagttgcctc

SEQ ID NO: 237653 - DNA, 25 bp, Mus musculus
ttcctgccggctctgaaagcaggtc

SEQ ID NO: 237654 - DNA, 25 bp, Mus musculus
cgagtgtctcccatggcggatacga

SEQ ID NO: 237655 - DNA, 25 bp, Mus musculus
aggagctccaagtttgtttcaaagg

SEQ ID NO: 237656 - DNA, 25 bp, Mus musculus
tttcaaaggcgacaacaggcagttc

SEQ ID NO: 237657 - DNA, 25 bp, Mus musculus
cacctgtcagctagggatgttggcc

SEQ ID NO: 237658 - DNA, 25 bp, Mus musculus
ttaaggcctttctccgaagctccgc

SEQ ID NO: 237659 - DNA, 25 bp, Mus musculus
cgaaaggatcacttccggttttgca

SEQ ID NO: 237660 - DNA, 25 bp, Mus musculus
cccgcctgactcacgtggaaacgaa

SEQ ID NO: 237661 - DNA, 25 bp, Mus musculus
ttaacatttccgtgccaattggctc

SEQ ID NO: 237662 - DNA, 25 bp, Mus musculus
aggaaaatcgcctgagtgccggtta

SEQ ID NO: 237663 - DNA, 25 bp, Mus musculus
ttctttgctgttgcagcgtcccggg

SEQ ID NO: 237664 - DNA, 25 bp, Mus musculus
cagacagagcctgccggtctcgcaa

SEQ ID NO: 237665 - DNA, 25 bp, Mus musculus
agtaccgcgacttcaaattttatgc

SEQ ID NO: 237666 - DNA, 25 bp, Mus musculus
gcacgcctctaattttgttatacta

SEQ ID NO: 237667 - DNA, 25 bp, Mus musculus
tgttatactacgaccgagaagcgga

SEQ ID NO: 237668 - DNA, 25 bp, Mus musculus
tgatcagcaaggtgaccacggtgtt

SEQ ID NO: 237669 - DNA, 25 bp, Mus musculus
ggacagaggcttaaaccctgccttc

SEQ ID NO: 237670 - DNA, 25 bp, Mus musculus
gcggcgcttcgtaagactgtctccc

SEQ ID NO: 237671 - DNA, 25 bp, Mus musculus
ggacacgacacggactcacaaatgc

SEQ ID NO: 237672 - DNA, 25 bp, Mus musculus
tccggtctatggagtcagttggcgc

SEQ ID NO: 237673 - DNA, 25 bp, Mus musculus
tctcgcaaggtcctcacaggtgtcc

SEQ ID NO: 237674 - DNA, 25 bp, Mus musculus
agacccggaggtcttagggcacatc

SEQ ID NO: 237675 - DNA, 25 bp, Mus musculus
tcgcggtgacccagggtgacccaaa

SEQ ID NO: 237676 - DNA, 25 bp, Mus musculus
atggcggattccaccagcttggagg

SEQ ID NO: 237677 - DNA, 25 bp, Mus musculus
tggcatattccgtcacttccgctgt

SEQ ID NO: 237678 - DNA, 25 bp, Mus musculus
atcagcggacctcactcgggctgct

SEQ ID NO: 237679 - DNA, 25 bp, Mus musculus
agcaaaccagacctagctctagagg

SEQ ID NO: 237680 - DNA, 25 bp, Mus musculus
ggggctaaatcagtctccaacaaag

SEQ ID NO: 237681 - DNA, 25 bp, Mus musculus
gcgctgtcaggagaacatagcccga

SEQ ID NO: 237682 - DNA, 25 bp, Mus musculus
catagcccgaccttaatgagaagtg

SEQ ID NO: 237683 - DNA, 25 bp, Mus musculus
ccaggtcggctggagcccaaagacc

SEQ ID NO: 237684 - DNA, 25 bp, Mus musculus
aagacccttgtccttgtcggctgcg

SEQ ID NO: 237685 - DNA, 25 bp, Mus musculus
caccgaccacacttgctgaatacag

SEQ ID NO: 237686 - DNA, 25 bp, Mus musculus
ctgaatacagctcgggtgcggcact

SEQ ID NO: 237687 - DNA, 25 bp, Mus musculus
accgccgcctacagagccttggtgg

SEQ ID NO: 237688 - DNA, 25 bp, Mus musculus
ggacagacgcttcactccacgcaga

SEQ ID NO: 237689 - DNA, 25 bp, Mus musculus
gcgctgcggctcaaagcatgcttcc

SEQ ID NO: 237690 - DNA, 25 bp, Mus musculus
catccagagagtccagcaaaccaga

SEQ ID NO: 237691 - DNA, 25 bp, Mus musculus
cactctgaaatgaggggcgctgtca

SEQ ID NO: 237692 - DNA, 25 bp, Mus musculus
cagtgcgtatgcagagtgcgaggtg

SEQ ID NO: 237693 - DNA, 25 bp, Mus musculus
cagagtggacacgtaatgcagtgcg

SEQ ID NO: 237694 - DNA, 25 bp, Mus musculus
tgcgaggtggcagagtggacgcgta

SEQ ID NO: 237695 - DNA, 25 bp, Mus musculus
gtggacgcgtaatgcagtgcgtatg

SEQ ID NO: 237696 - DNA, 25 bp, Mus musculus
gtggcagagtggacgcgtaatgcag

SEQ ID NO: 237697 - DNA, 25 bp, Mus musculus
tatgcagagtgcgaggtggcagagt

SEQ ID NO: 237698 - DNA, 25 bp, Mus musculus
tggcagagtggacgcgtaatgcagt

SEQ ID NO: 237699 - DNA, 25 bp, Mus musculus
cgtatgcagagtgcgaggtggcaga

SEQ ID NO: 237700 - DNA, 25 bp, Mus musculus
tggacgcgtaatgcagtgcgtatgc

SEQ ID NO: 237701 - DNA, 25 bp, Mus musculus
agtggacacgtaatgcagtgcgtat

SEQ ID NO: 237702 - DNA, 25 bp, Mus musculus
tggcagagtggacacgtaatgcagt

SEQ ID NO: 237703 - DNA, 25 bp, Mus musculus
gagtggacacgtaatgcagtgcgta

SEQ ID NO: 237704 - DNA, 25 bp, Mus musculus
tggacacgtaatgcagtgcgtatgc

SEQ ID NO: 237705 - DNA, 25 bp, Mus musculus
tgcagtgcgtatgcagagtgcgagg

SEQ ID NO: 237706 - DNA, 25 bp, Mus musculus
gccgcctgcatctcgggctccatgc

SEQ ID NO: 237707 - DNA, 25 bp, Mus musculus
caccttcggagctccgcaaagttgc

SEQ ID NO: 237708 - DNA, 25 bp, Mus musculus
cagaagttactactgcccgagcgta

SEQ ID NO: 237709 - DNA, 25 bp, Mus musculus
ctccgcaaagttgcggcccgggagt

SEQ ID NO: 237710 - DNA, 25 bp, Mus musculus
gggagtctgtacctgcactgagctc

SEQ ID NO: 237711 - DNA, 25 bp, Mus musculus
tactactgcccgagcgtagcacgct

SEQ ID NO: 237712 - DNA, 25 bp, Mus musculus
gcgacagctcgagcagagagggtct

SEQ ID NO: 237713 - DNA, 25 bp, Mus musculus
ccatgccgagtctgaggccctgccc

SEQ ID NO: 237714 - DNA, 25 bp, Mus musculus
tgtcgccgagcctggcatctccgag

SEQ ID NO: 237715 - DNA, 25 bp, Mus musculus
ggctgccgcccagcgctgattgaca

SEQ ID NO: 237716 - DNA, 25 bp, Mus musculus
cgcctcgccaatgcctggagggaga

SEQ ID NO: 237717 - DNA, 25 bp, Mus musculus
caagtgtttagggtaatatctgcta

SEQ ID NO: 237718 - DNA, 25 bp, Mus musculus
gggtaatatctgctaatgatgatgg

SEQ ID NO: 237719 - DNA, 25 bp, Mus musculus
tgtacctgcactgagctccaggctg

SEQ ID NO: 237720 - DNA, 25 bp, Mus musculus
aagcgggaccgtagtcttcctcatc

SEQ ID NO: 237721 - DNA, 25 bp, Mus musculus
tgtctcccgcctgcgtgacagtcag

SEQ ID NO: 237722 - DNA, 25 bp, Mus musculus
cccgtggaactcaagcgcggcgcaa

SEQ ID NO: 237723 - DNA, 25 bp, Mus musculus
catcgcggtgcacccgctgtgatta

SEQ ID NO: 237724 - DNA, 25 bp, Mus musculus
cctggctatgtgacagctaggtggc

SEQ ID NO: 237725 - DNA, 25 bp, Mus musculus
agggcggactttcctcaccctcgag

SEQ ID NO: 237726 - DNA, 25 bp, Mus musculus
cttcagacgccacgctcgtttttta

SEQ ID NO: 237727 - DNA, 25 bp, Mus musculus
ttaagggacgccctccaggcagagc

SEQ ID NO: 237728 - DNA, 25 bp, Mus musculus
gaacgcgttcttgaccgggaggtca

SEQ ID NO: 237729 - DNA, 25 bp, Mus musculus
gctgctaacccacgagaacgcgttc

SEQ ID NO: 237730 - DNA, 25 bp, Mus musculus
tcctagcgcgatgagcctggctaaa

SEQ ID NO: 237731 - DNA, 25 bp, Mus musculus
ggcgacagcccacgattgggacatt

SEQ ID NO: 237732 - DNA, 25 bp, Mus musculus
acctgcacgtggagagccaagctca

SEQ ID NO: 237733 - DNA, 25 bp, Mus musculus
cagcagcctggggaatactgccacg

SEQ ID NO: 237734 - DNA, 25 bp, Mus musculus
ctgcttggagcgtgcctttcctcac

SEQ ID NO: 237735 - DNA, 25 bp, Mus musculus
ttggagcgtgcctttcctcaccacg

SEQ ID NO: 237736 - DNA, 25 bp, Mus musculus
cctaagcgccaactggtgggtcact

SEQ ID NO: 237737 - DNA, 25 bp, Mus musculus
aagcgccaactggtgggtcactgtc

SEQ ID NO: 237738 - DNA, 25 bp, Mus musculus
ccaactggtgggtcactgtccgaga

SEQ ID NO: 237739 - DNA, 25 bp, Mus musculus
aactggtgggtcactgtccgagaga

SEQ ID NO: 237740 - DNA, 25 bp, Mus musculus
tcactgtccgagagagaggcgctgc

SEQ ID NO: 237741 - DNA, 25 bp, Mus musculus
cctgccttcccgcttggccgtagcc

SEQ ID NO: 237742 - DNA, 25 bp, Mus musculus
tggccgtagccgcggcctcattgct

SEQ ID NO: 237743 - DNA, 25 bp, Mus musculus
cctcattgctctgccagggccgcct

SEQ ID NO: 237744 - DNA, 25 bp, Mus musculus
ccggctgccgctccgaagaactcgc

SEQ ID NO: 237745 - DNA, 25 bp, Mus musculus
aagaactcgcgcctgtgcccgcggt

SEQ ID NO: 237746 - DNA, 25 bp, Mus musculus
gccctcctgcttggagcgtgccttt

SEQ ID NO: 237747 - DNA, 25 bp, Mus musculus
tcaccacgctcgctggcctaagcgc

SEQ ID NO: 237748 - DNA, 25 bp, Mus musculus
cccacccagggcagcgtcgccgcca

SEQ ID NO: 237749 - DNA, 25 bp, Mus musculus
atggtcggcatctcgacagcccctg

SEQ ID NO: 237750 - DNA, 25 bp, Mus musculus
acagcctcctgctgcggcggtcact

SEQ ID NO: 237751 - DNA, 25 bp, Mus musculus
atctagcattctcggcttctcggcc

SEQ ID NO: 237752 - DNA, 25 bp, Mus musculus
gggacttcgatctagcattctcggc

SEQ ID NO: 237753 - DNA, 25 bp, Mus musculus
ggaggggacttcgatctagcattct

SEQ ID NO: 237754 - DNA, 25 bp, Mus musculus
tcactcgctggcctcctggagtggg

SEQ ID NO: 237755 - DNA, 25 bp, Mus musculus
tgcgccgcgcagagggctcagctgc

SEQ ID NO: 237756 - DNA, 25 bp, Mus musculus
gtcctccgcatggtcggcatctcga

SEQ ID NO: 237757 - DNA, 25 bp, Mus musculus
actgtcctccgcatggtcggcatct

SEQ ID NO: 237758 - DNA, 25 bp, Mus musculus
gcgagcggatctccgacactgtcct

SEQ ID NO: 237759 - DNA, 25 bp, Mus musculus
cgcgcgagcggatctccgacactgt

SEQ ID NO: 237760 - DNA, 25 bp, Mus musculus
cggtcactcaccttccgcgcgcgag

SEQ ID NO: 237761 - DNA, 25 bp, Mus musculus
cagttcggaccgtaccatccgcggg

SEQ ID NO: 237762 - DNA, 25 bp, Mus musculus
accttgggcgacagcagcttgacca

SEQ ID NO: 237763 - DNA, 25 bp, Mus musculus
agactctcaggaatggacctccgcg

SEQ ID NO: 237764 - DNA, 25 bp, Mus musculus
tctgcctggttatctcgcaccgtgg

SEQ ID NO: 237765 - DNA, 25 bp, Mus musculus
tcgctctggcagcactcatcgttga

SEQ ID NO: 237766 - DNA, 25 bp, Mus musculus
ggctatgcgcccacacaccatgatg

SEQ ID NO: 237767 - DNA, 25 bp, Mus musculus
ccaggtcggtgagctgaaagaactc

SEQ ID NO: 237768 - DNA, 25 bp, Mus musculus
tctccttctcgggaaagtgctcggg

SEQ ID NO: 237769 - DNA, 25 bp, Mus musculus
tgtcgcgcaggtaatccagcacgta

SEQ ID NO: 237770 - DNA, 25 bp, Mus musculus
gtaacgtcgaatgcttggtcacata

SEQ ID NO: 237771 - DNA, 25 bp, Mus musculus
acattcagctccactacctcgggga

SEQ ID NO: 237772 - DNA, 25 bp, Mus musculus
gacaccatctcgctgatcgggagga

SEQ ID NO: 237773 - DNA, 25 bp, Mus musculus
tgcccgtgtccttcagagccatggt

SEQ ID NO: 237774 - DNA, 25 bp, Mus musculus
agagccgcacggagtgcttcccaga

SEQ ID NO: 237775 - DNA, 25 bp, Mus musculus
tgggaaacgttgtcctccaggtcgc

SEQ ID NO: 237776 - DNA, 25 bp, Mus musculus
ccgcgtagacgcgtcgacgtcataa

SEQ ID NO: 237777 - DNA, 25 bp, Mus musculus
cacatgcacggtgggcgagcatcct

SEQ ID NO: 237778 - DNA, 25 bp, Mus musculus
aaggtgcagggcttcagcacatgca

SEQ ID NO: 237779 - DNA, 25 bp, Mus musculus
cggccgagctcaaggtgaccatcac

SEQ ID NO: 237780 - DNA, 25 bp, Mus musculus
cgcgaccctggctttgtggtctccg

SEQ ID NO: 237781 - DNA, 25 bp, Mus musculus
tcgacgtcataagcggcgcgacctg

SEQ ID NO: 237782 - DNA, 25 bp, Mus musculus
acacgcgcttgaccggcagtatcac

SEQ ID NO: 237783 - DNA, 25 bp, Mus musculus
gctgtcacaccaggacacgcgcttg

SEQ ID NO: 237784 - DNA, 25 bp, Mus musculus
gtggctttctcaaggctgtcacacc

SEQ ID NO: 237785 - DNA, 25 bp, Mus musculus
ctccggtcgcctagactgtggcttt

SEQ ID NO: 237786 - DNA, 25 bp, Mus musculus
agagagtgatgcgacacccgactcc

SEQ ID NO: 237787 - DNA, 25 bp, Mus musculus
ccgctagctcctcggcttagggctg

SEQ ID NO: 237788 - DNA, 25 bp, Mus musculus
cttagggctggtgtagctcacgagc

SEQ ID NO: 237789 - DNA, 25 bp, Mus musculus
cgcatcagaagcgtgcccgctagct

SEQ ID NO: 237790 - DNA, 25 bp, Mus musculus
ttcactccgggtccgggaatctgcg

SEQ ID NO: 237791 - DNA, 25 bp, Mus musculus
cacaaacacaggaagggactcggga

SEQ ID NO: 237792 - DNA, 25 bp, Mus musculus
cccggatgcaaacacaaacacagga

SEQ ID NO: 237793 - DNA, 25 bp, Mus musculus
ggaagcctgagaacccggatgcaaa

SEQ ID NO: 237794 - DNA, 25 bp, Mus musculus
tgaggactgaggaagcctgagaacc

SEQ ID NO: 237795 - DNA, 25 bp, Mus musculus
cgccagcgactccagccggtgagga

SEQ ID NO: 237796 - DNA, 25 bp, Mus musculus
agagccggagctaacacacccagca

SEQ ID NO: 237797 - DNA, 25 bp, Mus musculus
ctcatccaacgaccgaagagccgga

SEQ ID NO: 237798 - DNA, 25 bp, Mus musculus
ccggcggacctacagcctcatccaa

SEQ ID NO: 237799 - DNA, 25 bp, Mus musculus
gcgctggaaacctcccgtggctcgg

SEQ ID NO: 237800 - DNA, 25 bp, Mus musculus
gtccgggaatctgcgacaacgagcc

SEQ ID NO: 237801 - DNA, 25 bp, Mus musculus
tgctagacttcactccgggtccggg

SEQ ID NO: 237802 - DNA, 25 bp, Mus musculus
aagccctgctagacttcactccggg

SEQ ID NO: 237803 - DNA, 25 bp, Mus musculus
tctgcgacaacgagccgcgtccaag

SEQ ID NO: 237804 - DNA, 25 bp, Mus musculus
gaaaccccgcgcgtctgctggagga

SEQ ID NO: 237805 - DNA, 25 bp, Mus musculus
acagccggggtagcgcggggcacca

SEQ ID NO: 237806 - DNA, 25 bp, Mus musculus
cacctggggcagcacagccggggta

SEQ ID NO: 237807 - DNA, 25 bp, Mus musculus
aggaagaggattaagaaggttccag

SEQ ID NO: 237808 - DNA, 25 bp, Mus musculus
cgaacgcgtccgtagtggcggtgat

SEQ ID NO: 237809 - DNA, 25 bp, Mus musculus
cgcgcatgcacgcagcagcgggcac

SEQ ID NO: 237810 - DNA, 25 bp, Mus musculus
tatgcgcgcatgcacgcagcagcgg

SEQ ID NO: 237811 - DNA, 25 bp, Mus musculus
gcgctatgcgcgcatgcacgcagca

SEQ ID NO: 237812 - DNA, 25 bp, Mus musculus
cggaagcgctatgcgcgcatgcacg

SEQ ID NO: 237813 - DNA, 25 bp, Mus musculus
cgcggaagcgctatgcgcgcatgca

SEQ ID NO: 237814 - DNA, 25 bp, Mus musculus
gagtagcgatcgcacgagccggggt

SEQ ID NO: 237815 - DNA, 25 bp, Mus musculus
aacatgaggagggagtagcgatcgc

SEQ ID NO: 237816 - DNA, 25 bp, Mus musculus
agtatgcggcgaacgcgtccgtagt

SEQ ID NO: 237817 - DNA, 25 bp, Mus musculus
cccaatcctggccaagccaccgccg

SEQ ID NO: 237818 - DNA, 25 bp, Mus musculus
gcacagcgcaatcgcgggtaccttc

SEQ ID NO: 237819 - DNA, 25 bp, Mus musculus
cggagcacagcgcaatcgcgggtac

SEQ ID NO: 237820 - DNA, 25 bp, Mus musculus
caatcgcgggtaccttctggacaga

SEQ ID NO: 237821 - DNA, 25 bp, Mus musculus
tcgcgggtaccttctggacagaaac

SEQ ID NO: 237822 - DNA, 25 bp, Mus musculus
cgggtaccttctggacagaaaccat

SEQ ID NO: 237823 - DNA, 25 bp, Mus musculus
agaaaccatcttcgcaacatgccat

SEQ ID NO: 237824 - DNA, 25 bp, Mus musculus
acatgccatactttaagcctgttca

SEQ ID NO: 237825 - DNA, 25 bp, Mus musculus
catactttaagcctgttcacgtttc

SEQ ID NO: 237826 - DNA, 25 bp, Mus musculus
tgttcacgtttccagcctctcgaga

SEQ ID NO: 237827 - DNA, 25 bp, Mus musculus
gtttccagcctctcgagatgccctg

SEQ ID NO: 237828 - DNA, 25 bp, Mus musculus
cagcctctcgagatgccctgggcag

SEQ ID NO: 237829 - DNA, 25 bp, Mus musculus
ctcgcgctcacactcgcccgcgctc

SEQ ID NO: 237830 - DNA, 25 bp, Mus musculus
cccgcgctcacactcgcccgcgctc

SEQ ID NO: 237831 - DNA, 25 bp, Mus musculus
ctcgcgcccagtgcgagcgagagcc

SEQ ID NO: 237832 - DNA, 25 bp, Mus musculus
cgtcctcgatcccaaagaggggtgt

SEQ ID NO: 237833 - DNA, 25 bp, Mus musculus
tccggagaggcgaacaaagggatga

SEQ ID NO: 237834 - DNA, 25 bp, Mus musculus
ccttcaactcggtgtccggagaggc

SEQ ID NO: 237835 - DNA, 25 bp, Mus musculus
ctgccttcaactcggtgtccggaga

SEQ ID NO: 237836 - DNA, 25 bp, Mus musculus
tttttcctgccttcaactcggtgtc

SEQ ID NO: 237837 - DNA, 25 bp, Mus musculus
ccgtctaatctttgatttccatcta

SEQ ID NO: 237838 - DNA, 25 bp, Mus musculus
gcctgcgaaaaagatttatgaggcg

SEQ ID NO: 237839 - DNA, 25 bp, Mus musculus
gtcaggcctgcgaaaaagatttatg

SEQ ID NO: 237840 - DNA, 25 bp, Mus musculus
cgtggcttttgtcaggcctgcgaaa

SEQ ID NO: 237841 - DNA, 25 bp, Mus musculus
gaactggaggacgtggcttttgtca

SEQ ID NO: 237842 - DNA, 25 bp, Mus musculus
ttctagattcccagggaactggagg

SEQ ID NO: 237843 - DNA, 25 bp, Mus musculus
cgataagtttctagattcccaggga

SEQ ID NO: 237844 - DNA, 25 bp, Mus musculus
tggcggtccggggatccccacataa

SEQ ID NO: 237845 - DNA, 25 bp, Mus musculus
aggagatcgataagtttctagattc

SEQ ID NO: 237846 - DNA, 25 bp, Mus musculus
ccacagtttgtattttcgacacaca

SEQ ID NO: 237847 - DNA, 25 bp, Mus musculus
actgtcgggctgtgcagggcaccat

SEQ ID NO: 237848 - DNA, 25 bp, Mus musculus
tctgagccttactttagccgggtct

SEQ ID NO: 237849 - DNA, 25 bp, Mus musculus
aggagacgtactccgcactattttg

SEQ ID NO: 237850 - DNA, 25 bp, Mus musculus
gcagtgctccgaaggagacgtactc

SEQ ID NO: 237851 - DNA, 25 bp, Mus musculus
tgcggatcgatgtcgccagcataga

SEQ ID NO: 237852 - DNA, 25 bp, Mus musculus
actccagtacacacactgtcggtcg

SEQ ID NO: 237853 - DNA, 25 bp, Mus musculus
ttcattggtggtcacctcggccctg

SEQ ID NO: 237854 - DNA, 25 bp, Mus musculus
cccgtcctctgcttttcattggtgg

SEQ ID NO: 237855 - DNA, 25 bp, Mus musculus
cgcagatgagaaatgaaccagttcc

SEQ ID NO: 237856 - DNA, 25 bp, Mus musculus
ccggccgagcttacgcagatgagaa

SEQ ID NO: 237857 - DNA, 25 bp, Mus musculus
atggtctcggaagtgaatatggtga

SEQ ID NO: 237858 - DNA, 25 bp, Mus musculus
tcgccagcatagacatggtctcgga

SEQ ID NO: 237859 - DNA, 25 bp, Mus musculus
gacacacacacaggctaccgcagtg

SEQ ID NO: 237860 - DNA, 25 bp, Mus musculus
cccgagctttctagaagcaagaaga

SEQ ID NO: 237861 - DNA, 25 bp, Mus musculus
atccgccggacctcacacagaaagg

SEQ ID NO: 237862 - DNA, 25 bp, Mus musculus
gacctcacacagaaaggggcgttcg

SEQ ID NO: 237863 - DNA, 25 bp, Mus musculus
ggcgttcgggagacctgaactcaaa

SEQ ID NO: 237864 - DNA, 25 bp, Mus musculus
gctctaccacccgagctttctagaa

SEQ ID NO: 237865 - DNA, 25 bp, Mus musculus
gcgtaaagtccttaggccgccattg

SEQ ID NO: 237866 - DNA, 25 bp, Mus musculus
tccaggggcccaagaagaatagtcc

SEQ ID NO: 237867 - DNA, 25 bp, Mus musculus
ggaggcagcttctgtagccgccaaa

SEQ ID NO: 237868 - DNA, 25 bp, Mus musculus
ttctgtagccgccaaagcggcgtcc

SEQ ID NO: 237869 - DNA, 25 bp, Mus musculus
cccgagaagtagagatacctgtcac

SEQ ID NO: 237870 - DNA, 25 bp, Mus musculus
tgtcacgtgacaggcctgaacctta

SEQ ID NO: 237871 - DNA, 25 bp, Mus musculus
tgaaccttaggcttacgctccgatt

SEQ ID NO: 237872 - DNA, 25 bp, Mus musculus
ttaggcttacgctccgattcgtcca

SEQ ID NO: 237873 - DNA, 25 bp, Mus musculus
cctgaactcaaagactgcggacgca

SEQ ID NO: 237874 - DNA, 25 bp, Mus musculus
cctggggactagaacgagccactga

SEQ ID NO: 237875 - DNA, 25 bp, Mus musculus
cgcgcagccaagaccgttcagtgca

SEQ ID NO: 237876 - DNA, 25 bp, Mus musculus
cctgtcccagagtaagttcgcgagc

SEQ ID NO: 237877 - DNA, 25 bp, Mus musculus
ttccagctctgagttgtgcggtgcc

SEQ ID NO: 237878 - DNA, 25 bp, Mus musculus
caaatgggatctagtcacggagcta

SEQ ID NO: 237879 - DNA, 25 bp, Mus musculus
atgcaggcttacgtctggagcaggc

SEQ ID NO: 237880 - DNA, 25 bp, Mus musculus
ggcggggctccaaagcaatccttcc

SEQ ID NO: 237881 - DNA, 25 bp, Mus musculus
actctgcaggagaggtagcatcgcc

SEQ ID NO: 237882 - DNA, 25 bp, Mus musculus
tagcatcgcccaggacaagagcagc

SEQ ID NO: 237883 - DNA, 25 bp, Mus musculus
gagctgacccgaacgctgaaggaaa

SEQ ID NO: 237884 - DNA, 25 bp, Mus musculus
tctccgacgccaagccacaggagtg

SEQ ID NO: 237885 - DNA, 25 bp, Mus musculus
gtgctcactgacctacggacgggaa

SEQ ID NO: 237886 - DNA, 25 bp, Mus musculus
cttaccctctttggggcgtcagctc

SEQ ID NO: 237887 - DNA, 25 bp, Mus musculus
ctgaaggaaaccctgcccatgactg

SEQ ID NO: 237888 - DNA, 25 bp, Mus musculus
cagaaacgcgaactgaccgtgcggc

SEQ ID NO: 237889 - DNA, 25 bp, Mus musculus
ctccatttcctgagaggggcactgc

SEQ ID NO: 237890 - DNA, 25 bp, Mus musculus
atccctgcagcggagagataaagga

SEQ ID NO: 237891 - DNA, 25 bp, Mus musculus
aagaagcacggagccacgaggagcc

SEQ ID NO: 237892 - DNA, 25 bp, Mus musculus
agccacgggaaattctcctcagcct

SEQ ID NO: 237893 - DNA, 25 bp, Mus musculus
cctcagcctcaggagaagtgcggta

SEQ ID NO: 237894 - DNA, 25 bp, Mus musculus
gcggccgggaaccaactgctgaagt

SEQ ID NO: 237895 - DNA, 25 bp, Mus musculus
cgcaccgaaaagctacgtctcctta

SEQ ID NO: 237896 - DNA, 25 bp, Mus musculus
tcccggaagagacgaaggaatgctc

SEQ ID NO: 237897 - DNA, 25 bp, Mus musculus
ttcccagagtgttccgaggctcatg

SEQ ID NO: 237898 - DNA, 25 bp, Mus musculus
tcatgaaaagtagacgcctccgttg

SEQ ID NO: 237899 - DNA, 25 bp, Mus musculus
tactggcggctgctcccaggaaata

SEQ ID NO: 237900 - DNA, 25 bp, Mus musculus
agcgccaccaaaagggactccattt

SEQ ID NO: 237901 - DNA, 25 bp, Mus musculus
ctgctgaagtggaccgcaccgaaaa

SEQ ID NO: 237902 - DNA, 25 bp, Mus musculus
cgtgggctggagacacttcctagaa

SEQ ID NO: 237903 - DNA, 25 bp, Mus musculus
ttatcgagaggagaggcgaatacga

SEQ ID NO: 237904 - DNA, 25 bp, Mus musculus
cttctaattatcgagaggagaggcg

SEQ ID NO: 237905 - DNA, 25 bp, Mus musculus
cttgcttctaattatcgagaggaga

SEQ ID NO: 237906 - DNA, 25 bp, Mus musculus
cgcaagtggcacttcttgcttctaa

SEQ ID NO: 237907 - DNA, 25 bp, Mus musculus
ctcctggcgcaagtggcacttcttg

SEQ ID NO: 237908 - DNA, 25 bp, Mus musculus
tggatcccgcgctcctggcgcaagt

SEQ ID NO: 237909 - DNA, 25 bp, Mus musculus
aacagagcgctgacaggcggcatcc

SEQ ID NO: 237910 - DNA, 25 bp, Mus musculus
ctttcctgtaaacagagcgctgaca

SEQ ID NO: 237911 - DNA, 25 bp, Mus musculus
ccctgcctgaactttcctgtaaaca

SEQ ID NO: 237912 - DNA, 25 bp, Mus musculus
gcgggctcaaccctgcctgaacttt

SEQ ID NO: 237913 - DNA, 25 bp, Mus musculus
acttcctagaaacgcgcgcgggctc

SEQ ID NO: 237914 - DNA, 25 bp, Mus musculus
gaggcgaatacgaactagctgctcg

SEQ ID NO: 237915 - DNA, 25 bp, Mus musculus
tggagacacttcctagaaacgcgcg

SEQ ID NO: 237916 - DNA, 25 bp, Mus musculus
gcaggcgctccttgtcctgctccgt

SEQ ID NO: 237917 - DNA, 25 bp, Mus musculus
cccgcaacctccagtgaggaggaga

SEQ ID NO: 237918 - DNA, 25 bp, Mus musculus
ctcccgcaacctccagtgaggagga

SEQ ID NO: 237919 - DNA, 25 bp, Mus musculus
tgcagcctgaacatcgccctcctcg

SEQ ID NO: 237920 - DNA, 25 bp, Mus musculus
cggcctgccctgcagcctgaacatc

SEQ ID NO: 237921 - DNA, 25 bp, Mus musculus
aggacatggctcctcgctcccaggc

SEQ ID NO: 237922 - DNA, 25 bp, Mus musculus
tgcggcaggacatggctcctcgctc

SEQ ID NO: 237923 - DNA, 25 bp, Mus musculus
atctctgcggcaggacatggctcct

SEQ ID NO: 237924 - DNA, 25 bp, Mus musculus
ccatctctgcggcaggacatggctc

SEQ ID NO: 237925 - DNA, 25 bp, Mus musculus
tctcgaggggcatccgaatcaccgg

SEQ ID NO: 237926 - DNA, 25 bp, Mus musculus
ggtctcgaggggcatccgaatcacc

SEQ ID NO: 237927 - DNA, 25 bp, Mus musculus
gcctggtctcgaggggcatccgaat

SEQ ID NO: 237928 - DNA, 25 bp, Mus musculus
cctccagtgaggaggagaggccaca

SEQ ID NO: 237929 - DNA, 25 bp, Mus musculus
cgctccttgtcctgctccgtgcttt

SEQ ID NO: 237930 - DNA, 25 bp, Mus musculus
cgagtgaacactgcaccgaggcgtc

SEQ ID NO: 237931 - DNA, 25 bp, Mus musculus
acactgttccggtcctccggtggtg

SEQ ID NO: 237932 - DNA, 25 bp, Mus musculus
gtctgccaggatcgcggggatctcc

SEQ ID NO: 237933 - DNA, 25 bp, Mus musculus
tgcggcgcccgagtgaacactgcac

SEQ ID NO: 237934 - DNA, 25 bp, Mus musculus
aacactgcaccgaggcgtcgcggcg

SEQ ID NO: 237935 - DNA, 25 bp, Mus musculus
tgaccgaccggggacccatccgcga

SEQ ID NO: 237936 - DNA, 25 bp, Mus musculus
ccatccgcgacagcagggccatgag

SEQ ID NO: 237937 - DNA, 25 bp, Mus musculus
cagcagggccatgagctgtgcccgc

SEQ ID NO: 237938 - DNA, 25 bp, Mus musculus
tactccgcggccatgagctgtctgt

SEQ ID NO: 237939 - DNA, 25 bp, Mus musculus
cgcggccatgagctgtctgtagccg

SEQ ID NO: 237940 - DNA, 25 bp, Mus musculus
cccggctttggtggcctgcggataa

SEQ ID NO: 237941 - DNA, 25 bp, Mus musculus
cccaggcagccatcagcgcagccca

SEQ ID NO: 237942 - DNA, 25 bp, Mus musculus
tcaccggggtcctgagccatctctg

SEQ ID NO: 237943 - DNA, 25 bp, Mus musculus
cgggttcacctgcaccgcagcgtca

SEQ ID NO: 237944 - DNA, 25 bp, Mus musculus
tcgcctcgaggttaagctgatgctt

SEQ ID NO: 237945 - DNA, 25 bp, Mus musculus
tggccttgggagacatggtgaggtt

SEQ ID NO: 237946 - DNA, 25 bp, Mus musculus
cgagaggcgagagggtgctggcctt

SEQ ID NO: 237947 - DNA, 25 bp, Mus musculus
ttaagctgatgcttgggctcggagc

SEQ ID NO: 237948 - DNA, 25 bp, Mus musculus
cgaggttaagctgatgcttgggctc

SEQ ID NO: 237949 - DNA, 25 bp, Mus musculus
ctcgaggttaagctgatgcttgggc

SEQ ID NO: 237950 - DNA, 25 bp, Mus musculus
cgcctcgaggttaagctgatgcttg

SEQ ID NO: 237951 - DNA, 25 bp, Mus musculus
gtcgcctcgaggttaagctgatgct

SEQ ID NO: 237952 - DNA, 25 bp, Mus musculus
tgtcgcctcgaggttaagctgatgc

SEQ ID NO: 237953 - DNA, 25 bp, Mus musculus
gtgtcgcctcgaggttaagctgatg

SEQ ID NO: 237954 - DNA, 25 bp, Mus musculus
ggtgtcgcctcgaggttaagctgat

SEQ ID NO: 237955 - DNA, 25 bp, Mus musculus
aatgggggctcgtggaagattcagg

SEQ ID NO: 237956 - DNA, 25 bp, Mus musculus
gcctcgaggttaagctgatgcttgg

SEQ ID NO: 237957 - DNA, 25 bp, Mus musculus
tggtgtcgcctcgaggttaagctga

SEQ ID NO: 237958 - DNA, 25 bp, Mus musculus
cgcagccagcagagcgcccacgggc

SEQ ID NO: 237959 - DNA, 25 bp, Mus musculus
acctgtctgtctggtcaagcgtccc

SEQ ID NO: 237960 - DNA, 25 bp, Mus musculus
ctgtggtcccttttacctgtctgtc

SEQ ID NO: 237961 - DNA, 25 bp, Mus musculus
tcctgtggtcccttttacctgtctg

SEQ ID NO: 237962 - DNA, 25 bp, Mus musculus
acacctcctccctcggtcctgtggt

SEQ ID NO: 237963 - DNA, 25 bp, Mus musculus
gactagaggtgacagcgagaggcga

SEQ ID NO: 237964 - DNA, 25 bp, Mus musculus
tggttgagcggcgtgtcccagaatg

SEQ ID NO: 237965 - DNA, 25 bp, Mus musculus
acattcagcccgtggttgagcggcg

SEQ ID NO: 237966 - DNA, 25 bp, Mus musculus
cacaaacacattcagcccgtggttg

SEQ ID NO: 237967 - DNA, 25 bp, Mus musculus
aggcggcgcccacaaacacattcag

SEQ ID NO: 237968 - DNA, 25 bp, Mus musculus
ggtgatgcacaaggcggcgcccaca

SEQ ID NO: 237969 - DNA, 25 bp, Mus musculus
acccagcatggtgatgcacaaggcg

SEQ ID NO: 237970 - DNA, 25 bp, Mus musculus
cctagacccagcatggtgatgcaca

SEQ ID NO: 237971 - DNA, 25 bp, Mus musculus
gtacagcctagacccagcatggtga

SEQ ID NO: 237972 - DNA, 25 bp, Mus musculus
gcgtgccgagacaagccaagacaga

SEQ ID NO: 237973 - DNA, 25 bp, Mus musculus
cggagagccggtagcaatagcactt

SEQ ID NO: 237974 - DNA, 25 bp, Mus musculus
agaaccgtccagaaaaatgctcctt

SEQ ID NO: 237975 - DNA, 25 bp, Mus musculus
gtccggacttcccatcctaagagaa

SEQ ID NO: 237976 - DNA, 25 bp, Mus musculus
tggggtctctctaagtccggacttc

SEQ ID NO: 237977 - DNA, 25 bp, Mus musculus
ctcttatccagacagacgcggcgtg

SEQ ID NO: 237978 - DNA, 25 bp, Mus musculus
aagttccagggagcgtctcttatcc

SEQ ID NO: 237979 - DNA, 25 bp, Mus musculus
cttccgcgatttcaaagccaaaggg

SEQ ID NO: 237980 - DNA, 25 bp, Mus musculus
ggcaagcgctgaccaaacccatcgg

SEQ ID NO: 237981 - DNA, 25 bp, Mus musculus
ccaagacagagcgacgtccaaactg

SEQ ID NO: 237982 - DNA, 25 bp, Mus musculus
cgagagtcccttggttcttaccttg

SEQ ID NO: 237983 - DNA, 25 bp, Mus musculus
gcacttgtgggtggctaagaaccga

SEQ ID NO: 237984 - DNA, 25 bp, Mus musculus
ttcttaccttgacggagcgcgtgcc

SEQ ID NO: 237985 - DNA, 25 bp, Mus musculus
cgacgtccaaactgcggagcccgga

SEQ ID NO: 237986 - DNA, 25 bp, Mus musculus
gcttagttctttcagcccgcgggcg

SEQ ID NO: 237987 - DNA, 25 bp, Mus musculus
agcccagctcgggtcggcgtgtcca

SEQ ID NO: 237988 - DNA, 25 bp, Mus musculus
cccgacgagctggagcgcttgtcag

SEQ ID NO: 237989 - DNA, 25 bp, Mus musculus
acacccgcccgcgatgagctttggg

SEQ ID NO: 237990 - DNA, 25 bp, Mus musculus
agccgggcgcttagttctttcagcc

SEQ ID NO: 237991 - DNA, 25 bp, Mus musculus
acgctctgaggtcaccgaccgggct

SEQ ID NO: 237992 - DNA, 25 bp, Mus musculus
aagatggctgccgaggccggatatt

SEQ ID NO: 237993 - DNA, 25 bp, Mus musculus
gaggccggatattggcgccgcctcc

SEQ ID NO: 237994 - DNA, 25 bp, Mus musculus
tatgccggcgcctcggctagcgtga

SEQ ID NO: 237995 - DNA, 25 bp, Mus musculus
agcggtggcggtaacgcctctcttt

SEQ ID NO: 237996 - DNA, 25 bp, Mus musculus
ggccggcatggaggacgttaactcc

SEQ ID NO: 237997 - DNA, 25 bp, Mus musculus
aactccaatgtgaacgcggaccagg

SEQ ID NO: 237998 - DNA, 25 bp, Mus musculus
agccgtgcagggtgcaggcctcctc

SEQ ID NO: 237999 - DNA, 25 bp, Mus musculus
aactccagcgatagcttagcccagc

SEQ ID NO: 238000 - DNA, 25 bp, Mus musculus
gctccaagtccaagcatcggcttta

SEQ ID NO: 238001 - DNA, 25 bp, Mus musculus
gctctgccagttcggcttcttgccg

SEQ ID NO: 238002 - DNA, 25 bp, Mus musculus
ctgcgctctgccagttcggcttctt

SEQ ID NO: 238003 - DNA, 25 bp, Mus musculus
cctggatcccccacgagcccccatt

SEQ ID NO: 238004 - DNA, 25 bp, Mus musculus
gcaaccccgactccagagcccacga

SEQ ID NO: 238005 - DNA, 25 bp, Mus musculus
aagcatcggctttagccccgaggca

SEQ ID NO: 238006 - DNA, 25 bp, Mus musculus
caagtccaagcatcggctttagccc

SEQ ID NO: 238007 - DNA, 25 bp, Mus musculus
tccaagtccaagcatcggctttagc

SEQ ID NO: 238008 - DNA, 25 bp, Mus musculus
cgctccaagtccaagcatcggcttt

SEQ ID NO: 238009 - DNA, 25 bp, Mus musculus
tcgctccaagtccaagcatcggctt

SEQ ID NO: 238010 - DNA, 25 bp, Mus musculus
agcgccagcaccctttcgcctctcg

SEQ ID NO: 238011 - DNA, 25 bp, Mus musculus
cctgtctcccaacgccggcagcccg

SEQ ID NO: 238012 - DNA, 25 bp, Mus musculus
ctcaccctgtctcccaacgccggca

SEQ ID NO: 238013 - DNA, 25 bp, Mus musculus
ccaagtccaagcatcggctttagcc

SEQ ID NO: 238014 - DNA, 25 bp, Mus musculus
accacaggaccgagggaggaggtgt

SEQ ID NO: 238015 - DNA, 25 bp, Mus musculus
ggacgcttgaccagacagacaggta

SEQ ID NO: 238016 - DNA, 25 bp, Mus musculus
cagacaggtaaaagggaccacagga

SEQ ID NO: 238017 - DNA, 25 bp, Mus musculus
tcgcctctcgctgtcacctctagtc

SEQ ID NO: 238018 - DNA, 25 bp, Mus musculus
tccagagcccacgagcagcagcctc

SEQ ID NO: 238019 - DNA, 25 bp, Mus musculus
cccattctgggacacgccgctcaac

SEQ ID NO: 238020 - DNA, 25 bp, Mus musculus
cgccgctcaaccacgggctgaatgt

SEQ ID NO: 238021 - DNA, 25 bp, Mus musculus
ctcaaccacgggctgaatgtgtttg

SEQ ID NO: 238022 - DNA, 25 bp, Mus musculus
ctgaatgtgtttgtgggcgccgcct

SEQ ID NO: 238023 - DNA, 25 bp, Mus musculus
tgggcgccgccttgtgcatcaccat

SEQ ID NO: 238024 - DNA, 25 bp, Mus musculus
gccgccttgtgcatcaccatgctgg

SEQ ID NO: 238025 - DNA, 25 bp, Mus musculus
cttgtgcatcaccatgctgggtcta

SEQ ID NO: 238026 - DNA, 25 bp, Mus musculus
tcaccatgctgggtctaggctgtac

SEQ ID NO: 238027 - DNA, 25 bp, Mus musculus
acgccgcggggacgcttgaccagac

SEQ ID NO: 238028 - DNA, 25 bp, Mus musculus
agattccactcgcagcttccaaacg

SEQ ID NO: 238029 - DNA, 25 bp, Mus musculus
taaacgagattccactcgcagcttc

SEQ ID NO: 238030 - DNA, 25 bp, Mus musculus
gtttttaaacgagattccactcgca

SEQ ID NO: 238031 - DNA, 25 bp, Mus musculus
cgacgaagatggatacttggtgtgc

SEQ ID NO: 238032 - DNA, 25 bp, Mus musculus
cccaactacgacgaagatggatact

SEQ ID NO: 238033 - DNA, 25 bp, Mus musculus
gggtagggaagtcacactcttcctc

SEQ ID NO: 238034 - DNA, 25 bp, Mus musculus
ctctgggtagggaagtcacactctt

SEQ ID NO: 238035 - DNA, 25 bp, Mus musculus
caaccagactctgggtagggaagtc

SEQ ID NO: 238036 - DNA, 25 bp, Mus musculus
ggatccgtgctcaaccagactctgg

SEQ ID NO: 238037 - DNA, 25 bp, Mus musculus
tctcctcggcgggatccgtgctcaa

SEQ ID NO: 238038 - DNA, 25 bp, Mus musculus
ccacaattaaggatcgctttgtccc

SEQ ID NO: 238039 - DNA, 25 bp, Mus musculus
tccgtgctcaaccagactctgggta

SEQ ID NO: 238040 - DNA, 25 bp, Mus musculus
attaaggatcgctttgtcccagaaa

SEQ ID NO: 238041 - DNA, 25 bp, Mus musculus
ccagactctgggtagggaagtcaca

SEQ ID NO: 238042 - DNA, 25 bp, Mus musculus
ggagatccccgcgatcctggcagac

SEQ ID NO: 238043 - DNA, 25 bp, Mus musculus
gctacagacagctcatggccgcgga

SEQ ID NO: 238044 - DNA, 25 bp, Mus musculus
acgcacccatgttcccggcgagcac

SEQ ID NO: 238045 - DNA, 25 bp, Mus musculus
atgttcccggcgagcacgttccacc

SEQ ID NO: 238046 - DNA, 25 bp, Mus musculus
tgcccgcatccttatccgcaggcca

SEQ ID NO: 238047 - DNA, 25 bp, Mus musculus
ttatccgcaggccaccaaagccggg

SEQ ID NO: 238048 - DNA, 25 bp, Mus musculus
cgggcacagctcatggccctgctgt

SEQ ID NO: 238049 - DNA, 25 bp, Mus musculus
agctcatggccctgctgtcgcggat

SEQ ID NO: 238050 - DNA, 25 bp, Mus musculus
tgacgctgcggtgcaggtgaacccg

SEQ ID NO: 238051 - DNA, 25 bp, Mus musculus
cgcgacgcctcggtgcagtgttcac

SEQ ID NO: 238052 - DNA, 25 bp, Mus musculus
tgcagtgttcactcgggcgccgcac

SEQ ID NO: 238053 - DNA, 25 bp, Mus musculus
caggccaccaaagccggggatggct

SEQ ID NO: 238054 - DNA, 25 bp, Mus musculus
acgcctcggtgcagtgttcactcgg

SEQ ID NO: 238055 - DNA, 25 bp, Mus musculus
cagacagctcatggccgcggagtac

SEQ ID NO: 238056 - DNA, 25 bp, Mus musculus
tacccgtaggattcatcgtcggttc

SEQ ID NO: 238057 - DNA, 25 bp, Mus musculus
attcatcgtcggttccgttctggcg

SEQ ID NO: 238058 - DNA, 25 bp, Mus musculus
tccgttctggcgtcggtaccagtca

SEQ ID NO: 238059 - DNA, 25 bp, Mus musculus
tggcgtcggtaccagtcaaacaggg

SEQ ID NO: 238060 - DNA, 25 bp, Mus musculus
taccagtcaaacagggttcggagta

SEQ ID NO: 238061 - DNA, 25 bp, Mus musculus
acagtgctcggctacggagctcata

SEQ ID NO: 238062 - DNA, 25 bp, Mus musculus
tcggctacggagctcatagagctta

SEQ ID NO: 238063 - DNA, 25 bp, Mus musculus
agagcttaccaactgaaaggcaaga

SEQ ID NO: 238064 - DNA, 25 bp, Mus musculus
atggccgggtgtgatacgcgtaaca

SEQ ID NO: 238065 - DNA, 25 bp, Mus musculus
gtgatacgcgtaacagcggcagaca

SEQ ID NO: 238066 - DNA, 25 bp, Mus musculus
gtaacagcggcagacagcaacctcc

SEQ ID NO: 238067 - DNA, 25 bp, Mus musculus
ggaaatgcagagaggagaacgtcct

SEQ ID NO: 238068 - DNA, 25 bp, Mus musculus
aggagaacgtcctcgataaaaatcg

SEQ ID NO: 238069 - DNA, 25 bp, Mus musculus
cctaggcctgtacccgtaggattca

SEQ ID NO: 238070 - DNA, 25 bp, Mus musculus
cagctccgacgggctttcggttgac

SEQ ID NO: 238071 - DNA, 25 bp, Mus musculus
ttaaccggatttctgtctctcccag

SEQ ID NO: 238072 - DNA, 25 bp, Mus musculus
tggttaaacctccctccgactctga

SEQ ID NO: 238073 - DNA, 25 bp, Mus musculus
atccgatcgggaccgattcgtggtt

SEQ ID NO: 238074 - DNA, 25 bp, Mus musculus
aggaataatccgatcgggaccgatt

SEQ ID NO: 238075 - DNA, 25 bp, Mus musculus
agaaagtgaaatgaagcgcctttcc

SEQ ID NO: 238076 - DNA, 25 bp, Mus musculus
tccctcgcggctcgcagcaagaagg

SEQ ID NO: 238077 - DNA, 25 bp, Mus musculus
cccagcaccgcaagcagtgggcgga

SEQ ID NO: 238078 - DNA, 25 bp, Mus musculus
tgaacccgcggcgtgcgaaccaagc

SEQ ID NO: 238079 - DNA, 25 bp, Mus musculus
atgatcaacccagcagtagcgcctg

SEQ ID NO: 238080 - DNA, 25 bp, Mus musculus
gtcggatgatcaacccagcagtagc

SEQ ID NO: 238081 - DNA, 25 bp, Mus musculus
cttcagccgggtcggatgatcaacc

SEQ ID NO: 238082 - DNA, 25 bp, Mus musculus
tgcccccgcgctggaagagaaagtg

SEQ ID NO: 238083 - DNA, 25 bp, Mus musculus
tgccggcaccttcagccgggtcgga

SEQ ID NO: 238084 - DNA, 25 bp, Mus musculus
cgtcaagggtactgcttccgggtgt

SEQ ID NO: 238085 - DNA, 25 bp, Mus musculus
ctgcccggaggtgtccggtcgcact

SEQ ID NO: 238086 - DNA, 25 bp, Mus musculus
ccgccattttcctgcccggaggtgt

SEQ ID NO: 238087 - DNA, 25 bp, Mus musculus
tggtggcgcggctttccgccagtct

SEQ ID NO: 238088 - DNA, 25 bp, Mus musculus
agcgttgccgcctccatcgtgaggt

SEQ ID NO: 238089 - DNA, 25 bp, Mus musculus
tgtgcctgtctctggggtcctctcc

SEQ ID NO: 238090 - DNA, 25 bp, Mus musculus
ttcccgcgttgtccgctgtgcctgt

SEQ ID NO: 238091 - DNA, 25 bp, Mus musculus
gtgggtgacatcttggcgatcgctt

SEQ ID NO: 238092 - DNA, 25 bp, Mus musculus
gctgtcctgacgtcatttcccgtca

SEQ ID NO: 238093 - DNA, 25 bp, Mus musculus
gtttcccagcgctgtcctgacgtca

SEQ ID NO: 238094 - DNA, 25 bp, Mus musculus
gtattgagaaactggcccgccgctg

SEQ ID NO: 238095 - DNA, 25 bp, Mus musculus
tccgtgagtattgagaaactggccc

SEQ ID NO: 238096 - DNA, 25 bp, Mus musculus
ggcgtgatcgacatccgtgagtatt

SEQ ID NO: 238097 - DNA, 25 bp, Mus musculus
ggcgatcgcttggaagctgccctct

SEQ ID NO: 238098 - DNA, 25 bp, Mus musculus
agcgaaggagaccagaccagataga

SEQ ID NO: 238099 - DNA, 25 bp, Mus musculus
ccaccctggatggaagcgaaggaga

SEQ ID NO: 238100 - DNA, 25 bp, Mus musculus
tgcttatcttatcttccaccctgga

SEQ ID NO: 238101 - DNA, 25 bp, Mus musculus
tccgggaatggagatgcttatctta

SEQ ID NO: 238102 - DNA, 25 bp, Mus musculus
gcgcaaactggctgggcttgttccc

SEQ ID NO: 238103 - DNA, 25 bp, Mus musculus
taagtcgaggctgtcctggcgcaaa

SEQ ID NO: 238104 - DNA, 25 bp, Mus musculus
ccctgaagaccttgctgggtaagtc

SEQ ID NO: 238105 - DNA, 25 bp, Mus musculus
gtggagagcaattgccctgaagacc

SEQ ID NO: 238106 - DNA, 25 bp, Mus musculus
ccaggcctgtggagagcaattgccc

SEQ ID NO: 238107 - DNA, 25 bp, Mus musculus
gtggtcgcagtcatgccaggcctgt

SEQ ID NO: 238108 - DNA, 25 bp, Mus musculus
cctctcggctttccgggtggtcgca

SEQ ID NO: 238109 - DNA, 25 bp, Mus musculus
ccgcgagctactcggggacaccgag

SEQ ID NO: 238110 - DNA, 25 bp, Mus musculus
accagatagaggttccctggcccgg

SEQ ID NO: 238111 - DNA, 25 bp, Mus musculus
ctcagacccgcgagctactcgggga

SEQ ID NO: 238112 - DNA, 25 bp, Mus musculus
agaagcttccctggcgctgtccaac

SEQ ID NO: 238113 - DNA, 25 bp, Mus musculus
cacagcctgcggactggtctgagct

SEQ ID NO: 238114 - DNA, 25 bp, Mus musculus
cgggcttctgcaccgggacgtgtcc

SEQ ID NO: 238115 - DNA, 25 bp, Mus musculus
gtcccgccgagccatgggcaacgag

SEQ ID NO: 238116 - DNA, 25 bp, Mus musculus
gaggagacagatcgctgctgtcatg

SEQ ID NO: 238117 - DNA, 25 bp, Mus musculus
tcgctgctgtcatgtcaagggcgca

SEQ ID NO: 238118 - DNA, 25 bp, Mus musculus
tgcggagtcgccctccatgcacagg

SEQ ID NO: 238119 - DNA, 25 bp, Mus musculus
tgcacaggcacgcacagcatgatgg

SEQ ID NO: 238120 - DNA, 25 bp, Mus musculus
tgatggagaggtccaagcatatata

SEQ ID NO: 238121 - DNA, 25 bp, Mus musculus
agcatatatataccgcttcccgtgc

SEQ ID NO: 238122 - DNA, 25 bp, Mus musculus
cgcttcccgtgcacgtacgtgtatg

SEQ ID NO: 238123 - DNA, 25 bp, Mus musculus
acgtacgtgtatgtgcccgcacggt

SEQ ID NO: 238124 - DNA, 25 bp, Mus musculus
cccgcacggtggtacatatatgtcg

SEQ ID NO: 238125 - DNA, 25 bp, Mus musculus
gctgtccaacatggaggagctgccc

SEQ ID NO: 238126 - DNA, 25 bp, Mus musculus
taggaggggaccaccattgagcctc

SEQ ID NO: 238127 - DNA, 25 bp, Mus musculus
caccattgagcctcggggtgcactg

SEQ ID NO: 238128 - DNA, 25 bp, Mus musculus
gcccgaaaatgcactcggatgctgc

SEQ ID NO: 238129 - DNA, 25 bp, Mus musculus
ttccagcctaggaggggaccaccat

SEQ ID NO: 238130 - DNA, 25 bp, Mus musculus
tcctccctggagaggcccggttcca

SEQ ID NO: 238131 - DNA, 25 bp, Mus musculus
tcatcttcgggtacggtgctcttgg

SEQ ID NO: 238132 - DNA, 25 bp, Mus musculus
ggctgtcatcttcgggtacggtgct

SEQ ID NO: 238133 - DNA, 25 bp, Mus musculus
tggcggataggactgctgtgcagtt

SEQ ID NO: 238134 - DNA, 25 bp, Mus musculus
ttccgatcgcgctggagtccctggc

SEQ ID NO: 238135 - DNA, 25 bp, Mus musculus
acttctccggttccgatcgcgctgg

SEQ ID NO: 238136 - DNA, 25 bp, Mus musculus
gctgtcagtgagtagcacagagcca

SEQ ID NO: 238137 - DNA, 25 bp, Mus musculus
cggatgctgcagctgtcagtgagta

SEQ ID NO: 238138 - DNA, 25 bp, Mus musculus
cgggtgtgagctgcccgaaaatgca

SEQ ID NO: 238139 - DNA, 25 bp, Mus musculus
tgtgagctgcccgaaaatgcactcg

SEQ ID NO: 238140 - DNA, 25 bp, Mus musculus
tgtcactcccgcagagggacagctc

SEQ ID NO: 238141 - DNA, 25 bp, Mus musculus
cagggcggtccctcacgaccgtaag

SEQ ID NO: 238142 - DNA, 25 bp, Mus musculus
ttcacatccttgcagggcggtccct

SEQ ID NO: 238143 - DNA, 25 bp, Mus musculus
tgtaggttcacatccttgcagggcg

SEQ ID NO: 238144 - DNA, 25 bp, Mus musculus
gtgggcaagattctgtgtaggttca

SEQ ID NO: 238145 - DNA, 25 bp, Mus musculus
cccgaaagaaatccagagtgggcaa

SEQ ID NO: 238146 - DNA, 25 bp, Mus musculus
ggctcacagacctgctcggtcgctg

SEQ ID NO: 238147 - DNA, 25 bp, Mus musculus
agcatcttggctgcggacagctccc

SEQ ID NO: 238148 - DNA, 25 bp, Mus musculus
agagggacagctccgctctctggcc

SEQ ID NO: 238149 - DNA, 25 bp, Mus musculus
atgacccgtgtcactcccgcagagg

SEQ ID NO: 238150 - DNA, 25 bp, Mus musculus
agaggcacgtccaggcgcaggctcc

SEQ ID NO: 238151 - DNA, 25 bp, Mus musculus
tccgcatggtttctggctgcggaga

SEQ ID NO: 238152 - DNA, 25 bp, Mus musculus
ctgacgttatttttatccgcatggt

SEQ ID NO: 238153 - DNA, 25 bp, Mus musculus
ggccttcgccagcatcttggctgcg

SEQ ID NO: 238154 - DNA, 25 bp, Mus musculus
ctctactactagatctcccggagtc

SEQ ID NO: 238155 - DNA, 25 bp, Mus musculus
gataacatccttaagctacatcacc

SEQ ID NO: 238156 - DNA, 25 bp, Mus musculus
ggagtttcgacgcttctgtgccttc

SEQ ID NO: 238157 - DNA, 25 bp, Mus musculus
tttcgacgcttctgtgccttcgcct

SEQ ID NO: 238158 - DNA, 25 bp, Mus musculus
ctcgggcccgttacgccacggcgct

SEQ ID NO: 238159 - DNA, 25 bp, Mus musculus
gcagccggccgccacgtcaaggttt

SEQ ID NO: 238160 - DNA, 25 bp, Mus musculus
cacgtcaaggtttgtttaataatcg

SEQ ID NO: 238161 - DNA, 25 bp, Mus musculus
taatcgccggggtatttatggcctg

SEQ ID NO: 238162 - DNA, 25 bp, Mus musculus
tcgccggggtatttatggcctggtc

SEQ ID NO: 238163 - DNA, 25 bp, Mus musculus
actccagccgcgttctgagcctgtg

SEQ ID NO: 238164 - DNA, 25 bp, Mus musculus
gcctgtgtggaagataacatcctta

SEQ ID NO: 238165 - DNA, 25 bp, Mus musculus
gtcgttcagcctaagccacccactc

SEQ ID NO: 238166 - DNA, 25 bp, Mus musculus
atctcccggagtcggaagcgcgaaa

SEQ ID NO: 238167 - DNA, 25 bp, Mus musculus
tgagcctgtgtggaagataacatcc

SEQ ID NO: 238168 - DNA, 25 bp, Mus musculus
gatgtttcggacagtcattagtcta

SEQ ID NO: 238169 - DNA, 25 bp, Mus musculus
gatccctgggatccgctcggggtcc

SEQ ID NO: 238170 - DNA, 25 bp, Mus musculus
aaaacgggactgtccatggtggcgc

SEQ ID NO: 238171 - DNA, 25 bp, Mus musculus
gcaccgccatctttaccaggggaaa

SEQ ID NO: 238172 - DNA, 25 bp, Mus musculus
ccagcctcgggaccgggaacttctg

SEQ ID NO: 238173 - DNA, 25 bp, Mus musculus
ggttgcagcgatcgcgcaccgccat

SEQ ID NO: 238174 - DNA, 25 bp, Mus musculus
gtgccagctgcaccgtaaggccagc

SEQ ID NO: 238175 - DNA, 25 bp, Mus musculus
acacgggcgtgctcgcttcccggtt

SEQ ID NO: 238176 - DNA, 25 bp, Mus musculus
acagatggaggcgatgtttcggaca

SEQ ID NO: 238177 - DNA, 25 bp, Mus musculus
actggaagccgttcttgctcctctg

SEQ ID NO: 238178 - DNA, 25 bp, Mus musculus
gccactcaccatattacagatggag

SEQ ID NO: 238179 - DNA, 25 bp, Mus musculus
cggaaccgaggccactgctatgctc

SEQ ID NO: 238180 - DNA, 25 bp, Mus musculus
gttccctttctttgcctggctcgct

SEQ ID NO: 238181 - DNA, 25 bp, Mus musculus
cattagtctaaaggttgcagcgatc

SEQ ID NO: 238182 - DNA, 25 bp, Mus musculus
ccctagtcctttggatcagcagaga

SEQ ID NO: 238183 - DNA, 25 bp, Mus musculus
agcggccgctccctttgtctgggca

SEQ ID NO: 238184 - DNA, 25 bp, Mus musculus
agccgcagtccaggaaagagcccta

SEQ ID NO: 238185 - DNA, 25 bp, Mus musculus
gaactctgagccctccgggaagaga

SEQ ID NO: 238186 - DNA, 25 bp, Mus musculus
caatcgcgaaaaggggacgaactct

SEQ ID NO: 238187 - DNA, 25 bp, Mus musculus
gggcagccggtgcaaaccaatggca

SEQ ID NO: 238188 - DNA, 25 bp, Mus musculus
cttctgcatccaggctccggcgtgt

SEQ ID NO: 238189 - DNA, 25 bp, Mus musculus
atgggatccgttttttagcgccagg

SEQ ID NO: 238190 - DNA, 25 bp, Mus musculus
cgccgagctaattctccaggaggca

SEQ ID NO: 238191 - DNA, 25 bp, Mus musculus
gctggtcgacctccgccgagctaat

SEQ ID NO: 238192 - DNA, 25 bp, Mus musculus
agctactccctatccggctggtcga

SEQ ID NO: 238193 - DNA, 25 bp, Mus musculus
ctccgtaggcaagggagctcccaga

SEQ ID NO: 238194 - DNA, 25 bp, Mus musculus
ggcgtgtccacgttcccaatcgcga

SEQ ID NO: 238195 - DNA, 25 bp, Mus musculus
cgcgcagggtttccctagtcctttg

SEQ ID NO: 238196 - DNA, 25 bp, Mus musculus
ctccaagcggccctctgattggttg

SEQ ID NO: 238197 - DNA, 25 bp, Mus musculus
acgtcccgacgattggcttcccata

SEQ ID NO: 238198 - DNA, 25 bp, Mus musculus
ccgagaagacggaggttccaggcct

SEQ ID NO: 238199 - DNA, 25 bp, Mus musculus
tccttctgacgattggctgctctcc

SEQ ID NO: 238200 - DNA, 25 bp, Mus musculus
tccaggcctgtctttgttgagctgc

SEQ ID NO: 238201 - DNA, 25 bp, Mus musculus
gccctctgattggttgcaggtctcg

SEQ ID NO: 238202 - DNA, 25 bp, Mus musculus
ccctctcccggatggctgtattaac

SEQ ID NO: 238203 - DNA, 25 bp, Mus musculus
tggctgtattaacgcagcgcgcagc

SEQ ID NO: 238204 - DNA, 25 bp, Mus musculus
ggtagagcagttctcagcggcccgc

SEQ ID NO: 238205 - DNA, 25 bp, Mus musculus
ggctgcgcgagacacaaagtcctct

SEQ ID NO: 238206 - DNA, 25 bp, Mus musculus
cctcggacacaagcgcaggtacgtc

SEQ ID NO: 238207 - DNA, 25 bp, Mus musculus
tacgtcccggcattgatcggaggca

SEQ ID NO: 238208 - DNA, 25 bp, Mus musculus
caggccctggccacgtggccgagaa

SEQ ID NO: 238209 - DNA, 25 bp, Mus musculus
acgcctacaatccttctgacgattg

SEQ ID NO: 238210 - DNA, 25 bp, Mus musculus
ggtgcttctaaacccaccgcggatc

SEQ ID NO: 238211 - DNA, 25 bp, Mus musculus
gcggacacgccaggtctcctatgaa

SEQ ID NO: 238212 - DNA, 25 bp, Mus musculus
cctatgaaggcaaggacagattccc

SEQ ID NO: 238213 - DNA, 25 bp, Mus musculus
gagacccagcagacacggccagatc

SEQ ID NO: 238214 - DNA, 25 bp, Mus musculus
gccctgttttcctcggatctcacgg

SEQ ID NO: 238215 - DNA, 25 bp, Mus musculus
gttctttccagtttctgcccgcgcg

SEQ ID NO: 238216 - DNA, 25 bp, Mus musculus
gcgagccgtctcctgtcctgacttt

SEQ ID NO: 238217 - DNA, 25 bp, Mus musculus
tccagaacatgtgtaccatcgcaga

SEQ ID NO: 238218 - DNA, 25 bp, Mus musculus
ccggctcgttaagatcgccgtggta

SEQ ID NO: 238219 - DNA, 25 bp, Mus musculus
tgagtccatgcgaggaacccgcttg

SEQ ID NO: 238220 - DNA, 25 bp, Mus musculus
cggatctgagatcccgcggacacgc

SEQ ID NO: 238221 - DNA, 25 bp, Mus musculus
tctgctttaacgaagagggtcactg

SEQ ID NO: 238222 - DNA, 25 bp, Mus musculus
gatcctctgcctcttcatgtctctg

SEQ ID NO: 238223 - DNA, 25 bp, Mus musculus
cccgctcggactggaactgagagac

SEQ ID NO: 238224 - DNA, 25 bp, Mus musculus
ggctgtgaccaccacacagtgctga

SEQ ID NO: 238225 - DNA, 25 bp, Mus musculus
agctgttcgaacaccggctgctgcc

SEQ ID NO: 238226 - DNA, 25 bp, Mus musculus
tgactgcggcaaatgatactctgta

SEQ ID NO: 238227 - DNA, 25 bp, Mus musculus
cagcgggctgctcaaaacgaaaacc

SEQ ID NO: 238228 - DNA, 25 bp, Mus musculus
cccgccaatggcctggggttcaaat

SEQ ID NO: 238229 - DNA, 25 bp, Mus musculus
ggggttcaaattcccgcaggtgaca

SEQ ID NO: 238230 - DNA, 25 bp, Mus musculus
gtagaccacggaccacttcactttg

SEQ ID NO: 238231 - DNA, 25 bp, Mus musculus
ccttgctgggcaaaggccagtatgc

SEQ ID NO: 238232 - DNA, 25 bp, Mus musculus
atgatcccgtatcgccagctggcca

SEQ ID NO: 238233 - DNA, 25 bp, Mus musculus
actcaggtcagaacgcagggcttcc

SEQ ID NO: 238234 - DNA, 25 bp, Mus musculus
cagggcttccgggtactgagtactt

SEQ ID NO: 238235 - DNA, 25 bp, Mus musculus
tcaacacagtacacgtgggcctgtc

SEQ ID NO: 238236 - DNA, 25 bp, Mus musculus
cagagcttctcctccagctgttcga

SEQ ID NO: 238237 - DNA, 25 bp, Mus musculus
agtgtctacgatccggcctttcagc

SEQ ID NO: 238238 - DNA, 25 bp, Mus musculus
cgcttgcgcaatgagaggcccaggt

SEQ ID NO: 238239 - DNA, 25 bp, Mus musculus
ctcgcttctgcgctctctattcatg

SEQ ID NO: 238240 - DNA, 25 bp, Mus musculus
ctcgtattggccctaaccggccttg

SEQ ID NO: 238241 - DNA, 25 bp, Mus musculus
tccgaggcctctcgtattggcccta

SEQ ID NO: 238242 - DNA, 25 bp, Mus musculus
cgtttcaggcccaggcgtccgaggc

SEQ ID NO: 238243 - DNA, 25 bp, Mus musculus
tgtatggcggtacggaacttcctgt

SEQ ID NO: 238244 - DNA, 25 bp, Mus musculus
ttggccgccgcctttaacttgtgcg

SEQ ID NO: 238245 - DNA, 25 bp, Mus musculus
cattctcgcgccctgggacggcgag

SEQ ID NO: 238246 - DNA, 25 bp, Mus musculus
ctcttcgttcgcttaccggcggctt

SEQ ID NO: 238247 - DNA, 25 bp, Mus musculus
cccagatttgagtctcgcgctcttc

SEQ ID NO: 238248 - DNA, 25 bp, Mus musculus
gtcgctgactcttcagggtcgccgc

SEQ ID NO: 238249 - DNA, 25 bp, Mus musculus
agacggatcggtcgctgactcttca

SEQ ID NO: 238250 - DNA, 25 bp, Mus musculus
tcatgctctttatcgattctgagcc

SEQ ID NO: 238251 - DNA, 25 bp, Mus musculus
cgccgcggaagcgtaaccacctaga

SEQ ID NO: 238252 - DNA, 25 bp, Mus musculus
cgaggtccataggagtccggcacgt

SEQ ID NO: 238253 - DNA, 25 bp, Mus musculus
ttctgctacggaacttctgctcccg

SEQ ID NO: 238254 - DNA, 25 bp, Mus musculus
attgcttctgctacggaacttctgc

SEQ ID NO: 238255 - DNA, 25 bp, Mus musculus
agtccggcacgtgcgcattgcttct

SEQ ID NO: 238256 - DNA, 25 bp, Mus musculus
cgcagcaccgttagccgcagcacct

SEQ ID NO: 238257 - DNA, 25 bp, Mus musculus
tgtcatcccgaggtccataggagtc

SEQ ID NO: 238258 - DNA, 25 bp, Mus musculus
ggaagctgtcatcccgaggtccata

SEQ ID NO: 238259 - DNA, 25 bp, Mus musculus
tgttgaggattacatggaagctgtc

SEQ ID NO: 238260 - DNA, 25 bp, Mus musculus
ctcctcggggctgcttttgttgagg

SEQ ID NO: 238261 - DNA, 25 bp, Mus musculus
tttatgccaagctgctcctcggggc

SEQ ID NO: 238262 - DNA, 25 bp, Mus musculus
cggcgcaccagctttatgccaagct

SEQ ID NO: 238263 - DNA, 25 bp, Mus musculus
gttgaagatgaacacgccgggctca

SEQ ID NO: 238264 - DNA, 25 bp, Mus musculus
cccatttagcacgttgaagatgaac

SEQ ID NO: 238265 - DNA, 25 bp, Mus musculus
cgtgcgcattgcttctgctacggaa

SEQ ID NO: 238266 - DNA, 25 bp, Mus musculus
agccggctaccgcatcgcgagactt

SEQ ID NO: 238267 - DNA, 25 bp, Mus musculus
gggcgagtacttgagcagctgctcc

SEQ ID NO: 238268 - DNA, 25 bp, Mus musculus
cctcctcgtagatttcatcgaaatc

SEQ ID NO: 238269 - DNA, 25 bp, Mus musculus
tttcatcgaaatccgccatcccgag

SEQ ID NO: 238270 - DNA, 25 bp, Mus musculus
ctccggctactgaggagacctggtc

SEQ ID NO: 238271 - DNA, 25 bp, Mus musculus
cattaccgtgggcaggaacaacaac

SEQ ID NO: 238272 - DNA, 25 bp, Mus musculus
acaatgtcaacatccgccggggccg

SEQ ID NO: 238273 - DNA, 25 bp, Mus musculus
actcgactcctagagccaggctgga

SEQ ID NO: 238274 - DNA, 25 bp, Mus musculus
ccaggctggagtaatctgtagccca

SEQ ID NO: 238275 - DNA, 25 bp, Mus musculus
ctgtagcccaaacaacgacagcggg

SEQ ID NO: 238276 - DNA, 25 bp, Mus musculus
tggccggaccagagaatctgactgc

SEQ ID NO: 238277 - DNA, 25 bp, Mus musculus
ttacacggtgacgtgaccggagccg

SEQ ID NO: 238278 - DNA, 25 bp, Mus musculus
atctgactgccggtttaataaaacg

SEQ ID NO: 238279 - DNA, 25 bp, Mus musculus
cctcgcagggccttacacggtgacg

SEQ ID NO: 238280 - DNA, 25 bp, Mus musculus
ctacaaagaaactcagcaccggccg

SEQ ID NO: 238281 - DNA, 25 bp, Mus musculus
aaaggcagcgctacggagaagagtc

SEQ ID NO: 238282 - DNA, 25 bp, Mus musculus
ccgggattctgctacaaagaaactc

SEQ ID NO: 238283 - DNA, 25 bp, Mus musculus
tagcaaaactggctgagcgcgctca

SEQ ID NO: 238284 - DNA, 25 bp, Mus musculus
ctgttcactgccaaaggcagcgcta

SEQ ID NO: 238285 - DNA, 25 bp, Mus musculus
cgcgcatagcaaaactggctgagcg

SEQ ID NO: 238286 - DNA, 25 bp, Mus musculus
tacggagaagagtctagcctgcagc

SEQ ID NO: 238287 - DNA, 25 bp, Mus musculus
gagaagagtctagcctgcagcagag

SEQ ID NO: 238288 - DNA, 25 bp, Mus musculus
gcgccgcgtcgctgtaatcggacac

SEQ ID NO: 238289 - DNA, 25 bp, Mus musculus
gcgtcgctgtaatcggacaccgagc

SEQ ID NO: 238290 - DNA, 25 bp, Mus musculus
acttgccattcactccgcggtgcgg

SEQ ID NO: 238291 - DNA, 25 bp, Mus musculus
tctgccgcccgggattctgctacaa

SEQ ID NO: 238292 - DNA, 25 bp, Mus musculus
ccgcccgggattctgctacaaagaa

SEQ ID NO: 238293 - DNA, 25 bp, Mus musculus
ctcagcgactgttcactgccaaagg

SEQ ID NO: 238294 - DNA, 25 bp, Mus musculus
acatgtcgcgctccttctacgtgga

SEQ ID NO: 238295 - DNA, 25 bp, Mus musculus
gcagttttgcccacgggtgagccac

SEQ ID NO: 238296 - DNA, 25 bp, Mus musculus
ttgctcaaaagccagttctctcccg

SEQ ID NO: 238297 - DNA, 25 bp, Mus musculus
accggcgctctacctttgctcaaaa

SEQ ID NO: 238298 - DNA, 25 bp, Mus musculus
tgtccgtcccgcaaaagcggcgctt

SEQ ID NO: 238299 - DNA, 25 bp, Mus musculus
ttcttcatcccgctgggcatgccgt

SEQ ID NO: 238300 - DNA, 25 bp, Mus musculus
acgtggactcactcatcatcaagga

SEQ ID NO: 238301 - DNA, 25 bp, Mus musculus
gcaggacaagccatccatcgacatg

SEQ ID NO: 238302 - DNA, 25 bp, Mus musculus
cagctttccggacagtgctcagata

SEQ ID NO: 238303 - DNA, 25 bp, Mus musculus
ttgttcgagtcccagacacctcagc

SEQ ID NO: 238304 - DNA, 25 bp, Mus musculus
cgtgaggaccaaccctctccaggga

SEQ ID NO: 238305 - DNA, 25 bp, Mus musculus
ctataaaatcctggagccggggctc

SEQ ID NO: 238306 - DNA, 25 bp, Mus musculus
agtctgagctgagcggtactccgca

SEQ ID NO: 238307 - DNA, 25 bp, Mus musculus
gaatcgcacccagggccggatttct

SEQ ID NO: 238308 - DNA, 25 bp, Mus musculus
cgagatcgcgacatacctaaacctg

SEQ ID NO: 238309 - DNA, 25 bp, Mus musculus
cgactccggagaatcgagatcgcga

SEQ ID NO: 238310 - DNA, 25 bp, Mus musculus
caggcgcattatgcgcgctccgagg

SEQ ID NO: 238311 - DNA, 25 bp, Mus musculus
gagaatcgagatcgcgacataccta

SEQ ID NO: 238312 - DNA, 25 bp, Mus musculus
tccgaggacgaggactccttgtccc

SEQ ID NO: 238313 - DNA, 25 bp, Mus musculus
gatcgcgacatacctaaacctgtca

SEQ ID NO: 238314 - DNA, 25 bp, Mus musculus
gcgacatacctaaacctgtcagaga

SEQ ID NO: 238315 - DNA, 25 bp, Mus musculus
tacctaaacctgtcagagaagcagg

SEQ ID NO: 238316 - DNA, 25 bp, Mus musculus
gggaaaggcgcttcgaggaacaatc

SEQ ID NO: 238317 - DNA, 25 bp, Mus musculus
ttcgaggaacaatcacacaagctgc

SEQ ID NO: 238318 - DNA, 25 bp, Mus musculus
gaggaacaatcacacaagctgcaag

SEQ ID NO: 238319 - DNA, 25 bp, Mus musculus
acaagctgcaagtgcgtgggtagcc

SEQ ID NO: 238320 - DNA, 25 bp, Mus musculus
tagccaggcgcattatgcgcgctcc

SEQ ID NO: 238321 - DNA, 25 bp, Mus musculus
tccggagaatcgagatcgcgacata

SEQ ID NO: 238322 - DNA, 25 bp, Mus musculus
ccgcttcgcccaggtttggttcctg

SEQ ID NO: 238323 - DNA, 25 bp, Mus musculus
tttggttcctggagtgtcagcgccc

SEQ ID NO: 238324 - DNA, 25 bp, Mus musculus
cctttccctcgccagcaggatcgcc

SEQ ID NO: 238325 - DNA, 25 bp, Mus musculus
agcaggatcgccgtgtcccaactgt

SEQ ID NO: 238326 - DNA, 25 bp, Mus musculus
ggatcgccgtgtcccaactgtctct

SEQ ID NO: 238327 - DNA, 25 bp, Mus musculus
tcccaactgtctctcgctgggtgtc

SEQ ID NO: 238328 - DNA, 25 bp, Mus musculus
tctcgctgggtgtcttgggttccct

SEQ ID NO: 238329 - DNA, 25 bp, Mus musculus
ttgggttccctggtttgtggctcaa

SEQ ID NO: 238330 - DNA, 25 bp, Mus musculus
tccctggtttgtggctcaaacgtcc

SEQ ID NO: 238331 - DNA, 25 bp, Mus musculus
tggctcaaacgtcctgaaagctttc

SEQ ID NO: 238332 - DNA, 25 bp, Mus musculus
cccaggtttggttcctggagtgtca

SEQ ID NO: 238333 - DNA, 25 bp, Mus musculus
agggtacgtcgcgtgcgacccactc

SEQ ID NO: 238334 - DNA, 25 bp, Mus musculus
ctttcctagggtacgtcgcgtgcga

SEQ ID NO: 238335 - DNA, 25 bp, Mus musculus
tgaaagctttcctagggtacgtcgc

SEQ ID NO: 238336 - DNA, 25 bp, Mus musculus
tcccggcgcgcgtgtcgcgagcatt

SEQ ID NO: 238337 - DNA, 25 bp, Mus musculus
gtctctctgtacatctgaggaccag

SEQ ID NO: 238338 - DNA, 25 bp, Mus musculus
tacatctgaggaccagacctcgggg

SEQ ID NO: 238339 - DNA, 25 bp, Mus musculus
aggtactgaaggaaaatagtctctc

SEQ ID NO: 238340 - DNA, 25 bp, Mus musculus
cctgcgcctccatggtggccggttt

SEQ ID NO: 238341 - DNA, 25 bp, Mus musculus
tggagctgagcaccgcggagaacac

SEQ ID NO: 238342 - DNA, 25 bp, Mus musculus
accgagaacgccaggtcgggcgcca

SEQ ID NO: 238343 - DNA, 25 bp, Mus musculus
ggagaacacgcggactcctcgcaga

SEQ ID NO: 238344 - DNA, 25 bp, Mus musculus
agcagcagatggtagcgattcccga

SEQ ID NO: 238345 - DNA, 25 bp, Mus musculus
atgtccctgtctgtcccggagtaaa

SEQ ID NO: 238346 - DNA, 25 bp, Mus musculus
ttccgtctgcgtaggatgtccctgt

SEQ ID NO: 238347 - DNA, 25 bp, Mus musculus
cgcgtaggcgcagagttccgtctgc

SEQ ID NO: 238348 - DNA, 25 bp, Mus musculus
ttcccgagctcggaagacagctagc

SEQ ID NO: 238349 - DNA, 25 bp, Mus musculus
ctaggctacacagcgcaaccgagaa

SEQ ID NO: 238350 - DNA, 25 bp, Mus musculus
ggctggcggacgactgttactacat

SEQ ID NO: 238351 - DNA, 25 bp, Mus musculus
cccgcacttgcaaaagacacctgtg

SEQ ID NO: 238352 - DNA, 25 bp, Mus musculus
tgtgcccaagctgttcccgcacttg

SEQ ID NO: 238353 - DNA, 25 bp, Mus musculus
ccaggccaagcgcagtgtgcccaag

SEQ ID NO: 238354 - DNA, 25 bp, Mus musculus
ctcagtacgaaatggtcacctcctc

SEQ ID NO: 238355 - DNA, 25 bp, Mus musculus
taccctcaggaacaggctcagtacg

SEQ ID NO: 238356 - DNA, 25 bp, Mus musculus
cttggtgctgctctaccctcaggaa

SEQ ID NO: 238357 - DNA, 25 bp, Mus musculus
ttgagtgctacgtgcgccacttctc

SEQ ID NO: 238358 - DNA, 25 bp, Mus musculus
tgttactacatcaaccgcaggcggc

SEQ ID NO: 238359 - DNA, 25 bp, Mus musculus
cacacaagacgggaagcggacgagc

SEQ ID NO: 238360 - DNA, 25 bp, Mus musculus
cgaggtgatggcgactcaaagccta

SEQ ID NO: 238361 - DNA, 25 bp, Mus musculus
cctcggctgcgcacctaaggatgac

SEQ ID NO: 238362 - DNA, 25 bp, Mus musculus
gcgttgccagtgacgaccatggcca

SEQ ID NO: 238363 - DNA, 25 bp, Mus musculus
ttgccagaccaatgtgggcgccatc

SEQ ID NO: 238364 - DNA, 25 bp, Mus musculus
atccctcacaggatggcctgattca

SEQ ID NO: 238365 - DNA, 25 bp, Mus musculus
cggccttgggcagccttgaaaccgc

SEQ ID NO: 238366 - DNA, 25 bp, Mus musculus
ctcctttcatcaagcggccttgggc

SEQ ID NO: 238367 - DNA, 25 bp, Mus musculus
cctttctcttcagatgcctttgatc

SEQ ID NO: 238368 - DNA, 25 bp, Mus musculus
cgcgcagcaatcaccgcgctggaga

SEQ ID NO: 238369 - DNA, 25 bp, Mus musculus
agatgtgcctcaccgcagctcgtgc

SEQ ID NO: 238370 - DNA, 25 bp, Mus musculus
gcctgattcaatcgcgtactggatc

SEQ ID NO: 238371 - DNA, 25 bp, Mus musculus
accgggagccggaattcgcgcccat

SEQ ID NO: 238372 - DNA, 25 bp, Mus musculus
acaacggagctcacctcaggccaag

SEQ ID NO: 238373 - DNA, 25 bp, Mus musculus
atcttctctccgtgcgtgcgaagcg

SEQ ID NO: 238374 - DNA, 25 bp, Mus musculus
ttgccagcagcggtttctcccgagc

SEQ ID NO: 238375 - DNA, 25 bp, Mus musculus
ccgagccgggaatcttctctccgtg

SEQ ID NO: 238376 - DNA, 25 bp, Mus musculus
actggatctgcaggagatgtgcctc

SEQ ID NO: 238377 - DNA, 25 bp, Mus musculus
cccgccgctggagggaccagaacaa

SEQ ID NO: 238378 - DNA, 25 bp, Mus musculus
gcgctgggatcgtgcgcctctcact

SEQ ID NO: 238379 - DNA, 25 bp, Mus musculus
aagccgcggcgcttggcctcttggc

SEQ ID NO: 238380 - DNA, 25 bp, Mus musculus
cacggaagaggacaggtttttaatg

SEQ ID NO: 238381 - DNA, 25 bp, Mus musculus
tgagtattttcattcgtcgcccgcg

SEQ ID NO: 238382 - DNA, 25 bp, Mus musculus
gccagtcgagccctcgtaattactg

SEQ ID NO: 238383 - DNA, 25 bp, Mus musculus
ctcgtaattactggacggcgctgct

SEQ ID NO: 238384 - DNA, 25 bp, Mus musculus
tctcactccagcgacggaggcagcg

SEQ ID NO: 238385 - DNA, 25 bp, Mus musculus
acggcgctgctgttggaaacatctg

SEQ ID NO: 238386 - DNA, 25 bp, Mus musculus
tgctagaagcctcgggcggaatccg

SEQ ID NO: 238387 - DNA, 25 bp, Mus musculus
cgaattacttgggtgctagaagcct

SEQ ID NO: 238388 - DNA, 25 bp, Mus musculus
ccggagagattggagcgaattactt

SEQ ID NO: 238389 - DNA, 25 bp, Mus musculus
cagctccaagggttccggagagatt

SEQ ID NO: 238390 - DNA, 25 bp, Mus musculus
aacatctggggccagacttgagcgc

SEQ ID NO: 238391 - DNA, 25 bp, Mus musculus
tgcttactgggacgaacaccaagta

SEQ ID NO: 238392 - DNA, 25 bp, Mus musculus
agctggagaattggggcgtcttaat

SEQ ID NO: 238393 - DNA, 25 bp, Mus musculus
gtgctagcgcggaacctcagagaga

SEQ ID NO: 238394 - DNA, 25 bp, Mus musculus
agcctgagctttgagcgacgccgga

SEQ ID NO: 238395 - DNA, 25 bp, Mus musculus
cttgtcccagtagccctgggcggtc

SEQ ID NO: 238396 - DNA, 25 bp, Mus musculus
ccagtgcgcctggaatttgggctca

SEQ ID NO: 238397 - DNA, 25 bp, Mus musculus
ttgagttttcctgcgggcactgcgt

SEQ ID NO: 238398 - DNA, 25 bp, Mus musculus
cgtcttaatttagcagaaggtgggt

SEQ ID NO: 238399 - DNA, 25 bp, Mus musculus
gaattccggatccagggagatcttg

SEQ ID NO: 238400 - DNA, 25 bp, Mus musculus
tccaggccggctcaagcttccttgg

SEQ ID NO: 238401 - DNA, 25 bp, Mus musculus
gcttccttggcctgttgctgtctta

SEQ ID NO: 238402 - DNA, 25 bp, Mus musculus
cccgcgttaccgagcaatggaaata

SEQ ID NO: 238403 - DNA, 25 bp, Mus musculus
gtcctttctaaccaactgggctgca

SEQ ID NO: 238404 - DNA, 25 bp, Mus musculus
ttacgagcagcgagaacagagtggc

SEQ ID NO: 238405 - DNA, 25 bp, Mus musculus
tcacctgggtcgctcttgagttttc

SEQ ID NO: 238406 - DNA, 25 bp, Mus musculus
ctccgttttttgcacggggagcacg

SEQ ID NO: 238407 - DNA, 25 bp, Mus musculus
atctgctctgcgtcctgttggtcct

SEQ ID NO: 238408 - DNA, 25 bp, Mus musculus
cggcagacaagaggactgcaccctc

SEQ ID NO: 238409 - DNA, 25 bp, Mus musculus
gagtggtagctgttggcttttccca

SEQ ID NO: 238410 - DNA, 25 bp, Mus musculus
cgctcacctgagctgagagacctca

SEQ ID NO: 238411 - DNA, 25 bp, Mus musculus
ttggtgatgcttttgtgccgactgc

SEQ ID NO: 238412 - DNA, 25 bp, Mus musculus
gtgaccgacgcctgggacaaccagc

SEQ ID NO: 238413 - DNA, 25 bp, Mus musculus
gagagccttttcttgcggccgctgc

SEQ ID NO: 238414 - DNA, 25 bp, Mus musculus
cacctcgggcgctctttgtgcacag

SEQ ID NO: 238415 - DNA, 25 bp, Mus musculus
gggacgcaactgcagccgctctcat

SEQ ID NO: 238416 - DNA, 25 bp, Mus musculus
gcgccacccgaggagacgaatctcg

SEQ ID NO: 238417 - DNA, 25 bp, Mus musculus
agcagccgctaggttgcagactttt

SEQ ID NO: 238418 - DNA, 25 bp, Mus musculus
agctcagagtctagcgcagccaccg

SEQ ID NO: 238419 - DNA, 25 bp, Mus musculus
tgtaaatctcgtgctaggggctcgc

SEQ ID NO: 238420 - DNA, 25 bp, Mus musculus
tcccgcccaggagccgcgtcaccgc

SEQ ID NO: 238421 - DNA, 25 bp, Mus musculus
atgtccccaagaggtaacgtcggtg

SEQ ID NO: 238422 - DNA, 25 bp, Mus musculus
gggccttcgatgtccccaagaggta

SEQ ID NO: 238423 - DNA, 25 bp, Mus musculus
ccgccgtctgcagggccttcgatgt

SEQ ID NO: 238424 - DNA, 25 bp, Mus musculus
aagaccaagcagtccggctcgcggc

SEQ ID NO: 238425 - DNA, 25 bp, Mus musculus
acgggaagaccaagcagtccggctc

SEQ ID NO: 238426 - DNA, 25 bp, Mus musculus
tccgctacgggaagaccaagcagtc

SEQ ID NO: 238427 - DNA, 25 bp, Mus musculus
gacctgctccgctacgggaagacca

SEQ ID NO: 238428 - DNA, 25 bp, Mus musculus
ttccaggacctgctccgctacggga

SEQ ID NO: 238429 - DNA, 25 bp, Mus musculus
ccgccttcctgttcgcgctgctgct

SEQ ID NO: 238430 - DNA, 25 bp, Mus musculus
gaaccccctgcggacgctgtggctg

SEQ ID NO: 238431 - DNA, 25 bp, Mus musculus
ggccgggtttgagctctcggccctg

SEQ ID NO: 238432 - DNA, 25 bp, Mus musculus
cgcaggcacgtgagccaggggctgt

SEQ ID NO: 238433 - DNA, 25 bp, Mus musculus
ctgtagccggctcccgggctatggc

SEQ ID NO: 238434 - DNA, 25 bp, Mus musculus
ggcccggaggaagacctgagccatc

SEQ ID NO: 238435 - DNA, 25 bp, Mus musculus
ggagggtgacaagacggctttctta

SEQ ID NO: 238436 - DNA, 25 bp, Mus musculus
agtcgggtaccaggctcccgcgctg

SEQ ID NO: 238437 - DNA, 25 bp, Mus musculus
tgacaagacggctttcttaggcgcg

SEQ ID NO: 238438 - DNA, 25 bp, Mus musculus
aggaagacctgagccatcggaacca

SEQ ID NO: 238439 - DNA, 25 bp, Mus musculus
tcttgctgcttcagttgctctgggc

SEQ ID NO: 238440 - DNA, 25 bp, Mus musculus
ctcgtgctcttgctgcttcagttgc

SEQ ID NO: 238441 - DNA, 25 bp, Mus musculus
ccgacgcgaaggctgctcgtgctct

SEQ ID NO: 238442 - DNA, 25 bp, Mus musculus
agtgtgtggcttctgctgcccagct

SEQ ID NO: 238443 - DNA, 25 bp, Mus musculus
tcaacctgccggaaacgtcacgacg

SEQ ID NO: 238444 - DNA, 25 bp, Mus musculus
gaccagtgagcgagccgcacctcaa

SEQ ID NO: 238445 - DNA, 25 bp, Mus musculus
tccaataggaccagtgagcgagccg

SEQ ID NO: 238446 - DNA, 25 bp, Mus musculus
cggcgcgccgggtccaataggacca

SEQ ID NO: 238447 - DNA, 25 bp, Mus musculus
agccatcggaaccaggagccgccgg

SEQ ID NO: 238448 - DNA, 25 bp, Mus musculus
ggaataaagtgggtcacaaggccta

SEQ ID NO: 238449 - DNA, 25 bp, Mus musculus
tgattgcgctgcctcccggcgcatg

SEQ ID NO: 238450 - DNA, 25 bp, Mus musculus
gccgctccaaacgtgcccgagtggt

SEQ ID NO: 238451 - DNA, 25 bp, Mus musculus
cgcgcatgcgactttccccgttagg

SEQ ID NO: 238452 - DNA, 25 bp, Mus musculus
gagtccgtgattgcgctgcctcccg

SEQ ID NO: 238453 - DNA, 25 bp, Mus musculus
ggcggccagatttccttcgcgctct

SEQ ID NO: 238454 - DNA, 25 bp, Mus musculus
cacggaacccgggagcacgcatgcg

SEQ ID NO: 238455 - DNA, 25 bp, Mus musculus
ccctcaaaattcaccgctaccgccg

SEQ ID NO: 238456 - DNA, 25 bp, Mus musculus
ctcaccgtgcctgaggctccggctt

SEQ ID NO: 238457 - DNA, 25 bp, Mus musculus
ctgagcgcgactctccagagctccg

SEQ ID NO: 238458 - DNA, 25 bp, Mus musculus
cgcccagtctcaagcgcgacgcggc

SEQ ID NO: 238459 - DNA, 25 bp, Mus musculus
taaagtgggtcacaaggcctagcgg

SEQ ID NO: 238460 - DNA, 25 bp, Mus musculus
cccgagtggtgacaggaataaagtg

SEQ ID NO: 238461 - DNA, 25 bp, Mus musculus
ctcgcgacagccgagcggcgacagc

SEQ ID NO: 238462 - DNA, 25 bp, Mus musculus
gtcttggagcaccaacctcggccgg

SEQ ID NO: 238463 - DNA, 25 bp, Mus musculus
cttagccggtgctgtccggggctct

SEQ ID NO: 238464 - DNA, 25 bp, Mus musculus
gcgtccttccttagccggtgctgtc

SEQ ID NO: 238465 - DNA, 25 bp, Mus musculus
cgggctgcgtccttccttagccggt

SEQ ID NO: 238466 - DNA, 25 bp, Mus musculus
tgcagagagacacgtgaccggatac

SEQ ID NO: 238467 - DNA, 25 bp, Mus musculus
ccaccctgctccacttcggggctgc

SEQ ID NO: 238468 - DNA, 25 bp, Mus musculus
agagacacgtgaccggatacgggaa

SEQ ID NO: 238469 - DNA, 25 bp, Mus musculus
tggcctcgcggtaagcttccggccg

SEQ ID NO: 238470 - DNA, 25 bp, Mus musculus
cctgagtccgtcttggagcaccaac

SEQ ID NO: 238471 - DNA, 25 bp, Mus musculus
gcgcccttcctgagtccgtcttgga

SEQ ID NO: 238472 - DNA, 25 bp, Mus musculus
agtgcttcaaagctgctattgctgc

SEQ ID NO: 238473 - DNA, 25 bp, Mus musculus
ttccctgttcaatgaaaagtgcttc

SEQ ID NO: 238474 - DNA, 25 bp, Mus musculus
gccgctgcttttccctgttcaatga

SEQ ID NO: 238475 - DNA, 25 bp, Mus musculus
cctaagtggaggcagtgttgcatcc

SEQ ID NO: 238476 - DNA, 25 bp, Mus musculus
tgggcaaagcgcaacgcggcacgac

SEQ ID NO: 238477 - DNA, 25 bp, Mus musculus
ctcagctcccgcaagctggaggcga

SEQ ID NO: 238478 - DNA, 25 bp, Mus musculus
tggcactttccaggcgtgggcaaag

SEQ ID NO: 238479 - DNA, 25 bp, Mus musculus
tctcaccaccgggtttccgtggaga

SEQ ID NO: 238480 - DNA, 25 bp, Mus musculus
gaatccctgcgaccgctaggctctg

SEQ ID NO: 238481 - DNA, 25 bp, Mus musculus
cttggctttgtggtcccgaattgtc

SEQ ID NO: 238482 - DNA, 25 bp, Mus musculus
ctagggagggcaaagctcaacttca

SEQ ID NO: 238483 - DNA, 25 bp, Mus musculus
ttcaaagatcggattcccacgcgtc

SEQ ID NO: 238484 - DNA, 25 bp, Mus musculus
cacactctgggctgccagtgaggtc

SEQ ID NO: 238485 - DNA, 25 bp, Mus musculus
gctcaatgtgcagcccatggtggcc

SEQ ID NO: 238486 - DNA, 25 bp, Mus musculus
ccttaagagcgcgagtgggacgctt

SEQ ID NO: 238487 - DNA, 25 bp, Mus musculus
tcccacgctttggagaccactgcgg

SEQ ID NO: 238488 - DNA, 25 bp, Mus musculus
gcgtgatcgccgagcccagcttttc

SEQ ID NO: 238489 - DNA, 25 bp, Mus musculus
ccaagaagccgcctgcgctgttgag

SEQ ID NO: 238490 - DNA, 25 bp, Mus musculus
cactgtgggccgctccggtccgtta

SEQ ID NO: 238491 - DNA, 25 bp, Mus musculus
aaggtcctcgggcaccgcagaggtt

SEQ ID NO: 238492 - DNA, 25 bp, Mus musculus
cgctccggcccgtgccctttgcggt

SEQ ID NO: 238493 - DNA, 25 bp, Mus musculus
ctccctccttgtgggccgcgaccgt

SEQ ID NO: 238494 - DNA, 25 bp, Mus musculus
gcgaccgtctctctccgcgccattt

SEQ ID NO: 238495 - DNA, 25 bp, Mus musculus
gcgccattttcaaaccgcgctcgtg

SEQ ID NO: 238496 - DNA, 25 bp, Mus musculus
tttcaaaccgcgctcgtgccggagc

SEQ ID NO: 238497 - DNA, 25 bp, Mus musculus
aaaccgcgctcgtgccggagccatt

SEQ ID NO: 238498 - DNA, 25 bp, Mus musculus
cgtgccggagccattggccgcagca

SEQ ID NO: 238499 - DNA, 25 bp, Mus musculus
attggccgcagcaggacgagccagc

SEQ ID NO: 238500 - DNA, 25 bp, Mus musculus
cgacccgaggagaactgccgttcca

SEQ ID NO: 238501 - DNA, 25 bp, Mus musculus
actgccgttccaccctccggcctga

SEQ ID NO: 238502 - DNA, 25 bp, Mus musculus
gaaggactgcttggccgctccggcc

SEQ ID NO: 238503 - DNA, 25 bp, Mus musculus
gccagttggcaaggtcctcgggcac

SEQ ID NO: 238504 - DNA, 25 bp, Mus musculus
tcattcgtgggtccctgggaggaac

SEQ ID NO: 238505 - DNA, 25 bp, Mus musculus
gggctcgccttatcttcttccatcg

SEQ ID NO: 238506 - DNA, 25 bp, Mus musculus
tggcagaggcgaacaaaggtttccc

SEQ ID NO: 238507 - DNA, 25 bp, Mus musculus
ctaccagtttgatggcagaggcgaa

SEQ ID NO: 238508 - DNA, 25 bp, Mus musculus
cccagttctgatgagctaccagttt

SEQ ID NO: 238509 - DNA, 25 bp, Mus musculus
agccgatgcgcacaaactcttgttg

SEQ ID NO: 238510 - DNA, 25 bp, Mus musculus
ttaacctctgccgagagccgatgcg

SEQ ID NO: 238511 - DNA, 25 bp, Mus musculus
cccaggctgcatggctttgtttaac

SEQ ID NO: 238512 - DNA, 25 bp, Mus musculus
aacttgccgagagcgtgggactcgc

SEQ ID NO: 238513 - DNA, 25 bp, Mus musculus
ccctctcttctggatctgtgcgggg

SEQ ID NO: 238514 - DNA, 25 bp, Mus musculus
gcgaaaccgcaggtgagctctcctc

SEQ ID NO: 238515 - DNA, 25 bp, Mus musculus
tgtccggcatgcaccaacggagctc

SEQ ID NO: 238516 - DNA, 25 bp, Mus musculus
cagcccgggtgcaaagtgtccggca

SEQ ID NO: 238517 - DNA, 25 bp, Mus musculus
cgggacctcgctaaccaggagctga

SEQ ID NO: 238518 - DNA, 25 bp, Mus musculus
cgccagcctattgggaggcctgttt

SEQ ID NO: 238519 - DNA, 25 bp, Mus musculus
gcgccagcctattgggaggcctgtt

SEQ ID NO: 238520 - DNA, 25 bp, Mus musculus
ccagcctattgggaggcctgtttac

SEQ ID NO: 238521 - DNA, 25 bp, Mus musculus
agcctattgggaggcctgtttacgc

SEQ ID NO: 238522 - DNA, 25 bp, Mus musculus
ctattgggaggcctgtttacgccga

SEQ ID NO: 238523 - DNA, 25 bp, Mus musculus
tattgggaggcctgtttacgccgaa

SEQ ID NO: 238524 - DNA, 25 bp, Mus musculus
tgggaggcctgtttacgccgaatga

SEQ ID NO: 238525 - DNA, 25 bp, Mus musculus
gaggcctgtttacgccgaatgagtg

SEQ ID NO: 238526 - DNA, 25 bp, Mus musculus
cctgtttacgccgaatgagtggcac

SEQ ID NO: 238527 - DNA, 25 bp, Mus musculus
tgtttacgccgaatgagtggcacga

SEQ ID NO: 238528 - DNA, 25 bp, Mus musculus
tacgccgaatgagtggcacgagctc

SEQ ID NO: 238529 - DNA, 25 bp, Mus musculus
cgccgaatgagtggcacgagctcag

SEQ ID NO: 238530 - DNA, 25 bp, Mus musculus
agtggcacgagctcagggccgtgga

SEQ ID NO: 238531 - DNA, 25 bp, Mus musculus
tttacgccgaatgagtggcacgagc

SEQ ID NO: 238532 - DNA, 25 bp, Mus musculus
atgggctcgctagagtcgttgttgt

SEQ ID NO: 238533 - DNA, 25 bp, Mus musculus
ctctggatgggctcgctagagtcgt

SEQ ID NO: 238534 - DNA, 25 bp, Mus musculus
ccgtggagggccgagcagccaatca

SEQ ID NO: 238535 - DNA, 25 bp, Mus musculus
gctcgctagagtcgttgttgtggaa

SEQ ID NO: 238536 - DNA, 25 bp, Mus musculus
tttgagagccgctctggatgggctc

SEQ ID NO: 238537 - DNA, 25 bp, Mus musculus
ctgcaggtttgagagccgctctgga

SEQ ID NO: 238538 - DNA, 25 bp, Mus musculus
ctccgggctgagtggcacgagctta

SEQ ID NO: 238539 - DNA, 25 bp, Mus musculus
gctgagtggcacgagcttattagta

SEQ ID NO: 238540 - DNA, 25 bp, Mus musculus
tgagtggcacgagcttattagtatg

SEQ ID NO: 238541 - DNA, 25 bp, Mus musculus
cacgagcttattagtatgcagggcc

SEQ ID NO: 238542 - DNA, 25 bp, Mus musculus
cttattagtatgcagggcccgtggc

SEQ ID NO: 238543 - DNA, 25 bp, Mus musculus
tattagtatgcagggcccgtggctc

SEQ ID NO: 238544 - DNA, 25 bp, Mus musculus
agagccgctctggatgggctcgcta

SEQ ID NO: 238545 - DNA, 25 bp, Mus musculus
cgctagagtcgttgttgtggaagcc

SEQ ID NO: 238546 - DNA, 25 bp, Mus musculus
tgcctgcctggcaaaagttttcgga

SEQ ID NO: 238547 - DNA, 25 bp, Mus musculus
tgagcccggtaacacccgctaagga

SEQ ID NO: 238548 - DNA, 25 bp, Mus musculus
tgagcatcccacacacggccatttt

SEQ ID NO: 238549 - DNA, 25 bp, Mus musculus
cggccattttggtcaccggagcgca

SEQ ID NO: 238550 - DNA, 25 bp, Mus musculus
cccggcggtcaacttgagccagatc

SEQ ID NO: 238551 - DNA, 25 bp, Mus musculus
tgagccagatcaaggacacagcatg

SEQ ID NO: 238552 - DNA, 25 bp, Mus musculus
ccctcctggggctgtcagaagaaaa

SEQ ID NO: 238553 - DNA, 25 bp, Mus musculus
gtcaccaagcaatgcggccgcgcta

SEQ ID NO: 238554 - DNA, 25 bp, Mus musculus
cgagtgggcttccattcgatccaga

SEQ ID NO: 238555 - DNA, 25 bp, Mus musculus
ggacgccgccagtcaacgccaagtt

SEQ ID NO: 238556 - DNA, 25 bp, Mus musculus
aacgccaagttctccatcatgcctg

SEQ ID NO: 238557 - DNA, 25 bp, Mus musculus
cagcggcgcagagaccttcagacaa

SEQ ID NO: 238558 - DNA, 25 bp, Mus musculus
cctctgggagtaggcagattctctt

SEQ ID NO: 238559 - DNA, 25 bp, Mus musculus
ggggctagcacccagcgaagaaaca

SEQ ID NO: 238560 - DNA, 25 bp, Mus musculus
gttggctctcggaaccacgctaaga

SEQ ID NO: 238561 - DNA, 25 bp, Mus musculus
ggtttggtccgtgcggattcagccc

SEQ ID NO: 238562 - DNA, 25 bp, Mus musculus
tggcgcacaggtctccgccgcgttt

SEQ ID NO: 238563 - DNA, 25 bp, Mus musculus
ccgtgacgtcactccagcgtcgggg

SEQ ID NO: 238564 - DNA, 25 bp, Mus musculus
ctgcgtcatcttcgggcgcccgtga

SEQ ID NO: 238565 - DNA, 25 bp, Mus musculus
ccgtaaaacggacctctgcgtcatc

SEQ ID NO: 238566 - DNA, 25 bp, Mus musculus
gccgcagacgctcagcagccgtaaa

SEQ ID NO: 238567 - DNA, 25 bp, Mus musculus
gcgtggcgtgcacttcctagcccag

SEQ ID NO: 238568 - DNA, 25 bp, Mus musculus
ccttctcacgacagcgcgtggcgtg

SEQ ID NO: 238569 - DNA, 25 bp, Mus musculus
gggtccggcagctcacaaagtctcc

SEQ ID NO: 238570 - DNA, 25 bp, Mus musculus
acagccgctccaagctggggtccgg

SEQ ID NO: 238571 - DNA, 25 bp, Mus musculus
agcaggtgaccgaggtgacccacac

SEQ ID NO: 238572 - DNA, 25 bp, Mus musculus
ggattcagccctgccgctgaaggtg

SEQ ID NO: 238573 - DNA, 25 bp, Mus musculus
aaccacgctaagaggtggcgcagca

SEQ ID NO: 238574 - DNA, 25 bp, Mus musculus
ctccgccaatcagctagggcaaaga

SEQ ID NO: 238575 - DNA, 25 bp, Mus musculus
tccgctatcgaacgcctcaagaggc

SEQ ID NO: 238576 - DNA, 25 bp, Mus musculus
aggatcgctactttctctgcacgtg

SEQ ID NO: 238577 - DNA, 25 bp, Mus musculus
ttcccgcgcccaaggagtaggtgat

SEQ ID NO: 238578 - DNA, 25 bp, Mus musculus
ctgatcgcgtgggtccctcagaaaa

SEQ ID NO: 238579 - DNA, 25 bp, Mus musculus
ctagggcgtgtccttgatattgcac

SEQ ID NO: 238580 - DNA, 25 bp, Mus musculus
gtggtcgcccttgttttccagaaca

SEQ ID NO: 238581 - DNA, 25 bp, Mus musculus
ttcacctcggataatggcgacagcc

SEQ ID NO: 238582 - DNA, 25 bp, Mus musculus
ggcgacagccgtaggtgagtaactt

SEQ ID NO: 238583 - DNA, 25 bp, Mus musculus
gtgagtaacttgctttcggacccta

SEQ ID NO: 238584 - DNA, 25 bp, Mus musculus
ctccgtcagagagctagcaggcttg

SEQ ID NO: 238585 - DNA, 25 bp, Mus musculus
cgacaaagtgcctgatcgggttccc

SEQ ID NO: 238586 - DNA, 25 bp, Mus musculus
ggtctgctcctctagttcacctcgg

SEQ ID NO: 238587 - DNA, 25 bp, Mus musculus
gtggtccaagcaccaaccagctgtc

SEQ ID NO: 238588 - DNA, 25 bp, Mus musculus
ttcggcgagcgccttctgaatctga

SEQ ID NO: 238589 - DNA, 25 bp, Mus musculus
cttggggctaacagtttcggcgagc

SEQ ID NO: 238590 - DNA, 25 bp, Mus musculus
gtcgcttaaggccacgtgtacttcc

SEQ ID NO: 238591 - DNA, 25 bp, Mus musculus
ctgtcaacaagagtaagtgtcccgg

SEQ ID NO: 238592 - DNA, 25 bp, Mus musculus
acgcgtgccctcaagactgtcaaca

SEQ ID NO: 238593 - DNA, 25 bp, Mus musculus
cgttatgggcagaacagcgacttca

SEQ ID NO: 238594 - DNA, 25 bp, Mus musculus
ttcgagatcctcttccggggcagag

SEQ ID NO: 238595 - DNA, 25 bp, Mus musculus
ttcgccgagccaacttcgagatcct

SEQ ID NO: 238596 - DNA, 25 bp, Mus musculus
aaccgatttctgacgctagctctgg

SEQ ID NO: 238597 - DNA, 25 bp, Mus musculus
ccagtcacctttggattaggagtaa

SEQ ID NO: 238598 - DNA, 25 bp, Mus musculus
cgggagttttctctcccaaagactg

SEQ ID NO: 238599 - DNA, 25 bp, Mus musculus
taaagagaccatggcgtccggaacc

SEQ ID NO: 238600 - DNA, 25 bp, Mus musculus
aaatgtttttcgtgtcgtctccgcg

SEQ ID NO: 238601 - DNA, 25 bp, Mus musculus
gggcgtcaggcaaacaaatgtcttg

SEQ ID NO: 238602 - DNA, 25 bp, Mus musculus
tgcggtgtctaacagagacgcaccc

SEQ ID NO: 238603 - DNA, 25 bp, Mus musculus
tgtctcccttcacaccggaagcggg

SEQ ID NO: 238604 - DNA, 25 bp, Mus musculus
aagcgggagcaggatccctctctcc

SEQ ID NO: 238605 - DNA, 25 bp, Mus musculus
ctctgtctcacggtgcggtgtctaa

SEQ ID NO: 238606 - DNA, 25 bp, Mus musculus
cgcaccctaggagagcgtcacgtct

SEQ ID NO: 238607 - DNA, 25 bp, Mus musculus
tagcaaccggtgatccaagcgctga

SEQ ID NO: 238608 - DNA, 25 bp, Mus musculus
atccaagcgctgaggccggaccggc

SEQ ID NO: 238609 - DNA, 25 bp, Mus musculus
tgtccactccgcgaactgagtttgg

SEQ ID NO: 238610 - DNA, 25 bp, Mus musculus
cggagcttctaaccggaatggagga

SEQ ID NO: 238611 - DNA, 25 bp, Mus musculus
gagacttctcaggttcatccgtgcg

SEQ ID NO: 238612 - DNA, 25 bp, Mus musculus
ttcatccgtgcgatccgaggtgacg

SEQ ID NO: 238613 - DNA, 25 bp, Mus musculus
tgggcggaacaccacgaccacgaca

SEQ ID NO: 238614 - DNA, 25 bp, Mus musculus
ggtggttgagttgtctcccttcaca

SEQ ID NO: 238615 - DNA, 25 bp, Mus musculus
gcgtcacgtctccatagcaaccggt

SEQ ID NO: 238616 - DNA, 25 bp, Mus musculus
aactgcggaatgatttggggactga

SEQ ID NO: 238617 - DNA, 25 bp, Mus musculus
tccggagatccggagctgccctagg

SEQ ID NO: 238618 - DNA, 25 bp, Mus musculus
cgcctcaagtgctgcctccggagat

SEQ ID NO: 238619 - DNA, 25 bp, Mus musculus
ggacagtatactgaggaagcgcctc

SEQ ID NO: 238620 - DNA, 25 bp, Mus musculus
cctgacactccgaggggacagtata

SEQ ID NO: 238621 - DNA, 25 bp, Mus musculus
cccaacctgactaaggatggagagg

SEQ ID NO: 238622 - DNA, 25 bp, Mus musculus
aggatctccacctggtcctccgtgg

SEQ ID NO: 238623 - DNA, 25 bp, Mus musculus
tgttgaagttgtactccaggatctc

SEQ ID NO: 238624 - DNA, 25 bp, Mus musculus
ccgggtgcttgttgaccttgttgaa

SEQ ID NO: 238625 - DNA, 25 bp, Mus musculus
cgcctcggctgcgatgaggcacagc

SEQ ID NO: 238626 - DNA, 25 bp, Mus musculus
atacataggcttggggactcacctg

SEQ ID NO: 238627 - DNA, 25 bp, Mus musculus
ccgccagtcccggaggatacatagg

SEQ ID NO: 238628 - DNA, 25 bp, Mus musculus
ccctagggactgaggacactcgcgg

SEQ ID NO: 238629 - DNA, 25 bp, Mus musculus
atacatatgatggaggcccgcggca

SEQ ID NO: 238630 - DNA, 25 bp, Mus musculus
cggcaggctggacagcgatttctgc

SEQ ID NO: 238631 - DNA, 25 bp, Mus musculus
cccaagtttgcaaagagctgctttg

SEQ ID NO: 238632 - DNA, 25 bp, Mus musculus
agggcccaagtttgcaaagagctgc

SEQ ID NO: 238633 - DNA, 25 bp, Mus musculus
gacagcgatttctgcggcccgcgct

SEQ ID NO: 238634 - DNA, 25 bp, Mus musculus
gctttgtgtttggtattttgagaaa

SEQ ID NO: 238635 - DNA, 25 bp, Mus musculus
ctggtgaccgcggtcctgaaacttc

SEQ ID NO: 238636 - DNA, 25 bp, Mus musculus
gatcgagttacggagcgagtcacgg

SEQ ID NO: 238637 - DNA, 25 bp, Mus musculus
atttgcagatactgtggctcgggcg

SEQ ID NO: 238638 - DNA, 25 bp, Mus musculus
gctgtccagggctgatttgcagata

SEQ ID NO: 238639 - DNA, 25 bp, Mus musculus
gtccagcaacaaagaaaaggagttg

SEQ ID NO: 238640 - DNA, 25 bp, Mus musculus
ccgaaagtccagcaacaaagaaaag

SEQ ID NO: 238641 - DNA, 25 bp, Mus musculus
ctcgagggcctcgacgcccaacttt

SEQ ID NO: 238642 - DNA, 25 bp, Mus musculus
ggtctgatcccgctccgcgatcgca

SEQ ID NO: 238643 - DNA, 25 bp, Mus musculus
gcgaagttcgcaaacttccgggcca

SEQ ID NO: 238644 - DNA, 25 bp, Mus musculus
ctgtccaacagtgcggccgattctc

SEQ ID NO: 238645 - DNA, 25 bp, Mus musculus
gctgctgcaatctctctcgttcctt

SEQ ID NO: 238646 - DNA, 25 bp, Mus musculus
acagaaagcgttcctccgtgtccgg

SEQ ID NO: 238647 - DNA, 25 bp, Mus musculus
ggccttctgcatagtcctcggtcgc

SEQ ID NO: 238648 - DNA, 25 bp, Mus musculus
aacccgacggcccaaggatgatgca

SEQ ID NO: 238649 - DNA, 25 bp, Mus musculus
ctagacgagagggaactgtccaaca

SEQ ID NO: 238650 - DNA, 25 bp, Mus musculus
cgcactctcgcgatgacagctctga

SEQ ID NO: 238651 - DNA, 25 bp, Mus musculus
actcgagagttcaggcagacgtgca

SEQ ID NO: 238652 - DNA, 25 bp, Mus musculus
tgcaaaggcacggactcgatagagc

SEQ ID NO: 238653 - DNA, 25 bp, Mus musculus
agaaggttctccagtgctcagtcca

SEQ ID NO: 238654 - DNA, 25 bp, Mus musculus
cacacgcggagccatttctttcata

SEQ ID NO: 238655 - DNA, 25 bp, Mus musculus
ctcgcgcatgcgtagttcaagtcca

SEQ ID NO: 238656 - DNA, 25 bp, Mus musculus
gccagctagtcatcactcgcgcatg

SEQ ID NO: 238657 - DNA, 25 bp, Mus musculus
acttctggctaaggagccgtctgtc

SEQ ID NO: 238658 - DNA, 25 bp, Mus musculus
cttcactaccgggtcaagccgcgga

SEQ ID NO: 238659 - DNA, 25 bp, Mus musculus
cggctctcttcaccggcctgcccat

SEQ ID NO: 238660 - DNA, 25 bp, Mus musculus
gcctgcccatgtcgggcctccgctc

SEQ ID NO: 238661 - DNA, 25 bp, Mus musculus
ctccctggcgctccactcggtgcgc

SEQ ID NO: 238662 - DNA, 25 bp, Mus musculus
gccgcccgcttgcatcctgccagta

SEQ ID NO: 238663 - DNA, 25 bp, Mus musculus
tcctgccagtacagtacaactagta

SEQ ID NO: 238664 - DNA, 25 bp, Mus musculus
tacaactagtacacaggcacacacg

SEQ ID NO: 238665 - DNA, 25 bp, Mus musculus
aactagtacacaggcacacacgcgc

SEQ ID NO: 238666 - DNA, 25 bp, Mus musculus
cacgcgctccctaccgctgccactg

SEQ ID NO: 238667 - DNA, 25 bp, Mus musculus
gctgccactgcagctgccatggata

SEQ ID NO: 238668 - DNA, 25 bp, Mus musculus
ctgcagctgccatggatatcggcta

SEQ ID NO: 238669 - DNA, 25 bp, Mus musculus
ctgccatggatatcggctaacaaca

SEQ ID NO: 238670 - DNA, 25 bp, Mus musculus
ggatatcggctaacaacacagaggc

SEQ ID NO: 238671 - DNA, 25 bp, Mus musculus
ctaacaacacagaggccggcgagcg

SEQ ID NO: 238672 - DNA, 25 bp, Mus musculus
tgcacacgcacacggcgagggtcgc

SEQ ID NO: 238673 - DNA, 25 bp, Mus musculus
gtcccacgtccaccatgcgtgctga

SEQ ID NO: 238674 - DNA, 25 bp, Mus musculus
tcgtgggcatcctcgctgccctgga

SEQ ID NO: 238675 - DNA, 25 bp, Mus musculus
ccatcataaggtggctggatgcgag

SEQ ID NO: 238676 - DNA, 25 bp, Mus musculus
cgctccatcataaggtggctggatg

SEQ ID NO: 238677 - DNA, 25 bp, Mus musculus
cgcacgggccgcaggcatccgaaga

SEQ ID NO: 238678 - DNA, 25 bp, Mus musculus
accctcgccgcgagcacacaccggg

SEQ ID NO: 238679 - DNA, 25 bp, Mus musculus
cgtttctcctggctcgggacaccgg

SEQ ID NO: 238680 - DNA, 25 bp, Mus musculus
cggctttacccttccgcctcttgcg

SEQ ID NO: 238681 - DNA, 25 bp, Mus musculus
ggctcttgcacacgcacacggcgag

SEQ ID NO: 238682 - DNA, 25 bp, Mus musculus
gcacaccgggtagcggctcttgcac

SEQ ID NO: 238683 - DNA, 25 bp, Mus musculus
ttgctgccgcacaccgggtagcggc

SEQ ID NO: 238684 - DNA, 25 bp, Mus musculus
taggtgatgccgttgctgccgcaca

SEQ ID NO: 238685 - DNA, 25 bp, Mus musculus
ttgcggctcttcacgcactccatgc

SEQ ID NO: 238686 - DNA, 25 bp, Mus musculus
ggaacggtcggctctccgtggccac

SEQ ID NO: 238687 - DNA, 25 bp, Mus musculus
gtcggctctccgtggccacggcttt

SEQ ID NO: 238688 - DNA, 25 bp, Mus musculus
cccagcaatcttgaatgggctccgc

SEQ ID NO: 238689 - DNA, 25 bp, Mus musculus
agcaatcttgaatgggctccgcccg

SEQ ID NO: 238690 - DNA, 25 bp, Mus musculus
atcttgaatgggctccgcccggtcg

SEQ ID NO: 238691 - DNA, 25 bp, Mus musculus
ctccgcccggtcgttccgtggcgca

SEQ ID NO: 238692 - DNA, 25 bp, Mus musculus
gacagtcagtgagagcccagttctg

SEQ ID NO: 238693 - DNA, 25 bp, Mus musculus
accaggagcgaaccccaattatttg

SEQ ID NO: 238694 - DNA, 25 bp, Mus musculus
cagtcagtgagagcccagttctgga

SEQ ID NO: 238695 - DNA, 25 bp, Mus musculus
gtgagagcccagttctggaggaacc

SEQ ID NO: 238696 - DNA, 25 bp, Mus musculus
gagcccagttctggaggaaccagga

SEQ ID NO: 238697 - DNA, 25 bp, Mus musculus
cccgaatggacagtcagtgagagcc

SEQ ID NO: 238698 - DNA, 25 bp, Mus musculus
ttctggaggaaccaggagcgaaccc

SEQ ID NO: 238699 - DNA, 25 bp, Mus musculus
cttgaatgggctccgcccggtcgtt

SEQ ID NO: 238700 - DNA, 25 bp, Mus musculus
cagaggctcactcgggcctcggctg

SEQ ID NO: 238701 - DNA, 25 bp, Mus musculus
agctgataggcgaccaccggagctc

SEQ ID NO: 238702 - DNA, 25 bp, Mus musculus
gccggcgagctgataggcgaccacc

SEQ ID NO: 238703 - DNA, 25 bp, Mus musculus
tgaagctcccgcatgcccgaagcta

SEQ ID NO: 238704 - DNA, 25 bp, Mus musculus
gccgggcgatgaagctcccgcatgc

SEQ ID NO: 238705 - DNA, 25 bp, Mus musculus
gcggtgacggcatcggctcagaccc

SEQ ID NO: 238706 - DNA, 25 bp, Mus musculus
gccgctgctggcatctcgcggactg

SEQ ID NO: 238707 - DNA, 25 bp, Mus musculus
tgcgttggccgctgcgctcacgctg

SEQ ID NO: 238708 - DNA, 25 bp, Mus musculus
tcgcggactccagatccgggttttg

SEQ ID NO: 238709 - DNA, 25 bp, Mus musculus
cgtgcacccggcaaggagtttgcgc

SEQ ID NO: 238710 - DNA, 25 bp, Mus musculus
cagagcggaccctctgctgccggag

SEQ ID NO: 238711 - DNA, 25 bp, Mus musculus
tcagtcttctccctccgggtgtgcg

SEQ ID NO: 238712 - DNA, 25 bp, Mus musculus
tcacgctgcctgtctgcgggcgcga

SEQ ID NO: 238713 - DNA, 25 bp, Mus musculus
tccagttcccaggagcggggatgca

SEQ ID NO: 238714 - DNA, 25 bp, Mus musculus
ggtgcggggttcacgtacactcacc

SEQ ID NO: 238715 - DNA, 25 bp, Mus musculus
tcatgcgcacactcatctgatcgtg

SEQ ID NO: 238716 - DNA, 25 bp, Mus musculus
actcatctgatcgtgatgcggggcg

SEQ ID NO: 238717 - DNA, 25 bp, Mus musculus
ttggcatgggttcgaggttttatca

SEQ ID NO: 238718 - DNA, 25 bp, Mus musculus
ttcgaggttttatcagctactgggc

SEQ ID NO: 238719 - DNA, 25 bp, Mus musculus
cgattaggtgccagagggagatata

SEQ ID NO: 238720 - DNA, 25 bp, Mus musculus
aggagaagagaaccagcgcactgtc

SEQ ID NO: 238721 - DNA, 25 bp, Mus musculus
actgtcagtcgcacacgccgggtga

SEQ ID NO: 238722 - DNA, 25 bp, Mus musculus
cgccgggtgacaagaacgaatccca

SEQ ID NO: 238723 - DNA, 25 bp, Mus musculus
ccaatgccgtcctttagtaggggca

SEQ ID NO: 238724 - DNA, 25 bp, Mus musculus
ctttagtaggggcagaaagcagcca

SEQ ID NO: 238725 - DNA, 25 bp, Mus musculus
ggcgccttttctccgctagtctgga

SEQ ID NO: 238726 - DNA, 25 bp, Mus musculus
ctagtctggagcaacactggacgtg

SEQ ID NO: 238727 - DNA, 25 bp, Mus musculus
cttcataattgtggtcgccctggtc

SEQ ID NO: 238728 - DNA, 25 bp, Mus musculus
gcgacacgctgagcgcagcccagga

SEQ ID NO: 238729 - DNA, 25 bp, Mus musculus
caggagcacagattgcagcccaagg

SEQ ID NO: 238730 - DNA, 25 bp, Mus musculus
cccaggagcacagattgcagcccaa

SEQ ID NO: 238731 - DNA, 25 bp, Mus musculus
tgccagaggagtccgtggaccaggt

SEQ ID NO: 238732 - DNA, 25 bp, Mus musculus
acggctcatcgaggacaggggccac

SEQ ID NO: 238733 - DNA, 25 bp, Mus musculus
agcgctcaacggctcatcgaggaca

SEQ ID NO: 238734 - DNA, 25 bp, Mus musculus
ggcagagcgctcaacggctcatcga

SEQ ID NO: 238735 - DNA, 25 bp, Mus musculus
gcagccagcggcagagcgctcaacg

SEQ ID NO: 238736 - DNA, 25 bp, Mus musculus
gaggcgctctccctcccagacatct

SEQ ID NO: 238737 - DNA, 25 bp, Mus musculus
tcgctgctccactgcgacacgctga

SEQ ID NO: 238738 - DNA, 25 bp, Mus musculus
atgagagacatccagccctcgctgc

SEQ ID NO: 238739 - DNA, 25 bp, Mus musculus
ggtggcaagcacaatgagagacatc

SEQ ID NO: 238740 - DNA, 25 bp, Mus musculus
cccgcaggtggcaagcacaatgaga

SEQ ID NO: 238741 - DNA, 25 bp, Mus musculus
agacatctccttcagcagccagcgg

SEQ ID NO: 238742 - DNA, 25 bp, Mus musculus
aggaatccgatgctcccttgctgcc

SEQ ID NO: 238743 - DNA, 25 bp, Mus musculus
gctgcacgcctactaccagctgggg

SEQ ID NO: 238744 - DNA, 25 bp, Mus musculus
aagcatgccaaacctgggctccaga

SEQ ID NO: 238745 - DNA, 25 bp, Mus musculus
ggtgacgccgaagatgtttactaca

SEQ ID NO: 238746 - DNA, 25 bp, Mus musculus
tgcagacagtgtgaccaccagcacc

SEQ ID NO: 238747 - DNA, 25 bp, Mus musculus
agtcaccgcacagggactctctgta

SEQ ID NO: 238748 - DNA, 25 bp, Mus musculus
taaccgacgagcacacagaagacct

SEQ ID NO: 238749 - DNA, 25 bp, Mus musculus
caccattacagcaggaggcggttcc

SEQ ID NO: 238750 - DNA, 25 bp, Mus musculus
agtctgggcctggaactcattcacg

SEQ ID NO: 238751 - DNA, 25 bp, Mus musculus
gccgcgtcctttaaccacgaggaga

SEQ ID NO: 238752 - DNA, 25 bp, Mus musculus
atcgtcctggatgacgccgcgtcct

SEQ ID NO: 238753 - DNA, 25 bp, Mus musculus
cagcgggagtgaagatgacgccatc

SEQ ID NO: 238754 - DNA, 25 bp, Mus musculus
cgctccagcgaacagaaccggaata

SEQ ID NO: 238755 - DNA, 25 bp, Mus musculus
cccaggaccacagcgagagcttctt

SEQ ID NO: 238756 - DNA, 25 bp, Mus musculus
aggtgccgaatagcagcctgccaga

SEQ ID NO: 238757 - DNA, 25 bp, Mus musculus
ttccctaccttcgttgctggggctg

SEQ ID NO: 238758 - DNA, 25 bp, Mus musculus
cggaaacgccagcaaaagcggacaa

SEQ ID NO: 238759 - DNA, 25 bp, Mus musculus
cacaagagaaggcacgtccagaggg

SEQ ID NO: 238760 - DNA, 25 bp, Mus musculus
gggccctttagaggtgccgaatagc

SEQ ID NO: 238761 - DNA, 25 bp, Mus musculus
accttcgttgctggggctggccaaa

SEQ ID NO: 238762 - DNA, 25 bp, Mus musculus
tccatttccctaccttcgttgctgg

SEQ ID NO: 238763 - DNA, 25 bp, Mus musculus
accggctgacacaagctccacctca

SEQ ID NO: 238764 - DNA, 25 bp, Mus musculus
acctctgccctgggtccgtcggtgt

SEQ ID NO: 238765 - DNA, 25 bp, Mus musculus
ggagcgctgcgaccggctgacacaa

SEQ ID NO: 238766 - DNA, 25 bp, Mus musculus
agagcggggatttagtctccgcagc

SEQ ID NO: 238767 - DNA, 25 bp, Mus musculus
acattaattggagatgaagagcggg

SEQ ID NO: 238768 - DNA, 25 bp, Mus musculus
agcggacaaacattaattggagatg

SEQ ID NO: 238769 - DNA, 25 bp, Mus musculus
caaaagggtccggagcgccgcacac

SEQ ID NO: 238770 - DNA, 25 bp, Mus musculus
gaccagggcgaaccggcgactgcac

SEQ ID NO: 238771 - DNA, 25 bp, Mus musculus
ctcgctcctgctgtgtctggagctc

SEQ ID NO: 238772 - DNA, 25 bp, Mus musculus
tgtgtctggagctccagcgtctccc

SEQ ID NO: 238773 - DNA, 25 bp, Mus musculus
tgctcgcggcctcgccagtgacaag

SEQ ID NO: 238774 - DNA, 25 bp, Mus musculus
gcctcgccagtgacaagctactgta

SEQ ID NO: 238775 - DNA, 25 bp, Mus musculus
acaagctactgtaagtgtgactcgc

SEQ ID NO: 238776 - DNA, 25 bp, Mus musculus
ctgtaagtgtgactcgcttaaacga

SEQ ID NO: 238777 - DNA, 25 bp, Mus musculus
actcgcttaaacgaagtcgcacacc

SEQ ID NO: 238778 - DNA, 25 bp, Mus musculus
acgaagtcgcacacccacagaggga

SEQ ID NO: 238779 - DNA, 25 bp, Mus musculus
cacccacagagggaagtaatctgca

SEQ ID NO: 238780 - DNA, 25 bp, Mus musculus
tgagtgttgcctagcggtctctgag

SEQ ID NO: 238781 - DNA, 25 bp, Mus musculus
taatctgcaggctgccgtggtgagt

SEQ ID NO: 238782 - DNA, 25 bp, Mus musculus
ggtctctgagaaaggcgcgtcttcc

SEQ ID NO: 238783 - DNA, 25 bp, Mus musculus
agggaagtaatctgcaggctgccgt

SEQ ID NO: 238784 - DNA, 25 bp, Mus musculus
taaagactccggctcttgttcccgc

SEQ ID NO: 238785 - DNA, 25 bp, Mus musculus
cattcgcctgttactcacctatcaa

SEQ ID NO: 238786 - DNA, 25 bp, Mus musculus
acaagcctagcttagccggccgtta

SEQ ID NO: 238787 - DNA, 25 bp, Mus musculus
taaaagtcaaacgagccacgcctgc

SEQ ID NO: 238788 - DNA, 25 bp, Mus musculus
agccgtaaataaacagcagccacca

SEQ ID NO: 238789 - DNA, 25 bp, Mus musculus
cgcacttaacactcagccgtaaata

SEQ ID NO: 238790 - DNA, 25 bp, Mus musculus
agagctgcgcgacccgcacttaaca

SEQ ID NO: 238791 - DNA, 25 bp, Mus musculus
tccaggagggttagagtaagattgc

SEQ ID NO: 238792 - DNA, 25 bp, Mus musculus
ctgagagggaaacccaagccggcca

SEQ ID NO: 238793 - DNA, 25 bp, Mus musculus
cccactaggtcaaacggaggcctga

SEQ ID NO: 238794 - DNA, 25 bp, Mus musculus
ggaacgaggccatggttccggccca

SEQ ID NO: 238795 - DNA, 25 bp, Mus musculus
ccgcacttaccagatggaacgaggc

SEQ ID NO: 238796 - DNA, 25 bp, Mus musculus
cagcacagggcgagcgacgcatcgc

SEQ ID NO: 238797 - DNA, 25 bp, Mus musculus
agccggatatgcacccggtccagca

SEQ ID NO: 238798 - DNA, 25 bp, Mus musculus
cgctgagggcaaacgcggaaccaaa

SEQ ID NO: 238799 - DNA, 25 bp, Mus musculus
cgtcacttccggctgtgagagcgta

SEQ ID NO: 238800 - DNA, 25 bp, Mus musculus
agtgcctacgtgaaggctgctgagc

SEQ ID NO: 238801 - DNA, 25 bp, Mus musculus
caacggggcgcgcttccttgcaggt

SEQ ID NO: 238802 - DNA, 25 bp, Mus musculus
ccctgggacacctgacttccggttg

SEQ ID NO: 238803 - DNA, 25 bp, Mus musculus
cccaggacagggtttccagtcagcc

SEQ ID NO: 238804 - DNA, 25 bp, Mus musculus
gctggggaaaagtacgcccaggaca

SEQ ID NO: 238805 - DNA, 25 bp, Mus musculus
aaagcacagccaacggctcggaccg

SEQ ID NO: 238806 - DNA, 25 bp, Mus musculus
gcctcttcacaggaaagcacagcca

SEQ ID NO: 238807 - DNA, 25 bp, Mus musculus
gagcaggacgcctcttcacaggaaa

SEQ ID NO: 238808 - DNA, 25 bp, Mus musculus
tccgagccgccggaacgcgagaacg

SEQ ID NO: 238809 - DNA, 25 bp, Mus musculus
gaagagccggtctcctcagaggagc

SEQ ID NO: 238810 - DNA, 25 bp, Mus musculus
gacccgggaagagccggtctcctca

SEQ ID NO: 238811 - DNA, 25 bp, Mus musculus
ccggctgtgagagcgtaccgctcca

SEQ ID NO: 238812 - DNA, 25 bp, Mus musculus
agagggcttgctttgaggaacttgc

SEQ ID NO: 238813 - DNA, 25 bp, Mus musculus
ctgaactgtcgtctttttggttgac

SEQ ID NO: 238814 - DNA, 25 bp, Mus musculus
ttatcctctggaacgagggcggttc

SEQ ID NO: 238815 - DNA, 25 bp, Mus musculus
cgggcacgtttcctggccggattat

SEQ ID NO: 238816 - DNA, 25 bp, Mus musculus
tctctcgtcactcccgggagcggtt

SEQ ID NO: 238817 - DNA, 25 bp, Mus musculus
gaccagggctttgcttctctcgtca

SEQ ID NO: 238818 - DNA, 25 bp, Mus musculus
ccaggcgggaagagaaccagagcac

SEQ ID NO: 238819 - DNA, 25 bp, Mus musculus
ccttgtctctgtggtggccgaaccc

SEQ ID NO: 238820 - DNA, 25 bp, Mus musculus
attgtttcgcgcaggaagcaggctc

SEQ ID NO: 238821 - DNA, 25 bp, Mus musculus
ttccgcgagaggcacagagcgtaaa

SEQ ID NO: 238822 - DNA, 25 bp, Mus musculus
cccgcactgtgacgttccgcgagag

SEQ ID NO: 238823 - DNA, 25 bp, Mus musculus
ggacgacgtgccgaagtcacgccct

SEQ ID NO: 238824 - DNA, 25 bp, Mus musculus
cggttccctggacgtcaagtttgcg

SEQ ID NO: 238825 - DNA, 25 bp, Mus musculus
ccggattatgcggatgtaatgcgta

SEQ ID NO: 238826 - DNA, 25 bp, Mus musculus
ttggatgggtgtatgctgcgccacc

SEQ ID NO: 238827 - DNA, 25 bp, Mus musculus
cacggtaactgtgttcggagcatta

SEQ ID NO: 238828 - DNA, 25 bp, Mus musculus
aaggtggcctatgaaagcggcagca

SEQ ID NO: 238829 - DNA, 25 bp, Mus musculus
tgaaagcggcagcaagttggtgtcc

SEQ ID NO: 238830 - DNA, 25 bp, Mus musculus
cggggctcaccatcagggacgttct

SEQ ID NO: 238831 - DNA, 25 bp, Mus musculus
accatcagggacgttctggccgtga

SEQ ID NO: 238832 - DNA, 25 bp, Mus musculus
gttctggccgtgatcaaacactgca

SEQ ID NO: 238833 - DNA, 25 bp, Mus musculus
ccgtgatcaaacactgcaaggaccc

SEQ ID NO: 238834 - DNA, 25 bp, Mus musculus
ccctccggctcaagtgtgtcaagca

SEQ ID NO: 238835 - DNA, 25 bp, Mus musculus
caagtgtgtcaagcaaggtgagcgc

SEQ ID NO: 238836 - DNA, 25 bp, Mus musculus
caagcaaggtgagcgcagcttgttc

SEQ ID NO: 238837 - DNA, 25 bp, Mus musculus
cttgttcggtgctctgcctggcggt

SEQ ID NO: 238838 - DNA, 25 bp, Mus musculus
gtccagagagcacggtaactgtgtt

SEQ ID NO: 238839 - DNA, 25 bp, Mus musculus
agcgcagcttgttcggtgctctgcc

SEQ ID NO: 238840 - DNA, 25 bp, Mus musculus
actccttagagtccttggtagcagc

SEQ ID NO: 238841 - DNA, 25 bp, Mus musculus
ttgtgacagtgaaaaaggacgttgc

SEQ ID NO: 238842 - DNA, 25 bp, Mus musculus
aaaggacgttgcgtgcgttatggtc

SEQ ID NO: 238843 - DNA, 25 bp, Mus musculus
gttatggtccgtcgccacctcctgt

SEQ ID NO: 238844 - DNA, 25 bp, Mus musculus
gccacctcctgtagcgtccctagta

SEQ ID NO: 238845 - DNA, 25 bp, Mus musculus
caagccaggatctgtgagctaggtg

SEQ ID NO: 238846 - DNA, 25 bp, Mus musculus
agctaggtggcagcgcctgcacgcc

SEQ ID NO: 238847 - DNA, 25 bp, Mus musculus
agccagccttctcctgtctgcaaat

SEQ ID NO: 238848 - DNA, 25 bp, Mus musculus
tgcaaatcccatcaccggagcaagg

SEQ ID NO: 238849 - DNA, 25 bp, Mus musculus
gcaagggtcgcccagtacgaaagcg

SEQ ID NO: 238850 - DNA, 25 bp, Mus musculus
cccagtacgaaagcgaagactcctt

SEQ ID NO: 238851 - DNA, 25 bp, Mus musculus
ggtctgagggctgtccgatcgtctc

SEQ ID NO: 238852 - DNA, 25 bp, Mus musculus
cggggttcgcatttgtgacagtgaa

SEQ ID NO: 238853 - DNA, 25 bp, Mus musculus
ctgtccgatcgtctcgggcaggacg

SEQ ID NO: 238854 - DNA, 25 bp, Mus musculus
tcgcctaaaagcagagactcgccgc

SEQ ID NO: 238855 - DNA, 25 bp, Mus musculus
ctcggaagtagccacaaaaggatcc

SEQ ID NO: 238856 - DNA, 25 bp, Mus musculus
ttcacgccggaagtcaccagagaga

SEQ ID NO: 238857 - DNA, 25 bp, Mus musculus
ggcaactatctagcgtggcccagtg

SEQ ID NO: 238858 - DNA, 25 bp, Mus musculus
cgaaaccgtgagctgggcaactatc

SEQ ID NO: 238859 - DNA, 25 bp, Mus musculus
tccactctggcaaacggagaacacg

SEQ ID NO: 238860 - DNA, 25 bp, Mus musculus
cgagtcccggcttcagaagtcaaga

SEQ ID NO: 238861 - DNA, 25 bp, Mus musculus
ctacggtagcaactcccaggcaaaa

SEQ ID NO: 238862 - DNA, 25 bp, Mus musculus
cggaaatatccttggcctagcgttc

SEQ ID NO: 238863 - DNA, 25 bp, Mus musculus
gaagtcctctctcgggtcgcctaaa

SEQ ID NO: 238864 - DNA, 25 bp, Mus musculus
ttccagtagaaggacaccgcgcgtc

SEQ ID NO: 238865 - DNA, 25 bp, Mus musculus
tccagaacgtctagaaaagcgaagc

SEQ ID NO: 238866 - DNA, 25 bp, Mus musculus
ctgaggctgacaacatggcgagtcc

SEQ ID NO: 238867 - DNA, 25 bp, Mus musculus
gcggctgacagcctcacagttttcc

SEQ ID NO: 238868 - DNA, 25 bp, Mus musculus
tacacacagacaacgccgctcggtt

SEQ ID NO: 238869 - DNA, 25 bp, Mus musculus
tggccttttccgcccagatctttgc

SEQ ID NO: 238870 - DNA, 25 bp, Mus musculus
cccgtgatccggagggatcggcgct

SEQ ID NO: 238871 - DNA, 25 bp, Mus musculus
aagcacctggccagcagggtccagc

SEQ ID NO: 238872 - DNA, 25 bp, Mus musculus
tcggttcaagcacctggccagcagg

SEQ ID NO: 238873 - DNA, 25 bp, Mus musculus
gctcggttcaagcacctggccagca

SEQ ID NO: 238874 - DNA, 25 bp, Mus musculus
cagacaacgccgctcggttcaagca

SEQ ID NO: 238875 - DNA, 25 bp, Mus musculus
aacgccgctcggttcaagcacctgg

SEQ ID NO: 238876 - DNA, 25 bp, Mus musculus
ggttacacacagacaacgccgctcg

SEQ ID NO: 238877 - DNA, 25 bp, Mus musculus
cgcgaagttggcggttacacacaga

SEQ ID NO: 238878 - DNA, 25 bp, Mus musculus
tctctccggtgacccgcgaagttgg

SEQ ID NO: 238879 - DNA, 25 bp, Mus musculus
tctctctccggtgacccgcgaagtt

SEQ ID NO: 238880 - DNA, 25 bp, Mus musculus
cagcagggtccagccgggtagcaga

SEQ ID NO: 238881 - DNA, 25 bp, Mus musculus
gcccagatctttgcgcctctctctc

SEQ ID NO: 238882 - DNA, 25 bp, Mus musculus
gtgtggcttagaaagggcacctccc

SEQ ID NO: 238883 - DNA, 25 bp, Mus musculus
ccaaacccatgagggaaagcggtga

SEQ ID NO: 238884 - DNA, 25 bp, Mus musculus
ccatgagggaaagcggtgaccctca

SEQ ID NO: 238885 - DNA, 25 bp, Mus musculus
ccgagccagggggatttctttgagc

SEQ ID NO: 238886 - DNA, 25 bp, Mus musculus
cccaaacccatgagggaaagcggtg

SEQ ID NO: 238887 - DNA, 25 bp, Mus musculus
acccatgagggaaagcggtgaccct

SEQ ID NO: 238888 - DNA, 25 bp, Mus musculus
cccatgagggaaagcggtgaccctc

SEQ ID NO: 238889 - DNA, 25 bp, Mus musculus
agtgtggcttagaaagggcacctcc

SEQ ID NO: 238890 - DNA, 25 bp, Mus musculus
aagtgtggcttagaaagggcacctc

SEQ ID NO: 238891 - DNA, 25 bp, Mus musculus
gaaagtgtggcttagaaagggcacc

SEQ ID NO: 238892 - DNA, 25 bp, Mus musculus
ccgaggtacgcgagaggaaggaaag

SEQ ID NO: 238893 - DNA, 25 bp, Mus musculus
agaaatggtcccgaggtacgcgaga

SEQ ID NO: 238894 - DNA, 25 bp, Mus musculus
tgagggaaagcggtgaccctcaccc

SEQ ID NO: 238895 - DNA, 25 bp, Mus musculus
gccagggggatttctttgagcgtcc

SEQ ID NO: 238896 - DNA, 25 bp, Mus musculus
caggctagcccacgctcccgtgcgc

SEQ ID NO: 238897 - DNA, 25 bp, Mus musculus
ggagcaacgcgcctagcacccagcg

SEQ ID NO: 238898 - DNA, 25 bp, Mus musculus
cccgtgcccaataggaggacggagc

SEQ ID NO: 238899 - DNA, 25 bp, Mus musculus
tgttcccgtgcccaataggaggacg

SEQ ID NO: 238900 - DNA, 25 bp, Mus musculus
tcccttgttcccgtgcccaatagga

SEQ ID NO: 238901 - DNA, 25 bp, Mus musculus
ccgtgagagcgtcccttgttcccgt

SEQ ID NO: 238902 - DNA, 25 bp, Mus musculus
tcggagggaacaaaacaagaagagc

SEQ ID NO: 238903 - DNA, 25 bp, Mus musculus
cagactcggagggaacaaaacaaga

SEQ ID NO: 238904 - DNA, 25 bp, Mus musculus
caaccgcccagactcggagggaaca

SEQ ID NO: 238905 - DNA, 25 bp, Mus musculus
agccacacttacactgcccaaccgc

SEQ ID NO: 238906 - DNA, 25 bp, Mus musculus
gggaaacaaggcctctacattcacc

SEQ ID NO: 238907 - DNA, 25 bp, Mus musculus
cggcgggaaacaaggcctctacatt

SEQ ID NO: 238908 - DNA, 25 bp, Mus musculus
acctccagcgggcataaggctaggg

SEQ ID NO: 238909 - DNA, 25 bp, Mus musculus
tcagcttcacctccagcgggcataa

SEQ ID NO: 238910 - DNA, 25 bp, Mus musculus
cccaggtcacgtgctcgggcaagct

SEQ ID NO: 238911 - DNA, 25 bp, Mus musculus
gagcttcttgttgtaagtattccca

SEQ ID NO: 238912 - DNA, 25 bp, Mus musculus
cggccgacatgagcttcttgttgta

SEQ ID NO: 238913 - DNA, 25 bp, Mus musculus
acgccgcggccgacatgagcttctt

SEQ ID NO: 238914 - DNA, 25 bp, Mus musculus
tccgccaccttttctctgattcaag

SEQ ID NO: 238915 - DNA, 25 bp, Mus musculus
aagccggagaagtcgcggccgctcc

SEQ ID NO: 238916 - DNA, 25 bp, Mus musculus
tcagccggccgcggcaagtagcgaa

SEQ ID NO: 238917 - DNA, 25 bp, Mus musculus
ttccagtccggtgagcctgccgagt

SEQ ID NO: 238918 - DNA, 25 bp, Mus musculus
ggccgctctgcttccagtccggtga

SEQ ID NO: 238919 - DNA, 25 bp, Mus musculus
cccgaaggtaatcctaatgtgggcg

SEQ ID NO: 238920 - DNA, 25 bp, Mus musculus
gtgacccgaaggtaatcctaatgtg

SEQ ID NO: 238921 - DNA, 25 bp, Mus musculus
aggcagaggtgacccgaaggtaatc

SEQ ID NO: 238922 - DNA, 25 bp, Mus musculus
agtattcccataacgccggctttgt

SEQ ID NO: 238923 - DNA, 25 bp, Mus musculus
ctcgggcaagctctcagctggactg

SEQ ID NO: 238924 - DNA, 25 bp, Mus musculus
gccaaagtcaaagtgcgggtcccgc

SEQ ID NO: 238925 - DNA, 25 bp, Mus musculus
aatgagctcattgcgcaaggcccgc

SEQ ID NO: 238926 - DNA, 25 bp, Mus musculus
cgcccggaggaaccacagacatgca

SEQ ID NO: 238927 - DNA, 25 bp, Mus musculus
acagacatgcagatcccgcgagggc

SEQ ID NO: 238928 - DNA, 25 bp, Mus musculus
gggttctccacggtctgcccaatcg

SEQ ID NO: 238929 - DNA, 25 bp, Mus musculus
gcctccgcgcgccaaagtcaaagtg

SEQ ID NO: 238930 - DNA, 25 bp, Mus musculus
cggcgcgagattgacgctgcaaccc

SEQ ID NO: 238931 - DNA, 25 bp, Mus musculus
ggttccgcacccgagccgtctggag

SEQ ID NO: 238932 - DNA, 25 bp, Mus musculus
ccgtctggagctaggcatggccacc

SEQ ID NO: 238933 - DNA, 25 bp, Mus musculus
aggggacccgcatcaagaagatctc

SEQ ID NO: 238934 - DNA, 25 bp, Mus musculus
gcatcaagaagatctccatcgaggg

SEQ ID NO: 238935 - DNA, 25 bp, Mus musculus
ctccatcgaggggaacatcggtaag

SEQ ID NO: 238936 - DNA, 25 bp, Mus musculus
cctgccctcgaatgagctcattgcg

SEQ ID NO: 238937 - DNA, 25 bp, Mus musculus
gattgacgctgcaacccggagccgc

SEQ ID NO: 238938 - DNA, 25 bp, Mus musculus
agggacgggcacatgcccatgactc

SEQ ID NO: 238939 - DNA, 25 bp, Mus musculus
cagcacctctgctccgcgtcgccga

SEQ ID NO: 238940 - DNA, 25 bp, Mus musculus
ggccactcgccgctttaaatatgga

SEQ ID NO: 238941 - DNA, 25 bp, Mus musculus
ctttaaatatggatcgcgggctcgc

SEQ ID NO: 238942 - DNA, 25 bp, Mus musculus
gccgcacagcttcggccgcctagcc

SEQ ID NO: 238943 - DNA, 25 bp, Mus musculus
tcggctgcagcgtcggttcccggca

SEQ ID NO: 238944 - DNA, 25 bp, Mus musculus
cggttcccggcagccacacagagag

SEQ ID NO: 238945 - DNA, 25 bp, Mus musculus
acgcacagtgcgcagccacccaccc

SEQ ID NO: 238946 - DNA, 25 bp, Mus musculus
ggcgccaaagttgcgaccgctgccc

SEQ ID NO: 238947 - DNA, 25 bp, Mus musculus
ggccgcgccaacttcccagcccacg

SEQ ID NO: 238948 - DNA, 25 bp, Mus musculus
ctcacactcggtcgccaagctggag

SEQ ID NO: 238949 - DNA, 25 bp, Mus musculus
ctggaggagcgaccgaagcccgacc

SEQ ID NO: 238950 - DNA, 25 bp, Mus musculus
tgcccatgactcacacgcggggcgg

SEQ ID NO: 238951 - DNA, 25 bp, Mus musculus
tcgccaagctggaggagcgaccgaa

SEQ ID NO: 238952 - DNA, 25 bp, Mus musculus
gcttctgctacagtgctcccattca

SEQ ID NO: 238953 - DNA, 25 bp, Mus musculus
ttctgctacagtgctcccattcatc

SEQ ID NO: 238954 - DNA, 25 bp, Mus musculus
ggcggctctcaggacggtctcccag

SEQ ID NO: 238955 - DNA, 25 bp, Mus musculus
tctcaggacggtctcccaggcagta

SEQ ID NO: 238956 - DNA, 25 bp, Mus musculus
gacggtctcccaggcagtacttgct

SEQ ID NO: 238957 - DNA, 25 bp, Mus musculus
ggtctcccaggcagtacttgctgtg

SEQ ID NO: 238958 - DNA, 25 bp, Mus musculus
cagtacttgctgtgcaccgagcggt

SEQ ID NO: 238959 - DNA, 25 bp, Mus musculus
acttgctgtgcaccgagcggttggt

SEQ ID NO: 238960 - DNA, 25 bp, Mus musculus
tgcaccgagcggttggtgccatcct

SEQ ID NO: 238961 - DNA, 25 bp, Mus musculus
ttggtgccatcctgcagtggctgga

SEQ ID NO: 238962 - DNA, 25 bp, Mus musculus
cagcgcacggtgcgcagctggttcc

SEQ ID NO: 238963 - DNA, 25 bp, Mus musculus
cattcatccgctgcccagctgtggg

SEQ ID NO: 238964 - DNA, 25 bp, Mus musculus
cggagctgccacagcttctgctaca

SEQ ID NO: 238965 - DNA, 25 bp, Mus musculus
tccgctgcccagctgtgggagcaag

SEQ ID NO: 238966 - DNA, 25 bp, Mus musculus
gagcgcccgaaacgccctcgcgaaa

SEQ ID NO: 238967 - DNA, 25 bp, Mus musculus
gactgcagtctcacacctggttcgc

SEQ ID NO: 238968 - DNA, 25 bp, Mus musculus
agtctcacacctggttcgctcctgg

SEQ ID NO: 238969 - DNA, 25 bp, Mus musculus
acacctggttcgctcctggtcgccg

SEQ ID NO: 238970 - DNA, 25 bp, Mus musculus
taggggatccccaagtgtgatgaac

SEQ ID NO: 238971 - DNA, 25 bp, Mus musculus
gtgtgatgaacctaggctcccgggg

SEQ ID NO: 238972 - DNA, 25 bp, Mus musculus
ctcccgggggatggctgtccaacct

SEQ ID NO: 238973 - DNA, 25 bp, Mus musculus
gtccaacctccggtgcagtgagccc

SEQ ID NO: 238974 - DNA, 25 bp, Mus musculus
gatctgactgcagtctcacacctgg

SEQ ID NO: 238975 - DNA, 25 bp, Mus musculus
taggatgagatctgactgcagtctc

SEQ ID NO: 238976 - DNA, 25 bp, Mus musculus
gctaggatgagatctgactgcagtc

SEQ ID NO: 238977 - DNA, 25 bp, Mus musculus
cccgctaggatgagatctgactgca

SEQ ID NO: 238978 - DNA, 25 bp, Mus musculus
tctgactgcagtctcacacctggtt

SEQ ID NO: 238979 - DNA, 25 bp, Mus musculus
gggacagcctgatagccccgctagg

SEQ ID NO: 238980 - DNA, 25 bp, Mus musculus
ccggagctgcttttgcgaggctctc

SEQ ID NO: 238981 - DNA, 25 bp, Mus musculus
accgtgggccgcctaggctaagcac

SEQ ID NO: 238982 - DNA, 25 bp, Mus musculus
cctaggctaagcacggagacggctc

SEQ ID NO: 238983 - DNA, 25 bp, Mus musculus
taagcacggagacggctcgggtccc

SEQ ID NO: 238984 - DNA, 25 bp, Mus musculus
gcagcgcgagccctggatcctccgc

SEQ ID NO: 238985 - DNA, 25 bp, Mus musculus
gatcctccgccgcacacgcagtggg

SEQ ID NO: 238986 - DNA, 25 bp, Mus musculus
cgcccgctccggttgcttgcgggcc

SEQ ID NO: 238987 - DNA, 25 bp, Mus musculus
gggcgctaaaaaggcgaccgtgtca

SEQ ID NO: 238988 - DNA, 25 bp, Mus musculus
cccggcgtagggtcagaactcgcac

SEQ ID NO: 238989 - DNA, 25 bp, Mus musculus
cgtagggtcagaactcgcaccgtcc

SEQ ID NO: 238990 - DNA, 25 bp, Mus musculus
gtcagaactcgcaccgtcccagggg

SEQ ID NO: 238991 - DNA, 25 bp, Mus musculus
accgtcccaggggctgcgaaagcgc

SEQ ID NO: 238992 - DNA, 25 bp, Mus musculus
cccttggtctccgtgatgggacgag

SEQ ID NO: 238993 - DNA, 25 bp, Mus musculus
tctcggagcaccgtgggccgcctag

SEQ ID NO: 238994 - DNA, 25 bp, Mus musculus
ccttggttaagtgatcccgggcagg

SEQ ID NO: 238995 - DNA, 25 bp, Mus musculus
ttcctccgagacacctttgggcagc

SEQ ID NO: 238996 - DNA, 25 bp, Mus musculus
cgccagtctggggttgtggcacaat

SEQ ID NO: 238997 - DNA, 25 bp, Mus musculus
gtgattgttccagcctcaccgggaa

SEQ ID NO: 238998 - DNA, 25 bp, Mus musculus
cccaatccgcagaggaagatcctgg

SEQ ID NO: 238999 - DNA, 25 bp, Mus musculus
ggcaggcgctgaatggagaaacatt

SEQ ID NO: 239000 - DNA, 25 bp, Mus musculus
ccgagagattttggtcgcacgtgca

SEQ ID NO: 239001 - DNA, 25 bp, Mus musculus
ctgggttgctcctctcagagttgaa

SEQ ID NO: 239002 - DNA, 25 bp, Mus musculus
ttgtctccgatttcgcccgggagca

SEQ ID NO: 239003 - DNA, 25 bp, Mus musculus
ccagacgcaggagaaggctgagcta

SEQ ID NO: 239004 - DNA, 25 bp, Mus musculus
gctatgcttggtctgtgctcctttg

SEQ ID NO: 239005 - DNA, 25 bp, Mus musculus
tgctcctttgcagggtcgacctagg

SEQ ID NO: 239006 - DNA, 25 bp, Mus musculus
gccacgcgaagaccagccttggtta

SEQ ID NO: 239007 - DNA, 25 bp, Mus musculus
cacgtgcatggtggtgtacagttta

SEQ ID NO: 239008 - DNA, 25 bp, Mus musculus
attgcctcccttttttatcgctcta

SEQ ID NO: 239009 - DNA, 25 bp, Mus musculus
atcctgtcagagtgcggcgacctcc

SEQ ID NO: 239010 - DNA, 25 bp, Mus musculus
gctcctcgcatgaccacggagtctg

SEQ ID NO: 239011 - DNA, 25 bp, Mus musculus
cgggcgtgatcggaaaactgacttt

SEQ ID NO: 239012 - DNA, 25 bp, Mus musculus
ctgacttttctaccaacctatagga

SEQ ID NO: 239013 - DNA, 25 bp, Mus musculus
tatcgctctaaaacggagggcagtc

SEQ ID NO: 239014 - DNA, 25 bp, Mus musculus
ctggcggccaaatgaaccaataaac

SEQ ID NO: 239015 - DNA, 25 bp, Mus musculus
tcgctctgctctccgggataggcca

SEQ ID NO: 239016 - DNA, 25 bp, Mus musculus
gaggcggaactatgtcttctcctta

SEQ ID NO: 239017 - DNA, 25 bp, Mus musculus
ccttaattatcatgtgagggcctaa

SEQ ID NO: 239018 - DNA, 25 bp, Mus musculus
ggattaggatccaaactggcggatt

SEQ ID NO: 239019 - DNA, 25 bp, Mus musculus
actggcggatttcccgaccttcgct

SEQ ID NO: 239020 - DNA, 25 bp, Mus musculus
cacagccctgggatcctgtcagagt

SEQ ID NO: 239021 - DNA, 25 bp, Mus musculus
gcagtcagttactggcggccaaatg

SEQ ID NO: 239022 - DNA, 25 bp, Mus musculus
ccttagccaggatgtagtgctgata

SEQ ID NO: 239023 - DNA, 25 bp, Mus musculus
ccagtgtcgcgctagagatgacgta

SEQ ID NO: 239024 - DNA, 25 bp, Mus musculus
cactagcaccaggaggttgcgcgca

SEQ ID NO: 239025 - DNA, 25 bp, Mus musculus
cgggcggccaactagagcactagca

SEQ ID NO: 239026 - DNA, 25 bp, Mus musculus
cacagcatggttacacggagcgggc

SEQ ID NO: 239027 - DNA, 25 bp, Mus musculus
gcacacgaccggcacagcatggtta

SEQ ID NO: 239028 - DNA, 25 bp, Mus musculus
agcggctgcccataccggaagggct

SEQ ID NO: 239029 - DNA, 25 bp, Mus musculus
gcagacaccgaagcggctgcccata

SEQ ID NO: 239030 - DNA, 25 bp, Mus musculus
agccacctggagaggccgcagacac

SEQ ID NO: 239031 - DNA, 25 bp, Mus musculus
agggcctcataccagccacctggag

SEQ ID NO: 239032 - DNA, 25 bp, Mus musculus
agtatgatgttgctccaccagggga

SEQ ID NO: 239033 - DNA, 25 bp, Mus musculus
acggtgctgagtatgatgttgctcc

SEQ ID NO: 239034 - DNA, 25 bp, Mus musculus
agatgacgtaagactccgcctttcc

SEQ ID NO: 239035 - DNA, 25 bp, Mus musculus
agagtgacagcaccgcgcagggcaa

SEQ ID NO: 239036 - DNA, 25 bp, Mus musculus
ctccacccttcaccctgcgaagcag

SEQ ID NO: 239037 - DNA, 25 bp, Mus musculus
acgactcaggccgagcaaagaaagg

SEQ ID NO: 239038 - DNA, 25 bp, Mus musculus
cctcacgactcaggccgagcaaaga

SEQ ID NO: 239039 - DNA, 25 bp, Mus musculus
ctccgtgcactctccggtcctccca

SEQ ID NO: 239040 - DNA, 25 bp, Mus musculus
ttctcggcaactccgtgcactctcc

SEQ ID NO: 239041 - DNA, 25 bp, Mus musculus
tagccagcttctcggcaactccgtg

SEQ ID NO: 239042 - DNA, 25 bp, Mus musculus
tcggctagccagcttctcggcaact

SEQ ID NO: 239043 - DNA, 25 bp, Mus musculus
tgcgaagcagcatcctcggctagcc

SEQ ID NO: 239044 - DNA, 25 bp, Mus musculus
cgaccaatcaatccctccacccttc

SEQ ID NO: 239045 - DNA, 25 bp, Mus musculus
agtgccacccgggaatccgaccaat

SEQ ID NO: 239046 - DNA, 25 bp, Mus musculus
ccagagagaccacccttcggcccca

SEQ ID NO: 239047 - DNA, 25 bp, Mus musculus
cgggaatgaggtggccttactggcc

SEQ ID NO: 239048 - DNA, 25 bp, Mus musculus
gagactctcctacctattatcttac

SEQ ID NO: 239049 - DNA, 25 bp, Mus musculus
gaagcagcatcctcggctagccagc

SEQ ID NO: 239050 - DNA, 25 bp, Mus musculus
tggcttcgtattagaacgcagccgc

SEQ ID NO: 239051 - DNA, 25 bp, Mus musculus
gaggcctggcccctcagatccggga

SEQ ID NO: 239052 - DNA, 25 bp, Mus musculus
caccgcctcggtcacctctactgcc

SEQ ID NO: 239053 - DNA, 25 bp, Mus musculus
ctcacctcgtctcgcgatactaagg

SEQ ID NO: 239054 - DNA, 25 bp, Mus musculus
ctcgtctcgcgatactaagggcggg

SEQ ID NO: 239055 - DNA, 25 bp, Mus musculus
acgccgtgcccgggaaagccgagca

SEQ ID NO: 239056 - DNA, 25 bp, Mus musculus
cttcctctggggagaccgagtctga

SEQ ID NO: 239057 - DNA, 25 bp, Mus musculus
gaccgagtctgagcggggaccgcaa

SEQ ID NO: 239058 - DNA, 25 bp, Mus musculus
acgagcgcctgggtggcttgtcttc

SEQ ID NO: 239059 - DNA, 25 bp, Mus musculus
tggcttgtcttctccgcgctacttc

SEQ ID NO: 239060 - DNA, 25 bp, Mus musculus
ttcgtattagaacgcagccgcaggc

SEQ ID NO: 239061 - DNA, 25 bp, Mus musculus
aagcgcgggtgacgccatcagccgg

SEQ ID NO: 239062 - DNA, 25 bp, Mus musculus
tattagaacgcagccgcaggcggaa

SEQ ID NO: 239063 - DNA, 25 bp, Mus musculus
gcctctcccaagtgcagactccagg

SEQ ID NO: 239064 - DNA, 25 bp, Mus musculus
aggacttccctgtgctcccgtggcg

SEQ ID NO: 239065 - DNA, 25 bp, Mus musculus
agcagcggccggaggtaggagctgc

SEQ ID NO: 239066 - DNA, 25 bp, Mus musculus
ccgagcgcgcgtggcgcggcttcgg

SEQ ID NO: 239067 - DNA, 25 bp, Mus musculus
ccgtctgggccgagggcctgtgcga

SEQ ID NO: 239068 - DNA, 25 bp, Mus musculus
cgggcccgcggcttctcgctgctcc

SEQ ID NO: 239069 - DNA, 25 bp, Mus musculus
ggcggacggcgaggcatggcgacgc

SEQ ID NO: 239070 - DNA, 25 bp, Mus musculus
tgtcgctgagctgaccgcgggaccc

SEQ ID NO: 239071 - DNA, 25 bp, Mus musculus
cctctgccttctcggggctcggccc

SEQ ID NO: 239072 - DNA, 25 bp, Mus musculus
gccaccagcggtgccgcctctgcct

SEQ ID NO: 239073 - DNA, 25 bp, Mus musculus
gggttggagccaagtcgcccgccac

SEQ ID NO: 239074 - DNA, 25 bp, Mus musculus
tgcacgggttggagccaagtcgccc

SEQ ID NO: 239075 - DNA, 25 bp, Mus musculus
tgctcccgtggcgacagcgtgcacg

SEQ ID NO: 239076 - DNA, 25 bp, Mus musculus
cctgtgctcccgtggcgacagcgtg

SEQ ID NO: 239077 - DNA, 25 bp, Mus musculus
ggacttccctgtgctcccgtggcga

SEQ ID NO: 239078 - DNA, 25 bp, Mus musculus
ttcgctcccttctgacccgcggcca

SEQ ID NO: 239079 - DNA, 25 bp, Mus musculus
tctataaaagcagcaggtgctcgcc

SEQ ID NO: 239080 - DNA, 25 bp, Mus musculus
acttcctcccgcgtcagctgggttt

SEQ ID NO: 239081 - DNA, 25 bp, Mus musculus
cgtcagctgggtttttggagtagta

SEQ ID NO: 239082 - DNA, 25 bp, Mus musculus
ttggagtagtaacctcccgcctcca

SEQ ID NO: 239083 - DNA, 25 bp, Mus musculus
tccacccagggctggtccgtgacgt

SEQ ID NO: 239084 - DNA, 25 bp, Mus musculus
agccgctgtcgtgttgctgcagaga

SEQ ID NO: 239085 - DNA, 25 bp, Mus musculus
tggctccagcgggtctataaaagca

SEQ ID NO: 239086 - DNA, 25 bp, Mus musculus
atgagaactccgctgctaccgctgg

SEQ ID NO: 239087 - DNA, 25 bp, Mus musculus
aaaagcagcaggtgctcgccgcacc

SEQ ID NO: 239088 - DNA, 25 bp, Mus musculus
tggatcccgcttccttcgctccctt

SEQ ID NO: 239089 - DNA, 25 bp, Mus musculus
accgcccggacatctccagctgagc

SEQ ID NO: 239090 - DNA, 25 bp, Mus musculus
ccggccggtggaaccaatgagaact

SEQ ID NO: 239091 - DNA, 25 bp, Mus musculus
ggaaccaatgagaactccgctgcta

SEQ ID NO: 239092 - DNA, 25 bp, Mus musculus
gcaaggtgctcatcgccctctgcat

SEQ ID NO: 239093 - DNA, 25 bp, Mus musculus
ggcgccgcagggcacacagctgact

SEQ ID NO: 239094 - DNA, 25 bp, Mus musculus
cagacaccgaagctgcctggactcg

SEQ ID NO: 239095 - DNA, 25 bp, Mus musculus
aagctgcctggactcgtcgcgcctg

SEQ ID NO: 239096 - DNA, 25 bp, Mus musculus
cccgaagcacttggtcagacccagg

SEQ ID NO: 239097 - DNA, 25 bp, Mus musculus
cttggtcagacccaggaaactcttc

SEQ ID NO: 239098 - DNA, 25 bp, Mus musculus
caggaaactcttctctagtcgcatc

SEQ ID NO: 239099 - DNA, 25 bp, Mus musculus
tctagtcgcatccagctcggtaccg

SEQ ID NO: 239100 - DNA, 25 bp, Mus musculus
ctcggtaccgagcaccagagtaata

SEQ ID NO: 239101 - DNA, 25 bp, Mus musculus
ccacttcgccttgcgccgccagaca

SEQ ID NO: 239102 - DNA, 25 bp, Mus musculus
atatggtctgcaaggtgctcatcgc

SEQ ID NO: 239103 - DNA, 25 bp, Mus musculus
tctgcatcttcaccgcaggtacttg

SEQ ID NO: 239104 - DNA, 25 bp, Mus musculus
accgcaggtacttggcgcggtccta

SEQ ID NO: 239105 - DNA, 25 bp, Mus musculus
ccgagcaccagagtaatatggtctg

SEQ ID NO: 239106 - DNA, 25 bp, Mus musculus
acgccttaaggaagcagagtcggtc

SEQ ID NO: 239107 - DNA, 25 bp, Mus musculus
tgatctgcagcatccggatttccgg

SEQ ID NO: 239108 - DNA, 25 bp, Mus musculus
ggggtccaatcacgtgatctgcagc

SEQ ID NO: 239109 - DNA, 25 bp, Mus musculus
gacgcttagtccgtcgtccacgtta

SEQ ID NO: 239110 - DNA, 25 bp, Mus musculus
cccagcttggaagccacgccttaag

SEQ ID NO: 239111 - DNA, 25 bp, Mus musculus
agcagcggccaccagagtcaggaag

SEQ ID NO: 239112 - DNA, 25 bp, Mus musculus
gctgtcgtcactgctaatggtagta

SEQ ID NO: 239113 - DNA, 25 bp, Mus musculus
ggcatcgctgccagccctgattgcg

SEQ ID NO: 239114 - DNA, 25 bp, Mus musculus
ccgcagctcatcgaggaggtaccct

SEQ ID NO: 239115 - DNA, 25 bp, Mus musculus
gtaccctctaaagtcgtcaccttga

SEQ ID NO: 239116 - DNA, 25 bp, Mus musculus
gtcaccttgaggagacaagctctgt

SEQ ID NO: 239117 - DNA, 25 bp, Mus musculus
caagctctgtcatagtgctcgcagc

SEQ ID NO: 239118 - DNA, 25 bp, Mus musculus
ctgcgccaggttgcggacgccatct

SEQ ID NO: 239119 - DNA, 25 bp, Mus musculus
tcgtccacgttagtcgctgtcgtca

SEQ ID NO: 239120 - DNA, 25 bp, Mus musculus
cgcaagctcacacttccgaggacta

SEQ ID NO: 239121 - DNA, 25 bp, Mus musculus
cccgagtcagaatgcgtctgcgaca

SEQ ID NO: 239122 - DNA, 25 bp, Mus musculus
cccagccataggcagtctccagaga

SEQ ID NO: 239123 - DNA, 25 bp, Mus musculus
tgaggaaaacagagcaccgccggcc

SEQ ID NO: 239124 - DNA, 25 bp, Mus musculus
gctcagctcagggaagcagcacctc

SEQ ID NO: 239125 - DNA, 25 bp, Mus musculus
ccaagtagccctaggcgaaggcgtt

SEQ ID NO: 239126 - DNA, 25 bp, Mus musculus
cggagcctccctgatcctgattggc

SEQ ID NO: 239127 - DNA, 25 bp, Mus musculus
aggcgttgtgattggctctgtgcca

SEQ ID NO: 239128 - DNA, 25 bp, Mus musculus
agctcgcaggttcgctcagctgacg

SEQ ID NO: 239129 - DNA, 25 bp, Mus musculus
agacctctgctctcaggggaccgca

SEQ ID NO: 239130 - DNA, 25 bp, Mus musculus
agaccatgagatttcccagcttgcc

SEQ ID NO: 239131 - DNA, 25 bp, Mus musculus
cgcgattcctcgcttcctttcggtt

SEQ ID NO: 239132 - DNA, 25 bp, Mus musculus
ccgcatgctgccgtcgtcaaggcaa

SEQ ID NO: 239133 - DNA, 25 bp, Mus musculus
gtcaaggcaacgacctcactcggtc

SEQ ID NO: 239134 - DNA, 25 bp, Mus musculus
cacagaaatggtgcccggaggccgc

SEQ ID NO: 239135 - DNA, 25 bp, Mus musculus
gtttggagagctagacccaaccttc

SEQ ID NO: 239136 - DNA, 25 bp, Mus musculus
cgccagccaatcaggcatcagtttg

SEQ ID NO: 239137 - DNA, 25 bp, Mus musculus
agagcctagagctgcaacgagctcc

SEQ ID NO: 239138 - DNA, 25 bp, Mus musculus
gcaacccgaggcttcggaatccgga

SEQ ID NO: 239139 - DNA, 25 bp, Mus musculus
accaagcgcacacaccggacggttg

SEQ ID NO: 239140 - DNA, 25 bp, Mus musculus
taggcagccggcgagaacaatgttt

SEQ ID NO: 239141 - DNA, 25 bp, Mus musculus
acgcactcttgctggcgtaggcagc

SEQ ID NO: 239142 - DNA, 25 bp, Mus musculus
ggaggccgctactttcgcatctgcg

SEQ ID NO: 239143 - DNA, 25 bp, Mus musculus
ccggattcagtttccgggcacagaa

SEQ ID NO: 239144 - DNA, 25 bp, Mus musculus
gtcccactgcggagcacgcgcagaa

SEQ ID NO: 239145 - DNA, 25 bp, Mus musculus
agcagattctcctccctcgaagcaa

SEQ ID NO: 239146 - DNA, 25 bp, Mus musculus
aaaggctcggctctgcacgcacgca

SEQ ID NO: 239147 - DNA, 25 bp, Mus musculus
gagaacaatgtttccgccgcaccaa

SEQ ID NO: 239148 - DNA, 25 bp, Mus musculus
gcctgcaacgcagccctcttagggt

SEQ ID NO: 239149 - DNA, 25 bp, Mus musculus
gtccactggcgaccgcaggggatcc

SEQ ID NO: 239150 - DNA, 25 bp, Mus musculus
cgcccttctctagcgaggaacatca

SEQ ID NO: 239151 - DNA, 25 bp, Mus musculus
cagccttggagtgtgattggtcgct

SEQ ID NO: 239152 - DNA, 25 bp, Mus musculus
attggtcgctgtgcagccaattaga

SEQ ID NO: 239153 - DNA, 25 bp, Mus musculus
tgtgcagccaattagagagcctctg

SEQ ID NO: 239154 - DNA, 25 bp, Mus musculus
ttagagagcctctgctgctcaggcc

SEQ ID NO: 239155 - DNA, 25 bp, Mus musculus
ctctgctgctcaggccaagccgatt

SEQ ID NO: 239156 - DNA, 25 bp, Mus musculus
agctctttcattctccgttcccggg

SEQ ID NO: 239157 - DNA, 25 bp, Mus musculus
gcttgttcgcacacgcgaactagga

SEQ ID NO: 239158 - DNA, 25 bp, Mus musculus
agccctcttagggtctgaccttgga

SEQ ID NO: 239159 - DNA, 25 bp, Mus musculus
gtctgaccttggacgagctctttca

SEQ ID NO: 239160 - DNA, 25 bp, Mus musculus
accggaggctacgaggtccactggc

SEQ ID NO: 239161 - DNA, 25 bp, Mus musculus
caggccaagccgattggctaagaga

SEQ ID NO: 239162 - DNA, 25 bp, Mus musculus
agccgactgggcagggctgcgacca

SEQ ID NO: 239163 - DNA, 25 bp, Mus musculus
ggcggtcgtgttttctttggcagag

SEQ ID NO: 239164 - DNA, 25 bp, Mus musculus
tgaagccggcggctgagcgacaaga

SEQ ID NO: 239165 - DNA, 25 bp, Mus musculus
agcgacaagatgaatttcctccgtg

SEQ ID NO: 239166 - DNA, 25 bp, Mus musculus
ctagtctaatcagagcctcgggagc

SEQ ID NO: 239167 - DNA, 25 bp, Mus musculus
cccagcacactgaagccgagacggt

SEQ ID NO: 239168 - DNA, 25 bp, Mus musculus
ctaccagccgatgctcctagtctaa

SEQ ID NO: 239169 - DNA, 25 bp, Mus musculus
cacactgaagccgagacggtgagcg

SEQ ID NO: 239170 - DNA, 25 bp, Mus musculus
tcgagccgccacgtaacgccacgtc

SEQ ID NO: 239171 - DNA, 25 bp, Mus musculus
tgagatcggggcgtctacgccgctc

SEQ ID NO: 239172 - DNA, 25 bp, Mus musculus
taatcagagcctcgggagccgactg

SEQ ID NO: 239173 - DNA, 25 bp, Mus musculus
gctctcggcgacaaaacacctacca

SEQ ID NO: 239174 - DNA, 25 bp, Mus musculus
agccgatgctcctagtctaatcaga

SEQ ID NO: 239175 - DNA, 25 bp, Mus musculus
gatgaatttcctccgtggggtgatg

SEQ ID NO: 239176 - DNA, 25 bp, Mus musculus
cttccacatggaggacgacgtagtc

SEQ ID NO: 239177 - DNA, 25 bp, Mus musculus
agggcgaccacgaccctgcctccgc

SEQ ID NO: 239178 - DNA, 25 bp, Mus musculus
cgggaaagccagctccgccctaggg

SEQ ID NO: 239179 - DNA, 25 bp, Mus musculus
aggcccgatactcggcgcggcctcc

SEQ ID NO: 239180 - DNA, 25 bp, Mus musculus
ccacctcggcgactggaagagcaag

SEQ ID NO: 239181 - DNA, 25 bp, Mus musculus
catgctgcaggtgggcttcaggccc

SEQ ID NO: 239182 - DNA, 25 bp, Mus musculus
gacgacgtagtcttgcacatgctgc

SEQ ID NO: 239183 - DNA, 25 bp, Mus musculus
gtggactcttcttccacatggagga

SEQ ID NO: 239184 - DNA, 25 bp, Mus musculus
gatctcgccctgtggactcttcttc

SEQ ID NO: 239185 - DNA, 25 bp, Mus musculus
agtgatggcagaggatctcgccctg

SEQ ID NO: 239186 - DNA, 25 bp, Mus musculus
ccgttgctctgcgaaggaccggccg

SEQ ID NO: 239187 - DNA, 25 bp, Mus musculus
gcaccgcccggtctacggcaggaag

SEQ ID NO: 239188 - DNA, 25 bp, Mus musculus
cttgcacatgctgcaggtgggcttc

SEQ ID NO: 239189 - DNA, 25 bp, Mus musculus
cggcaggaagcccttctcccgagga

SEQ ID NO: 239190 - DNA, 25 bp, Mus musculus
tgcgcgttaactggaaggcgaaacc

SEQ ID NO: 239191 - DNA, 25 bp, Mus musculus
tcatttggaggtcagaggtcttttc

SEQ ID NO: 239192 - DNA, 25 bp, Mus musculus
gtcaccgagcggaccttcatttgga

SEQ ID NO: 239193 - DNA, 25 bp, Mus musculus
accaatcaaagacgcggacagaagc

SEQ ID NO: 239194 - DNA, 25 bp, Mus musculus
gcgcgctaaactgagagatcccgga

SEQ ID NO: 239195 - DNA, 25 bp, Mus musculus
ccgagctcccattgggcgcgctaaa

SEQ ID NO: 239196 - DNA, 25 bp, Mus musculus
tgttgtatttactctccgccgctcc

SEQ ID NO: 239197 - DNA, 25 bp, Mus musculus
cattttgcgctcctgttgtatttac

SEQ ID NO: 239198 - DNA, 25 bp, Mus musculus
aggctgtactttgccagatgcttcc

SEQ ID NO: 239199 - DNA, 25 bp, Mus musculus
ttcttggcagacatagagcccggcg

SEQ ID NO: 239200 - DNA, 25 bp, Mus musculus
cttctcctcggtgcgaaccttcttg

SEQ ID NO: 239201 - DNA, 25 bp, Mus musculus
ctggcggagaaagagtaacagctcc

SEQ ID NO: 239202 - DNA, 25 bp, Mus musculus
cgaccgaaactccaggctccattta

SEQ ID NO: 239203 - DNA, 25 bp, Mus musculus
ccgaaaaccaggagtttcagccatc

SEQ ID NO: 239204 - DNA, 25 bp, Mus musculus
gctgaggcaggaagctctccacctt

SEQ ID NO: 239205 - DNA, 25 bp, Mus musculus
ggcacttacgcggaagcctcgtagg

SEQ ID NO: 239206 - DNA, 25 bp, Mus musculus
gcctcgtaggccaggttgaccaaga

SEQ ID NO: 239207 - DNA, 25 bp, Mus musculus
aggccaggttgaccaagataccgtc

SEQ ID NO: 239208 - DNA, 25 bp, Mus musculus
accaagataccgtcagccaggctga

SEQ ID NO: 239209 - DNA, 25 bp, Mus musculus
agtcacagatgctgcggatctcgtc

SEQ ID NO: 239210 - DNA, 25 bp, Mus musculus
acaatttctccgaccatcccgagta

SEQ ID NO: 239211 - DNA, 25 bp, Mus musculus
tacccactggggaaccctgtcgcta

SEQ ID NO: 239212 - DNA, 25 bp, Mus musculus
ggggaaccctgtcgctagaaatgaa

SEQ ID NO: 239213 - DNA, 25 bp, Mus musculus
ccctgtcgctagaaatgaaaaagta

SEQ ID NO: 239214 - DNA, 25 bp, Mus musculus
tttgtttctcgtctcagagcatgga

SEQ ID NO: 239215 - DNA, 25 bp, Mus musculus
tctcagagcatggacagtgcacgta

SEQ ID NO: 239216 - DNA, 25 bp, Mus musculus
atggacagtgcacgtatgcgtggac

SEQ ID NO: 239217 - DNA, 25 bp, Mus musculus
ataccgtcagccaggctgaggttga

SEQ ID NO: 239218 - DNA, 25 bp, Mus musculus
acagccgacagccagggaccggaca

SEQ ID NO: 239219 - DNA, 25 bp, Mus musculus
aaaatgtgtggtaaacgcgcgcgcc

SEQ ID NO: 239220 - DNA, 25 bp, Mus musculus
tccgaatttgagagccgaactggcc

SEQ ID NO: 239221 - DNA, 25 bp, Mus musculus
cgaactggccttgctgggtcagcca

SEQ ID NO: 239222 - DNA, 25 bp, Mus musculus
cttgctgggtcagccacccgctggg

SEQ ID NO: 239223 - DNA, 25 bp, Mus musculus
agggaagagcagagcctgactacaa

SEQ ID NO: 239224 - DNA, 25 bp, Mus musculus
gcagagcctgactacaagttcacca

SEQ ID NO: 239225 - DNA, 25 bp, Mus musculus
tgactacaagttcaccagaccagtc

SEQ ID NO: 239226 - DNA, 25 bp, Mus musculus
tgcgccaccgcggtgcgcaagaagt

SEQ ID NO: 239227 - DNA, 25 bp, Mus musculus
cgcaagaagtctgggtcgtagtgcc

SEQ ID NO: 239228 - DNA, 25 bp, Mus musculus
tagtgccgcagcatcggcagccagc

SEQ ID NO: 239229 - DNA, 25 bp, Mus musculus
tccagactgacgttgaagagaggcg

SEQ ID NO: 239230 - DNA, 25 bp, Mus musculus
gcaggaggctccgaatttgagagcc

SEQ ID NO: 239231 - DNA, 25 bp, Mus musculus
gggccgcgtccagactgacgttgaa

SEQ ID NO: 239232 - DNA, 25 bp, Mus musculus
cgagtttttgctctgaggcggccaa

SEQ ID NO: 239233 - DNA, 25 bp, Mus musculus
ctcatcgtatgctaggggctaactc

SEQ ID NO: 239234 - DNA, 25 bp, Mus musculus
cctgctgcaactctttgtaggcgtc

SEQ ID NO: 239235 - DNA, 25 bp, Mus musculus
gcagcaggttttagggtgtgtttca

SEQ ID NO: 239236 - DNA, 25 bp, Mus musculus
ggtcccgcttgatcaggttctgtaa

SEQ ID NO: 239237 - DNA, 25 bp, Mus musculus
tcaggttctgtaactgcggcaggtt

SEQ ID NO: 239238 - DNA, 25 bp, Mus musculus
ctccctggcgagcagtgcttggaaa

SEQ ID NO: 239239 - DNA, 25 bp, Mus musculus
tgcttggaaaacgtccgcctctgtc

SEQ ID NO: 239240 - DNA, 25 bp, Mus musculus
gcagcttagactcgtgggtcccagt

SEQ ID NO: 239241 - DNA, 25 bp, Mus musculus
ccagtgtaaccggaaacggcacgtg

SEQ ID NO: 239242 - DNA, 25 bp, Mus musculus
ttgcccgaccgagctacggaacgct

SEQ ID NO: 239243 - DNA, 25 bp, Mus musculus
cggaacgctcagaggatcaaacttc

SEQ ID NO: 239244 - DNA, 25 bp, Mus musculus
gctatcggtccctgccggtggacaa

SEQ ID NO: 239245 - DNA, 25 bp, Mus musculus
tgtaggcgtctgcacgctatcggtc

SEQ ID NO: 239246 - DNA, 25 bp, Mus musculus
ttagacatggcagagaacgcgtttg

SEQ ID NO: 239247 - DNA, 25 bp, Mus musculus
tgatccataattaaaagggcacggg

SEQ ID NO: 239248 - DNA, 25 bp, Mus musculus
ggcgcgctactgtgagagaaattta

SEQ ID NO: 239249 - DNA, 25 bp, Mus musculus
gtgtgatttcaagagcgatcctttc

SEQ ID NO: 239250 - DNA, 25 bp, Mus musculus
cttttgctccgaaggtgaaggcgga

SEQ ID NO: 239251 - DNA, 25 bp, Mus musculus
gaacgcgtttgacgacgaatacctg

SEQ ID NO: 239252 - DNA, 25 bp, Mus musculus
cgacgaatacctgaagtgcaaaagc

SEQ ID NO: 239253 - DNA, 25 bp, Mus musculus
tgcaaaagcagaatggaatcgaagt

SEQ ID NO: 239254 - DNA, 25 bp, Mus musculus
tccgcacaatgggatgtgatccata

SEQ ID NO: 239255 - DNA, 25 bp, Mus musculus
gagtgggcaaacgatgcgctcctgc

SEQ ID NO: 239256 - DNA, 25 bp, Mus musculus
aaacgatgcgctcctgcggatggtg

SEQ ID NO: 239257 - DNA, 25 bp, Mus musculus
acaatgcggagatccagtgggaagc

SEQ ID NO: 239258 - DNA, 25 bp, Mus musculus
tcgaagtatattccgcagatgaaga

SEQ ID NO: 239259 - DNA, 25 bp, Mus musculus
agagcgatcctttccttttgctccg

SEQ ID NO: 239260 - DNA, 25 bp, Mus musculus
gaacgggaacgcctaccaccgatca

SEQ ID NO: 239261 - DNA, 25 bp, Mus musculus
agcaggcaggaaccaagcaaggatg

SEQ ID NO: 239262 - DNA, 25 bp, Mus musculus
caactttacccgtctggaccttgag

SEQ ID NO: 239263 - DNA, 25 bp, Mus musculus
gccctctccaaatgactccaaggtg

SEQ ID NO: 239264 - DNA, 25 bp, Mus musculus
actccaaggtgtcccgagtgccagg

SEQ ID NO: 239265 - DNA, 25 bp, Mus musculus
cccaaaattgaaagccatgtcgcgg

SEQ ID NO: 239266 - DNA, 25 bp, Mus musculus
tgcgggcagcctggctccaacttta

SEQ ID NO: 239267 - DNA, 25 bp, Mus musculus
cttctgtccggctgggaaccgtcag

SEQ ID NO: 239268 - DNA, 25 bp, Mus musculus
cttcccggtctaagcggagcaggca

SEQ ID NO: 239269 - DNA, 25 bp, Mus musculus
tcaggcggtccgtaccattagttcc

SEQ ID NO: 239270 - DNA, 25 bp, Mus musculus
gggatgatcgaacgggaacgcctac

SEQ ID NO: 239271 - DNA, 25 bp, Mus musculus
cccagccggaccgatcggatcgagg

SEQ ID NO: 239272 - DNA, 25 bp, Mus musculus
ctccgctcttctgtccggctgggaa

SEQ ID NO: 239273 - DNA, 25 bp, Mus musculus
tgaaagccatgtcgcgggagcagca

SEQ ID NO: 239274 - DNA, 25 bp, Mus musculus
gatcgtctggtctaccgccttctga

SEQ ID NO: 239275 - DNA, 25 bp, Mus musculus
gccttctgaaagactcgagccacta

SEQ ID NO: 239276 - DNA, 25 bp, Mus musculus
accgaacggcgagctggaacaagcc

SEQ ID NO: 239277 - DNA, 25 bp, Mus musculus
tcgagccactagcagcgtgacgctg

SEQ ID NO: 239278 - DNA, 25 bp, Mus musculus
tggaacaagcctccgccaaggccga

SEQ ID NO: 239279 - DNA, 25 bp, Mus musculus
cttctccgtgcgtgttcagccgctg

SEQ ID NO: 239280 - DNA, 25 bp, Mus musculus
ccctggagtagataccggaatgagc

SEQ ID NO: 239281 - DNA, 25 bp, Mus musculus
aatgagcagcagagccggtgcgatc

SEQ ID NO: 239282 - DNA, 25 bp, Mus musculus
gaggccttcagtcatgtgccctgca

SEQ ID NO: 239283 - DNA, 25 bp, Mus musculus
ggcgcggtcatccagggaactgaaa

SEQ ID NO: 239284 - DNA, 25 bp, Mus musculus
tccagggaactgaaatcgcccttcc

SEQ ID NO: 239285 - DNA, 25 bp, Mus musculus
ttcagatctctgctgagggcccacg

SEQ ID NO: 239286 - DNA, 25 bp, Mus musculus
agcagcgtgacgctggtcaccagca

SEQ ID NO: 239287 - DNA, 25 bp, Mus musculus
cgtgtagaagcagcatctgcccata

SEQ ID NO: 239288 - DNA, 25 bp, Mus musculus
cgatcgggagctggtctccaaagca

SEQ ID NO: 239289 - DNA, 25 bp, Mus musculus
ctgcactggggctcgtagtctccct

SEQ ID NO: 239290 - DNA, 25 bp, Mus musculus
tggggctcgtagtctccctcagcct

SEQ ID NO: 239291 - DNA, 25 bp, Mus musculus
tctctcagccatgggcgccgtctgg

SEQ ID NO: 239292 - DNA, 25 bp, Mus musculus
tgggcgccgtctggtcagccctgct

SEQ ID NO: 239293 - DNA, 25 bp, Mus musculus
ggtctagctggagcgctcatcctgt

SEQ ID NO: 239294 - DNA, 25 bp, Mus musculus
tgagccctgaaccttccgatcggga

SEQ ID NO: 239295 - DNA, 25 bp, Mus musculus
cctcgagctagttgttttgaagttc

SEQ ID NO: 239296 - DNA, 25 bp, Mus musculus
aaacgaaaggcacttggagccatgc

SEQ ID NO: 239297 - DNA, 25 bp, Mus musculus
cgacctcggactgaaccttcttcag

SEQ ID NO: 239298 - DNA, 25 bp, Mus musculus
ttcttcagccctcatcgcgttctgg

SEQ ID NO: 239299 - DNA, 25 bp, Mus musculus
ccctcatcgcgttctggggttgtcc

SEQ ID NO: 239300 - DNA, 25 bp, Mus musculus
ttctggggttgtcctgtcctggaga

SEQ ID NO: 239301 - DNA, 25 bp, Mus musculus
tagctggagcgctcatcctgtggct

SEQ ID NO: 239302 - DNA, 25 bp, Mus musculus
gggtccgagacttaagctgagccga

SEQ ID NO: 239303 - DNA, 25 bp, Mus musculus
tgcgcctgcagactgcgctccagta

SEQ ID NO: 239304 - DNA, 25 bp, Mus musculus
gctccagtacgctggtgcgtccaga

SEQ ID NO: 239305 - DNA, 25 bp, Mus musculus
ttcccttgaccgcagtctaggcaaa

SEQ ID NO: 239306 - DNA, 25 bp, Mus musculus
ccgcagtctaggcaaaggcagcacc

SEQ ID NO: 239307 - DNA, 25 bp, Mus musculus
gcacctcgccgggagacgcagagaa

SEQ ID NO: 239308 - DNA, 25 bp, Mus musculus
agagaagcacactcaccgcgaaacg

SEQ ID NO: 239309 - DNA, 25 bp, Mus musculus
cacagcacccgagagtctactagga

SEQ ID NO: 239310 - DNA, 25 bp, Mus musculus
taagctgagccgactgttgggtccc

SEQ ID NO: 239311 - DNA, 25 bp, Mus musculus
ttgggtccctcggtcaccacgtgat

SEQ ID NO: 239312 - DNA, 25 bp, Mus musculus
tgggagccggtttctccttaggaga

SEQ ID NO: 239313 - DNA, 25 bp, Mus musculus
tccttaggagaaagcgccagggccg

SEQ ID NO: 239314 - DNA, 25 bp, Mus musculus
tcctgccgcccagatgaaggagacg

SEQ ID NO: 239315 - DNA, 25 bp, Mus musculus
tattggttgagagaacggcagcccg

SEQ ID NO: 239316 - DNA, 25 bp, Mus musculus
tgcgagaccctgtcggctctcactg

SEQ ID NO: 239317 - DNA, 25 bp, Mus musculus
gaggcgcactccgtccgcatacctg

SEQ ID NO: 239318 - DNA, 25 bp, Mus musculus
tgctaacaacacctagccctaagag

SEQ ID NO: 239319 - DNA, 25 bp, Mus musculus
cgcggccgcacctgcgagaccctgt

SEQ ID NO: 239320 - DNA, 25 bp, Mus musculus
tccgtccgcatacctgctaacaaca

SEQ ID NO: 239321 - DNA, 25 bp, Mus musculus
gctctcactgcacccgagaccgcga

SEQ ID NO: 239322 - DNA, 25 bp, Mus musculus
cgcgcagctaccttaccacggcacc

SEQ ID NO: 239323 - DNA, 25 bp, Mus musculus
ccacggcacccgaccggccacctcg

SEQ ID NO: 239324 - DNA, 25 bp, Mus musculus
gaccggccacctcgaggcctcgagc

SEQ ID NO: 239325 - DNA, 25 bp, Mus musculus
tcgagctccctgcttctgcggagcg

SEQ ID NO: 239326 - DNA, 25 bp, Mus musculus
gctccctgcttctgcggagcgcaag

SEQ ID NO: 239327 - DNA, 25 bp, Mus musculus
ctgcggagcgcaagcccggtctgac

SEQ ID NO: 239328 - DNA, 25 bp, Mus musculus
ctaagagaccggccgcatgtccgcg

SEQ ID NO: 239329 - DNA, 25 bp, Mus musculus
taacaacacctagccctaagagacc

SEQ ID NO: 239330 - DNA, 25 bp, Mus musculus
ctgattgccaggtctttgtggctga

SEQ ID NO: 239331 - DNA, 25 bp, Mus musculus
gtgttatcgactgtaggccggctct

SEQ ID NO: 239332 - DNA, 25 bp, Mus musculus
ttatcgactgtaggccggctctgat

SEQ ID NO: 239333 - DNA, 25 bp, Mus musculus
actgtaggccggctctgattgccag

SEQ ID NO: 239334 - DNA, 25 bp, Mus musculus
taggccggctctgattgccaggtct

SEQ ID NO: 239335 - DNA, 25 bp, Mus musculus
gccggctctgattgccaggtctttg

SEQ ID NO: 239336 - DNA, 25 bp, Mus musculus
cactctcgcttcaggcggctgcaga

SEQ ID NO: 239337 - DNA, 25 bp, Mus musculus
actcctctgccacccgcactctcgc

SEQ ID NO: 239338 - DNA, 25 bp, Mus musculus
gaattcggccgagcgcactcctctg

SEQ ID NO: 239339 - DNA, 25 bp, Mus musculus
tgtggctgaattcggccgagcgcac

SEQ ID NO: 239340 - DNA, 25 bp, Mus musculus
tctttgtggctgaattcggccgagc

SEQ ID NO: 239341 - DNA, 25 bp, Mus musculus
ccaggtctttgtggctgaattcggc

SEQ ID NO: 239342 - DNA, 25 bp, Mus musculus
ggctctgattgccaggtctttgtgg

SEQ ID NO: 239343 - DNA, 25 bp, Mus musculus
ttgccaggtctttgtggctgaattc

SEQ ID NO: 239344 - DNA, 25 bp, Mus musculus
gagggacccaccatcgctgaaaatg

SEQ ID NO: 239345 - DNA, 25 bp, Mus musculus
ctttaaatgcggcttctgcggaggg

SEQ ID NO: 239346 - DNA, 25 bp, Mus musculus
cgctagcgcccgctttctttaaatg

SEQ ID NO: 239347 - DNA, 25 bp, Mus musculus
gggcaacaggagcaccgctagcgcc

SEQ ID NO: 239348 - DNA, 25 bp, Mus musculus
aattccgagggcaacaggagcaccg

SEQ ID NO: 239349 - DNA, 25 bp, Mus musculus
cggggacaggatcgaaaattccgag

SEQ ID NO: 239350 - DNA, 25 bp, Mus musculus
tgggtacaaagttttcgcacagcct

SEQ ID NO: 239351 - DNA, 25 bp, Mus musculus
tgcttgacaaaaatgggtacaaagt

SEQ ID NO: 239352 - DNA, 25 bp, Mus musculus
gcgctgaacttaatgcttgacaaaa

SEQ ID NO: 239353 - DNA, 25 bp, Mus musculus
ccctaacctaagaagcaagcgctga

SEQ ID NO: 239354 - DNA, 25 bp, Mus musculus
agacactaaggatttctgccctcca

SEQ ID NO: 239355 - DNA, 25 bp, Mus musculus
ggggtgacttcctccagacactaag

SEQ ID NO: 239356 - DNA, 25 bp, Mus musculus
agcgcagcgcatcgctgagatttgg

SEQ ID NO: 239357 - DNA, 25 bp, Mus musculus
tcgctgaaaatgctaaagaaaagaa

SEQ ID NO: 239358 - DNA, 25 bp, Mus musculus
ccgctgaattccagcgggtgtagtg

SEQ ID NO: 239359 - DNA, 25 bp, Mus musculus
ccgaaagcagtctgcggagaccctg

SEQ ID NO: 239360 - DNA, 25 bp, Mus musculus
cactcaggacttccgctgaattcca

SEQ ID NO: 239361 - DNA, 25 bp, Mus musculus
cttcgctgtcccgactgagtttatc

SEQ ID NO: 239362 - DNA, 25 bp, Mus musculus
ctgagtttatcttggcctgagggca

SEQ ID NO: 239363 - DNA, 25 bp, Mus musculus
gcagcgtgctgagcgatctaaccca

SEQ ID NO: 239364 - DNA, 25 bp, Mus musculus
taacccagcagggaagctcctcttg

SEQ ID NO: 239365 - DNA, 25 bp, Mus musculus
tctgggtcaggcactttaaaccgaa

SEQ ID NO: 239366 - DNA, 25 bp, Mus musculus
taaaccgaagccgacttgaccatgc

SEQ ID NO: 239367 - DNA, 25 bp, Mus musculus
cttgaccatgcctctggcgcgatga

SEQ ID NO: 239368 - DNA, 25 bp, Mus musculus
ggcgcgatgaagactccggagaact

SEQ ID NO: 239369 - DNA, 25 bp, Mus musculus
tccggagaacttggaggagcctagc

SEQ ID NO: 239370 - DNA, 25 bp, Mus musculus
tggaggagcctagcgccacgccaaa

SEQ ID NO: 239371 - DNA, 25 bp, Mus musculus
tcagtgtgaacgcagtgggtagacc

SEQ ID NO: 239372 - DNA, 25 bp, Mus musculus
gagttaatgctctacaccctcgctc

SEQ ID NO: 239373 - DNA, 25 bp, Mus musculus
accaaggccggcatccgtacaggga

SEQ ID NO: 239374 - DNA, 25 bp, Mus musculus
agggacccagcgagttaatgctcta

SEQ ID NO: 239375 - DNA, 25 bp, Mus musculus
tcctcgcaccgcacacaaagcgctg

SEQ ID NO: 239376 - DNA, 25 bp, Mus musculus
ccggcgagaacggacactcaccatg

SEQ ID NO: 239377 - DNA, 25 bp, Mus musculus
tcaccatgaagtcccgggcgaagtt

SEQ ID NO: 239378 - DNA, 25 bp, Mus musculus
ggcgaagttgtcctccccattgtga

SEQ ID NO: 239379 - DNA, 25 bp, Mus musculus
tcatggcctggaccctctggatgaa

SEQ ID NO: 239380 - DNA, 25 bp, Mus musculus
tggaccctctggatgaacctcctca

SEQ ID NO: 239381 - DNA, 25 bp, Mus musculus
tctggatgaacctcctcaggatctc

SEQ ID NO: 239382 - DNA, 25 bp, Mus musculus
caacttaaagagcagcgtcgctttc

SEQ ID NO: 239383 - DNA, 25 bp, Mus musculus
cgcctcaggaacacggctctcagtt

SEQ ID NO: 239384 - DNA, 25 bp, Mus musculus
tgtgatccggactcttcatggcctg

SEQ ID NO: 239385 - DNA, 25 bp, Mus musculus
cggcatccgtacagggacccagcga

SEQ ID NO: 239386 - DNA, 25 bp, Mus musculus
ttgaacacaacgaggagagctgaga

SEQ ID NO: 239387 - DNA, 25 bp, Mus musculus
cgccgtggccgcgaggtttgaactt

SEQ ID NO: 239388 - DNA, 25 bp, Mus musculus
tagcgctgagcgctggccaatcgcg

SEQ ID NO: 239389 - DNA, 25 bp, Mus musculus
ccgtaccatgctattgacatgcaaa

SEQ ID NO: 239390 - DNA, 25 bp, Mus musculus
ggcgccctccgtaccatgctattga

SEQ ID NO: 239391 - DNA, 25 bp, Mus musculus
taagcgccctgtgtcttccagcctt

SEQ ID NO: 239392 - DNA, 25 bp, Mus musculus
aacttggcggcagctcgggattccg

SEQ ID NO: 239393 - DNA, 25 bp, Mus musculus
agagctgagagagcgcctaagcgcc

SEQ ID NO: 239394 - DNA, 25 bp, Mus musculus
caccgcattccgagcgggagtcgca

SEQ ID NO: 239395 - DNA, 25 bp, Mus musculus
gggtcccttcacttgaacacaacga

SEQ ID NO: 239396 - DNA, 25 bp, Mus musculus
gtgcgtgggtcccttcacttgaaca

SEQ ID NO: 239397 - DNA, 25 bp, Mus musculus
agagagcgcctaagcgccctgtgtc

SEQ ID NO: 239398 - DNA, 25 bp, Mus musculus
ggcgggagacttccagaagcccagc

SEQ ID NO: 239399 - DNA, 25 bp, Mus musculus
tgacatgcaaatctagcgctgagcg

SEQ ID NO: 239400 - DNA, 25 bp, Mus musculus
ccgcatcttcgagcgcgacggcaag

SEQ ID NO: 239401 - DNA, 25 bp, Mus musculus
tcaagcagttccagcagagcgccct

SEQ ID NO: 239402 - DNA, 25 bp, Mus musculus
agtacttccagcagtgacctcgacg

SEQ ID NO: 239403 - DNA, 25 bp, Mus musculus
agcgctcctactcggagcccgagaa

SEQ ID NO: 239404 - DNA, 25 bp, Mus musculus
ccggcagcgtccatttctcggagtc

SEQ ID NO: 239405 - DNA, 25 bp, Mus musculus
ggccgactacatccagcgtaagacg

SEQ ID NO: 239406 - DNA, 25 bp, Mus musculus
ctcgacgatccaaaagccggcagcg

SEQ ID NO: 239407 - DNA, 25 bp, Mus musculus
cggcgcctcactgtcgagcagaaga

SEQ ID NO: 239408 - DNA, 25 bp, Mus musculus
tcggagtccactgaacacctgcgca

SEQ ID NO: 239409 - DNA, 25 bp, Mus musculus
cacctgcgcaatggggagcagaacc

SEQ ID NO: 239410 - DNA, 25 bp, Mus musculus
tgcagccatttgatccggagggccc

SEQ ID NO: 239411 - DNA, 25 bp, Mus musculus
agcacctttcagctctacagtgagg

SEQ ID NO: 239412 - DNA, 25 bp, Mus musculus
ttcagccgcgcctacagaaacagca

SEQ ID NO: 239413 - DNA, 25 bp, Mus musculus
ggccacgtcgtttcgtcgccgagac

SEQ ID NO: 239414 - DNA, 25 bp, Mus musculus
cgcaggaagctcttgaagtggctca

SEQ ID NO: 239415 - DNA, 25 bp, Mus musculus
tccggcttctcgcaggcgactgcag

SEQ ID NO: 239416 - DNA, 25 bp, Mus musculus
cgactgcagggtctccgagatcttc

SEQ ID NO: 239417 - DNA, 25 bp, Mus musculus
tccgagatcttctggcagcggctgt

SEQ ID NO: 239418 - DNA, 25 bp, Mus musculus
gctttccatctacagggcccggtcg

SEQ ID NO: 239419 - DNA, 25 bp, Mus musculus
agtaggtccctgtacctcctcttga

SEQ ID NO: 239420 - DNA, 25 bp, Mus musculus
gccaccgagttcacgaagcccttga

SEQ ID NO: 239421 - DNA, 25 bp, Mus musculus
agtcggtttcacctgcgctctggct

SEQ ID NO: 239422 - DNA, 25 bp, Mus musculus
tggctcagcagctctgcgttacgca

SEQ ID NO: 239423 - DNA, 25 bp, Mus musculus
ccggcctggcacagaaagtccagca

SEQ ID NO: 239424 - DNA, 25 bp, Mus musculus
catcgctgctgggtccttagtccct

SEQ ID NO: 239425 - DNA, 25 bp, Mus musculus
cttcgaccgaaacccaggcctggag

SEQ ID NO: 239426 - DNA, 25 bp, Mus musculus
ctgaacgacgctggcctgtcgcagc

SEQ ID NO: 239427 - DNA, 25 bp, Mus musculus
gcagcgaaagttcccgggataggtc

SEQ ID NO: 239428 - DNA, 25 bp, Mus musculus
ccgagtgtgagtactggggcctcac

SEQ ID NO: 239429 - DNA, 25 bp, Mus musculus
cgcccttagaagagattgcttgagc

SEQ ID NO: 239430 - DNA, 25 bp, Mus musculus
ctctcacggcgcacaaggcttagct

SEQ ID NO: 239431 - DNA, 25 bp, Mus musculus
gaggtacaacctctgcaccctgcgg

SEQ ID NO: 239432 - DNA, 25 bp, Mus musculus
acccttctgtgaggcgcccttagaa

SEQ ID NO: 239433 - DNA, 25 bp, Mus musculus
aacattagatcgctttggcgcgccc

SEQ ID NO: 239434 - DNA, 25 bp, Mus musculus
gggcctcacttctctagcgtgctga

SEQ ID NO: 239435 - DNA, 25 bp, Mus musculus
cgggaggccatgttgctggaataaa

SEQ ID NO: 239436 - DNA, 25 bp, Mus musculus
ggatcacggttcacctgctgcgttc

SEQ ID NO: 239437 - DNA, 25 bp, Mus musculus
cgtatcatcttatcagctgaccagg

SEQ ID NO: 239438 - DNA, 25 bp, Mus musculus
gtggctgacttcaaagcgtatcatc

SEQ ID NO: 239439 - DNA, 25 bp, Mus musculus
tgtcccggcacaggacgctttaatg

SEQ ID NO: 239440 - DNA, 25 bp, Mus musculus
cagcagccagtgtcggtaaagagca

SEQ ID NO: 239441 - DNA, 25 bp, Mus musculus
ggggcgtgtcaccaggtcaattttc

SEQ ID NO: 239442 - DNA, 25 bp, Mus musculus
aaggtgcgcggactctttttcctcg

SEQ ID NO: 239443 - DNA, 25 bp, Mus musculus
gagcgtacgaaaaagcgccggccgc

SEQ ID NO: 239444 - DNA, 25 bp, Mus musculus
gtgtctgtaaacaacgccagtgttc

SEQ ID NO: 239445 - DNA, 25 bp, Mus musculus
cccacggacgcataggagagtttga

SEQ ID NO: 239446 - DNA, 25 bp, Mus musculus
ttgaacaaagacgaacttccgtgtc

SEQ ID NO: 239447 - DNA, 25 bp, Mus musculus
ccgtgtcttatggacgcacaggaga

SEQ ID NO: 239448 - DNA, 25 bp, Mus musculus
cgcacaggagagtttgaacaaagac

SEQ ID NO: 239449 - DNA, 25 bp, Mus musculus
ctgggatgaaaagggaaagtgcatt

SEQ ID NO: 239450 - DNA, 25 bp, Mus musculus
ttcggccgcgcgtgtctgtaaacaa

SEQ ID NO: 239451 - DNA, 25 bp, Mus musculus
gactctttttcctcgggcgcgcgga

SEQ ID NO: 239452 - DNA, 25 bp, Mus musculus
ccgccgcctgttcggtgacgtaaga

SEQ ID NO: 239453 - DNA, 25 bp, Mus musculus
cggtgacgtaagaggcttgttagcc

SEQ ID NO: 239454 - DNA, 25 bp, Mus musculus
caaagacgagcttccggagacgacc

SEQ ID NO: 239455 - DNA, 25 bp, Mus musculus
cagtgttctcgtctcttcctggcca

SEQ ID NO: 239456 - DNA, 25 bp, Mus musculus
gaacccgcttcggtggcttcagtct

SEQ ID NO: 239457 - DNA, 25 bp, Mus musculus
ctccagggtgttctgaggctatacg

SEQ ID NO: 239458 - DNA, 25 bp, Mus musculus
ttcgcaccgttactgagcccaagta

SEQ ID NO: 239459 - DNA, 25 bp, Mus musculus
agtattaggctactgctcgctgcgg

SEQ ID NO: 239460 - DNA, 25 bp, Mus musculus
gaagccgcctccttccagttctttg

SEQ ID NO: 239461 - DNA, 25 bp, Mus musculus
ccagttctttgttcagtctcgagac

SEQ ID NO: 239462 - DNA, 25 bp, Mus musculus
agttagaagtccctgctgtgctgtc

SEQ ID NO: 239463 - DNA, 25 bp, Mus musculus
tggacacttttcctgtacgtcaaac

SEQ ID NO: 239464 - DNA, 25 bp, Mus musculus
acgctgtcggccacagagctgatca

SEQ ID NO: 239465 - DNA, 25 bp, Mus musculus
agctgatcagaactagccctggcca

SEQ ID NO: 239466 - DNA, 25 bp, Mus musculus
atgccacgcctccatgtctttaggg

SEQ ID NO: 239467 - DNA, 25 bp, Mus musculus
tcacccggttctggcttgcgtgatc

SEQ ID NO: 239468 - DNA, 25 bp, Mus musculus
aacaaggggtttgctcagctccgga

SEQ ID NO: 239469 - DNA, 25 bp, Mus musculus
taggggacattacgcttcttggaca

SEQ ID NO: 239470 - DNA, 25 bp, Mus musculus
tctcccggctgtttggaaacttgtc

SEQ ID NO: 239471 - DNA, 25 bp, Mus musculus
tcaggcagccctgcaaggtcagctc

SEQ ID NO: 239472 - DNA, 25 bp, Mus musculus
tatgcacaggcgctctcaggcagcc

SEQ ID NO: 239473 - DNA, 25 bp, Mus musculus
gcacagagcttgattcgagcaggta

SEQ ID NO: 239474 - DNA, 25 bp, Mus musculus
tggaaacttgtcacccttagcaggg

SEQ ID NO: 239475 - DNA, 25 bp, Mus musculus
actggttttgggcacagaatgctta

SEQ ID NO: 239476 - DNA, 25 bp, Mus musculus
ccactgattatgaagtccgggtcaa

SEQ ID NO: 239477 - DNA, 25 bp, Mus musculus
tggcgagactcctctccactgatta

SEQ ID NO: 239478 - DNA, 25 bp, Mus musculus
tcccgactttcaggatggtccagcc

SEQ ID NO: 239479 - DNA, 25 bp, Mus musculus
tccctgggcatcaaagaaggtggtg

SEQ ID NO: 239480 - DNA, 25 bp, Mus musculus
tgggagagggtcaccagttcttcca

SEQ ID NO: 239481 - DNA, 25 bp, Mus musculus
gggagcggccatcacatcccagtca

SEQ ID NO: 239482 - DNA, 25 bp, Mus musculus
gacctttctctacagggtccgtgtg

SEQ ID NO: 239483 - DNA, 25 bp, Mus musculus
tgccgtcctagatggtgcctgaaga

SEQ ID NO: 239484 - DNA, 25 bp, Mus musculus
cgccgagccgttctcacctgtgagg

SEQ ID NO: 239485 - DNA, 25 bp, Mus musculus
ctgagggcagtaaagacatgcaggc

SEQ ID NO: 239486 - DNA, 25 bp, Mus musculus
cattcagcgcgccagggtccggacg

SEQ ID NO: 239487 - DNA, 25 bp, Mus musculus
tcacctgcattcagcgcgccagggt

SEQ ID NO: 239488 - DNA, 25 bp, Mus musculus
cctccagacctcagacgcaaacaca

SEQ ID NO: 239489 - DNA, 25 bp, Mus musculus
cctgaacgagcaccagcagccattt

SEQ ID NO: 239490 - DNA, 25 bp, Mus musculus
tacctcattctcctccgcgggccct

SEQ ID NO: 239491 - DNA, 25 bp, Mus musculus
ggcacggaaacactctacctcattc

SEQ ID NO: 239492 - DNA, 25 bp, Mus musculus
ggtccgactccgaggcacggaaaca

SEQ ID NO: 239493 - DNA, 25 bp, Mus musculus
tcccgcccgccaaagtcccaactca

SEQ ID NO: 239494 - DNA, 25 bp, Mus musculus
gaaggacctcgacgctctggggtcc

SEQ ID NO: 239495 - DNA, 25 bp, Mus musculus
ggcctcgaagcggaaggacctcgac

SEQ ID NO: 239496 - DNA, 25 bp, Mus musculus
taaagacatgcaggcagcccgccgg

SEQ ID NO: 239497 - DNA, 25 bp, Mus musculus
ttctcacctgtgaggctctgagccc

SEQ ID NO: 239498 - DNA, 25 bp, Mus musculus
tgataaacctttgaacccgagccac

SEQ ID NO: 239499 - DNA, 25 bp, Mus musculus
ggcagtctcagacagggaaccgaca

SEQ ID NO: 239500 - DNA, 25 bp, Mus musculus
ggaaccgacaggaacctcgccacga

SEQ ID NO: 239501 - DNA, 25 bp, Mus musculus
cgccacgagggcactgaagccaggt

SEQ ID NO: 239502 - DNA, 25 bp, Mus musculus
ttcgcatttccgtgcagttgaaacc

SEQ ID NO: 239503 - DNA, 25 bp, Mus musculus
ttcgtcagcacaatccggaacagtc

SEQ ID NO: 239504 - DNA, 25 bp, Mus musculus
atccggaacagtcaacatggcggcg

SEQ ID NO: 239505 - DNA, 25 bp, Mus musculus
gccgtaaggtgcctccgtagaggta

SEQ ID NO: 239506 - DNA, 25 bp, Mus musculus
ttgcgtggaaagtaaatctagagcc

SEQ ID NO: 239507 - DNA, 25 bp, Mus musculus
gtttcctgttgcagcggaatccatg

SEQ ID NO: 239508 - DNA, 25 bp, Mus musculus
gcagcggaatccatggcagaatctc

SEQ ID NO: 239509 - DNA, 25 bp, Mus musculus
tggcagaatctcgtaggcaccggtc

SEQ ID NO: 239510 - DNA, 25 bp, Mus musculus
acccgagccacgaaaggcagtctca

SEQ ID NO: 239511 - DNA, 25 bp, Mus musculus
ccggtcagcttctcggtcctcgaaa

SEQ ID NO: 239512 - DNA, 25 bp, Mus musculus
ctccggaggaactggtctagcccga

SEQ ID NO: 239513 - DNA, 25 bp, Mus musculus
acaaagtttgcaaccagcggccctg

SEQ ID NO: 239514 - DNA, 25 bp, Mus musculus
cctcggccgatgctacacggacaga

SEQ ID NO: 239515 - DNA, 25 bp, Mus musculus
tgaaaagctgccgaggaggaacctg

SEQ ID NO: 239516 - DNA, 25 bp, Mus musculus
tagcccgaggcaatgctgcggaatc

SEQ ID NO: 239517 - DNA, 25 bp, Mus musculus
cgctgacctgcaactttcctgctag

SEQ ID NO: 239518 - DNA, 25 bp, Mus musculus
actttcctgctagtcttggcggcga

SEQ ID NO: 239519 - DNA, 25 bp, Mus musculus
gccgctctgctggagaacccagtga

SEQ ID NO: 239520 - DNA, 25 bp, Mus musculus
actgagtgttactgtcggccgcatc

SEQ ID NO: 239521 - DNA, 25 bp, Mus musculus
ccacagcctgaggtttggcagagag

SEQ ID NO: 239522 - DNA, 25 bp, Mus musculus
ttcttggatgctgaaggctgggatc

SEQ ID NO: 239523 - DNA, 25 bp, Mus musculus
tgggatcttcctgcgagagtgccgc

SEQ ID NO: 239524 - DNA, 25 bp, Mus musculus
cggagctcctgcagggccgcacaaa

SEQ ID NO: 239525 - DNA, 25 bp, Mus musculus
gctgcggaatcccagcagccgctga

SEQ ID NO: 239526 - DNA, 25 bp, Mus musculus
cgatcctctcgggatagagtctgga

SEQ ID NO: 239527 - DNA, 25 bp, Mus musculus
gcggcttcgcaagctcgtccatggg

SEQ ID NO: 239528 - DNA, 25 bp, Mus musculus
gccgctaccaggtcaccctggagga

SEQ ID NO: 239529 - DNA, 25 bp, Mus musculus
aggacacctgggcttcgcaagtcgc

SEQ ID NO: 239530 - DNA, 25 bp, Mus musculus
ggagccctggaaaaccgatcctctc

SEQ ID NO: 239531 - DNA, 25 bp, Mus musculus
ctggaaaactggctgagactcgaag

SEQ ID NO: 239532 - DNA, 25 bp, Mus musculus
tcgaagccggcagcttccgagagtg

SEQ ID NO: 239533 - DNA, 25 bp, Mus musculus
gctgctggcggcatttaaggactcc

SEQ ID NO: 239534 - DNA, 25 bp, Mus musculus
taaggactccagagcggcacacaca

SEQ ID NO: 239535 - DNA, 25 bp, Mus musculus
tgacacgggccggaaccgtcacttc

SEQ ID NO: 239536 - DNA, 25 bp, Mus musculus
gcccggctctgcaagcggttggcac

SEQ ID NO: 239537 - DNA, 25 bp, Mus musculus
ggcgggaccatgaagaagttctctc

SEQ ID NO: 239538 - DNA, 25 bp, Mus musculus
agttctctcggatgcccaagtcgga

SEQ ID NO: 239539 - DNA, 25 bp, Mus musculus
ggaacctgcgagcttcgcgctgctc

SEQ ID NO: 239540 - DNA, 25 bp, Mus musculus
cacacaggcggcgacaacggacgaa

SEQ ID NO: 239541 - DNA, 25 bp, Mus musculus
atcctcggggctggaccgcccagaa

SEQ ID NO: 239542 - DNA, 25 bp, Mus musculus
ccctgaaccgaaagcagcctgggga

SEQ ID NO: 239543 - DNA, 25 bp, Mus musculus
taggctgagaggtgtaagcccgccc

SEQ ID NO: 239544 - DNA, 25 bp, Mus musculus
tgagaggtgtaagcccgcccggaat

SEQ ID NO: 239545 - DNA, 25 bp, Mus musculus
agccatggctctgcggctggtcact

SEQ ID NO: 239546 - DNA, 25 bp, Mus musculus
tctgcggctggtcactcacttcgat

SEQ ID NO: 239547 - DNA, 25 bp, Mus musculus
cggctggtcactcacttcgatgtgc

SEQ ID NO: 239548 - DNA, 25 bp, Mus musculus
tcactcacttcgatgtgctggagga

SEQ ID NO: 239549 - DNA, 25 bp, Mus musculus
tcacttcgatgtgctggaggacgtg

SEQ ID NO: 239550 - DNA, 25 bp, Mus musculus
gtgctcccgagtctgctcacacagg

SEQ ID NO: 239551 - DNA, 25 bp, Mus musculus
gcccagaaccctgaaccgaaagcag

SEQ ID NO: 239552 - DNA, 25 bp, Mus musculus
gacaacggacgaaggagacagagca

SEQ ID NO: 239553 - DNA, 25 bp, Mus musculus
tctgctcacacaggcggcgacaacg

SEQ ID NO: 239554 - DNA, 25 bp, Mus musculus
ggggaacatcatcggggtcctcctc

SEQ ID NO: 239555 - DNA, 25 bp, Mus musculus
caggccatggtagaagtagtacttc

SEQ ID NO: 239556 - DNA, 25 bp, Mus musculus
ggacacgtacttggcgccgaagttc

SEQ ID NO: 239557 - DNA, 25 bp, Mus musculus
cttggcaatggacctcagcgggcca

SEQ ID NO: 239558 - DNA, 25 bp, Mus musculus
cgtcgttgccttggcaatggacctc

SEQ ID NO: 239559 - DNA, 25 bp, Mus musculus
cggatgttcatcctggcgtcgttgc

SEQ ID NO: 239560 - DNA, 25 bp, Mus musculus
catgttcatcaggtcgtcgggccgg

SEQ ID NO: 239561 - DNA, 25 bp, Mus musculus
gccacgacaggccatggtagaagta

SEQ ID NO: 239562 - DNA, 25 bp, Mus musculus
ctcatcctcggcgatgtaggagagc

SEQ ID NO: 239563 - DNA, 25 bp, Mus musculus
ggacatagcccacgatcttgccgtc

SEQ ID NO: 239564 - DNA, 25 bp, Mus musculus
atcatcggggtcctcctccatcttg

SEQ ID NO: 239565 - DNA, 25 bp, Mus musculus
cgatcatcgcccgtgaggcctggtc

SEQ ID NO: 239566 - DNA, 25 bp, Mus musculus
tggcgccgaagttctcgatcatcgc

SEQ ID NO: 239567 - DNA, 25 bp, Mus musculus
tggccaggacatagcccacgatctt

SEQ ID NO: 239568 - DNA, 25 bp, Mus musculus
cgcgcgagaccaaaaaacggtcctg

SEQ ID NO: 239569 - DNA, 25 bp, Mus musculus
ggccgccaaaccagcgactcccagg

SEQ ID NO: 239570 - DNA, 25 bp, Mus musculus
gctccaaaggcaccgtgaagggctc

SEQ ID NO: 239571 - DNA, 25 bp, Mus musculus
agcctgggctccaaaggcaccgtga

SEQ ID NO: 239572 - DNA, 25 bp, Mus musculus
cgcgccagaactaggccagggagcc

SEQ ID NO: 239573 - DNA, 25 bp, Mus musculus
tcccggcgaccgctttgatactgcg

SEQ ID NO: 239574 - DNA, 25 bp, Mus musculus
gactcgctgcagtgctgcactcgct

SEQ ID NO: 239575 - DNA, 25 bp, Mus musculus
ggacaacctgctagctcgcacctgg

SEQ ID NO: 239576 - DNA, 25 bp, Mus musculus
gccgccagcagatgtcgggacaacc

SEQ ID NO: 239577 - DNA, 25 bp, Mus musculus
aactacctccgctgacaatcggcag

SEQ ID NO: 239578 - DNA, 25 bp, Mus musculus
aaaaacggtcctgccgctctcaact

SEQ ID NO: 239579 - DNA, 25 bp, Mus musculus
aggcaccgtgaagggctcactgccc

SEQ ID NO: 239580 - DNA, 25 bp, Mus musculus
cgctttgatactgcgcgcaccagct

SEQ ID NO: 239581 - DNA, 25 bp, Mus musculus
cacctgcgggactcgctgcagtgct

SEQ ID NO: 239582 - DNA, 25 bp, Mus musculus
ctgccgccggaactctgggcaaatc

SEQ ID NO: 239583 - DNA, 25 bp, Mus musculus
gcggatgactaacgcctgccagatt

SEQ ID NO: 239584 - DNA, 25 bp, Mus musculus
cacacttgagggttcgtgctgagca

SEQ ID NO: 239585 - DNA, 25 bp, Mus musculus
cgacgagccacacaagcacacttga

SEQ ID NO: 239586 - DNA, 25 bp, Mus musculus
ctcctcgcggcactttataactttc

SEQ ID NO: 239587 - DNA, 25 bp, Mus musculus
gacagctctcgggacaagttcctcg

SEQ ID NO: 239588 - DNA, 25 bp, Mus musculus
gttgctgcagacaatgaggcccgca

SEQ ID NO: 239589 - DNA, 25 bp, Mus musculus
tctctggctcacagtcccttgggct

SEQ ID NO: 239590 - DNA, 25 bp, Mus musculus
tgggcaaatcccagtggacagagtc

SEQ ID NO: 239591 - DNA, 25 bp, Mus musculus
gtcctgggaggacaaagagagtctc

SEQ ID NO: 239592 - DNA, 25 bp, Mus musculus
cccaacagctgccactgaggagaga

SEQ ID NO: 239593 - DNA, 25 bp, Mus musculus
gctgggatgccctctccaagctcag

SEQ ID NO: 239594 - DNA, 25 bp, Mus musculus
ccgggcttcacagagcagagacgtg

SEQ ID NO: 239595 - DNA, 25 bp, Mus musculus
tccggattccggagagttgctgcag

SEQ ID NO: 239596 - DNA, 25 bp, Mus musculus
cccagctcagaggaaagctgcttcg

SEQ ID NO: 239597 - DNA, 25 bp, Mus musculus
ctgctgcagaagagcccagtacgga

SEQ ID NO: 239598 - DNA, 25 bp, Mus musculus
cagtacggatcggaaagcctaggct

SEQ ID NO: 239599 - DNA, 25 bp, Mus musculus
caggctccagatggcggttccttgc

SEQ ID NO: 239600 - DNA, 25 bp, Mus musculus
aaagcctaggctgggataccggccg

SEQ ID NO: 239601 - DNA, 25 bp, Mus musculus
accgcggtttcagagcgagggactt

SEQ ID NO: 239602 - DNA, 25 bp, Mus musculus
agggacttcagaggtcggctcgccc

SEQ ID NO: 239603 - DNA, 25 bp, Mus musculus
cccacattccgcaggtaggaagcag

SEQ ID NO: 239604 - DNA, 25 bp, Mus musculus
tggaccacccgtgggacaaccaaca

SEQ ID NO: 239605 - DNA, 25 bp, Mus musculus
acaaccaacagtggctgcgcagccg

SEQ ID NO: 239606 - DNA, 25 bp, Mus musculus
acctgctctggaggcaggctgtgtc

SEQ ID NO: 239607 - DNA, 25 bp, Mus musculus
aagctgcttcgaccggaaggacgcc

SEQ ID NO: 239608 - DNA, 25 bp, Mus musculus
ttccttgcgctctgtttgcggtccc

SEQ ID NO: 239609 - DNA, 25 bp, Mus musculus
gcagctagaacctgctctggaggca

SEQ ID NO: 239610 - DNA, 25 bp, Mus musculus
ctattagcccggctgtgggaccttt

SEQ ID NO: 239611 - DNA, 25 bp, Mus musculus
ccagacaatgccagcccggagtgga

SEQ ID NO: 239612 - DNA, 25 bp, Mus musculus
catccggcagtagcgaccggctttc

SEQ ID NO: 239613 - DNA, 25 bp, Mus musculus
gaccggctttcagcgagcccagctg

SEQ ID NO: 239614 - DNA, 25 bp, Mus musculus
agcccagctggctctgagtttccca

SEQ ID NO: 239615 - DNA, 25 bp, Mus musculus
ctctgagtttcccaggaggatctgc

SEQ ID NO: 239616 - DNA, 25 bp, Mus musculus
tcccaggaggatctgcgaaggaaga

SEQ ID NO: 239617 - DNA, 25 bp, Mus musculus
ctgcgaaggaagagaacccgggcct

SEQ ID NO: 239618 - DNA, 25 bp, Mus musculus
cgtaggactgtgaaaggctagatac

SEQ ID NO: 239619 - DNA, 25 bp, Mus musculus
agatactataaagcccggggtcctg

SEQ ID NO: 239620 - DNA, 25 bp, Mus musculus
gggtcctgcctatcgctattgtggc

SEQ ID NO: 239621 - DNA, 25 bp, Mus musculus
cgctattgtggctgatttgcgtcaa

SEQ ID NO: 239622 - DNA, 25 bp, Mus musculus
tgatttgcgtcaaggcggccaccga

SEQ ID NO: 239623 - DNA, 25 bp, Mus musculus
cgaggcagcatggaccgctattagc

SEQ ID NO: 239624 - DNA, 25 bp, Mus musculus
gaagtccgacaggtagtgcacgcgc

SEQ ID NO: 239625 - DNA, 25 bp, Mus musculus
gccctcctggtcatacacatagacg

SEQ ID NO: 239626 - DNA, 25 bp, Mus musculus
tggacagaaagacctcagcctcatg

SEQ ID NO: 239627 - DNA, 25 bp, Mus musculus
ctggggacccgacttgtcactggcc

SEQ ID NO: 239628 - DNA, 25 bp, Mus musculus
ccgagcgggcagcagaagtccgaca

SEQ ID NO: 239629 - DNA, 25 bp, Mus musculus
gacgaactcgcgtccggtggacaga

SEQ ID NO: 239630 - DNA, 25 bp, Mus musculus
gacagttgctctacggtccgctaga

SEQ ID NO: 239631 - DNA, 25 bp, Mus musculus
gaaactggtacaccgcctgggcgcc

SEQ ID NO: 239632 - DNA, 25 bp, Mus musculus
gccatacctggtcgggaaactggta

SEQ ID NO: 239633 - DNA, 25 bp, Mus musculus
atggccaggagctgcaggtgccata

SEQ ID NO: 239634 - DNA, 25 bp, Mus musculus
acgtagagtgccctgcggatggcca

SEQ ID NO: 239635 - DNA, 25 bp, Mus musculus
ccagtccgggcacacaggacgtaga

SEQ ID NO: 239636 - DNA, 25 bp, Mus musculus
cgacaggcagtagatgccagtccgg

SEQ ID NO: 239637 - DNA, 25 bp, Mus musculus
ccagcgagtccaacgacaggcagta

SEQ ID NO: 239638 - DNA, 25 bp, Mus musculus
gccaaacggccgcatcggacgagcg

SEQ ID NO: 239639 - DNA, 25 bp, Mus musculus
cgcttctccgagaggccgctggcga

SEQ ID NO: 239640 - DNA, 25 bp, Mus musculus
cgctggcgacctccaaggaggagtt

SEQ ID NO: 239641 - DNA, 25 bp, Mus musculus
cctccaaggaggagttggtgtgcac

SEQ ID NO: 239642 - DNA, 25 bp, Mus musculus
gtgtgcacgccgcagcagtaccgcg

SEQ ID NO: 239643 - DNA, 25 bp, Mus musculus
cgccggcagctacttcggcctggag

SEQ ID NO: 239644 - DNA, 25 bp, Mus musculus
gccttcacctcggtgtcgcagctgg

SEQ ID NO: 239645 - DNA, 25 bp, Mus musculus
acgagcggaagagcgccttctcgca

SEQ ID NO: 239646 - DNA, 25 bp, Mus musculus
tcctcggccagaagctgggcgctct

SEQ ID NO: 239647 - DNA, 25 bp, Mus musculus
ctctcgagccgtgtcacccgggaga

SEQ ID NO: 239648 - DNA, 25 bp, Mus musculus
gacggcgtgggtcccaccagactct

SEQ ID NO: 239649 - DNA, 25 bp, Mus musculus
ccgatccgctggctgtgaagctgca

SEQ ID NO: 239650 - DNA, 25 bp, Mus musculus
gccttctggcccaagagctcggctg

SEQ ID NO: 239651 - DNA, 25 bp, Mus musculus
cccgagaagttgctggctccgcgtc

SEQ ID NO: 239652 - DNA, 25 bp, Mus musculus
gactgggtggctcttgacaaccgct

SEQ ID NO: 239653 - DNA, 25 bp, Mus musculus
aagcggctcggaacatagcagtttc

SEQ ID NO: 239654 - DNA, 25 bp, Mus musculus
agtcgcagcttctccgggcagccaa

SEQ ID NO: 239655 - DNA, 25 bp, Mus musculus
gagaagcgtctcactcccgaagggc

SEQ ID NO: 239656 - DNA, 25 bp, Mus musculus
acctgatccacagcgcttgggctca

SEQ ID NO: 239657 - DNA, 25 bp, Mus musculus
tgtccttgctcttcctcatcttctg

SEQ ID NO: 239658 - DNA, 25 bp, Mus musculus
cggccggaagaatgagcctgtcctt

SEQ ID NO: 239659 - DNA, 25 bp, Mus musculus
gagccagccctgcaagatgcactta

SEQ ID NO: 239660 - DNA, 25 bp, Mus musculus
tagcagtttccagtggagcccttcg

SEQ ID NO: 239661 - DNA, 25 bp, Mus musculus
gcgttataaatatcccggtgccagc

SEQ ID NO: 239662 - DNA, 25 bp, Mus musculus
gcgtgcacggagcagtgagatcact

SEQ ID NO: 239663 - DNA, 25 bp, Mus musculus
cgtaccggccgtgagtacacaaagc

SEQ ID NO: 239664 - DNA, 25 bp, Mus musculus
gcttctgagggcgagacacctcctc

SEQ ID NO: 239665 - DNA, 25 bp, Mus musculus
aaccgctgggttgcatgacccgtgc

SEQ ID NO: 239666 - DNA, 25 bp, Mus musculus
ttactagggacgcgtcggtgtagcc

SEQ ID NO: 239667 - DNA, 25 bp, Mus musculus
ccctggcggtgacggcgctcaccgc

SEQ ID NO: 239668 - DNA, 25 bp, Mus musculus
tactacctggaggtaagcgcgggtc

SEQ ID NO: 239669 - DNA, 25 bp, Mus musculus
gtcgacctgtactacctggaggtaa

SEQ ID NO: 239670 - DNA, 25 bp, Mus musculus
ctacggtcgacctgtactacctgga

SEQ ID NO: 239671 - DNA, 25 bp, Mus musculus
ctcagatcactacggtcgacctgta

SEQ ID NO: 239672 - DNA, 25 bp, Mus musculus
tggactctcagatcactacggtcga

SEQ ID NO: 239673 - DNA, 25 bp, Mus musculus
ttcctggactctcagatcactacgg

SEQ ID NO: 239674 - DNA, 25 bp, Mus musculus
cctatgaagacttcctggactctca

SEQ ID NO: 239675 - DNA, 25 bp, Mus musculus
gttcaacacctatgaagacttcctg

SEQ ID NO: 239676 - DNA, 25 bp, Mus musculus
ttgtcacacagttcaacacctatga

SEQ ID NO: 239677 - DNA, 25 bp, Mus musculus
ggccgtggacaacattgtcacacag

SEQ ID NO: 239678 - DNA, 25 bp, Mus musculus
gcgctcaccgcaggcctctggcttc

SEQ ID NO: 239679 - DNA, 25 bp, Mus musculus
tgtagccgcgatggatcaggacgag

SEQ ID NO: 239680 - DNA, 25 bp, Mus musculus
ctggtggagcgcagatccagatccc

SEQ ID NO: 239681 - DNA, 25 bp, Mus musculus
gagagcccgcgcttgacaactcggc

SEQ ID NO: 239682 - DNA, 25 bp, Mus musculus
acccgaagtagagcggtgcgacagc

SEQ ID NO: 239683 - DNA, 25 bp, Mus musculus
cgacagcaggacttcgctatggccg

SEQ ID NO: 239684 - DNA, 25 bp, Mus musculus
ctgctctgtctatggctaggttact

SEQ ID NO: 239685 - DNA, 25 bp, Mus musculus
tacttctgcctgaacctggcacagg

SEQ ID NO: 239686 - DNA, 25 bp, Mus musculus
gagaccaaacttgcacctcccggga

SEQ ID NO: 239687 - DNA, 25 bp, Mus musculus
ctccgtgagactgagccaagcgacc

SEQ ID NO: 239688 - DNA, 25 bp, Mus musculus
ccgcacgacaaggtgtcggagcata

SEQ ID NO: 239689 - DNA, 25 bp, Mus musculus
cggagcatatgctgtggctctatga

SEQ ID NO: 239690 - DNA, 25 bp, Mus musculus
ctctatgacaggtacagcggcagca

SEQ ID NO: 239691 - DNA, 25 bp, Mus musculus
agcagtagagtccaggctacccgga

SEQ ID NO: 239692 - DNA, 25 bp, Mus musculus
taacacggtccgcagcttcagagcc

SEQ ID NO: 239693 - DNA, 25 bp, Mus musculus
tgttcccagtctcaggtggcacgga

SEQ ID NO: 239694 - DNA, 25 bp, Mus musculus
gtagggcgataacatcgtggatgca

SEQ ID NO: 239695 - DNA, 25 bp, Mus musculus
ggcgataacatcgtggatgcaagcg

SEQ ID NO: 239696 - DNA, 25 bp, Mus musculus
tccttgaaggtggggtcacccgcgc

SEQ ID NO: 239697 - DNA, 25 bp, Mus musculus
cttaagtagggcgataacatcgtgg

SEQ ID NO: 239698 - DNA, 25 bp, Mus musculus
gcaacttaagtagggcgataacatc

SEQ ID NO: 239699 - DNA, 25 bp, Mus musculus
cgtgaggcaacttaagtagggcgat

SEQ ID NO: 239700 - DNA, 25 bp, Mus musculus
ccgaacctccggcgtgaggcaactt

SEQ ID NO: 239701 - DNA, 25 bp, Mus musculus
gtgctgccgcctggctgctctgcgg

SEQ ID NO: 239702 - DNA, 25 bp, Mus musculus
cggcgacagtctgcactttataccc

SEQ ID NO: 239703 - DNA, 25 bp, Mus musculus
cgacggcgacagtctgcactttata

SEQ ID NO: 239704 - DNA, 25 bp, Mus musculus
acctgtactccggagccggcctgcg

SEQ ID NO: 239705 - DNA, 25 bp, Mus musculus
gcgcgaacctgtactccggagccgg

SEQ ID NO: 239706 - DNA, 25 bp, Mus musculus
gccggcgcgaacctgtactccggag

SEQ ID NO: 239707 - DNA, 25 bp, Mus musculus
cccggagcccgcttccttgaaggtg

SEQ ID NO: 239708 - DNA, 25 bp, Mus musculus
caaggctgaagcgttccaagggaga

SEQ ID NO: 239709 - DNA, 25 bp, Mus musculus
tggccattctgtcggacgacatcga

SEQ ID NO: 239710 - DNA, 25 bp, Mus musculus
atcggcaggagatggccattctgtc

SEQ ID NO: 239711 - DNA, 25 bp, Mus musculus
tcaagtatgatgctgatcggcagga

SEQ ID NO: 239712 - DNA, 25 bp, Mus musculus
acagcctgcaggtcaagtatgatgc

SEQ ID NO: 239713 - DNA, 25 bp, Mus musculus
ttgcgcacccggatggcgaccgcgt

SEQ ID NO: 239714 - DNA, 25 bp, Mus musculus
atcagcgcccgatgactctggggcc

SEQ ID NO: 239715 - DNA, 25 bp, Mus musculus
cggcagggatcagcgcccgatgact

SEQ ID NO: 239716 - DNA, 25 bp, Mus musculus
caagggagagcatgttcggccgcct

SEQ ID NO: 239717 - DNA, 25 bp, Mus musculus
cagctcgtggttcttgtggtcccgg

SEQ ID NO: 239718 - DNA, 25 bp, Mus musculus
acccgaggcagctcgtggttcttgt

SEQ ID NO: 239719 - DNA, 25 bp, Mus musculus
ccttcgtgactgacccgaggcagct

SEQ ID NO: 239720 - DNA, 25 bp, Mus musculus
cttccttggcggagccgtgcatgct

SEQ ID NO: 239721 - DNA, 25 bp, Mus musculus
ctcggggctcggacttgcggctcca

SEQ ID NO: 239722 - DNA, 25 bp, Mus musculus
gatccagtcggggtccttgtttata

SEQ ID NO: 239723 - DNA, 25 bp, Mus musculus
gccttgtgtgctctacctgtaaata

SEQ ID NO: 239724 - DNA, 25 bp, Mus musculus
tttgtgcactcatgtgtcgccgagt

SEQ ID NO: 239725 - DNA, 25 bp, Mus musculus
cgctgcccgcggctgtttgtgcact

SEQ ID NO: 239726 - DNA, 25 bp, Mus musculus
cttgctggcgcagcgggtctccgca

SEQ ID NO: 239727 - DNA, 25 bp, Mus musculus
ggactcccgtgacgctgcggccgta

SEQ ID NO: 239728 - DNA, 25 bp, Mus musculus
tttatactgaaactccagcccgagc

SEQ ID NO: 239729 - DNA, 25 bp, Mus musculus
caaaaggcgagctcaggaccgggaa

SEQ ID NO: 239730 - DNA, 25 bp, Mus musculus
tctgccaatgctcgccagccgagga

SEQ ID NO: 239731 - DNA, 25 bp, Mus musculus
actcctagttctgtggctctgccaa

SEQ ID NO: 239732 - DNA, 25 bp, Mus musculus
cagcaggcgcgagaactcctagttc

SEQ ID NO: 239733 - DNA, 25 bp, Mus musculus
cgccgagtgtgtattcatttgcctt

SEQ ID NO: 239734 - DNA, 25 bp, Mus musculus
tcctgcgctggccaatcgtggcgca

SEQ ID NO: 239735 - DNA, 25 bp, Mus musculus
tacctgtaaataccggctcgactcg

SEQ ID NO: 239736 - DNA, 25 bp, Mus musculus
ttgctcggcagcgtgcagcccagga

SEQ ID NO: 239737 - DNA, 25 bp, Mus musculus
cgcctcaagtgagagcctaagccgg

SEQ ID NO: 239738 - DNA, 25 bp, Mus musculus
tagagtgcaggcgacgcctcaagtg

SEQ ID NO: 239739 - DNA, 25 bp, Mus musculus
ccagcccgcccaagggtagagtgca

SEQ ID NO: 239740 - DNA, 25 bp, Mus musculus
gagctcagagcagcgacagcccagc

SEQ ID NO: 239741 - DNA, 25 bp, Mus musculus
cactagcgccgtagtaaagggaagg

SEQ ID NO: 239742 - DNA, 25 bp, Mus musculus
gctgaatgtcactagcgccgtagta

SEQ ID NO: 239743 - DNA, 25 bp, Mus musculus
gcgttagcctcaccagctgaatgtc

SEQ ID NO: 239744 - DNA, 25 bp, Mus musculus
ggagcccgggctgcgttagcctcac

SEQ ID NO: 239745 - DNA, 25 bp, Mus musculus
ctgcagggagctcgtcgctgccact

SEQ ID NO: 239746 - DNA, 25 bp, Mus musculus
cagggcggacccaagctcgtggacc

SEQ ID NO: 239747 - DNA, 25 bp, Mus musculus
tgtcctcgacccgtgccagagctgg

SEQ ID NO: 239748 - DNA, 25 bp, Mus musculus
ctttgccatatacgagcagggaggc

SEQ ID NO: 239749 - DNA, 25 bp, Mus musculus
gagcgccgcgagaaactttgccata

SEQ ID NO: 239750 - DNA, 25 bp, Mus musculus
ctacagctgcgttgctaatggccga

SEQ ID NO: 239751 - DNA, 25 bp, Mus musculus
gcgacctggaaggactcagggaccg

SEQ ID NO: 239752 - DNA, 25 bp, Mus musculus
gttcggttcctcgaggctggcgcac

SEQ ID NO: 239753 - DNA, 25 bp, Mus musculus
tctgagggttcggttcctcgaggct

SEQ ID NO: 239754 - DNA, 25 bp, Mus musculus
tcacgcctcggcgtctgagggttcg

SEQ ID NO: 239755 - DNA, 25 bp, Mus musculus
atcaggtacctgaggctcacgcctc

SEQ ID NO: 239756 - DNA, 25 bp, Mus musculus
ttgctaatggccgagcggtcctggc

SEQ ID NO: 239757 - DNA, 25 bp, Mus musculus
gcctgctggttatgacgatcaccta

SEQ ID NO: 239758 - DNA, 25 bp, Mus musculus
gcttctctcactggcctgctggtta

SEQ ID NO: 239759 - DNA, 25 bp, Mus musculus
gttagaaggcggtccgcttctctca

SEQ ID NO: 239760 - DNA, 25 bp, Mus musculus
gtccaactgtagcgggcggttagaa

SEQ ID NO: 239761 - DNA, 25 bp, Mus musculus
actggcctgctggttatgacgatca

SEQ ID NO: 239762 - DNA, 25 bp, Mus musculus
gcggcgcctatcaggtacctgaggc

SEQ ID NO: 239763 - DNA, 25 bp, Mus musculus
gttatgacgatcacctacagctgcg

SEQ ID NO: 239764 - DNA, 25 bp, Mus musculus
gggaaaaaatcctggcggccacatc

SEQ ID NO: 239765 - DNA, 25 bp, Mus musculus
aagaacggcgcgtcccggtcacgtg

SEQ ID NO: 239766 - DNA, 25 bp, Mus musculus
gccgcggaccacctaaaatggccga

SEQ ID NO: 239767 - DNA, 25 bp, Mus musculus
aagaatgaagtagcagcggcggcca

SEQ ID NO: 239768 - DNA, 25 bp, Mus musculus
tggctgcaagggctcctgcgcctct

SEQ ID NO: 239769 - DNA, 25 bp, Mus musculus
caccctagacaaggcgcgcgcgtgg

SEQ ID NO: 239770 - DNA, 25 bp, Mus musculus
cgaggcaccctagacaaggcgcgcg

SEQ ID NO: 239771 - DNA, 25 bp, Mus musculus
ccgaaactagcagcaaagtaatccc

SEQ ID NO: 239772 - DNA, 25 bp, Mus musculus
cgccgcgaaccgaaactagcagcaa

SEQ ID NO: 239773 - DNA, 25 bp, Mus musculus
tccgacatagtgctactgccgccgc

SEQ ID NO: 239774 - DNA, 25 bp, Mus musculus
actggcgtcgatcttggctccctct

SEQ ID NO: 239775 - DNA, 25 bp, Mus musculus
ttcttactggcgtcgatcttggctc

SEQ ID NO: 239776 - DNA, 25 bp, Mus musculus
ttcatcctcctcgttcttactggcg

SEQ ID NO: 239777 - DNA, 25 bp, Mus musculus
aatcctggcggccacatcggtggga

SEQ ID NO: 239778 - DNA, 25 bp, Mus musculus
ggctccgccagtgccgatgtccggt

SEQ ID NO: 239779 - DNA, 25 bp, Mus musculus
gatgtccggtgcttcgctcaacaca

SEQ ID NO: 239780 - DNA, 25 bp, Mus musculus
ttccggagtgaaatcgtgacgaggc

SEQ ID NO: 239781 - DNA, 25 bp, Mus musculus
gcactcacgatgctctcggccatgg

SEQ ID NO: 239782 - DNA, 25 bp, Mus musculus
cccgcccaggacacccgcaaatctg

SEQ ID NO: 239783 - DNA, 25 bp, Mus musculus
ggccagggcaggtacctcctcaaac

SEQ ID NO: 239784 - DNA, 25 bp, Mus musculus
catgcgccaagtggtgccgcgcgtc

SEQ ID NO: 239785 - DNA, 25 bp, Mus musculus
gaagaagaaggccgctccgttccga

SEQ ID NO: 239786 - DNA, 25 bp, Mus musculus
caacctgcagcagcggggaagaaga

SEQ ID NO: 239787 - DNA, 25 bp, Mus musculus
tcagagcaacctgcagcagcgggga

SEQ ID NO: 239788 - DNA, 25 bp, Mus musculus
aaatcgtgacgaggcactgtcggga

SEQ ID NO: 239789 - DNA, 25 bp, Mus musculus
tcgactcttccggagtgaaatcgtg

SEQ ID NO: 239790 - DNA, 25 bp, Mus musculus
agcctttccgggctcggccagggca

SEQ ID NO: 239791 - DNA, 25 bp, Mus musculus
acacactccgccaggcggagagaga

SEQ ID NO: 239792 - DNA, 25 bp, Mus musculus
ggccacagtccctcttgccttgaga

SEQ ID NO: 239793 - DNA, 25 bp, Mus musculus
tccatcgccgcgctccggatgagga

SEQ ID NO: 239794 - DNA, 25 bp, Mus musculus
ctcttgccttgagagccgttggcgt

SEQ ID NO: 239795 - DNA, 25 bp, Mus musculus
cactccggcaaaagggcggcgtgca

SEQ ID NO: 239796 - DNA, 25 bp, Mus musculus
cttgctgaagctgcagcgcgcccgt

SEQ ID NO: 239797 - DNA, 25 bp, Mus musculus
ggcgcacgcgtgttttgtcctcgcg

SEQ ID NO: 239798 - DNA, 25 bp, Mus musculus
tgcaaccagccgagcagaaagcctg

SEQ ID NO: 239799 - DNA, 25 bp, Mus musculus
atgaccgcctccgtcctggcgggga

SEQ ID NO: 239800 - DNA, 25 bp, Mus musculus
caggatctctctctgcagcccgggt

SEQ ID NO: 239801 - DNA, 25 bp, Mus musculus
ttccgtgcgttcgttctccgaggct

SEQ ID NO: 239802 - DNA, 25 bp, Mus musculus
ctcggatgactgaagctgtgccaag

SEQ ID NO: 239803 - DNA, 25 bp, Mus musculus
actcaagggactcccgtctgcacga

SEQ ID NO: 239804 - DNA, 25 bp, Mus musculus
cggagcgttgtatggagctagattt

SEQ ID NO: 239805 - DNA, 25 bp, Mus musculus
gtccagttcggctcagtcccttgct

SEQ ID NO: 239806 - DNA, 25 bp, Mus musculus
cgtggataaccatagcgcctcgtgc

SEQ ID NO: 239807 - DNA, 25 bp, Mus musculus
gctcctcacccaacaaaaggcagga

SEQ ID NO: 239808 - DNA, 25 bp, Mus musculus
ccttcctaagccaaggtggacgcgc

SEQ ID NO: 239809 - DNA, 25 bp, Mus musculus
atcgcctccttcctaagccaaggtg

SEQ ID NO: 239810 - DNA, 25 bp, Mus musculus
tgcgggcggacggtccaatcgcctc

SEQ ID NO: 239811 - DNA, 25 bp, Mus musculus
ttccctcaccgtcacccggggctgc

SEQ ID NO: 239812 - DNA, 25 bp, Mus musculus
gagctctgaggtcccgtcttgtacc

SEQ ID NO: 239813 - DNA, 25 bp, Mus musculus
cagcagagctctgaggtcccgtctt

SEQ ID NO: 239814 - DNA, 25 bp, Mus musculus
ccacccgcggtggtgggacacctgt

SEQ ID NO: 239815 - DNA, 25 bp, Mus musculus
ctcagggcaccgcaagttagcgccg

SEQ ID NO: 239816 - DNA, 25 bp, Mus musculus
ttcccaggaacgcgcgcccagtagg

SEQ ID NO: 239817 - DNA, 25 bp, Mus musculus
taagcccgaaatcctggattcttcc

SEQ ID NO: 239818 - DNA, 25 bp, Mus musculus
cacccaacaaaaggcaggacgggat

SEQ ID NO: 239819 - DNA, 25 bp, Mus musculus
ctggttaagcccgaaatcctggatt

SEQ ID NO: 239820 - DNA, 25 bp, Mus musculus
agccactccggtaggctagtctggc

SEQ ID NO: 239821 - DNA, 25 bp, Mus musculus
ttcaggatgcatccgcttggcggta

SEQ ID NO: 239822 - DNA, 25 bp, Mus musculus
aggaggcgcctaaacttcaggatgc

SEQ ID NO: 239823 - DNA, 25 bp, Mus musculus
tctggccggaggtaaggattcagcc

SEQ ID NO: 239824 - DNA, 25 bp, Mus musculus
gctgctggcgacaatacccacacta

SEQ ID NO: 239825 - DNA, 25 bp, Mus musculus
cacgtagcactcctgtgaggcgtca

SEQ ID NO: 239826 - DNA, 25 bp, Mus musculus
ggcagaggatgaccggcacgatcac

SEQ ID NO: 239827 - DNA, 25 bp, Mus musculus
gggacagcacttccgggagcagcca

SEQ ID NO: 239828 - DNA, 25 bp, Mus musculus
gacctcagcgacctgtcctgcgtta

SEQ ID NO: 239829 - DNA, 25 bp, Mus musculus
aacaaacggcggacacacctggcgg

SEQ ID NO: 239830 - DNA, 25 bp, Mus musculus
cggcagcggacaccgaacctggcga

SEQ ID NO: 239831 - DNA, 25 bp, Mus musculus
atacccacactagacaaggcgggcg

SEQ ID NO: 239832 - DNA, 25 bp, Mus musculus
tgaccgcgaggacgccacgtagcac

SEQ ID NO: 239833 - DNA, 25 bp, Mus musculus
gcctgctgcgactccaggcgttgtc

SEQ ID NO: 239834 - DNA, 25 bp, Mus musculus
gcgtagacatgatgccagagcgtta

SEQ ID NO: 239835 - DNA, 25 bp, Mus musculus
tggcgccattctccaatcagtcctt

SEQ ID NO: 239836 - DNA, 25 bp, Mus musculus
cccagtcctcatgcggaacagagtt

SEQ ID NO: 239837 - DNA, 25 bp, Mus musculus
cgccatccgtgacctacaaaagaga

SEQ ID NO: 239838 - DNA, 25 bp, Mus musculus
gatcgctcttttgtcccgcctgcta

SEQ ID NO: 239839 - DNA, 25 bp, Mus musculus
tgctacacaacattcggcggacatc

SEQ ID NO: 239840 - DNA, 25 bp, Mus musculus
tcacgacctgttcctacccatttgg

SEQ ID NO: 239841 - DNA, 25 bp, Mus musculus
ggctgcttcgacatagcatggtatg

SEQ ID NO: 239842 - DNA, 25 bp, Mus musculus
agagtttaccgcgactcgagctctc

SEQ ID NO: 239843 - DNA, 25 bp, Mus musculus
actgctagtggagtgtctcgacctg

SEQ ID NO: 239844 - DNA, 25 bp, Mus musculus
ccaggcactgctatgggactgcaaa

SEQ ID NO: 239845 - DNA, 25 bp, Mus musculus
gcacatcggctagcgtcgccagaca

SEQ ID NO: 239846 - DNA, 25 bp, Mus musculus
cgccagacatgtgcaaccggacctg

SEQ ID NO: 239847 - DNA, 25 bp, Mus musculus
cgcatttgccttccggcttgaggga

SEQ ID NO: 239848 - DNA, 25 bp, Mus musculus
aaatggagcgctatagggtacccgg

SEQ ID NO: 239849 - DNA, 25 bp, Mus musculus
ccagtttgcacgaaatggagcgcta

SEQ ID NO: 239850 - DNA, 25 bp, Mus musculus
agcccgggcagtgcttgttttgcct

SEQ ID NO: 239851 - DNA, 25 bp, Mus musculus
gttttgcctgtgcaccgtagctctg

SEQ ID NO: 239852 - DNA, 25 bp, Mus musculus
gcaccgtagctctgtccagctgctt

SEQ ID NO: 239853 - DNA, 25 bp, Mus musculus
acgccacggggaatcgtgatacctg

SEQ ID NO: 239854 - DNA, 25 bp, Mus musculus
ataccaaacactcggcacccgggag

SEQ ID NO: 239855 - DNA, 25 bp, Mus musculus
ggccgccgcctctggtatgtcagag

SEQ ID NO: 239856 - DNA, 25 bp, Mus musculus
tcagaggccgggattgtatttcgaa

SEQ ID NO: 239857 - DNA, 25 bp, Mus musculus
ttgtatttcgaaagatccgccattt

SEQ ID NO: 239858 - DNA, 25 bp, Mus musculus
aagatccgccattttcacctcgtca

SEQ ID NO: 239859 - DNA, 25 bp, Mus musculus
gttctagggctcaccggcgggtcat

SEQ ID NO: 239860 - DNA, 25 bp, Mus musculus
ggcgggtcatgccagacccaacatc

SEQ ID NO: 239861 - DNA, 25 bp, Mus musculus
cagctgcttcctttcccagtttgca

SEQ ID NO: 239862 - DNA, 25 bp, Mus musculus
taccgttgcttgaccaggctgagtc

SEQ ID NO: 239863 - DNA, 25 bp, Mus musculus
gggttcccagtttctccatctttca

SEQ ID NO: 239864 - DNA, 25 bp, Mus musculus
tccaccggcactcggatggttgttt

SEQ ID NO: 239865 - DNA, 25 bp, Mus musculus
aacctcggtcagtgcggtttccagc

SEQ ID NO: 239866 - DNA, 25 bp, Mus musculus
ccgcggggacactatgacatttggc

SEQ ID NO: 239867 - DNA, 25 bp, Mus musculus
tttgttcaaaatcacgcccagcgcc

SEQ ID NO: 239868 - DNA, 25 bp, Mus musculus
tgacacagcagcaaaacaggttccc

SEQ ID NO: 239869 - DNA, 25 bp, Mus musculus
aacccgagtcgcgtctttgcgcagg

SEQ ID NO: 239870 - DNA, 25 bp, Mus musculus
ttccacgtgactgctcctggggcct

SEQ ID NO: 239871 - DNA, 25 bp, Mus musculus
aactccaagtgggttcgtgcttctg

SEQ ID NO: 239872 - DNA, 25 bp, Mus musculus
ggaggcgctggtacgaaatgacaca

SEQ ID NO: 239873 - DNA, 25 bp, Mus musculus
cgtgcttctggctttgtgactaaac

SEQ ID NO: 239874 - DNA, 25 bp, Mus musculus
ccagaagagtccatacaaaggggcg

SEQ ID NO: 239875 - DNA, 25 bp, Mus musculus
cttcgcgagggaaacggacacacac

SEQ ID NO: 239876 - DNA, 25 bp, Mus musculus
aacgccaggaccgagccgtagtcta

SEQ ID NO: 239877 - DNA, 25 bp, Mus musculus
tcgcttattgtacacggcgggcggc

SEQ ID NO: 239878 - DNA, 25 bp, Mus musculus
ggcgaaaccgcttcggacccatgta

SEQ ID NO: 239879 - DNA, 25 bp, Mus musculus
cttcggacccatgtactgcgaggga

SEQ ID NO: 239880 - DNA, 25 bp, Mus musculus
cccatgtactgcgagggagaggcac

SEQ ID NO: 239881 - DNA, 25 bp, Mus musculus
gaagatgagctcgtccatttccacc

SEQ ID NO: 239882 - DNA, 25 bp, Mus musculus
atttccaccatcagcgtcgcatgtc

SEQ ID NO: 239883 - DNA, 25 bp, Mus musculus
tggggagttcgcttattgtacacgg

SEQ ID NO: 239884 - DNA, 25 bp, Mus musculus
acagcatctatcgtggggagttcgc

SEQ ID NO: 239885 - DNA, 25 bp, Mus musculus
agcgtcgcatgtcccagccacgtga

SEQ ID NO: 239886 - DNA, 25 bp, Mus musculus
tcgttcaacgccaggaccgagccgt

SEQ ID NO: 239887 - DNA, 25 bp, Mus musculus
gctcgctgccgaaccgctcgttcaa

SEQ ID NO: 239888 - DNA, 25 bp, Mus musculus
ccgagccgtagtctaggtggtcgta

SEQ ID NO: 239889 - DNA, 25 bp, Mus musculus
gtgactgatgaggacagcatctatc

SEQ ID NO: 239890 - DNA, 25 bp, Mus musculus
ttcaagcggctctcataaagatctg

SEQ ID NO: 239891 - DNA, 25 bp, Mus musculus
ctggcgggcaagtgagtatttctta

SEQ ID NO: 239892 - DNA, 25 bp, Mus musculus
gagcccgacacaccgagtttgactt

SEQ ID NO: 239893 - DNA, 25 bp, Mus musculus
gggcgccttccttagagtctcttcg

SEQ ID NO: 239894 - DNA, 25 bp, Mus musculus
ctgcgggttcttttggcttctggaa

SEQ ID NO: 239895 - DNA, 25 bp, Mus musculus
taagtccttgataacgccctctgcg

SEQ ID NO: 239896 - DNA, 25 bp, Mus musculus
tggctgccagcttcttaagtccttg

SEQ ID NO: 239897 - DNA, 25 bp, Mus musculus
gcgacaggatttggcccagctcatg

SEQ ID NO: 239898 - DNA, 25 bp, Mus musculus
tttcttcttggcagcgagaggtccc

SEQ ID NO: 239899 - DNA, 25 bp, Mus musculus
cctggaggaccacgctcgttttctt

SEQ ID NO: 239900 - DNA, 25 bp, Mus musculus
tctggcccacagagacgctgctcta

SEQ ID NO: 239901 - DNA, 25 bp, Mus musculus
aagttcttcagccaatcccaggtcg

SEQ ID NO: 239902 - DNA, 25 bp, Mus musculus
gccgggcctttactgaagttgcaca

SEQ ID NO: 239903 - DNA, 25 bp, Mus musculus
cctgaactcggctgtggcggtaaat

SEQ ID NO: 239904 - DNA, 25 bp, Mus musculus
tcctcaggcaggcaggctgtcgagc

SEQ ID NO: 239905 - DNA, 25 bp, Mus musculus
gactcccggctcagagcgagggaaa

SEQ ID NO: 239906 - DNA, 25 bp, Mus musculus
tgtccctggctaaggtcctgaccga

SEQ ID NO: 239907 - DNA, 25 bp, Mus musculus
ctaaggtcctgaccgagtcccgagg

SEQ ID NO: 239908 - DNA, 25 bp, Mus musculus
tcctgaccgagtcccgaggggactg

SEQ ID NO: 239909 - DNA, 25 bp, Mus musculus
cccaatgggtgcatcgcagcggagt

SEQ ID NO: 239910 - DNA, 25 bp, Mus musculus
gagtcgcggtcactgcggccctgct

SEQ ID NO: 239911 - DNA, 25 bp, Mus musculus
ccggctcagagcgagggaaaatctg

SEQ ID NO: 239912 - DNA, 25 bp, Mus musculus
ccactcacctatgggcttgtccagg

SEQ ID NO: 239913 - DNA, 25 bp, Mus musculus
cctatgggcttgtccaggcgcatga

SEQ ID NO: 239914 - DNA, 25 bp, Mus musculus
ctgcgctgcgcaccagggccaatgg

SEQ ID NO: 239915 - DNA, 25 bp, Mus musculus
gcatcgcagcggagtcgcggtcact

SEQ ID NO: 239916 - DNA, 25 bp, Mus musculus
ggacctcgcagccatgcggaccgaa

SEQ ID NO: 239917 - DNA, 25 bp, Mus musculus
ggaaaatctgcgtgtccctggctaa

SEQ ID NO: 239918 - DNA, 25 bp, Mus musculus
ggcatagcattatagccgctgattg

SEQ ID NO: 239919 - DNA, 25 bp, Mus musculus
ccgcggttccttttgcggacagaca

SEQ ID NO: 239920 - DNA, 25 bp, Mus musculus
tttgcgtcgaatcccgggcagacag

SEQ ID NO: 239921 - DNA, 25 bp, Mus musculus
gggacagccgtcctccatgacaacg

SEQ ID NO: 239922 - DNA, 25 bp, Mus musculus
cgcgccggaacctttgcgtcgaatc

SEQ ID NO: 239923 - DNA, 25 bp, Mus musculus
tgacaacggcccagagtccctgcga

SEQ ID NO: 239924 - DNA, 25 bp, Mus musculus
caggtaaaacgtccggcatagcatt

SEQ ID NO: 239925 - DNA, 25 bp, Mus musculus
cgggaagataaaggtgcagtgcatt

SEQ ID NO: 239926 - DNA, 25 bp, Mus musculus
cagtgcattgaaacccgggccgcgt

SEQ ID NO: 239927 - DNA, 25 bp, Mus musculus
agaatttgacaaccgcggctggctg

SEQ ID NO: 239928 - DNA, 25 bp, Mus musculus
gctgcttcacggatcgcggaactca

SEQ ID NO: 239929 - DNA, 25 bp, Mus musculus
tcgcggaactcaagcaggtaaaacg

SEQ ID NO: 239930 - DNA, 25 bp, Mus musculus
aaccatggccgctctggttgctctg

SEQ ID NO: 239931 - DNA, 25 bp, Mus musculus
agcaggtgacccagcatcagctttc

SEQ ID NO: 239932 - DNA, 25 bp, Mus musculus
cacctcaggatctgctgggagggcc

SEQ ID NO: 239933 - DNA, 25 bp, Mus musculus
gacgctcagcgtcgttccctaggaa

SEQ ID NO: 239934 - DNA, 25 bp, Mus musculus
tccctaggaaaccacagcgcgagtc

SEQ ID NO: 239935 - DNA, 25 bp, Mus musculus
aaccacagcgcgagtccaagggcgg

SEQ ID NO: 239936 - DNA, 25 bp, Mus musculus
ctgggctgtaggtttagagaccacc

SEQ ID NO: 239937 - DNA, 25 bp, Mus musculus
ttagagaccaccgagaacttgctga

SEQ ID NO: 239938 - DNA, 25 bp, Mus musculus
ccgagaacttgctgaggctaacgtt

SEQ ID NO: 239939 - DNA, 25 bp, Mus musculus
tgaggctaacgttggatgattgacg

SEQ ID NO: 239940 - DNA, 25 bp, Mus musculus
atgattgacgttccttggtaccggc

SEQ ID NO: 239941 - DNA, 25 bp, Mus musculus
ttggtaccggcagagctcaagcctc

SEQ ID NO: 239942 - DNA, 25 bp, Mus musculus
gaccggaacaacaaacacctcagga

SEQ ID NO: 239943 - DNA, 25 bp, Mus musculus
gcctaacgggaaacgcctcggctgc

SEQ ID NO: 239944 - DNA, 25 bp, Mus musculus
gggtcgccaccaacaaagcgcactg

SEQ ID NO: 239945 - DNA, 25 bp, Mus musculus
gctgcgcctgacgtcagctcgctga

SEQ ID NO: 239946 - DNA, 25 bp, Mus musculus
ccggctgcacgaaaggcttcgcgca

SEQ ID NO: 239947 - DNA, 25 bp, Mus musculus
gtcttagaggctcgggacagccgca

SEQ ID NO: 239948 - DNA, 25 bp, Mus musculus
ttactgcgcggtcggccggtcttag

SEQ ID NO: 239949 - DNA, 25 bp, Mus musculus
acatagcactggttactgcgcggtc

SEQ ID NO: 239950 - DNA, 25 bp, Mus musculus
aggcctgggaacatagcactggtta

SEQ ID NO: 239951 - DNA, 25 bp, Mus musculus
tagtcatggcgaggcctgggaacat

SEQ ID NO: 239952 - DNA, 25 bp, Mus musculus
aatagcttcgtgcaggacgcgcctg

SEQ ID NO: 239953 - DNA, 25 bp, Mus musculus
gcggaaatagcttcgtgcaggacgc

SEQ ID NO: 239954 - DNA, 25 bp, Mus musculus
gctcgcaggcctggagcttgtaagt

SEQ ID NO: 239955 - DNA, 25 bp, Mus musculus
cacgaaaggcttcgcgcaacccggt

SEQ ID NO: 239956 - DNA, 25 bp, Mus musculus
aagcggaagtgatgctcgcaggcct

SEQ ID NO: 239957 - DNA, 25 bp, Mus musculus
cagcagcaggctcaaggacagcagc

SEQ ID NO: 239958 - DNA, 25 bp, Mus musculus
gtctgcagcggcgaccccatagctg

SEQ ID NO: 239959 - DNA, 25 bp, Mus musculus
gtgtccagcaccagagcgcagctcg

SEQ ID NO: 239960 - DNA, 25 bp, Mus musculus
acgctcacgcgctgcgagtaggacc

SEQ ID NO: 239961 - DNA, 25 bp, Mus musculus
cccgactttcgtcgccgagccggag

SEQ ID NO: 239962 - DNA, 25 bp, Mus musculus
cgaggcaggtaagctgcccgacttt

SEQ ID NO: 239963 - DNA, 25 bp, Mus musculus
cttcgcacagcagggtagcgaggca

SEQ ID NO: 239964 - DNA, 25 bp, Mus musculus
cgggatccttcgcacagcagggtag

SEQ ID NO: 239965 - DNA, 25 bp, Mus musculus
cttgagcctgcgcaccgggagacgc

SEQ ID NO: 239966 - DNA, 25 bp, Mus musculus
ccacagccactatcgcggagcatga

SEQ ID NO: 239967 - DNA, 25 bp, Mus musculus
tcgccctccatactgccgcctcggt

SEQ ID NO: 239968 - DNA, 25 bp, Mus musculus
agtgagcgcgccgagcacgaagcca

SEQ ID NO: 239969 - DNA, 25 bp, Mus musculus
ctgagtctgtgttgagatgatggaa

SEQ ID NO: 239970 - DNA, 25 bp, Mus musculus
caccgtgtctgagtctgtgttgaga

SEQ ID NO: 239971 - DNA, 25 bp, Mus musculus
cccggctcaccgtgtctgagtctgt

SEQ ID NO: 239972 - DNA, 25 bp, Mus musculus
agcccaagggcgagcagagaaaaag

SEQ ID NO: 239973 - DNA, 25 bp, Mus musculus
actttcctccaagcccaagggcgag

SEQ ID NO: 239974 - DNA, 25 bp, Mus musculus
acctcttcctgagggcgtgctgaga

SEQ ID NO: 239975 - DNA, 25 bp, Mus musculus
ttgttcagtagtttcctcctcccga

SEQ ID NO: 239976 - DNA, 25 bp, Mus musculus
gcgactgcctcacccttgttcagta

SEQ ID NO: 239977 - DNA, 25 bp, Mus musculus
gtgaagctcctgtccacctggctga

SEQ ID NO: 239978 - DNA, 25 bp, Mus musculus
gactgcctgggactctgacacctac

SEQ ID NO: 239979 - DNA, 25 bp, Mus musculus
ctggacgctgtgttttccgaactgc

SEQ ID NO: 239980 - DNA, 25 bp, Mus musculus
ggcctccagtagagagtgagcttgc

SEQ ID NO: 239981 - DNA, 25 bp, Mus musculus
cagctgggtcttctcgccagagaca

SEQ ID NO: 239982 - DNA, 25 bp, Mus musculus
tggctgcctccatgcactctgactg

SEQ ID NO: 239983 - DNA, 25 bp, Mus musculus
tcgcaatcgttacccggaggaaatc

SEQ ID NO: 239984 - DNA, 25 bp, Mus musculus
agtctgctaccgaaagaacctttgc

SEQ ID NO: 239985 - DNA, 25 bp, Mus musculus
ttgcaggctcacaaacaagatcttc

SEQ ID NO: 239986 - DNA, 25 bp, Mus musculus
tctgactgcactagggtgtcccgta

SEQ ID NO: 239987 - DNA, 25 bp, Mus musculus
aagcccttcccaggaggtcgtgttg

SEQ ID NO: 239988 - DNA, 25 bp, Mus musculus
tgtcgcagccgctcagagaacaccg

SEQ ID NO: 239989 - DNA, 25 bp, Mus musculus
tggtcacatctcacatcgaatgcgg

SEQ ID NO: 239990 - DNA, 25 bp, Mus musculus
gagtcccaatccctccgaacagatg

SEQ ID NO: 239991 - DNA, 25 bp, Mus musculus
cgaacagatgtttttgtccctcgcg

SEQ ID NO: 239992 - DNA, 25 bp, Mus musculus
ccctcgcggagatttgtaacttatg

SEQ ID NO: 239993 - DNA, 25 bp, Mus musculus
ttatgttcgcgacagctggtggacc

SEQ ID NO: 239994 - DNA, 25 bp, Mus musculus
gtggacctcgcgagcaacatgcatc

SEQ ID NO: 239995 - DNA, 25 bp, Mus musculus
ctgttctagaacaaacctggtggga

SEQ ID NO: 239996 - DNA, 25 bp, Mus musculus
caccttgagaagctcccgggcacta

SEQ ID NO: 239997 - DNA, 25 bp, Mus musculus
gagcttgcctacactacccagtatg

SEQ ID NO: 239998 - DNA, 25 bp, Mus musculus
agctacagaggcaaatggtcacatc

SEQ ID NO: 239999 - DNA, 25 bp, Mus musculus
accggctgggatctgcttatgtgaa

SEQ ID NO: 240000 - DNA, 25 bp, Mus musculus
ccggcaggggacgaattaacacgtg

SEQ ID NO: 240001 - DNA, 25 bp, Mus musculus
cgggcactaaaccttctcggagata

SEQ ID NO: 240002 - DNA, 25 bp, Mus musculus
ctccgagattctcaccaggcggtgg

SEQ ID NO: 240003 - DNA, 25 bp, Mus musculus
ctgcttcttcttggccgtggccatc

SEQ ID NO: 240004 - DNA, 25 bp, Mus musculus
ggctgcgtgcttctttctccacttg

SEQ ID NO: 240005 - DNA, 25 bp, Mus musculus
gggtccagccgtcaaagtcagtcta

SEQ ID NO: 240006 - DNA, 25 bp, Mus musculus
aagtcagtctaaccgccgcactaac

SEQ ID NO: 240007 - DNA, 25 bp, Mus musculus
aggtttgttgtaatcgtcgtcatcc

SEQ ID NO: 240008 - DNA, 25 bp, Mus musculus
tcgggtccagaggtttgttgtaatc

SEQ ID NO: 240009 - DNA, 25 bp, Mus musculus
tttctcgtcgtcagagttcgggtcc

SEQ ID NO: 240010 - DNA, 25 bp, Mus musculus
tcagcagctgagtgattttctcgtc

SEQ ID NO: 240011 - DNA, 25 bp, Mus musculus
ggctgccaccgctcgatttgtgctt

SEQ ID NO: 240012 - DNA, 25 bp, Mus musculus
gaaaatagtaaaggcccggcgagca

SEQ ID NO: 240013 - DNA, 25 bp, Mus musculus
tttgagcagtgcacttggcgggctc

SEQ ID NO: 240014 - DNA, 25 bp, Mus musculus
cggtctccgagtcctgcttcttctt

SEQ ID NO: 240015 - DNA, 25 bp, Mus musculus
cctttcggaaacacggctaggtgca

SEQ ID NO: 240016 - DNA, 25 bp, Mus musculus
acctaagtatggaaaaagtctgacg

SEQ ID NO: 240017 - DNA, 25 bp, Mus musculus
ctgctgagcaggaacgcgctctgcc

SEQ ID NO: 240018 - DNA, 25 bp, Mus musculus
gctgcgcagcaaaaatgtccaaacg

SEQ ID NO: 240019 - DNA, 25 bp, Mus musculus
tcagcgcttcctcggcttcgggagt

SEQ ID NO: 240020 - DNA, 25 bp, Mus musculus
gagtcccggattcgatcccaggcgc

SEQ ID NO: 240021 - DNA, 25 bp, Mus musculus
gttcccggctcagagcgctctgctt

SEQ ID NO: 240022 - DNA, 25 bp, Mus musculus
ccgcgggaaatcagcaagacgtacc

SEQ ID NO: 240023 - DNA, 25 bp, Mus musculus
ggttccgatcgtccgtcctcttctg

SEQ ID NO: 240024 - DNA, 25 bp, Mus musculus
ccgcagccgacccagagagtttgca

SEQ ID NO: 240025 - DNA, 25 bp, Mus musculus
ggcccggcgttactgcgccagaaag

SEQ ID NO: 240026 - DNA, 25 bp, Mus musculus
gccagaaagggcagtcagtgacacc

SEQ ID NO: 240027 - DNA, 25 bp, Mus musculus
acttggtgcgcccacgagcctactt

SEQ ID NO: 240028 - DNA, 25 bp, Mus musculus
cggactagccggatcgaaaaggata

SEQ ID NO: 240029 - DNA, 25 bp, Mus musculus
gggtcttcatctcggccatactgtg

SEQ ID NO: 240030 - DNA, 25 bp, Mus musculus
gtcagttgaactccgcctgacatcc

SEQ ID NO: 240031 - DNA, 25 bp, Mus musculus
gcttctttcccggatctcctggttc

SEQ ID NO: 240032 - DNA, 25 bp, Mus musculus
accggactgcactctagcttctttc

SEQ ID NO: 240033 - DNA, 25 bp, Mus musculus
ttccggaaccggactgcactctagc

SEQ ID NO: 240034 - DNA, 25 bp, Mus musculus
tctggggtcaggatggaacccgtcc

SEQ ID NO: 240035 - DNA, 25 bp, Mus musculus
accagcgacaaagtgagtgagtgcg

SEQ ID NO: 240036 - DNA, 25 bp, Mus musculus
cgagtcccttggaggagtcagttga

SEQ ID NO: 240037 - DNA, 25 bp, Mus musculus
accgagagcaccagcgacaaagtga

SEQ ID NO: 240038 - DNA, 25 bp, Mus musculus
ggcggtgaccacgaaaccgagagca

SEQ ID NO: 240039 - DNA, 25 bp, Mus musculus
agcgctcgctcgttgatgccgttct

SEQ ID NO: 240040 - DNA, 25 bp, Mus musculus
agggcccgagcattgacgtcatcgc

SEQ ID NO: 240041 - DNA, 25 bp, Mus musculus
cctgacatccctgcgccaaggagga

SEQ ID NO: 240042 - DNA, 25 bp, Mus musculus
gcgtgtcaagcagggccgagtccct

SEQ ID NO: 240043 - DNA, 25 bp, Mus musculus
atctcctggttctggggtcaggatg

SEQ ID NO: 240044 - DNA, 25 bp, Mus musculus
gcaccattttcttgcgcattctgca

SEQ ID NO: 240045 - DNA, 25 bp, Mus musculus
tagtggttgtagaacatgtcgttgc

SEQ ID NO: 240046 - DNA, 25 bp, Mus musculus
catgtcgttgcgcaccattttcttg

SEQ ID NO: 240047 - DNA, 25 bp, Mus musculus
gtagaacatgtcgttgcgcaccatt

SEQ ID NO: 240048 - DNA, 25 bp, Mus musculus
tctccggcacgtagggatagtggtt

SEQ ID NO: 240049 - DNA, 25 bp, Mus musculus
acgtagggatagtggttgtagaaca

SEQ ID NO: 240050 - DNA, 25 bp, Mus musculus
tggcttcctgctccgtctccggcac

SEQ ID NO: 240051 - DNA, 25 bp, Mus musculus
tcggtcacgtacttcagggcgttct

SEQ ID NO: 240052 - DNA, 25 bp, Mus musculus
cactcctcggtcacgtacttcaggg

SEQ ID NO: 240053 - DNA, 25 bp, Mus musculus
cactcgatctgacaccactcctcgg

SEQ ID NO: 240054 - DNA, 25 bp, Mus musculus
ttttcttgcgcattctgcagggccc

SEQ ID NO: 240055 - DNA, 25 bp, Mus musculus
ctccagcatccacttgtctaggtgg

SEQ ID NO: 240056 - DNA, 25 bp, Mus musculus
gcagcagctcgcactcgatctgaca

SEQ ID NO: 240057 - DNA, 25 bp, Mus musculus
ccacttgtctaggtgggagccgatg

SEQ ID NO: 240058 - DNA, 25 bp, Mus musculus
gaggacaccaacagctgcacgcagc

SEQ ID NO: 240059 - DNA, 25 bp, Mus musculus
tccgcgcagcgagcagaactgatac

SEQ ID NO: 240060 - DNA, 25 bp, Mus musculus
aggccatcttggtaaagtccgcgca

SEQ ID NO: 240061 - DNA, 25 bp, Mus musculus
ggcgcagaggcctcgaggccatctt

SEQ ID NO: 240062 - DNA, 25 bp, Mus musculus
ccctgcctggcctttaccaagatgg

SEQ ID NO: 240063 - DNA, 25 bp, Mus musculus
ctgcagccgggtcataccgggagcc

SEQ ID NO: 240064 - DNA, 25 bp, Mus musculus
cccatctttggtggcggtcgtctct

SEQ ID NO: 240065 - DNA, 25 bp, Mus musculus
caggctaacagcagggaggctcacc

SEQ ID NO: 240066 - DNA, 25 bp, Mus musculus
tcccgcgaagatccaggctaacagc

SEQ ID NO: 240067 - DNA, 25 bp, Mus musculus
acttcaccgaggtatccgaacagcc

SEQ ID NO: 240068 - DNA, 25 bp, Mus musculus
ggtcgtctctgaccatgcggtccca

SEQ ID NO: 240069 - DNA, 25 bp, Mus musculus
aaacccgctgcacttcaccgaggta

SEQ ID NO: 240070 - DNA, 25 bp, Mus musculus
agaaaggctgttccacgcagatatc

SEQ ID NO: 240071 - DNA, 25 bp, Mus musculus
acgcagatatcgagactaaggagca

SEQ ID NO: 240072 - DNA, 25 bp, Mus musculus
cggcacttattttcctgaggtctga

SEQ ID NO: 240073 - DNA, 25 bp, Mus musculus
cgcagggtcggtgacacagagtcca

SEQ ID NO: 240074 - DNA, 25 bp, Mus musculus
ctcatagcgcaaggctgccgtcagc

SEQ ID NO: 240075 - DNA, 25 bp, Mus musculus
agttggccggctcatagcgcaaggc

SEQ ID NO: 240076 - DNA, 25 bp, Mus musculus
aagaagtgcgagttggccggctcat

SEQ ID NO: 240077 - DNA, 25 bp, Mus musculus
tctcggtcttgaagaagtgcgagtt

SEQ ID NO: 240078 - DNA, 25 bp, Mus musculus
tcgtactgtatctcggtcttgaaga

SEQ ID NO: 240079 - DNA, 25 bp, Mus musculus
gcgtccgccagcttttcgtactgta

SEQ ID NO: 240080 - DNA, 25 bp, Mus musculus
ttttcctgaggtctgagaagcagcc

SEQ ID NO: 240081 - DNA, 25 bp, Mus musculus
cgggaagacgttcacggcacttatt

SEQ ID NO: 240082 - DNA, 25 bp, Mus musculus
ctgcgtgtttgacgggaagacgttc

SEQ ID NO: 240083 - DNA, 25 bp, Mus musculus
gtgacacagagtccacggacaccgc

SEQ ID NO: 240084 - DNA, 25 bp, Mus musculus
ttcctccagcagtctctggaaaggc

SEQ ID NO: 240085 - DNA, 25 bp, Mus musculus
ccaaggaagcggacagcgtccgcca

SEQ ID NO: 240086 - DNA, 25 bp, Mus musculus
tgcttgccggcaccctggacaggcg

SEQ ID NO: 240087 - DNA, 25 bp, Mus musculus
aacatcccggaaagtgagggctggt

SEQ ID NO: 240088 - DNA, 25 bp, Mus musculus
aggccggccgcagaaactgcagccg

SEQ ID NO: 240089 - DNA, 25 bp, Mus musculus
ggaccctgctgagaaagcaccgctg

SEQ ID NO: 240090 - DNA, 25 bp, Mus musculus
ctgagccctactcccattgctggat

SEQ ID NO: 240091 - DNA, 25 bp, Mus musculus
ctcccattgctggatgctgtcacca

SEQ ID NO: 240092 - DNA, 25 bp, Mus musculus
ctggatgctgtcaccagcgatgaaa

SEQ ID NO: 240093 - DNA, 25 bp, Mus musculus
ccagcgatgaaaacacgcgagcctg

SEQ ID NO: 240094 - DNA, 25 bp, Mus musculus
tgcgttcattttactccagctggag

SEQ ID NO: 240095 - DNA, 25 bp, Mus musculus
tccagctggagtacaaaagaactgc

SEQ ID NO: 240096 - DNA, 25 bp, Mus musculus
aagaactgcccacgctagctctttc

SEQ ID NO: 240097 - DNA, 25 bp, Mus musculus
agctctttcactacgcggcctcgaa

SEQ ID NO: 240098 - DNA, 25 bp, Mus musculus
cgcgagcctgcgttcattttactcc

SEQ ID NO: 240099 - DNA, 25 bp, Mus musculus
ctgctggtggccatctttaatcctc

SEQ ID NO: 240100 - DNA, 25 bp, Mus musculus
cgcaagtctcgccatggagcaggac

SEQ ID NO: 240101 - DNA, 25 bp, Mus musculus
gcaccttcgagcgtctcctaggtaa

SEQ ID NO: 240102 - DNA, 25 bp, Mus musculus
cagagtcagtgtgtaagcgcaagtc

SEQ ID NO: 240103 - DNA, 25 bp, Mus musculus
tcccaatggactgagcggtccaatg

SEQ ID NO: 240104 - DNA, 25 bp, Mus musculus
gctcgtccaggctgctcattggtta

SEQ ID NO: 240105 - DNA, 25 bp, Mus musculus
gctttcattggatagaccgctcgtc

SEQ ID NO: 240106 - DNA, 25 bp, Mus musculus
ccgcctccgcttagctttcattgga

SEQ ID NO: 240107 - DNA, 25 bp, Mus musculus
tgtacctccgagctaccacgcaatg

SEQ ID NO: 240108 - DNA, 25 bp, Mus musculus
cttcctcggataacgcgcttgtacc

SEQ ID NO: 240109 - DNA, 25 bp, Mus musculus
gcaggagacacatcccttcctcgga

SEQ ID NO: 240110 - DNA, 25 bp, Mus musculus
aggcgtttcaccagcagggtcttcc

SEQ ID NO: 240111 - DNA, 25 bp, Mus musculus
actcggcgcggaaggatattctgaa

SEQ ID NO: 240112 - DNA, 25 bp, Mus musculus
caggtcgcctttgccatctccggag

SEQ ID NO: 240113 - DNA, 25 bp, Mus musculus
ctggggttccagtgacgaatgctct

SEQ ID NO: 240114 - DNA, 25 bp, Mus musculus
cccaagtctgcacagtggagagtgc

SEQ ID NO: 240115 - DNA, 25 bp, Mus musculus
tgcagtttaatcctggctgagaccc

SEQ ID NO: 240116 - DNA, 25 bp, Mus musculus
ggagcgcgagctgcttgcagtttaa

SEQ ID NO: 240117 - DNA, 25 bp, Mus musculus
cctcggttcggatggtggcatccct

SEQ ID NO: 240118 - DNA, 25 bp, Mus musculus
catggtcacagttctccgaggtctc

SEQ ID NO: 240119 - DNA, 25 bp, Mus musculus
gcgagggtgacacaccatggtcaca

SEQ ID NO: 240120 - DNA, 25 bp, Mus musculus
ccagagactcggtcccaagggagga

SEQ ID NO: 240121 - DNA, 25 bp, Mus musculus
cccaaggcaccggttgtcatggcaa

SEQ ID NO: 240122 - DNA, 25 bp, Mus musculus
tggagagtgcacacagcagaaccct

SEQ ID NO: 240123 - DNA, 25 bp, Mus musculus
tcctcgcgcgtttcggaaagttctg

SEQ ID NO: 240124 - DNA, 25 bp, Mus musculus
cggcagcttcgcgtctgtcactctt

SEQ ID NO: 240125 - DNA, 25 bp, Mus musculus
tcgcccggagagaatctgggagcaa

SEQ ID NO: 240126 - DNA, 25 bp, Mus musculus
accttctttcattgcctgggtcgcc

SEQ ID NO: 240127 - DNA, 25 bp, Mus musculus
caaaagaagagtgaggagcccgacc

SEQ ID NO: 240128 - DNA, 25 bp, Mus musculus
ttgcttgctcgtgctcctgcttgct

SEQ ID NO: 240129 - DNA, 25 bp, Mus musculus
cacccaggcacggtaggcggtcatt

SEQ ID NO: 240130 - DNA, 25 bp, Mus musculus
ggcggtcattgagtactcctgagtc

SEQ ID NO: 240131 - DNA, 25 bp, Mus musculus
gagtactcctgagtcccgtcgcctg

SEQ ID NO: 240132 - DNA, 25 bp, Mus musculus
tggtctcgtagctgcgcgccctagt

SEQ ID NO: 240133 - DNA, 25 bp, Mus musculus
ggtggggacaacgacccagcctcac

SEQ ID NO: 240134 - DNA, 25 bp, Mus musculus
ctggctacctaagggcacggccctt

SEQ ID NO: 240135 - DNA, 25 bp, Mus musculus
tttcctgctctcagttccagacaga

SEQ ID NO: 240136 - DNA, 25 bp, Mus musculus
cagctcgcgctaggtgcacatggcc

SEQ ID NO: 240137 - DNA, 25 bp, Mus musculus
ctggtgcgcctgattgctcaggtgc

SEQ ID NO: 240138 - DNA, 25 bp, Mus musculus
gtgcggggctcatcaggcgctcacc

SEQ ID NO: 240139 - DNA, 25 bp, Mus musculus
gcgtcacccggtgcctcaataaagg

SEQ ID NO: 240140 - DNA, 25 bp, Mus musculus
cggtgcctcaataaagggctttgtg

SEQ ID NO: 240141 - DNA, 25 bp, Mus musculus
ttccagacagaaccggctagggcgc

SEQ ID NO: 240142 - DNA, 25 bp, Mus musculus
gattccgctgcaggtagcttccaga

SEQ ID NO: 240143 - DNA, 25 bp, Mus musculus
gtccctgcatctcaacaggtcaagg

SEQ ID NO: 240144 - DNA, 25 bp, Mus musculus
agctctagagcggaacccgtgtccc

SEQ ID NO: 240145 - DNA, 25 bp, Mus musculus
ccttgccgggactggagaaccaaag

SEQ ID NO: 240146 - DNA, 25 bp, Mus musculus
agtcgcgaacttctccgcagccggg

SEQ ID NO: 240147 - DNA, 25 bp, Mus musculus
cacgctaactcaagcgccggtcttg

SEQ ID NO: 240148 - DNA, 25 bp, Mus musculus
cggtcttgctactttcctgatggga

SEQ ID NO: 240149 - DNA, 25 bp, Mus musculus
cctgatgggaacctttggggcaaat

SEQ ID NO: 240150 - DNA, 25 bp, Mus musculus
gcctcgagtcctgcgggaaaatgtc

SEQ ID NO: 240151 - DNA, 25 bp, Mus musculus
atgtcccgttgttggagtctggttc

SEQ ID NO: 240152 - DNA, 25 bp, Mus musculus
tctggttcctgagttgcgtaacaca

SEQ ID NO: 240153 - DNA, 25 bp, Mus musculus
cacacgcgtcccagaagtttctcga

SEQ ID NO: 240154 - DNA, 25 bp, Mus musculus
ctcgaggagtacagccaggttcttt

SEQ ID NO: 240155 - DNA, 25 bp, Mus musculus
cacagtggtgcggactgtactctcc

SEQ ID NO: 240156 - DNA, 25 bp, Mus musculus
tgagccgagccatggcagcccattc

SEQ ID NO: 240157 - DNA, 25 bp, Mus musculus
aggcagtgatccgatgctcccactc

SEQ ID NO: 240158 - DNA, 25 bp, Mus musculus
gggatctctgtagcgcgcgtttgaa

SEQ ID NO: 240159 - DNA, 25 bp, Mus musculus
cgcgtttgaacacagccgaattggg

SEQ ID NO: 240160 - DNA, 25 bp, Mus musculus
gtgcgcgctgcccttaaaaggaggc

SEQ ID NO: 240161 - DNA, 25 bp, Mus musculus
ccagaagcagcgaaggcagtgatcc

SEQ ID NO: 240162 - DNA, 25 bp, Mus musculus
ttggtctctggtgacccgacagtgc

SEQ ID NO: 240163 - DNA, 25 bp, Mus musculus
tccctgatgtttccgatggcaagcc

SEQ ID NO: 240164 - DNA, 25 bp, Mus musculus
gcccattccaggtgaggcttgcgca

SEQ ID NO: 240165 - DNA, 25 bp, Mus musculus
cagcggctggatcactgctatctca

SEQ ID NO: 240166 - DNA, 25 bp, Mus musculus
ctcatccctgagtgtcgggtagaaa

SEQ ID NO: 240167 - DNA, 25 bp, Mus musculus
tgaaccgagtgcaaagggaccgccc

SEQ ID NO: 240168 - DNA, 25 bp, Mus musculus
tctggcccgaagaactgttattttc

SEQ ID NO: 240169 - DNA, 25 bp, Mus musculus
taaggttaaagattccgcttctggc

SEQ ID NO: 240170 - DNA, 25 bp, Mus musculus
agcaagccacgagctcagcctggag

SEQ ID NO: 240171 - DNA, 25 bp, Mus musculus
cccaaactgtgtccacaaatcgggg

SEQ ID NO: 240172 - DNA, 25 bp, Mus musculus
tgtgtccacaaatcggggaccctcc

SEQ ID NO: 240173 - DNA, 25 bp, Mus musculus
tccctggagcaagccacgagctcag

SEQ ID NO: 240174 - DNA, 25 bp, Mus musculus
acggattttgcaggagccccgcgaa

SEQ ID NO: 240175 - DNA, 25 bp, Mus musculus
gggtgaccgctccaggctgagaccc

SEQ ID NO: 240176 - DNA, 25 bp, Mus musculus
cgcgggataacgcagcggttacctc

SEQ ID NO: 240177 - DNA, 25 bp, Mus musculus
acgcagcggttacctctgtccgcgg

SEQ ID NO: 240178 - DNA, 25 bp, Mus musculus
tcggccgagcgctcttgagagccgc

SEQ ID NO: 240179 - DNA, 25 bp, Mus musculus
ggaaatgtagttctctgttgcctct

SEQ ID NO: 240180 - DNA, 25 bp, Mus musculus
tagttctctgttgcctctttgaaga

SEQ ID NO: 240181 - DNA, 25 bp, Mus musculus
gttgcctctttgaagagcgcgcctg

SEQ ID NO: 240182 - DNA, 25 bp, Mus musculus
acatcagggccgtgcaagcccggga

SEQ ID NO: 240183 - DNA, 25 bp, Mus musculus
agctcctcaccgacgcgagcgcggg

SEQ ID NO: 240184 - DNA, 25 bp, Mus musculus
tgactggcctgatcacgtgaccggc

SEQ ID NO: 240185 - DNA, 25 bp, Mus musculus
cccgattctaggacgggctgcggtt

SEQ ID NO: 240186 - DNA, 25 bp, Mus musculus
gcgtcagtgactgtccggtcctcag

SEQ ID NO: 240187 - DNA, 25 bp, Mus musculus
acacaggttagtttgcggcgtggcc

SEQ ID NO: 240188 - DNA, 25 bp, Mus musculus
acggagaggcctggcacacaggtta

SEQ ID NO: 240189 - DNA, 25 bp, Mus musculus
actccagttcgcctgcgcagacgga

SEQ ID NO: 240190 - DNA, 25 bp, Mus musculus
ctcctctcctggaagcacgtggtcg

SEQ ID NO: 240191 - DNA, 25 bp, Mus musculus
tctcaaacctcgcatggctcacgtg

SEQ ID NO: 240192 - DNA, 25 bp, Mus musculus
aaccaaggtgtttcaagactcgtca

SEQ ID NO: 240193 - DNA, 25 bp, Mus musculus
tgcgggcaagtttcgaaaagcaagt

SEQ ID NO: 240194 - DNA, 25 bp, Mus musculus
tctctgaatccggtatgcgggcaag

SEQ ID NO: 240195 - DNA, 25 bp, Mus musculus
tttgttgttcacaggcggtctctga

SEQ ID NO: 240196 - DNA, 25 bp, Mus musculus
gttccgagacctcgggtggacctgc

SEQ ID NO: 240197 - DNA, 25 bp, Mus musculus
gcgggacgcccacattttgttgttc

SEQ ID NO: 240198 - DNA, 25 bp, Mus musculus
tcggcgcgatttccggtacccatca

SEQ ID NO: 240199 - DNA, 25 bp, Mus musculus
cctaactcctctaattcggcgcgat

SEQ ID NO: 240200 - DNA, 25 bp, Mus musculus
tcgacgcgcctaagtccagtccagg

SEQ ID NO: 240201 - DNA, 25 bp, Mus musculus
cgactccgggaagaaaagaacatgg

SEQ ID NO: 240202 - DNA, 25 bp, Mus musculus
aaaagaacatggctcctgcggcaga

SEQ ID NO: 240203 - DNA, 25 bp, Mus musculus
ccagtgagcgccatggttaactcca

SEQ ID NO: 240204 - DNA, 25 bp, Mus musculus
gttaactccagacgcgtgcagccgc

SEQ ID NO: 240205 - DNA, 25 bp, Mus musculus
tttcgtcctgctccaggcaagcgtg

SEQ ID NO: 240206 - DNA, 25 bp, Mus musculus
gagccgcgacaacccgggctttgag

SEQ ID NO: 240207 - DNA, 25 bp, Mus musculus
gctgcgaggtaagatccggactctt

SEQ ID NO: 240208 - DNA, 25 bp, Mus musculus
actcttggcgtccagtgcacgcttg

SEQ ID NO: 240209 - DNA, 25 bp, Mus musculus
tgcacgcttgacaactgcctgcgcg

SEQ ID NO: 240210 - DNA, 25 bp, Mus musculus
cctgtcctacaagggtggctgtctg

SEQ ID NO: 240211 - DNA, 25 bp, Mus musculus
gtacccatcaccgaattttactgcg

SEQ ID NO: 240212 - DNA, 25 bp, Mus musculus
atagaacgcctacctggcccgcagg

SEQ ID NO: 240213 - DNA, 25 bp, Mus musculus
gtgcgcagaggactcgctgcaccgc

SEQ ID NO: 240214 - DNA, 25 bp, Mus musculus
cgcagtgacgtcagccgaacgccga

SEQ ID NO: 240215 - DNA, 25 bp, Mus musculus
agccgaacgccgaggagatcccgac

SEQ ID NO: 240216 - DNA, 25 bp, Mus musculus
gaccggtttcccaccgctctgtgga

SEQ ID NO: 240217 - DNA, 25 bp, Mus musculus
tgtgtcgttggtgtccctatcgagc

SEQ ID NO: 240218 - DNA, 25 bp, Mus musculus
gtgtccctatcgagctgggtcagga

SEQ ID NO: 240219 - DNA, 25 bp, Mus musculus
gcggaccgggctgtgctaacacacg

SEQ ID NO: 240220 - DNA, 25 bp, Mus musculus
cacacgcaggggaaagccacagacc

SEQ ID NO: 240221 - DNA, 25 bp, Mus musculus
ttccggggcgttcttgaagcgaaca

SEQ ID NO: 240222 - DNA, 25 bp, Mus musculus
tgaagcgaacagaccttaaatgaga

SEQ ID NO: 240223 - DNA, 25 bp, Mus musculus
taaatgagatctggtgtcaccgggc

SEQ ID NO: 240224 - DNA, 25 bp, Mus musculus
catttggtggctcccgtgagcgtct

SEQ ID NO: 240225 - DNA, 25 bp, Mus musculus
cgtgagcgtctctgggcacatagaa

SEQ ID NO: 240226 - DNA, 25 bp, Mus musculus
atggcggcggccgctctatcccgga

SEQ ID NO: 240227 - DNA, 25 bp, Mus musculus
ctctatcccggacgctgttgccaga

SEQ ID NO: 240228 - DNA, 25 bp, Mus musculus
tccggatccgctatcccggggcgct

SEQ ID NO: 240229 - DNA, 25 bp, Mus musculus
tgctttgggccgggcctccggatcc

SEQ ID NO: 240230 - DNA, 25 bp, Mus musculus
tcaggtgagtctcgctccgccgtgc

SEQ ID NO: 240231 - DNA, 25 bp, Mus musculus
gctgctcaggtgagtctcgctccgc

SEQ ID NO: 240232 - DNA, 25 bp, Mus musculus
cgccgctgctcaggtgagtctcgct

SEQ ID NO: 240233 - DNA, 25 bp, Mus musculus
ctgtggggatttacacgaaggcttc

SEQ ID NO: 240234 - DNA, 25 bp, Mus musculus
aaggcttccgcttcgccgcgccgct

SEQ ID NO: 240235 - DNA, 25 bp, Mus musculus
ttacacgaaggcttccgcttcgccg

SEQ ID NO: 240236 - DNA, 25 bp, Mus musculus
ggatttacacgaaggcttccgcttc

SEQ ID NO: 240237 - DNA, 25 bp, Mus musculus
cgcctgtggggatttacacgaaggc

SEQ ID NO: 240238 - DNA, 25 bp, Mus musculus
tggggatttacacgaaggcttccgc

SEQ ID NO: 240239 - DNA, 25 bp, Mus musculus
ccggacgctgttgccagaggcccgg

SEQ ID NO: 240240 - DNA, 25 bp, Mus musculus
agtcacctgctaagcagcggtcgcc

SEQ ID NO: 240241 - DNA, 25 bp, Mus musculus
tgaacacgcacctgtgtatccacca

SEQ ID NO: 240242 - DNA, 25 bp, Mus musculus
tgtccatacggctgaacacgcacct

SEQ ID NO: 240243 - DNA, 25 bp, Mus musculus
ccttcgttgtccatacggctgaaca

SEQ ID NO: 240244 - DNA, 25 bp, Mus musculus
cccaggcggtgccttcgttgtccat

SEQ ID NO: 240245 - DNA, 25 bp, Mus musculus
tcgtcccaaggccgggtggactctc

SEQ ID NO: 240246 - DNA, 25 bp, Mus musculus
tcccttgcgggcacctctcgtggat

SEQ ID NO: 240247 - DNA, 25 bp, Mus musculus
tgggatcagtcacctgctaagcagc

SEQ ID NO: 240248 - DNA, 25 bp, Mus musculus
tggctgccatgcaccgcggatgcca

SEQ ID NO: 240249 - DNA, 25 bp, Mus musculus
aggcgcctcacctgggtctcccgct

SEQ ID NO: 240250 - DNA, 25 bp, Mus musculus
ccgcgtcacaatggagcggctccgg

SEQ ID NO: 240251 - DNA, 25 bp, Mus musculus
acttagtcagcggttcgcgccgccg

SEQ ID NO: 240252 - DNA, 25 bp, Mus musculus
cgcgcgcgaacttagtcagcggttc

SEQ ID NO: 240253 - DNA, 25 bp, Mus musculus
gcacctctcgtggatgttggggtca

SEQ ID NO: 240254 - DNA, 25 bp, Mus musculus
gcttccgcttagagccgcgtgtgac

SEQ ID NO: 240255 - DNA, 25 bp, Mus musculus
cgagacaaaggcgtgcggaacacga

SEQ ID NO: 240256 - DNA, 25 bp, Mus musculus
gcggaacacgactgatggagaaagc

SEQ ID NO: 240257 - DNA, 25 bp, Mus musculus
tggagaaagcgccaacccagtattg

SEQ ID NO: 240258 - DNA, 25 bp, Mus musculus
aagcgccaacccagtattgtctccg

SEQ ID NO: 240259 - DNA, 25 bp, Mus musculus
gcgtcgcaccgcctagtgcgtaata

SEQ ID NO: 240260 - DNA, 25 bp, Mus musculus
tgcgtaataccaggagccaacccgg

SEQ ID NO: 240261 - DNA, 25 bp, Mus musculus
ccggatagagcgtcgcttccgctta

SEQ ID NO: 240262 - DNA, 25 bp, Mus musculus
tgaccttcccgcttgcggagctatg

SEQ ID NO: 240263 - DNA, 25 bp, Mus musculus
cagcgcttcgccttgccaggtaaag

SEQ ID NO: 240264 - DNA, 25 bp, Mus musculus
ccttgccaggtaaagcggtggtcta

SEQ ID NO: 240265 - DNA, 25 bp, Mus musculus
cgaccttgggtgcaggtacctttcg

SEQ ID NO: 240266 - DNA, 25 bp, Mus musculus
acccatcgccgtggtcggcagcata

SEQ ID NO: 240267 - DNA, 25 bp, Mus musculus
accaggagccaacccgggctagagc

SEQ ID NO: 240268 - DNA, 25 bp, Mus musculus
accattcgtccctggtggtcgacca

SEQ ID NO: 240269 - DNA, 25 bp, Mus musculus
cagggagctccacgtgtaccattcg

SEQ ID NO: 240270 - DNA, 25 bp, Mus musculus
gtactctaagcgcttctccatcttc

SEQ ID NO: 240271 - DNA, 25 bp, Mus musculus
tccatcttcctgtcggaggtcagcg

SEQ ID NO: 240272 - DNA, 25 bp, Mus musculus
tgtcggaggtcagcgagaacaaact

SEQ ID NO: 240273 - DNA, 25 bp, Mus musculus
caacaacgagtggaccgtggagaga

SEQ ID NO: 240274 - DNA, 25 bp, Mus musculus
ccgtggagagactgaagagcaagct

SEQ ID NO: 240275 - DNA, 25 bp, Mus musculus
gcctggagctgatcccggaagtcaa

SEQ ID NO: 240276 - DNA, 25 bp, Mus musculus
gcaagctcgtgaaaaactcgcagga

SEQ ID NO: 240277 - DNA, 25 bp, Mus musculus
ggacaaggtcgagctgcatctcttc

SEQ ID NO: 240278 - DNA, 25 bp, Mus musculus
tcttcatgctcaacggtctcccgga

SEQ ID NO: 240279 - DNA, 25 bp, Mus musculus
gtcgctcagctcgtcaacctcaggg

SEQ ID NO: 240280 - DNA, 25 bp, Mus musculus
cggtctcccggataacgtctttgag

SEQ ID NO: 240281 - DNA, 25 bp, Mus musculus
cgtctttgagctgacggagatggaa

SEQ ID NO: 240282 - DNA, 25 bp, Mus musculus
cctgccactagcctcggttctctgg

SEQ ID NO: 240283 - DNA, 25 bp, Mus musculus
ggcgttagctgcgtcccggctcaga

SEQ ID NO: 240284 - DNA, 25 bp, Mus musculus
ccagtacagcctggccgctaggttc

SEQ ID NO: 240285 - DNA, 25 bp, Mus musculus
agccgggagcccagtacagcctggc

SEQ ID NO: 240286 - DNA, 25 bp, Mus musculus
cctactcagcgtgcggttcggggat

SEQ ID NO: 240287 - DNA, 25 bp, Mus musculus
ggccgcagcactctgagcgcgacaa

SEQ ID NO: 240288 - DNA, 25 bp, Mus musculus
ctctgggacaggcacattgtggtcg

SEQ ID NO: 240289 - DNA, 25 bp, Mus musculus
gagagggacggccagcaccctgcca

SEQ ID NO: 240290 - DNA, 25 bp, Mus musculus
ctcagagcccgcgaagaagacgagg

SEQ ID NO: 240291 - DNA, 25 bp, Mus musculus
gcatccttttctgcggataccctcg

SEQ ID NO: 240292 - DNA, 25 bp, Mus musculus
gcgccctggcatccttttctgcgga

SEQ ID NO: 240293 - DNA, 25 bp, Mus musculus
gacaagccatgagcagcgacgccgc

SEQ ID NO: 240294 - DNA, 25 bp, Mus musculus
ctctgagcgcgacaagccatgagca

SEQ ID NO: 240295 - DNA, 25 bp, Mus musculus
ggcacattgtggtcgcctactcagc

SEQ ID NO: 240296 - DNA, 25 bp, Mus musculus
tatcgcggtggctccgagtcctcca

SEQ ID NO: 240297 - DNA, 25 bp, Mus musculus
agccggcgagaggagcccttgaact

SEQ ID NO: 240298 - DNA, 25 bp, Mus musculus
ctgagcttcaagcagccagcccaga

SEQ ID NO: 240299 - DNA, 25 bp, Mus musculus
ggagattgcctatcgcggtggctcc

SEQ ID NO: 240300 - DNA, 25 bp, Mus musculus
gacattgtttcgctttgggccctgc

SEQ ID NO: 240301 - DNA, 25 bp, Mus musculus
tcccggggctgcgatcgggaactcc

SEQ ID NO: 240302 - DNA, 25 bp, Mus musculus
tcctccgccgcgcttagaggtggca

SEQ ID NO: 240303 - DNA, 25 bp, Mus musculus
tacagagtcatgtgctgctgctccc

SEQ ID NO: 240304 - DNA, 25 bp, Mus musculus
ccctcgttacagagtcatgtgctgc

SEQ ID NO: 240305 - DNA, 25 bp, Mus musculus
ggagtccatgttacgctttgtctaa

SEQ ID NO: 240306 - DNA, 25 bp, Mus musculus
ctgcacgggcctggagtccatgtta

SEQ ID NO: 240307 - DNA, 25 bp, Mus musculus
aggcaatcacatggaggcccgggcc

SEQ ID NO: 240308 - DNA, 25 bp, Mus musculus
cgggcccagagcaggcaatcacatg

SEQ ID NO: 240309 - DNA, 25 bp, Mus musculus
gagcccttgaacttctgcagaaacg

SEQ ID NO: 240310 - DNA, 25 bp, Mus musculus
cttgctcgctccatccgcggctgct

SEQ ID NO: 240311 - DNA, 25 bp, Mus musculus
ttgctcgcggggactctctctctcg

SEQ ID NO: 240312 - DNA, 25 bp, Mus musculus
agccgagtcctcgagagcgccctga

SEQ ID NO: 240313 - DNA, 25 bp, Mus musculus
gaagtctcgcgtcgcagcggttcca

SEQ ID NO: 240314 - DNA, 25 bp, Mus musculus
ccaggatggaggagtgaagtctcgc

SEQ ID NO: 240315 - DNA, 25 bp, Mus musculus
gctgactgcaacgtgctgccggctc

SEQ ID NO: 240316 - DNA, 25 bp, Mus musculus
gaagtgcactgctgactgcaacgtg

SEQ ID NO: 240317 - DNA, 25 bp, Mus musculus
aaacaggaagtgcactgctgactgc

SEQ ID NO: 240318 - DNA, 25 bp, Mus musculus
ctcgctctctttgaaacaggaagtg

SEQ ID NO: 240319 - DNA, 25 bp, Mus musculus
caatcgctggctggatggctgcctg

SEQ ID NO: 240320 - DNA, 25 bp, Mus musculus
cccggcgtgcaatcgctggctggat

SEQ ID NO: 240321 - DNA, 25 bp, Mus musculus
cctgagcgtgaagtctgcgcaggga

SEQ ID NO: 240322 - DNA, 25 bp, Mus musculus
aggcgaaggccaagtgcccgctgcc

SEQ ID NO: 240323 - DNA, 25 bp, Mus musculus
ctctttgaaacaggaagtgcactgc

SEQ ID NO: 240324 - DNA, 25 bp, Mus musculus
gcttcccggctagtagcgccgctgt

SEQ ID NO: 240325 - DNA, 25 bp, Mus musculus
ttccatcgagatgggcttcggttcc

SEQ ID NO: 240326 - DNA, 25 bp, Mus musculus
tataaagggcgtctctaggcgttcc

SEQ ID NO: 240327 - DNA, 25 bp, Mus musculus
cttctccgtgtgagaggagtataaa

SEQ ID NO: 240328 - DNA, 25 bp, Mus musculus
ccagaaccagaatctgcaagttatt

SEQ ID NO: 240329 - DNA, 25 bp, Mus musculus
ctcgtgcgatgcttctccgtgtgag

SEQ ID NO: 240330 - DNA, 25 bp, Mus musculus
tggaatcttgctcgacacaggctgc

SEQ ID NO: 240331 - DNA, 25 bp, Mus musculus
tcaagatggccgtgtggctttgttc

SEQ ID NO: 240332 - DNA, 25 bp, Mus musculus
ggggtctgtttaccgcctcaagatg

SEQ ID NO: 240333 - DNA, 25 bp, Mus musculus
ccgcggcgtcgagcatggacttcga

SEQ ID NO: 240334 - DNA, 25 bp, Mus musculus
aggagcctgacaactgcctcgcttc

SEQ ID NO: 240335 - DNA, 25 bp, Mus musculus
ccggtcgtgtggacactgccgtatc

SEQ ID NO: 240336 - DNA, 25 bp, Mus musculus
gcaagttattaccacgtagccgacc

SEQ ID NO: 240337 - DNA, 25 bp, Mus musculus
acactgccgtatcgcgggctcttgc

SEQ ID NO: 240338 - DNA, 25 bp, Mus musculus
gaaaacaaccggcagaaacagtgag

SEQ ID NO: 240339 - DNA, 25 bp, Mus musculus
accggcagaaacagtgagatgacac

SEQ ID NO: 240340 - DNA, 25 bp, Mus musculus
tgagatgacacgtcaacccacgagc

SEQ ID NO: 240341 - DNA, 25 bp, Mus musculus
gacacgtcaacccacgagcgagcga

SEQ ID NO: 240342 - DNA, 25 bp, Mus musculus
gagcgagcgaggctcatgatgcgga

SEQ ID NO: 240343 - DNA, 25 bp, Mus musculus
gcagtacgggagcacaccgtccgtc

SEQ ID NO: 240344 - DNA, 25 bp, Mus musculus
tccccagtcactcgggagagagaga

SEQ ID NO: 240345 - DNA, 25 bp, Mus musculus
gagagagtaaatgtgttagaaatcc

SEQ ID NO: 240346 - DNA, 25 bp, Mus musculus
gtgttagaaatccacagcaaaatta

SEQ ID NO: 240347 - DNA, 25 bp, Mus musculus
cagcaaaattactcactattagccc

SEQ ID NO: 240348 - DNA, 25 bp, Mus musculus
ccctacagtgtgctttcaagccgcg

SEQ ID NO: 240349 - DNA, 25 bp, Mus musculus
agtgtgctttcaagccgcgtgtgca

SEQ ID NO: 240350 - DNA, 25 bp, Mus musculus
ttcaagccgcgtgtgcacgcgcacg

SEQ ID NO: 240351 - DNA, 25 bp, Mus musculus
gcggcagtacgggagcacaccgtcc

SEQ ID NO: 240352 - DNA, 25 bp, Mus musculus
cggttaagagttgatctgtcgcaga

SEQ ID NO: 240353 - DNA, 25 bp, Mus musculus
ctagctaccgggacttgaaggcacc

SEQ ID NO: 240354 - DNA, 25 bp, Mus musculus
agcgcctggtgcattctgcgccgcg

SEQ ID NO: 240355 - DNA, 25 bp, Mus musculus
tcccaagggcagcaccgagggccaa

SEQ ID NO: 240356 - DNA, 25 bp, Mus musculus
gccaggttctgcctcgcgctcggta

SEQ ID NO: 240357 - DNA, 25 bp, Mus musculus
ctcgcgctcggtacgcggttttcct

SEQ ID NO: 240358 - DNA, 25 bp, Mus musculus
tcagggcctcctatacgatcagacg

SEQ ID NO: 240359 - DNA, 25 bp, Mus musculus
tacgatcagacggtcgcaaaaagtc

SEQ ID NO: 240360 - DNA, 25 bp, Mus musculus
tcgcaaaaagtcgtgagcacgcgtg

SEQ ID NO: 240361 - DNA, 25 bp, Mus musculus
gagaagcgctgcagatcatgaaccc

SEQ ID NO: 240362 - DNA, 25 bp, Mus musculus
agagcttgtcttccagctgcggaga

SEQ ID NO: 240363 - DNA, 25 bp, Mus musculus
gagacctcgcgcgactgaagcagaa

SEQ ID NO: 240364 - DNA, 25 bp, Mus musculus
gacttgaaggcaccagcgcctggtg

SEQ ID NO: 240365 - DNA, 25 bp, Mus musculus
actgaagcagaagagccgccgggca

SEQ ID NO: 240366 - DNA, 25 bp, Mus musculus
tcgcggatccaagcacaactcatta

SEQ ID NO: 240367 - DNA, 25 bp, Mus musculus
cacaactcattagggcgagcgacta

SEQ ID NO: 240368 - DNA, 25 bp, Mus musculus
ctcattagggcgagcgactaggtga

SEQ ID NO: 240369 - DNA, 25 bp, Mus musculus
gctagaaggtcgcagttgggaacta

SEQ ID NO: 240370 - DNA, 25 bp, Mus musculus
ttgggaactaagaaggcaaggatca

SEQ ID NO: 240371 - DNA, 25 bp, Mus musculus
tgaacagctgcaaggccggcctagt

SEQ ID NO: 240372 - DNA, 25 bp, Mus musculus
aggcaaggatcaaagcggcgacaag

SEQ ID NO: 240373 - DNA, 25 bp, Mus musculus
acaagggtttgttagcagggcactc

SEQ ID NO: 240374 - DNA, 25 bp, Mus musculus
ttgttagcagggcactcggcgtccc

SEQ ID NO: 240375 - DNA, 25 bp, Mus musculus
ggattcctaattgctcggcccacag

SEQ ID NO: 240376 - DNA, 25 bp, Mus musculus
ccgctcgcaggctgtccggcagtga

SEQ ID NO: 240377 - DNA, 25 bp, Mus musculus
agccgcaggcggctgaacagctgca

SEQ ID NO: 240378 - DNA, 25 bp, Mus musculus
tgcaaggccggcctagtgtccgcct

SEQ ID NO: 240379 - DNA, 25 bp, Mus musculus
gttgtgctcccgcttcgcggatcca

SEQ ID NO: 240380 - DNA, 25 bp, Mus musculus
tgtcatttctacatgaggtccacgc

SEQ ID NO: 240381 - DNA, 25 bp, Mus musculus
gtccaagtggtacccactgtaacga

SEQ ID NO: 240382 - DNA, 25 bp, Mus musculus
aacgcctactccaggggtccaagtg

SEQ ID NO: 240383 - DNA, 25 bp, Mus musculus
tgctcttttgagaaccgaacctcgg

SEQ ID NO: 240384 - DNA, 25 bp, Mus musculus
cccggagccgagtttctgaactttg

SEQ ID NO: 240385 - DNA, 25 bp, Mus musculus
agcaggtgcagcgaccgctaaggcc

SEQ ID NO: 240386 - DNA, 25 bp, Mus musculus
cgagactaagatgctggccgctgga

SEQ ID NO: 240387 - DNA, 25 bp, Mus musculus
cagcggagagcagcaccgagactaa

SEQ ID NO: 240388 - DNA, 25 bp, Mus musculus
tgccacaagcgggaaggtgtgctcc

SEQ ID NO: 240389 - DNA, 25 bp, Mus musculus
gtgggcactttcgactcaacttttc

SEQ ID NO: 240390 - DNA, 25 bp, Mus musculus
tagacactaaaaagcgttgacactg

SEQ ID NO: 240391 - DNA, 25 bp, Mus musculus
caagcaagggaaactaccgatcgta

SEQ ID NO: 240392 - DNA, 25 bp, Mus musculus
cactgtaacgagtacccggccaggg

SEQ ID NO: 240393 - DNA, 25 bp, Mus musculus
aggtccacgctactccgcggatcag

SEQ ID NO: 240394 - DNA, 25 bp, Mus musculus
ggggacacttcaaattacagcactg

SEQ ID NO: 240395 - DNA, 25 bp, Mus musculus
gttcagcccgctccgtgagtcagca

SEQ ID NO: 240396 - DNA, 25 bp, Mus musculus
ctcaccaggatgaaggaaccacagg

SEQ ID NO: 240397 - DNA, 25 bp, Mus musculus
ccacaggtgcacaaggaagacgccc

SEQ ID NO: 240398 - DNA, 25 bp, Mus musculus
ttacagcactgagcagcaggggctc

SEQ ID NO: 240399 - DNA, 25 bp, Mus musculus
cgtccgcactacctgtggtctgagc

SEQ ID NO: 240400 - DNA, 25 bp, Mus musculus
tgagcctcgcgcctaggctttacgc

SEQ ID NO: 240401 - DNA, 25 bp, Mus musculus
catggagacgaccagtgagcacttc

SEQ ID NO: 240402 - DNA, 25 bp, Mus musculus
cctctgtgactctaaaccgaccgga

SEQ ID NO: 240403 - DNA, 25 bp, Mus musculus
accgaccggagaccaaggagctcga

SEQ ID NO: 240404 - DNA, 25 bp, Mus musculus
accaaggagctcgaaggaacagttc

SEQ ID NO: 240405 - DNA, 25 bp, Mus musculus
ggaacagttcctagacgcatcagtt

SEQ ID NO: 240406 - DNA, 25 bp, Mus musculus
gggctcggtcctcagctgttcagcc

SEQ ID NO: 240407 - DNA, 25 bp, Mus musculus
caaggctaccgagccaggggttgct

SEQ ID NO: 240408 - DNA, 25 bp, Mus musculus
atggccgaggcacgcgcatctcgct

SEQ ID NO: 240409 - DNA, 25 bp, Mus musculus
tagcactttgaaccgggcgttgagc

SEQ ID NO: 240410 - DNA, 25 bp, Mus musculus
ccgctggacctgctcaaggtgagtg

SEQ ID NO: 240411 - DNA, 25 bp, Mus musculus
gtgagtgagcctgagcttcaaggcc

SEQ ID NO: 240412 - DNA, 25 bp, Mus musculus
tgagcctgagcttcaaggccgagcg

SEQ ID NO: 240413 - DNA, 25 bp, Mus musculus
catccggggcctggcgcctacaagg

SEQ ID NO: 240414 - DNA, 25 bp, Mus musculus
tggcgcctacaaggcgcctgctgcg

SEQ ID NO: 240415 - DNA, 25 bp, Mus musculus
cttgactgcgcacccggtaattacc

SEQ ID NO: 240416 - DNA, 25 bp, Mus musculus
taattaccgccggtgacgcccacgc

SEQ ID NO: 240417 - DNA, 25 bp, Mus musculus
gctgcgggcgccaatacacttactt

SEQ ID NO: 240418 - DNA, 25 bp, Mus musculus
atacacttacttcccggtaggcagc

SEQ ID NO: 240419 - DNA, 25 bp, Mus musculus
tcccggtaggcagcggtggaaaatc

SEQ ID NO: 240420 - DNA, 25 bp, Mus musculus
gggcgctcggtagcactttgaaccg

SEQ ID NO: 240421 - DNA, 25 bp, Mus musculus
acgcgcatctcgctggtactttggg

SEQ ID NO: 240422 - DNA, 25 bp, Mus musculus
cccaaagactgtggccaatgccagg

SEQ ID NO: 240423 - DNA, 25 bp, Mus musculus
gatcacgggtcacgtgccccaaaga

SEQ ID NO: 240424 - DNA, 25 bp, Mus musculus
cggcccgcacgaccacacctccacg

SEQ ID NO: 240425 - DNA, 25 bp, Mus musculus
cgccacacggctcggcccgcacgac

SEQ ID NO: 240426 - DNA, 25 bp, Mus musculus
ccctctcgccacacggctcggcccg

SEQ ID NO: 240427 - DNA, 25 bp, Mus musculus
gaggcaaaggagtggtggaccaggt

SEQ ID NO: 240428 - DNA, 25 bp, Mus musculus
cccaccaagtgccgcggaggcaaag

SEQ ID NO: 240429 - DNA, 25 bp, Mus musculus
tcagggtagcgcacagccggggcga

SEQ ID NO: 240430 - DNA, 25 bp, Mus musculus
gctgcaggccaagtagccccgggaa

SEQ ID NO: 240431 - DNA, 25 bp, Mus musculus
agcggacacagagcggcgcggggcc

SEQ ID NO: 240432 - DNA, 25 bp, Mus musculus
aaagactgtggccaatgccaggccc

SEQ ID NO: 240433 - DNA, 25 bp, Mus musculus
gccacacgaggagcggacacagagc

SEQ ID NO: 240434 - DNA, 25 bp, Mus musculus
tggaccaggtggatctggatcacgg

SEQ ID NO: 240435 - DNA, 25 bp, Mus musculus
agccacacgaggagcggacacagag

SEQ ID NO: 240436 - DNA, 25 bp, Mus musculus
cccgaccgcacacggggctgaggaa

SEQ ID NO: 240437 - DNA, 25 bp, Mus musculus
tccctcttccggagatgaacgcgaa

SEQ ID NO: 240438 - DNA, 25 bp, Mus musculus
tgtaatcgtccctcttccggagatg

SEQ ID NO: 240439 - DNA, 25 bp, Mus musculus
ggccgcctctatgagggtccctctc

SEQ ID NO: 240440 - DNA, 25 bp, Mus musculus
aggcctctactgtccggccgcggag

SEQ ID NO: 240441 - DNA, 25 bp, Mus musculus
cctcggaagggaggcctctactgtc

SEQ ID NO: 240442 - DNA, 25 bp, Mus musculus
ctgcgccacctcctcggaagggagg

SEQ ID NO: 240443 - DNA, 25 bp, Mus musculus
ttccggagatgaacgcgaagcgacg

SEQ ID NO: 240444 - DNA, 25 bp, Mus musculus
cacacggggctgaggaacgcaagcc

SEQ ID NO: 240445 - DNA, 25 bp, Mus musculus
ctcgggccaagcacacgagactcgg

SEQ ID NO: 240446 - DNA, 25 bp, Mus musculus
catatcccggggtgactcgggccaa

SEQ ID NO: 240447 - DNA, 25 bp, Mus musculus
acaagggccgcatatcccggggtga

SEQ ID NO: 240448 - DNA, 25 bp, Mus musculus
tgggcccggacaagggccgcatatc

SEQ ID NO: 240449 - DNA, 25 bp, Mus musculus
ggacctcaccgggtagccgagcagc

SEQ ID NO: 240450 - DNA, 25 bp, Mus musculus
ccgaaactcacagtttggtgccgtg

SEQ ID NO: 240451 - DNA, 25 bp, Mus musculus
acttcttccgccaccctcagtcccg

SEQ ID NO: 240452 - DNA, 25 bp, Mus musculus
ggagccagcctagggcgtagctccc

SEQ ID NO: 240453 - DNA, 25 bp, Mus musculus
tcctttccgagggttgggagccagc

SEQ ID NO: 240454 - DNA, 25 bp, Mus musculus
atcttagcctgtgcggcaaaacgcg

SEQ ID NO: 240455 - DNA, 25 bp, Mus musculus
cgccatcttagcctgtgcggcaaaa

SEQ ID NO: 240456 - DNA, 25 bp, Mus musculus
cggagctcccgtgccaatcagaccc

SEQ ID NO: 240457 - DNA, 25 bp, Mus musculus
agcagccgccatcttagcctgtgcg

SEQ ID NO: 240458 - DNA, 25 bp, Mus musculus
cctcagcccggacgtccgaaacgcg

SEQ ID NO: 240459 - DNA, 25 bp, Mus musculus
tcacagtttggtgccgtgtgcgtca

SEQ ID NO: 240460 - DNA, 25 bp, Mus musculus
tttggtgccgtgtgcgtcaaaccgg

SEQ ID NO: 240461 - DNA, 25 bp, Mus musculus
tctgtacgctactcggctccaacgg

SEQ ID NO: 240462 - DNA, 25 bp, Mus musculus
ccgcttctcgcctccggcctcggtt

SEQ ID NO: 240463 - DNA, 25 bp, Mus musculus
cggctttcccgcctctgcctggccg

SEQ ID NO: 240464 - DNA, 25 bp, Mus musculus
aggacagcggactagagaacagacc

SEQ ID NO: 240465 - DNA, 25 bp, Mus musculus
aatgtgtgggagacgcccgctcgct

SEQ ID NO: 240466 - DNA, 25 bp, Mus musculus
cgcagacgtccacgcataacaacca

SEQ ID NO: 240467 - DNA, 25 bp, Mus musculus
cgcataacaaccaacccgtcagaaa

SEQ ID NO: 240468 - DNA, 25 bp, Mus musculus
acccgtcagaaatcatccgccggtg

SEQ ID NO: 240469 - DNA, 25 bp, Mus musculus
cgtcagaaatcatccgccggtgcag

SEQ ID NO: 240470 - DNA, 25 bp, Mus musculus
atcatccgccggtgcagagacccag

SEQ ID NO: 240471 - DNA, 25 bp, Mus musculus
cgcaccacaactgagcgcgagggga

SEQ ID NO: 240472 - DNA, 25 bp, Mus musculus
ggactagagaacagaccggcccggc

SEQ ID NO: 240473 - DNA, 25 bp, Mus musculus
ctagagaacagaccggcccggcgcg

SEQ ID NO: 240474 - DNA, 25 bp, Mus musculus
gcaccgcacggtgcgcctcaggcct

SEQ ID NO: 240475 - DNA, 25 bp, Mus musculus
tcaggccgcgctccctgacgggaat

SEQ ID NO: 240476 - DNA, 25 bp, Mus musculus
ccgcgctccctgacgggaatgtgtg

SEQ ID NO: 240477 - DNA, 25 bp, Mus musculus
ccaggcccagcgaccacgcaccaca

SEQ ID NO: 240478 - DNA, 25 bp, Mus musculus
ccgcggacgtcctaacttctgtgaa

SEQ ID NO: 240479 - DNA, 25 bp, Mus musculus
tccagtcgagtggagtgtcacgccc

SEQ ID NO: 240480 - DNA, 25 bp, Mus musculus
tatccttctgttggcaccctgctgc

SEQ ID NO: 240481 - DNA, 25 bp, Mus musculus
agggcggcccattcattcatttatc

SEQ ID NO: 240482 - DNA, 25 bp, Mus musculus
tgcgcactgagcttcccgttggcac

SEQ ID NO: 240483 - DNA, 25 bp, Mus musculus
gatcgtgacttaggtcgtgtcgccc

SEQ ID NO: 240484 - DNA, 25 bp, Mus musculus
gaaccgtgagtttctgacagttttc

SEQ ID NO: 240485 - DNA, 25 bp, Mus musculus
catgagcaattcaaagcagcgcggg

SEQ ID NO: 240486 - DNA, 25 bp, Mus musculus
agggcttcggaatgcgcatgagcaa

SEQ ID NO: 240487 - DNA, 25 bp, Mus musculus
gccttgaaaaaccacgcctcttgcg

SEQ ID NO: 240488 - DNA, 25 bp, Mus musculus
cgctaactcagcaaaggaccaccga

SEQ ID NO: 240489 - DNA, 25 bp, Mus musculus
ttagtcctggggctcgctaactcag

SEQ ID NO: 240490 - DNA, 25 bp, Mus musculus
ggcgagcgacttcctcccgggcaaa

SEQ ID NO: 240491 - DNA, 25 bp, Mus musculus
accggggacgagttcttgatcgtga

SEQ ID NO: 240492 - DNA, 25 bp, Mus musculus
tcaaccctgcgggaccaaagccagg

SEQ ID NO: 240493 - DNA, 25 bp, Mus musculus
agcgtccttcacagcgttttcggga

SEQ ID NO: 240494 - DNA, 25 bp, Mus musculus
tcacagcgttttcgggactgactcc

SEQ ID NO: 240495 - DNA, 25 bp, Mus musculus
gcctctgctacccatcatggtcgag

SEQ ID NO: 240496 - DNA, 25 bp, Mus musculus
gctacccatcatggtcgagtgccca

SEQ ID NO: 240497 - DNA, 25 bp, Mus musculus
tcagcgtcaaccctgcgggaccaaa

SEQ ID NO: 240498 - DNA, 25 bp, Mus musculus
taacccgggagcgtccttcacagcg

SEQ ID NO: 240499 - DNA, 25 bp, Mus musculus
atagggcgccaaaccgcacgtacct

SEQ ID NO: 240500 - DNA, 25 bp, Mus musculus
aggtcccagcctcggggtcctggat

SEQ ID NO: 240501 - DNA, 25 bp, Mus musculus
tggatggccagagcaaccccgcaaa

SEQ ID NO: 240502 - DNA, 25 bp, Mus musculus
gcaaagcaggcaccgacccgcacta

SEQ ID NO: 240503 - DNA, 25 bp, Mus musculus
cgcagcgtgcacagcctctgatagg

SEQ ID NO: 240504 - DNA, 25 bp, Mus musculus
acagcctctgatagggcgccaaacc

SEQ ID NO: 240505 - DNA, 25 bp, Mus musculus
agcggatcccggttccgctcagcgt

SEQ ID NO: 240506 - DNA, 25 bp, Mus musculus
cgaatacgcccagcccacgcagcct

SEQ ID NO: 240507 - DNA, 25 bp, Mus musculus
gacagccgccatccgggcgagagct

SEQ ID NO: 240508 - DNA, 25 bp, Mus musculus
agtcgctggctgctgacagccgcca

SEQ ID NO: 240509 - DNA, 25 bp, Mus musculus
aaaggcgccagtcgctggctgctga

SEQ ID NO: 240510 - DNA, 25 bp, Mus musculus
tgagtcccataaaggcgccagtcgc

SEQ ID NO: 240511 - DNA, 25 bp, Mus musculus
gctgctcgcgggtgagtcccataaa

SEQ ID NO: 240512 - DNA, 25 bp, Mus musculus
tcacgtggcagaccctggccaatca

SEQ ID NO: 240513 - DNA, 25 bp, Mus musculus
aggcacagtcacgtggcagaccctg

SEQ ID NO: 240514 - DNA, 25 bp, Mus musculus
gtttgaggcgcaggcacagtcacgt

SEQ ID NO: 240515 - DNA, 25 bp, Mus musculus
cacctccgcgcggtttgaggcgcag

SEQ ID NO: 240516 - DNA, 25 bp, Mus musculus
tgactcacacctccgcgcggtttga

SEQ ID NO: 240517 - DNA, 25 bp, Mus musculus
cagccgccacagacctgactcacac

SEQ ID NO: 240518 - DNA, 25 bp, Mus musculus
gccaccggtggagaaccgggagcga

SEQ ID NO: 240519 - DNA, 25 bp, Mus musculus
acgcagcctaacttcaaagcctcag

SEQ ID NO: 240520 - DNA, 25 bp, Mus musculus
tcgctcggctctagcgacgtggcac

SEQ ID NO: 240521 - DNA, 25 bp, Mus musculus
catccgggaaaaggtctgcggcttc

SEQ ID NO: 240522 - DNA, 25 bp, Mus musculus
cgctgggacctgttcagagcccgga

SEQ ID NO: 240523 - DNA, 25 bp, Mus musculus
agagcccggagcttcgacaggacct

SEQ ID NO: 240524 - DNA, 25 bp, Mus musculus
atggcgttcggcgtcgccttcatgt

SEQ ID NO: 240525 - DNA, 25 bp, Mus musculus
gtcgccttcatgtcgctcggctcta

SEQ ID NO: 240526 - DNA, 25 bp, Mus musculus
cctgctctactggtccctggtgtac

SEQ ID NO: 240527 - DNA, 25 bp, Mus musculus
aacttttgtggagcatcggtagggc

SEQ ID NO: 240528 - DNA, 25 bp, Mus musculus
ctccttagggactcactgctacgtg

SEQ ID NO: 240529 - DNA, 25 bp, Mus musculus
ctacgtgcgcatcaaggtgaaggcc

SEQ ID NO: 240530 - DNA, 25 bp, Mus musculus
gggccgattgttcctagatgcgtcc

SEQ ID NO: 240531 - DNA, 25 bp, Mus musculus
ttcctagatgcgtcccgatggctgc

SEQ ID NO: 240532 - DNA, 25 bp, Mus musculus
tccgcgattctcacatccgggaaaa

SEQ ID NO: 240533 - DNA, 25 bp, Mus musculus
ccgtccacctgctcaaacttttgtg

SEQ ID NO: 240534 - DNA, 25 bp, Mus musculus
ttagggaccggctgcaaactaggtg

SEQ ID NO: 240535 - DNA, 25 bp, Mus musculus
tggctacgggctttgagtcctaggc

SEQ ID NO: 240536 - DNA, 25 bp, Mus musculus
ctttgagtcctaggcgcgcggtgcc

SEQ ID NO: 240537 - DNA, 25 bp, Mus musculus
cgcggtgcctggtccgcagcattta

SEQ ID NO: 240538 - DNA, 25 bp, Mus musculus
agcatttagggaccggctgcaaact

SEQ ID NO: 240539 - DNA, 25 bp, Mus musculus
cgcctcgctgcagtctcgctgggcg

SEQ ID NO: 240540 - DNA, 25 bp, Mus musculus
ttccttccggggcggattcggctgc

SEQ ID NO: 240541 - DNA, 25 bp, Mus musculus
tgcggccgacatggcccactgtgga

SEQ ID NO: 240542 - DNA, 25 bp, Mus musculus
cccttctgagttccccggggcatgg

SEQ ID NO: 240543 - DNA, 25 bp, Mus musculus
tcagccgcgacgtgctcaggtagga

SEQ ID NO: 240544 - DNA, 25 bp, Mus musculus
cgcccggtcacgtggctacgggctt

SEQ ID NO: 240545 - DNA, 25 bp, Mus musculus
gcgggagcagcgctgctcactccct

SEQ ID NO: 240546 - DNA, 25 bp, Mus musculus
cggtgtcggagcagctcagccgcga

SEQ ID NO: 240547 - DNA, 25 bp, Mus musculus
tgcctggtccgcagcatttagggac

SEQ ID NO: 240548 - DNA, 25 bp, Mus musculus
aggccagcagcgaaggtccttgccc

SEQ ID NO: 240549 - DNA, 25 bp, Mus musculus
agcatgtctacctacccgccgatcc

SEQ ID NO: 240550 - DNA, 25 bp, Mus musculus
cgatccgcccgacccagcatgtcta

SEQ ID NO: 240551 - DNA, 25 bp, Mus musculus
gcaggtcctgttcggcgagcccgat

SEQ ID NO: 240552 - DNA, 25 bp, Mus musculus
cctccagaggccgagcaggagagcc

SEQ ID NO: 240553 - DNA, 25 bp, Mus musculus
tccctgctcctgcagggcagggtgt

SEQ ID NO: 240554 - DNA, 25 bp, Mus musculus
gggaggccatttctccctgctcctg

SEQ ID NO: 240555 - DNA, 25 bp, Mus musculus
ctgaggcgaagggaggccatttctc

SEQ ID NO: 240556 - DNA, 25 bp, Mus musculus
gcgcgaacaggaaaatcacacccta

SEQ ID NO: 240557 - DNA, 25 bp, Mus musculus
cccgcaggcgcgaacaggaaaatca

SEQ ID NO: 240558 - DNA, 25 bp, Mus musculus
gtatcacgaaaaggaggccagcagc

SEQ ID NO: 240559 - DNA, 25 bp, Mus musculus
tcaccgagtatcacgaaaaggaggc

SEQ ID NO: 240560 - DNA, 25 bp, Mus musculus
gtcagtgagatcaccgagtatcacg

SEQ ID NO: 240561 - DNA, 25 bp, Mus musculus
aatcacaccctaccgcgcctggctg

SEQ ID NO: 240562 - DNA, 25 bp, Mus musculus
ccgcattctccctgtggcgatgatg

SEQ ID NO: 240563 - DNA, 25 bp, Mus musculus
cgcagcctgccgtgcatgactccag

SEQ ID NO: 240564 - DNA, 25 bp, Mus musculus
gtgcatgactccagccgccgtcgcc

SEQ ID NO: 240565 - DNA, 25 bp, Mus musculus
gtcgcctggacaggcgctgcttctc

SEQ ID NO: 240566 - DNA, 25 bp, Mus musculus
agccgttgcttctcggtgttggcct

SEQ ID NO: 240567 - DNA, 25 bp, Mus musculus
ctcggtgttggcctcgtcccagcgt

SEQ ID NO: 240568 - DNA, 25 bp, Mus musculus
cattctccctgtggcgatgatgcgg

SEQ ID NO: 240569 - DNA, 25 bp, Mus musculus
tccataagccgctggtctggccgca

SEQ ID NO: 240570 - DNA, 25 bp, Mus musculus
acgccgtcctcctgctcgttgaggg

SEQ ID NO: 240571 - DNA, 25 bp, Mus musculus
tcctgctcgttgagggtcagggcta

SEQ ID NO: 240572 - DNA, 25 bp, Mus musculus
tcagggctagctcggagaaatagta

SEQ ID NO: 240573 - DNA, 25 bp, Mus musculus
tagctcggagaaatagtacatgttc

SEQ ID NO: 240574 - DNA, 25 bp, Mus musculus
catgttctccgcattctccctgtgg

SEQ ID NO: 240575 - DNA, 25 bp, Mus musculus
gaaatagtacatgttctccgcattc

SEQ ID NO: 240576 - DNA, 25 bp, Mus musculus
tgcggaccagcggaaaaccaaagag

SEQ ID NO: 240577 - DNA, 25 bp, Mus musculus
ggcttctaaaatgccggattaccta

SEQ ID NO: 240578 - DNA, 25 bp, Mus musculus
tgaacacgcgtttccttccaccaga

SEQ ID NO: 240579 - DNA, 25 bp, Mus musculus
ccttagatccgagcggtgaccgctc

SEQ ID NO: 240580 - DNA, 25 bp, Mus musculus
cctgccggccttagatccgagcggt

SEQ ID NO: 240581 - DNA, 25 bp, Mus musculus
tggcaccgcagaggcgcaggattcc

SEQ ID NO: 240582 - DNA, 25 bp, Mus musculus
gaggagaaggacgacaagcccatcc

SEQ ID NO: 240583 - DNA, 25 bp, Mus musculus
ccggattacctaggtgcggaccagc

SEQ ID NO: 240584 - DNA, 25 bp, Mus musculus
gcggaggcacttgcggcttctaaaa

SEQ ID NO: 240585 - DNA, 25 bp, Mus musculus
tgtgtaatcaccgagacgcggaggc

SEQ ID NO: 240586 - DNA, 25 bp, Mus musculus
agcgggaaaggtgctgtgtaatcac

SEQ ID NO: 240587 - DNA, 25 bp, Mus musculus
agaaagggaagacaccagcggaagc

SEQ ID NO: 240588 - DNA, 25 bp, Mus musculus
cagatgtccagggaaccggcgcccg

SEQ ID NO: 240589 - DNA, 25 bp, Mus musculus
caagcccatccgaggtgagaggaca

SEQ ID NO: 240590 - DNA, 25 bp, Mus musculus
cacgaagctacgagcgggccgcgct

SEQ ID NO: 240591 - DNA, 25 bp, Mus musculus
ccagcctcgcggaagctgaagtcca

SEQ ID NO: 240592 - DNA, 25 bp, Mus musculus
tcgaaaccagcctcgcggaagctga

SEQ ID NO: 240593 - DNA, 25 bp, Mus musculus
gaagctgaagtccagccatgcgctg

SEQ ID NO: 240594 - DNA, 25 bp, Mus musculus
ctgcacacacgaagctacgagcggg

SEQ ID NO: 240595 - DNA, 25 bp, Mus musculus
cacgcgcgcctcacctcgaaaccag

SEQ ID NO: 240596 - DNA, 25 bp, Mus musculus
acgcccgcctactttgcagccatcg

SEQ ID NO: 240597 - DNA, 25 bp, Mus musculus
cagccatcgaccctgcaaatattta

SEQ ID NO: 240598 - DNA, 25 bp, Mus musculus
tcgaccctgcaaatatttaccttgg

SEQ ID NO: 240599 - DNA, 25 bp, Mus musculus
tttaccttgggatccgagagactga

SEQ ID NO: 240600 - DNA, 25 bp, Mus musculus
cttgggatccgagagactgaaaata

SEQ ID NO: 240601 - DNA, 25 bp, Mus musculus
gactgaaaatatctagccggagcca

SEQ ID NO: 240602 - DNA, 25 bp, Mus musculus
tatctagccggagccagatgcgtcg

SEQ ID NO: 240603 - DNA, 25 bp, Mus musculus
gaagtccagccatgcgctgcacaca

SEQ ID NO: 240604 - DNA, 25 bp, Mus musculus
cgggtgcaaagcagctccgactcca

SEQ ID NO: 240605 - DNA, 25 bp, Mus musculus
gagtgcactgccttgtgttgctcca

SEQ ID NO: 240606 - DNA, 25 bp, Mus musculus
gcacatctcgcacgcaaagggtctt

SEQ ID NO: 240607 - DNA, 25 bp, Mus musculus
gcgagcctcaccttgctgcatttga

SEQ ID NO: 240608 - DNA, 25 bp, Mus musculus
ttgatgcatttgtaggagccgccgc

SEQ ID NO: 240609 - DNA, 25 bp, Mus musculus
ccatgatcttggtacagccggcctg

SEQ ID NO: 240610 - DNA, 25 bp, Mus musculus
gaccgctccatgcatagggcttgaa

SEQ ID NO: 240611 - DNA, 25 bp, Mus musculus
ttcgtccagagagcggcacagtgac

SEQ ID NO: 240612 - DNA, 25 bp, Mus musculus
acttctccgacgctgtgaaggcaca

SEQ ID NO: 240613 - DNA, 25 bp, Mus musculus
cacaggaggccattgagtcaagttc

SEQ ID NO: 240614 - DNA, 25 bp, Mus musculus
agcccgcagtgcaccatcactattg

SEQ ID NO: 240615 - DNA, 25 bp, Mus musculus
catcactattgtcaggcgccctagc

SEQ ID NO: 240616 - DNA, 25 bp, Mus musculus
agcgccgatcttacctgggagtgca

SEQ ID NO: 240617 - DNA, 25 bp, Mus musculus
tgccgatagctctgcaccaggtgcc

SEQ ID NO: 240618 - DNA, 25 bp, Mus musculus
aggggtcacaaacgctgccttcgca

SEQ ID NO: 240619 - DNA, 25 bp, Mus musculus
acgctcaccaggtggcactcggaca

SEQ ID NO: 240620 - DNA, 25 bp, Mus musculus
ttggaccctcggatactctgagttc

SEQ ID NO: 240621 - DNA, 25 bp, Mus musculus
cagccgctggacgaatgtttggacc

SEQ ID NO: 240622 - DNA, 25 bp, Mus musculus
ccttcttgctcttgaccaggaatga

SEQ ID NO: 240623 - DNA, 25 bp, Mus musculus
ggtgatagctgtgcgccttcttgct

SEQ ID NO: 240624 - DNA, 25 bp, Mus musculus
cgattcctaggaaacgaggtggctt

SEQ ID NO: 240625 - DNA, 25 bp, Mus musculus
aggggcatctctggcaagctcagca

SEQ ID NO: 240626 - DNA, 25 bp, Mus musculus
tcccgaattcaagagccgactgcga

SEQ ID NO: 240627 - DNA, 25 bp, Mus musculus
ctaaacctggccgaactgaagtggt

SEQ ID NO: 240628 - DNA, 25 bp, Mus musculus
cgccctctgcggaaaagattcagga

SEQ ID NO: 240629 - DNA, 25 bp, Mus musculus
gggctccattttcgactcgcctgca

SEQ ID NO: 240630 - DNA, 25 bp, Mus musculus
cactcggacaggtggcacgaatccc

SEQ ID NO: 240631 - DNA, 25 bp, Mus musculus
ggacaaacgctctcggggctccatt

SEQ ID NO: 240632 - DNA, 25 bp, Mus musculus
gcagttcagcaaacctaccttcggg

SEQ ID NO: 240633 - DNA, 25 bp, Mus musculus
ggtatccttgccaactccttgggca

SEQ ID NO: 240634 - DNA, 25 bp, Mus musculus
ccaatttgtttgtctgtgggatcgc

SEQ ID NO: 240635 - DNA, 25 bp, Mus musculus
gccacgagcctcctttgcgcaaggg

SEQ ID NO: 240636 - DNA, 25 bp, Mus musculus
acttcacttcctgagcgttagaggc

SEQ ID NO: 240637 - DNA, 25 bp, Mus musculus
tgctttcgggagagactgatctgtc

SEQ ID NO: 240638 - DNA, 25 bp, Mus musculus
gctctgagagtgtgcaaactgaatc

SEQ ID NO: 240639 - DNA, 25 bp, Mus musculus
tctgctatctaaccgctaaactgtg

SEQ ID NO: 240640 - DNA, 25 bp, Mus musculus
atgttttcttcctgcgtggatccca

SEQ ID NO: 240641 - DNA, 25 bp, Mus musculus
cctggtcatctgaggctggaaattc

SEQ ID NO: 240642 - DNA, 25 bp, Mus musculus
aggccacaaacctacgcttcggagg

SEQ ID NO: 240643 - DNA, 25 bp, Mus musculus
ttcggtcctgcgatagccaagaacg

SEQ ID NO: 240644 - DNA, 25 bp, Mus musculus
gcaagagttctggaggcctcgatga

SEQ ID NO: 240645 - DNA, 25 bp, Mus musculus
aatgtactcctaccagtcctcgagg

SEQ ID NO: 240646 - DNA, 25 bp, Mus musculus
agccctcggccatgcaaactgctga

SEQ ID NO: 240647 - DNA, 25 bp, Mus musculus
aactgctgacttcccagtctctcga

SEQ ID NO: 240648 - DNA, 25 bp, Mus musculus
ccagaacttttgcttcgctctttgg

SEQ ID NO: 240649 - DNA, 25 bp, Mus musculus
cgctctttggtgaaaagacctaagg

SEQ ID NO: 240650 - DNA, 25 bp, Mus musculus
gcaaccgggtgcacaggagctccgt

SEQ ID NO: 240651 - DNA, 25 bp, Mus musculus
aggccgaatggagacgccaactttc

SEQ ID NO: 240652 - DNA, 25 bp, Mus musculus
gccaactttccgagcagggcgcggc

SEQ ID NO: 240653 - DNA, 25 bp, Mus musculus
ggactccgccgtcaacatgaacttc

SEQ ID NO: 240654 - DNA, 25 bp, Mus musculus
atgaacttcccatgcagccggcggc

SEQ ID NO: 240655 - DNA, 25 bp, Mus musculus
ggtcgggccgcttcacgaaagccca

SEQ ID NO: 240656 - DNA, 25 bp, Mus musculus
ccggccggcctctacggcataatgg

SEQ ID NO: 240657 - DNA, 25 bp, Mus musculus
cggcataatgggttcgagcaggtta

SEQ ID NO: 240658 - DNA, 25 bp, Mus musculus
agccgaagcagaagccgaagggatt

SEQ ID NO: 240659 - DNA, 25 bp, Mus musculus
tggccagtcagggaagcacaagaca

SEQ ID NO: 240660 - DNA, 25 bp, Mus musculus
gcagatggcattcgattcccggctc

SEQ ID NO: 240661 - DNA, 25 bp, Mus musculus
gaggccgtgccacggaagcccgaat

SEQ ID NO: 240662 - DNA, 25 bp, Mus musculus
gatagcccgcgcatcttgaggccta

SEQ ID NO: 240663 - DNA, 25 bp, Mus musculus
ttgaggcctacagccactctttctc

SEQ ID NO: 240664 - DNA, 25 bp, Mus musculus
ttctcacgtcgcttgcgtgctggtg

SEQ ID NO: 240665 - DNA, 25 bp, Mus musculus
tggtgctacatactgcgcatgcgta

SEQ ID NO: 240666 - DNA, 25 bp, Mus musculus
tgcgtacgtgactccggtctttttc

SEQ ID NO: 240667 - DNA, 25 bp, Mus musculus
ttagcgcggccgactctgcaggtct

SEQ ID NO: 240668 - DNA, 25 bp, Mus musculus
cgcggttgcgggtctctattccgca

SEQ ID NO: 240669 - DNA, 25 bp, Mus musculus
tctctattccgcaggatggtgagtg

SEQ ID NO: 240670 - DNA, 25 bp, Mus musculus
ccgttccagcgtggcctaatggctg

SEQ ID NO: 240671 - DNA, 25 bp, Mus musculus
tgctcgggacgaggcttccgagtcc

SEQ ID NO: 240672 - DNA, 25 bp, Mus musculus
agtccggctgccagccgcagttgtc

SEQ ID NO: 240673 - DNA, 25 bp, Mus musculus
cagagccctgaagccgggagtgtct

SEQ ID NO: 240674 - DNA, 25 bp, Mus musculus
agcgcccacttcactgtgaggcttg

SEQ ID NO: 240675 - DNA, 25 bp, Mus musculus
taaaggggagtcgagcctcgcgtcc

SEQ ID NO: 240676 - DNA, 25 bp, Mus musculus
cgccataaaggggagtcgagcctcg

SEQ ID NO: 240677 - DNA, 25 bp, Mus musculus
cgcagagactcctcgccatggcact

SEQ ID NO: 240678 - DNA, 25 bp, Mus musculus
ggaggtaatggggtttcctcagcca

SEQ ID NO: 240679 - DNA, 25 bp, Mus musculus
ctgcgcctccgtgcttaaaggggag

SEQ ID NO: 240680 - DNA, 25 bp, Mus musculus
ccgtggagcgcccacttcactgtga

SEQ ID NO: 240681 - DNA, 25 bp, Mus musculus
cacttcactgtgaggcttgcggctt

SEQ ID NO: 240682 - DNA, 25 bp, Mus musculus
tcactgtgaggcttgcggcttcacg

SEQ ID NO: 240683 - DNA, 25 bp, Mus musculus
gcttgcggcttcacgcgcggagtcc

SEQ ID NO: 240684 - DNA, 25 bp, Mus musculus
cgtccgcgctctggacctgtgcgag

SEQ ID NO: 240685 - DNA, 25 bp, Mus musculus
ctggacctgtgcgagcggattgcac

SEQ ID NO: 240686 - DNA, 25 bp, Mus musculus
gcgtccgccgacacaaatccgcctg

SEQ ID NO: 240687 - DNA, 25 bp, Mus musculus
caaaacgtgggctccgtggagcgcc

SEQ ID NO: 240688 - DNA, 25 bp, Mus musculus
gaagcgctgcgctcactattgtgtc

SEQ ID NO: 240689 - DNA, 25 bp, Mus musculus
gtgagcacgcacattctccttccta

SEQ ID NO: 240690 - DNA, 25 bp, Mus musculus
ctgttgcgaagtggtctgtgtttga

SEQ ID NO: 240691 - DNA, 25 bp, Mus musculus
tgcaccgctagtccgcgggaaacca

SEQ ID NO: 240692 - DNA, 25 bp, Mus musculus
cagaatgcaccgctagtccgcggga

SEQ ID NO: 240693 - DNA, 25 bp, Mus musculus
ggagtagctccgcgctcccagaatg

SEQ ID NO: 240694 - DNA, 25 bp, Mus musculus
gctctggagagctgccattcggccc

SEQ ID NO: 240695 - DNA, 25 bp, Mus musculus
ttgttcagcgctggtccgggacgca

SEQ ID NO: 240696 - DNA, 25 bp, Mus musculus
agagtccctctttgttcagcgctgg

SEQ ID NO: 240697 - DNA, 25 bp, Mus musculus
caccgcgacgttaaagagtccctct

SEQ ID NO: 240698 - DNA, 25 bp, Mus musculus
agaggacttaattccaccgcgacgt

SEQ ID NO: 240699 - DNA, 25 bp, Mus musculus
caccggcagcaagaggacttaattc

SEQ ID NO: 240700 - DNA, 25 bp, Mus musculus
tctgcaccggcagcaagaggactta

SEQ ID NO: 240701 - DNA, 25 bp, Mus musculus
gctcactattgtgtctgcaccggca

SEQ ID NO: 240702 - DNA, 25 bp, Mus musculus
actggtgtctccgatttgaaatccc

SEQ ID NO: 240703 - DNA, 25 bp, Mus musculus
cgctggttctcctcatcgagagtca

SEQ ID NO: 240704 - DNA, 25 bp, Mus musculus
gcttccagactcatttcccggcatg

SEQ ID NO: 240705 - DNA, 25 bp, Mus musculus
caccagacttgtcggtttcggcttc

SEQ ID NO: 240706 - DNA, 25 bp, Mus musculus
cggcgagcctcactctcttggaagg

SEQ ID NO: 240707 - DNA, 25 bp, Mus musculus
atccctgtcgatctctgcctggacg

SEQ ID NO: 240708 - DNA, 25 bp, Mus musculus
ggccggcagcgtgaaggtaaaatca

SEQ ID NO: 240709 - DNA, 25 bp, Mus musculus
ggctggtagaaacactccttccggc

SEQ ID NO: 240710 - DNA, 25 bp, Mus musculus
tcgatctccaacgatgccttcaggg

SEQ ID NO: 240711 - DNA, 25 bp, Mus musculus
gaaggctagcccacttccgcactta

SEQ ID NO: 240712 - DNA, 25 bp, Mus musculus
gtcgctgtcccaccttttccaagta

SEQ ID NO: 240713 - DNA, 25 bp, Mus musculus
tcctcggattcacctcggtcgctgt

SEQ ID NO: 240714 - DNA, 25 bp, Mus musculus
gccaagcaggccagtttcccaggag

SEQ ID NO: 240715 - DNA, 25 bp, Mus musculus
ctgggtttcgcatccttccttcaca

SEQ ID NO: 240716 - DNA, 25 bp, Mus musculus
cagcgcggtcctgtctcgttggtac

SEQ ID NO: 240717 - DNA, 25 bp, Mus musculus
gtcagcactgccctagaccttcagt

SEQ ID NO: 240718 - DNA, 25 bp, Mus musculus
tagaccttcagtcagggtacagatc

SEQ ID NO: 240719 - DNA, 25 bp, Mus musculus
gggtacagatcacctcgcccactag

SEQ ID NO: 240720 - DNA, 25 bp, Mus musculus
aggctgtcctgcgtgctgttcccac

SEQ ID NO: 240721 - DNA, 25 bp, Mus musculus
actccagcgggaagagggatcgcac

SEQ ID NO: 240722 - DNA, 25 bp, Mus musculus
gggatcgcacttcctcagaaggcta

SEQ ID NO: 240723 - DNA, 25 bp, Mus musculus
cagaaggctagaggtccctccctca

SEQ ID NO: 240724 - DNA, 25 bp, Mus musculus
gcttgtttctaaggcgctgagccct

SEQ ID NO: 240725 - DNA, 25 bp, Mus musculus
ttcacctttccggagcccggcatgg

SEQ ID NO: 240726 - DNA, 25 bp, Mus musculus
ccggcatggtgctggcaacgcctct

SEQ ID NO: 240727 - DNA, 25 bp, Mus musculus
ctctcatcgcctcgttttaaaaata

SEQ ID NO: 240728 - DNA, 25 bp, Mus musculus
gccttgcgaactcgcgtcagcactg

SEQ ID NO: 240729 - DNA, 25 bp, Mus musculus
cacacctccgcaataaaggcgcggg

SEQ ID NO: 240730 - DNA, 25 bp, Mus musculus
acacggaaatccatcgaggagggcg

SEQ ID NO: 240731 - DNA, 25 bp, Mus musculus
ggagttcgacttccggtggcgcaaa

SEQ ID NO: 240732 - DNA, 25 bp, Mus musculus
cggggcgtgcacacggaaatccatc

SEQ ID NO: 240733 - DNA, 25 bp, Mus musculus
gttcggttagacgacagcgccagtc

SEQ ID NO: 240734 - DNA, 25 bp, Mus musculus
ccgggatcagcttgcggcaaacctc

SEQ ID NO: 240735 - DNA, 25 bp, Mus musculus
cagcgccagtccgtttgaggcgaca

SEQ ID NO: 240736 - DNA, 25 bp, Mus musculus
gtgcgctcccgtgccgtttaggttc

SEQ ID NO: 240737 - DNA, 25 bp, Mus musculus
ggtattcctctgtcttgcgtgcgct

SEQ ID NO: 240738 - DNA, 25 bp, Mus musculus
tagagctgaccctgctcagtgtccg

SEQ ID NO: 240739 - DNA, 25 bp, Mus musculus
ctgcggcttcggcagacatgttgtg

SEQ ID NO: 240740 - DNA, 25 bp, Mus musculus
ccggtccacttggtttcccaggcag

SEQ ID NO: 240741 - DNA, 25 bp, Mus musculus
cggcccgtagagagaccaccgttag

SEQ ID NO: 240742 - DNA, 25 bp, Mus musculus
gggctccggctctgtagagctgacc

SEQ ID NO: 240743 - DNA, 25 bp, Mus musculus
ttctgcccgcagagcaagcgagctc

SEQ ID NO: 240744 - DNA, 25 bp, Mus musculus
cccgcaatgtgcagggaaatgagca

SEQ ID NO: 240745 - DNA, 25 bp, Mus musculus
gggaaatgagcacctcgccctgctc

SEQ ID NO: 240746 - DNA, 25 bp, Mus musculus
cagcacggccaggacgagagcccgc

SEQ ID NO: 240747 - DNA, 25 bp, Mus musculus
gcgctctctcatccactttcggagg

SEQ ID NO: 240748 - DNA, 25 bp, Mus musculus
gcttgtcctggggaccctcccgtca

SEQ ID NO: 240749 - DNA, 25 bp, Mus musculus
atccactttcggaggcaccggcacg

SEQ ID NO: 240750 - DNA, 25 bp, Mus musculus
tccccgtggtgggtgcacaggaaaa

SEQ ID NO: 240751 - DNA, 25 bp, Mus musculus
cacctcgggctgtgcccggagcaca

SEQ ID NO: 240752 - DNA, 25 bp, Mus musculus
ctgctcggccgctgcgcgaacgaga

SEQ ID NO: 240753 - DNA, 25 bp, Mus musculus
gggctcacggctgcccgttctgcga

SEQ ID NO: 240754 - DNA, 25 bp, Mus musculus
gggaccgcgctgttctttgtctacg

SEQ ID NO: 240755 - DNA, 25 bp, Mus musculus
cgctgttctttgtctacgccggctg

SEQ ID NO: 240756 - DNA, 25 bp, Mus musculus
gttctttgtctacgccggctgcaac

SEQ ID NO: 240757 - DNA, 25 bp, Mus musculus
gaagttagcgggagaccgaggctcc

SEQ ID NO: 240758 - DNA, 25 bp, Mus musculus
ggcgcacaaacttggaatcctgaga

SEQ ID NO: 240759 - DNA, 25 bp, Mus musculus
cgcctggctcaaggcgcacaaactt

SEQ ID NO: 240760 - DNA, 25 bp, Mus musculus
cagctgcgtagcgattgaggtgatc

SEQ ID NO: 240761 - DNA, 25 bp, Mus musculus
gctgttacactaagtttcgggccga

SEQ ID NO: 240762 - DNA, 25 bp, Mus musculus
tgcgggtttgcaacgcccgctgtta

SEQ ID NO: 240763 - DNA, 25 bp, Mus musculus
gggcactcgccactctgacgtactt

SEQ ID NO: 240764 - DNA, 25 bp, Mus musculus
ctcccgaatggatcagccggggatt

SEQ ID NO: 240765 - DNA, 25 bp, Mus musculus
ggcaccggaagcgaggctcccgaat

SEQ ID NO: 240766 - DNA, 25 bp, Mus musculus
gcagcgctagatgcgcctggctcaa

SEQ ID NO: 240767 - DNA, 25 bp, Mus musculus
tcggggattcttcccagctcctgtt

SEQ ID NO: 240768 - DNA, 25 bp, Mus musculus
gcgcccgaacccgtagcaggtatag

SEQ ID NO: 240769 - DNA, 25 bp, Mus musculus
gctagaccagagcacgatgcagaga

SEQ ID NO: 240770 - DNA, 25 bp, Mus musculus
agctcctgttcgttcctctgctaga

SEQ ID NO: 240771 - DNA, 25 bp, Mus musculus
cgcgatatttattcggggattcttc

SEQ ID NO: 240772 - DNA, 25 bp, Mus musculus
tgaagtcggactcctccggggatag

SEQ ID NO: 240773 - DNA, 25 bp, Mus musculus
cccgcgtttctccaggagagggctc

SEQ ID NO: 240774 - DNA, 25 bp, Mus musculus
agcaggttttggctgttcaccggtc

SEQ ID NO: 240775 - DNA, 25 bp, Mus musculus
aggacgcctaggagcagcaggtttt

SEQ ID NO: 240776 - DNA, 25 bp, Mus musculus
ccaagcatgaagaccaggacgccta

SEQ ID NO: 240777 - DNA, 25 bp, Mus musculus
cactgctcccgcaaaggcgctgaga

SEQ ID NO: 240778 - DNA, 25 bp, Mus musculus
gagtacttgcgttccaccagggaca

SEQ ID NO: 240779 - DNA, 25 bp, Mus musculus
cctggggctacagagccagtgccct

SEQ ID NO: 240780 - DNA, 25 bp, Mus musculus
gtagtctttcaactggcggcatttg

SEQ ID NO: 240781 - DNA, 25 bp, Mus musculus
ccaggccgcgctggtagtctttcaa

SEQ ID NO: 240782 - DNA, 25 bp, Mus musculus
ttgaatacagtagagagcaccaggc

SEQ ID NO: 240783 - DNA, 25 bp, Mus musculus
cccagcaggcactcgagcgagttga

SEQ ID NO: 240784 - DNA, 25 bp, Mus musculus
tagttcttgaccagcaggaggctga

SEQ ID NO: 240785 - DNA, 25 bp, Mus musculus
tcggagcccagtgagaagcacttga

SEQ ID NO: 240786 - DNA, 25 bp, Mus musculus
accttcgcgccggaagctcaactga

SEQ ID NO: 240787 - DNA, 25 bp, Mus musculus
cattatagtagaaggcacaccgagg

SEQ ID NO: 240788 - DNA, 25 bp, Mus musculus
acaccgagggaacaaggggatcgca

SEQ ID NO: 240789 - DNA, 25 bp, Mus musculus
ccgggattgctcgagaccacagcca

SEQ ID NO: 240790 - DNA, 25 bp, Mus musculus
cacagccagcagtcccaagggtggg

SEQ ID NO: 240791 - DNA, 25 bp, Mus musculus
aggagctttgagcaccgcgcaacaa

SEQ ID NO: 240792 - DNA, 25 bp, Mus musculus
cgcaacaacggggatgaggattcac

SEQ ID NO: 240793 - DNA, 25 bp, Mus musculus
gggcaccattttgtccgtgaccttc

SEQ ID NO: 240794 - DNA, 25 bp, Mus musculus
tgaaagccgcctcctgaagccagaa

SEQ ID NO: 240795 - DNA, 25 bp, Mus musculus
atgcgccgcagtgaaagcgctgccc

SEQ ID NO: 240796 - DNA, 25 bp, Mus musculus
gtaccggccgaactgcagaagaaaa

SEQ ID NO: 240797 - DNA, 25 bp, Mus musculus
cttgatgagtggagagacctgaacc

SEQ ID NO: 240798 - DNA, 25 bp, Mus musculus
gcgccgtatgccatgccgatgatca

SEQ ID NO: 240799 - DNA, 25 bp, Mus musculus
aaactcactgtagcgcttggcgccg

SEQ ID NO: 240800 - DNA, 25 bp, Mus musculus
ggaggctgaccaccagcagaaagac

SEQ ID NO: 240801 - DNA, 25 bp, Mus musculus
tgtgaccgcacgaaaacagtcttgc

SEQ ID NO: 240802 - DNA, 25 bp, Mus musculus
ggcgctgaggctgctacaaagaccc

SEQ ID NO: 240803 - DNA, 25 bp, Mus musculus
agcacccttgtaccatcgcattgga

SEQ ID NO: 240804 - DNA, 25 bp, Mus musculus
gagcagctcaggaggctgaccacca

SEQ ID NO: 240805 - DNA, 25 bp, Mus musculus
gcagaaagacccagcgacgcgcata

SEQ ID NO: 240806 - DNA, 25 bp, Mus musculus
gacgcgcatacactcggggactagg

SEQ ID NO: 240807 - DNA, 25 bp, Mus musculus
atacactcggggactaggcaacgcg

SEQ ID NO: 240808 - DNA, 25 bp, Mus musculus
actaggcaacgcgtctccggcggtc

SEQ ID NO: 240809 - DNA, 25 bp, Mus musculus
ctccggcggtcccagatgtttccgg

SEQ ID NO: 240810 - DNA, 25 bp, Mus musculus
atgtttccgggctgttgcagtcttc

SEQ ID NO: 240811 - DNA, 25 bp, Mus musculus
tgcagtcttccagcctatccatagt

SEQ ID NO: 240812 - DNA, 25 bp, Mus musculus
atagtcccggccatgccagtgtccg

SEQ ID NO: 240813 - DNA, 25 bp, Mus musculus
accatcgcattggagcagctcagga

SEQ ID NO: 240814 - DNA, 25 bp, Mus musculus
caggacttctcgcaggtctggaccc

SEQ ID NO: 240815 - DNA, 25 bp, Mus musculus
cggtttcgttcctaactcatgcagt

SEQ ID NO: 240816 - DNA, 25 bp, Mus musculus
cgtggtctagatactccggtttcgt

SEQ ID NO: 240817 - DNA, 25 bp, Mus musculus
cgcgtcctgaacaacccggcggagt

SEQ ID NO: 240818 - DNA, 25 bp, Mus musculus
tctccaggtagtgcttctgaccacg

SEQ ID NO: 240819 - DNA, 25 bp, Mus musculus
gtcaattgctgcctgcacgcgcctg

SEQ ID NO: 240820 - DNA, 25 bp, Mus musculus
cccgcctctctcgtttgcgaggtgg

SEQ ID NO: 240821 - DNA, 25 bp, Mus musculus
gggagctgagccacacactgcgcat

SEQ ID NO: 240822 - DNA, 25 bp, Mus musculus
ctgggttcgggcatttccgcctctt

SEQ ID NO: 240823 - DNA, 25 bp, Mus musculus
aactctgcacggcttttttctcctc

SEQ ID NO: 240824 - DNA, 25 bp, Mus musculus
tggcctggtctgttcgcccgatcct

SEQ ID NO: 240825 - DNA, 25 bp, Mus musculus
cgggaccctaaaagcctgcgagaag

SEQ ID NO: 240826 - DNA, 25 bp, Mus musculus
agcctgcgagaaggccaggacttct

SEQ ID NO: 240827 - DNA, 25 bp, Mus musculus
actcatgcagttgcctgtcagcgcg

SEQ ID NO: 240828 - DNA, 25 bp, Mus musculus
cttccaaggtggacgatcaacagca

SEQ ID NO: 240829 - DNA, 25 bp, Mus musculus
cggagattccgcaaagaccaaggca

SEQ ID NO: 240830 - DNA, 25 bp, Mus musculus
aagaccaaggcatcccgttctctcg

SEQ ID NO: 240831 - DNA, 25 bp, Mus musculus
ccgcaccctttgctttgctgggcga

SEQ ID NO: 240832 - DNA, 25 bp, Mus musculus
ggccgtttcagcacctcacgatgga

SEQ ID NO: 240833 - DNA, 25 bp, Mus musculus
tcacgatggacagcgcctttcaggc

SEQ ID NO: 240834 - DNA, 25 bp, Mus musculus
ctttcaggctgagcaaccttgggtc

SEQ ID NO: 240835 - DNA, 25 bp, Mus musculus
cgatcaacagcagcgcgctctcagg

SEQ ID NO: 240836 - DNA, 25 bp, Mus musculus
ctgagcaaccttgggtctgaaagac

SEQ ID NO: 240837 - DNA, 25 bp, Mus musculus
tctgaaagacaaggaaccaagagta

SEQ ID NO: 240838 - DNA, 25 bp, Mus musculus
ccaagagtaggggaacctaggatat

SEQ ID NO: 240839 - DNA, 25 bp, Mus musculus
cctaggatatgggtaggagacccac

SEQ ID NO: 240840 - DNA, 25 bp, Mus musculus
ccagctgtagagaggctaggacgct

SEQ ID NO: 240841 - DNA, 25 bp, Mus musculus
gacccacggctagaaagcggggatc

SEQ ID NO: 240842 - DNA, 25 bp, Mus musculus
tgtctgccccacgaagtcactctga

SEQ ID NO: 240843 - DNA, 25 bp, Mus musculus
cagctccgcactgccgggttagcag

SEQ ID NO: 240844 - DNA, 25 bp, Mus musculus
tgcgggcgaacaacccggccatctt

SEQ ID NO: 240845 - DNA, 25 bp, Mus musculus
cgccgtgacgtaaatcagagagcga

SEQ ID NO: 240846 - DNA, 25 bp, Mus musculus
atcagagagcgagttgcgtcccgac

SEQ ID NO: 240847 - DNA, 25 bp, Mus musculus
ggcgcgtgtttctgcagagccagca

SEQ ID NO: 240848 - DNA, 25 bp, Mus musculus
agagggtgcgatcctacggacctca

SEQ ID NO: 240849 - DNA, 25 bp, Mus musculus
tacggacctcaagctcctaggaggc

SEQ ID NO: 240850 - DNA, 25 bp, Mus musculus
caagctcctaggaggcacggaggta

SEQ ID NO: 240851 - DNA, 25 bp, Mus musculus
agggctgtcgccatctgaccctaac

SEQ ID NO: 240852 - DNA, 25 bp, Mus musculus
ccgccaggaagtccagcgcagactg

SEQ ID NO: 240853 - DNA, 25 bp, Mus musculus
cgcgcctgacgcctcaaggtaaagc

SEQ ID NO: 240854 - DNA, 25 bp, Mus musculus
ggcccaggtccagcctaggtggcta

SEQ ID NO: 240855 - DNA, 25 bp, Mus musculus
tgaccctaacctcatctggttgctt

SEQ ID NO: 240856 - DNA, 25 bp, Mus musculus
cacaggatactagatatatgaggcc

SEQ ID NO: 240857 - DNA, 25 bp, Mus musculus
gtgggacttccacaagctcctttaa

SEQ ID NO: 240858 - DNA, 25 bp, Mus musculus
agatgcccagcactggactgccggc

SEQ ID NO: 240859 - DNA, 25 bp, Mus musculus
ggctgccaagacgtggggaaccact

SEQ ID NO: 240860 - DNA, 25 bp, Mus musculus
tccaagcgcacgataaagccaggtc

SEQ ID NO: 240861 - DNA, 25 bp, Mus musculus
acgataaagccaggtccgcggtgta

SEQ ID NO: 240862 - DNA, 25 bp, Mus musculus
ctacctaacgcgcaggctcacgtgg

SEQ ID NO: 240863 - DNA, 25 bp, Mus musculus
caaaggcggggcctctggactagac

SEQ ID NO: 240864 - DNA, 25 bp, Mus musculus
cctctggactagacagaggggcatg

SEQ ID NO: 240865 - DNA, 25 bp, Mus musculus
catggtggcccaagaggatttgttc

SEQ ID NO: 240866 - DNA, 25 bp, Mus musculus
ggatttgttctgacctccagcgcca

SEQ ID NO: 240867 - DNA, 25 bp, Mus musculus
tgaggcctttgctcgtataagcata

SEQ ID NO: 240868 - DNA, 25 bp, Mus musculus
atatggaaacattcagtgggacttc

SEQ ID NO: 240869 - DNA, 25 bp, Mus musculus
agcgccagattctccacacaggata

SEQ ID NO: 240870 - DNA, 25 bp, Mus musculus
gttacaccgagagggtctgagagct

SEQ ID NO: 240871 - DNA, 25 bp, Mus musculus
gccctcgggcctggacgtaagccag

SEQ ID NO: 240872 - DNA, 25 bp, Mus musculus
acgagcgtgacctgggcgcacagaa

SEQ ID NO: 240873 - DNA, 25 bp, Mus musculus
agcacgagcgtgacctgggcgcaca

SEQ ID NO: 240874 - DNA, 25 bp, Mus musculus
ccgaggggatggtctcaggctgtct

SEQ ID NO: 240875 - DNA, 25 bp, Mus musculus
cacagtgagcactagggtcgggccc

SEQ ID NO: 240876 - DNA, 25 bp, Mus musculus
ctagccccggcgactgagcacagtg

SEQ ID NO: 240877 - DNA, 25 bp, Mus musculus
atccgagtacgctcgaggaccgcga

SEQ ID NO: 240878 - DNA, 25 bp, Mus musculus
cgtcgccgctggaaagtttgcgagc

SEQ ID NO: 240879 - DNA, 25 bp, Mus musculus
cagcgtcgccgctggaaagtttgcg

SEQ ID NO: 240880 - DNA, 25 bp, Mus musculus
tgcaggtccgctgcactaaggcgcg

SEQ ID NO: 240881 - DNA, 25 bp, Mus musculus
gctcgctgcaggtccgctgcactaa

SEQ ID NO: 240882 - DNA, 25 bp, Mus musculus
cgggcctggacgtaagccagctgtc

SEQ ID NO: 240883 - DNA, 25 bp, Mus musculus
tctgagagctcgctgcaggtccgct

SEQ ID NO: 240884 - DNA, 25 bp, Mus musculus
ggggcacctggatatcccaaccatg

SEQ ID NO: 240885 - DNA, 25 bp, Mus musculus
gcgcgtgactgggttcctttttgtc

SEQ ID NO: 240886 - DNA, 25 bp, Mus musculus
ttgtcccggcctggcgagaggtcac

SEQ ID NO: 240887 - DNA, 25 bp, Mus musculus
gcgttacgcagaggcggaacactgc

SEQ ID NO: 240888 - DNA, 25 bp, Mus musculus
ggaacactgcgaccgccgcctaaaa

SEQ ID NO: 240889 - DNA, 25 bp, Mus musculus
gcgcccttggcgctggctgagtcac

SEQ ID NO: 240890 - DNA, 25 bp, Mus musculus
aaagcttgctgtttaggggcacctg

SEQ ID NO: 240891 - DNA, 25 bp, Mus musculus
gtccctcctcagctatgctgacgtt

SEQ ID NO: 240892 - DNA, 25 bp, Mus musculus
tcagctatgctgacgttttttgctg

SEQ ID NO: 240893 - DNA, 25 bp, Mus musculus
ttttttgctgcgttcttggccgcgc

SEQ ID NO: 240894 - DNA, 25 bp, Mus musculus
gacgcagcggaactcgccagcacgg

SEQ ID NO: 240895 - DNA, 25 bp, Mus musculus
ccgccgcctaaaaagcttgctgttt

SEQ ID NO: 240896 - DNA, 25 bp, Mus musculus
ctggctgagtcaccgtacctggtgc

SEQ ID NO: 240897 - DNA, 25 bp, Mus musculus
accgtacctggtgcgtgtggacgca

SEQ ID NO: 240898 - DNA, 25 bp, Mus musculus
ttggcatcccgcatagtcaggcgtc

SEQ ID NO: 240899 - DNA, 25 bp, Mus musculus
tcccgcatagtcaggcgtctgtaga

SEQ ID NO: 240900 - DNA, 25 bp, Mus musculus
agcgttctgagtgcacggctacctc

SEQ ID NO: 240901 - DNA, 25 bp, Mus musculus
gcgttttcttgtctgcctcagccct

SEQ ID NO: 240902 - DNA, 25 bp, Mus musculus
cccaagcgttctgagtgcacggcta

SEQ ID NO: 240903 - DNA, 25 bp, Mus musculus
agacaccaagcgtttccgcactaca

SEQ ID NO: 240904 - DNA, 25 bp, Mus musculus
tgtggcctcatcctctaagctcacg

SEQ ID NO: 240905 - DNA, 25 bp, Mus musculus
gctgtggcctcatcctctaagctca

SEQ ID NO: 240906 - DNA, 25 bp, Mus musculus
tcaggcgtctgtagaccgcgttttc

SEQ ID NO: 240907 - DNA, 25 bp, Mus musculus
ggcgtctgtagaccgcgttttcttg

SEQ ID NO: 240908 - DNA, 25 bp, Mus musculus
accgcgttttcttgtctgcctcagc

SEQ ID NO: 240909 - DNA, 25 bp, Mus musculus
cgagagacaccaagcgtttccgcac

SEQ ID NO: 240910 - DNA, 25 bp, Mus musculus
cctctaagctcacgcgctccgcctc

SEQ ID NO: 240911 - DNA, 25 bp, Mus musculus
cctcccaagcgttctgagtgcacgg

SEQ ID NO: 240912 - DNA, 25 bp, Mus musculus
ccgccgctctcaggctatggaggag

SEQ ID NO: 240913 - DNA, 25 bp, Mus musculus
cgtgaactaggcaggctcgagactg

SEQ ID NO: 240914 - DNA, 25 bp, Mus musculus
tcgagactgcctcggccagagccga

SEQ ID NO: 240915 - DNA, 25 bp, Mus musculus
agccgagccgcgaagcagaaactta

SEQ ID NO: 240916 - DNA, 25 bp, Mus musculus
atctgcaggtcttcctctgtcgcgg

SEQ ID NO: 240917 - DNA, 25 bp, Mus musculus
agcgggtgacctctcgggtccactc

SEQ ID NO: 240918 - DNA, 25 bp, Mus musculus
cttcctgccacaggaagttggggtg

SEQ ID NO: 240919 - DNA, 25 bp, Mus musculus
tttcagccgcaaacctgaagcggcc

SEQ ID NO: 240920 - DNA, 25 bp, Mus musculus
aacaggtgccctgagacccgaactc

SEQ ID NO: 240921 - DNA, 25 bp, Mus musculus
cgacccggaagctttttcagccgca

SEQ ID NO: 240922 - DNA, 25 bp, Mus musculus
cgaagtggcacggaccggcacgaac

SEQ ID NO: 240923 - DNA, 25 bp, Mus musculus
ccttgctatagctagcgtcgggctc

SEQ ID NO: 240924 - DNA, 25 bp, Mus musculus
gctcgctcaagtccagcgcatggtc

SEQ ID NO: 240925 - DNA, 25 bp, Mus musculus
ttggtgacaatccaggggcttcctg

SEQ ID NO: 240926 - DNA, 25 bp, Mus musculus
aggggaattgcaacgcacgccgctc

SEQ ID NO: 240927 - DNA, 25 bp, Mus musculus
ttcgggctcttccactactgcatcg

SEQ ID NO: 240928 - DNA, 25 bp, Mus musculus
atgatgctcatcatcgcctgcatcg

SEQ ID NO: 240929 - DNA, 25 bp, Mus musculus
atcggcctctccatgatgctcatca

SEQ ID NO: 240930 - DNA, 25 bp, Mus musculus
caggggtagcttcacggacttctcc

SEQ ID NO: 240931 - DNA, 25 bp, Mus musculus
agcgagggtgcagactctagaactg

SEQ ID NO: 240932 - DNA, 25 bp, Mus musculus
catctgctttgccatcgtcaatgtg

SEQ ID NO: 240933 - DNA, 25 bp, Mus musculus
tcaatgtggtgtgcttcatccagcc

SEQ ID NO: 240934 - DNA, 25 bp, Mus musculus
agccctactggatcggcgacggcgt

SEQ ID NO: 240935 - DNA, 25 bp, Mus musculus
cacgccgctcgctcggcgagtgtgt

SEQ ID NO: 240936 - DNA, 25 bp, Mus musculus
cgcaagccggctatttcgggctctt

SEQ ID NO: 240937 - DNA, 25 bp, Mus musculus
gactctagaactggtgctgctgggc

SEQ ID NO: 240938 - DNA, 25 bp, Mus musculus
gcaacggcttctcccgggagctgac

SEQ ID NO: 240939 - DNA, 25 bp, Mus musculus
cgagtgtgtctcctgcgcgccgaga

SEQ ID NO: 240940 - DNA, 25 bp, Mus musculus
cactgcgagggttaagcagcgagcc

SEQ ID NO: 240941 - DNA, 25 bp, Mus musculus
cgtgtgcggattggagcaaagtttc

SEQ ID NO: 240942 - DNA, 25 bp, Mus musculus
aagcctcgccgtttatccgcgcgga

SEQ ID NO: 240943 - DNA, 25 bp, Mus musculus
agcgatgaccgcgtcgcgctgctca

SEQ ID NO: 240944 - DNA, 25 bp, Mus musculus
cccagcgcaaatttgtccgctaatg

SEQ ID NO: 240945 - DNA, 25 bp, Mus musculus
ccgctaatggcgcaggcgattatct

SEQ ID NO: 240946 - DNA, 25 bp, Mus musculus
cccgagttacaagcgccaggaatcc

SEQ ID NO: 240947 - DNA, 25 bp, Mus musculus
ccaggaatccagacggtgtttggaa

SEQ ID NO: 240948 - DNA, 25 bp, Mus musculus
agtgtaaaccctttgtctgcctttg

SEQ ID NO: 240949 - DNA, 25 bp, Mus musculus
gtctgcctttgatacgctcagcgtc

SEQ ID NO: 240950 - DNA, 25 bp, Mus musculus
tggcgtccagtccagctcccagtga

SEQ ID NO: 240951 - DNA, 25 bp, Mus musculus
cctgcttcaggtccgaccggcgaga

SEQ ID NO: 240952 - DNA, 25 bp, Mus musculus
cgccagcctgaagggcagaagcact

SEQ ID NO: 240953 - DNA, 25 bp, Mus musculus
tcgctccgggagagttgacaaagcc

SEQ ID NO: 240954 - DNA, 25 bp, Mus musculus
tctgtcccacccacgggagtgaagc

SEQ ID NO: 240955 - DNA, 25 bp, Mus musculus
catgaccgaggacccacgtgagact

SEQ ID NO: 240956 - DNA, 25 bp, Mus musculus
cgaggccagcgaggccactgaagta

SEQ ID NO: 240957 - DNA, 25 bp, Mus musculus
ccactgaagtaggaacgcacggctc

SEQ ID NO: 240958 - DNA, 25 bp, Mus musculus
acgcacggctcagcttagaaaggca

SEQ ID NO: 240959 - DNA, 25 bp, Mus musculus
gcgttcattccagcgcatgcgtaca

SEQ ID NO: 240960 - DNA, 25 bp, Mus musculus
cagaaccaatcctgtggggaagcca

SEQ ID NO: 240961 - DNA, 25 bp, Mus musculus
cggaggcaaagaaaggccgtcgtct

SEQ ID NO: 240962 - DNA, 25 bp, Mus musculus
tgcggcgactggaaacagcgattac

SEQ ID NO: 240963 - DNA, 25 bp, Mus musculus
ctggtcaggctgaaggacgacttcc

SEQ ID NO: 240964 - DNA, 25 bp, Mus musculus
ggcagtacacgtgcccgcagctggt

SEQ ID NO: 240965 - DNA, 25 bp, Mus musculus
gaatacgcggacctttgaggaggca

SEQ ID NO: 240966 - DNA, 25 bp, Mus musculus
agaacacccagctggccatgaccga

SEQ ID NO: 240967 - DNA, 25 bp, Mus musculus
ccagcgagcctttttggcccatttc

SEQ ID NO: 240968 - DNA, 25 bp, Mus musculus
tatcgcttgggaggccaccgcctcg

SEQ ID NO: 240969 - DNA, 25 bp, Mus musculus
acagagaggtgtctgccctgagatg

SEQ ID NO: 240970 - DNA, 25 bp, Mus musculus
cgcacttttgcgttccggacagaga

SEQ ID NO: 240971 - DNA, 25 bp, Mus musculus
gcgagaaacccggtcgcacttttgc

SEQ ID NO: 240972 - DNA, 25 bp, Mus musculus
ccgctcagagggtcctgcgagaaac

SEQ ID NO: 240973 - DNA, 25 bp, Mus musculus
ggagaggcacatcgtcgagctgcac

SEQ ID NO: 240974 - DNA, 25 bp, Mus musculus
ggctcgcgaggctcggtttttgatc

SEQ ID NO: 240975 - DNA, 25 bp, Mus musculus
agccgagagttaactgcagcggaga

SEQ ID NO: 240976 - DNA, 25 bp, Mus musculus
aaggcatccagcgagccgagagtta

SEQ ID NO: 240977 - DNA, 25 bp, Mus musculus
aggctcggtttttgatctgcgtccc

SEQ ID NO: 240978 - DNA, 25 bp, Mus musculus
acgcccgaaggagaaccaaggcatc

SEQ ID NO: 240979 - DNA, 25 bp, Mus musculus
tctgcgtcccagctaaaggcttgtc

SEQ ID NO: 240980 - DNA, 25 bp, Mus musculus
ctcgggccgaaggtttccgacagca

SEQ ID NO: 240981 - DNA, 25 bp, Mus musculus
ttcgacttccgaaggagcccgcggc

SEQ ID NO: 240982 - DNA, 25 bp, Mus musculus
ctccctccatgtcacgcccacacca

SEQ ID NO: 240983 - DNA, 25 bp, Mus musculus
ccgcggggaggatgcacccggaagt

SEQ ID NO: 240984 - DNA, 25 bp, Mus musculus
ctccgtcgcgcagtgccagctccag

SEQ ID NO: 240985 - DNA, 25 bp, Mus musculus
gctgcctagccttaaacaccatggc

SEQ ID NO: 240986 - DNA, 25 bp, Mus musculus
gcgctgcctagccttaaacaccatg

SEQ ID NO: 240987 - DNA, 25 bp, Mus musculus
ccggaagtgacaccagcgccggaca

SEQ ID NO: 240988 - DNA, 25 bp, Mus musculus
gcccacaccactcacgccaggcgga

SEQ ID NO: 240989 - DNA, 25 bp, Mus musculus
gaagtgacaccagcgccggacagga

SEQ ID NO: 240990 - DNA, 25 bp, Mus musculus
acaccagcgccggacaggaaatatc

SEQ ID NO: 240991 - DNA, 25 bp, Mus musculus
accagcgccggacaggaaatatcgc

SEQ ID NO: 240992 - DNA, 25 bp, Mus musculus
cagcgccggacaggaaatatcgcgg

SEQ ID NO: 240993 - DNA, 25 bp, Mus musculus
cgccggacaggaaatatcgcgggca

SEQ ID NO: 240994 - DNA, 25 bp, Mus musculus
gacaggaaatatcgcgggcagggtt

SEQ ID NO: 240995 - DNA, 25 bp, Mus musculus
accactcacgccaggcggacgcgcg

SEQ ID NO: 240996 - DNA, 25 bp, Mus musculus
cggggctcatgcatacgcaaagatc

SEQ ID NO: 240997 - DNA, 25 bp, Mus musculus
caataaacggatgcggcgactcacc

SEQ ID NO: 240998 - DNA, 25 bp, Mus musculus
cggggccacggcaataaacggatgc

SEQ ID NO: 240999 - DNA, 25 bp, Mus musculus
gattgacagctggttcggtccgagc

SEQ ID NO: 241000 - DNA, 25 bp, Mus musculus
cgcggacgctgcagtgattgacagc

SEQ ID NO: 241001 - DNA, 25 bp, Mus musculus
gcgactcaccgacatgggcgtggcc

SEQ ID NO: 241002 - DNA, 25 bp, Mus musculus
tgaatatgcaaacgaagcgctatcc

SEQ ID NO: 241003 - DNA, 25 bp, Mus musculus
gcgctatccgatcgcccttaggagg

SEQ ID NO: 241004 - DNA, 25 bp, Mus musculus
catattcatgatgggacgaaaagca

SEQ ID NO: 241005 - DNA, 25 bp, Mus musculus
gcaatgatgggacgaaaagcaactt

SEQ ID NO: 241006 - DNA, 25 bp, Mus musculus
aacttggtagctcttgctcgggccc

SEQ ID NO: 241007 - DNA, 25 bp, Mus musculus
gcccaccgcggcgattgacaggcag

SEQ ID NO: 241008 - DNA, 25 bp, Mus musculus
ggccagaggccttatttgcatattc

SEQ ID NO: 241009 - DNA, 25 bp, Mus musculus
atgaccgcgagtgcccatgccatgt

SEQ ID NO: 241010 - DNA, 25 bp, Mus musculus
cgatgacatactgcctgaaccgtaa

SEQ ID NO: 241011 - DNA, 25 bp, Mus musculus
cggaacctatgcttcgtgcacatga

SEQ ID NO: 241012 - DNA, 25 bp, Mus musculus
ccggagggctctacacggaacctat

SEQ ID NO: 241013 - DNA, 25 bp, Mus musculus
gtacctggacctgcggatcgcgcat

SEQ ID NO: 241014 - DNA, 25 bp, Mus musculus
ctcatcctgcagaccctggacgtga

SEQ ID NO: 241015 - DNA, 25 bp, Mus musculus
gggtgtccatcctcatcctgcagac

SEQ ID NO: 241016 - DNA, 25 bp, Mus musculus
ccaggtgagccctgcggacaaggaa

SEQ ID NO: 241017 - DNA, 25 bp, Mus musculus
cccgtggtgatgaaatggtcggtca

SEQ ID NO: 241018 - DNA, 25 bp, Mus musculus
tgccattcatcaccgggcccgtggt

SEQ ID NO: 241019 - DNA, 25 bp, Mus musculus
cagggagccacgacacgatgacata

SEQ ID NO: 241020 - DNA, 25 bp, Mus musculus
atatgaccggtgacttgcgtgtccc

SEQ ID NO: 241021 - DNA, 25 bp, Mus musculus
aaccgtaagtctcggatctcccgtg

SEQ ID NO: 241022 - DNA, 25 bp, Mus musculus
agttcgtggctactgcacctgttgg

SEQ ID NO: 241023 - DNA, 25 bp, Mus musculus
gatctcccgtgcaagttcgtggcta

SEQ ID NO: 241024 - DNA, 25 bp, Mus musculus
tgccgggcatctctgaacaagaaca

SEQ ID NO: 241025 - DNA, 25 bp, Mus musculus
agctcaaaagcagggagcgccctca

SEQ ID NO: 241026 - DNA, 25 bp, Mus musculus
tgaacaagaacatcggcgcaccggc

SEQ ID NO: 241027 - DNA, 25 bp, Mus musculus
ggctggcctgcgcagctcaaaagca

SEQ ID NO: 241028 - DNA, 25 bp, Mus musculus
caaaagcagggagcgccctcagagg

SEQ ID NO: 241029 - DNA, 25 bp, Mus musculus
cggccgccacgtccgcactccgtgg

SEQ ID NO: 241030 - DNA, 25 bp, Mus musculus
cactccgtggagacaccggccttgt

SEQ ID NO: 241031 - DNA, 25 bp, Mus musculus
tccgtggagacaccggccttgtctc

SEQ ID NO: 241032 - DNA, 25 bp, Mus musculus
ggccaaggtcccacggagcctgcag

SEQ ID NO: 241033 - DNA, 25 bp, Mus musculus
cgcaaacggcgcgggccacgtgatc

SEQ ID NO: 241034 - DNA, 25 bp, Mus musculus
ccacgtgatcgctggcgaacggagt

SEQ ID NO: 241035 - DNA, 25 bp, Mus musculus
ggggttgccgggcatctctgaacaa

SEQ ID NO: 241036 - DNA, 25 bp, Mus musculus
gggcatctctgaacaagaacatcgg

SEQ ID NO: 241037 - DNA, 25 bp, Mus musculus
ccaggcgacccagcgacaccagggc

SEQ ID NO: 241038 - DNA, 25 bp, Mus musculus
ctctaccagggaaaggcagaacctc

SEQ ID NO: 241039 - DNA, 25 bp, Mus musculus
caaacgcgctgtgtatccaagggca

SEQ ID NO: 241040 - DNA, 25 bp, Mus musculus
tcaggatgcaggacgcaaacgcgct

SEQ ID NO: 241041 - DNA, 25 bp, Mus musculus
ccgatacctgtgcttcgaggctttt

SEQ ID NO: 241042 - DNA, 25 bp, Mus musculus
taagtttcggccttcaggtcctcgc

SEQ ID NO: 241043 - DNA, 25 bp, Mus musculus
gtggccttcctgtatagcactagta

SEQ ID NO: 241044 - DNA, 25 bp, Mus musculus
taccgtacgcccgatgtccatcata

SEQ ID NO: 241045 - DNA, 25 bp, Mus musculus
ctgccactccgctgtgaggacacaa

SEQ ID NO: 241046 - DNA, 25 bp, Mus musculus
aagggtccatccagtcaagggccga

SEQ ID NO: 241047 - DNA, 25 bp, Mus musculus
ccgaacgagttgtacgcggcgcaca

SEQ ID NO: 241048 - DNA, 25 bp, Mus musculus
cgccaggccatgatccaaagctcta

SEQ ID NO: 241049 - DNA, 25 bp, Mus musculus
ggagagcagccacgaacccagcaca

SEQ ID NO: 241050 - DNA, 25 bp, Mus musculus
aggcccaggtaccatcacatgctca

SEQ ID NO: 241051 - DNA, 25 bp, Mus musculus
ttagctctgggatgaaaccgcgccc

SEQ ID NO: 241052 - DNA, 25 bp, Mus musculus
ctatggagctacacggggaagagca

SEQ ID NO: 241053 - DNA, 25 bp, Mus musculus
tgagcgttttttaagtagtccctga

SEQ ID NO: 241054 - DNA, 25 bp, Mus musculus
gatagccttttctggcaccgctcta

SEQ ID NO: 241055 - DNA, 25 bp, Mus musculus
tctgtagatgtgagtcctatggagc

SEQ ID NO: 241056 - DNA, 25 bp, Mus musculus
ttggaaacgcgagtggaccatcgga

SEQ ID NO: 241057 - DNA, 25 bp, Mus musculus
aggcttcttcgtctaggcgcagagg

SEQ ID NO: 241058 - DNA, 25 bp, Mus musculus
cccagatccttctttggaaacgcga

SEQ ID NO: 241059 - DNA, 25 bp, Mus musculus
cccgagatgtctgttgacagcggtg

SEQ ID NO: 241060 - DNA, 25 bp, Mus musculus
atcagctggggtacccgagatgtct

SEQ ID NO: 241061 - DNA, 25 bp, Mus musculus
ctcgcctcccgtggatcagctgggg

SEQ ID NO: 241062 - DNA, 25 bp, Mus musculus
aatcacagggcgtaccgctctgctc

SEQ ID NO: 241063 - DNA, 25 bp, Mus musculus
tctagccgtcgctctcggtgggcac

SEQ ID NO: 241064 - DNA, 25 bp, Mus musculus
gcagcggtgctgagcgttttttaag

SEQ ID NO: 241065 - DNA, 25 bp, Mus musculus
cgtttctgggtctctgtagatgtga

SEQ ID NO: 241066 - DNA, 25 bp, Mus musculus
tcgcgcagactttgggtcagccgcg

SEQ ID NO: 241067 - DNA, 25 bp, Mus musculus
gtcatacccaccagtcagaaggccg

SEQ ID NO: 241068 - DNA, 25 bp, Mus musculus
cgtggcgagtccaacgtcactacca

SEQ ID NO: 241069 - DNA, 25 bp, Mus musculus
ctattactgaggagggtcgggacct

SEQ ID NO: 241070 - DNA, 25 bp, Mus musculus
ttgcccgagactggtaccctgttgc

SEQ ID NO: 241071 - DNA, 25 bp, Mus musculus
tcttccggaacgaagacctcgcgga

SEQ ID NO: 241072 - DNA, 25 bp, Mus musculus
ctgagggcagcctctcttccggaac

SEQ ID NO: 241073 - DNA, 25 bp, Mus musculus
tcaatctgtccggagatccatacca

SEQ ID NO: 241074 - DNA, 25 bp, Mus musculus
gtggccacgtggatcgtcataccca

SEQ ID NO: 241075 - DNA, 25 bp, Mus musculus
gtccactttctgaaggatatctcaa

SEQ ID NO: 241076 - DNA, 25 bp, Mus musculus
ctctgaagggaaggcacacaaaatt

SEQ ID NO: 241077 - DNA, 25 bp, Mus musculus
cgtctcttaggctggaagttgttcc

SEQ ID NO: 241078 - DNA, 25 bp, Mus musculus
agggttgtcctgatttcgtctctta

SEQ ID NO: 241079 - DNA, 25 bp, Mus musculus
cccaatttgaaagtggctactggcc

SEQ ID NO: 241080 - DNA, 25 bp, Mus musculus
gttccgggccgcgttctagcctgat

SEQ ID NO: 241081 - DNA, 25 bp, Mus musculus
tcgtgggaggaaaacctcactctcc

SEQ ID NO: 241082 - DNA, 25 bp, Mus musculus
cgtcagtcgtgggaggaaaacctca

SEQ ID NO: 241083 - DNA, 25 bp, Mus musculus
acagccaggtaaggcagcgtcagtc

SEQ ID NO: 241084 - DNA, 25 bp, Mus musculus
tccgcccagcgcgtctgaagcggtg

SEQ ID NO: 241085 - DNA, 25 bp, Mus musculus
gacctgaaccgttgcgggacgctct

SEQ ID NO: 241086 - DNA, 25 bp, Mus musculus
tgttcatcgccgtgcgctggctggt

SEQ ID NO: 241087 - DNA, 25 bp, Mus musculus
gcgcctcggtgctgttcatcgccgt

SEQ ID NO: 241088 - DNA, 25 bp, Mus musculus
ccctggatacggtaagaccctatcg

SEQ ID NO: 241089 - DNA, 25 bp, Mus musculus
ttctagcctgatcgttgggaaacgg

SEQ ID NO: 241090 - DNA, 25 bp, Mus musculus
gcagcgcgccgagtccgactcagga

SEQ ID NO: 241091 - DNA, 25 bp, Mus musculus
gctgcgctcgcgttaatcaggaccc

SEQ ID NO: 241092 - DNA, 25 bp, Mus musculus
ggctgcatttgcagcggccgcgctc

SEQ ID NO: 241093 - DNA, 25 bp, Mus musculus
tctccagcagcgacaactcggggcg

SEQ ID NO: 241094 - DNA, 25 bp, Mus musculus
gccgctgtatgtagcctcgtcgctc

SEQ ID NO: 241095 - DNA, 25 bp, Mus musculus
caggaagctgcactacggtgcttta

SEQ ID NO: 241096 - DNA, 25 bp, Mus musculus
ctacggtgctttacagcgaggatta

SEQ ID NO: 241097 - DNA, 25 bp, Mus musculus
tacagcgaggattaaagaagggata

SEQ ID NO: 241098 - DNA, 25 bp, Mus musculus
ttaaagaagggataagctcggccgc

SEQ ID NO: 241099 - DNA, 25 bp, Mus musculus
aagctcggccgctgtatgtagcctc

SEQ ID NO: 241100 - DNA, 25 bp, Mus musculus
tgtatgtagcctcgtcgctctgctc

SEQ ID NO: 241101 - DNA, 25 bp, Mus musculus
ctctgctccgtgaaggtcccaggaa

SEQ ID NO: 241102 - DNA, 25 bp, Mus musculus
tgctccgtgaaggtcccaggaaaac

SEQ ID NO: 241103 - DNA, 25 bp, Mus musculus
cgcagctgctctcccgagcggaagg

SEQ ID NO: 241104 - DNA, 25 bp, Mus musculus
ctgctctcccgagcggaagggcagc

SEQ ID NO: 241105 - DNA, 25 bp, Mus musculus
cagccgccgtgacgcagacagcgcc

SEQ ID NO: 241106 - DNA, 25 bp, Mus musculus
cgaccgagttaagcaggaagctgca

SEQ ID NO: 241107 - DNA, 25 bp, Mus musculus
tagcctcgtcgctctgctccgtgaa

SEQ ID NO: 241108 - DNA, 25 bp, Mus musculus
tccgggcggttagaggtccctcaga

SEQ ID NO: 241109 - DNA, 25 bp, Mus musculus
ccgcttccggctggtggaagtcccg

SEQ ID NO: 241110 - DNA, 25 bp, Mus musculus
gggacgccaggagcagacttccgct

SEQ ID NO: 241111 - DNA, 25 bp, Mus musculus
cgcaaatcgcgcgacctgacggcgg

SEQ ID NO: 241112 - DNA, 25 bp, Mus musculus
ctgccggaaagccatgccgcaaatc

SEQ ID NO: 241113 - DNA, 25 bp, Mus musculus
cgagaagagaacagcggccgagcca

SEQ ID NO: 241114 - DNA, 25 bp, Mus musculus
accgcgaccgccgagaagagaacag

SEQ ID NO: 241115 - DNA, 25 bp, Mus musculus
acctgtcccagttggtgtcccagac

SEQ ID NO: 241116 - DNA, 25 bp, Mus musculus
ggaagcagggccgagcccaaacctc

SEQ ID NO: 241117 - DNA, 25 bp, Mus musculus
aaactcaagacccactagcacgcag

SEQ ID NO: 241118 - DNA, 25 bp, Mus musculus
gccaccgattcacacaaactcaaga

SEQ ID NO: 241119 - DNA, 25 bp, Mus musculus
aagaccttcgggaggtgcgccatcc

SEQ ID NO: 241120 - DNA, 25 bp, Mus musculus
gacgaatcaggaaacgcggcccagg

SEQ ID NO: 241121 - DNA, 25 bp, Mus musculus
gtccctcagagagacgggtggccca

SEQ ID NO: 241122 - DNA, 25 bp, Mus musculus
tcctgctgccaaggcgctggcggta

SEQ ID NO: 241123 - DNA, 25 bp, Mus musculus
atcgcggtccggatgtctaagtcgc

SEQ ID NO: 241124 - DNA, 25 bp, Mus musculus
cacccaacagctaggcagtcgggca

SEQ ID NO: 241125 - DNA, 25 bp, Mus musculus
ggggacggcctgacattttctgccc

SEQ ID NO: 241126 - DNA, 25 bp, Mus musculus
gcggccagctagtgcactcttttcc

SEQ ID NO: 241127 - DNA, 25 bp, Mus musculus
accctctgcgctcgccggaggattg

SEQ ID NO: 241128 - DNA, 25 bp, Mus musculus
aggtccatctgaggccgcgccttct

SEQ ID NO: 241129 - DNA, 25 bp, Mus musculus
cgccttctcattggccgaagccgta

SEQ ID NO: 241130 - DNA, 25 bp, Mus musculus
cgaagccgtagcctcgcgagagcac

SEQ ID NO: 241131 - DNA, 25 bp, Mus musculus
cgagcgctcgcttgggaagcgaccc

SEQ ID NO: 241132 - DNA, 25 bp, Mus musculus
agcacgtggagagcgcgccaaattc

SEQ ID NO: 241133 - DNA, 25 bp, Mus musculus
gagctttggagcgtcgcaatggtcc

SEQ ID NO: 241134 - DNA, 25 bp, Mus musculus
agcgtcgcaatggtcctgaggaaca

SEQ ID NO: 241135 - DNA, 25 bp, Mus musculus
gaagcgacccgagctcggattccac

SEQ ID NO: 241136 - DNA, 25 bp, Mus musculus
actttgtgttccgacatggtgatcc

SEQ ID NO: 241137 - DNA, 25 bp, Mus musculus
ggaccggtttcgctatcctggtagc

SEQ ID NO: 241138 - DNA, 25 bp, Mus musculus
cccttgactttggtgatgatggagc

SEQ ID NO: 241139 - DNA, 25 bp, Mus musculus
atgatggagctctccggaccggttt

SEQ ID NO: 241140 - DNA, 25 bp, Mus musculus
cctggtagcttttctgcacgatgaa

SEQ ID NO: 241141 - DNA, 25 bp, Mus musculus
ctccggaggcaaccctggagagacc

SEQ ID NO: 241142 - DNA, 25 bp, Mus musculus
gatatccctctcctaaagccctaag

SEQ ID NO: 241143 - DNA, 25 bp, Mus musculus
ccggcgcaccacacgaagtaaagca

SEQ ID NO: 241144 - DNA, 25 bp, Mus musculus
gtgcacgaatcccaggcgccgattc

SEQ ID NO: 241145 - DNA, 25 bp, Mus musculus
gattccgcaccacgatcaccttggg

SEQ ID NO: 241146 - DNA, 25 bp, Mus musculus
accttgggcgtctcgtagtcccaga

SEQ ID NO: 241147 - DNA, 25 bp, Mus musculus
tggcccaaggagctcggtccacaag

SEQ ID NO: 241148 - DNA, 25 bp, Mus musculus
cctgtcagctcactcagacgggtca

SEQ ID NO: 241149 - DNA, 25 bp, Mus musculus
tctgcacgatgaagacgtacctgtg

SEQ ID NO: 241150 - DNA, 25 bp, Mus musculus
cgatcaggcgtctgcttcccggact

SEQ ID NO: 241151 - DNA, 25 bp, Mus musculus
tggcccactggtgctacaggcgacc

SEQ ID NO: 241152 - DNA, 25 bp, Mus musculus
cgagtctcagcctcacgctcggtga

SEQ ID NO: 241153 - DNA, 25 bp, Mus musculus
agtggctctccttgacccgagtctc

SEQ ID NO: 241154 - DNA, 25 bp, Mus musculus
tggcgccatcctctttgctaggtga

SEQ ID NO: 241155 - DNA, 25 bp, Mus musculus
gtcgcgcagccagtttggcgccatc

SEQ ID NO: 241156 - DNA, 25 bp, Mus musculus
gacccagtaggcctgccaggcgtag

SEQ ID NO: 241157 - DNA, 25 bp, Mus musculus
ttcacgtcgccctggggccgatcag

SEQ ID NO: 241158 - DNA, 25 bp, Mus musculus
ggtgtctcgtcttccctgcgttcct

SEQ ID NO: 241159 - DNA, 25 bp, Mus musculus
tagctgtggagtgcacgctgacgcc

SEQ ID NO: 241160 - DNA, 25 bp, Mus musculus
gcccaggcccatatgtgtagctgtg

SEQ ID NO: 241161 - DNA, 25 bp, Mus musculus
ccgcccgcagtcaccagtggaggag

SEQ ID NO: 241162 - DNA, 25 bp, Mus musculus
gtcgcccagggctgccttgcagtag

SEQ ID NO: 241163 - DNA, 25 bp, Mus musculus
gcggatcccacacgaagcctgctgt

SEQ ID NO: 241164 - DNA, 25 bp, Mus musculus
tgttcagctcttgcctgagcagttc

SEQ ID NO: 241165 - DNA, 25 bp, Mus musculus
aagccgtggtggctgctcgctactt

SEQ ID NO: 241166 - DNA, 25 bp, Mus musculus
atagtcacctggcactcccggggtc

SEQ ID NO: 241167 - DNA, 25 bp, Mus musculus
acgaggcggatagtcacctggcact

SEQ ID NO: 241168 - DNA, 25 bp, Mus musculus
aggcacgtcggccatgggctcccag

SEQ ID NO: 241169 - DNA, 25 bp, Mus musculus
gttcgtgatctacaagagaaaaaga

SEQ ID NO: 241170 - DNA, 25 bp, Mus musculus
tcttgcctgagcagttcgtgatcta

SEQ ID NO: 241171 - DNA, 25 bp, Mus musculus
aaccgcgtgttcagctcttgcctga

SEQ ID NO: 241172 - DNA, 25 bp, Mus musculus
ccagaaaccgcgtgttcagctcttg

SEQ ID NO: 241173 - DNA, 25 bp, Mus musculus
gttctgcaccagaaaccgcgtgttc

SEQ ID NO: 241174 - DNA, 25 bp, Mus musculus
cgccaggccgctccgcgttctgcac

SEQ ID NO: 241175 - DNA, 25 bp, Mus musculus
tgctggtggaactcggcccgcagca

SEQ ID NO: 241176 - DNA, 25 bp, Mus musculus
cagccctgcaaagggggcaaatgtg

SEQ ID NO: 241177 - DNA, 25 bp, Mus musculus
cctgagcagttcgtgatctacaaga

SEQ ID NO: 241178 - DNA, 25 bp, Mus musculus
gcgcctcctcgaagttgctcttctt

SEQ ID NO: 241179 - DNA, 25 bp, Mus musculus
ctcaaggaagccagggacgccactt

SEQ ID NO: 241180 - DNA, 25 bp, Mus musculus
ttgcattctgactggaccgcgtttc

SEQ ID NO: 241181 - DNA, 25 bp, Mus musculus
ccgattctccgtcgaacgtggcagt

SEQ ID NO: 241182 - DNA, 25 bp, Mus musculus
tccacacgtctggaatggctgcggc

SEQ ID NO: 241183 - DNA, 25 bp, Mus musculus
ctggacttctgactggcgacttttc

SEQ ID NO: 241184 - DNA, 25 bp, Mus musculus
ttcggttcttgcctgggattggcca

SEQ ID NO: 241185 - DNA, 25 bp, Mus musculus
ggactggacacccactcaaggctgg

SEQ ID NO: 241186 - DNA, 25 bp, Mus musculus
tccaccagcaggtacttgtgcgccg

SEQ ID NO: 241187 - DNA, 25 bp, Mus musculus
gctaggcacagcaaagcacggctca

SEQ ID NO: 241188 - DNA, 25 bp, Mus musculus
ggctgggccaccaagtcgacaaaga

SEQ ID NO: 241189 - DNA, 25 bp, Mus musculus
ggtgttctgtgcttttctcggctgc

SEQ ID NO: 241190 - DNA, 25 bp, Mus musculus
gcacggctcagcatgtcggacgtct

SEQ ID NO: 241191 - DNA, 25 bp, Mus musculus
tcggtccagacctcgcctttataaa

SEQ ID NO: 241192 - DNA, 25 bp, Mus musculus
caggcaggtaagcaaggcaccacgc

SEQ ID NO: 241193 - DNA, 25 bp, Mus musculus
tcaccgcgtgctttgtttgagacta

SEQ ID NO: 241194 - DNA, 25 bp, Mus musculus
ttgagactattggaccctagggaca

SEQ ID NO: 241195 - DNA, 25 bp, Mus musculus
caaagaactcaactccaggcaggta

SEQ ID NO: 241196 - DNA, 25 bp, Mus musculus
tcctgctccagcgaaggatgtgtga

SEQ ID NO: 241197 - DNA, 25 bp, Mus musculus
tgtgagcggaattcccagagtcgtc

SEQ ID NO: 241198 - DNA, 25 bp, Mus musculus
agatcctgcgcgcttctctgcgttc

SEQ ID NO: 241199 - DNA, 25 bp, Mus musculus
tcgacggtctcagccctaggtgctg

SEQ ID NO: 241200 - DNA, 25 bp, Mus musculus
gggcctgccatccagggagtctctt

SEQ ID NO: 241201 - DNA, 25 bp, Mus musculus
gggagtctctttctgcatgcccagc

SEQ ID NO: 241202 - DNA, 25 bp, Mus musculus
gtctgtctgatctgacccggtggta

SEQ ID NO: 241203 - DNA, 25 bp, Mus musculus
gcaatggccacaagaaacgcccgtg

SEQ ID NO: 241204 - DNA, 25 bp, Mus musculus
taagtcccgctttgctcttcgcgca

SEQ ID NO: 241205 - DNA, 25 bp, Mus musculus
ggacagccctcggatcagacacgca

SEQ ID NO: 241206 - DNA, 25 bp, Mus musculus
taacaactgacgcacttccgccggg

SEQ ID NO: 241207 - DNA, 25 bp, Mus musculus
gcacagctctttagaattccgaccc

SEQ ID NO: 241208 - DNA, 25 bp, Mus musculus
tggagtcccgcgttctccttgccag

SEQ ID NO: 241209 - DNA, 25 bp, Mus musculus
ttctccttgccaggactgggctctg

SEQ ID NO: 241210 - DNA, 25 bp, Mus musculus
cgaacgccggcttggccggaccttg

SEQ ID NO: 241211 - DNA, 25 bp, Mus musculus
ttggccggaccttggcctccatggc

SEQ ID NO: 241212 - DNA, 25 bp, Mus musculus
gtctctcggcgaccctagaccaggt

SEQ ID NO: 241213 - DNA, 25 bp, Mus musculus
cggagcttctgagcaccgggaccgt

SEQ ID NO: 241214 - DNA, 25 bp, Mus musculus
gcaccgggaccgtgaggcagacaca

SEQ ID NO: 241215 - DNA, 25 bp, Mus musculus
gcagcgaccagagcggataacaact

SEQ ID NO: 241216 - DNA, 25 bp, Mus musculus
cgcccttccggactaaatggctctg

SEQ ID NO: 241217 - DNA, 25 bp, Mus musculus
ctaaatggctctgcgctgagcgggc

SEQ ID NO: 241218 - DNA, 25 bp, Mus musculus
acccgtttgcgcacagctctttaga

SEQ ID NO: 241219 - DNA, 25 bp, Mus musculus
gcagacacagtagtggcagcgacca

SEQ ID NO: 241220 - DNA, 25 bp, Mus musculus
accgttggacttgtaaccctgcaca

SEQ ID NO: 241221 - DNA, 25 bp, Mus musculus
agcggcaactccacactgatctgcg

SEQ ID NO: 241222 - DNA, 25 bp, Mus musculus
acgcggctgaaaaagtgtggcttgc

SEQ ID NO: 241223 - DNA, 25 bp, Mus musculus
agggcatctagttgtacttgttcca

SEQ ID NO: 241224 - DNA, 25 bp, Mus musculus
taaccctgcacaatctcgggcggcg

SEQ ID NO: 241225 - DNA, 25 bp, Mus musculus
agctggaagatgctgctggcgaact

SEQ ID NO: 241226 - DNA, 25 bp, Mus musculus
atgtcgcgcttgcagatgaggtctg

SEQ ID NO: 241227 - DNA, 25 bp, Mus musculus
aagtactcgggtatgtcgcgcttgc

SEQ ID NO: 241228 - DNA, 25 bp, Mus musculus
tgagtgccggtctccaggaagtact

SEQ ID NO: 241229 - DNA, 25 bp, Mus musculus
attccagttgcgactgaggatcttg

SEQ ID NO: 241230 - DNA, 25 bp, Mus musculus
tccggaaggaccgtggctgacacca

SEQ ID NO: 241231 - DNA, 25 bp, Mus musculus
aagccgtggatgtgcgagtattcca

SEQ ID NO: 241232 - DNA, 25 bp, Mus musculus
tcaccggcggtagcttgaagtggac

SEQ ID NO: 241233 - DNA, 25 bp, Mus musculus
ggttgtcgaagctctagggcatcta

SEQ ID NO: 241234 - DNA, 25 bp, Mus musculus
cggacggtttctgcgcgctgaagaa

SEQ ID NO: 241235 - DNA, 25 bp, Mus musculus
tgggcatcattctcttctcggtgta

SEQ ID NO: 241236 - DNA, 25 bp, Mus musculus
gctgaaagaacagctcccgcccttg

SEQ ID NO: 241237 - DNA, 25 bp, Mus musculus
cggtggccaggaagatcaaaacttt

SEQ ID NO: 241238 - DNA, 25 bp, Mus musculus
actttgctgacggtcaacatcctgg

SEQ ID NO: 241239 - DNA, 25 bp, Mus musculus
aacatcctggtgttcgtgggcatca

SEQ ID NO: 241240 - DNA, 25 bp, Mus musculus
tccacgtgggcctatcctggccagg

SEQ ID NO: 241241 - DNA, 25 bp, Mus musculus
cgccgcgtgcatgctgatgagcgca

SEQ ID NO: 241242 - DNA, 25 bp, Mus musculus
gccgcctgcaggaccgttctgaggc

SEQ ID NO: 241243 - DNA, 25 bp, Mus musculus
tcgtgcgaggcaccgaccgccggat

SEQ ID NO: 241244 - DNA, 25 bp, Mus musculus
cgccggatgcgcaatcggctatcca

SEQ ID NO: 241245 - DNA, 25 bp, Mus musculus
tcggctatccaaggcgagtgctctg

SEQ ID NO: 241246 - DNA, 25 bp, Mus musculus
tctcttctcggtgtactgccgcctg

SEQ ID NO: 241247 - DNA, 25 bp, Mus musculus
gacgcagcagctaaggcctcgcgct

SEQ ID NO: 241248 - DNA, 25 bp, Mus musculus
caccggaactgcctagcggagagta

SEQ ID NO: 241249 - DNA, 25 bp, Mus musculus
gctcacctgaagcacagccaagatg

SEQ ID NO: 241250 - DNA, 25 bp, Mus musculus
atttcctcgggctcctcggactgaa

SEQ ID NO: 241251 - DNA, 25 bp, Mus musculus
tcccgctccagcaaggtaccgaaga

SEQ ID NO: 241252 - DNA, 25 bp, Mus musculus
ggcagcgagcccacgaacagctctt

SEQ ID NO: 241253 - DNA, 25 bp, Mus musculus
agccggagctcgagaccacaggaac

SEQ ID NO: 241254 - DNA, 25 bp, Mus musculus
agaacagagcccgtgagcgacagca

SEQ ID NO: 241255 - DNA, 25 bp, Mus musculus
gctgttccacatagcgcggtacgcg

SEQ ID NO: 241256 - DNA, 25 bp, Mus musculus
gtacgtcatcaaagagcgccggaga

SEQ ID NO: 241257 - DNA, 25 bp, Mus musculus
tcctggaaaccgaagtgtgcgccga

SEQ ID NO: 241258 - DNA, 25 bp, Mus musculus
actcgtcagcactgcctccaggagg

SEQ ID NO: 241259 - DNA, 25 bp, Mus musculus
gaacaccgcgttcgcttggccacga

SEQ ID NO: 241260 - DNA, 25 bp, Mus musculus
agccaagatgtcgaacaccgcgttc

SEQ ID NO: 241261 - DNA, 25 bp, Mus musculus
ccctacgttgtgctgtgtcgctcag

SEQ ID NO: 241262 - DNA, 25 bp, Mus musculus
cactagtgggcgtcgagtgacaatc

SEQ ID NO: 241263 - DNA, 25 bp, Mus musculus
agccagatccgtaatcgctgtgtga

SEQ ID NO: 241264 - DNA, 25 bp, Mus musculus
cgctgtgtgattttagtggagaacc

SEQ ID NO: 241265 - DNA, 25 bp, Mus musculus
ttcggttcgagaaaccagctctgtc

SEQ ID NO: 241266 - DNA, 25 bp, Mus musculus
ggcgctgacgatggctgcaattttt

SEQ ID NO: 241267 - DNA, 25 bp, Mus musculus
gctcctccatcgagacagcgcggga

SEQ ID NO: 241268 - DNA, 25 bp, Mus musculus
cggcggatggatgaatgcacctgtt

SEQ ID NO: 241269 - DNA, 25 bp, Mus musculus
tcgccagctccgcttttatccggtg

SEQ ID NO: 241270 - DNA, 25 bp, Mus musculus
ctcttacggagcacccaaggtcgtg

SEQ ID NO: 241271 - DNA, 25 bp, Mus musculus
gggtaggagcaagtgcatcacctta

SEQ ID NO: 241272 - DNA, 25 bp, Mus musculus
gctgtcatccttctacccactagta

SEQ ID NO: 241273 - DNA, 25 bp, Mus musculus
cgggccgcagcccataaccaagatg

SEQ ID NO: 241274 - DNA, 25 bp, Mus musculus
ctacatccaggcttgagggctactc

SEQ ID NO: 241275 - DNA, 25 bp, Mus musculus
gagccaagcccaccagctagcaaga

SEQ ID NO: 241276 - DNA, 25 bp, Mus musculus
tccgaaaggcctcatccgtacgagg

SEQ ID NO: 241277 - DNA, 25 bp, Mus musculus
tctgtctccgctcaaggctctacgt

SEQ ID NO: 241278 - DNA, 25 bp, Mus musculus
tttggagagcggagagccacctcag

SEQ ID NO: 241279 - DNA, 25 bp, Mus musculus
aagcggcttcttaagcaggcggtta

SEQ ID NO: 241280 - DNA, 25 bp, Mus musculus
aggcaggaccgaagcggcttcttaa

SEQ ID NO: 241281 - DNA, 25 bp, Mus musculus
tacctatcctgtagggccgctcgca

SEQ ID NO: 241282 - DNA, 25 bp, Mus musculus
tccacgggcacaggaagtagcagcg

SEQ ID NO: 241283 - DNA, 25 bp, Mus musculus
cctcatgggtacaaggcggagcctc

SEQ ID NO: 241284 - DNA, 25 bp, Mus musculus
ccgttcgcttgcaccgcgagcaaaa

SEQ ID NO: 241285 - DNA, 25 bp, Mus musculus
aagggccttgctgaggccggaccac

SEQ ID NO: 241286 - DNA, 25 bp, Mus musculus
actcgagagcgctgaccagagaagg

SEQ ID NO: 241287 - DNA, 25 bp, Mus musculus
tgcccagaaagaacggcgcactcga

SEQ ID NO: 241288 - DNA, 25 bp, Mus musculus
caaggctctacgtcgcgaaaggaag

SEQ ID NO: 241289 - DNA, 25 bp, Mus musculus
gagtttcactcagttacgccacctg

SEQ ID NO: 241290 - DNA, 25 bp, Mus musculus
agtttctcagcagtgcggcccacag

SEQ ID NO: 241291 - DNA, 25 bp, Mus musculus
aagtctttctgggacgcgcctagcg

SEQ ID NO: 241292 - DNA, 25 bp, Mus musculus
caaaagtctttctgggacgcgccta

SEQ ID NO: 241293 - DNA, 25 bp, Mus musculus
gcggacaaaagtctttctgggacgc

SEQ ID NO: 241294 - DNA, 25 bp, Mus musculus
tgaccacgtgcacgaaggcggaagc

SEQ ID NO: 241295 - DNA, 25 bp, Mus musculus
cccgaagctgaccacgtgcacgaag

SEQ ID NO: 241296 - DNA, 25 bp, Mus musculus
cggacccactcacggcgccgcggaa

SEQ ID NO: 241297 - DNA, 25 bp, Mus musculus
cgctcgaggagggaggaaagtcccg

SEQ ID NO: 241298 - DNA, 25 bp, Mus musculus
tagagatcgcgcagccggcgcgctc

SEQ ID NO: 241299 - DNA, 25 bp, Mus musculus
ccgtccttagagatcgcgcagccgg

SEQ ID NO: 241300 - DNA, 25 bp, Mus musculus
ccagatcctaggctgacctgtgacc

SEQ ID NO: 241301 - DNA, 25 bp, Mus musculus
cttccagatgtcttggctctgaccc

SEQ ID NO: 241302 - DNA, 25 bp, Mus musculus
tgtcttccagatgtcttggctctga

SEQ ID NO: 241303 - DNA, 25 bp, Mus musculus
aaatccctgccctgtcttccagatg

SEQ ID NO: 241304 - DNA, 25 bp, Mus musculus
cacctcgcggtgtcgacccttgaag

SEQ ID NO: 241305 - DNA, 25 bp, Mus musculus
gcgggtccgaaatgaaggacacctc

SEQ ID NO: 241306 - DNA, 25 bp, Mus musculus
tcaagacctcttaggcggcggagct

SEQ ID NO: 241307 - DNA, 25 bp, Mus musculus
cccgcagggaaacaaaagatccgcg

SEQ ID NO: 241308 - DNA, 25 bp, Mus musculus
ctgactgacgatgcggctcggagcc

SEQ ID NO: 241309 - DNA, 25 bp, Mus musculus
caagtccgggcctgactgacgatgc

SEQ ID NO: 241310 - DNA, 25 bp, Mus musculus
gggactcagctctgacacactccag

SEQ ID NO: 241311 - DNA, 25 bp, Mus musculus
ggtccgactcgggactcagctctga

SEQ ID NO: 241312 - DNA, 25 bp, Mus musculus
tgacagtcgggacccggtccgactc

SEQ ID NO: 241313 - DNA, 25 bp, Mus musculus
agagaactcgaacttgcccacggtc

SEQ ID NO: 241314 - DNA, 25 bp, Mus musculus
caatcaggtccttgcgagagaactc

SEQ ID NO: 241315 - DNA, 25 bp, Mus musculus
aggcgccgtgtccaatcaggtcctt

SEQ ID NO: 241316 - DNA, 25 bp, Mus musculus
atgaaggacacctcgtgggtggtaa

SEQ ID NO: 241317 - DNA, 25 bp, Mus musculus
tcgacccttgaagaccaccgcgaag

SEQ ID NO: 241318 - DNA, 25 bp, Mus musculus
ccaagcctagatcgctcgggttacg

SEQ ID NO: 241319 - DNA, 25 bp, Mus musculus
cgcccgtaccagttcatgaggctga

SEQ ID NO: 241320 - DNA, 25 bp, Mus musculus
catgaggctgaagtagtcacgagtg

SEQ ID NO: 241321 - DNA, 25 bp, Mus musculus
gcggcagtgtgagcagaagaactca

SEQ ID NO: 241322 - DNA, 25 bp, Mus musculus
ttgcgtgaccgcagttccagcactg

SEQ ID NO: 241323 - DNA, 25 bp, Mus musculus
ccagcactgcggtgcaatgctcttc

SEQ ID NO: 241324 - DNA, 25 bp, Mus musculus
cggcggcattgctgcccaaaagtct

SEQ ID NO: 241325 - DNA, 25 bp, Mus musculus
tgcccaaaagtctccttcccaggaa

SEQ ID NO: 241326 - DNA, 25 bp, Mus musculus
ggccgctcgctgacctaggtagcaa

SEQ ID NO: 241327 - DNA, 25 bp, Mus musculus
ctaggtagcaagacccgagggaaag

SEQ ID NO: 241328 - DNA, 25 bp, Mus musculus
aaaggaggaaagaccgtctcgctgc

SEQ ID NO: 241329 - DNA, 25 bp, Mus musculus
gtctcgctgctgattggttaaggga

SEQ ID NO: 241330 - DNA, 25 bp, Mus musculus
tagccgcgggaaaccaagacgtcga

SEQ ID NO: 241331 - DNA, 25 bp, Mus musculus
tcgggttacgaagcccgagctgctt

SEQ ID NO: 241332 - DNA, 25 bp, Mus musculus
tctgagaggtgtccgccaaggaaac

SEQ ID NO: 241333 - DNA, 25 bp, Mus musculus
ggctcttccagagcagcgtcgcgcg

SEQ ID NO: 241334 - DNA, 25 bp, Mus musculus
tgggacacgagagccggctcttcca

SEQ ID NO: 241335 - DNA, 25 bp, Mus musculus
gtcgccattttgctgcgggcctcgt

SEQ ID NO: 241336 - DNA, 25 bp, Mus musculus
gtcacaagacttccgctctcgcggg

SEQ ID NO: 241337 - DNA, 25 bp, Mus musculus
tgcctttcagttccgcagattccca

SEQ ID NO: 241338 - DNA, 25 bp, Mus musculus
tcacttccggggtcacaagacttcc

SEQ ID NO: 241339 - DNA, 25 bp, Mus musculus
caaggaaacacataaagcggcggtc

SEQ ID NO: 241340 - DNA, 25 bp, Mus musculus
cggccgttgtccctctgagaggtgt

SEQ ID NO: 241341 - DNA, 25 bp, Mus musculus
tgcctacaggcaatgcgcagcggtc

SEQ ID NO: 241342 - DNA, 25 bp, Mus musculus
gtctctcggaaacccactgtgatgc

SEQ ID NO: 241343 - DNA, 25 bp, Mus musculus
tcccgcaccaaatgacgaacgtcgt

SEQ ID NO: 241344 - DNA, 25 bp, Mus musculus
cgcagattcccaaacgtctctcgga

SEQ ID NO: 241345 - DNA, 25 bp, Mus musculus
cggaagcgcctagatgcctttcagt

SEQ ID NO: 241346 - DNA, 25 bp, Mus musculus
tcattaggcagaccctgtgcatcat

SEQ ID NO: 241347 - DNA, 25 bp, Mus musculus
ctgcctcagtttccacggctgtgtg

SEQ ID NO: 241348 - DNA, 25 bp, Mus musculus
ccgggaacagcgagcgaacagctcc

SEQ ID NO: 241349 - DNA, 25 bp, Mus musculus
cccgcagcgaatcattaggcagacc

SEQ ID NO: 241350 - DNA, 25 bp, Mus musculus
ctcggcggccgacgatgacctgcag

SEQ ID NO: 241351 - DNA, 25 bp, Mus musculus
gcgttcgccgagtcactctactctg

SEQ ID NO: 241352 - DNA, 25 bp, Mus musculus
tctttgtgaaactctgtcggtgcga

SEQ ID NO: 241353 - DNA, 25 bp, Mus musculus
ccacggctgtgtgcttggaatgcac

SEQ ID NO: 241354 - DNA, 25 bp, Mus musculus
accgttagctctaggcagacgccga

SEQ ID NO: 241355 - DNA, 25 bp, Mus musculus
cctagctggcgggaccgttagctct

SEQ ID NO: 241356 - DNA, 25 bp, Mus musculus
cgcacttgcgcggtgcgagctgtct

SEQ ID NO: 241357 - DNA, 25 bp, Mus musculus
gagtcactctactctggcgccttca

SEQ ID NO: 241358 - DNA, 25 bp, Mus musculus
cacaggccaaggaggccagcgttcg

SEQ ID NO: 241359 - DNA, 25 bp, Mus musculus
cttggaatgcactgggcacctaatc

SEQ ID NO: 241360 - DNA, 25 bp, Mus musculus
cgcgctgaaccgaagacgaagactg

SEQ ID NO: 241361 - DNA, 25 bp, Mus musculus
tcgcccgccaagttctcgcctccgg

SEQ ID NO: 241362 - DNA, 25 bp, Mus musculus
tccgtgcgcccatcgcccgccaagt

SEQ ID NO: 241363 - DNA, 25 bp, Mus musculus
tacaaatatgatgaaatggcagccc

SEQ ID NO: 241364 - DNA, 25 bp, Mus musculus
cgggtcggctgtacaaatatgatga

SEQ ID NO: 241365 - DNA, 25 bp, Mus musculus
cccgggtcggctgtacaaatatgat

SEQ ID NO: 241366 - DNA, 25 bp, Mus musculus
cacctcttgatgtgtcccgggtcgg

SEQ ID NO: 241367 - DNA, 25 bp, Mus musculus
agcccacctcttgatgtgtcccggg

SEQ ID NO: 241368 - DNA, 25 bp, Mus musculus
ccgaagacgaagactgtctgtccta

SEQ ID NO: 241369 - DNA, 25 bp, Mus musculus
gtggccgcggcacttcgcgctgaac

SEQ ID NO: 241370 - DNA, 25 bp, Mus musculus
gcagcatgacttgcagtcgccgccg

SEQ ID NO: 241371 - DNA, 25 bp, Mus musculus
attgtgcgccgcgtgtgtgcatcga

SEQ ID NO: 241372 - DNA, 25 bp, Mus musculus
caaggaggcagcatgacttgcagtc

SEQ ID NO: 241373 - DNA, 25 bp, Mus musculus
tgtctgtcctatcggggaaagaacg

SEQ ID NO: 241374 - DNA, 25 bp, Mus musculus
cgggaacatgggagctgtgtacatc

SEQ ID NO: 241375 - DNA, 25 bp, Mus musculus
atgcgctggccagtcacaagcagtg

SEQ ID NO: 241376 - DNA, 25 bp, Mus musculus
agtcacaagcagtgcgtcctcctgg

SEQ ID NO: 241377 - DNA, 25 bp, Mus musculus
gtcctcctggccaagcagtccaaag

SEQ ID NO: 241378 - DNA, 25 bp, Mus musculus
tggccaagcagtccaaagatgacct

SEQ ID NO: 241379 - DNA, 25 bp, Mus musculus
ccgagaactcgggaacatgggagct

SEQ ID NO: 241380 - DNA, 25 bp, Mus musculus
gagctgtgtacatcgccatgggtga

SEQ ID NO: 241381 - DNA, 25 bp, Mus musculus
catcgccatgggtgactttgagaac

SEQ ID NO: 241382 - DNA, 25 bp, Mus musculus
ccatgggtgactttgagaacgccgt

SEQ ID NO: 241383 - DNA, 25 bp, Mus musculus
ttgagaacgccgtgcagtgccacga

SEQ ID NO: 241384 - DNA, 25 bp, Mus musculus
tgccacgaacagcacctgcggatcg

SEQ ID NO: 241385 - DNA, 25 bp, Mus musculus
gcacctgcggatcgccaaggacctg

SEQ ID NO: 241386 - DNA, 25 bp, Mus musculus
cctacagcaacctgggcagcgccta

SEQ ID NO: 241387 - DNA, 25 bp, Mus musculus
aagatgacctttctgaagcccgaga

SEQ ID NO: 241388 - DNA, 25 bp, Mus musculus
ctcccgtggagagtatgtgcaggct

SEQ ID NO: 241389 - DNA, 25 bp, Mus musculus
gcctctcaggcatcgactcacggga

SEQ ID NO: 241390 - DNA, 25 bp, Mus musculus
aggcatcgactcacgggaacctggc

SEQ ID NO: 241391 - DNA, 25 bp, Mus musculus
tcgactcacgggaacctggccgtcg

SEQ ID NO: 241392 - DNA, 25 bp, Mus musculus
ctaccaggccctgggagcccatgac

SEQ ID NO: 241393 - DNA, 25 bp, Mus musculus
gggcgctgcagcactaccagaacca

SEQ ID NO: 241394 - DNA, 25 bp, Mus musculus
tgcagcactaccagaaccacctgaa

SEQ ID NO: 241395 - DNA, 25 bp, Mus musculus
gaaccacctgaacatcgcccgggag

SEQ ID NO: 241396 - DNA, 25 bp, Mus musculus
tgagagacatccagagcgaggcccg

SEQ ID NO: 241397 - DNA, 25 bp, Mus musculus
gaggcccgggctctcagcaaccttg

SEQ ID NO: 241398 - DNA, 25 bp, Mus musculus
tgggaacttccactgctcccgtgga

SEQ ID NO: 241399 - DNA, 25 bp, Mus musculus
aggctgcgccctactacgagcagta

SEQ ID NO: 241400 - DNA, 25 bp, Mus musculus
tactacgagcagtacctccgtctcg

SEQ ID NO: 241401 - DNA, 25 bp, Mus musculus
ggctctcagcaaccttgggaacttc

SEQ ID NO: 241402 - DNA, 25 bp, Mus musculus
gtcgagagcatctcagactgccctc

SEQ ID NO: 241403 - DNA, 25 bp, Mus musculus
cgccggcagcaagagctcctttggc

SEQ ID NO: 241404 - DNA, 25 bp, Mus musculus
ggtcgcggcttccaagatgttcgtt

SEQ ID NO: 241405 - DNA, 25 bp, Mus musculus
acgcgagtgacgtcgagagcatctc

SEQ ID NO: 241406 - DNA, 25 bp, Mus musculus
gcggcttccaagatgttcgttcacg

SEQ ID NO: 241407 - DNA, 25 bp, Mus musculus
agactgccctccactgcgagagctg

SEQ ID NO: 241408 - DNA, 25 bp, Mus musculus
cactgcgagagctgctgctcactgc

SEQ ID NO: 241409 - DNA, 25 bp, Mus musculus
tgctcactgcggctgacctcctgga

SEQ ID NO: 241410 - DNA, 25 bp, Mus musculus
tggacctgcggctgtcagtgaagct

SEQ ID NO: 241411 - DNA, 25 bp, Mus musculus
ctgtcagtgaagctggtggtgctca

SEQ ID NO: 241412 - DNA, 25 bp, Mus musculus
agctggtggtgctcagctcgtccca

SEQ ID NO: 241413 - DNA, 25 bp, Mus musculus
gccgcgtcacagcagacggcctggt

SEQ ID NO: 241414 - DNA, 25 bp, Mus musculus
tggtggcgctgacacgggccttcct

SEQ ID NO: 241415 - DNA, 25 bp, Mus musculus
ggcagcaagagctcctttggccacc

SEQ ID NO: 241416 - DNA, 25 bp, Mus musculus
acgggcgcagacagcattgcctccg

SEQ ID NO: 241417 - DNA, 25 bp, Mus musculus
gcctccgacgccatttctgtgtaca

SEQ ID NO: 241418 - DNA, 25 bp, Mus musculus
cgccatttctgtgtacagtctcagc

SEQ ID NO: 241419 - DNA, 25 bp, Mus musculus
tgtgtacagtctcagctcaatcgcc

SEQ ID NO: 241420 - DNA, 25 bp, Mus musculus
gctcaatcgcctcctccatgagttt

SEQ ID NO: 241421 - DNA, 25 bp, Mus musculus
gcctcctccatgagttttgtctcca

SEQ ID NO: 241422 - DNA, 25 bp, Mus musculus
ccatgagttttgtctccaagcccga

SEQ ID NO: 241423 - DNA, 25 bp, Mus musculus
tgagttttgtctccaagcccgaggg

SEQ ID NO: 241424 - DNA, 25 bp, Mus musculus
cccgaggacgacaggactatgatag

SEQ ID NO: 241425 - DNA, 25 bp, Mus musculus
cgacaggactatgataggtccaaga

SEQ ID NO: 241426 - DNA, 25 bp, Mus musculus
agacagcattgcctccgacgccatt

SEQ ID NO: 241427 - DNA, 25 bp, Mus musculus
agccaccctgccacggcgccagacg

SEQ ID NO: 241428 - DNA, 25 bp, Mus musculus
cacccacccgcaacgagccaccctg

SEQ ID NO: 241429 - DNA, 25 bp, Mus musculus
tgataggtccaagagcacccacccg

SEQ ID NO: 241430 - DNA, 25 bp, Mus musculus
cacttgacaagcagctcgggttttc

SEQ ID NO: 241431 - DNA, 25 bp, Mus musculus
gcccggagccaaaccacttgacaag

SEQ ID NO: 241432 - DNA, 25 bp, Mus musculus
ctcgggttttcagctggctggccca

SEQ ID NO: 241433 - DNA, 25 bp, Mus musculus
gctcaggatacggatcagggacgcc

SEQ ID NO: 241434 - DNA, 25 bp, Mus musculus
ctgcgcggccgcaagcaacattcag

SEQ ID NO: 241435 - DNA, 25 bp, Mus musculus
caagcaacattcagcgaggcggggc

SEQ ID NO: 241436 - DNA, 25 bp, Mus musculus
gcgcggactcactttttcggatgtt

SEQ ID NO: 241437 - DNA, 25 bp, Mus musculus
ttcggatgtttctctcttttcggcc

SEQ ID NO: 241438 - DNA, 25 bp, Mus musculus
tttcgggcctgaatggccagcactg

SEQ ID NO: 241439 - DNA, 25 bp, Mus musculus
agaagacacattaacggtcgggttg

SEQ ID NO: 241440 - DNA, 25 bp, Mus musculus
ttcctggagctcattccgactcggg

SEQ ID NO: 241441 - DNA, 25 bp, Mus musculus
acagtcagccgcaccgggatgcagc

SEQ ID NO: 241442 - DNA, 25 bp, Mus musculus
cggagctgaactcacgccaggaaca

SEQ ID NO: 241443 - DNA, 25 bp, Mus musculus
ctatccgacccgtgcggtacaggca

SEQ ID NO: 241444 - DNA, 25 bp, Mus musculus
actaacgctggcaggaggacgccgc

SEQ ID NO: 241445 - DNA, 25 bp, Mus musculus
agggtcgcccgcaagttcgagcccg

SEQ ID NO: 241446 - DNA, 25 bp, Mus musculus
gtcgcagttggctccttcctggagc

SEQ ID NO: 241447 - DNA, 25 bp, Mus musculus
ctgattaaggaattgtgagtgggtc

SEQ ID NO: 241448 - DNA, 25 bp, Mus musculus
ggttcccggaagatggtgctgatta

SEQ ID NO: 241449 - DNA, 25 bp, Mus musculus
gctacgcttgcgtgttgcgaggccc

SEQ ID NO: 241450 - DNA, 25 bp, Mus musculus
cactgctcgccgagagtacgcaggc

SEQ ID NO: 241451 - DNA, 25 bp, Mus musculus
tgcacagcgccgtgagagactaacg

SEQ ID NO: 241452 - DNA, 25 bp, Mus musculus
ctggaaaccataggctgcacagcgc

SEQ ID NO: 241453 - DNA, 25 bp, Mus musculus
ggtcccgactggagaactcactgga

SEQ ID NO: 241454 - DNA, 25 bp, Mus musculus
tttagggtcccgactggagaactca

SEQ ID NO: 241455 - DNA, 25 bp, Mus musculus
tgcgaactcaacgtcgtttagggtc

SEQ ID NO: 241456 - DNA, 25 bp, Mus musculus
acctgtgcgaactcaacgtcgttta

SEQ ID NO: 241457 - DNA, 25 bp, Mus musculus
cacgcagccgcagtggaggcctcgt

SEQ ID NO: 241458 - DNA, 25 bp, Mus musculus
ggagcaggctgtcatgccctattga

SEQ ID NO: 241459 - DNA, 25 bp, Mus musculus
cccgatcttgggcttgaacatggag

SEQ ID NO: 241460 - DNA, 25 bp, Mus musculus
gtccggatccaggtgcctcatgtct

SEQ ID NO: 241461 - DNA, 25 bp, Mus musculus
agcctcccttcgcagagagttatga

SEQ ID NO: 241462 - DNA, 25 bp, Mus musculus
cggacttccatagttcgggcacctc

SEQ ID NO: 241463 - DNA, 25 bp, Mus musculus
gcctctagcggctcggattctcaca

SEQ ID NO: 241464 - DNA, 25 bp, Mus musculus
aaggagccgtagattccctggaata

SEQ ID NO: 241465 - DNA, 25 bp, Mus musculus
tggaatacaattacccgagcgagcc

SEQ ID NO: 241466 - DNA, 25 bp, Mus musculus
gagccgccctcaggacattttgaca

SEQ ID NO: 241467 - DNA, 25 bp, Mus musculus
tgccacattatgctgcgggtcgcca

SEQ ID NO: 241468 - DNA, 25 bp, Mus musculus
cctcaggcatggtgggtttgtccaa

SEQ ID NO: 241469 - DNA, 25 bp, Mus musculus
gtggaccctgcaataagcgctctgg

SEQ ID NO: 241470 - DNA, 25 bp, Mus musculus
tgcttctgccatgcctagagcctca

SEQ ID NO: 241471 - DNA, 25 bp, Mus musculus
gagccctacggctttcatgcgcgca

SEQ ID NO: 241472 - DNA, 25 bp, Mus musculus
cgcccgtgttatggagagcctgtgc

SEQ ID NO: 241473 - DNA, 25 bp, Mus musculus
cgtactgtggagcgccttgtgctgt

SEQ ID NO: 241474 - DNA, 25 bp, Mus musculus
ctgtgctgtggagcgccttgtgttg

SEQ ID NO: 241475 - DNA, 25 bp, Mus musculus
ccgtgttatggagagcctgtgctgt

SEQ ID NO: 241476 - DNA, 25 bp, Mus musculus
gcccgtgttatggagagcctgtgct

SEQ ID NO: 241477 - DNA, 25 bp, Mus musculus
agtgccttgtgttgtggggcgcccg

SEQ ID NO: 241478 - DNA, 25 bp, Mus musculus
atgttatggagtgccttgtgttgtg

SEQ ID NO: 241479 - DNA, 25 bp, Mus musculus
cccatgttatggagtgccttgtgtt

SEQ ID NO: 241480 - DNA, 25 bp, Mus musculus
cgcccatgttatggagtgccttgtg

SEQ ID NO: 241481 - DNA, 25 bp, Mus musculus
gggcgcccatgttatggagtgcctt

SEQ ID NO: 241482 - DNA, 25 bp, Mus musculus
gcgccttgtgctgtggggcgcccat

SEQ ID NO: 241483 - DNA, 25 bp, Mus musculus
ccgtactgtggagcgccttgtgctg

SEQ ID NO: 241484 - DNA, 25 bp, Mus musculus
cccgtactgtggagcgccttgtgct

SEQ ID NO: 241485 - DNA, 25 bp, Mus musculus
cctgtgctgtggagcgccttgtgtt

SEQ ID NO: 241486 - DNA, 25 bp, Mus musculus
gccttggattggactcgctgagacc

SEQ ID NO: 241487 - DNA, 25 bp, Mus musculus
gctctgtagtgcatccgaagccttg

SEQ ID NO: 241488 - DNA, 25 bp, Mus musculus
agcgcgaagccttgtccatcacgtg

SEQ ID NO: 241489 - DNA, 25 bp, Mus musculus
tgcgacctccgcgttcggtagtaga

SEQ ID NO: 241490 - DNA, 25 bp, Mus musculus
cggtagtagaatttggaatccctgc

SEQ ID NO: 241491 - DNA, 25 bp, Mus musculus
ttggaatccctgcaccgggctaaca

SEQ ID NO: 241492 - DNA, 25 bp, Mus musculus
cgggctaacaatgaagcagagttcc

SEQ ID NO: 241493 - DNA, 25 bp, Mus musculus
ttcctcagcaagctgtggacgcttg

SEQ ID NO: 241494 - DNA, 25 bp, Mus musculus
gaggaaacccacaccaacgagttca

SEQ ID NO: 241495 - DNA, 25 bp, Mus musculus
aacgagttcatcacctggagtcagg

SEQ ID NO: 241496 - DNA, 25 bp, Mus musculus
ctagtgagcgagcacaggtcttatc

SEQ ID NO: 241497 - DNA, 25 bp, Mus musculus
cttatctaaagaaatcacctccgcg

SEQ ID NO: 241498 - DNA, 25 bp, Mus musculus
gcagagttccaacgtgccggctttc

SEQ ID NO: 241499 - DNA, 25 bp, Mus musculus
gcagccaatcgctttgctctgtagt

SEQ ID NO: 241500 - DNA, 25 bp, Mus musculus
ggacacccaagttctctcgcagcgg

SEQ ID NO: 241501 - DNA, 25 bp, Mus musculus
gccggaagatcctcgggcgtcgcct

SEQ ID NO: 241502 - DNA, 25 bp, Mus musculus
tttttatacattcccgcgcggaggc

SEQ ID NO: 241503 - DNA, 25 bp, Mus musculus
cgcggcgcggtcgtttttatacatt

SEQ ID NO: 241504 - DNA, 25 bp, Mus musculus
ctggcgctacttcggaggagcccga

SEQ ID NO: 241505 - DNA, 25 bp, Mus musculus
cgcgattccgcagagcgcctgcgta

SEQ ID NO: 241506 - DNA, 25 bp, Mus musculus
tcctcgctggctccggttcagctta

SEQ ID NO: 241507 - DNA, 25 bp, Mus musculus
aagatcctggcctcgggacggcctc

SEQ ID NO: 241508 - DNA, 25 bp, Mus musculus
aggctggaccacgaccggacaaagc

SEQ ID NO: 241509 - DNA, 25 bp, Mus musculus
gacactcgtgagactcgtcccggga

SEQ ID NO: 241510 - DNA, 25 bp, Mus musculus
accgtaagcacagagacactcgtga

SEQ ID NO: 241511 - DNA, 25 bp, Mus musculus
ttcggctggagagaaaccgtaagca

SEQ ID NO: 241512 - DNA, 25 bp, Mus musculus
aagaggtcgtgctgccatttgtcgg

SEQ ID NO: 241513 - DNA, 25 bp, Mus musculus
caaagcgtcccggaagatcctggcc

SEQ ID NO: 241514 - DNA, 25 bp, Mus musculus
acatcgactcgagttgttctcggtc

SEQ ID NO: 241515 - DNA, 25 bp, Mus musculus
tagcgtgtctgcatggccggtttac

SEQ ID NO: 241516 - DNA, 25 bp, Mus musculus
ggccatccgtgtagcgtgtctgcat

SEQ ID NO: 241517 - DNA, 25 bp, Mus musculus
cacttgcttagctgcgtggctccga

SEQ ID NO: 241518 - DNA, 25 bp, Mus musculus
ggacgtgtgacacttgcttagctgc

SEQ ID NO: 241519 - DNA, 25 bp, Mus musculus
ctgagtgactgggacgtgtgacact

SEQ ID NO: 241520 - DNA, 25 bp, Mus musculus
tctctcccagggatgcctgatagtc

SEQ ID NO: 241521 - DNA, 25 bp, Mus musculus
tcatggacggcaagctgagtgactg

SEQ ID NO: 241522 - DNA, 25 bp, Mus musculus
cgcctggtctctacatcgactcgag

SEQ ID NO: 241523 - DNA, 25 bp, Mus musculus
ttgttctcggtcatggacggcaagc

SEQ ID NO: 241524 - DNA, 25 bp, Mus musculus
tggccggtttacacgcttcttctgg

SEQ ID NO: 241525 - DNA, 25 bp, Mus musculus
cttcttctggttatagccgtctcta

SEQ ID NO: 241526 - DNA, 25 bp, Mus musculus
atgcctgatagtccgcctggtctct

SEQ ID NO: 241527 - DNA, 25 bp, Mus musculus
gttatagccgtctctatcccgcggc

SEQ ID NO: 241528 - DNA, 25 bp, Mus musculus
gttaacagcgcatcctttgtaccga

SEQ ID NO: 241529 - DNA, 25 bp, Mus musculus
cgtggaggagcccattaccgtacac

SEQ ID NO: 241530 - DNA, 25 bp, Mus musculus
ggaggagcccattaccgtacacgtg

SEQ ID NO: 241531 - DNA, 25 bp, Mus musculus
gagcccattaccgtacacgtgttaa

SEQ ID NO: 241532 - DNA, 25 bp, Mus musculus
gcccattaccgtacacgtgttaaca

SEQ ID NO: 241533 - DNA, 25 bp, Mus musculus
ttaccgtacacgtgttaacagcgca

SEQ ID NO: 241534 - DNA, 25 bp, Mus musculus
ccgtacacgtgttaacagcgcatcc

SEQ ID NO: 241535 - DNA, 25 bp, Mus musculus
cttgcccgggtatcgcgggccgaca

SEQ ID NO: 241536 - DNA, 25 bp, Mus musculus
acacgtgttaacagcgcatcctttg

SEQ ID NO: 241537 - DNA, 25 bp, Mus musculus
atgggccagcccgtcttgcccgggt

SEQ ID NO: 241538 - DNA, 25 bp, Mus musculus
ccgcggccggtgatggatgggccag

SEQ ID NO: 241539 - DNA, 25 bp, Mus musculus
atcctttgtaccgacagcgcgggcg

SEQ ID NO: 241540 - DNA, 25 bp, Mus musculus
gcatcctttgtaccgacagcgcggg

SEQ ID NO: 241541 - DNA, 25 bp, Mus musculus
acagcgcatcctttgtaccgacagc

SEQ ID NO: 241542 - DNA, 25 bp, Mus musculus
tggcgcgactcctctccgcagtggg

SEQ ID NO: 241543 - DNA, 25 bp, Mus musculus
gccacgtggcgggacattggctcac

SEQ ID NO: 241544 - DNA, 25 bp, Mus musculus
acattggctcacttgaggggagccc

SEQ ID NO: 241545 - DNA, 25 bp, Mus musculus
cgggagtgtggggttactcatcctt

SEQ ID NO: 241546 - DNA, 25 bp, Mus musculus
gggttactcatccttgcccgtcgca

SEQ ID NO: 241547 - DNA, 25 bp, Mus musculus
cccggagacgcctcctggaaagagc

SEQ ID NO: 241548 - DNA, 25 bp, Mus musculus
cctcctggaaagagcgctctgggga

SEQ ID NO: 241549 - DNA, 25 bp, Mus musculus
ggcagcaaggctgcgcccagctcag

SEQ ID NO: 241550 - DNA, 25 bp, Mus musculus
cgctggcgccgagaaaaacaaaccg

SEQ ID NO: 241551 - DNA, 25 bp, Mus musculus
agcaagttctctctctgccctcgat

SEQ ID NO: 241552 - DNA, 25 bp, Mus musculus
gggcgttttcctggcgcgactcctc

SEQ ID NO: 241553 - DNA, 25 bp, Mus musculus
ccggaatccctctgtccaagaaata

SEQ ID NO: 241554 - DNA, 25 bp, Mus musculus
cgccctagatgtgctgacgcagcgc

SEQ ID NO: 241555 - DNA, 25 bp, Mus musculus
tgtccaagaaataatctcgttcgcg

SEQ ID NO: 241556 - DNA, 25 bp, Mus musculus
ccatagcaacgctggccagtggaga

SEQ ID NO: 241557 - DNA, 25 bp, Mus musculus
gcaaagggctctttgtgcccagctc

SEQ ID NO: 241558 - DNA, 25 bp, Mus musculus
tgtgcccagctcttaacagaactgg

SEQ ID NO: 241559 - DNA, 25 bp, Mus musculus
cggcgtcgtcttcgcgtttactgca

SEQ ID NO: 241560 - DNA, 25 bp, Mus musculus
ctgcagcgcccatgaaattttaatg

SEQ ID NO: 241561 - DNA, 25 bp, Mus musculus
tgaaattttaatgcaggagcggctg

SEQ ID NO: 241562 - DNA, 25 bp, Mus musculus
tcacaaaggggctactgcgagcctc

SEQ ID NO: 241563 - DNA, 25 bp, Mus musculus
gggcacacgaacaagcacccatctt

SEQ ID NO: 241564 - DNA, 25 bp, Mus musculus
acccatcttgcggaccaggactcaa

SEQ ID NO: 241565 - DNA, 25 bp, Mus musculus
ttgccgaggaactctgttaggaaga

SEQ ID NO: 241566 - DNA, 25 bp, Mus musculus
gacccggtatccgtgcttggctctc

SEQ ID NO: 241567 - DNA, 25 bp, Mus musculus
tgcctagaatcccagaagaggaccc

SEQ ID NO: 241568 - DNA, 25 bp, Mus musculus
cgttgccctcccgaggatcaggtgc

SEQ ID NO: 241569 - DNA, 25 bp, Mus musculus
gcgcctaagcgagaagcactgccta

SEQ ID NO: 241570 - DNA, 25 bp, Mus musculus
cagcaagctctaacggcaggggctc

SEQ ID NO: 241571 - DNA, 25 bp, Mus musculus
tgcttgcttcctgcttcacacgtgg

SEQ ID NO: 241572 - DNA, 25 bp, Mus musculus
tgctctgccctgttttgcttgcttc

SEQ ID NO: 241573 - DNA, 25 bp, Mus musculus
gaacgcgtagacctctcttgctctg

SEQ ID NO: 241574 - DNA, 25 bp, Mus musculus
tcgcggcccacggtggttcttaaga

SEQ ID NO: 241575 - DNA, 25 bp, Mus musculus
cctcggccagtaccaggtcagggct

SEQ ID NO: 241576 - DNA, 25 bp, Mus musculus
caaccctctgggcaagcctggagtg

SEQ ID NO: 241577 - DNA, 25 bp, Mus musculus
acgccctgcgtagttaaaggagcca

SEQ ID NO: 241578 - DNA, 25 bp, Mus musculus
gcgccctcaaggatgccgtgcagag

SEQ ID NO: 241579 - DNA, 25 bp, Mus musculus
ctcagcgtctgaacgccagcttgtg

SEQ ID NO: 241580 - DNA, 25 bp, Mus musculus
gggacccaatcctgtacctatagtg

SEQ ID NO: 241581 - DNA, 25 bp, Mus musculus
ctttgctctgcacaccttgggctgg

SEQ ID NO: 241582 - DNA, 25 bp, Mus musculus
actcacagctaggacggggcagaaa

SEQ ID NO: 241583 - DNA, 25 bp, Mus musculus
tgtcgcggctctagcgatagacgtt

SEQ ID NO: 241584 - DNA, 25 bp, Mus musculus
attcctgctaatggtgcgtgacggc

SEQ ID NO: 241585 - DNA, 25 bp, Mus musculus
cgccgaccacgtggagtaccgctat

SEQ ID NO: 241586 - DNA, 25 bp, Mus musculus
tcgctgtgcagcttgggcagcaagt

SEQ ID NO: 241587 - DNA, 25 bp, Mus musculus
gcacacggaacccacggaggatgcg

SEQ ID NO: 241588 - DNA, 25 bp, Mus musculus
gggcgtccgtgcactccatgatcac

SEQ ID NO: 241589 - DNA, 25 bp, Mus musculus
tcaagtcatccgtctacctggcacg

SEQ ID NO: 241590 - DNA, 25 bp, Mus musculus
gaaccagcccgcgtgctgtgtaaca

SEQ ID NO: 241591 - DNA, 25 bp, Mus musculus
ttcattctggaggtgatcgccaagc

SEQ ID NO: 241592 - DNA, 25 bp, Mus musculus
cgcggccatgcaggccttcattctg

SEQ ID NO: 241593 - DNA, 25 bp, Mus musculus
cctggaccaagtctggccgtgagaa

SEQ ID NO: 241594 - DNA, 25 bp, Mus musculus
atcatccctcgtgtgctggccatgc

SEQ ID NO: 241595 - DNA, 25 bp, Mus musculus
catgttggacgcacacccagaggtg

SEQ ID NO: 241596 - DNA, 25 bp, Mus musculus
aggccatgccactcatctttgtggg

SEQ ID NO: 241597 - DNA, 25 bp, Mus musculus
tgatcacgcgcaaggtcaccatcgc

SEQ ID NO: 241598 - DNA, 25 bp, Mus musculus
ctcgtgacgctggtaacgccaagta

SEQ ID NO: 241599 - DNA, 25 bp, Mus musculus
agactccagtgcctggcgacggctc

SEQ ID NO: 241600 - DNA, 25 bp, Mus musculus
acggctcgccctggaacgagacggc

SEQ ID NO: 241601 - DNA, 25 bp, Mus musculus
cgaggctccgtgacgacggctttac

SEQ ID NO: 241602 - DNA, 25 bp, Mus musculus
ggaccctcgcagattcggggacgct

SEQ ID NO: 241603 - DNA, 25 bp, Mus musculus
acgagacggccactcagcctcagtt

SEQ ID NO: 241604 - DNA, 25 bp, Mus musculus
tgacgtatttccgatgcgccggtaa

SEQ ID NO: 241605 - DNA, 25 bp, Mus musculus
ggggtcgcgaggacattttaatctc

SEQ ID NO: 241606 - DNA, 25 bp, Mus musculus
acgccaagtaagactccagtgcctg

SEQ ID NO: 241607 - DNA, 25 bp, Mus musculus
ttaatctctcagtgtcctcgtgacg

SEQ ID NO: 241608 - DNA, 25 bp, Mus musculus
ccgcctctgagcgatgacgtatttc

SEQ ID NO: 241609 - DNA, 25 bp, Mus musculus
atcaccggcccttccgggttgcaga

SEQ ID NO: 241610 - DNA, 25 bp, Mus musculus
ttccgatgggaaccagaagcagcgc

SEQ ID NO: 241611 - DNA, 25 bp, Mus musculus
atgcgccggtaaaggccacatccgg

SEQ ID NO: 241612 - DNA, 25 bp, Mus musculus
aatctccgaggccacgtggcgtggt

SEQ ID NO: 241613 - DNA, 25 bp, Mus musculus
gaaaatctccgaggccacgtggcgt

SEQ ID NO: 241614 - DNA, 25 bp, Mus musculus
tgtccctgtcatccgagtcttgggc

SEQ ID NO: 241615 - DNA, 25 bp, Mus musculus
gtgaaaatctccgaggccacgtggc

SEQ ID NO: 241616 - DNA, 25 bp, Mus musculus
gccgtgaaaatctccgaggccacgt

SEQ ID NO: 241617 - DNA, 25 bp, Mus musculus
atctccgaggccacgtggcgtggtc

SEQ ID NO: 241618 - DNA, 25 bp, Mus musculus
tccagcgccggccctagcgtgtccc

SEQ ID NO: 241619 - DNA, 25 bp, Mus musculus
tccctgtcatccgagtcttgggcgg

SEQ ID NO: 241620 - DNA, 25 bp, Mus musculus
acgcgcttgagtgggcgaaattacc

SEQ ID NO: 241621 - DNA, 25 bp, Mus musculus
tgagtgggcgaaattacccctgtcc

SEQ ID NO: 241622 - DNA, 25 bp, Mus musculus
agcgccgtgaaaatctccgaggcca

SEQ ID NO: 241623 - DNA, 25 bp, Mus musculus
gcgatgtccctgtcatccgagtctt

SEQ ID NO: 241624 - DNA, 25 bp, Mus musculus
gatgtccctgtcatccgagtcttgg

SEQ ID NO: 241625 - DNA, 25 bp, Mus musculus
cctgtcatccgagtcttgggcgggc

SEQ ID NO: 241626 - DNA, 25 bp, Mus musculus
agagtacttaccaggagcgcgccgc

SEQ ID NO: 241627 - DNA, 25 bp, Mus musculus
ccttgctgacactgggattatcctg

SEQ ID NO: 241628 - DNA, 25 bp, Mus musculus
gaggggacaaatccgggcagcgcaa

SEQ ID NO: 241629 - DNA, 25 bp, Mus musculus
gagctctgatctcattcgcttccta

SEQ ID NO: 241630 - DNA, 25 bp, Mus musculus
ttcccgcctgactccagcgccggcc

SEQ ID NO: 241631 - DNA, 25 bp, Mus musculus
ggctcagccaaccagagtggcccag

SEQ ID NO: 241632 - DNA, 25 bp, Mus musculus
tctgatctcattcgcttcctaaata

SEQ ID NO: 241633 - DNA, 25 bp, Mus musculus
ccggggctcagccaaccagagtggc

SEQ ID NO: 241634 - DNA, 25 bp, Mus musculus
taaaaccgaccggacattgagcacc

SEQ ID NO: 241635 - DNA, 25 bp, Mus musculus
cgccacgggcgagcgccgtgaaaat

SEQ ID NO: 241636 - DNA, 25 bp, Mus musculus
ctgtcccacacagaagggacgcgta

SEQ ID NO: 241637 - DNA, 25 bp, Mus musculus
gacactgggattatcctgcctcctg

SEQ ID NO: 241638 - DNA, 25 bp, Mus musculus
cacacagaagggacgcgtatgggca

SEQ ID NO: 241639 - DNA, 25 bp, Mus musculus
gaccggacattgagcaccggggctc

SEQ ID NO: 241640 - DNA, 25 bp, Mus musculus
tgacgtcagcagagtgcgccagagc

SEQ ID NO: 241641 - DNA, 25 bp, Mus musculus
tcacacctcacgtcatcgccaagcc

SEQ ID NO: 241642 - DNA, 25 bp, Mus musculus
gccgccatgctctgacgtcagcaga

SEQ ID NO: 241643 - DNA, 25 bp, Mus musculus
tgaccagcgagggacttccctccgt

SEQ ID NO: 241644 - DNA, 25 bp, Mus musculus
ggctcctgaccagcgagggacttcc

SEQ ID NO: 241645 - DNA, 25 bp, Mus musculus
ctgatccacgcgatcgggccgcagg

SEQ ID NO: 241646 - DNA, 25 bp, Mus musculus
gcgggcgagcctgatccacgcgatc

SEQ ID NO: 241647 - DNA, 25 bp, Mus musculus
acaggctgcgtcacacctcacgtca

SEQ ID NO: 241648 - DNA, 25 bp, Mus musculus
gtgccgccgacgtcacaggctgcgt

SEQ ID NO: 241649 - DNA, 25 bp, Mus musculus
tgctctgacgtcagcagagtgcgcc

SEQ ID NO: 241650 - DNA, 25 bp, Mus musculus
cgctgcactcactcggcctcccgca

SEQ ID NO: 241651 - DNA, 25 bp, Mus musculus
aggcggcgtagcaccgcttcgccgt

SEQ ID NO: 241652 - DNA, 25 bp, Mus musculus
tccgcggagccaccgcgctccaggg

SEQ ID NO: 241653 - DNA, 25 bp, Mus musculus
gcgagcctgatccacgcgatcgggc

SEQ ID NO: 241654 - DNA, 25 bp, Mus musculus
accgagcatcgggtgcgcgcatcag

SEQ ID NO: 241655 - DNA, 25 bp, Mus musculus
tccagctcgagaggcactcagcacg

SEQ ID NO: 241656 - DNA, 25 bp, Mus musculus
cagctcgagaggcactcagcacgca

SEQ ID NO: 241657 - DNA, 25 bp, Mus musculus
tcgagaggcactcagcacgcagccg

SEQ ID NO: 241658 - DNA, 25 bp, Mus musculus
gagaggcactcagcacgcagccggt

SEQ ID NO: 241659 - DNA, 25 bp, Mus musculus
gaggcactcagcacgcagccggtgc

SEQ ID NO: 241660 - DNA, 25 bp, Mus musculus
actcagcacgcagccggtgctaggc

SEQ ID NO: 241661 - DNA, 25 bp, Mus musculus
agcacgcagccggtgctaggcgacc

SEQ ID NO: 241662 - DNA, 25 bp, Mus musculus
tagcatcgtcctcctctgccccgca

SEQ ID NO: 241663 - DNA, 25 bp, Mus musculus
ggcgcatgcatctgccgcgcgtacc

SEQ ID NO: 241664 - DNA, 25 bp, Mus musculus
gtccgggggcttcgcctatcagacg

SEQ ID NO: 241665 - DNA, 25 bp, Mus musculus
cgcggtccagctcgagaggcactca

SEQ ID NO: 241666 - DNA, 25 bp, Mus musculus
ggtccagctcgagaggcactcagca

SEQ ID NO: 241667 - DNA, 25 bp, Mus musculus
tggagaccccgcttacctgcgcggg

SEQ ID NO: 241668 - DNA, 25 bp, Mus musculus
ggaaccggacctctgcgcaatttag

SEQ ID NO: 241669 - DNA, 25 bp, Mus musculus
cagccgagggactttccagtgtaaa

SEQ ID NO: 241670 - DNA, 25 bp, Mus musculus
ggcaactcaacagccgagggacttt

SEQ ID NO: 241671 - DNA, 25 bp, Mus musculus
tgcagagctgccagcggcaactcaa

SEQ ID NO: 241672 - DNA, 25 bp, Mus musculus
gccctgtgtgtcaaagatgtgaccc

SEQ ID NO: 241673 - DNA, 25 bp, Mus musculus
acccaggccctgtgtgtcaaagatg

SEQ ID NO: 241674 - DNA, 25 bp, Mus musculus
ctctgcgcaatttagagatgcgccc

SEQ ID NO: 241675 - DNA, 25 bp, Mus musculus
agtctccagcactccgggtgggaac

SEQ ID NO: 241676 - DNA, 25 bp, Mus musculus
tcgagtttccacaggttcccgtcca

SEQ ID NO: 241677 - DNA, 25 bp, Mus musculus
ggggctactgtcgagtttccacagg

SEQ ID NO: 241678 - DNA, 25 bp, Mus musculus
agcggacgtcttcttgtcgctgcac

SEQ ID NO: 241679 - DNA, 25 bp, Mus musculus
agccttgtgagtgcaagcaggcgat

SEQ ID NO: 241680 - DNA, 25 bp, Mus musculus
tttccagtgtaaagcggacgtcttc

SEQ ID NO: 241681 - DNA, 25 bp, Mus musculus
cccagcgtaaggagccttgtgagtg

SEQ ID NO: 241682 - DNA, 25 bp, Mus musculus
catcgggaacggctcttcttattgc

SEQ ID NO: 241683 - DNA, 25 bp, Mus musculus
atgtgctcggctgcacctctggacc

SEQ ID NO: 241684 - DNA, 25 bp, Mus musculus
ggggccttccgccacgcatcgggaa

SEQ ID NO: 241685 - DNA, 25 bp, Mus musculus
tttacgagatgtgctcggctgcacc

SEQ ID NO: 241686 - DNA, 25 bp, Mus musculus
cggctcttcttattgccacttacga

SEQ ID NO: 241687 - DNA, 25 bp, Mus musculus
gccacttacgataaacctccgcagg

SEQ ID NO: 241688 - DNA, 25 bp, Mus musculus
ttacgataaacctccgcaggacctg

SEQ ID NO: 241689 - DNA, 25 bp, Mus musculus
ccgcaggacctgagatcattaattt

SEQ ID NO: 241690 - DNA, 25 bp, Mus musculus
gagatcattaatttgtttgggaaca

SEQ ID NO: 241691 - DNA, 25 bp, Mus musculus
tttgggaacaaatctcattaaccga

SEQ ID NO: 241692 - DNA, 25 bp, Mus musculus
tctcattaaccgattgcccacgtta

SEQ ID NO: 241693 - DNA, 25 bp, Mus musculus
cgattgcccacgttaatactttacg

SEQ ID NO: 241694 - DNA, 25 bp, Mus musculus
gcccacgttaatactttacgagatg

SEQ ID NO: 241695 - DNA, 25 bp, Mus musculus
gccacgcatcgggaacggctcttct

SEQ ID NO: 241696 - DNA, 25 bp, Mus musculus
cagccggaatcaggcagtgctatcc

SEQ ID NO: 241697 - DNA, 25 bp, Mus musculus
agagcgcccgatgtgtccttgcgaa

SEQ ID NO: 241698 - DNA, 25 bp, Mus musculus
cctactctttttgcggatgctggga

SEQ ID NO: 241699 - DNA, 25 bp, Mus musculus
gaagttagtgatatcgcccggtccc

SEQ ID NO: 241700 - DNA, 25 bp, Mus musculus
cccttaggccctgagaagttagtga

SEQ ID NO: 241701 - DNA, 25 bp, Mus musculus
aggctccaagcagccggatcccaga

SEQ ID NO: 241702 - DNA, 25 bp, Mus musculus
cagagagatccgtgtggtcggtcca

SEQ ID NO: 241703 - DNA, 25 bp, Mus musculus
ccacgggcatcgtagctacggagct

SEQ ID NO: 241704 - DNA, 25 bp, Mus musculus
tcgggtcagccgcaacaactttacc

SEQ ID NO: 241705 - DNA, 25 bp, Mus musculus
cgtgtgttcccagaccagtcgagac

SEQ ID NO: 241706 - DNA, 25 bp, Mus musculus
cagcctaaggcgagagtccttcaga

SEQ ID NO: 241707 - DNA, 25 bp, Mus musculus
gaccgacgaaggacccgcagcctaa

SEQ ID NO: 241708 - DNA, 25 bp, Mus musculus
cggaagcgtctccagactgcaaacg

SEQ ID NO: 241709 - DNA, 25 bp, Mus musculus
ccagaccgaggtccagacagacaga

SEQ ID NO: 241710 - DNA, 25 bp, Mus musculus
ctaagcacagtccagatgcccagta

SEQ ID NO: 241711 - DNA, 25 bp, Mus musculus
ctccggcaggacgaccttcttgctg

SEQ ID NO: 241712 - DNA, 25 bp, Mus musculus
gcaggacgaccttcttgctggcgcg

SEQ ID NO: 241713 - DNA, 25 bp, Mus musculus
tccagatgcccagtactgagtggac

SEQ ID NO: 241714 - DNA, 25 bp, Mus musculus
ccggcgccgtcttgctcttctccat

SEQ ID NO: 241715 - DNA, 25 bp, Mus musculus
gacgtcggccagcacggcctccagg

SEQ ID NO: 241716 - DNA, 25 bp, Mus musculus
ggccacgcgctcctgacccagcctc

SEQ ID NO: 241717 - DNA, 25 bp, Mus musculus
gcacagtccagatgcccagtactga

SEQ ID NO: 241718 - DNA, 25 bp, Mus musculus
tgacccagcctctcaggcaccaggg

SEQ ID NO: 241719 - DNA, 25 bp, Mus musculus
ggaaagaaccgaaggagactggata

SEQ ID NO: 241720 - DNA, 25 bp, Mus musculus
tcaggcaccagggacttcctctccc

SEQ ID NO: 241721 - DNA, 25 bp, Mus musculus
tctttctcacccttagctctctaag

SEQ ID NO: 241722 - DNA, 25 bp, Mus musculus
ctgggctccggcaggacgaccttct

SEQ ID NO: 241723 - DNA, 25 bp, Mus musculus
tagctctctaagcacagtccagatg

SEQ ID NO: 241724 - DNA, 25 bp, Mus musculus
gtccttctgtcggtgaccgtccttg

SEQ ID NO: 241725 - DNA, 25 bp, Mus musculus
gtgccaacccactgagtcatgtgtg

SEQ ID NO: 241726 - DNA, 25 bp, Mus musculus
tgtctgggccactgaaagcttgtcg

SEQ ID NO: 241727 - DNA, 25 bp, Mus musculus
cttgtcgcccaggtactccataggg

SEQ ID NO: 241728 - DNA, 25 bp, Mus musculus
ccggcagagaacatcagcgcaagta

SEQ ID NO: 241729 - DNA, 25 bp, Mus musculus
ccaaccaggtcgtccagttctagtc

SEQ ID NO: 241730 - DNA, 25 bp, Mus musculus
tggggccaaccctgatgaagtcaag

SEQ ID NO: 241731 - DNA, 25 bp, Mus musculus
cacttcctccgtccatgcagggaga

SEQ ID NO: 241732 - DNA, 25 bp, Mus musculus
agggagaactcccatgcacacctgg

SEQ ID NO: 241733 - DNA, 25 bp, Mus musculus
ctccaggctcttctcgtctgaacta

SEQ ID NO: 241734 - DNA, 25 bp, Mus musculus
ctggagactccaaacccgaagccga

SEQ ID NO: 241735 - DNA, 25 bp, Mus musculus
gggacttcatgtgccagactgctta

SEQ ID NO: 241736 - DNA, 25 bp, Mus musculus
cgtcaccaagtgcagagcctcctgg

SEQ ID NO: 241737 - DNA, 25 bp, Mus musculus
cagcaggagcctagagtcaaccaac

SEQ ID NO: 241738 - DNA, 25 bp, Mus musculus
tggcaaagagaaagttggccgcttg

SEQ ID NO: 241739 - DNA, 25 bp, Mus musculus
ccggccgcagattcaacgggatcca

SEQ ID NO: 241740 - DNA, 25 bp, Mus musculus
agcgcgatcccgagacacgcgcgag

SEQ ID NO: 241741 - DNA, 25 bp, Mus musculus
aagggtcagccctggcctgcacagc

SEQ ID NO: 241742 - DNA, 25 bp, Mus musculus
ctccgaaagcaaaaggccacggctt

SEQ ID NO: 241743 - DNA, 25 bp, Mus musculus
gcaggccctcgaggggacagctctc

SEQ ID NO: 241744 - DNA, 25 bp, Mus musculus
agttacacatctttgtcaccgcgga

SEQ ID NO: 241745 - DNA, 25 bp, Mus musculus
ccagtggaagaaagtccaagttaca

SEQ ID NO: 241746 - DNA, 25 bp, Mus musculus
ctgtgcgtggcctggagccgcaact

SEQ ID NO: 241747 - DNA, 25 bp, Mus musculus
agtcccagcgcttctctgtgcgtgg

SEQ ID NO: 241748 - DNA, 25 bp, Mus musculus
gattactgattaaccagtcccagcg

SEQ ID NO: 241749 - DNA, 25 bp, Mus musculus
ctccacctagagtcccgattactga

SEQ ID NO: 241750 - DNA, 25 bp, Mus musculus
cgctaactttgccaactttacacgc

SEQ ID NO: 241751 - DNA, 25 bp, Mus musculus
tggccgcttgaagcctccacctaga

SEQ ID NO: 241752 - DNA, 25 bp, Mus musculus
tacccgtgtgccaaaggagtcgaga

SEQ ID NO: 241753 - DNA, 25 bp, Mus musculus
ttggcgattaatgagcacgtgcacg

SEQ ID NO: 241754 - DNA, 25 bp, Mus musculus
agtgcagagaatcccatacccgtgt

SEQ ID NO: 241755 - DNA, 25 bp, Mus musculus
gtcgccagcaccgacagtgcagaga

SEQ ID NO: 241756 - DNA, 25 bp, Mus musculus
tgtctcttgtgcacagtcgccagca

SEQ ID NO: 241757 - DNA, 25 bp, Mus musculus
cggtagccgtcttgtctcttgtgca

SEQ ID NO: 241758 - DNA, 25 bp, Mus musculus
ggacacagtggtcggtagccgtctt

SEQ ID NO: 241759 - DNA, 25 bp, Mus musculus
aagagcgccgcgatcttgttgcttc

SEQ ID NO: 241760 - DNA, 25 bp, Mus musculus
tttgcccaccttcatgaagagcgcc

SEQ ID NO: 241761 - DNA, 25 bp, Mus musculus
ggagggaagcctttgcccaccttca

SEQ ID NO: 241762 - DNA, 25 bp, Mus musculus
agttcctggaccttgcggctcagct

SEQ ID NO: 241763 - DNA, 25 bp, Mus musculus
tcaatgagttgctccagttcctgga

SEQ ID NO: 241764 - DNA, 25 bp, Mus musculus
ttgttgcttcgcaggaagccggccg

SEQ ID NO: 241765 - DNA, 25 bp, Mus musculus
ctcacgcgctctcaatgagttgctc

SEQ ID NO: 241766 - DNA, 25 bp, Mus musculus
agcccaggatgtagacgtcagaacc

SEQ ID NO: 241767 - DNA, 25 bp, Mus musculus
agttgcctagggtgacctaagatgc

SEQ ID NO: 241768 - DNA, 25 bp, Mus musculus
gtgacctaagatgcggaaccgtgct

SEQ ID NO: 241769 - DNA, 25 bp, Mus musculus
ggaaccgtgctccacatcccgtgtg

SEQ ID NO: 241770 - DNA, 25 bp, Mus musculus
gtgtgtccatccacgcgtatttaga

SEQ ID NO: 241771 - DNA, 25 bp, Mus musculus
atacagcagagcatccgcatccagc

SEQ ID NO: 241772 - DNA, 25 bp, Mus musculus
cttcacagtgcgcagcagcctctgg

SEQ ID NO: 241773 - DNA, 25 bp, Mus musculus
cttacccgcagggaccgaagccatg

SEQ ID NO: 241774 - DNA, 25 bp, Mus musculus
cgcctcctggacagcatacagcaga

SEQ ID NO: 241775 - DNA, 25 bp, Mus musculus
accggcaggggatgaatgacagccc

SEQ ID NO: 241776 - DNA, 25 bp, Mus musculus
tagacgtcagaacctgacatcccgc

SEQ ID NO: 241777 - DNA, 25 bp, Mus musculus
gcgttagcgacaggccttgccaagt

SEQ ID NO: 241778 - DNA, 25 bp, Mus musculus
cctccaggcgttagcgacaggcctt

SEQ ID NO: 241779 - DNA, 25 bp, Mus musculus
aagccatggctcaagctggtcggtg

SEQ ID NO: 241780 - DNA, 25 bp, Mus musculus
actatgctgcgagaaaaggaagtta

SEQ ID NO: 241781 - DNA, 25 bp, Mus musculus
accgccagttaacatactatgctgc

SEQ ID NO: 241782 - DNA, 25 bp, Mus musculus
atggctctccctgcacctagtgagg

SEQ ID NO: 241783 - DNA, 25 bp, Mus musculus
acctagtgaggtgcacgtaaatcga

SEQ ID NO: 241784 - DNA, 25 bp, Mus musculus
gcacgtaaatcgagcaggtctttga

SEQ ID NO: 241785 - DNA, 25 bp, Mus musculus
gtctttgacaaacagccataccgtg

SEQ ID NO: 241786 - DNA, 25 bp, Mus musculus
caaacagccataccgtgaccgtgta

SEQ ID NO: 241787 - DNA, 25 bp, Mus musculus
tagtgagtagaacctgcctccgttg

SEQ ID NO: 241788 - DNA, 25 bp, Mus musculus
acctgcctccgttgctattgcgagc

SEQ ID NO: 241789 - DNA, 25 bp, Mus musculus
ttgctattgcgagcgaccacggaca

SEQ ID NO: 241790 - DNA, 25 bp, Mus musculus
tgcgagcgaccacggacagtctgga

SEQ ID NO: 241791 - DNA, 25 bp, Mus musculus
cagcgataagaaccgccagttaaca

SEQ ID NO: 241792 - DNA, 25 bp, Mus musculus
ccgtgaccgtgtagtgagtagaacc

SEQ ID NO: 241793 - DNA, 25 bp, Mus musculus
cgctatccacaacagcgataagaac

SEQ ID NO: 241794 - DNA, 25 bp, Mus musculus
aggctgcaccgcgtggagacgcaca

SEQ ID NO: 241795 - DNA, 25 bp, Mus musculus
agcatggatcgggaactaggggtcc

SEQ ID NO: 241796 - DNA, 25 bp, Mus musculus
ctaggggtccgggatcaaggatccg

SEQ ID NO: 241797 - DNA, 25 bp, Mus musculus
atccgggtgcgtggagcagaaataa

SEQ ID NO: 241798 - DNA, 25 bp, Mus musculus
tgcgtggagcagaaataagacaagc

SEQ ID NO: 241799 - DNA, 25 bp, Mus musculus
cagaaataagacaagcggggaaggt

SEQ ID NO: 241800 - DNA, 25 bp, Mus musculus
agcagcgcgagctgcgaccacggcc

SEQ ID NO: 241801 - DNA, 25 bp, Mus musculus
gccacgccgcaaagcagagcactta

SEQ ID NO: 241802 - DNA, 25 bp, Mus musculus
gcaaagcagagcacttaccgggagc

SEQ ID NO: 241803 - DNA, 25 bp, Mus musculus
agcacaggctgcaccgcgtggagac

SEQ ID NO: 241804 - DNA, 25 bp, Mus musculus
agacgcacagggacgggttatccca

SEQ ID NO: 241805 - DNA, 25 bp, Mus musculus
cagggacgggttatcccaccagccg

SEQ ID NO: 241806 - DNA, 25 bp, Mus musculus
gacgcggcgccgcttaacgaacggc

SEQ ID NO: 241807 - DNA, 25 bp, Mus musculus
cggccagcgccgaccagcacaggct

SEQ ID NO: 241808 - DNA, 25 bp, Mus musculus
ctgcagactgctccagcagggccgg

SEQ ID NO: 241809 - DNA, 25 bp, Mus musculus
aaactttcctctggccgcggacgcg

SEQ ID NO: 241810 - DNA, 25 bp, Mus musculus
ccggggagatgacaaactttcctct

SEQ ID NO: 241811 - DNA, 25 bp, Mus musculus
cggctccggggagatgacaaacttt

SEQ ID NO: 241812 - DNA, 25 bp, Mus musculus
ctgcagagaggtgacagtcggctcc

SEQ ID NO: 241813 - DNA, 25 bp, Mus musculus
cccaggtaagcagcagccacgggtc

SEQ ID NO: 241814 - DNA, 25 bp, Mus musculus
gggccttggatcacactctcgcact

SEQ ID NO: 241815 - DNA, 25 bp, Mus musculus
gctgcgccctaccaggcacagagag

SEQ ID NO: 241816 - DNA, 25 bp, Mus musculus
gccagcccgcaccacgctcaagcca

SEQ ID NO: 241817 - DNA, 25 bp, Mus musculus
ggagcggggctcagcacactgcaca

SEQ ID NO: 241818 - DNA, 25 bp, Mus musculus
cccgtctcggtgcatttcgccgcag

SEQ ID NO: 241819 - DNA, 25 bp, Mus musculus
ctggccaagtctccaagcagcggca

SEQ ID NO: 241820 - DNA, 25 bp, Mus musculus
gggctcctggccaagtctccaagca

SEQ ID NO: 241821 - DNA, 25 bp, Mus musculus
caggcacagagagctcggcgcttcc

SEQ ID NO: 241822 - DNA, 25 bp, Mus musculus
aggccaggttgcctcgtgcggcctc

SEQ ID NO: 241823 - DNA, 25 bp, Mus musculus
agccaatggcgtgcgccaaccaggg

SEQ ID NO: 241824 - DNA, 25 bp, Mus musculus
acccgcttggcgcagccaatggcgt

SEQ ID NO: 241825 - DNA, 25 bp, Mus musculus
cttgcgcgtgctcacgcggatctca

SEQ ID NO: 241826 - DNA, 25 bp, Mus musculus
ggctcccgcgacacacagtaccgtc

SEQ ID NO: 241827 - DNA, 25 bp, Mus musculus
gttccggatcatggcaccggaggcc

SEQ ID NO: 241828 - DNA, 25 bp, Mus musculus
tgcccgttccggatcatggcaccgg

SEQ ID NO: 241829 - DNA, 25 bp, Mus musculus
acagacagccgcatttccggttttc

SEQ ID NO: 241830 - DNA, 25 bp, Mus musculus
tgcggcctcggaagactccggttcc

SEQ ID NO: 241831 - DNA, 25 bp, Mus musculus
tacactcctaagtgaccggaggcca

SEQ ID NO: 241832 - DNA, 25 bp, Mus musculus
gatgcacccgtgtctgtacgctaca

SEQ ID NO: 241833 - DNA, 25 bp, Mus musculus
agcgcaccgtctgatgcacccgtgt

SEQ ID NO: 241834 - DNA, 25 bp, Mus musculus
gcatttccggttttcggggagcgca

SEQ ID NO: 241835 - DNA, 25 bp, Mus musculus
atgcgctgatctcccggacccttca

SEQ ID NO: 241836 - DNA, 25 bp, Mus musculus
cgaatggtggacacggcactacgta

SEQ ID NO: 241837 - DNA, 25 bp, Mus musculus
ggtttgtcatctgcccatctatcta

SEQ ID NO: 241838 - DNA, 25 bp, Mus musculus
catctatctagtggcgggctgacgc

SEQ ID NO: 241839 - DNA, 25 bp, Mus musculus
cccgagttcgtgaggaactatgccc

SEQ ID NO: 241840 - DNA, 25 bp, Mus musculus
cacgcacacgctggactggctcaag

SEQ ID NO: 241841 - DNA, 25 bp, Mus musculus
ctggctcaagtttggcaagaccgtc

SEQ ID NO: 241842 - DNA, 25 bp, Mus musculus
caagaccgtcctggtggtgcacttc

SEQ ID NO: 241843 - DNA, 25 bp, Mus musculus
cttcgaggacctgaagcaggacttg

SEQ ID NO: 241844 - DNA, 25 bp, Mus musculus
caggacttgtttacgcagctgggcc

SEQ ID NO: 241845 - DNA, 25 bp, Mus musculus
aggacggcaacttcaagcgctcggg

SEQ ID NO: 241846 - DNA, 25 bp, Mus musculus
caagctggagtatgacccttacaca

SEQ ID NO: 241847 - DNA, 25 bp, Mus musculus
cacagccgagatgcgcaggaccatt

SEQ ID NO: 241848 - DNA, 25 bp, Mus musculus
attgccgcctacatccgaatggtgg

SEQ ID NO: 241849 - DNA, 25 bp, Mus musculus
ttcaggcgtccggaaggtttgtcat

SEQ ID NO: 241850 - DNA, 25 bp, Mus musculus
ttcccatgaatgttggcggtgtccc

SEQ ID NO: 241851 - DNA, 25 bp, Mus musculus
aagacggggatcaggaagccgcaaa

SEQ ID NO: 241852 - DNA, 25 bp, Mus musculus
gagctcaagaagaaagccaggaccc

SEQ ID NO: 241853 - DNA, 25 bp, Mus musculus
cgctgcagcttgaagacgatggtaa

SEQ ID NO: 241854 - DNA, 25 bp, Mus musculus
agccaggacccagacggccgagcag

SEQ ID NO: 241855 - DNA, 25 bp, Mus musculus
gcaggttatcttcccatgaatgttg

SEQ ID NO: 241856 - DNA, 25 bp, Mus musculus
agttgttgaagcaggttatcttccc

SEQ ID NO: 241857 - DNA, 25 bp, Mus musculus
acggccgagcaggtcatgtaggcca

SEQ ID NO: 241858 - DNA, 25 bp, Mus musculus
accctgtggaaactacttgcgagtg

SEQ ID NO: 241859 - DNA, 25 bp, Mus musculus
acgtgtctgctgtaccctgtggaaa

SEQ ID NO: 241860 - DNA, 25 bp, Mus musculus
agtgaccgccacgtgtctgctgtac

SEQ ID NO: 241861 - DNA, 25 bp, Mus musculus
aagcgggtgacagtgaccgccacgt

SEQ ID NO: 241862 - DNA, 25 bp, Mus musculus
gcttgaagacgatggtaaggtagca

SEQ ID NO: 241863 - DNA, 25 bp, Mus musculus
atgttggcggtgtcccggaagacaa

SEQ ID NO: 241864 - DNA, 25 bp, Mus musculus
ctagctctagaacccggaagcgcgg

SEQ ID NO: 241865 - DNA, 25 bp, Mus musculus
agccgctgcacaggccgcgcgaagt

SEQ ID NO: 241866 - DNA, 25 bp, Mus musculus
aagccgaagtctgctgggctcgagc

SEQ ID NO: 241867 - DNA, 25 bp, Mus musculus
ccgcttcgggagtaagccgaagtct

SEQ ID NO: 241868 - DNA, 25 bp, Mus musculus
ccgtccgtccaatggcgaggcgacg

SEQ ID NO: 241869 - DNA, 25 bp, Mus musculus
gagacagccaatccgccgcggcaag

SEQ ID NO: 241870 - DNA, 25 bp, Mus musculus
ggggatgctctagctagctctagaa

SEQ ID NO: 241871 - DNA, 25 bp, Mus musculus
gacagccaatggaagcggcatcatc

SEQ ID NO: 241872 - DNA, 25 bp, Mus musculus
ccatgcacacaagcgacagccaatg

SEQ ID NO: 241873 - DNA, 25 bp, Mus musculus
ggacgcaaatgctcgccctagccgg

SEQ ID NO: 241874 - DNA, 25 bp, Mus musculus
cgggaaaacaggacgcaaatgctcg

SEQ ID NO: 241875 - DNA, 25 bp, Mus musculus
caagggcggccgtccgtccaatggc

SEQ ID NO: 241876 - DNA, 25 bp, Mus musculus
cacaggccgcgcgaagtgatgacgt

SEQ ID NO: 241877 - DNA, 25 bp, Mus musculus
gcggatggacaagtcgagacagcca

SEQ ID NO: 241878 - DNA, 25 bp, Mus musculus
gcagaggtccgagtactaccatgta

SEQ ID NO: 241879 - DNA, 25 bp, Mus musculus
acactggacacgttgctccttgcca

SEQ ID NO: 241880 - DNA, 25 bp, Mus musculus
tgtacatccaccctttcatcgacgg

SEQ ID NO: 241881 - DNA, 25 bp, Mus musculus
ttcatcgacggcaacgggaggacct

SEQ ID NO: 241882 - DNA, 25 bp, Mus musculus
gaggacctcccgtctgctgatgaac

SEQ ID NO: 241883 - DNA, 25 bp, Mus musculus
cgtctgctgatgaacctgattttga

SEQ ID NO: 241884 - DNA, 25 bp, Mus musculus
tgattttgatgcaggcgggataccc

SEQ ID NO: 241885 - DNA, 25 bp, Mus musculus
tcaccatccgcaaggagcagaggtc

SEQ ID NO: 241886 - DNA, 25 bp, Mus musculus
ctaccatgtactggaagtcgccaac

SEQ ID NO: 241887 - DNA, 25 bp, Mus musculus
cgtgcggcctttcatccgcttcata

SEQ ID NO: 241888 - DNA, 25 bp, Mus musculus
cttcatagccaagtgtacggaggtc

SEQ ID NO: 241889 - DNA, 25 bp, Mus musculus
tacggaggtcacactggacacgttg

SEQ ID NO: 241890 - DNA, 25 bp, Mus musculus
actggaagtcgccaacgagggtgac

SEQ ID NO: 241891 - DNA, 25 bp, Mus musculus
ggccctggcccattacaaactggtg

SEQ ID NO: 241892 - DNA, 25 bp, Mus musculus
cgcgtccgttttgctcccaggattt

SEQ ID NO: 241893 - DNA, 25 bp, Mus musculus
agcgttgctgtttccctctgcactg

SEQ ID NO: 241894 - DNA, 25 bp, Mus musculus
ttctcgaggtcggaaaagcgttgct

SEQ ID NO: 241895 - DNA, 25 bp, Mus musculus
tgggaaaagtctcatctctcgaata

SEQ ID NO: 241896 - DNA, 25 bp, Mus musculus
ccgcgatcggatgcaccatctcatg

SEQ ID NO: 241897 - DNA, 25 bp, Mus musculus
cgaccctcaagtgcggacaagattg

SEQ ID NO: 241898 - DNA, 25 bp, Mus musculus
tcgtcgctttggactaaagaccttc

SEQ ID NO: 241899 - DNA, 25 bp, Mus musculus
cgaggcgccatcttaggaaggtcaa

SEQ ID NO: 241900 - DNA, 25 bp, Mus musculus
ccagggacgtatgcatgatcgaatc

SEQ ID NO: 241901 - DNA, 25 bp, Mus musculus
gtccgtagttaaggtcgaggcgcca

SEQ ID NO: 241902 - DNA, 25 bp, Mus musculus
ccggctacaaccgtggacagctgtc

SEQ ID NO: 241903 - DNA, 25 bp, Mus musculus
cgagcataacctgcgtccggctaca

SEQ ID NO: 241904 - DNA, 25 bp, Mus musculus
gcggcgtctgcctgatcaaaactcc

SEQ ID NO: 241905 - DNA, 25 bp, Mus musculus
ctccatgggtgaaacggctacctcg

SEQ ID NO: 241906 - DNA, 25 bp, Mus musculus
ccacccaggtctttagaaccagagc

SEQ ID NO: 241907 - DNA, 25 bp, Mus musculus
aggtcttcagggtccaggaggccat

SEQ ID NO: 241908 - DNA, 25 bp, Mus musculus
ccaggaggccatgcactgcgagcca

SEQ ID NO: 241909 - DNA, 25 bp, Mus musculus
gcaggctcttcgcagcgctcagaca

SEQ ID NO: 241910 - DNA, 25 bp, Mus musculus
tcctgtcagccgagagcttcacacg

SEQ ID NO: 241911 - DNA, 25 bp, Mus musculus
tgatgtcatcctagccatctcggcg

SEQ ID NO: 241912 - DNA, 25 bp, Mus musculus
aggtcccggttagatgcccggctct

SEQ ID NO: 241913 - DNA, 25 bp, Mus musculus
agcgggcgttcttaagctccaccca

SEQ ID NO: 241914 - DNA, 25 bp, Mus musculus
acggccctgcagagcctctctatga

SEQ ID NO: 241915 - DNA, 25 bp, Mus musculus
cctctctatgaggatggtcgtttga

SEQ ID NO: 241916 - DNA, 25 bp, Mus musculus
atggtcgtttgagcgcatctaactg

SEQ ID NO: 241917 - DNA, 25 bp, Mus musculus
tctaactgcccaccgagtccgtgag

SEQ ID NO: 241918 - DNA, 25 bp, Mus musculus
agtccgtgagcagggcttggtttcc

SEQ ID NO: 241919 - DNA, 25 bp, Mus musculus
cctgagcgcgcgctgcttaccagag

SEQ ID NO: 241920 - DNA, 25 bp, Mus musculus
gcaagacgagcccaaaacgcaccaa

SEQ ID NO: 241921 - DNA, 25 bp, Mus musculus
aacgcaccaacacgggcacgcaggg

SEQ ID NO: 241922 - DNA, 25 bp, Mus musculus
tgctgagccaagtctcacgcagaca

SEQ ID NO: 241923 - DNA, 25 bp, Mus musculus
ggcccagattccagctggcaacttc

SEQ ID NO: 241924 - DNA, 25 bp, Mus musculus
tccagctggcaacttcctgggcctg

SEQ ID NO: 241925 - DNA, 25 bp, Mus musculus
ggtttactccgaggccttaagctca

SEQ ID NO: 241926 - DNA, 25 bp, Mus musculus
gaggccttaagctcatcaggggaag

SEQ ID NO: 241927 - DNA, 25 bp, Mus musculus
cccgattaagcagcatgagctcagg

SEQ ID NO: 241928 - DNA, 25 bp, Mus musculus
agagcctttcctggtgccctgcgat

SEQ ID NO: 241929 - DNA, 25 bp, Mus musculus
gtgccctgcgatctggaagcatccc

SEQ ID NO: 241930 - DNA, 25 bp, Mus musculus
ggcgcatgctcagtcaccgggacgc

SEQ ID NO: 241931 - DNA, 25 bp, Mus musculus
ggctcacctcgctgttgcttgcgga

SEQ ID NO: 241932 - DNA, 25 bp, Mus musculus
atgcgcatgcgccagtgaccggcct

SEQ ID NO: 241933 - DNA, 25 bp, Mus musculus
ctgaagggtcaccaaggccatcgcg

SEQ ID NO: 241934 - DNA, 25 bp, Mus musculus
cggtactcacggcaactgcctgagc

SEQ ID NO: 241935 - DNA, 25 bp, Mus musculus
caggagcccacggtcctctgattgg

SEQ ID NO: 241936 - DNA, 25 bp, Mus musculus
ccaccgccgggagaccgacaggagt

SEQ ID NO: 241937 - DNA, 25 bp, Mus musculus
tgcccgggagacaaagccagccgct

SEQ ID NO: 241938 - DNA, 25 bp, Mus musculus
agccctgcccgggagacaaagccag

SEQ ID NO: 241939 - DNA, 25 bp, Mus musculus
gatgctggacagctctaccgcttcc

SEQ ID NO: 241940 - DNA, 25 bp, Mus musculus
agcaccgggatgctggacagctcta

SEQ ID NO: 241941 - DNA, 25 bp, Mus musculus
tccggctttcagcaccgggatgctg

SEQ ID NO: 241942 - DNA, 25 bp, Mus musculus
agcaagggccggtgctccggctttc

SEQ ID NO: 241943 - DNA, 25 bp, Mus musculus
acccttacatggtggagcaagggcc

SEQ ID NO: 241944 - DNA, 25 bp, Mus musculus
cgagcctgggcatgacccttacatg

SEQ ID NO: 241945 - DNA, 25 bp, Mus musculus
agatcctcctccatgtccgcggtgc

SEQ ID NO: 241946 - DNA, 25 bp, Mus musculus
ccacggtcctctgattggggtgtct

SEQ ID NO: 241947 - DNA, 25 bp, Mus musculus
ctgcctgagctggaacagatcctcc

SEQ ID NO: 241948 - DNA, 25 bp, Mus musculus
tgcggttgctaggagcaaaggaacc

SEQ ID NO: 241949 - DNA, 25 bp, Mus musculus
aaggctcatagcttccgaagtggtc

SEQ ID NO: 241950 - DNA, 25 bp, Mus musculus
ggaaacctcccttagcaacgaatca

SEQ ID NO: 241951 - DNA, 25 bp, Mus musculus
cttagcaacgaatcaggctgcggtt

SEQ ID NO: 241952 - DNA, 25 bp, Mus musculus
aggggtcgtccgttcactatttcag

SEQ ID NO: 241953 - DNA, 25 bp, Mus musculus
ttcagtccggtgtgactaacttccg

SEQ ID NO: 241954 - DNA, 25 bp, Mus musculus
tgtgactaacttccggtccgtcctc

SEQ ID NO: 241955 - DNA, 25 bp, Mus musculus
accgcgggttcctccactttgcgag

SEQ ID NO: 241956 - DNA, 25 bp, Mus musculus
tccactttgcgagcctcctgtcttg

SEQ ID NO: 241957 - DNA, 25 bp, Mus musculus
tgtcttgggctcctcattccgctgc

SEQ ID NO: 241958 - DNA, 25 bp, Mus musculus
cagcgagcgcgatgctaagttcccg

SEQ ID NO: 241959 - DNA, 25 bp, Mus musculus
cgatgctaagttcccgggcgcaggc

SEQ ID NO: 241960 - DNA, 25 bp, Mus musculus
ggcggagcaaatgcgaaggctcata

SEQ ID NO: 241961 - DNA, 25 bp, Mus musculus
ccgttcactatttcagtccggtgtg

SEQ ID NO: 241962 - DNA, 25 bp, Mus musculus
ggcggtgcatggaatccagaattcg

SEQ ID NO: 241963 - DNA, 25 bp, Mus musculus
tgaccctgcgaggtggcacagaccc

SEQ ID NO: 241964 - DNA, 25 bp, Mus musculus
gatatcggcgaagtgccggcagccc

SEQ ID NO: 241965 - DNA, 25 bp, Mus musculus
atccagaattcgtgcggaggcagga

SEQ ID NO: 241966 - DNA, 25 bp, Mus musculus
gtgtgttccctagccggactctgca

SEQ ID NO: 241967 - DNA, 25 bp, Mus musculus
ggtcgcccagtctgtgtgttcccta

SEQ ID NO: 241968 - DNA, 25 bp, Mus musculus
cccagaaggctggtctggtcgccca

SEQ ID NO: 241969 - DNA, 25 bp, Mus musculus
accctgcgtcccagaaggctggtct

SEQ ID NO: 241970 - DNA, 25 bp, Mus musculus
ataggaagtcgaggtggcgctcaac

SEQ ID NO: 241971 - DNA, 25 bp, Mus musculus
accagagagtcggtgataggaagtc

SEQ ID NO: 241972 - DNA, 25 bp, Mus musculus
gccaagagaacggaaccagagagtc

SEQ ID NO: 241973 - DNA, 25 bp, Mus musculus
tatgcctctctaggccaagagaacg

SEQ ID NO: 241974 - DNA, 25 bp, Mus musculus
cggcgcgcagatatgcctctctagg

SEQ ID NO: 241975 - DNA, 25 bp, Mus musculus
gcttgcggctgacgatatcggcgaa

SEQ ID NO: 241976 - DNA, 25 bp, Mus musculus
ggctgccatcgctcctttgactgcg

SEQ ID NO: 241977 - DNA, 25 bp, Mus musculus
gctcctttgactgcgcttccggctt

SEQ ID NO: 241978 - DNA, 25 bp, Mus musculus
gctcagcagctttgcgctccgagcg

SEQ ID NO: 241979 - DNA, 25 bp, Mus musculus
gatgcgtgacacctacggacgagca

SEQ ID NO: 241980 - DNA, 25 bp, Mus musculus
cagccgccttcctcaggatgcgtga

SEQ ID NO: 241981 - DNA, 25 bp, Mus musculus
aggctggttattgccgccgctcgcc

SEQ ID NO: 241982 - DNA, 25 bp, Mus musculus
cacctgataggagccaggctggtta

SEQ ID NO: 241983 - DNA, 25 bp, Mus musculus
acttcggacagctccggccagttcg

SEQ ID NO: 241984 - DNA, 25 bp, Mus musculus
aagtgcctggcacttcggacagctc

SEQ ID NO: 241985 - DNA, 25 bp, Mus musculus
gcccgtgtagacaaccaagtgcctg

SEQ ID NO: 241986 - DNA, 25 bp, Mus musculus
ctgtgctgattccagcgcccgtgta

SEQ ID NO: 241987 - DNA, 25 bp, Mus musculus
gcaggccctcactcactgtgctgat

SEQ ID NO: 241988 - DNA, 25 bp, Mus musculus
tccgggtcatcacacacctgatagg

SEQ ID NO: 241989 - DNA, 25 bp, Mus musculus
tccggcagctacagagacgcatgcg

SEQ ID NO: 241990 - DNA, 25 bp, Mus musculus
cagctcagacgcgtcctacaaagga

SEQ ID NO: 241991 - DNA, 25 bp, Mus musculus
gtcttcctagcacaagctgacccga

SEQ ID NO: 241992 - DNA, 25 bp, Mus musculus
cggtgtaatcacagctcagaccttc

SEQ ID NO: 241993 - DNA, 25 bp, Mus musculus
ggaagttcacgcttctcccagggaa

SEQ ID NO: 241994 - DNA, 25 bp, Mus musculus
gaggctcgcccagttacccagaaaa

SEQ ID NO: 241995 - DNA, 25 bp, Mus musculus
ttcggaattcgagagctttggctgc

SEQ ID NO: 241996 - DNA, 25 bp, Mus musculus
tgggtcaggtctctgcacagacaca

SEQ ID NO: 241997 - DNA, 25 bp, Mus musculus
gggagcctgccctgtagcttaagtc

SEQ ID NO: 241998 - DNA, 25 bp, Mus musculus
tggcctcaccaggaacttgtccatc

SEQ ID NO: 241999 - DNA, 25 bp, Mus musculus
ctttgccgaataggacggtgtaatc

SEQ ID NO: 242000 - DNA, 25 bp, Mus musculus
cggaaaatcttgtctgcctcggctt

SEQ ID NO: 242001 - DNA, 25 bp, Mus musculus
tcgcacaagcctaacgcacgtaaga

SEQ ID NO: 242002 - DNA, 25 bp, Mus musculus
gaaggcgcatcctgtcctcgcacaa

SEQ ID NO: 242003 - DNA, 25 bp, Mus musculus
ctacacatgggaagacgcaagcgca

SEQ ID NO: 242004 - DNA, 25 bp, Mus musculus
cagctcgtccgcatccagaggaaca

SEQ ID NO: 242005 - DNA, 25 bp, Mus musculus
gcatgatcggccagaagaccctata

SEQ ID NO: 242006 - DNA, 25 bp, Mus musculus
cctgcccttgtatagtccaatcaga

SEQ ID NO: 242007 - DNA, 25 bp, Mus musculus
ccgcctcagagtcaatcggtgtgca

SEQ ID NO: 242008 - DNA, 25 bp, Mus musculus
acatctaccaatggggacggagctc

SEQ ID NO: 242009 - DNA, 25 bp, Mus musculus
cgccatgccgagacatctaccaatg

SEQ ID NO: 242010 - DNA, 25 bp, Mus musculus
tagaggtccaaaacaaccgcgcgcg

SEQ ID NO: 242011 - DNA, 25 bp, Mus musculus
cgtggtccaatcaaaagcggcaagg

SEQ ID NO: 242012 - DNA, 25 bp, Mus musculus
ctgctcctcgcgtggtccaatcaaa

SEQ ID NO: 242013 - DNA, 25 bp, Mus musculus
tcgccgcagagccaatcagtgtgca

SEQ ID NO: 242014 - DNA, 25 bp, Mus musculus
gccacgccgaggcactagccaatag

SEQ ID NO: 242015 - DNA, 25 bp, Mus musculus
caccttaggggttcaacacagccgc

SEQ ID NO: 242016 - DNA, 25 bp, Mus musculus
tgctcggacagactgggacacctta

SEQ ID NO: 242017 - DNA, 25 bp, Mus musculus
gccagactgggacaccttagaggtc

SEQ ID NO: 242018 - DNA, 25 bp, Mus musculus
ctgagcatgcgcagtagacgtgccg

SEQ ID NO: 242019 - DNA, 25 bp, Mus musculus
ttccctaagggtcagttacagggca

SEQ ID NO: 242020 - DNA, 25 bp, Mus musculus
ctctggagctgtccaactctgagca

SEQ ID NO: 242021 - DNA, 25 bp, Mus musculus
taaatttccctctctggagctgtcc

SEQ ID NO: 242022 - DNA, 25 bp, Mus musculus
cgtcgcagctcgatccgtttttaaa

SEQ ID NO: 242023 - DNA, 25 bp, Mus musculus
tgcaatttggccaccgtcgcagctc

SEQ ID NO: 242024 - DNA, 25 bp, Mus musculus
acagggcagggtcaaggagatttca

SEQ ID NO: 242025 - DNA, 25 bp, Mus musculus
tccaactttgcaaacaggcgagctg

SEQ ID NO: 242026 - DNA, 25 bp, Mus musculus
agcgagaggcgcacgcacagaacca

SEQ ID NO: 242027 - DNA, 25 bp, Mus musculus
ctcgctgtctgcaatttggccaccg

SEQ ID NO: 242028 - DNA, 25 bp, Mus musculus
tccgagaaagttgagcccgcgctac

SEQ ID NO: 242029 - DNA, 25 bp, Mus musculus
tgcggctgcgccctgaacgccgaag

SEQ ID NO: 242030 - DNA, 25 bp, Mus musculus
cgcaacttcatagctcgctctgcag

SEQ ID NO: 242031 - DNA, 25 bp, Mus musculus
ccgcgacaaggtccaggagcgcaga

SEQ ID NO: 242032 - DNA, 25 bp, Mus musculus
gtcaggcgtttagtcccacttctgg

SEQ ID NO: 242033 - DNA, 25 bp, Mus musculus
cctttccgtctgctaaagaagatga

SEQ ID NO: 242034 - DNA, 25 bp, Mus musculus
ctcctccatgggcaaagaagcagtg

SEQ ID NO: 242035 - DNA, 25 bp, Mus musculus
cgaccacggctcctttcatttgaag

SEQ ID NO: 242036 - DNA, 25 bp, Mus musculus
gccgagtcttggtttgagtgaagtc

SEQ ID NO: 242037 - DNA, 25 bp, Mus musculus
cagtgcggaactgttgtttcccgga

SEQ ID NO: 242038 - DNA, 25 bp, Mus musculus
aggcaggaaacacccagctcgctca

SEQ ID NO: 242039 - DNA, 25 bp, Mus musculus
tttcccggaactgaataattgcttg

SEQ ID NO: 242040 - DNA, 25 bp, Mus musculus
cccaagaggtgttcggagcacaaca

SEQ ID NO: 242041 - DNA, 25 bp, Mus musculus
cggggcctcgaacggataaagatct

SEQ ID NO: 242042 - DNA, 25 bp, Mus musculus
taaagatctccggactgcgggtagc

SEQ ID NO: 242043 - DNA, 25 bp, Mus musculus
tcaccatgaaaagtcggaggacgcc

SEQ ID NO: 242044 - DNA, 25 bp, Mus musculus
cagagggactcttcttaaagcgttc

SEQ ID NO: 242045 - DNA, 25 bp, Mus musculus
cggagtctccaaatccggactgaga

SEQ ID NO: 242046 - DNA, 25 bp, Mus musculus
tcaggccacatagagcacgtcatcg

SEQ ID NO: 242047 - DNA, 25 bp, Mus musculus
tgccttcgtgtcctcgatctgagcg

SEQ ID NO: 242048 - DNA, 25 bp, Mus musculus
ccttggaactctcccatctgatatg

SEQ ID NO: 242049 - DNA, 25 bp, Mus musculus
attggcctcaggaagacacacccgc

SEQ ID NO: 242050 - DNA, 25 bp, Mus musculus
ggagcccttagctccagctctctga

SEQ ID NO: 242051 - DNA, 25 bp, Mus musculus
gacccaatctgtaaaggagccctta

SEQ ID NO: 242052 - DNA, 25 bp, Mus musculus
ttcggcttgcttgaagttcccattg

SEQ ID NO: 242053 - DNA, 25 bp, Mus musculus
ccagctcttgattcccattggatta

SEQ ID NO: 242054 - DNA, 25 bp, Mus musculus
aatcgctgtttcctattggcctggg

SEQ ID NO: 242055 - DNA, 25 bp, Mus musculus
cgcacggtaacgcatccaagactga

SEQ ID NO: 242056 - DNA, 25 bp, Mus musculus
gagccacacagccatgcgcacggta

SEQ ID NO: 242057 - DNA, 25 bp, Mus musculus
cacggctctggaaacggggacacag

SEQ ID NO: 242058 - DNA, 25 bp, Mus musculus
tcctcctccgtgttgagttactctc

SEQ ID NO: 242059 - DNA, 25 bp, Mus musculus
tcggtgtgatgtacccacggaaaca

SEQ ID NO: 242060 - DNA, 25 bp, Mus musculus
tggtaaccgcctctcggctgcagct

SEQ ID NO: 242061 - DNA, 25 bp, Mus musculus
tctcctgcgaggatgcgccgcctga

SEQ ID NO: 242062 - DNA, 25 bp, Mus musculus
tggagcacagtctcctgcgaggatg

SEQ ID NO: 242063 - DNA, 25 bp, Mus musculus
ctcccgccggacgtatggagcacag

SEQ ID NO: 242064 - DNA, 25 bp, Mus musculus
tgcaaccctccgaggagacggactc

SEQ ID NO: 242065 - DNA, 25 bp, Mus musculus
ggccgctgcaggtgcgtgcaaccct

SEQ ID NO: 242066 - DNA, 25 bp, Mus musculus
tcattctcggcgctgctctctgcaa

SEQ ID NO: 242067 - DNA, 25 bp, Mus musculus
ccgcgaggctacatcccagtctctg

SEQ ID NO: 242068 - DNA, 25 bp, Mus musculus
atctgctggtcctcagcgccaaggc

SEQ ID NO: 242069 - DNA, 25 bp, Mus musculus
tgctggatctgctggtcctcagcgc

SEQ ID NO: 242070 - DNA, 25 bp, Mus musculus
gcggcgctcgagcaccataccgggt

SEQ ID NO: 242071 - DNA, 25 bp, Mus musculus
cacgggagagacctgtgcgccgacc

SEQ ID NO: 242072 - DNA, 25 bp, Mus musculus
tccgacttcggacggcgcttccgga

SEQ ID NO: 242073 - DNA, 25 bp, Mus musculus
cggctgcagctgattgggccgtaac

SEQ ID NO: 242074 - DNA, 25 bp, Mus musculus
gcgggccgggaattgctgctctccc

SEQ ID NO: 242075 - DNA, 25 bp, Mus musculus
ccgtaattcaatcaggcagcgattc

SEQ ID NO: 242076 - DNA, 25 bp, Mus musculus
ttcaatcaggcagcgattccttggg

SEQ ID NO: 242077 - DNA, 25 bp, Mus musculus
atcaggcagcgattccttggggctg

SEQ ID NO: 242078 - DNA, 25 bp, Mus musculus
cgagaacgagaaggcgcgcacaaaa

SEQ ID NO: 242079 - DNA, 25 bp, Mus musculus
gcgcgcacaaaagggccgctttatt

SEQ ID NO: 242080 - DNA, 25 bp, Mus musculus
gccggagccgcctttattgtgttaa

SEQ ID NO: 242081 - DNA, 25 bp, Mus musculus
cgcctttattgtgttaacccatttg

SEQ ID NO: 242082 - DNA, 25 bp, Mus musculus
attgtgttaacccatttgcgtgtca

SEQ ID NO: 242083 - DNA, 25 bp, Mus musculus
cccatttgcgtgtcaagagctattg

SEQ ID NO: 242084 - DNA, 25 bp, Mus musculus
cgtgtcaagagctattgtgcgcttt

SEQ ID NO: 242085 - DNA, 25 bp, Mus musculus
aagagctattgtgcgctttctcgcc

SEQ ID NO: 242086 - DNA, 25 bp, Mus musculus
cgtattcatgaaccgtaattcaatc

SEQ ID NO: 242087 - DNA, 25 bp, Mus musculus
gagccgcctttattgtgttaaccca

SEQ ID NO: 242088 - DNA, 25 bp, Mus musculus
gcacaccgccggctaccagggcctt

SEQ ID NO: 242089 - DNA, 25 bp, Mus musculus
gagggcaagcggactaaactgtcgc

SEQ ID NO: 242090 - DNA, 25 bp, Mus musculus
cgcacggtcaatggctacgacacca

SEQ ID NO: 242091 - DNA, 25 bp, Mus musculus
agcggactaaactgtcgccggccac

SEQ ID NO: 242092 - DNA, 25 bp, Mus musculus
gatgcctacgcggagaaggtagcca

SEQ ID NO: 242093 - DNA, 25 bp, Mus musculus
cccaaaagcgtgctcaagagtgtgg

SEQ ID NO: 242094 - DNA, 25 bp, Mus musculus
cgccgtctcctcgagtgctcatgcg

SEQ ID NO: 242095 - DNA, 25 bp, Mus musculus
ttctggccatcgtcaaggccgccgt

SEQ ID NO: 242096 - DNA, 25 bp, Mus musculus
ccagggccttctggccatcgtcaag

SEQ ID NO: 242097 - DNA, 25 bp, Mus musculus
gctacgacaccagcggccagcgtta

SEQ ID NO: 242098 - DNA, 25 bp, Mus musculus
acaagcacctgagccgcacggtcaa

SEQ ID NO: 242099 - DNA, 25 bp, Mus musculus
agtgccgcagcacaagcacctgagc

SEQ ID NO: 242100 - DNA, 25 bp, Mus musculus
caacatccgagtgccgcagcacaag

SEQ ID NO: 242101 - DNA, 25 bp, Mus musculus
cgcggagaaggtagccaacagtccc

SEQ ID NO: 242102 - DNA, 25 bp, Mus musculus
cacaggtgactttcgtggtggcgtc

SEQ ID NO: 242103 - DNA, 25 bp, Mus musculus
tggtagaaaaaagcccgcgaggcac

SEQ ID NO: 242104 - DNA, 25 bp, Mus musculus
tgccacgcgccctacctaagtggag

SEQ ID NO: 242105 - DNA, 25 bp, Mus musculus
acacccatcaaaggctggtagaaaa

SEQ ID NO: 242106 - DNA, 25 bp, Mus musculus
gcagctcacacccatcaaaggctgg

SEQ ID NO: 242107 - DNA, 25 bp, Mus musculus
gggaacccgcttgcccggcagctca

SEQ ID NO: 242108 - DNA, 25 bp, Mus musculus
cattcatccctggttcctgcgccca

SEQ ID NO: 242109 - DNA, 25 bp, Mus musculus
ccactcacctcaggacgcgggcgca

SEQ ID NO: 242110 - DNA, 25 bp, Mus musculus
ggtgacctagatctgcaccacactc

SEQ ID NO: 242111 - DNA, 25 bp, Mus musculus
tcgtggtggcgtcgcctcccgctat

SEQ ID NO: 242112 - DNA, 25 bp, Mus musculus
gtctaggtgacctagatctgcacca

SEQ ID NO: 242113 - DNA, 25 bp, Mus musculus
tcggcgcccaatccacaggtgactt

SEQ ID NO: 242114 - DNA, 25 bp, Mus musculus
ccctacctaagtggagctggtccgg

SEQ ID NO: 242115 - DNA, 25 bp, Mus musculus
tcgcgaggaactcgcggatcccttc

SEQ ID NO: 242116 - DNA, 25 bp, Mus musculus
cggaagtggactgtgcccgcccact

SEQ ID NO: 242117 - DNA, 25 bp, Mus musculus
tgcagacagacccacgaaagaactg

SEQ ID NO: 242118 - DNA, 25 bp, Mus musculus
actgtcaggtgctgaccgcgcagca

SEQ ID NO: 242119 - DNA, 25 bp, Mus musculus
atgagacttttggaagcctgaagtc

SEQ ID NO: 242120 - DNA, 25 bp, Mus musculus
cctgaagtcagaatgcggaagtgga

SEQ ID NO: 242121 - DNA, 25 bp, Mus musculus
atctgtcgtcggcatcaggcacacg

SEQ ID NO: 242122 - DNA, 25 bp, Mus musculus
cgtggaggatgcttcgatctgtcgt

SEQ ID NO: 242123 - DNA, 25 bp, Mus musculus
gacctcggcgttacagatgaggaaa

SEQ ID NO: 242124 - DNA, 25 bp, Mus musculus
acttaagcctggtaagacctcggcg

SEQ ID NO: 242125 - DNA, 25 bp, Mus musculus
tcgtcttgcagataccgcggtaatg

SEQ ID NO: 242126 - DNA, 25 bp, Mus musculus
gctccaaaccgctgcagtcgtcttg

SEQ ID NO: 242127 - DNA, 25 bp, Mus musculus
gggtgcagtttttacactctcgcta

SEQ ID NO: 242128 - DNA, 25 bp, Mus musculus
ccggacacgcggaaactacatctca

SEQ ID NO: 242129 - DNA, 25 bp, Mus musculus
cagcaaagacgcgtgcggacagcgc

SEQ ID NO: 242130 - DNA, 25 bp, Mus musculus
cgtcacatgatgtttggtcacgtgg

SEQ ID NO: 242131 - DNA, 25 bp, Mus musculus
tgcaatgcctccttcggagcctttg

SEQ ID NO: 242132 - DNA, 25 bp, Mus musculus
gcctccaactcacaggtctgtcaaa

SEQ ID NO: 242133 - DNA, 25 bp, Mus musculus
gatcgagccctgtctcccgactaga

SEQ ID NO: 242134 - DNA, 25 bp, Mus musculus
tgtctcccgactagaccggccgata

SEQ ID NO: 242135 - DNA, 25 bp, Mus musculus
cccagcgtcagcaggagcaccgagt

SEQ ID NO: 242136 - DNA, 25 bp, Mus musculus
ggagcaccgagtgacctcatgctga

SEQ ID NO: 242137 - DNA, 25 bp, Mus musculus
tcatgctgatgactcagcacgtctc

SEQ ID NO: 242138 - DNA, 25 bp, Mus musculus
gccgctcctcagacgtcacatgatg

SEQ ID NO: 242139 - DNA, 25 bp, Mus musculus
ttccattcatgaagcggcgacgcgg

SEQ ID NO: 242140 - DNA, 25 bp, Mus musculus
gagcccaagaaccaggcaaggatgc

SEQ ID NO: 242141 - DNA, 25 bp, Mus musculus
ttggtcacgtgggttccattcatga

SEQ ID NO: 242142 - DNA, 25 bp, Mus musculus
ccgacggacacctgatgagtcagca

SEQ ID NO: 242143 - DNA, 25 bp, Mus musculus
gacgcggctggcctaagcttaaagg

SEQ ID NO: 242144 - DNA, 25 bp, Mus musculus
gccccacgcggacatggccttgctc

SEQ ID NO: 242145 - DNA, 25 bp, Mus musculus
ccccacgcggacatggccttgctcc

SEQ ID NO: 242146 - DNA, 25 bp, Mus musculus
actcctcgcgccgttgctgcccgta

SEQ ID NO: 242147 - DNA, 25 bp, Mus musculus
ctcctcgcgccgttgctgcccgtac

SEQ ID NO: 242148 - DNA, 25 bp, Mus musculus
tcctcgcgccgttgctgcccgtacc

SEQ ID NO: 242149 - DNA, 25 bp, Mus musculus
cctcgcgccgttgctgcccgtaccg

SEQ ID NO: 242150 - DNA, 25 bp, Mus musculus
ctcgcgccgttgctgcccgtaccgc

SEQ ID NO: 242151 - DNA, 25 bp, Mus musculus
gtaccgcttcagctcacgcagttcg

SEQ ID NO: 242152 - DNA, 25 bp, Mus musculus
taccgcttcagctcacgcagttcgt

SEQ ID NO: 242153 - DNA, 25 bp, Mus musculus
accgcttcagctcacgcagttcgtg

SEQ ID NO: 242154 - DNA, 25 bp, Mus musculus
ccgcttcagctcacgcagttcgtgg

SEQ ID NO: 242155 - DNA, 25 bp, Mus musculus
cgcttcagctcacgcagttcgtgga

SEQ ID NO: 242156 - DNA, 25 bp, Mus musculus
tgggccccacgcggacatggccttg

SEQ ID NO: 242157 - DNA, 25 bp, Mus musculus
ggccccacgcggacatggccttgct

SEQ ID NO: 242158 - DNA, 25 bp, Mus musculus
aaggcgggatcagtgaccacgtctg

SEQ ID NO: 242159 - DNA, 25 bp, Mus musculus
ttgtactccaacacgtgccgcttga

SEQ ID NO: 242160 - DNA, 25 bp, Mus musculus
acacgtgccgcttgatcttggatga

SEQ ID NO: 242161 - DNA, 25 bp, Mus musculus
ggtgacaaagtcctccatgctgcga

SEQ ID NO: 242162 - DNA, 25 bp, Mus musculus
cgagaaaggcgggatcagtgaccac

SEQ ID NO: 242163 - DNA, 25 bp, Mus musculus
agcaaagtaggcaagcggcggcggc

SEQ ID NO: 242164 - DNA, 25 bp, Mus musculus
cgcagagttccagtgagccgcgcgt

SEQ ID NO: 242165 - DNA, 25 bp, Mus musculus
agcgtacagcttgtccaacagcgcc

SEQ ID NO: 242166 - DNA, 25 bp, Mus musculus
cgcgcacgcggaatgggtcgcgttc

SEQ ID NO: 242167 - DNA, 25 bp, Mus musculus
ctcagctggttgtagcgcgtgtact

SEQ ID NO: 242168 - DNA, 25 bp, Mus musculus
tgtagcgcgtgtactcctcgcgccg

SEQ ID NO: 242169 - DNA, 25 bp, Mus musculus
cacgcagttcgtggaggttgtggtc

SEQ ID NO: 242170 - DNA, 25 bp, Mus musculus
gctcctcattgtactccaacacgtg

SEQ ID NO: 242171 - DNA, 25 bp, Mus musculus
gagtcgcagagttccagtgagccgc

SEQ ID NO: 242172 - DNA, 25 bp, Mus musculus
ctcgatctgccggtctgcgggcagc

SEQ ID NO: 242173 - DNA, 25 bp, Mus musculus
tccgaccaatcgaagcccgccgccc

SEQ ID NO: 242174 - DNA, 25 bp, Mus musculus
cgccgcgcccttccgaccaatcgaa

SEQ ID NO: 242175 - DNA, 25 bp, Mus musculus
aggggctctgccaatgggcgcccac

SEQ ID NO: 242176 - DNA, 25 bp, Mus musculus
ccctcaggggctctgccaatgggcg

SEQ ID NO: 242177 - DNA, 25 bp, Mus musculus
gccggagccatggagcactcggccc

SEQ ID NO: 242178 - DNA, 25 bp, Mus musculus
ttccgcccgcgcctcgcagcgagcg

SEQ ID NO: 242179 - DNA, 25 bp, Mus musculus
tcccgggacgccagcgtcgccactt

SEQ ID NO: 242180 - DNA, 25 bp, Mus musculus
tcgaggcccttggtgatgccccagc

SEQ ID NO: 242181 - DNA, 25 bp, Mus musculus
cgccatttcggggtcgaggcccttg

SEQ ID NO: 242182 - DNA, 25 bp, Mus musculus
ccagcagcgccatttcggggtcgag

SEQ ID NO: 242183 - DNA, 25 bp, Mus musculus
ggtgctcggccagcagcgccatttc

SEQ ID NO: 242184 - DNA, 25 bp, Mus musculus
gaagcgcgggcgtcttgcacctggt

SEQ ID NO: 242185 - DNA, 25 bp, Mus musculus
gcagcggcttgagcaggtgctcggc

SEQ ID NO: 242186 - DNA, 25 bp, Mus musculus
catgagtcagaggttaggctgggcc

SEQ ID NO: 242187 - DNA, 25 bp, Mus musculus
ggaggaagtttgtccatcgccgtgc

SEQ ID NO: 242188 - DNA, 25 bp, Mus musculus
gggacgtggcatccttgtagccgcg

SEQ ID NO: 242189 - DNA, 25 bp, Mus musculus
cacggagtgcatgagtcagaggtta

SEQ ID NO: 242190 - DNA, 25 bp, Mus musculus
cttcggacacggagtgcatgagtca

SEQ ID NO: 242191 - DNA, 25 bp, Mus musculus
cgaacttcggacacggagtgcatga

SEQ ID NO: 242192 - DNA, 25 bp, Mus musculus
ccgcgaacttcggacacggagtgca

SEQ ID NO: 242193 - DNA, 25 bp, Mus musculus
cttctccgcgaacttcggacacgga

SEQ ID NO: 242194 - DNA, 25 bp, Mus musculus
cgaggaaacggctggcgtctgtgca

SEQ ID NO: 242195 - DNA, 25 bp, Mus musculus
gctgcccggcaaccggcgaggaaac

SEQ ID NO: 242196 - DNA, 25 bp, Mus musculus
ttgtccatcgccgtgctccgttgtc

SEQ ID NO: 242197 - DNA, 25 bp, Mus musculus
aagtttgtccatcgccgtgctccgt

SEQ ID NO: 242198 - DNA, 25 bp, Mus musculus
aggaagtttgtccatcgccgtgctc

SEQ ID NO: 242199 - DNA, 25 bp, Mus musculus
tgatcgagctaaggccggcgaccct

SEQ ID NO: 242200 - DNA, 25 bp, Mus musculus
tggacaagaagaaacccaggccagc

SEQ ID NO: 242201 - DNA, 25 bp, Mus musculus
tcgtctcggttaccaaggtactgtg

SEQ ID NO: 242202 - DNA, 25 bp, Mus musculus
ccagactagccggaagaaaggagcc

SEQ ID NO: 242203 - DNA, 25 bp, Mus musculus
ggagccgagagagaatctcagcacc

SEQ ID NO: 242204 - DNA, 25 bp, Mus musculus
ggaagcccacttggaagccaacgcg

SEQ ID NO: 242205 - DNA, 25 bp, Mus musculus
caacgcgcgcgaaagcacgtctctg

SEQ ID NO: 242206 - DNA, 25 bp, Mus musculus
taccaaggtactgtggttctgcgtg

SEQ ID NO: 242207 - DNA, 25 bp, Mus musculus
tctgcacatgggctatgaggacagg

SEQ ID NO: 242208 - DNA, 25 bp, Mus musculus
cccaccgggagtaggtaggccgcat

SEQ ID NO: 242209 - DNA, 25 bp, Mus musculus
gtaggccgcatgctacgtcacctgc

SEQ ID NO: 242210 - DNA, 25 bp, Mus musculus
atgctacgtcacctgcgtcagtctc

SEQ ID NO: 242211 - DNA, 25 bp, Mus musculus
gcgtcagtctctcgcctgtcaactt

SEQ ID NO: 242212 - DNA, 25 bp, Mus musculus
tctgcgtggcaagccagactagccg

SEQ ID NO: 242213 - DNA, 25 bp, Mus musculus
gcacgtctctgcacatgggctatga

SEQ ID NO: 242214 - DNA, 25 bp, Mus musculus
ccgaggagaatgcactaggtcagtc

SEQ ID NO: 242215 - DNA, 25 bp, Mus musculus
gccttagaagcacgggtcctgttta

SEQ ID NO: 242216 - DNA, 25 bp, Mus musculus
cttgcaggttgcactggacgacttc

SEQ ID NO: 242217 - DNA, 25 bp, Mus musculus
atctcccgggagacaacagttaagt

SEQ ID NO: 242218 - DNA, 25 bp, Mus musculus
tcaggagagtatctggtgccagctc

SEQ ID NO: 242219 - DNA, 25 bp, Mus musculus
agttgccacgcagtcctccattaga

SEQ ID NO: 242220 - DNA, 25 bp, Mus musculus
gtggacaaccatcgttctcatctga

SEQ ID NO: 242221 - DNA, 25 bp, Mus musculus
cgacttcgtggcagttgtaaacatc

SEQ ID NO: 242222 - DNA, 25 bp, Mus musculus
tctgggcagacacagcacttgcttc

SEQ ID NO: 242223 - DNA, 25 bp, Mus musculus
agcgcctgaagtcgtaacccaaaga

SEQ ID NO: 242224 - DNA, 25 bp, Mus musculus
tgtgcatattgtgagccaacctgga

SEQ ID NO: 242225 - DNA, 25 bp, Mus musculus
tgggccacaatcctgaatctgaatg

SEQ ID NO: 242226 - DNA, 25 bp, Mus musculus
gggaacaaccgctcccgtctggaga

SEQ ID NO: 242227 - DNA, 25 bp, Mus musculus
gtgcctgtctctagatgctctcgca

SEQ ID NO: 242228 - DNA, 25 bp, Mus musculus
tgaaacccgcactgcacggagcgcg

SEQ ID NO: 242229 - DNA, 25 bp, Mus musculus
ccgcaacaccgcgtagggctggctt

SEQ ID NO: 242230 - DNA, 25 bp, Mus musculus
aaacccgcactgcacggagcgcggg

SEQ ID NO: 242231 - DNA, 25 bp, Mus musculus
accgcgtagggctggctttgctccg

SEQ ID NO: 242232 - DNA, 25 bp, Mus musculus
tggtgaattatggttctgcgcagag

SEQ ID NO: 242233 - DNA, 25 bp, Mus musculus
aattatggttctgcgcagagggttc

SEQ ID NO: 242234 - DNA, 25 bp, Mus musculus
tatggttctgcgcagagggttccaa

SEQ ID NO: 242235 - DNA, 25 bp, Mus musculus
ggttctgcgcagagggttccaaagc

SEQ ID NO: 242236 - DNA, 25 bp, Mus musculus
cgcaacaccgcgtagggctggcttt

SEQ ID NO: 242237 - DNA, 25 bp, Mus musculus
caacaccgcgtagggctggctttgc

SEQ ID NO: 242238 - DNA, 25 bp, Mus musculus
tctgcctccgcaacaccgcgtaggg

SEQ ID NO: 242239 - DNA, 25 bp, Mus musculus
caccgcgtagggctggctttgctcc

SEQ ID NO: 242240 - DNA, 25 bp, Mus musculus
atggttctgcgcagagggttccaaa

SEQ ID NO: 242241 - DNA, 25 bp, Mus musculus
gtggtgaattatggttctgcgcaga

SEQ ID NO: 242242 - DNA, 25 bp, Mus musculus
agcacctcgtaggaccggctctgct

SEQ ID NO: 242243 - DNA, 25 bp, Mus musculus
tgcgcgcggagggttccaaaactgt

SEQ ID NO: 242244 - DNA, 25 bp, Mus musculus
gtgggatggtgaattatggttgcgc

SEQ ID NO: 242245 - DNA, 25 bp, Mus musculus
gcgctgcaaggagcgaggggacgcc

SEQ ID NO: 242246 - DNA, 25 bp, Mus musculus
acccgcgctgcaaggagcgagggga

SEQ ID NO: 242247 - DNA, 25 bp, Mus musculus
tgaaacccgcgctgcaaggagcgag

SEQ ID NO: 242248 - DNA, 25 bp, Mus musculus
ctgaaacccgcgctgcaaggagcga

SEQ ID NO: 242249 - DNA, 25 bp, Mus musculus
cacctcgtaggaccggctctgctcc

SEQ ID NO: 242250 - DNA, 25 bp, Mus musculus
gcagcacctcgtaggaccggctctg

SEQ ID NO: 242251 - DNA, 25 bp, Mus musculus
cgcgcggagggttccaaaactgtgg

SEQ ID NO: 242252 - DNA, 25 bp, Mus musculus
atggtgaattatggttgcgcgcgga

SEQ ID NO: 242253 - DNA, 25 bp, Mus musculus
cccgccctgtacaagctccccacgc

SEQ ID NO: 242254 - DNA, 25 bp, Mus musculus
ctgctccggcggcaacccggggctc

SEQ ID NO: 242255 - DNA, 25 bp, Mus musculus
cctgaccaactttgggggtgggatg

SEQ ID NO: 242256 - DNA, 25 bp, Mus musculus
ggacagctcagcaccctgatctgtc

SEQ ID NO: 242257 - DNA, 25 bp, Mus musculus
gtcgtcatcgtagcgctctgcctgc

SEQ ID NO: 242258 - DNA, 25 bp, Mus musculus
tgtcgtcatcgtagcgctctgcctg

SEQ ID NO: 242259 - DNA, 25 bp, Mus musculus
atgtcgtcatcgtagcgctctgcct

SEQ ID NO: 242260 - DNA, 25 bp, Mus musculus
catgtcgtcatcgtagcgctctgcc

SEQ ID NO: 242261 - DNA, 25 bp, Mus musculus
gcagtggccatgtcgtcatcgtagc

SEQ ID NO: 242262 - DNA, 25 bp, Mus musculus
atgcagtggccatgtcgtcatcgta

SEQ ID NO: 242263 - DNA, 25 bp, Mus musculus
gacagctcagcaccctgatctgtca

SEQ ID NO: 242264 - DNA, 25 bp, Mus musculus
tggacagctcagcaccctgatctgt

SEQ ID NO: 242265 - DNA, 25 bp, Mus musculus
tcgtcatcgtagcgctctgcctgct

SEQ ID NO: 242266 - DNA, 25 bp, Mus musculus
tgcagtggccatgtcgtcatcgtag

SEQ ID NO: 242267 - DNA, 25 bp, Mus musculus
cagcaccctgatctgtcacggcttt

SEQ ID NO: 242268 - DNA, 25 bp, Mus musculus
tcagcaccctgatctgtcacggctt

SEQ ID NO: 242269 - DNA, 25 bp, Mus musculus
ttggacagctcagcaccctgatctg

SEQ ID NO: 242270 - DNA, 25 bp, Mus musculus
cgcccagcggtgcaatgagcgattc

SEQ ID NO: 242271 - DNA, 25 bp, Mus musculus
ccagcggtgcaatgagcgattcgga

SEQ ID NO: 242272 - DNA, 25 bp, Mus musculus
ggtgcaatgagcgattcggagaaca

SEQ ID NO: 242273 - DNA, 25 bp, Mus musculus
tgcaatgagcgattcggagaacagc

SEQ ID NO: 242274 - DNA, 25 bp, Mus musculus
gggtgcgagccatggcgtcctgacg

SEQ ID NO: 242275 - DNA, 25 bp, Mus musculus
gcaatgagcgattcggagaacagca

SEQ ID NO: 242276 - DNA, 25 bp, Mus musculus
atgagcgattcggagaacagcagca

SEQ ID NO: 242277 - DNA, 25 bp, Mus musculus
agcgattcggagaacagcagcagta

SEQ ID NO: 242278 - DNA, 25 bp, Mus musculus
gtagcagcagcgatgcggaggaatt

SEQ ID NO: 242279 - DNA, 25 bp, Mus musculus
agcagcgatgcggaggaattggcac

SEQ ID NO: 242280 - DNA, 25 bp, Mus musculus
atgcggaggaattggcacgctgtcg

SEQ ID NO: 242281 - DNA, 25 bp, Mus musculus
gtaggggactttctggggctcaggc

SEQ ID NO: 242282 - DNA, 25 bp, Mus musculus
gcctgaaacggatgcgtggtggggt

SEQ ID NO: 242283 - DNA, 25 bp, Mus musculus
cacgctgtcgcgaggcggctacgcc

SEQ ID NO: 242284 - DNA, 25 bp, Mus musculus
tcacgtgagcgtgttttgggcacgt

SEQ ID NO: 242285 - DNA, 25 bp, Mus musculus
acctattcgtggtgagtgcgggctt

SEQ ID NO: 242286 - DNA, 25 bp, Mus musculus
ccatggcggaacagacctattcgtg

SEQ ID NO: 242287 - DNA, 25 bp, Mus musculus
ccgagaggcagcaccatggcggaac

SEQ ID NO: 242288 - DNA, 25 bp, Mus musculus
cctgtcctccgtgcgagcgagtgaa

SEQ ID NO: 242289 - DNA, 25 bp, Mus musculus
gagtctgtcggagcccgactgcctg

SEQ ID NO: 242290 - DNA, 25 bp, Mus musculus
ccgccatgttgggtttggagccgca

SEQ ID NO: 242291 - DNA, 25 bp, Mus musculus
cgcgggaacccgaatgcagcgctct

SEQ ID NO: 242292 - DNA, 25 bp, Mus musculus
atgcagcgctctgtccgcattttga

SEQ ID NO: 242293 - DNA, 25 bp, Mus musculus
tccgcattttgacagttgactggca

SEQ ID NO: 242294 - DNA, 25 bp, Mus musculus
ttgacagttgactggcagctgagga

SEQ ID NO: 242295 - DNA, 25 bp, Mus musculus
ttcgagccgcgcagcggaaccgact

SEQ ID NO: 242296 - DNA, 25 bp, Mus musculus
tgacagctgagtggcagtcaaccgc

SEQ ID NO: 242297 - DNA, 25 bp, Mus musculus
ggtgtgcttcgagcggcctcgcctc

SEQ ID NO: 242298 - DNA, 25 bp, Mus musculus
tgcccgcgcgttagaagtgccgccg

SEQ ID NO: 242299 - DNA, 25 bp, Mus musculus
tgcattcgtgggagactcgcacttg

SEQ ID NO: 242300 - DNA, 25 bp, Mus musculus
atgttgccctccactgccgtgaagt

SEQ ID NO: 242301 - DNA, 25 bp, Mus musculus
gaagtccagcgggaagctctccacc

SEQ ID NO: 242302 - DNA, 25 bp, Mus musculus
tggcaatgtcactccggcctgtggc

SEQ ID NO: 242303 - DNA, 25 bp, Mus musculus
gggcgcgcaagacactgctgctcct

SEQ ID NO: 242304 - DNA, 25 bp, Mus musculus
caatgcagactctgggtgcgctggc

SEQ ID NO: 242305 - DNA, 25 bp, Mus musculus
gggctgcgctcactcttttcttggc

SEQ ID NO: 242306 - DNA, 25 bp, Mus musculus
accacaagtctgacggaggggcctg

SEQ ID NO: 242307 - DNA, 25 bp, Mus musculus
gaggggcctggactaacccgttgca

SEQ ID NO: 242308 - DNA, 25 bp, Mus musculus
cttttcttggcggaggcttagcctt

SEQ ID NO: 242309 - DNA, 25 bp, Mus musculus
aacgttcacctagtgccgctggggc

SEQ ID NO: 242310 - DNA, 25 bp, Mus musculus
tcgcatacttggaaccgcccggagt

SEQ ID NO: 242311 - DNA, 25 bp, Mus musculus
ggcgcaggatgcgaacgttcaccta

SEQ ID NO: 242312 - DNA, 25 bp, Mus musculus
cacctctacggagagggccacgggc

SEQ ID NO: 242313 - DNA, 25 bp, Mus musculus
tccgcactcacctctacggagaggg

SEQ ID NO: 242314 - DNA, 25 bp, Mus musculus
gccgccaggatctccgccctgtgac

SEQ ID NO: 242315 - DNA, 25 bp, Mus musculus
gcccactcgtctgcccggggccaca

SEQ ID NO: 242316 - DNA, 25 bp, Mus musculus
cgcagccactgggtgctgcccactc

SEQ ID NO: 242317 - DNA, 25 bp, Mus musculus
ctaccaaactaggacaaaggccacg

SEQ ID NO: 242318 - DNA, 25 bp, Mus musculus
gaggctaccaaactaggacaaaggc

SEQ ID NO: 242319 - DNA, 25 bp, Mus musculus
ccggccagaggctaccaaactagga

SEQ ID NO: 242320 - DNA, 25 bp, Mus musculus
gggaaaagcgccgagcaggagcccg

SEQ ID NO: 242321 - DNA, 25 bp, Mus musculus
cttgcaccggccagaggctaccaaa

SEQ ID NO: 242322 - DNA, 25 bp, Mus musculus
cagagtctgggccttgcaccggcca

SEQ ID NO: 242323 - DNA, 25 bp, Mus musculus
gatccctcagagtctgggccttgca

SEQ ID NO: 242324 - DNA, 25 bp, Mus musculus
caggagcccggatccctcagagtct

SEQ ID NO: 242325 - DNA, 25 bp, Mus musculus
tggcgatgagggacccgcgggaaaa

SEQ ID NO: 242326 - DNA, 25 bp, Mus musculus
tgttgttttattgttgggacgaatc

SEQ ID NO: 242327 - DNA, 25 bp, Mus musculus
agcggaacgaggagcccaacaacca

SEQ ID NO: 242328 - DNA, 25 bp, Mus musculus
ggagcccaacaaccaccaccgtgtc

SEQ ID NO: 242329 - DNA, 25 bp, Mus musculus
ccggatcccggaagggagaggagct

SEQ ID NO: 242330 - DNA, 25 bp, Mus musculus
cgcatgcgccacgtggggcctttac

SEQ ID NO: 242331 - DNA, 25 bp, Mus musculus
ctttacggcaggagtcgtgaggcat

SEQ ID NO: 242332 - DNA, 25 bp, Mus musculus
caggagtcgtgaggcatcgccgaca

SEQ ID NO: 242333 - DNA, 25 bp, Mus musculus
ggcatcgccgacagaggccgtaatc

SEQ ID NO: 242334 - DNA, 25 bp, Mus musculus
agaggccgtaatccgtcgccttcca

SEQ ID NO: 242335 - DNA, 25 bp, Mus musculus
agcaacctagctccgccttgcgggt

SEQ ID NO: 242336 - DNA, 25 bp, Mus musculus
tagctccgccttgcgggttcactgc

SEQ ID NO: 242337 - DNA, 25 bp, Mus musculus
acggaccagcggaacgaggagccca

SEQ ID NO: 242338 - DNA, 25 bp, Mus musculus
cactgctcccgcctcgtttttgttg

SEQ ID NO: 242339 - DNA, 25 bp, Mus musculus
tgggacgaatccggcttttcctgga

SEQ ID NO: 242340 - DNA, 25 bp, Mus musculus
gagcgcattcttccttacgataagc

SEQ ID NO: 242341 - DNA, 25 bp, Mus musculus
acactgatatccacgtcgacgctct

SEQ ID NO: 242342 - DNA, 25 bp, Mus musculus
gcatacgtactgacgtcctcggaga

SEQ ID NO: 242343 - DNA, 25 bp, Mus musculus
tatcgaacgaaacggcccacactga

SEQ ID NO: 242344 - DNA, 25 bp, Mus musculus
aacgccggtgtgaactgatatcgaa

SEQ ID NO: 242345 - DNA, 25 bp, Mus musculus
actcacgtggcaccaacggtccgga

SEQ ID NO: 242346 - DNA, 25 bp, Mus musculus
tcacacgtgtttctgctgctaggga

SEQ ID NO: 242347 - DNA, 25 bp, Mus musculus
gcgggaactcgtagatgtgctcaca

SEQ ID NO: 242348 - DNA, 25 bp, Mus musculus
agattcttcatttcctcacagccag

SEQ ID NO: 242349 - DNA, 25 bp, Mus musculus
tcgatcatccggaaacctgtcactg

SEQ ID NO: 242350 - DNA, 25 bp, Mus musculus
tcccggaagtagtgccgctcgatca

SEQ ID NO: 242351 - DNA, 25 bp, Mus musculus
agtcaaaggtcttcagcagccgctc

SEQ ID NO: 242352 - DNA, 25 bp, Mus musculus
tgctagggatgcagaagccaaaatc

SEQ ID NO: 242353 - DNA, 25 bp, Mus musculus
ataagccaaatgttctgccctcaga

SEQ ID NO: 242354 - DNA, 25 bp, Mus musculus
gggttcgacccgctcatcgctccac

SEQ ID NO: 242355 - DNA, 25 bp, Mus musculus
ccctcagcagcacggcccgagcaga

SEQ ID NO: 242356 - DNA, 25 bp, Mus musculus
gtcggcagcactcgacccggcccag

SEQ ID NO: 242357 - DNA, 25 bp, Mus musculus
cactcactctcggtgacccggttga

SEQ ID NO: 242358 - DNA, 25 bp, Mus musculus
cactctcggtgacccggttgaggcg

SEQ ID NO: 242359 - DNA, 25 bp, Mus musculus
agcagctcctgctccgtgacggcgg

SEQ ID NO: 242360 - DNA, 25 bp, Mus musculus
cgtcgcgccttgagccggttcagga

SEQ ID NO: 242361 - DNA, 25 bp, Mus musculus
ttgagccggttcaggacgccgccgc

SEQ ID NO: 242362 - DNA, 25 bp, Mus musculus
tcggtcggaccaggcccagagacgc

SEQ ID NO: 242363 - DNA, 25 bp, Mus musculus
atcgctccaccaccaagatggccgc

SEQ ID NO: 242364 - DNA, 25 bp, Mus musculus
ttcttctcctccttgccagccacca

SEQ ID NO: 242365 - DNA, 25 bp, Mus musculus
cgggcccagcctgcgaacccgcagt

SEQ ID NO: 242366 - DNA, 25 bp, Mus musculus
gcagtcgcagccttcgggttcgacc

SEQ ID NO: 242367 - DNA, 25 bp, Mus musculus
acctcaggggcgccgtaactatgga

SEQ ID NO: 242368 - DNA, 25 bp, Mus musculus
tggatcccgtgcacgtccacatgcg

SEQ ID NO: 242369 - DNA, 25 bp, Mus musculus
cgtctctcccttggatgccatgtga

SEQ ID NO: 242370 - DNA, 25 bp, Mus musculus
agaagcgccacagcggttccctcgg

SEQ ID NO: 242371 - DNA, 25 bp, Mus musculus
actcaggagaacagcgcagcggacc

SEQ ID NO: 242372 - DNA, 25 bp, Mus musculus
caacccgggacatgtcgctctcagg

SEQ ID NO: 242373 - DNA, 25 bp, Mus musculus
gagggaggccctcatgaattaccca

SEQ ID NO: 242374 - DNA, 25 bp, Mus musculus
ccggaatcccacagtcgactgggaa

SEQ ID NO: 242375 - DNA, 25 bp, Mus musculus
aggtttagagaagggcgcactgaca

SEQ ID NO: 242376 - DNA, 25 bp, Mus musculus
tgacacgtcgccaacacttccggtg

SEQ ID NO: 242377 - DNA, 25 bp, Mus musculus
acttccggtgctctagagctgggga

SEQ ID NO: 242378 - DNA, 25 bp, Mus musculus
actcagaaagcaagagcccaggctc

SEQ ID NO: 242379 - DNA, 25 bp, Mus musculus
gcctgcgttcactgcccagatgacg

SEQ ID NO: 242380 - DNA, 25 bp, Mus musculus
tccaggaggccgtccaatcagaatg

SEQ ID NO: 242381 - DNA, 25 bp, Mus musculus
tcttgcaagccgagcgatggtttgt

SEQ ID NO: 242382 - DNA, 25 bp, Mus musculus
cgccgccttgagcagcgacgtcttg

SEQ ID NO: 242383 - DNA, 25 bp, Mus musculus
tctgcgcctggagcctcgagctccc

SEQ ID NO: 242384 - DNA, 25 bp, Mus musculus
tgtgacagcgcagcctctgcgcctg

SEQ ID NO: 242385 - DNA, 25 bp, Mus musculus
tcgccgccgcccatgtgacagcgca

SEQ ID NO: 242386 - DNA, 25 bp, Mus musculus
tggcaatgtgcgagctcatcgcggc

SEQ ID NO: 242387 - DNA, 25 bp, Mus musculus
tcgctcttggcaatgtgcgagctca

SEQ ID NO: 242388 - DNA, 25 bp, Mus musculus
ccttgagcagcgacgtcttggactc

SEQ ID NO: 242389 - DNA, 25 bp, Mus musculus
gcgcggcccttacctggccgaaggc

SEQ ID NO: 242390 - DNA, 25 bp, Mus musculus
aggacaggatgagccaaggtgcacc

SEQ ID NO: 242391 - DNA, 25 bp, Mus musculus
cacagggtgctgaatcagacacggg

SEQ ID NO: 242392 - DNA, 25 bp, Mus musculus
aggcccgaagtgtggacagcgcaca

SEQ ID NO: 242393 - DNA, 25 bp, Mus musculus
aggtcgctcttgcaggtgcgaggca

SEQ ID NO: 242394 - DNA, 25 bp, Mus musculus
agcgacgtcttggactcgctcttgg

SEQ ID NO: 242395 - DNA, 25 bp, Mus musculus
cagcgcacagggtgctgaatcagac

SEQ ID NO: 242396 - DNA, 25 bp, Mus musculus
acgacgcacaggtttgggctcagcg

SEQ ID NO: 242397 - DNA, 25 bp, Mus musculus
tccctgacagcaccgggccggagga

SEQ ID NO: 242398 - DNA, 25 bp, Mus musculus
acgcggtgtggtccctgacagcacc

SEQ ID NO: 242399 - DNA, 25 bp, Mus musculus
tcggaactagaaggggaagctctgc

SEQ ID NO: 242400 - DNA, 25 bp, Mus musculus
ccgctcgccgttgtttgtttattag

SEQ ID NO: 242401 - DNA, 25 bp, Mus musculus
atcagggtgcttcctctgggtgaca

SEQ ID NO: 242402 - DNA, 25 bp, Mus musculus
agaggctgcgacgacacgtcgccgc

SEQ ID NO: 242403 - DNA, 25 bp, Mus musculus
ggctaattaccaccgggagaggctg

SEQ ID NO: 242404 - DNA, 25 bp, Mus musculus
ttaggagacgtgtaattagcggctg

SEQ ID NO: 242405 - DNA, 25 bp, Mus musculus
acagccgccggcctcattaggagac

SEQ ID NO: 242406 - DNA, 25 bp, Mus musculus
gtaggtccgcctctctaagcctcag

SEQ ID NO: 242407 - DNA, 25 bp, Mus musculus
tgagtcatgcctgcgtaggtccgcc

SEQ ID NO: 242408 - DNA, 25 bp, Mus musculus
ctcagcggggattaggctccatccc

SEQ ID NO: 242409 - DNA, 25 bp, Mus musculus
ggatccgaacccacgcctgtggcta

SEQ ID NO: 242410 - DNA, 25 bp, Mus musculus
gcggcgggtcgaaaactgaacagaa

SEQ ID NO: 242411 - DNA, 25 bp, Mus musculus
ggacgccatggtgcggttcaagcac

SEQ ID NO: 242412 - DNA, 25 bp, Mus musculus
tcaagcacaggtaagcagcgctgtc

SEQ ID NO: 242413 - DNA, 25 bp, Mus musculus
cgctgtcgccgcaggtaccttctgt

SEQ ID NO: 242414 - DNA, 25 bp, Mus musculus
accttctgtgcgagctggtgtccga

SEQ ID NO: 242415 - DNA, 25 bp, Mus musculus
aggacgcgcgctgccgtttgagcct

SEQ ID NO: 242416 - DNA, 25 bp, Mus musculus
gtttgagcctggacgaccgcgtgct

SEQ ID NO: 242417 - DNA, 25 bp, Mus musculus
tggtccgcgacacgatcgcccgggt

SEQ ID NO: 242418 - DNA, 25 bp, Mus musculus
cgcctgctccgtgggctttgcaggt

SEQ ID NO: 242419 - DNA, 25 bp, Mus musculus
ttttgtacgatagtggagggttcta

SEQ ID NO: 242420 - DNA, 25 bp, Mus musculus
aactgaacagaaggtgccgatcgcg

SEQ ID NO: 242421 - DNA, 25 bp, Mus musculus
gcacgctgcctgtccgagcctagtg

SEQ ID NO: 242422 - DNA, 25 bp, Mus musculus
tggagattgacagggcacgctgcct

SEQ ID NO: 242423 - DNA, 25 bp, Mus musculus
ccagtgtgtcgcgttttgtacgata

SEQ ID NO: 242424 - DNA, 25 bp, Mus musculus
tccgggaatggcgacgagtcgccaa

SEQ ID NO: 242425 - DNA, 25 bp, Mus musculus
ctcggccttcatggcgacatttttc

SEQ ID NO: 242426 - DNA, 25 bp, Mus musculus
catggcgacatttttccttgtttcc

SEQ ID NO: 242427 - DNA, 25 bp, Mus musculus
cctcagcttctcaaaatggaaggag

SEQ ID NO: 242428 - DNA, 25 bp, Mus musculus
ggaccggggtctccgacacagcgac

SEQ ID NO: 242429 - DNA, 25 bp, Mus musculus
ggggtctccgacacagcgaccgaca

SEQ ID NO: 242430 - DNA, 25 bp, Mus musculus
gcgacgagtcgccaaacagcatctc

SEQ ID NO: 242431 - DNA, 25 bp, Mus musculus
gaacccggatggactatttatatag

SEQ ID NO: 242432 - DNA, 25 bp, Mus musculus
tatttatatagttgccaggcgggcg

SEQ ID NO: 242433 - DNA, 25 bp, Mus musculus
agtgtagtcttttacctacatccgg

SEQ ID NO: 242434 - DNA, 25 bp, Mus musculus
ggagggaccgcttgtgcctgccaat

SEQ ID NO: 242435 - DNA, 25 bp, Mus musculus
ccgcttgtgcctgccaatgcttttt

SEQ ID NO: 242436 - DNA, 25 bp, Mus musculus
cggttctcggccttcatggcgacat

SEQ ID NO: 242437 - DNA, 25 bp, Mus musculus
acagcatctccaagaacccggatgg

SEQ ID NO: 242438 - DNA, 25 bp, Mus musculus
cccgggtgtcatagatcctggccat

SEQ ID NO: 242439 - DNA, 25 bp, Mus musculus
actaatgtgtctcctgtcggccgcc

SEQ ID NO: 242440 - DNA, 25 bp, Mus musculus
gcgttccactaatgtgtctcctgtc

SEQ ID NO: 242441 - DNA, 25 bp, Mus musculus
ggggtgcgttccactaatgtgtctc

SEQ ID NO: 242442 - DNA, 25 bp, Mus musculus
gcggaaacgcacttcgggtttgaga

SEQ ID NO: 242443 - DNA, 25 bp, Mus musculus
gctggtgacgcaacccgacgttctc

SEQ ID NO: 242444 - DNA, 25 bp, Mus musculus
cgcccaggtgctgcgttctatggcg

SEQ ID NO: 242445 - DNA, 25 bp, Mus musculus
gcgagccacgggacactgcaggctc

SEQ ID NO: 242446 - DNA, 25 bp, Mus musculus
tgtcatagatcctggccatgggcca

SEQ ID NO: 242447 - DNA, 25 bp, Mus musculus
agatcctggccatgggccacgctgg

SEQ ID NO: 242448 - DNA, 25 bp, Mus musculus
ccacgctgggaacgcggtccttgtc

SEQ ID NO: 242449 - DNA, 25 bp, Mus musculus
ggtccttgtcccaggagaagcgagc

SEQ ID NO: 242450 - DNA, 25 bp, Mus musculus
cccaggagaagcgagccgcggaaac

SEQ ID NO: 242451 - DNA, 25 bp, Mus musculus
aagcgagccgcggaaacgcacttcg

SEQ ID NO: 242452 - DNA, 25 bp, Mus musculus
tgggctctgttcgacgtcccacctt

SEQ ID NO: 242453 - DNA, 25 bp, Mus musculus
caccagtcgctgaggagcacgcgaa

SEQ ID NO: 242454 - DNA, 25 bp, Mus musculus
agcagtcgtgcaaccatcccgaggg

SEQ ID NO: 242455 - DNA, 25 bp, Mus musculus
atgtgttcttttcggtccttcgcgg

SEQ ID NO: 242456 - DNA, 25 bp, Mus musculus
cgcggccgtctatttccatgtagaa

SEQ ID NO: 242457 - DNA, 25 bp, Mus musculus
ccatgtagaaacagggtgtgccctc

SEQ ID NO: 242458 - DNA, 25 bp, Mus musculus
cgggctgcacttgactgacagctca

SEQ ID NO: 242459 - DNA, 25 bp, Mus musculus
tgttccagcctttgctgcagcagtc

SEQ ID NO: 242460 - DNA, 25 bp, Mus musculus
cgggcgctccgaccaataagaggta

SEQ ID NO: 242461 - DNA, 25 bp, Mus musculus
ggcgccatgggctgaaaactcaacc

SEQ ID NO: 242462 - DNA, 25 bp, Mus musculus
tggaatctcccagtctgaaccggtt

SEQ ID NO: 242463 - DNA, 25 bp, Mus musculus
ttccgagtttgaggcactaggagga

SEQ ID NO: 242464 - DNA, 25 bp, Mus musculus
agcagcgggagcttcagcatcagca

SEQ ID NO: 242465 - DNA, 25 bp, Mus musculus
agggcctaccatccggcacctatgt

SEQ ID NO: 242466 - DNA, 25 bp, Mus musculus
ccaggcgcccagaggacgcagaatc

SEQ ID NO: 242467 - DNA, 25 bp, Mus musculus
gaggcccacacaccctgaaggcgga

SEQ ID NO: 242468 - DNA, 25 bp, Mus musculus
cgcgaaacccttgcgtcctttctag

SEQ ID NO: 242469 - DNA, 25 bp, Mus musculus
ttctagaactatccatcccgagccg

SEQ ID NO: 242470 - DNA, 25 bp, Mus musculus
tgctacagggaaactgccaggcgcc

SEQ ID NO: 242471 - DNA, 25 bp, Mus musculus
cggattcaatggttccctcaggatc

SEQ ID NO: 242472 - DNA, 25 bp, Mus musculus
cgcagaatcggggagtaggaactac

SEQ ID NO: 242473 - DNA, 25 bp, Mus musculus
ccgcgttttgttgcagaccacaatg

SEQ ID NO: 242474 - DNA, 25 bp, Mus musculus
gttgcagaccacaatgcaccgcgca

SEQ ID NO: 242475 - DNA, 25 bp, Mus musculus
cgggtcctcaccttcttgatatggg

SEQ ID NO: 242476 - DNA, 25 bp, Mus musculus
cacatggttacctgtgtggtgacga

SEQ ID NO: 242477 - DNA, 25 bp, Mus musculus
gagcccggtctcaccgtggagcaga

SEQ ID NO: 242478 - DNA, 25 bp, Mus musculus
tctcccgattggctagcggattcaa

SEQ ID NO: 242479 - DNA, 25 bp, Mus musculus
cgagccgccctgagtgctacaggga

SEQ ID NO: 242480 - DNA, 25 bp, Mus musculus
gagggtaaaaaccagcgcgctctgc

SEQ ID NO: 242481 - DNA, 25 bp, Mus musculus
gggtaaaaaccagcgcgctctgccc

SEQ ID NO: 242482 - DNA, 25 bp, Mus musculus
gcgctctgcccagccctcgagtttg

SEQ ID NO: 242483 - DNA, 25 bp, Mus musculus
ctaacgggaagcaccccgaaatgag

SEQ ID NO: 242484 - DNA, 25 bp, Mus musculus
agcaccccgaaatgagggaagcgcg

SEQ ID NO: 242485 - DNA, 25 bp, Mus musculus
cgaaccgaccctgcagaggactcgg

SEQ ID NO: 242486 - DNA, 25 bp, Mus musculus
cgaccctgcagaggactcggccgaa

SEQ ID NO: 242487 - DNA, 25 bp, Mus musculus
ccctgcagaggactcggccgaaggc

SEQ ID NO: 242488 - DNA, 25 bp, Mus musculus
cggccgaaggcgacagtcgcccatc

SEQ ID NO: 242489 - DNA, 25 bp, Mus musculus
gaaggcgacagtcgcccatcccgcc

SEQ ID NO: 242490 - DNA, 25 bp, Mus musculus
accacaggttgccttgggcggctga

SEQ ID NO: 242491 - DNA, 25 bp, Mus musculus
acaggttgccttgggcggctgaaaa

SEQ ID NO: 242492 - DNA, 25 bp, Mus musculus
cagcccgcccgacttgcccccgagg

SEQ ID NO: 242493 - DNA, 25 bp, Mus musculus
aaaaccagcgcgctctgcccagccc

SEQ ID NO: 242494 - DNA, 25 bp, Mus musculus
ccgcccaggactccgatgacgggga

SEQ ID NO: 242495 - DNA, 25 bp, Mus musculus
cggggccagtggctctggtgccgcc

SEQ ID NO: 242496 - DNA, 25 bp, Mus musculus
ccacgccacgtggtcttggcgattt

SEQ ID NO: 242497 - DNA, 25 bp, Mus musculus
cgccacgtggtcttggcgattttca

SEQ ID NO: 242498 - DNA, 25 bp, Mus musculus
ccacgtggtcttggcgattttcacg

SEQ ID NO: 242499 - DNA, 25 bp, Mus musculus
tggtcttggcgattttcacggcgct

SEQ ID NO: 242500 - DNA, 25 bp, Mus musculus
gtgatttcgcccacgcaggcgcgtc

SEQ ID NO: 242501 - DNA, 25 bp, Mus musculus
ggtgatttcgcccacgcaggcgcgt

SEQ ID NO: 242502 - DNA, 25 bp, Mus musculus
caggggtgatttcgcccacgcaggc

SEQ ID NO: 242503 - DNA, 25 bp, Mus musculus
cgatgacggggacatcgactattta

SEQ ID NO: 242504 - DNA, 25 bp, Mus musculus
tccgatgacggggacatcgactatt

SEQ ID NO: 242505 - DNA, 25 bp, Mus musculus
aggactccgatgacggggacatcga

SEQ ID NO: 242506 - DNA, 25 bp, Mus musculus
cggatttgtcccctctcggatggag

SEQ ID NO: 242507 - DNA, 25 bp, Mus musculus
ccaggactccgatgacggggacatc

SEQ ID NO: 242508 - DNA, 25 bp, Mus musculus
ccgtggcgcgggtccctgcccatac

SEQ ID NO: 242509 - DNA, 25 bp, Mus musculus
caggaggcaggataatcccagtgtc

SEQ ID NO: 242510 - DNA, 25 bp, Mus musculus
gtcctgggcacactcggggcttccc

SEQ ID NO: 242511 - DNA, 25 bp, Mus musculus
ttgcgagtcccaggaccacgccacg

SEQ ID NO: 242512 - DNA, 25 bp, Mus musculus
cgaatgagatcagagctcggaaagt

SEQ ID NO: 242513 - DNA, 25 bp, Mus musculus
tgggccactctggttggctgagccc

SEQ ID NO: 242514 - DNA, 25 bp, Mus musculus
caggataatcccagtgtcagcaagg

SEQ ID NO: 242515 - DNA, 25 bp, Mus musculus
acgcgtcccttctgtgtgggacagg

SEQ ID NO: 242516 - DNA, 25 bp, Mus musculus
gcccatacgcgtcccttctgtgtgg

SEQ ID NO: 242517 - DNA, 25 bp, Mus musculus
attttcacggcgctcgcccgtggcg

SEQ ID NO: 242518 - DNA, 25 bp, Mus musculus
cggcgcgctcctggtaagtactctc

SEQ ID NO: 242519 - DNA, 25 bp, Mus musculus
ggtgctcaatgtccggtcggtttta

SEQ ID NO: 242520 - DNA, 25 bp, Mus musculus
cccggtgctcaatgtccggtcggtt

SEQ ID NO: 242521 - DNA, 25 bp, Mus musculus
tttaggaagcgaatgagatcagagc

SEQ ID NO: 242522 - DNA, 25 bp, Mus musculus
cctttccctgtggattcgctttgga

SEQ ID NO: 242523 - DNA, 25 bp, Mus musculus
caaccgctggtttgctgagaagttc

SEQ ID NO: 242524 - DNA, 25 bp, Mus musculus
gccagtcgctccagatgctcgatta

SEQ ID NO: 242525 - DNA, 25 bp, Mus musculus
agtacgaccagtgcttcaaccgctg

SEQ ID NO: 242526 - DNA, 25 bp, Mus musculus
cttgcactgacatgaagcgcgagta

SEQ ID NO: 242527 - DNA, 25 bp, Mus musculus
tgaccacatttcttttgcttctcgg

SEQ ID NO: 242528 - DNA, 25 bp, Mus musculus
gaaatcgcacactcgcggcccgtga

SEQ ID NO: 242529 - DNA, 25 bp, Mus musculus
tggaagcaaagcttcggcccgcgtc

SEQ ID NO: 242530 - DNA, 25 bp, Mus musculus
aggggctccacaccgtcagtgtcca

SEQ ID NO: 242531 - DNA, 25 bp, Mus musculus
tgccgaagttcaccagcgccagtcg

SEQ ID NO: 242532 - DNA, 25 bp, Mus musculus
ctgatccgcaaaggcgatggctttc

SEQ ID NO: 242533 - DNA, 25 bp, Mus musculus
tccagtaccgactctaggggctcca

SEQ ID NO: 242534 - DNA, 25 bp, Mus musculus
cagccgggagtttacctgtcctcca

SEQ ID NO: 242535 - DNA, 25 bp, Mus musculus
atggctttctctagccggtccaccg

SEQ ID NO: 242536 - DNA, 25 bp, Mus musculus
ccctggacaggatctgaagtgcgga

SEQ ID NO: 242537 - DNA, 25 bp, Mus musculus
cgaacgacgttcctattgggcaacg

SEQ ID NO: 242538 - DNA, 25 bp, Mus musculus
gcagcgcctaccttggtcctgatgc

SEQ ID NO: 242539 - DNA, 25 bp, Mus musculus
ccgcgacttgaggaacacgttgagc

SEQ ID NO: 242540 - DNA, 25 bp, Mus musculus
gtcacgttagcggaggcgccattct

SEQ ID NO: 242541 - DNA, 25 bp, Mus musculus
cgctcccttctttggagtccctgga

SEQ ID NO: 242542 - DNA, 25 bp, Mus musculus
gatgtccgcggaactgaacttttgc

SEQ ID NO: 242543 - DNA, 25 bp, Mus musculus
ctgcgcactttatccgtccctgggg

SEQ ID NO: 242544 - DNA, 25 bp, Mus musculus
agccctgtccttgtcgttatcattg

SEQ ID NO: 242545 - DNA, 25 bp, Mus musculus
aacgccttctcagacctggctagga

SEQ ID NO: 242546 - DNA, 25 bp, Mus musculus
atcatggaactacaccggcgcgccg

SEQ ID NO: 242547 - DNA, 25 bp, Mus musculus
agagacccgagacgctgacagcacc

SEQ ID NO: 242548 - DNA, 25 bp, Mus musculus
ccacgaagtaggtgagggccttcca

SEQ ID NO: 242549 - DNA, 25 bp, Mus musculus
gctgccttctaattccgcgatttcc

SEQ ID NO: 242550 - DNA, 25 bp, Mus musculus
ccgccctgagccttgctgtctggct

SEQ ID NO: 242551 - DNA, 25 bp, Mus musculus
cctcattgtgaacgcgaaagggaga

SEQ ID NO: 242552 - DNA, 25 bp, Mus musculus
attgtgaacgcgaaagggagaaagc

SEQ ID NO: 242553 - DNA, 25 bp, Mus musculus
ccgggtagacctttcatgtgtaaat

SEQ ID NO: 242554 - DNA, 25 bp, Mus musculus
tagacctttcatgtgtaaatcaggc

SEQ ID NO: 242555 - DNA, 25 bp, Mus musculus
ctttcatgtgtaaatcaggccggcc

SEQ ID NO: 242556 - DNA, 25 bp, Mus musculus
ttcatgtgtaaatcaggccggccgg

SEQ ID NO: 242557 - DNA, 25 bp, Mus musculus
ggagcgggatttcactcttaattac

SEQ ID NO: 242558 - DNA, 25 bp, Mus musculus
gcgggatttcactcttaattactcc

SEQ ID NO: 242559 - DNA, 25 bp, Mus musculus
gatttcactcttaattactccgaga

SEQ ID NO: 242560 - DNA, 25 bp, Mus musculus
cttaattactccgagagaaagcagc

SEQ ID NO: 242561 - DNA, 25 bp, Mus musculus
cgctcctcattgtgaacgcgaaagg

SEQ ID NO: 242562 - DNA, 25 bp, Mus musculus
ttactccgagagaaagcagcggggt

SEQ ID NO: 242563 - DNA, 25 bp, Mus musculus
ggctctgggcgagcatggcgcagct

SEQ ID NO: 242564 - DNA, 25 bp, Mus musculus
ccctaatgagaatagaccgagtccc

SEQ ID NO: 242565 - DNA, 25 bp, Mus musculus
gcctcctctttgtgcggctgtctcg

SEQ ID NO: 242566 - DNA, 25 bp, Mus musculus
cggccgaggggcctcctctttgtgc

SEQ ID NO: 242567 - DNA, 25 bp, Mus musculus
ccacaaaggagagggatcaatgcga

SEQ ID NO: 242568 - DNA, 25 bp, Mus musculus
tgtccgagccacaaaggagagggat

SEQ ID NO: 242569 - DNA, 25 bp, Mus musculus
ctcccgttgtccgagccacaaagga

SEQ ID NO: 242570 - DNA, 25 bp, Mus musculus
cccacgaggcgcctctcccgttgtc

SEQ ID NO: 242571 - DNA, 25 bp, Mus musculus
gtctcgggcctgtttgcgccgccgt

SEQ ID NO: 242572 - DNA, 25 bp, Mus musculus
cgtgcccccattgatcaggcatgtg

SEQ ID NO: 242573 - DNA, 25 bp, Mus musculus
caggcatgtggaaagattccgcctc

SEQ ID NO: 242574 - DNA, 25 bp, Mus musculus
gcatgtggaaagattccgcctcccg

SEQ ID NO: 242575 - DNA, 25 bp, Mus musculus
ctttgtggcagcgttgccaggctgc

SEQ ID NO: 242576 - DNA, 25 bp, Mus musculus
ctccctttgtggcagcgttgccagg

SEQ ID NO: 242577 - DNA, 25 bp, Mus musculus
ctctttgtgcggctgtctcgggcct

SEQ ID NO: 242578 - DNA, 25 bp, Mus musculus
tcacgcgggccctttgtgtctctgc

SEQ ID NO: 242579 - DNA, 25 bp, Mus musculus
ccgagcccgcaccaggaatcagggg

SEQ ID NO: 242580 - DNA, 25 bp, Mus musculus
cccgcaccaggaatcaggggagctc

SEQ ID NO: 242581 - DNA, 25 bp, Mus musculus
aggaatcaggggagctcgctcaccc

SEQ ID NO: 242582 - DNA, 25 bp, Mus musculus
cggctcccgatggagactgacgcac

SEQ ID NO: 242583 - DNA, 25 bp, Mus musculus
tcgcctcaccggactagccgcacga

SEQ ID NO: 242584 - DNA, 25 bp, Mus musculus
accgggaagcgcttcatcccgggag

SEQ ID NO: 242585 - DNA, 25 bp, Mus musculus
ccaacatggccgatccgggtcgggc

SEQ ID NO: 242586 - DNA, 25 bp, Mus musculus
tgctcctcccgcagcaagatgttca

SEQ ID NO: 242587 - DNA, 25 bp, Mus musculus
tcctcccgcagcaagatgttcatcg

SEQ ID NO: 242588 - DNA, 25 bp, Mus musculus
cagcaagatgttcatcggaggactc

SEQ ID NO: 242589 - DNA, 25 bp, Mus musculus
atcggaggactcagttggcagacca

SEQ ID NO: 242590 - DNA, 25 bp, Mus musculus
actcagttggcagaccacgcagggt

SEQ ID NO: 242591 - DNA, 25 bp, Mus musculus
tgagccagcccagggatcgcccgcc

SEQ ID NO: 242592 - DNA, 25 bp, Mus musculus
ctccaaaacagtgagtgaccctcgg

SEQ ID NO: 242593 - DNA, 25 bp, Mus musculus
ggcacgagctcgactccaaaacagt

SEQ ID NO: 242594 - DNA, 25 bp, Mus musculus
gcgcaatcgcggcacgagctcgact

SEQ ID NO: 242595 - DNA, 25 bp, Mus musculus
gtggataaagtgctggcgcaatcgc

SEQ ID NO: 242596 - DNA, 25 bp, Mus musculus
cgtcactttcatggaccaggcgggg

SEQ ID NO: 242597 - DNA, 25 bp, Mus musculus
tttcggcttcgtcactttcatggac

SEQ ID NO: 242598 - DNA, 25 bp, Mus musculus
cactaccggcgcaggggtttcggct

SEQ ID NO: 242599 - DNA, 25 bp, Mus musculus
gctgtccttgtaaccatctgcctct

SEQ ID NO: 242600 - DNA, 25 bp, Mus musculus
ggtgagtcccggagacctctcctgc

SEQ ID NO: 242601 - DNA, 25 bp, Mus musculus
atccaggtgagtcccggagacctct

SEQ ID NO: 242602 - DNA, 25 bp, Mus musculus
ccctgaccaaaagatccaggtgagt

SEQ ID NO: 242603 - DNA, 25 bp, Mus musculus
tgcgcgaatacttcggccagttcgg

SEQ ID NO: 242604 - DNA, 25 bp, Mus musculus
ttacagaagggctgcgcgaatactt

SEQ ID NO: 242605 - DNA, 25 bp, Mus musculus
agagcgatccgggaactctctctcg

SEQ ID NO: 242606 - DNA, 25 bp, Mus musculus
gtcagcggccgcgtcttttgttcgg

SEQ ID NO: 242607 - DNA, 25 bp, Mus musculus
cggggtgtctttgtgtctgagcacc

SEQ ID NO: 242608 - DNA, 25 bp, Mus musculus
cggctcccactggtcagcaggcctc

SEQ ID NO: 242609 - DNA, 25 bp, Mus musculus
ttagccgccgccgaacttggcggct

SEQ ID NO: 242610 - DNA, 25 bp, Mus musculus
ggtgaacaatggtcagccgccatgg

SEQ ID NO: 242611 - DNA, 25 bp, Mus musculus
tggagaaagtgccagggtggaccca

SEQ ID NO: 242612 - DNA, 25 bp, Mus musculus
cggcgttggcatgtgaaaccggccc

SEQ ID NO: 242613 - DNA, 25 bp, Mus musculus
tgttcgggcctaaatcggcgttggc

SEQ ID NO: 242614 - DNA, 25 bp, Mus musculus
taatctgatccagcagctgtgattg

SEQ ID NO: 242615 - DNA, 25 bp, Mus musculus
gcactaatctgatccagcagctgtg

SEQ ID NO: 242616 - DNA, 25 bp, Mus musculus
gagcccgcactaatctgatccagca

SEQ ID NO: 242617 - DNA, 25 bp, Mus musculus
gcaccgagcattagagcccgcacta

SEQ ID NO: 242618 - DNA, 25 bp, Mus musculus
ctttgtgtctgagcaccgagcatta

SEQ ID NO: 242619 - DNA, 25 bp, Mus musculus
taaatcggcgttggcatgtgaaacc

SEQ ID NO: 242620 - DNA, 25 bp, Mus musculus
tcttcggcgcttgtccgaatccagc

SEQ ID NO: 242621 - DNA, 25 bp, Mus musculus
aagagtggcgttccttcctgctcag

SEQ ID NO: 242622 - DNA, 25 bp, Mus musculus
aatccagccttctcggtcaccggga

SEQ ID NO: 242623 - DNA, 25 bp, Mus musculus
cgggctgttgcggataaagttgttt

SEQ ID NO: 242624 - DNA, 25 bp, Mus musculus
cacacggtgaaggtgacgccgagca

SEQ ID NO: 242625 - DNA, 25 bp, Mus musculus
taatagcaaagcagagccagagcgc

SEQ ID NO: 242626 - DNA, 25 bp, Mus musculus
tgacgccgagcaccgtgctgctgca

SEQ ID NO: 242627 - DNA, 25 bp, Mus musculus
ccctgcggttgctcctagggcggta

SEQ ID NO: 242628 - DNA, 25 bp, Mus musculus
ccaatgagcgcctttcgcgcggctg

SEQ ID NO: 242629 - DNA, 25 bp, Mus musculus
catcctctagatctgggtcccgggg

SEQ ID NO: 242630 - DNA, 25 bp, Mus musculus
acttggaggcgcgtttgctgagcac

SEQ ID NO: 242631 - DNA, 25 bp, Mus musculus
ccactaacagggtcgagccttgcga

SEQ ID NO: 242632 - DNA, 25 bp, Mus musculus
cgggacgccatcaggctgcctaata

SEQ ID NO: 242633 - DNA, 25 bp, Mus musculus
ataaagttgtttgaggcgagccggc

SEQ ID NO: 242634 - DNA, 25 bp, Mus musculus
gcgaggacatcgtagagaaagtttg

SEQ ID NO: 242635 - DNA, 25 bp, Mus musculus
acaaaatggtgagctgggatcggtc

SEQ ID NO: 242636 - DNA, 25 bp, Mus musculus
tcaacaacaaaatggtgagctggga

SEQ ID NO: 242637 - DNA, 25 bp, Mus musculus
tccacttccatgaaatcaacaacaa

SEQ ID NO: 242638 - DNA, 25 bp, Mus musculus
gagatccacttccatgaaatcaaca

SEQ ID NO: 242639 - DNA, 25 bp, Mus musculus
ttgtgagatccacttccatgaaatc

SEQ ID NO: 242640 - DNA, 25 bp, Mus musculus
cgtagagaaagtttgtgagatccac

SEQ ID NO: 242641 - DNA, 25 bp, Mus musculus
tgagagcgaggacatcgtagagaaa

SEQ ID NO: 242642 - DNA, 25 bp, Mus musculus
atttgtcacgtttgagagcgaggac

SEQ ID NO: 242643 - DNA, 25 bp, Mus musculus
tttggatttgtcacgtttgagagcg

SEQ ID NO: 242644 - DNA, 25 bp, Mus musculus
tgtgctcgtgcttctgacctggccc

SEQ ID NO: 242645 - DNA, 25 bp, Mus musculus
gcgcgtgtgctcgtgcttctgacct

SEQ ID NO: 242646 - DNA, 25 bp, Mus musculus
gcaagagatgagctgcggtgtgtgc

SEQ ID NO: 242647 - DNA, 25 bp, Mus musculus
aagtttgtgagatccacttccatga

SEQ ID NO: 242648 - DNA, 25 bp, Mus musculus
cagattccgtgcatctcataggcca

SEQ ID NO: 242649 - DNA, 25 bp, Mus musculus
ggctcagattccgtgcatctcatag

SEQ ID NO: 242650 - DNA, 25 bp, Mus musculus
gtcagtggctcagattccgtgcatc

SEQ ID NO: 242651 - DNA, 25 bp, Mus musculus
acaggtcagtggctcagattccgtg

SEQ ID NO: 242652 - DNA, 25 bp, Mus musculus
gctcacaggtcagtggctcagattc

SEQ ID NO: 242653 - DNA, 25 bp, Mus musculus
cccgagctcacaggtcagtggctca

SEQ ID NO: 242654 - DNA, 25 bp, Mus musculus
gtgtagagcggagccctctcccgag

SEQ ID NO: 242655 - DNA, 25 bp, Mus musculus
tagaattccgtgtagagcggagccc

SEQ ID NO: 242656 - DNA, 25 bp, Mus musculus
tcattttagaattccgtgtagagcg

SEQ ID NO: 242657 - DNA, 25 bp, Mus musculus
gctgtcttacgtttcattttagaat

SEQ ID NO: 242658 - DNA, 25 bp, Mus musculus
gcgatttcctaagctgtcttacgtt

SEQ ID NO: 242659 - DNA, 25 bp, Mus musculus
ccctgcgatttcctaagctgtctta

SEQ ID NO: 242660 - DNA, 25 bp, Mus musculus
ttccgtgcatctcataggccacgcg

SEQ ID NO: 242661 - DNA, 25 bp, Mus musculus
caggggccatgccaaaggggctccc

SEQ ID NO: 242662 - DNA, 25 bp, Mus musculus
cggagcactgcggacgaaatcaatg

SEQ ID NO: 242663 - DNA, 25 bp, Mus musculus
ccctttgtcggcctgaaagtcaatc

SEQ ID NO: 242664 - DNA, 25 bp, Mus musculus
tgggtgatccaacggccctttgtcg

SEQ ID NO: 242665 - DNA, 25 bp, Mus musculus
ggtccacaagaacgcggccggctga

SEQ ID NO: 242666 - DNA, 25 bp, Mus musculus
tttgatcttttcagggtccaaagga

SEQ ID NO: 242667 - DNA, 25 bp, Mus musculus
agcgctgtaactctttgatcttttc

SEQ ID NO: 242668 - DNA, 25 bp, Mus musculus
tcttggaaaggctaatgaagcgctg

SEQ ID NO: 242669 - DNA, 25 bp, Mus musculus
ccgcgcctgtcatcacgaggagttt

SEQ ID NO: 242670 - DNA, 25 bp, Mus musculus
tgacctgtagtctgggatgccggac

SEQ ID NO: 242671 - DNA, 25 bp, Mus musculus
gtcccaccttttctgacctgtagtc

SEQ ID NO: 242672 - DNA, 25 bp, Mus musculus
cagtgcgggcgtaaagtcccacctt

SEQ ID NO: 242673 - DNA, 25 bp, Mus musculus
tcaatgtgctggatgggtctccggt

SEQ ID NO: 242674 - DNA, 25 bp, Mus musculus
taccgctggcggaccggagcactgc

SEQ ID NO: 242675 - DNA, 25 bp, Mus musculus
ctgcggacgaaatcaatgtgctgga

SEQ ID NO: 242676 - DNA, 25 bp, Mus musculus
tggcctttagccattcatcgccctg

SEQ ID NO: 242677 - DNA, 25 bp, Mus musculus
taatcccacatcgaaggctcgcctt

SEQ ID NO: 242678 - DNA, 25 bp, Mus musculus
ccttccctcgggcagttctgcaatg

SEQ ID NO: 242679 - DNA, 25 bp, Mus musculus
gcagttctgcaatggcctttagcca

SEQ ID NO: 242680 - DNA, 25 bp, Mus musculus
tcatcgccctgtctagcagagactc

SEQ ID NO: 242681 - DNA, 25 bp, Mus musculus
gacacctttcacttccgcctctgga

SEQ ID NO: 242682 - DNA, 25 bp, Mus musculus
gagtgcggaagtaacggctgacttc

SEQ ID NO: 242683 - DNA, 25 bp, Mus musculus
agtaacggctgacttccggcctcgg

SEQ ID NO: 242684 - DNA, 25 bp, Mus musculus
gcagaggtgacgtcactagcccggc

SEQ ID NO: 242685 - DNA, 25 bp, Mus musculus
ggcgcgctgtgcctaaatcctcggc

SEQ ID NO: 242686 - DNA, 25 bp, Mus musculus
tgtgcctaaatcctcggccgcctga

SEQ ID NO: 242687 - DNA, 25 bp, Mus musculus
gctctgggctggttcgagaccacag

SEQ ID NO: 242688 - DNA, 25 bp, Mus musculus
gccgtaatcccacatcgaaggctcg

SEQ ID NO: 242689 - DNA, 25 bp, Mus musculus
tctagcagagactcgcaagccgctc

SEQ ID NO: 242690 - DNA, 25 bp, Mus musculus
cccacgggattcaagacccgagcga

SEQ ID NO: 242691 - DNA, 25 bp, Mus musculus
agaagaggcagaactccagggtcca

SEQ ID NO: 242692 - DNA, 25 bp, Mus musculus
tccttctagcagcacgagtccgggc

SEQ ID NO: 242693 - DNA, 25 bp, Mus musculus
gacagaccggtctggcactccgaac

SEQ ID NO: 242694 - DNA, 25 bp, Mus musculus
tcacagcagccgcagaagaggcaga

SEQ ID NO: 242695 - DNA, 25 bp, Mus musculus
acccgagcgagcaccgctctgaaga

SEQ ID NO: 242696 - DNA, 25 bp, Mus musculus
ctctgaagagcaccgggtctgcgga

SEQ ID NO: 242697 - DNA, 25 bp, Mus musculus
ccataggctacggtgggctctgtgc

SEQ ID NO: 242698 - DNA, 25 bp, Mus musculus
ctgtgctaggccgaccctggggcac

SEQ ID NO: 242699 - DNA, 25 bp, Mus musculus
agctcatcgcccaaccgggaacgga

SEQ ID NO: 242700 - DNA, 25 bp, Mus musculus
aacggagcctcgttcacagcgggca

SEQ ID NO: 242701 - DNA, 25 bp, Mus musculus
cgctcctcccagaccaaagaaagtt

SEQ ID NO: 242702 - DNA, 25 bp, Mus musculus
tcgcggcagactcaccagagcagct

SEQ ID NO: 242703 - DNA, 25 bp, Mus musculus
tctcctggtggtggacagacagacc

SEQ ID NO: 242704 - DNA, 25 bp, Mus musculus
cgcgatgacgttgactcgatttgca

SEQ ID NO: 242705 - DNA, 25 bp, Mus musculus
gcatcccaagcgactgccgcgtagt

SEQ ID NO: 242706 - DNA, 25 bp, Mus musculus
cgactgccgcgtagtttgcaaaaca

SEQ ID NO: 242707 - DNA, 25 bp, Mus musculus
ttgcaaaacacggatgttcgggctc

SEQ ID NO: 242708 - DNA, 25 bp, Mus musculus
ttcgggctcgagataacccactggc

SEQ ID NO: 242709 - DNA, 25 bp, Mus musculus
acccactggcaagaacgtgtccacg

SEQ ID NO: 242710 - DNA, 25 bp, Mus musculus
cgtgtccacgcagataaccgagatg

SEQ ID NO: 242711 - DNA, 25 bp, Mus musculus
taaccgagatggaaccgccgggctc

SEQ ID NO: 242712 - DNA, 25 bp, Mus musculus
ggctccgctcccgtcacgtggaggt

SEQ ID NO: 242713 - DNA, 25 bp, Mus musculus
ctgaagctcaccgtgactgaaatgg

SEQ ID NO: 242714 - DNA, 25 bp, Mus musculus
gaggctgagcgagcacgcttactcg

SEQ ID NO: 242715 - DNA, 25 bp, Mus musculus
ggaccgtcacgacacatgtcctttc

SEQ ID NO: 242716 - DNA, 25 bp, Mus musculus
actgaaatgggagtcgtcagccctg

SEQ ID NO: 242717 - DNA, 25 bp, Mus musculus
cacccaggccatcgcgatgacgttg

SEQ ID NO: 242718 - DNA, 25 bp, Mus musculus
aaagagtccgaggagcacctgcgca

SEQ ID NO: 242719 - DNA, 25 bp, Mus musculus
gatggggctctgtgatttacatacc

SEQ ID NO: 242720 - DNA, 25 bp, Mus musculus
cacgagcttcgtgtatcagcacgga

SEQ ID NO: 242721 - DNA, 25 bp, Mus musculus
ggcatgcttgactatgcgaacggtc

SEQ ID NO: 242722 - DNA, 25 bp, Mus musculus
gtaggtgatctcaaaggcatgcttg

SEQ ID NO: 242723 - DNA, 25 bp, Mus musculus
taccagtgagcaagtaggtgatctc

SEQ ID NO: 242724 - DNA, 25 bp, Mus musculus
cccgcagaggaatttttaccagtga

SEQ ID NO: 242725 - DNA, 25 bp, Mus musculus
tggcagtcaccagtacccgcagagg

SEQ ID NO: 242726 - DNA, 25 bp, Mus musculus
tcccggctcatgcaatgcctgttga

SEQ ID NO: 242727 - DNA, 25 bp, Mus musculus
cacagcagccagatggcctgaatca

SEQ ID NO: 242728 - DNA, 25 bp, Mus musculus
caagggtctggatgttccggaaaga

SEQ ID NO: 242729 - DNA, 25 bp, Mus musculus
tcctccaaacgctcggcaagggtct

SEQ ID NO: 242730 - DNA, 25 bp, Mus musculus
cctgaatcaccaggcggggacacac

SEQ ID NO: 242731 - DNA, 25 bp, Mus musculus
gatccctggtgagctcatcctccaa

SEQ ID NO: 242732 - DNA, 25 bp, Mus musculus
cctcagatcatcgtaagtgtggagc

SEQ ID NO: 242733 - DNA, 25 bp, Mus musculus
actttcccgacttgctggagtggca

SEQ ID NO: 242734 - DNA, 25 bp, Mus musculus
ctcagccaatagacgcgcatgttta

SEQ ID NO: 242735 - DNA, 25 bp, Mus musculus
cacccagtttttcatctcgtcgagc

SEQ ID NO: 242736 - DNA, 25 bp, Mus musculus
aagttctgtagtcttgggatctccc

SEQ ID NO: 242737 - DNA, 25 bp, Mus musculus
tggccacgcgctttaacagagtttg

SEQ ID NO: 242738 - DNA, 25 bp, Mus musculus
acagggcgacctggaagtccaacta

SEQ ID NO: 242739 - DNA, 25 bp, Mus musculus
cggtctaccgcctggcttgtcggat

SEQ ID NO: 242740 - DNA, 25 bp, Mus musculus
cctataaaaggcacacgcgggcatg

SEQ ID NO: 242741 - DNA, 25 bp, Mus musculus
tcgaggaccgcctggttctcctata

SEQ ID NO: 242742 - DNA, 25 bp, Mus musculus
gccaataggcatggacgacgtcgtc

SEQ ID NO: 242743 - DNA, 25 bp, Mus musculus
ggacagtcgatggaaccagccaata

SEQ ID NO: 242744 - DNA, 25 bp, Mus musculus
acgcgcatgtttattgagtgaggca

SEQ ID NO: 242745 - DNA, 25 bp, Mus musculus
tttgggcatcctggggaagttctgt

SEQ ID NO: 242746 - DNA, 25 bp, Mus musculus
gcgagcagagcgaccctggactcga

SEQ ID NO: 242747 - DNA, 25 bp, Mus musculus
agcatcttgccatccgcttggcttc

SEQ ID NO: 242748 - DNA, 25 bp, Mus musculus
ttgccatccgcttggcttcggggta

SEQ ID NO: 242749 - DNA, 25 bp, Mus musculus
cagagcttacactcggcgtcggcta

SEQ ID NO: 242750 - DNA, 25 bp, Mus musculus
gcgtcggctacggttctccggagcc

SEQ ID NO: 242751 - DNA, 25 bp, Mus musculus
actctgtgcccacactcggagcgta

SEQ ID NO: 242752 - DNA, 25 bp, Mus musculus
aggccgaatcgaggagatcccgcgc

SEQ ID NO: 242753 - DNA, 25 bp, Mus musculus
cgtagcctttttatgtccatacggg

SEQ ID NO: 242754 - DNA, 25 bp, Mus musculus
aatcgaggagatcccgcgcccaggg

SEQ ID NO: 242755 - DNA, 25 bp, Mus musculus
tccatacgggttcggagttgagcct

SEQ ID NO: 242756 - DNA, 25 bp, Mus musculus
gttcggagttgagcctccgctcgtt

SEQ ID NO: 242757 - DNA, 25 bp, Mus musculus
ctccgctcgttggtttcgtcaaggc

SEQ ID NO: 242758 - DNA, 25 bp, Mus musculus
acactcggagcgtagcctttttatg

SEQ ID NO: 242759 - DNA, 25 bp, Mus musculus
gaccctggactcgagcatcttgcca

SEQ ID NO: 242760 - DNA, 25 bp, Mus musculus
cctctcttccgtcgggccctgctaa

SEQ ID NO: 242761 - DNA, 25 bp, Mus musculus
ctccgcgctgcgtccggaaaactga

SEQ ID NO: 242762 - DNA, 25 bp, Mus musculus
aaaaacgtggggctggctccgcgct

SEQ ID NO: 242763 - DNA, 25 bp, Mus musculus
ggatccgcagcgacggcgctcgctc

SEQ ID NO: 242764 - DNA, 25 bp, Mus musculus
gtgggcttccgctccaactggaaaa

SEQ ID NO: 242765 - DNA, 25 bp, Mus musculus
cggttgtcacctctcttccgtcggg

SEQ ID NO: 242766 - DNA, 25 bp, Mus musculus
aggcttcagccctgcggccggttgt

SEQ ID NO: 242767 - DNA, 25 bp, Mus musculus
cccagcgctgacctccaggcttcag

SEQ ID NO: 242768 - DNA, 25 bp, Mus musculus
tggtgctcgggggacgacttcctcc

SEQ ID NO: 242769 - DNA, 25 bp, Mus musculus
agcagggtgcatacgccccacggat

SEQ ID NO: 242770 - DNA, 25 bp, Mus musculus
gcagaaggagcagaagcgctggcga

SEQ ID NO: 242771 - DNA, 25 bp, Mus musculus
tgcgtccggaaaactgaggcagaag

SEQ ID NO: 242772 - DNA, 25 bp, Mus musculus
gcgctgcgtccggaaaactgaggca

SEQ ID NO: 242773 - DNA, 25 bp, Mus musculus
ctcgctagctcactcggacctcggc

SEQ ID NO: 242774 - DNA, 25 bp, Mus musculus
ggctgacttcgagcatgcacgactg

SEQ ID NO: 242775 - DNA, 25 bp, Mus musculus
atggagcgcctctgcttaagtttcc

SEQ ID NO: 242776 - DNA, 25 bp, Mus musculus
tgggcgagtcctcccaaacctgtca

SEQ ID NO: 242777 - DNA, 25 bp, Mus musculus
cctgtcactgagagatggcctcggc

SEQ ID NO: 242778 - DNA, 25 bp, Mus musculus
ctggtcgtccagcttgttaatctac

SEQ ID NO: 242779 - DNA, 25 bp, Mus musculus
cacggtaacacatcgataaggctga

SEQ ID NO: 242780 - DNA, 25 bp, Mus musculus
cggaagccactgtttccctccatgg

SEQ ID NO: 242781 - DNA, 25 bp, Mus musculus
acagtctcgatgtgcactctccgga

SEQ ID NO: 242782 - DNA, 25 bp, Mus musculus
ccaatgaacgtggaacgcgaccctg

SEQ ID NO: 242783 - DNA, 25 bp, Mus musculus
tgagttccagctcaagcccgccttt

SEQ ID NO: 242784 - DNA, 25 bp, Mus musculus
tgtagttcctatccttcccggcgca

SEQ ID NO: 242785 - DNA, 25 bp, Mus musculus
gtggcaccactcatcgtagaatgga

SEQ ID NO: 242786 - DNA, 25 bp, Mus musculus
actcttcctggatactgaggcgcga

SEQ ID NO: 242787 - DNA, 25 bp, Mus musculus
atgccttccgcaatgcctcctggga

SEQ ID NO: 242788 - DNA, 25 bp, Mus musculus
atacggctgagtcggcactgtcatt

SEQ ID NO: 242789 - DNA, 25 bp, Mus musculus
caggcacgtccttggccgacgaggt

SEQ ID NO: 242790 - DNA, 25 bp, Mus musculus
ctgtggatacggctgagtcggcact

SEQ ID NO: 242791 - DNA, 25 bp, Mus musculus
actcgtccatggaggagtctgtgga

SEQ ID NO: 242792 - DNA, 25 bp, Mus musculus
cgtccatggaggagtctgtggatac

SEQ ID NO: 242793 - DNA, 25 bp, Mus musculus
cgtccttggccgacgaggtctccga

SEQ ID NO: 242794 - DNA, 25 bp, Mus musculus
gagggcccttaccgtgggctccaca

SEQ ID NO: 242795 - DNA, 25 bp, Mus musculus
gcaggctgccggcaggcacgtcctt

SEQ ID NO: 242796 - DNA, 25 bp, Mus musculus
ttgagatcgttgagggcagtgcgca

SEQ ID NO: 242797 - DNA, 25 bp, Mus musculus
tgtatcagcctcttgagatcgttga

SEQ ID NO: 242798 - DNA, 25 bp, Mus musculus
gtccacgatgctctgtatcagcctc

SEQ ID NO: 242799 - DNA, 25 bp, Mus musculus
acaccgtccacgatgctctgtatca

SEQ ID NO: 242800 - DNA, 25 bp, Mus musculus
cttaccgtgggctccacaccgtcca

SEQ ID NO: 242801 - DNA, 25 bp, Mus musculus
aggtctccgaggactcgtccatgga

SEQ ID NO: 242802 - DNA, 25 bp, Mus musculus
cggagcagtccttccttcttgcctg

SEQ ID NO: 242803 - DNA, 25 bp, Mus musculus
gggttcagccgccctgttgctgccg

SEQ ID NO: 242804 - DNA, 25 bp, Mus musculus
gcgggattcgccgacgctccgctcg

SEQ ID NO: 242805 - DNA, 25 bp, Mus musculus
ctcggccggccaagcccaggcagaa

SEQ ID NO: 242806 - DNA, 25 bp, Mus musculus
ggctcgacatcgttggccgcacagc

SEQ ID NO: 242807 - DNA, 25 bp, Mus musculus
tcgctgcgtcgctcgttgctgctgc

SEQ ID NO: 242808 - DNA, 25 bp, Mus musculus
ggcagctccatgcagcaggcgctgt

SEQ ID NO: 242809 - DNA, 25 bp, Mus musculus
cccaggcagaaggcggacatggccc

SEQ ID NO: 242810 - DNA, 25 bp, Mus musculus
ttcgcctcgccttgcgccgcggcac

SEQ ID NO: 242811 - DNA, 25 bp, Mus musculus
agaagccgcgctaaggatcgccgcc

SEQ ID NO: 242812 - DNA, 25 bp, Mus musculus
tccgctgtcgctgcgtcgctcgttg

SEQ ID NO: 242813 - DNA, 25 bp, Mus musculus
gccgctccttgcagccgcgctccat

SEQ ID NO: 242814 - DNA, 25 bp, Mus musculus
cggcggctcgacatcgttggccgca

SEQ ID NO: 242815 - DNA, 25 bp, Mus musculus
cagcagtggcgggactccggactgc

SEQ ID NO: 242816 - DNA, 25 bp, Mus musculus
gaccgcgactggaactccgaacaga

SEQ ID NO: 242817 - DNA, 25 bp, Mus musculus
tggctgggaatctgcagggacacaa

SEQ ID NO: 242818 - DNA, 25 bp, Mus musculus
ctcgtgttgcccatggctgggaatc

SEQ ID NO: 242819 - DNA, 25 bp, Mus musculus
ctccaagttggttactctccagtaa

SEQ ID NO: 242820 - DNA, 25 bp, Mus musculus
agctccgctttacctggctcgggcg

SEQ ID NO: 242821 - DNA, 25 bp, Mus musculus
agagccggagcgtaacctgacactc

SEQ ID NO: 242822 - DNA, 25 bp, Mus musculus
ctctcggagttagggtgacatcagt

SEQ ID NO: 242823 - DNA, 25 bp, Mus musculus
gtgacatcagttccgtttccgcctc

SEQ ID NO: 242824 - DNA, 25 bp, Mus musculus
ttccctgctgctcagcgcgaagcgg

SEQ ID NO: 242825 - DNA, 25 bp, Mus musculus
ggctgccaccagatcgagcttcgta

SEQ ID NO: 242826 - DNA, 25 bp, Mus musculus
cgcgagcgagcgagaatgccagaat

SEQ ID NO: 242827 - DNA, 25 bp, Mus musculus
aatgccatggatggcgccgaccacc

SEQ ID NO: 242828 - DNA, 25 bp, Mus musculus
cgaccacctcactccaagttggtta

SEQ ID NO: 242829 - DNA, 25 bp, Mus musculus
ggatcgcgagtcacgccctctcgga

SEQ ID NO: 242830 - DNA, 25 bp, Mus musculus
gctgctgtggctccgactgggactc

SEQ ID NO: 242831 - DNA, 25 bp, Mus musculus
agggccttcgcttagcgcctcgtgc

SEQ ID NO: 242832 - DNA, 25 bp, Mus musculus
tagcgcctcgtgctggcatagcttt

SEQ ID NO: 242833 - DNA, 25 bp, Mus musculus
gcctcgtgctggcatagctttctgc

SEQ ID NO: 242834 - DNA, 25 bp, Mus musculus
tggcatagctttctgccgagctgta

SEQ ID NO: 242835 - DNA, 25 bp, Mus musculus
tagctttctgccgagctgtagctca

SEQ ID NO: 242836 - DNA, 25 bp, Mus musculus
cgagctgtagctcaggctccggttc

SEQ ID NO: 242837 - DNA, 25 bp, Mus musculus
tgtagctcaggctccggttccgact

SEQ ID NO: 242838 - DNA, 25 bp, Mus musculus
tccggttccgactgcggctccggga

SEQ ID NO: 242839 - DNA, 25 bp, Mus musculus
ctgaggctgcgagaactggagctgc

SEQ ID NO: 242840 - DNA, 25 bp, Mus musculus
ctggctcgacggagggccttcgctt

SEQ ID NO: 242841 - DNA, 25 bp, Mus musculus
ccggctccgggagtaactgcggcta

SEQ ID NO: 242842 - DNA, 25 bp, Mus musculus
gtggctccgactgggactccggctc

SEQ ID NO: 242843 - DNA, 25 bp, Mus musculus
ctccgggtctggctccggctgctgt

SEQ ID NO: 242844 - DNA, 25 bp, Mus musculus
tcctgcgcgcacgttctcggggctg

SEQ ID NO: 242845 - DNA, 25 bp, Mus musculus
tgggaagaatctgctcccgtgagca

SEQ ID NO: 242846 - DNA, 25 bp, Mus musculus
cgcactctgggaagaatctgctccc

SEQ ID NO: 242847 - DNA, 25 bp, Mus musculus
tcactgaggctaggctttgtcaggg

SEQ ID NO: 242848 - DNA, 25 bp, Mus musculus
ctgtgttcactgaggctaggctttg

SEQ ID NO: 242849 - DNA, 25 bp, Mus musculus
ctcttaactgtgttcactgaggcta

SEQ ID NO: 242850 - DNA, 25 bp, Mus musculus
tgtgtgagactcttaactgtgttca

SEQ ID NO: 242851 - DNA, 25 bp, Mus musculus
gtgcgtgctgtgtgagactcttaac

SEQ ID NO: 242852 - DNA, 25 bp, Mus musculus
gctggcttttctacgggtgcgtgct

SEQ ID NO: 242853 - DNA, 25 bp, Mus musculus
ttactaggtaactagggctgggctg

SEQ ID NO: 242854 - DNA, 25 bp, Mus musculus
tcccgttccctgaaggggtgtagca

SEQ ID NO: 242855 - DNA, 25 bp, Mus musculus
tctcaccatactttaggtcccgttc

SEQ ID NO: 242856 - DNA, 25 bp, Mus musculus
tcccgtgagcaccatgggatgagct

SEQ ID NO: 242857 - DNA, 25 bp, Mus musculus
gttctcggggctgtggttctttctc

SEQ ID NO: 242858 - DNA, 25 bp, Mus musculus
tggatcaggccgaagggtacccact

SEQ ID NO: 242859 - DNA, 25 bp, Mus musculus
acccagtgcgcatgcttgggactcc

SEQ ID NO: 242860 - DNA, 25 bp, Mus musculus
tgggactcccttcgcttgcaaccgt

SEQ ID NO: 242861 - DNA, 25 bp, Mus musculus
gagttggcttcgtctcgtcctcctt

SEQ ID NO: 242862 - DNA, 25 bp, Mus musculus
gaagccgtgctccagactgccgcgt

SEQ ID NO: 242863 - DNA, 25 bp, Mus musculus
aactgtcgccgcgaacccgcagagg

SEQ ID NO: 242864 - DNA, 25 bp, Mus musculus
acctccggcgtggaaaagagtagca

SEQ ID NO: 242865 - DNA, 25 bp, Mus musculus
ctgagaagaaacttgcggctcgcga

SEQ ID NO: 242866 - DNA, 25 bp, Mus musculus
ttgtgtaaccggtctcatccagttc

SEQ ID NO: 242867 - DNA, 25 bp, Mus musculus
gtgaggcctggagccttcccttacc

SEQ ID NO: 242868 - DNA, 25 bp, Mus musculus
ttcccttaccgtgcggtgtcatctg

SEQ ID NO: 242869 - DNA, 25 bp, Mus musculus
cccaagtggcacgagttgataaatc

SEQ ID NO: 242870 - DNA, 25 bp, Mus musculus
aaatcacctgtcatttagggcgacg

SEQ ID NO: 242871 - DNA, 25 bp, Mus musculus
gtacccactgttgaggacgccgcac

SEQ ID NO: 242872 - DNA, 25 bp, Mus musculus
cgcccgggttttgtctcttgcacaa

SEQ ID NO: 242873 - DNA, 25 bp, Mus musculus
ggcgaagcaaagctagccggctttc

SEQ ID NO: 242874 - DNA, 25 bp, Mus musculus
tgagctccgtgtcttcggcgaagca

SEQ ID NO: 242875 - DNA, 25 bp, Mus musculus
ggttcacctcttggcttggctctga

SEQ ID NO: 242876 - DNA, 25 bp, Mus musculus
ttacaaacccgatgacacgccctgg

SEQ ID NO: 242877 - DNA, 25 bp, Mus musculus
tgctgaaacgtggattacaaacccg

SEQ ID NO: 242878 - DNA, 25 bp, Mus musculus
gcgctgtccgaagtgctgaaacgtg

SEQ ID NO: 242879 - DNA, 25 bp, Mus musculus
gctagccatcctgaaagcccaagga

SEQ ID NO: 242880 - DNA, 25 bp, Mus musculus
cctgctgcaggctagccatcctgaa

SEQ ID NO: 242881 - DNA, 25 bp, Mus musculus
aacagctgtttctcgccctgctgca

SEQ ID NO: 242882 - DNA, 25 bp, Mus musculus
gaaggtccctttccagaacttctca

SEQ ID NO: 242883 - DNA, 25 bp, Mus musculus
ggccactgctttgaaggtccctttc

SEQ ID NO: 242884 - DNA, 25 bp, Mus musculus
gtctcttgcacaatgtgacgttgga

SEQ ID NO: 242885 - DNA, 25 bp, Mus musculus
tgatactggcgacgatgatgctctc

SEQ ID NO: 242886 - DNA, 25 bp, Mus musculus
aaagccagggcgagcattgctccga

SEQ ID NO: 242887 - DNA, 25 bp, Mus musculus
cccgagtgcggaaatgagagacgct

SEQ ID NO: 242888 - DNA, 25 bp, Mus musculus
cctggctcgcaagagctctggcgac

SEQ ID NO: 242889 - DNA, 25 bp, Mus musculus
acccgcaccttcgtcggactctcgg

SEQ ID NO: 242890 - DNA, 25 bp, Mus musculus
gctacttccgggtcgtgggctgctc

SEQ ID NO: 242891 - DNA, 25 bp, Mus musculus
gggctgctcggtgacagcctgatca

SEQ ID NO: 242892 - DNA, 25 bp, Mus musculus
tgacagcctgatcaggccgtcctcg

SEQ ID NO: 242893 - DNA, 25 bp, Mus musculus
tgatcaggccgtcctcgagacggta

SEQ ID NO: 242894 - DNA, 25 bp, Mus musculus
tcctcgagacggtaggtgagacgcc

SEQ ID NO: 242895 - DNA, 25 bp, Mus musculus
gccggggctccacggtttctgacac

SEQ ID NO: 242896 - DNA, 25 bp, Mus musculus
tccacggtttctgacacggcggccg

SEQ ID NO: 242897 - DNA, 25 bp, Mus musculus
gtcactgtcttaagaatccgcgatc

SEQ ID NO: 242898 - DNA, 25 bp, Mus musculus
taagaatccgcgatcggccacggcg

SEQ ID NO: 242899 - DNA, 25 bp, Mus musculus
agcattgctccgacccgagtgcgga

SEQ ID NO: 242900 - DNA, 25 bp, Mus musculus
gcaaggtcaatcgagcgcctatata

SEQ ID NO: 242901 - DNA, 25 bp, Mus musculus
ggcaatgggattaacgaggcgactt

SEQ ID NO: 242902 - DNA, 25 bp, Mus musculus
gagttgttagcggttctgccagtgc

SEQ ID NO: 242903 - DNA, 25 bp, Mus musculus
tggccgtgggataagcgaaagaacc

SEQ ID NO: 242904 - DNA, 25 bp, Mus musculus
gggcacccgagtgacatcccgagtc

SEQ ID NO: 242905 - DNA, 25 bp, Mus musculus
gagaacctatcaaagcatggctgtg

SEQ ID NO: 242906 - DNA, 25 bp, Mus musculus
gctcggacttcccaggcaaggtcaa

SEQ ID NO: 242907 - DNA, 25 bp, Mus musculus
ctggatccatcgaccgctcggactt

SEQ ID NO: 242908 - DNA, 25 bp, Mus musculus
cccaagttaagagagcttccgcgtt

SEQ ID NO: 242909 - DNA, 25 bp, Mus musculus
gcccgaaggggccatagctaaccca

SEQ ID NO: 242910 - DNA, 25 bp, Mus musculus
ttgaccctggcgcagcacaaacaga

SEQ ID NO: 242911 - DNA, 25 bp, Mus musculus
cgtggggaaagagagccaagaactt

SEQ ID NO: 242912 - DNA, 25 bp, Mus musculus
cacggtggtccgacaagacaagaca

SEQ ID NO: 242913 - DNA, 25 bp, Mus musculus
cgaagacccagcacgagagcgactc

SEQ ID NO: 242914 - DNA, 25 bp, Mus musculus
ggtgacgctcccgtccggtatacaa

SEQ ID NO: 242915 - DNA, 25 bp, Mus musculus
cccactggctgatgtcggcggccat

SEQ ID NO: 242916 - DNA, 25 bp, Mus musculus
gccagggtcactgcgaaacttcgcg

SEQ ID NO: 242917 - DNA, 25 bp, Mus musculus
ggtatacaaaggctgagctcgaggc

SEQ ID NO: 242918 - DNA, 25 bp, Mus musculus
cacaccgtacctgggtgggcgttag

SEQ ID NO: 242919 - DNA, 25 bp, Mus musculus
ggcgttagcactttgcccagctcgt

SEQ ID NO: 242920 - DNA, 25 bp, Mus musculus
ctcctgcaagcacaagggcccggcc

SEQ ID NO: 242921 - DNA, 25 bp, Mus musculus
cgtccggtatacaaaggctgagctc

SEQ ID NO: 242922 - DNA, 25 bp, Mus musculus
acgccgagtcccgagcgctgttaac

SEQ ID NO: 242923 - DNA, 25 bp, Mus musculus
gtcccgagcgctgttaacgtaaagc

SEQ ID NO: 242924 - DNA, 25 bp, Mus musculus
gctgttaacgtaaagcgcttgcgca

SEQ ID NO: 242925 - DNA, 25 bp, Mus musculus
aaagcgcttgcgcagttgactgccg

SEQ ID NO: 242926 - DNA, 25 bp, Mus musculus
cgagcgccagggtcactgcgaaact

SEQ ID NO: 242927 - DNA, 25 bp, Mus musculus
ggaccaaccgcaggtcgggtcacgc

SEQ ID NO: 242928 - DNA, 25 bp, Mus musculus
gcgcgcactcggctgtcttcgcacc

SEQ ID NO: 242929 - DNA, 25 bp, Mus musculus
ccggcgcatccatttctgtggcgtc

SEQ ID NO: 242930 - DNA, 25 bp, Mus musculus
ccatcaagtgcgtggtggttggcga

SEQ ID NO: 242931 - DNA, 25 bp, Mus musculus
tcttcgcacccgacactcggcggtg

SEQ ID NO: 242932 - DNA, 25 bp, Mus musculus
ccaggcgaggcagctctgccgcgcc

SEQ ID NO: 242933 - DNA, 25 bp, Mus musculus
tccaaggactggctggggctccgcc

SEQ ID NO: 242934 - DNA, 25 bp, Mus musculus
ttgttcctgggtgcggaccctcagc

SEQ ID NO: 242935 - DNA, 25 bp, Mus musculus
gcacgtccttgttcctgggtgcgga

SEQ ID NO: 242936 - DNA, 25 bp, Mus musculus
acaccgtggcacgtccttgttcctg

SEQ ID NO: 242937 - DNA, 25 bp, Mus musculus
tgagctacaccgtggcacgtccttg

SEQ ID NO: 242938 - DNA, 25 bp, Mus musculus
aacctgagctacaccgtggcacgtc

SEQ ID NO: 242939 - DNA, 25 bp, Mus musculus
ctgtggcgtcgccaacctgagctac

SEQ ID NO: 242940 - DNA, 25 bp, Mus musculus
atccatttctgtggcgtcgccaacc

SEQ ID NO: 242941 - DNA, 25 bp, Mus musculus
tgcggcgccgggcatttctccgcag

SEQ ID NO: 242942 - DNA, 25 bp, Mus musculus
ggccagcggctgttgttttccgcca

SEQ ID NO: 242943 - DNA, 25 bp, Mus musculus
ctcccggagtgagtttacctgagcc

SEQ ID NO: 242944 - DNA, 25 bp, Mus musculus
tacggagttgcttccttacgccctc

SEQ ID NO: 242945 - DNA, 25 bp, Mus musculus
gattgacccggccttacacctgtaa

SEQ ID NO: 242946 - DNA, 25 bp, Mus musculus
cgctgtaagcttccatttgtgtcca

SEQ ID NO: 242947 - DNA, 25 bp, Mus musculus
taactccgtgttctggctttgcccg

SEQ ID NO: 242948 - DNA, 25 bp, Mus musculus
tgcgcgctttcccaggagtagatct

SEQ ID NO: 242949 - DNA, 25 bp, Mus musculus
cccagatgacaagcgcgatagagcc

SEQ ID NO: 242950 - DNA, 25 bp, Mus musculus
acccgagtctcgtggttgcttttgg

SEQ ID NO: 242951 - DNA, 25 bp, Mus musculus
gtggtctcgacccaagttcattcga

SEQ ID NO: 242952 - DNA, 25 bp, Mus musculus
actcgctcttctcgtgtggtctcga

SEQ ID NO: 242953 - DNA, 25 bp, Mus musculus
acggtcgcgggatcatctttccctg

SEQ ID NO: 242954 - DNA, 25 bp, Mus musculus
ctccgcaggtaagggacttgccacc

SEQ ID NO: 242955 - DNA, 25 bp, Mus musculus
tgagatcgtcgcacaaggccctcct

SEQ ID NO: 242956 - DNA, 25 bp, Mus musculus
gggagggcagctttgtttcactttc

SEQ ID NO: 242957 - DNA, 25 bp, Mus musculus
cactgccccggggtgacacgtaggt

SEQ ID NO: 242958 - DNA, 25 bp, Mus musculus
cgcccatcgcggctcggtagtagct

SEQ ID NO: 242959 - DNA, 25 bp, Mus musculus
ggcttctggcctcagcgcccatcgc

SEQ ID NO: 242960 - DNA, 25 bp, Mus musculus
ccactggactgggatggctccagag

SEQ ID NO: 242961 - DNA, 25 bp, Mus musculus
agcccactggactgggatggctcca

SEQ ID NO: 242962 - DNA, 25 bp, Mus musculus
ctgagcgagcccactggactgggat

SEQ ID NO: 242963 - DNA, 25 bp, Mus musculus
gaccggccgccgtccctgagcgagc

SEQ ID NO: 242964 - DNA, 25 bp, Mus musculus
ttcgctgtcagctgcggcagccggc

SEQ ID NO: 242965 - DNA, 25 bp, Mus musculus
actttcgctgtcagctgcggcagcc

SEQ ID NO: 242966 - DNA, 25 bp, Mus musculus
ttcactttcgctgtcagctgcggca

SEQ ID NO: 242967 - DNA, 25 bp, Mus musculus
tttgtttcactttcgctgtcagctg

SEQ ID NO: 242968 - DNA, 25 bp, Mus musculus
gggcagctttgtttcactttcgctg

SEQ ID NO: 242969 - DNA, 25 bp, Mus musculus
gagggcagctttgtttcactttcgc

SEQ ID NO: 242970 - DNA, 25 bp, Mus musculus
tcggacacgagttcgaatccaacca

SEQ ID NO: 242971 - DNA, 25 bp, Mus musculus
ctcctcgcacgaggtccagggtgac

SEQ ID NO: 242972 - DNA, 25 bp, Mus musculus
gttaccgcctgagtcggctgtctca

SEQ ID NO: 242973 - DNA, 25 bp, Mus musculus
tgctaggtaaccctaggcgccggcc

SEQ ID NO: 242974 - DNA, 25 bp, Mus musculus
tgactgacagatgctgcgggtccct

SEQ ID NO: 242975 - DNA, 25 bp, Mus musculus
cggccgccgtcatgactgacagatg

SEQ ID NO: 242976 - DNA, 25 bp, Mus musculus
ctgcaaagctcctaggaggaagagc

SEQ ID NO: 242977 - DNA, 25 bp, Mus musculus
agcggggaaggatctgcaaagctcc

SEQ ID NO: 242978 - DNA, 25 bp, Mus musculus
agctcagagcccgttcaggtatgga

SEQ ID NO: 242979 - DNA, 25 bp, Mus musculus
cccgaggatggctaagctgagctca

SEQ ID NO: 242980 - DNA, 25 bp, Mus musculus
aatttattagggtcatcggagcgca

SEQ ID NO: 242981 - DNA, 25 bp, Mus musculus
agagtgcaagcgctgaattcggaca

SEQ ID NO: 242982 - DNA, 25 bp, Mus musculus
ccgcaaataaagaggggatagagtg

SEQ ID NO: 242983 - DNA, 25 bp, Mus musculus
tcatcggagcgcagaggcgatgctc

SEQ ID NO: 242984 - DNA, 25 bp, Mus musculus
ccacccaggccaccgagtacctctc

SEQ ID NO: 242985 - DNA, 25 bp, Mus musculus
gcccttcacggagccggtgtgcgaa

SEQ ID NO: 242986 - DNA, 25 bp, Mus musculus
aattccgcccttcacggagccggtg

SEQ ID NO: 242987 - DNA, 25 bp, Mus musculus
atacatataattccgcccttcacgg

SEQ ID NO: 242988 - DNA, 25 bp, Mus musculus
ccgcccaaatagatttatatacata

SEQ ID NO: 242989 - DNA, 25 bp, Mus musculus
gcgctcctttttgacataaaagcca

SEQ ID NO: 242990 - DNA, 25 bp, Mus musculus
caggcgcgctcctttttgacataaa

SEQ ID NO: 242991 - DNA, 25 bp, Mus musculus
accatgccgtgtcccgcgaccagaa

SEQ ID NO: 242992 - DNA, 25 bp, Mus musculus
cgcgccagccgtgcgcacagcatcc

SEQ ID NO: 242993 - DNA, 25 bp, Mus musculus
ggagcagaccgcagccagccgcagt

SEQ ID NO: 242994 - DNA, 25 bp, Mus musculus
cagcaacggcgacagtggcaacagc

SEQ ID NO: 242995 - DNA, 25 bp, Mus musculus
caggagcgatttcagcagccgtccc

SEQ ID NO: 242996 - DNA, 25 bp, Mus musculus
cgaggcaggagcgatttcagcagcc

SEQ ID NO: 242997 - DNA, 25 bp, Mus musculus
tgattgacaggcaagatgtcggtgt

SEQ ID NO: 242998 - DNA, 25 bp, Mus musculus
ctcggcagcaggtgagttctcagcc

SEQ ID NO: 242999 - DNA, 25 bp, Mus musculus
cacgcccataaaccagccggttgga

SEQ ID NO: 243000 - DNA, 25 bp, Mus musculus
gccggttggacgtcaccactaattc

SEQ ID NO: 243001 - DNA, 25 bp, Mus musculus
ccactaattcgtttcagcggtgata

SEQ ID NO: 243002 - DNA, 25 bp, Mus musculus
cgcggtccctgcgtattgatgcagc

SEQ ID NO: 243003 - DNA, 25 bp, Mus musculus
agcacagcggctgctactaggggca

SEQ ID NO: 243004 - DNA, 25 bp, Mus musculus
tggcagcttccagtcctgaacttgg

SEQ ID NO: 243005 - DNA, 25 bp, Mus musculus
tcctgaacttggctaggctagagcg

SEQ ID NO: 243006 - DNA, 25 bp, Mus musculus
ggagcgctcgctctggaagctccta

SEQ ID NO: 243007 - DNA, 25 bp, Mus musculus
tgaacagcgtgatccacagccctgg

SEQ ID NO: 243008 - DNA, 25 bp, Mus musculus
catgtaccttctcagggacctgcgc

SEQ ID NO: 243009 - DNA, 25 bp, Mus musculus
ccttggacccaaggtatcccatgta

SEQ ID NO: 243010 - DNA, 25 bp, Mus musculus
caacttggctctccttggcggcctg

SEQ ID NO: 243011 - DNA, 25 bp, Mus musculus
aagctcctaccctgtggcgctgttg

SEQ ID NO: 243012 - DNA, 25 bp, Mus musculus
tgctggagtacatcctgtgcagcgg

SEQ ID NO: 243013 - DNA, 25 bp, Mus musculus
tcaggtacgcggacaagatggcgtc

SEQ ID NO: 243014 - DNA, 25 bp, Mus musculus
tgaggtgagcgagcatcccgttccc

SEQ ID NO: 243015 - DNA, 25 bp, Mus musculus
atgttgacgtgcaggcaaagcagcg

SEQ ID NO: 243016 - DNA, 25 bp, Mus musculus
ccctgagggcgtggtacggcttctt

SEQ ID NO: 243017 - DNA, 25 bp, Mus musculus
ttcttaggctcctatcgcgcgcgcg

SEQ ID NO: 243018 - DNA, 25 bp, Mus musculus
gaggtgctggagtacatcctgtgca

SEQ ID NO: 243019 - DNA, 25 bp, Mus musculus
gcgctggacatcggccgcgtgtcca

SEQ ID NO: 243020 - DNA, 25 bp, Mus musculus
gtgagcgagcatcccgttcccggga

SEQ ID NO: 243021 - DNA, 25 bp, Mus musculus
ggccgcagacaaaggcctgcctgca

SEQ ID NO: 243022 - DNA, 25 bp, Mus musculus
aggcgcatcttttgtggccgctgca

SEQ ID NO: 243023 - DNA, 25 bp, Mus musculus
cgcatcttttgtggccgctgcagga

SEQ ID NO: 243024 - DNA, 25 bp, Mus musculus
tgcaggatgttgacgtgcaggcaaa

SEQ ID NO: 243025 - DNA, 25 bp, Mus musculus
tggtacggcttcttaggctcctatc

SEQ ID NO: 243026 - DNA, 25 bp, Mus musculus
gtcgtttctgatcgtcacacgtgga

SEQ ID NO: 243027 - DNA, 25 bp, Mus musculus
ccatttcagcatacccgagcgctga

SEQ ID NO: 243028 - DNA, 25 bp, Mus musculus
agaccgctgctggaacgagcatccc

SEQ ID NO: 243029 - DNA, 25 bp, Mus musculus
cccagtagtttgacaagtcgtttct

SEQ ID NO: 243030 - DNA, 25 bp, Mus musculus
agggccacttgctgcggacgcacac

SEQ ID NO: 243031 - DNA, 25 bp, Mus musculus
gagccttgagccagggccacttgct

SEQ ID NO: 243032 - DNA, 25 bp, Mus musculus
accctcaggtgacggtctgggagcc

SEQ ID NO: 243033 - DNA, 25 bp, Mus musculus
gctaccatgaccatatgccagtttt

SEQ ID NO: 243034 - DNA, 25 bp, Mus musculus
tgggacggcgctaccatgaccatat

SEQ ID NO: 243035 - DNA, 25 bp, Mus musculus
cgatgacgtcacactagccgggcct

SEQ ID NO: 243036 - DNA, 25 bp, Mus musculus
cggctcacggcacactggtcacaga

SEQ ID NO: 243037 - DNA, 25 bp, Mus musculus
ttggctaaagcccacgcggctcacg

SEQ ID NO: 243038 - DNA, 25 bp, Mus musculus
cgctgacagctctgctcttcttaaa

SEQ ID NO: 243039 - DNA, 25 bp, Mus musculus
gctcttcttaaatcccattggctaa

SEQ ID NO: 243040 - DNA, 25 bp, Mus musculus
gcgctgcacctgcaagtctgcggct

SEQ ID NO: 243041 - DNA, 25 bp, Mus musculus
ctcagtttgcctcctctgaggaatg

SEQ ID NO: 243042 - DNA, 25 bp, Mus musculus
ggaccagtcagttcccgtctcagtt

SEQ ID NO: 243043 - DNA, 25 bp, Mus musculus
acagagcgggttgtgagttctgcca

SEQ ID NO: 243044 - DNA, 25 bp, Mus musculus
ctcaacctgtttcggtggtgggaca

SEQ ID NO: 243045 - DNA, 25 bp, Mus musculus
tgagttgagagcacccagtcagccc

SEQ ID NO: 243046 - DNA, 25 bp, Mus musculus
ccgcgcttgaccctgggctcagaag

SEQ ID NO: 243047 - DNA, 25 bp, Mus musculus
gctgcttctgatgggttcccgccag

SEQ ID NO: 243048 - DNA, 25 bp, Mus musculus
accttgggctagtggcttgccctct

SEQ ID NO: 243049 - DNA, 25 bp, Mus musculus
tcgcgccaccgtgctgtgtgacctt

SEQ ID NO: 243050 - DNA, 25 bp, Mus musculus
tgtgagtaccacaccgtggccggga

SEQ ID NO: 243051 - DNA, 25 bp, Mus musculus
ggcaagaccggctgtgagtaccaca

SEQ ID NO: 243052 - DNA, 25 bp, Mus musculus
cagaagcgaccaggggacccggact

SEQ ID NO: 243053 - DNA, 25 bp, Mus musculus
ccgagaggcgacttgacccaagcct

SEQ ID NO: 243054 - DNA, 25 bp, Mus musculus
agctgatccaccagcggctcgggct

SEQ ID NO: 243055 - DNA, 25 bp, Mus musculus
accatagatggtgggcccacaggga

SEQ ID NO: 243056 - DNA, 25 bp, Mus musculus
tccgtagtcggcctggagacttccg

SEQ ID NO: 243057 - DNA, 25 bp, Mus musculus
agtcgcggatgagctgatccaccag

SEQ ID NO: 243058 - DNA, 25 bp, Mus musculus
cgtcttgtaggttccgggcagccac

SEQ ID NO: 243059 - DNA, 25 bp, Mus musculus
gcgatcggctggacgtatccttcct

SEQ ID NO: 243060 - DNA, 25 bp, Mus musculus
gctggacgtatccttcctgtcgcct

SEQ ID NO: 243061 - DNA, 25 bp, Mus musculus
cagtgccggcggaactcctccaggt

SEQ ID NO: 243062 - DNA, 25 bp, Mus musculus
cctccaggttgtggtcgtccatgct

SEQ ID NO: 243063 - DNA, 25 bp, Mus musculus
gtcgtccatgcttgacgcgcccagg

SEQ ID NO: 243064 - DNA, 25 bp, Mus musculus
tgccagaatggggacggactgtcca

SEQ ID NO: 243065 - DNA, 25 bp, Mus musculus
gacggactgtccatccgccggaagt

SEQ ID NO: 243066 - DNA, 25 bp, Mus musculus
cgccggaagtgtccgtagtcggcct

SEQ ID NO: 243067 - DNA, 25 bp, Mus musculus
cggccactcaccaagtcgcggatga

SEQ ID NO: 243068 - DNA, 25 bp, Mus musculus
cttcatttcagggttcaggctccca

SEQ ID NO: 243069 - DNA, 25 bp, Mus musculus
cgcgtgtcaggaatgtgtgcaccca

SEQ ID NO: 243070 - DNA, 25 bp, Mus musculus
tgcacccacccggaggctgacaggt

SEQ ID NO: 243071 - DNA, 25 bp, Mus musculus
aggctgtcccgaaacagggcaagtc

SEQ ID NO: 243072 - DNA, 25 bp, Mus musculus
ggcaagtcggcttgaaccctgcctc

SEQ ID NO: 243073 - DNA, 25 bp, Mus musculus
agcccggggatcttttcgcattacg

SEQ ID NO: 243074 - DNA, 25 bp, Mus musculus
cgcattacggccgaattctcccgga

SEQ ID NO: 243075 - DNA, 25 bp, Mus musculus
agcccggaccgagcaacaggtacgc

SEQ ID NO: 243076 - DNA, 25 bp, Mus musculus
cgtcagcacaacaaacgcgcggtga

SEQ ID NO: 243077 - DNA, 25 bp, Mus musculus
tttaattaataatagcgccgtcagc

SEQ ID NO: 243078 - DNA, 25 bp, Mus musculus
tgcgcttaagtcaggtcaccagaag

SEQ ID NO: 243079 - DNA, 25 bp, Mus musculus
ttctcccggagctcaattcacagtg

SEQ ID NO: 243080 - DNA, 25 bp, Mus musculus
tcaattcacagtgcgcaccgagctg

SEQ ID NO: 243081 - DNA, 25 bp, Mus musculus
agctggctttccaggctatctccga

SEQ ID NO: 243082 - DNA, 25 bp, Mus musculus
gaaaatgtctgctttgcactgatgg

SEQ ID NO: 243083 - DNA, 25 bp, Mus musculus
atcgagatggtctcagccgcggact

SEQ ID NO: 243084 - DNA, 25 bp, Mus musculus
gggacgcgacagtgactcacgcatc

SEQ ID NO: 243085 - DNA, 25 bp, Mus musculus
gtctcccggacgcatgcgctgcaag

SEQ ID NO: 243086 - DNA, 25 bp, Mus musculus
acggagcctgctccgctagaggacg

SEQ ID NO: 243087 - DNA, 25 bp, Mus musculus
gagctctcgcccacatctaagtcta

SEQ ID NO: 243088 - DNA, 25 bp, Mus musculus
tctacccggtaagacgcgacctctg

SEQ ID NO: 243089 - DNA, 25 bp, Mus musculus
cgacctctgaatcccggagaggata

SEQ ID NO: 243090 - DNA, 25 bp, Mus musculus
ctgtgccctggctgataaagcagtg

SEQ ID NO: 243091 - DNA, 25 bp, Mus musculus
ttgaatcccgcgtggtccgcttcag

SEQ ID NO: 243092 - DNA, 25 bp, Mus musculus
tggagggactgaaccgctctcctgc

SEQ ID NO: 243093 - DNA, 25 bp, Mus musculus
cgcggctccgtgaagttgaatcccg

SEQ ID NO: 243094 - DNA, 25 bp, Mus musculus
caggcttttcatagctgtttggtta

SEQ ID NO: 243095 - DNA, 25 bp, Mus musculus
tgcggggagaaatctcagcaccttc

SEQ ID NO: 243096 - DNA, 25 bp, Mus musculus
agccgccttcaacgccagcacagtg

SEQ ID NO: 243097 - DNA, 25 bp, Mus musculus
tggacacagtgcctacctcgcggac

SEQ ID NO: 243098 - DNA, 25 bp, Mus musculus
acagtgcctacctcgcggaccaggt

SEQ ID NO: 243099 - DNA, 25 bp, Mus musculus
tacctcgcggaccaggtcgtccagg

SEQ ID NO: 243100 - DNA, 25 bp, Mus musculus
ccgactcaccgccacaacctgtgca

SEQ ID NO: 243101 - DNA, 25 bp, Mus musculus
agtgctgcgcccgatgcctgaggca

SEQ ID NO: 243102 - DNA, 25 bp, Mus musculus
tgcgcccgatgcctgaggcaagcga

SEQ ID NO: 243103 - DNA, 25 bp, Mus musculus
caagcgaggattagtgccggtaccc

SEQ ID NO: 243104 - DNA, 25 bp, Mus musculus
cccgacagtgccactcgcccgccgc

SEQ ID NO: 243105 - DNA, 25 bp, Mus musculus
gcctcctcacctctggacacagtgc

SEQ ID NO: 243106 - DNA, 25 bp, Mus musculus
ttgcccgcgccggtgaccagcgccc

SEQ ID NO: 243107 - DNA, 25 bp, Mus musculus
tccaggtcctctcgcgtccgactca

SEQ ID NO: 243108 - DNA, 25 bp, Mus musculus
gcccgccgcctcacctttgcccgcg

SEQ ID NO: 243109 - DNA, 25 bp, Mus musculus
acaacctgtgcaccagccgccttca

SEQ ID NO: 243110 - DNA, 25 bp, Mus musculus
gcgcagacaccttaggaagctggcg

SEQ ID NO: 243111 - DNA, 25 bp, Mus musculus
gaactgtcgcttcggggcgccctgc

SEQ ID NO: 243112 - DNA, 25 bp, Mus musculus
aaagtaccgctgctgcggaatcccg

SEQ ID NO: 243113 - DNA, 25 bp, Mus musculus
ggctccctggctctgaaggtccctt

SEQ ID NO: 243114 - DNA, 25 bp, Mus musculus
ggcgcgcagacaccttaggaagctg

SEQ ID NO: 243115 - DNA, 25 bp, Mus musculus
tcctctctgttctccctttcaaaag

SEQ ID NO: 243116 - DNA, 25 bp, Mus musculus
ggcgacagatgtcgcgtgggcccgc

SEQ ID NO: 243117 - DNA, 25 bp, Mus musculus
cgctggcgaagagaactgtcgcttc

SEQ ID NO: 243118 - DNA, 25 bp, Mus musculus
tcaaaagtaccgctgctgcggaatc

SEQ ID NO: 243119 - DNA, 25 bp, Mus musculus
ccctttcaaaagtaccgctgctgcg

SEQ ID NO: 243120 - DNA, 25 bp, Mus musculus
agagaactgtcgcttcggggcgccc

SEQ ID NO: 243121 - DNA, 25 bp, Mus musculus
tccctggctctgaaggtcccttgcg

SEQ ID NO: 243122 - DNA, 25 bp, Mus musculus
ggctctgaaggtcccttgcgcgcct

SEQ ID NO: 243123 - DNA, 25 bp, Mus musculus
gacgggcgcgcagacaccttaggaa

SEQ ID NO: 243124 - DNA, 25 bp, Mus musculus
tctgagtgtccacggtggtccccac

SEQ ID NO: 243125 - DNA, 25 bp, Mus musculus
tggagttccgggctgctcgtcgacc

SEQ ID NO: 243126 - DNA, 25 bp, Mus musculus
ggagttccgggctgctcgtcgaccc

SEQ ID NO: 243127 - DNA, 25 bp, Mus musculus
cccttcctctgagtgtccacggtgg

SEQ ID NO: 243128 - DNA, 25 bp, Mus musculus
cttcctctgagtgtccacggtggtc

SEQ ID NO: 243129 - DNA, 25 bp, Mus musculus
tggggatgaagacatccccgccacc

SEQ ID NO: 243130 - DNA, 25 bp, Mus musculus
tcctctgagtgtccacggtggtccc

SEQ ID NO: 243131 - DNA, 25 bp, Mus musculus
tccctggtggctggcatggggatga

SEQ ID NO: 243132 - DNA, 25 bp, Mus musculus
gggcaccatggtggaagtggtggtg

SEQ ID NO: 243133 - DNA, 25 bp, Mus musculus
cctcatccctggtggctggcatggg

SEQ ID NO: 243134 - DNA, 25 bp, Mus musculus
cggcctcatccctggtggctggcat

SEQ ID NO: 243135 - DNA, 25 bp, Mus musculus
ccgcggtgggcaccatggtggaagt

SEQ ID NO: 243136 - DNA, 25 bp, Mus musculus
acccacgtgctgcagcagggagccc

SEQ ID NO: 243137 - DNA, 25 bp, Mus musculus
cccacccacgtgctgcagcagggag

SEQ ID NO: 243138 - DNA, 25 bp, Mus musculus
taaagcagtgctggaagcggattgc

SEQ ID NO: 243139 - DNA, 25 bp, Mus musculus
agaccggacggcgaagcgcctttgc

SEQ ID NO: 243140 - DNA, 25 bp, Mus musculus
agcggccgagcatagccttcattta

SEQ ID NO: 243141 - DNA, 25 bp, Mus musculus
gccttcatttacctgccagacactg

SEQ ID NO: 243142 - DNA, 25 bp, Mus musculus
gacactgcagcaatcacggcctctg

SEQ ID NO: 243143 - DNA, 25 bp, Mus musculus
ctagccaatccctggcgtggccagg

SEQ ID NO: 243144 - DNA, 25 bp, Mus musculus
ccggcagtgccaccgagaacgcgat

SEQ ID NO: 243145 - DNA, 25 bp, Mus musculus
gatcggcgctaggaccctcgcacag

SEQ ID NO: 243146 - DNA, 25 bp, Mus musculus
ggcctgcctctagtccgagaaggtc

SEQ ID NO: 243147 - DNA, 25 bp, Mus musculus
cctgccgtcacattcagccaatgga

SEQ ID NO: 243148 - DNA, 25 bp, Mus musculus
agagccgaggctccggcagaaccaa

SEQ ID NO: 243149 - DNA, 25 bp, Mus musculus
gccctaccgggatgctgaacctggc

SEQ ID NO: 243150 - DNA, 25 bp, Mus musculus
ccctacaggacgcttgggcgcgagc

SEQ ID NO: 243151 - DNA, 25 bp, Mus musculus
gctcctgcgcaagcgctgggtgctc

SEQ ID NO: 243152 - DNA, 25 bp, Mus musculus
ctaagtgttccgtccaattttctct

SEQ ID NO: 243153 - DNA, 25 bp, Mus musculus
ggaactctggacgttttgatcgcta

SEQ ID NO: 243154 - DNA, 25 bp, Mus musculus
acgttttgatcgctaccaaggagaa

SEQ ID NO: 243155 - DNA, 25 bp, Mus musculus
cgctaccaaggagaaaaaatggaca

SEQ ID NO: 243156 - DNA, 25 bp, Mus musculus
ggacagtttcgtacgagttggattc

SEQ ID NO: 243157 - DNA, 25 bp, Mus musculus
gaagcgtctgtaaaatatgtgtgta

SEQ ID NO: 243158 - DNA, 25 bp, Mus musculus
ccgcgggaggatttatgaagcgtct

SEQ ID NO: 243159 - DNA, 25 bp, Mus musculus
cttataggaaacctcgccgcgggag

SEQ ID NO: 243160 - DNA, 25 bp, Mus musculus
cttacttataggaaacctcgccgcg

SEQ ID NO: 243161 - DNA, 25 bp, Mus musculus
tacatgagaagaagccgcaatgatg

SEQ ID NO: 243162 - DNA, 25 bp, Mus musculus
cttgagtacatgagaagaagccgca

SEQ ID NO: 243163 - DNA, 25 bp, Mus musculus
ccctctgccgccttccctaagtgtt

SEQ ID NO: 243164 - DNA, 25 bp, Mus musculus
aatatgtgtgtaggaactctggacg

SEQ ID NO: 243165 - DNA, 25 bp, Mus musculus
cgtccaattttctcttgagtacatg

SEQ ID NO: 243166 - DNA, 25 bp, Mus musculus
ccagcgttggggatgtgtaattgat

SEQ ID NO: 243167 - DNA, 25 bp, Mus musculus
ttgattgcccgcgttataataaaca

SEQ ID NO: 243168 - DNA, 25 bp, Mus musculus
tgcccgcgttataataaacaagccg

SEQ ID NO: 243169 - DNA, 25 bp, Mus musculus
tgtgtaattgattgcccgcgttata

SEQ ID NO: 243170 - DNA, 25 bp, Mus musculus
ttataataaacaagccgtgacaggc

SEQ ID NO: 243171 - DNA, 25 bp, Mus musculus
aacaagccgtgacaggcgatcattc

SEQ ID NO: 243172 - DNA, 25 bp, Mus musculus
gccgtgacaggcgatcattcatcac

SEQ ID NO: 243173 - DNA, 25 bp, Mus musculus
tgacaggcgatcattcatcacgggc

SEQ ID NO: 243174 - DNA, 25 bp, Mus musculus
gcgatcattcatcacgggccgctga

SEQ ID NO: 243175 - DNA, 25 bp, Mus musculus
atcacgggccgctgaacgttccagc

SEQ ID NO: 243176 - DNA, 25 bp, Mus musculus
gatgtgtaattgattgcccgcgtta

SEQ ID NO: 243177 - DNA, 25 bp, Mus musculus
gctgaacgttccagcgacgccggga

SEQ ID NO: 243178 - DNA, 25 bp, Mus musculus
gtatcaatttcccgcgggccggcca

SEQ ID NO: 243179 - DNA, 25 bp, Mus musculus
cgttggggatgtgtaattgattgcc

SEQ ID NO: 243180 - DNA, 25 bp, Mus musculus
ccgccattgctgtcagagcgagcga

SEQ ID NO: 243181 - DNA, 25 bp, Mus musculus
cattgctgtcagagcgagcgagccc

SEQ ID NO: 243182 - DNA, 25 bp, Mus musculus
cggccgccattgctgtcagagcgag

SEQ ID NO: 243183 - DNA, 25 bp, Mus musculus
ggagcgcccacctccgtggcaatca

SEQ ID NO: 243184 - DNA, 25 bp, Mus musculus
acctcttctcgctggtgagtggcgg

SEQ ID NO: 243185 - DNA, 25 bp, Mus musculus
tccaacctcttctcgctggtgagtg

SEQ ID NO: 243186 - DNA, 25 bp, Mus musculus
ggattgtcactccaacctcttctcg

SEQ ID NO: 243187 - DNA, 25 bp, Mus musculus
cctggaggattgtcactccaacctc

SEQ ID NO: 243188 - DNA, 25 bp, Mus musculus
cgccgcggcgaactgggtagcgaac

SEQ ID NO: 243189 - DNA, 25 bp, Mus musculus
aggaccatgaccgccgcggcgaact

SEQ ID NO: 243190 - DNA, 25 bp, Mus musculus
ttggagataaacaaggcggccgacg

SEQ ID NO: 243191 - DNA, 25 bp, Mus musculus
gcccgccggcttggagataaacaag

SEQ ID NO: 243192 - DNA, 25 bp, Mus musculus
gtcgcccgctggcttcgtccgcacc

SEQ ID NO: 243193 - DNA, 25 bp, Mus musculus
ggcgagcctggaggattgtcactcc

SEQ ID NO: 243194 - DNA, 25 bp, Mus musculus
ggccgcagcactttgaggcgtgttt

SEQ ID NO: 243195 - DNA, 25 bp, Mus musculus
tgctgtcgccttccataaaccggga

SEQ ID NO: 243196 - DNA, 25 bp, Mus musculus
accgtgggcaattagtctgggagcc

SEQ ID NO: 243197 - DNA, 25 bp, Mus musculus
aggcgtgtttgcaccgtgggcaatt

SEQ ID NO: 243198 - DNA, 25 bp, Mus musculus
attgattgtaatgggcttctccgcc

SEQ ID NO: 243199 - DNA, 25 bp, Mus musculus
ccctgttattgacgaggccgcagca

SEQ ID NO: 243200 - DNA, 25 bp, Mus musculus
gtaacagaatccagtccacacagag

SEQ ID NO: 243201 - DNA, 25 bp, Mus musculus
gggagccgcaggagttaagctaaca

SEQ ID NO: 243202 - DNA, 25 bp, Mus musculus
gcgccagcctgcagccctaatgggg

SEQ ID NO: 243203 - DNA, 25 bp, Mus musculus
gcgcaggctgcgcaaattgattgta

SEQ ID NO: 243204 - DNA, 25 bp, Mus musculus
ccacacagagtctgtctgcgagcgc

SEQ ID NO: 243205 - DNA, 25 bp, Mus musculus
cctaatggggcccatccgcggaagg

SEQ ID NO: 243206 - DNA, 25 bp, Mus musculus
gcggaaggcagaaggctccagcctc

SEQ ID NO: 243207 - DNA, 25 bp, Mus musculus
cggaatggaagcgtctaataccctg

SEQ ID NO: 243208 - DNA, 25 bp, Mus musculus
ccacggggaccctctgctcaggccc

SEQ ID NO: 243209 - DNA, 25 bp, Mus musculus
tgtaggaccaagcatgctggaagta

SEQ ID NO: 243210 - DNA, 25 bp, Mus musculus
accaagcatgctggaagtactcctc

SEQ ID NO: 243211 - DNA, 25 bp, Mus musculus
tgctggaagtactcctcgaggcgct

SEQ ID NO: 243212 - DNA, 25 bp, Mus musculus
agtactcctcgaggcgctggcgtaa

SEQ ID NO: 243213 - DNA, 25 bp, Mus musculus
aatctggtgaaagcggataaactcc

SEQ ID NO: 243214 - DNA, 25 bp, Mus musculus
agcggataaactcccgcacccggag

SEQ ID NO: 243215 - DNA, 25 bp, Mus musculus
gcacccggagcatctgtgtgtggta

SEQ ID NO: 243216 - DNA, 25 bp, Mus musculus
ggacacgttgccgaagatgctggca

SEQ ID NO: 243217 - DNA, 25 bp, Mus musculus
aagatgctggcatacatgagggctg

SEQ ID NO: 243218 - DNA, 25 bp, Mus musculus
gggccgtcagcatccgcagggaccc

SEQ ID NO: 243219 - DNA, 25 bp, Mus musculus
gcaccaggtcaacgacactcgcggt

SEQ ID NO: 243220 - DNA, 25 bp, Mus musculus
gtcaacgacactcgcggtccggtca

SEQ ID NO: 243221 - DNA, 25 bp, Mus musculus
cgctggcgtaatgggttgggaatct

SEQ ID NO: 243222 - DNA, 25 bp, Mus musculus
gaagaagctgcagatccgcacaaga

SEQ ID NO: 243223 - DNA, 25 bp, Mus musculus
cgcagcgacgttccagtttccgaca

SEQ ID NO: 243224 - DNA, 25 bp, Mus musculus
ctgcgtgcccggacgctgatttttt

SEQ ID NO: 243225 - DNA, 25 bp, Mus musculus
cagacgcccggggaattctagaggc

SEQ ID NO: 243226 - DNA, 25 bp, Mus musculus
attggtccgaaagcgtcaaagagcc

SEQ ID NO: 243227 - DNA, 25 bp, Mus musculus
cccttcagagctacgcgagcctgga

SEQ ID NO: 243228 - DNA, 25 bp, Mus musculus
tcgacctgtgaaaaccacgcctatg

SEQ ID NO: 243229 - DNA, 25 bp, Mus musculus
ttccatgtggggctcccttcagagc

SEQ ID NO: 243230 - DNA, 25 bp, Mus musculus
tgacataaacgcaggacaggccgta

SEQ ID NO: 243231 - DNA, 25 bp, Mus musculus
atcagccacctagaggcgactttgg

SEQ ID NO: 243232 - DNA, 25 bp, Mus musculus
aggctgctgcgaactctcttctgga

SEQ ID NO: 243233 - DNA, 25 bp, Mus musculus
ctgaggcctttcagacgtaggctga

SEQ ID NO: 243234 - DNA, 25 bp, Mus musculus
ggcttattggccgaaagagaggttc

SEQ ID NO: 243235 - DNA, 25 bp, Mus musculus
cacgcctatgcagccacacaattgg

SEQ ID NO: 243236 - DNA, 25 bp, Mus musculus
gacgcggccaagatttccaccacta

SEQ ID NO: 243237 - DNA, 25 bp, Mus musculus
gacaccgcgcgtctggacaaggcat

SEQ ID NO: 243238 - DNA, 25 bp, Mus musculus
gcccagcaaccagggcgcagctgtt

SEQ ID NO: 243239 - DNA, 25 bp, Mus musculus
atttccaccactacggccgaggagc

SEQ ID NO: 243240 - DNA, 25 bp, Mus musculus
aaggcatcgccagactcgcgccata

SEQ ID NO: 243241 - DNA, 25 bp, Mus musculus
atccaccggcgtctcaggcctagaa

SEQ ID NO: 243242 - DNA, 25 bp, Mus musculus
ctggccacagtatccggagcatcca

SEQ ID NO: 243243 - DNA, 25 bp, Mus musculus
cggcgccttctctagcatggctgca

SEQ ID NO: 243244 - DNA, 25 bp, Mus musculus
cgggccagcagttcttcaacgggca

SEQ ID NO: 243245 - DNA, 25 bp, Mus musculus
ctccactgtcggtgcagacagacgc

SEQ ID NO: 243246 - DNA, 25 bp, Mus musculus
gcgattcctgccaaggacgccttcg

SEQ ID NO: 243247 - DNA, 25 bp, Mus musculus
gggtccagtcgccaccaaggtggat

SEQ ID NO: 243248 - DNA, 25 bp, Mus musculus
atctcgtccagcacgcgagttccgg

SEQ ID NO: 243249 - DNA, 25 bp, Mus musculus
ctagaatccacagccatggcctcgg

SEQ ID NO: 243250 - DNA, 25 bp, Mus musculus
tcgtgagatccaggtacgcagcagc

SEQ ID NO: 243251 - DNA, 25 bp, Mus musculus
tttaacttgcaggtagggcttggtg

SEQ ID NO: 243252 - DNA, 25 bp, Mus musculus
tcttgactgcaatgaagacgtcgtc

SEQ ID NO: 243253 - DNA, 25 bp, Mus musculus
agtagcagcaacacagccaggaccg

SEQ ID NO: 243254 - DNA, 25 bp, Mus musculus
agccctgacccggaactgacggacg

SEQ ID NO: 243255 - DNA, 25 bp, Mus musculus
ccgctgccggttcaggtgtttaact

SEQ ID NO: 243256 - DNA, 25 bp, Mus musculus
gcgcgccaacgctttccgtgcggtg

SEQ ID NO: 243257 - DNA, 25 bp, Mus musculus
cgtcaggccaacatgcggggcagcc

SEQ ID NO: 243258 - DNA, 25 bp, Mus musculus
ctgcgcacagcaggtccgacttgcg

SEQ ID NO: 243259 - DNA, 25 bp, Mus musculus
gcgggcgactacagcctgagcgcca

SEQ ID NO: 243260 - DNA, 25 bp, Mus musculus
tgtcggcctgcacgttgctttccga

SEQ ID NO: 243261 - DNA, 25 bp, Mus musculus
agcggctctcccgacggcgcttgag

SEQ ID NO: 243262 - DNA, 25 bp, Mus musculus
acgttgctttccgaggtacggctgc

SEQ ID NO: 243263 - DNA, 25 bp, Mus musculus
accaggggcgccagcctggaatcca

SEQ ID NO: 243264 - DNA, 25 bp, Mus musculus
aggctgcgttacagcccctattcca

SEQ ID NO: 243265 - DNA, 25 bp, Mus musculus
gactcggggtcggaactgaacagcc

SEQ ID NO: 243266 - DNA, 25 bp, Mus musculus
cccagcctcggtggctgtggactcg

SEQ ID NO: 243267 - DNA, 25 bp, Mus musculus
agccagcccagcctcggtggctgtg

SEQ ID NO: 243268 - DNA, 25 bp, Mus musculus
ctagacggcaaagcggccgccctgg

SEQ ID NO: 243269 - DNA, 25 bp, Mus musculus
taccatcaatggcttccgccgcggg

SEQ ID NO: 243270 - DNA, 25 bp, Mus musculus
gctggccacagctttaccatcaatg

SEQ ID NO: 243271 - DNA, 25 bp, Mus musculus
cagcagtttgctggccacagcttta

SEQ ID NO: 243272 - DNA, 25 bp, Mus musculus
ccggatagcagcagtttgctggcca

SEQ ID NO: 243273 - DNA, 25 bp, Mus musculus
gccacccgttcctcaatttgaacag

SEQ ID NO: 243274 - DNA, 25 bp, Mus musculus
gtcccagtgccggatagcagcagtt

SEQ ID NO: 243275 - DNA, 25 bp, Mus musculus
tcctcaatttgaacagcatgcgccc

SEQ ID NO: 243276 - DNA, 25 bp, Mus musculus
tcggaactgaacagccgctcgtcca

SEQ ID NO: 243277 - DNA, 25 bp, Mus musculus
ccagtgccggatagcagcagtttgc

SEQ ID NO: 243278 - DNA, 25 bp, Mus musculus
tatcagccgaagtcggtctgatgga

SEQ ID NO: 243279 - DNA, 25 bp, Mus musculus
tcctgcttatcagccgaagtcggtc

SEQ ID NO: 243280 - DNA, 25 bp, Mus musculus
cgctgcggattaacaacctcgcctt

SEQ ID NO: 243281 - DNA, 25 bp, Mus musculus
ccggcgaagctccacggcctgagaa

SEQ ID NO: 243282 - DNA, 25 bp, Mus musculus
ccacggcctgagaaggtgtgacttc

SEQ ID NO: 243283 - DNA, 25 bp, Mus musculus
cctgagaaggtgtgacttcagactc

SEQ ID NO: 243284 - DNA, 25 bp, Mus musculus
acttcagactctgggtaaggatggg

SEQ ID NO: 243285 - DNA, 25 bp, Mus musculus
tgctcgtcaacgcttaggctctgag

SEQ ID NO: 243286 - DNA, 25 bp, Mus musculus
aaccagaacggcctggccaggcatc

SEQ ID NO: 243287 - DNA, 25 bp, Mus musculus
tcgctgtcctgagcaccgctggcag

SEQ ID NO: 243288 - DNA, 25 bp, Mus musculus
tgtgtgaggtgattgtaaccagaac

SEQ ID NO: 243289 - DNA, 25 bp, Mus musculus
ggattaacaacctcgccttcactca

SEQ ID NO: 243290 - DNA, 25 bp, Mus musculus
cccggtgcgtgctcgtcaacgctta

SEQ ID NO: 243291 - DNA, 25 bp, Mus musculus
gccaggcatctcgtcgctgtcctga

SEQ ID NO: 243292 - DNA, 25 bp, Mus musculus
tggcgcgtgctgtttgtactttcca

SEQ ID NO: 243293 - DNA, 25 bp, Mus musculus
tattataattctgggcgcacgtgcg

SEQ ID NO: 243294 - DNA, 25 bp, Mus musculus
agccaggatttgctttgcctctgta

SEQ ID NO: 243295 - DNA, 25 bp, Mus musculus
gcctcaggtctgttaaagccatcga

SEQ ID NO: 243296 - DNA, 25 bp, Mus musculus
ctctaaactttggagacgcccgccg

SEQ ID NO: 243297 - DNA, 25 bp, Mus musculus
gccgggtcctaccactttggagaga

SEQ ID NO: 243298 - DNA, 25 bp, Mus musculus
tttgttcagtaagcgaccggcagcg

SEQ ID NO: 243299 - DNA, 25 bp, Mus musculus
tggggaccttaaagcaacgctcttc

SEQ ID NO: 243300 - DNA, 25 bp, Mus musculus
cgcgccgcaccgaattcagcgtatg

SEQ ID NO: 243301 - DNA, 25 bp, Mus musculus
cccttgcggttaatgagtcggctca

SEQ ID NO: 243302 - DNA, 25 bp, Mus musculus
gggtctcgtcgctttcctatgggaa

SEQ ID NO: 243303 - DNA, 25 bp, Mus musculus
cacagcgattcgcatgggtctcgtc

SEQ ID NO: 243304 - DNA, 25 bp, Mus musculus
ggacagatccttgtttgcgcgcgca

SEQ ID NO: 243305 - DNA, 25 bp, Mus musculus
ccgtgcatcgtgtgggaataagcta

SEQ ID NO: 243306 - DNA, 25 bp, Mus musculus
agcaaaaatggtgtttaagaggtcg

SEQ ID NO: 243307 - DNA, 25 bp, Mus musculus
agctgccgaccacgagttggtgcgc

SEQ ID NO: 243308 - DNA, 25 bp, Mus musculus
cgggcttgggaagctgccgaactat

SEQ ID NO: 243309 - DNA, 25 bp, Mus musculus
tgggaagctgccgaactatagtgca

SEQ ID NO: 243310 - DNA, 25 bp, Mus musculus
ccgaactatagtgcagggaagccca

SEQ ID NO: 243311 - DNA, 25 bp, Mus musculus
tgggcttggcggctagacaaaaaga

SEQ ID NO: 243312 - DNA, 25 bp, Mus musculus
ggcggctagacaaaaagaggaccta

SEQ ID NO: 243313 - DNA, 25 bp, Mus musculus
agaggacctagccaagcgtatcggc

SEQ ID NO: 243314 - DNA, 25 bp, Mus musculus
agcgtatcggcctaagacacccgga

SEQ ID NO: 243315 - DNA, 25 bp, Mus musculus
agccaagccggccttttagctccgg

SEQ ID NO: 243316 - DNA, 25 bp, Mus musculus
cggccttttagctccggctggctaa

SEQ ID NO: 243317 - DNA, 25 bp, Mus musculus
gctccggctggctaattaaatttaa

SEQ ID NO: 243318 - DNA, 25 bp, Mus musculus
tagccgggagcaaaaatggtgttta

SEQ ID NO: 243319 - DNA, 25 bp, Mus musculus
attgtttataaggatagccgggagc

SEQ ID NO: 243320 - DNA, 25 bp, Mus musculus
ttttgcacccacgtcttcccggaga

SEQ ID NO: 243321 - DNA, 25 bp, Mus musculus
gaaagcagacgaaaataatgggttc

SEQ ID NO: 243322 - DNA, 25 bp, Mus musculus
atgggttcggttcaaagaacactgc

SEQ ID NO: 243323 - DNA, 25 bp, Mus musculus
aagaacactgcgttttgcacccacg

SEQ ID NO: 243324 - DNA, 25 bp, Mus musculus
cacgtcttcccggagacagctttta

SEQ ID NO: 243325 - DNA, 25 bp, Mus musculus
tcgctgtgacttcgtaccagaatca

SEQ ID NO: 243326 - DNA, 25 bp, Mus musculus
ccagaatcacaaggtaagcctgaga

SEQ ID NO: 243327 - DNA, 25 bp, Mus musculus
taagcctgagagagtctccacccgc

SEQ ID NO: 243328 - DNA, 25 bp, Mus musculus
ccgcctgctgctttatgtggacgca

SEQ ID NO: 243329 - DNA, 25 bp, Mus musculus
tttatgtggacgcatgcgctgtgtc

SEQ ID NO: 243330 - DNA, 25 bp, Mus musculus
atgcgctgtgtcctcaccggaacgc

SEQ ID NO: 243331 - DNA, 25 bp, Mus musculus
caccggaacgcagccctttaagacg

SEQ ID NO: 243332 - DNA, 25 bp, Mus musculus
cgattacacatcgtgaaagcagacg

SEQ ID NO: 243333 - DNA, 25 bp, Mus musculus
cagcttttatcgctgtgacttcgta

SEQ ID NO: 243334 - DNA, 25 bp, Mus musculus
gaaaacaaaagcgtctccgccaaca

SEQ ID NO: 243335 - DNA, 25 bp, Mus musculus
cccgtggacaatggcgtcattcagt

SEQ ID NO: 243336 - DNA, 25 bp, Mus musculus
cccagacccgtggacaatggcgtca

SEQ ID NO: 243337 - DNA, 25 bp, Mus musculus
ttacaacccagacccgtggacaatg

SEQ ID NO: 243338 - DNA, 25 bp, Mus musculus
cagtttggccctcggtttcaatatt

SEQ ID NO: 243339 - DNA, 25 bp, Mus musculus
tgcagtttggccctcggtttcaata

SEQ ID NO: 243340 - DNA, 25 bp, Mus musculus
ctgatggtgcagtttggccctcggt

SEQ ID NO: 243341 - DNA, 25 bp, Mus musculus
gaaggttcattagatggcgggcggc

SEQ ID NO: 243342 - DNA, 25 bp, Mus musculus
ctgcagtgtagagggaaggttcatt

SEQ ID NO: 243343 - DNA, 25 bp, Mus musculus
aaggccgattcagcccgctgcagtg

SEQ ID NO: 243344 - DNA, 25 bp, Mus musculus
ctttcgtgaaaaggccgattcagcc

SEQ ID NO: 243345 - DNA, 25 bp, Mus musculus
cctgctttcgtgaaaaggccgattc

SEQ ID NO: 243346 - DNA, 25 bp, Mus musculus
tggcgtcattcagtacactcccgcg

SEQ ID NO: 243347 - DNA, 25 bp, Mus musculus
tccctgccacctgctttcgtgaaaa

SEQ ID NO: 243348 - DNA, 25 bp, Mus musculus
gaacctgagagccatgtcgcgtctg

SEQ ID NO: 243349 - DNA, 25 bp, Mus musculus
cggagagagtctcccgtgaggccac

SEQ ID NO: 243350 - DNA, 25 bp, Mus musculus
ggccacgtgactcgctaaaaatggc

SEQ ID NO: 243351 - DNA, 25 bp, Mus musculus
tgactcgctaaaaatggcggcgccc

SEQ ID NO: 243352 - DNA, 25 bp, Mus musculus
aaagttgtgggaagtcgctgtcgcc

SEQ ID NO: 243353 - DNA, 25 bp, Mus musculus
gtctgaaaagcgaagggaacctgag

SEQ ID NO: 243354 - DNA, 25 bp, Mus musculus
gagccatgtcgcgtctgatcgtgaa

SEQ ID NO: 243355 - DNA, 25 bp, Mus musculus
atgtcgcgtctgatcgtgaagaacc

SEQ ID NO: 243356 - DNA, 25 bp, Mus musculus
tcgcgtctgatcgtgaagaacctcc

SEQ ID NO: 243357 - DNA, 25 bp, Mus musculus
cgtctgatcgtgaagaacctcccga

SEQ ID NO: 243358 - DNA, 25 bp, Mus musculus
tgatcgtgaagaacctcccgaatgg

SEQ ID NO: 243359 - DNA, 25 bp, Mus musculus
cgtgaagaacctcccgaatggggtg

SEQ ID NO: 243360 - DNA, 25 bp, Mus musculus
aagaacctcccgaatggggtgagcg

SEQ ID NO: 243361 - DNA, 25 bp, Mus musculus
cgtgagtctgaaaagcgaagggaac

SEQ ID NO: 243362 - DNA, 25 bp, Mus musculus
tttgtgcccgtgtgaaccgcgaaat

SEQ ID NO: 243363 - DNA, 25 bp, Mus musculus
agagaatcgggttgcatggccacgc

SEQ ID NO: 243364 - DNA, 25 bp, Mus musculus
ccttccgggagagaatcgggttgca

SEQ ID NO: 243365 - DNA, 25 bp, Mus musculus
acctgcaggctgacccggacgaaac

SEQ ID NO: 243366 - DNA, 25 bp, Mus musculus
caaggttctgtccaggggcctccga

SEQ ID NO: 243367 - DNA, 25 bp, Mus musculus
cagacgcgggtcaaggttctgtcca

SEQ ID NO: 243368 - DNA, 25 bp, Mus musculus
agcccggccttgaacctgggctgtg

SEQ ID NO: 243369 - DNA, 25 bp, Mus musculus
gcgaaatctgttcctgcgcccggca

SEQ ID NO: 243370 - DNA, 25 bp, Mus musculus
cgcggcctttgtgcccgtgtgaacc

SEQ ID NO: 243371 - DNA, 25 bp, Mus musculus
gacaatgcggcgtctttgagcgcgc

SEQ ID NO: 243372 - DNA, 25 bp, Mus musculus
ccgccctgaagtgcgcggcgacaaa

SEQ ID NO: 243373 - DNA, 25 bp, Mus musculus
cggcgtctttgagcgcgcggccttt

SEQ ID NO: 243374 - DNA, 25 bp, Mus musculus
ctggcgcctttgtggccgccctgaa

SEQ ID NO: 243375 - DNA, 25 bp, Mus musculus
tgtgaaccgcgaaatctgttcctgc

SEQ ID NO: 243376 - DNA, 25 bp, Mus musculus
gtgcagggccgctgcatcacctcgg

SEQ ID NO: 243377 - DNA, 25 bp, Mus musculus
gaaggcgatctccactttgcgctcc

SEQ ID NO: 243378 - DNA, 25 bp, Mus musculus
accatctttccggtagaaggcgatc

SEQ ID NO: 243379 - DNA, 25 bp, Mus musculus
tgtcagcaacgcgtgtcagcagccg

SEQ ID NO: 243380 - DNA, 25 bp, Mus musculus
tcggcccgcgagtagccacacagtt

SEQ ID NO: 243381 - DNA, 25 bp, Mus musculus
agccacacagttcgcagaagccgtc

SEQ ID NO: 243382 - DNA, 25 bp, Mus musculus
cagaagccgtcgttgcagtagatga

SEQ ID NO: 243383 - DNA, 25 bp, Mus musculus
tgcagtagatgacagcgcagttctc

SEQ ID NO: 243384 - DNA, 25 bp, Mus musculus
tagcgatgatgaacttgcggcctgc

SEQ ID NO: 243385 - DNA, 25 bp, Mus musculus
acattcgctcgtcacacagtgccgt

SEQ ID NO: 243386 - DNA, 25 bp, Mus musculus
tgcagtgacacaggtgcctccacgg

SEQ ID NO: 243387 - DNA, 25 bp, Mus musculus
cagagagccagcgaccaaggccggc

SEQ ID NO: 243388 - DNA, 25 bp, Mus musculus
cgcagttctctacgcgcgcgttagc

SEQ ID NO: 243389 - DNA, 25 bp, Mus musculus
cgcggcccatgcaggaaatcgcagg

SEQ ID NO: 243390 - DNA, 25 bp, Mus musculus
aataattacactcttgtcggaggga

SEQ ID NO: 243391 - DNA, 25 bp, Mus musculus
gaatccggagagcaatttaaattta

SEQ ID NO: 243392 - DNA, 25 bp, Mus musculus
atcaaagaggggaagtaatgaatcc

SEQ ID NO: 243393 - DNA, 25 bp, Mus musculus
agtataatttttcacggctggctga

SEQ ID NO: 243394 - DNA, 25 bp, Mus musculus
gcagtttctcagtggtacaccagta

SEQ ID NO: 243395 - DNA, 25 bp, Mus musculus
ctctttgcggcaaagcagtttctca

SEQ ID NO: 243396 - DNA, 25 bp, Mus musculus
ggcgcaggctctttgcggcaaagca

SEQ ID NO: 243397 - DNA, 25 bp, Mus musculus
gcgcggggccgcctatatttacacc

SEQ ID NO: 243398 - DNA, 25 bp, Mus musculus
cactcttgtcggagggagaaagcca

SEQ ID NO: 243399 - DNA, 25 bp, Mus musculus
gccgcctatatttacacccaaaaca

SEQ ID NO: 243400 - DNA, 25 bp, Mus musculus
ttacaatttgtaacgccgccgccgc

SEQ ID NO: 243401 - DNA, 25 bp, Mus musculus
tcacggctggctgaaatcaaagagg

SEQ ID NO: 243402 - DNA, 25 bp, Mus musculus
aaagccagtgattaggcgcaggctc

SEQ ID NO: 243403 - DNA, 25 bp, Mus musculus
cagtggtacaccagtataatttttc

SEQ ID NO: 243404 - DNA, 25 bp, Mus musculus
ctgacgccgcctcggatcttgggtt

SEQ ID NO: 243405 - DNA, 25 bp, Mus musculus
agagtagcgagcacgtcagcctcca

SEQ ID NO: 243406 - DNA, 25 bp, Mus musculus
gctcctttcctggtcgggcccagag

SEQ ID NO: 243407 - DNA, 25 bp, Mus musculus
ccacggggcttgaactaggactact

SEQ ID NO: 243408 - DNA, 25 bp, Mus musculus
actacttcccgcaccgtcggagttg

SEQ ID NO: 243409 - DNA, 25 bp, Mus musculus
ccagggctcgatgaaggtctgtgac

SEQ ID NO: 243410 - DNA, 25 bp, Mus musculus
tgactgcgggcacgctccaaagaaa

SEQ ID NO: 243411 - DNA, 25 bp, Mus musculus
gccaagcgccgtggctcagactcag

SEQ ID NO: 243412 - DNA, 25 bp, Mus musculus
gtggctcagactcagcgcaacgccg

SEQ ID NO: 243413 - DNA, 25 bp, Mus musculus
accgtctgcggtgcagcaaaaaata

SEQ ID NO: 243414 - DNA, 25 bp, Mus musculus
aagtcctcggaaactgcagctcagc

SEQ ID NO: 243415 - DNA, 25 bp, Mus musculus
cagctcagcgctgaagggaccggcc

SEQ ID NO: 243416 - DNA, 25 bp, Mus musculus
gttgagcaagaacagactgcgcatg

SEQ ID NO: 243417 - DNA, 25 bp, Mus musculus
ccggccttgtggaaacgagagagtt

SEQ ID NO: 243418 - DNA, 25 bp, Mus musculus
cgcaccacgtcaccaaatctgaata

SEQ ID NO: 243419 - DNA, 25 bp, Mus musculus
acaaagatgaggatcgggaccgctt

SEQ ID NO: 243420 - DNA, 25 bp, Mus musculus
aaagatgaggatcgggaccgcttga

SEQ ID NO: 243421 - DNA, 25 bp, Mus musculus
atgaggatcgggaccgcttgaaagt

SEQ ID NO: 243422 - DNA, 25 bp, Mus musculus
ccagacaaagatgaggatcgggacc

SEQ ID NO: 243423 - DNA, 25 bp, Mus musculus
atgcgcgaattaggcggcggccaga

SEQ ID NO: 243424 - DNA, 25 bp, Mus musculus
ccacgtcaccaaatctgaataagga

SEQ ID NO: 243425 - DNA, 25 bp, Mus musculus
ctgaataaggatgcgcgaattaggc

SEQ ID NO: 243426 - DNA, 25 bp, Mus musculus
agacaaagatgaggatcgggaccgc

SEQ ID NO: 243427 - DNA, 25 bp, Mus musculus
aatctgaataaggatgcgcgaatta

SEQ ID NO: 243428 - DNA, 25 bp, Mus musculus
ccaaatctgaataaggatgcgcgaa

SEQ ID NO: 243429 - DNA, 25 bp, Mus musculus
tcaccaaatctgaataaggatgcgc

SEQ ID NO: 243430 - DNA, 25 bp, Mus musculus
cgtcaccaaatctgaataaggatgc

SEQ ID NO: 243431 - DNA, 25 bp, Mus musculus
gcaccacgtcaccaaatctgaataa

SEQ ID NO: 243432 - DNA, 25 bp, Mus musculus
ccaacctctcggagaagtgcttctc

SEQ ID NO: 243433 - DNA, 25 bp, Mus musculus
cctcgaccgctttctgctgaacgta

SEQ ID NO: 243434 - DNA, 25 bp, Mus musculus
caaatgtgttcaatgctgcgagtgc

SEQ ID NO: 243435 - DNA, 25 bp, Mus musculus
tgctgaacgtactagaccgcgcgtg

SEQ ID NO: 243436 - DNA, 25 bp, Mus musculus
gctgcgagtgcaaaaccaacctctc

SEQ ID NO: 243437 - DNA, 25 bp, Mus musculus
cgcggctatgatggtgcactgtgct

SEQ ID NO: 243438 - DNA, 25 bp, Mus musculus
ctacagactcgcctacagactagga

SEQ ID NO: 243439 - DNA, 25 bp, Mus musculus
tggttgatccgtaacggactcgccc

SEQ ID NO: 243440 - DNA, 25 bp, Mus musculus
cccgagaagtcttggttgatccgta

SEQ ID NO: 243441 - DNA, 25 bp, Mus musculus
acatgaggctgtgaccgctgccgcc

SEQ ID NO: 243442 - DNA, 25 bp, Mus musculus
cggtcgcgacccgtgacatgaggct

SEQ ID NO: 243443 - DNA, 25 bp, Mus musculus
ccgaggacacctgctcgaagctgga

SEQ ID NO: 243444 - DNA, 25 bp, Mus musculus
agtgccgaagccagcagccgccgag

SEQ ID NO: 243445 - DNA, 25 bp, Mus musculus
ccgcgcgtggcatatcaaatgtgtt

SEQ ID NO: 243446 - DNA, 25 bp, Mus musculus
cacgaaatccttcacccttggctgg

SEQ ID NO: 243447 - DNA, 25 bp, Mus musculus
attcaggtacgaccgatgggccagc

SEQ ID NO: 243448 - DNA, 25 bp, Mus musculus
acgggcctcaacatgagggtcattc

SEQ ID NO: 243449 - DNA, 25 bp, Mus musculus
acattcgcgaacagctggcacagga

SEQ ID NO: 243450 - DNA, 25 bp, Mus musculus
gctggagacgctcaaggcagccttc

SEQ ID NO: 243451 - DNA, 25 bp, Mus musculus
cagttcctgtgtcctagcgatgtga

SEQ ID NO: 243452 - DNA, 25 bp, Mus musculus
tagagacagtcgtgcacccgaggtt

SEQ ID NO: 243453 - DNA, 25 bp, Mus musculus
gaagccggggtctttatgagtcacc

SEQ ID NO: 243454 - DNA, 25 bp, Mus musculus
ggctggttcgctgaagcttctctcc

SEQ ID NO: 243455 - DNA, 25 bp, Mus musculus
ttccttcgccctaggtgtggtttca

SEQ ID NO: 243456 - DNA, 25 bp, Mus musculus
gagacacgccttcttccggagtccg

SEQ ID NO: 243457 - DNA, 25 bp, Mus musculus
gccgcatgaaacagctgagcgctct

SEQ ID NO: 243458 - DNA, 25 bp, Mus musculus
cgaaggtccaaagaacgccgcatga

SEQ ID NO: 243459 - DNA, 25 bp, Mus musculus
accagacctctgtgaattccgttca

SEQ ID NO: 243460 - DNA, 25 bp, Mus musculus
ggcttttgtgcccttttcagacagc

SEQ ID NO: 243461 - DNA, 25 bp, Mus musculus
cgcgcttcctttccgttcctttgag

SEQ ID NO: 243462 - DNA, 25 bp, Mus musculus
tagagccacggccttccctgcttag

SEQ ID NO: 243463 - DNA, 25 bp, Mus musculus
gcctaatccgcactgggagatcccg

SEQ ID NO: 243464 - DNA, 25 bp, Mus musculus
atccgcactgggagatcccggtggc

SEQ ID NO: 243465 - DNA, 25 bp, Mus musculus
ctgcggcttttgtgcccttttcaga

SEQ ID NO: 243466 - DNA, 25 bp, Mus musculus
tttgtgcccttttcagacagcgttt

SEQ ID NO: 243467 - DNA, 25 bp, Mus musculus
cggcgcgcacggctctagagccacg

SEQ ID NO: 243468 - DNA, 25 bp, Mus musculus
cccggccgccatatgggcggaggcg

SEQ ID NO: 243469 - DNA, 25 bp, Mus musculus
cagcgtttgttccaattacctccgg

SEQ ID NO: 243470 - DNA, 25 bp, Mus musculus
ctgcttagcgcgcttcctttccgtt

SEQ ID NO: 243471 - DNA, 25 bp, Mus musculus
tcagacagcgtttgttccaattacc

SEQ ID NO: 243472 - DNA, 25 bp, Mus musculus
tccccgtgggagctcggacaaagcc

SEQ ID NO: 243473 - DNA, 25 bp, Mus musculus
ctctctctcaaccttcctcgctttc

SEQ ID NO: 243474 - DNA, 25 bp, Mus musculus
accaaagtgactactacgctccggg

SEQ ID NO: 243475 - DNA, 25 bp, Mus musculus
ctcccgcagactaccaaagtgacta

SEQ ID NO: 243476 - DNA, 25 bp, Mus musculus
attacgatttcttcgcgcacggtcc

SEQ ID NO: 243477 - DNA, 25 bp, Mus musculus
ttggcacgcgcctgcgcaatttctc

SEQ ID NO: 243478 - DNA, 25 bp, Mus musculus
gcatcctcgagtcgccttcgcgtgg

SEQ ID NO: 243479 - DNA, 25 bp, Mus musculus
cagtctgtcctcacacggtctctta

SEQ ID NO: 243480 - DNA, 25 bp, Mus musculus
cgctccgggaggcaattacgatttc

SEQ ID NO: 243481 - DNA, 25 bp, Mus musculus
cagcttcctggcagcatcgggacct

SEQ ID NO: 243482 - DNA, 25 bp, Mus musculus
ccagattcaccgacatgatctcgca

SEQ ID NO: 243483 - DNA, 25 bp, Mus musculus
atgatctcgcatccggacacgccga

SEQ ID NO: 243484 - DNA, 25 bp, Mus musculus
catgagcggcaccagcggctacagt

SEQ ID NO: 243485 - DNA, 25 bp, Mus musculus
gcctgggtaagcctcaagagtcctc

SEQ ID NO: 243486 - DNA, 25 bp, Mus musculus
aagagtcctctcgtgggttcgcacc

SEQ ID NO: 243487 - DNA, 25 bp, Mus musculus
ctaggtccctatcggccctggcagt

SEQ ID NO: 243488 - DNA, 25 bp, Mus musculus
gggcttgtgcttgggcttccgggat

SEQ ID NO: 243489 - DNA, 25 bp, Mus musculus
ccagcaaggccagtgtggtcaggga

SEQ ID NO: 243490 - DNA, 25 bp, Mus musculus
ccacgtgactgcgtcccgaggggcg

SEQ ID NO: 243491 - DNA, 25 bp, Mus musculus
cagccgccggagctcccatccacgg

SEQ ID NO: 243492 - DNA, 25 bp, Mus musculus
aggtcagcgccagtgcccgccgtag

SEQ ID NO: 243493 - DNA, 25 bp, Mus musculus
ccagtgtggtcagggaggtcagcgc

SEQ ID NO: 243494 - DNA, 25 bp, Mus musculus
ccggtcagcgaggccagcaaggcca

SEQ ID NO: 243495 - DNA, 25 bp, Mus musculus
acagcccggtcagcgaggccagcaa

SEQ ID NO: 243496 - DNA, 25 bp, Mus musculus
agcaacagcccggtcagcgaggcca

SEQ ID NO: 243497 - DNA, 25 bp, Mus musculus
cccgccgggccgctcagcaacagcc

SEQ ID NO: 243498 - DNA, 25 bp, Mus musculus
ggtccggattttggcgctgccagcc

SEQ ID NO: 243499 - DNA, 25 bp, Mus musculus
aagccatcctccaggcgcagctggc

SEQ ID NO: 243500 - DNA, 25 bp, Mus musculus
tgaggttggcccaggccaccgcgtc

SEQ ID NO: 243501 - DNA, 25 bp, Mus musculus
cttacccggtctcgcggatggcgtt

SEQ ID NO: 243502 - DNA, 25 bp, Mus musculus
tccgcattgccggaggcgcttcatg

SEQ ID NO: 243503 - DNA, 25 bp, Mus musculus
tggccatccggctagaggaagactc

SEQ ID NO: 243504 - DNA, 25 bp, Mus musculus
ggcgagccttaaagggcgtgtcttg

SEQ ID NO: 243505 - DNA, 25 bp, Mus musculus
ccggctagaggaagactccgaggtc

SEQ ID NO: 243506 - DNA, 25 bp, Mus musculus
agcacacaggtgtccgcattgccgg

SEQ ID NO: 243507 - DNA, 25 bp, Mus musculus
agtctgcccacttcaccaacgccgc

SEQ ID NO: 243508 - DNA, 25 bp, Mus musculus
catccctcgccgtcaagtctgccca

SEQ ID NO: 243509 - DNA, 25 bp, Mus musculus
tcaaatccgctttcagctgggaccc

SEQ ID NO: 243510 - DNA, 25 bp, Mus musculus
ttctcaaatccgctttcagctggga

SEQ ID NO: 243511 - DNA, 25 bp, Mus musculus
gtcgctccaacttcagcttctcaaa

SEQ ID NO: 243512 - DNA, 25 bp, Mus musculus
agcttcgcagcctgtgcactcgtcg

SEQ ID NO: 243513 - DNA, 25 bp, Mus musculus
cccgaggtaagaggagcttcgcagc

SEQ ID NO: 243514 - DNA, 25 bp, Mus musculus
aagactccgaggtcgcggatccagg

SEQ ID NO: 243515 - DNA, 25 bp, Mus musculus
tcagaaagtgcttcccgattcccaa

SEQ ID NO: 243516 - DNA, 25 bp, Mus musculus
cttgcgtggttggtacattcctcga

SEQ ID NO: 243517 - DNA, 25 bp, Mus musculus
cctacgggtgaaacctggattctcg

SEQ ID NO: 243518 - DNA, 25 bp, Mus musculus
cctgcgaagttggttggtttcctca

SEQ ID NO: 243519 - DNA, 25 bp, Mus musculus
tctgcccggctggtacaccacttag

SEQ ID NO: 243520 - DNA, 25 bp, Mus musculus
ggtcccttaagcatctatcacggtt

SEQ ID NO: 243521 - DNA, 25 bp, Mus musculus
attcgcgcagttagtaggtccctta

SEQ ID NO: 243522 - DNA, 25 bp, Mus musculus
tctctcacagcttggcattcgcgca

SEQ ID NO: 243523 - DNA, 25 bp, Mus musculus
tcaggtcctgctctctttacagtta

SEQ ID NO: 243524 - DNA, 25 bp, Mus musculus
cgggctcgagtttacgcagccaata

SEQ ID NO: 243525 - DNA, 25 bp, Mus musculus
tcgagtttgtccacacgttcagttg

SEQ ID NO: 243526 - DNA, 25 bp, Mus musculus
cctcgcgctgatggtacgttccaca

SEQ ID NO: 243527 - DNA, 25 bp, Mus musculus
ttcgcccattgataaagccatgttg

SEQ ID NO: 243528 - DNA, 25 bp, Mus musculus
ttcagttgttatgtccctcaggtcc

SEQ ID NO: 243529 - DNA, 25 bp, Mus musculus
ccaccagttggtatgtccctcaggc

SEQ ID NO: 243530 - DNA, 25 bp, Mus musculus
tccagggctcgcttcagtattcgcg

SEQ ID NO: 243531 - DNA, 25 bp, Mus musculus
cgcttcagtattcgcgcgcagggct

SEQ ID NO: 243532 - DNA, 25 bp, Mus musculus
agtattcgcgcgcagggctccagac

SEQ ID NO: 243533 - DNA, 25 bp, Mus musculus
gcagggctccagacgctgcactttc

SEQ ID NO: 243534 - DNA, 25 bp, Mus musculus
cagccgcagctccttcagctgtgta

SEQ ID NO: 243535 - DNA, 25 bp, Mus musculus
ttcagctgtgtacgcagccgcctca

SEQ ID NO: 243536 - DNA, 25 bp, Mus musculus
agctgtgtacgcagccgcctcaact

SEQ ID NO: 243537 - DNA, 25 bp, Mus musculus
cagccgcctcaactcggcgtccagg

SEQ ID NO: 243538 - DNA, 25 bp, Mus musculus
cggcgtccaggttgcccgttatctt

SEQ ID NO: 243539 - DNA, 25 bp, Mus musculus
tccaggttgcccgttatcttccgct

SEQ ID NO: 243540 - DNA, 25 bp, Mus musculus
gttatcttccgctcctctatggctt

SEQ ID NO: 243541 - DNA, 25 bp, Mus musculus
ctcctctatggctttccgcgctgca

SEQ ID NO: 243542 - DNA, 25 bp, Mus musculus
gggctcgcttcagtattcgcgcgca

SEQ ID NO: 243543 - DNA, 25 bp, Mus musculus
cacgccgggcctcaacttcctggga

SEQ ID NO: 243544 - DNA, 25 bp, Mus musculus
taagctcagtaacagcctgcagccc

SEQ ID NO: 243545 - DNA, 25 bp, Mus musculus
tgcaaggggatgttcgaggtccctc

SEQ ID NO: 243546 - DNA, 25 bp, Mus musculus
ctgccgcccagagagagtactgttc

SEQ ID NO: 243547 - DNA, 25 bp, Mus musculus
ttcttggagggttcaaaataagctc

SEQ ID NO: 243548 - DNA, 25 bp, Mus musculus
agatcgcagcgcacagctacctgta

SEQ ID NO: 243549 - DNA, 25 bp, Mus musculus
aaccggctgacagcgtgcttggccc

SEQ ID NO: 243550 - DNA, 25 bp, Mus musculus
ttggcccgcagctgatgacatgtag

SEQ ID NO: 243551 - DNA, 25 bp, Mus musculus
tgacatgtagggtcacctcctggtc

SEQ ID NO: 243552 - DNA, 25 bp, Mus musculus
tcggcagactccttgcctggaaagt

SEQ ID NO: 243553 - DNA, 25 bp, Mus musculus
cctggaaagtttgggactgtgcgac

SEQ ID NO: 243554 - DNA, 25 bp, Mus musculus
ccaagagcggctcgctgagtatccg

SEQ ID NO: 243555 - DNA, 25 bp, Mus musculus
tgcccgccaaggacgtgtgagtccc

SEQ ID NO: 243556 - DNA, 25 bp, Mus musculus
cgctggcacactccgggtttaattg

SEQ ID NO: 243557 - DNA, 25 bp, Mus musculus
ctacctgtagctctggacgcatgtc

SEQ ID NO: 243558 - DNA, 25 bp, Mus musculus
tcgggcagcgcctgcggcttggtcc

SEQ ID NO: 243559 - DNA, 25 bp, Mus musculus
tgaagggttaatgcggcgcgcgccc

SEQ ID NO: 243560 - DNA, 25 bp, Mus musculus
gcgcccgcccttcttattggctgag

SEQ ID NO: 243561 - DNA, 25 bp, Mus musculus
accggcatcctgagcccatgggcgg

SEQ ID NO: 243562 - DNA, 25 bp, Mus musculus
ccggcccagcactaggcttcgggtg

SEQ ID NO: 243563 - DNA, 25 bp, Mus musculus
agggcgcgggattcccgctctgctt

SEQ ID NO: 243564 - DNA, 25 bp, Mus musculus
gggattcccgctctgcttagtggct

SEQ ID NO: 243565 - DNA, 25 bp, Mus musculus
attcccgctctgcttagtggctgcc

SEQ ID NO: 243566 - DNA, 25 bp, Mus musculus
cgctctgcttagtggctgccggctc

SEQ ID NO: 243567 - DNA, 25 bp, Mus musculus
ctgcggcgccggcacacctgtctgt

SEQ ID NO: 243568 - DNA, 25 bp, Mus musculus
acacctgtctgtcgacccgggctgg

SEQ ID NO: 243569 - DNA, 25 bp, Mus musculus
gggctcccggctcacgcctgcccgc

SEQ ID NO: 243570 - DNA, 25 bp, Mus musculus
cggatgatggtgtcgaggaaggtgt

SEQ ID NO: 243571 - DNA, 25 bp, Mus musculus
cccagcactaggcttcgggtggcct

SEQ ID NO: 243572 - DNA, 25 bp, Mus musculus
gctgcgattccacgccgcgatcgta

SEQ ID NO: 243573 - DNA, 25 bp, Mus musculus
gcctgctccacatcgaaaccaattg

SEQ ID NO: 243574 - DNA, 25 bp, Mus musculus
accaattggacaccgaggccgttct

SEQ ID NO: 243575 - DNA, 25 bp, Mus musculus
ccgaggccgttctcggtggcccaat

SEQ ID NO: 243576 - DNA, 25 bp, Mus musculus
ggttactaccggtcatcgtggccca

SEQ ID NO: 243577 - DNA, 25 bp, Mus musculus
cggcaacagcggcaaagcacttcgc

SEQ ID NO: 243578 - DNA, 25 bp, Mus musculus
acaggtccgtgtcgctgcgattcca

SEQ ID NO: 243579 - DNA, 25 bp, Mus musculus
ctctcggcctgatcgcggagctcag

SEQ ID NO: 243580 - DNA, 25 bp, Mus musculus
atccttccactggagccgtggcatc

SEQ ID NO: 243581 - DNA, 25 bp, Mus musculus
gcggccacgccacatgggctgacag

SEQ ID NO: 243582 - DNA, 25 bp, Mus musculus
cggcgctatttaaaccgcggccatc

SEQ ID NO: 243583 - DNA, 25 bp, Mus musculus
gggcgtgcttggtcacactggaaac

SEQ ID NO: 243584 - DNA, 25 bp, Mus musculus
tggtcacactggaaactctgcactg

SEQ ID NO: 243585 - DNA, 25 bp, Mus musculus
ctctgcactgaggaggacaccaggg

SEQ ID NO: 243586 - DNA, 25 bp, Mus musculus
tcatctgggacatgctgttgaagta

SEQ ID NO: 243587 - DNA, 25 bp, Mus musculus
taagccaggtccaggcgacggcgca

SEQ ID NO: 243588 - DNA, 25 bp, Mus musculus
gtcctggtcgactgaggttgttttg

SEQ ID NO: 243589 - DNA, 25 bp, Mus musculus
tgctgttgaccagcaggcactgctg

SEQ ID NO: 243590 - DNA, 25 bp, Mus musculus
actgctgacaggagcagggctgacc

SEQ ID NO: 243591 - DNA, 25 bp, Mus musculus
ctcccacgggccaggattgcgactt

SEQ ID NO: 243592 - DNA, 25 bp, Mus musculus
tgaagtagatgaggtagcagaagcc

SEQ ID NO: 243593 - DNA, 25 bp, Mus musculus
ctgcttctcgtacgcgttctggatg

SEQ ID NO: 243594 - DNA, 25 bp, Mus musculus
tggtgatgcagatgtccatgtcgta

SEQ ID NO: 243595 - DNA, 25 bp, Mus musculus
atgtccatgtcgtaggccgtccacg

SEQ ID NO: 243596 - DNA, 25 bp, Mus musculus
ccggcgccgacgatggatcgtagaa

SEQ ID NO: 243597 - DNA, 25 bp, Mus musculus
tggatcgtagaagttgcgtcgcacc

SEQ ID NO: 243598 - DNA, 25 bp, Mus musculus
acgctggtggacctctgtggtcctg

SEQ ID NO: 243599 - DNA, 25 bp, Mus musculus
attgcgacttgggaatggagccgac

SEQ ID NO: 243600 - DNA, 25 bp, Mus musculus
ttcgagttcaagatgcgggatgttg

SEQ ID NO: 243601 - DNA, 25 bp, Mus musculus
agccgcgaccgaggtttcctcaggg

SEQ ID NO: 243602 - DNA, 25 bp, Mus musculus
gcagaattccgggatgcggaatgaa

SEQ ID NO: 243603 - DNA, 25 bp, Mus musculus
ccagagccagggatttggggtccct

SEQ ID NO: 243604 - DNA, 25 bp, Mus musculus
atttggggtccctgcgctacacgct

SEQ ID NO: 243605 - DNA, 25 bp, Mus musculus
tctttctccgctggctcccgggagg

SEQ ID NO: 243606 - DNA, 25 bp, Mus musculus
agccgctgtgacacgcgagtcaccg

SEQ ID NO: 243607 - DNA, 25 bp, Mus musculus
tgtgacacgcgagtcaccgagtccc

SEQ ID NO: 243608 - DNA, 25 bp, Mus musculus
aaagagctgcaggtcgttatgtccc

SEQ ID NO: 243609 - DNA, 25 bp, Mus musculus
cccactggtgttcgcgacctgcagg

SEQ ID NO: 243610 - DNA, 25 bp, Mus musculus
gcctgagtggtggtagatctcccag

SEQ ID NO: 243611 - DNA, 25 bp, Mus musculus
ccgtgcctcgcttcggggtgacttg

SEQ ID NO: 243612 - DNA, 25 bp, Mus musculus
cagacaggaggacgcagtagtcctg

SEQ ID NO: 243613 - DNA, 25 bp, Mus musculus
cctgcagtccctggggtacccggag

SEQ ID NO: 243614 - DNA, 25 bp, Mus musculus
ttatttcggaatccccaggaggcga

SEQ ID NO: 243615 - DNA, 25 bp, Mus musculus
ctccgcggggtaccgtcacatggag

SEQ ID NO: 243616 - DNA, 25 bp, Mus musculus
cgcacggacccgctgctcgctcagg

SEQ ID NO: 243617 - DNA, 25 bp, Mus musculus
gatgtcatgttcctcccgtctccgg

SEQ ID NO: 243618 - DNA, 25 bp, Mus musculus
gggcggctcacctccgcgatgtcat

SEQ ID NO: 243619 - DNA, 25 bp, Mus musculus
caggaggcgacgctcatgaggcaat

SEQ ID NO: 243620 - DNA, 25 bp, Mus musculus
cgagcgcgcggggttatttcggaat

SEQ ID NO: 243621 - DNA, 25 bp, Mus musculus
aactcggggcggcaggaaatgaatg

SEQ ID NO: 243622 - DNA, 25 bp, Mus musculus
ctgaaagggtcctgtgtgaaggccc

SEQ ID NO: 243623 - DNA, 25 bp, Mus musculus
tcatgaggcaatgggtcaggaatgc

SEQ ID NO: 243624 - DNA, 25 bp, Mus musculus
gcacctgaaagggtcctgtgtgaag

SEQ ID NO: 243625 - DNA, 25 bp, Mus musculus
cgaagacgcaaaaagggggcacctg

SEQ ID NO: 243626 - DNA, 25 bp, Mus musculus
ccgcgcagtccagaggcagcgggga

SEQ ID NO: 243627 - DNA, 25 bp, Mus musculus
gcgacgctcatgaggcaatgggtca

SEQ ID NO: 243628 - DNA, 25 bp, Mus musculus
aatcctcgtccatccgaaattgggg

SEQ ID NO: 243629 - DNA, 25 bp, Mus musculus
ttatagaccggaagccgctgcctta

SEQ ID NO: 243630 - DNA, 25 bp, Mus musculus
gaagacgaccggagagcaccgctgt

SEQ ID NO: 243631 - DNA, 25 bp, Mus musculus
tcccgtcttgcaaggtaggaatggc

SEQ ID NO: 243632 - DNA, 25 bp, Mus musculus
accgctgtcggctactttgcggagc

SEQ ID NO: 243633 - DNA, 25 bp, Mus musculus
ggatcactacccagggccgcctatg

SEQ ID NO: 243634 - DNA, 25 bp, Mus musculus
cctatggtcgggatcattcgccaga

SEQ ID NO: 243635 - DNA, 25 bp, Mus musculus
attcgccagatctctcgggagcttc

SEQ ID NO: 243636 - DNA, 25 bp, Mus musculus
ttcatttctgtcagcgtgggttggc

SEQ ID NO: 243637 - DNA, 25 bp, Mus musculus
ctaagaacgagcgtagcgcccgaga

SEQ ID NO: 243638 - DNA, 25 bp, Mus musculus
ctgtgttgcgacttgcgaccctgca

SEQ ID NO: 243639 - DNA, 25 bp, Mus musculus
tccagaaccttctgttgagcctgtc

SEQ ID NO: 243640 - DNA, 25 bp, Mus musculus
tgttgagcctgtcttggccacgttg

SEQ ID NO: 243641 - DNA, 25 bp, Mus musculus
tgccttagttctctttcccgtcttg

SEQ ID NO: 243642 - DNA, 25 bp, Mus musculus
tcttactgacagttggctgcggagc

SEQ ID NO: 243643 - DNA, 25 bp, Mus musculus
catctttctgcacgacggactcatc

SEQ ID NO: 243644 - DNA, 25 bp, Mus musculus
ggactcatccgggtcaccgacctgg

SEQ ID NO: 243645 - DNA, 25 bp, Mus musculus
cgccgacaccgacctggaggtgagt

SEQ ID NO: 243646 - DNA, 25 bp, Mus musculus
ccacgcaaccgggagcctcttggag

SEQ ID NO: 243647 - DNA, 25 bp, Mus musculus
tgtgctccggagaccttttgtattt

SEQ ID NO: 243648 - DNA, 25 bp, Mus musculus
ttttgtattttgaacgctcgcacgg

SEQ ID NO: 243649 - DNA, 25 bp, Mus musculus
gctcgcacggactctgcttctttta

SEQ ID NO: 243650 - DNA, 25 bp, Mus musculus
ttcttttatcacagtcccagctcgg

SEQ ID NO: 243651 - DNA, 25 bp, Mus musculus
cccagctcggtgttgattttgtatg

SEQ ID NO: 243652 - DNA, 25 bp, Mus musculus
tgcagcgccttctcttagccatggg

SEQ ID NO: 243653 - DNA, 25 bp, Mus musculus
ggattgacttgacacccgcgccttt

SEQ ID NO: 243654 - DNA, 25 bp, Mus musculus
tctgtgcagtgcctcggattgactt

SEQ ID NO: 243655 - DNA, 25 bp, Mus musculus
agcaattctgcaacctgtctgtgca

SEQ ID NO: 243656 - DNA, 25 bp, Mus musculus
acggacagacagacctctagcgacg

SEQ ID NO: 243657 - DNA, 25 bp, Mus musculus
gccctgatggaagtccattggacca

SEQ ID NO: 243658 - DNA, 25 bp, Mus musculus
ccgtggggccctgatggaagtccat

SEQ ID NO: 243659 - DNA, 25 bp, Mus musculus
tcgccgagggccacgcccattggcc

SEQ ID NO: 243660 - DNA, 25 bp, Mus musculus
agccgcttcccaccgtcgccgaggg

SEQ ID NO: 243661 - DNA, 25 bp, Mus musculus
cccggagccaacaaccgcccagctg

SEQ ID NO: 243662 - DNA, 25 bp, Mus musculus
acctccgagcccagcgggaacagca

SEQ ID NO: 243663 - DNA, 25 bp, Mus musculus
ctcccgccgcgagcctgcgtcaccg

SEQ ID NO: 243664 - DNA, 25 bp, Mus musculus
aagactcagcaaaccgggaggccgg

SEQ ID NO: 243665 - DNA, 25 bp, Mus musculus
gcagggaagactcagcaaaccggga

SEQ ID NO: 243666 - DNA, 25 bp, Mus musculus
cgacggcagggaagactcagcaaac

SEQ ID NO: 243667 - DNA, 25 bp, Mus musculus
ctctagcgacggcagggaagactca

SEQ ID NO: 243668 - DNA, 25 bp, Mus musculus
ccattggaccacagcgctgccgttt

SEQ ID NO: 243669 - DNA, 25 bp, Mus musculus
gacagacctctagcgacggcaggga

SEQ ID NO: 243670 - DNA, 25 bp, Mus musculus
ccggagtcggtctgttagccaccgc

SEQ ID NO: 243671 - DNA, 25 bp, Mus musculus
cgagctcgacgctggccctttaacg

SEQ ID NO: 243672 - DNA, 25 bp, Mus musculus
cactgaggttctgcgcttgtcatca

SEQ ID NO: 243673 - DNA, 25 bp, Mus musculus
tgcgcttgtcatcatggcgacgcgg

SEQ ID NO: 243674 - DNA, 25 bp, Mus musculus
atgtgcaggaccctaacgaccggcg

SEQ ID NO: 243675 - DNA, 25 bp, Mus musculus
gcctccggcccatttacggtgagta

SEQ ID NO: 243676 - DNA, 25 bp, Mus musculus
gccaccgcggcgagacaaagcgtgc

SEQ ID NO: 243677 - DNA, 25 bp, Mus musculus
tgtcaactctgtgcggatcgcgccg

SEQ ID NO: 243678 - DNA, 25 bp, Mus musculus
agcgctcccggcaggttgttttatt

SEQ ID NO: 243679 - DNA, 25 bp, Mus musculus
gttgttttattccagccgctcccga

SEQ ID NO: 243680 - DNA, 25 bp, Mus musculus
cgcgcggtcttttcttgcaggtgac

SEQ ID NO: 243681 - DNA, 25 bp, Mus musculus
cttgcaggtgacaagcggctcaggc

SEQ ID NO: 243682 - DNA, 25 bp, Mus musculus
actatcgcgataggtcggcgagctc

SEQ ID NO: 243683 - DNA, 25 bp, Mus musculus
acccggaggcgacaagacaacggtg

SEQ ID NO: 243684 - DNA, 25 bp, Mus musculus
gcggtcctgcggtctcaagagaccc

SEQ ID NO: 243685 - DNA, 25 bp, Mus musculus
cgcgcacttggcgacactcggctag

SEQ ID NO: 243686 - DNA, 25 bp, Mus musculus
agcggccaccgccagagcgagatgc

SEQ ID NO: 243687 - DNA, 25 bp, Mus musculus
cggcgcgcatgaacgcaagcggcca

SEQ ID NO: 243688 - DNA, 25 bp, Mus musculus
acaggcaagctacaggcggagcgct

SEQ ID NO: 243689 - DNA, 25 bp, Mus musculus
gaagggcacccttcgtgtgtaggcc

SEQ ID NO: 243690 - DNA, 25 bp, Mus musculus
tgactgtgtccaagggaagggcacc

SEQ ID NO: 243691 - DNA, 25 bp, Mus musculus
ttaccttgtagaaagtgactgtgtc

SEQ ID NO: 243692 - DNA, 25 bp, Mus musculus
cgccgccctcattaccttgtagaaa

SEQ ID NO: 243693 - DNA, 25 bp, Mus musculus
gcgtctatctgcacctgcgcacgat

SEQ ID NO: 243694 - DNA, 25 bp, Mus musculus
tgccacgggcgtctatctgcacctg

SEQ ID NO: 243695 - DNA, 25 bp, Mus musculus
gacactcggctaggccgtgttccgc

SEQ ID NO: 243696 - DNA, 25 bp, Mus musculus
tctctcgcctcggaagaagacgtgg

SEQ ID NO: 243697 - DNA, 25 bp, Mus musculus
ccgtgttccgctgcgttctcgcggg

SEQ ID NO: 243698 - DNA, 25 bp, Mus musculus
tcgttctctcctgggcgatgcccga

SEQ ID NO: 243699 - DNA, 25 bp, Mus musculus
ctcgtgggccatgagagccgcgaac

SEQ ID NO: 243700 - DNA, 25 bp, Mus musculus
agccgcgaacaggaggacatcttca

SEQ ID NO: 243701 - DNA, 25 bp, Mus musculus
ggacatcttcatgatggaaggcctc

SEQ ID NO: 243702 - DNA, 25 bp, Mus musculus
ttcatgatggaaggcctccacggcc

SEQ ID NO: 243703 - DNA, 25 bp, Mus musculus
ggccgccgcaaactcacccgaacag

SEQ ID NO: 243704 - DNA, 25 bp, Mus musculus
cacccgaacaggcaccacggagaaa

SEQ ID NO: 243705 - DNA, 25 bp, Mus musculus
cggagaaacgcctggccctcgttct

SEQ ID NO: 243706 - DNA, 25 bp, Mus musculus
ctcctgggcgatgcccgacgatcaa

SEQ ID NO: 243707 - DNA, 25 bp, Mus musculus
agtgtgccacatcgtgcctgacccg

SEQ ID NO: 243708 - DNA, 25 bp, Mus musculus
ttgtgcccgagctcgtgggccatga

SEQ ID NO: 243709 - DNA, 25 bp, Mus musculus
tggatacccaggttgtgcccgagct

SEQ ID NO: 243710 - DNA, 25 bp, Mus musculus
cccgacgatcaagtgtgccacatcg

SEQ ID NO: 243711 - DNA, 25 bp, Mus musculus
tggtcgtgctggatacccaggttgt

SEQ ID NO: 243712 - DNA, 25 bp, Mus musculus
aagagttccgacctgtgcgctggta

SEQ ID NO: 243713 - DNA, 25 bp, Mus musculus
aacctgatgcgatgaccgtccactc

SEQ ID NO: 243714 - DNA, 25 bp, Mus musculus
ctgtgaagcgcgtgtggctaatcac

SEQ ID NO: 243715 - DNA, 25 bp, Mus musculus
tggctaatcacgaggtaggcgtttg

SEQ ID NO: 243716 - DNA, 25 bp, Mus musculus
taggcgtttgggagtctgagtcaaa

SEQ ID NO: 243717 - DNA, 25 bp, Mus musculus
gaattagcttcgtctcccgcgtgcg

SEQ ID NO: 243718 - DNA, 25 bp, Mus musculus
tgcgacctagagctgcgccagctgg

SEQ ID NO: 243719 - DNA, 25 bp, Mus musculus
gtctccaggattccgagcgccagca

SEQ ID NO: 243720 - DNA, 25 bp, Mus musculus
gcgcgggccacgttaccatagcgac

SEQ ID NO: 243721 - DNA, 25 bp, Mus musculus
accatagcgactggagtcagtaacc

SEQ ID NO: 243722 - DNA, 25 bp, Mus musculus
tcagtaaccttggtcccggtgcacc

SEQ ID NO: 243723 - DNA, 25 bp, Mus musculus
caggagtctcaacacaaaagagttc

SEQ ID NO: 243724 - DNA, 25 bp, Mus musculus
ctggtaccgaaggaagagacgcttg

SEQ ID NO: 243725 - DNA, 25 bp, Mus musculus
gatcccgccgggcagaaacaggagt

SEQ ID NO: 243726 - DNA, 25 bp, Mus musculus
tgccttgagcaaggacatatgtttg

SEQ ID NO: 243727 - DNA, 25 bp, Mus musculus
cctggcctgggcgttctcacagcaa

SEQ ID NO: 243728 - DNA, 25 bp, Mus musculus
gggcgttctcacagcaaggcccgtc

SEQ ID NO: 243729 - DNA, 25 bp, Mus musculus
gtccctagacctacgtgcaagacct

SEQ ID NO: 243730 - DNA, 25 bp, Mus musculus
ctacgtgcaagacctcctgaggaca

SEQ ID NO: 243731 - DNA, 25 bp, Mus musculus
tcctgaggacagagctagccgcgga

SEQ ID NO: 243732 - DNA, 25 bp, Mus musculus
ttcaccgtgtgctgtgccttgagca

SEQ ID NO: 243733 - DNA, 25 bp, Mus musculus
agatagcgtgacaaggccgttccca

SEQ ID NO: 243734 - DNA, 25 bp, Mus musculus
catatgtttgtctgcggcgatgtca

SEQ ID NO: 243735 - DNA, 25 bp, Mus musculus
tgtctgcggcgatgtcactatggca

SEQ ID NO: 243736 - DNA, 25 bp, Mus musculus
tggcaaccagcgtcctgcaaaccgt

SEQ ID NO: 243737 - DNA, 25 bp, Mus musculus
tgcaaaccgtgcagagaattctggc

SEQ ID NO: 243738 - DNA, 25 bp, Mus musculus
aattctggcaacagagggcggcatg

SEQ ID NO: 243739 - DNA, 25 bp, Mus musculus
agctagccgcggaggttcaccgtgt

SEQ ID NO: 243740 - DNA, 25 bp, Mus musculus
ctttctccatgtcgctgtcctccga

SEQ ID NO: 243741 - DNA, 25 bp, Mus musculus
tcgcggttgtcgacaaagcagggta

SEQ ID NO: 243742 - DNA, 25 bp, Mus musculus
caaagcagggtacgggttgcatctc

SEQ ID NO: 243743 - DNA, 25 bp, Mus musculus
gggtacgggttgcatctcccgctta

SEQ ID NO: 243744 - DNA, 25 bp, Mus musculus
tctcccgcttaccttgatggctttc

SEQ ID NO: 243745 - DNA, 25 bp, Mus musculus
gtcctccgacatgctccgctgggct

SEQ ID NO: 243746 - DNA, 25 bp, Mus musculus
gctccagcgccacacatcgccggga

SEQ ID NO: 243747 - DNA, 25 bp, Mus musculus
tctgcagcttcacgccagccatgct

SEQ ID NO: 243748 - DNA, 25 bp, Mus musculus
catccgccggcctttctgaggcttt

SEQ ID NO: 243749 - DNA, 25 bp, Mus musculus
cgggccttccactgacgtggcgctg

SEQ ID NO: 243750 - DNA, 25 bp, Mus musculus
aatgacgtaagacggcgcgaggcct

SEQ ID NO: 243751 - DNA, 25 bp, Mus musculus
cgaggcctggcctgccgaaagagaa

SEQ ID NO: 243752 - DNA, 25 bp, Mus musculus
agcggaatcgcggttgtcgacaaag

SEQ ID NO: 243753 - DNA, 25 bp, Mus musculus
ttccgcaggcggctctaagctggtg

SEQ ID NO: 243754 - DNA, 25 bp, Mus musculus
catcgatgcggggtaaagaggccca

SEQ ID NO: 243755 - DNA, 25 bp, Mus musculus
agggcgactgcagcgttgaagaaca

SEQ ID NO: 243756 - DNA, 25 bp, Mus musculus
gagccgagagaagccttgccgatcg

SEQ ID NO: 243757 - DNA, 25 bp, Mus musculus
actgaaatgggcgagccgagccgaa

SEQ ID NO: 243758 - DNA, 25 bp, Mus musculus
actgacccgaactgaactgaaatgg

SEQ ID NO: 243759 - DNA, 25 bp, Mus musculus
actgagcggagcttaactgacccga

SEQ ID NO: 243760 - DNA, 25 bp, Mus musculus
cgcagcatgctgaactgagcggagc

SEQ ID NO: 243761 - DNA, 25 bp, Mus musculus
tctcacctggttgcagaagacctca

SEQ ID NO: 243762 - DNA, 25 bp, Mus musculus
cgaggaggcgaagtgagtctcacct

SEQ ID NO: 243763 - DNA, 25 bp, Mus musculus
aagacgcgcgcaaagatcgctgggc

SEQ ID NO: 243764 - DNA, 25 bp, Mus musculus
acacactgcggccacatgggcaagg

SEQ ID NO: 243765 - DNA, 25 bp, Mus musculus
gtcccaggccgagaggcgacacact

SEQ ID NO: 243766 - DNA, 25 bp, Mus musculus
ttgaagaacaagtcctcgcctccgc

SEQ ID NO: 243767 - DNA, 25 bp, Mus musculus
ggtaaagaggcccaggactgtccca

SEQ ID NO: 243768 - DNA, 25 bp, Mus musculus
ctgacaaaagcgcttgcgcaacttg

SEQ ID NO: 243769 - DNA, 25 bp, Mus musculus
caccggtgggctcgtccggccaccg

SEQ ID NO: 243770 - DNA, 25 bp, Mus musculus
gcggcgctgccaccggtgggctcgt

SEQ ID NO: 243771 - DNA, 25 bp, Mus musculus
ttgtgactcggccacttggggctgc

SEQ ID NO: 243772 - DNA, 25 bp, Mus musculus
agcggaggttgtgactcggccactt

SEQ ID NO: 243773 - DNA, 25 bp, Mus musculus
aagcggaggttgtgactcggccact

SEQ ID NO: 243774 - DNA, 25 bp, Mus musculus
aaagcgcttgcgcaacttgggcccc

SEQ ID NO: 243775 - DNA, 25 bp, Mus musculus
gggcaaaaccaactgacaaaagcgc

SEQ ID NO: 243776 - DNA, 25 bp, Mus musculus
tgacaaaagcgcttgcgcaacttgg

SEQ ID NO: 243777 - DNA, 25 bp, Mus musculus
caactgacaaaagcgcttgcgcaac

SEQ ID NO: 243778 - DNA, 25 bp, Mus musculus
accaactgacaaaagcgcttgcgca

SEQ ID NO: 243779 - DNA, 25 bp, Mus musculus
aaaccaactgacaaaagcgcttgcg

SEQ ID NO: 243780 - DNA, 25 bp, Mus musculus
gcaaaaccaactgacaaaagcgctt

SEQ ID NO: 243781 - DNA, 25 bp, Mus musculus
acaaaagcgcttgcgcaacttgggc

SEQ ID NO: 243782 - DNA, 25 bp, Mus musculus
acccatagactctcggtgagccctg

SEQ ID NO: 243783 - DNA, 25 bp, Mus musculus
gtagagaggggtcaaacgcaaaata

SEQ ID NO: 243784 - DNA, 25 bp, Mus musculus
cgcaaaataggagccaggcgtcttt

SEQ ID NO: 243785 - DNA, 25 bp, Mus musculus
aggcgtctttgcgtgctctgcgcac

SEQ ID NO: 243786 - DNA, 25 bp, Mus musculus
cagctgtcgaaagcgcatgcgcgcc

SEQ ID NO: 243787 - DNA, 25 bp, Mus musculus
cagcgcctgtcctatgagtgtgtca

SEQ ID NO: 243788 - DNA, 25 bp, Mus musculus
tgtcactggtggtcatccgactgga

SEQ ID NO: 243789 - DNA, 25 bp, Mus musculus
gggcgatgctgtgcgcctttcccaa

SEQ ID NO: 243790 - DNA, 25 bp, Mus musculus
tggaaacgcgagttttagcccagcc

SEQ ID NO: 243791 - DNA, 25 bp, Mus musculus
caccggccacagacttccttagtgg

SEQ ID NO: 243792 - DNA, 25 bp, Mus musculus
accgagaggctgacgtcttcaccac

SEQ ID NO: 243793 - DNA, 25 bp, Mus musculus
atttgcccaaagttaggtgtgagtg

SEQ ID NO: 243794 - DNA, 25 bp, Mus musculus
ttcccaagctggcagtcagacagac

SEQ ID NO: 243795 - DNA, 25 bp, Mus musculus
ttccttagtgggtcatgcagcttcg

SEQ ID NO: 243796 - DNA, 25 bp, Mus musculus
ccaggtcctcggagctgcgtgcctt

SEQ ID NO: 243797 - DNA, 25 bp, Mus musculus
cagaaagtggctgtggcccggacct

SEQ ID NO: 243798 - DNA, 25 bp, Mus musculus
tggagaccgaagcaccaggcgaccc

SEQ ID NO: 243799 - DNA, 25 bp, Mus musculus
cagcgtgcgccgctgtccattgctg

SEQ ID NO: 243800 - DNA, 25 bp, Mus musculus
cgacctccttgagcgcctcagtggg

SEQ ID NO: 243801 - DNA, 25 bp, Mus musculus
tagcgcaatacgacctccttgagcg

SEQ ID NO: 243802 - DNA, 25 bp, Mus musculus
cgctggaagagctccgcgaactgca

SEQ ID NO: 243803 - DNA, 25 bp, Mus musculus
gcgaactgcagcgacaccaggtccg

SEQ ID NO: 243804 - DNA, 25 bp, Mus musculus
cgcgcgcgcaaacaaccagtactgg

SEQ ID NO: 243805 - DNA, 25 bp, Mus musculus
aacaaccagtactggcgggccagct

SEQ ID NO: 243806 - DNA, 25 bp, Mus musculus
ccgctgctgcgtgctgctcgcagaa

SEQ ID NO: 243807 - DNA, 25 bp, Mus musculus
tcgcagaagtcgctccagccgcgtg

SEQ ID NO: 243808 - DNA, 25 bp, Mus musculus
tcgtccgccaggctatagcgcaata

SEQ ID NO: 243809 - DNA, 25 bp, Mus musculus
gtcgatgtcattggtgtcactggta

SEQ ID NO: 243810 - DNA, 25 bp, Mus musculus
tcggaaaacggccagcgcctcattt

SEQ ID NO: 243811 - DNA, 25 bp, Mus musculus
cacgccgttatgtaaagaggaacca

SEQ ID NO: 243812 - DNA, 25 bp, Mus musculus
cgcggcgccatccatttgaagtccg

SEQ ID NO: 243813 - DNA, 25 bp, Mus musculus
ataaagaatctcgaaggggaggagc

SEQ ID NO: 243814 - DNA, 25 bp, Mus musculus
aaccttatctgagcttgcccggccg

SEQ ID NO: 243815 - DNA, 25 bp, Mus musculus
ttgcccggccgggtctagcaactgc

SEQ ID NO: 243816 - DNA, 25 bp, Mus musculus
tctagcaactgcgaccgcggttttc

SEQ ID NO: 243817 - DNA, 25 bp, Mus musculus
cgcggttttcatcacctccagggga

SEQ ID NO: 243818 - DNA, 25 bp, Mus musculus
gcgcttaccgcgcaagctgcgggtc

SEQ ID NO: 243819 - DNA, 25 bp, Mus musculus
cgccagaaaacagaagcgggacccg

SEQ ID NO: 243820 - DNA, 25 bp, Mus musculus
cagaatgaggaaacgccagaaaaca

SEQ ID NO: 243821 - DNA, 25 bp, Mus musculus
gcctctcggcgctcaggcaggaaac

SEQ ID NO: 243822 - DNA, 25 bp, Mus musculus
taaagaggaaccagccgcgagccgc

SEQ ID NO: 243823 - DNA, 25 bp, Mus musculus
tgggaggtagcatagcgacaagctc

SEQ ID NO: 243824 - DNA, 25 bp, Mus musculus
cttcctgggcgggtgcctgacgact

SEQ ID NO: 243825 - DNA, 25 bp, Mus musculus
cagggaagtgcagccgccctctctt

SEQ ID NO: 243826 - DNA, 25 bp, Mus musculus
ctggtttctggggaagtgactcagt

SEQ ID NO: 243827 - DNA, 25 bp, Mus musculus
tttctggggaagtgactcagtgccc

SEQ ID NO: 243828 - DNA, 25 bp, Mus musculus
attaaaggaccctaattgctccgca

SEQ ID NO: 243829 - DNA, 25 bp, Mus musculus
gaccctaattgctccgcagctcgga

SEQ ID NO: 243830 - DNA, 25 bp, Mus musculus
gtcctctcccggatccacgcgcgct

SEQ ID NO: 243831 - DNA, 25 bp, Mus musculus
aactgcaacctgccgccctgagaga

SEQ ID NO: 243832 - DNA, 25 bp, Mus musculus
tgcctgacgactgcagcgggcacga

SEQ ID NO: 243833 - DNA, 25 bp, Mus musculus
cgccctctgctggtcatgggcggca

SEQ ID NO: 243834 - DNA, 25 bp, Mus musculus
tcatgggcggcagcgcaactgcaac

SEQ ID NO: 243835 - DNA, 25 bp, Mus musculus
cgccggccctgggaatctggtttct

SEQ ID NO: 243836 - DNA, 25 bp, Mus musculus
gggcggcagcgcaactgcaacctgc

SEQ ID NO: 243837 - DNA, 25 bp, Mus musculus
tgctccgcagctcggagactccggt

SEQ ID NO: 243838 - DNA, 25 bp, Mus musculus
accttgcagggctgaccaatgggca

SEQ ID NO: 243839 - DNA, 25 bp, Mus musculus
gttccgcggtggtgatgccctgcct

SEQ ID NO: 243840 - DNA, 25 bp, Mus musculus
gtggtgatgccctgcctccgtttcc

SEQ ID NO: 243841 - DNA, 25 bp, Mus musculus
tcccagagccaggtaaagccgggcg

SEQ ID NO: 243842 - DNA, 25 bp, Mus musculus
gcctccgtttccctcgagtcctagc

SEQ ID NO: 243843 - DNA, 25 bp, Mus musculus
cgccaggttgctccgggaccgaatt

SEQ ID NO: 243844 - DNA, 25 bp, Mus musculus
tttaagagggatttttcaggcgcgc

SEQ ID NO: 243845 - DNA, 25 bp, Mus musculus
gttgagccgtctcgccaggttgctc

SEQ ID NO: 243846 - DNA, 25 bp, Mus musculus
cgacaagcgccgttgagccgtctcg

SEQ ID NO: 243847 - DNA, 25 bp, Mus musculus
gccggtcccagagccaggtaaagcc

SEQ ID NO: 243848 - DNA, 25 bp, Mus musculus
ccatgggcaggacagaccgtcgcgc

SEQ ID NO: 243849 - DNA, 25 bp, Mus musculus
gccactcggcctccgggagacaaag

SEQ ID NO: 243850 - DNA, 25 bp, Mus musculus
agacaaagggccctgtcgtcgccgg

SEQ ID NO: 243851 - DNA, 25 bp, Mus musculus
attctgggaactcccgaccctggca

SEQ ID NO: 243852 - DNA, 25 bp, Mus musculus
agttcgccttcgcagtgcgctttgc

SEQ ID NO: 243853 - DNA, 25 bp, Mus musculus
caactggctgccatgcgcgagggaa

SEQ ID NO: 243854 - DNA, 25 bp, Mus musculus
ggccagcttccactatctgcgcttg

SEQ ID NO: 243855 - DNA, 25 bp, Mus musculus
cggccgtacgtgctggccgctgaca

SEQ ID NO: 243856 - DNA, 25 bp, Mus musculus
tcatcctgctggagggctgcacggt

SEQ ID NO: 243857 - DNA, 25 bp, Mus musculus
ctcttttacttcgaggcagaaggca

SEQ ID NO: 243858 - DNA, 25 bp, Mus musculus
tgctccggggcaatatcctctttta

SEQ ID NO: 243859 - DNA, 25 bp, Mus musculus
cttcctgtacaagcgtggtggccgt

SEQ ID NO: 243860 - DNA, 25 bp, Mus musculus
tggccttctacgcaacctgcgatgc

SEQ ID NO: 243861 - DNA, 25 bp, Mus musculus
gtgaccatgaagctcaacgagcgca

SEQ ID NO: 243862 - DNA, 25 bp, Mus musculus
ccagagacccaaggagaacggctgg

SEQ ID NO: 243863 - DNA, 25 bp, Mus musculus
aacgagcgcagcttggccttctacg

SEQ ID NO: 243864 - DNA, 25 bp, Mus musculus
aggttgcagctcctcgtgaccatga

SEQ ID NO: 243865 - DNA, 25 bp, Mus musculus
ccactatctgcgcttggtggtgcgg

SEQ ID NO: 243866 - DNA, 25 bp, Mus musculus
tggagaaccttctcaccactgcggc

SEQ ID NO: 243867 - DNA, 25 bp, Mus musculus
acacgtgcgcttcggaatggtgcca

SEQ ID NO: 243868 - DNA, 25 bp, Mus musculus
ttggtgggaatgctacagcctcctt

SEQ ID NO: 243869 - DNA, 25 bp, Mus musculus
cctgggctatatttggtgggaatgc

SEQ ID NO: 243870 - DNA, 25 bp, Mus musculus
gtataaatagctcggcccaagaggg

SEQ ID NO: 243871 - DNA, 25 bp, Mus musculus
tctatccatccggtagccctcgggg

SEQ ID NO: 243872 - DNA, 25 bp, Mus musculus
ctgcggctccaccaaagggccatga

SEQ ID NO: 243873 - DNA, 25 bp, Mus musculus
ccattctttcttgacttggagaacc

SEQ ID NO: 243874 - DNA, 25 bp, Mus musculus
aaggtttggggccttcgatcatcag

SEQ ID NO: 243875 - DNA, 25 bp, Mus musculus
gccaaggcggacagaggcagataca

SEQ ID NO: 243876 - DNA, 25 bp, Mus musculus
cgcgcgacggatgagagcacttaaa

SEQ ID NO: 243877 - DNA, 25 bp, Mus musculus
cgtagacgcctatctatccatccgg

SEQ ID NO: 243878 - DNA, 25 bp, Mus musculus
gaacagccagttgcgcgcttgcatc

SEQ ID NO: 243879 - DNA, 25 bp, Mus musculus
tgggcgaccaaacgtccagagtata

SEQ ID NO: 243880 - DNA, 25 bp, Mus musculus
gtgtcaactccagcgtgtctacctc

SEQ ID NO: 243881 - DNA, 25 bp, Mus musculus
cctcccggtacatgtacagttcata

SEQ ID NO: 243882 - DNA, 25 bp, Mus musculus
acagttcatactgctcgggtgtcag

SEQ ID NO: 243883 - DNA, 25 bp, Mus musculus
atgctggatagtagggcagtcgccc

SEQ ID NO: 243884 - DNA, 25 bp, Mus musculus
ccatagctgcttcgtcctcaggggc

SEQ ID NO: 243885 - DNA, 25 bp, Mus musculus
agtagccggcatcgccgatctccga

SEQ ID NO: 243886 - DNA, 25 bp, Mus musculus
catagggacggctgagcaaaccacg

SEQ ID NO: 243887 - DNA, 25 bp, Mus musculus
atgcccagtggtggtcaaagtagcc

SEQ ID NO: 243888 - DNA, 25 bp, Mus musculus
gcggatgatccgctgcacaaatgca

SEQ ID NO: 243889 - DNA, 25 bp, Mus musculus
gcaaaccacggtctgatgcccagtg

SEQ ID NO: 243890 - DNA, 25 bp, Mus musculus
aggctcgcccattgggctgtccgga

SEQ ID NO: 243891 - DNA, 25 bp, Mus musculus
cccattctggctcgcagtggctggc

SEQ ID NO: 243892 - DNA, 25 bp, Mus musculus
caagcggcgcctgcacagtgctgct

SEQ ID NO: 243893 - DNA, 25 bp, Mus musculus
ctccgacttcaccttgcggatgatc

SEQ ID NO: 243894 - DNA, 25 bp, Mus musculus
cggaagagcagcaagtccacgttga

SEQ ID NO: 243895 - DNA, 25 bp, Mus musculus
ctctgcagttccaggaggcgagact

SEQ ID NO: 243896 - DNA, 25 bp, Mus musculus
gcgccgtcatggtagtgagcacatg

SEQ ID NO: 243897 - DNA, 25 bp, Mus musculus
tgttggctaacgctacctggtagtt

SEQ ID NO: 243898 - DNA, 25 bp, Mus musculus
tggacgtccagttccgtcagcggcc

SEQ ID NO: 243899 - DNA, 25 bp, Mus musculus
gcaggcagcagacccttgttggcta

SEQ ID NO: 243900 - DNA, 25 bp, Mus musculus
aaggcgtgcaatacctgccaggcca

SEQ ID NO: 243901 - DNA, 25 bp, Mus musculus
ctccacgtggctgtagaaggcgtgc

SEQ ID NO: 243902 - DNA, 25 bp, Mus musculus
cagctcgtgcggcagctcgttaaag

SEQ ID NO: 243903 - DNA, 25 bp, Mus musculus
ctcccgagaagaagaccagctggcg

SEQ ID NO: 243904 - DNA, 25 bp, Mus musculus
tgagcactagcagcgcggcaaagag

SEQ ID NO: 243905 - DNA, 25 bp, Mus musculus
tcctcatcgtagatggtgagcacta

SEQ ID NO: 243906 - DNA, 25 bp, Mus musculus
acggccaacacgtcctcatcgtaga

SEQ ID NO: 243907 - DNA, 25 bp, Mus musculus
gtgagcacatgctccacggccaaca

SEQ ID NO: 243908 - DNA, 25 bp, Mus musculus
cgatcgatcggccaatcaggagagt

SEQ ID NO: 243909 - DNA, 25 bp, Mus musculus
cgcaccgctgtttgttataacggta

SEQ ID NO: 243910 - DNA, 25 bp, Mus musculus
atcgatgctggaggctttgaattcc

SEQ ID NO: 243911 - DNA, 25 bp, Mus musculus
tcaatttatagatcagcgcagggct

SEQ ID NO: 243912 - DNA, 25 bp, Mus musculus
gccggtgtgtgattaagataagccc

SEQ ID NO: 243913 - DNA, 25 bp, Mus musculus
ggttcctttcatacattccttagtg

SEQ ID NO: 243914 - DNA, 25 bp, Mus musculus
tgcagcttctcagacgccaaatttg

SEQ ID NO: 243915 - DNA, 25 bp, Mus musculus
agagtctagccggtgcattatcgcc

SEQ ID NO: 243916 - DNA, 25 bp, Mus musculus
cggcgccttccaagccagagctttt

SEQ ID NO: 243917 - DNA, 25 bp, Mus musculus
ccagagcttttcatggcttccatca

SEQ ID NO: 243918 - DNA, 25 bp, Mus musculus
agcggctggcctgtctcatagccca

SEQ ID NO: 243919 - DNA, 25 bp, Mus musculus
cagggcgaacatctgttgtgctgca

SEQ ID NO: 243920 - DNA, 25 bp, Mus musculus
cccagcgggagagcagtaaatttct

SEQ ID NO: 243921 - DNA, 25 bp, Mus musculus
cggagacgttcaccgcagttaaaga

SEQ ID NO: 243922 - DNA, 25 bp, Mus musculus
ggagcacggagcacacacgcgcgac

SEQ ID NO: 243923 - DNA, 25 bp, Mus musculus
gcacttgactttggctccttgcaaa

SEQ ID NO: 243924 - DNA, 25 bp, Mus musculus
accgtaaagaacaaagtgagctctc

SEQ ID NO: 243925 - DNA, 25 bp, Mus musculus
tggctccttgcaaacttatcgacag

SEQ ID NO: 243926 - DNA, 25 bp, Mus musculus
caaagtgagctctctgcagtgcgtg

SEQ ID NO: 243927 - DNA, 25 bp, Mus musculus
gctcgcacttgactttggctccttg

SEQ ID NO: 243928 - DNA, 25 bp, Mus musculus
gcacgccgctcgcacttgactttgg

SEQ ID NO: 243929 - DNA, 25 bp, Mus musculus
tgcggctgccgccaacacccgggct

SEQ ID NO: 243930 - DNA, 25 bp, Mus musculus
ccctggtcgcccgtacagccctggc

SEQ ID NO: 243931 - DNA, 25 bp, Mus musculus
ccgccgccagtccaggcgccgtctt

SEQ ID NO: 243932 - DNA, 25 bp, Mus musculus
gggctggtctgctcacctgcagccg

SEQ ID NO: 243933 - DNA, 25 bp, Mus musculus
acaaaggcgggctggtctgctcacc

SEQ ID NO: 243934 - DNA, 25 bp, Mus musculus
gccgctcgtggcggcagcgaacaaa

SEQ ID NO: 243935 - DNA, 25 bp, Mus musculus
gcaaacttatcgacagcgccgcgcg

SEQ ID NO: 243936 - DNA, 25 bp, Mus musculus
ggccatcttgttcttctcgtggttc

SEQ ID NO: 243937 - DNA, 25 bp, Mus musculus
tctggggcgcgcatacaagcgcctc

SEQ ID NO: 243938 - DNA, 25 bp, Mus musculus
tctcggaagccgctttggatctggg

SEQ ID NO: 243939 - DNA, 25 bp, Mus musculus
atcatccaacggctgctggaaggtg

SEQ ID NO: 243940 - DNA, 25 bp, Mus musculus
tcgacagcatcatccaacggctgct

SEQ ID NO: 243941 - DNA, 25 bp, Mus musculus
cgacaaactcaacatcgacagcatc

SEQ ID NO: 243942 - DNA, 25 bp, Mus musculus
ttcttctcgtggttcccagtggcga

SEQ ID NO: 243943 - DNA, 25 bp, Mus musculus
cgcgctctatgggcccgtaaagaag

SEQ ID NO: 243944 - DNA, 25 bp, Mus musculus
ggagtcgcgctcaaccgtctccgcc

SEQ ID NO: 243945 - DNA, 25 bp, Mus musculus
ctctcccgccacagggggtctattt

SEQ ID NO: 243946 - DNA, 25 bp, Mus musculus
ttgcgcgcgccaacttcacaacttc

SEQ ID NO: 243947 - DNA, 25 bp, Mus musculus
gactgacaaagtccaccttcaactt

SEQ ID NO: 243948 - DNA, 25 bp, Mus musculus
ggcgatggcggatatcgacaaactc

SEQ ID NO: 243949 - DNA, 25 bp, Mus musculus
aaagtccaccttcaacttgcgcgcg

SEQ ID NO: 243950 - DNA, 25 bp, Mus musculus
cggcgatgttctcggtcttgtcgta

SEQ ID NO: 243951 - DNA, 25 bp, Mus musculus
tgcctggaccgtcctcggattgcca

SEQ ID NO: 243952 - DNA, 25 bp, Mus musculus
cgggaatccctgcttcttggcgagc

SEQ ID NO: 243953 - DNA, 25 bp, Mus musculus
ctgcaggctgctaacctcgctttgc

SEQ ID NO: 243954 - DNA, 25 bp, Mus musculus
gaaccgcgcactcttcttagtcaca

SEQ ID NO: 243955 - DNA, 25 bp, Mus musculus
tgtccagtccgtcccggtgcagaac

SEQ ID NO: 243956 - DNA, 25 bp, Mus musculus
caccgccttgggaatgtgtccagtc

SEQ ID NO: 243957 - DNA, 25 bp, Mus musculus
ccacactttagaaatggggaaactg

SEQ ID NO: 243958 - DNA, 25 bp, Mus musculus
gagatgcgttttctgcctcacgatc

SEQ ID NO: 243959 - DNA, 25 bp, Mus musculus
gagtgcgagtcttccctgcttcctc

SEQ ID NO: 243960 - DNA, 25 bp, Mus musculus
cctgctcaagaagggcgcgtgctac

SEQ ID NO: 243961 - DNA, 25 bp, Mus musculus
aggacttccgtaagggcctgctcaa

SEQ ID NO: 243962 - DNA, 25 bp, Mus musculus
gcggcttcggcaaggacttccgtaa

SEQ ID NO: 243963 - DNA, 25 bp, Mus musculus
cggattgccatccttttcgggaagg

SEQ ID NO: 243964 - DNA, 25 bp, Mus musculus
gacgatggataaaccctgcacgagg

SEQ ID NO: 243965 - DNA, 25 bp, Mus musculus
ccggaaaggggactgctcgtctcct

SEQ ID NO: 243966 - DNA, 25 bp, Mus musculus
ctgcacgaggcgttagacttttccc

SEQ ID NO: 243967 - DNA, 25 bp, Mus musculus
tccctcttctaagtagcaaagcaag

SEQ ID NO: 243968 - DNA, 25 bp, Mus musculus
gcaaagcaagaatggccgctccacc

SEQ ID NO: 243969 - DNA, 25 bp, Mus musculus
acttcagcatggctacgggcagagc

SEQ ID NO: 243970 - DNA, 25 bp, Mus musculus
cgatttcttgcagcgccgggttttt

SEQ ID NO: 243971 - DNA, 25 bp, Mus musculus
aggctcttgccaacttcgcgtctca

SEQ ID NO: 243972 - DNA, 25 bp, Mus musculus
tcgcgtctcattggtggcggaagaa

SEQ ID NO: 243973 - DNA, 25 bp, Mus musculus
gtgattgaacggagccctggtgaca

SEQ ID NO: 243974 - DNA, 25 bp, Mus musculus
cagtcggtgtgaccgcacgtctctt

SEQ ID NO: 243975 - DNA, 25 bp, Mus musculus
agagcgcgaagtagccgtcgcactg

SEQ ID NO: 243976 - DNA, 25 bp, Mus musculus
cccattgagcgatgtcgtggggatc

SEQ ID NO: 243977 - DNA, 25 bp, Mus musculus
ctatggcagcttcagtcgtggcgaa

SEQ ID NO: 243978 - DNA, 25 bp, Mus musculus
aagctcagtctctgtcctgctccga

SEQ ID NO: 243979 - DNA, 25 bp, Mus musculus
atgcctcgatatgcgcagctcgtca

SEQ ID NO: 243980 - DNA, 25 bp, Mus musculus
atctgtggttgcgattggctcctac

SEQ ID NO: 243981 - DNA, 25 bp, Mus musculus
acccgtgctgaacgagcgatctgtg

SEQ ID NO: 243982 - DNA, 25 bp, Mus musculus
cgctccgtagtctatggtgtagtaa

SEQ ID NO: 243983 - DNA, 25 bp, Mus musculus
cacgcgtttcggaaggcattttggc

SEQ ID NO: 243984 - DNA, 25 bp, Mus musculus
tctgcgcacgcgtgaacgaactcgt

SEQ ID NO: 243985 - DNA, 25 bp, Mus musculus
ttcgcgatccgctatcacctaggca

SEQ ID NO: 243986 - DNA, 25 bp, Mus musculus
gtgtcaaacccaagcaccggtgctg

SEQ ID NO: 243987 - DNA, 25 bp, Mus musculus
gcagaccttcggttgtcaccctatg

SEQ ID NO: 243988 - DNA, 25 bp, Mus musculus
gaccctcagaggacctgcagacctt

SEQ ID NO: 243989 - DNA, 25 bp, Mus musculus
acgcgtcagggcaaatccatccaca

SEQ ID NO: 243990 - DNA, 25 bp, Mus musculus
cctgggcatctctcgctgacaagga

SEQ ID NO: 243991 - DNA, 25 bp, Mus musculus
acccgagttcctggagctgtagacc

SEQ ID NO: 243992 - DNA, 25 bp, Mus musculus
cctggcgtcacttgcggtcagcgca

SEQ ID NO: 243993 - DNA, 25 bp, Mus musculus
agttcggcttctctggatcgaatcc

SEQ ID NO: 243994 - DNA, 25 bp, Mus musculus
ctctggatcgaatccggacaccgtc

SEQ ID NO: 243995 - DNA, 25 bp, Mus musculus
caagatgccggtaagcattcgagcc

SEQ ID NO: 243996 - DNA, 25 bp, Mus musculus
agagaggaagcgtccgccctgatct

SEQ ID NO: 243997 - DNA, 25 bp, Mus musculus
ggaaacgctttctgagttcggcttc

SEQ ID NO: 243998 - DNA, 25 bp, Mus musculus
ctcggtcgtcggaaacgctttctga

SEQ ID NO: 243999 - DNA, 25 bp, Mus musculus
cacccaggctcggtcgtcggaaacg

SEQ ID NO: 244000 - DNA, 25 bp, Mus musculus
caagtcaccggaagtgcgtttattc

SEQ ID NO: 244001 - DNA, 25 bp, Mus musculus
gtgctttatgcatgcgccacggtca

SEQ ID NO: 244002 - DNA, 25 bp, Mus musculus
tcacttgcggtcagcgcagccggag

SEQ ID NO: 244003 - DNA, 25 bp, Mus musculus
tatgcatgcgccacggtcatcgcct

SEQ ID NO: 244004 - DNA, 25 bp, Mus musculus
tcgaatccggacaccgtcaagatgc

SEQ ID NO: 244005 - DNA, 25 bp, Mus musculus
cgcagccggagcaagtcaccggaag

SEQ ID NO: 244006 - DNA, 25 bp, Mus musculus
tgtgcattgttactagcctccgcga

SEQ ID NO: 244007 - DNA, 25 bp, Mus musculus
tccgtggctacctccatcttcgggg

SEQ ID NO: 244008 - DNA, 25 bp, Mus musculus
cttgcgcgcctgattcgaaaattca

SEQ ID NO: 244009 - DNA, 25 bp, Mus musculus
tggctccttccagaacgacgaagtc

SEQ ID NO: 244010 - DNA, 25 bp, Mus musculus
cggcgccgtctccattttggaactt

SEQ ID NO: 244011 - DNA, 25 bp, Mus musculus
gggacccagtccaccgagtgtcagc

SEQ ID NO: 244012 - DNA, 25 bp, Mus musculus
ttctttttactcaggcacgtccgtg

SEQ ID NO: 244013 - DNA, 25 bp, Mus musculus
tggagaaaaccctttcgccgctgct

SEQ ID NO: 244014 - DNA, 25 bp, Mus musculus
tcctactgggatggctttgaagatg

SEQ ID NO: 244015 - DNA, 25 bp, Mus musculus
tttagcgcagcaaaactacgattcc

SEQ ID NO: 244016 - DNA, 25 bp, Mus musculus
aggcatccattcctctcaggctgtc

SEQ ID NO: 244017 - DNA, 25 bp, Mus musculus
cctccgctgtgtttaggatgaactc

SEQ ID NO: 244018 - DNA, 25 bp, Mus musculus
tcccgtagttggagaaagccagccc

SEQ ID NO: 244019 - DNA, 25 bp, Mus musculus
agcagcctgctgctcaccatgagta

SEQ ID NO: 244020 - DNA, 25 bp, Mus musculus
ctcgccttcgtgaagggcagaatga

SEQ ID NO: 244021 - DNA, 25 bp, Mus musculus
gaccactatctccagtcggttgccg

SEQ ID NO: 244022 - DNA, 25 bp, Mus musculus
caggtcggctggaccactatctcca

SEQ ID NO: 244023 - DNA, 25 bp, Mus musculus
cacgtcccgagtccgcttgggcgga

SEQ ID NO: 244024 - DNA, 25 bp, Mus musculus
actccaggcaatacggcagcggctc

SEQ ID NO: 244025 - DNA, 25 bp, Mus musculus
aggaccgcctactccaggcaatacg

SEQ ID NO: 244026 - DNA, 25 bp, Mus musculus
tagaagcagaggaccgcctactcca

SEQ ID NO: 244027 - DNA, 25 bp, Mus musculus
cgtgagctgcaagtacggtagaagc

SEQ ID NO: 244028 - DNA, 25 bp, Mus musculus
tctctcagggcatttggcgccgtga

SEQ ID NO: 244029 - DNA, 25 bp, Mus musculus
tcttaggtctctcagggcatttggc

SEQ ID NO: 244030 - DNA, 25 bp, Mus musculus
tctacgggtgagtcttaggtctctc

SEQ ID NO: 244031 - DNA, 25 bp, Mus musculus
ttgcaagctaatctacgggtgagtc

SEQ ID NO: 244032 - DNA, 25 bp, Mus musculus
ctggcccgccttgcaagctaatcta

SEQ ID NO: 244033 - DNA, 25 bp, Mus musculus
ggcagaatgaactggcccgccttgc

SEQ ID NO: 244034 - DNA, 25 bp, Mus musculus
acggctccgcggaggctgctctaat

SEQ ID NO: 244035 - DNA, 25 bp, Mus musculus
ccacggtctttgtgtgagcgttctc

SEQ ID NO: 244036 - DNA, 25 bp, Mus musculus
cccgccgcgagtgtgggtcgcttca

SEQ ID NO: 244037 - DNA, 25 bp, Mus musculus
gaccggggcgctgaatcacccgagc

SEQ ID NO: 244038 - DNA, 25 bp, Mus musculus
gcttccgcctgaccggggcgctgaa

SEQ ID NO: 244039 - DNA, 25 bp, Mus musculus
gtcagccatcttccttggcgctcgg

SEQ ID NO: 244040 - DNA, 25 bp, Mus musculus
tttgtgtgagcgttctccatggctg

SEQ ID NO: 244041 - DNA, 25 bp, Mus musculus
gcacctcctccacggtctttgtgtg

SEQ ID NO: 244042 - DNA, 25 bp, Mus musculus
ccgcggcatgtggacgccgctcatt

SEQ ID NO: 244043 - DNA, 25 bp, Mus musculus
gcttcttgacctgctccaagctcag

SEQ ID NO: 244044 - DNA, 25 bp, Mus musculus
tccttgagcttcttgacctgctcca

SEQ ID NO: 244045 - DNA, 25 bp, Mus musculus
gcggaggctgctctaatagcattta

SEQ ID NO: 244046 - DNA, 25 bp, Mus musculus
tctgcgtccacgctgtgctcgatgc

SEQ ID NO: 244047 - DNA, 25 bp, Mus musculus
aatagcatttatccgccgctgcctc

SEQ ID NO: 244048 - DNA, 25 bp, Mus musculus
agaccgctccttggcaacggttgcc

SEQ ID NO: 244049 - DNA, 25 bp, Mus musculus
cttgcgggttcttagagaccgctcc

SEQ ID NO: 244050 - DNA, 25 bp, Mus musculus
caggacgcgcgtggtatccggccca

SEQ ID NO: 244051 - DNA, 25 bp, Mus musculus
ttaaaaccaggacgcgcgtggtatc

SEQ ID NO: 244052 - DNA, 25 bp, Mus musculus
ggcaagaattaaaaccaggacgcgc

SEQ ID NO: 244053 - DNA, 25 bp, Mus musculus
actcacccactgcagcacccagggg

SEQ ID NO: 244054 - DNA, 25 bp, Mus musculus
ggccgagctaattcaccagcactca

SEQ ID NO: 244055 - DNA, 25 bp, Mus musculus
gcaaccggccgagctaattcaccag

SEQ ID NO: 244056 - DNA, 25 bp, Mus musculus
aaagcaattactctccctcttccag

SEQ ID NO: 244057 - DNA, 25 bp, Mus musculus
ttagcaaaagcaattactctccctc

SEQ ID NO: 244058 - DNA, 25 bp, Mus musculus
gggcgctgcgcgctaaaattagcaa

SEQ ID NO: 244059 - DNA, 25 bp, Mus musculus
tgacgtcacttcctctggctcgggg

SEQ ID NO: 244060 - DNA, 25 bp, Mus musculus
ttggcaacggttgccatgcggtgac

SEQ ID NO: 244061 - DNA, 25 bp, Mus musculus
ggttgccatgcggtgacgtcacttc

SEQ ID NO: 244062 - DNA, 25 bp, Mus musculus
gggctctctgcagcgatcaactcca

SEQ ID NO: 244063 - DNA, 25 bp, Mus musculus
ctacaaagtccaacaggctgcgctc

SEQ ID NO: 244064 - DNA, 25 bp, Mus musculus
tggcggaggacacgcggactacaaa

SEQ ID NO: 244065 - DNA, 25 bp, Mus musculus
tcgcggaggcaaaccttaaacttca

SEQ ID NO: 244066 - DNA, 25 bp, Mus musculus
aactcccaggaagcatcgcgtgtcg

SEQ ID NO: 244067 - DNA, 25 bp, Mus musculus
gcgatcaactccagggactcgtttc

SEQ ID NO: 244068 - DNA, 25 bp, Mus musculus
gccatagttcccaagaatgcctgtg

SEQ ID NO: 244069 - DNA, 25 bp, Mus musculus
tgtagtcccggggaagccatagttc

SEQ ID NO: 244070 - DNA, 25 bp, Mus musculus
cgcactggcatctgggacttgtagt

SEQ ID NO: 244071 - DNA, 25 bp, Mus musculus
tgctcaccacgcactggcatctggg

SEQ ID NO: 244072 - DNA, 25 bp, Mus musculus
gaggtggtactcacagctccagccc

SEQ ID NO: 244073 - DNA, 25 bp, Mus musculus
cgttgcagaggaggtggtactcaca

SEQ ID NO: 244074 - DNA, 25 bp, Mus musculus
tgcgggccctcggttctaagactcc

SEQ ID NO: 244075 - DNA, 25 bp, Mus musculus
ggactcgtttccatcgcggaggcaa

SEQ ID NO: 244076 - DNA, 25 bp, Mus musculus
catggcaggctgctgctccgtgctc

SEQ ID NO: 244077 - DNA, 25 bp, Mus musculus
cgggctttcctgttcgagtacgaca

SEQ ID NO: 244078 - DNA, 25 bp, Mus musculus
gcatcgtgctcatccgcagccgtaa

SEQ ID NO: 244079 - DNA, 25 bp, Mus musculus
atccgcagccgtaaagtggggctca

SEQ ID NO: 244080 - DNA, 25 bp, Mus musculus
gtaaagtggggctcatgaaccgcgt

SEQ ID NO: 244081 - DNA, 25 bp, Mus musculus
ctcatgaaccgcgtggtgcagctgc

SEQ ID NO: 244082 - DNA, 25 bp, Mus musculus
gtgcagctgctcatcctggcttacg

SEQ ID NO: 244083 - DNA, 25 bp, Mus musculus
tcctggcttacgtcattgggtgagc

SEQ ID NO: 244084 - DNA, 25 bp, Mus musculus
gggcaacccagactgtcgggacctg

SEQ ID NO: 244085 - DNA, 25 bp, Mus musculus
ccagactgtcgggacctggcagcgc

SEQ ID NO: 244086 - DNA, 25 bp, Mus musculus
ctctctgggtctggggcaatagctg

SEQ ID NO: 244087 - DNA, 25 bp, Mus musculus
ctggggcaatagctgagccggccaa

SEQ ID NO: 244088 - DNA, 25 bp, Mus musculus
cggagccatggcaggctgctgctcc

SEQ ID NO: 244089 - DNA, 25 bp, Mus musculus
tcgagtacgacacgccgcgcatcgt

SEQ ID NO: 244090 - DNA, 25 bp, Mus musculus
cgaacctgcaaaccggtaatggaga

SEQ ID NO: 244091 - DNA, 25 bp, Mus musculus
atgcagcgtccattcatgtccaggc

SEQ ID NO: 244092 - DNA, 25 bp, Mus musculus
cgtccattcatgtccaggctgttgc

SEQ ID NO: 244093 - DNA, 25 bp, Mus musculus
ctcctgcagggacatcttgcgacca

SEQ ID NO: 244094 - DNA, 25 bp, Mus musculus
cagggacatcttgcgaccagaaagc

SEQ ID NO: 244095 - DNA, 25 bp, Mus musculus
atcttgcgaccagaaagcggggacc

SEQ ID NO: 244096 - DNA, 25 bp, Mus musculus
cgggactcagggtccgaggcttcga

SEQ ID NO: 244097 - DNA, 25 bp, Mus musculus
cttcgagggggagttcctggccatc

SEQ ID NO: 244098 - DNA, 25 bp, Mus musculus
gcacgaacgaacctgcaaaccggta

SEQ ID NO: 244099 - DNA, 25 bp, Mus musculus
gatgggcagatgcagcgtccattca

SEQ ID NO: 244100 - DNA, 25 bp, Mus musculus
tggtgtgactctactgtgggccgcc

SEQ ID NO: 244101 - DNA, 25 bp, Mus musculus
tggagacgtggtgtgactctactgt

SEQ ID NO: 244102 - DNA, 25 bp, Mus musculus
ggcagatgcagcgtccattcatgtc

SEQ ID NO: 244103 - DNA, 25 bp, Mus musculus
cctgcaaaccggtaatggagacgtg

SEQ ID NO: 244104 - DNA, 25 bp, Mus musculus
gctcaggttccgcacctgtcaagcg

SEQ ID NO: 244105 - DNA, 25 bp, Mus musculus
tctggcggttccctccctggatttc

SEQ ID NO: 244106 - DNA, 25 bp, Mus musculus
ttgtccctgagcgtggagaagttcc

SEQ ID NO: 244107 - DNA, 25 bp, Mus musculus
acgccgctttgtccctgagcgtgga

SEQ ID NO: 244108 - DNA, 25 bp, Mus musculus
tgcgagatgctccacgccgctttgt

SEQ ID NO: 244109 - DNA, 25 bp, Mus musculus
gtctcggttcctgcgagatgctcca

SEQ ID NO: 244110 - DNA, 25 bp, Mus musculus
gtcccgcggagacttaagtagcggc

SEQ ID NO: 244111 - DNA, 25 bp, Mus musculus
tccttgctgattggccaaggacccg

SEQ ID NO: 244112 - DNA, 25 bp, Mus musculus
tccggttcggctctccacgggagga

SEQ ID NO: 244113 - DNA, 25 bp, Mus musculus
tctgggctgtgtctgccggctcccg

SEQ ID NO: 244114 - DNA, 25 bp, Mus musculus
gtgcggaactcctggccggctcctg

SEQ ID NO: 244115 - DNA, 25 bp, Mus musculus
cggcggaccttggtgcggaactcct

SEQ ID NO: 244116 - DNA, 25 bp, Mus musculus
tccgcacctgtcaagcgccaggggt

SEQ ID NO: 244117 - DNA, 25 bp, Mus musculus
ctaggccatcgctgggatccgggac

SEQ ID NO: 244118 - DNA, 25 bp, Mus musculus
cggcgatcttatagggcgtcaccca

SEQ ID NO: 244119 - DNA, 25 bp, Mus musculus
aagactgtttcccacagtagcgggg

SEQ ID NO: 244120 - DNA, 25 bp, Mus musculus
agctggttgagcttccgccgctcca

SEQ ID NO: 244121 - DNA, 25 bp, Mus musculus
cgcccaagactgtttcccacagtag

SEQ ID NO: 244122 - DNA, 25 bp, Mus musculus
gagccgcctttacgccatggctgca

SEQ ID NO: 244123 - DNA, 25 bp, Mus musculus
ggacgccggcaaggacaggccctct

SEQ ID NO: 244124 - DNA, 25 bp, Mus musculus
cctggctcttcgtggacgccggcaa

SEQ ID NO: 244125 - DNA, 25 bp, Mus musculus
ggctgaagtcctggctcttcgtgga

SEQ ID NO: 244126 - DNA, 25 bp, Mus musculus
gcgtcacccagtccttgatgccaaa

SEQ ID NO: 244127 - DNA, 25 bp, Mus musculus
caccaggacggcgatcttatagggc

SEQ ID NO: 244128 - DNA, 25 bp, Mus musculus
gcccatctcgttgagcagcaccagg

SEQ ID NO: 244129 - DNA, 25 bp, Mus musculus
cgttggtcatcatcgggctgaagtc

SEQ ID NO: 244130 - DNA, 25 bp, Mus musculus
gccaaacaagttggcgtgcactacc

SEQ ID NO: 244131 - DNA, 25 bp, Mus musculus
ccgtgcggcccatctcgttgagcag

SEQ ID NO: 244132 - DNA, 25 bp, Mus musculus
tttctctccgacagaccgggcgtca

SEQ ID NO: 244133 - DNA, 25 bp, Mus musculus
ggctagtggccctgcggtctcagcc

SEQ ID NO: 244134 - DNA, 25 bp, Mus musculus
gaggctgctatggtgctgagttccc

SEQ ID NO: 244135 - DNA, 25 bp, Mus musculus
cgtacgcccagagcgcttcctgttt

SEQ ID NO: 244136 - DNA, 25 bp, Mus musculus
ttcctgttttccgtctcagcggtta

SEQ ID NO: 244137 - DNA, 25 bp, Mus musculus
aggcgccgcattcgccgccttagaa

SEQ ID NO: 244138 - DNA, 25 bp, Mus musculus
gggcttcgtgagagaccaccacgta

SEQ ID NO: 244139 - DNA, 25 bp, Mus musculus
ttcgctcgcaagactgcgcccgaaa

SEQ ID NO: 244140 - DNA, 25 bp, Mus musculus
ctgtgctcttctcggggtcccgagc

SEQ ID NO: 244141 - DNA, 25 bp, Mus musculus
ccgccttagaaggaaggaagatccg

SEQ ID NO: 244142 - DNA, 25 bp, Mus musculus
cccttacgtagggacgctcagtggg

SEQ ID NO: 244143 - DNA, 25 bp, Mus musculus
cccgaagacccgcttcggattggtg

SEQ ID NO: 244144 - DNA, 25 bp, Mus musculus
ttcattggctttggtgatcgggccc

SEQ ID NO: 244145 - DNA, 25 bp, Mus musculus
tctcagcggttacccagaggggctt

SEQ ID NO: 244146 - DNA, 25 bp, Mus musculus
ctccatctggatgcacttgggtggg

SEQ ID NO: 244147 - DNA, 25 bp, Mus musculus
gatcacgtgacgctccatctggatg

SEQ ID NO: 244148 - DNA, 25 bp, Mus musculus
tgacgctccatctggatgcacttgg

SEQ ID NO: 244149 - DNA, 25 bp, Mus musculus
gctcgcagtggcttaagggcctctt

SEQ ID NO: 244150 - DNA, 25 bp, Mus musculus
ccgggacataacacgaggtggacta

SEQ ID NO: 244151 - DNA, 25 bp, Mus musculus
cttaagggcctcttgggctcgtcgt

SEQ ID NO: 244152 - DNA, 25 bp, Mus musculus
gtggccggatcacgtgacgctccat

SEQ ID NO: 244153 - DNA, 25 bp, Mus musculus
cgttgagccctttgctgaagcggtg

SEQ ID NO: 244154 - DNA, 25 bp, Mus musculus
gtgtgccgttgagccctttgctgaa

SEQ ID NO: 244155 - DNA, 25 bp, Mus musculus
agtgccgcagctcccgaggtgtgcc

SEQ ID NO: 244156 - DNA, 25 bp, Mus musculus
aggccaggtcccagcgagtgccgca

SEQ ID NO: 244157 - DNA, 25 bp, Mus musculus
gactacgcaggccaggtcccagcga

SEQ ID NO: 244158 - DNA, 25 bp, Mus musculus
taacacgaggtggactacgcaggcc

SEQ ID NO: 244159 - DNA, 25 bp, Mus musculus
gggcctcttgggctcgtcgttctcg

SEQ ID NO: 244160 - DNA, 25 bp, Mus musculus
ccgattcatagtcgtcgtcctcggc

SEQ ID NO: 244161 - DNA, 25 bp, Mus musculus
tcactcagcgcgtcaggcaggagct

SEQ ID NO: 244162 - DNA, 25 bp, Mus musculus
ctgcggccgccaaactttctcctcg

SEQ ID NO: 244163 - DNA, 25 bp, Mus musculus
cacattgtccgtggcgccgcagcgg

SEQ ID NO: 244164 - DNA, 25 bp, Mus musculus
cgggctccgattcatagtcgtcgtc

SEQ ID NO: 244165 - DNA, 25 bp, Mus musculus
gcgcggcgcccagacaaaagctcgg

SEQ ID NO: 244166 - DNA, 25 bp, Mus musculus
cgctcacggacatggccatggctca

SEQ ID NO: 244167 - DNA, 25 bp, Mus musculus
ccatggctcatggtgggcccagcct

SEQ ID NO: 244168 - DNA, 25 bp, Mus musculus
agcaggctcggctcaccctggctag

SEQ ID NO: 244169 - DNA, 25 bp, Mus musculus
atgcatatgcatgaggcgagccagg

SEQ ID NO: 244170 - DNA, 25 bp, Mus musculus
cgcgcgctgcgggatacatataggt

SEQ ID NO: 244171 - DNA, 25 bp, Mus musculus
cccttcctgtctcggctacccacgg

SEQ ID NO: 244172 - DNA, 25 bp, Mus musculus
gcgatcgccaggttccggatggccc

SEQ ID NO: 244173 - DNA, 25 bp, Mus musculus
gacctggtcgggctccgattcatag

SEQ ID NO: 244174 - DNA, 25 bp, Mus musculus
cgcggcgttgccagcatctgctgac

SEQ ID NO: 244175 - DNA, 25 bp, Mus musculus
gacctggtggaggtgttaaatgaaa

SEQ ID NO: 244176 - DNA, 25 bp, Mus musculus
cggccgaacgatgtgcgagaactgc

SEQ ID NO: 244177 - DNA, 25 bp, Mus musculus
tcagtcagcgcgatcctaagcgggg

SEQ ID NO: 244178 - DNA, 25 bp, Mus musculus
gtcgggatcagtcagcgcgatccta

SEQ ID NO: 244179 - DNA, 25 bp, Mus musculus
ggtggtgaagtgactctgctgcttc

SEQ ID NO: 244180 - DNA, 25 bp, Mus musculus
agcgctccattaaaatggcggcggc

SEQ ID NO: 244181 - DNA, 25 bp, Mus musculus
gcagcccgagcgctccattaaaatg

SEQ ID NO: 244182 - DNA, 25 bp, Mus musculus
cggctccttcgcctgggcggaaaga

SEQ ID NO: 244183 - DNA, 25 bp, Mus musculus
aatgagtgcgcgaggcgcctctctt

SEQ ID NO: 244184 - DNA, 25 bp, Mus musculus
ttccggccgctgacagagatccggc

SEQ ID NO: 244185 - DNA, 25 bp, Mus musculus
caccctcaaagtacccgaaggacag

SEQ ID NO: 244186 - DNA, 25 bp, Mus musculus
gaggtgttaaatgaaagtaagtcgc

SEQ ID NO: 244187 - DNA, 25 bp, Mus musculus
gttgccagcatctgctgacccgcgg

SEQ ID NO: 244188 - DNA, 25 bp, Mus musculus
ctgtagcgcaggagctcagtccttt

SEQ ID NO: 244189 - DNA, 25 bp, Mus musculus
gctctcggcttggtgccacagccag

SEQ ID NO: 244190 - DNA, 25 bp, Mus musculus
agctagccaggcttccgcaacggca

SEQ ID NO: 244191 - DNA, 25 bp, Mus musculus
aggcttccgcaacggcaaggctgga

SEQ ID NO: 244192 - DNA, 25 bp, Mus musculus
ccgcaacggcaaggctggacagcga

SEQ ID NO: 244193 - DNA, 25 bp, Mus musculus
tggacagcgaggcacgcgacatccc

SEQ ID NO: 244194 - DNA, 25 bp, Mus musculus
cccacgctaggtggcttctgtgcac

SEQ ID NO: 244195 - DNA, 25 bp, Mus musculus
cacgctaggtggcttctgtgcaccc

SEQ ID NO: 244196 - DNA, 25 bp, Mus musculus
gtggcttctgtgcaccccgcaagtt

SEQ ID NO: 244197 - DNA, 25 bp, Mus musculus
cccgcaagttcgcagctgaaattgc

SEQ ID NO: 244198 - DNA, 25 bp, Mus musculus
cggaaaatctgtagcgcaggagctc

SEQ ID NO: 244199 - DNA, 25 bp, Mus musculus
gagctcagtcctttcagcggttgga

SEQ ID NO: 244200 - DNA, 25 bp, Mus musculus
tcagtcctttcagcggttggaggcc

SEQ ID NO: 244201 - DNA, 25 bp, Mus musculus
cgcagctgaaattgcggaaaatctg

SEQ ID NO: 244202 - DNA, 25 bp, Mus musculus
cgcggaggccgccagggaggtggag

SEQ ID NO: 244203 - DNA, 25 bp, Mus musculus
ctgaacagccgtgcggcgcggaggc

SEQ ID NO: 244204 - DNA, 25 bp, Mus musculus
aaactgaacagccgtgcggcgcgga

SEQ ID NO: 244205 - DNA, 25 bp, Mus musculus
tgaaactgaacagccgtgcggcgcg

SEQ ID NO: 244206 - DNA, 25 bp, Mus musculus
ctgaaactgaacagccgtgcggcgc

SEQ ID NO: 244207 - DNA, 25 bp, Mus musculus
gctgaaactgaacagccgtgcggcg

SEQ ID NO: 244208 - DNA, 25 bp, Mus musculus
cgctgaaactgaacagccgtgcggc

SEQ ID NO: 244209 - DNA, 25 bp, Mus musculus
acgctgaaactgaacagccgtgcgg

SEQ ID NO: 244210 - DNA, 25 bp, Mus musculus
cacgctgaaactgaacagccgtgcg

SEQ ID NO: 244211 - DNA, 25 bp, Mus musculus
ccacgctgaaactgaacagccgtgc

SEQ ID NO: 244212 - DNA, 25 bp, Mus musculus
cccacgctgaaactgaacagccgtg

SEQ ID NO: 244213 - DNA, 25 bp, Mus musculus
tgtgcacatccccacgctgaaactg

SEQ ID NO: 244214 - DNA, 25 bp, Mus musculus
gccttccttcctcggggagacaggc

SEQ ID NO: 244215 - DNA, 25 bp, Mus musculus
aggccggcggcgacagagaagagct

SEQ ID NO: 244216 - DNA, 25 bp, Mus musculus
tttcgtcaccggatcccctggaatg

SEQ ID NO: 244217 - DNA, 25 bp, Mus musculus
cgcgggcgcgaaatacgaacccagc

SEQ ID NO: 244218 - DNA, 25 bp, Mus musculus
cgggcgcgaaatacgaacccagcca

SEQ ID NO: 244219 - DNA, 25 bp, Mus musculus
ggcgcgaaatacgaacccagccaca

SEQ ID NO: 244220 - DNA, 25 bp, Mus musculus
gcgcgaaatacgaacccagccacag

SEQ ID NO: 244221 - DNA, 25 bp, Mus musculus
cgcgaaatacgaacccagccacagg

SEQ ID NO: 244222 - DNA, 25 bp, Mus musculus
gcgaaatacgaacccagccacaggc

SEQ ID NO: 244223 - DNA, 25 bp, Mus musculus
gaaatacgaacccagccacaggcag

SEQ ID NO: 244224 - DNA, 25 bp, Mus musculus
aatacgaacccagccacaggcagct

SEQ ID NO: 244225 - DNA, 25 bp, Mus musculus
gaacccagccacaggcagctccctc

SEQ ID NO: 244226 - DNA, 25 bp, Mus musculus
gcgcgctggccctctgcagagtgaa

SEQ ID NO: 244227 - DNA, 25 bp, Mus musculus
cgcgctggccctctgcagagtgaag

SEQ ID NO: 244228 - DNA, 25 bp, Mus musculus
ctgcagagtgaagccaggagagggg

SEQ ID NO: 244229 - DNA, 25 bp, Mus musculus
gacgcgggcgcgaaatacgaaccca

SEQ ID NO: 244230 - DNA, 25 bp, Mus musculus
gctgaagccacggacgctgacaatt

SEQ ID NO: 244231 - DNA, 25 bp, Mus musculus
atctctggcggtcaatcgcacgctg

SEQ ID NO: 244232 - DNA, 25 bp, Mus musculus
ctcgtcgtatctctggcggtcaatc

SEQ ID NO: 244233 - DNA, 25 bp, Mus musculus
cttcgttctcgtcgtatctctggcg

SEQ ID NO: 244234 - DNA, 25 bp, Mus musculus
cgtccgacaagtcttcgttctcgtc

SEQ ID NO: 244235 - DNA, 25 bp, Mus musculus
tccacgtccgacaagtcttcgttct

SEQ ID NO: 244236 - DNA, 25 bp, Mus musculus
agccacggacgctgacaatttcctc

SEQ ID NO: 244237 - DNA, 25 bp, Mus musculus
ctccaggctgaagccacggacgctg

SEQ ID NO: 244238 - DNA, 25 bp, Mus musculus
ctggctacgtagcttctcctccagg

SEQ ID NO: 244239 - DNA, 25 bp, Mus musculus
ccctggtataactggctacgtagct

SEQ ID NO: 244240 - DNA, 25 bp, Mus musculus
catagcatgcacgaagtccccctgg

SEQ ID NO: 244241 - DNA, 25 bp, Mus musculus
tgccttccatagcatgcacgaagtc

SEQ ID NO: 244242 - DNA, 25 bp, Mus musculus
acctttgccttccatagcatgcacg

SEQ ID NO: 244243 - DNA, 25 bp, Mus musculus
ggacgctgacaatttcctccacgtc

SEQ ID NO: 244244 - DNA, 25 bp, Mus musculus
ttacctaaagccaaggtgccgcgcc

SEQ ID NO: 244245 - DNA, 25 bp, Mus musculus
cgaaatctagagctagcgggtaagc

SEQ ID NO: 244246 - DNA, 25 bp, Mus musculus
tgagggttccagacgaccctgtgcc

SEQ ID NO: 244247 - DNA, 25 bp, Mus musculus
ccactcccgtgagggttccagacga

SEQ ID NO: 244248 - DNA, 25 bp, Mus musculus
tttgtgggttgcctgggaccgcaac

SEQ ID NO: 244249 - DNA, 25 bp, Mus musculus
ggagctactgccttcagctcgctct

SEQ ID NO: 244250 - DNA, 25 bp, Mus musculus
cccgggacacgaaatctagagctag

SEQ ID NO: 244251 - DNA, 25 bp, Mus musculus
ccctgtcaccaggagcgggtagtct

SEQ ID NO: 244252 - DNA, 25 bp, Mus musculus
ccagaaactcgccactttgtgggtt

SEQ ID NO: 244253 - DNA, 25 bp, Mus musculus
gcctcttaagagttacctaaagcca

SEQ ID NO: 244254 - DNA, 25 bp, Mus musculus
tccgtggtccgcctcttaagagtta

SEQ ID NO: 244255 - DNA, 25 bp, Mus musculus
aagcgagattccgtggtccgcctct

SEQ ID NO: 244256 - DNA, 25 bp, Mus musculus
tgggaccgcaactcctcggatctcg

SEQ ID NO: 244257 - DNA, 25 bp, Mus musculus
tagtctcagggagctactgccttca

SEQ ID NO: 244258 - DNA, 25 bp, Mus musculus
gccgaccgaccgctagtgcaagaag

SEQ ID NO: 244259 - DNA, 25 bp, Mus musculus
ccgagctacagaaaagctggaaagc

SEQ ID NO: 244260 - DNA, 25 bp, Mus musculus
aaagctggaaagctgaaacggaagg

SEQ ID NO: 244261 - DNA, 25 bp, Mus musculus
cgaccgaccgctagtgcaagaagag

SEQ ID NO: 244262 - DNA, 25 bp, Mus musculus
ccgaccgctagtgcaagaagaggag

SEQ ID NO: 244263 - DNA, 25 bp, Mus musculus
cccaccacaaagcttctatcagaga

SEQ ID NO: 244264 - DNA, 25 bp, Mus musculus
accacaaagcttctatcagagaccc

SEQ ID NO: 244265 - DNA, 25 bp, Mus musculus
tatcagagaccccaaaacgcaccag

SEQ ID NO: 244266 - DNA, 25 bp, Mus musculus
aacgcaccagcagctgcctcatctc

SEQ ID NO: 244267 - DNA, 25 bp, Mus musculus
gcgcgcacactcacttcctaaggag

SEQ ID NO: 244268 - DNA, 25 bp, Mus musculus
cgcgcacactcacttcctaaggaga

SEQ ID NO: 244269 - DNA, 25 bp, Mus musculus
gcacactcacttcctaaggagactc

SEQ ID NO: 244270 - DNA, 25 bp, Mus musculus
gctacagaaaagctggaaagctgaa

SEQ ID NO: 244271 - DNA, 25 bp, Mus musculus
agcccaccacaaagcttctatcaga

SEQ ID NO: 244272 - DNA, 25 bp, Mus musculus
cggaacgtaaacattgttgccgatc

SEQ ID NO: 244273 - DNA, 25 bp, Mus musculus
acgagtgcgcctctgcacgcaggcg

SEQ ID NO: 244274 - DNA, 25 bp, Mus musculus
ttgggtcacgagtgcgcctctgcac

SEQ ID NO: 244275 - DNA, 25 bp, Mus musculus
ctgttttgttgttgggtcacgagtg

SEQ ID NO: 244276 - DNA, 25 bp, Mus musculus
catcgctgttttgttgttgggtcac

SEQ ID NO: 244277 - DNA, 25 bp, Mus musculus
gccttggcatcgctgttttgttgtt

SEQ ID NO: 244278 - DNA, 25 bp, Mus musculus
ttagcgccttggcatcgctgttttg

SEQ ID NO: 244279 - DNA, 25 bp, Mus musculus
acgcaccgggcgctgttagcgcctt

SEQ ID NO: 244280 - DNA, 25 bp, Mus musculus
ccagaagggagcctgggacgcaccg

SEQ ID NO: 244281 - DNA, 25 bp, Mus musculus
cttgcggctaggctagttggggaaa

SEQ ID NO: 244282 - DNA, 25 bp, Mus musculus
cgatcgcgctcggagcttgcggcta

SEQ ID NO: 244283 - DNA, 25 bp, Mus musculus
cattgttgccgatcgcgctcggagc

SEQ ID NO: 244284 - DNA, 25 bp, Mus musculus
gtaaacattgttgccgatcgcgctc

SEQ ID NO: 244285 - DNA, 25 bp, Mus musculus
ctgacttttggagggctgagttgca

SEQ ID NO: 244286 - DNA, 25 bp, Mus musculus
cagagttactccgaggtgatgagcc

SEQ ID NO: 244287 - DNA, 25 bp, Mus musculus
acccggactggatcggccagagtta

SEQ ID NO: 244288 - DNA, 25 bp, Mus musculus
cacgcgcaggtgtttttagacgggc

SEQ ID NO: 244289 - DNA, 25 bp, Mus musculus
agagatagagatacccacgcgcagg

SEQ ID NO: 244290 - DNA, 25 bp, Mus musculus
taagccgcgccaagctcaaagcttc

SEQ ID NO: 244291 - DNA, 25 bp, Mus musculus
ctgtcctggcgcaagctctacttaa

SEQ ID NO: 244292 - DNA, 25 bp, Mus musculus
gagcactcgatgcaggcgctgtcct

SEQ ID NO: 244293 - DNA, 25 bp, Mus musculus
ccgagtcacagcaatccggagcttc

SEQ ID NO: 244294 - DNA, 25 bp, Mus musculus
tcgcagcgtactccatgcatccgga

SEQ ID NO: 244295 - DNA, 25 bp, Mus musculus
gttctgcagccagtgcctcggcctt

SEQ ID NO: 244296 - DNA, 25 bp, Mus musculus
ttggaacttgcggagcggttctgca

SEQ ID NO: 244297 - DNA, 25 bp, Mus musculus
tggcgtatgcaaataacctcgggtc

SEQ ID NO: 244298 - DNA, 25 bp, Mus musculus
gtgatgagcctcaacgagcactcga

SEQ ID NO: 244299 - DNA, 25 bp, Mus musculus
gggtacgtcactcgcacggacaccg

SEQ ID NO: 244300 - DNA, 25 bp, Mus musculus
ggtcaagttcttacctctcaagagg

SEQ ID NO: 244301 - DNA, 25 bp, Mus musculus
tgtgagcaacgtccacaacctcaac

SEQ ID NO: 244302 - DNA, 25 bp, Mus musculus
acaacctcaactcggtcaaagagtc

SEQ ID NO: 244303 - DNA, 25 bp, Mus musculus
acgagcgcatgcatcgccacatcga

SEQ ID NO: 244304 - DNA, 25 bp, Mus musculus
gccacatcgagctggcctgggcctt

SEQ ID NO: 244305 - DNA, 25 bp, Mus musculus
gggccttctccacggtcatcgggac

SEQ ID NO: 244306 - DNA, 25 bp, Mus musculus
tcatcgggacgctgcttttcctagc

SEQ ID NO: 244307 - DNA, 25 bp, Mus musculus
acgctgcttttcctagcagaggtcg

SEQ ID NO: 244308 - DNA, 25 bp, Mus musculus
cgaggctgtgagcaacgtccacaac

SEQ ID NO: 244309 - DNA, 25 bp, Mus musculus
ctgctctgctgggtcaagttcttac

SEQ ID NO: 244310 - DNA, 25 bp, Mus musculus
cctctcaagaggcaagcgggacagc

SEQ ID NO: 244311 - DNA, 25 bp, Mus musculus
aagcctcccgctgaatcagtcatcg

SEQ ID NO: 244312 - DNA, 25 bp, Mus musculus
aatcagtcatcgtcgccaaccacag

SEQ ID NO: 244313 - DNA, 25 bp, Mus musculus
tcctagcagaggtcgtgctgctctg

SEQ ID NO: 244314 - DNA, 25 bp, Mus musculus
tagggttcgtgactcctccagtgcc

SEQ ID NO: 244315 - DNA, 25 bp, Mus musculus
cgcttccacgcggaaccgacggagg

SEQ ID NO: 244316 - DNA, 25 bp, Mus musculus
tgggaatcgcgcttccacgcggaac

SEQ ID NO: 244317 - DNA, 25 bp, Mus musculus
ctgggtactcttcgcggaagtgagt

SEQ ID NO: 244318 - DNA, 25 bp, Mus musculus
acacgcgtctgggaggtctctgaaa

SEQ ID NO: 244319 - DNA, 25 bp, Mus musculus
tgctcccgcggaattacccgtccta

SEQ ID NO: 244320 - DNA, 25 bp, Mus musculus
agccagtcgcgggagttctcgagac

SEQ ID NO: 244321 - DNA, 25 bp, Mus musculus
cgatcttcctgcacgcagtgcgcgt

SEQ ID NO: 244322 - DNA, 25 bp, Mus musculus
acacgcgatcttcctgcacgcagtg

SEQ ID NO: 244323 - DNA, 25 bp, Mus musculus
ttaggctcgcttcacacacgcgatc

SEQ ID NO: 244324 - DNA, 25 bp, Mus musculus
tccagtgccgcccttcctagtcacg

SEQ ID NO: 244325 - DNA, 25 bp, Mus musculus
tgcgcaatcaccaacacgcgtctgg

SEQ ID NO: 244326 - DNA, 25 bp, Mus musculus
atgcgcatgcgttaggctcgcttca

SEQ ID NO: 244327 - DNA, 25 bp, Mus musculus
gggagttctcgagacctacctgctc

SEQ ID NO: 244328 - DNA, 25 bp, Mus musculus
gtcacgctgcgggtttcgtcgccgc

SEQ ID NO: 244329 - DNA, 25 bp, Mus musculus
gccgccttgcaccattgcaccatgt

SEQ ID NO: 244330 - DNA, 25 bp, Mus musculus
accatgtccggccagctggagcgtt

SEQ ID NO: 244331 - DNA, 25 bp, Mus musculus
aatttcaggagctgcaggtaggacc

SEQ ID NO: 244332 - DNA, 25 bp, Mus musculus
agctgcaggtaggaccgggccacct

SEQ ID NO: 244333 - DNA, 25 bp, Mus musculus
ggtcccgccactcttgctacctgcg

SEQ ID NO: 244334 - DNA, 25 bp, Mus musculus
gctacctgcggtgcttgtgccttcc

SEQ ID NO: 244335 - DNA, 25 bp, Mus musculus
ggtgcttgtgccttccctatctagc

SEQ ID NO: 244336 - DNA, 25 bp, Mus musculus
cctatctagccatcccagcccggag

SEQ ID NO: 244337 - DNA, 25 bp, Mus musculus
ccttcctatgtagcagcgctttggc

SEQ ID NO: 244338 - DNA, 25 bp, Mus musculus
ttggctcctcagtctcttggggcgc

SEQ ID NO: 244339 - DNA, 25 bp, Mus musculus
acgctctcccttcgctacagaaagt

SEQ ID NO: 244340 - DNA, 25 bp, Mus musculus
gctacagaaagttcgtctctggccc

SEQ ID NO: 244341 - DNA, 25 bp, Mus musculus
cccttcgctacagaaagttcgtctc

SEQ ID NO: 244342 - DNA, 25 bp, Mus musculus
gaccctcagctccatggcagcggtg

SEQ ID NO: 244343 - DNA, 25 bp, Mus musculus
ccgggcctcaccgagatagatgtct

SEQ ID NO: 244344 - DNA, 25 bp, Mus musculus
cgagatagatgtctccgaaggagcc

SEQ ID NO: 244345 - DNA, 25 bp, Mus musculus
atgtctccgaaggagccgctgccga

SEQ ID NO: 244346 - DNA, 25 bp, Mus musculus
gctgccgatcttgcggcccagtcgg

SEQ ID NO: 244347 - DNA, 25 bp, Mus musculus
ttgcggcccagtcggtacctgttcc

SEQ ID NO: 244348 - DNA, 25 bp, Mus musculus
cgctttcaccatcgctttccggtcg

SEQ ID NO: 244349 - DNA, 25 bp, Mus musculus
gactcggatcttccgggcctaaatc

SEQ ID NO: 244350 - DNA, 25 bp, Mus musculus
ttcagctgcctaaaggagccgccgc

SEQ ID NO: 244351 - DNA, 25 bp, Mus musculus
ccgccatcgcgctgtgacgtcactt

SEQ ID NO: 244352 - DNA, 25 bp, Mus musculus
gcttggctacttgatggattgcgca

SEQ ID NO: 244353 - DNA, 25 bp, Mus musculus
ggctacttgatggattgcgcagtcg

SEQ ID NO: 244354 - DNA, 25 bp, Mus musculus
ggggatgccgaacgtccactccggc

SEQ ID NO: 244355 - DNA, 25 bp, Mus musculus
tcagcgcctcaatacggggcggatg

SEQ ID NO: 244356 - DNA, 25 bp, Mus musculus
tacgaggctccacccacgggcagct

SEQ ID NO: 244357 - DNA, 25 bp, Mus musculus
agctccttcctcgccgagctggggg

SEQ ID NO: 244358 - DNA, 25 bp, Mus musculus
cgtcacctacgatcactatcttcag

SEQ ID NO: 244359 - DNA, 25 bp, Mus musculus
gtcacctacgatcactatcttcagc

SEQ ID NO: 244360 - DNA, 25 bp, Mus musculus
tacgatcactatcttcagctccttc

SEQ ID NO: 244361 - DNA, 25 bp, Mus musculus
cgatcactatcttcagctccttcct

SEQ ID NO: 244362 - DNA, 25 bp, Mus musculus
agcacccggggcgtccatagcccgg

SEQ ID NO: 244363 - DNA, 25 bp, Mus musculus
gggcgtccatagcccggagcccgca

SEQ ID NO: 244364 - DNA, 25 bp, Mus musculus
cgctggatgctgcgcgctggctaga

SEQ ID NO: 244365 - DNA, 25 bp, Mus musculus
gagcccagtagagcgacagggcagg

SEQ ID NO: 244366 - DNA, 25 bp, Mus musculus
acagggcagggctacgaggctccac

SEQ ID NO: 244367 - DNA, 25 bp, Mus musculus
cgcagccgccgtcacctacgatcac

SEQ ID NO: 244368 - DNA, 25 bp, Mus musculus
aggctccacccacgggcagctggcg

SEQ ID NO: 244369 - DNA, 25 bp, Mus musculus
tacagggcagggctacgaggctcca

SEQ ID NO: 244370 - DNA, 25 bp, Mus musculus
cccacgctccgtgggtgaccaggag

SEQ ID NO: 244371 - DNA, 25 bp, Mus musculus
cgacccacctcggttgcagagagtc

SEQ ID NO: 244372 - DNA, 25 bp, Mus musculus
cggaacaatccgagaaaacactggg

SEQ ID NO: 244373 - DNA, 25 bp, Mus musculus
ccacctcggttgcagagagtctaaa

SEQ ID NO: 244374 - DNA, 25 bp, Mus musculus
tggccctctctctgcaggccagagc

SEQ ID NO: 244375 - DNA, 25 bp, Mus musculus
aagccttctgctggcgtggccctct

SEQ ID NO: 244376 - DNA, 25 bp, Mus musculus
ttcaggcaagccttctgctggcgtg

SEQ ID NO: 244377 - DNA, 25 bp, Mus musculus
gagtacagccacctcccagttcagg

SEQ ID NO: 244378 - DNA, 25 bp, Mus musculus
tctcgtgtagtaaatcgagtacagc

SEQ ID NO: 244379 - DNA, 25 bp, Mus musculus
ggggacactggaatctcgtgtagta

SEQ ID NO: 244380 - DNA, 25 bp, Mus musculus
tattccaaacttgggctcggggcca

SEQ ID NO: 244381 - DNA, 25 bp, Mus musculus
aggtcatattccaaacttgggctcg

SEQ ID NO: 244382 - DNA, 25 bp, Mus musculus
cagagagtctaaaaaggtcatattc

SEQ ID NO: 244383 - DNA, 25 bp, Mus musculus
tcccagttcaggcaagccttctgct

SEQ ID NO: 244384 - DNA, 25 bp, Mus musculus
tctctttggaagagcaggcgagccc

SEQ ID NO: 244385 - DNA, 25 bp, Mus musculus
gatgccaacatggacgccggccttt

SEQ ID NO: 244386 - DNA, 25 bp, Mus musculus
gagatgctgcgtcatgatgccaaca

SEQ ID NO: 244387 - DNA, 25 bp, Mus musculus
cccggaggacaagcagcgccaggct

SEQ ID NO: 244388 - DNA, 25 bp, Mus musculus
taaaactcgtgtttgagagggagga

SEQ ID NO: 244389 - DNA, 25 bp, Mus musculus
aaagccggccgccattagccagaga

SEQ ID NO: 244390 - DNA, 25 bp, Mus musculus
gcgacaaccagggaaaagcaggatg

SEQ ID NO: 244391 - DNA, 25 bp, Mus musculus
cgagacccgtcaccaggatcgcggg

SEQ ID NO: 244392 - DNA, 25 bp, Mus musculus
tgccacggagatcggggtccctcac

SEQ ID NO: 244393 - DNA, 25 bp, Mus musculus
aagccagagcgaggcctcgtgcccg

SEQ ID NO: 244394 - DNA, 25 bp, Mus musculus
aacggcaggcagtgcaagccagagc

SEQ ID NO: 244395 - DNA, 25 bp, Mus musculus
cgccattagccagagagcagtattg

SEQ ID NO: 244396 - DNA, 25 bp, Mus musculus
agcagtattgaatggcccggcggct

SEQ ID NO: 244397 - DNA, 25 bp, Mus musculus
cctcggctcggctcaaaaacctgaa

SEQ ID NO: 244398 - DNA, 25 bp, Mus musculus
cccaatatgaaatacaccaccacga

SEQ ID NO: 244399 - DNA, 25 bp, Mus musculus
aaaatggaagccgagcgctgattgg

SEQ ID NO: 244400 - DNA, 25 bp, Mus musculus
ctcacaaaatggaagccgagcgctg

SEQ ID NO: 244401 - DNA, 25 bp, Mus musculus
cgagttgaactcacaaaatggaagc

SEQ ID NO: 244402 - DNA, 25 bp, Mus musculus
gcctacgagttgaactcacaaaatg

SEQ ID NO: 244403 - DNA, 25 bp, Mus musculus
cggggaagcctacgagttgaactca

SEQ ID NO: 244404 - DNA, 25 bp, Mus musculus
gatccacgcgaaaagccggggaagc

SEQ ID NO: 244405 - DNA, 25 bp, Mus musculus
ccagatccacgcgaaaagccgggga

SEQ ID NO: 244406 - DNA, 25 bp, Mus musculus
gtctgcaaccagatccacgcgaaaa

SEQ ID NO: 244407 - DNA, 25 bp, Mus musculus
gagggcgtctgcaaccagatccacg

SEQ ID NO: 244408 - DNA, 25 bp, Mus musculus
gaccgagggcgtctgcaaccagatc

SEQ ID NO: 244409 - DNA, 25 bp, Mus musculus
tcggcagcccgagaagagagaccga

SEQ ID NO: 244410 - DNA, 25 bp, Mus musculus
gcttcgcctcggcagcccgagaaga

SEQ ID NO: 244411 - DNA, 25 bp, Mus musculus
tatgaaatacaccaccacgaagccc

SEQ ID NO: 244412 - DNA, 25 bp, Mus musculus
ggtggccacggagctctgtccgcct

SEQ ID NO: 244413 - DNA, 25 bp, Mus musculus
tttccactgcggctccttgttgtga

SEQ ID NO: 244414 - DNA, 25 bp, Mus musculus
cactgcggctccttgttgtgaggcc

SEQ ID NO: 244415 - DNA, 25 bp, Mus musculus
ccgcggtcgctttggaattggaaat

SEQ ID NO: 244416 - DNA, 25 bp, Mus musculus
tttggaattggaaatgcagcgcggc

SEQ ID NO: 244417 - DNA, 25 bp, Mus musculus
aattggaaatgcagcgcggcgtgtt

SEQ ID NO: 244418 - DNA, 25 bp, Mus musculus
atgcagcgcggcgtgttccgagcac

SEQ ID NO: 244419 - DNA, 25 bp, Mus musculus
ggtcaagccgggcgcgcacaagcac

SEQ ID NO: 244420 - DNA, 25 bp, Mus musculus
cgccgtgtgtttacgtggagacgaa

SEQ ID NO: 244421 - DNA, 25 bp, Mus musculus
tgtccgcctctttctaaacagatct

SEQ ID NO: 244422 - DNA, 25 bp, Mus musculus
aaacagatctttcctctccactgcg

SEQ ID NO: 244423 - DNA, 25 bp, Mus musculus
agcctaccctgcagacgccatggag

SEQ ID NO: 244424 - DNA, 25 bp, Mus musculus
aaaggaagctggcagccggcaaggc

SEQ ID NO: 244425 - DNA, 25 bp, Mus musculus
gcacaagcacctgccgggccacgct

SEQ ID NO: 244426 - DNA, 25 bp, Mus musculus
ccgagtgagctatctgccaaggcgc

SEQ ID NO: 244427 - DNA, 25 bp, Mus musculus
tgagctatctgccaaggcgcggagc

SEQ ID NO: 244428 - DNA, 25 bp, Mus musculus
ccgagcccgagtgagctatctgcca

SEQ ID NO: 244429 - DNA, 25 bp, Mus musculus
aaggcgcggagctgatgctgtccgc

SEQ ID NO: 244430 - DNA, 25 bp, Mus musculus
gtggtcaccaccactaacaccagct

SEQ ID NO: 244431 - DNA, 25 bp, Mus musculus
cctcaggcgccaccctacatgactc

SEQ ID NO: 244432 - DNA, 25 bp, Mus musculus
tctctcagctggtcttggggcccgg

SEQ ID NO: 244433 - DNA, 25 bp, Mus musculus
catcagcgggccaccgagtccgcca

SEQ ID NO: 244434 - DNA, 25 bp, Mus musculus
caatcgcagtccagcgccagggcgg

SEQ ID NO: 244435 - DNA, 25 bp, Mus musculus
ggagacgtggctcccagcaggcgct

SEQ ID NO: 244436 - DNA, 25 bp, Mus musculus
cgcttccgggaaatgcgcacgtcgc

SEQ ID NO: 244437 - DNA, 25 bp, Mus musculus
agagcttgcgctgaaaggtgccggg

SEQ ID NO: 244438 - DNA, 25 bp, Mus musculus
cgcgtaggtcactctctcagctggt

SEQ ID NO: 244439 - DNA, 25 bp, Mus musculus
caagaggcgagcagcccgtggtcac

SEQ ID NO: 244440 - DNA, 25 bp, Mus musculus
gaaagagctatcttccccgtccagg

SEQ ID NO: 244441 - DNA, 25 bp, Mus musculus
tacctcgattgcaaactcgtttggg

SEQ ID NO: 244442 - DNA, 25 bp, Mus musculus
tcggagatacctcgattgcaaactc

SEQ ID NO: 244443 - DNA, 25 bp, Mus musculus
cgggatcggagatacctcgattgca

SEQ ID NO: 244444 - DNA, 25 bp, Mus musculus
agcgggatcggagatacctcgattg

SEQ ID NO: 244445 - DNA, 25 bp, Mus musculus
aggctagtgtggttccaaaccttgg

SEQ ID NO: 244446 - DNA, 25 bp, Mus musculus
gtgaaggctagtgtggttccaaacc

SEQ ID NO: 244447 - DNA, 25 bp, Mus musculus
gaatgtgaaggctagtgtggttcca

SEQ ID NO: 244448 - DNA, 25 bp, Mus musculus
gttgtatcctcccaggaatgtgaag

SEQ ID NO: 244449 - DNA, 25 bp, Mus musculus
cgattgcaaactcgtttggggtcga

SEQ ID NO: 244450 - DNA, 25 bp, Mus musculus
gggttgtatcctcccaggaatgtga

SEQ ID NO: 244451 - DNA, 25 bp, Mus musculus
cgagggttgtatcctcccaggaatg

SEQ ID NO: 244452 - DNA, 25 bp, Mus musculus
tccaggcgagggttgtatcctccca

SEQ ID NO: 244453 - DNA, 25 bp, Mus musculus
cccgtccaggcgagggttgtatcct

SEQ ID NO: 244454 - DNA, 25 bp, Mus musculus
cagcccggcccttcgggcgagagga

SEQ ID NO: 244455 - DNA, 25 bp, Mus musculus
tggagcccccagacaagaggcgaac

SEQ ID NO: 244456 - DNA, 25 bp, Mus musculus
tggccgtgagtagccggcgcgcctt

SEQ ID NO: 244457 - DNA, 25 bp, Mus musculus
ggcagcatttcagcctggccgtgag

SEQ ID NO: 244458 - DNA, 25 bp, Mus musculus
acgatgggcagcatttcagcctggc

SEQ ID NO: 244459 - DNA, 25 bp, Mus musculus
taccgctacgatgggcagcatttca

SEQ ID NO: 244460 - DNA, 25 bp, Mus musculus
ctgtaccgctacgatgggcagcatt

SEQ ID NO: 244461 - DNA, 25 bp, Mus musculus
ggcaccataaactgtaccgctacga

SEQ ID NO: 244462 - DNA, 25 bp, Mus musculus
aggggcaccataaactgtaccgcta

SEQ ID NO: 244463 - DNA, 25 bp, Mus musculus
ccggctctgaaaaaggggcaccata

SEQ ID NO: 244464 - DNA, 25 bp, Mus musculus
tgattgacccggctctgaaaaaggg

SEQ ID NO: 244465 - DNA, 25 bp, Mus musculus
agttacaagttgatgattgacccgg

SEQ ID NO: 244466 - DNA, 25 bp, Mus musculus
ccaccattggagaagttacaagttg

SEQ ID NO: 244467 - DNA, 25 bp, Mus musculus
ggaggaaccaccattggagaagtta

SEQ ID NO: 244468 - DNA, 25 bp, Mus musculus
tacttgcgcgttggctgagctgttt

SEQ ID NO: 244469 - DNA, 25 bp, Mus musculus
cgcgttggctgagctgttttggccc

SEQ ID NO: 244470 - DNA, 25 bp, Mus musculus
ggaggacccgtagcctcagcctcgg

SEQ ID NO: 244471 - DNA, 25 bp, Mus musculus
cgggaaacccagaactctagcttga

SEQ ID NO: 244472 - DNA, 25 bp, Mus musculus
actctagcttgaggtccgcgatgtc

SEQ ID NO: 244473 - DNA, 25 bp, Mus musculus
ccgcgatgtcgggtgaagacgttcc

SEQ ID NO: 244474 - DNA, 25 bp, Mus musculus
aagacgttccgcaccgggcagagtc

SEQ ID NO: 244475 - DNA, 25 bp, Mus musculus
ttacgacgtcctggagagcgtgagt

SEQ ID NO: 244476 - DNA, 25 bp, Mus musculus
gcggtcagcgacatccaggatctga

SEQ ID NO: 244477 - DNA, 25 bp, Mus musculus
tcgaggcggagatcaaggctaatta

SEQ ID NO: 244478 - DNA, 25 bp, Mus musculus
atccaggatctgatgcgacgcaagg

SEQ ID NO: 244479 - DNA, 25 bp, Mus musculus
tctgatgcgacgcaaggaggagatc

SEQ ID NO: 244480 - DNA, 25 bp, Mus musculus
tcaaggctaattacgacgtcctgga

SEQ ID NO: 244481 - DNA, 25 bp, Mus musculus
gtgcggccgcggtcagcgacatcca

SEQ ID NO: 244482 - DNA, 25 bp, Mus musculus
caccaggctttgtgtgtgcgcgtat

SEQ ID NO: 244483 - DNA, 25 bp, Mus musculus
tcggttcgagccgagaccaggagcc

SEQ ID NO: 244484 - DNA, 25 bp, Mus musculus
gatatcaagagggtcatggcggcta

SEQ ID NO: 244485 - DNA, 25 bp, Mus musculus
ctatcgagaaagtgcgcaaatggta

SEQ ID NO: 244486 - DNA, 25 bp, Mus musculus
aaatggtaagccgaggcgcctgctc

SEQ ID NO: 244487 - DNA, 25 bp, Mus musculus
agcaagcccggacccagcgcgtaga

SEQ ID NO: 244488 - DNA, 25 bp, Mus musculus
gctgcgtccgctgcccaggtgtgct

SEQ ID NO: 244489 - DNA, 25 bp, Mus musculus
tgcaagtcacatgaaagcggcttcc

SEQ ID NO: 244490 - DNA, 25 bp, Mus musculus
cagagcgcgagctccattgtgcagc

SEQ ID NO: 244491 - DNA, 25 bp, Mus musculus
cgagctccattgtgcagcgcggagc

SEQ ID NO: 244492 - DNA, 25 bp, Mus musculus
ccgccagaaccatgtcgggcaggtc

SEQ ID NO: 244493 - DNA, 25 bp, Mus musculus
taaatttagcgctttgggcagcctg

SEQ ID NO: 244494 - DNA, 25 bp, Mus musculus
agagcgcgagccgtttaaatttagc

SEQ ID NO: 244495 - DNA, 25 bp, Mus musculus
cgccctcgagtctgcggagtttgca

SEQ ID NO: 244496 - DNA, 25 bp, Mus musculus
agcgcacgttcacgggctgcaaaac

SEQ ID NO: 244497 - DNA, 25 bp, Mus musculus
accgtgtgcccagagcccaaatagg

SEQ ID NO: 244498 - DNA, 25 bp, Mus musculus
gctgcaaaacctgggacgcatggcc

SEQ ID NO: 244499 - DNA, 25 bp, Mus musculus
aggctcagaaccttgctccgcgctg

SEQ ID NO: 244500 - DNA, 25 bp, Mus musculus
ggggacgttcctgcaacacagcttt

SEQ ID NO: 244501 - DNA, 25 bp, Mus musculus
ctggcgcctatctcagccgaggaga

SEQ ID NO: 244502 - DNA, 25 bp, Mus musculus
aacctgtgcacggtgatggccattg

SEQ ID NO: 244503 - DNA, 25 bp, Mus musculus
atggccattgggtctcgagtatctg

SEQ ID NO: 244504 - DNA, 25 bp, Mus musculus
gcgtggccggttattaatacccaga

SEQ ID NO: 244505 - DNA, 25 bp, Mus musculus
ctcgagtatctgagtgacaggacgc

SEQ ID NO: 244506 - DNA, 25 bp, Mus musculus
cacagctttccatacgcgacattag

SEQ ID NO: 244507 - DNA, 25 bp, Mus musculus
agctcgcacctcttgatctcggagg

SEQ ID NO: 244508 - DNA, 25 bp, Mus musculus
aggcagccaatgacttcgtgacata

SEQ ID NO: 244509 - DNA, 25 bp, Mus musculus
tcgtgacataggtgagcgcacgttc

SEQ ID NO: 244510 - DNA, 25 bp, Mus musculus
ttaattctagaaacacggcccaagc

SEQ ID NO: 244511 - DNA, 25 bp, Mus musculus
accttctggtccatgtttcatggca

SEQ ID NO: 244512 - DNA, 25 bp, Mus musculus
ttgacggactctgccgtgaaaccga

SEQ ID NO: 244513 - DNA, 25 bp, Mus musculus
ggtacatcggcaggcttaattctag

SEQ ID NO: 244514 - DNA, 25 bp, Mus musculus
ctctgccgtgaaaccgaaacactcg

SEQ ID NO: 244515 - DNA, 25 bp, Mus musculus
caagcgactcctcttgggcgcgagc

SEQ ID NO: 244516 - DNA, 25 bp, Mus musculus
gggcgcgagcagaactaacgtttca

SEQ ID NO: 244517 - DNA, 25 bp, Mus musculus
gagcagaactaacgtttcaagttta

SEQ ID NO: 244518 - DNA, 25 bp, Mus musculus
ttcaagtttactaaagtgcaaatcc

SEQ ID NO: 244519 - DNA, 25 bp, Mus musculus
ttactaaagtgcaaatccaagaaga

SEQ ID NO: 244520 - DNA, 25 bp, Mus musculus
tccaagaagaacctagagcggcggc

SEQ ID NO: 244521 - DNA, 25 bp, Mus musculus
cggcagcggaacttcgcagacactt

SEQ ID NO: 244522 - DNA, 25 bp, Mus musculus
aacttcgcagacacttgacggactc

SEQ ID NO: 244523 - DNA, 25 bp, Mus musculus
tttcatggcaggtacatcggcaggc

SEQ ID NO: 244524 - DNA, 25 bp, Mus musculus
ggccagggccgcctatacctcttct

SEQ ID NO: 244525 - DNA, 25 bp, Mus musculus
cctctctggacagtcaggaggagtc

SEQ ID NO: 244526 - DNA, 25 bp, Mus musculus
cagtcaggaggagtcgatacagttg

SEQ ID NO: 244527 - DNA, 25 bp, Mus musculus
gaggagtcgatacagttgagaaaga

SEQ ID NO: 244528 - DNA, 25 bp, Mus musculus
ttgagaaagaagacaacgatgaggt

SEQ ID NO: 244529 - DNA, 25 bp, Mus musculus
acaacgatgaggttcgaggtaccga

SEQ ID NO: 244530 - DNA, 25 bp, Mus musculus
gttcgaggtaccgaggctgtcatta

SEQ ID NO: 244531 - DNA, 25 bp, Mus musculus
gtaccgaggctgtcattagtttttc

SEQ ID NO: 244532 - DNA, 25 bp, Mus musculus
cattagtttttctctgaagtgcctg

SEQ ID NO: 244533 - DNA, 25 bp, Mus musculus
tttctctgaagtgcctgaacgtagg

SEQ ID NO: 244534 - DNA, 25 bp, Mus musculus
tatacctcttctaccctccgcagcc

SEQ ID NO: 244535 - DNA, 25 bp, Mus musculus
cgacggaggggaccattcggatgtt

SEQ ID NO: 244536 - DNA, 25 bp, Mus musculus
ctgaacgtaggaatgggccgtcgac

SEQ ID NO: 244537 - DNA, 25 bp, Mus musculus
tgcctgaacgtaggaatgggccgtc

SEQ ID NO: 244538 - DNA, 25 bp, Mus musculus
cccgcccaagaagggctatgatttc

SEQ ID NO: 244539 - DNA, 25 bp, Mus musculus
tgctcaagcctcaggtgcccgagga

SEQ ID NO: 244540 - DNA, 25 bp, Mus musculus
atgcgtcgctcaccaagctcttcga

SEQ ID NO: 244541 - DNA, 25 bp, Mus musculus
agctcctgccacttgtccatcgatg

SEQ ID NO: 244542 - DNA, 25 bp, Mus musculus
agctcttcgagtgcatgaccctggc

SEQ ID NO: 244543 - DNA, 25 bp, Mus musculus
tttcgacacggtcaacaagcagacg

SEQ ID NO: 244544 - DNA, 25 bp, Mus musculus
agcggccacttcatggtgtcctctc

SEQ ID NO: 244545 - DNA, 25 bp, Mus musculus
aggccgcagggctattcccaagctc

SEQ ID NO: 244546 - DNA, 25 bp, Mus musculus
tggagccagactagttgaacagaca

SEQ ID NO: 244547 - DNA, 25 bp, Mus musculus
tccgattggccaagacgacagtgac

SEQ ID NO: 244548 - DNA, 25 bp, Mus musculus
cgacagtgacgttacgaggaggccc

SEQ ID NO: 244549 - DNA, 25 bp, Mus musculus
ccggaccaggttctcctcatggctg

SEQ ID NO: 244550 - DNA, 25 bp, Mus musculus
tggctgccgacgttttcatgtgttc

SEQ ID NO: 244551 - DNA, 25 bp, Mus musculus
gcagacgtgccagacctatagcttc

SEQ ID NO: 244552 - DNA, 25 bp, Mus musculus
tcctcgcacagcatggagaccagcg

SEQ ID NO: 244553 - DNA, 25 bp, Mus musculus
gcacccagggtaacgcgtctggccg

SEQ ID NO: 244554 - DNA, 25 bp, Mus musculus
ggtaacgcgtctggccgttgcctag

SEQ ID NO: 244555 - DNA, 25 bp, Mus musculus
acgagctgtcctcgcacagcatgga

SEQ ID NO: 244556 - DNA, 25 bp, Mus musculus
ccagcgagtccagcactagcgacta

SEQ ID NO: 244557 - DNA, 25 bp, Mus musculus
tccagcactagcgactacagacaga

SEQ ID NO: 244558 - DNA, 25 bp, Mus musculus
ttgtgtctgcgcgaattcccgtgtg

SEQ ID NO: 244559 - DNA, 25 bp, Mus musculus
cctgcggaagttgtgtctgcgcgaa

SEQ ID NO: 244560 - DNA, 25 bp, Mus musculus
ctgtgtgtgagcacctgcggaagtt

SEQ ID NO: 244561 - DNA, 25 bp, Mus musculus
taccggggaccttgagcacggctgt

SEQ ID NO: 244562 - DNA, 25 bp, Mus musculus
ggagaccagcgagtccagcactagc

SEQ ID NO: 244563 - DNA, 25 bp, Mus musculus
cgactacagacagaccgagggcgag

SEQ ID NO: 244564 - DNA, 25 bp, Mus musculus
gttgcctagcaacgagctgtcctcg

SEQ ID NO: 244565 - DNA, 25 bp, Mus musculus
ctagcgactacagacagaccgaggg

SEQ ID NO: 244566 - DNA, 25 bp, Mus musculus
tcctccctgaagagcctcgcggttg

SEQ ID NO: 244567 - DNA, 25 bp, Mus musculus
ctggcagcccaacgggcgtgggaaa

SEQ ID NO: 244568 - DNA, 25 bp, Mus musculus
ccacaagtgcgtcctggatagactg

SEQ ID NO: 244569 - DNA, 25 bp, Mus musculus
ccctcatcgagtggccggatggcag

SEQ ID NO: 244570 - DNA, 25 bp, Mus musculus
ctgtggcgcctggatcccgttgccg

SEQ ID NO: 244571 - DNA, 25 bp, Mus musculus
tactgcccggcttttgtgtcggtgc

SEQ ID NO: 244572 - DNA, 25 bp, Mus musculus
tcccggcgagatactgcccggcttt

SEQ ID NO: 244573 - DNA, 25 bp, Mus musculus
ctctttgggaccctgcccctgaaga

SEQ ID NO: 244574 - DNA, 25 bp, Mus musculus
agcctcgcggttgctccattttgga

SEQ ID NO: 244575 - DNA, 25 bp, Mus musculus
tgcgtcctggatagactgcaaggtg

SEQ ID NO: 244576 - DNA, 25 bp, Mus musculus
acgagccacaagtgcgtcctggata

SEQ ID NO: 244577 - DNA, 25 bp, Mus musculus
tgcagttgccaacgagccacaagtg

SEQ ID NO: 244578 - DNA, 25 bp, Mus musculus
gagcgttgcagttgccaacgagcca

SEQ ID NO: 244579 - DNA, 25 bp, Mus musculus
cattttggagctccgccctctcttt

SEQ ID NO: 244580 - DNA, 25 bp, Mus musculus
ccggaagtgacgcagcatagcaagc

SEQ ID NO: 244581 - DNA, 25 bp, Mus musculus
gtcgccgcagccgattagcaacttg

SEQ ID NO: 244582 - DNA, 25 bp, Mus musculus
cccgccaggcggagaagtttcaaag

SEQ ID NO: 244583 - DNA, 25 bp, Mus musculus
catgcgatctgagttccacgagcga

SEQ ID NO: 244584 - DNA, 25 bp, Mus musculus
agtgcgcaggattcagctttagacc

SEQ ID NO: 244585 - DNA, 25 bp, Mus musculus
atggtcgcctccagcaaatcccggg

SEQ ID NO: 244586 - DNA, 25 bp, Mus musculus
gccgggacaccaggaaaccgctcta

SEQ ID NO: 244587 - DNA, 25 bp, Mus musculus
gggacccgtgctctctctaacaatg

SEQ ID NO: 244588 - DNA, 25 bp, Mus musculus
atgcgtgggaggagaaccactttca

SEQ ID NO: 244589 - DNA, 25 bp, Mus musculus
cgcggccgtacctgaacagagagca

SEQ ID NO: 244590 - DNA, 25 bp, Mus musculus
aaggagcccggagcttcatggtcac

SEQ ID NO: 244591 - DNA, 25 bp, Mus musculus
cgccaacgtaaaactctccggagtg

SEQ ID NO: 244592 - DNA, 25 bp, Mus musculus
gccagttaagtctcggcactcggga

SEQ ID NO: 244593 - DNA, 25 bp, Mus musculus
ggggcccgcctctaacttcagaaga

SEQ ID NO: 244594 - DNA, 25 bp, Mus musculus
cgcggccacgcacagcgactcaccg

SEQ ID NO: 244595 - DNA, 25 bp, Mus musculus
cagctccaccagctccatctcggct

SEQ ID NO: 244596 - DNA, 25 bp, Mus musculus
cccgggagcattgtggggattgtag

SEQ ID NO: 244597 - DNA, 25 bp, Mus musculus
gattgtagttcgccctgtttagttc

SEQ ID NO: 244598 - DNA, 25 bp, Mus musculus
ctgtgaacccacgtgccgggctgga

SEQ ID NO: 244599 - DNA, 25 bp, Mus musculus
cacgtgccgggctggaccagatgtt

SEQ ID NO: 244600 - DNA, 25 bp, Mus musculus
ggaccagatgttgccggtacccttg

SEQ ID NO: 244601 - DNA, 25 bp, Mus musculus
cagatgttgccggtacccttggatc

SEQ ID NO: 244602 - DNA, 25 bp, Mus musculus
ttgccggtacccttggatcgtcgat

SEQ ID NO: 244603 - DNA, 25 bp, Mus musculus
acccttggatcgtcgatgggcccac

SEQ ID NO: 244604 - DNA, 25 bp, Mus musculus
cctgaggtccctctccttccctgct

SEQ ID NO: 244605 - DNA, 25 bp, Mus musculus
aggtcgcagacacctgaggtccctc

SEQ ID NO: 244606 - DNA, 25 bp, Mus musculus
aaggcaccgaggtcgcagacacctg

SEQ ID NO: 244607 - DNA, 25 bp, Mus musculus
cacttccgggccgaaggcaccgagg

SEQ ID NO: 244608 - DNA, 25 bp, Mus musculus
gcacgttcaggttcactcgcccgta

SEQ ID NO: 244609 - DNA, 25 bp, Mus musculus
ctgaggcacattgaacgcgaaaggc

SEQ ID NO: 244610 - DNA, 25 bp, Mus musculus
ccgagtcgctgaggcacattgaacg

SEQ ID NO: 244611 - DNA, 25 bp, Mus musculus
acgttcacgtgatccgagtcgctga

SEQ ID NO: 244612 - DNA, 25 bp, Mus musculus
acgtgacgggacgttcacgtgatcc

SEQ ID NO: 244613 - DNA, 25 bp, Mus musculus
atcttgcccgggcacccgcatttcc

SEQ ID NO: 244614 - DNA, 25 bp, Mus musculus
ttcactcgcccgtacgacaggtgcg

SEQ ID NO: 244615 - DNA, 25 bp, Mus musculus
gcctcgcgcagcacgttcaggttca

SEQ ID NO: 244616 - DNA, 25 bp, Mus musculus
acttgtccaggaactcgcgcagctc

SEQ ID NO: 244617 - DNA, 25 bp, Mus musculus
cagcgcacttgtccaggaactcgcg

SEQ ID NO: 244618 - DNA, 25 bp, Mus musculus
tcactgagcgggcgacctgatcgcc

SEQ ID NO: 244619 - DNA, 25 bp, Mus musculus
acaactgtctcgcaggtcggggagc

SEQ ID NO: 244620 - DNA, 25 bp, Mus musculus
ccaggctggaaaggacaactgtctc

SEQ ID NO: 244621 - DNA, 25 bp, Mus musculus
cgtacgacaggtgcgccgccatctt

SEQ ID NO: 244622 - DNA, 25 bp, Mus musculus
gtccagggcaacaggtcgaaccgga

SEQ ID NO: 244623 - DNA, 25 bp, Mus musculus
ggacgccgctggtcgccgtcacatg

SEQ ID NO: 244624 - DNA, 25 bp, Mus musculus
tcaccgcatgggacgccgctggtcg

SEQ ID NO: 244625 - DNA, 25 bp, Mus musculus
tacatatgcagatggggcccgcgct

SEQ ID NO: 244626 - DNA, 25 bp, Mus musculus
tgtacggcgaggaagtacatatgca

SEQ ID NO: 244627 - DNA, 25 bp, Mus musculus
gggagcttgagacgagccttccctc

SEQ ID NO: 244628 - DNA, 25 bp, Mus musculus
gcgcagggacaaggagtccacgctc

SEQ ID NO: 244629 - DNA, 25 bp, Mus musculus
tgcccgaggaaagctcgcccagatg

SEQ ID NO: 244630 - DNA, 25 bp, Mus musculus
cgctccaggggtctgaaggaaaaca

SEQ ID NO: 244631 - DNA, 25 bp, Mus musculus
gtttcgcccttctaccttcacagag

SEQ ID NO: 244632 - DNA, 25 bp, Mus musculus
cgggcagcggtgatttcagagatct

SEQ ID NO: 244633 - DNA, 25 bp, Mus musculus
tcagagatctggcaccctgtttcgc

SEQ ID NO: 244634 - DNA, 25 bp, Mus musculus
tccacgctccatcttgaggcggcgg

SEQ ID NO: 244635 - DNA, 25 bp, Mus musculus
ttcacagagaatcacgctccagggg

SEQ ID NO: 244636 - DNA, 25 bp, Mus musculus
gactcctctggtgggtcaaacgcct

SEQ ID NO: 244637 - DNA, 25 bp, Mus musculus
cgaagagctctaggtcgccaaaatc

SEQ ID NO: 244638 - DNA, 25 bp, Mus musculus
tcgtcgtccttgaaccgggtgtgaa

SEQ ID NO: 244639 - DNA, 25 bp, Mus musculus
ccatcgcgccggaaggatattctcg

SEQ ID NO: 244640 - DNA, 25 bp, Mus musculus
agcaccgggaggcaagttagctcaa

SEQ ID NO: 244641 - DNA, 25 bp, Mus musculus
tgcagcttctgcaaccggaccgaga

SEQ ID NO: 244642 - DNA, 25 bp, Mus musculus
gtgtctccagtgtcacaacagttga

SEQ ID NO: 244643 - DNA, 25 bp, Mus musculus
tccaagaccgggagagaagtgtctc

SEQ ID NO: 244644 - DNA, 25 bp, Mus musculus
ctcgagcttggcacgcaaagttaga

SEQ ID NO: 244645 - DNA, 25 bp, Mus musculus
tacgactcgtctcttctcgagcttg

SEQ ID NO: 244646 - DNA, 25 bp, Mus musculus
tgggcactcgtagctttcgtccctc

SEQ ID NO: 244647 - DNA, 25 bp, Mus musculus
cgattctccatcacagtgggcactc

SEQ ID NO: 244648 - DNA, 25 bp, Mus musculus
tctggacaatttagcaagtctcttc

SEQ ID NO: 244649 - DNA, 25 bp, Mus musculus
ggacttcgaatgctaatcttcttgg

SEQ ID NO: 244650 - DNA, 25 bp, Mus musculus
ttgcgcatgcgcctgtcattgccgg

SEQ ID NO: 244651 - DNA, 25 bp, Mus musculus
agccggccattaggccgcgggaaat

SEQ ID NO: 244652 - DNA, 25 bp, Mus musculus
attaggccgcgggaaatcgcgcctc

SEQ ID NO: 244653 - DNA, 25 bp, Mus musculus
ggctgacgccagaagccgtcgcaca

SEQ ID NO: 244654 - DNA, 25 bp, Mus musculus
acgtcgtgacgtaagacgtaggcgc

SEQ ID NO: 244655 - DNA, 25 bp, Mus musculus
tcattgccggggtgtttgttcctgc

SEQ ID NO: 244656 - DNA, 25 bp, Mus musculus
gccatggcggttctcttggagacca

SEQ ID NO: 244657 - DNA, 25 bp, Mus musculus
ttctcttggagaccactctgggcga

SEQ ID NO: 244658 - DNA, 25 bp, Mus musculus
accactctgggcgacgtggtcatcg

SEQ ID NO: 244659 - DNA, 25 bp, Mus musculus
ggcgacgtggtcatcgacttgtaca

SEQ ID NO: 244660 - DNA, 25 bp, Mus musculus
tggtcatcgacttgtacactgaaga

SEQ ID NO: 244661 - DNA, 25 bp, Mus musculus
cgacttgtacactgaagagcgtccc

SEQ ID NO: 244662 - DNA, 25 bp, Mus musculus
agactggaggccttcgcgacctggc

SEQ ID NO: 244663 - DNA, 25 bp, Mus musculus
aagccgtcgcacacgtcgtgacgta

SEQ ID NO: 244664 - DNA, 25 bp, Mus musculus
ccagacgagagcaatcggaggccga

SEQ ID NO: 244665 - DNA, 25 bp, Mus musculus
ttggcactgcaaccctgaggcacct

SEQ ID NO: 244666 - DNA, 25 bp, Mus musculus
ctgtcttctcctgtagctgggctgc

SEQ ID NO: 244667 - DNA, 25 bp, Mus musculus
ggcccggatgacctgtctcctacgg

SEQ ID NO: 244668 - DNA, 25 bp, Mus musculus
tcgtccggctcacggccagacgaga

SEQ ID NO: 244669 - DNA, 25 bp, Mus musculus
gaggcacctgcggaattctgtcttc

SEQ ID NO: 244670 - DNA, 25 bp, Mus musculus
gccaccgattgtgctgggcccggat

SEQ ID NO: 244671 - DNA, 25 bp, Mus musculus
ccaaactcggggcaatagctgcgac

SEQ ID NO: 244672 - DNA, 25 bp, Mus musculus
gctacgacacgagagccaccaaact

SEQ ID NO: 244673 - DNA, 25 bp, Mus musculus
agccgtcgcagagccagctacgaca

SEQ ID NO: 244674 - DNA, 25 bp, Mus musculus
tgcagcactacttccctcgggaatt

SEQ ID NO: 244675 - DNA, 25 bp, Mus musculus
taaggatcccgctacctggtcgcgc

SEQ ID NO: 244676 - DNA, 25 bp, Mus musculus
gagtcaagcccacagccaccgattg

SEQ ID NO: 244677 - DNA, 25 bp, Mus musculus
atagctgcgacagcgaaagcgaggc

SEQ ID NO: 244678 - DNA, 25 bp, Mus musculus
catcttgtccacacacaggcacgga

SEQ ID NO: 244679 - DNA, 25 bp, Mus musculus
actcaacagtactggccgcctcgaa

SEQ ID NO: 244680 - DNA, 25 bp, Mus musculus
acagccctgatgagctggtcgccca

SEQ ID NO: 244681 - DNA, 25 bp, Mus musculus
gccttcgagctccacttagtaccta

SEQ ID NO: 244682 - DNA, 25 bp, Mus musculus
gcttcgccacagactgaatctcttg

SEQ ID NO: 244683 - DNA, 25 bp, Mus musculus
ggtcgcccactctgtgttaaagaaa

SEQ ID NO: 244684 - DNA, 25 bp, Mus musculus
cgagagacccggatggcacaagaaa

SEQ ID NO: 244685 - DNA, 25 bp, Mus musculus
cgcgcagcttgctgggagaaaaagt

SEQ ID NO: 244686 - DNA, 25 bp, Mus musculus
aagtgggtggcgataagagtttcta

SEQ ID NO: 244687 - DNA, 25 bp, Mus musculus
tttctataacaacgcggttcgaggc

SEQ ID NO: 244688 - DNA, 25 bp, Mus musculus
ggcggtgattggttagtctctcgaa

SEQ ID NO: 244689 - DNA, 25 bp, Mus musculus
gctcggtatcgggaattcaatttag

SEQ ID NO: 244690 - DNA, 25 bp, Mus musculus
gcggtttccgcgctcaattttgagc

SEQ ID NO: 244691 - DNA, 25 bp, Mus musculus
ggggccaaggatacctcccagaatg

SEQ ID NO: 244692 - DNA, 25 bp, Mus musculus
cgcctctacgcaactcggtcccgtt

SEQ ID NO: 244693 - DNA, 25 bp, Mus musculus
cccaggcgctgcctaaagcaggaag

SEQ ID NO: 244694 - DNA, 25 bp, Mus musculus
agcgctctcattcgcgctgctgcgg

SEQ ID NO: 244695 - DNA, 25 bp, Mus musculus
ccggctgggtaatgagcgctctcat

SEQ ID NO: 244696 - DNA, 25 bp, Mus musculus
ttgcatgtgtcgcttcagctggcgg

SEQ ID NO: 244697 - DNA, 25 bp, Mus musculus
aagaggagttgcatgtgtcgcttca

SEQ ID NO: 244698 - DNA, 25 bp, Mus musculus
cccagcagcgaatttcggggcagcc

SEQ ID NO: 244699 - DNA, 25 bp, Mus musculus
aaaggctcattgtctcgcgcgagcg

SEQ ID NO: 244700 - DNA, 25 bp, Mus musculus
cggggatatcgcgataaaggctcat

SEQ ID NO: 244701 - DNA, 25 bp, Mus musculus
ctcctagcggctggccggggatatc

SEQ ID NO: 244702 - DNA, 25 bp, Mus musculus
gacatcctcctagcggctggccggg

SEQ ID NO: 244703 - DNA, 25 bp, Mus musculus
gcacggtggcgtctcgcgacatcct

SEQ ID NO: 244704 - DNA, 25 bp, Mus musculus
cgggctccacgcatgggcgcatgct

SEQ ID NO: 244705 - DNA, 25 bp, Mus musculus
ggcgcatgctcctccctttttgggc

SEQ ID NO: 244706 - DNA, 25 bp, Mus musculus
cggcgaccttataccggcgccaggt

SEQ ID NO: 244707 - DNA, 25 bp, Mus musculus
ctgcgacgctctgggaaccttagag

SEQ ID NO: 244708 - DNA, 25 bp, Mus musculus
ccggcgtgggaatgaatataggttc

SEQ ID NO: 244709 - DNA, 25 bp, Mus musculus
tataggttcacgttcttgatccgcg

SEQ ID NO: 244710 - DNA, 25 bp, Mus musculus
ttcttgatccgcgagcgagcacagg

SEQ ID NO: 244711 - DNA, 25 bp, Mus musculus
cgagcacaggcgcaagtctcgcgag

SEQ ID NO: 244712 - DNA, 25 bp, Mus musculus
agtctcgcgagagcatcactcctgc

SEQ ID NO: 244713 - DNA, 25 bp, Mus musculus
actcctgcgcaacgtccgagtgcgg

SEQ ID NO: 244714 - DNA, 25 bp, Mus musculus
cgcctatggcgtctcggaggtgacc

SEQ ID NO: 244715 - DNA, 25 bp, Mus musculus
gctgctggcaccaactctctctggg

SEQ ID NO: 244716 - DNA, 25 bp, Mus musculus
gagtcatccatgaacccttcggcga

SEQ ID NO: 244717 - DNA, 25 bp, Mus musculus
ggacccagcgacgaggcacgagcac

SEQ ID NO: 244718 - DNA, 25 bp, Mus musculus
ttaattcacttcgtctttcccgctg

SEQ ID NO: 244719 - DNA, 25 bp, Mus musculus
agcaccggagcgctgctgttgaacg

SEQ ID NO: 244720 - DNA, 25 bp, Mus musculus
cgccagcgctgggtgtgacgtcatc

SEQ ID NO: 244721 - DNA, 25 bp, Mus musculus
acccatgtctcggttctaggttccg

SEQ ID NO: 244722 - DNA, 25 bp, Mus musculus
cggttctaggttccgatcccagatt

SEQ ID NO: 244723 - DNA, 25 bp, Mus musculus
gttccgatcccagattcaaaccggc

SEQ ID NO: 244724 - DNA, 25 bp, Mus musculus
ccaaggcgctcacctcttccatacc

SEQ ID NO: 244725 - DNA, 25 bp, Mus musculus
caccatgtcgccgagctgtgcatcg

SEQ ID NO: 244726 - DNA, 25 bp, Mus musculus
ccaagctccgccgaccggaagcgcc

SEQ ID NO: 244727 - DNA, 25 bp, Mus musculus
tgtcgccgagctgtgcatcgtcctc

SEQ ID NO: 244728 - DNA, 25 bp, Mus musculus
tcgtgcagctgcatcagcgacagcc

SEQ ID NO: 244729 - DNA, 25 bp, Mus musculus
atggcgagagccttgtgacgccatc

SEQ ID NO: 244730 - DNA, 25 bp, Mus musculus
cccagagtccgaggcttcagaggag

SEQ ID NO: 244731 - DNA, 25 bp, Mus musculus
ggcgcgcgaaagcacagcccagagt

SEQ ID NO: 244732 - DNA, 25 bp, Mus musculus
ggcgccttcactccctctcccggcc

SEQ ID NO: 244733 - DNA, 25 bp, Mus musculus
atcggcgcgcgaaagcacagcccag

SEQ ID NO: 244734 - DNA, 25 bp, Mus musculus
cagagcgctgttcttggccacgcct

SEQ ID NO: 244735 - DNA, 25 bp, Mus musculus
cgtgctcacgaaggccagcgtcact

SEQ ID NO: 244736 - DNA, 25 bp, Mus musculus
cgacgtccgtgctcacgaaggccag

SEQ ID NO: 244737 - DNA, 25 bp, Mus musculus
aaggcgtagatggccgtggtcaccc

SEQ ID NO: 244738 - DNA, 25 bp, Mus musculus
tccagcaggctacggtccaggtggc

SEQ ID NO: 244739 - DNA, 25 bp, Mus musculus
ttaaagtgtcggatgtcctccagca

SEQ ID NO: 244740 - DNA, 25 bp, Mus musculus
accgagtcgaagatgttaaagtgtc

SEQ ID NO: 244741 - DNA, 25 bp, Mus musculus
gtccagcaccgagtcgaagatgtta

SEQ ID NO: 244742 - DNA, 25 bp, Mus musculus
aggcagcccagaggtccagcaccga

SEQ ID NO: 244743 - DNA, 25 bp, Mus musculus
agggtgatgacgagccacgaagccc

SEQ ID NO: 244744 - DNA, 25 bp, Mus musculus
tgttcttggccacgcctatggtagc

SEQ ID NO: 244745 - DNA, 25 bp, Mus musculus
atgacgagccacgaagcccgcaggc

SEQ ID NO: 244746 - DNA, 25 bp, Mus musculus
acgaaggccagcgtcactactaccg

SEQ ID NO: 244747 - DNA, 25 bp, Mus musculus
agctgcggtacaggcaggcagccca

SEQ ID NO: 244748 - DNA, 25 bp, Mus musculus
ggcggagtcttcaggaaaaggcttc

SEQ ID NO: 244749 - DNA, 25 bp, Mus musculus
aggcttccggagaaatgggctgaaa

SEQ ID NO: 244750 - DNA, 25 bp, Mus musculus
ctacaagaccgcgtcgcagaagggt

SEQ ID NO: 244751 - DNA, 25 bp, Mus musculus
cgcaaggtacctacaagaccgcgtc

SEQ ID NO: 244752 - DNA, 25 bp, Mus musculus
tcgcagaagggtcaaaaaacagccg

SEQ ID NO: 244753 - DNA, 25 bp, Mus musculus
aaaacagccgaattcccgttgcgag

SEQ ID NO: 244754 - DNA, 25 bp, Mus musculus
ttcccgttgcgagctccgcagagct

SEQ ID NO: 244755 - DNA, 25 bp, Mus musculus
acctgccaccaggtgagtcgtcaga

SEQ ID NO: 244756 - DNA, 25 bp, Mus musculus
cggggacacaggatcctgcctctca

SEQ ID NO: 244757 - DNA, 25 bp, Mus musculus
gctgaaagaacctccctagtggggc

SEQ ID NO: 244758 - DNA, 25 bp, Mus musculus
ctctgggcaccgctttgctcggagc

SEQ ID NO: 244759 - DNA, 25 bp, Mus musculus
ctgcgccgctacaaggtcggagcct

SEQ ID NO: 244760 - DNA, 25 bp, Mus musculus
tttcacgggagtaggcgggacatcc

SEQ ID NO: 244761 - DNA, 25 bp, Mus musculus
tacaaggtcggagcctagcccagct

SEQ ID NO: 244762 - DNA, 25 bp, Mus musculus
atccataactgtcctgtcttacacg

SEQ ID NO: 244763 - DNA, 25 bp, Mus musculus
gccgcggtcttgtctcaatccataa

SEQ ID NO: 244764 - DNA, 25 bp, Mus musculus
gacgagcggtgaatgcccaacccga

SEQ ID NO: 244765 - DNA, 25 bp, Mus musculus
cttacacgttgcgtcaggaggctcc

SEQ ID NO: 244766 - DNA, 25 bp, Mus musculus
agggcagtgagtcccgcactgtcta

SEQ ID NO: 244767 - DNA, 25 bp, Mus musculus
ctgcgccgtgactacggccaggtga

SEQ ID NO: 244768 - DNA, 25 bp, Mus musculus
gacgagcatcagctgcgccgtgact

SEQ ID NO: 244769 - DNA, 25 bp, Mus musculus
gcacctgcgcttccgggacgagcat

SEQ ID NO: 244770 - DNA, 25 bp, Mus musculus
ccagaacctgtacgtggcgcgctac

SEQ ID NO: 244771 - DNA, 25 bp, Mus musculus
ttctgctcccagaacctgtacgtgg

SEQ ID NO: 244772 - DNA, 25 bp, Mus musculus
ccctccgaagttaagaattgtcagc

SEQ ID NO: 244773 - DNA, 25 bp, Mus musculus
aagacgtctttctacgcgggcctgc

SEQ ID NO: 244774 - DNA, 25 bp, Mus musculus
gcactgtctacgtcctgtgaccgtc

SEQ ID NO: 244775 - DNA, 25 bp, Mus musculus
aggaggctccgcaaagagatttcta

SEQ ID NO: 244776 - DNA, 25 bp, Mus musculus
agagttttagcttccgtctgcgccg

SEQ ID NO: 244777 - DNA, 25 bp, Mus musculus
ccagtcgccgagatttgctgggcgc

SEQ ID NO: 244778 - DNA, 25 bp, Mus musculus
gtctgcgactcgctggacctgcaca

SEQ ID NO: 244779 - DNA, 25 bp, Mus musculus
ttgtgcgccgcacgcgaacagcctt

SEQ ID NO: 244780 - DNA, 25 bp, Mus musculus
gcgaacagccttcgcggccacggag

SEQ ID NO: 244781 - DNA, 25 bp, Mus musculus
cacggagcgtgtgctccgggactcc

SEQ ID NO: 244782 - DNA, 25 bp, Mus musculus
gcggcctgctgcttggcctcttgcg

SEQ ID NO: 244783 - DNA, 25 bp, Mus musculus
ggcccaccagcatgacgttcctgga

SEQ ID NO: 244784 - DNA, 25 bp, Mus musculus
cgttcctggaggtgaaccgtctaga

SEQ ID NO: 244785 - DNA, 25 bp, Mus musculus
tgaaccgtctagagctggcggcgac

SEQ ID NO: 244786 - DNA, 25 bp, Mus musculus
ttcctgcggggagcgtccctatgga

SEQ ID NO: 244787 - DNA, 25 bp, Mus musculus
ccctatggagtagccagcgctggca

SEQ ID NO: 244788 - DNA, 25 bp, Mus musculus
gtcggcgctcaggaagagttttagc

SEQ ID NO: 244789 - DNA, 25 bp, Mus musculus
ccgagatttgctgggcgccgatacc

SEQ ID NO: 244790 - DNA, 25 bp, Mus musculus
tccctagaggcggaacccagagctc

SEQ ID NO: 244791 - DNA, 25 bp, Mus musculus
acccacgcggtcctattgcagctga

SEQ ID NO: 244792 - DNA, 25 bp, Mus musculus
atgctagttagaggtgggctcccta

SEQ ID NO: 244793 - DNA, 25 bp, Mus musculus
ctgaggaaagctgcagcgttccctc

SEQ ID NO: 244794 - DNA, 25 bp, Mus musculus
gccaccaagtccagtgcgcaggctt

SEQ ID NO: 244795 - DNA, 25 bp, Mus musculus
tgcgtttggattcgcctccgaggac

SEQ ID NO: 244796 - DNA, 25 bp, Mus musculus
tccgaggacacgctcacgaagagtc

SEQ ID NO: 244797 - DNA, 25 bp, Mus musculus
agtcgcaggctaagcgctttccttc

SEQ ID NO: 244798 - DNA, 25 bp, Mus musculus
atggctcacgttggctctcgaaagc

SEQ ID NO: 244799 - DNA, 25 bp, Mus musculus
caaggatgcctcgaggaactgttca

SEQ ID NO: 244800 - DNA, 25 bp, Mus musculus
actgttcagcctccagatcccaggg

SEQ ID NO: 244801 - DNA, 25 bp, Mus musculus
aagagagatgtgtggcgtccgcact

SEQ ID NO: 244802 - DNA, 25 bp, Mus musculus
tttcctcccgcgaaaggcctgctgt

SEQ ID NO: 244803 - DNA, 25 bp, Mus musculus
ccagagctccggaactcaaaatatc

SEQ ID NO: 244804 - DNA, 25 bp, Mus musculus
cggtgattgtacttgagctgggcca

SEQ ID NO: 244805 - DNA, 25 bp, Mus musculus
atggtgcggagcaggtgattccgag

SEQ ID NO: 244806 - DNA, 25 bp, Mus musculus
tgattgtacttgagctgggccaggt

SEQ ID NO: 244807 - DNA, 25 bp, Mus musculus
cgagcccggtgattgtacttgagct

SEQ ID NO: 244808 - DNA, 25 bp, Mus musculus
aaagccatgcgcgtggccgtgttcc

SEQ ID NO: 244809 - DNA, 25 bp, Mus musculus
gcccttgcgcaaagccatgcgcgtg

SEQ ID NO: 244810 - DNA, 25 bp, Mus musculus
aggtaggccgaagctgcccttgcgc

SEQ ID NO: 244811 - DNA, 25 bp, Mus musculus
tcactctggccaggtaggccgaagc

SEQ ID NO: 244812 - DNA, 25 bp, Mus musculus
tccgagagcgaaggaagtcactctg

SEQ ID NO: 244813 - DNA, 25 bp, Mus musculus
attccgagagcgaaggaagtcactc

SEQ ID NO: 244814 - DNA, 25 bp, Mus musculus
gatcgtgccgatggctgggcccact

SEQ ID NO: 244815 - DNA, 25 bp, Mus musculus
tccatctgggtctgtgtccgatcgt

SEQ ID NO: 244816 - DNA, 25 bp, Mus musculus
tctgtgtccgatcgtgccgatggct

SEQ ID NO: 244817 - DNA, 25 bp, Mus musculus
aggaagtcactctggccaggtaggc

SEQ ID NO: 244818 - DNA, 25 bp, Mus musculus
cgggtgcaccttgctctgttatgtc

SEQ ID NO: 244819 - DNA, 25 bp, Mus musculus
aggctctctcattggtctactacag

SEQ ID NO: 244820 - DNA, 25 bp, Mus musculus
gggcctccgtgcaagaagacaacaa

SEQ ID NO: 244821 - DNA, 25 bp, Mus musculus
tgccagtcccactccagatgaagtg

SEQ ID NO: 244822 - DNA, 25 bp, Mus musculus
actcttttcattggctcaggggtgt

SEQ ID NO: 244823 - DNA, 25 bp, Mus musculus
atcacctgtctgcagaggactgggc

SEQ ID NO: 244824 - DNA, 25 bp, Mus musculus
ctgttgtccactgcaggcgagtgca

SEQ ID NO: 244825 - DNA, 25 bp, Mus musculus
tccaggagacgcagtagagcagaac

SEQ ID NO: 244826 - DNA, 25 bp, Mus musculus
ctaacttgattgagcgggccaggcc

SEQ ID NO: 244827 - DNA, 25 bp, Mus musculus
ccgggcaactactagtcgagggaca

SEQ ID NO: 244828 - DNA, 25 bp, Mus musculus
cccgttctctgattggctcctggga

SEQ ID NO: 244829 - DNA, 25 bp, Mus musculus
tcacactctcattggcttaagcggc

SEQ ID NO: 244830 - DNA, 25 bp, Mus musculus
gtgagcgtgccataccatccttgca

SEQ ID NO: 244831 - DNA, 25 bp, Mus musculus
actcctcacagcttaggcgcgtcgg

SEQ ID NO: 244832 - DNA, 25 bp, Mus musculus
ctccttgccgtccagctctaggatg

SEQ ID NO: 244833 - DNA, 25 bp, Mus musculus
ctgctcgggaaagggaccagccgtc

SEQ ID NO: 244834 - DNA, 25 bp, Mus musculus
cgcagcttcacgtgggtcctcttgc

SEQ ID NO: 244835 - DNA, 25 bp, Mus musculus
tcacgtgggtcctcttgcgctgcca

SEQ ID NO: 244836 - DNA, 25 bp, Mus musculus
gctgccacctttccctgggctgtga

SEQ ID NO: 244837 - DNA, 25 bp, Mus musculus
ggcgtgaacacggacacctccttgc

SEQ ID NO: 244838 - DNA, 25 bp, Mus musculus
ccatagggcaggctcagacccgggc

SEQ ID NO: 244839 - DNA, 25 bp, Mus musculus
gggaagagcctcacccgcagcttca

SEQ ID NO: 244840 - DNA, 25 bp, Mus musculus
tgccgtccagctctaggatgctcga

SEQ ID NO: 244841 - DNA, 25 bp, Mus musculus
ctctaggatgctcgagctgtcgtgc

SEQ ID NO: 244842 - DNA, 25 bp, Mus musculus
atgctcgagctgtcgtgccgcatga

SEQ ID NO: 244843 - DNA, 25 bp, Mus musculus
tgccgcatgacctgcaggacagagg

SEQ ID NO: 244844 - DNA, 25 bp, Mus musculus
caggccatagggcaggctcagaccc

SEQ ID NO: 244845 - DNA, 25 bp, Mus musculus
ccctgggctgtgaaggcgtgaacac

SEQ ID NO: 244846 - DNA, 25 bp, Mus musculus
tccggagacgggcaacactcttaag

SEQ ID NO: 244847 - DNA, 25 bp, Mus musculus
ggaaacccgaggtctctgcctcctg

SEQ ID NO: 244848 - DNA, 25 bp, Mus musculus
gacgggcaacactcttaaggaacaa

SEQ ID NO: 244849 - DNA, 25 bp, Mus musculus
cactcttaaggaacaaggagtgggg

SEQ ID NO: 244850 - DNA, 25 bp, Mus musculus
cacgctaggtccttgtggaaacccg

SEQ ID NO: 244851 - DNA, 25 bp, Mus musculus
tccttgtggaaacccgaggtctctg

SEQ ID NO: 244852 - DNA, 25 bp, Mus musculus
tgcctcctgccgtagagtcctttgc

SEQ ID NO: 244853 - DNA, 25 bp, Mus musculus
ctgccgtagagtcctttgcacaaga

SEQ ID NO: 244854 - DNA, 25 bp, Mus musculus
ttgcacaagactcccggcgagaaaa

SEQ ID NO: 244855 - DNA, 25 bp, Mus musculus
cccggctcgcattccctcagtggcg

SEQ ID NO: 244856 - DNA, 25 bp, Mus musculus
cccgctggccatcagcagagggagt

SEQ ID NO: 244857 - DNA, 25 bp, Mus musculus
tgattaaactcctccggagacgggc

SEQ ID NO: 244858 - DNA, 25 bp, Mus musculus
aaaaaacgcccgctggccatcagca

SEQ ID NO: 244859 - DNA, 25 bp, Mus musculus
gggatcccacgcctcacgcgcttct

SEQ ID NO: 244860 - DNA, 25 bp, Mus musculus
gctctagggccaagacctctgctga

SEQ ID NO: 244861 - DNA, 25 bp, Mus musculus
cctagcctgttcacgcactcagggg

SEQ ID NO: 244862 - DNA, 25 bp, Mus musculus
ggtttagagtctcgccgaatgcttc

SEQ ID NO: 244863 - DNA, 25 bp, Mus musculus
gatttcccatcctcggtctaccgtg

SEQ ID NO: 244864 - DNA, 25 bp, Mus musculus
cgcatgcgcagacctggaaacctta

SEQ ID NO: 244865 - DNA, 25 bp, Mus musculus
cgcagttgatgagaatgggccctct

SEQ ID NO: 244866 - DNA, 25 bp, Mus musculus
acgcctgggtttctagcgtgcgcag

SEQ ID NO: 244867 - DNA, 25 bp, Mus musculus
cgagtctagaaaaggcgcacgcatc

SEQ ID NO: 244868 - DNA, 25 bp, Mus musculus
ctcagccgcgattggctgctcggaa

SEQ ID NO: 244869 - DNA, 25 bp, Mus musculus
tggagtcgtctaggactcagccctt

SEQ ID NO: 244870 - DNA, 25 bp, Mus musculus
ggtacccggagatttggcctcacgc

SEQ ID NO: 244871 - DNA, 25 bp, Mus musculus
ttggcctcacgcgaccgttaaattc

SEQ ID NO: 244872 - DNA, 25 bp, Mus musculus
aaattccaaggaacgtgcgcgcgcc

SEQ ID NO: 244873 - DNA, 25 bp, Mus musculus
acctctgctgattggttctctggaa

SEQ ID NO: 244874 - DNA, 25 bp, Mus musculus
tgcaacttcttccaaggggtctccc

SEQ ID NO: 244875 - DNA, 25 bp, Mus musculus
ggagtcgctctcatcgccaggaagc

SEQ ID NO: 244876 - DNA, 25 bp, Mus musculus
cggggcactgcaacttcttccaagg

SEQ ID NO: 244877 - DNA, 25 bp, Mus musculus
acagaacccacgaggccggggcact

SEQ ID NO: 244878 - DNA, 25 bp, Mus musculus
gagccgcagcatgccgcccacagaa

SEQ ID NO: 244879 - DNA, 25 bp, Mus musculus
gcaccgcgaactttggcagcgcagc

SEQ ID NO: 244880 - DNA, 25 bp, Mus musculus
ccaacttggcgacacttgcggcgcg

SEQ ID NO: 244881 - DNA, 25 bp, Mus musculus
cgccgagccgcccaaaaagcctaag

SEQ ID NO: 244882 - DNA, 25 bp, Mus musculus
atgtgcgcggtcaagttcggcttgt

SEQ ID NO: 244883 - DNA, 25 bp, Mus musculus
tcaagttcggcttgtacgacatccc

SEQ ID NO: 244884 - DNA, 25 bp, Mus musculus
gagcccgcgcactttttgttgtcgc

SEQ ID NO: 244885 - DNA, 25 bp, Mus musculus
cgcactttttgttgtcgccggctcg

SEQ ID NO: 244886 - DNA, 25 bp, Mus musculus
gcaaatatggccgtccctcaccctg

SEQ ID NO: 244887 - DNA, 25 bp, Mus musculus
tcgctctcactcaccggcgttgagg

SEQ ID NO: 244888 - DNA, 25 bp, Mus musculus
cggacggccatagagtggccgcctc

SEQ ID NO: 244889 - DNA, 25 bp, Mus musculus
cggaatctagcagggtgtccgcctc

SEQ ID NO: 244890 - DNA, 25 bp, Mus musculus
cagggtgtccgcctcggtttcacca

SEQ ID NO: 244891 - DNA, 25 bp, Mus musculus
cacccgtcccgggtccatgaagaga

SEQ ID NO: 244892 - DNA, 25 bp, Mus musculus
gggccgacccaaggatagcttctcc

SEQ ID NO: 244893 - DNA, 25 bp, Mus musculus
agaagcggcgtctggctctgcctac

SEQ ID NO: 244894 - DNA, 25 bp, Mus musculus
agcgcgcgacccgaatcacgtgact

SEQ ID NO: 244895 - DNA, 25 bp, Mus musculus
ccgcctccttcctagatgaaggaag

SEQ ID NO: 244896 - DNA, 25 bp, Mus musculus
tcccgctagcctggtaccggagatg

SEQ ID NO: 244897 - DNA, 25 bp, Mus musculus
gcctggtaccggagatgggatccaa

SEQ ID NO: 244898 - DNA, 25 bp, Mus musculus
caaaggcggcctaggacagtcacgt

SEQ ID NO: 244899 - DNA, 25 bp, Mus musculus
aggacagtcacgtgtccgccacttc

SEQ ID NO: 244900 - DNA, 25 bp, Mus musculus
gctccgcgacccgtgagcactgtga

SEQ ID NO: 244901 - DNA, 25 bp, Mus musculus
aggatagcttctccgggtccgcgaa

SEQ ID NO: 244902 - DNA, 25 bp, Mus musculus
cggtctagctgagcagttggctaca

SEQ ID NO: 244903 - DNA, 25 bp, Mus musculus
acggttgttactgatgccgcgagcc

SEQ ID NO: 244904 - DNA, 25 bp, Mus musculus
tcatggaaacttgagcgcagcgccc

SEQ ID NO: 244905 - DNA, 25 bp, Mus musculus
tccgtatgtcaaagctcatggaaac

SEQ ID NO: 244906 - DNA, 25 bp, Mus musculus
cccggagctggcatatccgtatgtc

SEQ ID NO: 244907 - DNA, 25 bp, Mus musculus
tggttcagccagtcttcccggagct

SEQ ID NO: 244908 - DNA, 25 bp, Mus musculus
ccttgttgaccagcgcttgactgtc

SEQ ID NO: 244909 - DNA, 25 bp, Mus musculus
actctgggtgctaccggagtacatt

SEQ ID NO: 244910 - DNA, 25 bp, Mus musculus
ctcacaggcatcctcctatggtgga

SEQ ID NO: 244911 - DNA, 25 bp, Mus musculus
ccgcactgctgggaacgcaaggtgc

SEQ ID NO: 244912 - DNA, 25 bp, Mus musculus
actgcctagctgagagccgcactgc

SEQ ID NO: 244913 - DNA, 25 bp, Mus musculus
cggccatggctagaggtatttgtta

SEQ ID NO: 244914 - DNA, 25 bp, Mus musculus
gaggcaggacgcagattgctgaccc

SEQ ID NO: 244915 - DNA, 25 bp, Mus musculus
agattccaggcggtgacagagcccg

SEQ ID NO: 244916 - DNA, 25 bp, Mus musculus
tccaggcaggaagatgtgcaagccc

SEQ ID NO: 244917 - DNA, 25 bp, Mus musculus
cagcgacggggtaagcaggctcctt

SEQ ID NO: 244918 - DNA, 25 bp, Mus musculus
ggggtaagcaggctcctttcccgca

SEQ ID NO: 244919 - DNA, 25 bp, Mus musculus
tttcccgcactgagcagcgcgccag

SEQ ID NO: 244920 - DNA, 25 bp, Mus musculus
aagcaggctcctttcccgcactgag

SEQ ID NO: 244921 - DNA, 25 bp, Mus musculus
ccctctccaggcaggaagatgtgca

SEQ ID NO: 244922 - DNA, 25 bp, Mus musculus
ccctgtgtgcgggcttagagacatg

SEQ ID NO: 244923 - DNA, 25 bp, Mus musculus
cctgctacgggccatgggcgaagcg

SEQ ID NO: 244924 - DNA, 25 bp, Mus musculus
gcctgggctggcgtgaacgtcccac

SEQ ID NO: 244925 - DNA, 25 bp, Mus musculus
cttcgggaagccgtgcagtcgctgc

SEQ ID NO: 244926 - DNA, 25 bp, Mus musculus
tggcgtgaacgtcccacgcatgcac

SEQ ID NO: 244927 - DNA, 25 bp, Mus musculus
ggctggcgtgaacgtcccacgcatg

SEQ ID NO: 244928 - DNA, 25 bp, Mus musculus
ggcctcgcgcacgtgggcgcagcaa

SEQ ID NO: 244929 - DNA, 25 bp, Mus musculus
ccgccatgggcctagccgggctgca

SEQ ID NO: 244930 - DNA, 25 bp, Mus musculus
tgagaagcctggtttccatggaaac

SEQ ID NO: 244931 - DNA, 25 bp, Mus musculus
tcgtttaccagcgtctccagcatct

SEQ ID NO: 244932 - DNA, 25 bp, Mus musculus
cacggggtgatcctccatggtaccc

SEQ ID NO: 244933 - DNA, 25 bp, Mus musculus
atgtcgtacacgtcgtcggtggtca

SEQ ID NO: 244934 - DNA, 25 bp, Mus musculus
tcgcggcccactacataggagatgt

SEQ ID NO: 244935 - DNA, 25 bp, Mus musculus
ggcacctatgcgtccactgactctg

SEQ ID NO: 244936 - DNA, 25 bp, Mus musculus
agaagcacccgaggcctggtagtct

SEQ ID NO: 244937 - DNA, 25 bp, Mus musculus
ctccacggccgtgcaccaaaagtga

SEQ ID NO: 244938 - DNA, 25 bp, Mus musculus
gcgggtagcaccgaaccatggaaaa

SEQ ID NO: 244939 - DNA, 25 bp, Mus musculus
aattgcgccgagtagcgggtagcac

SEQ ID NO: 244940 - DNA, 25 bp, Mus musculus
gccgagtccacgctgtgcgcagtct

SEQ ID NO: 244941 - DNA, 25 bp, Mus musculus
gaaactttgcactgggccgagtcca

SEQ ID NO: 244942 - DNA, 25 bp, Mus musculus
tgactctgggtcagggaaactttgc

SEQ ID NO: 244943 - DNA, 25 bp, Mus musculus
tactatcttgaactgcagccgggtg

SEQ ID NO: 244944 - DNA, 25 bp, Mus musculus
agaagaagggagctcggcccacgcc

SEQ ID NO: 244945 - DNA, 25 bp, Mus musculus
ccaaagcgaagaggcccagaggggc

SEQ ID NO: 244946 - DNA, 25 bp, Mus musculus
ccggccaaagcgaagaggcccagag

SEQ ID NO: 244947 - DNA, 25 bp, Mus musculus
cggccggccaaagcgaagaggccca

SEQ ID NO: 244948 - DNA, 25 bp, Mus musculus
ggctcgctgaatggagaagaaggga

SEQ ID NO: 244949 - DNA, 25 bp, Mus musculus
accaggcccggctggatgctgcgcc

SEQ ID NO: 244950 - DNA, 25 bp, Mus musculus
gaaggctaggaacgccggagcccgc

SEQ ID NO: 244951 - DNA, 25 bp, Mus musculus
cagagacccacaggaacctttgtaa

SEQ ID NO: 244952 - DNA, 25 bp, Mus musculus
ctcagatgagaagcggccgccgagc

SEQ ID NO: 244953 - DNA, 25 bp, Mus musculus
ctctcagatgagaagcggccgccga

SEQ ID NO: 244954 - DNA, 25 bp, Mus musculus
tgctctcagatgagaagcggccgcc

SEQ ID NO: 244955 - DNA, 25 bp, Mus musculus
ccgggccctgggactgctctcagat

SEQ ID NO: 244956 - DNA, 25 bp, Mus musculus
cagatgagaagcggccgccgagctc

SEQ ID NO: 244957 - DNA, 25 bp, Mus musculus
gccggccaaagcgaagaggcccaga

SEQ ID NO: 244958 - DNA, 25 bp, Mus musculus
ctgctgccgataaagggttccagtg

SEQ ID NO: 244959 - DNA, 25 bp, Mus musculus
tcctatgttggctttcggaaggcgc

SEQ ID NO: 244960 - DNA, 25 bp, Mus musculus
tggcggtttcgtcctatgttggctt

SEQ ID NO: 244961 - DNA, 25 bp, Mus musculus
aggagccggcttcacaccgacagct

SEQ ID NO: 244962 - DNA, 25 bp, Mus musculus
cctgtccaggcgtagttggaacctg

SEQ ID NO: 244963 - DNA, 25 bp, Mus musculus
ttagggacagccctgtccaggcgta

SEQ ID NO: 244964 - DNA, 25 bp, Mus musculus
tgaagcctggcagaaaccgggcagt

SEQ ID NO: 244965 - DNA, 25 bp, Mus musculus
gccgacgccatgttgaagcctggca

SEQ ID NO: 244966 - DNA, 25 bp, Mus musculus
agaaggcggagcgagtcgcccaact

SEQ ID NO: 244967 - DNA, 25 bp, Mus musculus
tcggcgtgtggaatctgcagtttct

SEQ ID NO: 244968 - DNA, 25 bp, Mus musculus
ctgcagtttctggtaaacgggcggt

SEQ ID NO: 244969 - DNA, 25 bp, Mus musculus
tggcgaatctgctgctgccgataaa

SEQ ID NO: 244970 - DNA, 25 bp, Mus musculus
cccaaatttgtcgaggtgagtggaa

SEQ ID NO: 244971 - DNA, 25 bp, Mus musculus
cccaactggcttggcggggtgccac

SEQ ID NO: 244972 - DNA, 25 bp, Mus musculus
cctcatgaagaagcggtcggtgacc

SEQ ID NO: 244973 - DNA, 25 bp, Mus musculus
tcgatgcggcaggttcccgagcagc

SEQ ID NO: 244974 - DNA, 25 bp, Mus musculus
gagcagcgcgcctgactctacgcaa

SEQ ID NO: 244975 - DNA, 25 bp, Mus musculus
gcgcctgactctacgcaacctaggg

SEQ ID NO: 244976 - DNA, 25 bp, Mus musculus
ctacgcaacctagggcggagtgtga

SEQ ID NO: 244977 - DNA, 25 bp, Mus musculus
attggtcggcgtgcccgtccgtcgt

SEQ ID NO: 244978 - DNA, 25 bp, Mus musculus
ggccgcgagttcgagtacctcatga

SEQ ID NO: 244979 - DNA, 25 bp, Mus musculus
gcaactcatcgcagggctcggtaga

SEQ ID NO: 244980 - DNA, 25 bp, Mus musculus
cggtagatgtgagcatgggccactc

SEQ ID NO: 244981 - DNA, 25 bp, Mus musculus
tgggccactcgagcttcatctcgcg

SEQ ID NO: 244982 - DNA, 25 bp, Mus musculus
gcggcgacttctacctgcgctgtct

SEQ ID NO: 244983 - DNA, 25 bp, Mus musculus
tacctgcgctgtctcggcaagaacg

SEQ ID NO: 244984 - DNA, 25 bp, Mus musculus
tctcggcaagaacggcgtgttcgtg

SEQ ID NO: 244985 - DNA, 25 bp, Mus musculus
gtcggtgaccatcggccgcaactca

SEQ ID NO: 244986 - DNA, 25 bp, Mus musculus
actcgcagccgtgttggtcgatgac

SEQ ID NO: 244987 - DNA, 25 bp, Mus musculus
ccggacttgatgctccaactgggtg

SEQ ID NO: 244988 - DNA, 25 bp, Mus musculus
gtccgtccactccagtaactcgtga

SEQ ID NO: 244989 - DNA, 25 bp, Mus musculus
acgttcttctccagagccgacaggg

SEQ ID NO: 244990 - DNA, 25 bp, Mus musculus
atgacggtcagctccgccacgttct

SEQ ID NO: 244991 - DNA, 25 bp, Mus musculus
ggcccacgagcgacgcgatatcgta

SEQ ID NO: 244992 - DNA, 25 bp, Mus musculus
tcgatgaccctctcgaactcgtggc

SEQ ID NO: 244993 - DNA, 25 bp, Mus musculus
aggaccctcacgaccttgggcatga

SEQ ID NO: 244994 - DNA, 25 bp, Mus musculus
tgccggctaaccagcacctcgagga

SEQ ID NO: 244995 - DNA, 25 bp, Mus musculus
agttccaggcgcagctcgtctagct

SEQ ID NO: 244996 - DNA, 25 bp, Mus musculus
tacgcgcaaccggtccagttccagg

SEQ ID NO: 244997 - DNA, 25 bp, Mus musculus
aaactttggtgacgccgagtgactc

SEQ ID NO: 244998 - DNA, 25 bp, Mus musculus
ccttttgatgcttgcgctccttttc

SEQ ID NO: 244999 - DNA, 25 bp, Mus musculus
gcgctccttttcaatgcggtccatc

SEQ ID NO: 245000 - DNA, 25 bp, Mus musculus
cggcgtggcgcggaaacaaactttg

SEQ ID NO: 245001 - DNA, 25 bp, Mus musculus
cgcatccttacgcaagcgccagatg

SEQ ID NO: 245002 - DNA, 25 bp, Mus musculus
gcttaacttcctagccgcatcctta

SEQ ID NO: 245003 - DNA, 25 bp, Mus musculus
ctttggcagaaaccagcttaacttc

SEQ ID NO: 245004 - DNA, 25 bp, Mus musculus
tttcgccgctcctagtccacgtgat

SEQ ID NO: 245005 - DNA, 25 bp, Mus musculus
caaactttgccgagtaggtcggaag

SEQ ID NO: 245006 - DNA, 25 bp, Mus musculus
ttacgcaagcgccagatgtgacccg

SEQ ID NO: 245007 - DNA, 25 bp, Mus musculus
cgactcggcgtggttctcctcggtc

SEQ ID NO: 245008 - DNA, 25 bp, Mus musculus
tcggaaagcgctcgtctctccgagc

SEQ ID NO: 245009 - DNA, 25 bp, Mus musculus
cgcgcgtctcggaaagcgctcgtct

SEQ ID NO: 245010 - DNA, 25 bp, Mus musculus
tgcgtccgttacgtggcagccgtcg

SEQ ID NO: 245011 - DNA, 25 bp, Mus musculus
ttggcccacgtcgaagggcttgagt

SEQ ID NO: 245012 - DNA, 25 bp, Mus musculus
tagtccacgtgatcattggcccacg

SEQ ID NO: 245013 - DNA, 25 bp, Mus musculus
cggagaaagtggctttggcagaaac

SEQ ID NO: 245014 - DNA, 25 bp, Mus musculus
ctgggttccttacgccgtcaggatc

SEQ ID NO: 245015 - DNA, 25 bp, Mus musculus
ggatctcagacttggcagtgccgga

SEQ ID NO: 245016 - DNA, 25 bp, Mus musculus
ttcccgcacatgacgccggtgcagg

SEQ ID NO: 245017 - DNA, 25 bp, Mus musculus
ttcattctgtcgatgcttctgcagc

SEQ ID NO: 245018 - DNA, 25 bp, Mus musculus
cgccttcagtcggaacgtcgtcgct

SEQ ID NO: 245019 - DNA, 25 bp, Mus musculus
tctttagctcctgtttgttggggtc

SEQ ID NO: 245020 - DNA, 25 bp, Mus musculus
cggagggtacccagcatctttagct

SEQ ID NO: 245021 - DNA, 25 bp, Mus musculus
cgatgtcctatgtgcaccggcggag

SEQ ID NO: 245022 - DNA, 25 bp, Mus musculus
cgagatggttctcgtctggcgccct

SEQ ID NO: 245023 - DNA, 25 bp, Mus musculus
ggctggccaactgcgagatggttct

SEQ ID NO: 245024 - DNA, 25 bp, Mus musculus
ttgctctaagcaagccaggctggcc

SEQ ID NO: 245025 - DNA, 25 bp, Mus musculus
ggagcggtcacaacttgctctaagc

SEQ ID NO: 245026 - DNA, 25 bp, Mus musculus
aacctccggcggcaagtcggtagag

SEQ ID NO: 245027 - DNA, 25 bp, Mus musculus
agtgccggaggagtcttcgatatcc

SEQ ID NO: 245028 - DNA, 25 bp, Mus musculus
tagggaagcaatggccgctgacggt

SEQ ID NO: 245029 - DNA, 25 bp, Mus musculus
gtggcatggatcgaaacgcggagcc

SEQ ID NO: 245030 - DNA, 25 bp, Mus musculus
cttcacggaggcgtagggaagcaat

SEQ ID NO: 245031 - DNA, 25 bp, Mus musculus
gccggaaatcgagtgcgccttggcc

SEQ ID NO: 245032 - DNA, 25 bp, Mus musculus
ggcgtcactcgtcggcgccggaaat

SEQ ID NO: 245033 - DNA, 25 bp, Mus musculus
cgtctccggcgtgcgtggcgtcact

SEQ ID NO: 245034 - DNA, 25 bp, Mus musculus
gcgtcagttccgtcgtctccggcgt

SEQ ID NO: 245035 - DNA, 25 bp, Mus musculus
aaagcacggcctgacagcgcgtcgc

SEQ ID NO: 245036 - DNA, 25 bp, Mus musculus
gccagcagcaaagcacggcctgaca

SEQ ID NO: 245037 - DNA, 25 bp, Mus musculus
gacttcccgcaaggcgccagcagca

SEQ ID NO: 245038 - DNA, 25 bp, Mus musculus
tccatggcttcctcgagcgacttcc

SEQ ID NO: 245039 - DNA, 25 bp, Mus musculus
gctctgttgacacactcaccaccgt

SEQ ID NO: 245040 - DNA, 25 bp, Mus musculus
agctcaggctgccagtgcggaggcc

SEQ ID NO: 245041 - DNA, 25 bp, Mus musculus
ttctcgcgcgtcagttccgtcgtct

SEQ ID NO: 245042 - DNA, 25 bp, Mus musculus
gctgagcgaggcagcgccgccatgg

SEQ ID NO: 245043 - DNA, 25 bp, Mus musculus
cgagaagggcctggtgcagttccga

SEQ ID NO: 245044 - DNA, 25 bp, Mus musculus
ctacgagtgtctgagcgcgctgggc

SEQ ID NO: 245045 - DNA, 25 bp, Mus musculus
ctgcagtcgggcacggcctacgagt

SEQ ID NO: 245046 - DNA, 25 bp, Mus musculus
tcttcctgcagtcgggcacggccta

SEQ ID NO: 245047 - DNA, 25 bp, Mus musculus
gcagctcttcctgcagtcgggcacg

SEQ ID NO: 245048 - DNA, 25 bp, Mus musculus
ggtcccagggctgggtgccgctaaa

SEQ ID NO: 245049 - DNA, 25 bp, Mus musculus
atgtgcctggcgcagctcttcctgc

SEQ ID NO: 245050 - DNA, 25 bp, Mus musculus
gagcatgtgcctggcgcagctcttc

SEQ ID NO: 245051 - DNA, 25 bp, Mus musculus
tgccgctaaagcaggctggcaccgc

SEQ ID NO: 245052 - DNA, 25 bp, Mus musculus
atgggctctctcttccgcagcgaga

SEQ ID NO: 245053 - DNA, 25 bp, Mus musculus
tgcagttccgagacgtgagtgtccc

SEQ ID NO: 245054 - DNA, 25 bp, Mus musculus
agacgtgagtgtccccgcggcctgc

SEQ ID NO: 245055 - DNA, 25 bp, Mus musculus
ttccgcagcgagagcatgtgcctgg

SEQ ID NO: 245056 - DNA, 25 bp, Mus musculus
tagggtcgccgttgccacggacgcc

SEQ ID NO: 245057 - DNA, 25 bp, Mus musculus
gctccctgcccagtctgttctgcgc

SEQ ID NO: 245058 - DNA, 25 bp, Mus musculus
cgctgctcaggtctgcgccatggac

SEQ ID NO: 245059 - DNA, 25 bp, Mus musculus
gccatggacgacctgcgggtcctgt

SEQ ID NO: 245060 - DNA, 25 bp, Mus musculus
ctgtggatgcgcgaccgcgtataca

SEQ ID NO: 245061 - DNA, 25 bp, Mus musculus
gcgaccgcgtatacactgccttcaa

SEQ ID NO: 245062 - DNA, 25 bp, Mus musculus
ctattcgaggagatgctgagccgtg

SEQ ID NO: 245063 - DNA, 25 bp, Mus musculus
agatgctgagccgtgatgacagcga

SEQ ID NO: 245064 - DNA, 25 bp, Mus musculus
ggcggaggactgcatcttgcacttc

SEQ ID NO: 245065 - DNA, 25 bp, Mus musculus
ttgcacttcctcaaccacttgagtg

SEQ ID NO: 245066 - DNA, 25 bp, Mus musculus
ccacttgagtgacgaggacaacgcc

SEQ ID NO: 245067 - DNA, 25 bp, Mus musculus
ggacaacgcctctgcgctgttcttc

SEQ ID NO: 245068 - DNA, 25 bp, Mus musculus
accaaccctatgctattcgaggaga

SEQ ID NO: 245069 - DNA, 25 bp, Mus musculus
cccgttgctagggtcgccgttgcca

SEQ ID NO: 245070 - DNA, 25 bp, Mus musculus
aagggatgttagttagcaacacgca

SEQ ID NO: 245071 - DNA, 25 bp, Mus musculus
tgagtctctcggcttttcaggccgg

SEQ ID NO: 245072 - DNA, 25 bp, Mus musculus
tgcgtttgagtctctcggcttttca

SEQ ID NO: 245073 - DNA, 25 bp, Mus musculus
accggagtcggtgcgtttgagtctc

SEQ ID NO: 245074 - DNA, 25 bp, Mus musculus
agtccgaggcctggacgcgctcctc

SEQ ID NO: 245075 - DNA, 25 bp, Mus musculus
tgtctccctcggaaggagagagaga

SEQ ID NO: 245076 - DNA, 25 bp, Mus musculus
cacctgtgaggtgtctccctcggaa

SEQ ID NO: 245077 - DNA, 25 bp, Mus musculus
ccatcctcccggaggcgtctgggtg

SEQ ID NO: 245078 - DNA, 25 bp, Mus musculus
actgctcaggtgcggccgcactgcg

SEQ ID NO: 245079 - DNA, 25 bp, Mus musculus
tgttagttagcaacacgcaagcgca

SEQ ID NO: 245080 - DNA, 25 bp, Mus musculus
ctctcggcttttcaggccggggcgt

SEQ ID NO: 245081 - DNA, 25 bp, Mus musculus
ctcggagacgcacctgtgaggtgtc

SEQ ID NO: 245082 - DNA, 25 bp, Mus musculus
gttagcaacacgcaagcgcactgct

SEQ ID NO: 245083 - DNA, 25 bp, Mus musculus
cactgcggttgcccggggtaaccag

SEQ ID NO: 245084 - DNA, 25 bp, Mus musculus
acaagatcttctacgctccagtgcc

SEQ ID NO: 245085 - DNA, 25 bp, Mus musculus
ggcactggtactcctccagcctgca

SEQ ID NO: 245086 - DNA, 25 bp, Mus musculus
ctcggccagcctcggcactggtact

SEQ ID NO: 245087 - DNA, 25 bp, Mus musculus
ccctgcactgcagcctcggccagcc

SEQ ID NO: 245088 - DNA, 25 bp, Mus musculus
gctccttccgcaccaccctgcactg

SEQ ID NO: 245089 - DNA, 25 bp, Mus musculus
aaactggcccgcagctccttccgca

SEQ ID NO: 245090 - DNA, 25 bp, Mus musculus
ggttcgggagcaccgccatcatctt

SEQ ID NO: 245091 - DNA, 25 bp, Mus musculus
agctgaccctggagcctcgcccacg

SEQ ID NO: 245092 - DNA, 25 bp, Mus musculus
ctggcggagctaccgcagccagctg

SEQ ID NO: 245093 - DNA, 25 bp, Mus musculus
agtggcggcgcccaactgcacctgg

SEQ ID NO: 245094 - DNA, 25 bp, Mus musculus
tgagaccatagtggcggcgcccaac

SEQ ID NO: 245095 - DNA, 25 bp, Mus musculus
cacggcctacagtgagaccatagtg

SEQ ID NO: 245096 - DNA, 25 bp, Mus musculus
cgagacaagatcttctacgctccag

SEQ ID NO: 245097 - DNA, 25 bp, Mus musculus
agtgcccacggtcacggcctacagt

SEQ ID NO: 245098 - DNA, 25 bp, Mus musculus
ccctttcgtgagcaatttgacgcgt

SEQ ID NO: 245099 - DNA, 25 bp, Mus musculus
atgtcttaccgtcgccaggggagtc

SEQ ID NO: 245100 - DNA, 25 bp, Mus musculus
cttaccgtcgccaggggagtcgttg

SEQ ID NO: 245101 - DNA, 25 bp, Mus musculus
agtcgttggccagcgaacctccttc

SEQ ID NO: 245102 - DNA, 25 bp, Mus musculus
tcgtgagcaatttgacgcgtgatta

SEQ ID NO: 245103 - DNA, 25 bp, Mus musculus
gcgtctatgaacgtggccgctgtca

SEQ ID NO: 245104 - DNA, 25 bp, Mus musculus
cgctgtcagggtggtcttacccaga

SEQ ID NO: 245105 - DNA, 25 bp, Mus musculus
gtcttacccagagaacggagttcca

SEQ ID NO: 245106 - DNA, 25 bp, Mus musculus
cggagttccaattcctggatggaaa

SEQ ID NO: 245107 - DNA, 25 bp, Mus musculus
actttgagtcttttctcggtgcaga

SEQ ID NO: 245108 - DNA, 25 bp, Mus musculus
tttctcggtgcagatctgaggccga

SEQ ID NO: 245109 - DNA, 25 bp, Mus musculus
atggccagcgtccacacggggccgc

SEQ ID NO: 245110 - DNA, 25 bp, Mus musculus
cgggccggatgtcttaccgtcgcca

SEQ ID NO: 245111 - DNA, 25 bp, Mus musculus
cgcgtgattattgcgtctatgaacg

SEQ ID NO: 245112 - DNA, 25 bp, Mus musculus
gtcgcctccgcaccgctcccattcc

SEQ ID NO: 245113 - DNA, 25 bp, Mus musculus
cctctagcctgctggcgagctcttt

SEQ ID NO: 245114 - DNA, 25 bp, Mus musculus
gctctgccgccctctagcctgctgg

SEQ ID NO: 245115 - DNA, 25 bp, Mus musculus
gtgggtgcagcaagactgggcagag

SEQ ID NO: 245116 - DNA, 25 bp, Mus musculus
cagcttctctccttcttggaacccg

SEQ ID NO: 245117 - DNA, 25 bp, Mus musculus
cccgcagcttctctccttcttggaa

SEQ ID NO: 245118 - DNA, 25 bp, Mus musculus
tccacggtgcgcagccggccggcca

SEQ ID NO: 245119 - DNA, 25 bp, Mus musculus
attgcttcctgctccacggtgcgca

SEQ ID NO: 245120 - DNA, 25 bp, Mus musculus
ccagattgcttcctgctccacggtg

SEQ ID NO: 245121 - DNA, 25 bp, Mus musculus
ccgcaattaagtcggctggcggagc

SEQ ID NO: 245122 - DNA, 25 bp, Mus musculus
gcctgctggcgagctctttggcgcc

SEQ ID NO: 245123 - DNA, 25 bp, Mus musculus
cagattgcttcctgctccacggtgc

SEQ ID NO: 245124 - DNA, 25 bp, Mus musculus
gactccgcaattaagtcggctggcg

SEQ ID NO: 245125 - DNA, 25 bp, Mus musculus
cggactccgcaattaagtcggctgg

SEQ ID NO: 245126 - DNA, 25 bp, Mus musculus
tttcctgaaagagccgccagagtct

SEQ ID NO: 245127 - DNA, 25 bp, Mus musculus
acccgctggcaacgtaagcgctgga

SEQ ID NO: 245128 - DNA, 25 bp, Mus musculus
tggagaccctgacgcccagcagtaa

SEQ ID NO: 245129 - DNA, 25 bp, Mus musculus
gtaaaaaagtggcactgcccgccga

SEQ ID NO: 245130 - DNA, 25 bp, Mus musculus
ccctacagagcggttcggagatttc

SEQ ID NO: 245131 - DNA, 25 bp, Mus musculus
agtctgagctctcagggcgcgaccg

SEQ ID NO: 245132 - DNA, 25 bp, Mus musculus
agcccgttgccgtgagggttacacg

SEQ ID NO: 245133 - DNA, 25 bp, Mus musculus
ttacacggcaggaggttcatggcgc

SEQ ID NO: 245134 - DNA, 25 bp, Mus musculus
gactgtggctcctcagcaccgcata

SEQ ID NO: 245135 - DNA, 25 bp, Mus musculus
gtcgtcagtgctgcgtcatcagtgc

SEQ ID NO: 245136 - DNA, 25 bp, Mus musculus
cgcaaccagcaagcgccgagggaca

SEQ ID NO: 245137 - DNA, 25 bp, Mus musculus
acagacgcgtccactgcagggaagt

SEQ ID NO: 245138 - DNA, 25 bp, Mus musculus
ggtgccagccgcaagaaccacgaca

SEQ ID NO: 245139 - DNA, 25 bp, Mus musculus
tctcaccgtggtcctggttgaagcc

SEQ ID NO: 245140 - DNA, 25 bp, Mus musculus
gagtcctggccctctccaaaacaag

SEQ ID NO: 245141 - DNA, 25 bp, Mus musculus
ctgcaaggtcccgagagttcccgaa

SEQ ID NO: 245142 - DNA, 25 bp, Mus musculus
tcaggttgtgccaccctacatggtc

SEQ ID NO: 245143 - DNA, 25 bp, Mus musculus
gcagggctaccagtcctcaggttgt

SEQ ID NO: 245144 - DNA, 25 bp, Mus musculus
cggcctgtgattccctgcagggcta

SEQ ID NO: 245145 - DNA, 25 bp, Mus musculus
cggggctactttatcccagaggatc

SEQ ID NO: 245146 - DNA, 25 bp, Mus musculus
ctaaagagtctccaggtccggggct

SEQ ID NO: 245147 - DNA, 25 bp, Mus musculus
gggtcttagctcgtgccatctcaga

SEQ ID NO: 245148 - DNA, 25 bp, Mus musculus
tcgggtcctgacctgaatctccctg

SEQ ID NO: 245149 - DNA, 25 bp, Mus musculus
ggggcctggccttcaaaacatacca

SEQ ID NO: 245150 - DNA, 25 bp, Mus musculus
cgccacaacagagggtccatgagtc

SEQ ID NO: 245151 - DNA, 25 bp, Mus musculus
agaatcccggttctcaggctgcgcc

SEQ ID NO: 245152 - DNA, 25 bp, Mus musculus
ggtcccaagtcctagagctgcgcca

SEQ ID NO: 245153 - DNA, 25 bp, Mus musculus
cgggtcctggcctaaactgcaagca

SEQ ID NO: 245154 - DNA, 25 bp, Mus musculus
gacgggatttggatgagctcacgct

SEQ ID NO: 245155 - DNA, 25 bp, Mus musculus
ttaggcgagccaacccgatctttct

SEQ ID NO: 245156 - DNA, 25 bp, Mus musculus
aacccgatctttctctgagctcagc

SEQ ID NO: 245157 - DNA, 25 bp, Mus musculus
ctgcctctgccttacgccgtgggga

SEQ ID NO: 245158 - DNA, 25 bp, Mus musculus
ggaggctggcgtcataaatgagcca

SEQ ID NO: 245159 - DNA, 25 bp, Mus musculus
cgtcataaatgagccactgtgatcc

SEQ ID NO: 245160 - DNA, 25 bp, Mus musculus
cccagcctcagatgtgtctcctgga

SEQ ID NO: 245161 - DNA, 25 bp, Mus musculus
gcggctcagacaatagacgggattt

SEQ ID NO: 245162 - DNA, 25 bp, Mus musculus
agctcacgctgtggcgggcacctta

SEQ ID NO: 245163 - DNA, 25 bp, Mus musculus
gggcaccttagacgcgccatgaatc

SEQ ID NO: 245164 - DNA, 25 bp, Mus musculus
tagacgcgccatgaatcacgacacg

SEQ ID NO: 245165 - DNA, 25 bp, Mus musculus
ctcctctggggattaggcgagccaa

SEQ ID NO: 245166 - DNA, 25 bp, Mus musculus
gcgctctggctcctctggggattag

SEQ ID NO: 245167 - DNA, 25 bp, Mus musculus
atgtgtctcctggagcggctcagac

SEQ ID NO: 245168 - DNA, 25 bp, Mus musculus
tatgcaagcaacacggaaggacggc

SEQ ID NO: 245169 - DNA, 25 bp, Mus musculus
gggtgacaacgttctattccactga

SEQ ID NO: 245170 - DNA, 25 bp, Mus musculus
acgtcagttttacgcttgatatatc

SEQ ID NO: 245171 - DNA, 25 bp, Mus musculus
cgttctattccactgacattatctc

SEQ ID NO: 245172 - DNA, 25 bp, Mus musculus
tatctcttaattacaatatgcaagc

SEQ ID NO: 245173 - DNA, 25 bp, Mus musculus
ccataaatagatcatttggggtttc

SEQ ID NO: 245174 - DNA, 25 bp, Mus musculus
gccgttactgggtgacaacgttcta

SEQ ID NO: 245175 - DNA, 25 bp, Mus musculus
tgactttgccgtgacatttccgagg

SEQ ID NO: 245176 - DNA, 25 bp, Mus musculus
cgcttgatatatctgtgactttgcc

SEQ ID NO: 245177 - DNA, 25 bp, Mus musculus
aggatccgcgttccctgctctgaaa

SEQ ID NO: 245178 - DNA, 25 bp, Mus musculus
tatcgctgtcccaggatccgcgttc

SEQ ID NO: 245179 - DNA, 25 bp, Mus musculus
gcagctgtatcgctgtcccaggatc

SEQ ID NO: 245180 - DNA, 25 bp, Mus musculus
cacgagccgagctgcacaccgaggg

SEQ ID NO: 245181 - DNA, 25 bp, Mus musculus
tccgcgttccctgctctgaaaacaa

SEQ ID NO: 245182 - DNA, 25 bp, Mus musculus
ctctcggggctcaggacctgaagga

SEQ ID NO: 245183 - DNA, 25 bp, Mus musculus
cgccgagcgcagcaaacagcagccc

SEQ ID NO: 245184 - DNA, 25 bp, Mus musculus
ccagaggctttatgcgccatggccc

SEQ ID NO: 245185 - DNA, 25 bp, Mus musculus
tgccgcccatgtccgcgtgcgcgga

SEQ ID NO: 245186 - DNA, 25 bp, Mus musculus
ctttatgcgccatggcccgggcagc

SEQ ID NO: 245187 - DNA, 25 bp, Mus musculus
tcaggacctgaaggagacggagaca

SEQ ID NO: 245188 - DNA, 25 bp, Mus musculus
tgacggaggccacagagatgacaga

SEQ ID NO: 245189 - DNA, 25 bp, Mus musculus
cggaggccacagagatgacagaagc

SEQ ID NO: 245190 - DNA, 25 bp, Mus musculus
agagatgacagaagccgagactccc

SEQ ID NO: 245191 - DNA, 25 bp, Mus musculus
gaagccgagactccctcagcagcaa

SEQ ID NO: 245192 - DNA, 25 bp, Mus musculus
tggccggagcagcagtagccctgca

SEQ ID NO: 245193 - DNA, 25 bp, Mus musculus
agcagtagccctgcaggtggccaga

SEQ ID NO: 245194 - DNA, 25 bp, Mus musculus
ctgcaggtggccagaggctttatgc

SEQ ID NO: 245195 - DNA, 25 bp, Mus musculus
ccaaggccacccagcgcgccctgga

SEQ ID NO: 245196 - DNA, 25 bp, Mus musculus
gatcgcacttccgtctttcagcaaa

SEQ ID NO: 245197 - DNA, 25 bp, Mus musculus
tacggcgcgcaaccctaattcagtc

SEQ ID NO: 245198 - DNA, 25 bp, Mus musculus
aggcttccatctggccgccatcttg

SEQ ID NO: 245199 - DNA, 25 bp, Mus musculus
ggctttctcctcaccagcggtggtg

SEQ ID NO: 245200 - DNA, 25 bp, Mus musculus
tggcggcagtcctcacacagcagac

SEQ ID NO: 245201 - DNA, 25 bp, Mus musculus
ggaactcgcagtctccacggaacta

SEQ ID NO: 245202 - DNA, 25 bp, Mus musculus
cgcccggcgtctctttatatagtca

SEQ ID NO: 245203 - DNA, 25 bp, Mus musculus
atgcggtcagggactactttgtaac

SEQ ID NO: 245204 - DNA, 25 bp, Mus musculus
tccagtctcggcagcgaaagcgaca

SEQ ID NO: 245205 - DNA, 25 bp, Mus musculus
gcgacaggctaaaactatcaaggta

SEQ ID NO: 245206 - DNA, 25 bp, Mus musculus
acggctctcacagcagaggctccta

SEQ ID NO: 245207 - DNA, 25 bp, Mus musculus
tcggcacgaaaacacggctgggatc

SEQ ID NO: 245208 - DNA, 25 bp, Mus musculus
ttgtttcacggtggcgtccagagat

SEQ ID NO: 245209 - DNA, 25 bp, Mus musculus
acctctctcacggagttgtttcacg

SEQ ID NO: 245210 - DNA, 25 bp, Mus musculus
ccatatcgcggtagagcggctgtca

SEQ ID NO: 245211 - DNA, 25 bp, Mus musculus
agacttccgggttgcgcatgcgcaa

SEQ ID NO: 245212 - DNA, 25 bp, Mus musculus
tactctgtctgtgggcggtccttat

SEQ ID NO: 245213 - DNA, 25 bp, Mus musculus
cctcagcagttgaggggcggaactg

SEQ ID NO: 245214 - DNA, 25 bp, Mus musculus
ctgtgggcggtccttatgtaaataa

SEQ ID NO: 245215 - DNA, 25 bp, Mus musculus
ccctgtgcgggtcatgtggaacccg

SEQ ID NO: 245216 - DNA, 25 bp, Mus musculus
cgggtcatgtggaacccggctccca

SEQ ID NO: 245217 - DNA, 25 bp, Mus musculus
cctccagttccagccgtacgggagg

SEQ ID NO: 245218 - DNA, 25 bp, Mus musculus
gttccagccgtacgggaggcgcttc

SEQ ID NO: 245219 - DNA, 25 bp, Mus musculus
cccttcacgttgtagcggcgtcgca

SEQ ID NO: 245220 - DNA, 25 bp, Mus musculus
cgttgtagcggcgtcgcagcttccc

SEQ ID NO: 245221 - DNA, 25 bp, Mus musculus
cagggaaaccgaacctggctaggag

SEQ ID NO: 245222 - DNA, 25 bp, Mus musculus
cgaacctggctaggagacttccggg

SEQ ID NO: 245223 - DNA, 25 bp, Mus musculus
gaaaaggccggcgtactctgtctgt

SEQ ID NO: 245224 - DNA, 25 bp, Mus musculus
tggggaggtgacacacctgtccttc

SEQ ID NO: 245225 - DNA, 25 bp, Mus musculus
cctgtccttcagtgttttcaaacgc

SEQ ID NO: 245226 - DNA, 25 bp, Mus musculus
ttcaaacgcttgcaaggatccggcc

SEQ ID NO: 245227 - DNA, 25 bp, Mus musculus
cccgatcaggagtgatcctgtgcaa

SEQ ID NO: 245228 - DNA, 25 bp, Mus musculus
atcaggagtgatcctgtgcaagccc

SEQ ID NO: 245229 - DNA, 25 bp, Mus musculus
gtgcagcagagttgatactatcagc

SEQ ID NO: 245230 - DNA, 25 bp, Mus musculus
tgcggacaagaacagccaccggcgc

SEQ ID NO: 245231 - DNA, 25 bp, Mus musculus
agagcgtgagcagcctcttcggaga

SEQ ID NO: 245232 - DNA, 25 bp, Mus musculus
cctcttcggagaggacaacgtgcgc

SEQ ID NO: 245233 - DNA, 25 bp, Mus musculus
tccgcgccgcctgcttttggggtgt

SEQ ID NO: 245234 - DNA, 25 bp, Mus musculus
ggtcgaccactatgagccaggcact

SEQ ID NO: 245235 - DNA, 25 bp, Mus musculus
ctgcggtgtgcagcagagttgatac

SEQ ID NO: 245236 - DNA, 25 bp, Mus musculus
gccgcgtctcaatggtcgaccacta

SEQ ID NO: 245237 - DNA, 25 bp, Mus musculus
ctatcagcttcaagggtacagggga

SEQ ID NO: 245238 - DNA, 25 bp, Mus musculus
attcttattgggcacgcccttaccg

SEQ ID NO: 245239 - DNA, 25 bp, Mus musculus
aatcaacgcgccaatcgcgtgtggc

SEQ ID NO: 245240 - DNA, 25 bp, Mus musculus
agtcccgcaccagccaatcaacgcg

SEQ ID NO: 245241 - DNA, 25 bp, Mus musculus
ctgatgtggggccagtcccgcacca

SEQ ID NO: 245242 - DNA, 25 bp, Mus musculus
tgtggcgcgtgcctatgctcagaat

SEQ ID NO: 245243 - DNA, 25 bp, Mus musculus
tggttgtcattcaggccggttcttc

SEQ ID NO: 245244 - DNA, 25 bp, Mus musculus
ggaatggcatgtgattggttgtcat

SEQ ID NO: 245245 - DNA, 25 bp, Mus musculus
ccctctgcctaattcttattgggca

SEQ ID NO: 245246 - DNA, 25 bp, Mus musculus
ccaatcgcgtgtggcgcgtgcctat

SEQ ID NO: 245247 - DNA, 25 bp, Mus musculus
ccacgcgcaggaatggcatgtgatt

SEQ ID NO: 245248 - DNA, 25 bp, Mus musculus
agagatgcagcccacgcgcaggaat

SEQ ID NO: 245249 - DNA, 25 bp, Mus musculus
tgctcagaatccctccgccgggatg

SEQ ID NO: 245250 - DNA, 25 bp, Mus musculus
cccttcaggattggctgagagatgc

SEQ ID NO: 245251 - DNA, 25 bp, Mus musculus
aagcggcgcctaacctccctgggct

SEQ ID NO: 245252 - DNA, 25 bp, Mus musculus
aggacacgcagatggaccgcttccg

SEQ ID NO: 245253 - DNA, 25 bp, Mus musculus
tgacagcaagaaggacacgcagatg

SEQ ID NO: 245254 - DNA, 25 bp, Mus musculus
tgatgtgggagcctgacagcaagaa

SEQ ID NO: 245255 - DNA, 25 bp, Mus musculus
aaccatgtccaagctggcgcggctc

SEQ ID NO: 245256 - DNA, 25 bp, Mus musculus
ttcagtctcgcgctgtggttcgtcg

SEQ ID NO: 245257 - DNA, 25 bp, Mus musculus
tgaccaggccggatgtcccacaggc

SEQ ID NO: 245258 - DNA, 25 bp, Mus musculus
gtggtctcaagaggcgtggctttct

SEQ ID NO: 245259 - DNA, 25 bp, Mus musculus
caagcgcaccttttgcaggcgcggc

SEQ ID NO: 245260 - DNA, 25 bp, Mus musculus
ggcactctttttggcagcaagcgca

SEQ ID NO: 245261 - DNA, 25 bp, Mus musculus
ctgcgcaggcgaggcactctttttg

SEQ ID NO: 245262 - DNA, 25 bp, Mus musculus
cgtggaacatgcttatcgcgcctgc

SEQ ID NO: 245263 - DNA, 25 bp, Mus musculus
ggttcgtcggcgcaccgctgatccg

SEQ ID NO: 245264 - DNA, 25 bp, Mus musculus
agctccgcaaccatgtccaagctgg

SEQ ID NO: 245265 - DNA, 25 bp, Mus musculus
gccggcgctggttcagtctcgcgct

SEQ ID NO: 245266 - DNA, 25 bp, Mus musculus
tccgctgcgcaggtaacgcggccgc

SEQ ID NO: 245267 - DNA, 25 bp, Mus musculus
aactccggccaagtgcagggcgggc

SEQ ID NO: 245268 - DNA, 25 bp, Mus musculus
agcgcgctccgctgcgcaggtaacg

SEQ ID NO: 245269 - DNA, 25 bp, Mus musculus
ttgctgcctgggtcccaagtcccgg

SEQ ID NO: 245270 - DNA, 25 bp, Mus musculus
aagttgctgcctgggtcccaagtcc

SEQ ID NO: 245271 - DNA, 25 bp, Mus musculus
aaagttgctgcctgggtcccaagtc

SEQ ID NO: 245272 - DNA, 25 bp, Mus musculus
caaagttgctgcctgggtcccaagt

SEQ ID NO: 245273 - DNA, 25 bp, Mus musculus
gagcgcgctccgctgcgcaggtaac

SEQ ID NO: 245274 - DNA, 25 bp, Mus musculus
cgcaactccggccaagtgcagggcg

SEQ ID NO: 245275 - DNA, 25 bp, Mus musculus
cccgcgcgcaaagttgctgcctggg

SEQ ID NO: 245276 - DNA, 25 bp, Mus musculus
cgcaaagttgctgcctgggtcccaa

SEQ ID NO: 245277 - DNA, 25 bp, Mus musculus
gcgcgcaaagttgctgcctgggtcc

SEQ ID NO: 245278 - DNA, 25 bp, Mus musculus
cggctcccgggaggaccatgcgggc

SEQ ID NO: 245279 - DNA, 25 bp, Mus musculus
ctcgctcactctcgcgctggctgga

SEQ ID NO: 245280 - DNA, 25 bp, Mus musculus
gactccgtccacagagcgcagtctt

SEQ ID NO: 245281 - DNA, 25 bp, Mus musculus
cagggagctcatcatgccggcccag

SEQ ID NO: 245282 - DNA, 25 bp, Mus musculus
agtagaaaatcgtaggcccgcaccg

SEQ ID NO: 245283 - DNA, 25 bp, Mus musculus
tcgcccaccaacaggaacttaagta

SEQ ID NO: 245284 - DNA, 25 bp, Mus musculus
cgtcctgcaagctggccaggatctc

SEQ ID NO: 245285 - DNA, 25 bp, Mus musculus
agactcggctgctccgtcctgcaag

SEQ ID NO: 245286 - DNA, 25 bp, Mus musculus
agcatgcggttcctagccctgccca

SEQ ID NO: 245287 - DNA, 25 bp, Mus musculus
agctgctttgcggactccgtccaca

SEQ ID NO: 245288 - DNA, 25 bp, Mus musculus
tcgacgaccaccctgagctgctttg

SEQ ID NO: 245289 - DNA, 25 bp, Mus musculus
tagcacctgcgatgtccctcgacga

SEQ ID NO: 245290 - DNA, 25 bp, Mus musculus
gaacacgtagctagcacctgcgatg

SEQ ID NO: 245291 - DNA, 25 bp, Mus musculus
cacttctccgaacacgtagctagca

SEQ ID NO: 245292 - DNA, 25 bp, Mus musculus
tgcccacgcctcctgtaatcccaca

SEQ ID NO: 245293 - DNA, 25 bp, Mus musculus
tggccgtaaggagactcggctgctc

SEQ ID NO: 245294 - DNA, 25 bp, Mus musculus
cggactcatccatcttcctcaaatt

SEQ ID NO: 245295 - DNA, 25 bp, Mus musculus
ggcggcagctggctaggtcctctcc

SEQ ID NO: 245296 - DNA, 25 bp, Mus musculus
gacccgcggctttgtgaaagtttgc

SEQ ID NO: 245297 - DNA, 25 bp, Mus musculus
ttcagtcactttctcgcgcgcgggc

SEQ ID NO: 245298 - DNA, 25 bp, Mus musculus
aatgcagattgatgaggccggaccc

SEQ ID NO: 245299 - DNA, 25 bp, Mus musculus
ttcctcaaattacgcttcacttgct

SEQ ID NO: 245300 - DNA, 25 bp, Mus musculus
agcgtccagcgctccgtcagtgcgc

SEQ ID NO: 245301 - DNA, 25 bp, Mus musculus
gcagcgcagtggtcagcgccaccat

SEQ ID NO: 245302 - DNA, 25 bp, Mus musculus
tggtcagcgccaccatcgagggcac

SEQ ID NO: 245303 - DNA, 25 bp, Mus musculus
agccccgcgcagaaggtattgctca

SEQ ID NO: 245304 - DNA, 25 bp, Mus musculus
ctctctcgctcataaggagggaggg

SEQ ID NO: 245305 - DNA, 25 bp, Mus musculus
cctgcggcaacacgagcggccggta

SEQ ID NO: 245306 - DNA, 25 bp, Mus musculus
gccgcgctctctcgctcataaggag

SEQ ID NO: 245307 - DNA, 25 bp, Mus musculus
gcggcccaaccaactattattaatg

SEQ ID NO: 245308 - DNA, 25 bp, Mus musculus
cgggaacctctctggcacacaagca

SEQ ID NO: 245309 - DNA, 25 bp, Mus musculus
gctcgctgctgcttaaggtcgctaa

SEQ ID NO: 245310 - DNA, 25 bp, Mus musculus
tttctggagacttgtgcaaaccggc

SEQ ID NO: 245311 - DNA, 25 bp, Mus musculus
tccggactctgcaggtttctggaga

SEQ ID NO: 245312 - DNA, 25 bp, Mus musculus
tggcattgaaagcatcggaccgctc

SEQ ID NO: 245313 - DNA, 25 bp, Mus musculus
acctgagactttccgccctacatta

SEQ ID NO: 245314 - DNA, 25 bp, Mus musculus
ttctacattgggctacacacccggg

SEQ ID NO: 245315 - DNA, 25 bp, Mus musculus
gggctacaccttgacttctacattg

SEQ ID NO: 245316 - DNA, 25 bp, Mus musculus
ttagagtcagtgctagggatcctcc

SEQ ID NO: 245317 - DNA, 25 bp, Mus musculus
gcctcagcttggagcattagagtca

SEQ ID NO: 245318 - DNA, 25 bp, Mus musculus
agcctccatctacggaaacagcgga

SEQ ID NO: 245319 - DNA, 25 bp, Mus musculus
ctagccacgctactgggccaaggta

SEQ ID NO: 245320 - DNA, 25 bp, Mus musculus
ccgcggctgcaacccgagaaaagtt

SEQ ID NO: 245321 - DNA, 25 bp, Mus musculus
ttattactcttctgtgagcccggtc

SEQ ID NO: 245322 - DNA, 25 bp, Mus musculus
cccgaacggcgagcccagataggtg

SEQ ID NO: 245323 - DNA, 25 bp, Mus musculus
actctcgcgagacagcgagttccct

SEQ ID NO: 245324 - DNA, 25 bp, Mus musculus
gaggactcggtagcccaactctcgc

SEQ ID NO: 245325 - DNA, 25 bp, Mus musculus
ctccatggccggttcactgaggact

SEQ ID NO: 245326 - DNA, 25 bp, Mus musculus
aacagcaccaggttggccgtgacgc

SEQ ID NO: 245327 - DNA, 25 bp, Mus musculus
aacggcgcgccattcaggaacagca

SEQ ID NO: 245328 - DNA, 25 bp, Mus musculus
cgccgccttttaactgggcaagctg

SEQ ID NO: 245329 - DNA, 25 bp, Mus musculus
cgccgagcagttgcgcacgagctcg

SEQ ID NO: 245330 - DNA, 25 bp, Mus musculus
acacgacgctgacccgttggggaag

SEQ ID NO: 245331 - DNA, 25 bp, Mus musculus
gcgttctcgggacacgacgctgacc

SEQ ID NO: 245332 - DNA, 25 bp, Mus musculus
cgtgatgttggccttgaccgtggcc

SEQ ID NO: 245333 - DNA, 25 bp, Mus musculus
caacgcttaggttcgggtagccgtg

SEQ ID NO: 245334 - DNA, 25 bp, Mus musculus
tgaggcccatgaagagcagcagcgc

SEQ ID NO: 245335 - DNA, 25 bp, Mus musculus
cccagataggtgaggcccatgaaga

SEQ ID NO: 245336 - DNA, 25 bp, Mus musculus
cacgtggctggaaagacgcagagtc

SEQ ID NO: 245337 - DNA, 25 bp, Mus musculus
cggctcctgttcctggcagtactga

SEQ ID NO: 245338 - DNA, 25 bp, Mus musculus
tccgagttccgtggctgctgccatt

SEQ ID NO: 245339 - DNA, 25 bp, Mus musculus
atgctccagcacgtgcggagattca

SEQ ID NO: 245340 - DNA, 25 bp, Mus musculus
gagtcccggtgcatcggatgctcca

SEQ ID NO: 245341 - DNA, 25 bp, Mus musculus
ggcctcgctgcagacttgagctttg

SEQ ID NO: 245342 - DNA, 25 bp, Mus musculus
tgagtgccctaggatgccgcaaaga

SEQ ID NO: 245343 - DNA, 25 bp, Mus musculus
ctgctgccctgtctggctattgtga

SEQ ID NO: 245344 - DNA, 25 bp, Mus musculus
tcacactggcaacgcggtcacagct

SEQ ID NO: 245345 - DNA, 25 bp, Mus musculus
cagttcttggcggtagcgacgacat

SEQ ID NO: 245346 - DNA, 25 bp, Mus musculus
aacagcaggcgggaccgaatccacc

SEQ ID NO: 245347 - DNA, 25 bp, Mus musculus
tggcagtactgaggcctcacactgg

SEQ ID NO: 245348 - DNA, 25 bp, Mus musculus
cgcctacggtatgttgcggggacct

SEQ ID NO: 245349 - DNA, 25 bp, Mus musculus
agctctgattccagctgcctgctgc

SEQ ID NO: 245350 - DNA, 25 bp, Mus musculus
ctcagtctttcgactgcgctgagga

SEQ ID NO: 245351 - DNA, 25 bp, Mus musculus
gggacccggggcacatagccttgcc

SEQ ID NO: 245352 - DNA, 25 bp, Mus musculus
gcggctgcatccgagcgcacccaga

SEQ ID NO: 245353 - DNA, 25 bp, Mus musculus
gtgccgggtccccacaggtccatag

SEQ ID NO: 245354 - DNA, 25 bp, Mus musculus
gcgctgcggctccacccaagccggc

SEQ ID NO: 245355 - DNA, 25 bp, Mus musculus
cccaagcatggagagcgctctgagg

SEQ ID NO: 245356 - DNA, 25 bp, Mus musculus
gaattgaatttcactccacaagggg

SEQ ID NO: 245357 - DNA, 25 bp, Mus musculus
aggactggctcgtgaattgaatttc

SEQ ID NO: 245358 - DNA, 25 bp, Mus musculus
cgcacccagagcagcgtgcccaggc

SEQ ID NO: 245359 - DNA, 25 bp, Mus musculus
ctttcgactgcgctgaggactggct

SEQ ID NO: 245360 - DNA, 25 bp, Mus musculus
catggagagcgctctgaggactccg

SEQ ID NO: 245361 - DNA, 25 bp, Mus musculus
gcaggccgaggctcacctcagtctt

SEQ ID NO: 245362 - DNA, 25 bp, Mus musculus
aggtccatagccaggccgctcaggc

SEQ ID NO: 245363 - DNA, 25 bp, Mus musculus
gaggctcacctcagtctttcgactg

SEQ ID NO: 245364 - DNA, 25 bp, Mus musculus
cattgagggcgccaccatgcaacac

SEQ ID NO: 245365 - DNA, 25 bp, Mus musculus
cgtgcacggccatcagctccatgga

SEQ ID NO: 245366 - DNA, 25 bp, Mus musculus
aggcggccatccaactgcacgagtt

SEQ ID NO: 245367 - DNA, 25 bp, Mus musculus
ccatggacttagagcgccctggaga

SEQ ID NO: 245368 - DNA, 25 bp, Mus musculus
agtgccagccggtggagattcccat

SEQ ID NO: 245369 - DNA, 25 bp, Mus musculus
ccaacctgatgggtcacgagaacca

SEQ ID NO: 245370 - DNA, 25 bp, Mus musculus
ttcttcctgtgttcgctgtacgcgc

SEQ ID NO: 245371 - DNA, 25 bp, Mus musculus
catgtgcaccgagcaggtctccaca

SEQ ID NO: 245372 - DNA, 25 bp, Mus musculus
ttcccatgtgcaaggacatcggcta

SEQ ID NO: 245373 - DNA, 25 bp, Mus musculus
ctcgctccgccgtattgtttgcaaa

SEQ ID NO: 245374 - DNA, 25 bp, Mus musculus
gtaccggggacaatctcaaggcctc

SEQ ID NO: 245375 - DNA, 25 bp, Mus musculus
ggggcgcaaggctttctgatgcaaa

SEQ ID NO: 245376 - DNA, 25 bp, Mus musculus
ggggcctgtcaccaatcggctttgc

SEQ ID NO: 245377 - DNA, 25 bp, Mus musculus
ttgcaagtcttctcatcccgggacg

SEQ ID NO: 245378 - DNA, 25 bp, Mus musculus
acccagaggtctgtggaggtagctc

SEQ ID NO: 245379 - DNA, 25 bp, Mus musculus
cgccgttaacccagaggtctgtgga

SEQ ID NO: 245380 - DNA, 25 bp, Mus musculus
tgcgcccgcgagaagcctgctgcag

SEQ ID NO: 245381 - DNA, 25 bp, Mus musculus
aatcagggcccagcacgtgtccacc

SEQ ID NO: 245382 - DNA, 25 bp, Mus musculus
ggagcctcagggactgcggacctaa

SEQ ID NO: 245383 - DNA, 25 bp, Mus musculus
actgcggacctaagcgtgctaagca

SEQ ID NO: 245384 - DNA, 25 bp, Mus musculus
cctaagcgtgctaagcacggggcca

SEQ ID NO: 245385 - DNA, 25 bp, Mus musculus
ctaagcacggggccaggataggact

SEQ ID NO: 245386 - DNA, 25 bp, Mus musculus
gataggactggacgctgctggacca

SEQ ID NO: 245387 - DNA, 25 bp, Mus musculus
gactggacgctgctggaccacgacg

SEQ ID NO: 245388 - DNA, 25 bp, Mus musculus
gcagttggggctgttagcaggtgcc

SEQ ID NO: 245389 - DNA, 25 bp, Mus musculus
ccacccacgtggcagccaatcaggg

SEQ ID NO: 245390 - DNA, 25 bp, Mus musculus
cagcacgtgtccacctcgccgttaa

SEQ ID NO: 245391 - DNA, 25 bp, Mus musculus
cctcgccgttaacccagaggtctgt

SEQ ID NO: 245392 - DNA, 25 bp, Mus musculus
tgctctgtcgggtcagcgtcctccg

SEQ ID NO: 245393 - DNA, 25 bp, Mus musculus
tcttcgatgctgctctgtcgggtca

SEQ ID NO: 245394 - DNA, 25 bp, Mus musculus
ctgatgacgtcactggggtccacct

SEQ ID NO: 245395 - DNA, 25 bp, Mus musculus
ggctgggtgtcatcgctcctgatga

SEQ ID NO: 245396 - DNA, 25 bp, Mus musculus
ttcgtggtcgctggcctcgtcccag

SEQ ID NO: 245397 - DNA, 25 bp, Mus musculus
ccgaaaatcttcgtggtcgctggcc

SEQ ID NO: 245398 - DNA, 25 bp, Mus musculus
tcgggcatggctgggcttttcctcc

SEQ ID NO: 245399 - DNA, 25 bp, Mus musculus
caaaggcaaaaccaacgaaaggatg

SEQ ID NO: 245400 - DNA, 25 bp, Mus musculus
cgaaaggatgagcacggattggttt

SEQ ID NO: 245401 - DNA, 25 bp, Mus musculus
ggggaggatggttacttgacacacc

SEQ ID NO: 245402 - DNA, 25 bp, Mus musculus
ttacttgacacaccaaagggccgtc

SEQ ID NO: 245403 - DNA, 25 bp, Mus musculus
accaaagggccgtctgccactcggg

SEQ ID NO: 245404 - DNA, 25 bp, Mus musculus
tcagccgccctactgtcgggcatgg

SEQ ID NO: 245405 - DNA, 25 bp, Mus musculus
gatgcacgccaaaacccggaaccaa

SEQ ID NO: 245406 - DNA, 25 bp, Mus musculus
ccgccgcacactctccggtggccgc

SEQ ID NO: 245407 - DNA, 25 bp, Mus musculus
cccaccggccatcaaggcggggcac

SEQ ID NO: 245408 - DNA, 25 bp, Mus musculus
tgaggtcaggcagccggtcccgcat

SEQ ID NO: 245409 - DNA, 25 bp, Mus musculus
tcaccgccgtgaggtcaggcagccg

SEQ ID NO: 245410 - DNA, 25 bp, Mus musculus
ctgctcaccgccgtgaggtcaggca

SEQ ID NO: 245411 - DNA, 25 bp, Mus musculus
ggctttctgctcaccgccgtgaggt

SEQ ID NO: 245412 - DNA, 25 bp, Mus musculus
tgcggctttctgctcaccgccgtga

SEQ ID NO: 245413 - DNA, 25 bp, Mus musculus
ctcataccgctatgcggctttctgc

SEQ ID NO: 245414 - DNA, 25 bp, Mus musculus
cggctcataccgctatgcggctttc

SEQ ID NO: 245415 - DNA, 25 bp, Mus musculus
cccacaacatctcgcccgccggctc

SEQ ID NO: 245416 - DNA, 25 bp, Mus musculus
acactctccggtggccgcgtcgccg

SEQ ID NO: 245417 - DNA, 25 bp, Mus musculus
tcgggcaagcgctgccacggcaacc

SEQ ID NO: 245418 - DNA, 25 bp, Mus musculus
caagcgctgccacggcaaccgcgcc

SEQ ID NO: 245419 - DNA, 25 bp, Mus musculus
cctcccgcgggacccaaggcacctg

SEQ ID NO: 245420 - DNA, 25 bp, Mus musculus
cgcaggtccagttcaaggtgcgtgt

SEQ ID NO: 245421 - DNA, 25 bp, Mus musculus
tttccagctccagtcggacaggcgc

SEQ ID NO: 245422 - DNA, 25 bp, Mus musculus
tttgaatcgcgcttccgccatcttt

SEQ ID NO: 245423 - DNA, 25 bp, Mus musculus
gtctccggcatttgaatcgcgcttc

SEQ ID NO: 245424 - DNA, 25 bp, Mus musculus
tccgctgcgtctccggcatttgaat

SEQ ID NO: 245425 - DNA, 25 bp, Mus musculus
tgggcgcggctttgttgctccgccc

SEQ ID NO: 245426 - DNA, 25 bp, Mus musculus
acaggcgcggagactcttctggaag

SEQ ID NO: 245427 - DNA, 25 bp, Mus musculus
tccagttcaaggtgcgtgtgcggcc

SEQ ID NO: 245428 - DNA, 25 bp, Mus musculus
gccgcctcgtctcttgaatctagct

SEQ ID NO: 245429 - DNA, 25 bp, Mus musculus
tcttgaatctagctcgtcctggtgg

SEQ ID NO: 245430 - DNA, 25 bp, Mus musculus
cggcaccgggaagacaaccttcgtg

SEQ ID NO: 245431 - DNA, 25 bp, Mus musculus
cacttgacgggcgagtttgagaaga

SEQ ID NO: 245432 - DNA, 25 bp, Mus musculus
ctcttctggaaggtagcgtcgaggc

SEQ ID NO: 245433 - DNA, 25 bp, Mus musculus
aaccttcgtgaagcgccacttgacg

SEQ ID NO: 245434 - DNA, 25 bp, Mus musculus
ggtagcgctagagactcagtcttca

SEQ ID NO: 245435 - DNA, 25 bp, Mus musculus
ctaaggcaacggtggctatgcaggt

SEQ ID NO: 245436 - DNA, 25 bp, Mus musculus
gcccgctaaggcaacggtggctatg

SEQ ID NO: 245437 - DNA, 25 bp, Mus musculus
ccgctgtgcccgctaaggcaacggt

SEQ ID NO: 245438 - DNA, 25 bp, Mus musculus
ggcttccctgcccttgcccgctgtg

SEQ ID NO: 245439 - DNA, 25 bp, Mus musculus
tccctttggcctccggcttccctgc

SEQ ID NO: 245440 - DNA, 25 bp, Mus musculus
cacagcccggcgatttccctttggc

SEQ ID NO: 245441 - DNA, 25 bp, Mus musculus
actcagtcttcagcgacagtctctg

SEQ ID NO: 245442 - DNA, 25 bp, Mus musculus
ttgggtagcgctagagactcagtct

SEQ ID NO: 245443 - DNA, 25 bp, Mus musculus
atcctgagctgacccgggttgggta

SEQ ID NO: 245444 - DNA, 25 bp, Mus musculus
ggtgtgtgagatcctgagctgaccc

SEQ ID NO: 245445 - DNA, 25 bp, Mus musculus
ctcgttgacccgaggctaaaatggg

SEQ ID NO: 245446 - DNA, 25 bp, Mus musculus
tcgggctcgttgacccgaggctaaa

SEQ ID NO: 245447 - DNA, 25 bp, Mus musculus
ttcagcgacagtctctgcccgctgt

SEQ ID NO: 245448 - DNA, 25 bp, Mus musculus
atagcgcagggcaaggggtttcacc

SEQ ID NO: 245449 - DNA, 25 bp, Mus musculus
tgagctcgggccgtgtgcacagcta

SEQ ID NO: 245450 - DNA, 25 bp, Mus musculus
gctaccaaaggactcgctctcgatt

SEQ ID NO: 245451 - DNA, 25 bp, Mus musculus
gggtttcacctcgagcgcctcacgt

SEQ ID NO: 245452 - DNA, 25 bp, Mus musculus
caaattggagcagagcgagcttgtc

SEQ ID NO: 245453 - DNA, 25 bp, Mus musculus
cctactttgaatgaagcaaattgga

SEQ ID NO: 245454 - DNA, 25 bp, Mus musculus
ccggctgacacctgctaccaaagga

SEQ ID NO: 245455 - DNA, 25 bp, Mus musculus
cgtgtgcacagctaggagataccta

SEQ ID NO: 245456 - DNA, 25 bp, Mus musculus
ggactcgctctcgatttgatctccg

SEQ ID NO: 245457 - DNA, 25 bp, Mus musculus
ccgtcctgactgtgagctcgggccg

SEQ ID NO: 245458 - DNA, 25 bp, Mus musculus
tgtgacgtcatcctgccatcacacg

SEQ ID NO: 245459 - DNA, 25 bp, Mus musculus
atcacaccgcgcagtgacctcgtga

SEQ ID NO: 245460 - DNA, 25 bp, Mus musculus
tgacctcgtgactgtgacgtcatcc

SEQ ID NO: 245461 - DNA, 25 bp, Mus musculus
ggagatacctactttgaatgaagca

SEQ ID NO: 245462 - DNA, 25 bp, Mus musculus
ctccttttcggttcttcgccaggag

SEQ ID NO: 245463 - DNA, 25 bp, Mus musculus
acgattcccaggtgttgcgccgttc

SEQ ID NO: 245464 - DNA, 25 bp, Mus musculus
ccggaactaccacgattcccaggtg

SEQ ID NO: 245465 - DNA, 25 bp, Mus musculus
tctcaaatcgtaagaacttagggcg

SEQ ID NO: 245466 - DNA, 25 bp, Mus musculus
cggcctctgtcgcaacagagctgct

SEQ ID NO: 245467 - DNA, 25 bp, Mus musculus
tgcggcgcggtttctctcccggaac

SEQ ID NO: 245468 - DNA, 25 bp, Mus musculus
tcttcgccaggagttcgtcccggac

SEQ ID NO: 245469 - DNA, 25 bp, Mus musculus
agtttccgaacttggcgctcgcgca

SEQ ID NO: 245470 - DNA, 25 bp, Mus musculus
cctcgtctccagtttccgaacttgg

SEQ ID NO: 245471 - DNA, 25 bp, Mus musculus
gccttagtgagggaccgctctgccc

SEQ ID NO: 245472 - DNA, 25 bp, Mus musculus
gccggcttcactcggatgcgctctt

SEQ ID NO: 245473 - DNA, 25 bp, Mus musculus
tctagtgacggcatcagaacgcgcg

SEQ ID NO: 245474 - DNA, 25 bp, Mus musculus
tttgtccgggcttctcacactctct

SEQ ID NO: 245475 - DNA, 25 bp, Mus musculus
ttgcgccgttctagtgacggcatca

SEQ ID NO: 245476 - DNA, 25 bp, Mus musculus
ctgcaagttgttccgcgacgacgag

SEQ ID NO: 245477 - DNA, 25 bp, Mus musculus
tcgctatggcggctgtgttgaagtt

SEQ ID NO: 245478 - DNA, 25 bp, Mus musculus
ctgatgttgacttgatggccgggac

SEQ ID NO: 245479 - DNA, 25 bp, Mus musculus
cccgcttgatttcgcctgatgttga

SEQ ID NO: 245480 - DNA, 25 bp, Mus musculus
atcctcatcgacaggtcggttcctc

SEQ ID NO: 245481 - DNA, 25 bp, Mus musculus
tggagcttctggttttcggctatgc

SEQ ID NO: 245482 - DNA, 25 bp, Mus musculus
tttcggctatgcctgcaagttgttc

SEQ ID NO: 245483 - DNA, 25 bp, Mus musculus
gccggagggatcgactctgctccca

SEQ ID NO: 245484 - DNA, 25 bp, Mus musculus
ttgttcggcccagcagcagaccgtc

SEQ ID NO: 245485 - DNA, 25 bp, Mus musculus
ggcccaggaacagggacagcacctc

SEQ ID NO: 245486 - DNA, 25 bp, Mus musculus
cctccattttgtggctcgctatggc

SEQ ID NO: 245487 - DNA, 25 bp, Mus musculus
gaagttgcgtctcctccattttgtg

SEQ ID NO: 245488 - DNA, 25 bp, Mus musculus
ttcctaccggaagttgcgtctcctc

SEQ ID NO: 245489 - DNA, 25 bp, Mus musculus
ctctcacctccggaaagagcgggtt

SEQ ID NO: 245490 - DNA, 25 bp, Mus musculus
ttagcatacattagcatggccctgc

SEQ ID NO: 245491 - DNA, 25 bp, Mus musculus
gcggggcgatgtttattagcataca

SEQ ID NO: 245492 - DNA, 25 bp, Mus musculus
gctgccaccactgctgcttgtactg

SEQ ID NO: 245493 - DNA, 25 bp, Mus musculus
gactcgcccttgctcctttcggaga

SEQ ID NO: 245494 - DNA, 25 bp, Mus musculus
cctttcggagaggtgcgcgaatccc

SEQ ID NO: 245495 - DNA, 25 bp, Mus musculus
gctcacgcttgcaggtctaggagga

SEQ ID NO: 245496 - DNA, 25 bp, Mus musculus
gtctaggaggatgccggtccctttc

SEQ ID NO: 245497 - DNA, 25 bp, Mus musculus
gccggagcctggtctctggttaaaa

SEQ ID NO: 245498 - DNA, 25 bp, Mus musculus
ctggttaaaagcagctccacagaga

SEQ ID NO: 245499 - DNA, 25 bp, Mus musculus
tccacagagacctctggcggggtga

SEQ ID NO: 245500 - DNA, 25 bp, Mus musculus
gtgaccggtgtcacagacgcccgga

SEQ ID NO: 245501 - DNA, 25 bp, Mus musculus
ccgctgacgatgttagaagagcctc

SEQ ID NO: 245502 - DNA, 25 bp, Mus musculus
ttagaagagcctcccgcacggcgag

SEQ ID NO: 245503 - DNA, 25 bp, Mus musculus
aacctctgctgtgtcaagcccgctg

SEQ ID NO: 245504 - DNA, 25 bp, Mus musculus
cacacggggagtcgggatgtcccca

SEQ ID NO: 245505 - DNA, 25 bp, Mus musculus
cgcaggcttccgttccggggtatct

SEQ ID NO: 245506 - DNA, 25 bp, Mus musculus
tggtctccggtttccgcaggcttcc

SEQ ID NO: 245507 - DNA, 25 bp, Mus musculus
gttctctggtctccggtttccgcag

SEQ ID NO: 245508 - DNA, 25 bp, Mus musculus
cagagtgtccgggttctctggtctc

SEQ ID NO: 245509 - DNA, 25 bp, Mus musculus
ccgttccagagtgtccgggttctct

SEQ ID NO: 245510 - DNA, 25 bp, Mus musculus
ccgcggtgtcccgttccagagtgtc

SEQ ID NO: 245511 - DNA, 25 bp, Mus musculus
cttgtcccgattccggaacggatct

SEQ ID NO: 245512 - DNA, 25 bp, Mus musculus
agcccggactcaccttgtcccgatt

SEQ ID NO: 245513 - DNA, 25 bp, Mus musculus
gcaccgctgcatctacaaaaaccac

SEQ ID NO: 245514 - DNA, 25 bp, Mus musculus
agatgccctagagaactcgacccga

SEQ ID NO: 245515 - DNA, 25 bp, Mus musculus
gccgcgagctgacagatgccctaga

SEQ ID NO: 245516 - DNA, 25 bp, Mus musculus
ggccctcgccgcgagctgacagatg

SEQ ID NO: 245517 - DNA, 25 bp, Mus musculus
agtatcccgccatcgggctgccagc

SEQ ID NO: 245518 - DNA, 25 bp, Mus musculus
cgtcccgtgtcagtttccctggtgg

SEQ ID NO: 245519 - DNA, 25 bp, Mus musculus
attgggcgcgttcttatctttagcc

SEQ ID NO: 245520 - DNA, 25 bp, Mus musculus
actgacaggactggcgccctgtgaa

SEQ ID NO: 245521 - DNA, 25 bp, Mus musculus
tagcgcaccgtgagcgtcatcacgc

SEQ ID NO: 245522 - DNA, 25 bp, Mus musculus
tccgccggccttgtggtggactccg

SEQ ID NO: 245523 - DNA, 25 bp, Mus musculus
gtcagcagtgctgcgtcccgtgtca

SEQ ID NO: 245524 - DNA, 25 bp, Mus musculus
gtggtttcggtagcgactgattctc

SEQ ID NO: 245525 - DNA, 25 bp, Mus musculus
tagcgactgattctcagagcggccc

SEQ ID NO: 245526 - DNA, 25 bp, Mus musculus
gagtcatagtctcgtctttcctcta

SEQ ID NO: 245527 - DNA, 25 bp, Mus musculus
ctttcctctacaggaacctggctca

SEQ ID NO: 245528 - DNA, 25 bp, Mus musculus
gaacctggctcaccggccgaggtct

SEQ ID NO: 245529 - DNA, 25 bp, Mus musculus
gccgggaggtgcttgttcaaataga

SEQ ID NO: 245530 - DNA, 25 bp, Mus musculus
ttgttcaaatagattgggcgcgttc

SEQ ID NO: 245531 - DNA, 25 bp, Mus musculus
agggtgtcaaccaggtctgggttct

SEQ ID NO: 245532 - DNA, 25 bp, Mus musculus
tgttgctcgcgcgaggaggcctgct

SEQ ID NO: 245533 - DNA, 25 bp, Mus musculus
cgacaccgaggcggtaggagcttca

SEQ ID NO: 245534 - DNA, 25 bp, Mus musculus
gcgggatctacggatatcttcagca

SEQ ID NO: 245535 - DNA, 25 bp, Mus musculus
acggatatcttcagcaacttcttgg

SEQ ID NO: 245536 - DNA, 25 bp, Mus musculus
atcttcagcaacttcttggcacgcc

SEQ ID NO: 245537 - DNA, 25 bp, Mus musculus
cggcagcactgaggcgccacgctgc

SEQ ID NO: 245538 - DNA, 25 bp, Mus musculus
ccctgcactacagcggcctagcgcc

SEQ ID NO: 245539 - DNA, 25 bp, Mus musculus
cttcaggctccggagcaagatggcg

SEQ ID NO: 245540 - DNA, 25 bp, Mus musculus
gcctgctgcggccagccgcccagag

SEQ ID NO: 245541 - DNA, 25 bp, Mus musculus
ggcctcccgagtcccaggcgaccga

SEQ ID NO: 245542 - DNA, 25 bp, Mus musculus
ctcaaggtcaccgtcctgccggcgc

SEQ ID NO: 245543 - DNA, 25 bp, Mus musculus
cgcgggccacgtccgccctcagcct

SEQ ID NO: 245544 - DNA, 25 bp, Mus musculus
aggagcttcaggctccggagcaaga

SEQ ID NO: 245545 - DNA, 25 bp, Mus musculus
agtagcaatgcctcgccccaggtcg

SEQ ID NO: 245546 - DNA, 25 bp, Mus musculus
caggccttcgcgctagcgttttctt

SEQ ID NO: 245547 - DNA, 25 bp, Mus musculus
cgatggccgcaaactcgagtcgctg

SEQ ID NO: 245548 - DNA, 25 bp, Mus musculus
accatgaagatgtaagcccgggctg

SEQ ID NO: 245549 - DNA, 25 bp, Mus musculus
cctgcaggatgttctgaggaccaac

SEQ ID NO: 245550 - DNA, 25 bp, Mus musculus
catggcggcggtaaagaccctaaat

SEQ ID NO: 245551 - DNA, 25 bp, Mus musculus
gccgggtgcgtaagacttttcgaga

SEQ ID NO: 245552 - DNA, 25 bp, Mus musculus
cgccacccaatggaggtgctctgtg

SEQ ID NO: 245553 - DNA, 25 bp, Mus musculus
ccagtttctcagatgcgcaatgacg

SEQ ID NO: 245554 - DNA, 25 bp, Mus musculus
gccgatgacgggagaaccagtttct

SEQ ID NO: 245555 - DNA, 25 bp, Mus musculus
accttaagatccagagtgccgatga

SEQ ID NO: 245556 - DNA, 25 bp, Mus musculus
gggcgagcacaacggaaccttaaga

SEQ ID NO: 245557 - DNA, 25 bp, Mus musculus
tcacacacgacctgcagggcttttc

SEQ ID NO: 245558 - DNA, 25 bp, Mus musculus
gcttcctgtcacacccagtcgagtg

SEQ ID NO: 245559 - DNA, 25 bp, Mus musculus
gaccagcgttggattaagccaatca

SEQ ID NO: 245560 - DNA, 25 bp, Mus musculus
tctaattggctacgtgcggaggttc

SEQ ID NO: 245561 - DNA, 25 bp, Mus musculus
gtccaataactttcagcgatcgtgc

SEQ ID NO: 245562 - DNA, 25 bp, Mus musculus
cgccaagcaacttcccggcgtggta

SEQ ID NO: 245563 - DNA, 25 bp, Mus musculus
tctggacgcttaaggtgcagacacc

SEQ ID NO: 245564 - DNA, 25 bp, Mus musculus
actgatgtctggttcgtccaataac

SEQ ID NO: 245565 - DNA, 25 bp, Mus musculus
agaacggggacacgctctgtgcact

SEQ ID NO: 245566 - DNA, 25 bp, Mus musculus
tcgtgcttctcctgggctctaattg

SEQ ID NO: 245567 - DNA, 25 bp, Mus musculus
cccgagtttgttgtgtctggacgct

SEQ ID NO: 245568 - DNA, 25 bp, Mus musculus
tgcagacaccgaggatgccacgtgg

SEQ ID NO: 245569 - DNA, 25 bp, Mus musculus
tgagaccctcgggactggggacaaa

SEQ ID NO: 245570 - DNA, 25 bp, Mus musculus
ggccaggacgaggttctgtagctta

SEQ ID NO: 245571 - DNA, 25 bp, Mus musculus
tctgtagcttaagagctgcgaagcc

SEQ ID NO: 245572 - DNA, 25 bp, Mus musculus
gatccgctaccaggggaggactccc

SEQ ID NO: 245573 - DNA, 25 bp, Mus musculus
gcaccgcattgccagttactgatgt

SEQ ID NO: 245574 - DNA, 25 bp, Mus musculus
gcgagcagcagctacgcaccaacta

SEQ ID NO: 245575 - DNA, 25 bp, Mus musculus
ccgcgaagaaacacaattccgcatc

SEQ ID NO: 245576 - DNA, 25 bp, Mus musculus
tccgcatctggaacaaagaagcatg

SEQ ID NO: 245577 - DNA, 25 bp, Mus musculus
gtgaggtcacagagcgctccctaca

SEQ ID NO: 245578 - DNA, 25 bp, Mus musculus
ctacagcggagccaataggagcact

SEQ ID NO: 245579 - DNA, 25 bp, Mus musculus
atcggcgatggaccctccaactcgt

SEQ ID NO: 245580 - DNA, 25 bp, Mus musculus
gcccaccgtcggcttcgaagaggag

SEQ ID NO: 245581 - DNA, 25 bp, Mus musculus
ctggattactactacctgcgtgact

SEQ ID NO: 245582 - DNA, 25 bp, Mus musculus
ccacgagcgcaaggtggcgcagata

SEQ ID NO: 245583 - DNA, 25 bp, Mus musculus
cgcaaggtggcgcagatactgctca

SEQ ID NO: 245584 - DNA, 25 bp, Mus musculus
gatactgctcaacgggcagcgcaag

SEQ ID NO: 245585 - DNA, 25 bp, Mus musculus
tggcctgagcacacgccacgcttga

SEQ ID NO: 245586 - DNA, 25 bp, Mus musculus
acacgccacgcttgagcgggtatgg

SEQ ID NO: 245587 - DNA, 25 bp, Mus musculus
aggtgtacgactgcctggattacta

SEQ ID NO: 245588 - DNA, 25 bp, Mus musculus
atgatgcgcttgttcgcgcctccgc

SEQ ID NO: 245589 - DNA, 25 bp, Mus musculus
tgtatctcttttcttcccggttgcc

SEQ ID NO: 245590 - DNA, 25 bp, Mus musculus
cggtagggttcttacggaagctgct

SEQ ID NO: 245591 - DNA, 25 bp, Mus musculus
gctggcagttctcgtgctgtatctc

SEQ ID NO: 245592 - DNA, 25 bp, Mus musculus
tcttacggaagctgctggcaggatg

SEQ ID NO: 245593 - DNA, 25 bp, Mus musculus
gtgctgtatctcttttcttcccggt

SEQ ID NO: 245594 - DNA, 25 bp, Mus musculus
ctggcaggatggtactgagcaatga

SEQ ID NO: 245595 - DNA, 25 bp, Mus musculus
agctgttttgttggcttgcgcgccc

SEQ ID NO: 245596 - DNA, 25 bp, Mus musculus
tccgccctggaagcgttcggcgaga

SEQ ID NO: 245597 - DNA, 25 bp, Mus musculus
caagcatcattttgcgcgctgagcc

SEQ ID NO: 245598 - DNA, 25 bp, Mus musculus
tcattttgcgcgctgagccgacttc

SEQ ID NO: 245599 - DNA, 25 bp, Mus musculus
agccgacttcgcgtgagctgttttg

SEQ ID NO: 245600 - DNA, 25 bp, Mus musculus
cgcgtgagctgttttgttggcttgc

SEQ ID NO: 245601 - DNA, 25 bp, Mus musculus
tactgagcaatgagccggctgcgag

SEQ ID NO: 245602 - DNA, 25 bp, Mus musculus
cgcccgtcctgctgagagtgtcggt

SEQ ID NO: 245603 - DNA, 25 bp, Mus musculus
cctggccggtgtgacttttctccct

SEQ ID NO: 245604 - DNA, 25 bp, Mus musculus
ggcctccaggtagcccggcttgagt

SEQ ID NO: 245605 - DNA, 25 bp, Mus musculus
ctgggtgaagtgctccgccgccctg

SEQ ID NO: 245606 - DNA, 25 bp, Mus musculus
acgcctaccacgtggagcgggagaa

SEQ ID NO: 245607 - DNA, 25 bp, Mus musculus
cgggatcctgctctccatctacgcc

SEQ ID NO: 245608 - DNA, 25 bp, Mus musculus
ttatgagcggctttctcgctccgcc

SEQ ID NO: 245609 - DNA, 25 bp, Mus musculus
tccctccacacttatgagcggcttt

SEQ ID NO: 245610 - DNA, 25 bp, Mus musculus
tggctgcttacaacctccgcctctt

SEQ ID NO: 245611 - DNA, 25 bp, Mus musculus
tgcgccacgcaaccctggctgctta

SEQ ID NO: 245612 - DNA, 25 bp, Mus musculus
atttctcagcaccacccttcacttg

SEQ ID NO: 245613 - DNA, 25 bp, Mus musculus
tgaccgcgccctccagtgtaacgaa

SEQ ID NO: 245614 - DNA, 25 bp, Mus musculus
gcctcactcctctcggggcggttgg

SEQ ID NO: 245615 - DNA, 25 bp, Mus musculus
catctacgcctaccacgtggagcgg

SEQ ID NO: 245616 - DNA, 25 bp, Mus musculus
cagcatcccgcccttcagagccagc

SEQ ID NO: 245617 - DNA, 25 bp, Mus musculus
ccagggagcgcgcacctcccgtagc

SEQ ID NO: 245618 - DNA, 25 bp, Mus musculus
tcccgtagcggctgccggtaccatt

SEQ ID NO: 245619 - DNA, 25 bp, Mus musculus
gctgccggtaccattgctgctcgaa

SEQ ID NO: 245620 - DNA, 25 bp, Mus musculus
gtaccattgctgctcgaaaccctgc

SEQ ID NO: 245621 - DNA, 25 bp, Mus musculus
gctcgaaaccctgcagccggttgtt

SEQ ID NO: 245622 - DNA, 25 bp, Mus musculus
cctgcagccggttgttcgagaggtc

SEQ ID NO: 245623 - DNA, 25 bp, Mus musculus
tcggcgcggaagtgccacagtccgt

SEQ ID NO: 245624 - DNA, 25 bp, Mus musculus
ggaagtgccacagtccgtccagcgc

SEQ ID NO: 245625 - DNA, 25 bp, Mus musculus
gggctctccttcgggaacagcatcc

SEQ ID NO: 245626 - DNA, 25 bp, Mus musculus
agagccagcgcgcagctgcacagca

SEQ ID NO: 245627 - DNA, 25 bp, Mus musculus
agcgcgcagctgcacagcagctggc

SEQ ID NO: 245628 - DNA, 25 bp, Mus musculus
gcagctggcccagcgcgacccaaca

SEQ ID NO: 245629 - DNA, 25 bp, Mus musculus
ttgagctcccgcgacgggctctcct

SEQ ID NO: 245630 - DNA, 25 bp, Mus musculus
gggagggcatctttctttagcgcta

SEQ ID NO: 245631 - DNA, 25 bp, Mus musculus
ctttagcgctaacagggttgagatg

SEQ ID NO: 245632 - DNA, 25 bp, Mus musculus
tctctgtgcagacgggattcactca

SEQ ID NO: 245633 - DNA, 25 bp, Mus musculus
attcactcaccgtggcgctaggagc

SEQ ID NO: 245634 - DNA, 25 bp, Mus musculus
accatagagagcgactgtaaggagc

SEQ ID NO: 245635 - DNA, 25 bp, Mus musculus
cagcggcagcaaagcggagctcctc

SEQ ID NO: 245636 - DNA, 25 bp, Mus musculus
ctgagaacccgctcggtcctgctgt

SEQ ID NO: 245637 - DNA, 25 bp, Mus musculus
gcccaagttcgcagagcaaaccagc

SEQ ID NO: 245638 - DNA, 25 bp, Mus musculus
caaaccagctggacgcaaggccttt

SEQ ID NO: 245639 - DNA, 25 bp, Mus musculus
caaggccttttctgcagtcgtggga

SEQ ID NO: 245640 - DNA, 25 bp, Mus musculus
tcgtgggacgtaggcgattaatttc

SEQ ID NO: 245641 - DNA, 25 bp, Mus musculus
atttctgtctccagacggccggcta

SEQ ID NO: 245642 - DNA, 25 bp, Mus musculus
ccggtttagttgaagcgtgctcaga

SEQ ID NO: 245643 - DNA, 25 bp, Mus musculus
atgaattggggagcgtctctgtgca

SEQ ID NO: 245644 - DNA, 25 bp, Mus musculus
ttctcacggcggttgcgtacgctga

SEQ ID NO: 245645 - DNA, 25 bp, Mus musculus
cgtgccttgcggcacacacacggaa

SEQ ID NO: 245646 - DNA, 25 bp, Mus musculus
tgcggcacacacacggaaccggtga

SEQ ID NO: 245647 - DNA, 25 bp, Mus musculus
acacggaaccggtgagcagagcagc

SEQ ID NO: 245648 - DNA, 25 bp, Mus musculus
cagcgccggcgcaacgtgagactct

SEQ ID NO: 245649 - DNA, 25 bp, Mus musculus
ccggcgcaacgtgagactcttctca

SEQ ID NO: 245650 - DNA, 25 bp, Mus musculus
gcggctagacctcgggacccgcgag

SEQ ID NO: 245651 - DNA, 25 bp, Mus musculus
gccaggatcatctggggaccgcgaa

SEQ ID NO: 245652 - DNA, 25 bp, Mus musculus
cgaccaggggaagccaggatcatct

SEQ ID NO: 245653 - DNA, 25 bp, Mus musculus
tgtaagcgacacgaccaggggaagc

SEQ ID NO: 245654 - DNA, 25 bp, Mus musculus
catggaagtgtaagcgacacgacca

SEQ ID NO: 245655 - DNA, 25 bp, Mus musculus
aggcagaggcaacatggaagtgtaa

SEQ ID NO: 245656 - DNA, 25 bp, Mus musculus
agactcttctcacggcggttgcgta

SEQ ID NO: 245657 - DNA, 25 bp, Mus musculus
cgtacgctgaggcagaggcaacatg

SEQ ID NO: 245658 - DNA, 25 bp, Mus musculus
ggcattcggctctccactcaccgga

SEQ ID NO: 245659 - DNA, 25 bp, Mus musculus
atcagagaggcggacacatcgcgcg

SEQ ID NO: 245660 - DNA, 25 bp, Mus musculus
cctatggcggcgtgcgtgagatccc

SEQ ID NO: 245661 - DNA, 25 bp, Mus musculus
ggcgggcgctatggccaccaactag

SEQ ID NO: 245662 - DNA, 25 bp, Mus musculus
atggccaccaactagggcggccgga

SEQ ID NO: 245663 - DNA, 25 bp, Mus musculus
agaagcggccgaagcccaagatgcc

SEQ ID NO: 245664 - DNA, 25 bp, Mus musculus
ggatcccgactcacctgcgcacgca

SEQ ID NO: 245665 - DNA, 25 bp, Mus musculus
tgtctgcccagcaggcattcggctc

SEQ ID NO: 245666 - DNA, 25 bp, Mus musculus
ggtcgctactgccatgtctgcccag

SEQ ID NO: 245667 - DNA, 25 bp, Mus musculus
tttcgcctagcagtcccggtcgcta

SEQ ID NO: 245668 - DNA, 25 bp, Mus musculus
cccggaaccgacaaatcagagaggc

SEQ ID NO: 245669 - DNA, 25 bp, Mus musculus
ctgcgcctccgccatcgtaggtaag

SEQ ID NO: 245670 - DNA, 25 bp, Mus musculus
catcgtaggtaagcggcgccgctct

SEQ ID NO: 245671 - DNA, 25 bp, Mus musculus
cccaagatgccggagcgacggcacg

SEQ ID NO: 245672 - DNA, 25 bp, Mus musculus
cctcgatggttggatcagaccttta

SEQ ID NO: 245673 - DNA, 25 bp, Mus musculus
gcgcttgtcagccaagagccaatca

SEQ ID NO: 245674 - DNA, 25 bp, Mus musculus
acggtgccatgtccagctccgaagc

SEQ ID NO: 245675 - DNA, 25 bp, Mus musculus
gtcaggcactgcttggctttagttc

SEQ ID NO: 245676 - DNA, 25 bp, Mus musculus
gcggcccatctcgtcatgtcaggca

SEQ ID NO: 245677 - DNA, 25 bp, Mus musculus
acgcgtgccctttaggtggcctata

SEQ ID NO: 245678 - DNA, 25 bp, Mus musculus
atcagaattgggtaggcctgtagcc

SEQ ID NO: 245679 - DNA, 25 bp, Mus musculus
caagccgttgtcagttgtcactcta

SEQ ID NO: 245680 - DNA, 25 bp, Mus musculus
agagagccgcttccctagataagtg

SEQ ID NO: 245681 - DNA, 25 bp, Mus musculus
ttgggcgaacctcctgacaatcagg

SEQ ID NO: 245682 - DNA, 25 bp, Mus musculus
cggagctaatcggacactgccagta

SEQ ID NO: 245683 - DNA, 25 bp, Mus musculus
gctcccgttagttagatagccaatc

SEQ ID NO: 245684 - DNA, 25 bp, Mus musculus
ggagttcatgaaacctcggccaata

SEQ ID NO: 245685 - DNA, 25 bp, Mus musculus
ttccgatttgcagcgcagggtccac

SEQ ID NO: 245686 - DNA, 25 bp, Mus musculus
tgtcccgtttcgtgtatggctgtcc

SEQ ID NO: 245687 - DNA, 25 bp, Mus musculus
tcacagacacgtcagcgagggcctc

SEQ ID NO: 245688 - DNA, 25 bp, Mus musculus
cggccgcattcgctaagcgctggga

SEQ ID NO: 245689 - DNA, 25 bp, Mus musculus
tcgccctcaggctaatgcaagcaga

SEQ ID NO: 245690 - DNA, 25 bp, Mus musculus
ccgatcctgtccgagtccggagttg

SEQ ID NO: 245691 - DNA, 25 bp, Mus musculus
aatgacaggggaaaccgcggcttct

SEQ ID NO: 245692 - DNA, 25 bp, Mus musculus
gcggcttctcgcgagtcacagacac

SEQ ID NO: 245693 - DNA, 25 bp, Mus musculus
agcctccggagcgttgcaatctttt

SEQ ID NO: 245694 - DNA, 25 bp, Mus musculus
gttgcaatcttttccggccagccgc

SEQ ID NO: 245695 - DNA, 25 bp, Mus musculus
cggaagtccgaagcgtcacggaaat

SEQ ID NO: 245696 - DNA, 25 bp, Mus musculus
gtcccagactttgatgtcccgtttc

SEQ ID NO: 245697 - DNA, 25 bp, Mus musculus
ccgagttcttcccagctcggcggga

SEQ ID NO: 245698 - DNA, 25 bp, Mus musculus
gggagatgtctcctggtcccagact

SEQ ID NO: 245699 - DNA, 25 bp, Mus musculus
tcacggaaatgacgccacgcgtacg

SEQ ID NO: 245700 - DNA, 25 bp, Mus musculus
aagacagtctgcttctcctcctaac

SEQ ID NO: 245701 - DNA, 25 bp, Mus musculus
tggcttcgggtcgtcgcttcggccc

SEQ ID NO: 245702 - DNA, 25 bp, Mus musculus
ctctggcctggcttcgggtcgtcgc

SEQ ID NO: 245703 - DNA, 25 bp, Mus musculus
tgacgtggttttctgccttcacccg

SEQ ID NO: 245704 - DNA, 25 bp, Mus musculus
gagcaattctgtcccttccgcgccg

SEQ ID NO: 245705 - DNA, 25 bp, Mus musculus
catttgcaaaacgaagacagtctgc

SEQ ID NO: 245706 - DNA, 25 bp, Mus musculus
gtatgcttttcccatttgcaaaacg

SEQ ID NO: 245707 - DNA, 25 bp, Mus musculus
ctccgtgtatgcttttcccatttgc

SEQ ID NO: 245708 - DNA, 25 bp, Mus musculus
cgagtgataaatttcaggcagctcc

SEQ ID NO: 245709 - DNA, 25 bp, Mus musculus
ttcgcgaatgcgagtgataaatttc

SEQ ID NO: 245710 - DNA, 25 bp, Mus musculus
cggcagttcgcgaatgcgagtgata

SEQ ID NO: 245711 - DNA, 25 bp, Mus musculus
gcaagctcacggcagttcgcgaatg

SEQ ID NO: 245712 - DNA, 25 bp, Mus musculus
cgggacggaaccgagcaagctcacg

SEQ ID NO: 245713 - DNA, 25 bp, Mus musculus
cgttagtggtgacgtggttttctgc

SEQ ID NO: 245714 - DNA, 25 bp, Mus musculus
tggcgcactagccaggcagccgata

SEQ ID NO: 245715 - DNA, 25 bp, Mus musculus
tgccctactgcacatgcgtcaagtg

SEQ ID NO: 245716 - DNA, 25 bp, Mus musculus
gcgccgtgactttttacgccctcta

SEQ ID NO: 245717 - DNA, 25 bp, Mus musculus
tctagttccaccctcaaaggaaggc

SEQ ID NO: 245718 - DNA, 25 bp, Mus musculus
aagtgctcggctgaaacgaccctgc

SEQ ID NO: 245719 - DNA, 25 bp, Mus musculus
tcgacatggtggctgttcacagatc

SEQ ID NO: 245720 - DNA, 25 bp, Mus musculus
cacggccacattggtcagtcggatc

SEQ ID NO: 245721 - DNA, 25 bp, Mus musculus
gccagccgacgaccttgtttttata

SEQ ID NO: 245722 - DNA, 25 bp, Mus musculus
ccgccgaactctgggcacaggatta

SEQ ID NO: 245723 - DNA, 25 bp, Mus musculus
caggcctgaaaggtaccgatgggtc

SEQ ID NO: 245724 - DNA, 25 bp, Mus musculus
cgggtcgttctgtgatgacgtcatt

SEQ ID NO: 245725 - DNA, 25 bp, Mus musculus
tgacgtcatttacaggcgccagtta

SEQ ID NO: 245726 - DNA, 25 bp, Mus musculus
agcaggcgatttcgaagcgcttccc

SEQ ID NO: 245727 - DNA, 25 bp, Mus musculus
taccagggaagaagctaccgcacgc

SEQ ID NO: 245728 - DNA, 25 bp, Mus musculus
ctcccgggcgcagcgaggaggcagc

SEQ ID NO: 245729 - DNA, 25 bp, Mus musculus
cagacgggaggcgaggacaaggaca

SEQ ID NO: 245730 - DNA, 25 bp, Mus musculus
gcacgttcccccagacgggaggcga

SEQ ID NO: 245731 - DNA, 25 bp, Mus musculus
gtgcggggcgcacgttcccccagac

SEQ ID NO: 245732 - DNA, 25 bp, Mus musculus
acatgggctaagcccgcgcggccag

SEQ ID NO: 245733 - DNA, 25 bp, Mus musculus
agccgcgcacatgggctaagcccgc

SEQ ID NO: 245734 - DNA, 25 bp, Mus musculus
cagccgcgcacatgggctaagcccg

SEQ ID NO: 245735 - DNA, 25 bp, Mus musculus
ggcagccgcgcacatgggctaagcc

SEQ ID NO: 245736 - DNA, 25 bp, Mus musculus
cccgggcgcagcgaggaggcagccg

SEQ ID NO: 245737 - DNA, 25 bp, Mus musculus
cggggcctcggccactgggctcccg

SEQ ID NO: 245738 - DNA, 25 bp, Mus musculus
gaggcgaggacaaggacaggggaga

SEQ ID NO: 245739 - DNA, 25 bp, Mus musculus
aggggtagaggcgagagcggtgcag

SEQ ID NO: 245740 - DNA, 25 bp, Mus musculus
aggcagccgcgcacatgggctaagc

SEQ ID NO: 245741 - DNA, 25 bp, Mus musculus
cacatgggctaagcccgcgcggcca

SEQ ID NO: 245742 - DNA, 25 bp, Mus musculus
gcagcctagatcatcgcgggctctg

SEQ ID NO: 245743 - DNA, 25 bp, Mus musculus
ttgagcgctctgtttcgcgtcgccc

SEQ ID NO: 245744 - DNA, 25 bp, Mus musculus
aggagcagcctagatcatcgcgggc

SEQ ID NO: 245745 - DNA, 25 bp, Mus musculus
tcgcgggctctgcaaagcccagctg

SEQ ID NO: 245746 - DNA, 25 bp, Mus musculus
tctgcaaagcccagctgtgagactc

SEQ ID NO: 245747 - DNA, 25 bp, Mus musculus
caaagcccagctgtgagactcaagg

SEQ ID NO: 245748 - DNA, 25 bp, Mus musculus
gctgtgagactcaagggaaaggcaa

SEQ ID NO: 245749 - DNA, 25 bp, Mus musculus
tgggttgggcaaagcggcctctcaa

SEQ ID NO: 245750 - DNA, 25 bp, Mus musculus
aagcggcctctcaaccagagtgggg

SEQ ID NO: 245751 - DNA, 25 bp, Mus musculus
ctctcaaccagagtgggggcacgcc

SEQ ID NO: 245752 - DNA, 25 bp, Mus musculus
ccggctacggagaggaaggatgccc

SEQ ID NO: 245753 - DNA, 25 bp, Mus musculus
cgtgtgagcgccagcttgagcgctc

SEQ ID NO: 245754 - DNA, 25 bp, Mus musculus
cagcttgagcgctctgtttcgcgtc

SEQ ID NO: 245755 - DNA, 25 bp, Mus musculus
ggcaaagcggcctctcaaccagagt

SEQ ID NO: 245756 - DNA, 25 bp, Mus musculus
tggtgggaaccctccaagctgaggt

SEQ ID NO: 245757 - DNA, 25 bp, Mus musculus
ccacgttctattggtgtagagacac

SEQ ID NO: 245758 - DNA, 25 bp, Mus musculus
aggcggtccttcgagcagaatgctc

SEQ ID NO: 245759 - DNA, 25 bp, Mus musculus
acacgtcagtcagtaagggaaggcg

SEQ ID NO: 245760 - DNA, 25 bp, Mus musculus
tggctcgctagggacttacgggtat

SEQ ID NO: 245761 - DNA, 25 bp, Mus musculus
cttccgattggtgcagagccacgtg

SEQ ID NO: 245762 - DNA, 25 bp, Mus musculus
gcacagactggaccgcttccgattg

SEQ ID NO: 245763 - DNA, 25 bp, Mus musculus
cggacacatgtctacctcgaaacgg

SEQ ID NO: 245764 - DNA, 25 bp, Mus musculus
gttcccgaacccgtggcagcgtaca

SEQ ID NO: 245765 - DNA, 25 bp, Mus musculus
tgcctaggaggccaacgcatgcaca

SEQ ID NO: 245766 - DNA, 25 bp, Mus musculus
caagctccaggaggcgatgcacaga

SEQ ID NO: 245767 - DNA, 25 bp, Mus musculus
ctgttaggggaacagccacgttcta

SEQ ID NO: 245768 - DNA, 25 bp, Mus musculus
ttcctgcaatcgcagtcctgcctag

SEQ ID NO: 245769 - DNA, 25 bp, Mus musculus
tgtacggtatgagctcggacacatg

SEQ ID NO: 245770 - DNA, 25 bp, Mus musculus
gactgtgcccagctcgtggagtctt

SEQ ID NO: 245771 - DNA, 25 bp, Mus musculus
tgctgcccacaagcgcctcccggac

SEQ ID NO: 245772 - DNA, 25 bp, Mus musculus
ggtgtcacccgagccatcctgatct

SEQ ID NO: 245773 - DNA, 25 bp, Mus musculus
agccatcctgatctctcttcatgct

SEQ ID NO: 245774 - DNA, 25 bp, Mus musculus
tctctcttcatgcttagggtgggtg

SEQ ID NO: 245775 - DNA, 25 bp, Mus musculus
tctcttcatgcttagggtgggtgag

SEQ ID NO: 245776 - DNA, 25 bp, Mus musculus
aacgctggaattgcagaagggcctg

SEQ ID NO: 245777 - DNA, 25 bp, Mus musculus
gcctgggtacactcgtgggaatccc

SEQ ID NO: 245778 - DNA, 25 bp, Mus musculus
tacactcgtgggaatcccgggactg

SEQ ID NO: 245779 - DNA, 25 bp, Mus musculus
agtcttgggtgctagtggccatcgg

SEQ ID NO: 245780 - DNA, 25 bp, Mus musculus
tgggaatcccgggactgtgcccagc

SEQ ID NO: 245781 - DNA, 25 bp, Mus musculus
cccagctcgtggagtcttgggtgct

SEQ ID NO: 245782 - DNA, 25 bp, Mus musculus
gagtgggcgggtgtgctgcccacaa

SEQ ID NO: 245783 - DNA, 25 bp, Mus musculus
actcgtgggaatcccgggactgtgc

SEQ ID NO: 245784 - DNA, 25 bp, Mus musculus
cggacctccaaagtcacaccagttg

SEQ ID NO: 245785 - DNA, 25 bp, Mus musculus
aaacgccgattctctggcgccagta

SEQ ID NO: 245786 - DNA, 25 bp, Mus musculus
ccgcagtcacgctcaaatctcaatg

SEQ ID NO: 245787 - DNA, 25 bp, Mus musculus
gtgtctttgttcagctcaccggctc

SEQ ID NO: 245788 - DNA, 25 bp, Mus musculus
tcgcagggcgaaaatagagttcttc

SEQ ID NO: 245789 - DNA, 25 bp, Mus musculus
cgcagacgtagaccttcagagaaca

SEQ ID NO: 245790 - DNA, 25 bp, Mus musculus
gtcccagctgctgttgaccacaaaa

SEQ ID NO: 245791 - DNA, 25 bp, Mus musculus
tgcctttagactttggacctcctcc

SEQ ID NO: 245792 - DNA, 25 bp, Mus musculus
agggctctctccctgtagaacagca

SEQ ID NO: 245793 - DNA, 25 bp, Mus musculus
acagcacgcagtcccttctacaaga

SEQ ID NO: 245794 - DNA, 25 bp, Mus musculus
gtgtctctgaaatgcctgctccgtc

SEQ ID NO: 245795 - DNA, 25 bp, Mus musculus
ccctggcttgcaaaagtgtctctga

SEQ ID NO: 245796 - DNA, 25 bp, Mus musculus
gacgcggctgatctctcacatggaa

SEQ ID NO: 245797 - DNA, 25 bp, Mus musculus
ccaagggaaccaagatccgagtgtc

SEQ ID NO: 245798 - DNA, 25 bp, Mus musculus
tgcatactaggcaggcctggtgtga

SEQ ID NO: 245799 - DNA, 25 bp, Mus musculus
atccaggtgtcctcctcgttcgtgc

SEQ ID NO: 245800 - DNA, 25 bp, Mus musculus
cagccgctcgcgttcatccaggtgt

SEQ ID NO: 245801 - DNA, 25 bp, Mus musculus
cgaagcacgtgcagccgctcgcgtt

SEQ ID NO: 245802 - DNA, 25 bp, Mus musculus
atagtcctcccgaagcacgtgcagc

SEQ ID NO: 245803 - DNA, 25 bp, Mus musculus
gggtgctcatagtcctcccgaagca

SEQ ID NO: 245804 - DNA, 25 bp, Mus musculus
tccatctagagaagcggggtgcaca

SEQ ID NO: 245805 - DNA, 25 bp, Mus musculus
gctgatgcgagggtagtgcatacta

SEQ ID NO: 245806 - DNA, 25 bp, Mus musculus
agtccattctggtggcccgcagtag

SEQ ID NO: 245807 - DNA, 25 bp, Mus musculus
cggggtcttgttaagcagtccattc

SEQ ID NO: 245808 - DNA, 25 bp, Mus musculus
tcagccgacagaggcgtagtcctcc

SEQ ID NO: 245809 - DNA, 25 bp, Mus musculus
ctctcggatttcagccgacagaggc

SEQ ID NO: 245810 - DNA, 25 bp, Mus musculus
cggtggcctctctcggatttcagcc

SEQ ID NO: 245811 - DNA, 25 bp, Mus musculus
cacagggtgcaaccgcgggtgctca

SEQ ID NO: 245812 - DNA, 25 bp, Mus musculus
cgggaggtgaagcagaaacaggcgc

SEQ ID NO: 245813 - DNA, 25 bp, Mus musculus
tgagcgatgagtgggagtgattggt

SEQ ID NO: 245814 - DNA, 25 bp, Mus musculus
taaccctgcgctgagcgatgagtgg

SEQ ID NO: 245815 - DNA, 25 bp, Mus musculus
ggtaaccctgcgctgagcgatgagt

SEQ ID NO: 245816 - DNA, 25 bp, Mus musculus
ggttggtaaccctgcgctgagcgat

SEQ ID NO: 245817 - DNA, 25 bp, Mus musculus
ctgggttggtaaccctgcgctgagc

SEQ ID NO: 245818 - DNA, 25 bp, Mus musculus
accctgggttggtaaccctgcgctg

SEQ ID NO: 245819 - DNA, 25 bp, Mus musculus
ggcaggtcagattcggtcccgaccc

SEQ ID NO: 245820 - DNA, 25 bp, Mus musculus
aacaggcgccggcaggtcagattcg

SEQ ID NO: 245821 - DNA, 25 bp, Mus musculus
ctccagacggcatcccggggcgctg

SEQ ID NO: 245822 - DNA, 25 bp, Mus musculus
attcgggctccagacggcatcccgg

SEQ ID NO: 245823 - DNA, 25 bp, Mus musculus
ggcattcgggctccagacggcatcc

SEQ ID NO: 245824 - DNA, 25 bp, Mus musculus
gggctgcccatgtacggggagcccg

SEQ ID NO: 245825 - DNA, 25 bp, Mus musculus
ccggcaggtcagattcggtcccgac

SEQ ID NO: 245826 - DNA, 25 bp, Mus musculus
tggctgtgcccatctctctcgggca

SEQ ID NO: 245827 - DNA, 25 bp, Mus musculus
cacgagcctcagtattcaaatgacc

SEQ ID NO: 245828 - DNA, 25 bp, Mus musculus
tctctctcgggcagatggctttcct

SEQ ID NO: 245829 - DNA, 25 bp, Mus musculus
tctcgggcagatggctttccttggc

SEQ ID NO: 245830 - DNA, 25 bp, Mus musculus
ttccttggctttgtgctcttcggtg

SEQ ID NO: 245831 - DNA, 25 bp, Mus musculus
tggctttgtgctcttcggtggtcag

SEQ ID NO: 245832 - DNA, 25 bp, Mus musculus
tggtcaggtcctttcgggatcccga

SEQ ID NO: 245833 - DNA, 25 bp, Mus musculus
tcctttcgggatcccgagtggtctc

SEQ ID NO: 245834 - DNA, 25 bp, Mus musculus
ggatcccgagtggtctctctccttc

SEQ ID NO: 245835 - DNA, 25 bp, Mus musculus
ctctccttctcttttggtttatctt

SEQ ID NO: 245836 - DNA, 25 bp, Mus musculus
ttggtttatctttctcacgagcctc

SEQ ID NO: 245837 - DNA, 25 bp, Mus musculus
gcacccgggacagctgcttgggttc

SEQ ID NO: 245838 - DNA, 25 bp, Mus musculus
tgctgcacgtccctcgtggctgtgc

SEQ ID NO: 245839 - DNA, 25 bp, Mus musculus
agctgcttgggttcctcgcctgctg

SEQ ID NO: 245840 - DNA, 25 bp, Mus musculus
tccgaaccggatcctaaacggcagc

SEQ ID NO: 245841 - DNA, 25 bp, Mus musculus
ccgcctgttcctggctcaagtgaac

SEQ ID NO: 245842 - DNA, 25 bp, Mus musculus
gacacgctccgggagtcgcaatctg

SEQ ID NO: 245843 - DNA, 25 bp, Mus musculus
tggcttaaaccagaggctcaacttg

SEQ ID NO: 245844 - DNA, 25 bp, Mus musculus
gctgaggcacgcgaaccaaatccga

SEQ ID NO: 245845 - DNA, 25 bp, Mus musculus
ttcctctccaaagtctcaaagctga

SEQ ID NO: 245846 - DNA, 25 bp, Mus musculus
cccggctaggtccacaagtctgtgt

SEQ ID NO: 245847 - DNA, 25 bp, Mus musculus
caccaccgggagagagcaaccaaaa

SEQ ID NO: 245848 - DNA, 25 bp, Mus musculus
ttctctccgggtggatcaccacaca

SEQ ID NO: 245849 - DNA, 25 bp, Mus musculus
tgagtcctccgtcaggttctctccg

SEQ ID NO: 245850 - DNA, 25 bp, Mus musculus
cccaagttcatggtttgagtcctcc

SEQ ID NO: 245851 - DNA, 25 bp, Mus musculus
tcaagtgaactccatcaggcggccc

SEQ ID NO: 245852 - DNA, 25 bp, Mus musculus
gtggggcaacattacctggtcgcca

SEQ ID NO: 245853 - DNA, 25 bp, Mus musculus
cggcgacaggacaaaggagaccatg

SEQ ID NO: 245854 - DNA, 25 bp, Mus musculus
caaaccggccgtcgactagcaaaga

SEQ ID NO: 245855 - DNA, 25 bp, Mus musculus
cgactagcaaagacacccgcggtgg

SEQ ID NO: 245856 - DNA, 25 bp, Mus musculus
tgatcctctttccaattagcccaga

SEQ ID NO: 245857 - DNA, 25 bp, Mus musculus
gcagcggtcgcaaagcaaaggcaga

SEQ ID NO: 245858 - DNA, 25 bp, Mus musculus
ctgattggctgcagcgaaggttgca

SEQ ID NO: 245859 - DNA, 25 bp, Mus musculus
ttgacaatttattcctgagacccgg

SEQ ID NO: 245860 - DNA, 25 bp, Mus musculus
agagagcgcgcacagcttctgttcc

SEQ ID NO: 245861 - DNA, 25 bp, Mus musculus
ttagcccagaaacctgcaaaccggc

SEQ ID NO: 245862 - DNA, 25 bp, Mus musculus
ctttcaaataggtgtgcggcgacta

SEQ ID NO: 245863 - DNA, 25 bp, Mus musculus
gtccgcagaccagccaggctcttga

SEQ ID NO: 245864 - DNA, 25 bp, Mus musculus
ggagcggcacgaccctagtccgcag

SEQ ID NO: 245865 - DNA, 25 bp, Mus musculus
tcacaactccgggacagcaggggct

SEQ ID NO: 245866 - DNA, 25 bp, Mus musculus
gagccggtgagcgacctactcacaa

SEQ ID NO: 245867 - DNA, 25 bp, Mus musculus
tcacccgcagtgcaccagctgattg

SEQ ID NO: 245868 - DNA, 25 bp, Mus musculus
agttccagaggtcacccttcttcca

SEQ ID NO: 245869 - DNA, 25 bp, Mus musculus
gaagaattgcaaagcctggcgcgtg

SEQ ID NO: 245870 - DNA, 25 bp, Mus musculus
cgctgaagcagttgtgggatttttt

SEQ ID NO: 245871 - DNA, 25 bp, Mus musculus
tcacaagcggagacagaggttgccc

SEQ ID NO: 245872 - DNA, 25 bp, Mus musculus
ggggagcataaccacgcaatcacaa

SEQ ID NO: 245873 - DNA, 25 bp, Mus musculus
aaatgcatccaagggaagccagggc

SEQ ID NO: 245874 - DNA, 25 bp, Mus musculus
gtccgaaaaggtcacggtgaagtga

SEQ ID NO: 245875 - DNA, 25 bp, Mus musculus
ggtgagtcagtcaacgaggaaagca

SEQ ID NO: 245876 - DNA, 25 bp, Mus musculus
aagcaaagagcagtctccaacccga

SEQ ID NO: 245877 - DNA, 25 bp, Mus musculus
ctccaacccgagatacaccggtgtg

SEQ ID NO: 245878 - DNA, 25 bp, Mus musculus
cccgcctgaggaagaagcgctgcga

SEQ ID NO: 245879 - DNA, 25 bp, Mus musculus
cgcacacacacaaattgtagatctc

SEQ ID NO: 245880 - DNA, 25 bp, Mus musculus
agcgctgcgagatgccgctcgctct

SEQ ID NO: 245881 - DNA, 25 bp, Mus musculus
tcgcagaaaaactcactcccgggct

SEQ ID NO: 245882 - DNA, 25 bp, Mus musculus
ccggcgtttgagtggcaagttgttt

SEQ ID NO: 245883 - DNA, 25 bp, Mus musculus
actgcacattctggaacaccggctg

SEQ ID NO: 245884 - DNA, 25 bp, Mus musculus
ggcggacgatggaactgcacattct

SEQ ID NO: 245885 - DNA, 25 bp, Mus musculus
gccaccgcggatgatccgccgtgga

SEQ ID NO: 245886 - DNA, 25 bp, Mus musculus
gaatcaacccggcatcgagctccgg

SEQ ID NO: 245887 - DNA, 25 bp, Mus musculus
tctggctcgagtacgaatcaacccg

SEQ ID NO: 245888 - DNA, 25 bp, Mus musculus
gccaagcttcctttttctggctcga

SEQ ID NO: 245889 - DNA, 25 bp, Mus musculus
ctcagccgggcgctgtttgcttgtc

SEQ ID NO: 245890 - DNA, 25 bp, Mus musculus
gccagcgtcgccaaggagagtatcc

SEQ ID NO: 245891 - DNA, 25 bp, Mus musculus
caagttgtttgttacagcgaacacc

SEQ ID NO: 245892 - DNA, 25 bp, Mus musculus
acaaatcccgattggcattgcgtgg

SEQ ID NO: 245893 - DNA, 25 bp, Mus musculus
gagagtatcccgctcttcacctacg

SEQ ID NO: 245894 - DNA, 25 bp, Mus musculus
ttacagcgaacaccagctgctgctg

SEQ ID NO: 245895 - DNA, 25 bp, Mus musculus
acaccggctgcaagttgccagcgtc

SEQ ID NO: 245896 - DNA, 25 bp, Mus musculus
gcgaccgaggcacagctgtccggta

SEQ ID NO: 245897 - DNA, 25 bp, Mus musculus
tagggtgagacagaagtcccttctg

SEQ ID NO: 245898 - DNA, 25 bp, Mus musculus
cggtagggtgagacagaagtccctt

SEQ ID NO: 245899 - DNA, 25 bp, Mus musculus
gcactacgcatctcaaggccgagga

SEQ ID NO: 245900 - DNA, 25 bp, Mus musculus
tccggtagggtgagacagaagtccc

SEQ ID NO: 245901 - DNA, 25 bp, Mus musculus
cacagctgtccggtagggtgagaca

SEQ ID NO: 245902 - DNA, 25 bp, Mus musculus
actacgcatctcaaggccgaggatg

SEQ ID NO: 245903 - DNA, 25 bp, Mus musculus
ggacacagcaccgtcggcgcacgca

SEQ ID NO: 245904 - DNA, 25 bp, Mus musculus
gcacgcacgcgcactacgcatctca

SEQ ID NO: 245905 - DNA, 25 bp, Mus musculus
gcgcactacgcatctcaaggccgag

SEQ ID NO: 245906 - DNA, 25 bp, Mus musculus
agggtgagacagaagtcccttctgg

SEQ ID NO: 245907 - DNA, 25 bp, Mus musculus
atctcaaggccgaggatggctgggt

SEQ ID NO: 245908 - DNA, 25 bp, Mus musculus
cgaccgaggcacagctgtccggtag

SEQ ID NO: 245909 - DNA, 25 bp, Mus musculus
tacgcatctcaaggccgaggatggc

SEQ ID NO: 245910 - DNA, 25 bp, Mus musculus
agaagtcccttctggagctcgccca

SEQ ID NO: 245911 - DNA, 25 bp, Mus musculus
cagaaggtctgtgagccgatcgccc

SEQ ID NO: 245912 - DNA, 25 bp, Mus musculus
tttccggccagaaggtctgtgagcc

SEQ ID NO: 245913 - DNA, 25 bp, Mus musculus
cgctgacgacgacggccctggtagc

SEQ ID NO: 245914 - DNA, 25 bp, Mus musculus
cacttggccatggcggcgctgacga

SEQ ID NO: 245915 - DNA, 25 bp, Mus musculus
gccagttgttcacgttggtcccgtc

SEQ ID NO: 245916 - DNA, 25 bp, Mus musculus
ggcccaccgcaccagtgccagttgt

SEQ ID NO: 245917 - DNA, 25 bp, Mus musculus
accgtctcccgccacgggcagccgt

SEQ ID NO: 245918 - DNA, 25 bp, Mus musculus
agcgcagttaggaaccgtctcccgc

SEQ ID NO: 245919 - DNA, 25 bp, Mus musculus
accagcgcagttaggaaccgtctcc

SEQ ID NO: 245920 - DNA, 25 bp, Mus musculus
gccgtaggaccagcgcagttaggaa

SEQ ID NO: 245921 - DNA, 25 bp, Mus musculus
agcctgaagccgtaggaccagcgca

SEQ ID NO: 245922 - DNA, 25 bp, Mus musculus
cccaacttcaggaggagcctgaagc

SEQ ID NO: 245923 - DNA, 25 bp, Mus musculus
ctcgcccaacttcaggaggagcctg

SEQ ID NO: 245924 - DNA, 25 bp, Mus musculus
cgggatctcggaggtcattgctccc

SEQ ID NO: 245925 - DNA, 25 bp, Mus musculus
ccatgcttactactggctgaaggcg

SEQ ID NO: 245926 - DNA, 25 bp, Mus musculus
gcggaagtagatacggccatgctta

SEQ ID NO: 245927 - DNA, 25 bp, Mus musculus
tgacctctagcctggcggaagtaga

SEQ ID NO: 245928 - DNA, 25 bp, Mus musculus
catcttgtgtcacccttgacctcta

SEQ ID NO: 245929 - DNA, 25 bp, Mus musculus
gcgtcacgcctcaaccgcttatggg

SEQ ID NO: 245930 - DNA, 25 bp, Mus musculus
aacggccggccggtgtccagtgctc

SEQ ID NO: 245931 - DNA, 25 bp, Mus musculus
cccagacgaagacgcgatcggcgcg

SEQ ID NO: 245932 - DNA, 25 bp, Mus musculus
aggacggcaccacgaagctgggcac

SEQ ID NO: 245933 - DNA, 25 bp, Mus musculus
ccttatgatccagctccaggcggta

SEQ ID NO: 245934 - DNA, 25 bp, Mus musculus
agatgccagcgaggatgccactgcc

SEQ ID NO: 245935 - DNA, 25 bp, Mus musculus
gaggtcattgctcccggaaatccgg

SEQ ID NO: 245936 - DNA, 25 bp, Mus musculus
agaaagttccctaagagatgccagc

SEQ ID NO: 245937 - DNA, 25 bp, Mus musculus
tcgcccacgtactgaaacaccggaa

SEQ ID NO: 245938 - DNA, 25 bp, Mus musculus
cttccttccaggaagcaaacaaaga

SEQ ID NO: 245939 - DNA, 25 bp, Mus musculus
cgcgaagccacgtgcacgccacgca

SEQ ID NO: 245940 - DNA, 25 bp, Mus musculus
cgtacctgcgctgtgtttagaaacc

SEQ ID NO: 245941 - DNA, 25 bp, Mus musculus
gaagccgaccttccttccaggaagc

SEQ ID NO: 245942 - DNA, 25 bp, Mus musculus
cgctgtgtttagaaacccttgattg

SEQ ID NO: 245943 - DNA, 25 bp, Mus musculus
gcagggccctcaggtgcgtatcccg

SEQ ID NO: 245944 - DNA, 25 bp, Mus musculus
gccgccgcttccctcacaacttccg

SEQ ID NO: 245945 - DNA, 25 bp, Mus musculus
ttccctaccgcgatcgggccgtgaa

SEQ ID NO: 245946 - DNA, 25 bp, Mus musculus
tggggttaggcgactttcgcacgcc

SEQ ID NO: 245947 - DNA, 25 bp, Mus musculus
ttaggcgactttcgcacgccaggcg

SEQ ID NO: 245948 - DNA, 25 bp, Mus musculus
aggcgcgcaccaaaatctcgctttc

SEQ ID NO: 245949 - DNA, 25 bp, Mus musculus
tctcgctttcgattggttgtgacgg

SEQ ID NO: 245950 - DNA, 25 bp, Mus musculus
gccacctgacgtacctgcgctgtgt

SEQ ID NO: 245951 - DNA, 25 bp, Mus musculus
gaagccgtcctgcagcgcaccggaa

SEQ ID NO: 245952 - DNA, 25 bp, Mus musculus
tctagggccgctgcttctcacacag

SEQ ID NO: 245953 - DNA, 25 bp, Mus musculus
ttccgtttggtgctctctgtgcagc

SEQ ID NO: 245954 - DNA, 25 bp, Mus musculus
cggagtcgatggattgtctgcaaac

SEQ ID NO: 245955 - DNA, 25 bp, Mus musculus
tctgcaaaccaaagccaggaccatc

SEQ ID NO: 245956 - DNA, 25 bp, Mus musculus
ccagcctcccagttgtaaggtgctc

SEQ ID NO: 245957 - DNA, 25 bp, Mus musculus
gtaaggtgctcgcagtttctagtcc

SEQ ID NO: 245958 - DNA, 25 bp, Mus musculus
gtttctagtcctgatcccgtcccta

SEQ ID NO: 245959 - DNA, 25 bp, Mus musculus
cctttgtgccatccgtgctcagcgg

SEQ ID NO: 245960 - DNA, 25 bp, Mus musculus
gctgctgcaggaatcggacgctgtt

SEQ ID NO: 245961 - DNA, 25 bp, Mus musculus
ttgcggcgataggtgtcctggctaa

SEQ ID NO: 245962 - DNA, 25 bp, Mus musculus
cacagcggacgtcagcttccgtttg

SEQ ID NO: 245963 - DNA, 25 bp, Mus musculus
ctggcccagcaggatgcaagtgtca

SEQ ID NO: 245964 - DNA, 25 bp, Mus musculus
ttccgagaacgctggtggatgctct

SEQ ID NO: 245965 - DNA, 25 bp, Mus musculus
ctggctaaggcgcttccgagaacgc

SEQ ID NO: 245966 - DNA, 25 bp, Mus musculus
gctcgcgcgagaccatccctctcaa

SEQ ID NO: 245967 - DNA, 25 bp, Mus musculus
gaacagggacgaagcccagggataa

SEQ ID NO: 245968 - DNA, 25 bp, Mus musculus
gacagggactcacccgaagagcagc

SEQ ID NO: 245969 - DNA, 25 bp, Mus musculus
cgatctgaggcgacagggactcacc

SEQ ID NO: 245970 - DNA, 25 bp, Mus musculus
ggcagagtgtcgaataaagacgccc

SEQ ID NO: 245971 - DNA, 25 bp, Mus musculus
agtcggtgcacacactcccgacggg

SEQ ID NO: 245972 - DNA, 25 bp, Mus musculus
ttgccactcgcagcgcgccaagcga

SEQ ID NO: 245973 - DNA, 25 bp, Mus musculus
aaaaaagccgcgtcgcgtccgctgc

SEQ ID NO: 245974 - DNA, 25 bp, Mus musculus
cgcaccacgggtgtgcgcgtgcaac

SEQ ID NO: 245975 - DNA, 25 bp, Mus musculus
tccacgcgtctggatacaatgtacg

SEQ ID NO: 245976 - DNA, 25 bp, Mus musculus
aagcccagggataaccgcggcaggc

SEQ ID NO: 245977 - DNA, 25 bp, Mus musculus
accgtccacgcgtctggatacaatg

SEQ ID NO: 245978 - DNA, 25 bp, Mus musculus
acaatgtacgcaggcgcggaacgcc

SEQ ID NO: 245979 - DNA, 25 bp, Mus musculus
ggtacgctaactcgtccgctcgttc

SEQ ID NO: 245980 - DNA, 25 bp, Mus musculus
tgggctctctcacacttctactcga

SEQ ID NO: 245981 - DNA, 25 bp, Mus musculus
ggctgccgcattcctgcactgataa

SEQ ID NO: 245982 - DNA, 25 bp, Mus musculus
taagacagaaatagtccggcggccc

SEQ ID NO: 245983 - DNA, 25 bp, Mus musculus
tgacaaggggctcgccagccactct

SEQ ID NO: 245984 - DNA, 25 bp, Mus musculus
tgccctcgccacaaatagtttctcg

SEQ ID NO: 245985 - DNA, 25 bp, Mus musculus
ttctcggttagggaattcgccgaca

SEQ ID NO: 245986 - DNA, 25 bp, Mus musculus
ctgcagcatttctgaggccctttcc

SEQ ID NO: 245987 - DNA, 25 bp, Mus musculus
accaggcaggccaagtagggaaaca

SEQ ID NO: 245988 - DNA, 25 bp, Mus musculus
agggaaacatttgctggaaggaatc

SEQ ID NO: 245989 - DNA, 25 bp, Mus musculus
gatgtgtgtgcccttgtctcgcaca

SEQ ID NO: 245990 - DNA, 25 bp, Mus musculus
gcacaccgtgtgtctgcaccctttt

SEQ ID NO: 245991 - DNA, 25 bp, Mus musculus
ctgcacccttttgtggcacggcgca

SEQ ID NO: 245992 - DNA, 25 bp, Mus musculus
gccaggcagggaacagacagttcca

SEQ ID NO: 245993 - DNA, 25 bp, Mus musculus
cccatggaccagaaactcaaaaagt

SEQ ID NO: 245994 - DNA, 25 bp, Mus musculus
gttggaactgtcattgggcggctcc

SEQ ID NO: 245995 - DNA, 25 bp, Mus musculus
cctccaggtgcaacaaagtagcgtc

SEQ ID NO: 245996 - DNA, 25 bp, Mus musculus
tgcgggtctacgaaggcagtttcac

SEQ ID NO: 245997 - DNA, 25 bp, Mus musculus
aaattcggcggagtctgtgaacagc

SEQ ID NO: 245998 - DNA, 25 bp, Mus musculus
cttaataacagccacgccctcgggg

SEQ ID NO: 245999 - DNA, 25 bp, Mus musculus
gactgcgcctcctcgagagagggca

SEQ ID NO: 246000 - DNA, 25 bp, Mus musculus
tggcagaattgtccctgcttgggac

SEQ ID NO: 246001 - DNA, 25 bp, Mus musculus
tgccagctgcggcattggcagaatt

SEQ ID NO: 246002 - DNA, 25 bp, Mus musculus
cggtgaccaagtcttctcagctgca

SEQ ID NO: 246003 - DNA, 25 bp, Mus musculus
gcttgccggctctgcctgttggaac

SEQ ID NO: 246004 - DNA, 25 bp, Mus musculus
tcggagacagatccgccctctgcag

SEQ ID NO: 246005 - DNA, 25 bp, Mus musculus
cacaccaggcttgagggacaccggc

SEQ ID NO: 246006 - DNA, 25 bp, Mus musculus
gtagcgtcaacctcatgcactcggc

SEQ ID NO: 246007 - DNA, 25 bp, Mus musculus
tctccaggccagtttaggggactgc

SEQ ID NO: 246008 - DNA, 25 bp, Mus musculus
accagcgaggggcagcgtgggaccg

SEQ ID NO: 246009 - DNA, 25 bp, Mus musculus
cagggtcccgcagattgtggacagc

SEQ ID NO: 246010 - DNA, 25 bp, Mus musculus
cagattgtggacagcgtgggaccag

SEQ ID NO: 246011 - DNA, 25 bp, Mus musculus
tcagcgcctcgttttatccccaaag

SEQ ID NO: 246012 - DNA, 25 bp, Mus musculus
aggggccccttacctccaggctgcg

SEQ ID NO: 246013 - DNA, 25 bp, Mus musculus
atggaggaggttgagcaagaggatc

SEQ ID NO: 246014 - DNA, 25 bp, Mus musculus
agaggatcagcaagacgccaggctg

SEQ ID NO: 246015 - DNA, 25 bp, Mus musculus
aggatcagcaagacgccaggctgcg

SEQ ID NO: 246016 - DNA, 25 bp, Mus musculus
tcagcaagacgccaggctgcgggac

SEQ ID NO: 246017 - DNA, 25 bp, Mus musculus
gctgcgggactaccgctgtcagacc

SEQ ID NO: 246018 - DNA, 25 bp, Mus musculus
tgtcagacccgccatctcggggagg

SEQ ID NO: 246019 - DNA, 25 bp, Mus musculus
tcagacccgccatctcggggaggac

SEQ ID NO: 246020 - DNA, 25 bp, Mus musculus
gacccgccatctcggggaggactgc

SEQ ID NO: 246021 - DNA, 25 bp, Mus musculus
agcctgctctcagcgcctcgtttta

SEQ ID NO: 246022 - DNA, 25 bp, Mus musculus
ctgagcctgtaccttcttggagacc

SEQ ID NO: 246023 - DNA, 25 bp, Mus musculus
tgggctgaggcgtagtcctccctcc

SEQ ID NO: 246024 - DNA, 25 bp, Mus musculus
aatgatgggctgaggcgtagtcctc

SEQ ID NO: 246025 - DNA, 25 bp, Mus musculus
cccgatccacctccgggaatgatgg

SEQ ID NO: 246026 - DNA, 25 bp, Mus musculus
tgtggtgaggaagaaccccacccgc

SEQ ID NO: 246027 - DNA, 25 bp, Mus musculus
taccttcttggagacccttgtggtg

SEQ ID NO: 246028 - DNA, 25 bp, Mus musculus
gcctgtaccttcttggagacccttg

SEQ ID NO: 246029 - DNA, 25 bp, Mus musculus
cttccctcgggtctgcctggagaag

SEQ ID NO: 246030 - DNA, 25 bp, Mus musculus
aaacccaatcgtcgcggtgctggag

SEQ ID NO: 246031 - DNA, 25 bp, Mus musculus
gaaacccaatcgtcgcggtgctgga

SEQ ID NO: 246032 - DNA, 25 bp, Mus musculus
cggaaacccaatcgtcgcggtgctg

SEQ ID NO: 246033 - DNA, 25 bp, Mus musculus
tgagcctgtaccttcttggagaccc

SEQ ID NO: 246034 - DNA, 25 bp, Mus musculus
tgtaccttcttggagacccttgtgg

SEQ ID NO: 246035 - DNA, 25 bp, Mus musculus
ctgtaccttcttggagacccttgtg

SEQ ID NO: 246036 - DNA, 25 bp, Mus musculus
agtacttggccgagtagggcttgtc

SEQ ID NO: 246037 - DNA, 25 bp, Mus musculus
ctccggcggtgatcatgatcttggc

SEQ ID NO: 246038 - DNA, 25 bp, Mus musculus
atgaacacggctccggcggtgatca

SEQ ID NO: 246039 - DNA, 25 bp, Mus musculus
agcatgcttgccacgatgaacacgg

SEQ ID NO: 246040 - DNA, 25 bp, Mus musculus
cgggcaccataatcagcatgcttgc

SEQ ID NO: 246041 - DNA, 25 bp, Mus musculus
cggtccaggacacgggcaccataat

SEQ ID NO: 246042 - DNA, 25 bp, Mus musculus
atgacgttgtgagcggtccaggaca

SEQ ID NO: 246043 - DNA, 25 bp, Mus musculus
ccaccatagggttgtagaagtcgcg

SEQ ID NO: 246044 - DNA, 25 bp, Mus musculus
gcccggaagccaccatagggttgta

SEQ ID NO: 246045 - DNA, 25 bp, Mus musculus
gccgcccagccgacgtaaagcgagg

SEQ ID NO: 246046 - DNA, 25 bp, Mus musculus
agcagaggaggcctcctcccaggag

SEQ ID NO: 246047 - DNA, 25 bp, Mus musculus
gcaactgcagcagaggaggcctcct

SEQ ID NO: 246048 - DNA, 25 bp, Mus musculus
ttgctacgaggtgggcaactgcagc

SEQ ID NO: 246049 - DNA, 25 bp, Mus musculus
cgagtagggcttgtcgttgctacga

SEQ ID NO: 246050 - DNA, 25 bp, Mus musculus
gggcgcccagtgtaccaactgcgta

SEQ ID NO: 246051 - DNA, 25 bp, Mus musculus
cgtcaccactaccagcagtcgatga

SEQ ID NO: 246052 - DNA, 25 bp, Mus musculus
ctacgaccgcaaggactacgtctga

SEQ ID NO: 246053 - DNA, 25 bp, Mus musculus
caagatcctctattctgcgccgcga

SEQ ID NO: 246054 - DNA, 25 bp, Mus musculus
gcgcgacaagtatgcacccaccaag

SEQ ID NO: 246055 - DNA, 25 bp, Mus musculus
tctataacccgttggtgcccgaggc

SEQ ID NO: 246056 - DNA, 25 bp, Mus musculus
ggccaaggccaagatcaccatcgtg

SEQ ID NO: 246057 - DNA, 25 bp, Mus musculus
ggcagcagcatcatcacggcgcaga

SEQ ID NO: 246058 - DNA, 25 bp, Mus musculus
agggcagttgattcccaggtccagc

SEQ ID NO: 246059 - DNA, 25 bp, Mus musculus
tccgtcagttttcgaagggcagttg

SEQ ID NO: 246060 - DNA, 25 bp, Mus musculus
tcccggcgacagacgtccgtcagtt

SEQ ID NO: 246061 - DNA, 25 bp, Mus musculus
gccggttcaagtccagcagccatgt

SEQ ID NO: 246062 - DNA, 25 bp, Mus musculus
ggtcggccaacaccatcatcaggga

SEQ ID NO: 246063 - DNA, 25 bp, Mus musculus
agccctcatcgtggtgtccatcctg

SEQ ID NO: 246064 - DNA, 25 bp, Mus musculus
gcgctcagtactccagcgacctgtg

SEQ ID NO: 246065 - DNA, 25 bp, Mus musculus
tccaggctagagctggcaggacaca

SEQ ID NO: 246066 - DNA, 25 bp, Mus musculus
tgacaccagggcgttccaggctaga

SEQ ID NO: 246067 - DNA, 25 bp, Mus musculus
cactgagtatctgcggcgtgacacc

SEQ ID NO: 246068 - DNA, 25 bp, Mus musculus
cggcgagatgctgcccactgagtat

SEQ ID NO: 246069 - DNA, 25 bp, Mus musculus
ccgggaacttgccagctcagaggtt

SEQ ID NO: 246070 - DNA, 25 bp, Mus musculus
cagctcagaggttctaggggcagcc

SEQ ID NO: 246071 - DNA, 25 bp, Mus musculus
cggcgcgcttctctagttgcagctt

SEQ ID NO: 246072 - DNA, 25 bp, Mus musculus
tatagacgcgcgacgtgatcagttc

SEQ ID NO: 246073 - DNA, 25 bp, Mus musculus
tgatcagttcgcacgcggacccacg

SEQ ID NO: 246074 - DNA, 25 bp, Mus musculus
agccagaccacggtccgggaacttg

SEQ ID NO: 246075 - DNA, 25 bp, Mus musculus
tattctgtgggtgcaggcacgcacc

SEQ ID NO: 246076 - DNA, 25 bp, Mus musculus
tctgcctcaagagcctattctgtgg

SEQ ID NO: 246077 - DNA, 25 bp, Mus musculus
ttccagcgtggactccctggacctg

SEQ ID NO: 246078 - DNA, 25 bp, Mus musculus
gaacccggcaggattacgtaatggc

SEQ ID NO: 246079 - DNA, 25 bp, Mus musculus
gcggttcctgtcacgttctgtagca

SEQ ID NO: 246080 - DNA, 25 bp, Mus musculus
ggacagccctaggaagcacactttg

SEQ ID NO: 246081 - DNA, 25 bp, Mus musculus
ggcggagccctagttggaatagaca

SEQ ID NO: 246082 - DNA, 25 bp, Mus musculus
cgggaatacattagaccacgtggcc

SEQ ID NO: 246083 - DNA, 25 bp, Mus musculus
gggctgaactgactccgggaataca

SEQ ID NO: 246084 - DNA, 25 bp, Mus musculus
tctagcggctgcgtccaagaagctt

SEQ ID NO: 246085 - DNA, 25 bp, Mus musculus
tcacagcgtctgtaggaattgcgta

SEQ ID NO: 246086 - DNA, 25 bp, Mus musculus
ggaactggtctctaagcggctcaca

SEQ ID NO: 246087 - DNA, 25 bp, Mus musculus
agggaccagtcccacgtagcgcttc

SEQ ID NO: 246088 - DNA, 25 bp, Mus musculus
gctaagaagcctacgtccgggtgcc

SEQ ID NO: 246089 - DNA, 25 bp, Mus musculus
tgcgaaaccgtgcaagggcctctta

SEQ ID NO: 246090 - DNA, 25 bp, Mus musculus
caattccgggagctagagcagttta

SEQ ID NO: 246091 - DNA, 25 bp, Mus musculus
aggcgtggtcaaggagtccaattcc

SEQ ID NO: 246092 - DNA, 25 bp, Mus musculus
cactcccgggagcatgaaggaccga

SEQ ID NO: 246093 - DNA, 25 bp, Mus musculus
ggtcacggactcgagcccttcagca

SEQ ID NO: 246094 - DNA, 25 bp, Mus musculus
cctccgatctacttctggtcacgga

SEQ ID NO: 246095 - DNA, 25 bp, Mus musculus
aaggaccgaacccaggagctccgca

SEQ ID NO: 246096 - DNA, 25 bp, Mus musculus
agctccgcacggtgagtccgatcct

SEQ ID NO: 246097 - DNA, 25 bp, Mus musculus
gctcacccggcgtcttgtaattctc

SEQ ID NO: 246098 - DNA, 25 bp, Mus musculus
tgccaccgaggcacctacaagggga

SEQ ID NO: 246099 - DNA, 25 bp, Mus musculus
caccgggactgatggctagaacctg

SEQ ID NO: 246100 - DNA, 25 bp, Mus musculus
cggcatccgcgcatgcgggacttac

SEQ ID NO: 246101 - DNA, 25 bp, Mus musculus
gtgaccgttcttcgcccgcttgtca

SEQ ID NO: 246102 - DNA, 25 bp, Mus musculus
ccctggaggctgaacctctcgtttc

SEQ ID NO: 246103 - DNA, 25 bp, Mus musculus
atgcgggacttactcggttgcagcc

SEQ ID NO: 246104 - DNA, 25 bp, Mus musculus
gcgggatgcaaaatcgtgaccgttc

SEQ ID NO: 246105 - DNA, 25 bp, Mus musculus
ttctccactttgttccggcatgcca

SEQ ID NO: 246106 - DNA, 25 bp, Mus musculus
tctgggttttccgtagagcccacta

SEQ ID NO: 246107 - DNA, 25 bp, Mus musculus
acgccactcagtcagactaccgaga

SEQ ID NO: 246108 - DNA, 25 bp, Mus musculus
tgtccgagtacaacgccactcagtc

SEQ ID NO: 246109 - DNA, 25 bp, Mus musculus
ggtcatgtccgagtacaacgccact

SEQ ID NO: 246110 - DNA, 25 bp, Mus musculus
tttgtggaggtcatgtccgagtaca

SEQ ID NO: 246111 - DNA, 25 bp, Mus musculus
gctgtcccgaaagtttgtggaggtc

SEQ ID NO: 246112 - DNA, 25 bp, Mus musculus
ccacgctgtcccgaaagtttgtgga

SEQ ID NO: 246113 - DNA, 25 bp, Mus musculus
tccggaagacgcaggtgcagccatg

SEQ ID NO: 246114 - DNA, 25 bp, Mus musculus
tccgtagagcccactacctaaccta

SEQ ID NO: 246115 - DNA, 25 bp, Mus musculus
tcagtcagactaccgagaacgctgc

SEQ ID NO: 246116 - DNA, 25 bp, Mus musculus
cgggcacctgagtctctgggttttc

SEQ ID NO: 246117 - DNA, 25 bp, Mus musculus
gactaccgagaacgctgcaaagggc

SEQ ID NO: 246118 - DNA, 25 bp, Mus musculus
cgacctgaggatccggaagacgcag

SEQ ID NO: 246119 - DNA, 25 bp, Mus musculus
gcactccacgctgtcccgaaagttt

SEQ ID NO: 246120 - DNA, 25 bp, Mus musculus
cagctagagagagaacggcgtttgc

SEQ ID NO: 246121 - DNA, 25 bp, Mus musculus
agcactagcgcgacgctttgacgtc

SEQ ID NO: 246122 - DNA, 25 bp, Mus musculus
tctaccaggcgcactacggagagca

SEQ ID NO: 246123 - DNA, 25 bp, Mus musculus
cggacctggcgtcaagccctctaag

SEQ ID NO: 246124 - DNA, 25 bp, Mus musculus
ctcaggattcgaggcctccattggc

SEQ ID NO: 246125 - DNA, 25 bp, Mus musculus
tttgacgtcatcaatctgcgcccgc

SEQ ID NO: 246126 - DNA, 25 bp, Mus musculus
ccatctcgatggtatggcaacgctg

SEQ ID NO: 246127 - DNA, 25 bp, Mus musculus
gtctccggctacgagatgccatctc

SEQ ID NO: 246128 - DNA, 25 bp, Mus musculus
aagaccaagacctggcggggctctc

SEQ ID NO: 246129 - DNA, 25 bp, Mus musculus
gggaagaatccaaaagcagtcattc

SEQ ID NO: 246130 - DNA, 25 bp, Mus musculus
tccgggcttcattctggtcataaaa

SEQ ID NO: 246131 - DNA, 25 bp, Mus musculus
cttgcgaacgtatttccgggcttca

SEQ ID NO: 246132 - DNA, 25 bp, Mus musculus
catgctctcctcacttgcgaacgta

SEQ ID NO: 246133 - DNA, 25 bp, Mus musculus
ctttccttttatttgattggctaga

SEQ ID NO: 246134 - DNA, 25 bp, Mus musculus
caaacctgtcgctcaaagcgggctc

SEQ ID NO: 246135 - DNA, 25 bp, Mus musculus
gagcatcctcgggagggcacgcctc

SEQ ID NO: 246136 - DNA, 25 bp, Mus musculus
ccatcccggggtgcacgggtgcatc

SEQ ID NO: 246137 - DNA, 25 bp, Mus musculus
actcggacgtgccaggctcccatga

SEQ ID NO: 246138 - DNA, 25 bp, Mus musculus
aggctcccatgatcccgaggcctgg

SEQ ID NO: 246139 - DNA, 25 bp, Mus musculus
tgctgagccgcacgatccggtccag

SEQ ID NO: 246140 - DNA, 25 bp, Mus musculus
atccggtccagcttgggctcatctt

SEQ ID NO: 246141 - DNA, 25 bp, Mus musculus
cttgggctcatcttgaagcagatcc

SEQ ID NO: 246142 - DNA, 25 bp, Mus musculus
atcttgaagcagatcccggagctgc

SEQ ID NO: 246143 - DNA, 25 bp, Mus musculus
agatcccggagctgcccggtgctga

SEQ ID NO: 246144 - DNA, 25 bp, Mus musculus
gttcccgagccatagcaaacctgtc

SEQ ID NO: 246145 - DNA, 25 bp, Mus musculus
aaagcgggctctctcccgaagtcca

SEQ ID NO: 246146 - DNA, 25 bp, Mus musculus
tcccacctatgtctcgaaatccaaa

SEQ ID NO: 246147 - DNA, 25 bp, Mus musculus
cggggtgttcccgagccatagcaaa

SEQ ID NO: 246148 - DNA, 25 bp, Mus musculus
cgaggtcccgcgtgcttaacgagca

SEQ ID NO: 246149 - DNA, 25 bp, Mus musculus
ctcaggaccagattggtggcggaca

SEQ ID NO: 246150 - DNA, 25 bp, Mus musculus
gaaggcgctctgtgattgcaccacg

SEQ ID NO: 246151 - DNA, 25 bp, Mus musculus
caccacgcgctgctgaggtgatctc

SEQ ID NO: 246152 - DNA, 25 bp, Mus musculus
gtgatggctgcacaaatgatcgcgc

SEQ ID NO: 246153 - DNA, 25 bp, Mus musculus
actcggtgaagaaagtgatggctgc

SEQ ID NO: 246154 - DNA, 25 bp, Mus musculus
aggctctaccgtggcacttggactc

SEQ ID NO: 246155 - DNA, 25 bp, Mus musculus
gggacctgaggaagcaggctctacc

SEQ ID NO: 246156 - DNA, 25 bp, Mus musculus
aaagcaagttgcctcctgtcacctg

SEQ ID NO: 246157 - DNA, 25 bp, Mus musculus
cctccgtctaggtgcggggattctt

SEQ ID NO: 246158 - DNA, 25 bp, Mus musculus
gcgccaccaggacgtcacagacggg

SEQ ID NO: 246159 - DNA, 25 bp, Mus musculus
ccggcctgatggcttagtctggccc

SEQ ID NO: 246160 - DNA, 25 bp, Mus musculus
gtcgcacaccgcttctcggaaaaga

SEQ ID NO: 246161 - DNA, 25 bp, Mus musculus
agcaagcccagaagtaccatcccga

SEQ ID NO: 246162 - DNA, 25 bp, Mus musculus
atctctccttccctcgcagaagcac

SEQ ID NO: 246163 - DNA, 25 bp, Mus musculus
gcggcctgcgggacggacgggccgc

SEQ ID NO: 246164 - DNA, 25 bp, Mus musculus
ccaccgtgcggagctagcggccgca

SEQ ID NO: 246165 - DNA, 25 bp, Mus musculus
caccaaatggcaaagcgccgctccc

SEQ ID NO: 246166 - DNA, 25 bp, Mus musculus
agcaccaaatggcaaagcgccgctc

SEQ ID NO: 246167 - DNA, 25 bp, Mus musculus
ttccctcgcagaagcaccaccagca

SEQ ID NO: 246168 - DNA, 25 bp, Mus musculus
taggccgagagcgtgtctggggcaa

SEQ ID NO: 246169 - DNA, 25 bp, Mus musculus
ccacacccgggtaggccgagagcgt

SEQ ID NO: 246170 - DNA, 25 bp, Mus musculus
ccagactgggcgcaggccacacccg

SEQ ID NO: 246171 - DNA, 25 bp, Mus musculus
ggccttcttccaaccagactgggcg

SEQ ID NO: 246172 - DNA, 25 bp, Mus musculus
cgtgcggagctagcggccgcagccg

SEQ ID NO: 246173 - DNA, 25 bp, Mus musculus
cacggctccccagaccgagcatgcg

SEQ ID NO: 246174 - DNA, 25 bp, Mus musculus
gaagagcccggccttcttccaacca

SEQ ID NO: 246175 - DNA, 25 bp, Mus musculus
ccctcgcagaagcaccaccagcacc

SEQ ID NO: 246176 - DNA, 25 bp, Mus musculus
gcaccggaccaaggggcaaaggaca

SEQ ID NO: 246177 - DNA, 25 bp, Mus musculus
ggagacccgaggtcccaggatccga

SEQ ID NO: 246178 - DNA, 25 bp, Mus musculus
tgagcatctgcagcctcgcggagac

SEQ ID NO: 246179 - DNA, 25 bp, Mus musculus
ggccgcagcggcctgagcatctgca

SEQ ID NO: 246180 - DNA, 25 bp, Mus musculus
cccagtctaaaagccgggcttcgtg

SEQ ID NO: 246181 - DNA, 25 bp, Mus musculus
agcccagcccgacgccatctgcaga

SEQ ID NO: 246182 - DNA, 25 bp, Mus musculus
caaggggcaaaggacacctcggagc

SEQ ID NO: 246183 - DNA, 25 bp, Mus musculus
ggctgccatccacgtgctaaggaga

SEQ ID NO: 246184 - DNA, 25 bp, Mus musculus
cctgaggagcggctgccatccacgt

SEQ ID NO: 246185 - DNA, 25 bp, Mus musculus
cacaggccaccagcctgaggagcgg

SEQ ID NO: 246186 - DNA, 25 bp, Mus musculus
attggcaggctcctgagcccacggc

SEQ ID NO: 246187 - DNA, 25 bp, Mus musculus
cagaaggtgattggcaggctcctga

SEQ ID NO: 246188 - DNA, 25 bp, Mus musculus
ggggaacctgcagcgcccagcagtc

SEQ ID NO: 246189 - DNA, 25 bp, Mus musculus
catccacgtgctaaggagagaagga

SEQ ID NO: 246190 - DNA, 25 bp, Mus musculus
gggctcctgtcccaaactgctacgg

SEQ ID NO: 246191 - DNA, 25 bp, Mus musculus
tacggacttggaggatccgagtccc

SEQ ID NO: 246192 - DNA, 25 bp, Mus musculus
gcgctctccagagcgcccgagagtt

SEQ ID NO: 246193 - DNA, 25 bp, Mus musculus
ccgagagttggcgacaatagtggcc

SEQ ID NO: 246194 - DNA, 25 bp, Mus musculus
cggatctatccgtgaacttgcaggt

SEQ ID NO: 246195 - DNA, 25 bp, Mus musculus
actcggactcggatacggacttgga

SEQ ID NO: 246196 - DNA, 25 bp, Mus musculus
tggcctgcatcgatcacaggtcatc

SEQ ID NO: 246197 - DNA, 25 bp, Mus musculus
acaggtcatccacagcggacacttc

SEQ ID NO: 246198 - DNA, 25 bp, Mus musculus
cacttcatggtgtcttcgccgcaca

SEQ ID NO: 246199 - DNA, 25 bp, Mus musculus
tcccagctttccgtggtgggaccgc

SEQ ID NO: 246200 - DNA, 25 bp, Mus musculus
agctggctacgttaagcgctctcca

SEQ ID NO: 246201 - DNA, 25 bp, Mus musculus
gacgctggacacaacttaggcatta

SEQ ID NO: 246202 - DNA, 25 bp, Mus musculus
gcattatcttcctcgcctggtcctg

SEQ ID NO: 246203 - DNA, 25 bp, Mus musculus
ttcgagtgcttgagcctggcttaca

SEQ ID NO: 246204 - DNA, 25 bp, Mus musculus
cgaaaaccgtcaagattggctcctc

SEQ ID NO: 246205 - DNA, 25 bp, Mus musculus
tcaaggcgctcaagaggccaacctc

SEQ ID NO: 246206 - DNA, 25 bp, Mus musculus
cgtgagcactcaaacgcgcgaggtt

SEQ ID NO: 246207 - DNA, 25 bp, Mus musculus
gaggttccgcctccagcacgagcag

SEQ ID NO: 246208 - DNA, 25 bp, Mus musculus
tgtcaacggccaggtcttgctcctc

SEQ ID NO: 246209 - DNA, 25 bp, Mus musculus
ggtcttgctcctcctaacactcaga

SEQ ID NO: 246210 - DNA, 25 bp, Mus musculus
tccgcccttatagagttccaactgc

SEQ ID NO: 246211 - DNA, 25 bp, Mus musculus
ggtgactctggggactttgctcccg

SEQ ID NO: 246212 - DNA, 25 bp, Mus musculus
agccagcccgtctgtaagtataccg

SEQ ID NO: 246213 - DNA, 25 bp, Mus musculus
agctgtcccgcagtcatggagctgc

SEQ ID NO: 246214 - DNA, 25 bp, Mus musculus
catcgtaacgactaggtcccgcctt

SEQ ID NO: 246215 - DNA, 25 bp, Mus musculus
ctgcagagcgctccaacggccaggt

SEQ ID NO: 246216 - DNA, 25 bp, Mus musculus
aatcgccgctccacagtacttgcaa

SEQ ID NO: 246217 - DNA, 25 bp, Mus musculus
aggtcgcttcccatagggcatcgta

SEQ ID NO: 246218 - DNA, 25 bp, Mus musculus
tcggggtgacaaggagaaactcagt

SEQ ID NO: 246219 - DNA, 25 bp, Mus musculus
gacacttgtcgagatgtcccaaata

SEQ ID NO: 246220 - DNA, 25 bp, Mus musculus
tgcgtgtcagaacaaaagaggcctc

SEQ ID NO: 246221 - DNA, 25 bp, Mus musculus
agaggcctccgggaatgacagtgcc

SEQ ID NO: 246222 - DNA, 25 bp, Mus musculus
ctcccacgagagagaaagccattgc

SEQ ID NO: 246223 - DNA, 25 bp, Mus musculus
agggcggataaacccagctcgcacg

SEQ ID NO: 246224 - DNA, 25 bp, Mus musculus
tgccgacaagatggagacagcttct

SEQ ID NO: 246225 - DNA, 25 bp, Mus musculus
cagcttctttcgtcctttttctggg

SEQ ID NO: 246226 - DNA, 25 bp, Mus musculus
ttctgggcttatttactgtctggca

SEQ ID NO: 246227 - DNA, 25 bp, Mus musculus
tttactgtctggcaggcacttccgg

SEQ ID NO: 246228 - DNA, 25 bp, Mus musculus
ttcgcgtgcgtcacttccgctcaga

SEQ ID NO: 246229 - DNA, 25 bp, Mus musculus
ctcagacctggacccggtgactgct

SEQ ID NO: 246230 - DNA, 25 bp, Mus musculus
cggtaagactacgtcgacacttgtc

SEQ ID NO: 246231 - DNA, 25 bp, Mus musculus
gaaagccattgctcgggagacgccc

SEQ ID NO: 246232 - DNA, 25 bp, Mus musculus
cgggtctcctgaaaacgtgggctgg

SEQ ID NO: 246233 - DNA, 25 bp, Mus musculus
agcggtttgcatagcgcgctgcgct

SEQ ID NO: 246234 - DNA, 25 bp, Mus musculus
ttcagcggtttgcatagcgcgctgc

SEQ ID NO: 246235 - DNA, 25 bp, Mus musculus
caattcagcggtttgcatagcgcgc

SEQ ID NO: 246236 - DNA, 25 bp, Mus musculus
agttgccaattcagcggtttgcata

SEQ ID NO: 246237 - DNA, 25 bp, Mus musculus
tgcaagttgccaattcagcggtttg

SEQ ID NO: 246238 - DNA, 25 bp, Mus musculus
acagctgcaagttgccaattcagcg

SEQ ID NO: 246239 - DNA, 25 bp, Mus musculus
ttgcatagcgcgctgcgctgatgcg

SEQ ID NO: 246240 - DNA, 25 bp, Mus musculus
ggggtctgatgtagctcatcccagg

SEQ ID NO: 246241 - DNA, 25 bp, Mus musculus
tctgatgtagctcatcccaggggca

SEQ ID NO: 246242 - DNA, 25 bp, Mus musculus
tgatgtagctcatcccaggggcagg

SEQ ID NO: 246243 - DNA, 25 bp, Mus musculus
tagctcatcccaggggcagggcgct

SEQ ID NO: 246244 - DNA, 25 bp, Mus musculus
cgctgcgctgatgcgggtctcctga

SEQ ID NO: 246245 - DNA, 25 bp, Mus musculus
caggcctggggaggtacacgatctc

SEQ ID NO: 246246 - DNA, 25 bp, Mus musculus
gcggaggctcgccatacaggaacag

SEQ ID NO: 246247 - DNA, 25 bp, Mus musculus
cgttgttgccgactattatacgata

SEQ ID NO: 246248 - DNA, 25 bp, Mus musculus
cggtgatgtccgttgttgccgacta

SEQ ID NO: 246249 - DNA, 25 bp, Mus musculus
cgcagcacaagtgtccggtgatgtc

SEQ ID NO: 246250 - DNA, 25 bp, Mus musculus
agacctcgcggaaatgctgcttggc

SEQ ID NO: 246251 - DNA, 25 bp, Mus musculus
tgcacagttgcacttccggtggaga

SEQ ID NO: 246252 - DNA, 25 bp, Mus musculus
atagctgtcattagccgcttccggc

SEQ ID NO: 246253 - DNA, 25 bp, Mus musculus
tcagaaagacggtcggctcatggcc

SEQ ID NO: 246254 - DNA, 25 bp, Mus musculus
agtccgcgttccctgtagccaatca

SEQ ID NO: 246255 - DNA, 25 bp, Mus musculus
cggcgtgaattcagagtccgcgttc

SEQ ID NO: 246256 - DNA, 25 bp, Mus musculus
tacaggaacaggcaggatgggaacc

SEQ ID NO: 246257 - DNA, 25 bp, Mus musculus
tgaggcgcgtgatatcccgcgtctt

SEQ ID NO: 246258 - DNA, 25 bp, Mus musculus
ctcagcctggcagcaagagggcaaa

SEQ ID NO: 246259 - DNA, 25 bp, Mus musculus
gcgcgccggtatcggcgtgaattca

SEQ ID NO: 246260 - DNA, 25 bp, Mus musculus
cggctcttacataacgtgacctttc

SEQ ID NO: 246261 - DNA, 25 bp, Mus musculus
ccaataggctgcgaaggccgacgag

SEQ ID NO: 246262 - DNA, 25 bp, Mus musculus
acctcggagcggcagcctctctgag

SEQ ID NO: 246263 - DNA, 25 bp, Mus musculus
ggcgcaatgtctgtatcagtgacag

SEQ ID NO: 246264 - DNA, 25 bp, Mus musculus
gggctttttgctctgacctctttga

SEQ ID NO: 246265 - DNA, 25 bp, Mus musculus
tacttttgaagtccgccactggagg

SEQ ID NO: 246266 - DNA, 25 bp, Mus musculus
gcgccacggagaagcaagttagtct

SEQ ID NO: 246267 - DNA, 25 bp, Mus musculus
gtgacctttcaccttttcagactgc

SEQ ID NO: 246268 - DNA, 25 bp, Mus musculus
gctgcaactcaacttcgcggctgga

SEQ ID NO: 246269 - DNA, 25 bp, Mus musculus
ggagaggagccgctcttcaccatcc

SEQ ID NO: 246270 - DNA, 25 bp, Mus musculus
ccagctctgagggaagccggagttc

SEQ ID NO: 246271 - DNA, 25 bp, Mus musculus
gggcgaggagaatctctccgttttc

SEQ ID NO: 246272 - DNA, 25 bp, Mus musculus
agcaagttagtctgtgcgctggccc

SEQ ID NO: 246273 - DNA, 25 bp, Mus musculus
ctctttgagtcttccgcttttcgtc

SEQ ID NO: 246274 - DNA, 25 bp, Mus musculus
ggcgccttcggaggaacaaccgcta

SEQ ID NO: 246275 - DNA, 25 bp, Mus musculus
tactggaacttctcggggttgtcgc

SEQ ID NO: 246276 - DNA, 25 bp, Mus musculus
cacagggagcatgcccaggcccttg

SEQ ID NO: 246277 - DNA, 25 bp, Mus musculus
ttctcgggtgcctccatacagagtg

SEQ ID NO: 246278 - DNA, 25 bp, Mus musculus
cgggccagccgaaattgaattgctc

SEQ ID NO: 246279 - DNA, 25 bp, Mus musculus
agtggagacctggtcggtgcacatt

SEQ ID NO: 246280 - DNA, 25 bp, Mus musculus
ccgtactgcacgaggggcgagaact

SEQ ID NO: 246281 - DNA, 25 bp, Mus musculus
gcatgcgggtcaggttgtagccaat

SEQ ID NO: 246282 - DNA, 25 bp, Mus musculus
cggcacatggggatctccatcgctt

SEQ ID NO: 246283 - DNA, 25 bp, Mus musculus
ggatctccatcgcttggcacggtgc

SEQ ID NO: 246284 - DNA, 25 bp, Mus musculus
gctccggatcgaagcggccgatctc

SEQ ID NO: 246285 - DNA, 25 bp, Mus musculus
cgtggtcagtaggaggacacgccca

SEQ ID NO: 246286 - DNA, 25 bp, Mus musculus
gagcgactcttctccacgtactgga

SEQ ID NO: 246287 - DNA, 25 bp, Mus musculus
tcgcgctttaaaggtgccgcgcctc

SEQ ID NO: 246288 - DNA, 25 bp, Mus musculus
cgagtgcagacagaggcccctttca

SEQ ID NO: 246289 - DNA, 25 bp, Mus musculus
agggtgagtacctagctcagtgtca

SEQ ID NO: 246290 - DNA, 25 bp, Mus musculus
agtacctagctcagtgtcaccgccg

SEQ ID NO: 246291 - DNA, 25 bp, Mus musculus
agctcagtgtcaccgccgcgatgct

SEQ ID NO: 246292 - DNA, 25 bp, Mus musculus
cgcgatgctctatcctccgcacaca

SEQ ID NO: 246293 - DNA, 25 bp, Mus musculus
actttctgctgacggcgacggaatc

SEQ ID NO: 246294 - DNA, 25 bp, Mus musculus
ccacgacactttctgctgacggcga

SEQ ID NO: 246295 - DNA, 25 bp, Mus musculus
tggcgccacgacactttctgctgac

SEQ ID NO: 246296 - DNA, 25 bp, Mus musculus
cacagcgccggccacgctccagtcc

SEQ ID NO: 246297 - DNA, 25 bp, Mus musculus
atgcaggcggatccgaacccgcaca

SEQ ID NO: 246298 - DNA, 25 bp, Mus musculus
ccaacacaaatgcaggcggatccga

SEQ ID NO: 246299 - DNA, 25 bp, Mus musculus
cgggccgctgccaacacaaatgcag

SEQ ID NO: 246300 - DNA, 25 bp, Mus musculus
tctgctgacggcgacggaatcgcag

SEQ ID NO: 246301 - DNA, 25 bp, Mus musculus
cctttcatcgcccaggccttgtgcc

SEQ ID NO: 246302 - DNA, 25 bp, Mus musculus
ccggaagtcaggcaccacgcgggct

SEQ ID NO: 246303 - DNA, 25 bp, Mus musculus
tccgtacctggcagtcgtctcgcga

SEQ ID NO: 246304 - DNA, 25 bp, Mus musculus
tctcgcgacggtgggattccgttcc

SEQ ID NO: 246305 - DNA, 25 bp, Mus musculus
attccgttcctgaggcgcgagaaga

SEQ ID NO: 246306 - DNA, 25 bp, Mus musculus
gagaagacgctcatcttgccgcaca

SEQ ID NO: 246307 - DNA, 25 bp, Mus musculus
tctccaaaggccttgccggaaacga

SEQ ID NO: 246308 - DNA, 25 bp, Mus musculus
agcatgcgctgagggtctcccagca

SEQ ID NO: 246309 - DNA, 25 bp, Mus musculus
cacgcgggctgtgcacgagagaaac

SEQ ID NO: 246310 - DNA, 25 bp, Mus musculus
cgagagaaacggcacgtgatcgata

SEQ ID NO: 246311 - DNA, 25 bp, Mus musculus
acgtgatcgatagacgcagcgagca

SEQ ID NO: 246312 - DNA, 25 bp, Mus musculus
cacgcgctgcacacgtgatggcagg

SEQ ID NO: 246313 - DNA, 25 bp, Mus musculus
agacgcagcgagcatgcgagcatgc

SEQ ID NO: 246314 - DNA, 25 bp, Mus musculus
ggtctcgggtgctgccacccatggc

SEQ ID NO: 246315 - DNA, 25 bp, Mus musculus
cttgccgcacaactgtctccaaagg

SEQ ID NO: 246316 - DNA, 25 bp, Mus musculus
ggttggtgtattccagcaacttcca

SEQ ID NO: 246317 - DNA, 25 bp, Mus musculus
tccctcaaggggttggtgtattcca

SEQ ID NO: 246318 - DNA, 25 bp, Mus musculus
ctgaaaacggaaagcagcgaaccct

SEQ ID NO: 246319 - DNA, 25 bp, Mus musculus
gcagcgaaccctttgactccggaaa

SEQ ID NO: 246320 - DNA, 25 bp, Mus musculus
tgtacaaattgttgcggcggccgta

SEQ ID NO: 246321 - DNA, 25 bp, Mus musculus
gccagcccgagttttgcgacagtgt

SEQ ID NO: 246322 - DNA, 25 bp, Mus musculus
ttgtacgctctggtgtgcgagacgc

SEQ ID NO: 246323 - DNA, 25 bp, Mus musculus
tgcgacagtgtcgtagagcgcttga

SEQ ID NO: 246324 - DNA, 25 bp, Mus musculus
cagaacctgaagcagttgtacgctc

SEQ ID NO: 246325 - DNA, 25 bp, Mus musculus
agacgcagcgctactcggccgtgct

SEQ ID NO: 246326 - DNA, 25 bp, Mus musculus
cgtgctggacgctgtcatcgccagt

SEQ ID NO: 246327 - DNA, 25 bp, Mus musculus
tgtcatcgccagtgctgggctcctt

SEQ ID NO: 246328 - DNA, 25 bp, Mus musculus
cgccgagaagaagctgagaccgcac

SEQ ID NO: 246329 - DNA, 25 bp, Mus musculus
ctgagaccgcaccttgccaaggtga

SEQ ID NO: 246330 - DNA, 25 bp, Mus musculus
gcggacttaaatatcccagggtaca

SEQ ID NO: 246331 - DNA, 25 bp, Mus musculus
gtagacgtggtggactcgctggacc

SEQ ID NO: 246332 - DNA, 25 bp, Mus musculus
cgccgcggagcggacttaaatatcc

SEQ ID NO: 246333 - DNA, 25 bp, Mus musculus
tccgcgccgcggagcggacttaaat

SEQ ID NO: 246334 - DNA, 25 bp, Mus musculus
gccgccggagacatcgcggctccgc

SEQ ID NO: 246335 - DNA, 25 bp, Mus musculus
ggcaccaggtagagcgcgaggccga

SEQ ID NO: 246336 - DNA, 25 bp, Mus musculus
cgcgcgtcgcgcacgaaggacgaca

SEQ ID NO: 246337 - DNA, 25 bp, Mus musculus
aggctaccgttgactggtgacttgg

SEQ ID NO: 246338 - DNA, 25 bp, Mus musculus
gttcgcagaggctaccgttgactgg

SEQ ID NO: 246339 - DNA, 25 bp, Mus musculus
ccatgagtaagagctcagccgggtc

SEQ ID NO: 246340 - DNA, 25 bp, Mus musculus
ggtagctgcccatgagtaagagctc

SEQ ID NO: 246341 - DNA, 25 bp, Mus musculus
ccggcctctcccttgggtcctgccg

SEQ ID NO: 246342 - DNA, 25 bp, Mus musculus
ccaccctgggaagatcgccggggct

SEQ ID NO: 246343 - DNA, 25 bp, Mus musculus
gacgtcactgtcgtcgacgcggcgc

SEQ ID NO: 246344 - DNA, 25 bp, Mus musculus
ccgcccacagatcgcctgaccctca

SEQ ID NO: 246345 - DNA, 25 bp, Mus musculus
gccggcctcacccggaatgaaaaca

SEQ ID NO: 246346 - DNA, 25 bp, Mus musculus
cgcccggtcccacatccgctccacc

SEQ ID NO: 246347 - DNA, 25 bp, Mus musculus
ctccctatttccatctactctgttg

SEQ ID NO: 246348 - DNA, 25 bp, Mus musculus
atttccatctactctgttgtcccgc

SEQ ID NO: 246349 - DNA, 25 bp, Mus musculus
atcagccccgcccattaaatactag

SEQ ID NO: 246350 - DNA, 25 bp, Mus musculus
cagccgcgttttcagggcttccttc

SEQ ID NO: 246351 - DNA, 25 bp, Mus musculus
tttcagggcttccttccgttcgatg

SEQ ID NO: 246352 - DNA, 25 bp, Mus musculus
ttccttccgttcgatgcttcagatc

SEQ ID NO: 246353 - DNA, 25 bp, Mus musculus
gttcgatgcttcagatcgcccttca

SEQ ID NO: 246354 - DNA, 25 bp, Mus musculus
gatgcttcagatcgcccttcaagcc

SEQ ID NO: 246355 - DNA, 25 bp, Mus musculus
ccttccatgcagctccggtcctcga

SEQ ID NO: 246356 - DNA, 25 bp, Mus musculus
tcctcgaccggccttccggacagcg

SEQ ID NO: 246357 - DNA, 25 bp, Mus musculus
gggcttccttccgttcgatgcttca

SEQ ID NO: 246358 - DNA, 25 bp, Mus musculus
tcctcggtggaactggagaatgtgc

SEQ ID NO: 246359 - DNA, 25 bp, Mus musculus
ggccaacaggcaggaagaatcaaca

SEQ ID NO: 246360 - DNA, 25 bp, Mus musculus
ccagaaaactttcaatggatcacgc

SEQ ID NO: 246361 - DNA, 25 bp, Mus musculus
caatggatcacgctgcagactaggg

SEQ ID NO: 246362 - DNA, 25 bp, Mus musculus
ggggagatagcgcttccaaagctct

SEQ ID NO: 246363 - DNA, 25 bp, Mus musculus
tagcgcttccaaagctctcacttac

SEQ ID NO: 246364 - DNA, 25 bp, Mus musculus
acttaccatcttgttcacatccatg

SEQ ID NO: 246365 - DNA, 25 bp, Mus musculus
gttcacatccatgaccgaagcgata

SEQ ID NO: 246366 - DNA, 25 bp, Mus musculus
atccgccgcaagaggtgaggacacc

SEQ ID NO: 246367 - DNA, 25 bp, Mus musculus
gccatgctgcttgctggcaacagcg

SEQ ID NO: 246368 - DNA, 25 bp, Mus musculus
ggaaacccggagatccgccgcaaga

SEQ ID NO: 246369 - DNA, 25 bp, Mus musculus
gcctccagatccttggccgggttct

SEQ ID NO: 246370 - DNA, 25 bp, Mus musculus
tgaggacacccagcgatggattccg

SEQ ID NO: 246371 - DNA, 25 bp, Mus musculus
tgaccgaagcgatagggtgtccgcc

SEQ ID NO: 246372 - DNA, 25 bp, Mus musculus
tcttccattggttgacagcgctgtc

SEQ ID NO: 246373 - DNA, 25 bp, Mus musculus
actccgcggcggctcaacactttgg

SEQ ID NO: 246374 - DNA, 25 bp, Mus musculus
cggggacagattccgtcttccattg

SEQ ID NO: 246375 - DNA, 25 bp, Mus musculus
gatccggcgctaacggggacagatt

SEQ ID NO: 246376 - DNA, 25 bp, Mus musculus
tggttgacagcgctgtccatctccc

SEQ ID NO: 246377 - DNA, 25 bp, Mus musculus
tgagtccgctcgaagctctcgcgct

SEQ ID NO: 246378 - DNA, 25 bp, Mus musculus
cggctcaacactttgggcagcgggt

SEQ ID NO: 246379 - DNA, 25 bp, Mus musculus
cagcgggttggatacctgcttcatg

SEQ ID NO: 246380 - DNA, 25 bp, Mus musculus
tgcttcatggagctggccattcggt

SEQ ID NO: 246381 - DNA, 25 bp, Mus musculus
gctggccattcggtccatgttgtct

SEQ ID NO: 246382 - DNA, 25 bp, Mus musculus
tcggtccatgttgtctgggtgaaca

SEQ ID NO: 246383 - DNA, 25 bp, Mus musculus
catgttgtctgggtgaacagagtca

SEQ ID NO: 246384 - DNA, 25 bp, Mus musculus
tgaacagagtcaggggccctcggcc

SEQ ID NO: 246385 - DNA, 25 bp, Mus musculus
aatctcacctgagtccgctcgaagc

SEQ ID NO: 246386 - DNA, 25 bp, Mus musculus
cctctgaacagctgtgggcaacatg

SEQ ID NO: 246387 - DNA, 25 bp, Mus musculus
gggcaacatgatctcctccaaggtg

SEQ ID NO: 246388 - DNA, 25 bp, Mus musculus
caccgtccaaggtggagctcggaga

SEQ ID NO: 246389 - DNA, 25 bp, Mus musculus
ggtgaaaacagctctgcagcagctc

SEQ ID NO: 246390 - DNA, 25 bp, Mus musculus
tgaaccgttggggtgaaaacagctc

SEQ ID NO: 246391 - DNA, 25 bp, Mus musculus
ccgggcacaggagcaaccaacggtc

SEQ ID NO: 246392 - DNA, 25 bp, Mus musculus
gcaccgttggaaggccaactggaag

SEQ ID NO: 246393 - DNA, 25 bp, Mus musculus
caccaactgcttggaagcaccgctg

SEQ ID NO: 246394 - DNA, 25 bp, Mus musculus
caactggaagccgtgccacttgatg

SEQ ID NO: 246395 - DNA, 25 bp, Mus musculus
cttccaacgctttggcgccacagtg

SEQ ID NO: 246396 - DNA, 25 bp, Mus musculus
gtcgctgccacaccaactgcttgga

SEQ ID NO: 246397 - DNA, 25 bp, Mus musculus
cttgccaccgctgggtcaggaggca

SEQ ID NO: 246398 - DNA, 25 bp, Mus musculus
tgccacttgatgaggcgggccctag

SEQ ID NO: 246399 - DNA, 25 bp, Mus musculus
aagcaccgctgtcgcggggcttcca

SEQ ID NO: 246400 - DNA, 25 bp, Mus musculus
ccgaggtgccctccgccacattctt

SEQ ID NO: 246401 - DNA, 25 bp, Mus musculus
cgcaaggaggcggaaattgaggagg

SEQ ID NO: 246402 - DNA, 25 bp, Mus musculus
taccgaggccgcacgctggaagggc

SEQ ID NO: 246403 - DNA, 25 bp, Mus musculus
cccgcgagtcgcttctggtgctcgt

SEQ ID NO: 246404 - DNA, 25 bp, Mus musculus
cgagtcgcttctggtgctcgtgtcc

SEQ ID NO: 246405 - DNA, 25 bp, Mus musculus
gtcgcttctggtgctcgtgtcccga

SEQ ID NO: 246406 - DNA, 25 bp, Mus musculus
tggtgctcgtgtcccgaggtgccct

SEQ ID NO: 246407 - DNA, 25 bp, Mus musculus
gccacattcttcaccgccctgctct

SEQ ID NO: 246408 - DNA, 25 bp, Mus musculus
ccctgctctcgctgctggtgtcggg

SEQ ID NO: 246409 - DNA, 25 bp, Mus musculus
ctgtctctgcgctccgaggccctgc

SEQ ID NO: 246410 - DNA, 25 bp, Mus musculus
cgaggccctgcgcaactggcaaggt

SEQ ID NO: 246411 - DNA, 25 bp, Mus musculus
gccctgcgcaactggcaaggtgaga

SEQ ID NO: 246412 - DNA, 25 bp, Mus musculus
ctgcgcaactggcaaggtgagaaga

SEQ ID NO: 246413 - DNA, 25 bp, Mus musculus
gcttctggtgctcgtgtcccgaggt

SEQ ID NO: 246414 - DNA, 25 bp, Mus musculus
ggcagggtcacgcaaagcacaaacg

SEQ ID NO: 246415 - DNA, 25 bp, Mus musculus
ggccggtagccaaacctcggagata

SEQ ID NO: 246416 - DNA, 25 bp, Mus musculus
ggcgtggcttagaaaatgagtatcc

SEQ ID NO: 246417 - DNA, 25 bp, Mus musculus
tgagtatccgaattgagcgccgccc

SEQ ID NO: 246418 - DNA, 25 bp, Mus musculus
cgtgccttttccgaggagaggatga

SEQ ID NO: 246419 - DNA, 25 bp, Mus musculus
gcattgacccaagcgacggagttcg

SEQ ID NO: 246420 - DNA, 25 bp, Mus musculus
gggccgtaccaacagcagagattta

SEQ ID NO: 246421 - DNA, 25 bp, Mus musculus
tgcctcagagacctacaggaccgcg

SEQ ID NO: 246422 - DNA, 25 bp, Mus musculus
gcacaaacgtctgtcaaagccaagc

SEQ ID NO: 246423 - DNA, 25 bp, Mus musculus
aacctcaggggatctccgcgatacc

SEQ ID NO: 246424 - DNA, 25 bp, Mus musculus
ggtcacctcttgtcgctgccactat

SEQ ID NO: 246425 - DNA, 25 bp, Mus musculus
cgctgccactatccggcttgtgact

SEQ ID NO: 246426 - DNA, 25 bp, Mus musculus
ggtttttaggccgatctccgcacga

SEQ ID NO: 246427 - DNA, 25 bp, Mus musculus
cgacctaacctgtcgcggggcgtat

SEQ ID NO: 246428 - DNA, 25 bp, Mus musculus
aggaacacctgcacaagatggcgtc

SEQ ID NO: 246429 - DNA, 25 bp, Mus musculus
ttaatgtggccttttcccgtgagca

SEQ ID NO: 246430 - DNA, 25 bp, Mus musculus
acggcgccctcacgcagcttaatgt

SEQ ID NO: 246431 - DNA, 25 bp, Mus musculus
atgaggactatctgtaccgcgagga

SEQ ID NO: 246432 - DNA, 25 bp, Mus musculus
agacgctgctctactacggctgccg

SEQ ID NO: 246433 - DNA, 25 bp, Mus musculus
ggcttcgagagcaaggtaaaccatg

SEQ ID NO: 246434 - DNA, 25 bp, Mus musculus
tttcatgggcttcatccaggagcgg

SEQ ID NO: 246435 - DNA, 25 bp, Mus musculus
catgttcgtccgcaagtcccagttc

SEQ ID NO: 246436 - DNA, 25 bp, Mus musculus
ccaccagctggcttcggaccaagga

SEQ ID NO: 246437 - DNA, 25 bp, Mus musculus
gctgcaggcccgctactattccatt

SEQ ID NO: 246438 - DNA, 25 bp, Mus musculus
acgtgctctacgagctggcccagta

SEQ ID NO: 246439 - DNA, 25 bp, Mus musculus
ggcccggaggcacatcctagccatt

SEQ ID NO: 246440 - DNA, 25 bp, Mus musculus
agtacgcctcagagccctcggagca

SEQ ID NO: 246441 - DNA, 25 bp, Mus musculus
ccattgcctcgtcgtctaaggtgaa

SEQ ID NO: 246442 - DNA, 25 bp, Mus musculus
aaaaggcccggcgtaatctgcgcgt

SEQ ID NO: 246443 - DNA, 25 bp, Mus musculus
cagccaatcagagccagggacgaga

SEQ ID NO: 246444 - DNA, 25 bp, Mus musculus
gtgacctagtactgcctgacccttg

SEQ ID NO: 246445 - DNA, 25 bp, Mus musculus
gctgccttatgtgtgacctagtact

SEQ ID NO: 246446 - DNA, 25 bp, Mus musculus
ggctcccatcagacatttaagaaga

SEQ ID NO: 246447 - DNA, 25 bp, Mus musculus
gggcaatccgggctcccatcagaca

SEQ ID NO: 246448 - DNA, 25 bp, Mus musculus
atatcccggcacagagggatcccgc

SEQ ID NO: 246449 - DNA, 25 bp, Mus musculus
taccttggaagtcctgctgcagatc

SEQ ID NO: 246450 - DNA, 25 bp, Mus musculus
gcagatcctcccagttgcgcaggca

SEQ ID NO: 246451 - DNA, 25 bp, Mus musculus
ggcggggactgcatgtctttgtcca

SEQ ID NO: 246452 - DNA, 25 bp, Mus musculus
atgtctttgtccacgccactggccg

SEQ ID NO: 246453 - DNA, 25 bp, Mus musculus
gacatgggcccgcagggcgtctcct

SEQ ID NO: 246454 - DNA, 25 bp, Mus musculus
gggacgctcacctggataccttgga

SEQ ID NO: 246455 - DNA, 25 bp, Mus musculus
cgccgccgtgactgccaacgggaaa

SEQ ID NO: 246456 - DNA, 25 bp, Mus musculus
cctgataaagtgaagccgggcctct

SEQ ID NO: 246457 - DNA, 25 bp, Mus musculus
atagtctgcgctccacgtaggtgca

SEQ ID NO: 246458 - DNA, 25 bp, Mus musculus
gtccaggtttcctccatagtctgcg

SEQ ID NO: 246459 - DNA, 25 bp, Mus musculus
cggagctcggcgtttcttaaccatc

SEQ ID NO: 246460 - DNA, 25 bp, Mus musculus
cagcttcagcacttcggcccaggta

SEQ ID NO: 246461 - DNA, 25 bp, Mus musculus
tagctcctgccagtagctccgtgtc

SEQ ID NO: 246462 - DNA, 25 bp, Mus musculus
ttggagtcactcgtcttcttgtagc

SEQ ID NO: 246463 - DNA, 25 bp, Mus musculus
ttctctcgcgagatcaggtggctct

SEQ ID NO: 246464 - DNA, 25 bp, Mus musculus
gccggagcccagagatgacttcttt

SEQ ID NO: 246465 - DNA, 25 bp, Mus musculus
tgaccgtctgtcctagcgctaggtc

SEQ ID NO: 246466 - DNA, 25 bp, Mus musculus
tccgcctaatcctggtgaccgtctg

SEQ ID NO: 246467 - DNA, 25 bp, Mus musculus
gagtccttctagtaccgggttgcta

SEQ ID NO: 246468 - DNA, 25 bp, Mus musculus
aacctagagcctgtcctccgggcga

SEQ ID NO: 246469 - DNA, 25 bp, Mus musculus
tctcgcgagatttggctcaagcttc

SEQ ID NO: 246470 - DNA, 25 bp, Mus musculus
acggcccggtggattgcgactgccc

SEQ ID NO: 246471 - DNA, 25 bp, Mus musculus
ttggagccgggcctggagtacccac

SEQ ID NO: 246472 - DNA, 25 bp, Mus musculus
gcctggagtacccacccttcgatga

SEQ ID NO: 246473 - DNA, 25 bp, Mus musculus
ctggagtacccacccttcgatgagg

SEQ ID NO: 246474 - DNA, 25 bp, Mus musculus
gagtacccacccttcgatgaggacg

SEQ ID NO: 246475 - DNA, 25 bp, Mus musculus
tacccacccttcgatgaggacgacg

SEQ ID NO: 246476 - DNA, 25 bp, Mus musculus
cccgcgacgaatggagggcttggag

SEQ ID NO: 246477 - DNA, 25 bp, Mus musculus
ccttcgatgaggacgacggcccggt

SEQ ID NO: 246478 - DNA, 25 bp, Mus musculus
ccggtggattgcgactgcccggtct

SEQ ID NO: 246479 - DNA, 25 bp, Mus musculus
gcgtggcagagaccccgcgacgaat

SEQ ID NO: 246480 - DNA, 25 bp, Mus musculus
tctctgtctctccttagcgtggcag

SEQ ID NO: 246481 - DNA, 25 bp, Mus musculus
ctgtctctccttagcgtggcagaga

SEQ ID NO: 246482 - DNA, 25 bp, Mus musculus
tctctccttagcgtggcagagaccc

SEQ ID NO: 246483 - DNA, 25 bp, Mus musculus
acccttcgatgaggacgacggcccg

SEQ ID NO: 246484 - DNA, 25 bp, Mus musculus
cgtgatgggtctccaggtgacccga

SEQ ID NO: 246485 - DNA, 25 bp, Mus musculus
ggtgacccgacagatgctctccctg

SEQ ID NO: 246486 - DNA, 25 bp, Mus musculus
atgctgtttgcctgctgactgcgcc

SEQ ID NO: 246487 - DNA, 25 bp, Mus musculus
tggagggtttgtcatgctgtttgcc

SEQ ID NO: 246488 - DNA, 25 bp, Mus musculus
agcccgcccgatgtacgtaagcttg

SEQ ID NO: 246489 - DNA, 25 bp, Mus musculus
cccagcagaacggaggcagcaggca

SEQ ID NO: 246490 - DNA, 25 bp, Mus musculus
aagacaggcagccagcgatccagcg

SEQ ID NO: 246491 - DNA, 25 bp, Mus musculus
agctggaaaccaggtcagttgcaga

SEQ ID NO: 246492 - DNA, 25 bp, Mus musculus
actcaaggtagtgcagctggaaacc

SEQ ID NO: 246493 - DNA, 25 bp, Mus musculus
ggtgtccatctggaggaagaactta

SEQ ID NO: 246494 - DNA, 25 bp, Mus musculus
tcatcagacagagcaaattggtgtc

SEQ ID NO: 246495 - DNA, 25 bp, Mus musculus
ggagcagtcctcagaaccaaagttc

SEQ ID NO: 246496 - DNA, 25 bp, Mus musculus
ggaattgttgtgtccctatgggttg

SEQ ID NO: 246497 - DNA, 25 bp, Mus musculus
cccaagcatcgagatgacgggcgga

SEQ ID NO: 246498 - DNA, 25 bp, Mus musculus
ctccctcctctagggcaaaggagcg

SEQ ID NO: 246499 - DNA, 25 bp, Mus musculus
taagtgtcccaaccggaatagtgtg

SEQ ID NO: 246500 - DNA, 25 bp, Mus musculus
cggggatccctcaccatgatgggtc

SEQ ID NO: 246501 - DNA, 25 bp, Mus musculus
acttaggacccagatggcggggatc

SEQ ID NO: 246502 - DNA, 25 bp, Mus musculus
gcggatggcatagaacccggactta

SEQ ID NO: 246503 - DNA, 25 bp, Mus musculus
agcggggcacactccagcagcgact

SEQ ID NO: 246504 - DNA, 25 bp, Mus musculus
ccagagggcaacagctcatcgcgca

SEQ ID NO: 246505 - DNA, 25 bp, Mus musculus
ggtgggctcatggatctctactgcc

SEQ ID NO: 246506 - DNA, 25 bp, Mus musculus
tcccattttctctggggtgggctca

SEQ ID NO: 246507 - DNA, 25 bp, Mus musculus
ttgtcctttgacgtcccattttctc

SEQ ID NO: 246508 - DNA, 25 bp, Mus musculus
ggtcactccatcacttccaatgaag

SEQ ID NO: 246509 - DNA, 25 bp, Mus musculus
ttcatcattccacgtgcagcccggt

SEQ ID NO: 246510 - DNA, 25 bp, Mus musculus
aacctcttggcaggtaagtgtccca

SEQ ID NO: 246511 - DNA, 25 bp, Mus musculus
gagacgatcgcggtcctcggccaac

SEQ ID NO: 246512 - DNA, 25 bp, Mus musculus
ctgaagccggtagaagaacccgaga

SEQ ID NO: 246513 - DNA, 25 bp, Mus musculus
ggaccgtttccacgtgcttcatgta

SEQ ID NO: 246514 - DNA, 25 bp, Mus musculus
gagcccaccaggtctgaagccggta

SEQ ID NO: 246515 - DNA, 25 bp, Mus musculus
ctaccttgaaggagcgcgcagcact

SEQ ID NO: 246516 - DNA, 25 bp, Mus musculus
ggtggtccgcacagaccctcagagc

SEQ ID NO: 246517 - DNA, 25 bp, Mus musculus
tcgttcctgcaaaggctcgaggtgc

SEQ ID NO: 246518 - DNA, 25 bp, Mus musculus
cggcggggaacaaggattatgactc

SEQ ID NO: 246519 - DNA, 25 bp, Mus musculus
attatgactctccaccggtgtcctc

SEQ ID NO: 246520 - DNA, 25 bp, Mus musculus
cgctctctcagctccgatgcaagga

SEQ ID NO: 246521 - DNA, 25 bp, Mus musculus
atgcaaggacccaggtgagacctcc

SEQ ID NO: 246522 - DNA, 25 bp, Mus musculus
tcctccgggaacagaacttagaagc

SEQ ID NO: 246523 - DNA, 25 bp, Mus musculus
tactcagaaccttctcggggctcag

SEQ ID NO: 246524 - DNA, 25 bp, Mus musculus
acttagaagctatccgggtccctcg

SEQ ID NO: 246525 - DNA, 25 bp, Mus musculus
aagcggagcgcggaacaatacaatc

SEQ ID NO: 246526 - DNA, 25 bp, Mus musculus
cccgatgagtggtcgcagtggttca

SEQ ID NO: 246527 - DNA, 25 bp, Mus musculus
acggctgatcgctggcgcgtgtccc

SEQ ID NO: 246528 - DNA, 25 bp, Mus musculus
agatccgacagacggctgatcgctg

SEQ ID NO: 246529 - DNA, 25 bp, Mus musculus
tctcggagatccgacagacggctga

SEQ ID NO: 246530 - DNA, 25 bp, Mus musculus
gctcaaccgacagctcagcagcggg

SEQ ID NO: 246531 - DNA, 25 bp, Mus musculus
gtgtccctggacgtcaaccacttcg

SEQ ID NO: 246532 - DNA, 25 bp, Mus musculus
gaccctggccgcaccagccttcagc

SEQ ID NO: 246533 - DNA, 25 bp, Mus musculus
cccggttgcccgatgagtggtcgca

SEQ ID NO: 246534 - DNA, 25 bp, Mus musculus
cttcgatcaagctttcggggtgccc

SEQ ID NO: 246535 - DNA, 25 bp, Mus musculus
agccgcctcttcgatcaagctttcg

SEQ ID NO: 246536 - DNA, 25 bp, Mus musculus
tccgggactggtaccctgcacacag

SEQ ID NO: 246537 - DNA, 25 bp, Mus musculus
gctgggaaccattccgggactggta

SEQ ID NO: 246538 - DNA, 25 bp, Mus musculus
ctgcggagcccgagctgggaaccat

SEQ ID NO: 246539 - DNA, 25 bp, Mus musculus
agccttcagccgagcgctcaaccga

SEQ ID NO: 246540 - DNA, 25 bp, Mus musculus
ggttcgccttgttcttgccgctggc

SEQ ID NO: 246541 - DNA, 25 bp, Mus musculus
tcctggcgctgtcttctgctaggct

SEQ ID NO: 246542 - DNA, 25 bp, Mus musculus
ggcgctgtcttctgctaggctcctc

SEQ ID NO: 246543 - DNA, 25 bp, Mus musculus
taaggctccgccctggccctagccc

SEQ ID NO: 246544 - DNA, 25 bp, Mus musculus
tggccctagccctccgctttgtaac

SEQ ID NO: 246545 - DNA, 25 bp, Mus musculus
cctggttcgccttgttcttgccgct

SEQ ID NO: 246546 - DNA, 25 bp, Mus musculus
tgcctcctggcgctgtcttctgcta

SEQ ID NO: 246547 - DNA, 25 bp, Mus musculus
tttctacgaacgaccgagactccgc

SEQ ID NO: 246548 - DNA, 25 bp, Mus musculus
ggctttctacgaacgaccgagactc

SEQ ID NO: 246549 - DNA, 25 bp, Mus musculus
cagggctttctacgaacgaccgaga

SEQ ID NO: 246550 - DNA, 25 bp, Mus musculus
ctggccagggctttctacgaacgac

SEQ ID NO: 246551 - DNA, 25 bp, Mus musculus
aggcttctggccagggctttctacg

SEQ ID NO: 246552 - DNA, 25 bp, Mus musculus
gctgcccagcgaggcttctggccag

SEQ ID NO: 246553 - DNA, 25 bp, Mus musculus
ctccgcccagggctcgtaccagagc

SEQ ID NO: 246554 - DNA, 25 bp, Mus musculus
ccacgctcgggctagaaggcaatct

SEQ ID NO: 246555 - DNA, 25 bp, Mus musculus
cgggctagaaggcaatctccgtgct

SEQ ID NO: 246556 - DNA, 25 bp, Mus musculus
gctcttgccacgctcgggctagaag

SEQ ID NO: 246557 - DNA, 25 bp, Mus musculus
cgagatgctggcttgtgattggctc

SEQ ID NO: 246558 - DNA, 25 bp, Mus musculus
caacaggccggccattggcacggag

SEQ ID NO: 246559 - DNA, 25 bp, Mus musculus
agacccagcaacaggccggccattg

SEQ ID NO: 246560 - DNA, 25 bp, Mus musculus
agggatgcgagacccagcaacaggc

SEQ ID NO: 246561 - DNA, 25 bp, Mus musculus
caggcgaattccaaaggagggatgc

SEQ ID NO: 246562 - DNA, 25 bp, Mus musculus
ggctcggcaggcgaattccaaagga

SEQ ID NO: 246563 - DNA, 25 bp, Mus musculus
ctccgcattagcactgcggcgggct

SEQ ID NO: 246564 - DNA, 25 bp, Mus musculus
tgataagctccgcattagcactgcg

SEQ ID NO: 246565 - DNA, 25 bp, Mus musculus
ggaagccatgataagctccgcatta

SEQ ID NO: 246566 - DNA, 25 bp, Mus musculus
agaggacccggaagccatgataagc

SEQ ID NO: 246567 - DNA, 25 bp, Mus musculus
tagaaggcaatctccgtgctgggtg

SEQ ID NO: 246568 - DNA, 25 bp, Mus musculus
ggtaggctcggaccatctcgatctt

SEQ ID NO: 246569 - DNA, 25 bp, Mus musculus
cgatgctgctgatgaccctccagga

SEQ ID NO: 246570 - DNA, 25 bp, Mus musculus
ttctcgatcttctcccggtaggctc

SEQ ID NO: 246571 - DNA, 25 bp, Mus musculus
atcaggtagttgtccagcaggctca

SEQ ID NO: 246572 - DNA, 25 bp, Mus musculus
tactgggtctcgctgcagttcttga

SEQ ID NO: 246573 - DNA, 25 bp, Mus musculus
tccgttcctcattggacagtggttc

SEQ ID NO: 246574 - DNA, 25 bp, Mus musculus
tagaacaccttgctctcgtactggg

SEQ ID NO: 246575 - DNA, 25 bp, Mus musculus
tctgccaggtaacggtaatagtccc

SEQ ID NO: 246576 - DNA, 25 bp, Mus musculus
cgctgtaggccttctcagacgactc

SEQ ID NO: 246577 - DNA, 25 bp, Mus musculus
atgtgctccttgctgatctcgtggg

SEQ ID NO: 246578 - DNA, 25 bp, Mus musculus
aaaccgagtagttgagcgccaggcc

SEQ ID NO: 246579 - DNA, 25 bp, Mus musculus
ggggcgttctggatctcatagtaga

SEQ ID NO: 246580 - DNA, 25 bp, Mus musculus
ctgcatgatcagagtggagtccttg

SEQ ID NO: 246581 - DNA, 25 bp, Mus musculus
acagtggttcgttcagctcggtcac

SEQ ID NO: 246582 - DNA, 25 bp, Mus musculus
atagtcgtgacaagacaacatgccc

SEQ ID NO: 246583 - DNA, 25 bp, Mus musculus
aaaagtcaccgcctactcgcgcatg

SEQ ID NO: 246584 - DNA, 25 bp, Mus musculus
gcccacacgggtgacgtaaaagtca

SEQ ID NO: 246585 - DNA, 25 bp, Mus musculus
aggctgcggctccaatgcgtgccgc

SEQ ID NO: 246586 - DNA, 25 bp, Mus musculus
gaccgacccacgaagcaagctactg

SEQ ID NO: 246587 - DNA, 25 bp, Mus musculus
ctcgtgtgtcggagggaccgaccca

SEQ ID NO: 246588 - DNA, 25 bp, Mus musculus
ccgaagaccgccttgaagggcttca

SEQ ID NO: 246589 - DNA, 25 bp, Mus musculus
gagaggtgaccctatagtcgtgaca

SEQ ID NO: 246590 - DNA, 25 bp, Mus musculus
ggagcatgccttccacgccgaggaa

SEQ ID NO: 246591 - DNA, 25 bp, Mus musculus
ggaggagacactcacgttcttcatg

SEQ ID NO: 246592 - DNA, 25 bp, Mus musculus
ttctgcaccagttgctcgcggtcca

SEQ ID NO: 246593 - DNA, 25 bp, Mus musculus
gcggtccaccatcttcacagggctg

SEQ ID NO: 246594 - DNA, 25 bp, Mus musculus
cacgttcttcatggccgcggccata

SEQ ID NO: 246595 - DNA, 25 bp, Mus musculus
gccgcgtcaccactcgggtgcatga

SEQ ID NO: 246596 - DNA, 25 bp, Mus musculus
ccatagacgtgagcgcatgcgttca

SEQ ID NO: 246597 - DNA, 25 bp, Mus musculus
gcgtccgcgaagtcccagtcatcgt

SEQ ID NO: 246598 - DNA, 25 bp, Mus musculus
tgaccaaggcccgtggcgcctagcg

SEQ ID NO: 246599 - DNA, 25 bp, Mus musculus
tagccaaaatgaccaaggcccgtgg

SEQ ID NO: 246600 - DNA, 25 bp, Mus musculus
cagggcctcggccatagccaaaatg

SEQ ID NO: 246601 - DNA, 25 bp, Mus musculus
acgttgtctagcagcacagggcctc

SEQ ID NO: 246602 - DNA, 25 bp, Mus musculus
ccggtgcagcctacgttgtctagca

SEQ ID NO: 246603 - DNA, 25 bp, Mus musculus
ttcaggcccgcccatagacgtgagc

SEQ ID NO: 246604 - DNA, 25 bp, Mus musculus
cggctccacctttcctccatataaa

SEQ ID NO: 246605 - DNA, 25 bp, Mus musculus
gcctcagtaccggtgcagcctacgt

SEQ ID NO: 246606 - DNA, 25 bp, Mus musculus
tcccgactgtgagctaaaagaggct

SEQ ID NO: 246607 - DNA, 25 bp, Mus musculus
atgcgttcatgggtcctcgcccagc

SEQ ID NO: 246608 - DNA, 25 bp, Mus musculus
tgagctaaaagaggctccgcccaca

SEQ ID NO: 246609 - DNA, 25 bp, Mus musculus
ctccggcgtcttcgtggtggccgca

SEQ ID NO: 246610 - DNA, 25 bp, Mus musculus
actcggccttgacacgggctggcgc

SEQ ID NO: 246611 - DNA, 25 bp, Mus musculus
ccagcatcctcgtggtgtccgcagt

SEQ ID NO: 246612 - DNA, 25 bp, Mus musculus
ccaccttcgcagtgaacattgtcca

SEQ ID NO: 246613 - DNA, 25 bp, Mus musculus
gcagtgaacattgtccagcaggata

SEQ ID NO: 246614 - DNA, 25 bp, Mus musculus
ccagcaggatatgcccggtaccata

SEQ ID NO: 246615 - DNA, 25 bp, Mus musculus
atgcccggtaccatagccgaaaaag

SEQ ID NO: 246616 - DNA, 25 bp, Mus musculus
ggtaccatagccgaaaaaggcatta

SEQ ID NO: 246617 - DNA, 25 bp, Mus musculus
cgtggtgtccgcagttgtgcacgcc

SEQ ID NO: 246618 - DNA, 25 bp, Mus musculus
aaaaggcattagtggtggcggccaa

SEQ ID NO: 246619 - DNA, 25 bp, Mus musculus
tggcggcacacaacagcagcatcct

SEQ ID NO: 246620 - DNA, 25 bp, Mus musculus
tcatcgtcgcatacagtgccccaga

SEQ ID NO: 246621 - DNA, 25 bp, Mus musculus
catgcagaatctccactcggccttg

SEQ ID NO: 246622 - DNA, 25 bp, Mus musculus
agaatctccactcggccttgacacg

SEQ ID NO: 246623 - DNA, 25 bp, Mus musculus
gggctcgccaccttcgcagtgaaca

SEQ ID NO: 246624 - DNA, 25 bp, Mus musculus
agccctgggcacctcggtaccaggg

SEQ ID NO: 246625 - DNA, 25 bp, Mus musculus
cttccctcagactcggtgagcggga

SEQ ID NO: 246626 - DNA, 25 bp, Mus musculus
gcacctcggtaccagggtcctggag

SEQ ID NO: 246627 - DNA, 25 bp, Mus musculus
ggtcctctcaacctgttccttctgc

SEQ ID NO: 246628 - DNA, 25 bp, Mus musculus
aggtcggcggtcctctcaacctgtt

SEQ ID NO: 246629 - DNA, 25 bp, Mus musculus
tactcgagggttcttcccaggccga

SEQ ID NO: 246630 - DNA, 25 bp, Mus musculus
gagacatactcgagggttcttccca

SEQ ID NO: 246631 - DNA, 25 bp, Mus musculus
tcggagacatactcgagggttcttc

SEQ ID NO: 246632 - DNA, 25 bp, Mus musculus
ggctcggagtcggagacatactcga

SEQ ID NO: 246633 - DNA, 25 bp, Mus musculus
cctccggctcggagtcggagacata

SEQ ID NO: 246634 - DNA, 25 bp, Mus musculus
gcgacgccgagtttcactccggctg

SEQ ID NO: 246635 - DNA, 25 bp, Mus musculus
cttggaggctgcgacgccgagtttc

SEQ ID NO: 246636 - DNA, 25 bp, Mus musculus
tattgagccaagctgagaccggaag

SEQ ID NO: 246637 - DNA, 25 bp, Mus musculus
aagtcgcagttgggacgctctgagc

SEQ ID NO: 246638 - DNA, 25 bp, Mus musculus
gagaggggacccatgagtccgaacc

SEQ ID NO: 246639 - DNA, 25 bp, Mus musculus
ggccaatgagggacgcaagccgcat

SEQ ID NO: 246640 - DNA, 25 bp, Mus musculus
gcgcagttcgctgtccatccgaatc

SEQ ID NO: 246641 - DNA, 25 bp, Mus musculus
acccgcaatggccaagcgcagttcg

SEQ ID NO: 246642 - DNA, 25 bp, Mus musculus
atggagtagcggagatccctcagcc

SEQ ID NO: 246643 - DNA, 25 bp, Mus musculus
gtgaatggagtagcggagatccctc

SEQ ID NO: 246644 - DNA, 25 bp, Mus musculus
ttggtccttccatgcagtgtctccc

SEQ ID NO: 246645 - DNA, 25 bp, Mus musculus
ggacgctgattggtccttccatgca

SEQ ID NO: 246646 - DNA, 25 bp, Mus musculus
catccaggacgctgattggtccttc

SEQ ID NO: 246647 - DNA, 25 bp, Mus musculus
gcccattctgggcatccaggacgct

SEQ ID NO: 246648 - DNA, 25 bp, Mus musculus
gcaagccgcataggccgcgcccatt

SEQ ID NO: 246649 - DNA, 25 bp, Mus musculus
atgagggacgcaagccgcataggcc

SEQ ID NO: 246650 - DNA, 25 bp, Mus musculus
cttccaggtggccaatgagggacgc

SEQ ID NO: 246651 - DNA, 25 bp, Mus musculus
ggccaagcgcagttcgctgtccatc

SEQ ID NO: 246652 - DNA, 25 bp, Mus musculus
tcagcaaagctaaaggccgggacag

SEQ ID NO: 246653 - DNA, 25 bp, Mus musculus
tgcttcttgaccaggctctactctc

SEQ ID NO: 246654 - DNA, 25 bp, Mus musculus
agcggcatgcagatgcccgcaccag

SEQ ID NO: 246655 - DNA, 25 bp, Mus musculus
tcttccacctgcgagagcggcatgc

SEQ ID NO: 246656 - DNA, 25 bp, Mus musculus
ttcatcgcggtcaccagcttcctgt

SEQ ID NO: 246657 - DNA, 25 bp, Mus musculus
cagaacgtaccattcatcgcggtca

SEQ ID NO: 246658 - DNA, 25 bp, Mus musculus
tgcccttccagaacgtaccattcat

SEQ ID NO: 246659 - DNA, 25 bp, Mus musculus
cagaaagggaatcctgcgggacaga

SEQ ID NO: 246660 - DNA, 25 bp, Mus musculus
cccgccctgtcagcaaagctaaagg

SEQ ID NO: 246661 - DNA, 25 bp, Mus musculus
ccacattccggcagctgttcaggcg

SEQ ID NO: 246662 - DNA, 25 bp, Mus musculus
atatgccgctcggttcgcacgtgcc

SEQ ID NO: 246663 - DNA, 25 bp, Mus musculus
gctgctgagcgccatatgccgctcg

SEQ ID NO: 246664 - DNA, 25 bp, Mus musculus
cctgcgggacagatatgcttcttga

SEQ ID NO: 246665 - DNA, 25 bp, Mus musculus
tgcccacttagtggcgctgctgagc

SEQ ID NO: 246666 - DNA, 25 bp, Mus musculus
gggagcacgcgccaaaacactcagc

SEQ ID NO: 246667 - DNA, 25 bp, Mus musculus
cactgctcctgtctggggaaaccga

SEQ ID NO: 246668 - DNA, 25 bp, Mus musculus
ttcttgctcttcgagggcgagaaga

SEQ ID NO: 246669 - DNA, 25 bp, Mus musculus
ccggccttcgagtcgttcttgctct

SEQ ID NO: 246670 - DNA, 25 bp, Mus musculus
taggatgaacgctcctccggccttc

SEQ ID NO: 246671 - DNA, 25 bp, Mus musculus
agaaatccggaagtggtcgcgcttc

SEQ ID NO: 246672 - DNA, 25 bp, Mus musculus
attggctgcggctgagaaatccgga

SEQ ID NO: 246673 - DNA, 25 bp, Mus musculus
ttccgtgctgctcaatgcgagtctg

SEQ ID NO: 246674 - DNA, 25 bp, Mus musculus
ccaggtgcttacactgattggctgc

SEQ ID NO: 246675 - DNA, 25 bp, Mus musculus
tgcgcctgcattaggtcatccgagc

SEQ ID NO: 246676 - DNA, 25 bp, Mus musculus
agggttctaaactgacgcatgcgca

SEQ ID NO: 246677 - DNA, 25 bp, Mus musculus
acactcagcatggacgcctcgaaca

SEQ ID NO: 246678 - DNA, 25 bp, Mus musculus
gctttgctttgagtcttccgtgctg

SEQ ID NO: 246679 - DNA, 25 bp, Mus musculus
caatgcgagtctgcccagcttcagg

SEQ ID NO: 246680 - DNA, 25 bp, Mus musculus
agttggcttccttgctccagcaggc

SEQ ID NO: 246681 - DNA, 25 bp, Mus musculus
agaaaacagcctgcctgcgtcctgc

SEQ ID NO: 246682 - DNA, 25 bp, Mus musculus
ctgctgctctggctaggctttggcg

SEQ ID NO: 246683 - DNA, 25 bp, Mus musculus
agggagttagttggcttccttgctc

SEQ ID NO: 246684 - DNA, 25 bp, Mus musculus
cccgccagccggtgagaggcctaga

SEQ ID NO: 246685 - DNA, 25 bp, Mus musculus
cagcactccgctttctggatattta

SEQ ID NO: 246686 - DNA, 25 bp, Mus musculus
tggatatttattgcctccgtgggtc

SEQ ID NO: 246687 - DNA, 25 bp, Mus musculus
tattgcctccgtgggtcgcacgtac

SEQ ID NO: 246688 - DNA, 25 bp, Mus musculus
tcgcacgtacgcagttgggactaga

SEQ ID NO: 246689 - DNA, 25 bp, Mus musculus
ttgggactagaagaagttgagcacc

SEQ ID NO: 246690 - DNA, 25 bp, Mus musculus
cagtcggagaagcagcggtagtctc

SEQ ID NO: 246691 - DNA, 25 bp, Mus musculus
ggtagtctcctctctccaacacgta

SEQ ID NO: 246692 - DNA, 25 bp, Mus musculus
ccctagcaggagaaaacagcctgcc

SEQ ID NO: 246693 - DNA, 25 bp, Mus musculus
agaggcctagaaagcactccgaggc

SEQ ID NO: 246694 - DNA, 25 bp, Mus musculus
cgacccggcgcacacgccaggctga

SEQ ID NO: 246695 - DNA, 25 bp, Mus musculus
gattccgcggcgtggacaccgactc

SEQ ID NO: 246696 - DNA, 25 bp, Mus musculus
gcagacaaaggcatcggaaagcagc

SEQ ID NO: 246697 - DNA, 25 bp, Mus musculus
aaaggcatcggaaagcagcctggcg

SEQ ID NO: 246698 - DNA, 25 bp, Mus musculus
accgaagctgggctccgtcgccaag

SEQ ID NO: 246699 - DNA, 25 bp, Mus musculus
gctccgtcgccaagagcgtaggcga

SEQ ID NO: 246700 - DNA, 25 bp, Mus musculus
ccggtgtcacctgcagcggccagca

SEQ ID NO: 246701 - DNA, 25 bp, Mus musculus
tagccagccgcccagcaagagcgcc

SEQ ID NO: 246702 - DNA, 25 bp, Mus musculus
gggccaatcgcaagctagcgccgca

SEQ ID NO: 246703 - DNA, 25 bp, Mus musculus
aatcgcaagctagcgccgcagcaga

SEQ ID NO: 246704 - DNA, 25 bp, Mus musculus
gcgccgcagcagagcatccaatgag

SEQ ID NO: 246705 - DNA, 25 bp, Mus musculus
agagcatccaatgagcgacgagatc

SEQ ID NO: 246706 - DNA, 25 bp, Mus musculus
caatgagcgacgagatcctgcgggt

SEQ ID NO: 246707 - DNA, 25 bp, Mus musculus
cagcgtctctctcacctccacaggg

SEQ ID NO: 246708 - DNA, 25 bp, Mus musculus
agggcgttcgctccaagtttatctg

SEQ ID NO: 246709 - DNA, 25 bp, Mus musculus
ccaagtttatctgacgccgggcgtt

SEQ ID NO: 246710 - DNA, 25 bp, Mus musculus
tgagccttgcattccgcccatcaaa

SEQ ID NO: 246711 - DNA, 25 bp, Mus musculus
cagcttatccgtcttgggtcgccca

SEQ ID NO: 246712 - DNA, 25 bp, Mus musculus
gtcgcccacgttgcaggagcagttg

SEQ ID NO: 246713 - DNA, 25 bp, Mus musculus
gcctccacgaagtccggtcgctaag

SEQ ID NO: 246714 - DNA, 25 bp, Mus musculus
caggaggtggcgcacaacaaaccct

SEQ ID NO: 246715 - DNA, 25 bp, Mus musculus
caaaccctttgcgagtccgttgcga

SEQ ID NO: 246716 - DNA, 25 bp, Mus musculus
ggaaggaagtagaacgccagcctta

SEQ ID NO: 246717 - DNA, 25 bp, Mus musculus
tcgaatcccggataacagaataacc

SEQ ID NO: 246718 - DNA, 25 bp, Mus musculus
gcgcctgcgctcttaactgatcgga

SEQ ID NO: 246719 - DNA, 25 bp, Mus musculus
ctgtaagggcatccggacctgtctt

SEQ ID NO: 246720 - DNA, 25 bp, Mus musculus
ccggacctgtcttatctgcgagaga

SEQ ID NO: 246721 - DNA, 25 bp, Mus musculus
tcccacatctccgtttggcgcgaga

SEQ ID NO: 246722 - DNA, 25 bp, Mus musculus
tcacggctccggctcgtggctagcg

SEQ ID NO: 246723 - DNA, 25 bp, Mus musculus
tccgtggggccctgccgcggaccac

SEQ ID NO: 246724 - DNA, 25 bp, Mus musculus
cacgtgacccatccgtggggccctg

SEQ ID NO: 246725 - DNA, 25 bp, Mus musculus
gccgtcacgtgacccatccgtgggg

SEQ ID NO: 246726 - DNA, 25 bp, Mus musculus
ctaggcaacactgcgccgccgtcac

SEQ ID NO: 246727 - DNA, 25 bp, Mus musculus
tgcctaggcaacactgcgccgccgt

SEQ ID NO: 246728 - DNA, 25 bp, Mus musculus
gcagccgctgcctaggcaacactgc

SEQ ID NO: 246729 - DNA, 25 bp, Mus musculus
gctagcgtctgtgtcgcggccgggt

SEQ ID NO: 246730 - DNA, 25 bp, Mus musculus
gctccggctcgtggctagcgtctgt

SEQ ID NO: 246731 - DNA, 25 bp, Mus musculus
ttggctccagctcacggctccggct

SEQ ID NO: 246732 - DNA, 25 bp, Mus musculus
ccctgactgtccagccctcagcgcg

SEQ ID NO: 246733 - DNA, 25 bp, Mus musculus
actcaccctgactgtccagccctca

SEQ ID NO: 246734 - DNA, 25 bp, Mus musculus
acccgcggccgagcactcaccctga

SEQ ID NO: 246735 - DNA, 25 bp, Mus musculus
ccggctcgtggctagcgtctgtgtc

SEQ ID NO: 246736 - DNA, 25 bp, Mus musculus
actgaatgtagccttgctcggtctg

SEQ ID NO: 246737 - DNA, 25 bp, Mus musculus
cgtgcagctacgctgtaggacaaga

SEQ ID NO: 246738 - DNA, 25 bp, Mus musculus
taggacaagaacaggagcgaggctc

SEQ ID NO: 246739 - DNA, 25 bp, Mus musculus
tgacgacagaagagcgcgccaaccg

SEQ ID NO: 246740 - DNA, 25 bp, Mus musculus
gcggccgctcgtattgatgacgaca

SEQ ID NO: 246741 - DNA, 25 bp, Mus musculus
tcctttacgaaagctgccggcggcc

SEQ ID NO: 246742 - DNA, 25 bp, Mus musculus
gcgaggtctgcctatcttacaaagc

SEQ ID NO: 246743 - DNA, 25 bp, Mus musculus
tcaccgggttcttcatgagccgctc

SEQ ID NO: 246744 - DNA, 25 bp, Mus musculus
aagcggcagcaggactcgccatagc

SEQ ID NO: 246745 - DNA, 25 bp, Mus musculus
ggacagcacgagcaacgccatgata

SEQ ID NO: 246746 - DNA, 25 bp, Mus musculus
tgagccgctccagcttgagcttctg

SEQ ID NO: 246747 - DNA, 25 bp, Mus musculus
gccgattcggtacggaacgtggaca

SEQ ID NO: 246748 - DNA, 25 bp, Mus musculus
tgagcttctgctcctcggccgcatt

SEQ ID NO: 246749 - DNA, 25 bp, Mus musculus
cgcattcttggggatgaccagcgtc

SEQ ID NO: 246750 - DNA, 25 bp, Mus musculus
tgttacgcagcgagaatccctttcg

SEQ ID NO: 246751 - DNA, 25 bp, Mus musculus
gttccatagtgtcggctgctgaccc

SEQ ID NO: 246752 - DNA, 25 bp, Mus musculus
gtgcgaagtccacagcagccacctg

SEQ ID NO: 246753 - DNA, 25 bp, Mus musculus
tgtcccgaaggaagcggcagaactt

SEQ ID NO: 246754 - DNA, 25 bp, Mus musculus
cgtgcagctcgcagaattgccgcca

SEQ ID NO: 246755 - DNA, 25 bp, Mus musculus
tcaccgcaggctcgggttccatagt

SEQ ID NO: 246756 - DNA, 25 bp, Mus musculus
cagtcttgagcgcagatgtcaccga

SEQ ID NO: 246757 - DNA, 25 bp, Mus musculus
gagtggccataggttgcagtcttga

SEQ ID NO: 246758 - DNA, 25 bp, Mus musculus
atccctttcggacacgcgccttggt

SEQ ID NO: 246759 - DNA, 25 bp, Mus musculus
gtcgcgtccatttgtcacgaggctc

SEQ ID NO: 246760 - DNA, 25 bp, Mus musculus
actaactccactttggctgccaggg

SEQ ID NO: 246761 - DNA, 25 bp, Mus musculus
tcacgctggatgtccactaactcca

SEQ ID NO: 246762 - DNA, 25 bp, Mus musculus
ggcgacacttctgccactgcgcagt

SEQ ID NO: 246763 - DNA, 25 bp, Mus musculus
cgtgggcagacacatcctcggagct

SEQ ID NO: 246764 - DNA, 25 bp, Mus musculus
gcctaggccgaaggggctgaatgga

SEQ ID NO: 246765 - DNA, 25 bp, Mus musculus
ccacggggtcactgtggcccagcga

SEQ ID NO: 246766 - DNA, 25 bp, Mus musculus
ctgggccggaaagagagtgtcccca

SEQ ID NO: 246767 - DNA, 25 bp, Mus musculus
tcacgaatagtggccgtgggaaaga

SEQ ID NO: 246768 - DNA, 25 bp, Mus musculus
ctccagagtgggcgggtcacgaata

SEQ ID NO: 246769 - DNA, 25 bp, Mus musculus
tcggcgatcctcctctcaaacccgg

SEQ ID NO: 246770 - DNA, 25 bp, Mus musculus
ctgaatggagggcactaacccgccc

SEQ ID NO: 246771 - DNA, 25 bp, Mus musculus
atcaatggcctaggccgaaggggct

SEQ ID NO: 246772 - DNA, 25 bp, Mus musculus
ttcatcaatggcctaggccgaaggg

SEQ ID NO: 246773 - DNA, 25 bp, Mus musculus
caggttcatcaatggcctaggccga

SEQ ID NO: 246774 - DNA, 25 bp, Mus musculus
tcacaggttcatcaatggcctaggc

SEQ ID NO: 246775 - DNA, 25 bp, Mus musculus
gccggcctgtcaccctcggcgatcc

SEQ ID NO: 246776 - DNA, 25 bp, Mus musculus
ccttcttaaaggcgccggcctgtca

SEQ ID NO: 246777 - DNA, 25 bp, Mus musculus
cctcctctcaaacccggggctgctc

SEQ ID NO: 246778 - DNA, 25 bp, Mus musculus
gtacctacaggcgcgcagcttcggc

SEQ ID NO: 246779 - DNA, 25 bp, Mus musculus
ttcaggctcccgagctccgcgcgct

SEQ ID NO: 246780 - DNA, 25 bp, Mus musculus
tctccctcttcaggctcccgagctc

SEQ ID NO: 246781 - DNA, 25 bp, Mus musculus
ttgaggttctctccctcttcaggct

SEQ ID NO: 246782 - DNA, 25 bp, Mus musculus
ccttgaggttctctccctcttcagg

SEQ ID NO: 246783 - DNA, 25 bp, Mus musculus
tggtgcggcccccttgaggttctct

SEQ ID NO: 246784 - DNA, 25 bp, Mus musculus
cggtcttggcggtcctggtgcggcc

SEQ ID NO: 246785 - DNA, 25 bp, Mus musculus
ctgcagcttgcgaggcggtcttggc

SEQ ID NO: 246786 - DNA, 25 bp, Mus musculus
tccctggcctgcagcttgcgaggcg

SEQ ID NO: 246787 - DNA, 25 bp, Mus musculus
gcttccctggcctgcagcttgcgag

SEQ ID NO: 246788 - DNA, 25 bp, Mus musculus
ctccgcccttggtggccggtggcgg

SEQ ID NO: 246789 - DNA, 25 bp, Mus musculus
catggccctccgggccgtagctccg

SEQ ID NO: 246790 - DNA, 25 bp, Mus musculus
gcgctgcccggaccgcggctgggat

SEQ ID NO: 246791 - DNA, 25 bp, Mus musculus
ctacaggcgcgcagcttcggccgcg

SEQ ID NO: 246792 - DNA, 25 bp, Mus musculus
tcctccctcccaccggtgcacacaa

SEQ ID NO: 246793 - DNA, 25 bp, Mus musculus
tgagaacaagcaggccgtacctaca

SEQ ID NO: 246794 - DNA, 25 bp, Mus musculus
aacaagcaggccgtacctacaggcg

SEQ ID NO: 246795 - DNA, 25 bp, Mus musculus
caagcaggccgtacctacaggcgcg

SEQ ID NO: 246796 - DNA, 25 bp, Mus musculus
gagctgagaacaagcaggccgtacc

SEQ ID NO: 246797 - DNA, 25 bp, Mus musculus
acagggagctgagaacaagcaggcc

SEQ ID NO: 246798 - DNA, 25 bp, Mus musculus
aaggaccgtggggacagggagctga

SEQ ID NO: 246799 - DNA, 25 bp, Mus musculus
gctgggcaccgggtagagtaaagga

SEQ ID NO: 246800 - DNA, 25 bp, Mus musculus
acagctgggcaccgggtagagtaaa

SEQ ID NO: 246801 - DNA, 25 bp, Mus musculus
caccctcggggacagctgggcaccg

SEQ ID NO: 246802 - DNA, 25 bp, Mus musculus
gggaggcggtgagcacacaccacac

SEQ ID NO: 246803 - DNA, 25 bp, Mus musculus
gtgcgaccgcgcttcccggggaggc

SEQ ID NO: 246804 - DNA, 25 bp, Mus musculus
gctgagaacaagcaggccgtaccta

SEQ ID NO: 246805 - DNA, 25 bp, Mus musculus
cacaaagacacgctcggacccgggc

SEQ ID NO: 246806 - DNA, 25 bp, Mus musculus
cttcaccgtcgtcctgtcctggggt

SEQ ID NO: 246807 - DNA, 25 bp, Mus musculus
ctcgggcagaccgaagaggctctgc

SEQ ID NO: 246808 - DNA, 25 bp, Mus musculus
gctctgcagtgagctaggccttcgc

SEQ ID NO: 246809 - DNA, 25 bp, Mus musculus
ctggtgcttggcaacgcagaactcc

SEQ ID NO: 246810 - DNA, 25 bp, Mus musculus
aacgcagaactcctctcggcagggc

SEQ ID NO: 246811 - DNA, 25 bp, Mus musculus
ctaggccggcttgcgtcttcaccgt

SEQ ID NO: 246812 - DNA, 25 bp, Mus musculus
cccgagcatagtggctgtgccttcg

SEQ ID NO: 246813 - DNA, 25 bp, Mus musculus
tgccagccctccctgagacttggtg

SEQ ID NO: 246814 - DNA, 25 bp, Mus musculus
agacttggtggccactatgttgcca

SEQ ID NO: 246815 - DNA, 25 bp, Mus musculus
tggccactatgttgccacctggctc

SEQ ID NO: 246816 - DNA, 25 bp, Mus musculus
tgtcaccttccgagctgggtgcagc

SEQ ID NO: 246817 - DNA, 25 bp, Mus musculus
cgcggctacttcgagctgaaggtga

SEQ ID NO: 246818 - DNA, 25 bp, Mus musculus
agccttcttcttccgcaccaggttg

SEQ ID NO: 246819 - DNA, 25 bp, Mus musculus
ggctgcgtcgcttcttcccggtctg

SEQ ID NO: 246820 - DNA, 25 bp, Mus musculus
gcctgacctgcagctgctgtaaatc

SEQ ID NO: 246821 - DNA, 25 bp, Mus musculus
tgaaacatcgatcccacattggccg

SEQ ID NO: 246822 - DNA, 25 bp, Mus musculus
cttgagacatattgagacggagtga

SEQ ID NO: 246823 - DNA, 25 bp, Mus musculus
accgcctcagccatggagtccgaag

SEQ ID NO: 246824 - DNA, 25 bp, Mus musculus
atggagtccgaagcctgagggaaac

SEQ ID NO: 246825 - DNA, 25 bp, Mus musculus
tcaagccgagtgatcaatgagagcc

SEQ ID NO: 246826 - DNA, 25 bp, Mus musculus
tggccagcgctttaggataaggtgc

SEQ ID NO: 246827 - DNA, 25 bp, Mus musculus
gcgccgagaagcctgacctgcagct

SEQ ID NO: 246828 - DNA, 25 bp, Mus musculus
agggtcccgcgacaacgacagcgcg

SEQ ID NO: 246829 - DNA, 25 bp, Mus musculus
tccttcctgagggaggccgcgaccg

SEQ ID NO: 246830 - DNA, 25 bp, Mus musculus
cttgggctgatcgatgaattgaaca

SEQ ID NO: 246831 - DNA, 25 bp, Mus musculus
atcaatttctgatcaagccgagtga

SEQ ID NO: 246832 - DNA, 25 bp, Mus musculus
agcgcttccaatattgaaacatcga

SEQ ID NO: 246833 - DNA, 25 bp, Mus musculus
gctgctgtaaatcaaagcgcttcca

SEQ ID NO: 246834 - DNA, 25 bp, Mus musculus
tagccgatctggaaggagaaacatc

SEQ ID NO: 246835 - DNA, 25 bp, Mus musculus
cagcgccgcggtagccgatctggaa

SEQ ID NO: 246836 - DNA, 25 bp, Mus musculus
cgatctggaaggagaaacatctgca

SEQ ID NO: 246837 - DNA, 25 bp, Mus musculus
aggagaaacatctgcaaggcatttg

SEQ ID NO: 246838 - DNA, 25 bp, Mus musculus
tctgcaaggcatttgtgcgaggctc

SEQ ID NO: 246839 - DNA, 25 bp, Mus musculus
gcaaggcatttgtgcgaggctcacc

SEQ ID NO: 246840 - DNA, 25 bp, Mus musculus
gcatttgtgcgaggctcacctttga

SEQ ID NO: 246841 - DNA, 25 bp, Mus musculus
gctcacctttgagacctcgcggttg

SEQ ID NO: 246842 - DNA, 25 bp, Mus musculus
aaggaggcgctgagttcgcgcaaaa

SEQ ID NO: 246843 - DNA, 25 bp, Mus musculus
gctgagttcgcgcaaaaggaaaatc

SEQ ID NO: 246844 - DNA, 25 bp, Mus musculus
gttcgcgcaaaaggaaaatcgctcc

SEQ ID NO: 246845 - DNA, 25 bp, Mus musculus
cgcaaaaggaaaatcgctccaaggt

SEQ ID NO: 246846 - DNA, 25 bp, Mus musculus
ttcttagggggaccctgactggcgc

SEQ ID NO: 246847 - DNA, 25 bp, Mus musculus
atcgctgcaggatcgcgcggctgct

SEQ ID NO: 246848 - DNA, 25 bp, Mus musculus
gggatcactgtgttggggtcctgcc

SEQ ID NO: 246849 - DNA, 25 bp, Mus musculus
ttgaggtcctgccagggatcactgt

SEQ ID NO: 246850 - DNA, 25 bp, Mus musculus
ggtcctgccagggatcactgtgttg

SEQ ID NO: 246851 - DNA, 25 bp, Mus musculus
aggtcctgccagggatcactgtgtt

SEQ ID NO: 246852 - DNA, 25 bp, Mus musculus
tactgccggggatcaccgtgttggg

SEQ ID NO: 246853 - DNA, 25 bp, Mus musculus
gtactgccggggatcaccgtgttgg

SEQ ID NO: 246854 - DNA, 25 bp, Mus musculus
gtgttagggtcctgccggggatcac

SEQ ID NO: 246855 - DNA, 25 bp, Mus musculus
ggatcaccgtgttggggtcctgccg

SEQ ID NO: 246856 - DNA, 25 bp, Mus musculus
ggatcactgtgttggggtcctgcct

SEQ ID NO: 246857 - DNA, 25 bp, Mus musculus
gattcattgtgttggggtcctgccg

SEQ ID NO: 246858 - DNA, 25 bp, Mus musculus
gggatcactgtgttagggtcctgcc

SEQ ID NO: 246859 - DNA, 25 bp, Mus musculus
ggtcctgccggggattcattgtgtt

SEQ ID NO: 246860 - DNA, 25 bp, Mus musculus
ggtcctgccggggatcactgtgttg

SEQ ID NO: 246861 - DNA, 25 bp, Mus musculus
gtcctgcctgggatcactgtgttag

SEQ ID NO: 246862 - DNA, 25 bp, Mus musculus
taggtgcgctgtctttactcttccc

SEQ ID NO: 246863 - DNA, 25 bp, Mus musculus
ctttctagctcctgcatccgtgggg

SEQ ID NO: 246864 - DNA, 25 bp, Mus musculus
ggtcgtacagccagcagactccaga

SEQ ID NO: 246865 - DNA, 25 bp, Mus musculus
attctgcgagactcccagggtttgg

SEQ ID NO: 246866 - DNA, 25 bp, Mus musculus
ccctagtctgggtttcaaatttgag

SEQ ID NO: 246867 - DNA, 25 bp, Mus musculus
ctcatcgacgtttctggcagcagct

SEQ ID NO: 246868 - DNA, 25 bp, Mus musculus
gcagctactacgacctaggtgccga

SEQ ID NO: 246869 - DNA, 25 bp, Mus musculus
ggccgaccctttaaggctagcagta

SEQ ID NO: 246870 - DNA, 25 bp, Mus musculus
tcgcagtctttcgttcgtagagcta

SEQ ID NO: 246871 - DNA, 25 bp, Mus musculus
ggacagccttacaggtcaccgtgta

SEQ ID NO: 246872 - DNA, 25 bp, Mus musculus
ggttcctgcattcctctcgtgaggg

SEQ ID NO: 246873 - DNA, 25 bp, Mus musculus
ttcttggggaacacaacggctgagc

SEQ ID NO: 246874 - DNA, 25 bp, Mus musculus
agcagacccaagctcgtcgctttga

SEQ ID NO: 246875 - DNA, 25 bp, Mus musculus
gcctggtactttcgttgtaaagctc

SEQ ID NO: 246876 - DNA, 25 bp, Mus musculus
cgggcaggcaactcctcagtgattg

SEQ ID NO: 246877 - DNA, 25 bp, Mus musculus
gagctctgactggacggctcccaga

SEQ ID NO: 246878 - DNA, 25 bp, Mus musculus
accggtagcccaggatggcgatctt

SEQ ID NO: 246879 - DNA, 25 bp, Mus musculus
atcttccgggacttggactgaggca

SEQ ID NO: 246880 - DNA, 25 bp, Mus musculus
ctgaggcatcttggtggcctgctca

SEQ ID NO: 246881 - DNA, 25 bp, Mus musculus
ttacgacaatcctgcccgagctctg

SEQ ID NO: 246882 - DNA, 25 bp, Mus musculus
ctgccgcgcgatgacgcaatggaaa

SEQ ID NO: 246883 - DNA, 25 bp, Mus musculus
tggaaactccgtcttctattgggga

SEQ ID NO: 246884 - DNA, 25 bp, Mus musculus
tcagcggggagctaaaaataaattc

SEQ ID NO: 246885 - DNA, 25 bp, Mus musculus
gcgtggtccaaaagcgtggccctac

SEQ ID NO: 246886 - DNA, 25 bp, Mus musculus
atggaggttatgaaacgcgcgccgc

SEQ ID NO: 246887 - DNA, 25 bp, Mus musculus
aggttggctgacacctcgcttcgca

SEQ ID NO: 246888 - DNA, 25 bp, Mus musculus
aaattctgtctgcttttgctcggcg

SEQ ID NO: 246889 - DNA, 25 bp, Mus musculus
acgaccgaaactcgctgcgtcatga

SEQ ID NO: 246890 - DNA, 25 bp, Mus musculus
ctcccggatgcaagtcggtgccatc

SEQ ID NO: 246891 - DNA, 25 bp, Mus musculus
tgatgtcgctggatccaaccctccg

SEQ ID NO: 246892 - DNA, 25 bp, Mus musculus
cagcaccgggccaatgttcttcaca

SEQ ID NO: 246893 - DNA, 25 bp, Mus musculus
gtcgagcctctgcttcctaacattc

SEQ ID NO: 246894 - DNA, 25 bp, Mus musculus
gcggcgcctcaaactcgatgccttt

SEQ ID NO: 246895 - DNA, 25 bp, Mus musculus
tgtcctttgatctagttcctgcgcc

SEQ ID NO: 246896 - DNA, 25 bp, Mus musculus
atcactggaccacttcgcctcttag

SEQ ID NO: 246897 - DNA, 25 bp, Mus musculus
cctcttagtctctgtggtgcgtccc

SEQ ID NO: 246898 - DNA, 25 bp, Mus musculus
ctcgtggtacaagtcccgtgtcctt

SEQ ID NO: 246899 - DNA, 25 bp, Mus musculus
cacaaggctcctacggtcgtgcgtt

SEQ ID NO: 246900 - DNA, 25 bp, Mus musculus
ggggtcccagcaaatgatcacaata

SEQ ID NO: 246901 - DNA, 25 bp, Mus musculus
tgccatctccattcgaagcccaggg

SEQ ID NO: 246902 - DNA, 25 bp, Mus musculus
ggctcactgtcctgcgttactagta

SEQ ID NO: 246903 - DNA, 25 bp, Mus musculus
gcgcgcactggctctaattctcacg

SEQ ID NO: 246904 - DNA, 25 bp, Mus musculus
agcgacagatctgcgtattcacctt

SEQ ID NO: 246905 - DNA, 25 bp, Mus musculus
attttcagccgggaaatcaggacaa

SEQ ID NO: 246906 - DNA, 25 bp, Mus musculus
ccttccacggtgaggattttcagcc

SEQ ID NO: 246907 - DNA, 25 bp, Mus musculus
gcggctcggttcagccttccacggt

SEQ ID NO: 246908 - DNA, 25 bp, Mus musculus
ctcctcatgtgttcgcggctcggtt

SEQ ID NO: 246909 - DNA, 25 bp, Mus musculus
aagctgtcgttagttgcaggtctga

SEQ ID NO: 246910 - DNA, 25 bp, Mus musculus
aggcgcgagcaagctgtcgttagtt

SEQ ID NO: 246911 - DNA, 25 bp, Mus musculus
gaaatgtagttaggcgcgagcaagc

SEQ ID NO: 246912 - DNA, 25 bp, Mus musculus
gcttgccgctgaaaactctgggaaa

SEQ ID NO: 246913 - DNA, 25 bp, Mus musculus
cccgctaacggcttgccgctgaaaa

SEQ ID NO: 246914 - DNA, 25 bp, Mus musculus
ccaatgaattttctgtcgcgagccc

SEQ ID NO: 246915 - DNA, 25 bp, Mus musculus
cacctcggcgccaatgaattttctg

SEQ ID NO: 246916 - DNA, 25 bp, Mus musculus
tattcaccttgctggtcaccggcca

SEQ ID NO: 246917 - DNA, 25 bp, Mus musculus
tcaggacaagacctgggactggatg

SEQ ID NO: 246918 - DNA, 25 bp, Mus musculus
gagccgcctgcaaatggtcactttt

SEQ ID NO: 246919 - DNA, 25 bp, Mus musculus
agcctaagcgtgctgctagccatgg

SEQ ID NO: 246920 - DNA, 25 bp, Mus musculus
gcgccaatgctgtcaacccaggtga

SEQ ID NO: 246921 - DNA, 25 bp, Mus musculus
aatccttgccttgtctcgccgtctg

SEQ ID NO: 246922 - DNA, 25 bp, Mus musculus
ctccgggtcagacttgtggtcaaga

SEQ ID NO: 246923 - DNA, 25 bp, Mus musculus
agacccacgaggatgtccgcgcgat

SEQ ID NO: 246924 - DNA, 25 bp, Mus musculus
ggctttgttgaacccagacccacga

SEQ ID NO: 246925 - DNA, 25 bp, Mus musculus
ggcaaacctaattccggtcgcattg

SEQ ID NO: 246926 - DNA, 25 bp, Mus musculus
gccatctttgataggggcaaaccta

SEQ ID NO: 246927 - DNA, 25 bp, Mus musculus
agctttcgctttccgccatctttga

SEQ ID NO: 246928 - DNA, 25 bp, Mus musculus
ttcccttggagatcagcaagctttc

SEQ ID NO: 246929 - DNA, 25 bp, Mus musculus
ccctcccgcttgaagtcattacgtg

SEQ ID NO: 246930 - DNA, 25 bp, Mus musculus
cgtgcacacatacgcgtgcgcagtc

SEQ ID NO: 246931 - DNA, 25 bp, Mus musculus
tccggtcgcattgtggttacccaaa

SEQ ID NO: 246932 - DNA, 25 bp, Mus musculus
agtccgtgcgcagtcagacccatag

SEQ ID NO: 246933 - DNA, 25 bp, Mus musculus
accagaaatccaagcgcccgctgtg

SEQ ID NO: 246934 - DNA, 25 bp, Mus musculus
tgaaaaccttcacgttgccggcatc

SEQ ID NO: 246935 - DNA, 25 bp, Mus musculus
ctcaggaccagggagagctcttcca

SEQ ID NO: 246936 - DNA, 25 bp, Mus musculus
agaagctctgctgaccgagtccgtg

SEQ ID NO: 246937 - DNA, 25 bp, Mus musculus
ctggcagcccgttggtcatgaaaac

SEQ ID NO: 246938 - DNA, 25 bp, Mus musculus
tccaaggcgtatcaaagtctaggtg

SEQ ID NO: 246939 - DNA, 25 bp, Mus musculus
gagactttgacacccttatccaagg

SEQ ID NO: 246940 - DNA, 25 bp, Mus musculus
ttccaggctcgaatgtccgaaagcg

SEQ ID NO: 246941 - DNA, 25 bp, Mus musculus
acgctgacccgagtcaatctggaga

SEQ ID NO: 246942 - DNA, 25 bp, Mus musculus
ttcgagatttcagtccgagcaatgc

SEQ ID NO: 246943 - DNA, 25 bp, Mus musculus
ctggaggcgctagcatccttgctcc

SEQ ID NO: 246944 - DNA, 25 bp, Mus musculus
cctcggtactgttgcaggcactgga

SEQ ID NO: 246945 - DNA, 25 bp, Mus musculus
ccggccaaaggatgacggcgtacca

SEQ ID NO: 246946 - DNA, 25 bp, Mus musculus
gccggaactacagcagctgttgccc

SEQ ID NO: 246947 - DNA, 25 bp, Mus musculus
gacgccggaactacagcagctgttg

SEQ ID NO: 246948 - DNA, 25 bp, Mus musculus
tggagacgccggaactacagcagct

SEQ ID NO: 246949 - DNA, 25 bp, Mus musculus
atctcttggctggagacgccggaac

SEQ ID NO: 246950 - DNA, 25 bp, Mus musculus
ttttgatctcttggctggagacgcc

SEQ ID NO: 246951 - DNA, 25 bp, Mus musculus
cgacccggggaattttgatctcttg

SEQ ID NO: 246952 - DNA, 25 bp, Mus musculus
cctgcctttgctacggggatctccg

SEQ ID NO: 246953 - DNA, 25 bp, Mus musculus
ctttgctacggggatctccggagct

SEQ ID NO: 246954 - DNA, 25 bp, Mus musculus
ggggatctccggagctcccggaaca

SEQ ID NO: 246955 - DNA, 25 bp, Mus musculus
agctcccggaacacagacgtcctgg

SEQ ID NO: 246956 - DNA, 25 bp, Mus musculus
agacgtcctggctcgcccttcaacc

SEQ ID NO: 246957 - DNA, 25 bp, Mus musculus
tgcgatgctcacgattctccagata

SEQ ID NO: 246958 - DNA, 25 bp, Mus musculus
gatgctcacgattctccagataccc

SEQ ID NO: 246959 - DNA, 25 bp, Mus musculus
ccggggaattttgatctcttggctg

SEQ ID NO: 246960 - DNA, 25 bp, Mus musculus
tgggccgccaataaactgttacagc

SEQ ID NO: 246961 - DNA, 25 bp, Mus musculus
actgcgcagccaggctggtttgccg

SEQ ID NO: 246962 - DNA, 25 bp, Mus musculus
tgcgactgcgcagccaggctggttt

SEQ ID NO: 246963 - DNA, 25 bp, Mus musculus
cctctgggccgccaataaactgtta

SEQ ID NO: 246964 - DNA, 25 bp, Mus musculus
cagcatccggcggaagcaagcgctg

SEQ ID NO: 246965 - DNA, 25 bp, Mus musculus
actgaggcaccctgcccgcagcatc

SEQ ID NO: 246966 - DNA, 25 bp, Mus musculus
attggtgagcactgaggcaccctgc

SEQ ID NO: 246967 - DNA, 25 bp, Mus musculus
aagcctcgggattggtgagcactga

SEQ ID NO: 246968 - DNA, 25 bp, Mus musculus
cgctgggaacagaagcctcgggatt

SEQ ID NO: 246969 - DNA, 25 bp, Mus musculus
gtcagagacgctgggaacagaagcc

SEQ ID NO: 246970 - DNA, 25 bp, Mus musculus
accagagtctgtgcaacacgcggga

SEQ ID NO: 246971 - DNA, 25 bp, Mus musculus
agtctgtgcaacacgcgggaagttg

SEQ ID NO: 246972 - DNA, 25 bp, Mus musculus
tacagccaccagagtctgtgcaaca

SEQ ID NO: 246973 - DNA, 25 bp, Mus musculus
actgttacagccaccagagtctgtg

SEQ ID NO: 246974 - DNA, 25 bp, Mus musculus
tgtcacccatggtgctgtcagagga

SEQ ID NO: 246975 - DNA, 25 bp, Mus musculus
tctcgcgtggttttgcgacaaaatc

SEQ ID NO: 246976 - DNA, 25 bp, Mus musculus
gagctcggcctccaactacaaaaca

SEQ ID NO: 246977 - DNA, 25 bp, Mus musculus
ctgggattctcagcccggagacgaa

SEQ ID NO: 246978 - DNA, 25 bp, Mus musculus
cgacaatggaccacaaagagggttg

SEQ ID NO: 246979 - DNA, 25 bp, Mus musculus
cggaccggaacgagcgacaatggac

SEQ ID NO: 246980 - DNA, 25 bp, Mus musculus
gcggggtatggacgttaatactgtc

SEQ ID NO: 246981 - DNA, 25 bp, Mus musculus
acacggtgatgatgaacaaggacca

SEQ ID NO: 246982 - DNA, 25 bp, Mus musculus
gcgtcttcggtcgtattcatcatca

SEQ ID NO: 246983 - DNA, 25 bp, Mus musculus
gaaatttgtccctgcgtcttcggtc

SEQ ID NO: 246984 - DNA, 25 bp, Mus musculus
cgctgcgctctcttcgaaatttgtc

SEQ ID NO: 246985 - DNA, 25 bp, Mus musculus
tcccgggaacggtcataatcgctgc

SEQ ID NO: 246986 - DNA, 25 bp, Mus musculus
tgtctcaccggtcattccaatcgtc

SEQ ID NO: 246987 - DNA, 25 bp, Mus musculus
ggcgatcgctccgacagtttcactg

SEQ ID NO: 246988 - DNA, 25 bp, Mus musculus
gcctgccggagtcgtactatttcag

SEQ ID NO: 246989 - DNA, 25 bp, Mus musculus
ctcgtacgctgccttgcaagccaaa

SEQ ID NO: 246990 - DNA, 25 bp, Mus musculus
agggagccgtgatcctccatcccga

SEQ ID NO: 246991 - DNA, 25 bp, Mus musculus
cgtccagtttcagctcgcaggctgc

SEQ ID NO: 246992 - DNA, 25 bp, Mus musculus
cctggtccctttcacattcagagga

SEQ ID NO: 246993 - DNA, 25 bp, Mus musculus
actatttcagcttctcgggagaccc

SEQ ID NO: 246994 - DNA, 25 bp, Mus musculus
gcaaggcgtcccattggtcccgatt

SEQ ID NO: 246995 - DNA, 25 bp, Mus musculus
ccgcctcaaaggtgtggtctacact

SEQ ID NO: 246996 - DNA, 25 bp, Mus musculus
tacacacctgggaactgagagcgac

SEQ ID NO: 246997 - DNA, 25 bp, Mus musculus
cccgttgccaggatgctagcagatg

SEQ ID NO: 246998 - DNA, 25 bp, Mus musculus
gcaaggtagtgggtcacgatcctca

SEQ ID NO: 246999 - DNA, 25 bp, Mus musculus
cgtctcgggtgtcttttgcaaggta

SEQ ID NO: 247000 - DNA, 25 bp, Mus musculus
tgactgcactccgagctccaggacg

SEQ ID NO: 247001 - DNA, 25 bp, Mus musculus
caaaccgttccacgtgcgtctcggg

SEQ ID NO: 247002 - DNA, 25 bp, Mus musculus
ttcagccaaagtgaggcggcgccat

SEQ ID NO: 247003 - DNA, 25 bp, Mus musculus
agagagaccgcgagcaatcggccca

SEQ ID NO: 247004 - DNA, 25 bp, Mus musculus
tccaccttccttgaccgcgaccggc

SEQ ID NO: 247005 - DNA, 25 bp, Mus musculus
accaaccactccagggagcgagaga

SEQ ID NO: 247006 - DNA, 25 bp, Mus musculus
ctcctgctcggttcccactttggtt

SEQ ID NO: 247007 - DNA, 25 bp, Mus musculus
gcgcgcccgcatgggccatcgttga

SEQ ID NO: 247008 - DNA, 25 bp, Mus musculus
ccatcgttgagaggccctcgacgga

SEQ ID NO: 247009 - DNA, 25 bp, Mus musculus
ccaaactcggatcgcattcagccaa

SEQ ID NO: 247010 - DNA, 25 bp, Mus musculus
agcagagtcggtgtgcacccgccca

SEQ ID NO: 247011 - DNA, 25 bp, Mus musculus
tcccagcagcagagtcggtgtgcac

SEQ ID NO: 247012 - DNA, 25 bp, Mus musculus
aggccctcgacggaaagtcccagca

SEQ ID NO: 247013 - DNA, 25 bp, Mus musculus
tgctcggttcccactttggtttcca

SEQ ID NO: 247014 - DNA, 25 bp, Mus musculus
ctcgacggaaagtcccagcagcaga

SEQ ID NO: 247015 - DNA, 25 bp, Mus musculus
ggcggcgcgacatccaccaaccact

SEQ ID NO: 247016 - DNA, 25 bp, Mus musculus
cgcgttcggcagtaaggcgcagatt

SEQ ID NO: 247017 - DNA, 25 bp, Mus musculus
agtcagtcagccaggcagtcggtca

SEQ ID NO: 247018 - DNA, 25 bp, Mus musculus
gcagtcagccagctagcccgtcagt

SEQ ID NO: 247019 - DNA, 25 bp, Mus musculus
agcccgtcagtcagccaaccagtga

SEQ ID NO: 247020 - DNA, 25 bp, Mus musculus
gctccggtcactagtgtcctggcgt

SEQ ID NO: 247021 - DNA, 25 bp, Mus musculus
ggccagtgcgcttacttcctccaga

SEQ ID NO: 247022 - DNA, 25 bp, Mus musculus
agagtccttgagagcgccgcttaaa

SEQ ID NO: 247023 - DNA, 25 bp, Mus musculus
tgcaaggcagccagtcagtcagtca

SEQ ID NO: 247024 - DNA, 25 bp, Mus musculus
tgggtttgcggctcacaccttccca

SEQ ID NO: 247025 - DNA, 25 bp, Mus musculus
agaagccgtcggtccctgagaaatc

SEQ ID NO: 247026 - DNA, 25 bp, Mus musculus
acggctgacaatttgccagatgaga

SEQ ID NO: 247027 - DNA, 25 bp, Mus musculus
ggggatttcccgctgcttacgtcac

SEQ ID NO: 247028 - DNA, 25 bp, Mus musculus
agacttgaaaggcagaccgtcctaa

SEQ ID NO: 247029 - DNA, 25 bp, Mus musculus
cggtactcactcgaggccatggctc

SEQ ID NO: 247030 - DNA, 25 bp, Mus musculus
atgcctgtccctgccgagggccagt

SEQ ID NO: 247031 - DNA, 25 bp, Mus musculus
gtccgcacctatgaggtgtgcgaca

SEQ ID NO: 247032 - DNA, 25 bp, Mus musculus
tgaggtgtgcgacatgaagcgtcca

SEQ ID NO: 247033 - DNA, 25 bp, Mus musculus
ccaaggcgaggtgctgtccacgtgt

SEQ ID NO: 247034 - DNA, 25 bp, Mus musculus
cacgtgtatgccacgatacgcttca

SEQ ID NO: 247035 - DNA, 25 bp, Mus musculus
ttcaccatgatggaatgcctgtccc

SEQ ID NO: 247036 - DNA, 25 bp, Mus musculus
ctgcgcactggctgggtcccaaggc

SEQ ID NO: 247037 - DNA, 25 bp, Mus musculus
agggccagtcgctcctgcaaggaga

SEQ ID NO: 247038 - DNA, 25 bp, Mus musculus
ctgcaaggagacattcactgtcttc

SEQ ID NO: 247039 - DNA, 25 bp, Mus musculus
cactgtcttctattacgagagcgaa

SEQ ID NO: 247040 - DNA, 25 bp, Mus musculus
ttacgagagcgaagctgatacggcc

SEQ ID NO: 247041 - DNA, 25 bp, Mus musculus
agctgatacggccacggcccatacg

SEQ ID NO: 247042 - DNA, 25 bp, Mus musculus
tgccacgatacgcttcaccatgatg

SEQ ID NO: 247043 - DNA, 25 bp, Mus musculus
tgctgtccacgtgtatgccacgata

SEQ ID NO: 247044 - DNA, 25 bp, Mus musculus
cagaacccggctgcgtcccttggag

SEQ ID NO: 247045 - DNA, 25 bp, Mus musculus
caggtgtgggtccatgggcaccctc

SEQ ID NO: 247046 - DNA, 25 bp, Mus musculus
gacacgcgcgtcctctcgcaggtgt

SEQ ID NO: 247047 - DNA, 25 bp, Mus musculus
gcgcctttggtacggcccgcgagca

SEQ ID NO: 247048 - DNA, 25 bp, Mus musculus
accgatcagcatgggccgcggcgct

SEQ ID NO: 247049 - DNA, 25 bp, Mus musculus
aggaggacaccgatcagcatgggcc

SEQ ID NO: 247050 - DNA, 25 bp, Mus musculus
agtgggctgcagtcccgatgcccgc

SEQ ID NO: 247051 - DNA, 25 bp, Mus musculus
ctgcatcccgggagcccggtgtttc

SEQ ID NO: 247052 - DNA, 25 bp, Mus musculus
tgctttcctcagagcgggactgcgt

SEQ ID NO: 247053 - DNA, 25 bp, Mus musculus
ccgaggccgggtgctttcctcagag

SEQ ID NO: 247054 - DNA, 25 bp, Mus musculus
gcttccctgagaaccggactgcatc

SEQ ID NO: 247055 - DNA, 25 bp, Mus musculus
ggagccagactgcttccctgagaac

SEQ ID NO: 247056 - DNA, 25 bp, Mus musculus
agcagagctgcatttcccggagcca

SEQ ID NO: 247057 - DNA, 25 bp, Mus musculus
gcgtcccttggagcagagctgcatt

SEQ ID NO: 247058 - DNA, 25 bp, Mus musculus
gctgagcagcaggtcacgggctgca

SEQ ID NO: 247059 - DNA, 25 bp, Mus musculus
tggccaacgcggtccctaccgccaa

SEQ ID NO: 247060 - DNA, 25 bp, Mus musculus
cccagcctctactgccgggaagatg

SEQ ID NO: 247061 - DNA, 25 bp, Mus musculus
ctctactgccgggaagatggtcaat

SEQ ID NO: 247062 - DNA, 25 bp, Mus musculus
ctactgccgggaagatggtcaatgg

SEQ ID NO: 247063 - DNA, 25 bp, Mus musculus
aagatggtcaatgggctgagcagca

SEQ ID NO: 247064 - DNA, 25 bp, Mus musculus
tgcagaggtgagaacgcgagtaccc

SEQ ID NO: 247065 - DNA, 25 bp, Mus musculus
caacaaagtatgcagaggtgagaac

SEQ ID NO: 247066 - DNA, 25 bp, Mus musculus
gctgcggaaagcaacaaagtatgca

SEQ ID NO: 247067 - DNA, 25 bp, Mus musculus
cgaggctgcggaaagcaacaaagta

SEQ ID NO: 247068 - DNA, 25 bp, Mus musculus
tacgaggctgcggaaagcaacaaag

SEQ ID NO: 247069 - DNA, 25 bp, Mus musculus
cagctgcgcgccagggtacgaggct

SEQ ID NO: 247070 - DNA, 25 bp, Mus musculus
cgagacggtgcctcgggagctcgtg

SEQ ID NO: 247071 - DNA, 25 bp, Mus musculus
agctgcgtggccaacgcggtcccta

SEQ ID NO: 247072 - DNA, 25 bp, Mus musculus
acaaggtgacaaacaagccgagaca

SEQ ID NO: 247073 - DNA, 25 bp, Mus musculus
cacaaggtgacaaacaagccgagac

SEQ ID NO: 247074 - DNA, 25 bp, Mus musculus
caaggtgacaaacaagccgagacac

SEQ ID NO: 247075 - DNA, 25 bp, Mus musculus
aaggtgacaaacaagccgagacaca

SEQ ID NO: 247076 - DNA, 25 bp, Mus musculus
aggtgacaaacaagccgagacacag

SEQ ID NO: 247077 - DNA, 25 bp, Mus musculus
acacagctggcgaatcgggcgcctc

SEQ ID NO: 247078 - DNA, 25 bp, Mus musculus
cacagctggcgaatcgggcgcctca

SEQ ID NO: 247079 - DNA, 25 bp, Mus musculus
cagctggcgaatcgggcgcctcact

SEQ ID NO: 247080 - DNA, 25 bp, Mus musculus
gctggcgaatcgggcgcctcactaa

SEQ ID NO: 247081 - DNA, 25 bp, Mus musculus
ctggcgaatcgggcgcctcactaaa

SEQ ID NO: 247082 - DNA, 25 bp, Mus musculus
cgaatcgggcgcctcactaaacaca

SEQ ID NO: 247083 - DNA, 25 bp, Mus musculus
cgggaggtgtgcgagccatggagtt

SEQ ID NO: 247084 - DNA, 25 bp, Mus musculus
acagctggcgaatcgggcgcctcac

SEQ ID NO: 247085 - DNA, 25 bp, Mus musculus
ccacaaggtgacaaacaagccgaga

SEQ ID NO: 247086 - DNA, 25 bp, Mus musculus
caagtgttggcagcttcccgccaca

SEQ ID NO: 247087 - DNA, 25 bp, Mus musculus
acgtcgctggcctcgatatgcagaa

SEQ ID NO: 247088 - DNA, 25 bp, Mus musculus
ccgataagcttatggccttctaggc

SEQ ID NO: 247089 - DNA, 25 bp, Mus musculus
tcctttcctcgtgcgcgtgcgcaag

SEQ ID NO: 247090 - DNA, 25 bp, Mus musculus
taaggctcgcgagacttgagggttc

SEQ ID NO: 247091 - DNA, 25 bp, Mus musculus
ttcgcagggttctagtgagcgcttc

SEQ ID NO: 247092 - DNA, 25 bp, Mus musculus
gacccacatgaggtgccaagtgttg

SEQ ID NO: 247093 - DNA, 25 bp, Mus musculus
ctagctagcagaggcggggctaatt

SEQ ID NO: 247094 - DNA, 25 bp, Mus musculus
tgatggactcctccctctgcgaggg

SEQ ID NO: 247095 - DNA, 25 bp, Mus musculus
ggctaattgacagaggcgggcccaa

SEQ ID NO: 247096 - DNA, 25 bp, Mus musculus
cggaagcctgtagtccacgtccatc

SEQ ID NO: 247097 - DNA, 25 bp, Mus musculus
agcagtggagttgacagctgacctc

SEQ ID NO: 247098 - DNA, 25 bp, Mus musculus
atcgaagggatcgtgtccaccatga

SEQ ID NO: 247099 - DNA, 25 bp, Mus musculus
tcgccgaccgatccaagtggacgtc

SEQ ID NO: 247100 - DNA, 25 bp, Mus musculus
cctaagtgcttggtcatcgatgtcc

SEQ ID NO: 247101 - DNA, 25 bp, Mus musculus
caaacacaaacagagaggagcggcc

SEQ ID NO: 247102 - DNA, 25 bp, Mus musculus
ggtaagctctgcgagcaccggagca

SEQ ID NO: 247103 - DNA, 25 bp, Mus musculus
ctcaatccgaagtaacggtcgcgtc

SEQ ID NO: 247104 - DNA, 25 bp, Mus musculus
agcccgctacgtgccaagcacggtt

SEQ ID NO: 247105 - DNA, 25 bp, Mus musculus
ccaagcacggttctggtagccgaac

SEQ ID NO: 247106 - DNA, 25 bp, Mus musculus
gcaggtccaagcgttccaccacttt

SEQ ID NO: 247107 - DNA, 25 bp, Mus musculus
tttggccaccatggtagctttattc

SEQ ID NO: 247108 - DNA, 25 bp, Mus musculus
ggtagctttattctgcccgaccatc

SEQ ID NO: 247109 - DNA, 25 bp, Mus musculus
ccgaccatctcgtcttgggtcttca

SEQ ID NO: 247110 - DNA, 25 bp, Mus musculus
ttgggtcttcacctcggtctcttgg

SEQ ID NO: 247111 - DNA, 25 bp, Mus musculus
ggcagccatcttgctacaaacacaa

SEQ ID NO: 247112 - DNA, 25 bp, Mus musculus
ttttaagcggccacctaagtgcttg

SEQ ID NO: 247113 - DNA, 25 bp, Mus musculus
tggtcatcgatgtcccttttccctc

SEQ ID NO: 247114 - DNA, 25 bp, Mus musculus
gcgttgccaaggaacaaacgacttc

SEQ ID NO: 247115 - DNA, 25 bp, Mus musculus
agtcccttcgaaaacagacctggcg

SEQ ID NO: 247116 - DNA, 25 bp, Mus musculus
gttgcctaggcaaccgtcacccgga

SEQ ID NO: 247117 - DNA, 25 bp, Mus musculus
tcacccggactaagagcacctcatt

SEQ ID NO: 247118 - DNA, 25 bp, Mus musculus
aaggcaaccgcatccgcggcagaga

SEQ ID NO: 247119 - DNA, 25 bp, Mus musculus
ctcttacccagaaccggccagggtg

SEQ ID NO: 247120 - DNA, 25 bp, Mus musculus
gccagggtggctgtttacaggattt

SEQ ID NO: 247121 - DNA, 25 bp, Mus musculus
gggaaaagccgattgagcactaata

SEQ ID NO: 247122 - DNA, 25 bp, Mus musculus
gcactaataggttcgggacggctca

SEQ ID NO: 247123 - DNA, 25 bp, Mus musculus
ccattagctgctggtcagtgcgaga

SEQ ID NO: 247124 - DNA, 25 bp, Mus musculus
cgtgggagcctctcagaagtaatta

SEQ ID NO: 247125 - DNA, 25 bp, Mus musculus
gtaattagggctccgaagagaggcc

SEQ ID NO: 247126 - DNA, 25 bp, Mus musculus
ctccggcaccgaaagacgttgcgtt

SEQ ID NO: 247127 - DNA, 25 bp, Mus musculus
cgcacggccaggaaaggatctgcta

SEQ ID NO: 247128 - DNA, 25 bp, Mus musculus
ctcctcccaacctcggaatgaagaa

SEQ ID NO: 247129 - DNA, 25 bp, Mus musculus
aagaagcggctgtacctttaaagca

SEQ ID NO: 247130 - DNA, 25 bp, Mus musculus
ggctgtacctttaaagcagcggccc

SEQ ID NO: 247131 - DNA, 25 bp, Mus musculus
cccagccgggttattgtctcgcttc

SEQ ID NO: 247132 - DNA, 25 bp, Mus musculus
gccgggttattgtctcgcttcataa

SEQ ID NO: 247133 - DNA, 25 bp, Mus musculus
tattgtctcgcttcataaccaatcg

SEQ ID NO: 247134 - DNA, 25 bp, Mus musculus
ttcataaccaatcggccgcgccgtt

SEQ ID NO: 247135 - DNA, 25 bp, Mus musculus
caggggatccagtgttctgattggc

SEQ ID NO: 247136 - DNA, 25 bp, Mus musculus
tccagtgttctgattggccgccgct

SEQ ID NO: 247137 - DNA, 25 bp, Mus musculus
gcgagcagcgtagagagggcactat

SEQ ID NO: 247138 - DNA, 25 bp, Mus musculus
gcactgggctctcggcctggtctac

SEQ ID NO: 247139 - DNA, 25 bp, Mus musculus
tgggctctcggcctggtctacagcc

SEQ ID NO: 247140 - DNA, 25 bp, Mus musculus
tggtctacagccctgcatcccgaac

SEQ ID NO: 247141 - DNA, 25 bp, Mus musculus
cctcggaatgaagaagcggctgtac

SEQ ID NO: 247142 - DNA, 25 bp, Mus musculus
gaagtctactgtccctacagcgcca

SEQ ID NO: 247143 - DNA, 25 bp, Mus musculus
tggtgtacgcccactacgggcggtc

SEQ ID NO: 247144 - DNA, 25 bp, Mus musculus
ggcaagctggtgtacgcccactacg

SEQ ID NO: 247145 - DNA, 25 bp, Mus musculus
gcgttcccagggcaagctggtgtac

SEQ ID NO: 247146 - DNA, 25 bp, Mus musculus
atacgggcagcgaggcctcaccaat

SEQ ID NO: 247147 - DNA, 25 bp, Mus musculus
cctcatcgggtagccgagttgggat

SEQ ID NO: 247148 - DNA, 25 bp, Mus musculus
catcacgtcctcatcgggtagccga

SEQ ID NO: 247149 - DNA, 25 bp, Mus musculus
agcgccaccggcaacgccacggtga

SEQ ID NO: 247150 - DNA, 25 bp, Mus musculus
tccggaagtctactgtccctacagc

SEQ ID NO: 247151 - DNA, 25 bp, Mus musculus
aggatccggaagtctactgtcccta

SEQ ID NO: 247152 - DNA, 25 bp, Mus musculus
taccgctggaggatccggaagtcta

SEQ ID NO: 247153 - DNA, 25 bp, Mus musculus
caggagcagctaccgctggaggatc

SEQ ID NO: 247154 - DNA, 25 bp, Mus musculus
gagcgtccaggagcagctaccgctg

SEQ ID NO: 247155 - DNA, 25 bp, Mus musculus
atggggagcccatcacgtcctcatc

SEQ ID NO: 247156 - DNA, 25 bp, Mus musculus
aggtcaccgaattgtgtccctgtgc

SEQ ID NO: 247157 - DNA, 25 bp, Mus musculus
agccgcttgtactgtgataatcacc

SEQ ID NO: 247158 - DNA, 25 bp, Mus musculus
cccgctagatgtggatcctgcagcc

SEQ ID NO: 247159 - DNA, 25 bp, Mus musculus
ctgtttctgaccacgccttttccgg

SEQ ID NO: 247160 - DNA, 25 bp, Mus musculus
ggcctgatgtcaccactgccttgga

SEQ ID NO: 247161 - DNA, 25 bp, Mus musculus
tctcctgacggactctgctctttga

SEQ ID NO: 247162 - DNA, 25 bp, Mus musculus
cgtctcttcacctcggaagcgaagc

SEQ ID NO: 247163 - DNA, 25 bp, Mus musculus
tcccgcctgtgaacagccgcttgta

SEQ ID NO: 247164 - DNA, 25 bp, Mus musculus
tctggtccgccctgaatactagatc

SEQ ID NO: 247165 - DNA, 25 bp, Mus musculus
ttgtgaccaaattaagggcgccatc

SEQ ID NO: 247166 - DNA, 25 bp, Mus musculus
cgccatcttcccgagagttccttta

SEQ ID NO: 247167 - DNA, 25 bp, Mus musculus
agttcctttatgcacttccgccgta

SEQ ID NO: 247168 - DNA, 25 bp, Mus musculus
gtgccctttccttgagctcggcata

SEQ ID NO: 247169 - DNA, 25 bp, Mus musculus
ctcggcatatgctctgctcgggatc

SEQ ID NO: 247170 - DNA, 25 bp, Mus musculus
gggatggtatttgcgccaatgcaga

SEQ ID NO: 247171 - DNA, 25 bp, Mus musculus
ggccaccgccaatatggcgctactt

SEQ ID NO: 247172 - DNA, 25 bp, Mus musculus
tatttatgacaatacagcgcggcca

SEQ ID NO: 247173 - DNA, 25 bp, Mus musculus
ccacaaaaccggctctatttatgac

SEQ ID NO: 247174 - DNA, 25 bp, Mus musculus
tcaaccgagtagtgaaaacaccaca

SEQ ID NO: 247175 - DNA, 25 bp, Mus musculus
tacagccgaggcattcaaccgagta

SEQ ID NO: 247176 - DNA, 25 bp, Mus musculus
gtccaattcccttcgctcgcttgta

SEQ ID NO: 247177 - DNA, 25 bp, Mus musculus
tggggtcctgttcttgccctctctt

SEQ ID NO: 247178 - DNA, 25 bp, Mus musculus
agtgtctttcgctttggggtcctgt

SEQ ID NO: 247179 - DNA, 25 bp, Mus musculus
cgtctctctccagcgagtgtctttc

SEQ ID NO: 247180 - DNA, 25 bp, Mus musculus
gacatctctttcatcgcttcctgcg

SEQ ID NO: 247181 - DNA, 25 bp, Mus musculus
tgaccgaccgttttttctcctcagc

SEQ ID NO: 247182 - DNA, 25 bp, Mus musculus
aatagacgggctcagacacggctgg

SEQ ID NO: 247183 - DNA, 25 bp, Mus musculus
caatgcagacagaatagacgggctc

SEQ ID NO: 247184 - DNA, 25 bp, Mus musculus
cttgtcagacatcacccaggctggt

SEQ ID NO: 247185 - DNA, 25 bp, Mus musculus
aatctagaattgagaggctccaccc

SEQ ID NO: 247186 - DNA, 25 bp, Mus musculus
gccgttttctgattgggcacttcta

SEQ ID NO: 247187 - DNA, 25 bp, Mus musculus
tgggcacttctaacgcgtctctggt

SEQ ID NO: 247188 - DNA, 25 bp, Mus musculus
ctctggttcatgattggtccgcgga

SEQ ID NO: 247189 - DNA, 25 bp, Mus musculus
tcctcccttcagtggggactacggc

SEQ ID NO: 247190 - DNA, 25 bp, Mus musculus
tgcagcttcagtgtccttgccaggg

SEQ ID NO: 247191 - DNA, 25 bp, Mus musculus
gtagcgcagaacgagccctagagga

SEQ ID NO: 247192 - DNA, 25 bp, Mus musculus
tggccaccgggaccctgaacttgtc

SEQ ID NO: 247193 - DNA, 25 bp, Mus musculus
cggcccgcagttacgacttgtcaga

SEQ ID NO: 247194 - DNA, 25 bp, Mus musculus
tgcccagagagcaggggacccatac

SEQ ID NO: 247195 - DNA, 25 bp, Mus musculus
ccatactggactgcgaccctcattt

SEQ ID NO: 247196 - DNA, 25 bp, Mus musculus
tcacctggcagtcttgaacgctcgc

SEQ ID NO: 247197 - DNA, 25 bp, Mus musculus
gtccaaccggcgtttgaagcacttc

SEQ ID NO: 247198 - DNA, 25 bp, Mus musculus
tctcgtagcactccaggcgtggtgg

SEQ ID NO: 247199 - DNA, 25 bp, Mus musculus
tcgagcagggcgctgtaccatgctt

SEQ ID NO: 247200 - DNA, 25 bp, Mus musculus
tgcttcctcagatggccacagagcc

SEQ ID NO: 247201 - DNA, 25 bp, Mus musculus
gcgctgtaccatgcttgctgctctg

SEQ ID NO: 247202 - DNA, 25 bp, Mus musculus
ggcggcgctgggacttctgcttcct

SEQ ID NO: 247203 - DNA, 25 bp, Mus musculus
tcgctctcgtagcactccaggcgtg

SEQ ID NO: 247204 - DNA, 25 bp, Mus musculus
ctggccaagaacttcttctcgctct

SEQ ID NO: 247205 - DNA, 25 bp, Mus musculus
cagccgctggccaagaacttcttct

SEQ ID NO: 247206 - DNA, 25 bp, Mus musculus
ttgctaatagtgcaggcaccctcca

SEQ ID NO: 247207 - DNA, 25 bp, Mus musculus
catccgcgcgcttgctaatagtgca

SEQ ID NO: 247208 - DNA, 25 bp, Mus musculus
tatagatgacgatcaggtggcgctg

SEQ ID NO: 247209 - DNA, 25 bp, Mus musculus
gctgtcgctggtatagatgacgatc

SEQ ID NO: 247210 - DNA, 25 bp, Mus musculus
cccaggctgctgtcgctggtataga

SEQ ID NO: 247211 - DNA, 25 bp, Mus musculus
agccgagggacacgtcggtgcactc

SEQ ID NO: 247212 - DNA, 25 bp, Mus musculus
tctcgtgtctgtgcctcgatggaaa

SEQ ID NO: 247213 - DNA, 25 bp, Mus musculus
aggactgctgccgttacactggagc

SEQ ID NO: 247214 - DNA, 25 bp, Mus musculus
cagagtgtcccttgttaaccgccta

SEQ ID NO: 247215 - DNA, 25 bp, Mus musculus
ctcaccggaatgtgcactcgcagtg

SEQ ID NO: 247216 - DNA, 25 bp, Mus musculus
ctcttcaggctagggttctttttgc

SEQ ID NO: 247217 - DNA, 25 bp, Mus musculus
catggctgcgcttcccataacttta

SEQ ID NO: 247218 - DNA, 25 bp, Mus musculus
tagaagttaattccggtgcctcgtc

SEQ ID NO: 247219 - DNA, 25 bp, Mus musculus
tggagccacgcgctttttatgactg

SEQ ID NO: 247220 - DNA, 25 bp, Mus musculus
ggagcgtcctctttctcctacggaa

SEQ ID NO: 247221 - DNA, 25 bp, Mus musculus
aatcattgggtgcagagtctcggcc

SEQ ID NO: 247222 - DNA, 25 bp, Mus musculus
gctacttttggttacgcgtggcaga

SEQ ID NO: 247223 - DNA, 25 bp, Mus musculus
gtcggccaggcaggtgcaattaaca

SEQ ID NO: 247224 - DNA, 25 bp, Mus musculus
gcgcgtggccgcaggaataaactgt

SEQ ID NO: 247225 - DNA, 25 bp, Mus musculus
aattcccagaggtagtcggccaggc

SEQ ID NO: 247226 - DNA, 25 bp, Mus musculus
agctgcccacggtgatgtccacata

SEQ ID NO: 247227 - DNA, 25 bp, Mus musculus
cgcactcgaaacagtggcggttccc

SEQ ID NO: 247228 - DNA, 25 bp, Mus musculus
ttcctctgcaagtcagcggtcgctc

SEQ ID NO: 247229 - DNA, 25 bp, Mus musculus
tcctcgtcctgttcggcacgctgat

SEQ ID NO: 247230 - DNA, 25 bp, Mus musculus
ccttgctttaattggttcgattcga

SEQ ID NO: 247231 - DNA, 25 bp, Mus musculus
ttcgattcgagacggcctccggttg

SEQ ID NO: 247232 - DNA, 25 bp, Mus musculus
cctccggttgctggagccttcagaa

SEQ ID NO: 247233 - DNA, 25 bp, Mus musculus
acccggccttctgtcttttccattg

SEQ ID NO: 247234 - DNA, 25 bp, Mus musculus
agtacaatgcgtgccctcctccttg

SEQ ID NO: 247235 - DNA, 25 bp, Mus musculus
cggactcctatgctgactctgattg

SEQ ID NO: 247236 - DNA, 25 bp, Mus musculus
actctgattggttgttaaggttgca

SEQ ID NO: 247237 - DNA, 25 bp, Mus musculus
ttaaggttgcaaaattagcgtgcga

SEQ ID NO: 247238 - DNA, 25 bp, Mus musculus
caggtggtgcagacgaagctgccca

SEQ ID NO: 247239 - DNA, 25 bp, Mus musculus
cgaagcggcttcagcctccgctttg

SEQ ID NO: 247240 - DNA, 25 bp, Mus musculus
agctttcgggcgtctggttctcgcc

SEQ ID NO: 247241 - DNA, 25 bp, Mus musculus
agatcagcgcatctgctcagcaggg

SEQ ID NO: 247242 - DNA, 25 bp, Mus musculus
gggcgtgctcccttggcttagtccc

SEQ ID NO: 247243 - DNA, 25 bp, Mus musculus
cttgttccaccgtgtggggctcaaa

SEQ ID NO: 247244 - DNA, 25 bp, Mus musculus
gggctcaaagtcttccgcgcgtccg

SEQ ID NO: 247245 - DNA, 25 bp, Mus musculus
cgcgctccaagtcattccttactaa

SEQ ID NO: 247246 - DNA, 25 bp, Mus musculus
tactaacctttgactccgtgggcgc

SEQ ID NO: 247247 - DNA, 25 bp, Mus musculus
atctgagcgcaccaggttggcccgt

SEQ ID NO: 247248 - DNA, 25 bp, Mus musculus
actccgagtcgcctgcctggagatc

SEQ ID NO: 247249 - DNA, 25 bp, Mus musculus
ccggtgcgccttagtgctcccgggt

SEQ ID NO: 247250 - DNA, 25 bp, Mus musculus
cccagcggaagcctggaggtcgcac

SEQ ID NO: 247251 - DNA, 25 bp, Mus musculus
ttgggtctcccaagccctaagcgga

SEQ ID NO: 247252 - DNA, 25 bp, Mus musculus
tgcctggagatcagcgcatctgctc

SEQ ID NO: 247253 - DNA, 25 bp, Mus musculus
ccctactcagccgtgttgtgctggg

SEQ ID NO: 247254 - DNA, 25 bp, Mus musculus
agcccgctgcccgaaagtccgaagg

SEQ ID NO: 247255 - DNA, 25 bp, Mus musculus
cgccttaaaggcgaagttagcgtgt

SEQ ID NO: 247256 - DNA, 25 bp, Mus musculus
ggaatgacgtccaggagcgccaatg

SEQ ID NO: 247257 - DNA, 25 bp, Mus musculus
agccgggcttggacttgagccttag

SEQ ID NO: 247258 - DNA, 25 bp, Mus musculus
cccgagcctttagaacaagatgatg

SEQ ID NO: 247259 - DNA, 25 bp, Mus musculus
ggcgtctgcgttagagtccattgaa

SEQ ID NO: 247260 - DNA, 25 bp, Mus musculus
gcgacgatcatgagctggaggcacc

SEQ ID NO: 247261 - DNA, 25 bp, Mus musculus
agcagcctggctttgagtctggagc

SEQ ID NO: 247262 - DNA, 25 bp, Mus musculus
agcggccagtttgatgcctccaagg

SEQ ID NO: 247263 - DNA, 25 bp, Mus musculus
tgagaaagtcgttccggacccgctg

SEQ ID NO: 247264 - DNA, 25 bp, Mus musculus
cgcgctctaagcgactctaccgaga

SEQ ID NO: 247265 - DNA, 25 bp, Mus musculus
tctaccgagacctggtgagtctgca

SEQ ID NO: 247266 - DNA, 25 bp, Mus musculus
agaagctggcgatgctgccaccgca

SEQ ID NO: 247267 - DNA, 25 bp, Mus musculus
caggttcgttttcaactggcgccgc

SEQ ID NO: 247268 - DNA, 25 bp, Mus musculus
acggctccgagagtttaaatacagc

SEQ ID NO: 247269 - DNA, 25 bp, Mus musculus
tcgcccgcgagaccaaaacaagatg

SEQ ID NO: 247270 - DNA, 25 bp, Mus musculus
cccttctcaagcgagggtactgaga

SEQ ID NO: 247271 - DNA, 25 bp, Mus musculus
cgatcatctcctctccctgtttaat

SEQ ID NO: 247272 - DNA, 25 bp, Mus musculus
gccggcaccagaaagggctccttct

SEQ ID NO: 247273 - DNA, 25 bp, Mus musculus
ccgactcatctttgagcggcggcgg

SEQ ID NO: 247274 - DNA, 25 bp, Mus musculus
aggcagcctcttggtgcgattgcac

SEQ ID NO: 247275 - DNA, 25 bp, Mus musculus
ggcccgtgttctgtcccatcacgga

SEQ ID NO: 247276 - DNA, 25 bp, Mus musculus
gatatcctttgtctctgccgtgcga

SEQ ID NO: 247277 - DNA, 25 bp, Mus musculus
cgctgctaagtccaagccctactga

SEQ ID NO: 247278 - DNA, 25 bp, Mus musculus
aagccgaggaaccaactgcgcgtgc

SEQ ID NO: 247279 - DNA, 25 bp, Mus musculus
gacacccgacccttgttcctgagga

SEQ ID NO: 247280 - DNA, 25 bp, Mus musculus
cgcatcgggagtgcgaaccaactta

SEQ ID NO: 247281 - DNA, 25 bp, Mus musculus
agctggtgtgaaaaggtctccttga

SEQ ID NO: 247282 - DNA, 25 bp, Mus musculus
tctgtaagcagaaaggacgcgcgcc

SEQ ID NO: 247283 - DNA, 25 bp, Mus musculus
tgcgcagacgcagaagcaacttcca

SEQ ID NO: 247284 - DNA, 25 bp, Mus musculus
gcgccttctcctggtggcgggaaaa

SEQ ID NO: 247285 - DNA, 25 bp, Mus musculus
gttagctgcgcttcacctttaggtc

SEQ ID NO: 247286 - DNA, 25 bp, Mus musculus
cccagaaggtagttgtcttttatgc

SEQ ID NO: 247287 - DNA, 25 bp, Mus musculus
gtgactctcggtacctgttggctga

SEQ ID NO: 247288 - DNA, 25 bp, Mus musculus
tttctcttcggagccacagcggacc

SEQ ID NO: 247289 - DNA, 25 bp, Mus musculus
tccgggagagtagcgaagcgttact

SEQ ID NO: 247290 - DNA, 25 bp, Mus musculus
tgcctgggtgagatctctgctttta

SEQ ID NO: 247291 - DNA, 25 bp, Mus musculus
ctctgcttttaatggccgtcgcgga

SEQ ID NO: 247292 - DNA, 25 bp, Mus musculus
ctccgctgtggggttcagtatacat

SEQ ID NO: 247293 - DNA, 25 bp, Mus musculus
tcgttcttaagatggcgggctactc

SEQ ID NO: 247294 - DNA, 25 bp, Mus musculus
cctagggcacaaggtcctcgaagca

SEQ ID NO: 247295 - DNA, 25 bp, Mus musculus
ccgtcgcggagagaattggtaaaga

SEQ ID NO: 247296 - DNA, 25 bp, Mus musculus
cgcagcctccggtgaaacaggatac

SEQ ID NO: 247297 - DNA, 25 bp, Mus musculus
ttctggttcggggagttcctccatg

SEQ ID NO: 247298 - DNA, 25 bp, Mus musculus
ggtttagcgactgtggttctggttc

SEQ ID NO: 247299 - DNA, 25 bp, Mus musculus
ttggccaaaagatttcgagagggtg

SEQ ID NO: 247300 - DNA, 25 bp, Mus musculus
gggagcgttggccaaaagatttcga

SEQ ID NO: 247301 - DNA, 25 bp, Mus musculus
cgagtcccaggttagcctagcggtc

SEQ ID NO: 247302 - DNA, 25 bp, Mus musculus
gtcacggtgagcctgcgagtcccag

SEQ ID NO: 247303 - DNA, 25 bp, Mus musculus
ccaaagcggttctgagtcacggtga

SEQ ID NO: 247304 - DNA, 25 bp, Mus musculus
aggattccagactccaaagcggttc

SEQ ID NO: 247305 - DNA, 25 bp, Mus musculus
gttcagccgctgtgaggattccaga

SEQ ID NO: 247306 - DNA, 25 bp, Mus musculus
cttccggtggtgctgtcgttcagcc

SEQ ID NO: 247307 - DNA, 25 bp, Mus musculus
acaacgctcggattcctagaggggc

SEQ ID NO: 247308 - DNA, 25 bp, Mus musculus
cggggagttcctccatggtggttct

SEQ ID NO: 247309 - DNA, 25 bp, Mus musculus
tgaaacaggataccgacaacgctcg

SEQ ID NO: 247310 - DNA, 25 bp, Mus musculus
acacccgggatcacgctgcgcgcct

SEQ ID NO: 247311 - DNA, 25 bp, Mus musculus
cgcctgcagctagggttgcggagct

SEQ ID NO: 247312 - DNA, 25 bp, Mus musculus
ctgcaggaggaaggtgggcccagaa

SEQ ID NO: 247313 - DNA, 25 bp, Mus musculus
gcgacgctaggaattttaaacactg

SEQ ID NO: 247314 - DNA, 25 bp, Mus musculus
ctaggaattttaaacactggggctg

SEQ ID NO: 247315 - DNA, 25 bp, Mus musculus
gctggggacggtaagagacacaaaa

SEQ ID NO: 247316 - DNA, 25 bp, Mus musculus
ttgcggagctggacagcgactgcag

SEQ ID NO: 247317 - DNA, 25 bp, Mus musculus
aaagcagacccggagtcccattacg

SEQ ID NO: 247318 - DNA, 25 bp, Mus musculus
gcagacccggagtcccattacgcga

SEQ ID NO: 247319 - DNA, 25 bp, Mus musculus
caacttccacctcaccgcgagtccg

SEQ ID NO: 247320 - DNA, 25 bp, Mus musculus
gtagcgacgctaggaattttaaaca

SEQ ID NO: 247321 - DNA, 25 bp, Mus musculus
cccggagaccacaacttccacctca

SEQ ID NO: 247322 - DNA, 25 bp, Mus musculus
ggccgcggacgtgtgaacaccaacc

SEQ ID NO: 247323 - DNA, 25 bp, Mus musculus
ccattacgcgacacccgggatcacg

SEQ ID NO: 247324 - DNA, 25 bp, Mus musculus
ggaatctggcttctcggtctatgta

SEQ ID NO: 247325 - DNA, 25 bp, Mus musculus
ccgctcctctcttgactgggctgaa

SEQ ID NO: 247326 - DNA, 25 bp, Mus musculus
gacccgagggtctcaccatcgtagt

SEQ ID NO: 247327 - DNA, 25 bp, Mus musculus
gggactgaaacacacccggaatctg

SEQ ID NO: 247328 - DNA, 25 bp, Mus musculus
ttctgtttctgcaagcctcgggagc

SEQ ID NO: 247329 - DNA, 25 bp, Mus musculus
tgtggcattcagctcccgactgttt

SEQ ID NO: 247330 - DNA, 25 bp, Mus musculus
ccgactgtttgtagggtcgctcaga

SEQ ID NO: 247331 - DNA, 25 bp, Mus musculus
tgacactagccttccggacacgcga

SEQ ID NO: 247332 - DNA, 25 bp, Mus musculus
ccaaacttgggctggatttctctcg

SEQ ID NO: 247333 - DNA, 25 bp, Mus musculus
cccgctgcagagctctcaacttgga

SEQ ID NO: 247334 - DNA, 25 bp, Mus musculus
tggaggctcagctctcaacttcggg

SEQ ID NO: 247335 - DNA, 25 bp, Mus musculus
cctagctttcactgggcaaagtttc

SEQ ID NO: 247336 - DNA, 25 bp, Mus musculus
aaagtttcccgagcgctgccacgag

SEQ ID NO: 247337 - DNA, 25 bp, Mus musculus
gtagtctcaccgtagctcctgctag

SEQ ID NO: 247338 - DNA, 25 bp, Mus musculus
cgcgcggaaggacactgtttacaca

SEQ ID NO: 247339 - DNA, 25 bp, Mus musculus
ttcacctttttcgatcgcgtagtcc

SEQ ID NO: 247340 - DNA, 25 bp, Mus musculus
ctcaacaggtgcaggtagaagtttc

SEQ ID NO: 247341 - DNA, 25 bp, Mus musculus
tcggagtcacagatcccggctcact

SEQ ID NO: 247342 - DNA, 25 bp, Mus musculus
atccttgacgcccactgcttattgc

SEQ ID NO: 247343 - DNA, 25 bp, Mus musculus
ggactccactgggttctctccataa

SEQ ID NO: 247344 - DNA, 25 bp, Mus musculus
tcccttgggtcacgtattgaatgca

SEQ ID NO: 247345 - DNA, 25 bp, Mus musculus
gctggcccagtaacctagtcccttg

SEQ ID NO: 247346 - DNA, 25 bp, Mus musculus
cagtctccagtggacgcgggaattc

SEQ ID NO: 247347 - DNA, 25 bp, Mus musculus
cgggccgttgaaagattgccagatc

SEQ ID NO: 247348 - DNA, 25 bp, Mus musculus
gcgtagtccttaagcgccatcgctg

SEQ ID NO: 247349 - DNA, 25 bp, Mus musculus
gggcgcttagcctcccaattctagg

SEQ ID NO: 247350 - DNA, 25 bp, Mus musculus
gggctcaaaaatctctctctgggga

SEQ ID NO: 247351 - DNA, 25 bp, Mus musculus
gcgcgaaacgtcgtcacccatgtga

SEQ ID NO: 247352 - DNA, 25 bp, Mus musculus
cgatgtgttcgagcgacttggtgac

SEQ ID NO: 247353 - DNA, 25 bp, Mus musculus
aggccctgagcgaagacccagtagc

SEQ ID NO: 247354 - DNA, 25 bp, Mus musculus
gtggcggggtaaatctcccttgtca

SEQ ID NO: 247355 - DNA, 25 bp, Mus musculus
tcccttgtcatgaacggtccagtgc

SEQ ID NO: 247356 - DNA, 25 bp, Mus musculus
tgagatccctttgctggcgtccagc

SEQ ID NO: 247357 - DNA, 25 bp, Mus musculus
gctcctactccgtggtggttctgct

SEQ ID NO: 247358 - DNA, 25 bp, Mus musculus
tgatggcactgtgactctcgtcctg

SEQ ID NO: 247359 - DNA, 25 bp, Mus musculus
gcggctctaagactgccctggagga

SEQ ID NO: 247360 - DNA, 25 bp, Mus musculus
gcgctgctggaagccctggctacac

SEQ ID NO: 247361 - DNA, 25 bp, Mus musculus
acccacggacactcggatcatattg

SEQ ID NO: 247362 - DNA, 25 bp, Mus musculus
catattgggaacctggggctgtttc

SEQ ID NO: 247363 - DNA, 25 bp, Mus musculus
aggcagctttgttagtctcccatga

SEQ ID NO: 247364 - DNA, 25 bp, Mus musculus
ctgccttcccgagggtctctatctg

SEQ ID NO: 247365 - DNA, 25 bp, Mus musculus
tgtgtgaaacgcagcccttgatact

SEQ ID NO: 247366 - DNA, 25 bp, Mus musculus
gtgtgcacgcctgcggttccgcgtc

SEQ ID NO: 247367 - DNA, 25 bp, Mus musculus
cggcagactgcttacactgcaccta

SEQ ID NO: 247368 - DNA, 25 bp, Mus musculus
tacactgcacctacggctgcgatgg

SEQ ID NO: 247369 - DNA, 25 bp, Mus musculus
gaaactacctatccggcagactgct

SEQ ID NO: 247370 - DNA, 25 bp, Mus musculus
agcctggagccggaaactacctatc

SEQ ID NO: 247371 - DNA, 25 bp, Mus musculus
ggtgaaaccacctgacccgagcctg

SEQ ID NO: 247372 - DNA, 25 bp, Mus musculus
ctgggctacagtcagctggtgaaac

SEQ ID NO: 247373 - DNA, 25 bp, Mus musculus
tccaatcctcaagcgaagggctggg

SEQ ID NO: 247374 - DNA, 25 bp, Mus musculus
agtataatgacatacccgccatcca

SEQ ID NO: 247375 - DNA, 25 bp, Mus musculus
gctccgcagtggttgataaagtata

SEQ ID NO: 247376 - DNA, 25 bp, Mus musculus
atccacgaatgtgttcggaaagcgg

SEQ ID NO: 247377 - DNA, 25 bp, Mus musculus
ggggcggggaaatgcaaccaatcca

SEQ ID NO: 247378 - DNA, 25 bp, Mus musculus
tctcgcaggcaaatcctgaggggcg

SEQ ID NO: 247379 - DNA, 25 bp, Mus musculus
tccggacaactctcgcaggcaaatc

SEQ ID NO: 247380 - DNA, 25 bp, Mus musculus
ccttaccattctgtttgatctgcta

SEQ ID NO: 247381 - DNA, 25 bp, Mus musculus
ccagccagtgttgtgatttactaga

SEQ ID NO: 247382 - DNA, 25 bp, Mus musculus
gtggccgtaacctccagccagtgtt

SEQ ID NO: 247383 - DNA, 25 bp, Mus musculus
atggccgttctctcggtggccgtaa

SEQ ID NO: 247384 - DNA, 25 bp, Mus musculus
atgggtactgcgcatggccgttctc

SEQ ID NO: 247385 - DNA, 25 bp, Mus musculus
caacagcagtgatgggtactgcgca

SEQ ID NO: 247386 - DNA, 25 bp, Mus musculus
gctgcttccggattcaacagcagtg

SEQ ID NO: 247387 - DNA, 25 bp, Mus musculus
ggacagagctcagctccacactggg

SEQ ID NO: 247388 - DNA, 25 bp, Mus musculus
ctaaggccctatgggacagagctca

SEQ ID NO: 247389 - DNA, 25 bp, Mus musculus
gtgaacttcactaaggccctatggg

SEQ ID NO: 247390 - DNA, 25 bp, Mus musculus
taagcttctctctggagtgaacttc

SEQ ID NO: 247391 - DNA, 25 bp, Mus musculus
ctcatctaagcttctctctggagtg

SEQ ID NO: 247392 - DNA, 25 bp, Mus musculus
cattctctccaagaaaaagtcgtcc

SEQ ID NO: 247393 - DNA, 25 bp, Mus musculus
gtttgatctgctaaatttcctcaca

SEQ ID NO: 247394 - DNA, 25 bp, Mus musculus
tgagaagggggctgcaacctcgaaa

SEQ ID NO: 247395 - DNA, 25 bp, Mus musculus
ctgaatgactggagagaaagcggaa

SEQ ID NO: 247396 - DNA, 25 bp, Mus musculus
ggaacctagacccagcagcgccaga

SEQ ID NO: 247397 - DNA, 25 bp, Mus musculus
aggcagcgggacacaccagcctggc

SEQ ID NO: 247398 - DNA, 25 bp, Mus musculus
gtccagacaccggaggaccgcggct

SEQ ID NO: 247399 - DNA, 25 bp, Mus musculus
tcggcctgcgagtccagacaccgga

SEQ ID NO: 247400 - DNA, 25 bp, Mus musculus
agtcgcattgggactccattgggtg

SEQ ID NO: 247401 - DNA, 25 bp, Mus musculus
acatcgagtagtcgcattgggactc

SEQ ID NO: 247402 - DNA, 25 bp, Mus musculus
gcacagccggaaagtacatcgagta

SEQ ID NO: 247403 - DNA, 25 bp, Mus musculus
cggtagcggcacagccggaaagtac

SEQ ID NO: 247404 - DNA, 25 bp, Mus musculus
tgtctcccccaggtacagatggttg

SEQ ID NO: 247405 - DNA, 25 bp, Mus musculus
gcaccagcagaaagcggactgtctc

SEQ ID NO: 247406 - DNA, 25 bp, Mus musculus
gtcagcatcctggtcgccggcgctg

SEQ ID NO: 247407 - DNA, 25 bp, Mus musculus
ctccgaggcttcttggctgagtcga

SEQ ID NO: 247408 - DNA, 25 bp, Mus musculus
aacgtggttagcacgagctcgcgct

SEQ ID NO: 247409 - DNA, 25 bp, Mus musculus
cggtagcccgccaatgataagaaga

SEQ ID NO: 247410 - DNA, 25 bp, Mus musculus
gaccagttaatctcgcgcctgcgca

SEQ ID NO: 247411 - DNA, 25 bp, Mus musculus
cccagcaccgtagcaggaccaggag

SEQ ID NO: 247412 - DNA, 25 bp, Mus musculus
tctcagccgcgcgaagaccagttaa

SEQ ID NO: 247413 - DNA, 25 bp, Mus musculus
tgaagccaatgtggaacggcaactc

SEQ ID NO: 247414 - DNA, 25 bp, Mus musculus
gggtgaaactgagccaattgcaatt

SEQ ID NO: 247415 - DNA, 25 bp, Mus musculus
ttaaccgcccgccaccagaggaaga

SEQ ID NO: 247416 - DNA, 25 bp, Mus musculus
ggactgaaggcagcagcaaacgctc

SEQ ID NO: 247417 - DNA, 25 bp, Mus musculus
gccgcgggacgtctcgaagaaaaga

SEQ ID NO: 247418 - DNA, 25 bp, Mus musculus
cgctcagccaatggaaggggacata

SEQ ID NO: 247419 - DNA, 25 bp, Mus musculus
cgtgacaggactgcacagctacatg

SEQ ID NO: 247420 - DNA, 25 bp, Mus musculus
accaggaggcatctgcggagacaat

SEQ ID NO: 247421 - DNA, 25 bp, Mus musculus
aattgcaattgaagagccggactga

SEQ ID NO: 247422 - DNA, 25 bp, Mus musculus
cttggcatctgtggccgctttcttc

SEQ ID NO: 247423 - DNA, 25 bp, Mus musculus
gacaccgggactgcgggacttatga

SEQ ID NO: 247424 - DNA, 25 bp, Mus musculus
atggatgcctcctaggtggggacac

SEQ ID NO: 247425 - DNA, 25 bp, Mus musculus
cgcgtgattcccatgaccagggctg

SEQ ID NO: 247426 - DNA, 25 bp, Mus musculus
atggtgcgtttacccacgacaaggc

SEQ ID NO: 247427 - DNA, 25 bp, Mus musculus
cctgagtcccgaaatggtgcgttta

SEQ ID NO: 247428 - DNA, 25 bp, Mus musculus
gggcgctcacctgagtcccgaaatg

SEQ ID NO: 247429 - DNA, 25 bp, Mus musculus
tgtgactcgctggtacctggacacc

SEQ ID NO: 247430 - DNA, 25 bp, Mus musculus
ggccttgcgtacgttgttgctgacc

SEQ ID NO: 247431 - DNA, 25 bp, Mus musculus
gctctgtgttctggattgcacctag

SEQ ID NO: 247432 - DNA, 25 bp, Mus musculus
tgaccagggctgctatggatgcctc

SEQ ID NO: 247433 - DNA, 25 bp, Mus musculus
ggacttatgactgcccaagcgcggc

SEQ ID NO: 247434 - DNA, 25 bp, Mus musculus
ttgcacctagtgtctgtcgccgtgt

SEQ ID NO: 247435 - DNA, 25 bp, Mus musculus
gtcttgtcgcgtccgcgtgattccc

SEQ ID NO: 247436 - DNA, 25 bp, Mus musculus
cgcgccatcacctccggacaccacc

SEQ ID NO: 247437 - DNA, 25 bp, Mus musculus
ctgaagtcaccgcatccggagggac

SEQ ID NO: 247438 - DNA, 25 bp, Mus musculus
tcccagacaaaggaccggtgacagc

SEQ ID NO: 247439 - DNA, 25 bp, Mus musculus
ccgttccgcaacagcgcgcccagct

SEQ ID NO: 247440 - DNA, 25 bp, Mus musculus
aggaccggtgacagccaaagcccgc

SEQ ID NO: 247441 - DNA, 25 bp, Mus musculus
actcaccaagtccacttctgcgaga

SEQ ID NO: 247442 - DNA, 25 bp, Mus musculus
acttctgcgagacgctggtgtcctc

SEQ ID NO: 247443 - DNA, 25 bp, Mus musculus
ggtgtcctcccaccatcgtccagca

SEQ ID NO: 247444 - DNA, 25 bp, Mus musculus
tcgtccagcacccacagcgtcacta

SEQ ID NO: 247445 - DNA, 25 bp, Mus musculus
actacgccaacaaagctgcgcagga

SEQ ID NO: 247446 - DNA, 25 bp, Mus musculus
caggaggctcctgggcaggaacacc

SEQ ID NO: 247447 - DNA, 25 bp, Mus musculus
gcaggaacaccgagcccaagatggc

SEQ ID NO: 247448 - DNA, 25 bp, Mus musculus
atggcggctcccagacaaaggaccg

SEQ ID NO: 247449 - DNA, 25 bp, Mus musculus
accgcatccggagggacaggacgcc

SEQ ID NO: 247450 - DNA, 25 bp, Mus musculus
gagcttcagggacgcaggctaccag

SEQ ID NO: 247451 - DNA, 25 bp, Mus musculus
gcaccgcgctctggatcggatctgt

SEQ ID NO: 247452 - DNA, 25 bp, Mus musculus
gacgggatgaacagccgcgccttct

SEQ ID NO: 247453 - DNA, 25 bp, Mus musculus
cttctgcttacacgcccgctgagtg

SEQ ID NO: 247454 - DNA, 25 bp, Mus musculus
ggcggttgtccttcacgacgtccaa

SEQ ID NO: 247455 - DNA, 25 bp, Mus musculus
tgctagctgctagtacactgaatgg

SEQ ID NO: 247456 - DNA, 25 bp, Mus musculus
cactgaatggaccttgacccgcggg

SEQ ID NO: 247457 - DNA, 25 bp, Mus musculus
cctgcgcggccatgaagatgatact

SEQ ID NO: 247458 - DNA, 25 bp, Mus musculus
aagatgatactggtgcgcaggtttc

SEQ ID NO: 247459 - DNA, 25 bp, Mus musculus
tcgcgtgctcatcctggtagtattc

SEQ ID NO: 247460 - DNA, 25 bp, Mus musculus
cctgacagaacagaggagccgcttt

SEQ ID NO: 247461 - DNA, 25 bp, Mus musculus
tgacctgctacccaagctggaccga

SEQ ID NO: 247462 - DNA, 25 bp, Mus musculus
cttgcgctttgcacattgctgttga

SEQ ID NO: 247463 - DNA, 25 bp, Mus musculus
agtattcctactggcttgcgctttg

SEQ ID NO: 247464 - DNA, 25 bp, Mus musculus
ttcgagaacggcaacttccgtcggc

SEQ ID NO: 247465 - DNA, 25 bp, Mus musculus
gccctgcccggagtctggggacact

SEQ ID NO: 247466 - DNA, 25 bp, Mus musculus
caagggcaaaggcaactactggacg

SEQ ID NO: 247467 - DNA, 25 bp, Mus musculus
tgccacggaccgagggcaacgacaa

SEQ ID NO: 247468 - DNA, 25 bp, Mus musculus
gctgagcctcacactcccgtaggtg

SEQ ID NO: 247469 - DNA, 25 bp, Mus musculus
ggggacactcgctgagcctcacact

SEQ ID NO: 247470 - DNA, 25 bp, Mus musculus
ggcaccaaagttcctttctagcaga

SEQ ID NO: 247471 - DNA, 25 bp, Mus musculus
ccagtcatccctggtgaccggcaga

SEQ ID NO: 247472 - DNA, 25 bp, Mus musculus
gctcaacagctgcttcgtcaaggtg

SEQ ID NO: 247473 - DNA, 25 bp, Mus musculus
gcaagttcccttattaccgcgccaa

SEQ ID NO: 247474 - DNA, 25 bp, Mus musculus
accctatcaggcatctacgacttta

SEQ ID NO: 247475 - DNA, 25 bp, Mus musculus
cgggccgcgtaaccctatcaggcat

SEQ ID NO: 247476 - DNA, 25 bp, Mus musculus
cttccgtcggcgacgcaggagacgc

SEQ ID NO: 247477 - DNA, 25 bp, Mus musculus
tacgactttatcatgcgcaagttcc

SEQ ID NO: 247478 - DNA, 25 bp, Mus musculus
ttaaatttattcaggcagccagagc

SEQ ID NO: 247479 - DNA, 25 bp, Mus musculus
aaaactcgccatgcgcaaagccact

SEQ ID NO: 247480 - DNA, 25 bp, Mus musculus
gccacgtcacgtctgctcgcgaaaa

SEQ ID NO: 247481 - DNA, 25 bp, Mus musculus
ggctgccctgagcacggtcccttaa

SEQ ID NO: 247482 - DNA, 25 bp, Mus musculus
tcgcgtcgcacagagcaccgggctg

SEQ ID NO: 247483 - DNA, 25 bp, Mus musculus
gcctccgagcgactgggcgttacat

SEQ ID NO: 247484 - DNA, 25 bp, Mus musculus
cagccagagctgcagaaggagcgca

SEQ ID NO: 247485 - DNA, 25 bp, Mus musculus
cggcctcgcaaagccggtggcacta

SEQ ID NO: 247486 - DNA, 25 bp, Mus musculus
tcgcgtggaccggtcctgccgcaaa

SEQ ID NO: 247487 - DNA, 25 bp, Mus musculus
aagtgacatcagaggctcgcgtgga

SEQ ID NO: 247488 - DNA, 25 bp, Mus musculus
cacgccacgagcaagtgacatcaga

SEQ ID NO: 247489 - DNA, 25 bp, Mus musculus
aaagccactgcgctgcgtactccag

SEQ ID NO: 247490 - DNA, 25 bp, Mus musculus
tcgcgaaaatccgagcgaaggtgcc

SEQ ID NO: 247491 - DNA, 25 bp, Mus musculus
aggagcgcacggaggccgtctccca

SEQ ID NO: 247492 - DNA, 25 bp, Mus musculus
aattcagtaccatccctcagggagc

SEQ ID NO: 247493 - DNA, 25 bp, Mus musculus
tcctgtggcggcgaaattcagtacc

SEQ ID NO: 247494 - DNA, 25 bp, Mus musculus
caggggctgtggaaagtcattcatc

SEQ ID NO: 247495 - DNA, 25 bp, Mus musculus
tcacggcaaagctcccggggaatgg

SEQ ID NO: 247496 - DNA, 25 bp, Mus musculus
agctgcctcgttcagccacctgtaa

SEQ ID NO: 247497 - DNA, 25 bp, Mus musculus
gagactgctccagccctgcgtcgga

SEQ ID NO: 247498 - DNA, 25 bp, Mus musculus
cctcccagagcacggtcagtttaca

SEQ ID NO: 247499 - DNA, 25 bp, Mus musculus
gttactgcattgtccgctgcgtttg

SEQ ID NO: 247500 - DNA, 25 bp, Mus musculus
cggagcgacgcaacgcgctggaaac

SEQ ID NO: 247501 - DNA, 25 bp, Mus musculus
cgctggaaactcaccagacacactt

SEQ ID NO: 247502 - DNA, 25 bp, Mus musculus
cttgggcatggcagaaaatagaacc

SEQ ID NO: 247503 - DNA, 25 bp, Mus musculus
cagagcttgaaacaggtagccgaga

SEQ ID NO: 247504 - DNA, 25 bp, Mus musculus
agcagcaggcaagcccaggtcctca

SEQ ID NO: 247505 - DNA, 25 bp, Mus musculus
cgagcagcgagtgcaaagccagcga

SEQ ID NO: 247506 - DNA, 25 bp, Mus musculus
tcatagcgaccgcaacaacagcggc

SEQ ID NO: 247507 - DNA, 25 bp, Mus musculus
cagggacgcccagctggaaatcaaa

SEQ ID NO: 247508 - DNA, 25 bp, Mus musculus
tcaccgttttatcccgattgttctg

SEQ ID NO: 247509 - DNA, 25 bp, Mus musculus
gcagagagcaccaaaggacaccttt

SEQ ID NO: 247510 - DNA, 25 bp, Mus musculus
tccaggaagaagatccggttgcatt

SEQ ID NO: 247511 - DNA, 25 bp, Mus musculus
ctttactctcttggcgcagcaggga

SEQ ID NO: 247512 - DNA, 25 bp, Mus musculus
attctgaagacgctaggggacatca

SEQ ID NO: 247513 - DNA, 25 bp, Mus musculus
taggggacatcagggaccagaatga

SEQ ID NO: 247514 - DNA, 25 bp, Mus musculus
tgaggctaggcctggattcatcgcc

SEQ ID NO: 247515 - DNA, 25 bp, Mus musculus
gctctaatcgccgaccgctattaaa

SEQ ID NO: 247516 - DNA, 25 bp, Mus musculus
aaaccgcgacccgtcgtcatagcga

SEQ ID NO: 247517 - DNA, 25 bp, Mus musculus
taagagcttgtgcagcccggcgcca

SEQ ID NO: 247518 - DNA, 25 bp, Mus musculus
tgggcgcaggcactgctctaatcgc

SEQ ID NO: 247519 - DNA, 25 bp, Mus musculus
acctccgcatggaggctgcgggttc

SEQ ID NO: 247520 - DNA, 25 bp, Mus musculus
aaattgacacaatgcacgctttatc

SEQ ID NO: 247521 - DNA, 25 bp, Mus musculus
cgttcccagggcgattatgcagctc

SEQ ID NO: 247522 - DNA, 25 bp, Mus musculus
ttcccactgctaaaacgggtgcgta

SEQ ID NO: 247523 - DNA, 25 bp, Mus musculus
ggcagattgttcgttcccagggcga

SEQ ID NO: 247524 - DNA, 25 bp, Mus musculus
cacagaatgggcagattgttcgttc

SEQ ID NO: 247525 - DNA, 25 bp, Mus musculus
tgcatggaccttgcgcagcctacac

SEQ ID NO: 247526 - DNA, 25 bp, Mus musculus
gcacactatgcatggaccttgcgca

SEQ ID NO: 247527 - DNA, 25 bp, Mus musculus
ctgcacagtgtgcacactatgcatg

SEQ ID NO: 247528 - DNA, 25 bp, Mus musculus
aatgcacgctttatcccacagcgtc

SEQ ID NO: 247529 - DNA, 25 bp, Mus musculus
gcagctcggttactataaattgaca

SEQ ID NO: 247530 - DNA, 25 bp, Mus musculus
tcaatgagcgtaaagaaccgttccc

SEQ ID NO: 247531 - DNA, 25 bp, Mus musculus
cccacagcgtctcaatgagcgtaaa

SEQ ID NO: 247532 - DNA, 25 bp, Mus musculus
gggcgattatgcagctcggttacta

SEQ ID NO: 247533 - DNA, 25 bp, Mus musculus
gcgtggacaacgcgccctgcacagt

SEQ ID NO: 247534 - DNA, 25 bp, Mus musculus
gctgacacccagctccagatagggc

SEQ ID NO: 247535 - DNA, 25 bp, Mus musculus
ctgcgtacctgtagatgcgcggtgc

SEQ ID NO: 247536 - DNA, 25 bp, Mus musculus
gcctgcgtacctgtagatgcgcggt

SEQ ID NO: 247537 - DNA, 25 bp, Mus musculus
cagcctgcgtacctgtagatgcgcg

SEQ ID NO: 247538 - DNA, 25 bp, Mus musculus
cccagcctgcgtacctgtagatgcg

SEQ ID NO: 247539 - DNA, 25 bp, Mus musculus
gatagggccgggtccctacacagac

SEQ ID NO: 247540 - DNA, 25 bp, Mus musculus
agatagggccgggtccctacacaga

SEQ ID NO: 247541 - DNA, 25 bp, Mus musculus
ccaaatccctcgtgtccccgtgagt

SEQ ID NO: 247542 - DNA, 25 bp, Mus musculus
tgacacccagctccagatagggccg

SEQ ID NO: 247543 - DNA, 25 bp, Mus musculus
cgctgacacccagctccagataggg

SEQ ID NO: 247544 - DNA, 25 bp, Mus musculus
gtacctgtagatgcgcggtgcccga

SEQ ID NO: 247545 - DNA, 25 bp, Mus musculus
ccggaggaggctgcgcgaggacgcg

SEQ ID NO: 247546 - DNA, 25 bp, Mus musculus
gacacccagctccagatagggccgg

SEQ ID NO: 247547 - DNA, 25 bp, Mus musculus
gcgtacctgtagatgcgcggtgccc

SEQ ID NO: 247548 - DNA, 25 bp, Mus musculus
agctctcgctcttccctatcgtttg

SEQ ID NO: 247549 - DNA, 25 bp, Mus musculus
gctttgctgcctcacgctcaggatc

SEQ ID NO: 247550 - DNA, 25 bp, Mus musculus
ctcggttcaacgcacggctagctct

SEQ ID NO: 247551 - DNA, 25 bp, Mus musculus
gtggctagctccctcacgctcggtt

SEQ ID NO: 247552 - DNA, 25 bp, Mus musculus
ctgctccagttgttgtggtgggttc

SEQ ID NO: 247553 - DNA, 25 bp, Mus musculus
acgccgcggcgaagttttgacagct

SEQ ID NO: 247554 - DNA, 25 bp, Mus musculus
agctagcaggacacgcactcacaca

SEQ ID NO: 247555 - DNA, 25 bp, Mus musculus
gtcaccaggaaagacacatggatcc

SEQ ID NO: 247556 - DNA, 25 bp, Mus musculus
tccgacgacatcctagtcaccagga

SEQ ID NO: 247557 - DNA, 25 bp, Mus musculus
cccgaggtcttttgtctgcggctgc

SEQ ID NO: 247558 - DNA, 25 bp, Mus musculus
aagcgccatctttgcgaggccggcc

SEQ ID NO: 247559 - DNA, 25 bp, Mus musculus
ctctggaaaggggaagcgccatctt

SEQ ID NO: 247560 - DNA, 25 bp, Mus musculus
cgcgctcaacttacttctttctggc

SEQ ID NO: 247561 - DNA, 25 bp, Mus musculus
gcggcaacatggagctagcaggaca

SEQ ID NO: 247562 - DNA, 25 bp, Mus musculus
ccaggcagccggaagtcttgccgta

SEQ ID NO: 247563 - DNA, 25 bp, Mus musculus
tgccactccgggtgagcgtcctatc

SEQ ID NO: 247564 - DNA, 25 bp, Mus musculus
aggagctgcgtctcgccctcgtgca

SEQ ID NO: 247565 - DNA, 25 bp, Mus musculus
tgctgcggcttctaagcgatccggc

SEQ ID NO: 247566 - DNA, 25 bp, Mus musculus
taagccgcctgctaccggggctgga

SEQ ID NO: 247567 - DNA, 25 bp, Mus musculus
tgaagccgcggaactgacccgcgcg

SEQ ID NO: 247568 - DNA, 25 bp, Mus musculus
tcggaccatcgtactagcgccggtt

SEQ ID NO: 247569 - DNA, 25 bp, Mus musculus
ctaaggggcgcacactcagcctcga

SEQ ID NO: 247570 - DNA, 25 bp, Mus musculus
gccaattacacttgcttctcttagc

SEQ ID NO: 247571 - DNA, 25 bp, Mus musculus
agactcccggacctagccaattaca

SEQ ID NO: 247572 - DNA, 25 bp, Mus musculus
gcccttgccgagcttgctgtcttct

SEQ ID NO: 247573 - DNA, 25 bp, Mus musculus
tgccgtaaagcgtgctcggaccatc

SEQ ID NO: 247574 - DNA, 25 bp, Mus musculus
ggagacaggcaacgcgctcaagatg

SEQ ID NO: 247575 - DNA, 25 bp, Mus musculus
cgccggttcccttggagacaggcaa

SEQ ID NO: 247576 - DNA, 25 bp, Mus musculus
gcgtgcgcctctgcacagaatccta

SEQ ID NO: 247577 - DNA, 25 bp, Mus musculus
ccgctgtgtagagtgaagtgtagtc

SEQ ID NO: 247578 - DNA, 25 bp, Mus musculus
ccgatgcagtcagcccggcgaactt

SEQ ID NO: 247579 - DNA, 25 bp, Mus musculus
gcccgctggagcttttttggatgca

SEQ ID NO: 247580 - DNA, 25 bp, Mus musculus
acggtaccaaagctggcccgctgga

SEQ ID NO: 247581 - DNA, 25 bp, Mus musculus
agcccggcacgcaggacggtaccaa

SEQ ID NO: 247582 - DNA, 25 bp, Mus musculus
tatcccgtgttagttgccttcgccc

SEQ ID NO: 247583 - DNA, 25 bp, Mus musculus
gccaccagcttgttatcccgtgtta

SEQ ID NO: 247584 - DNA, 25 bp, Mus musculus
tcccttctggggcacaggtgttgta

SEQ ID NO: 247585 - DNA, 25 bp, Mus musculus
cctgagtccagttgtctcgtgtgcc

SEQ ID NO: 247586 - DNA, 25 bp, Mus musculus
agtgggaaccgccaactggccacga

SEQ ID NO: 247587 - DNA, 25 bp, Mus musculus
tcctctcgggtactagggactgtct

SEQ ID NO: 247588 - DNA, 25 bp, Mus musculus
gattgacggacgttcgcgtcgctcc

SEQ ID NO: 247589 - DNA, 25 bp, Mus musculus
aattctaacgccaccggagaggagc

SEQ ID NO: 247590 - DNA, 25 bp, Mus musculus
cgagacgccaaggtttcgcaaggct

SEQ ID NO: 247591 - DNA, 25 bp, Mus musculus
acctacccggggctccgcagtcagc

SEQ ID NO: 247592 - DNA, 25 bp, Mus musculus
acgcagtcctgtccacccggccgca

SEQ ID NO: 247593 - DNA, 25 bp, Mus musculus
ccaacccagccaggacccagcgcgt

SEQ ID NO: 247594 - DNA, 25 bp, Mus musculus
ccctgacgccggcaggtgcacccgg

SEQ ID NO: 247595 - DNA, 25 bp, Mus musculus
tgcgcctcaccactgccagtccctg

SEQ ID NO: 247596 - DNA, 25 bp, Mus musculus
cacggagcccgcgaggtgccctccg

SEQ ID NO: 247597 - DNA, 25 bp, Mus musculus
tcggcggcacaggtcgcacggagcc

SEQ ID NO: 247598 - DNA, 25 bp, Mus musculus
tgacagcgtgacacgcagcccggcg

SEQ ID NO: 247599 - DNA, 25 bp, Mus musculus
agacgccaaggtttcgcaaggctgg

SEQ ID NO: 247600 - DNA, 25 bp, Mus musculus
cgcagtcagcgcagcgcgtgttccc

SEQ ID NO: 247601 - DNA, 25 bp, Mus musculus
tgccagtccctgacgccggcaggtg

SEQ ID NO: 247602 - DNA, 25 bp, Mus musculus
cgggtgacagcgtgacacgcagccc

SEQ ID NO: 247603 - DNA, 25 bp, Mus musculus
gtgccctccggatgctgcgcctcac

SEQ ID NO: 247604 - DNA, 25 bp, Mus musculus
cccgaagttcattgcggtcgacatc

SEQ ID NO: 247605 - DNA, 25 bp, Mus musculus
atcccaggccgccatcagcctgtgc

SEQ ID NO: 247606 - DNA, 25 bp, Mus musculus
tgcggtcgacatcacggcgaaatcc

SEQ ID NO: 247607 - DNA, 25 bp, Mus musculus
cacggcgaaatccagagcggagagc

SEQ ID NO: 247608 - DNA, 25 bp, Mus musculus
cgacgcagggcagatggctgaacac

SEQ ID NO: 247609 - DNA, 25 bp, Mus musculus
gcttttggtcccgaagttcattgcg

SEQ ID NO: 247610 - DNA, 25 bp, Mus musculus
gatggctgaacaccgagcgggtcca

SEQ ID NO: 247611 - DNA, 25 bp, Mus musculus
gtccaggaagcgtcgagctagtcga

SEQ ID NO: 247612 - DNA, 25 bp, Mus musculus
cgtcgagctagtcgagcggacgact

SEQ ID NO: 247613 - DNA, 25 bp, Mus musculus
cccgagtccacccaggctccaccca

SEQ ID NO: 247614 - DNA, 25 bp, Mus musculus
tccagcgggaagctgcctttgtctg

SEQ ID NO: 247615 - DNA, 25 bp, Mus musculus
gcggctggaagcttttggtcccgaa

SEQ ID NO: 247616 - DNA, 25 bp, Mus musculus
aacaccgagcgggtccaggaagcgt

SEQ ID NO: 247617 - DNA, 25 bp, Mus musculus
tcaccgaagtggtccagcgggaagc

SEQ ID NO: 247618 - DNA, 25 bp, Mus musculus
acgacctcgcgtggctacagagcga

SEQ ID NO: 247619 - DNA, 25 bp, Mus musculus
ggaaccagatctagccggctggaca

SEQ ID NO: 247620 - DNA, 25 bp, Mus musculus
gactggggcggaaccagatctagcc

SEQ ID NO: 247621 - DNA, 25 bp, Mus musculus
cttcacagcagcgagtcgggactgg

SEQ ID NO: 247622 - DNA, 25 bp, Mus musculus
ccaggacgcttcacagcagcgagtc

SEQ ID NO: 247623 - DNA, 25 bp, Mus musculus
tgccgagacccaggacgcttcacag

SEQ ID NO: 247624 - DNA, 25 bp, Mus musculus
agttgttggcgcgaactgccgagac

SEQ ID NO: 247625 - DNA, 25 bp, Mus musculus
agggacacctggacgacctcgcgtg

SEQ ID NO: 247626 - DNA, 25 bp, Mus musculus
gctacagagcgaggccaccaccgat

SEQ ID NO: 247627 - DNA, 25 bp, Mus musculus
atctagccggctggacagtgacgca

SEQ ID NO: 247628 - DNA, 25 bp, Mus musculus
acctggacgacctcgcgtggctaca

SEQ ID NO: 247629 - DNA, 25 bp, Mus musculus
actgacctcgctcgtaggcagcggg

SEQ ID NO: 247630 - DNA, 25 bp, Mus musculus
acgcactgacctcgctcgtaggcag

SEQ ID NO: 247631 - DNA, 25 bp, Mus musculus
caccaccgatgcctcggggtcacct

SEQ ID NO: 247632 - DNA, 25 bp, Mus musculus
cgcttcccagtcagctgagtcggga

SEQ ID NO: 247633 - DNA, 25 bp, Mus musculus
gctgccgtcttttgttccggccgga

SEQ ID NO: 247634 - DNA, 25 bp, Mus musculus
acctcgccgtgtcccagtctggagt

SEQ ID NO: 247635 - DNA, 25 bp, Mus musculus
ccaccgctgccgaagggcaagagca

SEQ ID NO: 247636 - DNA, 25 bp, Mus musculus
gaagccaaacattctgccagccgta

SEQ ID NO: 247637 - DNA, 25 bp, Mus musculus
tgccagccgtattttccacctcttt

SEQ ID NO: 247638 - DNA, 25 bp, Mus musculus
ttcctcagattagttcgcaccctca

SEQ ID NO: 247639 - DNA, 25 bp, Mus musculus
ttgcaaacttagagcgccggcggca

SEQ ID NO: 247640 - DNA, 25 bp, Mus musculus
cgaggaactccctcctcttactatt

SEQ ID NO: 247641 - DNA, 25 bp, Mus musculus
ttgggaaaaatctcgtgtctgaatg

SEQ ID NO: 247642 - DNA, 25 bp, Mus musculus
tctgaatgtttacaagcaccgcgtg

SEQ ID NO: 247643 - DNA, 25 bp, Mus musculus
cgggagcctcctgccaacaaacaga

SEQ ID NO: 247644 - DNA, 25 bp, Mus musculus
caaacagacagaggacggagcgcgc

SEQ ID NO: 247645 - DNA, 25 bp, Mus musculus
ccctgcagaaattccacagtcttta

SEQ ID NO: 247646 - DNA, 25 bp, Mus musculus
ttggttaagagcgtcaggacatttg

SEQ ID NO: 247647 - DNA, 25 bp, Mus musculus
ccaaggggattgtccgttcggactg

SEQ ID NO: 247648 - DNA, 25 bp, Mus musculus
gcctgcgggaactaagcaccggttc

SEQ ID NO: 247649 - DNA, 25 bp, Mus musculus
acggggtcacgtgtgtacacagccc

SEQ ID NO: 247650 - DNA, 25 bp, Mus musculus
ccctaatgctctgttccaggcggga

SEQ ID NO: 247651 - DNA, 25 bp, Mus musculus
gccatcggccctgaacattcatcgg

SEQ ID NO: 247652 - DNA, 25 bp, Mus musculus
acagggagtgtggtcctgaacccgc

SEQ ID NO: 247653 - DNA, 25 bp, Mus musculus
gcggacgggctctcctaggacgcta

SEQ ID NO: 247654 - DNA, 25 bp, Mus musculus
ctcctaggacgctacggttaccatc

SEQ ID NO: 247655 - DNA, 25 bp, Mus musculus
tcccttctgttggttaagagcgtca

SEQ ID NO: 247656 - DNA, 25 bp, Mus musculus
tcaggacatttggaacccgtgcgta

SEQ ID NO: 247657 - DNA, 25 bp, Mus musculus
cccgtgcgtagagatagcggaactt

SEQ ID NO: 247658 - DNA, 25 bp, Mus musculus
atagcggaacttgcgccatcggccc

SEQ ID NO: 247659 - DNA, 25 bp, Mus musculus
gttaccatcttcgtcccttctgttg

SEQ ID NO: 247660 - DNA, 25 bp, Mus musculus
ctgcagtcacgtgtcttctagaatc

SEQ ID NO: 247661 - DNA, 25 bp, Mus musculus
tgccacgcacctacatggccagtgt

SEQ ID NO: 247662 - DNA, 25 bp, Mus musculus
cacgcacctacatggccagtgtgta

SEQ ID NO: 247663 - DNA, 25 bp, Mus musculus
ctacatggccagtgtgtacaacacc

SEQ ID NO: 247664 - DNA, 25 bp, Mus musculus
gtgtgtacaacacccggcacgtgtg

SEQ ID NO: 247665 - DNA, 25 bp, Mus musculus
gctcttctacatctgcagtcacgtg

SEQ ID NO: 247666 - DNA, 25 bp, Mus musculus
acgtgtcttctagaatcgctgagtg

SEQ ID NO: 247667 - DNA, 25 bp, Mus musculus
tctagaatcgctgagtgtgcccgga

SEQ ID NO: 247668 - DNA, 25 bp, Mus musculus
tgagtgtgcccggatgcagaacacg

SEQ ID NO: 247669 - DNA, 25 bp, Mus musculus
ccggatgcagaacacggaggcagcc

SEQ ID NO: 247670 - DNA, 25 bp, Mus musculus
cggaggcagccgatgctatccttgt

SEQ ID NO: 247671 - DNA, 25 bp, Mus musculus
gcagccgatgctatccttgtgctca

SEQ ID NO: 247672 - DNA, 25 bp, Mus musculus
gctatccttgtgctcatcggctacg

SEQ ID NO: 247673 - DNA, 25 bp, Mus musculus
cccggcacgtgtgtggcttcgtctg

SEQ ID NO: 247674 - DNA, 25 bp, Mus musculus
atctctctgagctgagagcgcagtc

SEQ ID NO: 247675 - DNA, 25 bp, Mus musculus
agctgcgcagagacgcacagcccgg

SEQ ID NO: 247676 - DNA, 25 bp, Mus musculus
cacagcccggcccaggaccgcgtct

SEQ ID NO: 247677 - DNA, 25 bp, Mus musculus
cgcacctgcagctcccactctcgca

SEQ ID NO: 247678 - DNA, 25 bp, Mus musculus
accagctcagcaggttccgcgccgt

SEQ ID NO: 247679 - DNA, 25 bp, Mus musculus
gccctcagaagatcagcgctatcca

SEQ ID NO: 247680 - DNA, 25 bp, Mus musculus
agatcagcgctatccattggatcgg

SEQ ID NO: 247681 - DNA, 25 bp, Mus musculus
ccattggatcgggaaggcgtccatc

SEQ ID NO: 247682 - DNA, 25 bp, Mus musculus
ggaaggcgtccatcttccagccagc

SEQ ID NO: 247683 - DNA, 25 bp, Mus musculus
agccctggcgcaggatattggcgtc

SEQ ID NO: 247684 - DNA, 25 bp, Mus musculus
ggatattggcgtcatctctctgagc

SEQ ID NO: 247685 - DNA, 25 bp, Mus musculus
agagcgcagtcagttgccagggcaa

SEQ ID NO: 247686 - DNA, 25 bp, Mus musculus
ttgccagggcaacacctggtggcgt

SEQ ID NO: 247687 - DNA, 25 bp, Mus musculus
gcgcaggatattggcgtcatctctc

SEQ ID NO: 247688 - DNA, 25 bp, Mus musculus
gccctttgtggttatcccggtgaca

SEQ ID NO: 247689 - DNA, 25 bp, Mus musculus
cggtacctggcactcacgggtagtc

SEQ ID NO: 247690 - DNA, 25 bp, Mus musculus
ccaaaatgtcatcgaaggccagcca

SEQ ID NO: 247691 - DNA, 25 bp, Mus musculus
acaagcggtgccctttgtggttatc

SEQ ID NO: 247692 - DNA, 25 bp, Mus musculus
ggccagccaattccttcgtgttatg

SEQ ID NO: 247693 - DNA, 25 bp, Mus musculus
ccggtgacaccgcagtagaaactgc

SEQ ID NO: 247694 - DNA, 25 bp, Mus musculus
gaaactgcagctccaatcgccgcga

SEQ ID NO: 247695 - DNA, 25 bp, Mus musculus
gcgaagcgcccgacttctctcaagg

SEQ ID NO: 247696 - DNA, 25 bp, Mus musculus
gcccgacttctctcaaggccggaaa

SEQ ID NO: 247697 - DNA, 25 bp, Mus musculus
tctcaaggccggaaagcgtagcatt

SEQ ID NO: 247698 - DNA, 25 bp, Mus musculus
cccagccgacagatccagagtcata

SEQ ID NO: 247699 - DNA, 25 bp, Mus musculus
agtcatacatcctgggcgttcccgg

SEQ ID NO: 247700 - DNA, 25 bp, Mus musculus
taacatctagagtcggcccgccagc

SEQ ID NO: 247701 - DNA, 25 bp, Mus musculus
cggagacagacaagcggtgcccttt

SEQ ID NO: 247702 - DNA, 25 bp, Mus musculus
caggtgcgaaacacaagcggagctc

SEQ ID NO: 247703 - DNA, 25 bp, Mus musculus
tctacaaggccgtcggagctcagtc

SEQ ID NO: 247704 - DNA, 25 bp, Mus musculus
ctcagtccgttgctttggaggctca

SEQ ID NO: 247705 - DNA, 25 bp, Mus musculus
tagcctcgaacccacggatcaaagc

SEQ ID NO: 247706 - DNA, 25 bp, Mus musculus
cgagcaggcgtcctgaatgcgagtc

SEQ ID NO: 247707 - DNA, 25 bp, Mus musculus
tgcgagtcgtgtacgtcttattatc

SEQ ID NO: 247708 - DNA, 25 bp, Mus musculus
cactcggctgtagaaaaagggattt

SEQ ID NO: 247709 - DNA, 25 bp, Mus musculus
gctgcttcccattgagctgtttgga

SEQ ID NO: 247710 - DNA, 25 bp, Mus musculus
gaccgctccagaaagccgcaattga

SEQ ID NO: 247711 - DNA, 25 bp, Mus musculus
gctccagttggagccaagtgactcc

SEQ ID NO: 247712 - DNA, 25 bp, Mus musculus
taggcctgggccctttgtctacaag

SEQ ID NO: 247713 - DNA, 25 bp, Mus musculus
cgcgcggactcactcaaggggtcaa

SEQ ID NO: 247714 - DNA, 25 bp, Mus musculus
aagccactgggcgattgaaatggtc

SEQ ID NO: 247715 - DNA, 25 bp, Mus musculus
gagggcctctgaagagctctcgaga

SEQ ID NO: 247716 - DNA, 25 bp, Mus musculus
tgtcacgcagcatcccgtgcgatta

SEQ ID NO: 247717 - DNA, 25 bp, Mus musculus
agtaatacaggttcggatccgcgcc

SEQ ID NO: 247718 - DNA, 25 bp, Mus musculus
actcggagctgacctcggtccaagg

SEQ ID NO: 247719 - DNA, 25 bp, Mus musculus
gagttacctgttctccactcggagc

SEQ ID NO: 247720 - DNA, 25 bp, Mus musculus
cgcacagcgcactacttgtcgcgga

SEQ ID NO: 247721 - DNA, 25 bp, Mus musculus
ggctgccgaaggtctcctagccttc

SEQ ID NO: 247722 - DNA, 25 bp, Mus musculus
tcgggacgaactaggtcacgcgctt

SEQ ID NO: 247723 - DNA, 25 bp, Mus musculus
tgacaacctgtcaagtccacttcgg

SEQ ID NO: 247724 - DNA, 25 bp, Mus musculus
gcctctgggacgaagccaatgactg

SEQ ID NO: 247725 - DNA, 25 bp, Mus musculus
gccaacccgaggaccagcaagactg

SEQ ID NO: 247726 - DNA, 25 bp, Mus musculus
cagctggaatccaccgcggaccata

SEQ ID NO: 247727 - DNA, 25 bp, Mus musculus
tcgctgctacattgagtttgggacc

SEQ ID NO: 247728 - DNA, 25 bp, Mus musculus
cagagcctcactgcttaggggacca

SEQ ID NO: 247729 - DNA, 25 bp, Mus musculus
cgtgcgattattcgcccagagcctc

SEQ ID NO: 247730 - DNA, 25 bp, Mus musculus
actacccggacgtgtttatgcgcga

SEQ ID NO: 247731 - DNA, 25 bp, Mus musculus
tgggccaccaccacgtgtacgagct

SEQ ID NO: 247732 - DNA, 25 bp, Mus musculus
tggccggcgaaagccagcccttcaa

SEQ ID NO: 247733 - DNA, 25 bp, Mus musculus
ccttcaagcttgcaggtaggctgga

SEQ ID NO: 247734 - DNA, 25 bp, Mus musculus
gtgcaccaggccgtcggagaatagc

SEQ ID NO: 247735 - DNA, 25 bp, Mus musculus
ggctgcaaacggagacgcacccgca

SEQ ID NO: 247736 - DNA, 25 bp, Mus musculus
ccgcggctaattatcgagagcttga

SEQ ID NO: 247737 - DNA, 25 bp, Mus musculus
cgttcaatgagagccactacccgga

SEQ ID NO: 247738 - DNA, 25 bp, Mus musculus
tggtcgagtcccgagttcaggtaaa

SEQ ID NO: 247739 - DNA, 25 bp, Mus musculus
ttcaggtaaagattggtgtcgccca

SEQ ID NO: 247740 - DNA, 25 bp, Mus musculus
tgtcgcccaaggagtccgagatccc

SEQ ID NO: 247741 - DNA, 25 bp, Mus musculus
ggcagggccacctttgttctaagtg

SEQ ID NO: 247742 - DNA, 25 bp, Mus musculus
tcccatctggaggtgagtaacttga

SEQ ID NO: 247743 - DNA, 25 bp, Mus musculus
gcaccaactttaccggctggcagct

SEQ ID NO: 247744 - DNA, 25 bp, Mus musculus
gcctgcctaaggctagcccgttcag

SEQ ID NO: 247745 - DNA, 25 bp, Mus musculus
gcagccctgaggttgttgcctctcc

SEQ ID NO: 247746 - DNA, 25 bp, Mus musculus
ccgcgcaggccagtttcgggacctt

SEQ ID NO: 247747 - DNA, 25 bp, Mus musculus
ggccctgaattggtgcccaaggacg

SEQ ID NO: 247748 - DNA, 25 bp, Mus musculus
tgggtttcctagtgccacaggcagc

SEQ ID NO: 247749 - DNA, 25 bp, Mus musculus
cctgattggcaagggccacttcttg

SEQ ID NO: 247750 - DNA, 25 bp, Mus musculus
ggagagcctgctgtccgactcgcca

SEQ ID NO: 247751 - DNA, 25 bp, Mus musculus
cggcggacaaggacacggtcccttg

SEQ ID NO: 247752 - DNA, 25 bp, Mus musculus
ttctacccgagccaaagaagcggcg

SEQ ID NO: 247753 - DNA, 25 bp, Mus musculus
gctcaagagtcagagccgccacctg

SEQ ID NO: 247754 - DNA, 25 bp, Mus musculus
cgcaaacacgagaagaaactgctca

SEQ ID NO: 247755 - DNA, 25 bp, Mus musculus
gagatcgctcgcaaggaactggaga

SEQ ID NO: 247756 - DNA, 25 bp, Mus musculus
cccatggacccagaggagatcgctc

SEQ ID NO: 247757 - DNA, 25 bp, Mus musculus
tgtgcacctcggaccctgattggca

SEQ ID NO: 247758 - DNA, 25 bp, Mus musculus
tcatgagctgcactctttgtcagcg

SEQ ID NO: 247759 - DNA, 25 bp, Mus musculus
tgtcgcctgtaataggacaggcgcc

SEQ ID NO: 247760 - DNA, 25 bp, Mus musculus
ttgatcatgtgtcgcctgtaatagg

SEQ ID NO: 247761 - DNA, 25 bp, Mus musculus
gcctattgatcatgtgtcgcctgta

SEQ ID NO: 247762 - DNA, 25 bp, Mus musculus
tgttgctgcgttatcagcctattga

SEQ ID NO: 247763 - DNA, 25 bp, Mus musculus
ctgtcgcttatattgatgttgctgc

SEQ ID NO: 247764 - DNA, 25 bp, Mus musculus
cctcattgttctgtcgcttatattg

SEQ ID NO: 247765 - DNA, 25 bp, Mus musculus
tgatatccctcattgttctgtcgct

SEQ ID NO: 247766 - DNA, 25 bp, Mus musculus
gatagatgcccaatgatatccctca

SEQ ID NO: 247767 - DNA, 25 bp, Mus musculus
agcgcgcttgtagcgggctatatta

SEQ ID NO: 247768 - DNA, 25 bp, Mus musculus
atcgtggggcggaattttcatgagc

SEQ ID NO: 247769 - DNA, 25 bp, Mus musculus
ggcggaattttcatgagctgcactc

SEQ ID NO: 247770 - DNA, 25 bp, Mus musculus
agcgggctatattaagatagatgcc

SEQ ID NO: 247771 - DNA, 25 bp, Mus musculus
tgcactctttgtcagcgcgcttgta

SEQ ID NO: 247772 - DNA, 25 bp, Mus musculus
gaaagtttgcagtgcttcccagagc

SEQ ID NO: 247773 - DNA, 25 bp, Mus musculus
gagcagtgagcaagcgctcacactg

SEQ ID NO: 247774 - DNA, 25 bp, Mus musculus
tcccggccttatcggaaagtttgca

SEQ ID NO: 247775 - DNA, 25 bp, Mus musculus
tgcggagcagtgagcaagcgctcac

SEQ ID NO: 247776 - DNA, 25 bp, Mus musculus
cgaactccacttggggctgtgcgga

SEQ ID NO: 247777 - DNA, 25 bp, Mus musculus
ctccgaactccacttggggctgtgc

SEQ ID NO: 247778 - DNA, 25 bp, Mus musculus
aagctccgaactccacttggggctg

SEQ ID NO: 247779 - DNA, 25 bp, Mus musculus
aggcctttgttcgcagcccggaggc

SEQ ID NO: 247780 - DNA, 25 bp, Mus musculus
cgtggttcggcctcttcccttggct

SEQ ID NO: 247781 - DNA, 25 bp, Mus musculus
cttggtcgttgagggccaagacccg

SEQ ID NO: 247782 - DNA, 25 bp, Mus musculus
gtctagcttggtcgttgagggccaa

SEQ ID NO: 247783 - DNA, 25 bp, Mus musculus
ggattagggcgcacatggacagcgg

SEQ ID NO: 247784 - DNA, 25 bp, Mus musculus
gacctgcggtggaccgccacctgcc

SEQ ID NO: 247785 - DNA, 25 bp, Mus musculus
agtttgcagtgcttcccagagcagc

SEQ ID NO: 247786 - DNA, 25 bp, Mus musculus
acacattgctgccaccagctcagcc

SEQ ID NO: 247787 - DNA, 25 bp, Mus musculus
cagccgcatcccagagcagaggcgg

SEQ ID NO: 247788 - DNA, 25 bp, Mus musculus
catcccagagcagaggcggctgcaa

SEQ ID NO: 247789 - DNA, 25 bp, Mus musculus
ctcttgcgcgcagctggtaagtacc

SEQ ID NO: 247790 - DNA, 25 bp, Mus musculus
atctcttgcgcgcagctggtaagta

SEQ ID NO: 247791 - DNA, 25 bp, Mus musculus
gcgccgcccgcatctcttgcgcgca

SEQ ID NO: 247792 - DNA, 25 bp, Mus musculus
aggcgccaccgtgagggacctggcc

SEQ ID NO: 247793 - DNA, 25 bp, Mus musculus
tcgcagctccgtgccgcagagaggc

SEQ ID NO: 247794 - DNA, 25 bp, Mus musculus
cgcatcccagagcagaggcggctgc

SEQ ID NO: 247795 - DNA, 25 bp, Mus musculus
cgtcgcagctccgtgccgcagagag

SEQ ID NO: 247796 - DNA, 25 bp, Mus musculus
ctgcaagctccagccgcgtcgcagc

SEQ ID NO: 247797 - DNA, 25 bp, Mus musculus
aggcggctgcaagctccagccgcgt

SEQ ID NO: 247798 - DNA, 25 bp, Mus musculus
tcccagagcagaggcggctgcaagc

SEQ ID NO: 247799 - DNA, 25 bp, Mus musculus
ttgcgcgcagctggtaagtaccggc

SEQ ID NO: 247800 - DNA, 25 bp, Mus musculus
atgaatttcaggacccgcgctcagg

SEQ ID NO: 247801 - DNA, 25 bp, Mus musculus
ccaacttcactttttgcgcggccta

SEQ ID NO: 247802 - DNA, 25 bp, Mus musculus
ttaataatgaataaccgcggtcgcc

SEQ ID NO: 247803 - DNA, 25 bp, Mus musculus
acaaccggccagttcagggatcctg

SEQ ID NO: 247804 - DNA, 25 bp, Mus musculus
ccacgtgcatgaggactcgggagct

SEQ ID NO: 247805 - DNA, 25 bp, Mus musculus
gtgtactccagggtcctttcaggga

SEQ ID NO: 247806 - DNA, 25 bp, Mus musculus
tgctctctcgagcttaggggcatgg

SEQ ID NO: 247807 - DNA, 25 bp, Mus musculus
tgcccttggcttctaggttcacttt

SEQ ID NO: 247808 - DNA, 25 bp, Mus musculus
cataccggacggcttggcaacccaa

SEQ ID NO: 247809 - DNA, 25 bp, Mus musculus
agccaagacttgatcaggttatcca

SEQ ID NO: 247810 - DNA, 25 bp, Mus musculus
attgcgggcgaaacacatttgcaca

SEQ ID NO: 247811 - DNA, 25 bp, Mus musculus
cgggctagcagcgtcattaataatg

SEQ ID NO: 247812 - DNA, 25 bp, Mus musculus
gcatggccgaacacagggatgttgc

SEQ ID NO: 247813 - DNA, 25 bp, Mus musculus
ctggaagcccgaaatcacaacaata

SEQ ID NO: 247814 - DNA, 25 bp, Mus musculus
cagctcctaaatttgcccgctcgga

SEQ ID NO: 247815 - DNA, 25 bp, Mus musculus
cctacctcagttacaataaatattt

SEQ ID NO: 247816 - DNA, 25 bp, Mus musculus
cgcagatttaattagcttcgcttcc

SEQ ID NO: 247817 - DNA, 25 bp, Mus musculus
cccggcccgcgcagatttaattagc

SEQ ID NO: 247818 - DNA, 25 bp, Mus musculus
tgcgcattaaacatcctctcgcgcg

SEQ ID NO: 247819 - DNA, 25 bp, Mus musculus
ccgctcggagtgttgaaaggaagaa

SEQ ID NO: 247820 - DNA, 25 bp, Mus musculus
atcaaggggctaatctttcaccgtc

SEQ ID NO: 247821 - DNA, 25 bp, Mus musculus
tcgcgcgcacaatcggcctctgtag

SEQ ID NO: 247822 - DNA, 25 bp, Mus musculus
cccaatggcctataaatcaaggggc

SEQ ID NO: 247823 - DNA, 25 bp, Mus musculus
gcaggctgacagctcctaaatttgc

SEQ ID NO: 247824 - DNA, 25 bp, Mus musculus
ggctaatctttcaccgtccgctggc

SEQ ID NO: 247825 - DNA, 25 bp, Mus musculus
ccgctggcctctctcggggcgtgat

SEQ ID NO: 247826 - DNA, 25 bp, Mus musculus
tggcctgccgactgccgcgaaatca

SEQ ID NO: 247827 - DNA, 25 bp, Mus musculus
cgcgaaatcaccgagcaggctgaca

SEQ ID NO: 247828 - DNA, 25 bp, Mus musculus
gtgatgctcacgtcccggtagccct

SEQ ID NO: 247829 - DNA, 25 bp, Mus musculus
cccaaggcaggcgtggcctcagttt

SEQ ID NO: 247830 - DNA, 25 bp, Mus musculus
tgcagcggcacatcagagcccgaca

SEQ ID NO: 247831 - DNA, 25 bp, Mus musculus
cccgacagaggggttaaagagcact

SEQ ID NO: 247832 - DNA, 25 bp, Mus musculus
taaagagcactcacataaggtcagg

SEQ ID NO: 247833 - DNA, 25 bp, Mus musculus
agaaggccaggccatcgcggaacga

SEQ ID NO: 247834 - DNA, 25 bp, Mus musculus
cggcaccattcttgcagggccttta

SEQ ID NO: 247835 - DNA, 25 bp, Mus musculus
gcagggcctttatggcggccatatg

SEQ ID NO: 247836 - DNA, 25 bp, Mus musculus
cctcttgggcccgagacgcgcagga

SEQ ID NO: 247837 - DNA, 25 bp, Mus musculus
catcgcggaacgaggtggtcatgtt

SEQ ID NO: 247838 - DNA, 25 bp, Mus musculus
tggaagaagagaacaccgggagacc

SEQ ID NO: 247839 - DNA, 25 bp, Mus musculus
tggtcatgttggtgatgctcacgtc

SEQ ID NO: 247840 - DNA, 25 bp, Mus musculus
tcggtgcaagatagcgcagaaggcc

SEQ ID NO: 247841 - DNA, 25 bp, Mus musculus
cctcagtttcccgtttgcagcggca

SEQ ID NO: 247842 - DNA, 25 bp, Mus musculus
ggcgctccggaagtgcaaactgatc

SEQ ID NO: 247843 - DNA, 25 bp, Mus musculus
tagaggaagcgccttcacctgggag

SEQ ID NO: 247844 - DNA, 25 bp, Mus musculus
tcgcaccggggccactggaccgagt

SEQ ID NO: 247845 - DNA, 25 bp, Mus musculus
cagggccgcctaccggggtcacaga

SEQ ID NO: 247846 - DNA, 25 bp, Mus musculus
acagaaaggggccaagtgcggcaca

SEQ ID NO: 247847 - DNA, 25 bp, Mus musculus
agtgcggcacacacgcggccgactg

SEQ ID NO: 247848 - DNA, 25 bp, Mus musculus
cgactgcggagacggatgtcaccgc

SEQ ID NO: 247849 - DNA, 25 bp, Mus musculus
tgtcaccgcagggagcggacttcac

SEQ ID NO: 247850 - DNA, 25 bp, Mus musculus
ggagcggacttcacctgggtgcaaa

SEQ ID NO: 247851 - DNA, 25 bp, Mus musculus
tgcagcactctgcagacccgagaca

SEQ ID NO: 247852 - DNA, 25 bp, Mus musculus
agacccgagacacgggcgctccgga

SEQ ID NO: 247853 - DNA, 25 bp, Mus musculus
cgagccttccgagcgctgatttctc

SEQ ID NO: 247854 - DNA, 25 bp, Mus musculus
tgggcttggctcgattcatcctccc

SEQ ID NO: 247855 - DNA, 25 bp, Mus musculus
ctgatttctcacataaccggaagta

SEQ ID NO: 247856 - DNA, 25 bp, Mus musculus
ggcgtgttaagagtgtgcatgttta

SEQ ID NO: 247857 - DNA, 25 bp, Mus musculus
ttcgccgagtcggaacgagaagtcc

SEQ ID NO: 247858 - DNA, 25 bp, Mus musculus
aacgagaagtccgaagcgcgcaggc

SEQ ID NO: 247859 - DNA, 25 bp, Mus musculus
cgcttgtgaagagtgcgtgtccgca

SEQ ID NO: 247860 - DNA, 25 bp, Mus musculus
ggaacccagagttcgtgcacctgcg

SEQ ID NO: 247861 - DNA, 25 bp, Mus musculus
tgccacgcgggacctagctcaaggc

SEQ ID NO: 247862 - DNA, 25 bp, Mus musculus
acctggccatttccgtcggcgtaga

SEQ ID NO: 247863 - DNA, 25 bp, Mus musculus
ggcctgagtaactggtgtcactttc

SEQ ID NO: 247864 - DNA, 25 bp, Mus musculus
tttctaatcagctgaccggccagcg

SEQ ID NO: 247865 - DNA, 25 bp, Mus musculus
gaccgtcttggccagcctatcgctt

SEQ ID NO: 247866 - DNA, 25 bp, Mus musculus
gcttccgtcactttcttcaggtgtg

SEQ ID NO: 247867 - DNA, 25 bp, Mus musculus
ggccaaggtcccatccaactctgaa

SEQ ID NO: 247868 - DNA, 25 bp, Mus musculus
cagggacttgttgttcttcgccgag

SEQ ID NO: 247869 - DNA, 25 bp, Mus musculus
caactctgaagtgcgaggttcccta

SEQ ID NO: 247870 - DNA, 25 bp, Mus musculus
agcgtgtgacacagaaagaggagct

SEQ ID NO: 247871 - DNA, 25 bp, Mus musculus
acagaccttcgctcgcaccgtggcc

SEQ ID NO: 247872 - DNA, 25 bp, Mus musculus
gctacgcggctagctgtcgcatcaa

SEQ ID NO: 247873 - DNA, 25 bp, Mus musculus
gtcgcatcaagcgtgtgacacagaa

SEQ ID NO: 247874 - DNA, 25 bp, Mus musculus
ctcaagaacagaggctacgcggcta

SEQ ID NO: 247875 - DNA, 25 bp, Mus musculus
aacggcagcgtgtggagctacagca

SEQ ID NO: 247876 - DNA, 25 bp, Mus musculus
ggcggcgcacactcaagaacagagg

SEQ ID NO: 247877 - DNA, 25 bp, Mus musculus
aagctggctcgagagaacagcagca

SEQ ID NO: 247878 - DNA, 25 bp, Mus musculus
cagcatgcggctggagctagatgcc

SEQ ID NO: 247879 - DNA, 25 bp, Mus musculus
agctagatgccctgcgctccaagta

SEQ ID NO: 247880 - DNA, 25 bp, Mus musculus
atgccctgcgctccaagtatgaggc

SEQ ID NO: 247881 - DNA, 25 bp, Mus musculus
cgctccaagtatgaggccctacaga

SEQ ID NO: 247882 - DNA, 25 bp, Mus musculus
atgaggccctacagaccttcgctcg

SEQ ID NO: 247883 - DNA, 25 bp, Mus musculus
gctagctgtcgcatcaagcgtgtga

SEQ ID NO: 247884 - DNA, 25 bp, Mus musculus
agcggtttcagggagcaactaagcc

SEQ ID NO: 247885 - DNA, 25 bp, Mus musculus
aaagggacagtgtgcctctccgagc

SEQ ID NO: 247886 - DNA, 25 bp, Mus musculus
agccgtccaggcttcgtgttaaagg

SEQ ID NO: 247887 - DNA, 25 bp, Mus musculus
ttccgtgctgcaaaggagccgtcca

SEQ ID NO: 247888 - DNA, 25 bp, Mus musculus
agggcctaaggttccgtgctgcaaa

SEQ ID NO: 247889 - DNA, 25 bp, Mus musculus
cctaaggtccgtaggccacggcagt

SEQ ID NO: 247890 - DNA, 25 bp, Mus musculus
ccagcaatggtttagcagaagtccc

SEQ ID NO: 247891 - DNA, 25 bp, Mus musculus
ccagcagcgccagaaagcggtttca

SEQ ID NO: 247892 - DNA, 25 bp, Mus musculus
actgacagcagttgggaccgaaacc

SEQ ID NO: 247893 - DNA, 25 bp, Mus musculus
gggatggctggatcactactgacag

SEQ ID NO: 247894 - DNA, 25 bp, Mus musculus
ttatcagggatgaggaaaacggccg

SEQ ID NO: 247895 - DNA, 25 bp, Mus musculus
gactagctgtcccacttccagatta

SEQ ID NO: 247896 - DNA, 25 bp, Mus musculus
gggcttttgtgagcgtctttgtccc

SEQ ID NO: 247897 - DNA, 25 bp, Mus musculus
tgtcccgccgcactgcttgcgatga

SEQ ID NO: 247898 - DNA, 25 bp, Mus musculus
aaggcgagccttcgatgtgggatta

SEQ ID NO: 247899 - DNA, 25 bp, Mus musculus
gccgaggatttaggcacagcgcgcc

SEQ ID NO: 247900 - DNA, 25 bp, Mus musculus
ccgggctagtgacgtcacctctgcg

SEQ ID NO: 247901 - DNA, 25 bp, Mus musculus
gaggccggaagtcagccgttacttc

SEQ ID NO: 247902 - DNA, 25 bp, Mus musculus
gaagtcagccgttacttccgcactc

SEQ ID NO: 247903 - DNA, 25 bp, Mus musculus
ctttgcgagcggcttgcgagtctct

SEQ ID NO: 247904 - DNA, 25 bp, Mus musculus
gcggcttgcgagtctctgctagaca

SEQ ID NO: 247905 - DNA, 25 bp, Mus musculus
tctctgctagacagggcgatgaatg

SEQ ID NO: 247906 - DNA, 25 bp, Mus musculus
cagggcgatgaatggctaaaggcca

SEQ ID NO: 247907 - DNA, 25 bp, Mus musculus
tgtggtctcgaaccagcccagagcc

SEQ ID NO: 247908 - DNA, 25 bp, Mus musculus
cattgcagaactgcccgagggaagg

SEQ ID NO: 247909 - DNA, 25 bp, Mus musculus
cgagccttcgatgtgggattacggc

SEQ ID NO: 247910 - DNA, 25 bp, Mus musculus
tcaggcggccgaggatttaggcaca

SEQ ID NO: 247911 - DNA, 25 bp, Mus musculus
tggctaaaggccattgcagaactgc

SEQ ID NO: 247912 - DNA, 25 bp, Mus musculus
agaagccgagggcatgcgcagtaaa

SEQ ID NO: 247913 - DNA, 25 bp, Mus musculus
cgcagtaaagctgcggcgccctctt

SEQ ID NO: 247914 - DNA, 25 bp, Mus musculus
gcggctctcacctctgtcccggatt

SEQ ID NO: 247915 - DNA, 25 bp, Mus musculus
tcccggattccgctctgcgaaagtc

SEQ ID NO: 247916 - DNA, 25 bp, Mus musculus
cgctctgcgaaagtcgctacacatc

SEQ ID NO: 247917 - DNA, 25 bp, Mus musculus
gcgaaagtcgctacacatcgcccgg

SEQ ID NO: 247918 - DNA, 25 bp, Mus musculus
gcccggccagctccgcgggttcaac

SEQ ID NO: 247919 - DNA, 25 bp, Mus musculus
gcgggttcaacctacccgccagcaa

SEQ ID NO: 247920 - DNA, 25 bp, Mus musculus
cagcaacgccatttagcaaaagcgc

SEQ ID NO: 247921 - DNA, 25 bp, Mus musculus
acgccatttagcaaaagcgcgaaag

SEQ ID NO: 247922 - DNA, 25 bp, Mus musculus
aaagcgcgaaagacgcagccagtca

SEQ ID NO: 247923 - DNA, 25 bp, Mus musculus
gcagccagtcaaagcaatgaccctg

SEQ ID NO: 247924 - DNA, 25 bp, Mus musculus
aagcaatgaccctgtgtgcgcgtgc

SEQ ID NO: 247925 - DNA, 25 bp, Mus musculus
gccctcttggtgacgccagtctcct

SEQ ID NO: 247926 - DNA, 25 bp, Mus musculus
ggtttcagatgcagcgcgtttagtc

SEQ ID NO: 247927 - DNA, 25 bp, Mus musculus
agaggccgatcctcaagcccggcgg

SEQ ID NO: 247928 - DNA, 25 bp, Mus musculus
gaaggatacgctctcgccggcttcc

SEQ ID NO: 247929 - DNA, 25 bp, Mus musculus
agcgcgtttagtctgaggctccagg

SEQ ID NO: 247930 - DNA, 25 bp, Mus musculus
cggtgatcgagccttcaaccctggg

SEQ ID NO: 247931 - DNA, 25 bp, Mus musculus
gcgtgctctgctagccggtgatcga

SEQ ID NO: 247932 - DNA, 25 bp, Mus musculus
ggctcttgacgcagtgagcgccgca

SEQ ID NO: 247933 - DNA, 25 bp, Mus musculus
acctgcctcgcgctcacaaaatgaa

SEQ ID NO: 247934 - DNA, 25 bp, Mus musculus
gcaacctatggacgtgcagcggccc

SEQ ID NO: 247935 - DNA, 25 bp, Mus musculus
cctcccggggcaacctatggacgtg

SEQ ID NO: 247936 - DNA, 25 bp, Mus musculus
gctcttagctcagtggcctgggacg

SEQ ID NO: 247937 - DNA, 25 bp, Mus musculus
atgacactcggggacttgggctcca

SEQ ID NO: 247938 - DNA, 25 bp, Mus musculus
tgggctccacggctcttagctcagt

SEQ ID NO: 247939 - DNA, 25 bp, Mus musculus
ctctgccgcagacgtggggtccaca

SEQ ID NO: 247940 - DNA, 25 bp, Mus musculus
ttcaatccgagagcgaacttagagc

SEQ ID NO: 247941 - DNA, 25 bp, Mus musculus
tgcgtggaaaccttcgtgcggtcca

SEQ ID NO: 247942 - DNA, 25 bp, Mus musculus
cttcagcctcgagtggagctgcgtg

SEQ ID NO: 247943 - DNA, 25 bp, Mus musculus
gccttagagtcactgccgcagcttc

SEQ ID NO: 247944 - DNA, 25 bp, Mus musculus
gggtcctgatgtcgccttagagtca

SEQ ID NO: 247945 - DNA, 25 bp, Mus musculus
ccacagaaccagtgactaggggtcc

SEQ ID NO: 247946 - DNA, 25 bp, Mus musculus
tccgagctggttcggtcccacagaa

SEQ ID NO: 247947 - DNA, 25 bp, Mus musculus
gcaacttggcggtagaggaatccga

SEQ ID NO: 247948 - DNA, 25 bp, Mus musculus
caaacccggagtggtgctgccggta

SEQ ID NO: 247949 - DNA, 25 bp, Mus musculus
ctggggcgacattgcgcctctctca

SEQ ID NO: 247950 - DNA, 25 bp, Mus musculus
aagctcaggatttctcgcggcgcag

SEQ ID NO: 247951 - DNA, 25 bp, Mus musculus
aacttagagcttgaaggacggcggc

SEQ ID NO: 247952 - DNA, 25 bp, Mus musculus
cgaagctggggaggaatttcaatcc

SEQ ID NO: 247953 - DNA, 25 bp, Mus musculus
gccggtcaggtaagcgtgaagctca

SEQ ID NO: 247954 - DNA, 25 bp, Mus musculus
tgcacgccaccatgagaacagctct

SEQ ID NO: 247955 - DNA, 25 bp, Mus musculus
cgcgatgcctaacacggagaacgtg

SEQ ID NO: 247956 - DNA, 25 bp, Mus musculus
actgttaatggtcgtggctgctccc

SEQ ID NO: 247957 - DNA, 25 bp, Mus musculus
gaccgcatagacgatggcactgtta

SEQ ID NO: 247958 - DNA, 25 bp, Mus musculus
tggccggtgagtcagaccgcataga

SEQ ID NO: 247959 - DNA, 25 bp, Mus musculus
cacttgtgatgaagactcggtggcc

SEQ ID NO: 247960 - DNA, 25 bp, Mus musculus
agcataagcgtagccacctggccga

SEQ ID NO: 247961 - DNA, 25 bp, Mus musculus
agctccatgcagcacttcagcgagg

SEQ ID NO: 247962 - DNA, 25 bp, Mus musculus
gcggcctccaggcagctcaaagatc

SEQ ID NO: 247963 - DNA, 25 bp, Mus musculus
tgcagggcatggtgctcagctccat

SEQ ID NO: 247964 - DNA, 25 bp, Mus musculus
caggtcctgggcgaaaagcataagc

SEQ ID NO: 247965 - DNA, 25 bp, Mus musculus
atcgccttttgcctcctcatcagag

SEQ ID NO: 247966 - DNA, 25 bp, Mus musculus
gaacgggagcttgcgcttctccaca

SEQ ID NO: 247967 - DNA, 25 bp, Mus musculus
cggagactccagacaatcgcctttt

SEQ ID NO: 247968 - DNA, 25 bp, Mus musculus
ccaagaacgagatcggctacatcga

SEQ ID NO: 247969 - DNA, 25 bp, Mus musculus
gtggacctgcggcttaacgagaacc

SEQ ID NO: 247970 - DNA, 25 bp, Mus musculus
ctcaccaagaacgagatcggctaca

SEQ ID NO: 247971 - DNA, 25 bp, Mus musculus
tcaacctcaccaagaacgagatcgg

SEQ ID NO: 247972 - DNA, 25 bp, Mus musculus
atacctcaacctcaccaagaacgag

SEQ ID NO: 247973 - DNA, 25 bp, Mus musculus
gcttcggaaacctcacatacctcaa

SEQ ID NO: 247974 - DNA, 25 bp, Mus musculus
tgagccgcttcggaaacctcacata

SEQ ID NO: 247975 - DNA, 25 bp, Mus musculus
gaaccgtatccgcagcgtgcagtac

SEQ ID NO: 247976 - DNA, 25 bp, Mus musculus
gtatccgcagcgtgcagtacgcctc

SEQ ID NO: 247977 - DNA, 25 bp, Mus musculus
acgagaaccgtatccgcagcgtgca

SEQ ID NO: 247978 - DNA, 25 bp, Mus musculus
cggcttaacgagaaccgtatccgca

SEQ ID NO: 247979 - DNA, 25 bp, Mus musculus
cctgcggcttaacgagaaccgtatc

SEQ ID NO: 247980 - DNA, 25 bp, Mus musculus
acgagatcggctacatcgaggacgg

SEQ ID NO: 247981 - DNA, 25 bp, Mus musculus
gcagcgtgcagtacgcctccctgag

SEQ ID NO: 247982 - DNA, 25 bp, Mus musculus
accacgccgctggtgatcctgacta

SEQ ID NO: 247983 - DNA, 25 bp, Mus musculus
tacaataacagcaaatcgttcaccg

SEQ ID NO: 247984 - DNA, 25 bp, Mus musculus
tggagcagtacaataacagcaaatc

SEQ ID NO: 247985 - DNA, 25 bp, Mus musculus
accgcatgtacacgctggagcagta

SEQ ID NO: 247986 - DNA, 25 bp, Mus musculus
accatcatggtgcagctgccgagcc

SEQ ID NO: 247987 - DNA, 25 bp, Mus musculus
gagatggcaccacgccgctggtgat

SEQ ID NO: 247988 - DNA, 25 bp, Mus musculus
tcaagcagctgacccaaaattcggc

SEQ ID NO: 247989 - DNA, 25 bp, Mus musculus
tgccgagcccgttcaaccgcatgta

SEQ ID NO: 247990 - DNA, 25 bp, Mus musculus
tccctccatgaaggtcaagcagctg

SEQ ID NO: 247991 - DNA, 25 bp, Mus musculus
agaggcccgtccctccatgaaggtc

SEQ ID NO: 247992 - DNA, 25 bp, Mus musculus
gctggtccctcagacagaggcccgt

SEQ ID NO: 247993 - DNA, 25 bp, Mus musculus
tgactacgctggtccctcagacaga

SEQ ID NO: 247994 - DNA, 25 bp, Mus musculus
ctggtgatcctgactacgctggtcc

SEQ ID NO: 247995 - DNA, 25 bp, Mus musculus
ccaaaattcggccaccatcatggtg

SEQ ID NO: 247996 - DNA, 25 bp, Mus musculus
tgaggccaccggcacacataaggcc

SEQ ID NO: 247997 - DNA, 25 bp, Mus musculus
gggctgaggccaccggcacacataa

SEQ ID NO: 247998 - DNA, 25 bp, Mus musculus
cctcactgtgacacccgcggccact

SEQ ID NO: 247999 - DNA, 25 bp, Mus musculus
agaccaagtacattgaaaaaagctc

SEQ ID NO: 248000 - DNA, 25 bp, Mus musculus
gaaaaaagctcacctgtgcccgaga

SEQ ID NO: 248001 - DNA, 25 bp, Mus musculus
tgtgcccgagaccatcctcactgtg

SEQ ID NO: 248002 - DNA, 25 bp, Mus musculus
cggaggccgacaagagtcgccagta

SEQ ID NO: 248003 - DNA, 25 bp, Mus musculus
tacggcgagcatcggcactcatacc

SEQ ID NO: 248004 - DNA, 25 bp, Mus musculus
tctcaccctgccgagccacctgccc

SEQ ID NO: 248005 - DNA, 25 bp, Mus musculus
acccactcacgagggcttgggtggc

SEQ ID NO: 248006 - DNA, 25 bp, Mus musculus
aaggcatccatcctggagcctctga

SEQ ID NO: 248007 - DNA, 25 bp, Mus musculus
tggagcctctgacccggccacgacc

SEQ ID NO: 248008 - DNA, 25 bp, Mus musculus
agcacttcatccagcggttctgcac

SEQ ID NO: 248009 - DNA, 25 bp, Mus musculus
acaagagtcgccagtacggcgagca

SEQ ID NO: 248010 - DNA, 25 bp, Mus musculus
cgcgacaggaccgactcagaatgca

SEQ ID NO: 248011 - DNA, 25 bp, Mus musculus
cctctccgccggtgtctatatatcg

SEQ ID NO: 248012 - DNA, 25 bp, Mus musculus
cggtgtctatatatcgcgagacttc

SEQ ID NO: 248013 - DNA, 25 bp, Mus musculus
gcgagatctgagaaaacggcccgta

SEQ ID NO: 248014 - DNA, 25 bp, Mus musculus
cggcccgtaaagaattaaatatgtg

SEQ ID NO: 248015 - DNA, 25 bp, Mus musculus
taaatatgtgctccacgggcgtagc

SEQ ID NO: 248016 - DNA, 25 bp, Mus musculus
cacgggcgtagcctgagaacaaacc

SEQ ID NO: 248017 - DNA, 25 bp, Mus musculus
gagaacaaaccgcagtcccgccagg

SEQ ID NO: 248018 - DNA, 25 bp, Mus musculus
ggtgcgccgtaatgtatggaatagc

SEQ ID NO: 248019 - DNA, 25 bp, Mus musculus
ccgtaatgtatggaatagcaccgcg

SEQ ID NO: 248020 - DNA, 25 bp, Mus musculus
cgggtcccttacctcagttgaggag

SEQ ID NO: 248021 - DNA, 25 bp, Mus musculus
gtcgatggcagcagacagctccctc

SEQ ID NO: 248022 - DNA, 25 bp, Mus musculus
tacctcagttgaggagcccggtgct

SEQ ID NO: 248023 - DNA, 25 bp, Mus musculus
ctcagaatgcatgcgtgtcgatggc

SEQ ID NO: 248024 - DNA, 25 bp, Mus musculus
ccttttagcgcaggcagacgccgta

SEQ ID NO: 248025 - DNA, 25 bp, Mus musculus
aagacgtccttttagcgcaggcaga

SEQ ID NO: 248026 - DNA, 25 bp, Mus musculus
gttcctgtatgcaaagacgtccttt

SEQ ID NO: 248027 - DNA, 25 bp, Mus musculus
tccactccgttcctgtatgcaaaga

SEQ ID NO: 248028 - DNA, 25 bp, Mus musculus
attcactgagctccctactactgtc

SEQ ID NO: 248029 - DNA, 25 bp, Mus musculus
agcgcaggcagacgccgtaactcac

SEQ ID NO: 248030 - DNA, 25 bp, Mus musculus
ctgtcatccactccgttcctgtatg

SEQ ID NO: 248031 - DNA, 25 bp, Mus musculus
cgtaactcactcacccggccattgc

SEQ ID NO: 248032 - DNA, 25 bp, Mus musculus
gccattgctgcttgctggtggtttc

SEQ ID NO: 248033 - DNA, 25 bp, Mus musculus
tgcttgctggtggtttcctcccgcc

SEQ ID NO: 248034 - DNA, 25 bp, Mus musculus
aagtcccgccctcgcttccaacgcg

SEQ ID NO: 248035 - DNA, 25 bp, Mus musculus
aaggtatggatggtcccgggcgaat

SEQ ID NO: 248036 - DNA, 25 bp, Mus musculus
tcccgggcgaatgagatctgggtgc

SEQ ID NO: 248037 - DNA, 25 bp, Mus musculus
tctgcaacacaattcactgagctcc

SEQ ID NO: 248038 - DNA, 25 bp, Mus musculus
catcgcgcggccagtcatgtgagcc

SEQ ID NO: 248039 - DNA, 25 bp, Mus musculus
agcagctgcagcgactgccggcgag

SEQ ID NO: 248040 - DNA, 25 bp, Mus musculus
tgccctacctgtcgccggcggatcc

SEQ ID NO: 248041 - DNA, 25 bp, Mus musculus
ttggctctccgcacagggccatcgg

SEQ ID NO: 248042 - DNA, 25 bp, Mus musculus
tgaagcacttggctctccgcacagg

SEQ ID NO: 248043 - DNA, 25 bp, Mus musculus
gcggccagtcatgtgagcccgctcg

SEQ ID NO: 248044 - DNA, 25 bp, Mus musculus
gaggctggccccaagaatgtccacc

SEQ ID NO: 248045 - DNA, 25 bp, Mus musculus
tggcactgacaggtggtccccgagt

SEQ ID NO: 248046 - DNA, 25 bp, Mus musculus
cccgagtgtgaagcacttggctctc

SEQ ID NO: 248047 - DNA, 25 bp, Mus musculus
cgtggccacgcccatgccaacctcg

SEQ ID NO: 248048 - DNA, 25 bp, Mus musculus
ttcagcagctctggtccaagactga

SEQ ID NO: 248049 - DNA, 25 bp, Mus musculus
ctggtccaagactgagtgctagcgc

SEQ ID NO: 248050 - DNA, 25 bp, Mus musculus
ctcgctaacggagggctgaagagca

SEQ ID NO: 248051 - DNA, 25 bp, Mus musculus
cgctcgcccacgtgacttcctcccg

SEQ ID NO: 248052 - DNA, 25 bp, Mus musculus
agccgctgcagtgaggatggccatt

SEQ ID NO: 248053 - DNA, 25 bp, Mus musculus
atggccattgagattaaagccgctc

SEQ ID NO: 248054 - DNA, 25 bp, Mus musculus
acgctggcccacgtgatcgcgctct

SEQ ID NO: 248055 - DNA, 25 bp, Mus musculus
cgcgcgtgaagaccgcagtcaccgg

SEQ ID NO: 248056 - DNA, 25 bp, Mus musculus
gcagtcaccggcagacagaatcaca

SEQ ID NO: 248057 - DNA, 25 bp, Mus musculus
agacagaatcacagtgactttcacg

SEQ ID NO: 248058 - DNA, 25 bp, Mus musculus
cagtgactttcacgtctggggccaa

SEQ ID NO: 248059 - DNA, 25 bp, Mus musculus
cacgtctggggccaacgctaaattg

SEQ ID NO: 248060 - DNA, 25 bp, Mus musculus
ctggggccaacgctaaattgcgagc

SEQ ID NO: 248061 - DNA, 25 bp, Mus musculus
taaagccgctcatcacacgactctg

SEQ ID NO: 248062 - DNA, 25 bp, Mus musculus
cgctaaattgcgagccgctgcagtg

SEQ ID NO: 248063 - DNA, 25 bp, Mus musculus
cgctcatcacacgactctgcattgt

SEQ ID NO: 248064 - DNA, 25 bp, Mus musculus
attgtgcgggcagtcattcttgtgt

SEQ ID NO: 248065 - DNA, 25 bp, Mus musculus
cgactctgcattgtgcgggcagtca

SEQ ID NO: 248066 - DNA, 25 bp, Mus musculus
atttcgtagacgacgtgagcgagga

SEQ ID NO: 248067 - DNA, 25 bp, Mus musculus
cccgaggatttcgtagacgacgtga

SEQ ID NO: 248068 - DNA, 25 bp, Mus musculus
ggcagatgagccctccttcagcgac

SEQ ID NO: 248069 - DNA, 25 bp, Mus musculus
cggagaggcagatgagccctccttc

SEQ ID NO: 248070 - DNA, 25 bp, Mus musculus
cccgtcgcaggagccctctgctccc

SEQ ID NO: 248071 - DNA, 25 bp, Mus musculus
tccgaagaggaaacggcgacgagtc

SEQ ID NO: 248072 - DNA, 25 bp, Mus musculus
tgagggccaagccggcggcccaatc

SEQ ID NO: 248073 - DNA, 25 bp, Mus musculus
gaccggagcccgaagtgagggccaa

SEQ ID NO: 248074 - DNA, 25 bp, Mus musculus
cgccgaagaagacgccgaggccgga

SEQ ID NO: 248075 - DNA, 25 bp, Mus musculus
ggcagacggaagacgccgaagaaga

SEQ ID NO: 248076 - DNA, 25 bp, Mus musculus
ccatgcaggacgctgagaacgtggc

SEQ ID NO: 248077 - DNA, 25 bp, Mus musculus
cgggcccatgcaggacgctgagaac

SEQ ID NO: 248078 - DNA, 25 bp, Mus musculus
gcccaatccgaagaggaaacggcga

SEQ ID NO: 248079 - DNA, 25 bp, Mus musculus
cagggcgcgaggtctcccggttaca

SEQ ID NO: 248080 - DNA, 25 bp, Mus musculus
actcacgcttcgctgggcgtcctgg

SEQ ID NO: 248081 - DNA, 25 bp, Mus musculus
cccgattggccaactgtagagtgac

SEQ ID NO: 248082 - DNA, 25 bp, Mus musculus
cttggcactgggcacccaggggcac

SEQ ID NO: 248083 - DNA, 25 bp, Mus musculus
tcgctgcctccctgcgtggttgact

SEQ ID NO: 248084 - DNA, 25 bp, Mus musculus
ttgactgcggcaccgggtaagagcc

SEQ ID NO: 248085 - DNA, 25 bp, Mus musculus
gctgggcgtcctggagccatttccc

SEQ ID NO: 248086 - DNA, 25 bp, Mus musculus
ggccaactgtagagtgacgtcacga

SEQ ID NO: 248087 - DNA, 25 bp, Mus musculus
gcaccttggcactgggcacccaggg

SEQ ID NO: 248088 - DNA, 25 bp, Mus musculus
attggccaactgtagagtgacgtca

SEQ ID NO: 248089 - DNA, 25 bp, Mus musculus
tctgggctcccggcagctcctgggt

SEQ ID NO: 248090 - DNA, 25 bp, Mus musculus
gtgacgtcacgaggcagagcctctg

SEQ ID NO: 248091 - DNA, 25 bp, Mus musculus
tagagtgacgtcacgaggcagagcc

SEQ ID NO: 248092 - DNA, 25 bp, Mus musculus
tgcgacccggcaccttggcactggg

SEQ ID NO: 248093 - DNA, 25 bp, Mus musculus
ctccctgcgtggttgactgcggcac

SEQ ID NO: 248094 - DNA, 25 bp, Mus musculus
aggaggcgatttcggctgcagaatc

SEQ ID NO: 248095 - DNA, 25 bp, Mus musculus
cgatttcggctgcagaatcagcatc

SEQ ID NO: 248096 - DNA, 25 bp, Mus musculus
tttcggctgcagaatcagcatcacc

SEQ ID NO: 248097 - DNA, 25 bp, Mus musculus
ggctgcagaatcagcatcaccagca

SEQ ID NO: 248098 - DNA, 25 bp, Mus musculus
aggagcgcaggctcgagcagagcga

SEQ ID NO: 248099 - DNA, 25 bp, Mus musculus
cagaacgggcgtagtcccgctcgtt

SEQ ID NO: 248100 - DNA, 25 bp, Mus musculus
cgtaggagtcccgagtcctagggtg

SEQ ID NO: 248101 - DNA, 25 bp, Mus musculus
cagaatcagcatcaccagcaacagc

SEQ ID NO: 248102 - DNA, 25 bp, Mus musculus
gcgcatccagaacgggcgtagtccc

SEQ ID NO: 248103 - DNA, 25 bp, Mus musculus
cgcaagcgcatccagaacgggcgta

SEQ ID NO: 248104 - DNA, 25 bp, Mus musculus
agtgcgcaagcgcatccagaacggg

SEQ ID NO: 248105 - DNA, 25 bp, Mus musculus
caggaacggggagaagtgcgcaagc

SEQ ID NO: 248106 - DNA, 25 bp, Mus musculus
tagtcccgctcgttagctctcgcga

SEQ ID NO: 248107 - DNA, 25 bp, Mus musculus
cccgctcgttagctctcgcgagagg

SEQ ID NO: 248108 - DNA, 25 bp, Mus musculus
cgtacagcggcgctcagcgggctcc

SEQ ID NO: 248109 - DNA, 25 bp, Mus musculus
ccgcgtcacttaccggccagggcgc

SEQ ID NO: 248110 - DNA, 25 bp, Mus musculus
gctcgctccgccatgattgctttgt

SEQ ID NO: 248111 - DNA, 25 bp, Mus musculus
catgattgctttgtttcgctaattg

SEQ ID NO: 248112 - DNA, 25 bp, Mus musculus
tgctttgtttcgctaattgaacccg

SEQ ID NO: 248113 - DNA, 25 bp, Mus musculus
ttcgctaattgaacccgcgctcgtc

SEQ ID NO: 248114 - DNA, 25 bp, Mus musculus
ctcgctcgcgccgatttgtctgtct

SEQ ID NO: 248115 - DNA, 25 bp, Mus musculus
gcgccgatttgtctgtctttccctc

SEQ ID NO: 248116 - DNA, 25 bp, Mus musculus
tgtctttccctctcggtctgttcgg

SEQ ID NO: 248117 - DNA, 25 bp, Mus musculus
tttccctctcggtctgttcggctct

SEQ ID NO: 248118 - DNA, 25 bp, Mus musculus
ctgttcggctctgctgcggctagct

SEQ ID NO: 248119 - DNA, 25 bp, Mus musculus
gcggctagctgtggaaggcgaagtt

SEQ ID NO: 248120 - DNA, 25 bp, Mus musculus
ggtgcaggcaccctgcgcgtacagc

SEQ ID NO: 248121 - DNA, 25 bp, Mus musculus
ccggtgtgctcgctccgccatgatt

SEQ ID NO: 248122 - DNA, 25 bp, Mus musculus
gcacctcaccttcaacaagttctgg

SEQ ID NO: 248123 - DNA, 25 bp, Mus musculus
caccaactggaagcgagtgatgatc

SEQ ID NO: 248124 - DNA, 25 bp, Mus musculus
gccacggggtcatctactgctacgt

SEQ ID NO: 248125 - DNA, 25 bp, Mus musculus
ttctggcgccgctacggaaagttct

SEQ ID NO: 248126 - DNA, 25 bp, Mus musculus
aagttctcccgtcacctaatgaagg

SEQ ID NO: 248127 - DNA, 25 bp, Mus musculus
gctgaagaagtacaccaagttcctg

SEQ ID NO: 248128 - DNA, 25 bp, Mus musculus
tcagccttccgcagcaagttcgagc

SEQ ID NO: 248129 - DNA, 25 bp, Mus musculus
cgagctggagaacgaagagttttac

SEQ ID NO: 248130 - DNA, 25 bp, Mus musculus
ggctcaaggtctccttcgccaactt

SEQ ID NO: 248131 - DNA, 25 bp, Mus musculus
cctggacccacacacggagaagctg

SEQ ID NO: 248132 - DNA, 25 bp, Mus musculus
agaagctggcgcctttcaacgagca

SEQ ID NO: 248133 - DNA, 25 bp, Mus musculus
tcaacgagcactggcgacaggtgta

SEQ ID NO: 248134 - DNA, 25 bp, Mus musculus
tgccacccgtgccagatagactatg

SEQ ID NO: 248135 - DNA, 25 bp, Mus musculus
cccgcctcggtgagtgaggctttca

SEQ ID NO: 248136 - DNA, 25 bp, Mus musculus
agaaatgatactccggtctaaaata

SEQ ID NO: 248137 - DNA, 25 bp, Mus musculus
gctcggaccctgctcccactccagg

SEQ ID NO: 248138 - DNA, 25 bp, Mus musculus
ctcccggaagatgcagcaggctcgg

SEQ ID NO: 248139 - DNA, 25 bp, Mus musculus
ctgcgctcccggaagatgcagcagg

SEQ ID NO: 248140 - DNA, 25 bp, Mus musculus
ctgaagccaaccagacccaggggca

SEQ ID NO: 248141 - DNA, 25 bp, Mus musculus
gggacgcggaaactgaagccaacca

SEQ ID NO: 248142 - DNA, 25 bp, Mus musculus
tgggctcagacttcctttgaagggg

SEQ ID NO: 248143 - DNA, 25 bp, Mus musculus
agggtgggctcagacttcctttgaa

SEQ ID NO: 248144 - DNA, 25 bp, Mus musculus
acagcagtttatccgtggtggcagg

SEQ ID NO: 248145 - DNA, 25 bp, Mus musculus
gaacagcagtttatccgtggtggca

SEQ ID NO: 248146 - DNA, 25 bp, Mus musculus
agtcggcgacagaaggaacagcagt

SEQ ID NO: 248147 - DNA, 25 bp, Mus musculus
taaacgctagggagtcggcgacaga

SEQ ID NO: 248148 - DNA, 25 bp, Mus musculus
ctccggtctaaaatataaacgctag

SEQ ID NO: 248149 - DNA, 25 bp, Mus musculus
cactccaggggacccttggccattt

SEQ ID NO: 248150 - DNA, 25 bp, Mus musculus
tagcagccaattagcgcgtggaggc

SEQ ID NO: 248151 - DNA, 25 bp, Mus musculus
agacctggatctcgcgccacaagga

SEQ ID NO: 248152 - DNA, 25 bp, Mus musculus
gcgcggctcgatctgctgttcgaga

SEQ ID NO: 248153 - DNA, 25 bp, Mus musculus
ccagaaagtttcaccgcgcgcggct

SEQ ID NO: 248154 - DNA, 25 bp, Mus musculus
cgccgtcaagaccaccagaaagttt

SEQ ID NO: 248155 - DNA, 25 bp, Mus musculus
cgcgacgtcttcatcgccgtcaaga

SEQ ID NO: 248156 - DNA, 25 bp, Mus musculus
ctcctctggaggagctccggcttca

SEQ ID NO: 248157 - DNA, 25 bp, Mus musculus
tttaagagttcctgaagcgagaggc

SEQ ID NO: 248158 - DNA, 25 bp, Mus musculus
ccacaaggagatggtgagacccagc

SEQ ID NO: 248159 - DNA, 25 bp, Mus musculus
ggagagatctccctaaaggttacgc

SEQ ID NO: 248160 - DNA, 25 bp, Mus musculus
ccttgtccgtatcccacgtgggaag

SEQ ID NO: 248161 - DNA, 25 bp, Mus musculus
gcgaggtgcatagcctctccgagta

SEQ ID NO: 248162 - DNA, 25 bp, Mus musculus
ccagttggcactgggatagatatta

SEQ ID NO: 248163 - DNA, 25 bp, Mus musculus
gatagatattacgtgcggccgccgg

SEQ ID NO: 248164 - DNA, 25 bp, Mus musculus
tcgggccggaattggctgctggtgg

SEQ ID NO: 248165 - DNA, 25 bp, Mus musculus
tgctcagctgccctcatcgtgcccg

SEQ ID NO: 248166 - DNA, 25 bp, Mus musculus
ccctgctcagctgccctcatcgtgc

SEQ ID NO: 248167 - DNA, 25 bp, Mus musculus
agggacccgccgacccctgctcagc

SEQ ID NO: 248168 - DNA, 25 bp, Mus musculus
ctcgctgccggatgcacggggctca

SEQ ID NO: 248169 - DNA, 25 bp, Mus musculus
gcgccgcgtagctgaccccggccat

SEQ ID NO: 248170 - DNA, 25 bp, Mus musculus
gccggtgcaggaggctcacccacca

SEQ ID NO: 248171 - DNA, 25 bp, Mus musculus
gcagccggtgcaggaggctcaccca

SEQ ID NO: 248172 - DNA, 25 bp, Mus musculus
tcccaccgcaggtcgaagtgcggca

SEQ ID NO: 248173 - DNA, 25 bp, Mus musculus
cacctgctggtagtcggcgtcctcg

SEQ ID NO: 248174 - DNA, 25 bp, Mus musculus
gtcacctgctggtagtcggcgtcct

SEQ ID NO: 248175 - DNA, 25 bp, Mus musculus
cgcgtcacctgctggtagtcggcgt

SEQ ID NO: 248176 - DNA, 25 bp, Mus musculus
cgcgcgtcacctgctggtagtcggc

SEQ ID NO: 248177 - DNA, 25 bp, Mus musculus
caccgcaggtcgaagtgcggcagcc

SEQ ID NO: 248178 - DNA, 25 bp, Mus musculus
gaatcttgtgcacgcgcaaagtgtg

SEQ ID NO: 248179 - DNA, 25 bp, Mus musculus
cgagcaaggggcctaccaagcactc

SEQ ID NO: 248180 - DNA, 25 bp, Mus musculus
gcaacacttacgagaggagcttatc

SEQ ID NO: 248181 - DNA, 25 bp, Mus musculus
ccggagcccgacgaatcttgtgcac

SEQ ID NO: 248182 - DNA, 25 bp, Mus musculus
ccggatgtggtccttcctccggagc

SEQ ID NO: 248183 - DNA, 25 bp, Mus musculus
tgcccaggctcatagcggcagcgct

SEQ ID NO: 248184 - DNA, 25 bp, Mus musculus
tccgaggctatatctgtggtgccca

SEQ ID NO: 248185 - DNA, 25 bp, Mus musculus
cttgtgcggtaataatcggcctgcc

SEQ ID NO: 248186 - DNA, 25 bp, Mus musculus
taccaagcactctcccggggttgca

SEQ ID NO: 248187 - DNA, 25 bp, Mus musculus
cccggagatggctcttgtgcggtaa

SEQ ID NO: 248188 - DNA, 25 bp, Mus musculus
gcttcctggaagtagtggcctccgc

SEQ ID NO: 248189 - DNA, 25 bp, Mus musculus
aggagcttatcgtcggccggctgca

SEQ ID NO: 248190 - DNA, 25 bp, Mus musculus
gagaccacagcctacagcaacactt

SEQ ID NO: 248191 - DNA, 25 bp, Mus musculus
aggctccttaccgtctccgaggcta

SEQ ID NO: 248192 - DNA, 25 bp, Mus musculus
cacacagctggagcgcgtttacagg

SEQ ID NO: 248193 - DNA, 25 bp, Mus musculus
ctaactcgcagtcgccgagagcgca

SEQ ID NO: 248194 - DNA, 25 bp, Mus musculus
gcctaattcccgtagcggagggatg

SEQ ID NO: 248195 - DNA, 25 bp, Mus musculus
gtgcattttgcactctcgggcctaa

SEQ ID NO: 248196 - DNA, 25 bp, Mus musculus
ttagacaccggaacctcagcgggcg

SEQ ID NO: 248197 - DNA, 25 bp, Mus musculus
ttgcgtgaagcgaactctgagatgg

SEQ ID NO: 248198 - DNA, 25 bp, Mus musculus
ctatagcaacgtggagaggaacttc

SEQ ID NO: 248199 - DNA, 25 bp, Mus musculus
gacggaaacccgagcaacactgagg

SEQ ID NO: 248200 - DNA, 25 bp, Mus musculus
cggccaggcagtctaatggtgcatt

SEQ ID NO: 248201 - DNA, 25 bp, Mus musculus
acggcagggtcatcactggtctcca

SEQ ID NO: 248202 - DNA, 25 bp, Mus musculus
ctgcgtgggcacgtaccatagaacg

SEQ ID NO: 248203 - DNA, 25 bp, Mus musculus
agagcgcacctcttacccggatttg

SEQ ID NO: 248204 - DNA, 25 bp, Mus musculus
gtccgtcacgtggtacagacttagg

SEQ ID NO: 248205 - DNA, 25 bp, Mus musculus
cctcggccagcgtaaagcggaattt

SEQ ID NO: 248206 - DNA, 25 bp, Mus musculus
ctttccacccgatcccgcttcagtc

SEQ ID NO: 248207 - DNA, 25 bp, Mus musculus
ttcagtccctgcctcgcgtgctgac

SEQ ID NO: 248208 - DNA, 25 bp, Mus musculus
tgctgacgtcacaccaggaccggtt

SEQ ID NO: 248209 - DNA, 25 bp, Mus musculus
gtgccacgagaccacgggatgtgct

SEQ ID NO: 248210 - DNA, 25 bp, Mus musculus
gtgacccgcacaccaagcttctctg

SEQ ID NO: 248211 - DNA, 25 bp, Mus musculus
tgacgtcacaccaggaccggtttgg

SEQ ID NO: 248212 - DNA, 25 bp, Mus musculus
taggggccgcgtggaaagcaaccac

SEQ ID NO: 248213 - DNA, 25 bp, Mus musculus
ccgcgtggaaagcaaccacaggcgc

SEQ ID NO: 248214 - DNA, 25 bp, Mus musculus
aaagcaaccacaggcgcggggagct

SEQ ID NO: 248215 - DNA, 25 bp, Mus musculus
ttctagccagcgcaagccaggggga

SEQ ID NO: 248216 - DNA, 25 bp, Mus musculus
ctcctgtgccacgagaccacgggat

SEQ ID NO: 248217 - DNA, 25 bp, Mus musculus
gccacgagaccacgggatgtgctcg

SEQ ID NO: 248218 - DNA, 25 bp, Mus musculus
aagcttctctggggcagttccggag

SEQ ID NO: 248219 - DNA, 25 bp, Mus musculus
ggcgtgctcctgtgccacgagacca

SEQ ID NO: 248220 - DNA, 25 bp, Mus musculus
actcccggccgtggatgatgcgcat

SEQ ID NO: 248221 - DNA, 25 bp, Mus musculus
gccgctccctcaggctgcgtccgcc

SEQ ID NO: 248222 - DNA, 25 bp, Mus musculus
cgcgcgccacctggaccaggtgtgt

SEQ ID NO: 248223 - DNA, 25 bp, Mus musculus
gaggccctcactcgccgggccggct

SEQ ID NO: 248224 - DNA, 25 bp, Mus musculus
agcagcggctaagggtccgcaccac

SEQ ID NO: 248225 - DNA, 25 bp, Mus musculus
agcaagcagcggctaagggtccgca

SEQ ID NO: 248226 - DNA, 25 bp, Mus musculus
ccagcagcgcgtcgatgtcgcggct

SEQ ID NO: 248227 - DNA, 25 bp, Mus musculus
ttctggtcgaactcccggccgtgga

SEQ ID NO: 248228 - DNA, 25 bp, Mus musculus
tcgaagatggtgtcgcggaactcca

SEQ ID NO: 248229 - DNA, 25 bp, Mus musculus
caccttaaggatgttgtcgaagatg

SEQ ID NO: 248230 - DNA, 25 bp, Mus musculus
cgcgcgtcaccttaaggatgttgtc

SEQ ID NO: 248231 - DNA, 25 bp, Mus musculus
agcaggatcttgaccagccgccgca

SEQ ID NO: 248232 - DNA, 25 bp, Mus musculus
atggtgtcgcggaactccagcagcg

SEQ ID NO: 248233 - DNA, 25 bp, Mus musculus
ggccgcgcgtcaccttaaggatgtt

SEQ ID NO: 248234 - DNA, 25 bp, Mus musculus
atgcaaccgtcggtgcgcatgtgcg

SEQ ID NO: 248235 - DNA, 25 bp, Mus musculus
cttcccagaagagtcgccggcactg

SEQ ID NO: 248236 - DNA, 25 bp, Mus musculus
gctgagcttgcacgccgttttctga

SEQ ID NO: 248237 - DNA, 25 bp, Mus musculus
ctgcgcatgcgcgtatgcaaccgtc

SEQ ID NO: 248238 - DNA, 25 bp, Mus musculus
acagtggtccgcgatcacaagcgtg

SEQ ID NO: 248239 - DNA, 25 bp, Mus musculus
gaatccagcgatccgcggtttcgct

SEQ ID NO: 248240 - DNA, 25 bp, Mus musculus
gctcccaccgggagttctgtttata

SEQ ID NO: 248241 - DNA, 25 bp, Mus musculus
tgtttataaacacaccgcgcgaccg

SEQ ID NO: 248242 - DNA, 25 bp, Mus musculus
ccctaagtcagtgaggtcggaggtc

SEQ ID NO: 248243 - DNA, 25 bp, Mus musculus
cgcagacggagagaacggcttccgc

SEQ ID NO: 248244 - DNA, 25 bp, Mus musculus
gatggctgcctggacgaccctacca

SEQ ID NO: 248245 - DNA, 25 bp, Mus musculus
tccgcgcatgctcggagggacgcat

SEQ ID NO: 248246 - DNA, 25 bp, Mus musculus
acgcatcaggcgtcttccggtgtcc

SEQ ID NO: 248247 - DNA, 25 bp, Mus musculus
cgccggcactgcgtaaggacgcact

SEQ ID NO: 248248 - DNA, 25 bp, Mus musculus
cagtggtcgcgcgtttgctggagcc

SEQ ID NO: 248249 - DNA, 25 bp, Mus musculus
accatggccgctcacatgctggcag

SEQ ID NO: 248250 - DNA, 25 bp, Mus musculus
agaccaacctcgtgttggacaagaa

SEQ ID NO: 248251 - DNA, 25 bp, Mus musculus
accaacctcgtgttggacaagaagt

SEQ ID NO: 248252 - DNA, 25 bp, Mus musculus
ccaacctcgtgttggacaagaagtg

SEQ ID NO: 248253 - DNA, 25 bp, Mus musculus
caacctcgtgttggacaagaagtgt

SEQ ID NO: 248254 - DNA, 25 bp, Mus musculus
aacctcgtgttggacaagaagtgtg

SEQ ID NO: 248255 - DNA, 25 bp, Mus musculus
cctcgtgttggacaagaagtgtggc

SEQ ID NO: 248256 - DNA, 25 bp, Mus musculus
ctcgtgttggacaagaagtgtggcc

SEQ ID NO: 248257 - DNA, 25 bp, Mus musculus
tcgtgttggacaagaagtgtggcca

SEQ ID NO: 248258 - DNA, 25 bp, Mus musculus
gaccatggccgctcacatgctggca

SEQ ID NO: 248259 - DNA, 25 bp, Mus musculus
gctgatccaggtgcctgggagagca

SEQ ID NO: 248260 - DNA, 25 bp, Mus musculus
gacaagaagtgtggccagtggcggc

SEQ ID NO: 248261 - DNA, 25 bp, Mus musculus
ttggacaagaagtgtggccagtggc

SEQ ID NO: 248262 - DNA, 25 bp, Mus musculus
ctcagaaccgggagaaaactgtgta

SEQ ID NO: 248263 - DNA, 25 bp, Mus musculus
ggccattcctgtgcgccatggacga

SEQ ID NO: 248264 - DNA, 25 bp, Mus musculus
tgcgccatggacgaagcagaagcaa

SEQ ID NO: 248265 - DNA, 25 bp, Mus musculus
gcagaagcaagcctgttgcgccatt

SEQ ID NO: 248266 - DNA, 25 bp, Mus musculus
cgctgctacttcctcagaaccggga

SEQ ID NO: 248267 - DNA, 25 bp, Mus musculus
gttgcgccatttcccgctgctactt

SEQ ID NO: 248268 - DNA, 25 bp, Mus musculus
tagcgccgatactctgcgcatgcgc

SEQ ID NO: 248269 - DNA, 25 bp, Mus musculus
gcctggagaagtagcgccgatactc

SEQ ID NO: 248270 - DNA, 25 bp, Mus musculus
tggcaaagcctgaccgcggcgtctc

SEQ ID NO: 248271 - DNA, 25 bp, Mus musculus
gcctgtcactcgtggcaaagcctga

SEQ ID NO: 248272 - DNA, 25 bp, Mus musculus
ttctgtcgcgcgagagcctgtcact

SEQ ID NO: 248273 - DNA, 25 bp, Mus musculus
ctcaggtaccctgaggggtcgttct

SEQ ID NO: 248274 - DNA, 25 bp, Mus musculus
cgtccctttgcagactgcgcatgtg

SEQ ID NO: 248275 - DNA, 25 bp, Mus musculus
agggattcatttcggctcaggtacc

SEQ ID NO: 248276 - DNA, 25 bp, Mus musculus
cttggagccgtgtcggcatgttctc

SEQ ID NO: 248277 - DNA, 25 bp, Mus musculus
atggccctcccacgtggtgtggcac

SEQ ID NO: 248278 - DNA, 25 bp, Mus musculus
agtccgcggcaacgtttcgggcact

SEQ ID NO: 248279 - DNA, 25 bp, Mus musculus
gtgtggcaccggaagccgtcagcta

SEQ ID NO: 248280 - DNA, 25 bp, Mus musculus
agccgtcagctagcgctccagattc

SEQ ID NO: 248281 - DNA, 25 bp, Mus musculus
tagcgctccagattctcccacgtga

SEQ ID NO: 248282 - DNA, 25 bp, Mus musculus
gattctcccacgtgatccagccagg

SEQ ID NO: 248283 - DNA, 25 bp, Mus musculus
agagggcagacacagtccggtcaca

SEQ ID NO: 248284 - DNA, 25 bp, Mus musculus
cagtccggtcacatgacacgtcatg

SEQ ID NO: 248285 - DNA, 25 bp, Mus musculus
tcatgtgacacgatcccggaagtcc

SEQ ID NO: 248286 - DNA, 25 bp, Mus musculus
cgctgcacggttcgggtctccgtgt

SEQ ID NO: 248287 - DNA, 25 bp, Mus musculus
tgcaccaggccaggtctgccgatct

SEQ ID NO: 248288 - DNA, 25 bp, Mus musculus
cggaagctggtctgtcttttgcgcg

SEQ ID NO: 248289 - DNA, 25 bp, Mus musculus
cgggcgcggaaagtctgctgcacca

SEQ ID NO: 248290 - DNA, 25 bp, Mus musculus
tggtatccctccgggccaacatggc

SEQ ID NO: 248291 - DNA, 25 bp, Mus musculus
ttgttgtgctccttgggtggtcacc

SEQ ID NO: 248292 - DNA, 25 bp, Mus musculus
ggtggtcaccgcaaatggcatcatc

SEQ ID NO: 248293 - DNA, 25 bp, Mus musculus
aatggcatcatctctagctcccgcg

SEQ ID NO: 248294 - DNA, 25 bp, Mus musculus
gcctctgctcggctcatgatccgaa

SEQ ID NO: 248295 - DNA, 25 bp, Mus musculus
ctcggctcatgatccgaaggcgcga

SEQ ID NO: 248296 - DNA, 25 bp, Mus musculus
gctcctcagcggtcgcgttccagaa

SEQ ID NO: 248297 - DNA, 25 bp, Mus musculus
ttccagaaccgacggcacacgcacg

SEQ ID NO: 248298 - DNA, 25 bp, Mus musculus
cgctctcacgagattggaggaaatt

SEQ ID NO: 248299 - DNA, 25 bp, Mus musculus
tggaggaaattctcgcgctagaagg

SEQ ID NO: 248300 - DNA, 25 bp, Mus musculus
attctcgcgctagaaggcttccgga

SEQ ID NO: 248301 - DNA, 25 bp, Mus musculus
aggcttccggaagagctccatcccg

SEQ ID NO: 248302 - DNA, 25 bp, Mus musculus
acgatatgccgaactgcttcggggc

SEQ ID NO: 248303 - DNA, 25 bp, Mus musculus
tcagcggtcgcgttccagaaccgac

SEQ ID NO: 248304 - DNA, 25 bp, Mus musculus
aactgaggcctggaaaggtcccttg

SEQ ID NO: 248305 - DNA, 25 bp, Mus musculus
cctggaagtccacggggccacgcaa

SEQ ID NO: 248306 - DNA, 25 bp, Mus musculus
tttccatggcaaccgagcaagcctg

SEQ ID NO: 248307 - DNA, 25 bp, Mus musculus
tcgggcgagacgaacagaaacttga

SEQ ID NO: 248308 - DNA, 25 bp, Mus musculus
cgcccaatgggcagagacggagcct

SEQ ID NO: 248309 - DNA, 25 bp, Mus musculus
gttgttccaggttagattgcacctc

SEQ ID NO: 248310 - DNA, 25 bp, Mus musculus
tcacatgtattagggcgggcctggc

SEQ ID NO: 248311 - DNA, 25 bp, Mus musculus
cccaaagtcgagtcgtggtatctca

SEQ ID NO: 248312 - DNA, 25 bp, Mus musculus
aaagataggctgtgcgctagcgccc

SEQ ID NO: 248313 - DNA, 25 bp, Mus musculus
acttgacacctcagcgcccaatggg

SEQ ID NO: 248314 - DNA, 25 bp, Mus musculus
attgcacctccaaagcactaccagg

SEQ ID NO: 248315 - DNA, 25 bp, Mus musculus
cctggccgaccgagaaagataggct

SEQ ID NO: 248316 - DNA, 25 bp, Mus musculus
ccttgagctctttcgggttgttcca

SEQ ID NO: 248317 - DNA, 25 bp, Mus musculus
ccacgagtgacggaacccggattgc

SEQ ID NO: 248318 - DNA, 25 bp, Mus musculus
gcggtgcgccaaagttcctagaaca

SEQ ID NO: 248319 - DNA, 25 bp, Mus musculus
cgactcaggaccaacgaggtaactc

SEQ ID NO: 248320 - DNA, 25 bp, Mus musculus
ggtaactcgccgttctcagacagca

SEQ ID NO: 248321 - DNA, 25 bp, Mus musculus
acctttatgcatgcgcagtcgaccg

SEQ ID NO: 248322 - DNA, 25 bp, Mus musculus
attctcttcgagcaacgcggtgcgc

SEQ ID NO: 248323 - DNA, 25 bp, Mus musculus
agtcgaccggaaacacccgcggatg

SEQ ID NO: 248324 - DNA, 25 bp, Mus musculus
ccggctctggagcataaacaagagt

SEQ ID NO: 248325 - DNA, 25 bp, Mus musculus
gcctgtcacccggactcggttttgc

SEQ ID NO: 248326 - DNA, 25 bp, Mus musculus
gcagccatgaacctggcgagccaga

SEQ ID NO: 248327 - DNA, 25 bp, Mus musculus
ggccagctgctgttcgccaacttca

SEQ ID NO: 248328 - DNA, 25 bp, Mus musculus
caggataacacgtaaggccgggcgc

SEQ ID NO: 248329 - DNA, 25 bp, Mus musculus
ctgagacctggcctttcgcaaagtt

SEQ ID NO: 248330 - DNA, 25 bp, Mus musculus
aagttaggaaggaactgtgcacgcc

SEQ ID NO: 248331 - DNA, 25 bp, Mus musculus
accggacgtcgatcctgagtgtagc

SEQ ID NO: 248332 - DNA, 25 bp, Mus musculus
caagcctcgagaagcggggcacagc

SEQ ID NO: 248333 - DNA, 25 bp, Mus musculus
ctgtcggagcctttgtctgcggcgc

SEQ ID NO: 248334 - DNA, 25 bp, Mus musculus
tcccaggcaccggatggttgccgca

SEQ ID NO: 248335 - DNA, 25 bp, Mus musculus
atggttgccgcaccccttgtccggg

SEQ ID NO: 248336 - DNA, 25 bp, Mus musculus
aggatgggtaccctcgcacagtgca

SEQ ID NO: 248337 - DNA, 25 bp, Mus musculus
gggtaccctcgcacagtgcaagatc

SEQ ID NO: 248338 - DNA, 25 bp, Mus musculus
tgcaagatcccctgcatccgagctg

SEQ ID NO: 248339 - DNA, 25 bp, Mus musculus
aggatcccagcctggggccgcccga

SEQ ID NO: 248340 - DNA, 25 bp, Mus musculus
ccggtcccaagcctcgagaagcggg

SEQ ID NO: 248341 - DNA, 25 bp, Mus musculus
ccgggacaccgagcaggacgcccgc

SEQ ID NO: 248342 - DNA, 25 bp, Mus musculus
catctggatggtgaaaagtgtggtt

SEQ ID NO: 248343 - DNA, 25 bp, Mus musculus
gggacctgtcggagcctttgtctgc

SEQ ID NO: 248344 - DNA, 25 bp, Mus musculus
acgcaggctctagaaggggacagac

SEQ ID NO: 248345 - DNA, 25 bp, Mus musculus
cccagcacgcgctcacggacccggg

SEQ ID NO: 248346 - DNA, 25 bp, Mus musculus
gcccaccttcagaggtaacgtgata

SEQ ID NO: 248347 - DNA, 25 bp, Mus musculus
gcccatgaggtgacgcacagcaaca

SEQ ID NO: 248348 - DNA, 25 bp, Mus musculus
acagtggggtctacatgcgttttga

SEQ ID NO: 248349 - DNA, 25 bp, Mus musculus
gagtcaaacgaagctggcccacctt

SEQ ID NO: 248350 - DNA, 25 bp, Mus musculus
taacgtgatactgtggagtccggtg

SEQ ID NO: 248351 - DNA, 25 bp, Mus musculus
tccgtggctgtcacacgggctgaga

SEQ ID NO: 248352 - DNA, 25 bp, Mus musculus
atgagcgccagcctctaacattcct

SEQ ID NO: 248353 - DNA, 25 bp, Mus musculus
cacaagccctgctgttgcaccgata

SEQ ID NO: 248354 - DNA, 25 bp, Mus musculus
ctgttgcaccgatacgtcgtggcgc

SEQ ID NO: 248355 - DNA, 25 bp, Mus musculus
atctgggccgacatgctgtccattg

SEQ ID NO: 248356 - DNA, 25 bp, Mus musculus
ctgtccattgcggtaacctacttca

SEQ ID NO: 248357 - DNA, 25 bp, Mus musculus
tacactgtgcctgtttccgggcctg

SEQ ID NO: 248358 - DNA, 25 bp, Mus musculus
ggcctggagtccgagatccgccact

SEQ ID NO: 248359 - DNA, 25 bp, Mus musculus
cccggccacgagtcaaacgaagctg

SEQ ID NO: 248360 - DNA, 25 bp, Mus musculus
cacggccttgccgtggctgcctgcc

SEQ ID NO: 248361 - DNA, 25 bp, Mus musculus
ttgtgctttcaaccgctcctgctga

SEQ ID NO: 248362 - DNA, 25 bp, Mus musculus
gggccgttggccaggccggcagact

SEQ ID NO: 248363 - DNA, 25 bp, Mus musculus
ccggcagactttcgaggcaggagcc

SEQ ID NO: 248364 - DNA, 25 bp, Mus musculus
gcagactttcgaggcaggagcccag

SEQ ID NO: 248365 - DNA, 25 bp, Mus musculus
actttcgaggcaggagcccagggcc

SEQ ID NO: 248366 - DNA, 25 bp, Mus musculus
agcccagggcctgcggcactcaggc

SEQ ID NO: 248367 - DNA, 25 bp, Mus musculus
gcctgcggcactcaggccggccttg

SEQ ID NO: 248368 - DNA, 25 bp, Mus musculus
caggccggccttgcccgtggtctcc

SEQ ID NO: 248369 - DNA, 25 bp, Mus musculus
aggctcctcttgctaatcttctcct

SEQ ID NO: 248370 - DNA, 25 bp, Mus musculus
ctccatctccgttcgatgctcttgt

SEQ ID NO: 248371 - DNA, 25 bp, Mus musculus
cttgtgctttcaaccgctcctgctg

SEQ ID NO: 248372 - DNA, 25 bp, Mus musculus
gtgctttcaaccgctcctgctgagg

SEQ ID NO: 248373 - DNA, 25 bp, Mus musculus
tgggctcacggccttgccgtggctg

SEQ ID NO: 248374 - DNA, 25 bp, Mus musculus
aaataacttaacagcgcgggccagc

SEQ ID NO: 248375 - DNA, 25 bp, Mus musculus
accttctgctttgcggacccaaggg

SEQ ID NO: 248376 - DNA, 25 bp, Mus musculus
ctataatcgaaaccgtctcggcgtc

SEQ ID NO: 248377 - DNA, 25 bp, Mus musculus
gcagcctttgccatggtcgagaagc

SEQ ID NO: 248378 - DNA, 25 bp, Mus musculus
tgaagccctacggagcagcctttgc

SEQ ID NO: 248379 - DNA, 25 bp, Mus musculus
ggagcttcccgcatacacttaaaga

SEQ ID NO: 248380 - DNA, 25 bp, Mus musculus
cagcccgggatacttgtctcaaagg

SEQ ID NO: 248381 - DNA, 25 bp, Mus musculus
aatctaggatcgtcacagcccggga

SEQ ID NO: 248382 - DNA, 25 bp, Mus musculus
ctggttaccagaatcgcgtttactt

SEQ ID NO: 248383 - DNA, 25 bp, Mus musculus
ctcgctctttatcaggctctggtta

SEQ ID NO: 248384 - DNA, 25 bp, Mus musculus
cccaactttgctaaggacgcctatt

SEQ ID NO: 248385 - DNA, 25 bp, Mus musculus
gcgctctagcagacggagactaagc

SEQ ID NO: 248386 - DNA, 25 bp, Mus musculus
acccaaggggtacgctgcacaagtt

SEQ ID NO: 248387 - DNA, 25 bp, Mus musculus
atctgtcgctttcctgttcccgagg

SEQ ID NO: 248388 - DNA, 25 bp, Mus musculus
ccctctggaatgtacggctcggctc

SEQ ID NO: 248389 - DNA, 25 bp, Mus musculus
cggatttgccgatggcgtttgcatt

SEQ ID NO: 248390 - DNA, 25 bp, Mus musculus
ctctggaatgtacggctcggctccc

SEQ ID NO: 248391 - DNA, 25 bp, Mus musculus
cagagtttcattagggctgaggttg

SEQ ID NO: 248392 - DNA, 25 bp, Mus musculus
acccagagtttcattagggctgagg

SEQ ID NO: 248393 - DNA, 25 bp, Mus musculus
ccgacccagagtttcattagggctg

SEQ ID NO: 248394 - DNA, 25 bp, Mus musculus
ccgaccgacccagagtttcattagg

SEQ ID NO: 248395 - DNA, 25 bp, Mus musculus
taccgaccgacccagagtttcatta

SEQ ID NO: 248396 - DNA, 25 bp, Mus musculus
gcgtggcataccgaccgacccagag

SEQ ID NO: 248397 - DNA, 25 bp, Mus musculus
tttttcaagtgtgcgccccgtcggc

SEQ ID NO: 248398 - DNA, 25 bp, Mus musculus
cgatggcgtttgcatttttcaagtg

SEQ ID NO: 248399 - DNA, 25 bp, Mus musculus
gccgatggcgtttgcatttttcaag

SEQ ID NO: 248400 - DNA, 25 bp, Mus musculus
ttgccgatggcgtttgcatttttca

SEQ ID NO: 248401 - DNA, 25 bp, Mus musculus
ggcataccgaccgacccagagtttc

SEQ ID NO: 248402 - DNA, 25 bp, Mus musculus
tcaaagctctttgttgtaaaaccag

SEQ ID NO: 248403 - DNA, 25 bp, Mus musculus
tcctgaggcttttggtgtattcttc

SEQ ID NO: 248404 - DNA, 25 bp, Mus musculus
ctgcctggtccggcatggttgtccc

SEQ ID NO: 248405 - DNA, 25 bp, Mus musculus
ggacactcctgaggcttttggtgta

SEQ ID NO: 248406 - DNA, 25 bp, Mus musculus
ctgaggcttttggtgtattcttcca

SEQ ID NO: 248407 - DNA, 25 bp, Mus musculus
tattcttccagatacccggtccagg

SEQ ID NO: 248408 - DNA, 25 bp, Mus musculus
ttcttccagatacccggtccaggtc

SEQ ID NO: 248409 - DNA, 25 bp, Mus musculus
aggtctggaagctctggacgagtcc

SEQ ID NO: 248410 - DNA, 25 bp, Mus musculus
ttgttgtaaaaccagaggacaggcc

SEQ ID NO: 248411 - DNA, 25 bp, Mus musculus
tgtaaaaccagaggacaggccaacc

SEQ ID NO: 248412 - DNA, 25 bp, Mus musculus
cagaggacaggccaaccttgagtgc

SEQ ID NO: 248413 - DNA, 25 bp, Mus musculus
caggccaaccttgagtgcggctgcc

SEQ ID NO: 248414 - DNA, 25 bp, Mus musculus
tgccttccctgcggtgcgcctttgt

SEQ ID NO: 248415 - DNA, 25 bp, Mus musculus
atacccggtccaggtctggaagctc

SEQ ID NO: 248416 - DNA, 25 bp, Mus musculus
tctcctaaggcctcgcagccaggtg

SEQ ID NO: 248417 - DNA, 25 bp, Mus musculus
gctcgcccggttcaaacgctccctc

SEQ ID NO: 248418 - DNA, 25 bp, Mus musculus
tccctcccggccttgagcggcgacc

SEQ ID NO: 248419 - DNA, 25 bp, Mus musculus
ccgtcccggggatggcagtccggag

SEQ ID NO: 248420 - DNA, 25 bp, Mus musculus
cagtccggagctgtgcagaagcgcc

SEQ ID NO: 248421 - DNA, 25 bp, Mus musculus
tgtgcagaagcgccggccggtttcc

SEQ ID NO: 248422 - DNA, 25 bp, Mus musculus
tccgggatgagtcggtaccgggtgc

SEQ ID NO: 248423 - DNA, 25 bp, Mus musculus
taaggcctcgcagccaggtgggcct

SEQ ID NO: 248424 - DNA, 25 bp, Mus musculus
agcgctggtctcctaaggcctcgca

SEQ ID NO: 248425 - DNA, 25 bp, Mus musculus
gccgggcactgagcgtcggagccgg

SEQ ID NO: 248426 - DNA, 25 bp, Mus musculus
acagcgctggtctcctaaggcctcg

SEQ ID NO: 248427 - DNA, 25 bp, Mus musculus
gaagactgacctgccgccggagtcc

SEQ ID NO: 248428 - DNA, 25 bp, Mus musculus
gtgcttccggggtgacgctcgcccg

SEQ ID NO: 248429 - DNA, 25 bp, Mus musculus
ctgaagctgggcctgcagcgggccg

SEQ ID NO: 248430 - DNA, 25 bp, Mus musculus
agagcgccctcagagcgcctggcgt

SEQ ID NO: 248431 - DNA, 25 bp, Mus musculus
agccctgggcagagcgccctcagag

SEQ ID NO: 248432 - DNA, 25 bp, Mus musculus
gatacgcaccgactgcacttgcagc

SEQ ID NO: 248433 - DNA, 25 bp, Mus musculus
aggccagcgctgatccctggggtcc

SEQ ID NO: 248434 - DNA, 25 bp, Mus musculus
agggctgcgaggacatcccgcactc

SEQ ID NO: 248435 - DNA, 25 bp, Mus musculus
gacatcccgcactccacacccagtt

SEQ ID NO: 248436 - DNA, 25 bp, Mus musculus
gtttcttggtcctcttcgagtcctc

SEQ ID NO: 248437 - DNA, 25 bp, Mus musculus
ttggtcctcttcgagtcctcttgga

SEQ ID NO: 248438 - DNA, 25 bp, Mus musculus
tcgagtcctcttggagctgctccca

SEQ ID NO: 248439 - DNA, 25 bp, Mus musculus
gactgtttcccagcgaggcagccct

SEQ ID NO: 248440 - DNA, 25 bp, Mus musculus
acttggactgtttcccagcgaggca

SEQ ID NO: 248441 - DNA, 25 bp, Mus musculus
ttctggtttggacagacttggactg

SEQ ID NO: 248442 - DNA, 25 bp, Mus musculus
agtcctcttggagctgctcccactt

SEQ ID NO: 248443 - DNA, 25 bp, Mus musculus
tgctgggatacgcaccgactgcact

SEQ ID NO: 248444 - DNA, 25 bp, Mus musculus
gtctggttcccaatactgtgtactc

SEQ ID NO: 248445 - DNA, 25 bp, Mus musculus
gcagaccggccgcattattaccata

SEQ ID NO: 248446 - DNA, 25 bp, Mus musculus
acgcacgcgcagctaactaggaaga

SEQ ID NO: 248447 - DNA, 25 bp, Mus musculus
acacgcgcctcgatgcccagtgata

SEQ ID NO: 248448 - DNA, 25 bp, Mus musculus
cccagtgatagagagcgcacgcgca

SEQ ID NO: 248449 - DNA, 25 bp, Mus musculus
accggcaacgaaggagctgcaaaga

SEQ ID NO: 248450 - DNA, 25 bp, Mus musculus
ccctgcagtgaggtactagccacga

SEQ ID NO: 248451 - DNA, 25 bp, Mus musculus
cccatggtgtccgttctgagtgatc

SEQ ID NO: 248452 - DNA, 25 bp, Mus musculus
gcaaagagtctacacgctaggcgta

SEQ ID NO: 248453 - DNA, 25 bp, Mus musculus
gcccggcaagccgaataggcaaacc

SEQ ID NO: 248454 - DNA, 25 bp, Mus musculus
gtgtactctcaagatggacctaata

SEQ ID NO: 248455 - DNA, 25 bp, Mus musculus
cgtgatcgtagcgtctggttcccaa

SEQ ID NO: 248456 - DNA, 25 bp, Mus musculus
ctacaccgcgggaatgtggctgcaa

SEQ ID NO: 248457 - DNA, 25 bp, Mus musculus
tttggacaaagacccagaggccatt

SEQ ID NO: 248458 - DNA, 25 bp, Mus musculus
ccataaaaggcaaggagcgcaagtc

SEQ ID NO: 248459 - DNA, 25 bp, Mus musculus
cgctgcccacgagtcgtccataaaa

SEQ ID NO: 248460 - DNA, 25 bp, Mus musculus
acgagtcgtccataaaaggcaagga

SEQ ID NO: 248461 - DNA, 25 bp, Mus musculus
aggagcgcaagtcgcgccaaactta

SEQ ID NO: 248462 - DNA, 25 bp, Mus musculus
ccaaacttagtcatgcggcggcggc

SEQ ID NO: 248463 - DNA, 25 bp, Mus musculus
ggctgcccgcgcgacttcctccgcc

SEQ ID NO: 248464 - DNA, 25 bp, Mus musculus
gccgacttcccgtttcgagagcgaa

SEQ ID NO: 248465 - DNA, 25 bp, Mus musculus
gtggtcctgcctttcgaaatggctc

SEQ ID NO: 248466 - DNA, 25 bp, Mus musculus
cctgcctttcgaaatggctccgatt

SEQ ID NO: 248467 - DNA, 25 bp, Mus musculus
gcctttcgaaatggctccgattccc

SEQ ID NO: 248468 - DNA, 25 bp, Mus musculus
gcgccctgcagaggggaccgctaag

SEQ ID NO: 248469 - DNA, 25 bp, Mus musculus
accgctaagggtccgcgggcacaca

SEQ ID NO: 248470 - DNA, 25 bp, Mus musculus
tcccgtttcgagagcgaagcccgca

SEQ ID NO: 248471 - DNA, 25 bp, Mus musculus
cccacgagtcgtccataaaaggcaa

SEQ ID NO: 248472 - DNA, 25 bp, Mus musculus
caccaaggtgggcaaagatgagctc

SEQ ID NO: 248473 - DNA, 25 bp, Mus musculus
tacagtgtgcagacgtccgaccacc

SEQ ID NO: 248474 - DNA, 25 bp, Mus musculus
cttccaggaccaacgctacagtgtg

SEQ ID NO: 248475 - DNA, 25 bp, Mus musculus
ccgcaggttaacatctacagcgtta

SEQ ID NO: 248476 - DNA, 25 bp, Mus musculus
agtggagcgtgcacatcgccatgca

SEQ ID NO: 248477 - DNA, 25 bp, Mus musculus
cagatctggacgctggagcaacctc

SEQ ID NO: 248478 - DNA, 25 bp, Mus musculus
caaggtgaacgcatccgctagtagc

SEQ ID NO: 248479 - DNA, 25 bp, Mus musculus
caagtacctgacagccgaggcgttc

SEQ ID NO: 248480 - DNA, 25 bp, Mus musculus
ggctcatcagctgcggcaacaagta

SEQ ID NO: 248481 - DNA, 25 bp, Mus musculus
tgtgcagattcagttcgggctcatc

SEQ ID NO: 248482 - DNA, 25 bp, Mus musculus
aggtcgggcacagctatccaagctc

SEQ ID NO: 248483 - DNA, 25 bp, Mus musculus
cgggctaagccgtgttgaacaaagg

SEQ ID NO: 248484 - DNA, 25 bp, Mus musculus
ggtgacgtcatcctcctataaaacc

SEQ ID NO: 248485 - DNA, 25 bp, Mus musculus
agatgagctcttcgccctggaacag

SEQ ID NO: 248486 - DNA, 25 bp, Mus musculus
tccctgccctcctatgcacgccttg

SEQ ID NO: 248487 - DNA, 25 bp, Mus musculus
ttgtcctgctaaggctctgcagatg

SEQ ID NO: 248488 - DNA, 25 bp, Mus musculus
tatgcacgccttgcggtccggcact

SEQ ID NO: 248489 - DNA, 25 bp, Mus musculus
gcggagtgaagccgcctggctcttc

SEQ ID NO: 248490 - DNA, 25 bp, Mus musculus
caggcgttgtccctggtccagggtt

SEQ ID NO: 248491 - DNA, 25 bp, Mus musculus
tgcagatgggaaaaccagatgcggc

SEQ ID NO: 248492 - DNA, 25 bp, Mus musculus
ctggtccagggttcattgagaaggc

SEQ ID NO: 248493 - DNA, 25 bp, Mus musculus
ctaaggctctgcagatgggaaaacc

SEQ ID NO: 248494 - DNA, 25 bp, Mus musculus
ccctttgtcctgctaaggctctgca

SEQ ID NO: 248495 - DNA, 25 bp, Mus musculus
ggtcggccctgcgactcttggtggt

SEQ ID NO: 248496 - DNA, 25 bp, Mus musculus
cttaaatggcgagatagaggaggtt

SEQ ID NO: 248497 - DNA, 25 bp, Mus musculus
cccgccttaaatggcgagatagagg

SEQ ID NO: 248498 - DNA, 25 bp, Mus musculus
ctcccgtttcgcgggcctttggctg

SEQ ID NO: 248499 - DNA, 25 bp, Mus musculus
ctctgcagatgggaaaaccagatgc

SEQ ID NO: 248500 - DNA, 25 bp, Mus musculus
ttgttgtcccttgccacattgcccg

SEQ ID NO: 248501 - DNA, 25 bp, Mus musculus
tgctcagttccaggacgccgtgcgc

SEQ ID NO: 248502 - DNA, 25 bp, Mus musculus
cccggaattgtctggccaaactgca

SEQ ID NO: 248503 - DNA, 25 bp, Mus musculus
gcttgttgagcttctggtcgttgtg

SEQ ID NO: 248504 - DNA, 25 bp, Mus musculus
ttcttgttgtcccttgccacattgc

SEQ ID NO: 248505 - DNA, 25 bp, Mus musculus
agctccaggatctcgaggcattcca

SEQ ID NO: 248506 - DNA, 25 bp, Mus musculus
ggatctcgaggcattccagcaccgc

SEQ ID NO: 248507 - DNA, 25 bp, Mus musculus
aacgcggcccatggcctatggggaa

SEQ ID NO: 248508 - DNA, 25 bp, Mus musculus
cccatggcctatggggaactgcagg

SEQ ID NO: 248509 - DNA, 25 bp, Mus musculus
cctatggggaactgcaggtccgcgc

SEQ ID NO: 248510 - DNA, 25 bp, Mus musculus
cgccctgcttgcctctgcgcctgga

SEQ ID NO: 248511 - DNA, 25 bp, Mus musculus
cctggagctccaacttgctcagttc

SEQ ID NO: 248512 - DNA, 25 bp, Mus musculus
acttgctcagttccaggacgccgtg

SEQ ID NO: 248513 - DNA, 25 bp, Mus musculus
cttctggtcgttgtggatggccagc

SEQ ID NO: 248514 - DNA, 25 bp, Mus musculus
gaaactctgtgtcccagacgccttc

SEQ ID NO: 248515 - DNA, 25 bp, Mus musculus
actgaccgtgcagcccaaagcgatg

SEQ ID NO: 248516 - DNA, 25 bp, Mus musculus
tcccaggcgccgcaagctggggaca

SEQ ID NO: 248517 - DNA, 25 bp, Mus musculus
gcacagccgagtctgttcgctgccg

SEQ ID NO: 248518 - DNA, 25 bp, Mus musculus
tgcaggctcggcaactccagcttag

SEQ ID NO: 248519 - DNA, 25 bp, Mus musculus
cttagcgaacgcaaaggctgcggga

SEQ ID NO: 248520 - DNA, 25 bp, Mus musculus
gggaaggtagcctcgacacaccaga

SEQ ID NO: 248521 - DNA, 25 bp, Mus musculus
cgacacaccagacctgcaggaagtc

SEQ ID NO: 248522 - DNA, 25 bp, Mus musculus
caggaagtcaccacggcgcagtggc

SEQ ID NO: 248523 - DNA, 25 bp, Mus musculus
cacaggccgcgacgcgcatgtgcag

SEQ ID NO: 248524 - DNA, 25 bp, Mus musculus
cggaagtccgagttccaaggctctc

SEQ ID NO: 248525 - DNA, 25 bp, Mus musculus
aagcgatgcagctgtcccgctgtca

SEQ ID NO: 248526 - DNA, 25 bp, Mus musculus
gcgccactgcatctagggatcctcg

SEQ ID NO: 248527 - DNA, 25 bp, Mus musculus
cccaagaattgcacagaaactctgt

SEQ ID NO: 248528 - DNA, 25 bp, Mus musculus
tgcgcacttctgtttgtgtgcatgc

SEQ ID NO: 248529 - DNA, 25 bp, Mus musculus
cctgagcgatcagcgcctgcgcgat

SEQ ID NO: 248530 - DNA, 25 bp, Mus musculus
accgcttgccgaggcctgagcgatc

SEQ ID NO: 248531 - DNA, 25 bp, Mus musculus
cctgagaccgcttgccgaggcctga

SEQ ID NO: 248532 - DNA, 25 bp, Mus musculus
gcaggcgaacgcagctttgcaggcc

SEQ ID NO: 248533 - DNA, 25 bp, Mus musculus
tcggcagcaggcgaacgcagctttg

SEQ ID NO: 248534 - DNA, 25 bp, Mus musculus
tcgcagctttgacttgcgcgagctg

SEQ ID NO: 248535 - DNA, 25 bp, Mus musculus
ggtctgtgtctctacgctcgcagct

SEQ ID NO: 248536 - DNA, 25 bp, Mus musculus
tgtgtgcatgctcgcgcaagcgcac

SEQ ID NO: 248537 - DNA, 25 bp, Mus musculus
cgcgtgcgcacttctgtttgtgtgc

SEQ ID NO: 248538 - DNA, 25 bp, Mus musculus
cctgtcctcagcgtgcgggatccgg

SEQ ID NO: 248539 - DNA, 25 bp, Mus musculus
tttgacttgcgcgagctggagtcgc

SEQ ID NO: 248540 - DNA, 25 bp, Mus musculus
cttcctgcggtctgtgtctctacgc

SEQ ID NO: 248541 - DNA, 25 bp, Mus musculus
tctctacgctcgcagctttgacttg

SEQ ID NO: 248542 - DNA, 25 bp, Mus musculus
gttgcccatctcacgaaaccgtctg

SEQ ID NO: 248543 - DNA, 25 bp, Mus musculus
agcctcgggctcttcagtctctgcg

SEQ ID NO: 248544 - DNA, 25 bp, Mus musculus
ggtgcgagccgtacacgaagctctt

SEQ ID NO: 248545 - DNA, 25 bp, Mus musculus
acctgctcgtcctgtctggcttcag

SEQ ID NO: 248546 - DNA, 25 bp, Mus musculus
gaaaccgtctgtctggttcagggtc

SEQ ID NO: 248547 - DNA, 25 bp, Mus musculus
tccggatgcagccaggacttgggat

SEQ ID NO: 248548 - DNA, 25 bp, Mus musculus
ccagaatggggaaaccgtccggatg

SEQ ID NO: 248549 - DNA, 25 bp, Mus musculus
cggcttgcagccgttcagagaactc

SEQ ID NO: 248550 - DNA, 25 bp, Mus musculus
cagatggcgtccatcggcttgcagc

SEQ ID NO: 248551 - DNA, 25 bp, Mus musculus
tgcggaacgggtcgcaagccaaccc

SEQ ID NO: 248552 - DNA, 25 bp, Mus musculus
gggaatgctcgcaggccaccatcca

SEQ ID NO: 248553 - DNA, 25 bp, Mus musculus
agtcggagcagatccacgggctctc

SEQ ID NO: 248554 - DNA, 25 bp, Mus musculus
tgtcgcttgaagtccgagctgtggc

SEQ ID NO: 248555 - DNA, 25 bp, Mus musculus
agggtccttcttgctgtcggggaca

SEQ ID NO: 248556 - DNA, 25 bp, Mus musculus
aaggacgggccctgcagtcccgcga

SEQ ID NO: 248557 - DNA, 25 bp, Mus musculus
ctctggatgtagacagggtgctgct

SEQ ID NO: 248558 - DNA, 25 bp, Mus musculus
tcccggagctctggatgtagacagg

SEQ ID NO: 248559 - DNA, 25 bp, Mus musculus
cacttccggtcatggggcgtcccgg

SEQ ID NO: 248560 - DNA, 25 bp, Mus musculus
tacacaaagtgacggccgcgagctg

SEQ ID NO: 248561 - DNA, 25 bp, Mus musculus
ccaagccggagcgagacacggactc

SEQ ID NO: 248562 - DNA, 25 bp, Mus musculus
tccagctctcgagcatccatgacgg

SEQ ID NO: 248563 - DNA, 25 bp, Mus musculus
tctaggggcctggaagatctagctc

SEQ ID NO: 248564 - DNA, 25 bp, Mus musculus
gttaagccatccctgacgtgccgcg

SEQ ID NO: 248565 - DNA, 25 bp, Mus musculus
cctctagggtgttaagccatccctg

SEQ ID NO: 248566 - DNA, 25 bp, Mus musculus
tgcaaaggtgcagtgcacgacgtcc

SEQ ID NO: 248567 - DNA, 25 bp, Mus musculus
agaaggcggcgctagcaccctgcaa

SEQ ID NO: 248568 - DNA, 25 bp, Mus musculus
ggcgctagcaccctgcaaaggtgca

SEQ ID NO: 248569 - DNA, 25 bp, Mus musculus
gagcatccatgacggccagccttgc

SEQ ID NO: 248570 - DNA, 25 bp, Mus musculus
ttagatagatcatccacgcccgtgg

SEQ ID NO: 248571 - DNA, 25 bp, Mus musculus
cgcttccagagtcagaggtacctcc

SEQ ID NO: 248572 - DNA, 25 bp, Mus musculus
ccaactcggcgcaattccatggtga

SEQ ID NO: 248573 - DNA, 25 bp, Mus musculus
acagccagttcctggtggctgcata

SEQ ID NO: 248574 - DNA, 25 bp, Mus musculus
ttgctccactgcagcagctcttcgt

SEQ ID NO: 248575 - DNA, 25 bp, Mus musculus
gaatcgcgctgcgtggccatcctac

SEQ ID NO: 248576 - DNA, 25 bp, Mus musculus
atctcgccgagatgcagctgcaggc

SEQ ID NO: 248577 - DNA, 25 bp, Mus musculus
tagacatggtatccgcgcagcggca

SEQ ID NO: 248578 - DNA, 25 bp, Mus musculus
gcctccagccgccttagacatggta

SEQ ID NO: 248579 - DNA, 25 bp, Mus musculus
tggctgcataggtccgtcccaactc

SEQ ID NO: 248580 - DNA, 25 bp, Mus musculus
gcagctcttcgtccgtcactttaga

SEQ ID NO: 248581 - DNA, 25 bp, Mus musculus
ttgctgtggtccagcatcgcgctca

SEQ ID NO: 248582 - DNA, 25 bp, Mus musculus
tgacctcgcgaatgaggttgctgtg

SEQ ID NO: 248583 - DNA, 25 bp, Mus musculus
caagcgcgagtacctgccgaatctc

SEQ ID NO: 248584 - DNA, 25 bp, Mus musculus
gagtcccaggcctcgggagcgtcct

SEQ ID NO: 248585 - DNA, 25 bp, Mus musculus
tggcgggagtcagagccgcactccc

SEQ ID NO: 248586 - DNA, 25 bp, Mus musculus
ttcctccgctgtttggcgggagtca

SEQ ID NO: 248587 - DNA, 25 bp, Mus musculus
acactcgctgcagatggtcggcctg

SEQ ID NO: 248588 - DNA, 25 bp, Mus musculus
tgctgcggctgaaacccttgccaca

SEQ ID NO: 248589 - DNA, 25 bp, Mus musculus
cttggtgtcgcaccaggtccgtgct

SEQ ID NO: 248590 - DNA, 25 bp, Mus musculus
ttgccgcactcactgcagaggtacg

SEQ ID NO: 248591 - DNA, 25 bp, Mus musculus
tggaatgttgtgagaagctcttgcc

SEQ ID NO: 248592 - DNA, 25 bp, Mus musculus
acttggagcagtaggtgcaggcata

SEQ ID NO: 248593 - DNA, 25 bp, Mus musculus
ccgagctctcgctgaagcacttgga

SEQ ID NO: 248594 - DNA, 25 bp, Mus musculus
ctgatgctgcacgagcgccgagctc

SEQ ID NO: 248595 - DNA, 25 bp, Mus musculus
cttgccgcagtcaccgcagacgtag

SEQ ID NO: 248596 - DNA, 25 bp, Mus musculus
tctgcaccttgtgccggaagcgctc

SEQ ID NO: 248597 - DNA, 25 bp, Mus musculus
tcgtgcctgcggatctgcaccttgt

SEQ ID NO: 248598 - DNA, 25 bp, Mus musculus
acccaggcgattcgactcgcgtgtg

SEQ ID NO: 248599 - DNA, 25 bp, Mus musculus
gttccagtaccaggcgcggagcgac

SEQ ID NO: 248600 - DNA, 25 bp, Mus musculus
ccggcaagatcaacacctcgcgctc

SEQ ID NO: 248601 - DNA, 25 bp, Mus musculus
gtaccaaaggttcaccggcaagatc

SEQ ID NO: 248602 - DNA, 25 bp, Mus musculus
catggcttcgctgtaccaaaggttc

SEQ ID NO: 248603 - DNA, 25 bp, Mus musculus
gcggcccatggcttcgctgtaccaa

SEQ ID NO: 248604 - DNA, 25 bp, Mus musculus
agtgagccagcgcacggcggcccat

SEQ ID NO: 248605 - DNA, 25 bp, Mus musculus
gcatcctaaccagtgagccagcgca

SEQ ID NO: 248606 - DNA, 25 bp, Mus musculus
ccttctcgcttttctgctggagggg

SEQ ID NO: 248607 - DNA, 25 bp, Mus musculus
gagtcgctcaacacccaggcgattc

SEQ ID NO: 248608 - DNA, 25 bp, Mus musculus
caggcagagtcgctcaacacccagg

SEQ ID NO: 248609 - DNA, 25 bp, Mus musculus
agaagctgagccaggcagagtcgct

SEQ ID NO: 248610 - DNA, 25 bp, Mus musculus
gacccttggcttctgcgctgccggg

SEQ ID NO: 248611 - DNA, 25 bp, Mus musculus
tttttacgaagcatcctaaccagtg

SEQ ID NO: 248612 - DNA, 25 bp, Mus musculus
ccgccctcccgtgctgggcatccgt

SEQ ID NO: 248613 - DNA, 25 bp, Mus musculus
gctgccttcgcctaagccatagtct

SEQ ID NO: 248614 - DNA, 25 bp, Mus musculus
cttcgcctaagccatagtctctcta

SEQ ID NO: 248615 - DNA, 25 bp, Mus musculus
gtgcgcgtgtccgtgcgccacggtt

SEQ ID NO: 248616 - DNA, 25 bp, Mus musculus
cagcgcacgccgcaacgcatcgcct

SEQ ID NO: 248617 - DNA, 25 bp, Mus musculus
taagccatagtctctctaggccgcg

SEQ ID NO: 248618 - DNA, 25 bp, Mus musculus
ccagggtccaccgatgctgggcgca

SEQ ID NO: 248619 - DNA, 25 bp, Mus musculus
gtgcttcccagggtccaccgatgct

SEQ ID NO: 248620 - DNA, 25 bp, Mus musculus
gatggtcggccctgcgtgcttccca

SEQ ID NO: 248621 - DNA, 25 bp, Mus musculus
agctctgtgggcttaacccttcccg

SEQ ID NO: 248622 - DNA, 25 bp, Mus musculus
cagctagctctgtgggcttaaccct

SEQ ID NO: 248623 - DNA, 25 bp, Mus musculus
tctaggccgcgcagctagctctgtg

SEQ ID NO: 248624 - DNA, 25 bp, Mus musculus
gccatagtctctctaggccgcgcag

SEQ ID NO: 248625 - DNA, 25 bp, Mus musculus
caacgcatcgcctggtgcggtgcgc

SEQ ID NO: 248626 - DNA, 25 bp, Mus musculus
ccttgggcacttggaacacgaactc

SEQ ID NO: 248627 - DNA, 25 bp, Mus musculus
cggaggtgttctgagccggcaccac

SEQ ID NO: 248628 - DNA, 25 bp, Mus musculus
tttgattatcagacactcggaggtg

SEQ ID NO: 248629 - DNA, 25 bp, Mus musculus
ctccggcttcagaggtgtttgatta

SEQ ID NO: 248630 - DNA, 25 bp, Mus musculus
tcttcgcaagagtttctccggcttc

SEQ ID NO: 248631 - DNA, 25 bp, Mus musculus
ccagcgagtatcctggggtccgact

SEQ ID NO: 248632 - DNA, 25 bp, Mus musculus
aacaggcgccaacccgctcagggga

SEQ ID NO: 248633 - DNA, 25 bp, Mus musculus
tacttccgcccggagacaaagaggc

SEQ ID NO: 248634 - DNA, 25 bp, Mus musculus
tgtccaggtggtacagcacctcctt

SEQ ID NO: 248635 - DNA, 25 bp, Mus musculus
agcaacgccgctggactgcaaggcc

SEQ ID NO: 248636 - DNA, 25 bp, Mus musculus
acggagcccttgtccacgatgggca

SEQ ID NO: 248637 - DNA, 25 bp, Mus musculus
gagctcctgtcaccgagcgagggca

SEQ ID NO: 248638 - DNA, 25 bp, Mus musculus
tccaaccaggacgtgctctgatcgc

SEQ ID NO: 248639 - DNA, 25 bp, Mus musculus
cagctggctgctgaagtagatgtcc

SEQ ID NO: 248640 - DNA, 25 bp, Mus musculus
aagcaggctgggagacggcaactac

SEQ ID NO: 248641 - DNA, 25 bp, Mus musculus
agccgattgtgttttcgtaccgtcg

SEQ ID NO: 248642 - DNA, 25 bp, Mus musculus
ctctggttctgcgagccgattgtgt

SEQ ID NO: 248643 - DNA, 25 bp, Mus musculus
aattattgtctttggcctctggttc

SEQ ID NO: 248644 - DNA, 25 bp, Mus musculus
agcgggaggccggaaattattgtct

SEQ ID NO: 248645 - DNA, 25 bp, Mus musculus
tgcccgcgacggaggcgacttccga

SEQ ID NO: 248646 - DNA, 25 bp, Mus musculus
tccatggcgtcatcagtgcccgcga

SEQ ID NO: 248647 - DNA, 25 bp, Mus musculus
gacttccggcgcgtccatggcgtca

SEQ ID NO: 248648 - DNA, 25 bp, Mus musculus
gtgtcacagagccttccggagccgc

SEQ ID NO: 248649 - DNA, 25 bp, Mus musculus
cccagccggggtgtcacagagcctt

SEQ ID NO: 248650 - DNA, 25 bp, Mus musculus
tgtgctctcactcaaacacggggtc

SEQ ID NO: 248651 - DNA, 25 bp, Mus musculus
ctcggagaggactgtgctctcactc

SEQ ID NO: 248652 - DNA, 25 bp, Mus musculus
agcccggacaacgactggaagagga

SEQ ID NO: 248653 - DNA, 25 bp, Mus musculus
agacggcaactacgtccggagcccg

SEQ ID NO: 248654 - DNA, 25 bp, Mus musculus
cgagggtggccccacagccttgaca

SEQ ID NO: 248655 - DNA, 25 bp, Mus musculus
agccttgacagcagcctggctaacc

SEQ ID NO: 248656 - DNA, 25 bp, Mus musculus
ttcggcttccagctgggcggctctg

SEQ ID NO: 248657 - DNA, 25 bp, Mus musculus
cacggcgctgccctcgagtgccacc

SEQ ID NO: 248658 - DNA, 25 bp, Mus musculus
gcctcccgctgagccgcgaactgct

SEQ ID NO: 248659 - DNA, 25 bp, Mus musculus
ggctaacccggcgatttggccgcag

SEQ ID NO: 248660 - DNA, 25 bp, Mus musculus
ccctcgagtgccacccagcctcggt

SEQ ID NO: 248661 - DNA, 25 bp, Mus musculus
gcgcatcgtgcgcttggcacggcgc

SEQ ID NO: 248662 - DNA, 25 bp, Mus musculus
ccgagagcgcatcgtgcgcttggca

SEQ ID NO: 248663 - DNA, 25 bp, Mus musculus
ggggatcagatcctggaagtggagg

SEQ ID NO: 248664 - DNA, 25 bp, Mus musculus
ctgaaggaagcagcgcgcacgctgg

SEQ ID NO: 248665 - DNA, 25 bp, Mus musculus
cgtgatagaggtggctgaaggaagc

SEQ ID NO: 248666 - DNA, 25 bp, Mus musculus
tctggcccctgcttcgtgatagagg

SEQ ID NO: 248667 - DNA, 25 bp, Mus musculus
taacccggcgatttggccgcagcct

SEQ ID NO: 248668 - DNA, 25 bp, Mus musculus
cctgtgtcgccagcgggtgtcaact

SEQ ID NO: 248669 - DNA, 25 bp, Mus musculus
ggggaacttggtgcgtttgtctcca

SEQ ID NO: 248670 - DNA, 25 bp, Mus musculus
aacttggtgcgtttgtctccaggcc

SEQ ID NO: 248671 - DNA, 25 bp, Mus musculus
tgtctccaggccagactcagcggga

SEQ ID NO: 248672 - DNA, 25 bp, Mus musculus
ctcagcgggaggatcgctcagattt

SEQ ID NO: 248673 - DNA, 25 bp, Mus musculus
ggatcgctcagatttcccggtttca

SEQ ID NO: 248674 - DNA, 25 bp, Mus musculus
ttcccggtttcatctcggtgctgcg

SEQ ID NO: 248675 - DNA, 25 bp, Mus musculus
gtgctgcggggcttctgtctccgcc

SEQ ID NO: 248676 - DNA, 25 bp, Mus musculus
cgtctgcctctctgcttttcatccc

SEQ ID NO: 248677 - DNA, 25 bp, Mus musculus
tcagctgagaaacagaacgggagaa

SEQ ID NO: 248678 - DNA, 25 bp, Mus musculus
gatttagatcctggaaaaagcggga

SEQ ID NO: 248679 - DNA, 25 bp, Mus musculus
ttcatctcggtgctgcggggcttct

SEQ ID NO: 248680 - DNA, 25 bp, Mus musculus
gagaaggtggtctagatttagatcc

SEQ ID NO: 248681 - DNA, 25 bp, Mus musculus
ccctgtcagctgagaaacagaacgg

SEQ ID NO: 248682 - DNA, 25 bp, Mus musculus
cggagcttccaagaatgggcgggca

SEQ ID NO: 248683 - DNA, 25 bp, Mus musculus
gcacgctagcccagcaaaggcgcgt

SEQ ID NO: 248684 - DNA, 25 bp, Mus musculus
gctagcccagcaaaggcgcgtggaa

SEQ ID NO: 248685 - DNA, 25 bp, Mus musculus
tagcccagcaaaggcgcgtggaata

SEQ ID NO: 248686 - DNA, 25 bp, Mus musculus
gcgtggaatagcgggcgccctctct

SEQ ID NO: 248687 - DNA, 25 bp, Mus musculus
gccctctctgtcatcgcgggctctg

SEQ ID NO: 248688 - DNA, 25 bp, Mus musculus
ttctctcggcactttaggtagcttc

SEQ ID NO: 248689 - DNA, 25 bp, Mus musculus
ctctcggcactttaggtagcttccc

SEQ ID NO: 248690 - DNA, 25 bp, Mus musculus
tttaggtagcttccccatcgcgttc

SEQ ID NO: 248691 - DNA, 25 bp, Mus musculus
catcgcgggctctgccacccgctgc

SEQ ID NO: 248692 - DNA, 25 bp, Mus musculus
acccgctgcccggtgcgcacctgcc

SEQ ID NO: 248693 - DNA, 25 bp, Mus musculus
gaaggaccagggcttctctcggcac

SEQ ID NO: 248694 - DNA, 25 bp, Mus musculus
cgccctcgcggatccagatggggaa

SEQ ID NO: 248695 - DNA, 25 bp, Mus musculus
aggaccagggcttctctcggcactt

SEQ ID NO: 248696 - DNA, 25 bp, Mus musculus
tggtgtcgcagggtctgctgggcaa

SEQ ID NO: 248697 - DNA, 25 bp, Mus musculus
tctgctgggcaagctgtgccgtgct

SEQ ID NO: 248698 - DNA, 25 bp, Mus musculus
cgcacagcgtttgcgtcggagccgc

SEQ ID NO: 248699 - DNA, 25 bp, Mus musculus
acagcgtttgcgtcggagccgcagc

SEQ ID NO: 248700 - DNA, 25 bp, Mus musculus
cggagcgcctcttagtgtccacgcg

SEQ ID NO: 248701 - DNA, 25 bp, Mus musculus
gagcgcctcttagtgtccacgcgcg

SEQ ID NO: 248702 - DNA, 25 bp, Mus musculus
gtccacgcgcgctagcgccgctccc

SEQ ID NO: 248703 - DNA, 25 bp, Mus musculus
ccgcggaaggcaacctcgctgctgg

SEQ ID NO: 248704 - DNA, 25 bp, Mus musculus
aaggcaacctcgctgctgggcggtc

SEQ ID NO: 248705 - DNA, 25 bp, Mus musculus
aacctcgctgctgggcggtcgcact

SEQ ID NO: 248706 - DNA, 25 bp, Mus musculus
ggggtcctcgtaggtacgcacgaca

SEQ ID NO: 248707 - DNA, 25 bp, Mus musculus
tcctcgtaggtacgcacgacaggcg

SEQ ID NO: 248708 - DNA, 25 bp, Mus musculus
cgcgcttcgacgaggtggtgtcgca

SEQ ID NO: 248709 - DNA, 25 bp, Mus musculus
aagctgtgccgtgctcggagggcgc

SEQ ID NO: 248710 - DNA, 25 bp, Mus musculus
gcggccatcgtcatcctactgctga

SEQ ID NO: 248711 - DNA, 25 bp, Mus musculus
cgcgaacttgatccgtcctggctca

SEQ ID NO: 248712 - DNA, 25 bp, Mus musculus
cgcttggtccgctcgcgaacttgat

SEQ ID NO: 248713 - DNA, 25 bp, Mus musculus
cacctaggcggaaaccctggagacg

SEQ ID NO: 248714 - DNA, 25 bp, Mus musculus
aacatcttccggctgactggggacc

SEQ ID NO: 248715 - DNA, 25 bp, Mus musculus
ctcaccgacgctgggcctttaaggg

SEQ ID NO: 248716 - DNA, 25 bp, Mus musculus
tgtaaagtccggctgctcaccgacg

SEQ ID NO: 248717 - DNA, 25 bp, Mus musculus
ccgtccacgcgggatgtaaagtccg

SEQ ID NO: 248718 - DNA, 25 bp, Mus musculus
tgggtcctcagttgaccgtccacgc

SEQ ID NO: 248719 - DNA, 25 bp, Mus musculus
gcttgcgatggccagacacacccat

SEQ ID NO: 248720 - DNA, 25 bp, Mus musculus
ccattcggctctcggtcgttccgga

SEQ ID NO: 248721 - DNA, 25 bp, Mus musculus
aagacgcgctcctgtgctggtgagc

SEQ ID NO: 248722 - DNA, 25 bp, Mus musculus
ctcagcgagcgctggcgtaactgcc

SEQ ID NO: 248723 - DNA, 25 bp, Mus musculus
tgctgaagatctggaagacgcgctc

SEQ ID NO: 248724 - DNA, 25 bp, Mus musculus
acgaaactgcgtccgactccgccca

SEQ ID NO: 248725 - DNA, 25 bp, Mus musculus
ccttccacgctctgggtgtcatggc

SEQ ID NO: 248726 - DNA, 25 bp, Mus musculus
gctgtgctgcttgtgcccgtgcctc

SEQ ID NO: 248727 - DNA, 25 bp, Mus musculus
cggaatcgggcactcagctatttgc

SEQ ID NO: 248728 - DNA, 25 bp, Mus musculus
tcgggcactcagctatttgcagatg

SEQ ID NO: 248729 - DNA, 25 bp, Mus musculus
ctatttgcagatgcgagcgttgtgg

SEQ ID NO: 248730 - DNA, 25 bp, Mus musculus
agcgttgtggagcagcaccggatcc

SEQ ID NO: 248731 - DNA, 25 bp, Mus musculus
caccggatccagagcggtgactgta

SEQ ID NO: 248732 - DNA, 25 bp, Mus musculus
gcggtgactgtagacctgggacaca

SEQ ID NO: 248733 - DNA, 25 bp, Mus musculus
ctgtagacctgggacacaggtgaga

SEQ ID NO: 248734 - DNA, 25 bp, Mus musculus
cacaggtgagaaacggtgtgagttc

SEQ ID NO: 248735 - DNA, 25 bp, Mus musculus
tgtgagttcgcggttttcacgcggc

SEQ ID NO: 248736 - DNA, 25 bp, Mus musculus
tccgcccacaggagtgctggccaat

SEQ ID NO: 248737 - DNA, 25 bp, Mus musculus
tgctggccaatgaggcgctgcccag

SEQ ID NO: 248738 - DNA, 25 bp, Mus musculus
cgggtcttttgagctgttcctgcgt

SEQ ID NO: 248739 - DNA, 25 bp, Mus musculus
cgggtctttacgtaggcttgcgcct

SEQ ID NO: 248740 - DNA, 25 bp, Mus musculus
catgcgcgggtctttacgtaggctt

SEQ ID NO: 248741 - DNA, 25 bp, Mus musculus
cctccagacacgcgcggagtcagaa

SEQ ID NO: 248742 - DNA, 25 bp, Mus musculus
ttcggccggcgctggtctctagcca

SEQ ID NO: 248743 - DNA, 25 bp, Mus musculus
tagccagcgacgacttggtgttccc

SEQ ID NO: 248744 - DNA, 25 bp, Mus musculus
ttcctgcgtgtgctgtggtaagtga

SEQ ID NO: 248745 - DNA, 25 bp, Mus musculus
aggcgcgctggttaaggcgacaaaa

SEQ ID NO: 248746 - DNA, 25 bp, Mus musculus
ctggttaaggcgacaaaagtcgtgc

SEQ ID NO: 248747 - DNA, 25 bp, Mus musculus
cttggtgcttaaggggcaaccgcgc

SEQ ID NO: 248748 - DNA, 25 bp, Mus musculus
cgacaaaagtcgtgccttcttggtg

SEQ ID NO: 248749 - DNA, 25 bp, Mus musculus
tggtctctagccagcgacgacttgg

SEQ ID NO: 248750 - DNA, 25 bp, Mus musculus
cttcttggtgcttaaggggcaaccg

SEQ ID NO: 248751 - DNA, 25 bp, Mus musculus
tttacgtaggcttgcgccttggcgc

SEQ ID NO: 248752 - DNA, 25 bp, Mus musculus
gccgagtgccgggactgctgtccac

SEQ ID NO: 248753 - DNA, 25 bp, Mus musculus
gcaggagggtggagttcacttttcc

SEQ ID NO: 248754 - DNA, 25 bp, Mus musculus
cagaatccggaaccaggcccgggag

SEQ ID NO: 248755 - DNA, 25 bp, Mus musculus
cttgatggcctgcatctgggccgct

SEQ ID NO: 248756 - DNA, 25 bp, Mus musculus
ccacccaaagctggggaaaactgca

SEQ ID NO: 248757 - DNA, 25 bp, Mus musculus
aactgcagagaaacaggaaatggcc

SEQ ID NO: 248758 - DNA, 25 bp, Mus musculus
aggaaatggccgctccactcacatc

SEQ ID NO: 248759 - DNA, 25 bp, Mus musculus
cgttcctggcttccacgggctttcg

SEQ ID NO: 248760 - DNA, 25 bp, Mus musculus
aagctcggcaacagtcggctccagc

SEQ ID NO: 248761 - DNA, 25 bp, Mus musculus
cgccatcttggcacgctaaagcgtc

SEQ ID NO: 248762 - DNA, 25 bp, Mus musculus
cacgctaaagcgtcccggttgtgac

SEQ ID NO: 248763 - DNA, 25 bp, Mus musculus
ttgtgaccaggtttaggaagccctc

SEQ ID NO: 248764 - DNA, 25 bp, Mus musculus
agccctctgaatcctggggttacgg

SEQ ID NO: 248765 - DNA, 25 bp, Mus musculus
gctctacgccagctcgaggcttttc

SEQ ID NO: 248766 - DNA, 25 bp, Mus musculus
tgaccgtgtaagcaagggtaccttc

SEQ ID NO: 248767 - DNA, 25 bp, Mus musculus
tcgccagcgctgctgttggacagca

SEQ ID NO: 248768 - DNA, 25 bp, Mus musculus
agcgttcgctcttcagctgtcgcca

SEQ ID NO: 248769 - DNA, 25 bp, Mus musculus
aggggacctgaacaatccagcgttc

SEQ ID NO: 248770 - DNA, 25 bp, Mus musculus
tatttccctcacatggccgcagtgg

SEQ ID NO: 248771 - DNA, 25 bp, Mus musculus
tcacgaccgagaaccgaggacacag

SEQ ID NO: 248772 - DNA, 25 bp, Mus musculus
gttcgtacggcacatggcagccttg

SEQ ID NO: 248773 - DNA, 25 bp, Mus musculus
cagtgctgatggtctacaatagttc

SEQ ID NO: 248774 - DNA, 25 bp, Mus musculus
tacaccaccgcttcgggcatcagtg

SEQ ID NO: 248775 - DNA, 25 bp, Mus musculus
accacaccagctcggcaggggagta

SEQ ID NO: 248776 - DNA, 25 bp, Mus musculus
tcgcggaatagctcctctggaactt

SEQ ID NO: 248777 - DNA, 25 bp, Mus musculus
gcgtagtacttgacctcgcggaata

SEQ ID NO: 248778 - DNA, 25 bp, Mus musculus
tcgatgtcgcccaccgcgtagtact

SEQ ID NO: 248779 - DNA, 25 bp, Mus musculus
cccttggcaagggacacgctcagca

SEQ ID NO: 248780 - DNA, 25 bp, Mus musculus
gcttcagaaggtaggttcccacatc

SEQ ID NO: 248781 - DNA, 25 bp, Mus musculus
acgccactttccctgtgtcgttatt

SEQ ID NO: 248782 - DNA, 25 bp, Mus musculus
cctgtgtcgttattctcaactcttc

SEQ ID NO: 248783 - DNA, 25 bp, Mus musculus
cttcaccattagaggacgccagatg

SEQ ID NO: 248784 - DNA, 25 bp, Mus musculus
tagaggacgccagatgcaacgcagc

SEQ ID NO: 248785 - DNA, 25 bp, Mus musculus
tagtctccaactcatgcgcacttca

SEQ ID NO: 248786 - DNA, 25 bp, Mus musculus
atgcgcacttcacttgcaggaaagc

SEQ ID NO: 248787 - DNA, 25 bp, Mus musculus
ttcacttgcaggaaagccgcccgag

SEQ ID NO: 248788 - DNA, 25 bp, Mus musculus
atgcaggtgctaaggggctcatgct

SEQ ID NO: 248789 - DNA, 25 bp, Mus musculus
ggctcatgctatcagcctgaggctg

SEQ ID NO: 248790 - DNA, 25 bp, Mus musculus
ctgagtgtgaaccaaacaccgcgtc

SEQ ID NO: 248791 - DNA, 25 bp, Mus musculus
tgcatagaggatgcttcagaaggta

SEQ ID NO: 248792 - DNA, 25 bp, Mus musculus
agatgcaacgcagccaaccctagtc

SEQ ID NO: 248793 - DNA, 25 bp, Mus musculus
cccgttaccctactctgcatagagg

SEQ ID NO: 248794 - DNA, 25 bp, Mus musculus
ccagcgtctcattgccaagggcgtc

SEQ ID NO: 248795 - DNA, 25 bp, Mus musculus
gggcgaccttcccagcgtctcattg

SEQ ID NO: 248796 - DNA, 25 bp, Mus musculus
gctcgctgaggagctctccggttct

SEQ ID NO: 248797 - DNA, 25 bp, Mus musculus
ccctccctagcccagctgtttcgga

SEQ ID NO: 248798 - DNA, 25 bp, Mus musculus
ccaggtcgcctttctgagatggggc

SEQ ID NO: 248799 - DNA, 25 bp, Mus musculus
ggggtctccgcagcacagctccagg

SEQ ID NO: 248800 - DNA, 25 bp, Mus musculus
cttcgctgccctggtgagaggacat

SEQ ID NO: 248801 - DNA, 25 bp, Mus musculus
tgttgagagcccaggcttgagacgt

SEQ ID NO: 248802 - DNA, 25 bp, Mus musculus
gtcgcgctgttgagagcccaggctt

SEQ ID NO: 248803 - DNA, 25 bp, Mus musculus
cctcaaaatggacgaaggcggtggc

SEQ ID NO: 248804 - DNA, 25 bp, Mus musculus
cgcctttctgagatggggccactct

SEQ ID NO: 248805 - DNA, 25 bp, Mus musculus
acttctcttagtcccggcgttcagc

SEQ ID NO: 248806 - DNA, 25 bp, Mus musculus
tggttttgtgtcacgtgatggcgcc

SEQ ID NO: 248807 - DNA, 25 bp, Mus musculus
ttagtcccggcgttcagcccagtcg

SEQ ID NO: 248808 - DNA, 25 bp, Mus musculus
cctgattggcgggatgcactgattg

SEQ ID NO: 248809 - DNA, 25 bp, Mus musculus
tccgttcagagttcccggagtggcc

SEQ ID NO: 248810 - DNA, 25 bp, Mus musculus
cgacgccctgattggcgggatgcac

SEQ ID NO: 248811 - DNA, 25 bp, Mus musculus
cacactgattggtccgacgccctga

SEQ ID NO: 248812 - DNA, 25 bp, Mus musculus
tccgccggagaaagcacactgattg

SEQ ID NO: 248813 - DNA, 25 bp, Mus musculus
tcacgcgtcagctaagcgccgggct

SEQ ID NO: 248814 - DNA, 25 bp, Mus musculus
gggctggcctcacgcgtcagctaag

SEQ ID NO: 248815 - DNA, 25 bp, Mus musculus
cgcgcagctaacgggccgggcaaac

SEQ ID NO: 248816 - DNA, 25 bp, Mus musculus
acaatgacgtgcctccatccgggca

SEQ ID NO: 248817 - DNA, 25 bp, Mus musculus
ggggacaatgacgtgcctccatccg

SEQ ID NO: 248818 - DNA, 25 bp, Mus musculus
aggcgggagcttacctgacccggct

SEQ ID NO: 248819 - DNA, 25 bp, Mus musculus
ctgaggccgcgaaccagggacacgc

SEQ ID NO: 248820 - DNA, 25 bp, Mus musculus
cggctacactgtcccggcgtgcaca

SEQ ID NO: 248821 - DNA, 25 bp, Mus musculus
gccgcttccgttcagagttcccgga

SEQ ID NO: 248822 - DNA, 25 bp, Mus musculus
cgcgcagtgggcgttactaacggac

SEQ ID NO: 248823 - DNA, 25 bp, Mus musculus
tgggcgttactaacggacagcaccg

SEQ ID NO: 248824 - DNA, 25 bp, Mus musculus
cggagccggcggaagttctatctcc

SEQ ID NO: 248825 - DNA, 25 bp, Mus musculus
gccggcggaagttctatctccacca

SEQ ID NO: 248826 - DNA, 25 bp, Mus musculus
ggcggaagttctatctccaccaggc

SEQ ID NO: 248827 - DNA, 25 bp, Mus musculus
gaagttctatctccaccaggcgcaa

SEQ ID NO: 248828 - DNA, 25 bp, Mus musculus
ccaccaggcgcaagaggccaatgtg

SEQ ID NO: 248829 - DNA, 25 bp, Mus musculus
gcgcaagaggccaatgtgtaacttc

SEQ ID NO: 248830 - DNA, 25 bp, Mus musculus
aggccaatgtgtaacttcctcccgg

SEQ ID NO: 248831 - DNA, 25 bp, Mus musculus
caatgtgtaacttcctcccggggag

SEQ ID NO: 248832 - DNA, 25 bp, Mus musculus
gggaggggacacttccagttactgc

SEQ ID NO: 248833 - DNA, 25 bp, Mus musculus
ggggacacttccagttactgcgccc

SEQ ID NO: 248834 - DNA, 25 bp, Mus musculus
gtgcgcctgcgagctgtccctgcat

SEQ ID NO: 248835 - DNA, 25 bp, Mus musculus
ctgtccctgcatcccgcgcgcagtg

SEQ ID NO: 248836 - DNA, 25 bp, Mus musculus
cccgcagtggatcagccaatcattt

SEQ ID NO: 248837 - DNA, 25 bp, Mus musculus
tgacttctgttttgcgccacttccc

SEQ ID NO: 248838 - DNA, 25 bp, Mus musculus
ccgaggccgcttttcgcttcttgtt

SEQ ID NO: 248839 - DNA, 25 bp, Mus musculus
cccgtttgtgggcatttgtatttct

SEQ ID NO: 248840 - DNA, 25 bp, Mus musculus
agcgtctacgctctacccgtttgtg

SEQ ID NO: 248841 - DNA, 25 bp, Mus musculus
aactcgggcccagagctgtagggca

SEQ ID NO: 248842 - DNA, 25 bp, Mus musculus
acctaagatcctaggccgcctcggg

SEQ ID NO: 248843 - DNA, 25 bp, Mus musculus
tgttcatatgagttcctgcgcgcca

SEQ ID NO: 248844 - DNA, 25 bp, Mus musculus
agtcccacggttcgctgttcatatg

SEQ ID NO: 248845 - DNA, 25 bp, Mus musculus
ggttactatccacgctccgaacggc

SEQ ID NO: 248846 - DNA, 25 bp, Mus musculus
gaccggcagagcgaggttactatcc

SEQ ID NO: 248847 - DNA, 25 bp, Mus musculus
ctcttgtgttacttccggcttgggg

SEQ ID NO: 248848 - DNA, 25 bp, Mus musculus
gggacttccgttggctcttgtgtta

SEQ ID NO: 248849 - DNA, 25 bp, Mus musculus
acagaaacttcctggtcactggggc

SEQ ID NO: 248850 - DNA, 25 bp, Mus musculus
gccggtacatgcaggttggaagctc

SEQ ID NO: 248851 - DNA, 25 bp, Mus musculus
acaggccgtgcacttgaaacccagc

SEQ ID NO: 248852 - DNA, 25 bp, Mus musculus
tctccgggcgcattctatagagttc

SEQ ID NO: 248853 - DNA, 25 bp, Mus musculus
tccatggagcaaaccgaaggcgtga

SEQ ID NO: 248854 - DNA, 25 bp, Mus musculus
aggagacgcgtcttttcccgagagc

SEQ ID NO: 248855 - DNA, 25 bp, Mus musculus
gaggtcttggcatgccttcgctagc

SEQ ID NO: 248856 - DNA, 25 bp, Mus musculus
gccaatcaccggtaaagaggtcttg

SEQ ID NO: 248857 - DNA, 25 bp, Mus musculus
gggctggtctaacgtcaccaacttg

SEQ ID NO: 248858 - DNA, 25 bp, Mus musculus
tgctgctggcgttccggaaaatgaa

SEQ ID NO: 248859 - DNA, 25 bp, Mus musculus
agcagccgccttctttctgactctg

SEQ ID NO: 248860 - DNA, 25 bp, Mus musculus
tacatcggcatggtgggaacccaag

SEQ ID NO: 248861 - DNA, 25 bp, Mus musculus
ccatgatagggctttacctggtaca

SEQ ID NO: 248862 - DNA, 25 bp, Mus musculus
tcagtcgccgtagacaaaattcgtt

SEQ ID NO: 248863 - DNA, 25 bp, Mus musculus
aaccaatgggtgttccaggagacgc

SEQ ID NO: 248864 - DNA, 25 bp, Mus musculus
gattaacctgggacctccgttgcca

SEQ ID NO: 248865 - DNA, 25 bp, Mus musculus
cgcacttccgcctcgctagccggcg

SEQ ID NO: 248866 - DNA, 25 bp, Mus musculus
agccttagggaacaccgcacttccg

SEQ ID NO: 248867 - DNA, 25 bp, Mus musculus
gcagccttagggaacaccgcacttc

SEQ ID NO: 248868 - DNA, 25 bp, Mus musculus
ggcagcagccttagggaacaccgca

SEQ ID NO: 248869 - DNA, 25 bp, Mus musculus
gctccgaggcagcagccttagggaa

SEQ ID NO: 248870 - DNA, 25 bp, Mus musculus
tggcgggaactgcttctcctgggcc

SEQ ID NO: 248871 - DNA, 25 bp, Mus musculus
agcgctggcgggaactgcttctcct

SEQ ID NO: 248872 - DNA, 25 bp, Mus musculus
ctcagcagcgctggcgggaactgct

SEQ ID NO: 248873 - DNA, 25 bp, Mus musculus
tagatgaagaagctcagcagcgctg

SEQ ID NO: 248874 - DNA, 25 bp, Mus musculus
gggttgtagatgaagaagctcagca

SEQ ID NO: 248875 - DNA, 25 bp, Mus musculus
ttacctctccctcgcgcggcccgaa

SEQ ID NO: 248876 - DNA, 25 bp, Mus musculus
acctccgttgccaggacgggctgcg

SEQ ID NO: 248877 - DNA, 25 bp, Mus musculus
taacctgggacctccgttgccagga

SEQ ID NO: 248878 - DNA, 25 bp, Mus musculus
ctctagtcctgtgcacgcattcgga

SEQ ID NO: 248879 - DNA, 25 bp, Mus musculus
tcggcgggaaataggaactgtcaac

SEQ ID NO: 248880 - DNA, 25 bp, Mus musculus
caacgcgtttgtggaacattagatc

SEQ ID NO: 248881 - DNA, 25 bp, Mus musculus
ctcatcgtggccatggaacaccttc

SEQ ID NO: 248882 - DNA, 25 bp, Mus musculus
cccggcagaagcctcgcagattcta

SEQ ID NO: 248883 - DNA, 25 bp, Mus musculus
tgaaggctcgacctcccatcgtctt

SEQ ID NO: 248884 - DNA, 25 bp, Mus musculus
tgtcagcctgagtccctacacttgg

SEQ ID NO: 248885 - DNA, 25 bp, Mus musculus
gcattcggacttctcagcctggctc

SEQ ID NO: 248886 - DNA, 25 bp, Mus musculus
cctcccggcgcaggtagaaaagctc

SEQ ID NO: 248887 - DNA, 25 bp, Mus musculus
ccgaggtctgactctccggaagtgt

SEQ ID NO: 248888 - DNA, 25 bp, Mus musculus
cagcccgtacgaacctgctggaaga

SEQ ID NO: 248889 - DNA, 25 bp, Mus musculus
cgccactaccggctctcaagagtga

SEQ ID NO: 248890 - DNA, 25 bp, Mus musculus
gggccagaagccaccatgtcggata

SEQ ID NO: 248891 - DNA, 25 bp, Mus musculus
cgtctcagtccttttcgggctgtca

SEQ ID NO: 248892 - DNA, 25 bp, Mus musculus
ccacttccgcaaacaggtgcaggtg

SEQ ID NO: 248893 - DNA, 25 bp, Mus musculus
caccttgccgcctatggctgagagg

SEQ ID NO: 248894 - DNA, 25 bp, Mus musculus
ggctcccggagtcagtatggattga

SEQ ID NO: 248895 - DNA, 25 bp, Mus musculus
attggctggtccaggtgtcggtccc

SEQ ID NO: 248896 - DNA, 25 bp, Mus musculus
tcagctctacgtcacatgacgcagc

SEQ ID NO: 248897 - DNA, 25 bp, Mus musculus
catgacgcagcccatcatggcggcg

SEQ ID NO: 248898 - DNA, 25 bp, Mus musculus
aaggatgatgctggctccgaggcca

SEQ ID NO: 248899 - DNA, 25 bp, Mus musculus
agcggcggatgcagaccaggaacaa

SEQ ID NO: 248900 - DNA, 25 bp, Mus musculus
caggaacaaggttgacgtttggcta

SEQ ID NO: 248901 - DNA, 25 bp, Mus musculus
aagagacgtgtgtcccgaagcagcc

SEQ ID NO: 248902 - DNA, 25 bp, Mus musculus
gctcctgctcctgacggtcggctgt

SEQ ID NO: 248903 - DNA, 25 bp, Mus musculus
ggatgcccgcgatctcagggagatt

SEQ ID NO: 248904 - DNA, 25 bp, Mus musculus
tctcagggagatttcttgccgcagg

SEQ ID NO: 248905 - DNA, 25 bp, Mus musculus
accgactgactgaaggcggcgaccc

SEQ ID NO: 248906 - DNA, 25 bp, Mus musculus
agatggaggaggtcctcacggtgac

SEQ ID NO: 248907 - DNA, 25 bp, Mus musculus
cgcagaagacgtgcaccgtctgcta

SEQ ID NO: 248908 - DNA, 25 bp, Mus musculus
ccatccttgaccacttcgcccggga

SEQ ID NO: 248909 - DNA, 25 bp, Mus musculus
gggacgcatccagcagcgctgcctt

SEQ ID NO: 248910 - DNA, 25 bp, Mus musculus
accaacagcagggacgcatccagca

SEQ ID NO: 248911 - DNA, 25 bp, Mus musculus
tcaagcccgacaccaacagcaggga

SEQ ID NO: 248912 - DNA, 25 bp, Mus musculus
agtggactgctctcaagcccgacac

SEQ ID NO: 248913 - DNA, 25 bp, Mus musculus
tcgactttgaacagcagtggactgc

SEQ ID NO: 248914 - DNA, 25 bp, Mus musculus
ctcggaggtcgactttgaacagcag

SEQ ID NO: 248915 - DNA, 25 bp, Mus musculus
gggactcggaggtcgactttgaaca

SEQ ID NO: 248916 - DNA, 25 bp, Mus musculus
ctaacttacctgaggatgcagagcc

SEQ ID NO: 248917 - DNA, 25 bp, Mus musculus
ccgtctgctaacttacctgaggatg

SEQ ID NO: 248918 - DNA, 25 bp, Mus musculus
gtgcaccgtctgctaacttacctga

SEQ ID NO: 248919 - DNA, 25 bp, Mus musculus
agcagtggactgctctcaagcccga

SEQ ID NO: 248920 - DNA, 25 bp, Mus musculus
ccttccaggcactgcgcgaggtcat

SEQ ID NO: 248921 - DNA, 25 bp, Mus musculus
atacttactatgtccagcagccgcc

SEQ ID NO: 248922 - DNA, 25 bp, Mus musculus
gctgaccgccaccatacttactatg

SEQ ID NO: 248923 - DNA, 25 bp, Mus musculus
tatatcaagtcgctgaccgccacca

SEQ ID NO: 248924 - DNA, 25 bp, Mus musculus
ggccaagaactatatcaagtcgctg

SEQ ID NO: 248925 - DNA, 25 bp, Mus musculus
ctcacgctggccaagaactatatca

SEQ ID NO: 248926 - DNA, 25 bp, Mus musculus
actgcgcgaggtcatcccgcacgtg

SEQ ID NO: 248927 - DNA, 25 bp, Mus musculus
ataaactcaacaatgccttccaggc

SEQ ID NO: 248928 - DNA, 25 bp, Mus musculus
ggcagcggatgcataaactcaacaa

SEQ ID NO: 248929 - DNA, 25 bp, Mus musculus
agagaggcagcggatgcataaactc

SEQ ID NO: 248930 - DNA, 25 bp, Mus musculus
ggccgcagggagaacagtgttcaga

SEQ ID NO: 248931 - DNA, 25 bp, Mus musculus
cacgtgcgggctgacaagaagctct

SEQ ID NO: 248932 - DNA, 25 bp, Mus musculus
aagatcgagaccctcacgctggcca

SEQ ID NO: 248933 - DNA, 25 bp, Mus musculus
agaccctcacgctggccaagaacta

SEQ ID NO: 248934 - DNA, 25 bp, Mus musculus
cggacctgcgtggacctcattatct

SEQ ID NO: 248935 - DNA, 25 bp, Mus musculus
ccgacgaggtgatagccaccatctt

SEQ ID NO: 248936 - DNA, 25 bp, Mus musculus
ctgctgcagatccagcggaatgtca

SEQ ID NO: 248937 - DNA, 25 bp, Mus musculus
ccctggtgctcaacctgctgcagat

SEQ ID NO: 248938 - DNA, 25 bp, Mus musculus
cggagcctagtgctcttctcatttg

SEQ ID NO: 248939 - DNA, 25 bp, Mus musculus
accacgacttggtgcagcggagcct

SEQ ID NO: 248940 - DNA, 25 bp, Mus musculus
tctggaactatccaagcgcgggcgc

SEQ ID NO: 248941 - DNA, 25 bp, Mus musculus
ggctgcacgaccacgtctggaacta

SEQ ID NO: 248942 - DNA, 25 bp, Mus musculus
gcgtgtaccttccatgctgtgcctg

SEQ ID NO: 248943 - DNA, 25 bp, Mus musculus
gcctgccttataagcggaaaccgcg

SEQ ID NO: 248944 - DNA, 25 bp, Mus musculus
gctccggtggcagcctgccttataa

SEQ ID NO: 248945 - DNA, 25 bp, Mus musculus
tgcatacgtcatatgggccgccctc

SEQ ID NO: 248946 - DNA, 25 bp, Mus musculus
cgcaatagggcagcatcggaccatc

SEQ ID NO: 248947 - DNA, 25 bp, Mus musculus
attatctcagaaaccgaggtccggc

SEQ ID NO: 248948 - DNA, 25 bp, Mus musculus
tgaagcacttctcgtctacaccggc

SEQ ID NO: 248949 - DNA, 25 bp, Mus musculus
cgatcggagtctccacggcccttgt

SEQ ID NO: 248950 - DNA, 25 bp, Mus musculus
gccgcaatttctccggctcggggtg

SEQ ID NO: 248951 - DNA, 25 bp, Mus musculus
tggctgctgcgctcagccgcaattt

SEQ ID NO: 248952 - DNA, 25 bp, Mus musculus
cctggaagctcacgattggctgctg

SEQ ID NO: 248953 - DNA, 25 bp, Mus musculus
tgacgcaactgcctggaagctcacg

SEQ ID NO: 248954 - DNA, 25 bp, Mus musculus
actcagcgttgatcggccagattcg

SEQ ID NO: 248955 - DNA, 25 bp, Mus musculus
tccttcttgcctgaagcacttctcg

SEQ ID NO: 248956 - DNA, 25 bp, Mus musculus
gcgggccggaagcaataatcaactc

SEQ ID NO: 248957 - DNA, 25 bp, Mus musculus
tcctcggttttagctacagtccggc

SEQ ID NO: 248958 - DNA, 25 bp, Mus musculus
gaggcttctgtactcctcggtttta

SEQ ID NO: 248959 - DNA, 25 bp, Mus musculus
ttacggggacatcgcgccgcactta

SEQ ID NO: 248960 - DNA, 25 bp, Mus musculus
acggcccttgtcaccgatgttacgg

SEQ ID NO: 248961 - DNA, 25 bp, Mus musculus
cggccagattcggagtgacgcaact

SEQ ID NO: 248962 - DNA, 25 bp, Mus musculus
ggccgggagtcagaacttctctgga

SEQ ID NO: 248963 - DNA, 25 bp, Mus musculus
ttctctggaagtccaagatccattg

SEQ ID NO: 248964 - DNA, 25 bp, Mus musculus
ccaagatccattgtggggcgggact

SEQ ID NO: 248965 - DNA, 25 bp, Mus musculus
gcgggactgaacgaggacaacaccc

SEQ ID NO: 248966 - DNA, 25 bp, Mus musculus
tcactgggccgagctgcccgggaca

SEQ ID NO: 248967 - DNA, 25 bp, Mus musculus
gcctacaacctggaggccggccagg

SEQ ID NO: 248968 - DNA, 25 bp, Mus musculus
tacctcgtcacaggtgggcccgcag

SEQ ID NO: 248969 - DNA, 25 bp, Mus musculus
cgtgaacttagtgtcggagggttca

SEQ ID NO: 248970 - DNA, 25 bp, Mus musculus
ggagggttcacacttggcttctaga

SEQ ID NO: 248971 - DNA, 25 bp, Mus musculus
agtcgcccggggctgatcagcactc

SEQ ID NO: 248972 - DNA, 25 bp, Mus musculus
ccgggtctataacatccacagtcga

SEQ ID NO: 248973 - DNA, 25 bp, Mus musculus
cacagtcgaacggtcacccggtatc

SEQ ID NO: 248974 - DNA, 25 bp, Mus musculus
tgcccggtctgcaggtaagtctcta

SEQ ID NO: 248975 - DNA, 25 bp, Mus musculus
gtatcctgccaactccatcgtcgtg

SEQ ID NO: 248976 - DNA, 25 bp, Mus musculus
tacccggtacgtgttctccgtgagc

SEQ ID NO: 248977 - DNA, 25 bp, Mus musculus
acaatggtcagctgcttgtccgggc

SEQ ID NO: 248978 - DNA, 25 bp, Mus musculus
cgttcctggcctcgaaccctggagt

SEQ ID NO: 248979 - DNA, 25 bp, Mus musculus
tcagcctggaaccacagagtcccgg

SEQ ID NO: 248980 - DNA, 25 bp, Mus musculus
acttgagactgagtggtccttgaga

SEQ ID NO: 248981 - DNA, 25 bp, Mus musculus
ccacagctgtcagcgggagagagtc

SEQ ID NO: 248982 - DNA, 25 bp, Mus musculus
atgtcaaaactttgcggcgcttcgg

SEQ ID NO: 248983 - DNA, 25 bp, Mus musculus
cgcttcggtctgtaaggagctgcga

SEQ ID NO: 248984 - DNA, 25 bp, Mus musculus
ctgcgaggtagacgtagcctgccaa

SEQ ID NO: 248985 - DNA, 25 bp, Mus musculus
ccacctgaaatggactgatgggcgt

SEQ ID NO: 248986 - DNA, 25 bp, Mus musculus
ggacggagtgaacgaagtcgcccta

SEQ ID NO: 248987 - DNA, 25 bp, Mus musculus
aagtcgccctagctgtgtccgccag

SEQ ID NO: 248988 - DNA, 25 bp, Mus musculus
tggagttcccaagtctccgggcctc

SEQ ID NO: 248989 - DNA, 25 bp, Mus musculus
aacctggaagagacttgttgcgcta

SEQ ID NO: 248990 - DNA, 25 bp, Mus musculus
gcgaaggcgcccagacggcaaacca

SEQ ID NO: 248991 - DNA, 25 bp, Mus musculus
acgtcgtggagcagcttagccgctc

SEQ ID NO: 248992 - DNA, 25 bp, Mus musculus
agccgacgctttctctgaccgtttc

SEQ ID NO: 248993 - DNA, 25 bp, Mus musculus
ctctgaccgtttccgaagcccagtt

SEQ ID NO: 248994 - DNA, 25 bp, Mus musculus
ttcctaaggagccttggggatcctg

SEQ ID NO: 248995 - DNA, 25 bp, Mus musculus
gccgcctgggccagcttagcaatgc

SEQ ID NO: 248996 - DNA, 25 bp, Mus musculus
cgaacgccggcggaccaatcagaga

SEQ ID NO: 248997 - DNA, 25 bp, Mus musculus
ctccaagcttaagaaagggcgcgcg

SEQ ID NO: 248998 - DNA, 25 bp, Mus musculus
cacaggcaaggacaccatgggcgac

SEQ ID NO: 248999 - DNA, 25 bp, Mus musculus
cagcgagaagccatccgagagctca

SEQ ID NO: 249000 - DNA, 25 bp, Mus musculus
aggacagcccgatacctggcagccg

SEQ ID NO: 249001 - DNA, 25 bp, Mus musculus
gtgagcacacaggtcagcgagatgc

SEQ ID NO: 249002 - DNA, 25 bp, Mus musculus
ccagcgacccatgctgaagtgagca

SEQ ID NO: 249003 - DNA, 25 bp, Mus musculus
ctcaaggaccgcttggagagcctcg

SEQ ID NO: 249004 - DNA, 25 bp, Mus musculus
tagctccgcagtggcggctccgtct

SEQ ID NO: 249005 - DNA, 25 bp, Mus musculus
ccaagagcaggaggcaagcgaacca

SEQ ID NO: 249006 - DNA, 25 bp, Mus musculus
agcaggaggcaagcgaaccagaaga

SEQ ID NO: 249007 - DNA, 25 bp, Mus musculus
aggaggcaagcgaaccagaagacga

SEQ ID NO: 249008 - DNA, 25 bp, Mus musculus
aggcaagcgaaccagaagacgagga

SEQ ID NO: 249009 - DNA, 25 bp, Mus musculus
aagcgaaccagaagacgaggacgtc

SEQ ID NO: 249010 - DNA, 25 bp, Mus musculus
cgaaccagaagacgaggacgtcggt

SEQ ID NO: 249011 - DNA, 25 bp, Mus musculus
cgaggacgtcggtggccttggccat

SEQ ID NO: 249012 - DNA, 25 bp, Mus musculus
ttggccatggcgaagcgtggatacc

SEQ ID NO: 249013 - DNA, 25 bp, Mus musculus
cgtggagacgcagcgctcgcctgtc

SEQ ID NO: 249014 - DNA, 25 bp, Mus musculus
ttgtagctccgcagtggcggctccg

SEQ ID NO: 249015 - DNA, 25 bp, Mus musculus
ctccgtctggttgtgcgtggagacg

SEQ ID NO: 249016 - DNA, 25 bp, Mus musculus
cctcgccggacccaagagcaggagg

SEQ ID NO: 249017 - DNA, 25 bp, Mus musculus
cgaagcgtggataccgaggggcgcg

SEQ ID NO: 249018 - DNA, 25 bp, Mus musculus
tagtcggcaggtcccggtaagcgca

SEQ ID NO: 249019 - DNA, 25 bp, Mus musculus
cggtgcgcccgagcttagttctggt

SEQ ID NO: 249020 - DNA, 25 bp, Mus musculus
agtcggtgcagcacgacggctccac

SEQ ID NO: 249021 - DNA, 25 bp, Mus musculus
cacgacggctccacggagaagtgga

SEQ ID NO: 249022 - DNA, 25 bp, Mus musculus
aaggctgtccctgcttgaccgaggt

SEQ ID NO: 249023 - DNA, 25 bp, Mus musculus
tgtccctgcttgaccgaggtccttc

SEQ ID NO: 249024 - DNA, 25 bp, Mus musculus
aggagccctcctaaactagatcagc

SEQ ID NO: 249025 - DNA, 25 bp, Mus musculus
ctagatcagccacactgcagcattt

SEQ ID NO: 249026 - DNA, 25 bp, Mus musculus
actgcagcatttagtcctccgcggc

SEQ ID NO: 249027 - DNA, 25 bp, Mus musculus
agcatttagtcctccgcggcgccgg

SEQ ID NO: 249028 - DNA, 25 bp, Mus musculus
gcttgccgtagctcagcggcctgct

SEQ ID NO: 249029 - DNA, 25 bp, Mus musculus
cccgaaggccgtttgcgacgcgaag

SEQ ID NO: 249030 - DNA, 25 bp, Mus musculus
caaagccatcctggcatctgcgggc

SEQ ID NO: 249031 - DNA, 25 bp, Mus musculus
tcctggctctctgggccagacgctg

SEQ ID NO: 249032 - DNA, 25 bp, Mus musculus
cgggcattggctactgcgcttagag

SEQ ID NO: 249033 - DNA, 25 bp, Mus musculus
actcattggcccgtagttgctaggc

SEQ ID NO: 249034 - DNA, 25 bp, Mus musculus
tgacaacgtacgcagcagcccggaa

SEQ ID NO: 249035 - DNA, 25 bp, Mus musculus
tactgcgcttagagacggcgttcgc

SEQ ID NO: 249036 - DNA, 25 bp, Mus musculus
gacgcggacgcctaggccggattcc

SEQ ID NO: 249037 - DNA, 25 bp, Mus musculus
ggggcaaacgatagccctccactca

SEQ ID NO: 249038 - DNA, 25 bp, Mus musculus
ggaacgtttcctattggctagaaga

SEQ ID NO: 249039 - DNA, 25 bp, Mus musculus
ggcccgtctcaaaatggcgtgctga

SEQ ID NO: 249040 - DNA, 25 bp, Mus musculus
ccgtagttgctaggctgagagcaga

SEQ ID NO: 249041 - DNA, 25 bp, Mus musculus
ctgtctggcctttcggccgcaggaa

SEQ ID NO: 249042 - DNA, 25 bp, Mus musculus
ccaggttagacaccacaaaccagtt

SEQ ID NO: 249043 - DNA, 25 bp, Mus musculus
gtaaaatggtcgctatgacaacgta

SEQ ID NO: 249044 - DNA, 25 bp, Mus musculus
aggcctgagtcctgagctcctggag

SEQ ID NO: 249045 - DNA, 25 bp, Mus musculus
ttggctagaagagaacggggcaaac

SEQ ID NO: 249046 - DNA, 25 bp, Mus musculus
cgaggcagtccctgcttcacacctt

SEQ ID NO: 249047 - DNA, 25 bp, Mus musculus
cccagctgctcgtctgtggtagtta

SEQ ID NO: 249048 - DNA, 25 bp, Mus musculus
ggtcatgaacgatgcctgcctcacg

SEQ ID NO: 249049 - DNA, 25 bp, Mus musculus
taaggttcttctccccgaggcagtc

SEQ ID NO: 249050 - DNA, 25 bp, Mus musculus
cctgcctcacggagtcgcgcaggga

SEQ ID NO: 249051 - DNA, 25 bp, Mus musculus
cccgtagctttatgccccgagtgga

SEQ ID NO: 249052 - DNA, 25 bp, Mus musculus
cccgagtggagattgtgcagaagca

SEQ ID NO: 249053 - DNA, 25 bp, Mus musculus
tgcagaagcacaacacagcagcccg

SEQ ID NO: 249054 - DNA, 25 bp, Mus musculus
gaagcacaacacagcagcccgcagg

SEQ ID NO: 249055 - DNA, 25 bp, Mus musculus
gcaggctgcacatccgagggcacaa

SEQ ID NO: 249056 - DNA, 25 bp, Mus musculus
tccgagggcacaacggcaagatcta

SEQ ID NO: 249057 - DNA, 25 bp, Mus musculus
cggcaagatctacccgtacctggtc

SEQ ID NO: 249058 - DNA, 25 bp, Mus musculus
tacccgtacctggtcatgaacgatg

SEQ ID NO: 249059 - DNA, 25 bp, Mus musculus
tcgtctgtggtagttaaggttcttc

SEQ ID NO: 249060 - DNA, 25 bp, Mus musculus
tccgcagggtccctgggacagtcta

SEQ ID NO: 249061 - DNA, 25 bp, Mus musculus
gatcttgatgctggagccgttccta

SEQ ID NO: 249062 - DNA, 25 bp, Mus musculus
ggggttcgacatctcccgccagcgg

SEQ ID NO: 249063 - DNA, 25 bp, Mus musculus
cgcctcaaggttacggccacgggct

SEQ ID NO: 249064 - DNA, 25 bp, Mus musculus
gctggaaccgtagaaccgagcgctc

SEQ ID NO: 249065 - DNA, 25 bp, Mus musculus
gcggggagccttgaaacagacacca

SEQ ID NO: 249066 - DNA, 25 bp, Mus musculus
acgcacacacaagcggcgcagtcgg

SEQ ID NO: 249067 - DNA, 25 bp, Mus musculus
tcggagctggttcttagtcacaatc

SEQ ID NO: 249068 - DNA, 25 bp, Mus musculus
accaactgatttgcttgtgcgacga

SEQ ID NO: 249069 - DNA, 25 bp, Mus musculus
gggaaccgattgtttcttcagtgtc

SEQ ID NO: 249070 - DNA, 25 bp, Mus musculus
tgcctacctgtcagacggatcttga

SEQ ID NO: 249071 - DNA, 25 bp, Mus musculus
gaagccagggtgttgcatgaaaccc

SEQ ID NO: 249072 - DNA, 25 bp, Mus musculus
tttcaaagctcctgatggaagccag

SEQ ID NO: 249073 - DNA, 25 bp, Mus musculus
ttcagtgtcggacttttcaaagctc

SEQ ID NO: 249074 - DNA, 25 bp, Mus musculus
ttcagacagaacacgccaacaaagg

SEQ ID NO: 249075 - DNA, 25 bp, Mus musculus
ccaacctcaggtaaggagccacagg

SEQ ID NO: 249076 - DNA, 25 bp, Mus musculus
accagagtccgcgaatcgtccgctc

SEQ ID NO: 249077 - DNA, 25 bp, Mus musculus
ttcgcgtcgactgaccagagtccgc

SEQ ID NO: 249078 - DNA, 25 bp, Mus musculus
agccagttcgcgtcgactgaccaga

SEQ ID NO: 249079 - DNA, 25 bp, Mus musculus
ggatctgtcagcctctccctctagg

SEQ ID NO: 249080 - DNA, 25 bp, Mus musculus
gtcacttccgggatctgtcagcctc

SEQ ID NO: 249081 - DNA, 25 bp, Mus musculus
caggcgctccggtcacttccgggat

SEQ ID NO: 249082 - DNA, 25 bp, Mus musculus
acaaaggctacgttctgcgcctgcg

SEQ ID NO: 249083 - DNA, 25 bp, Mus musculus
tagcgctgacgagcggctgcctcac

SEQ ID NO: 249084 - DNA, 25 bp, Mus musculus
ttttgtatgttctatggcacgcggg

SEQ ID NO: 249085 - DNA, 25 bp, Mus musculus
cacgccaacaaaggctacgttctgc

SEQ ID NO: 249086 - DNA, 25 bp, Mus musculus
caagcgccagctgagagcggccgct

SEQ ID NO: 249087 - DNA, 25 bp, Mus musculus
gcagccgctcttcagacagaacacg

SEQ ID NO: 249088 - DNA, 25 bp, Mus musculus
ttctgggctgagctggacttaactg

SEQ ID NO: 249089 - DNA, 25 bp, Mus musculus
gactcgaggcgatgttcaacggtga

SEQ ID NO: 249090 - DNA, 25 bp, Mus musculus
agacccgtgtgcatgggagcctcgt

SEQ ID NO: 249091 - DNA, 25 bp, Mus musculus
cggtgggaagaatcgcagagattcc

SEQ ID NO: 249092 - DNA, 25 bp, Mus musculus
tcgacgccatcgagacggcaaagcc

SEQ ID NO: 249093 - DNA, 25 bp, Mus musculus
cagccttccgggttgttgcgaccgg

SEQ ID NO: 249094 - DNA, 25 bp, Mus musculus
ccagtgaccatacccggcaggggtc

SEQ ID NO: 249095 - DNA, 25 bp, Mus musculus
caggttcctggttccacccagcttg

SEQ ID NO: 249096 - DNA, 25 bp, Mus musculus
ttccacccagcttgggcgagcggac

SEQ ID NO: 249097 - DNA, 25 bp, Mus musculus
cgtgcgatctccgaacgaattctgg

SEQ ID NO: 249098 - DNA, 25 bp, Mus musculus
tgtggtgtctgaggccacctagaag

SEQ ID NO: 249099 - DNA, 25 bp, Mus musculus
tcgactgtccagagtccgcggccga

SEQ ID NO: 249100 - DNA, 25 bp, Mus musculus
gccacctagaagtcaggggactcga

SEQ ID NO: 249101 - DNA, 25 bp, Mus musculus
cttaactgaggtccgggcggcttag

SEQ ID NO: 249102 - DNA, 25 bp, Mus musculus
ggcggtcaatctccaatattccttg

SEQ ID NO: 249103 - DNA, 25 bp, Mus musculus
tttttcactgcggagcgaggatcgc

SEQ ID NO: 249104 - DNA, 25 bp, Mus musculus
gacctaatcaataacgcgcaccacg

SEQ ID NO: 249105 - DNA, 25 bp, Mus musculus
gcgtctactgatggttcatttttca

SEQ ID NO: 249106 - DNA, 25 bp, Mus musculus
tggacgaattcattacttggggacg

SEQ ID NO: 249107 - DNA, 25 bp, Mus musculus
agtgtttcttgtccctagcgccagc

SEQ ID NO: 249108 - DNA, 25 bp, Mus musculus
gtcacttcctctggcggtcaatctc

SEQ ID NO: 249109 - DNA, 25 bp, Mus musculus
ggataccagggtcaagtgtcacttc

SEQ ID NO: 249110 - DNA, 25 bp, Mus musculus
ctattttgaaatgcggcgactgcca

SEQ ID NO: 249111 - DNA, 25 bp, Mus musculus
gctgcttggggactgctattttgaa

SEQ ID NO: 249112 - DNA, 25 bp, Mus musculus
aggaccggccaaaagtcaccgcagc

SEQ ID NO: 249113 - DNA, 25 bp, Mus musculus
tgaaatgcgacctcaggaaagtgtg

SEQ ID NO: 249114 - DNA, 25 bp, Mus musculus
agcttcgcgccatcccagtgagttt

SEQ ID NO: 249115 - DNA, 25 bp, Mus musculus
ccggcttgatcaatagcgtctactg

SEQ ID NO: 249116 - DNA, 25 bp, Mus musculus
gttttctgccactgtcccttccgta

SEQ ID NO: 249117 - DNA, 25 bp, Mus musculus
tacggaattctacaaaggcagcgcc

SEQ ID NO: 249118 - DNA, 25 bp, Mus musculus
gtaaacttggggctcgctctttctc

SEQ ID NO: 249119 - DNA, 25 bp, Mus musculus
acttgcacaggggatggtaaacttg

SEQ ID NO: 249120 - DNA, 25 bp, Mus musculus
tcgagtaccgtatctttggcaatgg

SEQ ID NO: 249121 - DNA, 25 bp, Mus musculus
agcggccttaggtgcttgagtttcc

SEQ ID NO: 249122 - DNA, 25 bp, Mus musculus
cgccggagcggaagccgtcaataaa

SEQ ID NO: 249123 - DNA, 25 bp, Mus musculus
tccctgtccgaggagacacgtagcc

SEQ ID NO: 249124 - DNA, 25 bp, Mus musculus
ggtgcctgaattcctgaccagaata

SEQ ID NO: 249125 - DNA, 25 bp, Mus musculus
aatcgacttcttccgcccggcttgg

SEQ ID NO: 249126 - DNA, 25 bp, Mus musculus
gcctcgaactgacaccggaaccgga

SEQ ID NO: 249127 - DNA, 25 bp, Mus musculus
ttcagcgcggatctcttagaggccc

SEQ ID NO: 249128 - DNA, 25 bp, Mus musculus
cgcgagggccttattctgaagagtt

SEQ ID NO: 249129 - DNA, 25 bp, Mus musculus
cagggacacctaagatgacgcaatc

SEQ ID NO: 249130 - DNA, 25 bp, Mus musculus
agttcgacttggagatcgccgtgga

SEQ ID NO: 249131 - DNA, 25 bp, Mus musculus
atcctcgggacagcaggactgtgtc

SEQ ID NO: 249132 - DNA, 25 bp, Mus musculus
actgctccgtggcaatcctcgggac

SEQ ID NO: 249133 - DNA, 25 bp, Mus musculus
ggttgttcgcgtaattctccagtga

SEQ ID NO: 249134 - DNA, 25 bp, Mus musculus
tgtcacttgaactcggggagacctt

SEQ ID NO: 249135 - DNA, 25 bp, Mus musculus
cgagtctgattctgaccagaggtta

SEQ ID NO: 249136 - DNA, 25 bp, Mus musculus
tcgccagcgtagatcacatcaagtt

SEQ ID NO: 249137 - DNA, 25 bp, Mus musculus
cgccgccatgcaggaaataatcgcc

SEQ ID NO: 249138 - DNA, 25 bp, Mus musculus
actctgagctccgttggctgagtct

SEQ ID NO: 249139 - DNA, 25 bp, Mus musculus
gcgtcgccgcctcttgtgtaagata

SEQ ID NO: 249140 - DNA, 25 bp, Mus musculus
tcagcacagactacggagatcccgc

SEQ ID NO: 249141 - DNA, 25 bp, Mus musculus
agagacagcgttcctgccctcagca

SEQ ID NO: 249142 - DNA, 25 bp, Mus musculus
cctagtgagacgtcctcagagtcga

SEQ ID NO: 249143 - DNA, 25 bp, Mus musculus
tgggacttcccggtgtcacttgaac

SEQ ID NO: 249144 - DNA, 25 bp, Mus musculus
agagctcccaaagtcggctcagcgc

SEQ ID NO: 249145 - DNA, 25 bp, Mus musculus
gccattggagcctctggaccgtcca

SEQ ID NO: 249146 - DNA, 25 bp, Mus musculus
gcctcgcctgcgtaaggtctttcta

SEQ ID NO: 249147 - DNA, 25 bp, Mus musculus
gcgcaactgcctgaattgttttcga

SEQ ID NO: 249148 - DNA, 25 bp, Mus musculus
gaagtttcggggttctgccaatctc

SEQ ID NO: 249149 - DNA, 25 bp, Mus musculus
tccggaaccggaggactcctgattc

SEQ ID NO: 249150 - DNA, 25 bp, Mus musculus
cgtacaaagcccagcaccgagaggt

SEQ ID NO: 249151 - DNA, 25 bp, Mus musculus
cggccacttcctggtagcgcaactg

SEQ ID NO: 249152 - DNA, 25 bp, Mus musculus
gtccaggtcgagcttgttttctaga

SEQ ID NO: 249153 - DNA, 25 bp, Mus musculus
gcccaatgacttcacggaccttttc

SEQ ID NO: 249154 - DNA, 25 bp, Mus musculus
ccttttctgaaaccgaggcggagtg

SEQ ID NO: 249155 - DNA, 25 bp, Mus musculus
ggcggagtgctaccctcttccaaaa

SEQ ID NO: 249156 - DNA, 25 bp, Mus musculus
ttctcagttctcatttcggcaggtg

SEQ ID NO: 249157 - DNA, 25 bp, Mus musculus
aaggccactacggacacagcacaca

SEQ ID NO: 249158 - DNA, 25 bp, Mus musculus
ccgtgtccgtcagctgacagctcga

SEQ ID NO: 249159 - DNA, 25 bp, Mus musculus
cttggatctgaaggacaccaggctc

SEQ ID NO: 249160 - DNA, 25 bp, Mus musculus
aacccgggctcgtccttggatctga

SEQ ID NO: 249161 - DNA, 25 bp, Mus musculus
ggaccgaacctttgcccaagagaga

SEQ ID NO: 249162 - DNA, 25 bp, Mus musculus
agcgcctccgtgacgggacagtctc

SEQ ID NO: 249163 - DNA, 25 bp, Mus musculus
cgtcagccttctggcagtcgagaga

SEQ ID NO: 249164 - DNA, 25 bp, Mus musculus
cgtggacttccgtcgccggaagtga

SEQ ID NO: 249165 - DNA, 25 bp, Mus musculus
gcgaagcacaacagcaactaaggcc

SEQ ID NO: 249166 - DNA, 25 bp, Mus musculus
tgcgccctaatcagcagggagggct

SEQ ID NO: 249167 - DNA, 25 bp, Mus musculus
cctcctggtgtaagatgcgccctaa

SEQ ID NO: 249168 - DNA, 25 bp, Mus musculus
ggagttctttcccaacctctgtcgc

SEQ ID NO: 249169 - DNA, 25 bp, Mus musculus
tgcgacctcgagaaagcgaagcaca

SEQ ID NO: 249170 - DNA, 25 bp, Mus musculus
ccggaagtgacgtaaggcgtcagcc

SEQ ID NO: 249171 - DNA, 25 bp, Mus musculus
taaggccttatctagcgatgctgcg

SEQ ID NO: 249172 - DNA, 25 bp, Mus musculus
taggctccacgcacagcggtgatct

SEQ ID NO: 249173 - DNA, 25 bp, Mus musculus
agctagacagtagcagggacgttcg

SEQ ID NO: 249174 - DNA, 25 bp, Mus musculus
cactggcggaccgagctagacagta

SEQ ID NO: 249175 - DNA, 25 bp, Mus musculus
tctgccagaggcctggaagatccac

SEQ ID NO: 249176 - DNA, 25 bp, Mus musculus
acgcggcgccttctgtctgccagag

SEQ ID NO: 249177 - DNA, 25 bp, Mus musculus
gggaagaatagccacgcggcgcctt

SEQ ID NO: 249178 - DNA, 25 bp, Mus musculus
caagacagggatgggaagaatagcc

SEQ ID NO: 249179 - DNA, 25 bp, Mus musculus
cgtttttagacgcagatgcaagaca

SEQ ID NO: 249180 - DNA, 25 bp, Mus musculus
gggacgctaagcgtttttagacgca

SEQ ID NO: 249181 - DNA, 25 bp, Mus musculus
caggaagaccttgaccctgggactc

SEQ ID NO: 249182 - DNA, 25 bp, Mus musculus
gacccgcaggaagaccttgaccctg

SEQ ID NO: 249183 - DNA, 25 bp, Mus musculus
gggcctaaggtgtccaggacccgca

SEQ ID NO: 249184 - DNA, 25 bp, Mus musculus
ctcaggtaagatccatgcgggtcgc

SEQ ID NO: 249185 - DNA, 25 bp, Mus musculus
gcggtgatctcaggtaagatccatg

SEQ ID NO: 249186 - DNA, 25 bp, Mus musculus
acccggctggacaaaggctagctcc

SEQ ID NO: 249187 - DNA, 25 bp, Mus musculus
ccaggcacccggctggacaaaggct

SEQ ID NO: 249188 - DNA, 25 bp, Mus musculus
ggcgaaaacgcagctcagcctctta

SEQ ID NO: 249189 - DNA, 25 bp, Mus musculus
tagctcccttggagggacgcgcgaa

SEQ ID NO: 249190 - DNA, 25 bp, Mus musculus
ctggacaaaggctagctcccttgga

SEQ ID NO: 249191 - DNA, 25 bp, Mus musculus
cgcgaaggcggcgaaaacgcagctc

SEQ ID NO: 249192 - DNA, 25 bp, Mus musculus
tgccgctgcagtgagccggtgagga

SEQ ID NO: 249193 - DNA, 25 bp, Mus musculus
cgtgctctcggtgcctctcggtgct

SEQ ID NO: 249194 - DNA, 25 bp, Mus musculus
cagcctcttaaagcgcatcagcgtg

SEQ ID NO: 249195 - DNA, 25 bp, Mus musculus
ctcttaaagcgcatcagcgtggtcg

SEQ ID NO: 249196 - DNA, 25 bp, Mus musculus
acgcagctcagcctcttaaagcgca

SEQ ID NO: 249197 - DNA, 25 bp, Mus musculus
aagcgcatcagcgtggtcgggaacc

SEQ ID NO: 249198 - DNA, 25 bp, Mus musculus
ccgctcccaccgcttcagcaccgcg

SEQ ID NO: 249199 - DNA, 25 bp, Mus musculus
caaaggctagctcccttggagggac

SEQ ID NO: 249200 - DNA, 25 bp, Mus musculus
ccgagttccgcatctgctgtgcgca

SEQ ID NO: 249201 - DNA, 25 bp, Mus musculus
cgaccctgccggtgcgtctggaaac

SEQ ID NO: 249202 - DNA, 25 bp, Mus musculus
gagaactaagactggccaccgtctg

SEQ ID NO: 249203 - DNA, 25 bp, Mus musculus
ctcgcaccgcctcggagaactaaga

SEQ ID NO: 249204 - DNA, 25 bp, Mus musculus
agctaagagaggagcgtccgatctc

SEQ ID NO: 249205 - DNA, 25 bp, Mus musculus
tcgacctggcggagagaaagctaag

SEQ ID NO: 249206 - DNA, 25 bp, Mus musculus
ctcagagtctgtgttgctgctcgga

SEQ ID NO: 249207 - DNA, 25 bp, Mus musculus
ccctgaggcgcgaagctcagagtct

SEQ ID NO: 249208 - DNA, 25 bp, Mus musculus
ttcgaaggccgctacgccctctaat

SEQ ID NO: 249209 - DNA, 25 bp, Mus musculus
gcggaaggttcttggccgagccttc

SEQ ID NO: 249210 - DNA, 25 bp, Mus musculus
atgacccgcggttgttctcaccgag

SEQ ID NO: 249211 - DNA, 25 bp, Mus musculus
ctcccggaagtagtagtgagactca

SEQ ID NO: 249212 - DNA, 25 bp, Mus musculus
ggtcaaggcactcagagcccgtggc

SEQ ID NO: 249213 - DNA, 25 bp, Mus musculus
gtgagactcaccaaatgacccttcc

SEQ ID NO: 249214 - DNA, 25 bp, Mus musculus
ccaatcccatcatgcaacgttctga

SEQ ID NO: 249215 - DNA, 25 bp, Mus musculus
ctctctcggaggagctaccggctgt

SEQ ID NO: 249216 - DNA, 25 bp, Mus musculus
gacgtttttacgacagcggctgccg

SEQ ID NO: 249217 - DNA, 25 bp, Mus musculus
agcgcgaggcttcgcgacgttttta

SEQ ID NO: 249218 - DNA, 25 bp, Mus musculus
gccagctccggagtcgctcacaggt

SEQ ID NO: 249219 - DNA, 25 bp, Mus musculus
ccggcgtcagaagagacggctgcca

SEQ ID NO: 249220 - DNA, 25 bp, Mus musculus
ggtaagtctgtcagcagctccgctc

SEQ ID NO: 249221 - DNA, 25 bp, Mus musculus
tagtccacgtggtaagtctgtcagc

SEQ ID NO: 249222 - DNA, 25 bp, Mus musculus
cgcactggcgactgggttagtccac

SEQ ID NO: 249223 - DNA, 25 bp, Mus musculus
agccttggagtttctggccgcactg

SEQ ID NO: 249224 - DNA, 25 bp, Mus musculus
gccacccgtgcacttgagccttgga

SEQ ID NO: 249225 - DNA, 25 bp, Mus musculus
taaagactgcttctgcagccacccg

SEQ ID NO: 249226 - DNA, 25 bp, Mus musculus
cggcgtcgtggtaaagactgcttct

SEQ ID NO: 249227 - DNA, 25 bp, Mus musculus
aacgttctgaattcgcggcgtcgtg

SEQ ID NO: 249228 - DNA, 25 bp, Mus musculus
gctcggctcttcctggagtcggatt

SEQ ID NO: 249229 - DNA, 25 bp, Mus musculus
ggttgtgggcaaatgctaataactt

SEQ ID NO: 249230 - DNA, 25 bp, Mus musculus
gtccaaaggttgtgggcaaatgcta

SEQ ID NO: 249231 - DNA, 25 bp, Mus musculus
ttgcttatccagagtccaaaggttg

SEQ ID NO: 249232 - DNA, 25 bp, Mus musculus
tttatcttattgcttatccagagtc

SEQ ID NO: 249233 - DNA, 25 bp, Mus musculus
tgacttgggactatttaattttatc

SEQ ID NO: 249234 - DNA, 25 bp, Mus musculus
cacagaaattgacttgggactattt

SEQ ID NO: 249235 - DNA, 25 bp, Mus musculus
tagtattttattacagatggcaatc

SEQ ID NO: 249236 - DNA, 25 bp, Mus musculus
ctcttcctggagtcggattgcttgg

SEQ ID NO: 249237 - DNA, 25 bp, Mus musculus
aaatgtgtacggaagacgcactccc

SEQ ID NO: 249238 - DNA, 25 bp, Mus musculus
ttttaaatgagacatgggcgcggga

SEQ ID NO: 249239 - DNA, 25 bp, Mus musculus
ctgagtgtcatgaacataaaatttt

SEQ ID NO: 249240 - DNA, 25 bp, Mus musculus
tggcaatctactttgcacacaattg

SEQ ID NO: 249241 - DNA, 25 bp, Mus musculus
ggatctttcccgcaccctgttccaa

SEQ ID NO: 249242 - DNA, 25 bp, Mus musculus
ctacgctgccctctcccgttggctc

SEQ ID NO: 249243 - DNA, 25 bp, Mus musculus
agcgcctacgctgccctctcccgtt

SEQ ID NO: 249244 - DNA, 25 bp, Mus musculus
ggcctggtccatggcgcagcctccc

SEQ ID NO: 249245 - DNA, 25 bp, Mus musculus
aatccagccccctggccgtgaaggg

SEQ ID NO: 249246 - DNA, 25 bp, Mus musculus
gcggcaggacgatgaagccgggagc

SEQ ID NO: 249247 - DNA, 25 bp, Mus musculus
tcccgtcccgcgtgcggcctggcct

SEQ ID NO: 249248 - DNA, 25 bp, Mus musculus
ttggctctccattggccgcagagct

SEQ ID NO: 249249 - DNA, 25 bp, Mus musculus
ccgttggctctccattggccgcaga

SEQ ID NO: 249250 - DNA, 25 bp, Mus musculus
gtgcaccgaggctccggctgctccc

SEQ ID NO: 249251 - DNA, 25 bp, Mus musculus
ttcatcccgattgctcccgtcccgc

SEQ ID NO: 249252 - DNA, 25 bp, Mus musculus
ttgcgcatccttcatcccgattgct

SEQ ID NO: 249253 - DNA, 25 bp, Mus musculus
tggcgccgcatcctccttgcgcatc

SEQ ID NO: 249254 - DNA, 25 bp, Mus musculus
tgccgacctgccctggtccctcccg

SEQ ID NO: 249255 - DNA, 25 bp, Mus musculus
tgctcccggcctggtccatggcgca

SEQ ID NO: 249256 - DNA, 25 bp, Mus musculus
ttgaccctggggctcggcttcttat

SEQ ID NO: 249257 - DNA, 25 bp, Mus musculus
tgcgaagacccactcgaacggccgg

SEQ ID NO: 249258 - DNA, 25 bp, Mus musculus
gtggacgcccgcctgcaacagtcat

SEQ ID NO: 249259 - DNA, 25 bp, Mus musculus
gtgctgccgaatagctcgggccacc

SEQ ID NO: 249260 - DNA, 25 bp, Mus musculus
cccgcctgcaacagtcatgcgaaga

SEQ ID NO: 249261 - DNA, 25 bp, Mus musculus
ctccttcagtgctgccgaatagctc

SEQ ID NO: 249262 - DNA, 25 bp, Mus musculus
tgcaacagtcatgcgaagacccact

SEQ ID NO: 249263 - DNA, 25 bp, Mus musculus
gacccactcgaacggccggagagtc

SEQ ID NO: 249264 - DNA, 25 bp, Mus musculus
gccggagagtctggcgacctacttt

SEQ ID NO: 249265 - DNA, 25 bp, Mus musculus
tctggcgacctactttgatcctgtg

SEQ ID NO: 249266 - DNA, 25 bp, Mus musculus
acctactttgatcctgtggcttccc

SEQ ID NO: 249267 - DNA, 25 bp, Mus musculus
ggggctcggcttcttatgctttccc

SEQ ID NO: 249268 - DNA, 25 bp, Mus musculus
gtcaccttggcacgccctggccgag

SEQ ID NO: 249269 - DNA, 25 bp, Mus musculus
gcgacctactttgatcctgtggctt

SEQ ID NO: 249270 - DNA, 25 bp, Mus musculus
gcgatttgggattttctgtgaagta

SEQ ID NO: 249271 - DNA, 25 bp, Mus musculus
tcgataacatcctgcggcctgagtt

SEQ ID NO: 249272 - DNA, 25 bp, Mus musculus
tgatgctgcccgaggtcctacaggc

SEQ ID NO: 249273 - DNA, 25 bp, Mus musculus
gaaggattccaagcccagcgagacg

SEQ ID NO: 249274 - DNA, 25 bp, Mus musculus
tgcggcctgagtttggccgccgaaa

SEQ ID NO: 249275 - DNA, 25 bp, Mus musculus
tgtaggactccagccctggccactg

SEQ ID NO: 249276 - DNA, 25 bp, Mus musculus
cactccgtggatccgaacgtggctt

SEQ ID NO: 249277 - DNA, 25 bp, Mus musculus
tggtgatttgctaacgcactccgtg

SEQ ID NO: 249278 - DNA, 25 bp, Mus musculus
accatctagagtccggtgcgtcgcc

SEQ ID NO: 249279 - DNA, 25 bp, Mus musculus
agtggtgcggtgaccatctagagtc

SEQ ID NO: 249280 - DNA, 25 bp, Mus musculus
ccgaggctgctgaccaccaaaagga

SEQ ID NO: 249281 - DNA, 25 bp, Mus musculus
caacggccgagcagtggctgcccga

SEQ ID NO: 249282 - DNA, 25 bp, Mus musculus
acggccctccatgtgcgtgctggcg

SEQ ID NO: 249283 - DNA, 25 bp, Mus musculus
ggcgcagagacagccggaacccagc

SEQ ID NO: 249284 - DNA, 25 bp, Mus musculus
gacgtgaagcacctaccttagcttg

SEQ ID NO: 249285 - DNA, 25 bp, Mus musculus
agatgggtcctagcgccgacgtgaa

SEQ ID NO: 249286 - DNA, 25 bp, Mus musculus
ttcctcctgcagatgggtcctagcg

SEQ ID NO: 249287 - DNA, 25 bp, Mus musculus
cgtgccgcgttcctcctgcagatgg

SEQ ID NO: 249288 - DNA, 25 bp, Mus musculus
acggctccacccagtgcgcgttggg

SEQ ID NO: 249289 - DNA, 25 bp, Mus musculus
agcttggggaggacggctccaccca

SEQ ID NO: 249290 - DNA, 25 bp, Mus musculus
ccacgcccaccgcagctgtgccacg

SEQ ID NO: 249291 - DNA, 25 bp, Mus musculus
gcagctgtgccacgcccatggtgcc

SEQ ID NO: 249292 - DNA, 25 bp, Mus musculus
agagctccgcgcaggccctaccgcc

SEQ ID NO: 249293 - DNA, 25 bp, Mus musculus
ttaggggatcgagcctttgctctgc

SEQ ID NO: 249294 - DNA, 25 bp, Mus musculus
tctttaggggatcgagcctttgctc

SEQ ID NO: 249295 - DNA, 25 bp, Mus musculus
ctaccttagcttgcaagagcgggtc

SEQ ID NO: 249296 - DNA, 25 bp, Mus musculus
gcgccgacgtgaagcacctacctta

SEQ ID NO: 249297 - DNA, 25 bp, Mus musculus
cttagcttgcaagagcgggtcttta

SEQ ID NO: 249298 - DNA, 25 bp, Mus musculus
ctagcaggatgcctgagtgagtttc

SEQ ID NO: 249299 - DNA, 25 bp, Mus musculus
agaccgtctggaggtcactgccctg

SEQ ID NO: 249300 - DNA, 25 bp, Mus musculus
cccacgccgcagagactgcgtgtta

SEQ ID NO: 249301 - DNA, 25 bp, Mus musculus
tcttgttctccacacacgctgcgtg

SEQ ID NO: 249302 - DNA, 25 bp, Mus musculus
gccgcagccatcttccaggttggta

SEQ ID NO: 249303 - DNA, 25 bp, Mus musculus
cgtggctctctcgtcttgttctcca

SEQ ID NO: 249304 - DNA, 25 bp, Mus musculus
tctgcttgggtcttaacgatgccgg

SEQ ID NO: 249305 - DNA, 25 bp, Mus musculus
cgggacgatgaggttctctcgacca

SEQ ID NO: 249306 - DNA, 25 bp, Mus musculus
tgctgcctttaatctgcgccgggga

SEQ ID NO: 249307 - DNA, 25 bp, Mus musculus
aacgtcagcacgctacggaagtcgc

SEQ ID NO: 249308 - DNA, 25 bp, Mus musculus
cgtcacacgacgcaaggtaacgtca

SEQ ID NO: 249309 - DNA, 25 bp, Mus musculus
agaggcggtgcctcctacgtcacac

SEQ ID NO: 249310 - DNA, 25 bp, Mus musculus
tcctcacggcgtctccaggttatcg

SEQ ID NO: 249311 - DNA, 25 bp, Mus musculus
cgtttctcttcaggcagcttcgcgg

SEQ ID NO: 249312 - DNA, 25 bp, Mus musculus
gcgctgttgtgtccgcgcgtatcca

SEQ ID NO: 249313 - DNA, 25 bp, Mus musculus
cgtcaggcagccttgaggagcgcac

SEQ ID NO: 249314 - DNA, 25 bp, Mus musculus
tgtcgctctagtccggtccatcaca

SEQ ID NO: 249315 - DNA, 25 bp, Mus musculus
aatccaagagcctgggcagcaccgc

SEQ ID NO: 249316 - DNA, 25 bp, Mus musculus
gtccatcacattccgcggggaaagg

SEQ ID NO: 249317 - DNA, 25 bp, Mus musculus
tatccaggcggctctcgtgcaacgc

SEQ ID NO: 249318 - DNA, 25 bp, Mus musculus
gctcaccatgtctgggcactttctg

SEQ ID NO: 249319 - DNA, 25 bp, Mus musculus
ctcctgcccaaggacatcaagctgg

SEQ ID NO: 249320 - DNA, 25 bp, Mus musculus
taagtgggacaaaggcgcgcaaagc

SEQ ID NO: 249321 - DNA, 25 bp, Mus musculus
gtcttcacccgcagggatgccggga

SEQ ID NO: 249322 - DNA, 25 bp, Mus musculus
gcctgttgcttcagaggtccatttc

SEQ ID NO: 249323 - DNA, 25 bp, Mus musculus
ccatttctgagctctggacggggtt

SEQ ID NO: 249324 - DNA, 25 bp, Mus musculus
gtgcctgttgagtgtcgctctagtc

SEQ ID NO: 249325 - DNA, 25 bp, Mus musculus
gcgctcccggagctctttaaaatcc

SEQ ID NO: 249326 - DNA, 25 bp, Mus musculus
ctaagccgcgaaaccagagcccaga

SEQ ID NO: 249327 - DNA, 25 bp, Mus musculus
acgagtcctggatgcgcatgtgcaa

SEQ ID NO: 249328 - DNA, 25 bp, Mus musculus
atgcgcatgtgcaaccgggctctac

SEQ ID NO: 249329 - DNA, 25 bp, Mus musculus
tctacggcctctgggagcatgcgca

SEQ ID NO: 249330 - DNA, 25 bp, Mus musculus
gcgccagtggcttgcgtcccgcgtt

SEQ ID NO: 249331 - DNA, 25 bp, Mus musculus
aagcggtgtcgtcgctgaccatcgc

SEQ ID NO: 249332 - DNA, 25 bp, Mus musculus
ctgaccatcgcggatgcgttcgtcg

SEQ ID NO: 249333 - DNA, 25 bp, Mus musculus
cgcgcacctatgcaaacacacgggg

SEQ ID NO: 249334 - DNA, 25 bp, Mus musculus
gcctggaagctagacgcgcacctat

SEQ ID NO: 249335 - DNA, 25 bp, Mus musculus
gccagttacaacaaagcctggaagc

SEQ ID NO: 249336 - DNA, 25 bp, Mus musculus
tgcctctcgccgtggacgagtcctg

SEQ ID NO: 249337 - DNA, 25 bp, Mus musculus
gcgctgcccagcaggttcatctgct

SEQ ID NO: 249338 - DNA, 25 bp, Mus musculus
ggttcatctgctcctttcccgactg

SEQ ID NO: 249339 - DNA, 25 bp, Mus musculus
cgactgcagcgccagttacaacaaa

SEQ ID NO: 249340 - DNA, 25 bp, Mus musculus
cagcaaggtcactgggtctgagtca

SEQ ID NO: 249341 - DNA, 25 bp, Mus musculus
ctgctgggcgtttgtttacatcccg

SEQ ID NO: 249342 - DNA, 25 bp, Mus musculus
cgcctgctgggcgtttgtttacatc

SEQ ID NO: 249343 - DNA, 25 bp, Mus musculus
aaggtcactgggtctgagtcatggt

SEQ ID NO: 249344 - DNA, 25 bp, Mus musculus
caaaggccagacagcaaggtcactg

SEQ ID NO: 249345 - DNA, 25 bp, Mus musculus
tggccaaaggccagacagcaaggtc

SEQ ID NO: 249346 - DNA, 25 bp, Mus musculus
ggtcactgtggccaaaggccagaca

SEQ ID NO: 249347 - DNA, 25 bp, Mus musculus
aggacgccgccacactggtcactgt

SEQ ID NO: 249348 - DNA, 25 bp, Mus musculus
cccagctgtgggtgagtggaccgat

SEQ ID NO: 249349 - DNA, 25 bp, Mus musculus
tgagtggaccgatcgggactgcaca

SEQ ID NO: 249350 - DNA, 25 bp, Mus musculus
accgatcgggactgcacaggacggt

SEQ ID NO: 249351 - DNA, 25 bp, Mus musculus
aagtcatgaaggtgccgggtgcgta

SEQ ID NO: 249352 - DNA, 25 bp, Mus musculus
cactggtcactgtggccaaaggcca

SEQ ID NO: 249353 - DNA, 25 bp, Mus musculus
cccgtgggcgccagtatggagccga

SEQ ID NO: 249354 - DNA, 25 bp, Mus musculus
accttgacgggctttttgtctcgtg

SEQ ID NO: 249355 - DNA, 25 bp, Mus musculus
gagcgcgctcttgcagcggttttct

SEQ ID NO: 249356 - DNA, 25 bp, Mus musculus
gactgccagcatcggctgcggctca

SEQ ID NO: 249357 - DNA, 25 bp, Mus musculus
acgctccgccagaatctgggcggcg

SEQ ID NO: 249358 - DNA, 25 bp, Mus musculus
gcagcggttttcttctcccacaatc

SEQ ID NO: 249359 - DNA, 25 bp, Mus musculus
tcccacaatccagaggtagaggcgc

SEQ ID NO: 249360 - DNA, 25 bp, Mus musculus
cggcactgcggttccgaggccgtta

SEQ ID NO: 249361 - DNA, 25 bp, Mus musculus
gttaccctagctcctccagagggcg

SEQ ID NO: 249362 - DNA, 25 bp, Mus musculus
agggacacgcctcggtgctccggac

SEQ ID NO: 249363 - DNA, 25 bp, Mus musculus
gttgcgggcagacgctcccagctct

SEQ ID NO: 249364 - DNA, 25 bp, Mus musculus
gaacgcccagaaccgctcgcccagg

SEQ ID NO: 249365 - DNA, 25 bp, Mus musculus
cccacgttgggcttgagttcttggc

SEQ ID NO: 249366 - DNA, 25 bp, Mus musculus
ctcaccgggtgcagactgccagcat

SEQ ID NO: 249367 - DNA, 25 bp, Mus musculus
cctgcagccggacggtcagggacac

SEQ ID NO: 249368 - DNA, 25 bp, Mus musculus
aactggtctcgactccgaaggctgg

SEQ ID NO: 249369 - DNA, 25 bp, Mus musculus
gcgcgcacacaaacagcgaaactgg

SEQ ID NO: 249370 - DNA, 25 bp, Mus musculus
cgaaactggctaggctggcgagcaa

SEQ ID NO: 249371 - DNA, 25 bp, Mus musculus
ctaggctggcgagcaagtgattatt

SEQ ID NO: 249372 - DNA, 25 bp, Mus musculus
ggcagctcggcaactggtctcgact

SEQ ID NO: 249373 - DNA, 25 bp, Mus musculus
ctcgactccgaaggctggtgctgcc

SEQ ID NO: 249374 - DNA, 25 bp, Mus musculus
ccacggagggctctctgcacagaat

SEQ ID NO: 249375 - DNA, 25 bp, Mus musculus
ctctgcacagaatgttcccaggaca

SEQ ID NO: 249376 - DNA, 25 bp, Mus musculus
atgttcccaggacatgcattcccac

SEQ ID NO: 249377 - DNA, 25 bp, Mus musculus
tcacctcagcgttacctgggccggg

SEQ ID NO: 249378 - DNA, 25 bp, Mus musculus
gcaccgcgtcggcttccgtagcagg

SEQ ID NO: 249379 - DNA, 25 bp, Mus musculus
gcgagcaggaagaactagcaggtcc

SEQ ID NO: 249380 - DNA, 25 bp, Mus musculus
tagcaggtccgtacctggactccgc

SEQ ID NO: 249381 - DNA, 25 bp, Mus musculus
caagtgattattggcagctcggcaa

SEQ ID NO: 249382 - DNA, 25 bp, Mus musculus
agcacctggaagacctcgtcccgtg

SEQ ID NO: 249383 - DNA, 25 bp, Mus musculus
ccggctcatctgtccttcggactag

SEQ ID NO: 249384 - DNA, 25 bp, Mus musculus
ctgtccttcggactagtttaatgcc

SEQ ID NO: 249385 - DNA, 25 bp, Mus musculus
ggactagtttaatgccgagctgctc

SEQ ID NO: 249386 - DNA, 25 bp, Mus musculus
cgagctgctctgtcgagtctcgctt

SEQ ID NO: 249387 - DNA, 25 bp, Mus musculus
cttgtggagcagcacctggaagacc

SEQ ID NO: 249388 - DNA, 25 bp, Mus musculus
ggaagacctcgtcccgtggcgcgct

SEQ ID NO: 249389 - DNA, 25 bp, Mus musculus
ctgccgtccgcgtggctgttggcac

SEQ ID NO: 249390 - DNA, 25 bp, Mus musculus
cgtggctgttggcacggctgccaaa

SEQ ID NO: 249391 - DNA, 25 bp, Mus musculus
gttggcacggctgccaaagcgcctc

SEQ ID NO: 249392 - DNA, 25 bp, Mus musculus
gccaaagcgcctctcccgcagcact

SEQ ID NO: 249393 - DNA, 25 bp, Mus musculus
ccgcagcactgtcagctgcagcgtg

SEQ ID NO: 249394 - DNA, 25 bp, Mus musculus
gcactgtcagctgcagcgtgctgca

SEQ ID NO: 249395 - DNA, 25 bp, Mus musculus
tcgagtctcgcttgtggagcagcac

SEQ ID NO: 249396 - DNA, 25 bp, Mus musculus
ctctttttaaatagcaggtgtctcg

SEQ ID NO: 249397 - DNA, 25 bp, Mus musculus
ggccaagactttacttctcaaccgc

SEQ ID NO: 249398 - DNA, 25 bp, Mus musculus
tcggagcctctcgaccaatcaagga

SEQ ID NO: 249399 - DNA, 25 bp, Mus musculus
ggattctccctctcagacacacaga

SEQ ID NO: 249400 - DNA, 25 bp, Mus musculus
tcaaagggaaaaggagctgccagtc

SEQ ID NO: 249401 - DNA, 25 bp, Mus musculus
tcccacagcgtgagctcccgaggaa

SEQ ID NO: 249402 - DNA, 25 bp, Mus musculus
gagggcggtgctccaaactctcact

SEQ ID NO: 249403 - DNA, 25 bp, Mus musculus
tcgcagcccttgcacctagtggaga

SEQ ID NO: 249404 - DNA, 25 bp, Mus musculus
ccacagtatcgtcaggagagtcatc

SEQ ID NO: 249405 - DNA, 25 bp, Mus musculus
ggagagtcatctctgcacaacagtc

SEQ ID NO: 249406 - DNA, 25 bp, Mus musculus
agtctctctgctttttcaaggtgcc

SEQ ID NO: 249407 - DNA, 25 bp, Mus musculus
agcctatgctcttcagtggcacttg

SEQ ID NO: 249408 - DNA, 25 bp, Mus musculus
ttcctggcgagaagcaaagtccggc

SEQ ID NO: 249409 - DNA, 25 bp, Mus musculus
agctggcttagcttccgcagttcca

SEQ ID NO: 249410 - DNA, 25 bp, Mus musculus
cgatggctcgctcacactgatggct

SEQ ID NO: 249411 - DNA, 25 bp, Mus musculus
tcacactgatggctcgctcacactg

SEQ ID NO: 249412 - DNA, 25 bp, Mus musculus
tcacactgatggctcacaccgacgg

SEQ ID NO: 249413 - DNA, 25 bp, Mus musculus
acggctcacactgatggctcgctca

SEQ ID NO: 249414 - DNA, 25 bp, Mus musculus
ggctcacactgatggctcgctcaca

SEQ ID NO: 249415 - DNA, 25 bp, Mus musculus
taatggctcacaccgatggctcgct

SEQ ID NO: 249416 - DNA, 25 bp, Mus musculus
ctgatggctcacaccgactgcttgc

SEQ ID NO: 249417 - DNA, 25 bp, Mus musculus
ctaatggctcacaccgatggctcgc

SEQ ID NO: 249418 - DNA, 25 bp, Mus musculus
ggctcgctcacactgatggctcaca

SEQ ID NO: 249419 - DNA, 25 bp, Mus musculus
ggctcacactaatggctcacaccga

SEQ ID NO: 249420 - DNA, 25 bp, Mus musculus
gatggctcgctcacactgatggctc

SEQ ID NO: 249421 - DNA, 25 bp, Mus musculus
actaatggctcacaccgatggctcg

SEQ ID NO: 249422 - DNA, 25 bp, Mus musculus
gatggctcgctcacactaatggctc

SEQ ID NO: 249423 - DNA, 25 bp, Mus musculus
actgatggctcacaccgactgcttg

SEQ ID NO: 249424 - DNA, 25 bp, Mus musculus
ctcacagtgctagactgggaccgga

SEQ ID NO: 249425 - DNA, 25 bp, Mus musculus
cttcggatcgcagtactgccacgca

SEQ ID NO: 249426 - DNA, 25 bp, Mus musculus
tgaggatactcgaggggcgctcaca

SEQ ID NO: 249427 - DNA, 25 bp, Mus musculus
tggcgtagcccatcacatggcaata

SEQ ID NO: 249428 - DNA, 25 bp, Mus musculus
tgccggatcccagacagtttcactg

SEQ ID NO: 249429 - DNA, 25 bp, Mus musculus
tctgtgtcaccgcttcgcagctgca

SEQ ID NO: 249430 - DNA, 25 bp, Mus musculus
ttcccttgtgctgcgggaagccagc

SEQ ID NO: 249431 - DNA, 25 bp, Mus musculus
ctccttcctggtggattcccttgtg

SEQ ID NO: 249432 - DNA, 25 bp, Mus musculus
atctgcagttccctcgggctccagg

SEQ ID NO: 249433 - DNA, 25 bp, Mus musculus
aggggaagctacgacaggatctgca

SEQ ID NO: 249434 - DNA, 25 bp, Mus musculus
caaggtgattccagcccgggcttga

SEQ ID NO: 249435 - DNA, 25 bp, Mus musculus
cgtctttcagcaccactagcgctgg

SEQ ID NO: 249436 - DNA, 25 bp, Mus musculus
tagtcctatttaagcggcgccgccg

SEQ ID NO: 249437 - DNA, 25 bp, Mus musculus
cagtttcactgcatctctgtgggta

SEQ ID NO: 249438 - DNA, 25 bp, Mus musculus
gcgagagttcgcctccaacatgtac

SEQ ID NO: 249439 - DNA, 25 bp, Mus musculus
ggacggcgttcaccagcacacagct

SEQ ID NO: 249440 - DNA, 25 bp, Mus musculus
tgcgccttttagaggaccattggtt

SEQ ID NO: 249441 - DNA, 25 bp, Mus musculus
agtcactccgtaggtgcgcctttta

SEQ ID NO: 249442 - DNA, 25 bp, Mus musculus
cctccgggaaggatgacagagatct

SEQ ID NO: 249443 - DNA, 25 bp, Mus musculus
gacgaattgcccatgtctccatctt

SEQ ID NO: 249444 - DNA, 25 bp, Mus musculus
tgctcagaggacgacgacgaattgc

SEQ ID NO: 249445 - DNA, 25 bp, Mus musculus
tgcaagtgctcttcgctctcctcag

SEQ ID NO: 249446 - DNA, 25 bp, Mus musculus
ggcgcaccgcaaggctgcaagtgct

SEQ ID NO: 249447 - DNA, 25 bp, Mus musculus
caaaggcagtaaccaccgcggcgga

SEQ ID NO: 249448 - DNA, 25 bp, Mus musculus
accgccgggtgaagcacaagaaaga

SEQ ID NO: 249449 - DNA, 25 bp, Mus musculus
cgctggccaaccgacggatttcgtt

SEQ ID NO: 249450 - DNA, 25 bp, Mus musculus
gcgcatcgagatcgcgacctatctg

SEQ ID NO: 249451 - DNA, 25 bp, Mus musculus
gcgacctatctgaacctgtccgaga

SEQ ID NO: 249452 - DNA, 25 bp, Mus musculus
agcccgagaggaacactccctgatc

SEQ ID NO: 249453 - DNA, 25 bp, Mus musculus
cgcatcagttctgtggggaagccac

SEQ ID NO: 249454 - DNA, 25 bp, Mus musculus
ggccgcaaagccgatccgcaattaa

SEQ ID NO: 249455 - DNA, 25 bp, Mus musculus
caacgactgcgcgacattcactggc

SEQ ID NO: 249456 - DNA, 25 bp, Mus musculus
tgaacccttccggtgccaacgactg

SEQ ID NO: 249457 - DNA, 25 bp, Mus musculus
gtgttgatatatccagctccctttg

SEQ ID NO: 249458 - DNA, 25 bp, Mus musculus
gaactcggtttctgcagtgttgata

SEQ ID NO: 249459 - DNA, 25 bp, Mus musculus
aggggctgcatgacaaatgaactcg

SEQ ID NO: 249460 - DNA, 25 bp, Mus musculus
tgacaactgcgctgaaaggggctgc

SEQ ID NO: 249461 - DNA, 25 bp, Mus musculus
tccaccctctgctgatcaaagaagg

SEQ ID NO: 249462 - DNA, 25 bp, Mus musculus
gacaaaaccttgtgcggcgtctaga

SEQ ID NO: 249463 - DNA, 25 bp, Mus musculus
gtccacaccgaggttgtcaggggca

SEQ ID NO: 249464 - DNA, 25 bp, Mus musculus
tccggacttcccgaggaggctatgc

SEQ ID NO: 249465 - DNA, 25 bp, Mus musculus
aggcacgcactttacccggagcgca

SEQ ID NO: 249466 - DNA, 25 bp, Mus musculus
ccagctccctttcccgtggatgaaa

SEQ ID NO: 249467 - DNA, 25 bp, Mus musculus
tggcgtagagagtccgcgagccacc

SEQ ID NO: 249468 - DNA, 25 bp, Mus musculus
ctaaggcctggcttgtagctccgac

SEQ ID NO: 249469 - DNA, 25 bp, Mus musculus
caagtgccggctgccaccatgaaca

SEQ ID NO: 249470 - DNA, 25 bp, Mus musculus
ccatgaacagtgaggagcagtacta

SEQ ID NO: 249471 - DNA, 25 bp, Mus musculus
tacgcggccacacagctctacaagg

SEQ ID NO: 249472 - DNA, 25 bp, Mus musculus
gctctacaaggacccgtgcgcattc

SEQ ID NO: 249473 - DNA, 25 bp, Mus musculus
ccggtgccagagttcagcgctaacc

SEQ ID NO: 249474 - DNA, 25 bp, Mus musculus
ctgcgtgcctgtacatgggccgcca

SEQ ID NO: 249475 - DNA, 25 bp, Mus musculus
tttacaagctcgctgggatcactgg

SEQ ID NO: 249476 - DNA, 25 bp, Mus musculus
gcagggaagtcctccggacatctcc

SEQ ID NO: 249477 - DNA, 25 bp, Mus musculus
ctttcccgaatggaaccgagcctgg

SEQ ID NO: 249478 - DNA, 25 bp, Mus musculus
tggaagagcccaaccgcgtccagct

SEQ ID NO: 249479 - DNA, 25 bp, Mus musculus
gatgaaatccaccaaagctcacgcg

SEQ ID NO: 249480 - DNA, 25 bp, Mus musculus
cggagcaagattgtgcggtgacctc

SEQ ID NO: 249481 - DNA, 25 bp, Mus musculus
tcgcgccactgcgaccgcaggaacc

SEQ ID NO: 249482 - DNA, 25 bp, Mus musculus
ccggagcaagattgtgcggtgacct

SEQ ID NO: 249483 - DNA, 25 bp, Mus musculus
aagattgtgcggtgacctcgggcga

SEQ ID NO: 249484 - DNA, 25 bp, Mus musculus
tgccacctcccggaggtgccgtgcc

SEQ ID NO: 249485 - DNA, 25 bp, Mus musculus
caggcgtcccagctgcagtccggga

SEQ ID NO: 249486 - DNA, 25 bp, Mus musculus
gccttagcgtgtcgccacagccctc

SEQ ID NO: 249487 - DNA, 25 bp, Mus musculus
gcctactgccttcgggccttagcgt

SEQ ID NO: 249488 - DNA, 25 bp, Mus musculus
gccttcgggccttagcgtgtcgcca

SEQ ID NO: 249489 - DNA, 25 bp, Mus musculus
cttcgggccttagcgtgtcgccaca

SEQ ID NO: 249490 - DNA, 25 bp, Mus musculus
gccacagccctccagcatcgcgcca

SEQ ID NO: 249491 - DNA, 25 bp, Mus musculus
tcgggccttagcgtgtcgccacagc

SEQ ID NO: 249492 - DNA, 25 bp, Mus musculus
agggcctactgccttcgggccttag

SEQ ID NO: 249493 - DNA, 25 bp, Mus musculus
ccagcatcgcgccactgcgaccgca

SEQ ID NO: 249494 - DNA, 25 bp, Mus musculus
acgcaaagatggtccgtgagccctg

SEQ ID NO: 249495 - DNA, 25 bp, Mus musculus
acgcgctggctgaggaacgcaaaga

SEQ ID NO: 249496 - DNA, 25 bp, Mus musculus
tgctcttagagcaccacgcgctggc

SEQ ID NO: 249497 - DNA, 25 bp, Mus musculus
cgccctagaacggatgctgctctta

SEQ ID NO: 249498 - DNA, 25 bp, Mus musculus
gcgaggcgcagaacaatttcccaca

SEQ ID NO: 249499 - DNA, 25 bp, Mus musculus
cccgcgcctgctttggaagtaaagg

SEQ ID NO: 249500 - DNA, 25 bp, Mus musculus
gactgcgaaagtcaccaccctcttt

SEQ ID NO: 249501 - DNA, 25 bp, Mus musculus
cattaacatcacaagggcgcccggc

SEQ ID NO: 249502 - DNA, 25 bp, Mus musculus
ggagcctgtaacacactcgctagtg

SEQ ID NO: 249503 - DNA, 25 bp, Mus musculus
aaggtgtacatcaaagccggccggg

SEQ ID NO: 249504 - DNA, 25 bp, Mus musculus
gcgggccacagcttccctacattaa

SEQ ID NO: 249505 - DNA, 25 bp, Mus musculus
gcgggacttcacagcgacctctcat

SEQ ID NO: 249506 - DNA, 25 bp, Mus musculus
tccgggccctaaaagagacaatggc

SEQ ID NO: 249507 - DNA, 25 bp, Mus musculus
cccttgacagatgacgctctgcaga

SEQ ID NO: 249508 - DNA, 25 bp, Mus musculus
gggatgctccacgacctccgtgcga

SEQ ID NO: 249509 - DNA, 25 bp, Mus musculus
ggaaagctccgggttccattgctcg

SEQ ID NO: 249510 - DNA, 25 bp, Mus musculus
acctgagcctccagtgccggggtcg

SEQ ID NO: 249511 - DNA, 25 bp, Mus musculus
ctgacccatctttgggccgccgaga

SEQ ID NO: 249512 - DNA, 25 bp, Mus musculus
tggctctgtggcctgacccatcttt

SEQ ID NO: 249513 - DNA, 25 bp, Mus musculus
ttgctccgccctggcatggctctgt

SEQ ID NO: 249514 - DNA, 25 bp, Mus musculus
ggcttaccggaagtgccacggcttc

SEQ ID NO: 249515 - DNA, 25 bp, Mus musculus
cctctacgtgggcaggcttaccgga

SEQ ID NO: 249516 - DNA, 25 bp, Mus musculus
gcccgaagaccctctgccttcctgg

SEQ ID NO: 249517 - DNA, 25 bp, Mus musculus
ggcgccgagcctctgttctaactca

SEQ ID NO: 249518 - DNA, 25 bp, Mus musculus
tgctccacgacctccgtgcgaatgg

SEQ ID NO: 249519 - DNA, 25 bp, Mus musculus
aagctccgggttccattgctcggcc

SEQ ID NO: 249520 - DNA, 25 bp, Mus musculus
ccgcagctccgagcctgccattttc

SEQ ID NO: 249521 - DNA, 25 bp, Mus musculus
gggccgcagtctcacctcgggatgc

SEQ ID NO: 249522 - DNA, 25 bp, Mus musculus
tctggggacaaacgttgaaggctgc

SEQ ID NO: 249523 - DNA, 25 bp, Mus musculus
ccgtcggctccttgcagagcttctg

SEQ ID NO: 249524 - DNA, 25 bp, Mus musculus
gacctcaccatgctgtctggggaca

SEQ ID NO: 249525 - DNA, 25 bp, Mus musculus
gtccagaaggtagctcacgtacatg

SEQ ID NO: 249526 - DNA, 25 bp, Mus musculus
tgctcacgtccttgtccagaaggta

SEQ ID NO: 249527 - DNA, 25 bp, Mus musculus
ggcgcacggagctaggatacatgct

SEQ ID NO: 249528 - DNA, 25 bp, Mus musculus
tgacaaagttctgcggagccaggtt

SEQ ID NO: 249529 - DNA, 25 bp, Mus musculus
agcgctgtccaagttcgccgtagca

SEQ ID NO: 249530 - DNA, 25 bp, Mus musculus
gtagccattccagtcctcgcggaga

SEQ ID NO: 249531 - DNA, 25 bp, Mus musculus
accttggcttcctagggactgctgc

SEQ ID NO: 249532 - DNA, 25 bp, Mus musculus
cactcctgggatgaatccacctgta

SEQ ID NO: 249533 - DNA, 25 bp, Mus musculus
ggggagcgagacacaaatatacact

SEQ ID NO: 249534 - DNA, 25 bp, Mus musculus
tgccaatggggtactgccctaaaca

SEQ ID NO: 249535 - DNA, 25 bp, Mus musculus
cacctccttgccagtaagctgtaga

SEQ ID NO: 249536 - DNA, 25 bp, Mus musculus
acctgcgctgctgaagaagactctc

SEQ ID NO: 249537 - DNA, 25 bp, Mus musculus
cgcaccggctcgagaatctatagta

SEQ ID NO: 249538 - DNA, 25 bp, Mus musculus
aactggcgcagtgctgcagccgatc

SEQ ID NO: 249539 - DNA, 25 bp, Mus musculus
ccgctcgctgctaggcgggctgaac

SEQ ID NO: 249540 - DNA, 25 bp, Mus musculus
agattccctcggactggtgcagagc

SEQ ID NO: 249541 - DNA, 25 bp, Mus musculus
gtcactgaccacagattccctcgga

SEQ ID NO: 249542 - DNA, 25 bp, Mus musculus
tgaaggatgcgcgtcactgaccaca

SEQ ID NO: 249543 - DNA, 25 bp, Mus musculus
ggcccagcctgtgatgcggtcccag

SEQ ID NO: 249544 - DNA, 25 bp, Mus musculus
gaggggccttaccaagcagcagcag

SEQ ID NO: 249545 - DNA, 25 bp, Mus musculus
aagccaagttcaccgcttgaaaggg

SEQ ID NO: 249546 - DNA, 25 bp, Mus musculus
ggtgggcaaaccaaagccaagttca

SEQ ID NO: 249547 - DNA, 25 bp, Mus musculus
gctgacggagcatccaagcccaagc

SEQ ID NO: 249548 - DNA, 25 bp, Mus musculus
atctatagtacccagaggtcgggtc

SEQ ID NO: 249549 - DNA, 25 bp, Mus musculus
ctctcagaggctgacggagcatcca

SEQ ID NO: 249550 - DNA, 25 bp, Mus musculus
ttcccgccctcgtctatggtggcgg

SEQ ID NO: 249551 - DNA, 25 bp, Mus musculus
tagcaacagcgtcccgctggcgcta

SEQ ID NO: 249552 - DNA, 25 bp, Mus musculus
ggggcttggcctccatagcaacagc

SEQ ID NO: 249553 - DNA, 25 bp, Mus musculus
gcgaggagtgtcagttcctgcacga

SEQ ID NO: 249554 - DNA, 25 bp, Mus musculus
tgcttctacggcgaggagtgtcagt

SEQ ID NO: 249555 - DNA, 25 bp, Mus musculus
acaagacgtgcttctacggcgagga

SEQ ID NO: 249556 - DNA, 25 bp, Mus musculus
ctacgccaaggacaagacgtgcttc

SEQ ID NO: 249557 - DNA, 25 bp, Mus musculus
tactgccgctactacgccaaggaca

SEQ ID NO: 249558 - DNA, 25 bp, Mus musculus
gcgggcgtgaagctcaagtactgcc

SEQ ID NO: 249559 - DNA, 25 bp, Mus musculus
gagagggagaatccctgctcgccgc

SEQ ID NO: 249560 - DNA, 25 bp, Mus musculus
tggcataaacaagtcgggaggaccc

SEQ ID NO: 249561 - DNA, 25 bp, Mus musculus
tcaggaagaggaaaatggcataaac

SEQ ID NO: 249562 - DNA, 25 bp, Mus musculus
cgagcgtctcaggaagaggaaaatg

SEQ ID NO: 249563 - DNA, 25 bp, Mus musculus
tgaagctcaagtactgccgctacta

SEQ ID NO: 249564 - DNA, 25 bp, Mus musculus
tccttccagtgacgtcaaggggtcc

SEQ ID NO: 249565 - DNA, 25 bp, Mus musculus
acaggttcgcaggttcagggtcctt

SEQ ID NO: 249566 - DNA, 25 bp, Mus musculus
ctctcaaggacctcgctgaagtgca

SEQ ID NO: 249567 - DNA, 25 bp, Mus musculus
tcccagcagctgaccatggtgagca

SEQ ID NO: 249568 - DNA, 25 bp, Mus musculus
tgagaagcagacacccgagcagcgc

SEQ ID NO: 249569 - DNA, 25 bp, Mus musculus
ctggcgcgcctcacctgtgagaagc

SEQ ID NO: 249570 - DNA, 25 bp, Mus musculus
gaactccaactcatggtccctggcg

SEQ ID NO: 249571 - DNA, 25 bp, Mus musculus
gaggcgtacccgctgctacaagtgt

SEQ ID NO: 249572 - DNA, 25 bp, Mus musculus
ggatgctgaaaggtccacccgtgtg

SEQ ID NO: 249573 - DNA, 25 bp, Mus musculus
tggtgatctgcactcccagagtcta

SEQ ID NO: 249574 - DNA, 25 bp, Mus musculus
ccagagtctaaggagtgagcgccta

SEQ ID NO: 249575 - DNA, 25 bp, Mus musculus
gtctaagcggtgatgccaacttcca

SEQ ID NO: 249576 - DNA, 25 bp, Mus musculus
cctaggagcaggctctggatgctga

SEQ ID NO: 249577 - DNA, 25 bp, Mus musculus
gcccatcgctctcaggaaatcctta

SEQ ID NO: 249578 - DNA, 25 bp, Mus musculus
gccatctccgatggccccagtggga

SEQ ID NO: 249579 - DNA, 25 bp, Mus musculus
ctcgcttctgccctagccgccgagg

SEQ ID NO: 249580 - DNA, 25 bp, Mus musculus
ccctagccgccgaggccagagggac

SEQ ID NO: 249581 - DNA, 25 bp, Mus musculus
acttggcagggccatctccgatggc

SEQ ID NO: 249582 - DNA, 25 bp, Mus musculus
agtgggagggtcacggctaagacac

SEQ ID NO: 249583 - DNA, 25 bp, Mus musculus
cacccggcccatctcattgtttcag

SEQ ID NO: 249584 - DNA, 25 bp, Mus musculus
cggcttcctcttctggcagaggcca

SEQ ID NO: 249585 - DNA, 25 bp, Mus musculus
ttcctcttctggcagaggccagcgg

SEQ ID NO: 249586 - DNA, 25 bp, Mus musculus
ctcttctggcagaggccagcggcgc

SEQ ID NO: 249587 - DNA, 25 bp, Mus musculus
cggctggagccctcgggatgtctac

SEQ ID NO: 249588 - DNA, 25 bp, Mus musculus
tggagccctcgggatgtctacctct

SEQ ID NO: 249589 - DNA, 25 bp, Mus musculus
cctctccgggagctcgcgtttcccg

SEQ ID NO: 249590 - DNA, 25 bp, Mus musculus
ccgctgagctcgcttctgccctagc

SEQ ID NO: 249591 - DNA, 25 bp, Mus musculus
agacacccggcccatctcattgttt

SEQ ID NO: 249592 - DNA, 25 bp, Mus musculus
ttcccagcagtggaggcggatgcac

SEQ ID NO: 249593 - DNA, 25 bp, Mus musculus
ccgtgggaagtctgtgcatttgcac

SEQ ID NO: 249594 - DNA, 25 bp, Mus musculus
tgcatttgcacacgcccatctaaca

SEQ ID NO: 249595 - DNA, 25 bp, Mus musculus
cttcctggccggaaggacgcacttc

SEQ ID NO: 249596 - DNA, 25 bp, Mus musculus
ccatgtgtcgctcccgttttgttcg

SEQ ID NO: 249597 - DNA, 25 bp, Mus musculus
catctctctgtgtgccatgtgtcgc

SEQ ID NO: 249598 - DNA, 25 bp, Mus musculus
ctcacagagctgtttcaaagatggt

SEQ ID NO: 249599 - DNA, 25 bp, Mus musculus
gcctcggtttacaaacatctctctg

SEQ ID NO: 249600 - DNA, 25 bp, Mus musculus
attcgtacagctcagcctcggttta

SEQ ID NO: 249601 - DNA, 25 bp, Mus musculus
gaccgcccgttgcattcgtacagct

SEQ ID NO: 249602 - DNA, 25 bp, Mus musculus
tgcgtgttgggacacgccacgtgcc

SEQ ID NO: 249603 - DNA, 25 bp, Mus musculus
gggcacctccgaaagccaagccttg

SEQ ID NO: 249604 - DNA, 25 bp, Mus musculus
gcggactcgagcaggtttatagatc

SEQ ID NO: 249605 - DNA, 25 bp, Mus musculus
gcggatgcactccatgcactgggca

SEQ ID NO: 249606 - DNA, 25 bp, Mus musculus
gggcctttcgagagtcacgatcttc

SEQ ID NO: 249607 - DNA, 25 bp, Mus musculus
cagcacttaaggctctctctgtaga

SEQ ID NO: 249608 - DNA, 25 bp, Mus musculus
ctctctgtagatcctgggttcctta

SEQ ID NO: 249609 - DNA, 25 bp, Mus musculus
tccttaagggcacggttcttagcgc

SEQ ID NO: 249610 - DNA, 25 bp, Mus musculus
ggttcttagcgcctctgtcctctaa

SEQ ID NO: 249611 - DNA, 25 bp, Mus musculus
ctctgtcctctaaccagcgcattga

SEQ ID NO: 249612 - DNA, 25 bp, Mus musculus
cagcgcattgactttgtgttgtaga

SEQ ID NO: 249613 - DNA, 25 bp, Mus musculus
tgtgttgtagaacgccagaggtctt

SEQ ID NO: 249614 - DNA, 25 bp, Mus musculus
cggagctgaaggacagtattccagt

SEQ ID NO: 249615 - DNA, 25 bp, Mus musculus
agctctcagccagcgggcctttcga

SEQ ID NO: 249616 - DNA, 25 bp, Mus musculus
cgatcttctccggaaagggtatgtc

SEQ ID NO: 249617 - DNA, 25 bp, Mus musculus
gctgtgtctcgctcgttctcacgaa

SEQ ID NO: 249618 - DNA, 25 bp, Mus musculus
ctggctaccgcagcacttaaggctc

SEQ ID NO: 249619 - DNA, 25 bp, Mus musculus
cagtattccagtcgcggagctctca

SEQ ID NO: 249620 - DNA, 25 bp, Mus musculus
atttcgatggcaagaaccgcggcta

SEQ ID NO: 249621 - DNA, 25 bp, Mus musculus
gatcctctacgtgcgcaacctcatg

SEQ ID NO: 249622 - DNA, 25 bp, Mus musculus
ctcatgccgggtcggatccaactgt

SEQ ID NO: 249623 - DNA, 25 bp, Mus musculus
tatgagagccatcgtgctgcagcca

SEQ ID NO: 249624 - DNA, 25 bp, Mus musculus
cttcgcctttgtggagtatgagagc

SEQ ID NO: 249625 - DNA, 25 bp, Mus musculus
accgagggcgtactcaacgtgattg

SEQ ID NO: 249626 - DNA, 25 bp, Mus musculus
ccaagcgagccgttcgggaactcaa

SEQ ID NO: 249627 - DNA, 25 bp, Mus musculus
cgcggctatgccttcgtgatgtact

SEQ ID NO: 249628 - DNA, 25 bp, Mus musculus
accgtaggtcgcatctatgagctgc

SEQ ID NO: 249629 - DNA, 25 bp, Mus musculus
ccacgtgacgtgtatgaagatgagc

SEQ ID NO: 249630 - DNA, 25 bp, Mus musculus
agagcgcaccggctacaccatggta

SEQ ID NO: 249631 - DNA, 25 bp, Mus musculus
actgttggcactgatagagcgcacc

SEQ ID NO: 249632 - DNA, 25 bp, Mus musculus
acgtgattgtgtatgccagtgcggc

SEQ ID NO: 249633 - DNA, 25 bp, Mus musculus
gtgtggacaactgccgcctcttcat

SEQ ID NO: 249634 - DNA, 25 bp, Mus musculus
tgggaaccgcctcttgcctttgcag

SEQ ID NO: 249635 - DNA, 25 bp, Mus musculus
gcccccttgctcgtcttggggattc

SEQ ID NO: 249636 - DNA, 25 bp, Mus musculus
gccgtggtccttagtgcccaagccg

SEQ ID NO: 249637 - DNA, 25 bp, Mus musculus
gccgccgtggtccttagtgcccaag

SEQ ID NO: 249638 - DNA, 25 bp, Mus musculus
ctgctgctgttgctctttaccaccg

SEQ ID NO: 249639 - DNA, 25 bp, Mus musculus
ccggctttgcagaacttggggcccg

SEQ ID NO: 249640 - DNA, 25 bp, Mus musculus
gtatggggccggctttgcagaactt

SEQ ID NO: 249641 - DNA, 25 bp, Mus musculus
agccaagttgtggaagtccgtggac

SEQ ID NO: 249642 - DNA, 25 bp, Mus musculus
tcccgagccaagttgtggaagtccg

SEQ ID NO: 249643 - DNA, 25 bp, Mus musculus
tttccagttcccgagccaagttgtg

SEQ ID NO: 249644 - DNA, 25 bp, Mus musculus
ggggccgctacgcaactgctgcttc

SEQ ID NO: 249645 - DNA, 25 bp, Mus musculus
actcagctccgcctcctggtggccg

SEQ ID NO: 249646 - DNA, 25 bp, Mus musculus
tggcgacgccgtcgggactcagctc

SEQ ID NO: 249647 - DNA, 25 bp, Mus musculus
tcttgcctttgcagccgccggtggc

SEQ ID NO: 249648 - DNA, 25 bp, Mus musculus
cggaagggacggactgaatgaccca

SEQ ID NO: 249649 - DNA, 25 bp, Mus musculus
cttcggagtccacgagcgctcaggt

SEQ ID NO: 249650 - DNA, 25 bp, Mus musculus
agtccacgagcgctcaggtgcgctc

SEQ ID NO: 249651 - DNA, 25 bp, Mus musculus
taccggaagcacgacggggacctca

SEQ ID NO: 249652 - DNA, 25 bp, Mus musculus
gacctcacggaagggacggactgaa

SEQ ID NO: 249653 - DNA, 25 bp, Mus musculus
ggacggactgaatgacccacaattc

SEQ ID NO: 249654 - DNA, 25 bp, Mus musculus
ctgaatgacccacaattctcctggg

SEQ ID NO: 249655 - DNA, 25 bp, Mus musculus
cccacaattctcctgggtccggagg

SEQ ID NO: 249656 - DNA, 25 bp, Mus musculus
caattctcctgggtccggagggcga

SEQ ID NO: 249657 - DNA, 25 bp, Mus musculus
gacctcgcctgggagttgagtgagt

SEQ ID NO: 249658 - DNA, 25 bp, Mus musculus
gtcgcgagtgccagtgtcacttgcc

SEQ ID NO: 249659 - DNA, 25 bp, Mus musculus
tgccagtgtcacttgccgcggcttc

SEQ ID NO: 249660 - DNA, 25 bp, Mus musculus
acttgccgcggcttcggagtccacg

SEQ ID NO: 249661 - DNA, 25 bp, Mus musculus
aagcacgacggggacctcacggaag

SEQ ID NO: 249662 - DNA, 25 bp, Mus musculus
ccgccgacttacgtgacgggcgaag

SEQ ID NO: 249663 - DNA, 25 bp, Mus musculus
ctccgtacaaggcagggaggaactc

SEQ ID NO: 249664 - DNA, 25 bp, Mus musculus
tccctgatttatccgcggtcgccga

SEQ ID NO: 249665 - DNA, 25 bp, Mus musculus
aagggcgactgtggaaacagagctc

SEQ ID NO: 249666 - DNA, 25 bp, Mus musculus
ctgcgccgccatcaagggcgactgt

SEQ ID NO: 249667 - DNA, 25 bp, Mus musculus
ggccgcactctctagcgcgtggctg

SEQ ID NO: 249668 - DNA, 25 bp, Mus musculus
ttcgcgatcgaagatcagtgccctc

SEQ ID NO: 249669 - DNA, 25 bp, Mus musculus
gccagcagccatcttcgcgatcgaa

SEQ ID NO: 249670 - DNA, 25 bp, Mus musculus
cagagtcaaggccagcaggcagcca

SEQ ID NO: 249671 - DNA, 25 bp, Mus musculus
gctcctcgctcgaggggccgatcag

SEQ ID NO: 249672 - DNA, 25 bp, Mus musculus
gagaccaggctgagacgccgccgac

SEQ ID NO: 249673 - DNA, 25 bp, Mus musculus
gaggaactcccaaagtcgccgtcgc

SEQ ID NO: 249674 - DNA, 25 bp, Mus musculus
aggctcctgccgagcactttgctcg

SEQ ID NO: 249675 - DNA, 25 bp, Mus musculus
ccgatcagcccagattggaaaagtg

SEQ ID NO: 249676 - DNA, 25 bp, Mus musculus
cgccttcccagtgggctctggactt

SEQ ID NO: 249677 - DNA, 25 bp, Mus musculus
cgctccggaaccaacgtgcagaggt

SEQ ID NO: 249678 - DNA, 25 bp, Mus musculus
tgcgccggaagtgaggcactcaaca

SEQ ID NO: 249679 - DNA, 25 bp, Mus musculus
gccgctatggcgcacatcaccatta

SEQ ID NO: 249680 - DNA, 25 bp, Mus musculus
acctacagcaggtgggtttcgcttg

SEQ ID NO: 249681 - DNA, 25 bp, Mus musculus
gtttcgcttggtatcctggcctacg

SEQ ID NO: 249682 - DNA, 25 bp, Mus musculus
cagcctgccttgttcggaagttgca

SEQ ID NO: 249683 - DNA, 25 bp, Mus musculus
agatcggggccacttgtagaaacgg

SEQ ID NO: 249684 - DNA, 25 bp, Mus musculus
aaacggttgtctgtgtagtcagcgc

SEQ ID NO: 249685 - DNA, 25 bp, Mus musculus
cgtgaccagggacacgttcccaagt

SEQ ID NO: 249686 - DNA, 25 bp, Mus musculus
cgggtcgctagcacaccgacgtgac

SEQ ID NO: 249687 - DNA, 25 bp, Mus musculus
agtcaggagcgcctctgcacacgga

SEQ ID NO: 249688 - DNA, 25 bp, Mus musculus
ctctggactttggttccgggagagt

SEQ ID NO: 249689 - DNA, 25 bp, Mus musculus
ggttgggaactcctccacgtcagtc

SEQ ID NO: 249690 - DNA, 25 bp, Mus musculus
tgcgtagatttgctctcagatgcga

SEQ ID NO: 249691 - DNA, 25 bp, Mus musculus
gctgtgtttccttagatcgcgcgga

SEQ ID NO: 249692 - DNA, 25 bp, Mus musculus
agtaagctgtgtttccttagatcgc

SEQ ID NO: 249693 - DNA, 25 bp, Mus musculus
cccaagagagtaagctgtgtttcct

SEQ ID NO: 249694 - DNA, 25 bp, Mus musculus
tctttctgccctgagtcctcaggac

SEQ ID NO: 249695 - DNA, 25 bp, Mus musculus
tctctttctgccctgagtcctcagg

SEQ ID NO: 249696 - DNA, 25 bp, Mus musculus
cgctagtgtgtagccggcgctctct

SEQ ID NO: 249697 - DNA, 25 bp, Mus musculus
attcgctagtgtgtagccggcgctc

SEQ ID NO: 249698 - DNA, 25 bp, Mus musculus
agatttgctctcagatgcgacttgc

SEQ ID NO: 249699 - DNA, 25 bp, Mus musculus
cgagctgcgtagatttgctctcaga

SEQ ID NO: 249700 - DNA, 25 bp, Mus musculus
cccattcgctagtgtgtagccggcg

SEQ ID NO: 249701 - DNA, 25 bp, Mus musculus
tgtttccttagatcgcgcggaccgc

SEQ ID NO: 249702 - DNA, 25 bp, Mus musculus
tgccgcccggcacagttccggggta

SEQ ID NO: 249703 - DNA, 25 bp, Mus musculus
ttgctctcagatgcgacttgccgcc

SEQ ID NO: 249704 - DNA, 25 bp, Mus musculus
ttgcccaccgccctagtgtggggca

SEQ ID NO: 249705 - DNA, 25 bp, Mus musculus
agccggggcaggagatgctcccact

SEQ ID NO: 249706 - DNA, 25 bp, Mus musculus
ggagatgctcccactggcaggaaca

SEQ ID NO: 249707 - DNA, 25 bp, Mus musculus
cactggcaggaacaggcggtcaaac

SEQ ID NO: 249708 - DNA, 25 bp, Mus musculus
acaggcggtcaaacgctgggaagcc

SEQ ID NO: 249709 - DNA, 25 bp, Mus musculus
caaacgctgggaagccagctcaagc

SEQ ID NO: 249710 - DNA, 25 bp, Mus musculus
aagcggcccggctggcatcaatcac

SEQ ID NO: 249711 - DNA, 25 bp, Mus musculus
ggctggcatcaatcactccgtgctg

SEQ ID NO: 249712 - DNA, 25 bp, Mus musculus
tggcatcaatcactccgtgctgttg

SEQ ID NO: 249713 - DNA, 25 bp, Mus musculus
tttagctccagcgtgtaagcgcacg

SEQ ID NO: 249714 - DNA, 25 bp, Mus musculus
tgctgttgcccaccgccctagtgtg

SEQ ID NO: 249715 - DNA, 25 bp, Mus musculus
ccctttagctccagcgtgtaagcgc

SEQ ID NO: 249716 - DNA, 25 bp, Mus musculus
gcgtgtcctgcggagccgtcacagc

SEQ ID NO: 249717 - DNA, 25 bp, Mus musculus
atcaatcactccgtgctgttgccca

SEQ ID NO: 249718 - DNA, 25 bp, Mus musculus
agcagccgctccgtgctcctccgga

SEQ ID NO: 249719 - DNA, 25 bp, Mus musculus
gagcggacgatctcagagccggccc

SEQ ID NO: 249720 - DNA, 25 bp, Mus musculus
cctccctacgcgctgcggccaaggg

SEQ ID NO: 249721 - DNA, 25 bp, Mus musculus
cggtgcgcgcgtcacccgctccctc

SEQ ID NO: 249722 - DNA, 25 bp, Mus musculus
aagtccttttcggtgcgcgcgtcac

SEQ ID NO: 249723 - DNA, 25 bp, Mus musculus
tgcgcaaacttctccgacttaagtc

SEQ ID NO: 249724 - DNA, 25 bp, Mus musculus
gctgtgcgcaaacttctccgactta

SEQ ID NO: 249725 - DNA, 25 bp, Mus musculus
tgaagctgtgcgcaaacttctccga

SEQ ID NO: 249726 - DNA, 25 bp, Mus musculus
ccgagatgaagctgtgcgcaaactt

SEQ ID NO: 249727 - DNA, 25 bp, Mus musculus
ctccgagatgaagctgtgcgcaaac

SEQ ID NO: 249728 - DNA, 25 bp, Mus musculus
tgctcgctccgagatgaagctgtgc

SEQ ID NO: 249729 - DNA, 25 bp, Mus musculus
ccgctgctcgctccgagatgaagct

SEQ ID NO: 249730 - DNA, 25 bp, Mus musculus
ggagcctcaccttagcagtgcctgc

SEQ ID NO: 249731 - DNA, 25 bp, Mus musculus
cgcgggagcctcaccttagcagtgc

SEQ ID NO: 249732 - DNA, 25 bp, Mus musculus
cgcgggaaactcctcgaactcgtcg

SEQ ID NO: 249733 - DNA, 25 bp, Mus musculus
gaaggtcctcccagagcgtcctgcg

SEQ ID NO: 249734 - DNA, 25 bp, Mus musculus
tcattcccgcagagagcaggcccgg

SEQ ID NO: 249735 - DNA, 25 bp, Mus musculus
cgccatgaagcgacggctaccggga

SEQ ID NO: 249736 - DNA, 25 bp, Mus musculus
cgccggcgcaaccatagagacgaga

SEQ ID NO: 249737 - DNA, 25 bp, Mus musculus
tcagtactccggaggcgccgatcct

SEQ ID NO: 249738 - DNA, 25 bp, Mus musculus
ccgcaaagtcggaagcctcagtact

SEQ ID NO: 249739 - DNA, 25 bp, Mus musculus
tgggcccagctcattcccgcagaga

SEQ ID NO: 249740 - DNA, 25 bp, Mus musculus
aatgctgggacagcgaaggtcctcc

SEQ ID NO: 249741 - DNA, 25 bp, Mus musculus
aagctgctcggaccggccgcaaagt

SEQ ID NO: 249742 - DNA, 25 bp, Mus musculus
gctgcttcttttcggacatcgcgcc

SEQ ID NO: 249743 - DNA, 25 bp, Mus musculus
gacccaagtcgaccggctgcttctt

SEQ ID NO: 249744 - DNA, 25 bp, Mus musculus
cgacgaggcgcaaaacactgggccg

SEQ ID NO: 249745 - DNA, 25 bp, Mus musculus
gtcctcttccaagagacccaagtcg

SEQ ID NO: 249746 - DNA, 25 bp, Mus musculus
aggtcggctcgaagcagctagttga

SEQ ID NO: 249747 - DNA, 25 bp, Mus musculus
ctcggcagcgaagtagtccaggcaa

SEQ ID NO: 249748 - DNA, 25 bp, Mus musculus
gtggacatagacaccaggcactcgg

SEQ ID NO: 249749 - DNA, 25 bp, Mus musculus
cgggcaccacagcttaaatcagcca

SEQ ID NO: 249750 - DNA, 25 bp, Mus musculus
cagcagcctgggaaattatcttgtc

SEQ ID NO: 249751 - DNA, 25 bp, Mus musculus
ctggcgagccaggtaatttcaatgc

SEQ ID NO: 249752 - DNA, 25 bp, Mus musculus
tagttgaggcacacggagcttcttc

SEQ ID NO: 249753 - DNA, 25 bp, Mus musculus
ctcatcctcgaagaaggcctgggta

SEQ ID NO: 249754 - DNA, 25 bp, Mus musculus
tctcggcgtcagagagctcatcctc

SEQ ID NO: 249755 - DNA, 25 bp, Mus musculus
aatcactgcaggagctctcggcgtc

SEQ ID NO: 249756 - DNA, 25 bp, Mus musculus
cgcatccaggatagcagaatcactg

SEQ ID NO: 249757 - DNA, 25 bp, Mus musculus
cgggcgtaatctgcctccttcggta

SEQ ID NO: 249758 - DNA, 25 bp, Mus musculus
acgacttgtagtaggccttgttgca

SEQ ID NO: 249759 - DNA, 25 bp, Mus musculus
cttcggagtcttccctgaagtcttc

SEQ ID NO: 249760 - DNA, 25 bp, Mus musculus
tcgatccctctgttgagtctccggc

SEQ ID NO: 249761 - DNA, 25 bp, Mus musculus
gatgctgtgacgacgaacccaaata

SEQ ID NO: 249762 - DNA, 25 bp, Mus musculus
acccaaatactgctccaggggaaca

SEQ ID NO: 249763 - DNA, 25 bp, Mus musculus
tccaggggaacaactgcgaccagcc

SEQ ID NO: 249764 - DNA, 25 bp, Mus musculus
cacaagactgtacctcgcggtagtt

SEQ ID NO: 249765 - DNA, 25 bp, Mus musculus
tcgaactgttcagggtctgcgaccc

SEQ ID NO: 249766 - DNA, 25 bp, Mus musculus
gcacgcgggctccatcaaaacaaaa

SEQ ID NO: 249767 - DNA, 25 bp, Mus musculus
gcagagggcaccaccctgtttaccg

SEQ ID NO: 249768 - DNA, 25 bp, Mus musculus
gctcgagccctgagccggaaacggt

SEQ ID NO: 249769 - DNA, 25 bp, Mus musculus
acacgccgtgccgagcaagccgtgg

SEQ ID NO: 249770 - DNA, 25 bp, Mus musculus
gggtagatagctccaagctgtcaga

SEQ ID NO: 249771 - DNA, 25 bp, Mus musculus
tgtcagaagcctacagtgtgtgcca

SEQ ID NO: 249772 - DNA, 25 bp, Mus musculus
tgtgtgccacatgacgaagctcgcc

SEQ ID NO: 249773 - DNA, 25 bp, Mus musculus
cggtctgctcgatccctctgttgag

SEQ ID NO: 249774 - DNA, 25 bp, Mus musculus
ggctgtctaacgcagtgccagattt

SEQ ID NO: 249775 - DNA, 25 bp, Mus musculus
gcgtctgcccggagaaaagcgtctc

SEQ ID NO: 249776 - DNA, 25 bp, Mus musculus
gcaggctaaaccgtaccacaccgaa

SEQ ID NO: 249777 - DNA, 25 bp, Mus musculus
ctcagtcaggccttggcttcctcaa

SEQ ID NO: 249778 - DNA, 25 bp, Mus musculus
ttcctcaacggcaaggtggcccgta

SEQ ID NO: 249779 - DNA, 25 bp, Mus musculus
cccgtacctcgagcgtgatggtttt

SEQ ID NO: 249780 - DNA, 25 bp, Mus musculus
cccgtaagggtcttcacaaagatct

SEQ ID NO: 249781 - DNA, 25 bp, Mus musculus
acaaagatctgcatcgtggcggcgg

SEQ ID NO: 249782 - DNA, 25 bp, Mus musculus
gcggctccacctgcattcgaaaaga

SEQ ID NO: 249783 - DNA, 25 bp, Mus musculus
ggattagatccgacgacacccgtga

SEQ ID NO: 249784 - DNA, 25 bp, Mus musculus
agcgcggccacagagcatacactca

SEQ ID NO: 249785 - DNA, 25 bp, Mus musculus
tcgccactcgggataaagcaggcta

SEQ ID NO: 249786 - DNA, 25 bp, Mus musculus
cagatttgctcgttcgctcggtttc

SEQ ID NO: 249787 - DNA, 25 bp, Mus musculus
ctcacccacgatggcggatcggaaa

SEQ ID NO: 249788 - DNA, 25 bp, Mus musculus
ttccttcgctcacccgccgagcatc

SEQ ID NO: 249789 - DNA, 25 bp, Mus musculus
gccaacccatctgcctcaccgagag

SEQ ID NO: 249790 - DNA, 25 bp, Mus musculus
tagcacagatgacgcgccaacccat

SEQ ID NO: 249791 - DNA, 25 bp, Mus musculus
aaatagcacagatgacgcgccaacc

SEQ ID NO: 249792 - DNA, 25 bp, Mus musculus
gggaaaatagcacagatgacgcgcc

SEQ ID NO: 249793 - DNA, 25 bp, Mus musculus
caagagagtccaccgggaaaatagc

SEQ ID NO: 249794 - DNA, 25 bp, Mus musculus
gtcaagagagtccaccgggaaaata

SEQ ID NO: 249795 - DNA, 25 bp, Mus musculus
gacgtcaagagagtccaccgggaaa

SEQ ID NO: 249796 - DNA, 25 bp, Mus musculus
gccgagcatcctggcccgctgcctc

SEQ ID NO: 249797 - DNA, 25 bp, Mus musculus
acgcagcaaccctaccttccttcgc

SEQ ID NO: 249798 - DNA, 25 bp, Mus musculus
atgcccgtttcacgcagcaacccta

SEQ ID NO: 249799 - DNA, 25 bp, Mus musculus
atagctccgacatgcccgtttcacg

SEQ ID NO: 249800 - DNA, 25 bp, Mus musculus
cgaaatagctccgacatgcccgttt

SEQ ID NO: 249801 - DNA, 25 bp, Mus musculus
gactgcgagggtggacgtcaagaga

SEQ ID NO: 249802 - DNA, 25 bp, Mus musculus
gctcagcgcaccacggtgggcgaca

SEQ ID NO: 249803 - DNA, 25 bp, Mus musculus
ttctagaattttcccatgatggttg

SEQ ID NO: 249804 - DNA, 25 bp, Mus musculus
attttcccatgatggttggtgggga

SEQ ID NO: 249805 - DNA, 25 bp, Mus musculus
actctgagacaggtgcggggctgcc

SEQ ID NO: 249806 - DNA, 25 bp, Mus musculus
ccggctaaaagttgctcagcgcacc

SEQ ID NO: 249807 - DNA, 25 bp, Mus musculus
aaaagttgctcagcgcaccacggtg

SEQ ID NO: 249808 - DNA, 25 bp, Mus musculus
tgtccctggcgtcgcccacttgtca

SEQ ID NO: 249809 - DNA, 25 bp, Mus musculus
tccgagagcgtattcttctagaatt

SEQ ID NO: 249810 - DNA, 25 bp, Mus musculus
gagcgatggggactctgagacaggt

SEQ ID NO: 249811 - DNA, 25 bp, Mus musculus
acttgtcacgccaggctgctgcgtg

SEQ ID NO: 249812 - DNA, 25 bp, Mus musculus
cgtagattccgagagcgtattcttc

SEQ ID NO: 249813 - DNA, 25 bp, Mus musculus
cgcacgtagattccgagagcgtatt

SEQ ID NO: 249814 - DNA, 25 bp, Mus musculus
gggctgccggctaaaagttgctcag

SEQ ID NO: 249815 - DNA, 25 bp, Mus musculus
gattccgagagcgtattcttctaga

SEQ ID NO: 249816 - DNA, 25 bp, Mus musculus
ttctgctaccctgaggggccctccc

SEQ ID NO: 249817 - DNA, 25 bp, Mus musculus
gaacctgatcctcggtagcgaaggg

SEQ ID NO: 249818 - DNA, 25 bp, Mus musculus
gaggaacctgatcctcggtagcgaa

SEQ ID NO: 249819 - DNA, 25 bp, Mus musculus
ggaacctgatcctcggtagcgaagg

SEQ ID NO: 249820 - DNA, 25 bp, Mus musculus
aggcgcaggtggtcgccttgggaag

SEQ ID NO: 249821 - DNA, 25 bp, Mus musculus
ggttctgctaccctgaggggccctc

SEQ ID NO: 249822 - DNA, 25 bp, Mus musculus
accgagctccccctgagccgcctgg

SEQ ID NO: 249823 - DNA, 25 bp, Mus musculus
acctgatcctcggtagcgaagggct

SEQ ID NO: 249824 - DNA, 25 bp, Mus musculus
cctgatcctcggtagcgaagggctg

SEQ ID NO: 249825 - DNA, 25 bp, Mus musculus
aagggctggaggcaaacaccgagct

SEQ ID NO: 249826 - DNA, 25 bp, Mus musculus
agggctggaggcaaacaccgagctc

SEQ ID NO: 249827 - DNA, 25 bp, Mus musculus
ggaggaacctgatcctcggtagcga

SEQ ID NO: 249828 - DNA, 25 bp, Mus musculus
ggctggaggcaaacaccgagctccc

SEQ ID NO: 249829 - DNA, 25 bp, Mus musculus
gggacggcgggaccgctaggagcta

SEQ ID NO: 249830 - DNA, 25 bp, Mus musculus
cgctgcataagtggagctccttctc

SEQ ID NO: 249831 - DNA, 25 bp, Mus musculus
aagttggggagtccatccgcaccct

SEQ ID NO: 249832 - DNA, 25 bp, Mus musculus
agagaagttggggagtccatccgca

SEQ ID NO: 249833 - DNA, 25 bp, Mus musculus
ctctgcacgagtggcgagagaagtt

SEQ ID NO: 249834 - DNA, 25 bp, Mus musculus
gcttagctctgcacgagtggcgaga

SEQ ID NO: 249835 - DNA, 25 bp, Mus musculus
cctgagcccgcagtaaaagtgctta

SEQ ID NO: 249836 - DNA, 25 bp, Mus musculus
tccacctaccttcccgagtaagtgc

SEQ ID NO: 249837 - DNA, 25 bp, Mus musculus
tgccctacgcgctgcataagtggag

SEQ ID NO: 249838 - DNA, 25 bp, Mus musculus
ctacggtgctgacaagatggcggct

SEQ ID NO: 249839 - DNA, 25 bp, Mus musculus
gtggccgctacggtgctgacaagat

SEQ ID NO: 249840 - DNA, 25 bp, Mus musculus
aggaagcggcctccaagcagccagt

SEQ ID NO: 249841 - DNA, 25 bp, Mus musculus
ccggagttcctgagcccgcagtaaa

SEQ ID NO: 249842 - DNA, 25 bp, Mus musculus
acggctcggacagcgccggagttcc

SEQ ID NO: 249843 - DNA, 25 bp, Mus musculus
cccgcagtaaaagtgcttagctctg

SEQ ID NO: 249844 - DNA, 25 bp, Mus musculus
cgcctcgtactcgaccctgcacatt

SEQ ID NO: 249845 - DNA, 25 bp, Mus musculus
gatgcgtacagtttcgaagtggccc

SEQ ID NO: 249846 - DNA, 25 bp, Mus musculus
gccagatgcgtacagtttcgaagtg

SEQ ID NO: 249847 - DNA, 25 bp, Mus musculus
acatagccagatgcgtacagtttcg

SEQ ID NO: 249848 - DNA, 25 bp, Mus musculus
tcccgcgaacatagccagatgcgta

SEQ ID NO: 249849 - DNA, 25 bp, Mus musculus
ccagtcccgcgaacatagccagatg

SEQ ID NO: 249850 - DNA, 25 bp, Mus musculus
ggggcgcggtatcattcccacgccg

SEQ ID NO: 249851 - DNA, 25 bp, Mus musculus
atatttttctgagggggcgcggtat

SEQ ID NO: 249852 - DNA, 25 bp, Mus musculus
tcccttcacagttcggtcaaaaaca

SEQ ID NO: 249853 - DNA, 25 bp, Mus musculus
acgcttcccttcacagttcggtcaa

SEQ ID NO: 249854 - DNA, 25 bp, Mus musculus
ctgcgcatttggcacaccacgcttc

SEQ ID NO: 249855 - DNA, 25 bp, Mus musculus
tccagaggcaaagcgcctgcgcatt

SEQ ID NO: 249856 - DNA, 25 bp, Mus musculus
tacacctcttccagaggcaaagcgc

SEQ ID NO: 249857 - DNA, 25 bp, Mus musculus
cctgcacattccacatacacctctt

SEQ ID NO: 249858 - DNA, 25 bp, Mus musculus
tggtgccaaggtcaggactctgcgt

SEQ ID NO: 249859 - DNA, 25 bp, Mus musculus
gcgcacgttgctgcgaagactcccg

SEQ ID NO: 249860 - DNA, 25 bp, Mus musculus
cgctgggctgcgaacaataagcaga

SEQ ID NO: 249861 - DNA, 25 bp, Mus musculus
agaggaggaaactccgccctggagc

SEQ ID NO: 249862 - DNA, 25 bp, Mus musculus
acacggagccagcagcgacgagcga

SEQ ID NO: 249863 - DNA, 25 bp, Mus musculus
tcctgcctaccgcagagctgggctg

SEQ ID NO: 249864 - DNA, 25 bp, Mus musculus
acctgcggggttctccaatttggag

SEQ ID NO: 249865 - DNA, 25 bp, Mus musculus
acggccgcgaactccggagtcgcga

SEQ ID NO: 249866 - DNA, 25 bp, Mus musculus
tgagatgcaggcgacagtagcagca

SEQ ID NO: 249867 - DNA, 25 bp, Mus musculus
accattatgggagtgagatgcaggc

SEQ ID NO: 249868 - DNA, 25 bp, Mus musculus
cgcggctgtccactcaccattatgg

SEQ ID NO: 249869 - DNA, 25 bp, Mus musculus
aagcggtccgaccacgcggtgcagc

SEQ ID NO: 249870 - DNA, 25 bp, Mus musculus
ccagcagcgacgagcgaaggtgtct

SEQ ID NO: 249871 - DNA, 25 bp, Mus musculus
gagaggctgcaagcggtccgaccac

SEQ ID NO: 249872 - DNA, 25 bp, Mus musculus
ccgggcttgacagctcctcttgcag

SEQ ID NO: 249873 - DNA, 25 bp, Mus musculus
cagcgccgcattgacactgcagatg

SEQ ID NO: 249874 - DNA, 25 bp, Mus musculus
acactgcagatggtgcctgtaccgc

SEQ ID NO: 249875 - DNA, 25 bp, Mus musculus
gccctcctctgaacgtgtgcgtgtg

SEQ ID NO: 249876 - DNA, 25 bp, Mus musculus
cgcaaatactccaccgaggcacggg

SEQ ID NO: 249877 - DNA, 25 bp, Mus musculus
ccaaatcagagcctgccgggcttga

SEQ ID NO: 249878 - DNA, 25 bp, Mus musculus
agctcctcttgcagcgtccaaggtg

SEQ ID NO: 249879 - DNA, 25 bp, Mus musculus
ccggagcccaagcagcgacagcggt

SEQ ID NO: 249880 - DNA, 25 bp, Mus musculus
ccgcgggctgaatgtccttgatgcc

SEQ ID NO: 249881 - DNA, 25 bp, Mus musculus
tgtccttgatgccaagcgggcacgg

SEQ ID NO: 249882 - DNA, 25 bp, Mus musculus
agagcgcggccgtagtccaagccga

SEQ ID NO: 249883 - DNA, 25 bp, Mus musculus
tcgctgctgctgtgcattgaagccc

SEQ ID NO: 249884 - DNA, 25 bp, Mus musculus
gctccttacctggaagcgcggcgtt

SEQ ID NO: 249885 - DNA, 25 bp, Mus musculus
tccaaggtgggcgtaatgtccaaca

SEQ ID NO: 249886 - DNA, 25 bp, Mus musculus
acgcttctcttgcagggcaggagca

SEQ ID NO: 249887 - DNA, 25 bp, Mus musculus
ggtgctagcggtcccgcccatggct

SEQ ID NO: 249888 - DNA, 25 bp, Mus musculus
cacacttgcgcgtgaaagccctgga

SEQ ID NO: 249889 - DNA, 25 bp, Mus musculus
cgggttagcccgagaagcaaactgc

SEQ ID NO: 249890 - DNA, 25 bp, Mus musculus
gaaagccctggacgcttctcttgca

SEQ ID NO: 249891 - DNA, 25 bp, Mus musculus
ccgcagagtctggagcgtggaccta

SEQ ID NO: 249892 - DNA, 25 bp, Mus musculus
gttctcgtccgcctcgaaggtgacc

SEQ ID NO: 249893 - DNA, 25 bp, Mus musculus
ccacggtgatgttctcgttctcgtc

SEQ ID NO: 249894 - DNA, 25 bp, Mus musculus
ccggatgcccttcaccacggtgatg

SEQ ID NO: 249895 - DNA, 25 bp, Mus musculus
ggatccgaggtcaaaggctgccctc

SEQ ID NO: 249896 - DNA, 25 bp, Mus musculus
caggcacatttcagcgttgggatcc

SEQ ID NO: 249897 - DNA, 25 bp, Mus musculus
caggtgcagctgtcccaggcacatt

SEQ ID NO: 249898 - DNA, 25 bp, Mus musculus
tcacgtgccagaagtaggccgcttc

SEQ ID NO: 249899 - DNA, 25 bp, Mus musculus
gtggacctacgagcacgtcaggacc

SEQ ID NO: 249900 - DNA, 25 bp, Mus musculus
tgtgtccacagggacgcacccaccc

SEQ ID NO: 249901 - DNA, 25 bp, Mus musculus
gtccacagggacgcacccacccgag

SEQ ID NO: 249902 - DNA, 25 bp, Mus musculus
agggacgcacccacccgagctggag

SEQ ID NO: 249903 - DNA, 25 bp, Mus musculus
agcgtctgtgtccacagggacgcac

SEQ ID NO: 249904 - DNA, 25 bp, Mus musculus
acgcacccacccgagctggagggtc

SEQ ID NO: 249905 - DNA, 25 bp, Mus musculus
agggtctgtgtccacagggacgcac

SEQ ID NO: 249906 - DNA, 25 bp, Mus musculus
ggtctgtgtccacagggacgcaccc

SEQ ID NO: 249907 - DNA, 25 bp, Mus musculus
tctgtgtccacagggacgcacccac

SEQ ID NO: 249908 - DNA, 25 bp, Mus musculus
gcgtctgtgtccacagggacgcacc

SEQ ID NO: 249909 - DNA, 25 bp, Mus musculus
gacgcacccacccgagctggagggt

SEQ ID NO: 249910 - DNA, 25 bp, Mus musculus
gtctgtgtccacagggacgcaccca

SEQ ID NO: 249911 - DNA, 25 bp, Mus musculus
tgtccacagggacgcacccacccga

SEQ ID NO: 249912 - DNA, 25 bp, Mus musculus
cgtctgtgtccacagggacgcaccc

SEQ ID NO: 249913 - DNA, 25 bp, Mus musculus
cagggacgcacccacccgagctgga

SEQ ID NO: 249914 - DNA, 25 bp, Mus musculus
taccctagaaaatccgcgcgcaaca

SEQ ID NO: 249915 - DNA, 25 bp, Mus musculus
cggccagaccaggagctgtagttct

SEQ ID NO: 249916 - DNA, 25 bp, Mus musculus
ggtatcccgtgcagcgcactaggga

SEQ ID NO: 249917 - DNA, 25 bp, Mus musculus
cggaccagcttcgagaacccgggcg

SEQ ID NO: 249918 - DNA, 25 bp, Mus musculus
cgggccagcagctctaggaagatca

SEQ ID NO: 249919 - DNA, 25 bp, Mus musculus
aggaagatcacattactgcagcagc

SEQ ID NO: 249920 - DNA, 25 bp, Mus musculus
cgcgcagaaaaagcgccctttcagt

SEQ ID NO: 249921 - DNA, 25 bp, Mus musculus
gggccgtcttgatcaactcttcctc

SEQ ID NO: 249922 - DNA, 25 bp, Mus musculus
agaccgcgcgcctttacggcaggcg

SEQ ID NO: 249923 - DNA, 25 bp, Mus musculus
gcgtcctagggctaaccaaactaca

SEQ ID NO: 249924 - DNA, 25 bp, Mus musculus
catacccggtcccattcatttgagg

SEQ ID NO: 249925 - DNA, 25 bp, Mus musculus
ctgtagttctcagtcatacccggtc

SEQ ID NO: 249926 - DNA, 25 bp, Mus musculus
gccctttcagttcgctaccctagaa

SEQ ID NO: 249927 - DNA, 25 bp, Mus musculus
gttccctccctgagggccgtcttga

SEQ ID NO: 249928 - DNA, 25 bp, Mus musculus
cctcggaagcctgggtgccttcatt

SEQ ID NO: 249929 - DNA, 25 bp, Mus musculus
tctctcagttgctcatctgggcggc

SEQ ID NO: 249930 - DNA, 25 bp, Mus musculus
gcaggaggagaagtcttattgttcc

SEQ ID NO: 249931 - DNA, 25 bp, Mus musculus
ttattgttcctggagctgtcgcctt

SEQ ID NO: 249932 - DNA, 25 bp, Mus musculus
aaccgcccgcggctctgaggagaag

SEQ ID NO: 249933 - DNA, 25 bp, Mus musculus
gtagctgcagcatcatcgccgacca

SEQ ID NO: 249934 - DNA, 25 bp, Mus musculus
tcgccgaccatggaagacatagacc

SEQ ID NO: 249935 - DNA, 25 bp, Mus musculus
tcgctggtctcctcgtccgcggata

SEQ ID NO: 249936 - DNA, 25 bp, Mus musculus
gcccgctttcaagtaccagttcgtg

SEQ ID NO: 249937 - DNA, 25 bp, Mus musculus
gggagcacgtgcaccgctgccaagt

SEQ ID NO: 249938 - DNA, 25 bp, Mus musculus
cctagggctttgtctacgagtggca

SEQ ID NO: 249939 - DNA, 25 bp, Mus musculus
tgccttcattgtttgtcggggtttc

SEQ ID NO: 249940 - DNA, 25 bp, Mus musculus
caaactgggcggagagtctgccctc

SEQ ID NO: 249941 - DNA, 25 bp, Mus musculus
tggacttcagcagcgactcggtgcc

SEQ ID NO: 249942 - DNA, 25 bp, Mus musculus
ttgagttccagatggctggccatga

SEQ ID NO: 249943 - DNA, 25 bp, Mus musculus
ggtcaccgtgggtgtgtctccacct

SEQ ID NO: 249944 - DNA, 25 bp, Mus musculus
gtcggcgaggatgcttctttcccta

SEQ ID NO: 249945 - DNA, 25 bp, Mus musculus
acggctgagagacggatccttctga

SEQ ID NO: 249946 - DNA, 25 bp, Mus musculus
cctgccattggttgcacggctgaga

SEQ ID NO: 249947 - DNA, 25 bp, Mus musculus
gcctgtagaaagaacgcctgccatt

SEQ ID NO: 249948 - DNA, 25 bp, Mus musculus
ctcgggcgcgcacctttaaatagcc

SEQ ID NO: 249949 - DNA, 25 bp, Mus musculus
gggtcgcaccctgatgcatgcctac

SEQ ID NO: 249950 - DNA, 25 bp, Mus musculus
ggccatgatcgctgcacgttacaaa

SEQ ID NO: 249951 - DNA, 25 bp, Mus musculus
catcttggtgccgttgttgagttcc

SEQ ID NO: 249952 - DNA, 25 bp, Mus musculus
cggaattctccagctgctctgcttg

SEQ ID NO: 249953 - DNA, 25 bp, Mus musculus
ccctaggtcctagcggcacggaatt

SEQ ID NO: 249954 - DNA, 25 bp, Mus musculus
accggcaaatgtgcagcgctggctc

SEQ ID NO: 249955 - DNA, 25 bp, Mus musculus
atccttctgattggtcgatgccgcg

SEQ ID NO: 249956 - DNA, 25 bp, Mus musculus
tatgatgaagcttcgcgaggccttc

SEQ ID NO: 249957 - DNA, 25 bp, Mus musculus
cagcgaccgctgaatttcgatggca

SEQ ID NO: 249958 - DNA, 25 bp, Mus musculus
gatggcatttgctctgaccctgtcg

SEQ ID NO: 249959 - DNA, 25 bp, Mus musculus
ctaaagtattctcccggcaggggtg

SEQ ID NO: 249960 - DNA, 25 bp, Mus musculus
cgaccggcggacttgaagaggccca

SEQ ID NO: 249961 - DNA, 25 bp, Mus musculus
ctcgtccgcgcacgtaaggagctgc

SEQ ID NO: 249962 - DNA, 25 bp, Mus musculus
tcgtaatttcgagccgtcatccggg

SEQ ID NO: 249963 - DNA, 25 bp, Mus musculus
tcatccggggctgaagcttcggtct

SEQ ID NO: 249964 - DNA, 25 bp, Mus musculus
cccgagatgtcacctagaaaccgct

SEQ ID NO: 249965 - DNA, 25 bp, Mus musculus
gaaaccgctctctcgactgcagttg

SEQ ID NO: 249966 - DNA, 25 bp, Mus musculus
ctgcagttggcgtttatgatgaagc

SEQ ID NO: 249967 - DNA, 25 bp, Mus musculus
cccgaacgcgctcgtctgtagacgt

SEQ ID NO: 249968 - DNA, 25 bp, Mus musculus
gagagtacagccgttgccctggcaa

SEQ ID NO: 249969 - DNA, 25 bp, Mus musculus
aacaagcggcctgctctctcagcga

SEQ ID NO: 249970 - DNA, 25 bp, Mus musculus
ccatcgagccagcagccaggtcctg

SEQ ID NO: 249971 - DNA, 25 bp, Mus musculus
aggctcctgtttctgtcagctgttg

SEQ ID NO: 249972 - DNA, 25 bp, Mus musculus
catccgcaggctcctgtttctgtca

SEQ ID NO: 249973 - DNA, 25 bp, Mus musculus
tgcagaccgcgggtcacatccgcag

SEQ ID NO: 249974 - DNA, 25 bp, Mus musculus
cagaactgcgagacgcgcacgcatc

SEQ ID NO: 249975 - DNA, 25 bp, Mus musculus
ttccggggattcagaactgcgagac

SEQ ID NO: 249976 - DNA, 25 bp, Mus musculus
cagcgctgcggtccttcccgtgggt

SEQ ID NO: 249977 - DNA, 25 bp, Mus musculus
acgtcgctgcactagcgcggagctg

SEQ ID NO: 249978 - DNA, 25 bp, Mus musculus
cacacgcgggacgtcgctgcactag

SEQ ID NO: 249979 - DNA, 25 bp, Mus musculus
tctcacccagaaggcacacgcggga

SEQ ID NO: 249980 - DNA, 25 bp, Mus musculus
cctggaaaatctcacccagaaggca

SEQ ID NO: 249981 - DNA, 25 bp, Mus musculus
aggtttctggagctcagcgctgatc

SEQ ID NO: 249982 - DNA, 25 bp, Mus musculus
ttctgtcagctgttgtgacggaggc

SEQ ID NO: 249983 - DNA, 25 bp, Mus musculus
cctgcccgccgcaaggtttctggag

SEQ ID NO: 249984 - DNA, 25 bp, Mus musculus
gaagagcaggtactcccggaccagc

SEQ ID NO: 249985 - DNA, 25 bp, Mus musculus
cgggcgcctcgtacgtcacgccacg

SEQ ID NO: 249986 - DNA, 25 bp, Mus musculus
tatctcgggcgcctcgtacgtcacg

SEQ ID NO: 249987 - DNA, 25 bp, Mus musculus
gcgcgctgcaaaagacccgagccgc

SEQ ID NO: 249988 - DNA, 25 bp, Mus musculus
tgcgcgcgcgcgctgcaaaagaccc

SEQ ID NO: 249989 - DNA, 25 bp, Mus musculus
accagctcgtctgtgcgctccaccg

SEQ ID NO: 249990 - DNA, 25 bp, Mus musculus
gtactcccggaccagctcgtctgtg

SEQ ID NO: 249991 - DNA, 25 bp, Mus musculus
tctttgtccgccttgatctccgcat

SEQ ID NO: 249992 - DNA, 25 bp, Mus musculus
agagcaggtactcccggaccagctc

SEQ ID NO: 249993 - DNA, 25 bp, Mus musculus
tgtgtgcgtgaagccacggaagagc

SEQ ID NO: 249994 - DNA, 25 bp, Mus musculus
tgccgcagtgtgtgcgtgaagccac

SEQ ID NO: 249995 - DNA, 25 bp, Mus musculus
ccagctgccgcagtgtgtgcgtgaa

SEQ ID NO: 249996 - DNA, 25 bp, Mus musculus
ccgccttgatctccgcatccagctg

SEQ ID NO: 249997 - DNA, 25 bp, Mus musculus
aggtactcccggaccagctcgtctg

SEQ ID NO: 249998 - DNA, 25 bp, Mus musculus
ctagagcttgcgtggggatcacccg

SEQ ID NO: 249999 - DNA, 25 bp, Mus musculus
gactcctagagcttgcgtggggatc

SEQ ID NO: 250000 - DNA, 25 bp, Mus musculus
gatcacccgggactcctagagcgtg

SEQ ID NO: 250001 - DNA, 25 bp, Mus musculus
ggatcacccgggactcctagagctt

SEQ ID NO: 250002 - DNA, 25 bp, Mus musculus
tgcgtggggatcacccgggactcct

SEQ ID NO: 250003 - DNA, 25 bp, Mus musculus
gcgtggggatcacccgggactccta

SEQ ID NO: 250004 - DNA, 25 bp, Mus musculus
gatcacccgggactcctagagcttg

SEQ ID NO: 250005 - DNA, 25 bp, Mus musculus
atcacccgggactcctagagcttgc

SEQ ID NO: 250006 - DNA, 25 bp, Mus musculus
ctcctagagcttgcgtggggatcac

SEQ ID NO: 250007 - DNA, 25 bp, Mus musculus
gggatcacccgggactcctagagcg

SEQ ID NO: 250008 - DNA, 25 bp, Mus musculus
acccgggactcctagagcgtgcgtg

SEQ ID NO: 250009 - DNA, 25 bp, Mus musculus
cctagagcttgcgtggggatcaccc

SEQ ID NO: 250010 - DNA, 25 bp, Mus musculus
cctagagcgtgcgtggggatcaccc

SEQ ID NO: 250011 - DNA, 25 bp, Mus musculus
cacccgggactcctagagcgtgcgt

SEQ ID NO: 250012 - DNA, 25 bp, Mus musculus
agacgggccaccatcttacattagg

SEQ ID NO: 250013 - DNA, 25 bp, Mus musculus
agcgccggctttcttcttgttttgc

SEQ ID NO: 250014 - DNA, 25 bp, Mus musculus
cccgcccgccatagataggtatctg

SEQ ID NO: 250015 - DNA, 25 bp, Mus musculus
tggtcggcggttttcactaatgtta

SEQ ID NO: 250016 - DNA, 25 bp, Mus musculus
cgggaactcgttcctcacgtggcta

SEQ ID NO: 250017 - DNA, 25 bp, Mus musculus
gcaggccgggaattgaagtcatcac

SEQ ID NO: 250018 - DNA, 25 bp, Mus musculus
ttgtagtcctccgatagtaaccgcc

SEQ ID NO: 250019 - DNA, 25 bp, Mus musculus
actggtccactgcaccctgggagtt

SEQ ID NO: 250020 - DNA, 25 bp, Mus musculus
cctttacggctgagagagagactct

SEQ ID NO: 250021 - DNA, 25 bp, Mus musculus
tgcttcagtgagtccgacctttacg

SEQ ID NO: 250022 - DNA, 25 bp, Mus musculus
gaaccgggcctgactgcttcagtga

SEQ ID NO: 250023 - DNA, 25 bp, Mus musculus
ttctcttagccgactccacgcgttg

SEQ ID NO: 250024 - DNA, 25 bp, Mus musculus
tacattagggtaagactcctccggc

SEQ ID NO: 250025 - DNA, 25 bp, Mus musculus
gactctcagctttcggtgggttcca

SEQ ID NO: 250026 - DNA, 25 bp, Mus musculus
ggagccttgtgcacacccgctcgag

SEQ ID NO: 250027 - DNA, 25 bp, Mus musculus
cgcctccgtttgaatggcgcgcggc

SEQ ID NO: 250028 - DNA, 25 bp, Mus musculus
tttggccctcgaaacgggcgtgtga

SEQ ID NO: 250029 - DNA, 25 bp, Mus musculus
ttcaggtgtaggcaggccatctacc

SEQ ID NO: 250030 - DNA, 25 bp, Mus musculus
gcaggccatctaccgccgaggtacg

SEQ ID NO: 250031 - DNA, 25 bp, Mus musculus
taccgccgaggtacggctcaagtcc

SEQ ID NO: 250032 - DNA, 25 bp, Mus musculus
tgcaccgttgtcacagccacggcgg

SEQ ID NO: 250033 - DNA, 25 bp, Mus musculus
gtcgcagttagactcgatggcccta

SEQ ID NO: 250034 - DNA, 25 bp, Mus musculus
ctcgatggccctaggccagagcagg

SEQ ID NO: 250035 - DNA, 25 bp, Mus musculus
cgcccttgtgttcaggcgtcgacgc

SEQ ID NO: 250036 - DNA, 25 bp, Mus musculus
aggtacggctcaagtcccgggctgt

SEQ ID NO: 250037 - DNA, 25 bp, Mus musculus
cgagcctcgcatggcgttctcggag

SEQ ID NO: 250038 - DNA, 25 bp, Mus musculus
cttgttttaacggtaatggtcgcag

SEQ ID NO: 250039 - DNA, 25 bp, Mus musculus
acagccacggcggacggtgacatcg

SEQ ID NO: 250040 - DNA, 25 bp, Mus musculus
gctggagctggagcacctctcacac

SEQ ID NO: 250041 - DNA, 25 bp, Mus musculus
tgcttcccgagatggccgtcagagg

SEQ ID NO: 250042 - DNA, 25 bp, Mus musculus
ggctcgtcgccctcgggtttgctcg

SEQ ID NO: 250043 - DNA, 25 bp, Mus musculus
ctgcagttggggctcgtcgccctcg

SEQ ID NO: 250044 - DNA, 25 bp, Mus musculus
cacggctctgcagttggggctcgtc

SEQ ID NO: 250045 - DNA, 25 bp, Mus musculus
gatcgggcctcgcggtcgcctcgtt

SEQ ID NO: 250046 - DNA, 25 bp, Mus musculus
tccagttcctggtgagtggggcctc

SEQ ID NO: 250047 - DNA, 25 bp, Mus musculus
atcatgctccagttcctggtgagtg

SEQ ID NO: 250048 - DNA, 25 bp, Mus musculus
tggagcacctctcacaccctcctcg

SEQ ID NO: 250049 - DNA, 25 bp, Mus musculus
acctggcagcgggttccgccctcgc

SEQ ID NO: 250050 - DNA, 25 bp, Mus musculus
ctcttgcttcccgagatggccgtca

SEQ ID NO: 250051 - DNA, 25 bp, Mus musculus
ggcgctgcggctccgcgagtcgctt

SEQ ID NO: 250052 - DNA, 25 bp, Mus musculus
agtcgcttccgggaatggagagggc

SEQ ID NO: 250053 - DNA, 25 bp, Mus musculus
accgacatcatgctccagttcctgg

SEQ ID NO: 250054 - DNA, 25 bp, Mus musculus
cgccttagcaacaacacagcggtta

SEQ ID NO: 250055 - DNA, 25 bp, Mus musculus
cgcacgttcaggaaatcgttcccga

SEQ ID NO: 250056 - DNA, 25 bp, Mus musculus
aactgctcgggtttccttctcagga

SEQ ID NO: 250057 - DNA, 25 bp, Mus musculus
gggacaggccacagccgccttagca

SEQ ID NO: 250058 - DNA, 25 bp, Mus musculus
aggcgcattatcctggccggccaag

SEQ ID NO: 250059 - DNA, 25 bp, Mus musculus
gtctccgtttttcagggcccacatg

SEQ ID NO: 250060 - DNA, 25 bp, Mus musculus
gggcccacatgaactccttgtcgca

SEQ ID NO: 250061 - DNA, 25 bp, Mus musculus
ttgtcgcacatgactgcagcggggt

SEQ ID NO: 250062 - DNA, 25 bp, Mus musculus
gaaagttcttctgcagccgttgggc

SEQ ID NO: 250063 - DNA, 25 bp, Mus musculus
gcaggttccgcctagctgaggagaa

SEQ ID NO: 250064 - DNA, 25 bp, Mus musculus
gcaggacgcttacacttccggttca

SEQ ID NO: 250065 - DNA, 25 bp, Mus musculus
tctctccagaaagctctgctcggga

SEQ ID NO: 250066 - DNA, 25 bp, Mus musculus
gcttacctcaggagagccacttttg

SEQ ID NO: 250067 - DNA, 25 bp, Mus musculus
ttcaaagattgcagtacccggggta

SEQ ID NO: 250068 - DNA, 25 bp, Mus musculus
gcacccgggactcgagaagttaagc

SEQ ID NO: 250069 - DNA, 25 bp, Mus musculus
gcgtgttaaactgcacctcttgtta

SEQ ID NO: 250070 - DNA, 25 bp, Mus musculus
actgcacctcttgttaaaagggaag

SEQ ID NO: 250071 - DNA, 25 bp, Mus musculus
gaacaagggagccacttaaaaatga

SEQ ID NO: 250072 - DNA, 25 bp, Mus musculus
ggagccacttaaaaatgaattcaga

SEQ ID NO: 250073 - DNA, 25 bp, Mus musculus
tcagagttactgaaccggcacccgg

SEQ ID NO: 250074 - DNA, 25 bp, Mus musculus
cccgggactcgagaagttaagcgtg

SEQ ID NO: 250075 - DNA, 25 bp, Mus musculus
agcgccaatgtagctgcgggcgaaa

SEQ ID NO: 250076 - DNA, 25 bp, Mus musculus
cgcacggatcgcgttacaggttcgc

SEQ ID NO: 250077 - DNA, 25 bp, Mus musculus
tgcgggcgaaactctggagaaaacc

SEQ ID NO: 250078 - DNA, 25 bp, Mus musculus
aactctggagaaaaccggctggcca

SEQ ID NO: 250079 - DNA, 25 bp, Mus musculus
agaaaaccggctggccacgagcctc

SEQ ID NO: 250080 - DNA, 25 bp, Mus musculus
gatatgtaaacgcacggatcgcgtt

SEQ ID NO: 250081 - DNA, 25 bp, Mus musculus
ttacaggttcgcgtgttaaactgca

SEQ ID NO: 250082 - DNA, 25 bp, Mus musculus
cgatggtctcgccatcgaagtgcac

SEQ ID NO: 250083 - DNA, 25 bp, Mus musculus
tccacggcgcgctgcgattagcagt

SEQ ID NO: 250084 - DNA, 25 bp, Mus musculus
tgtaggatctccaggctgccagatt

SEQ ID NO: 250085 - DNA, 25 bp, Mus musculus
gaagcctcgctgctggatctagccg

SEQ ID NO: 250086 - DNA, 25 bp, Mus musculus
agatccatgctggaagcctcgctgc

SEQ ID NO: 250087 - DNA, 25 bp, Mus musculus
gctgccagattctgcacagtcgtgc

SEQ ID NO: 250088 - DNA, 25 bp, Mus musculus
cgtgcgccgcattgtacaccgctgt

SEQ ID NO: 250089 - DNA, 25 bp, Mus musculus
tggccgtggcgattggccacctcca

SEQ ID NO: 250090 - DNA, 25 bp, Mus musculus
ccagatactccaccacgtctaggtg

SEQ ID NO: 250091 - DNA, 25 bp, Mus musculus
gcgccgcagtggtccaccagatact

SEQ ID NO: 250092 - DNA, 25 bp, Mus musculus
aaggctacgcaccacggccaggtga

SEQ ID NO: 250093 - DNA, 25 bp, Mus musculus
gtggcccttgtagcaggagatcata

SEQ ID NO: 250094 - DNA, 25 bp, Mus musculus
caggagatcataaggcacgtgtggc

SEQ ID NO: 250095 - DNA, 25 bp, Mus musculus
tacaccgctgtgtgcagatccatgc

SEQ ID NO: 250096 - DNA, 25 bp, Mus musculus
gcaagcgggcaaccagctgaggact

SEQ ID NO: 250097 - DNA, 25 bp, Mus musculus
gctccagccagactccaccagatcg

SEQ ID NO: 250098 - DNA, 25 bp, Mus musculus
cccgccaaaggctcctcgctccagc

SEQ ID NO: 250099 - DNA, 25 bp, Mus musculus
cggtccaacctgagcccgccaaagg

SEQ ID NO: 250100 - DNA, 25 bp, Mus musculus
gccgctcgctcccaaaccggtccaa

SEQ ID NO: 250101 - DNA, 25 bp, Mus musculus
aggactccgagctgtgccgctcgct

SEQ ID NO: 250102 - DNA, 25 bp, Mus musculus
gggcaaccagctgaggactccgagc

SEQ ID NO: 250103 - DNA, 25 bp, Mus musculus
ctcgcaagatccagggagaaggcaa

SEQ ID NO: 250104 - DNA, 25 bp, Mus musculus
gcttttctctcgcaagatccaggga

SEQ ID NO: 250105 - DNA, 25 bp, Mus musculus
ctttcgcttttctctcgcaagatcc

SEQ ID NO: 250106 - DNA, 25 bp, Mus musculus
gtggcgacaactaatctttcgcttt

SEQ ID NO: 250107 - DNA, 25 bp, Mus musculus
acccgtctaagtgcggtggcgacaa

SEQ ID NO: 250108 - DNA, 25 bp, Mus musculus
accagctgaggactccgagctgtgc

SEQ ID NO: 250109 - DNA, 25 bp, Mus musculus
tgcggtggcgacaactaatctttcg

SEQ ID NO: 250110 - DNA, 25 bp, Mus musculus
ttgtgggaaactccgtgcctccact

SEQ ID NO: 250111 - DNA, 25 bp, Mus musculus
cctgcaggcaatggatcgcagtgga

SEQ ID NO: 250112 - DNA, 25 bp, Mus musculus
tctgcctgcaggcaatggatcgcag

SEQ ID NO: 250113 - DNA, 25 bp, Mus musculus
ttgaactctgcctgcaggcaatgga

SEQ ID NO: 250114 - DNA, 25 bp, Mus musculus
tgaacttgaactctgcctgcaggca

SEQ ID NO: 250115 - DNA, 25 bp, Mus musculus
ggactgaacttgaactctgcctgca

SEQ ID NO: 250116 - DNA, 25 bp, Mus musculus
gccggctccctccaattctcccacc

SEQ ID NO: 250117 - DNA, 25 bp, Mus musculus
atccatccgcggctgcaccgcaccg

SEQ ID NO: 250118 - DNA, 25 bp, Mus musculus
tggcaggggcagcaaatggcagccc

SEQ ID NO: 250119 - DNA, 25 bp, Mus musculus
aaagaagccgaggtggtgccgctgc

SEQ ID NO: 250120 - DNA, 25 bp, Mus musculus
ctccggcggccgcgaaagaagccga

SEQ ID NO: 250121 - DNA, 25 bp, Mus musculus
tcggcctcgcccgaccagccggctc

SEQ ID NO: 250122 - DNA, 25 bp, Mus musculus
agccgggactgaacttgaactctgc

SEQ ID NO: 250123 - DNA, 25 bp, Mus musculus
agcaaaagccgggactgaacttgaa

SEQ ID NO: 250124 - DNA, 25 bp, Mus musculus
tccaggccagtgaccaatcgaacgc

SEQ ID NO: 250125 - DNA, 25 bp, Mus musculus
gacccttgtcctcggaaatctgtga

SEQ ID NO: 250126 - DNA, 25 bp, Mus musculus
ccacgggtcctcaccgtgtggtaca

SEQ ID NO: 250127 - DNA, 25 bp, Mus musculus
acatgagggcctcagtctctccggg

SEQ ID NO: 250128 - DNA, 25 bp, Mus musculus
ctgacagctcgctcagcttgcggtc

SEQ ID NO: 250129 - DNA, 25 bp, Mus musculus
cgcgtggaacttatgcactggagca

SEQ ID NO: 250130 - DNA, 25 bp, Mus musculus
ctgccgaaggctacgcgacccttgt

SEQ ID NO: 250131 - DNA, 25 bp, Mus musculus
caggggttaaatcgggctgtgcatc

SEQ ID NO: 250132 - DNA, 25 bp, Mus musculus
aggcagcgctcatcccaagaaagtc

SEQ ID NO: 250133 - DNA, 25 bp, Mus musculus
ttgagactcccttgggctcttgagc

SEQ ID NO: 250134 - DNA, 25 bp, Mus musculus
tcgaacgcccgtcttgccatctata

SEQ ID NO: 250135 - DNA, 25 bp, Mus musculus
gtctccgcctagtcctcggaatgtg

SEQ ID NO: 250136 - DNA, 25 bp, Mus musculus
gcggagagggtcttttacgtcactg

SEQ ID NO: 250137 - DNA, 25 bp, Mus musculus
ccactagggctccagacaaactttg

SEQ ID NO: 250138 - DNA, 25 bp, Mus musculus
cttcagcgccatgggagccgcctat

SEQ ID NO: 250139 - DNA, 25 bp, Mus musculus
acagccaagagcggcactggcatcg

SEQ ID NO: 250140 - DNA, 25 bp, Mus musculus
ccatggtcttcagcgccatgggagc

SEQ ID NO: 250141 - DNA, 25 bp, Mus musculus
catggtcttcagcgccatgggagcc

SEQ ID NO: 250142 - DNA, 25 bp, Mus musculus
ggtcttcagcgccatgggagccgcc

SEQ ID NO: 250143 - DNA, 25 bp, Mus musculus
gtcttcagcgccatgggagccgcct

SEQ ID NO: 250144 - DNA, 25 bp, Mus musculus
tcttcagcgccatgggagccgccta

SEQ ID NO: 250145 - DNA, 25 bp, Mus musculus
tgggagccgcctatggcacagccaa

SEQ ID NO: 250146 - DNA, 25 bp, Mus musculus
gggagccgcctatggcacagccaag

SEQ ID NO: 250147 - DNA, 25 bp, Mus musculus
ggagccgcctatggcacagccaaga

SEQ ID NO: 250148 - DNA, 25 bp, Mus musculus
agccgcctatggcacagccaagagc

SEQ ID NO: 250149 - DNA, 25 bp, Mus musculus
ccgcctatggcacagccaagagcgg

SEQ ID NO: 250150 - DNA, 25 bp, Mus musculus
atgggagccgcctatggcacagcca

SEQ ID NO: 250151 - DNA, 25 bp, Mus musculus
gccgcctatggcacagccaagagcg

SEQ ID NO: 250152 - DNA, 25 bp, Mus musculus
ctgcttgcagacatggctgacatca

SEQ ID NO: 250153 - DNA, 25 bp, Mus musculus
ttcccatccgctgcctcgacgatct

SEQ ID NO: 250154 - DNA, 25 bp, Mus musculus
gcctcgtccgccatggtcttcagcg

SEQ ID NO: 250155 - DNA, 25 bp, Mus musculus
tgcctcgacgatcttcgcttgcctc

SEQ ID NO: 250156 - DNA, 25 bp, Mus musculus
cgacgatcttcgcttgcctcctcgc

SEQ ID NO: 250157 - DNA, 25 bp, Mus musculus
tccctgcttgcagacatggctgaca

SEQ ID NO: 250158 - DNA, 25 bp, Mus musculus
tgcagacatggctgacatcaagaac

SEQ ID NO: 250159 - DNA, 25 bp, Mus musculus
ctgacatcaagaacaaccccgaata

SEQ ID NO: 250160 - DNA, 25 bp, Mus musculus
gaatattcttcgtttttcggtgtca

SEQ ID NO: 250161 - DNA, 25 bp, Mus musculus
cttcgtttttcggtgtcatgggcgc

SEQ ID NO: 250162 - DNA, 25 bp, Mus musculus
tttttcggtgtcatgggcgcctcgt

SEQ ID NO: 250163 - DNA, 25 bp, Mus musculus
tgtcatgggcgcctcgtccgccatg

SEQ ID NO: 250164 - DNA, 25 bp, Mus musculus
tgggcgcctcgtccgccatggtctt

SEQ ID NO: 250165 - DNA, 25 bp, Mus musculus
gagcttgtcttttccctgcttgcag

SEQ ID NO: 250166 - DNA, 25 bp, Mus musculus
tcggctcgcagtcgccgcggttgct

SEQ ID NO: 250167 - DNA, 25 bp, Mus musculus
tttgcagagctctgacggttgtggc

SEQ ID NO: 250168 - DNA, 25 bp, Mus musculus
ttcgccattcgccacccaaggtgag

SEQ ID NO: 250169 - DNA, 25 bp, Mus musculus
tcggcggtccctcacttttgcagag

SEQ ID NO: 250170 - DNA, 25 bp, Mus musculus
gcccgagagaaaggctgctaggcac

SEQ ID NO: 250171 - DNA, 25 bp, Mus musculus
tggcggtttgcctatcggcccgcgc

SEQ ID NO: 250172 - DNA, 25 bp, Mus musculus
ggaggtggcttcctccctgtgctcc

SEQ ID NO: 250173 - DNA, 25 bp, Mus musculus
gcgtcccggctcaacctgttggaca

SEQ ID NO: 250174 - DNA, 25 bp, Mus musculus
acctgttggacacttgcgccgtgtg

SEQ ID NO: 250175 - DNA, 25 bp, Mus musculus
gccgtgtgccaccagaacatccaga

SEQ ID NO: 250176 - DNA, 25 bp, Mus musculus
agaacatccagagccgggtgcccaa

SEQ ID NO: 250177 - DNA, 25 bp, Mus musculus
tgcactcgttctgccagcgctgttt

SEQ ID NO: 250178 - DNA, 25 bp, Mus musculus
gcgccgcagcgctatctcatgctga

SEQ ID NO: 250179 - DNA, 25 bp, Mus musculus
gacacacacacagcgagccaatcag

SEQ ID NO: 250180 - DNA, 25 bp, Mus musculus
tccgcgaggcttacctggggcgcac

SEQ ID NO: 250181 - DNA, 25 bp, Mus musculus
tgagcggacaaagccgagagaagtc

SEQ ID NO: 250182 - DNA, 25 bp, Mus musculus
gagactgggcgcctagcaccggcgc

SEQ ID NO: 250183 - DNA, 25 bp, Mus musculus
gatccgcggactggggccgctgcac

SEQ ID NO: 250184 - DNA, 25 bp, Mus musculus
gccgctgccgggcaacgcacggccc

SEQ ID NO: 250185 - DNA, 25 bp, Mus musculus
tcgcaaaccgggtgattccggagca

SEQ ID NO: 250186 - DNA, 25 bp, Mus musculus
tccggagcacgctcctcccgagccg

SEQ ID NO: 250187 - DNA, 25 bp, Mus musculus
ccgctccggcaccagtgcaaccctg

SEQ ID NO: 250188 - DNA, 25 bp, Mus musculus
ctgctgagcggacaaagccgagaga

SEQ ID NO: 250189 - DNA, 25 bp, Mus musculus
ccgctccatggccacgcgtcggctc

SEQ ID NO: 250190 - DNA, 25 bp, Mus musculus
gcggccgcaccgctccggcaccagt

SEQ ID NO: 250191 - DNA, 25 bp, Mus musculus
accagtgcaaccctggcgcggggct

SEQ ID NO: 250192 - DNA, 25 bp, Mus musculus
gaagtcggctctctttcccagagcc

SEQ ID NO: 250193 - DNA, 25 bp, Mus musculus
acaaagccgagagaagtcggctctc

SEQ ID NO: 250194 - DNA, 25 bp, Mus musculus
caggctcgccgagaagcatccggaa

SEQ ID NO: 250195 - DNA, 25 bp, Mus musculus
ggccagcgcgaaggcctttgtccca

SEQ ID NO: 250196 - DNA, 25 bp, Mus musculus
gagaagcatccggaaggcgcatccc

SEQ ID NO: 250197 - DNA, 25 bp, Mus musculus
cacttgcccagcatgtggcggcgac

SEQ ID NO: 250198 - DNA, 25 bp, Mus musculus
atgtggcggcgacacaagtgcagct

SEQ ID NO: 250199 - DNA, 25 bp, Mus musculus
aacgcgcacagagtgaggtccgcca

SEQ ID NO: 250200 - DNA, 25 bp, Mus musculus
tgcagctggtcgcagccctgacact

SEQ ID NO: 250201 - DNA, 25 bp, Mus musculus
gcaggtcctgcaggaacatgcggcc

SEQ ID NO: 250202 - DNA, 25 bp, Mus musculus
ctcctgcagcaggaagcgctctgga

SEQ ID NO: 250203 - DNA, 25 bp, Mus musculus
cgccgtgagcacacagcaccttggt

SEQ ID NO: 250204 - DNA, 25 bp, Mus musculus
cccgaccggagcctgcgagctgtag

SEQ ID NO: 250205 - DNA, 25 bp, Mus musculus
ctgcaggaacatgcggccgccgtga

SEQ ID NO: 250206 - DNA, 25 bp, Mus musculus
agcaccttggtgaggaacgcgcaca

SEQ ID NO: 250207 - DNA, 25 bp, Mus musculus
ggaggacacggccatcaccctgcag

SEQ ID NO: 250208 - DNA, 25 bp, Mus musculus
cggcgccggactaggcaattagaga

SEQ ID NO: 250209 - DNA, 25 bp, Mus musculus
accctcggttccaggctagacgtga

SEQ ID NO: 250210 - DNA, 25 bp, Mus musculus
tccgaactccgcacttggggaaata

SEQ ID NO: 250211 - DNA, 25 bp, Mus musculus
gactctccgccgagtgtcgtcaatg

SEQ ID NO: 250212 - DNA, 25 bp, Mus musculus
cagacctggtgagcgcttcctgtaa

SEQ ID NO: 250213 - DNA, 25 bp, Mus musculus
ctgcaaggctgctaccaggaagaga

SEQ ID NO: 250214 - DNA, 25 bp, Mus musculus
tcagatttaaagtcagccgcgcggg

SEQ ID NO: 250215 - DNA, 25 bp, Mus musculus
cggcttcacggagaatcgaaactta

SEQ ID NO: 250216 - DNA, 25 bp, Mus musculus
tcagcagctcgtagagttgcgcttc

SEQ ID NO: 250217 - DNA, 25 bp, Mus musculus
gcctggtctccagtctccaatagca

SEQ ID NO: 250218 - DNA, 25 bp, Mus musculus
gcaccggccgagcagattaagcttg

SEQ ID NO: 250219 - DNA, 25 bp, Mus musculus
cgagagtttgtttccgggcctgatt

SEQ ID NO: 250220 - DNA, 25 bp, Mus musculus
gagtagtagccaccaccgaccgagt

SEQ ID NO: 250221 - DNA, 25 bp, Mus musculus
tgctcgccaccaccttaggacatgg

SEQ ID NO: 250222 - DNA, 25 bp, Mus musculus
gagacaggcctgtctgtgacgtcac

SEQ ID NO: 250223 - DNA, 25 bp, Mus musculus
ctgcgtggagttcagctacccggag

SEQ ID NO: 250224 - DNA, 25 bp, Mus musculus
acggacgaaagctgcgtggagttca

SEQ ID NO: 250225 - DNA, 25 bp, Mus musculus
accgccgaaggagacggttcgcctg

SEQ ID NO: 250226 - DNA, 25 bp, Mus musculus
gcgttcattagcctgtcaccggtga

SEQ ID NO: 250227 - DNA, 25 bp, Mus musculus
gagccgcgcagagtcgcgttcatta

SEQ ID NO: 250228 - DNA, 25 bp, Mus musculus
tggagcccatcagaacgtagtagcg

SEQ ID NO: 250229 - DNA, 25 bp, Mus musculus
cagcggcctgcttctatttatgtgg

SEQ ID NO: 250230 - DNA, 25 bp, Mus musculus
acgcgagcgtctcgagtgtgcgcat

SEQ ID NO: 250231 - DNA, 25 bp, Mus musculus
aacagccacgactgtggacgcgagc

SEQ ID NO: 250232 - DNA, 25 bp, Mus musculus
ggggaaaactgagcaacagccacga

SEQ ID NO: 250233 - DNA, 25 bp, Mus musculus
ctccagactgttgagaggaaaaggg

SEQ ID NO: 250234 - DNA, 25 bp, Mus musculus
gccgagctgtctggcctccagactg

SEQ ID NO: 250235 - DNA, 25 bp, Mus musculus
ctgtgcggagaacaacgggtacaga

SEQ ID NO: 250236 - DNA, 25 bp, Mus musculus
tccaaagggacgcagtcagaagggc

SEQ ID NO: 250237 - DNA, 25 bp, Mus musculus
tcagcttacggcagtccaaagggac

SEQ ID NO: 250238 - DNA, 25 bp, Mus musculus
gaggattcggcaccttcccttgctc

SEQ ID NO: 250239 - DNA, 25 bp, Mus musculus
tcactcgcgtttccctccaagggtg

SEQ ID NO: 250240 - DNA, 25 bp, Mus musculus
cacctcgcccgaggcagtgagggac

SEQ ID NO: 250241 - DNA, 25 bp, Mus musculus
agggaccaggctctccaaggacaga

SEQ ID NO: 250242 - DNA, 25 bp, Mus musculus
tccaaggacagaaaaatggcggccc

SEQ ID NO: 250243 - DNA, 25 bp, Mus musculus
gccttctgagggagctgcgctacct

SEQ ID NO: 250244 - DNA, 25 bp, Mus musculus
accgggcggccatatcgcgacacag

SEQ ID NO: 250245 - DNA, 25 bp, Mus musculus
tatcgcgacacagcggcctaccggt

SEQ ID NO: 250246 - DNA, 25 bp, Mus musculus
acctcgttaaggctttccgagcaca

SEQ ID NO: 250247 - DNA, 25 bp, Mus musculus
ttccgagcacatcgggtacggcatc

SEQ ID NO: 250248 - DNA, 25 bp, Mus musculus
gcggccatcagcttacggcagtcca

SEQ ID NO: 250249 - DNA, 25 bp, Mus musculus
tgaggtgcctgtcactcgcgtttcc

SEQ ID NO: 250250 - DNA, 25 bp, Mus musculus
cgactctgtcctcttcaaggctcga

SEQ ID NO: 250251 - DNA, 25 bp, Mus musculus
ctccagccggagctggcatctggga

SEQ ID NO: 250252 - DNA, 25 bp, Mus musculus
gatctgcatatccagacacggatta

SEQ ID NO: 250253 - DNA, 25 bp, Mus musculus
gatccgccatgataagccgacaccg

SEQ ID NO: 250254 - DNA, 25 bp, Mus musculus
cggattaccagttctccaagtttga

SEQ ID NO: 250255 - DNA, 25 bp, Mus musculus
tcttcaaggctcgagctgcgacgga

SEQ ID NO: 250256 - DNA, 25 bp, Mus musculus
ctgcgacggacctgcaagggctcag

SEQ ID NO: 250257 - DNA, 25 bp, Mus musculus
cctgcaagggctcagggtacagcac

SEQ ID NO: 250258 - DNA, 25 bp, Mus musculus
gggcgccaatttccgcggcgacgca

SEQ ID NO: 250259 - DNA, 25 bp, Mus musculus
tctcccggggtcaagcgggcctcga

SEQ ID NO: 250260 - DNA, 25 bp, Mus musculus
tcgagggtaccagtacccgcacaca

SEQ ID NO: 250261 - DNA, 25 bp, Mus musculus
gtcacccggcctttaaaatcagaga

SEQ ID NO: 250262 - DNA, 25 bp, Mus musculus
cccggcctttaaaatcagagatctg

SEQ ID NO: 250263 - DNA, 25 bp, Mus musculus
ggagctgtccgatccgccatgataa

SEQ ID NO: 250264 - DNA, 25 bp, Mus musculus
cgacaggatgcgtctgcagcctacc

SEQ ID NO: 250265 - DNA, 25 bp, Mus musculus
ccattcgactcgtggcgtctgcatc

SEQ ID NO: 250266 - DNA, 25 bp, Mus musculus
ccctttggagacaaaccattcgact

SEQ ID NO: 250267 - DNA, 25 bp, Mus musculus
taggaaggcgctgccctttggagac

SEQ ID NO: 250268 - DNA, 25 bp, Mus musculus
ctgaccaataggaaggcgctgccct

SEQ ID NO: 250269 - DNA, 25 bp, Mus musculus
ccagtagaagcggtgcgcctgtgac

SEQ ID NO: 250270 - DNA, 25 bp, Mus musculus
cagcgcacacgccagtagaagcggt

SEQ ID NO: 250271 - DNA, 25 bp, Mus musculus
cgaagaactccacaagcagcgcaca

SEQ ID NO: 250272 - DNA, 25 bp, Mus musculus
ttgcttaaggtaggcgaagaactcc

SEQ ID NO: 250273 - DNA, 25 bp, Mus musculus
cccaggttgcacctctgggctgagc

SEQ ID NO: 250274 - DNA, 25 bp, Mus musculus
gatgcgtctgcagcctaccgggcgc

SEQ ID NO: 250275 - DNA, 25 bp, Mus musculus
ggcgtctgcatcaagtctgaaagca

SEQ ID NO: 250276 - DNA, 25 bp, Mus musculus
cgtggcgtctgcatcaagtctgaaa

SEQ ID NO: 250277 - DNA, 25 bp, Mus musculus
gtctgaaagcagacgcgcaactttc

SEQ ID NO: 250278 - DNA, 25 bp, Mus musculus
cagggcggcaaacagcaaaggccta

SEQ ID NO: 250279 - DNA, 25 bp, Mus musculus
cgtcgggaaagcactaaccctgaga

SEQ ID NO: 250280 - DNA, 25 bp, Mus musculus
ctgagaacttctgtcgcactactta

SEQ ID NO: 250281 - DNA, 25 bp, Mus musculus
taagctcggcactggctaatttgcg

SEQ ID NO: 250282 - DNA, 25 bp, Mus musculus
gcaaaggcctaagtgacctgctgct

SEQ ID NO: 250283 - DNA, 25 bp, Mus musculus
gaagaggcttcggagtaggctaaaa

SEQ ID NO: 250284 - DNA, 25 bp, Mus musculus
aaagagcatcattctcgcgagactc

SEQ ID NO: 250285 - DNA, 25 bp, Mus musculus
cgagccgcgtcagagctcgcttgct

SEQ ID NO: 250286 - DNA, 25 bp, Mus musculus
attttccgcgttcacgccgtcgtga

SEQ ID NO: 250287 - DNA, 25 bp, Mus musculus
gacggtaagtcgctgccagagccct

SEQ ID NO: 250288 - DNA, 25 bp, Mus musculus
gttcccagattggtagcgcgaggtc

SEQ ID NO: 250289 - DNA, 25 bp, Mus musculus
cgtctctcttccagtccaatcaggg

SEQ ID NO: 250290 - DNA, 25 bp, Mus musculus
tactgcgactcgctctaagctcggc

SEQ ID NO: 250291 - DNA, 25 bp, Mus musculus
taatgggcacctctcgggacggtaa

SEQ ID NO: 250292 - DNA, 25 bp, Mus musculus
ttttgagcactcacctatgagcgtg

SEQ ID NO: 250293 - DNA, 25 bp, Mus musculus
tcacctatgagcgtgatggcccgcg

SEQ ID NO: 250294 - DNA, 25 bp, Mus musculus
tcttgccatctatgcctgcgcgctg

SEQ ID NO: 250295 - DNA, 25 bp, Mus musculus
agcgcgtcatcttctttggtcagtc

SEQ ID NO: 250296 - DNA, 25 bp, Mus musculus
atcttctttggtcagtccgggctcg

SEQ ID NO: 250297 - DNA, 25 bp, Mus musculus
gggaccatgcaaccctcagcggggc

SEQ ID NO: 250298 - DNA, 25 bp, Mus musculus
cgtagcccagactgagcggcggtac

SEQ ID NO: 250299 - DNA, 25 bp, Mus musculus
acggagacttctccgggagctcctg

SEQ ID NO: 250300 - DNA, 25 bp, Mus musculus
tgcggcggctccattcccgagcttt

SEQ ID NO: 250301 - DNA, 25 bp, Mus musculus
ccgagctttccgagggctcctctgg

SEQ ID NO: 250302 - DNA, 25 bp, Mus musculus
gccgactcgagactcgccgtgcgag

SEQ ID NO: 250303 - DNA, 25 bp, Mus musculus
ccgtgcgagcgtcgcgttctaggct

SEQ ID NO: 250304 - DNA, 25 bp, Mus musculus
gggcacgagcacttttgagcactca

SEQ ID NO: 250305 - DNA, 25 bp, Mus musculus
gcccgcggcagtttcttgccatcta

SEQ ID NO: 250306 - DNA, 25 bp, Mus musculus
gagcagccttcccaggtccttgtct

SEQ ID NO: 250307 - DNA, 25 bp, Mus musculus
ttgacagctcgcagaggaatggatc

SEQ ID NO: 250308 - DNA, 25 bp, Mus musculus
cctgagtcaagacccaggaaatggc

SEQ ID NO: 250309 - DNA, 25 bp, Mus musculus
ccggtccctgagtcaagacccagga

SEQ ID NO: 250310 - DNA, 25 bp, Mus musculus
agggtaagcgctcagccttccatcc

SEQ ID NO: 250311 - DNA, 25 bp, Mus musculus
ccttggagggtaagcgctcagcctt

SEQ ID NO: 250312 - DNA, 25 bp, Mus musculus
gcagcaccagctggaaggcggcctt

SEQ ID NO: 250313 - DNA, 25 bp, Mus musculus
gtcaggctacgagggcagcaccagc

SEQ ID NO: 250314 - DNA, 25 bp, Mus musculus
ggccagtggcctgggctgtctttcc

SEQ ID NO: 250315 - DNA, 25 bp, Mus musculus
caccttggctcacagctgcgaggga

SEQ ID NO: 250316 - DNA, 25 bp, Mus musculus
actctggaggaggagcaccttggct

SEQ ID NO: 250317 - DNA, 25 bp, Mus musculus
gaagatgcccagcagctgactctgg

SEQ ID NO: 250318 - DNA, 25 bp, Mus musculus
ccactttagaagatgcccagcagct

SEQ ID NO: 250319 - DNA, 25 bp, Mus musculus
gccttcccaggtccttgtcttggga

SEQ ID NO: 250320 - DNA, 25 bp, Mus musculus
caacggagaagggaacgcggcgcgc

SEQ ID NO: 250321 - DNA, 25 bp, Mus musculus
tccgcggttcatggcaacggagaag

SEQ ID NO: 250322 - DNA, 25 bp, Mus musculus
ttcatggcaacggagaagggaacgc

SEQ ID NO: 250323 - DNA, 25 bp, Mus musculus
cctcagcctcagtgggaatctgcca

SEQ ID NO: 250324 - DNA, 25 bp, Mus musculus
gcctcagtgggaatctgccatcttg

SEQ ID NO: 250325 - DNA, 25 bp, Mus musculus
cctcagtgggaatctgccatcttga

SEQ ID NO: 250326 - DNA, 25 bp, Mus musculus
cagtgggaatctgccatcttgagcc

SEQ ID NO: 250327 - DNA, 25 bp, Mus musculus
gtgggaatctgccatcttgagcctg

SEQ ID NO: 250328 - DNA, 25 bp, Mus musculus
gggaatctgccatcttgagcctgtg

SEQ ID NO: 250329 - DNA, 25 bp, Mus musculus
gaatctgccatcttgagcctgtgtc

SEQ ID NO: 250330 - DNA, 25 bp, Mus musculus
gtgtctccgctctcggcgcagccca

SEQ ID NO: 250331 - DNA, 25 bp, Mus musculus
ctgccatcttgagcctgtgtctccg

SEQ ID NO: 250332 - DNA, 25 bp, Mus musculus
atctgccatcttgagcctgtgtctc

SEQ ID NO: 250333 - DNA, 25 bp, Mus musculus
tgtccgcggttcatggcaacggaga

SEQ ID NO: 250334 - DNA, 25 bp, Mus musculus
gcggccacaactttgtgtgtgcgtg

SEQ ID NO: 250335 - DNA, 25 bp, Mus musculus
tggaggcggccacaactttgtgtgt

SEQ ID NO: 250336 - DNA, 25 bp, Mus musculus
cgagcggctgctgccgacagcagtc

SEQ ID NO: 250337 - DNA, 25 bp, Mus musculus
cccgctgccgggcaaagtgtcttca

SEQ ID NO: 250338 - DNA, 25 bp, Mus musculus
gctgccgggcaaagtgtcttcaccc

SEQ ID NO: 250339 - DNA, 25 bp, Mus musculus
cgtgcgggctccgttctagccgaca

SEQ ID NO: 250340 - DNA, 25 bp, Mus musculus
ggctccgttctagccgacacgcggg

SEQ ID NO: 250341 - DNA, 25 bp, Mus musculus
cgtagtcctcccgggagaatgtcgg

SEQ ID NO: 250342 - DNA, 25 bp, Mus musculus
ggagctccctgaactgctcggggaa

SEQ ID NO: 250343 - DNA, 25 bp, Mus musculus
ccctgaactgctcggggaaaacgca

SEQ ID NO: 250344 - DNA, 25 bp, Mus musculus
actgctcggggaaaacgcaacgtca

SEQ ID NO: 250345 - DNA, 25 bp, Mus musculus
tcggggaaaacgcaacgtcaggatg

SEQ ID NO: 250346 - DNA, 25 bp, Mus musculus
aacgcaacgtcaggatggacgcctg

SEQ ID NO: 250347 - DNA, 25 bp, Mus musculus
acgtcaggatggacgcctgatcccg

SEQ ID NO: 250348 - DNA, 25 bp, Mus musculus
gaaacagtcgctccgaattgccaga

SEQ ID NO: 250349 - DNA, 25 bp, Mus musculus
aattgccagacactccgcttttgta

SEQ ID NO: 250350 - DNA, 25 bp, Mus musculus
cttgcagttgccgtagatgagaaac

SEQ ID NO: 250351 - DNA, 25 bp, Mus musculus
gtcgcccgagccaaagcgggcttta

SEQ ID NO: 250352 - DNA, 25 bp, Mus musculus
ccgagcgaagtttccagacggcgcc

SEQ ID NO: 250353 - DNA, 25 bp, Mus musculus
gcaacctcgatctcggaaaagccga

SEQ ID NO: 250354 - DNA, 25 bp, Mus musculus
ggggttcagtcagcaacctcgatct

SEQ ID NO: 250355 - DNA, 25 bp, Mus musculus
tcccttcgaggcagcagcgtcctgt

SEQ ID NO: 250356 - DNA, 25 bp, Mus musculus
gcccttgtcttagggccgccagctg

SEQ ID NO: 250357 - DNA, 25 bp, Mus musculus
cccactgtttcgctggaaggaaacg

SEQ ID NO: 250358 - DNA, 25 bp, Mus musculus
ccgtcggactgaggcttagcacgga

SEQ ID NO: 250359 - DNA, 25 bp, Mus musculus
gcgcacagcagctgggtcacctctg

SEQ ID NO: 250360 - DNA, 25 bp, Mus musculus
acagacgcagcgacgacacggccag

SEQ ID NO: 250361 - DNA, 25 bp, Mus musculus
cccggtcttcaggaacttgcagttg

SEQ ID NO: 250362 - DNA, 25 bp, Mus musculus
ttcctgtttgttgtggcgactcttc

SEQ ID NO: 250363 - DNA, 25 bp, Mus musculus
catacacagtacacgggcggaggcg

SEQ ID NO: 250364 - DNA, 25 bp, Mus musculus
tacggctgccggcatacacagtaca

SEQ ID NO: 250365 - DNA, 25 bp, Mus musculus
aagcggttcacgtcgtacggctgcc

SEQ ID NO: 250366 - DNA, 25 bp, Mus musculus
gcactcgatcatgaagcggttcacg

SEQ ID NO: 250367 - DNA, 25 bp, Mus musculus
gtccttgcagacatcgcactcgatc

SEQ ID NO: 250368 - DNA, 25 bp, Mus musculus
cgtggaaccagtccttgcagacatc

SEQ ID NO: 250369 - DNA, 25 bp, Mus musculus
ttacctgccgtggaaccagtccttg

SEQ ID NO: 250370 - DNA, 25 bp, Mus musculus
cactcggtgcctaagagtcgggacg

SEQ ID NO: 250371 - DNA, 25 bp, Mus musculus
ttgtggcgactcttcgcccgggccg

SEQ ID NO: 250372 - DNA, 25 bp, Mus musculus
gccgcccgaggaagtttgataaaga

SEQ ID NO: 250373 - DNA, 25 bp, Mus musculus
cctttgttcctgtttgttgtggcga

SEQ ID NO: 250374 - DNA, 25 bp, Mus musculus
tcctccgctcgctgactggagcgag

SEQ ID NO: 250375 - DNA, 25 bp, Mus musculus
cccggacactcggtgcctaagagtc

SEQ ID NO: 250376 - DNA, 25 bp, Mus musculus
gctggtccagcctgactggctttcg

SEQ ID NO: 250377 - DNA, 25 bp, Mus musculus
gacctcctgcgcgttcacacctctc

SEQ ID NO: 250378 - DNA, 25 bp, Mus musculus
gttcacactccaggcttcctagcag

SEQ ID NO: 250379 - DNA, 25 bp, Mus musculus
gagccgggaaacgtgcggcacgtgc

SEQ ID NO: 250380 - DNA, 25 bp, Mus musculus
cggcacgtgcgctgcgcggtgattg

SEQ ID NO: 250381 - DNA, 25 bp, Mus musculus
cggtgattggcagctgcggacttga

SEQ ID NO: 250382 - DNA, 25 bp, Mus musculus
ccgcctcgcatcctgcttggggaag

SEQ ID NO: 250383 - DNA, 25 bp, Mus musculus
agctgcggctggtccagcctgactg

SEQ ID NO: 250384 - DNA, 25 bp, Mus musculus
ggtccagcctgactggctttcgctg

SEQ ID NO: 250385 - DNA, 25 bp, Mus musculus
tccagcctgactggctttcgctgct

SEQ ID NO: 250386 - DNA, 25 bp, Mus musculus
agcctgactggctttcgctgctcgc

SEQ ID NO: 250387 - DNA, 25 bp, Mus musculus
ctgactggctttcgctgctcgctgc

SEQ ID NO: 250388 - DNA, 25 bp, Mus musculus
cgcctcgcatcctgcttggggaagg

SEQ ID NO: 250389 - DNA, 25 bp, Mus musculus
gcgcgttcacacctctctgtgcacc

SEQ ID NO: 250390 - DNA, 25 bp, Mus musculus
agagcttccggacgctcacgtgacc

SEQ ID NO: 250391 - DNA, 25 bp, Mus musculus
ctcacccagcgggatgtggccagag

SEQ ID NO: 250392 - DNA, 25 bp, Mus musculus
gaagaacccgctccgctagactccg

SEQ ID NO: 250393 - DNA, 25 bp, Mus musculus
ctgagacccgccgaagaacccgctc

SEQ ID NO: 250394 - DNA, 25 bp, Mus musculus
atgtggccagagcttccggacgctc

SEQ ID NO: 250395 - DNA, 25 bp, Mus musculus
agcgcacgcaggctcgcacctgaga

SEQ ID NO: 250396 - DNA, 25 bp, Mus musculus
cgccacacccaccagctgtccgcgc

SEQ ID NO: 250397 - DNA, 25 bp, Mus musculus
cagcaccaggagctccggtggggtc

SEQ ID NO: 250398 - DNA, 25 bp, Mus musculus
tcgggactgcacagcggcagcacca

SEQ ID NO: 250399 - DNA, 25 bp, Mus musculus
tgcacacagcctcgggactgcacag

SEQ ID NO: 250400 - DNA, 25 bp, Mus musculus
ctcacgtgacctcggggacaggtgc

SEQ ID NO: 250401 - DNA, 25 bp, Mus musculus
gctgtagtccgccagtgccgcttta

SEQ ID NO: 250402 - DNA, 25 bp, Mus musculus
tagtccgccagtgccgctttacctg

SEQ ID NO: 250403 - DNA, 25 bp, Mus musculus
acagcctcgggactgcacagcggca

SEQ ID NO: 250404 - DNA, 25 bp, Mus musculus
cggtcctagcgagttcctgcactcc

SEQ ID NO: 250405 - DNA, 25 bp, Mus musculus
gcctcgcacgtagcatccctgcttt

SEQ ID NO: 250406 - DNA, 25 bp, Mus musculus
ctttctccgcctctaacctctgctg

SEQ ID NO: 250407 - DNA, 25 bp, Mus musculus
ctgctgccggccttgcgtccaggat

SEQ ID NO: 250408 - DNA, 25 bp, Mus musculus
tgccggccttgcgtccaggatctcg

SEQ ID NO: 250409 - DNA, 25 bp, Mus musculus
caggatctcgcaccagccagcgaaa

SEQ ID NO: 250410 - DNA, 25 bp, Mus musculus
gccagcgaaatcctctgcctgccct

SEQ ID NO: 250411 - DNA, 25 bp, Mus musculus
ggatctggggaccagctcttcctcc

SEQ ID NO: 250412 - DNA, 25 bp, Mus musculus
cagggaagagttacgcggcgaaatt

SEQ ID NO: 250413 - DNA, 25 bp, Mus musculus
ttacgcggcgaaattgcgccggttc

SEQ ID NO: 250414 - DNA, 25 bp, Mus musculus
ttcctgcactcccacccggaccagc

SEQ ID NO: 250415 - DNA, 25 bp, Mus musculus
cggaaacgcagacgcctcctagggc

SEQ ID NO: 250416 - DNA, 25 bp, Mus musculus
ggttcggaaacgcagacgcctccta

SEQ ID NO: 250417 - DNA, 25 bp, Mus musculus
gaaattgcgccggttcggaaacgca

SEQ ID NO: 250418 - DNA, 25 bp, Mus musculus
gcagcctccgccattactgtttatc

SEQ ID NO: 250419 - DNA, 25 bp, Mus musculus
acgctcggttcggagacaaagctcg

SEQ ID NO: 250420 - DNA, 25 bp, Mus musculus
gccgaccaccgacttacatacaaag

SEQ ID NO: 250421 - DNA, 25 bp, Mus musculus
caaaggcatacaaaagcggctgctc

SEQ ID NO: 250422 - DNA, 25 bp, Mus musculus
ttacaaacggatagcccggctcgga

SEQ ID NO: 250423 - DNA, 25 bp, Mus musculus
caccgagggtcgttagagcccgatt

SEQ ID NO: 250424 - DNA, 25 bp, Mus musculus
cccgaacctgtagcgatggaggcca

SEQ ID NO: 250425 - DNA, 25 bp, Mus musculus
ccgcagtctgaaacccgcagcgatg

SEQ ID NO: 250426 - DNA, 25 bp, Mus musculus
ctgacgcagcgatgctgtacggaca

SEQ ID NO: 250427 - DNA, 25 bp, Mus musculus
cacgcaacgtcctacctgcaggtga

SEQ ID NO: 250428 - DNA, 25 bp, Mus musculus
tcctgatgttgtggctgttgttccg

SEQ ID NO: 250429 - DNA, 25 bp, Mus musculus
tgtttatcccacacagcaatggccc

SEQ ID NO: 250430 - DNA, 25 bp, Mus musculus
gatcacatagttccggtccggctga

SEQ ID NO: 250431 - DNA, 25 bp, Mus musculus
tgcaggtgacctgtttcgtccagcc

SEQ ID NO: 250432 - DNA, 25 bp, Mus musculus
tcctaccacaacagcagcgcggccg

SEQ ID NO: 250433 - DNA, 25 bp, Mus musculus
cgccctacgcgtcgagcggaggcaa

SEQ ID NO: 250434 - DNA, 25 bp, Mus musculus
acgcgtcgagcggaggcaactccta

SEQ ID NO: 250435 - DNA, 25 bp, Mus musculus
tcgagcggaggcaactcctacaacc

SEQ ID NO: 250436 - DNA, 25 bp, Mus musculus
ggaggcaactcctacaaccaccgat

SEQ ID NO: 250437 - DNA, 25 bp, Mus musculus
aaccaccgatcgctcgccgcctacc

SEQ ID NO: 250438 - DNA, 25 bp, Mus musculus
ccctacatgagccactcgcagcaca

SEQ ID NO: 250439 - DNA, 25 bp, Mus musculus
tgagccactcgcagcacagccctta

SEQ ID NO: 250440 - DNA, 25 bp, Mus musculus
tccagtcctaccacaacagcagcgc

SEQ ID NO: 250441 - DNA, 25 bp, Mus musculus
gacgacacaggtgagaggccgctta

SEQ ID NO: 250442 - DNA, 25 bp, Mus musculus
agaggccgcttaggcagctagcttc

SEQ ID NO: 250443 - DNA, 25 bp, Mus musculus
ggccgcttaggcagctagcttcgcc

SEQ ID NO: 250444 - DNA, 25 bp, Mus musculus
gctcccgatcgcctggcgcctgcct

SEQ ID NO: 250445 - DNA, 25 bp, Mus musculus
agcacagcccttacctccagtccta

SEQ ID NO: 250446 - DNA, 25 bp, Mus musculus
tgcgccgcgaccgtctgcagtgacg

SEQ ID NO: 250447 - DNA, 25 bp, Mus musculus
tgaagatcgccgaaccggttctctg

SEQ ID NO: 250448 - DNA, 25 bp, Mus musculus
ccttttctgtgctgaagatcgccga

SEQ ID NO: 250449 - DNA, 25 bp, Mus musculus
agacggtggcttaaccttttctgtg

SEQ ID NO: 250450 - DNA, 25 bp, Mus musculus
taaacaggaccttctgccgcactca

SEQ ID NO: 250451 - DNA, 25 bp, Mus musculus
gagccacggtaaacaggaccttctg

SEQ ID NO: 250452 - DNA, 25 bp, Mus musculus
cgcggctccagtgagctaatccgca

SEQ ID NO: 250453 - DNA, 25 bp, Mus musculus
ctcggaggcgtgctgcgtctcctct

SEQ ID NO: 250454 - DNA, 25 bp, Mus musculus
aagagctgtggatcgcttcctgcgc

SEQ ID NO: 250455 - DNA, 25 bp, Mus musculus
cccgggaaagagctgtggatcgctt

SEQ ID NO: 250456 - DNA, 25 bp, Mus musculus
ttcttcggccctgaagttagcccga

SEQ ID NO: 250457 - DNA, 25 bp, Mus musculus
acaaatcccgactagagccgcctgg

SEQ ID NO: 250458 - DNA, 25 bp, Mus musculus
agctaatccgcagctggcgggcgcc

SEQ ID NO: 250459 - DNA, 25 bp, Mus musculus
gcccagtttctgcaagtttcttcgg

SEQ ID NO: 250460 - DNA, 25 bp, Mus musculus
aaaagagggctacagagctcgcgtc

SEQ ID NO: 250461 - DNA, 25 bp, Mus musculus
ctggacagcttgtcacccgtggtcc

SEQ ID NO: 250462 - DNA, 25 bp, Mus musculus
actctgagctctggcgctggacagc

SEQ ID NO: 250463 - DNA, 25 bp, Mus musculus
tcgtcgttctctctaggccgcgggt

SEQ ID NO: 250464 - DNA, 25 bp, Mus musculus
gccctctgaggcttcgtcgttctct

SEQ ID NO: 250465 - DNA, 25 bp, Mus musculus
tgtgcaggtcccgagccatcggctc

SEQ ID NO: 250466 - DNA, 25 bp, Mus musculus
tgtcactgcccgctctgtgcaggtc

SEQ ID NO: 250467 - DNA, 25 bp, Mus musculus
ggcccggacgcttagtgctctctct

SEQ ID NO: 250468 - DNA, 25 bp, Mus musculus
aaccaggtaccggaagctgggagca

SEQ ID NO: 250469 - DNA, 25 bp, Mus musculus
ccctttaaggagcatgtcgtgggca

SEQ ID NO: 250470 - DNA, 25 bp, Mus musculus
cgcttttgccctagttcgcgccgtg

SEQ ID NO: 250471 - DNA, 25 bp, Mus musculus
ggaactcgatgtgcccaggcgcttt

SEQ ID NO: 250472 - DNA, 25 bp, Mus musculus
tctctaaatcatcacaggaactcga

SEQ ID NO: 250473 - DNA, 25 bp, Mus musculus
cgcgtctgcgttttttctctaaatc

SEQ ID NO: 250474 - DNA, 25 bp, Mus musculus
gccatccggacgctgtcaccttgaa

SEQ ID NO: 250475 - DNA, 25 bp, Mus musculus
ggtgggaactgcagtcttgctagta

SEQ ID NO: 250476 - DNA, 25 bp, Mus musculus
tagagacgcagtgcgacgcagtgac

SEQ ID NO: 250477 - DNA, 25 bp, Mus musculus
cgcagtgcgacgcagtgacgtcacg

SEQ ID NO: 250478 - DNA, 25 bp, Mus musculus
aagtgacgcatcaggggtgggaact

SEQ ID NO: 250479 - DNA, 25 bp, Mus musculus
atgtctgcgctcacccgtctggtac

SEQ ID NO: 250480 - DNA, 25 bp, Mus musculus
tctggtacctttcggccgcgtcgga

SEQ ID NO: 250481 - DNA, 25 bp, Mus musculus
acagtggagtccgtcagtgagtgtc

SEQ ID NO: 250482 - DNA, 25 bp, Mus musculus
aacaggcagcgctgccatccggacg

SEQ ID NO: 250483 - DNA, 25 bp, Mus musculus
cggacgctgtcaccttgaagcagtc

SEQ ID NO: 250484 - DNA, 25 bp, Mus musculus
tcaccttgaagcagtcgcccgggag

SEQ ID NO: 250485 - DNA, 25 bp, Mus musculus
agggtgcgtgaaactccgctgccgc

SEQ ID NO: 250486 - DNA, 25 bp, Mus musculus
ttcggccggcttgaacaggcagcgc

SEQ ID NO: 250487 - DNA, 25 bp, Mus musculus
cttgctagtatgtctgcgctcaccc

SEQ ID NO: 250488 - DNA, 25 bp, Mus musculus
gaactactctcactccctgggggcg

SEQ ID NO: 250489 - DNA, 25 bp, Mus musculus
gcttgccttacctgctcctgacctc

SEQ ID NO: 250490 - DNA, 25 bp, Mus musculus
gccttacctgctcctgacctcgcgc

SEQ ID NO: 250491 - DNA, 25 bp, Mus musculus
ctttacttgcttcccagctccagag

SEQ ID NO: 250492 - DNA, 25 bp, Mus musculus
tacttgcttcccagctccagagagc

SEQ ID NO: 250493 - DNA, 25 bp, Mus musculus
cttgcttcccagctccagagagcag

SEQ ID NO: 250494 - DNA, 25 bp, Mus musculus
gagagaggcggaagcttgatggcta

SEQ ID NO: 250495 - DNA, 25 bp, Mus musculus
gcggaagcttgatggctagagcgga

SEQ ID NO: 250496 - DNA, 25 bp, Mus musculus
cccagcgctccgcttgccttacctg

SEQ ID NO: 250497 - DNA, 25 bp, Mus musculus
ggcggacaacccggaactactctca

SEQ ID NO: 250498 - DNA, 25 bp, Mus musculus
ggacctcgggcgacacctagcggcc

SEQ ID NO: 250499 - DNA, 25 bp, Mus musculus
cgggcgacacctagcggccgcgctc

SEQ ID NO: 250500 - DNA, 25 bp, Mus musculus
cgctcgctctgagcccagggcctcc

SEQ ID NO: 250501 - DNA, 25 bp, Mus musculus
ctagagcggagtcggcggacaaccc

SEQ ID NO: 250502 - DNA, 25 bp, Mus musculus
cgggcagctcgcttctgagagcacc

SEQ ID NO: 250503 - DNA, 25 bp, Mus musculus
gaactttttaggctgcccgcctcta

SEQ ID NO: 250504 - DNA, 25 bp, Mus musculus
ggagcctctcccgatcagaactttt

SEQ ID NO: 250505 - DNA, 25 bp, Mus musculus
cgtgctgagttcaccaccgcgagag

SEQ ID NO: 250506 - DNA, 25 bp, Mus musculus
ctgtcactccggtcagcaagctgca

SEQ ID NO: 250507 - DNA, 25 bp, Mus musculus
tcattcccaggaagccaggactgtc

SEQ ID NO: 250508 - DNA, 25 bp, Mus musculus
aaagaacagttctgggcacgcgtcc

SEQ ID NO: 250509 - DNA, 25 bp, Mus musculus
caaaggctggtagagaccatgcgtc

SEQ ID NO: 250510 - DNA, 25 bp, Mus musculus
cgctgtccaaaagcggagctgtctt

SEQ ID NO: 250511 - DNA, 25 bp, Mus musculus
cgggccctgaacagtcgcgtaacgc

SEQ ID NO: 250512 - DNA, 25 bp, Mus musculus
ctgtccatggtgttgaaggagctcc

SEQ ID NO: 250513 - DNA, 25 bp, Mus musculus
ccggccttcggctgcagaccgaaaa

SEQ ID NO: 250514 - DNA, 25 bp, Mus musculus
cgcgatccgtccttcggcgaagtgt

SEQ ID NO: 250515 - DNA, 25 bp, Mus musculus
aagtgtcgcgtcctcagatctccct

SEQ ID NO: 250516 - DNA, 25 bp, Mus musculus
gcgagcccatccctaggtcacggga

SEQ ID NO: 250517 - DNA, 25 bp, Mus musculus
ccctgcgagtcaggtgtgccggttc

SEQ ID NO: 250518 - DNA, 25 bp, Mus musculus
cccgttgtccctgcgagtcaggtgt

SEQ ID NO: 250519 - DNA, 25 bp, Mus musculus
gtgcacgcccgttgtccctgcgagt

SEQ ID NO: 250520 - DNA, 25 bp, Mus musculus
ccagcatggcgtgcacgcccgttgt

SEQ ID NO: 250521 - DNA, 25 bp, Mus musculus
atcggccacgcggttgctgactgcg

SEQ ID NO: 250522 - DNA, 25 bp, Mus musculus
ttgagcagagcgtccggggaacccg

SEQ ID NO: 250523 - DNA, 25 bp, Mus musculus
gcgcagccgctggtggctgcgttga

SEQ ID NO: 250524 - DNA, 25 bp, Mus musculus
tgagagcacacaggaaaggccgggc

SEQ ID NO: 250525 - DNA, 25 bp, Mus musculus
agggagagttttgtgagagcacaca

SEQ ID NO: 250526 - DNA, 25 bp, Mus musculus
ccctgaaaagagagggagagttttg

SEQ ID NO: 250527 - DNA, 25 bp, Mus musculus
cgtcggaacccgagagcagagggag

SEQ ID NO: 250528 - DNA, 25 bp, Mus musculus
tggctcgcgctgctccgcgtcggaa

SEQ ID NO: 250529 - DNA, 25 bp, Mus musculus
catccctaggtcacgggagggctcg

SEQ ID NO: 250530 - DNA, 25 bp, Mus musculus
tcgaaggtgaccacgaacacggcca

SEQ ID NO: 250531 - DNA, 25 bp, Mus musculus
gggtgtcttcctctcggcgtctata

SEQ ID NO: 250532 - DNA, 25 bp, Mus musculus
cctgctccaccatggcgaggcgagg

SEQ ID NO: 250533 - DNA, 25 bp, Mus musculus
gcgcagagcagggtcgttctgaacc

SEQ ID NO: 250534 - DNA, 25 bp, Mus musculus
accagcgcacttgcttggtcccgga

SEQ ID NO: 250535 - DNA, 25 bp, Mus musculus
tcgttctgaaccctcgtgggaggcg

SEQ ID NO: 250536 - DNA, 25 bp, Mus musculus
aaagttacggcgcagggagcaatcc

SEQ ID NO: 250537 - DNA, 25 bp, Mus musculus
tcggcgtctataagaacctttcagc

SEQ ID NO: 250538 - DNA, 25 bp, Mus musculus
cctttcagcccagcaggaaaacaga

SEQ ID NO: 250539 - DNA, 25 bp, Mus musculus
aaaagccaatgtgcccgctgccgca

SEQ ID NO: 250540 - DNA, 25 bp, Mus musculus
actgaagcggagcaaataggagagc

SEQ ID NO: 250541 - DNA, 25 bp, Mus musculus
ggatccctcggctccagtctggaga

SEQ ID NO: 250542 - DNA, 25 bp, Mus musculus
tctcaccggagcgaggatcgaaggt

SEQ ID NO: 250543 - DNA, 25 bp, Mus musculus
cttcggagaaagtgaactaggcggc

SEQ ID NO: 250544 - DNA, 25 bp, Mus musculus
ttcaacgacgcacttcagagatttc

SEQ ID NO: 250545 - DNA, 25 bp, Mus musculus
ctgtctttccttgcatctcgcgagc

SEQ ID NO: 250546 - DNA, 25 bp, Mus musculus
tgcatctcgcgagctttgcgggctc

SEQ ID NO: 250547 - DNA, 25 bp, Mus musculus
cgaagttgtgtttcccgagtgcacg

SEQ ID NO: 250548 - DNA, 25 bp, Mus musculus
atcagccggcggcatttcaacgacg

SEQ ID NO: 250549 - DNA, 25 bp, Mus musculus
tgtgctgctcgcgagcgccactttg

SEQ ID NO: 250550 - DNA, 25 bp, Mus musculus
agccgggcttactcagcgctaacgg

SEQ ID NO: 250551 - DNA, 25 bp, Mus musculus
gcttactcagcgctaacggggacga

SEQ ID NO: 250552 - DNA, 25 bp, Mus musculus
cgtgtttccggcgacatcagccggc

SEQ ID NO: 250553 - DNA, 25 bp, Mus musculus
aggcactgatttgcgtcctttcgga

SEQ ID NO: 250554 - DNA, 25 bp, Mus musculus
aaggctggcacgaagttgtgtttcc

SEQ ID NO: 250555 - DNA, 25 bp, Mus musculus
cctttcggagtagcgtttactgtgc

SEQ ID NO: 250556 - DNA, 25 bp, Mus musculus
ctaacggggacgaaggcactgattt

SEQ ID NO: 250557 - DNA, 25 bp, Mus musculus
gctcctcgctggagtccgagtgtcc

SEQ ID NO: 250558 - DNA, 25 bp, Mus musculus
cgaaccacgcggaagggcgttcgca

SEQ ID NO: 250559 - DNA, 25 bp, Mus musculus
ccgccttgtacctgggcgcaggcag

SEQ ID NO: 250560 - DNA, 25 bp, Mus musculus
tcaagccgccttgtacctgggcgca

SEQ ID NO: 250561 - DNA, 25 bp, Mus musculus
agcccgctgatcaagccgccttgta

SEQ ID NO: 250562 - DNA, 25 bp, Mus musculus
aggcgggtcagagcccgctgatcaa

SEQ ID NO: 250563 - DNA, 25 bp, Mus musculus
ctatcactcgaaaaggggtgcaggg

SEQ ID NO: 250564 - DNA, 25 bp, Mus musculus
atccgattacgattactatcactcg

SEQ ID NO: 250565 - DNA, 25 bp, Mus musculus
tacaatgttcagttgggcggccccg

SEQ ID NO: 250566 - DNA, 25 bp, Mus musculus
caaagctgctggaattacaatgttc

SEQ ID NO: 250567 - DNA, 25 bp, Mus musculus
aggtcccacaaagctgctggaatta

SEQ ID NO: 250568 - DNA, 25 bp, Mus musculus
cgcacggtcaggtcccacaaagctg

SEQ ID NO: 250569 - DNA, 25 bp, Mus musculus
ttgcagaccctaacccgcgcacggt

SEQ ID NO: 250570 - DNA, 25 bp, Mus musculus
tgcgcgggcgccaactgcaagcaca

SEQ ID NO: 250571 - DNA, 25 bp, Mus musculus
gcgttcgcaggccaaccttgcagac

SEQ ID NO: 250572 - DNA, 25 bp, Mus musculus
cgctttgctccgctgatgctcgggc

SEQ ID NO: 250573 - DNA, 25 bp, Mus musculus
cagtccctgcttgcagccttgggtc

SEQ ID NO: 250574 - DNA, 25 bp, Mus musculus
ggcgcgagctacagggttttaaaca

SEQ ID NO: 250575 - DNA, 25 bp, Mus musculus
ttttaaacacgcctcgcagcggcgc

SEQ ID NO: 250576 - DNA, 25 bp, Mus musculus
cgcgcacttgggtcctaggcccaga

SEQ ID NO: 250577 - DNA, 25 bp, Mus musculus
ctgcgttcgcccagctagcgctggg

SEQ ID NO: 250578 - DNA, 25 bp, Mus musculus
gcagccttgggtcctctcccagaat

SEQ ID NO: 250579 - DNA, 25 bp, Mus musculus
cacgcgcgacgctaggaaagatctg

SEQ ID NO: 250580 - DNA, 25 bp, Mus musculus
ctaagctgcgagcagacgcgggccc

SEQ ID NO: 250581 - DNA, 25 bp, Mus musculus
tcccagaatcccagagactctaagc

SEQ ID NO: 250582 - DNA, 25 bp, Mus musculus
atctgcgaggtgcagatccaccgcg

SEQ ID NO: 250583 - DNA, 25 bp, Mus musculus
tcagcgactccgatcgtgacaccgg

SEQ ID NO: 250584 - DNA, 25 bp, Mus musculus
ccagagactctaagctgcgagcaga

SEQ ID NO: 250585 - DNA, 25 bp, Mus musculus
cacagctcagcgactccgatcgtga

SEQ ID NO: 250586 - DNA, 25 bp, Mus musculus
cgggaatcgatagccaatcaggtcc

SEQ ID NO: 250587 - DNA, 25 bp, Mus musculus
gagcgatcttgtccgtcccgcgcta

SEQ ID NO: 250588 - DNA, 25 bp, Mus musculus
aggagtctatgagagcgatcttgtc

SEQ ID NO: 250589 - DNA, 25 bp, Mus musculus
tttgtccagcgcagaggagtctatg

SEQ ID NO: 250590 - DNA, 25 bp, Mus musculus
agcctccctttgtccagcgcagagg

SEQ ID NO: 250591 - DNA, 25 bp, Mus musculus
cgtgtacaggggctgcagcagcctc

SEQ ID NO: 250592 - DNA, 25 bp, Mus musculus
ccgagtaggagaaccctcgctcttt

SEQ ID NO: 250593 - DNA, 25 bp, Mus musculus
aggtcgcagtcctccctgcacagga

SEQ ID NO: 250594 - DNA, 25 bp, Mus musculus
ttcccattgggctgtgcgagcctca

SEQ ID NO: 250595 - DNA, 25 bp, Mus musculus
cctctcttcccattgggctgtgcga

SEQ ID NO: 250596 - DNA, 25 bp, Mus musculus
agcctcagcgagcagtgtgcgcttg

SEQ ID NO: 250597 - DNA, 25 bp, Mus musculus
tgtgcgcttgcgcatgtcccggcgt

SEQ ID NO: 250598 - DNA, 25 bp, Mus musculus
tttccgcgggaatcgatagccaatc

SEQ ID NO: 250599 - DNA, 25 bp, Mus musculus
ttcttggcctggtgccgcgtgtaca

SEQ ID NO: 250600 - DNA, 25 bp, Mus musculus
cctgtgtttgcgtcagtcctagaga

SEQ ID NO: 250601 - DNA, 25 bp, Mus musculus
gcgtcagtcctagagaggcggccaa

SEQ ID NO: 250602 - DNA, 25 bp, Mus musculus
cggcggccggatttacctgtgtttg

SEQ ID NO: 250603 - DNA, 25 bp, Mus musculus
gaccgaaccttgcagccgagctggg

SEQ ID NO: 250604 - DNA, 25 bp, Mus musculus
cagtcgggaccgaaccttgcagccg

SEQ ID NO: 250605 - DNA, 25 bp, Mus musculus
gaatcggctccagccagtcgggacc

SEQ ID NO: 250606 - DNA, 25 bp, Mus musculus
agtgctagagaatcggctccagcca

SEQ ID NO: 250607 - DNA, 25 bp, Mus musculus
ctgcaaagtgctagagaatcggctc

SEQ ID NO: 250608 - DNA, 25 bp, Mus musculus
atctgtgaatttctgcaaagtgcta

SEQ ID NO: 250609 - DNA, 25 bp, Mus musculus
gtctttctatctgtgaatttctgca

SEQ ID NO: 250610 - DNA, 25 bp, Mus musculus
atgcatcggttggtgtctttctatc

SEQ ID NO: 250611 - DNA, 25 bp, Mus musculus
cccaccgccacgtgggcctggctca

SEQ ID NO: 250612 - DNA, 25 bp, Mus musculus
tcgggacaaacgacgaatcccgcgc

SEQ ID NO: 250613 - DNA, 25 bp, Mus musculus
ggcaactcgggacaaacgacgaatc

SEQ ID NO: 250614 - DNA, 25 bp, Mus musculus
cccgctgacaggtgcaggcgggtcc

SEQ ID NO: 250615 - DNA, 25 bp, Mus musculus
ccagagggaaaatgcacgtgaacaa

SEQ ID NO: 250616 - DNA, 25 bp, Mus musculus
tcccggtggcacacgctcttcccgc

SEQ ID NO: 250617 - DNA, 25 bp, Mus musculus
attccctcccggtggcacacgctct

SEQ ID NO: 250618 - DNA, 25 bp, Mus musculus
gaacccattccctcccggtggcaca

SEQ ID NO: 250619 - DNA, 25 bp, Mus musculus
agaccattccctccaagcgtggaac

SEQ ID NO: 250620 - DNA, 25 bp, Mus musculus
tccctgagtccacggctcttccaga

SEQ ID NO: 250621 - DNA, 25 bp, Mus musculus
ctcctccctgagtccacggctcttc

SEQ ID NO: 250622 - DNA, 25 bp, Mus musculus
gcggactcccgacctctctcgggga

SEQ ID NO: 250623 - DNA, 25 bp, Mus musculus
tgggaagcggactcccgacctctct

SEQ ID NO: 250624 - DNA, 25 bp, Mus musculus
tctgggaagcggactcccgacctct

SEQ ID NO: 250625 - DNA, 25 bp, Mus musculus
aaaatgcacgtgaacaaagcaaatc

SEQ ID NO: 250626 - DNA, 25 bp, Mus musculus
gtgcaggcgggtcccagggttccta

SEQ ID NO: 250627 - DNA, 25 bp, Mus musculus
gagggaaaatgcacgtgaacaaagc

SEQ ID NO: 250628 - DNA, 25 bp, Mus musculus
agtccgcgagccgatgcagcccatg

SEQ ID NO: 250629 - DNA, 25 bp, Mus musculus
cgccgggctgcggtacccacccaca

SEQ ID NO: 250630 - DNA, 25 bp, Mus musculus
tgagctcctcgccatccccgctgag

SEQ ID NO: 250631 - DNA, 25 bp, Mus musculus
ggtacccacccacagtccgcgagcc

SEQ ID NO: 250632 - DNA, 25 bp, Mus musculus
tcgccatccccgctgagttctcccg

SEQ ID NO: 250633 - DNA, 25 bp, Mus musculus
gtccgcgagccgatgcagcccatgg

SEQ ID NO: 250634 - DNA, 25 bp, Mus musculus
agccgatgcagcccatggctccggg

SEQ ID NO: 250635 - DNA, 25 bp, Mus musculus
cctctccatccctccccacggcagc

SEQ ID NO: 250636 - DNA, 25 bp, Mus musculus
ccctcgccgcgctgcaaccacgtcc

SEQ ID NO: 250637 - DNA, 25 bp, Mus musculus
gctgcaaccacgtccctccgcctgt

SEQ ID NO: 250638 - DNA, 25 bp, Mus musculus
acgtccctccgcctgtccttcgcaa

SEQ ID NO: 250639 - DNA, 25 bp, Mus musculus
tccctccgcctgtccttcgcaaccc

SEQ ID NO: 250640 - DNA, 25 bp, Mus musculus
tgtccttcgcaacccccgcccctga

SEQ ID NO: 250641 - DNA, 25 bp, Mus musculus
ggctgcggtacccacccacagtccg

SEQ ID NO: 250642 - DNA, 25 bp, Mus musculus
gcgaatggcctgaaggtggagggat

SEQ ID NO: 250643 - DNA, 25 bp, Mus musculus
tagggaacagcgactgagccgcgaa

SEQ ID NO: 250644 - DNA, 25 bp, Mus musculus
aacagcgactgagccgcgaaggatg

SEQ ID NO: 250645 - DNA, 25 bp, Mus musculus
gaaggatgctgtggagaggctacca

SEQ ID NO: 250646 - DNA, 25 bp, Mus musculus
gagaggctaccagggaaggaccgcg

SEQ ID NO: 250647 - DNA, 25 bp, Mus musculus
aaggaccgcgcctgcgggagggcga

SEQ ID NO: 250648 - DNA, 25 bp, Mus musculus
cgatggagagaaggctatgagctga

SEQ ID NO: 250649 - DNA, 25 bp, Mus musculus
agaaggctatgagctgagagggatg

SEQ ID NO: 250650 - DNA, 25 bp, Mus musculus
atggaagccctggaggcgcgagggc

SEQ ID NO: 250651 - DNA, 25 bp, Mus musculus
agggcacaaggatagagggacctta

SEQ ID NO: 250652 - DNA, 25 bp, Mus musculus
ccatcgggagtagggaacagcgact

SEQ ID NO: 250653 - DNA, 25 bp, Mus musculus
gagggaaagtaaaggcgcgaggcag

SEQ ID NO: 250654 - DNA, 25 bp, Mus musculus
caaggatagagggaccttagcggat

SEQ ID NO: 250655 - DNA, 25 bp, Mus musculus
gcacaaggatagagggaccttagcg

SEQ ID NO: 250656 - DNA, 25 bp, Mus musculus
agtgcggacagtgagtcagttctcc

SEQ ID NO: 250657 - DNA, 25 bp, Mus musculus
ttccgggactgaccacaggacacgt

SEQ ID NO: 250658 - DNA, 25 bp, Mus musculus
tagccagcctgctcagcctggagtg

SEQ ID NO: 250659 - DNA, 25 bp, Mus musculus
tgagtcagttctccagcactcgcgg

SEQ ID NO: 250660 - DNA, 25 bp, Mus musculus
ggaaatgacatcagaggcctgtgct

SEQ ID NO: 250661 - DNA, 25 bp, Mus musculus
ccgcaggcggacctttgcagagcct

SEQ ID NO: 250662 - DNA, 25 bp, Mus musculus
gccgctccttgtatggtctgggcgc

SEQ ID NO: 250663 - DNA, 25 bp, Mus musculus
cgcttagaccgaggagtgtcagtcc

SEQ ID NO: 250664 - DNA, 25 bp, Mus musculus
gtcagtccgacaccgctctgcgtaa

SEQ ID NO: 250665 - DNA, 25 bp, Mus musculus
caaagtgaatcctttccggcctggg

SEQ ID NO: 250666 - DNA, 25 bp, Mus musculus
tcgggtgggcgagatcccaccacca

SEQ ID NO: 250667 - DNA, 25 bp, Mus musculus
gccctgatctttctcgggcgccagg

SEQ ID NO: 250668 - DNA, 25 bp, Mus musculus
cgcttggctagaagcggctccggac

SEQ ID NO: 250669 - DNA, 25 bp, Mus musculus
ttcaggaccgctgggattactagcc

SEQ ID NO: 250670 - DNA, 25 bp, Mus musculus
aacatcgaggggcagaaagtcagcc

SEQ ID NO: 250671 - DNA, 25 bp, Mus musculus
cagttctctcctgcggctccttggt

SEQ ID NO: 250672 - DNA, 25 bp, Mus musculus
ttggtgactcctgcctgggttctgc

SEQ ID NO: 250673 - DNA, 25 bp, Mus musculus
agacacgcaggggagtctagggcca

SEQ ID NO: 250674 - DNA, 25 bp, Mus musculus
gtagagctcaatcccgcggagctcg

SEQ ID NO: 250675 - DNA, 25 bp, Mus musculus
gacctgacgaggacccacggaggaa

SEQ ID NO: 250676 - DNA, 25 bp, Mus musculus
tcagttggagacctgacgaggaccc

SEQ ID NO: 250677 - DNA, 25 bp, Mus musculus
tgagcctcagttggagacctgacga

SEQ ID NO: 250678 - DNA, 25 bp, Mus musculus
aaagtcagccgggtccggatgagcc

SEQ ID NO: 250679 - DNA, 25 bp, Mus musculus
acaccggcgagtcccgtgcccagtt

SEQ ID NO: 250680 - DNA, 25 bp, Mus musculus
tgcggctccttggtgactcctgcct

SEQ ID NO: 250681 - DNA, 25 bp, Mus musculus
tccggatgagcctcagttggagacc

SEQ ID NO: 250682 - DNA, 25 bp, Mus musculus
ggtgctgtgggtagagctcaatccc

SEQ ID NO: 250683 - DNA, 25 bp, Mus musculus
acccacggaggaagagacacgcagg

SEQ ID NO: 250684 - DNA, 25 bp, Mus musculus
gtaaagtttttacctcgagatctca

SEQ ID NO: 250685 - DNA, 25 bp, Mus musculus
ctttggaaagccagagattgttttt

SEQ ID NO: 250686 - DNA, 25 bp, Mus musculus
cgcttccctagggcaggagcagagc

SEQ ID NO: 250687 - DNA, 25 bp, Mus musculus
tctcgctttttcttacattctctcc

SEQ ID NO: 250688 - DNA, 25 bp, Mus musculus
ataacaagtacatagctcctcccac

SEQ ID NO: 250689 - DNA, 25 bp, Mus musculus
tggaataacaagtacatagctcctc

SEQ ID NO: 250690 - DNA, 25 bp, Mus musculus
gtggaagacatttactggaataaca

SEQ ID NO: 250691 - DNA, 25 bp, Mus musculus
tggtaaggatcaggtggaagacatt

SEQ ID NO: 250692 - DNA, 25 bp, Mus musculus
tctctgcaggttgtggtaaggatca

SEQ ID NO: 250693 - DNA, 25 bp, Mus musculus
tagtaatgataatactgttctctgc

SEQ ID NO: 250694 - DNA, 25 bp, Mus musculus
cctgtataatgggatagtaatgata

SEQ ID NO: 250695 - DNA, 25 bp, Mus musculus
atactgttctctgcaggttgtggta

SEQ ID NO: 250696 - DNA, 25 bp, Mus musculus
cctcgagatctcagttttcattacc

SEQ ID NO: 250697 - DNA, 25 bp, Mus musculus
gatctcagttttcattacctgtata

SEQ ID NO: 250698 - DNA, 25 bp, Mus musculus
tcctggccacgaagcgggtgaccag

SEQ ID NO: 250699 - DNA, 25 bp, Mus musculus
ggcgccgtgtcgcacgcagctccag

SEQ ID NO: 250700 - DNA, 25 bp, Mus musculus
cactacacgccgtcgcccgagcgtc

SEQ ID NO: 250701 - DNA, 25 bp, Mus musculus
aggccctggctacgcactgggaaaa

SEQ ID NO: 250702 - DNA, 25 bp, Mus musculus
tacgcactgggaaaaagccggactc

SEQ ID NO: 250703 - DNA, 25 bp, Mus musculus
gcactgggaaaaagccggactcacc

SEQ ID NO: 250704 - DNA, 25 bp, Mus musculus
aaagccggactcaccgcggcctgtg

SEQ ID NO: 250705 - DNA, 25 bp, Mus musculus
tgtgcttttccaaaggaacggagcc

SEQ ID NO: 250706 - DNA, 25 bp, Mus musculus
tgcggggcatgattattgggtaaca

SEQ ID NO: 250707 - DNA, 25 bp, Mus musculus
ttctctctgggagcgtggccgagca

SEQ ID NO: 250708 - DNA, 25 bp, Mus musculus
tgattattgggtaacagtggtgccg

SEQ ID NO: 250709 - DNA, 25 bp, Mus musculus
ctccgttctctctgggagcgtggcc

SEQ ID NO: 250710 - DNA, 25 bp, Mus musculus
cgggatgcggtgtgcttttccaaag

SEQ ID NO: 250711 - DNA, 25 bp, Mus musculus
atccgggggcactcattgttgcgac

SEQ ID NO: 250712 - DNA, 25 bp, Mus musculus
cagtctgtcctttgtctgagtgcag

SEQ ID NO: 250713 - DNA, 25 bp, Mus musculus
cgactcggtcccaccaacttgtgtg

SEQ ID NO: 250714 - DNA, 25 bp, Mus musculus
caacttgtgtgtaagtcccgtccta

SEQ ID NO: 250715 - DNA, 25 bp, Mus musculus
ctcccagccacacaaagaagacttg

SEQ ID NO: 250716 - DNA, 25 bp, Mus musculus
cgcgtctgccggaatccacagttca

SEQ ID NO: 250717 - DNA, 25 bp, Mus musculus
caaaagcggcgctcgagtgagaccc

SEQ ID NO: 250718 - DNA, 25 bp, Mus musculus
ctgccttcgatgtcccactgggtgt

SEQ ID NO: 250719 - DNA, 25 bp, Mus musculus
acccaatcgccatcgcttttatttg

SEQ ID NO: 250720 - DNA, 25 bp, Mus musculus
actatcaagcgcctctccgattgga

SEQ ID NO: 250721 - DNA, 25 bp, Mus musculus
cttgctgggtggaagcaccacagtc

SEQ ID NO: 250722 - DNA, 25 bp, Mus musculus
ctgagtgcagactctcgactcggtc

SEQ ID NO: 250723 - DNA, 25 bp, Mus musculus
tgcggtacctctcaggaaagccatg

SEQ ID NO: 250724 - DNA, 25 bp, Mus musculus
ttcttttgccaacgtgcggtacctc

SEQ ID NO: 250725 - DNA, 25 bp, Mus musculus
agtcgctgtctttgttcttttgcca

SEQ ID NO: 250726 - DNA, 25 bp, Mus musculus
cccttgacaggaccgagtgcgtccg

SEQ ID NO: 250727 - DNA, 25 bp, Mus musculus
ttgaagacccagtggcaggacgtta

SEQ ID NO: 250728 - DNA, 25 bp, Mus musculus
tgcagagcagcacggaccacgcctg

SEQ ID NO: 250729 - DNA, 25 bp, Mus musculus
accgttactcgcagagcctggaaga

SEQ ID NO: 250730 - DNA, 25 bp, Mus musculus
ggggcaagcgacctcactgcgaaac

SEQ ID NO: 250731 - DNA, 25 bp, Mus musculus
cgggtgagttggcatcctcctgcct

SEQ ID NO: 250732 - DNA, 25 bp, Mus musculus
ctcacaggacgggaccagtaggcgc

SEQ ID NO: 250733 - DNA, 25 bp, Mus musculus
actggaggaatctgcagcctggacg

SEQ ID NO: 250734 - DNA, 25 bp, Mus musculus
aatctgcagcctggacggcgacagc

SEQ ID NO: 250735 - DNA, 25 bp, Mus musculus
cggcgacagctgcacagattccggg

SEQ ID NO: 250736 - DNA, 25 bp, Mus musculus
cgcccacccagagatggttcggatg

SEQ ID NO: 250737 - DNA, 25 bp, Mus musculus
tctccggagctctggcgcttcctaa

SEQ ID NO: 250738 - DNA, 25 bp, Mus musculus
gcacgaacctgttgaagacccagtg

SEQ ID NO: 250739 - DNA, 25 bp, Mus musculus
agggcagcagcagcgtcatgcgccc

SEQ ID NO: 250740 - DNA, 25 bp, Mus musculus
gtctctactcctcttgctgcttgct

SEQ ID NO: 250741 - DNA, 25 bp, Mus musculus
tagtggtcggcatgggaactgacac

SEQ ID NO: 250742 - DNA, 25 bp, Mus musculus
tcgctgacagttctccactcctaaa

SEQ ID NO: 250743 - DNA, 25 bp, Mus musculus
aggactcctgaagcccgctcgctgt

SEQ ID NO: 250744 - DNA, 25 bp, Mus musculus
actcctaaagcgagccggaggctca

SEQ ID NO: 250745 - DNA, 25 bp, Mus musculus
tgctgcttgcttgatgctcctcttg

SEQ ID NO: 250746 - DNA, 25 bp, Mus musculus
tgatgctcctcttgctcttcttgtc

SEQ ID NO: 250747 - DNA, 25 bp, Mus musculus
tcttcttgtcctgtcgccgtccaga

SEQ ID NO: 250748 - DNA, 25 bp, Mus musculus
tcgcacataactctctccgggaacg

SEQ ID NO: 250749 - DNA, 25 bp, Mus musculus
tccgggaacgctcagaaaaagcagc

SEQ ID NO: 250750 - DNA, 25 bp, Mus musculus
aaagcagcaagcgaccctggccctt

SEQ ID NO: 250751 - DNA, 25 bp, Mus musculus
gggcgactgacccacgacagcaaca

SEQ ID NO: 250752 - DNA, 25 bp, Mus musculus
ggacctccaggcctcgctgacagtt

SEQ ID NO: 250753 - DNA, 25 bp, Mus musculus
ggcatgggaactgacactccgcgcc

SEQ ID NO: 250754 - DNA, 25 bp, Mus musculus
ttcgtgtgcatctccggcgctcgca

SEQ ID NO: 250755 - DNA, 25 bp, Mus musculus
gagcaggaccaacagccaagctttc

SEQ ID NO: 250756 - DNA, 25 bp, Mus musculus
ccggagcttcatgattgggtgcaga

SEQ ID NO: 250757 - DNA, 25 bp, Mus musculus
cgagcgacgccggagcgcaccaaag

SEQ ID NO: 250758 - DNA, 25 bp, Mus musculus
gcgcaccaaagcctccaggaagttc

SEQ ID NO: 250759 - DNA, 25 bp, Mus musculus
ctccaggaagttcaggccggtgatt

SEQ ID NO: 250760 - DNA, 25 bp, Mus musculus
ccgcacgaatcagggcgagagccgt

SEQ ID NO: 250761 - DNA, 25 bp, Mus musculus
tcagctccgcgtttaaaactccgag

SEQ ID NO: 250762 - DNA, 25 bp, Mus musculus
actccgagccctagtgtgaggtgcc

SEQ ID NO: 250763 - DNA, 25 bp, Mus musculus
ttctgattggctgtgccgcgaccac

SEQ ID NO: 250764 - DNA, 25 bp, Mus musculus
agcagctgtgtcagcgccaagagca

SEQ ID NO: 250765 - DNA, 25 bp, Mus musculus
cttggagcgcccaggtccggaaaga

SEQ ID NO: 250766 - DNA, 25 bp, Mus musculus
ctgccactcggtttgcttggagcgc

SEQ ID NO: 250767 - DNA, 25 bp, Mus musculus
accaatcacgggctgccactcggtt

SEQ ID NO: 250768 - DNA, 25 bp, Mus musculus
ccgcaggcgtttactctgctggtga

SEQ ID NO: 250769 - DNA, 25 bp, Mus musculus
gtctgcgtgcggctaaattatgaca

SEQ ID NO: 250770 - DNA, 25 bp, Mus musculus
attatgacaccgtaaacccgcatgg

SEQ ID NO: 250771 - DNA, 25 bp, Mus musculus
ccgtaaacccgcatggatatcactg

SEQ ID NO: 250772 - DNA, 25 bp, Mus musculus
actgcaaacctgaggaaacccatcc

SEQ ID NO: 250773 - DNA, 25 bp, Mus musculus
tctgctggtgagaaaaggctatgga

SEQ ID NO: 250774 - DNA, 25 bp, Mus musculus
aaaggctatggagccgctgctgaca

SEQ ID NO: 250775 - DNA, 25 bp, Mus musculus
cggacgctcctagcctgagccttgg

SEQ ID NO: 250776 - DNA, 25 bp, Mus musculus
acgttcccgggcgataaagcgtgca

SEQ ID NO: 250777 - DNA, 25 bp, Mus musculus
cgataaagcgtgcactcactccgca

SEQ ID NO: 250778 - DNA, 25 bp, Mus musculus
gcagccgtcatcctgtctcacagcg

SEQ ID NO: 250779 - DNA, 25 bp, Mus musculus
ggagcagcacggctcaacatcagaa

SEQ ID NO: 250780 - DNA, 25 bp, Mus musculus
agcacggctcaacatcagaacctcg

SEQ ID NO: 250781 - DNA, 25 bp, Mus musculus
cgcatggatatcactgcaaacctga

SEQ ID NO: 250782 - DNA, 25 bp, Mus musculus
tccttcactacagcggcaagcggtc

SEQ ID NO: 250783 - DNA, 25 bp, Mus musculus
tgggccatgaccctctgtcggcgtc

SEQ ID NO: 250784 - DNA, 25 bp, Mus musculus
atgaccctctgtcggcgtctgttcg

SEQ ID NO: 250785 - DNA, 25 bp, Mus musculus
tctgtcggcgtctgttcgggcgccc

SEQ ID NO: 250786 - DNA, 25 bp, Mus musculus
cccgcagaggctagacgcttgggca

SEQ ID NO: 250787 - DNA, 25 bp, Mus musculus
cttgggcagggaagacgctagccaa

SEQ ID NO: 250788 - DNA, 25 bp, Mus musculus
cagggaagacgctagccaagggctc

SEQ ID NO: 250789 - DNA, 25 bp, Mus musculus
agccaagggctccaaagttcaaaga

SEQ ID NO: 250790 - DNA, 25 bp, Mus musculus
gggctccaaagttcaaagaccgaca

SEQ ID NO: 250791 - DNA, 25 bp, Mus musculus
ttcaaagaccgacaagcaaactatg

SEQ ID NO: 250792 - DNA, 25 bp, Mus musculus
gaccgacaagcaaactatgttcctt

SEQ ID NO: 250793 - DNA, 25 bp, Mus musculus
tgttccttcactacagcggcaagcg

SEQ ID NO: 250794 - DNA, 25 bp, Mus musculus
tcactacagcggcaagcggtcggtc

SEQ ID NO: 250795 - DNA, 25 bp, Mus musculus
aaactatgttccttcactacagcgg

SEQ ID NO: 250796 - DNA, 25 bp, Mus musculus
gcgtaggctgctcgctactcagctc

SEQ ID NO: 250797 - DNA, 25 bp, Mus musculus
agtttctaacctacacgcgccgcgg

SEQ ID NO: 250798 - DNA, 25 bp, Mus musculus
agcgagcaacgcgagaccgcttctc

SEQ ID NO: 250799 - DNA, 25 bp, Mus musculus
cgcgagtcctgtcagagcgagcaac

SEQ ID NO: 250800 - DNA, 25 bp, Mus musculus
cgggaccagggtctgcagtttctaa

SEQ ID NO: 250801 - DNA, 25 bp, Mus musculus
tgcagtactcgctgcccacaaagcg

SEQ ID NO: 250802 - DNA, 25 bp, Mus musculus
gggctcgaggtgtttttgcaatcca

SEQ ID NO: 250803 - DNA, 25 bp, Mus musculus
ccagccattctgtacagccgcgaga

SEQ ID NO: 250804 - DNA, 25 bp, Mus musculus
acagccgcgagagctgtcgttgcta

SEQ ID NO: 250805 - DNA, 25 bp, Mus musculus
taggtgcggcaggacagtcacctgc

SEQ ID NO: 250806 - DNA, 25 bp, Mus musculus
aaagccaaggtgtgtccttatggac

SEQ ID NO: 250807 - DNA, 25 bp, Mus musculus
cttatggactgcgtgaggacagaca

SEQ ID NO: 250808 - DNA, 25 bp, Mus musculus
cgcaggcttagccagtagtgcagtc

SEQ ID NO: 250809 - DNA, 25 bp, Mus musculus
ttctcgccgtctgccgagagcactg

SEQ ID NO: 250810 - DNA, 25 bp, Mus musculus
atccgcaagcatcacctcatgaagc

SEQ ID NO: 250811 - DNA, 25 bp, Mus musculus
cagacgctcaaggaccacctacgga

SEQ ID NO: 250812 - DNA, 25 bp, Mus musculus
ttccgctacaagcagacgctcaagg

SEQ ID NO: 250813 - DNA, 25 bp, Mus musculus
cagtgtgcggaaggagcttccgcta

SEQ ID NO: 250814 - DNA, 25 bp, Mus musculus
aggcgagcgaccatacccctgtgca

SEQ ID NO: 250815 - DNA, 25 bp, Mus musculus
agcatcacctcatgaagcaccagcg

SEQ ID NO: 250816 - DNA, 25 bp, Mus musculus
cagtgtccgcactgcggcaagagct

SEQ ID NO: 250817 - DNA, 25 bp, Mus musculus
agcggcctttccagtgtccgcactg

SEQ ID NO: 250818 - DNA, 25 bp, Mus musculus
accaccggaggctgcacacaggtga

SEQ ID NO: 250819 - DNA, 25 bp, Mus musculus
aggaacacttgctaaaccaccggag

SEQ ID NO: 250820 - DNA, 25 bp, Mus musculus
gtccctacccgtgcacagactgtag

SEQ ID NO: 250821 - DNA, 25 bp, Mus musculus
gctaaaccaccggaggctgcacaca

SEQ ID NO: 250822 - DNA, 25 bp, Mus musculus
cacagactgtagcaagagcttcatg

SEQ ID NO: 250823 - DNA, 25 bp, Mus musculus
gagcttcatgcgtaaggaacacttg

SEQ ID NO: 250824 - DNA, 25 bp, Mus musculus
acctagcgcggtagtggccgcttca

SEQ ID NO: 250825 - DNA, 25 bp, Mus musculus
gtccgacccgcctgggtttgcggca

SEQ ID NO: 250826 - DNA, 25 bp, Mus musculus
actgtttgctcctacgggctgtaga

SEQ ID NO: 250827 - DNA, 25 bp, Mus musculus
cgcttcactgagcagggactcgggt

SEQ ID NO: 250828 - DNA, 25 bp, Mus musculus
tttgtgtcaacacggccgcagcctc

SEQ ID NO: 250829 - DNA, 25 bp, Mus musculus
aggatgcagtttgtgtcaacacggc

SEQ ID NO: 250830 - DNA, 25 bp, Mus musculus
cggggaacagcactcccaggatgca

SEQ ID NO: 250831 - DNA, 25 bp, Mus musculus
gcgcctggaaaacgttcttcttctc

SEQ ID NO: 250832 - DNA, 25 bp, Mus musculus
cgcagcttgggacgtgaagatcgac

SEQ ID NO: 250833 - DNA, 25 bp, Mus musculus
cttgggacgtgaagatcgaccaccc

SEQ ID NO: 250834 - DNA, 25 bp, Mus musculus
cagccagacctagaggccggcggtc

SEQ ID NO: 250835 - DNA, 25 bp, Mus musculus
cggtcgccgtcagatttctttgggg

SEQ ID NO: 250836 - DNA, 25 bp, Mus musculus
caccgaaggggactgtttgctccta

SEQ ID NO: 250837 - DNA, 25 bp, Mus musculus
gactcgggttcctcttggcgtccga

SEQ ID NO: 250838 - DNA, 25 bp, Mus musculus
agcggccctacaaatgctccgagtg

SEQ ID NO: 250839 - DNA, 25 bp, Mus musculus
gtcactcaaggaccacctgcgcgtg

SEQ ID NO: 250840 - DNA, 25 bp, Mus musculus
gcttccgctacaaggagtcactcaa

SEQ ID NO: 250841 - DNA, 25 bp, Mus musculus
agcggccctacacatgtggcgagtg

SEQ ID NO: 250842 - DNA, 25 bp, Mus musculus
ctgctaaagcaccagcggatccaca

SEQ ID NO: 250843 - DNA, 25 bp, Mus musculus
gagcttcatccgaaagcagaacctg

SEQ ID NO: 250844 - DNA, 25 bp, Mus musculus
tgctccgagtgtgagaagacctaca

SEQ ID NO: 250845 - DNA, 25 bp, Mus musculus
gccaccagatgacgcaccgcggtga

SEQ ID NO: 250846 - DNA, 25 bp, Mus musculus
acgaccatacgagtgcgcagagtgc

SEQ ID NO: 250847 - DNA, 25 bp, Mus musculus
gcagccacaccaaggaacgaccata

SEQ ID NO: 250848 - DNA, 25 bp, Mus musculus
ttcggcgtgcgaaagagcctcatca

SEQ ID NO: 250849 - DNA, 25 bp, Mus musculus
aagccctactcttgcctggaatgcg

SEQ ID NO: 250850 - DNA, 25 bp, Mus musculus
tcagcccaccggagaaggcagtgca

SEQ ID NO: 250851 - DNA, 25 bp, Mus musculus
gacctacagccgcaaggagcacctg

SEQ ID NO: 250852 - DNA, 25 bp, Mus musculus
cgctcggtcgcaggcttggtttcct

SEQ ID NO: 250853 - DNA, 25 bp, Mus musculus
tgcgtctttccgcagaaacttctgc

SEQ ID NO: 250854 - DNA, 25 bp, Mus musculus
cggatgctctgcgtctttccgcaga

SEQ ID NO: 250855 - DNA, 25 bp, Mus musculus
agagcccggatgctctgcgtctttc

SEQ ID NO: 250856 - DNA, 25 bp, Mus musculus
gtccttctgcgtcaggctcagagcc

SEQ ID NO: 250857 - DNA, 25 bp, Mus musculus
ttgctccctgggtccttctgcgtca

SEQ ID NO: 250858 - DNA, 25 bp, Mus musculus
ggcgccggcggatgctgacttccct

SEQ ID NO: 250859 - DNA, 25 bp, Mus musculus
ctactcgggtaaggtgctccggccg

SEQ ID NO: 250860 - DNA, 25 bp, Mus musculus
agtcgacgcctactcgggtaaggtg

SEQ ID NO: 250861 - DNA, 25 bp, Mus musculus
ttcgagcagtatcccgccagtcggt

SEQ ID NO: 250862 - DNA, 25 bp, Mus musculus
agcggcgtacagttcgagcagtatc

SEQ ID NO: 250863 - DNA, 25 bp, Mus musculus
gtacagttcgagcagtatcccgcca

SEQ ID NO: 250864 - DNA, 25 bp, Mus musculus
atgctgacttccctcccggtaccct

SEQ ID NO: 250865 - DNA, 25 bp, Mus musculus
agtatcccgccagtcggtgttgtgg

SEQ ID NO: 250866 - DNA, 25 bp, Mus musculus
tcagcctacacatggccgcaggcgg

SEQ ID NO: 250867 - DNA, 25 bp, Mus musculus
gccctaagatcggtgcgcgcgacat

SEQ ID NO: 250868 - DNA, 25 bp, Mus musculus
gcaggccacggaagccatcagccta

SEQ ID NO: 250869 - DNA, 25 bp, Mus musculus
tagtcatggctgaagcggcgcctgc

SEQ ID NO: 250870 - DNA, 25 bp, Mus musculus
cccagcacggagttcagggatttcc

SEQ ID NO: 250871 - DNA, 25 bp, Mus musculus
ccagatgcgtcgatggaggcccgca

SEQ ID NO: 250872 - DNA, 25 bp, Mus musculus
ttgactgaaaatcagccggcgcttg

SEQ ID NO: 250873 - DNA, 25 bp, Mus musculus
tgggccgacctgttgactgaaaatc

SEQ ID NO: 250874 - DNA, 25 bp, Mus musculus
cggctccggtagattagggccagca

SEQ ID NO: 250875 - DNA, 25 bp, Mus musculus
cgaaggcttgcctgagccagctgcc

SEQ ID NO: 250876 - DNA, 25 bp, Mus musculus
atttacccgcccgaaggcttgcctg

SEQ ID NO: 250877 - DNA, 25 bp, Mus musculus
ctcacgggcgtctttctcgaattta

SEQ ID NO: 250878 - DNA, 25 bp, Mus musculus
cttagcgttttcctcacgggcgtct

SEQ ID NO: 250879 - DNA, 25 bp, Mus musculus
cagcccagcgacgacgtggtagtca

SEQ ID NO: 250880 - DNA, 25 bp, Mus musculus
cattgaacctggtgctggctccggc

SEQ ID NO: 250881 - DNA, 25 bp, Mus musculus
accggccaggggacctgcgcaaaga

SEQ ID NO: 250882 - DNA, 25 bp, Mus musculus
ggggacctgcgcaaagacgacttcc

SEQ ID NO: 250883 - DNA, 25 bp, Mus musculus
tgcgcaaagacgacttcctcccgga

SEQ ID NO: 250884 - DNA, 25 bp, Mus musculus
tcccggacaccaaggaggaagcgga

SEQ ID NO: 250885 - DNA, 25 bp, Mus musculus
agtgccagctctgcgtagccttgga

SEQ ID NO: 250886 - DNA, 25 bp, Mus musculus
cagctctgcgtagccttggagacgc

SEQ ID NO: 250887 - DNA, 25 bp, Mus musculus
aggcgtagtcgcctcgtaacgagac

SEQ ID NO: 250888 - DNA, 25 bp, Mus musculus
tcgtaacgagacctttgacccgcgc

SEQ ID NO: 250889 - DNA, 25 bp, Mus musculus
aacgagacctttgacccgcgctcgg

SEQ ID NO: 250890 - DNA, 25 bp, Mus musculus
gcggagcagccgagactcctgaaga

SEQ ID NO: 250891 - DNA, 25 bp, Mus musculus
cagccgagactcctgaagaggcggt

SEQ ID NO: 250892 - DNA, 25 bp, Mus musculus
cgcttggcattgaacctggtgctgg

SEQ ID NO: 250893 - DNA, 25 bp, Mus musculus
cgccgcggcgcttggcattgaacct

SEQ ID NO: 250894 - DNA, 25 bp, Mus musculus
ggcacacctgtttcgacagcaactc

SEQ ID NO: 250895 - DNA, 25 bp, Mus musculus
accgtgaacagcgacgagagcccgc

SEQ ID NO: 250896 - DNA, 25 bp, Mus musculus
gacccaggttcggatctcgacgccg

SEQ ID NO: 250897 - DNA, 25 bp, Mus musculus
tcagaaattggctggcacacctgtt

SEQ ID NO: 250898 - DNA, 25 bp, Mus musculus
cgtcgtctgggacccaggttcggat

SEQ ID NO: 250899 - DNA, 25 bp, Mus musculus
ttcgacagcaactcccgctctggtg

SEQ ID NO: 250900 - DNA, 25 bp, Mus musculus
cacaggctggagctgaggctttgac

SEQ ID NO: 250901 - DNA, 25 bp, Mus musculus
gaggctttgacgctggtcctgagcc

SEQ ID NO: 250902 - DNA, 25 bp, Mus musculus
tcctgagccgaacgcggatgagttc

SEQ ID NO: 250903 - DNA, 25 bp, Mus musculus
cggatgagttcatgcccggcgccgc

SEQ ID NO: 250904 - DNA, 25 bp, Mus musculus
gcaggacaagcagggcacaaccgtg

SEQ ID NO: 250905 - DNA, 25 bp, Mus musculus
agggcacaaccgtgaacagcgacga

SEQ ID NO: 250906 - DNA, 25 bp, Mus musculus
cgctctggtgcctgcacaggctgga

SEQ ID NO: 250907 - DNA, 25 bp, Mus musculus
tctcgacgccggctcagaaattggc

SEQ ID NO: 250908 - DNA, 25 bp, Mus musculus
aagggtggcccttaccgatcatgtg

SEQ ID NO: 250909 - DNA, 25 bp, Mus musculus
agcttgtgctcccagctagccaata

SEQ ID NO: 250910 - DNA, 25 bp, Mus musculus
agagtctggcttctctaccgtcagg

SEQ ID NO: 250911 - DNA, 25 bp, Mus musculus
tctctaccgtcaggggcggaacctc

SEQ ID NO: 250912 - DNA, 25 bp, Mus musculus
gcggaacctccagggctagccaatg

SEQ ID NO: 250913 - DNA, 25 bp, Mus musculus
cgaggacgtctaggtctcaaactgc

SEQ ID NO: 250914 - DNA, 25 bp, Mus musculus
aaactgccaactgcgtccaagacga

SEQ ID NO: 250915 - DNA, 25 bp, Mus musculus
gtccaagacgaccatcctgattctg

SEQ ID NO: 250916 - DNA, 25 bp, Mus musculus
ctgattctgtatcgtgaggccagga

SEQ ID NO: 250917 - DNA, 25 bp, Mus musculus
agcgaacgctatgcagcttgtgctc

SEQ ID NO: 250918 - DNA, 25 bp, Mus musculus
gacgaagcagaatcgcgcgcagcca

SEQ ID NO: 250919 - DNA, 25 bp, Mus musculus
tgagacgaaacgctagcgaacgcta

SEQ ID NO: 250920 - DNA, 25 bp, Mus musculus
atgtgaagcggttcctgaattcgcc

SEQ ID NO: 250921 - DNA, 25 bp, Mus musculus
ggacacagcggctacaacaagacga

SEQ ID NO: 250922 - DNA, 25 bp, Mus musculus
tggtgcttctgcgtgaagcgcttgc

SEQ ID NO: 250923 - DNA, 25 bp, Mus musculus
cgcatgctcactcgcccgtgtgggt

SEQ ID NO: 250924 - DNA, 25 bp, Mus musculus
gtccgcaggtggtacttgagcgact

SEQ ID NO: 250925 - DNA, 25 bp, Mus musculus
acttgagcgactgtttgtagcggaa

SEQ ID NO: 250926 - DNA, 25 bp, Mus musculus
tgcgacgggcggctgaaactcttgc

SEQ ID NO: 250927 - DNA, 25 bp, Mus musculus
atgctccagcaggtggtgcttctgc

SEQ ID NO: 250928 - DNA, 25 bp, Mus musculus
gcttgccacactcggcgcagtggta

SEQ ID NO: 250929 - DNA, 25 bp, Mus musculus
tggatgcgccggtgttccagcaagt

SEQ ID NO: 250930 - DNA, 25 bp, Mus musculus
ccggtgttccagcaagtggtgcttg

SEQ ID NO: 250931 - DNA, 25 bp, Mus musculus
ccagcaagtggtgcttgcggatgaa

SEQ ID NO: 250932 - DNA, 25 bp, Mus musculus
gcagtggttggtgagcttagatttc

SEQ ID NO: 250933 - DNA, 25 bp, Mus musculus
agatttctcactgaagctcttctcg

SEQ ID NO: 250934 - DNA, 25 bp, Mus musculus
accagtatgagtccgctggtggcgc

SEQ ID NO: 250935 - DNA, 25 bp, Mus musculus
cctgtgtgcgcacgctgatgctcca

SEQ ID NO: 250936 - DNA, 25 bp, Mus musculus
cgaaatgggagagccgcgtcagcac

SEQ ID NO: 250937 - DNA, 25 bp, Mus musculus
ggccgcccaccctggcgaagccgcc

SEQ ID NO: 250938 - DNA, 25 bp, Mus musculus
aggcctctacgggactgcgggcacc

SEQ ID NO: 250939 - DNA, 25 bp, Mus musculus
ctctacgggactgcgggcacctagc

SEQ ID NO: 250940 - DNA, 25 bp, Mus musculus
tagcccgggccgactcgctacgtga

SEQ ID NO: 250941 - DNA, 25 bp, Mus musculus
cgactcgctacgtgaccttggggca

SEQ ID NO: 250942 - DNA, 25 bp, Mus musculus
tcgctacgtgaccttggggcaggca

SEQ ID NO: 250943 - DNA, 25 bp, Mus musculus
cgccgggtgtccgtgcctcagtgtc

SEQ ID NO: 250944 - DNA, 25 bp, Mus musculus
gtgtccgtgcctcagtgtctccgct

SEQ ID NO: 250945 - DNA, 25 bp, Mus musculus
gcctcagtgtctccgctctgcgaaa

SEQ ID NO: 250946 - DNA, 25 bp, Mus musculus
tctgcgaaatgggagagccgcgtca

SEQ ID NO: 250947 - DNA, 25 bp, Mus musculus
ccgagctctgcggaaaacgtgccgc

SEQ ID NO: 250948 - DNA, 25 bp, Mus musculus
gccagtgctcggctagcccaggccg

SEQ ID NO: 250949 - DNA, 25 bp, Mus musculus
ctgcggaaaacgtgccgctggccac

SEQ ID NO: 250950 - DNA, 25 bp, Mus musculus
ttggccactgcagggtggttgcgct

SEQ ID NO: 250951 - DNA, 25 bp, Mus musculus
tgtgcaggtgaatggccgcacgccc

SEQ ID NO: 250952 - DNA, 25 bp, Mus musculus
cacactgtgcaggtgaatggccgca

SEQ ID NO: 250953 - DNA, 25 bp, Mus musculus
ttcccacacactgtgcaggtgaatg

SEQ ID NO: 250954 - DNA, 25 bp, Mus musculus
gctcttcccacacactgtgcaggtg

SEQ ID NO: 250955 - DNA, 25 bp, Mus musculus
aagctcttcccacacactgtgcagg

SEQ ID NO: 250956 - DNA, 25 bp, Mus musculus
accgtgtgcgggcgccttggccact

SEQ ID NO: 250957 - DNA, 25 bp, Mus musculus
ggaacgctctgtgaagcgcttctcg

SEQ ID NO: 250958 - DNA, 25 bp, Mus musculus
cttggaacgctctgtgaagcgcttc

SEQ ID NO: 250959 - DNA, 25 bp, Mus musculus
gagcttggaacgctctgtgaagcgc

SEQ ID NO: 250960 - DNA, 25 bp, Mus musculus
tcggtagtggtcgatgagcttggaa

SEQ ID NO: 250961 - DNA, 25 bp, Mus musculus
cgcacgcccgtgtgcgttcggtagt

SEQ ID NO: 250962 - DNA, 25 bp, Mus musculus
tgaatggccgcacgcccgtgtgcgt

SEQ ID NO: 250963 - DNA, 25 bp, Mus musculus
ggaggtggtccttgcggatgaagct

SEQ ID NO: 250964 - DNA, 25 bp, Mus musculus
ccgcgggactgtagtagtcagaatc

SEQ ID NO: 250965 - DNA, 25 bp, Mus musculus
actcctgtcatagctcccgggcggt

SEQ ID NO: 250966 - DNA, 25 bp, Mus musculus
cggatgcttgggactcttctgtcaa

SEQ ID NO: 250967 - DNA, 25 bp, Mus musculus
aacggagcttggaagtcgccggatc

SEQ ID NO: 250968 - DNA, 25 bp, Mus musculus
cgcttctgcgaagcacccttctatg

SEQ ID NO: 250969 - DNA, 25 bp, Mus musculus
agtcagaatcggtggccgaggactc

SEQ ID NO: 250970 - DNA, 25 bp, Mus musculus
ggggttgagcgctttgccataagaa

SEQ ID NO: 250971 - DNA, 25 bp, Mus musculus
gccgttcacgccgtggtactggtac

SEQ ID NO: 250972 - DNA, 25 bp, Mus musculus
tcggcataagccttggccgggtagc

SEQ ID NO: 250973 - DNA, 25 bp, Mus musculus
gctggcgtagccgtagtcggcataa

SEQ ID NO: 250974 - DNA, 25 bp, Mus musculus
ttacggatgccctgggtacctgcct

SEQ ID NO: 250975 - DNA, 25 bp, Mus musculus
tgcggacagcgtggccctcatctac

SEQ ID NO: 250976 - DNA, 25 bp, Mus musculus
acccttctatgggtgcggacagcgt

SEQ ID NO: 250977 - DNA, 25 bp, Mus musculus
actcgggcaaagttggcgattcctg

SEQ ID NO: 250978 - DNA, 25 bp, Mus musculus
tgctcaccagcgatgtgccacctgg

SEQ ID NO: 250979 - DNA, 25 bp, Mus musculus
tgccacctggtttggcggtataaaa

SEQ ID NO: 250980 - DNA, 25 bp, Mus musculus
gcagtcctcgcgtgccgcctgagga

SEQ ID NO: 250981 - DNA, 25 bp, Mus musculus
gtgggtgctcactgtctacagaatc

SEQ ID NO: 250982 - DNA, 25 bp, Mus musculus
tcactgtctacagaatcgacgtcgg

SEQ ID NO: 250983 - DNA, 25 bp, Mus musculus
ctacagaatcgacgtcggacacctc

SEQ ID NO: 250984 - DNA, 25 bp, Mus musculus
atcgacgtcggacacctcccaggtg

SEQ ID NO: 250985 - DNA, 25 bp, Mus musculus
cctcccaggtgccaccaggccgctg

SEQ ID NO: 250986 - DNA, 25 bp, Mus musculus
ggaacttggcgcaggtcggcctccc

SEQ ID NO: 250987 - DNA, 25 bp, Mus musculus
ggccgctccacactgcatcctggga

SEQ ID NO: 250988 - DNA, 25 bp, Mus musculus
gccgacgaaggcccgtgaggcttcc

SEQ ID NO: 250989 - DNA, 25 bp, Mus musculus
cacctgcagctcgagcggcgaacgg

SEQ ID NO: 250990 - DNA, 25 bp, Mus musculus
ttgggcacatagtgggtgctcactg

SEQ ID NO: 250991 - DNA, 25 bp, Mus musculus
gccagtgctcaccagcgatgtgcca

SEQ ID NO: 250992 - DNA, 25 bp, Mus musculus
ccgactttgagctcgagtgagccga

SEQ ID NO: 250993 - DNA, 25 bp, Mus musculus
gaagtgtagtctgcgcttgcgtcgt

SEQ ID NO: 250994 - DNA, 25 bp, Mus musculus
gaggatccgtcaccgccgactttga

SEQ ID NO: 250995 - DNA, 25 bp, Mus musculus
gggcttcttggtgcagcgcagtccc

SEQ ID NO: 250996 - DNA, 25 bp, Mus musculus
ttgcggaccgacgaacgccgcggtc

SEQ ID NO: 250997 - DNA, 25 bp, Mus musculus
gtaagacgagccgttgcggaccgac

SEQ ID NO: 250998 - DNA, 25 bp, Mus musculus
cgccatggcgctccaggtaagacga

SEQ ID NO: 250999 - DNA, 25 bp, Mus musculus
tcgcgaagctgagttccgccatggc

SEQ ID NO: 251000 - DNA, 25 bp, Mus musculus
cagccagagccgcaccggaagctgg

SEQ ID NO: 251001 - DNA, 25 bp, Mus musculus
cgcttcctgtcgtgcagaactgggc

SEQ ID NO: 251002 - DNA, 25 bp, Mus musculus
gcggttctcggtgtagcgagttccc

SEQ ID NO: 251003 - DNA, 25 bp, Mus musculus
cagacgagccaactctgcggttctc

SEQ ID NO: 251004 - DNA, 25 bp, Mus musculus
atgcgaagcgccagaccgacccaga

SEQ ID NO: 251005 - DNA, 25 bp, Mus musculus
cttgcgtcgttaccgctgtgaggct

SEQ ID NO: 251006 - DNA, 25 bp, Mus musculus
acgaccctcggtgagatgcagactc

SEQ ID NO: 251007 - DNA, 25 bp, Mus musculus
gcttgtcgcactctgagcacgggaa

SEQ ID NO: 251008 - DNA, 25 bp, Mus musculus
gggccttcttgctgaagcgcttgtc

SEQ ID NO: 251009 - DNA, 25 bp, Mus musculus
atcttctggctgaagcgtttgccgc

SEQ ID NO: 251010 - DNA, 25 bp, Mus musculus
ctgatgcgagcctaggtgaatcttc

SEQ ID NO: 251011 - DNA, 25 bp, Mus musculus
cggaaacgtttctcgcattcggtgc

SEQ ID NO: 251012 - DNA, 25 bp, Mus musculus
tcagatgcgtcttcttgcggaaacg

SEQ ID NO: 251013 - DNA, 25 bp, Mus musculus
ccgcaccaggtgttgcttgtgtgtg

SEQ ID NO: 251014 - DNA, 25 bp, Mus musculus
ggtgcgtagcgaggttctttttcca

SEQ ID NO: 251015 - DNA, 25 bp, Mus musculus
cacgttggtgccgagtgcacattca

SEQ ID NO: 251016 - DNA, 25 bp, Mus musculus
gaacccggtccacagtcaggcgcat

SEQ ID NO: 251017 - DNA, 25 bp, Mus musculus
cggccacactgagcacaggcaaatg

SEQ ID NO: 251018 - DNA, 25 bp, Mus musculus
acaggcaaaaggtctggcgccgcta

SEQ ID NO: 251019 - DNA, 25 bp, Mus musculus
tagcagcatcgtgcaccctctggtg

SEQ ID NO: 251020 - DNA, 25 bp, Mus musculus
actgctccggggcacaggctaaagc

SEQ ID NO: 251021 - DNA, 25 bp, Mus musculus
tcggcagggcttgtaaagctccgtt

SEQ ID NO: 251022 - DNA, 25 bp, Mus musculus
gcttgtaaagctccgtttgggtggc

SEQ ID NO: 251023 - DNA, 25 bp, Mus musculus
cctgcccgggagtctcgggtgtcct

SEQ ID NO: 251024 - DNA, 25 bp, Mus musculus
agtctcgggtgtccttacctggcgg

SEQ ID NO: 251025 - DNA, 25 bp, Mus musculus
ttacctggcgggctcctgcggctac

SEQ ID NO: 251026 - DNA, 25 bp, Mus musculus
taaagcggagggtcttcgagagacc

SEQ ID NO: 251027 - DNA, 25 bp, Mus musculus
gcacaggctaaagcggagggtcttc

SEQ ID NO: 251028 - DNA, 25 bp, Mus musculus
cccgggaagcgggaacactgctccg

SEQ ID NO: 251029 - DNA, 25 bp, Mus musculus
acagccctgaaacttcgcggggagg

SEQ ID NO: 251030 - DNA, 25 bp, Mus musculus
ccgggactgacagccctgaaacttc

SEQ ID NO: 251031 - DNA, 25 bp, Mus musculus
tcccgggcggccgtttgcacaatgg

SEQ ID NO: 251032 - DNA, 25 bp, Mus musculus
cgtttgcacaatggcgccggctgcc

SEQ ID NO: 251033 - DNA, 25 bp, Mus musculus
gctgcccgaaagactccgggactga

SEQ ID NO: 251034 - DNA, 25 bp, Mus musculus
agccgcagcgcgtcccttaaaaaca

SEQ ID NO: 251035 - DNA, 25 bp, Mus musculus
aaacaactttttctgcgtcgcacca

SEQ ID NO: 251036 - DNA, 25 bp, Mus musculus
cgcagcgcgtcccttaaaaacaact

SEQ ID NO: 251037 - DNA, 25 bp, Mus musculus
cgtcacttgcgtaccctgccagccg

SEQ ID NO: 251038 - DNA, 25 bp, Mus musculus
ctgggcctgcgccagaaaccgagtt

SEQ ID NO: 251039 - DNA, 25 bp, Mus musculus
cctgcgccagaaaccgagttgcgtg

SEQ ID NO: 251040 - DNA, 25 bp, Mus musculus
gcgccagaaaccgagttgcgtgttc

SEQ ID NO: 251041 - DNA, 25 bp, Mus musculus
ccgagttgcgtgttctgtttgtttg

SEQ ID NO: 251042 - DNA, 25 bp, Mus musculus
ggggatgctggattcttctggaacc

SEQ ID NO: 251043 - DNA, 25 bp, Mus musculus
tgctggattcttctggaaccgcccg

SEQ ID NO: 251044 - DNA, 25 bp, Mus musculus
tggattcttctggaaccgcccgcgg

SEQ ID NO: 251045 - DNA, 25 bp, Mus musculus
cgcccgcggttagtggccacgccct

SEQ ID NO: 251046 - DNA, 25 bp, Mus musculus
tgctctgagtgcagttaacagacag

SEQ ID NO: 251047 - DNA, 25 bp, Mus musculus
tgcagttaacagacagaacgcttta

SEQ ID NO: 251048 - DNA, 25 bp, Mus musculus
ccttctcccgagcagcattagctgg

SEQ ID NO: 251049 - DNA, 25 bp, Mus musculus
tagcagggtgctccctctctgcgtt

SEQ ID NO: 251050 - DNA, 25 bp, Mus musculus
tggcagatgaccgttgtacacagtg

SEQ ID NO: 251051 - DNA, 25 bp, Mus musculus
cgcgctgggtcatgcgtaagaagat

SEQ ID NO: 251052 - DNA, 25 bp, Mus musculus
agccaagacaagagcgcgctgggtc

SEQ ID NO: 251053 - DNA, 25 bp, Mus musculus
ggaccgacgcccagaagccaagaca

SEQ ID NO: 251054 - DNA, 25 bp, Mus musculus
cagccgccaggggaggaagacttat

SEQ ID NO: 251055 - DNA, 25 bp, Mus musculus
agtccacagacttgagcagctcggt

SEQ ID NO: 251056 - DNA, 25 bp, Mus musculus
tgcactgtcccgaacacttcgtagt

SEQ ID NO: 251057 - DNA, 25 bp, Mus musculus
ggtcagaccgtaccttgcactgtcc

SEQ ID NO: 251058 - DNA, 25 bp, Mus musculus
cctcgtcttggcatcccaggtcaga

SEQ ID NO: 251059 - DNA, 25 bp, Mus musculus
tggatggcataagcttcctcctctc

SEQ ID NO: 251060 - DNA, 25 bp, Mus musculus
tgcctcagtgagaagaaccgtccct

SEQ ID NO: 251061 - DNA, 25 bp, Mus musculus
aaccgtccctaaaatggatggcata

SEQ ID NO: 251062 - DNA, 25 bp, Mus musculus
gggcctggcagttgtgaactcgaac

SEQ ID NO: 251063 - DNA, 25 bp, Mus musculus
gcctagccgagactgaccctccgca

SEQ ID NO: 251064 - DNA, 25 bp, Mus musculus
tccgcagctcctgtagtcacgtgga

SEQ ID NO: 251065 - DNA, 25 bp, Mus musculus
ctgtagtcacgtggagctgggaacc

SEQ ID NO: 251066 - DNA, 25 bp, Mus musculus
ctggcagttgtgaactcgaacctgc

SEQ ID NO: 251067 - DNA, 25 bp, Mus musculus
cagctccacctgtggggcgcgtgac

SEQ ID NO: 251068 - DNA, 25 bp, Mus musculus
ggcgagcgcacctgcgcacaggctc

SEQ ID NO: 251069 - DNA, 25 bp, Mus musculus
tgcgtgggacccgagatggcccact

SEQ ID NO: 251070 - DNA, 25 bp, Mus musculus
agatggcccactggctggtccgaac

SEQ ID NO: 251071 - DNA, 25 bp, Mus musculus
actggctggtccgaaccggtccagc

SEQ ID NO: 251072 - DNA, 25 bp, Mus musculus
accggtccagcgagccagcaaatgt

SEQ ID NO: 251073 - DNA, 25 bp, Mus musculus
ccagcaaatgtggacggaggacacg

SEQ ID NO: 251074 - DNA, 25 bp, Mus musculus
tccctggccttgtgccggagcggca

SEQ ID NO: 251075 - DNA, 25 bp, Mus musculus
tgctctatggatgggcgctgcgtcc

SEQ ID NO: 251076 - DNA, 25 bp, Mus musculus
gtttccgccacaagcccaatctgat

SEQ ID NO: 251077 - DNA, 25 bp, Mus musculus
aagccctacccatgcaccgagtgtg

SEQ ID NO: 251078 - DNA, 25 bp, Mus musculus
tccacaagcgcttggaggtctcagc

SEQ ID NO: 251079 - DNA, 25 bp, Mus musculus
ccgagagtcaccagattgcagcaga

SEQ ID NO: 251080 - DNA, 25 bp, Mus musculus
gagcctatggcacaacctgcacttg

SEQ ID NO: 251081 - DNA, 25 bp, Mus musculus
gcttcctgcggctacaccagaggca

SEQ ID NO: 251082 - DNA, 25 bp, Mus musculus
cttcggcaagaagacgcacctggtg

SEQ ID NO: 251083 - DNA, 25 bp, Mus musculus
gtcgccgtttctcacagggcagcca

SEQ ID NO: 251084 - DNA, 25 bp, Mus musculus
agaccatgcaccagagaggcccttc

SEQ ID NO: 251085 - DNA, 25 bp, Mus musculus
agaaaccctatgtgtgtcccgactg

SEQ ID NO: 251086 - DNA, 25 bp, Mus musculus
gtggcaaagctttcagtcagaagtc

SEQ ID NO: 251087 - DNA, 25 bp, Mus musculus
gtcagaagtccaacctggtgtccca

SEQ ID NO: 251088 - DNA, 25 bp, Mus musculus
tgcgggaagcgtttcaccaacaagc

SEQ ID NO: 251089 - DNA, 25 bp, Mus musculus
agcgaccacaccagtgcccagagtg

SEQ ID NO: 251090 - DNA, 25 bp, Mus musculus
tacgccgcgagttcagatatcaata

SEQ ID NO: 251091 - DNA, 25 bp, Mus musculus
tgcagggcgaccagccaatcacacg

SEQ ID NO: 251092 - DNA, 25 bp, Mus musculus
agccgttcagccaatccgcagcggg

SEQ ID NO: 251093 - DNA, 25 bp, Mus musculus
ccgggagtgtcatctgagccgttca

SEQ ID NO: 251094 - DNA, 25 bp, Mus musculus
accctggctattggctccggagaac

SEQ ID NO: 251095 - DNA, 25 bp, Mus musculus
ctgattttttgcttagggccgcgcg

SEQ ID NO: 251096 - DNA, 25 bp, Mus musculus
cccagcagtgttcagctcactgatt

SEQ ID NO: 251097 - DNA, 25 bp, Mus musculus
cagcaactatgctccgcggggcaca

SEQ ID NO: 251098 - DNA, 25 bp, Mus musculus
gcacctggtggacgggcacagcaac

SEQ ID NO: 251099 - DNA, 25 bp, Mus musculus
tcaatacgcgcttgtgcgggaggca

SEQ ID NO: 251100 - DNA, 25 bp, Mus musculus
ctgctccggtgtaccgggctgtaga

SEQ ID NO: 251101 - DNA, 25 bp, Mus musculus
tccgagtcctgtgcaattctggcgg

SEQ ID NO: 251102 - DNA, 25 bp, Mus musculus
tcaaaggtatttatttctcaggccc

SEQ ID NO: 251103 - DNA, 25 bp, Mus musculus
agagcgctcaaaggtgggcagatcc

SEQ ID NO: 251104 - DNA, 25 bp, Mus musculus
cgtgtgcacacagctgcggagctgc

SEQ ID NO: 251105 - DNA, 25 bp, Mus musculus
tgcacgaggcgcttcagtcagaaac

SEQ ID NO: 251106 - DNA, 25 bp, Mus musculus
ttaagcaccagaagacacactctcg

SEQ ID NO: 251107 - DNA, 25 bp, Mus musculus
ctgccactcacacatgtccagaatg

SEQ ID NO: 251108 - DNA, 25 bp, Mus musculus
tgtccagaatgtgagcgctgctttc

SEQ ID NO: 251109 - DNA, 25 bp, Mus musculus
ctgctttcggcatcaagtgggcctc

SEQ ID NO: 251110 - DNA, 25 bp, Mus musculus
ggcacatgcccgaaaccgcctgggt

SEQ ID NO: 251111 - DNA, 25 bp, Mus musculus
tgggtgcccgagtcaacttacacga

SEQ ID NO: 251112 - DNA, 25 bp, Mus musculus
agatgttccggtatgctgctgcacg

SEQ ID NO: 251113 - DNA, 25 bp, Mus musculus
catggtgtccggacaacagcccaca

SEQ ID NO: 251114 - DNA, 25 bp, Mus musculus
acagccgcttaggtcccagtgaaca

SEQ ID NO: 251115 - DNA, 25 bp, Mus musculus
acgtggtggtcatcgctcaacatcc

SEQ ID NO: 251116 - DNA, 25 bp, Mus musculus
cttgctcgcactgtggacgcagctt

SEQ ID NO: 251117 - DNA, 25 bp, Mus musculus
agcttccgccagaagcagcatctgc

SEQ ID NO: 251118 - DNA, 25 bp, Mus musculus
gaggttaccgtatttatcgaggcta

SEQ ID NO: 251119 - DNA, 25 bp, Mus musculus
gttggcgcgttagacctcccagcct

SEQ ID NO: 251120 - DNA, 25 bp, Mus musculus
agtcccaggctagagcccaagatca

SEQ ID NO: 251121 - DNA, 25 bp, Mus musculus
cccaagatcaggagggaggttaccg

SEQ ID NO: 251122 - DNA, 25 bp, Mus musculus
accgtatttatcgaggctagtgggg

SEQ ID NO: 251123 - DNA, 25 bp, Mus musculus
tcaccgcgggcgtgctaccgtattt

SEQ ID NO: 251124 - DNA, 25 bp, Mus musculus
gggcgtgctaccgtatttgcctgga

SEQ ID NO: 251125 - DNA, 25 bp, Mus musculus
tatttgcctggagccgtggaagtcc

SEQ ID NO: 251126 - DNA, 25 bp, Mus musculus
agccgtggaagtcctttctgggagt

SEQ ID NO: 251127 - DNA, 25 bp, Mus musculus
tggcagtgccgggacttaattactt

SEQ ID NO: 251128 - DNA, 25 bp, Mus musculus
cagtgccgggacttaattacttgtt

SEQ ID NO: 251129 - DNA, 25 bp, Mus musculus
tgtttacttaggatcccgcggtctc

SEQ ID NO: 251130 - DNA, 25 bp, Mus musculus
ccagccaggttgttggcgcgttaga

SEQ ID NO: 251131 - DNA, 25 bp, Mus musculus
gggacccttgatgccgggtcaccgc

SEQ ID NO: 251132 - DNA, 25 bp, Mus musculus
cgcctttggcagagcgtttctgtcc

SEQ ID NO: 251133 - DNA, 25 bp, Mus musculus
ggggcggagctacgcccaccttctg

SEQ ID NO: 251134 - DNA, 25 bp, Mus musculus
atgtctcgagagtccgggctttata

SEQ ID NO: 251135 - DNA, 25 bp, Mus musculus
ccgggctttatataggcgaatcttg

SEQ ID NO: 251136 - DNA, 25 bp, Mus musculus
atcttgctgctacatcgggctctgc

SEQ ID NO: 251137 - DNA, 25 bp, Mus musculus
acctcaaagccctgggtgaccagta

SEQ ID NO: 251138 - DNA, 25 bp, Mus musculus
gaccagtacgtgaaggacgaattta

SEQ ID NO: 251139 - DNA, 25 bp, Mus musculus
gacgaatttaggagacataagactg

SEQ ID NO: 251140 - DNA, 25 bp, Mus musculus
ataagactgttggtcctggcgaggc

SEQ ID NO: 251141 - DNA, 25 bp, Mus musculus
cgaggcccagcgattcttgaaggaa

SEQ ID NO: 251142 - DNA, 25 bp, Mus musculus
ccaaaccggatgaaggtcgcgcgct

SEQ ID NO: 251143 - DNA, 25 bp, Mus musculus
ttctatgacggaccaaaccggatga

SEQ ID NO: 251144 - DNA, 25 bp, Mus musculus
tggggttcacccataggcgacttcc

SEQ ID NO: 251145 - DNA, 25 bp, Mus musculus
gtttccggaaggacaagattctatg

SEQ ID NO: 251146 - DNA, 25 bp, Mus musculus
aacacaacctggaggtgcaccagcg

SEQ ID NO: 251147 - DNA, 25 bp, Mus musculus
cgcgtgagggttcgctcaagaccca

SEQ ID NO: 251148 - DNA, 25 bp, Mus musculus
ggggagcggcgaccctacttctgcc

SEQ ID NO: 251149 - DNA, 25 bp, Mus musculus
agtgcggtcgctgcttccgcgagcc

SEQ ID NO: 251150 - DNA, 25 bp, Mus musculus
caccagtgcgcgcagtgcggtcgct

SEQ ID NO: 251151 - DNA, 25 bp, Mus musculus
tgcttcagcctcaagcagaatctgc

SEQ ID NO: 251152 - DNA, 25 bp, Mus musculus
cccgagagccaagcggcccatttga

SEQ ID NO: 251153 - DNA, 25 bp, Mus musculus
ttcagcgtcaaacacaacctggagg

SEQ ID NO: 251154 - DNA, 25 bp, Mus musculus
ggcaaggccttcagcgtcaaacaca

SEQ ID NO: 251155 - DNA, 25 bp, Mus musculus
gcagccgccttcgtgtgtcccgagt

SEQ ID NO: 251156 - DNA, 25 bp, Mus musculus
gtgcgggcagaccttctcccagcag

SEQ ID NO: 251157 - DNA, 25 bp, Mus musculus
gctgcccactgtgcgggcagacctt

SEQ ID NO: 251158 - DNA, 25 bp, Mus musculus
agcagaatctgctcacgcaccagcg

SEQ ID NO: 251159 - DNA, 25 bp, Mus musculus
ttctgccctcgctgcggcaagagct

SEQ ID NO: 251160 - DNA, 25 bp, Mus musculus
acaaccgcgcgctgcgggacctggt

SEQ ID NO: 251161 - DNA, 25 bp, Mus musculus
tggctggagactccctgcaggatta

SEQ ID NO: 251162 - DNA, 25 bp, Mus musculus
atatcttcagctccgagatcccgcg

SEQ ID NO: 251163 - DNA, 25 bp, Mus musculus
atgtgcactgcacggacaaccgcgc

SEQ ID NO: 251164 - DNA, 25 bp, Mus musculus
ttcacgcgccaagaggacctggctg

SEQ ID NO: 251165 - DNA, 25 bp, Mus musculus
ggggccgcgtgtgcgccctcaacaa

SEQ ID NO: 251166 - DNA, 25 bp, Mus musculus
gcgcgcactactccaatgaggtgta

SEQ ID NO: 251167 - DNA, 25 bp, Mus musculus
gcactgtcgtggtgttcacgcgcca

SEQ ID NO: 251168 - DNA, 25 bp, Mus musculus
tcaccatgcaggacagccaggcgct

SEQ ID NO: 251169 - DNA, 25 bp, Mus musculus
ctgggtcgcttcaccatgcaggaca

SEQ ID NO: 251170 - DNA, 25 bp, Mus musculus
agcccgctgctttgtgctgtcggcc

SEQ ID NO: 251171 - DNA, 25 bp, Mus musculus
gtgcgtggagacagcccgctgcttt

SEQ ID NO: 251172 - DNA, 25 bp, Mus musculus
agatcccgcggaccgaccctgggtg

SEQ ID NO: 251173 - DNA, 25 bp, Mus musculus
actccctgcaggattatgtgcactg

SEQ ID NO: 251174 - DNA, 25 bp, Mus musculus
ctaaggtagcgtgttgtcgtcaaaa

SEQ ID NO: 251175 - DNA, 25 bp, Mus musculus
ttcgtgacgtagaatcccggagccg

SEQ ID NO: 251176 - DNA, 25 bp, Mus musculus
ccgcaatggcttcggttccctggct

SEQ ID NO: 251177 - DNA, 25 bp, Mus musculus
ctggcagagcgatggcttcccgcga

SEQ ID NO: 251178 - DNA, 25 bp, Mus musculus
ctttgctttgcgtacccgagagtcc

SEQ ID NO: 251179 - DNA, 25 bp, Mus musculus
ccgcgcggcgtttatggccgctgct

SEQ ID NO: 251180 - DNA, 25 bp, Mus musculus
tgttgtcgtcaaaattccagtcata

SEQ ID NO: 251181 - DNA, 25 bp, Mus musculus
agacccgcccacttcgtgacgtaga

SEQ ID NO: 251182 - DNA, 25 bp, Mus musculus
cccgagagtcctagagggaggctaa

SEQ ID NO: 251183 - DNA, 25 bp, Mus musculus
tccagtcatagagcgggcaacatcc

SEQ ID NO: 251184 - DNA, 25 bp, Mus musculus
aggacacctggtggcccggcctgac

SEQ ID NO: 251185 - DNA, 25 bp, Mus musculus
gccctgggctttcctgtgcgcttcg

SEQ ID NO: 251186 - DNA, 25 bp, Mus musculus
agaaatagccattcgcgcagacgca

SEQ ID NO: 251187 - DNA, 25 bp, Mus musculus
ggtggtcggcaccaactttgctttg

SEQ ID NO: 251188 - DNA, 25 bp, Mus musculus
gcgtagcccgtcttcaccaggaagg

SEQ ID NO: 251189 - DNA, 25 bp, Mus musculus
ttgaagacactttccaggtccgcgg

SEQ ID NO: 251190 - DNA, 25 bp, Mus musculus
gctgaggttcccgatgtacaatttg

SEQ ID NO: 251191 - DNA, 25 bp, Mus musculus
gccaccgggatcttagcgtccttga

SEQ ID NO: 251192 - DNA, 25 bp, Mus musculus
cctgaaagcgcctcgatggccttga

SEQ ID NO: 251193 - DNA, 25 bp, Mus musculus
tcttggctttcaaacccacacagtg

SEQ ID NO: 251194 - DNA, 25 bp, Mus musculus
agcggcgggcgaaaaccagatccca

SEQ ID NO: 251195 - DNA, 25 bp, Mus musculus
cgagcccagcgtcgagtcttcctaa

SEQ ID NO: 251196 - DNA, 25 bp, Mus musculus
cgagtcttcctaactctggggagga

SEQ ID NO: 251197 - DNA, 25 bp, Mus musculus
gccagcgggctgtgaaaatatcaca

SEQ ID NO: 251198 - DNA, 25 bp, Mus musculus
cagcgcctcaattagagtgggtttc

SEQ ID NO: 251199 - DNA, 25 bp, Mus musculus
gtctcacgtgaggaatcccagcgcc

SEQ ID NO: 251200 - DNA, 25 bp, Mus musculus
gaatgagccatgtgttcaaactaca

SEQ ID NO: 251201 - DNA, 25 bp, Mus musculus
agccgctccgagtgtccggcttttt

SEQ ID NO: 251202 - DNA, 25 bp, Mus musculus
acgggacagcgcctcgctgccgtgt

SEQ ID NO: 251203 - DNA, 25 bp, Mus musculus
atctccggtctgtgcgagccactgc

SEQ ID NO: 251204 - DNA, 25 bp, Mus musculus
acgctccgcaagctgctctttacgg

SEQ ID NO: 251205 - DNA, 25 bp, Mus musculus
agcacccagatccttggagcttcgc

SEQ ID NO: 251206 - DNA, 25 bp, Mus musculus
tgtgccttgcgcaccgatcaggtga

SEQ ID NO: 251207 - DNA, 25 bp, Mus musculus
cagcgctcgctcgttctcatgtcag

SEQ ID NO: 251208 - DNA, 25 bp, Mus musculus
atccttggagcttcgcccttgctca

SEQ ID NO: 251209 - DNA, 25 bp, Mus musculus
acgcccgactacgagggctgacaga

SEQ ID NO: 251210 - DNA, 25 bp, Mus musculus
acaagctgctgacgcccgactacga

SEQ ID NO: 251211 - DNA, 25 bp, Mus musculus
tgctctttacgggacagcgcctcgc

SEQ ID NO: 251212 - DNA, 25 bp, Mus musculus
tccacaactggtgcgagtggcgacg

SEQ ID NO: 251213 - DNA, 25 bp, Mus musculus
gtgaagccgtccacaactggtgcga

SEQ ID NO: 251214 - DNA, 25 bp, Mus musculus
caccgatcaggtgaagccgtccaca

SEQ ID NO: 251215 - DNA, 25 bp, Mus musculus
ctcgctcgttctcatgtcagcgatg

SEQ ID NO: 251216 - DNA, 25 bp, Mus musculus
gggcgcgtttcactcttctcgagaa

SEQ ID NO: 251217 - DNA, 25 bp, Mus musculus
ttgtggcgcgaaaataaccctttgc

SEQ ID NO: 251218 - DNA, 25 bp, Mus musculus
agtcttagctggtctccacccattg

SEQ ID NO: 251219 - DNA, 25 bp, Mus musculus
tcgcagcgctcagccctttaactgt

SEQ ID NO: 251220 - DNA, 25 bp, Mus musculus
acagttgccgcctctggagtcttag

SEQ ID NO: 251221 - DNA, 25 bp, Mus musculus
ggcagcgagcctatcatcgacagtt

SEQ ID NO: 251222 - DNA, 25 bp, Mus musculus
ccaagcatggagactgcgtgtaaac

SEQ ID NO: 251223 - DNA, 25 bp, Mus musculus
tgccctgcaaggattcagaccctca

SEQ ID NO: 251224 - DNA, 25 bp, Mus musculus
gaccacacggctgcatccaagcatg

SEQ ID NO: 251225 - DNA, 25 bp, Mus musculus
gagaaagtcttcatgggccgctgga

SEQ ID NO: 251226 - DNA, 25 bp, Mus musculus
ggtctgctctcactccggaatctgt

SEQ ID NO: 251227 - DNA, 25 bp, Mus musculus
tgttcaaaccagaggcgagatccga

SEQ ID NO: 251228 - DNA, 25 bp, Mus musculus
tcgagaaccgctcctctgaactctg

SEQ ID NO: 251229 - DNA, 25 bp, Mus musculus
taaccctttgctcccttgttggctg

SEQ ID NO: 251230 - DNA, 25 bp, Mus musculus
ccaggcgctcccgagaactaaataa

SEQ ID NO: 251231 - DNA, 25 bp, Mus musculus
ctcgctctcgtcttaaggactctta

SEQ ID NO: 251232 - DNA, 25 bp, Mus musculus
gctgcggtcgttgactaaccacttc

SEQ ID NO: 251233 - DNA, 25 bp, Mus musculus
aaggctttcgcctttacagacgcga

SEQ ID NO: 251234 - DNA, 25 bp, Mus musculus
acgcggccgctcactgcaacagaga

SEQ ID NO: 251235 - DNA, 25 bp, Mus musculus
gagatgccaccgcaggaagcaccta

SEQ ID NO: 251236 - DNA, 25 bp, Mus musculus
gccaggtaccagtcagccgccagaa

SEQ ID NO: 251237 - DNA, 25 bp, Mus musculus
aagccatcttgggacgtgacgcgct

SEQ ID NO: 251238 - DNA, 25 bp, Mus musculus
tacatcactcatgtcggccaggcgc

SEQ ID NO: 251239 - DNA, 25 bp, Mus musculus
cgacggctacaacggccagtgcgtt

SEQ ID NO: 251240 - DNA, 25 bp, Mus musculus
ccagctcgcacgttcaggcaaaatg

SEQ ID NO: 251241 - DNA, 25 bp, Mus musculus
gtgccgccagaaacctcctggtgtc

SEQ ID NO: 251242 - DNA, 25 bp, Mus musculus
acctgtgatgacgtcgtcgcgaacc

SEQ ID NO: 251243 - DNA, 25 bp, Mus musculus
tgtactcactctgccctcgaagttg

SEQ ID NO: 251244 - DNA, 25 bp, Mus musculus
acagcacgtgctgtctctccgcaag

SEQ ID NO: 251245 - DNA, 25 bp, Mus musculus
ttgctactttgacagcctcgaccgc

SEQ ID NO: 251246 - DNA, 25 bp, Mus musculus
ccggctttgctactttgacagcctc

SEQ ID NO: 251247 - DNA, 25 bp, Mus musculus
aaccagcaggccaggtcagacggag

SEQ ID NO: 251248 - DNA, 25 bp, Mus musculus
tgaaaggaaaccagcaggccaggtc

SEQ ID NO: 251249 - DNA, 25 bp, Mus musculus
cccgcgtgattgaaaggaaaccagc

SEQ ID NO: 251250 - DNA, 25 bp, Mus musculus
gcggcccgcgtgattgaaaggaaac

SEQ ID NO: 251251 - DNA, 25 bp, Mus musculus
tggctgtacttccagtttgtgagcc

SEQ ID NO: 251252 - DNA, 25 bp, Mus musculus
cgggctgtggctgtacttccagttt

SEQ ID NO: 251253 - DNA, 25 bp, Mus musculus
taacgccctcccgtggcgggctgtg

SEQ ID NO: 251254 - DNA, 25 bp, Mus musculus
ccgcaggctgttgcggcgccgctaa

SEQ ID NO: 251255 - DNA, 25 bp, Mus musculus
tgtctctccgcaaggcgggactaca

SEQ ID NO: 251256 - DNA, 25 bp, Mus musculus
gggccaacagcacgtgctgtctctc

SEQ ID NO: 251257 - DNA, 25 bp, Mus musculus
caatgccgcgcgcagtaggccctgg

SEQ ID NO: 251258 - DNA, 25 bp, Mus musculus
tgaggccttaactctgctccgcggg

SEQ ID NO: 251259 - DNA, 25 bp, Mus musculus
tactagcgctctgggagtctgttcg

SEQ ID NO: 251260 - DNA, 25 bp, Mus musculus
ggacgaacgtactagcgctctggga

SEQ ID NO: 251261 - DNA, 25 bp, Mus musculus
cggacccagcggacgaacgtactag

SEQ ID NO: 251262 - DNA, 25 bp, Mus musculus
tccgtccgagcacggtgggacgaac

SEQ ID NO: 251263 - DNA, 25 bp, Mus musculus
actcttgtccgtccgagcacggtgg

SEQ ID NO: 251264 - DNA, 25 bp, Mus musculus
tcacggactcttgtccgtccgagca

SEQ ID NO: 251265 - DNA, 25 bp, Mus musculus
cttaactctgctccgcggggcgggc

SEQ ID NO: 251266 - DNA, 25 bp, Mus musculus
gcagtggacgagtacttggagtacc

SEQ ID NO: 251267 - DNA, 25 bp, Mus musculus
catggagcggctgacgttgcctcct

SEQ ID NO: 251268 - DNA, 25 bp, Mus musculus
tttcgcttcccgcggccatggagcg

SEQ ID NO: 251269 - DNA, 25 bp, Mus musculus
aggcaagggctcctttcgcttcccg

SEQ ID NO: 251270 - DNA, 25 bp, Mus musculus
agagctcgaggcaagggctcctttc

SEQ ID NO: 251271 - DNA, 25 bp, Mus musculus
cgggctcctgttcacggactcttgt

SEQ ID NO: 251272 - DNA, 25 bp, Mus musculus
ctgtggcgcaaagtgtaaggtcagt

SEQ ID NO: 251273 - DNA, 25 bp, Mus musculus
tgaggcctacttccggcgagctcga

SEQ ID NO: 251274 - DNA, 25 bp, Mus musculus
tttaggtctgggctgaggcctactt

SEQ ID NO: 251275 - DNA, 25 bp, Mus musculus
cacgctgctggcgttttaggtctgg

SEQ ID NO: 251276 - DNA, 25 bp, Mus musculus
ttgtccacgctgctggcgttttagg

SEQ ID NO: 251277 - DNA, 25 bp, Mus musculus
ccagggtgttcttgtccacgctgct

SEQ ID NO: 251278 - DNA, 25 bp, Mus musculus
caaagtgtaaggtcagtggtagtct

SEQ ID NO: 251279 - DNA, 25 bp, Mus musculus
tacttccggcgagctcgaaggcgcc

SEQ ID NO: 251280 - DNA, 25 bp, Mus musculus
ccagcggctctttgctgggacggct

SEQ ID NO: 251281 - DNA, 25 bp, Mus musculus
gaagctcggcggtaagcggcgccaa

SEQ ID NO: 251282 - DNA, 25 bp, Mus musculus
tccgctatagcgcagcagcacctcg

SEQ ID NO: 251283 - DNA, 25 bp, Mus musculus
cacccacgtgaccagggctgcgctc

SEQ ID NO: 251284 - DNA, 25 bp, Mus musculus
tcgaggccttgaggccggccaccca

SEQ ID NO: 251285 - DNA, 25 bp, Mus musculus
tgtaaggtcagtggtagtctttggt

SEQ ID NO: 251286 - DNA, 25 bp, Mus musculus
cgggctcccagacgccagtgaactt

SEQ ID NO: 251287 - DNA, 25 bp, Mus musculus
agcgggaaaaacctcgctcgcctgc

SEQ ID NO: 251288 - DNA, 25 bp, Mus musculus
cagagcgcgcagttatcccgcgggc

SEQ ID NO: 251289 - DNA, 25 bp, Mus musculus
cccaagtagaatattcaggtcccta

SEQ ID NO: 251290 - DNA, 25 bp, Mus musculus
cccgcacgcagagagctgacaattc

SEQ ID NO: 251291 - DNA, 25 bp, Mus musculus
gacaattcccgcgacaggcaaccta

SEQ ID NO: 251292 - DNA, 25 bp, Mus musculus
acaggcaacctaagcggtcccgctt

SEQ ID NO: 251293 - DNA, 25 bp, Mus musculus
gcttcatctccctagcgggactcga

SEQ ID NO: 251294 - DNA, 25 bp, Mus musculus
cgagggtgctcactcttgactgttc

SEQ ID NO: 251295 - DNA, 25 bp, Mus musculus
ctgccgcgacaagggcgctccataa

SEQ ID NO: 251296 - DNA, 25 bp, Mus musculus
ataaaagcctgtgggcgacccgctc

SEQ ID NO: 251297 - DNA, 25 bp, Mus musculus
accggtggatctcttctctcacaga

SEQ ID NO: 251298 - DNA, 25 bp, Mus musculus
gccacggtgagtgccaggatcaact

SEQ ID NO: 251299 - DNA, 25 bp, Mus musculus
ttctctcacagaggcacccagagca

SEQ ID NO: 251300 - DNA, 25 bp, Mus musculus
ggggcggctaattaaatattgagca

SEQ ID NO: 251301 - DNA, 25 bp, Mus musculus
ctctacatcacgcaagcgaaaggcg

SEQ ID NO: 251302 - DNA, 25 bp, Mus musculus
agagcgcccagcaagtgcgcacctg

SEQ ID NO: 251303 - DNA, 25 bp, Mus musculus
gtcacgtggctctacaggctcgtca

SEQ ID NO: 251304 - DNA, 25 bp, Mus musculus
ggctcgtcacgcctgagataaatac

SEQ ID NO: 251305 - DNA, 25 bp, Mus musculus
cgcctgagataaataccgcaaagca

SEQ ID NO: 251306 - DNA, 25 bp, Mus musculus
caggagctggggactagaccgcact

SEQ ID NO: 251307 - DNA, 25 bp, Mus musculus
ggactagaccgcactcggacctgct

SEQ ID NO: 251308 - DNA, 25 bp, Mus musculus
ctgcaccgcggccaaggagagcaaa

SEQ ID NO: 251309 - DNA, 25 bp, Mus musculus
acccgtcgtgccttcgtcggaggtg

SEQ ID NO: 251310 - DNA, 25 bp, Mus musculus
ttaccgtctcggaaactctacatca

SEQ ID NO: 251311 - DNA, 25 bp, Mus musculus
cggtctgaccgcagtgagtaccact

SEQ ID NO: 251312 - DNA, 25 bp, Mus musculus
aaggctgcctgggacccgtcgtgcc

SEQ ID NO: 251313 - DNA, 25 bp, Mus musculus
gtgagtaccactctagcctgccagc

SEQ ID NO: 251314 - DNA, 25 bp, Mus musculus
tctcccacagaacgtggaggacgcg

SEQ ID NO: 251315 - DNA, 25 bp, Mus musculus
tctcgcgtctcctttgtgctataag

SEQ ID NO: 251316 - DNA, 25 bp, Mus musculus
gtctcctttgtgctataagccgctc

SEQ ID NO: 251317 - DNA, 25 bp, Mus musculus
ctttgtgctataagccgctctcggc

SEQ ID NO: 251318 - DNA, 25 bp, Mus musculus
gctataagccgctctcggccggttc

SEQ ID NO: 251319 - DNA, 25 bp, Mus musculus
cgcgggctccaggactctcgcgtct

SEQ ID NO: 251320 - DNA, 25 bp, Mus musculus
gctcctctcccacagaacgtggagg

SEQ ID NO: 251321 - DNA, 25 bp, Mus musculus
ccacagaacgtggaggacgcgcgct

SEQ ID NO: 251322 - DNA, 25 bp, Mus musculus
ccgcagggccctctggtggtagcac

SEQ ID NO: 251323 - DNA, 25 bp, Mus musculus
cacctggcggccaggccacaaccga

SEQ ID NO: 251324 - DNA, 25 bp, Mus musculus
gggaatctccgcgcgcacgagtccg

SEQ ID NO: 251325 - DNA, 25 bp, Mus musculus
ccgcgagcccctgagtcggtagatg

SEQ ID NO: 251326 - DNA, 25 bp, Mus musculus
gcccgcgactgatgagtggagcggc

SEQ ID NO: 251327 - DNA, 25 bp, Mus musculus
ctctggtggtagcacctggcggcca

SEQ ID NO: 251328 - DNA, 25 bp, Mus musculus
cccgtctcatccctgtgcgctcctg

SEQ ID NO: 251329 - DNA, 25 bp, Mus musculus
ctcctgcgcactgtggccttcccgt

SEQ ID NO: 251330 - DNA, 25 bp, Mus musculus
ggccttcccgtctcatccctgtgcg

SEQ ID NO: 251331 - DNA, 25 bp, Mus musculus
gcactgtggccttcccgtctcatcc

SEQ ID NO: 251332 - DNA, 25 bp, Mus musculus
gcgctcctgcgcactgtggccttcc

SEQ ID NO: 251333 - DNA, 25 bp, Mus musculus
ccgtctcatccctgtgcgctcctgc

SEQ ID NO: 251334 - DNA, 25 bp, Mus musculus
cgctcctgcgcactgtggccttccc

SEQ ID NO: 251335 - DNA, 25 bp, Mus musculus
tcctgcgcactgtggccttcccgtc

SEQ ID NO: 251336 - DNA, 25 bp, Mus musculus
cgtctcatccctgtgcgctcctgcg

SEQ ID NO: 251337 - DNA, 25 bp, Mus musculus
tgtggccttcccgtctcatccctgt

SEQ ID NO: 251338 - DNA, 25 bp, Mus musculus
tgcgctcctgcgcactgtggccttc

SEQ ID NO: 251339 - DNA, 25 bp, Mus musculus
ttcccgtctcatccctgtgcgctcc

SEQ ID NO: 251340 - DNA, 25 bp, Mus musculus
tggccttcccgtctcatccctgtgc

SEQ ID NO: 251341 - DNA, 25 bp, Mus musculus
gtggccttcccgtctcatccctgtg

SEQ ID NO: 251342 - DNA, 25 bp, Mus musculus
tggcgcttacacgacagacgacctc

SEQ ID NO: 251343 - DNA, 25 bp, Mus musculus
gggtccctgcaagtctcagccgacg

SEQ ID NO: 251344 - DNA, 25 bp, Mus musculus
ttcagaccgagaaggacgcaaaccg

SEQ ID NO: 251345 - DNA, 25 bp, Mus musculus
cccagtgcgtgcttcagaccgagaa

SEQ ID NO: 251346 - DNA, 25 bp, Mus musculus
ctcacctaagtgttccgctgctggg

SEQ ID NO: 251347 - DNA, 25 bp, Mus musculus
gcaccagagtgcttcctcccagaaa

SEQ ID NO: 251348 - DNA, 25 bp, Mus musculus
cggacgccctgttgctcacctaagt

SEQ ID NO: 251349 - DNA, 25 bp, Mus musculus
ctgaaccatagagaatggctgcgtc

SEQ ID NO: 251350 - DNA, 25 bp, Mus musculus
cgggaccaccacagacacagtctga

SEQ ID NO: 251351 - DNA, 25 bp, Mus musculus
agacgacctcctagtctcagggctg

SEQ ID NO: 251352 - DNA, 25 bp, Mus musculus
gccaggctgtaactcgaggggcaca

SEQ ID NO: 251353 - DNA, 25 bp, Mus musculus
cctagaactttagggcgcgcgctgc

SEQ ID NO: 251354 - DNA, 25 bp, Mus musculus
gaccagttctcaatacttcgcctag

SEQ ID NO: 251355 - DNA, 25 bp, Mus musculus
gccgagcgctgctcgcagacagatg

SEQ ID NO: 251356 - DNA, 25 bp, Mus musculus
ctgttctgtccagacggcgctgacc

SEQ ID NO: 251357 - DNA, 25 bp, Mus musculus
tcctcgttgctttccgtgggacttc

SEQ ID NO: 251358 - DNA, 25 bp, Mus musculus
tggtgctgctcaactctgttctgtc

SEQ ID NO: 251359 - DNA, 25 bp, Mus musculus
ctccacgtaagtgggctgaagccgt

SEQ ID NO: 251360 - DNA, 25 bp, Mus musculus
gcctcttctggacgcggaaactctc

SEQ ID NO: 251361 - DNA, 25 bp, Mus musculus
agtcgctgacaccaaactcggctga

SEQ ID NO: 251362 - DNA, 25 bp, Mus musculus
ctggcacagatcaagagcaacctgg

SEQ ID NO: 251363 - DNA, 25 bp, Mus musculus
gagtccgacttgcagctggcacaga

SEQ ID NO: 251364 - DNA, 25 bp, Mus musculus
aagcttctgccctatgccgagcggc

SEQ ID NO: 251365 - DNA, 25 bp, Mus musculus
tcggtcgcctctcacgatcagcgtt

SEQ ID NO: 251366 - DNA, 25 bp, Mus musculus
ctgcagcgtcaccagaagagccgga

SEQ ID NO: 251367 - DNA, 25 bp, Mus musculus
atcagcgttctggtcctttctcttg

SEQ ID NO: 251368 - DNA, 25 bp, Mus musculus
tttctcttgacgtgccaggctctgg

SEQ ID NO: 251369 - DNA, 25 bp, Mus musculus
ccgcagaaggagatcgtgtacaaca

SEQ ID NO: 251370 - DNA, 25 bp, Mus musculus
gggctggtcaacaccacgaacgttc

SEQ ID NO: 251371 - DNA, 25 bp, Mus musculus
tctgcatggctttgtaggttaggcc

SEQ ID NO: 251372 - DNA, 25 bp, Mus musculus
gacgtcaccctctggcctgcgagat

SEQ ID NO: 251373 - DNA, 25 bp, Mus musculus
gaagacagacgtcccgcgctctagc

SEQ ID NO: 251374 - DNA, 25 bp, Mus musculus
tgtcggtgcaaccacacttgttccg

SEQ ID NO: 251375 - DNA, 25 bp, Mus musculus
gccgtgacgtaaccgcacctcattg

SEQ ID NO: 251376 - DNA, 25 bp, Mus musculus
cctcattggctccaggacaggtttg

SEQ ID NO: 251377 - DNA, 25 bp, Mus musculus
gctagcatggtaggatgtgcccaga

SEQ ID NO: 251378 - DNA, 25 bp, Mus musculus
cggcgggcgagttccttctagaact

SEQ ID NO: 251379 - DNA, 25 bp, Mus musculus
gcccttccttcagaggcctcgtttg

SEQ ID NO: 251380 - DNA, 25 bp, Mus musculus
agaggcctcgtttgcccgacactta

SEQ ID NO: 251381 - DNA, 25 bp, Mus musculus
ccgacacttacgacaggccttagga

SEQ ID NO: 251382 - DNA, 25 bp, Mus musculus
cgcgcgcatgcgagctagcatggta

SEQ ID NO: 251383 - DNA, 25 bp, Mus musculus
tccagccgtgccacagttctgcatg

SEQ ID NO: 251384 - DNA, 25 bp, Mus musculus
gactccggtccctagaagccgtgca

SEQ ID NO: 251385 - DNA, 25 bp, Mus musculus
gcgcactaggtaacacatcctgagg

SEQ ID NO: 251386 - DNA, 25 bp, Mus musculus
cggtgaccgcgcactaggtaacaca

SEQ ID NO: 251387 - DNA, 25 bp, Mus musculus
gaatttcgtggtcttccgcacctgc

SEQ ID NO: 251388 - DNA, 25 bp, Mus musculus
gcgtggaatttcgtggtcttccgca

SEQ ID NO: 251389 - DNA, 25 bp, Mus musculus
tcttgtctcgggatctggtgggtct

SEQ ID NO: 251390 - DNA, 25 bp, Mus musculus
ccctttcttgtctcgggatctggtg

SEQ ID NO: 251391 - DNA, 25 bp, Mus musculus
cgcgtctccctttcttgtctcggga

SEQ ID NO: 251392 - DNA, 25 bp, Mus musculus
gtgcagccaggggtcgcacgcacct

SEQ ID NO: 251393 - DNA, 25 bp, Mus musculus
cgctggagagaagcccgtcccttcg

SEQ ID NO: 251394 - DNA, 25 bp, Mus musculus
taacacatcctgagggtggggcgct

SEQ ID NO: 251395 - DNA, 25 bp, Mus musculus
tccctagaagccgtgcagccagggg

SEQ ID NO: 251396 - DNA, 25 bp, Mus musculus
gggtcgcacgcacctgacacatctg

SEQ ID NO: 251397 - DNA, 25 bp, Mus musculus
gagagaagcccgtcccttcggagga

SEQ ID NO: 251398 - DNA, 25 bp, Mus musculus
agtgaggcagaagccgacaccgtgc

SEQ ID NO: 251399 - DNA, 25 bp, Mus musculus
atcccgagaggacgagacgcgtcta

SEQ ID NO: 251400 - DNA, 25 bp, Mus musculus
tatgaagagctggaggccaaggatc

SEQ ID NO: 251401 - DNA, 25 bp, Mus musculus
ctctgggttaactatgcgctctatg

SEQ ID NO: 251402 - DNA, 25 bp, Mus musculus
aagcgctacatctacctctgggtta

SEQ ID NO: 251403 - DNA, 25 bp, Mus musculus
agaggcactggaagcgctacatcta

SEQ ID NO: 251404 - DNA, 25 bp, Mus musculus
ccaccggtgctggagaagaggcact

SEQ ID NO: 251405 - DNA, 25 bp, Mus musculus
aacgccgattccactacgaagaaga

SEQ ID NO: 251406 - DNA, 25 bp, Mus musculus
agccatcgccagtgtgccaccggtg

SEQ ID NO: 251407 - DNA, 25 bp, Mus musculus
gaagtgaaggctaatccgcacaatt

SEQ ID NO: 251408 - DNA, 25 bp, Mus musculus
tccgcacaattacgacgcgtggttt

SEQ ID NO: 251409 - DNA, 25 bp, Mus musculus
cttacgcttggtggaaagtgaggca

SEQ ID NO: 251410 - DNA, 25 bp, Mus musculus
gtctatgagagagccatcgccagtg

SEQ ID NO: 251411 - DNA, 25 bp, Mus musculus
acgacgcgtggtttgattacttacg

SEQ ID NO: 251412 - DNA, 25 bp, Mus musculus
tagggtgagagccggtgctcatccc

SEQ ID NO: 251413 - DNA, 25 bp, Mus musculus
gcagaaatgaaacccgctctggggc

SEQ ID NO: 251414 - DNA, 25 bp, Mus musculus
caggcccgctgcaggctgacacaaa

SEQ ID NO: 251415 - DNA, 25 bp, Mus musculus
gcccgctgcaggctgacacaaagca

SEQ ID NO: 251416 - DNA, 25 bp, Mus musculus
tgcaggctgacacaaagcaggcgcc

SEQ ID NO: 251417 - DNA, 25 bp, Mus musculus
gagagcttgattgatggaccccgga

SEQ ID NO: 251418 - DNA, 25 bp, Mus musculus
cccgcgctcctagcaaggaaaggct

SEQ ID NO: 251419 - DNA, 25 bp, Mus musculus
caaggaaaggctgatttacagcgcc

SEQ ID NO: 251420 - DNA, 25 bp, Mus musculus
aaggctgatttacagcgcccggcgg

SEQ ID NO: 251421 - DNA, 25 bp, Mus musculus
acgccggtgaggtccctgcagaaat

SEQ ID NO: 251422 - DNA, 25 bp, Mus musculus
ggtgaggtccctgcagaaatgaaac

SEQ ID NO: 251423 - DNA, 25 bp, Mus musculus
gtccctgcagaaatgaaacccgctc

SEQ ID NO: 251424 - DNA, 25 bp, Mus musculus
ctcctagcaaggaaaggctgattta

SEQ ID NO: 251425 - DNA, 25 bp, Mus musculus
cctgcagaaatgaaacccgctctgg

SEQ ID NO: 251426 - DNA, 25 bp, Mus musculus
cgggatgctgcttgctcattggcta

SEQ ID NO: 251427 - DNA, 25 bp, Mus musculus
ccagcgcccgcctctgaagaaacac

SEQ ID NO: 251428 - DNA, 25 bp, Mus musculus
aactggagaactcgcgtcgctgtgg

SEQ ID NO: 251429 - DNA, 25 bp, Mus musculus
ccaccttctttagggcgggatgctg

SEQ ID NO: 251430 - DNA, 25 bp, Mus musculus
ggcagcctcgcccaacttgctccgc

SEQ ID NO: 251431 - DNA, 25 bp, Mus musculus
tgcttgctcattggctaggttaata

SEQ ID NO: 251432 - DNA, 25 bp, Mus musculus
ctcattggctaggttaataattgtc

SEQ ID NO: 251433 - DNA, 25 bp, Mus musculus
aggttaataattgtcgcgcgtgcta

SEQ ID NO: 251434 - DNA, 25 bp, Mus musculus
attgtcgcgcgtgctattttgcata

SEQ ID NO: 251435 - DNA, 25 bp, Mus musculus
cgcgcgtgctattttgcataaaaac

SEQ ID NO: 251436 - DNA, 25 bp, Mus musculus
tgctattttgcataaaaacgggagt

SEQ ID NO: 251437 - DNA, 25 bp, Mus musculus
ttcccttcgtaactggagaactcgc

SEQ ID NO: 251438 - DNA, 25 bp, Mus musculus
ccttcgtaactggagaactcgcgtc

SEQ ID NO: 251439 - DNA, 25 bp, Mus musculus
gaagaaacacgaggcgggcacggcg

SEQ ID NO: 251440 - DNA, 25 bp, Mus musculus
cagatgggacgtcccgggaaagcca

SEQ ID NO: 251441 - DNA, 25 bp, Mus musculus
cgcacagtctgggaatccgcgtcca

SEQ ID NO: 251442 - DNA, 25 bp, Mus musculus
tctgcatgcagtccacgacacaggc

SEQ ID NO: 251443 - DNA, 25 bp, Mus musculus
caagcagctgttgcgcgcgtgcaac

SEQ ID NO: 251444 - DNA, 25 bp, Mus musculus
gcgtgcaacaggtccgcagagcgca

SEQ ID NO: 251445 - DNA, 25 bp, Mus musculus
catcttgacttttgccgacgtggaa

SEQ ID NO: 251446 - DNA, 25 bp, Mus musculus
agacgacctgcgctcttattggctg

SEQ ID NO: 251447 - DNA, 25 bp, Mus musculus
gaggtcacggctgctcttgctattc

SEQ ID NO: 251448 - DNA, 25 bp, Mus musculus
tgctcttgctattccgcgccaaggg

SEQ ID NO: 251449 - DNA, 25 bp, Mus musculus
ccgcaaaacggctcgtgtcaagtca

SEQ ID NO: 251450 - DNA, 25 bp, Mus musculus
ggaaagccaggcttttcgcggcctc

SEQ ID NO: 251451 - DNA, 25 bp, Mus musculus
tatgcaaataaacgacgaaggggcc

SEQ ID NO: 251452 - DNA, 25 bp, Mus musculus
ggggaaccgcctccttatgcaaata

SEQ ID NO: 251453 - DNA, 25 bp, Mus musculus
gtgtcaagtcagcaggttccctccg

SEQ ID NO: 251454 - DNA, 25 bp, Mus musculus
tggagcacacaaagaagccagagcc

SEQ ID NO: 251455 - DNA, 25 bp, Mus musculus
cgatcaaacgtcttaactgtgaccc

SEQ ID NO: 251456 - DNA, 25 bp, Mus musculus
gcgcagattctggagcacacaaaga

SEQ ID NO: 251457 - DNA, 25 bp, Mus musculus
taaaggcctcgcgaacaaacactgc

SEQ ID NO: 251458 - DNA, 25 bp, Mus musculus
ggcctcgcgaacaaacactgcgctg

SEQ ID NO: 251459 - DNA, 25 bp, Mus musculus
cgaacaaacactgcgctgcggaaaa

SEQ ID NO: 251460 - DNA, 25 bp, Mus musculus
cactgcgctgcggaaaacaaagcgg

SEQ ID NO: 251461 - DNA, 25 bp, Mus musculus
tgcggaaaacaaagcggagatggcc

SEQ ID NO: 251462 - DNA, 25 bp, Mus musculus
aaacaaagcggagatggccgaggcc

SEQ ID NO: 251463 - DNA, 25 bp, Mus musculus
ggccgtgcgcagattctggagcaca

SEQ ID NO: 251464 - DNA, 25 bp, Mus musculus
cgcatgcgcagctcagcgggtgcag

SEQ ID NO: 251465 - DNA, 25 bp, Mus musculus
aagccagagccatgctcgcgcgctg

SEQ ID NO: 251466 - DNA, 25 bp, Mus musculus
cgagtttcagtacgatcaaacgtct

SEQ ID NO: 251467 - DNA, 25 bp, Mus musculus
acaaagaagccagagccatgctcgc

SEQ ID NO: 251468 - DNA, 25 bp, Mus musculus
ttgtcatggaggaaccaagatggcg

SEQ ID NO: 251469 - DNA, 25 bp, Mus musculus
ccgctattaaggcaggaggctacca

SEQ ID NO: 251470 - DNA, 25 bp, Mus musculus
tattaaggcaggaggctaccaggga

SEQ ID NO: 251471 - DNA, 25 bp, Mus musculus
tggcggccgcttctcggctggctac

SEQ ID NO: 251472 - DNA, 25 bp, Mus musculus
ctccgccgcgcactgttgtcatgga

SEQ ID NO: 251473 - DNA, 25 bp, Mus musculus
cgcactgttgtcatggaggaaccaa

SEQ ID NO: 251474 - DNA, 25 bp, Mus musculus
ggcggctctggcctacaacctgggc

SEQ ID NO: 251475 - DNA, 25 bp, Mus musculus
tgggcaagcgggagatcaaccacta

SEQ ID NO: 251476 - DNA, 25 bp, Mus musculus
gcgggagatcaaccactacttcagc

SEQ ID NO: 251477 - DNA, 25 bp, Mus musculus
caaccactacttcagcgtgaggagc

SEQ ID NO: 251478 - DNA, 25 bp, Mus musculus
tacttcagcgtgaggagcgccaagg

SEQ ID NO: 251479 - DNA, 25 bp, Mus musculus
tgctgctgctcgcagcgtgccacct

SEQ ID NO: 251480 - DNA, 25 bp, Mus musculus
caggcgcagccgctattaaggcagg

SEQ ID NO: 251481 - DNA, 25 bp, Mus musculus
tacaacctgggcaagcgggagatca

SEQ ID NO: 251482 - DNA, 25 bp, Mus musculus
ccgcagtgctgacgagcgacgccag

SEQ ID NO: 251483 - DNA, 25 bp, Mus musculus
cgagcagagcgctccgcgctgagca

SEQ ID NO: 251484 - DNA, 25 bp, Mus musculus
cgcatccgaactcccgggacatgtg

SEQ ID NO: 251485 - DNA, 25 bp, Mus musculus
aacgcgtgcgggaagtttcatcatg

SEQ ID NO: 251486 - DNA, 25 bp, Mus musculus
gcttacctgagcactagcggccagg

SEQ ID NO: 251487 - DNA, 25 bp, Mus musculus
agtttcatcatgtggctgggaccca

SEQ ID NO: 251488 - DNA, 25 bp, Mus musculus
ttctgtaacgcgtgcgggaagtttc

SEQ ID NO: 251489 - DNA, 25 bp, Mus musculus
agagtcgccgggcttctgtaacgcg

SEQ ID NO: 251490 - DNA, 25 bp, Mus musculus
ccaccttagagtcgccgggcttctg

SEQ ID NO: 251491 - DNA, 25 bp, Mus musculus
gaggccgcttcccaccttagagtcg

SEQ ID NO: 251492 - DNA, 25 bp, Mus musculus
tgacaagaccggttggaggccgctt

SEQ ID NO: 251493 - DNA, 25 bp, Mus musculus
gcagaggcagcgcagtgacaagacc

SEQ ID NO: 251494 - DNA, 25 bp, Mus musculus
acctgagcactagcggccagggcca

SEQ ID NO: 251495 - DNA, 25 bp, Mus musculus
caaggcaaacgtgcatcctggggcc

SEQ ID NO: 251496 - DNA, 25 bp, Mus musculus
gagcggctcatagcagccctctggc

SEQ ID NO: 251497 - DNA, 25 bp, Mus musculus
ggcctcctgcaactcacgattctgt

SEQ ID NO: 251498 - DNA, 25 bp, Mus musculus
cgggacttaactgtgggcgttgcca

SEQ ID NO: 251499 - DNA, 25 bp, Mus musculus
cttgtacgccctggtccattgtctt

SEQ ID NO: 251500 - DNA, 25 bp, Mus musculus
ccattgtcttttcggctggtgccac

SEQ ID NO: 251501 - DNA, 25 bp, Mus musculus
tgccaagccgggtggacacaggcat

SEQ ID NO: 251502 - DNA, 25 bp, Mus musculus
gcgcaccgtgggagatgaagctccc

SEQ ID NO: 251503 - DNA, 25 bp, Mus musculus
actcacgattctgttgagcttggta

SEQ ID NO: 251504 - DNA, 25 bp, Mus musculus
tccgtgtggacctggacctcttcct

SEQ ID NO: 251505 - DNA, 25 bp, Mus musculus
ccgccgcactttgggaagagctgct

SEQ ID NO: 251506 - DNA, 25 bp, Mus musculus
aacgcaagcgagaagcacgtctacg

SEQ ID NO: 251507 - DNA, 25 bp, Mus musculus
gctacctgccaaaggccggctgctg

SEQ ID NO: 251508 - DNA, 25 bp, Mus musculus
gatgcgggagccaggtaacctaaaa

SEQ ID NO: 251509 - DNA, 25 bp, Mus musculus
ttctcggcttcggaaggctgggaac

SEQ ID NO: 251510 - DNA, 25 bp, Mus musculus
agcttccaggccaccgggcacagat

SEQ ID NO: 251511 - DNA, 25 bp, Mus musculus
atcacaccagggttgtgaggcgagc

SEQ ID NO: 251512 - DNA, 25 bp, Mus musculus
accgggaggatcacaccagggttgt

SEQ ID NO: 251513 - DNA, 25 bp, Mus musculus
agcccagaccgggaggatcacacca

SEQ ID NO: 251514 - DNA, 25 bp, Mus musculus
ccgcaagcccagaccgggaggatca

SEQ ID NO: 251515 - DNA, 25 bp, Mus musculus
ccagctggtaggtgagaggccgcaa

SEQ ID NO: 251516 - DNA, 25 bp, Mus musculus
ccgggcacagatagggtcactactg

SEQ ID NO: 251517 - DNA, 25 bp, Mus musculus
atgatgactctagcccggcagcttc

SEQ ID NO: 251518 - DNA, 25 bp, Mus musculus
cagcgatggcgatgatgactctagc

SEQ ID NO: 251519 - DNA, 25 bp, Mus musculus
gcactcccactaggctgaggcgggc

SEQ ID NO: 251520 - DNA, 25 bp, Mus musculus
gagcgcactcccactaggctgaggc

SEQ ID NO: 251521 - DNA, 25 bp, Mus musculus
ccaccgggcacagatagggtcacta

SEQ ID NO: 251522 - DNA, 25 bp, Mus musculus
cactactgcgacacggaggaggaag

SEQ ID NO: 251523 - DNA, 25 bp, Mus musculus
gatagggtcactactgcgacacgga

SEQ ID NO: 251524 - DNA, 25 bp, Mus musculus
gggactgctttacatcacttgcgca

SEQ ID NO: 251525 - DNA, 25 bp, Mus musculus
ccggccttcaagatccgggcaagga

SEQ ID NO: 251526 - DNA, 25 bp, Mus musculus
gccggtttccattgcggtgcctacg

SEQ ID NO: 251527 - DNA, 25 bp, Mus musculus
cggcctcgccatgccatttttaata

SEQ ID NO: 251528 - DNA, 25 bp, Mus musculus
ggactcagtcgcttcagcccgattt

SEQ ID NO: 251529 - DNA, 25 bp, Mus musculus
tttcccgcagccgagcgagatgaga

SEQ ID NO: 251530 - DNA, 25 bp, Mus musculus
cgagaccgccgcttttctagaacct

SEQ ID NO: 251531 - DNA, 25 bp, Mus musculus
tccttacgccaagtacgtgacactc

SEQ ID NO: 251532 - DNA, 25 bp, Mus musculus
cgcctagtgagaggtggtgcttaaa

SEQ ID NO: 251533 - DNA, 25 bp, Mus musculus
tctacacgtcccaaaggggttctca

SEQ ID NO: 251534 - DNA, 25 bp, Mus musculus
tgccaagcccgtccgcacaaatatt

SEQ ID NO: 251535 - DNA, 25 bp, Mus musculus
cttgcgcaactgtgttccgtgaatt

SEQ ID NO: 251536 - DNA, 25 bp, Mus musculus
ccctttaggtacagcgggactgctt

SEQ ID NO: 251537 - DNA, 25 bp, Mus musculus
tcgcgcagtttgaaataacgccgtc

SEQ ID NO: 251538 - DNA, 25 bp, Mus musculus
tgagtcagcaaactccgccgtgctc

SEQ ID NO: 251539 - DNA, 25 bp, Mus musculus
tgcgctcctcgggttcgctcttagg

SEQ ID NO: 251540 - DNA, 25 bp, Mus musculus
tcctcgggttcgctcttaggcgctc

SEQ ID NO: 251541 - DNA, 25 bp, Mus musculus
ggttcgctcttaggcgctcgtcgcc

SEQ ID NO: 251542 - DNA, 25 bp, Mus musculus
ccttgagtcagcaaactccgccgtg

SEQ ID NO: 251543 - DNA, 25 bp, Mus musculus
gttcagaaccgcgtgtgagtaaaca

SEQ ID NO: 251544 - DNA, 25 bp, Mus musculus
tcagaaccgcgtgtgagtaaacatg

SEQ ID NO: 251545 - DNA, 25 bp, Mus musculus
aaccgcgtgtgagtaaacatgagcc

SEQ ID NO: 251546 - DNA, 25 bp, Mus musculus
cgcgtgtgagtaaacatgagcctta

SEQ ID NO: 251547 - DNA, 25 bp, Mus musculus
tgtgagtaaacatgagccttaggga

SEQ ID NO: 251548 - DNA, 25 bp, Mus musculus
aaacatgagccttagggagggagtc

SEQ ID NO: 251549 - DNA, 25 bp, Mus musculus
ggctgcgctcctcgggttcgctctt

SEQ ID NO: 251550 - DNA, 25 bp, Mus musculus
ggagcgagcaggttctctccccgac

SEQ ID NO: 251551 - DNA, 25 bp, Mus musculus
cgccgccgcgccttgagtcagcaaa

SEQ ID NO: 251552 - DNA, 25 bp, Mus musculus
agctgctgagccaggtcacttgaag

SEQ ID NO: 251553 - DNA, 25 bp, Mus musculus
aggcacgtgggcctttgttcttcag

SEQ ID NO: 251554 - DNA, 25 bp, Mus musculus
ccgccctccgagagagtgcacatgg

SEQ ID NO: 251555 - DNA, 25 bp, Mus musculus
gtgcacatggctccatcagctccag

SEQ ID NO: 251556 - DNA, 25 bp, Mus musculus
acgctgcgctgtgcgcttattccca

SEQ ID NO: 251557 - DNA, 25 bp, Mus musculus
tgtgcgcttattcccaggagcctgg

SEQ ID NO: 251558 - DNA, 25 bp, Mus musculus
ggagcctggaaccttccagaccgga

SEQ ID NO: 251559 - DNA, 25 bp, Mus musculus
agaccggagcccaatacgctaacct

SEQ ID NO: 251560 - DNA, 25 bp, Mus musculus
ttcctctcttgcctgacccggttgg

SEQ ID NO: 251561 - DNA, 25 bp, Mus musculus
cccaggagcggaactttcgtccctg

SEQ ID NO: 251562 - DNA, 25 bp, Mus musculus
ttcgtccctgggaaagaatcgcgtg

SEQ ID NO: 251563 - DNA, 25 bp, Mus musculus
cacttgaagctgacctgcggtgcga

SEQ ID NO: 251564 - DNA, 25 bp, Mus musculus
cccagacagtgaggaccaaacaaag

SEQ ID NO: 251565 - DNA, 25 bp, Mus musculus
gaggaccaaacaaagccaccgcaca

SEQ ID NO: 251566 - DNA, 25 bp, Mus musculus
acggcggagcctgggcaacgcccta

SEQ ID NO: 251567 - DNA, 25 bp, Mus musculus
cgccagtgctcgcatctctctcttc

SEQ ID NO: 251568 - DNA, 25 bp, Mus musculus
ttcaaatcgcctgccgtgtcgcctg

SEQ ID NO: 251569 - DNA, 25 bp, Mus musculus
cctgatattcaaatcgcctgccgtg

SEQ ID NO: 251570 - DNA, 25 bp, Mus musculus
tgtggcagagcctgatattcaaatc

SEQ ID NO: 251571 - DNA, 25 bp, Mus musculus
ggtaatgaagttgtcagcggcgccc

SEQ ID NO: 251572 - DNA, 25 bp, Mus musculus
tatatgcggaggtaatgaagttgtc

SEQ ID NO: 251573 - DNA, 25 bp, Mus musculus
cccggcagtcatttttatatgcgga

SEQ ID NO: 251574 - DNA, 25 bp, Mus musculus
agacgcgcgagccatttgcattccc

SEQ ID NO: 251575 - DNA, 25 bp, Mus musculus
tcgagacgcgcgagccatttgcatt

SEQ ID NO: 251576 - DNA, 25 bp, Mus musculus
aggaggcgccttgggccgctcatta

SEQ ID NO: 251577 - DNA, 25 bp, Mus musculus
cctagacgccgtccaggctctgcca

SEQ ID NO: 251578 - DNA, 25 bp, Mus musculus
tctctctcttcccagccgctttgtc

SEQ ID NO: 251579 - DNA, 25 bp, Mus musculus
ggagcctgggcaacgccctagacgc

SEQ ID NO: 251580 - DNA, 25 bp, Mus musculus
ctgtgtcacctgaccggcccttgaa

SEQ ID NO: 251581 - DNA, 25 bp, Mus musculus
ctgccaacaaggaagtcactagctc

SEQ ID NO: 251582 - DNA, 25 bp, Mus musculus
ccttgaagctcgtccgcgccatttt

SEQ ID NO: 251583 - DNA, 25 bp, Mus musculus
tctgactgtccgaagaaagcgcctc

SEQ ID NO: 251584 - DNA, 25 bp, Mus musculus
cgcttgcgtagaccttgctttctga

SEQ ID NO: 251585 - DNA, 25 bp, Mus musculus
cttaaaacctgactgcgcttgcgta

SEQ ID NO: 251586 - DNA, 25 bp, Mus musculus
gaagtcactagctctccagccagcg

SEQ ID NO: 251587 - DNA, 25 bp, Mus musculus
cgcaatagcggtccgagtaagcacc

SEQ ID NO: 251588 - DNA, 25 bp, Mus musculus
cttggacctagactcgcaatagcgg

SEQ ID NO: 251589 - DNA, 25 bp, Mus musculus
tgggcatgataatggcttggaccta

SEQ ID NO: 251590 - DNA, 25 bp, Mus musculus
caggttcctaatttcctcagggaga

SEQ ID NO: 251591 - DNA, 25 bp, Mus musculus
gggctaagcgcttctgtccctgtcg

SEQ ID NO: 251592 - DNA, 25 bp, Mus musculus
taagcaccgagaggctacgactccg

SEQ ID NO: 251593 - DNA, 25 bp, Mus musculus
accgtccgcatagggtgagggctaa

SEQ ID NO: 251594 - DNA, 25 bp, Mus musculus
gctcgccagcctcggaatgtagagg

SEQ ID NO: 251595 - DNA, 25 bp, Mus musculus
ggacacgtgactctaccagccaatg

SEQ ID NO: 251596 - DNA, 25 bp, Mus musculus
gcgaggttgcgtcactggctcgcca

SEQ ID NO: 251597 - DNA, 25 bp, Mus musculus
ctgcaagagacctgagcccggaatc

SEQ ID NO: 251598 - DNA, 25 bp, Mus musculus
gggtgggaatccaacagacaccacg

SEQ ID NO: 251599 - DNA, 25 bp, Mus musculus
gccgaaaatctctgcgtggtcgcaa

SEQ ID NO: 251600 - DNA, 25 bp, Mus musculus
gcgggcatcttgtgggccgaaaatc

SEQ ID NO: 251601 - DNA, 25 bp, Mus musculus
agcccagaaagctgaactggcaaga

SEQ ID NO: 251602 - DNA, 25 bp, Mus musculus
cactgggaccaaagggagtcgagac

SEQ ID NO: 251603 - DNA, 25 bp, Mus musculus
cggcgctcctcagtgtaggtgacgc

SEQ ID NO: 251604 - DNA, 25 bp, Mus musculus
tcaccgtttcagtggcatttaaatc

SEQ ID NO: 251605 - DNA, 25 bp, Mus musculus
tgcggccgtgatggatcaccgtttc

SEQ ID NO: 251606 - DNA, 25 bp, Mus musculus
tgagccgcctgcgaaagtttaccgg

SEQ ID NO: 251607 - DNA, 25 bp, Mus musculus
atgaggcctcctggctctcttgtgg

SEQ ID NO: 251608 - DNA, 25 bp, Mus musculus
ttctgccagaactccacgcagagac

SEQ ID NO: 251609 - DNA, 25 bp, Mus musculus
ctttgtttctgccaggccgctctgc

SEQ ID NO: 251610 - DNA, 25 bp, Mus musculus
aggccgctctgcacttagcagcctg

SEQ ID NO: 251611 - DNA, 25 bp, Mus musculus
cggcagctgggaaccaggcagctca

SEQ ID NO: 251612 - DNA, 25 bp, Mus musculus
cgggagcctggcatttcccgagctg

SEQ ID NO: 251613 - DNA, 25 bp, Mus musculus
cccgagctgcggcagccacttgaaa

SEQ ID NO: 251614 - DNA, 25 bp, Mus musculus
agccacttgaaaccgcggcctctat

SEQ ID NO: 251615 - DNA, 25 bp, Mus musculus
gaactcgccgagcttccaaggcaga

SEQ ID NO: 251616 - DNA, 25 bp, Mus musculus
ccgagcttccaaggcagacgctgga

SEQ ID NO: 251617 - DNA, 25 bp, Mus musculus
gagacccgtgtccagccaaagaacc

SEQ ID NO: 251618 - DNA, 25 bp, Mus musculus
ccgctgacagttcgcttctgccaga

SEQ ID NO: 251619 - DNA, 25 bp, Mus musculus
aggccggccgcctttgtttctgcca

SEQ ID NO: 251620 - DNA, 25 bp, Mus musculus
acgcagagacccgtgtccagccaaa

SEQ ID NO: 251621 - DNA, 25 bp, Mus musculus
aggcctcacgccagagtcgcggtgc

SEQ ID NO: 251622 - DNA, 25 bp, Mus musculus
ctctgacaagggcttgacacccgta

SEQ ID NO: 251623 - DNA, 25 bp, Mus musculus
ttgacacccgtaagggagcacattg

SEQ ID NO: 251624 - DNA, 25 bp, Mus musculus
cgaacccattggctgcttggtaggg

SEQ ID NO: 251625 - DNA, 25 bp, Mus musculus
caccgtagatcgctgagctgtcgta

SEQ ID NO: 251626 - DNA, 25 bp, Mus musculus
tcgtgatcacactctctgacaaggg

SEQ ID NO: 251627 - DNA, 25 bp, Mus musculus
tcgcgatgtttcacgatcgtgatca

SEQ ID NO: 251628 - DNA, 25 bp, Mus musculus
gtcgctttttgcatcgcgatgtttc

SEQ ID NO: 251629 - DNA, 25 bp, Mus musculus
caggcaggtcgatggtactcaacgc

SEQ ID NO: 251630 - DNA, 25 bp, Mus musculus
cttggtaggggtagccaccgtagat

SEQ ID NO: 251631 - DNA, 25 bp, Mus musculus
gtactcaacgccatcggtgcccaga

SEQ ID NO: 251632 - DNA, 25 bp, Mus musculus
cgtatggctgctgactggcattgta

SEQ ID NO: 251633 - DNA, 25 bp, Mus musculus
actggcattgtaagcgaacccattg

SEQ ID NO: 251634 - DNA, 25 bp, Mus musculus
ccgtaagggagcacattggcacgcc

SEQ ID NO: 251635 - DNA, 25 bp, Mus musculus
ctgtcgtagtaggtcgctttttgca

SEQ ID NO: 251636 - DNA, 25 bp, Mus musculus
cgggatgccaccgaccctcagcatc

SEQ ID NO: 251637 - DNA, 25 bp, Mus musculus
tttcttatgaatactgcgccgagca

SEQ ID NO: 251638 - DNA, 25 bp, Mus musculus
ccgacttgggtatgtttcttatgaa

SEQ ID NO: 251639 - DNA, 25 bp, Mus musculus
agtggcaccgacttgggtatgtttc

SEQ ID NO: 251640 - DNA, 25 bp, Mus musculus
ctccgcggggctagtggcaccgact

SEQ ID NO: 251641 - DNA, 25 bp, Mus musculus
cccagataagcgctggcgcggccgg

SEQ ID NO: 251642 - DNA, 25 bp, Mus musculus
cggagagccggaccgctggctgctc

SEQ ID NO: 251643 - DNA, 25 bp, Mus musculus
cgcttaccttaacttctgacggccg

SEQ ID NO: 251644 - DNA, 25 bp, Mus musculus
tcagcatccgccgagccggcgtgcg

SEQ ID NO: 251645 - DNA, 25 bp, Mus musculus
cttaacttctgacggccgccgcggg

SEQ ID NO: 251646 - DNA, 25 bp, Mus musculus
cttatgaatactgcgccgagcaggg

SEQ ID NO: 251647 - DNA, 25 bp, Mus musculus
atgtttcttatgaatactgcgccga

SEQ ID NO: 251648 - DNA, 25 bp, Mus musculus
cccaaggccgggactcggcggagag

SEQ ID NO: 251649 - DNA, 25 bp, Mus musculus
tggcaccgacttgggtatgtttctt

SEQ ID NO: 251650 - DNA, 25 bp, Mus musculus
gacaggccacctcctcaggtcagtg

SEQ ID NO: 251651 - DNA, 25 bp, Mus musculus
ccgtgggagtcacgatcagattcct

SEQ ID NO: 251652 - DNA, 25 bp, Mus musculus
cgatcagattcctggtttacccgga

SEQ ID NO: 251653 - DNA, 25 bp, Mus musculus
ggaaggggctcaactcaagcgcgaa

SEQ ID NO: 251654 - DNA, 25 bp, Mus musculus
accgcccgtgcttcggcggccatct

SEQ ID NO: 251655 - DNA, 25 bp, Mus musculus
gaaacgtctgtgtggcgacaggcca

SEQ ID NO: 251656 - DNA, 25 bp, Mus musculus
ctcctcaggtcagtgagtgcggccc

SEQ ID NO: 251657 - DNA, 25 bp, Mus musculus
tggcgttccgctcgatcagtgcgat

SEQ ID NO: 251658 - DNA, 25 bp, Mus musculus
ctcgatcagtgcgatggtcacggca

SEQ ID NO: 251659 - DNA, 25 bp, Mus musculus
atcagtgcgatggtcacggcaccgg

SEQ ID NO: 251660 - DNA, 25 bp, Mus musculus
cagcggctcagccaggtgtctggac

SEQ ID NO: 251661 - DNA, 25 bp, Mus musculus
tgtctggaccgtgggagtcacgatc

SEQ ID NO: 251662 - DNA, 25 bp, Mus musculus
ttcctcagagcctcgccggcgggtg

SEQ ID NO: 251663 - DNA, 25 bp, Mus musculus
cgtacaggccggaaacgtctgtgtg

SEQ ID NO: 251664 - DNA, 25 bp, Mus musculus
gctggcccgaatgcttcgtgccaga

SEQ ID NO: 251665 - DNA, 25 bp, Mus musculus
ccttcctccattgccgcgtcctcca

SEQ ID NO: 251666 - DNA, 25 bp, Mus musculus
gcaagccgccgtctccttcctccat

SEQ ID NO: 251667 - DNA, 25 bp, Mus musculus
agaaccagcaacagtggccctccgg

SEQ ID NO: 251668 - DNA, 25 bp, Mus musculus
agaccgtacagaaccagcaacagtg

SEQ ID NO: 251669 - DNA, 25 bp, Mus musculus
tccaggagaccgtacagaaccagca

SEQ ID NO: 251670 - DNA, 25 bp, Mus musculus
ggacgcctccaggagaccgtacaga

SEQ ID NO: 251671 - DNA, 25 bp, Mus musculus
taccaggccagttgactcggaaggg

SEQ ID NO: 251672 - DNA, 25 bp, Mus musculus
aactcggtaccaggccagttgactc

SEQ ID NO: 251673 - DNA, 25 bp, Mus musculus
ccagagagaactcggtaccaggcca

SEQ ID NO: 251674 - DNA, 25 bp, Mus musculus
ggcactgaccagagagaactcggta

SEQ ID NO: 251675 - DNA, 25 bp, Mus musculus
ctgcggctcgtgagggcactgacca

SEQ ID NO: 251676 - DNA, 25 bp, Mus musculus
aatgcttcgtgccagaaagagggga

SEQ ID NO: 251677 - DNA, 25 bp, Mus musculus
gcccgaatgcttcgtgccagaaaga

SEQ ID NO: 251678 - DNA, 25 bp, Mus musculus
ctggcgtcctggcacatagattgcg

SEQ ID NO: 251679 - DNA, 25 bp, Mus musculus
caaaccctcagggtcggatgtggca

SEQ ID NO: 251680 - DNA, 25 bp, Mus musculus
agaaggcgtgggtcaataatcaacc

SEQ ID NO: 251681 - DNA, 25 bp, Mus musculus
tttctcctccaaactgctgacgcga

SEQ ID NO: 251682 - DNA, 25 bp, Mus musculus
ggccgtgagaaccagacctaggagt

SEQ ID NO: 251683 - DNA, 25 bp, Mus musculus
cgcaaaatccgctcggccgcttttt

SEQ ID NO: 251684 - DNA, 25 bp, Mus musculus
tggcacatagattgcgggtacccgc

SEQ ID NO: 251685 - DNA, 25 bp, Mus musculus
agcaaagggctagggcgtatgcaac

SEQ ID NO: 251686 - DNA, 25 bp, Mus musculus
gcgtatgcaacgcatacctttcttg

SEQ ID NO: 251687 - DNA, 25 bp, Mus musculus
tgcgccctcgactagcacctaggtg

SEQ ID NO: 251688 - DNA, 25 bp, Mus musculus
tcccagccggcaaaatagagctctg

SEQ ID NO: 251689 - DNA, 25 bp, Mus musculus
tctgatttcaataagcgggtctggc

SEQ ID NO: 251690 - DNA, 25 bp, Mus musculus
cctaggagtggactgtctgagccaa

SEQ ID NO: 251691 - DNA, 25 bp, Mus musculus
tcaagcagcccgagtgccaagacca

SEQ ID NO: 251692 - DNA, 25 bp, Mus musculus
cacagccaaagcgccggccagatgg

SEQ ID NO: 251693 - DNA, 25 bp, Mus musculus
ccacagccaaagcgccggccagatg

SEQ ID NO: 251694 - DNA, 25 bp, Mus musculus
cacacacccacagccaaagcgccgg

SEQ ID NO: 251695 - DNA, 25 bp, Mus musculus
acacacccacagccaaagcgccggc

SEQ ID NO: 251696 - DNA, 25 bp, Mus musculus
cacacccacagccaaagcgccggcc

SEQ ID NO: 251697 - DNA, 25 bp, Mus musculus
acacccacagccaaagcgccggcca

SEQ ID NO: 251698 - DNA, 25 bp, Mus musculus
cccacagccaaagcgccggccagat

SEQ ID NO: 251699 - DNA, 25 bp, Mus musculus
cacccacagccaaagcgccggccag

SEQ ID NO: 251700 - DNA, 25 bp, Mus musculus
gccagatgggggtcccctcccgcgc

SEQ ID NO: 251701 - DNA, 25 bp, Mus musculus
caaagcgccggccagatgggggtcc

SEQ ID NO: 251702 - DNA, 25 bp, Mus musculus
agccaaagcgccggccagatggggg

SEQ ID NO: 251703 - DNA, 25 bp, Mus musculus
acagccaaagcgccggccagatggg

SEQ ID NO: 251704 - DNA, 25 bp, Mus musculus
agcgccggccagatgggggtcccct

SEQ ID NO: 251705 - DNA, 25 bp, Mus musculus
cagccaaagcgccggccagatgggg

SEQ ID NO: 251706 - DNA, 25 bp, Mus musculus
gatcttcttcatccaggggtacacc

SEQ ID NO: 251707 - DNA, 25 bp, Mus musculus
gctgccccccgtcgcgacagccggg

SEQ ID NO: 251708 - DNA, 25 bp, Mus musculus
cgggccctggtccgccagcagcagc

SEQ ID NO: 251709 - DNA, 25 bp, Mus musculus
caggggtacaccaccggctccttgc

SEQ ID NO: 251710 - DNA, 25 bp, Mus musculus
ttcatccaggggtacaccaccggct

SEQ ID NO: 251711 - DNA, 25 bp, Mus musculus
atcttcttcatccaggggtacacca

SEQ ID NO: 251712 - DNA, 25 bp, Mus musculus
cacataccggcgctcacgtggatct

SEQ ID NO: 251713 - DNA, 25 bp, Mus musculus
tggatcttcttcatccaggggtaca

SEQ ID NO: 251714 - DNA, 25 bp, Mus musculus
cggcgctcacgtggatcttcttcat

SEQ ID NO: 251715 - DNA, 25 bp, Mus musculus
accggcgctcacgtggatcttcttc

SEQ ID NO: 251716 - DNA, 25 bp, Mus musculus
taccggcgctcacgtggatcttctt

SEQ ID NO: 251717 - DNA, 25 bp, Mus musculus
ataccggcgctcacgtggatcttct

SEQ ID NO: 251718 - DNA, 25 bp, Mus musculus
acataccggcgctcacgtggatctt

SEQ ID NO: 251719 - DNA, 25 bp, Mus musculus
tcttcttcatccaggggtacaccac

SEQ ID NO: 251720 - DNA, 25 bp, Mus musculus
cgggtcctttcgagccctgttcctg

SEQ ID NO: 251721 - DNA, 25 bp, Mus musculus
tccaaccaggcttcgggtggtcctc

SEQ ID NO: 251722 - DNA, 25 bp, Mus musculus
ccagtccaaccaggcttcgggtggt

SEQ ID NO: 251723 - DNA, 25 bp, Mus musculus
ctccagtccaaccaggcttcgggtg

SEQ ID NO: 251724 - DNA, 25 bp, Mus musculus
gatctccagtccaaccaggcttcgg

SEQ ID NO: 251725 - DNA, 25 bp, Mus musculus
ggtcgccacgactcagcgccgatct

SEQ ID NO: 251726 - DNA, 25 bp, Mus musculus
gcctctgggcagctggtcgccacga

SEQ ID NO: 251727 - DNA, 25 bp, Mus musculus
taggcctctgggcagctggtcgcca

SEQ ID NO: 251728 - DNA, 25 bp, Mus musculus
tgcccacgtctgtcctaggcctctg

SEQ ID NO: 251729 - DNA, 25 bp, Mus musculus
tgttcctgcccacgtctgtcctagg

SEQ ID NO: 251730 - DNA, 25 bp, Mus musculus
actgcgggtcctttcgagccctgtt

SEQ ID NO: 251731 - DNA, 25 bp, Mus musculus
ttagactgcgggtcctttcgagccc

SEQ ID NO: 251732 - DNA, 25 bp, Mus musculus
gcctgttagactgcgggtcctttcg

SEQ ID NO: 251733 - DNA, 25 bp, Mus musculus
accaggcttcgggtggtcctccgag

SEQ ID NO: 251734 - DNA, 25 bp, Mus musculus
acggctggctttaccgtgactaatg

SEQ ID NO: 251735 - DNA, 25 bp, Mus musculus
ccgaacggccgacgctgagatccat

SEQ ID NO: 251736 - DNA, 25 bp, Mus musculus
ctcgccggagccaaagtggccggaa

SEQ ID NO: 251737 - DNA, 25 bp, Mus musculus
tttttcccgccgtggtggctgtcgc

SEQ ID NO: 251738 - DNA, 25 bp, Mus musculus
ccctctctgctgctgatgtgggtgc

SEQ ID NO: 251739 - DNA, 25 bp, Mus musculus
cgtcctcctcggctgcggacgccgt

SEQ ID NO: 251740 - DNA, 25 bp, Mus musculus
atccaggggtagatctggggctgag

SEQ ID NO: 251741 - DNA, 25 bp, Mus musculus
taatgtgcagcttgcgcatccaggg

SEQ ID NO: 251742 - DNA, 25 bp, Mus musculus
tgactaatgtgcagcttgcgcatcc

SEQ ID NO: 251743 - DNA, 25 bp, Mus musculus
ctggctttaccgtgactaatgtgca

SEQ ID NO: 251744 - DNA, 25 bp, Mus musculus
cgtggatcagaaaacggctggcttt

SEQ ID NO: 251745 - DNA, 25 bp, Mus musculus
ccacggacgcgtggatcagaaaacg

SEQ ID NO: 251746 - DNA, 25 bp, Mus musculus
ccgacgctgagatccatgccattgt

SEQ ID NO: 251747 - DNA, 25 bp, Mus musculus
ttaccgtgactaatgtgcagcttgc

SEQ ID NO: 251748 - DNA, 25 bp, Mus musculus
ggatgtaccaattgtgaggccgtca

SEQ ID NO: 251749 - DNA, 25 bp, Mus musculus
ggcaaaattattgcatttccctcgc

SEQ ID NO: 251750 - DNA, 25 bp, Mus musculus
cctcgcagttccattaggatgtacc

SEQ ID NO: 251751 - DNA, 25 bp, Mus musculus
cagttccattaggatgtaccaattg

SEQ ID NO: 251752 - DNA, 25 bp, Mus musculus
taccaattgtgaggccgtcagctgc

SEQ ID NO: 251753 - DNA, 25 bp, Mus musculus
tgaggccgtcagctgccgatcgcac

SEQ ID NO: 251754 - DNA, 25 bp, Mus musculus
cacgcccggcgaggatacagaggat

SEQ ID NO: 251755 - DNA, 25 bp, Mus musculus
cgcccggcgaggatacagaggattc

SEQ ID NO: 251756 - DNA, 25 bp, Mus musculus
ggttacagcccattatggcaaaatt

SEQ ID NO: 251757 - DNA, 25 bp, Mus musculus
aattgaggttacagcccattatggc

SEQ ID NO: 251758 - DNA, 25 bp, Mus musculus
ggtcgaattgaggttacagcccatt

SEQ ID NO: 251759 - DNA, 25 bp, Mus musculus
agcccattatggcaaaattattgca

SEQ ID NO: 251760 - DNA, 25 bp, Mus musculus
tttccctcgcagttccattaggatg

SEQ ID NO: 251761 - DNA, 25 bp, Mus musculus
attaggatgtaccaattgtgaggcc

SEQ ID NO: 251762 - DNA, 25 bp, Mus musculus
gtgactcccatacacggcacctgtg

SEQ ID NO: 251763 - DNA, 25 bp, Mus musculus
atctggcgctcggtgaggcaaagcg

SEQ ID NO: 251764 - DNA, 25 bp, Mus musculus
gcaaagcgcgttagcgatctcgatg

SEQ ID NO: 251765 - DNA, 25 bp, Mus musculus
aagcgcgttagcgatctcgatgcgg

SEQ ID NO: 251766 - DNA, 25 bp, Mus musculus
aattccttctcaagctccagtgtct

SEQ ID NO: 251767 - DNA, 25 bp, Mus musculus
ctcaagctccagtgtctggtagcgc

SEQ ID NO: 251768 - DNA, 25 bp, Mus musculus
gcctctgcgcccgtgactcccatac

SEQ ID NO: 251769 - DNA, 25 bp, Mus musculus
tgactcccatacacggcacctgtgg

SEQ ID NO: 251770 - DNA, 25 bp, Mus musculus
ccatacacggcacctgtgggcagaa

SEQ ID NO: 251771 - DNA, 25 bp, Mus musculus
tacacggcacctgtgggcagaaatg

SEQ ID NO: 251772 - DNA, 25 bp, Mus musculus
cacggcacctgtgggcagaaatgag

SEQ ID NO: 251773 - DNA, 25 bp, Mus musculus
cctgtgggcagaaatgaggtgcgaa

SEQ ID NO: 251774 - DNA, 25 bp, Mus musculus
ggcagaaatgaggtgcgaataagcg

SEQ ID NO: 251775 - DNA, 25 bp, Mus musculus
aagctccagtgtctggtagcgcgtg

SEQ ID NO: 251776 - DNA, 25 bp, Mus musculus
taaataatccgcctgcggcagccgc

SEQ ID NO: 251777 - DNA, 25 bp, Mus musculus
caggctcaaagaggcgggacgctgc

SEQ ID NO: 251778 - DNA, 25 bp, Mus musculus
gcagcagcgagctccctgttcggtc

SEQ ID NO: 251779 - DNA, 25 bp, Mus musculus
cgagctccctgttcggtcgcaataa

SEQ ID NO: 251780 - DNA, 25 bp, Mus musculus
gctccctgttcggtcgcaataaata

SEQ ID NO: 251781 - DNA, 25 bp, Mus musculus
cggtcgcaataaataatccgcctgc

SEQ ID NO: 251782 - DNA, 25 bp, Mus musculus
cagcagtcgcgccaggctcaaagag

SEQ ID NO: 251783 - DNA, 25 bp, Mus musculus
cggcagccgcagtcaggcagccagc

SEQ ID NO: 251784 - DNA, 25 bp, Mus musculus
cagccagcggccctaggaggcaaat

SEQ ID NO: 251785 - DNA, 25 bp, Mus musculus
ccctaggaggcaaatgcggcgcttt

SEQ ID NO: 251786 - DNA, 25 bp, Mus musculus
taggaggcaaatgcggcgctttatc

SEQ ID NO: 251787 - DNA, 25 bp, Mus musculus
tgcccggggcgcatccacagagctg

SEQ ID NO: 251788 - DNA, 25 bp, Mus musculus
ggcgcatccacagagctgtccggcg

SEQ ID NO: 251789 - DNA, 25 bp, Mus musculus
cctgttcggtcgcaataaataatcc

SEQ ID NO: 251790 - DNA, 25 bp, Mus musculus
cctttggcgaggtcactgcagagcc

SEQ ID NO: 251791 - DNA, 25 bp, Mus musculus
gttgacattgtataagcccggcaca

SEQ ID NO: 251792 - DNA, 25 bp, Mus musculus
cgcttctctgcgagttgggtgcaaa

SEQ ID NO: 251793 - DNA, 25 bp, Mus musculus
caagaagtcggctcggcattttgga

SEQ ID NO: 251794 - DNA, 25 bp, Mus musculus
cccgccgtatatttgctaaaaagcg

SEQ ID NO: 251795 - DNA, 25 bp, Mus musculus
tcccaggccatagccggacgcgaag

SEQ ID NO: 251796 - DNA, 25 bp, Mus musculus
ggcagctttcagtgtcggttttacg

SEQ ID NO: 251797 - DNA, 25 bp, Mus musculus
cgaggtagcgtgatatatgataaca

SEQ ID NO: 251798 - DNA, 25 bp, Mus musculus
cattttcttttggacggagctcgcc

SEQ ID NO: 251799 - DNA, 25 bp, Mus musculus
gtagatgcggaaactggcttcggcc

SEQ ID NO: 251800 - DNA, 25 bp, Mus musculus
atctcagcagccctcacaggtggtc

SEQ ID NO: 251801 - DNA, 25 bp, Mus musculus
cgcctgcctcctagaatggaagggg

SEQ ID NO: 251802 - DNA, 25 bp, Mus musculus
actgagcctacctgaactgcgcatc

SEQ ID NO: 251803 - DNA, 25 bp, Mus musculus
cgctatggcgcctcagctctaatta

SEQ ID NO: 251804 - DNA, 25 bp, Mus musculus
cccttggaggctttcaggctggcat

SEQ ID NO: 251805 - DNA, 25 bp, Mus musculus
atgcgctctctgtgggttcatctgg

SEQ ID NO: 251806 - DNA, 25 bp, Mus musculus
ttcttcgatcgtgaacgacccgttc

SEQ ID NO: 251807 - DNA, 25 bp, Mus musculus
ctcgctgtccctagatctctgctgg

SEQ ID NO: 251808 - DNA, 25 bp, Mus musculus
tgccacgcaacacagcggtctcgga

SEQ ID NO: 251809 - DNA, 25 bp, Mus musculus
cctggaattttcttggcactgcagc

SEQ ID NO: 251810 - DNA, 25 bp, Mus musculus
tggagccacactgccatctcctgga

SEQ ID NO: 251811 - DNA, 25 bp, Mus musculus
agaaagcctcttgcgtggagccaca

SEQ ID NO: 251812 - DNA, 25 bp, Mus musculus
gctcgcttcaagtcgacattttagg

SEQ ID NO: 251813 - DNA, 25 bp, Mus musculus
tcccattccagaaaggctcgcttca

SEQ ID NO: 251814 - DNA, 25 bp, Mus musculus
agggaaaatatacgactgctgctca

SEQ ID NO: 251815 - DNA, 25 bp, Mus musculus
tgaccctgaaatggaactggcgttc

SEQ ID NO: 251816 - DNA, 25 bp, Mus musculus
gccgtaggtgttcattcccttgttc

SEQ ID NO: 251817 - DNA, 25 bp, Mus musculus
tggcccgcgtgaacttcggcaacgc

SEQ ID NO: 251818 - DNA, 25 bp, Mus musculus
tgtccgcccggcagaacaataacgc

SEQ ID NO: 251819 - DNA, 25 bp, Mus musculus
aaagctgacgcgctggtagatcctg

SEQ ID NO: 251820 - DNA, 25 bp, Mus musculus
ccggtttgcaggaaggagacactta

SEQ ID NO: 251821 - DNA, 25 bp, Mus musculus
cgctctcattctcggcattgttttc

SEQ ID NO: 251822 - DNA, 25 bp, Mus musculus
cattgttttcggagaaggcgccttc

SEQ ID NO: 251823 - DNA, 25 bp, Mus musculus
ccgagagcggttcaggtttaatgcc

SEQ ID NO: 251824 - DNA, 25 bp, Mus musculus
ttccagccaggagcgcatatacctg

SEQ ID NO: 251825 - DNA, 25 bp, Mus musculus
cactgggttccacgaggcaccaaac

SEQ ID NO: 251826 - DNA, 25 bp, Mus musculus
aaacaccgccgccttggactggaag

SEQ ID NO: 251827 - DNA, 25 bp, Mus musculus
tccacatagtagttgcccagggccc

SEQ ID NO: 251828 - DNA, 25 bp, Mus musculus
ccgacccgccgaaattatgaaactg

SEQ ID NO: 251829 - DNA, 25 bp, Mus musculus
tcacctaataagttgccggcgcccg

SEQ ID NO: 251830 - DNA, 25 bp, Mus musculus
tttcatgtaacaacttggtggcacc

SEQ ID NO: 251831 - DNA, 25 bp, Mus musculus
aatcactccgcacgctattaatggc

SEQ ID NO: 251832 - DNA, 25 bp, Mus musculus
agtccagccgctagggactctcggg

SEQ ID NO: 251833 - DNA, 25 bp, Mus musculus
tcagtccagccgctagggactctcg

SEQ ID NO: 251834 - DNA, 25 bp, Mus musculus
gctcagtccagccgctagggactct

SEQ ID NO: 251835 - DNA, 25 bp, Mus musculus
agccgctagggactctcgggatttg

SEQ ID NO: 251836 - DNA, 25 bp, Mus musculus
gccgctagggactctcgggatttgg

SEQ ID NO: 251837 - DNA, 25 bp, Mus musculus
gactctcgggatttgggggtgagtg

SEQ ID NO: 251838 - DNA, 25 bp, Mus musculus
cgctagggactctcgggatttgggg

SEQ ID NO: 251839 - DNA, 25 bp, Mus musculus
ccgctagggactctcgggatttggg

SEQ ID NO: 251840 - DNA, 25 bp, Mus musculus
gtccagccgctagggactctcggga

SEQ ID NO: 251841 - DNA, 25 bp, Mus musculus
tccagccgctagggactctcgggat

SEQ ID NO: 251842 - DNA, 25 bp, Mus musculus
ccagccgctagggactctcgggatt

SEQ ID NO: 251843 - DNA, 25 bp, Mus musculus
cagccgctagggactctcgggattt

SEQ ID NO: 251844 - DNA, 25 bp, Mus musculus
actctcgggatttgggggtgagtgg

SEQ ID NO: 251845 - DNA, 25 bp, Mus musculus
cagtccagccgctagggactctcgg

SEQ ID NO: 251846 - DNA, 25 bp, Mus musculus
cgcctccgccttacaagggcttggg

SEQ ID NO: 251847 - DNA, 25 bp, Mus musculus
gttggactcaaacgcagaggcccgg

SEQ ID NO: 251848 - DNA, 25 bp, Mus musculus
gcatcctagcggttggactcaaacg

SEQ ID NO: 251849 - DNA, 25 bp, Mus musculus
tgctgctgtagcatcctagcggttg

SEQ ID NO: 251850 - DNA, 25 bp, Mus musculus
tgcattgcgttgctgctgtagcatc

SEQ ID NO: 251851 - DNA, 25 bp, Mus musculus
gtcgcgttgcattgcgttgctgctg

SEQ ID NO: 251852 - DNA, 25 bp, Mus musculus
aagcccgcgcttgggtcgcgttgca

SEQ ID NO: 251853 - DNA, 25 bp, Mus musculus
caacatccggggttgttgagtcggt

SEQ ID NO: 251854 - DNA, 25 bp, Mus musculus
aggcagcacatcaacatccggggtt

SEQ ID NO: 251855 - DNA, 25 bp, Mus musculus
cttacaagggcttggggccaccgct

SEQ ID NO: 251856 - DNA, 25 bp, Mus musculus
gtctccttgcagacggctgggcaaa

SEQ ID NO: 251857 - DNA, 25 bp, Mus musculus
gccacgtctccttgcagacggctgg

SEQ ID NO: 251858 - DNA, 25 bp, Mus musculus
agacggctgggcaaagccgcctccg

SEQ ID NO: 251859 - DNA, 25 bp, Mus musculus
tccggggcaggcagcacatcaacat

SEQ ID NO: 251860 - DNA, 25 bp, Mus musculus
tggtaacatgctggcgttgacgcgc

SEQ ID NO: 251861 - DNA, 25 bp, Mus musculus
gggcactgacagttgccagcttttg

SEQ ID NO: 251862 - DNA, 25 bp, Mus musculus
cggcggagtctcaggtagctttctt

SEQ ID NO: 251863 - DNA, 25 bp, Mus musculus
cccggaagtaagctgaaggaccgtg

SEQ ID NO: 251864 - DNA, 25 bp, Mus musculus
gagcggccgaacgtcgacttgaccc

SEQ ID NO: 251865 - DNA, 25 bp, Mus musculus
tccggaagtactggtagactgccta

SEQ ID NO: 251866 - DNA, 25 bp, Mus musculus
caccaatcaaatccacgggagcatc

SEQ ID NO: 251867 - DNA, 25 bp, Mus musculus
caccaatcagaggagacgtacgctc

SEQ ID NO: 251868 - DNA, 25 bp, Mus musculus
ccgggcagatttcccgaacaccaat

SEQ ID NO: 251869 - DNA, 25 bp, Mus musculus
cagaaaatgattgacgcccagcggg

SEQ ID NO: 251870 - DNA, 25 bp, Mus musculus
ctcgcaacccgcaggaaagcagaaa

SEQ ID NO: 251871 - DNA, 25 bp, Mus musculus
cgctttggggagctgcattatgtcc

SEQ ID NO: 251872 - DNA, 25 bp, Mus musculus
ggccggtcgatatactgtggtaaca

SEQ ID NO: 251873 - DNA, 25 bp, Mus musculus
atgtcctccatgattctgccgccaa

SEQ ID NO: 251874 - DNA, 25 bp, Mus musculus
caatttccgaaccaatggatctggc

SEQ ID NO: 251875 - DNA, 25 bp, Mus musculus
ctaggcaggaattcagccctgattc

SEQ ID NO: 251876 - DNA, 25 bp, Mus musculus
tgccctcgatgtgggcacacaaaga

SEQ ID NO: 251877 - DNA, 25 bp, Mus musculus
tcgggcagccgctaacgcaaggccg

SEQ ID NO: 251878 - DNA, 25 bp, Mus musculus
caaagtgtttcctgccctcgatgtg

SEQ ID NO: 251879 - DNA, 25 bp, Mus musculus
cgccgccatccggtcgtgatcgtaa

SEQ ID NO: 251880 - DNA, 25 bp, Mus musculus
tgatcgtaaccgaggccttgtctgc

SEQ ID NO: 251881 - DNA, 25 bp, Mus musculus
attcagccctgattccaatttccga

SEQ ID NO: 251882 - DNA, 25 bp, Mus musculus
taggacccgtaaagctggcagagtc

SEQ ID NO: 251883 - DNA, 25 bp, Mus musculus
ctggcagagtcggtcagaagcttcc

SEQ ID NO: 251884 - DNA, 25 bp, Mus musculus
gcttcccgctgaagcgttctcagta

SEQ ID NO: 251885 - DNA, 25 bp, Mus musculus
agcgttctcagtagtcgggcgacac

SEQ ID NO: 251886 - DNA, 25 bp, Mus musculus
cgggcgacacagaacctaggcagga

SEQ ID NO: 251887 - DNA, 25 bp, Mus musculus
accaatggatctggcaaagtgtttc

SEQ ID NO: 251888 - DNA, 25 bp, Mus musculus
ggcgtccaagaatcagccgctaacc

SEQ ID NO: 251889 - DNA, 25 bp, Mus musculus
atggggatctgaggttgccaccgca

SEQ ID NO: 251890 - DNA, 25 bp, Mus musculus
cacatggggatctgaggttgccacc

SEQ ID NO: 251891 - DNA, 25 bp, Mus musculus
ctgcacatggggatctgaggttgcc

SEQ ID NO: 251892 - DNA, 25 bp, Mus musculus
tcctcctgcacatggggatctgagg

SEQ ID NO: 251893 - DNA, 25 bp, Mus musculus
ccggcgtccaagaatcagccgctaa

SEQ ID NO: 251894 - DNA, 25 bp, Mus musculus
gctcctcctgcacatggggatctga

SEQ ID NO: 251895 - DNA, 25 bp, Mus musculus
cgaagctcctcctgcacatggggat

SEQ ID NO: 251896 - DNA, 25 bp, Mus musculus
gctaacctgactgtacctgctccgg

SEQ ID NO: 251897 - DNA, 25 bp, Mus musculus
agccgctaacctgactgtacctgct

SEQ ID NO: 251898 - DNA, 25 bp, Mus musculus
tcagccgctaacctgactgtacctg

SEQ ID NO: 251899 - DNA, 25 bp, Mus musculus
ggatctgaggttgccaccgcaggcc

SEQ ID NO: 251900 - DNA, 25 bp, Mus musculus
agaatcagccgctaacctgactgta

SEQ ID NO: 251901 - DNA, 25 bp, Mus musculus
cgtccaagaatcagccgctaacctg

SEQ ID NO: 251902 - DNA, 25 bp, Mus musculus
tgctgtcgagagaaaggtggatccc

SEQ ID NO: 251903 - DNA, 25 bp, Mus musculus
cgattaggccttgatggcccgccta

SEQ ID NO: 251904 - DNA, 25 bp, Mus musculus
agccatcccgggctgctctggacag

SEQ ID NO: 251905 - DNA, 25 bp, Mus musculus
ctggacaggtacctggagatgcttt

SEQ ID NO: 251906 - DNA, 25 bp, Mus musculus
tgcgattgtgcccagtcgagccctc

SEQ ID NO: 251907 - DNA, 25 bp, Mus musculus
ctggagatgctttcaactgaagtaa

SEQ ID NO: 251908 - DNA, 25 bp, Mus musculus
ggaaagagccctgcgattgtgccca

SEQ ID NO: 251909 - DNA, 25 bp, Mus musculus
aatgaaggcagtgtcgtgctgtcga

SEQ ID NO: 251910 - DNA, 25 bp, Mus musculus
caccgcaggcctggcacgattaggc

SEQ ID NO: 251911 - DNA, 25 bp, Mus musculus
ggtggatcccaacaacaggaaacta

SEQ ID NO: 251912 - DNA, 25 bp, Mus musculus
ctacctaaatcaccgaccagttctg

SEQ ID NO: 251913 - DNA, 25 bp, Mus musculus
accagttctgatgctgcgggcgtag

SEQ ID NO: 251914 - DNA, 25 bp, Mus musculus
cactgtcgccgccaaggaaagagcc

SEQ ID NO: 251915 - DNA, 25 bp, Mus musculus
caactgaagtaatgaaggcagtgtc

SEQ ID NO: 251916 - DNA, 25 bp, Mus musculus
tccacttaaccgctgttgcaggcac

SEQ ID NO: 251917 - DNA, 25 bp, Mus musculus
gcccaggtccacttaaccgctgttg

SEQ ID NO: 251918 - DNA, 25 bp, Mus musculus
aggtccacttaaccgctgttgcagg

SEQ ID NO: 251919 - DNA, 25 bp, Mus musculus
cacttaaccgctgttgcaggcacta

SEQ ID NO: 251920 - DNA, 25 bp, Mus musculus
ttaaccgctgttgcaggcactagtg

SEQ ID NO: 251921 - DNA, 25 bp, Mus musculus
taaccgctgttgcaggcactagtgg

SEQ ID NO: 251922 - DNA, 25 bp, Mus musculus
accgctgttgcaggcactagtggtg

SEQ ID NO: 251923 - DNA, 25 bp, Mus musculus
ttgcaggcactagtggtgctccgtg

SEQ ID NO: 251924 - DNA, 25 bp, Mus musculus
caggcactagtggtgctccgtgagt

SEQ ID NO: 251925 - DNA, 25 bp, Mus musculus
tggtgctccgtgagtgggccctcct

SEQ ID NO: 251926 - DNA, 25 bp, Mus musculus
tgagtgggccctcctccgcggattt

SEQ ID NO: 251927 - DNA, 25 bp, Mus musculus
agtgggccctcctccgcggatttcg

SEQ ID NO: 251928 - DNA, 25 bp, Mus musculus
ctgttgcaggcactagtggtgctcc

SEQ ID NO: 251929 - DNA, 25 bp, Mus musculus
ccaggtccacttaaccgctgttgca

SEQ ID NO: 251930 - DNA, 25 bp, Mus musculus
aacgcatgggggatcgtaaactcga

SEQ ID NO: 251931 - DNA, 25 bp, Mus musculus
acgcatgggggatcgtaaactcgaa

SEQ ID NO: 251932 - DNA, 25 bp, Mus musculus
caggactcccgcccctccagaaact

SEQ ID NO: 251933 - DNA, 25 bp, Mus musculus
ctttgaaaaacgcatgggggatcgt

SEQ ID NO: 251934 - DNA, 25 bp, Mus musculus
tttgaaaaacgcatgggggatcgta

SEQ ID NO: 251935 - DNA, 25 bp, Mus musculus
ttgaaaaacgcatgggggatcgtaa

SEQ ID NO: 251936 - DNA, 25 bp, Mus musculus
cgcatgggggatcgtaaactcgaac

SEQ ID NO: 251937 - DNA, 25 bp, Mus musculus
aaacgcatgggggatcgtaaactcg

SEQ ID NO: 251938 - DNA, 25 bp, Mus musculus
gcatgggggatcgtaaactcgaact

SEQ ID NO: 251939 - DNA, 25 bp, Mus musculus
catgggggatcgtaaactcgaactt

SEQ ID NO: 251940 - DNA, 25 bp, Mus musculus
ctcgaacttcgccggttaatgggct

SEQ ID NO: 251941 - DNA, 25 bp, Mus musculus
atgggcttatttattggctctggcg

SEQ ID NO: 251942 - DNA, 25 bp, Mus musculus
tgggcttatttattggctctggcgg

SEQ ID NO: 251943 - DNA, 25 bp, Mus musculus
tgaaaaacgcatgggggatcgtaaa

SEQ ID NO: 251944 - DNA, 25 bp, Mus musculus
aagcgagccacttttcctccctgcc

SEQ ID NO: 251945 - DNA, 25 bp, Mus musculus
tccgtgctatctgcaagcgagccac

SEQ ID NO: 251946 - DNA, 25 bp, Mus musculus
atctgcaagcgagccacttttcctc

SEQ ID NO: 251947 - DNA, 25 bp, Mus musculus
ctatctgcaagcgagccacttttcc

SEQ ID NO: 251948 - DNA, 25 bp, Mus musculus
cgtgctatctgcaagcgagccactt

SEQ ID NO: 251949 - DNA, 25 bp, Mus musculus
atgccttacaaacatccgtgctatc

SEQ ID NO: 251950 - DNA, 25 bp, Mus musculus
atccgtgctatctgcaagcgagcca

SEQ ID NO: 251951 - DNA, 25 bp, Mus musculus
acatccgtgctatctgcaagcgagc

SEQ ID NO: 251952 - DNA, 25 bp, Mus musculus
caaacatccgtgctatctgcaagcg

SEQ ID NO: 251953 - DNA, 25 bp, Mus musculus
gccttacaaacatccgtgctatctg

SEQ ID NO: 251954 - DNA, 25 bp, Mus musculus
ctgcttattttggatgccttacaaa

SEQ ID NO: 251955 - DNA, 25 bp, Mus musculus
gcggctgcttattttggatgcctta

SEQ ID NO: 251956 - DNA, 25 bp, Mus musculus
tgctatctgcaagcgagccactttt

SEQ ID NO: 251957 - DNA, 25 bp, Mus musculus
ggctgcttattttggatgccttaca

SEQ ID NO: 251958 - DNA, 25 bp, Mus musculus
ctcccagtttggtttcgtaggcgcg

SEQ ID NO: 251959 - DNA, 25 bp, Mus musculus
ctggctgacatttcttgtgcaaaac

SEQ ID NO: 251960 - DNA, 25 bp, Mus musculus
agcagatagccctttctggctgaca

SEQ ID NO: 251961 - DNA, 25 bp, Mus musculus
gggctctccgagcatgacattgttg

SEQ ID NO: 251962 - DNA, 25 bp, Mus musculus
ccaaaaaggagttcgcggcagggct

SEQ ID NO: 251963 - DNA, 25 bp, Mus musculus
ctctgcctgagctgatgagcgagtc

SEQ ID NO: 251964 - DNA, 25 bp, Mus musculus
accgtgggcgtagtagccacctcca

SEQ ID NO: 251965 - DNA, 25 bp, Mus musculus
cgacggcgcttcattacgcttgctg

SEQ ID NO: 251966 - DNA, 25 bp, Mus musculus
ctgcgcaaaagaacacgaagtggcc

SEQ ID NO: 251967 - DNA, 25 bp, Mus musculus
gtaggagctctcttctttgatgttc

SEQ ID NO: 251968 - DNA, 25 bp, Mus musculus
tgtccgcagcatcgtagaggcagta

SEQ ID NO: 251969 - DNA, 25 bp, Mus musculus
gagcccttggggcatttgtccgcag

SEQ ID NO: 251970 - DNA, 25 bp, Mus musculus
gagtctaggactcgctccttcccgg

SEQ ID NO: 251971 - DNA, 25 bp, Mus musculus
tgagcgagtcgaccaaaaaggagtt

SEQ ID NO: 251972 - DNA, 25 bp, Mus musculus
acgtaccgtgctgctcttagtatca

SEQ ID NO: 251973 - DNA, 25 bp, Mus musculus
ccacattgtcacagccatcggagga

SEQ ID NO: 251974 - DNA, 25 bp, Mus musculus
ggggcttttatagggctcagaaatc

SEQ ID NO: 251975 - DNA, 25 bp, Mus musculus
cgaaggcgctttgctttaaatttca

SEQ ID NO: 251976 - DNA, 25 bp, Mus musculus
tgccggacaagtgaaataacgtacc

SEQ ID NO: 251977 - DNA, 25 bp, Mus musculus
tccctggcggctttgacattgatcg

SEQ ID NO: 251978 - DNA, 25 bp, Mus musculus
acattgatcgggagtgcgccatctc

SEQ ID NO: 251979 - DNA, 25 bp, Mus musculus
gagatccagcctgcggcccagaaaa

SEQ ID NO: 251980 - DNA, 25 bp, Mus musculus
agagaatgtgcccaacccgctgcta

SEQ ID NO: 251981 - DNA, 25 bp, Mus musculus
acccgctgctattgagatctcattt

SEQ ID NO: 251982 - DNA, 25 bp, Mus musculus
cagccgggtttatagcggcgcattc

SEQ ID NO: 251983 - DNA, 25 bp, Mus musculus
aaatatgcaaattggccggccctgg

SEQ ID NO: 251984 - DNA, 25 bp, Mus musculus
cctggacgggtttacgaccacattg

SEQ ID NO: 251985 - DNA, 25 bp, Mus musculus
tttgaatacgaaggggtgccggaca

SEQ ID NO: 251986 - DNA, 25 bp, Mus musculus
gggctcaatggcgtactctctgaag

SEQ ID NO: 251987 - DNA, 25 bp, Mus musculus
tccggggtgccgtaagccgtctcga

SEQ ID NO: 251988 - DNA, 25 bp, Mus musculus
aaagcctgtggcagaacgccgttcc

SEQ ID NO: 251989 - DNA, 25 bp, Mus musculus
cgttcctgcccaccgtgctatagaa

SEQ ID NO: 251990 - DNA, 25 bp, Mus musculus
ccaccgtgctatagaaattggacga

SEQ ID NO: 251991 - DNA, 25 bp, Mus musculus
ctatagaaattggacgagacggcgg

SEQ ID NO: 251992 - DNA, 25 bp, Mus musculus
gagctcttggccagcacgtcgccag

SEQ ID NO: 251993 - DNA, 25 bp, Mus musculus
gcctgcagacagtctctgtgcacga

SEQ ID NO: 251994 - DNA, 25 bp, Mus musculus
gacagtctctgtgcacgagctcctc

SEQ ID NO: 251995 - DNA, 25 bp, Mus musculus
gcacgagctcctccgcggagtagca

SEQ ID NO: 251996 - DNA, 25 bp, Mus musculus
tcctccgcggagtagcagtgggcca

SEQ ID NO: 251997 - DNA, 25 bp, Mus musculus
tctcgaaaaactggtcgaaagcctg

SEQ ID NO: 251998 - DNA, 25 bp, Mus musculus
ctctctgaaggtcacttcgcgcacg

SEQ ID NO: 251999 - DNA, 25 bp, Mus musculus
gtgccatttagtggcgggctcaatg

SEQ ID NO: 252000 - DNA, 25 bp, Mus musculus
taggcagacccccttagggccttgc

SEQ ID NO: 252001 - DNA, 25 bp, Mus musculus
tggaggtggccaacgatttaagcct

SEQ ID NO: 252002 - DNA, 25 bp, Mus musculus
gcatttggaggtggccaacgattta

SEQ ID NO: 252003 - DNA, 25 bp, Mus musculus
ccttagggccttgccgaggctcgcc

SEQ ID NO: 252004 - DNA, 25 bp, Mus musculus
cgaacttcaaggtctaggcagaccc

SEQ ID NO: 252005 - DNA, 25 bp, Mus musculus
tttcccgaacttcaaggtctaggca

SEQ ID NO: 252006 - DNA, 25 bp, Mus musculus
tgcgtgtgtgtctgtaaagaaggga

SEQ ID NO: 252007 - DNA, 25 bp, Mus musculus
gaggccaaaaatgtttggaggaaga

SEQ ID NO: 252008 - DNA, 25 bp, Mus musculus
aatgcaagaggccaaaaatgtttgg

SEQ ID NO: 252009 - DNA, 25 bp, Mus musculus
ctaaggcggctaatgcaagaggcca

SEQ ID NO: 252010 - DNA, 25 bp, Mus musculus
ccctaaggcggctaatgcaagaggc

SEQ ID NO: 252011 - DNA, 25 bp, Mus musculus
ccggagccctaaggcggctaatgca

SEQ ID NO: 252012 - DNA, 25 bp, Mus musculus
aatcgtcgcccggagccctaaggcg

SEQ ID NO: 252013 - DNA, 25 bp, Mus musculus
gcagcatttggaggtggccaacgat

SEQ ID NO: 252014 - DNA, 25 bp, Mus musculus
tcgacggcccacagaagtttaaaga

SEQ ID NO: 252015 - DNA, 25 bp, Mus musculus
ggaccacgggctcttggccaagaaa

SEQ ID NO: 252016 - DNA, 25 bp, Mus musculus
attccgggcctccatcttgagcagg

SEQ ID NO: 252017 - DNA, 25 bp, Mus musculus
ttgccaacacccttgcaccggggta

SEQ ID NO: 252018 - DNA, 25 bp, Mus musculus
tccacggctacgttgctctcacttg

SEQ ID NO: 252019 - DNA, 25 bp, Mus musculus
ggctcttctgtctgccgtcctcatg

SEQ ID NO: 252020 - DNA, 25 bp, Mus musculus
gcggccattctgtgtccacgtagca

SEQ ID NO: 252021 - DNA, 25 bp, Mus musculus
gcaaataatgcctggagcccgggga

SEQ ID NO: 252022 - DNA, 25 bp, Mus musculus
ggtcgcccgttctcagcaaataatg

SEQ ID NO: 252023 - DNA, 25 bp, Mus musculus
ccaggagagattaagtacccgatta

SEQ ID NO: 252024 - DNA, 25 bp, Mus musculus
cgcgatgtcttttcagccagtctca

SEQ ID NO: 252025 - DNA, 25 bp, Mus musculus
gctccaggctcccaagatttaagtg

SEQ ID NO: 252026 - DNA, 25 bp, Mus musculus
tcctcagacttcaggcggcagatgc

SEQ ID NO: 252027 - DNA, 25 bp, Mus musculus
caaggctctcttctcgtcctagatc

SEQ ID NO: 252028 - DNA, 25 bp, Mus musculus
acagttcttcccgtgctgacttggc

SEQ ID NO: 252029 - DNA, 25 bp, Mus musculus
cgagcggcagacacgtttctttctc

SEQ ID NO: 252030 - DNA, 25 bp, Mus musculus
attcggatcgtgtcaacagttcttc

SEQ ID NO: 252031 - DNA, 25 bp, Mus musculus
ctgcagcagcagaggtacgctttgc

SEQ ID NO: 252032 - DNA, 25 bp, Mus musculus
ggctgtccggcatctttggagaaaa

SEQ ID NO: 252033 - DNA, 25 bp, Mus musculus
ctggccggcttggaaacgaagttct

SEQ ID NO: 252034 - DNA, 25 bp, Mus musculus
ccggggaaggctagcaacaagtctt

SEQ ID NO: 252035 - DNA, 25 bp, Mus musculus
tcccgagccacggagagtttgtgcc

SEQ ID NO: 252036 - DNA, 25 bp, Mus musculus
gggcgcacgcgtttacctgtgttct

SEQ ID NO: 252037 - DNA, 25 bp, Mus musculus
acagacggcctttctgctgcgagct

SEQ ID NO: 252038 - DNA, 25 bp, Mus musculus
cgctccgcacacatggttctgggta

SEQ ID NO: 252039 - DNA, 25 bp, Mus musculus
tggagacctggattctttgtgcgcc

SEQ ID NO: 252040 - DNA, 25 bp, Mus musculus
gtcccttggtacttcgcacgggcca

SEQ ID NO: 252041 - DNA, 25 bp, Mus musculus
cgtgtgccacacgtcaggcttttgc

SEQ ID NO: 252042 - DNA, 25 bp, Mus musculus
ggtgctttgtcaccgcagcagcaag

SEQ ID NO: 252043 - DNA, 25 bp, Mus musculus
gacttccgcctctggcgatcggcag

SEQ ID NO: 252044 - DNA, 25 bp, Mus musculus
catgacgagtcagccggggcgcaca

SEQ ID NO: 252045 - DNA, 25 bp, Mus musculus
agcagttcgtgagcggtgctttgtc

SEQ ID NO: 252046 - DNA, 25 bp, Mus musculus
gccggggcgcacagtactctcctag

SEQ ID NO: 252047 - DNA, 25 bp, Mus musculus
caaagaccggatgggacgcctgact

SEQ ID NO: 252048 - DNA, 25 bp, Mus musculus
acgcctgactggctctcagcttgaa

SEQ ID NO: 252049 - DNA, 25 bp, Mus musculus
gctctcagcttgaaagggacattta

SEQ ID NO: 252050 - DNA, 25 bp, Mus musculus
cttgaaagggacatttaggggattg

SEQ ID NO: 252051 - DNA, 25 bp, Mus musculus
tttaggggattgtgcagctgcacct

SEQ ID NO: 252052 - DNA, 25 bp, Mus musculus
cacctggtgccgctgtgatggtgaa

SEQ ID NO: 252053 - DNA, 25 bp, Mus musculus
gtgaacggaagggatatagacgcca

SEQ ID NO: 252054 - DNA, 25 bp, Mus musculus
atatagacgccatgacgagtcagcc

SEQ ID NO: 252055 - DNA, 25 bp, Mus musculus
gggcgcaccaagacagcagttcgtg

SEQ ID NO: 252056 - DNA, 25 bp, Mus musculus
cagggcacgtatggacccacttttc

SEQ ID NO: 252057 - DNA, 25 bp, Mus musculus
cccagagcggaaacgtggtactgta

SEQ ID NO: 252058 - DNA, 25 bp, Mus musculus
tggtactgtaattggccgagtctcc

SEQ ID NO: 252059 - DNA, 25 bp, Mus musculus
taattggccgagtctcctctcactc

SEQ ID NO: 252060 - DNA, 25 bp, Mus musculus
ctccgacaatacaaccattccttgg

SEQ ID NO: 252061 - DNA, 25 bp, Mus musculus
ccattccttggcatcccggagtagg

SEQ ID NO: 252062 - DNA, 25 bp, Mus musculus
tagggtggcgctgccaatcacagcg

SEQ ID NO: 252063 - DNA, 25 bp, Mus musculus
cgccgacacaggattagttgccatt

SEQ ID NO: 252064 - DNA, 25 bp, Mus musculus
ccattccgagtgagaagcgggtcga

SEQ ID NO: 252065 - DNA, 25 bp, Mus musculus
tccgaggctaaagtcccggcgctgc

SEQ ID NO: 252066 - DNA, 25 bp, Mus musculus
tcaaagcctgtcaactcttaagtcc

SEQ ID NO: 252067 - DNA, 25 bp, Mus musculus
tgcagaggtagcgagcccaaccctc

SEQ ID NO: 252068 - DNA, 25 bp, Mus musculus
cagctcacctgagagacggagtccc

SEQ ID NO: 252069 - DNA, 25 bp, Mus musculus
gcgagtgccctgtcagcgcgatgcc

SEQ ID NO: 252070 - DNA, 25 bp, Mus musculus
ttttcttgcgaagcgaagctgtttc

SEQ ID NO: 252071 - DNA, 25 bp, Mus musculus
ttccaatcctcgaagaactggccgc

SEQ ID NO: 252072 - DNA, 25 bp, Mus musculus
tctcccaagccggattttcttgcga

SEQ ID NO: 252073 - DNA, 25 bp, Mus musculus
tgaagttcagagaattccaatcctc

SEQ ID NO: 252074 - DNA, 25 bp, Mus musculus
acccacagcgtttgaagttcagaga

SEQ ID NO: 252075 - DNA, 25 bp, Mus musculus
gcggaagccaaacccacagcgtttg

SEQ ID NO: 252076 - DNA, 25 bp, Mus musculus
tctatccctcctagccgggcggaag

SEQ ID NO: 252077 - DNA, 25 bp, Mus musculus
tttaaaacgactggcgcgacttatc

SEQ ID NO: 252078 - DNA, 25 bp, Mus musculus
agattccatttaaaacgactggcgc

SEQ ID NO: 252079 - DNA, 25 bp, Mus musculus
cccagcaggagaaggactgcaagtc

SEQ ID NO: 252080 - DNA, 25 bp, Mus musculus
cccaagcaaaggtttagattccatt

SEQ ID NO: 252081 - DNA, 25 bp, Mus musculus
gatccacattcggtggcccaagcaa

SEQ ID NO: 252082 - DNA, 25 bp, Mus musculus
gaagctgtttccgtggggatccaca

SEQ ID NO: 252083 - DNA, 25 bp, Mus musculus
aactggccgcatctgagccgatcgc

SEQ ID NO: 252084 - DNA, 25 bp, Mus musculus
cattagctgcgggtctcctttcatc

SEQ ID NO: 252085 - DNA, 25 bp, Mus musculus
ccagcggtactgtaatgacgattgc

SEQ ID NO: 252086 - DNA, 25 bp, Mus musculus
tcactgtggcagacgtttctattta

SEQ ID NO: 252087 - DNA, 25 bp, Mus musculus
ctatttatccacttgcgttcgccga

SEQ ID NO: 252088 - DNA, 25 bp, Mus musculus
agggcaatggggcttcctcccagag

SEQ ID NO: 252089 - DNA, 25 bp, Mus musculus
ttgtcgccttagctcctcttctcag

SEQ ID NO: 252090 - DNA, 25 bp, Mus musculus
tctcagccaagatcccagggagcct

SEQ ID NO: 252091 - DNA, 25 bp, Mus musculus
agcctgggattaggagcttacttgg

SEQ ID NO: 252092 - DNA, 25 bp, Mus musculus
agccgaaaggacatggttatgtttc

SEQ ID NO: 252093 - DNA, 25 bp, Mus musculus
cagcttggcactctggttggtaaga

SEQ ID NO: 252094 - DNA, 25 bp, Mus musculus
gtctctaatttgtccgaagccgtga

SEQ ID NO: 252095 - DNA, 25 bp, Mus musculus
ccgctgcctgaaccgccagagaaga

SEQ ID NO: 252096 - DNA, 25 bp, Mus musculus
ctggcgcatcactgccgagccatta

SEQ ID NO: 252097 - DNA, 25 bp, Mus musculus
aggagcgctcgcatcacaaggtgac

SEQ ID NO: 252098 - DNA, 25 bp, Mus musculus
aattaccttgtcacttcccgggctg

SEQ ID NO: 252099 - DNA, 25 bp, Mus musculus
atccgtcgggtagggcaagatcaaa

SEQ ID NO: 252100 - DNA, 25 bp, Mus musculus
tcggtcagaggtccaaattaccttg

SEQ ID NO: 252101 - DNA, 25 bp, Mus musculus
cggaaagacacatccgtcgggtagg

SEQ ID NO: 252102 - DNA, 25 bp, Mus musculus
gcacgtcggtcagaggtccaaatta

SEQ ID NO: 252103 - DNA, 25 bp, Mus musculus
ctccgaccagtttgcacgtcggtca

SEQ ID NO: 252104 - DNA, 25 bp, Mus musculus
atcgtggcggactctggtctccgga

SEQ ID NO: 252105 - DNA, 25 bp, Mus musculus
aaaatcgtggcggactctggtctcc

SEQ ID NO: 252106 - DNA, 25 bp, Mus musculus
gaccgtaaaatcgtggcggactctg

SEQ ID NO: 252107 - DNA, 25 bp, Mus musculus
cgcggaagcccggagaatataaagg

SEQ ID NO: 252108 - DNA, 25 bp, Mus musculus
caaggcacaaggaggcgcggaagcc

SEQ ID NO: 252109 - DNA, 25 bp, Mus musculus
cagtttgactggaggggagcaaggc

SEQ ID NO: 252110 - DNA, 25 bp, Mus musculus
atcaaacggttgtccgggcagtttg

SEQ ID NO: 252111 - DNA, 25 bp, Mus musculus
gtagggcaagatcaaacggttgtcc

SEQ ID NO: 252112 - DNA, 25 bp, Mus musculus
ccgaccctgccttctacacctacat

SEQ ID NO: 252113 - DNA, 25 bp, Mus musculus
ggcccgaactgctgtgcgccttccg

SEQ ID NO: 252114 - DNA, 25 bp, Mus musculus
acccacggcccgaactgctgtgcgc

SEQ ID NO: 252115 - DNA, 25 bp, Mus musculus
gcagccctacccacggcccgaactg

SEQ ID NO: 252116 - DNA, 25 bp, Mus musculus
gcgtgctctcgcagccctacccacg

SEQ ID NO: 252117 - DNA, 25 bp, Mus musculus
cgctcgacaccttccgcgtgctctc

SEQ ID NO: 252118 - DNA, 25 bp, Mus musculus
tactactcgcccgtgggcctgggcg

SEQ ID NO: 252119 - DNA, 25 bp, Mus musculus
ccacccgccgctctatcccggcccg

SEQ ID NO: 252120 - DNA, 25 bp, Mus musculus
gcacccggccgaccctgccttctac

SEQ ID NO: 252121 - DNA, 25 bp, Mus musculus
atgacgtggccgcacccggccgacc

SEQ ID NO: 252122 - DNA, 25 bp, Mus musculus
gctggccatgacgtggccgcacccg

SEQ ID NO: 252123 - DNA, 25 bp, Mus musculus
aagcgtcagcggctggccatgacgt

SEQ ID NO: 252124 - DNA, 25 bp, Mus musculus
gcgcatgaaggacaagcgtcagcgg

SEQ ID NO: 252125 - DNA, 25 bp, Mus musculus
ccctgcgcccgctcgacaccttccg

SEQ ID NO: 252126 - DNA, 25 bp, Mus musculus
caaccgcagcccttcgggcgaaaag

SEQ ID NO: 252127 - DNA, 25 bp, Mus musculus
gggcgaaaagccctcctcggatgac

SEQ ID NO: 252128 - DNA, 25 bp, Mus musculus
ccctcctcggatgaccagaggaaga

SEQ ID NO: 252129 - DNA, 25 bp, Mus musculus
cagatggggcgcgaggtccttaccc

SEQ ID NO: 252130 - DNA, 25 bp, Mus musculus
gcgaggtccttacccgctgcaaggc

SEQ ID NO: 252131 - DNA, 25 bp, Mus musculus
ggccgctccagtaccagaggccgga

SEQ ID NO: 252132 - DNA, 25 bp, Mus musculus
acacacggcctgtgaactacgagtg

SEQ ID NO: 252133 - DNA, 25 bp, Mus musculus
aactacgagtgtgcgcagccgggat

SEQ ID NO: 252134 - DNA, 25 bp, Mus musculus
gtaaggacagctcgcgcacgcgctc

SEQ ID NO: 252135 - DNA, 25 bp, Mus musculus
gaccacaattgtcgcttttaccctc

SEQ ID NO: 252136 - DNA, 25 bp, Mus musculus
gccggagtcgggaacagtccaatca

SEQ ID NO: 252137 - DNA, 25 bp, Mus musculus
agtccaatcaggatcccgaaatcca

SEQ ID NO: 252138 - DNA, 25 bp, Mus musculus
cgaaatccatagacgccctgccttg

SEQ ID NO: 252139 - DNA, 25 bp, Mus musculus
acgcgctctccttgctcggcttgga

SEQ ID NO: 252140 - DNA, 25 bp, Mus musculus
cggctctccgcttagagaaggtgta

SEQ ID NO: 252141 - DNA, 25 bp, Mus musculus
tgtcgccgcagagcatgcgcagcag

SEQ ID NO: 252142 - DNA, 25 bp, Mus musculus
ccgcgattgtgacgtgttttgggct

SEQ ID NO: 252143 - DNA, 25 bp, Mus musculus
accgccggctctccgcttagagaag

SEQ ID NO: 252144 - DNA, 25 bp, Mus musculus
cccggcgtctaacaagccagggacg

SEQ ID NO: 252145 - DNA, 25 bp, Mus musculus
ccgcttagagaaggtgtagccggtc

SEQ ID NO: 252146 - DNA, 25 bp, Mus musculus
tgtagccggtctacgctgagaggca

SEQ ID NO: 252147 - DNA, 25 bp, Mus musculus
gccgcgtgctttcgaggtaaccggc

SEQ ID NO: 252148 - DNA, 25 bp, Mus musculus
ctttcgaggtaaccggcgctcgcgc

SEQ ID NO: 252149 - DNA, 25 bp, Mus musculus
gaacggtctccgtggtgacgaagct

SEQ ID NO: 252150 - DNA, 25 bp, Mus musculus
tctccgtggtgacgaagctctcttt

SEQ ID NO: 252151 - DNA, 25 bp, Mus musculus
gtgacgaagctctctttcccaagga

SEQ ID NO: 252152 - DNA, 25 bp, Mus musculus
gctctctttcccaaggacgagcttc

SEQ ID NO: 252153 - DNA, 25 bp, Mus musculus
gcggaagtgacgcaccgccggctct

SEQ ID NO: 252154 - DNA, 25 bp, Mus musculus
cccaacggaccgcaatgatttagaa

SEQ ID NO: 252155 - DNA, 25 bp, Mus musculus
ttgctcagtccaacgtggtcccttc

SEQ ID NO: 252156 - DNA, 25 bp, Mus musculus
ggctcttgccttctccacacttgtt

SEQ ID NO: 252157 - DNA, 25 bp, Mus musculus
cacttctgggccttttgcatttagc

SEQ ID NO: 252158 - DNA, 25 bp, Mus musculus
actccggagcgtccttgtttgcagg

SEQ ID NO: 252159 - DNA, 25 bp, Mus musculus
tgcagccgcgaggttacttagtcca

SEQ ID NO: 252160 - DNA, 25 bp, Mus musculus
gctgtgtcctgtagtcacccagaga

SEQ ID NO: 252161 - DNA, 25 bp, Mus musculus
agcgcgcgtgagtttccctgacacg

SEQ ID NO: 252162 - DNA, 25 bp, Mus musculus
cggcatggtgtggaacccttctgaa

SEQ ID NO: 252163 - DNA, 25 bp, Mus musculus
cccttctgaagtgtggtcaagcggc

SEQ ID NO: 252164 - DNA, 25 bp, Mus musculus
ttcaggaatcccacgtgacgtcacc

SEQ ID NO: 252165 - DNA, 25 bp, Mus musculus
gggacttgactttcgctccaggcgc

SEQ ID NO: 252166 - DNA, 25 bp, Mus musculus
ttgcggcaaagtcgcctggtcacct

SEQ ID NO: 252167 - DNA, 25 bp, Mus musculus
cccgtttctcagtgatgcagcggaa

SEQ ID NO: 252168 - DNA, 25 bp, Mus musculus
gtccagccgtagcttgaccaaactc

SEQ ID NO: 252169 - DNA, 25 bp, Mus musculus
tggttgtactgcagatccagccgtc

SEQ ID NO: 252170 - DNA, 25 bp, Mus musculus
gcagcagttggtcatccaggtaatc

SEQ ID NO: 252171 - DNA, 25 bp, Mus musculus
tggcgacactgcacgaagaccgtaa

SEQ ID NO: 252172 - DNA, 25 bp, Mus musculus
atgccagttgcccatccagcgtttc

SEQ ID NO: 252173 - DNA, 25 bp, Mus musculus
gcaggtccaaccattgccgtctaga

SEQ ID NO: 252174 - DNA, 25 bp, Mus musculus
cagaaagctcattgccactcaggtc

SEQ ID NO: 252175 - DNA, 25 bp, Mus musculus
aggtctagtgcctccaagctgtgca

SEQ ID NO: 252176 - DNA, 25 bp, Mus musculus
ggttaccttccaggcgcagctcacg

SEQ ID NO: 252177 - DNA, 25 bp, Mus musculus
attgaggaatcgaagcttacccagc

SEQ ID NO: 252178 - DNA, 25 bp, Mus musculus
ggctgaaggcgttcttgcccaaaaa

SEQ ID NO: 252179 - DNA, 25 bp, Mus musculus
cggatccggttagattccaggtgta

SEQ ID NO: 252180 - DNA, 25 bp, Mus musculus
gcgactcaggcgtccaatctcgttg

SEQ ID NO: 252181 - DNA, 25 bp, Mus musculus
aggtacagctcctctagtcgtgaga

SEQ ID NO: 252182 - DNA, 25 bp, Mus musculus
attctgcagtaatgcgcctgggagg

SEQ ID NO: 252183 - DNA, 25 bp, Mus musculus
tcctccctgctgtgtgtgtacgtgt

SEQ ID NO: 252184 - DNA, 25 bp, Mus musculus
tgtacgtgtgcacgctcacgtctcc

SEQ ID NO: 252185 - DNA, 25 bp, Mus musculus
ggaactgctgctcttggcctcataa

SEQ ID NO: 252186 - DNA, 25 bp, Mus musculus
ttggcctcataaacccgaaggagta

SEQ ID NO: 252187 - DNA, 25 bp, Mus musculus
gagcgttgccacctagcgccacatg

SEQ ID NO: 252188 - DNA, 25 bp, Mus musculus
cgccacatggcactcgtccggtatt

SEQ ID NO: 252189 - DNA, 25 bp, Mus musculus
tcgtccggtattggcactccttgcc

SEQ ID NO: 252190 - DNA, 25 bp, Mus musculus
cctagtcttggagaacaggtgagcc

SEQ ID NO: 252191 - DNA, 25 bp, Mus musculus
gctcgcccgcgcattctgcagtaat

SEQ ID NO: 252192 - DNA, 25 bp, Mus musculus
gcctgggaggtttcatcacccaccg

SEQ ID NO: 252193 - DNA, 25 bp, Mus musculus
ctcttctgcgcctacgtgtgacaca

SEQ ID NO: 252194 - DNA, 25 bp, Mus musculus
aaatgagcgcgcaggttgtctttcc

SEQ ID NO: 252195 - DNA, 25 bp, Mus musculus
ggtgagcctgggtaccaactctcaa

SEQ ID NO: 252196 - DNA, 25 bp, Mus musculus
gacacttgttaaggtggtcaacacc

SEQ ID NO: 252197 - DNA, 25 bp, Mus musculus
ggaggtcgctgtctatctgtctccc

SEQ ID NO: 252198 - DNA, 25 bp, Mus musculus
acgagcgtcactgggacacttgtta

SEQ ID NO: 252199 - DNA, 25 bp, Mus musculus
gagagtctacctgtggccgtccctc

SEQ ID NO: 252200 - DNA, 25 bp, Mus musculus
tccgtgtcctctggtgagtttcagc

SEQ ID NO: 252201 - DNA, 25 bp, Mus musculus
agcaactctagtctgtccggctcct

SEQ ID NO: 252202 - DNA, 25 bp, Mus musculus
gagatggcagcatccagcaactcta

SEQ ID NO: 252203 - DNA, 25 bp, Mus musculus
gccgcccgcaccaggactgagagag

SEQ ID NO: 252204 - DNA, 25 bp, Mus musculus
gtcatctggcggagcaggaagtaca

SEQ ID NO: 252205 - DNA, 25 bp, Mus musculus
acggcgagcacgaataaatagcggc

SEQ ID NO: 252206 - DNA, 25 bp, Mus musculus
aggctggatccctagagtcagtgcc

SEQ ID NO: 252207 - DNA, 25 bp, Mus musculus
aggctccgagtcctgatggtctcca

SEQ ID NO: 252208 - DNA, 25 bp, Mus musculus
cagccagggttgcaggagctgtcaa

SEQ ID NO: 252209 - DNA, 25 bp, Mus musculus
tggtcaacacctttgcgtctgagcg

SEQ ID NO: 252210 - DNA, 25 bp, Mus musculus
cgataagggacaccgcgactaagct

SEQ ID NO: 252211 - DNA, 25 bp, Mus musculus
ctctcctagtcagcgataagggaca

SEQ ID NO: 252212 - DNA, 25 bp, Mus musculus
aacgattcctgcatctctcctagtc

SEQ ID NO: 252213 - DNA, 25 bp, Mus musculus
tgggcgagatcagcaacaacgattc

SEQ ID NO: 252214 - DNA, 25 bp, Mus musculus
ccaggttgttccgacagtgtgcgag

SEQ ID NO: 252215 - DNA, 25 bp, Mus musculus
ggatctgacagtccctgccacctga

SEQ ID NO: 252216 - DNA, 25 bp, Mus musculus
ctgaccagactcaccctggggcgga

SEQ ID NO: 252217 - DNA, 25 bp, Mus musculus
ctcccaccgggaaaggctgaccaga

SEQ ID NO: 252218 - DNA, 25 bp, Mus musculus
ctagaatgtgagactcccaccggga

SEQ ID NO: 252219 - DNA, 25 bp, Mus musculus
ggacgcgccctagaatgtgagactc

SEQ ID NO: 252220 - DNA, 25 bp, Mus musculus
tcctgtctagctgaggccagagagc

SEQ ID NO: 252221 - DNA, 25 bp, Mus musculus
gagtcagtagcccaggtcctgtcta

SEQ ID NO: 252222 - DNA, 25 bp, Mus musculus
ttcctacggacgctcaggaagggta

SEQ ID NO: 252223 - DNA, 25 bp, Mus musculus
cgactaagcttcaggcacccggaga

SEQ ID NO: 252224 - DNA, 25 bp, Mus musculus
ccgacgtcagcgtcagcactggcga

SEQ ID NO: 252225 - DNA, 25 bp, Mus musculus
gctgacgcacgctcctagggcgcgc

SEQ ID NO: 252226 - DNA, 25 bp, Mus musculus
cagccggaatagcaacgcggagccg

SEQ ID NO: 252227 - DNA, 25 bp, Mus musculus
ccgccagccggaatagcaacgcgga

SEQ ID NO: 252228 - DNA, 25 bp, Mus musculus
aggaagcggtccttcctgcagcggc

SEQ ID NO: 252229 - DNA, 25 bp, Mus musculus
ggcggagatcctagcgtccctccag

SEQ ID NO: 252230 - DNA, 25 bp, Mus musculus
agcctcccggcggagatcctagcgt

SEQ ID NO: 252231 - DNA, 25 bp, Mus musculus
gggcgtctcccactgcagcatgcag

SEQ ID NO: 252232 - DNA, 25 bp, Mus musculus
cccgtagcccgcaaagggcagtaga

SEQ ID NO: 252233 - DNA, 25 bp, Mus musculus
atgaggtgacccgcctggaacccgt

SEQ ID NO: 252234 - DNA, 25 bp, Mus musculus
aagaggatgatgctcctcccgcacc

SEQ ID NO: 252235 - DNA, 25 bp, Mus musculus
catccaggcccgagggaggatctgc

SEQ ID NO: 252236 - DNA, 25 bp, Mus musculus
tccacacatccaggcccgagggagg

SEQ ID NO: 252237 - DNA, 25 bp, Mus musculus
tagggcgcgcgcatcctccacacat

SEQ ID NO: 252238 - DNA, 25 bp, Mus musculus
aagtttccctcctgcgcactggcga

SEQ ID NO: 252239 - DNA, 25 bp, Mus musculus
tcgtggtggccgtgtccagtagcac

SEQ ID NO: 252240 - DNA, 25 bp, Mus musculus
tgcccactcgtggtggccgtgtcca

SEQ ID NO: 252241 - DNA, 25 bp, Mus musculus
aaacctagaaatgggcggcgcgcgc

SEQ ID NO: 252242 - DNA, 25 bp, Mus musculus
tgaaacctagaaatgggcggcgcgc

SEQ ID NO: 252243 - DNA, 25 bp, Mus musculus
cggagctgaaacctagaaatgggcg

SEQ ID NO: 252244 - DNA, 25 bp, Mus musculus
actggcgaatcccaggagcgccgcg

SEQ ID NO: 252245 - DNA, 25 bp, Mus musculus
tgcaacaacaaacggccgcacaagt

SEQ ID NO: 252246 - DNA, 25 bp, Mus musculus
gttccgggagaacctgcaacaacaa

SEQ ID NO: 252247 - DNA, 25 bp, Mus musculus
taccaggcagttccgggagaacctg

SEQ ID NO: 252248 - DNA, 25 bp, Mus musculus
tcctctaccaggcagttccgggaga

SEQ ID NO: 252249 - DNA, 25 bp, Mus musculus
ctgcgcactggcgaatcccaggagc

SEQ ID NO: 252250 - DNA, 25 bp, Mus musculus
cggcggagctgaaacctagaaatgg

SEQ ID NO: 252251 - DNA, 25 bp, Mus musculus
tgcgaagcggcggagctgaaaccta

SEQ ID NO: 252252 - DNA, 25 bp, Mus musculus
cgcgcagaagcaacgccaggcactg

SEQ ID NO: 252253 - DNA, 25 bp, Mus musculus
agagtccagcttagccgggcgcgca

SEQ ID NO: 252254 - DNA, 25 bp, Mus musculus
agcaacgccaggcactgtctgcagc

SEQ ID NO: 252255 - DNA, 25 bp, Mus musculus
agcccagccgggatcctcgaggcga

SEQ ID NO: 252256 - DNA, 25 bp, Mus musculus
ggacggaggcgccagctaaagtcca

SEQ ID NO: 252257 - DNA, 25 bp, Mus musculus
cagctaaagtccagtcggccgggtt

SEQ ID NO: 252258 - DNA, 25 bp, Mus musculus
ccagtcggccgggttacggccagct

SEQ ID NO: 252259 - DNA, 25 bp, Mus musculus
cctgggttaagtaagtggccgattg

SEQ ID NO: 252260 - DNA, 25 bp, Mus musculus
gtagagtggcctcccgcgttgtcaa

SEQ ID NO: 252261 - DNA, 25 bp, Mus musculus
ccgcgttgtcaaagacgctgggtga

SEQ ID NO: 252262 - DNA, 25 bp, Mus musculus
ccagccgcgactacgtctgggagct

SEQ ID NO: 252263 - DNA, 25 bp, Mus musculus
ctgggagctgctccgtgcagcccta

SEQ ID NO: 252264 - DNA, 25 bp, Mus musculus
ccagctgcaggtagctgctctgctc

SEQ ID NO: 252265 - DNA, 25 bp, Mus musculus
agcgaggagcgcagagtccagctta

SEQ ID NO: 252266 - DNA, 25 bp, Mus musculus
ggctgcagtagcttcgtcccgaagt

SEQ ID NO: 252267 - DNA, 25 bp, Mus musculus
gtttggtcacgcgaccgcagaccca

SEQ ID NO: 252268 - DNA, 25 bp, Mus musculus
cccggctaacagctggtttggtcac

SEQ ID NO: 252269 - DNA, 25 bp, Mus musculus
gcctctgcatccgtagcgcagaaga

SEQ ID NO: 252270 - DNA, 25 bp, Mus musculus
cggcggctaggttacagcctctgca

SEQ ID NO: 252271 - DNA, 25 bp, Mus musculus
ggaaatgtggtgacctcccagcgga

SEQ ID NO: 252272 - DNA, 25 bp, Mus musculus
gtccctgatctcaagtcgggccaga

SEQ ID NO: 252273 - DNA, 25 bp, Mus musculus
gcccagaaaaagcagcacccggtta

SEQ ID NO: 252274 - DNA, 25 bp, Mus musculus
caggctctctctgctagccgcaaga

SEQ ID NO: 252275 - DNA, 25 bp, Mus musculus
ccacggatgcattactcgggaagga

SEQ ID NO: 252276 - DNA, 25 bp, Mus musculus
cgaccaagggtagcggcctagtcag

SEQ ID NO: 252277 - DNA, 25 bp, Mus musculus
cccggggaagctcagagacacttcc

SEQ ID NO: 252278 - DNA, 25 bp, Mus musculus
ctcgcgaggcgttagaattgtaatg

SEQ ID NO: 252279 - DNA, 25 bp, Mus musculus
agcagattctgaccaggctgcagta

SEQ ID NO: 252280 - DNA, 25 bp, Mus musculus
cgcagtggccaaaccctggcgtgga

SEQ ID NO: 252281 - DNA, 25 bp, Mus musculus
tgaagtgtacgctggcgatcggcct

SEQ ID NO: 252282 - DNA, 25 bp, Mus musculus
ccgcagccctaagccctgaagtgta

SEQ ID NO: 252283 - DNA, 25 bp, Mus musculus
gtggaactctagcaccgcagcccta

SEQ ID NO: 252284 - DNA, 25 bp, Mus musculus
ctgccgaccgaggtagtggaactct

SEQ ID NO: 252285 - DNA, 25 bp, Mus musculus
gtcgatctccctaggcaccttcagg

SEQ ID NO: 252286 - DNA, 25 bp, Mus musculus
ttccagagtctccacgcagtcgatc

SEQ ID NO: 252287 - DNA, 25 bp, Mus musculus
ctgcagggtgccgagtgccaccaac

SEQ ID NO: 252288 - DNA, 25 bp, Mus musculus
ggggtccacctcaatctcgcgaatt

SEQ ID NO: 252289 - DNA, 25 bp, Mus musculus
actacctgagcggtgagtgccggct

SEQ ID NO: 252290 - DNA, 25 bp, Mus musculus
caagtggaccaactacctgagcggt

SEQ ID NO: 252291 - DNA, 25 bp, Mus musculus
cccggagctggtgctcccaggctgt

SEQ ID NO: 252292 - DNA, 25 bp, Mus musculus
tagcgtgcgcacagcgcagtgagca

SEQ ID NO: 252293 - DNA, 25 bp, Mus musculus
aaccctggcgtggatttggtagcgt

SEQ ID NO: 252294 - DNA, 25 bp, Mus musculus
tgtggcaacctaccggaccatcgcg

SEQ ID NO: 252295 - DNA, 25 bp, Mus musculus
ttggaccctctttgcggaattacgc

SEQ ID NO: 252296 - DNA, 25 bp, Mus musculus
cacccgcagtgatagatcttttgga

SEQ ID NO: 252297 - DNA, 25 bp, Mus musculus
cctgcgagtctctcaaacggacaca

SEQ ID NO: 252298 - DNA, 25 bp, Mus musculus
ttacgccctggagcttaaaaatgca

SEQ ID NO: 252299 - DNA, 25 bp, Mus musculus
ggggtctcagacacaactctgcagc

SEQ ID NO: 252300 - DNA, 25 bp, Mus musculus
gcgtggctaagagcatcccatggga

SEQ ID NO: 252301 - DNA, 25 bp, Mus musculus
cgggcgtctccttctacgtactgtg

SEQ ID NO: 252302 - DNA, 25 bp, Mus musculus
gcaggatggacttctacgccgaccc

SEQ ID NO: 252303 - DNA, 25 bp, Mus musculus
ggtgttccagcacgccctttgagct

SEQ ID NO: 252304 - DNA, 25 bp, Mus musculus
gattggccagagttcgtgacgtcac

SEQ ID NO: 252305 - DNA, 25 bp, Mus musculus
tagcggattccagagaaagccttcc

SEQ ID NO: 252306 - DNA, 25 bp, Mus musculus
cgtccctcgcgtttatagcggattc

SEQ ID NO: 252307 - DNA, 25 bp, Mus musculus
ggctcatagtccctgcggcaggatc

SEQ ID NO: 252308 - DNA, 25 bp, Mus musculus
ggtctgtccatcaccacatgctggg

SEQ ID NO: 252309 - DNA, 25 bp, Mus musculus
gtccgcacggctacctgagcggcag

SEQ ID NO: 252310 - DNA, 25 bp, Mus musculus
ccgcacttgtttggaggtacggctc

SEQ ID NO: 252311 - DNA, 25 bp, Mus musculus
agggcggagccaccggtctgtccat

SEQ ID NO: 252312 - DNA, 25 bp, Mus musculus
agagctagagcagcgggacccaatc

SEQ ID NO: 252313 - DNA, 25 bp, Mus musculus
agcgggacccaatctctgcgctttg

SEQ ID NO: 252314 - DNA, 25 bp, Mus musculus
atctctgcgctttgcctcgattcgg

SEQ ID NO: 252315 - DNA, 25 bp, Mus musculus
tcctctttcccgttgcaagcggctg

SEQ ID NO: 252316 - DNA, 25 bp, Mus musculus
tcggcctagttgtagggcagagcta

SEQ ID NO: 252317 - DNA, 25 bp, Mus musculus
tacctgagcggcagccgcgagctgc

SEQ ID NO: 252318 - DNA, 25 bp, Mus musculus
cccgtacggctcacaggactcagtg

SEQ ID NO: 252319 - DNA, 25 bp, Mus musculus
aggactcagtgcacagcagcccaga

SEQ ID NO: 252320 - DNA, 25 bp, Mus musculus
agcccagaggacagcgtcggcgcta

SEQ ID NO: 252321 - DNA, 25 bp, Mus musculus
gccgcgtctggtgatcggctcgctc

SEQ ID NO: 252322 - DNA, 25 bp, Mus musculus
agacatcggtcagggtcacagcaca

SEQ ID NO: 252323 - DNA, 25 bp, Mus musculus
cggagcagcacctttttgcgcagga

SEQ ID NO: 252324 - DNA, 25 bp, Mus musculus
gcagatgctcctgcgctgtgcgctc

SEQ ID NO: 252325 - DNA, 25 bp, Mus musculus
gggttggcatccagctgctgcagca

SEQ ID NO: 252326 - DNA, 25 bp, Mus musculus
atgatccaacagaagagcggcaccc

SEQ ID NO: 252327 - DNA, 25 bp, Mus musculus
aagaccgtctggaagtgctggaaac

SEQ ID NO: 252328 - DNA, 25 bp, Mus musculus
aggagccctcgaagaccgtctggaa

SEQ ID NO: 252329 - DNA, 25 bp, Mus musculus
tcagtgaccagcagaaagacatcgg

SEQ ID NO: 252330 - DNA, 25 bp, Mus musculus
cggcctgttcagatgcacctcagtg

SEQ ID NO: 252331 - DNA, 25 bp, Mus musculus
ttgcgctgcaccaggctgctgggct

SEQ ID NO: 252332 - DNA, 25 bp, Mus musculus
gccagcctgcacgtagggtttccgc

SEQ ID NO: 252333 - DNA, 25 bp, Mus musculus
agcgcatgcagcgtgcgccagcctg

SEQ ID NO: 252334 - DNA, 25 bp, Mus musculus
gggtcacagcacagtccggcaactg

SEQ ID NO: 252335 - DNA, 25 bp, Mus musculus
ccggcaactgtgaagaggagccctc

SEQ ID NO: 252336 - DNA, 25 bp, Mus musculus
ccactcagaagataccggtagtgcc

SEQ ID NO: 252337 - DNA, 25 bp, Mus musculus
actcccggcaggctgttggctcgct

SEQ ID NO: 252338 - DNA, 25 bp, Mus musculus
ccgtgtctggccgttagaaactaca

SEQ ID NO: 252339 - DNA, 25 bp, Mus musculus
ctatgttcttatagcccgtgtctgg

SEQ ID NO: 252340 - DNA, 25 bp, Mus musculus
cctggagccatcacctatgttctta

SEQ ID NO: 252341 - DNA, 25 bp, Mus musculus
gacggttggtttcctggagccatca

SEQ ID NO: 252342 - DNA, 25 bp, Mus musculus
ggcgctcgtctaatggcgtcaccga

SEQ ID NO: 252343 - DNA, 25 bp, Mus musculus
cccgaggctcaggtaccttagtgtc

SEQ ID NO: 252344 - DNA, 25 bp, Mus musculus
ttttgttttactccgggctctggca

SEQ ID NO: 252345 - DNA, 25 bp, Mus musculus
ggtgtcgggtgtgcaccactcagaa

SEQ ID NO: 252346 - DNA, 25 bp, Mus musculus
tgttggctcgctcgcgctagtttgc

SEQ ID NO: 252347 - DNA, 25 bp, Mus musculus
accgacggcctttgcattgtgggac

SEQ ID NO: 252348 - DNA, 25 bp, Mus musculus
tctggcacgtcaaagcaactggatg

SEQ ID NO: 252349 - DNA, 25 bp, Mus musculus
ggtaccttagtgtccacgtcggcca

SEQ ID NO: 252350 - DNA, 25 bp, Mus musculus
ggaactcgtcgtgccagctctgcca

SEQ ID NO: 252351 - DNA, 25 bp, Mus musculus
tgtaaccacaaccaatgccgggacc

SEQ ID NO: 252352 - DNA, 25 bp, Mus musculus
atcaggagctggctgtgtctacggc

SEQ ID NO: 252353 - DNA, 25 bp, Mus musculus
gcctgtaaccacaaccaatgccggg

SEQ ID NO: 252354 - DNA, 25 bp, Mus musculus
tgcatcggacgagcggccactgcgc

SEQ ID NO: 252355 - DNA, 25 bp, Mus musculus
gtgggcaggcctcgcagttcgccca

SEQ ID NO: 252356 - DNA, 25 bp, Mus musculus
tcgcagttcgcccaggggtgacacc

SEQ ID NO: 252357 - DNA, 25 bp, Mus musculus
acaccctgggaactcgtcgtgccag

SEQ ID NO: 252358 - DNA, 25 bp, Mus musculus
gatcgggcgggacaacagctgggag

SEQ ID NO: 252359 - DNA, 25 bp, Mus musculus
ccagctctgccacggccgcggagag

SEQ ID NO: 252360 - DNA, 25 bp, Mus musculus
gagagtgccacccagcgcctgtaac

SEQ ID NO: 252361 - DNA, 25 bp, Mus musculus
ctaccgctcgcggtccgggatcagg

SEQ ID NO: 252362 - DNA, 25 bp, Mus musculus
cctgggaactcgtcgtgccagctct

SEQ ID NO: 252363 - DNA, 25 bp, Mus musculus
aggagccgccgcacactgcatcgga

SEQ ID NO: 252364 - DNA, 25 bp, Mus musculus
gcacaacggcactgacctgcaggcg

SEQ ID NO: 252365 - DNA, 25 bp, Mus musculus
acggacagcccgagagtggctactg

SEQ ID NO: 252366 - DNA, 25 bp, Mus musculus
tggctactggcgactgtgttttccc

SEQ ID NO: 252367 - DNA, 25 bp, Mus musculus
ttctattggatgcatccctcggatg

SEQ ID NO: 252368 - DNA, 25 bp, Mus musculus
gcccactgacgtcgcttttctattg

SEQ ID NO: 252369 - DNA, 25 bp, Mus musculus
cggcgtgagctaactaccaggattg

SEQ ID NO: 252370 - DNA, 25 bp, Mus musculus
ctaaaaagagcagtgcgccgccacc

SEQ ID NO: 252371 - DNA, 25 bp, Mus musculus
gagaagccggactagcgctgctaaa

SEQ ID NO: 252372 - DNA, 25 bp, Mus musculus
cgccagcagcgtcaagcacagagaa

SEQ ID NO: 252373 - DNA, 25 bp, Mus musculus
gcatggccctcacagtcggagctcg

SEQ ID NO: 252374 - DNA, 25 bp, Mus musculus
cgctgattggcgagtctaacggaca

SEQ ID NO: 252375 - DNA, 25 bp, Mus musculus
atcctctcggtcaggagattgctgc

SEQ ID NO: 252376 - DNA, 25 bp, Mus musculus
cgaactccgacggtggctagaggtt

SEQ ID NO: 252377 - DNA, 25 bp, Mus musculus
cgtaggcgaagtacaggaatgtctc

SEQ ID NO: 252378 - DNA, 25 bp, Mus musculus
gcgtctcagcggctcctcagcgctc

SEQ ID NO: 252379 - DNA, 25 bp, Mus musculus
gggttctctgccgaatctgcggttg

SEQ ID NO: 252380 - DNA, 25 bp, Mus musculus
ccgaatctgcggttgcagacgcggc

SEQ ID NO: 252381 - DNA, 25 bp, Mus musculus
ggcctggctgcgctatttcatcatg

SEQ ID NO: 252382 - DNA, 25 bp, Mus musculus
cgctatttcatcatgcaccgggcgg

SEQ ID NO: 252383 - DNA, 25 bp, Mus musculus
agtggtcgcagcgtccgcgtctcag

SEQ ID NO: 252384 - DNA, 25 bp, Mus musculus
cgaatccagccgtaggcttcgcctc

SEQ ID NO: 252385 - DNA, 25 bp, Mus musculus
gcctcccggagcagcatggacagcg

SEQ ID NO: 252386 - DNA, 25 bp, Mus musculus
atggctcggctcagcggcaagctga

SEQ ID NO: 252387 - DNA, 25 bp, Mus musculus
tagccgtgcgccagcaggtaccgac

SEQ ID NO: 252388 - DNA, 25 bp, Mus musculus
cgctgcgtcggcatccgtgatcctt

SEQ ID NO: 252389 - DNA, 25 bp, Mus musculus
atccgtgatccttgggcctcgtgcc

SEQ ID NO: 252390 - DNA, 25 bp, Mus musculus
ctcagcggcaagctgatgctgcgcg

SEQ ID NO: 252391 - DNA, 25 bp, Mus musculus
gcggcgtgctcatgccctgtctgct

SEQ ID NO: 252392 - DNA, 25 bp, Mus musculus
ttctgaaactgggactcatcgcgcc

SEQ ID NO: 252393 - DNA, 25 bp, Mus musculus
tccttagtcgccttggggctttcca

SEQ ID NO: 252394 - DNA, 25 bp, Mus musculus
ctgtgcttgcagcttccaaaatttc

SEQ ID NO: 252395 - DNA, 25 bp, Mus musculus
tcatcgcgcctgttgtgtggctttc

SEQ ID NO: 252396 - DNA, 25 bp, Mus musculus
tgaggagtcgttcacccacgtgtca

SEQ ID NO: 252397 - DNA, 25 bp, Mus musculus
ctatcctctggcaaccgcggaaatc

SEQ ID NO: 252398 - DNA, 25 bp, Mus musculus
ggctgctggtgtcagtgccaacaca

SEQ ID NO: 252399 - DNA, 25 bp, Mus musculus
gcctcttaagtttcctgcaccggga

SEQ ID NO: 252400 - DNA, 25 bp, Mus musculus
cgggaattcaactgtgccaagccta

SEQ ID NO: 252401 - DNA, 25 bp, Mus musculus
caggccgtagtagctcctccatgga

SEQ ID NO: 252402 - DNA, 25 bp, Mus musculus
agcggttcttgctcgctgcatttgc

SEQ ID NO: 252403 - DNA, 25 bp, Mus musculus
ctccaccgttcttggcagggacacg

SEQ ID NO: 252404 - DNA, 25 bp, Mus musculus
gttcgggtcttatcgctcaagttca

SEQ ID NO: 252405 - DNA, 25 bp, Mus musculus
tgcctccagtcctgtgcggtatgta

SEQ ID NO: 252406 - DNA, 25 bp, Mus musculus
tcggtgccctctggacccgacaagt

SEQ ID NO: 252407 - DNA, 25 bp, Mus musculus
gagcaagcccatgtgccgctagttg

SEQ ID NO: 252408 - DNA, 25 bp, Mus musculus
ccgacaagtccctagaatggcctca

SEQ ID NO: 252409 - DNA, 25 bp, Mus musculus
atggcctcagtgctggcgatctatg

SEQ ID NO: 252410 - DNA, 25 bp, Mus musculus
ggtggccgaataactcctccgagga

SEQ ID NO: 252411 - DNA, 25 bp, Mus musculus
cgcgacaagcgagggacactcacgg

SEQ ID NO: 252412 - DNA, 25 bp, Mus musculus
tcggggctccgcaattgatcgatca

SEQ ID NO: 252413 - DNA, 25 bp, Mus musculus
cgctagttgtctagcctcctgccta

SEQ ID NO: 252414 - DNA, 25 bp, Mus musculus
ccaaggtcgtgttgcagtaggtgta

SEQ ID NO: 252415 - DNA, 25 bp, Mus musculus
ccagcaggtcccgatctggtccaag

SEQ ID NO: 252416 - DNA, 25 bp, Mus musculus
ggcacggtctctctactagggctcc

SEQ ID NO: 252417 - DNA, 25 bp, Mus musculus
ccattgaagtactcggggcacggtc

SEQ ID NO: 252418 - DNA, 25 bp, Mus musculus
acgggtcgtgttgtacttgatgcca

SEQ ID NO: 252419 - DNA, 25 bp, Mus musculus
cggggtgccactcagacctgcacta

SEQ ID NO: 252420 - DNA, 25 bp, Mus musculus
agtacgcacacaccgcggcgcaggg

SEQ ID NO: 252421 - DNA, 25 bp, Mus musculus
cgcggtcccttgtgcagtacgcaca

SEQ ID NO: 252422 - DNA, 25 bp, Mus musculus
acagacttggctgctcgcggccaca

SEQ ID NO: 252423 - DNA, 25 bp, Mus musculus
tccgattcccgactgcgactggctg

SEQ ID NO: 252424 - DNA, 25 bp, Mus musculus
ggattcgcgggttgcgcgtcctcct

SEQ ID NO: 252425 - DNA, 25 bp, Mus musculus
cgaggccatcaggtaaggaccactc

SEQ ID NO: 252426 - DNA, 25 bp, Mus musculus
tccaggagccgcgtgctctgccaaa

SEQ ID NO: 252427 - DNA, 25 bp, Mus musculus
ctctctgctccatccaagtgtcgga

SEQ ID NO: 252428 - DNA, 25 bp, Mus musculus
gacgagggacgcctcgctccgattc

SEQ ID NO: 252429 - DNA, 25 bp, Mus musculus
gcgcagggacacacagacttggctg

SEQ ID NO: 252430 - DNA, 25 bp, Mus musculus
tcagcgcggtggtcctcatccagct

SEQ ID NO: 252431 - DNA, 25 bp, Mus musculus
ctgcagctctggcttgtgtcagcgc

SEQ ID NO: 252432 - DNA, 25 bp, Mus musculus
ctgcgactggctgcgactttggagc

SEQ ID NO: 252433 - DNA, 25 bp, Mus musculus
acgctccagccagtgcggctctggg

SEQ ID NO: 252434 - DNA, 25 bp, Mus musculus
agtgcccgtggaatcttgcgctgca

SEQ ID NO: 252435 - DNA, 25 bp, Mus musculus
ctgcgctggctcaggcagtgcccgt

SEQ ID NO: 252436 - DNA, 25 bp, Mus musculus
accacggaggctgtgggaggtcacc

SEQ ID NO: 252437 - DNA, 25 bp, Mus musculus
ggtcacctgcgtcctgcagccctgt

SEQ ID NO: 252438 - DNA, 25 bp, Mus musculus
cagtgcccgtggaatcttgcgctgc

SEQ ID NO: 252439 - DNA, 25 bp, Mus musculus
cagccggagttctggagaccacgga

SEQ ID NO: 252440 - DNA, 25 bp, Mus musculus
gcttggcccgctgttctccacaggc

SEQ ID NO: 252441 - DNA, 25 bp, Mus musculus
gtctgagtggccaggatgggactgc

SEQ ID NO: 252442 - DNA, 25 bp, Mus musculus
gactgcgctggctcaggcagtgccc

SEQ ID NO: 252443 - DNA, 25 bp, Mus musculus
ctagatgggcgaggccccagactgc

SEQ ID NO: 252444 - DNA, 25 bp, Mus musculus
cagggcgcccactgcgggcggaatt

SEQ ID NO: 252445 - DNA, 25 bp, Mus musculus
ccactgcgggcggaattcgggcagc

SEQ ID NO: 252446 - DNA, 25 bp, Mus musculus
cagcgcagccggagttctggagacc

SEQ ID NO: 252447 - DNA, 25 bp, Mus musculus
gcgcagccggagttctggagaccac

SEQ ID NO: 252448 - DNA, 25 bp, Mus musculus
tggtgtccgtcatgactcctgcgtt

SEQ ID NO: 252449 - DNA, 25 bp, Mus musculus
atgactcctgcgttcccggtcctgg

SEQ ID NO: 252450 - DNA, 25 bp, Mus musculus
atcccgagcccgctgtagctgcgat

SEQ ID NO: 252451 - DNA, 25 bp, Mus musculus
taacaaccaaggctcctagtgaagc

SEQ ID NO: 252452 - DNA, 25 bp, Mus musculus
ccagacctgggagctaacaaccaag

SEQ ID NO: 252453 - DNA, 25 bp, Mus musculus
acaagctgctcacgccggctgcagg

SEQ ID NO: 252454 - DNA, 25 bp, Mus musculus
acgcgcgctaggtacaagctgctca

SEQ ID NO: 252455 - DNA, 25 bp, Mus musculus
accgccactgtcgtgtgcgagaacg

SEQ ID NO: 252456 - DNA, 25 bp, Mus musculus
ccctctttcttgtggctggtgtccg

SEQ ID NO: 252457 - DNA, 25 bp, Mus musculus
agtggcgctcctacatttcttgaag

SEQ ID NO: 252458 - DNA, 25 bp, Mus musculus
tacccgtcgatgctgaaagtggcgc

SEQ ID NO: 252459 - DNA, 25 bp, Mus musculus
caccgatggtgaagctgtacccgtc

SEQ ID NO: 252460 - DNA, 25 bp, Mus musculus
ccggggtgcaaagttctcaccgatg

SEQ ID NO: 252461 - DNA, 25 bp, Mus musculus
gcactgtcactgcagacgcgcgcta

SEQ ID NO: 252462 - DNA, 25 bp, Mus musculus
accgcgccagcacggaggagacaga

SEQ ID NO: 252463 - DNA, 25 bp, Mus musculus
cgctgggttctagagtctttgagag

SEQ ID NO: 252464 - DNA, 25 bp, Mus musculus
aaggtctgaaagagccttgatgccc

SEQ ID NO: 252465 - DNA, 25 bp, Mus musculus
aaagagccttgatgcccgagtaccc

SEQ ID NO: 252466 - DNA, 25 bp, Mus musculus
cttgatgcccgagtacccgacgctg

SEQ ID NO: 252467 - DNA, 25 bp, Mus musculus
cccgacgctgggttctagagtcttt

SEQ ID NO: 252468 - DNA, 25 bp, Mus musculus
tctagagtctttgagagacgcggga

SEQ ID NO: 252469 - DNA, 25 bp, Mus musculus
agcagcgagcggcacttcttgatgc

SEQ ID NO: 252470 - DNA, 25 bp, Mus musculus
gcacttcttgatgcggcggcgacga

SEQ ID NO: 252471 - DNA, 25 bp, Mus musculus
atcccggctgcacgacggtgttgcg

SEQ ID NO: 252472 - DNA, 25 bp, Mus musculus
gacagctccgcgctctccaactttg

SEQ ID NO: 252473 - DNA, 25 bp, Mus musculus
atcccagcgggccaggtcgagatcc

SEQ ID NO: 252474 - DNA, 25 bp, Mus musculus
ccaggtcgagatcctcggggatccg

SEQ ID NO: 252475 - DNA, 25 bp, Mus musculus
cgacgatcccggctgcacgacggtg

SEQ ID NO: 252476 - DNA, 25 bp, Mus musculus
ccaccgacaggcaaaacggtctgtc

SEQ ID NO: 252477 - DNA, 25 bp, Mus musculus
tggaattgcagcaacccgaccgctc

SEQ ID NO: 252478 - DNA, 25 bp, Mus musculus
gcgactcatgacatcttactggcga

SEQ ID NO: 252479 - DNA, 25 bp, Mus musculus
atcttactggcgagctcaaaaaggc

SEQ ID NO: 252480 - DNA, 25 bp, Mus musculus
ctcaaaaaggccgagcacgtccttc

SEQ ID NO: 252481 - DNA, 25 bp, Mus musculus
cgagcacgtccttcactaagtggga

SEQ ID NO: 252482 - DNA, 25 bp, Mus musculus
cccagcgtggaattgcagcaacccg

SEQ ID NO: 252483 - DNA, 25 bp, Mus musculus
cagactttaaaattgcgcgcttccg

SEQ ID NO: 252484 - DNA, 25 bp, Mus musculus
aggacaccggcgcagactttaaaat

SEQ ID NO: 252485 - DNA, 25 bp, Mus musculus
cacgccggaagtggctaaggacacc

SEQ ID NO: 252486 - DNA, 25 bp, Mus musculus
agccgccatggccacgccggaagtg

SEQ ID NO: 252487 - DNA, 25 bp, Mus musculus
acaagacttttacctagtggcagga

SEQ ID NO: 252488 - DNA, 25 bp, Mus musculus
gcccagtgacgccaaggaccggaca

SEQ ID NO: 252489 - DNA, 25 bp, Mus musculus
gttcgtggtcgcgttagccgccatg

SEQ ID NO: 252490 - DNA, 25 bp, Mus musculus
cgagaggcccggacacacaccgccc

SEQ ID NO: 252491 - DNA, 25 bp, Mus musculus
actgctcgccgccgcagcgagggaa

SEQ ID NO: 252492 - DNA, 25 bp, Mus musculus
aggcacagactgacccggcgtggac

SEQ ID NO: 252493 - DNA, 25 bp, Mus musculus
catttgcgggccactaccagctagt

SEQ ID NO: 252494 - DNA, 25 bp, Mus musculus
aatgaccaacaggtacgggcgcgcg

SEQ ID NO: 252495 - DNA, 25 bp, Mus musculus
cactaccagctagtggccgcggggc

SEQ ID NO: 252496 - DNA, 25 bp, Mus musculus
ggtcaacgccgccatttgcgggcca

SEQ ID NO: 252497 - DNA, 25 bp, Mus musculus
gggcgtggtcaacgccgccatttgc

SEQ ID NO: 252498 - DNA, 25 bp, Mus musculus
ctcgcgagcctaggctggcgctctt

SEQ ID NO: 252499 - DNA, 25 bp, Mus musculus
ctagtccggctttggcgggccttag

SEQ ID NO: 252500 - DNA, 25 bp, Mus musculus
cgaggtttaaccacgccctctcaga

SEQ ID NO: 252501 - DNA, 25 bp, Mus musculus
cgcaccgtcctacccacgcgaggtt

SEQ ID NO: 252502 - DNA, 25 bp, Mus musculus
gggaccggccctcaaatcgactgct

SEQ ID NO: 252503 - DNA, 25 bp, Mus musculus
ggcggccggaatgaccaacaggtac

SEQ ID NO: 252504 - DNA, 25 bp, Mus musculus
ggcagaaaccgcaggaccttccagg

SEQ ID NO: 252505 - DNA, 25 bp, Mus musculus
ccagagaccttcctgggtggagctc

SEQ ID NO: 252506 - DNA, 25 bp, Mus musculus
tccctcatcgaaccggaagtgtctc

SEQ ID NO: 252507 - DNA, 25 bp, Mus musculus
tctcggtctttccagctggttgtca

SEQ ID NO: 252508 - DNA, 25 bp, Mus musculus
ggttgtcatttcactcggctcggtc

SEQ ID NO: 252509 - DNA, 25 bp, Mus musculus
tcggtcctgaggagaaggactcagc

SEQ ID NO: 252510 - DNA, 25 bp, Mus musculus
tccgcaacgacgacagctgggactg

SEQ ID NO: 252511 - DNA, 25 bp, Mus musculus
gcggcccagcaaccgtgaggagaaa

SEQ ID NO: 252512 - DNA, 25 bp, Mus musculus
aagaggcggctctgagatgaccaga

SEQ ID NO: 252513 - DNA, 25 bp, Mus musculus
ggggaggcttttctcctgtagagta

SEQ ID NO: 252514 - DNA, 25 bp, Mus musculus
actgagagaactgaacaaaccgccc

SEQ ID NO: 252515 - DNA, 25 bp, Mus musculus
ttatagtttccaatcagtctagggg

SEQ ID NO: 252516 - DNA, 25 bp, Mus musculus
gcttgcccttgtccagtctcgctaa

SEQ ID NO: 252517 - DNA, 25 bp, Mus musculus
ccggcggagaatcgaactgagagaa

SEQ ID NO: 252518 - DNA, 25 bp, Mus musculus
tgcgagccttggaatctgtagtttg

SEQ ID NO: 252519 - DNA, 25 bp, Mus musculus
ctgacatccgaaggctgccgctctg

SEQ ID NO: 252520 - DNA, 25 bp, Mus musculus
cctttgtttatctcttgcgagcctt

SEQ ID NO: 252521 - DNA, 25 bp, Mus musculus
tgacgcacttgtaagctccgctcgg

SEQ ID NO: 252522 - DNA, 25 bp, Mus musculus
gggtttccacacgaatgctcaagta

SEQ ID NO: 252523 - DNA, 25 bp, Mus musculus
gtgtctacccataaaggagctcttg

SEQ ID NO: 252524 - DNA, 25 bp, Mus musculus
tttggacgccggcacgttacgagct

SEQ ID NO: 252525 - DNA, 25 bp, Mus musculus
gctcttgaggaaaactcggtgtttg

SEQ ID NO: 252526 - DNA, 25 bp, Mus musculus
cgagccttgtgttccctgtcagtct

SEQ ID NO: 252527 - DNA, 25 bp, Mus musculus
cggctttcaccacaagaagggctgc

SEQ ID NO: 252528 - DNA, 25 bp, Mus musculus
ctccggcgagcgtccatggagaagt

SEQ ID NO: 252529 - DNA, 25 bp, Mus musculus
tgtagcgtcaggtgacagcccggaa

SEQ ID NO: 252530 - DNA, 25 bp, Mus musculus
cacatcgtggtggtcggctttcacc

SEQ ID NO: 252531 - DNA, 25 bp, Mus musculus
tgtcagtctccaccaacctgctggg

SEQ ID NO: 252532 - DNA, 25 bp, Mus musculus
gctcaccgcgcccttttcctctgcc

SEQ ID NO: 252533 - DNA, 25 bp, Mus musculus
acacgagccgggcaaaacagctctc

SEQ ID NO: 252534 - DNA, 25 bp, Mus musculus
ggcaaaacagctctccctcagaaag

SEQ ID NO: 252535 - DNA, 25 bp, Mus musculus
aacagctctccctcagaaaggacgc

SEQ ID NO: 252536 - DNA, 25 bp, Mus musculus
gccgcgccggaaacaccgcgcgctc

SEQ ID NO: 252537 - DNA, 25 bp, Mus musculus
ccgggctgcactcacgcggccgcac

SEQ ID NO: 252538 - DNA, 25 bp, Mus musculus
ggatccgggccgctcgcttccgccc

SEQ ID NO: 252539 - DNA, 25 bp, Mus musculus
cggccgcgacacgagccgggcaaaa

SEQ ID NO: 252540 - DNA, 25 bp, Mus musculus
ttcatctggctcaccgcgccctttt

SEQ ID NO: 252541 - DNA, 25 bp, Mus musculus
caccggaaagccaaaacaatcggag

SEQ ID NO: 252542 - DNA, 25 bp, Mus musculus
aagccaaaacaatcggagccgcgca

SEQ ID NO: 252543 - DNA, 25 bp, Mus musculus
ggtcgcccttctccggcggccgcga

SEQ ID NO: 252544 - DNA, 25 bp, Mus musculus
ccaaaacaatcggagccgcgcaggc

SEQ ID NO: 252545 - DNA, 25 bp, Mus musculus
cttccgcttcctcgcgcctcctggg

SEQ ID NO: 252546 - DNA, 25 bp, Mus musculus
cactacgtggggactttcctcgacg

SEQ ID NO: 252547 - DNA, 25 bp, Mus musculus
gtaggagtctccatatcgtctcttg

SEQ ID NO: 252548 - DNA, 25 bp, Mus musculus
atcgtctcttgggatccgcagtgct

SEQ ID NO: 252549 - DNA, 25 bp, Mus musculus
gcctggcagtcagagcgatcctctc

SEQ ID NO: 252550 - DNA, 25 bp, Mus musculus
cgggagacctttccacgtttgcatc

SEQ ID NO: 252551 - DNA, 25 bp, Mus musculus
ctggctgtgagctcggaacttcaga

SEQ ID NO: 252552 - DNA, 25 bp, Mus musculus
cggaacttcagatccagcagagctt

SEQ ID NO: 252553 - DNA, 25 bp, Mus musculus
tccagcagagcttcgtgcctgatga

SEQ ID NO: 252554 - DNA, 25 bp, Mus musculus
tcgtgcctgatgagtgtccgcgcac

SEQ ID NO: 252555 - DNA, 25 bp, Mus musculus
gcgcacggtgcacagtggcgacttc

SEQ ID NO: 252556 - DNA, 25 bp, Mus musculus
gtggcgacttcgtgcgctaccacta

SEQ ID NO: 252557 - DNA, 25 bp, Mus musculus
tcctcgacggccagaagttcgactc

SEQ ID NO: 252558 - DNA, 25 bp, Mus musculus
cgctgccacgtaggagtctccatat

SEQ ID NO: 252559 - DNA, 25 bp, Mus musculus
gccagaagttcgactccaggtaccc

SEQ ID NO: 252560 - DNA, 25 bp, Mus musculus
caaggtgaatatgtactgggccagc

SEQ ID NO: 252561 - DNA, 25 bp, Mus musculus
actgggccagcaccacgcctgctac

SEQ ID NO: 252562 - DNA, 25 bp, Mus musculus
cgcgagccgatgctcccgcactcac

SEQ ID NO: 252563 - DNA, 25 bp, Mus musculus
cgcactcaccatttcgatgatcttg

SEQ ID NO: 252564 - DNA, 25 bp, Mus musculus
ttcgatgatcttggtcttgcggccc

SEQ ID NO: 252565 - DNA, 25 bp, Mus musculus
gtcttgcggcccgtttttctcttca

SEQ ID NO: 252566 - DNA, 25 bp, Mus musculus
cacggccgcgcggtccattgacagg

SEQ ID NO: 252567 - DNA, 25 bp, Mus musculus
ctgacttcaggaaacgccgcaagga

SEQ ID NO: 252568 - DNA, 25 bp, Mus musculus
gacttcctctgaccctgacttcagg

SEQ ID NO: 252569 - DNA, 25 bp, Mus musculus
ggcgggacttcctctgaccctgact

SEQ ID NO: 252570 - DNA, 25 bp, Mus musculus
cgtccggaatcccgcccttatagtg

SEQ ID NO: 252571 - DNA, 25 bp, Mus musculus
gagactaagaggtccgcgtccggaa

SEQ ID NO: 252572 - DNA, 25 bp, Mus musculus
cggtccattgacaggcccgcgtgct

SEQ ID NO: 252573 - DNA, 25 bp, Mus musculus
cgtttttctcttcaaggtgaatatg

SEQ ID NO: 252574 - DNA, 25 bp, Mus musculus
ctgcggtagcagctggagttttcta

SEQ ID NO: 252575 - DNA, 25 bp, Mus musculus
cgcgagcctaggagagtgtgatatt

SEQ ID NO: 252576 - DNA, 25 bp, Mus musculus
agtgtgatattttctccgcgtttga

SEQ ID NO: 252577 - DNA, 25 bp, Mus musculus
ccgcgtttgatttctcagagggcca

SEQ ID NO: 252578 - DNA, 25 bp, Mus musculus
gttgagcctagtgttctgaactcca

SEQ ID NO: 252579 - DNA, 25 bp, Mus musculus
tgaactccacagcagattccgggcc

SEQ ID NO: 252580 - DNA, 25 bp, Mus musculus
ggccacgggagtgcaccgaaaactc

SEQ ID NO: 252581 - DNA, 25 bp, Mus musculus
cgtgtttttcggtcttagctctggc

SEQ ID NO: 252582 - DNA, 25 bp, Mus musculus
accggctggataaatgggactaaga

SEQ ID NO: 252583 - DNA, 25 bp, Mus musculus
gttagtgtctttcattcccaagagc

SEQ ID NO: 252584 - DNA, 25 bp, Mus musculus
gcttcagaatccaccagcccggata

SEQ ID NO: 252585 - DNA, 25 bp, Mus musculus
tgtgaatccggtacatatgcgcgcg

SEQ ID NO: 252586 - DNA, 25 bp, Mus musculus
atccctgcaagtggccgtgtttttc

SEQ ID NO: 252587 - DNA, 25 bp, Mus musculus
cgcgcgtgtgagtacgtgtatttac

SEQ ID NO: 252588 - DNA, 25 bp, Mus musculus
atggacgaagcagcgctcggaactt

SEQ ID NO: 252589 - DNA, 25 bp, Mus musculus
tgagtctcacctaagcggcttcttg

SEQ ID NO: 252590 - DNA, 25 bp, Mus musculus
ctgaccctagcataggggtcggccg

SEQ ID NO: 252591 - DNA, 25 bp, Mus musculus
ccttcctcgggccaaggcggcagat

SEQ ID NO: 252592 - DNA, 25 bp, Mus musculus
agcgctcggaacttcactgctctca

SEQ ID NO: 252593 - DNA, 25 bp, Mus musculus
caaggcggcagatgagtctcaccta

SEQ ID NO: 252594 - DNA, 25 bp, Mus musculus
agtaagcttctgatccgctggcggg

SEQ ID NO: 252595 - DNA, 25 bp, Mus musculus
ggcttcttggagagcggacacacca

SEQ ID NO: 252596 - DNA, 25 bp, Mus musculus
ggagagcggacacaccaggaactgc

SEQ ID NO: 252597 - DNA, 25 bp, Mus musculus
ctctggtcagagcagagcctggccc

SEQ ID NO: 252598 - DNA, 25 bp, Mus musculus
ggcacttgcagaaacctcccggcga

SEQ ID NO: 252599 - DNA, 25 bp, Mus musculus
cgactgcagacagtgcgcggagcct

SEQ ID NO: 252600 - DNA, 25 bp, Mus musculus
catggcggctcagaagatggacgaa

SEQ ID NO: 252601 - DNA, 25 bp, Mus musculus
ggatggcatccagggagtaagcttc

SEQ ID NO: 252602 - DNA, 25 bp, Mus musculus
gggcgagaccatgtcaaagagactc

SEQ ID NO: 252603 - DNA, 25 bp, Mus musculus
actgttctccaggaaggcttcgccg

SEQ ID NO: 252604 - DNA, 25 bp, Mus musculus
aggttcggctttttcgcgctagctg

SEQ ID NO: 252605 - DNA, 25 bp, Mus musculus
aatctctcggaaggacacggccacg

SEQ ID NO: 252606 - DNA, 25 bp, Mus musculus
aggcgtgcgttttctctagaatctc

SEQ ID NO: 252607 - DNA, 25 bp, Mus musculus
gatgtgcaagccactgttctccagg

SEQ ID NO: 252608 - DNA, 25 bp, Mus musculus
cgccttccaggaggtttgtccctgc

SEQ ID NO: 252609 - DNA, 25 bp, Mus musculus
cgtgagctttctaggcgtgcgtttt

SEQ ID NO: 252610 - DNA, 25 bp, Mus musculus
agagactcaagttccacctaggaga

SEQ ID NO: 252611 - DNA, 25 bp, Mus musculus
aatcccttcccagactatgaagccg

SEQ ID NO: 252612 - DNA, 25 bp, Mus musculus
aggaaaccggccgtgtctgccctct

SEQ ID NO: 252613 - DNA, 25 bp, Mus musculus
gtgaggccacctccgccaatggtag

SEQ ID NO: 252614 - DNA, 25 bp, Mus musculus
tgcgctgacgtcatcggcgtacgtc

SEQ ID NO: 252615 - DNA, 25 bp, Mus musculus
cgcgctagctgcatccagatgtgca

SEQ ID NO: 252616 - DNA, 25 bp, Mus musculus
tgtccctcctaccagctgcgggagg

SEQ ID NO: 252617 - DNA, 25 bp, Mus musculus
ctccaaaggcagaaatgtccctgtc

SEQ ID NO: 252618 - DNA, 25 bp, Mus musculus
cgtcacaggatgtcgcagttcagtc

SEQ ID NO: 252619 - DNA, 25 bp, Mus musculus
gtttccgcggcttcacaacagtaca

SEQ ID NO: 252620 - DNA, 25 bp, Mus musculus
tgggatttttctcctcgcctctaaa

SEQ ID NO: 252621 - DNA, 25 bp, Mus musculus
actccggggatacgagctgaagccg

SEQ ID NO: 252622 - DNA, 25 bp, Mus musculus
aaagcctgcacttcatctccaaagg

SEQ ID NO: 252623 - DNA, 25 bp, Mus musculus
tgtggacacgcacaaaggtccctcc

SEQ ID NO: 252624 - DNA, 25 bp, Mus musculus
ctcgtgggctcggagcctgcaaagt

SEQ ID NO: 252625 - DNA, 25 bp, Mus musculus
tgtacggccagctcagggccagtcc

SEQ ID NO: 252626 - DNA, 25 bp, Mus musculus
atggctccagcgaggaccgtccgaa

SEQ ID NO: 252627 - DNA, 25 bp, Mus musculus
cccgagcaagcagcgagagggaaac

SEQ ID NO: 252628 - DNA, 25 bp, Mus musculus
tcccggggacgcaagcccgagcaag

SEQ ID NO: 252629 - DNA, 25 bp, Mus musculus
ctgcaaagtctgtggagcgcgctgc

SEQ ID NO: 252630 - DNA, 25 bp, Mus musculus
gcgcgagctgacgtcacggcggtcg

SEQ ID NO: 252631 - DNA, 25 bp, Mus musculus
cgaggcttcttatcgcaggtcagcg

SEQ ID NO: 252632 - DNA, 25 bp, Mus musculus
aagctccgggagtgtgctaggcgcc

SEQ ID NO: 252633 - DNA, 25 bp, Mus musculus
gcagacgctcctggcgggcgagcgt

SEQ ID NO: 252634 - DNA, 25 bp, Mus musculus
tgggaccggcttctcctgccggcga

SEQ ID NO: 252635 - DNA, 25 bp, Mus musculus
gtccagctgctcctgggaccggctt

SEQ ID NO: 252636 - DNA, 25 bp, Mus musculus
atgtgtccagctgctcctgggaccg

SEQ ID NO: 252637 - DNA, 25 bp, Mus musculus
cacatgtgtccagctgctcctggga

SEQ ID NO: 252638 - DNA, 25 bp, Mus musculus
caggagcctgtgcagcacaggaagc

SEQ ID NO: 252639 - DNA, 25 bp, Mus musculus
ccgtccaggagcctgtgcagcacag

SEQ ID NO: 252640 - DNA, 25 bp, Mus musculus
cgctctccgccctccgtccaggagc

SEQ ID NO: 252641 - DNA, 25 bp, Mus musculus
ttatcgcaggtcagcgccttgcctc

SEQ ID NO: 252642 - DNA, 25 bp, Mus musculus
cttcttatcgcaggtcagcgccttg

SEQ ID NO: 252643 - DNA, 25 bp, Mus musculus
gcaggtctgagtgtgtgcgagttct

SEQ ID NO: 252644 - DNA, 25 bp, Mus musculus
ccctggagcaggtgtgtggactgaa

SEQ ID NO: 252645 - DNA, 25 bp, Mus musculus
ctgtccgcagctccctgtcgccgag

SEQ ID NO: 252646 - DNA, 25 bp, Mus musculus
gccaccattggccaggcgggaagtc

SEQ ID NO: 252647 - DNA, 25 bp, Mus musculus
cgggaagtcggtctcccagctcatt

SEQ ID NO: 252648 - DNA, 25 bp, Mus musculus
agtcggtctcccagctcattctgcg

SEQ ID NO: 252649 - DNA, 25 bp, Mus musculus
cagctcattctgcgcccgcgggagt

SEQ ID NO: 252650 - DNA, 25 bp, Mus musculus
ggaaacttcattattactgtgacgc

SEQ ID NO: 252651 - DNA, 25 bp, Mus musculus
ttattactgtgacgctgaaggccgg

SEQ ID NO: 252652 - DNA, 25 bp, Mus musculus
tcccggctctgcttagccgcttagc

SEQ ID NO: 252653 - DNA, 25 bp, Mus musculus
ggtgacctccctgcgtgaagagcat

SEQ ID NO: 252654 - DNA, 25 bp, Mus musculus
ctccctgcgtgaagagcatcgcggc

SEQ ID NO: 252655 - DNA, 25 bp, Mus musculus
acctggtgtctggtgcagacgccgc

SEQ ID NO: 252656 - DNA, 25 bp, Mus musculus
acctggggagactcgctcgtgctgc

SEQ ID NO: 252657 - DNA, 25 bp, Mus musculus
cctgcgtgaagagcatcgcggcgcc

SEQ ID NO: 252658 - DNA, 25 bp, Mus musculus
tcccgggtctgacaactgctttgta

SEQ ID NO: 252659 - DNA, 25 bp, Mus musculus
gggacagtgccttcggcccagaaaa

SEQ ID NO: 252660 - DNA, 25 bp, Mus musculus
ccgttgctaccaaggtccggaatca

SEQ ID NO: 252661 - DNA, 25 bp, Mus musculus
atcctgcgatcggagacattgctgc

SEQ ID NO: 252662 - DNA, 25 bp, Mus musculus
tccggaatcatgaagggccctctct

SEQ ID NO: 252663 - DNA, 25 bp, Mus musculus
tctctcgcgccggaagttcgaacca

SEQ ID NO: 252664 - DNA, 25 bp, Mus musculus
gtaatccgagcccaagtcccatttg

SEQ ID NO: 252665 - DNA, 25 bp, Mus musculus
gtcccatttgactgaaggccttctg

SEQ ID NO: 252666 - DNA, 25 bp, Mus musculus
cgcggtcgcagagcaactatctaca

SEQ ID NO: 252667 - DNA, 25 bp, Mus musculus
ggtccttctggctacttggcgcatt

SEQ ID NO: 252668 - DNA, 25 bp, Mus musculus
acgcctgggaactgcgtagtccttc

SEQ ID NO: 252669 - DNA, 25 bp, Mus musculus
agtccttcgaggtacagaatcagtc

SEQ ID NO: 252670 - DNA, 25 bp, Mus musculus
aactgcccattgttccgcgaggaga

SEQ ID NO: 252671 - DNA, 25 bp, Mus musculus
ttggcctgagtctgaaaaatcctgc

SEQ ID NO: 252672 - DNA, 25 bp, Mus musculus
gcactgtcaccggtcgcggcatctt

SEQ ID NO: 252673 - DNA, 25 bp, Mus musculus
gcttctgcagctttttgagcgccag

SEQ ID NO: 252674 - DNA, 25 bp, Mus musculus
tttgagcgccagaacccggcatttc

SEQ ID NO: 252675 - DNA, 25 bp, Mus musculus
atttcacggaattgggcaagctctc

SEQ ID NO: 252676 - DNA, 25 bp, Mus musculus
gtccctgcttctcggggtcggccat

SEQ ID NO: 252677 - DNA, 25 bp, Mus musculus
ctcagctgggcttgtttgccgcagt

SEQ ID NO: 252678 - DNA, 25 bp, Mus musculus
tgcgcagtctgcaatagagctggtc

SEQ ID NO: 252679 - DNA, 25 bp, Mus musculus
tagagctggtccagagaggtcctgc

SEQ ID NO: 252680 - DNA, 25 bp, Mus musculus
tgcagctgtgattgcggctggtcca

SEQ ID NO: 252681 - DNA, 25 bp, Mus musculus
ctggtccagagtgcgtctgaagatg

SEQ ID NO: 252682 - DNA, 25 bp, Mus musculus
tgaagatgcggcaaacgctgacggc

SEQ ID NO: 252683 - DNA, 25 bp, Mus musculus
aaacgctgacggctgtggtgacgtc

SEQ ID NO: 252684 - DNA, 25 bp, Mus musculus
cgatcttatcgcagcgcttctgcag

SEQ ID NO: 252685 - DNA, 25 bp, Mus musculus
ccatggctactgctcggctcagctg

SEQ ID NO: 252686 - DNA, 25 bp, Mus musculus
ccgtgagccacacgctgggtgtccg

SEQ ID NO: 252687 - DNA, 25 bp, Mus musculus
gccctctgctggtctcagccgtgag

SEQ ID NO: 252688 - DNA, 25 bp, Mus musculus
ccagcgtccggctcggagcttgctg

SEQ ID NO: 252689 - DNA, 25 bp, Mus musculus
gcctccgactttcacccagcgtccg

SEQ ID NO: 252690 - DNA, 25 bp, Mus musculus
ggccgtgaccctctgcctccgactt

SEQ ID NO: 252691 - DNA, 25 bp, Mus musculus
accagtcgctcgctgtagggctgcg

SEQ ID NO: 252692 - DNA, 25 bp, Mus musculus
cgcctggtgaccagtcgctcgctgt

SEQ ID NO: 252693 - DNA, 25 bp, Mus musculus
atgcccgcaccctgcttcccggcgt

SEQ ID NO: 252694 - DNA, 25 bp, Mus musculus
ctctgctggctctgcgttctggccg

SEQ ID NO: 252695 - DNA, 25 bp, Mus musculus
acttcgctggggacttcctctgctg

SEQ ID NO: 252696 - DNA, 25 bp, Mus musculus
gtcgacttcgctggggacttcctct

SEQ ID NO: 252697 - DNA, 25 bp, Mus musculus
tccgttgcgcgctcgctctgcggtg

SEQ ID NO: 252698 - DNA, 25 bp, Mus musculus
ggtctcagccgtgagccacacgctg

SEQ ID NO: 252699 - DNA, 25 bp, Mus musculus
tcgccgacaacacgttcctgcgggg

SEQ ID NO: 252700 - DNA, 25 bp, Mus musculus
actgagattactatgccaagagctg

SEQ ID NO: 252701 - DNA, 25 bp, Mus musculus
gctgctgggtgacttgagcagtccc

SEQ ID NO: 252702 - DNA, 25 bp, Mus musculus
gccacactgctgctgggtgacttga

SEQ ID NO: 252703 - DNA, 25 bp, Mus musculus
tggctctgccacactgctgctgggt

SEQ ID NO: 252704 - DNA, 25 bp, Mus musculus
ctgcgcgatcaggaactgagattac

SEQ ID NO: 252705 - DNA, 25 bp, Mus musculus
tagtcgattcccagccctggctctg

SEQ ID NO: 252706 - DNA, 25 bp, Mus musculus
attactatgccaagagctgaggcgg

SEQ ID NO: 252707 - DNA, 25 bp, Mus musculus
ggcggagaccagcagcttctacgct

SEQ ID NO: 252708 - DNA, 25 bp, Mus musculus
agcttctacgctgggcggtgagcca

SEQ ID NO: 252709 - DNA, 25 bp, Mus musculus
tggagttcacgtgcgggcagatcca

SEQ ID NO: 252710 - DNA, 25 bp, Mus musculus
gtgctgggcttctagtcgattccca

SEQ ID NO: 252711 - DNA, 25 bp, Mus musculus
cgggcagatccacgccagctaggcg

SEQ ID NO: 252712 - DNA, 25 bp, Mus musculus
ctgtctgcgcggtgctgggcttcta

SEQ ID NO: 252713 - DNA, 25 bp, Mus musculus
ccagctctgcgcgatcaggaactga

SEQ ID NO: 252714 - DNA, 25 bp, Mus musculus
agctccaaggtagcgacgcggtgca

SEQ ID NO: 252715 - DNA, 25 bp, Mus musculus
cccgcgctgacagcaggtggctgtc

SEQ ID NO: 252716 - DNA, 25 bp, Mus musculus
actgagcgcgaccaggtgactctcc

SEQ ID NO: 252717 - DNA, 25 bp, Mus musculus
tccggagcccgccacgtagagtgga

SEQ ID NO: 252718 - DNA, 25 bp, Mus musculus
ccacgtagagtggacggattgcttt

SEQ ID NO: 252719 - DNA, 25 bp, Mus musculus
ggacggattgctttgtggcgcaccc

SEQ ID NO: 252720 - DNA, 25 bp, Mus musculus
gtgctcctgcgtgtgttctcgcgcc

SEQ ID NO: 252721 - DNA, 25 bp, Mus musculus
ctcacctttgggcttgaatcttagg

SEQ ID NO: 252722 - DNA, 25 bp, Mus musculus
tgaatcttagggactcgcgcacacg

SEQ ID NO: 252723 - DNA, 25 bp, Mus musculus
actgcgaagctctggcggagcagcc

SEQ ID NO: 252724 - DNA, 25 bp, Mus musculus
gaatgactgactgcgaagctctggc

SEQ ID NO: 252725 - DNA, 25 bp, Mus musculus
tcccatcctcgctcagaatgactga

SEQ ID NO: 252726 - DNA, 25 bp, Mus musculus
gcagcgctgtcccattcttcagcgt

SEQ ID NO: 252727 - DNA, 25 bp, Mus musculus
ggaccagcccgcagctccaaggtag

SEQ ID NO: 252728 - DNA, 25 bp, Mus musculus
tggaccgcttaagagaatatctacg

SEQ ID NO: 252729 - DNA, 25 bp, Mus musculus
gcccgtgcctcttctgtgaccagaa

SEQ ID NO: 252730 - DNA, 25 bp, Mus musculus
ggggaaagctgcactcaactctatc

SEQ ID NO: 252731 - DNA, 25 bp, Mus musculus
gacctcaaactctgtggaccgctta

SEQ ID NO: 252732 - DNA, 25 bp, Mus musculus
cgtcttggaagcaaagtcgtggtca

SEQ ID NO: 252733 - DNA, 25 bp, Mus musculus
tgtccttctgttggtctcgaacctg

SEQ ID NO: 252734 - DNA, 25 bp, Mus musculus
cctggcgaccgctgattctatcatc

SEQ ID NO: 252735 - DNA, 25 bp, Mus musculus
tccacatcggtaagacagggcttct

SEQ ID NO: 252736 - DNA, 25 bp, Mus musculus
gtggcttgtggcgactttccctaac

SEQ ID NO: 252737 - DNA, 25 bp, Mus musculus
tttccttggctgtgatctctgcttc

SEQ ID NO: 252738 - DNA, 25 bp, Mus musculus
cacgggctcagctttccctaagcag

SEQ ID NO: 252739 - DNA, 25 bp, Mus musculus
tcccggatgtacatttgagccatta

SEQ ID NO: 252740 - DNA, 25 bp, Mus musculus
cagccaaggctggatacatttttta

SEQ ID NO: 252741 - DNA, 25 bp, Mus musculus
cggcatcggaggatggaagttttcc

SEQ ID NO: 252742 - DNA, 25 bp, Mus musculus
ggcacttttcaggacggcatgcgta

SEQ ID NO: 252743 - DNA, 25 bp, Mus musculus
tctcgactggtgagacaggcacttt

SEQ ID NO: 252744 - DNA, 25 bp, Mus musculus
cgactggtgagacaggcacttttca

SEQ ID NO: 252745 - DNA, 25 bp, Mus musculus
tgagacaggcacttttcaggacggc

SEQ ID NO: 252746 - DNA, 25 bp, Mus musculus
gacaggtcgagtctccagccgccgg

SEQ ID NO: 252747 - DNA, 25 bp, Mus musculus
ccgcaggacaggtcgagtctccagc

SEQ ID NO: 252748 - DNA, 25 bp, Mus musculus
gcccagatcccgcaggacaggtcga

SEQ ID NO: 252749 - DNA, 25 bp, Mus musculus
cgcggcttccttagcggcgcctccc

SEQ ID NO: 252750 - DNA, 25 bp, Mus musculus
tcatccggcggtccgctggcagtgc

SEQ ID NO: 252751 - DNA, 25 bp, Mus musculus
atagaccagggtcatccggcggtcc

SEQ ID NO: 252752 - DNA, 25 bp, Mus musculus
ggcatgcgtatagaccagggtcatc

SEQ ID NO: 252753 - DNA, 25 bp, Mus musculus
acggcatgcgtatagaccagggtca

SEQ ID NO: 252754 - DNA, 25 bp, Mus musculus
gacaggcacttttcaggacggcatg

SEQ ID NO: 252755 - DNA, 25 bp, Mus musculus
tttcaggacggcatgcgtatagacc

SEQ ID NO: 252756 - DNA, 25 bp, Mus musculus
gttgctgcagactcccaatgtcgga

SEQ ID NO: 252757 - DNA, 25 bp, Mus musculus
tcaacgctctgtcggagttgctgca

SEQ ID NO: 252758 - DNA, 25 bp, Mus musculus
tggcccagatctacatcaacgctct

SEQ ID NO: 252759 - DNA, 25 bp, Mus musculus
cttcgaccagctgcgcaacgttatc

SEQ ID NO: 252760 - DNA, 25 bp, Mus musculus
atgcacgggctgaaccacgccttcg

SEQ ID NO: 252761 - DNA, 25 bp, Mus musculus
gtcaaagtacgggaacagctgtgca

SEQ ID NO: 252762 - DNA, 25 bp, Mus musculus
tatctgctgcattctcccgagctgg

SEQ ID NO: 252763 - DNA, 25 bp, Mus musculus
aactgtccctcctggatagcaccga

SEQ ID NO: 252764 - DNA, 25 bp, Mus musculus
tgcaggcgagagaccttcccgtcta

SEQ ID NO: 252765 - DNA, 25 bp, Mus musculus
tgtcccgcctgctgcatgcagaaga

SEQ ID NO: 252766 - DNA, 25 bp, Mus musculus
ctccgagccattgcagtgcgatgtc

SEQ ID NO: 252767 - DNA, 25 bp, Mus musculus
cgcccacagcttcctgcaaaaatga

SEQ ID NO: 252768 - DNA, 25 bp, Mus musculus
agaagcttcgttgcacgcgacctgg

SEQ ID NO: 252769 - DNA, 25 bp, Mus musculus
actgggttgccagcacctcctctaa

SEQ ID NO: 252770 - DNA, 25 bp, Mus musculus
cccgccagaaaaggagcatgcttaa

SEQ ID NO: 252771 - DNA, 25 bp, Mus musculus
ctccctaacagacgcctggcataga

SEQ ID NO: 252772 - DNA, 25 bp, Mus musculus
catcccgcgcgggtggggaccacaa

SEQ ID NO: 252773 - DNA, 25 bp, Mus musculus
caaggatcgggaagccagcgcatcc

SEQ ID NO: 252774 - DNA, 25 bp, Mus musculus
cctgaagcagtgaaccagcaaggat

SEQ ID NO: 252775 - DNA, 25 bp, Mus musculus
aaggagcatgcttaagccagagtca

SEQ ID NO: 252776 - DNA, 25 bp, Mus musculus
ggctccggcacctgaagcagtgaac

SEQ ID NO: 252777 - DNA, 25 bp, Mus musculus
gccagagtcaagcaaagcctagggg

SEQ ID NO: 252778 - DNA, 25 bp, Mus musculus
cacgcgctgtcagctggtgagcgca

SEQ ID NO: 252779 - DNA, 25 bp, Mus musculus
tgagcgcactcgctttcaggccgct

SEQ ID NO: 252780 - DNA, 25 bp, Mus musculus
gagctgagcggccacatttaacacc

SEQ ID NO: 252781 - DNA, 25 bp, Mus musculus
gcggccacatttaacaccgtcgtca

SEQ ID NO: 252782 - DNA, 25 bp, Mus musculus
tggggaccacaagcgctccctaaca

SEQ ID NO: 252783 - DNA, 25 bp, Mus musculus
cccaccggcagagtttacagaagcc

SEQ ID NO: 252784 - DNA, 25 bp, Mus musculus
aggtcccgcaggttgcccgacagga

SEQ ID NO: 252785 - DNA, 25 bp, Mus musculus
ggccagatgggcctcgcttaatcta

SEQ ID NO: 252786 - DNA, 25 bp, Mus musculus
ggcctcgcttaatctacgtgacccg

SEQ ID NO: 252787 - DNA, 25 bp, Mus musculus
caccgccatggcgtgtggcagctga

SEQ ID NO: 252788 - DNA, 25 bp, Mus musculus
tctccgaggtttcggccatcgaggc

SEQ ID NO: 252789 - DNA, 25 bp, Mus musculus
ggcccgctgtgcctcaaagcaagca

SEQ ID NO: 252790 - DNA, 25 bp, Mus musculus
gtgcctcaaagcaagcagcggtgga

SEQ ID NO: 252791 - DNA, 25 bp, Mus musculus
aggagagcggcccactggctcccag

SEQ ID NO: 252792 - DNA, 25 bp, Mus musculus
ccctttccagcggaggtcgagagcg

SEQ ID NO: 252793 - DNA, 25 bp, Mus musculus
agcaagcagcgcaagcaggtggcac

SEQ ID NO: 252794 - DNA, 25 bp, Mus musculus
cccagccgcagtgggcaaaggccag

SEQ ID NO: 252795 - DNA, 25 bp, Mus musculus
cgcgccattttgtgcgcgcggcttc

SEQ ID NO: 252796 - DNA, 25 bp, Mus musculus
tgactgggcagctcccgcgccattt

SEQ ID NO: 252797 - DNA, 25 bp, Mus musculus
atcgtcctgtcagcggcctgctgct

SEQ ID NO: 252798 - DNA, 25 bp, Mus musculus
cccgtgtggcctaacaaagcacagc

SEQ ID NO: 252799 - DNA, 25 bp, Mus musculus
cggcgcgctcagacatttttctgac

SEQ ID NO: 252800 - DNA, 25 bp, Mus musculus
taacaaagcacagccggaaccgggc

SEQ ID NO: 252801 - DNA, 25 bp, Mus musculus
gcatttggccgggactgcaatccgc

SEQ ID NO: 252802 - DNA, 25 bp, Mus musculus
agcctgccaggctgtaagtgcgtgc

SEQ ID NO: 252803 - DNA, 25 bp, Mus musculus
ttgttccaacgaggagcctgccagg

SEQ ID NO: 252804 - DNA, 25 bp, Mus musculus
ttgtccacctttgttccaacgagga

SEQ ID NO: 252805 - DNA, 25 bp, Mus musculus
attattttgttcttgtccacctttg

SEQ ID NO: 252806 - DNA, 25 bp, Mus musculus
cagcgctgccttggaaggtcccggc

SEQ ID NO: 252807 - DNA, 25 bp, Mus musculus
tgcgtcatcactacgcgctccgtgg

SEQ ID NO: 252808 - DNA, 25 bp, Mus musculus
gggctgcgtgttgcgtcatcactac

SEQ ID NO: 252809 - DNA, 25 bp, Mus musculus
gaccacgcgacgcttgggagaacaa

SEQ ID NO: 252810 - DNA, 25 bp, Mus musculus
cgtcgcctccctcaaagaattattt

SEQ ID NO: 252811 - DNA, 25 bp, Mus musculus
catttttctgaccacgcgacgcttg

SEQ ID NO: 252812 - DNA, 25 bp, Mus musculus
ctggtagtctatgtggtgacccgca

SEQ ID NO: 252813 - DNA, 25 bp, Mus musculus
aacttgaccgcggagcagctctcgg

SEQ ID NO: 252814 - DNA, 25 bp, Mus musculus
gctgcttcggctgcacaacctgacg

SEQ ID NO: 252815 - DNA, 25 bp, Mus musculus
tgcacaacctgacgcgcgctcagtt

SEQ ID NO: 252816 - DNA, 25 bp, Mus musculus
cgcgctcagttcatcgcgcactatg

SEQ ID NO: 252817 - DNA, 25 bp, Mus musculus
atcgcgcactatgggctgcggccac

SEQ ID NO: 252818 - DNA, 25 bp, Mus musculus
cctgctggtcggcatgctcatcttt

SEQ ID NO: 252819 - DNA, 25 bp, Mus musculus
ggtcaccatgctccagaacgtctcg

SEQ ID NO: 252820 - DNA, 25 bp, Mus musculus
tggcactcagcgacctgctcatcgt

SEQ ID NO: 252821 - DNA, 25 bp, Mus musculus
cgctcttcggcaacgccctggtagt

SEQ ID NO: 252822 - DNA, 25 bp, Mus musculus
gtgacccgcagcaaggccatgcgca

SEQ ID NO: 252823 - DNA, 25 bp, Mus musculus
agcccggcatgtcgtggaacttgac

SEQ ID NO: 252824 - DNA, 25 bp, Mus musculus
atcgtcttcttctgcatcccggtca

SEQ ID NO: 252825 - DNA, 25 bp, Mus musculus
tcatctttgccctggcgctcttcgg

SEQ ID NO: 252826 - DNA, 25 bp, Mus musculus
tagccctgactagacactgactttg

SEQ ID NO: 252827 - DNA, 25 bp, Mus musculus
agactctctagaacacggacgtggg

SEQ ID NO: 252828 - DNA, 25 bp, Mus musculus
ggacctgggctttttccgcaccaca

SEQ ID NO: 252829 - DNA, 25 bp, Mus musculus
tccctaagctgggtggtctaggtcc

SEQ ID NO: 252830 - DNA, 25 bp, Mus musculus
cgcagaccagcatccttagagaaac

SEQ ID NO: 252831 - DNA, 25 bp, Mus musculus
ccgggttcaaagtcctccatatgtg

SEQ ID NO: 252832 - DNA, 25 bp, Mus musculus
cctcggttcgtggatcctggtattt

SEQ ID NO: 252833 - DNA, 25 bp, Mus musculus
ctaggtcccgctcatactttccgaa

SEQ ID NO: 252834 - DNA, 25 bp, Mus musculus
ttacatttgccctagcgtgcacgtc

SEQ ID NO: 252835 - DNA, 25 bp, Mus musculus
gcccgccacaaagttgggacacttg

SEQ ID NO: 252836 - DNA, 25 bp, Mus musculus
tggaagtttgcagcgcccgccacaa

SEQ ID NO: 252837 - DNA, 25 bp, Mus musculus
aggtgcatcctcacacagggaaagg

SEQ ID NO: 252838 - DNA, 25 bp, Mus musculus
gcatttgcatctaagggctggttta

SEQ ID NO: 252839 - DNA, 25 bp, Mus musculus
tgggtctgcgaagcttacaggactc

SEQ ID NO: 252840 - DNA, 25 bp, Mus musculus
gggcatgtacgtaccagacaggttc

SEQ ID NO: 252841 - DNA, 25 bp, Mus musculus
gccacaaactttgggccaatcagcg

SEQ ID NO: 252842 - DNA, 25 bp, Mus musculus
cggcgccacaaactttgggccaatc

SEQ ID NO: 252843 - DNA, 25 bp, Mus musculus
gggattctgggagccgagctcattt

SEQ ID NO: 252844 - DNA, 25 bp, Mus musculus
ttctgggagccgagctcatttcctc

SEQ ID NO: 252845 - DNA, 25 bp, Mus musculus
tgggagccgagctcatttcctcctc

SEQ ID NO: 252846 - DNA, 25 bp, Mus musculus
gaggatgctgggcatgtacgtacca

SEQ ID NO: 252847 - DNA, 25 bp, Mus musculus
gtacgtaccagacaggttcgccctg

SEQ ID NO: 252848 - DNA, 25 bp, Mus musculus
taccagacaggttcgccctgaagtc

SEQ ID NO: 252849 - DNA, 25 bp, Mus musculus
acaggttcgccctgaagtcgtcccg

SEQ ID NO: 252850 - DNA, 25 bp, Mus musculus
ctgaagtcgtcccgggtccaggacg

SEQ ID NO: 252851 - DNA, 25 bp, Mus musculus
tccaggacgggatggggctctacac

SEQ ID NO: 252852 - DNA, 25 bp, Mus musculus
gtgtctggttgtctttcgcggctgt

SEQ ID NO: 252853 - DNA, 25 bp, Mus musculus
cccatctccacgtgcggcgcctccg

SEQ ID NO: 252854 - DNA, 25 bp, Mus musculus
ccgagtttttctgtgagtgctgagc

SEQ ID NO: 252855 - DNA, 25 bp, Mus musculus
cgctaggacggaaccacggatcctc

SEQ ID NO: 252856 - DNA, 25 bp, Mus musculus
cactctgcgcttgctcattcggtca

SEQ ID NO: 252857 - DNA, 25 bp, Mus musculus
agccagggccggatacaagtcgctt

SEQ ID NO: 252858 - DNA, 25 bp, Mus musculus
ttaacccgtggtgcaactgggcata

SEQ ID NO: 252859 - DNA, 25 bp, Mus musculus
agagacccggctctctaatgtggga

SEQ ID NO: 252860 - DNA, 25 bp, Mus musculus
gggattcggagttacaaagccagcc

SEQ ID NO: 252861 - DNA, 25 bp, Mus musculus
ttagggctcattacgcctgcgcacc

SEQ ID NO: 252862 - DNA, 25 bp, Mus musculus
ggcgggctgcgtagttatttttgaa

SEQ ID NO: 252863 - DNA, 25 bp, Mus musculus
tagaagccattagggcgccgtctgc

SEQ ID NO: 252864 - DNA, 25 bp, Mus musculus
ttggtagtgttctccgttcgatcta

SEQ ID NO: 252865 - DNA, 25 bp, Mus musculus
ttcgatctagtgatggcacagcagc

SEQ ID NO: 252866 - DNA, 25 bp, Mus musculus
cgagagcaaggcatcaccctgcgtg

SEQ ID NO: 252867 - DNA, 25 bp, Mus musculus
agcgcagaaatcgtggccgagtttt

SEQ ID NO: 252868 - DNA, 25 bp, Mus musculus
agcgagctgcaccaacccagccgcg

SEQ ID NO: 252869 - DNA, 25 bp, Mus musculus
gtggagagaattcgggtgacacttc

SEQ ID NO: 252870 - DNA, 25 bp, Mus musculus
gtgacacttcacgagggaccctgcg

SEQ ID NO: 252871 - DNA, 25 bp, Mus musculus
aaggagctgatcgtggagagaattc

SEQ ID NO: 252872 - DNA, 25 bp, Mus musculus
cctcggtactgggtcttcacagggg

SEQ ID NO: 252873 - DNA, 25 bp, Mus musculus
gcagcctcggtactgggtcttcaca

SEQ ID NO: 252874 - DNA, 25 bp, Mus musculus
ccgatctctagacgcgcgtgggttg

SEQ ID NO: 252875 - DNA, 25 bp, Mus musculus
tcctccgatctctagacgcgcgtgg

SEQ ID NO: 252876 - DNA, 25 bp, Mus musculus
ctgggtctgcgtagctgcctcgctc

SEQ ID NO: 252877 - DNA, 25 bp, Mus musculus
gcccacagacgcgagagcccgctgg

SEQ ID NO: 252878 - DNA, 25 bp, Mus musculus
tcgccgctacttcggggccgcctgt

SEQ ID NO: 252879 - DNA, 25 bp, Mus musculus
tgagtgccaaggtagcgccgggacc

SEQ ID NO: 252880 - DNA, 25 bp, Mus musculus
cgacgacggcgaagagtgagtgcca

SEQ ID NO: 252881 - DNA, 25 bp, Mus musculus
gttgggcgcggcgaccacgtcccat

SEQ ID NO: 252882 - DNA, 25 bp, Mus musculus
ggcggctttcacttcctccttgtcg

SEQ ID NO: 252883 - DNA, 25 bp, Mus musculus
tctggtgcaggctaataaagttttc

SEQ ID NO: 252884 - DNA, 25 bp, Mus musculus
tctcctttcaagtcaggcggtgctg

SEQ ID NO: 252885 - DNA, 25 bp, Mus musculus
ctccgctgtgcaaattctgggtctt

SEQ ID NO: 252886 - DNA, 25 bp, Mus musculus
cagacggacccttgctggaagctgc

SEQ ID NO: 252887 - DNA, 25 bp, Mus musculus
gtcccttggcttccgagatagcgtg

SEQ ID NO: 252888 - DNA, 25 bp, Mus musculus
tacgttgtctgagtgagggattacc

SEQ ID NO: 252889 - DNA, 25 bp, Mus musculus
tagtaagtgtctccgaggcctcagc

SEQ ID NO: 252890 - DNA, 25 bp, Mus musculus
tgtctctgacagaaggccctccgct

SEQ ID NO: 252891 - DNA, 25 bp, Mus musculus
ttaccgagtggtcagaagttaggcg

SEQ ID NO: 252892 - DNA, 25 bp, Mus musculus
tccttgtcggagctgtatccgggtc

SEQ ID NO: 252893 - DNA, 25 bp, Mus musculus
gggtcgctgttctccctattgtctc

SEQ ID NO: 252894 - DNA, 25 bp, Mus musculus
tcggtagctgctctccgaccggtct

SEQ ID NO: 252895 - DNA, 25 bp, Mus musculus
cctcacggattccttagtaagtgtc

SEQ ID NO: 252896 - DNA, 25 bp, Mus musculus
cagcgttcagctcggacaaggtcca

SEQ ID NO: 252897 - DNA, 25 bp, Mus musculus
gtcgttctccagtagcagcagctca

SEQ ID NO: 252898 - DNA, 25 bp, Mus musculus
aggatgttgatgtcgttctcgcagc

SEQ ID NO: 252899 - DNA, 25 bp, Mus musculus
tggaggccacccacgagcttagaca

SEQ ID NO: 252900 - DNA, 25 bp, Mus musculus
tcatattgcaagtgcgagtccctcc

SEQ ID NO: 252901 - DNA, 25 bp, Mus musculus
tggatctgcagagccacatcccggt

SEQ ID NO: 252902 - DNA, 25 bp, Mus musculus
acatcccggtcgtcgtcttcgtcag

SEQ ID NO: 252903 - DNA, 25 bp, Mus musculus
tcttcgtcagcagccagcaggcaca

SEQ ID NO: 252904 - DNA, 25 bp, Mus musculus
agcaggcacagtaccacgttatcgg

SEQ ID NO: 252905 - DNA, 25 bp, Mus musculus
ggccacttacacgttgagcagcttg

SEQ ID NO: 252906 - DNA, 25 bp, Mus musculus
ctcgtacacgccgaccgtaatggtg

SEQ ID NO: 252907 - DNA, 25 bp, Mus musculus
ggcaggcacacttacctttcggtct

SEQ ID NO: 252908 - DNA, 25 bp, Mus musculus
tgcagccgagaattcctccaaagtc

SEQ ID NO: 252909 - DNA, 25 bp, Mus musculus
ttctcgcagcagaacgcacggatga

SEQ ID NO: 252910 - DNA, 25 bp, Mus musculus
atcggaccctttcgaggtactgaag

SEQ ID NO: 252911 - DNA, 25 bp, Mus musculus
cgcgaagagttgctgcgcagtgcac

SEQ ID NO: 252912 - DNA, 25 bp, Mus musculus
ccagcgtcggcgtggccgacaaaaa

SEQ ID NO: 252913 - DNA, 25 bp, Mus musculus
tgaagttcaggagtagacagccatc

SEQ ID NO: 252914 - DNA, 25 bp, Mus musculus
tcccgggctaatcagttgtggccta

SEQ ID NO: 252915 - DNA, 25 bp, Mus musculus
gtccgctgcaatccgtggaggaacg

SEQ ID NO: 252916 - DNA, 25 bp, Mus musculus
gctgcgtggtcaccaaccgattcga

SEQ ID NO: 252917 - DNA, 25 bp, Mus musculus
ctatttgacgacgaatcggaccctt

SEQ ID NO: 252918 - DNA, 25 bp, Mus musculus
agcacgctgcacactttccttgaga

SEQ ID NO: 252919 - DNA, 25 bp, Mus musculus
agaccaactccaacgcggcgggcaa

SEQ ID NO: 252920 - DNA, 25 bp, Mus musculus
cgcggcgggcaaacagttgcgtaaa

SEQ ID NO: 252921 - DNA, 25 bp, Mus musculus
ttgcgtaaagagtcccagaaagacc

SEQ ID NO: 252922 - DNA, 25 bp, Mus musculus
ggaacgtggctggtcccaagtccac

SEQ ID NO: 252923 - DNA, 25 bp, Mus musculus
aaccgattcgaccagctatttgacg

SEQ ID NO: 252924 - DNA, 25 bp, Mus musculus
gcgctctcaccacgcccgccactag

SEQ ID NO: 252925 - DNA, 25 bp, Mus musculus
atgacaagtgtccaggcagaggtgc

SEQ ID NO: 252926 - DNA, 25 bp, Mus musculus
gtgcagtggccatgacaagtgtcca

SEQ ID NO: 252927 - DNA, 25 bp, Mus musculus
acctccggtgcagtggccatgacaa

SEQ ID NO: 252928 - DNA, 25 bp, Mus musculus
ccacgcggcagtgtggacctccggt

SEQ ID NO: 252929 - DNA, 25 bp, Mus musculus
ccatcgctggagtccacgcggcagt

SEQ ID NO: 252930 - DNA, 25 bp, Mus musculus
tagcctagcgcagcgccatcgctgg

SEQ ID NO: 252931 - DNA, 25 bp, Mus musculus
agggatcctggcacccgctagccta

SEQ ID NO: 252932 - DNA, 25 bp, Mus musculus
gacgcagagagggatcctggcaccc

SEQ ID NO: 252933 - DNA, 25 bp, Mus musculus
gctcttcccgcgcacaggacgcaga

SEQ ID NO: 252934 - DNA, 25 bp, Mus musculus
agtgcctccactcaccagagctctt

SEQ ID NO: 252935 - DNA, 25 bp, Mus musculus
ttcctctgcgctcgcccaagtgcct

SEQ ID NO: 252936 - DNA, 25 bp, Mus musculus
tctccttaccgggttcctctgcgct

SEQ ID NO: 252937 - DNA, 25 bp, Mus musculus
tgtccaggcagaggtgcccggccct

SEQ ID NO: 252938 - DNA, 25 bp, Mus musculus
caccttgttgggtgatgccgtgcac

SEQ ID NO: 252939 - DNA, 25 bp, Mus musculus
gacaggtgtcttgcgcgaaacgata

SEQ ID NO: 252940 - DNA, 25 bp, Mus musculus
cgatagcaacgctggccttccttga

SEQ ID NO: 252941 - DNA, 25 bp, Mus musculus
tgacaaccagcccagaccgaagaga

SEQ ID NO: 252942 - DNA, 25 bp, Mus musculus
cggggaacagaatagctcgtagctc

SEQ ID NO: 252943 - DNA, 25 bp, Mus musculus
cgtgacctgctctatccagccaata

SEQ ID NO: 252944 - DNA, 25 bp, Mus musculus
gactcgcacatttcattggctactg

SEQ ID NO: 252945 - DNA, 25 bp, Mus musculus
ctgaagccacgcagtataccattgg

SEQ ID NO: 252946 - DNA, 25 bp, Mus musculus
attggctaagctatctcgtcggggc

SEQ ID NO: 252947 - DNA, 25 bp, Mus musculus
tggacgtgttccaagaaggtctcgc

SEQ ID NO: 252948 - DNA, 25 bp, Mus musculus
tgcgcacgcgccttttgcttatcaa

SEQ ID NO: 252949 - DNA, 25 bp, Mus musculus
agcgccggaaagcaacactagtcta

SEQ ID NO: 252950 - DNA, 25 bp, Mus musculus
gctctgcgaccttccgatccaggtg

SEQ ID NO: 252951 - DNA, 25 bp, Mus musculus
aaggtctcgccatggtggtgcaaga

SEQ ID NO: 252952 - DNA, 25 bp, Mus musculus
tcgtccaggtagtagatgagcgtcc

SEQ ID NO: 252953 - DNA, 25 bp, Mus musculus
tcgtagaggccatcgttgtccagta

SEQ ID NO: 252954 - DNA, 25 bp, Mus musculus
ttgtcgtcacactccgggtcgtaga

SEQ ID NO: 252955 - DNA, 25 bp, Mus musculus
ttacgcaccagcacaccgaggtctg

SEQ ID NO: 252956 - DNA, 25 bp, Mus musculus
ggctcctcatagtgtaccgcggata

SEQ ID NO: 252957 - DNA, 25 bp, Mus musculus
ctctatctgaatggtgggctcctca

SEQ ID NO: 252958 - DNA, 25 bp, Mus musculus
cgcgttctgccgaagctctatctga

SEQ ID NO: 252959 - DNA, 25 bp, Mus musculus
tcagcgatgtccacgtctctcaagc

SEQ ID NO: 252960 - DNA, 25 bp, Mus musculus
gcccatgaacagtgactcgccttta

SEQ ID NO: 252961 - DNA, 25 bp, Mus musculus
ttgagcagcaggcacttggaagtta

SEQ ID NO: 252962 - DNA, 25 bp, Mus musculus
gtcgaccaatacctgtgagcccatt

SEQ ID NO: 252963 - DNA, 25 bp, Mus musculus
gggccatttgtgtcgcagaccgtca

SEQ ID NO: 252964 - DNA, 25 bp, Mus musculus
tcatcttgttggtggggcatgtaca

SEQ ID NO: 252965 - DNA, 25 bp, Mus musculus
ccctttcgaagtagtaggcggcatc

SEQ ID NO: 252966 - DNA, 25 bp, Mus musculus
tccagactttctgtccggaaggtcc

SEQ ID NO: 252967 - DNA, 25 bp, Mus musculus
gcgaattcgggtacaaggctcatcc

SEQ ID NO: 252968 - DNA, 25 bp, Mus musculus
aaccctcgccctttcaggagtcagg

SEQ ID NO: 252969 - DNA, 25 bp, Mus musculus
tgggcgcgcagcacgaagccatcac

SEQ ID NO: 252970 - DNA, 25 bp, Mus musculus
ttcacgtggttctccaccgccgtgt

SEQ ID NO: 252971 - DNA, 25 bp, Mus musculus
tgtggctcgccagcttcttagcctc

SEQ ID NO: 252972 - DNA, 25 bp, Mus musculus
agcctcctcggccttggacatcgtg

SEQ ID NO: 252973 - DNA, 25 bp, Mus musculus
cccgcgcgtattactaaatgcgtgt

SEQ ID NO: 252974 - DNA, 25 bp, Mus musculus
agtcctacggcgacagtggttccta

SEQ ID NO: 252975 - DNA, 25 bp, Mus musculus
acagtggttcctaggcccttctgca

SEQ ID NO: 252976 - DNA, 25 bp, Mus musculus
gcccttctgcattcgggactacaag

SEQ ID NO: 252977 - DNA, 25 bp, Mus musculus
tcgaccctagtgtgcaaatcgcccg

SEQ ID NO: 252978 - DNA, 25 bp, Mus musculus
gtcccacaatacgatcgaccctagt

SEQ ID NO: 252979 - DNA, 25 bp, Mus musculus
ccggcaactgcacgtgggaacccga

SEQ ID NO: 252980 - DNA, 25 bp, Mus musculus
ctggcgaaccggagtcacgcgcgac

SEQ ID NO: 252981 - DNA, 25 bp, Mus musculus
cctctcgcagggatgcgagtgactg

SEQ ID NO: 252982 - DNA, 25 bp, Mus musculus
cccgatgacgacgtggaactgcggc

SEQ ID NO: 252983 - DNA, 25 bp, Mus musculus
tcggagtggcaaggcgcgcaaccaa

SEQ ID NO: 252984 - DNA, 25 bp, Mus musculus
ggcgcgcaaccaatcgcagagcaga

SEQ ID NO: 252985 - DNA, 25 bp, Mus musculus
atcgcagagcagacgcacggaaccc

SEQ ID NO: 252986 - DNA, 25 bp, Mus musculus
acgcacggaaccctcgctcaatggg

SEQ ID NO: 252987 - DNA, 25 bp, Mus musculus
tcaatgggcgatgtctgcacaaggc

SEQ ID NO: 252988 - DNA, 25 bp, Mus musculus
gatgtctgcacaaggctgtcactca

SEQ ID NO: 252989 - DNA, 25 bp, Mus musculus
cagtttgcttgctcccgcgtcggag

SEQ ID NO: 252990 - DNA, 25 bp, Mus musculus
cgcgtcggagacagtgtttggctta

SEQ ID NO: 252991 - DNA, 25 bp, Mus musculus
gctgccgctggcgaaccggagtcac

SEQ ID NO: 252992 - DNA, 25 bp, Mus musculus
cacgcgcgacggagcccgatgacga

SEQ ID NO: 252993 - DNA, 25 bp, Mus musculus
tgactgcggacaaagcagagagccg

SEQ ID NO: 252994 - DNA, 25 bp, Mus musculus
caagggatgctctctccgaagtgcc

SEQ ID NO: 252995 - DNA, 25 bp, Mus musculus
acctgatgaagatggtgcgaccacc

SEQ ID NO: 252996 - DNA, 25 bp, Mus musculus
aggaaggaccgatggacgcttttca

SEQ ID NO: 252997 - DNA, 25 bp, Mus musculus
tggacgcttttcaccttgactccgg

SEQ ID NO: 252998 - DNA, 25 bp, Mus musculus
gtcgcccagcctcccaggtataaga

SEQ ID NO: 252999 - DNA, 25 bp, Mus musculus
ctcctcagcgctccaagtcggtagt

SEQ ID NO: 253000 - DNA, 25 bp, Mus musculus
gacaacttcgtatactcgcagcccg

SEQ ID NO: 253001 - DNA, 25 bp, Mus musculus
gcaccctatgggctgtccgactacg

SEQ ID NO: 253002 - DNA, 25 bp, Mus musculus
ctatggccatccagagcgcgcctga

SEQ ID NO: 253003 - DNA, 25 bp, Mus musculus
gccacatttaccagttcgtcgccga

SEQ ID NO: 253004 - DNA, 25 bp, Mus musculus
tcgtcgccgataacttccctttcta

SEQ ID NO: 253005 - DNA, 25 bp, Mus musculus
ctcaacgactgctttaagaaggtgc

SEQ ID NO: 253006 - DNA, 25 bp, Mus musculus
tttctaccagcgcagcaaggccggc

SEQ ID NO: 253007 - DNA, 25 bp, Mus musculus
tggccctgtattgcggcgacaactt

SEQ ID NO: 253008 - DNA, 25 bp, Mus musculus
cccgcttttggagcagactttacgt

SEQ ID NO: 253009 - DNA, 25 bp, Mus musculus
tgaatcccttctgctctgtagtctc

SEQ ID NO: 253010 - DNA, 25 bp, Mus musculus
cctgtacctgacaaggcttctttga

SEQ ID NO: 253011 - DNA, 25 bp, Mus musculus
aggcccggaatgcacacacctgtac

SEQ ID NO: 253012 - DNA, 25 bp, Mus musculus
caaggcggctttctttagcagaacg

SEQ ID NO: 253013 - DNA, 25 bp, Mus musculus
tcgtctcaccgaagcaacaaggatg

SEQ ID NO: 253014 - DNA, 25 bp, Mus musculus
cagactttacgttggggatgccctt

SEQ ID NO: 253015 - DNA, 25 bp, Mus musculus
tcttcctaaggatggtccacgcctg

SEQ ID NO: 253016 - DNA, 25 bp, Mus musculus
aggctggatgggaaactcgtcttcc

SEQ ID NO: 253017 - DNA, 25 bp, Mus musculus
agagtcctgccacctagaggctgga

SEQ ID NO: 253018 - DNA, 25 bp, Mus musculus
gccttatttctctgccgtctcggga

SEQ ID NO: 253019 - DNA, 25 bp, Mus musculus
cgccgccttttataggtctaactcg

SEQ ID NO: 253020 - DNA, 25 bp, Mus musculus
cccttagctagggactcaggcttac

SEQ ID NO: 253021 - DNA, 25 bp, Mus musculus
cccgggttggcaactgcgctaaaca

SEQ ID NO: 253022 - DNA, 25 bp, Mus musculus
ccctagtggtagatcactactcctg

SEQ ID NO: 253023 - DNA, 25 bp, Mus musculus
cagcagagaactgggcgaggttacc

SEQ ID NO: 253024 - DNA, 25 bp, Mus musculus
atctgacgtgtcaccgtggagagcg

SEQ ID NO: 253025 - DNA, 25 bp, Mus musculus
ggacagcagccagaaatctgacgtg

SEQ ID NO: 253026 - DNA, 25 bp, Mus musculus
ctgagctacgggaccaggacagcag

SEQ ID NO: 253027 - DNA, 25 bp, Mus musculus
gccaagctgagctacgggaccagga

SEQ ID NO: 253028 - DNA, 25 bp, Mus musculus
acccgcgcgggctgctagggctatt

SEQ ID NO: 253029 - DNA, 25 bp, Mus musculus
actgccgaaccctggctgcaggaga

SEQ ID NO: 253030 - DNA, 25 bp, Mus musculus
cgcactgtcctgagtttccgggtta

SEQ ID NO: 253031 - DNA, 25 bp, Mus musculus
ctgaacacagcgcactgtcctgagt

SEQ ID NO: 253032 - DNA, 25 bp, Mus musculus
tggcgagctcgccgaaccctaagac

SEQ ID NO: 253033 - DNA, 25 bp, Mus musculus
ttggagtttaaagcaaggcctggga

SEQ ID NO: 253034 - DNA, 25 bp, Mus musculus
cctggattggagtttaaagcaaggc

SEQ ID NO: 253035 - DNA, 25 bp, Mus musculus
ggtagatcactactcctggattgga

SEQ ID NO: 253036 - DNA, 25 bp, Mus musculus
acagagccggttagtccgaaatggc

SEQ ID NO: 253037 - DNA, 25 bp, Mus musculus
catggccgagggacctcacggcctg

SEQ ID NO: 253038 - DNA, 25 bp, Mus musculus
ggttcagtgaggaatccccgtcctc

SEQ ID NO: 253039 - DNA, 25 bp, Mus musculus
gcagcctcggtttggtgcaggagcg

SEQ ID NO: 253040 - DNA, 25 bp, Mus musculus
cgccttcgaaatggccgacgagagc

SEQ ID NO: 253041 - DNA, 25 bp, Mus musculus
gccgcgccttcgaaatggccgacga

SEQ ID NO: 253042 - DNA, 25 bp, Mus musculus
cagccctcaactcccgcggcctggt

SEQ ID NO: 253043 - DNA, 25 bp, Mus musculus
ggacagtagttgtagacgcccgccc

SEQ ID NO: 253044 - DNA, 25 bp, Mus musculus
agcggtgtctctgcctctccgccac

SEQ ID NO: 253045 - DNA, 25 bp, Mus musculus
tcaggaagtcaggtctccgcctcct

SEQ ID NO: 253046 - DNA, 25 bp, Mus musculus
cgctgtccagtcagccgcgggtggt

SEQ ID NO: 253047 - DNA, 25 bp, Mus musculus
ggccgccctgctgcgcacgcgcacc

SEQ ID NO: 253048 - DNA, 25 bp, Mus musculus
ccctcggagcgcctgactctctcct

SEQ ID NO: 253049 - DNA, 25 bp, Mus musculus
atttcccgagggctcggccgccctg

SEQ ID NO: 253050 - DNA, 25 bp, Mus musculus
tccaccagtagagaaagcaaagctc

SEQ ID NO: 253051 - DNA, 25 bp, Mus musculus
ctcagcaggagtagcaagagcagtg

SEQ ID NO: 253052 - DNA, 25 bp, Mus musculus
aagagcagtggcaaccgcagcagct

SEQ ID NO: 253053 - DNA, 25 bp, Mus musculus
ggagccgcaccactctcgcagggga

SEQ ID NO: 253054 - DNA, 25 bp, Mus musculus
accactctcgcaggggacggtcttt

SEQ ID NO: 253055 - DNA, 25 bp, Mus musculus
gacggtctttccttctccaccagta

SEQ ID NO: 253056 - DNA, 25 bp, Mus musculus
gcaaagctctccctgcttctattgt

SEQ ID NO: 253057 - DNA, 25 bp, Mus musculus
gctccagatgaaaagcagccaaaga

SEQ ID NO: 253058 - DNA, 25 bp, Mus musculus
cagccaaagagcaactaacactagg

SEQ ID NO: 253059 - DNA, 25 bp, Mus musculus
actagggaacaatagcatcagcggc

SEQ ID NO: 253060 - DNA, 25 bp, Mus musculus
atggcgcgcagactggcaggtccta

SEQ ID NO: 253061 - DNA, 25 bp, Mus musculus
agaagagagagctgagaagagccaa

SEQ ID NO: 253062 - DNA, 25 bp, Mus musculus
gcgccagagctcagcaggagtagca

SEQ ID NO: 253063 - DNA, 25 bp, Mus musculus
ctgcttctattgttcgctccagatg

SEQ ID NO: 253064 - DNA, 25 bp, Mus musculus
cagggaactttagcgatagcgtcaa

SEQ ID NO: 253065 - DNA, 25 bp, Mus musculus
cgcgaggggaaacatgacagcaatt

SEQ ID NO: 253066 - DNA, 25 bp, Mus musculus
agccaaaccaatgcgctcgctgttg

SEQ ID NO: 253067 - DNA, 25 bp, Mus musculus
cgccctgattgcaatttgtgttttc

SEQ ID NO: 253068 - DNA, 25 bp, Mus musculus
ttcagccaatccagactgaggagcc

SEQ ID NO: 253069 - DNA, 25 bp, Mus musculus
ctgggccgaggcgtaaaacttcagc

SEQ ID NO: 253070 - DNA, 25 bp, Mus musculus
ggttaggagcgagacaaacatcctc

SEQ ID NO: 253071 - DNA, 25 bp, Mus musculus
tagcgtcaactacgcggccggtaaa

SEQ ID NO: 253072 - DNA, 25 bp, Mus musculus
ccgcgcagctgaacagggaacttta

SEQ ID NO: 253073 - DNA, 25 bp, Mus musculus
tgttttcacgggaaccggccgatga

SEQ ID NO: 253074 - DNA, 25 bp, Mus musculus
gtcacgcactgatccatgccggaga

SEQ ID NO: 253075 - DNA, 25 bp, Mus musculus
ccgtagcccgagaacttgtgcagca

SEQ ID NO: 253076 - DNA, 25 bp, Mus musculus
tgttttctccaggatttcgccctga

SEQ ID NO: 253077 - DNA, 25 bp, Mus musculus
tccgcccagaagcagaagagtgacc

SEQ ID NO: 253078 - DNA, 25 bp, Mus musculus
gccgacgtcagttgttatgtcttga

SEQ ID NO: 253079 - DNA, 25 bp, Mus musculus
accgcgcggctacgcagctgacagg

SEQ ID NO: 253080 - DNA, 25 bp, Mus musculus
tacgcagctgacaggaagccgcccg

SEQ ID NO: 253081 - DNA, 25 bp, Mus musculus
cgttggggcctagcgttatttgctt

SEQ ID NO: 253082 - DNA, 25 bp, Mus musculus
gcctagcgttatttgctttttcctc

SEQ ID NO: 253083 - DNA, 25 bp, Mus musculus
ttttcctcccttcacgactgtcgtc

SEQ ID NO: 253084 - DNA, 25 bp, Mus musculus
tgcggcggtcactccaacccgcgct

SEQ ID NO: 253085 - DNA, 25 bp, Mus musculus
taccgcgccctctggaccactcagt

SEQ ID NO: 253086 - DNA, 25 bp, Mus musculus
tccagccgtccgcagctcgatgggt

SEQ ID NO: 253087 - DNA, 25 bp, Mus musculus
ctcagctcctgaccgcaaggccaga

SEQ ID NO: 253088 - DNA, 25 bp, Mus musculus
tcagtcgcacgcacgccgcgatcca

SEQ ID NO: 253089 - DNA, 25 bp, Mus musculus
agagcacagtaactcggaaggttta

SEQ ID NO: 253090 - DNA, 25 bp, Mus musculus
cccgatgccgacgtcagttgttatg

SEQ ID NO: 253091 - DNA, 25 bp, Mus musculus
ttgttatgtcttgactggggccgcg

SEQ ID NO: 253092 - DNA, 25 bp, Mus musculus
cgatctgccgcttgacatagctgtc

SEQ ID NO: 253093 - DNA, 25 bp, Mus musculus
gtcccgccgcactgaccacctcctg

SEQ ID NO: 253094 - DNA, 25 bp, Mus musculus
catagctgtcgatgcgtttccggta

SEQ ID NO: 253095 - DNA, 25 bp, Mus musculus
ctgtcgatgcgtttccggtacgtgc

SEQ ID NO: 253096 - DNA, 25 bp, Mus musculus
tgcggttggtgagccgtcccaccat

SEQ ID NO: 253097 - DNA, 25 bp, Mus musculus
cataaggccgcttttcccgagcgaa

SEQ ID NO: 253098 - DNA, 25 bp, Mus musculus
ccgcttttcccgagcgaagagtttg

SEQ ID NO: 253099 - DNA, 25 bp, Mus musculus
ttcccgagcgaagagtttgcgcact

SEQ ID NO: 253100 - DNA, 25 bp, Mus musculus
agcgaagagtttgcgcactggcaca

SEQ ID NO: 253101 - DNA, 25 bp, Mus musculus
tttgcgcactggcacagcgatacgc

SEQ ID NO: 253102 - DNA, 25 bp, Mus musculus
gcgcactggcacagcgatacgctga

SEQ ID NO: 253103 - DNA, 25 bp, Mus musculus
tgccgcttgacatagctgtcgatgc

SEQ ID NO: 253104 - DNA, 25 bp, Mus musculus
ccacctcctggcgaagccgcacctt

SEQ ID NO: 253105 - DNA, 25 bp, Mus musculus
agcgatacgctgacccctcctgggt

SEQ ID NO: 253106 - DNA, 25 bp, Mus musculus
cctcccaaagagctggtaagggcca

SEQ ID NO: 253107 - DNA, 25 bp, Mus musculus
ggagaagcctcccaaagagctggta

SEQ ID NO: 253108 - DNA, 25 bp, Mus musculus
gcgcgcgtgcgtactagccctgctg

SEQ ID NO: 253109 - DNA, 25 bp, Mus musculus
aggggtaagaggagttcagttcatc

SEQ ID NO: 253110 - DNA, 25 bp, Mus musculus
gttcagttcatcatgggactctttg

SEQ ID NO: 253111 - DNA, 25 bp, Mus musculus
catcatgggactctttggaaaaacc

SEQ ID NO: 253112 - DNA, 25 bp, Mus musculus
acttgccctagaccggaaggttgtg

SEQ ID NO: 253113 - DNA, 25 bp, Mus musculus
aaagagctggtaagggccagcgacc

SEQ ID NO: 253114 - DNA, 25 bp, Mus musculus
tgcgctctcaggctggcccctattt

SEQ ID NO: 253115 - DNA, 25 bp, Mus musculus
tatttccggggccttccactctgcc

SEQ ID NO: 253116 - DNA, 25 bp, Mus musculus
tgccctagaccggaaggttgtgtgc

SEQ ID NO: 253117 - DNA, 25 bp, Mus musculus
tggttaggagcacctcggcctcgcc

SEQ ID NO: 253118 - DNA, 25 bp, Mus musculus
agaccacccggaggacttgccctag

SEQ ID NO: 253119 - DNA, 25 bp, Mus musculus
tgtagggcctggttaggagcacctc

SEQ ID NO: 253120 - DNA, 25 bp, Mus musculus
ggactcgctcgcgactcgacacttg

SEQ ID NO: 253121 - DNA, 25 bp, Mus musculus
gacccaggatcatgagcgcctattg

SEQ ID NO: 253122 - DNA, 25 bp, Mus musculus
tcgcacaggctcacagataagactg

SEQ ID NO: 253123 - DNA, 25 bp, Mus musculus
cccgccgaatcggttatcgactttg

SEQ ID NO: 253124 - DNA, 25 bp, Mus musculus
cctcgcgctatgcaaaaaagtcccg

SEQ ID NO: 253125 - DNA, 25 bp, Mus musculus
ttcttccatttgttgcctcgcgcta

SEQ ID NO: 253126 - DNA, 25 bp, Mus musculus
tctcagcaacgactcgaagccgatc

SEQ ID NO: 253127 - DNA, 25 bp, Mus musculus
cggggcagcctaggaaattctacgt

SEQ ID NO: 253128 - DNA, 25 bp, Mus musculus
gccgctgccaccgatgattggttga

SEQ ID NO: 253129 - DNA, 25 bp, Mus musculus
gccgactctagctctgacttggttc

SEQ ID NO: 253130 - DNA, 25 bp, Mus musculus
cccgtcctgagccttgaaccgagaa

SEQ ID NO: 253131 - DNA, 25 bp, Mus musculus
aaaggctccctcttagtgcctaggg

SEQ ID NO: 253132 - DNA, 25 bp, Mus musculus
cggcgccagtgcttttgcctaagtg

SEQ ID NO: 253133 - DNA, 25 bp, Mus musculus
agtcacccacgacggcggcaacaga

SEQ ID NO: 253134 - DNA, 25 bp, Mus musculus
tccacgcgttctctctcctttggaa

SEQ ID NO: 253135 - DNA, 25 bp, Mus musculus
catctccaggctggtggtgtaagtg

SEQ ID NO: 253136 - DNA, 25 bp, Mus musculus
tgtaagtggcctcttctcctgtgtc

SEQ ID NO: 253137 - DNA, 25 bp, Mus musculus
gctagctattaatacccggcggtcg

SEQ ID NO: 253138 - DNA, 25 bp, Mus musculus
acccggcggtcgctaaatttagcag

SEQ ID NO: 253139 - DNA, 25 bp, Mus musculus
tttagcaggtacagtagctgcctgg

SEQ ID NO: 253140 - DNA, 25 bp, Mus musculus
taggacgcgcgacgctacagaccca

SEQ ID NO: 253141 - DNA, 25 bp, Mus musculus
ctacagacccatgggtagccgcggg

SEQ ID NO: 253142 - DNA, 25 bp, Mus musculus
ctgggcaatgggtctcgccttctct

SEQ ID NO: 253143 - DNA, 25 bp, Mus musculus
gtctcgccttctctctgttgctttg

SEQ ID NO: 253144 - DNA, 25 bp, Mus musculus
tctctgttgctttgttccattccgg

SEQ ID NO: 253145 - DNA, 25 bp, Mus musculus
ctttggaagaaaatgccttgggctc

SEQ ID NO: 253146 - DNA, 25 bp, Mus musculus
ccacacggtttcacaaggagggcgg

SEQ ID NO: 253147 - DNA, 25 bp, Mus musculus
atggtgtcgtggatcatctccaggc

SEQ ID NO: 253148 - DNA, 25 bp, Mus musculus
gccggacgcagctaggctgtacaga

SEQ ID NO: 253149 - DNA, 25 bp, Mus musculus
tgggcacgtgataggtttccaatcg

SEQ ID NO: 253150 - DNA, 25 bp, Mus musculus
agtctcggaccaatcctggctgctg

SEQ ID NO: 253151 - DNA, 25 bp, Mus musculus
agtacctccttatctcagtctcgga

SEQ ID NO: 253152 - DNA, 25 bp, Mus musculus
tcagggacctggtatccaatcagta

SEQ ID NO: 253153 - DNA, 25 bp, Mus musculus
ctggactggaatgactcgagggtta

SEQ ID NO: 253154 - DNA, 25 bp, Mus musculus
aaccgaggcagtcctctagggcggc

SEQ ID NO: 253155 - DNA, 25 bp, Mus musculus
cggacaacgtgagaggcatccatga

SEQ ID NO: 253156 - DNA, 25 bp, Mus musculus
tgcggactgccaacggacaacgtga

SEQ ID NO: 253157 - DNA, 25 bp, Mus musculus
ggtcacgctgactgcggactgccaa

SEQ ID NO: 253158 - DNA, 25 bp, Mus musculus
gcctgtcagttatccggcgtgaccg

SEQ ID NO: 253159 - DNA, 25 bp, Mus musculus
cggcagaaatgctgcgggcctgtca

SEQ ID NO: 253160 - DNA, 25 bp, Mus musculus
gtttccaatcgtgaaggtcggcgcg

SEQ ID NO: 253161 - DNA, 25 bp, Mus musculus
gcagcgctgtcgcttcggcagaaat

SEQ ID NO: 253162 - DNA, 25 bp, Mus musculus
actcttcgcggagcacgtcgggaac

SEQ ID NO: 253163 - DNA, 25 bp, Mus musculus
aacgctcagtacacatcgttcacct

SEQ ID NO: 253164 - DNA, 25 bp, Mus musculus
gcagcggaacgctcagtacacatcg

SEQ ID NO: 253165 - DNA, 25 bp, Mus musculus
tggctagactagcagcggaacgctc

SEQ ID NO: 253166 - DNA, 25 bp, Mus musculus
cacaaggtcctgtttggctagacta

SEQ ID NO: 253167 - DNA, 25 bp, Mus musculus
ccaaacgggtggtcacaaggtcctg

SEQ ID NO: 253168 - DNA, 25 bp, Mus musculus
tctccaaacgggtggtcacaaggtc

SEQ ID NO: 253169 - DNA, 25 bp, Mus musculus
ggagcacgtcgggaacgacctccgc

SEQ ID NO: 253170 - DNA, 25 bp, Mus musculus
atctttggactcttcgcggagcacg

SEQ ID NO: 253171 - DNA, 25 bp, Mus musculus
ccgccatctttggactcttcgcgga

SEQ ID NO: 253172 - DNA, 25 bp, Mus musculus
caagcccgctgcgaaaggacaggcg

SEQ ID NO: 253173 - DNA, 25 bp, Mus musculus
tggtctgcagcaagacaagcccgct

SEQ ID NO: 253174 - DNA, 25 bp, Mus musculus
cccgagtggtctgcagcaagacaag

SEQ ID NO: 253175 - DNA, 25 bp, Mus musculus
ggaacgtctcatctccaaacgggtg

SEQ ID NO: 253176 - DNA, 25 bp, Mus musculus
gtgacggacctcaaaactgactcgg

SEQ ID NO: 253177 - DNA, 25 bp, Mus musculus
cgcggttctcgcacgcaagcgcagt

SEQ ID NO: 253178 - DNA, 25 bp, Mus musculus
cgcaagcgcagtggaaaaacacatg

SEQ ID NO: 253179 - DNA, 25 bp, Mus musculus
agaaggctttgagccgagccagtcc

SEQ ID NO: 253180 - DNA, 25 bp, Mus musculus
agttggagctgggaactacgattcc

SEQ ID NO: 253181 - DNA, 25 bp, Mus musculus
ttcggccgaagagctcaagtaagga

SEQ ID NO: 253182 - DNA, 25 bp, Mus musculus
tttccttcggaatgtattcggccga

SEQ ID NO: 253183 - DNA, 25 bp, Mus musculus
aaaactgactcggaagatgctggcc

SEQ ID NO: 253184 - DNA, 25 bp, Mus musculus
ctggaacttctctcgtagtgacgga

SEQ ID NO: 253185 - DNA, 25 bp, Mus musculus
ttctctgcggctgactggaacttct

SEQ ID NO: 253186 - DNA, 25 bp, Mus musculus
gactcaagtggcgttctctgcggct

SEQ ID NO: 253187 - DNA, 25 bp, Mus musculus
ggctctgcgctacaagactcaagtg

SEQ ID NO: 253188 - DNA, 25 bp, Mus musculus
aacacatggtggctctgcgctacaa

SEQ ID NO: 253189 - DNA, 25 bp, Mus musculus
gcggcttcagggcatttccttcgga

SEQ ID NO: 253190 - DNA, 25 bp, Mus musculus
actatctaatcacgcgcaagcctgg

SEQ ID NO: 253191 - DNA, 25 bp, Mus musculus
ggtccagccagagtggccctcttca

SEQ ID NO: 253192 - DNA, 25 bp, Mus musculus
cgctgcgggtaaggatgacctgccc

SEQ ID NO: 253193 - DNA, 25 bp, Mus musculus
agatagcggcgatccgcctttgcga

SEQ ID NO: 253194 - DNA, 25 bp, Mus musculus
cggcacctgcctgccgaggtacgtg

SEQ ID NO: 253195 - DNA, 25 bp, Mus musculus
gctgcgaagccaagcagcggcacct

SEQ ID NO: 253196 - DNA, 25 bp, Mus musculus
cccagaagctgcgaagccaagcagc

SEQ ID NO: 253197 - DNA, 25 bp, Mus musculus
ccctagcatgcacacagaggcggtg

SEQ ID NO: 253198 - DNA, 25 bp, Mus musculus
tggtctcccttatcctcgtgacgcg

SEQ ID NO: 253199 - DNA, 25 bp, Mus musculus
tgattggtctcccttatcctcgtga

SEQ ID NO: 253200 - DNA, 25 bp, Mus musculus
ggcctcggcgcactctgattggtct

SEQ ID NO: 253201 - DNA, 25 bp, Mus musculus
cccacctacttctcggctggagttg

SEQ ID NO: 253202 - DNA, 25 bp, Mus musculus
aatcacgcgcaagcctggggagagt

SEQ ID NO: 253203 - DNA, 25 bp, Mus musculus
cggaacgccttccactatctaatca

SEQ ID NO: 253204 - DNA, 25 bp, Mus musculus
aagcacggagaaaggcgccagctgt

SEQ ID NO: 253205 - DNA, 25 bp, Mus musculus
gaggggactccagagcgcccacacg

SEQ ID NO: 253206 - DNA, 25 bp, Mus musculus
gtccagtgcggcgtggtttgcctaa

SEQ ID NO: 253207 - DNA, 25 bp, Mus musculus
ggaggggactccagagcgcccacac

SEQ ID NO: 253208 - DNA, 25 bp, Mus musculus
gcccacacagggaccagggcgcctg

SEQ ID NO: 253209 - DNA, 25 bp, Mus musculus
aaagcccacacagggaccagggcgc

SEQ ID NO: 253210 - DNA, 25 bp, Mus musculus
tcaaagcccacacagggaccagggc

SEQ ID NO: 253211 - DNA, 25 bp, Mus musculus
tgagtcaaagcccacacagggacca

SEQ ID NO: 253212 - DNA, 25 bp, Mus musculus
cgctgagtcaaagcccacacaggga

SEQ ID NO: 253213 - DNA, 25 bp, Mus musculus
cggcgctgagtcaaagcccacacag

SEQ ID NO: 253214 - DNA, 25 bp, Mus musculus
tggtttgcctaagccaggctcccgg

SEQ ID NO: 253215 - DNA, 25 bp, Mus musculus
agtgcggcgtggtttgcctaagcca

SEQ ID NO: 253216 - DNA, 25 bp, Mus musculus
agtcaaagcccacacagggaccagg

SEQ ID NO: 253217 - DNA, 25 bp, Mus musculus
gcgtggtttgcctaagccaggctcc

SEQ ID NO: 253218 - DNA, 25 bp, Mus musculus
gctacaaaatactcataggcgcttc

SEQ ID NO: 253219 - DNA, 25 bp, Mus musculus
actcataggcgcttcatgcgctaca

SEQ ID NO: 253220 - DNA, 25 bp, Mus musculus
cataggcgcttcatgcgctacaaaa

SEQ ID NO: 253221 - DNA, 25 bp, Mus musculus
tcatgcgctacaaaatactcatagg

SEQ ID NO: 253222 - DNA, 25 bp, Mus musculus
caaaatactcataggcgcttcatgc

SEQ ID NO: 253223 - DNA, 25 bp, Mus musculus
ctcataggcgcttcatgcgctacaa

SEQ ID NO: 253224 - DNA, 25 bp, Mus musculus
gcgcttcatgcgctacaaaatactc

SEQ ID NO: 253225 - DNA, 25 bp, Mus musculus
catgcgctacaaaatactcataggc

SEQ ID NO: 253226 - DNA, 25 bp, Mus musculus
acaaaatactcataggcgcttcatg

SEQ ID NO: 253227 - DNA, 25 bp, Mus musculus
aaaatactcataggcgcttcatgcg

SEQ ID NO: 253228 - DNA, 25 bp, Mus musculus
cgcttcatgcgctacaaaatactca

SEQ ID NO: 253229 - DNA, 25 bp, Mus musculus
atgcgcttcgctgtactaatgggcg

SEQ ID NO: 253230 - DNA, 25 bp, Mus musculus
taggcgcttcatgcgctacaaaata

SEQ ID NO: 253231 - DNA, 25 bp, Mus musculus
cgctacaaaatactcataggcgctt

SEQ ID NO: 253232 - DNA, 25 bp, Mus musculus
cgcacatgagctactgaccgaattg

SEQ ID NO: 253233 - DNA, 25 bp, Mus musculus
cccgatacacgcgtttccaacttga

SEQ ID NO: 253234 - DNA, 25 bp, Mus musculus
tcaagccttcagtggccagatcctg

SEQ ID NO: 253235 - DNA, 25 bp, Mus musculus
cgcgccatgcgcttcactgtactaa

SEQ ID NO: 253236 - DNA, 25 bp, Mus musculus
agcaagtcttcacggcttcgggtcc

SEQ ID NO: 253237 - DNA, 25 bp, Mus musculus
ccacgactcgcgtccagaaatggtc

SEQ ID NO: 253238 - DNA, 25 bp, Mus musculus
cgctacgaacggattgcactgcaga

SEQ ID NO: 253239 - DNA, 25 bp, Mus musculus
cgcgtcttgcgctgtgataaactaa

SEQ ID NO: 253240 - DNA, 25 bp, Mus musculus
cgggcgcttcatgcgctacaaaatc

SEQ ID NO: 253241 - DNA, 25 bp, Mus musculus
taggcacttcacacgctacgaactg

SEQ ID NO: 253242 - DNA, 25 bp, Mus musculus
ctacgaactgatgggcgcttcatgc

SEQ ID NO: 253243 - DNA, 25 bp, Mus musculus
tgggcgcttcatgtgctacgatgta

SEQ ID NO: 253244 - DNA, 25 bp, Mus musculus
gcgcttaatgcgcttcgctgtacta

SEQ ID NO: 253245 - DNA, 25 bp, Mus musculus
tccgcgaattcggtttccacgactc

SEQ ID NO: 253246 - DNA, 25 bp, Mus musculus
tgaccctgtcctgcggcccgcacgc

SEQ ID NO: 253247 - DNA, 25 bp, Mus musculus
ggcccgcacgcaccggagcatcccg

SEQ ID NO: 253248 - DNA, 25 bp, Mus musculus
aggctctcccggtacggagctcagc

SEQ ID NO: 253249 - DNA, 25 bp, Mus musculus
ccagggcccttgatctgagcggccg

SEQ ID NO: 253250 - DNA, 25 bp, Mus musculus
cttggcttcgctcccggggtggctc

SEQ ID NO: 253251 - DNA, 25 bp, Mus musculus
agcactccgcgtgcgggtgagcgac

SEQ ID NO: 253252 - DNA, 25 bp, Mus musculus
acgcgcaggctctcccggtacggag

SEQ ID NO: 253253 - DNA, 25 bp, Mus musculus
ggaccgggacgctgtgaccctgtcc

SEQ ID NO: 253254 - DNA, 25 bp, Mus musculus
tcccggctgcactctaccggcgctc

SEQ ID NO: 253255 - DNA, 25 bp, Mus musculus
agctgatgcagttgttgtgctaccc

SEQ ID NO: 253256 - DNA, 25 bp, Mus musculus
ctcagctgatgcagttgttgtgcta

SEQ ID NO: 253257 - DNA, 25 bp, Mus musculus
agctcagctgatgcagttgttgtgc

SEQ ID NO: 253258 - DNA, 25 bp, Mus musculus
ctcccggtacggagctcagctgatg

SEQ ID NO: 253259 - DNA, 25 bp, Mus musculus
cccgggaccgcgcagcactccgcgt

SEQ ID NO: 253260 - DNA, 25 bp, Mus musculus
tgcagagtttcagacgccaccttcg

SEQ ID NO: 253261 - DNA, 25 bp, Mus musculus
caggggtcccgcagagacacctgta

SEQ ID NO: 253262 - DNA, 25 bp, Mus musculus
ccgcctgactcagggctgaggaatg

SEQ ID NO: 253263 - DNA, 25 bp, Mus musculus
tagggtcctcagaagggtctgcacc

SEQ ID NO: 253264 - DNA, 25 bp, Mus musculus
actcaccgccgtagggtcctcagaa

SEQ ID NO: 253265 - DNA, 25 bp, Mus musculus
gccgatccgaccacgggctatttct

SEQ ID NO: 253266 - DNA, 25 bp, Mus musculus
cgaagtcgcgctctctgtgcagagt

SEQ ID NO: 253267 - DNA, 25 bp, Mus musculus
gcagctgccactgttactcccgtga

SEQ ID NO: 253268 - DNA, 25 bp, Mus musculus
ttgccgatgcgaaccgggctgaaac

SEQ ID NO: 253269 - DNA, 25 bp, Mus musculus
cacttcccgagtttgccgatgcgaa

SEQ ID NO: 253270 - DNA, 25 bp, Mus musculus
agatgtctttggaggcacttcccga

SEQ ID NO: 253271 - DNA, 25 bp, Mus musculus
cactgtacagggcaggagatgtctt

SEQ ID NO: 253272 - DNA, 25 bp, Mus musculus
ggcctacttcaagatcccgactgtg

SEQ ID NO: 253273 - DNA, 25 bp, Mus musculus
gcggacacgcgccagaacgcaagct

SEQ ID NO: 253274 - DNA, 25 bp, Mus musculus
agtgtcatctgaagtcgctgccgcc

SEQ ID NO: 253275 - DNA, 25 bp, Mus musculus
gctgcgctccatctgtgtttgttta

SEQ ID NO: 253276 - DNA, 25 bp, Mus musculus
tgccagcatttctgcagaacgcccg

SEQ ID NO: 253277 - DNA, 25 bp, Mus musculus
cccgggagagctcagagtgtcatct

SEQ ID NO: 253278 - DNA, 25 bp, Mus musculus
tttaacgcacacagtcttccacggc

SEQ ID NO: 253279 - DNA, 25 bp, Mus musculus
aggccgttcagttctttaacgcaca

SEQ ID NO: 253280 - DNA, 25 bp, Mus musculus
cgcttgagcttcttgaggccgttca

SEQ ID NO: 253281 - DNA, 25 bp, Mus musculus
ggctccttgcctttccgcttgagct

SEQ ID NO: 253282 - DNA, 25 bp, Mus musculus
agttttatagccattcgcgcgccgc

SEQ ID NO: 253283 - DNA, 25 bp, Mus musculus
agctcgggagcttccaagtccaatc

SEQ ID NO: 253284 - DNA, 25 bp, Mus musculus
gaacggttgtgtcctgtcccgaagc

SEQ ID NO: 253285 - DNA, 25 bp, Mus musculus
cgaaaccgcgtttgcgcgcgtcaga

SEQ ID NO: 253286 - DNA, 25 bp, Mus musculus
cgcgtcagagacctcaggcgctctg

SEQ ID NO: 253287 - DNA, 25 bp, Mus musculus
cggtcccactgtgcccagagcgaaa

SEQ ID NO: 253288 - DNA, 25 bp, Mus musculus
tcgggctccgagtcttcatcggcct

SEQ ID NO: 253289 - DNA, 25 bp, Mus musculus
ttctcacggtctcgctccttcttga

SEQ ID NO: 253290 - DNA, 25 bp, Mus musculus
ctccttcttgatgcgacccgagctg

SEQ ID NO: 253291 - DNA, 25 bp, Mus musculus
tgccacgagactcggactcacgctt

SEQ ID NO: 253292 - DNA, 25 bp, Mus musculus
ggactcacgcttcccgcgggtggaa

SEQ ID NO: 253293 - DNA, 25 bp, Mus musculus
tggaaccatgggactgccgcttgga

SEQ ID NO: 253294 - DNA, 25 bp, Mus musculus
cgcttggaccggctagacatcgcca

SEQ ID NO: 253295 - DNA, 25 bp, Mus musculus
atcgccaccaccagttaggagcttc

SEQ ID NO: 253296 - DNA, 25 bp, Mus musculus
gagcacgggcagcaagcagccaatc

SEQ ID NO: 253297 - DNA, 25 bp, Mus musculus
ccaatcagaagtcgagatggcctca

SEQ ID NO: 253298 - DNA, 25 bp, Mus musculus
tggcctcatagaaacgcagcgcgct

SEQ ID NO: 253299 - DNA, 25 bp, Mus musculus
ctacgagtcgctgtgagggacaata

SEQ ID NO: 253300 - DNA, 25 bp, Mus musculus
gtgagggacaatacaggcttataaa

SEQ ID NO: 253301 - DNA, 25 bp, Mus musculus
acgttataagcgctgctggcccaac

SEQ ID NO: 253302 - DNA, 25 bp, Mus musculus
actacgacaagaaggtgaagcaggc

SEQ ID NO: 253303 - DNA, 25 bp, Mus musculus
ggcttcgtacaccacatccgtcgga

SEQ ID NO: 253304 - DNA, 25 bp, Mus musculus
cgggcgctcacagatgaaggttctc

SEQ ID NO: 253305 - DNA, 25 bp, Mus musculus
tgaaggttctcaaatttcgaaagca

SEQ ID NO: 253306 - DNA, 25 bp, Mus musculus
ttcgaaagcatctctgctccgctgc

SEQ ID NO: 253307 - DNA, 25 bp, Mus musculus
ctacgcaaccggaaaaagggcatcg

SEQ ID NO: 253308 - DNA, 25 bp, Mus musculus
ccggaagtcatggtccgcagccgaa

SEQ ID NO: 253309 - DNA, 25 bp, Mus musculus
agccgaaggccctaattccgcggca

SEQ ID NO: 253310 - DNA, 25 bp, Mus musculus
attccgcggcagttgtggcggttac

SEQ ID NO: 253311 - DNA, 25 bp, Mus musculus
ttacggcggttctgtacccagcata

SEQ ID NO: 253312 - DNA, 25 bp, Mus musculus
gtctggacatgagccacggcttcgt

SEQ ID NO: 253313 - DNA, 25 bp, Mus musculus
tccgtcggaaccagctcgatcggta

SEQ ID NO: 253314 - DNA, 25 bp, Mus musculus
cgcaagccagacctacaagtgtacc

SEQ ID NO: 253315 - DNA, 25 bp, Mus musculus
ccagcatacgaatggaggcggccca

SEQ ID NO: 253316 - DNA, 25 bp, Mus musculus
gacccggtcaagcttccctcgagaa

SEQ ID NO: 253317 - DNA, 25 bp, Mus musculus
cgtgcacgatgacagccacaggcga

SEQ ID NO: 253318 - DNA, 25 bp, Mus musculus
tgacaactgccctctagatcttaag

SEQ ID NO: 253319 - DNA, 25 bp, Mus musculus
atcttaagtgtcagaggtgtccggg

SEQ ID NO: 253320 - DNA, 25 bp, Mus musculus
agacttggggcaccgcccatgtttc

SEQ ID NO: 253321 - DNA, 25 bp, Mus musculus
tttaaacctttcagggctgctccga

SEQ ID NO: 253322 - DNA, 25 bp, Mus musculus
gggtattgtcgctggctgcacactc

SEQ ID NO: 253323 - DNA, 25 bp, Mus musculus
ccagatgttacagccctgcccgagt

SEQ ID NO: 253324 - DNA, 25 bp, Mus musculus
cgcccgtggcatttgggtagaccgc

SEQ ID NO: 253325 - DNA, 25 bp, Mus musculus
cttgattgtcctagctccagccttc

SEQ ID NO: 253326 - DNA, 25 bp, Mus musculus
cgtggctctctttccagatgttaca

SEQ ID NO: 253327 - DNA, 25 bp, Mus musculus
cacaggcgacatgcacaggcagagc

SEQ ID NO: 253328 - DNA, 25 bp, Mus musculus
actccctccgcaggaatgacaactg

SEQ ID NO: 253329 - DNA, 25 bp, Mus musculus
tggctgcacactcctacctaaattg

SEQ ID NO: 253330 - DNA, 25 bp, Mus musculus
cgcagtcgtgctcatcaaaataaga

SEQ ID NO: 253331 - DNA, 25 bp, Mus musculus
tccagcgctggccaataagcgatcg

SEQ ID NO: 253332 - DNA, 25 bp, Mus musculus
ctggcgggccctactcattaatagc

SEQ ID NO: 253333 - DNA, 25 bp, Mus musculus
cacagctttaggttgccgctggaga

SEQ ID NO: 253334 - DNA, 25 bp, Mus musculus
aaataagacgccatggctcctgggc

SEQ ID NO: 253335 - DNA, 25 bp, Mus musculus
ttgccgctggagagccgaatccagc

SEQ ID NO: 253336 - DNA, 25 bp, Mus musculus
ttcaacggctcgcagtcgtgctcat

SEQ ID NO: 253337 - DNA, 25 bp, Mus musculus
ggcctcacgctcagggttcaacggc

SEQ ID NO: 253338 - DNA, 25 bp, Mus musculus
caacatattgttgcgggcctcacgc

SEQ ID NO: 253339 - DNA, 25 bp, Mus musculus
tctcgcgagttccagcaacatattg

SEQ ID NO: 253340 - DNA, 25 bp, Mus musculus
gcgtcgccctgactaacattattta

SEQ ID NO: 253341 - DNA, 25 bp, Mus musculus
gactcgactaatcgcgtcgccctga

SEQ ID NO: 253342 - DNA, 25 bp, Mus musculus
gcccaaattaacgactccgactcga

SEQ ID NO: 253343 - DNA, 25 bp, Mus musculus
gccgggcttgtctgacacagcttta

SEQ ID NO: 253344 - DNA, 25 bp, Mus musculus
ccctggggttcagaatcctgctttt

SEQ ID NO: 253345 - DNA, 25 bp, Mus musculus
ccgggcaaaccgaaagcggtgacag

SEQ ID NO: 253346 - DNA, 25 bp, Mus musculus
tcagaggtgcccgtcccgggcaaac

SEQ ID NO: 253347 - DNA, 25 bp, Mus musculus
gcccgtctcaccattgcctccgcag

SEQ ID NO: 253348 - DNA, 25 bp, Mus musculus
gaatcctgctttttgcccctgcaca

SEQ ID NO: 253349 - DNA, 25 bp, Mus musculus
tccgtgcgaccagcgtgacctatgc

SEQ ID NO: 253350 - DNA, 25 bp, Mus musculus
actagtccgtgcgaccagcgtgacc

SEQ ID NO: 253351 - DNA, 25 bp, Mus musculus
agttggggactagtccgtgcgacca

SEQ ID NO: 253352 - DNA, 25 bp, Mus musculus
tgcctgcaaagttggggactagtcc

SEQ ID NO: 253353 - DNA, 25 bp, Mus musculus
ctaccgggccacaggcgtccgattt

SEQ ID NO: 253354 - DNA, 25 bp, Mus musculus
gggcgcactccgaagtctccctccc

SEQ ID NO: 253355 - DNA, 25 bp, Mus musculus
ggggttcagaatcctgctttttgcc

SEQ ID NO: 253356 - DNA, 25 bp, Mus musculus
cggttgcctgcaaagttggggacta

SEQ ID NO: 253357 - DNA, 25 bp, Mus musculus
cagcgtgacctatgcccctggggtt

SEQ ID NO: 253358 - DNA, 25 bp, Mus musculus
ctcctgccagtagttagtcatcttg

SEQ ID NO: 253359 - DNA, 25 bp, Mus musculus
ccacttgaggtttttccaggcgacg

SEQ ID NO: 253360 - DNA, 25 bp, Mus musculus
tttctggaaccttccgcatgccggg

SEQ ID NO: 253361 - DNA, 25 bp, Mus musculus
cggggccgcacattgcaaactcgcg

SEQ ID NO: 253362 - DNA, 25 bp, Mus musculus
tcaatgaacgcctcgtggaagccgt

SEQ ID NO: 253363 - DNA, 25 bp, Mus musculus
ggaagccgttgagctgcccgttcat

SEQ ID NO: 253364 - DNA, 25 bp, Mus musculus
aggatcgcttcagctctcggcaggc

SEQ ID NO: 253365 - DNA, 25 bp, Mus musculus
gagctccggctgaaccattctaccg

SEQ ID NO: 253366 - DNA, 25 bp, Mus musculus
agtcatcttgatggcgtgggttaaa

SEQ ID NO: 253367 - DNA, 25 bp, Mus musculus
cccacgttgattgctggagaagaga

SEQ ID NO: 253368 - DNA, 25 bp, Mus musculus
gatttggatttgaaggacggcctcc

SEQ ID NO: 253369 - DNA, 25 bp, Mus musculus
ccctgtacgagggtatggtacatcc

SEQ ID NO: 253370 - DNA, 25 bp, Mus musculus
tatggtacatccctccgaccgttgc

SEQ ID NO: 253371 - DNA, 25 bp, Mus musculus
ggcgaagcggcccagtatttataga

SEQ ID NO: 253372 - DNA, 25 bp, Mus musculus
cctgagtcggcgtctctcttataaa

SEQ ID NO: 253373 - DNA, 25 bp, Mus musculus
ttgtcgcatcctctgctcgtgtttc

SEQ ID NO: 253374 - DNA, 25 bp, Mus musculus
gcgcagtttcgttcaactcggcatc

SEQ ID NO: 253375 - DNA, 25 bp, Mus musculus
gcggcccagattccgccttactgga

SEQ ID NO: 253376 - DNA, 25 bp, Mus musculus
cggtcggccttgtagtctttacctg

SEQ ID NO: 253377 - DNA, 25 bp, Mus musculus
tcttataaacggacggcagagctcc

SEQ ID NO: 253378 - DNA, 25 bp, Mus musculus
gcttccgccctctgatgacgtgaga

SEQ ID NO: 253379 - DNA, 25 bp, Mus musculus
agagcggcgcacgagattttcccga

SEQ ID NO: 253380 - DNA, 25 bp, Mus musculus
cagccgttgtctgtgtgttccggta

SEQ ID NO: 253381 - DNA, 25 bp, Mus musculus
gccggaagtcaagtccagctcttta

SEQ ID NO: 253382 - DNA, 25 bp, Mus musculus
ggctcggcgatctcgttcttgttca

SEQ ID NO: 253383 - DNA, 25 bp, Mus musculus
tcacttggcctcgtttttcggaagc

SEQ ID NO: 253384 - DNA, 25 bp, Mus musculus
gtcgccttcgctgcttatgatgtag

SEQ ID NO: 253385 - DNA, 25 bp, Mus musculus
tgctgccaaagtcgtcttgtcctgg

SEQ ID NO: 253386 - DNA, 25 bp, Mus musculus
ctcggagtccgagctactgctctga

SEQ ID NO: 253387 - DNA, 25 bp, Mus musculus
gacccgtacggccaatcgctgatgg

SEQ ID NO: 253388 - DNA, 25 bp, Mus musculus
gactgacggagaaggcacttacctt

SEQ ID NO: 253389 - DNA, 25 bp, Mus musculus
ttcggcgaaatagtcgcgcggcttc

SEQ ID NO: 253390 - DNA, 25 bp, Mus musculus
gaggctgaccctaggaatcccttta

SEQ ID NO: 253391 - DNA, 25 bp, Mus musculus
ttctccgattcgttgaccagggacg

SEQ ID NO: 253392 - DNA, 25 bp, Mus musculus
cagggacgacttgacctcatccaga

SEQ ID NO: 253393 - DNA, 25 bp, Mus musculus
ccctcgtcctggaaggggatcagct

SEQ ID NO: 253394 - DNA, 25 bp, Mus musculus
gatcagctcgtcgttcgctccgagg

SEQ ID NO: 253395 - DNA, 25 bp, Mus musculus
ccgctgcggcgacaaagttttgaca

SEQ ID NO: 253396 - DNA, 25 bp, Mus musculus
caaagttttgacagggcgtggctct

SEQ ID NO: 253397 - DNA, 25 bp, Mus musculus
atcgtcccgcagcacggaacctagg

SEQ ID NO: 253398 - DNA, 25 bp, Mus musculus
ctctcggaaccaggcgaactgcagc

SEQ ID NO: 253399 - DNA, 25 bp, Mus musculus
ctccgcctgtggaggagacacaaag

SEQ ID NO: 253400 - DNA, 25 bp, Mus musculus
cggcgtccgcaaatcccgctcgtcc

SEQ ID NO: 253401 - DNA, 25 bp, Mus musculus
gctcgcccgcggtctcccagagacc

SEQ ID NO: 253402 - DNA, 25 bp, Mus musculus
cctcggcgtccggtatgtgtcccga

SEQ ID NO: 253403 - DNA, 25 bp, Mus musculus
tatgtgtcccgagggccaggctccc

SEQ ID NO: 253404 - DNA, 25 bp, Mus musculus
atgacagtgcaaagcctccggccgc

SEQ ID NO: 253405 - DNA, 25 bp, Mus musculus
ggggctcggctctcaccttcatgtc

SEQ ID NO: 253406 - DNA, 25 bp, Mus musculus
ctcggctctcaccttcatgtcggga

SEQ ID NO: 253407 - DNA, 25 bp, Mus musculus
gctctcaccttcatgtcgggacatc

SEQ ID NO: 253408 - DNA, 25 bp, Mus musculus
ccttcatgtcgggacatcctagttc

SEQ ID NO: 253409 - DNA, 25 bp, Mus musculus
tcgggacatcctagttcagacgctg

SEQ ID NO: 253410 - DNA, 25 bp, Mus musculus
atcctagttcagacgctggcggcgc

SEQ ID NO: 253411 - DNA, 25 bp, Mus musculus
gccgactcccactcgactcccgggc

SEQ ID NO: 253412 - DNA, 25 bp, Mus musculus
gcccgccgtgactcggtcactctcg

SEQ ID NO: 253413 - DNA, 25 bp, Mus musculus
cacggcgcccggctcttccgggagc

SEQ ID NO: 253414 - DNA, 25 bp, Mus musculus
catgaggtcggccagatgccagcgc

SEQ ID NO: 253415 - DNA, 25 bp, Mus musculus
gcagaggagccctaaaaccggtgtc

SEQ ID NO: 253416 - DNA, 25 bp, Mus musculus
ctgcagagacggtcacgtcagcatc

SEQ ID NO: 253417 - DNA, 25 bp, Mus musculus
tgagcccacggcgagctggcacagt

SEQ ID NO: 253418 - DNA, 25 bp, Mus musculus
agacggtcacgtcagcatccattcc

SEQ ID NO: 253419 - DNA, 25 bp, Mus musculus
agtctgagcccacggcgagctggca

SEQ ID NO: 253420 - DNA, 25 bp, Mus musculus
ggatccctagtgaccggatatcatg

SEQ ID NO: 253421 - DNA, 25 bp, Mus musculus
tgccagagcaggatccctagtgacc

SEQ ID NO: 253422 - DNA, 25 bp, Mus musculus
cgccgcccagggaatgccagagcag

SEQ ID NO: 253423 - DNA, 25 bp, Mus musculus
agcctccatttcttggacgagcccg

SEQ ID NO: 253424 - DNA, 25 bp, Mus musculus
acaccgagcagcctccatttcttgg

SEQ ID NO: 253425 - DNA, 25 bp, Mus musculus
gctacatgccttctgcgcagacgca

SEQ ID NO: 253426 - DNA, 25 bp, Mus musculus
tagagtcctcgctccgcctcttctg

SEQ ID NO: 253427 - DNA, 25 bp, Mus musculus
ccggatatcatgaggtcggccagat

SEQ ID NO: 253428 - DNA, 25 bp, Mus musculus
gcactagcaccgcaaggcctcggta

SEQ ID NO: 253429 - DNA, 25 bp, Mus musculus
gagcctcgctctttccgctgcgaag

SEQ ID NO: 253430 - DNA, 25 bp, Mus musculus
agcatcgatcccaccaggaggccga

SEQ ID NO: 253431 - DNA, 25 bp, Mus musculus
gggacgaggcgacaccacgcgactc

SEQ ID NO: 253432 - DNA, 25 bp, Mus musculus
ccttagctctgggacgaggcgacac

SEQ ID NO: 253433 - DNA, 25 bp, Mus musculus
gctcgggaccctggctgttccgcta

SEQ ID NO: 253434 - DNA, 25 bp, Mus musculus
cgttagggctcgatctagcgagaga

SEQ ID NO: 253435 - DNA, 25 bp, Mus musculus
cggagcctccgagccagaacgcgga

SEQ ID NO: 253436 - DNA, 25 bp, Mus musculus
cgcaaggcctcggtagaaactttcg

SEQ ID NO: 253437 - DNA, 25 bp, Mus musculus
agaaactttcgctaggaccgacacg

SEQ ID NO: 253438 - DNA, 25 bp, Mus musculus
ctaggaccgacacggccgccatgtt

SEQ ID NO: 253439 - DNA, 25 bp, Mus musculus
cagcgctacggatcgccgtcaggga

SEQ ID NO: 253440 - DNA, 25 bp, Mus musculus
atcgccgtcagggacaaggcgcgcc

SEQ ID NO: 253441 - DNA, 25 bp, Mus musculus
tgcgaagctcgcagagccaaagggc

SEQ ID NO: 253442 - DNA, 25 bp, Mus musculus
ctagtacccaggagcctgctgctca

SEQ ID NO: 253443 - DNA, 25 bp, Mus musculus
cgcgaacgcctctcaacgtggcatt

SEQ ID NO: 253444 - DNA, 25 bp, Mus musculus
cagaagattccaaaccgccgggtcg

SEQ ID NO: 253445 - DNA, 25 bp, Mus musculus
gacttggggttttgttgaatgtatg

SEQ ID NO: 253446 - DNA, 25 bp, Mus musculus
gaggatcctagactcgtccaccaca

SEQ ID NO: 253447 - DNA, 25 bp, Mus musculus
tcgcctgttgcaaccgaaggggaac

SEQ ID NO: 253448 - DNA, 25 bp, Mus musculus
gcgctgtgccttaccgtggattctc

SEQ ID NO: 253449 - DNA, 25 bp, Mus musculus
accgtggattctccttccgagctcg

SEQ ID NO: 253450 - DNA, 25 bp, Mus musculus
tcccactctcgttgctgcagcaaga

SEQ ID NO: 253451 - DNA, 25 bp, Mus musculus
taacccgttgcgatcccgcgtggag

SEQ ID NO: 253452 - DNA, 25 bp, Mus musculus
ccagctcccggtggtctcttttctt

SEQ ID NO: 253453 - DNA, 25 bp, Mus musculus
tgatatatctccttttcctagtacc

SEQ ID NO: 253454 - DNA, 25 bp, Mus musculus
caagagacaaaagagcggcgcccgc

SEQ ID NO: 253455 - DNA, 25 bp, Mus musculus
gtggcattcccagtcctgggcgttc

SEQ ID NO: 253456 - DNA, 25 bp, Mus musculus
gatgcacttcgcagggcgccctgca

SEQ ID NO: 253457 - DNA, 25 bp, Mus musculus
agacctcgggttcctgattctggcc

SEQ ID NO: 253458 - DNA, 25 bp, Mus musculus
ttgcgtagacctcgggttcctgatt

SEQ ID NO: 253459 - DNA, 25 bp, Mus musculus
tccatgcttgcgtagacctcgggtt

SEQ ID NO: 253460 - DNA, 25 bp, Mus musculus
ggctctgtcctccatgcttgcgtag

SEQ ID NO: 253461 - DNA, 25 bp, Mus musculus
accttcctccgtgagtcgtgccggc

SEQ ID NO: 253462 - DNA, 25 bp, Mus musculus
ttgtcgcgcaccttcctccgtgagt

SEQ ID NO: 253463 - DNA, 25 bp, Mus musculus
gtccaaacgccagtggcagacctcg

SEQ ID NO: 253464 - DNA, 25 bp, Mus musculus
ggcaacaatatcctagttccctcgg

SEQ ID NO: 253465 - DNA, 25 bp, Mus musculus
gcgccctgcagacacggcaacaata

SEQ ID NO: 253466 - DNA, 25 bp, Mus musculus
gcgagggagccaccggtccaaacgc

SEQ ID NO: 253467 - DNA, 25 bp, Mus musculus
tgcagacacggcaacaatatcctag

SEQ ID NO: 253468 - DNA, 25 bp, Mus musculus
caatatcctagttccctcggtgacg

SEQ ID NO: 253469 - DNA, 25 bp, Mus musculus
cgtggatcggccgatgcacttcgca

SEQ ID NO: 253470 - DNA, 25 bp, Mus musculus
agagcgggacagaaagtcagcctcg

SEQ ID NO: 253471 - DNA, 25 bp, Mus musculus
ggacagaaagtcagcctcggcaaac

SEQ ID NO: 253472 - DNA, 25 bp, Mus musculus
gacagaaagtcagcctcggcaaacc

SEQ ID NO: 253473 - DNA, 25 bp, Mus musculus
gggacagaaagtcagcctcggcaaa

SEQ ID NO: 253474 - DNA, 25 bp, Mus musculus
agcgggacagaaagtcagcctcggc

SEQ ID NO: 253475 - DNA, 25 bp, Mus musculus
gaaagtcagcctcggcaaaccccga

SEQ ID NO: 253476 - DNA, 25 bp, Mus musculus
gagagcgggacagaaagtcagcctc

SEQ ID NO: 253477 - DNA, 25 bp, Mus musculus
tcgcggcgagtgacacccaaaggga

SEQ ID NO: 253478 - DNA, 25 bp, Mus musculus
gctcgcggcgagtgacacccaaagg

SEQ ID NO: 253479 - DNA, 25 bp, Mus musculus
cgctcgcggcgagtgacacccaaag

SEQ ID NO: 253480 - DNA, 25 bp, Mus musculus
agcggtaaacaggacagggccacgg

SEQ ID NO: 253481 - DNA, 25 bp, Mus musculus
ctggagcggtaaacaggacagggcc

SEQ ID NO: 253482 - DNA, 25 bp, Mus musculus
gttaggagcctggagcggtaaacag

SEQ ID NO: 253483 - DNA, 25 bp, Mus musculus
cgggacagaaagtcagcctcggcaa

SEQ ID NO: 253484 - DNA, 25 bp, Mus musculus
actgtcaaatcctggggagtctcga

SEQ ID NO: 253485 - DNA, 25 bp, Mus musculus
tgctcggagaagacgcacaatcgcg

SEQ ID NO: 253486 - DNA, 25 bp, Mus musculus
cgcgagcagcttacgacactcagtg

SEQ ID NO: 253487 - DNA, 25 bp, Mus musculus
acactcagtgagcagtcggtgccgg

SEQ ID NO: 253488 - DNA, 25 bp, Mus musculus
acacgaatggcaggcgttctccaac

SEQ ID NO: 253489 - DNA, 25 bp, Mus musculus
acattgtgcgtctgccagatcctcg

SEQ ID NO: 253490 - DNA, 25 bp, Mus musculus
tgccgatgacattctccagactgtc

SEQ ID NO: 253491 - DNA, 25 bp, Mus musculus
acgtcacagtctcaactgcagagga

SEQ ID NO: 253492 - DNA, 25 bp, Mus musculus
ccggcacgtagttgggaaacttgcg

SEQ ID NO: 253493 - DNA, 25 bp, Mus musculus
acttgcgggtcctagaagtcgcctc

SEQ ID NO: 253494 - DNA, 25 bp, Mus musculus
agcgcagcagcaaagtgagacattg

SEQ ID NO: 253495 - DNA, 25 bp, Mus musculus
gctcgcgcacactcctcggaggagg

SEQ ID NO: 253496 - DNA, 25 bp, Mus musculus
cttcgattcgcgttggtcattgccg

SEQ ID NO: 253497 - DNA, 25 bp, Mus musculus
cctggactccaaggtggcttcgatt

SEQ ID NO: 253498 - DNA, 25 bp, Mus musculus
gcgcaactctttcgccggcttgttc

SEQ ID NO: 253499 - DNA, 25 bp, Mus musculus
cccatgtgttcgagaccgttcccta

SEQ ID NO: 253500 - DNA, 25 bp, Mus musculus
ttgccattgtggtcagctctctcga

SEQ ID NO: 253501 - DNA, 25 bp, Mus musculus
gctacacctggagcataatgacttg

SEQ ID NO: 253502 - DNA, 25 bp, Mus musculus
tcctggaagtcccttacgagcatca

SEQ ID NO: 253503 - DNA, 25 bp, Mus musculus
cgcagcctcaagtttctcgacattg

SEQ ID NO: 253504 - DNA, 25 bp, Mus musculus
aattcgtgccggtgcgcatctttca

SEQ ID NO: 253505 - DNA, 25 bp, Mus musculus
ctgggcttgtctttgcgctacaaca

SEQ ID NO: 253506 - DNA, 25 bp, Mus musculus
ccggccagttcacagggttaatgca

SEQ ID NO: 253507 - DNA, 25 bp, Mus musculus
ctcacgtggctgtatttggatcaca

SEQ ID NO: 253508 - DNA, 25 bp, Mus musculus
gcctttcagaaactgcgccgagtta

SEQ ID NO: 253509 - DNA, 25 bp, Mus musculus
gtggacctgtcctataacaagctgc

SEQ ID NO: 253510 - DNA, 25 bp, Mus musculus
gcgggccaatgccatccaattcgtg

SEQ ID NO: 253511 - DNA, 25 bp, Mus musculus
cactcgctctgcctgaggcggaata

SEQ ID NO: 253512 - DNA, 25 bp, Mus musculus
ctggcgcggaatgacagaagctgct

SEQ ID NO: 253513 - DNA, 25 bp, Mus musculus
ttgctcgttcgctcgtgcccgcgac

SEQ ID NO: 253514 - DNA, 25 bp, Mus musculus
cacgcgcggccgctcacttgcttgc

SEQ ID NO: 253515 - DNA, 25 bp, Mus musculus
agcggcccggatcgccgctagggga

SEQ ID NO: 253516 - DNA, 25 bp, Mus musculus
ccgcgtcctgcccaagcgagcggca

SEQ ID NO: 253517 - DNA, 25 bp, Mus musculus
cagggctgccagcaaagccgctccc

SEQ ID NO: 253518 - DNA, 25 bp, Mus musculus
tcactcagggctgccagcaaagccg

SEQ ID NO: 253519 - DNA, 25 bp, Mus musculus
ccgggtctccgcctcactcagggct

SEQ ID NO: 253520 - DNA, 25 bp, Mus musculus
aatgacagaagctgctggagaggcg

SEQ ID NO: 253521 - DNA, 25 bp, Mus musculus
cggtgggagtttctcgcctcctcct

SEQ ID NO: 253522 - DNA, 25 bp, Mus musculus
tcgttcgctcgtgcccgcgactcgc

SEQ ID NO: 253523 - DNA, 25 bp, Mus musculus
actcagggctgccagcaaagccgct

SEQ ID NO: 253524 - DNA, 25 bp, Mus musculus
tggggactagggcagctgctgcagc

SEQ ID NO: 253525 - DNA, 25 bp, Mus musculus
cagctggcgcggaatgacagaagct

SEQ ID NO: 253526 - DNA, 25 bp, Mus musculus
ccagcagcgtgctatcaagcagata

SEQ ID NO: 253527 - DNA, 25 bp, Mus musculus
acccaagctttgatcctggctccaa

SEQ ID NO: 253528 - DNA, 25 bp, Mus musculus
tcgagaaacccaagctttgatcctg

SEQ ID NO: 253529 - DNA, 25 bp, Mus musculus
ccaggttcgagaaacccaagctttg

SEQ ID NO: 253530 - DNA, 25 bp, Mus musculus
cagtgcttggatatccaggttcgag

SEQ ID NO: 253531 - DNA, 25 bp, Mus musculus
caagacggccaccttcagtatctca

SEQ ID NO: 253532 - DNA, 25 bp, Mus musculus
tggcacaggcaagacggccaccttc

SEQ ID NO: 253533 - DNA, 25 bp, Mus musculus
ctttgatcctggctccaaccagaga

SEQ ID NO: 253534 - DNA, 25 bp, Mus musculus
ccttcagcgatccagcagcgtgcta

SEQ ID NO: 253535 - DNA, 25 bp, Mus musculus
gttttgaaaaaccttcagcgatcca

SEQ ID NO: 253536 - DNA, 25 bp, Mus musculus
cagcctcatagaagaaaggaggatg

SEQ ID NO: 253537 - DNA, 25 bp, Mus musculus
gggagcagcctcatagaagaaagga

SEQ ID NO: 253538 - DNA, 25 bp, Mus musculus
gtgctatcaagcagataatgaaagg

SEQ ID NO: 253539 - DNA, 25 bp, Mus musculus
gcacagtctcagtctggcacaggca

SEQ ID NO: 253540 - DNA, 25 bp, Mus musculus
cggcgccaggtcgagtccagcgata

SEQ ID NO: 253541 - DNA, 25 bp, Mus musculus
ctagccttaaggagacgcgccaatc

SEQ ID NO: 253542 - DNA, 25 bp, Mus musculus
gcaggcgccggacacctagccttaa

SEQ ID NO: 253543 - DNA, 25 bp, Mus musculus
tgcgcatctcgagacgcgcgactgc

SEQ ID NO: 253544 - DNA, 25 bp, Mus musculus
gagctctcacaaacacgcatgcgca

SEQ ID NO: 253545 - DNA, 25 bp, Mus musculus
ggaaagggctccgttgctcagatcc

SEQ ID NO: 253546 - DNA, 25 bp, Mus musculus
cccagaggactttcaggcggcgcca

SEQ ID NO: 253547 - DNA, 25 bp, Mus musculus
tccagcgatagcgatagcgatagcg

SEQ ID NO: 253548 - DNA, 25 bp, Mus musculus
atagcgatagcgatagcgacggcgc

SEQ ID NO: 253549 - DNA, 25 bp, Mus musculus
cgcattgctcaatgccggggttgcc

SEQ ID NO: 253550 - DNA, 25 bp, Mus musculus
tatggccgtctgcacccgcattgct

SEQ ID NO: 253551 - DNA, 25 bp, Mus musculus
agaggcctctatggccgtctgcacc

SEQ ID NO: 253552 - DNA, 25 bp, Mus musculus
cgttgctcagatccagaggcctcta

SEQ ID NO: 253553 - DNA, 25 bp, Mus musculus
cgcgccaatcctacttggaacatgg

SEQ ID NO: 253554 - DNA, 25 bp, Mus musculus
aaagcgggtatcaaagtgtgcgcac

SEQ ID NO: 253555 - DNA, 25 bp, Mus musculus
cagcccagctataaagcgggtatca

SEQ ID NO: 253556 - DNA, 25 bp, Mus musculus
tcgtgatctagagaggggcagaccc

SEQ ID NO: 253557 - DNA, 25 bp, Mus musculus
gcagacccggaacccgatttcgtgc

SEQ ID NO: 253558 - DNA, 25 bp, Mus musculus
gtgcagacacggcaggcatcagatg

SEQ ID NO: 253559 - DNA, 25 bp, Mus musculus
aacccgatttcgtgcagcccagcta

SEQ ID NO: 253560 - DNA, 25 bp, Mus musculus
ttctctcgtcttccgggactcggcg

SEQ ID NO: 253561 - DNA, 25 bp, Mus musculus
cattcggacgctccgggccaggtac

SEQ ID NO: 253562 - DNA, 25 bp, Mus musculus
gcatcagatgcgaaggcagcaagcc

SEQ ID NO: 253563 - DNA, 25 bp, Mus musculus
ctctgaaatcggcttgggcccgtgc

SEQ ID NO: 253564 - DNA, 25 bp, Mus musculus
tctgaaggcccggtgctctgaaatc

SEQ ID NO: 253565 - DNA, 25 bp, Mus musculus
cggtggcttgaacccaccgggctct

SEQ ID NO: 253566 - DNA, 25 bp, Mus musculus
cgccggtccacgatgacaggtttcg

SEQ ID NO: 253567 - DNA, 25 bp, Mus musculus
gcagcaagccgtggcctggccattc

SEQ ID NO: 253568 - DNA, 25 bp, Mus musculus
cacttacttgtctgggacgcggggt

SEQ ID NO: 253569 - DNA, 25 bp, Mus musculus
ctcggcgctcactctcgcgagactt

SEQ ID NO: 253570 - DNA, 25 bp, Mus musculus
acacggaggaagccggcacctcggc

SEQ ID NO: 253571 - DNA, 25 bp, Mus musculus
accgccaggagccacttacttgtct

SEQ ID NO: 253572 - DNA, 25 bp, Mus musculus
gtagggaccgcaaaagccgaaggca

SEQ ID NO: 253573 - DNA, 25 bp, Mus musculus
gaggaactcgcgtagggaccgcaaa

SEQ ID NO: 253574 - DNA, 25 bp, Mus musculus
cgtgcgcctgagaggaactcgcgta

SEQ ID NO: 253575 - DNA, 25 bp, Mus musculus
acgctgatggggctggtattgtccc

SEQ ID NO: 253576 - DNA, 25 bp, Mus musculus
tcaccaggatcacgctgatggggct

SEQ ID NO: 253577 - DNA, 25 bp, Mus musculus
cgagctcaccaggatcacgctgatg

SEQ ID NO: 253578 - DNA, 25 bp, Mus musculus
agacttcgccgagcggcgctccaca

SEQ ID NO: 253579 - DNA, 25 bp, Mus musculus
ctcctggctcctctggaaggggtac

SEQ ID NO: 253580 - DNA, 25 bp, Mus musculus
aggagccacttacttgtctgggacg

SEQ ID NO: 253581 - DNA, 25 bp, Mus musculus
gctcctctggaaggggtacctgaag

SEQ ID NO: 253582 - DNA, 25 bp, Mus musculus
gcccttccctaggtgatctgatcca

SEQ ID NO: 253583 - DNA, 25 bp, Mus musculus
acagggcgcagcagcacactgccgt

SEQ ID NO: 253584 - DNA, 25 bp, Mus musculus
ggaagtacgcgccagtcgtcctaga

SEQ ID NO: 253585 - DNA, 25 bp, Mus musculus
ccgtgcccttccctaggtgatctga

SEQ ID NO: 253586 - DNA, 25 bp, Mus musculus
tcgtcctagagaaggtaagctgctt

SEQ ID NO: 253587 - DNA, 25 bp, Mus musculus
tcctagagaaggtaagctgcttccc

SEQ ID NO: 253588 - DNA, 25 bp, Mus musculus
actgccgtgcccttccctaggtgat

SEQ ID NO: 253589 - DNA, 25 bp, Mus musculus
agggcgcagcagcacactgccgtgc

SEQ ID NO: 253590 - DNA, 25 bp, Mus musculus
cgcgccagtcgtcctagagaaggta

SEQ ID NO: 253591 - DNA, 25 bp, Mus musculus
gttccgtgctcagccctgattgggg

SEQ ID NO: 253592 - DNA, 25 bp, Mus musculus
cgcgttccgtgctcagccctgattg

SEQ ID NO: 253593 - DNA, 25 bp, Mus musculus
gccagtcgtcctagagaaggtaagc

SEQ ID NO: 253594 - DNA, 25 bp, Mus musculus
agtacgcgccagtcgtcctagagaa

SEQ ID NO: 253595 - DNA, 25 bp, Mus musculus
ccaaattgctctccggcgcgcgggt

SEQ ID NO: 253596 - DNA, 25 bp, Mus musculus
tcggtgacagtggtctcagcccacc

SEQ ID NO: 253597 - DNA, 25 bp, Mus musculus
gtggcgactgcccattagggctccg

SEQ ID NO: 253598 - DNA, 25 bp, Mus musculus
gactgcccattagggctccgggagc

SEQ ID NO: 253599 - DNA, 25 bp, Mus musculus
ctgtggggctgaaaagagctgaccc

SEQ ID NO: 253600 - DNA, 25 bp, Mus musculus
ccgatgcctgtttaccttcgcggta

SEQ ID NO: 253601 - DNA, 25 bp, Mus musculus
ggtctcagcccaccgctggggacag

SEQ ID NO: 253602 - DNA, 25 bp, Mus musculus
gtacttcttgcggagccgccgatga

SEQ ID NO: 253603 - DNA, 25 bp, Mus musculus
cggagccgccgatgaacgctcttca

SEQ ID NO: 253604 - DNA, 25 bp, Mus musculus
cccggacagcttctcctgctccagc

SEQ ID NO: 253605 - DNA, 25 bp, Mus musculus
gaaagcactgggctcctcgccaggc

SEQ ID NO: 253606 - DNA, 25 bp, Mus musculus
gggcggtgtcttcccaatagcgcaa

SEQ ID NO: 253607 - DNA, 25 bp, Mus musculus
gtcttcccaatagcgcaaggtgatt

SEQ ID NO: 253608 - DNA, 25 bp, Mus musculus
tagcgcaaggtgattggtgaactgc

SEQ ID NO: 253609 - DNA, 25 bp, Mus musculus
accttcgcggtacttcttgcggagc

SEQ ID NO: 253610 - DNA, 25 bp, Mus musculus
ggtgcgcagacaccgccgcttcgag

SEQ ID NO: 253611 - DNA, 25 bp, Mus musculus
agctggagcgcgcacagcgcttgga

SEQ ID NO: 253612 - DNA, 25 bp, Mus musculus
aacgtgttcacctctgcagaggagc

SEQ ID NO: 253613 - DNA, 25 bp, Mus musculus
agaacgtgttcacctctgcagagga

SEQ ID NO: 253614 - DNA, 25 bp, Mus musculus
gactttgaataagaacgtgttcacc

SEQ ID NO: 253615 - DNA, 25 bp, Mus musculus
ttcgagaggactttgaataagaacg

SEQ ID NO: 253616 - DNA, 25 bp, Mus musculus
agacaccgccgcttcgagaggactt

SEQ ID NO: 253617 - DNA, 25 bp, Mus musculus
agcctctgacctctcggtgcgcaga

SEQ ID NO: 253618 - DNA, 25 bp, Mus musculus
ggacacagcctctgacctctcggtg

SEQ ID NO: 253619 - DNA, 25 bp, Mus musculus
atggtagcgaggacacagcctctga

SEQ ID NO: 253620 - DNA, 25 bp, Mus musculus
gcagcgacagcgaggatggtagcga

SEQ ID NO: 253621 - DNA, 25 bp, Mus musculus
ttgcaggaccgcgagtgcagcgaca

SEQ ID NO: 253622 - DNA, 25 bp, Mus musculus
cgccgcttcgagaggactttgaata

SEQ ID NO: 253623 - DNA, 25 bp, Mus musculus
accgcgagtgcagcgacagcagcga

SEQ ID NO: 253624 - DNA, 25 bp, Mus musculus
cacgcgccaggataaagatggcttc

SEQ ID NO: 253625 - DNA, 25 bp, Mus musculus
ccggggatcatgttttaggtggaat

SEQ ID NO: 253626 - DNA, 25 bp, Mus musculus
gagtttaacctctaggccaacagga

SEQ ID NO: 253627 - DNA, 25 bp, Mus musculus
gcctcagtaggtgctgagtttaacc

SEQ ID NO: 253628 - DNA, 25 bp, Mus musculus
cggatgcttctctagagcctcagta

SEQ ID NO: 253629 - DNA, 25 bp, Mus musculus
gctgagccggaagtccggatgcttc

SEQ ID NO: 253630 - DNA, 25 bp, Mus musculus
tgatgtactcttccgggcggccaca

SEQ ID NO: 253631 - DNA, 25 bp, Mus musculus
tctgactccggggtctgatgtactc

SEQ ID NO: 253632 - DNA, 25 bp, Mus musculus
cctcactaggcgtggcgcgccagaa

SEQ ID NO: 253633 - DNA, 25 bp, Mus musculus
agaccacgcctctccgtgtgggcgt

SEQ ID NO: 253634 - DNA, 25 bp, Mus musculus
aggcagcctcgagaggcgaactccc

SEQ ID NO: 253635 - DNA, 25 bp, Mus musculus
ccaaggcctttactctcgccagagg

SEQ ID NO: 253636 - DNA, 25 bp, Mus musculus
agcgttacgtcagggtctgccttca

SEQ ID NO: 253637 - DNA, 25 bp, Mus musculus
aagatggcttcctgtcccgccagcg

SEQ ID NO: 253638 - DNA, 25 bp, Mus musculus
tgtccgaccgctttgaaaccaggcc

SEQ ID NO: 253639 - DNA, 25 bp, Mus musculus
aggactttcccagctacccagactg

SEQ ID NO: 253640 - DNA, 25 bp, Mus musculus
caggtcctctgcgtgctccagattc

SEQ ID NO: 253641 - DNA, 25 bp, Mus musculus
cagattccgggagagcacgcaactt

SEQ ID NO: 253642 - DNA, 25 bp, Mus musculus
gcaacttggtccgaagcgagccaga

SEQ ID NO: 253643 - DNA, 25 bp, Mus musculus
cgaggcgatcatcttgttgcggcga

SEQ ID NO: 253644 - DNA, 25 bp, Mus musculus
gggcggccgtcccatcaagaaatta

SEQ ID NO: 253645 - DNA, 25 bp, Mus musculus
tgagggcctcaagtttccagaaaca

SEQ ID NO: 253646 - DNA, 25 bp, Mus musculus
gtcgctaacttcactcactgggtca

SEQ ID NO: 253647 - DNA, 25 bp, Mus musculus
cactgggtcactaaggctcaacttc

SEQ ID NO: 253648 - DNA, 25 bp, Mus musculus
tgacagttctgttccaatccggcga

SEQ ID NO: 253649 - DNA, 25 bp, Mus musculus
ccggcgatcgcacctatcagagtca

SEQ ID NO: 253650 - DNA, 25 bp, Mus musculus
ggtgtcctgagactccagcactgga

SEQ ID NO: 253651 - DNA, 25 bp, Mus musculus
ctccgtgaataagcaggcgatcata

SEQ ID NO: 253652 - DNA, 25 bp, Mus musculus
agtaccgctactgcgcgggcctcgg

SEQ ID NO: 253653 - DNA, 25 bp, Mus musculus
agatgggcagcgaggttctgggcac

SEQ ID NO: 253654 - DNA, 25 bp, Mus musculus
gcgtcgggcagcctctactcagtac

SEQ ID NO: 253655 - DNA, 25 bp, Mus musculus
taccctcggccgagctcggcctgca

SEQ ID NO: 253656 - DNA, 25 bp, Mus musculus
ggcagcgaggttctgggcaccgagc

SEQ ID NO: 253657 - DNA, 25 bp, Mus musculus
acgcggccgcacaccggggcgctca

SEQ ID NO: 253658 - DNA, 25 bp, Mus musculus
cgacggcggcgggaagagagagacc

SEQ ID NO: 253659 - DNA, 25 bp, Mus musculus
ggccgctcggccctggccagcatct

SEQ ID NO: 253660 - DNA, 25 bp, Mus musculus
gccctggccagcatctctggctccg

SEQ ID NO: 253661 - DNA, 25 bp, Mus musculus
gtcgggcagcctctactcagtaccg

SEQ ID NO: 253662 - DNA, 25 bp, Mus musculus
gggcagcctctactcagtaccgcta

SEQ ID NO: 253663 - DNA, 25 bp, Mus musculus
ggcagcctctactcagtaccgctac

SEQ ID NO: 253664 - DNA, 25 bp, Mus musculus
tactcagtaccgctactgcgcgggc

SEQ ID NO: 253665 - DNA, 25 bp, Mus musculus
ccgctcggccctggccagcatctct

SEQ ID NO: 253666 - DNA, 25 bp, Mus musculus
catgccgccgcggcgcagtatcgtg

SEQ ID NO: 253667 - DNA, 25 bp, Mus musculus
catctcctcgcgagctctcgccttg

SEQ ID NO: 253668 - DNA, 25 bp, Mus musculus
gcgtccgcgccacgcggcgatccca

SEQ ID NO: 253669 - DNA, 25 bp, Mus musculus
atgtgagtcggcgtccgcgccacgc

SEQ ID NO: 253670 - DNA, 25 bp, Mus musculus
caaggatcgctttggcccggcccgg

SEQ ID NO: 253671 - DNA, 25 bp, Mus musculus
cgcagtatcgtggaggtgaaggtgc

SEQ ID NO: 253672 - DNA, 25 bp, Mus musculus
gtgaaggtgctggacgtgcagaagc

SEQ ID NO: 253673 - DNA, 25 bp, Mus musculus
cagaagcggcgcgtgcccaacaagc

SEQ ID NO: 253674 - DNA, 25 bp, Mus musculus
cggcgcgtgcccaacaagcattatg

SEQ ID NO: 253675 - DNA, 25 bp, Mus musculus
cgcgtgcccaacaagcattatgtga

SEQ ID NO: 253676 - DNA, 25 bp, Mus musculus
tgcccaacaagcattatgtgagtcg

SEQ ID NO: 253677 - DNA, 25 bp, Mus musculus
cggcaaggatcgctttggcccggcc

SEQ ID NO: 253678 - DNA, 25 bp, Mus musculus
cacgagcccttggtccctgtgcctt

SEQ ID NO: 253679 - DNA, 25 bp, Mus musculus
aagcattatgtgagtcggcgtccgc

SEQ ID NO: 253680 - DNA, 25 bp, Mus musculus
aaagtcctgtccagttcagccggcc

SEQ ID NO: 253681 - DNA, 25 bp, Mus musculus
acgaagccaccgtgccgcggacggc

SEQ ID NO: 253682 - DNA, 25 bp, Mus musculus
ctagggcagcgcacgaagccaccgt

SEQ ID NO: 253683 - DNA, 25 bp, Mus musculus
cctccccgcatgcattggcagtggg

SEQ ID NO: 253684 - DNA, 25 bp, Mus musculus
gaggcagcttcggaacttttccctc

SEQ ID NO: 253685 - DNA, 25 bp, Mus musculus
ccctcgaggcagcttcggaactttt

SEQ ID NO: 253686 - DNA, 25 bp, Mus musculus
cccaaatcaggcttttgttccctcg

SEQ ID NO: 253687 - DNA, 25 bp, Mus musculus
tttgcttcaaagtcctgtccagttc

SEQ ID NO: 253688 - DNA, 25 bp, Mus musculus
aggctggctttgcttcaaagtcctg

SEQ ID NO: 253689 - DNA, 25 bp, Mus musculus
ccggagcaggctggctttgcttcaa

SEQ ID NO: 253690 - DNA, 25 bp, Mus musculus
ctgtctccggagcaggctggctttg

SEQ ID NO: 253691 - DNA, 25 bp, Mus musculus
cggcctccgccgagccagcaggaac

SEQ ID NO: 253692 - DNA, 25 bp, Mus musculus
ctgcgcgttggagcctccttcagct

SEQ ID NO: 253693 - DNA, 25 bp, Mus musculus
atcaggcttttgttccctcgaggca

SEQ ID NO: 253694 - DNA, 25 bp, Mus musculus
tggcagataagctggctgaagcccg

SEQ ID NO: 253695 - DNA, 25 bp, Mus musculus
agggagacgcttctcctgactcgcc

SEQ ID NO: 253696 - DNA, 25 bp, Mus musculus
agaccacgagacttccggctagctg

SEQ ID NO: 253697 - DNA, 25 bp, Mus musculus
gacatcccagctagccgaactgttg

SEQ ID NO: 253698 - DNA, 25 bp, Mus musculus
cacttggaggctgccatcgagatgc

SEQ ID NO: 253699 - DNA, 25 bp, Mus musculus
tctaccacactctgcagggacattc

SEQ ID NO: 253700 - DNA, 25 bp, Mus musculus
cggcgatttacagctgtgcccatct

SEQ ID NO: 253701 - DNA, 25 bp, Mus musculus
cctgcagcagttgcacggcgattta

SEQ ID NO: 253702 - DNA, 25 bp, Mus musculus
acattgcttcgtctgcaccgcgagc

SEQ ID NO: 253703 - DNA, 25 bp, Mus musculus
tgcccggacttcagcagacagccgt

SEQ ID NO: 253704 - DNA, 25 bp, Mus musculus
actcgctaacgtaccctcgtcgtgg

SEQ ID NO: 253705 - DNA, 25 bp, Mus musculus
gcgtccagctctagtggccctttgc

SEQ ID NO: 253706 - DNA, 25 bp, Mus musculus
ttgggactcgccgtgcaaatggcac

SEQ ID NO: 253707 - DNA, 25 bp, Mus musculus
atgcagcttcgttcactgggccgga

SEQ ID NO: 253708 - DNA, 25 bp, Mus musculus
aggaccttcctccagacggtgagca

SEQ ID NO: 253709 - DNA, 25 bp, Mus musculus
gcagcatctgcaccgggcgcagaca

SEQ ID NO: 253710 - DNA, 25 bp, Mus musculus
ggaaatgttaagtgccttggcctcc

SEQ ID NO: 253711 - DNA, 25 bp, Mus musculus
ccacctcaccactcaggaaatgtta

SEQ ID NO: 253712 - DNA, 25 bp, Mus musculus
atcggctgattatgcgcggtgccca

SEQ ID NO: 253713 - DNA, 25 bp, Mus musculus
cccaggagatgggtatcggctgatt

SEQ ID NO: 253714 - DNA, 25 bp, Mus musculus
tgcgtggacgtgttgttcggtaaac

SEQ ID NO: 253715 - DNA, 25 bp, Mus musculus
ccgtttgagaagaacgtggagtcca

SEQ ID NO: 253716 - DNA, 25 bp, Mus musculus
cgagttcagttctgcccgtttgaga

SEQ ID NO: 253717 - DNA, 25 bp, Mus musculus
ccggtcaagctggttcgagttcagt

SEQ ID NO: 253718 - DNA, 25 bp, Mus musculus
ccagtgctactccttccggggtgga

SEQ ID NO: 253719 - DNA, 25 bp, Mus musculus
ctcaactgctctgtgatcgccgacg

SEQ ID NO: 253720 - DNA, 25 bp, Mus musculus
tcagggtccctaactcatcggtttg

SEQ ID NO: 253721 - DNA, 25 bp, Mus musculus
gatcgccgccatagccctgcatagt

SEQ ID NO: 253722 - DNA, 25 bp, Mus musculus
cctgacgtgaaagcgggatttccgg

SEQ ID NO: 253723 - DNA, 25 bp, Mus musculus
acacgtctatttcggcatgaagact

SEQ ID NO: 253724 - DNA, 25 bp, Mus musculus
ccacacgtctatttcggcatgaaga

SEQ ID NO: 253725 - DNA, 25 bp, Mus musculus
cgcccacacgtctatttcggcatga

SEQ ID NO: 253726 - DNA, 25 bp, Mus musculus
tcttctggggcacctaccgcccaca

SEQ ID NO: 253727 - DNA, 25 bp, Mus musculus
gactcctccagtcctgccgtggccc

SEQ ID NO: 253728 - DNA, 25 bp, Mus musculus
gcgaaggctcggtccgctgaccgca

SEQ ID NO: 253729 - DNA, 25 bp, Mus musculus
ccggacctgacgtgaaagcgggatt

SEQ ID NO: 253730 - DNA, 25 bp, Mus musculus
agtcaaccagccacagcgcttccgg

SEQ ID NO: 253731 - DNA, 25 bp, Mus musculus
ctggtctccgtaccgagtcaaccag

SEQ ID NO: 253732 - DNA, 25 bp, Mus musculus
gagtcctggtctccgtaccgagtca

SEQ ID NO: 253733 - DNA, 25 bp, Mus musculus
catcgagtcctggtctccgtaccga

SEQ ID NO: 253734 - DNA, 25 bp, Mus musculus
cgcttctcacccatcgagtcctggt

SEQ ID NO: 253735 - DNA, 25 bp, Mus musculus
gctgccgccggactcctccagtcct

SEQ ID NO: 253736 - DNA, 25 bp, Mus musculus
ttgatgcggtagcactgtaggctgc

SEQ ID NO: 253737 - DNA, 25 bp, Mus musculus
ccacccactggcagaggcagagtcg

SEQ ID NO: 253738 - DNA, 25 bp, Mus musculus
agcagcatctcttcggtgagggcag

SEQ ID NO: 253739 - DNA, 25 bp, Mus musculus
cttcagcagcatctcttcggtgagg

SEQ ID NO: 253740 - DNA, 25 bp, Mus musculus
cttccgtgcacgctcctcacgcttc

SEQ ID NO: 253741 - DNA, 25 bp, Mus musculus
ctgatttttgtgctcctcggccctc

SEQ ID NO: 253742 - DNA, 25 bp, Mus musculus
gaggcgctcaattgtctgatttttg

SEQ ID NO: 253743 - DNA, 25 bp, Mus musculus
ccgtcttggtgaggcgctcaattgt

SEQ ID NO: 253744 - DNA, 25 bp, Mus musculus
acgcccgctaggagcggccgtcttg

SEQ ID NO: 253745 - DNA, 25 bp, Mus musculus
gctgcagtagcgcaccatgggtgca

SEQ ID NO: 253746 - DNA, 25 bp, Mus musculus
actgtaggctgcaaagggcctggcc

SEQ ID NO: 253747 - DNA, 25 bp, Mus musculus
cctcccagccgtagctgcaggttga

SEQ ID NO: 253748 - DNA, 25 bp, Mus musculus
cccagccgtagctgcaggttgatgc

SEQ ID NO: 253749 - DNA, 25 bp, Mus musculus
ttgtctgatttttgtgctcctcggc

SEQ ID NO: 253750 - DNA, 25 bp, Mus musculus
cccgcggaagaacggaatccagcaa

SEQ ID NO: 253751 - DNA, 25 bp, Mus musculus
cggctccacggagttacagcgactc

SEQ ID NO: 253752 - DNA, 25 bp, Mus musculus
ctggcaaccatgtttgtgcgtggta

SEQ ID NO: 253753 - DNA, 25 bp, Mus musculus
tacttccggcgcctggcaaccatgt

SEQ ID NO: 253754 - DNA, 25 bp, Mus musculus
ccagcaaaataaccggctacttccg

SEQ ID NO: 253755 - DNA, 25 bp, Mus musculus
cggaatccagcaaaataaccggcta

SEQ ID NO: 253756 - DNA, 25 bp, Mus musculus
gggacacaagccgacatgccttttc

SEQ ID NO: 253757 - DNA, 25 bp, Mus musculus
ttgctcatggggtcctgcaaaggga

SEQ ID NO: 253758 - DNA, 25 bp, Mus musculus
cacagcttgctcatggggtcctgca

SEQ ID NO: 253759 - DNA, 25 bp, Mus musculus
cgccgccacagcttgctcatggggt

SEQ ID NO: 253760 - DNA, 25 bp, Mus musculus
tcgagttagatccacccgcgcttac

SEQ ID NO: 253761 - DNA, 25 bp, Mus musculus
ctttttcaagatcactcgagttaga

SEQ ID NO: 253762 - DNA, 25 bp, Mus musculus
ggaaactgtcgggacacaagccgac

SEQ ID NO: 253763 - DNA, 25 bp, Mus musculus
agttacagcgactcctttttcaaga

SEQ ID NO: 253764 - DNA, 25 bp, Mus musculus
gatcacagtggccaggggctccgcc

SEQ ID NO: 253765 - DNA, 25 bp, Mus musculus
cttagtttcttcagcgagtcgccgg

SEQ ID NO: 253766 - DNA, 25 bp, Mus musculus
gagattcccggctgtactggtagga

SEQ ID NO: 253767 - DNA, 25 bp, Mus musculus
caagcccgcgagagactgatcccag

SEQ ID NO: 253768 - DNA, 25 bp, Mus musculus
gcgagagactgatcccaggagcgta

SEQ ID NO: 253769 - DNA, 25 bp, Mus musculus
ctgatcccaggagcgtactgggcaa

SEQ ID NO: 253770 - DNA, 25 bp, Mus musculus
gcaaggggctgccagcatgttctct

SEQ ID NO: 253771 - DNA, 25 bp, Mus musculus
catcggagtcggatcacagtggcca

SEQ ID NO: 253772 - DNA, 25 bp, Mus musculus
ggctccgccctggagatggagttca

SEQ ID NO: 253773 - DNA, 25 bp, Mus musculus
atggagttcaaacgcggccgcttcc

SEQ ID NO: 253774 - DNA, 25 bp, Mus musculus
caaacgcggccgcttccgacttagt

SEQ ID NO: 253775 - DNA, 25 bp, Mus musculus
gggctgccagcatgttctctcgaaa

SEQ ID NO: 253776 - DNA, 25 bp, Mus musculus
ttctctcgaaaccatcggagtcgga

SEQ ID NO: 253777 - DNA, 25 bp, Mus musculus
ttcttcagcgagtcgccggaggtga

SEQ ID NO: 253778 - DNA, 25 bp, Mus musculus
cctctcgcggcaattgggagctgat

SEQ ID NO: 253779 - DNA, 25 bp, Mus musculus
tgtgacccctcgctaactgcaggcg

SEQ ID NO: 253780 - DNA, 25 bp, Mus musculus
ggtttctgcgacctgtgacccctcg

SEQ ID NO: 253781 - DNA, 25 bp, Mus musculus
ggggttcttcaatccccacgcgatc

SEQ ID NO: 253782 - DNA, 25 bp, Mus musculus
agcgccgacgctcggggttcttcaa

SEQ ID NO: 253783 - DNA, 25 bp, Mus musculus
acgggcacagcggacgcaggcggtg

SEQ ID NO: 253784 - DNA, 25 bp, Mus musculus
atgtcacgggcgcccacgggcacag

SEQ ID NO: 253785 - DNA, 25 bp, Mus musculus
tctcgcggcaattgggagctgatgt

SEQ ID NO: 253786 - DNA, 25 bp, Mus musculus
ccttggcgcctctcgcggcaattgg

SEQ ID NO: 253787 - DNA, 25 bp, Mus musculus
tcgcagcgcccgcagggaccgcccg

SEQ ID NO: 253788 - DNA, 25 bp, Mus musculus
tggtagagatgcaggcatcgcagcg

SEQ ID NO: 253789 - DNA, 25 bp, Mus musculus
tcccggtggtagagatgcaggcatc

SEQ ID NO: 253790 - DNA, 25 bp, Mus musculus
ctccgcgacagggtcccggtggtag

SEQ ID NO: 253791 - DNA, 25 bp, Mus musculus
cgcggcaattgggagctgatgtcac

SEQ ID NO: 253792 - DNA, 25 bp, Mus musculus
ttcgggcagcctcaacgagaactcg

SEQ ID NO: 253793 - DNA, 25 bp, Mus musculus
cctgagtttcggatgacagctgccc

SEQ ID NO: 253794 - DNA, 25 bp, Mus musculus
gccgggctcagctttcctgagtttc

SEQ ID NO: 253795 - DNA, 25 bp, Mus musculus
agcccttcccgcgtcggcagagttg

SEQ ID NO: 253796 - DNA, 25 bp, Mus musculus
actcggctgccggattgcggctcgt

SEQ ID NO: 253797 - DNA, 25 bp, Mus musculus
ctagctgggaggacaactcggctgc

SEQ ID NO: 253798 - DNA, 25 bp, Mus musculus
tcaacgagaactcggacggcacggg

SEQ ID NO: 253799 - DNA, 25 bp, Mus musculus
agcacgactcttcgggcagcctcaa

SEQ ID NO: 253800 - DNA, 25 bp, Mus musculus
ccctcggtgcatgcagccaatcaga

SEQ ID NO: 253801 - DNA, 25 bp, Mus musculus
cactcggttctgctcggtattctcc

SEQ ID NO: 253802 - DNA, 25 bp, Mus musculus
gggcgctcgtctccactcggttctg

SEQ ID NO: 253803 - DNA, 25 bp, Mus musculus
agctggccacttcgtccttacttga

SEQ ID NO: 253804 - DNA, 25 bp, Mus musculus
cctcaagtaaggacgagctggccac

SEQ ID NO: 253805 - DNA, 25 bp, Mus musculus
ccctttgtcgtttctgctctgcgtc

SEQ ID NO: 253806 - DNA, 25 bp, Mus musculus
aagcaaccgtggaccacgccaggga

SEQ ID NO: 253807 - DNA, 25 bp, Mus musculus
ggagtgactgtcacgaaaatgagtc

SEQ ID NO: 253808 - DNA, 25 bp, Mus musculus
caccgccttggagtgactgtcacga

SEQ ID NO: 253809 - DNA, 25 bp, Mus musculus
tgaaggcagctgaaacaccgccttg

SEQ ID NO: 253810 - DNA, 25 bp, Mus musculus
tacaacgatggagggtcctgaaggc

SEQ ID NO: 253811 - DNA, 25 bp, Mus musculus
ctgcagctacaacgatggagggtcc

SEQ ID NO: 253812 - DNA, 25 bp, Mus musculus
agaccgttgggtcgcggccactgca

SEQ ID NO: 253813 - DNA, 25 bp, Mus musculus
tacgcggttaccaagcaaccgtgga

SEQ ID NO: 253814 - DNA, 25 bp, Mus musculus
cggcgcgcagctacgcggttaccaa

SEQ ID NO: 253815 - DNA, 25 bp, Mus musculus
tcacgaaaatgagtcacgaaggctc

SEQ ID NO: 253816 - DNA, 25 bp, Mus musculus
tagagacgacgcaccgacgcacggc

SEQ ID NO: 253817 - DNA, 25 bp, Mus musculus
accatagagacgacgcaccgacgca

SEQ ID NO: 253818 - DNA, 25 bp, Mus musculus
gccgcgatcctaaggtccctccaaa

SEQ ID NO: 253819 - DNA, 25 bp, Mus musculus
gcggccactgcagctacaacgatgg

SEQ ID NO: 253820 - DNA, 25 bp, Mus musculus
ggaatcatccttcggctcacacctg

SEQ ID NO: 253821 - DNA, 25 bp, Mus musculus
agctccacagcagcccgatagggtc

SEQ ID NO: 253822 - DNA, 25 bp, Mus musculus
cacacctgtcgctcgaggatcttta

SEQ ID NO: 253823 - DNA, 25 bp, Mus musculus
agaccaccacgttgcgcatggattc

SEQ ID NO: 253824 - DNA, 25 bp, Mus musculus
ggtcctgatcccagacctcgaagtg

SEQ ID NO: 253825 - DNA, 25 bp, Mus musculus
cctcgaagtgcaccctttggaaata

SEQ ID NO: 253826 - DNA, 25 bp, Mus musculus
tttggaaatatatcgcgggcgcccg

SEQ ID NO: 253827 - DNA, 25 bp, Mus musculus
gcatgcgagtcccaagcccttagct

SEQ ID NO: 253828 - DNA, 25 bp, Mus musculus
caaggttccctctccagcgttgtgc

SEQ ID NO: 253829 - DNA, 25 bp, Mus musculus
gtagtccgtcttcaggcctctgaga

SEQ ID NO: 253830 - DNA, 25 bp, Mus musculus
gtccttcgggtcaaacgtgccattc

SEQ ID NO: 253831 - DNA, 25 bp, Mus musculus
gcgttgtgctacattccgtgctttg

SEQ ID NO: 253832 - DNA, 25 bp, Mus musculus
tctttacgatctacggcggaaggcg

SEQ ID NO: 253833 - DNA, 25 bp, Mus musculus
ccctagctaagtggccaagtggctg

SEQ ID NO: 253834 - DNA, 25 bp, Mus musculus
tgtctagctcagtgccttatcgatg

SEQ ID NO: 253835 - DNA, 25 bp, Mus musculus
cgcggagccctgacagcaggtacgc

SEQ ID NO: 253836 - DNA, 25 bp, Mus musculus
atctagagttttctgggacccgagg

SEQ ID NO: 253837 - DNA, 25 bp, Mus musculus
ctgctcacagaaatctagagttttc

SEQ ID NO: 253838 - DNA, 25 bp, Mus musculus
caggaatgaggagactgctcacaga

SEQ ID NO: 253839 - DNA, 25 bp, Mus musculus
ttttctctgcctcgcttggcgagac

SEQ ID NO: 253840 - DNA, 25 bp, Mus musculus
ctcagtgccttatcgatgttttctc

SEQ ID NO: 253841 - DNA, 25 bp, Mus musculus
atcctgccgcaggtgtctagctcag

SEQ ID NO: 253842 - DNA, 25 bp, Mus musculus
tgcgcgtgcgcatgcacacatgcac

SEQ ID NO: 253843 - DNA, 25 bp, Mus musculus
acttcccagacgtagtgcgcgtgcg

SEQ ID NO: 253844 - DNA, 25 bp, Mus musculus
ggtcctaatccacttcccagacgta

SEQ ID NO: 253845 - DNA, 25 bp, Mus musculus
acatgcacgcatcctgccgcaggtg

SEQ ID NO: 253846 - DNA, 25 bp, Mus musculus
gccttatcgatgttttctctgcctc

SEQ ID NO: 253847 - DNA, 25 bp, Mus musculus
cgcaggtgtctagctcagtgcctta

SEQ ID NO: 253848 - DNA, 25 bp, Mus musculus
ggtaagtttcttcgccctcactcag

SEQ ID NO: 253849 - DNA, 25 bp, Mus musculus
gcatttgcgtcgagacccaacatcg

SEQ ID NO: 253850 - DNA, 25 bp, Mus musculus
caggggtcgcatttgcgtcgagacc

SEQ ID NO: 253851 - DNA, 25 bp, Mus musculus
tgtcagatttccacatagggcaggg

SEQ ID NO: 253852 - DNA, 25 bp, Mus musculus
gccagggtgacatgtgtcagatttc

SEQ ID NO: 253853 - DNA, 25 bp, Mus musculus
gatccggtcgcgcagcaaagtttcg

SEQ ID NO: 253854 - DNA, 25 bp, Mus musculus
ggccagactgcgactttgctccacg

SEQ ID NO: 253855 - DNA, 25 bp, Mus musculus
cgatcgcggtaagtttcttcgccct

SEQ ID NO: 253856 - DNA, 25 bp, Mus musculus
agcgggtgccacctcctgggacgct

SEQ ID NO: 253857 - DNA, 25 bp, Mus musculus
cctgggtgcacagcgggtgccacct

SEQ ID NO: 253858 - DNA, 25 bp, Mus musculus
ccagggcatttatgccgcggccgcg

SEQ ID NO: 253859 - DNA, 25 bp, Mus musculus
gccaccagcagttcatccgtcagtg

SEQ ID NO: 253860 - DNA, 25 bp, Mus musculus
agcctccgagaaagcgcgagacacg

SEQ ID NO: 253861 - DNA, 25 bp, Mus musculus
gactttgctccacgctgatccggtc

SEQ ID NO: 253862 - DNA, 25 bp, Mus musculus
tggggcgcaacaaccgcacagccaa

SEQ ID NO: 253863 - DNA, 25 bp, Mus musculus
gcgcgcgggccacgaagctataccc

SEQ ID NO: 253864 - DNA, 25 bp, Mus musculus
tgaagccatggctcgcgccggtgcc

SEQ ID NO: 253865 - DNA, 25 bp, Mus musculus
aaactgaagccatggctcgcgccgg

SEQ ID NO: 253866 - DNA, 25 bp, Mus musculus
acaaggaaactgaagccatggctcg

SEQ ID NO: 253867 - DNA, 25 bp, Mus musculus
cgcagacaacaaggaaactgaagcc

SEQ ID NO: 253868 - DNA, 25 bp, Mus musculus
acagccaacgcagacaacaaggaaa

SEQ ID NO: 253869 - DNA, 25 bp, Mus musculus
gtgcgtggggcgcaacaaccgcaca

SEQ ID NO: 253870 - DNA, 25 bp, Mus musculus
caccgcactgccgccaggtggaagg

SEQ ID NO: 253871 - DNA, 25 bp, Mus musculus
aaggatatctgtccacgccgcgctc

SEQ ID NO: 253872 - DNA, 25 bp, Mus musculus
tgggaaggatatctgtccacgccgc

SEQ ID NO: 253873 - DNA, 25 bp, Mus musculus
tgatgcttgggaaggatatctgtcc

SEQ ID NO: 253874 - DNA, 25 bp, Mus musculus
gccaacgcagacaacaaggaaactg

SEQ ID NO: 253875 - DNA, 25 bp, Mus musculus
tgcttgggaaggatatctgtccacg

SEQ ID NO: 253876 - DNA, 25 bp, Mus musculus
ggaacagttgacagcggcgcctagt

SEQ ID NO: 253877 - DNA, 25 bp, Mus musculus
cctcggccacggaacagttgacagc

SEQ ID NO: 253878 - DNA, 25 bp, Mus musculus
tggcagacgtccctcggccacggaa

SEQ ID NO: 253879 - DNA, 25 bp, Mus musculus
cgtgcccacagaatactgattggct

SEQ ID NO: 253880 - DNA, 25 bp, Mus musculus
tactgattggctgagctcaggaagg

SEQ ID NO: 253881 - DNA, 25 bp, Mus musculus
cccggtctcgcgagatcctcttggt

SEQ ID NO: 253882 - DNA, 25 bp, Mus musculus
gagatcctcttggttccgcattttg

SEQ ID NO: 253883 - DNA, 25 bp, Mus musculus
gcggcggctggaactcggtaccaaa

SEQ ID NO: 253884 - DNA, 25 bp, Mus musculus
aacccgggccgtgaagcttcggcag

SEQ ID NO: 253885 - DNA, 25 bp, Mus musculus
gccgtgaagcttcggcagccctgta

SEQ ID NO: 253886 - DNA, 25 bp, Mus musculus
tgtagagccgcggaccgtcctctgc

SEQ ID NO: 253887 - DNA, 25 bp, Mus musculus
cctcgggctagcgaggatgagcttc

SEQ ID NO: 253888 - DNA, 25 bp, Mus musculus
atgagcttcctcttgtgagtgggcc

SEQ ID NO: 253889 - DNA, 25 bp, Mus musculus
ccgcattttggctcgcggagctgtg

SEQ ID NO: 253890 - DNA, 25 bp, Mus musculus
catgtttgcaggtgcggccggttcc

SEQ ID NO: 253891 - DNA, 25 bp, Mus musculus
gaacgcccatgtttgcaggtgcggc

SEQ ID NO: 253892 - DNA, 25 bp, Mus musculus
aacgcccatgtttgcaggtgcggcc

SEQ ID NO: 253893 - DNA, 25 bp, Mus musculus
cccatgtttgcaggtgcggccggtt

SEQ ID NO: 253894 - DNA, 25 bp, Mus musculus
tggacacagtgcccgcgtctttccg

SEQ ID NO: 253895 - DNA, 25 bp, Mus musculus
agtgcccgcgtctttccggctgcac

SEQ ID NO: 253896 - DNA, 25 bp, Mus musculus
tttccggctgcaccgtgacctcggg

SEQ ID NO: 253897 - DNA, 25 bp, Mus musculus
gctgcaccgtgacctcgggctgcgt

SEQ ID NO: 253898 - DNA, 25 bp, Mus musculus
tgcaccgtgacctcgggctgcgtcg

SEQ ID NO: 253899 - DNA, 25 bp, Mus musculus
acctcgggctgcgtcgccgggcatg

SEQ ID NO: 253900 - DNA, 25 bp, Mus musculus
cgggcatggcggcatggggcccggc

SEQ ID NO: 253901 - DNA, 25 bp, Mus musculus
ccgctgcgcctctgctgcgcgggag

SEQ ID NO: 253902 - DNA, 25 bp, Mus musculus
cggctgttgtcaggctggggacccg

SEQ ID NO: 253903 - DNA, 25 bp, Mus musculus
acgcccatgtttgcaggtgcggccg

SEQ ID NO: 253904 - DNA, 25 bp, Mus musculus
cccattttcgcttcttcccgtagag

SEQ ID NO: 253905 - DNA, 25 bp, Mus musculus
cacactcgatgaggatggagcaatg

SEQ ID NO: 253906 - DNA, 25 bp, Mus musculus
ctcgccgggcacactcgatgaggat

SEQ ID NO: 253907 - DNA, 25 bp, Mus musculus
tggcatgcagctctcgccgggcaca

SEQ ID NO: 253908 - DNA, 25 bp, Mus musculus
tgttggtagaagaccagcgagatgc

SEQ ID NO: 253909 - DNA, 25 bp, Mus musculus
aggttcttgtgttggtagaagacca

SEQ ID NO: 253910 - DNA, 25 bp, Mus musculus
tcttcccgtagagcttggcctcctg

SEQ ID NO: 253911 - DNA, 25 bp, Mus musculus
tgctggggctcagccaccatagcac

SEQ ID NO: 253912 - DNA, 25 bp, Mus musculus
cttcttttctttgtgctggggctca

SEQ ID NO: 253913 - DNA, 25 bp, Mus musculus
ctttgtgtaggcgtaagaggacacg

SEQ ID NO: 253914 - DNA, 25 bp, Mus musculus
ggccagtgacctttgtgtaggcgta

SEQ ID NO: 253915 - DNA, 25 bp, Mus musculus
tggcacctagatccagcggctgtag

SEQ ID NO: 253916 - DNA, 25 bp, Mus musculus
ccgacgctgaggtacgctggctcct

SEQ ID NO: 253917 - DNA, 25 bp, Mus musculus
agctgcttcatcttggcctcccaga

SEQ ID NO: 253918 - DNA, 25 bp, Mus musculus
tcatctcacggttgaaggtttcata

SEQ ID NO: 253919 - DNA, 25 bp, Mus musculus
ggctctctagcaccattgaccggcg

SEQ ID NO: 253920 - DNA, 25 bp, Mus musculus
gtccggcgggctctctagcaccatt

SEQ ID NO: 253921 - DNA, 25 bp, Mus musculus
gcagctcccagaagaccgggtccgg

SEQ ID NO: 253922 - DNA, 25 bp, Mus musculus
ggcttctggtctacccgccaaggac

SEQ ID NO: 253923 - DNA, 25 bp, Mus musculus
agtcgggcttctggtctacccgcca

SEQ ID NO: 253924 - DNA, 25 bp, Mus musculus
tcttccagacgagcagcgtgagtgg

SEQ ID NO: 253925 - DNA, 25 bp, Mus musculus
gcatcttccagacgagcagcgtgag

SEQ ID NO: 253926 - DNA, 25 bp, Mus musculus
gccaccaggtcgtgggcatcttcca

SEQ ID NO: 253927 - DNA, 25 bp, Mus musculus
tcatagagccgggtactaagggccc

SEQ ID NO: 253928 - DNA, 25 bp, Mus musculus
cctgccgttgctcccagcctcacga

SEQ ID NO: 253929 - DNA, 25 bp, Mus musculus
gcctcacgactcatctcacggttga

SEQ ID NO: 253930 - DNA, 25 bp, Mus musculus
atgacacagcttcggccacggccga

SEQ ID NO: 253931 - DNA, 25 bp, Mus musculus
gaaggtttcatagagccgggtacta

SEQ ID NO: 253932 - DNA, 25 bp, Mus musculus
gagcagagcagtccagcacaggccc

SEQ ID NO: 253933 - DNA, 25 bp, Mus musculus
aagacgtcccctgcagttctagcgg

SEQ ID NO: 253934 - DNA, 25 bp, Mus musculus
cctggcaacatacacaagacgtccc

SEQ ID NO: 253935 - DNA, 25 bp, Mus musculus
gagccatcgccacaagggctgcttc

SEQ ID NO: 253936 - DNA, 25 bp, Mus musculus
ccttggtggagggagccatcgccac

SEQ ID NO: 253937 - DNA, 25 bp, Mus musculus
tcggccggcctccactactgcatcg

SEQ ID NO: 253938 - DNA, 25 bp, Mus musculus
aggcccagcgctctacctcggccgg

SEQ ID NO: 253939 - DNA, 25 bp, Mus musculus
tgcttcggttctccggcctctggag

SEQ ID NO: 253940 - DNA, 25 bp, Mus musculus
tgttttcctgcttcggttctccggc

SEQ ID NO: 253941 - DNA, 25 bp, Mus musculus
ctgcgccttccagtgttttgttttc

SEQ ID NO: 253942 - DNA, 25 bp, Mus musculus
ccctgcgccttccagtgttttgttt

SEQ ID NO: 253943 - DNA, 25 bp, Mus musculus
agaaaggctggacgggaccatcttc

SEQ ID NO: 253944 - DNA, 25 bp, Mus musculus
agaagaaaggctggacgggaccatc

SEQ ID NO: 253945 - DNA, 25 bp, Mus musculus
cagcacactggaggggaagggcccg

SEQ ID NO: 253946 - DNA, 25 bp, Mus musculus
ccggttgctcgcaggctcctggaca

SEQ ID NO: 253947 - DNA, 25 bp, Mus musculus
agtcgctctccacgcagtacacgga

SEQ ID NO: 253948 - DNA, 25 bp, Mus musculus
gggcaccgcctcgaggactccgagg

SEQ ID NO: 253949 - DNA, 25 bp, Mus musculus
tcgtcttcctcctcgtccggcgcgg

SEQ ID NO: 253950 - DNA, 25 bp, Mus musculus
tcctccacctcgtagtcgtcgtctt

SEQ ID NO: 253951 - DNA, 25 bp, Mus musculus
gcggcccttctgcttccggatccct

SEQ ID NO: 253952 - DNA, 25 bp, Mus musculus
ttgctcgcaggctcctggacactcg

SEQ ID NO: 253953 - DNA, 25 bp, Mus musculus
agcacgtccaggagcagcccgtcgg

SEQ ID NO: 253954 - DNA, 25 bp, Mus musculus
tgtcgctgggccagcacgtccagga

SEQ ID NO: 253955 - DNA, 25 bp, Mus musculus
ggggcctcgggcaagtcgctctcca

SEQ ID NO: 253956 - DNA, 25 bp, Mus musculus
cgcagtacacggagcagaggacttg

SEQ ID NO: 253957 - DNA, 25 bp, Mus musculus
ggcaagtcgctctccacgcagtaca

SEQ ID NO: 253958 - DNA, 25 bp, Mus musculus
cagttccagactctgggggtccagg

SEQ ID NO: 253959 - DNA, 25 bp, Mus musculus
acacggagcagaggacttgcggctt

SEQ ID NO: 253960 - DNA, 25 bp, Mus musculus
tctcccggatagctaggccctgtca

SEQ ID NO: 253961 - DNA, 25 bp, Mus musculus
gggagttcgtctcgatcgtttgcga

SEQ ID NO: 253962 - DNA, 25 bp, Mus musculus
taggccctgtcacggctgccgtgtc

SEQ ID NO: 253963 - DNA, 25 bp, Mus musculus
gcgtcgtcggtctcccggatagcta

SEQ ID NO: 253964 - DNA, 25 bp, Mus musculus
gtttcctcttcatggctatccgcgg

SEQ ID NO: 253965 - DNA, 25 bp, Mus musculus
cggtacatcgcctcggtgcagggct

SEQ ID NO: 253966 - DNA, 25 bp, Mus musculus
caaggccgacgtggagcggtacatc

SEQ ID NO: 253967 - DNA, 25 bp, Mus musculus
gtgttcggcgctcacctcctggagc

SEQ ID NO: 253968 - DNA, 25 bp, Mus musculus
cgacggagctgcgtcaccggtgttc

SEQ ID NO: 253969 - DNA, 25 bp, Mus musculus
tgtgcccatccgttcgcgacggagc

SEQ ID NO: 253970 - DNA, 25 bp, Mus musculus
gcgcacagtgatgacgcgcgccgca

SEQ ID NO: 253971 - DNA, 25 bp, Mus musculus
tcgtttgcgaaacggtcacgtggtc

SEQ ID NO: 253972 - DNA, 25 bp, Mus musculus
ctggagcccgcagtcgctgtaggcc

SEQ ID NO: 253973 - DNA, 25 bp, Mus musculus
gaagggcgcgtcagcataaacgaca

SEQ ID NO: 253974 - DNA, 25 bp, Mus musculus
caccgacggcggttgaaagacacca

SEQ ID NO: 253975 - DNA, 25 bp, Mus musculus
cagcacgagacctgcctaggaagtg

SEQ ID NO: 253976 - DNA, 25 bp, Mus musculus
cgaaagccacctgggaccgcgtgaa

SEQ ID NO: 253977 - DNA, 25 bp, Mus musculus
gggaccgcgtgaactttgaggcaaa

SEQ ID NO: 253978 - DNA, 25 bp, Mus musculus
tttgaggcaaagagcaccgaggact

SEQ ID NO: 253979 - DNA, 25 bp, Mus musculus
cgggaagctggcgaaccaagcctca

SEQ ID NO: 253980 - DNA, 25 bp, Mus musculus
tgtgcgctgatgcacccactcggca

SEQ ID NO: 253981 - DNA, 25 bp, Mus musculus
ccggcggactacagtctccagagtg

SEQ ID NO: 253982 - DNA, 25 bp, Mus musculus
ctcccgcagccaattgaggggtctc

SEQ ID NO: 253983 - DNA, 25 bp, Mus musculus
tttcgccaatttccgccgcatcttg

SEQ ID NO: 253984 - DNA, 25 bp, Mus musculus
gcatcttgcggttatccaccttcga

SEQ ID NO: 253985 - DNA, 25 bp, Mus musculus
accttcgagaagagaaagtcccgtg

SEQ ID NO: 253986 - DNA, 25 bp, Mus musculus
tcccgtgaatatgagcacgtccgcc

SEQ ID NO: 253987 - DNA, 25 bp, Mus musculus
aagcctcagcgggagagttctgtgc

SEQ ID NO: 253988 - DNA, 25 bp, Mus musculus
cctctcaggccgaggcaggacaata

SEQ ID NO: 253989 - DNA, 25 bp, Mus musculus
taccgagtcagcctgaccggcaaga

SEQ ID NO: 253990 - DNA, 25 bp, Mus musculus
catcgcgcgtttgcgtaccgagtca

SEQ ID NO: 253991 - DNA, 25 bp, Mus musculus
ccgaggcaggacaataggggacatc

SEQ ID NO: 253992 - DNA, 25 bp, Mus musculus
cttcctgccactccctgcgagctcg

SEQ ID NO: 253993 - DNA, 25 bp, Mus musculus
aggcctcacggaggggccctcctga

SEQ ID NO: 253994 - DNA, 25 bp, Mus musculus
ggccgcccgggttttgcacctgcag

SEQ ID NO: 253995 - DNA, 25 bp, Mus musculus
agcccagccaagctcgctgcgcgcg

SEQ ID NO: 253996 - DNA, 25 bp, Mus musculus
cggagcgcacaaaggggcaaagttt

SEQ ID NO: 253997 - DNA, 25 bp, Mus musculus
cggagccggaaagccaccggctgca

SEQ ID NO: 253998 - DNA, 25 bp, Mus musculus
tgcgcccaccatggccgtgccacgg

SEQ ID NO: 253999 - DNA, 25 bp, Mus musculus
ttgccgggtcgctggctaccctgct

SEQ ID NO: 254000 - DNA, 25 bp, Mus musculus
ttgttctggggcctcggctgctccg

SEQ ID NO: 254001 - DNA, 25 bp, Mus musculus
acaataggggacatcgcgcgtttgc

SEQ ID NO: 254002 - DNA, 25 bp, Mus musculus
cagggaaatgacgagattccttctc

SEQ ID NO: 254003 - DNA, 25 bp, Mus musculus
tgacccgcgcaccacccgtgtcaga

SEQ ID NO: 254004 - DNA, 25 bp, Mus musculus
cttggcctgtgtgcctgtgacccgc

SEQ ID NO: 254005 - DNA, 25 bp, Mus musculus
tacgagtgtcttggcctgtgtgcct

SEQ ID NO: 254006 - DNA, 25 bp, Mus musculus
ctccgtgtacgagtgtcttggcctg

SEQ ID NO: 254007 - DNA, 25 bp, Mus musculus
gacgagattccttctcagctttcta

SEQ ID NO: 254008 - DNA, 25 bp, Mus musculus
cagcgccacagggactcgcagattt

SEQ ID NO: 254009 - DNA, 25 bp, Mus musculus
tttcggcagggaaatgacgagattc

SEQ ID NO: 254010 - DNA, 25 bp, Mus musculus
acatcagaagcgatgggtttcggca

SEQ ID NO: 254011 - DNA, 25 bp, Mus musculus
tctcgggcagaggtacatcagaagc

SEQ ID NO: 254012 - DNA, 25 bp, Mus musculus
tcgcagatttgacctctcgggcaga

SEQ ID NO: 254013 - DNA, 25 bp, Mus musculus
cccgggtcctgggttctggatgact

SEQ ID NO: 254014 - DNA, 25 bp, Mus musculus
cacagggactcgcagatttgacctc

SEQ ID NO: 254015 - DNA, 25 bp, Mus musculus
tagttttactccgtgtacgagtgtc

SEQ ID NO: 254016 - DNA, 25 bp, Mus musculus
agcacttccgcctgcgatcaagcga

SEQ ID NO: 254017 - DNA, 25 bp, Mus musculus
cactttctggcccttaccgatgttg

SEQ ID NO: 254018 - DNA, 25 bp, Mus musculus
aggccaaggctcgacagccactttc

SEQ ID NO: 254019 - DNA, 25 bp, Mus musculus
gcccttaccgatgttgccttcaatg

SEQ ID NO: 254020 - DNA, 25 bp, Mus musculus
tgttgccttcaatgcagagccttcg

SEQ ID NO: 254021 - DNA, 25 bp, Mus musculus
cggaaagacgctcggagacgacgca

SEQ ID NO: 254022 - DNA, 25 bp, Mus musculus
aaggaaccgacctgcagccatccta

SEQ ID NO: 254023 - DNA, 25 bp, Mus musculus
tttagctctctaggcgggtgaggcc

SEQ ID NO: 254024 - DNA, 25 bp, Mus musculus
atcaagcgacgccagcgcacctttg

SEQ ID NO: 254025 - DNA, 25 bp, Mus musculus
cacctttgacgtcagagggccgtca

SEQ ID NO: 254026 - DNA, 25 bp, Mus musculus
caggaagtggctggttttagctctc

SEQ ID NO: 254027 - DNA, 25 bp, Mus musculus
ggagctgctctgttctcgcgacatt

SEQ ID NO: 254028 - DNA, 25 bp, Mus musculus
agacgacgcagaaggaaccgacctg

SEQ ID NO: 254029 - DNA, 25 bp, Mus musculus
tctcgcgacatttgcagggacgatg

SEQ ID NO: 254030 - DNA, 25 bp, Mus musculus
gccggcctgggccagggacacggac

SEQ ID NO: 254031 - DNA, 25 bp, Mus musculus
gacacgcccactctcgccactcctt

SEQ ID NO: 254032 - DNA, 25 bp, Mus musculus
cacctccgatgacacgcccactctc

SEQ ID NO: 254033 - DNA, 25 bp, Mus musculus
ggaaacgtcacctccgatgacacgc

SEQ ID NO: 254034 - DNA, 25 bp, Mus musculus
tccggaaacgtcacctccgatgaca

SEQ ID NO: 254035 - DNA, 25 bp, Mus musculus
tcagagcttccggaaacgtcacctc

SEQ ID NO: 254036 - DNA, 25 bp, Mus musculus
acagtcagagcttccggaaacgtca

SEQ ID NO: 254037 - DNA, 25 bp, Mus musculus
gagcttccggaaacgtcacctccga

SEQ ID NO: 254038 - DNA, 25 bp, Mus musculus
atgacagtcagagcttccggaaacg

SEQ ID NO: 254039 - DNA, 25 bp, Mus musculus
cctttcgtgaaggatgacagtcaga

SEQ ID NO: 254040 - DNA, 25 bp, Mus musculus
ccacctttcgtgaaggatgacagtc

SEQ ID NO: 254041 - DNA, 25 bp, Mus musculus
cccttcccacctttcgtgaaggatg

SEQ ID NO: 254042 - DNA, 25 bp, Mus musculus
gccactccttcaattacgctccacg

SEQ ID NO: 254043 - DNA, 25 bp, Mus musculus
ccagtcccgctgcattcccgggacc

SEQ ID NO: 254044 - DNA, 25 bp, Mus musculus
cagagcctcgctgactaccggtggc

SEQ ID NO: 254045 - DNA, 25 bp, Mus musculus
gaggtcccttaggtcgctctgccgc

SEQ ID NO: 254046 - DNA, 25 bp, Mus musculus
caggctgctttcaaatcctaacttc

SEQ ID NO: 254047 - DNA, 25 bp, Mus musculus
aatggcccaggcattgcggcgtgct

SEQ ID NO: 254048 - DNA, 25 bp, Mus musculus
agacgcacaagtggatcctaaagtc

SEQ ID NO: 254049 - DNA, 25 bp, Mus musculus
tgtgctctaaaaacagttgatcctg

SEQ ID NO: 254050 - DNA, 25 bp, Mus musculus
ccttttgcttttcccgccagaggca

SEQ ID NO: 254051 - DNA, 25 bp, Mus musculus
tttcccgccagaggcaggccgtttc

SEQ ID NO: 254052 - DNA, 25 bp, Mus musculus
acctaagcagctggggtccgtgcac

SEQ ID NO: 254053 - DNA, 25 bp, Mus musculus
gtcctgcgcgggtgaagccctcgct

SEQ ID NO: 254054 - DNA, 25 bp, Mus musculus
tgcggcgtgctgtgctctaaaaaca

SEQ ID NO: 254055 - DNA, 25 bp, Mus musculus
caagtacttgcgagttgcgagtttc

SEQ ID NO: 254056 - DNA, 25 bp, Mus musculus
ctctggctcggagcgtggcccatgt

SEQ ID NO: 254057 - DNA, 25 bp, Mus musculus
cagttgatcctgctgtcccttttgc

SEQ ID NO: 254058 - DNA, 25 bp, Mus musculus
agtcccattatttctgccgctgaag

SEQ ID NO: 254059 - DNA, 25 bp, Mus musculus
ccggctgctttgtaaattgttctta

SEQ ID NO: 254060 - DNA, 25 bp, Mus musculus
tcggtagacctcgaggattcatccc

SEQ ID NO: 254061 - DNA, 25 bp, Mus musculus
cccgagtccagattcaccggatttc

SEQ ID NO: 254062 - DNA, 25 bp, Mus musculus
cggataggcttactccgtgaagcta

SEQ ID NO: 254063 - DNA, 25 bp, Mus musculus
cccagagctggaagtaggaaacttc

SEQ ID NO: 254064 - DNA, 25 bp, Mus musculus
ctgcagctcggaagcattccagaga

SEQ ID NO: 254065 - DNA, 25 bp, Mus musculus
gcattgtgtctcgaagccaagcttc

SEQ ID NO: 254066 - DNA, 25 bp, Mus musculus
actgggaaccgagcagcttatttgc

SEQ ID NO: 254067 - DNA, 25 bp, Mus musculus
tttccagtggaaagatgtcaggctc

SEQ ID NO: 254068 - DNA, 25 bp, Mus musculus
agtgccttcagctccgggcgttttt

SEQ ID NO: 254069 - DNA, 25 bp, Mus musculus
cgcgaagcgagaacgcccgcctaaa

SEQ ID NO: 254070 - DNA, 25 bp, Mus musculus
gccaccaacaagaccgggatttcga

SEQ ID NO: 254071 - DNA, 25 bp, Mus musculus
ttgggatactttcttgccgtcagtc

SEQ ID NO: 254072 - DNA, 25 bp, Mus musculus
gctggggacagcatccgcctcccgg

SEQ ID NO: 254073 - DNA, 25 bp, Mus musculus
gcctcccgggcttgtctggcgaaac

SEQ ID NO: 254074 - DNA, 25 bp, Mus musculus
ttgtctggcgaaactcgcgggatcc

SEQ ID NO: 254075 - DNA, 25 bp, Mus musculus
tcgcgggatccccacaataagtggc

SEQ ID NO: 254076 - DNA, 25 bp, Mus musculus
cctcccgggcttgtctggcgaaact

SEQ ID NO: 254077 - DNA, 25 bp, Mus musculus
cgaaactcgcgggatccccacaata

SEQ ID NO: 254078 - DNA, 25 bp, Mus musculus
tgtctggcgaaactcgcgggatccc

SEQ ID NO: 254079 - DNA, 25 bp, Mus musculus
cttgtctggcgaaactcgcgggatc

SEQ ID NO: 254080 - DNA, 25 bp, Mus musculus
ccgggcttgtctggcgaaactcgcg

SEQ ID NO: 254081 - DNA, 25 bp, Mus musculus
cccgggcttgtctggcgaaactcgc

SEQ ID NO: 254082 - DNA, 25 bp, Mus musculus
cagctccgcacctcaccctggctgg

SEQ ID NO: 254083 - DNA, 25 bp, Mus musculus
cgcctcccgggcttgtctggcgaaa

SEQ ID NO: 254084 - DNA, 25 bp, Mus musculus
ctcccgggcttgtctggcgaaactc

SEQ ID NO: 254085 - DNA, 25 bp, Mus musculus
tcccgggcttgtctggcgaaactcg

SEQ ID NO: 254086 - DNA, 25 bp, Mus musculus
ctcctcttttctgccgggtcgagtc

SEQ ID NO: 254087 - DNA, 25 bp, Mus musculus
ttttctgccgggtcgagtcagggtc

SEQ ID NO: 254088 - DNA, 25 bp, Mus musculus
acctcctcttttctgccgggtcgag

SEQ ID NO: 254089 - DNA, 25 bp, Mus musculus
cacaataagtggctgttctgtgtgc

SEQ ID NO: 254090 - DNA, 25 bp, Mus musculus
caataagtggctgttctgtgtgcct

SEQ ID NO: 254091 - DNA, 25 bp, Mus musculus
ataagtggctgttctgtgtgcctga

SEQ ID NO: 254092 - DNA, 25 bp, Mus musculus
aagtggctgttctgtgtgcctgagt

SEQ ID NO: 254093 - DNA, 25 bp, Mus musculus
gtgcctgagtgtgagtgccttggtt

SEQ ID NO: 254094 - DNA, 25 bp, Mus musculus
ggacgcgtgccctgaaccccagacc

SEQ ID NO: 254095 - DNA, 25 bp, Mus musculus
ccaccgcaccaagttccggagccca

SEQ ID NO: 254096 - DNA, 25 bp, Mus musculus
gcaccaagttccggagcccagcaaa

SEQ ID NO: 254097 - DNA, 25 bp, Mus musculus
gttccggagcccagcaaacctcctc

SEQ ID NO: 254098 - DNA, 25 bp, Mus musculus
agcaaacctcctcttttctgccggg

SEQ ID NO: 254099 - DNA, 25 bp, Mus musculus
cttttctgccgggtcgagtcagggt

SEQ ID NO: 254100 - DNA, 25 bp, Mus musculus
catctctcagatcatacagtggttc

SEQ ID NO: 254101 - DNA, 25 bp, Mus musculus
cagcacctagccttgcgtgggttga

SEQ ID NO: 254102 - DNA, 25 bp, Mus musculus
cggagaaagtcacgcgcgcgctgta

SEQ ID NO: 254103 - DNA, 25 bp, Mus musculus
acacgaatcagttggagaagcccga

SEQ ID NO: 254104 - DNA, 25 bp, Mus musculus
ctctctaggcccatccgggctggtt

SEQ ID NO: 254105 - DNA, 25 bp, Mus musculus
ctggaccttgtttcgtcctgctgga

SEQ ID NO: 254106 - DNA, 25 bp, Mus musculus
ccgagtgcctattgtgtgcgggaca

SEQ ID NO: 254107 - DNA, 25 bp, Mus musculus
cagtggttcattcatttggtagttc

SEQ ID NO: 254108 - DNA, 25 bp, Mus musculus
aagctgcctttcctggggcctccga

SEQ ID NO: 254109 - DNA, 25 bp, Mus musculus
gccgccgcatcctggtacgaggtaa

SEQ ID NO: 254110 - DNA, 25 bp, Mus musculus
gtgagacagaccactgccgccgcat

SEQ ID NO: 254111 - DNA, 25 bp, Mus musculus
gtgctgacacaggtagcgcgagtcc

SEQ ID NO: 254112 - DNA, 25 bp, Mus musculus
agcggaagatttgcgtgctgacaca

SEQ ID NO: 254113 - DNA, 25 bp, Mus musculus
gttcatcctgtaaatactccgagtg

SEQ ID NO: 254114 - DNA, 25 bp, Mus musculus
gacgtgaccgtgaccgcctagtcct

SEQ ID NO: 254115 - DNA, 25 bp, Mus musculus
ccgaggacctgctctacctggagtt

SEQ ID NO: 254116 - DNA, 25 bp, Mus musculus
acctggagttcctgcagaagtttga

SEQ ID NO: 254117 - DNA, 25 bp, Mus musculus
gagaagaatttcatcacccaaggtg

SEQ ID NO: 254118 - DNA, 25 bp, Mus musculus
ctagtcctctccttctgggccagag

SEQ ID NO: 254119 - DNA, 25 bp, Mus musculus
caggtccttacgagaaccgcacggt

SEQ ID NO: 254120 - DNA, 25 bp, Mus musculus
gaaccgcacggtgttcgagtcgctg

SEQ ID NO: 254121 - DNA, 25 bp, Mus musculus
ggctggaaactgctgcgcatctttc

SEQ ID NO: 254122 - DNA, 25 bp, Mus musculus
ctttccgaaagagatgctgaagcgc

SEQ ID NO: 254123 - DNA, 25 bp, Mus musculus
gctgaagcgcattccgcagagcatg

SEQ ID NO: 254124 - DNA, 25 bp, Mus musculus
cgcagagcatgacggacgagttcta

SEQ ID NO: 254125 - DNA, 25 bp, Mus musculus
ggacgagttctactctcgccagggg

SEQ ID NO: 254126 - DNA, 25 bp, Mus musculus
ctacgccatcgggaaggacgtgcag

SEQ ID NO: 254127 - DNA, 25 bp, Mus musculus
gccagaggttctcacgctccttcgt

SEQ ID NO: 254128 - DNA, 25 bp, Mus musculus
gcggcgtcgttccaaagccagtaca

SEQ ID NO: 254129 - DNA, 25 bp, Mus musculus
atctgtacaaggaggcacgcggcaa

SEQ ID NO: 254130 - DNA, 25 bp, Mus musculus
acgcggcaagcggaacatgacttga

SEQ ID NO: 254131 - DNA, 25 bp, Mus musculus
ccgaatcctcgcagtacaggtgggc

SEQ ID NO: 254132 - DNA, 25 bp, Mus musculus
tagaagcccggagttgttctcggcc

SEQ ID NO: 254133 - DNA, 25 bp, Mus musculus
ggccgatcctagtacctccgagttg

SEQ ID NO: 254134 - DNA, 25 bp, Mus musculus
ctccgagttgtggagccataaagtg

SEQ ID NO: 254135 - DNA, 25 bp, Mus musculus
gtgatcgcgaactactccgagcttt

SEQ ID NO: 254136 - DNA, 25 bp, Mus musculus
ctccgagcttttcgcagcctcagtg

SEQ ID NO: 254137 - DNA, 25 bp, Mus musculus
tcagtgggcaatgtggactggcttc

SEQ ID NO: 254138 - DNA, 25 bp, Mus musculus
actggcttcggttctgtgtgaatcc

SEQ ID NO: 254139 - DNA, 25 bp, Mus musculus
cgcaaggagatcatagtcgacgaca

SEQ ID NO: 254140 - DNA, 25 bp, Mus musculus
ccagaaggcgcccagggacaaaaga

SEQ ID NO: 254141 - DNA, 25 bp, Mus musculus
aggactgggccctcggattccagaa

SEQ ID NO: 254142 - DNA, 25 bp, Mus musculus
cagcgctgcagcctagacgactagt

SEQ ID NO: 254143 - DNA, 25 bp, Mus musculus
cccgactcggtgattgaagacaaga

SEQ ID NO: 254144 - DNA, 25 bp, Mus musculus
ttgtagtcttcgctgtgcgtcctgc

SEQ ID NO: 254145 - DNA, 25 bp, Mus musculus
caagcggcttcttgctcccacaaag

SEQ ID NO: 254146 - DNA, 25 bp, Mus musculus
cagaagccggcagattggaccaagc

SEQ ID NO: 254147 - DNA, 25 bp, Mus musculus
agatactccagctctgcacgtccgg

SEQ ID NO: 254148 - DNA, 25 bp, Mus musculus
ggccctatcgcgagcaagccctaga

SEQ ID NO: 254149 - DNA, 25 bp, Mus musculus
cgcgaggatttctgggacaagtagt

SEQ ID NO: 254150 - DNA, 25 bp, Mus musculus
gaccaaccggaagaagacctcgcgc

SEQ ID NO: 254151 - DNA, 25 bp, Mus musculus
tgccaggaagtcaggaacgaccaac

SEQ ID NO: 254152 - DNA, 25 bp, Mus musculus
agttgcctcggagtttccgtccagg

SEQ ID NO: 254153 - DNA, 25 bp, Mus musculus
tctccgacaagtgaggagttgcctc

SEQ ID NO: 254154 - DNA, 25 bp, Mus musculus
agatcgctcgctcgcactgcaaaga

SEQ ID NO: 254155 - DNA, 25 bp, Mus musculus
ctgctatggctcgttgctgacgctt

SEQ ID NO: 254156 - DNA, 25 bp, Mus musculus
tccagtaggaccagctcggggtcgt

SEQ ID NO: 254157 - DNA, 25 bp, Mus musculus
ccgctaaccggctcggaggatcgaa

SEQ ID NO: 254158 - DNA, 25 bp, Mus musculus
ctcggaggatcgaaatcgcgctgca

SEQ ID NO: 254159 - DNA, 25 bp, Mus musculus
aaggttccgcagaggtccagtagga

SEQ ID NO: 254160 - DNA, 25 bp, Mus musculus
caccggaaggttccgcagaggtcca

SEQ ID NO: 254161 - DNA, 25 bp, Mus musculus
aatcgcgctgcacccggtacggagc

SEQ ID NO: 254162 - DNA, 25 bp, Mus musculus
cgacagccagctcagcacgtacatg

SEQ ID NO: 254163 - DNA, 25 bp, Mus musculus
atcgaaatcgcgctgcacccggtac

SEQ ID NO: 254164 - DNA, 25 bp, Mus musculus
tcagcgcccagctgcaaagagcagc

SEQ ID NO: 254165 - DNA, 25 bp, Mus musculus
gctcagcacgtacatgaaccacatg

SEQ ID NO: 254166 - DNA, 25 bp, Mus musculus
tgccacctggatgaacagcgacagc

SEQ ID NO: 254167 - DNA, 25 bp, Mus musculus
cggccagagtgatgaatgccacctg

SEQ ID NO: 254168 - DNA, 25 bp, Mus musculus
agcgctctcaccgacggccagagtg

SEQ ID NO: 254169 - DNA, 25 bp, Mus musculus
cagctgcaaagagcagcagcggttg

SEQ ID NO: 254170 - DNA, 25 bp, Mus musculus
agctacttccggctggcccttggca

SEQ ID NO: 254171 - DNA, 25 bp, Mus musculus
gcctcctcgcgaagcagtcacttga

SEQ ID NO: 254172 - DNA, 25 bp, Mus musculus
gcgtctgccagctacttccggctgg

SEQ ID NO: 254173 - DNA, 25 bp, Mus musculus
gagaggacgtagcatccacacccta

SEQ ID NO: 254174 - DNA, 25 bp, Mus musculus
cagtcacttgaacggcgggctagaa

SEQ ID NO: 254175 - DNA, 25 bp, Mus musculus
ggcgagagaggacgtagcatccaca

SEQ ID NO: 254176 - DNA, 25 bp, Mus musculus
gcctttgtgctccacggtgcgacca

SEQ ID NO: 254177 - DNA, 25 bp, Mus musculus
ggcagccctcacacaccctcccagg

SEQ ID NO: 254178 - DNA, 25 bp, Mus musculus
acaccatgcccggtgcctttgtgct

SEQ ID NO: 254179 - DNA, 25 bp, Mus musculus
gcaacggtagtatggccgcgcttta

SEQ ID NO: 254180 - DNA, 25 bp, Mus musculus
tcacggctagggtcgaggttgctac

SEQ ID NO: 254181 - DNA, 25 bp, Mus musculus
agtcacatgacaaggggcggtgccc

SEQ ID NO: 254182 - DNA, 25 bp, Mus musculus
acgcaagcgcgtcgtagtcacatga

SEQ ID NO: 254183 - DNA, 25 bp, Mus musculus
acaccctacgcaagcgcgtcgtagt

SEQ ID NO: 254184 - DNA, 25 bp, Mus musculus
cccgaggtccgcaccacagcacagc

SEQ ID NO: 254185 - DNA, 25 bp, Mus musculus
cgcagtcccgggtggccagacgatc

SEQ ID NO: 254186 - DNA, 25 bp, Mus musculus
gtcccgggtggccagacgatcccag

SEQ ID NO: 254187 - DNA, 25 bp, Mus musculus
gacgcctcaacccacctggccgcgc

SEQ ID NO: 254188 - DNA, 25 bp, Mus musculus
gcacagcgccgcctcctaagagcgc

SEQ ID NO: 254189 - DNA, 25 bp, Mus musculus
agagcgcgagcctcggcgcacaaac

SEQ ID NO: 254190 - DNA, 25 bp, Mus musculus
tcggcgcacaaacgctcgaggtacc

SEQ ID NO: 254191 - DNA, 25 bp, Mus musculus
gcgcacaaacgctcgaggtacctcg

SEQ ID NO: 254192 - DNA, 25 bp, Mus musculus
aaacgctcgaggtacctcggcctca

SEQ ID NO: 254193 - DNA, 25 bp, Mus musculus
ctcggcctcacacgcgcgtctcgcc

SEQ ID NO: 254194 - DNA, 25 bp, Mus musculus
ccagcgccattcattggctgccgga

SEQ ID NO: 254195 - DNA, 25 bp, Mus musculus
ccattcattggctgccggacaacgc

SEQ ID NO: 254196 - DNA, 25 bp, Mus musculus
gagcgccagagcgtcggacggcctg

SEQ ID NO: 254197 - DNA, 25 bp, Mus musculus
tcctaagagcgcgagcctcggcgca

SEQ ID NO: 254198 - DNA, 25 bp, Mus musculus
tctcctattggctggcttgttggtg

SEQ ID NO: 254199 - DNA, 25 bp, Mus musculus
tcgtcgcaggtgtcggactccctga

SEQ ID NO: 254200 - DNA, 25 bp, Mus musculus
tgagcgcttcccttgtccgcggtgc

SEQ ID NO: 254201 - DNA, 25 bp, Mus musculus
cctggtcgcctgctctggggcttca

SEQ ID NO: 254202 - DNA, 25 bp, Mus musculus
tgggcttgggcccttggcgacacca

SEQ ID NO: 254203 - DNA, 25 bp, Mus musculus
tgttgcacaggctcttggccgcaga

SEQ ID NO: 254204 - DNA, 25 bp, Mus musculus
ctgaccactctggaccggcttagcg

SEQ ID NO: 254205 - DNA, 25 bp, Mus musculus
cggcttagcgcgaagcccttggttc

SEQ ID NO: 254206 - DNA, 25 bp, Mus musculus
ccttggttctgcgaaggagcacaca

SEQ ID NO: 254207 - DNA, 25 bp, Mus musculus
cgaaggagcacacacgacagagacc

SEQ ID NO: 254208 - DNA, 25 bp, Mus musculus
agattcccgcgctcgtctcctattg

SEQ ID NO: 254209 - DNA, 25 bp, Mus musculus
gagctcaacgcctggggacccggca

SEQ ID NO: 254210 - DNA, 25 bp, Mus musculus
tggcgttcccgcagcggcatcgagc

SEQ ID NO: 254211 - DNA, 25 bp, Mus musculus
ggcggaaccctgcacggagctcaac

SEQ ID NO: 254212 - DNA, 25 bp, Mus musculus
agtgagcaccgaagccgagattgtc

SEQ ID NO: 254213 - DNA, 25 bp, Mus musculus
cttagtcgggctggaagagcttcct

SEQ ID NO: 254214 - DNA, 25 bp, Mus musculus
gcctgacagctagcgggaagaccgc

SEQ ID NO: 254215 - DNA, 25 bp, Mus musculus
cgcagccgctgcgtacaagatggcg

SEQ ID NO: 254216 - DNA, 25 bp, Mus musculus
actattgtatgtgtcgcagccgctg

SEQ ID NO: 254217 - DNA, 25 bp, Mus musculus
tgccaggtcgcggtcgactattgta

SEQ ID NO: 254218 - DNA, 25 bp, Mus musculus
aaggcagaggtccttagcgcaggcc

SEQ ID NO: 254219 - DNA, 25 bp, Mus musculus
atccagctgttagtcggtaggcata

SEQ ID NO: 254220 - DNA, 25 bp, Mus musculus
cccgacagcgtctctggagaacgcg

SEQ ID NO: 254221 - DNA, 25 bp, Mus musculus
ctttaggcgaagatgcgcatgcgtg

SEQ ID NO: 254222 - DNA, 25 bp, Mus musculus
cgcatgcgtgtagtcccatggaggc

SEQ ID NO: 254223 - DNA, 25 bp, Mus musculus
tagctgcttcatcgcggtgactgga

SEQ ID NO: 254224 - DNA, 25 bp, Mus musculus
gactggaggccgagtgctaaactgt

SEQ ID NO: 254225 - DNA, 25 bp, Mus musculus
tcggccctgggatgtcgtcgaaaat

SEQ ID NO: 254226 - DNA, 25 bp, Mus musculus
ccggagttcccgcagcggagatcgc

SEQ ID NO: 254227 - DNA, 25 bp, Mus musculus
cgacgggcgtggtcgcctcacctga

SEQ ID NO: 254228 - DNA, 25 bp, Mus musculus
ccttgctagcggcacgctctggctg

SEQ ID NO: 254229 - DNA, 25 bp, Mus musculus
gctgattggccgctacccggcactg

SEQ ID NO: 254230 - DNA, 25 bp, Mus musculus
cattggctgccagggcctctttgtt

SEQ ID NO: 254231 - DNA, 25 bp, Mus musculus
tcgagtgcccatgctgagtagcagc

SEQ ID NO: 254232 - DNA, 25 bp, Mus musculus
ccgatcccttgggtgactgtcgctg

SEQ ID NO: 254233 - DNA, 25 bp, Mus musculus
agcgggaccctgcaactcgctgtct

SEQ ID NO: 254234 - DNA, 25 bp, Mus musculus
gcaactcgctgtctctgcgcctgaa

SEQ ID NO: 254235 - DNA, 25 bp, Mus musculus
gtctctgcgcctgaaacttttcgga

SEQ ID NO: 254236 - DNA, 25 bp, Mus musculus
tcgcctcacctgagcgcgggagctg

SEQ ID NO: 254237 - DNA, 25 bp, Mus musculus
cctggaaaccaaaatgaagaaggtg

SEQ ID NO: 254238 - DNA, 25 bp, Mus musculus
cgacgcccagtatggacctggaaac

SEQ ID NO: 254239 - DNA, 25 bp, Mus musculus
ctgcggaagttcgagtgcccatgct

SEQ ID NO: 254240 - DNA, 25 bp, Mus musculus
ctccgcggtgtttgcaggtaggacc

SEQ ID NO: 254241 - DNA, 25 bp, Mus musculus
tcctcttcagggcaacacctgtgag

SEQ ID NO: 254242 - DNA, 25 bp, Mus musculus
caacacctgtgagccggcagccatt

SEQ ID NO: 254243 - DNA, 25 bp, Mus musculus
ccattcatccaagtcggcctcgctc

SEQ ID NO: 254244 - DNA, 25 bp, Mus musculus
gcgatgctgcgagtcttcatccttt

SEQ ID NO: 254245 - DNA, 25 bp, Mus musculus
ctttttgcggagaatgtccacaccc

SEQ ID NO: 254246 - DNA, 25 bp, Mus musculus
cggactccgacatcagcgatgccta

SEQ ID NO: 254247 - DNA, 25 bp, Mus musculus
tactgctccgcggtgtttgcaggta

SEQ ID NO: 254248 - DNA, 25 bp, Mus musculus
gactagcttgttcctcttcagggca

SEQ ID NO: 254249 - DNA, 25 bp, Mus musculus
ctccagcttagcgatgctgcgagtc

SEQ ID NO: 254250 - DNA, 25 bp, Mus musculus
agcgatgcctactgctccgcggtgt

SEQ ID NO: 254251 - DNA, 25 bp, Mus musculus
caacgcactctgactagcggggtga

SEQ ID NO: 254252 - DNA, 25 bp, Mus musculus
cttcatcctttttgcggagaatgtc

SEQ ID NO: 254253 - DNA, 25 bp, Mus musculus
gccgcctggactagcttgttcctct

SEQ ID NO: 254254 - DNA, 25 bp, Mus musculus
ggttctgcatagctcggggaaattg

SEQ ID NO: 254255 - DNA, 25 bp, Mus musculus
tccgcggcaccctcggggcagtaaa

SEQ ID NO: 254256 - DNA, 25 bp, Mus musculus
cagagcaggcctggctcagcgttga

SEQ ID NO: 254257 - DNA, 25 bp, Mus musculus
cccggagtccagacgctgcggggag

SEQ ID NO: 254258 - DNA, 25 bp, Mus musculus
cagaaaaaataaatcagccgggagc

SEQ ID NO: 254259 - DNA, 25 bp, Mus musculus
caccctcggggcagtaaatattata

SEQ ID NO: 254260 - DNA, 25 bp, Mus musculus
cctcggggcagtaaatattatatta

SEQ ID NO: 254261 - DNA, 25 bp, Mus musculus
accacagggtgtgcagtacgtgacc

SEQ ID NO: 254262 - DNA, 25 bp, Mus musculus
gcagtacgtgacctgagacgggccc

SEQ ID NO: 254263 - DNA, 25 bp, Mus musculus
ctccggcggtaattggttctgcata

SEQ ID NO: 254264 - DNA, 25 bp, Mus musculus
ccgagatggagctcgcgcacccgct

SEQ ID NO: 254265 - DNA, 25 bp, Mus musculus
aaataacaggaaagacgcagcgcgc

SEQ ID NO: 254266 - DNA, 25 bp, Mus musculus
taacaggaaagacgcagcgcgccga

SEQ ID NO: 254267 - DNA, 25 bp, Mus musculus
atattatattaccacagggtgtgca

SEQ ID NO: 254268 - DNA, 25 bp, Mus musculus
ccaacagcaatacaacgtgcatggc

SEQ ID NO: 254269 - DNA, 25 bp, Mus musculus
gcatggccgctacaatgtgcaattg

SEQ ID NO: 254270 - DNA, 25 bp, Mus musculus
tgcatggccgctacaatgtgcaatt

SEQ ID NO: 254271 - DNA, 25 bp, Mus musculus
cgtgcatggccgctacaatgtgcaa

SEQ ID NO: 254272 - DNA, 25 bp, Mus musculus
tacaacgtgcatggccgctacaatg

SEQ ID NO: 254273 - DNA, 25 bp, Mus musculus
aatacaacgtgcatggccgctacaa

SEQ ID NO: 254274 - DNA, 25 bp, Mus musculus
caatacaacgtgcatggccgctaca

SEQ ID NO: 254275 - DNA, 25 bp, Mus musculus
acagcaatacaacgtgcatggccgc

SEQ ID NO: 254276 - DNA, 25 bp, Mus musculus
tgccaacagcaatacaacgtgcatg

SEQ ID NO: 254277 - DNA, 25 bp, Mus musculus
gctgccaacagcaatacaacgtgca

SEQ ID NO: 254278 - DNA, 25 bp, Mus musculus
gtgctgccaacagcaatacaacgtg

SEQ ID NO: 254279 - DNA, 25 bp, Mus musculus
gggtgctgccaacagcaatacaacg

SEQ ID NO: 254280 - DNA, 25 bp, Mus musculus
ggggtgctgccaacagcaatacaac

SEQ ID NO: 254281 - DNA, 25 bp, Mus musculus
agcaatacaacgtgcatggccgcta

SEQ ID NO: 254282 - DNA, 25 bp, Mus musculus
atatggttttatttatcggaacgcg

SEQ ID NO: 254283 - DNA, 25 bp, Mus musculus
caaaagaggccttttcgccggctct

SEQ ID NO: 254284 - DNA, 25 bp, Mus musculus
tcgccggctctctaatatggtttta

SEQ ID NO: 254285 - DNA, 25 bp, Mus musculus
aatgtgcaattgtgacctttgtgta

SEQ ID NO: 254286 - DNA, 25 bp, Mus musculus
aagaggccttttcgccggctctcta

SEQ ID NO: 254287 - DNA, 25 bp, Mus musculus
cggctctctaatatggttttattta

SEQ ID NO: 254288 - DNA, 25 bp, Mus musculus
aaataaagcgttgggaagcataggg

SEQ ID NO: 254289 - DNA, 25 bp, Mus musculus
gcccgcacgcttataaaaataaagc

SEQ ID NO: 254290 - DNA, 25 bp, Mus musculus
ctggggcccgcacgcttataaaaat

SEQ ID NO: 254291 - DNA, 25 bp, Mus musculus
tgtaaacgcagtcggtctggggccc

SEQ ID NO: 254292 - DNA, 25 bp, Mus musculus
cctttgtgtaaacgcagtcggtctg

SEQ ID NO: 254293 - DNA, 25 bp, Mus musculus
ttgtgacctttgtgtaaacgcagtc

SEQ ID NO: 254294 - DNA, 25 bp, Mus musculus
tgcaattgtgacctttgtgtaaacg

SEQ ID NO: 254295 - DNA, 25 bp, Mus musculus
ccttttcgccggctctctaatatgg

SEQ ID NO: 254296 - DNA, 25 bp, Mus musculus
cgttggcacccagtgcggttcagtg

SEQ ID NO: 254297 - DNA, 25 bp, Mus musculus
ttggcacccagtgcggttcagtgcc

SEQ ID NO: 254298 - DNA, 25 bp, Mus musculus
ttcagtgcccgttggcacccagtgc

SEQ ID NO: 254299 - DNA, 25 bp, Mus musculus
gcacccagtgcggttcagtgcccgt

SEQ ID NO: 254300 - DNA, 25 bp, Mus musculus
tcagtgcccgttggcacccagtgcg

SEQ ID NO: 254301 - DNA, 25 bp, Mus musculus
agtgcggttcagtgcccgttggcac

SEQ ID NO: 254302 - DNA, 25 bp, Mus musculus
cccagtgcggttcagtgcccgttgg

SEQ ID NO: 254303 - DNA, 25 bp, Mus musculus
ccgttggcacccagtgcggttcagt

SEQ ID NO: 254304 - DNA, 25 bp, Mus musculus
agtgcccgttggcacccagtgcggt

SEQ ID NO: 254305 - DNA, 25 bp, Mus musculus
ccagtgcggttcagtgcccgttggc

SEQ ID NO: 254306 - DNA, 25 bp, Mus musculus
gttcagtgcccgttggcacccagtg

SEQ ID NO: 254307 - DNA, 25 bp, Mus musculus
cccgttggcacccagtgcggttcag

SEQ ID NO: 254308 - DNA, 25 bp, Mus musculus
cacccagtgcggttcagtgcccgtt

SEQ ID NO: 254309 - DNA, 25 bp, Mus musculus
ggttcagtgcccgttggcacccagt

SEQ ID NO: 254310 - DNA, 25 bp, Mus musculus
ataatattccgagcgtgggaacgga

SEQ ID NO: 254311 - DNA, 25 bp, Mus musculus
tttgcgcctcccgacttggcttgcg

SEQ ID NO: 254312 - DNA, 25 bp, Mus musculus
ctcccgcggtggatctggcagcttc

SEQ ID NO: 254313 - DNA, 25 bp, Mus musculus
gcctctcaggatgctctggctgttc

SEQ ID NO: 254314 - DNA, 25 bp, Mus musculus
agctcggactggctgcagcctctca

SEQ ID NO: 254315 - DNA, 25 bp, Mus musculus
cgctccacccggaaagttgggctca

SEQ ID NO: 254316 - DNA, 25 bp, Mus musculus
aacggaggttgcagccgtcgctccc

SEQ ID NO: 254317 - DNA, 25 bp, Mus musculus
ggtctggcagggtcgataatattcc

SEQ ID NO: 254318 - DNA, 25 bp, Mus musculus
gctcaggcccggaccaggtctggca

SEQ ID NO: 254319 - DNA, 25 bp, Mus musculus
cgaccgcctgcgtgtttggtgctca

SEQ ID NO: 254320 - DNA, 25 bp, Mus musculus
gatgctttcacaccgaatccgtttg

SEQ ID NO: 254321 - DNA, 25 bp, Mus musculus
gcgccctaagctcacgcgatgcttt

SEQ ID NO: 254322 - DNA, 25 bp, Mus musculus
cccagactgtcaggatgaggtcact

SEQ ID NO: 254323 - DNA, 25 bp, Mus musculus
actggaccgggaatagacgccgata

SEQ ID NO: 254324 - DNA, 25 bp, Mus musculus
tgaacctgaagctggagcctgctcc

SEQ ID NO: 254325 - DNA, 25 bp, Mus musculus
ggccgcaggccaaagattatttata

SEQ ID NO: 254326 - DNA, 25 bp, Mus musculus
gagtttcctctctgctccggtgtgg

SEQ ID NO: 254327 - DNA, 25 bp, Mus musculus
tgggtccagagcaacaactctcctg

SEQ ID NO: 254328 - DNA, 25 bp, Mus musculus
ggatggactttcgtctccgccctta

SEQ ID NO: 254329 - DNA, 25 bp, Mus musculus
taacccgcgcaggtaatcggatcgc

SEQ ID NO: 254330 - DNA, 25 bp, Mus musculus
caggttttatttttcgcagcttgca

SEQ ID NO: 254331 - DNA, 25 bp, Mus musculus
ttctctcggggaaactatatactcc

SEQ ID NO: 254332 - DNA, 25 bp, Mus musculus
tggtctcctaggaacacgtcggctc

SEQ ID NO: 254333 - DNA, 25 bp, Mus musculus
ttttccacatgcttctgggcccggc

SEQ ID NO: 254334 - DNA, 25 bp, Mus musculus
agtggctacagaacccagattctta

SEQ ID NO: 254335 - DNA, 25 bp, Mus musculus
cccacggaaggctgcgtttagtaat

SEQ ID NO: 254336 - DNA, 25 bp, Mus musculus
tactccagttagaagtgaacacgcc

SEQ ID NO: 254337 - DNA, 25 bp, Mus musculus
taaatttggaactggagcacccgga

SEQ ID NO: 254338 - DNA, 25 bp, Mus musculus
gcagcagcgtcacggacaccaggca

SEQ ID NO: 254339 - DNA, 25 bp, Mus musculus
gttaactagctcacagggcgccgga

SEQ ID NO: 254340 - DNA, 25 bp, Mus musculus
aaacagcatgttggcagccgcttgg

SEQ ID NO: 254341 - DNA, 25 bp, Mus musculus
cggcctcgttaactagctcacaggg

SEQ ID NO: 254342 - DNA, 25 bp, Mus musculus
gtgcttccgagtgtccgagctctcg

SEQ ID NO: 254343 - DNA, 25 bp, Mus musculus
ccgcggctagcggactcctcgagag

SEQ ID NO: 254344 - DNA, 25 bp, Mus musculus
ctcctcgagagagcgcttacctgta

SEQ ID NO: 254345 - DNA, 25 bp, Mus musculus
gagcgcttacctgtagcaaccagtg

SEQ ID NO: 254346 - DNA, 25 bp, Mus musculus
ccagtctctccgatgagcgggaatc

SEQ ID NO: 254347 - DNA, 25 bp, Mus musculus
agcgggaatcccatggagcccttgg

SEQ ID NO: 254348 - DNA, 25 bp, Mus musculus
atgggcagcttgcagctcttgtcgc

SEQ ID NO: 254349 - DNA, 25 bp, Mus musculus
ctcttgtcgcgggtggcagcccagc

SEQ ID NO: 254350 - DNA, 25 bp, Mus musculus
ctccaagccttcaaacagcatgttg

SEQ ID NO: 254351 - DNA, 25 bp, Mus musculus
tgtagcaaccagtgaccagtctctc

SEQ ID NO: 254352 - DNA, 25 bp, Mus musculus
gctgccgagcgtgtgagctcccgcc

SEQ ID NO: 254353 - DNA, 25 bp, Mus musculus
agacacatgcccgagcgcgcatgca

SEQ ID NO: 254354 - DNA, 25 bp, Mus musculus
tgagatgagacacatgcccgagcgc

SEQ ID NO: 254355 - DNA, 25 bp, Mus musculus
cttcaaacggatgagatgagacaca

SEQ ID NO: 254356 - DNA, 25 bp, Mus musculus
gccgagtccagcaccttcaaacgga

SEQ ID NO: 254357 - DNA, 25 bp, Mus musculus
ctcagttcacctcgcgccttctctt

SEQ ID NO: 254358 - DNA, 25 bp, Mus musculus
ggatcaaactcagttcacctcgcgc

SEQ ID NO: 254359 - DNA, 25 bp, Mus musculus
ggcgcctcaggatcaaactcagttc

SEQ ID NO: 254360 - DNA, 25 bp, Mus musculus
cgatgcgtgtgtttatatagaggcg

SEQ ID NO: 254361 - DNA, 25 bp, Mus musculus
ggacccacttgtaggcgcctcagga

SEQ ID NO: 254362 - DNA, 25 bp, Mus musculus
ccagcaccttcaaacggatgagatg

SEQ ID NO: 254363 - DNA, 25 bp, Mus musculus
gcatgcacacactaatgcgcgcgcg

SEQ ID NO: 254364 - DNA, 25 bp, Mus musculus
ttgtaggcgcctcaggatcaaactc

SEQ ID NO: 254365 - DNA, 25 bp, Mus musculus
tctcgcccgggtctcgccgagtcca

SEQ ID NO: 254366 - DNA, 25 bp, Mus musculus
catcttcgcccgctccatcgcaggg

SEQ ID NO: 254367 - DNA, 25 bp, Mus musculus
agcgtcgcgcgcagcccactgggat

SEQ ID NO: 254368 - DNA, 25 bp, Mus musculus
cgcggccctctctcagcgagtaccc

SEQ ID NO: 254369 - DNA, 25 bp, Mus musculus
tgtgctctcgatctccctcaggatc

SEQ ID NO: 254370 - DNA, 25 bp, Mus musculus
ccgatgcaggccgtgtctgtgctct

SEQ ID NO: 254371 - DNA, 25 bp, Mus musculus
gtctgtgctctcgatctccctcagg

SEQ ID NO: 254372 - DNA, 25 bp, Mus musculus
cccagtacctgagcgtgggcccgat

SEQ ID NO: 254373 - DNA, 25 bp, Mus musculus
ccgcgcctcaccctttctcctcaga

SEQ ID NO: 254374 - DNA, 25 bp, Mus musculus
gctaaccaaagggagcggcggccca

SEQ ID NO: 254375 - DNA, 25 bp, Mus musculus
ctcctgactgaagagcagctaacca

SEQ ID NO: 254376 - DNA, 25 bp, Mus musculus
gagccggcgcttgctcctgactgaa

SEQ ID NO: 254377 - DNA, 25 bp, Mus musculus
atgggcagttccacagcgcgcagag

SEQ ID NO: 254378 - DNA, 25 bp, Mus musculus
cgagaaaaccgggacgctctcggag

SEQ ID NO: 254379 - DNA, 25 bp, Mus musculus
atccctctgcccaggatctgcggcc

SEQ ID NO: 254380 - DNA, 25 bp, Mus musculus
cggcggctgctttagcgttcttgaa

SEQ ID NO: 254381 - DNA, 25 bp, Mus musculus
cccgggatcacgacaatcaggagat

SEQ ID NO: 254382 - DNA, 25 bp, Mus musculus
ttgtggcccgggatcacgacaatca

SEQ ID NO: 254383 - DNA, 25 bp, Mus musculus
tgtaatgtggtggaagttgtggccc

SEQ ID NO: 254384 - DNA, 25 bp, Mus musculus
cggagcacgtgctggcgttgaacat

SEQ ID NO: 254385 - DNA, 25 bp, Mus musculus
atgacacggagcacgtgctggcgtt

SEQ ID NO: 254386 - DNA, 25 bp, Mus musculus
tcactttcaaggttgaggaggagga

SEQ ID NO: 254387 - DNA, 25 bp, Mus musculus
ccttcactttcaaggttgaggagga

SEQ ID NO: 254388 - DNA, 25 bp, Mus musculus
cccgctccttcactttcaaggttga

SEQ ID NO: 254389 - DNA, 25 bp, Mus musculus
ggttgtgagctctccggccacaccc

SEQ ID NO: 254390 - DNA, 25 bp, Mus musculus
cacaatggacagtttcttcttcggt

SEQ ID NO: 254391 - DNA, 25 bp, Mus musculus
cccggtcacaatggacagtttcttc

SEQ ID NO: 254392 - DNA, 25 bp, Mus musculus
tttagcgttcttgaaccaagagagc

SEQ ID NO: 254393 - DNA, 25 bp, Mus musculus
ggctgctttagcgttcttgaaccaa

SEQ ID NO: 254394 - DNA, 25 bp, Mus musculus
agagcctgcgtggtccctgtggccc

SEQ ID NO: 254395 - DNA, 25 bp, Mus musculus
ggcacctgcccaacgctcggctcgc

SEQ ID NO: 254396 - DNA, 25 bp, Mus musculus
cgactagaatcgtgcgagagccctg

SEQ ID NO: 254397 - DNA, 25 bp, Mus musculus
ggggtcctcctgatgcggcacctgc

SEQ ID NO: 254398 - DNA, 25 bp, Mus musculus
cgcctagagcctgcgtggtccctgt

SEQ ID NO: 254399 - DNA, 25 bp, Mus musculus
cggggaactctgagcaaccgccgga

SEQ ID NO: 254400 - DNA, 25 bp, Mus musculus
aactctgagcaaccgccggagcgcg

SEQ ID NO: 254401 - DNA, 25 bp, Mus musculus
cgcgcgctgtgcgtgctactgagaa

SEQ ID NO: 254402 - DNA, 25 bp, Mus musculus
tgtgcgtgctactgagaacctcttc

SEQ ID NO: 254403 - DNA, 25 bp, Mus musculus
cgtcgcggccacgactagaatcgtg

SEQ ID NO: 254404 - DNA, 25 bp, Mus musculus
ctactgagaacctcttctggggtcc

SEQ ID NO: 254405 - DNA, 25 bp, Mus musculus
agaacctcttctggggtcctcctga

SEQ ID NO: 254406 - DNA, 25 bp, Mus musculus
cgtgcgagagccctggcacgaagtt

SEQ ID NO: 254407 - DNA, 25 bp, Mus musculus
ccctggcacgaagttgggcaactgc

SEQ ID NO: 254408 - DNA, 25 bp, Mus musculus
tgaccctgtgcggagccagatgctg

SEQ ID NO: 254409 - DNA, 25 bp, Mus musculus
gctggcttcagactccagaactgga

SEQ ID NO: 254410 - DNA, 25 bp, Mus musculus
cgccttgtttccgtggcgcctagat

SEQ ID NO: 254411 - DNA, 25 bp, Mus musculus
tccgtggcgcctagatctctgtcca

SEQ ID NO: 254412 - DNA, 25 bp, Mus musculus
gagactcggggccactgatctccct

SEQ ID NO: 254413 - DNA, 25 bp, Mus musculus
ctctgcgctggcttcagactccaga

SEQ ID NO: 254414 - DNA, 25 bp, Mus musculus
gctggggagagggaaacttctccac

SEQ ID NO: 254415 - DNA, 25 bp, Mus musculus
gagagggaaacttctccacctagaa

SEQ ID NO: 254416 - DNA, 25 bp, Mus musculus
agaaagtttcaccttgccgagggcg

SEQ ID NO: 254417 - DNA, 25 bp, Mus musculus
ccaaccctccaagggtggtgccagt

SEQ ID NO: 254418 - DNA, 25 bp, Mus musculus
cgttggggacaaacctagagcgaca

SEQ ID NO: 254419 - DNA, 25 bp, Mus musculus
acagggacgaacagacacgtgctgg

SEQ ID NO: 254420 - DNA, 25 bp, Mus musculus
caaggtacaaactccagccgcgtcg

SEQ ID NO: 254421 - DNA, 25 bp, Mus musculus
acctagagcgacagggacgaacaga

SEQ ID NO: 254422 - DNA, 25 bp, Mus musculus
ctgccagcaccactttcaggtcagg

SEQ ID NO: 254423 - DNA, 25 bp, Mus musculus
tgcgcagctactgaaccaggacggg

SEQ ID NO: 254424 - DNA, 25 bp, Mus musculus
tggaactcagactcatgcgcagcta

SEQ ID NO: 254425 - DNA, 25 bp, Mus musculus
tgcctccatgcctggaactcagact

SEQ ID NO: 254426 - DNA, 25 bp, Mus musculus
tcacggaaccgggagacagcaaccg

SEQ ID NO: 254427 - DNA, 25 bp, Mus musculus
gtgcgcttacgagcatcacggaacc

SEQ ID NO: 254428 - DNA, 25 bp, Mus musculus
agcatcgactcactgcgtgcgctta

SEQ ID NO: 254429 - DNA, 25 bp, Mus musculus
ggagctcgcgtactgcgctcagcaa

SEQ ID NO: 254430 - DNA, 25 bp, Mus musculus
ttcaggtcaggctgctgagcgccca

SEQ ID NO: 254431 - DNA, 25 bp, Mus musculus
agcctcggtgcccagatcggcggct

SEQ ID NO: 254432 - DNA, 25 bp, Mus musculus
ttcgggccagaatccactggtgttt

SEQ ID NO: 254433 - DNA, 25 bp, Mus musculus
ccgggcctcggcaggaaatcctaat

SEQ ID NO: 254434 - DNA, 25 bp, Mus musculus
cttcagttgccgcagcatcgactca

SEQ ID NO: 254435 - DNA, 25 bp, Mus musculus
gagcctattcttggcttgggacggc

SEQ ID NO: 254436 - DNA, 25 bp, Mus musculus
agcgcgatgctgagctcccgaggcc

SEQ ID NO: 254437 - DNA, 25 bp, Mus musculus
ctcctggggcttttgtcccgccctg

SEQ ID NO: 254438 - DNA, 25 bp, Mus musculus
gcagctagcccggttgcagttaccg

SEQ ID NO: 254439 - DNA, 25 bp, Mus musculus
cagttaccgggttcggtgatgctcc

SEQ ID NO: 254440 - DNA, 25 bp, Mus musculus
taccgggttcggtgatgctcctaaa

SEQ ID NO: 254441 - DNA, 25 bp, Mus musculus
gttcggtgatgctcctaaacgcacg

SEQ ID NO: 254442 - DNA, 25 bp, Mus musculus
tgatgctcctaaacgcacgctgtga

SEQ ID NO: 254443 - DNA, 25 bp, Mus musculus
ctcctaaacgcacgctgtgagttcg

SEQ ID NO: 254444 - DNA, 25 bp, Mus musculus
acgctgtgagttcgtgctgtggcaa

SEQ ID NO: 254445 - DNA, 25 bp, Mus musculus
agttcgtgctgtggcaactgaagga

SEQ ID NO: 254446 - DNA, 25 bp, Mus musculus
tgcacccgctccacacaccactctg

SEQ ID NO: 254447 - DNA, 25 bp, Mus musculus
aggccggcatgcagcggttgcctct

SEQ ID NO: 254448 - DNA, 25 bp, Mus musculus
agcggttgcctctgagcgcgatgct

SEQ ID NO: 254449 - DNA, 25 bp, Mus musculus
gcctctgagcgcgatgctgagctcc

SEQ ID NO: 254450 - DNA, 25 bp, Mus musculus
agctggtgttcccagaggccatgaa

SEQ ID NO: 254451 - DNA, 25 bp, Mus musculus
ctaagcggggtttcaccatagagtc

SEQ ID NO: 254452 - DNA, 25 bp, Mus musculus
caactcggtgttagggctctcgcac

SEQ ID NO: 254453 - DNA, 25 bp, Mus musculus
tgcgcagtggcccaactcggtgtta

SEQ ID NO: 254454 - DNA, 25 bp, Mus musculus
agcggctctcagtagcacaggcagc

SEQ ID NO: 254455 - DNA, 25 bp, Mus musculus
caggaggaccgctgaagcggctctc

SEQ ID NO: 254456 - DNA, 25 bp, Mus musculus
gtggtcggtcacagcttgattagta

SEQ ID NO: 254457 - DNA, 25 bp, Mus musculus
agacggccttcgtgagtggcttccc

SEQ ID NO: 254458 - DNA, 25 bp, Mus musculus
gaggccatgaaccacccggctctga

SEQ ID NO: 254459 - DNA, 25 bp, Mus musculus
ccaccgcttccagggtgagtgtcca

SEQ ID NO: 254460 - DNA, 25 bp, Mus musculus
agtgtccatgccgtgttcgtgaccc

SEQ ID NO: 254461 - DNA, 25 bp, Mus musculus
ggccgcatcagaggaaccgctcagg

SEQ ID NO: 254462 - DNA, 25 bp, Mus musculus
accatagagtccttggtggccaagg

SEQ ID NO: 254463 - DNA, 25 bp, Mus musculus
tggcccggcagagctagaaagatca

SEQ ID NO: 254464 - DNA, 25 bp, Mus musculus
ttacggcaggtacggcaggtattag

SEQ ID NO: 254465 - DNA, 25 bp, Mus musculus
gtacggcaggtattagagagggcgc

SEQ ID NO: 254466 - DNA, 25 bp, Mus musculus
agagggcgcctgtgtgtgacaccac

SEQ ID NO: 254467 - DNA, 25 bp, Mus musculus
gtgtgtgacaccaccttacggcagg

SEQ ID NO: 254468 - DNA, 25 bp, Mus musculus
tgacaccaccttacggcaggtacgg

SEQ ID NO: 254469 - DNA, 25 bp, Mus musculus
ccaccttacggcaggtacggcaggt

SEQ ID NO: 254470 - DNA, 25 bp, Mus musculus
gggcgcctgtgtgtgacaccacctt

SEQ ID NO: 254471 - DNA, 25 bp, Mus musculus
gcgcctgtgtgtgacaccaccttac

SEQ ID NO: 254472 - DNA, 25 bp, Mus musculus
tgtgtgacaccaccttacggcaggt

SEQ ID NO: 254473 - DNA, 25 bp, Mus musculus
ggcgcctgtgtgtgacaccacctta

SEQ ID NO: 254474 - DNA, 25 bp, Mus musculus
acggcaggtattagagagggcgcct

SEQ ID NO: 254475 - DNA, 25 bp, Mus musculus
caccttacggcaggtacggcaggta

SEQ ID NO: 254476 - DNA, 25 bp, Mus musculus
tgtgtgtgacaccaccttacggcag

SEQ ID NO: 254477 - DNA, 25 bp, Mus musculus
gtgtgacaccaccttacggcaggta

SEQ ID NO: 254478 - DNA, 25 bp, Mus musculus
gctgcctcttccagattccactggg

SEQ ID NO: 254479 - DNA, 25 bp, Mus musculus
gaccgcgcttgcgaactcggaagtc

SEQ ID NO: 254480 - DNA, 25 bp, Mus musculus
ctcggaagtccaatgggtgctgatc

SEQ ID NO: 254481 - DNA, 25 bp, Mus musculus
cggaaccggcttacgcgttctgtgc

SEQ ID NO: 254482 - DNA, 25 bp, Mus musculus
gatgctcacttcagtcccgttttgg

SEQ ID NO: 254483 - DNA, 25 bp, Mus musculus
agaaccgggtctccgcgatgctcac

SEQ ID NO: 254484 - DNA, 25 bp, Mus musculus
ctccggcgccgtgttttctggagaa

SEQ ID NO: 254485 - DNA, 25 bp, Mus musculus
tctccgggctaagaacccagcagtc

SEQ ID NO: 254486 - DNA, 25 bp, Mus musculus
ctttccaactccgaagtgccatggc

SEQ ID NO: 254487 - DNA, 25 bp, Mus musculus
cccgcgaagattaagcgaggttggc

SEQ ID NO: 254488 - DNA, 25 bp, Mus musculus
ccagcggatacgttgtggagttaca

SEQ ID NO: 254489 - DNA, 25 bp, Mus musculus
tctgagccatcggtcccagcggata

SEQ ID NO: 254490 - DNA, 25 bp, Mus musculus
ctcagccaagcgaggccagtatatc

SEQ ID NO: 254491 - DNA, 25 bp, Mus musculus
tgtgccttttgagagagatcagctc

SEQ ID NO: 254492 - DNA, 25 bp, Mus musculus
atcctagggcacacgcagcaccttg

SEQ ID NO: 254493 - DNA, 25 bp, Mus musculus
gcttcggagaatgacacagcgtttc

SEQ ID NO: 254494 - DNA, 25 bp, Mus musculus
agaccctcgagctgaagtgactttg

SEQ ID NO: 254495 - DNA, 25 bp, Mus musculus
cccggacagagatcaggtcgctgta

SEQ ID NO: 254496 - DNA, 25 bp, Mus musculus
tggttgctgtatccgccatggccac

SEQ ID NO: 254497 - DNA, 25 bp, Mus musculus
agttttgcccggagactgtcccgca

SEQ ID NO: 254498 - DNA, 25 bp, Mus musculus
tgtcccgcagctcacaagaaaggtc

SEQ ID NO: 254499 - DNA, 25 bp, Mus musculus
agttgaggagcataccggccacacc

SEQ ID NO: 254500 - DNA, 25 bp, Mus musculus
tcacaagacgggaactttgcgccta

SEQ ID NO: 254501 - DNA, 25 bp, Mus musculus
cgcgtggccaatcatcgagcgacta

SEQ ID NO: 254502 - DNA, 25 bp, Mus musculus
gcatccgcggaatgactgtgccacc

SEQ ID NO: 254503 - DNA, 25 bp, Mus musculus
tgccacccgccaataggaaaccaga

SEQ ID NO: 254504 - DNA, 25 bp, Mus musculus
gcccaataggaaaggagcggctaca

SEQ ID NO: 254505 - DNA, 25 bp, Mus musculus
gtccggctggtctcatcactgaagc

SEQ ID NO: 254506 - DNA, 25 bp, Mus musculus
cccagactcactgcgtgtgctgggc

SEQ ID NO: 254507 - DNA, 25 bp, Mus musculus
agagctacggttgcccggcccagaa

SEQ ID NO: 254508 - DNA, 25 bp, Mus musculus
gaaacttgtccacgccgatgagtga

SEQ ID NO: 254509 - DNA, 25 bp, Mus musculus
cacgccgatgagtgagcgatgcatg

SEQ ID NO: 254510 - DNA, 25 bp, Mus musculus
cgatgcatggtggtgagcacgagct

SEQ ID NO: 254511 - DNA, 25 bp, Mus musculus
gctccaggcggtagctcgaacgaac

SEQ ID NO: 254512 - DNA, 25 bp, Mus musculus
gcggtagctcgaacgaacactcttc

SEQ ID NO: 254513 - DNA, 25 bp, Mus musculus
tcgaacgaacactcttcgcaccatt

SEQ ID NO: 254514 - DNA, 25 bp, Mus musculus
accattccgggcagccttgcgtctt

SEQ ID NO: 254515 - DNA, 25 bp, Mus musculus
ttgcgtcttctccactaccgaggtg

SEQ ID NO: 254516 - DNA, 25 bp, Mus musculus
cggaagacctcgtccagagctacgg

SEQ ID NO: 254517 - DNA, 25 bp, Mus musculus
gaggtgctgtacttctctcggccca

SEQ ID NO: 254518 - DNA, 25 bp, Mus musculus
ccactaccgaggtgctgtacttctc

SEQ ID NO: 254519 - DNA, 25 bp, Mus musculus
tcttctccactaccgaggtgctgta

SEQ ID NO: 254520 - DNA, 25 bp, Mus musculus
cgcttgtgcacagtgcggaactgca

SEQ ID NO: 254521 - DNA, 25 bp, Mus musculus
agccgaacctctctgcataactatc

SEQ ID NO: 254522 - DNA, 25 bp, Mus musculus
ccaagctagagagccgaacctctct

SEQ ID NO: 254523 - DNA, 25 bp, Mus musculus
ttaggcagcgactccaagctagaga

SEQ ID NO: 254524 - DNA, 25 bp, Mus musculus
cccgtttaggcagcgactccaagct

SEQ ID NO: 254525 - DNA, 25 bp, Mus musculus
acgaaggccgcttgcagcctctgca

SEQ ID NO: 254526 - DNA, 25 bp, Mus musculus
gtgcacagtgcggaactgcaaagga

SEQ ID NO: 254527 - DNA, 25 bp, Mus musculus
cggattcgcttgtgcacagtgcgga

SEQ ID NO: 254528 - DNA, 25 bp, Mus musculus
tcacgaccggattcgcttgtgcaca

SEQ ID NO: 254529 - DNA, 25 bp, Mus musculus
ccttaatcacgaccggattcgcttg

SEQ ID NO: 254530 - DNA, 25 bp, Mus musculus
tggccatgccttaatcacgaccgga

SEQ ID NO: 254531 - DNA, 25 bp, Mus musculus
ttgagatctggccatgccttaatca

SEQ ID NO: 254532 - DNA, 25 bp, Mus musculus
gagaggattgagatctggccatgcc

SEQ ID NO: 254533 - DNA, 25 bp, Mus musculus
tgcggaactgcaaaggaagaaatgg

SEQ ID NO: 254534 - DNA, 25 bp, Mus musculus
gcactaatcctctggctgcagctgg

SEQ ID NO: 254535 - DNA, 25 bp, Mus musculus
cagcgcactaatcctctggctgcag

SEQ ID NO: 254536 - DNA, 25 bp, Mus musculus
ctaatcctctggctgcagctggccg

SEQ ID NO: 254537 - DNA, 25 bp, Mus musculus
gctgaccagcctgaggcatccgcgt

SEQ ID NO: 254538 - DNA, 25 bp, Mus musculus
tcccgcgactcaaatgcggcatttg

SEQ ID NO: 254539 - DNA, 25 bp, Mus musculus
aaatgcggcatttgagatgcggcgc

SEQ ID NO: 254540 - DNA, 25 bp, Mus musculus
gcccgcctgtttgctcgcggagctg

SEQ ID NO: 254541 - DNA, 25 bp, Mus musculus
cgcctgtttgctcgcggagctggcc

SEQ ID NO: 254542 - DNA, 25 bp, Mus musculus
cgggaagccgactcgcaagagtatc

SEQ ID NO: 254543 - DNA, 25 bp, Mus musculus
agccgactcgcaagagtatcagaga

SEQ ID NO: 254544 - DNA, 25 bp, Mus musculus
cgactcgcaagagtatcagagatta

SEQ ID NO: 254545 - DNA, 25 bp, Mus musculus
tcgcaagagtatcagagattagggg

SEQ ID NO: 254546 - DNA, 25 bp, Mus musculus
tatcagagattagggggcccgcttc

SEQ ID NO: 254547 - DNA, 25 bp, Mus musculus
cctggccgcgattccgcccgcgggt

SEQ ID NO: 254548 - DNA, 25 bp, Mus musculus
atggcggcctccatgtgcgacgtgt

SEQ ID NO: 254549 - DNA, 25 bp, Mus musculus
ctccatgtgcgacgtgttctccttc

SEQ ID NO: 254550 - DNA, 25 bp, Mus musculus
tgtgcgacgtgttctccttctgcgt

SEQ ID NO: 254551 - DNA, 25 bp, Mus musculus
acgtgttctccttctgcgtgggcgt

SEQ ID NO: 254552 - DNA, 25 bp, Mus musculus
cgtggaagtccgttatgtggacagc

SEQ ID NO: 254553 - DNA, 25 bp, Mus musculus
ccgttatgtggacagcatcaaggtg

SEQ ID NO: 254554 - DNA, 25 bp, Mus musculus
acagcatcaaggtgaggccaggtcg

SEQ ID NO: 254555 - DNA, 25 bp, Mus musculus
acgctcacattctggagtccgggcc

SEQ ID NO: 254556 - DNA, 25 bp, Mus musculus
ctcggcgccagtctggttgctgctt

SEQ ID NO: 254557 - DNA, 25 bp, Mus musculus
ccagtctggttgctgcttgggcccg

SEQ ID NO: 254558 - DNA, 25 bp, Mus musculus
ggtgcagagtcggtcctcgtgccca

SEQ ID NO: 254559 - DNA, 25 bp, Mus musculus
ctcgtgcccaggctcgtggcgatat

SEQ ID NO: 254560 - DNA, 25 bp, Mus musculus
gcccaggctcgtggcgatatcgcgc

SEQ ID NO: 254561 - DNA, 25 bp, Mus musculus
ggggaacccacgctcacattctgga

SEQ ID NO: 254562 - DNA, 25 bp, Mus musculus
tgaggcgggaccttaccgcacctta

SEQ ID NO: 254563 - DNA, 25 bp, Mus musculus
cgcgagttcctagagcgtccctgga

SEQ ID NO: 254564 - DNA, 25 bp, Mus musculus
tgcacgtctaccatggcgtctggga

SEQ ID NO: 254565 - DNA, 25 bp, Mus musculus
ggctacctcgggagctaaccataga

SEQ ID NO: 254566 - DNA, 25 bp, Mus musculus
tcgcccgactttagcctgacagctg

SEQ ID NO: 254567 - DNA, 25 bp, Mus musculus
cgggctaacgtctcgccagaagctt

SEQ ID NO: 254568 - DNA, 25 bp, Mus musculus
aagcttctgggcatttctccggcgc

SEQ ID NO: 254569 - DNA, 25 bp, Mus musculus
aactgacgagttgcgggtacctgaa

SEQ ID NO: 254570 - DNA, 25 bp, Mus musculus
tgaagccgcttccaagatgatggtg

SEQ ID NO: 254571 - DNA, 25 bp, Mus musculus
tgcgccctaggccacttcctattgg

SEQ ID NO: 254572 - DNA, 25 bp, Mus musculus
gcgctgattggccaaaactcttaat

SEQ ID NO: 254573 - DNA, 25 bp, Mus musculus
tcccaagctacctgtgaaactcacg

SEQ ID NO: 254574 - DNA, 25 bp, Mus musculus
tcctagccggtgttcagtactgata

SEQ ID NO: 254575 - DNA, 25 bp, Mus musculus
gagcaaatttcctgcgcccgagcgg

SEQ ID NO: 254576 - DNA, 25 bp, Mus musculus
ggctccggtggtgggccgcacgcct

SEQ ID NO: 254577 - DNA, 25 bp, Mus musculus
cggcgcggaagaccgctcggaaagg

SEQ ID NO: 254578 - DNA, 25 bp, Mus musculus
gctgctgccaccagcgccacggtct

SEQ ID NO: 254579 - DNA, 25 bp, Mus musculus
cagcgccacggtctgtcgccagaag

SEQ ID NO: 254580 - DNA, 25 bp, Mus musculus
cgccacggtctgtcgccagaaggaa

SEQ ID NO: 254581 - DNA, 25 bp, Mus musculus
gccacggtctgtcgccagaaggaag

SEQ ID NO: 254582 - DNA, 25 bp, Mus musculus
acggtctgtcgccagaaggaagatg

SEQ ID NO: 254583 - DNA, 25 bp, Mus musculus
tcgccagaaggaagatggcggatct

SEQ ID NO: 254584 - DNA, 25 bp, Mus musculus
atctggaggagcagttgtccgatga

SEQ ID NO: 254585 - DNA, 25 bp, Mus musculus
gcagttgtccgatgaggagaaggta

SEQ ID NO: 254586 - DNA, 25 bp, Mus musculus
ctcccaggcgtgtgcgcagtggctc

SEQ ID NO: 254587 - DNA, 25 bp, Mus musculus
gagaaggtaggtgccgcggcggtga

SEQ ID NO: 254588 - DNA, 25 bp, Mus musculus
ggccgcacgcctgcgcttcccgagc

SEQ ID NO: 254589 - DNA, 25 bp, Mus musculus
tgcgcttcccgagcggggtgctgcc

SEQ ID NO: 254590 - DNA, 25 bp, Mus musculus
tctcgtaggtgtggctgtactccag

SEQ ID NO: 254591 - DNA, 25 bp, Mus musculus
agtttctagctctgctgccttgcgc

SEQ ID NO: 254592 - DNA, 25 bp, Mus musculus
ggatcttaaggcgtgccaggccctc

SEQ ID NO: 254593 - DNA, 25 bp, Mus musculus
aggatgccacggacttgcgcgcaaa

SEQ ID NO: 254594 - DNA, 25 bp, Mus musculus
ttgcgcgcaaacagctcgccgagtg

SEQ ID NO: 254595 - DNA, 25 bp, Mus musculus
ctcgccgagtgggatttcgatttcg

SEQ ID NO: 254596 - DNA, 25 bp, Mus musculus
ttcgatttcgcgtagcgcatagcgc

SEQ ID NO: 254597 - DNA, 25 bp, Mus musculus
gtcgcctgttccttgccctggaagg

SEQ ID NO: 254598 - DNA, 25 bp, Mus musculus
ccctggaaggacgtgctctcaaaga

SEQ ID NO: 254599 - DNA, 25 bp, Mus musculus
cgccgtcgcagatgctgttggtctt

SEQ ID NO: 254600 - DNA, 25 bp, Mus musculus
tcttggaaaggatgtagagcgtctc

SEQ ID NO: 254601 - DNA, 25 bp, Mus musculus
ataggctccggaagcgcttatgctc

SEQ ID NO: 254602 - DNA, 25 bp, Mus musculus
tcacgtccacttggcgtgagagctc

SEQ ID NO: 254603 - DNA, 25 bp, Mus musculus
gcgcgctctcctgtcttgcagtttc

SEQ ID NO: 254604 - DNA, 25 bp, Mus musculus
ctgtgtcttctgctgcccaccttta

SEQ ID NO: 254605 - DNA, 25 bp, Mus musculus
tgctttggagcgtccagctgtgtct

SEQ ID NO: 254606 - DNA, 25 bp, Mus musculus
caaggcattcctgtgctttggagcg

SEQ ID NO: 254607 - DNA, 25 bp, Mus musculus
accaccaaggcattcctgtgctttg

SEQ ID NO: 254608 - DNA, 25 bp, Mus musculus
cgttttccgcagaagctggtggctt

SEQ ID NO: 254609 - DNA, 25 bp, Mus musculus
tctccagcaagaggggagcggcact

SEQ ID NO: 254610 - DNA, 25 bp, Mus musculus
ctcttccagcctgtggcgaggccag

SEQ ID NO: 254611 - DNA, 25 bp, Mus musculus
ttgcctttacctcttccagcctgtg

SEQ ID NO: 254612 - DNA, 25 bp, Mus musculus
gcagcacgctccagacttgccttta

SEQ ID NO: 254613 - DNA, 25 bp, Mus musculus
tgcctagcctctccaggaccagtcc

SEQ ID NO: 254614 - DNA, 25 bp, Mus musculus
tggctgaggtcttccctgcctagcc

SEQ ID NO: 254615 - DNA, 25 bp, Mus musculus
ctcacggcctcaggagggcaacagg

SEQ ID NO: 254616 - DNA, 25 bp, Mus musculus
agttctagcggcctcacggcctcag

SEQ ID NO: 254617 - DNA, 25 bp, Mus musculus
tgcccacctttaatcagggcctgtc

SEQ ID NO: 254618 - DNA, 25 bp, Mus musculus
cggcggaaagtgaatcactaattga

SEQ ID NO: 254619 - DNA, 25 bp, Mus musculus
gctcccttggaagcggtgactcagc

SEQ ID NO: 254620 - DNA, 25 bp, Mus musculus
ggcactaggcggcaccggacttcgc

SEQ ID NO: 254621 - DNA, 25 bp, Mus musculus
ggagcaaaggagaaaagcgagtctc

SEQ ID NO: 254622 - DNA, 25 bp, Mus musculus
cgagtctcaaactcaaagcaggttg

SEQ ID NO: 254623 - DNA, 25 bp, Mus musculus
aaactcaaagcaggttggtctggga

SEQ ID NO: 254624 - DNA, 25 bp, Mus musculus
cgggcaggagaacaaagcgcctgac

SEQ ID NO: 254625 - DNA, 25 bp, Mus musculus
caggagaacaaagcgcctgacgcgg

SEQ ID NO: 254626 - DNA, 25 bp, Mus musculus
gaaactgctggccaagacggggacg

SEQ ID NO: 254627 - DNA, 25 bp, Mus musculus
ccaggccaggggaccagacacccgc

SEQ ID NO: 254628 - DNA, 25 bp, Mus musculus
cctgcgacggcggaaagtgaatcac

SEQ ID NO: 254629 - DNA, 25 bp, Mus musculus
tcactaattgaaaccactcctaggc

SEQ ID NO: 254630 - DNA, 25 bp, Mus musculus
agccggctcccttggaagcggtgac

SEQ ID NO: 254631 - DNA, 25 bp, Mus musculus
tgaaaccactcctaggcatccgacg

SEQ ID NO: 254632 - DNA, 25 bp, Mus musculus
ccaggaagcaggagtctgttaagtc

SEQ ID NO: 254633 - DNA, 25 bp, Mus musculus
gcagagcgcctcgtgcacttccgat

SEQ ID NO: 254634 - DNA, 25 bp, Mus musculus
gcacttccgatcctgcagcagaggg

SEQ ID NO: 254635 - DNA, 25 bp, Mus musculus
gtgcctcggagcctacagctgcgac

SEQ ID NO: 254636 - DNA, 25 bp, Mus musculus
gcacacctcaaagggcgtgcctcgg

SEQ ID NO: 254637 - DNA, 25 bp, Mus musculus
cctgccaaaggagggaccacgcatc

SEQ ID NO: 254638 - DNA, 25 bp, Mus musculus
agctcaagaagtcgcctgccaaagg

SEQ ID NO: 254639 - DNA, 25 bp, Mus musculus
gccaggcccaagatgccagacatga

SEQ ID NO: 254640 - DNA, 25 bp, Mus musculus
cggccgaactcagatctggggagta

SEQ ID NO: 254641 - DNA, 25 bp, Mus musculus
gggccctttgaaggctgaagcagca

SEQ ID NO: 254642 - DNA, 25 bp, Mus musculus
cgaccttggtccctactgcagagaa

SEQ ID NO: 254643 - DNA, 25 bp, Mus musculus
ggcagctgatggacagcaggtcctc

SEQ ID NO: 254644 - DNA, 25 bp, Mus musculus
cctaagtcacctggggccaacgaga

SEQ ID NO: 254645 - DNA, 25 bp, Mus musculus
cctggatgaagaagctgccgctgta

SEQ ID NO: 254646 - DNA, 25 bp, Mus musculus
tacgagtcccagcggcaggagagct

SEQ ID NO: 254647 - DNA, 25 bp, Mus musculus
ctagtgacgctcttctgcggctttc

SEQ ID NO: 254648 - DNA, 25 bp, Mus musculus
tactgtgagcgaggtctagtgacgc

SEQ ID NO: 254649 - DNA, 25 bp, Mus musculus
cgaggtctagtgacgctcttctgcg

SEQ ID NO: 254650 - DNA, 25 bp, Mus musculus
gtgacgctcttctgcggctttcccg

SEQ ID NO: 254651 - DNA, 25 bp, Mus musculus
caacgcgcgggctggttctcagctc

SEQ ID NO: 254652 - DNA, 25 bp, Mus musculus
gcgcagccgcaaccgccagtcaact

SEQ ID NO: 254653 - DNA, 25 bp, Mus musculus
agcgcgaggccaacatggagcctga

SEQ ID NO: 254654 - DNA, 25 bp, Mus musculus
gaggccaacatggagcctgaggacc

SEQ ID NO: 254655 - DNA, 25 bp, Mus musculus
agcctgaggacctgccgtggcctga

SEQ ID NO: 254656 - DNA, 25 bp, Mus musculus
acctgccgtggcctgacgagctgga

SEQ ID NO: 254657 - DNA, 25 bp, Mus musculus
ggcgaccgaggaggccctgacctct

SEQ ID NO: 254658 - DNA, 25 bp, Mus musculus
ttggattttaactacgagtcccagc

SEQ ID NO: 254659 - DNA, 25 bp, Mus musculus
ccgaggaggccctgacctctgagga

SEQ ID NO: 254660 - DNA, 25 bp, Mus musculus
agtttcctaggggacgatcttctga

SEQ ID NO: 254661 - DNA, 25 bp, Mus musculus
cccacctatcaaacattaagcactt

SEQ ID NO: 254662 - DNA, 25 bp, Mus musculus
cctatcaaacattaagcacttccgg

SEQ ID NO: 254663 - DNA, 25 bp, Mus musculus
caaacattaagcacttccggaagta

SEQ ID NO: 254664 - DNA, 25 bp, Mus musculus
gcagggtgagttccgccctgttgct

SEQ ID NO: 254665 - DNA, 25 bp, Mus musculus
taggatgcagggtgagttccgccct

SEQ ID NO: 254666 - DNA, 25 bp, Mus musculus
acgatcttctgatgcgggcgtagga

SEQ ID NO: 254667 - DNA, 25 bp, Mus musculus
tagagagctaagtttcctaggggac

SEQ ID NO: 254668 - DNA, 25 bp, Mus musculus
ttcctaggggacgatcttctgatgc

SEQ ID NO: 254669 - DNA, 25 bp, Mus musculus
cattaagcacttccggaagtagaga

SEQ ID NO: 254670 - DNA, 25 bp, Mus musculus
gagctaagtttcctaggggacgatc

SEQ ID NO: 254671 - DNA, 25 bp, Mus musculus
ccaccggaaactgggcgcctcggcg

SEQ ID NO: 254672 - DNA, 25 bp, Mus musculus
cggaagtagagagctaagtttccta

SEQ ID NO: 254673 - DNA, 25 bp, Mus musculus
cctaggggacgatcttctgatgcgg

SEQ ID NO: 254674 - DNA, 25 bp, Mus musculus
tgggcggaacccactttcattttgc

SEQ ID NO: 254675 - DNA, 25 bp, Mus musculus
cggctgggcggaacccactttcatt

SEQ ID NO: 254676 - DNA, 25 bp, Mus musculus
tccggctgggcggaacccactttca

SEQ ID NO: 254677 - DNA, 25 bp, Mus musculus
cttagatgatcgttccccggaagca

SEQ ID NO: 254678 - DNA, 25 bp, Mus musculus
ctgggcggaacccactttcattttg

SEQ ID NO: 254679 - DNA, 25 bp, Mus musculus
cactttcattttgccgcacggctta

SEQ ID NO: 254680 - DNA, 25 bp, Mus musculus
ttcattttgccgcacggcttagatg

SEQ ID NO: 254681 - DNA, 25 bp, Mus musculus
tcattttgccgcacggcttagatga

SEQ ID NO: 254682 - DNA, 25 bp, Mus musculus
ttgccgcacggcttagatgatcgtt

SEQ ID NO: 254683 - DNA, 25 bp, Mus musculus
tgccgcacggcttagatgatcgttc

SEQ ID NO: 254684 - DNA, 25 bp, Mus musculus
gccgcacggcttagatgatcgttcc

SEQ ID NO: 254685 - DNA, 25 bp, Mus musculus
ccgcacggcttagatgatcgttccc

SEQ ID NO: 254686 - DNA, 25 bp, Mus musculus
tttgccgcacggcttagatgatcgt

SEQ ID NO: 254687 - DNA, 25 bp, Mus musculus
acggcttagatgatcgttccccgga

SEQ ID NO: 254688 - DNA, 25 bp, Mus musculus
gagaccatgtcgctctccaccgggg

SEQ ID NO: 254689 - DNA, 25 bp, Mus musculus
ttcgcccgcaaaactgtccgcaggg

SEQ ID NO: 254690 - DNA, 25 bp, Mus musculus
aggcacgcgtacttcgcccgcaaaa

SEQ ID NO: 254691 - DNA, 25 bp, Mus musculus
aaaggcacgcgtacttcgcccgcaa

SEQ ID NO: 254692 - DNA, 25 bp, Mus musculus
acgggcaaaggcacgcgtacttcgc

SEQ ID NO: 254693 - DNA, 25 bp, Mus musculus
aacacgggcaaaggcacgcgtactt

SEQ ID NO: 254694 - DNA, 25 bp, Mus musculus
acaaacacgggcaaaggcacgcgta

SEQ ID NO: 254695 - DNA, 25 bp, Mus musculus
tcgcgacaaacacgggcaaaggcac

SEQ ID NO: 254696 - DNA, 25 bp, Mus musculus
ggctcgcgacaaacacgggcaaagg

SEQ ID NO: 254697 - DNA, 25 bp, Mus musculus
atgtcgctctccaccggggctcgcg

SEQ ID NO: 254698 - DNA, 25 bp, Mus musculus
taaagcctggggtggaggcgactcc

SEQ ID NO: 254699 - DNA, 25 bp, Mus musculus
ccgcaaaactgtccgcagggaaaga

SEQ ID NO: 254700 - DNA, 25 bp, Mus musculus
cgcccgcaaaactgtccgcagggaa

SEQ ID NO: 254701 - DNA, 25 bp, Mus musculus
ggggctcgcgacaaacacgggcaaa

SEQ ID NO: 254702 - DNA, 25 bp, Mus musculus
gcgcctacacaagcagaagcctgtg

SEQ ID NO: 254703 - DNA, 25 bp, Mus musculus
aacgcgacgcgtcgacgtctcgcta

SEQ ID NO: 254704 - DNA, 25 bp, Mus musculus
agaggcgcccgcaaaggaacgcgac

SEQ ID NO: 254705 - DNA, 25 bp, Mus musculus
ccaaagtggcgacttcagggaggcc

SEQ ID NO: 254706 - DNA, 25 bp, Mus musculus
cataatgctggttcatgtgggcgca

SEQ ID NO: 254707 - DNA, 25 bp, Mus musculus
gtccacgaccatgtcggccataatg

SEQ ID NO: 254708 - DNA, 25 bp, Mus musculus
gatgtggtttctgcccttcttcttg

SEQ ID NO: 254709 - DNA, 25 bp, Mus musculus
aaagcgcttacctttcggggatgtg

SEQ ID NO: 254710 - DNA, 25 bp, Mus musculus
gccaagcccggaaccaaagcgctta

SEQ ID NO: 254711 - DNA, 25 bp, Mus musculus
ggccagggaacactcggagactcga

SEQ ID NO: 254712 - DNA, 25 bp, Mus musculus
gagtcctgtcgggacagacccaaga

SEQ ID NO: 254713 - DNA, 25 bp, Mus musculus
gcttcggagatcaagggacgcctca

SEQ ID NO: 254714 - DNA, 25 bp, Mus musculus
accgagtgaagggtgtcgacagctc

SEQ ID NO: 254715 - DNA, 25 bp, Mus musculus
aggcccgagctccacagagtcctgt

SEQ ID NO: 254716 - DNA, 25 bp, Mus musculus
ctgtgagtccaggaagcggatccca

SEQ ID NO: 254717 - DNA, 25 bp, Mus musculus
tgatgcctgctacaccgagaaggtg

SEQ ID NO: 254718 - DNA, 25 bp, Mus musculus
cggatctgtcacattgagctctgga

SEQ ID NO: 254719 - DNA, 25 bp, Mus musculus
ggccctttgtcatcacgcactgctg

SEQ ID NO: 254720 - DNA, 25 bp, Mus musculus
cactgctgggagctcacacttcttc

SEQ ID NO: 254721 - DNA, 25 bp, Mus musculus
ggctctggacttgactctgactgca

SEQ ID NO: 254722 - DNA, 25 bp, Mus musculus
tacacctgcggctctgcggatctgt

SEQ ID NO: 254723 - DNA, 25 bp, Mus musculus
cacgcagcggaagagctgtgagtcc

SEQ ID NO: 254724 - DNA, 25 bp, Mus musculus
tgcccagccttgctgggtgaatttg

SEQ ID NO: 254725 - DNA, 25 bp, Mus musculus
accgcagagtacgaggtagggcacc

SEQ ID NO: 254726 - DNA, 25 bp, Mus musculus
gccacagaatgacagcgagctcagc

SEQ ID NO: 254727 - DNA, 25 bp, Mus musculus
ctcagcttcagcctgggagtggctg

SEQ ID NO: 254728 - DNA, 25 bp, Mus musculus
catgggcattcagggtctgtgatgc

SEQ ID NO: 254729 - DNA, 25 bp, Mus musculus
atctagggcctttgtcccgagctgt

SEQ ID NO: 254730 - DNA, 25 bp, Mus musculus
gatctctgcgtttctcttgagtccg

SEQ ID NO: 254731 - DNA, 25 bp, Mus musculus
cactgcagggaggtgtctgaagcca

SEQ ID NO: 254732 - DNA, 25 bp, Mus musculus
accggacagcttcgctctgctagcg

SEQ ID NO: 254733 - DNA, 25 bp, Mus musculus
taggcaacacccgatgttcccgggc

SEQ ID NO: 254734 - DNA, 25 bp, Mus musculus
cagcaccctgcgctcggaagatggt

SEQ ID NO: 254735 - DNA, 25 bp, Mus musculus
tcttgagtccgcttgggagaacaga

SEQ ID NO: 254736 - DNA, 25 bp, Mus musculus
ctacagcctggacgcggctactacg

SEQ ID NO: 254737 - DNA, 25 bp, Mus musculus
agccaccgggagtcaccaagaactg

SEQ ID NO: 254738 - DNA, 25 bp, Mus musculus
gtgagatccggcctgaactttactc

SEQ ID NO: 254739 - DNA, 25 bp, Mus musculus
tgaactttactctgcgcgtcgtcgg

SEQ ID NO: 254740 - DNA, 25 bp, Mus musculus
gccgggcttcttcaaagccgcctaa

SEQ ID NO: 254741 - DNA, 25 bp, Mus musculus
gccgcctaagcgcaggttgtcccag

SEQ ID NO: 254742 - DNA, 25 bp, Mus musculus
atgcgttgcgcatccgtacccttag

SEQ ID NO: 254743 - DNA, 25 bp, Mus musculus
ctagcgctgggtatgtaggcaacac

SEQ ID NO: 254744 - DNA, 25 bp, Mus musculus
aatgttctccgaaggcgattggctc

SEQ ID NO: 254745 - DNA, 25 bp, Mus musculus
agacttctgtctcgctcgggctgcc

SEQ ID NO: 254746 - DNA, 25 bp, Mus musculus
agtcggccctatcgagacttctgtc

SEQ ID NO: 254747 - DNA, 25 bp, Mus musculus
ctgaagaagtgagtagagtcggccc

SEQ ID NO: 254748 - DNA, 25 bp, Mus musculus
gaggagtcgccatgagcaaagccca

SEQ ID NO: 254749 - DNA, 25 bp, Mus musculus
gccgagcccgcagaggagtcgccat

SEQ ID NO: 254750 - DNA, 25 bp, Mus musculus
caagcctgccttgcgcgcgtttctg

SEQ ID NO: 254751 - DNA, 25 bp, Mus musculus
cgtggctctggtccgcaggttcaga

SEQ ID NO: 254752 - DNA, 25 bp, Mus musculus
aaccggaagcgtggctctggtccgc

SEQ ID NO: 254753 - DNA, 25 bp, Mus musculus
tgtcactggcgacgcaaccggaagc

SEQ ID NO: 254754 - DNA, 25 bp, Mus musculus
ctccgtcgtggcctgtcactggcga

SEQ ID NO: 254755 - DNA, 25 bp, Mus musculus
tatcgcgagatgaaaggtaatgttc

SEQ ID NO: 254756 - DNA, 25 bp, Mus musculus
gcgcgcgtttctgagcctgctcact

SEQ ID NO: 254757 - DNA, 25 bp, Mus musculus
gtgacgtcagacaccagcgccaagc

SEQ ID NO: 254758 - DNA, 25 bp, Mus musculus
tgtcaggtcacccaacggaatgtcg

SEQ ID NO: 254759 - DNA, 25 bp, Mus musculus
aagttgtcctgttctcggctgagcc

SEQ ID NO: 254760 - DNA, 25 bp, Mus musculus
gtccctctaggagcgtggatgacgt

SEQ ID NO: 254761 - DNA, 25 bp, Mus musculus
agggcatgtccgtaggtccctctag

SEQ ID NO: 254762 - DNA, 25 bp, Mus musculus
gaaagttagtgcaaagtcgcgcggc

SEQ ID NO: 254763 - DNA, 25 bp, Mus musculus
cctgaggatcaacgacaacctgagc

SEQ ID NO: 254764 - DNA, 25 bp, Mus musculus
gtgctcttcctggtctacatcctga

SEQ ID NO: 254765 - DNA, 25 bp, Mus musculus
accgtgtggttcttcctcgtgctct

SEQ ID NO: 254766 - DNA, 25 bp, Mus musculus
tcgtggacctatctgtggaccgtgt

SEQ ID NO: 254767 - DNA, 25 bp, Mus musculus
tcaagtcctgcatcgtgtggtcgtg

SEQ ID NO: 254768 - DNA, 25 bp, Mus musculus
cgggcttcctggagcagctcaagtc

SEQ ID NO: 254769 - DNA, 25 bp, Mus musculus
ccgggctgtcctcctaaaatactag

SEQ ID NO: 254770 - DNA, 25 bp, Mus musculus
agctgttacgtcagtgggtccctcg

SEQ ID NO: 254771 - DNA, 25 bp, Mus musculus
ggaagcgctctacacccgcgagctg

SEQ ID NO: 254772 - DNA, 25 bp, Mus musculus
caggtcgtcctgatcaatcatgtcc

SEQ ID NO: 254773 - DNA, 25 bp, Mus musculus
tgccattgaggtaatagagccggtc

SEQ ID NO: 254774 - DNA, 25 bp, Mus musculus
ccgcaaactcgatgccattgaggta

SEQ ID NO: 254775 - DNA, 25 bp, Mus musculus
tgcagctggccgcaaactcgatgcc

SEQ ID NO: 254776 - DNA, 25 bp, Mus musculus
ttccatgcagctggccgcaaactcg

SEQ ID NO: 254777 - DNA, 25 bp, Mus musculus
tggcgctcatttccatgcagctggc

SEQ ID NO: 254778 - DNA, 25 bp, Mus musculus
cggcaatggcgctcatttccatgca

SEQ ID NO: 254779 - DNA, 25 bp, Mus musculus
gttgtagccggcaatggcgctcatt

SEQ ID NO: 254780 - DNA, 25 bp, Mus musculus
cctcattgccgttccagcggtggta

SEQ ID NO: 254781 - DNA, 25 bp, Mus musculus
gtcctgatcaatcatgtcctcattg

SEQ ID NO: 254782 - DNA, 25 bp, Mus musculus
aagcctttcatacaggtcgtcctga

SEQ ID NO: 254783 - DNA, 25 bp, Mus musculus
acagctccgtcttaagcctttcata

SEQ ID NO: 254784 - DNA, 25 bp, Mus musculus
agtgctcagttacagctccgtctta

SEQ ID NO: 254785 - DNA, 25 bp, Mus musculus
tcatgtcctcattgccgttccagcg

SEQ ID NO: 254786 - DNA, 25 bp, Mus musculus
acagacagacacgtagcagaaagtc

SEQ ID NO: 254787 - DNA, 25 bp, Mus musculus
ggggagagacacgactcgactctca

SEQ ID NO: 254788 - DNA, 25 bp, Mus musculus
gactcgactctcaggagcccacgta

SEQ ID NO: 254789 - DNA, 25 bp, Mus musculus
aggagcccacgtacctgaacctgga

SEQ ID NO: 254790 - DNA, 25 bp, Mus musculus
acctgaacctggaagcacagcagta

SEQ ID NO: 254791 - DNA, 25 bp, Mus musculus
cacagcagtagaaagtgtaaacacc

SEQ ID NO: 254792 - DNA, 25 bp, Mus musculus
aggaaggggcacagatagacagaca

SEQ ID NO: 254793 - DNA, 25 bp, Mus musculus
cacgtagcagaaagtcgggcggaca

SEQ ID NO: 254794 - DNA, 25 bp, Mus musculus
cggctcctagcccagcctgcacatg

SEQ ID NO: 254795 - DNA, 25 bp, Mus musculus
atctgcagtgcgaacgcgtcacggc

SEQ ID NO: 254796 - DNA, 25 bp, Mus musculus
ggctcatgtctcctcctctgtgtct

SEQ ID NO: 254797 - DNA, 25 bp, Mus musculus
cccgcgccggcacaatgaggatgcg

SEQ ID NO: 254798 - DNA, 25 bp, Mus musculus
tcagtccaggggcagcatgcacggc

SEQ ID NO: 254799 - DNA, 25 bp, Mus musculus
agtgtaaacacctgcgggagaaaga

SEQ ID NO: 254800 - DNA, 25 bp, Mus musculus
ctgctgacatttttgctgggccctc

SEQ ID NO: 254801 - DNA, 25 bp, Mus musculus
cgaccgtcgttacaagcaaacagtt

SEQ ID NO: 254802 - DNA, 25 bp, Mus musculus
acgagattcctagagttgcgaggca

SEQ ID NO: 254803 - DNA, 25 bp, Mus musculus
ggccctcagtttgacgccgccggaa

SEQ ID NO: 254804 - DNA, 25 bp, Mus musculus
gccgttcccggaagctgagcttagg

SEQ ID NO: 254805 - DNA, 25 bp, Mus musculus
gtggcccggactctgttatttgaca

SEQ ID NO: 254806 - DNA, 25 bp, Mus musculus
tagcgcctccacaggatcccttgtg

SEQ ID NO: 254807 - DNA, 25 bp, Mus musculus
aaaggtctgcgagctgtgacgtctc

SEQ ID NO: 254808 - DNA, 25 bp, Mus musculus
gcacgtgggctgatctgaccaataa

SEQ ID NO: 254809 - DNA, 25 bp, Mus musculus
gtctcgatccaaccagacagtttta

SEQ ID NO: 254810 - DNA, 25 bp, Mus musculus
tcctaaaatgggtaaatagcgcctc

SEQ ID NO: 254811 - DNA, 25 bp, Mus musculus
cccttgtgtgaatgcatgcactcga

SEQ ID NO: 254812 - DNA, 25 bp, Mus musculus
cagtgaccgggctgattctacaatc

SEQ ID NO: 254813 - DNA, 25 bp, Mus musculus
gcgagggtcgtcaccaacgagattc

SEQ ID NO: 254814 - DNA, 25 bp, Mus musculus
agccagaacagtgagcccaccaatg

SEQ ID NO: 254815 - DNA, 25 bp, Mus musculus
agtggcactcctccagactcggagc

SEQ ID NO: 254816 - DNA, 25 bp, Mus musculus
ccagccctgggaagaccgacctagg

SEQ ID NO: 254817 - DNA, 25 bp, Mus musculus
gaagaccgacctaggcatcgccgcg

SEQ ID NO: 254818 - DNA, 25 bp, Mus musculus
cacctaccgatcctgttcggcgggg

SEQ ID NO: 254819 - DNA, 25 bp, Mus musculus
agactgcccagaccacatagcagca

SEQ ID NO: 254820 - DNA, 25 bp, Mus musculus
gagcacacgaccacgcccactcgtc

SEQ ID NO: 254821 - DNA, 25 bp, Mus musculus
acagtgagcccaccaatgcagcggc

SEQ ID NO: 254822 - DNA, 25 bp, Mus musculus
agcccaccaatgcagcggcgaagcg

SEQ ID NO: 254823 - DNA, 25 bp, Mus musculus
agctgcagactgaccgcgggtccgc

SEQ ID NO: 254824 - DNA, 25 bp, Mus musculus
cagcagaccctgctctatgcgtctg

SEQ ID NO: 254825 - DNA, 25 bp, Mus musculus
ctagcacacgcctccagtggcactc

SEQ ID NO: 254826 - DNA, 25 bp, Mus musculus
ataccgagtccctggctagcacacg

SEQ ID NO: 254827 - DNA, 25 bp, Mus musculus
gctctatgcgtctgcgcgctttcgc

SEQ ID NO: 254828 - DNA, 25 bp, Mus musculus
tgcgcacgccaggatgcttagagcc

SEQ ID NO: 254829 - DNA, 25 bp, Mus musculus
tgcagcctattgttctccgtggacg

SEQ ID NO: 254830 - DNA, 25 bp, Mus musculus
actctgtgagtctggagcagcgttg

SEQ ID NO: 254831 - DNA, 25 bp, Mus musculus
ccatggaggacgagatgcccaagac

SEQ ID NO: 254832 - DNA, 25 bp, Mus musculus
gccatagcccgcctcaaggatttgg

SEQ ID NO: 254833 - DNA, 25 bp, Mus musculus
gaggccggctcttccgcagccatag

SEQ ID NO: 254834 - DNA, 25 bp, Mus musculus
ctgccaaagaagaaagcgaagtagc

SEQ ID NO: 254835 - DNA, 25 bp, Mus musculus
ttttttgtgtaatcgctgccaaaga

SEQ ID NO: 254836 - DNA, 25 bp, Mus musculus
gatcggggtttcattgttcgcggta

SEQ ID NO: 254837 - DNA, 25 bp, Mus musculus
cgccatcttggatcggggtttcatt

SEQ ID NO: 254838 - DNA, 25 bp, Mus musculus
agcatgctagctggctgtgcgcatg

SEQ ID NO: 254839 - DNA, 25 bp, Mus musculus
ctaaacccggctgccaggagggtga

SEQ ID NO: 254840 - DNA, 25 bp, Mus musculus
cgtccttgaagcctaaacccggctg

SEQ ID NO: 254841 - DNA, 25 bp, Mus musculus
agcgaagtagcctccggtcaagcga

SEQ ID NO: 254842 - DNA, 25 bp, Mus musculus
cgtcaccacgctgccgccgcacgtc

SEQ ID NO: 254843 - DNA, 25 bp, Mus musculus
accaccttcgcgtcctttctggaga

SEQ ID NO: 254844 - DNA, 25 bp, Mus musculus
cgctccggacacgtcaccaccttcg

SEQ ID NO: 254845 - DNA, 25 bp, Mus musculus
gctttgtgcacagccgcgctggcgc

SEQ ID NO: 254846 - DNA, 25 bp, Mus musculus
ttggtcacgcgctttgtgcacagcc

SEQ ID NO: 254847 - DNA, 25 bp, Mus musculus
gccgcacgtcgcttccagccacacc

SEQ ID NO: 254848 - DNA, 25 bp, Mus musculus
acgtggccccgcgaggtgacgtcac

SEQ ID NO: 254849 - DNA, 25 bp, Mus musculus
aagccggaacagcacgcggtcacgt

SEQ ID NO: 254850 - DNA, 25 bp, Mus musculus
gagaagccggaacagcacgcggtca

SEQ ID NO: 254851 - DNA, 25 bp, Mus musculus
ctgcccacaccggtagaggggagaa

SEQ ID NO: 254852 - DNA, 25 bp, Mus musculus
cgtttctgcccacaccggtagaggg

SEQ ID NO: 254853 - DNA, 25 bp, Mus musculus
acgtcaccggggttccctgcgagct

SEQ ID NO: 254854 - DNA, 25 bp, Mus musculus
ttcgcgtcctttctggagagcgcgg

SEQ ID NO: 254855 - DNA, 25 bp, Mus musculus
agccacaccgccactgttcttccgc

SEQ ID NO: 254856 - DNA, 25 bp, Mus musculus
ccaaggattcgatggcggagcgata

SEQ ID NO: 254857 - DNA, 25 bp, Mus musculus
tacttcctttccgtgcatcagcagc

SEQ ID NO: 254858 - DNA, 25 bp, Mus musculus
tcagcagccgaatggtgagagtcac

SEQ ID NO: 254859 - DNA, 25 bp, Mus musculus
tgagagtcacgttgagtccgctttc

SEQ ID NO: 254860 - DNA, 25 bp, Mus musculus
ctttcagtcacaccggcgtccatgg

SEQ ID NO: 254861 - DNA, 25 bp, Mus musculus
ttgggctcgttacgtggtcaagtcc

SEQ ID NO: 254862 - DNA, 25 bp, Mus musculus
ccggaagtgctttccgcgcaggacc

SEQ ID NO: 254863 - DNA, 25 bp, Mus musculus
ccggcttttttaggtcacaagactg

SEQ ID NO: 254864 - DNA, 25 bp, Mus musculus
gagagggagcacgtgttttgttaac

SEQ ID NO: 254865 - DNA, 25 bp, Mus musculus
tttgttaaccctagcggctccggca

SEQ ID NO: 254866 - DNA, 25 bp, Mus musculus
ctccggcaggggactgggaaaatat

SEQ ID NO: 254867 - DNA, 25 bp, Mus musculus
tgtgccggggacagataattgtttc

SEQ ID NO: 254868 - DNA, 25 bp, Mus musculus
ttcttcccgatgatgctgcctactt

SEQ ID NO: 254869 - DNA, 25 bp, Mus musculus
atatactggttttgtgccggggaca

SEQ ID NO: 254870 - DNA, 25 bp, Mus musculus
gctctccgggtattgggcaagtaca

SEQ ID NO: 254871 - DNA, 25 bp, Mus musculus
gcctcattggcctaatcctcggaaa

SEQ ID NO: 254872 - DNA, 25 bp, Mus musculus
gaaacctcccggctacgatgacgtc

SEQ ID NO: 254873 - DNA, 25 bp, Mus musculus
actcccgtgctgctgattggctaca

SEQ ID NO: 254874 - DNA, 25 bp, Mus musculus
ctccagcagcagctggatgttcatc

SEQ ID NO: 254875 - DNA, 25 bp, Mus musculus
ccattggctctacgccgatagccgg

SEQ ID NO: 254876 - DNA, 25 bp, Mus musculus
cggctacgatgacgtcacctctctg

SEQ ID NO: 254877 - DNA, 25 bp, Mus musculus
ctggatgttcatcccgacggctgtc

SEQ ID NO: 254878 - DNA, 25 bp, Mus musculus
gtgtggaaggttccagctgctcgcc

SEQ ID NO: 254879 - DNA, 25 bp, Mus musculus
aatgcctgctctttcctggcgtgga

SEQ ID NO: 254880 - DNA, 25 bp, Mus musculus
acagtatagggaatgccgctgcgcc

SEQ ID NO: 254881 - DNA, 25 bp, Mus musculus
ttctgagaacaatgcctgctctttc

SEQ ID NO: 254882 - DNA, 25 bp, Mus musculus
tctgtctgtcggagtccgggacacc

SEQ ID NO: 254883 - DNA, 25 bp, Mus musculus
accgccgagtgtttatcccgactcg

SEQ ID NO: 254884 - DNA, 25 bp, Mus musculus
ccggctggaaactagcagagcgcgt

SEQ ID NO: 254885 - DNA, 25 bp, Mus musculus
acttcgacccatcggagtcctcctc

SEQ ID NO: 254886 - DNA, 25 bp, Mus musculus
ttaaggtcgtgggtagcacctgaca

SEQ ID NO: 254887 - DNA, 25 bp, Mus musculus
agttgatttttgcaggccggctgga

SEQ ID NO: 254888 - DNA, 25 bp, Mus musculus
ccacaacttccggagcagctggaag

SEQ ID NO: 254889 - DNA, 25 bp, Mus musculus
caggccggctggaaactagcagagc

SEQ ID NO: 254890 - DNA, 25 bp, Mus musculus
gcggctacgacttcgacccatcgga

SEQ ID NO: 254891 - DNA, 25 bp, Mus musculus
ccctacgcggggagcggctacgact

SEQ ID NO: 254892 - DNA, 25 bp, Mus musculus
gccgtgagactttctggactcaccc

SEQ ID NO: 254893 - DNA, 25 bp, Mus musculus
cctagccgtgagactttctggactc

SEQ ID NO: 254894 - DNA, 25 bp, Mus musculus
ccgtccctagccgtgagactttctg

SEQ ID NO: 254895 - DNA, 25 bp, Mus musculus
tgacaccgtccctagccgtgagact

SEQ ID NO: 254896 - DNA, 25 bp, Mus musculus
gggtagcacctgacaccgtccctag

SEQ ID NO: 254897 - DNA, 25 bp, Mus musculus
ccggagcagctggaagttgattttt

SEQ ID NO: 254898 - DNA, 25 bp, Mus musculus
cgcaaggcgagcctccggaaaaggc

SEQ ID NO: 254899 - DNA, 25 bp, Mus musculus
tctcctgtcaaggacaccggggtca

SEQ ID NO: 254900 - DNA, 25 bp, Mus musculus
cggcgtgttcagcagcctctgctgc

SEQ ID NO: 254901 - DNA, 25 bp, Mus musculus
gtgacagtagcagaatgtgccgctg

SEQ ID NO: 254902 - DNA, 25 bp, Mus musculus
cggccgcccggacagtaacagaagc

SEQ ID NO: 254903 - DNA, 25 bp, Mus musculus
tcagcggaccggcttcgctagacct

SEQ ID NO: 254904 - DNA, 25 bp, Mus musculus
agcctgcgctgcaggttgcgcatgc

SEQ ID NO: 254905 - DNA, 25 bp, Mus musculus
ctgacttccgcggttccggcttcaa

SEQ ID NO: 254906 - DNA, 25 bp, Mus musculus
cgtgggcactgtgtgcttatgccta

SEQ ID NO: 254907 - DNA, 25 bp, Mus musculus
tgcttatgcctaacagatctcggga

SEQ ID NO: 254908 - DNA, 25 bp, Mus musculus
gtcgctggttcttcccgtaagcttc

SEQ ID NO: 254909 - DNA, 25 bp, Mus musculus
acctaggtctgtctgcaaacgccca

SEQ ID NO: 254910 - DNA, 25 bp, Mus musculus
gatctcgggatctctgtcgctggtt

SEQ ID NO: 254911 - DNA, 25 bp, Mus musculus
cgttccgtacctgcgcggcgtgttc

SEQ ID NO: 254912 - DNA, 25 bp, Mus musculus
acagtctattcctgcaggcgccgtc

SEQ ID NO: 254913 - DNA, 25 bp, Mus musculus
ccgcgcgattgacagtctattcctg

SEQ ID NO: 254914 - DNA, 25 bp, Mus musculus
ctctgtcatcgcaggtttaaactta

SEQ ID NO: 254915 - DNA, 25 bp, Mus musculus
ctctggagtgtgttactgattcatc

SEQ ID NO: 254916 - DNA, 25 bp, Mus musculus
acccggcagttaggctctggagtgt

SEQ ID NO: 254917 - DNA, 25 bp, Mus musculus
tgctttccctaggacccggcagtta

SEQ ID NO: 254918 - DNA, 25 bp, Mus musculus
atgacggcctgtgctttccctagga

SEQ ID NO: 254919 - DNA, 25 bp, Mus musculus
agcgtttcctctggatgacggcctg

SEQ ID NO: 254920 - DNA, 25 bp, Mus musculus
tgcacgcagcgtttcctctggatga

SEQ ID NO: 254921 - DNA, 25 bp, Mus musculus
tcccgaagaaaatgcacgcagcgtt

SEQ ID NO: 254922 - DNA, 25 bp, Mus musculus
agcgccgcctccttcgtgtcgcagg

SEQ ID NO: 254923 - DNA, 25 bp, Mus musculus
gacccgccgcgcgattgacagtcta

SEQ ID NO: 254924 - DNA, 25 bp, Mus musculus
cagggctttcccgaagaaaatgcac

SEQ ID NO: 254925 - DNA, 25 bp, Mus musculus
ctctgcctctgtcatcgcaggttta

SEQ ID NO: 254926 - DNA, 25 bp, Mus musculus
tctttgcggccctagagttaatccc

SEQ ID NO: 254927 - DNA, 25 bp, Mus musculus
ccgccgccaatgtgttaggacttca

SEQ ID NO: 254928 - DNA, 25 bp, Mus musculus
ttggcaccaggctagactgcgacct

SEQ ID NO: 254929 - DNA, 25 bp, Mus musculus
ttaggacttcaggtgcttcttggca

SEQ ID NO: 254930 - DNA, 25 bp, Mus musculus
atcctctgcgggatctattgtttcc

SEQ ID NO: 254931 - DNA, 25 bp, Mus musculus
acagaccgggatccgcctggcagcg

SEQ ID NO: 254932 - DNA, 25 bp, Mus musculus
gtgattgtcaccctagcctttgctc

SEQ ID NO: 254933 - DNA, 25 bp, Mus musculus
agcagaggcattcgtgtgattgtca

SEQ ID NO: 254934 - DNA, 25 bp, Mus musculus
ccggcacactgggaggaaaagcaga

SEQ ID NO: 254935 - DNA, 25 bp, Mus musculus
agagcgccgaaggagtccgacctcc

SEQ ID NO: 254936 - DNA, 25 bp, Mus musculus
gagttaatcccatcagccgaggtga

SEQ ID NO: 254937 - DNA, 25 bp, Mus musculus
tccctctcctgggatttcgctgctg

SEQ ID NO: 254938 - DNA, 25 bp, Mus musculus
tttcgcccttcgttggccgccagag

SEQ ID NO: 254939 - DNA, 25 bp, Mus musculus
gcggcctgatccctaagtccatcgg

SEQ ID NO: 254940 - DNA, 25 bp, Mus musculus
tcctaacacccgaggctacaggctg

SEQ ID NO: 254941 - DNA, 25 bp, Mus musculus
cctgccgtggctcaacacaagagga

SEQ ID NO: 254942 - DNA, 25 bp, Mus musculus
ttcgtgcacaggagaaacgcctctc

SEQ ID NO: 254943 - DNA, 25 bp, Mus musculus
tcaagttcgcgccacaggcaaggtc

SEQ ID NO: 254944 - DNA, 25 bp, Mus musculus
tttcctagtgttcaggccgctgctt

SEQ ID NO: 254945 - DNA, 25 bp, Mus musculus
atccatcgagtcttccatgaggtgg

SEQ ID NO: 254946 - DNA, 25 bp, Mus musculus
tgttccacagaacagacgcgcagga

SEQ ID NO: 254947 - DNA, 25 bp, Mus musculus
cgggctctccgcacgtatatatggt

SEQ ID NO: 254948 - DNA, 25 bp, Mus musculus
tatatatggtcgcaggagatctcgc

SEQ ID NO: 254949 - DNA, 25 bp, Mus musculus
ctcgcgagatctgcgctagtcctgc

SEQ ID NO: 254950 - DNA, 25 bp, Mus musculus
aagcgcaggcgcgttttctctttgt

SEQ ID NO: 254951 - DNA, 25 bp, Mus musculus
tcgctctgggttttcagggcttcca

SEQ ID NO: 254952 - DNA, 25 bp, Mus musculus
ctcggtcgccacagaatacaagatg

SEQ ID NO: 254953 - DNA, 25 bp, Mus musculus
cttctaaggcctgggagattcctcc

SEQ ID NO: 254954 - DNA, 25 bp, Mus musculus
tgaggtggaaaatggcgcccacgca

SEQ ID NO: 254955 - DNA, 25 bp, Mus musculus
cctgcccagtctgctgtggtgctgc

SEQ ID NO: 254956 - DNA, 25 bp, Mus musculus
tcaggccaaagcagtcctgcccagt

SEQ ID NO: 254957 - DNA, 25 bp, Mus musculus
gcaaggtcaggccaaagcagtcctg

SEQ ID NO: 254958 - DNA, 25 bp, Mus musculus
ccgactagcccgagggtgcaagcaa

SEQ ID NO: 254959 - DNA, 25 bp, Mus musculus
cggctccgactagcccgagggtgca

SEQ ID NO: 254960 - DNA, 25 bp, Mus musculus
actgcacctgtgctgaggtggaaaa

SEQ ID NO: 254961 - DNA, 25 bp, Mus musculus
gaggaaccgactgcacctgtgctga

SEQ ID NO: 254962 - DNA, 25 bp, Mus musculus
ggcctgtgaggaaccgactgcacct

SEQ ID NO: 254963 - DNA, 25 bp, Mus musculus
ccagccgtgttagagaaaccgggcg

SEQ ID NO: 254964 - DNA, 25 bp, Mus musculus
cggagccagccgtgttagagaaacc

SEQ ID NO: 254965 - DNA, 25 bp, Mus musculus
aaaaagcaatcgagacgacttacgg

SEQ ID NO: 254966 - DNA, 25 bp, Mus musculus
atcgagacgacttacggagccagcc

SEQ ID NO: 254967 - DNA, 25 bp, Mus musculus
acgacttacggagccagccgtgtta

SEQ ID NO: 254968 - DNA, 25 bp, Mus musculus
tgtcctgtcgttccctttccaggga

SEQ ID NO: 254969 - DNA, 25 bp, Mus musculus
ttgtgtcgtgtcctgtcgttccctt

SEQ ID NO: 254970 - DNA, 25 bp, Mus musculus
aagtccaccgcccaggcttgtgcga

SEQ ID NO: 254971 - DNA, 25 bp, Mus musculus
agtgagtgactcgaggaagtccacc

SEQ ID NO: 254972 - DNA, 25 bp, Mus musculus
gccctctctgcagggcctgagtctg

SEQ ID NO: 254973 - DNA, 25 bp, Mus musculus
cctgagtctgcgtaggacttggaga

SEQ ID NO: 254974 - DNA, 25 bp, Mus musculus
cgcaagcgcactggcactgaagtga

SEQ ID NO: 254975 - DNA, 25 bp, Mus musculus
ttggctccctggctagcagatccct

SEQ ID NO: 254976 - DNA, 25 bp, Mus musculus
tagcagatccctgtcgctgccttct

SEQ ID NO: 254977 - DNA, 25 bp, Mus musculus
tctgagggacccttgtcctggctcc

SEQ ID NO: 254978 - DNA, 25 bp, Mus musculus
caccttccacggatgtcccttgtaa

SEQ ID NO: 254979 - DNA, 25 bp, Mus musculus
gatgtcccttgtaaatcccacggga

SEQ ID NO: 254980 - DNA, 25 bp, Mus musculus
tcccacgggaatgtggctccgaagg

SEQ ID NO: 254981 - DNA, 25 bp, Mus musculus
ctttccagggagatcacggctcgga

SEQ ID NO: 254982 - DNA, 25 bp, Mus musculus
ctgagctgtcgcatcccagagtcct

SEQ ID NO: 254983 - DNA, 25 bp, Mus musculus
cggagagttcattcgcgacaagagc

SEQ ID NO: 254984 - DNA, 25 bp, Mus musculus
gggactactgactagtggtacctta

SEQ ID NO: 254985 - DNA, 25 bp, Mus musculus
cgctaactcctcttttctcaacgga

SEQ ID NO: 254986 - DNA, 25 bp, Mus musculus
cagaggtggacagcgcgtgtcaaca

SEQ ID NO: 254987 - DNA, 25 bp, Mus musculus
tcgcccgtgaccaacatcatgtgcg

SEQ ID NO: 254988 - DNA, 25 bp, Mus musculus
cctaaagcggatgctggtcgagccc

SEQ ID NO: 254989 - DNA, 25 bp, Mus musculus
cggctccaggaacctaaagcggatg

SEQ ID NO: 254990 - DNA, 25 bp, Mus musculus
tggtaccttaggcagagaacagtga

SEQ ID NO: 254991 - DNA, 25 bp, Mus musculus
cagctcaggtcgtcaccggaatggc

SEQ ID NO: 254992 - DNA, 25 bp, Mus musculus
ctgctgtgtaaacattcccttcctc

SEQ ID NO: 254993 - DNA, 25 bp, Mus musculus
agcgatcccgagtacaacgtgccca

SEQ ID NO: 254994 - DNA, 25 bp, Mus musculus
acatcatgtgcggtaagggcagcga

SEQ ID NO: 254995 - DNA, 25 bp, Mus musculus
tggctctgcacactgacacgtctgt

SEQ ID NO: 254996 - DNA, 25 bp, Mus musculus
tcgaatcctccgtagcaagctggtc

SEQ ID NO: 254997 - DNA, 25 bp, Mus musculus
tcaaggatttcgctttggtttccgc

SEQ ID NO: 254998 - DNA, 25 bp, Mus musculus
ttgcagtcgaagcagttccgtcccg

SEQ ID NO: 254999 - DNA, 25 bp, Mus musculus
acacgagcacgagtgcagccacgca

SEQ ID NO: 255000 - DNA, 25 bp, Mus musculus
ccaggcacttacttgtccaggatga

SEQ ID NO: 255001 - DNA, 25 bp, Mus musculus
tttggtttccgctggttctgagccc

SEQ ID NO: 255002 - DNA, 25 bp, Mus musculus
agcaaacgcccggaagcaattgttc

SEQ ID NO: 255003 - DNA, 25 bp, Mus musculus
tcccaggctgcgcttgaagctttgc

SEQ ID NO: 255004 - DNA, 25 bp, Mus musculus
cgtgtgacatcaggggcgcgccata

SEQ ID NO: 255005 - DNA, 25 bp, Mus musculus
tccaggatgaagtagaggtcgaatc

SEQ ID NO: 255006 - DNA, 25 bp, Mus musculus
tgcgcttgaagctttgcagtcgaag

SEQ ID NO: 255007 - DNA, 25 bp, Mus musculus
cgtgtccggcgcacacgagcacgag

SEQ ID NO: 255008 - DNA, 25 bp, Mus musculus
cctcgctggcgtccgtgtgacatca

SEQ ID NO: 255009 - DNA, 25 bp, Mus musculus
ttgttcagagaagttcaaggatttc

SEQ ID NO: 255010 - DNA, 25 bp, Mus musculus
cttctgagggtctttccgtgctcga

SEQ ID NO: 255011 - DNA, 25 bp, Mus musculus
agcagaggctaaggccagccagccc

SEQ ID NO: 255012 - DNA, 25 bp, Mus musculus
ttctcagagcgtctccggggctgtc

SEQ ID NO: 255013 - DNA, 25 bp, Mus musculus
gctgtcggtacctgcgaaccagagc

SEQ ID NO: 255014 - DNA, 25 bp, Mus musculus
acacgtggttctcagagcgtctccg

SEQ ID NO: 255015 - DNA, 25 bp, Mus musculus
cctgcgaaccagagcgaggatctca

SEQ ID NO: 255016 - DNA, 25 bp, Mus musculus
ggatctcagacgctcctccggagct

SEQ ID NO: 255017 - DNA, 25 bp, Mus musculus
ggctaggagcacctctgtcttctga

SEQ ID NO: 255018 - DNA, 25 bp, Mus musculus
ggacggacacactgagcagaggcta

SEQ ID NO: 255019 - DNA, 25 bp, Mus musculus
ctcctactacttcggcggacggaca

SEQ ID NO: 255020 - DNA, 25 bp, Mus musculus
gtctttccgtgctcgagtggcagct

SEQ ID NO: 255021 - DNA, 25 bp, Mus musculus
caccctctacacgtggttctcagag

SEQ ID NO: 255022 - DNA, 25 bp, Mus musculus
agctctgcagcaagggctaggagca

SEQ ID NO: 255023 - DNA, 25 bp, Mus musculus
gtggcagctggcctcctactacttc

SEQ ID NO: 255024 - DNA, 25 bp, Mus musculus
agacggccacggaggacgcaaactc

SEQ ID NO: 255025 - DNA, 25 bp, Mus musculus
cacgaacccggctgctgggatgatc

SEQ ID NO: 255026 - DNA, 25 bp, Mus musculus
tgcaggaggttttccaccacttgga

SEQ ID NO: 255027 - DNA, 25 bp, Mus musculus
ctggctaccggtctggatcagtatc

SEQ ID NO: 255028 - DNA, 25 bp, Mus musculus
aatgagatcgtggtgctggctaccg

SEQ ID NO: 255029 - DNA, 25 bp, Mus musculus
tgagtgccttggctcaccactacgg

SEQ ID NO: 255030 - DNA, 25 bp, Mus musculus
tctgccgagagaaaccgccagggtt

SEQ ID NO: 255031 - DNA, 25 bp, Mus musculus
tgcctggatacggtcccgtgcctct

SEQ ID NO: 255032 - DNA, 25 bp, Mus musculus
cacagtccacgcagctgcctggata

SEQ ID NO: 255033 - DNA, 25 bp, Mus musculus
tcccatcgggacaaacacagacgtc

SEQ ID NO: 255034 - DNA, 25 bp, Mus musculus
ccgcggagctcttagcgagcacatc

SEQ ID NO: 255035 - DNA, 25 bp, Mus musculus
tagcgagcacatcgagacacagatc

SEQ ID NO: 255036 - DNA, 25 bp, Mus musculus
gcacatctagaggaggaaaacagta

SEQ ID NO: 255037 - DNA, 25 bp, Mus musculus
gctatttcagtagccgagcggggcc

SEQ ID NO: 255038 - DNA, 25 bp, Mus musculus
ggaaaagccagtcggacatcccaga

SEQ ID NO: 255039 - DNA, 25 bp, Mus musculus
tcggcctctggaaaagccagtcgga

SEQ ID NO: 255040 - DNA, 25 bp, Mus musculus
ccagtcggacatcccagaagcggcg

SEQ ID NO: 255041 - DNA, 25 bp, Mus musculus
caggcggtgcgacgcagcttgcacc

SEQ ID NO: 255042 - DNA, 25 bp, Mus musculus
tgcgacgcagcttgcaccgagtgcg

SEQ ID NO: 255043 - DNA, 25 bp, Mus musculus
gcttgcagcgccaggtgcagcgact

SEQ ID NO: 255044 - DNA, 25 bp, Mus musculus
tgcagcgactggaggcagagcttag

SEQ ID NO: 255045 - DNA, 25 bp, Mus musculus
tgtttcccaaacctaggcgagcatc

SEQ ID NO: 255046 - DNA, 25 bp, Mus musculus
agcatccacgctacgcactctaatg

SEQ ID NO: 255047 - DNA, 25 bp, Mus musculus
gttcattccggtcttcagctattcg

SEQ ID NO: 255048 - DNA, 25 bp, Mus musculus
cagagcttagaggttacaggtgagc

SEQ ID NO: 255049 - DNA, 25 bp, Mus musculus
gctacgcactctaatgttcattccg

SEQ ID NO: 255050 - DNA, 25 bp, Mus musculus
gacaggtcggcctctggaaaagcca

SEQ ID NO: 255051 - DNA, 25 bp, Mus musculus
caaacctaggcgagcatccacgcta

SEQ ID NO: 255052 - DNA, 25 bp, Mus musculus
ctccagcgtcttcatggtgaagtcg

SEQ ID NO: 255053 - DNA, 25 bp, Mus musculus
tcccagagcccaaggtggtgctttc

SEQ ID NO: 255054 - DNA, 25 bp, Mus musculus
aggcccaagcccgttctgaaagaag

SEQ ID NO: 255055 - DNA, 25 bp, Mus musculus
gtcgacaccgatggtgctgccctga

SEQ ID NO: 255056 - DNA, 25 bp, Mus musculus
gaagcgctgcaccacgcacgtcttg

SEQ ID NO: 255057 - DNA, 25 bp, Mus musculus
gcccactaacaccagcttgaacagg

SEQ ID NO: 255058 - DNA, 25 bp, Mus musculus
atcgtagtgttcgtcctgatctccc

SEQ ID NO: 255059 - DNA, 25 bp, Mus musculus
agcaccgttctttctcacttctcag

SEQ ID NO: 255060 - DNA, 25 bp, Mus musculus
tcagcacttcactaacccggactta

SEQ ID NO: 255061 - DNA, 25 bp, Mus musculus
acttaagcccggtgcggattcgctg

SEQ ID NO: 255062 - DNA, 25 bp, Mus musculus
ggattcgctgtcaacaacgccttga

SEQ ID NO: 255063 - DNA, 25 bp, Mus musculus
aacgccttgatcctctatttggtcc

SEQ ID NO: 255064 - DNA, 25 bp, Mus musculus
cacctgaacgagctgcacggcggac

SEQ ID NO: 255065 - DNA, 25 bp, Mus musculus
ctttcggacctgaacccagcacgga

SEQ ID NO: 255066 - DNA, 25 bp, Mus musculus
ggaacggaaaacagcggacagtctg

SEQ ID NO: 255067 - DNA, 25 bp, Mus musculus
tcgtttggtttcgttctgctggtaa

SEQ ID NO: 255068 - DNA, 25 bp, Mus musculus
ctgctggtaactgcggtcaaagatt

SEQ ID NO: 255069 - DNA, 25 bp, Mus musculus
tggcgccgctctgcaacgcaacgtg

SEQ ID NO: 255070 - DNA, 25 bp, Mus musculus
tcaggcgcccggaacaaggcaggca

SEQ ID NO: 255071 - DNA, 25 bp, Mus musculus
cagcggacagtctggtctttttgtc

SEQ ID NO: 255072 - DNA, 25 bp, Mus musculus
gtctggtctttttgtcggaagacta

SEQ ID NO: 255073 - DNA, 25 bp, Mus musculus
gccgacgcgtgtccagtgcgtcatc

SEQ ID NO: 255074 - DNA, 25 bp, Mus musculus
gtcatcccgcgcctaagtcagcaag

SEQ ID NO: 255075 - DNA, 25 bp, Mus musculus
gcctaagtcagcaagactacgcttg

SEQ ID NO: 255076 - DNA, 25 bp, Mus musculus
gcaagactacgcttgcgcggcagga

SEQ ID NO: 255077 - DNA, 25 bp, Mus musculus
cgcggcaggaatgtgtgcgtcattt

SEQ ID NO: 255078 - DNA, 25 bp, Mus musculus
tgtgcgtcatttgtcgtttggtttc

SEQ ID NO: 255079 - DNA, 25 bp, Mus musculus
acgcaacgtgctcaggcgcccggaa

SEQ ID NO: 255080 - DNA, 25 bp, Mus musculus
tcgtccctcgaacctttgctggttc

SEQ ID NO: 255081 - DNA, 25 bp, Mus musculus
ggcttcgtcacaggccaggtcctga

SEQ ID NO: 255082 - DNA, 25 bp, Mus musculus
ctgagctgcccacagcggaggagac

SEQ ID NO: 255083 - DNA, 25 bp, Mus musculus
ggacgaagaaccaagaaggcgactc

SEQ ID NO: 255084 - DNA, 25 bp, Mus musculus
cgactcgcaaagcagcggctgttta

SEQ ID NO: 255085 - DNA, 25 bp, Mus musculus
cagcggctgtttattttcagggtcc

SEQ ID NO: 255086 - DNA, 25 bp, Mus musculus
tttcagggtccttgcctgcgccaca

SEQ ID NO: 255087 - DNA, 25 bp, Mus musculus
cacggatccaatcagcgcaggaagc

SEQ ID NO: 255088 - DNA, 25 bp, Mus musculus
gccaatcagaatcgcccgctgggag

SEQ ID NO: 255089 - DNA, 25 bp, Mus musculus
tacctgggttccgtgtctacgatga

SEQ ID NO: 255090 - DNA, 25 bp, Mus musculus
cgatgagtggttcgctgctttccta

SEQ ID NO: 255091 - DNA, 25 bp, Mus musculus
ctcgtcgccacacggatgaggcctg

SEQ ID NO: 255092 - DNA, 25 bp, Mus musculus
ttctctccagcctacggggctgatc

SEQ ID NO: 255093 - DNA, 25 bp, Mus musculus
tttcctactagcagttcgtccctcg

SEQ ID NO: 255094 - DNA, 25 bp, Mus musculus
gcactatcttgaagccctctctaga

SEQ ID NO: 255095 - DNA, 25 bp, Mus musculus
gcaccaccagctgggcgacacttga

SEQ ID NO: 255096 - DNA, 25 bp, Mus musculus
catagagcttcttcgtcgtttacgg

SEQ ID NO: 255097 - DNA, 25 bp, Mus musculus
gagagaggaccctaaaacagccctg

SEQ ID NO: 255098 - DNA, 25 bp, Mus musculus
aacagccctggccatcaatccgaaa

SEQ ID NO: 255099 - DNA, 25 bp, Mus musculus
atccgaaatccgagtgggtgggcta

SEQ ID NO: 255100 - DNA, 25 bp, Mus musculus
caaaacactggcgagatgggcctga

SEQ ID NO: 255101 - DNA, 25 bp, Mus musculus
accgccacttggtcctccgattttg

SEQ ID NO: 255102 - DNA, 25 bp, Mus musculus
cgcgtccgtcattttgagggacttt

SEQ ID NO: 255103 - DNA, 25 bp, Mus musculus
ccgaggccaggtacttttggcgatg

SEQ ID NO: 255104 - DNA, 25 bp, Mus musculus
gctcacagatctgcacccgggaaaa

SEQ ID NO: 255105 - DNA, 25 bp, Mus musculus
ccgccgctgcagagacacatgaggc

SEQ ID NO: 255106 - DNA, 25 bp, Mus musculus
cggggtgtctaccaggcactatctt

SEQ ID NO: 255107 - DNA, 25 bp, Mus musculus
tgggacacagtgctccgctatttcg

SEQ ID NO: 255108 - DNA, 25 bp, Mus musculus
actttctctaggtctgagcggcagc

SEQ ID NO: 255109 - DNA, 25 bp, Mus musculus
agcctccgcggaagatgtggcttcg

SEQ ID NO: 255110 - DNA, 25 bp, Mus musculus
tggctgacctaacggagcctccgcg

SEQ ID NO: 255111 - DNA, 25 bp, Mus musculus
tgcgcctatcaggatcggcagggcc

SEQ ID NO: 255112 - DNA, 25 bp, Mus musculus
ctgctgcgtccgtgggaaacaacct

SEQ ID NO: 255113 - DNA, 25 bp, Mus musculus
cagtggccgggactggctgacctaa

SEQ ID NO: 255114 - DNA, 25 bp, Mus musculus
aggagcggctttctttctcgcccgc

SEQ ID NO: 255115 - DNA, 25 bp, Mus musculus
gctggcgtcaaagccgagcgctctc

SEQ ID NO: 255116 - DNA, 25 bp, Mus musculus
gcccgcgagtgtcgctggcgtcaaa

SEQ ID NO: 255117 - DNA, 25 bp, Mus musculus
aggaccgcccacgttccgagctgga

SEQ ID NO: 255118 - DNA, 25 bp, Mus musculus
acgggcgtctcttaggcggacgcta

SEQ ID NO: 255119 - DNA, 25 bp, Mus musculus
ctgtcacttgcccagagaggttctc

SEQ ID NO: 255120 - DNA, 25 bp, Mus musculus
tcaccagggcctgcgcctatcagga

SEQ ID NO: 255121 - DNA, 25 bp, Mus musculus
gcgaacgtcctgtcacttgcccaga

SEQ ID NO: 255122 - DNA, 25 bp, Mus musculus
ggccgcctcgcccacagccaattcc

SEQ ID NO: 255123 - DNA, 25 bp, Mus musculus
cccttgcgtctacatcaggtcagac

SEQ ID NO: 255124 - DNA, 25 bp, Mus musculus
catcaggtcagactccgtgtgcggg

SEQ ID NO: 255125 - DNA, 25 bp, Mus musculus
catgcgtgcccggagcagaagcgct

SEQ ID NO: 255126 - DNA, 25 bp, Mus musculus
tgcccggagcagaagcgctcagctc

SEQ ID NO: 255127 - DNA, 25 bp, Mus musculus
cctccaggcgcagctaaagaagggg

SEQ ID NO: 255128 - DNA, 25 bp, Mus musculus
ctcccgcgcaccctgtcctttccgt

SEQ ID NO: 255129 - DNA, 25 bp, Mus musculus
cccaagcactgcgagcgcaggcagc

SEQ ID NO: 255130 - DNA, 25 bp, Mus musculus
cccagcgagcgataaagggcagccc

SEQ ID NO: 255131 - DNA, 25 bp, Mus musculus
aagacgagcccagcgagcgataaag

SEQ ID NO: 255132 - DNA, 25 bp, Mus musculus
taaagtttcaaaagacgagcccagc

SEQ ID NO: 255133 - DNA, 25 bp, Mus musculus
ggtgagactcactgataaagtttca

SEQ ID NO: 255134 - DNA, 25 bp, Mus musculus
ggctagtggtgagactcactgataa

SEQ ID NO: 255135 - DNA, 25 bp, Mus musculus
ccgagctctgcttgcctcccgcgca

SEQ ID NO: 255136 - DNA, 25 bp, Mus musculus
ggtgcccttcacctgcagtagcgta

SEQ ID NO: 255137 - DNA, 25 bp, Mus musculus
gttcttccttctcttgggctgcgtg

SEQ ID NO: 255138 - DNA, 25 bp, Mus musculus
ggctggttcttcttgcggttcttcc

SEQ ID NO: 255139 - DNA, 25 bp, Mus musculus
accaccagctggctgtacttgcctg

SEQ ID NO: 255140 - DNA, 25 bp, Mus musculus
agcttgcggatggtctccaccacca

SEQ ID NO: 255141 - DNA, 25 bp, Mus musculus
cctcagcgtagatgcgcgccagaga

SEQ ID NO: 255142 - DNA, 25 bp, Mus musculus
agtagcgtatcgttctgcaccagcg

SEQ ID NO: 255143 - DNA, 25 bp, Mus musculus
tcagcttgaaggatccgttggcgcc

SEQ ID NO: 255144 - DNA, 25 bp, Mus musculus
ctccagcttcttgcggttcagcttg

SEQ ID NO: 255145 - DNA, 25 bp, Mus musculus
cttcactttcttcgcgctggcagca

SEQ ID NO: 255146 - DNA, 25 bp, Mus musculus
tcgccagaccgtaggggcgtcactt

SEQ ID NO: 255147 - DNA, 25 bp, Mus musculus
accagcgcccggatagagtacttga

SEQ ID NO: 255148 - DNA, 25 bp, Mus musculus
cgcccgttctgctggtcgaaccatg

SEQ ID NO: 255149 - DNA, 25 bp, Mus musculus
tggtcgaaccatgccaccttcctgg

SEQ ID NO: 255150 - DNA, 25 bp, Mus musculus
ttcccacccagcaggttgccggtgg

SEQ ID NO: 255151 - DNA, 25 bp, Mus musculus
ctccaccttgcgtcacgttccggtc

SEQ ID NO: 255152 - DNA, 25 bp, Mus musculus
cacgagacgcccgacgccagggttg

SEQ ID NO: 255153 - DNA, 25 bp, Mus musculus
agtgtctgtcacgagacgcccgacg

SEQ ID NO: 255154 - DNA, 25 bp, Mus musculus
cccgagcggaagtgtctgtcacgag

SEQ ID NO: 255155 - DNA, 25 bp, Mus musculus
gccttgcttccacttccgccaccgc

SEQ ID NO: 255156 - DNA, 25 bp, Mus musculus
atggtcaaagctccggccttgcttc

SEQ ID NO: 255157 - DNA, 25 bp, Mus musculus
tttatggtcaaagctccggccttgc

SEQ ID NO: 255158 - DNA, 25 bp, Mus musculus
cgccgccttgggctttatggtcaaa

SEQ ID NO: 255159 - DNA, 25 bp, Mus musculus
ggctccagcaggctcctcggagctg

SEQ ID NO: 255160 - DNA, 25 bp, Mus musculus
gagacgtccgattccggctccagca

SEQ ID NO: 255161 - DNA, 25 bp, Mus musculus
aggccgcaacagagacgtccgattc

SEQ ID NO: 255162 - DNA, 25 bp, Mus musculus
ggaggagacacaacgcaggccgcaa

SEQ ID NO: 255163 - DNA, 25 bp, Mus musculus
tgctcaccgcagggtcaacggagga

SEQ ID NO: 255164 - DNA, 25 bp, Mus musculus
tctgaccgggcccagccatcttgtg

SEQ ID NO: 255165 - DNA, 25 bp, Mus musculus
ctgagcagccacctagccaaggtga

SEQ ID NO: 255166 - DNA, 25 bp, Mus musculus
cagctctttcgttctggccctggag

SEQ ID NO: 255167 - DNA, 25 bp, Mus musculus
agccagaactggagtcgcggcttgc

SEQ ID NO: 255168 - DNA, 25 bp, Mus musculus
cttgcgcacctaggcgtgcaggtga

SEQ ID NO: 255169 - DNA, 25 bp, Mus musculus
acctcacgcgggatgcctgaggcga

SEQ ID NO: 255170 - DNA, 25 bp, Mus musculus
ggcgttagggatcctccaggtgtct

SEQ ID NO: 255171 - DNA, 25 bp, Mus musculus
catcttgtggtgctgttggccaatc

SEQ ID NO: 255172 - DNA, 25 bp, Mus musculus
ccaggtgtctggttgtctgaaaggc

SEQ ID NO: 255173 - DNA, 25 bp, Mus musculus
agtacgcctgcactttaagattttc

SEQ ID NO: 255174 - DNA, 25 bp, Mus musculus
tctcggacacgtcagcacaagcttc

SEQ ID NO: 255175 - DNA, 25 bp, Mus musculus
cacaagcttccgagcgtggggcacc

SEQ ID NO: 255176 - DNA, 25 bp, Mus musculus
ctcagctcgcggtcatggagtcgcc

SEQ ID NO: 255177 - DNA, 25 bp, Mus musculus
ccgctggtcaacgaggacgtgaagc

SEQ ID NO: 255178 - DNA, 25 bp, Mus musculus
cgggcctggaaaaatacagcctttg

SEQ ID NO: 255179 - DNA, 25 bp, Mus musculus
tgcgtgttccaaaggcctgagtccc

SEQ ID NO: 255180 - DNA, 25 bp, Mus musculus
gccaatgtccaacccagagtctgca

SEQ ID NO: 255181 - DNA, 25 bp, Mus musculus
cacacctagtcgttctgggtccaca

SEQ ID NO: 255182 - DNA, 25 bp, Mus musculus
ccagcagctttaggaagacaccttg

SEQ ID NO: 255183 - DNA, 25 bp, Mus musculus
acatacttggagtggcttcgaaccc

SEQ ID NO: 255184 - DNA, 25 bp, Mus musculus
ggctaggtacttgtaggccctcaaa

SEQ ID NO: 255185 - DNA, 25 bp, Mus musculus
ggccctcaaagtaaattgtctcgtg

SEQ ID NO: 255186 - DNA, 25 bp, Mus musculus
tcaccatgcatgtgcgcagggtctc

SEQ ID NO: 255187 - DNA, 25 bp, Mus musculus
gcagggtctcgcacacgtgaacttt

SEQ ID NO: 255188 - DNA, 25 bp, Mus musculus
cgtgaactttctcgaggcacactta

SEQ ID NO: 255189 - DNA, 25 bp, Mus musculus
atctgtggtggtaaatgctgcattc

SEQ ID NO: 255190 - DNA, 25 bp, Mus musculus
cgctgtataatagactccggggaga

SEQ ID NO: 255191 - DNA, 25 bp, Mus musculus
tgcagcctgcaaagtgctacacata

SEQ ID NO: 255192 - DNA, 25 bp, Mus musculus
cgcacgatccttctagtggctcaaa

SEQ ID NO: 255193 - DNA, 25 bp, Mus musculus
tgtcgaaataaaaagctgccgctct

SEQ ID NO: 255194 - DNA, 25 bp, Mus musculus
cgggaaccgagagacagccagaacc

SEQ ID NO: 255195 - DNA, 25 bp, Mus musculus
gcggtagctcactgctcaggtctcc

SEQ ID NO: 255196 - DNA, 25 bp, Mus musculus
gcgccgcagtcggtaagttcctgca

SEQ ID NO: 255197 - DNA, 25 bp, Mus musculus
gtggctcaaacccaggtcatccgga

SEQ ID NO: 255198 - DNA, 25 bp, Mus musculus
tgccttccgtttttccggagctctg

SEQ ID NO: 255199 - DNA, 25 bp, Mus musculus
gacccggctttccagagctttgcga

SEQ ID NO: 255200 - DNA, 25 bp, Mus musculus
cgcggccctttatcctgtgtggcga

SEQ ID NO: 255201 - DNA, 25 bp, Mus musculus
ggaagtctttccatgcccaagtcgg

SEQ ID NO: 255202 - DNA, 25 bp, Mus musculus
ccaagtcggagtcggaatcttttca

SEQ ID NO: 255203 - DNA, 25 bp, Mus musculus
tttcaataagaacgaggccgacgca

SEQ ID NO: 255204 - DNA, 25 bp, Mus musculus
tgtctggacgctgggcattgaacca

SEQ ID NO: 255205 - DNA, 25 bp, Mus musculus
tcaggtctccctggcctaagatcac

SEQ ID NO: 255206 - DNA, 25 bp, Mus musculus
ttccggtccagtggagttctgcacc

SEQ ID NO: 255207 - DNA, 25 bp, Mus musculus
tcgccttgctcgttaatggagaatc

SEQ ID NO: 255208 - DNA, 25 bp, Mus musculus
gctctgcgccagcaccgtgagaaac

SEQ ID NO: 255209 - DNA, 25 bp, Mus musculus
tctcctgctaggttccagggacata

SEQ ID NO: 255210 - DNA, 25 bp, Mus musculus
atctggctggcactgagaccaccca

SEQ ID NO: 255211 - DNA, 25 bp, Mus musculus
cgggtcctaagtgaaccgcgcagtg

SEQ ID NO: 255212 - DNA, 25 bp, Mus musculus
gcatggggtaccgttgtcgaaaatg

SEQ ID NO: 255213 - DNA, 25 bp, Mus musculus
gttccagggcctcggacagacagat

SEQ ID NO: 255214 - DNA, 25 bp, Mus musculus
tctcgtttcgagtgggaacccacca

SEQ ID NO: 255215 - DNA, 25 bp, Mus musculus
agcttggccattttcacctctatga

SEQ ID NO: 255216 - DNA, 25 bp, Mus musculus
cccggtccgcaatgtggcatggaaa

SEQ ID NO: 255217 - DNA, 25 bp, Mus musculus
tcctagaactctgcagggccatgga

SEQ ID NO: 255218 - DNA, 25 bp, Mus musculus
cgccggctttgagaggcctttagaa

SEQ ID NO: 255219 - DNA, 25 bp, Mus musculus
ggcagtttcctctgcgcaccgcgtt

SEQ ID NO: 255220 - DNA, 25 bp, Mus musculus
acctatccgtgtgtgtgacctcgtg

SEQ ID NO: 255221 - DNA, 25 bp, Mus musculus
tctgtggagctcagaccaggatctc

SEQ ID NO: 255222 - DNA, 25 bp, Mus musculus
cccagagtggatgtctaggcaactg

SEQ ID NO: 255223 - DNA, 25 bp, Mus musculus
ggcacggtgtgagaacctgatttca

SEQ ID NO: 255224 - DNA, 25 bp, Mus musculus
cctgatttcagttccgcgtgcgttt

SEQ ID NO: 255225 - DNA, 25 bp, Mus musculus
cgcgagtttccctgcaagtgtatga

SEQ ID NO: 255226 - DNA, 25 bp, Mus musculus
actggtcctcagtgaagctccgatg

SEQ ID NO: 255227 - DNA, 25 bp, Mus musculus
gctccgatggaacgtctttgctctc

SEQ ID NO: 255228 - DNA, 25 bp, Mus musculus
gcctggttcccaagacacagtagtg

SEQ ID NO: 255229 - DNA, 25 bp, Mus musculus
ggctctcttggtgtctcttactctc

SEQ ID NO: 255230 - DNA, 25 bp, Mus musculus
atctcgactcgcagggcaaccctta

SEQ ID NO: 255231 - DNA, 25 bp, Mus musculus
tctcctgtgggcgattacgttctta

SEQ ID NO: 255232 - DNA, 25 bp, Mus musculus
cccgacgaggtggatgtcttcttca

SEQ ID NO: 255233 - DNA, 25 bp, Mus musculus
cagagtttatgtgtttgtgtgccca

SEQ ID NO: 255234 - DNA, 25 bp, Mus musculus
gcgtgtcgctagaaccgggttctgc

SEQ ID NO: 255235 - DNA, 25 bp, Mus musculus
tgagttcgagaccacaagccttccg

SEQ ID NO: 255236 - DNA, 25 bp, Mus musculus
aggcctaggctgtcaggccgccatc

SEQ ID NO: 255237 - DNA, 25 bp, Mus musculus
cgctcaccgccaatgatggtccgga

SEQ ID NO: 255238 - DNA, 25 bp, Mus musculus
tgacctgcagcagcgtgtcgctaga

SEQ ID NO: 255239 - DNA, 25 bp, Mus musculus
gcagcggcacgacaaaacaggagaa

SEQ ID NO: 255240 - DNA, 25 bp, Mus musculus
agaagcccaggtcgagcgttatgcc

SEQ ID NO: 255241 - DNA, 25 bp, Mus musculus
gccagcgctgttttgccactgtcga

SEQ ID NO: 255242 - DNA, 25 bp, Mus musculus
gccactgtcgatgtgacccagcacg

SEQ ID NO: 255243 - DNA, 25 bp, Mus musculus
tgagcgcaccggttccggcacggaa

SEQ ID NO: 255244 - DNA, 25 bp, Mus musculus
acagccctatggcagagcgcacaca

SEQ ID NO: 255245 - DNA, 25 bp, Mus musculus
cctgctacctgggtttgctgtcatc

SEQ ID NO: 255246 - DNA, 25 bp, Mus musculus
aaggtgagaactgtgtccgcgtctg

SEQ ID NO: 255247 - DNA, 25 bp, Mus musculus
cagtcgaccagtgtgacctgcagca

SEQ ID NO: 255248 - DNA, 25 bp, Mus musculus
gtggtagctgacgtcgccctgcatc

SEQ ID NO: 255249 - DNA, 25 bp, Mus musculus
agtgcgggagccaccggacagaccc

SEQ ID NO: 255250 - DNA, 25 bp, Mus musculus
gacctgaaagtgcagcgccatcttc

SEQ ID NO: 255251 - DNA, 25 bp, Mus musculus
cgtgtgcagcaattatcgcgcgctc

SEQ ID NO: 255252 - DNA, 25 bp, Mus musculus
ccgaggctccaccaatgaggctgcg

SEQ ID NO: 255253 - DNA, 25 bp, Mus musculus
cgcgatatcccgtgactaattctac

SEQ ID NO: 255254 - DNA, 25 bp, Mus musculus
tacttctgtgggatgaagaccggca

SEQ ID NO: 255255 - DNA, 25 bp, Mus musculus
cggagaggctcagtatacttctgtg

SEQ ID NO: 255256 - DNA, 25 bp, Mus musculus
atgcacagcggagaggctcagtata

SEQ ID NO: 255257 - DNA, 25 bp, Mus musculus
cgttccgccacaggagatgcacagc

SEQ ID NO: 255258 - DNA, 25 bp, Mus musculus
atcccgagaacgttccgccacagga

SEQ ID NO: 255259 - DNA, 25 bp, Mus musculus
tcgcgcgctctaaaaggacgagggt

SEQ ID NO: 255260 - DNA, 25 bp, Mus musculus
ccataacagtcttcacgtgtgcagc

SEQ ID NO: 255261 - DNA, 25 bp, Mus musculus
acagcccggcgcactgacctgaaag

SEQ ID NO: 255262 - DNA, 25 bp, Mus musculus
cctggcgtgcggtagttcctaccac

SEQ ID NO: 255263 - DNA, 25 bp, Mus musculus
tcaccggaaacgcagtggaaggctg

SEQ ID NO: 255264 - DNA, 25 bp, Mus musculus
tgaccagcgtagcttttagccaata

SEQ ID NO: 255265 - DNA, 25 bp, Mus musculus
tgacatattgataggggcgggtcca

SEQ ID NO: 255266 - DNA, 25 bp, Mus musculus
gggcgaaactcagcagccgtgacca

SEQ ID NO: 255267 - DNA, 25 bp, Mus musculus
ttcctaccactccacgcaggttgtg

SEQ ID NO: 255268 - DNA, 25 bp, Mus musculus
tgttcctagacactcggcaaaatga

SEQ ID NO: 255269 - DNA, 25 bp, Mus musculus
gagcaccacgaagacgcagcgcatc

SEQ ID NO: 255270 - DNA, 25 bp, Mus musculus
ctcccacagccacgtgaagggtctg

SEQ ID NO: 255271 - DNA, 25 bp, Mus musculus
cgggaccaggatccactaagatcta

SEQ ID NO: 255272 - DNA, 25 bp, Mus musculus
cacactagcgagcaaaggctgcatc

SEQ ID NO: 255273 - DNA, 25 bp, Mus musculus
catcctttgcgggtcacggcacgca

SEQ ID NO: 255274 - DNA, 25 bp, Mus musculus
ggcacgcaaattagacctcaccgga

SEQ ID NO: 255275 - DNA, 25 bp, Mus musculus
ttagccaatagaaagcgaagccttc

SEQ ID NO: 255276 - DNA, 25 bp, Mus musculus
cccgcgcgatcaatgggcggcgtgc

SEQ ID NO: 255277 - DNA, 25 bp, Mus musculus
cggcaccatgcggtgattaatggcc

SEQ ID NO: 255278 - DNA, 25 bp, Mus musculus
ccatgcggtgattaatggccgggcc

SEQ ID NO: 255279 - DNA, 25 bp, Mus musculus
gtcagcgcgatggatgtggctgtca

SEQ ID NO: 255280 - DNA, 25 bp, Mus musculus
ctgtcaggccgagcgtccgcgctga

SEQ ID NO: 255281 - DNA, 25 bp, Mus musculus
ataagatgggccgatgcgcgcccgc

SEQ ID NO: 255282 - DNA, 25 bp, Mus musculus
cgcccgccgattgcccgctccgtca

SEQ ID NO: 255283 - DNA, 25 bp, Mus musculus
cgtcacccgccgtcaccggcgccgt

SEQ ID NO: 255284 - DNA, 25 bp, Mus musculus
gcgccgtcagcacgcgtgattaatg

SEQ ID NO: 255285 - DNA, 25 bp, Mus musculus
cagcacgcgtgattaatggggacgc

SEQ ID NO: 255286 - DNA, 25 bp, Mus musculus
ccagacccttgcaaatacccgcgga

SEQ ID NO: 255287 - DNA, 25 bp, Mus musculus
agggctggcaatcgcccgctggtcc

SEQ ID NO: 255288 - DNA, 25 bp, Mus musculus
aggtgcggcccagacccttgcaaat

SEQ ID NO: 255289 - DNA, 25 bp, Mus musculus
gtcactcggcaccatgcggtgatta

SEQ ID NO: 255290 - DNA, 25 bp, Mus musculus
cagaaggaccgacaggcccctagta

SEQ ID NO: 255291 - DNA, 25 bp, Mus musculus
gttcgctccgcaccccggagaggtg

SEQ ID NO: 255292 - DNA, 25 bp, Mus musculus
ggaagggacacacgaagggcacacc

SEQ ID NO: 255293 - DNA, 25 bp, Mus musculus
cactacggggaagggacacacgaag

SEQ ID NO: 255294 - DNA, 25 bp, Mus musculus
cccggagaggtgaacaatggagact

SEQ ID NO: 255295 - DNA, 25 bp, Mus musculus
ggggctggcgtttccccacttgagc

SEQ ID NO: 255296 - DNA, 25 bp, Mus musculus
gtgaacaatggagactgagataccc

SEQ ID NO: 255297 - DNA, 25 bp, Mus musculus
ggtgtccagaaggaccgacaggccc

SEQ ID NO: 255298 - DNA, 25 bp, Mus musculus
cgtgtggtgtccagaaggaccgaca

SEQ ID NO: 255299 - DNA, 25 bp, Mus musculus
tcaccagggacgcgtgtggtgtcca

SEQ ID NO: 255300 - DNA, 25 bp, Mus musculus
tgagcaaaggggtcaccagggacgc

SEQ ID NO: 255301 - DNA, 25 bp, Mus musculus
ccgcgagtgagcaaaggggtcacca

SEQ ID NO: 255302 - DNA, 25 bp, Mus musculus
ggagactgagataccccgcgagtga

SEQ ID NO: 255303 - DNA, 25 bp, Mus musculus
gacactacggggaagggacacacga

SEQ ID NO: 255304 - DNA, 25 bp, Mus musculus
caggaaactcactcgccatggcggc

SEQ ID NO: 255305 - DNA, 25 bp, Mus musculus
caaacggggaaaggcgacgcatcct

SEQ ID NO: 255306 - DNA, 25 bp, Mus musculus
gactgcgctccacttcgagtgagga

SEQ ID NO: 255307 - DNA, 25 bp, Mus musculus
gacccagtaggcctcagctgctgct

SEQ ID NO: 255308 - DNA, 25 bp, Mus musculus
gcccttgttactagtggacgcttcg

SEQ ID NO: 255309 - DNA, 25 bp, Mus musculus
agtgatagcatgtcgcgacccagta

SEQ ID NO: 255310 - DNA, 25 bp, Mus musculus
agcgcgcttcctcgaccgagagaca

SEQ ID NO: 255311 - DNA, 25 bp, Mus musculus
cggtggccctcagtaccagtgatag

SEQ ID NO: 255312 - DNA, 25 bp, Mus musculus
gttggccctacgaagcaggcgattc

SEQ ID NO: 255313 - DNA, 25 bp, Mus musculus
agagacacgtcagtgatagcccggc

SEQ ID NO: 255314 - DNA, 25 bp, Mus musculus
tctcccggaagtgagggccaaatca

SEQ ID NO: 255315 - DNA, 25 bp, Mus musculus
tcgggaagacgactgtcgggccaca

SEQ ID NO: 255316 - DNA, 25 bp, Mus musculus
aggcgattcggctttccgtgtcggt

SEQ ID NO: 255317 - DNA, 25 bp, Mus musculus
actcccggcatgcagcaggagcaga

SEQ ID NO: 255318 - DNA, 25 bp, Mus musculus
gtgcgccaccttgggatagctacag

SEQ ID NO: 255319 - DNA, 25 bp, Mus musculus
accttgggatagctacagcggtgcg

SEQ ID NO: 255320 - DNA, 25 bp, Mus musculus
agcggtgcgccaccttgggatagct

SEQ ID NO: 255321 - DNA, 25 bp, Mus musculus
tgggatagctacagcggtgcgccac

SEQ ID NO: 255322 - DNA, 25 bp, Mus musculus
gccaccttgggatagctacagcggt

SEQ ID NO: 255323 - DNA, 25 bp, Mus musculus
gggatagctacagcggtgcgccacc

SEQ ID NO: 255324 - DNA, 25 bp, Mus musculus
ggtgcgccaccttgggatagctaca

SEQ ID NO: 255325 - DNA, 25 bp, Mus musculus
gatagctacagcggtgcgccacctt

SEQ ID NO: 255326 - DNA, 25 bp, Mus musculus
gcgccaccttgggatagctacagcg

SEQ ID NO: 255327 - DNA, 25 bp, Mus musculus
agctacagcggtgcgccaccttggg

SEQ ID NO: 255328 - DNA, 25 bp, Mus musculus
cgccaccttgggatagctacagcgg

SEQ ID NO: 255329 - DNA, 25 bp, Mus musculus
atagctacagcggtgcgccaccttg

SEQ ID NO: 255330 - DNA, 25 bp, Mus musculus
ccaccttgggatagctacagcggtg

SEQ ID NO: 255331 - DNA, 25 bp, Mus musculus
tagctacagcggtgcgccaccttgg

SEQ ID NO: 255332 - DNA, 25 bp, Mus musculus
tgactgactacactacccgaaatgg

SEQ ID NO: 255333 - DNA, 25 bp, Mus musculus
agaggtaacaggtgctcggcctccg

SEQ ID NO: 255334 - DNA, 25 bp, Mus musculus
acccagaggtaacaggtgctcggcc

SEQ ID NO: 255335 - DNA, 25 bp, Mus musculus
cgctggcggccacccagaggtaaca

SEQ ID NO: 255336 - DNA, 25 bp, Mus musculus
cactataaatagaccaagcgagggg

SEQ ID NO: 255337 - DNA, 25 bp, Mus musculus
cctgggctgacaagcactataaata

SEQ ID NO: 255338 - DNA, 25 bp, Mus musculus
gacacgcgctgcagtgtgcgcctgc

SEQ ID NO: 255339 - DNA, 25 bp, Mus musculus
actacccgaaatgggcctgggctga

SEQ ID NO: 255340 - DNA, 25 bp, Mus musculus
cagaggtccctcaccggcaagtgcg

SEQ ID NO: 255341 - DNA, 25 bp, Mus musculus
gggcaggcctgactgactacactac

SEQ ID NO: 255342 - DNA, 25 bp, Mus musculus
atggcgccgtgactaggcacacgcg

SEQ ID NO: 255343 - DNA, 25 bp, Mus musculus
cgccatggcgccgtgactaggcaca

SEQ ID NO: 255344 - DNA, 25 bp, Mus musculus
cctacttactcgctgctgctccgcc

SEQ ID NO: 255345 - DNA, 25 bp, Mus musculus
gggcctgggctgacaagcactataa

SEQ ID NO: 255346 - DNA, 25 bp, Mus musculus
atgacagccgcgaggtttccttccc

SEQ ID NO: 255347 - DNA, 25 bp, Mus musculus
gcctggcgctgatactcgaggctgt

SEQ ID NO: 255348 - DNA, 25 bp, Mus musculus
acagccctcgtttgcctggcgctga

SEQ ID NO: 255349 - DNA, 25 bp, Mus musculus
cggccgcgatgagggaacagccctc

SEQ ID NO: 255350 - DNA, 25 bp, Mus musculus
cagcaggagggagcaactcgcaccc

SEQ ID NO: 255351 - DNA, 25 bp, Mus musculus
cgacatgagctagagctggagcagc

SEQ ID NO: 255352 - DNA, 25 bp, Mus musculus
ccgcatctgcgcgaatgcgcggtgc

SEQ ID NO: 255353 - DNA, 25 bp, Mus musculus
aacggccaggtccacgtcctgtgtg

SEQ ID NO: 255354 - DNA, 25 bp, Mus musculus
actgcatcttcccagaccggtgtgg

SEQ ID NO: 255355 - DNA, 25 bp, Mus musculus
gacttgtgcccgtcaactgcatctt

SEQ ID NO: 255356 - DNA, 25 bp, Mus musculus
agtagtctggctctagcccgccgca

SEQ ID NO: 255357 - DNA, 25 bp, Mus musculus
actttgctcggggacccgcatctgc

SEQ ID NO: 255358 - DNA, 25 bp, Mus musculus
ttctggaaaagtggcgacatgagct

SEQ ID NO: 255359 - DNA, 25 bp, Mus musculus
ccttcaggggtgtgttctggaaaag

SEQ ID NO: 255360 - DNA, 25 bp, Mus musculus
cttcaccggaagagcagttcgctgc

SEQ ID NO: 255361 - DNA, 25 bp, Mus musculus
cccgcgcgtcttagcggctttaatg

SEQ ID NO: 255362 - DNA, 25 bp, Mus musculus
cctcggaaggcaaaaaacaggcgtg

SEQ ID NO: 255363 - DNA, 25 bp, Mus musculus
ctggttccacccagatgaccttata

SEQ ID NO: 255364 - DNA, 25 bp, Mus musculus
aggacttttcccagcctacttcagg

SEQ ID NO: 255365 - DNA, 25 bp, Mus musculus
agctcggttcaggtcccgcacatca

SEQ ID NO: 255366 - DNA, 25 bp, Mus musculus
gtcagtcctgagtctagctcggttc

SEQ ID NO: 255367 - DNA, 25 bp, Mus musculus
cttgggatccgttctgaaaacagca

SEQ ID NO: 255368 - DNA, 25 bp, Mus musculus
cactcgcccgaagaatagctcacta

SEQ ID NO: 255369 - DNA, 25 bp, Mus musculus
acccgtctagaggacaactcaattc

SEQ ID NO: 255370 - DNA, 25 bp, Mus musculus
ttagcctctggggacttctagcctt

SEQ ID NO: 255371 - DNA, 25 bp, Mus musculus
gtgcccggccggatgtaaacactca

SEQ ID NO: 255372 - DNA, 25 bp, Mus musculus
gctggcaaacaagtcgctggtatcc

SEQ ID NO: 255373 - DNA, 25 bp, Mus musculus
ctcccacaggcttggaacgcttgtc

SEQ ID NO: 255374 - DNA, 25 bp, Mus musculus
ggacacgcgttcacaacgacacgca

SEQ ID NO: 255375 - DNA, 25 bp, Mus musculus
ccctattgcggagtccggcttcgca

SEQ ID NO: 255376 - DNA, 25 bp, Mus musculus
ccggagtgactgctgaatgaaaacc

SEQ ID NO: 255377 - DNA, 25 bp, Mus musculus
ttgtcagctcctaataaagttgccc

SEQ ID NO: 255378 - DNA, 25 bp, Mus musculus
cgcccacactaacgaggtatccgga

SEQ ID NO: 255379 - DNA, 25 bp, Mus musculus
ccaggcaagctccacgcacatgtaa

SEQ ID NO: 255380 - DNA, 25 bp, Mus musculus
cgccggacctttacgatgcgatttc

SEQ ID NO: 255381 - DNA, 25 bp, Mus musculus
tgcgatttctccaagggtgtcaccc

SEQ ID NO: 255382 - DNA, 25 bp, Mus musculus
tggccgcagactggtcacctgtcac

SEQ ID NO: 255383 - DNA, 25 bp, Mus musculus
acctgtcacctgtcacctggcgagg

SEQ ID NO: 255384 - DNA, 25 bp, Mus musculus
acggagcatccagcgcccaggacag

SEQ ID NO: 255385 - DNA, 25 bp, Mus musculus
cagcctttgttctgcggcgctgcca

SEQ ID NO: 255386 - DNA, 25 bp, Mus musculus
cgcccaatcgatgcagcggagggat

SEQ ID NO: 255387 - DNA, 25 bp, Mus musculus
gaaaaccacgtacccgagtctcaca

SEQ ID NO: 255388 - DNA, 25 bp, Mus musculus
tttcgcgcgaaaactagaccacgtg

SEQ ID NO: 255389 - DNA, 25 bp, Mus musculus
cgcccgggatcagcccattcctcac

SEQ ID NO: 255390 - DNA, 25 bp, Mus musculus
attcctcaccgccatgtctgcgcta

SEQ ID NO: 255391 - DNA, 25 bp, Mus musculus
tgtctgcgctagctccaccgcacca

SEQ ID NO: 255392 - DNA, 25 bp, Mus musculus
gctgccaccggttttcgcgcgaaaa

SEQ ID NO: 255393 - DNA, 25 bp, Mus musculus
cgcgaaaactagaccacgtgacccg

SEQ ID NO: 255394 - DNA, 25 bp, Mus musculus
acgtgacccgcccatgcccgggaag

SEQ ID NO: 255395 - DNA, 25 bp, Mus musculus
gccgggaggactcagacgtcactac

SEQ ID NO: 255396 - DNA, 25 bp, Mus musculus
acgtcactacgtcctcgtcaatcta

SEQ ID NO: 255397 - DNA, 25 bp, Mus musculus
tacgtcctcgtcaatctagagcgga

SEQ ID NO: 255398 - DNA, 25 bp, Mus musculus
gggctagaatgtttgggcacgccca

SEQ ID NO: 255399 - DNA, 25 bp, Mus musculus
ccaagctagccgagatcgctgaata

SEQ ID NO: 255400 - DNA, 25 bp, Mus musculus
ctcgtcaatctagagcggaaggagg

SEQ ID NO: 255401 - DNA, 25 bp, Mus musculus
agccgagatcgctgaataccgcccg

SEQ ID NO: 255402 - DNA, 25 bp, Mus musculus
ggaccactacaattcccaaggtctg

SEQ ID NO: 255403 - DNA, 25 bp, Mus musculus
aagctagaaaatcgcgcttctttgc

SEQ ID NO: 255404 - DNA, 25 bp, Mus musculus
gacgctctggggctcgcttaccgtc

SEQ ID NO: 255405 - DNA, 25 bp, Mus musculus
ggctcgcttaccgtccgacaagtca

SEQ ID NO: 255406 - DNA, 25 bp, Mus musculus
ccgacaagtcaatcagcccgaggta

SEQ ID NO: 255407 - DNA, 25 bp, Mus musculus
cagcccgaggtagtgcaatagtttc

SEQ ID NO: 255408 - DNA, 25 bp, Mus musculus
ggcaggcatttaaagctagaaaatc

SEQ ID NO: 255409 - DNA, 25 bp, Mus musculus
cccaaggtctggagcccttcggact

SEQ ID NO: 255410 - DNA, 25 bp, Mus musculus
ttcggactcgccctgtgtcaacatc

SEQ ID NO: 255411 - DNA, 25 bp, Mus musculus
gtgtcaacatctccgttctcgggta

SEQ ID NO: 255412 - DNA, 25 bp, Mus musculus
acatctccgttctcgggtaggcaag

SEQ ID NO: 255413 - DNA, 25 bp, Mus musculus
gaggagcacaggaccactacaattc

SEQ ID NO: 255414 - DNA, 25 bp, Mus musculus
tgcaatagtttcagggaggagcaca

SEQ ID NO: 255415 - DNA, 25 bp, Mus musculus
acgcgggcaggcatttaaagctaga

SEQ ID NO: 255416 - DNA, 25 bp, Mus musculus
gtgctcagtacgcttcccgaaacgc

SEQ ID NO: 255417 - DNA, 25 bp, Mus musculus
ggtacagccgcaagacaacctttga

SEQ ID NO: 255418 - DNA, 25 bp, Mus musculus
tccgccaagctagcgaggaggccct

SEQ ID NO: 255419 - DNA, 25 bp, Mus musculus
atctcagctgcggttcttgcgcgac

SEQ ID NO: 255420 - DNA, 25 bp, Mus musculus
tgaccgatccacgtagcatctcagc

SEQ ID NO: 255421 - DNA, 25 bp, Mus musculus
aatcccgttacgataggctgctgga

SEQ ID NO: 255422 - DNA, 25 bp, Mus musculus
cactcctgtgggtggaatcccgtta

SEQ ID NO: 255423 - DNA, 25 bp, Mus musculus
cgcctcgcccatctgaggaatttta

SEQ ID NO: 255424 - DNA, 25 bp, Mus musculus
gactggagctgtccgcagaaagatg

SEQ ID NO: 255425 - DNA, 25 bp, Mus musculus
cccacactttgctttgcttcgactg

SEQ ID NO: 255426 - DNA, 25 bp, Mus musculus
gggcaaaggcacagcgtgctcagta

SEQ ID NO: 255427 - DNA, 25 bp, Mus musculus
ttgagaagtttctggggaccctagc

SEQ ID NO: 255428 - DNA, 25 bp, Mus musculus
ttcgactgcagtccctttaagagct

SEQ ID NO: 255429 - DNA, 25 bp, Mus musculus
taggcgccatcctcaaagacatagg

SEQ ID NO: 255430 - DNA, 25 bp, Mus musculus
gaggtaagctgcgtgtctagctgca

SEQ ID NO: 255431 - DNA, 25 bp, Mus musculus
taggcgtcctgcaccagccgatact

SEQ ID NO: 255432 - DNA, 25 bp, Mus musculus
gccgatactccacgccagcctgctc

SEQ ID NO: 255433 - DNA, 25 bp, Mus musculus
agcctgctcgcagccaatggggaac

SEQ ID NO: 255434 - DNA, 25 bp, Mus musculus
gcagccaatggggaactccacgtaa

SEQ ID NO: 255435 - DNA, 25 bp, Mus musculus
gaactccacgtaagagtagaacttg

SEQ ID NO: 255436 - DNA, 25 bp, Mus musculus
aggtagtatacgaactgctcgctgc

SEQ ID NO: 255437 - DNA, 25 bp, Mus musculus
tagaacttggggtcattcacgcaca

SEQ ID NO: 255438 - DNA, 25 bp, Mus musculus
gctcaggtaggcgtcctgcaccagc

SEQ ID NO: 255439 - DNA, 25 bp, Mus musculus
tggggtcattcacgcacagccgcac

SEQ ID NO: 255440 - DNA, 25 bp, Mus musculus
acgcacagccgcacaatcttggagg

SEQ ID NO: 255441 - DNA, 25 bp, Mus musculus
tcttggaggtgaagaagtgctcgcc

SEQ ID NO: 255442 - DNA, 25 bp, Mus musculus
tgaagaagtgctcgccagcggcgtc

SEQ ID NO: 255443 - DNA, 25 bp, Mus musculus
tctagctgcagggtgaggtagtata

SEQ ID NO: 255444 - DNA, 25 bp, Mus musculus
agccttaaaactctggactggggtg

SEQ ID NO: 255445 - DNA, 25 bp, Mus musculus
acccggcgcaacacgggccgacatg

SEQ ID NO: 255446 - DNA, 25 bp, Mus musculus
acgcggcagcccatagcggagaccg

SEQ ID NO: 255447 - DNA, 25 bp, Mus musculus
cgcttgccttcaaagggcgatggcc

SEQ ID NO: 255448 - DNA, 25 bp, Mus musculus
ggccacctcagccttaaaactctgg

SEQ ID NO: 255449 - DNA, 25 bp, Mus musculus
gcggggccactgcaaactttctctc

SEQ ID NO: 255450 - DNA, 25 bp, Mus musculus
gtcccaggagtcgatgcactcttta

SEQ ID NO: 255451 - DNA, 25 bp, Mus musculus
tgcactctttaaggagcacaggctg

SEQ ID NO: 255452 - DNA, 25 bp, Mus musculus
agcacaggctggaagtacagctttc

SEQ ID NO: 255453 - DNA, 25 bp, Mus musculus
tggaagtacagctttcgtgcacgga

SEQ ID NO: 255454 - DNA, 25 bp, Mus musculus
ctttcgtgcacggaagggtaaactg

SEQ ID NO: 255455 - DNA, 25 bp, Mus musculus
tgcacggaagggtaaactgagtccg

SEQ ID NO: 255456 - DNA, 25 bp, Mus musculus
ccttcaaagggcgatggccacctca

SEQ ID NO: 255457 - DNA, 25 bp, Mus musculus
tcgccgctgcccagcatgaatgggg

SEQ ID NO: 255458 - DNA, 25 bp, Mus musculus
cccgcccacccgctagcccagtcgc

SEQ ID NO: 255459 - DNA, 25 bp, Mus musculus
aagcaagcttcctccctcgaggcga

SEQ ID NO: 255460 - DNA, 25 bp, Mus musculus
aaagcaagcttcctccctcgaggcg

SEQ ID NO: 255461 - DNA, 25 bp, Mus musculus
gaaagcaagcttcctccctcgaggc

SEQ ID NO: 255462 - DNA, 25 bp, Mus musculus
agaaagcaagcttcctccctcgagg

SEQ ID NO: 255463 - DNA, 25 bp, Mus musculus
ccgggggatgcaaaagaaagcaagc

SEQ ID NO: 255464 - DNA, 25 bp, Mus musculus
acaccgggggatgcaaaagaaagca

SEQ ID NO: 255465 - DNA, 25 bp, Mus musculus
ctggtgtcgaggggaccaaacaccg

SEQ ID NO: 255466 - DNA, 25 bp, Mus musculus
cgctggtgtcgaggggaccaaacac

SEQ ID NO: 255467 - DNA, 25 bp, Mus musculus
agcaccagagatgcgcggcctcgcg

SEQ ID NO: 255468 - DNA, 25 bp, Mus musculus
cgctcccacgggaccaagaaccagc

SEQ ID NO: 255469 - DNA, 25 bp, Mus musculus
cccagtcgctcccacgggaccaaga

SEQ ID NO: 255470 - DNA, 25 bp, Mus musculus
agcaagcttcctccctcgaggcgac

SEQ ID NO: 255471 - DNA, 25 bp, Mus musculus
gcccacccgctagcccagtcgctcc

SEQ ID NO: 255472 - DNA, 25 bp, Mus musculus
cgcgggcggtacttaacccgctgct

SEQ ID NO: 255473 - DNA, 25 bp, Mus musculus
acaagtcgggctcgcagctcgcgct

SEQ ID NO: 255474 - DNA, 25 bp, Mus musculus
cagctcgcgctgtccgtcgccatct

SEQ ID NO: 255475 - DNA, 25 bp, Mus musculus
gtcgccatcttcctgctctagcgga

SEQ ID NO: 255476 - DNA, 25 bp, Mus musculus
cttcctgctctagcggatccgaatg

SEQ ID NO: 255477 - DNA, 25 bp, Mus musculus
cctgctctagcggatccgaatgcga

SEQ ID NO: 255478 - DNA, 25 bp, Mus musculus
tctagcggatccgaatgcgagctcg

SEQ ID NO: 255479 - DNA, 25 bp, Mus musculus
tagcggatccgaatgcgagctcgga

SEQ ID NO: 255480 - DNA, 25 bp, Mus musculus
cggcggggttcagctctctcggcgc

SEQ ID NO: 255481 - DNA, 25 bp, Mus musculus
tacttaacccgctgctggctgtggc

SEQ ID NO: 255482 - DNA, 25 bp, Mus musculus
tgccgcttaaccctgtgcgcgctgg

SEQ ID NO: 255483 - DNA, 25 bp, Mus musculus
gcttaaccctgtgcgcgctggagac

SEQ ID NO: 255484 - DNA, 25 bp, Mus musculus
tgtcacccggggtgcgggacaagtc

SEQ ID NO: 255485 - DNA, 25 bp, Mus musculus
ttaacccgctgctggctgtggccgc

SEQ ID NO: 255486 - DNA, 25 bp, Mus musculus
ccgggtagagcacggaacaaatccg

SEQ ID NO: 255487 - DNA, 25 bp, Mus musculus
aatccggaaccgagagagccaaggc

SEQ ID NO: 255488 - DNA, 25 bp, Mus musculus
acactgcgctctattggctgctggg

SEQ ID NO: 255489 - DNA, 25 bp, Mus musculus
ggccagcaacactgcgctctattgg

SEQ ID NO: 255490 - DNA, 25 bp, Mus musculus
tgctgcagcacacgcaacgagaagc

SEQ ID NO: 255491 - DNA, 25 bp, Mus musculus
aaaatgacttgaggcggccggctgc

SEQ ID NO: 255492 - DNA, 25 bp, Mus musculus
aagcacaagacaagtgaaaccgggt

SEQ ID NO: 255493 - DNA, 25 bp, Mus musculus
gagccaaggcggtggaaaatgactt

SEQ ID NO: 255494 - DNA, 25 bp, Mus musculus
tcactcgggacacaggccagcaaca

SEQ ID NO: 255495 - DNA, 25 bp, Mus musculus
agcggcctacgctcgtcactcggga

SEQ ID NO: 255496 - DNA, 25 bp, Mus musculus
acagcaaccaggacgacgctgctca

SEQ ID NO: 255497 - DNA, 25 bp, Mus musculus
gctctcggcgctgcccatgacagga

SEQ ID NO: 255498 - DNA, 25 bp, Mus musculus
tccatctcgaaggacacccttcggg

SEQ ID NO: 255499 - DNA, 25 bp, Mus musculus
cgcaacgagaagcacaagacaagtg

SEQ ID NO: 255500 - DNA, 25 bp, Mus musculus
ccgggctcagtagttagcgcctggt

SEQ ID NO: 255501 - DNA, 25 bp, Mus musculus
ccagtgcgtagcgttctcaagttct

SEQ ID NO: 255502 - DNA, 25 bp, Mus musculus
gcccgtcttctgaggcccgcgagga

SEQ ID NO: 255503 - DNA, 25 bp, Mus musculus
tgcttgatgggcgtaaccggaatag

SEQ ID NO: 255504 - DNA, 25 bp, Mus musculus
ggcccggagcgacaacaaagccctg

SEQ ID NO: 255505 - DNA, 25 bp, Mus musculus
tctgagcagtgagccgggcgaaccc

SEQ ID NO: 255506 - DNA, 25 bp, Mus musculus
cgttctcaagttctcagcggctttg

SEQ ID NO: 255507 - DNA, 25 bp, Mus musculus
ctgcgggacctcatcgagggcaaca

SEQ ID NO: 255508 - DNA, 25 bp, Mus musculus
ggcaacagggtgatgatcttcagca

SEQ ID NO: 255509 - DNA, 25 bp, Mus musculus
tcttcagcaagagttactgtccaca

SEQ ID NO: 255510 - DNA, 25 bp, Mus musculus
ctgtccacacagcacgcgggtaggc

SEQ ID NO: 255511 - DNA, 25 bp, Mus musculus
tgggcagggtctaagcaatcccggt

SEQ ID NO: 255512 - DNA, 25 bp, Mus musculus
ctgggtaagtttgtgagccggatct

SEQ ID NO: 255513 - DNA, 25 bp, Mus musculus
atctggggactgatcagaggtctga

SEQ ID NO: 255514 - DNA, 25 bp, Mus musculus
accattcccacagggccttcccagc

SEQ ID NO: 255515 - DNA, 25 bp, Mus musculus
ctgcccacgcgcctttaccgcacta

SEQ ID NO: 255516 - DNA, 25 bp, Mus musculus
cccctggtgggatcagcaaggtgca

SEQ ID NO: 255517 - DNA, 25 bp, Mus musculus
gcaaggtgcagagagcgaaccctgc

SEQ ID NO: 255518 - DNA, 25 bp, Mus musculus
tgcagagagcgaaccctgcgccctg

SEQ ID NO: 255519 - DNA, 25 bp, Mus musculus
gtttgcctctatgtctcccgagctc

SEQ ID NO: 255520 - DNA, 25 bp, Mus musculus
gtctccgctgcctctcctgtctgcg

SEQ ID NO: 255521 - DNA, 25 bp, Mus musculus
ccaccggagcgccagatgcatggag

SEQ ID NO: 255522 - DNA, 25 bp, Mus musculus
attcgagagtggtcgagccatggga

SEQ ID NO: 255523 - DNA, 25 bp, Mus musculus
agccatgggagtgtcggcccgccca

SEQ ID NO: 255524 - DNA, 25 bp, Mus musculus
cctggtatttggtgagggaacacta

SEQ ID NO: 255525 - DNA, 25 bp, Mus musculus
agcagtcccggagccagtcatggag

SEQ ID NO: 255526 - DNA, 25 bp, Mus musculus
aagtgcgcttggcgcaccataccgc

SEQ ID NO: 255527 - DNA, 25 bp, Mus musculus
tgacctgggccctggtatttggtga

SEQ ID NO: 255528 - DNA, 25 bp, Mus musculus
ctcccagtgttcgttgaagggctca

SEQ ID NO: 255529 - DNA, 25 bp, Mus musculus
tcgtccaccagcacgtgacgcaggt

SEQ ID NO: 255530 - DNA, 25 bp, Mus musculus
caccttaggcacgtagcagtacagc

SEQ ID NO: 255531 - DNA, 25 bp, Mus musculus
gccagcatcacacgcttccagttgg

SEQ ID NO: 255532 - DNA, 25 bp, Mus musculus
cagttgacctcagccggcgcaaagt

SEQ ID NO: 255533 - DNA, 25 bp, Mus musculus
cccgcacgaagagaaaggtcaggta

SEQ ID NO: 255534 - DNA, 25 bp, Mus musculus
aggaactcggcgaagcgcacgtcgt

SEQ ID NO: 255535 - DNA, 25 bp, Mus musculus
tagcgcactaggcacggatggcaca

SEQ ID NO: 255536 - DNA, 25 bp, Mus musculus
gcccactacatcatagcgcactagg

SEQ ID NO: 255537 - DNA, 25 bp, Mus musculus
gcatcatctgctatcgtctcaaact

SEQ ID NO: 255538 - DNA, 25 bp, Mus musculus
ggtccagcacgaaggcagcatcatc

SEQ ID NO: 255539 - DNA, 25 bp, Mus musculus
gcagggaaacgtagcccaggctcac

SEQ ID NO: 255540 - DNA, 25 bp, Mus musculus
ctgctcacgcgtaaggtccttctct

SEQ ID NO: 255541 - DNA, 25 bp, Mus musculus
cgcacgatgcgtgtgccatagcgcc

SEQ ID NO: 255542 - DNA, 25 bp, Mus musculus
cgcacaggagcaggagtgcagcacc

SEQ ID NO: 255543 - DNA, 25 bp, Mus musculus
ttagggcccgcccagaagcagcgtc

SEQ ID NO: 255544 - DNA, 25 bp, Mus musculus
ccttcctactgtgcggcggaggtcc

SEQ ID NO: 255545 - DNA, 25 bp, Mus musculus
gttctccttcctactgtgcggcgga

SEQ ID NO: 255546 - DNA, 25 bp, Mus musculus
gtgcgttctccttcctactgtgcgg

SEQ ID NO: 255547 - DNA, 25 bp, Mus musculus
acagtcatccggtgcgttctccttc

SEQ ID NO: 255548 - DNA, 25 bp, Mus musculus
aggagtgcagcacccagacttgcca

SEQ ID NO: 255549 - DNA, 25 bp, Mus musculus
gcaggcgacagtcatccggtgcgtt

SEQ ID NO: 255550 - DNA, 25 bp, Mus musculus
catgctgtgcctggcacgcgtggca

SEQ ID NO: 255551 - DNA, 25 bp, Mus musculus
gtcttcccatgctgtgcctggcacg

SEQ ID NO: 255552 - DNA, 25 bp, Mus musculus
acaggagcgtcttcccatgctgtgc

SEQ ID NO: 255553 - DNA, 25 bp, Mus musculus
ccaccaccggcaagggccgcctgca

SEQ ID NO: 255554 - DNA, 25 bp, Mus musculus
cgtccagtgctccaggctagagata

SEQ ID NO: 255555 - DNA, 25 bp, Mus musculus
cctgcaacaggagcgtcttcccatg

SEQ ID NO: 255556 - DNA, 25 bp, Mus musculus
ctgcagtcgcatgacaagctgcgtc

SEQ ID NO: 255557 - DNA, 25 bp, Mus musculus
aaggtgcacctgctgacgcacggca

SEQ ID NO: 255558 - DNA, 25 bp, Mus musculus
ttcgccaagaagcaccagttgaagg

SEQ ID NO: 255559 - DNA, 25 bp, Mus musculus
tgcgcgctgagcttcgccaagaagc

SEQ ID NO: 255560 - DNA, 25 bp, Mus musculus
tggcaggcacggtcaccatccacaa

SEQ ID NO: 255561 - DNA, 25 bp, Mus musculus
cgacacccatggtcaggaggaggcc

SEQ ID NO: 255562 - DNA, 25 bp, Mus musculus
ccttcgtggtactgctggaagtgcc

SEQ ID NO: 255563 - DNA, 25 bp, Mus musculus
cggacgcctcagctgggcctaagat

SEQ ID NO: 255564 - DNA, 25 bp, Mus musculus
gccacgagcaggagagcttgttcaa

SEQ ID NO: 255565 - DNA, 25 bp, Mus musculus
aggcgcacatgaagggccacgagca

SEQ ID NO: 255566 - DNA, 25 bp, Mus musculus
cgtctacaacctcaaggcgcacatg

SEQ ID NO: 255567 - DNA, 25 bp, Mus musculus
gcggcaagaagttcaccaccgtcta

SEQ ID NO: 255568 - DNA, 25 bp, Mus musculus
tacaagctcaaacggcacctgcagt

SEQ ID NO: 255569 - DNA, 25 bp, Mus musculus
aagctgcgtccctttagctgcccgg

SEQ ID NO: 255570 - DNA, 25 bp, Mus musculus
gggaggtcgctagccctgccttcct

SEQ ID NO: 255571 - DNA, 25 bp, Mus musculus
tagccctgccttcctcggggaggct

SEQ ID NO: 255572 - DNA, 25 bp, Mus musculus
cggggaggctcactagagagttccc

SEQ ID NO: 255573 - DNA, 25 bp, Mus musculus
tcactagagagttcccgccctcggg

SEQ ID NO: 255574 - DNA, 25 bp, Mus musculus
caggatatggtagtggagcgtctca

SEQ ID NO: 255575 - DNA, 25 bp, Mus musculus
caagccaccgggacaggatatggta

SEQ ID NO: 255576 - DNA, 25 bp, Mus musculus
agccaggcgtcgtgacgtactgccc

SEQ ID NO: 255577 - DNA, 25 bp, Mus musculus
gtactgcccgccctgacgtgactgt

SEQ ID NO: 255578 - DNA, 25 bp, Mus musculus
tgacgtgactgtgaacccggtttcc

SEQ ID NO: 255579 - DNA, 25 bp, Mus musculus
tttcccgggcgaccgcagtcagaga

SEQ ID NO: 255580 - DNA, 25 bp, Mus musculus
caaaagccgctacggcctggcggga

SEQ ID NO: 255581 - DNA, 25 bp, Mus musculus
gtggtcaagccaccgggacaggata

SEQ ID NO: 255582 - DNA, 25 bp, Mus musculus
tggagcgtctcaaaagccgctacgg

SEQ ID NO: 255583 - DNA, 25 bp, Mus musculus
agtcagagactcaccatggagcgca

SEQ ID NO: 255584 - DNA, 25 bp, Mus musculus
tcatgaatgaacagcgccagggact

SEQ ID NO: 255585 - DNA, 25 bp, Mus musculus
agccgggccactggcttctccgagg

SEQ ID NO: 255586 - DNA, 25 bp, Mus musculus
cctgcctgatgttggacacggggcc

SEQ ID NO: 255587 - DNA, 25 bp, Mus musculus
cccaaagcctgcctgatgttggaca

SEQ ID NO: 255588 - DNA, 25 bp, Mus musculus
caaagcctgcctgatgttggacacg

SEQ ID NO: 255589 - DNA, 25 bp, Mus musculus
aagcctgcctgatgttggacacggg

SEQ ID NO: 255590 - DNA, 25 bp, Mus musculus
ccgcgctcgggctggatctcagggg

SEQ ID NO: 255591 - DNA, 25 bp, Mus musculus
ggggccgagtaccaatcatgaatga

SEQ ID NO: 255592 - DNA, 25 bp, Mus musculus
gccgagtaccaatcatgaatgaaca

SEQ ID NO: 255593 - DNA, 25 bp, Mus musculus
caatcatgaatgaacagcgccaggg

SEQ ID NO: 255594 - DNA, 25 bp, Mus musculus
gtaccaatcatgaatgaacagcgcc

SEQ ID NO: 255595 - DNA, 25 bp, Mus musculus
aatgaacagcgccagggactggtgc

SEQ ID NO: 255596 - DNA, 25 bp, Mus musculus
agtagagcggggctcagaaccaggc

SEQ ID NO: 255597 - DNA, 25 bp, Mus musculus
cccgcacggccgaggctgccgagcc

SEQ ID NO: 255598 - DNA, 25 bp, Mus musculus
catcggaggacccagtgcagatcca

SEQ ID NO: 255599 - DNA, 25 bp, Mus musculus
gtccctactagatcgggccttgtta

SEQ ID NO: 255600 - DNA, 25 bp, Mus musculus
gttgcagggacgattccgctcccga

SEQ ID NO: 255601 - DNA, 25 bp, Mus musculus
cacgtggtctgcacttcgggactct

SEQ ID NO: 255602 - DNA, 25 bp, Mus musculus
ttcagtggattctagaacccgtctc

SEQ ID NO: 255603 - DNA, 25 bp, Mus musculus
agaggttactgtcggtcactgttgc

SEQ ID NO: 255604 - DNA, 25 bp, Mus musculus
ctctgcgggctttcagtggattcta

SEQ ID NO: 255605 - DNA, 25 bp, Mus musculus
ctggacctgcgctcccatatggcgg

SEQ ID NO: 255606 - DNA, 25 bp, Mus musculus
gaacccgtctcacgtgcgcatcgga

SEQ ID NO: 255607 - DNA, 25 bp, Mus musculus
cagatccacgaagagaccggagagc

SEQ ID NO: 255608 - DNA, 25 bp, Mus musculus
cgtgggtcctcccttggggatcacg

SEQ ID NO: 255609 - DNA, 25 bp, Mus musculus
ctggcgcgcgctgtaggaaccacgc

SEQ ID NO: 255610 - DNA, 25 bp, Mus musculus
cgccgggcctgcaaagggcaaatcc

SEQ ID NO: 255611 - DNA, 25 bp, Mus musculus
ggcaaatccggtgtgcgcagcttct

SEQ ID NO: 255612 - DNA, 25 bp, Mus musculus
cacgtgctgctgtttttctgggacc

SEQ ID NO: 255613 - DNA, 25 bp, Mus musculus
ctggctacgccacgtgctgctgttt

SEQ ID NO: 255614 - DNA, 25 bp, Mus musculus
ggctacgccacgtgctgctgttttt

SEQ ID NO: 255615 - DNA, 25 bp, Mus musculus
gctacgccacgtgctgctgtttttc

SEQ ID NO: 255616 - DNA, 25 bp, Mus musculus
ctacgccacgtgctgctgtttttct

SEQ ID NO: 255617 - DNA, 25 bp, Mus musculus
tacgccacgtgctgctgtttttctg

SEQ ID NO: 255618 - DNA, 25 bp, Mus musculus
acgccacgtgctgctgtttttctgg

SEQ ID NO: 255619 - DNA, 25 bp, Mus musculus
acgtgctgctgtttttctgggaccg

SEQ ID NO: 255620 - DNA, 25 bp, Mus musculus
ccacgtgctgctgtttttctgggac

SEQ ID NO: 255621 - DNA, 25 bp, Mus musculus
gccacgtgctgctgtttttctggga

SEQ ID NO: 255622 - DNA, 25 bp, Mus musculus
ctctggctacgccacgtgctgctgt

SEQ ID NO: 255623 - DNA, 25 bp, Mus musculus
cgtgctgctgtttttctgggaccgg

SEQ ID NO: 255624 - DNA, 25 bp, Mus musculus
gctgctgtttttctgggaccggctt

SEQ ID NO: 255625 - DNA, 25 bp, Mus musculus
tgctgtttttctgggaccggcttga

SEQ ID NO: 255626 - DNA, 25 bp, Mus musculus
gtgatttgcacgctgacccaatggc

SEQ ID NO: 255627 - DNA, 25 bp, Mus musculus
cccgggaggataaacagcaggcctg

SEQ ID NO: 255628 - DNA, 25 bp, Mus musculus
gttgttcctacagccgctgtgtccc

SEQ ID NO: 255629 - DNA, 25 bp, Mus musculus
atgttgttcctacagccgctgtgtc

SEQ ID NO: 255630 - DNA, 25 bp, Mus musculus
acatgttgttcctacagccgctgtg

SEQ ID NO: 255631 - DNA, 25 bp, Mus musculus
aattacatgttgttcctacagccgc

SEQ ID NO: 255632 - DNA, 25 bp, Mus musculus
tcggcttgttatcaattacatgttg

SEQ ID NO: 255633 - DNA, 25 bp, Mus musculus
ggctctcggcttgttatcaattaca

SEQ ID NO: 255634 - DNA, 25 bp, Mus musculus
ccggctctcggcttgttatcaatta

SEQ ID NO: 255635 - DNA, 25 bp, Mus musculus
gacccaatggctagcccttggccgg

SEQ ID NO: 255636 - DNA, 25 bp, Mus musculus
acgctgacccaatggctagcccttg

SEQ ID NO: 255637 - DNA, 25 bp, Mus musculus
cccgtgatttgcacgctgacccaat

SEQ ID NO: 255638 - DNA, 25 bp, Mus musculus
ggcctgccggggaccgtgcccagaa

SEQ ID NO: 255639 - DNA, 25 bp, Mus musculus
tttgcacgctgacccaatggctagc

SEQ ID NO: 255640 - DNA, 25 bp, Mus musculus
tccacagtgtccagcgcgcgcctgg

SEQ ID NO: 255641 - DNA, 25 bp, Mus musculus
ctgtctggacgcctaggcagggcgg

SEQ ID NO: 255642 - DNA, 25 bp, Mus musculus
ccgccgcaggcctccacagtgtcca

SEQ ID NO: 255643 - DNA, 25 bp, Mus musculus
caggcctccacagtgtccagcgcgc

SEQ ID NO: 255644 - DNA, 25 bp, Mus musculus
gcctggccgcctcgctttcgccgcc

SEQ ID NO: 255645 - DNA, 25 bp, Mus musculus
gagctggactgggagccggggaagc

SEQ ID NO: 255646 - DNA, 25 bp, Mus musculus
aagccaagggaaagcggagcgtcaa

SEQ ID NO: 255647 - DNA, 25 bp, Mus musculus
agccaagggaaagcggagcgtcaat

SEQ ID NO: 255648 - DNA, 25 bp, Mus musculus
ggaaagcggagcgtcaatggccctc

SEQ ID NO: 255649 - DNA, 25 bp, Mus musculus
gaaagcggagcgtcaatggccctcg

SEQ ID NO: 255650 - DNA, 25 bp, Mus musculus
aaagcggagcgtcaatggccctcgg

SEQ ID NO: 255651 - DNA, 25 bp, Mus musculus
cggagcgtcaatggccctcgggatg

SEQ ID NO: 255652 - DNA, 25 bp, Mus musculus
ccctctgtctggacgcctaggcagg

SEQ ID NO: 255653 - DNA, 25 bp, Mus musculus
agaggaccggtaagcgcgggcagga

SEQ ID NO: 255654 - DNA, 25 bp, Mus musculus
ccgccacgcgccttcgccggtccct

SEQ ID NO: 255655 - DNA, 25 bp, Mus musculus
caagtccggcctgaggaatgtggcc

SEQ ID NO: 255656 - DNA, 25 bp, Mus musculus
tcaagtccggcctgaggaatgtggc

SEQ ID NO: 255657 - DNA, 25 bp, Mus musculus
gcgtagctcaagtccggcctgagga

SEQ ID NO: 255658 - DNA, 25 bp, Mus musculus
tgccaggcgtagctcaagtccggcc

SEQ ID NO: 255659 - DNA, 25 bp, Mus musculus
tgctagtccaatcaccggcccggtg

SEQ ID NO: 255660 - DNA, 25 bp, Mus musculus
ctaggcctgctagtccaatcaccgg

SEQ ID NO: 255661 - DNA, 25 bp, Mus musculus
agccctaggcctgctagtccaatca

SEQ ID NO: 255662 - DNA, 25 bp, Mus musculus
gcagccctaggcctgctagtccaat

SEQ ID NO: 255663 - DNA, 25 bp, Mus musculus
ttcacgcagccctaggcctgctagt

SEQ ID NO: 255664 - DNA, 25 bp, Mus musculus
gcaggttcacgcagccctaggcctg

SEQ ID NO: 255665 - DNA, 25 bp, Mus musculus
gcctgcaggttcacgcagccctagg

SEQ ID NO: 255666 - DNA, 25 bp, Mus musculus
gccagagccgtgagttccgggagaa

SEQ ID NO: 255667 - DNA, 25 bp, Mus musculus
ttcgccggtccctcctgccctgcgc

SEQ ID NO: 255668 - DNA, 25 bp, Mus musculus
ttcgtcgccgctgaggcctcagagt

SEQ ID NO: 255669 - DNA, 25 bp, Mus musculus
gcccggcggaaacacactgcgcatg

SEQ ID NO: 255670 - DNA, 25 bp, Mus musculus
cgtccctgattcgtcgccgctgagg

SEQ ID NO: 255671 - DNA, 25 bp, Mus musculus
gcctcagagtctcgcggtctttgcg

SEQ ID NO: 255672 - DNA, 25 bp, Mus musculus
tctcgcggtctttgcgttcgccagc

SEQ ID NO: 255673 - DNA, 25 bp, Mus musculus
gcgcgaagctgtccgggtttctgtc

SEQ ID NO: 255674 - DNA, 25 bp, Mus musculus
cggtgttttgtctcctcgttgccga

SEQ ID NO: 255675 - DNA, 25 bp, Mus musculus
ttttgtctcctcgttgccgagccct

SEQ ID NO: 255676 - DNA, 25 bp, Mus musculus
cggcttcctgtttggccggctcctt

SEQ ID NO: 255677 - DNA, 25 bp, Mus musculus
tccgggcccagcagcatgacgtctg

SEQ ID NO: 255678 - DNA, 25 bp, Mus musculus
atcaaccgtatcctccggcgggctg

SEQ ID NO: 255679 - DNA, 25 bp, Mus musculus
gctttggagaactacatcaaccgta

SEQ ID NO: 255680 - DNA, 25 bp, Mus musculus
ttctgtcgggcggtgttttgtctcc

SEQ ID NO: 255681 - DNA, 25 bp, Mus musculus
gcatgacgtctgctttggagaacta

SEQ ID NO: 255682 - DNA, 25 bp, Mus musculus
gcacgcagaaaaccggcgcggagtc

SEQ ID NO: 255683 - DNA, 25 bp, Mus musculus
actgctgaggtttgtccgggcacca

SEQ ID NO: 255684 - DNA, 25 bp, Mus musculus
agtcgcacagcgtccggactgctga

SEQ ID NO: 255685 - DNA, 25 bp, Mus musculus
gacagtctagggaggacaagccact

SEQ ID NO: 255686 - DNA, 25 bp, Mus musculus
tgcacttgtccgcagttcgctgaga

SEQ ID NO: 255687 - DNA, 25 bp, Mus musculus
aattaacacccagccgaaaagcagc

SEQ ID NO: 255688 - DNA, 25 bp, Mus musculus
tttctcttacgaacctcaagatccc

SEQ ID NO: 255689 - DNA, 25 bp, Mus musculus
tgtcccagcacagcaggaggcaccg

SEQ ID NO: 255690 - DNA, 25 bp, Mus musculus
gagtcgtcggcacggcggcaccttt

SEQ ID NO: 255691 - DNA, 25 bp, Mus musculus
caggtggccaggcacgcagaaaacc

SEQ ID NO: 255692 - DNA, 25 bp, Mus musculus
agaagctgttcggtcgcgtcctccg

SEQ ID NO: 255693 - DNA, 25 bp, Mus musculus
aagccactggctccgagtcgcacag

SEQ ID NO: 255694 - DNA, 25 bp, Mus musculus
gcggcacctttcctttctcttacga

SEQ ID NO: 255695 - DNA, 25 bp, Mus musculus
gtccgcagttcgctgagacagtcta

SEQ ID NO: 255696 - DNA, 25 bp, Mus musculus
acgtagtgcggcctcgctggaccaa

SEQ ID NO: 255697 - DNA, 25 bp, Mus musculus
ggcctcgctggaccaatcgccaaag

SEQ ID NO: 255698 - DNA, 25 bp, Mus musculus
aggagcaacgtagtgcggcctcgct

SEQ ID NO: 255699 - DNA, 25 bp, Mus musculus
cttccaggagcaacgtagtgcggcc

SEQ ID NO: 255700 - DNA, 25 bp, Mus musculus
ctccttccaggagcaacgtagtgcg

SEQ ID NO: 255701 - DNA, 25 bp, Mus musculus
ctctcgcagcatccggaggagggac

SEQ ID NO: 255702 - DNA, 25 bp, Mus musculus
ctgtgccggtttgctctcgcagcat

SEQ ID NO: 255703 - DNA, 25 bp, Mus musculus
gtgtctgtgccggtttgctctcgca

SEQ ID NO: 255704 - DNA, 25 bp, Mus musculus
cttgggaattttccctcccgcacat

SEQ ID NO: 255705 - DNA, 25 bp, Mus musculus
tgcctcgctgctacctgggacttcc

SEQ ID NO: 255706 - DNA, 25 bp, Mus musculus
cgctggaccaatcgccaaagtgctc

SEQ ID NO: 255707 - DNA, 25 bp, Mus musculus
agtcaccatggtcgccaggttgggc

SEQ ID NO: 255708 - DNA, 25 bp, Mus musculus
gtttgctctcgcagcatccggagga

SEQ ID NO: 255709 - DNA, 25 bp, Mus musculus
gtcgagtcaccatggtcgccaggtt

SEQ ID NO: 255710 - DNA, 25 bp, Mus musculus
tgaagagagatggaactagaaactt

SEQ ID NO: 255711 - DNA, 25 bp, Mus musculus
gagcacattgagtattatgaagaga

SEQ ID NO: 255712 - DNA, 25 bp, Mus musculus
gcacattgagtattatgaagagaga

SEQ ID NO: 255713 - DNA, 25 bp, Mus musculus
tattatgaagagagatggaactaga

SEQ ID NO: 255714 - DNA, 25 bp, Mus musculus
agatggaactagaaacttgagggtg

SEQ ID NO: 255715 - DNA, 25 bp, Mus musculus
atggaactagaaacttgagggtgaa

SEQ ID NO: 255716 - DNA, 25 bp, Mus musculus
ggaactagaaacttgagggtgaaga

SEQ ID NO: 255717 - DNA, 25 bp, Mus musculus
actagaaacttgagggtgaagagga

SEQ ID NO: 255718 - DNA, 25 bp, Mus musculus
aacttgagggtgaagaggaatagcc

SEQ ID NO: 255719 - DNA, 25 bp, Mus musculus
acttgagggtgaagaggaatagcct

SEQ ID NO: 255720 - DNA, 25 bp, Mus musculus
ggaatagcctgttgcacacacacac

SEQ ID NO: 255721 - DNA, 25 bp, Mus musculus
gaatagcctgttgcacacacacaca

SEQ ID NO: 255722 - DNA, 25 bp, Mus musculus
gcatattcacccctacacaaacata

SEQ ID NO: 255723 - DNA, 25 bp, Mus musculus
tgagtattatgaagagagatggaac

SEQ ID NO: 255724 - DNA, 25 bp, Mus musculus
ctaagcatgagtggcccaggcggcc

SEQ ID NO: 255725 - DNA, 25 bp, Mus musculus
cttaatcctcggtccgaaatagccg

SEQ ID NO: 255726 - DNA, 25 bp, Mus musculus
atctcgggtcgagacaggggaatta

SEQ ID NO: 255727 - DNA, 25 bp, Mus musculus
gagagcactaagcatgagtggccca

SEQ ID NO: 255728 - DNA, 25 bp, Mus musculus
acgcgacagccgctcggcgaggtca

SEQ ID NO: 255729 - DNA, 25 bp, Mus musculus
tctgcacttacttgtcgcggcggca

SEQ ID NO: 255730 - DNA, 25 bp, Mus musculus
caggtgtcgccggtgtcgctccagc

SEQ ID NO: 255731 - DNA, 25 bp, Mus musculus
agcaggccggcgttctcacggctca

SEQ ID NO: 255732 - DNA, 25 bp, Mus musculus
cgacgatccgggtcagctcctgcag

SEQ ID NO: 255733 - DNA, 25 bp, Mus musculus
gctcctgcaggtactcggctgccgt

SEQ ID NO: 255734 - DNA, 25 bp, Mus musculus
gcagacgaggagtttgcaaagtgcc

SEQ ID NO: 255735 - DNA, 25 bp, Mus musculus
agtttgcaaagtgccggctgcgacg

SEQ ID NO: 255736 - DNA, 25 bp, Mus musculus
ggcgtctccttaatcctcggtccga

SEQ ID NO: 255737 - DNA, 25 bp, Mus musculus
gggtccggccgagggactcactcca

SEQ ID NO: 255738 - DNA, 25 bp, Mus musculus
tcagaagcttccagagtgaagttca

SEQ ID NO: 255739 - DNA, 25 bp, Mus musculus
cccaggcgccatgcgcagagagaga

SEQ ID NO: 255740 - DNA, 25 bp, Mus musculus
tagcgcgtggcctaaggcctctgcc

SEQ ID NO: 255741 - DNA, 25 bp, Mus musculus
ccggagcccgtagcgcgtggcctaa

SEQ ID NO: 255742 - DNA, 25 bp, Mus musculus
cgaatcctgcgagctttttcagccc

SEQ ID NO: 255743 - DNA, 25 bp, Mus musculus
agcgcgccgaatcctgcgagctttt

SEQ ID NO: 255744 - DNA, 25 bp, Mus musculus
agagcacgcgcctggtgctgagccc

SEQ ID NO: 255745 - DNA, 25 bp, Mus musculus
gctgcactagtgaggcccgcgccat

SEQ ID NO: 255746 - DNA, 25 bp, Mus musculus
gcgggacccactacctgcagcaaca

SEQ ID NO: 255747 - DNA, 25 bp, Mus musculus
cttgggaatgttaagcttggcggcc

SEQ ID NO: 255748 - DNA, 25 bp, Mus musculus
ggcagcagcaccttgggaatgttaa

SEQ ID NO: 255749 - DNA, 25 bp, Mus musculus
ccgcgtgaagggcagcagcaccttg

SEQ ID NO: 255750 - DNA, 25 bp, Mus musculus
gcctcaccagcggtagcagccctca

SEQ ID NO: 255751 - DNA, 25 bp, Mus musculus
agagtgaagttcacgcgcgtggccc

SEQ ID NO: 255752 - DNA, 25 bp, Mus musculus
ctggactcccagattcgtgacacta

SEQ ID NO: 255753 - DNA, 25 bp, Mus musculus
gcggtccgaccgaagactacaccga

SEQ ID NO: 255754 - DNA, 25 bp, Mus musculus
aggcggctccagagaactcaggttc

SEQ ID NO: 255755 - DNA, 25 bp, Mus musculus
ctgcttttagtgaagtgtgtttctc

SEQ ID NO: 255756 - DNA, 25 bp, Mus musculus
acgcttcctggctgctgcaaccgga

SEQ ID NO: 255757 - DNA, 25 bp, Mus musculus
gcgttcctgctgcttcgttttctta

SEQ ID NO: 255758 - DNA, 25 bp, Mus musculus
ttgaatacggttcccgcgagaactc

SEQ ID NO: 255759 - DNA, 25 bp, Mus musculus
ctcaggttcctgagaacaggcgttc

SEQ ID NO: 255760 - DNA, 25 bp, Mus musculus
gtcgtctttaccaacgccagtgtcg

SEQ ID NO: 255761 - DNA, 25 bp, Mus musculus
ctcacgtttctcacgagatgtcttg

SEQ ID NO: 255762 - DNA, 25 bp, Mus musculus
agatgtcttgtccaatccgcgcctc

SEQ ID NO: 255763 - DNA, 25 bp, Mus musculus
ggcgccttgcagagactgcgcatgt

SEQ ID NO: 255764 - DNA, 25 bp, Mus musculus
tgcgcatgtgcatgctccgcgactt

SEQ ID NO: 255765 - DNA, 25 bp, Mus musculus
cactgctaagtaagcgccggggatt

SEQ ID NO: 255766 - DNA, 25 bp, Mus musculus
tgaccgtgcggacgaacggtggttc

SEQ ID NO: 255767 - DNA, 25 bp, Mus musculus
ccagcgccatggaggcgtgtgttct

SEQ ID NO: 255768 - DNA, 25 bp, Mus musculus
tccaggcggcactccattgggtgct

SEQ ID NO: 255769 - DNA, 25 bp, Mus musculus
gcactccattgggtgcttctccttg

SEQ ID NO: 255770 - DNA, 25 bp, Mus musculus
cgccggtccggtcgtctgtgacgca

SEQ ID NO: 255771 - DNA, 25 bp, Mus musculus
ccggtcgtctgtgacgcagctgcag

SEQ ID NO: 255772 - DNA, 25 bp, Mus musculus
agctcccagcgccatggaggcgtgt

SEQ ID NO: 255773 - DNA, 25 bp, Mus musculus
gagctgcgcatgaccacgccctcca

SEQ ID NO: 255774 - DNA, 25 bp, Mus musculus
gtgttctgcgtaggccctgcctctt

SEQ ID NO: 255775 - DNA, 25 bp, Mus musculus
attcccatgggcacggcgggacagc

SEQ ID NO: 255776 - DNA, 25 bp, Mus musculus
gtggttctcccctttgcagggcacc

SEQ ID NO: 255777 - DNA, 25 bp, Mus musculus
cacagcctcctgcagtcgcggtcta

SEQ ID NO: 255778 - DNA, 25 bp, Mus musculus
tgcagtcgcggtctactcacctccc

SEQ ID NO: 255779 - DNA, 25 bp, Mus musculus
agtggcgtccagagcaggcagggcc

SEQ ID NO: 255780 - DNA, 25 bp, Mus musculus
gcgcttcctctaggtcagtcacgtt

SEQ ID NO: 255781 - DNA, 25 bp, Mus musculus
aagtacagagccttcgatctccacc

SEQ ID NO: 255782 - DNA, 25 bp, Mus musculus
tcacgttctcttgatcgctggctcg

SEQ ID NO: 255783 - DNA, 25 bp, Mus musculus
gtcagtcacgttctcttgatcgctg

SEQ ID NO: 255784 - DNA, 25 bp, Mus musculus
cgaagtcttagcaaaatcgaggccc

SEQ ID NO: 255785 - DNA, 25 bp, Mus musculus
agcaccgggtaagtacagagccttc

SEQ ID NO: 255786 - DNA, 25 bp, Mus musculus
gtctcaaggcctggctagtcccgct

SEQ ID NO: 255787 - DNA, 25 bp, Mus musculus
aaggcctggctagtcccgctcttct

SEQ ID NO: 255788 - DNA, 25 bp, Mus musculus
acccggactctggattcaccgacgg

SEQ ID NO: 255789 - DNA, 25 bp, Mus musculus
actctggattcaccgacggcgggtg

SEQ ID NO: 255790 - DNA, 25 bp, Mus musculus
cggcggcgcagctcaacacagagca

SEQ ID NO: 255791 - DNA, 25 bp, Mus musculus
ctcaacacagagcaccgggtaagta

SEQ ID NO: 255792 - DNA, 25 bp, Mus musculus
cctctaggtcagtcacgttctcttg

SEQ ID NO: 255793 - DNA, 25 bp, Mus musculus
ccgggtaagtacagagccttcgatc

SEQ ID NO: 255794 - DNA, 25 bp, Mus musculus
atccagagcgggacagctgctcacg

SEQ ID NO: 255795 - DNA, 25 bp, Mus musculus
gcgcagcgtagtcagcgtggccaca

SEQ ID NO: 255796 - DNA, 25 bp, Mus musculus
agcgtggccacaggtggacactccc

SEQ ID NO: 255797 - DNA, 25 bp, Mus musculus
ttcagggcccacatatccagagcgg

SEQ ID NO: 255798 - DNA, 25 bp, Mus musculus
gctctgactttcagcctggcttgga

SEQ ID NO: 255799 - DNA, 25 bp, Mus musculus
ctctcaggaagagcccggactccag

SEQ ID NO: 255800 - DNA, 25 bp, Mus musculus
tcagctgctgagtgccagtccctag

SEQ ID NO: 255801 - DNA, 25 bp, Mus musculus
tggccagccgcctttggccagtgca

SEQ ID NO: 255802 - DNA, 25 bp, Mus musculus
cagctagggcgtgcgccaaagccac

SEQ ID NO: 255803 - DNA, 25 bp, Mus musculus
cgctgaggatgttggacgccaccag

SEQ ID NO: 255804 - DNA, 25 bp, Mus musculus
cggtggctctggcagaaagctatcc

SEQ ID NO: 255805 - DNA, 25 bp, Mus musculus
cagaaagctatccaggcgcaggggc

SEQ ID NO: 255806 - DNA, 25 bp, Mus musculus
cccgctctccgttctgcagtgataa

SEQ ID NO: 255807 - DNA, 25 bp, Mus musculus
catgccgggactctcaggaagagcc

SEQ ID NO: 255808 - DNA, 25 bp, Mus musculus
ggcattctgcttgatctcccgggca

SEQ ID NO: 255809 - DNA, 25 bp, Mus musculus
cgacccgcctcgttattgtgtaagt

SEQ ID NO: 255810 - DNA, 25 bp, Mus musculus
cgcctcgttattgtgtaagttcatg

SEQ ID NO: 255811 - DNA, 25 bp, Mus musculus
gtgtaagttcatgagcgtccgggca

SEQ ID NO: 255812 - DNA, 25 bp, Mus musculus
tggcatgggccacgcccgcagcgat

SEQ ID NO: 255813 - DNA, 25 bp, Mus musculus
agcagtgatggcatgggccacgccc

SEQ ID NO: 255814 - DNA, 25 bp, Mus musculus
tcgcagccacagtcgctcaggttgc

SEQ ID NO: 255815 - DNA, 25 bp, Mus musculus
tgcttctccttgtcgcagccacagt

SEQ ID NO: 255816 - DNA, 25 bp, Mus musculus
tggccttgcttctccttgtcgcagc

SEQ ID NO: 255817 - DNA, 25 bp, Mus musculus
agcggatgtcggcagagcagccacc

SEQ ID NO: 255818 - DNA, 25 bp, Mus musculus
agaccttggcgaagccgatgccgta

SEQ ID NO: 255819 - DNA, 25 bp, Mus musculus
cgggcatccacgaagaccttggcga

SEQ ID NO: 255820 - DNA, 25 bp, Mus musculus
gcgtccgggcattctgcttgatctc

SEQ ID NO: 255821 - DNA, 25 bp, Mus musculus
tgatctcccgggcatccacgaagac

SEQ ID NO: 255822 - DNA, 25 bp, Mus musculus
cttcctggatgctggatgagtggat

SEQ ID NO: 255823 - DNA, 25 bp, Mus musculus
tgagcccgacctcgcttcctggatg

SEQ ID NO: 255824 - DNA, 25 bp, Mus musculus
aatgagcccgacctcgcttcctgga

SEQ ID NO: 255825 - DNA, 25 bp, Mus musculus
aagccgcctctcgatccgcggttgg

SEQ ID NO: 255826 - DNA, 25 bp, Mus musculus
aaaacacacccgcaggcaggcagcg

SEQ ID NO: 255827 - DNA, 25 bp, Mus musculus
gggcgaatcaataacacttaaaaca

SEQ ID NO: 255828 - DNA, 25 bp, Mus musculus
cgcgggcgaatcaataacacttaaa

SEQ ID NO: 255829 - DNA, 25 bp, Mus musculus
gacgcgggcgaatcaataacactta

SEQ ID NO: 255830 - DNA, 25 bp, Mus musculus
gcggccagagccaatgagcccgacc

SEQ ID NO: 255831 - DNA, 25 bp, Mus musculus
gccaagatgaagattaaagcaagtg

SEQ ID NO: 255832 - DNA, 25 bp, Mus musculus
agcgcgcgagcccagaagccgcctc

SEQ ID NO: 255833 - DNA, 25 bp, Mus musculus
cgcgggccaagatgaagattaaagc

SEQ ID NO: 255834 - DNA, 25 bp, Mus musculus
tgcgcgggccaagatgaagattaaa

SEQ ID NO: 255835 - DNA, 25 bp, Mus musculus
acttaaaacacacccgcaggcaggc

SEQ ID NO: 255836 - DNA, 25 bp, Mus musculus
ctctcgcttggtgacatttggcgtc

SEQ ID NO: 255837 - DNA, 25 bp, Mus musculus
actgcacctgagctgaacttgaaca

SEQ ID NO: 255838 - DNA, 25 bp, Mus musculus
cttatttatcgatcgcaccggcaga

SEQ ID NO: 255839 - DNA, 25 bp, Mus musculus
cctttccgggtacaaggcgacagca

SEQ ID NO: 255840 - DNA, 25 bp, Mus musculus
agaaccacctggatgctctcgcttg

SEQ ID NO: 255841 - DNA, 25 bp, Mus musculus
tgccagctcccaggctctataactg

SEQ ID NO: 255842 - DNA, 25 bp, Mus musculus
aggagacgcctttgcctaacctgcg

SEQ ID NO: 255843 - DNA, 25 bp, Mus musculus
tgaacagagagtgaaagggcccatc

SEQ ID NO: 255844 - DNA, 25 bp, Mus musculus
ggcaaacgctctcggctagcgcaga

SEQ ID NO: 255845 - DNA, 25 bp, Mus musculus
tgcgcactttgccaggtatgtaccg

SEQ ID NO: 255846 - DNA, 25 bp, Mus musculus
ccgagtgccttgaagcttccctttg

SEQ ID NO: 255847 - DNA, 25 bp, Mus musculus
ttccatcaaacagccgcggccgagt

SEQ ID NO: 255848 - DNA, 25 bp, Mus musculus
ccgcacctttttgaacttgttgctg

SEQ ID NO: 255849 - DNA, 25 bp, Mus musculus
tttgttcatccaaggctcgctcatc

SEQ ID NO: 255850 - DNA, 25 bp, Mus musculus
cccaggctgagaaagaggtggccca

SEQ ID NO: 255851 - DNA, 25 bp, Mus musculus
gccagcgatcgcggcaagtgtttga

SEQ ID NO: 255852 - DNA, 25 bp, Mus musculus
caagcgcaacaaggggcgccgctgc

SEQ ID NO: 255853 - DNA, 25 bp, Mus musculus
cactggagactgtcccagagcgcgg

SEQ ID NO: 255854 - DNA, 25 bp, Mus musculus
gctaggcactggagactgtcccaga

SEQ ID NO: 255855 - DNA, 25 bp, Mus musculus
tcggtccgcgctaggcactggagac

SEQ ID NO: 255856 - DNA, 25 bp, Mus musculus
ggcaatccacatagcctgcgcaggg

SEQ ID NO: 255857 - DNA, 25 bp, Mus musculus
ctatgcccaggctgagaaagaggtg

SEQ ID NO: 255858 - DNA, 25 bp, Mus musculus
agcgccgcgctttccgggtcatagt

SEQ ID NO: 255859 - DNA, 25 bp, Mus musculus
tgcttacccgatccggaggtagact

SEQ ID NO: 255860 - DNA, 25 bp, Mus musculus
agaacgcgcgcggtgcttacccgat

SEQ ID NO: 255861 - DNA, 25 bp, Mus musculus
gcctccgtcgcacgcgcggaaagaa

SEQ ID NO: 255862 - DNA, 25 bp, Mus musculus
tcccgggcccagtcaactttgcctc

SEQ ID NO: 255863 - DNA, 25 bp, Mus musculus
ggcccggcggggcaatccacatagc

SEQ ID NO: 255864 - DNA, 25 bp, Mus musculus
ggtcgtcagcccaattcctagcgga

SEQ ID NO: 255865 - DNA, 25 bp, Mus musculus
gtaacttttgtcctgcgtcccgcca

SEQ ID NO: 255866 - DNA, 25 bp, Mus musculus
tgacaccatcatccgggccgctttt

SEQ ID NO: 255867 - DNA, 25 bp, Mus musculus
ccatggcagcgaacgtaagtgcttc

SEQ ID NO: 255868 - DNA, 25 bp, Mus musculus
tggcagacaggaggtcaccgtattc

SEQ ID NO: 255869 - DNA, 25 bp, Mus musculus
tcctggattccacgagaagtcttgc

SEQ ID NO: 255870 - DNA, 25 bp, Mus musculus
taggacatggttgttcccgacagtc

SEQ ID NO: 255871 - DNA, 25 bp, Mus musculus
gcacgcgcagacaacttgaggctta

SEQ ID NO: 255872 - DNA, 25 bp, Mus musculus
gttcgggcttcaccttgaccttgga

SEQ ID NO: 255873 - DNA, 25 bp, Mus musculus
gagcggatacaccttctcgccgtga

SEQ ID NO: 255874 - DNA, 25 bp, Mus musculus
ttgcgcctctccaactagaccgata

SEQ ID NO: 255875 - DNA, 25 bp, Mus musculus
cgtgtcagacgtcggactacatttc

SEQ ID NO: 255876 - DNA, 25 bp, Mus musculus
gagcgacggtgtctaattcctaaca

SEQ ID NO: 255877 - DNA, 25 bp, Mus musculus
tttcccagaaatcttgcagcgcgca

SEQ ID NO: 255878 - DNA, 25 bp, Mus musculus
ggcgcgaagggacaaaaataatata

SEQ ID NO: 255879 - DNA, 25 bp, Mus musculus
gtcgtcgccctttctctgtagaatg

SEQ ID NO: 255880 - DNA, 25 bp, Mus musculus
gcccatctctgggagctagctgtcg

SEQ ID NO: 255881 - DNA, 25 bp, Mus musculus
ggcctgctcctgaaacctccgtagg

SEQ ID NO: 255882 - DNA, 25 bp, Mus musculus
aggcgttcgaagaggaaatgctttc

SEQ ID NO: 255883 - DNA, 25 bp, Mus musculus
cggacgacgtagatcaggtaagttt

SEQ ID NO: 255884 - DNA, 25 bp, Mus musculus
cgtttgaaacatggcggacgacgta

SEQ ID NO: 255885 - DNA, 25 bp, Mus musculus
ggtttctgagttcctgttcccgcga

SEQ ID NO: 255886 - DNA, 25 bp, Mus musculus
atatagttcgccttcagtgcgtggc

SEQ ID NO: 255887 - DNA, 25 bp, Mus musculus
taggaccacgccctcgaaggaagcc

SEQ ID NO: 255888 - DNA, 25 bp, Mus musculus
gccatgctagccagaggcgttcctc

SEQ ID NO: 255889 - DNA, 25 bp, Mus musculus
ggcatgttgcagactcggcctctca

SEQ ID NO: 255890 - DNA, 25 bp, Mus musculus
ggagaccttgccacaggcgcagatc

SEQ ID NO: 255891 - DNA, 25 bp, Mus musculus
cctccgtaggcccagagtttctcaa

SEQ ID NO: 255892 - DNA, 25 bp, Mus musculus
ggagaagccgcttataaattaccgc

SEQ ID NO: 255893 - DNA, 25 bp, Mus musculus
gacctggttgctgccgagctcccgt

SEQ ID NO: 255894 - DNA, 25 bp, Mus musculus
tccgccacctcaccgggtccctgcg

SEQ ID NO: 255895 - DNA, 25 bp, Mus musculus
ccagcgtcgtgctccgggacctggt

SEQ ID NO: 255896 - DNA, 25 bp, Mus musculus
gctcccgtgcccagccgccaacgcc

SEQ ID NO: 255897 - DNA, 25 bp, Mus musculus
tgctccgggacctggttgctgccga

SEQ ID NO: 255898 - DNA, 25 bp, Mus musculus
gccgcttataaattaccgcttcctc

SEQ ID NO: 255899 - DNA, 25 bp, Mus musculus
gaggtcagggagaagccgcttataa

SEQ ID NO: 255900 - DNA, 25 bp, Mus musculus
gccagtcccgccagcctcgccagcc

SEQ ID NO: 255901 - DNA, 25 bp, Mus musculus
ggccatccgctgtgggcttagccac

SEQ ID NO: 255902 - DNA, 25 bp, Mus musculus
atccgctgtgggcttagccacccag

SEQ ID NO: 255903 - DNA, 25 bp, Mus musculus
tgtgggcttagccacccaggtaccc

SEQ ID NO: 255904 - DNA, 25 bp, Mus musculus
agccacccaggtacccagggcgtgt

SEQ ID NO: 255905 - DNA, 25 bp, Mus musculus
gcttataaattaccgcttcctccgc

SEQ ID NO: 255906 - DNA, 25 bp, Mus musculus
gggcgcttgtgcaccatggccctcg

SEQ ID NO: 255907 - DNA, 25 bp, Mus musculus
tcagtgaatggagaaagcgagcgcc

SEQ ID NO: 255908 - DNA, 25 bp, Mus musculus
tcggtacctgggcaccgtgagtgat

SEQ ID NO: 255909 - DNA, 25 bp, Mus musculus
gccaggcatcctcctctgggtgcgg

SEQ ID NO: 255910 - DNA, 25 bp, Mus musculus
cgcttgcgagcatcctgagcggacc

SEQ ID NO: 255911 - DNA, 25 bp, Mus musculus
cccgcaacgcagagcgcctgtgagt

SEQ ID NO: 255912 - DNA, 25 bp, Mus musculus
tggctcctacagagtcgccctcagg

SEQ ID NO: 255913 - DNA, 25 bp, Mus musculus
agggcgcaggtccttctttcctctc

SEQ ID NO: 255914 - DNA, 25 bp, Mus musculus
tgtcagacacgctcaataagttggg

SEQ ID NO: 255915 - DNA, 25 bp, Mus musculus
cgtagtgcctccctggttgagggca

SEQ ID NO: 255916 - DNA, 25 bp, Mus musculus
gggcttatccgctgacagatcggga

SEQ ID NO: 255917 - DNA, 25 bp, Mus musculus
acagatcgggagaataaagctagca

SEQ ID NO: 255918 - DNA, 25 bp, Mus musculus
cggtgtctaccctgctcagtgaatg

SEQ ID NO: 255919 - DNA, 25 bp, Mus musculus
ccgctagcgtggactgccacgggct

SEQ ID NO: 255920 - DNA, 25 bp, Mus musculus
ttaatggcccggatcctctgcggct

SEQ ID NO: 255921 - DNA, 25 bp, Mus musculus
aagcagggaccctcgtcagcgccag

SEQ ID NO: 255922 - DNA, 25 bp, Mus musculus
agctctgagcaaagcgcgcgtcccg

SEQ ID NO: 255923 - DNA, 25 bp, Mus musculus
cacgtggctgttaatggcccggatc

SEQ ID NO: 255924 - DNA, 25 bp, Mus musculus
cggtcctgtcgagctctgagcaaag

SEQ ID NO: 255925 - DNA, 25 bp, Mus musculus
ctcgtcagcgccagtctctttataa

SEQ ID NO: 255926 - DNA, 25 bp, Mus musculus
gtgcgcaccgcggtcctgtcgagct

SEQ ID NO: 255927 - DNA, 25 bp, Mus musculus
gggaagccaagcagggaccctcgtc

SEQ ID NO: 255928 - DNA, 25 bp, Mus musculus
tccggcagccgctgcaagcagagcg

SEQ ID NO: 255929 - DNA, 25 bp, Mus musculus
aagcagagcgcgaggttcctgcgcc

SEQ ID NO: 255930 - DNA, 25 bp, Mus musculus
gtctctttataacttgggctgctgc

SEQ ID NO: 255931 - DNA, 25 bp, Mus musculus
agagctctgtcggatcggggtccct

SEQ ID NO: 255932 - DNA, 25 bp, Mus musculus
ccgcgtcctaccttcgtccggcagc

SEQ ID NO: 255933 - DNA, 25 bp, Mus musculus
tgtcggatcggggtccctgcgctct

SEQ ID NO: 255934 - DNA, 25 bp, Mus musculus
ttggacgttacagcctcctcggtga

SEQ ID NO: 255935 - DNA, 25 bp, Mus musculus
ttgtcccacgcaagtcaggggcctg

SEQ ID NO: 255936 - DNA, 25 bp, Mus musculus
ggtgacctagttgttgtcccacgca

SEQ ID NO: 255937 - DNA, 25 bp, Mus musculus
cctccgcctgtctcagtcgagaatg

SEQ ID NO: 255938 - DNA, 25 bp, Mus musculus
cctcggtgagtacaagtgtggctta

SEQ ID NO: 255939 - DNA, 25 bp, Mus musculus
ctggactgcccatctgacaaggatc

SEQ ID NO: 255940 - DNA, 25 bp, Mus musculus
actcgtagggtctgactgaggccac

SEQ ID NO: 255941 - DNA, 25 bp, Mus musculus
gcaaactcagcgtccctatcaaaga

SEQ ID NO: 255942 - DNA, 25 bp, Mus musculus
aagatggcgccgaggtcgtaaatcc

SEQ ID NO: 255943 - DNA, 25 bp, Mus musculus
cgacgtagcgactagggacctcata

SEQ ID NO: 255944 - DNA, 25 bp, Mus musculus
atcaaagacacttccggttctgctg

SEQ ID NO: 255945 - DNA, 25 bp, Mus musculus
aggatcctgaactcggctccgccag

SEQ ID NO: 255946 - DNA, 25 bp, Mus musculus
ggacctcatactgacgctttcaaga

SEQ ID NO: 255947 - DNA, 25 bp, Mus musculus
ggtcgtaaatccaagtcgcaaaatg

SEQ ID NO: 255948 - DNA, 25 bp, Mus musculus
cagagcaggtaggagcccgcgccac

SEQ ID NO: 255949 - DNA, 25 bp, Mus musculus
gtcccacgcacctcgccgttgtccc

SEQ ID NO: 255950 - DNA, 25 bp, Mus musculus
ttcgggtgttctgtcccacgcacct

SEQ ID NO: 255951 - DNA, 25 bp, Mus musculus
cccagagttcgggtgttctgtccca

SEQ ID NO: 255952 - DNA, 25 bp, Mus musculus
ctagtagcccagagttcgggtgttc

SEQ ID NO: 255953 - DNA, 25 bp, Mus musculus
ccctctctagtagcccagagttcgg

SEQ ID NO: 255954 - DNA, 25 bp, Mus musculus
ccaccttccgcgctccggcggcagg

SEQ ID NO: 255955 - DNA, 25 bp, Mus musculus
atgcacagagcaggtaggagcccgc

SEQ ID NO: 255956 - DNA, 25 bp, Mus musculus
ctccgcggtggaagatgcacagagc

SEQ ID NO: 255957 - DNA, 25 bp, Mus musculus
agcacgcagcgaccagcctcgggct

SEQ ID NO: 255958 - DNA, 25 bp, Mus musculus
agtgggactccgactgaccgacccg

SEQ ID NO: 255959 - DNA, 25 bp, Mus musculus
cggcagtgggactccgactgaccga

SEQ ID NO: 255960 - DNA, 25 bp, Mus musculus
gcggcaggctctgcgagtggagctt

SEQ ID NO: 255961 - DNA, 25 bp, Mus musculus
ctgaccgacccgcacagcacgcagc

SEQ ID NO: 255962 - DNA, 25 bp, Mus musculus
gccggccgcagacacgggatctgct

SEQ ID NO: 255963 - DNA, 25 bp, Mus musculus
gcagggcacgacctcctgagtgacg

SEQ ID NO: 255964 - DNA, 25 bp, Mus musculus
acgacctcctgagtgacggccgggc

SEQ ID NO: 255965 - DNA, 25 bp, Mus musculus
gacggccgggctggccaatcgttcc

SEQ ID NO: 255966 - DNA, 25 bp, Mus musculus
ggctggccaatcgttcccccttata

SEQ ID NO: 255967 - DNA, 25 bp, Mus musculus
cccttataggagggccacggcctgc

SEQ ID NO: 255968 - DNA, 25 bp, Mus musculus
cgcctcacgcctggccctccgccag

SEQ ID NO: 255969 - DNA, 25 bp, Mus musculus
acaataacaaagcgcggtccctccg

SEQ ID NO: 255970 - DNA, 25 bp, Mus musculus
acacgggatctgctccgcggttgtg

SEQ ID NO: 255971 - DNA, 25 bp, Mus musculus
gcgcccgaccctgaggtaagagcaa

SEQ ID NO: 255972 - DNA, 25 bp, Mus musculus
accctgaggtaagagcaagcccgcc

SEQ ID NO: 255973 - DNA, 25 bp, Mus musculus
ccgcggaggctgaacgcggcctttt

SEQ ID NO: 255974 - DNA, 25 bp, Mus musculus
tgaacgcggccttttacctttgcca

SEQ ID NO: 255975 - DNA, 25 bp, Mus musculus
ccggcctgcccgcttcttcctgtgt

SEQ ID NO: 255976 - DNA, 25 bp, Mus musculus
tcacagactccttgaataccacgtc

SEQ ID NO: 255977 - DNA, 25 bp, Mus musculus
atccctccggtggaggagcactcgg

SEQ ID NO: 255978 - DNA, 25 bp, Mus musculus
tttctatcggggatcagtcgggatg

SEQ ID NO: 255979 - DNA, 25 bp, Mus musculus
gatcagtcgggatgccctccactgc

SEQ ID NO: 255980 - DNA, 25 bp, Mus musculus
cactgcctcagcttctttcactgaa

SEQ ID NO: 255981 - DNA, 25 bp, Mus musculus
agggctgtgacccacactgacctgg

SEQ ID NO: 255982 - DNA, 25 bp, Mus musculus
agttcacggtcatgatcttcacaga

SEQ ID NO: 255983 - DNA, 25 bp, Mus musculus
cgcgacccaggtactgcagcgtacg

SEQ ID NO: 255984 - DNA, 25 bp, Mus musculus
agcgacccttcatcggcatggtgga

SEQ ID NO: 255985 - DNA, 25 bp, Mus musculus
gcatggtggaagtcaggaactcctc

SEQ ID NO: 255986 - DNA, 25 bp, Mus musculus
aggaactcctcaagccgcggaccag

SEQ ID NO: 255987 - DNA, 25 bp, Mus musculus
gctccgggaatcttgggaggcactt

SEQ ID NO: 255988 - DNA, 25 bp, Mus musculus
agcactcgggtttctatcggggatc

SEQ ID NO: 255989 - DNA, 25 bp, Mus musculus
cccatacgtgttgtagttcacggtc

SEQ ID NO: 255990 - DNA, 25 bp, Mus musculus
ggacgcgactctgcgggacatcacg

SEQ ID NO: 255991 - DNA, 25 bp, Mus musculus
tgaacctggaagaggatgctgcgca

SEQ ID NO: 255992 - DNA, 25 bp, Mus musculus
cgagcgcactgaacctggaagagga

SEQ ID NO: 255993 - DNA, 25 bp, Mus musculus
agcgccgagtcctcgagcgcactga

SEQ ID NO: 255994 - DNA, 25 bp, Mus musculus
agacagactgacacgcggcggtcga

SEQ ID NO: 255995 - DNA, 25 bp, Mus musculus
gggcagaaaccggaagacagactga

SEQ ID NO: 255996 - DNA, 25 bp, Mus musculus
ccatcagtggctcggcgctcgacag

SEQ ID NO: 255997 - DNA, 25 bp, Mus musculus
agtggcagccatcgccatcagtggc

SEQ ID NO: 255998 - DNA, 25 bp, Mus musculus
tcctcagagaccagtggcagccatc

SEQ ID NO: 255999 - DNA, 25 bp, Mus musculus
tgccggcctacgaggttcctcagag

SEQ ID NO: 256000 - DNA, 25 bp, Mus musculus
acctcgggttctgactgccggccta

SEQ ID NO: 256001 - DNA, 25 bp, Mus musculus
gcctttccacctcgggttctgactg

SEQ ID NO: 256002 - DNA, 25 bp, Mus musculus
aggcagtcggcagcctgcctttcca

SEQ ID NO: 256003 - DNA, 25 bp, Mus musculus
ggacatcacgcaacacgtcacggcg

SEQ ID NO: 256004 - DNA, 25 bp, Mus musculus
cctccgggaataatggatgagcctg

SEQ ID NO: 256005 - DNA, 25 bp, Mus musculus
agaaatgcagtttgtcctccgggaa

SEQ ID NO: 256006 - DNA, 25 bp, Mus musculus
gcgccagcagcagacgcttccttgt

SEQ ID NO: 256007 - DNA, 25 bp, Mus musculus
ggtgcggcagtacccaagccggacc

SEQ ID NO: 256008 - DNA, 25 bp, Mus musculus
aagccggaccggtcatcattcacta

SEQ ID NO: 256009 - DNA, 25 bp, Mus musculus
cctgcgcggtcaggcaaagtcaccg

SEQ ID NO: 256010 - DNA, 25 bp, Mus musculus
gcagaagccactccggcaggcggca

SEQ ID NO: 256011 - DNA, 25 bp, Mus musculus
gtcggggacacacagcagacactca

SEQ ID NO: 256012 - DNA, 25 bp, Mus musculus
ggtcgcacagctcgggtgtgaactc

SEQ ID NO: 256013 - DNA, 25 bp, Mus musculus
acagcagacactcatccgggcaggg

SEQ ID NO: 256014 - DNA, 25 bp, Mus musculus
ctcctcccggagagccaaagggatg

SEQ ID NO: 256015 - DNA, 25 bp, Mus musculus
ccaaagggatgcatcggcgccagca

SEQ ID NO: 256016 - DNA, 25 bp, Mus musculus
ggacttgtggccactcaccgttcga

SEQ ID NO: 256017 - DNA, 25 bp, Mus musculus
tctttggaagaacgtgagaaatgca

SEQ ID NO: 256018 - DNA, 25 bp, Mus musculus
cgagcggcgggacagtcttttccgc

SEQ ID NO: 256019 - DNA, 25 bp, Mus musculus
tcccgcctggttcgggagagcacgt

SEQ ID NO: 256020 - DNA, 25 bp, Mus musculus
tagctgtcccgcctggttcgggaga

SEQ ID NO: 256021 - DNA, 25 bp, Mus musculus
agccgggcggtctccgcctagctgt

SEQ ID NO: 256022 - DNA, 25 bp, Mus musculus
tcggttgaatgtgtccgcgctgcag

SEQ ID NO: 256023 - DNA, 25 bp, Mus musculus
agcgctgtcggttgaatgtgtccgc

SEQ ID NO: 256024 - DNA, 25 bp, Mus musculus
ccgcacgcagcgctgtcggttgaat

SEQ ID NO: 256025 - DNA, 25 bp, Mus musculus
tccggctgaacatggccgggcgctt

SEQ ID NO: 256026 - DNA, 25 bp, Mus musculus
cgggacagtcttttccgcgagctcc

SEQ ID NO: 256027 - DNA, 25 bp, Mus musculus
tacctggggccacaggtgcgcggcc

SEQ ID NO: 256028 - DNA, 25 bp, Mus musculus
gcctggttcgggagagcacgtttcc

SEQ ID NO: 256029 - DNA, 25 bp, Mus musculus
ctcgggtggaggacactcaccgagc

SEQ ID NO: 256030 - DNA, 25 bp, Mus musculus
ggacagtcttttccgcgagctccgg

SEQ ID NO: 256031 - DNA, 25 bp, Mus musculus
cggggccagcttacctggggccaca

SEQ ID NO: 256032 - DNA, 25 bp, Mus musculus
ctgccgccaactttttgactttagg

SEQ ID NO: 256033 - DNA, 25 bp, Mus musculus
ataccctaggtgcacgcctccagga

SEQ ID NO: 256034 - DNA, 25 bp, Mus musculus
cgcgggcgctcaaataccctaggtg

SEQ ID NO: 256035 - DNA, 25 bp, Mus musculus
ttagccgagccgcttcttgaatggg

SEQ ID NO: 256036 - DNA, 25 bp, Mus musculus
gccctttgctggctgagttagccga

SEQ ID NO: 256037 - DNA, 25 bp, Mus musculus
gcggctcggccgcataatgtccagc

SEQ ID NO: 256038 - DNA, 25 bp, Mus musculus
ttgactttaggagtcgctgaggtcc

SEQ ID NO: 256039 - DNA, 25 bp, Mus musculus
tactaactgcatggtgctcctcacc

SEQ ID NO: 256040 - DNA, 25 bp, Mus musculus
agtgtggcccaggatactaactgca

SEQ ID NO: 256041 - DNA, 25 bp, Mus musculus
caccaggagcgttagcagtgtggcc

SEQ ID NO: 256042 - DNA, 25 bp, Mus musculus
atctcaaccaggtccggcaccagga

SEQ ID NO: 256043 - DNA, 25 bp, Mus musculus
gtcagggctcctcatctcaaccagg

SEQ ID NO: 256044 - DNA, 25 bp, Mus musculus
ggtgccaggactcaccgctttaggc

SEQ ID NO: 256045 - DNA, 25 bp, Mus musculus
gtctgcgctccgctgagcaacgctg

SEQ ID NO: 256046 - DNA, 25 bp, Mus musculus
ttttgtccagtgaccgctctcgcct

SEQ ID NO: 256047 - DNA, 25 bp, Mus musculus
ctcgcttttcggcatgttgtgatga

SEQ ID NO: 256048 - DNA, 25 bp, Mus musculus
tgttgccttttggatccttcgcgtg

SEQ ID NO: 256049 - DNA, 25 bp, Mus musculus
ttctagaagttccattccaggtgtg

SEQ ID NO: 256050 - DNA, 25 bp, Mus musculus
ttgaaccattggtggctgtccgctc

SEQ ID NO: 256051 - DNA, 25 bp, Mus musculus
cggtgacctcctctttgaaccattg

SEQ ID NO: 256052 - DNA, 25 bp, Mus musculus
atgcttctcccttctttccaaagtg

SEQ ID NO: 256053 - DNA, 25 bp, Mus musculus
cctctcgggagatatctctcttctc

SEQ ID NO: 256054 - DNA, 25 bp, Mus musculus
tgaacgctctcgcttcctctcggga

SEQ ID NO: 256055 - DNA, 25 bp, Mus musculus
actccaaggctggatgcggtctgtg

SEQ ID NO: 256056 - DNA, 25 bp, Mus musculus
cggctcggggagctatcttttctcc

SEQ ID NO: 256057 - DNA, 25 bp, Mus musculus
atccaggagtctttcgagggacctc

SEQ ID NO: 256058 - DNA, 25 bp, Mus musculus
ggggaccgtctttgatccaggagtc

SEQ ID NO: 256059 - DNA, 25 bp, Mus musculus
tcctgtcggtggatttggctctcct

SEQ ID NO: 256060 - DNA, 25 bp, Mus musculus
ctcttcttcgatctgggctatgata

SEQ ID NO: 256061 - DNA, 25 bp, Mus musculus
cctcggcgagatattgtgttcatga

SEQ ID NO: 256062 - DNA, 25 bp, Mus musculus
tctctggcgagctgtaccgccgagc

SEQ ID NO: 256063 - DNA, 25 bp, Mus musculus
cttggtgctactgcaggagtacttc

SEQ ID NO: 256064 - DNA, 25 bp, Mus musculus
cttctggcgaaaggtggaagctttc

SEQ ID NO: 256065 - DNA, 25 bp, Mus musculus
gtgcggccgggtgccaccttcatca

SEQ ID NO: 256066 - DNA, 25 bp, Mus musculus
ttccactatgaggaagtgcgcgggc

SEQ ID NO: 256067 - DNA, 25 bp, Mus musculus
ccaatggccgaaacgacttccacta

SEQ ID NO: 256068 - DNA, 25 bp, Mus musculus
cggccagaagcacgagctcaagttc

SEQ ID NO: 256069 - DNA, 25 bp, Mus musculus
tcctgttccgcttcggccagaagca

SEQ ID NO: 256070 - DNA, 25 bp, Mus musculus
gcagcacactgctcaacatcctgtt

SEQ ID NO: 256071 - DNA, 25 bp, Mus musculus
tgttcatgaagacgcacaagaccgc

SEQ ID NO: 256072 - DNA, 25 bp, Mus musculus
ggctcagcaggagggtgtcaacctc

SEQ ID NO: 256073 - DNA, 25 bp, Mus musculus
tatttcaagctcaatgcgcggcgcg

SEQ ID NO: 256074 - DNA, 25 bp, Mus musculus
ctcgcgctctcaagccatcataaaa

SEQ ID NO: 256075 - DNA, 25 bp, Mus musculus
gaagggagagattccaacgcgcctc

SEQ ID NO: 256076 - DNA, 25 bp, Mus musculus
ggctcggcttgttttgttacagttc

SEQ ID NO: 256077 - DNA, 25 bp, Mus musculus
cgcccgcgagctttgtttgcattcc

SEQ ID NO: 256078 - DNA, 25 bp, Mus musculus
tacagttcattctactccgcgcggc

SEQ ID NO: 256079 - DNA, 25 bp, Mus musculus
gggctcacgggagaagcatctctcg

SEQ ID NO: 256080 - DNA, 25 bp, Mus musculus
cttcttctggatcactttcgacatg

SEQ ID NO: 256081 - DNA, 25 bp, Mus musculus
ttcctcctcttgcagtgtggtcggc

SEQ ID NO: 256082 - DNA, 25 bp, Mus musculus
aacacgtgtgcttgcccgactccag

SEQ ID NO: 256083 - DNA, 25 bp, Mus musculus
ccagctctcgaacttttggaacaca

SEQ ID NO: 256084 - DNA, 25 bp, Mus musculus
tagggccgacccttcattgacgcca

SEQ ID NO: 256085 - DNA, 25 bp, Mus musculus
ggagaccaattcagcgcggggctca

SEQ ID NO: 256086 - DNA, 25 bp, Mus musculus
gcggggctcacactcttgctgccta

SEQ ID NO: 256087 - DNA, 25 bp, Mus musculus
tttccaagctagttgccgggagccc

SEQ ID NO: 256088 - DNA, 25 bp, Mus musculus
gcccagctctttaagtcagcacctg

SEQ ID NO: 256089 - DNA, 25 bp, Mus musculus
aggctcttgcctagcgcctccggag

SEQ ID NO: 256090 - DNA, 25 bp, Mus musculus
cagggtcctccaggaaaggctcagc

SEQ ID NO: 256091 - DNA, 25 bp, Mus musculus
gaaaggctcagcgaccagcaccgag

SEQ ID NO: 256092 - DNA, 25 bp, Mus musculus
accgagcgacgcacgtgcttttgtt

SEQ ID NO: 256093 - DNA, 25 bp, Mus musculus
tggtgtgacgtcacgagttctgccc

SEQ ID NO: 256094 - DNA, 25 bp, Mus musculus
gaagtagttgctccatatcccgccc

SEQ ID NO: 256095 - DNA, 25 bp, Mus musculus
gcccagcttgtgatttttaaccttg

SEQ ID NO: 256096 - DNA, 25 bp, Mus musculus
cttgtgatttttaaccttggcggcg

SEQ ID NO: 256097 - DNA, 25 bp, Mus musculus
tcacggcctcgctggtggtgagtac

SEQ ID NO: 256098 - DNA, 25 bp, Mus musculus
tgccgctttcttccgggtttaagca

SEQ ID NO: 256099 - DNA, 25 bp, Mus musculus
gtctttcgtagatcccatccggggc

SEQ ID NO: 256100 - DNA, 25 bp, Mus musculus
ggccacaggcttgtgcgaggctctt

SEQ ID NO: 256101 - DNA, 25 bp, Mus musculus
tcagcacctgcttttgcccagcttg

SEQ ID NO: 256102 - DNA, 25 bp, Mus musculus
ccatcttgtctggaacgcgccgcga

SEQ ID NO: 256103 - DNA, 25 bp, Mus musculus
tgcccgttgctcattggctcctgga

SEQ ID NO: 256104 - DNA, 25 bp, Mus musculus
gctgcagggctacagcattacgccc

SEQ ID NO: 256105 - DNA, 25 bp, Mus musculus
cgtgcctcagcgctgcgaacaatca

SEQ ID NO: 256106 - DNA, 25 bp, Mus musculus
ctgagctgatgatagccgtggaccc

SEQ ID NO: 256107 - DNA, 25 bp, Mus musculus
tgaaaacgcttagcctcggcctctg

SEQ ID NO: 256108 - DNA, 25 bp, Mus musculus
ggcgaactctgtggagtcccgcagt

SEQ ID NO: 256109 - DNA, 25 bp, Mus musculus
tgactccggccattgcagtagcagc

SEQ ID NO: 256110 - DNA, 25 bp, Mus musculus
atactcacaggctgcgcgtccagga

SEQ ID NO: 256111 - DNA, 25 bp, Mus musculus
cggacgagaggcaaaggcgatactc

SEQ ID NO: 256112 - DNA, 25 bp, Mus musculus
cgtcttagtgacagcgcccggacga

SEQ ID NO: 256113 - DNA, 25 bp, Mus musculus
cgcctctgaggactgaaaacgctta

SEQ ID NO: 256114 - DNA, 25 bp, Mus musculus
ctgagagtcgccttcagagctcggg

SEQ ID NO: 256115 - DNA, 25 bp, Mus musculus
ggcatctcactgagggcgctgagct

SEQ ID NO: 256116 - DNA, 25 bp, Mus musculus
tgcatctcaaggcacaggctggcgg

SEQ ID NO: 256117 - DNA, 25 bp, Mus musculus
acccacgatgccgtaaactggcttc

SEQ ID NO: 256118 - DNA, 25 bp, Mus musculus
tcctgtgcccacacacggacgtttg

SEQ ID NO: 256119 - DNA, 25 bp, Mus musculus
tcctagagcctgtgtcggcgctcct

SEQ ID NO: 256120 - DNA, 25 bp, Mus musculus
gcccttgttgagctctcggctccta

SEQ ID NO: 256121 - DNA, 25 bp, Mus musculus
ctgggaacttgttcgcccttgttga

SEQ ID NO: 256122 - DNA, 25 bp, Mus musculus
aacccgggagcgagcgaaacgcaat

SEQ ID NO: 256123 - DNA, 25 bp, Mus musculus
caacgcttagcagagccggaacccg

SEQ ID NO: 256124 - DNA, 25 bp, Mus musculus
accctcattggctaggcaacgctta

SEQ ID NO: 256125 - DNA, 25 bp, Mus musculus
tgaccaatcagagccaggtattttg

SEQ ID NO: 256126 - DNA, 25 bp, Mus musculus
ggtaatcgcgcactgaccaatcaga

SEQ ID NO: 256127 - DNA, 25 bp, Mus musculus
tacatttcccgacgcgctggtaatc

SEQ ID NO: 256128 - DNA, 25 bp, Mus musculus
ggcctctgtccgactaggagcacgc

SEQ ID NO: 256129 - DNA, 25 bp, Mus musculus
aatagaaatgctcggcttgggcctc

SEQ ID NO: 256130 - DNA, 25 bp, Mus musculus
cagagccagtaagcggctgagaaac

SEQ ID NO: 256131 - DNA, 25 bp, Mus musculus
ccattagaacgatccgggtcgtggg

SEQ ID NO: 256132 - DNA, 25 bp, Mus musculus
agcggctgagaaacctctgcgttcc

SEQ ID NO: 256133 - DNA, 25 bp, Mus musculus
gaaacctctgcgttccaacagtgcg

SEQ ID NO: 256134 - DNA, 25 bp, Mus musculus
gcgttccaacagtgcgcccaacttt

SEQ ID NO: 256135 - DNA, 25 bp, Mus musculus
tgcgcccaacttttgggaactcgcc

SEQ ID NO: 256136 - DNA, 25 bp, Mus musculus
caaggctgatgggagccattagaac

SEQ ID NO: 256137 - DNA, 25 bp, Mus musculus
ctgatgggagccattagaacgatcc

SEQ ID NO: 256138 - DNA, 25 bp, Mus musculus
gggagccattagaacgatccgggtc

SEQ ID NO: 256139 - DNA, 25 bp, Mus musculus
agaagcttcccagcctgcgccgcga

SEQ ID NO: 256140 - DNA, 25 bp, Mus musculus
gcagcgctcgctctcgcagaagctt

SEQ ID NO: 256141 - DNA, 25 bp, Mus musculus
acctgaccgccaggagcggccgcag

SEQ ID NO: 256142 - DNA, 25 bp, Mus musculus
agcgagctcgggcttagagccgccc

SEQ ID NO: 256143 - DNA, 25 bp, Mus musculus
cccgacacctcggacgccgcacagc

SEQ ID NO: 256144 - DNA, 25 bp, Mus musculus
gcgccgaagtggcaatcctgctgtg

SEQ ID NO: 256145 - DNA, 25 bp, Mus musculus
tcctccggttgtctgcggaacgtca

SEQ ID NO: 256146 - DNA, 25 bp, Mus musculus
agctgtcttaggagacgctcggctc

SEQ ID NO: 256147 - DNA, 25 bp, Mus musculus
ctcggctcccaggtgtgcctggaga

SEQ ID NO: 256148 - DNA, 25 bp, Mus musculus
gtgtgcctggagaagccactccgcc

SEQ ID NO: 256149 - DNA, 25 bp, Mus musculus
cccagcatggggatcgaggcaacag

SEQ ID NO: 256150 - DNA, 25 bp, Mus musculus
tggctgggcatctccctagcctaca

SEQ ID NO: 256151 - DNA, 25 bp, Mus musculus
tacagccaccgatcaactcctggta

SEQ ID NO: 256152 - DNA, 25 bp, Mus musculus
tcctggtaaccagctgaaggccgcg

SEQ ID NO: 256153 - DNA, 25 bp, Mus musculus
agtcccagagtcaggctgcgggccc

SEQ ID NO: 256154 - DNA, 25 bp, Mus musculus
acctgcagcttgactagggagcggc

SEQ ID NO: 256155 - DNA, 25 bp, Mus musculus
cagcttgggagtaacgagacgtcac

SEQ ID NO: 256156 - DNA, 25 bp, Mus musculus
gtaacgagacgtcaccgccggcagc

SEQ ID NO: 256157 - DNA, 25 bp, Mus musculus
caatcctgctgtggcgatcctccgg

SEQ ID NO: 256158 - DNA, 25 bp, Mus musculus
accctgtcgatggacttctgggcct

SEQ ID NO: 256159 - DNA, 25 bp, Mus musculus
gttctcaactgagggacgcgatctg

SEQ ID NO: 256160 - DNA, 25 bp, Mus musculus
tctgggcttcatggccgttctcaac

SEQ ID NO: 256161 - DNA, 25 bp, Mus musculus
ttaccagccgcctctgggcttcatg

SEQ ID NO: 256162 - DNA, 25 bp, Mus musculus
cggagcggagcccttagttaccagc

SEQ ID NO: 256163 - DNA, 25 bp, Mus musculus
cggtagcgtgaagccacatccggga

SEQ ID NO: 256164 - DNA, 25 bp, Mus musculus
cgagttccgcccagacggaaggacg

SEQ ID NO: 256165 - DNA, 25 bp, Mus musculus
caaccaccagatccgggagccgagt

SEQ ID NO: 256166 - DNA, 25 bp, Mus musculus
gctgcgagccttccgcacagctgag

SEQ ID NO: 256167 - DNA, 25 bp, Mus musculus
ctggatgtccaggaccctgtcgatg

SEQ ID NO: 256168 - DNA, 25 bp, Mus musculus
cctgcttggcgaagctggacaactg

SEQ ID NO: 256169 - DNA, 25 bp, Mus musculus
agacctccgggagcgaccagagccg

SEQ ID NO: 256170 - DNA, 25 bp, Mus musculus
agccgcgtgtgcctcgctataatcc

SEQ ID NO: 256171 - DNA, 25 bp, Mus musculus
ctgcgaggcattgaaccagctcatg

SEQ ID NO: 256172 - DNA, 25 bp, Mus musculus
ctcactaatggccacgctcggggaa

SEQ ID NO: 256173 - DNA, 25 bp, Mus musculus
ggtttctgtagttgccactccaaga

SEQ ID NO: 256174 - DNA, 25 bp, Mus musculus
ccggttgacgtcatcgctgcagaca

SEQ ID NO: 256175 - DNA, 25 bp, Mus musculus
tcaggcgccaaagtggagccttttt

SEQ ID NO: 256176 - DNA, 25 bp, Mus musculus
cgccatattggaagggacaaaactc

SEQ ID NO: 256177 - DNA, 25 bp, Mus musculus
tccggcgacagcgagtgacacaaat

SEQ ID NO: 256178 - DNA, 25 bp, Mus musculus
tttctcacggtaactggcagcctcg

SEQ ID NO: 256179 - DNA, 25 bp, Mus musculus
cctctgacggactgtgcctttgaca

SEQ ID NO: 256180 - DNA, 25 bp, Mus musculus
cctttgacagtgattgagcagcttc

SEQ ID NO: 256181 - DNA, 25 bp, Mus musculus
agcagcttccgatggacctacggga

SEQ ID NO: 256182 - DNA, 25 bp, Mus musculus
ccgcgctacttttttcaggctgtga

SEQ ID NO: 256183 - DNA, 25 bp, Mus musculus
gcggggcacagcaaacacagttgtt

SEQ ID NO: 256184 - DNA, 25 bp, Mus musculus
tttcccagaataccgcggagatccg

SEQ ID NO: 256185 - DNA, 25 bp, Mus musculus
tactgcatggagatgacgacactgc

SEQ ID NO: 256186 - DNA, 25 bp, Mus musculus
cggcaaaatcccgatacttacggct

SEQ ID NO: 256187 - DNA, 25 bp, Mus musculus
gcaaaatcccgatacttacggctcc

SEQ ID NO: 256188 - DNA, 25 bp, Mus musculus
aaatcccgatacttacggctcctcg

SEQ ID NO: 256189 - DNA, 25 bp, Mus musculus
cgctccggcaaaatcccgatactta

SEQ ID NO: 256190 - DNA, 25 bp, Mus musculus
gatacttacggctcctcgccatccg

SEQ ID NO: 256191 - DNA, 25 bp, Mus musculus
gctcctcgccatccgccatattgtt

SEQ ID NO: 256192 - DNA, 25 bp, Mus musculus
ctccggcaaaatcccgatacttacg

SEQ ID NO: 256193 - DNA, 25 bp, Mus musculus
ggcgctccggcaaaatcccgatact

SEQ ID NO: 256194 - DNA, 25 bp, Mus musculus
tcggcgctccggcaaaatcccgata

SEQ ID NO: 256195 - DNA, 25 bp, Mus musculus
acaacccagcccaactcggcgctcc

SEQ ID NO: 256196 - DNA, 25 bp, Mus musculus
accgccgcgctctctcacaacccag

SEQ ID NO: 256197 - DNA, 25 bp, Mus musculus
ctggcagcggtgactgcccaccgcc

SEQ ID NO: 256198 - DNA, 25 bp, Mus musculus
gcggtgactgcccaccgccgcgctc

SEQ ID NO: 256199 - DNA, 25 bp, Mus musculus
gcgctccggcaaaatcccgatactt

SEQ ID NO: 256200 - DNA, 25 bp, Mus musculus
tccgtgcctgggacgatttcttccc

SEQ ID NO: 256201 - DNA, 25 bp, Mus musculus
ctgtcatctttcatccagctggttg

SEQ ID NO: 256202 - DNA, 25 bp, Mus musculus
cctccagattccgaaggcgaagctc

SEQ ID NO: 256203 - DNA, 25 bp, Mus musculus
gaaggacccgctgtcatctttcatc

SEQ ID NO: 256204 - DNA, 25 bp, Mus musculus
agaaccaatccgaaggacccgctgt

SEQ ID NO: 256205 - DNA, 25 bp, Mus musculus
tgctttaaccgcagaaccaatccga

SEQ ID NO: 256206 - DNA, 25 bp, Mus musculus
tgagccctgccgtgctttaaccgca

SEQ ID NO: 256207 - DNA, 25 bp, Mus musculus
gggctctgatcgtttcgcccggccg

SEQ ID NO: 256208 - DNA, 25 bp, Mus musculus
tctttcatccagctggttgtcgctg

SEQ ID NO: 256209 - DNA, 25 bp, Mus musculus
gggacgatttcttcccgggctctga

SEQ ID NO: 256210 - DNA, 25 bp, Mus musculus
aggaacatggacgtgaacctcgccc

SEQ ID NO: 256211 - DNA, 25 bp, Mus musculus
ccgaaggcgaagctcgcgaagcaga

SEQ ID NO: 256212 - DNA, 25 bp, Mus musculus
tcgcgaagcagaggaacatggacgt

SEQ ID NO: 256213 - DNA, 25 bp, Mus musculus
agccaattttctgagccctgccgtg

SEQ ID NO: 256214 - DNA, 25 bp, Mus musculus
atgtcttccagtgcacggacggctc

SEQ ID NO: 256215 - DNA, 25 bp, Mus musculus
agagacacttggaatgtggctgccg

SEQ ID NO: 256216 - DNA, 25 bp, Mus musculus
cggacggctcctcattcgtggaaga

SEQ ID NO: 256217 - DNA, 25 bp, Mus musculus
aggtgcccatcatggaatgccgcgg

SEQ ID NO: 256218 - DNA, 25 bp, Mus musculus
tcctcattcgtggaagaggtggaga

SEQ ID NO: 256219 - DNA, 25 bp, Mus musculus
cggcgtccaaggtgcccatcatgga

SEQ ID NO: 256220 - DNA, 25 bp, Mus musculus
cggcggaaatatgtcttccagtgca

SEQ ID NO: 256221 - DNA, 25 bp, Mus musculus
cgtgaagccatccgccgccagaaag

SEQ ID NO: 256222 - DNA, 25 bp, Mus musculus
gccgccagaaagactacgcctcttg

SEQ ID NO: 256223 - DNA, 25 bp, Mus musculus
aagactacgcctcttgtgccacggc

SEQ ID NO: 256224 - DNA, 25 bp, Mus musculus
cctcttgtgccacggcgtccaaggt

SEQ ID NO: 256225 - DNA, 25 bp, Mus musculus
gtgctgccagccgattcgaagcaag

SEQ ID NO: 256226 - DNA, 25 bp, Mus musculus
cgattcgaagcaagcggcggaaata

SEQ ID NO: 256227 - DNA, 25 bp, Mus musculus
agcaagcggcggaaatatgtcttcc

SEQ ID NO: 256228 - DNA, 25 bp, Mus musculus
cagccaacggctgcgactggcacgg

SEQ ID NO: 256229 - DNA, 25 bp, Mus musculus
gtcctcagttgagcgccgggcatcc

SEQ ID NO: 256230 - DNA, 25 bp, Mus musculus
gactggcacggaggctgtgtcaccc

SEQ ID NO: 256231 - DNA, 25 bp, Mus musculus
gcctttcactgtgtgtcccggccag

SEQ ID NO: 256232 - DNA, 25 bp, Mus musculus
gatctgccactgaactcgcctttca

SEQ ID NO: 256233 - DNA, 25 bp, Mus musculus
tcgccacgctctgctgtagctgaca

SEQ ID NO: 256234 - DNA, 25 bp, Mus musculus
ggattccgcgatcctgggctcgcca

SEQ ID NO: 256235 - DNA, 25 bp, Mus musculus
gctgctttccctcggagcctggatt

SEQ ID NO: 256236 - DNA, 25 bp, Mus musculus
tccgcacatgaacaccgaagccatg

SEQ ID NO: 256237 - DNA, 25 bp, Mus musculus
ggctgccgctgaacagcaggtcctc

SEQ ID NO: 256238 - DNA, 25 bp, Mus musculus
ggtcaagttccacacgaagcggctg

SEQ ID NO: 256239 - DNA, 25 bp, Mus musculus
ccgcagcgtggacacggtcaagttc

SEQ ID NO: 256240 - DNA, 25 bp, Mus musculus
ctcggtgtaccatctccgcagcgtg

SEQ ID NO: 256241 - DNA, 25 bp, Mus musculus
acgtccgcagcacctggtggcaagc

SEQ ID NO: 256242 - DNA, 25 bp, Mus musculus
gtccaacgcggcgtgttctcaaacc

SEQ ID NO: 256243 - DNA, 25 bp, Mus musculus
ctggcccggtatccttaccaggata

SEQ ID NO: 256244 - DNA, 25 bp, Mus musculus
tctgcagcagctgtcttcctctcgg

SEQ ID NO: 256245 - DNA, 25 bp, Mus musculus
gctactttattgtctgcgttgcgca

SEQ ID NO: 256246 - DNA, 25 bp, Mus musculus
gctgttgtcgccttgctactttatt

SEQ ID NO: 256247 - DNA, 25 bp, Mus musculus
tgggacagtcgcctacctacctgct

SEQ ID NO: 256248 - DNA, 25 bp, Mus musculus
agcgcgctctgataatcctgggaca

SEQ ID NO: 256249 - DNA, 25 bp, Mus musculus
ctaatgtggaacctcggcctccttc

SEQ ID NO: 256250 - DNA, 25 bp, Mus musculus
gcgcactctgcgctcctaatgtgga

SEQ ID NO: 256251 - DNA, 25 bp, Mus musculus
caggctgaaccagcccgggagcttt

SEQ ID NO: 256252 - DNA, 25 bp, Mus musculus
ctaggaactccagtccaggctgaac

SEQ ID NO: 256253 - DNA, 25 bp, Mus musculus
gagcggcgccaagtgcctaggaact

SEQ ID NO: 256254 - DNA, 25 bp, Mus musculus
gctgttccggcccagtcattgtatc

SEQ ID NO: 256255 - DNA, 25 bp, Mus musculus
tacactgccagagccaccaaagagc

SEQ ID NO: 256256 - DNA, 25 bp, Mus musculus
caggctgtgcctttcctcgaaaacc

SEQ ID NO: 256257 - DNA, 25 bp, Mus musculus
cggcaggtgaaaccgacgctcggcc

SEQ ID NO: 256258 - DNA, 25 bp, Mus musculus
ccgcggtgaactttcacttcacgtc

SEQ ID NO: 256259 - DNA, 25 bp, Mus musculus
gcgccaggctgtgcctttcctcgaa

SEQ ID NO: 256260 - DNA, 25 bp, Mus musculus
ctctgggctaccgagcaggcttgcg

SEQ ID NO: 256261 - DNA, 25 bp, Mus musculus
agctgctctgggctaccgagcaggc

SEQ ID NO: 256262 - DNA, 25 bp, Mus musculus
gcgccctccgccaaggaagcctaca

SEQ ID NO: 256263 - DNA, 25 bp, Mus musculus
gagttgtgctaaccttccgggacgc

SEQ ID NO: 256264 - DNA, 25 bp, Mus musculus
cttcgaaactgacaaagagttgtgc

SEQ ID NO: 256265 - DNA, 25 bp, Mus musculus
cttgtttgtttcctcttcgaaactg

SEQ ID NO: 256266 - DNA, 25 bp, Mus musculus
cgctgcccagccggctttggggaaa

SEQ ID NO: 256267 - DNA, 25 bp, Mus musculus
ggtgacccctctcgggctgacgtct

SEQ ID NO: 256268 - DNA, 25 bp, Mus musculus
ctctttaattgctgttaacccggtg

SEQ ID NO: 256269 - DNA, 25 bp, Mus musculus
ctgacaaagagttgtgctaaccttc

SEQ ID NO: 256270 - DNA, 25 bp, Mus musculus
ttcggaccaaaacacgcgtggctgc

SEQ ID NO: 256271 - DNA, 25 bp, Mus musculus
atcaaagtttccgagcgcagcaggg

SEQ ID NO: 256272 - DNA, 25 bp, Mus musculus
agctggcaaactcctcggctctcgg

SEQ ID NO: 256273 - DNA, 25 bp, Mus musculus
ctccgagggacaggaacggaatatc

SEQ ID NO: 256274 - DNA, 25 bp, Mus musculus
gcgcgtgtcgcagagaagagcttaa

SEQ ID NO: 256275 - DNA, 25 bp, Mus musculus
tagagagcgtccacaccgctgagtt

SEQ ID NO: 256276 - DNA, 25 bp, Mus musculus
ttatgcaaatagacccaagggtgcg

SEQ ID NO: 256277 - DNA, 25 bp, Mus musculus
aaggggcacgcacccttggatagca

SEQ ID NO: 256278 - DNA, 25 bp, Mus musculus
ctttgagctcaggagatgatgccac

SEQ ID NO: 256279 - DNA, 25 bp, Mus musculus
ggcggccaccaaacgctgacactgg

SEQ ID NO: 256280 - DNA, 25 bp, Mus musculus
actcaaagttgcgacaggcggcctg

SEQ ID NO: 256281 - DNA, 25 bp, Mus musculus
gcctgggcttattgatcgctctacc

SEQ ID NO: 256282 - DNA, 25 bp, Mus musculus
tctacccgagcgactcaagcgagtg

SEQ ID NO: 256283 - DNA, 25 bp, Mus musculus
aagcccactcgcgatcttgctacgg

SEQ ID NO: 256284 - DNA, 25 bp, Mus musculus
gaactctgctgcgtccgcgcgagct

SEQ ID NO: 256285 - DNA, 25 bp, Mus musculus
gccttgtcgagaggctcgttagccc

SEQ ID NO: 256286 - DNA, 25 bp, Mus musculus
cgccggccgatttttctgactgctg

SEQ ID NO: 256287 - DNA, 25 bp, Mus musculus
accggagcgcctagtagtctcccgg

SEQ ID NO: 256288 - DNA, 25 bp, Mus musculus
agaccagccgggactccctgcccag

SEQ ID NO: 256289 - DNA, 25 bp, Mus musculus
cagcgccatgttctccgccggccag

SEQ ID NO: 256290 - DNA, 25 bp, Mus musculus
ggcaacgcggacagagccttgtcga

SEQ ID NO: 256291 - DNA, 25 bp, Mus musculus
tccagccagaaggtccagggcgagt

SEQ ID NO: 256292 - DNA, 25 bp, Mus musculus
cacctgtccagccagaaggtccagg

SEQ ID NO: 256293 - DNA, 25 bp, Mus musculus
cgctatcggggacgcgcggaactct

SEQ ID NO: 256294 - DNA, 25 bp, Mus musculus
aggtcacgtcccgagcaagcctagc

SEQ ID NO: 256295 - DNA, 25 bp, Mus musculus
tgtcaccgcaaaggtcacgtcccga

SEQ ID NO: 256296 - DNA, 25 bp, Mus musculus
tctgactgctgtcaccgcaaaggtc

SEQ ID NO: 256297 - DNA, 25 bp, Mus musculus
acaagcggaccggagcgcctagtag

SEQ ID NO: 256298 - DNA, 25 bp, Mus musculus
ttcgcgctgctcatcgtgcgggagc

SEQ ID NO: 256299 - DNA, 25 bp, Mus musculus
acgcggccttcctgctgctgggcgt

SEQ ID NO: 256300 - DNA, 25 bp, Mus musculus
tgctgttcgcgctgctcatcgtgcg

SEQ ID NO: 256301 - DNA, 25 bp, Mus musculus
actcttctgcttccacgcggccttc

SEQ ID NO: 256302 - DNA, 25 bp, Mus musculus
ccttcctggccgcactcttctgctt

SEQ ID NO: 256303 - DNA, 25 bp, Mus musculus
tgggctgcaagctgctggccttcct

SEQ ID NO: 256304 - DNA, 25 bp, Mus musculus
cgctgggccttaggctggccacgct

SEQ ID NO: 256305 - DNA, 25 bp, Mus musculus
cgtactacctgctgctcgacctgtg

SEQ ID NO: 256306 - DNA, 25 bp, Mus musculus
tcagcctgctgctgtgcgtgagcct

SEQ ID NO: 256307 - DNA, 25 bp, Mus musculus
gcgtcacccgctacctggccatcgc

SEQ ID NO: 256308 - DNA, 25 bp, Mus musculus
tcgacctgtgcctggccgacgggct

SEQ ID NO: 256309 - DNA, 25 bp, Mus musculus
tggccatcgcgcaccaccgcttcta

SEQ ID NO: 256310 - DNA, 25 bp, Mus musculus
gggtgcgctaggcttcctgctgctc

SEQ ID NO: 256311 - DNA, 25 bp, Mus musculus
tggccacgctcagcctgctgctgtg

SEQ ID NO: 256312 - DNA, 25 bp, Mus musculus
catttgccatacagatgtgcagggg

SEQ ID NO: 256313 - DNA, 25 bp, Mus musculus
tcgcagaggcacatcatttgccata

SEQ ID NO: 256314 - DNA, 25 bp, Mus musculus
ccacactcgcagaggcacatcattt

SEQ ID NO: 256315 - DNA, 25 bp, Mus musculus
ttttccagagcctcacgtgctcagc

SEQ ID NO: 256316 - DNA, 25 bp, Mus musculus
gtcctgttttccagagcctcacgtg

SEQ ID NO: 256317 - DNA, 25 bp, Mus musculus
ggggtacccacgacgtgccagacgc

SEQ ID NO: 256318 - DNA, 25 bp, Mus musculus
tgtggtctcagaaaccctcctcctt

SEQ ID NO: 256319 - DNA, 25 bp, Mus musculus
ccttcctgaagcttttgtggtctca

SEQ ID NO: 256320 - DNA, 25 bp, Mus musculus
ctagccagccttcctgaagcttttg

SEQ ID NO: 256321 - DNA, 25 bp, Mus musculus
agcctggcggcggttataaaggcga

SEQ ID NO: 256322 - DNA, 25 bp, Mus musculus
cggtagcagcagaagtagcagtagc

SEQ ID NO: 256323 - DNA, 25 bp, Mus musculus
tctcttgggcgatcctggcgcgaca

SEQ ID NO: 256324 - DNA, 25 bp, Mus musculus
tccttcgccgtcctgttttccagag

SEQ ID NO: 256325 - DNA, 25 bp, Mus musculus
gtgactcacgccaggcagcacgcgg

SEQ ID NO: 256326 - DNA, 25 bp, Mus musculus
cgtccgcgatctcccggatcttgta

SEQ ID NO: 256327 - DNA, 25 bp, Mus musculus
tagatgtcggagaacagctcgtcat

SEQ ID NO: 256328 - DNA, 25 bp, Mus musculus
tccggaccttcagcggaagcatttc

SEQ ID NO: 256329 - DNA, 25 bp, Mus musculus
ttcagcggaagcatttccaccgatg

SEQ ID NO: 256330 - DNA, 25 bp, Mus musculus
cggaagcatttccaccgatgagcga

SEQ ID NO: 256331 - DNA, 25 bp, Mus musculus
agcatttccaccgatgagcgagtca

SEQ ID NO: 256332 - DNA, 25 bp, Mus musculus
tgagcgagtcatcgatggcaccctc

SEQ ID NO: 256333 - DNA, 25 bp, Mus musculus
gtcatcgatggcaccctctgttcta

SEQ ID NO: 256334 - DNA, 25 bp, Mus musculus
tcgatggcaccctctgttctactga

SEQ ID NO: 256335 - DNA, 25 bp, Mus musculus
tggcaccctctgttctactgaccat

SEQ ID NO: 256336 - DNA, 25 bp, Mus musculus
cgcgatctcccggatcttgtagatg

SEQ ID NO: 256337 - DNA, 25 bp, Mus musculus
cggatcttgtagatgtcggagaaca

SEQ ID NO: 256338 - DNA, 25 bp, Mus musculus
tctcccggatcttgtagatgtcgga

SEQ ID NO: 256339 - DNA, 25 bp, Mus musculus
tcttgtagatgtcggagaacagctc

SEQ ID NO: 256340 - DNA, 25 bp, Mus musculus
caagatcccgggtcgcgtctgcgac

SEQ ID NO: 256341 - DNA, 25 bp, Mus musculus
cgcgtctgcgactcaatgtgaactt

SEQ ID NO: 256342 - DNA, 25 bp, Mus musculus
ccgagccgacgctgaggtccctgga

SEQ ID NO: 256343 - DNA, 25 bp, Mus musculus
aatgagcccggcaaccgcggagccg

SEQ ID NO: 256344 - DNA, 25 bp, Mus musculus
gccgtcagtcctgtcggaggccgac

SEQ ID NO: 256345 - DNA, 25 bp, Mus musculus
ggcaaacacccgcttccaggtgcag

SEQ ID NO: 256346 - DNA, 25 bp, Mus musculus
cgaggggcaaacacccgcttccagg

SEQ ID NO: 256347 - DNA, 25 bp, Mus musculus
ggataccgaccacgaggggcaaaca

SEQ ID NO: 256348 - DNA, 25 bp, Mus musculus
tcaacctgcaggataccgaccacga

SEQ ID NO: 256349 - DNA, 25 bp, Mus musculus
ctctgggaacgctcaacctgcagga

SEQ ID NO: 256350 - DNA, 25 bp, Mus musculus
gtccatcccatccagttctctggga

SEQ ID NO: 256351 - DNA, 25 bp, Mus musculus
agagttcgaatccagcacgcccgtc

SEQ ID NO: 256352 - DNA, 25 bp, Mus musculus
aggcggtccagcacagagttcgaat

SEQ ID NO: 256353 - DNA, 25 bp, Mus musculus
atgtgaacttgccacgtgggagctg

SEQ ID NO: 256354 - DNA, 25 bp, Mus musculus
catttaaaggcttcggcgctgttcc

SEQ ID NO: 256355 - DNA, 25 bp, Mus musculus
gcacatcgcagatgctgcatttaaa

SEQ ID NO: 256356 - DNA, 25 bp, Mus musculus
catcgcagatgctgcatttaaaggc

SEQ ID NO: 256357 - DNA, 25 bp, Mus musculus
cgcagatgctgcatttaaaggcttc

SEQ ID NO: 256358 - DNA, 25 bp, Mus musculus
agatgctgcatttaaaggcttcggc

SEQ ID NO: 256359 - DNA, 25 bp, Mus musculus
gctgcatttaaaggcttcggcgctg

SEQ ID NO: 256360 - DNA, 25 bp, Mus musculus
aggcttcggcgctgttcctaaaggt

SEQ ID NO: 256361 - DNA, 25 bp, Mus musculus
gcttcggcgctgttcctaaaggtgc

SEQ ID NO: 256362 - DNA, 25 bp, Mus musculus
tcctaaaggtgcagacgctacaatc

SEQ ID NO: 256363 - DNA, 25 bp, Mus musculus
ctaaaggtgcagacgctacaatccc

SEQ ID NO: 256364 - DNA, 25 bp, Mus musculus
agacgctacaatcccaaaagccttc

SEQ ID NO: 256365 - DNA, 25 bp, Mus musculus
ggtgcagacgctacaatcccaaaag

SEQ ID NO: 256366 - DNA, 25 bp, Mus musculus
aaggtgcagacgctacaatcccaaa

SEQ ID NO: 256367 - DNA, 25 bp, Mus musculus
tgcagacgctacaatcccaaaagcc

SEQ ID NO: 256368 - DNA, 25 bp, Mus musculus
ccactctgaggcgatctccggaagc

SEQ ID NO: 256369 - DNA, 25 bp, Mus musculus
gaattgccaggaccgcccacggctt

SEQ ID NO: 256370 - DNA, 25 bp, Mus musculus
gcttgctaccattggcggcctcctt

SEQ ID NO: 256371 - DNA, 25 bp, Mus musculus
cggcctccttgctggcgtgactaag

SEQ ID NO: 256372 - DNA, 25 bp, Mus musculus
ctagaaataggggtcgagaggcatc

SEQ ID NO: 256373 - DNA, 25 bp, Mus musculus
tggagcctcactctacggagaacta

SEQ ID NO: 256374 - DNA, 25 bp, Mus musculus
agccagctccggagtattcacctct

SEQ ID NO: 256375 - DNA, 25 bp, Mus musculus
gcgccttaggccgacgccatgaaga

SEQ ID NO: 256376 - DNA, 25 bp, Mus musculus
cgccatgaagatcaaggatgccaaa

SEQ ID NO: 256377 - DNA, 25 bp, Mus musculus
ggatgccaaaaaaccctgtaagatg

SEQ ID NO: 256378 - DNA, 25 bp, Mus musculus
gcccgctttaagctcgcgactgttc

SEQ ID NO: 256379 - DNA, 25 bp, Mus musculus
actgttctcggacgccagccaggga

SEQ ID NO: 256380 - DNA, 25 bp, Mus musculus
gctacgagaccagagcccgggaatt

SEQ ID NO: 256381 - DNA, 25 bp, Mus musculus
tagtccgcctgagcatctgccgcag

SEQ ID NO: 256382 - DNA, 25 bp, Mus musculus
atgaaacgcacgctaacctgtaccc

SEQ ID NO: 256383 - DNA, 25 bp, Mus musculus
cacttaggaagtgccagggcccgac

SEQ ID NO: 256384 - DNA, 25 bp, Mus musculus
cgctgaagtagttccgcgcagtttg

SEQ ID NO: 256385 - DNA, 25 bp, Mus musculus
ccgcttctgccacgaggggctttgt

SEQ ID NO: 256386 - DNA, 25 bp, Mus musculus
ctttgtggccgcctttcccaagcgg

SEQ ID NO: 256387 - DNA, 25 bp, Mus musculus
ccggggaagttgctgttcagatcca

SEQ ID NO: 256388 - DNA, 25 bp, Mus musculus
agttgctgttcagatccaggcgacc

SEQ ID NO: 256389 - DNA, 25 bp, Mus musculus
tccaggcgaccacatgcctgttttc

SEQ ID NO: 256390 - DNA, 25 bp, Mus musculus
gttttccaacctctagtcgcggctc

SEQ ID NO: 256391 - DNA, 25 bp, Mus musculus
tcctgcctctgcgaaataaggctcc

SEQ ID NO: 256392 - DNA, 25 bp, Mus musculus
taaggctcctaacgctctttccagg

SEQ ID NO: 256393 - DNA, 25 bp, Mus musculus
gctctttccagggagggcactctgg

SEQ ID NO: 256394 - DNA, 25 bp, Mus musculus
ggcactctggatgaaacgcacgcta

SEQ ID NO: 256395 - DNA, 25 bp, Mus musculus
agccgctccgctgaagtagttccgc

SEQ ID NO: 256396 - DNA, 25 bp, Mus musculus
ttgattgacaaacagagcccttccc

SEQ ID NO: 256397 - DNA, 25 bp, Mus musculus
tctcacaagggtgctctctgcgttg

SEQ ID NO: 256398 - DNA, 25 bp, Mus musculus
gatttcgggccagcgctagactgga

SEQ ID NO: 256399 - DNA, 25 bp, Mus musculus
aatccgaaggatcagtgcccagggc

SEQ ID NO: 256400 - DNA, 25 bp, Mus musculus
ccaaggctctacaggaatccgaagg

SEQ ID NO: 256401 - DNA, 25 bp, Mus musculus
catgaggtcacgtcccaaggctcta

SEQ ID NO: 256402 - DNA, 25 bp, Mus musculus
acccgtcattcaggagtgagacagc

SEQ ID NO: 256403 - DNA, 25 bp, Mus musculus
ggaacggggtctatcctgttctata

SEQ ID NO: 256404 - DNA, 25 bp, Mus musculus
ccgcgcggtagttgtaagacacata

SEQ ID NO: 256405 - DNA, 25 bp, Mus musculus
attctcgtctttccgccagaaggcc

SEQ ID NO: 256406 - DNA, 25 bp, Mus musculus
gcctcggtaacagatggagcaatca

SEQ ID NO: 256407 - DNA, 25 bp, Mus musculus
taattaagcatccactcagccgggg

SEQ ID NO: 256408 - DNA, 25 bp, Mus musculus
cccggaggtcgactgtaattaagca

SEQ ID NO: 256409 - DNA, 25 bp, Mus musculus
cctgttctataggagtgacccatga

SEQ ID NO: 256410 - DNA, 25 bp, Mus musculus
agattgagaaagatgccctgcaggc

SEQ ID NO: 256411 - DNA, 25 bp, Mus musculus
tccacggatgccacaggaggtgatt

SEQ ID NO: 256412 - DNA, 25 bp, Mus musculus
agacccgcgagagtgtttgtgtccg

SEQ ID NO: 256413 - DNA, 25 bp, Mus musculus
cgtgggctcccgaatgaaagcggca

SEQ ID NO: 256414 - DNA, 25 bp, Mus musculus
gcgggaactcgcctcagaaagtacg

SEQ ID NO: 256415 - DNA, 25 bp, Mus musculus
ccacgccgtgaggtcaccacggata

SEQ ID NO: 256416 - DNA, 25 bp, Mus musculus
cgaagtacacgtcgaactcagaggc

SEQ ID NO: 256417 - DNA, 25 bp, Mus musculus
cagctcgaacgcaggagtaagcatc

SEQ ID NO: 256418 - DNA, 25 bp, Mus musculus
gctagctgggcggagtttttaaaca

SEQ ID NO: 256419 - DNA, 25 bp, Mus musculus
ccctgcaggcttgttatgaaacttc

SEQ ID NO: 256420 - DNA, 25 bp, Mus musculus
acggcttggcgtagaacttgaagtc

SEQ ID NO: 256421 - DNA, 25 bp, Mus musculus
cgtaccacagcgcttccggacggag

SEQ ID NO: 256422 - DNA, 25 bp, Mus musculus
agtcgcagtcctgggtcagctcgaa

SEQ ID NO: 256423 - DNA, 25 bp, Mus musculus
cgggaacacgaagtcgccttagact

SEQ ID NO: 256424 - DNA, 25 bp, Mus musculus
gccgccagccgcgagaagttggcga

SEQ ID NO: 256425 - DNA, 25 bp, Mus musculus
gaggacctgcgtctcgcttccagcg

SEQ ID NO: 256426 - DNA, 25 bp, Mus musculus
ccatctgaggacctgcgtctcgctt

SEQ ID NO: 256427 - DNA, 25 bp, Mus musculus
tggatccctcccatctgaggacctg

SEQ ID NO: 256428 - DNA, 25 bp, Mus musculus
agcttggatccctcccatctgagga

SEQ ID NO: 256429 - DNA, 25 bp, Mus musculus
ggcagcttggatccctcccatctga

SEQ ID NO: 256430 - DNA, 25 bp, Mus musculus
tcgtggcagcttggatccctcccat

SEQ ID NO: 256431 - DNA, 25 bp, Mus musculus
ccgcgagaagttggcgaggtgagtc

SEQ ID NO: 256432 - DNA, 25 bp, Mus musculus
gcgctgctgtccttgcgcgcccgcc

SEQ ID NO: 256433 - DNA, 25 bp, Mus musculus
catgaagctccgcagcaaggcggca

SEQ ID NO: 256434 - DNA, 25 bp, Mus musculus
ggcaccatgaagctccgcagcaagg

SEQ ID NO: 256435 - DNA, 25 bp, Mus musculus
tgcggcaccatgaagctccgcagca

SEQ ID NO: 256436 - DNA, 25 bp, Mus musculus
cagcgatgcgcagagtgtccgcgcc

SEQ ID NO: 256437 - DNA, 25 bp, Mus musculus
tgagtcgtggcagcttggatccctc

SEQ ID NO: 256438 - DNA, 25 bp, Mus musculus
cttggggctggattcattcaggtgc

SEQ ID NO: 256439 - DNA, 25 bp, Mus musculus
ccgcggcttggcaagcaacaggctc

SEQ ID NO: 256440 - DNA, 25 bp, Mus musculus
cattcaggtgcacgctgcggcggtc

SEQ ID NO: 256441 - DNA, 25 bp, Mus musculus
ggcttggcaagcaacaggctcgaga

SEQ ID NO: 256442 - DNA, 25 bp, Mus musculus
ctggattcattcaggtgcacgctgc

SEQ ID NO: 256443 - DNA, 25 bp, Mus musculus
ctttagtggcttggggctggattca

SEQ ID NO: 256444 - DNA, 25 bp, Mus musculus
ccctaggacatgcgggagcatttgg

SEQ ID NO: 256445 - DNA, 25 bp, Mus musculus
ctgcttcccaaacttggaaccgcgg

SEQ ID NO: 256446 - DNA, 25 bp, Mus musculus
gagaacactgcttcccaaacttgga

SEQ ID NO: 256447 - DNA, 25 bp, Mus musculus
aggctcgagaacactgcttcccaaa

SEQ ID NO: 256448 - DNA, 25 bp, Mus musculus
gcaacaggctcgagaacactgcttc

SEQ ID NO: 256449 - DNA, 25 bp, Mus musculus
gcaagcaacaggctcgagaacactg

SEQ ID NO: 256450 - DNA, 25 bp, Mus musculus
ttggcaagcaacaggctcgagaaca

SEQ ID NO: 256451 - DNA, 25 bp, Mus musculus
attcattcaggtgcacgctgcggcg

SEQ ID NO: 256452 - DNA, 25 bp, Mus musculus
gaacaggactcctccggccgtattg

SEQ ID NO: 256453 - DNA, 25 bp, Mus musculus
cgctgtactcggtgaacttcttctg

SEQ ID NO: 256454 - DNA, 25 bp, Mus musculus
cgcagcgcggtcatctgcagttcga

SEQ ID NO: 256455 - DNA, 25 bp, Mus musculus
gcctccttcttgagcgccttgtgca

SEQ ID NO: 256456 - DNA, 25 bp, Mus musculus
tgctcgggcaagtcctgcaacttga

SEQ ID NO: 256457 - DNA, 25 bp, Mus musculus
tgcgcgcacttgatgtccaacttga

SEQ ID NO: 256458 - DNA, 25 bp, Mus musculus
tccaacttgaggatgagacgcttga

SEQ ID NO: 256459 - DNA, 25 bp, Mus musculus
cttgtggcacaaggcgcacttcaga

SEQ ID NO: 256460 - DNA, 25 bp, Mus musculus
cgcacttcagatcagggtccacgtc

SEQ ID NO: 256461 - DNA, 25 bp, Mus musculus
cgccgtcgaagcgatccaactcgaa

SEQ ID NO: 256462 - DNA, 25 bp, Mus musculus
caactcgaaacccatggtggcggcc

SEQ ID NO: 256463 - DNA, 25 bp, Mus musculus
aacttcttctggtagcgcagcgcgg

SEQ ID NO: 256464 - DNA, 25 bp, Mus musculus
ttgctccagacttcctcggaaaatg

SEQ ID NO: 256465 - DNA, 25 bp, Mus musculus
tcccaggactgagcctaattgctcc

SEQ ID NO: 256466 - DNA, 25 bp, Mus musculus
gggtcctgcgcctcacgctgctcgc

SEQ ID NO: 256467 - DNA, 25 bp, Mus musculus
ccgcgctgttctgcaaggttccgca

SEQ ID NO: 256468 - DNA, 25 bp, Mus musculus
cgcgcgagcactgaagggagggagg

SEQ ID NO: 256469 - DNA, 25 bp, Mus musculus
tgcaggcgccgaaggtgcgctgcct

SEQ ID NO: 256470 - DNA, 25 bp, Mus musculus
acacttcccagtcggacccgcggcg

SEQ ID NO: 256471 - DNA, 25 bp, Mus musculus
ctgccctgcgcgctcctgcgagccg

SEQ ID NO: 256472 - DNA, 25 bp, Mus musculus
aggttccgcacacttcccagtcgga

SEQ ID NO: 256473 - DNA, 25 bp, Mus musculus
cgtccgcgctgttctgcaaggttcc

SEQ ID NO: 256474 - DNA, 25 bp, Mus musculus
cgctgctcgcaccaccaccctcccg

SEQ ID NO: 256475 - DNA, 25 bp, Mus musculus
aaggttccgcacacttcccagtcgg

SEQ ID NO: 256476 - DNA, 25 bp, Mus musculus
tgcaaggttccgcacacttcccagt

SEQ ID NO: 256477 - DNA, 25 bp, Mus musculus
tgttctgcaaggttccgcacacttc

SEQ ID NO: 256478 - DNA, 25 bp, Mus musculus
gcgctgttctgcaaggttccgcaca

SEQ ID NO: 256479 - DNA, 25 bp, Mus musculus
gcgcagccaacagggtcctgcgcct

SEQ ID NO: 256480 - DNA, 25 bp, Mus musculus
aaatagtgggagatttgcgcgtgcg

SEQ ID NO: 256481 - DNA, 25 bp, Mus musculus
tgcgagtagccagcaagcacgagca

SEQ ID NO: 256482 - DNA, 25 bp, Mus musculus
tagccagcaagcacgagcaggtgtg

SEQ ID NO: 256483 - DNA, 25 bp, Mus musculus
ccagcaagcacgagcaggtgtgcgt

SEQ ID NO: 256484 - DNA, 25 bp, Mus musculus
cggggaaggagcttccgactctgcc

SEQ ID NO: 256485 - DNA, 25 bp, Mus musculus
gcttccgactctgcctggggagaaa

SEQ ID NO: 256486 - DNA, 25 bp, Mus musculus
tggggagaaaggagatcaataccgc

SEQ ID NO: 256487 - DNA, 25 bp, Mus musculus
aggagatcaataccgccccgcaggc

SEQ ID NO: 256488 - DNA, 25 bp, Mus musculus
gccccgcaggccagaactgagaaga

SEQ ID NO: 256489 - DNA, 25 bp, Mus musculus
aactgagaagagctggctggtagca

SEQ ID NO: 256490 - DNA, 25 bp, Mus musculus
cagccagcggaaggcgtgtgcacca

SEQ ID NO: 256491 - DNA, 25 bp, Mus musculus
cagcggaaggcgtgtgcaccacagc

SEQ ID NO: 256492 - DNA, 25 bp, Mus musculus
gctcccgctgctggaaatagtggga

SEQ ID NO: 256493 - DNA, 25 bp, Mus musculus
gcgcgctcccgctgctggaaatagt

SEQ ID NO: 256494 - DNA, 25 bp, Mus musculus
cgctgcggctcttcgtgcgtgctga

SEQ ID NO: 256495 - DNA, 25 bp, Mus musculus
gcaacgcccggtctctcttcattga

SEQ ID NO: 256496 - DNA, 25 bp, Mus musculus
gcgaccggcttgagcgtcgctgtcc

SEQ ID NO: 256497 - DNA, 25 bp, Mus musculus
gctatctcagatacgcgaccggctt

SEQ ID NO: 256498 - DNA, 25 bp, Mus musculus
gttaggggagaaagtcgctatctca

SEQ ID NO: 256499 - DNA, 25 bp, Mus musculus
gcggtcgtatctcagggccggttcc

SEQ ID NO: 256500 - DNA, 25 bp, Mus musculus
gacgtcactggtccgcgacccggaa

SEQ ID NO: 256501 - DNA, 25 bp, Mus musculus
aggagcgccacgtttctaagacacc

SEQ ID NO: 256502 - DNA, 25 bp, Mus musculus
ctaagacaccttggcgacctggctg

SEQ ID NO: 256503 - DNA, 25 bp, Mus musculus
cctggctgtgcagcgtgcgtctgaa

SEQ ID NO: 256504 - DNA, 25 bp, Mus musculus
cgtctgaacgcgtccttgggagatg

SEQ ID NO: 256505 - DNA, 25 bp, Mus musculus
aggctgctccctactctaggcaacg

SEQ ID NO: 256506 - DNA, 25 bp, Mus musculus
ctctcttcattgagccgtgggcggc

SEQ ID NO: 256507 - DNA, 25 bp, Mus musculus
cgcagttttccagagttaggggaga

SEQ ID NO: 256508 - DNA, 25 bp, Mus musculus
tcgcctgggtaagtgataggacctc

SEQ ID NO: 256509 - DNA, 25 bp, Mus musculus
aggggacagcgtcccgcctgaagcc

SEQ ID NO: 256510 - DNA, 25 bp, Mus musculus
tgaagccaggcgcttggtccaggct

SEQ ID NO: 256511 - DNA, 25 bp, Mus musculus
aggcgcttggtccaggctcggtccc

SEQ ID NO: 256512 - DNA, 25 bp, Mus musculus
gcgccgcctagccttgtattctctt

SEQ ID NO: 256513 - DNA, 25 bp, Mus musculus
tctctctatcactcgttcacctaga

SEQ ID NO: 256514 - DNA, 25 bp, Mus musculus
cccaccctctgtaccctaagctgta

SEQ ID NO: 256515 - DNA, 25 bp, Mus musculus
ctgcagcccgctcaggcaggggaca

SEQ ID NO: 256516 - DNA, 25 bp, Mus musculus
ttcagctcctgtgcctgtgtcgcct

SEQ ID NO: 256517 - DNA, 25 bp, Mus musculus
ttcctcgcgtgcgttcagctcctgt

SEQ ID NO: 256518 - DNA, 25 bp, Mus musculus
gcagagcttcctcgcgtgcgttcag

SEQ ID NO: 256519 - DNA, 25 bp, Mus musculus
accgggctggagatgcgaatcctgc

SEQ ID NO: 256520 - DNA, 25 bp, Mus musculus
atgcgaatcctgcagagcttcctcg

SEQ ID NO: 256521 - DNA, 25 bp, Mus musculus
ctagaccctggccagtcaccggcgt

SEQ ID NO: 256522 - DNA, 25 bp, Mus musculus
cagaagcaaacacggcctcggcaga

SEQ ID NO: 256523 - DNA, 25 bp, Mus musculus
cggcgcccaggtacaacactttgga

SEQ ID NO: 256524 - DNA, 25 bp, Mus musculus
caacactttggacttgggcttgatg

SEQ ID NO: 256525 - DNA, 25 bp, Mus musculus
tgccaatttggagcggaagggattc

SEQ ID NO: 256526 - DNA, 25 bp, Mus musculus
attccacgtgcggtactcctgtttc

SEQ ID NO: 256527 - DNA, 25 bp, Mus musculus
accgagactccaggcaccatgttca

SEQ ID NO: 256528 - DNA, 25 bp, Mus musculus
tgttcagtgtgaccagagcatcctc

SEQ ID NO: 256529 - DNA, 25 bp, Mus musculus
cgcggtagatgaacacgccctcgtg

SEQ ID NO: 256530 - DNA, 25 bp, Mus musculus
gatgcggctccaccgacaccgtgat

SEQ ID NO: 256531 - DNA, 25 bp, Mus musculus
gttcttgttcttgcctggaccgccg

SEQ ID NO: 256532 - DNA, 25 bp, Mus musculus
ttggccacgttgaccagatcgcggc

SEQ ID NO: 256533 - DNA, 25 bp, Mus musculus
cgggcatcttccagcaccgggatga

SEQ ID NO: 256534 - DNA, 25 bp, Mus musculus
cgcgatgggagaattcaaccgcata

SEQ ID NO: 256535 - DNA, 25 bp, Mus musculus
tcggcgaagatcacgtccaccatgc

SEQ ID NO: 256536 - DNA, 25 bp, Mus musculus
tctgtttacccgcaaaggagcctgg

SEQ ID NO: 256537 - DNA, 25 bp, Mus musculus
cctggcggctccaacgaggcgagcc

SEQ ID NO: 256538 - DNA, 25 bp, Mus musculus
gagggtctgcgatacgccgccgcca

SEQ ID NO: 256539 - DNA, 25 bp, Mus musculus
gccatgtctgtttacccgcaaagga

SEQ ID NO: 256540 - DNA, 25 bp, Mus musculus
gccggccatgtctgtttacccgcaa

SEQ ID NO: 256541 - DNA, 25 bp, Mus musculus
tgctgatctccctcgccggccatgt

SEQ ID NO: 256542 - DNA, 25 bp, Mus musculus
tgtgcgcagcgtcctgctgatctcc

SEQ ID NO: 256543 - DNA, 25 bp, Mus musculus
tttcccatgttgtgcgcagcgtcct

SEQ ID NO: 256544 - DNA, 25 bp, Mus musculus
caggtggtttcccatgttgtgcgca

SEQ ID NO: 256545 - DNA, 25 bp, Mus musculus
gcagaagcggcaggtggtttcccat

SEQ ID NO: 256546 - DNA, 25 bp, Mus musculus
gtcccggaggttaccaggcagaagc

SEQ ID NO: 256547 - DNA, 25 bp, Mus musculus
gtcctcggtctccacccacggccag

SEQ ID NO: 256548 - DNA, 25 bp, Mus musculus
gcgaggctcacacgggaggcttccc

SEQ ID NO: 256549 - DNA, 25 bp, Mus musculus
gccgctgcgcccgagtagctgtccc

SEQ ID NO: 256550 - DNA, 25 bp, Mus musculus
ctcgggcgccttccttgagaccgat

SEQ ID NO: 256551 - DNA, 25 bp, Mus musculus
cggcgttcttcctgacagtggcatc

SEQ ID NO: 256552 - DNA, 25 bp, Mus musculus
tgacagtggcatccttgccaccgca

SEQ ID NO: 256553 - DNA, 25 bp, Mus musculus
gcgccggcagcaagccgtgaagcca

SEQ ID NO: 256554 - DNA, 25 bp, Mus musculus
ttgcttacaccaggtgcacgccggc

SEQ ID NO: 256555 - DNA, 25 bp, Mus musculus
tgaccgcttttgcttacaccaggtg

SEQ ID NO: 256556 - DNA, 25 bp, Mus musculus
atcagctgaccgcttttgcttacac

SEQ ID NO: 256557 - DNA, 25 bp, Mus musculus
tcttcctgacagtggcatccttgcc

SEQ ID NO: 256558 - DNA, 25 bp, Mus musculus
cccaagaacgcgatttagcccagcc

SEQ ID NO: 256559 - DNA, 25 bp, Mus musculus
aatcggcgcgcagcccatcagctga

SEQ ID NO: 256560 - DNA, 25 bp, Mus musculus
ttccttgagaccgatccttcgctgc

SEQ ID NO: 256561 - DNA, 25 bp, Mus musculus
ctattcccgcctgtctctaccacga

SEQ ID NO: 256562 - DNA, 25 bp, Mus musculus
cccgcggctgtctcgccttgcatct

SEQ ID NO: 256563 - DNA, 25 bp, Mus musculus
ccttgcatcttggtgctctgctggg

SEQ ID NO: 256564 - DNA, 25 bp, Mus musculus
tataatggcacagatgatatggggc

SEQ ID NO: 256565 - DNA, 25 bp, Mus musculus
tatcaaagtgggctggcgagatagc

SEQ ID NO: 256566 - DNA, 25 bp, Mus musculus
gatatatcaaagtgggctggcgaga

SEQ ID NO: 256567 - DNA, 25 bp, Mus musculus
taagatatatcaaagtgggctggcg

SEQ ID NO: 256568 - DNA, 25 bp, Mus musculus
acttgaatattttatgtagttaaga

SEQ ID NO: 256569 - DNA, 25 bp, Mus musculus
atggcggccgggcaacaaataaatt

SEQ ID NO: 256570 - DNA, 25 bp, Mus musculus
ccagatgtaagcaaatgagaaagaa

SEQ ID NO: 256571 - DNA, 25 bp, Mus musculus
ggcccagatgtaagcaaatgagaaa

SEQ ID NO: 256572 - DNA, 25 bp, Mus musculus
ggggcccagatgtaagcaaatgaga

SEQ ID NO: 256573 - DNA, 25 bp, Mus musculus
tatggggcccagatgtaagcaaatg

SEQ ID NO: 256574 - DNA, 25 bp, Mus musculus
gcacagatgatatggggcccagatg

SEQ ID NO: 256575 - DNA, 25 bp, Mus musculus
tggcacagatgatatggggcccaga

SEQ ID NO: 256576 - DNA, 25 bp, Mus musculus
taatggcacagatgatatggggccc

SEQ ID NO: 256577 - DNA, 25 bp, Mus musculus
tcaaagtgggctggcgagatagctc

SEQ ID NO: 256578 - DNA, 25 bp, Mus musculus
cagtctgatgcagcagcggagagcc

SEQ ID NO: 256579 - DNA, 25 bp, Mus musculus
aggcctcatgccgtagccaacgaca

SEQ ID NO: 256580 - DNA, 25 bp, Mus musculus
cgcgggcgcagccatgttgttcccg

SEQ ID NO: 256581 - DNA, 25 bp, Mus musculus
tgccgtagccaacgacacccacacg

SEQ ID NO: 256582 - DNA, 25 bp, Mus musculus
cccaggaatggaaggcgcaccttgg

SEQ ID NO: 256583 - DNA, 25 bp, Mus musculus
ttcgcctcccgggagtagcgctgcg

SEQ ID NO: 256584 - DNA, 25 bp, Mus musculus
cgcaccttccctggcctcggcctca

SEQ ID NO: 256585 - DNA, 25 bp, Mus musculus
tcggcctcatcgcttcccgccacct

SEQ ID NO: 256586 - DNA, 25 bp, Mus musculus
ttcccgccacctcgcacgccaacac

SEQ ID NO: 256587 - DNA, 25 bp, Mus musculus
cagcagcaagaagactcgcgccagt

SEQ ID NO: 256588 - DNA, 25 bp, Mus musculus
agcaagaagactcgcgccagtctga

SEQ ID NO: 256589 - DNA, 25 bp, Mus musculus
actcgcgccagtctgatgcagcagc

SEQ ID NO: 256590 - DNA, 25 bp, Mus musculus
aaggcgcaccttggtgagcgcgagc

SEQ ID NO: 256591 - DNA, 25 bp, Mus musculus
agcccgcaagggacgccgcaccttc

SEQ ID NO: 256592 - DNA, 25 bp, Mus musculus
ttctgtgcttgactagccagggtgg

SEQ ID NO: 256593 - DNA, 25 bp, Mus musculus
ggaggcgacccggacgcctctgcat

SEQ ID NO: 256594 - DNA, 25 bp, Mus musculus
acccggacgcctctgcatcggaggg

SEQ ID NO: 256595 - DNA, 25 bp, Mus musculus
aacgccgggcactgtgcccggtatc

SEQ ID NO: 256596 - DNA, 25 bp, Mus musculus
gcactgtgcccggtatctttctgtg

SEQ ID NO: 256597 - DNA, 25 bp, Mus musculus
ctaggcttggaagccagcgcggaga

SEQ ID NO: 256598 - DNA, 25 bp, Mus musculus
agaggcttgcaagtgagccgagctc

SEQ ID NO: 256599 - DNA, 25 bp, Mus musculus
gcttgcaagtgagccgagctccggc

SEQ ID NO: 256600 - DNA, 25 bp, Mus musculus
gtccgggccacgtgaagcgtcacgc

SEQ ID NO: 256601 - DNA, 25 bp, Mus musculus
gccgtcgccgcggttgtgtaacgct

SEQ ID NO: 256602 - DNA, 25 bp, Mus musculus
cacccgcaggctgcgcctgggacct

SEQ ID NO: 256603 - DNA, 25 bp, Mus musculus
ggcagtgaggcaccctgaaaggcgg

SEQ ID NO: 256604 - DNA, 25 bp, Mus musculus
ccgcggttgtgtaacgctgcagccg

SEQ ID NO: 256605 - DNA, 25 bp, Mus musculus
cccggtatctttctgtgcttgacta

SEQ ID NO: 256606 - DNA, 25 bp, Mus musculus
atcgaacggggcagacagcgcagcg

SEQ ID NO: 256607 - DNA, 25 bp, Mus musculus
cacacaccgccagtctgtgtgcaga

SEQ ID NO: 256608 - DNA, 25 bp, Mus musculus
acaccgccagtctgtgtgcagagcg

SEQ ID NO: 256609 - DNA, 25 bp, Mus musculus
tctgtgtgcagagcgggagccagaa

SEQ ID NO: 256610 - DNA, 25 bp, Mus musculus
caactgaagcgacacctcaaagccg

SEQ ID NO: 256611 - DNA, 25 bp, Mus musculus
ccgaggccgataggccctgagcaaa

SEQ ID NO: 256612 - DNA, 25 bp, Mus musculus
gagccagaagccgtggggacacccg

SEQ ID NO: 256613 - DNA, 25 bp, Mus musculus
taacttggatcgaacggggcagaca

SEQ ID NO: 256614 - DNA, 25 bp, Mus musculus
ctcattaacttggatcgaacggggc

SEQ ID NO: 256615 - DNA, 25 bp, Mus musculus
cccacttctcattaacttggatcga

SEQ ID NO: 256616 - DNA, 25 bp, Mus musculus
ccgacccacttctcattaacttgga

SEQ ID NO: 256617 - DNA, 25 bp, Mus musculus
aggccgataggccctgagcaaaccc

SEQ ID NO: 256618 - DNA, 25 bp, Mus musculus
acttggatcgaacggggcagacagc

SEQ ID NO: 256619 - DNA, 25 bp, Mus musculus
ctcacgactctcagcccgacccact

SEQ ID NO: 256620 - DNA, 25 bp, Mus musculus
ctgccggttcctggaagcagacgtg

SEQ ID NO: 256621 - DNA, 25 bp, Mus musculus
ccgatccttggggaagcttggcaaa

SEQ ID NO: 256622 - DNA, 25 bp, Mus musculus
tagagcctttcatgtgcggcccgcg

SEQ ID NO: 256623 - DNA, 25 bp, Mus musculus
ccctggtgcgcagtgggacagaatc

SEQ ID NO: 256624 - DNA, 25 bp, Mus musculus
gatggtctcacccagcgctgacctg

SEQ ID NO: 256625 - DNA, 25 bp, Mus musculus
caaagcttcgggatcgctcggtccc

SEQ ID NO: 256626 - DNA, 25 bp, Mus musculus
cgcgtcagcagaaacccgatccttg

SEQ ID NO: 256627 - DNA, 25 bp, Mus musculus
tggcaccgcgtcagcagaaacccga

SEQ ID NO: 256628 - DNA, 25 bp, Mus musculus
tggaagcagacgtgcctggcaccgc

SEQ ID NO: 256629 - DNA, 25 bp, Mus musculus
ccgcggctaaatgcggctgccggtt

SEQ ID NO: 256630 - DNA, 25 bp, Mus musculus
gtcacgtttccgactagagcctttc

SEQ ID NO: 256631 - DNA, 25 bp, Mus musculus
gcctgttgacaaaacgtcacgtttc

SEQ ID NO: 256632 - DNA, 25 bp, Mus musculus
gacctgccgcgcctgttgacaaaac

SEQ ID NO: 256633 - DNA, 25 bp, Mus musculus
cagaaatagggcctggctgctggca

SEQ ID NO: 256634 - DNA, 25 bp, Mus musculus
gctgtgcctttaacacggcctggaa

SEQ ID NO: 256635 - DNA, 25 bp, Mus musculus
aggggacgcctctcctaagtctcca

SEQ ID NO: 256636 - DNA, 25 bp, Mus musculus
ccacttgggacgatggagtcgcatt

SEQ ID NO: 256637 - DNA, 25 bp, Mus musculus
tcgcattgtgaaagcaggcaacccg

SEQ ID NO: 256638 - DNA, 25 bp, Mus musculus
ggtctttgtcacttgtccatggagc

SEQ ID NO: 256639 - DNA, 25 bp, Mus musculus
ctgtcacttgttcacccggacgggt

SEQ ID NO: 256640 - DNA, 25 bp, Mus musculus
cgagtcatatgacccgctgggcttc

SEQ ID NO: 256641 - DNA, 25 bp, Mus musculus
ggttaatccgagtctgccacacttg

SEQ ID NO: 256642 - DNA, 25 bp, Mus musculus
cagcaggagggtcaattccacgttg

SEQ ID NO: 256643 - DNA, 25 bp, Mus musculus
ttcgtcaatgtcatcgcggtgagca

SEQ ID NO: 256644 - DNA, 25 bp, Mus musculus
gactggttccgttcgctcttctgga

SEQ ID NO: 256645 - DNA, 25 bp, Mus musculus
ggccgatacccgctcgtgggaaaga

SEQ ID NO: 256646 - DNA, 25 bp, Mus musculus
cacacttgctgcctttcgggccgta

SEQ ID NO: 256647 - DNA, 25 bp, Mus musculus
tggccttttccagaacgcctgcgaa

SEQ ID NO: 256648 - DNA, 25 bp, Mus musculus
tgcgtcacgagggagttccttaaag

SEQ ID NO: 256649 - DNA, 25 bp, Mus musculus
agcatgggcttctaccagcggtttc

SEQ ID NO: 256650 - DNA, 25 bp, Mus musculus
ccggacgagtacgagcggcgctaca

SEQ ID NO: 256651 - DNA, 25 bp, Mus musculus
cagcggtttccgctcagcttcggct

SEQ ID NO: 256652 - DNA, 25 bp, Mus musculus
ccgcgctcctattggctggaagttc

SEQ ID NO: 256653 - DNA, 25 bp, Mus musculus
tggaccagttcctggtgcgtcacga

SEQ ID NO: 256654 - DNA, 25 bp, Mus musculus
cacgccagctagaccagactcggaa

SEQ ID NO: 256655 - DNA, 25 bp, Mus musculus
tcagcttcggcttccagcgcttgag

SEQ ID NO: 256656 - DNA, 25 bp, Mus musculus
cgcgcccggcgcttcaaaataatgc

SEQ ID NO: 256657 - DNA, 25 bp, Mus musculus
ggcttcatcggccaaggcgcggaac

SEQ ID NO: 256658 - DNA, 25 bp, Mus musculus
gcttcaaaataatgcccgcggcgga

SEQ ID NO: 256659 - DNA, 25 bp, Mus musculus
ggcatgttcgtcttcggctatgaca

SEQ ID NO: 256660 - DNA, 25 bp, Mus musculus
atgacaactacatggcgcacgcctt

SEQ ID NO: 256661 - DNA, 25 bp, Mus musculus
cgcgaccatgcaatggcgagcgctt

SEQ ID NO: 256662 - DNA, 25 bp, Mus musculus
tccacaggctggaagctatgcttta

SEQ ID NO: 256663 - DNA, 25 bp, Mus musculus
caacctgctgcccaacgtaacgtta

SEQ ID NO: 256664 - DNA, 25 bp, Mus musculus
ccagggacacttatgcgctcgaaca

SEQ ID NO: 256665 - DNA, 25 bp, Mus musculus
tgcgctcgaacagtcgctcactttc

SEQ ID NO: 256666 - DNA, 25 bp, Mus musculus
gctcactttcgtccaggcgcttatc

SEQ ID NO: 256667 - DNA, 25 bp, Mus musculus
ggcgcttatccagaaggacacctcc

SEQ ID NO: 256668 - DNA, 25 bp, Mus musculus
aggagctcacctcgagaagccggga

SEQ ID NO: 256669 - DNA, 25 bp, Mus musculus
ccgcgtcctgactttgatgaagttc

SEQ ID NO: 256670 - DNA, 25 bp, Mus musculus
ctccgacgtgcgttgcaccaacgga

SEQ ID NO: 256671 - DNA, 25 bp, Mus musculus
cctgcggcgacatcaagagggagaa

SEQ ID NO: 256672 - DNA, 25 bp, Mus musculus
gctatgctttatgctctcgaccaga

SEQ ID NO: 256673 - DNA, 25 bp, Mus musculus
caacgtaacgttaggcgcgcggatc

SEQ ID NO: 256674 - DNA, 25 bp, Mus musculus
tggacacttgttccagggacactta

SEQ ID NO: 256675 - DNA, 25 bp, Mus musculus
ctgttcccagtgcacgccaagggtc

SEQ ID NO: 256676 - DNA, 25 bp, Mus musculus
gcccagggacaaacctgctgcagca

SEQ ID NO: 256677 - DNA, 25 bp, Mus musculus
tctcgtcagcgactcacatgccaag

SEQ ID NO: 256678 - DNA, 25 bp, Mus musculus
ccctaacgggatccaggagacactg

SEQ ID NO: 256679 - DNA, 25 bp, Mus musculus
gaagcggaagtgtctagtttgggcc

SEQ ID NO: 256680 - DNA, 25 bp, Mus musculus
ctcacatgccaagcggccggaagcg

SEQ ID NO: 256681 - DNA, 25 bp, Mus musculus
gtcagcgactcacatgccaagcggc

SEQ ID NO: 256682 - DNA, 25 bp, Mus musculus
gccaagaggaaagggccagcggagc

SEQ ID NO: 256683 - DNA, 25 bp, Mus musculus
cagggacaaacctgctgcagcaacc

SEQ ID NO: 256684 - DNA, 25 bp, Mus musculus
agcaaccgcgcggagcactgagcca

SEQ ID NO: 256685 - DNA, 25 bp, Mus musculus
gcggagcactgagccaccagaccgt

SEQ ID NO: 256686 - DNA, 25 bp, Mus musculus
agaccgtccatcctctcgtcagcga

SEQ ID NO: 256687 - DNA, 25 bp, Mus musculus
ccgcctgtggaagccactgcggact

SEQ ID NO: 256688 - DNA, 25 bp, Mus musculus
cggagcagcaaggcttcgcaagccc

SEQ ID NO: 256689 - DNA, 25 bp, Mus musculus
gtggaagccactgcggactctgccc

SEQ ID NO: 256690 - DNA, 25 bp, Mus musculus
accatccggcccatggtgcgggacc

SEQ ID NO: 256691 - DNA, 25 bp, Mus musculus
tgcccgcgtgggaacccaactgaac

SEQ ID NO: 256692 - DNA, 25 bp, Mus musculus
acatgcccgcgtgggaacccaactg

SEQ ID NO: 256693 - DNA, 25 bp, Mus musculus
acatccgcacatgcccgcgtgggaa

SEQ ID NO: 256694 - DNA, 25 bp, Mus musculus
tggctcgggcctgaccgagcagctc

SEQ ID NO: 256695 - DNA, 25 bp, Mus musculus
agcaaactcagagccaccatccggc

SEQ ID NO: 256696 - DNA, 25 bp, Mus musculus
gtgggaacccaactgaacttgattc

SEQ ID NO: 256697 - DNA, 25 bp, Mus musculus
agcccgatgcccagcaaactcagag

SEQ ID NO: 256698 - DNA, 25 bp, Mus musculus
tgagcgctaggaaccgctcgcccag

SEQ ID NO: 256699 - DNA, 25 bp, Mus musculus
ctacctgagcgctaggaaccgctcg

SEQ ID NO: 256700 - DNA, 25 bp, Mus musculus
tcccgacccgggaccctcggcagca

SEQ ID NO: 256701 - DNA, 25 bp, Mus musculus
tcggcagcacctacctgagcgctag

SEQ ID NO: 256702 - DNA, 25 bp, Mus musculus
gcagcacctacctgagcgctaggaa

SEQ ID NO: 256703 - DNA, 25 bp, Mus musculus
ctcgtcctcggagcacatccgcaca

SEQ ID NO: 256704 - DNA, 25 bp, Mus musculus
tccagcaccggtggcacactggcga

SEQ ID NO: 256705 - DNA, 25 bp, Mus musculus
tcttcgtagtggaatcggcgttttc

SEQ ID NO: 256706 - DNA, 25 bp, Mus musculus
tgcggattagccttcacttcttctt

SEQ ID NO: 256707 - DNA, 25 bp, Mus musculus
ccacgcgtcgtaattgtgcggatta

SEQ ID NO: 256708 - DNA, 25 bp, Mus musculus
gtaagtaatcaaaccacgcgtcgta

SEQ ID NO: 256709 - DNA, 25 bp, Mus musculus
tgcctcactttccaccaagcgtaag

SEQ ID NO: 256710 - DNA, 25 bp, Mus musculus
gcacactggcgatggctctctcata

SEQ ID NO: 256711 - DNA, 25 bp, Mus musculus
agtgcctcttctccagcaccggtgg

SEQ ID NO: 256712 - DNA, 25 bp, Mus musculus
gatgtagcgcttccagtgcctcttc

SEQ ID NO: 256713 - DNA, 25 bp, Mus musculus
cccagaggtagatgtagcgcttcca

SEQ ID NO: 256714 - DNA, 25 bp, Mus musculus
agagcgcatagttaacccagaggta

SEQ ID NO: 256715 - DNA, 25 bp, Mus musculus
atagacgcgtctcgtcctctcggga

SEQ ID NO: 256716 - DNA, 25 bp, Mus musculus
gcacggtgtcggcttctgcctcact

SEQ ID NO: 256717 - DNA, 25 bp, Mus musculus
cctccagctcttcatagagcgcata

SEQ ID NO: 256718 - DNA, 25 bp, Mus musculus
atccacgtgacgtaggccttgggtc

SEQ ID NO: 256719 - DNA, 25 bp, Mus musculus
tgccgtcttgagtcgcagattctgc

SEQ ID NO: 256720 - DNA, 25 bp, Mus musculus
ccagatcttgaagctgatgagacca

SEQ ID NO: 256721 - DNA, 25 bp, Mus musculus
ccagcacgatgaccggtacaatgta

SEQ ID NO: 256722 - DNA, 25 bp, Mus musculus
ttcgcgcagcgagaaaatgtgcacc

SEQ ID NO: 256723 - DNA, 25 bp, Mus musculus
cgagcgacatcagcaacagcaggta

SEQ ID NO: 256724 - DNA, 25 bp, Mus musculus
tggaggcgaacatgcccaccacctg

SEQ ID NO: 256725 - DNA, 25 bp, Mus musculus
tgcaagtatttgaccagacgacaca

SEQ ID NO: 256726 - DNA, 25 bp, Mus musculus
gcgatgctcaggtgcttcatgaaaa

SEQ ID NO: 256727 - DNA, 25 bp, Mus musculus
gccactcagagccaggaacagtatg

SEQ ID NO: 256728 - DNA, 25 bp, Mus musculus
cagtatgagacacaggaccgccacc

SEQ ID NO: 256729 - DNA, 25 bp, Mus musculus
gcacccggccttgaggctctttaaa

SEQ ID NO: 256730 - DNA, 25 bp, Mus musculus
cggaaggtgatgtcccacagcagct

SEQ ID NO: 256731 - DNA, 25 bp, Mus musculus
atgagaccatagcaggcggccagca

SEQ ID NO: 256732 - DNA, 25 bp, Mus musculus
gacgttagcggcttcggaagaccga

SEQ ID NO: 256733 - DNA, 25 bp, Mus musculus
gagctgtagttcttgtgcgttggac

SEQ ID NO: 256734 - DNA, 25 bp, Mus musculus
tacgtcagctacgtgcggcgcgctc

SEQ ID NO: 256735 - DNA, 25 bp, Mus musculus
cgctacaccgtacgtcagctacgtg

SEQ ID NO: 256736 - DNA, 25 bp, Mus musculus
tccatggccgcacctgatgagaccg

SEQ ID NO: 256737 - DNA, 25 bp, Mus musculus
ggtgcctgttcgcaccgacgacgtc

SEQ ID NO: 256738 - DNA, 25 bp, Mus musculus
gacctaaggctgactgcgcagggcc

SEQ ID NO: 256739 - DNA, 25 bp, Mus musculus
ttagggcggcgacctaaggctgact

SEQ ID NO: 256740 - DNA, 25 bp, Mus musculus
acgcggtgatagtgacagaaaccca

SEQ ID NO: 256741 - DNA, 25 bp, Mus musculus
ctactttacggggagacgcggtgat

SEQ ID NO: 256742 - DNA, 25 bp, Mus musculus
ttgacactactttacggggagacgc

SEQ ID NO: 256743 - DNA, 25 bp, Mus musculus
gaaggggaaaaagtgagacattcca

SEQ ID NO: 256744 - DNA, 25 bp, Mus musculus
agttcttgtgcgttggacgttagcg

SEQ ID NO: 256745 - DNA, 25 bp, Mus musculus
cattccagggcgtagcctggagcga

SEQ ID NO: 256746 - DNA, 25 bp, Mus musculus
gaaccgcaagtcgacctcatggaga

SEQ ID NO: 256747 - DNA, 25 bp, Mus musculus
cgcgtggaaccgcaagtcgacctca

SEQ ID NO: 256748 - DNA, 25 bp, Mus musculus
cccacttcggcgcctggggatggct

SEQ ID NO: 256749 - DNA, 25 bp, Mus musculus
atccttctcttctcagggctctcga

SEQ ID NO: 256750 - DNA, 25 bp, Mus musculus
agtcgccatccttctcttctcaggg

SEQ ID NO: 256751 - DNA, 25 bp, Mus musculus
atactgccagcgctcccgaaagtcg

SEQ ID NO: 256752 - DNA, 25 bp, Mus musculus
agggtagttgatactgccagcgctc

SEQ ID NO: 256753 - DNA, 25 bp, Mus musculus
cgccttcttgtcagggtagttgata

SEQ ID NO: 256754 - DNA, 25 bp, Mus musculus
atggctgctccgtcggaccgtagtc

SEQ ID NO: 256755 - DNA, 25 bp, Mus musculus
ctgtcagcgccttcttgtcagggta

SEQ ID NO: 256756 - DNA, 25 bp, Mus musculus
gagcccttctgtcagcgccttcttg

SEQ ID NO: 256757 - DNA, 25 bp, Mus musculus
tcatggagagcccttctgtcagcgc

SEQ ID NO: 256758 - DNA, 25 bp, Mus musculus
gtcgacctcatggagagcccttctg

SEQ ID NO: 256759 - DNA, 25 bp, Mus musculus
gcgtgtctatgctgggacccaagcc

SEQ ID NO: 256760 - DNA, 25 bp, Mus musculus
ttcctcttccgggtcagagtgcacc

SEQ ID NO: 256761 - DNA, 25 bp, Mus musculus
agcatccgctcgctaggagagcgcc

SEQ ID NO: 256762 - DNA, 25 bp, Mus musculus
ttgtgttcacagtggcgaacggtga

SEQ ID NO: 256763 - DNA, 25 bp, Mus musculus
tccgcagtggttccctccgggcagg

SEQ ID NO: 256764 - DNA, 25 bp, Mus musculus
tcacagtggcgaacggtgacacggt

SEQ ID NO: 256765 - DNA, 25 bp, Mus musculus
agagtgcacccaactgcgcacagct

SEQ ID NO: 256766 - DNA, 25 bp, Mus musculus
ctgacttccgtttccgggctggcac

SEQ ID NO: 256767 - DNA, 25 bp, Mus musculus
tctgtgcttgctgccggtaactggc

SEQ ID NO: 256768 - DNA, 25 bp, Mus musculus
ttgctgccggtaactggccgcggct

SEQ ID NO: 256769 - DNA, 25 bp, Mus musculus
agtgagagagccactgcccttcggt

SEQ ID NO: 256770 - DNA, 25 bp, Mus musculus
cccttcggtccgaacagcccttctg

SEQ ID NO: 256771 - DNA, 25 bp, Mus musculus
ttctgctctccacactgtccgtagg

SEQ ID NO: 256772 - DNA, 25 bp, Mus musculus
actgtccgtaggagttgtgttcaca

SEQ ID NO: 256773 - DNA, 25 bp, Mus musculus
taggagagcgccctccgcagtggtt

SEQ ID NO: 256774 - DNA, 25 bp, Mus musculus
aatggcaagggccagttttctgggc

SEQ ID NO: 256775 - DNA, 25 bp, Mus musculus
tcgcgcgcgagctactttcgctgac

SEQ ID NO: 256776 - DNA, 25 bp, Mus musculus
ctccggctgccgttaactgacaggc

SEQ ID NO: 256777 - DNA, 25 bp, Mus musculus
tgacaggcgccttacgccaaccaaa

SEQ ID NO: 256778 - DNA, 25 bp, Mus musculus
tgtgttttcacacacggcgggagga

SEQ ID NO: 256779 - DNA, 25 bp, Mus musculus
ccaatcagcgacgagacgtcggccg

SEQ ID NO: 256780 - DNA, 25 bp, Mus musculus
gtggagacttttccgctcccttctc

SEQ ID NO: 256781 - DNA, 25 bp, Mus musculus
agcgtcacgactcgtacccggctgt

SEQ ID NO: 256782 - DNA, 25 bp, Mus musculus
tacccggctgtctcacagaacggct

SEQ ID NO: 256783 - DNA, 25 bp, Mus musculus
agaacggctccaccacgctcggagg

SEQ ID NO: 256784 - DNA, 25 bp, Mus musculus
cccgagagccaatcagacgacgagg

SEQ ID NO: 256785 - DNA, 25 bp, Mus musculus
gctcagagactcacgcagccctagt

SEQ ID NO: 256786 - DNA, 25 bp, Mus musculus
attggcggcgcaccggccaataagt

SEQ ID NO: 256787 - DNA, 25 bp, Mus musculus
gcagcctccgctgattggcggcgca

SEQ ID NO: 256788 - DNA, 25 bp, Mus musculus
gcccgctgcccacgcagtagtggaa

SEQ ID NO: 256789 - DNA, 25 bp, Mus musculus
tggtgctgaagtcggtgaaagagcc

SEQ ID NO: 256790 - DNA, 25 bp, Mus musculus
cccacgcagtagtggaagaggccga

SEQ ID NO: 256791 - DNA, 25 bp, Mus musculus
gaagaggccgaagtagccaggcttg

SEQ ID NO: 256792 - DNA, 25 bp, Mus musculus
ccaggcttgggagtgctcacgctgt

SEQ ID NO: 256793 - DNA, 25 bp, Mus musculus
tcacgctgtcgcctacccagtaggg

SEQ ID NO: 256794 - DNA, 25 bp, Mus musculus
ggctggatgaagaccaccacgttga

SEQ ID NO: 256795 - DNA, 25 bp, Mus musculus
accacgttgatgatggcgaagcaga

SEQ ID NO: 256796 - DNA, 25 bp, Mus musculus
ccgcgagttccgcatgtagtgctca

SEQ ID NO: 256797 - DNA, 25 bp, Mus musculus
ccgcatgtagtgctcatggtagagc

SEQ ID NO: 256798 - DNA, 25 bp, Mus musculus
ctcatggtagagcttggaggcttcc

SEQ ID NO: 256799 - DNA, 25 bp, Mus musculus
atggtagagcttggaggcttcctgc

SEQ ID NO: 256800 - DNA, 25 bp, Mus musculus
cgagaagcagccctgagtctaggaa

SEQ ID NO: 256801 - DNA, 25 bp, Mus musculus
ctgagtctaggaactcgcaagggcg

SEQ ID NO: 256802 - DNA, 25 bp, Mus musculus
tctgcgcggcctccatcttgctccg

SEQ ID NO: 256803 - DNA, 25 bp, Mus musculus
atccgggaccggcagggctcaagct

SEQ ID NO: 256804 - DNA, 25 bp, Mus musculus
aacagcggttgccttggcccaggcg

SEQ ID NO: 256805 - DNA, 25 bp, Mus musculus
tcctaacagcggttgccttggccca

SEQ ID NO: 256806 - DNA, 25 bp, Mus musculus
gatgctcctaacagcggttgccttg

SEQ ID NO: 256807 - DNA, 25 bp, Mus musculus
tgctcgatgctcctaacagcggttg

SEQ ID NO: 256808 - DNA, 25 bp, Mus musculus
tccggtgctcgatgctcctaacagc

SEQ ID NO: 256809 - DNA, 25 bp, Mus musculus
gttgccttggcccaggcggcgtcct

SEQ ID NO: 256810 - DNA, 25 bp, Mus musculus
tgggaagaccaacctgggccgagtc

SEQ ID NO: 256811 - DNA, 25 bp, Mus musculus
atgtgggaagaccaacctgggccga

SEQ ID NO: 256812 - DNA, 25 bp, Mus musculus
ccaagggaacaggcgatcgaggcca

SEQ ID NO: 256813 - DNA, 25 bp, Mus musculus
cgaggagagtggctttccaggccaa

SEQ ID NO: 256814 - DNA, 25 bp, Mus musculus
cagggctcaagctccggtgctcgat

SEQ ID NO: 256815 - DNA, 25 bp, Mus musculus
aagctccggtgctcgatgctcctaa

SEQ ID NO: 256816 - DNA, 25 bp, Mus musculus
tggaggagttctcccggactcagta

SEQ ID NO: 256817 - DNA, 25 bp, Mus musculus
tcagtaccgtgccaaggacagcggc

SEQ ID NO: 256818 - DNA, 25 bp, Mus musculus
gagttctcccggactcagtaccgtg

SEQ ID NO: 256819 - DNA, 25 bp, Mus musculus
ctgagtcggttcaggaggttttaga

SEQ ID NO: 256820 - DNA, 25 bp, Mus musculus
tccgagcttcaggtgccatgggctg

SEQ ID NO: 256821 - DNA, 25 bp, Mus musculus
ccggagtccgagcttcaggtgccat

SEQ ID NO: 256822 - DNA, 25 bp, Mus musculus
cttcctctcttgttgccaatggttc

SEQ ID NO: 256823 - DNA, 25 bp, Mus musculus
ttgttgccaatggttcccgcctttc

SEQ ID NO: 256824 - DNA, 25 bp, Mus musculus
tgaggccacttggatccctccgcgt

SEQ ID NO: 256825 - DNA, 25 bp, Mus musculus
acttggatccctccgcgtcaggggt

SEQ ID NO: 256826 - DNA, 25 bp, Mus musculus
acgaaccccgggctctgattggctg

SEQ ID NO: 256827 - DNA, 25 bp, Mus musculus
tgcggcgggagtaaacatccggaga

SEQ ID NO: 256828 - DNA, 25 bp, Mus musculus
gcggttccttcctctcttgttgcca

SEQ ID NO: 256829 - DNA, 25 bp, Mus musculus
cccggactcagtaccgtgccaagga

SEQ ID NO: 256830 - DNA, 25 bp, Mus musculus
gtgggacagtcccaatcgccgacca

SEQ ID NO: 256831 - DNA, 25 bp, Mus musculus
cccaggaggctaggctctctctacg

SEQ ID NO: 256832 - DNA, 25 bp, Mus musculus
gaggctaggctctctctacgccaga

SEQ ID NO: 256833 - DNA, 25 bp, Mus musculus
tgtagtagaccttgccgtcgaagtc

SEQ ID NO: 256834 - DNA, 25 bp, Mus musculus
tcgatccagctggtggtgcggttcc

SEQ ID NO: 256835 - DNA, 25 bp, Mus musculus
tggtgcggttcctgtgatctatgta

SEQ ID NO: 256836 - DNA, 25 bp, Mus musculus
tctacgccagagtgtccgggctctt

SEQ ID NO: 256837 - DNA, 25 bp, Mus musculus
gatctatgtagtagaccttgccgtc

SEQ ID NO: 256838 - DNA, 25 bp, Mus musculus
ctccggcggtgcaggtaactgcgct

SEQ ID NO: 256839 - DNA, 25 bp, Mus musculus
agaccttgccgtcgaagtcgcgcgc

SEQ ID NO: 256840 - DNA, 25 bp, Mus musculus
ccggggcatcttcccgagcctggcc

SEQ ID NO: 256841 - DNA, 25 bp, Mus musculus
agacttctgcctccgccaggtgtgg

SEQ ID NO: 256842 - DNA, 25 bp, Mus musculus
cgcctctcacgctgccatgtgcgcc

SEQ ID NO: 256843 - DNA, 25 bp, Mus musculus
cggttcctgtgatctatgtagtaga

SEQ ID NO: 256844 - DNA, 25 bp, Mus musculus
ttgaaattactgtgtcgtgccggtg

SEQ ID NO: 256845 - DNA, 25 bp, Mus musculus
ccggccaccaagattgaaattactg

SEQ ID NO: 256846 - DNA, 25 bp, Mus musculus
tagcgtcccggccaccaagattgaa

SEQ ID NO: 256847 - DNA, 25 bp, Mus musculus
tcatgtctctcagcggagcctcgga

SEQ ID NO: 256848 - DNA, 25 bp, Mus musculus
tggaccagtcatgtctctcagcgga

SEQ ID NO: 256849 - DNA, 25 bp, Mus musculus
ttggccattggaccagtcatgtctc

SEQ ID NO: 256850 - DNA, 25 bp, Mus musculus
cgcacacaaggctggagagagccgc

SEQ ID NO: 256851 - DNA, 25 bp, Mus musculus
ctgcctccgcacatgggccggcctc

SEQ ID NO: 256852 - DNA, 25 bp, Mus musculus
ccctacgcggctttggccattggac

SEQ ID NO: 256853 - DNA, 25 bp, Mus musculus
gcggctttggccattggaccagtca

SEQ ID NO: 256854 - DNA, 25 bp, Mus musculus
tgtgctgccatctggagccgctgct

SEQ ID NO: 256855 - DNA, 25 bp, Mus musculus
tagcttcggcacccggggtctcgca

SEQ ID NO: 256856 - DNA, 25 bp, Mus musculus
caaggctggagagagccgctgcctc

SEQ ID NO: 256857 - DNA, 25 bp, Mus musculus
aaattactgtgtcgtgccggtgagc

SEQ ID NO: 256858 - DNA, 25 bp, Mus musculus
cgggaacctctagcccgactgcacg

SEQ ID NO: 256859 - DNA, 25 bp, Mus musculus
tcggacgaaccgaggtgattgacaa

SEQ ID NO: 256860 - DNA, 25 bp, Mus musculus
gacttcgtgcgcaaattcgttctcg

SEQ ID NO: 256861 - DNA, 25 bp, Mus musculus
tccagacttcgtgcgcaaattcgtt

SEQ ID NO: 256862 - DNA, 25 bp, Mus musculus
actgaatccagacttcgtgcgcaaa

SEQ ID NO: 256863 - DNA, 25 bp, Mus musculus
gacaacacactgaatccagacttcg

SEQ ID NO: 256864 - DNA, 25 bp, Mus musculus
ggtgattgacaacacactgaatcca

SEQ ID NO: 256865 - DNA, 25 bp, Mus musculus
acgaaccgaggtgattgacaacaca

SEQ ID NO: 256866 - DNA, 25 bp, Mus musculus
ccagttcggacgaaccgaggtgatt

SEQ ID NO: 256867 - DNA, 25 bp, Mus musculus
ctgctgcccagttcggacgaaccga

SEQ ID NO: 256868 - DNA, 25 bp, Mus musculus
ttgcgttcatgctccgtcctcccac

SEQ ID NO: 256869 - DNA, 25 bp, Mus musculus
cgactgcacgccttgcgttcatgct

SEQ ID NO: 256870 - DNA, 25 bp, Mus musculus
ctcagggccgctcccgggaacctct

SEQ ID NO: 256871 - DNA, 25 bp, Mus musculus
tgcacgccttgcgttcatgctccgt

SEQ ID NO: 256872 - DNA, 25 bp, Mus musculus
aggccaaccgctcccacctcacagg

SEQ ID NO: 256873 - DNA, 25 bp, Mus musculus
tggcgcgcctttccaaacctcgagg

SEQ ID NO: 256874 - DNA, 25 bp, Mus musculus
ggaagaaccatactggcgcgccttt

SEQ ID NO: 256875 - DNA, 25 bp, Mus musculus
actgggacccggaagaaccatactg

SEQ ID NO: 256876 - DNA, 25 bp, Mus musculus
atctacttccggtgggagtaaactg

SEQ ID NO: 256877 - DNA, 25 bp, Mus musculus
caaggatctacttccggtgggagta

SEQ ID NO: 256878 - DNA, 25 bp, Mus musculus
taagcgggagcaaggatctacttcc

SEQ ID NO: 256879 - DNA, 25 bp, Mus musculus
cctctagggtcaaataagcgggagc

SEQ ID NO: 256880 - DNA, 25 bp, Mus musculus
ctcggattggctacctctagggtca

SEQ ID NO: 256881 - DNA, 25 bp, Mus musculus
tcgtactttcttctcggattggcta

SEQ ID NO: 256882 - DNA, 25 bp, Mus musculus
tggtgcttcgtactttcttctcgga

SEQ ID NO: 256883 - DNA, 25 bp, Mus musculus
cccgagttctcattggtgcttcgta

SEQ ID NO: 256884 - DNA, 25 bp, Mus musculus
tccggcactcccgagttctcattgg

SEQ ID NO: 256885 - DNA, 25 bp, Mus musculus
ttccaaacctcgagggctgcgcagg

SEQ ID NO: 256886 - DNA, 25 bp, Mus musculus
ggaggctacaaccaaagcgacaagc

SEQ ID NO: 256887 - DNA, 25 bp, Mus musculus
tctccgtccacggtagaggttggct

SEQ ID NO: 256888 - DNA, 25 bp, Mus musculus
gtcctccctgtgttttgcctgtaga

SEQ ID NO: 256889 - DNA, 25 bp, Mus musculus
tccagcccggaagtgctgtcggaga

SEQ ID NO: 256890 - DNA, 25 bp, Mus musculus
gatctgaatatctctcggctctccc

SEQ ID NO: 256891 - DNA, 25 bp, Mus musculus
tacaagtcccagaggtcccagtgtg

SEQ ID NO: 256892 - DNA, 25 bp, Mus musculus
tcatagcaggtcttctacaagtccc

SEQ ID NO: 256893 - DNA, 25 bp, Mus musculus
gggactcgaccgctactgtctcata

SEQ ID NO: 256894 - DNA, 25 bp, Mus musculus
cggccgaaccctacggttgcaaatg

SEQ ID NO: 256895 - DNA, 25 bp, Mus musculus
cccaacctgaggtcgggctgtacta

SEQ ID NO: 256896 - DNA, 25 bp, Mus musculus
ctaaggccacctacgaatctccggg

SEQ ID NO: 256897 - DNA, 25 bp, Mus musculus
ggcccagagcccaaatctcaaggga

SEQ ID NO: 256898 - DNA, 25 bp, Mus musculus
tatgtgtagcgatccaaggggactc

SEQ ID NO: 256899 - DNA, 25 bp, Mus musculus
ggttcggcctgtcctaatttggtgc

SEQ ID NO: 256900 - DNA, 25 bp, Mus musculus
agctggctccggaggtcgcagccat

SEQ ID NO: 256901 - DNA, 25 bp, Mus musculus
gtcagctcggcgcttctcctgagcg

SEQ ID NO: 256902 - DNA, 25 bp, Mus musculus
taaaggcgcatgcagggtgtcagct

SEQ ID NO: 256903 - DNA, 25 bp, Mus musculus
gcactgcgagctggctaaaggcgca

SEQ ID NO: 256904 - DNA, 25 bp, Mus musculus
ggaggtcgcagccatccgagctccg

SEQ ID NO: 256905 - DNA, 25 bp, Mus musculus
tcccggcggtctgagaggctacaat

SEQ ID NO: 256906 - DNA, 25 bp, Mus musculus
agaggctacaatggcctggtcccgc

SEQ ID NO: 256907 - DNA, 25 bp, Mus musculus
ggattacagctcattgcctgcgcgc

SEQ ID NO: 256908 - DNA, 25 bp, Mus musculus
acctaagcagcgctcgcgagtcgtc

SEQ ID NO: 256909 - DNA, 25 bp, Mus musculus
agctccgagtgtagctggctccgga

SEQ ID NO: 256910 - DNA, 25 bp, Mus musculus
gcgagtcgtccatgcccggtgctct

SEQ ID NO: 256911 - DNA, 25 bp, Mus musculus
ccctacggccgcctgatggtgaggc

SEQ ID NO: 256912 - DNA, 25 bp, Mus musculus
caccctatcggcttcaggcagaggc

SEQ ID NO: 256913 - DNA, 25 bp, Mus musculus
gcaactccgagtcccggcggtctga

SEQ ID NO: 256914 - DNA, 25 bp, Mus musculus
cagtacgcatgcgtgtccacggaca

SEQ ID NO: 256915 - DNA, 25 bp, Mus musculus
cggcatccctctgccgtgcgcaaga

SEQ ID NO: 256916 - DNA, 25 bp, Mus musculus
agggcgctcagacgagcgagaatcc

SEQ ID NO: 256917 - DNA, 25 bp, Mus musculus
agctccggccgccagatcatagaga

SEQ ID NO: 256918 - DNA, 25 bp, Mus musculus
ccggccgccagatcatagagacata

SEQ ID NO: 256919 - DNA, 25 bp, Mus musculus
cgccagatcatagagacataacgca

SEQ ID NO: 256920 - DNA, 25 bp, Mus musculus
acgcaaaactctcagggctcccatt

SEQ ID NO: 256921 - DNA, 25 bp, Mus musculus
gccggggaccaagcacagtacgcat

SEQ ID NO: 256922 - DNA, 25 bp, Mus musculus
catgcgtgtccacggacagctcaac

SEQ ID NO: 256923 - DNA, 25 bp, Mus musculus
cccgtacatcctccgtgcgtagatt

SEQ ID NO: 256924 - DNA, 25 bp, Mus musculus
cctccgtgcgtagattggtcaggca

SEQ ID NO: 256925 - DNA, 25 bp, Mus musculus
tggtcaggcaggctgtcaatcaagg

SEQ ID NO: 256926 - DNA, 25 bp, Mus musculus
cagggctcccattgccggggaccaa

SEQ ID NO: 256927 - DNA, 25 bp, Mus musculus
caggctgtcaatcaaggcagagggc

SEQ ID NO: 256928 - DNA, 25 bp, Mus musculus
cgcgtcgccatgcactaccagatga

SEQ ID NO: 256929 - DNA, 25 bp, Mus musculus
cggagcctgcagatcctgggaagaa

SEQ ID NO: 256930 - DNA, 25 bp, Mus musculus
ctgctctgtttccaggccggggaaa

SEQ ID NO: 256931 - DNA, 25 bp, Mus musculus
cagccagttgtcgtgtacccgccag

SEQ ID NO: 256932 - DNA, 25 bp, Mus musculus
acggcagcgactttcagcaccggga

SEQ ID NO: 256933 - DNA, 25 bp, Mus musculus
gttctgtacaatggcgtctcgggca

SEQ ID NO: 256934 - DNA, 25 bp, Mus musculus
gcgttaggggccttagttctgtaca

SEQ ID NO: 256935 - DNA, 25 bp, Mus musculus
aagaagcgacgccagtggtcctcac

SEQ ID NO: 256936 - DNA, 25 bp, Mus musculus
ctccacgccgtgtagtgaaagccgg

SEQ ID NO: 256937 - DNA, 25 bp, Mus musculus
ggccggaagttctcccggagctcca

SEQ ID NO: 256938 - DNA, 25 bp, Mus musculus
tcccaggatagagaggccggaagtt

SEQ ID NO: 256939 - DNA, 25 bp, Mus musculus
ctgctctaacgacctctgctctgtt

SEQ ID NO: 256940 - DNA, 25 bp, Mus musculus
ccacagagtcagtcctcccaggata

SEQ ID NO: 256941 - DNA, 25 bp, Mus musculus
accagatgaggtacgaggtgagcca

SEQ ID NO: 256942 - DNA, 25 bp, Mus musculus
aggctgcgtcccttcgcaccttgtt

SEQ ID NO: 256943 - DNA, 25 bp, Mus musculus
ctctgggaagggacgcacgtagcac

SEQ ID NO: 256944 - DNA, 25 bp, Mus musculus
tcgaacaaggccagttttactccta

SEQ ID NO: 256945 - DNA, 25 bp, Mus musculus
gccagttttactcctacatgcagcg

SEQ ID NO: 256946 - DNA, 25 bp, Mus musculus
tacatgcagcggactcagaggcaca

SEQ ID NO: 256947 - DNA, 25 bp, Mus musculus
cacagcgacgcctggtgggagcttt

SEQ ID NO: 256948 - DNA, 25 bp, Mus musculus
gacgcgacgtgatcgtggatctctg

SEQ ID NO: 256949 - DNA, 25 bp, Mus musculus
gcacgtagcacgcattggaccactg

SEQ ID NO: 256950 - DNA, 25 bp, Mus musculus
gaccactgccgtggctttgggcagc

SEQ ID NO: 256951 - DNA, 25 bp, Mus musculus
ggaactgtgcgggtcccagcaccgc

SEQ ID NO: 256952 - DNA, 25 bp, Mus musculus
cctaggctccggtcgaacaaggcca

SEQ ID NO: 256953 - DNA, 25 bp, Mus musculus
gcaccttgttgtgcgctgctccacg

SEQ ID NO: 256954 - DNA, 25 bp, Mus musculus
tcgcctctgcgccaaaggtgacatc

SEQ ID NO: 256955 - DNA, 25 bp, Mus musculus
cagtgctgctcctgtggaactgtgc

SEQ ID NO: 256956 - DNA, 25 bp, Mus musculus
cagcagcgtggagtactggaactca

SEQ ID NO: 256957 - DNA, 25 bp, Mus musculus
agcgtgaccaggtcaccatccgcgg

SEQ ID NO: 256958 - DNA, 25 bp, Mus musculus
tggttcctagcgtgaccaggtcacc

SEQ ID NO: 256959 - DNA, 25 bp, Mus musculus
accttgcgcccaatggtggttccta

SEQ ID NO: 256960 - DNA, 25 bp, Mus musculus
gtgggctgtgacaccgtcacgttca

SEQ ID NO: 256961 - DNA, 25 bp, Mus musculus
tcctgccattcaccagcagcgtggg

SEQ ID NO: 256962 - DNA, 25 bp, Mus musculus
ttcgagtcctgccattcaccagcag

SEQ ID NO: 256963 - DNA, 25 bp, Mus musculus
tgttggtgaaccttcgagtcctgcc

SEQ ID NO: 256964 - DNA, 25 bp, Mus musculus
tggaactcaatgttggtgaaccttc

SEQ ID NO: 256965 - DNA, 25 bp, Mus musculus
tactgagcagcagcgtggagtactg

SEQ ID NO: 256966 - DNA, 25 bp, Mus musculus
aggccgtagcggatactgagcagca

SEQ ID NO: 256967 - DNA, 25 bp, Mus musculus
acgcgggccttttcttcgtccagcg

SEQ ID NO: 256968 - DNA, 25 bp, Mus musculus
cgcttggtccaggacgcgggccttt

SEQ ID NO: 256969 - DNA, 25 bp, Mus musculus
ccttttcttcgtccagcgtgtcggg

SEQ ID NO: 256970 - DNA, 25 bp, Mus musculus
catggctttccataattggctggga

SEQ ID NO: 256971 - DNA, 25 bp, Mus musculus
tggcgtggtaatccttctcttctcg

SEQ ID NO: 256972 - DNA, 25 bp, Mus musculus
agcagtggctgcagctccagacagt

SEQ ID NO: 256973 - DNA, 25 bp, Mus musculus
cagctgcgtgctacccgatttcctg

SEQ ID NO: 256974 - DNA, 25 bp, Mus musculus
ggtctacttcgacgggctgctgcac

SEQ ID NO: 256975 - DNA, 25 bp, Mus musculus
tgccggctttcctggatgcactgca

SEQ ID NO: 256976 - DNA, 25 bp, Mus musculus
tccgccctggacagctgtacttcta

SEQ ID NO: 256977 - DNA, 25 bp, Mus musculus
ttcctaaccaagtagcactcgtgta

SEQ ID NO: 256978 - DNA, 25 bp, Mus musculus
tcgtgtatctgttccgaggacccgc

SEQ ID NO: 256979 - DNA, 25 bp, Mus musculus
cgaggacccgctaacagagccttta

SEQ ID NO: 256980 - DNA, 25 bp, Mus musculus
accagcgacgccgtatcctgcagga

SEQ ID NO: 256981 - DNA, 25 bp, Mus musculus
gagccgcttctggttggctagtgta

SEQ ID NO: 256982 - DNA, 25 bp, Mus musculus
tgggaccctgcactacactagaata

SEQ ID NO: 256983 - DNA, 25 bp, Mus musculus
tttaaagcccggacaggtgcagccc

SEQ ID NO: 256984 - DNA, 25 bp, Mus musculus
gcggcctcggagcaatgatgtgccc

SEQ ID NO: 256985 - DNA, 25 bp, Mus musculus
cttagcccagcaagcgtgctccgtg

SEQ ID NO: 256986 - DNA, 25 bp, Mus musculus
gccaagccacggagaccacagcgtt

SEQ ID NO: 256987 - DNA, 25 bp, Mus musculus
tctcgaaccaagtgctcccggaaga

SEQ ID NO: 256988 - DNA, 25 bp, Mus musculus
caaattgataggtgacggtggccgc

SEQ ID NO: 256989 - DNA, 25 bp, Mus musculus
gggacatcctctggccacctggacg

SEQ ID NO: 256990 - DNA, 25 bp, Mus musculus
cagcgttggaacacactctctcgaa

SEQ ID NO: 256991 - DNA, 25 bp, Mus musculus
ccagggtccagaaccaggagtgaca

SEQ ID NO: 256992 - DNA, 25 bp, Mus musculus
cccagcagcgttgcggatgagactt

SEQ ID NO: 256993 - DNA, 25 bp, Mus musculus
agacttttgctgatgtccaggccgc

SEQ ID NO: 256994 - DNA, 25 bp, Mus musculus
ccgcatagcagttattgggtctctc

SEQ ID NO: 256995 - DNA, 25 bp, Mus musculus
ggaacttcgctcttccctgtaggcg

SEQ ID NO: 256996 - DNA, 25 bp, Mus musculus
gacgtgcgcaagcacacctcggtga

SEQ ID NO: 256997 - DNA, 25 bp, Mus musculus
tcgatgctgcggctcaaattgatag

SEQ ID NO: 256998 - DNA, 25 bp, Mus musculus
gtttggcaccgtgcaggcccatgcc

SEQ ID NO: 256999 - DNA, 25 bp, Mus musculus
cctttgggaacggtctctgttcgct

SEQ ID NO: 257000 - DNA, 25 bp, Mus musculus
caggagcgcgggatacttaaccctt

SEQ ID NO: 257001 - DNA, 25 bp, Mus musculus
ccgcccacaggagcgcgggatactt

SEQ ID NO: 257002 - DNA, 25 bp, Mus musculus
cggctctgccgatctcctcgtcaag

SEQ ID NO: 257003 - DNA, 25 bp, Mus musculus
atgctcaggcttggccagcagagcc

SEQ ID NO: 257004 - DNA, 25 bp, Mus musculus
cctccgagatgctcaggcttggcca

SEQ ID NO: 257005 - DNA, 25 bp, Mus musculus
tcccggaggcgcatcctccgagatg

SEQ ID NO: 257006 - DNA, 25 bp, Mus musculus
agccatgcgttcaccttgcgcgcgt

SEQ ID NO: 257007 - DNA, 25 bp, Mus musculus
ttgccttcttgggtcccgccatctc

SEQ ID NO: 257008 - DNA, 25 bp, Mus musculus
gctgtaagccttgctccttgccttc

SEQ ID NO: 257009 - DNA, 25 bp, Mus musculus
gcgaaggggctgtaagccttgctcc

SEQ ID NO: 257010 - DNA, 25 bp, Mus musculus
aacggtctctgttcgctgctcctca

SEQ ID NO: 257011 - DNA, 25 bp, Mus musculus
gcccatgcccgcgaaggggctgtaa

SEQ ID NO: 257012 - DNA, 25 bp, Mus musculus
ctctgacggcaaaatccgaggtttc

SEQ ID NO: 257013 - DNA, 25 bp, Mus musculus
cgcaccaatgactcggggacaatca

SEQ ID NO: 257014 - DNA, 25 bp, Mus musculus
tcgcagagttcttggcgcaccaatg

SEQ ID NO: 257015 - DNA, 25 bp, Mus musculus
gcagccaagatctcgccaatcgtta

SEQ ID NO: 257016 - DNA, 25 bp, Mus musculus
tttttctctctgcagtcggtgacta

SEQ ID NO: 257017 - DNA, 25 bp, Mus musculus
cttttcattggtgagagagcttccc

SEQ ID NO: 257018 - DNA, 25 bp, Mus musculus
ggccagagacctagacgcggattga

SEQ ID NO: 257019 - DNA, 25 bp, Mus musculus
agccttgaccaggaaacctctgacg

SEQ ID NO: 257020 - DNA, 25 bp, Mus musculus
gaggtggtgctcattccctgaatca

SEQ ID NO: 257021 - DNA, 25 bp, Mus musculus
ttccctgaatcaaggagtcgctgca

SEQ ID NO: 257022 - DNA, 25 bp, Mus musculus
cgtctggaccgtttggaagacacca

SEQ ID NO: 257023 - DNA, 25 bp, Mus musculus
ggcctcccaaaatgcccttgagatg

SEQ ID NO: 257024 - DNA, 25 bp, Mus musculus
cgcaccagcaccacaaagttgagtt

SEQ ID NO: 257025 - DNA, 25 bp, Mus musculus
cagagtctaattcaggggcaaatgc

SEQ ID NO: 257026 - DNA, 25 bp, Mus musculus
gcctagctttctccgcgcactgttt

SEQ ID NO: 257027 - DNA, 25 bp, Mus musculus
agtgatgataacgatgggcaggacc

SEQ ID NO: 257028 - DNA, 25 bp, Mus musculus
acgatgggcaggaccacccagaggc

SEQ ID NO: 257029 - DNA, 25 bp, Mus musculus
cacccagaggcggatgttggagtca

SEQ ID NO: 257030 - DNA, 25 bp, Mus musculus
atgttggagtcaagcagcagctcgg

SEQ ID NO: 257031 - DNA, 25 bp, Mus musculus
cgccatcttcgctgagagttcgctg

SEQ ID NO: 257032 - DNA, 25 bp, Mus musculus
gaatctggggcagcctagctttctc

SEQ ID NO: 257033 - DNA, 25 bp, Mus musculus
tctccgcgcactgtttccagctggg

SEQ ID NO: 257034 - DNA, 25 bp, Mus musculus
tcaacttccggtgcgggcgagtaac

SEQ ID NO: 257035 - DNA, 25 bp, Mus musculus
taacgtcacgccacggcgcggcttt

SEQ ID NO: 257036 - DNA, 25 bp, Mus musculus
ctttgatggcgtcagagcgccgttc

SEQ ID NO: 257037 - DNA, 25 bp, Mus musculus
agtcgaaaacgaagggaagcaactg

SEQ ID NO: 257038 - DNA, 25 bp, Mus musculus
gcgccgttcttctagcgggaaagtc

SEQ ID NO: 257039 - DNA, 25 bp, Mus musculus
cctcagtctggctggcgtggaatct

SEQ ID NO: 257040 - DNA, 25 bp, Mus musculus
ctaacgacaagatccgctagtggtc

SEQ ID NO: 257041 - DNA, 25 bp, Mus musculus
gcgcttccgtgccagtcttcacttg

SEQ ID NO: 257042 - DNA, 25 bp, Mus musculus
gagggtctaccctgcccgttgccat

SEQ ID NO: 257043 - DNA, 25 bp, Mus musculus
tggctactcgcttcctctttggctg

SEQ ID NO: 257044 - DNA, 25 bp, Mus musculus
ggggacagggtagctcttagtcttc

SEQ ID NO: 257045 - DNA, 25 bp, Mus musculus
tcttagtcttcacatcgcgagtgga

SEQ ID NO: 257046 - DNA, 25 bp, Mus musculus
tctcaactctttcggtcagcgggcg

SEQ ID NO: 257047 - DNA, 25 bp, Mus musculus
gccagccctttctggggctcgaaca

SEQ ID NO: 257048 - DNA, 25 bp, Mus musculus
tcaccagcagcatcaagaaaatctc

SEQ ID NO: 257049 - DNA, 25 bp, Mus musculus
tgcgcagccgtgtcacggtcacggt

SEQ ID NO: 257050 - DNA, 25 bp, Mus musculus
gcgaaccgggagtacattgagatca

SEQ ID NO: 257051 - DNA, 25 bp, Mus musculus
gtgcagcgggagattcaccaggact

SEQ ID NO: 257052 - DNA, 25 bp, Mus musculus
ggctcgaacactcgggtactggctg

SEQ ID NO: 257053 - DNA, 25 bp, Mus musculus
cgcgagtggaggaatcttgtttacc

SEQ ID NO: 257054 - DNA, 25 bp, Mus musculus
ctaggccgctgctgctgtaacaggc

SEQ ID NO: 257055 - DNA, 25 bp, Mus musculus
acaggcggggcgctttctctccgac

SEQ ID NO: 257056 - DNA, 25 bp, Mus musculus
cacgtccagcttgcgaatccgaggg

SEQ ID NO: 257057 - DNA, 25 bp, Mus musculus
cccagttcccggtcaggttcggcat

SEQ ID NO: 257058 - DNA, 25 bp, Mus musculus
ttcggatgcagtgttaacccagttc

SEQ ID NO: 257059 - DNA, 25 bp, Mus musculus
gagcgcgtagatccgcacgcacgca

SEQ ID NO: 257060 - DNA, 25 bp, Mus musculus
agacctgtcccggagcgcgtagatc

SEQ ID NO: 257061 - DNA, 25 bp, Mus musculus
ctttgtggctcaacttcgacggcga

SEQ ID NO: 257062 - DNA, 25 bp, Mus musculus
ttccgccttcaagttgcccggagcg

SEQ ID NO: 257063 - DNA, 25 bp, Mus musculus
tcaggtcatcttctgcaaccgcagc

SEQ ID NO: 257064 - DNA, 25 bp, Mus musculus
tccgagggacccgttccaataatgc

SEQ ID NO: 257065 - DNA, 25 bp, Mus musculus
tgaactcgcgcgagccctctcaggt

SEQ ID NO: 257066 - DNA, 25 bp, Mus musculus
cgcatccacagctaccgaggtacga

SEQ ID NO: 257067 - DNA, 25 bp, Mus musculus
ccctaccagtgatttcggatgcagt

SEQ ID NO: 257068 - DNA, 25 bp, Mus musculus
ggccctccgccacaggctcagtcgc

SEQ ID NO: 257069 - DNA, 25 bp, Mus musculus
tcagtcgccaggcagtctcgccatg

SEQ ID NO: 257070 - DNA, 25 bp, Mus musculus
cgacctgtgccgcaatatcgacacg

SEQ ID NO: 257071 - DNA, 25 bp, Mus musculus
tgctggacgacctgtgccgcaatat

SEQ ID NO: 257072 - DNA, 25 bp, Mus musculus
catctaccagctgccgtcctgggtg

SEQ ID NO: 257073 - DNA, 25 bp, Mus musculus
ggcttgctacatctaccagctgccg

SEQ ID NO: 257074 - DNA, 25 bp, Mus musculus
tcgccatggcttgctacatctacca

SEQ ID NO: 257075 - DNA, 25 bp, Mus musculus
tactagggaagtcgcggccctccgc

SEQ ID NO: 257076 - DNA, 25 bp, Mus musculus
ggcagcgccgccctttactagggaa

SEQ ID NO: 257077 - DNA, 25 bp, Mus musculus
tgctcgcttacccagtggggccgcg

SEQ ID NO: 257078 - DNA, 25 bp, Mus musculus
ggggagcttgctcgcttacccagtg

SEQ ID NO: 257079 - DNA, 25 bp, Mus musculus
catagcttgggtggagcgtgacacc

SEQ ID NO: 257080 - DNA, 25 bp, Mus musculus
cttgcccgctctcggccatagcttg

SEQ ID NO: 257081 - DNA, 25 bp, Mus musculus
ggcagtctcgccatggcttgctaca

SEQ ID NO: 257082 - DNA, 25 bp, Mus musculus
aaggctgctgctacaatcgtcgttc

SEQ ID NO: 257083 - DNA, 25 bp, Mus musculus
agaacgtcggaccaacaggcgcgct

SEQ ID NO: 257084 - DNA, 25 bp, Mus musculus
aggcgcgctccgtcttgcccgaagt

SEQ ID NO: 257085 - DNA, 25 bp, Mus musculus
ctcccgttggagcaatcggcgccgt

SEQ ID NO: 257086 - DNA, 25 bp, Mus musculus
gtgcggcccaaaaggcggctccgca

SEQ ID NO: 257087 - DNA, 25 bp, Mus musculus
gcttcggaaggcagaccgctgcacc

SEQ ID NO: 257088 - DNA, 25 bp, Mus musculus
cccgtagcactggaatgggcagacg

SEQ ID NO: 257089 - DNA, 25 bp, Mus musculus
cagacgacaggaacgggaaaggtca

SEQ ID NO: 257090 - DNA, 25 bp, Mus musculus
aatcgtcgttcctctgtccctggca

SEQ ID NO: 257091 - DNA, 25 bp, Mus musculus
tcaagtatcactggggcagcacgtc

SEQ ID NO: 257092 - DNA, 25 bp, Mus musculus
cacgtcggaagggtgtcccagcaag

SEQ ID NO: 257093 - DNA, 25 bp, Mus musculus
cccagcgtctgaaagtccggcgcgg

SEQ ID NO: 257094 - DNA, 25 bp, Mus musculus
caaccacagagcttcgtgaggcgta

SEQ ID NO: 257095 - DNA, 25 bp, Mus musculus
agcggcgcaaggtcaagtatcactg

SEQ ID NO: 257096 - DNA, 25 bp, Mus musculus
agagagctacggaacgccttcacga

SEQ ID NO: 257097 - DNA, 25 bp, Mus musculus
tccggaattcaggatgagccatgaa

SEQ ID NO: 257098 - DNA, 25 bp, Mus musculus
gctgggaatcttcgatccggaattc

SEQ ID NO: 257099 - DNA, 25 bp, Mus musculus
tcttccaggtcggtgtcatcgatga

SEQ ID NO: 257100 - DNA, 25 bp, Mus musculus
ttgagcgcggcatcttcttccaggt

SEQ ID NO: 257101 - DNA, 25 bp, Mus musculus
ctcgagttctgcttgagcgcggcat

SEQ ID NO: 257102 - DNA, 25 bp, Mus musculus
attgttcttgttgagcgaggacggc

SEQ ID NO: 257103 - DNA, 25 bp, Mus musculus
tcccgctgtcgatggcgctattgtt

SEQ ID NO: 257104 - DNA, 25 bp, Mus musculus
tcggtcgtcaggttgatcccgctgt

SEQ ID NO: 257105 - DNA, 25 bp, Mus musculus
ggtagctgatttgctcgtgtcggtc

SEQ ID NO: 257106 - DNA, 25 bp, Mus musculus
tccctggacttgaagaggtagctga

SEQ ID NO: 257107 - DNA, 25 bp, Mus musculus
aagcgacgtctccaggctgtggatg

SEQ ID NO: 257108 - DNA, 25 bp, Mus musculus
taacccttcatagagagagctacgg

SEQ ID NO: 257109 - DNA, 25 bp, Mus musculus
ggggcctcagctaaagcgacgtctc

SEQ ID NO: 257110 - DNA, 25 bp, Mus musculus
caagagtgctccctggagtcgtcca

SEQ ID NO: 257111 - DNA, 25 bp, Mus musculus
cagctgtcacttgggcatgctggca

SEQ ID NO: 257112 - DNA, 25 bp, Mus musculus
gtcgggatgatgctcccaaactttc

SEQ ID NO: 257113 - DNA, 25 bp, Mus musculus
ctttccttcgcggaggcgttgagaa

SEQ ID NO: 257114 - DNA, 25 bp, Mus musculus
tttgcaaatcgtggaggctagtgcc

SEQ ID NO: 257115 - DNA, 25 bp, Mus musculus
tccagcgctggctaagaaagcagtc

SEQ ID NO: 257116 - DNA, 25 bp, Mus musculus
cccttcctgaagctcgcggagaatc

SEQ ID NO: 257117 - DNA, 25 bp, Mus musculus
accctgtttattgacggcgactgcc

SEQ ID NO: 257118 - DNA, 25 bp, Mus musculus
caggctcggcgtgtcactttgcaaa

SEQ ID NO: 257119 - DNA, 25 bp, Mus musculus
tccggctgagctagttgagcaaggc

SEQ ID NO: 257120 - DNA, 25 bp, Mus musculus
gcagtgactgtgacctctgcgcgtc

SEQ ID NO: 257121 - DNA, 25 bp, Mus musculus
ctctggctgctagacttaggcggct

SEQ ID NO: 257122 - DNA, 25 bp, Mus musculus
gggctaggcgcaaatgcccgctctc

SEQ ID NO: 257123 - DNA, 25 bp, Mus musculus
caggagaggtgtccgtttcccaaca

SEQ ID NO: 257124 - DNA, 25 bp, Mus musculus
cggccaagcgcccattgaagaagta

SEQ ID NO: 257125 - DNA, 25 bp, Mus musculus
agatcttctccgttcggatatttcg

SEQ ID NO: 257126 - DNA, 25 bp, Mus musculus
atcgtagatcttctccgttcggata

SEQ ID NO: 257127 - DNA, 25 bp, Mus musculus
tccggtggtcatcgtagatcttctc

SEQ ID NO: 257128 - DNA, 25 bp, Mus musculus
cgtcggcgaacatgcgggacacgat

SEQ ID NO: 257129 - DNA, 25 bp, Mus musculus
atgcgggacacgatccggccttgct

SEQ ID NO: 257130 - DNA, 25 bp, Mus musculus
cctcagggtgaatttccggtggtca

SEQ ID NO: 257131 - DNA, 25 bp, Mus musculus
cccactgctcgggagccacaggaag

SEQ ID NO: 257132 - DNA, 25 bp, Mus musculus
cccattgaagaagtaggagacattg

SEQ ID NO: 257133 - DNA, 25 bp, Mus musculus
aggagacattgacggctgccagccc

SEQ ID NO: 257134 - DNA, 25 bp, Mus musculus
ccggccttgcttgtcaatgtctgtc

SEQ ID NO: 257135 - DNA, 25 bp, Mus musculus
aggggcggcccacctggtcatagat

SEQ ID NO: 257136 - DNA, 25 bp, Mus musculus
aatgtctgtcctctcgctcatggcc

SEQ ID NO: 257137 - DNA, 25 bp, Mus musculus
tggtcatagatgatcctcagggtga

SEQ ID NO: 257138 - DNA, 25 bp, Mus musculus
ctggtgacggaggactgtctccgca

SEQ ID NO: 257139 - DNA, 25 bp, Mus musculus
agagactggctacgtcctggctctg

SEQ ID NO: 257140 - DNA, 25 bp, Mus musculus
ggcgcaacatcacaaacagccgcag

SEQ ID NO: 257141 - DNA, 25 bp, Mus musculus
cgactaggactagagagactggcta

SEQ ID NO: 257142 - DNA, 25 bp, Mus musculus
tggataacgacacgcgactaggact

SEQ ID NO: 257143 - DNA, 25 bp, Mus musculus
aaggagtcacactcacgcccagctg

SEQ ID NO: 257144 - DNA, 25 bp, Mus musculus
cccgctcttgaaagtattgactact

SEQ ID NO: 257145 - DNA, 25 bp, Mus musculus
cggaggcggtaaggagtcacactca

SEQ ID NO: 257146 - DNA, 25 bp, Mus musculus
tgactacttcaatctgcaacggagg

SEQ ID NO: 257147 - DNA, 25 bp, Mus musculus
ctgcaacggaggagagaacgagaca

SEQ ID NO: 257148 - DNA, 25 bp, Mus musculus
caagttgcgagaagaaacgaacacc

SEQ ID NO: 257149 - DNA, 25 bp, Mus musculus
aacgaacaccacagctacacaactg

SEQ ID NO: 257150 - DNA, 25 bp, Mus musculus
ctacacaactgacgggcgcaacatc

SEQ ID NO: 257151 - DNA, 25 bp, Mus musculus
cggagaggaaagagcattggataac

SEQ ID NO: 257152 - DNA, 25 bp, Mus musculus
tgccaagaacgatggtgcagaagat

SEQ ID NO: 257153 - DNA, 25 bp, Mus musculus
gtcagagatcggagggacagacacg

SEQ ID NO: 257154 - DNA, 25 bp, Mus musculus
gcacgatcactatctgcgggtcaga

SEQ ID NO: 257155 - DNA, 25 bp, Mus musculus
cactatctgcgggtcagagatcgga

SEQ ID NO: 257156 - DNA, 25 bp, Mus musculus
gacagacacggagatggcacggagg

SEQ ID NO: 257157 - DNA, 25 bp, Mus musculus
gccttgcccagcccaggttaagtgg

SEQ ID NO: 257158 - DNA, 25 bp, Mus musculus
cgtggatcttgcgggcgttgatctc

SEQ ID NO: 257159 - DNA, 25 bp, Mus musculus
gcgaaagtgccaagaacgatggtgc

SEQ ID NO: 257160 - DNA, 25 bp, Mus musculus
gatggggttccggaagatcccgtca

SEQ ID NO: 257161 - DNA, 25 bp, Mus musculus
ccggaagatcccgtcaaagacgttg

SEQ ID NO: 257162 - DNA, 25 bp, Mus musculus
ccgtcaaagacgttgcgctcgccgt

SEQ ID NO: 257163 - DNA, 25 bp, Mus musculus
agacgttgcgctcgccgtggatctt

SEQ ID NO: 257164 - DNA, 25 bp, Mus musculus
cgccaaactgcacgatcactatctg

SEQ ID NO: 257165 - DNA, 25 bp, Mus musculus
tacctggatggcgaaagtgccaaga

SEQ ID NO: 257166 - DNA, 25 bp, Mus musculus
ccctcgcacaggaggccgtgtcaag

SEQ ID NO: 257167 - DNA, 25 bp, Mus musculus
ccagcgatcggttcgggttccaggc

SEQ ID NO: 257168 - DNA, 25 bp, Mus musculus
agcccgtaatcgcggtgcggcagct

SEQ ID NO: 257169 - DNA, 25 bp, Mus musculus
ggtccctgcgcagactgtaccatcg

SEQ ID NO: 257170 - DNA, 25 bp, Mus musculus
gcagactgtaccatcgctcccgagg

SEQ ID NO: 257171 - DNA, 25 bp, Mus musculus
actgtaccatcgctcccgaggctgg

SEQ ID NO: 257172 - DNA, 25 bp, Mus musculus
tgtaccatcgctcccgaggctgggg

SEQ ID NO: 257173 - DNA, 25 bp, Mus musculus
ggcgcgagcgcggaccgaaccaccc

SEQ ID NO: 257174 - DNA, 25 bp, Mus musculus
ggctctgggcatcgctcccacggga

SEQ ID NO: 257175 - DNA, 25 bp, Mus musculus
tcccacgggacgcatccgcggccgc

SEQ ID NO: 257176 - DNA, 25 bp, Mus musculus
cagagccctagggagaggcccgttc

SEQ ID NO: 257177 - DNA, 25 bp, Mus musculus
cctcgcacaggaggccgtgtcaagg

SEQ ID NO: 257178 - DNA, 25 bp, Mus musculus
cgccagcgatcggttcgggttccag

SEQ ID NO: 257179 - DNA, 25 bp, Mus musculus
acaggaggccgtgtcaagggcacgc

SEQ ID NO: 257180 - DNA, 25 bp, Mus musculus
tctgaacgcccctagctccggaaag

SEQ ID NO: 257181 - DNA, 25 bp, Mus musculus
cggtcctgccgaccctcacctgcgc

SEQ ID NO: 257182 - DNA, 25 bp, Mus musculus
gctctggctttagccgaggccgctg

SEQ ID NO: 257183 - DNA, 25 bp, Mus musculus
gctttagccgaggccgctgggtccc

SEQ ID NO: 257184 - DNA, 25 bp, Mus musculus
gctacagggaagaagccgcgggaaa

SEQ ID NO: 257185 - DNA, 25 bp, Mus musculus
agtgcccgctcaaggtcaccgctga

SEQ ID NO: 257186 - DNA, 25 bp, Mus musculus
tcaaggtcaccgctgacaccgcgga

SEQ ID NO: 257187 - DNA, 25 bp, Mus musculus
aaggtcaccgctgacaccgcggaca

SEQ ID NO: 257188 - DNA, 25 bp, Mus musculus
gctgacaccgcggacaccggggccc

SEQ ID NO: 257189 - DNA, 25 bp, Mus musculus
ctggccaagctctggctttagccga

SEQ ID NO: 257190 - DNA, 25 bp, Mus musculus
ccaagctctggctttagccgaggcc

SEQ ID NO: 257191 - DNA, 25 bp, Mus musculus
aagctctggctttagccgaggccgc

SEQ ID NO: 257192 - DNA, 25 bp, Mus musculus
cgcgggaaaggtggcagagcccgtg

SEQ ID NO: 257193 - DNA, 25 bp, Mus musculus
gccgcgcccgctgccgagtgcccgc

SEQ ID NO: 257194 - DNA, 25 bp, Mus musculus
ctgaatgttcgttcctgccgtgttc

SEQ ID NO: 257195 - DNA, 25 bp, Mus musculus
gcttcgtttgccagagcccagctct

SEQ ID NO: 257196 - DNA, 25 bp, Mus musculus
gcccagctcttgaattcgaagtgaa

SEQ ID NO: 257197 - DNA, 25 bp, Mus musculus
agtgaaattcgaaagctgaatgttc

SEQ ID NO: 257198 - DNA, 25 bp, Mus musculus
ctgccgtgttctgctttgcttggtt

SEQ ID NO: 257199 - DNA, 25 bp, Mus musculus
gtttccagttcacaaagcccagcta

SEQ ID NO: 257200 - DNA, 25 bp, Mus musculus
agcccagctaaaaatgcctccaagg

SEQ ID NO: 257201 - DNA, 25 bp, Mus musculus
tgaagagctgggctagtcttctgcg

SEQ ID NO: 257202 - DNA, 25 bp, Mus musculus
gtcttctgcggcctggtgcccagac

SEQ ID NO: 257203 - DNA, 25 bp, Mus musculus
ctggtgcccagaccttcatgcttgc

SEQ ID NO: 257204 - DNA, 25 bp, Mus musculus
tgtgcgagtcccgtcccgctctgaa

SEQ ID NO: 257205 - DNA, 25 bp, Mus musculus
ggccagcgtgactgcggccgatcta

SEQ ID NO: 257206 - DNA, 25 bp, Mus musculus
acccgcctgggctacgcttcgtttg

SEQ ID NO: 257207 - DNA, 25 bp, Mus musculus
tctgctttgcttggtttccagttca

SEQ ID NO: 257208 - DNA, 25 bp, Mus musculus
gggcccagagcagcgtctgtcacct

SEQ ID NO: 257209 - DNA, 25 bp, Mus musculus
taccatcccgggattcaagcgggca

SEQ ID NO: 257210 - DNA, 25 bp, Mus musculus
ccatgactgcggagcaagcgctgcc

SEQ ID NO: 257211 - DNA, 25 bp, Mus musculus
cgaggcgcgcgacaaggctgtccac

SEQ ID NO: 257212 - DNA, 25 bp, Mus musculus
acaaggctgtccacgagcgcggcca

SEQ ID NO: 257213 - DNA, 25 bp, Mus musculus
acgagcgcggccactggaacaacaa

SEQ ID NO: 257214 - DNA, 25 bp, Mus musculus
ccactggaacaacaaggtggagttc

SEQ ID NO: 257215 - DNA, 25 bp, Mus musculus
ttgagcgtagctggagagatcatcg

SEQ ID NO: 257216 - DNA, 25 bp, Mus musculus
agatcatcggactgggcaacgtgtg

SEQ ID NO: 257217 - DNA, 25 bp, Mus musculus
gggtgacacctctcgtgcatggccc

SEQ ID NO: 257218 - DNA, 25 bp, Mus musculus
ggcccacctgtttctctgcgcctgc

SEQ ID NO: 257219 - DNA, 25 bp, Mus musculus
cagagcccgcttcgcacctgagcgc

SEQ ID NO: 257220 - DNA, 25 bp, Mus musculus
gcccgccgctcgagcctctcaaaag

SEQ ID NO: 257221 - DNA, 25 bp, Mus musculus
ccaccatctgccacctgccaccggg

SEQ ID NO: 257222 - DNA, 25 bp, Mus musculus
aggccaggtgccgtctatgtcctag

SEQ ID NO: 257223 - DNA, 25 bp, Mus musculus
cgggcaagacggcacggacaagccc

SEQ ID NO: 257224 - DNA, 25 bp, Mus musculus
ccggccctgggagccctagagagct

SEQ ID NO: 257225 - DNA, 25 bp, Mus musculus
ccctgggagccctagagagctgaga

SEQ ID NO: 257226 - DNA, 25 bp, Mus musculus
agccctagagagctgagaggttgca

SEQ ID NO: 257227 - DNA, 25 bp, Mus musculus
ctgagaggttgcaggcgagctgcgc

SEQ ID NO: 257228 - DNA, 25 bp, Mus musculus
cgagctgcgcgagcccaggagccca

SEQ ID NO: 257229 - DNA, 25 bp, Mus musculus
ccggccgcaggtaggaagggaggct

SEQ ID NO: 257230 - DNA, 25 bp, Mus musculus
cccagggatgctccggaggcgggag

SEQ ID NO: 257231 - DNA, 25 bp, Mus musculus
caagaggccaggtgccgtctatgtc

SEQ ID NO: 257232 - DNA, 25 bp, Mus musculus
ccaggtgccgtctatgtcctagttc

SEQ ID NO: 257233 - DNA, 25 bp, Mus musculus
gtgccgtctatgtcctagttcgttc

SEQ ID NO: 257234 - DNA, 25 bp, Mus musculus
gtcctagttcgttcgccagccgacg

SEQ ID NO: 257235 - DNA, 25 bp, Mus musculus
gtcccaagaggccaggtgccgtcta

SEQ ID NO: 257236 - DNA, 25 bp, Mus musculus
atgcgcgccgcgcttccgcgtttgt

SEQ ID NO: 257237 - DNA, 25 bp, Mus musculus
gaaagctgaagccagttttgggctg

SEQ ID NO: 257238 - DNA, 25 bp, Mus musculus
gccagttttgggctggtctggaata

SEQ ID NO: 257239 - DNA, 25 bp, Mus musculus
gcggggttcacttaggaaagctgaa

SEQ ID NO: 257240 - DNA, 25 bp, Mus musculus
ctggcggggttcacttaggaaagct

SEQ ID NO: 257241 - DNA, 25 bp, Mus musculus
gcggcggtaagtaagccgtggttgc

SEQ ID NO: 257242 - DNA, 25 bp, Mus musculus
tttgtgtgggctgggttattacgtc

SEQ ID NO: 257243 - DNA, 25 bp, Mus musculus
tgtcgttgttgttgtagtgcgcatg

SEQ ID NO: 257244 - DNA, 25 bp, Mus musculus
cgttgttgttgtagtgcgcatgcgc

SEQ ID NO: 257245 - DNA, 25 bp, Mus musculus
ctggaatattcttcacctgtctata

SEQ ID NO: 257246 - DNA, 25 bp, Mus musculus
ttgggctggtctggaatattcttca

SEQ ID NO: 257247 - DNA, 25 bp, Mus musculus
ggtcccctcgtactccggcagagag

SEQ ID NO: 257248 - DNA, 25 bp, Mus musculus
ccggcagagagtgttgcgatctccg

SEQ ID NO: 257249 - DNA, 25 bp, Mus musculus
ctgggttattacgtcattgggccgc

SEQ ID NO: 257250 - DNA, 25 bp, Mus musculus
cgctctgccacggaaggctgcagga

SEQ ID NO: 257251 - DNA, 25 bp, Mus musculus
cgcctgcctgcaccttccttggttg

SEQ ID NO: 257252 - DNA, 25 bp, Mus musculus
cggtcgctctgccacggaaggctgc

SEQ ID NO: 257253 - DNA, 25 bp, Mus musculus
ggaggggcgccgacctgatgccgct

SEQ ID NO: 257254 - DNA, 25 bp, Mus musculus
catctttgttgcggctgggcagccg

SEQ ID NO: 257255 - DNA, 25 bp, Mus musculus
gtcgctctgccacggaaggctgcag

SEQ ID NO: 257256 - DNA, 25 bp, Mus musculus
gcggcatctttgttgcggctgggca

SEQ ID NO: 257257 - DNA, 25 bp, Mus musculus
gtgaagaacggagggcggcggcatc

SEQ ID NO: 257258 - DNA, 25 bp, Mus musculus
ccgcctcgacttggcgcgcccgcag

SEQ ID NO: 257259 - DNA, 25 bp, Mus musculus
ttctccgcctcgacttggcgcgccc

SEQ ID NO: 257260 - DNA, 25 bp, Mus musculus
ccttccttggttggcgcttgcccgc

SEQ ID NO: 257261 - DNA, 25 bp, Mus musculus
acccgcgcctgcctgcaccttcctt

SEQ ID NO: 257262 - DNA, 25 bp, Mus musculus
caccccccgcctgtgctcgcacccg

SEQ ID NO: 257263 - DNA, 25 bp, Mus musculus
ctcggcgccttctccgcctcgactt

SEQ ID NO: 257264 - DNA, 25 bp, Mus musculus
cctgccttcaaatgggtggcaggtg

SEQ ID NO: 257265 - DNA, 25 bp, Mus musculus
atcagaagcttcaccctacccaagg

SEQ ID NO: 257266 - DNA, 25 bp, Mus musculus
cagaaagcctgccttcaaatgggtg

SEQ ID NO: 257267 - DNA, 25 bp, Mus musculus
cagaaacgcttcagcagaaagcctg

SEQ ID NO: 257268 - DNA, 25 bp, Mus musculus
cacagatggccgctgggatgtgact

SEQ ID NO: 257269 - DNA, 25 bp, Mus musculus
agccacagagatggccgcacagatg

SEQ ID NO: 257270 - DNA, 25 bp, Mus musculus
agcttcaccctacccaaggtttgcg

SEQ ID NO: 257271 - DNA, 25 bp, Mus musculus
cgctgggatgtgacttcgttcctta

SEQ ID NO: 257272 - DNA, 25 bp, Mus musculus
tcgttccttagacgagccactcaga

SEQ ID NO: 257273 - DNA, 25 bp, Mus musculus
acatcgctttgggtgggaacatcag

SEQ ID NO: 257274 - DNA, 25 bp, Mus musculus
cgagccactcagaacagaaacgctt

SEQ ID NO: 257275 - DNA, 25 bp, Mus musculus
cagcacatcgctttgggtgggaaca

SEQ ID NO: 257276 - DNA, 25 bp, Mus musculus
cacacgcgtgcagcagccacagaga

SEQ ID NO: 257277 - DNA, 25 bp, Mus musculus
cggcgcgtttgcagcacatcgcttt

SEQ ID NO: 257278 - DNA, 25 bp, Mus musculus
tggttctccgtgatccgcaggatga

SEQ ID NO: 257279 - DNA, 25 bp, Mus musculus
tctccattggtggtgacttggcgta

SEQ ID NO: 257280 - DNA, 25 bp, Mus musculus
ggcgtaagcgtcatctcccgagtag

SEQ ID NO: 257281 - DNA, 25 bp, Mus musculus
tcccgagtagcagatgcagttgaca

SEQ ID NO: 257282 - DNA, 25 bp, Mus musculus
catcgtttttgcagtcacagtctga

SEQ ID NO: 257283 - DNA, 25 bp, Mus musculus
cggctaagaggcagatctctccatt

SEQ ID NO: 257284 - DNA, 25 bp, Mus musculus
cggccattctagacggacctgcaca

SEQ ID NO: 257285 - DNA, 25 bp, Mus musculus
gatcttcttctcgtccgtctcagtg

SEQ ID NO: 257286 - DNA, 25 bp, Mus musculus
tccgtctcagtgatgtagagcaccc

SEQ ID NO: 257287 - DNA, 25 bp, Mus musculus
ctggctgattccagcgcagaatgga

SEQ ID NO: 257288 - DNA, 25 bp, Mus musculus
cgtcccgcgatgatgctgacctggt

SEQ ID NO: 257289 - DNA, 25 bp, Mus musculus
tccagaacgtacagggagttgtcca

SEQ ID NO: 257290 - DNA, 25 bp, Mus musculus
ccgcaggatgacgttgttctccaga

SEQ ID NO: 257291 - DNA, 25 bp, Mus musculus
aacctggcagtgcataggccgtccc

SEQ ID NO: 257292 - DNA, 25 bp, Mus musculus
atggactaggatttcccggcactca

SEQ ID NO: 257293 - DNA, 25 bp, Mus musculus
cgctgggaatccaaagctccgactc

SEQ ID NO: 257294 - DNA, 25 bp, Mus musculus
gtggacacggcatttctcagcattc

SEQ ID NO: 257295 - DNA, 25 bp, Mus musculus
acgaacgcatcttcccgacacatgg

SEQ ID NO: 257296 - DNA, 25 bp, Mus musculus
tgactcccgtaatcattccgcttag

SEQ ID NO: 257297 - DNA, 25 bp, Mus musculus
caaggcaccgagtcaccttcgcaga

SEQ ID NO: 257298 - DNA, 25 bp, Mus musculus
cagtagtctaggctccgcgattgca

SEQ ID NO: 257299 - DNA, 25 bp, Mus musculus
attgcacctacacggaggcagctcc

SEQ ID NO: 257300 - DNA, 25 bp, Mus musculus
caaagccattgggacgcgacaggca

SEQ ID NO: 257301 - DNA, 25 bp, Mus musculus
cctgaaggcacagtgcggtcgcaca

SEQ ID NO: 257302 - DNA, 25 bp, Mus musculus
cggccactctgatgcgtgtccaggt

SEQ ID NO: 257303 - DNA, 25 bp, Mus musculus
tgggataagaacactcagagccggc

SEQ ID NO: 257304 - DNA, 25 bp, Mus musculus
gcagtcagccacacgtacctgaagg

SEQ ID NO: 257305 - DNA, 25 bp, Mus musculus
ttccgcttagtcagccacgcaaggc

SEQ ID NO: 257306 - DNA, 25 bp, Mus musculus
ctccgcaggaatgaaaggcatgcga

SEQ ID NO: 257307 - DNA, 25 bp, Mus musculus
attcccggtcgtgcggaccgcgctt

SEQ ID NO: 257308 - DNA, 25 bp, Mus musculus
tgtgctcgcaattcccggtcgtgcg

SEQ ID NO: 257309 - DNA, 25 bp, Mus musculus
tgtgccgaccctgtgctcgcaattc

SEQ ID NO: 257310 - DNA, 25 bp, Mus musculus
ggacagacggtgctgtgccgaccct

SEQ ID NO: 257311 - DNA, 25 bp, Mus musculus
tgagccaggatcctgcgcaggccca

SEQ ID NO: 257312 - DNA, 25 bp, Mus musculus
cctccgggaagtgagccaggatcct

SEQ ID NO: 257313 - DNA, 25 bp, Mus musculus
caaactcaggtcctccgggaagtga

SEQ ID NO: 257314 - DNA, 25 bp, Mus musculus
gtaggcgaaggccaaactcaggtcc

SEQ ID NO: 257315 - DNA, 25 bp, Mus musculus
atacaccgcggagccgtaggcgaag

SEQ ID NO: 257316 - DNA, 25 bp, Mus musculus
gtcctgcctggcgatacaccgcgga

SEQ ID NO: 257317 - DNA, 25 bp, Mus musculus
cgactcacctcctggtgggcactgg

SEQ ID NO: 257318 - DNA, 25 bp, Mus musculus
cttcagagcgggcagctggcaacct

SEQ ID NO: 257319 - DNA, 25 bp, Mus musculus
cgtgtccgggctccgcaggaatgaa

SEQ ID NO: 257320 - DNA, 25 bp, Mus musculus
cggagacagaagtagtcacgccctc

SEQ ID NO: 257321 - DNA, 25 bp, Mus musculus
acagaagtagtcacgccctcggcac

SEQ ID NO: 257322 - DNA, 25 bp, Mus musculus
ctgtctgctgggctcccggagacgc

SEQ ID NO: 257323 - DNA, 25 bp, Mus musculus
gagacgcggaccaccttcggtgtcc

SEQ ID NO: 257324 - DNA, 25 bp, Mus musculus
ggtggtcgacgagccgcacaccgac

SEQ ID NO: 257325 - DNA, 25 bp, Mus musculus
agatgatgaacttcctgaggcgccg

SEQ ID NO: 257326 - DNA, 25 bp, Mus musculus
ggacagcagcttcatcgccaacctg

SEQ ID NO: 257327 - DNA, 25 bp, Mus musculus
tacatgactgaccttcagcgcccgg

SEQ ID NO: 257328 - DNA, 25 bp, Mus musculus
gcagcagcttcttcagctcgctgtc

SEQ ID NO: 257329 - DNA, 25 bp, Mus musculus
tcggccgcttccaggaaggccaagg

SEQ ID NO: 257330 - DNA, 25 bp, Mus musculus
aacctgcccaatggctacatgactg

SEQ ID NO: 257331 - DNA, 25 bp, Mus musculus
gtgtgaagatggaccctcgaggtca

SEQ ID NO: 257332 - DNA, 25 bp, Mus musculus
accctcgaggtcacccgggagagca

SEQ ID NO: 257333 - DNA, 25 bp, Mus musculus
gctcgctgtcgcaagcggtgaagca

SEQ ID NO: 257334 - DNA, 25 bp, Mus musculus
cgtgatcacggaggcgatttggccc

SEQ ID NO: 257335 - DNA, 25 bp, Mus musculus
ccggctgaggagaaggcaaactctt

SEQ ID NO: 257336 - DNA, 25 bp, Mus musculus
ggcaaactcttgacaggaccgaatg

SEQ ID NO: 257337 - DNA, 25 bp, Mus musculus
gccacagtgcttccctgagagggtg

SEQ ID NO: 257338 - DNA, 25 bp, Mus musculus
ccctgacaggaaagccaggtctcca

SEQ ID NO: 257339 - DNA, 25 bp, Mus musculus
caggtctccagaactaccgcgttgg

SEQ ID NO: 257340 - DNA, 25 bp, Mus musculus
tgtgcggatcctggtgacagattta

SEQ ID NO: 257341 - DNA, 25 bp, Mus musculus
tctggatctgactggctaggtgact

SEQ ID NO: 257342 - DNA, 25 bp, Mus musculus
actcgggatgagaagtcacattctg

SEQ ID NO: 257343 - DNA, 25 bp, Mus musculus
tcacattctgacagggctgcgtaac

SEQ ID NO: 257344 - DNA, 25 bp, Mus musculus
ccctgtctcgactagaggggatacg

SEQ ID NO: 257345 - DNA, 25 bp, Mus musculus
tggaaagccacactccgacaggacg

SEQ ID NO: 257346 - DNA, 25 bp, Mus musculus
cggagagtgaccaagtgacagaatc

SEQ ID NO: 257347 - DNA, 25 bp, Mus musculus
acgggctgaggagaagtcacactct

SEQ ID NO: 257348 - DNA, 25 bp, Mus musculus
agccagtcccttttgcggctgcgtg

SEQ ID NO: 257349 - DNA, 25 bp, Mus musculus
tatcgtcagcggtacagtgcgcagg

SEQ ID NO: 257350 - DNA, 25 bp, Mus musculus
cgcaggcgtgctgtgctaggacaca

SEQ ID NO: 257351 - DNA, 25 bp, Mus musculus
tgctaggacacagccagtccctttt

SEQ ID NO: 257352 - DNA, 25 bp, Mus musculus
ttttgcggctgcgtgcaactggttt

SEQ ID NO: 257353 - DNA, 25 bp, Mus musculus
ggccgcactgcttgacggctgcagc

SEQ ID NO: 257354 - DNA, 25 bp, Mus musculus
cggcgaaaggtaagactgagtagtc

SEQ ID NO: 257355 - DNA, 25 bp, Mus musculus
ctgagtagtcctgtttctcgcgttc

SEQ ID NO: 257356 - DNA, 25 bp, Mus musculus
tttctcgcgttctgtgtccagcgtg

SEQ ID NO: 257357 - DNA, 25 bp, Mus musculus
gtccagcgtgcgagcgacttcaggc

SEQ ID NO: 257358 - DNA, 25 bp, Mus musculus
ctgtggctgtcactcaagcgcgcat

SEQ ID NO: 257359 - DNA, 25 bp, Mus musculus
actcaagcgcgcatgggcacagcgt

SEQ ID NO: 257360 - DNA, 25 bp, Mus musculus
ggcggaatgtatcgtcagcggtaca

SEQ ID NO: 257361 - DNA, 25 bp, Mus musculus
tgcaactggttttgcggccgcactg

SEQ ID NO: 257362 - DNA, 25 bp, Mus musculus
ccctcgctgagtaccgaggggctcg

SEQ ID NO: 257363 - DNA, 25 bp, Mus musculus
gttgaatgggtacgcgatgcacctc

SEQ ID NO: 257364 - DNA, 25 bp, Mus musculus
cgatgcacctcaccacgaagacgta

SEQ ID NO: 257365 - DNA, 25 bp, Mus musculus
accacgaagacgtagagctgcaggc

SEQ ID NO: 257366 - DNA, 25 bp, Mus musculus
cccgagcaacacgtggaacggaatg

SEQ ID NO: 257367 - DNA, 25 bp, Mus musculus
ggcgcctcccgagcaacacgtggaa

SEQ ID NO: 257368 - DNA, 25 bp, Mus musculus
caggtgaggaacctgtggcgcctcc

SEQ ID NO: 257369 - DNA, 25 bp, Mus musculus
agttcggcgcccgagtgtttgccgc

SEQ ID NO: 257370 - DNA, 25 bp, Mus musculus
gctttccggacacgtcgagttcggc

SEQ ID NO: 257371 - DNA, 25 bp, Mus musculus
cggccgcagaacgaaagggaaagtg

SEQ ID NO: 257372 - DNA, 25 bp, Mus musculus
gggcttctcgccgagcgcagctgtc

SEQ ID NO: 257373 - DNA, 25 bp, Mus musculus
gatccctggggcttctcgccgagcg

SEQ ID NO: 257374 - DNA, 25 bp, Mus musculus
agctgcaggcggatgcgccgctcct

SEQ ID NO: 257375 - DNA, 25 bp, Mus musculus
cctcctcgctggaagacgggtcgag

SEQ ID NO: 257376 - DNA, 25 bp, Mus musculus
gccatgagcaccaagcaggtcacct

SEQ ID NO: 257377 - DNA, 25 bp, Mus musculus
ggataacgcgcaggaaggccgcata

SEQ ID NO: 257378 - DNA, 25 bp, Mus musculus
taacgcgcaggaaggccgcatagag

SEQ ID NO: 257379 - DNA, 25 bp, Mus musculus
ccgcatagaggctagagcggcaaga

SEQ ID NO: 257380 - DNA, 25 bp, Mus musculus
tagagcggcaagagctgctgcaacc

SEQ ID NO: 257381 - DNA, 25 bp, Mus musculus
tttcagtgcgactccagcccgtggc

SEQ ID NO: 257382 - DNA, 25 bp, Mus musculus
gccgccatgagcaccaagcaggtca

SEQ ID NO: 257383 - DNA, 25 bp, Mus musculus
cgggcggcaccttagaagtagcgca

SEQ ID NO: 257384 - DNA, 25 bp, Mus musculus
accgcgacttgcagagagtgagcga

SEQ ID NO: 257385 - DNA, 25 bp, Mus musculus
tgaggtttcagtgcgactccagccc

SEQ ID NO: 257386 - DNA, 25 bp, Mus musculus
cggctctgaggtttcagtgcgactc

SEQ ID NO: 257387 - DNA, 25 bp, Mus musculus
ttagaagtagcgcacgaacgagggt

SEQ ID NO: 257388 - DNA, 25 bp, Mus musculus
gcaccttagaagtagcgcacgaacg

SEQ ID NO: 257389 - DNA, 25 bp, Mus musculus
agagctgctgcaaccgcgacttgca

SEQ ID NO: 257390 - DNA, 25 bp, Mus musculus
ggatctatcgctcgagcctggaatg

SEQ ID NO: 257391 - DNA, 25 bp, Mus musculus
ttaaaactcggctcggggatctatc

SEQ ID NO: 257392 - DNA, 25 bp, Mus musculus
tgggctcggcagtccgcttaaaact

SEQ ID NO: 257393 - DNA, 25 bp, Mus musculus
ctctcaggctatcccgggcgagcta

SEQ ID NO: 257394 - DNA, 25 bp, Mus musculus
ccgcgaagaagacgctctcaggcta

SEQ ID NO: 257395 - DNA, 25 bp, Mus musculus
tggcggcaccagcacccgcgaagaa

SEQ ID NO: 257396 - DNA, 25 bp, Mus musculus
ccgagaaacactgggaaatctgagc

SEQ ID NO: 257397 - DNA, 25 bp, Mus musculus
tgcggagaacaacagagaagccttc

SEQ ID NO: 257398 - DNA, 25 bp, Mus musculus
tggaaactggctcgccggccatgac

SEQ ID NO: 257399 - DNA, 25 bp, Mus musculus
cagccctgtggcctacctgagggag

SEQ ID NO: 257400 - DNA, 25 bp, Mus musculus
agaacgcgttggttgcggtcacatt

SEQ ID NO: 257401 - DNA, 25 bp, Mus musculus
ggcgctggcacgtttccgagaaaca

SEQ ID NO: 257402 - DNA, 25 bp, Mus musculus
ctccgtggtagcagagtgactgttt

SEQ ID NO: 257403 - DNA, 25 bp, Mus musculus
ggccagacgcgcctggtgacacacg

SEQ ID NO: 257404 - DNA, 25 bp, Mus musculus
catgagtaccggtgccttctacatc

SEQ ID NO: 257405 - DNA, 25 bp, Mus musculus
agccagcatgagtaccggtgccttc

SEQ ID NO: 257406 - DNA, 25 bp, Mus musculus
cggcgcagccagcatgagtaccggt

SEQ ID NO: 257407 - DNA, 25 bp, Mus musculus
gactcgttttcaggggtctcagcct

SEQ ID NO: 257408 - DNA, 25 bp, Mus musculus
ccgcgccgccatattcgattcgacc

SEQ ID NO: 257409 - DNA, 25 bp, Mus musculus
tcgggactcgttttcaggggtctca

SEQ ID NO: 257410 - DNA, 25 bp, Mus musculus
cgacaaagacttcaggtgcgccctg

SEQ ID NO: 257411 - DNA, 25 bp, Mus musculus
ggtgccttctacatctccagcctgc

SEQ ID NO: 257412 - DNA, 25 bp, Mus musculus
gtccagcgacaaagacttcaggtgc

SEQ ID NO: 257413 - DNA, 25 bp, Mus musculus
gagaagatgacgtccagcgacaaag

SEQ ID NO: 257414 - DNA, 25 bp, Mus musculus
agcctgctggagaagatgacgtcca

SEQ ID NO: 257415 - DNA, 25 bp, Mus musculus
gtaccggtgccttctacatctccag

SEQ ID NO: 257416 - DNA, 25 bp, Mus musculus
tccagcctgctggagaagatgacgt

SEQ ID NO: 257417 - DNA, 25 bp, Mus musculus
aaagacttcaggtgcgccctgtggg

SEQ ID NO: 257418 - DNA, 25 bp, Mus musculus
gtcgtctcagagcaccaaccaaagg

SEQ ID NO: 257419 - DNA, 25 bp, Mus musculus
cgtccgaaactctcgggccgcatgg

SEQ ID NO: 257420 - DNA, 25 bp, Mus musculus
agatggcagccacctcgtaggcagc

SEQ ID NO: 257421 - DNA, 25 bp, Mus musculus
tcgttatgtttgaagtgttgcgccc

SEQ ID NO: 257422 - DNA, 25 bp, Mus musculus
tcccgctccactaagcttcgttatg

SEQ ID NO: 257423 - DNA, 25 bp, Mus musculus
tcgccactaccacgctggtgcggag

SEQ ID NO: 257424 - DNA, 25 bp, Mus musculus
tcggattcgccgcagaaaaaggctg

SEQ ID NO: 257425 - DNA, 25 bp, Mus musculus
cctgacttaagatttcggattcgcc

SEQ ID NO: 257426 - DNA, 25 bp, Mus musculus
ggcggcagctccctgacttaagatt

SEQ ID NO: 257427 - DNA, 25 bp, Mus musculus
agaaagcatttctgctcactggcga

SEQ ID NO: 257428 - DNA, 25 bp, Mus musculus
ccgggcttgcgcttcagaaagcatt

SEQ ID NO: 257429 - DNA, 25 bp, Mus musculus
accaaccaaagggtgccttctctgc

SEQ ID NO: 257430 - DNA, 25 bp, Mus musculus
cccttaaatacgcaaagccaccatg

SEQ ID NO: 257431 - DNA, 25 bp, Mus musculus
tggccgccgatacagactcaccgta

SEQ ID NO: 257432 - DNA, 25 bp, Mus musculus
ctctcggcattcacatttgccatct

SEQ ID NO: 257433 - DNA, 25 bp, Mus musculus
atttgccatctttacaggtcccgtg

SEQ ID NO: 257434 - DNA, 25 bp, Mus musculus
cgcgaccgtcactatcgatctacga

SEQ ID NO: 257435 - DNA, 25 bp, Mus musculus
cgtcactatcgatctacgatttatg

SEQ ID NO: 257436 - DNA, 25 bp, Mus musculus
aaagcaatatgtgcctgtttcggtg

SEQ ID NO: 257437 - DNA, 25 bp, Mus musculus
aatatgtgcctgtttcggtgcctgc

SEQ ID NO: 257438 - DNA, 25 bp, Mus musculus
cggtgcctgccgtttgcctaccaat

SEQ ID NO: 257439 - DNA, 25 bp, Mus musculus
cctgccgtttgcctaccaatggtgc

SEQ ID NO: 257440 - DNA, 25 bp, Mus musculus
gcctaccaatggtgcagtgttcacc

SEQ ID NO: 257441 - DNA, 25 bp, Mus musculus
tacaggtcccgtgctcaatgcagcg

SEQ ID NO: 257442 - DNA, 25 bp, Mus musculus
gccctcttcacagcggcaggctccc

SEQ ID NO: 257443 - DNA, 25 bp, Mus musculus
gtggcacacgcgctggtcacaagct

SEQ ID NO: 257444 - DNA, 25 bp, Mus musculus
tggtcacaagctgcgcctgtccagc

SEQ ID NO: 257445 - DNA, 25 bp, Mus musculus
gtgcagtgttcaccattccagccct

SEQ ID NO: 257446 - DNA, 25 bp, Mus musculus
aggaaccggcgcattgccatggcaa

SEQ ID NO: 257447 - DNA, 25 bp, Mus musculus
tgtacatgcgcacttggagctttgg

SEQ ID NO: 257448 - DNA, 25 bp, Mus musculus
ctttgggaaactcatgcgcggttca

SEQ ID NO: 257449 - DNA, 25 bp, Mus musculus
ttgcgcatgtgcgttgctaagggta

SEQ ID NO: 257450 - DNA, 25 bp, Mus musculus
gaaagaagcctgttgctgccgaggc

SEQ ID NO: 257451 - DNA, 25 bp, Mus musculus
ccgtgttgacgtggagagacaaagc

SEQ ID NO: 257452 - DNA, 25 bp, Mus musculus
gcctggaccgaggactctgattccg

SEQ ID NO: 257453 - DNA, 25 bp, Mus musculus
ccaaacaccgacgtgaaagtcaatc

SEQ ID NO: 257454 - DNA, 25 bp, Mus musculus
accgcttcagctacagatgccacag

SEQ ID NO: 257455 - DNA, 25 bp, Mus musculus
tacagatgccacagccagggtcccg

SEQ ID NO: 257456 - DNA, 25 bp, Mus musculus
gccaatcaaaccctctgtcgtcaag

SEQ ID NO: 257457 - DNA, 25 bp, Mus musculus
gtgggctcccttttgtacatgcgca

SEQ ID NO: 257458 - DNA, 25 bp, Mus musculus
tcgctcgtgtcatacttacgcttcc

SEQ ID NO: 257459 - DNA, 25 bp, Mus musculus
acctttccggaccaatcgctcgtgt

SEQ ID NO: 257460 - DNA, 25 bp, Mus musculus
ctcagctggcacagaccctggtaga

SEQ ID NO: 257461 - DNA, 25 bp, Mus musculus
tcaggatgttatcgtccgacgggtt

SEQ ID NO: 257462 - DNA, 25 bp, Mus musculus
aatggcagcctgcacgtcgtcgaag

SEQ ID NO: 257463 - DNA, 25 bp, Mus musculus
gcctctcgaagacagcgaagaactg

SEQ ID NO: 257464 - DNA, 25 bp, Mus musculus
cgcgcactgcaagcccagttggatg

SEQ ID NO: 257465 - DNA, 25 bp, Mus musculus
tcgcctcggcttccaggctcaagtt

SEQ ID NO: 257466 - DNA, 25 bp, Mus musculus
ggcgccctgcttgatcttcaggatg

SEQ ID NO: 257467 - DNA, 25 bp, Mus musculus
tcgacagttggtacaggcggttcac

SEQ ID NO: 257468 - DNA, 25 bp, Mus musculus
ctcgaagcggtggtcttctaggcta

SEQ ID NO: 257469 - DNA, 25 bp, Mus musculus
gcggcagcaccagtcccacagtgga

SEQ ID NO: 257470 - DNA, 25 bp, Mus musculus
ccacgttgagcatgctggggaacac

SEQ ID NO: 257471 - DNA, 25 bp, Mus musculus
ccgggtccaactgcaggattttgtt

SEQ ID NO: 257472 - DNA, 25 bp, Mus musculus
ggctcaagttggcactcgacagttg

SEQ ID NO: 257473 - DNA, 25 bp, Mus musculus
aggcacgcacgaagcccagcttgtg

SEQ ID NO: 257474 - DNA, 25 bp, Mus musculus
gcaaaatgcaaaaagctcctaaccc

SEQ ID NO: 257475 - DNA, 25 bp, Mus musculus
aacaccggcagtttgaatcacggtc

SEQ ID NO: 257476 - DNA, 25 bp, Mus musculus
aaaacaccggcagtttgaatcacgg

SEQ ID NO: 257477 - DNA, 25 bp, Mus musculus
ccaaaacaccggcagtttgaatcac

SEQ ID NO: 257478 - DNA, 25 bp, Mus musculus
cataataaccaaaacaccggcagtt

SEQ ID NO: 257479 - DNA, 25 bp, Mus musculus
ttacataataaccaaaacaccggca

SEQ ID NO: 257480 - DNA, 25 bp, Mus musculus
gaaattcttcccattacataataac

SEQ ID NO: 257481 - DNA, 25 bp, Mus musculus
gaaaagaaattcttcccattacata

SEQ ID NO: 257482 - DNA, 25 bp, Mus musculus
tgcaaaatgcaaaaagctcctaacc

SEQ ID NO: 257483 - DNA, 25 bp, Mus musculus
tctaaagaaagagatacccataaac

SEQ ID NO: 257484 - DNA, 25 bp, Mus musculus
caatttaaagggccaggaaatatct

SEQ ID NO: 257485 - DNA, 25 bp, Mus musculus
tgaagattcccaatttaaagggcca

SEQ ID NO: 257486 - DNA, 25 bp, Mus musculus
caccggcagtttgaatcacggtccg

SEQ ID NO: 257487 - DNA, 25 bp, Mus musculus
tgcaaaaagctcctaacccaaaaca

SEQ ID NO: 257488 - DNA, 25 bp, Mus musculus
agagtttttcctgaccgttcctgca

SEQ ID NO: 257489 - DNA, 25 bp, Mus musculus
cgccagagcgaccagaggtccgatc

SEQ ID NO: 257490 - DNA, 25 bp, Mus musculus
gacgggccgcgctaaagagatcgcc

SEQ ID NO: 257491 - DNA, 25 bp, Mus musculus
ggccagtcctactcaccggtggaga

SEQ ID NO: 257492 - DNA, 25 bp, Mus musculus
gaaccagcgcgagggaacgacagct

SEQ ID NO: 257493 - DNA, 25 bp, Mus musculus
acagctagaacgagaacgcgcaccc

SEQ ID NO: 257494 - DNA, 25 bp, Mus musculus
tgacccgacccagaggtgtagccac

SEQ ID NO: 257495 - DNA, 25 bp, Mus musculus
gaggtgtagccacgcctcaggccca

SEQ ID NO: 257496 - DNA, 25 bp, Mus musculus
gcatcctccgccagagtttttcctg

SEQ ID NO: 257497 - DNA, 25 bp, Mus musculus
ccgttcctgcagttcagacgctgaa

SEQ ID NO: 257498 - DNA, 25 bp, Mus musculus
gcatttcagcatctcggctcttcga

SEQ ID NO: 257499 - DNA, 25 bp, Mus musculus
ggctcttcgactcctcggcttgtcg

SEQ ID NO: 257500 - DNA, 25 bp, Mus musculus
cggcttgtcgttctttagcctctca

SEQ ID NO: 257501 - DNA, 25 bp, Mus musculus
cccacgcgggcgcaggtcaagtaag

SEQ ID NO: 257502 - DNA, 25 bp, Mus musculus
tcctccagtattcaaaggcgcaatc

SEQ ID NO: 257503 - DNA, 25 bp, Mus musculus
cccagactcagctcttctttttgtc

SEQ ID NO: 257504 - DNA, 25 bp, Mus musculus
tctgccgcgcagacgcgggtttcct

SEQ ID NO: 257505 - DNA, 25 bp, Mus musculus
aaggcgcaatctcagacaccgggga

SEQ ID NO: 257506 - DNA, 25 bp, Mus musculus
gggcagtgtagtagccactcccgta

SEQ ID NO: 257507 - DNA, 25 bp, Mus musculus
tcgctgtagatgaaccggacgagcc

SEQ ID NO: 257508 - DNA, 25 bp, Mus musculus
ctcggggacacgcttcctccagtat

SEQ ID NO: 257509 - DNA, 25 bp, Mus musculus
acgtgacgtgaaccatgtgattacc

SEQ ID NO: 257510 - DNA, 25 bp, Mus musculus
catgtgattaccaccgcgctgggtg

SEQ ID NO: 257511 - DNA, 25 bp, Mus musculus
cccaggtcacgtgaggacaccatca

SEQ ID NO: 257512 - DNA, 25 bp, Mus musculus
ctcccgtagtcactttggagcttgc

SEQ ID NO: 257513 - DNA, 25 bp, Mus musculus
ctttttgtccttctcgctgtagatg

SEQ ID NO: 257514 - DNA, 25 bp, Mus musculus
gatccgccgcagcagtcagaactgg

SEQ ID NO: 257515 - DNA, 25 bp, Mus musculus
tcagaactggtctctggcggctgac

SEQ ID NO: 257516 - DNA, 25 bp, Mus musculus
ttacattttaatcgccgcccatttg

SEQ ID NO: 257517 - DNA, 25 bp, Mus musculus
ttcagtctccgcgtccgtccgagat

SEQ ID NO: 257518 - DNA, 25 bp, Mus musculus
agcgtaggtaggctgctttacattt

SEQ ID NO: 257519 - DNA, 25 bp, Mus musculus
agcaacgcttttagcctgaggcgcg

SEQ ID NO: 257520 - DNA, 25 bp, Mus musculus
tcacgtgaccggtcagtcggcgtcc

SEQ ID NO: 257521 - DNA, 25 bp, Mus musculus
tcgggctctctcaggtgaagtcctg

SEQ ID NO: 257522 - DNA, 25 bp, Mus musculus
cccaggtcgccaaagcaacgctttt

SEQ ID NO: 257523 - DNA, 25 bp, Mus musculus
ccgtccgagatggaagtgtggattc

SEQ ID NO: 257524 - DNA, 25 bp, Mus musculus
tctggacggtgctgctctagtagaa

SEQ ID NO: 257525 - DNA, 25 bp, Mus musculus
ctagtagaagcgctggaggcaaagc

SEQ ID NO: 257526 - DNA, 25 bp, Mus musculus
atttgctagcgcaccggaaggttta

SEQ ID NO: 257527 - DNA, 25 bp, Mus musculus
gtagttctcgctcccacttcatttg

SEQ ID NO: 257528 - DNA, 25 bp, Mus musculus
ctacactgagaaggtgaagccgggc

SEQ ID NO: 257529 - DNA, 25 bp, Mus musculus
gaaggtttacctttctctacactga

SEQ ID NO: 257530 - DNA, 25 bp, Mus musculus
cttacctcgtgtggagtgtcgcaca

SEQ ID NO: 257531 - DNA, 25 bp, Mus musculus
cacggcgaaggcaaaaggaggcatt

SEQ ID NO: 257532 - DNA, 25 bp, Mus musculus
agcgtctctgcccaccgatgaggga

SEQ ID NO: 257533 - DNA, 25 bp, Mus musculus
gggtctcgttaatcttgcaagggca

SEQ ID NO: 257534 - DNA, 25 bp, Mus musculus
gttcggtcgatcacagtcttgcttg

SEQ ID NO: 257535 - DNA, 25 bp, Mus musculus
gtcttgcttgagaaggacgacacaa

SEQ ID NO: 257536 - DNA, 25 bp, Mus musculus
accaggccagttgtctgtgcagaga

SEQ ID NO: 257537 - DNA, 25 bp, Mus musculus
gccgtgaagaaacgcgtcttaatta

SEQ ID NO: 257538 - DNA, 25 bp, Mus musculus
tgtgcagagacaaaacaggaccgtg

SEQ ID NO: 257539 - DNA, 25 bp, Mus musculus
agcgctacgctacggaaaaacttgc

SEQ ID NO: 257540 - DNA, 25 bp, Mus musculus
ccgcccacctaggagaggtagattt

SEQ ID NO: 257541 - DNA, 25 bp, Mus musculus
ctccacgcagggctttggtgtagta

SEQ ID NO: 257542 - DNA, 25 bp, Mus musculus
gaccgactgacgtctctgagtacta

SEQ ID NO: 257543 - DNA, 25 bp, Mus musculus
acctttttcagcaagcccgccatga

SEQ ID NO: 257544 - DNA, 25 bp, Mus musculus
tgaccgtgtaggagggcatgactcc

SEQ ID NO: 257545 - DNA, 25 bp, Mus musculus
agatgtagtcgtcggtgcccgcgaa

SEQ ID NO: 257546 - DNA, 25 bp, Mus musculus
ctacagcccgcagagccaatgaggc

SEQ ID NO: 257547 - DNA, 25 bp, Mus musculus
aacttcttgaccctgtcactcgcgg

SEQ ID NO: 257548 - DNA, 25 bp, Mus musculus
agcagatgcttctcgctacagcccg

SEQ ID NO: 257549 - DNA, 25 bp, Mus musculus
agccttgcgcttgggtctggctcca

SEQ ID NO: 257550 - DNA, 25 bp, Mus musculus
gtagaatgccttgtccagcagatgc

SEQ ID NO: 257551 - DNA, 25 bp, Mus musculus
cccgttcgaagtcattgtagaatgc

SEQ ID NO: 257552 - DNA, 25 bp, Mus musculus
cagatgcgctcacatagggtcacga

SEQ ID NO: 257553 - DNA, 25 bp, Mus musculus
agcgcgctgggacagacagttctca

SEQ ID NO: 257554 - DNA, 25 bp, Mus musculus
caatgaggctgaggtagatgtagtc

SEQ ID NO: 257555 - DNA, 25 bp, Mus musculus
gaagctcggcgtggcagcccaccaa

SEQ ID NO: 257556 - DNA, 25 bp, Mus musculus
acagttctcaggtgcctgcctgtcc

SEQ ID NO: 257557 - DNA, 25 bp, Mus musculus
tgactccgggcaagtgagtgctgct

SEQ ID NO: 257558 - DNA, 25 bp, Mus musculus
ttccctccaagtcgctcacaatggc

SEQ ID NO: 257559 - DNA, 25 bp, Mus musculus
acaatggcccggtgcagcctaccca

SEQ ID NO: 257560 - DNA, 25 bp, Mus musculus
gcagcaacaaagagtccgccgcttc

SEQ ID NO: 257561 - DNA, 25 bp, Mus musculus
ctcacccatttacggcagcaacaaa

SEQ ID NO: 257562 - DNA, 25 bp, Mus musculus
cagtactggggacccgtctagccgg

SEQ ID NO: 257563 - DNA, 25 bp, Mus musculus
agctgggtgatggagctccagtact

SEQ ID NO: 257564 - DNA, 25 bp, Mus musculus
aagtccggttgtctgatcgaggtcc

SEQ ID NO: 257565 - DNA, 25 bp, Mus musculus
atggagtctttctcctccgcggcga

SEQ ID NO: 257566 - DNA, 25 bp, Mus musculus
tcactgtccgacctggggagtccat

SEQ ID NO: 257567 - DNA, 25 bp, Mus musculus
ctgatttctcactgtccgacctggg

SEQ ID NO: 257568 - DNA, 25 bp, Mus musculus
gcctccgggcctgatttctcactgt

SEQ ID NO: 257569 - DNA, 25 bp, Mus musculus
caacaccggcccaggcagacccgca

SEQ ID NO: 257570 - DNA, 25 bp, Mus musculus
aacgcccgccaagtccggttgtctg

SEQ ID NO: 257571 - DNA, 25 bp, Mus musculus
ctacccacccgtacaatggagtctt

SEQ ID NO: 257572 - DNA, 25 bp, Mus musculus
ctctagcgccctgcctgatcgcggc

SEQ ID NO: 257573 - DNA, 25 bp, Mus musculus
cggtccagaggccaccagcaagaga

SEQ ID NO: 257574 - DNA, 25 bp, Mus musculus
agtcatcgcgcggtccagaggccac

SEQ ID NO: 257575 - DNA, 25 bp, Mus musculus
ccgttcagtcatcgcgcggtccaga

SEQ ID NO: 257576 - DNA, 25 bp, Mus musculus
gagcatcactcaccgttcagtcatc

SEQ ID NO: 257577 - DNA, 25 bp, Mus musculus
tgcagtctgagcatcactcaccgtt

SEQ ID NO: 257578 - DNA, 25 bp, Mus musculus
acctttgcagtctgagcatcactca

SEQ ID NO: 257579 - DNA, 25 bp, Mus musculus
gcccactacctttgcagtctgagca

SEQ ID NO: 257580 - DNA, 25 bp, Mus musculus
ggatgcccactacctttgcagtctg

SEQ ID NO: 257581 - DNA, 25 bp, Mus musculus
aaggtagggtgctccaaggatgccc

SEQ ID NO: 257582 - DNA, 25 bp, Mus musculus
aggagactcgcgcactgcggctggg

SEQ ID NO: 257583 - DNA, 25 bp, Mus musculus
agaggccaccagcaagagaggtcgc

SEQ ID NO: 257584 - DNA, 25 bp, Mus musculus
gggtgcaagtgctcaggctctagcg

SEQ ID NO: 257585 - DNA, 25 bp, Mus musculus
gggtgctccaaggatgcccactacc

SEQ ID NO: 257586 - DNA, 25 bp, Mus musculus
ttccaagagcagaaactgagcgcgc

SEQ ID NO: 257587 - DNA, 25 bp, Mus musculus
ggctgggttggtgcctttagatcta

SEQ ID NO: 257588 - DNA, 25 bp, Mus musculus
gctgcaaccggggttctgcgaacta

SEQ ID NO: 257589 - DNA, 25 bp, Mus musculus
cgaactagggagcatcgccagccta

SEQ ID NO: 257590 - DNA, 25 bp, Mus musculus
agcatgcccagtgctcggctggacc

SEQ ID NO: 257591 - DNA, 25 bp, Mus musculus
agttcagttcggttctgggcttgtc

SEQ ID NO: 257592 - DNA, 25 bp, Mus musculus
ccaagcccgggcctcatagagttca

SEQ ID NO: 257593 - DNA, 25 bp, Mus musculus
tccctccgtgggaagtgagagccaa

SEQ ID NO: 257594 - DNA, 25 bp, Mus musculus
cacagaggcgcagagctccgctcta

SEQ ID NO: 257595 - DNA, 25 bp, Mus musculus
ctttagatctaaggggtagcgagcc

SEQ ID NO: 257596 - DNA, 25 bp, Mus musculus
gttccctagctgcacgcaccgagga

SEQ ID NO: 257597 - DNA, 25 bp, Mus musculus
ggactctgctctgctaaacccgatg

SEQ ID NO: 257598 - DNA, 25 bp, Mus musculus
cctttgtctgcagagatatcccgcc

SEQ ID NO: 257599 - DNA, 25 bp, Mus musculus
gcacacacatataaactcgcgcgcg

SEQ ID NO: 257600 - DNA, 25 bp, Mus musculus
tacggacaccactaagcgcttcgcg

SEQ ID NO: 257601 - DNA, 25 bp, Mus musculus
agctactactgtgcgcttcctaggg

SEQ ID NO: 257602 - DNA, 25 bp, Mus musculus
aagcgcttcgcgcatcacttaagtc

SEQ ID NO: 257603 - DNA, 25 bp, Mus musculus
cacttaagtccccaatcctcgaggg

SEQ ID NO: 257604 - DNA, 25 bp, Mus musculus
cccaggacgcaaagagaaagcagta

SEQ ID NO: 257605 - DNA, 25 bp, Mus musculus
acgcaaagagaaagcagtaggagtg

SEQ ID NO: 257606 - DNA, 25 bp, Mus musculus
caggggccctcggtctacacaggcg

SEQ ID NO: 257607 - DNA, 25 bp, Mus musculus
cgatctttacggacaccactaagcg

SEQ ID NO: 257608 - DNA, 25 bp, Mus musculus
cctcggtctacacaggcggaggcca

SEQ ID NO: 257609 - DNA, 25 bp, Mus musculus
gggagcctgggtaacgcagatactt

SEQ ID NO: 257610 - DNA, 25 bp, Mus musculus
ctgggtaacgcagatacttgggttt

SEQ ID NO: 257611 - DNA, 25 bp, Mus musculus
tctgcgcaggcgctacagctactac

SEQ ID NO: 257612 - DNA, 25 bp, Mus musculus
cgcaggcgctacagctactactgtg

SEQ ID NO: 257613 - DNA, 25 bp, Mus musculus
ctactgtgcgcttcctagggagggt

SEQ ID NO: 257614 - DNA, 25 bp, Mus musculus
tctgcacagttcgttggtccgtagc

SEQ ID NO: 257615 - DNA, 25 bp, Mus musculus
cggagttgaccgtgcaagaggttca

SEQ ID NO: 257616 - DNA, 25 bp, Mus musculus
agtgcatggcttggctataggttca

SEQ ID NO: 257617 - DNA, 25 bp, Mus musculus
ccgcctggttttcgcctctaaagcg

SEQ ID NO: 257618 - DNA, 25 bp, Mus musculus
tgttctcttacagcaccctcgaggg

SEQ ID NO: 257619 - DNA, 25 bp, Mus musculus
gcgtgtgtcagcaaactctcaaaga

SEQ ID NO: 257620 - DNA, 25 bp, Mus musculus
taccggcgcccagatgtttccagag

SEQ ID NO: 257621 - DNA, 25 bp, Mus musculus
gaagtgcggccataggacctagaga

SEQ ID NO: 257622 - DNA, 25 bp, Mus musculus
caccgaggttttgtgctctgcgaag

SEQ ID NO: 257623 - DNA, 25 bp, Mus musculus
cgaacttggggcagtccactttgca

SEQ ID NO: 257624 - DNA, 25 bp, Mus musculus
gtcggcgccgttcactacaagcgaa

SEQ ID NO: 257625 - DNA, 25 bp, Mus musculus
ccgcgctctgcatcagtgacggtga

SEQ ID NO: 257626 - DNA, 25 bp, Mus musculus
cggtgtcctcttgctgtccagctct

SEQ ID NO: 257627 - DNA, 25 bp, Mus musculus
ccggtcaagtagctcgaagtgcatg

SEQ ID NO: 257628 - DNA, 25 bp, Mus musculus
ctcggcgccggctttgtctgtctgc

SEQ ID NO: 257629 - DNA, 25 bp, Mus musculus
tcctgctgcaatgtcggggtccctg

SEQ ID NO: 257630 - DNA, 25 bp, Mus musculus
tgctgcggaagggtcctgctgcaat

SEQ ID NO: 257631 - DNA, 25 bp, Mus musculus
aaccgcagacaagggtgcgctggtc

SEQ ID NO: 257632 - DNA, 25 bp, Mus musculus
aatcgccaaccgcagacaagggtgc

SEQ ID NO: 257633 - DNA, 25 bp, Mus musculus
ggccaaaatcgccaaccgcagacaa

SEQ ID NO: 257634 - DNA, 25 bp, Mus musculus
ccaggctggccgtccgggccaaaat

SEQ ID NO: 257635 - DNA, 25 bp, Mus musculus
cgctcctccacaggacggcgctccc

SEQ ID NO: 257636 - DNA, 25 bp, Mus musculus
ggctgtgtcttgagcctgctgctcc

SEQ ID NO: 257637 - DNA, 25 bp, Mus musculus
ggtcgcggcgcttcccacagtgcct

SEQ ID NO: 257638 - DNA, 25 bp, Mus musculus
gtttctgccgcagctcggtcgcggc

SEQ ID NO: 257639 - DNA, 25 bp, Mus musculus
accagaagcagccaccgcgtttctg

SEQ ID NO: 257640 - DNA, 25 bp, Mus musculus
aacaaccagaagcagccaccgcgtt

SEQ ID NO: 257641 - DNA, 25 bp, Mus musculus
tcttgagcctgctgctccggccagg

SEQ ID NO: 257642 - DNA, 25 bp, Mus musculus
ttgagcctcgttttgtgtcccgggc

SEQ ID NO: 257643 - DNA, 25 bp, Mus musculus
gttcggtccctacacagcctcccga

SEQ ID NO: 257644 - DNA, 25 bp, Mus musculus
ggcctttgtgcgcatcgccctgggc

SEQ ID NO: 257645 - DNA, 25 bp, Mus musculus
caagggtggcgttgagcctcgtttt

SEQ ID NO: 257646 - DNA, 25 bp, Mus musculus
gctgtgcgtgcgcagaaagagccac

SEQ ID NO: 257647 - DNA, 25 bp, Mus musculus
cgcagaaagagccacgcccaggttc

SEQ ID NO: 257648 - DNA, 25 bp, Mus musculus
agagccacgcccaggttccaaggga

SEQ ID NO: 257649 - DNA, 25 bp, Mus musculus
caggttccaagggacgcgaacggct

SEQ ID NO: 257650 - DNA, 25 bp, Mus musculus
cgaaaaggagagtgacagccgagtt

SEQ ID NO: 257651 - DNA, 25 bp, Mus musculus
tgacagccgagttctcacaggagtg

SEQ ID NO: 257652 - DNA, 25 bp, Mus musculus
gttctcacaggagtgaagccacgtg

SEQ ID NO: 257653 - DNA, 25 bp, Mus musculus
cacaggagtgaagccacgtggcgcc

SEQ ID NO: 257654 - DNA, 25 bp, Mus musculus
gcaagcggcacgatgggtaccgttc

SEQ ID NO: 257655 - DNA, 25 bp, Mus musculus
tctccgaggcgccaaactgcgctcc

SEQ ID NO: 257656 - DNA, 25 bp, Mus musculus
ctcctctaggtgctctgagggccgg

SEQ ID NO: 257657 - DNA, 25 bp, Mus musculus
ggtgacagtaaacaagcctcaactg

SEQ ID NO: 257658 - DNA, 25 bp, Mus musculus
tttcacaagcctgggcgggacggct

SEQ ID NO: 257659 - DNA, 25 bp, Mus musculus
actgcctcagctacaactgccaagt

SEQ ID NO: 257660 - DNA, 25 bp, Mus musculus
gagcgaagccgagcgcctcgcttcc

SEQ ID NO: 257661 - DNA, 25 bp, Mus musculus
cgcacagccatagccgtgcggaggc

SEQ ID NO: 257662 - DNA, 25 bp, Mus musculus
catagccgtgcggaggctgcccacg

SEQ ID NO: 257663 - DNA, 25 bp, Mus musculus
gggagccgaagttcagcgcattttc

SEQ ID NO: 257664 - DNA, 25 bp, Mus musculus
ttcagcgcattttcgacggggattg

SEQ ID NO: 257665 - DNA, 25 bp, Mus musculus
cgcccggagaaagcgcggctttcct

SEQ ID NO: 257666 - DNA, 25 bp, Mus musculus
agggtggagcgcttctcacccaccg

SEQ ID NO: 257667 - DNA, 25 bp, Mus musculus
acccaccgcggcttacgctctgtca

SEQ ID NO: 257668 - DNA, 25 bp, Mus musculus
aggcgcccggagtttcacaagcctg

SEQ ID NO: 257669 - DNA, 25 bp, Mus musculus
gtaaacaagcctcaactgcctcagc

SEQ ID NO: 257670 - DNA, 25 bp, Mus musculus
gggccacacctgcaggcacgctttt

SEQ ID NO: 257671 - DNA, 25 bp, Mus musculus
tcattggtgacatattggcgggccc

SEQ ID NO: 257672 - DNA, 25 bp, Mus musculus
tccgactgccgctgtagatcacgcg

SEQ ID NO: 257673 - DNA, 25 bp, Mus musculus
gaacgcccttttcggcgtggtgagc

SEQ ID NO: 257674 - DNA, 25 bp, Mus musculus
cctcaggctccaggcagcgtacttt

SEQ ID NO: 257675 - DNA, 25 bp, Mus musculus
gcagcgtactttacctggtcaccta

SEQ ID NO: 257676 - DNA, 25 bp, Mus musculus
tggtcacctagaagtttccctcttg

SEQ ID NO: 257677 - DNA, 25 bp, Mus musculus
tgcgcgagttcttgctcagccctct

SEQ ID NO: 257678 - DNA, 25 bp, Mus musculus
caggggctccgcttccacagaaagc

SEQ ID NO: 257679 - DNA, 25 bp, Mus musculus
cttccacagaaagcgtttgcccatg

SEQ ID NO: 257680 - DNA, 25 bp, Mus musculus
gcaggcacgcttttctcattggtga

SEQ ID NO: 257681 - DNA, 25 bp, Mus musculus
agccctctgcgtttttaaggcgtcg

SEQ ID NO: 257682 - DNA, 25 bp, Mus musculus
gttgagaacaaaaagatgcacctgg

SEQ ID NO: 257683 - DNA, 25 bp, Mus musculus
ttgcccatggtcattggaacttcca

SEQ ID NO: 257684 - DNA, 25 bp, Mus musculus
ccgtgcagtgtatgatgacagcgct

SEQ ID NO: 257685 - DNA, 25 bp, Mus musculus
ctcggggatgctgccaggcaactac

SEQ ID NO: 257686 - DNA, 25 bp, Mus musculus
ggcaactacgcggaggccatctgaa

SEQ ID NO: 257687 - DNA, 25 bp, Mus musculus
ggaggccatctgaaccctgtgccgc

SEQ ID NO: 257688 - DNA, 25 bp, Mus musculus
atgtacgggaccgtagagcgcaccg

SEQ ID NO: 257689 - DNA, 25 bp, Mus musculus
gcagatcgatgacggctggatgtac

SEQ ID NO: 257690 - DNA, 25 bp, Mus musculus
aaacggtaccgtgcagtgtatgatg

SEQ ID NO: 257691 - DNA, 25 bp, Mus musculus
caatgtgcagcagatcgatgacggc

SEQ ID NO: 257692 - DNA, 25 bp, Mus musculus
tggagacaccatcgtcaatgtgcag

SEQ ID NO: 257693 - DNA, 25 bp, Mus musculus
tccaggatggagacaccatcgtcaa

SEQ ID NO: 257694 - DNA, 25 bp, Mus musculus
ggacgaggtctccttccaggatgga

SEQ ID NO: 257695 - DNA, 25 bp, Mus musculus
cgctgccaatgaggacgaggtctcc

SEQ ID NO: 257696 - DNA, 25 bp, Mus musculus
accgtagagcgcaccggtgactcgg

SEQ ID NO: 257697 - DNA, 25 bp, Mus musculus
tgacagcgctgccaatgaggacgag

SEQ ID NO: 257698 - DNA, 25 bp, Mus musculus
gggtctcggctactgaccacacatt

SEQ ID NO: 257699 - DNA, 25 bp, Mus musculus
agactcgttctcttgcggggtgagc

SEQ ID NO: 257700 - DNA, 25 bp, Mus musculus
agcgtccagggtcgtcacttctggc

SEQ ID NO: 257701 - DNA, 25 bp, Mus musculus
cactcgggtcccactctgggtgaca

SEQ ID NO: 257702 - DNA, 25 bp, Mus musculus
gctggatggtcgttgtcctagcact

SEQ ID NO: 257703 - DNA, 25 bp, Mus musculus
gcggcagccgcacaatccaacatgg

SEQ ID NO: 257704 - DNA, 25 bp, Mus musculus
catcccggttgaggtcttgttgcag

SEQ ID NO: 257705 - DNA, 25 bp, Mus musculus
gcgggtctcctacactgactgccga

SEQ ID NO: 257706 - DNA, 25 bp, Mus musculus
ccagtgtttgttaggcatcgaagcg

SEQ ID NO: 257707 - DNA, 25 bp, Mus musculus
agcgagactctcaggccgcctgtca

SEQ ID NO: 257708 - DNA, 25 bp, Mus musculus
cgcctgtcagggagatctagtttag

SEQ ID NO: 257709 - DNA, 25 bp, Mus musculus
ccggcgtagtttcggtcagagccgc

SEQ ID NO: 257710 - DNA, 25 bp, Mus musculus
gcctcgggtttctggatcttagtcc

SEQ ID NO: 257711 - DNA, 25 bp, Mus musculus
ccacacatttcttgccgaggaagga

SEQ ID NO: 257712 - DNA, 25 bp, Mus musculus
gcaccctcctctgctcgccccgcgc

SEQ ID NO: 257713 - DNA, 25 bp, Mus musculus
gggacgagcatggtgggagcgcacc

SEQ ID NO: 257714 - DNA, 25 bp, Mus musculus
atggtgggagcgcaccgggtagcag

SEQ ID NO: 257715 - DNA, 25 bp, Mus musculus
ggaactccgccctgggctggacggc

SEQ ID NO: 257716 - DNA, 25 bp, Mus musculus
gttcctggaactccgccctgggctg

SEQ ID NO: 257717 - DNA, 25 bp, Mus musculus
gagttcctggaactccgccctgggc

SEQ ID NO: 257718 - DNA, 25 bp, Mus musculus
cccgcgtggagttcctggaactccg

SEQ ID NO: 257719 - DNA, 25 bp, Mus musculus
tggatccagggacgggcgccgggta

SEQ ID NO: 257720 - DNA, 25 bp, Mus musculus
ccctcgggtcgtcagcgcgggcggg

SEQ ID NO: 257721 - DNA, 25 bp, Mus musculus
ctgaccgaggtaggcagcggcagcc

SEQ ID NO: 257722 - DNA, 25 bp, Mus musculus
cgggagcgacgctggcgctgaccga

SEQ ID NO: 257723 - DNA, 25 bp, Mus musculus
gggcgccgagcatgagccgccggcg

SEQ ID NO: 257724 - DNA, 25 bp, Mus musculus
gagggaactgctctgcccgcagctg

SEQ ID NO: 257725 - DNA, 25 bp, Mus musculus
cggcgggacccctgcgcctcctgca

SEQ ID NO: 257726 - DNA, 25 bp, Mus musculus
gcgcgcgcgaggaaatgagggaaat

SEQ ID NO: 257727 - DNA, 25 bp, Mus musculus
cacacctggccagcgccctgcgcgg

SEQ ID NO: 257728 - DNA, 25 bp, Mus musculus
gccctccagggccagacccagccca

SEQ ID NO: 257729 - DNA, 25 bp, Mus musculus
gccctccacagccagactccgccct

SEQ ID NO: 257730 - DNA, 25 bp, Mus musculus
tctggggacctgcacacctggccag

SEQ ID NO: 257731 - DNA, 25 bp, Mus musculus
atgagggaaatgaggctgggttgct

SEQ ID NO: 257732 - DNA, 25 bp, Mus musculus
cgccgctcagcgtcgccgcctctgg

SEQ ID NO: 257733 - DNA, 25 bp, Mus musculus
acacggcggtactcaccgcgcccgc

SEQ ID NO: 257734 - DNA, 25 bp, Mus musculus
cgcggcaggacacggcggtactcac

SEQ ID NO: 257735 - DNA, 25 bp, Mus musculus
gccgctgcccagaggcgcggcagga

SEQ ID NO: 257736 - DNA, 25 bp, Mus musculus
cggcgtcccggagggctcgtccgag

SEQ ID NO: 257737 - DNA, 25 bp, Mus musculus
cgcgtcaaggaagcgccgcgcccag

SEQ ID NO: 257738 - DNA, 25 bp, Mus musculus
tccctggcagcagcggtctccaaaa

SEQ ID NO: 257739 - DNA, 25 bp, Mus musculus
gcaaaccagcggtccctggcagcag

SEQ ID NO: 257740 - DNA, 25 bp, Mus musculus
ttcttccggaggagcctctagcccg

SEQ ID NO: 257741 - DNA, 25 bp, Mus musculus
gcccttcttccggaggagcctctag

SEQ ID NO: 257742 - DNA, 25 bp, Mus musculus
ctccttccgtgagtaccgtccctgc

SEQ ID NO: 257743 - DNA, 25 bp, Mus musculus
tgtggacttggtccctgctccctgc

SEQ ID NO: 257744 - DNA, 25 bp, Mus musculus
cacagcagccgcctttgagcccggg

SEQ ID NO: 257745 - DNA, 25 bp, Mus musculus
gccgacctgtggacttggtccctgc

SEQ ID NO: 257746 - DNA, 25 bp, Mus musculus
accggtcgcgatcaccttcccgtag

SEQ ID NO: 257747 - DNA, 25 bp, Mus musculus
agccgccgtgcccttttggctattg

SEQ ID NO: 257748 - DNA, 25 bp, Mus musculus
tttggctattgtggcctcgccatcc

SEQ ID NO: 257749 - DNA, 25 bp, Mus musculus
gccatccggcccacgcggaacccag

SEQ ID NO: 257750 - DNA, 25 bp, Mus musculus
cgctcccagcaagggtacggcaagc

SEQ ID NO: 257751 - DNA, 25 bp, Mus musculus
cctgcgtgcgaggactgcgcgctac

SEQ ID NO: 257752 - DNA, 25 bp, Mus musculus
ctctaggcggccgacctgtggactt

SEQ ID NO: 257753 - DNA, 25 bp, Mus musculus
ttcgttggaggagtggagtttccca

SEQ ID NO: 257754 - DNA, 25 bp, Mus musculus
cgcgaaaggaaaatctgggcgctgc

SEQ ID NO: 257755 - DNA, 25 bp, Mus musculus
aaatctgggcgctgcagtctccaag

SEQ ID NO: 257756 - DNA, 25 bp, Mus musculus
agtctccaagcgctggctcaagtcg

SEQ ID NO: 257757 - DNA, 25 bp, Mus musculus
ctggctcaagtcgtgggcttcccag

SEQ ID NO: 257758 - DNA, 25 bp, Mus musculus
ccgcggctggaaaagcgaccagctt

SEQ ID NO: 257759 - DNA, 25 bp, Mus musculus
gacagccaatgtaagcgcgcttctg

SEQ ID NO: 257760 - DNA, 25 bp, Mus musculus
aagcgaccagcttgggatgttcagc

SEQ ID NO: 257761 - DNA, 25 bp, Mus musculus
agcagctagccgcagcgacccggtt

SEQ ID NO: 257762 - DNA, 25 bp, Mus musculus
cttgggatgttcagctgcggctttg

SEQ ID NO: 257763 - DNA, 25 bp, Mus musculus
gctttggcggagcagtctactctgc

SEQ ID NO: 257764 - DNA, 25 bp, Mus musculus
ggagcagtctactctgcccggctcg

SEQ ID NO: 257765 - DNA, 25 bp, Mus musculus
tcgcacggacccaaggcgagccgag

SEQ ID NO: 257766 - DNA, 25 bp, Mus musculus
cggccggtgacagccaatgtaagcg

SEQ ID NO: 257767 - DNA, 25 bp, Mus musculus
aggcgacaagatctgtccgcttcgc

SEQ ID NO: 257768 - DNA, 25 bp, Mus musculus
ttgctgtttctgttagtcctttccc

SEQ ID NO: 257769 - DNA, 25 bp, Mus musculus
acctggatccatgatcatttgccgg

SEQ ID NO: 257770 - DNA, 25 bp, Mus musculus
catttgccggcatagccactttctc

SEQ ID NO: 257771 - DNA, 25 bp, Mus musculus
gtgcgtctcgcttgctgtttctgtt

SEQ ID NO: 257772 - DNA, 25 bp, Mus musculus
acacagaagattcggcgtctgggcc

SEQ ID NO: 257773 - DNA, 25 bp, Mus musculus
gcgggtgctggtctactaaaggtaa

SEQ ID NO: 257774 - DNA, 25 bp, Mus musculus
cctatactcgcagagacccagagtc

SEQ ID NO: 257775 - DNA, 25 bp, Mus musculus
ccagagtctagaatgatgtccctcc

SEQ ID NO: 257776 - DNA, 25 bp, Mus musculus
gaatgatgtccctccagtctctgga

SEQ ID NO: 257777 - DNA, 25 bp, Mus musculus
ctccagtctctggacgcgaagagca

SEQ ID NO: 257778 - DNA, 25 bp, Mus musculus
cgcgaagagcatcctccgccattta

SEQ ID NO: 257779 - DNA, 25 bp, Mus musculus
gcatcctccgccatttatcaagggg

SEQ ID NO: 257780 - DNA, 25 bp, Mus musculus
ctaaaggtaacctggatccatgatc

SEQ ID NO: 257781 - DNA, 25 bp, Mus musculus
tgggccgactggtcacctatactcg

SEQ ID NO: 257782 - DNA, 25 bp, Mus musculus
gggtcccagccactctgagagtcgg

SEQ ID NO: 257783 - DNA, 25 bp, Mus musculus
tgctgccctcttgtgccaggaccga

SEQ ID NO: 257784 - DNA, 25 bp, Mus musculus
tcacgggttttcagcgctctgctgc

SEQ ID NO: 257785 - DNA, 25 bp, Mus musculus
tgccagagctgtcctcacgggtttt

SEQ ID NO: 257786 - DNA, 25 bp, Mus musculus
cgagtcatcgccagtcccaacttga

SEQ ID NO: 257787 - DNA, 25 bp, Mus musculus
aacgctggaaggacgcccgagtcat

SEQ ID NO: 257788 - DNA, 25 bp, Mus musculus
cgacctggcttcagaggatccgcgc

SEQ ID NO: 257789 - DNA, 25 bp, Mus musculus
ttcagatttcgcacggactgccctc

SEQ ID NO: 257790 - DNA, 25 bp, Mus musculus
ttgcgcaagcgcactttcagatttc

SEQ ID NO: 257791 - DNA, 25 bp, Mus musculus
tgtccttctgcttgtacccgtcgga

SEQ ID NO: 257792 - DNA, 25 bp, Mus musculus
gccggaagcggaaactgtccttctg

SEQ ID NO: 257793 - DNA, 25 bp, Mus musculus
gggctcgcgaaagcactcggactca

SEQ ID NO: 257794 - DNA, 25 bp, Mus musculus
cgagaaacttgccttccagcccaga

SEQ ID NO: 257795 - DNA, 25 bp, Mus musculus
ccctggcccgcttatttgagtagca

SEQ ID NO: 257796 - DNA, 25 bp, Mus musculus
gccctagattagctctgcagaagtg

SEQ ID NO: 257797 - DNA, 25 bp, Mus musculus
cccaacggtgctcgtagtggggtct

SEQ ID NO: 257798 - DNA, 25 bp, Mus musculus
gagcaggactgcagtttgcgcatgc

SEQ ID NO: 257799 - DNA, 25 bp, Mus musculus
gccaggagttgtttcccaggaggta

SEQ ID NO: 257800 - DNA, 25 bp, Mus musculus
ctcctgcagtgcaccgtgccgaagg

SEQ ID NO: 257801 - DNA, 25 bp, Mus musculus
tgatgctgtctaaggctcacccgcc

SEQ ID NO: 257802 - DNA, 25 bp, Mus musculus
gttgctgccaacagcgaccaggatg

SEQ ID NO: 257803 - DNA, 25 bp, Mus musculus
cgctcgcgccatgcgtgagtcaact

SEQ ID NO: 257804 - DNA, 25 bp, Mus musculus
cagaagtgcgggactatccggatcc

SEQ ID NO: 257805 - DNA, 25 bp, Mus musculus
agcacgagctagaggccctagatta

SEQ ID NO: 257806 - DNA, 25 bp, Mus musculus
aaatgcgcaggcgtagcacgagcta

SEQ ID NO: 257807 - DNA, 25 bp, Mus musculus
ccgcctagtgggcaaaatgcgcagg

SEQ ID NO: 257808 - DNA, 25 bp, Mus musculus
tgagtcaactcctcagggttccgcc

SEQ ID NO: 257809 - DNA, 25 bp, Mus musculus
gcaagcccgagccatggagtcccag

SEQ ID NO: 257810 - DNA, 25 bp, Mus musculus
aaagcccacgcagttgctgcgcggg

SEQ ID NO: 257811 - DNA, 25 bp, Mus musculus
cagctagggcacttattgaaaagcc

SEQ ID NO: 257812 - DNA, 25 bp, Mus musculus
tgaaaagccggcctagacgcacggg

SEQ ID NO: 257813 - DNA, 25 bp, Mus musculus
tagacgcacgggatcccaccgggaa

SEQ ID NO: 257814 - DNA, 25 bp, Mus musculus
atcccaccgggaaagacgctgcatg

SEQ ID NO: 257815 - DNA, 25 bp, Mus musculus
catggcccggcaggtttttaaagca

SEQ ID NO: 257816 - DNA, 25 bp, Mus musculus
ttaaagcacaataatcgccaagccg

SEQ ID NO: 257817 - DNA, 25 bp, Mus musculus
caagccgagctgcaaactagcaacc

SEQ ID NO: 257818 - DNA, 25 bp, Mus musculus
ttcaggaggtcagggcgctgcaacc

SEQ ID NO: 257819 - DNA, 25 bp, Mus musculus
ccgcgcaacgttggctgacaacaca

SEQ ID NO: 257820 - DNA, 25 bp, Mus musculus
cttcttcatggcagagggtacgccc

SEQ ID NO: 257821 - DNA, 25 bp, Mus musculus
ggctgacaacacaacgcagctaggg

SEQ ID NO: 257822 - DNA, 25 bp, Mus musculus
tgggcccttactcctgaagccaaaa

SEQ ID NO: 257823 - DNA, 25 bp, Mus musculus
gcgctgcaacctagcgggttctcta

SEQ ID NO: 257824 - DNA, 25 bp, Mus musculus
gaacccattaggaacattgaaacga

SEQ ID NO: 257825 - DNA, 25 bp, Mus musculus
gcacttctgaaacgaacccattagg

SEQ ID NO: 257826 - DNA, 25 bp, Mus musculus
gtctcgccagccctgaggactacag

SEQ ID NO: 257827 - DNA, 25 bp, Mus musculus
gttgctgacgtaggacctgctgtcc

SEQ ID NO: 257828 - DNA, 25 bp, Mus musculus
tgacgtaggacctgctgtccgcgag

SEQ ID NO: 257829 - DNA, 25 bp, Mus musculus
atgaagacgctgttccggttacctc

SEQ ID NO: 257830 - DNA, 25 bp, Mus musculus
tcccgacagcagtgaatgaagacgc

SEQ ID NO: 257831 - DNA, 25 bp, Mus musculus
agctctgaggcttatcccgacagca

SEQ ID NO: 257832 - DNA, 25 bp, Mus musculus
tgaaaagccgactccgtacaccgcc

SEQ ID NO: 257833 - DNA, 25 bp, Mus musculus
cagtgaggcacttctgaaacgaacc

SEQ ID NO: 257834 - DNA, 25 bp, Mus musculus
ctgaggactacaggttgctgacgta

SEQ ID NO: 257835 - DNA, 25 bp, Mus musculus
ttacctccaggtcacgagaacagtg

SEQ ID NO: 257836 - DNA, 25 bp, Mus musculus
cgctgttccggttacctccaggtca

SEQ ID NO: 257837 - DNA, 25 bp, Mus musculus
ggtcacgagaacagtgaggcacttc

SEQ ID NO: 257838 - DNA, 25 bp, Mus musculus
cgcctcctttcgtgagattgtaatg

SEQ ID NO: 257839 - DNA, 25 bp, Mus musculus
aagaatttagcaccgcacctctggc

SEQ ID NO: 257840 - DNA, 25 bp, Mus musculus
taatgcatcctcagtacatccgggc

SEQ ID NO: 257841 - DNA, 25 bp, Mus musculus
ctcgctcgggatttcatgggaacca

SEQ ID NO: 257842 - DNA, 25 bp, Mus musculus
tcccttcgggtgattacctgatccc

SEQ ID NO: 257843 - DNA, 25 bp, Mus musculus
ctggcggctacaccatttgaaaata

SEQ ID NO: 257844 - DNA, 25 bp, Mus musculus
ggaattttccgctccggctcgcacg

SEQ ID NO: 257845 - DNA, 25 bp, Mus musculus
cgcttaccttggtggttttcctctg

SEQ ID NO: 257846 - DNA, 25 bp, Mus musculus
ttcctctggaacgtacatcctcgtg

SEQ ID NO: 257847 - DNA, 25 bp, Mus musculus
cgtgttttcattgaccattggccaa

SEQ ID NO: 257848 - DNA, 25 bp, Mus musculus
aactgcttggaaaggagaagccaca

SEQ ID NO: 257849 - DNA, 25 bp, Mus musculus
gcggctctcgcgcaaatccaggaac

SEQ ID NO: 257850 - DNA, 25 bp, Mus musculus
tccaggaacccgtggatccgcagtg

SEQ ID NO: 257851 - DNA, 25 bp, Mus musculus
atccgcagtggttcttgctcccttc

SEQ ID NO: 257852 - DNA, 25 bp, Mus musculus
tttgagatcagaagacagaagctct

SEQ ID NO: 257853 - DNA, 25 bp, Mus musculus
tcgcatcgtggacgtggccagccag

SEQ ID NO: 257854 - DNA, 25 bp, Mus musculus
cagccaggtggctctgtacactttc

SEQ ID NO: 257855 - DNA, 25 bp, Mus musculus
gacacgatatcagcctggcagccct

SEQ ID NO: 257856 - DNA, 25 bp, Mus musculus
gctctgtacactttcggccatcggg

SEQ ID NO: 257857 - DNA, 25 bp, Mus musculus
actttcggccatcgggccaacgagt

SEQ ID NO: 257858 - DNA, 25 bp, Mus musculus
cgggccacgggctttgagatcagaa

SEQ ID NO: 257859 - DNA, 25 bp, Mus musculus
ctacatcagtcgcatcgtggacgtg

SEQ ID NO: 257860 - DNA, 25 bp, Mus musculus
aagacagaagctctccggcagcgga

SEQ ID NO: 257861 - DNA, 25 bp, Mus musculus
aaacttagataagtccagcctcgcg

SEQ ID NO: 257862 - DNA, 25 bp, Mus musculus
acacagaaggtgtggccggctccgc

SEQ ID NO: 257863 - DNA, 25 bp, Mus musculus
gaggacccggccatcgattagcgaa

SEQ ID NO: 257864 - DNA, 25 bp, Mus musculus
tgcctgggaagggacacgatatcag

SEQ ID NO: 257865 - DNA, 25 bp, Mus musculus
tcgattagcgaagcctagcccgggt

SEQ ID NO: 257866 - DNA, 25 bp, Mus musculus
cgcacgtagcttcgatcggatcggg

SEQ ID NO: 257867 - DNA, 25 bp, Mus musculus
taccagcacgtccaaggtgatgccg

SEQ ID NO: 257868 - DNA, 25 bp, Mus musculus
ggtgagatgttgctcacccgcgctc

SEQ ID NO: 257869 - DNA, 25 bp, Mus musculus
tcgggaatcaccctgcgcggcctaa

SEQ ID NO: 257870 - DNA, 25 bp, Mus musculus
ccctcttctccagtccagggtgaga

SEQ ID NO: 257871 - DNA, 25 bp, Mus musculus
gatcttcaacatcggacagcggctc

SEQ ID NO: 257872 - DNA, 25 bp, Mus musculus
cgctcggccggatcttcaacatcgg

SEQ ID NO: 257873 - DNA, 25 bp, Mus musculus
tgatgccgtgcatcccgtagaagta

SEQ ID NO: 257874 - DNA, 25 bp, Mus musculus
gcctggcagaggataccagcacgtc

SEQ ID NO: 257875 - DNA, 25 bp, Mus musculus
gaaacccagcatccgcagatccagg

SEQ ID NO: 257876 - DNA, 25 bp, Mus musculus
ggccgctgcaggtatagctgctcca

SEQ ID NO: 257877 - DNA, 25 bp, Mus musculus
gcgagcacgtactgcagcgccaggt

SEQ ID NO: 257878 - DNA, 25 bp, Mus musculus
gcttcaggaacacttggccgtggta

SEQ ID NO: 257879 - DNA, 25 bp, Mus musculus
tcccgtagaagtagaagcgcatcca

SEQ ID NO: 257880 - DNA, 25 bp, Mus musculus
agagcgcgcgtgctcaacagcaagc

SEQ ID NO: 257881 - DNA, 25 bp, Mus musculus
cgcgcgtgctcaacagcaagcaagc

SEQ ID NO: 257882 - DNA, 25 bp, Mus musculus
acgcagggatgtccggtctggttca

SEQ ID NO: 257883 - DNA, 25 bp, Mus musculus
ggacacacgggcagcttggcaggca

SEQ ID NO: 257884 - DNA, 25 bp, Mus musculus
acagctggggcgcatctgcgatggc

SEQ ID NO: 257885 - DNA, 25 bp, Mus musculus
agcttggcaggcagaacgcagggat

SEQ ID NO: 257886 - DNA, 25 bp, Mus musculus
gctgcggggtcagcgacaaactgaa

SEQ ID NO: 257887 - DNA, 25 bp, Mus musculus
acagcaagcaagcagagggaggaga

SEQ ID NO: 257888 - DNA, 25 bp, Mus musculus
aggtagaaggatcagagcgcgcgtg

SEQ ID NO: 257889 - DNA, 25 bp, Mus musculus
aggcggacccgcaggctgagctgcc

SEQ ID NO: 257890 - DNA, 25 bp, Mus musculus
cggggtcagcgacaaactgaagcga

SEQ ID NO: 257891 - DNA, 25 bp, Mus musculus
gcgacaaactgaagcgaaagaggga

SEQ ID NO: 257892 - DNA, 25 bp, Mus musculus
cgggaggaagacagaccgaagaggg

SEQ ID NO: 257893 - DNA, 25 bp, Mus musculus
cagcgcctgtgaaggaggcggaccc

SEQ ID NO: 257894 - DNA, 25 bp, Mus musculus
ctctcgggagcatccgaatgccttg

SEQ ID NO: 257895 - DNA, 25 bp, Mus musculus
ttactgtctctctgtgcgtgcctgt

SEQ ID NO: 257896 - DNA, 25 bp, Mus musculus
gagcggaattaggagacggtcccta

SEQ ID NO: 257897 - DNA, 25 bp, Mus musculus
taaagccacgtgacgctaaccctcg

SEQ ID NO: 257898 - DNA, 25 bp, Mus musculus
atttagtacccgctgcgccggtcac

SEQ ID NO: 257899 - DNA, 25 bp, Mus musculus
caacccgtctggaaccaccgaatgg

SEQ ID NO: 257900 - DNA, 25 bp, Mus musculus
gccctcaccgtgaaggctctcggga

SEQ ID NO: 257901 - DNA, 25 bp, Mus musculus
tccgaatgccttgaacaaagatggc

SEQ ID NO: 257902 - DNA, 25 bp, Mus musculus
acgctcaccggctgaaccaatcgga

SEQ ID NO: 257903 - DNA, 25 bp, Mus musculus
gaaccaatcggaaggcaacttgtta

SEQ ID NO: 257904 - DNA, 25 bp, Mus musculus
aggcaacttgttaggacttcggaga

SEQ ID NO: 257905 - DNA, 25 bp, Mus musculus
gacttcggagaacgttgtcgcgaga

SEQ ID NO: 257906 - DNA, 25 bp, Mus musculus
acaaagatggcggacgacgctcacc

SEQ ID NO: 257907 - DNA, 25 bp, Mus musculus
ggaaagggacgttactgtctctctg

SEQ ID NO: 257908 - DNA, 25 bp, Mus musculus
ctaggcgtcgtcttatgaaggtttc

SEQ ID NO: 257909 - DNA, 25 bp, Mus musculus
ggccaacataatgctaggcgtcgtc

SEQ ID NO: 257910 - DNA, 25 bp, Mus musculus
ttccgacccgggcaatctgctgagc

SEQ ID NO: 257911 - DNA, 25 bp, Mus musculus
gaggatttcagtctccggccatcgc

SEQ ID NO: 257912 - DNA, 25 bp, Mus musculus
tgtgtttgtgtcagcggccaacata

SEQ ID NO: 257913 - DNA, 25 bp, Mus musculus
tgggccgccacggtttaatgactcg

SEQ ID NO: 257914 - DNA, 25 bp, Mus musculus
ggtaccggctccgaaatcgactaga

SEQ ID NO: 257915 - DNA, 25 bp, Mus musculus
acccagcttcctcgacgatttctga

SEQ ID NO: 257916 - DNA, 25 bp, Mus musculus
agagtgcctcggaacgctcacccag

SEQ ID NO: 257917 - DNA, 25 bp, Mus musculus
ttcggccgggtccacaatgtaaaca

SEQ ID NO: 257918 - DNA, 25 bp, Mus musculus
ggctttggaagcgtgatgcatcttg

SEQ ID NO: 257919 - DNA, 25 bp, Mus musculus
agccgcgctggcctaaaccggaagc

SEQ ID NO: 257920 - DNA, 25 bp, Mus musculus
gcgggccgagccagtaagaccacac

SEQ ID NO: 257921 - DNA, 25 bp, Mus musculus
ttcgcccgagttagcggccgtctca

SEQ ID NO: 257922 - DNA, 25 bp, Mus musculus
ccagcggcgctcactgcatacgtga

SEQ ID NO: 257923 - DNA, 25 bp, Mus musculus
atccacaaactccttggcaaagcgg

SEQ ID NO: 257924 - DNA, 25 bp, Mus musculus
aaggcagtctctcggctacctgcag

SEQ ID NO: 257925 - DNA, 25 bp, Mus musculus
tgcatacgtgaaggcagtctctcgg

SEQ ID NO: 257926 - DNA, 25 bp, Mus musculus
gtaggttcatgagagctcggccctg

SEQ ID NO: 257927 - DNA, 25 bp, Mus musculus
aaagttcttctcacgctctcgggca

SEQ ID NO: 257928 - DNA, 25 bp, Mus musculus
cttggcaaagcggtagccgtactcc

SEQ ID NO: 257929 - DNA, 25 bp, Mus musculus
gtagccgtactccacgttgtctcca

SEQ ID NO: 257930 - DNA, 25 bp, Mus musculus
aggcaggtccttgggcctcgcagca

SEQ ID NO: 257931 - DNA, 25 bp, Mus musculus
gtggacagctcaccctctctgcagg

SEQ ID NO: 257932 - DNA, 25 bp, Mus musculus
tgcaggctcggctgatggcattcac

SEQ ID NO: 257933 - DNA, 25 bp, Mus musculus
tgatggcattcaccacgccagcggc

SEQ ID NO: 257934 - DNA, 25 bp, Mus musculus
ccagcctcgttgttctgtaggttca

SEQ ID NO: 257935 - DNA, 25 bp, Mus musculus
ctccgatcccttggcaaagttcttc

SEQ ID NO: 257936 - DNA, 25 bp, Mus musculus
agctgctggccatgatcttcggcta

SEQ ID NO: 257937 - DNA, 25 bp, Mus musculus
ttcggctacttggacgtccgagaca

SEQ ID NO: 257938 - DNA, 25 bp, Mus musculus
ggacgccgcctaccacaagtcggtg

SEQ ID NO: 257939 - DNA, 25 bp, Mus musculus
cctcagctacgtgatccagggcatg

SEQ ID NO: 257940 - DNA, 25 bp, Mus musculus
ggcatggcgaacatcgagagcctca

SEQ ID NO: 257941 - DNA, 25 bp, Mus musculus
ttgagcctttgcaagcagatcaccg

SEQ ID NO: 257942 - DNA, 25 bp, Mus musculus
ggccgcatagcccagtacctcaagg

SEQ ID NO: 257943 - DNA, 25 bp, Mus musculus
accggccttctgctcattgcctggg

SEQ ID NO: 257944 - DNA, 25 bp, Mus musculus
tcaagagccttaatctccgcagctg

SEQ ID NO: 257945 - DNA, 25 bp, Mus musculus
agctgtcgccacctctcggatgtgg

SEQ ID NO: 257946 - DNA, 25 bp, Mus musculus
tggagcagctcactcttcaggactg

SEQ ID NO: 257947 - DNA, 25 bp, Mus musculus
caggactgccagaaactcacggatc

SEQ ID NO: 257948 - DNA, 25 bp, Mus musculus
tttccctgaagcacatctcgcgagg

SEQ ID NO: 257949 - DNA, 25 bp, Mus musculus
tggagacccacatctcgtgcctgtt

SEQ ID NO: 257950 - DNA, 25 bp, Mus musculus
agctttgttcgcaacggcccgcgga

SEQ ID NO: 257951 - DNA, 25 bp, Mus musculus
gacagcaccacgtctccagtgtgtg

SEQ ID NO: 257952 - DNA, 25 bp, Mus musculus
acgtctccagtgtgtgacccgcggt

SEQ ID NO: 257953 - DNA, 25 bp, Mus musculus
tgggacaggaacttgggctaaagtc

SEQ ID NO: 257954 - DNA, 25 bp, Mus musculus
gggctaaagtcatcccttcgcagta

SEQ ID NO: 257955 - DNA, 25 bp, Mus musculus
cccttcgcagtacctgtcggagaca

SEQ ID NO: 257956 - DNA, 25 bp, Mus musculus
tgtcggagacactccgcgccgttcg

SEQ ID NO: 257957 - DNA, 25 bp, Mus musculus
cgagccaggaaaagcggagcagctc

SEQ ID NO: 257958 - DNA, 25 bp, Mus musculus
gacttagcggcaccgttggcggcca

SEQ ID NO: 257959 - DNA, 25 bp, Mus musculus
tctgcggggacagagcactgcaacc

SEQ ID NO: 257960 - DNA, 25 bp, Mus musculus
agcgcggacgcgtgactcacctttt

SEQ ID NO: 257961 - DNA, 25 bp, Mus musculus
tgactcaccttttggtgacaccctt

SEQ ID NO: 257962 - DNA, 25 bp, Mus musculus
tgacaccctttggagtccggagctg

SEQ ID NO: 257963 - DNA, 25 bp, Mus musculus
ttcgtcgcgcgcaaaactgcagctg

SEQ ID NO: 257964 - DNA, 25 bp, Mus musculus
cgaggttccgcctgacgagcgagcc

SEQ ID NO: 257965 - DNA, 25 bp, Mus musculus
cgagccgggtaggaaacgacaaatg

SEQ ID NO: 257966 - DNA, 25 bp, Mus musculus
agtggagtggcctttcccaaacctg

SEQ ID NO: 257967 - DNA, 25 bp, Mus musculus
acgacaaatgcctcggcgcctgcga

SEQ ID NO: 257968 - DNA, 25 bp, Mus musculus
ggcagatcgaggttccgcctgacga

SEQ ID NO: 257969 - DNA, 25 bp, Mus musculus
tgctgctactgcttcccggacagcc

SEQ ID NO: 257970 - DNA, 25 bp, Mus musculus
tgccgccgacactaccacagccgcc

SEQ ID NO: 257971 - DNA, 25 bp, Mus musculus
tgggctttccctcgtcccactggga

SEQ ID NO: 257972 - DNA, 25 bp, Mus musculus
accgcgcgccaggatcgacaagtgc

SEQ ID NO: 257973 - DNA, 25 bp, Mus musculus
aggatcgacaagtgcggcgctccga

SEQ ID NO: 257974 - DNA, 25 bp, Mus musculus
ccgaggcagggttgcgccacacgta

SEQ ID NO: 257975 - DNA, 25 bp, Mus musculus
agggttgcgccacacgtagcgccgc

SEQ ID NO: 257976 - DNA, 25 bp, Mus musculus
tgcttgccgtaggacgtggactgct

SEQ ID NO: 257977 - DNA, 25 bp, Mus musculus
cgcctgcgacctctgggcagatcga

SEQ ID NO: 257978 - DNA, 25 bp, Mus musculus
gcaccgcgttccgaagcgcgtgagt

SEQ ID NO: 257979 - DNA, 25 bp, Mus musculus
gccgcttccagttcgcgacttgatt

SEQ ID NO: 257980 - DNA, 25 bp, Mus musculus
tacggaaaccgaagcggcttgctgc

SEQ ID NO: 257981 - DNA, 25 bp, Mus musculus
cgcgggcggtgagataacagcccaa

SEQ ID NO: 257982 - DNA, 25 bp, Mus musculus
agcccaagagcgctcaggatgctga

SEQ ID NO: 257983 - DNA, 25 bp, Mus musculus
aggatgctgagtcctccgccgcttc

SEQ ID NO: 257984 - DNA, 25 bp, Mus musculus
acttgatttgcgacagcctgctttg

SEQ ID NO: 257985 - DNA, 25 bp, Mus musculus
gacagcctgctttgcggctctcggc

SEQ ID NO: 257986 - DNA, 25 bp, Mus musculus
ctctcggcgccttctgacttgactt

SEQ ID NO: 257987 - DNA, 25 bp, Mus musculus
tgacttgacttacggcctttccttc

SEQ ID NO: 257988 - DNA, 25 bp, Mus musculus
tctgtttttctttgggcgaggactc

SEQ ID NO: 257989 - DNA, 25 bp, Mus musculus
agagtctccattccttctgcgaggc

SEQ ID NO: 257990 - DNA, 25 bp, Mus musculus
tcgcagggcgcctacggaaaccgaa

SEQ ID NO: 257991 - DNA, 25 bp, Mus musculus
ctctgagcttgcagagtctccattc

SEQ ID NO: 257992 - DNA, 25 bp, Mus musculus
catccatcctgcagcgagcggaggc

SEQ ID NO: 257993 - DNA, 25 bp, Mus musculus
ctcgaagcctcgaagcctgaggagc

SEQ ID NO: 257994 - DNA, 25 bp, Mus musculus
tcactagatgctgagggccgaagcc

SEQ ID NO: 257995 - DNA, 25 bp, Mus musculus
tcagagggcgcccatcactagatgc

SEQ ID NO: 257996 - DNA, 25 bp, Mus musculus
gaagacggctaagctccctccgctg

SEQ ID NO: 257997 - DNA, 25 bp, Mus musculus
agaagcgccgcagtcatgaggagca

SEQ ID NO: 257998 - DNA, 25 bp, Mus musculus
tgacccggagaagccaccaagaagt

SEQ ID NO: 257999 - DNA, 25 bp, Mus musculus
gcgggctcggatttatgaatgaaaa

SEQ ID NO: 258000 - DNA, 25 bp, Mus musculus
cgtcagacatggtcggtccgatgga

SEQ ID NO: 258001 - DNA, 25 bp, Mus musculus
gcttctcggcggcaccgtcagacat

SEQ ID NO: 258002 - DNA, 25 bp, Mus musculus
gaagcccggagtgccgctttgcttc

SEQ ID NO: 258003 - DNA, 25 bp, Mus musculus
cggagcttgagccattcttggggac

SEQ ID NO: 258004 - DNA, 25 bp, Mus musculus
tcgcccacggaagaatcggagcttg

SEQ ID NO: 258005 - DNA, 25 bp, Mus musculus
gatgcgacccaagtgaagacggcta

SEQ ID NO: 258006 - DNA, 25 bp, Mus musculus
accagctccagatacagagtccaga

SEQ ID NO: 258007 - DNA, 25 bp, Mus musculus
tcctcagcagcttgatcgggcgcag

SEQ ID NO: 258008 - DNA, 25 bp, Mus musculus
ggggaaacagcgagccaaccactcc

SEQ ID NO: 258009 - DNA, 25 bp, Mus musculus
ccgactgctcatgctcgacgcgttg

SEQ ID NO: 258010 - DNA, 25 bp, Mus musculus
agtccagagtcccaccgatactacg

SEQ ID NO: 258011 - DNA, 25 bp, Mus musculus
cccggcgctacttactgtggttcag

SEQ ID NO: 258012 - DNA, 25 bp, Mus musculus
acagtggcctcgacaagcccaggtc

SEQ ID NO: 258013 - DNA, 25 bp, Mus musculus
ggtgcctcgcaggtcgttctccggc

SEQ ID NO: 258014 - DNA, 25 bp, Mus musculus
caggccaggatcagcgacccacagt

SEQ ID NO: 258015 - DNA, 25 bp, Mus musculus
ccggctccactctgtcctgagtggg

SEQ ID NO: 258016 - DNA, 25 bp, Mus musculus
gatgtcctgagagcgtcccggctcc

SEQ ID NO: 258017 - DNA, 25 bp, Mus musculus
accagcgctccggatgtcctgagag

SEQ ID NO: 258018 - DNA, 25 bp, Mus musculus
caaagttggggaggctctgatcgca

SEQ ID NO: 258019 - DNA, 25 bp, Mus musculus
ctctctcggaggtgctttttgaaaa

SEQ ID NO: 258020 - DNA, 25 bp, Mus musculus
cgcagaactttgacaggcaagctgt

SEQ ID NO: 258021 - DNA, 25 bp, Mus musculus
cgtcctaagaagatgcgctgcggcc

SEQ ID NO: 258022 - DNA, 25 bp, Mus musculus
gcgaccgagcgaaacgagttgtaca

SEQ ID NO: 258023 - DNA, 25 bp, Mus musculus
aacgggcatctgcaaaatccggcca

SEQ ID NO: 258024 - DNA, 25 bp, Mus musculus
tgctctccgaggcattacacattcc

SEQ ID NO: 258025 - DNA, 25 bp, Mus musculus
ggccacccaaggtagcgtcgcctga

SEQ ID NO: 258026 - DNA, 25 bp, Mus musculus
ggcggactgatttagcagcacgtta

SEQ ID NO: 258027 - DNA, 25 bp, Mus musculus
cagcacgttaacttccgggagcgtc

SEQ ID NO: 258028 - DNA, 25 bp, Mus musculus
gtgaggactcgttctcgtcctaaga

SEQ ID NO: 258029 - DNA, 25 bp, Mus musculus
ttttttggtgaccatggcgtccgtg

SEQ ID NO: 258030 - DNA, 25 bp, Mus musculus
ccagttgggaggagttcacagaccc

SEQ ID NO: 258031 - DNA, 25 bp, Mus musculus
ccgctgagttttatcgggcgcatcc

SEQ ID NO: 258032 - DNA, 25 bp, Mus musculus
cgcatccggccctttgcggagaaaa

SEQ ID NO: 258033 - DNA, 25 bp, Mus musculus
ctcggccaagagttcgtcacttgtc

SEQ ID NO: 258034 - DNA, 25 bp, Mus musculus
ctgcgcctagtgcacgggctgagaa

SEQ ID NO: 258035 - DNA, 25 bp, Mus musculus
gcgctgctgttttgtgcacagtgct

SEQ ID NO: 258036 - DNA, 25 bp, Mus musculus
ctgtgggctgcaggagcttgtcact

SEQ ID NO: 258037 - DNA, 25 bp, Mus musculus
aggagcttgtcactgccaccaccat

SEQ ID NO: 258038 - DNA, 25 bp, Mus musculus
accaccatcgcaacccgggtggaga

SEQ ID NO: 258039 - DNA, 25 bp, Mus musculus
actgcgcgggcttcactccaggtcg

SEQ ID NO: 258040 - DNA, 25 bp, Mus musculus
tctcgtcctccttctagcagagcat

SEQ ID NO: 258041 - DNA, 25 bp, Mus musculus
cgcagtagctttcaataggaagcta

SEQ ID NO: 258042 - DNA, 25 bp, Mus musculus
tccttctagcagagcatctggtttg

SEQ ID NO: 258043 - DNA, 25 bp, Mus musculus
cagagcatctggtttgtggagagac

SEQ ID NO: 258044 - DNA, 25 bp, Mus musculus
agagggcgctgctgttttgtgcaca

SEQ ID NO: 258045 - DNA, 25 bp, Mus musculus
cgtttcattcaaggcgttcgcagta

SEQ ID NO: 258046 - DNA, 25 bp, Mus musculus
aaggcgttcgcagtagctttcaata

SEQ ID NO: 258047 - DNA, 25 bp, Mus musculus
acccacacacgtttcattcaaggcg

SEQ ID NO: 258048 - DNA, 25 bp, Mus musculus
gacgaagtggatggagagctccttc

SEQ ID NO: 258049 - DNA, 25 bp, Mus musculus
cagggagagaggtaaacaaactcaa

SEQ ID NO: 258050 - DNA, 25 bp, Mus musculus
cagccctacagggagagaggtaaac

SEQ ID NO: 258051 - DNA, 25 bp, Mus musculus
ctcgccacgcgttcaaaaaggggcg

SEQ ID NO: 258052 - DNA, 25 bp, Mus musculus
cagcgggcgtgagcgcagccctaca

SEQ ID NO: 258053 - DNA, 25 bp, Mus musculus
ctctcgccacgcgttcaaaaagggg

SEQ ID NO: 258054 - DNA, 25 bp, Mus musculus
gcgcctgttgattggccgcctctcg

SEQ ID NO: 258055 - DNA, 25 bp, Mus musculus
gaagtggatggagagctccttctcc

SEQ ID NO: 258056 - DNA, 25 bp, Mus musculus
cctggccgcgcctgttgattggccg

SEQ ID NO: 258057 - DNA, 25 bp, Mus musculus
tccactagcgcagcactgccagggg

SEQ ID NO: 258058 - DNA, 25 bp, Mus musculus
agtcgcgaccgcaagctccactagc

SEQ ID NO: 258059 - DNA, 25 bp, Mus musculus
gtctttgcgccgcttcagtcgcgac

SEQ ID NO: 258060 - DNA, 25 bp, Mus musculus
ccaccatgcccgcagtctttgcgcc

SEQ ID NO: 258061 - DNA, 25 bp, Mus musculus
ccagctggcagcagccggggacgaa

SEQ ID NO: 258062 - DNA, 25 bp, Mus musculus
tcgacttcccggctccggtctgcgc

SEQ ID NO: 258063 - DNA, 25 bp, Mus musculus
ctggcagcgactccgggagtggagt

SEQ ID NO: 258064 - DNA, 25 bp, Mus musculus
ccgtgtgaagccgacgagcgccagt

SEQ ID NO: 258065 - DNA, 25 bp, Mus musculus
tgaagccgacgagcgccagtcctcg

SEQ ID NO: 258066 - DNA, 25 bp, Mus musculus
gaaagccatcgcgggccctcgctgt

SEQ ID NO: 258067 - DNA, 25 bp, Mus musculus
tatggcgattcggcgctgctggcca

SEQ ID NO: 258068 - DNA, 25 bp, Mus musculus
tgcttctgctgctgaacgttctggc

SEQ ID NO: 258069 - DNA, 25 bp, Mus musculus
cttctgctgctgaacgttctggccc

SEQ ID NO: 258070 - DNA, 25 bp, Mus musculus
tctgcgcgcaggaggtgagagaagc

SEQ ID NO: 258071 - DNA, 25 bp, Mus musculus
gctgtcaaaggtgctgagagccgtc

SEQ ID NO: 258072 - DNA, 25 bp, Mus musculus
tgaaagtccgccctaggggctcgga

SEQ ID NO: 258073 - DNA, 25 bp, Mus musculus
aaactacgcgggcggcggagtcact

SEQ ID NO: 258074 - DNA, 25 bp, Mus musculus
ggggtgacaattccgtctgggcctc

SEQ ID NO: 258075 - DNA, 25 bp, Mus musculus
tcaaaggtgctgagagccgtcgcga

SEQ ID NO: 258076 - DNA, 25 bp, Mus musculus
ggcgatccaagagcaccagtacagg

SEQ ID NO: 258077 - DNA, 25 bp, Mus musculus
gatgctaatgctctcgtcgtcgtcc

SEQ ID NO: 258078 - DNA, 25 bp, Mus musculus
caccagtggcttgctgatgctaatg

SEQ ID NO: 258079 - DNA, 25 bp, Mus musculus
ccagtacaggtcagtgactgcaatg

SEQ ID NO: 258080 - DNA, 25 bp, Mus musculus
cgcgcagctcgatgaggtccaggat

SEQ ID NO: 258081 - DNA, 25 bp, Mus musculus
ctcgctaatggcacgcactaggctg

SEQ ID NO: 258082 - DNA, 25 bp, Mus musculus
ccaccacgaggtcggtggcgatcca

SEQ ID NO: 258083 - DNA, 25 bp, Mus musculus
cactaggctgtagagcagcggcacg

SEQ ID NO: 258084 - DNA, 25 bp, Mus musculus
ttcttggcgaagaagatggcccagc

SEQ ID NO: 258085 - DNA, 25 bp, Mus musculus
tacgcaaaagcgaactcgcccgctg

SEQ ID NO: 258086 - DNA, 25 bp, Mus musculus
gatgagccaggccaggtacgcaaaa

SEQ ID NO: 258087 - DNA, 25 bp, Mus musculus
tgtgcccaggatgagcaccacctta

SEQ ID NO: 258088 - DNA, 25 bp, Mus musculus
cagcgccatggtaaggcgaaagccc

SEQ ID NO: 258089 - DNA, 25 bp, Mus musculus
caatgaggtacaggtccagcagacc

SEQ ID NO: 258090 - DNA, 25 bp, Mus musculus
ggaaggtgcgcacccggacaccgct

SEQ ID NO: 258091 - DNA, 25 bp, Mus musculus
agacttggggtcagcgagtatcgac

SEQ ID NO: 258092 - DNA, 25 bp, Mus musculus
cctgacactgaatggcgaggctctg

SEQ ID NO: 258093 - DNA, 25 bp, Mus musculus
gagagcgcgttcctgacactgaatg

SEQ ID NO: 258094 - DNA, 25 bp, Mus musculus
gcacagccgagcaaccaatcagcgg

SEQ ID NO: 258095 - DNA, 25 bp, Mus musculus
gactgtgtgtctctcccactctcga

SEQ ID NO: 258096 - DNA, 25 bp, Mus musculus
cgcacgcgcagactgtgtgtctctc

SEQ ID NO: 258097 - DNA, 25 bp, Mus musculus
gacaaggactcttccagcgggtgga

SEQ ID NO: 258098 - DNA, 25 bp, Mus musculus
gagctgcgaacccacccgaggctga

SEQ ID NO: 258099 - DNA, 25 bp, Mus musculus
gaggcacattcctgacgcgcgggaa

SEQ ID NO: 258100 - DNA, 25 bp, Mus musculus
gaaacgaattaactgctgaggcaca

SEQ ID NO: 258101 - DNA, 25 bp, Mus musculus
cgcgaacccttacttcgagcagaag

SEQ ID NO: 258102 - DNA, 25 bp, Mus musculus
gcagtttccacagatggcgcccggc

SEQ ID NO: 258103 - DNA, 25 bp, Mus musculus
agacaggcgcacaggcagtttccac

SEQ ID NO: 258104 - DNA, 25 bp, Mus musculus
tgtcttccgtcaccaaagtcgccga

SEQ ID NO: 258105 - DNA, 25 bp, Mus musculus
ccctccacagcagtaataactgaaa

SEQ ID NO: 258106 - DNA, 25 bp, Mus musculus
taactgaaatcccacacgtgcgcac

SEQ ID NO: 258107 - DNA, 25 bp, Mus musculus
acacgtgcgcactcccggagcgagt

SEQ ID NO: 258108 - DNA, 25 bp, Mus musculus
aggactcgaccactgaggccacgtg

SEQ ID NO: 258109 - DNA, 25 bp, Mus musculus
ctttctccgcgcttctctgcgggga

SEQ ID NO: 258110 - DNA, 25 bp, Mus musculus
gtgggagagacccttattgtcttcc

SEQ ID NO: 258111 - DNA, 25 bp, Mus musculus
tctgctcgctctttcgcacggcgtt

SEQ ID NO: 258112 - DNA, 25 bp, Mus musculus
caaacacctgcacggcagagcgcgg

SEQ ID NO: 258113 - DNA, 25 bp, Mus musculus
cccgacttcgagatcgaggtgagta

SEQ ID NO: 258114 - DNA, 25 bp, Mus musculus
cccatctgttttcctcagcgctgag

SEQ ID NO: 258115 - DNA, 25 bp, Mus musculus
gagtagccggcgctgcgccctttct

SEQ ID NO: 258116 - DNA, 25 bp, Mus musculus
cctcagcgctgagtggattatattg

SEQ ID NO: 258117 - DNA, 25 bp, Mus musculus
agctccgctcctggtgggaagtccc

SEQ ID NO: 258118 - DNA, 25 bp, Mus musculus
cggcggagcaaacctgagacgaaaa

SEQ ID NO: 258119 - DNA, 25 bp, Mus musculus
tcaaccaatagatcgagaactgtgc

SEQ ID NO: 258120 - DNA, 25 bp, Mus musculus
ccgatgaacgcaggccacccgaaga

SEQ ID NO: 258121 - DNA, 25 bp, Mus musculus
cgaagaccctgctctgcaaagcaaa

SEQ ID NO: 258122 - DNA, 25 bp, Mus musculus
gggccgtagccttctcaaccaatag

SEQ ID NO: 258123 - DNA, 25 bp, Mus musculus
tgtacatctgcatcgctgagcgcca

SEQ ID NO: 258124 - DNA, 25 bp, Mus musculus
ccatggcgaaggcaaagtccggcca

SEQ ID NO: 258125 - DNA, 25 bp, Mus musculus
cttcgaatctgggttcaaagtggcg

SEQ ID NO: 258126 - DNA, 25 bp, Mus musculus
gcaaacgtcaacactgtcctccgga

SEQ ID NO: 258127 - DNA, 25 bp, Mus musculus
tcacctgcttctgtacatctgcatc

SEQ ID NO: 258128 - DNA, 25 bp, Mus musculus
ctgggaggtccagcttcctttactt

SEQ ID NO: 258129 - DNA, 25 bp, Mus musculus
ccgcggaagttctgccttggctccg

SEQ ID NO: 258130 - DNA, 25 bp, Mus musculus
gtccggccaggggacagcttcgaat

SEQ ID NO: 258131 - DNA, 25 bp, Mus musculus
atcgagaactgtgcccgcggaagtt

SEQ ID NO: 258132 - DNA, 25 bp, Mus musculus
gaccaccgagctgaccacggtgctg

SEQ ID NO: 258133 - DNA, 25 bp, Mus musculus
ggtgacctcaccgtccaacatggcg

SEQ ID NO: 258134 - DNA, 25 bp, Mus musculus
gtgaatccgacctgtccagtgcgcc

SEQ ID NO: 258135 - DNA, 25 bp, Mus musculus
tggcttccggcttggcattacgccc

SEQ ID NO: 258136 - DNA, 25 bp, Mus musculus
ttaggttcgcgggtcgaagcagcca

SEQ ID NO: 258137 - DNA, 25 bp, Mus musculus
gtcgaagcagccactgtcgctcctg

SEQ ID NO: 258138 - DNA, 25 bp, Mus musculus
cgtctccttcgtcccttgtggggca

SEQ ID NO: 258139 - DNA, 25 bp, Mus musculus
tggtggagcggtttccatccgctga

SEQ ID NO: 258140 - DNA, 25 bp, Mus musculus
gtcttggagaccaccgagctgacca

SEQ ID NO: 258141 - DNA, 25 bp, Mus musculus
ttccagttgaccgagccgctggctt

SEQ ID NO: 258142 - DNA, 25 bp, Mus musculus
cgccgcggcgtctcggaacttctga

SEQ ID NO: 258143 - DNA, 25 bp, Mus musculus
tctcggaacttctgaggggctgttt

SEQ ID NO: 258144 - DNA, 25 bp, Mus musculus
ctgtttggggtgaatccgacctgtc

SEQ ID NO: 258145 - DNA, 25 bp, Mus musculus
ttccatccgctgaggaaggggtctt

SEQ ID NO: 258146 - DNA, 25 bp, Mus musculus
gcgcccagtagggtgggcatactca

SEQ ID NO: 258147 - DNA, 25 bp, Mus musculus
ctgcccgaagcggaccaggaccgag

SEQ ID NO: 258148 - DNA, 25 bp, Mus musculus
cccaggccttcgagtgagtgccttc

SEQ ID NO: 258149 - DNA, 25 bp, Mus musculus
tcagctccgcggtggcaccctgtgg

SEQ ID NO: 258150 - DNA, 25 bp, Mus musculus
cccgccatcacgaaggatcgatagc

SEQ ID NO: 258151 - DNA, 25 bp, Mus musculus
ggatcgatagcatacgaaactgagc

SEQ ID NO: 258152 - DNA, 25 bp, Mus musculus
tacgaaactgagctccgtgccgacc

SEQ ID NO: 258153 - DNA, 25 bp, Mus musculus
cccgtcctcccagaggggaactgtg

SEQ ID NO: 258154 - DNA, 25 bp, Mus musculus
gtgggcatactcaccacgcagacgc

SEQ ID NO: 258155 - DNA, 25 bp, Mus musculus
caaaggtttgcggagccacactcgg

SEQ ID NO: 258156 - DNA, 25 bp, Mus musculus
ccggcgctctactccacctaccttt

SEQ ID NO: 258157 - DNA, 25 bp, Mus musculus
tacctttcctcgtgctcgcccggga

SEQ ID NO: 258158 - DNA, 25 bp, Mus musculus
cgactggccacactttgcggaaacc

SEQ ID NO: 258159 - DNA, 25 bp, Mus musculus
tggccacactttgcggaaacccaag

SEQ ID NO: 258160 - DNA, 25 bp, Mus musculus
ccgccagagggaggcacaaggcacc

SEQ ID NO: 258161 - DNA, 25 bp, Mus musculus
acgtgtccagccacgcatcggggcg

SEQ ID NO: 258162 - DNA, 25 bp, Mus musculus
ttcatgctgctgtgtcctcgtggcc

SEQ ID NO: 258163 - DNA, 25 bp, Mus musculus
tctgcttcatgctgctgtgtcctcg

SEQ ID NO: 258164 - DNA, 25 bp, Mus musculus
aggagcacggcgctcacctctgctt

SEQ ID NO: 258165 - DNA, 25 bp, Mus musculus
ggattgtggttgctccccaggagca

SEQ ID NO: 258166 - DNA, 25 bp, Mus musculus
gccacccgcgccaaagccgcccgtg

SEQ ID NO: 258167 - DNA, 25 bp, Mus musculus
agcgcagaggggcttcctcgcctga

SEQ ID NO: 258168 - DNA, 25 bp, Mus musculus
cacccgatttctggaggtcagggac

SEQ ID NO: 258169 - DNA, 25 bp, Mus musculus
cctagcacccgatttctggaggtca

SEQ ID NO: 258170 - DNA, 25 bp, Mus musculus
gacctgacctagcacccgatttctg

SEQ ID NO: 258171 - DNA, 25 bp, Mus musculus
ggcgggacgtgtccagccacgcatc

SEQ ID NO: 258172 - DNA, 25 bp, Mus musculus
acgcgtccgccagagggaggcacaa

SEQ ID NO: 258173 - DNA, 25 bp, Mus musculus
gccagccgccgaccggcacaccgag

SEQ ID NO: 258174 - DNA, 25 bp, Mus musculus
acctggacttccatgccgcactaga

SEQ ID NO: 258175 - DNA, 25 bp, Mus musculus
caggcccagtccgaatttccaggaa

SEQ ID NO: 258176 - DNA, 25 bp, Mus musculus
tttccaggaagctcccgagaagctg

SEQ ID NO: 258177 - DNA, 25 bp, Mus musculus
gagaagctgtcctcctgacgtgtga

SEQ ID NO: 258178 - DNA, 25 bp, Mus musculus
acgtgtgaggagacctggtcgaacc

SEQ ID NO: 258179 - DNA, 25 bp, Mus musculus
cctggtcgaacccaggctggctatg

SEQ ID NO: 258180 - DNA, 25 bp, Mus musculus
ctggctatgaagagcgacgcctcga

SEQ ID NO: 258181 - DNA, 25 bp, Mus musculus
agagcgacgcctcgacgtctgcagc

SEQ ID NO: 258182 - DNA, 25 bp, Mus musculus
tttgaaagggctcgtgggccctctg

SEQ ID NO: 258183 - DNA, 25 bp, Mus musculus
acctgttggtggtgcacctggactt

SEQ ID NO: 258184 - DNA, 25 bp, Mus musculus
ctagagacttgcgaacgagcctggc

SEQ ID NO: 258185 - DNA, 25 bp, Mus musculus
ggcacgtacgtgctgagctatgttc

SEQ ID NO: 258186 - DNA, 25 bp, Mus musculus
ttgcgggacatctaccaggcccagt

SEQ ID NO: 258187 - DNA, 25 bp, Mus musculus
cctgctggaagaggcgtccgacctg

SEQ ID NO: 258188 - DNA, 25 bp, Mus musculus
tcgctttcctttggatctaggggaa

SEQ ID NO: 258189 - DNA, 25 bp, Mus musculus
cttgtcgtgtcctggtgtaggcgac

SEQ ID NO: 258190 - DNA, 25 bp, Mus musculus
cgtatccaggagttaccgggccagg

SEQ ID NO: 258191 - DNA, 25 bp, Mus musculus
tatccaggagttaccgggccaggtc

SEQ ID NO: 258192 - DNA, 25 bp, Mus musculus
ggccaggtccggcttgtcgtgtcct

SEQ ID NO: 258193 - DNA, 25 bp, Mus musculus
aggcgactggactgcgggttctgta

SEQ ID NO: 258194 - DNA, 25 bp, Mus musculus
ctgtaggggcgcgtacaaccgctcc

SEQ ID NO: 258195 - DNA, 25 bp, Mus musculus
gtaggggcgcgtacaaccgctccgc

SEQ ID NO: 258196 - DNA, 25 bp, Mus musculus
ccgcccggtgcctgagtttcgcttt

SEQ ID NO: 258197 - DNA, 25 bp, Mus musculus
cccggtgcctgagtttcgctttcct

SEQ ID NO: 258198 - DNA, 25 bp, Mus musculus
agtttcgctttcctttggatctagg

SEQ ID NO: 258199 - DNA, 25 bp, Mus musculus
ggccaggcgtgcagaaggcttggcc

SEQ ID NO: 258200 - DNA, 25 bp, Mus musculus
tgcagaaggcttggccggcagtgcc

SEQ ID NO: 258201 - DNA, 25 bp, Mus musculus
cctgagtttcgctttcctttggatc

SEQ ID NO: 258202 - DNA, 25 bp, Mus musculus
attttagcgcatcgccgagccgcca

SEQ ID NO: 258203 - DNA, 25 bp, Mus musculus
ctccggcatttcaggcatgattcca

SEQ ID NO: 258204 - DNA, 25 bp, Mus musculus
ctattttggggaaacgcagcgagag

SEQ ID NO: 258205 - DNA, 25 bp, Mus musculus
gtctggctcctctggcccggtcttt

SEQ ID NO: 258206 - DNA, 25 bp, Mus musculus
tctggcccggtctttgttcgctccg

SEQ ID NO: 258207 - DNA, 25 bp, Mus musculus
gcacggagcacacggacgccaaaaa

SEQ ID NO: 258208 - DNA, 25 bp, Mus musculus
gccaaaaacgtgaggcgcagctccg

SEQ ID NO: 258209 - DNA, 25 bp, Mus musculus
ggcatgattccagaactattttggg

SEQ ID NO: 258210 - DNA, 25 bp, Mus musculus
gttccatggcctccggcatttcagg

SEQ ID NO: 258211 - DNA, 25 bp, Mus musculus
cgtagcagcggtttggaatcgattt

SEQ ID NO: 258212 - DNA, 25 bp, Mus musculus
tgctagctcttacctgttccatggc

SEQ ID NO: 258213 - DNA, 25 bp, Mus musculus
ccgagtcttgaattgctagctctta

SEQ ID NO: 258214 - DNA, 25 bp, Mus musculus
gagccgccaccgagtcttgaattgc

SEQ ID NO: 258215 - DNA, 25 bp, Mus musculus
ggaatcgattttagcgcatcgccga

SEQ ID NO: 258216 - DNA, 25 bp, Mus musculus
gcaccagtcggagagcgcctccgcc

SEQ ID NO: 258217 - DNA, 25 bp, Mus musculus
gcgccctgggcttcagcctccagcg

SEQ ID NO: 258218 - DNA, 25 bp, Mus musculus
ctctgaccgtgagtgctgccgagga

SEQ ID NO: 258219 - DNA, 25 bp, Mus musculus
tgaccgtgagtgctgccgaggagct

SEQ ID NO: 258220 - DNA, 25 bp, Mus musculus
ctgcagggagcgtctgccttggctt

SEQ ID NO: 258221 - DNA, 25 bp, Mus musculus
tgcagggagcgtctgccttggcttc

SEQ ID NO: 258222 - DNA, 25 bp, Mus musculus
actctgaccgtgagtgctgccgagg

SEQ ID NO: 258223 - DNA, 25 bp, Mus musculus
ccactctgaccgtgagtgctgccga

SEQ ID NO: 258224 - DNA, 25 bp, Mus musculus
gggccactctgaccgtgagtgctgc

SEQ ID NO: 258225 - DNA, 25 bp, Mus musculus
gtccgcctgacaccggggccactct

SEQ ID NO: 258226 - DNA, 25 bp, Mus musculus
ctgctggccgcaggcacccacaccc

SEQ ID NO: 258227 - DNA, 25 bp, Mus musculus
cgccacacctgctggccgcaggcac

SEQ ID NO: 258228 - DNA, 25 bp, Mus musculus
ggcttcagcctccagcgcgcaccag

SEQ ID NO: 258229 - DNA, 25 bp, Mus musculus
agcgcgcaccagtcggagagcgcct

SEQ ID NO: 258230 - DNA, 25 bp, Mus musculus
ctcttgcagcgagcacatggtcttg

SEQ ID NO: 258231 - DNA, 25 bp, Mus musculus
tggtacgcgccactctcttgcagcg

SEQ ID NO: 258232 - DNA, 25 bp, Mus musculus
tccatctgttccgaggctgggactt

SEQ ID NO: 258233 - DNA, 25 bp, Mus musculus
cttgctgagctggtactggcgaaaa

SEQ ID NO: 258234 - DNA, 25 bp, Mus musculus
ctgggacttccgagacctcctgatc

SEQ ID NO: 258235 - DNA, 25 bp, Mus musculus
gtgcacccagacagttggccacaga

SEQ ID NO: 258236 - DNA, 25 bp, Mus musculus
ttagcgatctgcaccgtaacgtccc

SEQ ID NO: 258237 - DNA, 25 bp, Mus musculus
taacgtcccggaaagccatcatgag

SEQ ID NO: 258238 - DNA, 25 bp, Mus musculus
cacatggtcttgaggctccaggtgc

SEQ ID NO: 258239 - DNA, 25 bp, Mus musculus
acctgctcggtaaaggagtcctcca

SEQ ID NO: 258240 - DNA, 25 bp, Mus musculus
tcaccttgcgcagtgagatccgccg

SEQ ID NO: 258241 - DNA, 25 bp, Mus musculus
tctccaggagcgagttacggatctt

SEQ ID NO: 258242 - DNA, 25 bp, Mus musculus
cggatcttctcaaagttcttgctga

SEQ ID NO: 258243 - DNA, 25 bp, Mus musculus
ccatcatgagggtaccgctgtgacc

SEQ ID NO: 258244 - DNA, 25 bp, Mus musculus
agcagcccagcagctctggcggtcg

SEQ ID NO: 258245 - DNA, 25 bp, Mus musculus
ctgaggagtctgaaccctgctgctg

SEQ ID NO: 258246 - DNA, 25 bp, Mus musculus
gtccgtggtcctgaagcggttcctg

SEQ ID NO: 258247 - DNA, 25 bp, Mus musculus
tgcagcaactgctggtgttcccaca

SEQ ID NO: 258248 - DNA, 25 bp, Mus musculus
tgttcccacaggctgcggttctccg

SEQ ID NO: 258249 - DNA, 25 bp, Mus musculus
gttctccgcgctcagctcgtctaga

SEQ ID NO: 258250 - DNA, 25 bp, Mus musculus
cgcggcagcacaacaactcgaggga

SEQ ID NO: 258251 - DNA, 25 bp, Mus musculus
atgaggctttgctggttctgcacga

SEQ ID NO: 258252 - DNA, 25 bp, Mus musculus
agctccttgaggtagagcacggcgc

SEQ ID NO: 258253 - DNA, 25 bp, Mus musculus
ggacgctccttctccttgtcagcta

SEQ ID NO: 258254 - DNA, 25 bp, Mus musculus
cacaggcattcgcacacgcactgag

SEQ ID NO: 258255 - DNA, 25 bp, Mus musculus
ccacctctgggcttcgtgaggaacc

SEQ ID NO: 258256 - DNA, 25 bp, Mus musculus
cagctcatcgatgcgctggcgctgg

SEQ ID NO: 258257 - DNA, 25 bp, Mus musculus
tgcacgatggccgtgagctccttga

SEQ ID NO: 258258 - DNA, 25 bp, Mus musculus
cggacgcgtcttccaacctcagaga

SEQ ID NO: 258259 - DNA, 25 bp, Mus musculus
actgatcttgacaatctccgagtga

SEQ ID NO: 258260 - DNA, 25 bp, Mus musculus
cctcattggtagaaaggcgacccga

SEQ ID NO: 258261 - DNA, 25 bp, Mus musculus
tcagcgtccaaaagagagaccaggg

SEQ ID NO: 258262 - DNA, 25 bp, Mus musculus
aaccaaggttctgcggtcacacgcc

SEQ ID NO: 258263 - DNA, 25 bp, Mus musculus
ttgctcagcaggctctcgctgcttc

SEQ ID NO: 258264 - DNA, 25 bp, Mus musculus
ctctgtactgaaggaggtgcggacc

SEQ ID NO: 258265 - DNA, 25 bp, Mus musculus
ctgcttcctgtttccggcttctgga

SEQ ID NO: 258266 - DNA, 25 bp, Mus musculus
agcgctggcttcagagaggaatcga

SEQ ID NO: 258267 - DNA, 25 bp, Mus musculus
gggtcctcgcacacctctgtactga

SEQ ID NO: 258268 - DNA, 25 bp, Mus musculus
ttttcccgtgacacgtgagtgttgg

SEQ ID NO: 258269 - DNA, 25 bp, Mus musculus
agcgaactaggctgctgaccaatca

SEQ ID NO: 258270 - DNA, 25 bp, Mus musculus
ccgcggttgctctgttttcccgtga

SEQ ID NO: 258271 - DNA, 25 bp, Mus musculus
aggcggagctcgaacctcattggta

SEQ ID NO: 258272 - DNA, 25 bp, Mus musculus
aatgagaagcggtcagaggcaacga

SEQ ID NO: 258273 - DNA, 25 bp, Mus musculus
cagcaccgagcacagcgagcgcaaa

SEQ ID NO: 258274 - DNA, 25 bp, Mus musculus
ggtggctgaggaaacatccccgcgc

SEQ ID NO: 258275 - DNA, 25 bp, Mus musculus
ggtacctgggcgttgcacacgccga

SEQ ID NO: 258276 - DNA, 25 bp, Mus musculus
aagcaccgcaaagcgcagcagagcg

SEQ ID NO: 258277 - DNA, 25 bp, Mus musculus
ggacgcgcagcacccaagcaccgca

SEQ ID NO: 258278 - DNA, 25 bp, Mus musculus
acagcgagcgcaaagcacgaagacc

SEQ ID NO: 258279 - DNA, 25 bp, Mus musculus
tgacggacagacagcaccgagcaca

SEQ ID NO: 258280 - DNA, 25 bp, Mus musculus
gcaacgaggtgacggacagacagca

SEQ ID NO: 258281 - DNA, 25 bp, Mus musculus
agcgcgagaagcagggagataacca

SEQ ID NO: 258282 - DNA, 25 bp, Mus musculus
cagggagataaccagacagcatgct

SEQ ID NO: 258283 - DNA, 25 bp, Mus musculus
acagcatgctcggatggaaggacca

SEQ ID NO: 258284 - DNA, 25 bp, Mus musculus
tgctcggatggaaggaccaaagtcg

SEQ ID NO: 258285 - DNA, 25 bp, Mus musculus
caaagcacgaagaccgggacgcgca

SEQ ID NO: 258286 - DNA, 25 bp, Mus musculus
ctgcggccgtgagcgctttgatgcc

SEQ ID NO: 258287 - DNA, 25 bp, Mus musculus
ccgtgagcgctttgatgcccgccga

SEQ ID NO: 258288 - DNA, 25 bp, Mus musculus
ccctgccgttgtgcgccctcccgcc

SEQ ID NO: 258289 - DNA, 25 bp, Mus musculus
agagtaggccctgccgttgtgcgcc

SEQ ID NO: 258290 - DNA, 25 bp, Mus musculus
caccgcgagagtaggccctgccgtt

SEQ ID NO: 258291 - DNA, 25 bp, Mus musculus
tgttccgctcggcaccgcgagagta

SEQ ID NO: 258292 - DNA, 25 bp, Mus musculus
ttccgctcggcaccgcgagagtagg

SEQ ID NO: 258293 - DNA, 25 bp, Mus musculus
aggtttgttccgctcggcaccgcga

SEQ ID NO: 258294 - DNA, 25 bp, Mus musculus
ggcgaggtttgttccgctcggcacc

SEQ ID NO: 258295 - DNA, 25 bp, Mus musculus
ctctcggagcctggaaaacgggtag

SEQ ID NO: 258296 - DNA, 25 bp, Mus musculus
gccgcgaggtctggccagggtactc

SEQ ID NO: 258297 - DNA, 25 bp, Mus musculus
gtgagcgctttgatgcccgccgacc

SEQ ID NO: 258298 - DNA, 25 bp, Mus musculus
gctcggcaccgcgagagtaggccct

SEQ ID NO: 258299 - DNA, 25 bp, Mus musculus
gtttgttccgctcggcaccgcgaga

SEQ ID NO: 258300 - DNA, 25 bp, Mus musculus
gagcagcaggttacgccagagtctg

SEQ ID NO: 258301 - DNA, 25 bp, Mus musculus
ggcaggcaccagaaagcccttattt

SEQ ID NO: 258302 - DNA, 25 bp, Mus musculus
ccgacgcacgcctaaatagcaagta

SEQ ID NO: 258303 - DNA, 25 bp, Mus musculus
atgtgcagggctgttcttttccgtc

SEQ ID NO: 258304 - DNA, 25 bp, Mus musculus
tcttttccgtcggtcgtcgatcgtg

SEQ ID NO: 258305 - DNA, 25 bp, Mus musculus
gcatgctcacacacatctgatcctt

SEQ ID NO: 258306 - DNA, 25 bp, Mus musculus
ttccttcttcctggtggtctgcagc

SEQ ID NO: 258307 - DNA, 25 bp, Mus musculus
accaagggaaggagcggaacactgc

SEQ ID NO: 258308 - DNA, 25 bp, Mus musculus
gaggcagatccaagcgactcaggga

SEQ ID NO: 258309 - DNA, 25 bp, Mus musculus
atccgaggcatctctgtggagcagc

SEQ ID NO: 258310 - DNA, 25 bp, Mus musculus
tgtccatctattttgccgcaggcca

SEQ ID NO: 258311 - DNA, 25 bp, Mus musculus
ccattcggcttcgtcgtgcagcaca

SEQ ID NO: 258312 - DNA, 25 bp, Mus musculus
gcagcacaccaggtcgctcacgttt

SEQ ID NO: 258313 - DNA, 25 bp, Mus musculus
gaaagtgcagttgtcaggaatccga

SEQ ID NO: 258314 - DNA, 25 bp, Mus musculus
tccacttacggcgaaagcaagggtc

SEQ ID NO: 258315 - DNA, 25 bp, Mus musculus
tgctgctttaagagatacggaaccc

SEQ ID NO: 258316 - DNA, 25 bp, Mus musculus
cccttaagagggagttgacattgct

SEQ ID NO: 258317 - DNA, 25 bp, Mus musculus
atcctccgtgcctcccttaagaggg

SEQ ID NO: 258318 - DNA, 25 bp, Mus musculus
tgtcagcgccctgaggcttcacgtc

SEQ ID NO: 258319 - DNA, 25 bp, Mus musculus
ccgaacgtgtcagcgccctgaggct

SEQ ID NO: 258320 - DNA, 25 bp, Mus musculus
caagggtcccttccagggcggcctg

SEQ ID NO: 258321 - DNA, 25 bp, Mus musculus
tgcacgctccacttacggcgaaagc

SEQ ID NO: 258322 - DNA, 25 bp, Mus musculus
aggaaaacgtgcccggcgctcgctt

SEQ ID NO: 258323 - DNA, 25 bp, Mus musculus
cgccagcccgctttccgttcggaag

SEQ ID NO: 258324 - DNA, 25 bp, Mus musculus
caccgccaccgtcgcagccgttagc

SEQ ID NO: 258325 - DNA, 25 bp, Mus musculus
ttccagggcggcctgtcgcctgcgt

SEQ ID NO: 258326 - DNA, 25 bp, Mus musculus
tggccaccaaccgatcaggcgtagt

SEQ ID NO: 258327 - DNA, 25 bp, Mus musculus
aaccgatcaggcgtagtctggggtc

SEQ ID NO: 258328 - DNA, 25 bp, Mus musculus
ggaagttacaactttgtacagtctg

SEQ ID NO: 258329 - DNA, 25 bp, Mus musculus
gctctcgtctccctagcgagcctcg

SEQ ID NO: 258330 - DNA, 25 bp, Mus musculus
gcctcgctctaaacgctcgctctcg

SEQ ID NO: 258331 - DNA, 25 bp, Mus musculus
ctgggcctccctgggtgtgcgactc

SEQ ID NO: 258332 - DNA, 25 bp, Mus musculus
gggaacagacccatcgctgggcctc

SEQ ID NO: 258333 - DNA, 25 bp, Mus musculus
ctcttaaggtgggaacagacccatc

SEQ ID NO: 258334 - DNA, 25 bp, Mus musculus
ctggcgccctcttaaggtgggaaca

SEQ ID NO: 258335 - DNA, 25 bp, Mus musculus
gggcgcggatctttccatccgccta

SEQ ID NO: 258336 - DNA, 25 bp, Mus musculus
gctcgcgggtctatctcggagcccg

SEQ ID NO: 258337 - DNA, 25 bp, Mus musculus
cctttgcagtggctcgcgggtctat

SEQ ID NO: 258338 - DNA, 25 bp, Mus musculus
gtctcagccgcctttgcagtggctc

SEQ ID NO: 258339 - DNA, 25 bp, Mus musculus
cgtccgggtctatctcggatccagt

SEQ ID NO: 258340 - DNA, 25 bp, Mus musculus
gccagcgtccgggtctatctcggat

SEQ ID NO: 258341 - DNA, 25 bp, Mus musculus
tgtacagtctgtgctgccagcgtcc

SEQ ID NO: 258342 - DNA, 25 bp, Mus musculus
actgggaatacttgtcttaggcgta

SEQ ID NO: 258343 - DNA, 25 bp, Mus musculus
gccctataaccctttataagctgtc

SEQ ID NO: 258344 - DNA, 25 bp, Mus musculus
ccctttataagctgtctggaagaga

SEQ ID NO: 258345 - DNA, 25 bp, Mus musculus
taagctgtctggaagagaaagagag

SEQ ID NO: 258346 - DNA, 25 bp, Mus musculus
gaggagccatcaaatgcgtttctga

SEQ ID NO: 258347 - DNA, 25 bp, Mus musculus
tgagaaaactgggaatacttgtctt

SEQ ID NO: 258348 - DNA, 25 bp, Mus musculus
cttaggcgtagaccacagcacaatg

SEQ ID NO: 258349 - DNA, 25 bp, Mus musculus
gtagaccacagcacaatgagaggtg

SEQ ID NO: 258350 - DNA, 25 bp, Mus musculus
caatgagaggtgtgtgtggccctta

SEQ ID NO: 258351 - DNA, 25 bp, Mus musculus
ccaccctcgggacaccctgtgccgg

SEQ ID NO: 258352 - DNA, 25 bp, Mus musculus
cccgaccggtcggagcctcagaggt

SEQ ID NO: 258353 - DNA, 25 bp, Mus musculus
ggcccttagcgtggacgctggcatc

SEQ ID NO: 258354 - DNA, 25 bp, Mus musculus
tagcgtggacgctggcatcgccagt

SEQ ID NO: 258355 - DNA, 25 bp, Mus musculus
gccatcaaatgcgtttctgagaaaa

SEQ ID NO: 258356 - DNA, 25 bp, Mus musculus
ccagggctcacgagtgtcttaaatg

SEQ ID NO: 258357 - DNA, 25 bp, Mus musculus
caagcgcacttcacaggccggtgga

SEQ ID NO: 258358 - DNA, 25 bp, Mus musculus
ttggcgtcacacaggtttaaagatc

SEQ ID NO: 258359 - DNA, 25 bp, Mus musculus
agatcgcaggcacttttctcctttg

SEQ ID NO: 258360 - DNA, 25 bp, Mus musculus
tttctcctttgttccggcgtcagtg

SEQ ID NO: 258361 - DNA, 25 bp, Mus musculus
cggcgtcagtgttctttggatgtca

SEQ ID NO: 258362 - DNA, 25 bp, Mus musculus
cgcgtcggaattttggcgtcacaca

SEQ ID NO: 258363 - DNA, 25 bp, Mus musculus
cttcggtcgatttcaccagggctca

SEQ ID NO: 258364 - DNA, 25 bp, Mus musculus
ggtgttcattgaagtccaggtgccc

SEQ ID NO: 258365 - DNA, 25 bp, Mus musculus
tgggctctgaaagggagaattttgc

SEQ ID NO: 258366 - DNA, 25 bp, Mus musculus
ttgcacactcggacacgccagtttg

SEQ ID NO: 258367 - DNA, 25 bp, Mus musculus
cagtttggactcttgcgcatgtgca

SEQ ID NO: 258368 - DNA, 25 bp, Mus musculus
tgcgtggcgtcttcagaatgtccgc

SEQ ID NO: 258369 - DNA, 25 bp, Mus musculus
gtcaacatctctaggcttcggtcga

SEQ ID NO: 258370 - DNA, 25 bp, Mus musculus
ggcgcatcagcgtttccagattgta

SEQ ID NO: 258371 - DNA, 25 bp, Mus musculus
tgctgcgacctttggcttgtaatcc

SEQ ID NO: 258372 - DNA, 25 bp, Mus musculus
ccattcatgcctgctccatctgtta

SEQ ID NO: 258373 - DNA, 25 bp, Mus musculus
ttcttcctgccgtcatgcgtctttc

SEQ ID NO: 258374 - DNA, 25 bp, Mus musculus
ctgttttgctggaactctgattttg

SEQ ID NO: 258375 - DNA, 25 bp, Mus musculus
cggctccgtctacttttctgttttg

SEQ ID NO: 258376 - DNA, 25 bp, Mus musculus
gtgtgaagcccgacgtcagcgtcta

SEQ ID NO: 258377 - DNA, 25 bp, Mus musculus
cggcagagctggaatatgagtccgt

SEQ ID NO: 258378 - DNA, 25 bp, Mus musculus
tgtaacaggttttgcgccgcctaga

SEQ ID NO: 258379 - DNA, 25 bp, Mus musculus
cgttactcaagatggcgagccaggc

SEQ ID NO: 258380 - DNA, 25 bp, Mus musculus
ggcttgtaatcctccacgcgcgcgt

SEQ ID NO: 258381 - DNA, 25 bp, Mus musculus
cgtagttagcctgccacccgggctg

SEQ ID NO: 258382 - DNA, 25 bp, Mus musculus
ctcgaagctgtacccgagcggaagt

SEQ ID NO: 258383 - DNA, 25 bp, Mus musculus
atgagtccgtgctgtgtgtgaagcc

SEQ ID NO: 258384 - DNA, 25 bp, Mus musculus
tcacgaagcgggctgccttcatcct

SEQ ID NO: 258385 - DNA, 25 bp, Mus musculus
cgcccacctaggctggcggtggtta

SEQ ID NO: 258386 - DNA, 25 bp, Mus musculus
tggttaggatccgtagggttggcga

SEQ ID NO: 258387 - DNA, 25 bp, Mus musculus
caagtgcgttgtggtcccagggtcc

SEQ ID NO: 258388 - DNA, 25 bp, Mus musculus
tggcgctgctcagcgagctggcgct

SEQ ID NO: 258389 - DNA, 25 bp, Mus musculus
gcgcatcacgaagcgggctgccttc

SEQ ID NO: 258390 - DNA, 25 bp, Mus musculus
tgccttcatcctgacgcccacctag

SEQ ID NO: 258391 - DNA, 25 bp, Mus musculus
gtcgcccgcctctcaccaaagtcca

SEQ ID NO: 258392 - DNA, 25 bp, Mus musculus
gcctctcaccaaagtccagcagctg

SEQ ID NO: 258393 - DNA, 25 bp, Mus musculus
ccagcagctgcttcatggacagcgg

SEQ ID NO: 258394 - DNA, 25 bp, Mus musculus
cagctgcttcatggacagcggggac

SEQ ID NO: 258395 - DNA, 25 bp, Mus musculus
ctgtagcgggagaacagctcgacct

SEQ ID NO: 258396 - DNA, 25 bp, Mus musculus
gagaacagctcgacctccctgggga

SEQ ID NO: 258397 - DNA, 25 bp, Mus musculus
cgctgcgcatcacgaagcgggctgc

SEQ ID NO: 258398 - DNA, 25 bp, Mus musculus
tgaataacaaatactcccaccggcg

SEQ ID NO: 258399 - DNA, 25 bp, Mus musculus
gcaccacggcgcagtgagctcggct

SEQ ID NO: 258400 - DNA, 25 bp, Mus musculus
taagggaaccgcaccacggcgcagt

SEQ ID NO: 258401 - DNA, 25 bp, Mus musculus
aagtctgaatcaactccgagttctg

SEQ ID NO: 258402 - DNA, 25 bp, Mus musculus
cccttcacattcaagtctgaatcaa

SEQ ID NO: 258403 - DNA, 25 bp, Mus musculus
agtgagctcggctgccgctgacgac

SEQ ID NO: 258404 - DNA, 25 bp, Mus musculus
gcccgggatcaccaatcgcttcgca

SEQ ID NO: 258405 - DNA, 25 bp, Mus musculus
gcgagtctcttccatgtgaataaca

SEQ ID NO: 258406 - DNA, 25 bp, Mus musculus
agccaccggcgagtctcttccatgt

SEQ ID NO: 258407 - DNA, 25 bp, Mus musculus
cacttgtggctggtctccgggctga

SEQ ID NO: 258408 - DNA, 25 bp, Mus musculus
ccacggccgcacttgtggctggtct

SEQ ID NO: 258409 - DNA, 25 bp, Mus musculus
aggcgagcaccacggccgcacttgt

SEQ ID NO: 258410 - DNA, 25 bp, Mus musculus
gccaccgagagaggcgagcaccacg

SEQ ID NO: 258411 - DNA, 25 bp, Mus musculus
ggggacccgcagctccatatcagcg

SEQ ID NO: 258412 - DNA, 25 bp, Mus musculus
gcgctgcggcccagctcaacggaaa

SEQ ID NO: 258413 - DNA, 25 bp, Mus musculus
tgcgggtcccgatcccagctcgtgt

SEQ ID NO: 258414 - DNA, 25 bp, Mus musculus
tcaggcgccagctgcgggtcccgat

SEQ ID NO: 258415 - DNA, 25 bp, Mus musculus
gcgcatcataaacacggctagaccc

SEQ ID NO: 258416 - DNA, 25 bp, Mus musculus
cagcggggacgccttccaccgtaca

SEQ ID NO: 258417 - DNA, 25 bp, Mus musculus
ctctaacctgacgagggacagcggg

SEQ ID NO: 258418 - DNA, 25 bp, Mus musculus
aggctccaatgctcgccgtcgcggg

SEQ ID NO: 258419 - DNA, 25 bp, Mus musculus
cggctagacccgaactctaacctga

SEQ ID NO: 258420 - DNA, 25 bp, Mus musculus
cagctctacaaaagggcctggaccc

SEQ ID NO: 258421 - DNA, 25 bp, Mus musculus
ccaacagcagctctacaaaagggcc

SEQ ID NO: 258422 - DNA, 25 bp, Mus musculus
agcggacggcagctcagacaccacc

SEQ ID NO: 258423 - DNA, 25 bp, Mus musculus
tgcggcccagctcaacggaaacggg

SEQ ID NO: 258424 - DNA, 25 bp, Mus musculus
ccgaactctaacctgacgagggaca

SEQ ID NO: 258425 - DNA, 25 bp, Mus musculus
gcacggggagcgcatcataaacacg

SEQ ID NO: 258426 - DNA, 25 bp, Mus musculus
caataatcgggtgggtctagaggct

SEQ ID NO: 258427 - DNA, 25 bp, Mus musculus
tcgagtcccagtacttgaacaaccg

SEQ ID NO: 258428 - DNA, 25 bp, Mus musculus
ccttaacaagttggcgacgtctctg

SEQ ID NO: 258429 - DNA, 25 bp, Mus musculus
gacctgcatcgggaagagctacgta

SEQ ID NO: 258430 - DNA, 25 bp, Mus musculus
agctacgtagcattaaagggtgttc

SEQ ID NO: 258431 - DNA, 25 bp, Mus musculus
agcagacattcgctccgctccgtta

SEQ ID NO: 258432 - DNA, 25 bp, Mus musculus
ccgagagtaacctcgcggtctggtg

SEQ ID NO: 258433 - DNA, 25 bp, Mus musculus
ctgtctcaaccaatgggaaggcagc

SEQ ID NO: 258434 - DNA, 25 bp, Mus musculus
ccgtccggaccgagttgtactgtca

SEQ ID NO: 258435 - DNA, 25 bp, Mus musculus
tgaacaaccgaaaaggacctgcatc

SEQ ID NO: 258436 - DNA, 25 bp, Mus musculus
cccggctggctcgaccaataatcgg

SEQ ID NO: 258437 - DNA, 25 bp, Mus musculus
gcccgcagttaagatggcgtctaca

SEQ ID NO: 258438 - DNA, 25 bp, Mus musculus
ggtgtcgaggatctgagccttaaca

SEQ ID NO: 258439 - DNA, 25 bp, Mus musculus
cacgggagtcacctttgccttacaa

SEQ ID NO: 258440 - DNA, 25 bp, Mus musculus
caccactggccgcagacatcttgta

SEQ ID NO: 258441 - DNA, 25 bp, Mus musculus
ttcacttcaggtaatggcgggcaga

SEQ ID NO: 258442 - DNA, 25 bp, Mus musculus
gttgcaccgaagtccttaagttaga

SEQ ID NO: 258443 - DNA, 25 bp, Mus musculus
tagaacttcacgtccgtcctcacgg

SEQ ID NO: 258444 - DNA, 25 bp, Mus musculus
gccaacttccttcgagctgccattt

SEQ ID NO: 258445 - DNA, 25 bp, Mus musculus
ggacttccggatgcgccattcctgt

SEQ ID NO: 258446 - DNA, 25 bp, Mus musculus
gcgctcgaaaatggcgatgcccgta

SEQ ID NO: 258447 - DNA, 25 bp, Mus musculus
catggcccagaacttgaaggactta

SEQ ID NO: 258448 - DNA, 25 bp, Mus musculus
tccgcgaatccgtgttcaccggtga

SEQ ID NO: 258449 - DNA, 25 bp, Mus musculus
ggcggtcatagagccatctttttta

SEQ ID NO: 258450 - DNA, 25 bp, Mus musculus
tttaatcgtattggtggcgtgcagc

SEQ ID NO: 258451 - DNA, 25 bp, Mus musculus
cgatcctggccgaaggccttcactt

SEQ ID NO: 258452 - DNA, 25 bp, Mus musculus
ccgctcacgaggttggaagccacca

SEQ ID NO: 258453 - DNA, 25 bp, Mus musculus
cgccgccttcgggaggatcagacat

SEQ ID NO: 258454 - DNA, 25 bp, Mus musculus
caacccttcgccctaatgggcaagg

SEQ ID NO: 258455 - DNA, 25 bp, Mus musculus
tcgtccatgcgcacggcattctctg

SEQ ID NO: 258456 - DNA, 25 bp, Mus musculus
tctctggggccgagaacgcttgaat

SEQ ID NO: 258457 - DNA, 25 bp, Mus musculus
aacgcttgaatcacctccgccagga

SEQ ID NO: 258458 - DNA, 25 bp, Mus musculus
ggcctgcaagcaacccgataagctt

SEQ ID NO: 258459 - DNA, 25 bp, Mus musculus
gttgcacgcattgtctctagcctcg

SEQ ID NO: 258460 - DNA, 25 bp, Mus musculus
cccacttggagaggcaaagaatagt

SEQ ID NO: 258461 - DNA, 25 bp, Mus musculus
gcaaagaatagtatcgcgccctccc

SEQ ID NO: 258462 - DNA, 25 bp, Mus musculus
gactaggctctttcctcacccttgg

SEQ ID NO: 258463 - DNA, 25 bp, Mus musculus
ggacgccatagaacgccactcggtg

SEQ ID NO: 258464 - DNA, 25 bp, Mus musculus
tcggtgcttgagtagtgggaacaca

SEQ ID NO: 258465 - DNA, 25 bp, Mus musculus
cacagaagagatccggagaaccctg

SEQ ID NO: 258466 - DNA, 25 bp, Mus musculus
gcggaagtctcagagcgtggctcta

SEQ ID NO: 258467 - DNA, 25 bp, Mus musculus
aggaccactgcgagacggaagcatc

SEQ ID NO: 258468 - DNA, 25 bp, Mus musculus
tcccgtccaccaggtggcggagcga

SEQ ID NO: 258469 - DNA, 25 bp, Mus musculus
gcggaggcagagatgacaaacttga

SEQ ID NO: 258470 - DNA, 25 bp, Mus musculus
tgtgagcctcaaaggcagccagtcc

SEQ ID NO: 258471 - DNA, 25 bp, Mus musculus
ccgccggctcctgtttgatctgcgt

SEQ ID NO: 258472 - DNA, 25 bp, Mus musculus
aggcgcggcgcaccttgtgacgcac

SEQ ID NO: 258473 - DNA, 25 bp, Mus musculus
gaggttcatactcttccgccggctc

SEQ ID NO: 258474 - DNA, 25 bp, Mus musculus
ccggactctcgggaggttcatactc

SEQ ID NO: 258475 - DNA, 25 bp, Mus musculus
ctgggcacgtccaccaccttgggag

SEQ ID NO: 258476 - DNA, 25 bp, Mus musculus
gtttgtcgctcgctaatcccggcag

SEQ ID NO: 258477 - DNA, 25 bp, Mus musculus
ctccagcggcacgaagtacaggtcg

SEQ ID NO: 258478 - DNA, 25 bp, Mus musculus
agccgcggtccaagtgcttattgaa

SEQ ID NO: 258479 - DNA, 25 bp, Mus musculus
agtgcttattgaacctgccgggcgg

SEQ ID NO: 258480 - DNA, 25 bp, Mus musculus
cgcggacctgtgagcctcaaaggca

SEQ ID NO: 258481 - DNA, 25 bp, Mus musculus
ccgcgcgcttcttggccagcttgga

SEQ ID NO: 258482 - DNA, 25 bp, Mus musculus
gaaaataacaaatggaggcggcggc

SEQ ID NO: 258483 - DNA, 25 bp, Mus musculus
gcaatgagggaacgcgaccgggaaa

SEQ ID NO: 258484 - DNA, 25 bp, Mus musculus
gctgccatctctccgatccgtcctg

SEQ ID NO: 258485 - DNA, 25 bp, Mus musculus
gatccgtcctgccttctccgcgaac

SEQ ID NO: 258486 - DNA, 25 bp, Mus musculus
ctccgcgaaccacccgcacagcatc

SEQ ID NO: 258487 - DNA, 25 bp, Mus musculus
ttacctccgccaagtctccacctcg

SEQ ID NO: 258488 - DNA, 25 bp, Mus musculus
caagtctccacctcggcgttcctcc

SEQ ID NO: 258489 - DNA, 25 bp, Mus musculus
tcctcccctttaggctctggtcctg

SEQ ID NO: 258490 - DNA, 25 bp, Mus musculus
cacctcccgagctcgcgactcccag

SEQ ID NO: 258491 - DNA, 25 bp, Mus musculus
gagctcgcgactcccaggcccgcgt

SEQ ID NO: 258492 - DNA, 25 bp, Mus musculus
gcctcgggcccggtcgtgcccgcaa

SEQ ID NO: 258493 - DNA, 25 bp, Mus musculus
tcgtgcccgcaatgagggaacgcga

SEQ ID NO: 258494 - DNA, 25 bp, Mus musculus
tgcccgcaatgagggaacgcgaccg

SEQ ID NO: 258495 - DNA, 25 bp, Mus musculus
ccacctcgctgccatctctccgatc

SEQ ID NO: 258496 - DNA, 25 bp, Mus musculus
taagcccaggacaacggggagtgga

SEQ ID NO: 258497 - DNA, 25 bp, Mus musculus
tgagtcaagagctgcaggcggagac

SEQ ID NO: 258498 - DNA, 25 bp, Mus musculus
cccgatgagtcaagagctgcaggcg

SEQ ID NO: 258499 - DNA, 25 bp, Mus musculus
atagagccgggagggcgcatgtgac

SEQ ID NO: 258500 - DNA, 25 bp, Mus musculus
actgcagactcagtcggtggcgttg

SEQ ID NO: 258501 - DNA, 25 bp, Mus musculus
tcgaggactgcagactcagtcggtg

SEQ ID NO: 258502 - DNA, 25 bp, Mus musculus
ctcacctcgaggactgcagactcag

SEQ ID NO: 258503 - DNA, 25 bp, Mus musculus
cgatacgggcctcacctcgaggact

SEQ ID NO: 258504 - DNA, 25 bp, Mus musculus
aaggagcgagtaaggggatgcggcc

SEQ ID NO: 258505 - DNA, 25 bp, Mus musculus
cgcccgggtcgctaagcccaggaca

SEQ ID NO: 258506 - DNA, 25 bp, Mus musculus
caggcggagacgcatgtacgagcgc

SEQ ID NO: 258507 - DNA, 25 bp, Mus musculus
acctcgaggactgcagactcagtcg

SEQ ID NO: 258508 - DNA, 25 bp, Mus musculus
ggatgcggcccgatacgggcctcac

SEQ ID NO: 258509 - DNA, 25 bp, Mus musculus
gggcctcacctcgaggactgcagac

SEQ ID NO: 258510 - DNA, 25 bp, Mus musculus
gacagccacgtcttcaccacggtga

SEQ ID NO: 258511 - DNA, 25 bp, Mus musculus
gagtgcagggttctgagatccaccc

SEQ ID NO: 258512 - DNA, 25 bp, Mus musculus
cccgatccgacaggcctactaaggg

SEQ ID NO: 258513 - DNA, 25 bp, Mus musculus
caggcctactaaggggacggactag

SEQ ID NO: 258514 - DNA, 25 bp, Mus musculus
gtggagggtccctcagcgccctgac

SEQ ID NO: 258515 - DNA, 25 bp, Mus musculus
agtactgccttcctcggggtcagcg

SEQ ID NO: 258516 - DNA, 25 bp, Mus musculus
tcagcgcgcagcgaaggactgcgcc

SEQ ID NO: 258517 - DNA, 25 bp, Mus musculus
tggagacctggctctctagctggga

SEQ ID NO: 258518 - DNA, 25 bp, Mus musculus
ctgggacgcatctacgtcgctgatt

SEQ ID NO: 258519 - DNA, 25 bp, Mus musculus
cgtcgctgattggtgtggttctttt

SEQ ID NO: 258520 - DNA, 25 bp, Mus musculus
tggttcttttgatggatggtctctg

SEQ ID NO: 258521 - DNA, 25 bp, Mus musculus
ggtctctgaggaagctcggccaatc

SEQ ID NO: 258522 - DNA, 25 bp, Mus musculus
tcccgttgtccagacttcaattctc

SEQ ID NO: 258523 - DNA, 25 bp, Mus musculus
tctaggcgcagactagcccgggctt

SEQ ID NO: 258524 - DNA, 25 bp, Mus musculus
tcgttgccttggttacgggactagc

SEQ ID NO: 258525 - DNA, 25 bp, Mus musculus
cccgagtggcggaccactaggactg

SEQ ID NO: 258526 - DNA, 25 bp, Mus musculus
accactaggactggctgaggattca

SEQ ID NO: 258527 - DNA, 25 bp, Mus musculus
ctgaggattcagcagctacacagtc

SEQ ID NO: 258528 - DNA, 25 bp, Mus musculus
ttcagcagctacacagtcgcggtgg

SEQ ID NO: 258529 - DNA, 25 bp, Mus musculus
cagctacacagtcgcggtggggcat

SEQ ID NO: 258530 - DNA, 25 bp, Mus musculus
agcgcacactatgagcccacgcgtg

SEQ ID NO: 258531 - DNA, 25 bp, Mus musculus
actatgagcccacgcgtgaccgtca

SEQ ID NO: 258532 - DNA, 25 bp, Mus musculus
acgcgtgaccgtcagcctgcatgag

SEQ ID NO: 258533 - DNA, 25 bp, Mus musculus
gtcagcctgcatgagtcagcttccc

SEQ ID NO: 258534 - DNA, 25 bp, Mus musculus
cccgacccagctagtgcgttcgttg

SEQ ID NO: 258535 - DNA, 25 bp, Mus musculus
tagtgcgttcgttgccttggttacg

SEQ ID NO: 258536 - DNA, 25 bp, Mus musculus
ttacgggactagctccaagggtgtg

SEQ ID NO: 258537 - DNA, 25 bp, Mus musculus
gcccgaagcacaaactgcgagggga

SEQ ID NO: 258538 - DNA, 25 bp, Mus musculus
tcccgccttggggacacggatcgtc

SEQ ID NO: 258539 - DNA, 25 bp, Mus musculus
agcgccgcgggtacaactgatggcc

SEQ ID NO: 258540 - DNA, 25 bp, Mus musculus
cgaataccaataaaaagcgccgcgg

SEQ ID NO: 258541 - DNA, 25 bp, Mus musculus
cgagatcggcagttggacccagcct

SEQ ID NO: 258542 - DNA, 25 bp, Mus musculus
ctaaaggcaagacgcgcgagatcgg

SEQ ID NO: 258543 - DNA, 25 bp, Mus musculus
tgtgcgcatgcgctaaaggcaagac

SEQ ID NO: 258544 - DNA, 25 bp, Mus musculus
gcgactcagtgtgcgcatgcgctaa

SEQ ID NO: 258545 - DNA, 25 bp, Mus musculus
tcgcatccaatgagcgcgactcagt

SEQ ID NO: 258546 - DNA, 25 bp, Mus musculus
acagcagctcccactgtacctagta

SEQ ID NO: 258547 - DNA, 25 bp, Mus musculus
ggacacggatcgtcggtaacactga

SEQ ID NO: 258548 - DNA, 25 bp, Mus musculus
agcgcactcgtctttatggacccgg

SEQ ID NO: 258549 - DNA, 25 bp, Mus musculus
tgtcgaaagagaaagcgcactcgtc

SEQ ID NO: 258550 - DNA, 25 bp, Mus musculus
gcttaccggcgtgtcgaaagagaaa

SEQ ID NO: 258551 - DNA, 25 bp, Mus musculus
ggtaacactgacagcagcgcctctt

SEQ ID NO: 258552 - DNA, 25 bp, Mus musculus
ctgcaggtagttgtaaggctcccgc

SEQ ID NO: 258553 - DNA, 25 bp, Mus musculus
catcgcaagtcctggccacgtttca

SEQ ID NO: 258554 - DNA, 25 bp, Mus musculus
tggccacgtttcaatggtacccaca

SEQ ID NO: 258555 - DNA, 25 bp, Mus musculus
tggtacccacacaagagtagaactc

SEQ ID NO: 258556 - DNA, 25 bp, Mus musculus
gagtagaactccgttatccgccctc

SEQ ID NO: 258557 - DNA, 25 bp, Mus musculus
tcagctcccagtaagacagtcagta

SEQ ID NO: 258558 - DNA, 25 bp, Mus musculus
cagtcagtaggcttggggtagcacc

SEQ ID NO: 258559 - DNA, 25 bp, Mus musculus
gcacctggtagtaggccctctgcag

SEQ ID NO: 258560 - DNA, 25 bp, Mus musculus
agtaggctcgcagcccgtccgcgta

SEQ ID NO: 258561 - DNA, 25 bp, Mus musculus
agcccgtccgcgtagagcaagtcgg

SEQ ID NO: 258562 - DNA, 25 bp, Mus musculus
ccggtgacaactgagccaggcccgg

SEQ ID NO: 258563 - DNA, 25 bp, Mus musculus
agcagcaaaagcaacaaccgcagga

SEQ ID NO: 258564 - DNA, 25 bp, Mus musculus
aagcaacaaccgcaggagccggagc

SEQ ID NO: 258565 - DNA, 25 bp, Mus musculus
catggtgccagagtcgcgggcccac

SEQ ID NO: 258566 - DNA, 25 bp, Mus musculus
ctgaagaaacgcatcgcacggagca

SEQ ID NO: 258567 - DNA, 25 bp, Mus musculus
taaagaagccggggattttgcaggc

SEQ ID NO: 258568 - DNA, 25 bp, Mus musculus
gcgggctgaagaaacgcatcgcacg

SEQ ID NO: 258569 - DNA, 25 bp, Mus musculus
catcgcacggagcaaggagtggccc

SEQ ID NO: 258570 - DNA, 25 bp, Mus musculus
gaggcgctccgaccagcgacgacga

SEQ ID NO: 258571 - DNA, 25 bp, Mus musculus
ggatgcagacgacctgggcgcccga

SEQ ID NO: 258572 - DNA, 25 bp, Mus musculus
ggcttcgccaggcttcggcccgcac

SEQ ID NO: 258573 - DNA, 25 bp, Mus musculus
cacgggcgcagcgaaccccagggaa

SEQ ID NO: 258574 - DNA, 25 bp, Mus musculus
gaaagacaaagacacgccggttagc

SEQ ID NO: 258575 - DNA, 25 bp, Mus musculus
aagacacgccggttagcaacgggcg

SEQ ID NO: 258576 - DNA, 25 bp, Mus musculus
acccttcaggtaaagctgcgcccag

SEQ ID NO: 258577 - DNA, 25 bp, Mus musculus
ttcaggtaaagctgcgcccaggagc

SEQ ID NO: 258578 - DNA, 25 bp, Mus musculus
tgtgcggtgaggtttttaaagaagc

SEQ ID NO: 258579 - DNA, 25 bp, Mus musculus
cgagctgaggcgctccgaccagcga

SEQ ID NO: 258580 - DNA, 25 bp, Mus musculus
cgaggccgatcttggagactatgaa

SEQ ID NO: 258581 - DNA, 25 bp, Mus musculus
agttaacgggccatcgcaccatcca

SEQ ID NO: 258582 - DNA, 25 bp, Mus musculus
aggcggtagttaacgggccatcgca

SEQ ID NO: 258583 - DNA, 25 bp, Mus musculus
atccagatgcccatgacggcatgca

SEQ ID NO: 258584 - DNA, 25 bp, Mus musculus
gatgaagctgaccatccagatgccc

SEQ ID NO: 258585 - DNA, 25 bp, Mus musculus
cgtggagaggatgaagctgaccatc

SEQ ID NO: 258586 - DNA, 25 bp, Mus musculus
ccccgttgttgtgccagccgatgga

SEQ ID NO: 258587 - DNA, 25 bp, Mus musculus
catagtagcgctccccgttgttgtg

SEQ ID NO: 258588 - DNA, 25 bp, Mus musculus
gcagcctcgggcatagtagcgctcc

SEQ ID NO: 258589 - DNA, 25 bp, Mus musculus
aactggcagcctcgggcatagtagc

SEQ ID NO: 258590 - DNA, 25 bp, Mus musculus
ctatgaactggcagcctcgggcata

SEQ ID NO: 258591 - DNA, 25 bp, Mus musculus
ttggagactatgaactggcagcctc

SEQ ID NO: 258592 - DNA, 25 bp, Mus musculus
tccacatgcgatggtaggagagcga

SEQ ID NO: 258593 - DNA, 25 bp, Mus musculus
cgatcttggagactatgaactggca

SEQ ID NO: 258594 - DNA, 25 bp, Mus musculus
tctcccagggtcatcagcctgcgag

SEQ ID NO: 258595 - DNA, 25 bp, Mus musculus
tgtctcccagggtcatcagcctgcg

SEQ ID NO: 258596 - DNA, 25 bp, Mus musculus
gcgcgctagtttgcggcccctcgag

SEQ ID NO: 258597 - DNA, 25 bp, Mus musculus
ggctcagcccgcggcgcgctagttt

SEQ ID NO: 258598 - DNA, 25 bp, Mus musculus
tgccggctccagctcgccagccctc

SEQ ID NO: 258599 - DNA, 25 bp, Mus musculus
gcactcccgacgaggctcgcccggg

SEQ ID NO: 258600 - DNA, 25 bp, Mus musculus
aggagacgcactcccgacgaggctc

SEQ ID NO: 258601 - DNA, 25 bp, Mus musculus
tcctgctctgccgaggagacgcact

SEQ ID NO: 258602 - DNA, 25 bp, Mus musculus
ctgcgtcctgctctgccgaggagac

SEQ ID NO: 258603 - DNA, 25 bp, Mus musculus
ttacctctggctgcgtcctgctctg

SEQ ID NO: 258604 - DNA, 25 bp, Mus musculus
caggggtccacttacctctggctgc

SEQ ID NO: 258605 - DNA, 25 bp, Mus musculus
ccgggcaggggtccacttacctctg

SEQ ID NO: 258606 - DNA, 25 bp, Mus musculus
gttagggagccgctgaccagtcttg

SEQ ID NO: 258607 - DNA, 25 bp, Mus musculus
agccgctgaccagtcttggggtcgg

SEQ ID NO: 258608 - DNA, 25 bp, Mus musculus
tactcgaggcctggccgacgcgcag

SEQ ID NO: 258609 - DNA, 25 bp, Mus musculus
tagcgaccgggtgcgggttgtctag

SEQ ID NO: 258610 - DNA, 25 bp, Mus musculus
tcagcaccgtgtagcgaccgggtgc

SEQ ID NO: 258611 - DNA, 25 bp, Mus musculus
acgctcagcaccgtgtagcgaccgg

SEQ ID NO: 258612 - DNA, 25 bp, Mus musculus
aggcctcctggagccacgctcagca

SEQ ID NO: 258613 - DNA, 25 bp, Mus musculus
cgctgcgcaggcctcctggagccac

SEQ ID NO: 258614 - DNA, 25 bp, Mus musculus
tgcaggggctgcctcccgctgcgca

SEQ ID NO: 258615 - DNA, 25 bp, Mus musculus
cctccagctgcacgtggggatgcag

SEQ ID NO: 258616 - DNA, 25 bp, Mus musculus
cgctcctccagctgcacgtggggat

SEQ ID NO: 258617 - DNA, 25 bp, Mus musculus
accacagagagaagtccccgcgctg

SEQ ID NO: 258618 - DNA, 25 bp, Mus musculus
agagctgggcgcaaccacagagaga

SEQ ID NO: 258619 - DNA, 25 bp, Mus musculus
tcgcccgcatcggtgcgcagagctg

SEQ ID NO: 258620 - DNA, 25 bp, Mus musculus
gtactcgcccgcatcggtgcgcaga

SEQ ID NO: 258621 - DNA, 25 bp, Mus musculus
tggcgtggtactcgcccgcatcggt

SEQ ID NO: 258622 - DNA, 25 bp, Mus musculus
cgctcggcaagctggctcgctgcaa

SEQ ID NO: 258623 - DNA, 25 bp, Mus musculus
ccgcttttaaggcggcgctgcccga

SEQ ID NO: 258624 - DNA, 25 bp, Mus musculus
gaacccgcttttaaggcggcgctgc

SEQ ID NO: 258625 - DNA, 25 bp, Mus musculus
accagcagagctgccgccgaccagc

SEQ ID NO: 258626 - DNA, 25 bp, Mus musculus
cccgcaccagcagagctgccgccga

SEQ ID NO: 258627 - DNA, 25 bp, Mus musculus
gtcgcggtcgctcggtcttgctcgc

SEQ ID NO: 258628 - DNA, 25 bp, Mus musculus
tcggcaagctggctcgctgcaagag

SEQ ID NO: 258629 - DNA, 25 bp, Mus musculus
ccgcggccggaacttggcgcggtgg

SEQ ID NO: 258630 - DNA, 25 bp, Mus musculus
cttctccgacatggtgccggggccg

SEQ ID NO: 258631 - DNA, 25 bp, Mus musculus
ctcttctccgacatggtgccggggc

SEQ ID NO: 258632 - DNA, 25 bp, Mus musculus
ccgctgcctccacgctcttctccga

SEQ ID NO: 258633 - DNA, 25 bp, Mus musculus
accttggcactcagctcggccgctg

SEQ ID NO: 258634 - DNA, 25 bp, Mus musculus
tgcccgtaccttggcactcagctcg

SEQ ID NO: 258635 - DNA, 25 bp, Mus musculus
ctcgctgcaagaggcggcagaggcg

SEQ ID NO: 258636 - DNA, 25 bp, Mus musculus
agaagctgccgcgcggaccaatcct

SEQ ID NO: 258637 - DNA, 25 bp, Mus musculus
gcgtctctccagagggacaggccca

SEQ ID NO: 258638 - DNA, 25 bp, Mus musculus
ccctcctgcagtgtgtttaaaggtc

SEQ ID NO: 258639 - DNA, 25 bp, Mus musculus
cgcaaaaaaggtgcggcacaccctg

SEQ ID NO: 258640 - DNA, 25 bp, Mus musculus
cgagccagcttaatgacacctccca

SEQ ID NO: 258641 - DNA, 25 bp, Mus musculus
gacgtcacttccgttcgggcctgac

SEQ ID NO: 258642 - DNA, 25 bp, Mus musculus
cgggcctgaccgaagatcggcttct

SEQ ID NO: 258643 - DNA, 25 bp, Mus musculus
accgaagatcggcttctcgggccga

SEQ ID NO: 258644 - DNA, 25 bp, Mus musculus
cgatcccgggagtggaccttcctct

SEQ ID NO: 258645 - DNA, 25 bp, Mus musculus
cccagtgccagcagaaggcggagta

SEQ ID NO: 258646 - DNA, 25 bp, Mus musculus
ggccgccgttcgagattctcatcga

SEQ ID NO: 258647 - DNA, 25 bp, Mus musculus
ttctcatcgagtctggcgtcggagg

SEQ ID NO: 258648 - DNA, 25 bp, Mus musculus
cccgagcgtctctccagagggacag

SEQ ID NO: 258649 - DNA, 25 bp, Mus musculus
ctggtagcgcccagtgccagcagaa

SEQ ID NO: 258650 - DNA, 25 bp, Mus musculus
agcgttagcggaaggcgagaattcg

SEQ ID NO: 258651 - DNA, 25 bp, Mus musculus
tatggccagcttccggccgtacttc

SEQ ID NO: 258652 - DNA, 25 bp, Mus musculus
ggcagcggctcccaagcctttcctg

SEQ ID NO: 258653 - DNA, 25 bp, Mus musculus
gacggctacctggaagcctcgtctc

SEQ ID NO: 258654 - DNA, 25 bp, Mus musculus
cgactgcaaccgacggctacctgga

SEQ ID NO: 258655 - DNA, 25 bp, Mus musculus
gtctgcgcccaaggccaggtcgtac

SEQ ID NO: 258656 - DNA, 25 bp, Mus musculus
gtgacctcacctcctcgcgcctgac

SEQ ID NO: 258657 - DNA, 25 bp, Mus musculus
cccacttcgggacgcgagtcgtgca

SEQ ID NO: 258658 - DNA, 25 bp, Mus musculus
tccgctctgtccgtgcatctttatg

SEQ ID NO: 258659 - DNA, 25 bp, Mus musculus
cgtgcatctttatgggtgcgagagc

SEQ ID NO: 258660 - DNA, 25 bp, Mus musculus
gaccctcccgggagctgcaggacaa

SEQ ID NO: 258661 - DNA, 25 bp, Mus musculus
ctcccgggagctgcaggacaaggca

SEQ ID NO: 258662 - DNA, 25 bp, Mus musculus
tagccgctcgcttctatggccagct

SEQ ID NO: 258663 - DNA, 25 bp, Mus musculus
agttcctgcggcgacgtgagcgtta

SEQ ID NO: 258664 - DNA, 25 bp, Mus musculus
taaggactcgccaccacaggaggtc

SEQ ID NO: 258665 - DNA, 25 bp, Mus musculus
tggtgcaacacttcagggacgtcct

SEQ ID NO: 258666 - DNA, 25 bp, Mus musculus
cgaagtgagcgaccaagagcctcca

SEQ ID NO: 258667 - DNA, 25 bp, Mus musculus
tcaagtcccggaccttgcagcggag

SEQ ID NO: 258668 - DNA, 25 bp, Mus musculus
atgtgcatctcaagaaaaggttctg

SEQ ID NO: 258669 - DNA, 25 bp, Mus musculus
gcgttttgacgaaaagccaagtgtg

SEQ ID NO: 258670 - DNA, 25 bp, Mus musculus
agcgcttcaaggaactggtcaatgc

SEQ ID NO: 258671 - DNA, 25 bp, Mus musculus
cgggacactcggaattggtgcaaca

SEQ ID NO: 258672 - DNA, 25 bp, Mus musculus
cttcaaagctgggatcgcgcgtgct

SEQ ID NO: 258673 - DNA, 25 bp, Mus musculus
tcgcgggactcgagactcttcaaag

SEQ ID NO: 258674 - DNA, 25 bp, Mus musculus
gactgtcgccgagattgagtcccga

SEQ ID NO: 258675 - DNA, 25 bp, Mus musculus
acagttgtctctcggactgggtggc

SEQ ID NO: 258676 - DNA, 25 bp, Mus musculus
caggaggcaaatccacagttgtctc

SEQ ID NO: 258677 - DNA, 25 bp, Mus musculus
tcccgcggatggtaccaagtatgtg

SEQ ID NO: 258678 - DNA, 25 bp, Mus musculus
ggaagttatctctgcgcagccggaa

SEQ ID NO: 258679 - DNA, 25 bp, Mus musculus
atgagccgtcgtggaacggcggacc

SEQ ID NO: 258680 - DNA, 25 bp, Mus musculus
agtcctcgcggtgatgagccgtcgt

SEQ ID NO: 258681 - DNA, 25 bp, Mus musculus
gcgggtatcccctgcagtgagtcct

SEQ ID NO: 258682 - DNA, 25 bp, Mus musculus
attgagcagacgaactggggacctc

SEQ ID NO: 258683 - DNA, 25 bp, Mus musculus
tcgtttctggcggatggttttgagt

SEQ ID NO: 258684 - DNA, 25 bp, Mus musculus
cgagtcgcttcgtttctggcggatg

SEQ ID NO: 258685 - DNA, 25 bp, Mus musculus
acattgccgagtcgcttcgtttctg

SEQ ID NO: 258686 - DNA, 25 bp, Mus musculus
tatctctgcgcagccggaagaaggc

SEQ ID NO: 258687 - DNA, 25 bp, Mus musculus
tcccggaagttatctctgcgcagcc

SEQ ID NO: 258688 - DNA, 25 bp, Mus musculus
gccgatctcccggaagttatctctg

SEQ ID NO: 258689 - DNA, 25 bp, Mus musculus
gcatgtgccgatctcccggaagtta

SEQ ID NO: 258690 - DNA, 25 bp, Mus musculus
cttgcaaatgcgcatgtgccgatct

SEQ ID NO: 258691 - DNA, 25 bp, Mus musculus
ccggaagtaaacattgccgagtcgc

SEQ ID NO: 258692 - DNA, 25 bp, Mus musculus
gcgccgccacaccaggcatgcaggt

SEQ ID NO: 258693 - DNA, 25 bp, Mus musculus
tccagctcctcgctgccagccaaac

SEQ ID NO: 258694 - DNA, 25 bp, Mus musculus
ctcgctgccagccaaacctcccgac

SEQ ID NO: 258695 - DNA, 25 bp, Mus musculus
caaacctcccgaccatgcccggcgc

SEQ ID NO: 258696 - DNA, 25 bp, Mus musculus
gcgtagctccgagcgcctgcagtcg

SEQ ID NO: 258697 - DNA, 25 bp, Mus musculus
agcgcctgcagtcgtcgcgccgcca

SEQ ID NO: 258698 - DNA, 25 bp, Mus musculus
gtcgcgccgccacaccaggcatgca

SEQ ID NO: 258699 - DNA, 25 bp, Mus musculus
tgccctcccagtgccagctccgcgt

SEQ ID NO: 258700 - DNA, 25 bp, Mus musculus
cccgcccctcctggcgcggtctcca

SEQ ID NO: 258701 - DNA, 25 bp, Mus musculus
gggagcagactctgccctcccagtg

SEQ ID NO: 258702 - DNA, 25 bp, Mus musculus
cctacccgtagggagcagactctgc

SEQ ID NO: 258703 - DNA, 25 bp, Mus musculus
tacccgtagggagcagactctgccc

SEQ ID NO: 258704 - DNA, 25 bp, Mus musculus
acccgtagggagcagactctgccct

SEQ ID NO: 258705 - DNA, 25 bp, Mus musculus
gtagggagcagactctgccctccca

SEQ ID NO: 258706 - DNA, 25 bp, Mus musculus
gctacttccgcccttacgtgtcgta

SEQ ID NO: 258707 - DNA, 25 bp, Mus musculus
agtgactcggactctgacctgtttc

SEQ ID NO: 258708 - DNA, 25 bp, Mus musculus
cgtgtcgtaacttctgccctcaaga

SEQ ID NO: 258709 - DNA, 25 bp, Mus musculus
ccggtttgggcgtcacatccaccga

SEQ ID NO: 258710 - DNA, 25 bp, Mus musculus
ctcgagcggctctcggaagtgactc

SEQ ID NO: 258711 - DNA, 25 bp, Mus musculus
tgccctcaagatgtccgagccctaa

SEQ ID NO: 258712 - DNA, 25 bp, Mus musculus
ttctccgagaaacgactgcacattg

SEQ ID NO: 258713 - DNA, 25 bp, Mus musculus
cgactgcacattgaagctgttgggg

SEQ ID NO: 258714 - DNA, 25 bp, Mus musculus
accacttccgggtgagtgtccagga

SEQ ID NO: 258715 - DNA, 25 bp, Mus musculus
ccgagccctaacagcaccggatgtg

SEQ ID NO: 258716 - DNA, 25 bp, Mus musculus
gatgctcagcttcagccctttaaca

SEQ ID NO: 258717 - DNA, 25 bp, Mus musculus
cgggaacgctctcctgatgctcagc

SEQ ID NO: 258718 - DNA, 25 bp, Mus musculus
agcaccggatgtgctcgagcggctc

SEQ ID NO: 258719 - DNA, 25 bp, Mus musculus
acacgctgccttcacgtccggtttg

SEQ ID NO: 258720 - DNA, 25 bp, Mus musculus
agaacagtattcaggaccgcgatca

SEQ ID NO: 258721 - DNA, 25 bp, Mus musculus
ggcagctgtctctttctgatgctca

SEQ ID NO: 258722 - DNA, 25 bp, Mus musculus
tgatgctcatcaacgtggaccgcta

SEQ ID NO: 258723 - DNA, 25 bp, Mus musculus
gggctctcatcctgctgttcgctgt

SEQ ID NO: 258724 - DNA, 25 bp, Mus musculus
gtcccactgcacgtacaagaacatc

SEQ ID NO: 258725 - DNA, 25 bp, Mus musculus
atcactgtgcgcctgtgcttcgaga

SEQ ID NO: 258726 - DNA, 25 bp, Mus musculus
ctgctggccgagatactaggctttc

SEQ ID NO: 258727 - DNA, 25 bp, Mus musculus
tgtcgtctattcgtctggcagagtc

SEQ ID NO: 258728 - DNA, 25 bp, Mus musculus
cctgctgtgcttcgtgccctataac

SEQ ID NO: 258729 - DNA, 25 bp, Mus musculus
cacgctggctgtatatgggttgcta

SEQ ID NO: 258730 - DNA, 25 bp, Mus musculus
cgggccaacttggtgaagaacagta

SEQ ID NO: 258731 - DNA, 25 bp, Mus musculus
actgcgtgctggatccactggttta

SEQ ID NO: 258732 - DNA, 25 bp, Mus musculus
tccagatgaacatgtacggcagctg

SEQ ID NO: 258733 - DNA, 25 bp, Mus musculus
tactacttcagtgccgagggtttcc

SEQ ID NO: 258734 - DNA, 25 bp, Mus musculus
gcgaggcaacgggagagacatctct

SEQ ID NO: 258735 - DNA, 25 bp, Mus musculus
agagaacctgagttgtcccagagga

SEQ ID NO: 258736 - DNA, 25 bp, Mus musculus
cgccgttccggaagagaacctgagt

SEQ ID NO: 258737 - DNA, 25 bp, Mus musculus
cttcccggtgggtgctcgctttcct

SEQ ID NO: 258738 - DNA, 25 bp, Mus musculus
agagacatctctctcagcccgacgt

SEQ ID NO: 258739 - DNA, 25 bp, Mus musculus
cctctccagggagccgacccttctt

SEQ ID NO: 258740 - DNA, 25 bp, Mus musculus
gggtcattccttcacctgtcccttc

SEQ ID NO: 258741 - DNA, 25 bp, Mus musculus
cgtggccaatggttgcctgagcgac

SEQ ID NO: 258742 - DNA, 25 bp, Mus musculus
ttgaggttattatgggctgtccgtg

SEQ ID NO: 258743 - DNA, 25 bp, Mus musculus
gcctgtgcggtgttatttcccggcc

SEQ ID NO: 258744 - DNA, 25 bp, Mus musculus
cctttaagaggcgacgccggagccg

SEQ ID NO: 258745 - DNA, 25 bp, Mus musculus
agtgacaccggcgagacccagcgcg

SEQ ID NO: 258746 - DNA, 25 bp, Mus musculus
tcccagaggacagcctttggagagc

SEQ ID NO: 258747 - DNA, 25 bp, Mus musculus
ccagcgcgacctgaggcggctctag

SEQ ID NO: 258748 - DNA, 25 bp, Mus musculus
cccacctggggccttgcgggtagca

SEQ ID NO: 258749 - DNA, 25 bp, Mus musculus
cggaagcgccacagctcaccacgtc

SEQ ID NO: 258750 - DNA, 25 bp, Mus musculus
gcgcaggcagttgacaggacgaacc

SEQ ID NO: 258751 - DNA, 25 bp, Mus musculus
ttgacaggacgaaccgccgggcgca

SEQ ID NO: 258752 - DNA, 25 bp, Mus musculus
cgggtagcagatgcttcgggaaact

SEQ ID NO: 258753 - DNA, 25 bp, Mus musculus
ctttatggaagtcagtcccgttctc

SEQ ID NO: 258754 - DNA, 25 bp, Mus musculus
aagtcagtcccgttctctcgtggcc

SEQ ID NO: 258755 - DNA, 25 bp, Mus musculus
gaagcagagaagtctccggctgcga

SEQ ID NO: 258756 - DNA, 25 bp, Mus musculus
tctccggctgcgacagggagcgact

SEQ ID NO: 258757 - DNA, 25 bp, Mus musculus
gcgacagggagcgactgactgaccc

SEQ ID NO: 258758 - DNA, 25 bp, Mus musculus
cgagggcaggaagtgacaagctcac

SEQ ID NO: 258759 - DNA, 25 bp, Mus musculus
caggaagtgacaagctcacggagtg

SEQ ID NO: 258760 - DNA, 25 bp, Mus musculus
cgcgccgccaagtgcgcccaactta

SEQ ID NO: 258761 - DNA, 25 bp, Mus musculus
tcgggaaactttatggaagtcagtc

SEQ ID NO: 258762 - DNA, 25 bp, Mus musculus
tttcagcatccacaacgtcgctttg

SEQ ID NO: 258763 - DNA, 25 bp, Mus musculus
ccaccttccgaaccgagggcagaga

SEQ ID NO: 258764 - DNA, 25 bp, Mus musculus
ctacgaagaaggagaagcgtggacc

SEQ ID NO: 258765 - DNA, 25 bp, Mus musculus
cgtgtccctggatcacgtgtgttcc

SEQ ID NO: 258766 - DNA, 25 bp, Mus musculus
gggcgcaagttggatcctacgaaga

SEQ ID NO: 258767 - DNA, 25 bp, Mus musculus
cactttcgcggtgtgcgacctctga

SEQ ID NO: 258768 - DNA, 25 bp, Mus musculus
cgtcgctttgcctcgtttgtctttg

SEQ ID NO: 258769 - DNA, 25 bp, Mus musculus
gtttccctctctgaaccgcgggtga

SEQ ID NO: 258770 - DNA, 25 bp, Mus musculus
tacggcctgcgttcccatttcagca

SEQ ID NO: 258771 - DNA, 25 bp, Mus musculus
tggtaatatccttaagcctacggcc

SEQ ID NO: 258772 - DNA, 25 bp, Mus musculus
ggcggtacccatccctggtaatatc

SEQ ID NO: 258773 - DNA, 25 bp, Mus musculus
ttgcgcttgcgcgattcactttcgc

SEQ ID NO: 258774 - DNA, 25 bp, Mus musculus
gttgtgacgaccctttttgcgcttg

SEQ ID NO: 258775 - DNA, 25 bp, Mus musculus
tgctttagttatcatggggcgcaag

SEQ ID NO: 258776 - DNA, 25 bp, Mus musculus
ggtttcgctgcttcctagccaaggt

SEQ ID NO: 258777 - DNA, 25 bp, Mus musculus
cgacctaggctccaacatcaacgta

SEQ ID NO: 258778 - DNA, 25 bp, Mus musculus
gaacctccggtttcgctgcttccta

SEQ ID NO: 258779 - DNA, 25 bp, Mus musculus
tagagcgccgaaatcggctgctgga

SEQ ID NO: 258780 - DNA, 25 bp, Mus musculus
gcccgccgtgaccaggcggtacaga

SEQ ID NO: 258781 - DNA, 25 bp, Mus musculus
gtacagaccggcttcatcagcccga

SEQ ID NO: 258782 - DNA, 25 bp, Mus musculus
ttcatgcctggcaccatctggtcct

SEQ ID NO: 258783 - DNA, 25 bp, Mus musculus
gccggcttggaccaggactggaacc

SEQ ID NO: 258784 - DNA, 25 bp, Mus musculus
aggactggaacccacgctggtgcaa

SEQ ID NO: 258785 - DNA, 25 bp, Mus musculus
ggtgggcgtccagatcgacaccatc

SEQ ID NO: 258786 - DNA, 25 bp, Mus musculus
gatccgtgccctgtacaacgtgctg

SEQ ID NO: 258787 - DNA, 25 bp, Mus musculus
tgcctattcgcctccggggcctggt

SEQ ID NO: 258788 - DNA, 25 bp, Mus musculus
atggctctccgcaacgacctaggct

SEQ ID NO: 258789 - DNA, 25 bp, Mus musculus
atcaacgtactgaagaccctgaacc

SEQ ID NO: 258790 - DNA, 25 bp, Mus musculus
tccagtcctagctcaagggcgcaga

SEQ ID NO: 258791 - DNA, 25 bp, Mus musculus
gagggctgcagtccgtatttatagg

SEQ ID NO: 258792 - DNA, 25 bp, Mus musculus
ctgcacaagaagatgcggccgtctc

SEQ ID NO: 258793 - DNA, 25 bp, Mus musculus
cgcgattttcacctggcactgcaca

SEQ ID NO: 258794 - DNA, 25 bp, Mus musculus
caccattttgtctacgggacgaggc

SEQ ID NO: 258795 - DNA, 25 bp, Mus musculus
gttcacaccgaccttcaccattttg

SEQ ID NO: 258796 - DNA, 25 bp, Mus musculus
tcagcaagacctgcgtaggcaacgg

SEQ ID NO: 258797 - DNA, 25 bp, Mus musculus
gtccgagcgctgaccttgaggtctc

SEQ ID NO: 258798 - DNA, 25 bp, Mus musculus
ccgcaaaggcggagttaccagaggt

SEQ ID NO: 258799 - DNA, 25 bp, Mus musculus
taatacttaagactccgggccgctc

SEQ ID NO: 258800 - DNA, 25 bp, Mus musculus
tcctcagggcgcgaaagtaaagaaa

SEQ ID NO: 258801 - DNA, 25 bp, Mus musculus
aaggtatgcacctcacaacgccatg

SEQ ID NO: 258802 - DNA, 25 bp, Mus musculus
tttccttcccgtttgcaacatggcg

SEQ ID NO: 258803 - DNA, 25 bp, Mus musculus
ggcctgagctacgtgcacccgtaaa

SEQ ID NO: 258804 - DNA, 25 bp, Mus musculus
acgcgcctcacaggccggaacttgg

SEQ ID NO: 258805 - DNA, 25 bp, Mus musculus
agcttttaaccatgtggcgcccggc

SEQ ID NO: 258806 - DNA, 25 bp, Mus musculus
ggccgcctaaagcagtccagctttt

SEQ ID NO: 258807 - DNA, 25 bp, Mus musculus
gtcggctaagcatggtcacccgttg

SEQ ID NO: 258808 - DNA, 25 bp, Mus musculus
cggccctgtacactccgggaatata

SEQ ID NO: 258809 - DNA, 25 bp, Mus musculus
gcggttccattcttccaggggctaa

SEQ ID NO: 258810 - DNA, 25 bp, Mus musculus
ggggcgtcctttcctgcgacaacaa

SEQ ID NO: 258811 - DNA, 25 bp, Mus musculus
gttcaaacctcaacggctgccagga

SEQ ID NO: 258812 - DNA, 25 bp, Mus musculus
ggaagtatttgactggacgcgcctc

SEQ ID NO: 258813 - DNA, 25 bp, Mus musculus
cacgtcctggacctgctttttctca

SEQ ID NO: 258814 - DNA, 25 bp, Mus musculus
cgcgccaaacaacgagatggttttc

SEQ ID NO: 258815 - DNA, 25 bp, Mus musculus
ttcaagctagcggaggaaccggcca

SEQ ID NO: 258816 - DNA, 25 bp, Mus musculus
cggagcccgcaattccctgttcaaa

SEQ ID NO: 258817 - DNA, 25 bp, Mus musculus
tttcccggcatctctaccgtagtcg

SEQ ID NO: 258818 - DNA, 25 bp, Mus musculus
cggcgctcgacagttccgtctgctt

SEQ ID NO: 258819 - DNA, 25 bp, Mus musculus
atgtctaataaagccgagagccggc

SEQ ID NO: 258820 - DNA, 25 bp, Mus musculus
tgcacctgcagtaagttccaccgca

SEQ ID NO: 258821 - DNA, 25 bp, Mus musculus
taagttccaccgcagttagagttcc

SEQ ID NO: 258822 - DNA, 25 bp, Mus musculus
ttagagttccgggtgtttcgtgtga

SEQ ID NO: 258823 - DNA, 25 bp, Mus musculus
cgagaggcgtggtcatgtctaataa

SEQ ID NO: 258824 - DNA, 25 bp, Mus musculus
tgcccgtctcgttgcattctccaga

SEQ ID NO: 258825 - DNA, 25 bp, Mus musculus
attctccagagaggggacggacctc

SEQ ID NO: 258826 - DNA, 25 bp, Mus musculus
tgtgagttgactctgctctagggtc

SEQ ID NO: 258827 - DNA, 25 bp, Mus musculus
ctctagggtcctcgacacctcttta

SEQ ID NO: 258828 - DNA, 25 bp, Mus musculus
ccgcagtgtccgactctgcgggacg

SEQ ID NO: 258829 - DNA, 25 bp, Mus musculus
cgggaaatggcgcattgcagcagct

SEQ ID NO: 258830 - DNA, 25 bp, Mus musculus
actgcagctggcactccatggcagg

SEQ ID NO: 258831 - DNA, 25 bp, Mus musculus
gacagttccgtctgcttcagccgca

SEQ ID NO: 258832 - DNA, 25 bp, Mus musculus
tggcatggccgtacttcgctgtcat

SEQ ID NO: 258833 - DNA, 25 bp, Mus musculus
ctccttcgcttggagaaacaaggtc

SEQ ID NO: 258834 - DNA, 25 bp, Mus musculus
tggtgcctcctcgtgtaccaaccta

SEQ ID NO: 258835 - DNA, 25 bp, Mus musculus
tcggtgtttcgcgtaaactgactga

SEQ ID NO: 258836 - DNA, 25 bp, Mus musculus
aacatggtgcctcctcgtgtaccaa

SEQ ID NO: 258837 - DNA, 25 bp, Mus musculus
ccgcggccaccggtgcttcctgatc

SEQ ID NO: 258838 - DNA, 25 bp, Mus musculus
tggagaaacaaggtccgcggccacc

SEQ ID NO: 258839 - DNA, 25 bp, Mus musculus
agatcatgttctccttcgcttggag

SEQ ID NO: 258840 - DNA, 25 bp, Mus musculus
ggttctcggcctccaggcgacagat

SEQ ID NO: 258841 - DNA, 25 bp, Mus musculus
tggacatgctcagccagtagtggtt

SEQ ID NO: 258842 - DNA, 25 bp, Mus musculus
tcatgttggacatgctcagccagta

SEQ ID NO: 258843 - DNA, 25 bp, Mus musculus
cttcgctgtcatgttggacatgctc

SEQ ID NO: 258844 - DNA, 25 bp, Mus musculus
ggccgtacttcgctgtcatgttgga

SEQ ID NO: 258845 - DNA, 25 bp, Mus musculus
tcgcgtaaactgactgacacggccg

SEQ ID NO: 258846 - DNA, 25 bp, Mus musculus
gccgcctcggccgttcctcaccact

SEQ ID NO: 258847 - DNA, 25 bp, Mus musculus
tgctgaactccggagacccgctcag

SEQ ID NO: 258848 - DNA, 25 bp, Mus musculus
tgaactccggagacccgctcagacg

SEQ ID NO: 258849 - DNA, 25 bp, Mus musculus
cggagacccgctcagacgccgcctc

SEQ ID NO: 258850 - DNA, 25 bp, Mus musculus
ggccgttcctcaccactggtcctca

SEQ ID NO: 258851 - DNA, 25 bp, Mus musculus
ctggtctgcgcgctcaacagtccag

SEQ ID NO: 258852 - DNA, 25 bp, Mus musculus
tctgcgcgctcaacagtccaggacg

SEQ ID NO: 258853 - DNA, 25 bp, Mus musculus
gcgcgctcaacagtccaggacggat

SEQ ID NO: 258854 - DNA, 25 bp, Mus musculus
cgctcaacagtccaggacggatgtg

SEQ ID NO: 258855 - DNA, 25 bp, Mus musculus
aacagtccaggacggatgtggagtc

SEQ ID NO: 258856 - DNA, 25 bp, Mus musculus
atgtggagtccaggccggggctcat

SEQ ID NO: 258857 - DNA, 25 bp, Mus musculus
cattggcccagagcgccttaggggc

SEQ ID NO: 258858 - DNA, 25 bp, Mus musculus
cccggcctgggactgctcccaccac

SEQ ID NO: 258859 - DNA, 25 bp, Mus musculus
actggtcctcaaccgcctctggtct

SEQ ID NO: 258860 - DNA, 25 bp, Mus musculus
aagcctggctctcagaggggattgc

SEQ ID NO: 258861 - DNA, 25 bp, Mus musculus
ttcggctcggctgaccagaccgggt

SEQ ID NO: 258862 - DNA, 25 bp, Mus musculus
aagcccggacgtcctgagcagcgtt

SEQ ID NO: 258863 - DNA, 25 bp, Mus musculus
acgtcctgagcagcgttggccacga

SEQ ID NO: 258864 - DNA, 25 bp, Mus musculus
agcagcgttggccacgacttcccaa

SEQ ID NO: 258865 - DNA, 25 bp, Mus musculus
gttggccacgacttcccaagcctgg

SEQ ID NO: 258866 - DNA, 25 bp, Mus musculus
acgacttcccaagcctggcggctgg

SEQ ID NO: 258867 - DNA, 25 bp, Mus musculus
gcagaggccggcctgtcgcaatcgc

SEQ ID NO: 258868 - DNA, 25 bp, Mus musculus
aggccggcctgtcgcaatcgcgacg

SEQ ID NO: 258869 - DNA, 25 bp, Mus musculus
ctgcaggcccggaacccggcctcca

SEQ ID NO: 258870 - DNA, 25 bp, Mus musculus
gcctccacctttcttcggaagcctg

SEQ ID NO: 258871 - DNA, 25 bp, Mus musculus
ggcctttcggctcggctgaccagac

SEQ ID NO: 258872 - DNA, 25 bp, Mus musculus
cgcatggcggcctttcggctcggct

SEQ ID NO: 258873 - DNA, 25 bp, Mus musculus
tgcggattaggatcgcttgctggcc

SEQ ID NO: 258874 - DNA, 25 bp, Mus musculus
tcctccagtgtacgcgacaacaatc

SEQ ID NO: 258875 - DNA, 25 bp, Mus musculus
cgagcttgctcggtcccatggaccg

SEQ ID NO: 258876 - DNA, 25 bp, Mus musculus
tacgagcttgctcggtcccatggac

SEQ ID NO: 258877 - DNA, 25 bp, Mus musculus
aggacccgcctacgagcttgctcgg

SEQ ID NO: 258878 - DNA, 25 bp, Mus musculus
gaaaatcggcttccaactggtaagc

SEQ ID NO: 258879 - DNA, 25 bp, Mus musculus
ctggaaaatcggcttccaactggta

SEQ ID NO: 258880 - DNA, 25 bp, Mus musculus
gacctccggggtgctctcccacacc

SEQ ID NO: 258881 - DNA, 25 bp, Mus musculus
gcgtcctccagtgtacgcgacaaca

SEQ ID NO: 258882 - DNA, 25 bp, Mus musculus
gcagcgcgtcctccagtgtacgcga

SEQ ID NO: 258883 - DNA, 25 bp, Mus musculus
ggcgcgcagcgcgtcctccagtgta

SEQ ID NO: 258884 - DNA, 25 bp, Mus musculus
cacctccgcccaatcccgcccgctc

SEQ ID NO: 258885 - DNA, 25 bp, Mus musculus
cgcctgcgcacaccacctccgccca

SEQ ID NO: 258886 - DNA, 25 bp, Mus musculus
gtacgcgacaacaatccccaagtgg

SEQ ID NO: 258887 - DNA, 25 bp, Mus musculus
ggaaggactggaaaatcggcttcca

SEQ ID NO: 258888 - DNA, 25 bp, Mus musculus
gccgcgccacgaggacacgctggaa

SEQ ID NO: 258889 - DNA, 25 bp, Mus musculus
ggctgggtgcctggagaatatcctc

SEQ ID NO: 258890 - DNA, 25 bp, Mus musculus
tccaagatgaacctggctgggtgcc

SEQ ID NO: 258891 - DNA, 25 bp, Mus musculus
gagaatatcctcgaggctctgagaa

SEQ ID NO: 258892 - DNA, 25 bp, Mus musculus
tcctcgaggctctgagaaatcccgc

SEQ ID NO: 258893 - DNA, 25 bp, Mus musculus
cctcgtgctttccaagatgaacctg

SEQ ID NO: 258894 - DNA, 25 bp, Mus musculus
gcgaggctcagtacagcatgctgga

SEQ ID NO: 258895 - DNA, 25 bp, Mus musculus
gctcagtacagcatgctggaagcct

SEQ ID NO: 258896 - DNA, 25 bp, Mus musculus
acacgctggaagtagtgggcctcgt

SEQ ID NO: 258897 - DNA, 25 bp, Mus musculus
cgctgcctgcgcgaggctcagtaca

SEQ ID NO: 258898 - DNA, 25 bp, Mus musculus
gagttcatgcgtttcatggggctga

SEQ ID NO: 258899 - DNA, 25 bp, Mus musculus
cgctggaaggagttcatgcgtttca

SEQ ID NO: 258900 - DNA, 25 bp, Mus musculus
ctccagcgcgctggaaggagttcat

SEQ ID NO: 258901 - DNA, 25 bp, Mus musculus
agtgggcctcgtgctttccaagatg

SEQ ID NO: 258902 - DNA, 25 bp, Mus musculus
tgtccttgacgtccgctggatactg

SEQ ID NO: 258903 - DNA, 25 bp, Mus musculus
tgctcacctgtgagcgcaggtgtcc

SEQ ID NO: 258904 - DNA, 25 bp, Mus musculus
gagcgcaggtgtccgagcttccgct

SEQ ID NO: 258905 - DNA, 25 bp, Mus musculus
tccgagcttccgctgtccttgacgt

SEQ ID NO: 258906 - DNA, 25 bp, Mus musculus
acgtccgctggatactgtggaaatc

SEQ ID NO: 258907 - DNA, 25 bp, Mus musculus
gaaatctgggtcgttgtcagcttcc

SEQ ID NO: 258908 - DNA, 25 bp, Mus musculus
gtcgttgtcagcttccttggcgatg

SEQ ID NO: 258909 - DNA, 25 bp, Mus musculus
tgtcagcttccttggcgatggcagc

SEQ ID NO: 258910 - DNA, 25 bp, Mus musculus
tcccagcctgggactaggaccgagc

SEQ ID NO: 258911 - DNA, 25 bp, Mus musculus
gccttgcagcgtcgcggtcctggtc

SEQ ID NO: 258912 - DNA, 25 bp, Mus musculus
tcgcggtcctggtcacccggacaga

SEQ ID NO: 258913 - DNA, 25 bp, Mus musculus
cctggtcacccggacagagagggta

SEQ ID NO: 258914 - DNA, 25 bp, Mus musculus
tcccaagtgctcacctgtgagcgca

SEQ ID NO: 258915 - DNA, 25 bp, Mus musculus
tactgtggaaatctgggtcgttgtc

SEQ ID NO: 258916 - DNA, 25 bp, Mus musculus
tggggctcttaggaactctgcatta

SEQ ID NO: 258917 - DNA, 25 bp, Mus musculus
gtgcgcgcagaacattttatagagg

SEQ ID NO: 258918 - DNA, 25 bp, Mus musculus
ttatagaggagtgaatggctgcaca

SEQ ID NO: 258919 - DNA, 25 bp, Mus musculus
tgcacaaaggtaggccgtgcgccgc

SEQ ID NO: 258920 - DNA, 25 bp, Mus musculus
ccgtgcgccgcaagaaatgcaattt

SEQ ID NO: 258921 - DNA, 25 bp, Mus musculus
aatgcaatttgcctcttcagagacc

SEQ ID NO: 258922 - DNA, 25 bp, Mus musculus
cctcttcagagacccagcagggctg

SEQ ID NO: 258923 - DNA, 25 bp, Mus musculus
tggagcgcggaaaacaccggcagct

SEQ ID NO: 258924 - DNA, 25 bp, Mus musculus
ccggcagctgcagcaaataggagtg

SEQ ID NO: 258925 - DNA, 25 bp, Mus musculus
aataggagtgatccgcagcagcgcg

SEQ ID NO: 258926 - DNA, 25 bp, Mus musculus
gctgcgacaagacgagccggagttt

SEQ ID NO: 258927 - DNA, 25 bp, Mus musculus
tagtttcccaggcagggttagccgc

SEQ ID NO: 258928 - DNA, 25 bp, Mus musculus
agccgctgcttttgtgcgcgcagaa

SEQ ID NO: 258929 - DNA, 25 bp, Mus musculus
ctgcattagtttcccaggcagggtt

SEQ ID NO: 258930 - DNA, 25 bp, Mus musculus
gagcgaagtgcacagccggagccac

SEQ ID NO: 258931 - DNA, 25 bp, Mus musculus
agacgctcgactgccctgctggcaa

SEQ ID NO: 258932 - DNA, 25 bp, Mus musculus
cccatctcaaatactcggcggtaga

SEQ ID NO: 258933 - DNA, 25 bp, Mus musculus
gctggcctgaggctccacttttaaa

SEQ ID NO: 258934 - DNA, 25 bp, Mus musculus
tctcgggcctgagaacaggtggcct

SEQ ID NO: 258935 - DNA, 25 bp, Mus musculus
tcacccagaagatgaagttaaatcc

SEQ ID NO: 258936 - DNA, 25 bp, Mus musculus
ttactcgaaaaggttgctccgctcc

SEQ ID NO: 258937 - DNA, 25 bp, Mus musculus
aaagtgccactccttacggcgctcg

SEQ ID NO: 258938 - DNA, 25 bp, Mus musculus
tcgacaaccgactgagacacgctgc

SEQ ID NO: 258939 - DNA, 25 bp, Mus musculus
actgggacagaagggactcgacaac

SEQ ID NO: 258940 - DNA, 25 bp, Mus musculus
acaagaggcacgaacgactgggaca

SEQ ID NO: 258941 - DNA, 25 bp, Mus musculus
ccggcatggtacaagctggagttgc

SEQ ID NO: 258942 - DNA, 25 bp, Mus musculus
ttgctacctcctttgaccggcatgg

SEQ ID NO: 258943 - DNA, 25 bp, Mus musculus
gctcggccagctgctatgcgcatgt

SEQ ID NO: 258944 - DNA, 25 bp, Mus musculus
atacgggagcctcgattccagttcc

SEQ ID NO: 258945 - DNA, 25 bp, Mus musculus
gtagcgcctcttggatgcacaccca

SEQ ID NO: 258946 - DNA, 25 bp, Mus musculus
cgtcctagagcagccgccactcaga

SEQ ID NO: 258947 - DNA, 25 bp, Mus musculus
agactctcaacctgctacccgccgg

SEQ ID NO: 258948 - DNA, 25 bp, Mus musculus
tcaatccggtgggtgcttcccagac

SEQ ID NO: 258949 - DNA, 25 bp, Mus musculus
ttgcgcaaagcagtagcgcctcttg

SEQ ID NO: 258950 - DNA, 25 bp, Mus musculus
cccagacctggaatacgggagcctc

SEQ ID NO: 258951 - DNA, 25 bp, Mus musculus
cctgcgacctctctaatcaactgtg

SEQ ID NO: 258952 - DNA, 25 bp, Mus musculus
tcaactgtgtccacaccattcggtg

SEQ ID NO: 258953 - DNA, 25 bp, Mus musculus
acaccattcggtgctggagtcccag

SEQ ID NO: 258954 - DNA, 25 bp, Mus musculus
ggtgcatctgaacgccgcggaagaa

SEQ ID NO: 258955 - DNA, 25 bp, Mus musculus
cgccgcggaagaacgccaaaattgc

SEQ ID NO: 258956 - DNA, 25 bp, Mus musculus
gccaaaattgcgcaaagcagtagcg

SEQ ID NO: 258957 - DNA, 25 bp, Mus musculus
tggagtcccaggaaggtgcatctga

SEQ ID NO: 258958 - DNA, 25 bp, Mus musculus
tcgacatgaagagaaaggtggactc

SEQ ID NO: 258959 - DNA, 25 bp, Mus musculus
ccatggcatccgtgtgactatttcc

SEQ ID NO: 258960 - DNA, 25 bp, Mus musculus
ataaccagccaacccggccagatgg

SEQ ID NO: 258961 - DNA, 25 bp, Mus musculus
gatggctccgcgctcagcgccttaa

SEQ ID NO: 258962 - DNA, 25 bp, Mus musculus
cgaaaagttagcgtgttgcgcgatg

SEQ ID NO: 258963 - DNA, 25 bp, Mus musculus
ttaccgtggcagaagtaaccatggc

SEQ ID NO: 258964 - DNA, 25 bp, Mus musculus
aggtggactcgagttcggtcattca

SEQ ID NO: 258965 - DNA, 25 bp, Mus musculus
cccgtgaacataatctgagcggtta

SEQ ID NO: 258966 - DNA, 25 bp, Mus musculus
ttcaactctgagtcccgtgaacata

SEQ ID NO: 258967 - DNA, 25 bp, Mus musculus
ctgggtaaggagaggagccttcaac

SEQ ID NO: 258968 - DNA, 25 bp, Mus musculus
gcagccactacccagcggtgggaaa

SEQ ID NO: 258969 - DNA, 25 bp, Mus musculus
actatttccagggacgtcgacatga

SEQ ID NO: 258970 - DNA, 25 bp, Mus musculus
tgagcggttataaccagccaacccg

SEQ ID NO: 258971 - DNA, 25 bp, Mus musculus
agttcggtcattcagtctcgcccac

SEQ ID NO: 258972 - DNA, 25 bp, Mus musculus
ccagagtcttgagctgcgtttcgaa

SEQ ID NO: 258973 - DNA, 25 bp, Mus musculus
gcggtcgaagcctcgtccgcattct

SEQ ID NO: 258974 - DNA, 25 bp, Mus musculus
tgacctggagcggtcgaagcctcgt

SEQ ID NO: 258975 - DNA, 25 bp, Mus musculus
ctgcctcgggtagctgccatcctgg

SEQ ID NO: 258976 - DNA, 25 bp, Mus musculus
ctcgcagcattcgtggtcgtcgtgg

SEQ ID NO: 258977 - DNA, 25 bp, Mus musculus
cccggagatgttgattactacgcgc

SEQ ID NO: 258978 - DNA, 25 bp, Mus musculus
ttggggaactgtgccagagtcttga

SEQ ID NO: 258979 - DNA, 25 bp, Mus musculus
ttgcccagcagcgtgttggggaact

SEQ ID NO: 258980 - DNA, 25 bp, Mus musculus
gcatgcgtttcttcgggttgcccag

SEQ ID NO: 258981 - DNA, 25 bp, Mus musculus
ggggtcaaagtagcgcatgcgtttc

SEQ ID NO: 258982 - DNA, 25 bp, Mus musculus
ataaaggatggcatcgaagctgggc

SEQ ID NO: 258983 - DNA, 25 bp, Mus musculus
actggtagtaataaaggatggcatc

SEQ ID NO: 258984 - DNA, 25 bp, Mus musculus
tcctcggagaacatgtccaggggca

SEQ ID NO: 258985 - DNA, 25 bp, Mus musculus
ttactacgcgctcgcagcattcgtg

SEQ ID NO: 258986 - DNA, 25 bp, Mus musculus
gtagccgagccaagtcggccttttc

SEQ ID NO: 258987 - DNA, 25 bp, Mus musculus
tttccgtggcggtaaccaagagcta

SEQ ID NO: 258988 - DNA, 25 bp, Mus musculus
caagagctacccacgcgagcgactg

SEQ ID NO: 258989 - DNA, 25 bp, Mus musculus
gcgagcgactgcctatcaagtttga

SEQ ID NO: 258990 - DNA, 25 bp, Mus musculus
atgaacgagggtggccactacaacg

SEQ ID NO: 258991 - DNA, 25 bp, Mus musculus
ctacaacgcgtccagtggcaagttc

SEQ ID NO: 258992 - DNA, 25 bp, Mus musculus
agtggcaagttcgtctgcagcgtgc

SEQ ID NO: 258993 - DNA, 25 bp, Mus musculus
gcgtgccggggatctattactttac

SEQ ID NO: 258994 - DNA, 25 bp, Mus musculus
actttacctatgacattacgctggc

SEQ ID NO: 258995 - DNA, 25 bp, Mus musculus
ttacgctggccaacaaacacctggc

SEQ ID NO: 258996 - DNA, 25 bp, Mus musculus
tcggcctggtgcacaatggtcagta

SEQ ID NO: 258997 - DNA, 25 bp, Mus musculus
tggtcagtaccgcattcggactttt

SEQ ID NO: 258998 - DNA, 25 bp, Mus musculus
tgccaacacgggcaaccacgacgtg

SEQ ID NO: 258999 - DNA, 25 bp, Mus musculus
tcggacttttgatgccaacacgggc

SEQ ID NO: 259000 - DNA, 25 bp, Mus musculus
cctctgaacactacgggagcccttg

SEQ ID NO: 259001 - DNA, 25 bp, Mus musculus
gagacgctgtcctctctctggggaa

SEQ ID NO: 259002 - DNA, 25 bp, Mus musculus
ggttgtcattcagttcccatccttg

SEQ ID NO: 259003 - DNA, 25 bp, Mus musculus
gagcccttgattcgatcccgaggga

SEQ ID NO: 259004 - DNA, 25 bp, Mus musculus
ctggctctacatggctctccggtaa

SEQ ID NO: 259005 - DNA, 25 bp, Mus musculus
gtaacctgcgctaccacagcacgga

SEQ ID NO: 259006 - DNA, 25 bp, Mus musculus
cggtccatttctgggcgctgcaaga

SEQ ID NO: 259007 - DNA, 25 bp, Mus musculus
gaaacctgagaaagcgcctggaatg

SEQ ID NO: 259008 - DNA, 25 bp, Mus musculus
atcgagcagctacggaggaaacgtc

SEQ ID NO: 259009 - DNA, 25 bp, Mus musculus
tcctcacacggtgcaagcaacctgg

SEQ ID NO: 259010 - DNA, 25 bp, Mus musculus
cccgggaatttcacattggagatgg

SEQ ID NO: 259011 - DNA, 25 bp, Mus musculus
caggagtccgatcgttttatcgagc

SEQ ID NO: 259012 - DNA, 25 bp, Mus musculus
actagagagcttcctacctggcggg

SEQ ID NO: 259013 - DNA, 25 bp, Mus musculus
tctccggaatcacccaagcaaatgg

SEQ ID NO: 259014 - DNA, 25 bp, Mus musculus
agggcttcctctcccaactgataga

SEQ ID NO: 259015 - DNA, 25 bp, Mus musculus
gccgctggtacctaagcgccagatg

SEQ ID NO: 259016 - DNA, 25 bp, Mus musculus
tgctggctctcaccaggtcctactg

SEQ ID NO: 259017 - DNA, 25 bp, Mus musculus
ctcgatggtgcctaaaactgggctc

SEQ ID NO: 259018 - DNA, 25 bp, Mus musculus
tgcccgaaaagacgcgtggcttagc

SEQ ID NO: 259019 - DNA, 25 bp, Mus musculus
gcgcgtgaaactggctgcccgaaaa

SEQ ID NO: 259020 - DNA, 25 bp, Mus musculus
cccgcaaactgtcgcgcgcgtgaaa

SEQ ID NO: 259021 - DNA, 25 bp, Mus musculus
tgagatgcctggaacccgcaaactg

SEQ ID NO: 259022 - DNA, 25 bp, Mus musculus
gcgcctccgtgctcaggatttctga

SEQ ID NO: 259023 - DNA, 25 bp, Mus musculus
tcagggatttctccgatctcatgtc

SEQ ID NO: 259024 - DNA, 25 bp, Mus musculus
tctcctagcagcgtgtcagggaaca

SEQ ID NO: 259025 - DNA, 25 bp, Mus musculus
atgtccaggggcacattaacaggcc

SEQ ID NO: 259026 - DNA, 25 bp, Mus musculus
ggaactctccgggtactcaaagaga

SEQ ID NO: 259027 - DNA, 25 bp, Mus musculus
gcaggcgacctccagattgatagta

SEQ ID NO: 259028 - DNA, 25 bp, Mus musculus
tagcctaccaggtccctctggagtg

SEQ ID NO: 259029 - DNA, 25 bp, Mus musculus
aatcgcgctgccctctgtcggatct

SEQ ID NO: 259030 - DNA, 25 bp, Mus musculus
cgctcaacgtatgacagccacttaa

SEQ ID NO: 259031 - DNA, 25 bp, Mus musculus
cacttaacgcggtcgctcgctgtcg

SEQ ID NO: 259032 - DNA, 25 bp, Mus musculus
ctcgctgtcgcgttaagcgcgactc

SEQ ID NO: 259033 - DNA, 25 bp, Mus musculus
gtcaccaaccactcacctgatagga

SEQ ID NO: 259034 - DNA, 25 bp, Mus musculus
tctcccgcaaccatgcatgacagtg

SEQ ID NO: 259035 - DNA, 25 bp, Mus musculus
caagcgagatgccaggcgggctcct

SEQ ID NO: 259036 - DNA, 25 bp, Mus musculus
ctcaccggagactggcgacgagcac

SEQ ID NO: 259037 - DNA, 25 bp, Mus musculus
cagctgtggcggtttcaattcccgc

SEQ ID NO: 259038 - DNA, 25 bp, Mus musculus
cctagagcagcagtgctctggagct

SEQ ID NO: 259039 - DNA, 25 bp, Mus musculus
caccatggtgccctgcctagagcag

SEQ ID NO: 259040 - DNA, 25 bp, Mus musculus
ctcacctgataggacgcaccatggt

SEQ ID NO: 259041 - DNA, 25 bp, Mus musculus
gcgcgactcaaatgctagcctacca

SEQ ID NO: 259042 - DNA, 25 bp, Mus musculus
ttctcccagttcctggctcgcagga

SEQ ID NO: 259043 - DNA, 25 bp, Mus musculus
ctgtgcctgtatcctgctctcgcga

SEQ ID NO: 259044 - DNA, 25 bp, Mus musculus
tccatcctccagtcggttcagccca

SEQ ID NO: 259045 - DNA, 25 bp, Mus musculus
cagccagcgatcctctgggggtgct

SEQ ID NO: 259046 - DNA, 25 bp, Mus musculus
gcggataggtgtcgcccctttccca

SEQ ID NO: 259047 - DNA, 25 bp, Mus musculus
tcctggctcgcaggaacgaggtccc

SEQ ID NO: 259048 - DNA, 25 bp, Mus musculus
ctcgcaggaacgaggtcccgctgct

SEQ ID NO: 259049 - DNA, 25 bp, Mus musculus
gaggtcccgctgctgcatttctaca

SEQ ID NO: 259050 - DNA, 25 bp, Mus musculus
gctgctgcatttctacactgttcgc

SEQ ID NO: 259051 - DNA, 25 bp, Mus musculus
atttctacactgttcgcccacggcg

SEQ ID NO: 259052 - DNA, 25 bp, Mus musculus
accggagcgcgacccactgaacgtg

SEQ ID NO: 259053 - DNA, 25 bp, Mus musculus
gcgcgacccactgaacgtgctcaag

SEQ ID NO: 259054 - DNA, 25 bp, Mus musculus
caggttcgtctaggtccccaggcca

SEQ ID NO: 259055 - DNA, 25 bp, Mus musculus
gtatcctgctctcgcgagctgccga

SEQ ID NO: 259056 - DNA, 25 bp, Mus musculus
ccggcaactgcgatactcactggcg

SEQ ID NO: 259057 - DNA, 25 bp, Mus musculus
gggttaacgccctggagtcttgcca

SEQ ID NO: 259058 - DNA, 25 bp, Mus musculus
ccgggtcatgtcttctcgcaatggc

SEQ ID NO: 259059 - DNA, 25 bp, Mus musculus
ggaaccgtgatcgtgtgcttctcca

SEQ ID NO: 259060 - DNA, 25 bp, Mus musculus
cctcgtggaaaacgcaaggctcttg

SEQ ID NO: 259061 - DNA, 25 bp, Mus musculus
tcttgacatttaagacccggcttcc

SEQ ID NO: 259062 - DNA, 25 bp, Mus musculus
ctcacgcagggtgtcgcggataaaa

SEQ ID NO: 259063 - DNA, 25 bp, Mus musculus
ctcactggcggataacggtcaaggc

SEQ ID NO: 259064 - DNA, 25 bp, Mus musculus
cctgactctgggaccactttgcctg

SEQ ID NO: 259065 - DNA, 25 bp, Mus musculus
actttgcctgcactacttccgtctg

SEQ ID NO: 259066 - DNA, 25 bp, Mus musculus
tagctattggtcgaggcggctgaac

SEQ ID NO: 259067 - DNA, 25 bp, Mus musculus
cggctgaacgtcaccacagggttgc

SEQ ID NO: 259068 - DNA, 25 bp, Mus musculus
cgaagcgcggcattttggcacaaga

SEQ ID NO: 259069 - DNA, 25 bp, Mus musculus
ctcctgcgcgccaacctgtgattgg

SEQ ID NO: 259070 - DNA, 25 bp, Mus musculus
agaacgcggtcttccagcaggttgc

SEQ ID NO: 259071 - DNA, 25 bp, Mus musculus
tcctcgatggtcaacaggttctgca

SEQ ID NO: 259072 - DNA, 25 bp, Mus musculus
aggtagcgctcctcgatggtcaaca

SEQ ID NO: 259073 - DNA, 25 bp, Mus musculus
gaacactgcgggaggtagcgctcct

SEQ ID NO: 259074 - DNA, 25 bp, Mus musculus
ccagcgcaggggtagttctcccgca

SEQ ID NO: 259075 - DNA, 25 bp, Mus musculus
gttctcccgcagtttttaggatctc

SEQ ID NO: 259076 - DNA, 25 bp, Mus musculus
cacttgaaataggaacactgcggga

SEQ ID NO: 259077 - DNA, 25 bp, Mus musculus
ctgcacgcacttgaaataggaacac

SEQ ID NO: 259078 - DNA, 25 bp, Mus musculus
acggttggatgtccttctgcacgca

SEQ ID NO: 259079 - DNA, 25 bp, Mus musculus
tcctgcgcatgtacggttggatgtc

SEQ ID NO: 259080 - DNA, 25 bp, Mus musculus
caggtggccaccatcctgcgcatgt

SEQ ID NO: 259081 - DNA, 25 bp, Mus musculus
acacctacctctagcatccaggtgg

SEQ ID NO: 259082 - DNA, 25 bp, Mus musculus
gtttttaggatctctgcgtgttgga

SEQ ID NO: 259083 - DNA, 25 bp, Mus musculus
aggttctgcagaacgcggtcttcca

SEQ ID NO: 259084 - DNA, 25 bp, Mus musculus
gaaggtgggagccagttccaacctg

SEQ ID NO: 259085 - DNA, 25 bp, Mus musculus
ggcaaaagcactgcaggagccaggc

SEQ ID NO: 259086 - DNA, 25 bp, Mus musculus
ctaagccgggttccatcacgatttc

SEQ ID NO: 259087 - DNA, 25 bp, Mus musculus
ttccaacctggaggcggagtgacgc

SEQ ID NO: 259088 - DNA, 25 bp, Mus musculus
tgacgctgacctagcaggagcagtc

SEQ ID NO: 259089 - DNA, 25 bp, Mus musculus
agcagtcagcctaggctctccagta

SEQ ID NO: 259090 - DNA, 25 bp, Mus musculus
aggctctccagtacaggccctgagc

SEQ ID NO: 259091 - DNA, 25 bp, Mus musculus
gcccacgataagcccagggtttaca

SEQ ID NO: 259092 - DNA, 25 bp, Mus musculus
caactggaacagcaccgcttccggg

SEQ ID NO: 259093 - DNA, 25 bp, Mus musculus
tgacggcagcaaaacgccacagacc

SEQ ID NO: 259094 - DNA, 25 bp, Mus musculus
gtctcctggaagtgacggcagcaaa

SEQ ID NO: 259095 - DNA, 25 bp, Mus musculus
cgatttcccaacaactggaacagca

SEQ ID NO: 259096 - DNA, 25 bp, Mus musculus
gcggtggccaggcaaaagcactgca

SEQ ID NO: 259097 - DNA, 25 bp, Mus musculus
cgggttccatcacgatttcccaaca

SEQ ID NO: 259098 - DNA, 25 bp, Mus musculus
ggactgtgggccaatggaaccacgc

SEQ ID NO: 259099 - DNA, 25 bp, Mus musculus
gtcccggatctctaaacacccagtg

SEQ ID NO: 259100 - DNA, 25 bp, Mus musculus
ggctgggtcccggatctctaaacac

SEQ ID NO: 259101 - DNA, 25 bp, Mus musculus
gtcgtgcggtggctgcccaaccgct

SEQ ID NO: 259102 - DNA, 25 bp, Mus musculus
attttgacgtcacccacatgtgggg

SEQ ID NO: 259103 - DNA, 25 bp, Mus musculus
gcggaattttgacgtcacccacatg

SEQ ID NO: 259104 - DNA, 25 bp, Mus musculus
tttcgcggaattttgacgtcaccca

SEQ ID NO: 259105 - DNA, 25 bp, Mus musculus
acgctgctttttcgcggaattttga

SEQ ID NO: 259106 - DNA, 25 bp, Mus musculus
agccaacacgctgctttttcgcgga

SEQ ID NO: 259107 - DNA, 25 bp, Mus musculus
tggggagccaacacgctgctttttc

SEQ ID NO: 259108 - DNA, 25 bp, Mus musculus
aaccacgcctctgcttggggagcca

SEQ ID NO: 259109 - DNA, 25 bp, Mus musculus
atggaaccacgcctctgcttgggga

SEQ ID NO: 259110 - DNA, 25 bp, Mus musculus
cgagttgcgccccagcggcaaagct

SEQ ID NO: 259111 - DNA, 25 bp, Mus musculus
tgggccaatggaaccacgcctctgc

SEQ ID NO: 259112 - DNA, 25 bp, Mus musculus
cgcaccgttatgtgggaagcgaatc

SEQ ID NO: 259113 - DNA, 25 bp, Mus musculus
ccgtggactcgcagctttgagccgt

SEQ ID NO: 259114 - DNA, 25 bp, Mus musculus
cttgacgatcacgtggtgggtatga

SEQ ID NO: 259115 - DNA, 25 bp, Mus musculus
ctccgctcgatttcgcaccgttatg

SEQ ID NO: 259116 - DNA, 25 bp, Mus musculus
tcggaaaaagcccaccatatcgacc

SEQ ID NO: 259117 - DNA, 25 bp, Mus musculus
tgcctttcggtcctttcgctcctgg

SEQ ID NO: 259118 - DNA, 25 bp, Mus musculus
tccgaagacgccagcttgtgacggg

SEQ ID NO: 259119 - DNA, 25 bp, Mus musculus
ttcgatggtccgaagacgccagctt

SEQ ID NO: 259120 - DNA, 25 bp, Mus musculus
ccgccactgattggctggatccagg

SEQ ID NO: 259121 - DNA, 25 bp, Mus musculus
acagcacgcgcggaagttccaaggg

SEQ ID NO: 259122 - DNA, 25 bp, Mus musculus
taccacacaggtaaaggcggcccgc

SEQ ID NO: 259123 - DNA, 25 bp, Mus musculus
gcttcaaacagctttaccacacagg

SEQ ID NO: 259124 - DNA, 25 bp, Mus musculus
tgatggccggcttcaaacagcttta

SEQ ID NO: 259125 - DNA, 25 bp, Mus musculus
agcctgccacgcttgacgatcacgt

SEQ ID NO: 259126 - DNA, 25 bp, Mus musculus
cgctaagctgggacaccacggtatg

SEQ ID NO: 259127 - DNA, 25 bp, Mus musculus
ggacaactcggacagccgcactgga

SEQ ID NO: 259128 - DNA, 25 bp, Mus musculus
cctgacagctgcgagtcagaaggca

SEQ ID NO: 259129 - DNA, 25 bp, Mus musculus
ggcgaattcctgacagctgcgagtc

SEQ ID NO: 259130 - DNA, 25 bp, Mus musculus
gctggccggcgaattcctgacagct

SEQ ID NO: 259131 - DNA, 25 bp, Mus musculus
acagcggaccagatccggctggccg

SEQ ID NO: 259132 - DNA, 25 bp, Mus musculus
ctggaccagccatgcagccggaggc

SEQ ID NO: 259133 - DNA, 25 bp, Mus musculus
cacggtatggtgtagatcctggagc

SEQ ID NO: 259134 - DNA, 25 bp, Mus musculus
caagttgcttcgctaagctgggaca

SEQ ID NO: 259135 - DNA, 25 bp, Mus musculus
tagtagtcagtcacaagttgcttcg

SEQ ID NO: 259136 - DNA, 25 bp, Mus musculus
tgcaggctttagtagtcagtcacaa

SEQ ID NO: 259137 - DNA, 25 bp, Mus musculus
tcgccacccagactgcaggctttag

SEQ ID NO: 259138 - DNA, 25 bp, Mus musculus
cactggacgcccctgcaggtaatcg

SEQ ID NO: 259139 - DNA, 25 bp, Mus musculus
ctgctggggctggaccagccatgca

SEQ ID NO: 259140 - DNA, 25 bp, Mus musculus
tctgcgcgagaaggtcagttcctcc

SEQ ID NO: 259141 - DNA, 25 bp, Mus musculus
tcggacgtacactgcactctgcgcg

SEQ ID NO: 259142 - DNA, 25 bp, Mus musculus
gaagcctagctttctgcccgggcga

SEQ ID NO: 259143 - DNA, 25 bp, Mus musculus
cgccggggaaagaaagactgccatt

SEQ ID NO: 259144 - DNA, 25 bp, Mus musculus
catcggagggcactacgtacccggt

SEQ ID NO: 259145 - DNA, 25 bp, Mus musculus
ggactctgagccagtgacccagcca

SEQ ID NO: 259146 - DNA, 25 bp, Mus musculus
agccctgggagagctactacagccc

SEQ ID NO: 259147 - DNA, 25 bp, Mus musculus
tgcaacttttgcagaggggcacatt

SEQ ID NO: 259148 - DNA, 25 bp, Mus musculus
gcaagttgttgcacacagttccaga

SEQ ID NO: 259149 - DNA, 25 bp, Mus musculus
gacactgctggctcttcaggacagc

SEQ ID NO: 259150 - DNA, 25 bp, Mus musculus
acagccagctccacggtgcagggca

SEQ ID NO: 259151 - DNA, 25 bp, Mus musculus
agtctccgatcgctgaagctcctgg

SEQ ID NO: 259152 - DNA, 25 bp, Mus musculus
cccagggaaggtgaagcctagcttt

SEQ ID NO: 259153 - DNA, 25 bp, Mus musculus
cgagatcccggtagcttcataactg

SEQ ID NO: 259154 - DNA, 25 bp, Mus musculus
agacggctgatgtggctttaaaaga

SEQ ID NO: 259155 - DNA, 25 bp, Mus musculus
ggacccatagcttggggaccacctc

SEQ ID NO: 259156 - DNA, 25 bp, Mus musculus
gcggtcgccactttgttcacgtttc

SEQ ID NO: 259157 - DNA, 25 bp, Mus musculus
gtgcttagtactgccaccaggtcgg

SEQ ID NO: 259158 - DNA, 25 bp, Mus musculus
tcctccgcgacaatcgagctctgtg

SEQ ID NO: 259159 - DNA, 25 bp, Mus musculus
ccacctcgagcttgaagggtaaagc

SEQ ID NO: 259160 - DNA, 25 bp, Mus musculus
tcggtgcactgcagggagcaaacct

SEQ ID NO: 259161 - DNA, 25 bp, Mus musculus
tccagctcttcgtaaagccgggatc

SEQ ID NO: 259162 - DNA, 25 bp, Mus musculus
cacttgcaagttctggtcgcgctca

SEQ ID NO: 259163 - DNA, 25 bp, Mus musculus
tccgggatcactatcggaatcctgt

SEQ ID NO: 259164 - DNA, 25 bp, Mus musculus
tacctcggtgctttcgactgcattc

SEQ ID NO: 259165 - DNA, 25 bp, Mus musculus
tccgccattttcctccggaggagca

SEQ ID NO: 259166 - DNA, 25 bp, Mus musculus
ggaggagtgtttcatgcccataaga

SEQ ID NO: 259167 - DNA, 25 bp, Mus musculus
gcccataagagccaacaagggtttg

SEQ ID NO: 259168 - DNA, 25 bp, Mus musculus
tgtggccaggacagccacaatcaca

SEQ ID NO: 259169 - DNA, 25 bp, Mus musculus
gctgcatccagcctggcggttttgg

SEQ ID NO: 259170 - DNA, 25 bp, Mus musculus
tcgctgcatccagcctggcggtttt

SEQ ID NO: 259171 - DNA, 25 bp, Mus musculus
ctcgctgcatccagcctggcggttt

SEQ ID NO: 259172 - DNA, 25 bp, Mus musculus
cggattcccgatccctcgctgcatc

SEQ ID NO: 259173 - DNA, 25 bp, Mus musculus
acaatcacagctccggattcccgat

SEQ ID NO: 259174 - DNA, 25 bp, Mus musculus
acagccacaatcacagctccggatt

SEQ ID NO: 259175 - DNA, 25 bp, Mus musculus
ggcgcgtcccccagtctgagtgaga

SEQ ID NO: 259176 - DNA, 25 bp, Mus musculus
ggccaggacagccacaatcacagct

SEQ ID NO: 259177 - DNA, 25 bp, Mus musculus
ggctgtggccaggacagccacaatc

SEQ ID NO: 259178 - DNA, 25 bp, Mus musculus
ccaccgcgggccagtgggcaaggag

SEQ ID NO: 259179 - DNA, 25 bp, Mus musculus
tgcatccagcctggcggttttggcc

SEQ ID NO: 259180 - DNA, 25 bp, Mus musculus
ggacagccacaatcacagctccgga

SEQ ID NO: 259181 - DNA, 25 bp, Mus musculus
tcccccagtctgagtgagaggggca

SEQ ID NO: 259182 - DNA, 25 bp, Mus musculus
cggcttggcaaagtccgagtccttg

SEQ ID NO: 259183 - DNA, 25 bp, Mus musculus
agccctgactctcgactctgaaatc

SEQ ID NO: 259184 - DNA, 25 bp, Mus musculus
aagctggctgttggagcttcgcacg

SEQ ID NO: 259185 - DNA, 25 bp, Mus musculus
ctctgcacccgcgagcaatagcgga

SEQ ID NO: 259186 - DNA, 25 bp, Mus musculus
atagcggagcaaccaactgccgggg

SEQ ID NO: 259187 - DNA, 25 bp, Mus musculus
gctctgcggcactgttataagcacg

SEQ ID NO: 259188 - DNA, 25 bp, Mus musculus
cggctcgcctgcgtaactaggcttc

SEQ ID NO: 259189 - DNA, 25 bp, Mus musculus
ggcttctttagggaggctgcaattt

SEQ ID NO: 259190 - DNA, 25 bp, Mus musculus
tgcaatttgactgctctttcccggg

SEQ ID NO: 259191 - DNA, 25 bp, Mus musculus
accggacgcagcactcgaggcgaaa

SEQ ID NO: 259192 - DNA, 25 bp, Mus musculus
agagagcctcggatccgctgcagct

SEQ ID NO: 259193 - DNA, 25 bp, Mus musculus
tgggcttgccctgcgaaattccagc

SEQ ID NO: 259194 - DNA, 25 bp, Mus musculus
cgagtccttgctgtccaaagatgga

SEQ ID NO: 259195 - DNA, 25 bp, Mus musculus
ccggtggatcgaagaatcctcgcta

SEQ ID NO: 259196 - DNA, 25 bp, Mus musculus
tcaccgcgcttggactcggtgtggc

SEQ ID NO: 259197 - DNA, 25 bp, Mus musculus
actcaccgcgcttggactcggtgtg

SEQ ID NO: 259198 - DNA, 25 bp, Mus musculus
ccaccctgctaggaatccgatcgag

SEQ ID NO: 259199 - DNA, 25 bp, Mus musculus
gcactcaccgcgcttggactcggtg

SEQ ID NO: 259200 - DNA, 25 bp, Mus musculus
cgccgcgctgaaccccagcaacttc

SEQ ID NO: 259201 - DNA, 25 bp, Mus musculus
ggtgacaagcccctcacgtcccggc

SEQ ID NO: 259202 - DNA, 25 bp, Mus musculus
taggaatccgatcgaggccgggccc

SEQ ID NO: 259203 - DNA, 25 bp, Mus musculus
cccagactcccaccctgctaggaat

SEQ ID NO: 259204 - DNA, 25 bp, Mus musculus
ctaggaatccgatcgaggccgggcc

SEQ ID NO: 259205 - DNA, 25 bp, Mus musculus
cctgctaggaatccgatcgaggccg

SEQ ID NO: 259206 - DNA, 25 bp, Mus musculus
ccctgctaggaatccgatcgaggcc

SEQ ID NO: 259207 - DNA, 25 bp, Mus musculus
accctgctaggaatccgatcgaggc

SEQ ID NO: 259208 - DNA, 25 bp, Mus musculus
caccctgctaggaatccgatcgagg

SEQ ID NO: 259209 - DNA, 25 bp, Mus musculus
cgcgcttggactcggtgtggcgccc

SEQ ID NO: 259210 - DNA, 25 bp, Mus musculus
tctacggccgatccgctgcacctac

SEQ ID NO: 259211 - DNA, 25 bp, Mus musculus
acgagggcggaacgtaggcaggcaa

SEQ ID NO: 259212 - DNA, 25 bp, Mus musculus
tggaagctcactgccggtcgcgtgc

SEQ ID NO: 259213 - DNA, 25 bp, Mus musculus
ccagtggaagctcactgccggtcgc

SEQ ID NO: 259214 - DNA, 25 bp, Mus musculus
ctacccagtggaagctcactgccgg

SEQ ID NO: 259215 - DNA, 25 bp, Mus musculus
tccttgctgggttatcaccgctgcc

SEQ ID NO: 259216 - DNA, 25 bp, Mus musculus
atgcgactctgcttccttgctgggt

SEQ ID NO: 259217 - DNA, 25 bp, Mus musculus
acggggtctctacggccgatccgct

SEQ ID NO: 259218 - DNA, 25 bp, Mus musculus
cttcctgagtccgacggggtctcta

SEQ ID NO: 259219 - DNA, 25 bp, Mus musculus
cgagcggctgacagtgccttcctga

SEQ ID NO: 259220 - DNA, 25 bp, Mus musculus
cgctccgagcggctgacagtgcctt

SEQ ID NO: 259221 - DNA, 25 bp, Mus musculus
tgcttccttgctgggttatcaccgc

SEQ ID NO: 259222 - DNA, 25 bp, Mus musculus
actctgcttccttgctgggttatca

SEQ ID NO: 259223 - DNA, 25 bp, Mus musculus
ttgctgggttatcaccgctgcccgg

SEQ ID NO: 259224 - DNA, 25 bp, Mus musculus
acgcgggtgtcctccgaactcagca

SEQ ID NO: 259225 - DNA, 25 bp, Mus musculus
aggaagcaggaactcccggctctgc

SEQ ID NO: 259226 - DNA, 25 bp, Mus musculus
cactcgctccgggagcaggaagcag

SEQ ID NO: 259227 - DNA, 25 bp, Mus musculus
acggaggacactcgctccgggagca

SEQ ID NO: 259228 - DNA, 25 bp, Mus musculus
cccgaggctgctacggaggacactc

SEQ ID NO: 259229 - DNA, 25 bp, Mus musculus
ctgcgctcctggagtacgcggacag

SEQ ID NO: 259230 - DNA, 25 bp, Mus musculus
gcgttgagtcctaactgtctctcca

SEQ ID NO: 259231 - DNA, 25 bp, Mus musculus
ccgggttgcgttgagtcctaactgt

SEQ ID NO: 259232 - DNA, 25 bp, Mus musculus
tgatctaccgatttcccgctctcat

SEQ ID NO: 259233 - DNA, 25 bp, Mus musculus
cccttgactctgatctaccgatttc

SEQ ID NO: 259234 - DNA, 25 bp, Mus musculus
cacccgcacctttgggaggagaccg

SEQ ID NO: 259235 - DNA, 25 bp, Mus musculus
gctgccacccgcacctttgggagga

SEQ ID NO: 259236 - DNA, 25 bp, Mus musculus
tcagcagccttaccggtcccagggt

SEQ ID NO: 259237 - DNA, 25 bp, Mus musculus
gtgtcctccgaactcagcagcctta

SEQ ID NO: 259238 - DNA, 25 bp, Mus musculus
ttccaggaaagagacgcgagagcgc

SEQ ID NO: 259239 - DNA, 25 bp, Mus musculus
tgactgccaaatgcaacggccttgg

SEQ ID NO: 259240 - DNA, 25 bp, Mus musculus
ttgcaaatgagggaatcggaggccc

SEQ ID NO: 259241 - DNA, 25 bp, Mus musculus
ggaaccaattaaccatcactcgcga

SEQ ID NO: 259242 - DNA, 25 bp, Mus musculus
agagtgccctccttccagctcagtt

SEQ ID NO: 259243 - DNA, 25 bp, Mus musculus
agctcagttctgatcctactcgtga

SEQ ID NO: 259244 - DNA, 25 bp, Mus musculus
cgaacgcattgcaagtaagggaatc

SEQ ID NO: 259245 - DNA, 25 bp, Mus musculus
gcgagctggtccagggtaaactcca

SEQ ID NO: 259246 - DNA, 25 bp, Mus musculus
taaactccaggggagcggctcaaga

SEQ ID NO: 259247 - DNA, 25 bp, Mus musculus
cacgggatgcacagcgcattgcaaa

SEQ ID NO: 259248 - DNA, 25 bp, Mus musculus
gtcggaagagtctgctgctccattc

SEQ ID NO: 259249 - DNA, 25 bp, Mus musculus
cctctcactggcaaatggcgttagc

SEQ ID NO: 259250 - DNA, 25 bp, Mus musculus
ggactcgttccagaattccgcaatg

SEQ ID NO: 259251 - DNA, 25 bp, Mus musculus
gaccggtggcatcagcgtccagacc

SEQ ID NO: 259252 - DNA, 25 bp, Mus musculus
ttcgcggccacattccgggtcaaga

SEQ ID NO: 259253 - DNA, 25 bp, Mus musculus
caggttacccaatggcggcgacttt

SEQ ID NO: 259254 - DNA, 25 bp, Mus musculus
tgcggaggtgaaacgtcagaactct

SEQ ID NO: 259255 - DNA, 25 bp, Mus musculus
ctctgagagcagtaaggttcctttg

SEQ ID NO: 259256 - DNA, 25 bp, Mus musculus
ttccggtgtccagctccgtacacgt

SEQ ID NO: 259257 - DNA, 25 bp, Mus musculus
ctgccagatgctgacgtgtcctttc

SEQ ID NO: 259258 - DNA, 25 bp, Mus musculus
atcagctctttcagcgcttcctgga

SEQ ID NO: 259259 - DNA, 25 bp, Mus musculus
cggagcttcataaagagagtgccta

SEQ ID NO: 259260 - DNA, 25 bp, Mus musculus
agagtgcctattggcttgagttcca

SEQ ID NO: 259261 - DNA, 25 bp, Mus musculus
gcgggttctggacgctaattggcta

SEQ ID NO: 259262 - DNA, 25 bp, Mus musculus
gagatcgcgtctcctcttttgctcc

SEQ ID NO: 259263 - DNA, 25 bp, Mus musculus
tcccagtcccgctggtgttctagtg

SEQ ID NO: 259264 - DNA, 25 bp, Mus musculus
tgcctgctccttgtcgctgcaagcg

SEQ ID NO: 259265 - DNA, 25 bp, Mus musculus
cgggtcaagactaacatcagcaggt

SEQ ID NO: 259266 - DNA, 25 bp, Mus musculus
ctcctcaggacaccgagcgttcggg

SEQ ID NO: 259267 - DNA, 25 bp, Mus musculus
ctgtatcctccgctcttatcgtaaa

SEQ ID NO: 259268 - DNA, 25 bp, Mus musculus
cgctcttatcgtaaagtacttcgag

SEQ ID NO: 259269 - DNA, 25 bp, Mus musculus
tacttcgagggaataaacgatcgtc

SEQ ID NO: 259270 - DNA, 25 bp, Mus musculus
ataaacgatcgtccggacacctcgg

SEQ ID NO: 259271 - DNA, 25 bp, Mus musculus
ggagccacgtaaccgcaagtctagg

SEQ ID NO: 259272 - DNA, 25 bp, Mus musculus
tgtcccggaaggaagtcgaccactg

SEQ ID NO: 259273 - DNA, 25 bp, Mus musculus
acccggagacaagccggtgccgatt

SEQ ID NO: 259274 - DNA, 25 bp, Mus musculus
attggcgacgctccgtcacgtgacc

SEQ ID NO: 259275 - DNA, 25 bp, Mus musculus
gccggcgccaatttcaaacagcgga

SEQ ID NO: 259276 - DNA, 25 bp, Mus musculus
cggaacaactgaaagcggcgctgcg

SEQ ID NO: 259277 - DNA, 25 bp, Mus musculus
accgccgggaagaaggtctgagcct

SEQ ID NO: 259278 - DNA, 25 bp, Mus musculus
aagaaggtctgagcctccggcctcg

SEQ ID NO: 259279 - DNA, 25 bp, Mus musculus
tctagggccagaaacccaagccgga

SEQ ID NO: 259280 - DNA, 25 bp, Mus musculus
gcaagcgcacaacacgccatcgtgt

SEQ ID NO: 259281 - DNA, 25 bp, Mus musculus
gccatgttgactccagtgcgcaagc

SEQ ID NO: 259282 - DNA, 25 bp, Mus musculus
ctccgcccaaatgcagtggtttgca

SEQ ID NO: 259283 - DNA, 25 bp, Mus musculus
gtcaggccaccgaaccggaagtcta

SEQ ID NO: 259284 - DNA, 25 bp, Mus musculus
cgcgtcgttatccacgtctccgagg

SEQ ID NO: 259285 - DNA, 25 bp, Mus musculus
tgcgcatgcactcaccgcgtcgtta

SEQ ID NO: 259286 - DNA, 25 bp, Mus musculus
cagtggtttgcagtgcgcatgcact

SEQ ID NO: 259287 - DNA, 25 bp, Mus musculus
cgtgcgggaagagactcccgctgaa

SEQ ID NO: 259288 - DNA, 25 bp, Mus musculus
agcgccacgcgctgcacataactaa

SEQ ID NO: 259289 - DNA, 25 bp, Mus musculus
tgcacataactaaccgacctcatgg

SEQ ID NO: 259290 - DNA, 25 bp, Mus musculus
acctcatggcactctggagggctga

SEQ ID NO: 259291 - DNA, 25 bp, Mus musculus
gtgccgggccactgcaccaaaacga

SEQ ID NO: 259292 - DNA, 25 bp, Mus musculus
tcaggacagccgtgcacgcgtgtca

SEQ ID NO: 259293 - DNA, 25 bp, Mus musculus
tccacgtctccgaggcagatggcgt

SEQ ID NO: 259294 - DNA, 25 bp, Mus musculus
caatcacgagcatcagggaaagggc

SEQ ID NO: 259295 - DNA, 25 bp, Mus musculus
gacggctccttctgaccaatgggtt

SEQ ID NO: 259296 - DNA, 25 bp, Mus musculus
tcatggacctatccaaaaggtaccg

SEQ ID NO: 259297 - DNA, 25 bp, Mus musculus
gccaatggcgcggtgccaatcacga

SEQ ID NO: 259298 - DNA, 25 bp, Mus musculus
aagctgtccgctccgccgcgaggga

SEQ ID NO: 259299 - DNA, 25 bp, Mus musculus
agctagagcccattcccggcagcga

SEQ ID NO: 259300 - DNA, 25 bp, Mus musculus
agctggccgatagctccgaggctga

SEQ ID NO: 259301 - DNA, 25 bp, Mus musculus
ggactcggcggtgtcgcacctcatc

SEQ ID NO: 259302 - DNA, 25 bp, Mus musculus
gcgggtcacgctggaccacatcatc

SEQ ID NO: 259303 - DNA, 25 bp, Mus musculus
ggaccacatcatcgaggacgcgctc

SEQ ID NO: 259304 - DNA, 25 bp, Mus musculus
aggacgcgctcgtcgtgtcgttccg

SEQ ID NO: 259305 - DNA, 25 bp, Mus musculus
tgtcgttccgcctcggggagaagct

SEQ ID NO: 259306 - DNA, 25 bp, Mus musculus
cttctccggggtcctcatggaccta

SEQ ID NO: 259307 - DNA, 25 bp, Mus musculus
accaatgggttgacagaagtgcgga

SEQ ID NO: 259308 - DNA, 25 bp, Mus musculus
cctggcgcaccttcgtccaggtgga

SEQ ID NO: 259309 - DNA, 25 bp, Mus musculus
ttaactttcaagtgggcgagccctg

SEQ ID NO: 259310 - DNA, 25 bp, Mus musculus
gccttcatctcctcggcggtcatgg

SEQ ID NO: 259311 - DNA, 25 bp, Mus musculus
ggcgcagaaaggcacaaagggcttt

SEQ ID NO: 259312 - DNA, 25 bp, Mus musculus
agcctgcgcagggaagacgaatccc

SEQ ID NO: 259313 - DNA, 25 bp, Mus musculus
cgtgccgttttcagggctgcagcct

SEQ ID NO: 259314 - DNA, 25 bp, Mus musculus
tctcggcgattgcaaaaggggcgca

SEQ ID NO: 259315 - DNA, 25 bp, Mus musculus
tgacctcgctggatctcggcgattg

SEQ ID NO: 259316 - DNA, 25 bp, Mus musculus
cgaggaactacaggtcccggcatgc

SEQ ID NO: 259317 - DNA, 25 bp, Mus musculus
cgctggctctaaggcaatgcacctc

SEQ ID NO: 259318 - DNA, 25 bp, Mus musculus
gggagccgtttcaggtcctagctaa

SEQ ID NO: 259319 - DNA, 25 bp, Mus musculus
gggctgatgtccactccttcgagag

SEQ ID NO: 259320 - DNA, 25 bp, Mus musculus
ccctcgtcctgtttggggctgatgt

SEQ ID NO: 259321 - DNA, 25 bp, Mus musculus
ccgcacagtgcagccggatcgagtt

SEQ ID NO: 259322 - DNA, 25 bp, Mus musculus
gcccgtgtaacactagcaaaatgga

SEQ ID NO: 259323 - DNA, 25 bp, Mus musculus
ctagcaaaatggaacagaagggtcg

SEQ ID NO: 259324 - DNA, 25 bp, Mus musculus
gcttcgcccgtgtaacactagcaaa

SEQ ID NO: 259325 - DNA, 25 bp, Mus musculus
tggaacagaagggtcgggagaactg

SEQ ID NO: 259326 - DNA, 25 bp, Mus musculus
cgtggccgtacgtcattgccattga

SEQ ID NO: 259327 - DNA, 25 bp, Mus musculus
tgtaacactagcaaaatggaacaga

SEQ ID NO: 259328 - DNA, 25 bp, Mus musculus
ccgtgtaacactagcaaaatggaac

SEQ ID NO: 259329 - DNA, 25 bp, Mus musculus
tcgcccgtgtaacactagcaaaatg

SEQ ID NO: 259330 - DNA, 25 bp, Mus musculus
gctgcttcgcccgtgtaacactagc

SEQ ID NO: 259331 - DNA, 25 bp, Mus musculus
tgatctttcgtcattccccgaattc

SEQ ID NO: 259332 - DNA, 25 bp, Mus musculus
ttgccattgatctttcgtcattccc

SEQ ID NO: 259333 - DNA, 25 bp, Mus musculus
cattgccattgatctttcgtcattc

SEQ ID NO: 259334 - DNA, 25 bp, Mus musculus
tggccgtacgtcattgccattgatc

SEQ ID NO: 259335 - DNA, 25 bp, Mus musculus
tcgggagaactgaggacatggattg

SEQ ID NO: 259336 - DNA, 25 bp, Mus musculus
gcgaccatttctcgccggccgacta

SEQ ID NO: 259337 - DNA, 25 bp, Mus musculus
agctgcactggtgcctatgcgcccg

SEQ ID NO: 259338 - DNA, 25 bp, Mus musculus
tgagctgcactggtgcctatgcgcc

SEQ ID NO: 259339 - DNA, 25 bp, Mus musculus
gtgtgagctgcactggtgcctatgc

SEQ ID NO: 259340 - DNA, 25 bp, Mus musculus
agcgtgtgagctgcactggtgccta

SEQ ID NO: 259341 - DNA, 25 bp, Mus musculus
cagctctgcgtggacaagagcgtgt

SEQ ID NO: 259342 - DNA, 25 bp, Mus musculus
tgcagctctgcgtggacaagagcgt

SEQ ID NO: 259343 - DNA, 25 bp, Mus musculus
cgtgtgcagctctgcgtggacaaga

SEQ ID NO: 259344 - DNA, 25 bp, Mus musculus
gaagcgtggcgtggggagaagacag

SEQ ID NO: 259345 - DNA, 25 bp, Mus musculus
ggtcgtgtcaggacggaagcgtggc

SEQ ID NO: 259346 - DNA, 25 bp, Mus musculus
ggccgactactgatcgctgcttcgc

SEQ ID NO: 259347 - DNA, 25 bp, Mus musculus
cggccgactactgatcgctgcttcg

SEQ ID NO: 259348 - DNA, 25 bp, Mus musculus
gccggccgactactgatcgctgctt

SEQ ID NO: 259349 - DNA, 25 bp, Mus musculus
gacgcgaaggatgcgatctgggtgc

SEQ ID NO: 259350 - DNA, 25 bp, Mus musculus
ttggcttgcgccctcttgcagtgcc

SEQ ID NO: 259351 - DNA, 25 bp, Mus musculus
gcagacacaatggtccaggtaaaga

SEQ ID NO: 259352 - DNA, 25 bp, Mus musculus
tgtattcctccttggcttgcgccct

SEQ ID NO: 259353 - DNA, 25 bp, Mus musculus
ttcctctgaattctctgtattcctc

SEQ ID NO: 259354 - DNA, 25 bp, Mus musculus
cttgcagtgcccagggctttttcta

SEQ ID NO: 259355 - DNA, 25 bp, Mus musculus
ccagggctttttctaggtaagcaga

SEQ ID NO: 259356 - DNA, 25 bp, Mus musculus
cttcaggcgtgcattcctctgaatt

SEQ ID NO: 259357 - DNA, 25 bp, Mus musculus
tctctgtattcctccttggcttgcg

SEQ ID NO: 259358 - DNA, 25 bp, Mus musculus
cccagcaaacacactcccgcacctt

SEQ ID NO: 259359 - DNA, 25 bp, Mus musculus
tccaggtaaagagactgcagaatta

SEQ ID NO: 259360 - DNA, 25 bp, Mus musculus
caatggtccaggtaaagagactgca

SEQ ID NO: 259361 - DNA, 25 bp, Mus musculus
ttctaggtaagcagacacaatggtc

SEQ ID NO: 259362 - DNA, 25 bp, Mus musculus
cagtgcccagggctttttctaggta

SEQ ID NO: 259363 - DNA, 25 bp, Mus musculus
gcaccttcaggcgtgcattcctctg

SEQ ID NO: 259364 - DNA, 25 bp, Mus musculus
ccgttcagagaaaatgttcgctgca

SEQ ID NO: 259365 - DNA, 25 bp, Mus musculus
tcagaaacaggctcagcggaagcgc

SEQ ID NO: 259366 - DNA, 25 bp, Mus musculus
gtgaggattacttagagtcagaaac

SEQ ID NO: 259367 - DNA, 25 bp, Mus musculus
cgcttcgagtgttcggttttatgta

SEQ ID NO: 259368 - DNA, 25 bp, Mus musculus
tgttcgctgcaaagagtccgttttt

SEQ ID NO: 259369 - DNA, 25 bp, Mus musculus
cagccaccgttcagagaaaatgttc

SEQ ID NO: 259370 - DNA, 25 bp, Mus musculus
cgagtcagcagccaccgttcagaga

SEQ ID NO: 259371 - DNA, 25 bp, Mus musculus
tctgcacgtgcggaacgagtcagca

SEQ ID NO: 259372 - DNA, 25 bp, Mus musculus
ttttctacagttctgcacgtgcgga

SEQ ID NO: 259373 - DNA, 25 bp, Mus musculus
gccctctcgcgacccttttctacag

SEQ ID NO: 259374 - DNA, 25 bp, Mus musculus
gccttctctacaatccgcctgctta

SEQ ID NO: 259375 - DNA, 25 bp, Mus musculus
ggctactgctccacgctgcttacaa

SEQ ID NO: 259376 - DNA, 25 bp, Mus musculus
gaaccagcttcttcagccgcaccgg

SEQ ID NO: 259377 - DNA, 25 bp, Mus musculus
agtccgttttttctcgcttcgagtg

SEQ ID NO: 259378 - DNA, 25 bp, Mus musculus
tacagactcatccacgcgcgggctg

SEQ ID NO: 259379 - DNA, 25 bp, Mus musculus
ggctccacggttacagagatccttc

SEQ ID NO: 259380 - DNA, 25 bp, Mus musculus
gagacttacggctgagcgcgcagtc

SEQ ID NO: 259381 - DNA, 25 bp, Mus musculus
cgtgcgtcactaagaagacgcttca

SEQ ID NO: 259382 - DNA, 25 bp, Mus musculus
taccagttagcgtgcgtcactaaga

SEQ ID NO: 259383 - DNA, 25 bp, Mus musculus
gagtgctattggctccacggttaca

SEQ ID NO: 259384 - DNA, 25 bp, Mus musculus
gatccttccgctaaataccagttag

SEQ ID NO: 259385 - DNA, 25 bp, Mus musculus
tagcgagtacagactcatccacgcg

SEQ ID NO: 259386 - DNA, 25 bp, Mus musculus
gacagacggagtgctattggctcca

SEQ ID NO: 259387 - DNA, 25 bp, Mus musculus
ctcagcggagagtttgtgtaaagcc

SEQ ID NO: 259388 - DNA, 25 bp, Mus musculus
agaccttccgggattgttgcgggtg

SEQ ID NO: 259389 - DNA, 25 bp, Mus musculus
cggttacagagatccttccgctaaa

SEQ ID NO: 259390 - DNA, 25 bp, Mus musculus
atcttccgctgtgaatgtggagggc

SEQ ID NO: 259391 - DNA, 25 bp, Mus musculus
cgaaaaggtagaggaatagcgagta

SEQ ID NO: 259392 - DNA, 25 bp, Mus musculus
ggtgtttttgtgtttccagctcttg

SEQ ID NO: 259393 - DNA, 25 bp, Mus musculus
gtggccagacgcgagacgcagtcat

SEQ ID NO: 259394 - DNA, 25 bp, Mus musculus
tgtgataaggctgacattgactggg

SEQ ID NO: 259395 - DNA, 25 bp, Mus musculus
tggagcgattgtgataaggctgaca

SEQ ID NO: 259396 - DNA, 25 bp, Mus musculus
ttagccacgtagtgcggcgactggc

SEQ ID NO: 259397 - DNA, 25 bp, Mus musculus
ccttctctggacgtttagccacgta

SEQ ID NO: 259398 - DNA, 25 bp, Mus musculus
ccaggtccttctctggacgtttagc

SEQ ID NO: 259399 - DNA, 25 bp, Mus musculus
ggccgcgagatctccaggtccttct

SEQ ID NO: 259400 - DNA, 25 bp, Mus musculus
tcctttaccttcaggccgcgagatc

SEQ ID NO: 259401 - DNA, 25 bp, Mus musculus
ccagctcttgggaaaagccacccta

SEQ ID NO: 259402 - DNA, 25 bp, Mus musculus
acagcaccgccctggtgtttttgtg

SEQ ID NO: 259403 - DNA, 25 bp, Mus musculus
gggcgtcgtgatgtcacagcaccgc

SEQ ID NO: 259404 - DNA, 25 bp, Mus musculus
cgagacgcagtcatcagcgcgcgca

SEQ ID NO: 259405 - DNA, 25 bp, Mus musculus
ctggtggtcctttaccttcaggccg

SEQ ID NO: 259406 - DNA, 25 bp, Mus musculus
gcccttatgcccgacgtagtagcga

SEQ ID NO: 259407 - DNA, 25 bp, Mus musculus
acttgcccttatgcccgacgtagta

SEQ ID NO: 259408 - DNA, 25 bp, Mus musculus
gcgcgtcaccaagggcgcgtttact

SEQ ID NO: 259409 - DNA, 25 bp, Mus musculus
gcgaaggtagaaatcactacccata

SEQ ID NO: 259410 - DNA, 25 bp, Mus musculus
caaacttgcccttatgcccgacgta

SEQ ID NO: 259411 - DNA, 25 bp, Mus musculus
tccaaaaactcgtgcccaaacttgc

SEQ ID NO: 259412 - DNA, 25 bp, Mus musculus
tgcccgacgtagtagcgaaggtaga

SEQ ID NO: 259413 - DNA, 25 bp, Mus musculus
tcgaactccaaaaactcgtgcccaa

SEQ ID NO: 259414 - DNA, 25 bp, Mus musculus
ctacccatagacatttttaccctcg

SEQ ID NO: 259415 - DNA, 25 bp, Mus musculus
taaagcccgctataccgcggggcca

SEQ ID NO: 259416 - DNA, 25 bp, Mus musculus
caggcaaagcgcgtcaccaagggcg

SEQ ID NO: 259417 - DNA, 25 bp, Mus musculus
gccgctcaccgtccggccgaaactc

SEQ ID NO: 259418 - DNA, 25 bp, Mus musculus
cgacgtagtagcgaaggtagaaatc

SEQ ID NO: 259419 - DNA, 25 bp, Mus musculus
cacgggcgcaggcaaagcgcgtcac

SEQ ID NO: 259420 - DNA, 25 bp, Mus musculus
gctgacgcatactgttctagggaga

SEQ ID NO: 259421 - DNA, 25 bp, Mus musculus
cggcagctgattgcagtcgtgagct

SEQ ID NO: 259422 - DNA, 25 bp, Mus musculus
tcttcgcctcttctcggaagggtta

SEQ ID NO: 259423 - DNA, 25 bp, Mus musculus
aactgggctcagttctccagtcccg

SEQ ID NO: 259424 - DNA, 25 bp, Mus musculus
ctgccgcctgccctcaaggggttaa

SEQ ID NO: 259425 - DNA, 25 bp, Mus musculus
acccagtccgcgaacggaggagcgc

SEQ ID NO: 259426 - DNA, 25 bp, Mus musculus
tcccggagccttcagcaacggagct

SEQ ID NO: 259427 - DNA, 25 bp, Mus musculus
aaacgctccgaagccggtgaacatg

SEQ ID NO: 259428 - DNA, 25 bp, Mus musculus
cgcagactgctctctcatccttttg

SEQ ID NO: 259429 - DNA, 25 bp, Mus musculus
ttaagaggtgttcgctgcgccttcg

SEQ ID NO: 259430 - DNA, 25 bp, Mus musculus
aacgtgaatgtactgctgacgcata

SEQ ID NO: 259431 - DNA, 25 bp, Mus musculus
tctagggagaagattagcgtgatgc

SEQ ID NO: 259432 - DNA, 25 bp, Mus musculus
cgtgatgcagtgctcttatgtatta

SEQ ID NO: 259433 - DNA, 25 bp, Mus musculus
cttttgtccttcagtcagaacgtga

SEQ ID NO: 259434 - DNA, 25 bp, Mus musculus
gctactcggcaaggctcccggagct

SEQ ID NO: 259435 - DNA, 25 bp, Mus musculus
gcggtctcgctggatctcccggccc

SEQ ID NO: 259436 - DNA, 25 bp, Mus musculus
cgcctcgctcatgccgcctctccgc

SEQ ID NO: 259437 - DNA, 25 bp, Mus musculus
tctccgctctctccgggcacctcgg

SEQ ID NO: 259438 - DNA, 25 bp, Mus musculus
cagtcgcggcgtccggctcgctctc

SEQ ID NO: 259439 - DNA, 25 bp, Mus musculus
gcgcgctcgcggtctcgctggatct

SEQ ID NO: 259440 - DNA, 25 bp, Mus musculus
gggaaagccgccgtagctgcttatt

SEQ ID NO: 259441 - DNA, 25 bp, Mus musculus
aagccgccgtagctgcttattagca

SEQ ID NO: 259442 - DNA, 25 bp, Mus musculus
cgccgtagctgcttattagcattta

SEQ ID NO: 259443 - DNA, 25 bp, Mus musculus
tattagcatttaaaggcgcccgcgc

SEQ ID NO: 259444 - DNA, 25 bp, Mus musculus
aaggcgcccgcgctactcggcaagg

SEQ ID NO: 259445 - DNA, 25 bp, Mus musculus
actcggcaaggctcccggagctggt

SEQ ID NO: 259446 - DNA, 25 bp, Mus musculus
ccggagctggttagtccggggatgc

SEQ ID NO: 259447 - DNA, 25 bp, Mus musculus
ttagcatttaaaggcgcccgcgcta

SEQ ID NO: 259448 - DNA, 25 bp, Mus musculus
tgcgaaagtccacttcacacgtcgg

SEQ ID NO: 259449 - DNA, 25 bp, Mus musculus
cacacgtcggtatcagagtcccagc

SEQ ID NO: 259450 - DNA, 25 bp, Mus musculus
cggtatcagagtcccagctcaggtt

SEQ ID NO: 259451 - DNA, 25 bp, Mus musculus
tcagagtcccagctcaggttctctc

SEQ ID NO: 259452 - DNA, 25 bp, Mus musculus
ggtacaggaacgaagaaaatgactc

SEQ ID NO: 259453 - DNA, 25 bp, Mus musculus
tgactcttctctgaagacgggactg

SEQ ID NO: 259454 - DNA, 25 bp, Mus musculus
ctgaagacgggactggagaaaattc

SEQ ID NO: 259455 - DNA, 25 bp, Mus musculus
agaaaattcggagtggcaagctggc

SEQ ID NO: 259456 - DNA, 25 bp, Mus musculus
caagctggcgcctaagccgcagtct

SEQ ID NO: 259457 - DNA, 25 bp, Mus musculus
gcgcctaagccgcagtctcgatgca

SEQ ID NO: 259458 - DNA, 25 bp, Mus musculus
gtccacttcacacgtcggtatcaga

SEQ ID NO: 259459 - DNA, 25 bp, Mus musculus
cagaaaaaccgagtccctcagaagg

SEQ ID NO: 259460 - DNA, 25 bp, Mus musculus
ccttcagaaaaaccgagtccctcag

SEQ ID NO: 259461 - DNA, 25 bp, Mus musculus
tccacccgctcagcaggtgaggccc

SEQ ID NO: 259462 - DNA, 25 bp, Mus musculus
tacctcggccgccactagcacaggc

SEQ ID NO: 259463 - DNA, 25 bp, Mus musculus
agccggggctcatccgagaggaacc

SEQ ID NO: 259464 - DNA, 25 bp, Mus musculus
cgcctcctgactccgggactggccc

SEQ ID NO: 259465 - DNA, 25 bp, Mus musculus
ggacactgccctgccggcttttgag

SEQ ID NO: 259466 - DNA, 25 bp, Mus musculus
ctgccggcttttgagctgccagata

SEQ ID NO: 259467 - DNA, 25 bp, Mus musculus
cggcttttgagctgccagatacctc

SEQ ID NO: 259468 - DNA, 25 bp, Mus musculus
gaaccgggcggctaccagacatcgt

SEQ ID NO: 259469 - DNA, 25 bp, Mus musculus
ttgagctgccagatacctcggccgc

SEQ ID NO: 259470 - DNA, 25 bp, Mus musculus
accgggcggctaccagacatcgtga

SEQ ID NO: 259471 - DNA, 25 bp, Mus musculus
tctcccttggccctgctctctgagg

SEQ ID NO: 259472 - DNA, 25 bp, Mus musculus
cctgctctctgaggcgagggcccag

SEQ ID NO: 259473 - DNA, 25 bp, Mus musculus
agcatcctgaggacgtgcccggagg

SEQ ID NO: 259474 - DNA, 25 bp, Mus musculus
caaagttaagctttccaaccgcagc

SEQ ID NO: 259475 - DNA, 25 bp, Mus musculus
taagctttccaaccgcagcgtccta

SEQ ID NO: 259476 - DNA, 25 bp, Mus musculus
tcgccttcttcgagctggcctggca

SEQ ID NO: 259477 - DNA, 25 bp, Mus musculus
agcgcgagaagaacgtgcaatcttg

SEQ ID NO: 259478 - DNA, 25 bp, Mus musculus
aactgcacggagcttcggagaccct

SEQ ID NO: 259479 - DNA, 25 bp, Mus musculus
gcggcaccttcaagaagcgcgagaa

SEQ ID NO: 259480 - DNA, 25 bp, Mus musculus
cccgtatggtgtcttctgcaagggg

SEQ ID NO: 259481 - DNA, 25 bp, Mus musculus
gctgcgcatgaacttcccgtacttc

SEQ ID NO: 259482 - DNA, 25 bp, Mus musculus
gtgcaatcttgcgagagctggcttg

SEQ ID NO: 259483 - DNA, 25 bp, Mus musculus
gtacttctacatcgcgggctccgtg

SEQ ID NO: 259484 - DNA, 25 bp, Mus musculus
gatcctcaacatccgcctgcaggta

SEQ ID NO: 259485 - DNA, 25 bp, Mus musculus
tccgcctgcaggtacacatttagag

SEQ ID NO: 259486 - DNA, 25 bp, Mus musculus
atttagagccttgtctgcgttgccc

SEQ ID NO: 259487 - DNA, 25 bp, Mus musculus
ggaccgcaagatggccgcttcccag

SEQ ID NO: 259488 - DNA, 25 bp, Mus musculus
ccacggctcatctggctcgggaact

SEQ ID NO: 259489 - DNA, 25 bp, Mus musculus
agaccctcggcctggtgggacaacg

SEQ ID NO: 259490 - DNA, 25 bp, Mus musculus
gaacttcctgatccctttcgctgtg

SEQ ID NO: 259491 - DNA, 25 bp, Mus musculus
tgtaacccgagctcccatttcctgg

SEQ ID NO: 259492 - DNA, 25 bp, Mus musculus
cctggtggattctcttaaagcggcc

SEQ ID NO: 259493 - DNA, 25 bp, Mus musculus
tcgccgcgcagaacaaaggccattg

SEQ ID NO: 259494 - DNA, 25 bp, Mus musculus
ctgcatttgcgcctctgggagtgca

SEQ ID NO: 259495 - DNA, 25 bp, Mus musculus
gatgaaccaggcttgctggtccttg

SEQ ID NO: 259496 - DNA, 25 bp, Mus musculus
gtccttgggccacgctgcaaggttc

SEQ ID NO: 259497 - DNA, 25 bp, Mus musculus
cgcacgccttttgatttctccgcgg

SEQ ID NO: 259498 - DNA, 25 bp, Mus musculus
ttatttcctggtggctcctttaaga

SEQ ID NO: 259499 - DNA, 25 bp, Mus musculus
tgctgggaattcacgtcagtttctg

SEQ ID NO: 259500 - DNA, 25 bp, Mus musculus
tgccctgaaactctcaagatcaatg

SEQ ID NO: 259501 - DNA, 25 bp, Mus musculus
gaccgcgcggctttgtctccagcgt

SEQ ID NO: 259502 - DNA, 25 bp, Mus musculus
cgccagcgatgctgcaagaaacttc

SEQ ID NO: 259503 - DNA, 25 bp, Mus musculus
tgagcagagagctttctcagttctg

SEQ ID NO: 259504 - DNA, 25 bp, Mus musculus
tacgctttcccgaagcggcgggcca

SEQ ID NO: 259505 - DNA, 25 bp, Mus musculus
aggcacagtctcattgccgcgggcc

SEQ ID NO: 259506 - DNA, 25 bp, Mus musculus
acctctcagcagcacgcagaagctg

SEQ ID NO: 259507 - DNA, 25 bp, Mus musculus
gggtctgcacgctcatgctttccgc

SEQ ID NO: 259508 - DNA, 25 bp, Mus musculus
tccgcggccgcgagaagaaagaaaa

SEQ ID NO: 259509 - DNA, 25 bp, Mus musculus
aagaaaagggcgcacgtcagggctc

SEQ ID NO: 259510 - DNA, 25 bp, Mus musculus
cacgctgcggggataaggtcttccc

SEQ ID NO: 259511 - DNA, 25 bp, Mus musculus
aggtcttcccgaggcgcattccgat

SEQ ID NO: 259512 - DNA, 25 bp, Mus musculus
gcgcattccgatgggattcttttcc

SEQ ID NO: 259513 - DNA, 25 bp, Mus musculus
tgtggtcgggactactttatgagta

SEQ ID NO: 259514 - DNA, 25 bp, Mus musculus
tgagtacaggactgttgccgcccgc

SEQ ID NO: 259515 - DNA, 25 bp, Mus musculus
gggacgtaggaaaatcaaagtgcca

SEQ ID NO: 259516 - DNA, 25 bp, Mus musculus
cgtagcagagatacaaggcacagtc

SEQ ID NO: 259517 - DNA, 25 bp, Mus musculus
gccattgcggcttacgctttcccga

SEQ ID NO: 259518 - DNA, 25 bp, Mus musculus
ccagaggcggaaagagacgccttta

SEQ ID NO: 259519 - DNA, 25 bp, Mus musculus
cgcttgggcccaaggacagttaggt

SEQ ID NO: 259520 - DNA, 25 bp, Mus musculus
aggacagttaggtcgcttttgcaaa

SEQ ID NO: 259521 - DNA, 25 bp, Mus musculus
ttttgcaaagaaccagcgaagcggc

SEQ ID NO: 259522 - DNA, 25 bp, Mus musculus
accggtcccgcagattttgtcgtga

SEQ ID NO: 259523 - DNA, 25 bp, Mus musculus
tttgtcgtgaccaagttcctgcttc

SEQ ID NO: 259524 - DNA, 25 bp, Mus musculus
caagttcctgcttccgtcgcagcga

SEQ ID NO: 259525 - DNA, 25 bp, Mus musculus
ccgtcgcagcgactgaaagtttgca

SEQ ID NO: 259526 - DNA, 25 bp, Mus musculus
ggagctgcttcccaggcaacatcca

SEQ ID NO: 259527 - DNA, 25 bp, Mus musculus
gatgtgcgaacctagccgccagatc

SEQ ID NO: 259528 - DNA, 25 bp, Mus musculus
acccaacgcactgagagccactaga

SEQ ID NO: 259529 - DNA, 25 bp, Mus musculus
tgactctcggggtcaccaagggtct

SEQ ID NO: 259530 - DNA, 25 bp, Mus musculus
caagggtcttaaaccgtgccgctcg

SEQ ID NO: 259531 - DNA, 25 bp, Mus musculus
gaaagagacgcctttacctgcaagc

SEQ ID NO: 259532 - DNA, 25 bp, Mus musculus
acccggaactgaaggccgcgcattg

SEQ ID NO: 259533 - DNA, 25 bp, Mus musculus
gcctctccaagtgtctgtggcccag

SEQ ID NO: 259534 - DNA, 25 bp, Mus musculus
gtgttgctggcgaagccgaccgccc

SEQ ID NO: 259535 - DNA, 25 bp, Mus musculus
caccggtgttgctggcgaagccgac

SEQ ID NO: 259536 - DNA, 25 bp, Mus musculus
tgaacgcctcaggtcggtgcctcac

SEQ ID NO: 259537 - DNA, 25 bp, Mus musculus
ccggcgatctgaacgcctcaggtcg

SEQ ID NO: 259538 - DNA, 25 bp, Mus musculus
ggtgtccctccgctgcaggggccat

SEQ ID NO: 259539 - DNA, 25 bp, Mus musculus
cagcggcgcctctccaagtgtctgt

SEQ ID NO: 259540 - DNA, 25 bp, Mus musculus
agcggcgtgctttccagcggcgcct

SEQ ID NO: 259541 - DNA, 25 bp, Mus musculus
ctgtcaacgcgagcggcgtgctttc

SEQ ID NO: 259542 - DNA, 25 bp, Mus musculus
agcctcctgtcaacgcgagcggcgt

SEQ ID NO: 259543 - DNA, 25 bp, Mus musculus
agtgaatgacagcagcgccgcccgc

SEQ ID NO: 259544 - DNA, 25 bp, Mus musculus
ccgagccagtgaatgacagcagcgc

SEQ ID NO: 259545 - DNA, 25 bp, Mus musculus
aagccaccgagccagtgaatgacag

SEQ ID NO: 259546 - DNA, 25 bp, Mus musculus
acttcaagcgcggatgaggtcatcg

SEQ ID NO: 259547 - DNA, 25 bp, Mus musculus
gagcgagcgttgtcaccgcgtcgcc

SEQ ID NO: 259548 - DNA, 25 bp, Mus musculus
cgccggggcttctcctctgaagggt

SEQ ID NO: 259549 - DNA, 25 bp, Mus musculus
cgggcgtttgcaacttttcttcact

SEQ ID NO: 259550 - DNA, 25 bp, Mus musculus
aaaaaatgtcgacagggatgaagaa

SEQ ID NO: 259551 - DNA, 25 bp, Mus musculus
cccaaacggtgatgcccgcaggagg

SEQ ID NO: 259552 - DNA, 25 bp, Mus musculus
aaagagtcgctggtcaggaaacttc

SEQ ID NO: 259553 - DNA, 25 bp, Mus musculus
agtcgctggtcaggaaacttcaagc

SEQ ID NO: 259554 - DNA, 25 bp, Mus musculus
ggatgaggtcatcggtttaaaaata

SEQ ID NO: 259555 - DNA, 25 bp, Mus musculus
taaagagatggcgtcacttgaaacc

SEQ ID NO: 259556 - DNA, 25 bp, Mus musculus
gcgtcacttgaaaccaatcccagtg

SEQ ID NO: 259557 - DNA, 25 bp, Mus musculus
ccaatcccagtgaatgaactcagcg

SEQ ID NO: 259558 - DNA, 25 bp, Mus musculus
agtgaatgaactcagcggagcccgg

SEQ ID NO: 259559 - DNA, 25 bp, Mus musculus
cgctggggtctctcctccgacggag

SEQ ID NO: 259560 - DNA, 25 bp, Mus musculus
agggtccgctctgccattcctgaac

SEQ ID NO: 259561 - DNA, 25 bp, Mus musculus
ccacaggaaaacagcccgggcagcg

SEQ ID NO: 259562 - DNA, 25 bp, Mus musculus
cagcggaggctacatggacgttgta

SEQ ID NO: 259563 - DNA, 25 bp, Mus musculus
catggacgttgtagttccttttcca

SEQ ID NO: 259564 - DNA, 25 bp, Mus musculus
tccagtcggtcgcttagagaacacg

SEQ ID NO: 259565 - DNA, 25 bp, Mus musculus
tgccactgtactatggcggccgagg

SEQ ID NO: 259566 - DNA, 25 bp, Mus musculus
cgtctgtaaacacgccgggagcctg

SEQ ID NO: 259567 - DNA, 25 bp, Mus musculus
cttcagggaagcgaactgttaggcg

SEQ ID NO: 259568 - DNA, 25 bp, Mus musculus
cctgtctgcggagatggatgacagc

SEQ ID NO: 259569 - DNA, 25 bp, Mus musculus
caaggtaagtcctgagctggccgcc

SEQ ID NO: 259570 - DNA, 25 bp, Mus musculus
tgcttgtcgccgcacgtagtctcgc

SEQ ID NO: 259571 - DNA, 25 bp, Mus musculus
gttcagaagtccacgcgagcactca

SEQ ID NO: 259572 - DNA, 25 bp, Mus musculus
ggccgcttgccagtgcgtctgtaaa

SEQ ID NO: 259573 - DNA, 25 bp, Mus musculus
tgccattcctgaactggtccgggtc

SEQ ID NO: 259574 - DNA, 25 bp, Mus musculus
aaggccgcgtccaagatccaggagg

SEQ ID NO: 259575 - DNA, 25 bp, Mus musculus
cgccatggacaccacgaagtagttg

SEQ ID NO: 259576 - DNA, 25 bp, Mus musculus
tgagaaggtcagcacacgccatgga

SEQ ID NO: 259577 - DNA, 25 bp, Mus musculus
gctggccacgctgatgagaaggtca

SEQ ID NO: 259578 - DNA, 25 bp, Mus musculus
tgaactgcagcacgacaaacggcgt

SEQ ID NO: 259579 - DNA, 25 bp, Mus musculus
gtccacctcccggtggtgaactgca

SEQ ID NO: 259580 - DNA, 25 bp, Mus musculus
tgcacatggcgctacccagggtcca

SEQ ID NO: 259581 - DNA, 25 bp, Mus musculus
gaagtagcggaccaccttgcacatg

SEQ ID NO: 259582 - DNA, 25 bp, Mus musculus
tggagagcagcacgtagatctgcac

SEQ ID NO: 259583 - DNA, 25 bp, Mus musculus
cgatggtatagaagcggtcgatgca

SEQ ID NO: 259584 - DNA, 25 bp, Mus musculus
ctcagcgggtagacgatggtataga

SEQ ID NO: 259585 - DNA, 25 bp, Mus musculus
tctcgggacaccttgaagctcagcg

SEQ ID NO: 259586 - DNA, 25 bp, Mus musculus
tttcttggccttctctcgggacacc

SEQ ID NO: 259587 - DNA, 25 bp, Mus musculus
ccaggaggctgcaatcattttcttg

SEQ ID NO: 259588 - DNA, 25 bp, Mus musculus
cccggcctgaattaatgtgttacta

SEQ ID NO: 259589 - DNA, 25 bp, Mus musculus
cgctgcccggaacggagtttctccg

SEQ ID NO: 259590 - DNA, 25 bp, Mus musculus
ccagcgctctaacacgggtaacttc

SEQ ID NO: 259591 - DNA, 25 bp, Mus musculus
caatgcaggtcagcagcagactctc

SEQ ID NO: 259592 - DNA, 25 bp, Mus musculus
tatttcgggcgagccagtgtttcca

SEQ ID NO: 259593 - DNA, 25 bp, Mus musculus
gctgcagggttacaaacagtctctc

SEQ ID NO: 259594 - DNA, 25 bp, Mus musculus
tcaaaatagtacgtgagcgctgccg

SEQ ID NO: 259595 - DNA, 25 bp, Mus musculus
cgttacccacggacatccaggaggc

SEQ ID NO: 259596 - DNA, 25 bp, Mus musculus
agagagacccagtgtggctcgcaca

SEQ ID NO: 259597 - DNA, 25 bp, Mus musculus
gcgcacagcacagcaggtccatgaa

SEQ ID NO: 259598 - DNA, 25 bp, Mus musculus
actcgaacctatccggagcaccggg

SEQ ID NO: 259599 - DNA, 25 bp, Mus musculus
tgtggagaccaacctgcggtactga

SEQ ID NO: 259600 - DNA, 25 bp, Mus musculus
ctctctgggattctataaatttgcc

SEQ ID NO: 259601 - DNA, 25 bp, Mus musculus
tttccaggggaaacctaatgacgca

SEQ ID NO: 259602 - DNA, 25 bp, Mus musculus
tgcctgcggcagctgatggagctcc

SEQ ID NO: 259603 - DNA, 25 bp, Mus musculus
gactctgccgctcatcgtggctcag

SEQ ID NO: 259604 - DNA, 25 bp, Mus musculus
tggggctcaggtcaccgactctgcc

SEQ ID NO: 259605 - DNA, 25 bp, Mus musculus
ctcctcctgtttggggctcaggtca

SEQ ID NO: 259606 - DNA, 25 bp, Mus musculus
caagagcaagctcaccttggccagt

SEQ ID NO: 259607 - DNA, 25 bp, Mus musculus
cgagggccacagacagaccaagagc

SEQ ID NO: 259608 - DNA, 25 bp, Mus musculus
ttttcagccaggagcgagggccaca

SEQ ID NO: 259609 - DNA, 25 bp, Mus musculus
ggacagtcccttacagccgcttttc

SEQ ID NO: 259610 - DNA, 25 bp, Mus musculus
aagcggtccgctgggcactagccaa

SEQ ID NO: 259611 - DNA, 25 bp, Mus musculus
cccgaggtcctcaccctgaaggaga

SEQ ID NO: 259612 - DNA, 25 bp, Mus musculus
taaagtcccagtctttggccgaggc

SEQ ID NO: 259613 - DNA, 25 bp, Mus musculus
ccgcagccgctggagtaaagtccca

SEQ ID NO: 259614 - DNA, 25 bp, Mus musculus
tcatcgtggctcagccttggggcgc

SEQ ID NO: 259615 - DNA, 25 bp, Mus musculus
atggagctccgactcgtttgccgcc

SEQ ID NO: 259616 - DNA, 25 bp, Mus musculus
tcggagccctgaaatgagaaccaca

SEQ ID NO: 259617 - DNA, 25 bp, Mus musculus
gctgacgtggatttctccgggaaaa

SEQ ID NO: 259618 - DNA, 25 bp, Mus musculus
cgcctgcgcagtgcttgtttaccgc

SEQ ID NO: 259619 - DNA, 25 bp, Mus musculus
atgctagggtttgctttggccttcc

SEQ ID NO: 259620 - DNA, 25 bp, Mus musculus
ccacaccgtcgatcgtcttaagatg

SEQ ID NO: 259621 - DNA, 25 bp, Mus musculus
tgagagtagcagaagccacaccgtc

SEQ ID NO: 259622 - DNA, 25 bp, Mus musculus
ctctcagcctcagtgtagacagtga

SEQ ID NO: 259623 - DNA, 25 bp, Mus musculus
cggagacctcatgacccatacgaga

SEQ ID NO: 259624 - DNA, 25 bp, Mus musculus
tgactcttggattcgcggagacctc

SEQ ID NO: 259625 - DNA, 25 bp, Mus musculus
ggttctcttcccactctgactcttg

SEQ ID NO: 259626 - DNA, 25 bp, Mus musculus
ctggcacaggatctcgcgttgtctg

SEQ ID NO: 259627 - DNA, 25 bp, Mus musculus
tgcacgccaccgtcgctgaagtgag

SEQ ID NO: 259628 - DNA, 25 bp, Mus musculus
agttctgaacggtttgcgcgccaaa

SEQ ID NO: 259629 - DNA, 25 bp, Mus musculus
cctgtgaccaagcaggaagttctga

SEQ ID NO: 259630 - DNA, 25 bp, Mus musculus
cccgaggaggaagatgtcaaacgtg

SEQ ID NO: 259631 - DNA, 25 bp, Mus musculus
ctaacccgggacttggagaagcact

SEQ ID NO: 259632 - DNA, 25 bp, Mus musculus
tgcagaaatctcttcggcccggtca

SEQ ID NO: 259633 - DNA, 25 bp, Mus musculus
catccgtggcgtttcgcttttgttc

SEQ ID NO: 259634 - DNA, 25 bp, Mus musculus
tcgaagagggttttgcgctccatcc

SEQ ID NO: 259635 - DNA, 25 bp, Mus musculus
gtgtgcagtcgcagaacttcgaaga

SEQ ID NO: 259636 - DNA, 25 bp, Mus musculus
gctctgctccatttgactgtctgtg

SEQ ID NO: 259637 - DNA, 25 bp, Mus musculus
cttccaccgccatattgggcaacta

SEQ ID NO: 259638 - DNA, 25 bp, Mus musculus
ggagctcctcctctgtttaaataga

SEQ ID NO: 259639 - DNA, 25 bp, Mus musculus
agtagtcacgcgaccagccaatgtc

SEQ ID NO: 259640 - DNA, 25 bp, Mus musculus
agcaggtttgttggcagtcgtacac

SEQ ID NO: 259641 - DNA, 25 bp, Mus musculus
agctctccggccgtttggctagttt

SEQ ID NO: 259642 - DNA, 25 bp, Mus musculus
cttgatcactgaagcctcgagctgc

SEQ ID NO: 259643 - DNA, 25 bp, Mus musculus
cggcccggtcaatcatgaagaacta

SEQ ID NO: 259644 - DNA, 25 bp, Mus musculus
ggcggctaagcgaccgtcaccaatg

SEQ ID NO: 259645 - DNA, 25 bp, Mus musculus
ttcgaaagccttcccggctcgctgg

SEQ ID NO: 259646 - DNA, 25 bp, Mus musculus
taccgcagggctccaatgatccgca

SEQ ID NO: 259647 - DNA, 25 bp, Mus musculus
agttcgtggaccctccagggcagca

SEQ ID NO: 259648 - DNA, 25 bp, Mus musculus
aatcactatggaaggcccacgaccc

SEQ ID NO: 259649 - DNA, 25 bp, Mus musculus
cctccagacgaagaaaatcactatg

SEQ ID NO: 259650 - DNA, 25 bp, Mus musculus
tcaccatcgatcctccagacgaaga

SEQ ID NO: 259651 - DNA, 25 bp, Mus musculus
cagccgggctgggttacttcttaga

SEQ ID NO: 259652 - DNA, 25 bp, Mus musculus
caagtcccgcactgccagggtggct

SEQ ID NO: 259653 - DNA, 25 bp, Mus musculus
caaaagtctttaatgtcgccggcta

SEQ ID NO: 259654 - DNA, 25 bp, Mus musculus
actgtggagaaccactgccgctttc

SEQ ID NO: 259655 - DNA, 25 bp, Mus musculus
tgtcgccggctacttgcaagtcccg

SEQ ID NO: 259656 - DNA, 25 bp, Mus musculus
gcccgctcactgtggcaactgctgg

SEQ ID NO: 259657 - DNA, 25 bp, Mus musculus
accaatgcgcgcctaactgtggaga

SEQ ID NO: 259658 - DNA, 25 bp, Mus musculus
acttgattggcattggctgcgccca

SEQ ID NO: 259659 - DNA, 25 bp, Mus musculus
ctccttccctttgtgtgcgtgtgca

SEQ ID NO: 259660 - DNA, 25 bp, Mus musculus
cggagcctcgcgcttaactgagttt

SEQ ID NO: 259661 - DNA, 25 bp, Mus musculus
cctgcaccgagtccactgaagattt

SEQ ID NO: 259662 - DNA, 25 bp, Mus musculus
caaacttgttacttggcggcggagc

SEQ ID NO: 259663 - DNA, 25 bp, Mus musculus
cccgagctggtggttgtaaacttga

SEQ ID NO: 259664 - DNA, 25 bp, Mus musculus
cggccagcgagcttagaagcgtttg

SEQ ID NO: 259665 - DNA, 25 bp, Mus musculus
gaagttgaagtttctccctctggcc

SEQ ID NO: 259666 - DNA, 25 bp, Mus musculus
aaagcctaaaccgtgcgcctgctgc

SEQ ID NO: 259667 - DNA, 25 bp, Mus musculus
gcctgctgcgttttacgaatccttc

SEQ ID NO: 259668 - DNA, 25 bp, Mus musculus
aatccttcggtccacaggtccgcgg

SEQ ID NO: 259669 - DNA, 25 bp, Mus musculus
ctgagaaccgcagccaccatcatgg

SEQ ID NO: 259670 - DNA, 25 bp, Mus musculus
ggggattgcatcatttgcggctccc

SEQ ID NO: 259671 - DNA, 25 bp, Mus musculus
cctcgacgcgcctctaaaaggaacg

SEQ ID NO: 259672 - DNA, 25 bp, Mus musculus
tccaaggattgctgctggaccgccg

SEQ ID NO: 259673 - DNA, 25 bp, Mus musculus
tctgtctacttcatcgtcttcttcg

SEQ ID NO: 259674 - DNA, 25 bp, Mus musculus
gtgcgtctatgtccctcacagggca

SEQ ID NO: 259675 - DNA, 25 bp, Mus musculus
tcttcggctcacgtggcttcctcat

SEQ ID NO: 259676 - DNA, 25 bp, Mus musculus
tgcggcgcttccaaggattgctgct

SEQ ID NO: 259677 - DNA, 25 bp, Mus musculus
cgtggccggctgcacagccaagtgc

SEQ ID NO: 259678 - DNA, 25 bp, Mus musculus
acagccaagtgctgcgcctgcgcga

SEQ ID NO: 259679 - DNA, 25 bp, Mus musculus
ccatggccctttacaactctgtcta

SEQ ID NO: 259680 - DNA, 25 bp, Mus musculus
cgagcttctgagctgcctggagttc

SEQ ID NO: 259681 - DNA, 25 bp, Mus musculus
ccaggaccagatgcgcgagcttctg

SEQ ID NO: 259682 - DNA, 25 bp, Mus musculus
ctctctgatcttctgcaattcccgg

SEQ ID NO: 259683 - DNA, 25 bp, Mus musculus
agccatcgtggggttgtcactcagc

SEQ ID NO: 259684 - DNA, 25 bp, Mus musculus
aggggcagtcaccatcacgtccgac

SEQ ID NO: 259685 - DNA, 25 bp, Mus musculus
cggaaactcgggctaactgtgcgtc

SEQ ID NO: 259686 - DNA, 25 bp, Mus musculus
tttcacgcgtgagtcgcaagttctc

SEQ ID NO: 259687 - DNA, 25 bp, Mus musculus
ccaaggcgggatccttgtcccagga

SEQ ID NO: 259688 - DNA, 25 bp, Mus musculus
acgtcagggaggctttcagttcatt

SEQ ID NO: 259689 - DNA, 25 bp, Mus musculus
tctctggcacggtgactttattttc

SEQ ID NO: 259690 - DNA, 25 bp, Mus musculus
cggaactggattaggcgtgtcctct

SEQ ID NO: 259691 - DNA, 25 bp, Mus musculus
ccctccggcgacagaagcctttata

SEQ ID NO: 259692 - DNA, 25 bp, Mus musculus
ccgccacctatttcatgagtgactg

SEQ ID NO: 259693 - DNA, 25 bp, Mus musculus
tataaccgctttgcgcggccaaggc

SEQ ID NO: 259694 - DNA, 25 bp, Mus musculus
acactcgtcgagagctacgcctggc

SEQ ID NO: 259695 - DNA, 25 bp, Mus musculus
gacctgcccagtagccaggggttga

SEQ ID NO: 259696 - DNA, 25 bp, Mus musculus
gctcatccgtagctgggttcaccgt

SEQ ID NO: 259697 - DNA, 25 bp, Mus musculus
tctgggaccgacctgaacactcgtc

SEQ ID NO: 259698 - DNA, 25 bp, Mus musculus
ctcttttcataagggcgggagctct

SEQ ID NO: 259699 - DNA, 25 bp, Mus musculus
ggttcaccgtgtggctcttttcata

SEQ ID NO: 259700 - DNA, 25 bp, Mus musculus
tgagttcctgatcatgcccaacatg

SEQ ID NO: 259701 - DNA, 25 bp, Mus musculus
acgctcccgaacagtgagttcctga

SEQ ID NO: 259702 - DNA, 25 bp, Mus musculus
acgtttccacgctcccgaacagtga

SEQ ID NO: 259703 - DNA, 25 bp, Mus musculus
acctgccaaggccacgtttccacgc

SEQ ID NO: 259704 - DNA, 25 bp, Mus musculus
ccccggtgcttagaacctgccaagg

SEQ ID NO: 259705 - DNA, 25 bp, Mus musculus
aggtcctctacaccctgccggccta

SEQ ID NO: 259706 - DNA, 25 bp, Mus musculus
ggccgcgcagagtcctccttcaggt

SEQ ID NO: 259707 - DNA, 25 bp, Mus musculus
actggcagtaaggtccacagggcga

SEQ ID NO: 259708 - DNA, 25 bp, Mus musculus
cccaacatggtgacgccgtggggtc

SEQ ID NO: 259709 - DNA, 25 bp, Mus musculus
actcactggcagtaaggtccacagg

SEQ ID NO: 259710 - DNA, 25 bp, Mus musculus
taagcgcgtgagtagacaggcgatt

SEQ ID NO: 259711 - DNA, 25 bp, Mus musculus
atcgagcgtacactcactggcagta

SEQ ID NO: 259712 - DNA, 25 bp, Mus musculus
tctggccgatcgagcgtacactcac

SEQ ID NO: 259713 - DNA, 25 bp, Mus musculus
tcatgcccaacatggtgacgccgtg

SEQ ID NO: 259714 - DNA, 25 bp, Mus musculus
ggcgcaagcgactcaaccttggctc

SEQ ID NO: 259715 - DNA, 25 bp, Mus musculus
ggcctccgccatggcgacagtgctg

SEQ ID NO: 259716 - DNA, 25 bp, Mus musculus
gttcgcagcgaactacacttcccgg

SEQ ID NO: 259717 - DNA, 25 bp, Mus musculus
ccgcaccagtgacctgcgacagtgg

SEQ ID NO: 259718 - DNA, 25 bp, Mus musculus
ctgctgaggcgcaagcgactcaacc

SEQ ID NO: 259719 - DNA, 25 bp, Mus musculus
gacagtgggcgcctcctcctagctg

SEQ ID NO: 259720 - DNA, 25 bp, Mus musculus
cgaccacgctgtggagacctggcct

SEQ ID NO: 259721 - DNA, 25 bp, Mus musculus
atggcgacagtgctgtccagggctc

SEQ ID NO: 259722 - DNA, 25 bp, Mus musculus
gacacttggggactctcggggactc

SEQ ID NO: 259723 - DNA, 25 bp, Mus musculus
actcccggggcagacattgctggag

SEQ ID NO: 259724 - DNA, 25 bp, Mus musculus
acgaggcggttactgtcaggtcaga

SEQ ID NO: 259725 - DNA, 25 bp, Mus musculus
tactgtcaggtcagagcgcatgtcg

SEQ ID NO: 259726 - DNA, 25 bp, Mus musculus
ccagggctctcaagctcccgggtaa

SEQ ID NO: 259727 - DNA, 25 bp, Mus musculus
caagctcccgggtaaggagtctgca

SEQ ID NO: 259728 - DNA, 25 bp, Mus musculus
taccactccgtgcttatcgcctgtt

SEQ ID NO: 259729 - DNA, 25 bp, Mus musculus
ggagcccttctttgtccctgaagta

SEQ ID NO: 259730 - DNA, 25 bp, Mus musculus
ccaggtagaagtctcggagcccttc

SEQ ID NO: 259731 - DNA, 25 bp, Mus musculus
ctttgttcggaactggtccaggtag

SEQ ID NO: 259732 - DNA, 25 bp, Mus musculus
gaggcgagttctcctttgttcggaa

SEQ ID NO: 259733 - DNA, 25 bp, Mus musculus
acgtgctcccagtgaggcgagttct

SEQ ID NO: 259734 - DNA, 25 bp, Mus musculus
aatgtcagtcaagtccacgtgctcc

SEQ ID NO: 259735 - DNA, 25 bp, Mus musculus
actacgttctttgtaaatgtcagtc

SEQ ID NO: 259736 - DNA, 25 bp, Mus musculus
ctcgcttgaagtcatcactacgttc

SEQ ID NO: 259737 - DNA, 25 bp, Mus musculus
cactgaccgaatctcgcttgaagtc

SEQ ID NO: 259738 - DNA, 25 bp, Mus musculus
tgagacctgttggtacagggcccgc

SEQ ID NO: 259739 - DNA, 25 bp, Mus musculus
tgttccgtgtttaaggtgagacctg

SEQ ID NO: 259740 - DNA, 25 bp, Mus musculus
gtgcttatcgcctgttccgtgttta

SEQ ID NO: 259741 - DNA, 25 bp, Mus musculus
tgtccctgaagtagcgcttgtggtc

SEQ ID NO: 259742 - DNA, 25 bp, Mus musculus
ctgggcttcatcttcagctcgtcga

SEQ ID NO: 259743 - DNA, 25 bp, Mus musculus
agcactctgcgctgggcttcatctt

SEQ ID NO: 259744 - DNA, 25 bp, Mus musculus
tcggaagtgcccacgaggatgacag

SEQ ID NO: 259745 - DNA, 25 bp, Mus musculus
acgaggatgacagcgatgccgatgc

SEQ ID NO: 259746 - DNA, 25 bp, Mus musculus
ctcttttgggaacgagctttgctgc

SEQ ID NO: 259747 - DNA, 25 bp, Mus musculus
gctttgctgcccgatacggccaaga

SEQ ID NO: 259748 - DNA, 25 bp, Mus musculus
gacggccaacaccaaccagaacttg

SEQ ID NO: 259749 - DNA, 25 bp, Mus musculus
cgtgacccgcgttgtggaacgcatc

SEQ ID NO: 259750 - DNA, 25 bp, Mus musculus
acttgggagaacagcactctgcgct

SEQ ID NO: 259751 - DNA, 25 bp, Mus musculus
cagctcgtcgactctctgaaaaaga

SEQ ID NO: 259752 - DNA, 25 bp, Mus musculus
ggaacgcatccttgaagtgtctgaa

SEQ ID NO: 259753 - DNA, 25 bp, Mus musculus
tctgcggttcatgaaactcggtttc

SEQ ID NO: 259754 - DNA, 25 bp, Mus musculus
acctcgtctccgtctgcggttcatg

SEQ ID NO: 259755 - DNA, 25 bp, Mus musculus
atgctagaaaatcaagaacctcgtc

SEQ ID NO: 259756 - DNA, 25 bp, Mus musculus
gcaaaaccacgccaatgacccagtg

SEQ ID NO: 259757 - DNA, 25 bp, Mus musculus
tgtcgcgttaaagtccgaattcgtc

SEQ ID NO: 259758 - DNA, 25 bp, Mus musculus
agtccgaattcgtcctagcctgtta

SEQ ID NO: 259759 - DNA, 25 bp, Mus musculus
cgaattcgtcctagcctgttaaaag

SEQ ID NO: 259760 - DNA, 25 bp, Mus musculus
tcaggactcgcaggcttcgctttta

SEQ ID NO: 259761 - DNA, 25 bp, Mus musculus
cgcaggcttcgcttttactcgagtg

SEQ ID NO: 259762 - DNA, 25 bp, Mus musculus
cttttactcgagtgtcgcgtccctc

SEQ ID NO: 259763 - DNA, 25 bp, Mus musculus
cgtccctcccggctatgagtcaagg

SEQ ID NO: 259764 - DNA, 25 bp, Mus musculus
ctatgagtcaaggttagaaaagccc

SEQ ID NO: 259765 - DNA, 25 bp, Mus musculus
aacgccgcgagacccacgatgggct

SEQ ID NO: 259766 - DNA, 25 bp, Mus musculus
gagacccacgatgggcttcacaacc

SEQ ID NO: 259767 - DNA, 25 bp, Mus musculus
ttctacttcctcctgagtcaggtgc

SEQ ID NO: 259768 - DNA, 25 bp, Mus musculus
tcctgagtcaggtgcacttccggcc

SEQ ID NO: 259769 - DNA, 25 bp, Mus musculus
atgacccagtgtcgcgttaaagtcc

SEQ ID NO: 259770 - DNA, 25 bp, Mus musculus
ggattaccggctcataccaagcgcc

SEQ ID NO: 259771 - DNA, 25 bp, Mus musculus
gagcactaggttgctgctgccactg

SEQ ID NO: 259772 - DNA, 25 bp, Mus musculus
cctcgaggattaccggctcatacca

SEQ ID NO: 259773 - DNA, 25 bp, Mus musculus
acttgcactcgagggcgcggctgaa

SEQ ID NO: 259774 - DNA, 25 bp, Mus musculus
tcgaggcgcctagaatggagcacta

SEQ ID NO: 259775 - DNA, 25 bp, Mus musculus
tgctcagtagctgctggccggacct

SEQ ID NO: 259776 - DNA, 25 bp, Mus musculus
ggacctcgaggattaccggctcata

SEQ ID NO: 259777 - DNA, 25 bp, Mus musculus
cccaaacttgcactcgagggcgcgg

SEQ ID NO: 259778 - DNA, 25 bp, Mus musculus
cgcctagaatggagcactaggttgc

SEQ ID NO: 259779 - DNA, 25 bp, Mus musculus
gagggcgcggctgaagttctccctc

SEQ ID NO: 259780 - DNA, 25 bp, Mus musculus
gaagttctccctcgaggcgcctaga

SEQ ID NO: 259781 - DNA, 25 bp, Mus musculus
gttctccctcgaggcgcctagaatg

SEQ ID NO: 259782 - DNA, 25 bp, Mus musculus
taccgctgctcagtagctgctggcc

SEQ ID NO: 259783 - DNA, 25 bp, Mus musculus
ctgctggccggacctcgaggattac

SEQ ID NO: 259784 - DNA, 25 bp, Mus musculus
ccacatcgccggtgaagatgggtag

SEQ ID NO: 259785 - DNA, 25 bp, Mus musculus
gtaggtcatccaggtgccagctcac

SEQ ID NO: 259786 - DNA, 25 bp, Mus musculus
cgaactgtctggcttcgaattttcc

SEQ ID NO: 259787 - DNA, 25 bp, Mus musculus
ctgtctggcttcgaattttccaggc

SEQ ID NO: 259788 - DNA, 25 bp, Mus musculus
tggcttcgaattttccaggcgttcc

SEQ ID NO: 259789 - DNA, 25 bp, Mus musculus
agagtccacgaaccacatcgccggt

SEQ ID NO: 259790 - DNA, 25 bp, Mus musculus
agtccacgaaccacatcgccggtga

SEQ ID NO: 259791 - DNA, 25 bp, Mus musculus
ccacgaaccacatcgccggtgaaga

SEQ ID NO: 259792 - DNA, 25 bp, Mus musculus
cgagggcggactgcccacagttgcc

SEQ ID NO: 259793 - DNA, 25 bp, Mus musculus
cagttgcctccggcaccaggaactg

SEQ ID NO: 259794 - DNA, 25 bp, Mus musculus
actgacactgtaggtcatccaggtg

SEQ ID NO: 259795 - DNA, 25 bp, Mus musculus
gacactgtaggtcatccaggtgcca

SEQ ID NO: 259796 - DNA, 25 bp, Mus musculus
ggactgcccacagttgcctccggca

SEQ ID NO: 259797 - DNA, 25 bp, Mus musculus
ctgtaggtcatccaggtgccagctc

SEQ ID NO: 259798 - DNA, 25 bp, Mus musculus
ccaggccggctctctggagattgag

SEQ ID NO: 259799 - DNA, 25 bp, Mus musculus
tggcacttggagactggccctggac

SEQ ID NO: 259800 - DNA, 25 bp, Mus musculus
cacttggagactggccctggactcg

SEQ ID NO: 259801 - DNA, 25 bp, Mus musculus
cgcccaggccggctctctggagatt

SEQ ID NO: 259802 - DNA, 25 bp, Mus musculus
gccggctctctggagattgaggttc

SEQ ID NO: 259803 - DNA, 25 bp, Mus musculus
cggctctctggagattgaggttcgc

SEQ ID NO: 259804 - DNA, 25 bp, Mus musculus
gctctctggagattgaggttcgccc

SEQ ID NO: 259805 - DNA, 25 bp, Mus musculus
tctggagattgaggttcgccccgcc

SEQ ID NO: 259806 - DNA, 25 bp, Mus musculus
ccggaagaggaatgcgaatgcagaa

SEQ ID NO: 259807 - DNA, 25 bp, Mus musculus
aagaggaatgcgaatgcagaaggca

SEQ ID NO: 259808 - DNA, 25 bp, Mus musculus
ggaatgcgaatgcagaaggcacgcc

SEQ ID NO: 259809 - DNA, 25 bp, Mus musculus
aatgcgaatgcagaaggcacgcccg

SEQ ID NO: 259810 - DNA, 25 bp, Mus musculus
tgcgaatgcagaaggcacgcccgcc

SEQ ID NO: 259811 - DNA, 25 bp, Mus musculus
tggccctggactcgcccaggccggc

SEQ ID NO: 259812 - DNA, 25 bp, Mus musculus
ggcaggaggcgtggccaaaaatccc

SEQ ID NO: 259813 - DNA, 25 bp, Mus musculus
cggatgcgatcgaaaagacggcagc

SEQ ID NO: 259814 - DNA, 25 bp, Mus musculus
tttcggaagagtcaagaccgcatta

SEQ ID NO: 259815 - DNA, 25 bp, Mus musculus
ctacaatttcaaggcaggaggcgtg

SEQ ID NO: 259816 - DNA, 25 bp, Mus musculus
gtcgggctctagctgcagttgagca

SEQ ID NO: 259817 - DNA, 25 bp, Mus musculus
caggagatttgcatggagaataggc

SEQ ID NO: 259818 - DNA, 25 bp, Mus musculus
ataggcatcgcgcacgttcattggc

SEQ ID NO: 259819 - DNA, 25 bp, Mus musculus
ttcattggccgatcgctcagtgggt

SEQ ID NO: 259820 - DNA, 25 bp, Mus musculus
ggagtacatagtgtgcccacgaagc

SEQ ID NO: 259821 - DNA, 25 bp, Mus musculus
ttgtttttgaatctgcggtggcggc

SEQ ID NO: 259822 - DNA, 25 bp, Mus musculus
aaggaactcgggtcccaggctctca

SEQ ID NO: 259823 - DNA, 25 bp, Mus musculus
cccgaaggtatacgcgagtgccagg

SEQ ID NO: 259824 - DNA, 25 bp, Mus musculus
accactgtcggagaaatgactattg

SEQ ID NO: 259825 - DNA, 25 bp, Mus musculus
caccaccgcagacgggctacaattt

SEQ ID NO: 259826 - DNA, 25 bp, Mus musculus
cgggcggccgttctgctcacctgtt

SEQ ID NO: 259827 - DNA, 25 bp, Mus musculus
ttctgctcacctgttgggtcgctct

SEQ ID NO: 259828 - DNA, 25 bp, Mus musculus
ctcacctgttgggtcgctctggctg

SEQ ID NO: 259829 - DNA, 25 bp, Mus musculus
ggaggctgcagcagcaatggcagca

SEQ ID NO: 259830 - DNA, 25 bp, Mus musculus
atggcggcctgaggctcctgccagg

SEQ ID NO: 259831 - DNA, 25 bp, Mus musculus
tcctgccagggctgcggtggcacat

SEQ ID NO: 259832 - DNA, 25 bp, Mus musculus
gtggcacatcgctcctccgctgtga

SEQ ID NO: 259833 - DNA, 25 bp, Mus musculus
ctccgctgtgacctcggcctggttg

SEQ ID NO: 259834 - DNA, 25 bp, Mus musculus
tgacctcggcctggttggattaggt

SEQ ID NO: 259835 - DNA, 25 bp, Mus musculus
cctggttggattaggtcccgctggc

SEQ ID NO: 259836 - DNA, 25 bp, Mus musculus
ccgttctgctcacctgttgggtcgc

SEQ ID NO: 259837 - DNA, 25 bp, Mus musculus
agagccgcacttgaggatggtagca

SEQ ID NO: 259838 - DNA, 25 bp, Mus musculus
cagctgttgcaagagccgcacttga

SEQ ID NO: 259839 - DNA, 25 bp, Mus musculus
ggcagctgttgcaagagccgcactt

SEQ ID NO: 259840 - DNA, 25 bp, Mus musculus
caaccgccggatagcgggcttggta

SEQ ID NO: 259841 - DNA, 25 bp, Mus musculus
ttgtcgcggagaaccttgcggtgtc

SEQ ID NO: 259842 - DNA, 25 bp, Mus musculus
gagacccgagatgcgcttcacgccg

SEQ ID NO: 259843 - DNA, 25 bp, Mus musculus
tgaggacaccgcgagtctcctcgta

SEQ ID NO: 259844 - DNA, 25 bp, Mus musculus
gaaaaccttgaggacaccgcgagtc

SEQ ID NO: 259845 - DNA, 25 bp, Mus musculus
gatcacattctcaaggaaaaccttg

SEQ ID NO: 259846 - DNA, 25 bp, Mus musculus
gtcgcggatcacattctcaaggaaa

SEQ ID NO: 259847 - DNA, 25 bp, Mus musculus
gcgtacaccacgtccatagccgtaa

SEQ ID NO: 259848 - DNA, 25 bp, Mus musculus
ttagccgccgaagccgtacagagtg

SEQ ID NO: 259849 - DNA, 25 bp, Mus musculus
caggagggctcgcttagccgccgaa

SEQ ID NO: 259850 - DNA, 25 bp, Mus musculus
gcctaggcacaggagggctcgctta

SEQ ID NO: 259851 - DNA, 25 bp, Mus musculus
cggccaagggaacggcctaggcaca

SEQ ID NO: 259852 - DNA, 25 bp, Mus musculus
atagccgtaaccgtcttgcgcttgg

SEQ ID NO: 259853 - DNA, 25 bp, Mus musculus
agaaccttgcggtgtcgcttggcgc

SEQ ID NO: 259854 - DNA, 25 bp, Mus musculus
ttccgcgagctgattgggtacggta

SEQ ID NO: 259855 - DNA, 25 bp, Mus musculus
cccgtcgcatcaccgtgggcaggag

SEQ ID NO: 259856 - DNA, 25 bp, Mus musculus
cacctgtgtggccatgtgcgagccg

SEQ ID NO: 259857 - DNA, 25 bp, Mus musculus
gtgacgcaggccacctgtgtggcca

SEQ ID NO: 259858 - DNA, 25 bp, Mus musculus
aactttgagcgtgacgcaggccacc

SEQ ID NO: 259859 - DNA, 25 bp, Mus musculus
gttccaactttgagcgtgacgcagg

SEQ ID NO: 259860 - DNA, 25 bp, Mus musculus
tggggacgagttccaactttgagcg

SEQ ID NO: 259861 - DNA, 25 bp, Mus musculus
taatctagagagctgtgtagtcgcg

SEQ ID NO: 259862 - DNA, 25 bp, Mus musculus
tacctgcctgtcacgggcggcagcg

SEQ ID NO: 259863 - DNA, 25 bp, Mus musculus
ggggctctgcttccgcgagctgatt

SEQ ID NO: 259864 - DNA, 25 bp, Mus musculus
tcgcatcaccgtgggcaggagaagc

SEQ ID NO: 259865 - DNA, 25 bp, Mus musculus
gcaacgcggcgagggacaacaagaa

SEQ ID NO: 259866 - DNA, 25 bp, Mus musculus
cggtgaaaagcgagtaatctagaga

SEQ ID NO: 259867 - DNA, 25 bp, Mus musculus
attgggtacggtacctgcctgtcac

SEQ ID NO: 259868 - DNA, 25 bp, Mus musculus
agctgctaacgatgctcacagactg

SEQ ID NO: 259869 - DNA, 25 bp, Mus musculus
gaagcctcaaccgaaagcctcagtg

SEQ ID NO: 259870 - DNA, 25 bp, Mus musculus
aggcgactgtaagaactccgagctg

SEQ ID NO: 259871 - DNA, 25 bp, Mus musculus
atctgagaagcaggagcagactgtg

SEQ ID NO: 259872 - DNA, 25 bp, Mus musculus
ggcttgtatctgagaagcaggagca

SEQ ID NO: 259873 - DNA, 25 bp, Mus musculus
cattgttctgaaggatccctcaccc

SEQ ID NO: 259874 - DNA, 25 bp, Mus musculus
cgacacacattgttctgaaggatcc

SEQ ID NO: 259875 - DNA, 25 bp, Mus musculus
agcctcagtgctgactgacgacaca

SEQ ID NO: 259876 - DNA, 25 bp, Mus musculus
tcccttggaagcctcaaccgaaagc

SEQ ID NO: 259877 - DNA, 25 bp, Mus musculus
ggtcttccttcccttggaagcctca

SEQ ID NO: 259878 - DNA, 25 bp, Mus musculus
tcacagactggaagggtcttccttc

SEQ ID NO: 259879 - DNA, 25 bp, Mus musculus
taagaactccgagctgctaacgatg

SEQ ID NO: 259880 - DNA, 25 bp, Mus musculus
gatccttaagaagaggcgactgtaa

SEQ ID NO: 259881 - DNA, 25 bp, Mus musculus
tgctgactgacgacacacattgttc

SEQ ID NO: 259882 - DNA, 25 bp, Mus musculus
tgcgcgtccctcagggtgcttggat

SEQ ID NO: 259883 - DNA, 25 bp, Mus musculus
gtttcattcgcgttgcttactcgta

SEQ ID NO: 259884 - DNA, 25 bp, Mus musculus
acctcgtccgagaaacagcttccaa

SEQ ID NO: 259885 - DNA, 25 bp, Mus musculus
ttcctagcgttgagctgtagatgcg

SEQ ID NO: 259886 - DNA, 25 bp, Mus musculus
cctctgtattccttcctagcgttga

SEQ ID NO: 259887 - DNA, 25 bp, Mus musculus
aaggacgccagattgcaggtggcta

SEQ ID NO: 259888 - DNA, 25 bp, Mus musculus
tccgagaaacagcttccaagtgtgc

SEQ ID NO: 259889 - DNA, 25 bp, Mus musculus
tcgcgttgcttactcgtattggaca

SEQ ID NO: 259890 - DNA, 25 bp, Mus musculus
gggcgtggcgcagtgcctctcacca

SEQ ID NO: 259891 - DNA, 25 bp, Mus musculus
tgcactctaagaacgcggtggcgcg

SEQ ID NO: 259892 - DNA, 25 bp, Mus musculus
ccgggcaggttgcactctaagaacg

SEQ ID NO: 259893 - DNA, 25 bp, Mus musculus
cgcctgcctgaacgccgggcaggtt

SEQ ID NO: 259894 - DNA, 25 bp, Mus musculus
gcttactcgtattggacagcagatg

SEQ ID NO: 259895 - DNA, 25 bp, Mus musculus
cagcttccaagtgtgcgtggaggaa

SEQ ID NO: 259896 - DNA, 25 bp, Mus musculus
cggttgatagcgactcgagcggcta

SEQ ID NO: 259897 - DNA, 25 bp, Mus musculus
actcgagcggctagacgtcagcccg

SEQ ID NO: 259898 - DNA, 25 bp, Mus musculus
tcgcggaaaacggagcaccgagtcc

SEQ ID NO: 259899 - DNA, 25 bp, Mus musculus
actgccgaaaccatagcgacggttg

SEQ ID NO: 259900 - DNA, 25 bp, Mus musculus
ggaggcctcacagcaactgccgaaa

SEQ ID NO: 259901 - DNA, 25 bp, Mus musculus
ccatagcgacggttgatagcgactc

SEQ ID NO: 259902 - DNA, 25 bp, Mus musculus
gcccgagaacccgtcggacgcagtg

SEQ ID NO: 259903 - DNA, 25 bp, Mus musculus
agaacccgtcggacgcagtgccagg

SEQ ID NO: 259904 - DNA, 25 bp, Mus musculus
gggtccactccaggaggcctcacag

SEQ ID NO: 259905 - DNA, 25 bp, Mus musculus
tgtttcagagaaggcttcgcaggcc

SEQ ID NO: 259906 - DNA, 25 bp, Mus musculus
gcggtcccggaggactctctgcgaa

SEQ ID NO: 259907 - DNA, 25 bp, Mus musculus
ggactctctgcgaaggggccttcac

SEQ ID NO: 259908 - DNA, 25 bp, Mus musculus
tccgccagctcacgtcacttcctgt

SEQ ID NO: 259909 - DNA, 25 bp, Mus musculus
cctctgggcctggtgtttcagagaa

SEQ ID NO: 259910 - DNA, 25 bp, Mus musculus
gaccggccatgagaccgagagacaa

SEQ ID NO: 259911 - DNA, 25 bp, Mus musculus
agtcagaccggccatgagaccgaga

SEQ ID NO: 259912 - DNA, 25 bp, Mus musculus
acaagcgcgtgaggctgcgagcacc

SEQ ID NO: 259913 - DNA, 25 bp, Mus musculus
gcgcgtgaggctgcgagcacctcac

SEQ ID NO: 259914 - DNA, 25 bp, Mus musculus
cggtgccgagttgccgggaaattca

SEQ ID NO: 259915 - DNA, 25 bp, Mus musculus
ttgccgggaaattcaggaagtcctc

SEQ ID NO: 259916 - DNA, 25 bp, Mus musculus
tcaggaagtcctctttgctcaaaag

SEQ ID NO: 259917 - DNA, 25 bp, Mus musculus
ctttgctcaaaagagtccgggagga

SEQ ID NO: 259918 - DNA, 25 bp, Mus musculus
tgctcaaaagagtccgggaggaaac

SEQ ID NO: 259919 - DNA, 25 bp, Mus musculus
gcagactggaaggaatagttccgga

SEQ ID NO: 259920 - DNA, 25 bp, Mus musculus
gggagacggcccacgaataaagtca

SEQ ID NO: 259921 - DNA, 25 bp, Mus musculus
ggcggagcttcttgaacgacggtct

SEQ ID NO: 259922 - DNA, 25 bp, Mus musculus
cttgaacgacggtctctgtgcagtc

SEQ ID NO: 259923 - DNA, 25 bp, Mus musculus
cacgaataaagtcagaccggccatg

SEQ ID NO: 259924 - DNA, 25 bp, Mus musculus
ctaagcacgcacggtgccaccgtaa

SEQ ID NO: 259925 - DNA, 25 bp, Mus musculus
taagcacgcacggtgccaccgtaac

SEQ ID NO: 259926 - DNA, 25 bp, Mus musculus
ggtgccaccgtaacctctaagcacg

SEQ ID NO: 259927 - DNA, 25 bp, Mus musculus
aacctctaagcacgcacggtgccac

SEQ ID NO: 259928 - DNA, 25 bp, Mus musculus
acggtgccaccgtaacctctaagca

SEQ ID NO: 259929 - DNA, 25 bp, Mus musculus
cacggtgccaccgtaacctctaagc

SEQ ID NO: 259930 - DNA, 25 bp, Mus musculus
tgccaccgtaacctctaagcacgca

SEQ ID NO: 259931 - DNA, 25 bp, Mus musculus
cggtgccaccgtaacctctaagcac

SEQ ID NO: 259932 - DNA, 25 bp, Mus musculus
cacgcacggtgccaccgtaacctct

SEQ ID NO: 259933 - DNA, 25 bp, Mus musculus
tctaagcacgcacggtgccaccgta

SEQ ID NO: 259934 - DNA, 25 bp, Mus musculus
gtaacctctaagcacgcacggtgcc

SEQ ID NO: 259935 - DNA, 25 bp, Mus musculus
gcacggtgccaccgtaacctctaag

SEQ ID NO: 259936 - DNA, 25 bp, Mus musculus
cgtaacctctaagcacgcacggtgc

SEQ ID NO: 259937 - DNA, 25 bp, Mus musculus
caccgtaacctctaagcacgcacgg

SEQ ID NO: 259938 - DNA, 25 bp, Mus musculus
gtgtcactcacctgttcactgtcca

SEQ ID NO: 259939 - DNA, 25 bp, Mus musculus
ctggcgttcacatctctcaggagaa

SEQ ID NO: 259940 - DNA, 25 bp, Mus musculus
tcacccaggggctgagccctcaggg

SEQ ID NO: 259941 - DNA, 25 bp, Mus musculus
ggggctcgtaccctgtcctcaggga

SEQ ID NO: 259942 - DNA, 25 bp, Mus musculus
tcctcagggagccacctggacacgt

SEQ ID NO: 259943 - DNA, 25 bp, Mus musculus
cacctggacacgtgcgtgtcactca

SEQ ID NO: 259944 - DNA, 25 bp, Mus musculus
caagttcgcaatccgcccgcggaga

SEQ ID NO: 259945 - DNA, 25 bp, Mus musculus
gcccgcggagactaggaagctctcc

SEQ ID NO: 259946 - DNA, 25 bp, Mus musculus
acccacgcgggctacaggaggcgtt

SEQ ID NO: 259947 - DNA, 25 bp, Mus musculus
gctcagactagcagcgcagagactg

SEQ ID NO: 259948 - DNA, 25 bp, Mus musculus
gctccgccaccaagatgctgcagtg

SEQ ID NO: 259949 - DNA, 25 bp, Mus musculus
ccaagatgctgcagtgaggtgcccg

SEQ ID NO: 259950 - DNA, 25 bp, Mus musculus
caagcctggtggctggcgttcacat

SEQ ID NO: 259951 - DNA, 25 bp, Mus musculus
gagacagccgcggtcctctccaagt

SEQ ID NO: 259952 - DNA, 25 bp, Mus musculus
cggagatggggatccatcccgccgt

SEQ ID NO: 259953 - DNA, 25 bp, Mus musculus
tccttagccattaaacaacgccggc

SEQ ID NO: 259954 - DNA, 25 bp, Mus musculus
aacgccggctccaagcacgttctag

SEQ ID NO: 259955 - DNA, 25 bp, Mus musculus
cacgttctagcaggactcgggcaca

SEQ ID NO: 259956 - DNA, 25 bp, Mus musculus
gcacaggacgacctgccaggcgaca

SEQ ID NO: 259957 - DNA, 25 bp, Mus musculus
gcgcccgaagtctgaggctgccagc

SEQ ID NO: 259958 - DNA, 25 bp, Mus musculus
tgccagccgggactggtcattgtaa

SEQ ID NO: 259959 - DNA, 25 bp, Mus musculus
ttgtaagcgccacggagaactgctg

SEQ ID NO: 259960 - DNA, 25 bp, Mus musculus
ctcccgtggcaaccgctgtagctgt

SEQ ID NO: 259961 - DNA, 25 bp, Mus musculus
ctttgtgctgctcaaggtagggtcc

SEQ ID NO: 259962 - DNA, 25 bp, Mus musculus
agctattcgctcagggtgcggtgac

SEQ ID NO: 259963 - DNA, 25 bp, Mus musculus
acacgctttgtcctcagagcggtgc

SEQ ID NO: 259964 - DNA, 25 bp, Mus musculus
gagagcgccagtcgcacacgctttg

SEQ ID NO: 259965 - DNA, 25 bp, Mus musculus
tgctacctctgctcgggctctttgt

SEQ ID NO: 259966 - DNA, 25 bp, Mus musculus
gggagtgccacgacctccctagacg

SEQ ID NO: 259967 - DNA, 25 bp, Mus musculus
gtgacggctcacaaagacccttatg

SEQ ID NO: 259968 - DNA, 25 bp, Mus musculus
cctgcatctaagacgttagggcggg

SEQ ID NO: 259969 - DNA, 25 bp, Mus musculus
cgaaagccctgcatctaagacgtta

SEQ ID NO: 259970 - DNA, 25 bp, Mus musculus
tgcggaactcaggtacgcccgcgca

SEQ ID NO: 259971 - DNA, 25 bp, Mus musculus
tggccgccgacacaccagttgcaaa

SEQ ID NO: 259972 - DNA, 25 bp, Mus musculus
cagttgcaaagggtccaagtgaacc

SEQ ID NO: 259973 - DNA, 25 bp, Mus musculus
ccaagtgaaccgcagcggccgctga

SEQ ID NO: 259974 - DNA, 25 bp, Mus musculus
gctgagcctggcaccactccggtga

SEQ ID NO: 259975 - DNA, 25 bp, Mus musculus
ccactccggtgacggctcacaaaga

SEQ ID NO: 259976 - DNA, 25 bp, Mus musculus
caaagacccttatgggaaagcgaga

SEQ ID NO: 259977 - DNA, 25 bp, Mus musculus
gctcttacctaggatccgccctccg

SEQ ID NO: 259978 - DNA, 25 bp, Mus musculus
cacgacctccctagacgcgagggag

SEQ ID NO: 259979 - DNA, 25 bp, Mus musculus
tccaggtgtgcggaactcaggtacg

SEQ ID NO: 259980 - DNA, 25 bp, Mus musculus
gcttgcaaaggtgagctgagcccgc

SEQ ID NO: 259981 - DNA, 25 bp, Mus musculus
cgctgctgctgggaactaccgcctt

SEQ ID NO: 259982 - DNA, 25 bp, Mus musculus
tcagagcagcatgggttcggtctcc

SEQ ID NO: 259983 - DNA, 25 bp, Mus musculus
ccgcgcgcttgacgtcgtcagagca

SEQ ID NO: 259984 - DNA, 25 bp, Mus musculus
ccaacactgggtagcaacgggacgc

SEQ ID NO: 259985 - DNA, 25 bp, Mus musculus
atggccatgaggcagacgccgctca

SEQ ID NO: 259986 - DNA, 25 bp, Mus musculus
gtggatttggccttcagcggcatca

SEQ ID NO: 259987 - DNA, 25 bp, Mus musculus
gtcacttccggctgacgcgacgcgt

SEQ ID NO: 259988 - DNA, 25 bp, Mus musculus
acggctactttctgatcagcgcttg

SEQ ID NO: 259989 - DNA, 25 bp, Mus musculus
gtcgtggctgccagcgacagccatc

SEQ ID NO: 259990 - DNA, 25 bp, Mus musculus
cagccatcgcgctgctgggactaga

SEQ ID NO: 259991 - DNA, 25 bp, Mus musculus
tggccgggctttatgcgtccctcct

SEQ ID NO: 259992 - DNA, 25 bp, Mus musculus
cacgtcctgccgctaccggtaggga

SEQ ID NO: 259993 - DNA, 25 bp, Mus musculus
gcggcatcacgccttacggctactt

SEQ ID NO: 259994 - DNA, 25 bp, Mus musculus
tggctgctcactgccggggcacaga

SEQ ID NO: 259995 - DNA, 25 bp, Mus musculus
gccacaatggctgctcactgccggg

SEQ ID NO: 259996 - DNA, 25 bp, Mus musculus
ggttggctttcagcggtggccacaa

SEQ ID NO: 259997 - DNA, 25 bp, Mus musculus
gacctggagcaagggttggctttca

SEQ ID NO: 259998 - DNA, 25 bp, Mus musculus
aaggccaggcccgtgtggcgacctg

SEQ ID NO: 259999 - DNA, 25 bp, Mus musculus
cggggacttgacaggaaggaggaag

SEQ ID NO: 260000 - DNA, 25 bp, Mus musculus
ggcgttgcaaaaggggcgtggctct

SEQ ID NO: 260001 - DNA, 25 bp, Mus musculus
acaatggctgctcactgccggggca

SEQ ID NO: 260002 - DNA, 25 bp, Mus musculus
gtggctttggtagggcgttgcaaaa

SEQ ID NO: 260003 - DNA, 25 bp, Mus musculus
ggtggccacaatggctgctcactgc

SEQ ID NO: 260004 - DNA, 25 bp, Mus musculus
ttgcgctccccttcgccaggttggg

SEQ ID NO: 260005 - DNA, 25 bp, Mus musculus
actgccggggcacagagctcggtaa

SEQ ID NO: 260006 - DNA, 25 bp, Mus musculus
gcacagagctcggtaagggccagcg

SEQ ID NO: 260007 - DNA, 25 bp, Mus musculus
aagggccagcgggttgcgctcccct

SEQ ID NO: 260008 - DNA, 25 bp, Mus musculus
actgctttctgccaagcagcttcct

SEQ ID NO: 260009 - DNA, 25 bp, Mus musculus
cccagagaactgctttctgccaagc

SEQ ID NO: 260010 - DNA, 25 bp, Mus musculus
tgcggtgagacggtcccgcatcctc

SEQ ID NO: 260011 - DNA, 25 bp, Mus musculus
tccagcaccctttaggaagtcctca

SEQ ID NO: 260012 - DNA, 25 bp, Mus musculus
cttctcctaagtgggactgtgggta

SEQ ID NO: 260013 - DNA, 25 bp, Mus musculus
agcgcttggagacggcgccctcttc

SEQ ID NO: 260014 - DNA, 25 bp, Mus musculus
gccttttcatcagcgcttggagacg

SEQ ID NO: 260015 - DNA, 25 bp, Mus musculus
catgtgatccaaacaccggtgagtc

SEQ ID NO: 260016 - DNA, 25 bp, Mus musculus
cgcagccagtgatcccggctcaaaa

SEQ ID NO: 260017 - DNA, 25 bp, Mus musculus
ggtagccgcagccaagctccacgta

SEQ ID NO: 260018 - DNA, 25 bp, Mus musculus
attcttctccgccttttcatcagcg

SEQ ID NO: 260019 - DNA, 25 bp, Mus musculus
cacctcctacttctcctaagtggga

SEQ ID NO: 260020 - DNA, 25 bp, Mus musculus
ccagttccacgaggaaatgcatctc

SEQ ID NO: 260021 - DNA, 25 bp, Mus musculus
tccacgtaccaccagcaggcggtgg

SEQ ID NO: 260022 - DNA, 25 bp, Mus musculus
ttacctggcatacttggcggccgtg

SEQ ID NO: 260023 - DNA, 25 bp, Mus musculus
cgcgtagatccggaagaagtgattc

SEQ ID NO: 260024 - DNA, 25 bp, Mus musculus
tcgcctggagaccttacctggcata

SEQ ID NO: 260025 - DNA, 25 bp, Mus musculus
ccctggtttctctggagaggttcaa

SEQ ID NO: 260026 - DNA, 25 bp, Mus musculus
actagcgtgcttaggacggtggccc

SEQ ID NO: 260027 - DNA, 25 bp, Mus musculus
cgtcctcatggtcgcctggactagc

SEQ ID NO: 260028 - DNA, 25 bp, Mus musculus
ctcagctgcctaggtggcgcgacat

SEQ ID NO: 260029 - DNA, 25 bp, Mus musculus
ggtacgccgagcagatcctgccgca

SEQ ID NO: 260030 - DNA, 25 bp, Mus musculus
ccttcttctggatgggcttgtgcct

SEQ ID NO: 260031 - DNA, 25 bp, Mus musculus
tcagtctcctgtgcgccttcttctg

SEQ ID NO: 260032 - DNA, 25 bp, Mus musculus
gcgctgctcttcagtctcctgtgcg

SEQ ID NO: 260033 - DNA, 25 bp, Mus musculus
gctccggctgttgttggagagccct

SEQ ID NO: 260034 - DNA, 25 bp, Mus musculus
gcccgtgtggcaagagggaaccacc

SEQ ID NO: 260035 - DNA, 25 bp, Mus musculus
cgcgaggaccaaggaagagattccg

SEQ ID NO: 260036 - DNA, 25 bp, Mus musculus
atgttgctcttgaagcccggctgcc

SEQ ID NO: 260037 - DNA, 25 bp, Mus musculus
tgcagctgccactgtcatccagaga

SEQ ID NO: 260038 - DNA, 25 bp, Mus musculus
tgtaagcgcagcctcctagacggcg

SEQ ID NO: 260039 - DNA, 25 bp, Mus musculus
tccacggccggtaggtgtaagcgca

SEQ ID NO: 260040 - DNA, 25 bp, Mus musculus
ccagagagtccttccgcgactgcga

SEQ ID NO: 260041 - DNA, 25 bp, Mus musculus
cggctgcccgttggccaggtcagtt

SEQ ID NO: 260042 - DNA, 25 bp, Mus musculus
cgcacagctccacgggtggctgcgt

SEQ ID NO: 260043 - DNA, 25 bp, Mus musculus
cacgacccaggtatcccgggctggg

SEQ ID NO: 260044 - DNA, 25 bp, Mus musculus
gcgccaggggcatgttgctcttgaa

SEQ ID NO: 260045 - DNA, 25 bp, Mus musculus
tgaagagagaccctaaaagtgcccg

SEQ ID NO: 260046 - DNA, 25 bp, Mus musculus
ccaggtcagttgtggtgtcgcagcc

SEQ ID NO: 260047 - DNA, 25 bp, Mus musculus
tcgcccaggagcttgaaagtgaaga

SEQ ID NO: 260048 - DNA, 25 bp, Mus musculus
tttccactcggggaaggcgcacagc

SEQ ID NO: 260049 - DNA, 25 bp, Mus musculus
ggtggctgcgttccacgacccaggt

SEQ ID NO: 260050 - DNA, 25 bp, Mus musculus
cgcaaaacacgtgggaaatactcat

SEQ ID NO: 260051 - DNA, 25 bp, Mus musculus
tcgcgggtcgctcttccggcttttc

SEQ ID NO: 260052 - DNA, 25 bp, Mus musculus
cctgttgtcgtggttacgggagatt

SEQ ID NO: 260053 - DNA, 25 bp, Mus musculus
cttctggaccctgttgtcgtggtta

SEQ ID NO: 260054 - DNA, 25 bp, Mus musculus
catcgctggcgtcacgtgtgccgag

SEQ ID NO: 260055 - DNA, 25 bp, Mus musculus
cccgcgaccggcagggacattcgtg

SEQ ID NO: 260056 - DNA, 25 bp, Mus musculus
tcaccagtgttcagtctgccgccag

SEQ ID NO: 260057 - DNA, 25 bp, Mus musculus
tagctggaactttcaccagtgttca

SEQ ID NO: 260058 - DNA, 25 bp, Mus musculus
tctcttccgggtagaaaatagctgg

SEQ ID NO: 260059 - DNA, 25 bp, Mus musculus
gaagtgatttgtgggcagcgtctct

SEQ ID NO: 260060 - DNA, 25 bp, Mus musculus
agtccaatgtcaatggcccgagcgc

SEQ ID NO: 260061 - DNA, 25 bp, Mus musculus
gggcacccgtagtccaatgtcaatg

SEQ ID NO: 260062 - DNA, 25 bp, Mus musculus
actaagtgtgagcttccgggcaccc

SEQ ID NO: 260063 - DNA, 25 bp, Mus musculus
gggaaatactcatacggactaagtg

SEQ ID NO: 260064 - DNA, 25 bp, Mus musculus
tggcagagacgacgcccagctccta

SEQ ID NO: 260065 - DNA, 25 bp, Mus musculus
tacgcagagtaagcgctgccgggcc

SEQ ID NO: 260066 - DNA, 25 bp, Mus musculus
cccgcaatgaatggagcgagcgcgc

SEQ ID NO: 260067 - DNA, 25 bp, Mus musculus
tctgtcccacggaacagccgtcgga

SEQ ID NO: 260068 - DNA, 25 bp, Mus musculus
cgaggctcttctccggaccaggctt

SEQ ID NO: 260069 - DNA, 25 bp, Mus musculus
gaaggaaaacgcacgctaaccctga

SEQ ID NO: 260070 - DNA, 25 bp, Mus musculus
gcagaagcgcaagctgcggcgacca

SEQ ID NO: 260071 - DNA, 25 bp, Mus musculus
gcgaccagggctcctgaaagcgatg

SEQ ID NO: 260072 - DNA, 25 bp, Mus musculus
acaagccattgccttctctgattgg

SEQ ID NO: 260073 - DNA, 25 bp, Mus musculus
atccgaacaagagcgcgtgctattg

SEQ ID NO: 260074 - DNA, 25 bp, Mus musculus
cgtgctattggtctcgctgcagcca

SEQ ID NO: 260075 - DNA, 25 bp, Mus musculus
gctgcagccaatggagcgcggcctt

SEQ ID NO: 260076 - DNA, 25 bp, Mus musculus
atgatctccctcacggatacgcaga

SEQ ID NO: 260077 - DNA, 25 bp, Mus musculus
cgtccgggtgcacatccgaacaaga

SEQ ID NO: 260078 - DNA, 25 bp, Mus musculus
gtgctgcgctgtgcggaggccctcc

SEQ ID NO: 260079 - DNA, 25 bp, Mus musculus
tccacgacctccagtgagcctccgc

SEQ ID NO: 260080 - DNA, 25 bp, Mus musculus
gacagcacatcctgctggcgcgggc

SEQ ID NO: 260081 - DNA, 25 bp, Mus musculus
agacagcacatcctgctggcgcggg

SEQ ID NO: 260082 - DNA, 25 bp, Mus musculus
tgagacagcacatcctgctggcgcg

SEQ ID NO: 260083 - DNA, 25 bp, Mus musculus
cgtgagacagcacatcctgctggcg

SEQ ID NO: 260084 - DNA, 25 bp, Mus musculus
agcgtgagacagcacatcctgctgg

SEQ ID NO: 260085 - DNA, 25 bp, Mus musculus
gcagcgtgagacagcacatcctgct

SEQ ID NO: 260086 - DNA, 25 bp, Mus musculus
gcgcagcgtgagacagcacatcctg

SEQ ID NO: 260087 - DNA, 25 bp, Mus musculus
cgcgcagcgtgagacagcacatcct

SEQ ID NO: 260088 - DNA, 25 bp, Mus musculus
aggagcgctagcctagccgcgcagc

SEQ ID NO: 260089 - DNA, 25 bp, Mus musculus
gaagtgatcgctccgggaggagcgc

SEQ ID NO: 260090 - DNA, 25 bp, Mus musculus
ctggtgttgggagctgtcagtgtca

SEQ ID NO: 260091 - DNA, 25 bp, Mus musculus
ccgcagccctggtgttgggagctgt

SEQ ID NO: 260092 - DNA, 25 bp, Mus musculus
gtgaagcacctcgtagccctgcagg

SEQ ID NO: 260093 - DNA, 25 bp, Mus musculus
gaagtccacggtgcaatcgctgcta

SEQ ID NO: 260094 - DNA, 25 bp, Mus musculus
caccttggagaaggagatcgggacc

SEQ ID NO: 260095 - DNA, 25 bp, Mus musculus
gggcctgctagagcgcatagctgca

SEQ ID NO: 260096 - DNA, 25 bp, Mus musculus
atcgcgctacccaggggctccttgt

SEQ ID NO: 260097 - DNA, 25 bp, Mus musculus
tcccggagacaatcggaagagcttg

SEQ ID NO: 260098 - DNA, 25 bp, Mus musculus
ctgggtagagaccaagcagcgctaa

SEQ ID NO: 260099 - DNA, 25 bp, Mus musculus
aagcctgcttggcttccgtagccca

SEQ ID NO: 260100 - DNA, 25 bp, Mus musculus
gacaggggtagcacccttaaagcca

SEQ ID NO: 260101 - DNA, 25 bp, Mus musculus
ccaacaagagagtgccagcaggagc

SEQ ID NO: 260102 - DNA, 25 bp, Mus musculus
gtcctgcagcagtagccagacgaga

SEQ ID NO: 260103 - DNA, 25 bp, Mus musculus
atgcccgtaggcgtcgtagaagagc

SEQ ID NO: 260104 - DNA, 25 bp, Mus musculus
gcagatccagcaacgccaggcaggg

SEQ ID NO: 260105 - DNA, 25 bp, Mus musculus
gcagacctagctggaaagcccacca

SEQ ID NO: 260106 - DNA, 25 bp, Mus musculus
aaggagcttgcagaccggccgcctc

SEQ ID NO: 260107 - DNA, 25 bp, Mus musculus
atcccactggggctgctctccgaat

SEQ ID NO: 260108 - DNA, 25 bp, Mus musculus
ctgctctccgaatcgaggtcgcatc

SEQ ID NO: 260109 - DNA, 25 bp, Mus musculus
ctccgaatcgaggtcgcatccctgg

SEQ ID NO: 260110 - DNA, 25 bp, Mus musculus
aggtcgcatccctggcgggaacccg

SEQ ID NO: 260111 - DNA, 25 bp, Mus musculus
gcgatctccctgatcctggggtcta

SEQ ID NO: 260112 - DNA, 25 bp, Mus musculus
ctccctgatcctggggtctagctgt

SEQ ID NO: 260113 - DNA, 25 bp, Mus musculus
ggtctagctgtctgcctcagtcctc

SEQ ID NO: 260114 - DNA, 25 bp, Mus musculus
gcctcagtcctcctcgtgtcccacc

SEQ ID NO: 260115 - DNA, 25 bp, Mus musculus
ttcctctccgaccagagccgtagga

SEQ ID NO: 260116 - DNA, 25 bp, Mus musculus
tctccgaccagagccgtaggaagga

SEQ ID NO: 260117 - DNA, 25 bp, Mus musculus
agccgtaggaaggagcttgcagacc

SEQ ID NO: 260118 - DNA, 25 bp, Mus musculus
gcgcgaatcccactggggctgctct

SEQ ID NO: 260119 - DNA, 25 bp, Mus musculus
ccagagccgtaggaaggagcttgca

SEQ ID NO: 260120 - DNA, 25 bp, Mus musculus
gcagactccggctctacaagaagga

SEQ ID NO: 260121 - DNA, 25 bp, Mus musculus
tccggctctacaagaaggaggagga

SEQ ID NO: 260122 - DNA, 25 bp, Mus musculus
aggcaggggagccactgcaaagtca

SEQ ID NO: 260123 - DNA, 25 bp, Mus musculus
cactgcaaagtcagcaggctgctgc

SEQ ID NO: 260124 - DNA, 25 bp, Mus musculus
gcggatcgcagactccggctctaca

SEQ ID NO: 260125 - DNA, 25 bp, Mus musculus
ggctggagtgtgcacgcgctctccc

SEQ ID NO: 260126 - DNA, 25 bp, Mus musculus
cctagctttctccattgtgattgga

SEQ ID NO: 260127 - DNA, 25 bp, Mus musculus
ctccattgtgattggaaacccgaga

SEQ ID NO: 260128 - DNA, 25 bp, Mus musculus
tgtgattggaaacccgagacgggtc

SEQ ID NO: 260129 - DNA, 25 bp, Mus musculus
tcggctcgttcaatctccttcaagg

SEQ ID NO: 260130 - DNA, 25 bp, Mus musculus
caatctccttcaaggacaaggctgg

SEQ ID NO: 260131 - DNA, 25 bp, Mus musculus
acaaggctggagtgtgcacgcgctc

SEQ ID NO: 260132 - DNA, 25 bp, Mus musculus
aggctgctgctctgcggatcgcaga

SEQ ID NO: 260133 - DNA, 25 bp, Mus musculus
agcctcctagctttctccattgtga

SEQ ID NO: 260134 - DNA, 25 bp, Mus musculus
aaggtgcgatccatagtgcacgcgg

SEQ ID NO: 260135 - DNA, 25 bp, Mus musculus
tgctagtggccatgctccgccagct

SEQ ID NO: 260136 - DNA, 25 bp, Mus musculus
ctagctggggccagacctccgagcg

SEQ ID NO: 260137 - DNA, 25 bp, Mus musculus
tctagaaggtgcgatccatagtgca

SEQ ID NO: 260138 - DNA, 25 bp, Mus musculus
gccgagccagctcggttcccagtag

SEQ ID NO: 260139 - DNA, 25 bp, Mus musculus
tacagactcgggtttgcgctcccgg

SEQ ID NO: 260140 - DNA, 25 bp, Mus musculus
gaggaggcaccagccgagccagctc

SEQ ID NO: 260141 - DNA, 25 bp, Mus musculus
gttaagactctagaaggtgcgatcc

SEQ ID NO: 260142 - DNA, 25 bp, Mus musculus
ggtcctccagaactgagttaagact

SEQ ID NO: 260143 - DNA, 25 bp, Mus musculus
atgttggtcctccagaactgagtta

SEQ ID NO: 260144 - DNA, 25 bp, Mus musculus
caggctctcgcatcccgggagcaga

SEQ ID NO: 260145 - DNA, 25 bp, Mus musculus
gatgcaacttacagactcgggtttg

SEQ ID NO: 260146 - DNA, 25 bp, Mus musculus
ggaggcgcgatgcaacttacagact

SEQ ID NO: 260147 - DNA, 25 bp, Mus musculus
cagagacctcccgaagtgcagatcc

SEQ ID NO: 260148 - DNA, 25 bp, Mus musculus
cgccgcacctggcagcgctggtgct

SEQ ID NO: 260149 - DNA, 25 bp, Mus musculus
ggggattccagaggtgcgcatgccg

SEQ ID NO: 260150 - DNA, 25 bp, Mus musculus
ctcattggctgggtcctgcgcgccg

SEQ ID NO: 260151 - DNA, 25 bp, Mus musculus
gttccgctcattggctgggtcctgc

SEQ ID NO: 260152 - DNA, 25 bp, Mus musculus
tgaagaacatcaagcgcctggcggg

SEQ ID NO: 260153 - DNA, 25 bp, Mus musculus
cccactgaagaacatcaagcgcctg

SEQ ID NO: 260154 - DNA, 25 bp, Mus musculus
ggcatcccactgaagaacatcaagc

SEQ ID NO: 260155 - DNA, 25 bp, Mus musculus
ggcagcaaaggcatcccactgaaga

SEQ ID NO: 260156 - DNA, 25 bp, Mus musculus
cggcctagagaagccgccgcacctg

SEQ ID NO: 260157 - DNA, 25 bp, Mus musculus
gaggaagatggacgcgctggagaag

SEQ ID NO: 260158 - DNA, 25 bp, Mus musculus
ccgagctcccggatgtggagacgtt

SEQ ID NO: 260159 - DNA, 25 bp, Mus musculus
gcgtggcctacagctgccacagcag

SEQ ID NO: 260160 - DNA, 25 bp, Mus musculus
tgggcgtggcctacagctgccacag

SEQ ID NO: 260161 - DNA, 25 bp, Mus musculus
caaaggcatcccactgaagaacatc

SEQ ID NO: 260162 - DNA, 25 bp, Mus musculus
ctctctctcatcagttcattcagcg

SEQ ID NO: 260163 - DNA, 25 bp, Mus musculus
ctcccggacgtctgatgggttgtgt

SEQ ID NO: 260164 - DNA, 25 bp, Mus musculus
gatgggttgtgtcccttccagaaag

SEQ ID NO: 260165 - DNA, 25 bp, Mus musculus
aaagagatgctcctgcgccctgcac

SEQ ID NO: 260166 - DNA, 25 bp, Mus musculus
gcgccacaccaagtccttggaaatt

SEQ ID NO: 260167 - DNA, 25 bp, Mus musculus
tggaaatttccacgatggcccggga

SEQ ID NO: 260168 - DNA, 25 bp, Mus musculus
ctcacgggcaaacctagaactctct

SEQ ID NO: 260169 - DNA, 25 bp, Mus musculus
cgggcaaacctagaactctctctca

SEQ ID NO: 260170 - DNA, 25 bp, Mus musculus
ttcattcagcggtgcgccgcagcct

SEQ ID NO: 260171 - DNA, 25 bp, Mus musculus
ggattggtggaaatcaaggtctccc

SEQ ID NO: 260172 - DNA, 25 bp, Mus musculus
gcgaaattgcctcccgtgacctgct

SEQ ID NO: 260173 - DNA, 25 bp, Mus musculus
tcccgtgacctgcttggggccgcga

SEQ ID NO: 260174 - DNA, 25 bp, Mus musculus
ttactgcagcatcaccgtcgccctc

SEQ ID NO: 260175 - DNA, 25 bp, Mus musculus
tgcgccctggactccgcagacacgc

SEQ ID NO: 260176 - DNA, 25 bp, Mus musculus
ctccacgaaggcatccgtcaggtca

SEQ ID NO: 260177 - DNA, 25 bp, Mus musculus
tgtccaggaccgatggccacatctc

SEQ ID NO: 260178 - DNA, 25 bp, Mus musculus
gccgatttgaattcgcggggccatg

SEQ ID NO: 260179 - DNA, 25 bp, Mus musculus
agcgatcgatctctcggtgctctgc

SEQ ID NO: 260180 - DNA, 25 bp, Mus musculus
accttccaaaaatggcggctcgagg

SEQ ID NO: 260181 - DNA, 25 bp, Mus musculus
agtccagtcagcatcccgcaaagca

SEQ ID NO: 260182 - DNA, 25 bp, Mus musculus
gccaccgaggcctcattccggagaa

SEQ ID NO: 260183 - DNA, 25 bp, Mus musculus
tcacgctctgagcaggaaccgagtc

SEQ ID NO: 260184 - DNA, 25 bp, Mus musculus
tcctgcagaaacaaacaagcgagtc

SEQ ID NO: 260185 - DNA, 25 bp, Mus musculus
gcttcggcctctcctaggattcctg

SEQ ID NO: 260186 - DNA, 25 bp, Mus musculus
ggccacaattttcaccttcagcttc

SEQ ID NO: 260187 - DNA, 25 bp, Mus musculus
cggcaaatggcgaccggccacaatt

SEQ ID NO: 260188 - DNA, 25 bp, Mus musculus
catctacccagcctcgggtcggtta

SEQ ID NO: 260189 - DNA, 25 bp, Mus musculus
tggcacggtccatcaccggcaaatg

SEQ ID NO: 260190 - DNA, 25 bp, Mus musculus
acggagctgaacttcaccaccacgt

SEQ ID NO: 260191 - DNA, 25 bp, Mus musculus
cagctcaagtggacggatgaagcca

SEQ ID NO: 260192 - DNA, 25 bp, Mus musculus
cacgactcaacaaaatccgattccg

SEQ ID NO: 260193 - DNA, 25 bp, Mus musculus
tgaagccacgactcaacaaaatccg

SEQ ID NO: 260194 - DNA, 25 bp, Mus musculus
tggacggatgaagccacgactcaac

SEQ ID NO: 260195 - DNA, 25 bp, Mus musculus
ccacgtccccgagggatggactgga

SEQ ID NO: 260196 - DNA, 25 bp, Mus musculus
gatggactggaggaagcaaagcaaa

SEQ ID NO: 260197 - DNA, 25 bp, Mus musculus
ctggaggaagcaaagcaaaagattc

SEQ ID NO: 260198 - DNA, 25 bp, Mus musculus
agcaaaagattcaggtcgcaaagcc

SEQ ID NO: 260199 - DNA, 25 bp, Mus musculus
gattcaggtcgcaaagcctcgggca

SEQ ID NO: 260200 - DNA, 25 bp, Mus musculus
ggtcgcaaagcctcgggcagctcaa

SEQ ID NO: 260201 - DNA, 25 bp, Mus musculus
caaagcctcgggcagctcaagtgga

SEQ ID NO: 260202 - DNA, 25 bp, Mus musculus
cctcgggcagctcaagtggacggat

SEQ ID NO: 260203 - DNA, 25 bp, Mus musculus
gaagacggagctgaacttcaccacc

SEQ ID NO: 260204 - DNA, 25 bp, Mus musculus
agtcggcttggagacctgccgcgcc

SEQ ID NO: 260205 - DNA, 25 bp, Mus musculus
agcctagtcggcttggagacctgcc

SEQ ID NO: 260206 - DNA, 25 bp, Mus musculus
ccagcgccagcctagtcggcttgga

SEQ ID NO: 260207 - DNA, 25 bp, Mus musculus
aatgcgggtccagccaaggagcgca

SEQ ID NO: 260208 - DNA, 25 bp, Mus musculus
ccctgactctgtgcggcactagggg

SEQ ID NO: 260209 - DNA, 25 bp, Mus musculus
gcgccctgactctgtgcggcactag

SEQ ID NO: 260210 - DNA, 25 bp, Mus musculus
tgactgcacggcggtgacatcaggc

SEQ ID NO: 260211 - DNA, 25 bp, Mus musculus
agccgcctctgggctgactgcacgg

SEQ ID NO: 260212 - DNA, 25 bp, Mus musculus
ggaccgcggtgccttctccgcccag

SEQ ID NO: 260213 - DNA, 25 bp, Mus musculus
tctccgcccagcgatcgcgaggagg

SEQ ID NO: 260214 - DNA, 25 bp, Mus musculus
atcgcgaggagggtctgctttcaat

SEQ ID NO: 260215 - DNA, 25 bp, Mus musculus
cgaggagggtctgctttcaatgagc

SEQ ID NO: 260216 - DNA, 25 bp, Mus musculus
gtctgctttcaatgagccgcctctg

SEQ ID NO: 260217 - DNA, 25 bp, Mus musculus
tgctttcaatgagccgcctctgggc

SEQ ID NO: 260218 - DNA, 25 bp, Mus musculus
cgcgctcggactccttcgggtgcag

SEQ ID NO: 260219 - DNA, 25 bp, Mus musculus
ttcgggtgcaggagcccagccaacc

SEQ ID NO: 260220 - DNA, 25 bp, Mus musculus
cgtgacgctagcgtcaggccagtcc

SEQ ID NO: 260221 - DNA, 25 bp, Mus musculus
agcgcactgaggcatcttcccgaga

SEQ ID NO: 260222 - DNA, 25 bp, Mus musculus
tgggccatggccaattacatccacg

SEQ ID NO: 260223 - DNA, 25 bp, Mus musculus
tgccgaagctcgacgtgacggtgca

SEQ ID NO: 260224 - DNA, 25 bp, Mus musculus
caaggctcgtaagcgctccggctgg

SEQ ID NO: 260225 - DNA, 25 bp, Mus musculus
ctcggcagtgttcggcaaggctcgt

SEQ ID NO: 260226 - DNA, 25 bp, Mus musculus
aaagctcgacagtgctccggcaggg

SEQ ID NO: 260227 - DNA, 25 bp, Mus musculus
cccggtagggctcggcaaagctcga

SEQ ID NO: 260228 - DNA, 25 bp, Mus musculus
gaagccgccgcgtcagcgacgtctg

SEQ ID NO: 260229 - DNA, 25 bp, Mus musculus
gctcgggcaaggctcgttagagccc

SEQ ID NO: 260230 - DNA, 25 bp, Mus musculus
gagccgcgggagaacaactcctttc

SEQ ID NO: 260231 - DNA, 25 bp, Mus musculus
gctcgcccgaggtgccgaagctcga

SEQ ID NO: 260232 - DNA, 25 bp, Mus musculus
ggacggcattcctgccatggcgatg

SEQ ID NO: 260233 - DNA, 25 bp, Mus musculus
acagaaagagaaggtgagtgtgcac

SEQ ID NO: 260234 - DNA, 25 bp, Mus musculus
tctcggcttgactgcctcggtaccg

SEQ ID NO: 260235 - DNA, 25 bp, Mus musculus
cacgggaggtctcggcttgactgcc

SEQ ID NO: 260236 - DNA, 25 bp, Mus musculus
ttgcctgtcacagaaagagaaggtg

SEQ ID NO: 260237 - DNA, 25 bp, Mus musculus
ggatctgtgcttgttgcctgtcaca

SEQ ID NO: 260238 - DNA, 25 bp, Mus musculus
aactccggccgtcgcgatggggatc

SEQ ID NO: 260239 - DNA, 25 bp, Mus musculus
gggtatacaactccggccgtcgcga

SEQ ID NO: 260240 - DNA, 25 bp, Mus musculus
cattcctgccatggcgatggcgctg

SEQ ID NO: 260241 - DNA, 25 bp, Mus musculus
tgctggacacgctcgagtgctcgga

SEQ ID NO: 260242 - DNA, 25 bp, Mus musculus
gctccgggctgctggacacgctcga

SEQ ID NO: 260243 - DNA, 25 bp, Mus musculus
agtgctctggatcacgggcatcccg

SEQ ID NO: 260244 - DNA, 25 bp, Mus musculus
cgccgtaagtgctctggatcacggg

SEQ ID NO: 260245 - DNA, 25 bp, Mus musculus
gatggcgctggggtatacaactccg

SEQ ID NO: 260246 - DNA, 25 bp, Mus musculus
cgggtctggttaatcgctcctctga

SEQ ID NO: 260247 - DNA, 25 bp, Mus musculus
ttataaaacaataccggcaacagga

SEQ ID NO: 260248 - DNA, 25 bp, Mus musculus
ggcaacaggacacgggctcctccaa

SEQ ID NO: 260249 - DNA, 25 bp, Mus musculus
cagcacagataaagttggccgggtc

SEQ ID NO: 260250 - DNA, 25 bp, Mus musculus
ctctccagctggagcagggcgcctt

SEQ ID NO: 260251 - DNA, 25 bp, Mus musculus
gccttggagggttgcccgccaccag

SEQ ID NO: 260252 - DNA, 25 bp, Mus musculus
tccacagcgggacgcgccacaaagt

SEQ ID NO: 260253 - DNA, 25 bp, Mus musculus
gacgcgccacaaagttaaaacgctg

SEQ ID NO: 260254 - DNA, 25 bp, Mus musculus
cacaaagttaaaacgctgcggttca

SEQ ID NO: 260255 - DNA, 25 bp, Mus musculus
aaaacgctgcggttcacgcacctta

SEQ ID NO: 260256 - DNA, 25 bp, Mus musculus
tcacgcaccttaccgggtctggtta

SEQ ID NO: 260257 - DNA, 25 bp, Mus musculus
taatcgctcctctgacgcgggatgc

SEQ ID NO: 260258 - DNA, 25 bp, Mus musculus
tctccgccaccacttataaaacaat

SEQ ID NO: 260259 - DNA, 25 bp, Mus musculus
cctccgaggaccctggagacgggat

SEQ ID NO: 260260 - DNA, 25 bp, Mus musculus
aatacgtggcacagcggcgactcgt

SEQ ID NO: 260261 - DNA, 25 bp, Mus musculus
gcgagcgcagccgatgcagcatctc

SEQ ID NO: 260262 - DNA, 25 bp, Mus musculus
gccgatgcagcatctccgcgttgcg

SEQ ID NO: 260263 - DNA, 25 bp, Mus musculus
catctccgcgttgcgggtgcgtgca

SEQ ID NO: 260264 - DNA, 25 bp, Mus musculus
aagaggtacgatgggagagccacca

SEQ ID NO: 260265 - DNA, 25 bp, Mus musculus
cgtgcagtcacgcatggctgggcac

SEQ ID NO: 260266 - DNA, 25 bp, Mus musculus
cgcgaccagtgttgccttgcggtaa

SEQ ID NO: 260267 - DNA, 25 bp, Mus musculus
cagtgttgccttgcggtaataccca

SEQ ID NO: 260268 - DNA, 25 bp, Mus musculus
tgcggtaatacccaagagcctagtg

SEQ ID NO: 260269 - DNA, 25 bp, Mus musculus
tacccaagagcctagtggcgcccta

SEQ ID NO: 260270 - DNA, 25 bp, Mus musculus
ctcgcctttcgccacgcaggtacct

SEQ ID NO: 260271 - DNA, 25 bp, Mus musculus
ggcaagcaggccatgacgaagctgc

SEQ ID NO: 260272 - DNA, 25 bp, Mus musculus
gatgggagagccaccagcaagcacc

SEQ ID NO: 260273 - DNA, 25 bp, Mus musculus
acagcccgggactgcagtttggcgt

SEQ ID NO: 260274 - DNA, 25 bp, Mus musculus
agcctgttctccgttgcgcccaaag

SEQ ID NO: 260275 - DNA, 25 bp, Mus musculus
agtccagaccgacggacctgcttct

SEQ ID NO: 260276 - DNA, 25 bp, Mus musculus
aaggctcggcgagtctagcctgttc

SEQ ID NO: 260277 - DNA, 25 bp, Mus musculus
cgttgcgcccaaagccgggactcga

SEQ ID NO: 260278 - DNA, 25 bp, Mus musculus
aaagccgggactcgagctcagagtc

SEQ ID NO: 260279 - DNA, 25 bp, Mus musculus
cttgccgggcgatcgcagcagctgc

SEQ ID NO: 260280 - DNA, 25 bp, Mus musculus
gctgccaatcagctgcgggagagtc

SEQ ID NO: 260281 - DNA, 25 bp, Mus musculus
agagtcggtgcctcgttctcagcct

SEQ ID NO: 260282 - DNA, 25 bp, Mus musculus
tgcctcgttctcagcctggcgctgg

SEQ ID NO: 260283 - DNA, 25 bp, Mus musculus
gccacaggctcggaggacagcccaa

SEQ ID NO: 260284 - DNA, 25 bp, Mus musculus
ggctcggaggacagcccaacgcaca

SEQ ID NO: 260285 - DNA, 25 bp, Mus musculus
acaagcacgccattcccgagaaaca

SEQ ID NO: 260286 - DNA, 25 bp, Mus musculus
gacctgcttctctcgctcgggcgag

SEQ ID NO: 260287 - DNA, 25 bp, Mus musculus
attccctttggcttgccgggcgatc

SEQ ID NO: 260288 - DNA, 25 bp, Mus musculus
ttacagaaccaggacaagaaccgga

SEQ ID NO: 260289 - DNA, 25 bp, Mus musculus
gtccgagcatcctcgccaaacccta

SEQ ID NO: 260290 - DNA, 25 bp, Mus musculus
cttcttcccgcctagggagcatgta

SEQ ID NO: 260291 - DNA, 25 bp, Mus musculus
tcccgcctagggagcatgtaggaga

SEQ ID NO: 260292 - DNA, 25 bp, Mus musculus
ctcaaacgcaacgatacggtccttc

SEQ ID NO: 260293 - DNA, 25 bp, Mus musculus
taggagaggcgctgtggcatcctct

SEQ ID NO: 260294 - DNA, 25 bp, Mus musculus
ggcgctgtggcatcctctaaatctg

SEQ ID NO: 260295 - DNA, 25 bp, Mus musculus
tctgggcagctcaaacgcaacgata

SEQ ID NO: 260296 - DNA, 25 bp, Mus musculus
ctgtggcatcctctaaatctgggta

SEQ ID NO: 260297 - DNA, 25 bp, Mus musculus
acaagaaccggagcgggagcatctg

SEQ ID NO: 260298 - DNA, 25 bp, Mus musculus
atcctctaaatctgggtaccgcatt

SEQ ID NO: 260299 - DNA, 25 bp, Mus musculus
tgggtaccgcatttacagaaccagg

SEQ ID NO: 260300 - DNA, 25 bp, Mus musculus
ccgcatttacagaaccaggacaaga

SEQ ID NO: 260301 - DNA, 25 bp, Mus musculus
caaaccctatctctgggcagctcaa

SEQ ID NO: 260302 - DNA, 25 bp, Mus musculus
aggtacgcccacatcgcggctttta

SEQ ID NO: 260303 - DNA, 25 bp, Mus musculus
tcgtagactggttacacaagccaca

SEQ ID NO: 260304 - DNA, 25 bp, Mus musculus
atttacggccgtggtgccgcaaagc

SEQ ID NO: 260305 - DNA, 25 bp, Mus musculus
ttccggcagacggtcggagcattta

SEQ ID NO: 260306 - DNA, 25 bp, Mus musculus
cgagtcccatacactgctgcctgta

SEQ ID NO: 260307 - DNA, 25 bp, Mus musculus
aaagaaagcggcctcgagtcccata

SEQ ID NO: 260308 - DNA, 25 bp, Mus musculus
tgagtactgcccaagtcgtagactg

SEQ ID NO: 260309 - DNA, 25 bp, Mus musculus
acatcgcggcttttacctaatcccg

SEQ ID NO: 260310 - DNA, 25 bp, Mus musculus
gtagtcttccggtgagtactgccca

SEQ ID NO: 260311 - DNA, 25 bp, Mus musculus
tgcgcaatcgcactgtagtcttccg

SEQ ID NO: 260312 - DNA, 25 bp, Mus musculus
tgcgaaggacaacctgcgcaatcgc

SEQ ID NO: 260313 - DNA, 25 bp, Mus musculus
tcccagtgttttgcgaaggacaacc

SEQ ID NO: 260314 - DNA, 25 bp, Mus musculus
actcacaactcccagtgttttgcga

SEQ ID NO: 260315 - DNA, 25 bp, Mus musculus
ctcacggttgtcaagacgacaggcc

SEQ ID NO: 260316 - DNA, 25 bp, Mus musculus
gagccggcttcattcagcgccgcgg

SEQ ID NO: 260317 - DNA, 25 bp, Mus musculus
acttttctgcttccgtgcgggtcgc

SEQ ID NO: 260318 - DNA, 25 bp, Mus musculus
gcgtgggccacctgttctgccagca

SEQ ID NO: 260319 - DNA, 25 bp, Mus musculus
gttctgccagcaccatccctacctc

SEQ ID NO: 260320 - DNA, 25 bp, Mus musculus
tccacctcctcctttgtggccgcgg

SEQ ID NO: 260321 - DNA, 25 bp, Mus musculus
ggccgcggcaatgtcacagccctta

SEQ ID NO: 260322 - DNA, 25 bp, Mus musculus
tgtcacagcccttacaggcgtgggg

SEQ ID NO: 260323 - DNA, 25 bp, Mus musculus
ctccgagaaccacgacgccctccgg

SEQ ID NO: 260324 - DNA, 25 bp, Mus musculus
cccgcgcgcccgacaagttgagccg

SEQ ID NO: 260325 - DNA, 25 bp, Mus musculus
gctcgctccgggtccgaaatggcgc

SEQ ID NO: 260326 - DNA, 25 bp, Mus musculus
gcctgccgaatcgagcccggagtgc

SEQ ID NO: 260327 - DNA, 25 bp, Mus musculus
gcagagcaggccgatcgatgcgctc

SEQ ID NO: 260328 - DNA, 25 bp, Mus musculus
aggccgatcgatgcgctcggtgctc

SEQ ID NO: 260329 - DNA, 25 bp, Mus musculus
gccaccgggtccgagcacctcccgc

SEQ ID NO: 260330 - DNA, 25 bp, Mus musculus
actctgcactctccgtccgggccca

SEQ ID NO: 260331 - DNA, 25 bp, Mus musculus
ggggcgagaccattgcactctgcac

SEQ ID NO: 260332 - DNA, 25 bp, Mus musculus
gggcgagaccattgcactctgcact

SEQ ID NO: 260333 - DNA, 25 bp, Mus musculus
gcgagaccattgcactctgcactct

SEQ ID NO: 260334 - DNA, 25 bp, Mus musculus
agaccattgcactctgcactctccg

SEQ ID NO: 260335 - DNA, 25 bp, Mus musculus
gaccattgcactctgcactctccgt

SEQ ID NO: 260336 - DNA, 25 bp, Mus musculus
attgcactctgcactctccgtccgg

SEQ ID NO: 260337 - DNA, 25 bp, Mus musculus
ttgcactctgcactctccgtccggg

SEQ ID NO: 260338 - DNA, 25 bp, Mus musculus
cggggcgagaccattgcactctgca

SEQ ID NO: 260339 - DNA, 25 bp, Mus musculus
gcactctgcactctccgtccgggcc

SEQ ID NO: 260340 - DNA, 25 bp, Mus musculus
ggcgagaccattgcactctgcactc

SEQ ID NO: 260341 - DNA, 25 bp, Mus musculus
ccctcgacacccgccaccgcgcagc

SEQ ID NO: 260342 - DNA, 25 bp, Mus musculus
tgcactctgcactctccgtccgggc

SEQ ID NO: 260343 - DNA, 25 bp, Mus musculus
cgagaccattgcactctgcactctc

SEQ ID NO: 260344 - DNA, 25 bp, Mus musculus
agctataaataccaccgggctctga

SEQ ID NO: 260345 - DNA, 25 bp, Mus musculus
caaccgtgccgcgacctggacggga

SEQ ID NO: 260346 - DNA, 25 bp, Mus musculus
tgacacaaccgtgccgcgacctgga

SEQ ID NO: 260347 - DNA, 25 bp, Mus musculus
cccagggctctttaaatacgagcta

SEQ ID NO: 260348 - DNA, 25 bp, Mus musculus
atacgagctataaataccaccgggc

SEQ ID NO: 260349 - DNA, 25 bp, Mus musculus
aataccaccgggctctgagagcacg

SEQ ID NO: 260350 - DNA, 25 bp, Mus musculus
accgggctctgagagcacgtcaccg

SEQ ID NO: 260351 - DNA, 25 bp, Mus musculus
ggccgctctgggtatctcatttgca

SEQ ID NO: 260352 - DNA, 25 bp, Mus musculus
ccgctctgggtatctcatttgcata

SEQ ID NO: 260353 - DNA, 25 bp, Mus musculus
cctccccggcaagacagtgggcgga

SEQ ID NO: 260354 - DNA, 25 bp, Mus musculus
ctctgggtatctcatttgcataggg

SEQ ID NO: 260355 - DNA, 25 bp, Mus musculus
tttgcataggggctgacacaaccgt

SEQ ID NO: 260356 - DNA, 25 bp, Mus musculus
ataggggctgacacaaccgtgccgc

SEQ ID NO: 260357 - DNA, 25 bp, Mus musculus
cagggctctttaaatacgagctata

SEQ ID NO: 260358 - DNA, 25 bp, Mus musculus
cgcagcgagctggagaagaaagcca

SEQ ID NO: 260359 - DNA, 25 bp, Mus musculus
tggtcgctgtaagacgcagcgagct

SEQ ID NO: 260360 - DNA, 25 bp, Mus musculus
ctgtaagacgcagcgagctggagaa

SEQ ID NO: 260361 - DNA, 25 bp, Mus musculus
acgcagcgagctggagaagaaagcc

SEQ ID NO: 260362 - DNA, 25 bp, Mus musculus
cagcgagctggagaagaaagccagc

SEQ ID NO: 260363 - DNA, 25 bp, Mus musculus
cagggctcggagatgcaggacttac

SEQ ID NO: 260364 - DNA, 25 bp, Mus musculus
ggctcggagatgcaggacttacgat

SEQ ID NO: 260365 - DNA, 25 bp, Mus musculus
tcggagatgcaggacttacgatgtc

SEQ ID NO: 260366 - DNA, 25 bp, Mus musculus
agatgcaggacttacgatgtctccc

SEQ ID NO: 260367 - DNA, 25 bp, Mus musculus
atgcaggacttacgatgtctcccgg

SEQ ID NO: 260368 - DNA, 25 bp, Mus musculus
tgcaggacttacgatgtctcccggt

SEQ ID NO: 260369 - DNA, 25 bp, Mus musculus
caggacttacgatgtctcccggttt

SEQ ID NO: 260370 - DNA, 25 bp, Mus musculus
ctgtggtcgctgtaagacgcagcga

SEQ ID NO: 260371 - DNA, 25 bp, Mus musculus
ctggagaagaaagccagcagggctc

SEQ ID NO: 260372 - DNA, 25 bp, Mus musculus
tccttcgccttcagggaacatcagc

SEQ ID NO: 260373 - DNA, 25 bp, Mus musculus
tccgatgctcaaaacagactgcgtg

SEQ ID NO: 260374 - DNA, 25 bp, Mus musculus
ggccactccgatgctcaaaacagac

SEQ ID NO: 260375 - DNA, 25 bp, Mus musculus
tgtgagatgactggccactccgatg

SEQ ID NO: 260376 - DNA, 25 bp, Mus musculus
cacggttctgtgagatgactggcca

SEQ ID NO: 260377 - DNA, 25 bp, Mus musculus
tgacccgccacggttctgtgagatg

SEQ ID NO: 260378 - DNA, 25 bp, Mus musculus
aaaccacgtgagagctgacccgcca

SEQ ID NO: 260379 - DNA, 25 bp, Mus musculus
gcggctaaatttaaaccacgtgaga

SEQ ID NO: 260380 - DNA, 25 bp, Mus musculus
cgggtggctcctagcggctaaattt

SEQ ID NO: 260381 - DNA, 25 bp, Mus musculus
ctggatctttttgctttctacgaaa

SEQ ID NO: 260382 - DNA, 25 bp, Mus musculus
gcccgccgattgacactggatcttt

SEQ ID NO: 260383 - DNA, 25 bp, Mus musculus
gaacatcagctctgcccgccgattg

SEQ ID NO: 260384 - DNA, 25 bp, Mus musculus
aacagactgcgtgctgtggtcgctg

SEQ ID NO: 260385 - DNA, 25 bp, Mus musculus
tcgccttcagggaacatcagctctg

SEQ ID NO: 260386 - DNA, 25 bp, Mus musculus
cgagacaaaccacggggcgcatgca

SEQ ID NO: 260387 - DNA, 25 bp, Mus musculus
ggcgcatgcagttcagtggcatccc

SEQ ID NO: 260388 - DNA, 25 bp, Mus musculus
gcggaaccagctacagcggacgaaa

SEQ ID NO: 260389 - DNA, 25 bp, Mus musculus
cgcagcggaacctaaggagaccgga

SEQ ID NO: 260390 - DNA, 25 bp, Mus musculus
gccgcttgtttggtttctcctccga

SEQ ID NO: 260391 - DNA, 25 bp, Mus musculus
tctcctccgatgtgacgcctgcgga

SEQ ID NO: 260392 - DNA, 25 bp, Mus musculus
aacattctgggacgtgggaagcctt

SEQ ID NO: 260393 - DNA, 25 bp, Mus musculus
tttttccaccagagctgagctttgc

SEQ ID NO: 260394 - DNA, 25 bp, Mus musculus
actttgacctctgtgaaagagaccc

SEQ ID NO: 260395 - DNA, 25 bp, Mus musculus
gcagtgtcgcgttccgaatgaagcc

SEQ ID NO: 260396 - DNA, 25 bp, Mus musculus
ccggccgagtgttttccagactttg

SEQ ID NO: 260397 - DNA, 25 bp, Mus musculus
ggacgccttcgacaacccgcgtgag

SEQ ID NO: 260398 - DNA, 25 bp, Mus musculus
ctttgcggagccctgtgactcctgt

SEQ ID NO: 260399 - DNA, 25 bp, Mus musculus
gcccgcggacgcagaacattctggg

SEQ ID NO: 260400 - DNA, 25 bp, Mus musculus
gcatggaagtccaggtgcaccacca

SEQ ID NO: 260401 - DNA, 25 bp, Mus musculus
tcacacgtcaggaggacagcttctc

SEQ ID NO: 260402 - DNA, 25 bp, Mus musculus
tgccaggctcgttcgcaagtctcta

SEQ ID NO: 260403 - DNA, 25 bp, Mus musculus
actgggcctggtagatgtcccgcaa

SEQ ID NO: 260404 - DNA, 25 bp, Mus musculus
cggaacatagctcagcacgtacgtg

SEQ ID NO: 260405 - DNA, 25 bp, Mus musculus
cagcttctcgggagcttcctggaaa

SEQ ID NO: 260406 - DNA, 25 bp, Mus musculus
gaccaggtctcctcacacgtcagga

SEQ ID NO: 260407 - DNA, 25 bp, Mus musculus
tagccagcctgggttcgaccaggtc

SEQ ID NO: 260408 - DNA, 25 bp, Mus musculus
cgaggcgtcgctcttcatagccagc

SEQ ID NO: 260409 - DNA, 25 bp, Mus musculus
ctttcaaaggggctgcagacgtcga

SEQ ID NO: 260410 - DNA, 25 bp, Mus musculus
cagagggcccacgagccctttcaaa

SEQ ID NO: 260411 - DNA, 25 bp, Mus musculus
aggtgcaccaccaacaggtcggacg

SEQ ID NO: 260412 - DNA, 25 bp, Mus musculus
caagtctctagtgcggcatggaagt

SEQ ID NO: 260413 - DNA, 25 bp, Mus musculus
ttcctggaaattcggactgggcctg

SEQ ID NO: 260414 - DNA, 25 bp, Mus musculus
ctctccagatggaaatcggatgctc

SEQ ID NO: 260415 - DNA, 25 bp, Mus musculus
cttctgcattttgtctgaaccgtag

SEQ ID NO: 260416 - DNA, 25 bp, Mus musculus
gagtcgcccagaggcggcttgcaaa

SEQ ID NO: 260417 - DNA, 25 bp, Mus musculus
gcttgcaaagttggctgcgtcctgc

SEQ ID NO: 260418 - DNA, 25 bp, Mus musculus
ctgcgtcctgcaccctggaaacttg

SEQ ID NO: 260419 - DNA, 25 bp, Mus musculus
ccctggaaacttgcagagggcaatc

SEQ ID NO: 260420 - DNA, 25 bp, Mus musculus
tgcagagggcaatcataggaggctc

SEQ ID NO: 260421 - DNA, 25 bp, Mus musculus
cataggaggctcaactttaagggtc

SEQ ID NO: 260422 - DNA, 25 bp, Mus musculus
ccagctaggggctgggttgctcatt

SEQ ID NO: 260423 - DNA, 25 bp, Mus musculus
tgcgagcgcagtaagtacaactttc

SEQ ID NO: 260424 - DNA, 25 bp, Mus musculus
tggcggttggaaggcttctgcattt

SEQ ID NO: 260425 - DNA, 25 bp, Mus musculus
cgagcgactttagaggccacttttg

SEQ ID NO: 260426 - DNA, 25 bp, Mus musculus
tgctcatttcagcatcgccgagctg

SEQ ID NO: 260427 - DNA, 25 bp, Mus musculus
tcccggtgtccttggcgagcgactt

SEQ ID NO: 260428 - DNA, 25 bp, Mus musculus
tccaggccgctcttgtctagccagg

SEQ ID NO: 260429 - DNA, 25 bp, Mus musculus
ttcctgagagctctccgggttcaca

SEQ ID NO: 260430 - DNA, 25 bp, Mus musculus
gcgacagcacggacgacaagcaagg

SEQ ID NO: 260431 - DNA, 25 bp, Mus musculus
ccgcggggtacagatacttgtccag

SEQ ID NO: 260432 - DNA, 25 bp, Mus musculus
tccagcttcggcctcttgggcgcag

SEQ ID NO: 260433 - DNA, 25 bp, Mus musculus
tccagctctcaaagcgcgcgaggta

SEQ ID NO: 260434 - DNA, 25 bp, Mus musculus
cgcgcgaggtattgcaagacttctt

SEQ ID NO: 260435 - DNA, 25 bp, Mus musculus
caagacttctttggcgcaggtttga

SEQ ID NO: 260436 - DNA, 25 bp, Mus musculus
tggaacgcatccaagtcggcctgga

SEQ ID NO: 260437 - DNA, 25 bp, Mus musculus
accggcgatttcagagagcgctccc

SEQ ID NO: 260438 - DNA, 25 bp, Mus musculus
aaccgcggcgttaagacatctgctc

SEQ ID NO: 260439 - DNA, 25 bp, Mus musculus
acatctgctcatcacgtgggccctg

SEQ ID NO: 260440 - DNA, 25 bp, Mus musculus
tgcgtggcatcttcctgagagctct

SEQ ID NO: 260441 - DNA, 25 bp, Mus musculus
ggctccctgggtgtccagctctcaa

SEQ ID NO: 260442 - DNA, 25 bp, Mus musculus
gacaccctttaggtcaggctggaga

SEQ ID NO: 260443 - DNA, 25 bp, Mus musculus
gctcgtccagcatctcggtgcagaa

SEQ ID NO: 260444 - DNA, 25 bp, Mus musculus
ttggctttcccaccaattgctgttg

SEQ ID NO: 260445 - DNA, 25 bp, Mus musculus
cgcgaattcgtggtggctaaacttg

SEQ ID NO: 260446 - DNA, 25 bp, Mus musculus
cggacattcgctatcgccagcggca

SEQ ID NO: 260447 - DNA, 25 bp, Mus musculus
atcacgttcactctcggacattcgc

SEQ ID NO: 260448 - DNA, 25 bp, Mus musculus
cccaggttgctcctacactaatttc

SEQ ID NO: 260449 - DNA, 25 bp, Mus musculus
gtggcgagcccacgtttactactgg

SEQ ID NO: 260450 - DNA, 25 bp, Mus musculus
gccggaattgcggtgacactaatca

SEQ ID NO: 260451 - DNA, 25 bp, Mus musculus
ccaagtggttctggcaacagtgtcc

SEQ ID NO: 260452 - DNA, 25 bp, Mus musculus
tcagaatgtcgcataccaagtggtt

SEQ ID NO: 260453 - DNA, 25 bp, Mus musculus
ttgcttcccggatttaagatcagtg

SEQ ID NO: 260454 - DNA, 25 bp, Mus musculus
ctcattgtttactggccaggggtga

SEQ ID NO: 260455 - DNA, 25 bp, Mus musculus
aggctggagacctaccctgaaaagg

SEQ ID NO: 260456 - DNA, 25 bp, Mus musculus
agacatgctgcttcacgctcctgtg

SEQ ID NO: 260457 - DNA, 25 bp, Mus musculus
cctatttgcaaaaggcaagggactt

SEQ ID NO: 260458 - DNA, 25 bp, Mus musculus
gagcgcgcagagacaatccctattt

SEQ ID NO: 260459 - DNA, 25 bp, Mus musculus
tgcagccagcgtagacaggacgacc

SEQ ID NO: 260460 - DNA, 25 bp, Mus musculus
cccaggactttccagatgcgggctg

SEQ ID NO: 260461 - DNA, 25 bp, Mus musculus
actctttagaccaggtggcggtgcc

SEQ ID NO: 260462 - DNA, 25 bp, Mus musculus
tccgctgcacgcaagggtgagctca

SEQ ID NO: 260463 - DNA, 25 bp, Mus musculus
cctgcccagcagtaggtttcctgtt

SEQ ID NO: 260464 - DNA, 25 bp, Mus musculus
aactgccgacacgagggttcagatg

SEQ ID NO: 260465 - DNA, 25 bp, Mus musculus
gctggacattttgtcagacatgctg

SEQ ID NO: 260466 - DNA, 25 bp, Mus musculus
cccaatgtagaggaagctggacatt

SEQ ID NO: 260467 - DNA, 25 bp, Mus musculus
tggcgctgctcaaagcacgtcctgc

SEQ ID NO: 260468 - DNA, 25 bp, Mus musculus
cagaggggtccaagcagctctgctc

SEQ ID NO: 260469 - DNA, 25 bp, Mus musculus
ctgttcctggcgaagttctgtccta

SEQ ID NO: 260470 - DNA, 25 bp, Mus musculus
tgagcccatcctcgggaacgtagcc

SEQ ID NO: 260471 - DNA, 25 bp, Mus musculus
agctgctgcgcggtgagcccatcct

SEQ ID NO: 260472 - DNA, 25 bp, Mus musculus
cattcgggcgtcagcgaggaacagc

SEQ ID NO: 260473 - DNA, 25 bp, Mus musculus
cgtgctcacccaggtaggggcaatc

SEQ ID NO: 260474 - DNA, 25 bp, Mus musculus
caatctcggcgcttacttgtaggtg

SEQ ID NO: 260475 - DNA, 25 bp, Mus musculus
aggtgaggccatccgcgttggcaaa

SEQ ID NO: 260476 - DNA, 25 bp, Mus musculus
atccgcgttggcaaagagctgctgc

SEQ ID NO: 260477 - DNA, 25 bp, Mus musculus
cagcgaggaacagccgtgcacgtgc

SEQ ID NO: 260478 - DNA, 25 bp, Mus musculus
agaaagagccaagcgtagacacgcc

SEQ ID NO: 260479 - DNA, 25 bp, Mus musculus
cgggcaggatatgagaccagagaaa

SEQ ID NO: 260480 - DNA, 25 bp, Mus musculus
ctcgactctggcgaccaggccaggg

SEQ ID NO: 260481 - DNA, 25 bp, Mus musculus
cgcaatggcacctcgactctggcga

SEQ ID NO: 260482 - DNA, 25 bp, Mus musculus
ggagacaccgcgacccgacataaac

SEQ ID NO: 260483 - DNA, 25 bp, Mus musculus
tagtccgccatgctgctgggagaca

SEQ ID NO: 260484 - DNA, 25 bp, Mus musculus
gtggaataactacacgcgtgggcga

SEQ ID NO: 260485 - DNA, 25 bp, Mus musculus
acggtcaggacgacccgagagatcc

SEQ ID NO: 260486 - DNA, 25 bp, Mus musculus
gttccctgaaaaccctgggcctgca

SEQ ID NO: 260487 - DNA, 25 bp, Mus musculus
gctctggacaggcagagcctaccca

SEQ ID NO: 260488 - DNA, 25 bp, Mus musculus
ccctcggaaaacacgcgagagtgtg

SEQ ID NO: 260489 - DNA, 25 bp, Mus musculus
tgcgagcggcagagcaaaaccttga

SEQ ID NO: 260490 - DNA, 25 bp, Mus musculus
gttctccaatcaacggccagccgtt

SEQ ID NO: 260491 - DNA, 25 bp, Mus musculus
gaagtctcgcgaggcttgtcgctca

SEQ ID NO: 260492 - DNA, 25 bp, Mus musculus
gtcccgccgctgtgtgagcaggact

SEQ ID NO: 260493 - DNA, 25 bp, Mus musculus
caggactgtgcgtccgctcgctgag

SEQ ID NO: 260494 - DNA, 25 bp, Mus musculus
gcgcggagaccactccgtgggcact

SEQ ID NO: 260495 - DNA, 25 bp, Mus musculus
ggactgaagcgcagtggaataacta

SEQ ID NO: 260496 - DNA, 25 bp, Mus musculus
gctctccctgaggtcctgccgggaa

SEQ ID NO: 260497 - DNA, 25 bp, Mus musculus
tcctgccgggaactgaggtacggaa

SEQ ID NO: 260498 - DNA, 25 bp, Mus musculus
cgaacccgcggcctgacgcgcatct

SEQ ID NO: 260499 - DNA, 25 bp, Mus musculus
cttccggcacgacagccgcgcgcgt

SEQ ID NO: 260500 - DNA, 25 bp, Mus musculus
cctgacgcgcatctgcaaccgggga

SEQ ID NO: 260501 - DNA, 25 bp, Mus musculus
atctgcaaccggggagggctgcaca

SEQ ID NO: 260502 - DNA, 25 bp, Mus musculus
cagcctgcggccctgctgcaggagc

SEQ ID NO: 260503 - DNA, 25 bp, Mus musculus
cggaggcaagttcgggaagctcacc

SEQ ID NO: 260504 - DNA, 25 bp, Mus musculus
aagttcgggaagctcaccgtcgctg

SEQ ID NO: 260505 - DNA, 25 bp, Mus musculus
ggaagctcaccgtcgctggagttcg

SEQ ID NO: 260506 - DNA, 25 bp, Mus musculus
agcaccgctaggaccagcaggcgca

SEQ ID NO: 260507 - DNA, 25 bp, Mus musculus
gcagccgccacatcgctgcgggccg

SEQ ID NO: 260508 - DNA, 25 bp, Mus musculus
gcgcgcaggccaggtcgcttgctac

SEQ ID NO: 260509 - DNA, 25 bp, Mus musculus
agcgcccgcgcgcatcgctttagcg

SEQ ID NO: 260510 - DNA, 25 bp, Mus musculus
gcgcatcgctttagcgcgccggccc

SEQ ID NO: 260511 - DNA, 25 bp, Mus musculus
caggatggacacggtcccgaacccg

SEQ ID NO: 260512 - DNA, 25 bp, Mus musculus
cgtaaacgcgaacccgtagcagctc

SEQ ID NO: 260513 - DNA, 25 bp, Mus musculus
ctgacgtcagcaggcccgcaggctg

SEQ ID NO: 260514 - DNA, 25 bp, Mus musculus
gattggtccggaggcgtcataaatt

SEQ ID NO: 260515 - DNA, 25 bp, Mus musculus
tcataaattggccaatcgctcgcgc

SEQ ID NO: 260516 - DNA, 25 bp, Mus musculus
tctagcagcttttgcgcacccttgc

SEQ ID NO: 260517 - DNA, 25 bp, Mus musculus
tgagggctttcctctgctcgccagc

SEQ ID NO: 260518 - DNA, 25 bp, Mus musculus
cgcacccttgcgtgcgtggtgaaca

SEQ ID NO: 260519 - DNA, 25 bp, Mus musculus
atggcggatagactcactcagctgc

SEQ ID NO: 260520 - DNA, 25 bp, Mus musculus
ctcagctgcaggacgctgtgaactc

SEQ ID NO: 260521 - DNA, 25 bp, Mus musculus
ctgtgaactcggtgagggctttcct

SEQ ID NO: 260522 - DNA, 25 bp, Mus musculus
tcacgtagtccacagggcggggtct

SEQ ID NO: 260523 - DNA, 25 bp, Mus musculus
cgtgaggcctgggtctcacgtagtc

SEQ ID NO: 260524 - DNA, 25 bp, Mus musculus
cagccttgctttcctgacgcggaga

SEQ ID NO: 260525 - DNA, 25 bp, Mus musculus
atcgctcgcgctctagcagcttttg

SEQ ID NO: 260526 - DNA, 25 bp, Mus musculus
tatggatggcacagctcacgcaata

SEQ ID NO: 260527 - DNA, 25 bp, Mus musculus
catagagcttgggaagcacgtaggc

SEQ ID NO: 260528 - DNA, 25 bp, Mus musculus
aggtgcagcgccagcaggtctgaat

SEQ ID NO: 260529 - DNA, 25 bp, Mus musculus
tgcagcgccagcaggtctgaatcgt

SEQ ID NO: 260530 - DNA, 25 bp, Mus musculus
agcgccagcaggtctgaatcgtggt

SEQ ID NO: 260531 - DNA, 25 bp, Mus musculus
tgctatggatggcacagctcacgca

SEQ ID NO: 260532 - DNA, 25 bp, Mus musculus
tggcacagctcacgcaataatgcag

SEQ ID NO: 260533 - DNA, 25 bp, Mus musculus
acagctcacgcaataatgcagcttg

SEQ ID NO: 260534 - DNA, 25 bp, Mus musculus
gctcacgcaataatgcagcttgaca

SEQ ID NO: 260535 - DNA, 25 bp, Mus musculus
tcacgcaataatgcagcttgacata

SEQ ID NO: 260536 - DNA, 25 bp, Mus musculus
cttgacatagagcttgggaagcacg

SEQ ID NO: 260537 - DNA, 25 bp, Mus musculus
tgggaagcacgtaggcgtcgaagac

SEQ ID NO: 260538 - DNA, 25 bp, Mus musculus
ggatggcacagctcacgcaataatg

SEQ ID NO: 260539 - DNA, 25 bp, Mus musculus
gcaataatgcagcttgacatagagc

SEQ ID NO: 260540 - DNA, 25 bp, Mus musculus
gtgagcgcgaacacgtgtcagaatg

SEQ ID NO: 260541 - DNA, 25 bp, Mus musculus
cgtcggaaccgaagatctcaccgga

SEQ ID NO: 260542 - DNA, 25 bp, Mus musculus
gagccgccgctgtgagccgcgcaaa

SEQ ID NO: 260543 - DNA, 25 bp, Mus musculus
gtgacctcacggttcgggccgcttc

SEQ ID NO: 260544 - DNA, 25 bp, Mus musculus
tcgccgcggaggatggtgacctcac

SEQ ID NO: 260545 - DNA, 25 bp, Mus musculus
aagatcccgccgtgcgcgattgtga

SEQ ID NO: 260546 - DNA, 25 bp, Mus musculus
tagtctgccggaccagcaccaaaga

SEQ ID NO: 260547 - DNA, 25 bp, Mus musculus
agcaccaaagagaagccggcgtttc

SEQ ID NO: 260548 - DNA, 25 bp, Mus musculus
cccttccttggaatagtctgccgga

SEQ ID NO: 260549 - DNA, 25 bp, Mus musculus
tgtcgcctcacccttccttggaata

SEQ ID NO: 260550 - DNA, 25 bp, Mus musculus
cacagtgcatgtcccggtgtcgcct

SEQ ID NO: 260551 - DNA, 25 bp, Mus musculus
acgtgtcagaatggctggggtcaca

SEQ ID NO: 260552 - DNA, 25 bp, Mus musculus
cggctccaggtgactgcggtcagcc

SEQ ID NO: 260553 - DNA, 25 bp, Mus musculus
gaagccggcgtttcgggcccactca

SEQ ID NO: 260554 - DNA, 25 bp, Mus musculus
actttctctgttgcggggtcgctct

SEQ ID NO: 260555 - DNA, 25 bp, Mus musculus
agagggcacggctcgccggcacaaa

SEQ ID NO: 260556 - DNA, 25 bp, Mus musculus
gacacttccgcctgggtgcgtatga

SEQ ID NO: 260557 - DNA, 25 bp, Mus musculus
aatctaggagatcaagtctcgcgag

SEQ ID NO: 260558 - DNA, 25 bp, Mus musculus
tcgcgagattctggcgcggccgctt

SEQ ID NO: 260559 - DNA, 25 bp, Mus musculus
cgatgctactttctctgttgcgggg

SEQ ID NO: 260560 - DNA, 25 bp, Mus musculus
gccggcacaaagttgccggtgcaca

SEQ ID NO: 260561 - DNA, 25 bp, Mus musculus
ccggtgcacagcgacggcaaactgt

SEQ ID NO: 260562 - DNA, 25 bp, Mus musculus
agcgacggcaaactgtgcccgagcc

SEQ ID NO: 260563 - DNA, 25 bp, Mus musculus
gcgtccctgtcaccgatgctacttt

SEQ ID NO: 260564 - DNA, 25 bp, Mus musculus
tccggctcctctgcaacttgggacg

SEQ ID NO: 260565 - DNA, 25 bp, Mus musculus
gcgctgacgccagaaggacacttcc

SEQ ID NO: 260566 - DNA, 25 bp, Mus musculus
tcgctcttgggtcccgaagtttgga

SEQ ID NO: 260567 - DNA, 25 bp, Mus musculus
ccctcgggactcactcggtgcagag

SEQ ID NO: 260568 - DNA, 25 bp, Mus musculus
cagcctctgcgcttggggctctgct

SEQ ID NO: 260569 - DNA, 25 bp, Mus musculus
cctcttggtttagggcggatctcaa

SEQ ID NO: 260570 - DNA, 25 bp, Mus musculus
ttcctcttggtttagggcggatctc

SEQ ID NO: 260571 - DNA, 25 bp, Mus musculus
ctgagggcgttcctcttggtttagg

SEQ ID NO: 260572 - DNA, 25 bp, Mus musculus
tttagggcggatctcaacgctgctc

SEQ ID NO: 260573 - DNA, 25 bp, Mus musculus
gatctcaacgctgctccgccagcct

SEQ ID NO: 260574 - DNA, 25 bp, Mus musculus
gcctctgcgcttggggctctgctga

SEQ ID NO: 260575 - DNA, 25 bp, Mus musculus
ccgcccgtgcgggtgccttgtccct

SEQ ID NO: 260576 - DNA, 25 bp, Mus musculus
gcccaagccctgtgcgcccaggccg

SEQ ID NO: 260577 - DNA, 25 bp, Mus musculus
tgagtggcttgtcgagaccccgaaa

SEQ ID NO: 260578 - DNA, 25 bp, Mus musculus
tgtcgagaccccgaaactgtgtcgg

SEQ ID NO: 260579 - DNA, 25 bp, Mus musculus
cactgagggcgttcctcttggttta

SEQ ID NO: 260580 - DNA, 25 bp, Mus musculus
gccactgagggcgttcctcttggtt

SEQ ID NO: 260581 - DNA, 25 bp, Mus musculus
tagggcggatctcaacgctgctccg

SEQ ID NO: 260582 - DNA, 25 bp, Mus musculus
tcccgggaggcggaactgcaacttg

SEQ ID NO: 260583 - DNA, 25 bp, Mus musculus
ccacgcggaactagggtggccacct

SEQ ID NO: 260584 - DNA, 25 bp, Mus musculus
aatgtgggagaccaggcgccgcctc

SEQ ID NO: 260585 - DNA, 25 bp, Mus musculus
agctccgctgggctcggccaggaat

SEQ ID NO: 260586 - DNA, 25 bp, Mus musculus
cttctgacccgggaagagctgcgag

SEQ ID NO: 260587 - DNA, 25 bp, Mus musculus
ttcgggatgagcgtcgcttctgacc

SEQ ID NO: 260588 - DNA, 25 bp, Mus musculus
agccgcgggcggttccttctgcgac

SEQ ID NO: 260589 - DNA, 25 bp, Mus musculus
acagaggcgttctttcgggatgagc

SEQ ID NO: 260590 - DNA, 25 bp, Mus musculus
ggtccgcgacacagaggcgttcttt

SEQ ID NO: 260591 - DNA, 25 bp, Mus musculus
agtctctgtaagtcctcagtttccc

SEQ ID NO: 260592 - DNA, 25 bp, Mus musculus
atcctcgtccgctcagtctctgtaa

SEQ ID NO: 260593 - DNA, 25 bp, Mus musculus
ggtggccacctctgggatcctcgtc

SEQ ID NO: 260594 - DNA, 25 bp, Mus musculus
gttgagcgccgctagatgaccacgc

SEQ ID NO: 260595 - DNA, 25 bp, Mus musculus
aactgcaacttgtggagctcggcgg

SEQ ID NO: 260596 - DNA, 25 bp, Mus musculus
tgcgcaccttctcctcggtcgccag

SEQ ID NO: 260597 - DNA, 25 bp, Mus musculus
tccggctcgccgtcctttatcatgg

SEQ ID NO: 260598 - DNA, 25 bp, Mus musculus
cgctccgtgaccttcctgtgttttt

SEQ ID NO: 260599 - DNA, 25 bp, Mus musculus
cctgtgtttttctggaggtcgtcgc

SEQ ID NO: 260600 - DNA, 25 bp, Mus musculus
aggtcgtcgcgcatttccacgagtg

SEQ ID NO: 260601 - DNA, 25 bp, Mus musculus
gcatttccacgagtgcgttcgctga

SEQ ID NO: 260602 - DNA, 25 bp, Mus musculus
cgcgctgcagctgaggcagaccctg

SEQ ID NO: 260603 - DNA, 25 bp, Mus musculus
agtgcgttcgctgagcccggcacac

SEQ ID NO: 260604 - DNA, 25 bp, Mus musculus
tgagcccggcacaccgcaggggttc

SEQ ID NO: 260605 - DNA, 25 bp, Mus musculus
gggcacctgcccaccagggccttcc

SEQ ID NO: 260606 - DNA, 25 bp, Mus musculus
gcctctcctgcagggcatgcttctt

SEQ ID NO: 260607 - DNA, 25 bp, Mus musculus
agggcatgcttcttccttccgcgct

SEQ ID NO: 260608 - DNA, 25 bp, Mus musculus
gctcgctctcctgcagacctgctca

SEQ ID NO: 260609 - DNA, 25 bp, Mus musculus
tcgccgtcctttatcatggcggccg

SEQ ID NO: 260610 - DNA, 25 bp, Mus musculus
gctgatcgaacagagcgactacttc

SEQ ID NO: 260611 - DNA, 25 bp, Mus musculus
tcagccgcaattcccgctactgttg

SEQ ID NO: 260612 - DNA, 25 bp, Mus musculus
tgcgcttccaccaggtgctgtgtca

SEQ ID NO: 260613 - DNA, 25 bp, Mus musculus
tgcgcttcatggtgctgcgcttcca

SEQ ID NO: 260614 - DNA, 25 bp, Mus musculus
tacggactgcccgacctgcaggacg

SEQ ID NO: 260615 - DNA, 25 bp, Mus musculus
ctgggcaactgcctggagctgtacc

SEQ ID NO: 260616 - DNA, 25 bp, Mus musculus
cttctgcgcttgctgctgtcgcacg

SEQ ID NO: 260617 - DNA, 25 bp, Mus musculus
tttctgcaggtcacggcgcttctgc

SEQ ID NO: 260618 - DNA, 25 bp, Mus musculus
gtgctggacttcatcaacgcgggcg

SEQ ID NO: 260619 - DNA, 25 bp, Mus musculus
cccggtgagcaagagcaagctgatc

SEQ ID NO: 260620 - DNA, 25 bp, Mus musculus
gtgcagatccgcctggaagaccgct

SEQ ID NO: 260621 - DNA, 25 bp, Mus musculus
gcccagccatgtcggccgaggagat

SEQ ID NO: 260622 - DNA, 25 bp, Mus musculus
tccatgcttaggtacgaggagacca

SEQ ID NO: 260623 - DNA, 25 bp, Mus musculus
gaagaccgctgctacccggtgagca

SEQ ID NO: 260624 - DNA, 25 bp, Mus musculus
gggccgatctgacgctctcctcctc

SEQ ID NO: 260625 - DNA, 25 bp, Mus musculus
tgctgagaagtgagcgagtcgcaaa

SEQ ID NO: 260626 - DNA, 25 bp, Mus musculus
cgagtcgcaaagaggtggcgcccga

SEQ ID NO: 260627 - DNA, 25 bp, Mus musculus
gtggcgcccgaggaacgcgcgccgg

SEQ ID NO: 260628 - DNA, 25 bp, Mus musculus
gcgtgggccgatctgacgctctcct

SEQ ID NO: 260629 - DNA, 25 bp, Mus musculus
tcctcctcctgaaccggcctgctgt

SEQ ID NO: 260630 - DNA, 25 bp, Mus musculus
cctgctgagaagtgagcgagtcgca

SEQ ID NO: 260631 - DNA, 25 bp, Mus musculus
ggccaacctgctgagaagtgagcga

SEQ ID NO: 260632 - DNA, 25 bp, Mus musculus
ctccggggccaacctgctgagaagt

SEQ ID NO: 260633 - DNA, 25 bp, Mus musculus
ggaaggttcacacgctccggggcca

SEQ ID NO: 260634 - DNA, 25 bp, Mus musculus
ccctggaaggttcacacgctccggg

SEQ ID NO: 260635 - DNA, 25 bp, Mus musculus
agccctggaaggttcacacgctccg

SEQ ID NO: 260636 - DNA, 25 bp, Mus musculus
gcgcgtgtcgtggatgcgagggcca

SEQ ID NO: 260637 - DNA, 25 bp, Mus musculus
tcctggcccgcgtgggccgatctga

SEQ ID NO: 260638 - DNA, 25 bp, Mus musculus
tcccgaaccggcgtaggcaataaga

SEQ ID NO: 260639 - DNA, 25 bp, Mus musculus
ctccggctcgtagccggcctgcagc

SEQ ID NO: 260640 - DNA, 25 bp, Mus musculus
ctctccgcgtggaggctcccgaacc

SEQ ID NO: 260641 - DNA, 25 bp, Mus musculus
gttcctccatgccatgcggaggccg

SEQ ID NO: 260642 - DNA, 25 bp, Mus musculus
tctcccggcgttgccgcgcccttct

SEQ ID NO: 260643 - DNA, 25 bp, Mus musculus
cagcgctacccggtctcccggcgtt

SEQ ID NO: 260644 - DNA, 25 bp, Mus musculus
cgaaccggcgtaggcaataagagcc

SEQ ID NO: 260645 - DNA, 25 bp, Mus musculus
ggtgagagcggttcctccatgccat

SEQ ID NO: 260646 - DNA, 25 bp, Mus musculus
agcggcgagagcagcccggactccg

SEQ ID NO: 260647 - DNA, 25 bp, Mus musculus
agccgctccacctccctgcagcagc

SEQ ID NO: 260648 - DNA, 25 bp, Mus musculus
gcggtctcatgtcccgggtgttgcc

SEQ ID NO: 260649 - DNA, 25 bp, Mus musculus
tgcgccgcggtctcatgtcccgggt

SEQ ID NO: 260650 - DNA, 25 bp, Mus musculus
tgggcgtcacctctccggctcgtag

SEQ ID NO: 260651 - DNA, 25 bp, Mus musculus
gagcggttcctccatgccatgcgga

SEQ ID NO: 260652 - DNA, 25 bp, Mus musculus
ggtgggaacgtgaccaagttactgc

SEQ ID NO: 260653 - DNA, 25 bp, Mus musculus
cacaccctcagtggcgtctcgggtt

SEQ ID NO: 260654 - DNA, 25 bp, Mus musculus
gagctgatcgctggacacaccctca

SEQ ID NO: 260655 - DNA, 25 bp, Mus musculus
cactcggagttctggagagctgatc

SEQ ID NO: 260656 - DNA, 25 bp, Mus musculus
agcgcgcactgtgcactcggagttc

SEQ ID NO: 260657 - DNA, 25 bp, Mus musculus
ctcagaccttgggaaagcgcgcact

SEQ ID NO: 260658 - DNA, 25 bp, Mus musculus
gaagtgttgaccctgatgcggttcc

SEQ ID NO: 260659 - DNA, 25 bp, Mus musculus
aagtccgcttgttgtccgcgctgta

SEQ ID NO: 260660 - DNA, 25 bp, Mus musculus
cccgagtggagagccatagtaagtc

SEQ ID NO: 260661 - DNA, 25 bp, Mus musculus
gcgcttggcctctgtctgttacaca

SEQ ID NO: 260662 - DNA, 25 bp, Mus musculus
aagttactgcgagtcgcgaggccgc

SEQ ID NO: 260663 - DNA, 25 bp, Mus musculus
acttccggtgaggatgtcctggacg

SEQ ID NO: 260664 - DNA, 25 bp, Mus musculus
ctgcacttgggtagtcccgagtgga

SEQ ID NO: 260665 - DNA, 25 bp, Mus musculus
gcgggcctaggtagaaatcaacttc

SEQ ID NO: 260666 - DNA, 25 bp, Mus musculus
atatagagagtcacgtttgggagcc

SEQ ID NO: 260667 - DNA, 25 bp, Mus musculus
ggaccgtgaccaccagccggcaagt

SEQ ID NO: 260668 - DNA, 25 bp, Mus musculus
atctccgggaggaccgtgaccacca

SEQ ID NO: 260669 - DNA, 25 bp, Mus musculus
cttcatctccgggaggaccgtgacc

SEQ ID NO: 260670 - DNA, 25 bp, Mus musculus
gaaaagctcgagtgcctccttcatc

SEQ ID NO: 260671 - DNA, 25 bp, Mus musculus
ttcagaaaagctcgagtgcctcctt

SEQ ID NO: 260672 - DNA, 25 bp, Mus musculus
gcagaggcgcggttcagaaaagctc

SEQ ID NO: 260673 - DNA, 25 bp, Mus musculus
gccggatatatagagagtcacgttt

SEQ ID NO: 260674 - DNA, 25 bp, Mus musculus
ttctgagccggatatatagagagtc

SEQ ID NO: 260675 - DNA, 25 bp, Mus musculus
cagcagcgaccaggaaggtcggagg

SEQ ID NO: 260676 - DNA, 25 bp, Mus musculus
tcctcccgccctggcagaggcctcg

SEQ ID NO: 260677 - DNA, 25 bp, Mus musculus
catcctcggggcctgtgcgtccgag

SEQ ID NO: 260678 - DNA, 25 bp, Mus musculus
gaagcccaggcgatgccatcctcgg

SEQ ID NO: 260679 - DNA, 25 bp, Mus musculus
cgcggttcagaaaagctcgagtgcc

SEQ ID NO: 260680 - DNA, 25 bp, Mus musculus
ccggaagtgatcaccagccacctta

SEQ ID NO: 260681 - DNA, 25 bp, Mus musculus
cgtggctacgtggaaactaagtgaa

SEQ ID NO: 260682 - DNA, 25 bp, Mus musculus
tgtgatctaatcaagcggcgcggtc

SEQ ID NO: 260683 - DNA, 25 bp, Mus musculus
tccgcgttgacggtatgtgatctaa

SEQ ID NO: 260684 - DNA, 25 bp, Mus musculus
tctcacggctgaccatgtccgaagg

SEQ ID NO: 260685 - DNA, 25 bp, Mus musculus
gccgaccgccatgtttcacagaagc

SEQ ID NO: 260686 - DNA, 25 bp, Mus musculus
tcttacctagtggtacggtcccagc

SEQ ID NO: 260687 - DNA, 25 bp, Mus musculus
cacgacagcctggacgagacaacga

SEQ ID NO: 260688 - DNA, 25 bp, Mus musculus
ccctggatgggtcaacagctgacaa

SEQ ID NO: 260689 - DNA, 25 bp, Mus musculus
tcccgtatcaggagctgagccgtca

SEQ ID NO: 260690 - DNA, 25 bp, Mus musculus
cacgtttgcccgtagatctccgaga

SEQ ID NO: 260691 - DNA, 25 bp, Mus musculus
gcaccgaattgcacgcctaaagtta

SEQ ID NO: 260692 - DNA, 25 bp, Mus musculus
gcctccggctttgcgtcttcattta

SEQ ID NO: 260693 - DNA, 25 bp, Mus musculus
ccgaaacagctgttacttgcctata

SEQ ID NO: 260694 - DNA, 25 bp, Mus musculus
cgccggggtgctggacgccaacaca

SEQ ID NO: 260695 - DNA, 25 bp, Mus musculus
ctctgcagctcggtgttggatagct

SEQ ID NO: 260696 - DNA, 25 bp, Mus musculus
aagaggcgtctctgcagctcggtgt

SEQ ID NO: 260697 - DNA, 25 bp, Mus musculus
ttaacccagaagaggcgtctctgca

SEQ ID NO: 260698 - DNA, 25 bp, Mus musculus
tgttttaacccagaagaggcgtctc

SEQ ID NO: 260699 - DNA, 25 bp, Mus musculus
cccatctgcgagtgttttcgttttg

SEQ ID NO: 260700 - DNA, 25 bp, Mus musculus
aagctttgccggcactttccgcagc

SEQ ID NO: 260701 - DNA, 25 bp, Mus musculus
cgagcccaagctttgccggcacttt

SEQ ID NO: 260702 - DNA, 25 bp, Mus musculus
ggccagagatcagcgagctgctgga

SEQ ID NO: 260703 - DNA, 25 bp, Mus musculus
actcgtcgccgggtggccagagatc

SEQ ID NO: 260704 - DNA, 25 bp, Mus musculus
acgcgagtgcgtctgccgctgcgct

SEQ ID NO: 260705 - DNA, 25 bp, Mus musculus
tggccacgcgagtgcgtctgccgct

SEQ ID NO: 260706 - DNA, 25 bp, Mus musculus
tgctggacgccaacacagcggcgca

SEQ ID NO: 260707 - DNA, 25 bp, Mus musculus
tgttggatagctgcgcttttctgac

SEQ ID NO: 260708 - DNA, 25 bp, Mus musculus
ctcactccgcttgtgctctgggaag

SEQ ID NO: 260709 - DNA, 25 bp, Mus musculus
ctccctccaacagatggcgctagga

SEQ ID NO: 260710 - DNA, 25 bp, Mus musculus
cctccaacagatggcgctaggaagt

SEQ ID NO: 260711 - DNA, 25 bp, Mus musculus
caacagatggcgctaggaagtcccg

SEQ ID NO: 260712 - DNA, 25 bp, Mus musculus
acagatggcgctaggaagtcccgcc

SEQ ID NO: 260713 - DNA, 25 bp, Mus musculus
ccgcctactggaaaggacccggatg

SEQ ID NO: 260714 - DNA, 25 bp, Mus musculus
gcctcactccgcttgtgctctggga

SEQ ID NO: 260715 - DNA, 25 bp, Mus musculus
tcgtgatcgggaagggcaacaagcc

SEQ ID NO: 260716 - DNA, 25 bp, Mus musculus
gctggacaaactgaccggtgtgttc

SEQ ID NO: 260717 - DNA, 25 bp, Mus musculus
caaactgaccggtgtgttcgcgccc

SEQ ID NO: 260718 - DNA, 25 bp, Mus musculus
ccggctcctttgacgtggtccacgt

SEQ ID NO: 260719 - DNA, 25 bp, Mus musculus
gctcctttgacgtggtccacgtgaa

SEQ ID NO: 260720 - DNA, 25 bp, Mus musculus
catcttcgtgatcgggaagggcaac

SEQ ID NO: 260721 - DNA, 25 bp, Mus musculus
cgcctactggaaaggacccggatgg

SEQ ID NO: 260722 - DNA, 25 bp, Mus musculus
gaatccgcctcaccattgccgaaga

SEQ ID NO: 260723 - DNA, 25 bp, Mus musculus
ggtcccaagaaacacctgaagcgtg

SEQ ID NO: 260724 - DNA, 25 bp, Mus musculus
tcttcgtgggtaccaagggcatccc

SEQ ID NO: 260725 - DNA, 25 bp, Mus musculus
catcaagtttgataccggcaacctg

SEQ ID NO: 260726 - DNA, 25 bp, Mus musculus
gacccgctcatcaaggtcaacgaca

SEQ ID NO: 260727 - DNA, 25 bp, Mus musculus
gcatggtaaccggaggcgccaacct

SEQ ID NO: 260728 - DNA, 25 bp, Mus musculus
gctgtgcaaggtgaggaaagtcttc

SEQ ID NO: 260729 - DNA, 25 bp, Mus musculus
gccaagtacaagctgtgcaaggtga

SEQ ID NO: 260730 - DNA, 25 bp, Mus musculus
atcacgcccgaggaggccaagtaca

SEQ ID NO: 260731 - DNA, 25 bp, Mus musculus
gcatgcagcggctcattaaggtcga

SEQ ID NO: 260732 - DNA, 25 bp, Mus musculus
cgctcgccatcttcctgaggaacag

SEQ ID NO: 260733 - DNA, 25 bp, Mus musculus
cgccactggatgctggacaaactga

SEQ ID NO: 260734 - DNA, 25 bp, Mus musculus
cgccatggctcgtggtcccaagaaa

SEQ ID NO: 260735 - DNA, 25 bp, Mus musculus
ggaaaaatcaccgatgccatcaagt

SEQ ID NO: 260736 - DNA, 25 bp, Mus musculus
acacatcgtcgtgtacaaactcgcc

SEQ ID NO: 260737 - DNA, 25 bp, Mus musculus
ctctctccctggaggcgtgagcgat

SEQ ID NO: 260738 - DNA, 25 bp, Mus musculus
ggtactcagtctggacccggacacc

SEQ ID NO: 260739 - DNA, 25 bp, Mus musculus
ggcaggcttgtcaggtactcagtct

SEQ ID NO: 260740 - DNA, 25 bp, Mus musculus
tcccggccgcaaatcggcaggcttg

SEQ ID NO: 260741 - DNA, 25 bp, Mus musculus
accagctggcgctgagtccgggaca

SEQ ID NO: 260742 - DNA, 25 bp, Mus musculus
cggccgtagcaaaggcagctggccc

SEQ ID NO: 260743 - DNA, 25 bp, Mus musculus
gatcgcccacacatcgtcgtgtaca

SEQ ID NO: 260744 - DNA, 25 bp, Mus musculus
ggttgttcacgatcgcccacacatc

SEQ ID NO: 260745 - DNA, 25 bp, Mus musculus
ccgcacgtcggggttgttcacgatc

SEQ ID NO: 260746 - DNA, 25 bp, Mus musculus
gttagcgaagatggcccagcgcagc

SEQ ID NO: 260747 - DNA, 25 bp, Mus musculus
cgcctcctggatcctgggacctgag

SEQ ID NO: 260748 - DNA, 25 bp, Mus musculus
ccagctgcaaataaacagcgatccc

SEQ ID NO: 260749 - DNA, 25 bp, Mus musculus
gggtacgcccaactgctttcccaga

SEQ ID NO: 260750 - DNA, 25 bp, Mus musculus
tccattcaccttttacgacagccgg

SEQ ID NO: 260751 - DNA, 25 bp, Mus musculus
cgatagtgcccttcagcgcctggat

SEQ ID NO: 260752 - DNA, 25 bp, Mus musculus
ccttcagcgcctggatgatccgatt

SEQ ID NO: 260753 - DNA, 25 bp, Mus musculus
tgatccgattgaggtccatgtccgc

SEQ ID NO: 260754 - DNA, 25 bp, Mus musculus
gcagacggccgccatgatgcggtac

SEQ ID NO: 260755 - DNA, 25 bp, Mus musculus
gcagctacttgctgcgccactctga

SEQ ID NO: 260756 - DNA, 25 bp, Mus musculus
ggagactcctttacggctgcctctt

SEQ ID NO: 260757 - DNA, 25 bp, Mus musculus
agcacccgccagagacgccatgatg

SEQ ID NO: 260758 - DNA, 25 bp, Mus musculus
acgccatgatgctcgtctcaggagc

SEQ ID NO: 260759 - DNA, 25 bp, Mus musculus
ctcgtctcaggagccggcattcatt

SEQ ID NO: 260760 - DNA, 25 bp, Mus musculus
ccggcattcattgcacagcggtgct

SEQ ID NO: 260761 - DNA, 25 bp, Mus musculus
cacagcggtgctgctacaggaagtc

SEQ ID NO: 260762 - DNA, 25 bp, Mus musculus
gaagtcgctcaagtttgttccaaac

SEQ ID NO: 260763 - DNA, 25 bp, Mus musculus
ttgcagccgggatgtctcctggccc

SEQ ID NO: 260764 - DNA, 25 bp, Mus musculus
cgcaacttatgtaggccgcgcacgg

SEQ ID NO: 260765 - DNA, 25 bp, Mus musculus
cttggcgcgtaccttccctgcgctt

SEQ ID NO: 260766 - DNA, 25 bp, Mus musculus
agagcgctctgcaaagccgctgaga

SEQ ID NO: 260767 - DNA, 25 bp, Mus musculus
atgtaggccgcgcacggcgcgacca

SEQ ID NO: 260768 - DNA, 25 bp, Mus musculus
aatgctggggcaccacgcttctcca

SEQ ID NO: 260769 - DNA, 25 bp, Mus musculus
ctgcctccgaaagcgcgcgggagtc

SEQ ID NO: 260770 - DNA, 25 bp, Mus musculus
cgcgctgcaaagtgggcgaactcca

SEQ ID NO: 260771 - DNA, 25 bp, Mus musculus
aatcccgcctatttccggtcctctg

SEQ ID NO: 260772 - DNA, 25 bp, Mus musculus
cctcggaggcttcgccttccggtgt

SEQ ID NO: 260773 - DNA, 25 bp, Mus musculus
gacctgcgagggacaggtcctttcc

SEQ ID NO: 260774 - DNA, 25 bp, Mus musculus
tctctgcaagcctgcgcttggcgcg

SEQ ID NO: 260775 - DNA, 25 bp, Mus musculus
cgcctcagcttagcctgcggccacc

SEQ ID NO: 260776 - DNA, 25 bp, Mus musculus
caccagacgcagagcgctctgcaaa

SEQ ID NO: 260777 - DNA, 25 bp, Mus musculus
caaggcgcgcgcaacttatgtaggc

SEQ ID NO: 260778 - DNA, 25 bp, Mus musculus
acccacgcgagctcgggtatcctga

SEQ ID NO: 260779 - DNA, 25 bp, Mus musculus
catatgctgcgagttggcgactttc

SEQ ID NO: 260780 - DNA, 25 bp, Mus musculus
tggcgactttcgctgtgctttggaa

SEQ ID NO: 260781 - DNA, 25 bp, Mus musculus
ggcaagacgccatcaccaggaaatc

SEQ ID NO: 260782 - DNA, 25 bp, Mus musculus
tccgagctggacactgagatgtagc

SEQ ID NO: 260783 - DNA, 25 bp, Mus musculus
gcggccctaagcacgtggcttgtca

SEQ ID NO: 260784 - DNA, 25 bp, Mus musculus
gtgaccagacggacagcgaactttg

SEQ ID NO: 260785 - DNA, 25 bp, Mus musculus
aactttgggctgcagagaccactcg

SEQ ID NO: 260786 - DNA, 25 bp, Mus musculus
gccggctccaggaactggcaagtta

SEQ ID NO: 260787 - DNA, 25 bp, Mus musculus
tggcaagttagtttccgagctccgg

SEQ ID NO: 260788 - DNA, 25 bp, Mus musculus
cggctttgttgttcacccgcgtgca

SEQ ID NO: 260789 - DNA, 25 bp, Mus musculus
ctttcagcgtggatgcaagtccgcc

SEQ ID NO: 260790 - DNA, 25 bp, Mus musculus
gaagcgcatctccaacgcctctgta

SEQ ID NO: 260791 - DNA, 25 bp, Mus musculus
gagtcccggatgagaaacgcccaga

SEQ ID NO: 260792 - DNA, 25 bp, Mus musculus
gggccaaacttcacgaaccactgca

SEQ ID NO: 260793 - DNA, 25 bp, Mus musculus
tgagaagcgtcgcaggcttccctcg

SEQ ID NO: 260794 - DNA, 25 bp, Mus musculus
gccgactttttgtctggagcccgca

SEQ ID NO: 260795 - DNA, 25 bp, Mus musculus
cgggatccttctagacgctggtacc

SEQ ID NO: 260796 - DNA, 25 bp, Mus musculus
gctctccggcgtgaaccgatgagaa

SEQ ID NO: 260797 - DNA, 25 bp, Mus musculus
gatcccgcacagcacgaagtagtgc

SEQ ID NO: 260798 - DNA, 25 bp, Mus musculus
ccgatgagaagcctcgctgagaagc

SEQ ID NO: 260799 - DNA, 25 bp, Mus musculus
cccatctagccggagcgcggctata

SEQ ID NO: 260800 - DNA, 25 bp, Mus musculus
atgtcgcccacgagtgcccatctag

SEQ ID NO: 260801 - DNA, 25 bp, Mus musculus
caacaatgtcattatgtcgcccacg

SEQ ID NO: 260802 - DNA, 25 bp, Mus musculus
acacccaggggcttagccagagcgc

SEQ ID NO: 260803 - DNA, 25 bp, Mus musculus
gactccttcatggagctgccgacca

SEQ ID NO: 260804 - DNA, 25 bp, Mus musculus
gggtcaactgaaccgcgctgcgcga

SEQ ID NO: 260805 - DNA, 25 bp, Mus musculus
ccagagcgcggaattaacaacaatg

SEQ ID NO: 260806 - DNA, 25 bp, Mus musculus
cagaggcctcgtcccttgctattgg

SEQ ID NO: 260807 - DNA, 25 bp, Mus musculus
tctgcttcggatcgggcttttgttc

SEQ ID NO: 260808 - DNA, 25 bp, Mus musculus
actgtagaaggcacacctgcccggc

SEQ ID NO: 260809 - DNA, 25 bp, Mus musculus
cctcgtcccttgctattggcgtgta

SEQ ID NO: 260810 - DNA, 25 bp, Mus musculus
ctctgcgcttggcagaggcctcgtc

SEQ ID NO: 260811 - DNA, 25 bp, Mus musculus
aacgaaggctgccaccaaacctctg

SEQ ID NO: 260812 - DNA, 25 bp, Mus musculus
tctgctgatttgctgacccatcata

SEQ ID NO: 260813 - DNA, 25 bp, Mus musculus
gatttgctgacccatcataatatga

SEQ ID NO: 260814 - DNA, 25 bp, Mus musculus
tcataatatgattgtaaggcctggg

SEQ ID NO: 260815 - DNA, 25 bp, Mus musculus
gggtcttacaccctcaggtgattct

SEQ ID NO: 260816 - DNA, 25 bp, Mus musculus
cctcaggtgattctcatataaattc

SEQ ID NO: 260817 - DNA, 25 bp, Mus musculus
catataaattctaggtgcaaggctg

SEQ ID NO: 260818 - DNA, 25 bp, Mus musculus
gtgcaaggctgagcttttttctccc

SEQ ID NO: 260819 - DNA, 25 bp, Mus musculus
tattggcgtgtaagcacccgccggg

SEQ ID NO: 260820 - DNA, 25 bp, Mus musculus
ccagagcagtgcctgcgtggagctt

SEQ ID NO: 260821 - DNA, 25 bp, Mus musculus
acgttgcgactcagccgaccttctt

SEQ ID NO: 260822 - DNA, 25 bp, Mus musculus
gcgagccgcgtgctttccgtgactc

SEQ ID NO: 260823 - DNA, 25 bp, Mus musculus
aactctgcggcgacgctgctgacgc

SEQ ID NO: 260824 - DNA, 25 bp, Mus musculus
ttggggcttatttctatccagagca

SEQ ID NO: 260825 - DNA, 25 bp, Mus musculus
ttccttactcctgcacgacctggtg

SEQ ID NO: 260826 - DNA, 25 bp, Mus musculus
acgacctggtgtgactgtgagcagc

SEQ ID NO: 260827 - DNA, 25 bp, Mus musculus
gtgagcagccgtctctcaacttttc

SEQ ID NO: 260828 - DNA, 25 bp, Mus musculus
tggagcttccacgttgcgactcagc

SEQ ID NO: 260829 - DNA, 25 bp, Mus musculus
ttttccttctgaggtaactggccca

SEQ ID NO: 260830 - DNA, 25 bp, Mus musculus
aggccgagacatggatcccttgtcc

SEQ ID NO: 260831 - DNA, 25 bp, Mus musculus
atcccttgtcccatcggtcgggcta

SEQ ID NO: 260832 - DNA, 25 bp, Mus musculus
gtcgggctacttgcgttcgagtcag

SEQ ID NO: 260833 - DNA, 25 bp, Mus musculus
ttcgagtcagggctttgcctccacc

SEQ ID NO: 260834 - DNA, 25 bp, Mus musculus
tggccgtacgaagaagccatacgtc

SEQ ID NO: 260835 - DNA, 25 bp, Mus musculus
caccgtttttgtgcctggtttcgcg

SEQ ID NO: 260836 - DNA, 25 bp, Mus musculus
gaggctccactctggccctcagagt

SEQ ID NO: 260837 - DNA, 25 bp, Mus musculus
ggtgtcctcactccggtctcagtgc

SEQ ID NO: 260838 - DNA, 25 bp, Mus musculus
cccattcgtagtgggtgtcctcact

SEQ ID NO: 260839 - DNA, 25 bp, Mus musculus
tggttcgctcttattctgtccgtcg

SEQ ID NO: 260840 - DNA, 25 bp, Mus musculus
tgagccgcagccacggtatcctgcg

SEQ ID NO: 260841 - DNA, 25 bp, Mus musculus
cgcgattgtgagaccaatggccgta

SEQ ID NO: 260842 - DNA, 25 bp, Mus musculus
gccatacgtcagcagtgatcgtgcc

SEQ ID NO: 260843 - DNA, 25 bp, Mus musculus
gccaatcccggccacgcgattgtga

SEQ ID NO: 260844 - DNA, 25 bp, Mus musculus
gggacgtggcgatttccagccaatc

SEQ ID NO: 260845 - DNA, 25 bp, Mus musculus
gggaatccggtccacgcaactcggc

SEQ ID NO: 260846 - DNA, 25 bp, Mus musculus
cgtaaatgaggtcgttgcggtcagt

SEQ ID NO: 260847 - DNA, 25 bp, Mus musculus
accacttccggttgggcggtgcttg

SEQ ID NO: 260848 - DNA, 25 bp, Mus musculus
cggtagctcacgtccgcttttcagg

SEQ ID NO: 260849 - DNA, 25 bp, Mus musculus
cactcgcgtcaggtggccaggccag

SEQ ID NO: 260850 - DNA, 25 bp, Mus musculus
acgtccgcttttcaggcgcagcaga

SEQ ID NO: 260851 - DNA, 25 bp, Mus musculus
tcaggcgcagcagacctgaagctgc

SEQ ID NO: 260852 - DNA, 25 bp, Mus musculus
acctgaagctgcctcggacgagcct

SEQ ID NO: 260853 - DNA, 25 bp, Mus musculus
cctcggacgagcctggggcacttta

SEQ ID NO: 260854 - DNA, 25 bp, Mus musculus
acgagcctggggcactttagtgacg

SEQ ID NO: 260855 - DNA, 25 bp, Mus musculus
gcactttagtgacgtgttttgaacc

SEQ ID NO: 260856 - DNA, 25 bp, Mus musculus
gacgtgttttgaacctcttttgctg

SEQ ID NO: 260857 - DNA, 25 bp, Mus musculus
tcttttgctggtcctcactgggtct

SEQ ID NO: 260858 - DNA, 25 bp, Mus musculus
ctggtcctcactgggtctggagccg

SEQ ID NO: 260859 - DNA, 25 bp, Mus musculus
ccacaggcgggcactcgcgtcaggt

SEQ ID NO: 260860 - DNA, 25 bp, Mus musculus
ctctctcctccctgcgcaccgggct

SEQ ID NO: 260861 - DNA, 25 bp, Mus musculus
agacccggtagctcacgtccgcttt

SEQ ID NO: 260862 - DNA, 25 bp, Mus musculus
agccgccttctaacctgcggaaatc

SEQ ID NO: 260863 - DNA, 25 bp, Mus musculus
ccagcccgtggagattgagaggacg

SEQ ID NO: 260864 - DNA, 25 bp, Mus musculus
aaagcaggcccaggcgccttggaag

SEQ ID NO: 260865 - DNA, 25 bp, Mus musculus
tagtcccgggctcagaaagcaggcc

SEQ ID NO: 260866 - DNA, 25 bp, Mus musculus
agtccctagtagtcccgggctcaga

SEQ ID NO: 260867 - DNA, 25 bp, Mus musculus
cagcgcagtccctagtagtcccggg

SEQ ID NO: 260868 - DNA, 25 bp, Mus musculus
agtaagtgggcgcagcgcagtccct

SEQ ID NO: 260869 - DNA, 25 bp, Mus musculus
tcgtcctggccctctacgacagaca

SEQ ID NO: 260870 - DNA, 25 bp, Mus musculus
taacctgcggaaatccaacttcttc

SEQ ID NO: 260871 - DNA, 25 bp, Mus musculus
ctcactttgagaagcagccgccttc

SEQ ID NO: 260872 - DNA, 25 bp, Mus musculus
tggcccgggctcactttgagaagca

SEQ ID NO: 260873 - DNA, 25 bp, Mus musculus
aactctgcgtctttggtcgcagcgg

SEQ ID NO: 260874 - DNA, 25 bp, Mus musculus
ttagccatctaactctgcgtctttg

SEQ ID NO: 260875 - DNA, 25 bp, Mus musculus
cgggacacagtctggcttagccatc

SEQ ID NO: 260876 - DNA, 25 bp, Mus musculus
cgcgggcatccaacccactccaagc

SEQ ID NO: 260877 - DNA, 25 bp, Mus musculus
ccagtaagtgccaagtgtcttcttt

SEQ ID NO: 260878 - DNA, 25 bp, Mus musculus
ccataaccagtaagtgccaagtgtc

SEQ ID NO: 260879 - DNA, 25 bp, Mus musculus
agatgcaggccataaccagtaagtg

SEQ ID NO: 260880 - DNA, 25 bp, Mus musculus
gccgccgagatgcaggccataacca

SEQ ID NO: 260881 - DNA, 25 bp, Mus musculus
ttcagaggcggttccggccgccaaa

SEQ ID NO: 260882 - DNA, 25 bp, Mus musculus
tacctagtgttcagaggcggttccg

SEQ ID NO: 260883 - DNA, 25 bp, Mus musculus
tcagaggtacctagtgttcagaggc

SEQ ID NO: 260884 - DNA, 25 bp, Mus musculus
cggcctcagaggtacctagtgttca

SEQ ID NO: 260885 - DNA, 25 bp, Mus musculus
gcgctcgcggcctcagaggtaccta

SEQ ID NO: 260886 - DNA, 25 bp, Mus musculus
cgcgccttgcccgtttccgccgagt

SEQ ID NO: 260887 - DNA, 25 bp, Mus musculus
aacctgagacgggtccttgcgcacg

SEQ ID NO: 260888 - DNA, 25 bp, Mus musculus
taagtgccaagtgtcttctttgccc

SEQ ID NO: 260889 - DNA, 25 bp, Mus musculus
cggatggaacctgagacgggtcctt

SEQ ID NO: 260890 - DNA, 25 bp, Mus musculus
acgaggcggacgagatgccgtccac

SEQ ID NO: 260891 - DNA, 25 bp, Mus musculus
gccagaagcgcatgtaccgcaagtt

SEQ ID NO: 260892 - DNA, 25 bp, Mus musculus
gagacctcagcgacgggctgcgcct

SEQ ID NO: 260893 - DNA, 25 bp, Mus musculus
tgaccgacctgcagcgagacctcag

SEQ ID NO: 260894 - DNA, 25 bp, Mus musculus
tgggcaagcgcctgaccgacctgca

SEQ ID NO: 260895 - DNA, 25 bp, Mus musculus
atctcaagtgtgtgggcaagcgcct

SEQ ID NO: 260896 - DNA, 25 bp, Mus musculus
acgagcatctcaagtgtgtgggcaa

SEQ ID NO: 260897 - DNA, 25 bp, Mus musculus
tgccgtccacggagaaggacctagc

SEQ ID NO: 260898 - DNA, 25 bp, Mus musculus
acagcaactattcggacgcctccgg

SEQ ID NO: 260899 - DNA, 25 bp, Mus musculus
tgatgaacaacagcaactattcgga

SEQ ID NO: 260900 - DNA, 25 bp, Mus musculus
gccgcgccaccatgatgaacaacag

SEQ ID NO: 260901 - DNA, 25 bp, Mus musculus
gaagtctccgagaactcggtgtccc

SEQ ID NO: 260902 - DNA, 25 bp, Mus musculus
gcccagagcgctaacgaagtctccg

SEQ ID NO: 260903 - DNA, 25 bp, Mus musculus
aaggacctagcggaggacgcaccgt

SEQ ID NO: 260904 - DNA, 25 bp, Mus musculus
gctccgttcagctctagcagtcgct

SEQ ID NO: 260905 - DNA, 25 bp, Mus musculus
agtgcatcctccctgttccggggct

SEQ ID NO: 260906 - DNA, 25 bp, Mus musculus
tcgctgagtccctcagaagcagcct

SEQ ID NO: 260907 - DNA, 25 bp, Mus musculus
agaagcagcctcatcccttcgggga

SEQ ID NO: 260908 - DNA, 25 bp, Mus musculus
atcccttcggggacacagccgcggt

SEQ ID NO: 260909 - DNA, 25 bp, Mus musculus
cctgtggtgccttctgagccacgct

SEQ ID NO: 260910 - DNA, 25 bp, Mus musculus
cccagcggataaacccggcgatggt

SEQ ID NO: 260911 - DNA, 25 bp, Mus musculus
aaacccggcgatggtggttcgcaag

SEQ ID NO: 260912 - DNA, 25 bp, Mus musculus
gttcgcaaggatgcggagtcgttcc

SEQ ID NO: 260913 - DNA, 25 bp, Mus musculus
aggatgcggagtcgttccaggacct

SEQ ID NO: 260914 - DNA, 25 bp, Mus musculus
tgcctggctgctccgttcagctcta

SEQ ID NO: 260915 - DNA, 25 bp, Mus musculus
cagctctagcagtcgctgcagaacc

SEQ ID NO: 260916 - DNA, 25 bp, Mus musculus
tgcagaacctcctgccctgcgctgg

SEQ ID NO: 260917 - DNA, 25 bp, Mus musculus
cagtcagcgggctctgcctaggcaa

SEQ ID NO: 260918 - DNA, 25 bp, Mus musculus
aagctccggttcaccttctcgagga

SEQ ID NO: 260919 - DNA, 25 bp, Mus musculus
cgacctgcatgcacagcttggcctg

SEQ ID NO: 260920 - DNA, 25 bp, Mus musculus
cgcttggacctctggaacctcaaca

SEQ ID NO: 260921 - DNA, 25 bp, Mus musculus
acaagccgctctactcctttgaaga

SEQ ID NO: 260922 - DNA, 25 bp, Mus musculus
ggcagcgccactaagtcttcacggt

SEQ ID NO: 260923 - DNA, 25 bp, Mus musculus
attaggctctctagacagcccgagg

SEQ ID NO: 260924 - DNA, 25 bp, Mus musculus
cgaggactttcatctcgggaagttt

SEQ ID NO: 260925 - DNA, 25 bp, Mus musculus
aactgtgtctgaaaccgcctcgctc

SEQ ID NO: 260926 - DNA, 25 bp, Mus musculus
ctggaatgtcgcttacaactgtgtc

SEQ ID NO: 260927 - DNA, 25 bp, Mus musculus
gtcgcgtccacctgtctggaatgtc

SEQ ID NO: 260928 - DNA, 25 bp, Mus musculus
ttggcctggcaagaattccgagcta

SEQ ID NO: 260929 - DNA, 25 bp, Mus musculus
tccacgaggtggcagacgttgcctt

SEQ ID NO: 260930 - DNA, 25 bp, Mus musculus
ttccgagctaatggcagtcgcgtcc

SEQ ID NO: 260931 - DNA, 25 bp, Mus musculus
ccactggacagttgtagtcacatta

SEQ ID NO: 260932 - DNA, 25 bp, Mus musculus
gacgcgccaggcactgtacgttgcc

SEQ ID NO: 260933 - DNA, 25 bp, Mus musculus
agccgagtcggggttagtgcgaagt

SEQ ID NO: 260934 - DNA, 25 bp, Mus musculus
gactggctgcggacaggacagtggc

SEQ ID NO: 260935 - DNA, 25 bp, Mus musculus
tcaccagacagcgacacaggcgaca

SEQ ID NO: 260936 - DNA, 25 bp, Mus musculus
gctcaccagacagcgacacaggcga

SEQ ID NO: 260937 - DNA, 25 bp, Mus musculus
cctttcctccgggtcacacgctcac

SEQ ID NO: 260938 - DNA, 25 bp, Mus musculus
accagacagcgacacaggcgacacg

SEQ ID NO: 260939 - DNA, 25 bp, Mus musculus
cgaaagggcagacccgaagccgagt

SEQ ID NO: 260940 - DNA, 25 bp, Mus musculus
gcactgtacgttgccgctctgcgaa

SEQ ID NO: 260941 - DNA, 25 bp, Mus musculus
ccaggcactgtacgttgccgctctg

SEQ ID NO: 260942 - DNA, 25 bp, Mus musculus
gcgccaggcactgtacgttgccgct

SEQ ID NO: 260943 - DNA, 25 bp, Mus musculus
acagcgacgcgccaggcactgtacg

SEQ ID NO: 260944 - DNA, 25 bp, Mus musculus
cgggcagcagtctcccggagtgagg

SEQ ID NO: 260945 - DNA, 25 bp, Mus musculus
gggtcacacgctcaccagacagcga

SEQ ID NO: 260946 - DNA, 25 bp, Mus musculus
caggagcagtggtagcaacgccgcc

SEQ ID NO: 260947 - DNA, 25 bp, Mus musculus
agagagcaccaaggccggccagcga

SEQ ID NO: 260948 - DNA, 25 bp, Mus musculus
gtctggcccggtccgacggtctgct

SEQ ID NO: 260949 - DNA, 25 bp, Mus musculus
tgagccataagttggggcacaccca

SEQ ID NO: 260950 - DNA, 25 bp, Mus musculus
ggcacacccaggacgctccgactca

SEQ ID NO: 260951 - DNA, 25 bp, Mus musculus
gccagcgccaggctcccgaggtgca

SEQ ID NO: 260952 - DNA, 25 bp, Mus musculus
gcagtggtagcaacgccgcccgagc

SEQ ID NO: 260953 - DNA, 25 bp, Mus musculus
ccgcctcgctttaggtctgtgctca

SEQ ID NO: 260954 - DNA, 25 bp, Mus musculus
tcgctttaggtctgtgctcagccgg

SEQ ID NO: 260955 - DNA, 25 bp, Mus musculus
gggtgcggagactcaagccgccgcc

SEQ ID NO: 260956 - DNA, 25 bp, Mus musculus
agcgacgcgcaacccaggcggggat

SEQ ID NO: 260957 - DNA, 25 bp, Mus musculus
cccagtctttgttcagggagggctc

SEQ ID NO: 260958 - DNA, 25 bp, Mus musculus
ttcagggagggctccgcggttctcc

SEQ ID NO: 260959 - DNA, 25 bp, Mus musculus
cgcccacccagtctttgttcaggga

SEQ ID NO: 260960 - DNA, 25 bp, Mus musculus
cccgcgggcgcacagcaaacaggta

SEQ ID NO: 260961 - DNA, 25 bp, Mus musculus
gcagcggatctccagctccaggcgg

SEQ ID NO: 260962 - DNA, 25 bp, Mus musculus
tggatgactctgtctccccggattc

SEQ ID NO: 260963 - DNA, 25 bp, Mus musculus
tgcagctcggcgagagctcagctcg

SEQ ID NO: 260964 - DNA, 25 bp, Mus musculus
cagcaaacaggtaggtcccggggct

SEQ ID NO: 260965 - DNA, 25 bp, Mus musculus
gcgaatggctccaaggcgctccgca

SEQ ID NO: 260966 - DNA, 25 bp, Mus musculus
gccaacgttcgcatgctcggggaaa

SEQ ID NO: 260967 - DNA, 25 bp, Mus musculus
catgctcggggaaagtcccaagggc

SEQ ID NO: 260968 - DNA, 25 bp, Mus musculus
actgcgcctcgccagggtcaaggat

SEQ ID NO: 260969 - DNA, 25 bp, Mus musculus
tcgccagggtcaaggatgccaagcg

SEQ ID NO: 260970 - DNA, 25 bp, Mus musculus
atgccaagcgccctgtcacagtctg

SEQ ID NO: 260971 - DNA, 25 bp, Mus musculus
tgtcggcacacagctcgtctctcct

SEQ ID NO: 260972 - DNA, 25 bp, Mus musculus
cggattcccaaaggagcccggcgag

SEQ ID NO: 260973 - DNA, 25 bp, Mus musculus
acaggctacagggtatctggggact

SEQ ID NO: 260974 - DNA, 25 bp, Mus musculus
tcagttgccactggtttccgaaagg

SEQ ID NO: 260975 - DNA, 25 bp, Mus musculus
agggcccgttcgtgaccaatcagtt

SEQ ID NO: 260976 - DNA, 25 bp, Mus musculus
ttccgaaaggcagcacatctgtggc

SEQ ID NO: 260977 - DNA, 25 bp, Mus musculus
ccagctccttcggaaagaggatctc

SEQ ID NO: 260978 - DNA, 25 bp, Mus musculus
agaggatctcccactgccaagcgct

SEQ ID NO: 260979 - DNA, 25 bp, Mus musculus
aagccaaaacgaggcgcgctccttt

SEQ ID NO: 260980 - DNA, 25 bp, Mus musculus
ggtaaagcgcttgcaccgcctggta

SEQ ID NO: 260981 - DNA, 25 bp, Mus musculus
aaagagcccgatactcctccctagg

SEQ ID NO: 260982 - DNA, 25 bp, Mus musculus
gagaggtcgctttcaggttcctgcc

SEQ ID NO: 260983 - DNA, 25 bp, Mus musculus
ttgtcttgtcttcccgccagaatcg

SEQ ID NO: 260984 - DNA, 25 bp, Mus musculus
cgccagaatcgcagactctcgagtc

SEQ ID NO: 260985 - DNA, 25 bp, Mus musculus
agaggcctacctccgcatgacacga

SEQ ID NO: 260986 - DNA, 25 bp, Mus musculus
ccgtccgtagactttggcacacttc

SEQ ID NO: 260987 - DNA, 25 bp, Mus musculus
cgcctggtacacgagctgcaaggtt

SEQ ID NO: 260988 - DNA, 25 bp, Mus musculus
ggacgagttctccttcgtcagcccg

SEQ ID NO: 260989 - DNA, 25 bp, Mus musculus
tacggggacgagttctccttcgtca

SEQ ID NO: 260990 - DNA, 25 bp, Mus musculus
gcgggccaagctggtctgcggccgc

SEQ ID NO: 260991 - DNA, 25 bp, Mus musculus
gcagcctcaccaatggccgtccggg

SEQ ID NO: 260992 - DNA, 25 bp, Mus musculus
agaagtcagcctcgggcagcctcac

SEQ ID NO: 260993 - DNA, 25 bp, Mus musculus
ctgcctacggggacgagttctcctt

SEQ ID NO: 260994 - DNA, 25 bp, Mus musculus
gagacctggcgtgccggctgcctac

SEQ ID NO: 260995 - DNA, 25 bp, Mus musculus
agcggcggaccatggcgcggagacc

SEQ ID NO: 260996 - DNA, 25 bp, Mus musculus
cgccgaccaatgagaagtcagcctc

SEQ ID NO: 260997 - DNA, 25 bp, Mus musculus
accaatgagaagtcagcctcgggca

SEQ ID NO: 260998 - DNA, 25 bp, Mus musculus
aatgagaagtcagcctcgggcagcc

SEQ ID NO: 260999 - DNA, 25 bp, Mus musculus
ccggtggccgctgggagataggccc

SEQ ID NO: 261000 - DNA, 25 bp, Mus musculus
agtctccgctgctcacgctgcccgc

SEQ ID NO: 261001 - DNA, 25 bp, Mus musculus
tctgcggccgcggtggagtctccgc

SEQ ID NO: 261002 - DNA, 25 bp, Mus musculus
accaccacgctgctggctggggact

SEQ ID NO: 261003 - DNA, 25 bp, Mus musculus
actcgcaggaggaagcgcacggcaa

SEQ ID NO: 261004 - DNA, 25 bp, Mus musculus
ctgcgagcctttgcgctacaacgtg

SEQ ID NO: 261005 - DNA, 25 bp, Mus musculus
agacagcttcgatctccaggccagg

SEQ ID NO: 261006 - DNA, 25 bp, Mus musculus
ctgagttggctgtttggccatggcc

SEQ ID NO: 261007 - DNA, 25 bp, Mus musculus
gggcgcaccggtcgcctaagtagcc

SEQ ID NO: 261008 - DNA, 25 bp, Mus musculus
ggttcccagggttgaagacagcttc

SEQ ID NO: 261009 - DNA, 25 bp, Mus musculus
gcattccagagagcagggccagcta

SEQ ID NO: 261010 - DNA, 25 bp, Mus musculus
ttgcgctacaacgtgtgcctgggct

SEQ ID NO: 261011 - DNA, 25 bp, Mus musculus
tgggaccggccactgacggaaagaa

SEQ ID NO: 261012 - DNA, 25 bp, Mus musculus
gcaagctcgtgctctggtccggtaa

SEQ ID NO: 261013 - DNA, 25 bp, Mus musculus
aggctcaggcctcaaactgttgggc

SEQ ID NO: 261014 - DNA, 25 bp, Mus musculus
gcacccggaatagttggagaaacga

SEQ ID NO: 261015 - DNA, 25 bp, Mus musculus
gctagagcaacaaaggagcccggta

SEQ ID NO: 261016 - DNA, 25 bp, Mus musculus
gcaatcacgcggaggctgtgtcaga

SEQ ID NO: 261017 - DNA, 25 bp, Mus musculus
gagtttggcctcctggacaccaggc

SEQ ID NO: 261018 - DNA, 25 bp, Mus musculus
cgtacccagcttggagtttggcctc

SEQ ID NO: 261019 - DNA, 25 bp, Mus musculus
tgctttgatcgtcgtacccagcttg

SEQ ID NO: 261020 - DNA, 25 bp, Mus musculus
cgccgggcagacagatgctttgatc

SEQ ID NO: 261021 - DNA, 25 bp, Mus musculus
tctccgagcctctggcggctcaaaa

SEQ ID NO: 261022 - DNA, 25 bp, Mus musculus
agctggtggacaaagcgtgagtatc

SEQ ID NO: 261023 - DNA, 25 bp, Mus musculus
gcgcagggcgcggactacaattccc

SEQ ID NO: 261024 - DNA, 25 bp, Mus musculus
cttgcaactgttgtgatggcaatca

SEQ ID NO: 261025 - DNA, 25 bp, Mus musculus
tgagcgcgagtaagtcttgcaactg

SEQ ID NO: 261026 - DNA, 25 bp, Mus musculus
cgtgcttagcatcaatgtgtacatc

SEQ ID NO: 261027 - DNA, 25 bp, Mus musculus
acactctgtaatcgtgcttagcatc

SEQ ID NO: 261028 - DNA, 25 bp, Mus musculus
acgcacgccaatcacactctgtaat

SEQ ID NO: 261029 - DNA, 25 bp, Mus musculus
tgcggccgcgtctcgacgtgtcact

SEQ ID NO: 261030 - DNA, 25 bp, Mus musculus
tgctgaggtcccacggtcttctagt

SEQ ID NO: 261031 - DNA, 25 bp, Mus musculus
tatacttttctgttagtcgctgtcc

SEQ ID NO: 261032 - DNA, 25 bp, Mus musculus
ttctgttagtcgctgtcctgggagt

SEQ ID NO: 261033 - DNA, 25 bp, Mus musculus
agtcgctgtcctgggagttccctct

SEQ ID NO: 261034 - DNA, 25 bp, Mus musculus
cctgggagttccctctccatcaaaa

SEQ ID NO: 261035 - DNA, 25 bp, Mus musculus
ggagttccctctccatcaaaaacta

SEQ ID NO: 261036 - DNA, 25 bp, Mus musculus
cagtgcaagttggttgctgaggtcc

SEQ ID NO: 261037 - DNA, 25 bp, Mus musculus
cccacggtcttctagtcgcgtgcaa

SEQ ID NO: 261038 - DNA, 25 bp, Mus musculus
tcttctagtcgcgtgcaacccggag

SEQ ID NO: 261039 - DNA, 25 bp, Mus musculus
tgcaacccggagcaagcgcactaca

SEQ ID NO: 261040 - DNA, 25 bp, Mus musculus
ccggagcaagcgcactacaggttct

SEQ ID NO: 261041 - DNA, 25 bp, Mus musculus
cactacaggttctgtggcgcctcgc

SEQ ID NO: 261042 - DNA, 25 bp, Mus musculus
tctgtggcgcctcgcgcgtgagtca

SEQ ID NO: 261043 - DNA, 25 bp, Mus musculus
catcaaaaactactttccggaggag

SEQ ID NO: 261044 - DNA, 25 bp, Mus musculus
gcacactcccgcgtgtaattttccg

SEQ ID NO: 261045 - DNA, 25 bp, Mus musculus
cgcgtgtaattttccggactgttcg

SEQ ID NO: 261046 - DNA, 25 bp, Mus musculus
gggaggagaagcacctactactaca

SEQ ID NO: 261047 - DNA, 25 bp, Mus musculus
cactactacttgaacgaggcagggg

SEQ ID NO: 261048 - DNA, 25 bp, Mus musculus
ggtagcgcccttcactactacttga

SEQ ID NO: 261049 - DNA, 25 bp, Mus musculus
taataacatggaggtagcgcccttc

SEQ ID NO: 261050 - DNA, 25 bp, Mus musculus
acgggcgtactttactaataacatg

SEQ ID NO: 261051 - DNA, 25 bp, Mus musculus
gctccgctgcgaagcgaagcctcta

SEQ ID NO: 261052 - DNA, 25 bp, Mus musculus
ttgaacccgctcttagagcggccgc

SEQ ID NO: 261053 - DNA, 25 bp, Mus musculus
ctagatcgtggagccgagagtcttc

SEQ ID NO: 261054 - DNA, 25 bp, Mus musculus
cggttccacaccctctagatcgtgg

SEQ ID NO: 261055 - DNA, 25 bp, Mus musculus
gtcgggctgcctcgcttctcggaga

SEQ ID NO: 261056 - DNA, 25 bp, Mus musculus
gaagcctctaggtaccacgggcgta

SEQ ID NO: 261057 - DNA, 25 bp, Mus musculus
cgccgcgcacggtcaagaaggtact

SEQ ID NO: 261058 - DNA, 25 bp, Mus musculus
gggcctcggagagtagttacagcca

SEQ ID NO: 261059 - DNA, 25 bp, Mus musculus
taccgatggggaaccagcgcataga

SEQ ID NO: 261060 - DNA, 25 bp, Mus musculus
atttggatcccggtgtaccgatggg

SEQ ID NO: 261061 - DNA, 25 bp, Mus musculus
ctgccgcccggtgaagccggaattt

SEQ ID NO: 261062 - DNA, 25 bp, Mus musculus
agatacttgacagctgccgcccggt

SEQ ID NO: 261063 - DNA, 25 bp, Mus musculus
gagcgtaacagatactttccagata

SEQ ID NO: 261064 - DNA, 25 bp, Mus musculus
cctaaccggcgcgaagagcgtaaca

SEQ ID NO: 261065 - DNA, 25 bp, Mus musculus
ttgccttggcctgcggttttcctaa

SEQ ID NO: 261066 - DNA, 25 bp, Mus musculus
aggaacccggaggtatccgccagcg

SEQ ID NO: 261067 - DNA, 25 bp, Mus musculus
ggcagggaaacgttccgcaaccagc

SEQ ID NO: 261068 - DNA, 25 bp, Mus musculus
taatgacaacggcaacgggaacggc

SEQ ID NO: 261069 - DNA, 25 bp, Mus musculus
gccggctctcctgctaatgacaacg

SEQ ID NO: 261070 - DNA, 25 bp, Mus musculus
gggaaccttcccagcatggacgacc

SEQ ID NO: 261071 - DNA, 25 bp, Mus musculus
tgaggcgaaccgctgaagggaacct

SEQ ID NO: 261072 - DNA, 25 bp, Mus musculus
agtgagccgagccttgcttaccagc

SEQ ID NO: 261073 - DNA, 25 bp, Mus musculus
tcgcactgccggagacaaaactttg

SEQ ID NO: 261074 - DNA, 25 bp, Mus musculus
actcgaaagcgagctgtccgggtgc

SEQ ID NO: 261075 - DNA, 25 bp, Mus musculus
ttccgcggggtttgtgcactcgaaa

SEQ ID NO: 261076 - DNA, 25 bp, Mus musculus
caaataaacagttcgaggttccgcg

SEQ ID NO: 261077 - DNA, 25 bp, Mus musculus
ccggtgccctagcaacaaataaaca

SEQ ID NO: 261078 - DNA, 25 bp, Mus musculus
aaactgagctcacaagggctccgcc

SEQ ID NO: 261079 - DNA, 25 bp, Mus musculus
tcacctccgcgtaaaccgaatcgga

SEQ ID NO: 261080 - DNA, 25 bp, Mus musculus
cgaatcggaacacacaaactgagct

SEQ ID NO: 261081 - DNA, 25 bp, Mus musculus
tcttaatcatcgtcacctccgcgta

SEQ ID NO: 261082 - DNA, 25 bp, Mus musculus
tcccagtttgagttcttaatcatcg

SEQ ID NO: 261083 - DNA, 25 bp, Mus musculus
tgcaactttgctcccagtttgagtt

SEQ ID NO: 261084 - DNA, 25 bp, Mus musculus
ccggagacaaaactttgcaactttg

SEQ ID NO: 261085 - DNA, 25 bp, Mus musculus
gagccttgcttaccagcatctgcgc

SEQ ID NO: 261086 - DNA, 25 bp, Mus musculus
accgctcctggccagaccaagtggg

SEQ ID NO: 261087 - DNA, 25 bp, Mus musculus
ggtcatgcgggtgccgtcagcccat

SEQ ID NO: 261088 - DNA, 25 bp, Mus musculus
acttcccgtcccgagcagaggtggg

SEQ ID NO: 261089 - DNA, 25 bp, Mus musculus
tctggttggattgcaccggggaccc

SEQ ID NO: 261090 - DNA, 25 bp, Mus musculus
agacctgctctctggttggattgca

SEQ ID NO: 261091 - DNA, 25 bp, Mus musculus
gtacaggcggctttgagacctgctc

SEQ ID NO: 261092 - DNA, 25 bp, Mus musculus
gccgccatgcttcggccggggtaca

SEQ ID NO: 261093 - DNA, 25 bp, Mus musculus
gcaaggtggaacctcgcatctacta

SEQ ID NO: 261094 - DNA, 25 bp, Mus musculus
cttcctccctcagctgcaaggtgga

SEQ ID NO: 261095 - DNA, 25 bp, Mus musculus
gtacccacgcggccacaagtgcagt

SEQ ID NO: 261096 - DNA, 25 bp, Mus musculus
ctgtagcacgatcgggccgcggtac

SEQ ID NO: 261097 - DNA, 25 bp, Mus musculus
aaagtttctgtagcacgatcgggcc

SEQ ID NO: 261098 - DNA, 25 bp, Mus musculus
tgtccggctggcaaagtttctgtag

SEQ ID NO: 261099 - DNA, 25 bp, Mus musculus
ctggccagaccaagtgggagtgtcc

SEQ ID NO: 261100 - DNA, 25 bp, Mus musculus
gtcgcagtctccacggcgcaggccc

SEQ ID NO: 261101 - DNA, 25 bp, Mus musculus
gcgtccgcgacttgctcagccggtt

SEQ ID NO: 261102 - DNA, 25 bp, Mus musculus
ttgctcagccggttgccctcctggt

SEQ ID NO: 261103 - DNA, 25 bp, Mus musculus
ctgccgagccgcaccagaggccgac

SEQ ID NO: 261104 - DNA, 25 bp, Mus musculus
agccgtgctggcctcgccatcatgg

SEQ ID NO: 261105 - DNA, 25 bp, Mus musculus
gcgctcgccattgccgctggtggca

SEQ ID NO: 261106 - DNA, 25 bp, Mus musculus
ccacggtagcgcagccgctctgagg

SEQ ID NO: 261107 - DNA, 25 bp, Mus musculus
agccgctctgaggtgagtgccctac

SEQ ID NO: 261108 - DNA, 25 bp, Mus musculus
taccgcgcaatctccagctatttca

SEQ ID NO: 261109 - DNA, 25 bp, Mus musculus
cccgaggatgcgcaggccgcactag

SEQ ID NO: 261110 - DNA, 25 bp, Mus musculus
gggcctggtcttccttctgcgggct

SEQ ID NO: 261111 - DNA, 25 bp, Mus musculus
tggtcttccttctgcgggctcggga

SEQ ID NO: 261112 - DNA, 25 bp, Mus musculus
cgtgggatggttacccaggtggact

SEQ ID NO: 261113 - DNA, 25 bp, Mus musculus
ggcagcgctcgccattgccgctggt

SEQ ID NO: 261114 - DNA, 25 bp, Mus musculus
ggaattcacagtgccgcgtcatccc

SEQ ID NO: 261115 - DNA, 25 bp, Mus musculus
ccgccaaaaggccaaggaagtcagg

SEQ ID NO: 261116 - DNA, 25 bp, Mus musculus
cggccgcccacaaaactgggtgcta

SEQ ID NO: 261117 - DNA, 25 bp, Mus musculus
tgctagaactgttggccctccggca

SEQ ID NO: 261118 - DNA, 25 bp, Mus musculus
gagtccacacccgaggaactaggca

SEQ ID NO: 261119 - DNA, 25 bp, Mus musculus
agcgggcccaatggacagaacttga

SEQ ID NO: 261120 - DNA, 25 bp, Mus musculus
gaggagcctcttccacgcagcaggc

SEQ ID NO: 261121 - DNA, 25 bp, Mus musculus
cgatcgtgttcaaggaaggaggcta

SEQ ID NO: 261122 - DNA, 25 bp, Mus musculus
ctcgacggagtgcagagataatgac

SEQ ID NO: 261123 - DNA, 25 bp, Mus musculus
ggcggaccgaagatgattcaccttg

SEQ ID NO: 261124 - DNA, 25 bp, Mus musculus
ccttgaatgttgctccggttggtgc

SEQ ID NO: 261125 - DNA, 25 bp, Mus musculus
cgggcagcatcaggcaccgagccaa

SEQ ID NO: 261126 - DNA, 25 bp, Mus musculus
cactggatgcggtgcacatggtact

SEQ ID NO: 261127 - DNA, 25 bp, Mus musculus
tgcaccaggtgtgacgatcgtgttc

SEQ ID NO: 261128 - DNA, 25 bp, Mus musculus
agatccttactttgctggcccgccg

SEQ ID NO: 261129 - DNA, 25 bp, Mus musculus
gagatggatccggtttctacctttc

SEQ ID NO: 261130 - DNA, 25 bp, Mus musculus
gcccaagagccagcgtcgcttgctg

SEQ ID NO: 261131 - DNA, 25 bp, Mus musculus
gccgtgaaattgcacccgcaaggtc

SEQ ID NO: 261132 - DNA, 25 bp, Mus musculus
ccgcaaggtcctcatacatatttta

SEQ ID NO: 261133 - DNA, 25 bp, Mus musculus
acatattttaggtagcaggctcgac

SEQ ID NO: 261134 - DNA, 25 bp, Mus musculus
gtagcaggctcgaccagtaactgga

SEQ ID NO: 261135 - DNA, 25 bp, Mus musculus
tatcccagatcgcttacagcccggg

SEQ ID NO: 261136 - DNA, 25 bp, Mus musculus
tcgagaaccagacaccgcagaacgg

SEQ ID NO: 261137 - DNA, 25 bp, Mus musculus
tcacagctctgtgtgctcggacgcg

SEQ ID NO: 261138 - DNA, 25 bp, Mus musculus
aacggaaagctagccgctcggctgc

SEQ ID NO: 261139 - DNA, 25 bp, Mus musculus
gctctgttgaaagtcgagacagccc

SEQ ID NO: 261140 - DNA, 25 bp, Mus musculus
agctcggacgaacccagatccttac

SEQ ID NO: 261141 - DNA, 25 bp, Mus musculus
cctcactctaggaggggccgtgaaa

SEQ ID NO: 261142 - DNA, 25 bp, Mus musculus
tacggactatccagaacggcggagc

SEQ ID NO: 261143 - DNA, 25 bp, Mus musculus
gtcctcagatcctggaagtcacgcc

SEQ ID NO: 261144 - DNA, 25 bp, Mus musculus
cggactatccagaacggcggagccc

SEQ ID NO: 261145 - DNA, 25 bp, Mus musculus
tgtctacggactatccagaacggcg

SEQ ID NO: 261146 - DNA, 25 bp, Mus musculus
ctcagctgtctacggactatccaga

SEQ ID NO: 261147 - DNA, 25 bp, Mus musculus
gcggtctcagctgtctacggactat

SEQ ID NO: 261148 - DNA, 25 bp, Mus musculus
gggtcacagcatctgccaccgcggg

SEQ ID NO: 261149 - DNA, 25 bp, Mus musculus
agctctggggtcacagcatctgcca

SEQ ID NO: 261150 - DNA, 25 bp, Mus musculus
ctcagcagctctggggtcacagcat

SEQ ID NO: 261151 - DNA, 25 bp, Mus musculus
cgtctcagcagctctggggtcacag

SEQ ID NO: 261152 - DNA, 25 bp, Mus musculus
gagcctgtggcgtctcagcagctct

SEQ ID NO: 261153 - DNA, 25 bp, Mus musculus
cgaggagggacactctggagagcct

SEQ ID NO: 261154 - DNA, 25 bp, Mus musculus
tctggggtcacagcatctgccaccg

SEQ ID NO: 261155 - DNA, 25 bp, Mus musculus
ccggtgtcctcagatcctggaagtc

SEQ ID NO: 261156 - DNA, 25 bp, Mus musculus
ccgtgatgtcacctctgtgacgtca

SEQ ID NO: 261157 - DNA, 25 bp, Mus musculus
ttggcccgtctgtcacgggctccgg

SEQ ID NO: 261158 - DNA, 25 bp, Mus musculus
ggctcctcggccgaggtggcaacac

SEQ ID NO: 261159 - DNA, 25 bp, Mus musculus
gctgccctccgactgaggctccgcc

SEQ ID NO: 261160 - DNA, 25 bp, Mus musculus
gcctgcgctagctcgttcgcctgcc

SEQ ID NO: 261161 - DNA, 25 bp, Mus musculus
tgcttcctccacaagccgacgactc

SEQ ID NO: 261162 - DNA, 25 bp, Mus musculus
acaagccgacgactccagctcggtc

SEQ ID NO: 261163 - DNA, 25 bp, Mus musculus
ggtcggcctctctaccctagcctcg

SEQ ID NO: 261164 - DNA, 25 bp, Mus musculus
aggcgccgtgatgtcacctctgtga

SEQ ID NO: 261165 - DNA, 25 bp, Mus musculus
gatacagcttgactacgtccgtgtc

SEQ ID NO: 261166 - DNA, 25 bp, Mus musculus
tgaaggatacagcttgactacgtcc

SEQ ID NO: 261167 - DNA, 25 bp, Mus musculus
ctagcctcgctctaggcgccgtgat

SEQ ID NO: 261168 - DNA, 25 bp, Mus musculus
ccctccatgaaggatacagcttgac

SEQ ID NO: 261169 - DNA, 25 bp, Mus musculus
gcttgactacgtccgtgtccatccg

SEQ ID NO: 261170 - DNA, 25 bp, Mus musculus
cgtaagcacattgcggggtgccttc

SEQ ID NO: 261171 - DNA, 25 bp, Mus musculus
gggcagcatagattcgctctggaga

SEQ ID NO: 261172 - DNA, 25 bp, Mus musculus
cgtacaaggccagcagcgggtcgaa

SEQ ID NO: 261173 - DNA, 25 bp, Mus musculus
aagctgtaggagctgacgtccagcc

SEQ ID NO: 261174 - DNA, 25 bp, Mus musculus
cactcgcgctcctccatgtttgaaa

SEQ ID NO: 261175 - DNA, 25 bp, Mus musculus
tccatgtttgaaaggcccgcaagca

SEQ ID NO: 261176 - DNA, 25 bp, Mus musculus
cagccgcggctcaaggggacgcact

SEQ ID NO: 261177 - DNA, 25 bp, Mus musculus
ctcacaaggcatccgcgtaagcaca

SEQ ID NO: 261178 - DNA, 25 bp, Mus musculus
gtgggtcgtcactctccctgttcct

SEQ ID NO: 261179 - DNA, 25 bp, Mus musculus
tgttcctcaactcgtgcacagtctc

SEQ ID NO: 261180 - DNA, 25 bp, Mus musculus
tctgtgactcacaggtgaccgtgcc

SEQ ID NO: 261181 - DNA, 25 bp, Mus musculus
gagaggcgtgacctgctcaggcctc

SEQ ID NO: 261182 - DNA, 25 bp, Mus musculus
gaagctctcgtactccgccacgttg

SEQ ID NO: 261183 - DNA, 25 bp, Mus musculus
ccacgttgttgaagcagggcgcgtt

SEQ ID NO: 261184 - DNA, 25 bp, Mus musculus
tagctatagctatggttaccacgtc

SEQ ID NO: 261185 - DNA, 25 bp, Mus musculus
ccggagcacgccgaagagaagtctc

SEQ ID NO: 261186 - DNA, 25 bp, Mus musculus
ggggcaccggacagctcaaccgatt

SEQ ID NO: 261187 - DNA, 25 bp, Mus musculus
gcggcaatcgttagcgggccatgtc

SEQ ID NO: 261188 - DNA, 25 bp, Mus musculus
ccagccattggttgctggagagccc

SEQ ID NO: 261189 - DNA, 25 bp, Mus musculus
agagactgcccattggtccactgtc

SEQ ID NO: 261190 - DNA, 25 bp, Mus musculus
agagaagtctcgctgtgtcgacagc

SEQ ID NO: 261191 - DNA, 25 bp, Mus musculus
agaggccgctgtctctttgacattc

SEQ ID NO: 261192 - DNA, 25 bp, Mus musculus
ggagtatcgaccatgctgaggcagc

SEQ ID NO: 261193 - DNA, 25 bp, Mus musculus
agctccgggaatcgatgcgctctct

SEQ ID NO: 261194 - DNA, 25 bp, Mus musculus
tctgagcgtctgcttacgccttttc

SEQ ID NO: 261195 - DNA, 25 bp, Mus musculus
accgattcgtgcagctctcgggacg

SEQ ID NO: 261196 - DNA, 25 bp, Mus musculus
tccacctgccaagaaagagactgcc

SEQ ID NO: 261197 - DNA, 25 bp, Mus musculus
ctcggtcttcgactatctggtctga

SEQ ID NO: 261198 - DNA, 25 bp, Mus musculus
tttcgaatgtaaaatggcctcgtgc

SEQ ID NO: 261199 - DNA, 25 bp, Mus musculus
gccaggtcaggatttttcgaatgta

SEQ ID NO: 261200 - DNA, 25 bp, Mus musculus
cggagccaggtcaggatttttcgaa

SEQ ID NO: 261201 - DNA, 25 bp, Mus musculus
aaatggcctcgtgcttcgcggagaa

SEQ ID NO: 261202 - DNA, 25 bp, Mus musculus
ctggtcgtgggcaccgcgactagca

SEQ ID NO: 261203 - DNA, 25 bp, Mus musculus
ggtgcccacgctaactgtgcatcta

SEQ ID NO: 261204 - DNA, 25 bp, Mus musculus
cggcaaagctcccagtgtccacata

SEQ ID NO: 261205 - DNA, 25 bp, Mus musculus
gccagtcacttgtcccggcaaagct

SEQ ID NO: 261206 - DNA, 25 bp, Mus musculus
gtacgcaaccggctgggatgccacc

SEQ ID NO: 261207 - DNA, 25 bp, Mus musculus
gtccacatagatgcggagccaggtc

SEQ ID NO: 261208 - DNA, 25 bp, Mus musculus
cgcagtgcagcacgatgaagcctgt

SEQ ID NO: 261209 - DNA, 25 bp, Mus musculus
cacgatgaagcctgtgcctgggacg

SEQ ID NO: 261210 - DNA, 25 bp, Mus musculus
tgctctggaagcgagcgccaagtcc

SEQ ID NO: 261211 - DNA, 25 bp, Mus musculus
ctgtgcatctagtgggtacgcaacc

SEQ ID NO: 261212 - DNA, 25 bp, Mus musculus
agcgcagcttggatcctggcgccca

SEQ ID NO: 261213 - DNA, 25 bp, Mus musculus
ttgccaagggcaacgcgggacgccc

SEQ ID NO: 261214 - DNA, 25 bp, Mus musculus
aaagctgctcaatggttgccaaggg

SEQ ID NO: 261215 - DNA, 25 bp, Mus musculus
agctccgtttactgcttcggcccgg

SEQ ID NO: 261216 - DNA, 25 bp, Mus musculus
ggccagccaatagaagctccgttta

SEQ ID NO: 261217 - DNA, 25 bp, Mus musculus
cttccgattggctcggctgcccagg

SEQ ID NO: 261218 - DNA, 25 bp, Mus musculus
tgcctccgggcagacatatttgctc

SEQ ID NO: 261219 - DNA, 25 bp, Mus musculus
ggggttctagcctcacgtctggcta

SEQ ID NO: 261220 - DNA, 25 bp, Mus musculus
caaccgaccacgctcggggttctag

SEQ ID NO: 261221 - DNA, 25 bp, Mus musculus
gacatatttgctccaaccgaccacg

SEQ ID NO: 261222 - DNA, 25 bp, Mus musculus
tccctgtaacctctcttccgattgg

SEQ ID NO: 261223 - DNA, 25 bp, Mus musculus
tgccactgacgtggagcctcggcct

SEQ ID NO: 261224 - DNA, 25 bp, Mus musculus
tcaggattcccaatgtgcctccggg

SEQ ID NO: 261225 - DNA, 25 bp, Mus musculus
cctcacgtctggctactaatctagc

SEQ ID NO: 261226 - DNA, 25 bp, Mus musculus
acatcccggtgcttcttctcaggcg

SEQ ID NO: 261227 - DNA, 25 bp, Mus musculus
tcgccaaacggcgtagtgctgcagg

SEQ ID NO: 261228 - DNA, 25 bp, Mus musculus
aaagtcggtgcctgcttgctcctct

SEQ ID NO: 261229 - DNA, 25 bp, Mus musculus
ttctcaggcgcagcagctttcctct

SEQ ID NO: 261230 - DNA, 25 bp, Mus musculus
ccagggtttagtcgcgtgagattta

SEQ ID NO: 261231 - DNA, 25 bp, Mus musculus
ctcagtgggctttaaaagtcggtgc

SEQ ID NO: 261232 - DNA, 25 bp, Mus musculus
atgcgggaggcaaaaatccttatcc

SEQ ID NO: 261233 - DNA, 25 bp, Mus musculus
cgagttgctgcttgctgcctctgct

SEQ ID NO: 261234 - DNA, 25 bp, Mus musculus
gccctcactgatgatttttagaacc

SEQ ID NO: 261235 - DNA, 25 bp, Mus musculus
tccttatccaaaggttgccgcccag

SEQ ID NO: 261236 - DNA, 25 bp, Mus musculus
atggtgcgccgagatcgcttgcgca

SEQ ID NO: 261237 - DNA, 25 bp, Mus musculus
tgtgatccgcaatcctgcggcgggc

SEQ ID NO: 261238 - DNA, 25 bp, Mus musculus
ctccgatcctgtatcgctgcgggcg

SEQ ID NO: 261239 - DNA, 25 bp, Mus musculus
aaactctcggaatcgccctcactga

SEQ ID NO: 261240 - DNA, 25 bp, Mus musculus
tccttcttgtcgaattttttaatca

SEQ ID NO: 261241 - DNA, 25 bp, Mus musculus
gactcctcgtccttcttgtcgaatt

SEQ ID NO: 261242 - DNA, 25 bp, Mus musculus
gtaccagactcctcgtccttcttgt

SEQ ID NO: 261243 - DNA, 25 bp, Mus musculus
cccttgcgcctgagagtgggcgtcc

SEQ ID NO: 261244 - DNA, 25 bp, Mus musculus
aaacccttgcgcctgagagtgggcg

SEQ ID NO: 261245 - DNA, 25 bp, Mus musculus
agccgccgagcgctcgaggcgactc

SEQ ID NO: 261246 - DNA, 25 bp, Mus musculus
caccgcaaccgtcccaggcgccgca

SEQ ID NO: 261247 - DNA, 25 bp, Mus musculus
tttttaatcatcttggacggcttcc

SEQ ID NO: 261248 - DNA, 25 bp, Mus musculus
aatcatcttggacggcttcccagcg

SEQ ID NO: 261249 - DNA, 25 bp, Mus musculus
agaatctgcccggaggctcaccacg

SEQ ID NO: 261250 - DNA, 25 bp, Mus musculus
caggccctgggttctcgcaccggtt

SEQ ID NO: 261251 - DNA, 25 bp, Mus musculus
cggcgagcggaagacgctgcaggaa

SEQ ID NO: 261252 - DNA, 25 bp, Mus musculus
ttcccagcgcccagacccaccgcaa

SEQ ID NO: 261253 - DNA, 25 bp, Mus musculus
cgtggccagaatctgcccggaggct

SEQ ID NO: 261254 - DNA, 25 bp, Mus musculus
taattctgcagtctctttacctgga

SEQ ID NO: 261255 - DNA, 25 bp, Mus musculus
ggaatacagagaattcagaggaatg

SEQ ID NO: 261256 - DNA, 25 bp, Mus musculus
tagaaaaagccctgggcactgcaag

SEQ ID NO: 261257 - DNA, 25 bp, Mus musculus
agggcgcaagccaaggaggaataca

SEQ ID NO: 261258 - DNA, 25 bp, Mus musculus
cgcaagccaaggaggaatacagaga

SEQ ID NO: 261259 - DNA, 25 bp, Mus musculus
gccaaggaggaatacagagaattca

SEQ ID NO: 261260 - DNA, 25 bp, Mus musculus
tgcttacctagaaaaagccctgggc

SEQ ID NO: 261261 - DNA, 25 bp, Mus musculus
cagaggaatgcacgcctgaaggtgc

SEQ ID NO: 261262 - DNA, 25 bp, Mus musculus
gtctgcttacctagaaaaagccctg

SEQ ID NO: 261263 - DNA, 25 bp, Mus musculus
tgtgtctgcttacctagaaaaagcc

SEQ ID NO: 261264 - DNA, 25 bp, Mus musculus
acctggaccattgtgtctgcttacc

SEQ ID NO: 261265 - DNA, 25 bp, Mus musculus
gtctctttacctggaccattgtgtc

SEQ ID NO: 261266 - DNA, 25 bp, Mus musculus
tgcagtctctttacctggaccattg

SEQ ID NO: 261267 - DNA, 25 bp, Mus musculus
tacctagaaaaagccctgggcactg

SEQ ID NO: 261268 - DNA, 25 bp, Mus musculus
cgggcgcataggcaccagtgcagct

SEQ ID NO: 261269 - DNA, 25 bp, Mus musculus
acccagatcgcatccttcgcgtcct

SEQ ID NO: 261270 - DNA, 25 bp, Mus musculus
tagtcggccggcgagaaatggtcgc

SEQ ID NO: 261271 - DNA, 25 bp, Mus musculus
ggcgcataggcaccagtgcagctca

SEQ ID NO: 261272 - DNA, 25 bp, Mus musculus
cgcataggcaccagtgcagctcaca

SEQ ID NO: 261273 - DNA, 25 bp, Mus musculus
taggcaccagtgcagctcacacgct

SEQ ID NO: 261274 - DNA, 25 bp, Mus musculus
acacgctcttgtccacgcagagctg

SEQ ID NO: 261275 - DNA, 25 bp, Mus musculus
acgctcttgtccacgcagagctgca

SEQ ID NO: 261276 - DNA, 25 bp, Mus musculus
tcttgtccacgcagagctgcacacg

SEQ ID NO: 261277 - DNA, 25 bp, Mus musculus
cccacgccacgcttccgtcctgaca

SEQ ID NO: 261278 - DNA, 25 bp, Mus musculus
gccacgcttccgtcctgacacgacc

SEQ ID NO: 261279 - DNA, 25 bp, Mus musculus
gcgaagcagcgatcagtagtcggcc

SEQ ID NO: 261280 - DNA, 25 bp, Mus musculus
aagcagcgatcagtagtcggccggc

SEQ ID NO: 261281 - DNA, 25 bp, Mus musculus
gcccacgcacccagatcgcatcctt

SEQ ID NO: 261282 - DNA, 25 bp, Mus musculus
catagtccaccacggtcaatcggcc

SEQ ID NO: 261283 - DNA, 25 bp, Mus musculus
catgtcttggcccagagagcacctc

SEQ ID NO: 261284 - DNA, 25 bp, Mus musculus
cgggcatgtcttggcccagagagca

SEQ ID NO: 261285 - DNA, 25 bp, Mus musculus
ccgggcatgtcttggcccagagagc

SEQ ID NO: 261286 - DNA, 25 bp, Mus musculus
cccgggcatgtcttggcccagagag

SEQ ID NO: 261287 - DNA, 25 bp, Mus musculus
ccacggtcaatcggcccgagcaggc

SEQ ID NO: 261288 - DNA, 25 bp, Mus musculus
accacggtcaatcggcccgagcagg

SEQ ID NO: 261289 - DNA, 25 bp, Mus musculus
tccaccacggtcaatcggcccgagc

SEQ ID NO: 261290 - DNA, 25 bp, Mus musculus
gtccaccacggtcaatcggcccgag

SEQ ID NO: 261291 - DNA, 25 bp, Mus musculus
ggcatagtccaccacggtcaatcgg

SEQ ID NO: 261292 - DNA, 25 bp, Mus musculus
tagtccaccacggtcaatcggcccg

SEQ ID NO: 261293 - DNA, 25 bp, Mus musculus
gcatagtccaccacggtcaatcggc

SEQ ID NO: 261294 - DNA, 25 bp, Mus musculus
tggcatagtccaccacggtcaatcg

SEQ ID NO: 261295 - DNA, 25 bp, Mus musculus
agtccaccacggtcaatcggcccga

SEQ ID NO: 261296 - DNA, 25 bp, Mus musculus
cggctttcttgacccgtccagacct

SEQ ID NO: 261297 - DNA, 25 bp, Mus musculus
atgaggcccgcctagctggccggag

SEQ ID NO: 261298 - DNA, 25 bp, Mus musculus
acttgagccgctttcctctcttggg

SEQ ID NO: 261299 - DNA, 25 bp, Mus musculus
tcggcccgagcaggcgtcgtgggcc

SEQ ID NO: 261300 - DNA, 25 bp, Mus musculus
tcgtgggcccggaacttgagccgct

SEQ ID NO: 261301 - DNA, 25 bp, Mus musculus
tgggcccggaacttgagccgctttc

SEQ ID NO: 261302 - DNA, 25 bp, Mus musculus
gaacttgagccgctttcctctcttg

SEQ ID NO: 261303 - DNA, 25 bp, Mus musculus
ttgagccgctttcctctcttgggca

SEQ ID NO: 261304 - DNA, 25 bp, Mus musculus
gagccgctttcctctcttgggcatg

SEQ ID NO: 261305 - DNA, 25 bp, Mus musculus
agccgctttcctctcttgggcatgg

SEQ ID NO: 261306 - DNA, 25 bp, Mus musculus
ccgctttcctctcttgggcatggtg

SEQ ID NO: 261307 - DNA, 25 bp, Mus musculus
cctctcttgggcatggtgacggtgt

SEQ ID NO: 261308 - DNA, 25 bp, Mus musculus
cgctttcctctcttgggcatggtga

SEQ ID NO: 261309 - DNA, 25 bp, Mus musculus
ctttcctctcttgggcatggtgacg

SEQ ID NO: 261310 - DNA, 25 bp, Mus musculus
tagctcttacttccgggacctcttc

SEQ ID NO: 261311 - DNA, 25 bp, Mus musculus
gacctcttcaacagcagccgcagtg

SEQ ID NO: 261312 - DNA, 25 bp, Mus musculus
ctggccgcgagtagctcttacttcc

SEQ ID NO: 261313 - DNA, 25 bp, Mus musculus
caccgtgctgcgctggccgcgagta

SEQ ID NO: 261314 - DNA, 25 bp, Mus musculus
ggtgacgggccatgccttcaaagcc

SEQ ID NO: 261315 - DNA, 25 bp, Mus musculus
caagggactatactgtgacgtgtca

SEQ ID NO: 261316 - DNA, 25 bp, Mus musculus
agcagcggctacaagggactatact

SEQ ID NO: 261317 - DNA, 25 bp, Mus musculus
atccttgagtgcctcaatgagcagc

SEQ ID NO: 261318 - DNA, 25 bp, Mus musculus
cttcggcaacagcatccttgagtgc

SEQ ID NO: 261319 - DNA, 25 bp, Mus musculus
ggagattccaaacttcggcaacagc

SEQ ID NO: 261320 - DNA, 25 bp, Mus musculus
gcagaccttgcagatggagattcca

SEQ ID NO: 261321 - DNA, 25 bp, Mus musculus
tgccatggcgcagaccttgcagatg

SEQ ID NO: 261322 - DNA, 25 bp, Mus musculus
agcgcagctgctgccatggcgcaga

SEQ ID NO: 261323 - DNA, 25 bp, Mus musculus
cagtgctgtggtagaactgccggcc

SEQ ID NO: 261324 - DNA, 25 bp, Mus musculus
ggatctacaattgcccgcgcgccgt

SEQ ID NO: 261325 - DNA, 25 bp, Mus musculus
cggaaaggcggttctgcataaagtc

SEQ ID NO: 261326 - DNA, 25 bp, Mus musculus
gtcccgaagcgctgactctgcagaa

SEQ ID NO: 261327 - DNA, 25 bp, Mus musculus
gccaggcgtatcatcttgcagtcta

SEQ ID NO: 261328 - DNA, 25 bp, Mus musculus
tcttgcagtctagacggcgagagcc

SEQ ID NO: 261329 - DNA, 25 bp, Mus musculus
tgggtaaagcacagcccaagttttc

SEQ ID NO: 261330 - DNA, 25 bp, Mus musculus
tccacctctgggaaagaacgaaaga

SEQ ID NO: 261331 - DNA, 25 bp, Mus musculus
aagagacccatgaaggccgatctga

SEQ ID NO: 261332 - DNA, 25 bp, Mus musculus
ccgatctgagtctggggcttcccag

SEQ ID NO: 261333 - DNA, 25 bp, Mus musculus
ccaggctgagctactttcccaaaga

SEQ ID NO: 261334 - DNA, 25 bp, Mus musculus
agggcacagcccgagacttttaagg

SEQ ID NO: 261335 - DNA, 25 bp, Mus musculus
taagggaacgtcttggggatctaca

SEQ ID NO: 261336 - DNA, 25 bp, Mus musculus
ctctgcagaaaaagcggaccctcca

SEQ ID NO: 261337 - DNA, 25 bp, Mus musculus
gctcacacattcagccaggcgtatc

SEQ ID NO: 261338 - DNA, 25 bp, Mus musculus
ccgcgctgaggtcgccttcgttgcc

SEQ ID NO: 261339 - DNA, 25 bp, Mus musculus
ccttggttttggagggcgtcagaat

SEQ ID NO: 261340 - DNA, 25 bp, Mus musculus
tgccgcggcaggacgccttggtttt

SEQ ID NO: 261341 - DNA, 25 bp, Mus musculus
aaactgccgcggcaggacgccttgg

SEQ ID NO: 261342 - DNA, 25 bp, Mus musculus
ccgctcagtgcgagtggatgtgaaa

SEQ ID NO: 261343 - DNA, 25 bp, Mus musculus
ttttggagggcgtcagaatcggtcc

SEQ ID NO: 261344 - DNA, 25 bp, Mus musculus
ggatcatgggctctgccgatcgccc

SEQ ID NO: 261345 - DNA, 25 bp, Mus musculus
cggtcggatcatgggctctgccgat

SEQ ID NO: 261346 - DNA, 25 bp, Mus musculus
cctctccggtcggatcatgggctct

SEQ ID NO: 261347 - DNA, 25 bp, Mus musculus
gccacctctccggtcggatcatggg

SEQ ID NO: 261348 - DNA, 25 bp, Mus musculus
ttagactacggcctcgccacctctc

SEQ ID NO: 261349 - DNA, 25 bp, Mus musculus
gggaccttagactacggcctcgcca

SEQ ID NO: 261350 - DNA, 25 bp, Mus musculus
gtcagaatcggtccggaagacggtc

SEQ ID NO: 261351 - DNA, 25 bp, Mus musculus
cagtgcgagtggatgtgaaactgcc

SEQ ID NO: 261352 - DNA, 25 bp, Mus musculus
cgccatgcccgaaggctccagtttg

SEQ ID NO: 261353 - DNA, 25 bp, Mus musculus
gtctcggcggatgcccaaagactcc

SEQ ID NO: 261354 - DNA, 25 bp, Mus musculus
cggctctttgactcgcaccggtaag

SEQ ID NO: 261355 - DNA, 25 bp, Mus musculus
cgtcctgtcagcttcggcgcctgat

SEQ ID NO: 261356 - DNA, 25 bp, Mus musculus
acaggctcccgagtgacggcttcct

SEQ ID NO: 261357 - DNA, 25 bp, Mus musculus
ggctccacgtcttcctggtcagctg

SEQ ID NO: 261358 - DNA, 25 bp, Mus musculus
tacgaaccatgtgtgcggtcctggg

SEQ ID NO: 261359 - DNA, 25 bp, Mus musculus
caccgcgtcagggtccttatttcca

SEQ ID NO: 261360 - DNA, 25 bp, Mus musculus
tcaccacctgtagcaccgtgagtgg

SEQ ID NO: 261361 - DNA, 25 bp, Mus musculus
aacgtagtcccgtcaggacgcgctc

SEQ ID NO: 261362 - DNA, 25 bp, Mus musculus
agctgttcagcgcatgccgggaaac

SEQ ID NO: 261363 - DNA, 25 bp, Mus musculus
acccggcaagcggtctaggagaagc

SEQ ID NO: 261364 - DNA, 25 bp, Mus musculus
gcatgctgggaacgctagcccttcc

SEQ ID NO: 261365 - DNA, 25 bp, Mus musculus
aggcggtcctctagaacccggcaag

SEQ ID NO: 261366 - DNA, 25 bp, Mus musculus
catagcccgaggctccgtggaatcc

SEQ ID NO: 261367 - DNA, 25 bp, Mus musculus
agcgcaggtggacgctaagttgccc

SEQ ID NO: 261368 - DNA, 25 bp, Mus musculus
tctgggactcgcatcccgaaggagc

SEQ ID NO: 261369 - DNA, 25 bp, Mus musculus
atctcacccgtgagcctgtcctttg

SEQ ID NO: 261370 - DNA, 25 bp, Mus musculus
cgggacagcaacatccctgtgcaca

SEQ ID NO: 261371 - DNA, 25 bp, Mus musculus
tggaaaaggtgtttctgacggctgc

SEQ ID NO: 261372 - DNA, 25 bp, Mus musculus
cctgagaggttggatgactggaaaa

SEQ ID NO: 261373 - DNA, 25 bp, Mus musculus
tccatgggtccaagcctgagaggtt

SEQ ID NO: 261374 - DNA, 25 bp, Mus musculus
caggatctgatcgatgccgaagctg

SEQ ID NO: 261375 - DNA, 25 bp, Mus musculus
ttcgggaccgctcaggatctgatcg

SEQ ID NO: 261376 - DNA, 25 bp, Mus musculus
acaccgaggggtagggcaatctcac

SEQ ID NO: 261377 - DNA, 25 bp, Mus musculus
gaaaacgccgcactttctccgtggc

SEQ ID NO: 261378 - DNA, 25 bp, Mus musculus
actcccgagcctctaggcaaggagg

SEQ ID NO: 261379 - DNA, 25 bp, Mus musculus
tccatccaggggaaggtgagtcccg

SEQ ID NO: 261380 - DNA, 25 bp, Mus musculus
gggtgtgccggaaaactagccaatc

SEQ ID NO: 261381 - DNA, 25 bp, Mus musculus
gctaccgaagttgatccagaggttg

SEQ ID NO: 261382 - DNA, 25 bp, Mus musculus
tcccagggcacacaggctctcttag

SEQ ID NO: 261383 - DNA, 25 bp, Mus musculus
cctccataacgaccaccgattgttg

SEQ ID NO: 261384 - DNA, 25 bp, Mus musculus
ccaatccggagaatgtgaggccctc

SEQ ID NO: 261385 - DNA, 25 bp, Mus musculus
ggccctcgttgctaggagacaagtc

SEQ ID NO: 261386 - DNA, 25 bp, Mus musculus
tcagcctttaagatggcgtctcctc

SEQ ID NO: 261387 - DNA, 25 bp, Mus musculus
ttcggaaccagctccagtcagtgta

SEQ ID NO: 261388 - DNA, 25 bp, Mus musculus
ggtccgttagctgtgtgaacccaaa

SEQ ID NO: 261389 - DNA, 25 bp, Mus musculus
gccgagttgccaaacgctggacttg

SEQ ID NO: 261390 - DNA, 25 bp, Mus musculus
agcgtgcaccgcagagaccctgctt

SEQ ID NO: 261391 - DNA, 25 bp, Mus musculus
ttgtgtctccgacagcgtctggtct

SEQ ID NO: 261392 - DNA, 25 bp, Mus musculus
atggacccactacggaacgaggtgc

SEQ ID NO: 261393 - DNA, 25 bp, Mus musculus
ggactgcactgtatagagaggaccc

SEQ ID NO: 261394 - DNA, 25 bp, Mus musculus
gaactctgtacatcagcgccggaca

SEQ ID NO: 261395 - DNA, 25 bp, Mus musculus
aagtagcggacttgaactgtgtgtg

SEQ ID NO: 261396 - DNA, 25 bp, Mus musculus
cacgccagccaagtagcggacttga

SEQ ID NO: 261397 - DNA, 25 bp, Mus musculus
agccttctgaaggtacacgccagcc

SEQ ID NO: 261398 - DNA, 25 bp, Mus musculus
tagcaagtaaaactttcctgggcca

SEQ ID NO: 261399 - DNA, 25 bp, Mus musculus
tgcgctggaggagctagcaagtaaa

SEQ ID NO: 261400 - DNA, 25 bp, Mus musculus
tcagcgccggacaccctttagtatc

SEQ ID NO: 261401 - DNA, 25 bp, Mus musculus
tcccgcttgccatgaactctgtaca

SEQ ID NO: 261402 - DNA, 25 bp, Mus musculus
gatcgctacaatcccgcttgccatg

SEQ ID NO: 261403 - DNA, 25 bp, Mus musculus
agcagaaggcgggatcgctacaatc

SEQ ID NO: 261404 - DNA, 25 bp, Mus musculus
aggttgtgaagccaagcgcagcaga

SEQ ID NO: 261405 - DNA, 25 bp, Mus musculus
gacaccctttagtatcgcagacatc

SEQ ID NO: 261406 - DNA, 25 bp, Mus musculus
cgcagacatcctaggtccgagcatg

SEQ ID NO: 261407 - DNA, 25 bp, Mus musculus
cgcgtcaccactgtgtgcgctggag

SEQ ID NO: 261408 - DNA, 25 bp, Mus musculus
ggttctgacccggtgtatagggatc

SEQ ID NO: 261409 - DNA, 25 bp, Mus musculus
atgcgcgcggacgtggcctccctat

SEQ ID NO: 261410 - DNA, 25 bp, Mus musculus
aagtggtcacttggttccagaaccg

SEQ ID NO: 261411 - DNA, 25 bp, Mus musculus
ctggctaatgcgcaagtggtcactt

SEQ ID NO: 261412 - DNA, 25 bp, Mus musculus
ggcaccgtcagagcgcgacggactt

SEQ ID NO: 261413 - DNA, 25 bp, Mus musculus
tccagaagtacttggcaccgtcaga

SEQ ID NO: 261414 - DNA, 25 bp, Mus musculus
agcggcgattcgtcttccagaagta

SEQ ID NO: 261415 - DNA, 25 bp, Mus musculus
cgcaagtctcggacagcgttcactg

SEQ ID NO: 261416 - DNA, 25 bp, Mus musculus
ggtgtccggagacgccgcaagtctc

SEQ ID NO: 261417 - DNA, 25 bp, Mus musculus
gacatttccgtctcatcctggcagg

SEQ ID NO: 261418 - DNA, 25 bp, Mus musculus
cctccaaagccgagactgacatttc

SEQ ID NO: 261419 - DNA, 25 bp, Mus musculus
aagtttttccatccagacctcagcc

SEQ ID NO: 261420 - DNA, 25 bp, Mus musculus
gcgaccctaagtttttccatccaga

SEQ ID NO: 261421 - DNA, 25 bp, Mus musculus
tgtatagggatcgtgatgctggccc

SEQ ID NO: 261422 - DNA, 25 bp, Mus musculus
ctctccgctctggatttcgccgtga

SEQ ID NO: 261423 - DNA, 25 bp, Mus musculus
acgcttcctggacccgctcggtgtt

SEQ ID NO: 261424 - DNA, 25 bp, Mus musculus
ctcgactagctcgacgcttcctgga

SEQ ID NO: 261425 - DNA, 25 bp, Mus musculus
agtcgtccgctcgactagctcgacg

SEQ ID NO: 261426 - DNA, 25 bp, Mus musculus
tggggccagtcgtccgctcgactag

SEQ ID NO: 261427 - DNA, 25 bp, Mus musculus
gtgttcagccatctgccctgcgtcg

SEQ ID NO: 261428 - DNA, 25 bp, Mus musculus
ggatttcgccgtgatgtcgaccgca

SEQ ID NO: 261429 - DNA, 25 bp, Mus musculus
ccgtgatgtcgaccgcaatgaactt

SEQ ID NO: 261430 - DNA, 25 bp, Mus musculus
cgcaatgaacttcgggaccaaaagc

SEQ ID NO: 261431 - DNA, 25 bp, Mus musculus
ttcgggaccaaaagcttccagccgc

SEQ ID NO: 261432 - DNA, 25 bp, Mus musculus
gggaccaaaagcttccagccgcggc

SEQ ID NO: 261433 - DNA, 25 bp, Mus musculus
cagacaaaggcagcttcccgctgga

SEQ ID NO: 261434 - DNA, 25 bp, Mus musculus
gcttcccgctggaccacttcggtga

SEQ ID NO: 261435 - DNA, 25 bp, Mus musculus
ggacccgctcggtgttcagccatct

SEQ ID NO: 261436 - DNA, 25 bp, Mus musculus
cgagccctggcctgtttggtaaggc

SEQ ID NO: 261437 - DNA, 25 bp, Mus musculus
tcaagccgagcggtgacgtctattg

SEQ ID NO: 261438 - DNA, 25 bp, Mus musculus
atcacgccacggtcaggacgttcga

SEQ ID NO: 261439 - DNA, 25 bp, Mus musculus
acgtccgggtaacgtcatcacgcca

SEQ ID NO: 261440 - DNA, 25 bp, Mus musculus
tgagcgctgtcttggttgtcttgaa

SEQ ID NO: 261441 - DNA, 25 bp, Mus musculus
ccagactagagccagccggtgactg

SEQ ID NO: 261442 - DNA, 25 bp, Mus musculus
acgtctattggctgtgcgcgacaca

SEQ ID NO: 261443 - DNA, 25 bp, Mus musculus
gctgacaaacgccaacacgcgactg

SEQ ID NO: 261444 - DNA, 25 bp, Mus musculus
gccagcttccggcttgctgacaaac

SEQ ID NO: 261445 - DNA, 25 bp, Mus musculus
tccacctagcgtcgtggactccatg

SEQ ID NO: 261446 - DNA, 25 bp, Mus musculus
gttacgctggccttcctgttgccta

SEQ ID NO: 261447 - DNA, 25 bp, Mus musculus
gggctccattgacccgctgttacgc

SEQ ID NO: 261448 - DNA, 25 bp, Mus musculus
cgcgccctgcgtctttgaagggtgt

SEQ ID NO: 261449 - DNA, 25 bp, Mus musculus
tgtcttgaagctgccttggaccgcc

SEQ ID NO: 261450 - DNA, 25 bp, Mus musculus
gtctcctacctgcaggccgagttgg

SEQ ID NO: 261451 - DNA, 25 bp, Mus musculus
cttctaagcacccatcgagcacggg

SEQ ID NO: 261452 - DNA, 25 bp, Mus musculus
ccagcgtggactgccgcctcagcct

SEQ ID NO: 261453 - DNA, 25 bp, Mus musculus
tggcgcagctgccagccttctaagc

SEQ ID NO: 261454 - DNA, 25 bp, Mus musculus
gcccggacaactccagcgtggactg

SEQ ID NO: 261455 - DNA, 25 bp, Mus musculus
ggcgcagctgccagccttctaagca

SEQ ID NO: 261456 - DNA, 25 bp, Mus musculus
cggacaactccagcgtggactgccg

SEQ ID NO: 261457 - DNA, 25 bp, Mus musculus
tctaagcacccatcgagcacgggcg

SEQ ID NO: 261458 - DNA, 25 bp, Mus musculus
aagcacccatcgagcacgggcggga

SEQ ID NO: 261459 - DNA, 25 bp, Mus musculus
tgggcctgtcctacacgggcccgga

SEQ ID NO: 261460 - DNA, 25 bp, Mus musculus
acctgcaggccgagttggccttcga

SEQ ID NO: 261461 - DNA, 25 bp, Mus musculus
cacccatcgagcacgggcgggagca

SEQ ID NO: 261462 - DNA, 25 bp, Mus musculus
acgggcccggacaactccagcgtgg

SEQ ID NO: 261463 - DNA, 25 bp, Mus musculus
ccgagttggccttcgagggcgaggc

SEQ ID NO: 261464 - DNA, 25 bp, Mus musculus
gatcccggagccgaattgcagcggt

SEQ ID NO: 261465 - DNA, 25 bp, Mus musculus
cggcatggtgcacaccgggacgcca

SEQ ID NO: 261466 - DNA, 25 bp, Mus musculus
ctgcagttgaaggtggcgtcgtact

SEQ ID NO: 261467 - DNA, 25 bp, Mus musculus
catgtggcggtgctcgcagcagaaa

SEQ ID NO: 261468 - DNA, 25 bp, Mus musculus
tgctcgcagcagaaacggtagtggc

SEQ ID NO: 261469 - DNA, 25 bp, Mus musculus
aacggtagtggcaggtgccacaaca

SEQ ID NO: 261470 - DNA, 25 bp, Mus musculus
tgccacaacagaagcggtaggagcc

SEQ ID NO: 261471 - DNA, 25 bp, Mus musculus
gtggcgtcgtactggcccatgacat

SEQ ID NO: 261472 - DNA, 25 bp, Mus musculus
ggcccatgacatcgtagtagccatg

SEQ ID NO: 261473 - DNA, 25 bp, Mus musculus
cgtagtagccatggcagagctcggc

SEQ ID NO: 261474 - DNA, 25 bp, Mus musculus
cgttggcgctggtacctgccgcgct

SEQ ID NO: 261475 - DNA, 25 bp, Mus musculus
cagcagggccggcatggtgcacacc

SEQ ID NO: 261476 - DNA, 25 bp, Mus musculus
acaccgggacgccaggctgcggatc

SEQ ID NO: 261477 - DNA, 25 bp, Mus musculus
gccactgagcttgtgtcgttggatg

SEQ ID NO: 261478 - DNA, 25 bp, Mus musculus
gcagccaaaagactgccgatcctcg

SEQ ID NO: 261479 - DNA, 25 bp, Mus musculus
ggaaagcccacattcgccataagga

SEQ ID NO: 261480 - DNA, 25 bp, Mus musculus
gtactcaaacttgctcttggccatg

SEQ ID NO: 261481 - DNA, 25 bp, Mus musculus
gtgtcctgaacctcaaaattccgca

SEQ ID NO: 261482 - DNA, 25 bp, Mus musculus
cagtgcggcaggcatgtgtcctgaa

SEQ ID NO: 261483 - DNA, 25 bp, Mus musculus
tccagctcaccggtggaaattccgg

SEQ ID NO: 261484 - DNA, 25 bp, Mus musculus
cacttcccggaagtgtgggcgcacc

SEQ ID NO: 261485 - DNA, 25 bp, Mus musculus
ccggtaactacgagaggcgcacttc

SEQ ID NO: 261486 - DNA, 25 bp, Mus musculus
agtgttcattggctgtcgcgttacc

SEQ ID NO: 261487 - DNA, 25 bp, Mus musculus
tctcaggcaccgtcttaaaataacg

SEQ ID NO: 261488 - DNA, 25 bp, Mus musculus
cccggaagttcctgtcgctgtcaga

SEQ ID NO: 261489 - DNA, 25 bp, Mus musculus
ccataaggaagcaatggacgggccc

SEQ ID NO: 261490 - DNA, 25 bp, Mus musculus
cgatcctcgctgtgcggaaagccca

SEQ ID NO: 261491 - DNA, 25 bp, Mus musculus
cgacgctcaatgctgagtgttcatt

SEQ ID NO: 261492 - DNA, 25 bp, Mus musculus
tgggagacacggctcagagaacgca

SEQ ID NO: 261493 - DNA, 25 bp, Mus musculus
gtcttggctctcaatgctactgggg

SEQ ID NO: 261494 - DNA, 25 bp, Mus musculus
atgcgcgctgtaggtttgcacatgc

SEQ ID NO: 261495 - DNA, 25 bp, Mus musculus
tgcacatgcgcaattgagcaccaga

SEQ ID NO: 261496 - DNA, 25 bp, Mus musculus
gcaccagagcccagggaacctactt

SEQ ID NO: 261497 - DNA, 25 bp, Mus musculus
ggaacctacttcagcgctaaatgtg

SEQ ID NO: 261498 - DNA, 25 bp, Mus musculus
tcagcgctaaatgtgcggctgcgca

SEQ ID NO: 261499 - DNA, 25 bp, Mus musculus
gcagctgtgtccttctggtaaagca

SEQ ID NO: 261500 - DNA, 25 bp, Mus musculus
cttctggtaaagcaaggcgacggga

SEQ ID NO: 261501 - DNA, 25 bp, Mus musculus
cgacgggaagttctgcgcttgcgca

SEQ ID NO: 261502 - DNA, 25 bp, Mus musculus
gagaacgcagctctgtcagggtatc

SEQ ID NO: 261503 - DNA, 25 bp, Mus musculus
gcgcgcatgcgtcttggctctcaat

SEQ ID NO: 261504 - DNA, 25 bp, Mus musculus
gaggccgcagaagccgaagccctga

SEQ ID NO: 261505 - DNA, 25 bp, Mus musculus
ctctgtcagggtatctggagaccgc

SEQ ID NO: 261506 - DNA, 25 bp, Mus musculus
tccttctcccggagtggcgcagtga

SEQ ID NO: 261507 - DNA, 25 bp, Mus musculus
cctcccggctatttgctcttcttta

SEQ ID NO: 261508 - DNA, 25 bp, Mus musculus
atgctggctgtaacttggatccggg

SEQ ID NO: 261509 - DNA, 25 bp, Mus musculus
gctcccgagccaccttaaaatgaca

SEQ ID NO: 261510 - DNA, 25 bp, Mus musculus
caaagatgtcctcggatgccggccc

SEQ ID NO: 261511 - DNA, 25 bp, Mus musculus
ggggcgctgaccaaagatgtcctcg

SEQ ID NO: 261512 - DNA, 25 bp, Mus musculus
gcagaggtccacctccgggcgtagt

SEQ ID NO: 261513 - DNA, 25 bp, Mus musculus
caaagggcggccagcaagcgcaatc

SEQ ID NO: 261514 - DNA, 25 bp, Mus musculus
caacaaaaatcctggagcaaagggc

SEQ ID NO: 261515 - DNA, 25 bp, Mus musculus
ttcgcattcatcaactctcatcaca

SEQ ID NO: 261516 - DNA, 25 bp, Mus musculus
aaggtgaccgcctacttcgcattca

SEQ ID NO: 261517 - DNA, 25 bp, Mus musculus
cccaatcctgatgggaaggaaggtg

SEQ ID NO: 261518 - DNA, 25 bp, Mus musculus
gaagccgagcgcctcccggctattt

SEQ ID NO: 261519 - DNA, 25 bp, Mus musculus
aaaacttaatctctccagctccgcg

SEQ ID NO: 261520 - DNA, 25 bp, Mus musculus
cgagggccttgatgccaccagcttt

SEQ ID NO: 261521 - DNA, 25 bp, Mus musculus
tccagacattgagcatgcccgggtg

SEQ ID NO: 261522 - DNA, 25 bp, Mus musculus
ccagggagggcacagagaatttgca

SEQ ID NO: 261523 - DNA, 25 bp, Mus musculus
aggcgtttgcttgcaatgcgcaaca

SEQ ID NO: 261524 - DNA, 25 bp, Mus musculus
cggaatgaatcaccaggcgagcctg

SEQ ID NO: 261525 - DNA, 25 bp, Mus musculus
tagcacctctagtacggaatgaatc

SEQ ID NO: 261526 - DNA, 25 bp, Mus musculus
ctctgaggttctcctgcgactctgg

SEQ ID NO: 261527 - DNA, 25 bp, Mus musculus
gcgagatttcatcgcgctacctcga

SEQ ID NO: 261528 - DNA, 25 bp, Mus musculus
ctggacctttgggtgaatctcgcga

SEQ ID NO: 261529 - DNA, 25 bp, Mus musculus
ccgccctaatggtgtgacaggcaac

SEQ ID NO: 261530 - DNA, 25 bp, Mus musculus
tgtatcgcgagaagtgtccgcccta

SEQ ID NO: 261531 - DNA, 25 bp, Mus musculus
tgtttgccaacaaagaccggccacg

SEQ ID NO: 261532 - DNA, 25 bp, Mus musculus
cagccaccgcgactttgactcaagt

SEQ ID NO: 261533 - DNA, 25 bp, Mus musculus
gccaccagctttgattacgcgaata

SEQ ID NO: 261534 - DNA, 25 bp, Mus musculus
actccaccagtgagcccgaggttgg

SEQ ID NO: 261535 - DNA, 25 bp, Mus musculus
caggacaacctgcacgccgagataa

SEQ ID NO: 261536 - DNA, 25 bp, Mus musculus
ccggcgacatggcatctaaggctaa

SEQ ID NO: 261537 - DNA, 25 bp, Mus musculus
acaggcccgtgtcctagtcaagtcc

SEQ ID NO: 261538 - DNA, 25 bp, Mus musculus
tgtcagggatcgcaaagcccagcgt

SEQ ID NO: 261539 - DNA, 25 bp, Mus musculus
atccgcggagaccttgtgcttactg

SEQ ID NO: 261540 - DNA, 25 bp, Mus musculus
cggacacctacctcgcgggctaaga

SEQ ID NO: 261541 - DNA, 25 bp, Mus musculus
ccgagataaccgagagcggcctctc

SEQ ID NO: 261542 - DNA, 25 bp, Mus musculus
tgctcgtacctcagacccgaggatc

SEQ ID NO: 261543 - DNA, 25 bp, Mus musculus
ggccactgacccacatctggctgtg

SEQ ID NO: 261544 - DNA, 25 bp, Mus musculus
gaacgcagacggatgggccaaacca

SEQ ID NO: 261545 - DNA, 25 bp, Mus musculus
tgggccaaaccactacacacagagg

SEQ ID NO: 261546 - DNA, 25 bp, Mus musculus
cccaaggaggaagcaatttagcaga

SEQ ID NO: 261547 - DNA, 25 bp, Mus musculus
gacgccgtggacctgaagtagcaaa

SEQ ID NO: 261548 - DNA, 25 bp, Mus musculus
cccgagcgacgccagacgaagacag

SEQ ID NO: 261549 - DNA, 25 bp, Mus musculus
agctagccgggccaggtctcgaacc

SEQ ID NO: 261550 - DNA, 25 bp, Mus musculus
agcagagaccgagctagccgggcca

SEQ ID NO: 261551 - DNA, 25 bp, Mus musculus
cgccagacgaagacaggcgttagga

SEQ ID NO: 261552 - DNA, 25 bp, Mus musculus
tcgccctcagctgtgcctggtcggg

SEQ ID NO: 261553 - DNA, 25 bp, Mus musculus
cccgggagcagctgaccatggagcc

SEQ ID NO: 261554 - DNA, 25 bp, Mus musculus
gttgtcagggcaacccgagcgacgc

SEQ ID NO: 261555 - DNA, 25 bp, Mus musculus
cggagctccggttctccttccggag

SEQ ID NO: 261556 - DNA, 25 bp, Mus musculus
gcctgccctgccgttacctgcagcg

SEQ ID NO: 261557 - DNA, 25 bp, Mus musculus
cgacgttcgcgtggtccctagagga

SEQ ID NO: 261558 - DNA, 25 bp, Mus musculus
ccctagaggagctgacagagcgttc

SEQ ID NO: 261559 - DNA, 25 bp, Mus musculus
agctgacagagcgttcccgagctcg

SEQ ID NO: 261560 - DNA, 25 bp, Mus musculus
gctgctctgcgtttccacgtcactt

SEQ ID NO: 261561 - DNA, 25 bp, Mus musculus
tgcgtttccacgtcactttttggtc

SEQ ID NO: 261562 - DNA, 25 bp, Mus musculus
ctgtgcaatggatccgcggccagca

SEQ ID NO: 261563 - DNA, 25 bp, Mus musculus
gcagccgcctgtgcgggtgacttac

SEQ ID NO: 261564 - DNA, 25 bp, Mus musculus
cgggtgacttacctcgggctgcacg

SEQ ID NO: 261565 - DNA, 25 bp, Mus musculus
gggaagtcctactgccctgagtctg

SEQ ID NO: 261566 - DNA, 25 bp, Mus musculus
gctgagcagcgagtctagcctttca

SEQ ID NO: 261567 - DNA, 25 bp, Mus musculus
gagccgcccttgaccgttgcaataa

SEQ ID NO: 261568 - DNA, 25 bp, Mus musculus
cactcgcggagaccctgacttgtag

SEQ ID NO: 261569 - DNA, 25 bp, Mus musculus
atgagcagcctgtccgagttggcgc

SEQ ID NO: 261570 - DNA, 25 bp, Mus musculus
tagaccagctgtgtggcgcaaaggc

SEQ ID NO: 261571 - DNA, 25 bp, Mus musculus
agcagtcgccgttctcattaccacg

SEQ ID NO: 261572 - DNA, 25 bp, Mus musculus
cattaccacggaacaaattagcgtc

SEQ ID NO: 261573 - DNA, 25 bp, Mus musculus
agaccctgacttgtagcgaggtggc

SEQ ID NO: 261574 - DNA, 25 bp, Mus musculus
tggctggatgcaggataccctcaga

SEQ ID NO: 261575 - DNA, 25 bp, Mus musculus
cgttgcaataaatgagcagcctgtc

SEQ ID NO: 261576 - DNA, 25 bp, Mus musculus
aggcgcagagtttcctgcccgagca

SEQ ID NO: 261577 - DNA, 25 bp, Mus musculus
cttttcattgtgcagcgctcggatc

SEQ ID NO: 261578 - DNA, 25 bp, Mus musculus
ctctgtcgtagtcccgtgtgctcct

SEQ ID NO: 261579 - DNA, 25 bp, Mus musculus
aggggacactcaggcgctcctgtgt

SEQ ID NO: 261580 - DNA, 25 bp, Mus musculus
cggggtcattgtttgtgtgcgtttt

SEQ ID NO: 261581 - DNA, 25 bp, Mus musculus
cttcgggaaacttctgtttggcatc

SEQ ID NO: 261582 - DNA, 25 bp, Mus musculus
acttctgtttggcatccgggactcc

SEQ ID NO: 261583 - DNA, 25 bp, Mus musculus
gcatccgggactccgggtggacact

SEQ ID NO: 261584 - DNA, 25 bp, Mus musculus
gggtggacacttttcattgtgcagc

SEQ ID NO: 261585 - DNA, 25 bp, Mus musculus
cgctcggatctgtgaagcctccttt

SEQ ID NO: 261586 - DNA, 25 bp, Mus musculus
tccttttctcgcgtgaggagtggct

SEQ ID NO: 261587 - DNA, 25 bp, Mus musculus
attcccgcgcattcgctctgtcgta

SEQ ID NO: 261588 - DNA, 25 bp, Mus musculus
cccgccctggatggtaggggacact

SEQ ID NO: 261589 - DNA, 25 bp, Mus musculus
tgtgcgttttggcttcttcgggaaa

SEQ ID NO: 261590 - DNA, 25 bp, Mus musculus
ctttggctgcttactgataagtgga

SEQ ID NO: 261591 - DNA, 25 bp, Mus musculus
ccggacctaggcgaagccagtttag

SEQ ID NO: 261592 - DNA, 25 bp, Mus musculus
gccaccgggtctacactgggctaca

SEQ ID NO: 261593 - DNA, 25 bp, Mus musculus
agtttaggggctattgcgtgcgcaa

SEQ ID NO: 261594 - DNA, 25 bp, Mus musculus
caagagccagggtctgcgcccatct

SEQ ID NO: 261595 - DNA, 25 bp, Mus musculus
gcgcccatctgccagcggtcaagta

SEQ ID NO: 261596 - DNA, 25 bp, Mus musculus
gcatgctgggctctgcttacctttg

SEQ ID NO: 261597 - DNA, 25 bp, Mus musculus
gggcagagcatccacggcaaggatc

SEQ ID NO: 261598 - DNA, 25 bp, Mus musculus
ctcggctccggagacttggccagct

SEQ ID NO: 261599 - DNA, 25 bp, Mus musculus
gtgctcctcagatgtcctcatttac

SEQ ID NO: 261600 - DNA, 25 bp, Mus musculus
actgcaattgtcttcggcgagatcc

SEQ ID NO: 261601 - DNA, 25 bp, Mus musculus
accaggtcccggctactctatgcag

SEQ ID NO: 261602 - DNA, 25 bp, Mus musculus
gctactctatgcagccgagcggcca

SEQ ID NO: 261603 - DNA, 25 bp, Mus musculus
ccagcggtcaagtacagagggcttg

SEQ ID NO: 261604 - DNA, 25 bp, Mus musculus
catggccatccaaagcgcgccgcta

SEQ ID NO: 261605 - DNA, 25 bp, Mus musculus
cgagctacggccgaacggatctgag

SEQ ID NO: 261606 - DNA, 25 bp, Mus musculus
tacggccgaacggatctgagctctg

SEQ ID NO: 261607 - DNA, 25 bp, Mus musculus
ccggctccatcctacgctgcagcga

SEQ ID NO: 261608 - DNA, 25 bp, Mus musculus
tacgctgcagcgactctcgccgtcc

SEQ ID NO: 261609 - DNA, 25 bp, Mus musculus
cccgggttcgcttcttggcgcttca

SEQ ID NO: 261610 - DNA, 25 bp, Mus musculus
tcttggcgcttcaggcggtctggca

SEQ ID NO: 261611 - DNA, 25 bp, Mus musculus
gtctggcaggcgctgatctcgcttg

SEQ ID NO: 261612 - DNA, 25 bp, Mus musculus
ctgatctcgcttggctgagcctgtc

SEQ ID NO: 261613 - DNA, 25 bp, Mus musculus
ctgtccggacagcaggagctgctga

SEQ ID NO: 261614 - DNA, 25 bp, Mus musculus
ctgaggctggtacggccgccctact

SEQ ID NO: 261615 - DNA, 25 bp, Mus musculus
actcagcactgatcgccatggccat

SEQ ID NO: 261616 - DNA, 25 bp, Mus musculus
aaagcgcgccgctacgcaggttgac

SEQ ID NO: 261617 - DNA, 25 bp, Mus musculus
tcctactcagcactgatcgccatgg

SEQ ID NO: 261618 - DNA, 25 bp, Mus musculus
cgcagggcttaagactggagctttt

SEQ ID NO: 261619 - DNA, 25 bp, Mus musculus
ggaccgggccagacagatttcctgc

SEQ ID NO: 261620 - DNA, 25 bp, Mus musculus
atttcctgctctcctgtagggctga

SEQ ID NO: 261621 - DNA, 25 bp, Mus musculus
ggctacaggctacgggctacggact

SEQ ID NO: 261622 - DNA, 25 bp, Mus musculus
ggcggcgcaggtacctcactgccta

SEQ ID NO: 261623 - DNA, 25 bp, Mus musculus
cgtgcacattgagcagaccgggata

SEQ ID NO: 261624 - DNA, 25 bp, Mus musculus
tcctcctagtgtacaggatgctagc

SEQ ID NO: 261625 - DNA, 25 bp, Mus musculus
gctagcgactgtagaccctgcgacc

SEQ ID NO: 261626 - DNA, 25 bp, Mus musculus
ctacctgctcgagacgcggtccgaa

SEQ ID NO: 261627 - DNA, 25 bp, Mus musculus
gcggtccgaacttggctaccaccta

SEQ ID NO: 261628 - DNA, 25 bp, Mus musculus
gctctctcggtgaatagctacacag

SEQ ID NO: 261629 - DNA, 25 bp, Mus musculus
acaacctggggatgtgtgtgaacgc

SEQ ID NO: 261630 - DNA, 25 bp, Mus musculus
tccagaaagtgactcgagttgcgcc

SEQ ID NO: 261631 - DNA, 25 bp, Mus musculus
cgactgtaggaagaggacaacaacc

SEQ ID NO: 261632 - DNA, 25 bp, Mus musculus
cagggttctcgcacgcggctagtgt

SEQ ID NO: 261633 - DNA, 25 bp, Mus musculus
ccgccaagttggatggcaccgggaa

SEQ ID NO: 261634 - DNA, 25 bp, Mus musculus
atctcggaggaccaccgaggccggc

SEQ ID NO: 261635 - DNA, 25 bp, Mus musculus
ggacgctgctcgtcaaggccgagaa

SEQ ID NO: 261636 - DNA, 25 bp, Mus musculus
tgaagccggaacaggtgctgctgct

SEQ ID NO: 261637 - DNA, 25 bp, Mus musculus
gcctgctgcaagtgaagccggaaca

SEQ ID NO: 261638 - DNA, 25 bp, Mus musculus
ggacgcgacgcctgctgcaagtgaa

SEQ ID NO: 261639 - DNA, 25 bp, Mus musculus
aaacggctgagctcacaatcccggc

SEQ ID NO: 261640 - DNA, 25 bp, Mus musculus
ggaggccgccaacaaacggctgagc

SEQ ID NO: 261641 - DNA, 25 bp, Mus musculus
cggcccggtctatggcggatgattc

SEQ ID NO: 261642 - DNA, 25 bp, Mus musculus
gttctgggtagccaaggccttggaa

SEQ ID NO: 261643 - DNA, 25 bp, Mus musculus
gatgattccagggttctcgcacgcg

SEQ ID NO: 261644 - DNA, 25 bp, Mus musculus
tctatggcggatgattccagggttc

SEQ ID NO: 261645 - DNA, 25 bp, Mus musculus
tagccaaggccttggaagggtctta

SEQ ID NO: 261646 - DNA, 25 bp, Mus musculus
tcaccttccaaacaggcaggagctg

SEQ ID NO: 261647 - DNA, 25 bp, Mus musculus
ccagagaccaatggcgagggcgaca

SEQ ID NO: 261648 - DNA, 25 bp, Mus musculus
cctgagaacgacagtgcggaagttg

SEQ ID NO: 261649 - DNA, 25 bp, Mus musculus
gtcagcctcgcgtctaccgagtgta

SEQ ID NO: 261650 - DNA, 25 bp, Mus musculus
cggttcaaattctggcgctaagtgc

SEQ ID NO: 261651 - DNA, 25 bp, Mus musculus
agcgcaagttagctctggccgccgc

SEQ ID NO: 261652 - DNA, 25 bp, Mus musculus
cagctggtccagtcagcgcaagtta

SEQ ID NO: 261653 - DNA, 25 bp, Mus musculus
gctccgcttgatggtgaccaggtga

SEQ ID NO: 261654 - DNA, 25 bp, Mus musculus
taccgagtgtaaaatcccgattcca

SEQ ID NO: 261655 - DNA, 25 bp, Mus musculus
gggacaaccctgtcaaacgcagagg

SEQ ID NO: 261656 - DNA, 25 bp, Mus musculus
tgacttccgaacaagccacagggac

SEQ ID NO: 261657 - DNA, 25 bp, Mus musculus
cccaatgcatgagcgtgacttccga

SEQ ID NO: 261658 - DNA, 25 bp, Mus musculus
tccatttggaagctcccaatgcatg

SEQ ID NO: 261659 - DNA, 25 bp, Mus musculus
aagcctctcggtgaagctcgcagtc

SEQ ID NO: 261660 - DNA, 25 bp, Mus musculus
ggacagcatcgccaccaaaatcaac

SEQ ID NO: 261661 - DNA, 25 bp, Mus musculus
tatgtgttgtcagaggaccgcaggc

SEQ ID NO: 261662 - DNA, 25 bp, Mus musculus
tgtcacctacgaggaagcacctttg

SEQ ID NO: 261663 - DNA, 25 bp, Mus musculus
caccacttttgcacaggggaccaga

SEQ ID NO: 261664 - DNA, 25 bp, Mus musculus
aagccgcgcttctccttcgaggaga

SEQ ID NO: 261665 - DNA, 25 bp, Mus musculus
ttcgaggagaaccagatcctgatcc

SEQ ID NO: 261666 - DNA, 25 bp, Mus musculus
aggcttcgaccgctagtacacaacg

SEQ ID NO: 261667 - DNA, 25 bp, Mus musculus
agatcctgatccgagaggtgcgcgc

SEQ ID NO: 261668 - DNA, 25 bp, Mus musculus
ggagactattttcgccatcctggga

SEQ ID NO: 261669 - DNA, 25 bp, Mus musculus
atcaccagctggaaacgcacgggcc

SEQ ID NO: 261670 - DNA, 25 bp, Mus musculus
aagcgttggaacgacttcaagcgcc

SEQ ID NO: 261671 - DNA, 25 bp, Mus musculus
ttcaagcgccgcaccaaggagaagc

SEQ ID NO: 261672 - DNA, 25 bp, Mus musculus
cttctctgcggaggaggagactatt

SEQ ID NO: 261673 - DNA, 25 bp, Mus musculus
ttgattgcattcagcacctcgccgc

SEQ ID NO: 261674 - DNA, 25 bp, Mus musculus
agctcagtaatcaactgcaccctga

SEQ ID NO: 261675 - DNA, 25 bp, Mus musculus
ccttgcgtcacacactgggcgtgct

SEQ ID NO: 261676 - DNA, 25 bp, Mus musculus
ttgcgtcacacactgggcgtgctta

SEQ ID NO: 261677 - DNA, 25 bp, Mus musculus
gcgtcacacactgggcgtgcttaca

SEQ ID NO: 261678 - DNA, 25 bp, Mus musculus
acacactgggcgtgcttacactccc

SEQ ID NO: 261679 - DNA, 25 bp, Mus musculus
ccccttttccggcagctcccagagc

SEQ ID NO: 261680 - DNA, 25 bp, Mus musculus
caggcccgctttacaccctcggact

SEQ ID NO: 261681 - DNA, 25 bp, Mus musculus
ccgctttacaccctcggactacaag

SEQ ID NO: 261682 - DNA, 25 bp, Mus musculus
ggactacaagcccacagctcagtaa

SEQ ID NO: 261683 - DNA, 25 bp, Mus musculus
ctacaagcccacagctcagtaatca

SEQ ID NO: 261684 - DNA, 25 bp, Mus musculus
aagcccacagctcagtaatcaactg

SEQ ID NO: 261685 - DNA, 25 bp, Mus musculus
acccttgcgtcacacactgggcgtg

SEQ ID NO: 261686 - DNA, 25 bp, Mus musculus
gcccacagctcagtaatcaactgca

SEQ ID NO: 261687 - DNA, 25 bp, Mus musculus
tcagtaatcaactgcaccctgactc

SEQ ID NO: 261688 - DNA, 25 bp, Mus musculus
ggaccacgggcgcaaaagcgctctt

SEQ ID NO: 261689 - DNA, 25 bp, Mus musculus
ggcgcaaaagcgctcttctgtttca

SEQ ID NO: 261690 - DNA, 25 bp, Mus musculus
gcgctcttctgtttcactgcggaga

SEQ ID NO: 261691 - DNA, 25 bp, Mus musculus
cttctgtttcactgcggagatgaca

SEQ ID NO: 261692 - DNA, 25 bp, Mus musculus
agatgacattggcaggtgagaatga

SEQ ID NO: 261693 - DNA, 25 bp, Mus musculus
tgagaatgagaaaatgccgtgtgtg

SEQ ID NO: 261694 - DNA, 25 bp, Mus musculus
gccgtgtgtgctgctacagtttgaa

SEQ ID NO: 261695 - DNA, 25 bp, Mus musculus
ggctggacggcactactgcaacaaa

SEQ ID NO: 261696 - DNA, 25 bp, Mus musculus
gcgagagctctgagggcctcgcctc

SEQ ID NO: 261697 - DNA, 25 bp, Mus musculus
ctactgcaacaaagcaaacatggtc

SEQ ID NO: 261698 - DNA, 25 bp, Mus musculus
ggaggggccacaaaacaagacacga

SEQ ID NO: 261699 - DNA, 25 bp, Mus musculus
acaagacacgacatgcttcggctcg

SEQ ID NO: 261700 - DNA, 25 bp, Mus musculus
aagcaaacatggtcagcacgcgcgg

SEQ ID NO: 261701 - DNA, 25 bp, Mus musculus
ggcgcagcaccacggcgagagctct

SEQ ID NO: 261702 - DNA, 25 bp, Mus musculus
gtgctaatggccaatctggtgttta

SEQ ID NO: 261703 - DNA, 25 bp, Mus musculus
gcgactgcgactacagacgccggga

SEQ ID NO: 261704 - DNA, 25 bp, Mus musculus
gctaggcgtcctccgacagcaggaa

SEQ ID NO: 261705 - DNA, 25 bp, Mus musculus
ggccacgtgcttctcgcccgatgat

SEQ ID NO: 261706 - DNA, 25 bp, Mus musculus
ctcgcccgatgatatttagaaagaa

SEQ ID NO: 261707 - DNA, 25 bp, Mus musculus
tcctcgggtaaaaaggcagtgtctg

SEQ ID NO: 261708 - DNA, 25 bp, Mus musculus
gtcgatcagagtgcgctgcgactgc

SEQ ID NO: 261709 - DNA, 25 bp, Mus musculus
gcccgatcgctctatcggaagaagt

SEQ ID NO: 261710 - DNA, 25 bp, Mus musculus
cattgtcttatacgaaggcccgatc

SEQ ID NO: 261711 - DNA, 25 bp, Mus musculus
ggcgtcgtcctctggccattgtctt

SEQ ID NO: 261712 - DNA, 25 bp, Mus musculus
gctcctgaagcttgggccaccgcaa

SEQ ID NO: 261713 - DNA, 25 bp, Mus musculus
gcctgcaagagaccggggcacagcc

SEQ ID NO: 261714 - DNA, 25 bp, Mus musculus
ctgccacttcagtcagtcgcgggga

SEQ ID NO: 261715 - DNA, 25 bp, Mus musculus
tccgccagatggtgcgaagccctag

SEQ ID NO: 261716 - DNA, 25 bp, Mus musculus
tgcgccatatatgggagcggccgcc

SEQ ID NO: 261717 - DNA, 25 bp, Mus musculus
cgcctgctccaaagacaaataaacg

SEQ ID NO: 261718 - DNA, 25 bp, Mus musculus
acactgcgggatcgcccgcttctgg

SEQ ID NO: 261719 - DNA, 25 bp, Mus musculus
tgtcatcctagccaggcggcgtccg

SEQ ID NO: 261720 - DNA, 25 bp, Mus musculus
cgcgctcaacgtggtgtcatcctag

SEQ ID NO: 261721 - DNA, 25 bp, Mus musculus
tgaatcccaaacatgaacactgctg

SEQ ID NO: 261722 - DNA, 25 bp, Mus musculus
cacagtcaaaacaccgtgggtcgga

SEQ ID NO: 261723 - DNA, 25 bp, Mus musculus
cggacggaggcgcacaaaactcagc

SEQ ID NO: 261724 - DNA, 25 bp, Mus musculus
ggccgaggaagttaccacccgctca

SEQ ID NO: 261725 - DNA, 25 bp, Mus musculus
cccgctcaaataaatctcgcaaaga

SEQ ID NO: 261726 - DNA, 25 bp, Mus musculus
cgcaaagaagcgagcgcagccagtg

SEQ ID NO: 261727 - DNA, 25 bp, Mus musculus
tgcataagtgctgcttggcccgtta

SEQ ID NO: 261728 - DNA, 25 bp, Mus musculus
tggcccgttatacctgcccacaaga

SEQ ID NO: 261729 - DNA, 25 bp, Mus musculus
cccgcgcggaatattctcctgaatc

SEQ ID NO: 261730 - DNA, 25 bp, Mus musculus
cgagcctctactccgacgggcgtgg

SEQ ID NO: 261731 - DNA, 25 bp, Mus musculus
tcccgggatcctaccagagaaagcc

SEQ ID NO: 261732 - DNA, 25 bp, Mus musculus
tcctaccagagaaagccgaatggtc

SEQ ID NO: 261733 - DNA, 25 bp, Mus musculus
gccttcccgggatcctaccagagaa

SEQ ID NO: 261734 - DNA, 25 bp, Mus musculus
aactttgcgggctctgcggccgctt

SEQ ID NO: 261735 - DNA, 25 bp, Mus musculus
aaagccgaatggtcacgccacccga

SEQ ID NO: 261736 - DNA, 25 bp, Mus musculus
atcgcgcggagcagagcgcttacct

SEQ ID NO: 261737 - DNA, 25 bp, Mus musculus
cgaagttcaactttgcgggctctgc

SEQ ID NO: 261738 - DNA, 25 bp, Mus musculus
cccgcgacgcgcgaagttcaacttt

SEQ ID NO: 261739 - DNA, 25 bp, Mus musculus
ctggaggtgtgctgctccgcgcctc

SEQ ID NO: 261740 - DNA, 25 bp, Mus musculus
gaggatctggctccgcatcctgtgt

SEQ ID NO: 261741 - DNA, 25 bp, Mus musculus
agaccctcgcgcaccgaggatctgg

SEQ ID NO: 261742 - DNA, 25 bp, Mus musculus
cccgagccgccaagcctccctcagt

SEQ ID NO: 261743 - DNA, 25 bp, Mus musculus
agagcgcttacctgagccgccgagc

SEQ ID NO: 261744 - DNA, 25 bp, Mus musculus
acggcctgaagtgcgggtaattctt

SEQ ID NO: 261745 - DNA, 25 bp, Mus musculus
taagtagatccacggaccaatcggc

SEQ ID NO: 261746 - DNA, 25 bp, Mus musculus
cttccttgtgattggttactgagtc

SEQ ID NO: 261747 - DNA, 25 bp, Mus musculus
tgtttaggatttgccacccttcggc

SEQ ID NO: 261748 - DNA, 25 bp, Mus musculus
ttcacaaagtcagtcccaaagggcg

SEQ ID NO: 261749 - DNA, 25 bp, Mus musculus
gtggcttgtcgattctcggttcaca

SEQ ID NO: 261750 - DNA, 25 bp, Mus musculus
agccacaggtcgatgcctcgcaagc

SEQ ID NO: 261751 - DNA, 25 bp, Mus musculus
cccgaatctcctacggcctgaagtg

SEQ ID NO: 261752 - DNA, 25 bp, Mus musculus
caggagtagccgaaacccgaatctc

SEQ ID NO: 261753 - DNA, 25 bp, Mus musculus
ggcgtagcctagactccactgactg

SEQ ID NO: 261754 - DNA, 25 bp, Mus musculus
ggaaccactcgaccacgtgtctgga

SEQ ID NO: 261755 - DNA, 25 bp, Mus musculus
caggctgtccatgcggcttcacgta

SEQ ID NO: 261756 - DNA, 25 bp, Mus musculus
tcggcagcaggcttacgacgtccag

SEQ ID NO: 261757 - DNA, 25 bp, Mus musculus
gcctcgcaagcccaagccgtgagtg

SEQ ID NO: 261758 - DNA, 25 bp, Mus musculus
agacccgcatgtggcgcctcctgaa

SEQ ID NO: 261759 - DNA, 25 bp, Mus musculus
ggaagtcggctctgcccagcagttt

SEQ ID NO: 261760 - DNA, 25 bp, Mus musculus
tctgcccagcagtttgaagagctac

SEQ ID NO: 261761 - DNA, 25 bp, Mus musculus
tgaagagctactgcgcctcaaaacc

SEQ ID NO: 261762 - DNA, 25 bp, Mus musculus
tgcgcctcaaaaccaagtacgcggg

SEQ ID NO: 261763 - DNA, 25 bp, Mus musculus
ccaacgcggcacgtccggagctgag

SEQ ID NO: 261764 - DNA, 25 bp, Mus musculus
agctcgtggtccaacggcggcccta

SEQ ID NO: 261765 - DNA, 25 bp, Mus musculus
gcacaatggacctgccctccggaga

SEQ ID NO: 261766 - DNA, 25 bp, Mus musculus
cgcctcctgaaggaagccttggctg

SEQ ID NO: 261767 - DNA, 25 bp, Mus musculus
caggcccagctagggtcccgggctt

SEQ ID NO: 261768 - DNA, 25 bp, Mus musculus
tttcctgaaccaccagccggctaag

SEQ ID NO: 261769 - DNA, 25 bp, Mus musculus
ccaccagccggctaagggagggtct

SEQ ID NO: 261770 - DNA, 25 bp, Mus musculus
ctccggcgctcgactgctggtgtct

SEQ ID NO: 261771 - DNA, 25 bp, Mus musculus
cttggctggcgaccagcctgcaggc

SEQ ID NO: 261772 - DNA, 25 bp, Mus musculus
ccaggataggaagggacccgcaata

SEQ ID NO: 261773 - DNA, 25 bp, Mus musculus
gtctgcattcatcggccacgggaga

SEQ ID NO: 261774 - DNA, 25 bp, Mus musculus
cttcggagcgaactcacttggttgc

SEQ ID NO: 261775 - DNA, 25 bp, Mus musculus
tagcccactccgttgtcgctactgg

SEQ ID NO: 261776 - DNA, 25 bp, Mus musculus
tgtcgctactggtggccaattgctc

SEQ ID NO: 261777 - DNA, 25 bp, Mus musculus
caattgctctagctgacggtgcgca

SEQ ID NO: 261778 - DNA, 25 bp, Mus musculus
ggtccaggctgtttggcttcagcca

SEQ ID NO: 261779 - DNA, 25 bp, Mus musculus
atctagggcggtctaatgagagcca

SEQ ID NO: 261780 - DNA, 25 bp, Mus musculus
ctgccaaagcaaaaccggacgtcga

SEQ ID NO: 261781 - DNA, 25 bp, Mus musculus
ggacgtcgaagcatgaactttcttg

SEQ ID NO: 261782 - DNA, 25 bp, Mus musculus
caatgtatgaatgcgcggctgcgtc

SEQ ID NO: 261783 - DNA, 25 bp, Mus musculus
ctgcgtcctgatggtatggagaacc

SEQ ID NO: 261784 - DNA, 25 bp, Mus musculus
gagccgttacctgtccgtggagcag

SEQ ID NO: 261785 - DNA, 25 bp, Mus musculus
tatggagaacccaggacaacccagg

SEQ ID NO: 261786 - DNA, 25 bp, Mus musculus
ccaggtatgcggagcctccggactc

SEQ ID NO: 261787 - DNA, 25 bp, Mus musculus
ccgcggtcctggcagctttgaatag

SEQ ID NO: 261788 - DNA, 25 bp, Mus musculus
cctggcagctttgaataggagcttc

SEQ ID NO: 261789 - DNA, 25 bp, Mus musculus
aggagcttcgctcggctcaccttca

SEQ ID NO: 261790 - DNA, 25 bp, Mus musculus
cagcggcgtcgtgtctcagtctcgt

SEQ ID NO: 261791 - DNA, 25 bp, Mus musculus
ctcgtgggccggactggatgcccac

SEQ ID NO: 261792 - DNA, 25 bp, Mus musculus
tgccaccatagggttgccaggtatg

SEQ ID NO: 261793 - DNA, 25 bp, Mus musculus
cgacgaactccgtgccaagacgcgg

SEQ ID NO: 261794 - DNA, 25 bp, Mus musculus
tatgcggagcctccggactccgaac

SEQ ID NO: 261795 - DNA, 25 bp, Mus musculus
ctttctccgggcgatctcgggtctc

SEQ ID NO: 261796 - DNA, 25 bp, Mus musculus
gggcgatctcgggtctccaatctgc

SEQ ID NO: 261797 - DNA, 25 bp, Mus musculus
acaggcccggctgtcggagagacac

SEQ ID NO: 261798 - DNA, 25 bp, Mus musculus
aactccgtgccaagacgcgggcctg

SEQ ID NO: 261799 - DNA, 25 bp, Mus musculus
cagcgctgccaccatagggttgcca

SEQ ID NO: 261800 - DNA, 25 bp, Mus musculus
cgagccgggatggaccacaagtaag

SEQ ID NO: 261801 - DNA, 25 bp, Mus musculus
gcgtttgcttgaaaacctccgccgc

SEQ ID NO: 261802 - DNA, 25 bp, Mus musculus
tgagagggccgttgctatcatgccc

SEQ ID NO: 261803 - DNA, 25 bp, Mus musculus
cgttgctatcatgcccgggcgcgcg

SEQ ID NO: 261804 - DNA, 25 bp, Mus musculus
tcgcccggttctgcttgctggctct

SEQ ID NO: 261805 - DNA, 25 bp, Mus musculus
tggctctcgctctgcagctacattg

SEQ ID NO: 261806 - DNA, 25 bp, Mus musculus
tgcagctacattggccgctggcggc

SEQ ID NO: 261807 - DNA, 25 bp, Mus musculus
acaagtaagtggcagcgcgcagatg

SEQ ID NO: 261808 - DNA, 25 bp, Mus musculus
cgcagatgggttctgaggcgactag

SEQ ID NO: 261809 - DNA, 25 bp, Mus musculus
atgactgagggtctgagagtcgctc

SEQ ID NO: 261810 - DNA, 25 bp, Mus musculus
tctgagagtcgctcttgcatgccgg

SEQ ID NO: 261811 - DNA, 25 bp, Mus musculus
agtcgctcttgcatgccggcagctc

SEQ ID NO: 261812 - DNA, 25 bp, Mus musculus
atgccggcagctccatgaccgctat

SEQ ID NO: 261813 - DNA, 25 bp, Mus musculus
tgaccgctatccctgcggactccgc

SEQ ID NO: 261814 - DNA, 25 bp, Mus musculus
tggctaagccgtgtggcgccgtgca

SEQ ID NO: 261815 - DNA, 25 bp, Mus musculus
gctctggcgtggctaagccgtgtgg

SEQ ID NO: 261816 - DNA, 25 bp, Mus musculus
taagccgtgtggcgccgtgcagctc

SEQ ID NO: 261817 - DNA, 25 bp, Mus musculus
ctaagccgtgtggcgccgtgcagct

SEQ ID NO: 261818 - DNA, 25 bp, Mus musculus
gctaagccgtgtggcgccgtgcagc

SEQ ID NO: 261819 - DNA, 25 bp, Mus musculus
aagccgtgtggcgccgtgcagctct

SEQ ID NO: 261820 - DNA, 25 bp, Mus musculus
tggcgtggctaagccgtgtggcgcc

SEQ ID NO: 261821 - DNA, 25 bp, Mus musculus
cagctctggcgtgggtaagccgtgt

SEQ ID NO: 261822 - DNA, 25 bp, Mus musculus
cagctctggcgtggctaagccgtgt

SEQ ID NO: 261823 - DNA, 25 bp, Mus musculus
ccgtgtggcgccgtgcagctctggc

SEQ ID NO: 261824 - DNA, 25 bp, Mus musculus
gcagctctggcgtggctaagccgtg

SEQ ID NO: 261825 - DNA, 25 bp, Mus musculus
cgtggctaagccgtgtggcgccgtg

SEQ ID NO: 261826 - DNA, 25 bp, Mus musculus
ctggcgtggctaagccgtgtggcgc

SEQ ID NO: 261827 - DNA, 25 bp, Mus musculus
gtgtggcgccgtgcagctctggcgt

SEQ ID NO: 261828 - DNA, 25 bp, Mus musculus
acacgactcgagaaggccgcctcta

SEQ ID NO: 261829 - DNA, 25 bp, Mus musculus
ttaagaacgtagagggcgtcgcgtc

SEQ ID NO: 261830 - DNA, 25 bp, Mus musculus
ccgcagaagaaagtctgaggcctta

SEQ ID NO: 261831 - DNA, 25 bp, Mus musculus
aaggcccaggccttcgagcatccag

SEQ ID NO: 261832 - DNA, 25 bp, Mus musculus
tcccgttggctcagctgtaggaaag

SEQ ID NO: 261833 - DNA, 25 bp, Mus musculus
cagatccacggaggttccgcgttcc

SEQ ID NO: 261834 - DNA, 25 bp, Mus musculus
cgagcgctctctattggcagatcca

SEQ ID NO: 261835 - DNA, 25 bp, Mus musculus
gcctctatctgccagcggactagtc

SEQ ID NO: 261836 - DNA, 25 bp, Mus musculus
cagcggctacgtaggtccaacctca

SEQ ID NO: 261837 - DNA, 25 bp, Mus musculus
aacctcaagacagctcgcgcagacg

SEQ ID NO: 261838 - DNA, 25 bp, Mus musculus
cggcaacgacttccagtggtgcttc

SEQ ID NO: 261839 - DNA, 25 bp, Mus musculus
tgagtcccgcttcggggatctgttg

SEQ ID NO: 261840 - DNA, 25 bp, Mus musculus
gatgatggccatgacgccggcctca

SEQ ID NO: 261841 - DNA, 25 bp, Mus musculus
gcgtcctagccttgacacgactcga

SEQ ID NO: 261842 - DNA, 25 bp, Mus musculus
gtggctcgccagatgtttcatgatg

SEQ ID NO: 261843 - DNA, 25 bp, Mus musculus
ccggaccgctatgacagggctactt

SEQ ID NO: 261844 - DNA, 25 bp, Mus musculus
tgccttcgccggctttggagtacac

SEQ ID NO: 261845 - DNA, 25 bp, Mus musculus
tgacgctggcacctggcttaagccc

SEQ ID NO: 261846 - DNA, 25 bp, Mus musculus
gctcgtccacttttcggctccgatt

SEQ ID NO: 261847 - DNA, 25 bp, Mus musculus
tgcggactgcttggcagaactgaac

SEQ ID NO: 261848 - DNA, 25 bp, Mus musculus
tgtaagggaacagctactggctctg

SEQ ID NO: 261849 - DNA, 25 bp, Mus musculus
tcgattcaagaaggaccacgggctg

SEQ ID NO: 261850 - DNA, 25 bp, Mus musculus
ggtgttcgcctttgatgccactgcc

SEQ ID NO: 261851 - DNA, 25 bp, Mus musculus
cctccgggctatgagttcgagctga

SEQ ID NO: 261852 - DNA, 25 bp, Mus musculus
ccctgtggttctggcaatgtttacg

SEQ ID NO: 261853 - DNA, 25 bp, Mus musculus
tcgggcttcaagtacctcgagtatg

SEQ ID NO: 261854 - DNA, 25 bp, Mus musculus
cggaccgcatcgagctgctcatcga

SEQ ID NO: 261855 - DNA, 25 bp, Mus musculus
tacctcgagtatgaacggcgccatg

SEQ ID NO: 261856 - DNA, 25 bp, Mus musculus
ctctgcgacatggtggctcggcaaa

SEQ ID NO: 261857 - DNA, 25 bp, Mus musculus
ctggccttgggtgctgagtttgccc

SEQ ID NO: 261858 - DNA, 25 bp, Mus musculus
cttgggactccgaggtgcgcgcatt

SEQ ID NO: 261859 - DNA, 25 bp, Mus musculus
ctcctgctcgcggttgacccatagt

SEQ ID NO: 261860 - DNA, 25 bp, Mus musculus
tgctcgcggttgacccatagttccc

SEQ ID NO: 261861 - DNA, 25 bp, Mus musculus
cagcctgcgccgctcagttctgagg

SEQ ID NO: 261862 - DNA, 25 bp, Mus musculus
gctcagttctgaggccaggcgacac

SEQ ID NO: 261863 - DNA, 25 bp, Mus musculus
caggcgacactggactgagggacaa

SEQ ID NO: 261864 - DNA, 25 bp, Mus musculus
ttaaggtctaatgcagaagtggacc

SEQ ID NO: 261865 - DNA, 25 bp, Mus musculus
gctcgaggtctgagccttgggactc

SEQ ID NO: 261866 - DNA, 25 bp, Mus musculus
ggagcccgaacccaactgcgacagg

SEQ ID NO: 261867 - DNA, 25 bp, Mus musculus
gctcggcaaaggagcccgaacccaa

SEQ ID NO: 261868 - DNA, 25 bp, Mus musculus
caatctcctccggaacctgcgagcg

SEQ ID NO: 261869 - DNA, 25 bp, Mus musculus
cccaactgcgacaggcctgggaggc

SEQ ID NO: 261870 - DNA, 25 bp, Mus musculus
tgagtgattcctaccacggatagtc

SEQ ID NO: 261871 - DNA, 25 bp, Mus musculus
accagggtcatcttcggcaatgtca

SEQ ID NO: 261872 - DNA, 25 bp, Mus musculus
cacggatagtccctcgtaggcgcgt

SEQ ID NO: 261873 - DNA, 25 bp, Mus musculus
gcacatttaacctggatggctttta

SEQ ID NO: 261874 - DNA, 25 bp, Mus musculus
taagcgcaacgatctggggaagcca

SEQ ID NO: 261875 - DNA, 25 bp, Mus musculus
gcagcggtgcgatcctcaggatccc

SEQ ID NO: 261876 - DNA, 25 bp, Mus musculus
aggatcccacgcatcccacagttga

SEQ ID NO: 261877 - DNA, 25 bp, Mus musculus
ccgctcctggcactgaatattcagg

SEQ ID NO: 261878 - DNA, 25 bp, Mus musculus
ttgctcgactctccctggtgatccg

SEQ ID NO: 261879 - DNA, 25 bp, Mus musculus
ggtgtttgcctctctgggagatttc

SEQ ID NO: 261880 - DNA, 25 bp, Mus musculus
gagatttctcgcgttccactggcaa

SEQ ID NO: 261881 - DNA, 25 bp, Mus musculus
tatttcactgcaccggtttcccgcg

SEQ ID NO: 261882 - DNA, 25 bp, Mus musculus
gctgctcacatccagcacgcaatga

SEQ ID NO: 261883 - DNA, 25 bp, Mus musculus
ccgaagcctgatcgaggggaacctt

SEQ ID NO: 261884 - DNA, 25 bp, Mus musculus
cgaacagcgcaagcacgcggtcctg

SEQ ID NO: 261885 - DNA, 25 bp, Mus musculus
atggcgcgcccgacaaggtgaagac

SEQ ID NO: 261886 - DNA, 25 bp, Mus musculus
tgctcaacaccctgcgggatggcgc

SEQ ID NO: 261887 - DNA, 25 bp, Mus musculus
gtcctggtcacggagctcaagacca

SEQ ID NO: 261888 - DNA, 25 bp, Mus musculus
aggccttgctcaacaccctgcggga

SEQ ID NO: 261889 - DNA, 25 bp, Mus musculus
acggagctcaagaccaagctgcacg

SEQ ID NO: 261890 - DNA, 25 bp, Mus musculus
gggtcatcaagattaaggacaacga

SEQ ID NO: 261891 - DNA, 25 bp, Mus musculus
ctcctgagggtcatcaagattaagg

SEQ ID NO: 261892 - DNA, 25 bp, Mus musculus
gccgagctcctgagggtcatcaaga

SEQ ID NO: 261893 - DNA, 25 bp, Mus musculus
tgcgacagcacgaggccgagctcct

SEQ ID NO: 261894 - DNA, 25 bp, Mus musculus
gcgaggcactgttgcgacagcacga

SEQ ID NO: 261895 - DNA, 25 bp, Mus musculus
ccgtgcgcgaggcactgttgcgaca

SEQ ID NO: 261896 - DNA, 25 bp, Mus musculus
gcaagcacgcggtcctggtcacgga

SEQ ID NO: 261897 - DNA, 25 bp, Mus musculus
aggacaacgagaaccagcggctgca

SEQ ID NO: 261898 - DNA, 25 bp, Mus musculus
agctttctaaagtgagtatgcaaca

SEQ ID NO: 261899 - DNA, 25 bp, Mus musculus
agctccttaaatgacctcgatcaaa

SEQ ID NO: 261900 - DNA, 25 bp, Mus musculus
gacctcgatcaaagtcaagatgaga

SEQ ID NO: 261901 - DNA, 25 bp, Mus musculus
tcaaagtcaagatgagagagagatc

SEQ ID NO: 261902 - DNA, 25 bp, Mus musculus
acttcctaaagctccagatcgtgga

SEQ ID NO: 261903 - DNA, 25 bp, Mus musculus
tctgctgccataccttctgtctaca

SEQ ID NO: 261904 - DNA, 25 bp, Mus musculus
cctcattgatgagctttctaaagtg

SEQ ID NO: 261905 - DNA, 25 bp, Mus musculus
aacacttccgtgctgtgctgagctg

SEQ ID NO: 261906 - DNA, 25 bp, Mus musculus
gctgagctgtgtccgccgaagccac

SEQ ID NO: 261907 - DNA, 25 bp, Mus musculus
tgctgccctgtgcactcactgaagc

SEQ ID NO: 261908 - DNA, 25 bp, Mus musculus
tccctgtgtccctctagagctgtac

SEQ ID NO: 261909 - DNA, 25 bp, Mus musculus
tcactgcacattctctgctgccata

SEQ ID NO: 261910 - DNA, 25 bp, Mus musculus
gtgagtatgcaacacttccgtgctg

SEQ ID NO: 261911 - DNA, 25 bp, Mus musculus
atcgtggagcagcagaacctcattg

SEQ ID NO: 261912 - DNA, 25 bp, Mus musculus
ccgcccgtgtatcaggatgtccttc

SEQ ID NO: 261913 - DNA, 25 bp, Mus musculus
gtagatctgatgtccctggaggccc

SEQ ID NO: 261914 - DNA, 25 bp, Mus musculus
ttagccctggctagtagatctgatg

SEQ ID NO: 261915 - DNA, 25 bp, Mus musculus
ttgtccgagacaaagcgatttagcc

SEQ ID NO: 261916 - DNA, 25 bp, Mus musculus
ggctagctcacactcggacttccta

SEQ ID NO: 261917 - DNA, 25 bp, Mus musculus
ttggcttgcacgctcaacggacgac

SEQ ID NO: 261918 - DNA, 25 bp, Mus musculus
gaaccctttgcgcagtcggcgcaca

SEQ ID NO: 261919 - DNA, 25 bp, Mus musculus
tccggaatccggtgatccgcttgga

SEQ ID NO: 261920 - DNA, 25 bp, Mus musculus
ttcaagtggacattgcctggagctc

SEQ ID NO: 261921 - DNA, 25 bp, Mus musculus
ccggcggacacagcctttgttggcc

SEQ ID NO: 261922 - DNA, 25 bp, Mus musculus
gcctcaaggcactcggacgtccgaa

SEQ ID NO: 261923 - DNA, 25 bp, Mus musculus
gacgtccgaagctgctcccagagca

SEQ ID NO: 261924 - DNA, 25 bp, Mus musculus
cggggcctggatgcaaataagctaa

SEQ ID NO: 261925 - DNA, 25 bp, Mus musculus
ctttcgtgtctctagcgctttgtcc

SEQ ID NO: 261926 - DNA, 25 bp, Mus musculus
accgactctcacctcgaaaggcgag

SEQ ID NO: 261927 - DNA, 25 bp, Mus musculus
tcctcatcgccaggcctgggtatgc

SEQ ID NO: 261928 - DNA, 25 bp, Mus musculus
ggaggctcgacccttgcaccgaaaa

SEQ ID NO: 261929 - DNA, 25 bp, Mus musculus
tgcgcagcacacagagtgggctacc

SEQ ID NO: 261930 - DNA, 25 bp, Mus musculus
tggtattagattccgtgcgcagcac

SEQ ID NO: 261931 - DNA, 25 bp, Mus musculus
tcctggtatctgctctggctcgcca

SEQ ID NO: 261932 - DNA, 25 bp, Mus musculus
gcaacgccggccgttctcctggtat

SEQ ID NO: 261933 - DNA, 25 bp, Mus musculus
gctgcctgacgatatggacgacata

SEQ ID NO: 261934 - DNA, 25 bp, Mus musculus
cccagtgggcggtttcactcaccgt

SEQ ID NO: 261935 - DNA, 25 bp, Mus musculus
ttcgtcccaacgcagagaaatgcca

SEQ ID NO: 261936 - DNA, 25 bp, Mus musculus
gggacttcagtcgtggcccaatagt

SEQ ID NO: 261937 - DNA, 25 bp, Mus musculus
tcactggaaacaggacgcgccatgg

SEQ ID NO: 261938 - DNA, 25 bp, Mus musculus
gaaaggcgagccagaacctcatcta

SEQ ID NO: 261939 - DNA, 25 bp, Mus musculus
ctacccgctgcgctgtcactggaaa

SEQ ID NO: 261940 - DNA, 25 bp, Mus musculus
ctccatggcgacctggtaaaccgcg

SEQ ID NO: 261941 - DNA, 25 bp, Mus musculus
tgcactggatgggacccggccacca

SEQ ID NO: 261942 - DNA, 25 bp, Mus musculus
ctgttacgtcagtcaccgctagccg

SEQ ID NO: 261943 - DNA, 25 bp, Mus musculus
agcccatcctctcgaagtttctttc

SEQ ID NO: 261944 - DNA, 25 bp, Mus musculus
aaccgcgcagctcgctggtttgtta

SEQ ID NO: 261945 - DNA, 25 bp, Mus musculus
gacttgatgccttccggcctccgta

SEQ ID NO: 261946 - DNA, 25 bp, Mus musculus
gccagacctgcgacttgatgccttc

SEQ ID NO: 261947 - DNA, 25 bp, Mus musculus
gaagctatcccaagccagacctgcg

SEQ ID NO: 261948 - DNA, 25 bp, Mus musculus
tccagcataagaggcggtaagcgca

SEQ ID NO: 261949 - DNA, 25 bp, Mus musculus
cagcggtcagttccagaggcctgag

SEQ ID NO: 261950 - DNA, 25 bp, Mus musculus
ggtccatggccctggaagacggtct

SEQ ID NO: 261951 - DNA, 25 bp, Mus musculus
agacggtctggtcagcagaagcatc

SEQ ID NO: 261952 - DNA, 25 bp, Mus musculus
aagcatcactcgacctccttcgggt

SEQ ID NO: 261953 - DNA, 25 bp, Mus musculus
tttgttaggtggtgcctgagcctct

SEQ ID NO: 261954 - DNA, 25 bp, Mus musculus
ctgtgccttgggcaacaccgggcga

SEQ ID NO: 261955 - DNA, 25 bp, Mus musculus
agctccatggggacctgggctgaca

SEQ ID NO: 261956 - DNA, 25 bp, Mus musculus
acctgggctgacagcgcccgaggtc

SEQ ID NO: 261957 - DNA, 25 bp, Mus musculus
tcctgggcaggttgccgtgacttgt

SEQ ID NO: 261958 - DNA, 25 bp, Mus musculus
ttgccgtgacttgtcccaacgtggc

SEQ ID NO: 261959 - DNA, 25 bp, Mus musculus
gacttgtcccaacgtggctccggca

SEQ ID NO: 261960 - DNA, 25 bp, Mus musculus
ctgccattggcgttggcgacccgca

SEQ ID NO: 261961 - DNA, 25 bp, Mus musculus
caagtctccctcacagccgcacgca

SEQ ID NO: 261962 - DNA, 25 bp, Mus musculus
tcggggaggagtcaccctgtgcctt

SEQ ID NO: 261963 - DNA, 25 bp, Mus musculus
aacaccgggcgatggggaatcaact

SEQ ID NO: 261964 - DNA, 25 bp, Mus musculus
gctcatgcccttctggggtgcgacc

SEQ ID NO: 261965 - DNA, 25 bp, Mus musculus
agtcatccgcccgtgccaggggcaa

SEQ ID NO: 261966 - DNA, 25 bp, Mus musculus
tgggtgccagccaccgagtcatccg

SEQ ID NO: 261967 - DNA, 25 bp, Mus musculus
gcaccgttctcgcagctgccattgg

SEQ ID NO: 261968 - DNA, 25 bp, Mus musculus
gcagcttcgccggaatcctgctgga

SEQ ID NO: 261969 - DNA, 25 bp, Mus musculus
cgcaatgcgttgcaagcccagcttt

SEQ ID NO: 261970 - DNA, 25 bp, Mus musculus
agcccagctttgagagccggctgtg

SEQ ID NO: 261971 - DNA, 25 bp, Mus musculus
cggccggcacacagagctttgtgac

SEQ ID NO: 261972 - DNA, 25 bp, Mus musculus
tcctgctggattgcacgaaaaagtg

SEQ ID NO: 261973 - DNA, 25 bp, Mus musculus
gggacactcctccaccgattcaagg

SEQ ID NO: 261974 - DNA, 25 bp, Mus musculus
caaggttccaatgcaggctccgaga

SEQ ID NO: 261975 - DNA, 25 bp, Mus musculus
ggcgtccgctttcagtttctgctgg

SEQ ID NO: 261976 - DNA, 25 bp, Mus musculus
tggctctctcccaaagtcgcggtga

SEQ ID NO: 261977 - DNA, 25 bp, Mus musculus
gcacgggaagccttgcctgaaactc

SEQ ID NO: 261978 - DNA, 25 bp, Mus musculus
aacgcacttttctttgttcagacgc

SEQ ID NO: 261979 - DNA, 25 bp, Mus musculus
acgcactgttgaattcgactgtttg

SEQ ID NO: 261980 - DNA, 25 bp, Mus musculus
cgtggcgtcaagattaacgaaccct

SEQ ID NO: 261981 - DNA, 25 bp, Mus musculus
ggactcctcggaatctcccgggaca

SEQ ID NO: 261982 - DNA, 25 bp, Mus musculus
gctgaagaccggttccacatcgggg

SEQ ID NO: 261983 - DNA, 25 bp, Mus musculus
ccaggctgaagaccggttccacatc

SEQ ID NO: 261984 - DNA, 25 bp, Mus musculus
ccaggacagaggttccaaggatctc

SEQ ID NO: 261985 - DNA, 25 bp, Mus musculus
gaggttccaaggatctccagggctc

SEQ ID NO: 261986 - DNA, 25 bp, Mus musculus
tccagggctcccaacaagaaggcgg

SEQ ID NO: 261987 - DNA, 25 bp, Mus musculus
tcccaacaagaaggcgggctgtagt

SEQ ID NO: 261988 - DNA, 25 bp, Mus musculus
gcgggctgtagtcgtccaaactcgc

SEQ ID NO: 261989 - DNA, 25 bp, Mus musculus
gtcgtccaaactcgcggctccttta

SEQ ID NO: 261990 - DNA, 25 bp, Mus musculus
taagaagcgctttggtaacagggtc

SEQ ID NO: 261991 - DNA, 25 bp, Mus musculus
agcgctttggtaacagggtcgtgac

SEQ ID NO: 261992 - DNA, 25 bp, Mus musculus
ttggtaacagggtcgtgacgtcatg

SEQ ID NO: 261993 - DNA, 25 bp, Mus musculus
aatatgcgcgtaaccgcggcagggc

SEQ ID NO: 261994 - DNA, 25 bp, Mus musculus
ctgtagtcgtccaaactcgcggctc

SEQ ID NO: 261995 - DNA, 25 bp, Mus musculus
cctggacccaggctgaagaccggtt

SEQ ID NO: 261996 - DNA, 25 bp, Mus musculus
ttacgggctaggagtctcccagccc

SEQ ID NO: 261997 - DNA, 25 bp, Mus musculus
gcgtcttctatagccgcggactccg

SEQ ID NO: 261998 - DNA, 25 bp, Mus musculus
cagcgtcttctatagccgcggactc

SEQ ID NO: 261999 - DNA, 25 bp, Mus musculus
ctacagcgtcttctatagccgcgga

SEQ ID NO: 262000 - DNA, 25 bp, Mus musculus
ccattttcagttggagaccctaaat

SEQ ID NO: 262001 - DNA, 25 bp, Mus musculus
gcggttacgggctaggagtctccca

SEQ ID NO: 262002 - DNA, 25 bp, Mus musculus
cgacgacgtaagtgccgcgccgtcg

SEQ ID NO: 262003 - DNA, 25 bp, Mus musculus
tcttcgacgacgtaagtgccgcgcc

SEQ ID NO: 262004 - DNA, 25 bp, Mus musculus
ggctcgctcttcgacgacgtaagtg

SEQ ID NO: 262005 - DNA, 25 bp, Mus musculus
ccaacgtgggctcgctcttcgacga

SEQ ID NO: 262006 - DNA, 25 bp, Mus musculus
tcacggccaacgtgggctcgctctt

SEQ ID NO: 262007 - DNA, 25 bp, Mus musculus
cggtcctgctggtcacggccaacgt

SEQ ID NO: 262008 - DNA, 25 bp, Mus musculus
tccgcccgggcaccatggcggggaa

SEQ ID NO: 262009 - DNA, 25 bp, Mus musculus
tcagttggagaccctaaattccggc

SEQ ID NO: 262010 - DNA, 25 bp, Mus musculus
agccagaaaccgcagggcttcctgc

SEQ ID NO: 262011 - DNA, 25 bp, Mus musculus
ctcctcctgcggaataatatttggg

SEQ ID NO: 262012 - DNA, 25 bp, Mus musculus
cggaataatatttgggctgttggcc

SEQ ID NO: 262013 - DNA, 25 bp, Mus musculus
ggagaagccagaaaccgcagggctt

SEQ ID NO: 262014 - DNA, 25 bp, Mus musculus
ccggggagactgagggcctttctct

SEQ ID NO: 262015 - DNA, 25 bp, Mus musculus
ggaggaattccccaggacagccagc

SEQ ID NO: 262016 - DNA, 25 bp, Mus musculus
ccagcctggtgggacggctgacaac

SEQ ID NO: 262017 - DNA, 25 bp, Mus musculus
gacggctgacaactgggagccagca

SEQ ID NO: 262018 - DNA, 25 bp, Mus musculus
ctgacaactgggagccagcaaggca

SEQ ID NO: 262019 - DNA, 25 bp, Mus musculus
gcaaggcgggactgcgacagaaata

SEQ ID NO: 262020 - DNA, 25 bp, Mus musculus
tgcgacagaaatagagggacccgcc

SEQ ID NO: 262021 - DNA, 25 bp, Mus musculus
gaaatagagggacccgcctgccagg

SEQ ID NO: 262022 - DNA, 25 bp, Mus musculus
caccgactcctcctgcggaataata

SEQ ID NO: 262023 - DNA, 25 bp, Mus musculus
gagactgagggcctttctctcggcc

SEQ ID NO: 262024 - DNA, 25 bp, Mus musculus
acacgggctaacgagcgccaagttc

SEQ ID NO: 262025 - DNA, 25 bp, Mus musculus
tctttttagccgacgccatctctgc

SEQ ID NO: 262026 - DNA, 25 bp, Mus musculus
ttgcgccacttggtccgccgattct

SEQ ID NO: 262027 - DNA, 25 bp, Mus musculus
cttggctctcggtcatgcccagaga

SEQ ID NO: 262028 - DNA, 25 bp, Mus musculus
cgcgctctgggcctgccaaatactt

SEQ ID NO: 262029 - DNA, 25 bp, Mus musculus
cttggtctgctcgaaagtcttctcc

SEQ ID NO: 262030 - DNA, 25 bp, Mus musculus
cgaagatctgctggccggagaaagt

SEQ ID NO: 262031 - DNA, 25 bp, Mus musculus
aagtcggccgcgagtgtttcttctt

SEQ ID NO: 262032 - DNA, 25 bp, Mus musculus
gcccgaagtagacacctgcagacga

SEQ ID NO: 262033 - DNA, 25 bp, Mus musculus
gtgcctagaggcaactgcgcgccaa

SEQ ID NO: 262034 - DNA, 25 bp, Mus musculus
gccggttgtattcgtcatcgtcctc

SEQ ID NO: 262035 - DNA, 25 bp, Mus musculus
aagccgcgtgatcttctcgtcatcg

SEQ ID NO: 262036 - DNA, 25 bp, Mus musculus
ggcatccgagtcttgcttcttttta

SEQ ID NO: 262037 - DNA, 25 bp, Mus musculus
cgccaagttcgagggtttgtgcttt

SEQ ID NO: 262038 - DNA, 25 bp, Mus musculus
cagagtgggaagtcctgaaacctcc

SEQ ID NO: 262039 - DNA, 25 bp, Mus musculus
gctccacttcgattacgaccgcgta

SEQ ID NO: 262040 - DNA, 25 bp, Mus musculus
gaccgcgtatactccgaggatctga

SEQ ID NO: 262041 - DNA, 25 bp, Mus musculus
ccctggtagagtacggacttttctg

SEQ ID NO: 262042 - DNA, 25 bp, Mus musculus
gtgccaagccgaccctgaacagcta

SEQ ID NO: 262043 - DNA, 25 bp, Mus musculus
tgaacagctaggaagagcgcccgtc

SEQ ID NO: 262044 - DNA, 25 bp, Mus musculus
cccgtcctcggaatcagcgttcgga

SEQ ID NO: 262045 - DNA, 25 bp, Mus musculus
ctgtgctcgaactctggctgttgtc

SEQ ID NO: 262046 - DNA, 25 bp, Mus musculus
ctgggcaatcgaaagatcttccgtc

SEQ ID NO: 262047 - DNA, 25 bp, Mus musculus
tgcgggctcactccaactgcgaaac

SEQ ID NO: 262048 - DNA, 25 bp, Mus musculus
tcattgccatgctctccctgggatc

SEQ ID NO: 262049 - DNA, 25 bp, Mus musculus
ttgcgctttcttcgggcgttctgtc

SEQ ID NO: 262050 - DNA, 25 bp, Mus musculus
ctgagcatcgggagtacagtccctg

SEQ ID NO: 262051 - DNA, 25 bp, Mus musculus
agcggccctgcatctgtgtacacct

SEQ ID NO: 262052 - DNA, 25 bp, Mus musculus
atgtgtgactgttccaggcacctgc

SEQ ID NO: 262053 - DNA, 25 bp, Mus musculus
ggtgcgtcactgtactggcggcaca

SEQ ID NO: 262054 - DNA, 25 bp, Mus musculus
cggtccttgattccgtctaacgtca

SEQ ID NO: 262055 - DNA, 25 bp, Mus musculus
gtccttgattccgtctaacgtcagt

SEQ ID NO: 262056 - DNA, 25 bp, Mus musculus
ccttgattccgtctaacgtcagtgg

SEQ ID NO: 262057 - DNA, 25 bp, Mus musculus
ttgattccgtctaacgtcagtgggg

SEQ ID NO: 262058 - DNA, 25 bp, Mus musculus
tctaacgtcagtgggggtgcgtcac

SEQ ID NO: 262059 - DNA, 25 bp, Mus musculus
tgtgactgttccaggcacctgcgcg

SEQ ID NO: 262060 - DNA, 25 bp, Mus musculus
tgcgtcactgtactggcggcacaaa

SEQ ID NO: 262061 - DNA, 25 bp, Mus musculus
cgtcactgtactggcggcacaaatg

SEQ ID NO: 262062 - DNA, 25 bp, Mus musculus
ctgtactggcggcacaaatgtgtga

SEQ ID NO: 262063 - DNA, 25 bp, Mus musculus
gtactggcggcacaaatgtgtgact

SEQ ID NO: 262064 - DNA, 25 bp, Mus musculus
caaatgtgtgactgttccaggcacc

SEQ ID NO: 262065 - DNA, 25 bp, Mus musculus
actgttccaggcacctgcgcgagcg

SEQ ID NO: 262066 - DNA, 25 bp, Mus musculus
aaatcgactctgcagtgtgacgggc

SEQ ID NO: 262067 - DNA, 25 bp, Mus musculus
tgctgcagaaatccggcgcgcaggc

SEQ ID NO: 262068 - DNA, 25 bp, Mus musculus
tgttgctgcagaaatccggcgcgca

SEQ ID NO: 262069 - DNA, 25 bp, Mus musculus
cttcattcccctggctgttgctgca

SEQ ID NO: 262070 - DNA, 25 bp, Mus musculus
cagctcctgcttcccggccggtcct

SEQ ID NO: 262071 - DNA, 25 bp, Mus musculus
atggttacagctcctgcttcccggc

SEQ ID NO: 262072 - DNA, 25 bp, Mus musculus
ctctgccgcagggagccagggcacg

SEQ ID NO: 262073 - DNA, 25 bp, Mus musculus
gaaccattcccgctctgccgcaggg

SEQ ID NO: 262074 - DNA, 25 bp, Mus musculus
tgggaagaaccattcccgctctgcc

SEQ ID NO: 262075 - DNA, 25 bp, Mus musculus
cgactctgcagtgtgacgggcagcc

SEQ ID NO: 262076 - DNA, 25 bp, Mus musculus
ctttaaatcgactctgcagtgtgac

SEQ ID NO: 262077 - DNA, 25 bp, Mus musculus
gtctctttaaatcgactctgcagtg

SEQ ID NO: 262078 - DNA, 25 bp, Mus musculus
cggttgtctctttaaatcgactctg

SEQ ID NO: 262079 - DNA, 25 bp, Mus musculus
cgggctgggaagaaccattcccgct

SEQ ID NO: 262080 - DNA, 25 bp, Mus musculus
ttgaagacatctgcggagcccaaac

SEQ ID NO: 262081 - DNA, 25 bp, Mus musculus
cgacactgcggcaggcagcgggcgc

SEQ ID NO: 262082 - DNA, 25 bp, Mus musculus
cgaactgtcacagacagcgcaggca

SEQ ID NO: 262083 - DNA, 25 bp, Mus musculus
cccggaggctgacgtagttgaagac

SEQ ID NO: 262084 - DNA, 25 bp, Mus musculus
ggctgacgtagttgaagacatctgc

SEQ ID NO: 262085 - DNA, 25 bp, Mus musculus
acgtagttgaagacatctgcggagc

SEQ ID NO: 262086 - DNA, 25 bp, Mus musculus
tagttgaagacatctgcggagccca

SEQ ID NO: 262087 - DNA, 25 bp, Mus musculus
gacatctgcggagcccaaactcggc

SEQ ID NO: 262088 - DNA, 25 bp, Mus musculus
ccggcccgccagtgaccacggccct

SEQ ID NO: 262089 - DNA, 25 bp, Mus musculus
gcgccaccgtttggcgacactgcgg

SEQ ID NO: 262090 - DNA, 25 bp, Mus musculus
cgtagctggcggtgcccagctcagc

SEQ ID NO: 262091 - DNA, 25 bp, Mus musculus
ctcagaggcggcagccagcttggac

SEQ ID NO: 262092 - DNA, 25 bp, Mus musculus
agccagcttggaccgggatctgccc

SEQ ID NO: 262093 - DNA, 25 bp, Mus musculus
agtgaccacggccctcagggagcca

SEQ ID NO: 262094 - DNA, 25 bp, Mus musculus
gagccgggccataccttcgaatcct

SEQ ID NO: 262095 - DNA, 25 bp, Mus musculus
gatccgccaactcatggggctattg

SEQ ID NO: 262096 - DNA, 25 bp, Mus musculus
gtccggacccttcgataaccagatc

SEQ ID NO: 262097 - DNA, 25 bp, Mus musculus
acgttccgcgcgtttctctcgtaga

SEQ ID NO: 262098 - DNA, 25 bp, Mus musculus
ttggagtgcacgcacctctacctgg

SEQ ID NO: 262099 - DNA, 25 bp, Mus musculus
gtgactacgtctgatgccttcgcta

SEQ ID NO: 262100 - DNA, 25 bp, Mus musculus
agtgcccgagagacggagctacttc

SEQ ID NO: 262101 - DNA, 25 bp, Mus musculus
atgtggcgctcactactgctggacc

SEQ ID NO: 262102 - DNA, 25 bp, Mus musculus
gccgtcgctacaagttcctcaagga

SEQ ID NO: 262103 - DNA, 25 bp, Mus musculus
cgctggctgcggaaaatgacgaacc

SEQ ID NO: 262104 - DNA, 25 bp, Mus musculus
acgacgaagtctgcaggtgcccacc

SEQ ID NO: 262105 - DNA, 25 bp, Mus musculus
agtcgttgaataccgcgttgctgca

SEQ ID NO: 262106 - DNA, 25 bp, Mus musculus
cagaccttgacgcacttgggcgaca

SEQ ID NO: 262107 - DNA, 25 bp, Mus musculus
gcgctcagattcagttcttccacga

SEQ ID NO: 262108 - DNA, 25 bp, Mus musculus
ccgcggctgctgtcacacaaagagc

SEQ ID NO: 262109 - DNA, 25 bp, Mus musculus
cccttacctggctcggtggcaggtc

SEQ ID NO: 262110 - DNA, 25 bp, Mus musculus
gttgtctccgagagtcccttacctg

SEQ ID NO: 262111 - DNA, 25 bp, Mus musculus
cggttcctgcatcagccctgttgtc

SEQ ID NO: 262112 - DNA, 25 bp, Mus musculus
cgcctaggcagcatttcggttcctg

SEQ ID NO: 262113 - DNA, 25 bp, Mus musculus
aggaacgcatccaccgcctaggcag

SEQ ID NO: 262114 - DNA, 25 bp, Mus musculus
aagccgtgtagcctcgggcgccaag

SEQ ID NO: 262115 - DNA, 25 bp, Mus musculus
gcctccagggacctgaagccgtgta

SEQ ID NO: 262116 - DNA, 25 bp, Mus musculus
tctggaaaacgctccctgcccaggg

SEQ ID NO: 262117 - DNA, 25 bp, Mus musculus
ctgcgctgtacccacgacttctgga

SEQ ID NO: 262118 - DNA, 25 bp, Mus musculus
actgcccggcgatctgcagtatgta

SEQ ID NO: 262119 - DNA, 25 bp, Mus musculus
gctctctctggccttggctgaatga

SEQ ID NO: 262120 - DNA, 25 bp, Mus musculus
ctgcctctttttagggcgggtggct

SEQ ID NO: 262121 - DNA, 25 bp, Mus musculus
ccgagactatccctgcctcttttta

SEQ ID NO: 262122 - DNA, 25 bp, Mus musculus
tcgagactacttcggggtgcggaaa

SEQ ID NO: 262123 - DNA, 25 bp, Mus musculus
ggggtaaggagcattcgagactact

SEQ ID NO: 262124 - DNA, 25 bp, Mus musculus
aggcggcgcttacggggattcacaa

SEQ ID NO: 262125 - DNA, 25 bp, Mus musculus
gcgcttacggggattcacaagtttc

SEQ ID NO: 262126 - DNA, 25 bp, Mus musculus
acggggattcacaagtttctgtgca

SEQ ID NO: 262127 - DNA, 25 bp, Mus musculus
acaagtttctgtgcagggcgtattc

SEQ ID NO: 262128 - DNA, 25 bp, Mus musculus
tctgtgcagggcgtattctctagaa

SEQ ID NO: 262129 - DNA, 25 bp, Mus musculus
gcgtattctctagaagggctttgga

SEQ ID NO: 262130 - DNA, 25 bp, Mus musculus
ctctagaagggctttggaattaaga

SEQ ID NO: 262131 - DNA, 25 bp, Mus musculus
agacgactgcgcttaagcccggaga

SEQ ID NO: 262132 - DNA, 25 bp, Mus musculus
tggaattaagaagacgaaagcgcgc

SEQ ID NO: 262133 - DNA, 25 bp, Mus musculus
gaggaaccagagacgactgcgctta

SEQ ID NO: 262134 - DNA, 25 bp, Mus musculus
cgcttaagcccggagatcagtcttg

SEQ ID NO: 262135 - DNA, 25 bp, Mus musculus
taagcccggagatcagtcttggggc

SEQ ID NO: 262136 - DNA, 25 bp, Mus musculus
gagctcggcttggaagcactgagca

SEQ ID NO: 262137 - DNA, 25 bp, Mus musculus
cccatagcgcctcgccctcactcgc

SEQ ID NO: 262138 - DNA, 25 bp, Mus musculus
gccctcactcgcaccaccatcactg

SEQ ID NO: 262139 - DNA, 25 bp, Mus musculus
ccatcactgaagtcccgagccaagt

SEQ ID NO: 262140 - DNA, 25 bp, Mus musculus
ctgaagtcccgagccaagtggcgct

SEQ ID NO: 262141 - DNA, 25 bp, Mus musculus
aagtcccgagccaagtggcgcttgg

SEQ ID NO: 262142 - DNA, 25 bp, Mus musculus
gccaggcgcagaggttatgaatatc

SEQ ID NO: 262143 - DNA, 25 bp, Mus musculus
caggcgcagaggttatgaatatccc

SEQ ID NO: 262144 - DNA, 25 bp, Mus musculus
cccaggcgttggcaggaacgaagct

SEQ ID NO: 262145 - DNA, 25 bp, Mus musculus
cgaagctgagctcggcttggaagca

SEQ ID NO: 262146 - DNA, 25 bp, Mus musculus
catggcagagaagtgggtgtgcagc

SEQ ID NO: 262147 - DNA, 25 bp, Mus musculus
gtgtgcagcagagaaacacagcgga

SEQ ID NO: 262148 - DNA, 25 bp, Mus musculus
cacagcggaagaaacctggcgggtt

SEQ ID NO: 262149 - DNA, 25 bp, Mus musculus
cgttggcaggaacgaagctgagctc

SEQ ID NO: 262150 - DNA, 25 bp, Mus musculus
cacagctcttgacgcgtgtcttctg

SEQ ID NO: 262151 - DNA, 25 bp, Mus musculus
ggcttgctagcgctatcctgattcc

SEQ ID NO: 262152 - DNA, 25 bp, Mus musculus
tcgaggccttactcggcttgctagc

SEQ ID NO: 262153 - DNA, 25 bp, Mus musculus
tgagcaccttggcttcgaggcctta

SEQ ID NO: 262154 - DNA, 25 bp, Mus musculus
ccggaaaaatccatgtgagcacctt

SEQ ID NO: 262155 - DNA, 25 bp, Mus musculus
cgcaagtgtccgagacgccggaaaa

SEQ ID NO: 262156 - DNA, 25 bp, Mus musculus
cagcggcacctgtacttgcaggaca

SEQ ID NO: 262157 - DNA, 25 bp, Mus musculus
aggggcctagaagcaagactgtcgc

SEQ ID NO: 262158 - DNA, 25 bp, Mus musculus
acaacccgggcggaagatgtcctga

SEQ ID NO: 262159 - DNA, 25 bp, Mus musculus
aattcttcgaggtgcgtgacaaccc

SEQ ID NO: 262160 - DNA, 25 bp, Mus musculus
ttcccgcgggatcacgaattcttcg

SEQ ID NO: 262161 - DNA, 25 bp, Mus musculus
tcgccacaggaagttagtagacgtc

SEQ ID NO: 262162 - DNA, 25 bp, Mus musculus
gaggcccaagagaatcaggctcttc

SEQ ID NO: 262163 - DNA, 25 bp, Mus musculus
tgcaggacatgctcacgcaagtgtc

SEQ ID NO: 262164 - DNA, 25 bp, Mus musculus
ggcgagcgctcaaactctggctgca

SEQ ID NO: 262165 - DNA, 25 bp, Mus musculus
ggaggcgccctagacttaggtctgc

SEQ ID NO: 262166 - DNA, 25 bp, Mus musculus
ttaggtctgctctcccaacccgtga

SEQ ID NO: 262167 - DNA, 25 bp, Mus musculus
ggcctggaggctgtccaataaccga

SEQ ID NO: 262168 - DNA, 25 bp, Mus musculus
cgagtagcggtcaggtctccaaaca

SEQ ID NO: 262169 - DNA, 25 bp, Mus musculus
gttgcggacctcgaccaagaagaga

SEQ ID NO: 262170 - DNA, 25 bp, Mus musculus
ctgtgcacaatgttgggcgcccacc

SEQ ID NO: 262171 - DNA, 25 bp, Mus musculus
ccaccgccagttatcattgctcttg

SEQ ID NO: 262172 - DNA, 25 bp, Mus musculus
cattgctcttggactgagccggtta

SEQ ID NO: 262173 - DNA, 25 bp, Mus musculus
tactagccactagttcggagcaaca

SEQ ID NO: 262174 - DNA, 25 bp, Mus musculus
caccttggactttcgagccttgaca

SEQ ID NO: 262175 - DNA, 25 bp, Mus musculus
gcggtcgcttttcagggcctgagac

SEQ ID NO: 262176 - DNA, 25 bp, Mus musculus
agaccgggagactgagcacttacgt

SEQ ID NO: 262177 - DNA, 25 bp, Mus musculus
tcatgtcgaatgtcgcccgggccat

SEQ ID NO: 262178 - DNA, 25 bp, Mus musculus
ggaccgctgggaactccatttccca

SEQ ID NO: 262179 - DNA, 25 bp, Mus musculus
ctagggagagggactccggaccgct

SEQ ID NO: 262180 - DNA, 25 bp, Mus musculus
cagaagccttcgttcccatttccgt

SEQ ID NO: 262181 - DNA, 25 bp, Mus musculus
gttcccatttccgtccggcgcctgc

SEQ ID NO: 262182 - DNA, 25 bp, Mus musculus
tcccatttccgtccggcgcctgcgc

SEQ ID NO: 262183 - DNA, 25 bp, Mus musculus
gcctgcgcagcgcggactacatttc

SEQ ID NO: 262184 - DNA, 25 bp, Mus musculus
ccagaaggcatggcgctcgaaggcc

SEQ ID NO: 262185 - DNA, 25 bp, Mus musculus
atggcgctcgaaggccggaaatggc

SEQ ID NO: 262186 - DNA, 25 bp, Mus musculus
aaggccggaaatggcggccgctccg

SEQ ID NO: 262187 - DNA, 25 bp, Mus musculus
ctgccgacgcggcacgccttagggg

SEQ ID NO: 262188 - DNA, 25 bp, Mus musculus
atttcccggcggccctactagtgca

SEQ ID NO: 262189 - DNA, 25 bp, Mus musculus
ggcggccctactagtgcagcgcctg

SEQ ID NO: 262190 - DNA, 25 bp, Mus musculus
gcctgcgccgtgtcacggcggcggg

SEQ ID NO: 262191 - DNA, 25 bp, Mus musculus
agccgtctagggagagggactccgg

SEQ ID NO: 262192 - DNA, 25 bp, Mus musculus
gggcactgttcaaagggcctggata

SEQ ID NO: 262193 - DNA, 25 bp, Mus musculus
ttccgggttcggcaggattctccca

SEQ ID NO: 262194 - DNA, 25 bp, Mus musculus
tttttgtcgggatgagctgaccgcc

SEQ ID NO: 262195 - DNA, 25 bp, Mus musculus
cagcggcgtccagatgttgtgagcc

SEQ ID NO: 262196 - DNA, 25 bp, Mus musculus
gagcctcgggcccttttaatcactg

SEQ ID NO: 262197 - DNA, 25 bp, Mus musculus
ccacctcgctggcatctgtaacgga

SEQ ID NO: 262198 - DNA, 25 bp, Mus musculus
aaacaggcggtacactgcgcggaca

SEQ ID NO: 262199 - DNA, 25 bp, Mus musculus
tgcgcggacaaagcacggcagtctc

SEQ ID NO: 262200 - DNA, 25 bp, Mus musculus
gccaggcgctttgtgcgccgcttaa

SEQ ID NO: 262201 - DNA, 25 bp, Mus musculus
gcgccgcttaatgagctggaaaata

SEQ ID NO: 262202 - DNA, 25 bp, Mus musculus
aatacaattggcttccctggctgtg

SEQ ID NO: 262203 - DNA, 25 bp, Mus musculus
tgaaaatcgtttcaaggaccgcggc

SEQ ID NO: 262204 - DNA, 25 bp, Mus musculus
ccttttaatcactgcccggcggctg

SEQ ID NO: 262205 - DNA, 25 bp, Mus musculus
gcatctgtaacggagtttttgtcgg

SEQ ID NO: 262206 - DNA, 25 bp, Mus musculus
ctggcacaatggcagcgccactcaa

SEQ ID NO: 262207 - DNA, 25 bp, Mus musculus
tggcagcgccactcaatggctaccg

SEQ ID NO: 262208 - DNA, 25 bp, Mus musculus
cctcacgcgcgtgcttgagggccga

SEQ ID NO: 262209 - DNA, 25 bp, Mus musculus
ccgagttgcagatcgagaggaacgc

SEQ ID NO: 262210 - DNA, 25 bp, Mus musculus
cagatcgagaggaacgcgccagccg

SEQ ID NO: 262211 - DNA, 25 bp, Mus musculus
tcaaaggagctttcaggcgtcacca

SEQ ID NO: 262212 - DNA, 25 bp, Mus musculus
tgagctgccggtcaaaggagctttc

SEQ ID NO: 262213 - DNA, 25 bp, Mus musculus
gaggctctatagagcgggctctgca

SEQ ID NO: 262214 - DNA, 25 bp, Mus musculus
caggcgtcaccagggagcggacttc

SEQ ID NO: 262215 - DNA, 25 bp, Mus musculus
tgctgcgcgttcagaggctctatag

SEQ ID NO: 262216 - DNA, 25 bp, Mus musculus
cctggcagctgctgcgcgttcagag

SEQ ID NO: 262217 - DNA, 25 bp, Mus musculus
agcgtgtcaccactcgcggcgctgg

SEQ ID NO: 262218 - DNA, 25 bp, Mus musculus
ctctgcaggtgagctgccggtcaaa

SEQ ID NO: 262219 - DNA, 25 bp, Mus musculus
agcggacttcgagcgtgtcaccact

SEQ ID NO: 262220 - DNA, 25 bp, Mus musculus
agtacatctccagggtcagtggggt

SEQ ID NO: 262221 - DNA, 25 bp, Mus musculus
cagatcttgtgctgcagcggatgca

SEQ ID NO: 262222 - DNA, 25 bp, Mus musculus
cggggtccatctcggtgtagtacat

SEQ ID NO: 262223 - DNA, 25 bp, Mus musculus
atctcagtgccgtgtttgcggctca

SEQ ID NO: 262224 - DNA, 25 bp, Mus musculus
cagacagcgggcatctcagtgccgt

SEQ ID NO: 262225 - DNA, 25 bp, Mus musculus
atgctcctccttggcggtccggtag

SEQ ID NO: 262226 - DNA, 25 bp, Mus musculus
atcgccgcaggggtagtgcccttat

SEQ ID NO: 262227 - DNA, 25 bp, Mus musculus
tgcagctgcagtggacacagccatc

SEQ ID NO: 262228 - DNA, 25 bp, Mus musculus
aaagacttccctgacggctcggtgc

SEQ ID NO: 262229 - DNA, 25 bp, Mus musculus
tctctcgtgtccaaagacttccctg

SEQ ID NO: 262230 - DNA, 25 bp, Mus musculus
gggtcttctttctctctcgtgtcca

SEQ ID NO: 262231 - DNA, 25 bp, Mus musculus
cgccttctgcgggtcttctttctct

SEQ ID NO: 262232 - DNA, 25 bp, Mus musculus
gtagtgcccttatgctcctccttgg

SEQ ID NO: 262233 - DNA, 25 bp, Mus musculus
atgcatattccggaccagcgtgggg

SEQ ID NO: 262234 - DNA, 25 bp, Mus musculus
cagcggactgaggacaacagtgagc

SEQ ID NO: 262235 - DNA, 25 bp, Mus musculus
atcccaggcgggatgaagacggaag

SEQ ID NO: 262236 - DNA, 25 bp, Mus musculus
atgtgttccgcccacagaatcgccc

SEQ ID NO: 262237 - DNA, 25 bp, Mus musculus
agacgatgtgttccgcccacagaat

SEQ ID NO: 262238 - DNA, 25 bp, Mus musculus
agagacgatgtgttccgcccacaga

SEQ ID NO: 262239 - DNA, 25 bp, Mus musculus
ggagagacgatgtgttccgcccaca

SEQ ID NO: 262240 - DNA, 25 bp, Mus musculus
ccatggcggagagacgatgtgttcc

SEQ ID NO: 262241 - DNA, 25 bp, Mus musculus
cagcagagcacgcagggccgccatg

SEQ ID NO: 262242 - DNA, 25 bp, Mus musculus
caggctctgggcagcagagcacgca

SEQ ID NO: 262243 - DNA, 25 bp, Mus musculus
aacagtgagctacaggctctgggca

SEQ ID NO: 262244 - DNA, 25 bp, Mus musculus
tgaagacggaagcttaaggggtgga

SEQ ID NO: 262245 - DNA, 25 bp, Mus musculus
ggactgaggacaacagtgagctaca

SEQ ID NO: 262246 - DNA, 25 bp, Mus musculus
tgagctacaggctctgggcagcaga

SEQ ID NO: 262247 - DNA, 25 bp, Mus musculus
aagcgccgtagttctgggcagcgga

SEQ ID NO: 262248 - DNA, 25 bp, Mus musculus
tgcgcagtcgcgcacggaacccagg

SEQ ID NO: 262249 - DNA, 25 bp, Mus musculus
cgccggaaccctgtgagcagatcca

SEQ ID NO: 262250 - DNA, 25 bp, Mus musculus
cctgtgagcagatccaggccctggc

SEQ ID NO: 262251 - DNA, 25 bp, Mus musculus
ggtccgactgcgaactcttccgaca

SEQ ID NO: 262252 - DNA, 25 bp, Mus musculus
ctgcgaactcttccgacaccagtga

SEQ ID NO: 262253 - DNA, 25 bp, Mus musculus
tcttccgacaccagtgacatgaggc

SEQ ID NO: 262254 - DNA, 25 bp, Mus musculus
tccgacaccagtgacatgaggctgt

SEQ ID NO: 262255 - DNA, 25 bp, Mus musculus
gcgcttggcgcgagtgcttccctct

SEQ ID NO: 262256 - DNA, 25 bp, Mus musculus
gcgagtgcttccctctgcaaggtca

SEQ ID NO: 262257 - DNA, 25 bp, Mus musculus
tccctctgcaaggtcacgatgtagc

SEQ ID NO: 262258 - DNA, 25 bp, Mus musculus
gtcacgatgtagcacgctggttccc

SEQ ID NO: 262259 - DNA, 25 bp, Mus musculus
ccacatggccaagggtgaggccagc

SEQ ID NO: 262260 - DNA, 25 bp, Mus musculus
tccttggttcgccttcctggcatcg

SEQ ID NO: 262261 - DNA, 25 bp, Mus musculus
caggcgcgccggaaccctgtgagca

SEQ ID NO: 262262 - DNA, 25 bp, Mus musculus
gctctaacgcgggatgcccaagtta

SEQ ID NO: 262263 - DNA, 25 bp, Mus musculus
ccgctgcgctgaggaaaagtcacta

SEQ ID NO: 262264 - DNA, 25 bp, Mus musculus
ggcgaccgcagcctaagtctgtctc

SEQ ID NO: 262265 - DNA, 25 bp, Mus musculus
gagtaccgctctctccggacgacaa

SEQ ID NO: 262266 - DNA, 25 bp, Mus musculus
ccacgccacgggcttttataatgtc

SEQ ID NO: 262267 - DNA, 25 bp, Mus musculus
cgcgtcagaggcttcttcctgagaa

SEQ ID NO: 262268 - DNA, 25 bp, Mus musculus
atcctgtaccagactttccgcgggg

SEQ ID NO: 262269 - DNA, 25 bp, Mus musculus
agcacccacgagacactggatcttg

SEQ ID NO: 262270 - DNA, 25 bp, Mus musculus
tttctgtaaggtggcccgctctaac

SEQ ID NO: 262271 - DNA, 25 bp, Mus musculus
gcacttgcgcccgaaaaaactaatg

SEQ ID NO: 262272 - DNA, 25 bp, Mus musculus
tcctgagaaggcaaccggaacttgt

SEQ ID NO: 262273 - DNA, 25 bp, Mus musculus
ataatgtcgtggtcttagcctgccc

SEQ ID NO: 262274 - DNA, 25 bp, Mus musculus
agtcacgacctccagcggctttgaa

SEQ ID NO: 262275 - DNA, 25 bp, Mus musculus
ctgccctgtcgccattggtaaagtg

SEQ ID NO: 262276 - DNA, 25 bp, Mus musculus
cgcagcagcttccaggctgttagac

SEQ ID NO: 262277 - DNA, 25 bp, Mus musculus
cgccagctcaccatgccaacccagg

SEQ ID NO: 262278 - DNA, 25 bp, Mus musculus
gatctcctcagacctcgacaggcag

SEQ ID NO: 262279 - DNA, 25 bp, Mus musculus
gcgtgatctcctcagacctcgacag

SEQ ID NO: 262280 - DNA, 25 bp, Mus musculus
aggcacccttcagccactacctctg

SEQ ID NO: 262281 - DNA, 25 bp, Mus musculus
aacacgagaggaccgcgtggctagc

SEQ ID NO: 262282 - DNA, 25 bp, Mus musculus
ggctgttagacactgcacctgcgca

SEQ ID NO: 262283 - DNA, 25 bp, Mus musculus
ccacttcctcagctgccgcagcagc

SEQ ID NO: 262284 - DNA, 25 bp, Mus musculus
tggtggccatactgctccacttcct

SEQ ID NO: 262285 - DNA, 25 bp, Mus musculus
cggtctggtggccatactgctccac

SEQ ID NO: 262286 - DNA, 25 bp, Mus musculus
catacccaacggctgcggtctggtg

SEQ ID NO: 262287 - DNA, 25 bp, Mus musculus
gggctccatacccaacggctgcggt

SEQ ID NO: 262288 - DNA, 25 bp, Mus musculus
gtctgctgagccctcgggctccata

SEQ ID NO: 262289 - DNA, 25 bp, Mus musculus
tgcacctgcgcagtacgctgcgcgg

SEQ ID NO: 262290 - DNA, 25 bp, Mus musculus
acctggagtgcttctcgggaatgta

SEQ ID NO: 262291 - DNA, 25 bp, Mus musculus
taaatcagtcggatgcctctggcgc

SEQ ID NO: 262292 - DNA, 25 bp, Mus musculus
taggaaccagctcagtaaatcagtc

SEQ ID NO: 262293 - DNA, 25 bp, Mus musculus
ctcggagcaggtgttcagacccaaa

SEQ ID NO: 262294 - DNA, 25 bp, Mus musculus
cccacggattggtcagcaatattag

SEQ ID NO: 262295 - DNA, 25 bp, Mus musculus
caccagcattcggacccacggattg

SEQ ID NO: 262296 - DNA, 25 bp, Mus musculus
cacagcaacggacgtggcaccagta

SEQ ID NO: 262297 - DNA, 25 bp, Mus musculus
ccactcagggaattcgcagcacagc

SEQ ID NO: 262298 - DNA, 25 bp, Mus musculus
gtgctctcacctcgagtccaatctg

SEQ ID NO: 262299 - DNA, 25 bp, Mus musculus
cgatgtctccagctccagacttaga

SEQ ID NO: 262300 - DNA, 25 bp, Mus musculus
cgccaggcgaaatccggccctgttt

SEQ ID NO: 262301 - DNA, 25 bp, Mus musculus
tttccagggatacgtaagcgccacc

SEQ ID NO: 262302 - DNA, 25 bp, Mus musculus
cctctggcgctgctaaatccaactg

SEQ ID NO: 262303 - DNA, 25 bp, Mus musculus
cttccaccgagaaacgagcgatgtc

SEQ ID NO: 262304 - DNA, 25 bp, Mus musculus
ccttggagaccggagaggaagatgc

SEQ ID NO: 262305 - DNA, 25 bp, Mus musculus
caccttaagtcggaggcgcctgtac

SEQ ID NO: 262306 - DNA, 25 bp, Mus musculus
aggcgcctgtacacacccttgggtt

SEQ ID NO: 262307 - DNA, 25 bp, Mus musculus
acacacccttgggttcggctgctct

SEQ ID NO: 262308 - DNA, 25 bp, Mus musculus
tgggttcggctgctctcccagcatc

SEQ ID NO: 262309 - DNA, 25 bp, Mus musculus
tcccagcatccctcacgcgtggacg

SEQ ID NO: 262310 - DNA, 25 bp, Mus musculus
cggtgacagaagctctgcggtcgtt

SEQ ID NO: 262311 - DNA, 25 bp, Mus musculus
aagctctgcggtcgttcaaccggga

SEQ ID NO: 262312 - DNA, 25 bp, Mus musculus
ttcaaccgggaggtgagaggcatcc

SEQ ID NO: 262313 - DNA, 25 bp, Mus musculus
agaggcatccggctgccgaggaaat

SEQ ID NO: 262314 - DNA, 25 bp, Mus musculus
tccggctgccgaggaaatttcagga

SEQ ID NO: 262315 - DNA, 25 bp, Mus musculus
ccgaggaaatttcaggaagagagga

SEQ ID NO: 262316 - DNA, 25 bp, Mus musculus
agcccaagccttccagcacccggtg

SEQ ID NO: 262317 - DNA, 25 bp, Mus musculus
gggtttggccgattgcgtcttccca

SEQ ID NO: 262318 - DNA, 25 bp, Mus musculus
tgccgggtccttactcccacaattg

SEQ ID NO: 262319 - DNA, 25 bp, Mus musculus
tgcctcaagggcagggccagaaacc

SEQ ID NO: 262320 - DNA, 25 bp, Mus musculus
cgccatccggtttcagaggacccaa

SEQ ID NO: 262321 - DNA, 25 bp, Mus musculus
tgagcgatttgcatcacacctagtc

SEQ ID NO: 262322 - DNA, 25 bp, Mus musculus
gcgggtgataactaatgctctctga

SEQ ID NO: 262323 - DNA, 25 bp, Mus musculus
gacctccttgagtaggcgggtgata

SEQ ID NO: 262324 - DNA, 25 bp, Mus musculus
ccctctgtgggactctgacttattg

SEQ ID NO: 262325 - DNA, 25 bp, Mus musculus
ttatgcctggtgctggcagcttctc

SEQ ID NO: 262326 - DNA, 25 bp, Mus musculus
cccgcacgataacccgaagtgtgga

SEQ ID NO: 262327 - DNA, 25 bp, Mus musculus
ctagagggtcaagcgccatccgaat

SEQ ID NO: 262328 - DNA, 25 bp, Mus musculus
cttagcgccatgatgctctgcagga

SEQ ID NO: 262329 - DNA, 25 bp, Mus musculus
ggccaatgccagtcgaccgcttagc

SEQ ID NO: 262330 - DNA, 25 bp, Mus musculus
aggcttgaggctacgtgaccagtca

SEQ ID NO: 262331 - DNA, 25 bp, Mus musculus
gatagcctatctgcgagatcccgtg

SEQ ID NO: 262332 - DNA, 25 bp, Mus musculus
ttacgccttccagcgttcaagaaga

SEQ ID NO: 262333 - DNA, 25 bp, Mus musculus
cgcgagcacgtgctacgacagcatg

SEQ ID NO: 262334 - DNA, 25 bp, Mus musculus
gctcgctctgtgaagatcaacaagc

SEQ ID NO: 262335 - DNA, 25 bp, Mus musculus
cgctcggacacgcacacttttaatc

SEQ ID NO: 262336 - DNA, 25 bp, Mus musculus
tccggggaaatgatgaagagagctc

SEQ ID NO: 262337 - DNA, 25 bp, Mus musculus
cccggcaggcatcggcaaaaccatg

SEQ ID NO: 262338 - DNA, 25 bp, Mus musculus
atggccgccaagaaaatcctctatg

SEQ ID NO: 262339 - DNA, 25 bp, Mus musculus
atcctctatgactgggcagcaggta

SEQ ID NO: 262340 - DNA, 25 bp, Mus musculus
aggtaagctataccacagccaggtg

SEQ ID NO: 262341 - DNA, 25 bp, Mus musculus
cagccaggtggactttgccttcttc

SEQ ID NO: 262342 - DNA, 25 bp, Mus musculus
ttgccttcttcatgccgtgcggcga

SEQ ID NO: 262343 - DNA, 25 bp, Mus musculus
tggcgcaacccaatcgcctactgtt

SEQ ID NO: 262344 - DNA, 25 bp, Mus musculus
cgcctactgttcatcctggacggtg

SEQ ID NO: 262345 - DNA, 25 bp, Mus musculus
ttcaagaagaagtaccgcgagcacg

SEQ ID NO: 262346 - DNA, 25 bp, Mus musculus
gcttcctggacacgccggtcatcag

SEQ ID NO: 262347 - DNA, 25 bp, Mus musculus
tatctccgcgcgcagattgcgcgca

SEQ ID NO: 262348 - DNA, 25 bp, Mus musculus
gcgcgcaagatcaaaaagttcttca

SEQ ID NO: 262349 - DNA, 25 bp, Mus musculus
gcttctaccagttcggcgaggagga

SEQ ID NO: 262350 - DNA, 25 bp, Mus musculus
tgcaacgagccaggccgcccgtgga

SEQ ID NO: 262351 - DNA, 25 bp, Mus musculus
cgccgccacacacatcagcccgctg

SEQ ID NO: 262352 - DNA, 25 bp, Mus musculus
gaggccaactatctccgcgcgcaga

SEQ ID NO: 262353 - DNA, 25 bp, Mus musculus
ttcccgggcaacgaggccaactatc

SEQ ID NO: 262354 - DNA, 25 bp, Mus musculus
tggacacgccggtcatcagctatcc

SEQ ID NO: 262355 - DNA, 25 bp, Mus musculus
aagttcttcactggcttcctggaca

SEQ ID NO: 262356 - DNA, 25 bp, Mus musculus
cgggacgcgattcctttgaggagaa

SEQ ID NO: 262357 - DNA, 25 bp, Mus musculus
gtgcgcgcgcaagatcaaaaagttc

SEQ ID NO: 262358 - DNA, 25 bp, Mus musculus
tgacgcccgcgcagatcgtgtgcgc

SEQ ID NO: 262359 - DNA, 25 bp, Mus musculus
agcccgctgggcttctaccagttcg

SEQ ID NO: 262360 - DNA, 25 bp, Mus musculus
cgaacaccaggtgaatgcgcgcgtc

SEQ ID NO: 262361 - DNA, 25 bp, Mus musculus
gctcctcccagctcagctatattgg

SEQ ID NO: 262362 - DNA, 25 bp, Mus musculus
tggatcattggcacaccctaacgcg

SEQ ID NO: 262363 - DNA, 25 bp, Mus musculus
ctccgagcatcacggattggttgta

SEQ ID NO: 262364 - DNA, 25 bp, Mus musculus
catcggtcccgtttcacgctgggta

SEQ ID NO: 262365 - DNA, 25 bp, Mus musculus
tagcaccgcagcgtggatgctgctc

SEQ ID NO: 262366 - DNA, 25 bp, Mus musculus
gagtagtggccgaatcccgtagtcc

SEQ ID NO: 262367 - DNA, 25 bp, Mus musculus
cggacaaaggaccatgcggtgctgc

SEQ ID NO: 262368 - DNA, 25 bp, Mus musculus
tggtgtccctcaccgcagattcggt

SEQ ID NO: 262369 - DNA, 25 bp, Mus musculus
cccagtgacgtcagcagtaacgcca

SEQ ID NO: 262370 - DNA, 25 bp, Mus musculus
tgccatggcctccacagtaacaacg

SEQ ID NO: 262371 - DNA, 25 bp, Mus musculus
ttttcccagacacgcagccggattc

SEQ ID NO: 262372 - DNA, 25 bp, Mus musculus
tcacgtatgtgcaccggagcctggt

SEQ ID NO: 262373 - DNA, 25 bp, Mus musculus
tggttcccggtgaagaaggtccgca

SEQ ID NO: 262374 - DNA, 25 bp, Mus musculus
ctcagtacatggagcggctaaatgc

SEQ ID NO: 262375 - DNA, 25 bp, Mus musculus
gtatccgggaacctgcaacttcctg

SEQ ID NO: 262376 - DNA, 25 bp, Mus musculus
ctggaacgacctgcgctgtaacgta

SEQ ID NO: 262377 - DNA, 25 bp, Mus musculus
ctgcgctgtaacgtatccgggaacc

SEQ ID NO: 262378 - DNA, 25 bp, Mus musculus
tgcaacttcctgaggccgaagcggt

SEQ ID NO: 262379 - DNA, 25 bp, Mus musculus
agtggctcagtacatggagcggcta

SEQ ID NO: 262380 - DNA, 25 bp, Mus musculus
ctaaatgcaaagcatggcgggtacg

SEQ ID NO: 262381 - DNA, 25 bp, Mus musculus
tgcgctctgactggaacgacctgcg

SEQ ID NO: 262382 - DNA, 25 bp, Mus musculus
tggacttcgagctcctgcgctctga

SEQ ID NO: 262383 - DNA, 25 bp, Mus musculus
tgggcgccatggacttcgagctcct

SEQ ID NO: 262384 - DNA, 25 bp, Mus musculus
agcgcacgttcagcgtgggcgccat

SEQ ID NO: 262385 - DNA, 25 bp, Mus musculus
gccatcaactggcagcgcacgttca

SEQ ID NO: 262386 - DNA, 25 bp, Mus musculus
cgctggcgggaggatgccatcaact

SEQ ID NO: 262387 - DNA, 25 bp, Mus musculus
tggagcggctaaatgcaaagcatgg

SEQ ID NO: 262388 - DNA, 25 bp, Mus musculus
gcagagctacaaccctcggttaatc

SEQ ID NO: 262389 - DNA, 25 bp, Mus musculus
caaggatctttcctcttacaggaga

SEQ ID NO: 262390 - DNA, 25 bp, Mus musculus
ggggactcgtacttcaacatcatct

SEQ ID NO: 262391 - DNA, 25 bp, Mus musculus
ttcctggcagatatgaccgcgctgc

SEQ ID NO: 262392 - DNA, 25 bp, Mus musculus
ttccagtgaagaatcaggcgcgctg

SEQ ID NO: 262393 - DNA, 25 bp, Mus musculus
cggtccagtcatgctgcttcagtga

SEQ ID NO: 262394 - DNA, 25 bp, Mus musculus
attgtaccaggtatgtgcgccacta

SEQ ID NO: 262395 - DNA, 25 bp, Mus musculus
ggcctttgcatctggcctggcgtca

SEQ ID NO: 262396 - DNA, 25 bp, Mus musculus
gaatacgtcttcctgcggttgcccg

SEQ ID NO: 262397 - DNA, 25 bp, Mus musculus
gagatgagttattctgacgccgccg

SEQ ID NO: 262398 - DNA, 25 bp, Mus musculus
gcttctcgcttctacgcatcgtgaa

SEQ ID NO: 262399 - DNA, 25 bp, Mus musculus
aggtgggaaccattcggtccagtca

SEQ ID NO: 262400 - DNA, 25 bp, Mus musculus
cctggaactggaattgcaagagcgc

SEQ ID NO: 262401 - DNA, 25 bp, Mus musculus
gcgtcaggatgtcatggttcatttc

SEQ ID NO: 262402 - DNA, 25 bp, Mus musculus
gtcctctaggaagagtttgtatccc

SEQ ID NO: 262403 - DNA, 25 bp, Mus musculus
gccgacagcgactcaggttcaccaa

SEQ ID NO: 262404 - DNA, 25 bp, Mus musculus
cgacagcgactcaggttcaccaaaa

SEQ ID NO: 262405 - DNA, 25 bp, Mus musculus
agcgactcaggttcaccaaaaggtc

SEQ ID NO: 262406 - DNA, 25 bp, Mus musculus
actcaggttcaccaaaaggtcggca

SEQ ID NO: 262407 - DNA, 25 bp, Mus musculus
caaaaggtcggcagagggctctgta

SEQ ID NO: 262408 - DNA, 25 bp, Mus musculus
gactcagggaacagagtagggacca

SEQ ID NO: 262409 - DNA, 25 bp, Mus musculus
acttgggcggtacccgcgcgaggca

SEQ ID NO: 262410 - DNA, 25 bp, Mus musculus
cgaggcaagaggtcgcggtcctcta

SEQ ID NO: 262411 - DNA, 25 bp, Mus musculus
aagaggtcgcggtcctctaggaaga

SEQ ID NO: 262412 - DNA, 25 bp, Mus musculus
cgcggtcctctaggaagagtttgta

SEQ ID NO: 262413 - DNA, 25 bp, Mus musculus
taggaagagtttgtatccccgacgc

SEQ ID NO: 262414 - DNA, 25 bp, Mus musculus
cgatgagacgccgacagcgactcag

SEQ ID NO: 262415 - DNA, 25 bp, Mus musculus
gagacgccgacagcgactcaggttc

SEQ ID NO: 262416 - DNA, 25 bp, Mus musculus
tgagggcgagcgacccagccagact

SEQ ID NO: 262417 - DNA, 25 bp, Mus musculus
agggacatcgcactgcccgaatctc

SEQ ID NO: 262418 - DNA, 25 bp, Mus musculus
ctagaagcagcacagggacatcgca

SEQ ID NO: 262419 - DNA, 25 bp, Mus musculus
tggccaccgcctagaagcagcacag

SEQ ID NO: 262420 - DNA, 25 bp, Mus musculus
cgtcctccgggagcgatccgaggac

SEQ ID NO: 262421 - DNA, 25 bp, Mus musculus
acagacttcggacttggcgcccgct

SEQ ID NO: 262422 - DNA, 25 bp, Mus musculus
tggtgctgggaacagacttcggact

SEQ ID NO: 262423 - DNA, 25 bp, Mus musculus
cccgaatctctcagcgttgtcagga

SEQ ID NO: 262424 - DNA, 25 bp, Mus musculus
atctctcagcgttgtcaggagctga

SEQ ID NO: 262425 - DNA, 25 bp, Mus musculus
ttcgctcggagcctggctcgctcta

SEQ ID NO: 262426 - DNA, 25 bp, Mus musculus
gctcccgcagcatggagggcgatct

SEQ ID NO: 262427 - DNA, 25 bp, Mus musculus
gcgctgcttgagctacgcgctctga

SEQ ID NO: 262428 - DNA, 25 bp, Mus musculus
ttcgcctgctcacagtgctcggctg

SEQ ID NO: 262429 - DNA, 25 bp, Mus musculus
ccgagggcaagctgctgaggttccc

SEQ ID NO: 262430 - DNA, 25 bp, Mus musculus
tggcgcacgacctgtttcccggaac

SEQ ID NO: 262431 - DNA, 25 bp, Mus musculus
ctcgcgcggaagctgacagtttacc

SEQ ID NO: 262432 - DNA, 25 bp, Mus musculus
cctccgcgtgtctgagtcacgactg

SEQ ID NO: 262433 - DNA, 25 bp, Mus musculus
tcaaccctaaaactggagcggctcc

SEQ ID NO: 262434 - DNA, 25 bp, Mus musculus
caaggctcctcggagcaaagtgctc

SEQ ID NO: 262435 - DNA, 25 bp, Mus musculus
ttcagagctacttcctgcgggacca

SEQ ID NO: 262436 - DNA, 25 bp, Mus musculus
gggaaacccgtctggttcagagcta

SEQ ID NO: 262437 - DNA, 25 bp, Mus musculus
cagtgctctcgagcttccgggctga

SEQ ID NO: 262438 - DNA, 25 bp, Mus musculus
aggaagctattgaccatgttgggca

SEQ ID NO: 262439 - DNA, 25 bp, Mus musculus
gcctctacaggcttgcacttaaatc

SEQ ID NO: 262440 - DNA, 25 bp, Mus musculus
actctgctcaggtgtcctagacttg

SEQ ID NO: 262441 - DNA, 25 bp, Mus musculus
agccgacctatcaggcacgcgtgca

SEQ ID NO: 262442 - DNA, 25 bp, Mus musculus
acagtttacctgtccgaggtgcgca

SEQ ID NO: 262443 - DNA, 25 bp, Mus musculus
tttcccggaactcaacaggtgaggc

SEQ ID NO: 262444 - DNA, 25 bp, Mus musculus
gcaggagtttgggacagacagttta

SEQ ID NO: 262445 - DNA, 25 bp, Mus musculus
ctccgtatgagatgtcgagtgtttt

SEQ ID NO: 262446 - DNA, 25 bp, Mus musculus
tcgagtgttttttcggatcggagga

SEQ ID NO: 262447 - DNA, 25 bp, Mus musculus
cccgtggtcgtctccgtatgagatg

SEQ ID NO: 262448 - DNA, 25 bp, Mus musculus
aaccgtcagggcctggatcagccag

SEQ ID NO: 262449 - DNA, 25 bp, Mus musculus
tttagattggaatcgggaaccgtca

SEQ ID NO: 262450 - DNA, 25 bp, Mus musculus
gggacagacagtttagattggaatc

SEQ ID NO: 262451 - DNA, 25 bp, Mus musculus
tctgaagtctacgacgatggcacta

SEQ ID NO: 262452 - DNA, 25 bp, Mus musculus
ccgcagcaccgagtctgaagtctac

SEQ ID NO: 262453 - DNA, 25 bp, Mus musculus
gaggctcgggatctgagtctccgct

SEQ ID NO: 262454 - DNA, 25 bp, Mus musculus
ctgcagcctactgggctgcgcaggc

SEQ ID NO: 262455 - DNA, 25 bp, Mus musculus
tagggctttccagcgcccagcatgc

SEQ ID NO: 262456 - DNA, 25 bp, Mus musculus
caccgggcagtttagggctttccag

SEQ ID NO: 262457 - DNA, 25 bp, Mus musculus
cgatggcactaacaccttcttttgg

SEQ ID NO: 262458 - DNA, 25 bp, Mus musculus
attttttgatccctcaaaccttctg

SEQ ID NO: 262459 - DNA, 25 bp, Mus musculus
agaggtcccagacgatccgttttct

SEQ ID NO: 262460 - DNA, 25 bp, Mus musculus
agacgatccgttttcttccgcccag

SEQ ID NO: 262461 - DNA, 25 bp, Mus musculus
ccgctgcaagaggtcccagacgatc

SEQ ID NO: 262462 - DNA, 25 bp, Mus musculus
ttgctcacctggtgccgctgcaaga

SEQ ID NO: 262463 - DNA, 25 bp, Mus musculus
ggaacatggcccttgctcacctggt

SEQ ID NO: 262464 - DNA, 25 bp, Mus musculus
aaaaactctcaaaggcagccgggcg

SEQ ID NO: 262465 - DNA, 25 bp, Mus musculus
ccacgtattaagagggccaggaagg

SEQ ID NO: 262466 - DNA, 25 bp, Mus musculus
gctctgccacgtattaagagggcca

SEQ ID NO: 262467 - DNA, 25 bp, Mus musculus
aacatggcccttgctcacctggtgc

SEQ ID NO: 262468 - DNA, 25 bp, Mus musculus
cagccgctctgccacgtattaagag

SEQ ID NO: 262469 - DNA, 25 bp, Mus musculus
gtccagccgctctgccacgtattaa

SEQ ID NO: 262470 - DNA, 25 bp, Mus musculus
tgatccctcaaaccttctggtccag

SEQ ID NO: 262471 - DNA, 25 bp, Mus musculus
tgcaagaggtcccagacgatccgtt

SEQ ID NO: 262472 - DNA, 25 bp, Mus musculus
gagatcatccgtctcgcctccagtt

SEQ ID NO: 262473 - DNA, 25 bp, Mus musculus
cggacatctcagtgaccacgagcta

SEQ ID NO: 262474 - DNA, 25 bp, Mus musculus
cgaggccttcgtgtcctcgctgtgg

SEQ ID NO: 262475 - DNA, 25 bp, Mus musculus
ctccagttcttcaccggctgagctg

SEQ ID NO: 262476 - DNA, 25 bp, Mus musculus
gagctgggtacggacatctcagtga

SEQ ID NO: 262477 - DNA, 25 bp, Mus musculus
agaagcgtagcgaggccttcgtgtc

SEQ ID NO: 262478 - DNA, 25 bp, Mus musculus
tccggactgaagtggaagaagcgta

SEQ ID NO: 262479 - DNA, 25 bp, Mus musculus
gcgacagcgacctccggactgaagt

SEQ ID NO: 262480 - DNA, 25 bp, Mus musculus
gagacccggagtgcgacagcgacct

SEQ ID NO: 262481 - DNA, 25 bp, Mus musculus
agaacgaagcctggagacccggagt

SEQ ID NO: 262482 - DNA, 25 bp, Mus musculus
ctgacctcaggaagaacgaagcctg

SEQ ID NO: 262483 - DNA, 25 bp, Mus musculus
atagcacgtgaaactgacctcagga

SEQ ID NO: 262484 - DNA, 25 bp, Mus musculus
tgaccacgagctaacatagcacgtg

SEQ ID NO: 262485 - DNA, 25 bp, Mus musculus
gcggcgtcatccaagtgcgcagacg

SEQ ID NO: 262486 - DNA, 25 bp, Mus musculus
cccacgagtggaaaggtcatcccga

SEQ ID NO: 262487 - DNA, 25 bp, Mus musculus
ctagctgcctgttctcgtaggtcga

SEQ ID NO: 262488 - DNA, 25 bp, Mus musculus
agcaaaggctccatcctggggcagc

SEQ ID NO: 262489 - DNA, 25 bp, Mus musculus
ctccggagagaaactggtgcacgct

SEQ ID NO: 262490 - DNA, 25 bp, Mus musculus
caccgcgctcttcgtgttttggaga

SEQ ID NO: 262491 - DNA, 25 bp, Mus musculus
agaagctcatactgcgtccatttga

SEQ ID NO: 262492 - DNA, 25 bp, Mus musculus
tgttccacccactcaagcaagtagg

SEQ ID NO: 262493 - DNA, 25 bp, Mus musculus
ctcaggcttttactcaggtcgtgca

SEQ ID NO: 262494 - DNA, 25 bp, Mus musculus
aagctcggcttgttctattcatcta

SEQ ID NO: 262495 - DNA, 25 bp, Mus musculus
tgcgttgaggacctactacagagcc

SEQ ID NO: 262496 - DNA, 25 bp, Mus musculus
tgattggtcgaactcctccgcaccg

SEQ ID NO: 262497 - DNA, 25 bp, Mus musculus
ttggctgagcaacccatccgtcaga

SEQ ID NO: 262498 - DNA, 25 bp, Mus musculus
cggaacttgggtcctgcactcaaca

SEQ ID NO: 262499 - DNA, 25 bp, Mus musculus
ccgtgcttacgagcccgggatttct

SEQ ID NO: 262500 - DNA, 25 bp, Mus musculus
tgaggcggcaccgaagcgcccaagt

SEQ ID NO: 262501 - DNA, 25 bp, Mus musculus
agcagacgcgcttccgcattgatta

SEQ ID NO: 262502 - DNA, 25 bp, Mus musculus
gggaccaccagaacccagagctctg

SEQ ID NO: 262503 - DNA, 25 bp, Mus musculus
gcctccgagctaatgggatgctgtg

SEQ ID NO: 262504 - DNA, 25 bp, Mus musculus
ccgcattgattaacagaggtgagca

SEQ ID NO: 262505 - DNA, 25 bp, Mus musculus
cccaagtcccgaaggccagcaagta

SEQ ID NO: 262506 - DNA, 25 bp, Mus musculus
caagtacccaggtgagctgtgccgg

SEQ ID NO: 262507 - DNA, 25 bp, Mus musculus
ttctcgagactcctgagcactgggc

SEQ ID NO: 262508 - DNA, 25 bp, Mus musculus
accgagtaacgagccaatggggcgt

SEQ ID NO: 262509 - DNA, 25 bp, Mus musculus
cttcgaccgaggagaagcgaatctg

SEQ ID NO: 262510 - DNA, 25 bp, Mus musculus
acctgcgtctgtccgctgcagagtg

SEQ ID NO: 262511 - DNA, 25 bp, Mus musculus
ctgcagagtgggacgtctggatccc

SEQ ID NO: 262512 - DNA, 25 bp, Mus musculus
cggcatcagggagccgtcttcgacc

SEQ ID NO: 262513 - DNA, 25 bp, Mus musculus
gcgggagacacacgcctccgagcta

SEQ ID NO: 262514 - DNA, 25 bp, Mus musculus
tcgcgttgaccacacccacatattg

SEQ ID NO: 262515 - DNA, 25 bp, Mus musculus
cccagggcgctgttgttagggtcta

SEQ ID NO: 262516 - DNA, 25 bp, Mus musculus
caaacggttcccagggcgctgttgt

SEQ ID NO: 262517 - DNA, 25 bp, Mus musculus
ccgcgagggcttctacaagctgctc

SEQ ID NO: 262518 - DNA, 25 bp, Mus musculus
tctaggggcgttcccaacagtcaca

SEQ ID NO: 262519 - DNA, 25 bp, Mus musculus
acgcgagggtctgtcgcgttgacca

SEQ ID NO: 262520 - DNA, 25 bp, Mus musculus
cgttgctgggcaaacggttcccagg

SEQ ID NO: 262521 - DNA, 25 bp, Mus musculus
cagaaccgttacctcagcaactgtc

SEQ ID NO: 262522 - DNA, 25 bp, Mus musculus
tccggctctgggtgccaatcgtaga

SEQ ID NO: 262523 - DNA, 25 bp, Mus musculus
gccaatcgtagaggcgtcacccgga

SEQ ID NO: 262524 - DNA, 25 bp, Mus musculus
ccatgggcgactgcgcggagatcaa

SEQ ID NO: 262525 - DNA, 25 bp, Mus musculus
tgcgcggagatcaagtcgcagtttc

SEQ ID NO: 262526 - DNA, 25 bp, Mus musculus
aagtcgcagtttcgcacccgcgagg

SEQ ID NO: 262527 - DNA, 25 bp, Mus musculus
tcgtagccaaccaaacgcgagggtc

SEQ ID NO: 262528 - DNA, 25 bp, Mus musculus
ctacttgcggtcgtgttcggacaga

SEQ ID NO: 262529 - DNA, 25 bp, Mus musculus
ctgcagttaagtccagccaccagga

SEQ ID NO: 262530 - DNA, 25 bp, Mus musculus
gccacctatggtggccgtacgcttt

SEQ ID NO: 262531 - DNA, 25 bp, Mus musculus
ttccggaagagtatgggtgcacttc

SEQ ID NO: 262532 - DNA, 25 bp, Mus musculus
tccaccaacgggcagggcagaaagt

SEQ ID NO: 262533 - DNA, 25 bp, Mus musculus
cgctcccattcatcgcggcggatgg

SEQ ID NO: 262534 - DNA, 25 bp, Mus musculus
ggggacgcgctaacgtctcgtcatc

SEQ ID NO: 262535 - DNA, 25 bp, Mus musculus
tgctctcctctgacagtacttgtga

SEQ ID NO: 262536 - DNA, 25 bp, Mus musculus
gctcggacagcacacgctcagcaaa

SEQ ID NO: 262537 - DNA, 25 bp, Mus musculus
tagtgcactggtgagagctcggaca

SEQ ID NO: 262538 - DNA, 25 bp, Mus musculus
acccacagcctggtttagtgcactg

SEQ ID NO: 262539 - DNA, 25 bp, Mus musculus
gccgtacgctttgtctgtggccttc

SEQ ID NO: 262540 - DNA, 25 bp, Mus musculus
ggagtcggactgtaccaactgcatg

SEQ ID NO: 262541 - DNA, 25 bp, Mus musculus
caactgcatggaggtgagacccaca

SEQ ID NO: 262542 - DNA, 25 bp, Mus musculus
ggcgatctcggtcgcctagcttgga

SEQ ID NO: 262543 - DNA, 25 bp, Mus musculus
ctcggtcgcctagcttggagcatag

SEQ ID NO: 262544 - DNA, 25 bp, Mus musculus
gagagggaccggagacacaaacatc

SEQ ID NO: 262545 - DNA, 25 bp, Mus musculus
acgaaggccaccttcccgtgagaag

SEQ ID NO: 262546 - DNA, 25 bp, Mus musculus
agcataggccacgaaggccaccttc

SEQ ID NO: 262547 - DNA, 25 bp, Mus musculus
cctagcttggagcataggccacgaa

SEQ ID NO: 262548 - DNA, 25 bp, Mus musculus
cggcggaagtccaggtctcgctcag

SEQ ID NO: 262549 - DNA, 25 bp, Mus musculus
agacacaaacatcgggagaggagcc

SEQ ID NO: 262550 - DNA, 25 bp, Mus musculus
taagagacggaagaggcgacattcg

SEQ ID NO: 262551 - DNA, 25 bp, Mus musculus
cgccatgagagtaagagacggaaga

SEQ ID NO: 262552 - DNA, 25 bp, Mus musculus
tcctgtgagcgccatgagagtaaga

SEQ ID NO: 262553 - DNA, 25 bp, Mus musculus
gcagttcttcctgtgagcgccatga

SEQ ID NO: 262554 - DNA, 25 bp, Mus musculus
tcagggagccctggcagttcttcct

SEQ ID NO: 262555 - DNA, 25 bp, Mus musculus
gtccaggtctcgctcagggagccct

SEQ ID NO: 262556 - DNA, 25 bp, Mus musculus
aacagcagcgctactgaggacggtg

SEQ ID NO: 262557 - DNA, 25 bp, Mus musculus
ctctttgtctactccgaggtgagcc

SEQ ID NO: 262558 - DNA, 25 bp, Mus musculus
caccaactacttcatcgtgagcctg

SEQ ID NO: 262559 - DNA, 25 bp, Mus musculus
ggattccgggtagcccctgcctgca

SEQ ID NO: 262560 - DNA, 25 bp, Mus musculus
cgcctcccggagcgggttcagcagt

SEQ ID NO: 262561 - DNA, 25 bp, Mus musculus
ccgaggtgagcctcggtgcgctctt

SEQ ID NO: 262562 - DNA, 25 bp, Mus musculus
gccagaatccctggggactggcgcc

SEQ ID NO: 262563 - DNA, 25 bp, Mus musculus
gcgtgctgctcatcggcttggtgtt

SEQ ID NO: 262564 - DNA, 25 bp, Mus musculus
cttggtgttggcagggaactcgctc

SEQ ID NO: 262565 - DNA, 25 bp, Mus musculus
gaactcgctcgtgtgcgtgagcgtg

SEQ ID NO: 262566 - DNA, 25 bp, Mus musculus
tggtgctgcctctctttgtctactc

SEQ ID NO: 262567 - DNA, 25 bp, Mus musculus
gcacgctgcagacacccaccaacta

SEQ ID NO: 262568 - DNA, 25 bp, Mus musculus
tacttcatcgtgagcctggctgctg

SEQ ID NO: 262569 - DNA, 25 bp, Mus musculus
tgagcgtggcctccgagcgcacgct

SEQ ID NO: 262570 - DNA, 25 bp, Mus musculus
tcgctgagagaaggtgaagcctctg

SEQ ID NO: 262571 - DNA, 25 bp, Mus musculus
tgaaagtagaatccagtggcgaagg

SEQ ID NO: 262572 - DNA, 25 bp, Mus musculus
aaagtagaatccagtggcgaagggt

SEQ ID NO: 262573 - DNA, 25 bp, Mus musculus
aagtagaatccagtggcgaagggtc

SEQ ID NO: 262574 - DNA, 25 bp, Mus musculus
gtagaatccagtggcgaagggtcgc

SEQ ID NO: 262575 - DNA, 25 bp, Mus musculus
tagaatccagtggcgaagggtcgct

SEQ ID NO: 262576 - DNA, 25 bp, Mus musculus
gaatccagtggcgaagggtcgctga

SEQ ID NO: 262577 - DNA, 25 bp, Mus musculus
gtcgctgagagaaggtgaagcctct

SEQ ID NO: 262578 - DNA, 25 bp, Mus musculus
cgctgagagaaggtgaagcctctgt

SEQ ID NO: 262579 - DNA, 25 bp, Mus musculus
ctgagagaaggtgaagcctctgtgg

SEQ ID NO: 262580 - DNA, 25 bp, Mus musculus
tgagagaaggtgaagcctctgtggg

SEQ ID NO: 262581 - DNA, 25 bp, Mus musculus
aggtgaagcctctgtgggggcgtca

SEQ ID NO: 262582 - DNA, 25 bp, Mus musculus
atccagtggcgaagggtcgctgaga

SEQ ID NO: 262583 - DNA, 25 bp, Mus musculus
gtgaaagtagaatccagtggcgaag

SEQ ID NO: 262584 - DNA, 25 bp, Mus musculus
ggtcactagaataactcgacatggc

SEQ ID NO: 262585 - DNA, 25 bp, Mus musculus
tctcggtcactagaataactcgaca

SEQ ID NO: 262586 - DNA, 25 bp, Mus musculus
gcggaacccagtgaaagtagaatcc

SEQ ID NO: 262587 - DNA, 25 bp, Mus musculus
ggcggaacccagtgaaagtagaatc

SEQ ID NO: 262588 - DNA, 25 bp, Mus musculus
actcgacatggcgtcaatggtggcg

SEQ ID NO: 262589 - DNA, 25 bp, Mus musculus
ggtctcggtcactagaataactcga

SEQ ID NO: 262590 - DNA, 25 bp, Mus musculus
tcggtcactagaataactcgacatg

SEQ ID NO: 262591 - DNA, 25 bp, Mus musculus
gaataactcgacatggcgtcaatgg

SEQ ID NO: 262592 - DNA, 25 bp, Mus musculus
tcactagaataactcgacatggcgt

SEQ ID NO: 262593 - DNA, 25 bp, Mus musculus
cactagaataactcgacatggcgtc

SEQ ID NO: 262594 - DNA, 25 bp, Mus musculus
actagaataactcgacatggcgtca

SEQ ID NO: 262595 - DNA, 25 bp, Mus musculus
ctagaataactcgacatggcgtcaa

SEQ ID NO: 262596 - DNA, 25 bp, Mus musculus
agaataactcgacatggcgtcaatg

SEQ ID NO: 262597 - DNA, 25 bp, Mus musculus
ataactcgacatggcgtcaatggtg

SEQ ID NO: 262598 - DNA, 25 bp, Mus musculus
catggacgtcatgctgtgcaccgcc

SEQ ID NO: 262599 - DNA, 25 bp, Mus musculus
tggtctactcgtccgtctgctcctt

SEQ ID NO: 262600 - DNA, 25 bp, Mus musculus
accgagactatgtggtctactcgtc

SEQ ID NO: 262601 - DNA, 25 bp, Mus musculus
gctgcctggagaaccgagactatgt

SEQ ID NO: 262602 - DNA, 25 bp, Mus musculus
cctcaatgatgtgcccggccgcgat

SEQ ID NO: 262603 - DNA, 25 bp, Mus musculus
tggtgtgtggcctcaatgatgtgcc

SEQ ID NO: 262604 - DNA, 25 bp, Mus musculus
acgctcatggccatggacgtcatgc

SEQ ID NO: 262605 - DNA, 25 bp, Mus musculus
ccatcagcgtggacaggtgggtacc

SEQ ID NO: 262606 - DNA, 25 bp, Mus musculus
gctcctgtgctcctctaggttcgtg

SEQ ID NO: 262607 - DNA, 25 bp, Mus musculus
cttcgccagtggtgtgtggcctcaa

SEQ ID NO: 262608 - DNA, 25 bp, Mus musculus
gtgccgctgcgctacaaccagcagg

SEQ ID NO: 262609 - DNA, 25 bp, Mus musculus
ctcctctaggttcgtggccgtgacc

SEQ ID NO: 262610 - DNA, 25 bp, Mus musculus
cgtctctgtgacacgctcatggcca

SEQ ID NO: 262611 - DNA, 25 bp, Mus musculus
acaaccagcagggtcagtgccagct

SEQ ID NO: 262612 - DNA, 25 bp, Mus musculus
gtcagtgccgtcacctggctaggct

SEQ ID NO: 262613 - DNA, 25 bp, Mus musculus
tcgaagtgtcttccgcaagactctc

SEQ ID NO: 262614 - DNA, 25 bp, Mus musculus
tcttcgtggtgcacatcacgcgggc

SEQ ID NO: 262615 - DNA, 25 bp, Mus musculus
atcacgcgggcgctgtgtccggctt

SEQ ID NO: 262616 - DNA, 25 bp, Mus musculus
tgtccggcttgcttcgtgtctccgc

SEQ ID NO: 262617 - DNA, 25 bp, Mus musculus
tgcttcgtgtctccgcgcctggtca

SEQ ID NO: 262618 - DNA, 25 bp, Mus musculus
gcgcctggtcagtgccgtcacctgg

SEQ ID NO: 262619 - DNA, 25 bp, Mus musculus
gtcacctggctaggctatgtcaaca

SEQ ID NO: 262620 - DNA, 25 bp, Mus musculus
tggctaggctatgtcaacagtgccc

SEQ ID NO: 262621 - DNA, 25 bp, Mus musculus
tacaccatcttcaacgcggagtttc

SEQ ID NO: 262622 - DNA, 25 bp, Mus musculus
caacgcggagtttcgaagtgtcttc

SEQ ID NO: 262623 - DNA, 25 bp, Mus musculus
cggagtttcgaagtgtcttccgcaa

SEQ ID NO: 262624 - DNA, 25 bp, Mus musculus
acgcctttcttcgtggtgcacatca

SEQ ID NO: 262625 - DNA, 25 bp, Mus musculus
gccgtcacctggctaggctatgtca

SEQ ID NO: 262626 - DNA, 25 bp, Mus musculus
tttcccgaagcgcagaatctagata

SEQ ID NO: 262627 - DNA, 25 bp, Mus musculus
gctggctctgcaactcctctgattg

SEQ ID NO: 262628 - DNA, 25 bp, Mus musculus
tgctgtcacgatgagaggctgtctg

SEQ ID NO: 262629 - DNA, 25 bp, Mus musculus
acagtgtggtctcatgctgtcacga

SEQ ID NO: 262630 - DNA, 25 bp, Mus musculus
ccttctatccgaaagctcccgagta

SEQ ID NO: 262631 - DNA, 25 bp, Mus musculus
cctgcttccaacgaagtctgggttc

SEQ ID NO: 262632 - DNA, 25 bp, Mus musculus
tggtcaccgaccgatagagctggcc

SEQ ID NO: 262633 - DNA, 25 bp, Mus musculus
aagcggatctgactgtggtcaccga

SEQ ID NO: 262634 - DNA, 25 bp, Mus musculus
agcgtttcttgctcgctgtctaaga

SEQ ID NO: 262635 - DNA, 25 bp, Mus musculus
cgagcagctccgaagtttcccgaag

SEQ ID NO: 262636 - DNA, 25 bp, Mus musculus
taatacgaatggtcccgaagcttcc

SEQ ID NO: 262637 - DNA, 25 bp, Mus musculus
tccgagtcctcgtctctgcttaaca

SEQ ID NO: 262638 - DNA, 25 bp, Mus musculus
gcccgagtgtagaaccgagcagctc

SEQ ID NO: 262639 - DNA, 25 bp, Mus musculus
cccgaaagcttacgagcgtttcttg

SEQ ID NO: 262640 - DNA, 25 bp, Mus musculus
agagggagctccagaggctctgaca

SEQ ID NO: 262641 - DNA, 25 bp, Mus musculus
ccttcaggctccctcgtgcccactc

SEQ ID NO: 262642 - DNA, 25 bp, Mus musculus
cactcccgggtgactcggtaacctg

SEQ ID NO: 262643 - DNA, 25 bp, Mus musculus
gggtgactcggtaacctgtcgctca

SEQ ID NO: 262644 - DNA, 25 bp, Mus musculus
ggtaacctgtcgctcaggttcctcc

SEQ ID NO: 262645 - DNA, 25 bp, Mus musculus
gcctatccggcccagcagaggtccc

SEQ ID NO: 262646 - DNA, 25 bp, Mus musculus
ctccagaggctctgacagacagacg

SEQ ID NO: 262647 - DNA, 25 bp, Mus musculus
tctgacagacagacggcggacaagc

SEQ ID NO: 262648 - DNA, 25 bp, Mus musculus
gacagacggcggacaagctgaccga

SEQ ID NO: 262649 - DNA, 25 bp, Mus musculus
acaagctgaccgaggggcctaacca

SEQ ID NO: 262650 - DNA, 25 bp, Mus musculus
tgaccgaggggcctaaccaagcaca

SEQ ID NO: 262651 - DNA, 25 bp, Mus musculus
gggcctaaccaagcacaggcgctga

SEQ ID NO: 262652 - DNA, 25 bp, Mus musculus
taaccaagcacaggcgctgagggac

SEQ ID NO: 262653 - DNA, 25 bp, Mus musculus
tcgctcaggttcctcctcgcacagc

SEQ ID NO: 262654 - DNA, 25 bp, Mus musculus
caggtgagtcccgtgtgtacagccg

SEQ ID NO: 262655 - DNA, 25 bp, Mus musculus
gagctaatccaccacatggacgagg

SEQ ID NO: 262656 - DNA, 25 bp, Mus musculus
tccaccacatggacgaggtcaatga

SEQ ID NO: 262657 - DNA, 25 bp, Mus musculus
cgaggtcaatgacgagctcatgaaa

SEQ ID NO: 262658 - DNA, 25 bp, Mus musculus
gctcatgaaaaagatcagccacatc

SEQ ID NO: 262659 - DNA, 25 bp, Mus musculus
gatcagccacatcaagacacagccg

SEQ ID NO: 262660 - DNA, 25 bp, Mus musculus
agccgcagcgcaacttccgcgtgga

SEQ ID NO: 262661 - DNA, 25 bp, Mus musculus
gtgcacctgccgcttaccttcgagt

SEQ ID NO: 262662 - DNA, 25 bp, Mus musculus
ctgccgcttaccttcgagtcaggtc

SEQ ID NO: 262663 - DNA, 25 bp, Mus musculus
ttaccttcgagtcaggtccggatga

SEQ ID NO: 262664 - DNA, 25 bp, Mus musculus
gccttcagtgccaggtgagtcccgt

SEQ ID NO: 262665 - DNA, 25 bp, Mus musculus
agcctggaggacagtgtcccgccca

SEQ ID NO: 262666 - DNA, 25 bp, Mus musculus
tggaggacagtgtcccgcccacggc

SEQ ID NO: 262667 - DNA, 25 bp, Mus musculus
tcaggtccggatgaggtccgcgcct

SEQ ID NO: 262668 - DNA, 25 bp, Mus musculus
gtctgttcattctacgcatccgagc

SEQ ID NO: 262669 - DNA, 25 bp, Mus musculus
taccgcctcagctgttcgcgtttcg

SEQ ID NO: 262670 - DNA, 25 bp, Mus musculus
ggctcgtcgtcaggcttcatttagc

SEQ ID NO: 262671 - DNA, 25 bp, Mus musculus
gtctccaagtacatgggcggggctc

SEQ ID NO: 262672 - DNA, 25 bp, Mus musculus
cgtggtctatggcaaggtctccaag

SEQ ID NO: 262673 - DNA, 25 bp, Mus musculus
ctcgctactggggaagagaactccg

SEQ ID NO: 262674 - DNA, 25 bp, Mus musculus
tctccttggactggtagaaactaac

SEQ ID NO: 262675 - DNA, 25 bp, Mus musculus
atccatccgtagtccgtggggtctg

SEQ ID NO: 262676 - DNA, 25 bp, Mus musculus
tccgagctctagaggggtacaaaga

SEQ ID NO: 262677 - DNA, 25 bp, Mus musculus
gcgcgcgtctcagtagaatccgttg

SEQ ID NO: 262678 - DNA, 25 bp, Mus musculus
gacgcggtgcatgcgccctatttaa

SEQ ID NO: 262679 - DNA, 25 bp, Mus musculus
cccaattttggaaccagcaccggtg

SEQ ID NO: 262680 - DNA, 25 bp, Mus musculus
gggtacaaagaatccactctccttg

SEQ ID NO: 262681 - DNA, 25 bp, Mus musculus
ccgacacgggtgatttcaatggtaa

SEQ ID NO: 262682 - DNA, 25 bp, Mus musculus
cctcaccttcggaagcgccgctggc

SEQ ID NO: 262683 - DNA, 25 bp, Mus musculus
aatgcgcatgcgtgaggcacgaagg

SEQ ID NO: 262684 - DNA, 25 bp, Mus musculus
agcggaatgcgcatgcgtgaggcac

SEQ ID NO: 262685 - DNA, 25 bp, Mus musculus
cgcctgcagagagcggaatgcgcat

SEQ ID NO: 262686 - DNA, 25 bp, Mus musculus
ctcgcctgcagagagcggaatgcgc

SEQ ID NO: 262687 - DNA, 25 bp, Mus musculus
ccaggcggatatttgtgcgagggat

SEQ ID NO: 262688 - DNA, 25 bp, Mus musculus
ggctacagcccaggcggatatttgt

SEQ ID NO: 262689 - DNA, 25 bp, Mus musculus
atggctacagcccaggcggatattt

SEQ ID NO: 262690 - DNA, 25 bp, Mus musculus
gccatggctacagcccaggcggata

SEQ ID NO: 262691 - DNA, 25 bp, Mus musculus
ggcagccgctcggacgccatggcta

SEQ ID NO: 262692 - DNA, 25 bp, Mus musculus
gcttggcagccgctcggacgccatg

SEQ ID NO: 262693 - DNA, 25 bp, Mus musculus
aggcctgcttggcagccgctcggac

SEQ ID NO: 262694 - DNA, 25 bp, Mus musculus
caccaggagacacgcaggcctgctt

SEQ ID NO: 262695 - DNA, 25 bp, Mus musculus
aggagacacgcaggcctgcttggca

SEQ ID NO: 262696 - DNA, 25 bp, Mus musculus
gactccaagccatctttcatttagg

SEQ ID NO: 262697 - DNA, 25 bp, Mus musculus
aaagcgtctctgtgcccatcgcgcc

SEQ ID NO: 262698 - DNA, 25 bp, Mus musculus
gagcgacccaaagcgtctctgtgcc

SEQ ID NO: 262699 - DNA, 25 bp, Mus musculus
agggagcgacccaaagcgtctctgt

SEQ ID NO: 262700 - DNA, 25 bp, Mus musculus
cgaccagggagcgacccaaagcgtc

SEQ ID NO: 262701 - DNA, 25 bp, Mus musculus
gtcgagcgaccagggagcgacccaa

SEQ ID NO: 262702 - DNA, 25 bp, Mus musculus
ccatctttcatttaggcctcctagg

SEQ ID NO: 262703 - DNA, 25 bp, Mus musculus
tgaaccctaagactccaagccatct

SEQ ID NO: 262704 - DNA, 25 bp, Mus musculus
gcggtctcaccccagtctggtgttt

SEQ ID NO: 262705 - DNA, 25 bp, Mus musculus
tggtggcctataccggcggtctcac

SEQ ID NO: 262706 - DNA, 25 bp, Mus musculus
aggcgcgttgcctgctcctgttcgc

SEQ ID NO: 262707 - DNA, 25 bp, Mus musculus
ttgcctgctcctgttcgccgctgct

SEQ ID NO: 262708 - DNA, 25 bp, Mus musculus
tgctgccgccacactgggctgcact

SEQ ID NO: 262709 - DNA, 25 bp, Mus musculus
cctcctaggaaggtcgagcgaccag

SEQ ID NO: 262710 - DNA, 25 bp, Mus musculus
aaatgaccggctagcactcaccaca

SEQ ID NO: 262711 - DNA, 25 bp, Mus musculus
gctccgccctaagtttttgctgcct

SEQ ID NO: 262712 - DNA, 25 bp, Mus musculus
cgccacgggaaatgaccggctagca

SEQ ID NO: 262713 - DNA, 25 bp, Mus musculus
cagccagatttgagtgggcgccacg

SEQ ID NO: 262714 - DNA, 25 bp, Mus musculus
tccctgcaacccagccagatttgag

SEQ ID NO: 262715 - DNA, 25 bp, Mus musculus
gtctgagcagatgtcacctctccca

SEQ ID NO: 262716 - DNA, 25 bp, Mus musculus
ccgccaaagccgcagtgtctgagca

SEQ ID NO: 262717 - DNA, 25 bp, Mus musculus
tacccattaggttcaggctccgcca

SEQ ID NO: 262718 - DNA, 25 bp, Mus musculus
ccggtcgatgtacccattaggttca

SEQ ID NO: 262719 - DNA, 25 bp, Mus musculus
cacccggagacagccggtcgatgta

SEQ ID NO: 262720 - DNA, 25 bp, Mus musculus
agagccgggaccgagcacggccttc

SEQ ID NO: 262721 - DNA, 25 bp, Mus musculus
cacactgctgggacacgtgtgcgcg

SEQ ID NO: 262722 - DNA, 25 bp, Mus musculus
tctggagcgtccacactgctgggac

SEQ ID NO: 262723 - DNA, 25 bp, Mus musculus
taagtttttgctgccttcggctccc

SEQ ID NO: 262724 - DNA, 25 bp, Mus musculus
gaaggcctctcggataacctcacca

SEQ ID NO: 262725 - DNA, 25 bp, Mus musculus
agcattctgtgaccggaggcctggc

SEQ ID NO: 262726 - DNA, 25 bp, Mus musculus
tctcctagcgccaaagacatcaaga

SEQ ID NO: 262727 - DNA, 25 bp, Mus musculus
ccttcgcgctgcattttgggagctg

SEQ ID NO: 262728 - DNA, 25 bp, Mus musculus
tgcccgcatggatttcgggagactc

SEQ ID NO: 262729 - DNA, 25 bp, Mus musculus
gggagactctcgtccatgttgcaga

SEQ ID NO: 262730 - DNA, 25 bp, Mus musculus
ctcgtttttgttgtggggaagacat

SEQ ID NO: 262731 - DNA, 25 bp, Mus musculus
gaaatgtcttccttccggtgcaccc

SEQ ID NO: 262732 - DNA, 25 bp, Mus musculus
cggtgcacccttttcgtcaatggga

SEQ ID NO: 262733 - DNA, 25 bp, Mus musculus
cccgcagccgagtgagtagcctggc

SEQ ID NO: 262734 - DNA, 25 bp, Mus musculus
acgtggcctcacttgctgcttaaaa

SEQ ID NO: 262735 - DNA, 25 bp, Mus musculus
ttagcatgcgctacgtcgcctctta

SEQ ID NO: 262736 - DNA, 25 bp, Mus musculus
tactagacagcgtgggcatcgaagc

SEQ ID NO: 262737 - DNA, 25 bp, Mus musculus
aggtcgcacgcgtgaggtctgtccc

SEQ ID NO: 262738 - DNA, 25 bp, Mus musculus
ccgcagttcccggacatgatcctgt

SEQ ID NO: 262739 - DNA, 25 bp, Mus musculus
ccagttgttagttggggcgtgcata

SEQ ID NO: 262740 - DNA, 25 bp, Mus musculus
agtctcgtggttaagcaagtggcgc

SEQ ID NO: 262741 - DNA, 25 bp, Mus musculus
cgggacgaccctttacacatgaacg

SEQ ID NO: 262742 - DNA, 25 bp, Mus musculus
tcctggggactgcatgagagtctcg

SEQ ID NO: 262743 - DNA, 25 bp, Mus musculus
atgatcctgtctgcgtctcgaggta

SEQ ID NO: 262744 - DNA, 25 bp, Mus musculus
tggatgggtaacacagatcgccacc

SEQ ID NO: 262745 - DNA, 25 bp, Mus musculus
ccttaagggccacaatggatgggta

SEQ ID NO: 262746 - DNA, 25 bp, Mus musculus
gcagatgacccttcgcgggaccctt

SEQ ID NO: 262747 - DNA, 25 bp, Mus musculus
gcagccatgaccgagcagatgaccc

SEQ ID NO: 262748 - DNA, 25 bp, Mus musculus
tgagctatccggtgccatccttgtc

SEQ ID NO: 262749 - DNA, 25 bp, Mus musculus
gtggtgcttggctctctgagctatc

SEQ ID NO: 262750 - DNA, 25 bp, Mus musculus
tgctctccgagtatttccggttccg

SEQ ID NO: 262751 - DNA, 25 bp, Mus musculus
tacgggctgcatgccgggtaaatca

SEQ ID NO: 262752 - DNA, 25 bp, Mus musculus
accgccacagcgctggtcactgggg

SEQ ID NO: 262753 - DNA, 25 bp, Mus musculus
ctcacatctacggagcctcggcagg

SEQ ID NO: 262754 - DNA, 25 bp, Mus musculus
ggatgctctagcgtcccacgcctag

SEQ ID NO: 262755 - DNA, 25 bp, Mus musculus
cgagggagaccaagtggaacatctc

SEQ ID NO: 262756 - DNA, 25 bp, Mus musculus
tgatccagttggatcgcgcgcccag

SEQ ID NO: 262757 - DNA, 25 bp, Mus musculus
cccaaggtatcgagactgcgggacc

SEQ ID NO: 262758 - DNA, 25 bp, Mus musculus
atcgagtcacgatgttcccgaggga

SEQ ID NO: 262759 - DNA, 25 bp, Mus musculus
ggccgttccctgcttgatccagttg

SEQ ID NO: 262760 - DNA, 25 bp, Mus musculus
tggaacatctcattcgctggctgcg

SEQ ID NO: 262761 - DNA, 25 bp, Mus musculus
gcttcctcggggtctaccacattgg

SEQ ID NO: 262762 - DNA, 25 bp, Mus musculus
gccggtggatgctctagcgtcccac

SEQ ID NO: 262763 - DNA, 25 bp, Mus musculus
gtctaccacattggcgtggcctcct

SEQ ID NO: 262764 - DNA, 25 bp, Mus musculus
tggtggccaacgccactcacatcta

SEQ ID NO: 262765 - DNA, 25 bp, Mus musculus
actgcccgcaggacatcgagtcacg

SEQ ID NO: 262766 - DNA, 25 bp, Mus musculus
ctgcctttcgtctggactccctgga

SEQ ID NO: 262767 - DNA, 25 bp, Mus musculus
gatggacctccggtcccgaggaaca

SEQ ID NO: 262768 - DNA, 25 bp, Mus musculus
atgagatttgcctgtgggcccaccc

SEQ ID NO: 262769 - DNA, 25 bp, Mus musculus
atctctgtctggaacggctgtgttc

SEQ ID NO: 262770 - DNA, 25 bp, Mus musculus
tgtgttcctcgggtgaaggcagcta

SEQ ID NO: 262771 - DNA, 25 bp, Mus musculus
gccatcgcacgcatctctgtctgga

SEQ ID NO: 262772 - DNA, 25 bp, Mus musculus
gcccagacgtgcgtggatgagattt

SEQ ID NO: 262773 - DNA, 25 bp, Mus musculus
ggcatttatttgctcgcaggtcccg

SEQ ID NO: 262774 - DNA, 25 bp, Mus musculus
tagctccagtggtcgcaccttccga

SEQ ID NO: 262775 - DNA, 25 bp, Mus musculus
cggctcgcaggtaggcatttatttg

SEQ ID NO: 262776 - DNA, 25 bp, Mus musculus
ctgtgtagagcagccatcgcacgca

SEQ ID NO: 262777 - DNA, 25 bp, Mus musculus
cggacgtgctatcccggggtctccg

SEQ ID NO: 262778 - DNA, 25 bp, Mus musculus
cctgtaaggccgcaaggtcgctctg

SEQ ID NO: 262779 - DNA, 25 bp, Mus musculus
tcgcaccttccgagcgctgtgtaga

SEQ ID NO: 262780 - DNA, 25 bp, Mus musculus
gcagagacttggctcggaaatgatc

SEQ ID NO: 262781 - DNA, 25 bp, Mus musculus
cgcggactgtatgaagaactggagc

SEQ ID NO: 262782 - DNA, 25 bp, Mus musculus
aggtgcgcggactgtatgaagaact

SEQ ID NO: 262783 - DNA, 25 bp, Mus musculus
tgatatcccggttcctcgaaggcgg

SEQ ID NO: 262784 - DNA, 25 bp, Mus musculus
catgtctatgatatcccggttcctc

SEQ ID NO: 262785 - DNA, 25 bp, Mus musculus
gacctgagctgttgggctctctaga

SEQ ID NO: 262786 - DNA, 25 bp, Mus musculus
tatgaagaactggagcagcagctcg

SEQ ID NO: 262787 - DNA, 25 bp, Mus musculus
aaggtcttgagcaagcgctgcgacg

SEQ ID NO: 262788 - DNA, 25 bp, Mus musculus
ttctgatgcgcgcatcggcctgcct

SEQ ID NO: 262789 - DNA, 25 bp, Mus musculus
tagaggaagttctgatgcgcgcatc

SEQ ID NO: 262790 - DNA, 25 bp, Mus musculus
ctgttgggctctctagaggaagttc

SEQ ID NO: 262791 - DNA, 25 bp, Mus musculus
cagcagctcggggagcagcgacacc

SEQ ID NO: 262792 - DNA, 25 bp, Mus musculus
tgcagcgcgagcgacctgagctgtt

SEQ ID NO: 262793 - DNA, 25 bp, Mus musculus
tggctcggaaatgatcatgtctatg

SEQ ID NO: 262794 - DNA, 25 bp, Mus musculus
actccgagtgatcgctcctaccgtg

SEQ ID NO: 262795 - DNA, 25 bp, Mus musculus
gcccagcccacttcagtgtttaatc

SEQ ID NO: 262796 - DNA, 25 bp, Mus musculus
cttcatctctgtgacgcggggattc

SEQ ID NO: 262797 - DNA, 25 bp, Mus musculus
gaccaccctattcattgtccctgga

SEQ ID NO: 262798 - DNA, 25 bp, Mus musculus
cctgacggtctctttcgtgcagaaa

SEQ ID NO: 262799 - DNA, 25 bp, Mus musculus
cttctgtggttcttgagcaggcctg

SEQ ID NO: 262800 - DNA, 25 bp, Mus musculus
gttgcagactcctttccggaagatc

SEQ ID NO: 262801 - DNA, 25 bp, Mus musculus
gttcctagtctccaagctggcctca

SEQ ID NO: 262802 - DNA, 25 bp, Mus musculus
tcctcgctcactggtgttcctagtc

SEQ ID NO: 262803 - DNA, 25 bp, Mus musculus
agcagtgtcctgagttcctcgctca

SEQ ID NO: 262804 - DNA, 25 bp, Mus musculus
tgagtgctccgtgaagcatagccgg

SEQ ID NO: 262805 - DNA, 25 bp, Mus musculus
ccgagcgttctctgtactccgagtg

SEQ ID NO: 262806 - DNA, 25 bp, Mus musculus
tgccggggctggtatttcaaagcgt

SEQ ID NO: 262807 - DNA, 25 bp, Mus musculus
ttcaaagcgtggttggtgagtgctc

SEQ ID NO: 262808 - DNA, 25 bp, Mus musculus
ctacggcgtccgagcaaggccgaaa

SEQ ID NO: 262809 - DNA, 25 bp, Mus musculus
tcttcggccgctgcagaaccgtcgg

SEQ ID NO: 262810 - DNA, 25 bp, Mus musculus
gtctggagcccttacccgaggtgcc

SEQ ID NO: 262811 - DNA, 25 bp, Mus musculus
actccaaggggtctcggtctggagc

SEQ ID NO: 262812 - DNA, 25 bp, Mus musculus
actgtccacggccaaggcggtcttc

SEQ ID NO: 262813 - DNA, 25 bp, Mus musculus
actggagccaagaggtggttaacaa

SEQ ID NO: 262814 - DNA, 25 bp, Mus musculus
gatcgcaagccgactggagccaaga

SEQ ID NO: 262815 - DNA, 25 bp, Mus musculus
atagcgcggggctcattacgcccta

SEQ ID NO: 262816 - DNA, 25 bp, Mus musculus
gttcgcgtttctcgtgttgccttga

SEQ ID NO: 262817 - DNA, 25 bp, Mus musculus
cctcccgctgtggtggtagatcccg

SEQ ID NO: 262818 - DNA, 25 bp, Mus musculus
ctcccatgattaccctgaagcggcg

SEQ ID NO: 262819 - DNA, 25 bp, Mus musculus
cgcgcacaggtacggcggttctagc

SEQ ID NO: 262820 - DNA, 25 bp, Mus musculus
aggctgccggcagtagcttttcaag

SEQ ID NO: 262821 - DNA, 25 bp, Mus musculus
ttgccttgactgacagctgctccgc

SEQ ID NO: 262822 - DNA, 25 bp, Mus musculus
gtgcagagcgctgacaacgactgta

SEQ ID NO: 262823 - DNA, 25 bp, Mus musculus
cgtccggtagccacgggtgcagagc

SEQ ID NO: 262824 - DNA, 25 bp, Mus musculus
gatgcgccgctccagcacggacgaa

SEQ ID NO: 262825 - DNA, 25 bp, Mus musculus
gcgctgacaacgactgtagccagtg

SEQ ID NO: 262826 - DNA, 25 bp, Mus musculus
tgacaacgactgtagccagtgagcg

SEQ ID NO: 262827 - DNA, 25 bp, Mus musculus
aacgactgtagccagtgagcgtggc

SEQ ID NO: 262828 - DNA, 25 bp, Mus musculus
gctccagcacggacgaatccacgta

SEQ ID NO: 262829 - DNA, 25 bp, Mus musculus
ggacgaatccacgtaccggcgcagc

SEQ ID NO: 262830 - DNA, 25 bp, Mus musculus
ggcgcagcccttctccggagagcaa

SEQ ID NO: 262831 - DNA, 25 bp, Mus musculus
cgcagcccttctccggagagcaagg

SEQ ID NO: 262832 - DNA, 25 bp, Mus musculus
cgctgcagcagcctgtatgggcgcg

SEQ ID NO: 262833 - DNA, 25 bp, Mus musculus
ggcggcggcttcttcggcctgcact

SEQ ID NO: 262834 - DNA, 25 bp, Mus musculus
tgcggatggagcgtccggtagccac

SEQ ID NO: 262835 - DNA, 25 bp, Mus musculus
cagcacggacgaatccacgtaccgg

SEQ ID NO: 262836 - DNA, 25 bp, Mus musculus
cgcggaagatgaagcagtcccattg

SEQ ID NO: 262837 - DNA, 25 bp, Mus musculus
gcggaacgtgtacttcgtagccgta

SEQ ID NO: 262838 - DNA, 25 bp, Mus musculus
actctgcccgttctgtccggggaga

SEQ ID NO: 262839 - DNA, 25 bp, Mus musculus
gggagagcctcgctgcccgacgttc

SEQ ID NO: 262840 - DNA, 25 bp, Mus musculus
cttcgtagccgtaggtgctgtttcc

SEQ ID NO: 262841 - DNA, 25 bp, Mus musculus
cgggaccgtcagttggatgaagaca

SEQ ID NO: 262842 - DNA, 25 bp, Mus musculus
gccagcttcctagatgccttgcgca

SEQ ID NO: 262843 - DNA, 25 bp, Mus musculus
cacggccggaagacgatttaatcaa

SEQ ID NO: 262844 - DNA, 25 bp, Mus musculus
ggagaccggccagacccatcaagca

SEQ ID NO: 262845 - DNA, 25 bp, Mus musculus
ccttcatgtcaggagaccggccaga

SEQ ID NO: 262846 - DNA, 25 bp, Mus musculus
agccgggctcaccttcatgtcagga

SEQ ID NO: 262847 - DNA, 25 bp, Mus musculus
tgaagcagtcccattgccgccacag

SEQ ID NO: 262848 - DNA, 25 bp, Mus musculus
ttcccgcattgtgacgcggaagatg

SEQ ID NO: 262849 - DNA, 25 bp, Mus musculus
agacccatcaagcacggccggaaga

SEQ ID NO: 262850 - DNA, 25 bp, Mus musculus
tcaccaggcggtgataccaggaggt

SEQ ID NO: 262851 - DNA, 25 bp, Mus musculus
gagatcggggctactccggtataca

SEQ ID NO: 262852 - DNA, 25 bp, Mus musculus
cgggctcacccgtgagagcgagatc

SEQ ID NO: 262853 - DNA, 25 bp, Mus musculus
agcaccgcgagaatgcgcacgctct

SEQ ID NO: 262854 - DNA, 25 bp, Mus musculus
ttctccaagcagcaatccggctcta

SEQ ID NO: 262855 - DNA, 25 bp, Mus musculus
gggcgcaaagatgccggccgtatcc

SEQ ID NO: 262856 - DNA, 25 bp, Mus musculus
ccggtatacattggaaggatccttc

SEQ ID NO: 262857 - DNA, 25 bp, Mus musculus
ataccaggaggtgtagcgcctgcgc

SEQ ID NO: 262858 - DNA, 25 bp, Mus musculus
tggaaggatccttcaccaggcggtg

SEQ ID NO: 262859 - DNA, 25 bp, Mus musculus
tccgacatccgcaactgtgagtgcc

SEQ ID NO: 262860 - DNA, 25 bp, Mus musculus
ggcctagcggtcttcatctccgaca

SEQ ID NO: 262861 - DNA, 25 bp, Mus musculus
acagctccggttctccaagcagcaa

SEQ ID NO: 262862 - DNA, 25 bp, Mus musculus
agaatgcgcacgctctcttgcaccg

SEQ ID NO: 262863 - DNA, 25 bp, Mus musculus
tccgcaactgtgagtgccagacgcc

SEQ ID NO: 262864 - DNA, 25 bp, Mus musculus
ctgcaaactttctagcgcgattccc

SEQ ID NO: 262865 - DNA, 25 bp, Mus musculus
cgggaattccgaggggcggagcacg

SEQ ID NO: 262866 - DNA, 25 bp, Mus musculus
gcaagccacgcgcatccgctttttg

SEQ ID NO: 262867 - DNA, 25 bp, Mus musculus
atgggagcggcttcgcgcccttaac

SEQ ID NO: 262868 - DNA, 25 bp, Mus musculus
tcctcccagctagatccaccgccta

SEQ ID NO: 262869 - DNA, 25 bp, Mus musculus
tgctgcaaactttctagcgcgattc

SEQ ID NO: 262870 - DNA, 25 bp, Mus musculus
agttgctgcaaactttctagcgcga

SEQ ID NO: 262871 - DNA, 25 bp, Mus musculus
gctttttggaccgacactccagaaa

SEQ ID NO: 262872 - DNA, 25 bp, Mus musculus
ccgctttttggaccgacactccaga

SEQ ID NO: 262873 - DNA, 25 bp, Mus musculus
gcatccgctttttggaccgacactc

SEQ ID NO: 262874 - DNA, 25 bp, Mus musculus
cgcgcatccgctttttggaccgaca

SEQ ID NO: 262875 - DNA, 25 bp, Mus musculus
cacgcgcatccgctttttggaccga

SEQ ID NO: 262876 - DNA, 25 bp, Mus musculus
aagccacgcgcatccgctttttgga

SEQ ID NO: 262877 - DNA, 25 bp, Mus musculus
tagatccaccgcctacccgcggggc

SEQ ID NO: 262878 - DNA, 25 bp, Mus musculus
acccgcgtgcccgtggagtcgtacg

SEQ ID NO: 262879 - DNA, 25 bp, Mus musculus
gacctgagaactggaggaccgcctc

SEQ ID NO: 262880 - DNA, 25 bp, Mus musculus
cgcattcacgtctttctgtcttaag

SEQ ID NO: 262881 - DNA, 25 bp, Mus musculus
tctgtcttaagcgagccgaatgtga

SEQ ID NO: 262882 - DNA, 25 bp, Mus musculus
ccgaatgtgagaggctgctgacctc

SEQ ID NO: 262883 - DNA, 25 bp, Mus musculus
tgccgtaagtagctagtggcccgtg

SEQ ID NO: 262884 - DNA, 25 bp, Mus musculus
ggaccgcctcactctgccgtaagta

SEQ ID NO: 262885 - DNA, 25 bp, Mus musculus
gctctcacgcaggaggccgacctga

SEQ ID NO: 262886 - DNA, 25 bp, Mus musculus
gagttctcgcgccagtgctctcacg

SEQ ID NO: 262887 - DNA, 25 bp, Mus musculus
gtgcagcaccctggctgagttctcg

SEQ ID NO: 262888 - DNA, 25 bp, Mus musculus
cgaccgctgccagtgtccgaagggt

SEQ ID NO: 262889 - DNA, 25 bp, Mus musculus
ctgcatgcacgaccgctgccagtgt

SEQ ID NO: 262890 - DNA, 25 bp, Mus musculus
ttcgaggactgccagacccgcgtgc

SEQ ID NO: 262891 - DNA, 25 bp, Mus musculus
tggagtcgtacgtgcgcgcctgcat

SEQ ID NO: 262892 - DNA, 25 bp, Mus musculus
aaaggaatgtcctccgaccagccca

SEQ ID NO: 262893 - DNA, 25 bp, Mus musculus
ccggaaacgagaaggagacgctcta

SEQ ID NO: 262894 - DNA, 25 bp, Mus musculus
agcctgacgaaaccggctgggactg

SEQ ID NO: 262895 - DNA, 25 bp, Mus musculus
cgacaagccgctcaggtggacctga

SEQ ID NO: 262896 - DNA, 25 bp, Mus musculus
aggtggacctgagtgcaaatctgcc

SEQ ID NO: 262897 - DNA, 25 bp, Mus musculus
tccgcactacctgaactcacgagtt

SEQ ID NO: 262898 - DNA, 25 bp, Mus musculus
cccaggctgcagagcgaccggaaac

SEQ ID NO: 262899 - DNA, 25 bp, Mus musculus
cgaccaccgtgtctcacagagggga

SEQ ID NO: 262900 - DNA, 25 bp, Mus musculus
acgctctagctgacactcgggaaca

SEQ ID NO: 262901 - DNA, 25 bp, Mus musculus
tcggtgatgactggccgcgaagaac

SEQ ID NO: 262902 - DNA, 25 bp, Mus musculus
taccgaccaggcacggacgattgca

SEQ ID NO: 262903 - DNA, 25 bp, Mus musculus
gacgattgcagaagggactcccagg

SEQ ID NO: 262904 - DNA, 25 bp, Mus musculus
acttgttcgttcgtttgcgagtccg

SEQ ID NO: 262905 - DNA, 25 bp, Mus musculus
tcccaggaccagtgccggaagctga

SEQ ID NO: 262906 - DNA, 25 bp, Mus musculus
tgcctcgccaactgcacagagaccc

SEQ ID NO: 262907 - DNA, 25 bp, Mus musculus
atagacgagagtcgctgctccgggt

SEQ ID NO: 262908 - DNA, 25 bp, Mus musculus
aatgggtctcccgtacacgcctgcg

SEQ ID NO: 262909 - DNA, 25 bp, Mus musculus
agtggctcccttcgggcgctcagca

SEQ ID NO: 262910 - DNA, 25 bp, Mus musculus
cccagagcactcaccggcccgcgct

SEQ ID NO: 262911 - DNA, 25 bp, Mus musculus
cgggagagctcttccgctcccacca

SEQ ID NO: 262912 - DNA, 25 bp, Mus musculus
cacaagctgcgtcgccgaccgttgt

SEQ ID NO: 262913 - DNA, 25 bp, Mus musculus
cgaggcaatcggctcttcagtcagc

SEQ ID NO: 262914 - DNA, 25 bp, Mus musculus
gctcttcagtcagctgacagtcgcc

SEQ ID NO: 262915 - DNA, 25 bp, Mus musculus
cgcacgcgtgttccgacctcagggg

SEQ ID NO: 262916 - DNA, 25 bp, Mus musculus
cggcgttcccaaagcacagagcttg

SEQ ID NO: 262917 - DNA, 25 bp, Mus musculus
cacagagcttggcaatagctggccc

SEQ ID NO: 262918 - DNA, 25 bp, Mus musculus
gccgaccgttgtcccgcgaggcaat

SEQ ID NO: 262919 - DNA, 25 bp, Mus musculus
gctaatccgcgcacgcgtgttccga

SEQ ID NO: 262920 - DNA, 25 bp, Mus musculus
tcgcgagggcggaaaactccttcca

SEQ ID NO: 262921 - DNA, 25 bp, Mus musculus
aaggtctgcttcctgcgccgtccgg

SEQ ID NO: 262922 - DNA, 25 bp, Mus musculus
gtcttcccaaggtctgcttcctgcg

SEQ ID NO: 262923 - DNA, 25 bp, Mus musculus
tggacgtcttcccaaggtctgcttc

SEQ ID NO: 262924 - DNA, 25 bp, Mus musculus
tttatatgaaaaacgctcgcgaggg

SEQ ID NO: 262925 - DNA, 25 bp, Mus musculus
ctagaccaaggcgaccacatggacg

SEQ ID NO: 262926 - DNA, 25 bp, Mus musculus
cgccgtccggcattcgttttaatga

SEQ ID NO: 262927 - DNA, 25 bp, Mus musculus
tggcccagcgcgctcttagagactg

SEQ ID NO: 262928 - DNA, 25 bp, Mus musculus
gcgaccacatggacgtcttcccaag

SEQ ID NO: 262929 - DNA, 25 bp, Mus musculus
tgacaaggcaccaggcagctaaagc

SEQ ID NO: 262930 - DNA, 25 bp, Mus musculus
ccaatctcgcttttcctggcccagc

SEQ ID NO: 262931 - DNA, 25 bp, Mus musculus
ccagcgcgctcttagagactggcgg

SEQ ID NO: 262932 - DNA, 25 bp, Mus musculus
tcgttttaatgacaaggcaccaggc

SEQ ID NO: 262933 - DNA, 25 bp, Mus musculus
cagctaaagcactctccggaggctc

SEQ ID NO: 262934 - DNA, 25 bp, Mus musculus
ccgtctgccgcgttaataggcgtgc

SEQ ID NO: 262935 - DNA, 25 bp, Mus musculus
gccagggagaccgtgctgaccggcc

SEQ ID NO: 262936 - DNA, 25 bp, Mus musculus
ccggcggccgcgaacaatgggcggc

SEQ ID NO: 262937 - DNA, 25 bp, Mus musculus
ccgccgcactcctgggtcccgcggt

SEQ ID NO: 262938 - DNA, 25 bp, Mus musculus
ctcagcccaccggttgcaggagggc

SEQ ID NO: 262939 - DNA, 25 bp, Mus musculus
ccctaccggctggagaagacgctgg

SEQ ID NO: 262940 - DNA, 25 bp, Mus musculus
ggccctaccggctggagaagacgct

SEQ ID NO: 262941 - DNA, 25 bp, Mus musculus
agcccaaggacatgcagcgcggcct

SEQ ID NO: 262942 - DNA, 25 bp, Mus musculus
catctgccgtctgccgcgttaatag

SEQ ID NO: 262943 - DNA, 25 bp, Mus musculus
gagcagctgcgtcccggccgcatga

SEQ ID NO: 262944 - DNA, 25 bp, Mus musculus
acgcgcagtatgtggggccctaccg

SEQ ID NO: 262945 - DNA, 25 bp, Mus musculus
cagcacgcgcagtatgtggggccct

SEQ ID NO: 262946 - DNA, 25 bp, Mus musculus
gccgcgttaataggcgtgctgcctg

SEQ ID NO: 262947 - DNA, 25 bp, Mus musculus
gactcctggcagtcccgctgcaggt

SEQ ID NO: 262948 - DNA, 25 bp, Mus musculus
taaattggaagaaagtcacttgggc

SEQ ID NO: 262949 - DNA, 25 bp, Mus musculus
gaaggccggctctctctgtggtcca

SEQ ID NO: 262950 - DNA, 25 bp, Mus musculus
cggcttgctgggacgcgtagtccca

SEQ ID NO: 262951 - DNA, 25 bp, Mus musculus
agccctcgtactgccgaagccgaag

SEQ ID NO: 262952 - DNA, 25 bp, Mus musculus
cacagggtcgagaaccgagccgccg

SEQ ID NO: 262953 - DNA, 25 bp, Mus musculus
ctcactctcctcaaaagtaaattgg

SEQ ID NO: 262954 - DNA, 25 bp, Mus musculus
tcacttgggcggaagaactttcgca

SEQ ID NO: 262955 - DNA, 25 bp, Mus musculus
ccgcgaagaccgacgaccgacagtg

SEQ ID NO: 262956 - DNA, 25 bp, Mus musculus
gaccgacagtgccaggtgcccgact

SEQ ID NO: 262957 - DNA, 25 bp, Mus musculus
atgagccagtccatggctgcgcgga

SEQ ID NO: 262958 - DNA, 25 bp, Mus musculus
cggcggccggaagtaaacactcgat

SEQ ID NO: 262959 - DNA, 25 bp, Mus musculus
cggacaccgccacagggtcgagaac

SEQ ID NO: 262960 - DNA, 25 bp, Mus musculus
aagtaaacactcgatggctcccgcc

SEQ ID NO: 262961 - DNA, 25 bp, Mus musculus
ctgtggtccagcaggattatacgga

SEQ ID NO: 262962 - DNA, 25 bp, Mus musculus
aaagttcaggcccagaccatgcgcg

SEQ ID NO: 262963 - DNA, 25 bp, Mus musculus
gtccaggtgcgcctgcacttacccg

SEQ ID NO: 262964 - DNA, 25 bp, Mus musculus
tgatgtccagggaaaaggaacgctt

SEQ ID NO: 262965 - DNA, 25 bp, Mus musculus
gcggagaacacagcgcctggaccct

SEQ ID NO: 262966 - DNA, 25 bp, Mus musculus
tccagggaaaaggaacgcttgaggc

SEQ ID NO: 262967 - DNA, 25 bp, Mus musculus
ggcactctggaacggagtccgggct

SEQ ID NO: 262968 - DNA, 25 bp, Mus musculus
cccagacgggctgtccagcttgcag

SEQ ID NO: 262969 - DNA, 25 bp, Mus musculus
cagcttgcagagcttcggggcttca

SEQ ID NO: 262970 - DNA, 25 bp, Mus musculus
cttgcagagcttcggggcttcaccg

SEQ ID NO: 262971 - DNA, 25 bp, Mus musculus
aaagtcgggcctcctgctgggtgca

SEQ ID NO: 262972 - DNA, 25 bp, Mus musculus
cctcctgctgggtgcataggccgac

SEQ ID NO: 262973 - DNA, 25 bp, Mus musculus
ggtgcataggccgacttgatgtcca

SEQ ID NO: 262974 - DNA, 25 bp, Mus musculus
aggccgacttgatgtccagggaaaa

SEQ ID NO: 262975 - DNA, 25 bp, Mus musculus
tacccggccaaaggcggagaacaca

SEQ ID NO: 262976 - DNA, 25 bp, Mus musculus
acgggacagccatgcgagtcgaaga

SEQ ID NO: 262977 - DNA, 25 bp, Mus musculus
tccagataaggagcctaccgcaggc

SEQ ID NO: 262978 - DNA, 25 bp, Mus musculus
ggacgaccttctccaaatctggctg

SEQ ID NO: 262979 - DNA, 25 bp, Mus musculus
gggactctcaccgatctgtgctgga

SEQ ID NO: 262980 - DNA, 25 bp, Mus musculus
cccgcgaatccctaggtctcttata

SEQ ID NO: 262981 - DNA, 25 bp, Mus musculus
ggtctcttatatatatccctccaga

SEQ ID NO: 262982 - DNA, 25 bp, Mus musculus
tccctccagataagaaggaatatgc

SEQ ID NO: 262983 - DNA, 25 bp, Mus musculus
tatgccgagaaagacagcgcactgc

SEQ ID NO: 262984 - DNA, 25 bp, Mus musculus
tcgcggggcagagccatttattctc

SEQ ID NO: 262985 - DNA, 25 bp, Mus musculus
tattctcggtgctccaaagagcttc

SEQ ID NO: 262986 - DNA, 25 bp, Mus musculus
ggggtcctatagcttcctctccaga

SEQ ID NO: 262987 - DNA, 25 bp, Mus musculus
tgaggtcatgccgagcgaaaaagcc

SEQ ID NO: 262988 - DNA, 25 bp, Mus musculus
ggcttaggactcgaccgctgtcagc

SEQ ID NO: 262989 - DNA, 25 bp, Mus musculus
aaagagcttcttccttcagggcaca

SEQ ID NO: 262990 - DNA, 25 bp, Mus musculus
tctttaaaagagactatccttgccc

SEQ ID NO: 262991 - DNA, 25 bp, Mus musculus
gctcgcttcactccaaaattcttta

SEQ ID NO: 262992 - DNA, 25 bp, Mus musculus
acgagagctgctagctacgacccgc

SEQ ID NO: 262993 - DNA, 25 bp, Mus musculus
gcgtaaaaaagaaagctccgcgagc

SEQ ID NO: 262994 - DNA, 25 bp, Mus musculus
ttgatgctaaagacaagctcgcgtc

SEQ ID NO: 262995 - DNA, 25 bp, Mus musculus
gtaattactcgctccacgagagctg

SEQ ID NO: 262996 - DNA, 25 bp, Mus musculus
agtacgcccgcctttccacagagct

SEQ ID NO: 262997 - DNA, 25 bp, Mus musculus
gcccgagcgattgccgggcgcttca

SEQ ID NO: 262998 - DNA, 25 bp, Mus musculus
ggtccctactctcattgatgctaaa

SEQ ID NO: 262999 - DNA, 25 bp, Mus musculus
ctgccggtccctactctcattgatg

SEQ ID NO: 263000 - DNA, 25 bp, Mus musculus
gctcgcgtctcaggtagcaggatta

SEQ ID NO: 263001 - DNA, 25 bp, Mus musculus
caggtagcaggattacaagaagttt

SEQ ID NO: 263002 - DNA, 25 bp, Mus musculus
agaagttttagagctccagcaacag

SEQ ID NO: 263003 - DNA, 25 bp, Mus musculus
tagagctccagcaacagtacgcccg

SEQ ID NO: 263004 - DNA, 25 bp, Mus musculus
gctgcagccagagcctgactcacgg

SEQ ID NO: 263005 - DNA, 25 bp, Mus musculus
tgtctgtccgctgatcgcgtcccag

SEQ ID NO: 263006 - DNA, 25 bp, Mus musculus
tcacggcggcgtcgcagacacctcc

SEQ ID NO: 263007 - DNA, 25 bp, Mus musculus
gtccttccgctctcccgctgtctgt

SEQ ID NO: 263008 - DNA, 25 bp, Mus musculus
tctgcgccaccaggcgcacccggcg

SEQ ID NO: 263009 - DNA, 25 bp, Mus musculus
gatcgcgtcccagcggcccaacctt

SEQ ID NO: 263010 - DNA, 25 bp, Mus musculus
cctgaacctaggagcgcgcgtcctt

SEQ ID NO: 263011 - DNA, 25 bp, Mus musculus
gcgactcgacgagtgggtcagaccc

SEQ ID NO: 263012 - DNA, 25 bp, Mus musculus
tcacctactggcgactcgacgagtg

SEQ ID NO: 263013 - DNA, 25 bp, Mus musculus
ggctgaactgggtggtccccaatct

SEQ ID NO: 263014 - DNA, 25 bp, Mus musculus
atagcaaggggctgtggctgaactg

SEQ ID NO: 263015 - DNA, 25 bp, Mus musculus
cacccggcgccggtgaggtgatagc

SEQ ID NO: 263016 - DNA, 25 bp, Mus musculus
gagcctgactcacggcggcgtcgca

SEQ ID NO: 263017 - DNA, 25 bp, Mus musculus
ggctgcagcagtcaccagtaccgct

SEQ ID NO: 263018 - DNA, 25 bp, Mus musculus
agtcttcatggtcgcggcggcccga

SEQ ID NO: 263019 - DNA, 25 bp, Mus musculus
tcgccggcttataggcaggatgacg

SEQ ID NO: 263020 - DNA, 25 bp, Mus musculus
tataggcaggatgacgccgcagtcc

SEQ ID NO: 263021 - DNA, 25 bp, Mus musculus
atgacgccgcagtcccgcggagtca

SEQ ID NO: 263022 - DNA, 25 bp, Mus musculus
cgcggagtcagctgacccgcttgtt

SEQ ID NO: 263023 - DNA, 25 bp, Mus musculus
gctgacccgcttgtttggccctcaa

SEQ ID NO: 263024 - DNA, 25 bp, Mus musculus
gtttggccctcaacgggtcacgtga

SEQ ID NO: 263025 - DNA, 25 bp, Mus musculus
agcacgcggcactccaggtgacgag

SEQ ID NO: 263026 - DNA, 25 bp, Mus musculus
gcgggtcctcacctgataatcgcga

SEQ ID NO: 263027 - DNA, 25 bp, Mus musculus
cctgataatcgcgaaggaggacgaa

SEQ ID NO: 263028 - DNA, 25 bp, Mus musculus
caagacgccgggagtcttcatggtc

SEQ ID NO: 263029 - DNA, 25 bp, Mus musculus
cggcccgaagagagcaaagcttaaa

SEQ ID NO: 263030 - DNA, 25 bp, Mus musculus
cttaaagccagaggtcgccggctta

SEQ ID NO: 263031 - DNA, 25 bp, Mus musculus
gccgagaatgagcagcaagacgccg

SEQ ID NO: 263032 - DNA, 25 bp, Mus musculus
gctatcccacgcctgacgagaagcg

SEQ ID NO: 263033 - DNA, 25 bp, Mus musculus
gaggtgcccactggccttcgcttct

SEQ ID NO: 263034 - DNA, 25 bp, Mus musculus
gcttctcgcccgaacaggtggcatg

SEQ ID NO: 263035 - DNA, 25 bp, Mus musculus
ctacgtggcagcgatccggtgctgc

SEQ ID NO: 263036 - DNA, 25 bp, Mus musculus
ccttccagcggggtgaatacgccga

SEQ ID NO: 263037 - DNA, 25 bp, Mus musculus
gccgagctctaccaacttctcgaga

SEQ ID NO: 263038 - DNA, 25 bp, Mus musculus
caaataccggctgcgcaagaagttc

SEQ ID NO: 263039 - DNA, 25 bp, Mus musculus
aggagaccgtctattgcttcaagga

SEQ ID NO: 263040 - DNA, 25 bp, Mus musculus
ggcctctcgcttacacaggtcagca

SEQ ID NO: 263041 - DNA, 25 bp, Mus musculus
accggcggtggagcgccttgcaaaa

SEQ ID NO: 263042 - DNA, 25 bp, Mus musculus
ctccttcctcggtggccgctggagt

SEQ ID NO: 263043 - DNA, 25 bp, Mus musculus
gagtctgcgcaagtgacccttcaca

SEQ ID NO: 263044 - DNA, 25 bp, Mus musculus
tcacatccctcttcggtggcgtcgg

SEQ ID NO: 263045 - DNA, 25 bp, Mus musculus
tctgcccaagaccatctgggatggc

SEQ ID NO: 263046 - DNA, 25 bp, Mus musculus
ctgagtccaaacaggtatcgtgccc

SEQ ID NO: 263047 - DNA, 25 bp, Mus musculus
gccgccagtagccactgagtccaaa

SEQ ID NO: 263048 - DNA, 25 bp, Mus musculus
tcgcagtcatgcaggccggacccgt

SEQ ID NO: 263049 - DNA, 25 bp, Mus musculus
cagccctgagcgtcgcagtcatgca

SEQ ID NO: 263050 - DNA, 25 bp, Mus musculus
ccggttgtcgccaccgaggtggact

SEQ ID NO: 263051 - DNA, 25 bp, Mus musculus
taatcttgtcgtcgcaccggttgtc

SEQ ID NO: 263052 - DNA, 25 bp, Mus musculus
ggatacttcgtgtggtgatctttaa

SEQ ID NO: 263053 - DNA, 25 bp, Mus musculus
cgccgccatcttgtcattgagttgg

SEQ ID NO: 263054 - DNA, 25 bp, Mus musculus
tggcaacggcgtaccgcgccacgga

SEQ ID NO: 263055 - DNA, 25 bp, Mus musculus
ggccgctgccttggcaacggcgtac

SEQ ID NO: 263056 - DNA, 25 bp, Mus musculus
actctaagttgggagcccaggccgc

SEQ ID NO: 263057 - DNA, 25 bp, Mus musculus
gagaatgcctcgcaactctaagttg

SEQ ID NO: 263058 - DNA, 25 bp, Mus musculus
tctgaggctccgagaatgcctcgca

SEQ ID NO: 263059 - DNA, 25 bp, Mus musculus
tgcctgcaggcctgctggaggcctc

SEQ ID NO: 263060 - DNA, 25 bp, Mus musculus
ggacaccgaaagtgcggggccctgc

SEQ ID NO: 263061 - DNA, 25 bp, Mus musculus
gcggggctgttcactgtttttatgg

SEQ ID NO: 263062 - DNA, 25 bp, Mus musculus
ggctgttcactgtttttatggctga

SEQ ID NO: 263063 - DNA, 25 bp, Mus musculus
tcactgtttttatggctgagaggcg

SEQ ID NO: 263064 - DNA, 25 bp, Mus musculus
cgcaagcagcttacggtgcacgggt

SEQ ID NO: 263065 - DNA, 25 bp, Mus musculus
tgacccgcggaacgggctaagcagc

SEQ ID NO: 263066 - DNA, 25 bp, Mus musculus
gggtgtcgctccttcctgaccagga

SEQ ID NO: 263067 - DNA, 25 bp, Mus musculus
tccttcctgaccaggaggtgcggct

SEQ ID NO: 263068 - DNA, 25 bp, Mus musculus
cgcggaatgtgttgtgagtaaagtc

SEQ ID NO: 263069 - DNA, 25 bp, Mus musculus
tgttgtgagtaaagtcgtgacccgc

SEQ ID NO: 263070 - DNA, 25 bp, Mus musculus
aaacccgccagggtccacgcggcag

SEQ ID NO: 263071 - DNA, 25 bp, Mus musculus
tgagtaaagtcgtgacccgcggaac

SEQ ID NO: 263072 - DNA, 25 bp, Mus musculus
cggtgcgcaagcagcttacggtgca

SEQ ID NO: 263073 - DNA, 25 bp, Mus musculus
cggaacgggctaagcagcccaggtc

SEQ ID NO: 263074 - DNA, 25 bp, Mus musculus
acctgtgctcagttagagggttaca

SEQ ID NO: 263075 - DNA, 25 bp, Mus musculus
tcccggccgactgagttaaggcgca

SEQ ID NO: 263076 - DNA, 25 bp, Mus musculus
cctgggtgtctatccctaaaaatcg

SEQ ID NO: 263077 - DNA, 25 bp, Mus musculus
ggttctcacagggacctacttgcta

SEQ ID NO: 263078 - DNA, 25 bp, Mus musculus
tacttgctaagcaggggacagtccc

SEQ ID NO: 263079 - DNA, 25 bp, Mus musculus
gcacctcgaatagcagccagataga

SEQ ID NO: 263080 - DNA, 25 bp, Mus musculus
gcctgggatctcctagcagcctttg

SEQ ID NO: 263081 - DNA, 25 bp, Mus musculus
ggctggcttggccacgccaaatctg

SEQ ID NO: 263082 - DNA, 25 bp, Mus musculus
ggcgggaaacgtagctcaaaccaga

SEQ ID NO: 263083 - DNA, 25 bp, Mus musculus
cccagtatgagcagataacagttcc

SEQ ID NO: 263084 - DNA, 25 bp, Mus musculus
tcccatgtcatgtttccggggtgcc

SEQ ID NO: 263085 - DNA, 25 bp, Mus musculus
cccaggggccaatgcgataattccg

SEQ ID NO: 263086 - DNA, 25 bp, Mus musculus
tccgcacctctaggcctctaaaggg

SEQ ID NO: 263087 - DNA, 25 bp, Mus musculus
cctaacctctgctttgcctgggatc

SEQ ID NO: 263088 - DNA, 25 bp, Mus musculus
ttttcgttctttcgccttctagcca

SEQ ID NO: 263089 - DNA, 25 bp, Mus musculus
tgccaaggaactcacacggagcagg

SEQ ID NO: 263090 - DNA, 25 bp, Mus musculus
aactcacacggagcaggggcgccct

SEQ ID NO: 263091 - DNA, 25 bp, Mus musculus
acgcagattgggagcacggacgcca

SEQ ID NO: 263092 - DNA, 25 bp, Mus musculus
attgggagcacggacgccacagagc

SEQ ID NO: 263093 - DNA, 25 bp, Mus musculus
gccagcttcatttttcgttctttcg

SEQ ID NO: 263094 - DNA, 25 bp, Mus musculus
gatccgcggtgccaaggaactcaca

SEQ ID NO: 263095 - DNA, 25 bp, Mus musculus
tcgccttctagccaacgagagggtt

SEQ ID NO: 263096 - DNA, 25 bp, Mus musculus
tctagccaacgagagggtttgggta

SEQ ID NO: 263097 - DNA, 25 bp, Mus musculus
ctcagacgccgcgagcctaggcgaa

SEQ ID NO: 263098 - DNA, 25 bp, Mus musculus
agactcgtccctagctcagttttgg

SEQ ID NO: 263099 - DNA, 25 bp, Mus musculus
tcgtccctagctcagttttggggcc

SEQ ID NO: 263100 - DNA, 25 bp, Mus musculus
gctaacacacgcctatccggccgtg

SEQ ID NO: 263101 - DNA, 25 bp, Mus musculus
gcgcccgagccagcttcatttttcg

SEQ ID NO: 263102 - DNA, 25 bp, Mus musculus
tggcgtacacattctgcaaagctga

SEQ ID NO: 263103 - DNA, 25 bp, Mus musculus
gcagctgctttcctccgacgagtag

SEQ ID NO: 263104 - DNA, 25 bp, Mus musculus
cgaatgtactctaccgcggagcgca

SEQ ID NO: 263105 - DNA, 25 bp, Mus musculus
tactcagcttcttgttggcgccgcc

SEQ ID NO: 263106 - DNA, 25 bp, Mus musculus
agcccaagtttaccagctttacgcg

SEQ ID NO: 263107 - DNA, 25 bp, Mus musculus
agcgcagcaattccggagacgcttg

SEQ ID NO: 263108 - DNA, 25 bp, Mus musculus
gcaggctccagcgactccagacgag

SEQ ID NO: 263109 - DNA, 25 bp, Mus musculus
ccctgctacgagttctggtgcggca

SEQ ID NO: 263110 - DNA, 25 bp, Mus musculus
ctggtgcggcacaggaaaagtgctc

SEQ ID NO: 263111 - DNA, 25 bp, Mus musculus
agtggacgtttgcaccttcacgggc

SEQ ID NO: 263112 - DNA, 25 bp, Mus musculus
actgctgcaggactccctagggcac

SEQ ID NO: 263113 - DNA, 25 bp, Mus musculus
cccgtaccagtcaaggtctgaaaga

SEQ ID NO: 263114 - DNA, 25 bp, Mus musculus
tacgcggctcaagcggctccttttt

SEQ ID NO: 263115 - DNA, 25 bp, Mus musculus
cgctgcagcgcacgaatgtactcta

SEQ ID NO: 263116 - DNA, 25 bp, Mus musculus
ttcgtcttctgggtgagcagccact

SEQ ID NO: 263117 - DNA, 25 bp, Mus musculus
caacgcagttctccggcccgcaagc

SEQ ID NO: 263118 - DNA, 25 bp, Mus musculus
gcgtccttgcttcaaagagatagtg

SEQ ID NO: 263119 - DNA, 25 bp, Mus musculus
agagatagtgactctcgcgcctccg

SEQ ID NO: 263120 - DNA, 25 bp, Mus musculus
tacgtctcattctccgcaacgcagt

SEQ ID NO: 263121 - DNA, 25 bp, Mus musculus
agcgagcgcgtccttgcttcaaaga

SEQ ID NO: 263122 - DNA, 25 bp, Mus musculus
aagcgctccaggctatctgccagtc

SEQ ID NO: 263123 - DNA, 25 bp, Mus musculus
gcccgctccaggaccaatccaagct

SEQ ID NO: 263124 - DNA, 25 bp, Mus musculus
gtggagggctgcaccaaatgcatca

SEQ ID NO: 263125 - DNA, 25 bp, Mus musculus
cgtcttcaatttcgtcttctgggtg

SEQ ID NO: 263126 - DNA, 25 bp, Mus musculus
aggcgcagcgcaaccgcgaagttgc

SEQ ID NO: 263127 - DNA, 25 bp, Mus musculus
ctgcaccaaatgcatcaaatacctg

SEQ ID NO: 263128 - DNA, 25 bp, Mus musculus
ctataaagagtgaggagctaggcgc

SEQ ID NO: 263129 - DNA, 25 bp, Mus musculus
ggcgggacctagaggtctataaaga

SEQ ID NO: 263130 - DNA, 25 bp, Mus musculus
aactggttggcgctcacagtgcgtg

SEQ ID NO: 263131 - DNA, 25 bp, Mus musculus
attgtgggaaccgtggctccgcctt

SEQ ID NO: 263132 - DNA, 25 bp, Mus musculus
cagttagccctggagtattgtggga

SEQ ID NO: 263133 - DNA, 25 bp, Mus musculus
gcgattggcagttagccctggagta

SEQ ID NO: 263134 - DNA, 25 bp, Mus musculus
accctttgcgattggcagttagccc

SEQ ID NO: 263135 - DNA, 25 bp, Mus musculus
agctgcaggcctcaaccctttgcga

SEQ ID NO: 263136 - DNA, 25 bp, Mus musculus
ggcgaagctgcaggcctcaaccctt

SEQ ID NO: 263137 - DNA, 25 bp, Mus musculus
acggcttccgacaggcgaagctgca

SEQ ID NO: 263138 - DNA, 25 bp, Mus musculus
gacgcacttcctccttgtgtcggac

SEQ ID NO: 263139 - DNA, 25 bp, Mus musculus
ctcacagtgcgtggtgacgcacttc

SEQ ID NO: 263140 - DNA, 25 bp, Mus musculus
tctaggaaactggttggcgctcaca

SEQ ID NO: 263141 - DNA, 25 bp, Mus musculus
cagggccggaaatgtctaggaaact

SEQ ID NO: 263142 - DNA, 25 bp, Mus musculus
cgcccagggccggaaatgtctagga

SEQ ID NO: 263143 - DNA, 25 bp, Mus musculus
tggtgacgcacttcctccttgtgtc

SEQ ID NO: 263144 - DNA, 25 bp, Mus musculus
cttctgacaccgtctccctcagcga

SEQ ID NO: 263145 - DNA, 25 bp, Mus musculus
gaggatgacaccctgccttctgaca

SEQ ID NO: 263146 - DNA, 25 bp, Mus musculus
cctggaggctgatgaacccaccgag

SEQ ID NO: 263147 - DNA, 25 bp, Mus musculus
gaggcctcccgtccggctgtgagta

SEQ ID NO: 263148 - DNA, 25 bp, Mus musculus
tttaaccacccagcttcgcgaggcc

SEQ ID NO: 263149 - DNA, 25 bp, Mus musculus
ccggctgtgagtagaggcacttgac

SEQ ID NO: 263150 - DNA, 25 bp, Mus musculus
tgagtagaggcacttgacacatagt

SEQ ID NO: 263151 - DNA, 25 bp, Mus musculus
ggcacttgacacatagtggaggtga

SEQ ID NO: 263152 - DNA, 25 bp, Mus musculus
tgacacatagtggaggtgaaagacg

SEQ ID NO: 263153 - DNA, 25 bp, Mus musculus
gagggatgaggccttaaatacaccc

SEQ ID NO: 263154 - DNA, 25 bp, Mus musculus
gctgatgaacccaccgaggatgaca

SEQ ID NO: 263155 - DNA, 25 bp, Mus musculus
ccctcacggcggaactgggactgct

SEQ ID NO: 263156 - DNA, 25 bp, Mus musculus
aactgggactgcttcgctacaggtg

SEQ ID NO: 263157 - DNA, 25 bp, Mus musculus
tgtcaggtcgtatggcggagacaga

SEQ ID NO: 263158 - DNA, 25 bp, Mus musculus
tcccttctcactggagctggccgaa

SEQ ID NO: 263159 - DNA, 25 bp, Mus musculus
tgtgagtaacctccctgcacgcacg

SEQ ID NO: 263160 - DNA, 25 bp, Mus musculus
cttcaccgtgtgagtaacctccctg

SEQ ID NO: 263161 - DNA, 25 bp, Mus musculus
gtgtttcgtgtaccacttcaccgtg

SEQ ID NO: 263162 - DNA, 25 bp, Mus musculus
catccagggccgagtctacaacttc

SEQ ID NO: 263163 - DNA, 25 bp, Mus musculus
gggcagcacggtctatgcgcccatc

SEQ ID NO: 263164 - DNA, 25 bp, Mus musculus
gcccggaacgcggagatagcctgac

SEQ ID NO: 263165 - DNA, 25 bp, Mus musculus
cggtggtcaagaagtgtcccttctc

SEQ ID NO: 263166 - DNA, 25 bp, Mus musculus
cccgcccagtgctgaaaggaagcgc

SEQ ID NO: 263167 - DNA, 25 bp, Mus musculus
aggggtcctgtctggccatggacac

SEQ ID NO: 263168 - DNA, 25 bp, Mus musculus
tggcagcagtggctacccgcgctgc

SEQ ID NO: 263169 - DNA, 25 bp, Mus musculus
taacccgctggctgagcaaggccgc

SEQ ID NO: 263170 - DNA, 25 bp, Mus musculus
cggagatagcctgacttggcttggc

SEQ ID NO: 263171 - DNA, 25 bp, Mus musculus
tgacccgcgggtctccatctacagt

SEQ ID NO: 263172 - DNA, 25 bp, Mus musculus
acaaagatggggacgtggacgcaaa

SEQ ID NO: 263173 - DNA, 25 bp, Mus musculus
cgaaagcgcggcacgaatcacctct

SEQ ID NO: 263174 - DNA, 25 bp, Mus musculus
attcggtttcagctccagtgcgttc

SEQ ID NO: 263175 - DNA, 25 bp, Mus musculus
tgagccggtgtcctaggccactcac

SEQ ID NO: 263176 - DNA, 25 bp, Mus musculus
ggactcgaccgacctcggggctcaa

SEQ ID NO: 263177 - DNA, 25 bp, Mus musculus
tcggggctcaaagggcctcaagacc

SEQ ID NO: 263178 - DNA, 25 bp, Mus musculus
cctgcttctgtaagcctgggccaca

SEQ ID NO: 263179 - DNA, 25 bp, Mus musculus
tttagaatccgaaggcctgagccgg

SEQ ID NO: 263180 - DNA, 25 bp, Mus musculus
tggacgcaaaatacgagaactgagc

SEQ ID NO: 263181 - DNA, 25 bp, Mus musculus
tgagccacggccgtgaaacgaggac

SEQ ID NO: 263182 - DNA, 25 bp, Mus musculus
gaggaccgagccgtaactgcaaaac

SEQ ID NO: 263183 - DNA, 25 bp, Mus musculus
aaacgaatacggagccactgcggca

SEQ ID NO: 263184 - DNA, 25 bp, Mus musculus
cactgcggcaaaacgaagatggagc

SEQ ID NO: 263185 - DNA, 25 bp, Mus musculus
acttgtgccgtgctgactcagagaa

SEQ ID NO: 263186 - DNA, 25 bp, Mus musculus
ccgcaaggaaagctgcgcagacgtg

SEQ ID NO: 263187 - DNA, 25 bp, Mus musculus
cgcagacgtgctgaggcaactgttc

SEQ ID NO: 263188 - DNA, 25 bp, Mus musculus
gatcacacggatgaaaaccacgctg

SEQ ID NO: 263189 - DNA, 25 bp, Mus musculus
tgcaccatcatagaccacgcggagg

SEQ ID NO: 263190 - DNA, 25 bp, Mus musculus
ccgggcctgactggaccaaaatgca

SEQ ID NO: 263191 - DNA, 25 bp, Mus musculus
atgaggccgaccacaccgggcctga

SEQ ID NO: 263192 - DNA, 25 bp, Mus musculus
gtaatccaaaatgaggccgaccaca

SEQ ID NO: 263193 - DNA, 25 bp, Mus musculus
cgaggagaagcccaccgaagtaatc

SEQ ID NO: 263194 - DNA, 25 bp, Mus musculus
ctagaccgtaaccacgccgaggaga

SEQ ID NO: 263195 - DNA, 25 bp, Mus musculus
gcacactaaggtgtactagaccgta

SEQ ID NO: 263196 - DNA, 25 bp, Mus musculus
ggaccatgcagagaaaagcacacta

SEQ ID NO: 263197 - DNA, 25 bp, Mus musculus
ccacgctgggaaggaccatgcagag

SEQ ID NO: 263198 - DNA, 25 bp, Mus musculus
aaccacgctgctgagacgagccacg

SEQ ID NO: 263199 - DNA, 25 bp, Mus musculus
tgctgaggcaactgttcctcctagc

SEQ ID NO: 263200 - DNA, 25 bp, Mus musculus
ttaagctctactgccaagacgacgg

SEQ ID NO: 263201 - DNA, 25 bp, Mus musculus
tgtcagtcgaatgcggccacagctt

SEQ ID NO: 263202 - DNA, 25 bp, Mus musculus
ccagtgggtactcggagctcagccc

SEQ ID NO: 263203 - DNA, 25 bp, Mus musculus
gacccaatcgacagctggccgcggt

SEQ ID NO: 263204 - DNA, 25 bp, Mus musculus
cagcttctgccgagcctgtattatg

SEQ ID NO: 263205 - DNA, 25 bp, Mus musculus
tcccaacacggagagcaacttaagc

SEQ ID NO: 263206 - DNA, 25 bp, Mus musculus
tctgcctagagtttttccgggagcc

SEQ ID NO: 263207 - DNA, 25 bp, Mus musculus
aggcgacgtgctccatctgcctaga

SEQ ID NO: 263208 - DNA, 25 bp, Mus musculus
ccctagcggcagagctccaaggcga

SEQ ID NO: 263209 - DNA, 25 bp, Mus musculus
gtactaaggacacggatggcgactg

SEQ ID NO: 263210 - DNA, 25 bp, Mus musculus
gccacaagactcgaatgtactaagg

SEQ ID NO: 263211 - DNA, 25 bp, Mus musculus
ttggacagtagcatccagggacctc

SEQ ID NO: 263212 - DNA, 25 bp, Mus musculus
ggagctcagcccagcttggacagta

SEQ ID NO: 263213 - DNA, 25 bp, Mus musculus
tattatgcgctgctgggagcgtccc

SEQ ID NO: 263214 - DNA, 25 bp, Mus musculus
gggagctgtgtgttcccagcgcaaa

SEQ ID NO: 263215 - DNA, 25 bp, Mus musculus
cggcagctctttcttttgcagatgc

SEQ ID NO: 263216 - DNA, 25 bp, Mus musculus
tcctcaccaggtacggatgcgctca

SEQ ID NO: 263217 - DNA, 25 bp, Mus musculus
gaccacggagcagcaactgtccatc

SEQ ID NO: 263218 - DNA, 25 bp, Mus musculus
cccagcgcaaaatagactcccgttg

SEQ ID NO: 263219 - DNA, 25 bp, Mus musculus
tcactttccggatgcgggaccttca

SEQ ID NO: 263220 - DNA, 25 bp, Mus musculus
acactctgatctccaaggggctgca

SEQ ID NO: 263221 - DNA, 25 bp, Mus musculus
gggcgtctgtagagtttgaacactc

SEQ ID NO: 263222 - DNA, 25 bp, Mus musculus
tggacacgggatgccttcaaaggcc

SEQ ID NO: 263223 - DNA, 25 bp, Mus musculus
gactggtccttgcatctctggtgga

SEQ ID NO: 263224 - DNA, 25 bp, Mus musculus
cccagtgcagatgtggccgctgcca

SEQ ID NO: 263225 - DNA, 25 bp, Mus musculus
aggatggatggaactcctaggtccc

SEQ ID NO: 263226 - DNA, 25 bp, Mus musculus
atgcgctcacctcactttccggatg

SEQ ID NO: 263227 - DNA, 25 bp, Mus musculus
cagaattctgcgtcttgggcgagta

SEQ ID NO: 263228 - DNA, 25 bp, Mus musculus
cgcgcagaccgagcgaagaatggca

SEQ ID NO: 263229 - DNA, 25 bp, Mus musculus
acagctccgacacgtgctcccgctc

SEQ ID NO: 263230 - DNA, 25 bp, Mus musculus
ttggaaaagggcagtgcggcgagtg

SEQ ID NO: 263231 - DNA, 25 bp, Mus musculus
gcacgagcagaggagcgttggaaaa

SEQ ID NO: 263232 - DNA, 25 bp, Mus musculus
ccacgttcccgccacgcggtgccag

SEQ ID NO: 263233 - DNA, 25 bp, Mus musculus
ctgtggcgcgaaggcaccagagcgc

SEQ ID NO: 263234 - DNA, 25 bp, Mus musculus
cgcttcgacagtctgaaggctccgg

SEQ ID NO: 263235 - DNA, 25 bp, Mus musculus
tcccgacgcgcagaccgagcgaaga

SEQ ID NO: 263236 - DNA, 25 bp, Mus musculus
atgcagaccgcgtgcctcccgacgc

SEQ ID NO: 263237 - DNA, 25 bp, Mus musculus
tcccagggatgcagaccgcgtgcct

SEQ ID NO: 263238 - DNA, 25 bp, Mus musculus
acagtctgaaggctccggcagcggc

SEQ ID NO: 263239 - DNA, 25 bp, Mus musculus
ttcgacagtctgaaggctccggcag

SEQ ID NO: 263240 - DNA, 25 bp, Mus musculus
agggcacgggccacagctccgacac

SEQ ID NO: 263241 - DNA, 25 bp, Mus musculus
caccagagcgcctgaggcgaggcca

SEQ ID NO: 263242 - DNA, 25 bp, Mus musculus
tccggcgagctttaatgcgcagaca

SEQ ID NO: 263243 - DNA, 25 bp, Mus musculus
ttctccaaacagactgcgcgcgggg

SEQ ID NO: 263244 - DNA, 25 bp, Mus musculus
tggcccgctttcttctccaaacaga

SEQ ID NO: 263245 - DNA, 25 bp, Mus musculus
tgaatgaaaacaaattggcccgctt

SEQ ID NO: 263246 - DNA, 25 bp, Mus musculus
tcttaagtgactctgaatgaaaaca

SEQ ID NO: 263247 - DNA, 25 bp, Mus musculus
tccaaaatgggatcttaagtgactc

SEQ ID NO: 263248 - DNA, 25 bp, Mus musculus
ttcatttctccaaaatgggatctta

SEQ ID NO: 263249 - DNA, 25 bp, Mus musculus
ccggccatgtagatgagcgcggcca

SEQ ID NO: 263250 - DNA, 25 bp, Mus musculus
ttaattgcgcctccgcagatgggcc

SEQ ID NO: 263251 - DNA, 25 bp, Mus musculus
ccgcgtttaattgcgcctccgcaga

SEQ ID NO: 263252 - DNA, 25 bp, Mus musculus
cgcggaaatgctaatttcgggcgcc

SEQ ID NO: 263253 - DNA, 25 bp, Mus musculus
tcctcgcgccagatggccgcggaaa

SEQ ID NO: 263254 - DNA, 25 bp, Mus musculus
gcaggtcaatgccgcggcacactcg

SEQ ID NO: 263255 - DNA, 25 bp, Mus musculus
atgcgcagacaaagcctcatttgca

SEQ ID NO: 263256 - DNA, 25 bp, Mus musculus
ccataatagacacgaacagagttgc

SEQ ID NO: 263257 - DNA, 25 bp, Mus musculus
cgccgggactcagaatgaactccgc

SEQ ID NO: 263258 - DNA, 25 bp, Mus musculus
tgaactccgcgtggctttgaatccg

SEQ ID NO: 263259 - DNA, 25 bp, Mus musculus
aatccgggctcacatatggttggta

SEQ ID NO: 263260 - DNA, 25 bp, Mus musculus
tatggttggtaattagctggctatc

SEQ ID NO: 263261 - DNA, 25 bp, Mus musculus
tcgcccggttcgcatccataataga

SEQ ID NO: 263262 - DNA, 25 bp, Mus musculus
cagagttgcgattgttcgctgttgc

SEQ ID NO: 263263 - DNA, 25 bp, Mus musculus
tgcgtcgacgcggatttgacatatg

SEQ ID NO: 263264 - DNA, 25 bp, Mus musculus
ttgacatatggttgcgcggagccca

SEQ ID NO: 263265 - DNA, 25 bp, Mus musculus
tggatgaacggatccgggactcctg

SEQ ID NO: 263266 - DNA, 25 bp, Mus musculus
ttgtgaagcccgtgagacaatgagc

SEQ ID NO: 263267 - DNA, 25 bp, Mus musculus
ggaggcacctgctcgcctgaaaggc

SEQ ID NO: 263268 - DNA, 25 bp, Mus musculus
tgaaaggcccataaatcgccgccgg

SEQ ID NO: 263269 - DNA, 25 bp, Mus musculus
gctggctatctcttggcgttaaatg

SEQ ID NO: 263270 - DNA, 25 bp, Mus musculus
cgcgctgctcttgattctcgtcctg

SEQ ID NO: 263271 - DNA, 25 bp, Mus musculus
tggaggccaagcgttccatcgctgt

SEQ ID NO: 263272 - DNA, 25 bp, Mus musculus
cagcttcttgatcgcaccgttcgca

SEQ ID NO: 263273 - DNA, 25 bp, Mus musculus
ccatcgctgttctgctgcggaggta

SEQ ID NO: 263274 - DNA, 25 bp, Mus musculus
tacgcgctatcactgggaaggtatc

SEQ ID NO: 263275 - DNA, 25 bp, Mus musculus
tggaagttgaagtcccagcggttct

SEQ ID NO: 263276 - DNA, 25 bp, Mus musculus
agaggcacatcctgctggaagttga

SEQ ID NO: 263277 - DNA, 25 bp, Mus musculus
gggtcacctccggaattgggtctga

SEQ ID NO: 263278 - DNA, 25 bp, Mus musculus
ctgctcagagacctgctcagggacc

SEQ ID NO: 263279 - DNA, 25 bp, Mus musculus
agagaccggctcagttcccagctca

SEQ ID NO: 263280 - DNA, 25 bp, Mus musculus
cccatggtcgaaggctgtgcaaacg

SEQ ID NO: 263281 - DNA, 25 bp, Mus musculus
cccgagagaggctggtccttcagct

SEQ ID NO: 263282 - DNA, 25 bp, Mus musculus
cccagaacgcgggatgacagccacg

SEQ ID NO: 263283 - DNA, 25 bp, Mus musculus
gtacacgtcggacatgcccatggtc

SEQ ID NO: 263284 - DNA, 25 bp, Mus musculus
ggtgtgtgcggttacagaagaaccc

SEQ ID NO: 263285 - DNA, 25 bp, Mus musculus
ctgccagacacgtcctccgcaggtg

SEQ ID NO: 263286 - DNA, 25 bp, Mus musculus
ttcttggggccgctgccagacacgt

SEQ ID NO: 263287 - DNA, 25 bp, Mus musculus
cccgcaccagttcccgcgctcggct

SEQ ID NO: 263288 - DNA, 25 bp, Mus musculus
agggcgaacgccctcccgcaccagt

SEQ ID NO: 263289 - DNA, 25 bp, Mus musculus
tgcggttacagaagaaccccgccgc

SEQ ID NO: 263290 - DNA, 25 bp, Mus musculus
aggtgccggcctctctccggtgacg

SEQ ID NO: 263291 - DNA, 25 bp, Mus musculus
attacagggcctgccttgtactcgg

SEQ ID NO: 263292 - DNA, 25 bp, Mus musculus
ccagcagtaagcagctccctgcgcg

SEQ ID NO: 263293 - DNA, 25 bp, Mus musculus
cctctctccggtgacgcggccacat

SEQ ID NO: 263294 - DNA, 25 bp, Mus musculus
acgcggccacatgcggcccaggctc

SEQ ID NO: 263295 - DNA, 25 bp, Mus musculus
gcccaggctccgattacagggcctg

SEQ ID NO: 263296 - DNA, 25 bp, Mus musculus
ggctccgattacagggcctgccttg

SEQ ID NO: 263297 - DNA, 25 bp, Mus musculus
cagggcctgccttgtactcggggtc

SEQ ID NO: 263298 - DNA, 25 bp, Mus musculus
agcacgcagcgcttcttcttccata

SEQ ID NO: 263299 - DNA, 25 bp, Mus musculus
cccgtgcgtttctgtagggagaaga

SEQ ID NO: 263300 - DNA, 25 bp, Mus musculus
cccgggtgcagcttttaagtctcca

SEQ ID NO: 263301 - DNA, 25 bp, Mus musculus
tactccgacgccgtggacaagtttg

SEQ ID NO: 263302 - DNA, 25 bp, Mus musculus
gtttgttactcaccacggacccaga

SEQ ID NO: 263303 - DNA, 25 bp, Mus musculus
tcccggctcggaaggcatttcagac

SEQ ID NO: 263304 - DNA, 25 bp, Mus musculus
gaaagtcttgcagcgcccgacggtt

SEQ ID NO: 263305 - DNA, 25 bp, Mus musculus
ttctggaagtcgatcagcgccatgg

SEQ ID NO: 263306 - DNA, 25 bp, Mus musculus
gtgtgctccacgcagtccaccttga

SEQ ID NO: 263307 - DNA, 25 bp, Mus musculus
acaggctgtcgcttcgcttctccag

SEQ ID NO: 263308 - DNA, 25 bp, Mus musculus
cgcggcgtggtctttataaggactc

SEQ ID NO: 263309 - DNA, 25 bp, Mus musculus
ggttgcaccaaatgcgctcgctctg

SEQ ID NO: 263310 - DNA, 25 bp, Mus musculus
cgccctcgcaaaggatctcgtcgga

SEQ ID NO: 263311 - DNA, 25 bp, Mus musculus
ctctccaccgtgcagcggaagtcga

SEQ ID NO: 263312 - DNA, 25 bp, Mus musculus
tgcaccgccgtggtcgccaacaaaa

SEQ ID NO: 263313 - DNA, 25 bp, Mus musculus
ctctgcgagcaaaacgggcgacgaa

SEQ ID NO: 263314 - DNA, 25 bp, Mus musculus
cgcgcagttcgtgcttctttaaagg

SEQ ID NO: 263315 - DNA, 25 bp, Mus musculus
agcccgcgagctatatgtagttaga

SEQ ID NO: 263316 - DNA, 25 bp, Mus musculus
ggcggtatccaatcaaaatctgttg

SEQ ID NO: 263317 - DNA, 25 bp, Mus musculus
caggcactaggaaaggcggtatcca

SEQ ID NO: 263318 - DNA, 25 bp, Mus musculus
agagctgtttatcaactgcaccagg

SEQ ID NO: 263319 - DNA, 25 bp, Mus musculus
ggcgggaacaaagcgcgctgacctt

SEQ ID NO: 263320 - DNA, 25 bp, Mus musculus
ttgtcctctcaaggaaccgcctgcg

SEQ ID NO: 263321 - DNA, 25 bp, Mus musculus
cactgtgcggagagcatgcaaagcc

SEQ ID NO: 263322 - DNA, 25 bp, Mus musculus
tgctgacgaccctgaacccgttagg

SEQ ID NO: 263323 - DNA, 25 bp, Mus musculus
ccctcggaagaaggggtactgctga

SEQ ID NO: 263324 - DNA, 25 bp, Mus musculus
cgcgccggaagctaccgcggaaatt

SEQ ID NO: 263325 - DNA, 25 bp, Mus musculus
cgacgaatggacaatagagctgttt

SEQ ID NO: 263326 - DNA, 25 bp, Mus musculus
ccgcggagatcctgcacaaagcgca

SEQ ID NO: 263327 - DNA, 25 bp, Mus musculus
cgcctgcgtagcttggtttcctaga

SEQ ID NO: 263328 - DNA, 25 bp, Mus musculus
gcgtagcttggtttcctagaggccc

SEQ ID NO: 263329 - DNA, 25 bp, Mus musculus
ctctgccgtcatagcccagcttctg

SEQ ID NO: 263330 - DNA, 25 bp, Mus musculus
gcctccagaactgcgccggcgcaga

SEQ ID NO: 263331 - DNA, 25 bp, Mus musculus
gcagaccgtgtcttacccggaagcc

SEQ ID NO: 263332 - DNA, 25 bp, Mus musculus
cgtcctttcgccctccacagccaca

SEQ ID NO: 263333 - DNA, 25 bp, Mus musculus
tcactttcgcagtgcgcgcccttcc

SEQ ID NO: 263334 - DNA, 25 bp, Mus musculus
gatcctgcacaaagcgcacccttta

SEQ ID NO: 263335 - DNA, 25 bp, Mus musculus
aaagtagggccctaaggagcgcctg

SEQ ID NO: 263336 - DNA, 25 bp, Mus musculus
cctgcgcagtaaggttgtctcagcg

SEQ ID NO: 263337 - DNA, 25 bp, Mus musculus
gcagtaaggttgtctcagcgtcccg

SEQ ID NO: 263338 - DNA, 25 bp, Mus musculus
actgtccggtctacgcctgcgtagc

SEQ ID NO: 263339 - DNA, 25 bp, Mus musculus
tgcacaaagcgcaccctttaaagta

SEQ ID NO: 263340 - DNA, 25 bp, Mus musculus
gctgtcaatctcaagactgccgccg

SEQ ID NO: 263341 - DNA, 25 bp, Mus musculus
ttccgcactcaggtgagaattcgtg

SEQ ID NO: 263342 - DNA, 25 bp, Mus musculus
gcccgtcctgctgtcaatctcaaga

SEQ ID NO: 263343 - DNA, 25 bp, Mus musculus
ggatcagccgcctggattccgcact

SEQ ID NO: 263344 - DNA, 25 bp, Mus musculus
cactgctggagagcgtggatcagcc

SEQ ID NO: 263345 - DNA, 25 bp, Mus musculus
ggcaggcacttagaacactgctgga

SEQ ID NO: 263346 - DNA, 25 bp, Mus musculus
cggagcttcaggcaggcacttagaa

SEQ ID NO: 263347 - DNA, 25 bp, Mus musculus
gtgacctcacatcatctggggcgga

SEQ ID NO: 263348 - DNA, 25 bp, Mus musculus
ccgattggtcgtctgtgacctcaca

SEQ ID NO: 263349 - DNA, 25 bp, Mus musculus
tcgcgaaatccacttccgattggtc

SEQ ID NO: 263350 - DNA, 25 bp, Mus musculus
tcacaggacgcagctcgcgaaatcc

SEQ ID NO: 263351 - DNA, 25 bp, Mus musculus
tgccttcaccaatcacaggacgcag

SEQ ID NO: 263352 - DNA, 25 bp, Mus musculus
gaattcgtgtgcacggaccaggcca

SEQ ID NO: 263353 - DNA, 25 bp, Mus musculus
gtgggctctgagtcagctcactgcc

SEQ ID NO: 263354 - DNA, 25 bp, Mus musculus
tgaggcgctcctccgatcttggaga

SEQ ID NO: 263355 - DNA, 25 bp, Mus musculus
ttagcatgtggcagtggagaaagca

SEQ ID NO: 263356 - DNA, 25 bp, Mus musculus
gacccgccgctgaccctgaaatgaa

SEQ ID NO: 263357 - DNA, 25 bp, Mus musculus
tgaaggcgctaaatcctacaggaac

SEQ ID NO: 263358 - DNA, 25 bp, Mus musculus
tgggccagcctaggcttggaacacc

SEQ ID NO: 263359 - DNA, 25 bp, Mus musculus
actgcaggcgacaggactgacccga

SEQ ID NO: 263360 - DNA, 25 bp, Mus musculus
tcccttcgctctggagtggggctca

SEQ ID NO: 263361 - DNA, 25 bp, Mus musculus
cccagcactaggaccttcttgaatg

SEQ ID NO: 263362 - DNA, 25 bp, Mus musculus
tcttgaatgttccatcccgggcagc

SEQ ID NO: 263363 - DNA, 25 bp, Mus musculus
gggctgagtctctccgtttcgatcg

SEQ ID NO: 263364 - DNA, 25 bp, Mus musculus
cccgagccgcagatggttagcatgt

SEQ ID NO: 263365 - DNA, 25 bp, Mus musculus
cagccagcctccctgatgacttgtg

SEQ ID NO: 263366 - DNA, 25 bp, Mus musculus
atgacttgtgcagcggtacctcgtc

SEQ ID NO: 263367 - DNA, 25 bp, Mus musculus
gaatataaaagggacgcctggctcc

SEQ ID NO: 263368 - DNA, 25 bp, Mus musculus
cctctgggcgacatcactgggaggt

SEQ ID NO: 263369 - DNA, 25 bp, Mus musculus
ttgataccaacacccgcgttctggc

SEQ ID NO: 263370 - DNA, 25 bp, Mus musculus
cctgtggtttctcctctgggcgaca

SEQ ID NO: 263371 - DNA, 25 bp, Mus musculus
gctttgataccaacacccgcgttct

SEQ ID NO: 263372 - DNA, 25 bp, Mus musculus
cctaaccatcctcgccgctttgata

SEQ ID NO: 263373 - DNA, 25 bp, Mus musculus
cccaggacttgcctaaccatcctcg

SEQ ID NO: 263374 - DNA, 25 bp, Mus musculus
acgtctaggacagcgcgcccaggac

SEQ ID NO: 263375 - DNA, 25 bp, Mus musculus
aacacccgcgttctggcatcctgtg

SEQ ID NO: 263376 - DNA, 25 bp, Mus musculus
gcgttctggcatcctgtggtttctc

SEQ ID NO: 263377 - DNA, 25 bp, Mus musculus
cgtacgtctaggacagcgcgcccag

SEQ ID NO: 263378 - DNA, 25 bp, Mus musculus
ctccaaggacggctgggctttcggt

SEQ ID NO: 263379 - DNA, 25 bp, Mus musculus
agcgtgcgtcgcaagggcctcacgc

SEQ ID NO: 263380 - DNA, 25 bp, Mus musculus
gtcgcaagggcctcacgccttttac

SEQ ID NO: 263381 - DNA, 25 bp, Mus musculus
tggcatcctgtggtttctcctctgg

SEQ ID NO: 263382 - DNA, 25 bp, Mus musculus
tcgggcacccaacctggcttcttga

SEQ ID NO: 263383 - DNA, 25 bp, Mus musculus
tgacctccacgctccctagtagggg

SEQ ID NO: 263384 - DNA, 25 bp, Mus musculus
gcggccaccttgagagacttggaca

SEQ ID NO: 263385 - DNA, 25 bp, Mus musculus
acaggttctggatctcaggtcctcc

SEQ ID NO: 263386 - DNA, 25 bp, Mus musculus
cgtctctctgggttgctacaacaga

SEQ ID NO: 263387 - DNA, 25 bp, Mus musculus
aagcgtgtgcctctggattccagaa

SEQ ID NO: 263388 - DNA, 25 bp, Mus musculus
ttccagaagcaacagcgaccgagtc

SEQ ID NO: 263389 - DNA, 25 bp, Mus musculus
gctcctgtacccacagaggctgatc

SEQ ID NO: 263390 - DNA, 25 bp, Mus musculus
tacaagacccttggatgcgacctgg

SEQ ID NO: 263391 - DNA, 25 bp, Mus musculus
gggcaggtggatcagcctcaatttc

SEQ ID NO: 263392 - DNA, 25 bp, Mus musculus
tgtctctagagacccgatgcgcgct

SEQ ID NO: 263393 - DNA, 25 bp, Mus musculus
gatgcgcgctctctcagattctctc

SEQ ID NO: 263394 - DNA, 25 bp, Mus musculus
ccagttgcttgctttgcgcacgatc

SEQ ID NO: 263395 - DNA, 25 bp, Mus musculus
gtcctccaggctgagacaggttctg

SEQ ID NO: 263396 - DNA, 25 bp, Mus musculus
cagcgtggcactgctcacatgagga

SEQ ID NO: 263397 - DNA, 25 bp, Mus musculus
tggggctccggctcacaaatgcctc

SEQ ID NO: 263398 - DNA, 25 bp, Mus musculus
cgcgcaatcgcctgctccatgttaa

SEQ ID NO: 263399 - DNA, 25 bp, Mus musculus
tccatgttaaccctgcgtggtgctg

SEQ ID NO: 263400 - DNA, 25 bp, Mus musculus
gatgccctgcttgctctctcggcag

SEQ ID NO: 263401 - DNA, 25 bp, Mus musculus
cagcagccgggtttccttggataac

SEQ ID NO: 263402 - DNA, 25 bp, Mus musculus
cacatgaggatcaccgccagaggta

SEQ ID NO: 263403 - DNA, 25 bp, Mus musculus
caccgccagaggtagccggttctga

SEQ ID NO: 263404 - DNA, 25 bp, Mus musculus
gccggttctgagagcagcctcagtc

SEQ ID NO: 263405 - DNA, 25 bp, Mus musculus
gcacagttgcttcccagctgacaga

SEQ ID NO: 263406 - DNA, 25 bp, Mus musculus
cctgcccgccgagagggttatataa

SEQ ID NO: 263407 - DNA, 25 bp, Mus musculus
caccagcacgctgggtctggcatgc

SEQ ID NO: 263408 - DNA, 25 bp, Mus musculus
ttccttggataactggggctccggc

SEQ ID NO: 263409 - DNA, 25 bp, Mus musculus
atatggggtgggctttgtcaccagc

SEQ ID NO: 263410 - DNA, 25 bp, Mus musculus
gcatgcttgtaggtcgcccttctcc

SEQ ID NO: 263411 - DNA, 25 bp, Mus musculus
tcgctcattggctcgggccgtcacg

SEQ ID NO: 263412 - DNA, 25 bp, Mus musculus
gtcacgcgcgcgtctgtcaacaaag

SEQ ID NO: 263413 - DNA, 25 bp, Mus musculus
gcgtctgtcaacaaaggggcggatc

SEQ ID NO: 263414 - DNA, 25 bp, Mus musculus
tctgtcaacaaaggggcggatcgga

SEQ ID NO: 263415 - DNA, 25 bp, Mus musculus
atcggagtgcgcagcgtgcctgccc

SEQ ID NO: 263416 - DNA, 25 bp, Mus musculus
ggcccacaaggctagagtgcgcatg

SEQ ID NO: 263417 - DNA, 25 bp, Mus musculus
ccacaaggctagagtgcgcatgctt

SEQ ID NO: 263418 - DNA, 25 bp, Mus musculus
caaggctagagtgcgcatgcttgta

SEQ ID NO: 263419 - DNA, 25 bp, Mus musculus
ctagagtgcgcatgcttgtaggtcg

SEQ ID NO: 263420 - DNA, 25 bp, Mus musculus
gtgcgcatgcttgtaggtcgccctt

SEQ ID NO: 263421 - DNA, 25 bp, Mus musculus
atgcttgtaggtcgcccttctccct

SEQ ID NO: 263422 - DNA, 25 bp, Mus musculus
ccggtcgctcattggctcgggccgt

SEQ ID NO: 263423 - DNA, 25 bp, Mus musculus
gcccttctccctaccgcctggagga

SEQ ID NO: 263424 - DNA, 25 bp, Mus musculus
aattggctgtgatgatgagcgtccc

SEQ ID NO: 263425 - DNA, 25 bp, Mus musculus
tgcacagaacaaacggagagaaccc

SEQ ID NO: 263426 - DNA, 25 bp, Mus musculus
ccttcaagaaatagcaaagcagctg

SEQ ID NO: 263427 - DNA, 25 bp, Mus musculus
aaagcagctgtcttggttattcctc

SEQ ID NO: 263428 - DNA, 25 bp, Mus musculus
gtcttggttattcctccggctgatt

SEQ ID NO: 263429 - DNA, 25 bp, Mus musculus
tcctccggctgatttcttctgcttc

SEQ ID NO: 263430 - DNA, 25 bp, Mus musculus
cttctgcttccctggaagatgcgtc

SEQ ID NO: 263431 - DNA, 25 bp, Mus musculus
gggacctccttcaccacgctgctgc

SEQ ID NO: 263432 - DNA, 25 bp, Mus musculus
cgggccacttactttctttgctctg

SEQ ID NO: 263433 - DNA, 25 bp, Mus musculus
ttactttctttgctctgggcggcgg

SEQ ID NO: 263434 - DNA, 25 bp, Mus musculus
ctccatgctgcctggatctgagctg

SEQ ID NO: 263435 - DNA, 25 bp, Mus musculus
gcagccaccgtgatgatgaccggtt

SEQ ID NO: 263436 - DNA, 25 bp, Mus musculus
gatctgagctgggtgattaattggc

SEQ ID NO: 263437 - DNA, 25 bp, Mus musculus
gtggagcagccaccgtgatgatgac

SEQ ID NO: 263438 - DNA, 25 bp, Mus musculus
ttttgccaggctagccgcaactctg

SEQ ID NO: 263439 - DNA, 25 bp, Mus musculus
gctatcaacccgttttgccaggcta

SEQ ID NO: 263440 - DNA, 25 bp, Mus musculus
cgggacactagcgagcgcagagaac

SEQ ID NO: 263441 - DNA, 25 bp, Mus musculus
gccgcaactctgctggctctgctga

SEQ ID NO: 263442 - DNA, 25 bp, Mus musculus
gcgcatgcgctagatccgcggtagt

SEQ ID NO: 263443 - DNA, 25 bp, Mus musculus
tccaattggctagtcctcgctttag

SEQ ID NO: 263444 - DNA, 25 bp, Mus musculus
gagacagggcgaccgtggaaacacc

SEQ ID NO: 263445 - DNA, 25 bp, Mus musculus
gtggaaacaccggtaaagatctctg

SEQ ID NO: 263446 - DNA, 25 bp, Mus musculus
aagatctctggcaggtgtgcgcagc

SEQ ID NO: 263447 - DNA, 25 bp, Mus musculus
gtgtgcgcagctcgcagtcctgctt

SEQ ID NO: 263448 - DNA, 25 bp, Mus musculus
ttccgtgctctcacgccagtgtgtg

SEQ ID NO: 263449 - DNA, 25 bp, Mus musculus
tgtgtgttgacgtcacccaaacgcc

SEQ ID NO: 263450 - DNA, 25 bp, Mus musculus
cgaactcggacctaactgctatcaa

SEQ ID NO: 263451 - DNA, 25 bp, Mus musculus
cggtctatcgggagatccaattggc

SEQ ID NO: 263452 - DNA, 25 bp, Mus musculus
tcgtccaggcgctgcagtagatcgt

SEQ ID NO: 263453 - DNA, 25 bp, Mus musculus
atccgctgttgtagtagctttgaca

SEQ ID NO: 263454 - DNA, 25 bp, Mus musculus
cttcggatgtggctgtaaccgcttc

SEQ ID NO: 263455 - DNA, 25 bp, Mus musculus
tgtccaaatcagacgcatgcgcttc

SEQ ID NO: 263456 - DNA, 25 bp, Mus musculus
agcgtctcgcgggatgtccaaatca

SEQ ID NO: 263457 - DNA, 25 bp, Mus musculus
cctcagcgatcccacataggaaatc

SEQ ID NO: 263458 - DNA, 25 bp, Mus musculus
cagcaccaggaatgggtccatggca

SEQ ID NO: 263459 - DNA, 25 bp, Mus musculus
ctccatcagatcgttgcccgacagg

SEQ ID NO: 263460 - DNA, 25 bp, Mus musculus
gctccagcagcaccgtgaacaggtc

SEQ ID NO: 263461 - DNA, 25 bp, Mus musculus
gcacaagaacttgagctccatcaga

SEQ ID NO: 263462 - DNA, 25 bp, Mus musculus
tgctcacgcgctcgcggcacaagaa

SEQ ID NO: 263463 - DNA, 25 bp, Mus musculus
acgcgctccagctttcgtttgctca

SEQ ID NO: 263464 - DNA, 25 bp, Mus musculus
gttgacttcagcttacgcgcgcgtt

SEQ ID NO: 263465 - DNA, 25 bp, Mus musculus
gctccaggtcgttctgctccagcag

SEQ ID NO: 263466 - DNA, 25 bp, Mus musculus
tccgccgggagcgtcgagtacttct

SEQ ID NO: 263467 - DNA, 25 bp, Mus musculus
cgccggctccgccttaaagatataa

SEQ ID NO: 263468 - DNA, 25 bp, Mus musculus
gtacttctcggggaccctcatggtg

SEQ ID NO: 263469 - DNA, 25 bp, Mus musculus
ttaaagatataagcgcaggggcggc

SEQ ID NO: 263470 - DNA, 25 bp, Mus musculus
cggtcgcgtgcacttggttccggca

SEQ ID NO: 263471 - DNA, 25 bp, Mus musculus
tcccaggccacacgtgcgtggctgg

SEQ ID NO: 263472 - DNA, 25 bp, Mus musculus
agagtatagccggtcgcgtgcactt

SEQ ID NO: 263473 - DNA, 25 bp, Mus musculus
agatgttcacgatgtggacgctgcg

SEQ ID NO: 263474 - DNA, 25 bp, Mus musculus
tcctcgatggcgcagatgttcacga

SEQ ID NO: 263475 - DNA, 25 bp, Mus musculus
agcccaggtcctcgatggcgcagat

SEQ ID NO: 263476 - DNA, 25 bp, Mus musculus
ctcggacggcaggtagcccaggtcc

SEQ ID NO: 263477 - DNA, 25 bp, Mus musculus
tcaccgtgccctcggacggcaggta

SEQ ID NO: 263478 - DNA, 25 bp, Mus musculus
cactgtggagaggtcacccgtggcc

SEQ ID NO: 263479 - DNA, 25 bp, Mus musculus
cccaaaaaccttgcgcactgtggag

SEQ ID NO: 263480 - DNA, 25 bp, Mus musculus
ctggcactctcggtccgcagaggtt

SEQ ID NO: 263481 - DNA, 25 bp, Mus musculus
cagaggttccctctggggtcaagcc

SEQ ID NO: 263482 - DNA, 25 bp, Mus musculus
tgcctcgtgcgcgattgtttccggt

SEQ ID NO: 263483 - DNA, 25 bp, Mus musculus
tccgcagaggttccctctggggtca

SEQ ID NO: 263484 - DNA, 25 bp, Mus musculus
ctcgtgcgcgattgtttccggtccc

SEQ ID NO: 263485 - DNA, 25 bp, Mus musculus
ccctctggggtcaagccctccaggc

SEQ ID NO: 263486 - DNA, 25 bp, Mus musculus
aggccgatgtcgctgtcctgcgcgt

SEQ ID NO: 263487 - DNA, 25 bp, Mus musculus
tcctgcgcgtcctgcatgatgtgtt

SEQ ID NO: 263488 - DNA, 25 bp, Mus musculus
cgcgtcctgcatgatgtgttcgctc

SEQ ID NO: 263489 - DNA, 25 bp, Mus musculus
atgatgtgttcgctccggacgccct

SEQ ID NO: 263490 - DNA, 25 bp, Mus musculus
gtgttcgctccggacgccctgggtc

SEQ ID NO: 263491 - DNA, 25 bp, Mus musculus
ttgagcccagctgcctgcaccgcgc

SEQ ID NO: 263492 - DNA, 25 bp, Mus musculus
tctcggtccgcagaggttccctctg

SEQ ID NO: 263493 - DNA, 25 bp, Mus musculus
cctgcatgatgtgttcgctccggac

SEQ ID NO: 263494 - DNA, 25 bp, Mus musculus
cctgccgccacgtcctagatagagg

SEQ ID NO: 263495 - DNA, 25 bp, Mus musculus
tctttgctctcagccgatgcgcgga

SEQ ID NO: 263496 - DNA, 25 bp, Mus musculus
gccgttggacaaggatttatcgccc

SEQ ID NO: 263497 - DNA, 25 bp, Mus musculus
ccggttctgacacgtttctattact

SEQ ID NO: 263498 - DNA, 25 bp, Mus musculus
agcgcctatagtgagtgttcaggtc

SEQ ID NO: 263499 - DNA, 25 bp, Mus musculus
ggcagccttgagaacagcgcctata

SEQ ID NO: 263500 - DNA, 25 bp, Mus musculus
gcaagctctactgcgctaccaagta

SEQ ID NO: 263501 - DNA, 25 bp, Mus musculus
ccacggccgccttttgttgtcaagc

SEQ ID NO: 263502 - DNA, 25 bp, Mus musculus
gctggaacccagctggccaactacg

SEQ ID NO: 263503 - DNA, 25 bp, Mus musculus
atgggcctgatctggcttctgctgc

SEQ ID NO: 263504 - DNA, 25 bp, Mus musculus
cccattcctgggtgaaaattcaaag

SEQ ID NO: 263505 - DNA, 25 bp, Mus musculus
gtcaagcgccctttcttcagaactg

SEQ ID NO: 263506 - DNA, 25 bp, Mus musculus
aggcagagctcggtttccgcaacgc

SEQ ID NO: 263507 - DNA, 25 bp, Mus musculus
tggccagtccctttcgttctctttg

SEQ ID NO: 263508 - DNA, 25 bp, Mus musculus
atataccactgctccggagggctgg

SEQ ID NO: 263509 - DNA, 25 bp, Mus musculus
accgttgcgtccctatttgctctcg

SEQ ID NO: 263510 - DNA, 25 bp, Mus musculus
tttgctctcgctacttaggtctgtg

SEQ ID NO: 263511 - DNA, 25 bp, Mus musculus
aggtctgtgcgcagcactcaccgaa

SEQ ID NO: 263512 - DNA, 25 bp, Mus musculus
tacctgctgggcctcaaaaggcttc

SEQ ID NO: 263513 - DNA, 25 bp, Mus musculus
gcggctctactgcaacgtgggcatc

SEQ ID NO: 263514 - DNA, 25 bp, Mus musculus
ggcatcggattccacctgcaggtgc

SEQ ID NO: 263515 - DNA, 25 bp, Mus musculus
gcatcggtggtgtgcacgcagacac

SEQ ID NO: 263516 - DNA, 25 bp, Mus musculus
gcagacacgagggacagtgagttct

SEQ ID NO: 263517 - DNA, 25 bp, Mus musculus
gctgagtagagtcgagctcccaccc

SEQ ID NO: 263518 - DNA, 25 bp, Mus musculus
cccttgggctccaggactgagagcg

SEQ ID NO: 263519 - DNA, 25 bp, Mus musculus
tggtctctcggtgcggaattccatc

SEQ ID NO: 263520 - DNA, 25 bp, Mus musculus
cggtgcggaattccatcgccttcac

SEQ ID NO: 263521 - DNA, 25 bp, Mus musculus
gggcgccggctatatataccactgc

SEQ ID NO: 263522 - DNA, 25 bp, Mus musculus
cagggtcgcccgctgtttcataaca

SEQ ID NO: 263523 - DNA, 25 bp, Mus musculus
aaccgcacggtctgtgaatcaacta

SEQ ID NO: 263524 - DNA, 25 bp, Mus musculus
gaacttggccagtgctaagaaccgc

SEQ ID NO: 263525 - DNA, 25 bp, Mus musculus
ttcccgggcaatccaggagaacttg

SEQ ID NO: 263526 - DNA, 25 bp, Mus musculus
cctcagtcagtctgcgcaggaggtg

SEQ ID NO: 263527 - DNA, 25 bp, Mus musculus
ccagcgcaatcaaagccggttagac

SEQ ID NO: 263528 - DNA, 25 bp, Mus musculus
ctctcttttgctatgaagtgaacca

SEQ ID NO: 263529 - DNA, 25 bp, Mus musculus
agggagcccgaagcactctcttttg

SEQ ID NO: 263530 - DNA, 25 bp, Mus musculus
tgcgaatgtaaacgacagggagccc

SEQ ID NO: 263531 - DNA, 25 bp, Mus musculus
cccggctctgagtgaatgattgcga

SEQ ID NO: 263532 - DNA, 25 bp, Mus musculus
cataacagctgttgatatcgacaga

SEQ ID NO: 263533 - DNA, 25 bp, Mus musculus
gagagtagcaatcagggtcgcccgc

SEQ ID NO: 263534 - DNA, 25 bp, Mus musculus
aactactccggtcagattcaccgcg

SEQ ID NO: 263535 - DNA, 25 bp, Mus musculus
tcgacagaaaactcaacccgaggcc

SEQ ID NO: 263536 - DNA, 25 bp, Mus musculus
cccagtgacattccacttgtggagt

SEQ ID NO: 263537 - DNA, 25 bp, Mus musculus
ccctcctctccggtacgcagctgtc

SEQ ID NO: 263538 - DNA, 25 bp, Mus musculus
cgcgcacagactcaagggcctgatc

SEQ ID NO: 263539 - DNA, 25 bp, Mus musculus
gactcaagggcctgatcatcgaccc

SEQ ID NO: 263540 - DNA, 25 bp, Mus musculus
tcatcgacccaagaggggatcccgc

SEQ ID NO: 263541 - DNA, 25 bp, Mus musculus
caggcagaggacgtgcagacagcga

SEQ ID NO: 263542 - DNA, 25 bp, Mus musculus
ctgccgtgcttctgcacgctggtca

SEQ ID NO: 263543 - DNA, 25 bp, Mus musculus
tgcttctgcacgctggtcagtccac

SEQ ID NO: 263544 - DNA, 25 bp, Mus musculus
agtccacccttctcaaaagtcgcag

SEQ ID NO: 263545 - DNA, 25 bp, Mus musculus
acttgtggagtccacgcgcgaggca

SEQ ID NO: 263546 - DNA, 25 bp, Mus musculus
agcgtccaccgttgctcctagctgg

SEQ ID NO: 263547 - DNA, 25 bp, Mus musculus
gcctgatcatcgacccaagagggga

SEQ ID NO: 263548 - DNA, 25 bp, Mus musculus
ggtcagtccacccttctcaaaagtc

SEQ ID NO: 263549 - DNA, 25 bp, Mus musculus
acccaagaggggatcccgcggcctg

SEQ ID NO: 263550 - DNA, 25 bp, Mus musculus
gtctgtgtcagatgaagatccactc

SEQ ID NO: 263551 - DNA, 25 bp, Mus musculus
ggggcccggcaacatctttctcttg

SEQ ID NO: 263552 - DNA, 25 bp, Mus musculus
tgtcggagcagtaactctgtgcgcc

SEQ ID NO: 263553 - DNA, 25 bp, Mus musculus
gccacctttgtaacggccttcagga

SEQ ID NO: 263554 - DNA, 25 bp, Mus musculus
tgccatcaaggacgtcagcagcgtg

SEQ ID NO: 263555 - DNA, 25 bp, Mus musculus
tgctcgcagatttgttggaattccg

SEQ ID NO: 263556 - DNA, 25 bp, Mus musculus
gtgtgtcgccgtggccttaacatcc

SEQ ID NO: 263557 - DNA, 25 bp, Mus musculus
tcccttaggacccagaagcacgtgg

SEQ ID NO: 263558 - DNA, 25 bp, Mus musculus
cgaagtgagtatcattcagcccgtc

SEQ ID NO: 263559 - DNA, 25 bp, Mus musculus
agtacctgtactccgctggtcccta

SEQ ID NO: 263560 - DNA, 25 bp, Mus musculus
ggggcaagattacccgcctgcagta

SEQ ID NO: 263561 - DNA, 25 bp, Mus musculus
gatccactctttctctacggctggg

SEQ ID NO: 263562 - DNA, 25 bp, Mus musculus
tggctcagcaatcccagtctgtgtc

SEQ ID NO: 263563 - DNA, 25 bp, Mus musculus
aattccgcgcggtcgctctgaagac

SEQ ID NO: 263564 - DNA, 25 bp, Mus musculus
tccgcgcggcatacacggaagtgtc

SEQ ID NO: 263565 - DNA, 25 bp, Mus musculus
accacggagcgagcggtaccaagga

SEQ ID NO: 263566 - DNA, 25 bp, Mus musculus
cccatgcgcagtgggatgggctttt

SEQ ID NO: 263567 - DNA, 25 bp, Mus musculus
tggcttctttagcttgccgtcctta

SEQ ID NO: 263568 - DNA, 25 bp, Mus musculus
cggaagtgtcttcttcattctgaca

SEQ ID NO: 263569 - DNA, 25 bp, Mus musculus
gtttgtgatcgcgtctcgccagttg

SEQ ID NO: 263570 - DNA, 25 bp, Mus musculus
cgccagttggcgattactacacaga

SEQ ID NO: 263571 - DNA, 25 bp, Mus musculus
agagccgagacaccgccatggccgt

SEQ ID NO: 263572 - DNA, 25 bp, Mus musculus
ggccgtggagcaggacatatttgac

SEQ ID NO: 263573 - DNA, 25 bp, Mus musculus
caggacatatttgacgccgtcgtga

SEQ ID NO: 263574 - DNA, 25 bp, Mus musculus
gccatctgcgagctgccactttttc

SEQ ID NO: 263575 - DNA, 25 bp, Mus musculus
tgtcctttaattgccgcacatacgg

SEQ ID NO: 263576 - DNA, 25 bp, Mus musculus
tggacaccgcgagcgacccagacga

SEQ ID NO: 263577 - DNA, 25 bp, Mus musculus
ttcattctgacaatccgggcgtttg

SEQ ID NO: 263578 - DNA, 25 bp, Mus musculus
ctccacggaagaggaccagtcaatg

SEQ ID NO: 263579 - DNA, 25 bp, Mus musculus
gccaagatccgcctcgctgaggtta

SEQ ID NO: 263580 - DNA, 25 bp, Mus musculus
agagtaactgcgtccttccctgaga

SEQ ID NO: 263581 - DNA, 25 bp, Mus musculus
tgcgagcgaaacctacaccatgtga

SEQ ID NO: 263582 - DNA, 25 bp, Mus musculus
ttctcgccctgtacgccaaaggctg

SEQ ID NO: 263583 - DNA, 25 bp, Mus musculus
acagccgctggtatttggttgcgca

SEQ ID NO: 263584 - DNA, 25 bp, Mus musculus
tcgctatggtaacaggccacgccca

SEQ ID NO: 263585 - DNA, 25 bp, Mus musculus
acgattgcgattggctgtcctaagc

SEQ ID NO: 263586 - DNA, 25 bp, Mus musculus
ttcctcatgagcagacaccctattg

SEQ ID NO: 263587 - DNA, 25 bp, Mus musculus
gccatgccctcaagaaaagtgtccg

SEQ ID NO: 263588 - DNA, 25 bp, Mus musculus
gccgattggtttacctgaagccatg

SEQ ID NO: 263589 - DNA, 25 bp, Mus musculus
ggcggcatccatccctaaaacaagg

SEQ ID NO: 263590 - DNA, 25 bp, Mus musculus
ccgggactcatggtagctttgctct

SEQ ID NO: 263591 - DNA, 25 bp, Mus musculus
ccagtcaatgggctgcgtccgaatg

SEQ ID NO: 263592 - DNA, 25 bp, Mus musculus
ttccatggctcttccgtctggggag

SEQ ID NO: 263593 - DNA, 25 bp, Mus musculus
tcgcgctgtactgccggtctccgga

SEQ ID NO: 263594 - DNA, 25 bp, Mus musculus
tctgtagctctctgctactgcgccg

SEQ ID NO: 263595 - DNA, 25 bp, Mus musculus
gagcgcgcggagtctgtagctctct

SEQ ID NO: 263596 - DNA, 25 bp, Mus musculus
tacgcgcggcggatggtctccactt

SEQ ID NO: 263597 - DNA, 25 bp, Mus musculus
gagggcgcacaggtctcctccgtct

SEQ ID NO: 263598 - DNA, 25 bp, Mus musculus
cacaggagctggtgttccatggctc

SEQ ID NO: 263599 - DNA, 25 bp, Mus musculus
cttcgcagcacaggagctggtgttc

SEQ ID NO: 263600 - DNA, 25 bp, Mus musculus
gcagcacccggtcgttgaggagatt

SEQ ID NO: 263601 - DNA, 25 bp, Mus musculus
tctccacttcgcagcacaggagctg

SEQ ID NO: 263602 - DNA, 25 bp, Mus musculus
tcttgagcatggctcgcagcacccg

SEQ ID NO: 263603 - DNA, 25 bp, Mus musculus
tctcctccgtcttgagcatggctcg

SEQ ID NO: 263604 - DNA, 25 bp, Mus musculus
gcacaggtctcctccgtcttgagca

SEQ ID NO: 263605 - DNA, 25 bp, Mus musculus
ctggtgttccatggctcttccgtct

SEQ ID NO: 263606 - DNA, 25 bp, Mus musculus
tgcgaactgagcaggctagcctagc

SEQ ID NO: 263607 - DNA, 25 bp, Mus musculus
ccgggcggcagtaagcatgatttat

SEQ ID NO: 263608 - DNA, 25 bp, Mus musculus
ttcataaaatccctaccgggcggca

SEQ ID NO: 263609 - DNA, 25 bp, Mus musculus
ggccaggctgccttttcattcataa

SEQ ID NO: 263610 - DNA, 25 bp, Mus musculus
aagcctgggagccttagcctaagca

SEQ ID NO: 263611 - DNA, 25 bp, Mus musculus
agagtgcccacgcttgctctggcca

SEQ ID NO: 263612 - DNA, 25 bp, Mus musculus
agtgattccactgtagctccgaagg

SEQ ID NO: 263613 - DNA, 25 bp, Mus musculus
gtccaggcggcacacaagacgcaaa

SEQ ID NO: 263614 - DNA, 25 bp, Mus musculus
agcctagccagggtgcgccaccaag

SEQ ID NO: 263615 - DNA, 25 bp, Mus musculus
cggacccttcgggacagtgattcca

SEQ ID NO: 263616 - DNA, 25 bp, Mus musculus
actcagtgctgttactaggcggacc

SEQ ID NO: 263617 - DNA, 25 bp, Mus musculus
cgggcagatctccacgaggaacttc

SEQ ID NO: 263618 - DNA, 25 bp, Mus musculus
agccaatccggactcagtgctgtta

SEQ ID NO: 263619 - DNA, 25 bp, Mus musculus
tgcgcgctatcacccgcggctgagt

SEQ ID NO: 263620 - DNA, 25 bp, Mus musculus
ttgaggaaccctcgcgactaagcgc

SEQ ID NO: 263621 - DNA, 25 bp, Mus musculus
gtcgcatcctatcttcccaagcgtg

SEQ ID NO: 263622 - DNA, 25 bp, Mus musculus
ctgtgcacacctgggaccgtcgcat

SEQ ID NO: 263623 - DNA, 25 bp, Mus musculus
ctaaggtgtgtatgctcagctcatc

SEQ ID NO: 263624 - DNA, 25 bp, Mus musculus
gcggatttcaggcacccttcggcta

SEQ ID NO: 263625 - DNA, 25 bp, Mus musculus
tgctccgcctaggttaccctgagcg

SEQ ID NO: 263626 - DNA, 25 bp, Mus musculus
ggcggcaatactgagcctctggctc

SEQ ID NO: 263627 - DNA, 25 bp, Mus musculus
gctccagctagccattgttaattta

SEQ ID NO: 263628 - DNA, 25 bp, Mus musculus
aaaggacttggctgtttctgctcca

SEQ ID NO: 263629 - DNA, 25 bp, Mus musculus
cctggcggcaacttgaaaggacttg

SEQ ID NO: 263630 - DNA, 25 bp, Mus musculus
acgcacctaggtggggtcacctgca

SEQ ID NO: 263631 - DNA, 25 bp, Mus musculus
tcctggagaagagcggacgcaccta

SEQ ID NO: 263632 - DNA, 25 bp, Mus musculus
ttagccttcaagtcgcccagagaaa

SEQ ID NO: 263633 - DNA, 25 bp, Mus musculus
tcccaagcgtgccttaccaaataag

SEQ ID NO: 263634 - DNA, 25 bp, Mus musculus
agcgccgcgcttaccgtaaaccttg

SEQ ID NO: 263635 - DNA, 25 bp, Mus musculus
ccgtaaaccttggacgcgacgcgca

SEQ ID NO: 263636 - DNA, 25 bp, Mus musculus
accttggacgcgacgcgcagcagtg

SEQ ID NO: 263637 - DNA, 25 bp, Mus musculus
gctcgcgagagcctgaggacgctcc

SEQ ID NO: 263638 - DNA, 25 bp, Mus musculus
gaacggtggttgagcctgcgcttca

SEQ ID NO: 263639 - DNA, 25 bp, Mus musculus
cctgcgcttcagtagaggcaccaag

SEQ ID NO: 263640 - DNA, 25 bp, Mus musculus
cgcttcagtagaggcaccaagcccg

SEQ ID NO: 263641 - DNA, 25 bp, Mus musculus
atggcactagcctccgcggtcccac

SEQ ID NO: 263642 - DNA, 25 bp, Mus musculus
gcgggcggacccatggcactagcct

SEQ ID NO: 263643 - DNA, 25 bp, Mus musculus
tggtcgtcctgagcgccgcgcttac

SEQ ID NO: 263644 - DNA, 25 bp, Mus musculus
attccgcgcattcccgccggccggt

SEQ ID NO: 263645 - DNA, 25 bp, Mus musculus
ggccgcaccgcgcattccgcgcatt

SEQ ID NO: 263646 - DNA, 25 bp, Mus musculus
gcggtcccacaaacgcgcgcccgga

SEQ ID NO: 263647 - DNA, 25 bp, Mus musculus
tgtttcgccgccacgtggtcgtcct

SEQ ID NO: 263648 - DNA, 25 bp, Mus musculus
ccgagcaggggccacgaggcttgca

SEQ ID NO: 263649 - DNA, 25 bp, Mus musculus
gcagacaatcgagccctttctctcc

SEQ ID NO: 263650 - DNA, 25 bp, Mus musculus
cccaattagctatcacttctggagg

SEQ ID NO: 263651 - DNA, 25 bp, Mus musculus
acttctggaggccagcacggtccga

SEQ ID NO: 263652 - DNA, 25 bp, Mus musculus
ctgggcgggctgtacagcagcagca

SEQ ID NO: 263653 - DNA, 25 bp, Mus musculus
gcagcaggcccgcaccgagcagggg

SEQ ID NO: 263654 - DNA, 25 bp, Mus musculus
gctgccgcagacaatcgagcccttt

SEQ ID NO: 263655 - DNA, 25 bp, Mus musculus
aggcctttccggctgccgcagacaa

SEQ ID NO: 263656 - DNA, 25 bp, Mus musculus
ttccggctgccgcagacaatcgagc

SEQ ID NO: 263657 - DNA, 25 bp, Mus musculus
cccaaacatctcccggcggcagctg

SEQ ID NO: 263658 - DNA, 25 bp, Mus musculus
ggctgacgtaatccccaaacatctc

SEQ ID NO: 263659 - DNA, 25 bp, Mus musculus
ctgcctgccaggctgacgtaatccc

SEQ ID NO: 263660 - DNA, 25 bp, Mus musculus
tgccgcagacaatcgagccctttct

SEQ ID NO: 263661 - DNA, 25 bp, Mus musculus
ggccacgaggcttgcagggaggccc

SEQ ID NO: 263662 - DNA, 25 bp, Mus musculus
gcgctcagggtgacgctgttcccag

SEQ ID NO: 263663 - DNA, 25 bp, Mus musculus
cgttgccaacggcagcttctcggca

SEQ ID NO: 263664 - DNA, 25 bp, Mus musculus
caacggcagcttctcggcacgcaga

SEQ ID NO: 263665 - DNA, 25 bp, Mus musculus
gcagcttctcggcacgcagagctca

SEQ ID NO: 263666 - DNA, 25 bp, Mus musculus
ttctcggcacgcagagctcaaaggc

SEQ ID NO: 263667 - DNA, 25 bp, Mus musculus
tcggcacgcagagctcaaaggcaca

SEQ ID NO: 263668 - DNA, 25 bp, Mus musculus
tgcggacgtggacgctgctcttgaa

SEQ ID NO: 263669 - DNA, 25 bp, Mus musculus
gacgtggacgctgctcttgaagact

SEQ ID NO: 263670 - DNA, 25 bp, Mus musculus
tgctcttgaagactgagacgcaggc

SEQ ID NO: 263671 - DNA, 25 bp, Mus musculus
tcttgaagactgagacgcaggcggc

SEQ ID NO: 263672 - DNA, 25 bp, Mus musculus
cggtggcgccaaccctggcggatct

SEQ ID NO: 263673 - DNA, 25 bp, Mus musculus
gactgcacctgcaacgccgggcgct

SEQ ID NO: 263674 - DNA, 25 bp, Mus musculus
gacgctgttcccagggtggccgcca

SEQ ID NO: 263675 - DNA, 25 bp, Mus musculus
ggcggatctccgactgcacctgcaa

SEQ ID NO: 263676 - DNA, 25 bp, Mus musculus
atgcgggtccagcacgaagtactcg

SEQ ID NO: 263677 - DNA, 25 bp, Mus musculus
aggacgcctatcctccggggaggca

SEQ ID NO: 263678 - DNA, 25 bp, Mus musculus
agaaagacagcttcccggcctcgta

SEQ ID NO: 263679 - DNA, 25 bp, Mus musculus
acgaagtactcgcagcggttccaca

SEQ ID NO: 263680 - DNA, 25 bp, Mus musculus
gcctcgtagtccaacaggacgccta

SEQ ID NO: 263681 - DNA, 25 bp, Mus musculus
tctgctccgagaaccgctgcgggtc

SEQ ID NO: 263682 - DNA, 25 bp, Mus musculus
ggctcagcacgcaggtctgctccga

SEQ ID NO: 263683 - DNA, 25 bp, Mus musculus
ccggatgttcactgccgtcgtgagc

SEQ ID NO: 263684 - DNA, 25 bp, Mus musculus
ccctgagaaagtgtcggtgaagctg

SEQ ID NO: 263685 - DNA, 25 bp, Mus musculus
tctaaccggcaaagagcagatggtc

SEQ ID NO: 263686 - DNA, 25 bp, Mus musculus
ttgtcgttctcttcgaggacctgtg

SEQ ID NO: 263687 - DNA, 25 bp, Mus musculus
tgcgagccatcagacacgttgaaga

SEQ ID NO: 263688 - DNA, 25 bp, Mus musculus
agatggtcataggatccggatgttc

SEQ ID NO: 263689 - DNA, 25 bp, Mus musculus
ggacctgtggccctctaaccggcaa

SEQ ID NO: 263690 - DNA, 25 bp, Mus musculus
cgttgcggtatagccttcatcactc

SEQ ID NO: 263691 - DNA, 25 bp, Mus musculus
cttccagtagtaattgtagcgccaa

SEQ ID NO: 263692 - DNA, 25 bp, Mus musculus
tcgcctgcgggcatgcgaagagcaa

SEQ ID NO: 263693 - DNA, 25 bp, Mus musculus
ggtatgaggacgatgcacaaaggca

SEQ ID NO: 263694 - DNA, 25 bp, Mus musculus
ggcatgacctcatgttcatatctaa

SEQ ID NO: 263695 - DNA, 25 bp, Mus musculus
tctaaccctattgctccagtgtgtc

SEQ ID NO: 263696 - DNA, 25 bp, Mus musculus
ggctcctctcggaccttgctgaaga

SEQ ID NO: 263697 - DNA, 25 bp, Mus musculus
tgtcagctcctgaaaggccttccca

SEQ ID NO: 263698 - DNA, 25 bp, Mus musculus
cgagctctggccgtaggtaaggcaa

SEQ ID NO: 263699 - DNA, 25 bp, Mus musculus
ctgcaagaagatgaactggcggtcc

SEQ ID NO: 263700 - DNA, 25 bp, Mus musculus
gcagccgtcgctacttatcacctga

SEQ ID NO: 263701 - DNA, 25 bp, Mus musculus
cgtagccgtaccacatcttccagta

SEQ ID NO: 263702 - DNA, 25 bp, Mus musculus
atcactctggtctttctgcagcagc

SEQ ID NO: 263703 - DNA, 25 bp, Mus musculus
ccttgctgaagaacagggctatacc

SEQ ID NO: 263704 - DNA, 25 bp, Mus musculus
gccgcacatttgcatacccaacgta

SEQ ID NO: 263705 - DNA, 25 bp, Mus musculus
cgtgacatcacgcaagacgcggtga

SEQ ID NO: 263706 - DNA, 25 bp, Mus musculus
ggaaatcgactcagtacgtgacatc

SEQ ID NO: 263707 - DNA, 25 bp, Mus musculus
ttaattgggactcaccaggcgcctc

SEQ ID NO: 263708 - DNA, 25 bp, Mus musculus
gggcgtgtcactgacccaataggga

SEQ ID NO: 263709 - DNA, 25 bp, Mus musculus
aggcgcctcctatgggcagggaaat

SEQ ID NO: 263710 - DNA, 25 bp, Mus musculus
ccgatctttctagttcaggggaacg

SEQ ID NO: 263711 - DNA, 25 bp, Mus musculus
agctgttctacttgggcatccggca

SEQ ID NO: 263712 - DNA, 25 bp, Mus musculus
ggcgcgaaccggcaaaacgctatag

SEQ ID NO: 263713 - DNA, 25 bp, Mus musculus
gaacggcgtctgtgcttgaccaatc

SEQ ID NO: 263714 - DNA, 25 bp, Mus musculus
agccgctggccaaccgtatcaagga

SEQ ID NO: 263715 - DNA, 25 bp, Mus musculus
gtatcaaggatgctgcccgccgcag

SEQ ID NO: 263716 - DNA, 25 bp, Mus musculus
tgcaaacgcacgctcctacgtaggc

SEQ ID NO: 263717 - DNA, 25 bp, Mus musculus
aggcaagtccttccttacgcaagca

SEQ ID NO: 263718 - DNA, 25 bp, Mus musculus
ctcagatctgggacgcccaaagcgc

SEQ ID NO: 263719 - DNA, 25 bp, Mus musculus
ctgggatcccctgcgatggaaagcg

SEQ ID NO: 263720 - DNA, 25 bp, Mus musculus
cggtgttctgatgtgctgggatccc

SEQ ID NO: 263721 - DNA, 25 bp, Mus musculus
tcccaccggtgttctgatgtgctgg

SEQ ID NO: 263722 - DNA, 25 bp, Mus musculus
ctcctcccaccggtgttctgatgtg

SEQ ID NO: 263723 - DNA, 25 bp, Mus musculus
agagtccagcttcctggggagaacg

SEQ ID NO: 263724 - DNA, 25 bp, Mus musculus
cccatagagtccagcttcctgggga

SEQ ID NO: 263725 - DNA, 25 bp, Mus musculus
ttctgctcagtctctctcggggtcc

SEQ ID NO: 263726 - DNA, 25 bp, Mus musculus
tgggacgcccaaagcgctgtgtccc

SEQ ID NO: 263727 - DNA, 25 bp, Mus musculus
ttccagaaggcaccggctcagatct

SEQ ID NO: 263728 - DNA, 25 bp, Mus musculus
gatcgttccagaaggcaccggctca

SEQ ID NO: 263729 - DNA, 25 bp, Mus musculus
tttagagatcgttccagaaggcacc

SEQ ID NO: 263730 - DNA, 25 bp, Mus musculus
gggtgtcgatatttagagatcgttc

SEQ ID NO: 263731 - DNA, 25 bp, Mus musculus
tccaggttctgctcagtctctctcg

SEQ ID NO: 263732 - DNA, 25 bp, Mus musculus
tagtaggatcgtcccaacaatccgg

SEQ ID NO: 263733 - DNA, 25 bp, Mus musculus
gtaggatcgtcccaacaatccggca

SEQ ID NO: 263734 - DNA, 25 bp, Mus musculus
ccgccaacacgtccgggctgagtcg

SEQ ID NO: 263735 - DNA, 25 bp, Mus musculus
gtagtaggatcgtcccaacaatccg

SEQ ID NO: 263736 - DNA, 25 bp, Mus musculus
gtcccaacaatccggcaggctcaga

SEQ ID NO: 263737 - DNA, 25 bp, Mus musculus
cccgccaacacgtccgggctgagtc

SEQ ID NO: 263738 - DNA, 25 bp, Mus musculus
ggtagtaggatcgtcccaacaatcc

SEQ ID NO: 263739 - DNA, 25 bp, Mus musculus
tcccaacaatccggcaggctcagag

SEQ ID NO: 263740 - DNA, 25 bp, Mus musculus
taggatcgtcccaacaatccggcag

SEQ ID NO: 263741 - DNA, 25 bp, Mus musculus
tcgtcccaacaatccggcaggctca

SEQ ID NO: 263742 - DNA, 25 bp, Mus musculus
gatcgtcccaacaatccggcaggct

SEQ ID NO: 263743 - DNA, 25 bp, Mus musculus
aggatcgtcccaacaatccggcagg

SEQ ID NO: 263744 - DNA, 25 bp, Mus musculus
ggatcgtcccaacaatccggcaggc

SEQ ID NO: 263745 - DNA, 25 bp, Mus musculus
aggctcagaggcccggagaccctcc

SEQ ID NO: 263746 - DNA, 25 bp, Mus musculus
acgcgggcccagctacagcttaatt

SEQ ID NO: 263747 - DNA, 25 bp, Mus musculus
cgcgggcccagctacagcttaattt

SEQ ID NO: 263748 - DNA, 25 bp, Mus musculus
gcgggcccagctacagcttaatttt

SEQ ID NO: 263749 - DNA, 25 bp, Mus musculus
cgggcccagctacagcttaattttg

SEQ ID NO: 263750 - DNA, 25 bp, Mus musculus
gggcccagctacagcttaattttgc

SEQ ID NO: 263751 - DNA, 25 bp, Mus musculus
tttgcccacggagggtagtaggatc

SEQ ID NO: 263752 - DNA, 25 bp, Mus musculus
cacgcgggcccagctacagcttaat

SEQ ID NO: 263753 - DNA, 25 bp, Mus musculus
ggatagactaggagcgaagggttgg

SEQ ID NO: 263754 - DNA, 25 bp, Mus musculus
gagaccccgatctgctccccacgcg

SEQ ID NO: 263755 - DNA, 25 bp, Mus musculus
ttggtggtgagaccccgatctgctc

SEQ ID NO: 263756 - DNA, 25 bp, Mus musculus
actaggagcgaagggttggtggtga

SEQ ID NO: 263757 - DNA, 25 bp, Mus musculus
tagactaggagcgaagggttggtgg

SEQ ID NO: 263758 - DNA, 25 bp, Mus musculus
gccgctgactcaccgcggccgggtc

SEQ ID NO: 263759 - DNA, 25 bp, Mus musculus
gcccacggagggtagtaggatcgtc

SEQ ID NO: 263760 - DNA, 25 bp, Mus musculus
aggagactcccagacgcaccaggca

SEQ ID NO: 263761 - DNA, 25 bp, Mus musculus
cgagtcgctccagcaggcggacaaa

SEQ ID NO: 263762 - DNA, 25 bp, Mus musculus
acggcgaaaaaagcccatcctgatg

SEQ ID NO: 263763 - DNA, 25 bp, Mus musculus
ccatggccatccaagacggcgaaaa

SEQ ID NO: 263764 - DNA, 25 bp, Mus musculus
aaggcgctacgaagagcctggcgca

SEQ ID NO: 263765 - DNA, 25 bp, Mus musculus
acgagcagagccacagccgttgagc

SEQ ID NO: 263766 - DNA, 25 bp, Mus musculus
cccgcagtgtgccaggtagaggaat

SEQ ID NO: 263767 - DNA, 25 bp, Mus musculus
ccagatcagcaccagacagagcgtc

SEQ ID NO: 263768 - DNA, 25 bp, Mus musculus
cgaagtcacctagggctcgcgacac

SEQ ID NO: 263769 - DNA, 25 bp, Mus musculus
cggtgcctgcttgtaggcgaagtca

SEQ ID NO: 263770 - DNA, 25 bp, Mus musculus
tcagcggacacgagctgcagctcag

SEQ ID NO: 263771 - DNA, 25 bp, Mus musculus
acgaactcgtcctcatcctggcgtg

SEQ ID NO: 263772 - DNA, 25 bp, Mus musculus
cacgccatcagaagccaggagaacg

SEQ ID NO: 263773 - DNA, 25 bp, Mus musculus
gccacagagcccgagcgactcagaa

SEQ ID NO: 263774 - DNA, 25 bp, Mus musculus
cccgctctccgaaacccagacgcct

SEQ ID NO: 263775 - DNA, 25 bp, Mus musculus
cccgcgctgcagtgcttgctcctct

SEQ ID NO: 263776 - DNA, 25 bp, Mus musculus
gctgctaaagcagcccgggaggatg

SEQ ID NO: 263777 - DNA, 25 bp, Mus musculus
cggtcttcgcccactgcagtgagta

SEQ ID NO: 263778 - DNA, 25 bp, Mus musculus
tcgcccactgcagtgagtatggaga

SEQ ID NO: 263779 - DNA, 25 bp, Mus musculus
cctggtgtggggcacagaaaaccgc

SEQ ID NO: 263780 - DNA, 25 bp, Mus musculus
cctgacccggaggacccggtgcaat

SEQ ID NO: 263781 - DNA, 25 bp, Mus musculus
gcacagaaaaccgcgtggggtcctc

SEQ ID NO: 263782 - DNA, 25 bp, Mus musculus
cgctttggaggcaactggggcatcc

SEQ ID NO: 263783 - DNA, 25 bp, Mus musculus
tcctagggtctccatcttccgcgag

SEQ ID NO: 263784 - DNA, 25 bp, Mus musculus
tccatcttccgcgagcgggctcgag

SEQ ID NO: 263785 - DNA, 25 bp, Mus musculus
ccagacgcctcccattaaaacggag

SEQ ID NO: 263786 - DNA, 25 bp, Mus musculus
gcaactggggcatcctgacccggag

SEQ ID NO: 263787 - DNA, 25 bp, Mus musculus
tggggtcctcctagggtctccatct

SEQ ID NO: 263788 - DNA, 25 bp, Mus musculus
cccgacaccctgcaaagcttccgtt

SEQ ID NO: 263789 - DNA, 25 bp, Mus musculus
atggtgggtttgcaaacagccagca

SEQ ID NO: 263790 - DNA, 25 bp, Mus musculus
cacgtagtcagagccgcgggtctac

SEQ ID NO: 263791 - DNA, 25 bp, Mus musculus
ttcccggtctgaatgacgggatggt

SEQ ID NO: 263792 - DNA, 25 bp, Mus musculus
aagcttccgtttcccggtctgaatg

SEQ ID NO: 263793 - DNA, 25 bp, Mus musculus
gcaaagcttccgtttcccggtctga

SEQ ID NO: 263794 - DNA, 25 bp, Mus musculus
gcaaacagccagcaagtaacgaacc

SEQ ID NO: 263795 - DNA, 25 bp, Mus musculus
tgggtttgcaaacagccagcaagta

SEQ ID NO: 263796 - DNA, 25 bp, Mus musculus
gccagcaagtaacgaaccggactta

SEQ ID NO: 263797 - DNA, 25 bp, Mus musculus
cagcaagtaacgaaccggacttact

SEQ ID NO: 263798 - DNA, 25 bp, Mus musculus
ctttttgccctttgtagacacgtag

SEQ ID NO: 263799 - DNA, 25 bp, Mus musculus
tgccctttgtagacacgtagtcaga

SEQ ID NO: 263800 - DNA, 25 bp, Mus musculus
tttgtagacacgtagtcagagccgc

SEQ ID NO: 263801 - DNA, 25 bp, Mus musculus
agacacgtagtcagagccgcgggtc

SEQ ID NO: 263802 - DNA, 25 bp, Mus musculus
tgggtgacagcttggaaagcatccc

SEQ ID NO: 263803 - DNA, 25 bp, Mus musculus
cctgggtgacagcttggaaagcatc

SEQ ID NO: 263804 - DNA, 25 bp, Mus musculus
ggtgacagcttggaaagcatcccta

SEQ ID NO: 263805 - DNA, 25 bp, Mus musculus
ttcagtctcagaaccacgggaccca

SEQ ID NO: 263806 - DNA, 25 bp, Mus musculus
ccagggacgttcagtctcagaacca

SEQ ID NO: 263807 - DNA, 25 bp, Mus musculus
cgttcagtctcagaaccacgggacc

SEQ ID NO: 263808 - DNA, 25 bp, Mus musculus
cccaacagtccggcctgggtgacag

SEQ ID NO: 263809 - DNA, 25 bp, Mus musculus
tgacagcttggaaagcatccctagc

SEQ ID NO: 263810 - DNA, 25 bp, Mus musculus
cagcttggaaagcatccctagcctg

SEQ ID NO: 263811 - DNA, 25 bp, Mus musculus
cggtgaccctgaccccgtgcctcca

SEQ ID NO: 263812 - DNA, 25 bp, Mus musculus
cccagggacgttcagtctcagaacc

SEQ ID NO: 263813 - DNA, 25 bp, Mus musculus
gactcagttgttcgtcgtccccggc

SEQ ID NO: 263814 - DNA, 25 bp, Mus musculus
gacgttcagtctcagaaccacggga

SEQ ID NO: 263815 - DNA, 25 bp, Mus musculus
agggacgttcagtctcagaaccacg

SEQ ID NO: 263816 - DNA, 25 bp, Mus musculus
ttaccgcaaagtgctgcaggccgtg

SEQ ID NO: 263817 - DNA, 25 bp, Mus musculus
cctttccagtgagaatgcttggccc

SEQ ID NO: 263818 - DNA, 25 bp, Mus musculus
gagcggtcttcacgggcctcatggc

SEQ ID NO: 263819 - DNA, 25 bp, Mus musculus
gtgagaatgcttggccctgcccagc

SEQ ID NO: 263820 - DNA, 25 bp, Mus musculus
cgcaaagtgctgcaggccgtgcacc

SEQ ID NO: 263821 - DNA, 25 bp, Mus musculus
tctcagggtttaccgcaaagtgctg

SEQ ID NO: 263822 - DNA, 25 bp, Mus musculus
accatctctctcagggtttaccgca

SEQ ID NO: 263823 - DNA, 25 bp, Mus musculus
tgttgggtctctgcgccaccatctc

SEQ ID NO: 263824 - DNA, 25 bp, Mus musculus
gcgcacctggccctgttgggtctct

SEQ ID NO: 263825 - DNA, 25 bp, Mus musculus
catcgtgtccgtggctgcgcacctg

SEQ ID NO: 263826 - DNA, 25 bp, Mus musculus
actttagcatcgtgtccgtggctgc

SEQ ID NO: 263827 - DNA, 25 bp, Mus musculus
cctgcactttagcatcgtgtccgtg

SEQ ID NO: 263828 - DNA, 25 bp, Mus musculus
ctgcctcctgcactttagcatcgtg

SEQ ID NO: 263829 - DNA, 25 bp, Mus musculus
cggcaccaaccctttccagtgagaa

SEQ ID NO: 263830 - DNA, 25 bp, Mus musculus
cttctctttttgcagctcggcgatc

SEQ ID NO: 263831 - DNA, 25 bp, Mus musculus
agccgaagccgtcttccttagcgga

SEQ ID NO: 263832 - DNA, 25 bp, Mus musculus
tgaggacaaacgaggaagtgtacga

SEQ ID NO: 263833 - DNA, 25 bp, Mus musculus
cgaggaagtgtacgaagggctaaca

SEQ ID NO: 263834 - DNA, 25 bp, Mus musculus
gtcgccgaggacttgaacttcactg

SEQ ID NO: 263835 - DNA, 25 bp, Mus musculus
tgaacttcactgtgtgtaaagagag

SEQ ID NO: 263836 - DNA, 25 bp, Mus musculus
tgtaaagagagaagccgtcaggttg

SEQ ID NO: 263837 - DNA, 25 bp, Mus musculus
ttccttagcggatgttgaccctggc

SEQ ID NO: 263838 - DNA, 25 bp, Mus musculus
tgttgaccctggcaaatctctcacc

SEQ ID NO: 263839 - DNA, 25 bp, Mus musculus
ctcttcgtaggggatcttgcagccc

SEQ ID NO: 263840 - DNA, 25 bp, Mus musculus
tcttgcagcccggtttgtgggccac

SEQ ID NO: 263841 - DNA, 25 bp, Mus musculus
ttgtgggccaccaggacaaactcca

SEQ ID NO: 263842 - DNA, 25 bp, Mus musculus
caggacaaactccaggcgttccttc

SEQ ID NO: 263843 - DNA, 25 bp, Mus musculus
caggcgttccttctctttttgcagc

SEQ ID NO: 263844 - DNA, 25 bp, Mus musculus
gtcacgtgcgcgatcagagcccgac

SEQ ID NO: 263845 - DNA, 25 bp, Mus musculus
tcagagcccgaccatcgagtcagtc

SEQ ID NO: 263846 - DNA, 25 bp, Mus musculus
gaccatcgagtcagtcctccagctt

SEQ ID NO: 263847 - DNA, 25 bp, Mus musculus
cggctcgggtctttccggccaggca

SEQ ID NO: 263848 - DNA, 25 bp, Mus musculus
cggccaggcagtccgcgcttttgtc

SEQ ID NO: 263849 - DNA, 25 bp, Mus musculus
aaagaggagaatcccgattattagc

SEQ ID NO: 263850 - DNA, 25 bp, Mus musculus
tgccgccacagccagtacgtgagtc

SEQ ID NO: 263851 - DNA, 25 bp, Mus musculus
ttcgggcttagaaagaggagaatcc

SEQ ID NO: 263852 - DNA, 25 bp, Mus musculus
gtcatggccgtttcgggcttagaaa

SEQ ID NO: 263853 - DNA, 25 bp, Mus musculus
ccttgactgtcatggccgtttcggg

SEQ ID NO: 263854 - DNA, 25 bp, Mus musculus
gcaggctgccatcggagcaggccct

SEQ ID NO: 263855 - DNA, 25 bp, Mus musculus
tgactttccacacgccctggggagc

SEQ ID NO: 263856 - DNA, 25 bp, Mus musculus
ggagggagagcgtgactttccacac

SEQ ID NO: 263857 - DNA, 25 bp, Mus musculus
cagtacgtgagtcccgggctgccga

SEQ ID NO: 263858 - DNA, 25 bp, Mus musculus
tcgccaacgtttgcccagctgcatt

SEQ ID NO: 263859 - DNA, 25 bp, Mus musculus
gagtcaccagtagtcaagtccagca

SEQ ID NO: 263860 - DNA, 25 bp, Mus musculus
gcgcgatccagaagcccacagaaag

SEQ ID NO: 263861 - DNA, 25 bp, Mus musculus
tcctgtcgaagcgtcccaagaaatg

SEQ ID NO: 263862 - DNA, 25 bp, Mus musculus
agcgtgcgcttcagatgcagttcca

SEQ ID NO: 263863 - DNA, 25 bp, Mus musculus
gaccgccgctgtacctcctgaaagt

SEQ ID NO: 263864 - DNA, 25 bp, Mus musculus
ctccggttcggagaactgcccaagt

SEQ ID NO: 263865 - DNA, 25 bp, Mus musculus
acgtctccaaagtgcgctgctcggg

SEQ ID NO: 263866 - DNA, 25 bp, Mus musculus
tagtctccgggaaaagcttgaaaca

SEQ ID NO: 263867 - DNA, 25 bp, Mus musculus
cgcgctccgcgcaaataaccttttg

SEQ ID NO: 263868 - DNA, 25 bp, Mus musculus
ggtatatactttgcaccgggcatcg

SEQ ID NO: 263869 - DNA, 25 bp, Mus musculus
cccaagtttcgatgcaagttccctc

SEQ ID NO: 263870 - DNA, 25 bp, Mus musculus
cgaaggagtccaccgaagacaggta

SEQ ID NO: 263871 - DNA, 25 bp, Mus musculus
aagtccaggctctgtcggtttcacg

SEQ ID NO: 263872 - DNA, 25 bp, Mus musculus
aggctccggacggacaggcactccg

SEQ ID NO: 263873 - DNA, 25 bp, Mus musculus
ggcaacgcgaatcgactgttctccg

SEQ ID NO: 263874 - DNA, 25 bp, Mus musculus
ctgcccaggcaacgcgaatcgactg

SEQ ID NO: 263875 - DNA, 25 bp, Mus musculus
ctgtggtttgttgacgttgctaggc

SEQ ID NO: 263876 - DNA, 25 bp, Mus musculus
tcgcaacggcgctgtggtttgttga

SEQ ID NO: 263877 - DNA, 25 bp, Mus musculus
acaggctgccgcgtcactgcgtcag

SEQ ID NO: 263878 - DNA, 25 bp, Mus musculus
aggtaacggcgtgccacaggctgcc

SEQ ID NO: 263879 - DNA, 25 bp, Mus musculus
ttcccgtcgctaggtaacggcgtgc

SEQ ID NO: 263880 - DNA, 25 bp, Mus musculus
gcttggccagggacaaacaaccttc

SEQ ID NO: 263881 - DNA, 25 bp, Mus musculus
ccctggccggtcttggctgctgtgc

SEQ ID NO: 263882 - DNA, 25 bp, Mus musculus
gagccgtctgtctgccctggccggt

SEQ ID NO: 263883 - DNA, 25 bp, Mus musculus
tgccatctccgggtcgagccgtctg

SEQ ID NO: 263884 - DNA, 25 bp, Mus musculus
cagacagtggtaatttggggatacg

SEQ ID NO: 263885 - DNA, 25 bp, Mus musculus
gggcgcaaacagaaagcagacagtg

SEQ ID NO: 263886 - DNA, 25 bp, Mus musculus
cggatggacagaccgatgcaggacc

SEQ ID NO: 263887 - DNA, 25 bp, Mus musculus
accgccgcacagaatcttccaggag

SEQ ID NO: 263888 - DNA, 25 bp, Mus musculus
taaaaatggacccagcgcgcgcgcg

SEQ ID NO: 263889 - DNA, 25 bp, Mus musculus
cggtgactatttttagcggcgttcg

SEQ ID NO: 263890 - DNA, 25 bp, Mus musculus
cagcagcgcggtgactatttttagc

SEQ ID NO: 263891 - DNA, 25 bp, Mus musculus
cgcttcgcagcagcgcggtgactat

SEQ ID NO: 263892 - DNA, 25 bp, Mus musculus
ctatttcgggctccgcttcgcagca

SEQ ID NO: 263893 - DNA, 25 bp, Mus musculus
cgctgccttatctggcggccgctat

SEQ ID NO: 263894 - DNA, 25 bp, Mus musculus
tcgggtaaaaatggacccagcgcgc

SEQ ID NO: 263895 - DNA, 25 bp, Mus musculus
tgagtcgtcgctgccttatctggcg

SEQ ID NO: 263896 - DNA, 25 bp, Mus musculus
gaagcgctgagtcgtcgctgcctta

SEQ ID NO: 263897 - DNA, 25 bp, Mus musculus
accgatgcaggacctgacggggcca

SEQ ID NO: 263898 - DNA, 25 bp, Mus musculus
tatcgcggcggaataaggaaaccga

SEQ ID NO: 263899 - DNA, 25 bp, Mus musculus
tggacagaccgatgcaggacctgac

SEQ ID NO: 263900 - DNA, 25 bp, Mus musculus
gtcgggtccggtgcgctccactgtc

SEQ ID NO: 263901 - DNA, 25 bp, Mus musculus
ctctgctccacgctatttcgggctc

SEQ ID NO: 263902 - DNA, 25 bp, Mus musculus
tcgggctccgggcactataaataga

SEQ ID NO: 263903 - DNA, 25 bp, Mus musculus
cgggctccgggcactataaatagaa

SEQ ID NO: 263904 - DNA, 25 bp, Mus musculus
ctccgggcactataaatagaagctc

SEQ ID NO: 263905 - DNA, 25 bp, Mus musculus
cgggcactataaatagaagctctca

SEQ ID NO: 263906 - DNA, 25 bp, Mus musculus
taaatagaagctctcacagccgagg

SEQ ID NO: 263907 - DNA, 25 bp, Mus musculus
atagaagctctcacagccgaggcga

SEQ ID NO: 263908 - DNA, 25 bp, Mus musculus
gaagctctcacagccgaggcgagcc

SEQ ID NO: 263909 - DNA, 25 bp, Mus musculus
ggcccgccgcgatcgccgtcaccgc

SEQ ID NO: 263910 - DNA, 25 bp, Mus musculus
ccgtcaccgcggctaagtttagagg

SEQ ID NO: 263911 - DNA, 25 bp, Mus musculus
tcaccgcggctaagtttagaggcgg

SEQ ID NO: 263912 - DNA, 25 bp, Mus musculus
gacgccggcctggtcactgtggtcc

SEQ ID NO: 263913 - DNA, 25 bp, Mus musculus
ggccgctctgctccacgctatttcg

SEQ ID NO: 263914 - DNA, 25 bp, Mus musculus
ggccaattgcctctgagcgagtgtc

SEQ ID NO: 263915 - DNA, 25 bp, Mus musculus
ccaatcattgcggaggctgagacta

SEQ ID NO: 263916 - DNA, 25 bp, Mus musculus
tggcagcggaagaagccaatcattg

SEQ ID NO: 263917 - DNA, 25 bp, Mus musculus
cttagacgcagagctaggaccgaga

SEQ ID NO: 263918 - DNA, 25 bp, Mus musculus
ttggcagtgcttagacgcagagcta

SEQ ID NO: 263919 - DNA, 25 bp, Mus musculus
accaggtgagttttggcagtgctta

SEQ ID NO: 263920 - DNA, 25 bp, Mus musculus
tctaggcatcgggaaagaccaggtg

SEQ ID NO: 263921 - DNA, 25 bp, Mus musculus
cccgtggtatttccttctaggcatc

SEQ ID NO: 263922 - DNA, 25 bp, Mus musculus
aagtgagtctagcaggagttgtgct

SEQ ID NO: 263923 - DNA, 25 bp, Mus musculus
gcggggctataagacccgtagacca

SEQ ID NO: 263924 - DNA, 25 bp, Mus musculus
gcccactggttggtcctctggaacc

SEQ ID NO: 263925 - DNA, 25 bp, Mus musculus
ctctggaacctaacgctagcgaacc

SEQ ID NO: 263926 - DNA, 25 bp, Mus musculus
cccgtagaccaatccggagtgagaa

SEQ ID NO: 263927 - DNA, 25 bp, Mus musculus
ctggcgttgtgtcgcctctgtttcc

SEQ ID NO: 263928 - DNA, 25 bp, Mus musculus
tggccggtgtgtcagcgtcgctgcc

SEQ ID NO: 263929 - DNA, 25 bp, Mus musculus
gcagctggtcggtccctgtctgctc

SEQ ID NO: 263930 - DNA, 25 bp, Mus musculus
gggagactcgactgcattcctggcc

SEQ ID NO: 263931 - DNA, 25 bp, Mus musculus
acagggagactcgactgcattcctg

SEQ ID NO: 263932 - DNA, 25 bp, Mus musculus
acggtggcgagacagggagactcga

SEQ ID NO: 263933 - DNA, 25 bp, Mus musculus
tcccagcaggactgcagcgcatggg

SEQ ID NO: 263934 - DNA, 25 bp, Mus musculus
acagcggcgcgtgcacgtgggattt

SEQ ID NO: 263935 - DNA, 25 bp, Mus musculus
ttccgaggcaggtagaggtgcagct

SEQ ID NO: 263936 - DNA, 25 bp, Mus musculus
cccaagtaaacagcggcgcgtgcac

SEQ ID NO: 263937 - DNA, 25 bp, Mus musculus
cggcccaagtaaacagcggcgcgtg

SEQ ID NO: 263938 - DNA, 25 bp, Mus musculus
aggtgcagctggtcggtccctgtct

SEQ ID NO: 263939 - DNA, 25 bp, Mus musculus
tccgcggcccaagtaaacagcggcg

SEQ ID NO: 263940 - DNA, 25 bp, Mus musculus
tgctccgcggcccaagtaaacagcg

SEQ ID NO: 263941 - DNA, 25 bp, Mus musculus
agactcgactgcattcctggccggt

SEQ ID NO: 263942 - DNA, 25 bp, Mus musculus
agtcagagtcacgtcgtctaacctg

SEQ ID NO: 263943 - DNA, 25 bp, Mus musculus
gactccaaatggaagtgtccctggc

SEQ ID NO: 263944 - DNA, 25 bp, Mus musculus
gcctcgcccattcgggactacaaat

SEQ ID NO: 263945 - DNA, 25 bp, Mus musculus
gggactacaaatcccaaggtgctcc

SEQ ID NO: 263946 - DNA, 25 bp, Mus musculus
gtctaacctgttcccaggcgactgc

SEQ ID NO: 263947 - DNA, 25 bp, Mus musculus
gatctgccccgacgcgtgagttcca

SEQ ID NO: 263948 - DNA, 25 bp, Mus musculus
aggtgctccaggcaaccgcagttcc

SEQ ID NO: 263949 - DNA, 25 bp, Mus musculus
cctcctccgagggacacgcctccct

SEQ ID NO: 263950 - DNA, 25 bp, Mus musculus
cctccagtcagagtcacgtcgtcta

SEQ ID NO: 263951 - DNA, 25 bp, Mus musculus
cgcgtctgactccaaatggaagtgt

SEQ ID NO: 263952 - DNA, 25 bp, Mus musculus
tacaaatcccaaggtgctccaggca

SEQ ID NO: 263953 - DNA, 25 bp, Mus musculus
aatcccaaggtgctccaggcaaccg

SEQ ID NO: 263954 - DNA, 25 bp, Mus musculus
agtcacgtcgtctaacctgttccca

SEQ ID NO: 263955 - DNA, 25 bp, Mus musculus
cgtcgtctaacctgttcccaggcga

SEQ ID NO: 263956 - DNA, 25 bp, Mus musculus
aaggggagcagacctcgtgtccaaa

SEQ ID NO: 263957 - DNA, 25 bp, Mus musculus
tgcccgtccttacagacggaggaaa

SEQ ID NO: 263958 - DNA, 25 bp, Mus musculus
gcagacctcgtgtccaaagtgggca

SEQ ID NO: 263959 - DNA, 25 bp, Mus musculus
gtaagtccaactgcccgtccttaca

SEQ ID NO: 263960 - DNA, 25 bp, Mus musculus
cctcgtgtccaaagtgggcaaaacg

SEQ ID NO: 263961 - DNA, 25 bp, Mus musculus
tgcactcgaacctggtaccgccggg

SEQ ID NO: 263962 - DNA, 25 bp, Mus musculus
tgacccagcccggaactagtgacag

SEQ ID NO: 263963 - DNA, 25 bp, Mus musculus
ggacttgctgcactcgaacctggta

SEQ ID NO: 263964 - DNA, 25 bp, Mus musculus
ccagcccggaactagtgacagtcca

SEQ ID NO: 263965 - DNA, 25 bp, Mus musculus
ccggaactagtgacagtccagtggg

SEQ ID NO: 263966 - DNA, 25 bp, Mus musculus
gtagacacgtaaggggagcagacct

SEQ ID NO: 263967 - DNA, 25 bp, Mus musculus
ctgaagggacctagtggagggactt

SEQ ID NO: 263968 - DNA, 25 bp, Mus musculus
ggagggacttgctgcactcgaacct

SEQ ID NO: 263969 - DNA, 25 bp, Mus musculus
caaagtgggcaaaacggtgacccag

SEQ ID NO: 263970 - DNA, 25 bp, Mus musculus
agcctacgacacagcgggcacgttc

SEQ ID NO: 263971 - DNA, 25 bp, Mus musculus
gtccctgcacccttacagccctctg

SEQ ID NO: 263972 - DNA, 25 bp, Mus musculus
cctctgtctcccaagggccgtccgt

SEQ ID NO: 263973 - DNA, 25 bp, Mus musculus
ggccgtccgtcttcaccgcgcaccc

SEQ ID NO: 263974 - DNA, 25 bp, Mus musculus
agcctgacacctacagcagcctaga

SEQ ID NO: 263975 - DNA, 25 bp, Mus musculus
tgacacctacagcagcctagatcgg

SEQ ID NO: 263976 - DNA, 25 bp, Mus musculus
acagcagcctagatcgggcgccatc

SEQ ID NO: 263977 - DNA, 25 bp, Mus musculus
ccgcgccttcgatggagcgggcagc

SEQ ID NO: 263978 - DNA, 25 bp, Mus musculus
ccctttgactatctgggccgcgcag

SEQ ID NO: 263979 - DNA, 25 bp, Mus musculus
ccaggccttcttcccggagcgagga

SEQ ID NO: 263980 - DNA, 25 bp, Mus musculus
tgctgcagcctacgacacagcgggc

SEQ ID NO: 263981 - DNA, 25 bp, Mus musculus
cagcgggcacgttcgggagccctct

SEQ ID NO: 263982 - DNA, 25 bp, Mus musculus
cgatggcatagaggcccgttttgga

SEQ ID NO: 263983 - DNA, 25 bp, Mus musculus
atagaggcccgttttggacgctcgg

SEQ ID NO: 263984 - DNA, 25 bp, Mus musculus
tctgtgttctgctcgaagtcctcgg

SEQ ID NO: 263985 - DNA, 25 bp, Mus musculus
tacatgctggagctcaagcgcacgc

SEQ ID NO: 263986 - DNA, 25 bp, Mus musculus
cccggagcagttctcctacatgctg

SEQ ID NO: 263987 - DNA, 25 bp, Mus musculus
gtacgactacatctacccggagcag

SEQ ID NO: 263988 - DNA, 25 bp, Mus musculus
tgctggtctacttcccgtacgacta

SEQ ID NO: 263989 - DNA, 25 bp, Mus musculus
ccgccaggctcaacgtggacgggct

SEQ ID NO: 263990 - DNA, 25 bp, Mus musculus
ccgccatgaagtgagatggggtctc

SEQ ID NO: 263991 - DNA, 25 bp, Mus musculus
ggacgccgcgatcagccgccatgaa

SEQ ID NO: 263992 - DNA, 25 bp, Mus musculus
ccctcgttgaatattcaggagcggg

SEQ ID NO: 263993 - DNA, 25 bp, Mus musculus
gaaggtgtgtctctgggtcacgccc

SEQ ID NO: 263994 - DNA, 25 bp, Mus musculus
ttttccgattggcagagtgacggga

SEQ ID NO: 263995 - DNA, 25 bp, Mus musculus
atgcgcacgcgccaattttccgatt

SEQ ID NO: 263996 - DNA, 25 bp, Mus musculus
tcaagcgcacgctggacgccaaggt

SEQ ID NO: 263997 - DNA, 25 bp, Mus musculus
aagtcctcggcgatcctcagcgatg

SEQ ID NO: 263998 - DNA, 25 bp, Mus musculus
gacctacttccggaggacaggcgga

SEQ ID NO: 263999 - DNA, 25 bp, Mus musculus
cgctcccgctctaggcctcagccta

SEQ ID NO: 264000 - DNA, 25 bp, Mus musculus
tcagtgtcactgtgccgtgagaacg

SEQ ID NO: 264001 - DNA, 25 bp, Mus musculus
agtatagggagggtctcagtgtcac

SEQ ID NO: 264002 - DNA, 25 bp, Mus musculus
gcagacacacctcccgcgttgatga

SEQ ID NO: 264003 - DNA, 25 bp, Mus musculus
caactggcccaagcgtgcagacaca

SEQ ID NO: 264004 - DNA, 25 bp, Mus musculus
gctacatcttcccaggggccttctg

SEQ ID NO: 264005 - DNA, 25 bp, Mus musculus
gccgcactgagtgacgcacgctccc

SEQ ID NO: 264006 - DNA, 25 bp, Mus musculus
tcactgtgccgtgagaacgccgagc

SEQ ID NO: 264007 - DNA, 25 bp, Mus musculus
gagccagcggttgcccaggacctac

SEQ ID NO: 264008 - DNA, 25 bp, Mus musculus
cccaggtaagcagcccgtgcaggga

SEQ ID NO: 264009 - DNA, 25 bp, Mus musculus
cgccctccacctcgtgaacactgca

SEQ ID NO: 264010 - DNA, 25 bp, Mus musculus
ttgcccaggacctacttccggagga

SEQ ID NO: 264011 - DNA, 25 bp, Mus musculus
acacctcccgcgttgatgatggagg

SEQ ID NO: 264012 - DNA, 25 bp, Mus musculus
ggagtgaactccagccactgcactc

SEQ ID NO: 264013 - DNA, 25 bp, Mus musculus
gcggacaagcgtggtaagctgcctc

SEQ ID NO: 264014 - DNA, 25 bp, Mus musculus
agccactgcactctctcatcgcgtg

SEQ ID NO: 264015 - DNA, 25 bp, Mus musculus
ttccggcgaaaggacaggagtgaac

SEQ ID NO: 264016 - DNA, 25 bp, Mus musculus
acatgcttcctagtcgtctctggcc

SEQ ID NO: 264017 - DNA, 25 bp, Mus musculus
ccaccaggtgtgcacatgcttccta

SEQ ID NO: 264018 - DNA, 25 bp, Mus musculus
gcacggcttctctctccaccaggtg

SEQ ID NO: 264019 - DNA, 25 bp, Mus musculus
gcagcccttccaccgggtaagcctg

SEQ ID NO: 264020 - DNA, 25 bp, Mus musculus
cgccaagtacttcctgcggcagatg

SEQ ID NO: 264021 - DNA, 25 bp, Mus musculus
gggtgtacaggtcgccaagtacttc

SEQ ID NO: 264022 - DNA, 25 bp, Mus musculus
ccaacctcaacctgaccgtggatga

SEQ ID NO: 264023 - DNA, 25 bp, Mus musculus
ggatccaggagcacctgaccgactc

SEQ ID NO: 264024 - DNA, 25 bp, Mus musculus
taagctgcctcgctggatccaggag

SEQ ID NO: 264025 - DNA, 25 bp, Mus musculus
tcctgcggcagatggcgcagccctt

SEQ ID NO: 264026 - DNA, 25 bp, Mus musculus
cagcattcggtgaaacctgcgttcc

SEQ ID NO: 264027 - DNA, 25 bp, Mus musculus
agcccaggctcgctcgcctccaact

SEQ ID NO: 264028 - DNA, 25 bp, Mus musculus
agtttccacagtgcgccctgcctta

SEQ ID NO: 264029 - DNA, 25 bp, Mus musculus
ccctgccttactctccctctctttg

SEQ ID NO: 264030 - DNA, 25 bp, Mus musculus
aggctcccttaccatgcatgtcttg

SEQ ID NO: 264031 - DNA, 25 bp, Mus musculus
catgcatgtcttgcaccctcaggct

SEQ ID NO: 264032 - DNA, 25 bp, Mus musculus
ggaccctccgacagccggccagccc

SEQ ID NO: 264033 - DNA, 25 bp, Mus musculus
tgcaccggacttcgcgtcacaaggc

SEQ ID NO: 264034 - DNA, 25 bp, Mus musculus
gctgtttttctactccgctaggggc

SEQ ID NO: 264035 - DNA, 25 bp, Mus musculus
ctcgggaatcccgaagcagccgccg

SEQ ID NO: 264036 - DNA, 25 bp, Mus musculus
tccgccagcacacattgagaaacct

SEQ ID NO: 264037 - DNA, 25 bp, Mus musculus
agcacacattgagaaacctgtggtc

SEQ ID NO: 264038 - DNA, 25 bp, Mus musculus
ccgcagctgtttttctactccgcta

SEQ ID NO: 264039 - DNA, 25 bp, Mus musculus
ccctctgccgcagcattcggtgaaa

SEQ ID NO: 264040 - DNA, 25 bp, Mus musculus
ggcgccgtgttcgacatctccaacg

SEQ ID NO: 264041 - DNA, 25 bp, Mus musculus
tctggccaatgagaacctgcctctc

SEQ ID NO: 264042 - DNA, 25 bp, Mus musculus
tgtcctctgggttctggccaatgag

SEQ ID NO: 264043 - DNA, 25 bp, Mus musculus
caatcattgggctctgtcctctggg

SEQ ID NO: 264044 - DNA, 25 bp, Mus musculus
ccgcctcctggaagtccaatcattg

SEQ ID NO: 264045 - DNA, 25 bp, Mus musculus
cagcctgcagtgtgcgctggtgccc

SEQ ID NO: 264046 - DNA, 25 bp, Mus musculus
tggcgcaccagcctgcagtgtgcgc

SEQ ID NO: 264047 - DNA, 25 bp, Mus musculus
gggccagtccatcgacgacatgatc

SEQ ID NO: 264048 - DNA, 25 bp, Mus musculus
gaagctggaaaagggccagtccatc

SEQ ID NO: 264049 - DNA, 25 bp, Mus musculus
atccgaagtcgaacaggtgcagctg

SEQ ID NO: 264050 - DNA, 25 bp, Mus musculus
ctgggctcatccgaagtcgaacagg

SEQ ID NO: 264051 - DNA, 25 bp, Mus musculus
tccaacgccgatcggctgggctcat

SEQ ID NO: 264052 - DNA, 25 bp, Mus musculus
gttcgacatctccaacgccgatcgg

SEQ ID NO: 264053 - DNA, 25 bp, Mus musculus
ccaatgagaacctgcctctccggag

SEQ ID NO: 264054 - DNA, 25 bp, Mus musculus
agccatcagggcctcaggaggtcgc

SEQ ID NO: 264055 - DNA, 25 bp, Mus musculus
cacacctccacttcgaaatgggaca

SEQ ID NO: 264056 - DNA, 25 bp, Mus musculus
cacctccacttcgaaatgggacagg

SEQ ID NO: 264057 - DNA, 25 bp, Mus musculus
cctccacttcgaaatgggacagggg

SEQ ID NO: 264058 - DNA, 25 bp, Mus musculus
ccacttcgaaatgggacaggggctc

SEQ ID NO: 264059 - DNA, 25 bp, Mus musculus
caggcaggccagcaggaacggctgc

SEQ ID NO: 264060 - DNA, 25 bp, Mus musculus
gtggcctgtcgcagggcagccatca

SEQ ID NO: 264061 - DNA, 25 bp, Mus musculus
cctgtcgcagggcagccatcagggc

SEQ ID NO: 264062 - DNA, 25 bp, Mus musculus
cagggcagccatcagggcctcagga

SEQ ID NO: 264063 - DNA, 25 bp, Mus musculus
gctggcacacctccacttcgaaatg

SEQ ID NO: 264064 - DNA, 25 bp, Mus musculus
gtgcccgccacacggcggaagagga

SEQ ID NO: 264065 - DNA, 25 bp, Mus musculus
aggtcgttggagatgcgggtgacga

SEQ ID NO: 264066 - DNA, 25 bp, Mus musculus
ggcacacctccacttcgaaatggga

SEQ ID NO: 264067 - DNA, 25 bp, Mus musculus
tcgcagggcagccatcagggcctca

SEQ ID NO: 264068 - DNA, 25 bp, Mus musculus
cagagttacgtgctgtaacactaga

SEQ ID NO: 264069 - DNA, 25 bp, Mus musculus
caggctatgactggaaggcgaggca

SEQ ID NO: 264070 - DNA, 25 bp, Mus musculus
ttcgggtcagtttggaggtcagctt

SEQ ID NO: 264071 - DNA, 25 bp, Mus musculus
tcaccttcgggtcagtttggaggtc

SEQ ID NO: 264072 - DNA, 25 bp, Mus musculus
tgcaggaagcgaagcagagaagaca

SEQ ID NO: 264073 - DNA, 25 bp, Mus musculus
gaccagaccatttttcagagttacg

SEQ ID NO: 264074 - DNA, 25 bp, Mus musculus
agctgtgtgcagagaaagacaagtc

SEQ ID NO: 264075 - DNA, 25 bp, Mus musculus
cacccgcgaggtaccggagctgtgt

SEQ ID NO: 264076 - DNA, 25 bp, Mus musculus
tgcagagaaagacaagtcatggtgg

SEQ ID NO: 264077 - DNA, 25 bp, Mus musculus
ctgtcagggcattatggatcctcgc

SEQ ID NO: 264078 - DNA, 25 bp, Mus musculus
gcattatggatcctcgcattgttta

SEQ ID NO: 264079 - DNA, 25 bp, Mus musculus
tcgcattgtttattgttccagatta

SEQ ID NO: 264080 - DNA, 25 bp, Mus musculus
gttccagattatcccatccaagttc

SEQ ID NO: 264081 - DNA, 25 bp, Mus musculus
tccaagttctaaccagaccagacca

SEQ ID NO: 264082 - DNA, 25 bp, Mus musculus
cactcaccgtgtccgagtttcgatc

SEQ ID NO: 264083 - DNA, 25 bp, Mus musculus
acgcccgagtcctcgcagagcgaga

SEQ ID NO: 264084 - DNA, 25 bp, Mus musculus
cgcgagctcaaaagctgggcgccgt

SEQ ID NO: 264085 - DNA, 25 bp, Mus musculus
ccgacctggggacgcgagctcaaaa

SEQ ID NO: 264086 - DNA, 25 bp, Mus musculus
aagacatcttctctggggtcccaga

SEQ ID NO: 264087 - DNA, 25 bp, Mus musculus
tgtccgagtttcgatcgttgcccgg

SEQ ID NO: 264088 - DNA, 25 bp, Mus musculus
agaagacaccgagggtcctagtggc

SEQ ID NO: 264089 - DNA, 25 bp, Mus musculus
ttctatggctggactcaggcagggc

SEQ ID NO: 264090 - DNA, 25 bp, Mus musculus
tcaaagtcatgggaagcgttggtct

SEQ ID NO: 264091 - DNA, 25 bp, Mus musculus
cagagaggcctcaaagtcatgggaa

SEQ ID NO: 264092 - DNA, 25 bp, Mus musculus
gaagagtccaaagacaggggcgccc

SEQ ID NO: 264093 - DNA, 25 bp, Mus musculus
cagagggaccggagaagagtccaaa

SEQ ID NO: 264094 - DNA, 25 bp, Mus musculus
tgccatccgggaagagtcgaggcca

SEQ ID NO: 264095 - DNA, 25 bp, Mus musculus
agcgccgtcctcgaagacatcttct

SEQ ID NO: 264096 - DNA, 25 bp, Mus musculus
cctttgaagacactccaacgctgga

SEQ ID NO: 264097 - DNA, 25 bp, Mus musculus
cgcggagctggggacactgcccaat

SEQ ID NO: 264098 - DNA, 25 bp, Mus musculus
actgcccaatgggacatcgtgccgc

SEQ ID NO: 264099 - DNA, 25 bp, Mus musculus
gagacgggcaagtgcgctctttctt

SEQ ID NO: 264100 - DNA, 25 bp, Mus musculus
accgggcatacggaggagctccgca

SEQ ID NO: 264101 - DNA, 25 bp, Mus musculus
tgtcggtacgtctcgtgcacgcgca

SEQ ID NO: 264102 - DNA, 25 bp, Mus musculus
ttccgaacccatggcgatgaggagc

SEQ ID NO: 264103 - DNA, 25 bp, Mus musculus
ccagctggagaagccgctcgaagac

SEQ ID NO: 264104 - DNA, 25 bp, Mus musculus
tcgaagactggctttcctgagactc

SEQ ID NO: 264105 - DNA, 25 bp, Mus musculus
catccctggcggagagactggtacc

SEQ ID NO: 264106 - DNA, 25 bp, Mus musculus
taaaggaaccactgtcaggtgagtg

SEQ ID NO: 264107 - DNA, 25 bp, Mus musculus
ccctgatgcagattcggggactatc

SEQ ID NO: 264108 - DNA, 25 bp, Mus musculus
ggactatctatcaaccctgcgtggg

SEQ ID NO: 264109 - DNA, 25 bp, Mus musculus
gctccgcagatttcggcctcctaaa

SEQ ID NO: 264110 - DNA, 25 bp, Mus musculus
tgcactggcacaatcatgtgtaccc

SEQ ID NO: 264111 - DNA, 25 bp, Mus musculus
ccacgaggcactggccgagtggctc

SEQ ID NO: 264112 - DNA, 25 bp, Mus musculus
tggctaccacgaggcactggccgag

SEQ ID NO: 264113 - DNA, 25 bp, Mus musculus
cgcgagcggacgagcacatcctgga

SEQ ID NO: 264114 - DNA, 25 bp, Mus musculus
acgagcacatcctggagctggaggc

SEQ ID NO: 264115 - DNA, 25 bp, Mus musculus
gcgctgctgtacgaggcgctgcagc

SEQ ID NO: 264116 - DNA, 25 bp, Mus musculus
ctggtgcgcgagtcgctggcttccc

SEQ ID NO: 264117 - DNA, 25 bp, Mus musculus
cgcagctgggcctcgtgctgctgca

SEQ ID NO: 264118 - DNA, 25 bp, Mus musculus
gcggatcgttatgcgctgttgcact

SEQ ID NO: 264119 - DNA, 25 bp, Mus musculus
cgtctacctgcgtggctaccacgag

SEQ ID NO: 264120 - DNA, 25 bp, Mus musculus
gcgctgttgcactggcacaatcatg

SEQ ID NO: 264121 - DNA, 25 bp, Mus musculus
ctcccgctggcggatcgttatgcgc

SEQ ID NO: 264122 - DNA, 25 bp, Mus musculus
cgttatgcgctgttgcactggcaca

SEQ ID NO: 264123 - DNA, 25 bp, Mus musculus
cggcccgcaagctgcgcacgcactg

SEQ ID NO: 264124 - DNA, 25 bp, Mus musculus
gtctgcgtgtacaccacgggcctga

SEQ ID NO: 264125 - DNA, 25 bp, Mus musculus
ctgaggcttggacccccgggattct

SEQ ID NO: 264126 - DNA, 25 bp, Mus musculus
agggaacagggtctgcgtgtacacc

SEQ ID NO: 264127 - DNA, 25 bp, Mus musculus
acaccacgggcctgaggcttggacc

SEQ ID NO: 264128 - DNA, 25 bp, Mus musculus
ccgggattctgcatctggcgaaccc

SEQ ID NO: 264129 - DNA, 25 bp, Mus musculus
cttggcggcgttgcgtcatgacgca

SEQ ID NO: 264130 - DNA, 25 bp, Mus musculus
cgataaaggttgagtgcctcgcgcc

SEQ ID NO: 264131 - DNA, 25 bp, Mus musculus
cgttgcgtcatgacgcacgaaggcg

SEQ ID NO: 264132 - DNA, 25 bp, Mus musculus
cggagtcgtttggagaacggcgagc

SEQ ID NO: 264133 - DNA, 25 bp, Mus musculus
agggaaggtcgctatttcgcctccg

SEQ ID NO: 264134 - DNA, 25 bp, Mus musculus
aggtcgctatttcgcctccgatatt

SEQ ID NO: 264135 - DNA, 25 bp, Mus musculus
ttcgcctccgatatttaatctgtta

SEQ ID NO: 264136 - DNA, 25 bp, Mus musculus
tatttaatctgttaggccggctccg

SEQ ID NO: 264137 - DNA, 25 bp, Mus musculus
gccgccgataaaggttgagtgcctc

SEQ ID NO: 264138 - DNA, 25 bp, Mus musculus
ctgacggctgtttcctgctgggacc

SEQ ID NO: 264139 - DNA, 25 bp, Mus musculus
acacgggggacacacacgggcatgt

SEQ ID NO: 264140 - DNA, 25 bp, Mus musculus
acaaacaagcggtcacaggaagccc

SEQ ID NO: 264141 - DNA, 25 bp, Mus musculus
gggctcgcaaacaaacaagcggtca

SEQ ID NO: 264142 - DNA, 25 bp, Mus musculus
gccaccagggctcgcaaacaaacaa

SEQ ID NO: 264143 - DNA, 25 bp, Mus musculus
cttaatacgatttccctccttctgc

SEQ ID NO: 264144 - DNA, 25 bp, Mus musculus
ccagggcattcttaatacgatttcc

SEQ ID NO: 264145 - DNA, 25 bp, Mus musculus
cctgctgggaccagggcattcttaa

SEQ ID NO: 264146 - DNA, 25 bp, Mus musculus
agagcgtgtctgacggctgtttcct

SEQ ID NO: 264147 - DNA, 25 bp, Mus musculus
agcagagcgtgtctgacggctgttt

SEQ ID NO: 264148 - DNA, 25 bp, Mus musculus
ctggcctgcgccaaagcagggtggc

SEQ ID NO: 264149 - DNA, 25 bp, Mus musculus
tggcatccgtcccagcgtttcctgg

SEQ ID NO: 264150 - DNA, 25 bp, Mus musculus
gggtctctttggcatccgtcccagc

SEQ ID NO: 264151 - DNA, 25 bp, Mus musculus
tgggaccagggcattcttaatacga

SEQ ID NO: 264152 - DNA, 25 bp, Mus musculus
gaaggccaaccagaccggacgaggc

SEQ ID NO: 264153 - DNA, 25 bp, Mus musculus
cggggaaggaccacattgccggcta

SEQ ID NO: 264154 - DNA, 25 bp, Mus musculus
acattgccggctagcaggaaggcca

SEQ ID NO: 264155 - DNA, 25 bp, Mus musculus
tagcaggaaggccaaccagaccgga

SEQ ID NO: 264156 - DNA, 25 bp, Mus musculus
aaggaccacattgccggctagcagg

SEQ ID NO: 264157 - DNA, 25 bp, Mus musculus
aaccagaccggacgaggccgctcca

SEQ ID NO: 264158 - DNA, 25 bp, Mus musculus
agcctggttccaggcggggtgagtt

SEQ ID NO: 264159 - DNA, 25 bp, Mus musculus
gtgagttgagaggatccggtgagct

SEQ ID NO: 264160 - DNA, 25 bp, Mus musculus
cctggggcttgtcccaggaggacaa

SEQ ID NO: 264161 - DNA, 25 bp, Mus musculus
gtctgagtcccgagtgtgctccaaa

SEQ ID NO: 264162 - DNA, 25 bp, Mus musculus
ccgagtgtgctccaaagccagggcg

SEQ ID NO: 264163 - DNA, 25 bp, Mus musculus
gctccaaagccagggcggtgagagt

SEQ ID NO: 264164 - DNA, 25 bp, Mus musculus
gagtcccgagtgtgctccaaagcca

SEQ ID NO: 264165 - DNA, 25 bp, Mus musculus
ccggctagcaggaaggccaaccaga

SEQ ID NO: 264166 - DNA, 25 bp, Mus musculus
gcgacagccagccacgatatccagg

SEQ ID NO: 264167 - DNA, 25 bp, Mus musculus
cagcaagcgacagccagccacgata

SEQ ID NO: 264168 - DNA, 25 bp, Mus musculus
gcagccgctacgtcgtggtccaggc

SEQ ID NO: 264169 - DNA, 25 bp, Mus musculus
tggctctcagccaaccggagctgca

SEQ ID NO: 264170 - DNA, 25 bp, Mus musculus
caggcgccatggcaggggtctcctc

SEQ ID NO: 264171 - DNA, 25 bp, Mus musculus
caggtcgaccggcacaaccgtgggc

SEQ ID NO: 264172 - DNA, 25 bp, Mus musculus
cggcacaaccgtgggctcgggctca

SEQ ID NO: 264173 - DNA, 25 bp, Mus musculus
agttcctcctcggacgaggatgcag

SEQ ID NO: 264174 - DNA, 25 bp, Mus musculus
agctccgagtcggtctccgcagctt

SEQ ID NO: 264175 - DNA, 25 bp, Mus musculus
ccgaccctgggatgactccatggca

SEQ ID NO: 264176 - DNA, 25 bp, Mus musculus
ctgggatgactccatggcacggagc

SEQ ID NO: 264177 - DNA, 25 bp, Mus musculus
agcggacgtgaggtcccgagtccca

SEQ ID NO: 264178 - DNA, 25 bp, Mus musculus
tcctgctcgggctccataccaggga

SEQ ID NO: 264179 - DNA, 25 bp, Mus musculus
ccaggtatagttcctcctcggacga

SEQ ID NO: 264180 - DNA, 25 bp, Mus musculus
atcgagccttatggcaggtcattgc

SEQ ID NO: 264181 - DNA, 25 bp, Mus musculus
ttaacaagagccaccgacaccagag

SEQ ID NO: 264182 - DNA, 25 bp, Mus musculus
acgcggtgctattcgagtttctgca

SEQ ID NO: 264183 - DNA, 25 bp, Mus musculus
gcggagctaaataggatcaccaatc

SEQ ID NO: 264184 - DNA, 25 bp, Mus musculus
tggacccgcctcctggctttcaaga

SEQ ID NO: 264185 - DNA, 25 bp, Mus musculus
cggaagatgttaacagcgcggccaa

SEQ ID NO: 264186 - DNA, 25 bp, Mus musculus
cgagtttctgcacaccgagatggtg

SEQ ID NO: 264187 - DNA, 25 bp, Mus musculus
actcagccaattggatgtccgaaga

SEQ ID NO: 264188 - DNA, 25 bp, Mus musculus
tggaccctcacaggaatcagagact

SEQ ID NO: 264189 - DNA, 25 bp, Mus musculus
ttagacaagtcgcttccgtagtgtg

SEQ ID NO: 264190 - DNA, 25 bp, Mus musculus
tggccaataggaaagcggttagaca

SEQ ID NO: 264191 - DNA, 25 bp, Mus musculus
gcgctcagttctaggcctcgtcctg

SEQ ID NO: 264192 - DNA, 25 bp, Mus musculus
cacgtgagccgagttatggccaata

SEQ ID NO: 264193 - DNA, 25 bp, Mus musculus
ccagagtcccggaaggaaggccata

SEQ ID NO: 264194 - DNA, 25 bp, Mus musculus
ctcggtccagttcgcggggcccaga

SEQ ID NO: 264195 - DNA, 25 bp, Mus musculus
cctgcaccggcagcctgcggctcct

SEQ ID NO: 264196 - DNA, 25 bp, Mus musculus
caccggcagcctgcggctccttcac

SEQ ID NO: 264197 - DNA, 25 bp, Mus musculus
cagaaggggtcacccgcgatcgccg

SEQ ID NO: 264198 - DNA, 25 bp, Mus musculus
ggcccagaaggggtcacccgcgatc

SEQ ID NO: 264199 - DNA, 25 bp, Mus musculus
ctggagcccagcgagcccaccgagg

SEQ ID NO: 264200 - DNA, 25 bp, Mus musculus
cctcctggagcccagcgagcccacc

SEQ ID NO: 264201 - DNA, 25 bp, Mus musculus
accgcagtatcagccacggccagca

SEQ ID NO: 264202 - DNA, 25 bp, Mus musculus
cacacccaccgcagtatcagccacg

SEQ ID NO: 264203 - DNA, 25 bp, Mus musculus
agccagcgcccccaagcctgtcacc

SEQ ID NO: 264204 - DNA, 25 bp, Mus musculus
tgcccgcatggaaccagccagcgcc

SEQ ID NO: 264205 - DNA, 25 bp, Mus musculus
gccgctgcccgcatggaaccagcca

SEQ ID NO: 264206 - DNA, 25 bp, Mus musculus
cgcgatcgccgctgcccgcatggaa

SEQ ID NO: 264207 - DNA, 25 bp, Mus musculus
ggctccttcacctcctacggcgccg

SEQ ID NO: 264208 - DNA, 25 bp, Mus musculus
actccgtgggcaagcatctgttcgt

SEQ ID NO: 264209 - DNA, 25 bp, Mus musculus
ctgttcgtgagccagcgcaagaaga

SEQ ID NO: 264210 - DNA, 25 bp, Mus musculus
ggaggtggaactgctcacggatttc

SEQ ID NO: 264211 - DNA, 25 bp, Mus musculus
tcctcgaggtcactgggttggacac

SEQ ID NO: 264212 - DNA, 25 bp, Mus musculus
tggacacgtgctacccagagcgcgt

SEQ ID NO: 264213 - DNA, 25 bp, Mus musculus
ctacccttctccgtgccgattatgg

SEQ ID NO: 264214 - DNA, 25 bp, Mus musculus
ggccgtcgcaccaagttgcagttcc

SEQ ID NO: 264215 - DNA, 25 bp, Mus musculus
tcgtcctcgctaaccagtggccttg

SEQ ID NO: 264216 - DNA, 25 bp, Mus musculus
gacgatctgctgttccgggaattga

SEQ ID NO: 264217 - DNA, 25 bp, Mus musculus
tgcccgacaacgtggtgtccatgcg

SEQ ID NO: 264218 - DNA, 25 bp, Mus musculus
ctgcctgcatgacgagggtgattgc

SEQ ID NO: 264219 - DNA, 25 bp, Mus musculus
gcctgtatgagtacgtgcccgacaa

SEQ ID NO: 264220 - DNA, 25 bp, Mus musculus
gcgcattgtcaacacggtgcccatc

SEQ ID NO: 264221 - DNA, 25 bp, Mus musculus
cagttcctgcacgatgcggtgcgta

SEQ ID NO: 264222 - DNA, 25 bp, Mus musculus
catgagcccgcctgtcttgatctcg

SEQ ID NO: 264223 - DNA, 25 bp, Mus musculus
cctgtcttgatctcgttttcccgga

SEQ ID NO: 264224 - DNA, 25 bp, Mus musculus
tcttgatctcgttttcccggaggtc

SEQ ID NO: 264225 - DNA, 25 bp, Mus musculus
tgatctcgttttcccggaggtccag

SEQ ID NO: 264226 - DNA, 25 bp, Mus musculus
ttttcccggaggtccagtctcagga

SEQ ID NO: 264227 - DNA, 25 bp, Mus musculus
tcccggaggtccagtctcaggaggc

SEQ ID NO: 264228 - DNA, 25 bp, Mus musculus
tcggcgatgaactctgccacggcca

SEQ ID NO: 264229 - DNA, 25 bp, Mus musculus
gaccgcaggggctggccaagggccc

SEQ ID NO: 264230 - DNA, 25 bp, Mus musculus
cccatgcctggccactggccggccg

SEQ ID NO: 264231 - DNA, 25 bp, Mus musculus
gcgcctggcccgcatcctaccctcg

SEQ ID NO: 264232 - DNA, 25 bp, Mus musculus
gcccgcctgtcttgatctcgttttc

SEQ ID NO: 264233 - DNA, 25 bp, Mus musculus
cctcgcacgtgagcttggttgaggc

SEQ ID NO: 264234 - DNA, 25 bp, Mus musculus
taccctcgcacgtgagcttggttga

SEQ ID NO: 264235 - DNA, 25 bp, Mus musculus
atcctaccctcgcacgtgagcttgg

SEQ ID NO: 264236 - DNA, 25 bp, Mus musculus
agcatagcaccgactcaagcttttg

SEQ ID NO: 264237 - DNA, 25 bp, Mus musculus
cggctaaagccgtctgagttcgtaa

SEQ ID NO: 264238 - DNA, 25 bp, Mus musculus
acaaatcctataaccgcggcctgcg

SEQ ID NO: 264239 - DNA, 25 bp, Mus musculus
cgcacattcgtcacaagcccaagta

SEQ ID NO: 264240 - DNA, 25 bp, Mus musculus
agctgtcaacagtcaggctcccgca

SEQ ID NO: 264241 - DNA, 25 bp, Mus musculus
ggcctatgaacgctgtctcccggag

SEQ ID NO: 264242 - DNA, 25 bp, Mus musculus
ccggcgaatctgcagagccaaactg

SEQ ID NO: 264243 - DNA, 25 bp, Mus musculus
gcccgctgcgtaccgagaaaagcat

SEQ ID NO: 264244 - DNA, 25 bp, Mus musculus
ctttcgctacaagccgaagggcccg

SEQ ID NO: 264245 - DNA, 25 bp, Mus musculus
tcccggtaggagactcagcttcggc

SEQ ID NO: 264246 - DNA, 25 bp, Mus musculus
gaacgtgacacgcttggcagcagcc

SEQ ID NO: 264247 - DNA, 25 bp, Mus musculus
ccagacacgatgtcctcgtcagatg

SEQ ID NO: 264248 - DNA, 25 bp, Mus musculus
caaagctaccgtgtctccaggggtc

SEQ ID NO: 264249 - DNA, 25 bp, Mus musculus
tagaagaatcgcctccacaaaattg

SEQ ID NO: 264250 - DNA, 25 bp, Mus musculus
agggcaggatctgttccctccgcgg

SEQ ID NO: 264251 - DNA, 25 bp, Mus musculus
cacagagtccggagctcctgagttc

SEQ ID NO: 264252 - DNA, 25 bp, Mus musculus
atgtcccacgaccacggagaactca

SEQ ID NO: 264253 - DNA, 25 bp, Mus musculus
tttaattcctcctggcctcctagcg

SEQ ID NO: 264254 - DNA, 25 bp, Mus musculus
cgcgcaacctcagcagaggtccgga

SEQ ID NO: 264255 - DNA, 25 bp, Mus musculus
ggcctcctagcgtcctgcttttcaa

SEQ ID NO: 264256 - DNA, 25 bp, Mus musculus
acctcagcagaggtccggatgggca

SEQ ID NO: 264257 - DNA, 25 bp, Mus musculus
gagaactcaccaaggcctgtccctg

SEQ ID NO: 264258 - DNA, 25 bp, Mus musculus
ctgacggggaagatgtcccacgacc

SEQ ID NO: 264259 - DNA, 25 bp, Mus musculus
caatgccacccggagcggctgacgg

SEQ ID NO: 264260 - DNA, 25 bp, Mus musculus
tccctgcgtcagagtacagtctctc

SEQ ID NO: 264261 - DNA, 25 bp, Mus musculus
taagaatgtccatccgctccggggc

SEQ ID NO: 264262 - DNA, 25 bp, Mus musculus
tcctgcttttcaaattctaagaatg

SEQ ID NO: 264263 - DNA, 25 bp, Mus musculus
gactgcctagtttccgcccgcgcaa

SEQ ID NO: 264264 - DNA, 25 bp, Mus musculus
gatgtaaagccggacctcgacttga

SEQ ID NO: 264265 - DNA, 25 bp, Mus musculus
tcgagtttgacctccgagactggcc

SEQ ID NO: 264266 - DNA, 25 bp, Mus musculus
taggaccagcacgtgtaaaaagttc

SEQ ID NO: 264267 - DNA, 25 bp, Mus musculus
gccaccgcgcggattacctggatct

SEQ ID NO: 264268 - DNA, 25 bp, Mus musculus
gtgcctcgccgcgtagatcccgata

SEQ ID NO: 264269 - DNA, 25 bp, Mus musculus
gatcccgataccgacaccgacattg

SEQ ID NO: 264270 - DNA, 25 bp, Mus musculus
cccgatcttgtcatggatgtaaagc

SEQ ID NO: 264271 - DNA, 25 bp, Mus musculus
acctcgacttgaggtccctggcgca

SEQ ID NO: 264272 - DNA, 25 bp, Mus musculus
ggatcgcgagggacatgcccatatc

SEQ ID NO: 264273 - DNA, 25 bp, Mus musculus
atgcccatatcggatgtgaagcgtc

SEQ ID NO: 264274 - DNA, 25 bp, Mus musculus
tgtgaagcgtcaactccaaactgcc

SEQ ID NO: 264275 - DNA, 25 bp, Mus musculus
cccgcggatgcctctgagttctaag

SEQ ID NO: 264276 - DNA, 25 bp, Mus musculus
taagtcttccggtgagtccctagcc

SEQ ID NO: 264277 - DNA, 25 bp, Mus musculus
accgacattgagatgcccgatcttg

SEQ ID NO: 264278 - DNA, 25 bp, Mus musculus
gtccgtcgcgggaaccgccgtctga

SEQ ID NO: 264279 - DNA, 25 bp, Mus musculus
tgattttttcctcgcggcctgggct

SEQ ID NO: 264280 - DNA, 25 bp, Mus musculus
aagtgattttttcctcgcggcctgg

SEQ ID NO: 264281 - DNA, 25 bp, Mus musculus
aactggtgatgaaagtgattttttc

SEQ ID NO: 264282 - DNA, 25 bp, Mus musculus
cgctgcctccaaaactggtgatgaa

SEQ ID NO: 264283 - DNA, 25 bp, Mus musculus
tcgtcgctgcctccaaaactggtga

SEQ ID NO: 264284 - DNA, 25 bp, Mus musculus
tgcagcagctgcctcctcgtcgctg

SEQ ID NO: 264285 - DNA, 25 bp, Mus musculus
cgaccgggtgctggcattacggcct

SEQ ID NO: 264286 - DNA, 25 bp, Mus musculus
gttaccgaccgggtgctggcattac

SEQ ID NO: 264287 - DNA, 25 bp, Mus musculus
agcgacactgtcctagagggcccgt

SEQ ID NO: 264288 - DNA, 25 bp, Mus musculus
acagggtttgtgagcgacactgtcc

SEQ ID NO: 264289 - DNA, 25 bp, Mus musculus
cgcgaactggagcgcgaactggatc

SEQ ID NO: 264290 - DNA, 25 bp, Mus musculus
cggccagagcggtaatagccacggc

SEQ ID NO: 264291 - DNA, 25 bp, Mus musculus
ggaaccgccgtctgagtgccgccgt

SEQ ID NO: 264292 - DNA, 25 bp, Mus musculus
cttcactgccctctgcgtggacaga

SEQ ID NO: 264293 - DNA, 25 bp, Mus musculus
cgaaggcttcgcgacagcggagaca

SEQ ID NO: 264294 - DNA, 25 bp, Mus musculus
tggggtggcatctcctccattatgc

SEQ ID NO: 264295 - DNA, 25 bp, Mus musculus
agaaggacctgtttctcctcctgtc

SEQ ID NO: 264296 - DNA, 25 bp, Mus musculus
ccgaggatccgtactcgtggggaca

SEQ ID NO: 264297 - DNA, 25 bp, Mus musculus
ccttggcctctgattcccgaggatc

SEQ ID NO: 264298 - DNA, 25 bp, Mus musculus
actcaggacaccagaaacgtggctc

SEQ ID NO: 264299 - DNA, 25 bp, Mus musculus
agcggagacacagcagcgtccagtc

SEQ ID NO: 264300 - DNA, 25 bp, Mus musculus
gcccgaggccttgtcatccttcttg

SEQ ID NO: 264301 - DNA, 25 bp, Mus musculus
ccagcaggctgagtggaccatggac

SEQ ID NO: 264302 - DNA, 25 bp, Mus musculus
gccaggccgcagtctggacacacaa

SEQ ID NO: 264303 - DNA, 25 bp, Mus musculus
ccttgaggcagatggaacactggtg

SEQ ID NO: 264304 - DNA, 25 bp, Mus musculus
gcgtcggaaacctttgccacactca

SEQ ID NO: 264305 - DNA, 25 bp, Mus musculus
gtggacagatccacctcgctacctg

SEQ ID NO: 264306 - DNA, 25 bp, Mus musculus
tgcatccttaccctggatccttcgg

SEQ ID NO: 264307 - DNA, 25 bp, Mus musculus
tctgcctcggactcctccaaggtga

SEQ ID NO: 264308 - DNA, 25 bp, Mus musculus
ctgcctcggactcctccaaggtgag

SEQ ID NO: 264309 - DNA, 25 bp, Mus musculus
gcctcggactcctccaaggtgagcg

SEQ ID NO: 264310 - DNA, 25 bp, Mus musculus
cttgcgtctgcactgaagatcggta

SEQ ID NO: 264311 - DNA, 25 bp, Mus musculus
ttgcgtctgcactgaagatcggtaa

SEQ ID NO: 264312 - DNA, 25 bp, Mus musculus
ctgcactgaagatcggtaacccgag

SEQ ID NO: 264313 - DNA, 25 bp, Mus musculus
tgcctcggactcctccaaggtgagc

SEQ ID NO: 264314 - DNA, 25 bp, Mus musculus
tgcactgaagatcggtaacccgagg

SEQ ID NO: 264315 - DNA, 25 bp, Mus musculus
tgcgtctgcactgaagatcggtaac

SEQ ID NO: 264316 - DNA, 25 bp, Mus musculus
tctgcactgaagatcggtaacccga

SEQ ID NO: 264317 - DNA, 25 bp, Mus musculus
gtctgcactgaagatcggtaacccg

SEQ ID NO: 264318 - DNA, 25 bp, Mus musculus
cgtctgcactgaagatcggtaaccc

SEQ ID NO: 264319 - DNA, 25 bp, Mus musculus
gcgtctgcactgaagatcggtaacc

SEQ ID NO: 264320 - DNA, 25 bp, Mus musculus
tgaacctgcgcctgtggctctgcct

SEQ ID NO: 264321 - DNA, 25 bp, Mus musculus
ttactcagtccccaggaagtccagg

SEQ ID NO: 264322 - DNA, 25 bp, Mus musculus
cggtccgtagtgaaatgcatcctta

SEQ ID NO: 264323 - DNA, 25 bp, Mus musculus
gtccggtccgtagtgaaatgcatcc

SEQ ID NO: 264324 - DNA, 25 bp, Mus musculus
acggtccggtccgtagtgaaatgca

SEQ ID NO: 264325 - DNA, 25 bp, Mus musculus
cccgctggaaccagggaagtcatgg

SEQ ID NO: 264326 - DNA, 25 bp, Mus musculus
cgtgaatcatttccccattgatcca

SEQ ID NO: 264327 - DNA, 25 bp, Mus musculus
cgcaccaggggcctgtggtgagacc

SEQ ID NO: 264328 - DNA, 25 bp, Mus musculus
cgcgcaggtcccacccgcgcccagg

SEQ ID NO: 264329 - DNA, 25 bp, Mus musculus
ctgcgctgaacctgcgcctgtggct

SEQ ID NO: 264330 - DNA, 25 bp, Mus musculus
tgcagccgggcgctgcgctgaacct

SEQ ID NO: 264331 - DNA, 25 bp, Mus musculus
ttgggtgcgcacttcccgacgcctt

SEQ ID NO: 264332 - DNA, 25 bp, Mus musculus
caggtcccagtcttaagtctacggt

SEQ ID NO: 264333 - DNA, 25 bp, Mus musculus
acgcccgctggaaccagggaagtca

SEQ ID NO: 264334 - DNA, 25 bp, Mus musculus
cgctgcacaaaaggcacttccgcgg

SEQ ID NO: 264335 - DNA, 25 bp, Mus musculus
cagcctgaggcctgtcagggcggaa

SEQ ID NO: 264336 - DNA, 25 bp, Mus musculus
ggcggacacccacggtgatctccgg

SEQ ID NO: 264337 - DNA, 25 bp, Mus musculus
gacacccacggtgatctccggagcg

SEQ ID NO: 264338 - DNA, 25 bp, Mus musculus
tccggagcgcctcggacaaggatga

SEQ ID NO: 264339 - DNA, 25 bp, Mus musculus
ctcggacaaggatgaggtcgactgc

SEQ ID NO: 264340 - DNA, 25 bp, Mus musculus
aaggatgaggtcgactgccaccgct

SEQ ID NO: 264341 - DNA, 25 bp, Mus musculus
tcggggtcggatgcctgcactcacc

SEQ ID NO: 264342 - DNA, 25 bp, Mus musculus
gcactcaccggccagtcgccgcctc

SEQ ID NO: 264343 - DNA, 25 bp, Mus musculus
gcgcgctcacgacccacaccggaag

SEQ ID NO: 264344 - DNA, 25 bp, Mus musculus
caaagcccggattcgggcctgagga

SEQ ID NO: 264345 - DNA, 25 bp, Mus musculus
caaaaggcacttccgcggtcgagag

SEQ ID NO: 264346 - DNA, 25 bp, Mus musculus
gtcgccgcctcccactgctgcgctc

SEQ ID NO: 264347 - DNA, 25 bp, Mus musculus
atgtgggcgtggctctcgcgattat

SEQ ID NO: 264348 - DNA, 25 bp, Mus musculus
gcggaagcgcatgccacgctgcttt

SEQ ID NO: 264349 - DNA, 25 bp, Mus musculus
cagctgtgtcccgtccaggccaaag

SEQ ID NO: 264350 - DNA, 25 bp, Mus musculus
gcgcggcatctcactcagctgtgtc

SEQ ID NO: 264351 - DNA, 25 bp, Mus musculus
gtccaggccaaagccgttctcctta

SEQ ID NO: 264352 - DNA, 25 bp, Mus musculus
ctcgcactcgtagcggaagcgcatg

SEQ ID NO: 264353 - DNA, 25 bp, Mus musculus
tgtattcgtcgatgatttctgcgcg

SEQ ID NO: 264354 - DNA, 25 bp, Mus musculus
ggccaaagccgttctccttaatgta

SEQ ID NO: 264355 - DNA, 25 bp, Mus musculus
atgccacgctgctttggctgctctg

SEQ ID NO: 264356 - DNA, 25 bp, Mus musculus
ctgctttggctgctctgtgatgacc

SEQ ID NO: 264357 - DNA, 25 bp, Mus musculus
ctctgtgatgaccaggtacggccgt

SEQ ID NO: 264358 - DNA, 25 bp, Mus musculus
ttgctggcttcggtgctgctctccc

SEQ ID NO: 264359 - DNA, 25 bp, Mus musculus
ccagcgtgacgctgctcagtgaggc

SEQ ID NO: 264360 - DNA, 25 bp, Mus musculus
cagcagggcccagcgtgacgctgct

SEQ ID NO: 264361 - DNA, 25 bp, Mus musculus
gccgttctccttaatgtattcgtcg

SEQ ID NO: 264362 - DNA, 25 bp, Mus musculus
agcgggacgcctagcctgtatctcc

SEQ ID NO: 264363 - DNA, 25 bp, Mus musculus
cggactctctggcagcgcggcgact

SEQ ID NO: 264364 - DNA, 25 bp, Mus musculus
tagggaccgacagcccgaaggccag

SEQ ID NO: 264365 - DNA, 25 bp, Mus musculus
gaggttccactctgcttacccaagg

SEQ ID NO: 264366 - DNA, 25 bp, Mus musculus
tgcggaaacccgcagatgactccga

SEQ ID NO: 264367 - DNA, 25 bp, Mus musculus
ttgtactctccgcaccgaagcgcga

SEQ ID NO: 264368 - DNA, 25 bp, Mus musculus
cagcccggtcggctgggacgatcac

SEQ ID NO: 264369 - DNA, 25 bp, Mus musculus
aaggccagctcagggcgagcgcaca

SEQ ID NO: 264370 - DNA, 25 bp, Mus musculus
ttctcactccttagcgggacgccta

SEQ ID NO: 264371 - DNA, 25 bp, Mus musculus
cactgaggtccgtccgggtccactt

SEQ ID NO: 264372 - DNA, 25 bp, Mus musculus
tgccttggccaagaccactgaggtc

SEQ ID NO: 264373 - DNA, 25 bp, Mus musculus
gagtcgctgcccattgccttggcca

SEQ ID NO: 264374 - DNA, 25 bp, Mus musculus
tgacgtcacgtcaaagggaatggga

SEQ ID NO: 264375 - DNA, 25 bp, Mus musculus
gaaggcttggcacttcgcagggtcc

SEQ ID NO: 264376 - DNA, 25 bp, Mus musculus
acctcgttgcggtactgcccgagtc

SEQ ID NO: 264377 - DNA, 25 bp, Mus musculus
gagtcggttgcgtagatcctccatg

SEQ ID NO: 264378 - DNA, 25 bp, Mus musculus
tcctctgtgctctggcccagcatgg

SEQ ID NO: 264379 - DNA, 25 bp, Mus musculus
cccagcatggtgtgcacctcgttgc

SEQ ID NO: 264380 - DNA, 25 bp, Mus musculus
ggtcacgggcctggttgcccacttc

SEQ ID NO: 264381 - DNA, 25 bp, Mus musculus
ctcggatgcggtcaccaaaagcctg

SEQ ID NO: 264382 - DNA, 25 bp, Mus musculus
cccagcgcctaggttggcagtgcgc

SEQ ID NO: 264383 - DNA, 25 bp, Mus musculus
gctggcgaccttgctccaccagagg

SEQ ID NO: 264384 - DNA, 25 bp, Mus musculus
aggcgctcacggatggcactcacac

SEQ ID NO: 264385 - DNA, 25 bp, Mus musculus
tgccttgtacacagctaggcgcttc

SEQ ID NO: 264386 - DNA, 25 bp, Mus musculus
aggcgcttctgcagatcctcggcat

SEQ ID NO: 264387 - DNA, 25 bp, Mus musculus
ccgcatcaagcgcttgcgcatcttg

SEQ ID NO: 264388 - DNA, 25 bp, Mus musculus
tcaccaaaagcctgggcgcgatcgc

SEQ ID NO: 264389 - DNA, 25 bp, Mus musculus
agatcctccatgtcggctccgagtc

SEQ ID NO: 264390 - DNA, 25 bp, Mus musculus
gttgaagccctactcctattggttc

SEQ ID NO: 264391 - DNA, 25 bp, Mus musculus
tgcacttccggtggcactcctcgaa

SEQ ID NO: 264392 - DNA, 25 bp, Mus musculus
cgttccgaaccacggccagtgcttg

SEQ ID NO: 264393 - DNA, 25 bp, Mus musculus
ggaagttccacccttctgttgaagc

SEQ ID NO: 264394 - DNA, 25 bp, Mus musculus
tggctcgtgtatcccaagttcattg

SEQ ID NO: 264395 - DNA, 25 bp, Mus musculus
cccaccgccctagaagaaagacatt

SEQ ID NO: 264396 - DNA, 25 bp, Mus musculus
tacagtatgtctaatgggccggcca

SEQ ID NO: 264397 - DNA, 25 bp, Mus musculus
gcagcttcctctaccttcctattgg

SEQ ID NO: 264398 - DNA, 25 bp, Mus musculus
cctagtcgaaatcagtcagtgcagc

SEQ ID NO: 264399 - DNA, 25 bp, Mus musculus
gtgctaggtctctcattggccaatg

SEQ ID NO: 264400 - DNA, 25 bp, Mus musculus
ggaccttggctcaactcacattcta

SEQ ID NO: 264401 - DNA, 25 bp, Mus musculus
tgccttgactattggtggaccttgg

SEQ ID NO: 264402 - DNA, 25 bp, Mus musculus
caagttcattggttcgcgacgccgc

SEQ ID NO: 264403 - DNA, 25 bp, Mus musculus
gatagcacacgcattgacacgccta

SEQ ID NO: 264404 - DNA, 25 bp, Mus musculus
aatctcgatcagtagggccaaccta

SEQ ID NO: 264405 - DNA, 25 bp, Mus musculus
ccgcgcgttttcacctgtttcctga

SEQ ID NO: 264406 - DNA, 25 bp, Mus musculus
ccggatcagttcgttcggcccagct

SEQ ID NO: 264407 - DNA, 25 bp, Mus musculus
actgacgaaggcatccgcgcgtttt

SEQ ID NO: 264408 - DNA, 25 bp, Mus musculus
ttccctcccttctgaggactgacga

SEQ ID NO: 264409 - DNA, 25 bp, Mus musculus
ccggtgtgttgcgagaatctcgatc

SEQ ID NO: 264410 - DNA, 25 bp, Mus musculus
gtgcctagggaccactcttcgtgta

SEQ ID NO: 264411 - DNA, 25 bp, Mus musculus
cactctaatgagacgcggtcacacc

SEQ ID NO: 264412 - DNA, 25 bp, Mus musculus
cagtagcagcggcaacaacggcagc

SEQ ID NO: 264413 - DNA, 25 bp, Mus musculus
tttgaccacgcccactcgacatgga

SEQ ID NO: 264414 - DNA, 25 bp, Mus musculus
actcttcgtgtaccgatcggctggg

SEQ ID NO: 264415 - DNA, 25 bp, Mus musculus
ctccgccttctcctggaattaacta

SEQ ID NO: 264416 - DNA, 25 bp, Mus musculus
gggccggactcatgacgtcacaggc

SEQ ID NO: 264417 - DNA, 25 bp, Mus musculus
caacggcagcgtcggtgacaatctg

SEQ ID NO: 264418 - DNA, 25 bp, Mus musculus
ttctaggcgctggagcaacttcacc

SEQ ID NO: 264419 - DNA, 25 bp, Mus musculus
gggcctttgccacctctccaagtag

SEQ ID NO: 264420 - DNA, 25 bp, Mus musculus
tttgccacctctccaagtagctgcg

SEQ ID NO: 264421 - DNA, 25 bp, Mus musculus
acctctccaagtagctgcgcggtgc

SEQ ID NO: 264422 - DNA, 25 bp, Mus musculus
tgaccatcctgggatccctgcattg

SEQ ID NO: 264423 - DNA, 25 bp, Mus musculus
atcctgggatccctgcattgctctt

SEQ ID NO: 264424 - DNA, 25 bp, Mus musculus
gggatccctgcattgctcttctagg

SEQ ID NO: 264425 - DNA, 25 bp, Mus musculus
ctgcattgctcttctaggcgctgga

SEQ ID NO: 264426 - DNA, 25 bp, Mus musculus
ctcttctaggcgctggagcaacttc

SEQ ID NO: 264427 - DNA, 25 bp, Mus musculus
cccgctgccaccctcgcggggctgc

SEQ ID NO: 264428 - DNA, 25 bp, Mus musculus
tggagcaacttcaccgcccggctaa

SEQ ID NO: 264429 - DNA, 25 bp, Mus musculus
cgccgcagccatgggtccctcgggt

SEQ ID NO: 264430 - DNA, 25 bp, Mus musculus
ttcaccgcccggctaagcgcgcgtg

SEQ ID NO: 264431 - DNA, 25 bp, Mus musculus
ctaggcgctggagcaacttcaccgc

SEQ ID NO: 264432 - DNA, 25 bp, Mus musculus
agaatacatctgagcgttcacgttg

SEQ ID NO: 264433 - DNA, 25 bp, Mus musculus
agcgttcacgttggcgccgtgctgt

SEQ ID NO: 264434 - DNA, 25 bp, Mus musculus
ctgtgggacggagaaattcgagtca

SEQ ID NO: 264435 - DNA, 25 bp, Mus musculus
cggagaaattcgagtcaagagtcac

SEQ ID NO: 264436 - DNA, 25 bp, Mus musculus
tcaagagtcacgtgggccaatggcc

SEQ ID NO: 264437 - DNA, 25 bp, Mus musculus
acgtgggccaatggcctcgcttggc

SEQ ID NO: 264438 - DNA, 25 bp, Mus musculus
tgcgcgccaccatgagaggtgtgtc

SEQ ID NO: 264439 - DNA, 25 bp, Mus musculus
cagagccgagctgccagaatacatc

SEQ ID NO: 264440 - DNA, 25 bp, Mus musculus
cccgcggccagacgcagaatgcaga

SEQ ID NO: 264441 - DNA, 25 bp, Mus musculus
ccagacgcagaatgcagagccgagc

SEQ ID NO: 264442 - DNA, 25 bp, Mus musculus
ccatgagaggtgtgtcattgtgaca

SEQ ID NO: 264443 - DNA, 25 bp, Mus musculus
attgtgacagttcttgaggccgctg

SEQ ID NO: 264444 - DNA, 25 bp, Mus musculus
gacagttcttgaggccgctgtcagc

SEQ ID NO: 264445 - DNA, 25 bp, Mus musculus
cagcgtgcgcaccagaggcagaagc

SEQ ID NO: 264446 - DNA, 25 bp, Mus musculus
acagtggtcgatgtgcgcatgcgca

SEQ ID NO: 264447 - DNA, 25 bp, Mus musculus
accacgggctcacggacgtccaggt

SEQ ID NO: 264448 - DNA, 25 bp, Mus musculus
acgcttacagtggtcgatgtgcgca

SEQ ID NO: 264449 - DNA, 25 bp, Mus musculus
agcgacctggcggatgctgactcga

SEQ ID NO: 264450 - DNA, 25 bp, Mus musculus
cacggacgtccaggttggtgttaga

SEQ ID NO: 264451 - DNA, 25 bp, Mus musculus
cgctgagtcgtgagtggctcagacc

SEQ ID NO: 264452 - DNA, 25 bp, Mus musculus
gtttcgttctgacgctgagtcgtga

SEQ ID NO: 264453 - DNA, 25 bp, Mus musculus
gagcacagtttcgttctgacgctga

SEQ ID NO: 264454 - DNA, 25 bp, Mus musculus
aagcggtgagcacagtttcgttctg

SEQ ID NO: 264455 - DNA, 25 bp, Mus musculus
agtcatgccgggtgtgcttcaggat

SEQ ID NO: 264456 - DNA, 25 bp, Mus musculus
ccgccactcgagtcatgccgggtgt

SEQ ID NO: 264457 - DNA, 25 bp, Mus musculus
ctgactcgaagtggaagccagaccc

SEQ ID NO: 264458 - DNA, 25 bp, Mus musculus
cggatgctgactcgaagtggaagcc

SEQ ID NO: 264459 - DNA, 25 bp, Mus musculus
tggtgttagatgtgggacgcttaca

SEQ ID NO: 264460 - DNA, 25 bp, Mus musculus
tggcgtcggccggtcctctctagct

SEQ ID NO: 264461 - DNA, 25 bp, Mus musculus
agtgacggctgaggtgacttccgct

SEQ ID NO: 264462 - DNA, 25 bp, Mus musculus
tagttccagcgccagtgacggctga

SEQ ID NO: 264463 - DNA, 25 bp, Mus musculus
aattgtagttccagcgccagtgacg

SEQ ID NO: 264464 - DNA, 25 bp, Mus musculus
ttccgctgacgcattctgggaattg

SEQ ID NO: 264465 - DNA, 25 bp, Mus musculus
ggctccctggcagtacttctgatga

SEQ ID NO: 264466 - DNA, 25 bp, Mus musculus
tacttctgatgaggtgacatcctgc

SEQ ID NO: 264467 - DNA, 25 bp, Mus musculus
atgaggtgacatcctgcagcgttcc

SEQ ID NO: 264468 - DNA, 25 bp, Mus musculus
gtgacatcctgcagcgttccgcgac

SEQ ID NO: 264469 - DNA, 25 bp, Mus musculus
cgacccttctgtgtgctggtgtttc

SEQ ID NO: 264470 - DNA, 25 bp, Mus musculus
ctggtgtttcggtgtgtcttctcgg

SEQ ID NO: 264471 - DNA, 25 bp, Mus musculus
tcttctcggggaccgagtctgcatc

SEQ ID NO: 264472 - DNA, 25 bp, Mus musculus
aggccaggctccctggcagtacttc

SEQ ID NO: 264473 - DNA, 25 bp, Mus musculus
ccgagtctgcatctccggggagaag

SEQ ID NO: 264474 - DNA, 25 bp, Mus musculus
gactacgtgtgtgaagtgcaggata

SEQ ID NO: 264475 - DNA, 25 bp, Mus musculus
gcgggaccacgtttctcagccttcg

SEQ ID NO: 264476 - DNA, 25 bp, Mus musculus
gccaggacaagcactgccacaagaa

SEQ ID NO: 264477 - DNA, 25 bp, Mus musculus
gatcccttagaaggccagtccgtgc

SEQ ID NO: 264478 - DNA, 25 bp, Mus musculus
ctagaggccaacctagaggaggcag

SEQ ID NO: 264479 - DNA, 25 bp, Mus musculus
ttgctggactgcaaaaacgtgcacc

SEQ ID NO: 264480 - DNA, 25 bp, Mus musculus
acactgcacgatgctcaagggaacc

SEQ ID NO: 264481 - DNA, 25 bp, Mus musculus
atctgcgctggtaccggctcaacct

SEQ ID NO: 264482 - DNA, 25 bp, Mus musculus
acacgtacgaacatctgcgctggta

SEQ ID NO: 264483 - DNA, 25 bp, Mus musculus
gggcggacaactacacgtacgaaca

SEQ ID NO: 264484 - DNA, 25 bp, Mus musculus
acggtttcagtatcgagtcggagcc

SEQ ID NO: 264485 - DNA, 25 bp, Mus musculus
tgcgcctcagctgccgggcggacaa

SEQ ID NO: 264486 - DNA, 25 bp, Mus musculus
ctgccacaagaagtacctgtccgtg

SEQ ID NO: 264487 - DNA, 25 bp, Mus musculus
gtcggagccttctgaggatccctta

SEQ ID NO: 264488 - DNA, 25 bp, Mus musculus
tgtgatctgcagaactaaggcagcg

SEQ ID NO: 264489 - DNA, 25 bp, Mus musculus
ttcttccttccctgcggccgggcga

SEQ ID NO: 264490 - DNA, 25 bp, Mus musculus
ggtcttacctccacctcctgcgctc

SEQ ID NO: 264491 - DNA, 25 bp, Mus musculus
gagccggtcttacctccacctcctg

SEQ ID NO: 264492 - DNA, 25 bp, Mus musculus
cagtctcagggagccggtcttacct

SEQ ID NO: 264493 - DNA, 25 bp, Mus musculus
cccagtctcagggagccggtcttac

SEQ ID NO: 264494 - DNA, 25 bp, Mus musculus
aactaaggcagcgggtcgaggcctt

SEQ ID NO: 264495 - DNA, 25 bp, Mus musculus
cgggtaggtgtgatctgcagaacta

SEQ ID NO: 264496 - DNA, 25 bp, Mus musculus
aacctgccggctgtcgggggatcta

SEQ ID NO: 264497 - DNA, 25 bp, Mus musculus
ggatctaggtccaagagggggtcta

SEQ ID NO: 264498 - DNA, 25 bp, Mus musculus
tatctgttccgggtaggtgtgatct

SEQ ID NO: 264499 - DNA, 25 bp, Mus musculus
ttccgggtaggtgtgatctgcagaa

SEQ ID NO: 264500 - DNA, 25 bp, Mus musculus
taggtgtgatctgcagaactaaggc

SEQ ID NO: 264501 - DNA, 25 bp, Mus musculus
ccttgcagattgctctgcgcagggc

SEQ ID NO: 264502 - DNA, 25 bp, Mus musculus
ctagcgggtcattctggaggttcct

SEQ ID NO: 264503 - DNA, 25 bp, Mus musculus
tcgccgctgctccttacctttcaaa

SEQ ID NO: 264504 - DNA, 25 bp, Mus musculus
tccttttcacccgagacgcaattgc

SEQ ID NO: 264505 - DNA, 25 bp, Mus musculus
agacgcaattgctgtcgatctcaga

SEQ ID NO: 264506 - DNA, 25 bp, Mus musculus
gctgtcgatctcagaagcatctagc

SEQ ID NO: 264507 - DNA, 25 bp, Mus musculus
gctccctcagtggtaacggaagtga

SEQ ID NO: 264508 - DNA, 25 bp, Mus musculus
ctcggctccctcagtggtaacggaa

SEQ ID NO: 264509 - DNA, 25 bp, Mus musculus
agaaaccgtgcgtgacgctcggctc

SEQ ID NO: 264510 - DNA, 25 bp, Mus musculus
ccagaattccgcgtggagaaaccgt

SEQ ID NO: 264511 - DNA, 25 bp, Mus musculus
tgaagccgacgagttcccagaattc

SEQ ID NO: 264512 - DNA, 25 bp, Mus musculus
aggctagcctgaagccgacgagttc

SEQ ID NO: 264513 - DNA, 25 bp, Mus musculus
gggacagatggctacaggctagcct

SEQ ID NO: 264514 - DNA, 25 bp, Mus musculus
ctcagaagcatctagcgggtcattc

SEQ ID NO: 264515 - DNA, 25 bp, Mus musculus
ggaggttcctggctaaaataactca

SEQ ID NO: 264516 - DNA, 25 bp, Mus musculus
tgcggagaggcggatcttacactcg

SEQ ID NO: 264517 - DNA, 25 bp, Mus musculus
gcgcagagaccctggacgacacttc

SEQ ID NO: 264518 - DNA, 25 bp, Mus musculus
ccgagaatttgaactacgcttccca

SEQ ID NO: 264519 - DNA, 25 bp, Mus musculus
cttcccagaatgctcggcgtccgcc

SEQ ID NO: 264520 - DNA, 25 bp, Mus musculus
ggccttcacagacgcacgcgcaatg

SEQ ID NO: 264521 - DNA, 25 bp, Mus musculus
cagacgcacgcgcaatgcgcagaga

SEQ ID NO: 264522 - DNA, 25 bp, Mus musculus
gcacgcgcaatgctccgagaatttg

SEQ ID NO: 264523 - DNA, 25 bp, Mus musculus
tggacgacacttcccagaaatctcc

SEQ ID NO: 264524 - DNA, 25 bp, Mus musculus
agaaatctccgcgtcagctctcccg

SEQ ID NO: 264525 - DNA, 25 bp, Mus musculus
cagctctcccgggtgcctgcgtgtt

SEQ ID NO: 264526 - DNA, 25 bp, Mus musculus
cctgcgtgtttgtggaacagttgaa

SEQ ID NO: 264527 - DNA, 25 bp, Mus musculus
acatttccggtagtgaatgcggaga

SEQ ID NO: 264528 - DNA, 25 bp, Mus musculus
ccgcacaacagaagcacgcgcaatg

SEQ ID NO: 264529 - DNA, 25 bp, Mus musculus
cagttgaactacatttccggtagtg

SEQ ID NO: 264530 - DNA, 25 bp, Mus musculus
catcttgtccttgcggttctgctcc

SEQ ID NO: 264531 - DNA, 25 bp, Mus musculus
tgaactccaagtccaggatgttgtc

SEQ ID NO: 264532 - DNA, 25 bp, Mus musculus
tcctggagcggatcggattgaactc

SEQ ID NO: 264533 - DNA, 25 bp, Mus musculus
ctgaacctctggtgcagctgcttga

SEQ ID NO: 264534 - DNA, 25 bp, Mus musculus
gcggtactcctgcagggtaatgatc

SEQ ID NO: 264535 - DNA, 25 bp, Mus musculus
ggaaggtgatctcctccgccagacc

SEQ ID NO: 264536 - DNA, 25 bp, Mus musculus
gggtaatgatcccatcgccgtcctg

SEQ ID NO: 264537 - DNA, 25 bp, Mus musculus
atgttgtcgaagctctctggctgta

SEQ ID NO: 264538 - DNA, 25 bp, Mus musculus
gctgcttgatctgctcccagctgaa

SEQ ID NO: 264539 - DNA, 25 bp, Mus musculus
cccagctgaagtcgcacttgttcaa

SEQ ID NO: 264540 - DNA, 25 bp, Mus musculus
gatgtgcgcccaccataagtcggtc

SEQ ID NO: 264541 - DNA, 25 bp, Mus musculus
ctcggaacgacctcaggcgctcagt

SEQ ID NO: 264542 - DNA, 25 bp, Mus musculus
ccgtcctggtcgtacatgttgaaga

SEQ ID NO: 264543 - DNA, 25 bp, Mus musculus
tcctctttgttgagactgggccgca

SEQ ID NO: 264544 - DNA, 25 bp, Mus musculus
gcggggtcctgctcaacgcgtccta

SEQ ID NO: 264545 - DNA, 25 bp, Mus musculus
tgtacatgaacacgcacccgggtcg

SEQ ID NO: 264546 - DNA, 25 bp, Mus musculus
agctgtacatgaacacgcacccggg

SEQ ID NO: 264547 - DNA, 25 bp, Mus musculus
tggccaagctgtacatgaacacgca

SEQ ID NO: 264548 - DNA, 25 bp, Mus musculus
ttcgtggccaagctgtacatgaaca

SEQ ID NO: 264549 - DNA, 25 bp, Mus musculus
ctggttcgtggccaagctgtacatg

SEQ ID NO: 264550 - DNA, 25 bp, Mus musculus
aacgcgtcctaccgcagcatcgggg

SEQ ID NO: 264551 - DNA, 25 bp, Mus musculus
ctgcgcagcggggtcctgctcaacg

SEQ ID NO: 264552 - DNA, 25 bp, Mus musculus
ccctggccatgctcctgcgtctcta

SEQ ID NO: 264553 - DNA, 25 bp, Mus musculus
gttgctgtccctggccatgctcctg

SEQ ID NO: 264554 - DNA, 25 bp, Mus musculus
gcgaggcgttgctgtccctggccat

SEQ ID NO: 264555 - DNA, 25 bp, Mus musculus
agcatcggggcgctcaaccaagtcc

SEQ ID NO: 264556 - DNA, 25 bp, Mus musculus
gtccgcttccgccactggttcgtgg

SEQ ID NO: 264557 - DNA, 25 bp, Mus musculus
gccactggttcgtggccaagctgta

SEQ ID NO: 264558 - DNA, 25 bp, Mus musculus
tccggcaccatttacacggcaggtg

SEQ ID NO: 264559 - DNA, 25 bp, Mus musculus
acgccaaggcctgttccggaatagc

SEQ ID NO: 264560 - DNA, 25 bp, Mus musculus
ccgccctgccgttaaaaggtcgctg

SEQ ID NO: 264561 - DNA, 25 bp, Mus musculus
cgcgctgcgacccaggaactaatca

SEQ ID NO: 264562 - DNA, 25 bp, Mus musculus
aacgtgaaggtctcggaattgcggc

SEQ ID NO: 264563 - DNA, 25 bp, Mus musculus
attctctggcttgtgaccttccggc

SEQ ID NO: 264564 - DNA, 25 bp, Mus musculus
tgacaacactacagaagacccggga

SEQ ID NO: 264565 - DNA, 25 bp, Mus musculus
tcgaactcgaaatctccagagctgc

SEQ ID NO: 264566 - DNA, 25 bp, Mus musculus
agcaggcccgcccagagaaacaatg

SEQ ID NO: 264567 - DNA, 25 bp, Mus musculus
atccgcatgcgtgctgaagccagcc

SEQ ID NO: 264568 - DNA, 25 bp, Mus musculus
ttcacgcatgctcagtctaacgcgc

SEQ ID NO: 264569 - DNA, 25 bp, Mus musculus
ctaacgcgcacgttgggttcgcttg

SEQ ID NO: 264570 - DNA, 25 bp, Mus musculus
gctgcgtactgtggcttcctcttct

SEQ ID NO: 264571 - DNA, 25 bp, Mus musculus
taatcagcagctgccctaggtaagg

SEQ ID NO: 264572 - DNA, 25 bp, Mus musculus
agccgctccgtgcagtgatctcgga

SEQ ID NO: 264573 - DNA, 25 bp, Mus musculus
gtctctggtgagacctcgttggcca

SEQ ID NO: 264574 - DNA, 25 bp, Mus musculus
ccagcgtgccgaaaacagggatgcc

SEQ ID NO: 264575 - DNA, 25 bp, Mus musculus
cttggtgcgcacaaagtaaaacttc

SEQ ID NO: 264576 - DNA, 25 bp, Mus musculus
ctgcgagtagagtctcaggacagtc

SEQ ID NO: 264577 - DNA, 25 bp, Mus musculus
agcggataagcaaggcgtcgtcgta

SEQ ID NO: 264578 - DNA, 25 bp, Mus musculus
gacaccagataccaaggcagtctta

SEQ ID NO: 264579 - DNA, 25 bp, Mus musculus
agcatgtccttcttcttctgcagag

SEQ ID NO: 264580 - DNA, 25 bp, Mus musculus
tctgcagagcctccagcgagatgtc

SEQ ID NO: 264581 - DNA, 25 bp, Mus musculus
caccaggaagatgcggggatcattc

SEQ ID NO: 264582 - DNA, 25 bp, Mus musculus
atctcggatctcctggaggactgca

SEQ ID NO: 264583 - DNA, 25 bp, Mus musculus
gtcatagcggccgaaatccacctgc

SEQ ID NO: 264584 - DNA, 25 bp, Mus musculus
tggtcacgagcatcgggaagtcata

SEQ ID NO: 264585 - DNA, 25 bp, Mus musculus
tggcaccatctgaggactgcgagta

SEQ ID NO: 264586 - DNA, 25 bp, Mus musculus
ccgcatctcccgtgtgtcttctata

SEQ ID NO: 264587 - DNA, 25 bp, Mus musculus
gtccgcatgctgtcctgctctccca

SEQ ID NO: 264588 - DNA, 25 bp, Mus musculus
actggctcccacgacgccgtcacgc

SEQ ID NO: 264589 - DNA, 25 bp, Mus musculus
tttgcaccttcacacgaccctcacg

SEQ ID NO: 264590 - DNA, 25 bp, Mus musculus
ggagctccgctagtccaggctacgc

SEQ ID NO: 264591 - DNA, 25 bp, Mus musculus
cagcgtcctctagggagctccgcta

SEQ ID NO: 264592 - DNA, 25 bp, Mus musculus
gtgtctcccgtgcagcgtcctctag

SEQ ID NO: 264593 - DNA, 25 bp, Mus musculus
cacactccggtgcatctcctgcgca

SEQ ID NO: 264594 - DNA, 25 bp, Mus musculus
tcccgtgtgtcttctatacattccc

SEQ ID NO: 264595 - DNA, 25 bp, Mus musculus
gcgcatctcccaagcatctcccacg

SEQ ID NO: 264596 - DNA, 25 bp, Mus musculus
atgggtttcccaagcagcttctgca

SEQ ID NO: 264597 - DNA, 25 bp, Mus musculus
cgcgcttccgagcatcgccctctcg

SEQ ID NO: 264598 - DNA, 25 bp, Mus musculus
cttagctgacgccacgcccaccaag

SEQ ID NO: 264599 - DNA, 25 bp, Mus musculus
gcatctctcgtgcatcttccgcgca

SEQ ID NO: 264600 - DNA, 25 bp, Mus musculus
gcgtgagctctacagccttcgccat

SEQ ID NO: 264601 - DNA, 25 bp, Mus musculus
ttcccatcgacctccgggaatggtc

SEQ ID NO: 264602 - DNA, 25 bp, Mus musculus
ttaaaggcccgaggcatcgtgggac

SEQ ID NO: 264603 - DNA, 25 bp, Mus musculus
actgtaccaagtctagcggggccgt

SEQ ID NO: 264604 - DNA, 25 bp, Mus musculus
ggaatggtccatctgaccgcgcacg

SEQ ID NO: 264605 - DNA, 25 bp, Mus musculus
agcctcccgaaacgcaggcgcagtg

SEQ ID NO: 264606 - DNA, 25 bp, Mus musculus
tttttcgtcgcacacgccttctgtg

SEQ ID NO: 264607 - DNA, 25 bp, Mus musculus
ctaggattatgcaaatgagcgagcc

SEQ ID NO: 264608 - DNA, 25 bp, Mus musculus
ctcattccaaggcatccactattta

SEQ ID NO: 264609 - DNA, 25 bp, Mus musculus
ccactatttataaggcgcgttcgct

SEQ ID NO: 264610 - DNA, 25 bp, Mus musculus
tataaggcgcgttcgctctaccgcg

SEQ ID NO: 264611 - DNA, 25 bp, Mus musculus
cgcacgcgcgattcttaaagcttct

SEQ ID NO: 264612 - DNA, 25 bp, Mus musculus
cgggccgcagactgtaccaagtcta

SEQ ID NO: 264613 - DNA, 25 bp, Mus musculus
gcacagcttcgcctcgaggcattgt

SEQ ID NO: 264614 - DNA, 25 bp, Mus musculus
ctaaagcccgggatgagactgcagc

SEQ ID NO: 264615 - DNA, 25 bp, Mus musculus
attcccgatggacggcaggactctg

SEQ ID NO: 264616 - DNA, 25 bp, Mus musculus
gctcgggaaagtccgccctgatcgc

SEQ ID NO: 264617 - DNA, 25 bp, Mus musculus
gtggacacggtagagattcccgatg

SEQ ID NO: 264618 - DNA, 25 bp, Mus musculus
cttcctgggtgagctgagttgccca

SEQ ID NO: 264619 - DNA, 25 bp, Mus musculus
ccaacttgctggtattggtgctacc

SEQ ID NO: 264620 - DNA, 25 bp, Mus musculus
ccgctgctggctgtccggaatctgc

SEQ ID NO: 264621 - DNA, 25 bp, Mus musculus
attcccagaatgcagctaaagcccg

SEQ ID NO: 264622 - DNA, 25 bp, Mus musculus
agactgcagccttgttgaacagtgc

SEQ ID NO: 264623 - DNA, 25 bp, Mus musculus
taggagctgcgcctctctttgtgcc

SEQ ID NO: 264624 - DNA, 25 bp, Mus musculus
cggattgcagcagcagtgaccgctg

SEQ ID NO: 264625 - DNA, 25 bp, Mus musculus
accgctgcgaggagctagagcgcct

SEQ ID NO: 264626 - DNA, 25 bp, Mus musculus
aatctgcgccctggagattcccaga

SEQ ID NO: 264627 - DNA, 25 bp, Mus musculus
ccgcgttatgcggtaagaatgtgga

SEQ ID NO: 264628 - DNA, 25 bp, Mus musculus
tgccctgtggaaccaccataccagt

SEQ ID NO: 264629 - DNA, 25 bp, Mus musculus
ggactcttggcagcccgacgcttta

SEQ ID NO: 264630 - DNA, 25 bp, Mus musculus
tgggcgcgactatcccgcgtcgtgc

SEQ ID NO: 264631 - DNA, 25 bp, Mus musculus
gctgacgctgctgggcgcgactatc

SEQ ID NO: 264632 - DNA, 25 bp, Mus musculus
gcttctcattggctgacgctgctgg

SEQ ID NO: 264633 - DNA, 25 bp, Mus musculus
ccctcgttttcattgaaagcaaaca

SEQ ID NO: 264634 - DNA, 25 bp, Mus musculus
gggtctgccctgtggaaccaccata

SEQ ID NO: 264635 - DNA, 25 bp, Mus musculus
tcctcccgatgagtgcagcggggtc

SEQ ID NO: 264636 - DNA, 25 bp, Mus musculus
cgtcgcgctcacctctcgagctgcg

SEQ ID NO: 264637 - DNA, 25 bp, Mus musculus
actcctaagttgtgcgcgagtgcgc

SEQ ID NO: 264638 - DNA, 25 bp, Mus musculus
tcactccgagaactcctaagttgtg

SEQ ID NO: 264639 - DNA, 25 bp, Mus musculus
acagacgtcactccgagaactccta

SEQ ID NO: 264640 - DNA, 25 bp, Mus musculus
tccgagaagccagggttcacgccac

SEQ ID NO: 264641 - DNA, 25 bp, Mus musculus
agcaaacaagcatcatggcggcggc

SEQ ID NO: 264642 - DNA, 25 bp, Mus musculus
tgcacgcagcgaaggaaagaaagct

SEQ ID NO: 264643 - DNA, 25 bp, Mus musculus
agctgttcgtgaggccttcgagacc

SEQ ID NO: 264644 - DNA, 25 bp, Mus musculus
ggcggtggccggcaccaccaatgta

SEQ ID NO: 264645 - DNA, 25 bp, Mus musculus
accaatgtaggccttgtgctagata

SEQ ID NO: 264646 - DNA, 25 bp, Mus musculus
ctagatatgctgctggggttggatc

SEQ ID NO: 264647 - DNA, 25 bp, Mus musculus
cactacgatgccctgatccttgtca

SEQ ID NO: 264648 - DNA, 25 bp, Mus musculus
cccggggctcccacagaggagaact

SEQ ID NO: 264649 - DNA, 25 bp, Mus musculus
ggcccaggtccgctcattggtgtcc

SEQ ID NO: 264650 - DNA, 25 bp, Mus musculus
ccagatgctccactcgtcggtgtgc

SEQ ID NO: 264651 - DNA, 25 bp, Mus musculus
ggccagccctgttggctagcctggc

SEQ ID NO: 264652 - DNA, 25 bp, Mus musculus
ccagaatgcaagtgatgggaactca

SEQ ID NO: 264653 - DNA, 25 bp, Mus musculus
aaagaaagctggcatcggggactcg

SEQ ID NO: 264654 - DNA, 25 bp, Mus musculus
agggcgaagatccacccgaggttct

SEQ ID NO: 264655 - DNA, 25 bp, Mus musculus
cagccgagctggaagctgttcgtga

SEQ ID NO: 264656 - DNA, 25 bp, Mus musculus
tggtacagtgtgtcttccgaagatg

SEQ ID NO: 264657 - DNA, 25 bp, Mus musculus
caagctcccggccatggtcaaaacg

SEQ ID NO: 264658 - DNA, 25 bp, Mus musculus
gcgctcacagcgagggcacttgaat

SEQ ID NO: 264659 - DNA, 25 bp, Mus musculus
ccctgcaggtcatgagtgagcttgt

SEQ ID NO: 264660 - DNA, 25 bp, Mus musculus
aatgcctccagcttgggcacgcctg

SEQ ID NO: 264661 - DNA, 25 bp, Mus musculus
gtcccgcagtcgcactggtacagtg

SEQ ID NO: 264662 - DNA, 25 bp, Mus musculus
ctgggcctgagtgagcctctaaatg

SEQ ID NO: 264663 - DNA, 25 bp, Mus musculus
aagatcttcttgctacggctggagg

SEQ ID NO: 264664 - DNA, 25 bp, Mus musculus
ggaacagcttctcacattcggaaca

SEQ ID NO: 264665 - DNA, 25 bp, Mus musculus
gtctcgaggtgaacggaacagcttc

SEQ ID NO: 264666 - DNA, 25 bp, Mus musculus
cggtatggaccaacacatgcctttc

SEQ ID NO: 264667 - DNA, 25 bp, Mus musculus
acactccaggcacgggaacggcttt

SEQ ID NO: 264668 - DNA, 25 bp, Mus musculus
ggtagcactcgtggcggaagaactt

SEQ ID NO: 264669 - DNA, 25 bp, Mus musculus
aacctgcgttggaggtgcattgctc

SEQ ID NO: 264670 - DNA, 25 bp, Mus musculus
gcactgagtcccgtgcagggcgcgc

SEQ ID NO: 264671 - DNA, 25 bp, Mus musculus
ctccacgttatcaggcggctaggcc

SEQ ID NO: 264672 - DNA, 25 bp, Mus musculus
ctgttgctaagggaacccggcgcct

SEQ ID NO: 264673 - DNA, 25 bp, Mus musculus
cgcggagaggcccaaccgagcatgc

SEQ ID NO: 264674 - DNA, 25 bp, Mus musculus
agaggcccaaccgagcatgcgcagt

SEQ ID NO: 264675 - DNA, 25 bp, Mus musculus
catgcgcagtgttgacgtgtgcgcc

SEQ ID NO: 264676 - DNA, 25 bp, Mus musculus
ctccgccacgtcgtgtcctgcagca

SEQ ID NO: 264677 - DNA, 25 bp, Mus musculus
gagtctccacgttatcaggcggcta

SEQ ID NO: 264678 - DNA, 25 bp, Mus musculus
ccttcttcttcattccctggacggt

SEQ ID NO: 264679 - DNA, 25 bp, Mus musculus
ttcttcttcattccctggacggtcg

SEQ ID NO: 264680 - DNA, 25 bp, Mus musculus
gtcgggcgtccacgggcgtggacat

SEQ ID NO: 264681 - DNA, 25 bp, Mus musculus
gtggacatgccggagatcagcctcc

SEQ ID NO: 264682 - DNA, 25 bp, Mus musculus
tcctgcagcagccaggactcggtga

SEQ ID NO: 264683 - DNA, 25 bp, Mus musculus
gtttgaaaggcccgagccttgcgcg

SEQ ID NO: 264684 - DNA, 25 bp, Mus musculus
tcgtggcacagacgatgggccgcca

SEQ ID NO: 264685 - DNA, 25 bp, Mus musculus
gatgggccgccagtttggaaggaaa

SEQ ID NO: 264686 - DNA, 25 bp, Mus musculus
aaacgagaacgctttggggcagtgc

SEQ ID NO: 264687 - DNA, 25 bp, Mus musculus
gccgccaacttggacgggtagcaga

SEQ ID NO: 264688 - DNA, 25 bp, Mus musculus
acttggacgggtagcagaaggactt

SEQ ID NO: 264689 - DNA, 25 bp, Mus musculus
aaggacttggggcaatcggggcacg

SEQ ID NO: 264690 - DNA, 25 bp, Mus musculus
tgcgtgcgtccagagatgcgccgcc

SEQ ID NO: 264691 - DNA, 25 bp, Mus musculus
gcgtccagagatgcgccgccagttt

SEQ ID NO: 264692 - DNA, 25 bp, Mus musculus
agatgcgccgccagtttggaacggt

SEQ ID NO: 264693 - DNA, 25 bp, Mus musculus
cagccagcttggacgggtaggagaa

SEQ ID NO: 264694 - DNA, 25 bp, Mus musculus
gcgctagccggtgcgtggccagctt

SEQ ID NO: 264695 - DNA, 25 bp, Mus musculus
ggcacagacgatgggccgccagttt

SEQ ID NO: 264696 - DNA, 25 bp, Mus musculus
gtacgagaaggccttggggcaatcc

SEQ ID NO: 264697 - DNA, 25 bp, Mus musculus
tggccagcttggatgggtacgagaa

SEQ ID NO: 264698 - DNA, 25 bp, Mus musculus
cgtctcaattaagcctcgtgagcta

SEQ ID NO: 264699 - DNA, 25 bp, Mus musculus
tgccgagccgtagggcccagcttca

SEQ ID NO: 264700 - DNA, 25 bp, Mus musculus
gattgccgagccgtagggcccagct

SEQ ID NO: 264701 - DNA, 25 bp, Mus musculus
ctcccgtctcaattaagcctcgtga

SEQ ID NO: 264702 - DNA, 25 bp, Mus musculus
agagaagagcgggaaggagattgcc

SEQ ID NO: 264703 - DNA, 25 bp, Mus musculus
tctcaattaagcctcgtgagctacc

SEQ ID NO: 264704 - DNA, 25 bp, Mus musculus
acctgcacctcccagcgggcgctgg

SEQ ID NO: 264705 - DNA, 25 bp, Mus musculus
attaagcctcgtgagctaccttgta

SEQ ID NO: 264706 - DNA, 25 bp, Mus musculus
gccctcggacctgcacctcccagcg

SEQ ID NO: 264707 - DNA, 25 bp, Mus musculus
agctaccttgtagccctcggacctg

SEQ ID NO: 264708 - DNA, 25 bp, Mus musculus
cgtgagctaccttgtagccctcgga

SEQ ID NO: 264709 - DNA, 25 bp, Mus musculus
agcctcgtgagctaccttgtagccc

SEQ ID NO: 264710 - DNA, 25 bp, Mus musculus
taagcctcgtgagctaccttgtagc

SEQ ID NO: 264711 - DNA, 25 bp, Mus musculus
cgtagggcccagcttcacttccatc

SEQ ID NO: 264712 - DNA, 25 bp, Mus musculus
gcgaacggacgaaaggacccagagc

SEQ ID NO: 264713 - DNA, 25 bp, Mus musculus
ggcaggtacggagaggcgaacggac

SEQ ID NO: 264714 - DNA, 25 bp, Mus musculus
agcaaagcgcatccggagccccggt

SEQ ID NO: 264715 - DNA, 25 bp, Mus musculus
tgagccagcaaagcgcatccggagc

SEQ ID NO: 264716 - DNA, 25 bp, Mus musculus
gctgagccagcaaagcgcatccgga

SEQ ID NO: 264717 - DNA, 25 bp, Mus musculus
gcggctgagccagcaaagcgcatcc

SEQ ID NO: 264718 - DNA, 25 bp, Mus musculus
cggcggctgagccagcaaagcgcat

SEQ ID NO: 264719 - DNA, 25 bp, Mus musculus
agcgcggtcgtcagggtcgccgggc

SEQ ID NO: 264720 - DNA, 25 bp, Mus musculus
ggctcagtgctgagcgggctctggc

SEQ ID NO: 264721 - DNA, 25 bp, Mus musculus
gcggctgcagggctcagtgctgagc

SEQ ID NO: 264722 - DNA, 25 bp, Mus musculus
gtcagccccggtgcgtaaggctctg

SEQ ID NO: 264723 - DNA, 25 bp, Mus musculus
gtgtgtactgcggttcctttaaggc

SEQ ID NO: 264724 - DNA, 25 bp, Mus musculus
tgtgtactgcggttcctttaaggca

SEQ ID NO: 264725 - DNA, 25 bp, Mus musculus
gtactgcggttcctttaaggcaggc

SEQ ID NO: 264726 - DNA, 25 bp, Mus musculus
acaccacaggaatccgaagcggcca

SEQ ID NO: 264727 - DNA, 25 bp, Mus musculus
aattctcttcccacctctaggtgtg

SEQ ID NO: 264728 - DNA, 25 bp, Mus musculus
ccaaaggtttcggaatgcgccgtcg

SEQ ID NO: 264729 - DNA, 25 bp, Mus musculus
gctcctcgtctccaaaggtttcgga

SEQ ID NO: 264730 - DNA, 25 bp, Mus musculus
cgaagcggccatggggacacccagc

SEQ ID NO: 264731 - DNA, 25 bp, Mus musculus
caaacatcagaccacgcctctgaaa

SEQ ID NO: 264732 - DNA, 25 bp, Mus musculus
ttaggttccgccctctgggcaagct

SEQ ID NO: 264733 - DNA, 25 bp, Mus musculus
agctggtctctgaacctttaggttc

SEQ ID NO: 264734 - DNA, 25 bp, Mus musculus
ccgcggaatgttcagagctggtctc

SEQ ID NO: 264735 - DNA, 25 bp, Mus musculus
tctacgcccgcggaatgttcagagc

SEQ ID NO: 264736 - DNA, 25 bp, Mus musculus
cccaggaaatctacgcccgcggaat

SEQ ID NO: 264737 - DNA, 25 bp, Mus musculus
gtgtcaccttcggagccgacagcct

SEQ ID NO: 264738 - DNA, 25 bp, Mus musculus
taggtgtgtgtgtcaccttcggagc

SEQ ID NO: 264739 - DNA, 25 bp, Mus musculus
cagcaccctagaggagggctcctcg

SEQ ID NO: 264740 - DNA, 25 bp, Mus musculus
cccggaagccatgcggatttggatg

SEQ ID NO: 264741 - DNA, 25 bp, Mus musculus
ttctgcgtcaagacctacgaacgtc

SEQ ID NO: 264742 - DNA, 25 bp, Mus musculus
atgtcatcgtgacagctgcggacga

SEQ ID NO: 264743 - DNA, 25 bp, Mus musculus
gcctgaccttctgcgtcaagaccta

SEQ ID NO: 264744 - DNA, 25 bp, Mus musculus
gacctacgaacgtcttttctatatg

SEQ ID NO: 264745 - DNA, 25 bp, Mus musculus
cccagcccggaagccatgcggattt

SEQ ID NO: 264746 - DNA, 25 bp, Mus musculus
catgcggatttggatggatgtcatc

SEQ ID NO: 264747 - DNA, 25 bp, Mus musculus
tttggatggatgtcatcgtgacagc

SEQ ID NO: 264748 - DNA, 25 bp, Mus musculus
atcgtgacagctgcggacgagaacc

SEQ ID NO: 264749 - DNA, 25 bp, Mus musculus
gacagctgcggacgagaaccacgcc

SEQ ID NO: 264750 - DNA, 25 bp, Mus musculus
ctagacgcacttaccggcctttggg

SEQ ID NO: 264751 - DNA, 25 bp, Mus musculus
tgcgtcaagacctacgaacgtcttt

SEQ ID NO: 264752 - DNA, 25 bp, Mus musculus
tgaccttctgcgtcaagacctacga

SEQ ID NO: 264753 - DNA, 25 bp, Mus musculus
gaacgtcttttctatatggtggccc

SEQ ID NO: 264754 - DNA, 25 bp, Mus musculus
gcagtgggtctgagtcaacgcctca

SEQ ID NO: 264755 - DNA, 25 bp, Mus musculus
ctcgctctggctgaggtcattcgac

SEQ ID NO: 264756 - DNA, 25 bp, Mus musculus
ccattggctgcctgcttgcaaagtg

SEQ ID NO: 264757 - DNA, 25 bp, Mus musculus
aggcaacgtgtgtgagactcaactc

SEQ ID NO: 264758 - DNA, 25 bp, Mus musculus
tgagactcaactcgacgcgctattg

SEQ ID NO: 264759 - DNA, 25 bp, Mus musculus
cgcgctattggctggcgtgattgtt

SEQ ID NO: 264760 - DNA, 25 bp, Mus musculus
ggggacgattgcaaaccctattggc

SEQ ID NO: 264761 - DNA, 25 bp, Mus musculus
tctcctggctgactgtgattcggct

SEQ ID NO: 264762 - DNA, 25 bp, Mus musculus
tggagctcattggtccttgtgtgaa

SEQ ID NO: 264763 - DNA, 25 bp, Mus musculus
tgattcggctcgaggctgtggtaac

SEQ ID NO: 264764 - DNA, 25 bp, Mus musculus
actgtgtcgcccttttctctgggcc

SEQ ID NO: 264765 - DNA, 25 bp, Mus musculus
aagcgcggagcccaggttatgcgca

SEQ ID NO: 264766 - DNA, 25 bp, Mus musculus
cccgctggcggcatgaacatcatac

SEQ ID NO: 264767 - DNA, 25 bp, Mus musculus
cgaagcgctgtgcttggagctcatt

SEQ ID NO: 264768 - DNA, 25 bp, Mus musculus
gcggcaggcccggacatgcctgatc

SEQ ID NO: 264769 - DNA, 25 bp, Mus musculus
ccaggaagcagggtcttgcgctgaa

SEQ ID NO: 264770 - DNA, 25 bp, Mus musculus
agggtcttgcgctgaatcccgcctt

SEQ ID NO: 264771 - DNA, 25 bp, Mus musculus
caaggctcaaatgaaggccgactcc

SEQ ID NO: 264772 - DNA, 25 bp, Mus musculus
tacagacccgcccattttgggtgga

SEQ ID NO: 264773 - DNA, 25 bp, Mus musculus
cccattttgggtggagatgaagcca

SEQ ID NO: 264774 - DNA, 25 bp, Mus musculus
ccatattcgccctcagaaaggcgga

SEQ ID NO: 264775 - DNA, 25 bp, Mus musculus
cagaaaggcggagccctctggttta

SEQ ID NO: 264776 - DNA, 25 bp, Mus musculus
tggtttagccgctctcgcgagcact

SEQ ID NO: 264777 - DNA, 25 bp, Mus musculus
aaatctcgcgagactcgacgcccga

SEQ ID NO: 264778 - DNA, 25 bp, Mus musculus
taactattcccatttccggccagga

SEQ ID NO: 264779 - DNA, 25 bp, Mus musculus
gtggagggctctcccacgcggtcac

SEQ ID NO: 264780 - DNA, 25 bp, Mus musculus
gacatgcctgatcgccgcaatccgg

SEQ ID NO: 264781 - DNA, 25 bp, Mus musculus
gacgcccgacttgtgcgcccgggaa

SEQ ID NO: 264782 - DNA, 25 bp, Mus musculus
agttcggattcatcgtgggttcgca

SEQ ID NO: 264783 - DNA, 25 bp, Mus musculus
actcggaggccaacggcttcgccga

SEQ ID NO: 264784 - DNA, 25 bp, Mus musculus
gtgggcctgacccaccaacgtgtct

SEQ ID NO: 264785 - DNA, 25 bp, Mus musculus
accaacgtgtctccactgtcccaac

SEQ ID NO: 264786 - DNA, 25 bp, Mus musculus
cgccgcatcgacaagttcggattca

SEQ ID NO: 264787 - DNA, 25 bp, Mus musculus
tcacgtcggtccacttggcgccagg

SEQ ID NO: 264788 - DNA, 25 bp, Mus musculus
cctcggcacccattgggcgcgtggt

SEQ ID NO: 264789 - DNA, 25 bp, Mus musculus
ccagctttgtggcagccaatgggca

SEQ ID NO: 264790 - DNA, 25 bp, Mus musculus
ttgtggcagccaatgggcacagtgc

SEQ ID NO: 264791 - DNA, 25 bp, Mus musculus
cgcggccgatatggcgaaaagcagc

SEQ ID NO: 264792 - DNA, 25 bp, Mus musculus
tatggcgaaaagcagcagagagaat

SEQ ID NO: 264793 - DNA, 25 bp, Mus musculus
gctccgactcggaggccaacggctt

SEQ ID NO: 264794 - DNA, 25 bp, Mus musculus
cgagcgccgcatcgacaagttcgga

SEQ ID NO: 264795 - DNA, 25 bp, Mus musculus
gccaccgccgacgagctgagctcgc

SEQ ID NO: 264796 - DNA, 25 bp, Mus musculus
tgtattgcgatacccgccggcagga

SEQ ID NO: 264797 - DNA, 25 bp, Mus musculus
cctctggctcggctagagcgactct

SEQ ID NO: 264798 - DNA, 25 bp, Mus musculus
tctggctcggctagagcgactctgc

SEQ ID NO: 264799 - DNA, 25 bp, Mus musculus
ctcggctagagcgactctgcggcac

SEQ ID NO: 264800 - DNA, 25 bp, Mus musculus
tcggctagagcgactctgcggcacg

SEQ ID NO: 264801 - DNA, 25 bp, Mus musculus
aggagtggagctggacgcaaaggcg

SEQ ID NO: 264802 - DNA, 25 bp, Mus musculus
ccggcaggaggagtggagttgccga

SEQ ID NO: 264803 - DNA, 25 bp, Mus musculus
gcgccgtgtattgcgatacccgccg

SEQ ID NO: 264804 - DNA, 25 bp, Mus musculus
agcgtggcgccgtgtattgcgatac

SEQ ID NO: 264805 - DNA, 25 bp, Mus musculus
ccctatcgggccagcgtggcgccgt

SEQ ID NO: 264806 - DNA, 25 bp, Mus musculus
tggcgccgtgtattgcgatacccgc

SEQ ID NO: 264807 - DNA, 25 bp, Mus musculus
ctggacgcaaaggcggcctctggct

SEQ ID NO: 264808 - DNA, 25 bp, Mus musculus
ttgccgaggccggagagcggtagga

SEQ ID NO: 264809 - DNA, 25 bp, Mus musculus
cgtgtattgcgatacccgccggcag

SEQ ID NO: 264810 - DNA, 25 bp, Mus musculus
ccagagttaaggcacagccgtgccc

SEQ ID NO: 264811 - DNA, 25 bp, Mus musculus
aggatgttcggagtcccgcgaagac

SEQ ID NO: 264812 - DNA, 25 bp, Mus musculus
acaggatgttcggagtcccgcgaag

SEQ ID NO: 264813 - DNA, 25 bp, Mus musculus
acacaggatgttcggagtcccgcga

SEQ ID NO: 264814 - DNA, 25 bp, Mus musculus
ggacacaggatgttcggagtcccgc

SEQ ID NO: 264815 - DNA, 25 bp, Mus musculus
taaagttcggatcccgcagccatgg

SEQ ID NO: 264816 - DNA, 25 bp, Mus musculus
ttaaagttcggatcccgcagccatg

SEQ ID NO: 264817 - DNA, 25 bp, Mus musculus
gtttaaagttcggatcccgcagcca

SEQ ID NO: 264818 - DNA, 25 bp, Mus musculus
agtgtttaaagttcggatcccgcag

SEQ ID NO: 264819 - DNA, 25 bp, Mus musculus
cgccttgcgcatccgctccggtccg

SEQ ID NO: 264820 - DNA, 25 bp, Mus musculus
ctttccgcgccttgcgcatccgctc

SEQ ID NO: 264821 - DNA, 25 bp, Mus musculus
gctcactcactttccgcgccttgcg

SEQ ID NO: 264822 - DNA, 25 bp, Mus musculus
gtctctggggaccacctcccgtgcc

SEQ ID NO: 264823 - DNA, 25 bp, Mus musculus
cccgctgacgaccaccaagctgccc

SEQ ID NO: 264824 - DNA, 25 bp, Mus musculus
gaggggcctctcgacttccgcctca

SEQ ID NO: 264825 - DNA, 25 bp, Mus musculus
ccgacattttgggtagcggggtcag

SEQ ID NO: 264826 - DNA, 25 bp, Mus musculus
cggggtcagcgtcacttccacctga

SEQ ID NO: 264827 - DNA, 25 bp, Mus musculus
ggggtcagcgtcacttccacctgag

SEQ ID NO: 264828 - DNA, 25 bp, Mus musculus
gggtcagcgtcacttccacctgagg

SEQ ID NO: 264829 - DNA, 25 bp, Mus musculus
ggtcagcgtcacttccacctgaggg

SEQ ID NO: 264830 - DNA, 25 bp, Mus musculus
gtcagcgtcacttccacctgagggg

SEQ ID NO: 264831 - DNA, 25 bp, Mus musculus
cacctgaggggcctctcgacttccg

SEQ ID NO: 264832 - DNA, 25 bp, Mus musculus
gggcctctcgacttccgcctcagct

SEQ ID NO: 264833 - DNA, 25 bp, Mus musculus
gcctctcgacttccgcctcagctct

SEQ ID NO: 264834 - DNA, 25 bp, Mus musculus
tccgcctcagctctcttctacgccc

SEQ ID NO: 264835 - DNA, 25 bp, Mus musculus
ctcagctctcttctacgccccccca

SEQ ID NO: 264836 - DNA, 25 bp, Mus musculus
cttggcttctctatcccgcccccgc

SEQ ID NO: 264837 - DNA, 25 bp, Mus musculus
tcagcgtcacttccacctgaggggc

SEQ ID NO: 264838 - DNA, 25 bp, Mus musculus
gcagcatttcgtagcccacggtgcg

SEQ ID NO: 264839 - DNA, 25 bp, Mus musculus
ttccagccgcggaggttaaagaagc

SEQ ID NO: 264840 - DNA, 25 bp, Mus musculus
aggttaaagaagctaggctagcgcc

SEQ ID NO: 264841 - DNA, 25 bp, Mus musculus
gaagctaggctagcgccatctttgt

SEQ ID NO: 264842 - DNA, 25 bp, Mus musculus
gctaggctagcgccatctttgttga

SEQ ID NO: 264843 - DNA, 25 bp, Mus musculus
tacccgcggcgccatatagactaag

SEQ ID NO: 264844 - DNA, 25 bp, Mus musculus
ccgcggcgccatatagactaagggc

SEQ ID NO: 264845 - DNA, 25 bp, Mus musculus
ggcgccatatagactaagggcaata

SEQ ID NO: 264846 - DNA, 25 bp, Mus musculus
gccatatagactaagggcaatactc

SEQ ID NO: 264847 - DNA, 25 bp, Mus musculus
gactaagggcaatactctcagcgtg

SEQ ID NO: 264848 - DNA, 25 bp, Mus musculus
tactctcagcgtgcagcatttcgta

SEQ ID NO: 264849 - DNA, 25 bp, Mus musculus
gtgcagcatttcgtagcccacggtg

SEQ ID NO: 264850 - DNA, 25 bp, Mus musculus
ttcctttcctatttccagccgcgga

SEQ ID NO: 264851 - DNA, 25 bp, Mus musculus
tcagcgtgcagcatttcgtagccca

SEQ ID NO: 264852 - DNA, 25 bp, Mus musculus
atgaaaaatagcaggcatcggagcc

SEQ ID NO: 264853 - DNA, 25 bp, Mus musculus
agatgggacatgacaggtgcgatca

SEQ ID NO: 264854 - DNA, 25 bp, Mus musculus
tgggacatgacaggtgcgatcaata

SEQ ID NO: 264855 - DNA, 25 bp, Mus musculus
tgacaggtgcgatcaatacgcagcc

SEQ ID NO: 264856 - DNA, 25 bp, Mus musculus
agagcgcggtgtttgtggagctgtc

SEQ ID NO: 264857 - DNA, 25 bp, Mus musculus
ggccttcagcttcgattaggggaga

SEQ ID NO: 264858 - DNA, 25 bp, Mus musculus
agccggccttcagcttcgattaggg

SEQ ID NO: 264859 - DNA, 25 bp, Mus musculus
ggagccggccttcagcttcgattag

SEQ ID NO: 264860 - DNA, 25 bp, Mus musculus
tagcaggcatcggagccggccttca

SEQ ID NO: 264861 - DNA, 25 bp, Mus musculus
cttcagcttcgattaggggagatgg

SEQ ID NO: 264862 - DNA, 25 bp, Mus musculus
gtcggctgcggtggaattatgaaaa

SEQ ID NO: 264863 - DNA, 25 bp, Mus musculus
ctgcggtggaattatgaaaaatagc

SEQ ID NO: 264864 - DNA, 25 bp, Mus musculus
actcggtgttggaacggcacggccg

SEQ ID NO: 264865 - DNA, 25 bp, Mus musculus
cggctgcggtggaattatgaaaaat

SEQ ID NO: 264866 - DNA, 25 bp, Mus musculus
aattagcaagaagccgggaggacta

SEQ ID NO: 264867 - DNA, 25 bp, Mus musculus
tcggatcgctggatgtggcctccag

SEQ ID NO: 264868 - DNA, 25 bp, Mus musculus
tggcctccaggacggggacccgaca

SEQ ID NO: 264869 - DNA, 25 bp, Mus musculus
cggaagagctagaacgtcggcaaga

SEQ ID NO: 264870 - DNA, 25 bp, Mus musculus
cctggagagaagagctataacgcgg

SEQ ID NO: 264871 - DNA, 25 bp, Mus musculus
gaagaggggttacatcgccggccaa

SEQ ID NO: 264872 - DNA, 25 bp, Mus musculus
agcacatgcagaggggttcgaactc

SEQ ID NO: 264873 - DNA, 25 bp, Mus musculus
cacgttagaactccgttagaacacg

SEQ ID NO: 264874 - DNA, 25 bp, Mus musculus
atttccgctcgcaaccctggcaagg

SEQ ID NO: 264875 - DNA, 25 bp, Mus musculus
gaacctgggcgactcgggattagaa

SEQ ID NO: 264876 - DNA, 25 bp, Mus musculus
ggttagaactcgatggggataacta

SEQ ID NO: 264877 - DNA, 25 bp, Mus musculus
tggggataactagagcacatgcaga

SEQ ID NO: 264878 - DNA, 25 bp, Mus musculus
gactggactgcggacaaggtgtcta

SEQ ID NO: 264879 - DNA, 25 bp, Mus musculus
aacactagagtgcaggcggaagagc

SEQ ID NO: 264880 - DNA, 25 bp, Mus musculus
cgaacacgtagttgctttgataata

SEQ ID NO: 264881 - DNA, 25 bp, Mus musculus
tgctttgataatactccacgttgcg

SEQ ID NO: 264882 - DNA, 25 bp, Mus musculus
actccacgttgcgtaccaggcgctg

SEQ ID NO: 264883 - DNA, 25 bp, Mus musculus
gtaccaggcgctggcaaagctctcc

SEQ ID NO: 264884 - DNA, 25 bp, Mus musculus
aagctctcccacattgcggggtcgc

SEQ ID NO: 264885 - DNA, 25 bp, Mus musculus
cgctccagccactctcggcctgcgc

SEQ ID NO: 264886 - DNA, 25 bp, Mus musculus
tcgcgagaaacgttgctggtccacg

SEQ ID NO: 264887 - DNA, 25 bp, Mus musculus
aacgttgctggtccacgaaggtgcc

SEQ ID NO: 264888 - DNA, 25 bp, Mus musculus
gccgagaaacacgaacacgtagttg

SEQ ID NO: 264889 - DNA, 25 bp, Mus musculus
ccacattgcggggtcgcgagaaacg

SEQ ID NO: 264890 - DNA, 25 bp, Mus musculus
cacacgcagtacaggatgaggccga

SEQ ID NO: 264891 - DNA, 25 bp, Mus musculus
ggcactcacacgcagtacaggatga

SEQ ID NO: 264892 - DNA, 25 bp, Mus musculus
cgcagaggcactcacacgcagtaca

SEQ ID NO: 264893 - DNA, 25 bp, Mus musculus
cagtacaggatgaggccgagaaaca

SEQ ID NO: 264894 - DNA, 25 bp, Mus musculus
gggcacacgagcaaccgcacaaggt

SEQ ID NO: 264895 - DNA, 25 bp, Mus musculus
cggccaatcaggagcagtactgagc

SEQ ID NO: 264896 - DNA, 25 bp, Mus musculus
tgggtcccaccgcacagaggctgcg

SEQ ID NO: 264897 - DNA, 25 bp, Mus musculus
aagagcggcgttcagactgatgagc

SEQ ID NO: 264898 - DNA, 25 bp, Mus musculus
tgtcacgcacacagagtccagccga

SEQ ID NO: 264899 - DNA, 25 bp, Mus musculus
gtcactggacacgatgtcacgcaca

SEQ ID NO: 264900 - DNA, 25 bp, Mus musculus
ccggcacacagccaaagtcactgga

SEQ ID NO: 264901 - DNA, 25 bp, Mus musculus
aaactagtcaggtcagccggctccc

SEQ ID NO: 264902 - DNA, 25 bp, Mus musculus
attcgccctcaagcatttgcactcg

SEQ ID NO: 264903 - DNA, 25 bp, Mus musculus
agtactgagcagacggacagcttgc

SEQ ID NO: 264904 - DNA, 25 bp, Mus musculus
ttcccagccacacaaactagtcagg

SEQ ID NO: 264905 - DNA, 25 bp, Mus musculus
aagcctccaacatgcgccacagatt

SEQ ID NO: 264906 - DNA, 25 bp, Mus musculus
tcaaaccgagatgctaagggccagc

SEQ ID NO: 264907 - DNA, 25 bp, Mus musculus
tcgtgccgccacactcatgcaaggg

SEQ ID NO: 264908 - DNA, 25 bp, Mus musculus
gcatcgcgtccctgcagtcagtcgg

SEQ ID NO: 264909 - DNA, 25 bp, Mus musculus
gggacagtcacttcgaggcccgccg

SEQ ID NO: 264910 - DNA, 25 bp, Mus musculus
caagacacggcgtggcgtagctcct

SEQ ID NO: 264911 - DNA, 25 bp, Mus musculus
gaacgcgaggtctttcggcaagaca

SEQ ID NO: 264912 - DNA, 25 bp, Mus musculus
ttgctgagtcgcatctcgcggactg

SEQ ID NO: 264913 - DNA, 25 bp, Mus musculus
tagagcttgccgttgctgagtcgca

SEQ ID NO: 264914 - DNA, 25 bp, Mus musculus
acggtcattcgtgctcggtcagctc

SEQ ID NO: 264915 - DNA, 25 bp, Mus musculus
ttgaaggcaaaatcgcggcgtcctg

SEQ ID NO: 264916 - DNA, 25 bp, Mus musculus
gggctcggacttcaccaggaattga

SEQ ID NO: 264917 - DNA, 25 bp, Mus musculus
tcaagtccactaggaggcgcaggcc

SEQ ID NO: 264918 - DNA, 25 bp, Mus musculus
gacacccttgctcaagtccactagg

SEQ ID NO: 264919 - DNA, 25 bp, Mus musculus
cccgtccacggtgcgggatagaatg

SEQ ID NO: 264920 - DNA, 25 bp, Mus musculus
tggcccttagagtcctcggtctctg

SEQ ID NO: 264921 - DNA, 25 bp, Mus musculus
gatgcgcctgcactcctggcagacg

SEQ ID NO: 264922 - DNA, 25 bp, Mus musculus
tgctcttgacaaacacgctgggctg

SEQ ID NO: 264923 - DNA, 25 bp, Mus musculus
atgccgtagcccttggtgtcgagga

SEQ ID NO: 264924 - DNA, 25 bp, Mus musculus
ccgatctgggtgaggttgcaattga

SEQ ID NO: 264925 - DNA, 25 bp, Mus musculus
caattgaggcgcctgtggtactcgt

SEQ ID NO: 264926 - DNA, 25 bp, Mus musculus
cctgtggtactcgttcatggtggac

SEQ ID NO: 264927 - DNA, 25 bp, Mus musculus
tactcgttcatggtggactccagca

SEQ ID NO: 264928 - DNA, 25 bp, Mus musculus
cgttcatggtggactccagcaggaa

SEQ ID NO: 264929 - DNA, 25 bp, Mus musculus
gcgattccctcctctgtgctcttga

SEQ ID NO: 264930 - DNA, 25 bp, Mus musculus
aacacgctgggctgcttcgattgca

SEQ ID NO: 264931 - DNA, 25 bp, Mus musculus
gcatgtagttccacatccgctggta

SEQ ID NO: 264932 - DNA, 25 bp, Mus musculus
tccacatccgctggtacgtctggta

SEQ ID NO: 264933 - DNA, 25 bp, Mus musculus
atccgctggtacgtctggtaccgcg

SEQ ID NO: 264934 - DNA, 25 bp, Mus musculus
cggcatgccgatgccgtagcccttg

SEQ ID NO: 264935 - DNA, 25 bp, Mus musculus
gctgcttcgattgcatgtagttcca

SEQ ID NO: 264936 - DNA, 25 bp, Mus musculus
ctgcacgatgaaggcctgaaggatc

SEQ ID NO: 264937 - DNA, 25 bp, Mus musculus
ctccgctctattggtcgaggcttca

SEQ ID NO: 264938 - DNA, 25 bp, Mus musculus
cattgctaaaggattggctgggcgc

SEQ ID NO: 264939 - DNA, 25 bp, Mus musculus
tatccacctggaggccgaccagcga

SEQ ID NO: 264940 - DNA, 25 bp, Mus musculus
taaagaggcgggtagtatccacctg

SEQ ID NO: 264941 - DNA, 25 bp, Mus musculus
tttcgagctatcaaaggcggaatcc

SEQ ID NO: 264942 - DNA, 25 bp, Mus musculus
gctttgcgtgtctctacagcctaca

SEQ ID NO: 264943 - DNA, 25 bp, Mus musculus
cctgagcatcgattggtctaatgac

SEQ ID NO: 264944 - DNA, 25 bp, Mus musculus
tgacaggggcagacagccgatgatt

SEQ ID NO: 264945 - DNA, 25 bp, Mus musculus
cagccgatgattgggcgaattgtgc

SEQ ID NO: 264946 - DNA, 25 bp, Mus musculus
attgtgcagttcttcgcagcggccc

SEQ ID NO: 264947 - DNA, 25 bp, Mus musculus
ggtgcaaagggacctgaagcccgta

SEQ ID NO: 264948 - DNA, 25 bp, Mus musculus
cgaggcttcaggaaacctgagcatc

SEQ ID NO: 264949 - DNA, 25 bp, Mus musculus
gcctgcgtcattcggcctgcacgat

SEQ ID NO: 264950 - DNA, 25 bp, Mus musculus
aaaggtttgcccatcttgcttgcga

SEQ ID NO: 264951 - DNA, 25 bp, Mus musculus
tgtctccaccaggagggtgcttcct

SEQ ID NO: 264952 - DNA, 25 bp, Mus musculus
ggtgcttccttcacttggcccacaa

SEQ ID NO: 264953 - DNA, 25 bp, Mus musculus
gcaacctcatcattccgggctcgga

SEQ ID NO: 264954 - DNA, 25 bp, Mus musculus
aggagacctcacctgtgcggtgtca

SEQ ID NO: 264955 - DNA, 25 bp, Mus musculus
actccgtgtaagaggaaccaagcca

SEQ ID NO: 264956 - DNA, 25 bp, Mus musculus
tcctggtgcgctcagaaaggtttgc

SEQ ID NO: 264957 - DNA, 25 bp, Mus musculus
tgcttgcgactcaaaaagaatctcc

SEQ ID NO: 264958 - DNA, 25 bp, Mus musculus
agaatctcctgtccctagaagggtg

SEQ ID NO: 264959 - DNA, 25 bp, Mus musculus
cgagctcttggcgacaggatagata

SEQ ID NO: 264960 - DNA, 25 bp, Mus musculus
ctgggcgcacatctgcaattcctta

SEQ ID NO: 264961 - DNA, 25 bp, Mus musculus
tgcaattccttaccctcctggctgg

SEQ ID NO: 264962 - DNA, 25 bp, Mus musculus
tccctcagagcctaggccagagagc

SEQ ID NO: 264963 - DNA, 25 bp, Mus musculus
gggcgtcccaaacagctcctggtgc

SEQ ID NO: 264964 - DNA, 25 bp, Mus musculus
cctgtggcaagaaagtgggctctgc

SEQ ID NO: 264965 - DNA, 25 bp, Mus musculus
gcgtctggcagaacatcgccgcatc

SEQ ID NO: 264966 - DNA, 25 bp, Mus musculus
aaggcctttgccatctccatgcgtc

SEQ ID NO: 264967 - DNA, 25 bp, Mus musculus
gttccttcttgctacgccggctgct

SEQ ID NO: 264968 - DNA, 25 bp, Mus musculus
agcttgtgatccatgctgggcgcca

SEQ ID NO: 264969 - DNA, 25 bp, Mus musculus
ccaggagtgcggagtccgttttcac

SEQ ID NO: 264970 - DNA, 25 bp, Mus musculus
tgctgctcgcctgcaggcacatgaa

SEQ ID NO: 264971 - DNA, 25 bp, Mus musculus
gccctcagtggtacaacctctgctg

SEQ ID NO: 264972 - DNA, 25 bp, Mus musculus
gtgcagtgagtgcaagaagctcttc

SEQ ID NO: 264973 - DNA, 25 bp, Mus musculus
ttcagcacagagacgtcactacagg

SEQ ID NO: 264974 - DNA, 25 bp, Mus musculus
gtcactacaggtccatcggcgcatc

SEQ ID NO: 264975 - DNA, 25 bp, Mus musculus
tccgccagagtacccatctgaaaga

SEQ ID NO: 264976 - DNA, 25 bp, Mus musculus
ccctttgcgtgtgaagtgtgtggca

SEQ ID NO: 264977 - DNA, 25 bp, Mus musculus
ctgctagaggtccaccagcttgtga

SEQ ID NO: 264978 - DNA, 25 bp, Mus musculus
gcgcacacctgcgagggtcacacaa

SEQ ID NO: 264979 - DNA, 25 bp, Mus musculus
gctcatcagtcctgcggttttcctg

SEQ ID NO: 264980 - DNA, 25 bp, Mus musculus
gctccgctcatcagtcctgcggttt

SEQ ID NO: 264981 - DNA, 25 bp, Mus musculus
atcagtcctgcggttttcctgaagc

SEQ ID NO: 264982 - DNA, 25 bp, Mus musculus
agtcctgcggttttcctgaagcccg

SEQ ID NO: 264983 - DNA, 25 bp, Mus musculus
cggttttcctgaagcccgccagagg

SEQ ID NO: 264984 - DNA, 25 bp, Mus musculus
gcagcgtccagtcaatgggcaggag

SEQ ID NO: 264985 - DNA, 25 bp, Mus musculus
acacctgcgagggtcacacaaaggc

SEQ ID NO: 264986 - DNA, 25 bp, Mus musculus
cctgcgagggtcacacaaaggcgca

SEQ ID NO: 264987 - DNA, 25 bp, Mus musculus
agggtcacacaaaggcgcaggactc

SEQ ID NO: 264988 - DNA, 25 bp, Mus musculus
cacaaaggcgcaggactcgggcgca

SEQ ID NO: 264989 - DNA, 25 bp, Mus musculus
actcgggcgcacagtagcgcagaca

SEQ ID NO: 264990 - DNA, 25 bp, Mus musculus
cagtagcgcagacaaaggcaggcgc

SEQ ID NO: 264991 - DNA, 25 bp, Mus musculus
cgcacagtagcgcagacaaaggcag

SEQ ID NO: 264992 - DNA, 25 bp, Mus musculus
gtctccgagctcactcctttttgtg

SEQ ID NO: 264993 - DNA, 25 bp, Mus musculus
tctccgagctcactcctttttgtgt

SEQ ID NO: 264994 - DNA, 25 bp, Mus musculus
cgtctccgagctcactcctttttgt

SEQ ID NO: 264995 - DNA, 25 bp, Mus musculus
gcgtctccgagctcactcctttttg

SEQ ID NO: 264996 - DNA, 25 bp, Mus musculus
tgccaccttgcctcgcgtctccgag

SEQ ID NO: 264997 - DNA, 25 bp, Mus musculus
ggatgccaccttgcctcgcgtctcc

SEQ ID NO: 264998 - DNA, 25 bp, Mus musculus
gcggatgccaccttgcctcgcgtct

SEQ ID NO: 264999 - DNA, 25 bp, Mus musculus
gagcggatgccaccttgcctcgcgt

SEQ ID NO: 265000 - DNA, 25 bp, Mus musculus
ggagcggatgccaccttgcctcgcg

SEQ ID NO: 265001 - DNA, 25 bp, Mus musculus
aggagcggatgccaccttgcctcgc

SEQ ID NO: 265002 - DNA, 25 bp, Mus musculus
gccaggagcggatgccaccttgcct

SEQ ID NO: 265003 - DNA, 25 bp, Mus musculus
agccaggagcggatgccaccttgcc

SEQ ID NO: 265004 - DNA, 25 bp, Mus musculus
cagccaggagcggatgccaccttgc

SEQ ID NO: 265005 - DNA, 25 bp, Mus musculus
ctccgagctcactcctttttgtgtt

SEQ ID NO: 265006 - DNA, 25 bp, Mus musculus
gcatgcaaatgaggtacccagaggc

SEQ ID NO: 265007 - DNA, 25 bp, Mus musculus
cacgcgagcccaggcagcatgcaaa

SEQ ID NO: 265008 - DNA, 25 bp, Mus musculus
cgcgagcccaggcagcatgcaaatg

SEQ ID NO: 265009 - DNA, 25 bp, Mus musculus
gcagcatgcaaatgaggtacccaga

SEQ ID NO: 265010 - DNA, 25 bp, Mus musculus
atgcaaatgaggtacccagaggcgg

SEQ ID NO: 265011 - DNA, 25 bp, Mus musculus
ggcacctgttcccagcttctttgct

SEQ ID NO: 265012 - DNA, 25 bp, Mus musculus
ttctttgctctctcctgcgcacgtc

SEQ ID NO: 265013 - DNA, 25 bp, Mus musculus
tcctgcgcacgtcgacctcgcgccc

SEQ ID NO: 265014 - DNA, 25 bp, Mus musculus
tgccaccaatgtccccgcgccgctc

SEQ ID NO: 265015 - DNA, 25 bp, Mus musculus
gctcattggccaccgtaccctgagg

SEQ ID NO: 265016 - DNA, 25 bp, Mus musculus
tcattggccaccgtaccctgagggc

SEQ ID NO: 265017 - DNA, 25 bp, Mus musculus
cgggctgggccactcgcgcctgaca

SEQ ID NO: 265018 - DNA, 25 bp, Mus musculus
gtacacacgcgagcccaggcagcat

SEQ ID NO: 265019 - DNA, 25 bp, Mus musculus
gcataagcgcgcacccggcacctgt

SEQ ID NO: 265020 - DNA, 25 bp, Mus musculus
gcaaagcgcagatattaatatgcaa

SEQ ID NO: 265021 - DNA, 25 bp, Mus musculus
cgcgggtcagattatgcaaagcgca

SEQ ID NO: 265022 - DNA, 25 bp, Mus musculus
agatttttaaatggaagggcgagcg

SEQ ID NO: 265023 - DNA, 25 bp, Mus musculus
atttttaaatggaagggcgagcgcg

SEQ ID NO: 265024 - DNA, 25 bp, Mus musculus
aagcgcgggtcagattatgcaaagc

SEQ ID NO: 265025 - DNA, 25 bp, Mus musculus
agcgcgggtcagattatgcaaagcg

SEQ ID NO: 265026 - DNA, 25 bp, Mus musculus
cgggtcagattatgcaaagcgcaga

SEQ ID NO: 265027 - DNA, 25 bp, Mus musculus
ggtcagattatgcaaagcgcagata

SEQ ID NO: 265028 - DNA, 25 bp, Mus musculus
gtcagattatgcaaagcgcagatat

SEQ ID NO: 265029 - DNA, 25 bp, Mus musculus
cagattatgcaaagcgcagatatta

SEQ ID NO: 265030 - DNA, 25 bp, Mus musculus
atgcaaagcgcagatattaatatgc

SEQ ID NO: 265031 - DNA, 25 bp, Mus musculus
taaagcgcgggtcagattatgcaaa

SEQ ID NO: 265032 - DNA, 25 bp, Mus musculus
gcgcagatattaatatgcaaagttt

SEQ ID NO: 265033 - DNA, 25 bp, Mus musculus
ataaagcgcgggtcagattatgcaa

SEQ ID NO: 265034 - DNA, 25 bp, Mus musculus
cggagagctctctgcaataggccga

SEQ ID NO: 265035 - DNA, 25 bp, Mus musculus
cggctgcattaagcttcttgcaatc

SEQ ID NO: 265036 - DNA, 25 bp, Mus musculus
cttgcaatcaataaagcgcgggtca

SEQ ID NO: 265037 - DNA, 25 bp, Mus musculus
tcttgcaatcaataaagcgcgggtc

SEQ ID NO: 265038 - DNA, 25 bp, Mus musculus
cttcttgcaatcaataaagcgcggg

SEQ ID NO: 265039 - DNA, 25 bp, Mus musculus
gcattaagcttcttgcaatcaataa

SEQ ID NO: 265040 - DNA, 25 bp, Mus musculus
agccggctgcattaagcttcttgca

SEQ ID NO: 265041 - DNA, 25 bp, Mus musculus
cgagccggctgcattaagcttcttg

SEQ ID NO: 265042 - DNA, 25 bp, Mus musculus
gccgagccggctgcattaagcttct

SEQ ID NO: 265043 - DNA, 25 bp, Mus musculus
ctctctgcaataggccgagccggct

SEQ ID NO: 265044 - DNA, 25 bp, Mus musculus
gagagctctctgcaataggccgagc

SEQ ID NO: 265045 - DNA, 25 bp, Mus musculus
cccggagagctctctgcaataggcc

SEQ ID NO: 265046 - DNA, 25 bp, Mus musculus
ccgcccggagagctctctgcaatag

SEQ ID NO: 265047 - DNA, 25 bp, Mus musculus
agctctctgcaataggccgagccgg

SEQ ID NO: 265048 - DNA, 25 bp, Mus musculus
ccctcccacggacaggaatggtatc

SEQ ID NO: 265049 - DNA, 25 bp, Mus musculus
cggccgcagccacttgttttggatc

SEQ ID NO: 265050 - DNA, 25 bp, Mus musculus
ccagattccagcgtccgatgacttc

SEQ ID NO: 265051 - DNA, 25 bp, Mus musculus
ccacacaggtggtactgtctgaatc

SEQ ID NO: 265052 - DNA, 25 bp, Mus musculus
gccctcgggttctgtccactagtac

SEQ ID NO: 265053 - DNA, 25 bp, Mus musculus
ccggtgacttcggatggcaaatgtc

SEQ ID NO: 265054 - DNA, 25 bp, Mus musculus
tgacctagacgaccagctcgaatga

SEQ ID NO: 265055 - DNA, 25 bp, Mus musculus
tgcccttttctgagtagtacgtttc

SEQ ID NO: 265056 - DNA, 25 bp, Mus musculus
tggtatcgcccgagatcccatagta

SEQ ID NO: 265057 - DNA, 25 bp, Mus musculus
ccgagcacccaagtggttccagcta

SEQ ID NO: 265058 - DNA, 25 bp, Mus musculus
cgacagcatgccgtagtaatccaaa

SEQ ID NO: 265059 - DNA, 25 bp, Mus musculus
aggagctccagttcgcactcggtca

SEQ ID NO: 265060 - DNA, 25 bp, Mus musculus
atcactgtcgggaggaccaagccca

SEQ ID NO: 265061 - DNA, 25 bp, Mus musculus
gtgggaccgaccaagacaaccctga

SEQ ID NO: 265062 - DNA, 25 bp, Mus musculus
cgctctataaggatgcacacttttc

SEQ ID NO: 265063 - DNA, 25 bp, Mus musculus
ctccgctgaattttcaaacagcagg

SEQ ID NO: 265064 - DNA, 25 bp, Mus musculus
ctgaattttcaaacagcaggaaagg

SEQ ID NO: 265065 - DNA, 25 bp, Mus musculus
aaggatgcacacttttctccgctga

SEQ ID NO: 265066 - DNA, 25 bp, Mus musculus
gagaactgcgcaggcgcctctcctg

SEQ ID NO: 265067 - DNA, 25 bp, Mus musculus
ggacaccgcctccagggcactggtg

SEQ ID NO: 265068 - DNA, 25 bp, Mus musculus
gcacacttttctccgctgaattttc

SEQ ID NO: 265069 - DNA, 25 bp, Mus musculus
gcactggtgtctgcgtggagaaact

SEQ ID NO: 265070 - DNA, 25 bp, Mus musculus
cgacctcgctctataaggatgcaca

SEQ ID NO: 265071 - DNA, 25 bp, Mus musculus
tctgcgtggagaaactcgcggagcc

SEQ ID NO: 265072 - DNA, 25 bp, Mus musculus
tgtgcgacctcgctctataaggatg

SEQ ID NO: 265073 - DNA, 25 bp, Mus musculus
gccacgttcatttgtgcgacctcgc

SEQ ID NO: 265074 - DNA, 25 bp, Mus musculus
cgcaccgccacgttcatttgtgcga

SEQ ID NO: 265075 - DNA, 25 bp, Mus musculus
gcctccagggcactggtgtctgcgt

SEQ ID NO: 265076 - DNA, 25 bp, Mus musculus
gtgagaggcccttccagtgtcactc

SEQ ID NO: 265077 - DNA, 25 bp, Mus musculus
tcccatcacgggtctctacaacaag

SEQ ID NO: 265078 - DNA, 25 bp, Mus musculus
acaccttcggcctgtggcctttgca

SEQ ID NO: 265079 - DNA, 25 bp, Mus musculus
caacctgcagcagcatcggcggcta

SEQ ID NO: 265080 - DNA, 25 bp, Mus musculus
gtggcaagcgctttacacagagctc

SEQ ID NO: 265081 - DNA, 25 bp, Mus musculus
taccaatgcctggactgtggcaagc

SEQ ID NO: 265082 - DNA, 25 bp, Mus musculus
gagtgcgtccctaccaatgcctgga

SEQ ID NO: 265083 - DNA, 25 bp, Mus musculus
cagctgacccacacaggagtgcgtc

SEQ ID NO: 265084 - DNA, 25 bp, Mus musculus
tccagtgtcactcctgcggcaagac

SEQ ID NO: 265085 - DNA, 25 bp, Mus musculus
accatctgcggacacacacgggtga

SEQ ID NO: 265086 - DNA, 25 bp, Mus musculus
gctcgtccatgtgcgcaaccatctg

SEQ ID NO: 265087 - DNA, 25 bp, Mus musculus
gggcttcaagaagctcgtccatgtg

SEQ ID NO: 265088 - DNA, 25 bp, Mus musculus
ccctgaacgccgacacaggtgtggg

SEQ ID NO: 265089 - DNA, 25 bp, Mus musculus
gcggcaagaccttcgcttctttagc

SEQ ID NO: 265090 - DNA, 25 bp, Mus musculus
gccgggagatgaagtccctctgccg

SEQ ID NO: 265091 - DNA, 25 bp, Mus musculus
cgggagatgaagtccctctgccgtc

SEQ ID NO: 265092 - DNA, 25 bp, Mus musculus
gttctcaaaccctcagagtagctga

SEQ ID NO: 265093 - DNA, 25 bp, Mus musculus
ggagttctcaaaccctcagagtagc

SEQ ID NO: 265094 - DNA, 25 bp, Mus musculus
cccgcacagcactctgggaaatgga

SEQ ID NO: 265095 - DNA, 25 bp, Mus musculus
gacccgcacagcactctgggaaatg

SEQ ID NO: 265096 - DNA, 25 bp, Mus musculus
tcgacccgcacagcactctgggaaa

SEQ ID NO: 265097 - DNA, 25 bp, Mus musculus
tcggcttcgttgtcaccaccctcga

SEQ ID NO: 265098 - DNA, 25 bp, Mus musculus
tctgccgtcggcttcgttgtcacca

SEQ ID NO: 265099 - DNA, 25 bp, Mus musculus
gtccctctgccgtcggcttcgttgt

SEQ ID NO: 265100 - DNA, 25 bp, Mus musculus
atgaagtccctctgccgtcggcttc

SEQ ID NO: 265101 - DNA, 25 bp, Mus musculus
agatgaagtccctctgccgtcggct

SEQ ID NO: 265102 - DNA, 25 bp, Mus musculus
ctcaaaccctcagagtagctgactg

SEQ ID NO: 265103 - DNA, 25 bp, Mus musculus
tcgttgtcaccaccctcgacccgca

SEQ ID NO: 265104 - DNA, 25 bp, Mus musculus
gtcctttctattggttactgtcgca

SEQ ID NO: 265105 - DNA, 25 bp, Mus musculus
tagcagcgggactcggtcctttcta

SEQ ID NO: 265106 - DNA, 25 bp, Mus musculus
agcgctctgagagtaggagaacgta

SEQ ID NO: 265107 - DNA, 25 bp, Mus musculus
gtggaaaatctcgtgagcgctctga

SEQ ID NO: 265108 - DNA, 25 bp, Mus musculus
agccaggcggctagtggaaaatctc

SEQ ID NO: 265109 - DNA, 25 bp, Mus musculus
cgattggcagaggtccggtacctca

SEQ ID NO: 265110 - DNA, 25 bp, Mus musculus
tttgtggacacagacagaccgcgcc

SEQ ID NO: 265111 - DNA, 25 bp, Mus musculus
aaaacggtgcacctggggctttgtg

SEQ ID NO: 265112 - DNA, 25 bp, Mus musculus
ccaagcccgttgctcgcaaaaaaga

SEQ ID NO: 265113 - DNA, 25 bp, Mus musculus
gcggttgcggcatctcctgaaagca

SEQ ID NO: 265114 - DNA, 25 bp, Mus musculus
tggagtcttgacaggcttgggttca

SEQ ID NO: 265115 - DNA, 25 bp, Mus musculus
tttcggctgaaaaactggagtcttg

SEQ ID NO: 265116 - DNA, 25 bp, Mus musculus
caaactcgtctgcacctatgggtgc

SEQ ID NO: 265117 - DNA, 25 bp, Mus musculus
acaaagcggctttgtagggcctgtc

SEQ ID NO: 265118 - DNA, 25 bp, Mus musculus
gactgctcggtactgcccggctatc

SEQ ID NO: 265119 - DNA, 25 bp, Mus musculus
tggcggacgctcttccagcaagcag

SEQ ID NO: 265120 - DNA, 25 bp, Mus musculus
cttgacctggatccctaactctgtg

SEQ ID NO: 265121 - DNA, 25 bp, Mus musculus
tccagcaagcagacggtcagacggc

SEQ ID NO: 265122 - DNA, 25 bp, Mus musculus
gccactctgcactagggcatccaga

SEQ ID NO: 265123 - DNA, 25 bp, Mus musculus
agtctcaattggtcccgcctgtctg

SEQ ID NO: 265124 - DNA, 25 bp, Mus musculus
cgcctgtctggatatcctagttctg

SEQ ID NO: 265125 - DNA, 25 bp, Mus musculus
aatccgtcagactgagcgccgcggc

SEQ ID NO: 265126 - DNA, 25 bp, Mus musculus
taactctgtgcacactggcggacgc

SEQ ID NO: 265127 - DNA, 25 bp, Mus musculus
ctatccacggttccgcggtcgttct

SEQ ID NO: 265128 - DNA, 25 bp, Mus musculus
ttcctccagctgtgaggcacgtcgc

SEQ ID NO: 265129 - DNA, 25 bp, Mus musculus
ttctctcccgcctggtgtgtgcagc

SEQ ID NO: 265130 - DNA, 25 bp, Mus musculus
tgattggctggcctaagaatccgtc

SEQ ID NO: 265131 - DNA, 25 bp, Mus musculus
ggagacggtcctagcttgacctgga

SEQ ID NO: 265132 - DNA, 25 bp, Mus musculus
gcttggagccaaccgtagtccgccc

SEQ ID NO: 265133 - DNA, 25 bp, Mus musculus
cacaccgtgagtgagcgtgttcctc

SEQ ID NO: 265134 - DNA, 25 bp, Mus musculus
gccaggccggccacaccgtgagtga

SEQ ID NO: 265135 - DNA, 25 bp, Mus musculus
ttcagcaagaccctgtgcgccaggc

SEQ ID NO: 265136 - DNA, 25 bp, Mus musculus
ttggtcctttcagcaagaccctgtg

SEQ ID NO: 265137 - DNA, 25 bp, Mus musculus
cgtcaccgttggtcctttcagcaag

SEQ ID NO: 265138 - DNA, 25 bp, Mus musculus
gttcctcgcgcgcactggacatagc

SEQ ID NO: 265139 - DNA, 25 bp, Mus musculus
gcactggacatagcacgacactcaa

SEQ ID NO: 265140 - DNA, 25 bp, Mus musculus
tggacatagcacgacactcaacttc

SEQ ID NO: 265141 - DNA, 25 bp, Mus musculus
ctggcttgctgcctttgctgcagtg

SEQ ID NO: 265142 - DNA, 25 bp, Mus musculus
cccgtccctatttgcatatgactga

SEQ ID NO: 265143 - DNA, 25 bp, Mus musculus
ctatttgcatatgactgacgttccc

SEQ ID NO: 265144 - DNA, 25 bp, Mus musculus
agtgagcgtgttcctcgcgcgcact

SEQ ID NO: 265145 - DNA, 25 bp, Mus musculus
gacactcaacttcgggcctctgcag

SEQ ID NO: 265146 - DNA, 25 bp, Mus musculus
ggttcccgctgctccggaccatgta

SEQ ID NO: 265147 - DNA, 25 bp, Mus musculus
ccaaggagcgggttacgggcagagc

SEQ ID NO: 265148 - DNA, 25 bp, Mus musculus
gcagagcggtgtcggccgctgagga

SEQ ID NO: 265149 - DNA, 25 bp, Mus musculus
ccgctgaggaggtgcgatcccctgt

SEQ ID NO: 265150 - DNA, 25 bp, Mus musculus
cggaccatgtactcggcccacaggc

SEQ ID NO: 265151 - DNA, 25 bp, Mus musculus
gcggcctctcgtggcctcggcatgt

SEQ ID NO: 265152 - DNA, 25 bp, Mus musculus
cctcggcatgttcggtcagtagcgt

SEQ ID NO: 265153 - DNA, 25 bp, Mus musculus
tcggcatgttcggtcagtagcgtct

SEQ ID NO: 265154 - DNA, 25 bp, Mus musculus
gcatgttcggtcagtagcgtctggc

SEQ ID NO: 265155 - DNA, 25 bp, Mus musculus
tgttcggtcagtagcgtctggcgct

SEQ ID NO: 265156 - DNA, 25 bp, Mus musculus
gctgggactgcaggggtcaatgtgt

SEQ ID NO: 265157 - DNA, 25 bp, Mus musculus
tcaatgtgtcggggtgctaagcgcc

SEQ ID NO: 265158 - DNA, 25 bp, Mus musculus
ggcggggacgactctcgctgacctc

SEQ ID NO: 265159 - DNA, 25 bp, Mus musculus
atacccgcgtctggcgcggcctctc

SEQ ID NO: 265160 - DNA, 25 bp, Mus musculus
gagtccgcccgggaaagctccgcga

SEQ ID NO: 265161 - DNA, 25 bp, Mus musculus
aaagtgggctcgtctgccgcttccc

SEQ ID NO: 265162 - DNA, 25 bp, Mus musculus
ggtcactcaccagagacatccagcg

SEQ ID NO: 265163 - DNA, 25 bp, Mus musculus
catccagcgcccgtcaccctgcacg

SEQ ID NO: 265164 - DNA, 25 bp, Mus musculus
accctgcacgtcttgcacaggcgtg

SEQ ID NO: 265165 - DNA, 25 bp, Mus musculus
cacgtcttgcacaggcgtgggcttg

SEQ ID NO: 265166 - DNA, 25 bp, Mus musculus
tccgcgaggacgtggatccgccacg

SEQ ID NO: 265167 - DNA, 25 bp, Mus musculus
gggccaacacaatggaccgtcctgc

SEQ ID NO: 265168 - DNA, 25 bp, Mus musculus
gccgcctcctttcgcagactagaaa

SEQ ID NO: 265169 - DNA, 25 bp, Mus musculus
aggccgcaaagtgggctcgtctgcc

SEQ ID NO: 265170 - DNA, 25 bp, Mus musculus
cacgtaggaaggaatcctcgctccc

SEQ ID NO: 265171 - DNA, 25 bp, Mus musculus
accgtcacgtaggaaggaatcctcg

SEQ ID NO: 265172 - DNA, 25 bp, Mus musculus
ttcgcagactagaaaccgtcacgta

SEQ ID NO: 265173 - DNA, 25 bp, Mus musculus
gaaagctccgcgaggacgtggatcc

SEQ ID NO: 265174 - DNA, 25 bp, Mus musculus
ggcaacctcagctccaaagaggtga

SEQ ID NO: 265175 - DNA, 25 bp, Mus musculus
tgcgtccagcggcccctttaatcgg

SEQ ID NO: 265176 - DNA, 25 bp, Mus musculus
tctcgcctccgtcaccgggccggag

SEQ ID NO: 265177 - DNA, 25 bp, Mus musculus
cagagcgggaggaatggagccctcc

SEQ ID NO: 265178 - DNA, 25 bp, Mus musculus
ggccaagtacgtgcggggcaacctc

SEQ ID NO: 265179 - DNA, 25 bp, Mus musculus
acgtgcggggcaacctcagctccaa

SEQ ID NO: 265180 - DNA, 25 bp, Mus musculus
cggggcaacctcagctccaaagagg

SEQ ID NO: 265181 - DNA, 25 bp, Mus musculus
cctcagctccaaagaggtgagcaca

SEQ ID NO: 265182 - DNA, 25 bp, Mus musculus
tcagctccaaagaggtgagcacacc

SEQ ID NO: 265183 - DNA, 25 bp, Mus musculus
agctccaaagaggtgagcacaccga

SEQ ID NO: 265184 - DNA, 25 bp, Mus musculus
ggtgagcacaccgagccatctccta

SEQ ID NO: 265185 - DNA, 25 bp, Mus musculus
gtgagcacaccgagccatctcctag

SEQ ID NO: 265186 - DNA, 25 bp, Mus musculus
atctcctagcgttccctggcccgcg

SEQ ID NO: 265187 - DNA, 25 bp, Mus musculus
tgcggggcaacctcagctccaaaga

SEQ ID NO: 265188 - DNA, 25 bp, Mus musculus
gaatttctgccgtgacctctgtcca

SEQ ID NO: 265189 - DNA, 25 bp, Mus musculus
cagcagtacgcagagccggcttctt

SEQ ID NO: 265190 - DNA, 25 bp, Mus musculus
gttgatctccaactgtgacgccagg

SEQ ID NO: 265191 - DNA, 25 bp, Mus musculus
tggacccagcctccggttgcgtaac

SEQ ID NO: 265192 - DNA, 25 bp, Mus musculus
ccctctaggaagaagcggcagaccg

SEQ ID NO: 265193 - DNA, 25 bp, Mus musculus
tccatgggccttcacgcactaagcg

SEQ ID NO: 265194 - DNA, 25 bp, Mus musculus
cgccgtccagcgcatcaaggatagt

SEQ ID NO: 265195 - DNA, 25 bp, Mus musculus
cggatgacgtcagcagcagtacgca

SEQ ID NO: 265196 - DNA, 25 bp, Mus musculus
gcgcagaatggctcttcctgcactc

SEQ ID NO: 265197 - DNA, 25 bp, Mus musculus
cactcccaggaagcggtcggtgtag

SEQ ID NO: 265198 - DNA, 25 bp, Mus musculus
tgtagcccaccgaaaagtcagcagg

SEQ ID NO: 265199 - DNA, 25 bp, Mus musculus
tcgtcccagcagaaggcgcagaatg

SEQ ID NO: 265200 - DNA, 25 bp, Mus musculus
aagcggtctctgtctgcagcgttga

SEQ ID NO: 265201 - DNA, 25 bp, Mus musculus
gcccgatccaaaaatgaggtcagta

SEQ ID NO: 265202 - DNA, 25 bp, Mus musculus
acttgcggcgccattgtaacatcca

SEQ ID NO: 265203 - DNA, 25 bp, Mus musculus
agaacccaaccgctgtgggacgacg

SEQ ID NO: 265204 - DNA, 25 bp, Mus musculus
tgtccctcatgtagggtgcgcttca

SEQ ID NO: 265205 - DNA, 25 bp, Mus musculus
tggtgagcgaccttaccaatgtccc

SEQ ID NO: 265206 - DNA, 25 bp, Mus musculus
ggcaggggagctcgcacatcaccac

SEQ ID NO: 265207 - DNA, 25 bp, Mus musculus
acccagagcttgtggggatgcctgt

SEQ ID NO: 265208 - DNA, 25 bp, Mus musculus
tccggcgccattacaaacgcaaaca

SEQ ID NO: 265209 - DNA, 25 bp, Mus musculus
tgccctcgccgtttccgagaggcag

SEQ ID NO: 265210 - DNA, 25 bp, Mus musculus
gtaacatccatgctggccttaggcc

SEQ ID NO: 265211 - DNA, 25 bp, Mus musculus
gtgcgcttcaccgaggccaatactc

SEQ ID NO: 265212 - DNA, 25 bp, Mus musculus
ttcaaacggtccagccacttgcggc

SEQ ID NO: 265213 - DNA, 25 bp, Mus musculus
cgtgtgcaaagattgcggcaagacc

SEQ ID NO: 265214 - DNA, 25 bp, Mus musculus
aggccaatactctccggcgccatta

SEQ ID NO: 265215 - DNA, 25 bp, Mus musculus
gccttaggcccttccgttgtgtgct

SEQ ID NO: 265216 - DNA, 25 bp, Mus musculus
tcttgtgccaaacggtcccgcggga

SEQ ID NO: 265217 - DNA, 25 bp, Mus musculus
gtgaccatggccgaacccggcgcag

SEQ ID NO: 265218 - DNA, 25 bp, Mus musculus
ccgtgtggtgaccatggccgaaccc

SEQ ID NO: 265219 - DNA, 25 bp, Mus musculus
tgccagactgggtcctggcgctgtt

SEQ ID NO: 265220 - DNA, 25 bp, Mus musculus
actccttccctgattgacaagtgcg

SEQ ID NO: 265221 - DNA, 25 bp, Mus musculus
tccctgattgacaagtgcgtccata

SEQ ID NO: 265222 - DNA, 25 bp, Mus musculus
ccgctcggttctccaaggcggtcga

SEQ ID NO: 265223 - DNA, 25 bp, Mus musculus
gttctgggcagcctctgaccctgac

SEQ ID NO: 265224 - DNA, 25 bp, Mus musculus
gcgcccactttggatgcgctgcgtc

SEQ ID NO: 265225 - DNA, 25 bp, Mus musculus
aagggctcggccatgccaggcatcc

SEQ ID NO: 265226 - DNA, 25 bp, Mus musculus
tacttcagcatgcacacagccgggg

SEQ ID NO: 265227 - DNA, 25 bp, Mus musculus
ttctccaaggcggtcgactcgggct

SEQ ID NO: 265228 - DNA, 25 bp, Mus musculus
accggcttcaccgaatacttcagca

SEQ ID NO: 265229 - DNA, 25 bp, Mus musculus
caagtgcgtccatatttggggtggt

SEQ ID NO: 265230 - DNA, 25 bp, Mus musculus
tgaattcctattctcgctgcgcaag

SEQ ID NO: 265231 - DNA, 25 bp, Mus musculus
tgatctagcccattcgcctcgagtg

SEQ ID NO: 265232 - DNA, 25 bp, Mus musculus
ggtctctctgatctagcccattcgc

SEQ ID NO: 265233 - DNA, 25 bp, Mus musculus
ggagtctccaggtctctctgatcta

SEQ ID NO: 265234 - DNA, 25 bp, Mus musculus
ctctggcccgggagtctccaggtct

SEQ ID NO: 265235 - DNA, 25 bp, Mus musculus
agcgggtcttcctcgggccgctctg

SEQ ID NO: 265236 - DNA, 25 bp, Mus musculus
cctattctcgctgcgcaagcgactg

SEQ ID NO: 265237 - DNA, 25 bp, Mus musculus
gcattagagtgagccctggagatcc

SEQ ID NO: 265238 - DNA, 25 bp, Mus musculus
tctctgagctgaattcctattctcg

SEQ ID NO: 265239 - DNA, 25 bp, Mus musculus
acgcatgcgtaattctctgagctga

SEQ ID NO: 265240 - DNA, 25 bp, Mus musculus
acactcttagcaatacgcatgcgta

SEQ ID NO: 265241 - DNA, 25 bp, Mus musculus
tgggttacactcttagcaatacgca

SEQ ID NO: 265242 - DNA, 25 bp, Mus musculus
cgcgattttgggttacactcttagc

SEQ ID NO: 265243 - DNA, 25 bp, Mus musculus
ttaatcctctcaggccgctctgacc

SEQ ID NO: 265244 - DNA, 25 bp, Mus musculus
ggcctgctgtgtttgcccccgagga

SEQ ID NO: 265245 - DNA, 25 bp, Mus musculus
cagaacggtcaggtcccgggcctgc

SEQ ID NO: 265246 - DNA, 25 bp, Mus musculus
gccgcacagacctggacagggcaga

SEQ ID NO: 265247 - DNA, 25 bp, Mus musculus
aagtgccgcacagacctggacaggg

SEQ ID NO: 265248 - DNA, 25 bp, Mus musculus
cgaaagtgccgcacagacctggaca

SEQ ID NO: 265249 - DNA, 25 bp, Mus musculus
cacagcggggcgaaagtgccgcaca

SEQ ID NO: 265250 - DNA, 25 bp, Mus musculus
aagtcatcggagatgcggcaggcca

SEQ ID NO: 265251 - DNA, 25 bp, Mus musculus
cggggcgaaagtgccgcacagacct

SEQ ID NO: 265252 - DNA, 25 bp, Mus musculus
atgtggtagcgctccctcatgccgg

SEQ ID NO: 265253 - DNA, 25 bp, Mus musculus
cctcatgccggtgcgcagagagtgc

SEQ ID NO: 265254 - DNA, 25 bp, Mus musculus
tccctcatgccggtgcgcagagagt

SEQ ID NO: 265255 - DNA, 25 bp, Mus musculus
ccaaagtcatcggagatgcggcagg

SEQ ID NO: 265256 - DNA, 25 bp, Mus musculus
acctggatgtggtagcgctccctca

SEQ ID NO: 265257 - DNA, 25 bp, Mus musculus
cgcgcacctggatgtggtagcgctc

SEQ ID NO: 265258 - DNA, 25 bp, Mus musculus
tcacattgagggtcccgagcgcatt

SEQ ID NO: 265259 - DNA, 25 bp, Mus musculus
tccctcaagcgaggggaaacgaatc

SEQ ID NO: 265260 - DNA, 25 bp, Mus musculus
agaggtggatgacactgggccgaat

SEQ ID NO: 265261 - DNA, 25 bp, Mus musculus
acgaatcacattgagggtcccgagc

SEQ ID NO: 265262 - DNA, 25 bp, Mus musculus
acacctccctaaggcgcagggcgag

SEQ ID NO: 265263 - DNA, 25 bp, Mus musculus
tcccgagcgcattcctggacattgg

SEQ ID NO: 265264 - DNA, 25 bp, Mus musculus
cgcattcctggacattgggtcttga

SEQ ID NO: 265265 - DNA, 25 bp, Mus musculus
acattgggtcttgatcccgggagct

SEQ ID NO: 265266 - DNA, 25 bp, Mus musculus
aggcttggacaaggcgacggcatgc

SEQ ID NO: 265267 - DNA, 25 bp, Mus musculus
gctccacccgcgcttccctgtgcgg

SEQ ID NO: 265268 - DNA, 25 bp, Mus musculus
taacgcgcggtcaggagacacacct

SEQ ID NO: 265269 - DNA, 25 bp, Mus musculus
aggagacacacctgcgctgcggaca

SEQ ID NO: 265270 - DNA, 25 bp, Mus musculus
acacacctgcgctgcggacaagggc

SEQ ID NO: 265271 - DNA, 25 bp, Mus musculus
agcgaggggaaacgaatcacattga

SEQ ID NO: 265272 - DNA, 25 bp, Mus musculus
gctcaggaagccatgcggcagatct

SEQ ID NO: 265273 - DNA, 25 bp, Mus musculus
gagcccatctcggagcgcactcata

SEQ ID NO: 265274 - DNA, 25 bp, Mus musculus
tcggagcgcactcataacggaagcc

SEQ ID NO: 265275 - DNA, 25 bp, Mus musculus
ctcataacggaagcccgcgcagatg

SEQ ID NO: 265276 - DNA, 25 bp, Mus musculus
cgcagatgggagcaagaggtctttt

SEQ ID NO: 265277 - DNA, 25 bp, Mus musculus
agcaagaggtcttttagtgccgccc

SEQ ID NO: 265278 - DNA, 25 bp, Mus musculus
cccagctcagttcagtggtgcagca

SEQ ID NO: 265279 - DNA, 25 bp, Mus musculus
aggatcagccggatgcgctgcacgc

SEQ ID NO: 265280 - DNA, 25 bp, Mus musculus
tgcgctgcacgcagaactccgtggc

SEQ ID NO: 265281 - DNA, 25 bp, Mus musculus
acgcagaactccgtggcctgccggg

SEQ ID NO: 265282 - DNA, 25 bp, Mus musculus
gcctgccgggtctcgcgacacagtg

SEQ ID NO: 265283 - DNA, 25 bp, Mus musculus
ggcagatcttctaccactttcagcg

SEQ ID NO: 265284 - DNA, 25 bp, Mus musculus
aggtcgcgcagtcgccgcgcgaaca

SEQ ID NO: 265285 - DNA, 25 bp, Mus musculus
acacagtgccgccaggctcaggaag

SEQ ID NO: 265286 - DNA, 25 bp, Mus musculus
tcgatccttctttgccctgcttgga

SEQ ID NO: 265287 - DNA, 25 bp, Mus musculus
agtccttacgtctcggtggggcatt

SEQ ID NO: 265288 - DNA, 25 bp, Mus musculus
tggggcattctactctcacatcacc

SEQ ID NO: 265289 - DNA, 25 bp, Mus musculus
tggatcagtccacgggtctcttccc

SEQ ID NO: 265290 - DNA, 25 bp, Mus musculus
tgcgactgcggttcttcgatccttc

SEQ ID NO: 265291 - DNA, 25 bp, Mus musculus
tcatcttgtgcaggtgctgaccctc

SEQ ID NO: 265292 - DNA, 25 bp, Mus musculus
ggccggctccatcaattctttccag

SEQ ID NO: 265293 - DNA, 25 bp, Mus musculus
ccagcgatcaagttcctctcttaga

SEQ ID NO: 265294 - DNA, 25 bp, Mus musculus
ctccgcctttaatgggtggggctga

SEQ ID NO: 265295 - DNA, 25 bp, Mus musculus
ccgcgcagtgcaccgtaacgacaaa

SEQ ID NO: 265296 - DNA, 25 bp, Mus musculus
gagaagtgccctcacagcaggaata

SEQ ID NO: 265297 - DNA, 25 bp, Mus musculus
cgcactgggacagacgtagtcctta

SEQ ID NO: 265298 - DNA, 25 bp, Mus musculus
tctgctcagattaaaggaaccgcgc

SEQ ID NO: 265299 - DNA, 25 bp, Mus musculus
agctgttaccgactcacctttgatc

SEQ ID NO: 265300 - DNA, 25 bp, Mus musculus
tgggactggaccaggcagaagagca

SEQ ID NO: 265301 - DNA, 25 bp, Mus musculus
gaccaggcagaagagcatccgccgc

SEQ ID NO: 265302 - DNA, 25 bp, Mus musculus
caggcagaagagcatccgccgcgca

SEQ ID NO: 265303 - DNA, 25 bp, Mus musculus
aggcagaagagcatccgccgcgcag

SEQ ID NO: 265304 - DNA, 25 bp, Mus musculus
gcagaagagcatccgccgcgcagga

SEQ ID NO: 265305 - DNA, 25 bp, Mus musculus
gagcatccgccgcgcaggagaactt

SEQ ID NO: 265306 - DNA, 25 bp, Mus musculus
ccctgctaggcgagcgcttcggggc

SEQ ID NO: 265307 - DNA, 25 bp, Mus musculus
cgggctcacatagacagcaccagga

SEQ ID NO: 265308 - DNA, 25 bp, Mus musculus
gcgggctcacatagacagcaccagg

SEQ ID NO: 265309 - DNA, 25 bp, Mus musculus
cggcgggctcacatagacagcacca

SEQ ID NO: 265310 - DNA, 25 bp, Mus musculus
gccggcgggctcacatagacagcac

SEQ ID NO: 265311 - DNA, 25 bp, Mus musculus
agccggcgggctcacatagacagca

SEQ ID NO: 265312 - DNA, 25 bp, Mus musculus
gcagccggcgggctcacatagacag

SEQ ID NO: 265313 - DNA, 25 bp, Mus musculus
agctttgctcagcgcccgacgcgga

SEQ ID NO: 265314 - DNA, 25 bp, Mus musculus
gatcctttacaggaaagaccgtctc

SEQ ID NO: 265315 - DNA, 25 bp, Mus musculus
cttctgtttacgttacctggcaaga

SEQ ID NO: 265316 - DNA, 25 bp, Mus musculus
cgccgcggaatgtcacgcgtgtata

SEQ ID NO: 265317 - DNA, 25 bp, Mus musculus
tcagtcgtactgattctgctgtaga

SEQ ID NO: 265318 - DNA, 25 bp, Mus musculus
gtctgcggaaacagagcgtctcctg

SEQ ID NO: 265319 - DNA, 25 bp, Mus musculus
tcagcctcctgggaaacaaaagtct

SEQ ID NO: 265320 - DNA, 25 bp, Mus musculus
cgcgtcccggaactatggttcactt

SEQ ID NO: 265321 - DNA, 25 bp, Mus musculus
cgagggccacagagagtctcgagtc

SEQ ID NO: 265322 - DNA, 25 bp, Mus musculus
agggaacgtcctgcctcttctgttt

SEQ ID NO: 265323 - DNA, 25 bp, Mus musculus
tctgaaccacgtgttaggagggaac

SEQ ID NO: 265324 - DNA, 25 bp, Mus musculus
acacgcgtggcccttggtgtctgaa

SEQ ID NO: 265325 - DNA, 25 bp, Mus musculus
ctgctgtagagatatcgggtgtaaa

SEQ ID NO: 265326 - DNA, 25 bp, Mus musculus
cgcgtgtatacgcacaataacaata

SEQ ID NO: 265327 - DNA, 25 bp, Mus musculus
gttcactttgtagctcggttctcga

SEQ ID NO: 265328 - DNA, 25 bp, Mus musculus
tctttgctcgttgggacctccctca

SEQ ID NO: 265329 - DNA, 25 bp, Mus musculus
acagcttgaggacgcacagctgcga

SEQ ID NO: 265330 - DNA, 25 bp, Mus musculus
cctccagacttgcagcgcgggctgg

SEQ ID NO: 265331 - DNA, 25 bp, Mus musculus
ccagggcgcgtctccctgtctgcct

SEQ ID NO: 265332 - DNA, 25 bp, Mus musculus
agaaaaccagccctaactcgccagg

SEQ ID NO: 265333 - DNA, 25 bp, Mus musculus
cccgccgtctcaccagaaaaccagc

SEQ ID NO: 265334 - DNA, 25 bp, Mus musculus
gctcgttgggacctccctcacaggt

SEQ ID NO: 265335 - DNA, 25 bp, Mus musculus
tctcttctctttgctcgttgggacc

SEQ ID NO: 265336 - DNA, 25 bp, Mus musculus
ggtggcctcgaactagccccttggc

SEQ ID NO: 265337 - DNA, 25 bp, Mus musculus
agcacagtcacgacgctttcaggcg

SEQ ID NO: 265338 - DNA, 25 bp, Mus musculus
tcgcagcacagtcacgacgctttca

SEQ ID NO: 265339 - DNA, 25 bp, Mus musculus
ctgggccgacagcttgaggacgcac

SEQ ID NO: 265340 - DNA, 25 bp, Mus musculus
tccctcacaggtccgcggctttggc

SEQ ID NO: 265341 - DNA, 25 bp, Mus musculus
tcacgacgctttcaggcggtggcct

SEQ ID NO: 265342 - DNA, 25 bp, Mus musculus
gccaactcgggcgtgccctagacgg

SEQ ID NO: 265343 - DNA, 25 bp, Mus musculus
gctgagccacgtgctagggccaact

SEQ ID NO: 265344 - DNA, 25 bp, Mus musculus
atgcgcaataggtacgcggccggta

SEQ ID NO: 265345 - DNA, 25 bp, Mus musculus
tgcgcgcgccgctaagcggaagcta

SEQ ID NO: 265346 - DNA, 25 bp, Mus musculus
ggcgcaaagcgtgcagacgccaatt

SEQ ID NO: 265347 - DNA, 25 bp, Mus musculus
gacgccaatttactcactgacaccg

SEQ ID NO: 265348 - DNA, 25 bp, Mus musculus
actgacaccggaacagagtccagcc

SEQ ID NO: 265349 - DNA, 25 bp, Mus musculus
gaagtccagtctgcagtctccggca

SEQ ID NO: 265350 - DNA, 25 bp, Mus musculus
gtctccggcactttgcttgtgagca

SEQ ID NO: 265351 - DNA, 25 bp, Mus musculus
agcaaaacctgctgtcccggccgga

SEQ ID NO: 265352 - DNA, 25 bp, Mus musculus
gccggatggatctgcttcttttctt

SEQ ID NO: 265353 - DNA, 25 bp, Mus musculus
caagtttaactcagcgcgcgccatc

SEQ ID NO: 265354 - DNA, 25 bp, Mus musculus
gcgccatcctcaccgaagaagggtt

SEQ ID NO: 265355 - DNA, 25 bp, Mus musculus
ttttcttcaaggtacgagcctcacc

SEQ ID NO: 265356 - DNA, 25 bp, Mus musculus
caccatcctccacgccggcgcttgg

SEQ ID NO: 265357 - DNA, 25 bp, Mus musculus
tctagtgccggcgtaatttccctta

SEQ ID NO: 265358 - DNA, 25 bp, Mus musculus
cccgtgtctagtgccggcgtaattt

SEQ ID NO: 265359 - DNA, 25 bp, Mus musculus
ttggctgttcccctcccgtgtctag

SEQ ID NO: 265360 - DNA, 25 bp, Mus musculus
cgcaatgggcgcatgcgcactaggc

SEQ ID NO: 265361 - DNA, 25 bp, Mus musculus
gccctaagaagaagcgggcgcaatg

SEQ ID NO: 265362 - DNA, 25 bp, Mus musculus
tctagggtgcgtcctaaccggaagc

SEQ ID NO: 265363 - DNA, 25 bp, Mus musculus
gacccgagtctagggtgcgtcctaa

SEQ ID NO: 265364 - DNA, 25 bp, Mus musculus
aggctttggcttgagacccgagtct

SEQ ID NO: 265365 - DNA, 25 bp, Mus musculus
gaagcgaggctttggcttgagaccc

SEQ ID NO: 265366 - DNA, 25 bp, Mus musculus
ggtccagcctaggaagcgaggcttt

SEQ ID NO: 265367 - DNA, 25 bp, Mus musculus
tcagagatgggcgtggtccagccta

SEQ ID NO: 265368 - DNA, 25 bp, Mus musculus
tataacgggacgttcagagatgggc

SEQ ID NO: 265369 - DNA, 25 bp, Mus musculus
ggcctataacgggacgttcagagat

SEQ ID NO: 265370 - DNA, 25 bp, Mus musculus
accaatcatcagcacgcagggcggg

SEQ ID NO: 265371 - DNA, 25 bp, Mus musculus
agacgcatgcgccttttgaagcttg

SEQ ID NO: 265372 - DNA, 25 bp, Mus musculus
atgcaattctcgcaaaaaagtcccg

SEQ ID NO: 265373 - DNA, 25 bp, Mus musculus
aagcggccctacacccgagacgaga

SEQ ID NO: 265374 - DNA, 25 bp, Mus musculus
aaagtcccgaatgaccgcgtccatc

SEQ ID NO: 265375 - DNA, 25 bp, Mus musculus
gagggcagctatagcaccaatcatc

SEQ ID NO: 265376 - DNA, 25 bp, Mus musculus
gcgtcgcaggagcaagacctatgca

SEQ ID NO: 265377 - DNA, 25 bp, Mus musculus
cggcgcccgcaaagaagcccgtgaa

SEQ ID NO: 265378 - DNA, 25 bp, Mus musculus
atgacgcatgcgctacgcctacggg

SEQ ID NO: 265379 - DNA, 25 bp, Mus musculus
agactagtctcgacggcgcccgcaa

SEQ ID NO: 265380 - DNA, 25 bp, Mus musculus
tgaagcttggctgatctgccgcgaa

SEQ ID NO: 265381 - DNA, 25 bp, Mus musculus
aggctgcggatctatctacctcaga

SEQ ID NO: 265382 - DNA, 25 bp, Mus musculus
tctaacggtcaagtacgcggaggta

SEQ ID NO: 265383 - DNA, 25 bp, Mus musculus
gaggcagctttcacttctaacggtc

SEQ ID NO: 265384 - DNA, 25 bp, Mus musculus
tccctcggacctgctggcagtagct

SEQ ID NO: 265385 - DNA, 25 bp, Mus musculus
ttttgagacttttccgctgctactg

SEQ ID NO: 265386 - DNA, 25 bp, Mus musculus
gctgctactgcaagtcagagacgtg

SEQ ID NO: 265387 - DNA, 25 bp, Mus musculus
acttcttggcactgcgctgtctcgc

SEQ ID NO: 265388 - DNA, 25 bp, Mus musculus
gctgtctcgcaaggaggcaggacct

SEQ ID NO: 265389 - DNA, 25 bp, Mus musculus
gaaacggaagcgcatcgaagccatc

SEQ ID NO: 265390 - DNA, 25 bp, Mus musculus
tgctcaccgtcgtggacactcgatc

SEQ ID NO: 265391 - DNA, 25 bp, Mus musculus
acccacttttggatctcagagagcg

SEQ ID NO: 265392 - DNA, 25 bp, Mus musculus
cagagagcgctcatctcgattttta

SEQ ID NO: 265393 - DNA, 25 bp, Mus musculus
ttaccctggtggtatactgagacac

SEQ ID NO: 265394 - DNA, 25 bp, Mus musculus
tggtgtcagagcctcaccgcgactc

SEQ ID NO: 265395 - DNA, 25 bp, Mus musculus
gactatcacctacctttccttggga

SEQ ID NO: 265396 - DNA, 25 bp, Mus musculus
actcccgtggcttctagtgctgacg

SEQ ID NO: 265397 - DNA, 25 bp, Mus musculus
gacctgaggactccagacagccctg

SEQ ID NO: 265398 - DNA, 25 bp, Mus musculus
gacaggctgtaaccccaaggtccca

SEQ ID NO: 265399 - DNA, 25 bp, Mus musculus
cgaatcggtaaggatgaggaagccc

SEQ ID NO: 265400 - DNA, 25 bp, Mus musculus
cgggacccaagcgtcgtgtgtgacc

SEQ ID NO: 265401 - DNA, 25 bp, Mus musculus
tgtaggcgcccacgcgggacccaag

SEQ ID NO: 265402 - DNA, 25 bp, Mus musculus
ggctgttagtctcccgccctcctca

SEQ ID NO: 265403 - DNA, 25 bp, Mus musculus
gccctccctaggctgttagtctccc

SEQ ID NO: 265404 - DNA, 25 bp, Mus musculus
agacgaggcaggtccggatcccgcc

SEQ ID NO: 265405 - DNA, 25 bp, Mus musculus
acccagcgtccggtcgccacgccct

SEQ ID NO: 265406 - DNA, 25 bp, Mus musculus
ggagacagagatcgcgcgcggagcc

SEQ ID NO: 265407 - DNA, 25 bp, Mus musculus
tcccagttcctcctaccggaggctg

SEQ ID NO: 265408 - DNA, 25 bp, Mus musculus
actgaacgctgacaggctgtaaccc

SEQ ID NO: 265409 - DNA, 25 bp, Mus musculus
gtaaggatgaggaagcccccacgtg

SEQ ID NO: 265410 - DNA, 25 bp, Mus musculus
cggaactgaacgctgacaggctgta

SEQ ID NO: 265411 - DNA, 25 bp, Mus musculus
cccacggaactgaacgctgacaggc

SEQ ID NO: 265412 - DNA, 25 bp, Mus musculus
ggtgccctgacagcacacggcctga

SEQ ID NO: 265413 - DNA, 25 bp, Mus musculus
cctgggcattccaggtgccctgaca

SEQ ID NO: 265414 - DNA, 25 bp, Mus musculus
tccgcaggcctagtccctgggcatt

SEQ ID NO: 265415 - DNA, 25 bp, Mus musculus
gagcagtggggaccactccttccca

SEQ ID NO: 265416 - DNA, 25 bp, Mus musculus
agcaggcagcgcctattgcgcacgc

SEQ ID NO: 265417 - DNA, 25 bp, Mus musculus
ccaggagtactacacggcgctcatc

SEQ ID NO: 265418 - DNA, 25 bp, Mus musculus
cggcgctcatcaacgtgacggtgca

SEQ ID NO: 265419 - DNA, 25 bp, Mus musculus
gacaacgcgagccaggagtactaca

SEQ ID NO: 265420 - DNA, 25 bp, Mus musculus
tcgtgcccggctcgtttcgaggcgc

SEQ ID NO: 265421 - DNA, 25 bp, Mus musculus
cctgagagatccacgggcgcgcact

SEQ ID NO: 265422 - DNA, 25 bp, Mus musculus
acttgcagcctgtggccgacgcgag

SEQ ID NO: 265423 - DNA, 25 bp, Mus musculus
gggctcgactcacccaaggccgagg

SEQ ID NO: 265424 - DNA, 25 bp, Mus musculus
cgacgcgagcggacaacgcgagcca

SEQ ID NO: 265425 - DNA, 25 bp, Mus musculus
ctggccctgctgacttgcagcctgt

SEQ ID NO: 265426 - DNA, 25 bp, Mus musculus
atttcctggtcacaccgcaagagca

SEQ ID NO: 265427 - DNA, 25 bp, Mus musculus
gcggtcagacttcctagagtcctca

SEQ ID NO: 265428 - DNA, 25 bp, Mus musculus
agcatcaaagttccgggtcaaaggc

SEQ ID NO: 265429 - DNA, 25 bp, Mus musculus
agcgcttgccggaaccatttcctgg

SEQ ID NO: 265430 - DNA, 25 bp, Mus musculus
gggccttctcttatgcgcatgcgta

SEQ ID NO: 265431 - DNA, 25 bp, Mus musculus
gagcctggcaaacgtctcaccatta

SEQ ID NO: 265432 - DNA, 25 bp, Mus musculus
gcctccataacaggtctcttcaaca

SEQ ID NO: 265433 - DNA, 25 bp, Mus musculus
ggtctcttcaacacagtaaccgcca

SEQ ID NO: 265434 - DNA, 25 bp, Mus musculus
agtaaccgccacagcgggctccgga

SEQ ID NO: 265435 - DNA, 25 bp, Mus musculus
gctggaccctaggtacccgcaggta

SEQ ID NO: 265436 - DNA, 25 bp, Mus musculus
ccgcaggtacttccggttacgcaag

SEQ ID NO: 265437 - DNA, 25 bp, Mus musculus
gcaagcgtctttatgcggcacccaa

SEQ ID NO: 265438 - DNA, 25 bp, Mus musculus
tgcggcacccaagcatcaaagttcc

SEQ ID NO: 265439 - DNA, 25 bp, Mus musculus
gagtcctcagcgcttgccggaacca

SEQ ID NO: 265440 - DNA, 25 bp, Mus musculus
tcctcgttgttgtgcccaggtaacc

SEQ ID NO: 265441 - DNA, 25 bp, Mus musculus
agttcgttcaccttcaggcgacgca

SEQ ID NO: 265442 - DNA, 25 bp, Mus musculus
acgagtctcaattggtcagcgcatg

SEQ ID NO: 265443 - DNA, 25 bp, Mus musculus
cgggaaccaagccaatcacagtgtg

SEQ ID NO: 265444 - DNA, 25 bp, Mus musculus
caaaagaacggtactagagggctca

SEQ ID NO: 265445 - DNA, 25 bp, Mus musculus
ctgcctaagaggaagcgttagccta

SEQ ID NO: 265446 - DNA, 25 bp, Mus musculus
agcctacgttgaagtcgcggccaga

SEQ ID NO: 265447 - DNA, 25 bp, Mus musculus
cgcccgctgcggtacagtcaaatga

SEQ ID NO: 265448 - DNA, 25 bp, Mus musculus
agggagtaacgacttggagccatta

SEQ ID NO: 265449 - DNA, 25 bp, Mus musculus
ccattagcagccagatctcagaaca

SEQ ID NO: 265450 - DNA, 25 bp, Mus musculus
gctgcagctcctcgcgaagttcgtt

SEQ ID NO: 265451 - DNA, 25 bp, Mus musculus
gaaggagattaattcaccgaggccc

SEQ ID NO: 265452 - DNA, 25 bp, Mus musculus
ctcgtctttcctgttgcctttcggg

SEQ ID NO: 265453 - DNA, 25 bp, Mus musculus
ccacaaccaatcaaatgcggcggga

SEQ ID NO: 265454 - DNA, 25 bp, Mus musculus
cgcacccttatttctctgtctctgg

SEQ ID NO: 265455 - DNA, 25 bp, Mus musculus
tgtacctcctagaagctccttgccg

SEQ ID NO: 265456 - DNA, 25 bp, Mus musculus
tcggctgggtctgtacctcctagaa

SEQ ID NO: 265457 - DNA, 25 bp, Mus musculus
tggctgcctccatctctgcaggtcg

SEQ ID NO: 265458 - DNA, 25 bp, Mus musculus
agcagcgcccaggtgctggctgcct

SEQ ID NO: 265459 - DNA, 25 bp, Mus musculus
tgtcgccagaagtctcacaccatcg

SEQ ID NO: 265460 - DNA, 25 bp, Mus musculus
ctgaatagcgtcagagacagcagca

SEQ ID NO: 265461 - DNA, 25 bp, Mus musculus
ccggggtcctgaatagcgtcagaga

SEQ ID NO: 265462 - DNA, 25 bp, Mus musculus
ccctggttaggatgtccttgcgtcc

SEQ ID NO: 265463 - DNA, 25 bp, Mus musculus
ggctccctcctcaacgaaatcaaga

SEQ ID NO: 265464 - DNA, 25 bp, Mus musculus
tctggcccgctgtcgccagaagtct

SEQ ID NO: 265465 - DNA, 25 bp, Mus musculus
ttatttctctgtctctggcccgctg

SEQ ID NO: 265466 - DNA, 25 bp, Mus musculus
tcaacgaaatcaagaggagtggggc

SEQ ID NO: 265467 - DNA, 25 bp, Mus musculus
tagaagctccttgccgccggactag

SEQ ID NO: 265468 - DNA, 25 bp, Mus musculus
tcgcctgggtggaagattacgagcc

SEQ ID NO: 265469 - DNA, 25 bp, Mus musculus
aatgccaccgcgcaacattcgcggg

SEQ ID NO: 265470 - DNA, 25 bp, Mus musculus
tgtgccctacgggaggaagcctact

SEQ ID NO: 265471 - DNA, 25 bp, Mus musculus
aggaagcctactggggcccgacaca

SEQ ID NO: 265472 - DNA, 25 bp, Mus musculus
cacacccagccggaagggaggtcct

SEQ ID NO: 265473 - DNA, 25 bp, Mus musculus
aggtcctgccagacggacggactga

SEQ ID NO: 265474 - DNA, 25 bp, Mus musculus
gagcagagtccgacccgactgcctt

SEQ ID NO: 265475 - DNA, 25 bp, Mus musculus
tgcgcgtgcgcgaaccgcacgttga

SEQ ID NO: 265476 - DNA, 25 bp, Mus musculus
accgcacgttgacaggaggcttaga

SEQ ID NO: 265477 - DNA, 25 bp, Mus musculus
ggaggcttagaacgcactgcccaag

SEQ ID NO: 265478 - DNA, 25 bp, Mus musculus
actgcccaagaagtgagctggtccg

SEQ ID NO: 265479 - DNA, 25 bp, Mus musculus
ggacgcgaggcttatttgcattatg

SEQ ID NO: 265480 - DNA, 25 bp, Mus musculus
cttatttgcattatgtgctcctccc

SEQ ID NO: 265481 - DNA, 25 bp, Mus musculus
aacattcgcgggaacctaatcgcct

SEQ ID NO: 265482 - DNA, 25 bp, Mus musculus
tggcgaccgctgagggccgcaatat

SEQ ID NO: 265483 - DNA, 25 bp, Mus musculus
cgagcctccggagctgcggatacca

SEQ ID NO: 265484 - DNA, 25 bp, Mus musculus
agcctcaccgtaggtctcggccatg

SEQ ID NO: 265485 - DNA, 25 bp, Mus musculus
agctgcggataccaggccacgctcg

SEQ ID NO: 265486 - DNA, 25 bp, Mus musculus
cacgctcgcccaacgcagtgattgg

SEQ ID NO: 265487 - DNA, 25 bp, Mus musculus
cccaacgcagtgattggtggattca

SEQ ID NO: 265488 - DNA, 25 bp, Mus musculus
gccgagtcaaaaggggcgtgacata

SEQ ID NO: 265489 - DNA, 25 bp, Mus musculus
caaaaggggcgtgacatagaagagc

SEQ ID NO: 265490 - DNA, 25 bp, Mus musculus
agagatgctgccctagcggtggaac

SEQ ID NO: 265491 - DNA, 25 bp, Mus musculus
gcggtggaacggatttggtcaaata

SEQ ID NO: 265492 - DNA, 25 bp, Mus musculus
tcaaatatcggggagcagagactag

SEQ ID NO: 265493 - DNA, 25 bp, Mus musculus
cagagactagactccgtattggtta

SEQ ID NO: 265494 - DNA, 25 bp, Mus musculus
tattggttatacgtaggcacggggc

SEQ ID NO: 265495 - DNA, 25 bp, Mus musculus
agggccgcaatatggcgccgcagcc

SEQ ID NO: 265496 - DNA, 25 bp, Mus musculus
agcggcgcttcccattagtccacgt

SEQ ID NO: 265497 - DNA, 25 bp, Mus musculus
aatgctctacgagtcccggcaggcg

SEQ ID NO: 265498 - DNA, 25 bp, Mus musculus
atcccagaatgctctacgagtcccg

SEQ ID NO: 265499 - DNA, 25 bp, Mus musculus
cattagtccacgtgcgcgaaaggcg

SEQ ID NO: 265500 - DNA, 25 bp, Mus musculus
cccggatgtcggagccagttaagaa

SEQ ID NO: 265501 - DNA, 25 bp, Mus musculus
ggggccgacttggaacatcctagtc

SEQ ID NO: 265502 - DNA, 25 bp, Mus musculus
tcctagtctctcaaagagaggcctc

SEQ ID NO: 265503 - DNA, 25 bp, Mus musculus
gagcagcgtctacaacccgcgggaa

SEQ ID NO: 265504 - DNA, 25 bp, Mus musculus
atcacggcgggcaaactcggtaagt

SEQ ID NO: 265505 - DNA, 25 bp, Mus musculus
actcggtaagttcagagtctctccc

SEQ ID NO: 265506 - DNA, 25 bp, Mus musculus
ccggcctcagcgtctgccaaaggaa

SEQ ID NO: 265507 - DNA, 25 bp, Mus musculus
tcagcgtctgccaaaggaacacttg

SEQ ID NO: 265508 - DNA, 25 bp, Mus musculus
caacccgcgtgctaagggagagcta

SEQ ID NO: 265509 - DNA, 25 bp, Mus musculus
ttccgcgagctaatcacggcgggca

SEQ ID NO: 265510 - DNA, 25 bp, Mus musculus
acgcaactactaggccagctgcttc

SEQ ID NO: 265511 - DNA, 25 bp, Mus musculus
acaggattctgcctgtggaccgttc

SEQ ID NO: 265512 - DNA, 25 bp, Mus musculus
ggaggctggactcctcgatccaggc

SEQ ID NO: 265513 - DNA, 25 bp, Mus musculus
tccaggtcgttgtagtccaggctgt

SEQ ID NO: 265514 - DNA, 25 bp, Mus musculus
tccgcgtgtccatctccacaggatt

SEQ ID NO: 265515 - DNA, 25 bp, Mus musculus
gaccgttcggacacggcgcaggctc

SEQ ID NO: 265516 - DNA, 25 bp, Mus musculus
caaaacacggccctcgccggaagtg

SEQ ID NO: 265517 - DNA, 25 bp, Mus musculus
taaaatcctacgaggggtgtggctg

SEQ ID NO: 265518 - DNA, 25 bp, Mus musculus
tctgattctggtcagggtctaggtc

SEQ ID NO: 265519 - DNA, 25 bp, Mus musculus
agcacttggcttctgattctggtca

SEQ ID NO: 265520 - DNA, 25 bp, Mus musculus
gcagggaaccagcacttggcttctg

SEQ ID NO: 265521 - DNA, 25 bp, Mus musculus
atgccaccgtgtgtctcgcagggaa

SEQ ID NO: 265522 - DNA, 25 bp, Mus musculus
ccgctcggatatgcaggggttaacc

SEQ ID NO: 265523 - DNA, 25 bp, Mus musculus
tgcaggggttaaccgatactccacc

SEQ ID NO: 265524 - DNA, 25 bp, Mus musculus
cgtttccgggagtccttccatctga

SEQ ID NO: 265525 - DNA, 25 bp, Mus musculus
ccatctgagcaagcaccacgtggtg

SEQ ID NO: 265526 - DNA, 25 bp, Mus musculus
cctacaagtgcgagttgtgcggcaa

SEQ ID NO: 265527 - DNA, 25 bp, Mus musculus
caaggtcttcggctacccgcagagc

SEQ ID NO: 265528 - DNA, 25 bp, Mus musculus
accgccaggtgcatcggctccaatt

SEQ ID NO: 265529 - DNA, 25 bp, Mus musculus
gcggggagcacttcccggatctctt

SEQ ID NO: 265530 - DNA, 25 bp, Mus musculus
aagacgttctgctgtggcatctgtg

SEQ ID NO: 265531 - DNA, 25 bp, Mus musculus
cggatctcttccacgtcatgagtca

SEQ ID NO: 265532 - DNA, 25 bp, Mus musculus
tgagtcacaaggaagctcacatgtc

SEQ ID NO: 265533 - DNA, 25 bp, Mus musculus
ctcacatgtcagagaagccgtatgg

SEQ ID NO: 265534 - DNA, 25 bp, Mus musculus
gcaagacgttcggtttcatcgagaa

SEQ ID NO: 265535 - DNA, 25 bp, Mus musculus
ctcatgtggcacaagctggttcacc

SEQ ID NO: 265536 - DNA, 25 bp, Mus musculus
ggccgacctgagctatgcctgctca

SEQ ID NO: 265537 - DNA, 25 bp, Mus musculus
cccagtcttctgatggcggcagcag

SEQ ID NO: 265538 - DNA, 25 bp, Mus musculus
gcccgcgtcagaccgagccgccgcc

SEQ ID NO: 265539 - DNA, 25 bp, Mus musculus
ctttgcttgggaggagacccggtag

SEQ ID NO: 265540 - DNA, 25 bp, Mus musculus
aggagacccggtagtgtttatgtgg

SEQ ID NO: 265541 - DNA, 25 bp, Mus musculus
agggcggggttatcttttgcatata

SEQ ID NO: 265542 - DNA, 25 bp, Mus musculus
ggcggggttatcttttgcatataca

SEQ ID NO: 265543 - DNA, 25 bp, Mus musculus
cggggttatcttttgcatatacagc

SEQ ID NO: 265544 - DNA, 25 bp, Mus musculus
ggttatcttttgcatatacagcagg

SEQ ID NO: 265545 - DNA, 25 bp, Mus musculus
atcttttgcatatacagcaggcggc

SEQ ID NO: 265546 - DNA, 25 bp, Mus musculus
cttttgcatatacagcaggcggcgg

SEQ ID NO: 265547 - DNA, 25 bp, Mus musculus
tttgcatatacagcaggcggcgggc

SEQ ID NO: 265548 - DNA, 25 bp, Mus musculus
ttgcatatacagcaggcggcgggcc

SEQ ID NO: 265549 - DNA, 25 bp, Mus musculus
ccgggccctggatgtcccgcagcgc

SEQ ID NO: 265550 - DNA, 25 bp, Mus musculus
tgcaggttcccgcaaggccagacca

SEQ ID NO: 265551 - DNA, 25 bp, Mus musculus
caggttcccgcaaggccagaccaag

SEQ ID NO: 265552 - DNA, 25 bp, Mus musculus
ggcctgcttggaagcccgtgccgca

SEQ ID NO: 265553 - DNA, 25 bp, Mus musculus
cgcacaagtgtagccgcttggccta

SEQ ID NO: 265554 - DNA, 25 bp, Mus musculus
ggaaacctgggtcgcacgcacaagt

SEQ ID NO: 265555 - DNA, 25 bp, Mus musculus
gctcaccaatgcagcgagtgccctg

SEQ ID NO: 265556 - DNA, 25 bp, Mus musculus
tgcccagctcaccaatgcagcgagt

SEQ ID NO: 265557 - DNA, 25 bp, Mus musculus
gcagaggacctgactccgcgaaatc

SEQ ID NO: 265558 - DNA, 25 bp, Mus musculus
aagctagttacgtgctggccaggca

SEQ ID NO: 265559 - DNA, 25 bp, Mus musculus
ctggggacacagagcaagctagtta

SEQ ID NO: 265560 - DNA, 25 bp, Mus musculus
acattcatctatgtctggggacaca

SEQ ID NO: 265561 - DNA, 25 bp, Mus musculus
gggacgcggcgacattcatctatgt

SEQ ID NO: 265562 - DNA, 25 bp, Mus musculus
gtgtattctcgcaacgcccaggagc

SEQ ID NO: 265563 - DNA, 25 bp, Mus musculus
agcgaaagctgcctggtgtattctc

SEQ ID NO: 265564 - DNA, 25 bp, Mus musculus
agccgcttggcctaggaacgcagcg

SEQ ID NO: 265565 - DNA, 25 bp, Mus musculus
gtgccgcacacgcagcgaaagctgc

SEQ ID NO: 265566 - DNA, 25 bp, Mus musculus
gcgcgcttccgcctcacgggctctg

SEQ ID NO: 265567 - DNA, 25 bp, Mus musculus
cttcttcgtgctgcagcggcgccga

SEQ ID NO: 265568 - DNA, 25 bp, Mus musculus
gcttccgcctcacgggctctggccc

SEQ ID NO: 265569 - DNA, 25 bp, Mus musculus
gcgggatgtggctcgggcccgagga

SEQ ID NO: 265570 - DNA, 25 bp, Mus musculus
aggtgctggtggctaacgcgctatg

SEQ ID NO: 265571 - DNA, 25 bp, Mus musculus
ctaacgcgctatgggtgacggagcg

SEQ ID NO: 265572 - DNA, 25 bp, Mus musculus
ttcttcgtgctgcagcggcgccgag

SEQ ID NO: 265573 - DNA, 25 bp, Mus musculus
gcgccgaggccacggcaagggcgga

SEQ ID NO: 265574 - DNA, 25 bp, Mus musculus
aagggcggaggcctcacgggtgagc

SEQ ID NO: 265575 - DNA, 25 bp, Mus musculus
ggggaggacgatcccgggacaggca

SEQ ID NO: 265576 - DNA, 25 bp, Mus musculus
aaggacaccagtggcctccgccggg

SEQ ID NO: 265577 - DNA, 25 bp, Mus musculus
gccaaccttcgggccgacgtctcga

SEQ ID NO: 265578 - DNA, 25 bp, Mus musculus
acgctgtgagccagcgcggccgcta

SEQ ID NO: 265579 - DNA, 25 bp, Mus musculus
ggacaggcagcaggggaaggacacc

SEQ ID NO: 265580 - DNA, 25 bp, Mus musculus
cgcgtggtggcatttttaagggatt

SEQ ID NO: 265581 - DNA, 25 bp, Mus musculus
tgccagcactgtgtagggcgccgcc

SEQ ID NO: 265582 - DNA, 25 bp, Mus musculus
cgcgctctgtgccagcactgtgtag

SEQ ID NO: 265583 - DNA, 25 bp, Mus musculus
agtagccgtcctcgcgtggcgcgct

SEQ ID NO: 265584 - DNA, 25 bp, Mus musculus
gaggcgtctgagtagccgtcctcgc

SEQ ID NO: 265585 - DNA, 25 bp, Mus musculus
acagtaaccgaagccggaggcgtct

SEQ ID NO: 265586 - DNA, 25 bp, Mus musculus
gcagttctctaaaacagtaaccgaa

SEQ ID NO: 265587 - DNA, 25 bp, Mus musculus
cgcgcacgggtgacaatcatgaaca

SEQ ID NO: 265588 - DNA, 25 bp, Mus musculus
ccggcctcggctcacttcgcttccg

SEQ ID NO: 265589 - DNA, 25 bp, Mus musculus
gcgatgcacactgtagaagaagtga

SEQ ID NO: 265590 - DNA, 25 bp, Mus musculus
cagcggcgatgcacactgtagaaga

SEQ ID NO: 265591 - DNA, 25 bp, Mus musculus
gcagcagacttcctgcgtccggagc

SEQ ID NO: 265592 - DNA, 25 bp, Mus musculus
caggccaagccctctcctcggcagc

SEQ ID NO: 265593 - DNA, 25 bp, Mus musculus
ttcgcttccgcgcagttctctaaaa

SEQ ID NO: 265594 - DNA, 25 bp, Mus musculus
ccctcccactcttgggcgagctagg

SEQ ID NO: 265595 - DNA, 25 bp, Mus musculus
acctctgggcggggcactgccagct

SEQ ID NO: 265596 - DNA, 25 bp, Mus musculus
ctccggtagcatcgggcggggcaac

SEQ ID NO: 265597 - DNA, 25 bp, Mus musculus
caaaggaggccggacgtgtctttcg

SEQ ID NO: 265598 - DNA, 25 bp, Mus musculus
actgctgagccaaaggaggccggac

SEQ ID NO: 265599 - DNA, 25 bp, Mus musculus
ccggactgctgagccaaaggaggcc

SEQ ID NO: 265600 - DNA, 25 bp, Mus musculus
ctccgcattccggacccttggggag

SEQ ID NO: 265601 - DNA, 25 bp, Mus musculus
gcagcggaggcagggcgtcgtctcc

SEQ ID NO: 265602 - DNA, 25 bp, Mus musculus
ccagctgtgcggtggggtaaacaaa

SEQ ID NO: 265603 - DNA, 25 bp, Mus musculus
cctctctgggcccttggccacctct

SEQ ID NO: 265604 - DNA, 25 bp, Mus musculus
aactagcggggacgcgcctctactc

SEQ ID NO: 265605 - DNA, 25 bp, Mus musculus
gcaactagcggggacgcgcctctac

SEQ ID NO: 265606 - DNA, 25 bp, Mus musculus
tcccggcctccggtagcatcgggcg

SEQ ID NO: 265607 - DNA, 25 bp, Mus musculus
taaacaaagaaaggggtgcagcgga

SEQ ID NO: 265608 - DNA, 25 bp, Mus musculus
agcagcaccaatagcgacacccaga

SEQ ID NO: 265609 - DNA, 25 bp, Mus musculus
ccaatagcgacacccagagcagctg

SEQ ID NO: 265610 - DNA, 25 bp, Mus musculus
agcaccaatagcgacacccagagca

SEQ ID NO: 265611 - DNA, 25 bp, Mus musculus
ccgctgtccacgctggtggcgttgc

SEQ ID NO: 265612 - DNA, 25 bp, Mus musculus
acgctctcggggtcggcccagtacg

SEQ ID NO: 265613 - DNA, 25 bp, Mus musculus
cgaagacgctctcggggtcggccca

SEQ ID NO: 265614 - DNA, 25 bp, Mus musculus
aagcgcacgcgaagacgctctcggg

SEQ ID NO: 265615 - DNA, 25 bp, Mus musculus
cgccgctgtccacgctggtggcgtt

SEQ ID NO: 265616 - DNA, 25 bp, Mus musculus
ggatgcaacgcaggccgcacacagc

SEQ ID NO: 265617 - DNA, 25 bp, Mus musculus
ccgtggatgcaacgcaggccgcaca

SEQ ID NO: 265618 - DNA, 25 bp, Mus musculus
ccagtgggcccgtggatgcaacgca

SEQ ID NO: 265619 - DNA, 25 bp, Mus musculus
caggtcggggtacagcgggagccag

SEQ ID NO: 265620 - DNA, 25 bp, Mus musculus
cactcacaggcgcggaagccgggtc

SEQ ID NO: 265621 - DNA, 25 bp, Mus musculus
tgaagcgcacgcgaagacgctctcg

SEQ ID NO: 265622 - DNA, 25 bp, Mus musculus
gagagctcgctcaacgcaattacgg

SEQ ID NO: 265623 - DNA, 25 bp, Mus musculus
atggggcctcgaggatctcccacac

SEQ ID NO: 265624 - DNA, 25 bp, Mus musculus
ccctacgttcagatgaatcacttcc

SEQ ID NO: 265625 - DNA, 25 bp, Mus musculus
cactgcagtcgtcgcgacggccata

SEQ ID NO: 265626 - DNA, 25 bp, Mus musculus
cggctcgcacccacttccgggtgtg

SEQ ID NO: 265627 - DNA, 25 bp, Mus musculus
gggtgtgcatagaccccgcctcttc

SEQ ID NO: 265628 - DNA, 25 bp, Mus musculus
tcttcctcttgctcattggcctaga

SEQ ID NO: 265629 - DNA, 25 bp, Mus musculus
gctcattggcctagagactccagga

SEQ ID NO: 265630 - DNA, 25 bp, Mus musculus
agactccaggatccaccggcgattg

SEQ ID NO: 265631 - DNA, 25 bp, Mus musculus
ttggacagagagctcgctcaacgca

SEQ ID NO: 265632 - DNA, 25 bp, Mus musculus
tcgctcaacgcaattacggtctctg

SEQ ID NO: 265633 - DNA, 25 bp, Mus musculus
tctgactctttaaagagggccggtc

SEQ ID NO: 265634 - DNA, 25 bp, Mus musculus
tcaacgcaattacggtctctgactc

SEQ ID NO: 265635 - DNA, 25 bp, Mus musculus
tccaccggcgattggacagagagct

SEQ ID NO: 265636 - DNA, 25 bp, Mus musculus
ttgcggttagcgtcgagctcgcgct

SEQ ID NO: 265637 - DNA, 25 bp, Mus musculus
cggttagcgtcgagctcgcgcttgc

SEQ ID NO: 265638 - DNA, 25 bp, Mus musculus
gcttgcgcagcaggaagccctcgtg

SEQ ID NO: 265639 - DNA, 25 bp, Mus musculus
ttgcgcagcaggaagccctcgtgct

SEQ ID NO: 265640 - DNA, 25 bp, Mus musculus
agcaggaagccctcgtgctgcactg

SEQ ID NO: 265641 - DNA, 25 bp, Mus musculus
gaagccctcgtgctgcactgtgtga

SEQ ID NO: 265642 - DNA, 25 bp, Mus musculus
ccctcgtgctgcactgtgtgagtgg

SEQ ID NO: 265643 - DNA, 25 bp, Mus musculus
accaccctctcgaggccgtggccgc

SEQ ID NO: 265644 - DNA, 25 bp, Mus musculus
ccgctcgggcggctcaagcccgttg

SEQ ID NO: 265645 - DNA, 25 bp, Mus musculus
gccgatcgggccgaggtgtccgctc

SEQ ID NO: 265646 - DNA, 25 bp, Mus musculus
acgacttgcggttagcgtcgagctc

SEQ ID NO: 265647 - DNA, 25 bp, Mus musculus
acgcgctcaccggttggacgacttg

SEQ ID NO: 265648 - DNA, 25 bp, Mus musculus
tcaccggttggacgacttgcggtta

SEQ ID NO: 265649 - DNA, 25 bp, Mus musculus
ctcaagcccgttgggcaggcgacca

SEQ ID NO: 265650 - DNA, 25 bp, Mus musculus
cctctggttgatccacggactcctg

SEQ ID NO: 265651 - DNA, 25 bp, Mus musculus
ctcgtagcgacctagagtaaggctg

SEQ ID NO: 265652 - DNA, 25 bp, Mus musculus
acctccgctgacagcgtgtccgagg

SEQ ID NO: 265653 - DNA, 25 bp, Mus musculus
cgttctgatcttcgtctccgtggca

SEQ ID NO: 265654 - DNA, 25 bp, Mus musculus
ggcttgagctcctggcgcacatacc

SEQ ID NO: 265655 - DNA, 25 bp, Mus musculus
ctccatctgctcgtagcgacctaga

SEQ ID NO: 265656 - DNA, 25 bp, Mus musculus
gacctagagtaaggctgtgcggccc

SEQ ID NO: 265657 - DNA, 25 bp, Mus musculus
gcgctgtctcctctggttgatccac

SEQ ID NO: 265658 - DNA, 25 bp, Mus musculus
tccacggactcctggcgttctgatc

SEQ ID NO: 265659 - DNA, 25 bp, Mus musculus
gatccgctaactcctggcgctccga

SEQ ID NO: 265660 - DNA, 25 bp, Mus musculus
gtcccaggggtgtccgtcgtgtcca

SEQ ID NO: 265661 - DNA, 25 bp, Mus musculus
cgtcgtgtccaacgctgcggctgtc

SEQ ID NO: 265662 - DNA, 25 bp, Mus musculus
aggtctctggcagccggtcaatgcg

SEQ ID NO: 265663 - DNA, 25 bp, Mus musculus
tagactcctgtcgttctatccgccg

SEQ ID NO: 265664 - DNA, 25 bp, Mus musculus
gctgccgtacctgagagacaagcca

SEQ ID NO: 265665 - DNA, 25 bp, Mus musculus
acctgagagacaagccaggtcctgc

SEQ ID NO: 265666 - DNA, 25 bp, Mus musculus
agccctgcaacacctcctgctcgcg

SEQ ID NO: 265667 - DNA, 25 bp, Mus musculus
ctgcagctgccgtacctgagagaca

SEQ ID NO: 265668 - DNA, 25 bp, Mus musculus
cttcctgcagctgccgtacctgaga

SEQ ID NO: 265669 - DNA, 25 bp, Mus musculus
cagcgtacaccgtccgcagctgggc

SEQ ID NO: 265670 - DNA, 25 bp, Mus musculus
cctcggcgtgctcgccagcgtacac

SEQ ID NO: 265671 - DNA, 25 bp, Mus musculus
acaggctgctagcagctccttccag

SEQ ID NO: 265672 - DNA, 25 bp, Mus musculus
tgcagacgagcatcttcacaggctg

SEQ ID NO: 265673 - DNA, 25 bp, Mus musculus
agctgacgtgcagacgagcatcttc

SEQ ID NO: 265674 - DNA, 25 bp, Mus musculus
cgtccatccaggagagcaggtcgcg

SEQ ID NO: 265675 - DNA, 25 bp, Mus musculus
ccgcgatgccgtccatccaggagag

SEQ ID NO: 265676 - DNA, 25 bp, Mus musculus
acgagcatcttcacaggctgctagc

SEQ ID NO: 265677 - DNA, 25 bp, Mus musculus
tgccgtccatccaggagagcaggtc

SEQ ID NO: 265678 - DNA, 25 bp, Mus musculus
cgcaggccctgcgaatgagacatcg

SEQ ID NO: 265679 - DNA, 25 bp, Mus musculus
gtgagcctggatctcccgccgcagg

SEQ ID NO: 265680 - DNA, 25 bp, Mus musculus
cacctcctccaagcgcggcccgtga

SEQ ID NO: 265681 - DNA, 25 bp, Mus musculus
tgcagctgctcttggccacggcgca

SEQ ID NO: 265682 - DNA, 25 bp, Mus musculus
gctctgcagctgctcttggccacgg

SEQ ID NO: 265683 - DNA, 25 bp, Mus musculus
actgttccacctggaaggcggcgtc

SEQ ID NO: 265684 - DNA, 25 bp, Mus musculus
cgcccgcgatgagttcgcagaggac

SEQ ID NO: 265685 - DNA, 25 bp, Mus musculus
tgttctgggcgcaccttgcccttgt

SEQ ID NO: 265686 - DNA, 25 bp, Mus musculus
ttgcccttgtcctcactcatcatga

SEQ ID NO: 265687 - DNA, 25 bp, Mus musculus
tcactcatcatgagcagctcctgct

SEQ ID NO: 265688 - DNA, 25 bp, Mus musculus
tcctgctcgcccagccatgcctcca

SEQ ID NO: 265689 - DNA, 25 bp, Mus musculus
cacctcagccacgtcaaagtagtac

SEQ ID NO: 265690 - DNA, 25 bp, Mus musculus
cagccacgtcaaagtagtactgttc

SEQ ID NO: 265691 - DNA, 25 bp, Mus musculus
caaagtagtactgttccacctggaa

SEQ ID NO: 265692 - DNA, 25 bp, Mus musculus
ttgccctgcgatcttcttcgctgtg

SEQ ID NO: 265693 - DNA, 25 bp, Mus musculus
gcggccatcttgtacctaagcccgg

SEQ ID NO: 265694 - DNA, 25 bp, Mus musculus
ggcggaatccggcaaaaggtcttca

SEQ ID NO: 265695 - DNA, 25 bp, Mus musculus
tcttgtacctaagcccggtccctga

SEQ ID NO: 265696 - DNA, 25 bp, Mus musculus
cccggtccctgagggcaaagattgc

SEQ ID NO: 265697 - DNA, 25 bp, Mus musculus
ctgagggcaaagattgctccgcgaa

SEQ ID NO: 265698 - DNA, 25 bp, Mus musculus
gcgggatcataaccggtagatgagc

SEQ ID NO: 265699 - DNA, 25 bp, Mus musculus
ataaccggtagatgagcggggccct

SEQ ID NO: 265700 - DNA, 25 bp, Mus musculus
gaaggtcggccacaccctagcgacg

SEQ ID NO: 265701 - DNA, 25 bp, Mus musculus
cagctggaaggtcggccacacccta

SEQ ID NO: 265702 - DNA, 25 bp, Mus musculus
gggctgactgaacttgcagctggaa

SEQ ID NO: 265703 - DNA, 25 bp, Mus musculus
tccgcatgggctgactgaacttgca

SEQ ID NO: 265704 - DNA, 25 bp, Mus musculus
aaaacctgtcggtcctccgcatggg

SEQ ID NO: 265705 - DNA, 25 bp, Mus musculus
cctgcgatcttcttcgctgtgaacc

SEQ ID NO: 265706 - DNA, 25 bp, Mus musculus
aagcggcgtcgctcctgcaaaggct

SEQ ID NO: 265707 - DNA, 25 bp, Mus musculus
tcaccagttcatcgtccaggtcgtg

SEQ ID NO: 265708 - DNA, 25 bp, Mus musculus
agttcatcgtccaggtcgtgggcca

SEQ ID NO: 265709 - DNA, 25 bp, Mus musculus
caggtcgtgggccacctgatgcagc

SEQ ID NO: 265710 - DNA, 25 bp, Mus musculus
gtcgtgggccacctgatgcagctcc

SEQ ID NO: 265711 - DNA, 25 bp, Mus musculus
ctgatgcagctccttggatgccagc

SEQ ID NO: 265712 - DNA, 25 bp, Mus musculus
tgcagctccttggatgccagcaaca

SEQ ID NO: 265713 - DNA, 25 bp, Mus musculus
agctccttggatgccagcaacaagc

SEQ ID NO: 265714 - DNA, 25 bp, Mus musculus
ttggatgccagcaacaagcggcgtc

SEQ ID NO: 265715 - DNA, 25 bp, Mus musculus
ctcgcccaccgcactctgccgctcc

SEQ ID NO: 265716 - DNA, 25 bp, Mus musculus
caacaagcggcgtcgctcctgcaaa

SEQ ID NO: 265717 - DNA, 25 bp, Mus musculus
ggcgtcgctcctgcaaaggctccag

SEQ ID NO: 265718 - DNA, 25 bp, Mus musculus
cccatcctcgagtcccggtcccagg

SEQ ID NO: 265719 - DNA, 25 bp, Mus musculus
atgccagcaacaagcggcgtcgctc

SEQ ID NO: 265720 - DNA, 25 bp, Mus musculus
ccggctcagcagtctcgggttctac

SEQ ID NO: 265721 - DNA, 25 bp, Mus musculus
tctttcctagcaggacggtgggcga

SEQ ID NO: 265722 - DNA, 25 bp, Mus musculus
gccggagaggcgaacagtgaccacc

SEQ ID NO: 265723 - DNA, 25 bp, Mus musculus
cagtgaccaccgagacagtgggcta

SEQ ID NO: 265724 - DNA, 25 bp, Mus musculus
cggggccgactcagtcagagaagaa

SEQ ID NO: 265725 - DNA, 25 bp, Mus musculus
ctcagtcagagaagaacggagagac

SEQ ID NO: 265726 - DNA, 25 bp, Mus musculus
aacggagagacgcaccagggcatgc

SEQ ID NO: 265727 - DNA, 25 bp, Mus musculus
cgggattgcagagcccgagctcacg

SEQ ID NO: 265728 - DNA, 25 bp, Mus musculus
tgagtcctgaatggcgccggctcag

SEQ ID NO: 265729 - DNA, 25 bp, Mus musculus
cagcagtctcgggttctacggtgct

SEQ ID NO: 265730 - DNA, 25 bp, Mus musculus
tgccacatctttcaggcgcatcagg

SEQ ID NO: 265731 - DNA, 25 bp, Mus musculus
atctttcaggcgcatcaggtggggt

SEQ ID NO: 265732 - DNA, 25 bp, Mus musculus
ggtgctgcagctgccacatctttca

SEQ ID NO: 265733 - DNA, 25 bp, Mus musculus
tcaccctctttcctagcaggacggt

SEQ ID NO: 265734 - DNA, 25 bp, Mus musculus
agttgatagacgtgcgcttggacca

SEQ ID NO: 265735 - DNA, 25 bp, Mus musculus
gcaagcgcctggcacaggtctctca

SEQ ID NO: 265736 - DNA, 25 bp, Mus musculus
aggtgcggcagccactcgtctagcg

SEQ ID NO: 265737 - DNA, 25 bp, Mus musculus
tctcaggaagagttgatagacgtgc

SEQ ID NO: 265738 - DNA, 25 bp, Mus musculus
tcgtctagcgccagaccggggccca

SEQ ID NO: 265739 - DNA, 25 bp, Mus musculus
agacgtgcgcttggaccagcgcctc

SEQ ID NO: 265740 - DNA, 25 bp, Mus musculus
ctcccacaagccgagcagtttgtgc

SEQ ID NO: 265741 - DNA, 25 bp, Mus musculus
aagccgagcagtttgtgccaccaaa

SEQ ID NO: 265742 - DNA, 25 bp, Mus musculus
tttgtgccaccaaacctcgaggtgc

SEQ ID NO: 265743 - DNA, 25 bp, Mus musculus
ggcagccacgatgcgcgcgtagtcc

SEQ ID NO: 265744 - DNA, 25 bp, Mus musculus
gcagcgcttcactggcagccacgat

SEQ ID NO: 265745 - DNA, 25 bp, Mus musculus
ctcggacgctagcagcgcttcactg

SEQ ID NO: 265746 - DNA, 25 bp, Mus musculus
accaaacctcgaggtgcggcagcca

SEQ ID NO: 265747 - DNA, 25 bp, Mus musculus
tggcacaggtctctcaggaagagtt

SEQ ID NO: 265748 - DNA, 25 bp, Mus musculus
agcccgtccaggtcggcgccaaatt

SEQ ID NO: 265749 - DNA, 25 bp, Mus musculus
gaatcgggcacacgcatggccagca

SEQ ID NO: 265750 - DNA, 25 bp, Mus musculus
ccgatccacaactcgcaggcatgta

SEQ ID NO: 265751 - DNA, 25 bp, Mus musculus
gcaggcatgtacctcgccgaacatg

SEQ ID NO: 265752 - DNA, 25 bp, Mus musculus
ccgaacatgcggtacacggcgagcg

SEQ ID NO: 265753 - DNA, 25 bp, Mus musculus
gagcgcgtcccgaagccactgtcgt

SEQ ID NO: 265754 - DNA, 25 bp, Mus musculus
tacgcgtcacgaagccagtccagca

SEQ ID NO: 265755 - DNA, 25 bp, Mus musculus
tgcaggatcttatgctgcgccagca

SEQ ID NO: 265756 - DNA, 25 bp, Mus musculus
agcagcgcccacaggctccgagaag

SEQ ID NO: 265757 - DNA, 25 bp, Mus musculus
gctccgacagacagccatgcacgtg

SEQ ID NO: 265758 - DNA, 25 bp, Mus musculus
ggtcacctcggcgaacaactgttcg

SEQ ID NO: 265759 - DNA, 25 bp, Mus musculus
ccacctcaacgtcgtcgagggaatc

SEQ ID NO: 265760 - DNA, 25 bp, Mus musculus
tggacgcttcgtcgtgaccaaaatc

SEQ ID NO: 265761 - DNA, 25 bp, Mus musculus
tctccagcggctgctagacgatacg

SEQ ID NO: 265762 - DNA, 25 bp, Mus musculus
ctgtctgtcacacgcagtcacttgc

SEQ ID NO: 265763 - DNA, 25 bp, Mus musculus
actctcatggtgtcactccttcgta

SEQ ID NO: 265764 - DNA, 25 bp, Mus musculus
tcactccttcgtaaggggtcagtca

SEQ ID NO: 265765 - DNA, 25 bp, Mus musculus
agcgctcgaggcagcgtcacacact

SEQ ID NO: 265766 - DNA, 25 bp, Mus musculus
gggtcaaaccttctaactgtctgtc

SEQ ID NO: 265767 - DNA, 25 bp, Mus musculus
acgcgtgtgatgcacagccgcgctc

SEQ ID NO: 265768 - DNA, 25 bp, Mus musculus
gggtcagtcagggtcaaaccttcta

SEQ ID NO: 265769 - DNA, 25 bp, Mus musculus
acacaccgggccacgcgtgtgatgc

SEQ ID NO: 265770 - DNA, 25 bp, Mus musculus
aaacagatccgagggctcaggtcgc

SEQ ID NO: 265771 - DNA, 25 bp, Mus musculus
tccggctaaacagatccgagggctc

SEQ ID NO: 265772 - DNA, 25 bp, Mus musculus
gatcgcaagcctctatccggctaaa

SEQ ID NO: 265773 - DNA, 25 bp, Mus musculus
tgaggggttcattggatcgcaagcc

SEQ ID NO: 265774 - DNA, 25 bp, Mus musculus
cacgcctggttcagtggctgagcta

SEQ ID NO: 265775 - DNA, 25 bp, Mus musculus
tctccacatgcacactctcatggtg

SEQ ID NO: 265776 - DNA, 25 bp, Mus musculus
tactcatgctctttccagcgggagg

SEQ ID NO: 265777 - DNA, 25 bp, Mus musculus
gctcaccacactggcgcaggcggtg

SEQ ID NO: 265778 - DNA, 25 bp, Mus musculus
ccgcagcatgactgtcaagaagatc

SEQ ID NO: 265779 - DNA, 25 bp, Mus musculus
agttctcagcttttccggccctgga

SEQ ID NO: 265780 - DNA, 25 bp, Mus musculus
cgcgtcctcggagttctcagctttt

SEQ ID NO: 265781 - DNA, 25 bp, Mus musculus
tccttctgggtcgaggaggacccgc

SEQ ID NO: 265782 - DNA, 25 bp, Mus musculus
tgaacccaaattaggagggtgaggc

SEQ ID NO: 265783 - DNA, 25 bp, Mus musculus
aatttgactcctccgcctactcatg

SEQ ID NO: 265784 - DNA, 25 bp, Mus musculus
aaggggctctggaaatgcaatttga

SEQ ID NO: 265785 - DNA, 25 bp, Mus musculus
tctaagcgcctatcggagaaggggc

SEQ ID NO: 265786 - DNA, 25 bp, Mus musculus
cgtggcttctacgtctaagcgccta

SEQ ID NO: 265787 - DNA, 25 bp, Mus musculus
aagatcgcgatcttcggtgccaccg

SEQ ID NO: 265788 - DNA, 25 bp, Mus musculus
aggctggaaccttgtctggtcccgc

SEQ ID NO: 265789 - DNA, 25 bp, Mus musculus
gaagtcatgaacaccgggcggagtt

SEQ ID NO: 265790 - DNA, 25 bp, Mus musculus
catgccggatcagcaccagcttgta

SEQ ID NO: 265791 - DNA, 25 bp, Mus musculus
ccgggctcaggtcggcgtcgtacca

SEQ ID NO: 265792 - DNA, 25 bp, Mus musculus
tcggcgtcgtaccagccgctgaagc

SEQ ID NO: 265793 - DNA, 25 bp, Mus musculus
taccagccgctgaagcggttctcca

SEQ ID NO: 265794 - DNA, 25 bp, Mus musculus
gatcgccgagattctcttcgcagcc

SEQ ID NO: 265795 - DNA, 25 bp, Mus musculus
aggcgctctcgccatgccggatcag

SEQ ID NO: 265796 - DNA, 25 bp, Mus musculus
ccggatcagcaccagcttgtaggca

SEQ ID NO: 265797 - DNA, 25 bp, Mus musculus
cagcaccagcttgtaggcagccatg

SEQ ID NO: 265798 - DNA, 25 bp, Mus musculus
caccagcttgtaggcagccatggcg

SEQ ID NO: 265799 - DNA, 25 bp, Mus musculus
cagaggatgcagcagcaactgagga

SEQ ID NO: 265800 - DNA, 25 bp, Mus musculus
tgcagcagcaactgaggatcgccga

SEQ ID NO: 265801 - DNA, 25 bp, Mus musculus
cagcaactgaggatcgccgagattc

SEQ ID NO: 265802 - DNA, 25 bp, Mus musculus
ctgaggatcgccgagattctcttcg

SEQ ID NO: 265803 - DNA, 25 bp, Mus musculus
gctgaagcggttctccaggttccag

SEQ ID NO: 265804 - DNA, 25 bp, Mus musculus
ctgaccagtagccaacctaaaccgg

SEQ ID NO: 265805 - DNA, 25 bp, Mus musculus
tagtcgtggcgaccctggcagccga

SEQ ID NO: 265806 - DNA, 25 bp, Mus musculus
cggcgttaccagactccaccgtgga

SEQ ID NO: 265807 - DNA, 25 bp, Mus musculus
tccaaccaatcctggcttgcgactg

SEQ ID NO: 265808 - DNA, 25 bp, Mus musculus
ggcctagcatccgtggctcctctta

SEQ ID NO: 265809 - DNA, 25 bp, Mus musculus
cgtggctcctcttagccaatggcgc

SEQ ID NO: 265810 - DNA, 25 bp, Mus musculus
cgcggcgggcaggattccaaccaat

SEQ ID NO: 265811 - DNA, 25 bp, Mus musculus
aaagtgagccggacttctacccagc

SEQ ID NO: 265812 - DNA, 25 bp, Mus musculus
atttccctggagttagaggaggacg

SEQ ID NO: 265813 - DNA, 25 bp, Mus musculus
ttctacccagcactggtggaaccca

SEQ ID NO: 265814 - DNA, 25 bp, Mus musculus
tggtggaacccaaccctgcaggctt

SEQ ID NO: 265815 - DNA, 25 bp, Mus musculus
caaccctgcaggcttgtcggaggta

SEQ ID NO: 265816 - DNA, 25 bp, Mus musculus
gcctgtgtgagatttccctggagtt

SEQ ID NO: 265817 - DNA, 25 bp, Mus musculus
agtggccgcctgtgtgagatttccc

SEQ ID NO: 265818 - DNA, 25 bp, Mus musculus
aacgagagccgatccctgagctgca

SEQ ID NO: 265819 - DNA, 25 bp, Mus musculus
cggagtcagaactgcgcctaccgtc

SEQ ID NO: 265820 - DNA, 25 bp, Mus musculus
ctaccgtcccaggtgtcggttgctg

SEQ ID NO: 265821 - DNA, 25 bp, Mus musculus
ctggagcagaacaagctagcgatgc

SEQ ID NO: 265822 - DNA, 25 bp, Mus musculus
ctacggcagccgcttcctgattggc

SEQ ID NO: 265823 - DNA, 25 bp, Mus musculus
gtggctccctcttcgttctgattgg

SEQ ID NO: 265824 - DNA, 25 bp, Mus musculus
cttcgttctgattggccgcgagtga

SEQ ID NO: 265825 - DNA, 25 bp, Mus musculus
ccgcgagtgatctgtgtatgtaaat

SEQ ID NO: 265826 - DNA, 25 bp, Mus musculus
tctttagggtgttcgatacctcagc

SEQ ID NO: 265827 - DNA, 25 bp, Mus musculus
acctcagctaggtagatggtggccg

SEQ ID NO: 265828 - DNA, 25 bp, Mus musculus
aactagggatagtcgagtgtctgga

SEQ ID NO: 265829 - DNA, 25 bp, Mus musculus
ggctgaattcctgcggttcccggct

SEQ ID NO: 265830 - DNA, 25 bp, Mus musculus
aatctaaaggatcccggggtcactg

SEQ ID NO: 265831 - DNA, 25 bp, Mus musculus
tgaatcacgtcggagcccgagaagg

SEQ ID NO: 265832 - DNA, 25 bp, Mus musculus
cacagaccggggtcagcggcttcaa

SEQ ID NO: 265833 - DNA, 25 bp, Mus musculus
gggaaaggagagctgtttaaccaca

SEQ ID NO: 265834 - DNA, 25 bp, Mus musculus
gagctgtttaaccacaacgcgggtc

SEQ ID NO: 265835 - DNA, 25 bp, Mus musculus
ctagagaaggaacgccatggcgagc

SEQ ID NO: 265836 - DNA, 25 bp, Mus musculus
cgagctctgggcgagttgccgtctt

SEQ ID NO: 265837 - DNA, 25 bp, Mus musculus
agattatcgtggagaccgaggcaca

SEQ ID NO: 265838 - DNA, 25 bp, Mus musculus
tcagcggcttcaacgtagcaggcgg

SEQ ID NO: 265839 - DNA, 25 bp, Mus musculus
aggcggcggcaaagaaggaatcttt

SEQ ID NO: 265840 - DNA, 25 bp, Mus musculus
aggaatctttgtccgtgagctgcga

SEQ ID NO: 265841 - DNA, 25 bp, Mus musculus
ctgcgagaggactcaccggcagcta

SEQ ID NO: 265842 - DNA, 25 bp, Mus musculus
accggcagctaagagcctcagcttg

SEQ ID NO: 265843 - DNA, 25 bp, Mus musculus
ctcagcttgcaagaaggtaggcgtg

SEQ ID NO: 265844 - DNA, 25 bp, Mus musculus
cggagttaggaatctgctttgggtc

SEQ ID NO: 265845 - DNA, 25 bp, Mus musculus
ttgccgtcttggagctccatggcga

SEQ ID NO: 265846 - DNA, 25 bp, Mus musculus
atgaagctcccgaaggtgcccgaga

SEQ ID NO: 265847 - DNA, 25 bp, Mus musculus
ccgatgtacaccttccagatgtaca

SEQ ID NO: 265848 - DNA, 25 bp, Mus musculus
tgcccgatgtacaccttccagatgt

SEQ ID NO: 265849 - DNA, 25 bp, Mus musculus
atggccgtgcccgatgtacaccttc

SEQ ID NO: 265850 - DNA, 25 bp, Mus musculus
ccgagatggccgtgcccgatgtaca

SEQ ID NO: 265851 - DNA, 25 bp, Mus musculus
tcccgaaggtgcccgagatggccgt

SEQ ID NO: 265852 - DNA, 25 bp, Mus musculus
gatgtacaccttccagatgtacagc

SEQ ID NO: 265853 - DNA, 25 bp, Mus musculus
gcccgatgtacaccttccagatgta

SEQ ID NO: 265854 - DNA, 25 bp, Mus musculus
gtgcccgatgtacaccttccagatg

SEQ ID NO: 265855 - DNA, 25 bp, Mus musculus
cgagatggccgtgcccgatgtacac

SEQ ID NO: 265856 - DNA, 25 bp, Mus musculus
cccgagatggccgtgcccgatgtac

SEQ ID NO: 265857 - DNA, 25 bp, Mus musculus
gctcccgaaggtgcccgagatggcc

SEQ ID NO: 265858 - DNA, 25 bp, Mus musculus
tgtacaccttccagatgtacagctc

SEQ ID NO: 265859 - DNA, 25 bp, Mus musculus
aagctcccgaaggtgcccgagatgg

SEQ ID NO: 265860 - DNA, 25 bp, Mus musculus
cccaaagtccctgagatgaaagtcc

SEQ ID NO: 265861 - DNA, 25 bp, Mus musculus
agttccagagatgaagctaccagag

SEQ ID NO: 265862 - DNA, 25 bp, Mus musculus
ggccgtgccggatgtacgactcccg

SEQ ID NO: 265863 - DNA, 25 bp, Mus musculus
tgcccaaagtccctgagatgaaagt

SEQ ID NO: 265864 - DNA, 25 bp, Mus musculus
cctgagatgaaagtcccagagatga

SEQ ID NO: 265865 - DNA, 25 bp, Mus musculus
gaaagttccagagatgaagctacca

SEQ ID NO: 265866 - DNA, 25 bp, Mus musculus
gtccctgagatgaaagtcccagaga

SEQ ID NO: 265867 - DNA, 25 bp, Mus musculus
caaagtccctgagatgaaagtccca

SEQ ID NO: 265868 - DNA, 25 bp, Mus musculus
atggccgtgccggatgtacgactcc

SEQ ID NO: 265869 - DNA, 25 bp, Mus musculus
gacgttcgtcttccggaagtgcagc

SEQ ID NO: 265870 - DNA, 25 bp, Mus musculus
ggaagtgcagctgcccaaagtccct

SEQ ID NO: 265871 - DNA, 25 bp, Mus musculus
gtgcagctgcccaaagtccctgaga

SEQ ID NO: 265872 - DNA, 25 bp, Mus musculus
cagctgcccaaagtccctgagatga

SEQ ID NO: 265873 - DNA, 25 bp, Mus musculus
tgagatgaaagtcccagagatgaag

SEQ ID NO: 265874 - DNA, 25 bp, Mus musculus
cgacgaaagcgacactcagagcctg

SEQ ID NO: 265875 - DNA, 25 bp, Mus musculus
tgctctttctcagggacgccgtcgc

SEQ ID NO: 265876 - DNA, 25 bp, Mus musculus
ccgagaggctgctgcaccgggtacg

SEQ ID NO: 265877 - DNA, 25 bp, Mus musculus
ctcgtcagggcaagcccgggtccgt

SEQ ID NO: 265878 - DNA, 25 bp, Mus musculus
aagctcgctcctaccgcggcgctcg

SEQ ID NO: 265879 - DNA, 25 bp, Mus musculus
acggtgctctttctcagggacgccg

SEQ ID NO: 265880 - DNA, 25 bp, Mus musculus
tgaacggtgctctttctcagggacg

SEQ ID NO: 265881 - DNA, 25 bp, Mus musculus
cgtttctgaacggtgctctttctca

SEQ ID NO: 265882 - DNA, 25 bp, Mus musculus
cgggcgtttctgaacggtgctcttt

SEQ ID NO: 265883 - DNA, 25 bp, Mus musculus
agcgacactcagagcctgagagagg

SEQ ID NO: 265884 - DNA, 25 bp, Mus musculus
aaccttcgtgtgtgtagcgggcgtt

SEQ ID NO: 265885 - DNA, 25 bp, Mus musculus
cgaaagcgacactcagagcctgaga

SEQ ID NO: 265886 - DNA, 25 bp, Mus musculus
cttcgtgtgtgtagcgggcgtttct

SEQ ID NO: 265887 - DNA, 25 bp, Mus musculus
cggtgaggcgacgaaagcgacactc

SEQ ID NO: 265888 - DNA, 25 bp, Mus musculus
gctgcttatttatccgcgtcactcc

SEQ ID NO: 265889 - DNA, 25 bp, Mus musculus
gagagcccagcttttatagaaaacg

SEQ ID NO: 265890 - DNA, 25 bp, Mus musculus
ctaggtacggacgaaacagctgggc

SEQ ID NO: 265891 - DNA, 25 bp, Mus musculus
gccataaccgcggtctaggtacgga

SEQ ID NO: 265892 - DNA, 25 bp, Mus musculus
gccttcaccgtgaacgacgccataa

SEQ ID NO: 265893 - DNA, 25 bp, Mus musculus
cttgcccagaagataggccttcacc

SEQ ID NO: 265894 - DNA, 25 bp, Mus musculus
tccgggctgaagcagaagctgaagc

SEQ ID NO: 265895 - DNA, 25 bp, Mus musculus
aggcctcagcgtggggaacagcaca

SEQ ID NO: 265896 - DNA, 25 bp, Mus musculus
cctcaccgcggtagtgcgcctggaa

SEQ ID NO: 265897 - DNA, 25 bp, Mus musculus
ttagatgtaacctgagcggccgcct

SEQ ID NO: 265898 - DNA, 25 bp, Mus musculus
cgaaccgctggatgttagatgtaac

SEQ ID NO: 265899 - DNA, 25 bp, Mus musculus
cttgatgggacccttgaaaggtacg

SEQ ID NO: 265900 - DNA, 25 bp, Mus musculus
tctgcctggtcccaggtcttccggg

SEQ ID NO: 265901 - DNA, 25 bp, Mus musculus
cgttacggggagcaagcgaaccgct

SEQ ID NO: 265902 - DNA, 25 bp, Mus musculus
tgcacgtcagagtcttctactccag

SEQ ID NO: 265903 - DNA, 25 bp, Mus musculus
gagtgtctgacagttggcgcgaccc

SEQ ID NO: 265904 - DNA, 25 bp, Mus musculus
ttccggtatcaagggcaggacttcc

SEQ ID NO: 265905 - DNA, 25 bp, Mus musculus
gtgcagtctggcttccggtatcaag

SEQ ID NO: 265906 - DNA, 25 bp, Mus musculus
ctctcttgctggttggaggctagga

SEQ ID NO: 265907 - DNA, 25 bp, Mus musculus
cccacactctcttgctggttggagg

SEQ ID NO: 265908 - DNA, 25 bp, Mus musculus
tgttgtcatgtgatggtcgccgccc

SEQ ID NO: 265909 - DNA, 25 bp, Mus musculus
ctctgtgttgtcatgtgatggtcgc

SEQ ID NO: 265910 - DNA, 25 bp, Mus musculus
accgaggctctgtgttgtcatgtga

SEQ ID NO: 265911 - DNA, 25 bp, Mus musculus
gcgttcttcgcgaccgaggctctgt

SEQ ID NO: 265912 - DNA, 25 bp, Mus musculus
gggctagacttgatcctttctgatt

SEQ ID NO: 265913 - DNA, 25 bp, Mus musculus
agtacctgcacgtcagagtcttcta

SEQ ID NO: 265914 - DNA, 25 bp, Mus musculus
cagatcgcacagtacctgcacgtca

SEQ ID NO: 265915 - DNA, 25 bp, Mus musculus
tcctttctgattggcggcgttcttc

SEQ ID NO: 265916 - DNA, 25 bp, Mus musculus
ctgcgcgagccgttgggcctgactc

SEQ ID NO: 265917 - DNA, 25 bp, Mus musculus
cgtggtccataccactgcggcggcg

SEQ ID NO: 265918 - DNA, 25 bp, Mus musculus
ggcgggtgccgtggtccataccact

SEQ ID NO: 265919 - DNA, 25 bp, Mus musculus
tcgctgggccgtaccacccgtgccc

SEQ ID NO: 265920 - DNA, 25 bp, Mus musculus
ccctccgcgatggtcgcgtcctggc

SEQ ID NO: 265921 - DNA, 25 bp, Mus musculus
aggtgagtacgccagcgcgtgtccc

SEQ ID NO: 265922 - DNA, 25 bp, Mus musculus
ccgccggtgacaggtgagtacgcca

SEQ ID NO: 265923 - DNA, 25 bp, Mus musculus
aataaggagcgggaacgagctcagc

SEQ ID NO: 265924 - DNA, 25 bp, Mus musculus
tgctgccgccagttcataaataagg

SEQ ID NO: 265925 - DNA, 25 bp, Mus musculus
ttgggcctgactccgagaaggcgtc

SEQ ID NO: 265926 - DNA, 25 bp, Mus musculus
gagctctctctgagtgtgcgggctg

SEQ ID NO: 265927 - DNA, 25 bp, Mus musculus
gccagttcataaataaggagcggga

SEQ ID NO: 265928 - DNA, 25 bp, Mus musculus
tgactccgagaaggcgtcgccgccg

SEQ ID NO: 265929 - DNA, 25 bp, Mus musculus
cgttgctgccgccagttcataaata

SEQ ID NO: 265930 - DNA, 25 bp, Mus musculus
agggtcagcgttgctaccgagagaa

SEQ ID NO: 265931 - DNA, 25 bp, Mus musculus
ggcggccgcaggagtttcccacaat

SEQ ID NO: 265932 - DNA, 25 bp, Mus musculus
tggctgcggcgctcgacagcagcct

SEQ ID NO: 265933 - DNA, 25 bp, Mus musculus
cgttgctaccgagagaagaagttcc

SEQ ID NO: 265934 - DNA, 25 bp, Mus musculus
ccgagagaagaagttccgagaagcc

SEQ ID NO: 265935 - DNA, 25 bp, Mus musculus
ttccgagaagccattggcaagtacc

SEQ ID NO: 265936 - DNA, 25 bp, Mus musculus
agtaccaccgggcactgctgcagct

SEQ ID NO: 265937 - DNA, 25 bp, Mus musculus
accgggcactgctgcagctgaaggc

SEQ ID NO: 265938 - DNA, 25 bp, Mus musculus
agcggcgcctggtggagaacacaga

SEQ ID NO: 265939 - DNA, 25 bp, Mus musculus
acacagaggttgaatgttacgactc

SEQ ID NO: 265940 - DNA, 25 bp, Mus musculus
tacgactccctcactggtacggggc

SEQ ID NO: 265941 - DNA, 25 bp, Mus musculus
ttgaatgttacgactccctcactgg

SEQ ID NO: 265942 - DNA, 25 bp, Mus musculus
cattggcaagtaccaccgggcactg

SEQ ID NO: 265943 - DNA, 25 bp, Mus musculus
ccatggctctgctcggtcgggtcct

SEQ ID NO: 265944 - DNA, 25 bp, Mus musculus
tccgatacagaggataatgacacca

SEQ ID NO: 265945 - DNA, 25 bp, Mus musculus
tccacgtccacgagaggattggtgc

SEQ ID NO: 265946 - DNA, 25 bp, Mus musculus
tcgtcactgtcagagcgcagcaatg

SEQ ID NO: 265947 - DNA, 25 bp, Mus musculus
ctgtgtccacggctcacagcgtggg

SEQ ID NO: 265948 - DNA, 25 bp, Mus musculus
gcgcgtagagttacaatccgataca

SEQ ID NO: 265949 - DNA, 25 bp, Mus musculus
ggggtccttcttgaagctctccaac

SEQ ID NO: 265950 - DNA, 25 bp, Mus musculus
ccgagggtgccagacccaagcctgg

SEQ ID NO: 265951 - DNA, 25 bp, Mus musculus
gggctgtgtcttcgcggcgacctcc

SEQ ID NO: 265952 - DNA, 25 bp, Mus musculus
aagagactgtccagccagcgccgct

SEQ ID NO: 265953 - DNA, 25 bp, Mus musculus
gcactcagcagcgtggcacagctta

SEQ ID NO: 265954 - DNA, 25 bp, Mus musculus
agcgtggcacagcttagcagcgcca

SEQ ID NO: 265955 - DNA, 25 bp, Mus musculus
gtcgcagcgcctacgagctccgtgt

SEQ ID NO: 265956 - DNA, 25 bp, Mus musculus
cgcctgaacacaaggagaaggctcg

SEQ ID NO: 265957 - DNA, 25 bp, Mus musculus
gcgcagcaatgagcgcgtagagtta

SEQ ID NO: 265958 - DNA, 25 bp, Mus musculus
gcctcctcacgcgaggaacgcgtgg

SEQ ID NO: 265959 - DNA, 25 bp, Mus musculus
tctccacgccatacggcgcgataga

SEQ ID NO: 265960 - DNA, 25 bp, Mus musculus
ggcgcgatagactttgccaaagccc

SEQ ID NO: 265961 - DNA, 25 bp, Mus musculus
tgcagctcgtggaaggggatctcct

SEQ ID NO: 265962 - DNA, 25 bp, Mus musculus
ttgctggggaagacgcccacacggc

SEQ ID NO: 265963 - DNA, 25 bp, Mus musculus
ccgcacagtcctgggaaagcacctg

SEQ ID NO: 265964 - DNA, 25 bp, Mus musculus
cctcgtagtcgaacacggcggtcca

SEQ ID NO: 265965 - DNA, 25 bp, Mus musculus
gcttcacgcaggctgcccgcggaat

SEQ ID NO: 265966 - DNA, 25 bp, Mus musculus
gatgggagacagtccctgcggaccc

SEQ ID NO: 265967 - DNA, 25 bp, Mus musculus
ctccgctggagcgaaggaattaaaa

SEQ ID NO: 265968 - DNA, 25 bp, Mus musculus
gaaaaagcatcctcagccacgaccg

SEQ ID NO: 265969 - DNA, 25 bp, Mus musculus
atccctcggatttggctgtgcagga

SEQ ID NO: 265970 - DNA, 25 bp, Mus musculus
aggagaggcgttaggttcacctgtc

SEQ ID NO: 265971 - DNA, 25 bp, Mus musculus
tttcaaacgataggaccgatccctc

SEQ ID NO: 265972 - DNA, 25 bp, Mus musculus
tacgcaccttgagctatttgcatta

SEQ ID NO: 265973 - DNA, 25 bp, Mus musculus
atgttgatgcgtgtgtgagtgttta

SEQ ID NO: 265974 - DNA, 25 bp, Mus musculus
ctaggcttcatcgagttgagcactc

SEQ ID NO: 265975 - DNA, 25 bp, Mus musculus
ttgagcactcggcactacatttccc

SEQ ID NO: 265976 - DNA, 25 bp, Mus musculus
ctaccgcggcggaagtaaagcaact

SEQ ID NO: 265977 - DNA, 25 bp, Mus musculus
gtaaagcaacttccggtgccctggc

SEQ ID NO: 265978 - DNA, 25 bp, Mus musculus
ctatagcggacggtcgggtctttct

SEQ ID NO: 265979 - DNA, 25 bp, Mus musculus
gtctttctggtctgagtagggaatt

SEQ ID NO: 265980 - DNA, 25 bp, Mus musculus
tctgagtagggaattgctttgtgtc

SEQ ID NO: 265981 - DNA, 25 bp, Mus musculus
gctttgtgtcttcggtctctgcaga

SEQ ID NO: 265982 - DNA, 25 bp, Mus musculus
tctctgcagagtaaggccgggagtc

SEQ ID NO: 265983 - DNA, 25 bp, Mus musculus
ctctgcgtacgcaccttgagctatt

SEQ ID NO: 265984 - DNA, 25 bp, Mus musculus
tcaccgtgcttgtcgctttctctcg

SEQ ID NO: 265985 - DNA, 25 bp, Mus musculus
atttgcattatcaccgtgcttgtcg

SEQ ID NO: 265986 - DNA, 25 bp, Mus musculus
tgcttgtgacaactgtgttttccgg

SEQ ID NO: 265987 - DNA, 25 bp, Mus musculus
ggcccgagttgcacgccgggatctc

SEQ ID NO: 265988 - DNA, 25 bp, Mus musculus
gtgggcactcccacaagccactgga

SEQ ID NO: 265989 - DNA, 25 bp, Mus musculus
gcactcccacaagccactggactcg

SEQ ID NO: 265990 - DNA, 25 bp, Mus musculus
gactcggttttctgatgggctggcc

SEQ ID NO: 265991 - DNA, 25 bp, Mus musculus
tcggttttctgatgggctggcccga

SEQ ID NO: 265992 - DNA, 25 bp, Mus musculus
ttttctgatgggctggcccgagttg

SEQ ID NO: 265993 - DNA, 25 bp, Mus musculus
tgacaactgtgttttccgggaccac

SEQ ID NO: 265994 - DNA, 25 bp, Mus musculus
ttctgatgggctggcccgagttgca

SEQ ID NO: 265995 - DNA, 25 bp, Mus musculus
ggatctccgggacgctccaggcttc

SEQ ID NO: 265996 - DNA, 25 bp, Mus musculus
tgtgacaactgtgttttccgggacc

SEQ ID NO: 265997 - DNA, 25 bp, Mus musculus
ctttgcttgtgacaactgtgttttc

SEQ ID NO: 265998 - DNA, 25 bp, Mus musculus
gagaaccggaagtaccttttgctca

SEQ ID NO: 265999 - DNA, 25 bp, Mus musculus
agggctttgcttgtgacaactgtgt

SEQ ID NO: 266000 - DNA, 25 bp, Mus musculus
atgccagatctgcgagcggagccca

SEQ ID NO: 266001 - DNA, 25 bp, Mus musculus
gagaccgaagccaacctgaaatttc

SEQ ID NO: 266002 - DNA, 25 bp, Mus musculus
gccaacctgaaatttcttccgccga

SEQ ID NO: 266003 - DNA, 25 bp, Mus musculus
aaagatcggaccttccgcattagcg

SEQ ID NO: 266004 - DNA, 25 bp, Mus musculus
cgcattagcggcaccagaacaccaa

SEQ ID NO: 266005 - DNA, 25 bp, Mus musculus
ggcaccagaacaccaaaagcctatg

SEQ ID NO: 266006 - DNA, 25 bp, Mus musculus
aagcctatgcgctagtttcggcgtg

SEQ ID NO: 266007 - DNA, 25 bp, Mus musculus
tcggcgtggtgaccctaaaaaatgc

SEQ ID NO: 266008 - DNA, 25 bp, Mus musculus
aatgcagttatcaccagcaaagccc

SEQ ID NO: 266009 - DNA, 25 bp, Mus musculus
tactccatggagaccgaagccaacc

SEQ ID NO: 266010 - DNA, 25 bp, Mus musculus
tcttccgccgaccacaaagatcgga

SEQ ID NO: 266011 - DNA, 25 bp, Mus musculus
ggttctgcggggaactgattttctc

SEQ ID NO: 266012 - DNA, 25 bp, Mus musculus
ggtgaccctaaaaaatgcagttatc

SEQ ID NO: 266013 - DNA, 25 bp, Mus musculus
gctgcctcaggccttactccatgga

SEQ ID NO: 266014 - DNA, 25 bp, Mus musculus
gcgcgtgcgcagtaactcttgttct

SEQ ID NO: 266015 - DNA, 25 bp, Mus musculus
cgctgacgccaacggaagtccttca

SEQ ID NO: 266016 - DNA, 25 bp, Mus musculus
cggaagtccttcacatagagcatct

SEQ ID NO: 266017 - DNA, 25 bp, Mus musculus
tcacatagagcatcttgggaaacgt

SEQ ID NO: 266018 - DNA, 25 bp, Mus musculus
taaggtaccgctgcgggttgacctg

SEQ ID NO: 266019 - DNA, 25 bp, Mus musculus
gcgggaaactcttagccctgggctc

SEQ ID NO: 266020 - DNA, 25 bp, Mus musculus
tcgcgcgttgtgaaggtttctccag

SEQ ID NO: 266021 - DNA, 25 bp, Mus musculus
acggcttccgctgacgccaacggaa

SEQ ID NO: 266022 - DNA, 25 bp, Mus musculus
tgcagcccggccagtcacggcttcc

SEQ ID NO: 266023 - DNA, 25 bp, Mus musculus
agtaactcttgttctggcgccatcc

SEQ ID NO: 266024 - DNA, 25 bp, Mus musculus
gttctggcgccatcctgcttcgcgg

SEQ ID NO: 266025 - DNA, 25 bp, Mus musculus
gtttctccagtagatggcgcggccg

SEQ ID NO: 266026 - DNA, 25 bp, Mus musculus
tgtgaaggtttctccagtagatggc

SEQ ID NO: 266027 - DNA, 25 bp, Mus musculus
cccgcaaggatgttgcgcgtgcgca

SEQ ID NO: 266028 - DNA, 25 bp, Mus musculus
acttgggtcgcagatgaaagggccc

SEQ ID NO: 266029 - DNA, 25 bp, Mus musculus
tcgcgcgaccagaacgcagtaatga

SEQ ID NO: 266030 - DNA, 25 bp, Mus musculus
tcactccctgtcaacgataccttgg

SEQ ID NO: 266031 - DNA, 25 bp, Mus musculus
cccgggtaaatgaggatctccggct

SEQ ID NO: 266032 - DNA, 25 bp, Mus musculus
attgctttaggggatccgacttggg

SEQ ID NO: 266033 - DNA, 25 bp, Mus musculus
ggcctacaagcttgccgcctcagag

SEQ ID NO: 266034 - DNA, 25 bp, Mus musculus
aggttgcctgaatcgcgcgaccaga

SEQ ID NO: 266035 - DNA, 25 bp, Mus musculus
ttccacgtgcgaaagcctgagactc

SEQ ID NO: 266036 - DNA, 25 bp, Mus musculus
gtggttacgcgcttccgtcactcgc

SEQ ID NO: 266037 - DNA, 25 bp, Mus musculus
aggattcagaactcccacccaaggg

SEQ ID NO: 266038 - DNA, 25 bp, Mus musculus
cgacagagccggaaaaggattcaga

SEQ ID NO: 266039 - DNA, 25 bp, Mus musculus
tgaagccaggtaaggaccacggtgc

SEQ ID NO: 266040 - DNA, 25 bp, Mus musculus
gcttggatctccgagcattgcttta

SEQ ID NO: 266041 - DNA, 25 bp, Mus musculus
tccagaccctgacccagagttgggg

SEQ ID NO: 266042 - DNA, 25 bp, Mus musculus
gctgcacaatagctgaccctcattc

SEQ ID NO: 266043 - DNA, 25 bp, Mus musculus
tcattcatcaccactgtagccgcga

SEQ ID NO: 266044 - DNA, 25 bp, Mus musculus
tgaccctcattcatcaccactgtag

SEQ ID NO: 266045 - DNA, 25 bp, Mus musculus
cgcgactttcctggggcgcgctatt

SEQ ID NO: 266046 - DNA, 25 bp, Mus musculus
actgtagccgcgactttcctggggc

SEQ ID NO: 266047 - DNA, 25 bp, Mus musculus
tcatcaccactgtagccgcgacttt

SEQ ID NO: 266048 - DNA, 25 bp, Mus musculus
tctgtccctgctgcacaatagctga

SEQ ID NO: 266049 - DNA, 25 bp, Mus musculus
gagacttgggggaacaggcatctcc

SEQ ID NO: 266050 - DNA, 25 bp, Mus musculus
tgggatcttctgaaaggagacttgg

SEQ ID NO: 266051 - DNA, 25 bp, Mus musculus
gctcatgggatcttctgaaaggaga

SEQ ID NO: 266052 - DNA, 25 bp, Mus musculus
ggacttgctcatgggatcttctgaa

SEQ ID NO: 266053 - DNA, 25 bp, Mus musculus
gtagggacttgctcatgggatcttc

SEQ ID NO: 266054 - DNA, 25 bp, Mus musculus
aggtctaggtgtagggacttgctca

SEQ ID NO: 266055 - DNA, 25 bp, Mus musculus
cttgaaggtctaggtgtagggactt

SEQ ID NO: 266056 - DNA, 25 bp, Mus musculus
ggctgggccgccatctgctcatcga

SEQ ID NO: 266057 - DNA, 25 bp, Mus musculus
cagagtgcgctcgtgtctttgcgag

SEQ ID NO: 266058 - DNA, 25 bp, Mus musculus
tctttgcgagccctctgcggctgca

SEQ ID NO: 266059 - DNA, 25 bp, Mus musculus
tgcagagccaccgtgtgtcgcactc

SEQ ID NO: 266060 - DNA, 25 bp, Mus musculus
gtgtgtcgcactcggacctcaagcc

SEQ ID NO: 266061 - DNA, 25 bp, Mus musculus
gacctcaagccctttacttgtggtg

SEQ ID NO: 266062 - DNA, 25 bp, Mus musculus
ttgtggtgcttgtggcaaagctttc

SEQ ID NO: 266063 - DNA, 25 bp, Mus musculus
tggcaaagctttcaagcgatccagc

SEQ ID NO: 266064 - DNA, 25 bp, Mus musculus
tttcaagcgatccagccacctgtcg

SEQ ID NO: 266065 - DNA, 25 bp, Mus musculus
agctgccgctccagatgctgctgct

SEQ ID NO: 266066 - DNA, 25 bp, Mus musculus
gccaggtcctcgcaagggctatagc

SEQ ID NO: 266067 - DNA, 25 bp, Mus musculus
cctacacgtacacggtgcagctgga

SEQ ID NO: 266068 - DNA, 25 bp, Mus musculus
caagggctatagctgcccagagtgc

SEQ ID NO: 266069 - DNA, 25 bp, Mus musculus
atctgctcatcgacgccaacggggt

SEQ ID NO: 266070 - DNA, 25 bp, Mus musculus
tcagcacccttaaggcgcaggcgca

SEQ ID NO: 266071 - DNA, 25 bp, Mus musculus
gctgccctgagtgctaattggttaa

SEQ ID NO: 266072 - DNA, 25 bp, Mus musculus
cttcgctgtcgcctagcaacagctg

SEQ ID NO: 266073 - DNA, 25 bp, Mus musculus
ccgccctttgtttgggctcggctgc

SEQ ID NO: 266074 - DNA, 25 bp, Mus musculus
tggattcctggaagaggctgagccc

SEQ ID NO: 266075 - DNA, 25 bp, Mus musculus
cggagtccggctcttcatagctgga

SEQ ID NO: 266076 - DNA, 25 bp, Mus musculus
ccgcgagatttagcaagggaaagga

SEQ ID NO: 266077 - DNA, 25 bp, Mus musculus
acgccctcaggtaagggtgctgcga

SEQ ID NO: 266078 - DNA, 25 bp, Mus musculus
gacaccctcagccagtgggcaggtc

SEQ ID NO: 266079 - DNA, 25 bp, Mus musculus
gcattactgggtaatcggggccctg

SEQ ID NO: 266080 - DNA, 25 bp, Mus musculus
cgccattttgctggttgcattactg

SEQ ID NO: 266081 - DNA, 25 bp, Mus musculus
ccggtttgttgtggtcgccattttg

SEQ ID NO: 266082 - DNA, 25 bp, Mus musculus
gctccgctaggtcacgtgaatgatg

SEQ ID NO: 266083 - DNA, 25 bp, Mus musculus
attggttaagctcttggcagcaaca

SEQ ID NO: 266084 - DNA, 25 bp, Mus musculus
gtctcagcgagcagcggtgctgacc

SEQ ID NO: 266085 - DNA, 25 bp, Mus musculus
actacctggagaactacccgatcgc

SEQ ID NO: 266086 - DNA, 25 bp, Mus musculus
gcaaatgcccggaggacacgcgtgc

SEQ ID NO: 266087 - DNA, 25 bp, Mus musculus
gaggacacgcgtgcgcactgctcct

SEQ ID NO: 266088 - DNA, 25 bp, Mus musculus
actgctcctcggcttcgccgttgga

SEQ ID NO: 266089 - DNA, 25 bp, Mus musculus
gcttcgccgttggagctacgcctgc

SEQ ID NO: 266090 - DNA, 25 bp, Mus musculus
ctacgcctgcgcagacggcgagaca

SEQ ID NO: 266091 - DNA, 25 bp, Mus musculus
tgcgcagacggcgagacacgcgacc

SEQ ID NO: 266092 - DNA, 25 bp, Mus musculus
tacccgtgcgcattgcgctcgtgga

SEQ ID NO: 266093 - DNA, 25 bp, Mus musculus
tccgacatgtcgcagctgcccgcag

SEQ ID NO: 266094 - DNA, 25 bp, Mus musculus
ccctcagcgtcttgggcatcaatta

SEQ ID NO: 266095 - DNA, 25 bp, Mus musculus
gggcatcaattaccagcagttcctg

SEQ ID NO: 266096 - DNA, 25 bp, Mus musculus
ggcgatgccgtacatgcgcttccgc

SEQ ID NO: 266097 - DNA, 25 bp, Mus musculus
cagttcctgcgccactacctggaga

SEQ ID NO: 266098 - DNA, 25 bp, Mus musculus
ccgtggcggtaatggcacatggcac

SEQ ID NO: 266099 - DNA, 25 bp, Mus musculus
tagaggtccgggcacccgtccttgc

SEQ ID NO: 266100 - DNA, 25 bp, Mus musculus
cccgtccttgcgcaagcacttttgt

SEQ ID NO: 266101 - DNA, 25 bp, Mus musculus
gcacttttgttttccagggcgccga

SEQ ID NO: 266102 - DNA, 25 bp, Mus musculus
agccggtgcttctgaggattcaacg

SEQ ID NO: 266103 - DNA, 25 bp, Mus musculus
gaagcccaggaagacccgctggcca

SEQ ID NO: 266104 - DNA, 25 bp, Mus musculus
ccatgaacggcgtcggcgacgtcct

SEQ ID NO: 266105 - DNA, 25 bp, Mus musculus
tcctcctcctagagctgtacgagca

SEQ ID NO: 266106 - DNA, 25 bp, Mus musculus
acgagcagcggatgttccaacacta

SEQ ID NO: 266107 - DNA, 25 bp, Mus musculus
ccaggctgctccacgaaatcgagga

SEQ ID NO: 266108 - DNA, 25 bp, Mus musculus
tccacgaaatcgaggagcgccgccg

SEQ ID NO: 266109 - DNA, 25 bp, Mus musculus
cagggaggcggccttcgacgccaac

SEQ ID NO: 266110 - DNA, 25 bp, Mus musculus
tcaacggtggcaatgtccgagcttc

SEQ ID NO: 266111 - DNA, 25 bp, Mus musculus
gggcctgatggcgatcccgcacgtc

SEQ ID NO: 266112 - DNA, 25 bp, Mus musculus
gctttcgcacccgaggattctaaaa

SEQ ID NO: 266113 - DNA, 25 bp, Mus musculus
cttcagatctcaccgaatagacacc

SEQ ID NO: 266114 - DNA, 25 bp, Mus musculus
gctgctgtcttcagatctcaccgaa

SEQ ID NO: 266115 - DNA, 25 bp, Mus musculus
gattccaagctctgcgccagggagg

SEQ ID NO: 266116 - DNA, 25 bp, Mus musculus
tccagtcaggcggagattccaagct

SEQ ID NO: 266117 - DNA, 25 bp, Mus musculus
ctgttacaccgggttccagtcaggc

SEQ ID NO: 266118 - DNA, 25 bp, Mus musculus
tctaaaaaccgaagcaaccacgagc

SEQ ID NO: 266119 - DNA, 25 bp, Mus musculus
agagctttcgcacccgaggattcta

SEQ ID NO: 266120 - DNA, 25 bp, Mus musculus
ttccttgagcgaggagagctttcgc

SEQ ID NO: 266121 - DNA, 25 bp, Mus musculus
cgccctgcttccttgagcgaggaga

SEQ ID NO: 266122 - DNA, 25 bp, Mus musculus
tattcatggggaccaggtgagaccc

SEQ ID NO: 266123 - DNA, 25 bp, Mus musculus
cgcgccttgttattcatggggacca

SEQ ID NO: 266124 - DNA, 25 bp, Mus musculus
ggacccgcgccttgttattcatggg

SEQ ID NO: 266125 - DNA, 25 bp, Mus musculus
gcaaccacgagcaggcactgttaca

SEQ ID NO: 266126 - DNA, 25 bp, Mus musculus
aagtgggcgtagcaacggcctccat

SEQ ID NO: 266127 - DNA, 25 bp, Mus musculus
ctcggcggcgaacgtggatgaccaa

SEQ ID NO: 266128 - DNA, 25 bp, Mus musculus
ctcccgggtcccagaaagcaggcga

SEQ ID NO: 266129 - DNA, 25 bp, Mus musculus
cgcagtcgtccaggtcgtgctcgca

SEQ ID NO: 266130 - DNA, 25 bp, Mus musculus
cgagtcccggtatcctggccaggac

SEQ ID NO: 266131 - DNA, 25 bp, Mus musculus
accaagagtgcggcgccagccaaac

SEQ ID NO: 266132 - DNA, 25 bp, Mus musculus
cagaagaaagcgctgtggatccgcc

SEQ ID NO: 266133 - DNA, 25 bp, Mus musculus
aagcgctgtggatccgcctgcctca

SEQ ID NO: 266134 - DNA, 25 bp, Mus musculus
gaactcgcatctcacgcccatgtag

SEQ ID NO: 266135 - DNA, 25 bp, Mus musculus
cgccgaagcccagcgcacaggagca

SEQ ID NO: 266136 - DNA, 25 bp, Mus musculus
agcgcaacgcgtggcccaggtccag

SEQ ID NO: 266137 - DNA, 25 bp, Mus musculus
aacgcgtggcccaggtccaggcaga

SEQ ID NO: 266138 - DNA, 25 bp, Mus musculus
aggcgcagaccaggccagagaagtg

SEQ ID NO: 266139 - DNA, 25 bp, Mus musculus
tcccagaaagcaggcgagtcccggt

SEQ ID NO: 266140 - DNA, 25 bp, Mus musculus
tagggactcacacggggcttcgcac

SEQ ID NO: 266141 - DNA, 25 bp, Mus musculus
ggccgaccacacgtgctagcaggtt

SEQ ID NO: 266142 - DNA, 25 bp, Mus musculus
gtctacggccgaccacacgtgctag

SEQ ID NO: 266143 - DNA, 25 bp, Mus musculus
tgcctgtgcgctgcacatcgcgggc

SEQ ID NO: 266144 - DNA, 25 bp, Mus musculus
gcaactcccatgtgcctgtgcgctg

SEQ ID NO: 266145 - DNA, 25 bp, Mus musculus
gagaagtgcaactcccatgtgcctg

SEQ ID NO: 266146 - DNA, 25 bp, Mus musculus
cgcgcggtaggagaagtgcaactcc

SEQ ID NO: 266147 - DNA, 25 bp, Mus musculus
cagggtcgcagtcccgggccacacc

SEQ ID NO: 266148 - DNA, 25 bp, Mus musculus
tcacacggggcttcgcactcgtctg

SEQ ID NO: 266149 - DNA, 25 bp, Mus musculus
cgcgcttaagtagtagcgcagggca

SEQ ID NO: 266150 - DNA, 25 bp, Mus musculus
agggcacgcatagggactcacacgg

SEQ ID NO: 266151 - DNA, 25 bp, Mus musculus
acgcatagggactcacacggggctt

SEQ ID NO: 266152 - DNA, 25 bp, Mus musculus
cacacgtgctagcaggttccaggcg

SEQ ID NO: 266153 - DNA, 25 bp, Mus musculus
tcgcactcgtctgggaatggcgtgc

SEQ ID NO: 266154 - DNA, 25 bp, Mus musculus
cgtacgaggccatcaggcagcggca

SEQ ID NO: 266155 - DNA, 25 bp, Mus musculus
ccaagcatcgcggaagggcacacgt

SEQ ID NO: 266156 - DNA, 25 bp, Mus musculus
ggcacacgtacgaggccatcaggca

SEQ ID NO: 266157 - DNA, 25 bp, Mus musculus
agcggcagggcagccgctgactctc

SEQ ID NO: 266158 - DNA, 25 bp, Mus musculus
gcagccgctgactctccggggtgct

SEQ ID NO: 266159 - DNA, 25 bp, Mus musculus
actctccggggtgctccgtatagac

SEQ ID NO: 266160 - DNA, 25 bp, Mus musculus
gtgctccgtatagaccgggacgctc

SEQ ID NO: 266161 - DNA, 25 bp, Mus musculus
gctccgtatagaccgggacgctcgt

SEQ ID NO: 266162 - DNA, 25 bp, Mus musculus
ccgggacgctcgtgctcagtgctgc

SEQ ID NO: 266163 - DNA, 25 bp, Mus musculus
cgcccagggcgcacagggactcggt

SEQ ID NO: 266164 - DNA, 25 bp, Mus musculus
agactccgggcttcaggcagaccct

SEQ ID NO: 266165 - DNA, 25 bp, Mus musculus
ccgggcttcaggcagaccctgaaga

SEQ ID NO: 266166 - DNA, 25 bp, Mus musculus
cagaccctgaagaagaggcggcaag

SEQ ID NO: 266167 - DNA, 25 bp, Mus musculus
ggaagggcacacgtacgaggccatc

SEQ ID NO: 266168 - DNA, 25 bp, Mus musculus
ctgagcgcgaaattggaatactgtc

SEQ ID NO: 266169 - DNA, 25 bp, Mus musculus
ggaatactgtcatctggcaccacgc

SEQ ID NO: 266170 - DNA, 25 bp, Mus musculus
aggaccgccaccatccagtcgctcg

SEQ ID NO: 266171 - DNA, 25 bp, Mus musculus
gaaaacgcgggctccgtcccattca

SEQ ID NO: 266172 - DNA, 25 bp, Mus musculus
ctttcctctggctgagcgcgaaatt

SEQ ID NO: 266173 - DNA, 25 bp, Mus musculus
tgcgctcctagtcggtctttcctct

SEQ ID NO: 266174 - DNA, 25 bp, Mus musculus
acctttggtgcgctcctagtcggtc

SEQ ID NO: 266175 - DNA, 25 bp, Mus musculus
tacgaccaatgggatcgctgaggta

SEQ ID NO: 266176 - DNA, 25 bp, Mus musculus
cgcccaggcgaggactacgaccaat

SEQ ID NO: 266177 - DNA, 25 bp, Mus musculus
tccgcaagcgcgagaacagagccgc

SEQ ID NO: 266178 - DNA, 25 bp, Mus musculus
gacgcccaaaactttagagagaagc

SEQ ID NO: 266179 - DNA, 25 bp, Mus musculus
caccagacgcccaaaactttagaga

SEQ ID NO: 266180 - DNA, 25 bp, Mus musculus
ttcagcaccctgaggtgcggtctcc

SEQ ID NO: 266181 - DNA, 25 bp, Mus musculus
gtcccattcagcaccctgaggtgcg

SEQ ID NO: 266182 - DNA, 25 bp, Mus musculus
aactgttggctcgtccgtcctctaa

SEQ ID NO: 266183 - DNA, 25 bp, Mus musculus
acgcggactgtacggccgccatctt

SEQ ID NO: 266184 - DNA, 25 bp, Mus musculus
ctctaaacttccctcggaggtgtca

SEQ ID NO: 266185 - DNA, 25 bp, Mus musculus
cccagagctgaatcgggtgaactgt

SEQ ID NO: 266186 - DNA, 25 bp, Mus musculus
atcggcttctcctaacccagagctg

SEQ ID NO: 266187 - DNA, 25 bp, Mus musculus
aacgcgagactttaggggcctgctc

SEQ ID NO: 266188 - DNA, 25 bp, Mus musculus
actggcgcgtcagtctcacctaacg

SEQ ID NO: 266189 - DNA, 25 bp, Mus musculus
gcctgagcgctctctcgcgagaact

SEQ ID NO: 266190 - DNA, 25 bp, Mus musculus
tgcggatcacacaacgcctagctgg

SEQ ID NO: 266191 - DNA, 25 bp, Mus musculus
ttcgggctatggcagctagcacacc

SEQ ID NO: 266192 - DNA, 25 bp, Mus musculus
aagttgctgtcttcgctgtccgaca

SEQ ID NO: 266193 - DNA, 25 bp, Mus musculus
gacgggacagagattcggcttcaca

SEQ ID NO: 266194 - DNA, 25 bp, Mus musculus
tcgcgaacccgcgttgttcgggcta

SEQ ID NO: 266195 - DNA, 25 bp, Mus musculus
gccaaagtggtttacgcggactgta

SEQ ID NO: 266196 - DNA, 25 bp, Mus musculus
acctgagcctctcccatgctcgccc

SEQ ID NO: 266197 - DNA, 25 bp, Mus musculus
acgcagcgctcagcggccagaaagg

SEQ ID NO: 266198 - DNA, 25 bp, Mus musculus
tggtacgcagcgctcagcggccaga

SEQ ID NO: 266199 - DNA, 25 bp, Mus musculus
tgctcgccccacttgtttgcttttg

SEQ ID NO: 266200 - DNA, 25 bp, Mus musculus
gtttgcttttggcatcacgaaattc

SEQ ID NO: 266201 - DNA, 25 bp, Mus musculus
gcttttggcatcacgaaattccctg

SEQ ID NO: 266202 - DNA, 25 bp, Mus musculus
tttggcatcacgaaattccctggtc

SEQ ID NO: 266203 - DNA, 25 bp, Mus musculus
catcacgaaattccctggtcaggcc

SEQ ID NO: 266204 - DNA, 25 bp, Mus musculus
ggggagcgagtggttaccagatccc

SEQ ID NO: 266205 - DNA, 25 bp, Mus musculus
tggcgctcgggactggcctctgcct

SEQ ID NO: 266206 - DNA, 25 bp, Mus musculus
tggcctctgcctgcggttatcccat

SEQ ID NO: 266207 - DNA, 25 bp, Mus musculus
tgcctgcggttatcccatgccaggg

SEQ ID NO: 266208 - DNA, 25 bp, Mus musculus
ctgcggttatcccatgccaggggcg

SEQ ID NO: 266209 - DNA, 25 bp, Mus musculus
tgccgccgcctgctcaggcccgcac

SEQ ID NO: 266210 - DNA, 25 bp, Mus musculus
tgcaaacggggaaatgggctcatca

SEQ ID NO: 266211 - DNA, 25 bp, Mus musculus
tgcgcagaccctgaaaaatcggctg

SEQ ID NO: 266212 - DNA, 25 bp, Mus musculus
ctcgtgcttgtgctcggagctatgc

SEQ ID NO: 266213 - DNA, 25 bp, Mus musculus
gagctatgccgtccaagggtccgct

SEQ ID NO: 266214 - DNA, 25 bp, Mus musculus
gctgcagtccgtgcaggtcttcgga

SEQ ID NO: 266215 - DNA, 25 bp, Mus musculus
tgacgtagcactcaatgcgcctgcg

SEQ ID NO: 266216 - DNA, 25 bp, Mus musculus
agccacggctgtggcccactgcaaa

SEQ ID NO: 266217 - DNA, 25 bp, Mus musculus
gctcatcaaggtgaacggacgtccc

SEQ ID NO: 266218 - DNA, 25 bp, Mus musculus
ccctggagatgatcgagccgcgcac

SEQ ID NO: 266219 - DNA, 25 bp, Mus musculus
ccctggctgggtgacatgatgagct

SEQ ID NO: 266220 - DNA, 25 bp, Mus musculus
agcccgcttctgtcgtgacgtagca

SEQ ID NO: 266221 - DNA, 25 bp, Mus musculus
tcgacgtcagccgtaaagcccgctt

SEQ ID NO: 266222 - DNA, 25 bp, Mus musculus
cgcgcacgctgcagtacaaggtgtt

SEQ ID NO: 266223 - DNA, 25 bp, Mus musculus
gcctgaaggcgttcccgccgcaatt

SEQ ID NO: 266224 - DNA, 25 bp, Mus musculus
gcttctctccgcgacactttgcaga

SEQ ID NO: 266225 - DNA, 25 bp, Mus musculus
tttactcgcccacgcgagtgcggga

SEQ ID NO: 266226 - DNA, 25 bp, Mus musculus
gaggggctttactcgcccacgcgag

SEQ ID NO: 266227 - DNA, 25 bp, Mus musculus
cctcccacttgtgggacaaagggtg

SEQ ID NO: 266228 - DNA, 25 bp, Mus musculus
attctgggacccttcgccacggtcg

SEQ ID NO: 266229 - DNA, 25 bp, Mus musculus
cccatgccggttgcccattctggga

SEQ ID NO: 266230 - DNA, 25 bp, Mus musculus
ttgtaccctgagcacccaaaggcgg

SEQ ID NO: 266231 - DNA, 25 bp, Mus musculus
gcgggcctcacctgggctccaggaa

SEQ ID NO: 266232 - DNA, 25 bp, Mus musculus
cttactggtgggtgggcgcttctct

SEQ ID NO: 266233 - DNA, 25 bp, Mus musculus
ccgctacgcccgcttactggtgggt

SEQ ID NO: 266234 - DNA, 25 bp, Mus musculus
gattcggttagtgcccacgtctccg

SEQ ID NO: 266235 - DNA, 25 bp, Mus musculus
gcctgattcggttagtgcccacgtc

SEQ ID NO: 266236 - DNA, 25 bp, Mus musculus
cctgagcacccaaaggcggggaacg

SEQ ID NO: 266237 - DNA, 25 bp, Mus musculus
ccaggctcggcaggcctgattcggt

SEQ ID NO: 266238 - DNA, 25 bp, Mus musculus
cctcactcttctaggtagggctgtg

SEQ ID NO: 266239 - DNA, 25 bp, Mus musculus
tggggaggctcacaacccagactta

SEQ ID NO: 266240 - DNA, 25 bp, Mus musculus
acccagacttaaggtcgtgaacttg

SEQ ID NO: 266241 - DNA, 25 bp, Mus musculus
gaacttggggttctcggactccaga

SEQ ID NO: 266242 - DNA, 25 bp, Mus musculus
gaagatgctgcaaccctctactcga

SEQ ID NO: 266243 - DNA, 25 bp, Mus musculus
gtctggaccgtaacgcgcgatccct

SEQ ID NO: 266244 - DNA, 25 bp, Mus musculus
caccgggattccagagtttccagaa

SEQ ID NO: 266245 - DNA, 25 bp, Mus musculus
actggctaactcctcggtctcctgg

SEQ ID NO: 266246 - DNA, 25 bp, Mus musculus
gtgatggatgctgcagccctaagtc

SEQ ID NO: 266247 - DNA, 25 bp, Mus musculus
atgcacggccacagatcctacggtc

SEQ ID NO: 266248 - DNA, 25 bp, Mus musculus
tgcgggtctcttaaaacgcgggaca

SEQ ID NO: 266249 - DNA, 25 bp, Mus musculus
cgcctgggcccaagactatgaacgc

SEQ ID NO: 266250 - DNA, 25 bp, Mus musculus
taattgcaagcaagcggttccaacg

SEQ ID NO: 266251 - DNA, 25 bp, Mus musculus
ccgaagtctcggtgttctaaataga

SEQ ID NO: 266252 - DNA, 25 bp, Mus musculus
cgagtttatgttccaaagtcctccg

SEQ ID NO: 266253 - DNA, 25 bp, Mus musculus
gccagtcaggcgagaggtgacccca

SEQ ID NO: 266254 - DNA, 25 bp, Mus musculus
cccagacgggatggagtccgagttt

SEQ ID NO: 266255 - DNA, 25 bp, Mus musculus
cagacgggatggagtccgagtttat

SEQ ID NO: 266256 - DNA, 25 bp, Mus musculus
acgggatggagtccgagtttatgtt

SEQ ID NO: 266257 - DNA, 25 bp, Mus musculus
gggatggagtccgagtttatgttcc

SEQ ID NO: 266258 - DNA, 25 bp, Mus musculus
gatggagtccgagtttatgttccaa

SEQ ID NO: 266259 - DNA, 25 bp, Mus musculus
tggagtccgagtttatgttccaaag

SEQ ID NO: 266260 - DNA, 25 bp, Mus musculus
tccgagtttatgttccaaagtcctc

SEQ ID NO: 266261 - DNA, 25 bp, Mus musculus
atgttccaaagtcctccgagggatt

SEQ ID NO: 266262 - DNA, 25 bp, Mus musculus
agtttatgttccaaagtcctccgag

SEQ ID NO: 266263 - DNA, 25 bp, Mus musculus
ttatgttccaaagtcctccgaggga

SEQ ID NO: 266264 - DNA, 25 bp, Mus musculus
tgttccaaagtcctccgagggattc

SEQ ID NO: 266265 - DNA, 25 bp, Mus musculus
gagtccgagtttatgttccaaagtc

SEQ ID NO: 266266 - DNA, 25 bp, Mus musculus
caccagaaaaggtaaggtgacgtcg

SEQ ID NO: 266267 - DNA, 25 bp, Mus musculus
cttgccagtccggtttgtgggttct

SEQ ID NO: 266268 - DNA, 25 bp, Mus musculus
tcacgagcttgccagtccggtttgt

SEQ ID NO: 266269 - DNA, 25 bp, Mus musculus
ccctgttgtaaagcacttcacgagc

SEQ ID NO: 266270 - DNA, 25 bp, Mus musculus
gtttgtgggttctcggcctgagccc

SEQ ID NO: 266271 - DNA, 25 bp, Mus musculus
taggccaccagaaaaggtaaggtga

SEQ ID NO: 266272 - DNA, 25 bp, Mus musculus
ctctgagaggaacagggttcggtta

SEQ ID NO: 266273 - DNA, 25 bp, Mus musculus
tcgactggaggctctgagaggaaca

SEQ ID NO: 266274 - DNA, 25 bp, Mus musculus
atggctcatcgactggaggctctga

SEQ ID NO: 266275 - DNA, 25 bp, Mus musculus
gacaggtcatggctcatcgactgga

SEQ ID NO: 266276 - DNA, 25 bp, Mus musculus
gtcggatgacaggtcatggctcatc

SEQ ID NO: 266277 - DNA, 25 bp, Mus musculus
ttcctccgtggtcggatgacaggtc

SEQ ID NO: 266278 - DNA, 25 bp, Mus musculus
gattcggttcctccgtggtcggatg

SEQ ID NO: 266279 - DNA, 25 bp, Mus musculus
agcacttcacgagcttgccagtccg

SEQ ID NO: 266280 - DNA, 25 bp, Mus musculus
ccgcagcaggagctttctcctttta

SEQ ID NO: 266281 - DNA, 25 bp, Mus musculus
gcctaagtttggtgcgtcggggatc

SEQ ID NO: 266282 - DNA, 25 bp, Mus musculus
gccttggtgaagagaccgactgtcg

SEQ ID NO: 266283 - DNA, 25 bp, Mus musculus
agaagtcaggctgtggcccgcagca

SEQ ID NO: 266284 - DNA, 25 bp, Mus musculus
gttcgcagaagtcaggctgtggccc

SEQ ID NO: 266285 - DNA, 25 bp, Mus musculus
accgactgtcggttcgcagaagtca

SEQ ID NO: 266286 - DNA, 25 bp, Mus musculus
cgcgaatggccttggtgaagagacc

SEQ ID NO: 266287 - DNA, 25 bp, Mus musculus
cagagagatccatggtggcgcgaat

SEQ ID NO: 266288 - DNA, 25 bp, Mus musculus
tcacctcgtagatggcagagagatc

SEQ ID NO: 266289 - DNA, 25 bp, Mus musculus
aggtactcacctcgtagatggcaga

SEQ ID NO: 266290 - DNA, 25 bp, Mus musculus
tgctgtctaacaggtactcacctcg

SEQ ID NO: 266291 - DNA, 25 bp, Mus musculus
ggggatcccgggatgctgtctaaca

SEQ ID NO: 266292 - DNA, 25 bp, Mus musculus
gccactagagcttccgggacgcgcc

SEQ ID NO: 266293 - DNA, 25 bp, Mus musculus
ccgggatgctgtctaacaggtactc

SEQ ID NO: 266294 - DNA, 25 bp, Mus musculus
ggctgcttgcgacatcactgattcc

SEQ ID NO: 266295 - DNA, 25 bp, Mus musculus
tctcaaagtcggtacgccactcagc

SEQ ID NO: 266296 - DNA, 25 bp, Mus musculus
cttggatccggcgtctctcaaagtc

SEQ ID NO: 266297 - DNA, 25 bp, Mus musculus
cgacgctgtctgtgctcttacttca

SEQ ID NO: 266298 - DNA, 25 bp, Mus musculus
acctgtctagtcttctgcgtcttgg

SEQ ID NO: 266299 - DNA, 25 bp, Mus musculus
tttcgccaatcataagaggagttcc

SEQ ID NO: 266300 - DNA, 25 bp, Mus musculus
gttagccatgccttaccgacagatt

SEQ ID NO: 266301 - DNA, 25 bp, Mus musculus
tcagttggctgacctcctagttagc

SEQ ID NO: 266302 - DNA, 25 bp, Mus musculus
cgtcataaatgcgtctgctccggta

SEQ ID NO: 266303 - DNA, 25 bp, Mus musculus
tgtagcgctgcacaggatcgaagtc

SEQ ID NO: 266304 - DNA, 25 bp, Mus musculus
tggagactctccttcagttgcggga

SEQ ID NO: 266305 - DNA, 25 bp, Mus musculus
tccgaggccatgagtggaatatctt

SEQ ID NO: 266306 - DNA, 25 bp, Mus musculus
tctatttccctgaaggccttgcggc

SEQ ID NO: 266307 - DNA, 25 bp, Mus musculus
tcactgtgaaggactgaccaaactc

SEQ ID NO: 266308 - DNA, 25 bp, Mus musculus
gccactgtgcgccagcattagctca

SEQ ID NO: 266309 - DNA, 25 bp, Mus musculus
gcgcctcaagtgacacctcaagatg

SEQ ID NO: 266310 - DNA, 25 bp, Mus musculus
tcctggctcctggtatcgatcggcc

SEQ ID NO: 266311 - DNA, 25 bp, Mus musculus
ggatgacaatgctgcctcctggctc

SEQ ID NO: 266312 - DNA, 25 bp, Mus musculus
tcgccctttgggatgacaatgctgc

SEQ ID NO: 266313 - DNA, 25 bp, Mus musculus
tgtccggtagtaccatcgccctttg

SEQ ID NO: 266314 - DNA, 25 bp, Mus musculus
caattcctcattctggcgttcaagg

SEQ ID NO: 266315 - DNA, 25 bp, Mus musculus
tagcggcgaacccagtcacaattcc

SEQ ID NO: 266316 - DNA, 25 bp, Mus musculus
ctcgcgccggtctaactcagtagcg

SEQ ID NO: 266317 - DNA, 25 bp, Mus musculus
cgaagcccgcgattggacctacgga

SEQ ID NO: 266318 - DNA, 25 bp, Mus musculus
tctgacgagaaggtgacggacagac

SEQ ID NO: 266319 - DNA, 25 bp, Mus musculus
cctcactacgattggtctgacgaga

SEQ ID NO: 266320 - DNA, 25 bp, Mus musculus
tgacagacggtgagcccagccaact

SEQ ID NO: 266321 - DNA, 25 bp, Mus musculus
tagctcacaccctattgacagacgg

SEQ ID NO: 266322 - DNA, 25 bp, Mus musculus
cttgggtaacctccgccacttgatc

SEQ ID NO: 266323 - DNA, 25 bp, Mus musculus
gaacgtggcacctacgctgaccatg

SEQ ID NO: 266324 - DNA, 25 bp, Mus musculus
aagacgggcctgctctttgtgccac

SEQ ID NO: 266325 - DNA, 25 bp, Mus musculus
actgacaacttcattgcggctgtgc

SEQ ID NO: 266326 - DNA, 25 bp, Mus musculus
gtctcgcaacaccattggccaggta

SEQ ID NO: 266327 - DNA, 25 bp, Mus musculus
tgacgccttcctgtccaccgtggag

SEQ ID NO: 266328 - DNA, 25 bp, Mus musculus
caccgtggaggacctggatctatcc

SEQ ID NO: 266329 - DNA, 25 bp, Mus musculus
tgaacttgaacaccctcacgctgga

SEQ ID NO: 266330 - DNA, 25 bp, Mus musculus
aactcgtgcgcttggacatgacctc

SEQ ID NO: 266331 - DNA, 25 bp, Mus musculus
gtggcaacccgctgcactgcaactg

SEQ ID NO: 266332 - DNA, 25 bp, Mus musculus
tgcaactgtgaactgctctggcttc

SEQ ID NO: 266333 - DNA, 25 bp, Mus musculus
gcatctcactgaccgctatttctgg

SEQ ID NO: 266334 - DNA, 25 bp, Mus musculus
ccatcccggaggaggaatttctatg

SEQ ID NO: 266335 - DNA, 25 bp, Mus musculus
gtgcgtcgtcgagacttcgccaata

SEQ ID NO: 266336 - DNA, 25 bp, Mus musculus
ggcccatttcttgggcggcaccatg

SEQ ID NO: 266337 - DNA, 25 bp, Mus musculus
caccgaatggatgctggagagtacc

SEQ ID NO: 266338 - DNA, 25 bp, Mus musculus
ggccttcaccagcaccgaatggatg

SEQ ID NO: 266339 - DNA, 25 bp, Mus musculus
gggcgctgttccagagtcacagtta

SEQ ID NO: 266340 - DNA, 25 bp, Mus musculus
caacgctattccttcgacggggact

SEQ ID NO: 266341 - DNA, 25 bp, Mus musculus
cgaccgaggccacaacaacgctatt

SEQ ID NO: 266342 - DNA, 25 bp, Mus musculus
tgctgccctccgaggaaacttctgg

SEQ ID NO: 266343 - DNA, 25 bp, Mus musculus
cgaggcgacttccactgagctagag

SEQ ID NO: 266344 - DNA, 25 bp, Mus musculus
tgcggccatcgaggcaaaggccatg

SEQ ID NO: 266345 - DNA, 25 bp, Mus musculus
tgctctcagaccaacggcgcaggtg

SEQ ID NO: 266346 - DNA, 25 bp, Mus musculus
tctgctcatgattcgctacaaggtg

SEQ ID NO: 266347 - DNA, 25 bp, Mus musculus
gtagcctcggtcctcgttttcatcg

SEQ ID NO: 266348 - DNA, 25 bp, Mus musculus
ggcaccatgatcatcgccatcgggg

SEQ ID NO: 266349 - DNA, 25 bp, Mus musculus
gtgtgcaattcaccaccgcgggaga

SEQ ID NO: 266350 - DNA, 25 bp, Mus musculus
cagggttccctaaaaccactgattg

SEQ ID NO: 266351 - DNA, 25 bp, Mus musculus
acgactttcgcgtggcagagtccca

SEQ ID NO: 266352 - DNA, 25 bp, Mus musculus
accggtctaaccactggtcgcgaca

SEQ ID NO: 266353 - DNA, 25 bp, Mus musculus
tggcccagaactctgtgcccgcgta

SEQ ID NO: 266354 - DNA, 25 bp, Mus musculus
cgccgccatgttgaatccccaatga

SEQ ID NO: 266355 - DNA, 25 bp, Mus musculus
cccatggcaacggagctgaccgggt

SEQ ID NO: 266356 - DNA, 25 bp, Mus musculus
gggaaataacgactttcgcgtggca

SEQ ID NO: 266357 - DNA, 25 bp, Mus musculus
cagcgagccgggcagggttccctaa

SEQ ID NO: 266358 - DNA, 25 bp, Mus musculus
gaaaaggtgcgggatcgttgactcc

SEQ ID NO: 266359 - DNA, 25 bp, Mus musculus
accactgattggtgcgagtggccca

SEQ ID NO: 266360 - DNA, 25 bp, Mus musculus
cgagtggcccaatcggagaccgcta

SEQ ID NO: 266361 - DNA, 25 bp, Mus musculus
gcccaatcggagaccgctaggtgga

SEQ ID NO: 266362 - DNA, 25 bp, Mus musculus
tgaagagcagagattgggaagtttt

SEQ ID NO: 266363 - DNA, 25 bp, Mus musculus
gtctaaccactggtcgcgacagtcc

SEQ ID NO: 266364 - DNA, 25 bp, Mus musculus
gcaggagaaggaagactcagtcatc

SEQ ID NO: 266365 - DNA, 25 bp, Mus musculus
cgactgaagccgtggaacgtctcgc

SEQ ID NO: 266366 - DNA, 25 bp, Mus musculus
tggaacgtctcgcacaggcacgtac

SEQ ID NO: 266367 - DNA, 25 bp, Mus musculus
tcgcacaggcacgtacttcatctgc

SEQ ID NO: 266368 - DNA, 25 bp, Mus musculus
tctgcccaccgtcttccaccatctg

SEQ ID NO: 266369 - DNA, 25 bp, Mus musculus
atctgccgcacctgctggctaagga

SEQ ID NO: 266370 - DNA, 25 bp, Mus musculus
ctggctaaggagagcagtctgcagc

SEQ ID NO: 266371 - DNA, 25 bp, Mus musculus
cagtatccgtggtgatgggcattcc

SEQ ID NO: 266372 - DNA, 25 bp, Mus musculus
cgtacggcgcgaggtgcactcgtac

SEQ ID NO: 266373 - DNA, 25 bp, Mus musculus
gaggtgcactcgtacttgactgaca

SEQ ID NO: 266374 - DNA, 25 bp, Mus musculus
gcactcgtacttgactgacacattg

SEQ ID NO: 266375 - DNA, 25 bp, Mus musculus
ttgcactcgctcatctcggagctga

SEQ ID NO: 266376 - DNA, 25 bp, Mus musculus
tcagtcatcgtggtgctgatcgccg

SEQ ID NO: 266377 - DNA, 25 bp, Mus musculus
cttgactgacacattgcactcgctc

SEQ ID NO: 266378 - DNA, 25 bp, Mus musculus
cagacagcaggttagcgccgggaca

SEQ ID NO: 266379 - DNA, 25 bp, Mus musculus
caggtgcctcgggtctgaaagaacc

SEQ ID NO: 266380 - DNA, 25 bp, Mus musculus
gcctcgggtctgaaagaaccgtcca

SEQ ID NO: 266381 - DNA, 25 bp, Mus musculus
gaaccgtccaccgaaggtcgagagc

SEQ ID NO: 266382 - DNA, 25 bp, Mus musculus
tccaccgaaggtcgagagctgggac

SEQ ID NO: 266383 - DNA, 25 bp, Mus musculus
ctcggccaccgatgcgctgcagtat

SEQ ID NO: 266384 - DNA, 25 bp, Mus musculus
ccgatgcgctgcagtatttatgagc

SEQ ID NO: 266385 - DNA, 25 bp, Mus musculus
gtatttatgagcttgcagggacaca

SEQ ID NO: 266386 - DNA, 25 bp, Mus musculus
ccggctgcttcaggtgacgggctcc

SEQ ID NO: 266387 - DNA, 25 bp, Mus musculus
gacccagaaaagcatgggacgccgc

SEQ ID NO: 266388 - DNA, 25 bp, Mus musculus
agaaaagcatgggacgccgccacct

SEQ ID NO: 266389 - DNA, 25 bp, Mus musculus
acctgccctcgggacctggacaggt

SEQ ID NO: 266390 - DNA, 25 bp, Mus musculus
cacctccgagccagacagcaggtta

SEQ ID NO: 266391 - DNA, 25 bp, Mus musculus
ccgggacaggtaaggctgccctgtc

SEQ ID NO: 266392 - DNA, 25 bp, Mus musculus
cctgctgacactagcccgccgctgt

SEQ ID NO: 266393 - DNA, 25 bp, Mus musculus
gggaccatgggtgcctggatatcca

SEQ ID NO: 266394 - DNA, 25 bp, Mus musculus
tggatatccaggacccgggtcccga

SEQ ID NO: 266395 - DNA, 25 bp, Mus musculus
aggtcctggacctgagccgtctgcc

SEQ ID NO: 266396 - DNA, 25 bp, Mus musculus
ggagctgctcctgctggtactgagc

SEQ ID NO: 266397 - DNA, 25 bp, Mus musculus
tcctgctggtactgagccacgtgcc

SEQ ID NO: 266398 - DNA, 25 bp, Mus musculus
acgctgctgatgcactgccgccgag

SEQ ID NO: 266399 - DNA, 25 bp, Mus musculus
cgccctggtagatggccaggcccta

SEQ ID NO: 266400 - DNA, 25 bp, Mus musculus
attctgcgcactgagaccgctagga

SEQ ID NO: 266401 - DNA, 25 bp, Mus musculus
gttgctgctgctggcccgtgaccac

SEQ ID NO: 266402 - DNA, 25 bp, Mus musculus
tgcccacgaagacacgccctgcccg

SEQ ID NO: 266403 - DNA, 25 bp, Mus musculus
ccgctgggccaattctgcgcactga

SEQ ID NO: 266404 - DNA, 25 bp, Mus musculus
tgggccaattctgcgcactgagacc

SEQ ID NO: 266405 - DNA, 25 bp, Mus musculus
atggccaggccctatggttgctgct

SEQ ID NO: 266406 - DNA, 25 bp, Mus musculus
tgggagagttcgatccatccaagga

SEQ ID NO: 266407 - DNA, 25 bp, Mus musculus
gagcaccaccgtgtggacaggaaca

SEQ ID NO: 266408 - DNA, 25 bp, Mus musculus
tcacctaccgcttcaagcggtgatg

SEQ ID NO: 266409 - DNA, 25 bp, Mus musculus
gacaggaacaccgtggcgctgacca

SEQ ID NO: 266410 - DNA, 25 bp, Mus musculus
acgcccatcgcagagctactcattg

SEQ ID NO: 266411 - DNA, 25 bp, Mus musculus
tggctcccgaaaagctggctgaggt

SEQ ID NO: 266412 - DNA, 25 bp, Mus musculus
ccaaggagcgcctgctagagtattc

SEQ ID NO: 266413 - DNA, 25 bp, Mus musculus
tgctagagtattcccgccgctgctt

SEQ ID NO: 266414 - DNA, 25 bp, Mus musculus
cttcctggcactggacgacgagact

SEQ ID NO: 266415 - DNA, 25 bp, Mus musculus
gcactggacgacgagactctcaaga

SEQ ID NO: 266416 - DNA, 25 bp, Mus musculus
actctcaagaaggtgcaggctctca

SEQ ID NO: 266417 - DNA, 25 bp, Mus musculus
gtgcaggctctcaagaagagcaagc

SEQ ID NO: 266418 - DNA, 25 bp, Mus musculus
caagaagagcaagctgctcctgccc

SEQ ID NO: 266419 - DNA, 25 bp, Mus musculus
agctactcattgtggctcccgaaaa

SEQ ID NO: 266420 - DNA, 25 bp, Mus musculus
ctgtctctgctttcattctctggtt

SEQ ID NO: 266421 - DNA, 25 bp, Mus musculus
actcgagggtcgtgtccaaaccagc

SEQ ID NO: 266422 - DNA, 25 bp, Mus musculus
tgagctcccggacaggtacggacct

SEQ ID NO: 266423 - DNA, 25 bp, Mus musculus
gggttactcttcgactgcctccagc

SEQ ID NO: 266424 - DNA, 25 bp, Mus musculus
ctgagcatagaagaagacggtccac

SEQ ID NO: 266425 - DNA, 25 bp, Mus musculus
cgggctcactcaggctgcaacgttg

SEQ ID NO: 266426 - DNA, 25 bp, Mus musculus
gattggcagccacgtttcagggaca

SEQ ID NO: 266427 - DNA, 25 bp, Mus musculus
tgacgacggtgttaggaaaagctgc

SEQ ID NO: 266428 - DNA, 25 bp, Mus musculus
tgagcctttcgctagggaccaaaga

SEQ ID NO: 266429 - DNA, 25 bp, Mus musculus
cccgcgtgttgaacggttctgctaa

SEQ ID NO: 266430 - DNA, 25 bp, Mus musculus
ttctctggtttcaaatctgcggtca

SEQ ID NO: 266431 - DNA, 25 bp, Mus musculus
ggtcagagccacagctgagcctttc

SEQ ID NO: 266432 - DNA, 25 bp, Mus musculus
ttctgctaaagacggattctgcttc

SEQ ID NO: 266433 - DNA, 25 bp, Mus musculus
tctgcttccaagaaccgatcctgtc

SEQ ID NO: 266434 - DNA, 25 bp, Mus musculus
gttagtgacccgctgccggccagtg

SEQ ID NO: 266435 - DNA, 25 bp, Mus musculus
ccctcgcgacggcagatgactgaag

SEQ ID NO: 266436 - DNA, 25 bp, Mus musculus
gcagatgactgaagctcggcgcctg

SEQ ID NO: 266437 - DNA, 25 bp, Mus musculus
tcggcgcctggctctaaccaagctg

SEQ ID NO: 266438 - DNA, 25 bp, Mus musculus
cacgtgccgcctcgcgcgttagtga

SEQ ID NO: 266439 - DNA, 25 bp, Mus musculus
gtagatggcccaagtatatggctgc

SEQ ID NO: 266440 - DNA, 25 bp, Mus musculus
tatatggctgctgcaactggctcgc

SEQ ID NO: 266441 - DNA, 25 bp, Mus musculus
agggcagagccctctacgccttggc

SEQ ID NO: 266442 - DNA, 25 bp, Mus musculus
gacgagttcccattctgcgctctgg

SEQ ID NO: 266443 - DNA, 25 bp, Mus musculus
tctggcccgattctgcctgagagcg

SEQ ID NO: 266444 - DNA, 25 bp, Mus musculus
agagcgccgtttggccgcaacctca

SEQ ID NO: 266445 - DNA, 25 bp, Mus musculus
atccacaactcctgcggagaacgtg

SEQ ID NO: 266446 - DNA, 25 bp, Mus musculus
actcctgcggagaacgtgggtaccg

SEQ ID NO: 266447 - DNA, 25 bp, Mus musculus
tgcaggtgctgagccacgtgccgcc

SEQ ID NO: 266448 - DNA, 25 bp, Mus musculus
cagaacccaaggaggagtttcgcta

SEQ ID NO: 266449 - DNA, 25 bp, Mus musculus
ggctacagcgagcttccctacttgg

SEQ ID NO: 266450 - DNA, 25 bp, Mus musculus
acgagagggctacagcgagcttccc

SEQ ID NO: 266451 - DNA, 25 bp, Mus musculus
tgtacgaacacgcacgagagggcta

SEQ ID NO: 266452 - DNA, 25 bp, Mus musculus
gcatgcccagaaaaagccgcgcgct

SEQ ID NO: 266453 - DNA, 25 bp, Mus musculus
cctgcctgcgattgtgagtgcgctt

SEQ ID NO: 266454 - DNA, 25 bp, Mus musculus
gcgagcttccctacttggacatgga

SEQ ID NO: 266455 - DNA, 25 bp, Mus musculus
gtgtgcagccagaacccaaggagga

SEQ ID NO: 266456 - DNA, 25 bp, Mus musculus
tcccgaggacgctgcgtgtgcagcc

SEQ ID NO: 266457 - DNA, 25 bp, Mus musculus
ttcctggctcgccaggggctccggt

SEQ ID NO: 266458 - DNA, 25 bp, Mus musculus
atggcgcggctttggtggcctttcc

SEQ ID NO: 266459 - DNA, 25 bp, Mus musculus
ctacttggacatggagtcggtgtgc

SEQ ID NO: 266460 - DNA, 25 bp, Mus musculus
gaggagtttcgctacggagaaacga

SEQ ID NO: 266461 - DNA, 25 bp, Mus musculus
ggaacctcctgtacgaacacgcacg

SEQ ID NO: 266462 - DNA, 25 bp, Mus musculus
agtgcttccgccctatcgggaattc

SEQ ID NO: 266463 - DNA, 25 bp, Mus musculus
acagagcagtcggtgacagtcccga

SEQ ID NO: 266464 - DNA, 25 bp, Mus musculus
ttcttgtttccgctgccgtcacggg

SEQ ID NO: 266465 - DNA, 25 bp, Mus musculus
ttgtagttctctatcctatctcggc

SEQ ID NO: 266466 - DNA, 25 bp, Mus musculus
agcggttatggggatcgcattgcct

SEQ ID NO: 266467 - DNA, 25 bp, Mus musculus
ggcacattgtacgaaagcggttatg

SEQ ID NO: 266468 - DNA, 25 bp, Mus musculus
gtttgataacatgagaggcacattg

SEQ ID NO: 266469 - DNA, 25 bp, Mus musculus
ggcgccaggctttttgggatttgta

SEQ ID NO: 266470 - DNA, 25 bp, Mus musculus
cctttatcaatatggccgccggcgc

SEQ ID NO: 266471 - DNA, 25 bp, Mus musculus
ggtggacattcgctcgctgagtttc

SEQ ID NO: 266472 - DNA, 25 bp, Mus musculus
ctctgcgatgagctccagtgcttcc

SEQ ID NO: 266473 - DNA, 25 bp, Mus musculus
ccattcatcggcatccgcagttttc

SEQ ID NO: 266474 - DNA, 25 bp, Mus musculus
aggccgctgtcgcaccattcatcgg

SEQ ID NO: 266475 - DNA, 25 bp, Mus musculus
cacattttccagacgccctttatca

SEQ ID NO: 266476 - DNA, 25 bp, Mus musculus
gtctacgagccgcttgcaccgtaca

SEQ ID NO: 266477 - DNA, 25 bp, Mus musculus
cgtctctgacgtagacgcgggaccc

SEQ ID NO: 266478 - DNA, 25 bp, Mus musculus
cactaccgtctctgacgtagacgcg

SEQ ID NO: 266479 - DNA, 25 bp, Mus musculus
agcacgcccgaatgaggggcatacg

SEQ ID NO: 266480 - DNA, 25 bp, Mus musculus
tagtgcggacagcacgcccgaatga

SEQ ID NO: 266481 - DNA, 25 bp, Mus musculus
tagcctagtgcggacagcacgcccg

SEQ ID NO: 266482 - DNA, 25 bp, Mus musculus
gtgcgtcacctgctacgccttggcg

SEQ ID NO: 266483 - DNA, 25 bp, Mus musculus
gtgagtagtctacgagccgcttgca

SEQ ID NO: 266484 - DNA, 25 bp, Mus musculus
cccaggcgtgagtagtctacgagcc

SEQ ID NO: 266485 - DNA, 25 bp, Mus musculus
ggcgtgggcaccagtagctgcccca

SEQ ID NO: 266486 - DNA, 25 bp, Mus musculus
acctgcgggacgcacgtcgctgcgc

SEQ ID NO: 266487 - DNA, 25 bp, Mus musculus
ggccaagctcgccgccgagctggta

SEQ ID NO: 266488 - DNA, 25 bp, Mus musculus
ttgcaccgtacagggtttagcctag

SEQ ID NO: 266489 - DNA, 25 bp, Mus musculus
cagggtttagcctagtgcggacagc

SEQ ID NO: 266490 - DNA, 25 bp, Mus musculus
gtccctatgcgcaagcgcgtttcta

SEQ ID NO: 266491 - DNA, 25 bp, Mus musculus
agccctcgcgcttttttggtgggtg

SEQ ID NO: 266492 - DNA, 25 bp, Mus musculus
gaggacaggcgcttgcgcgtgcgca

SEQ ID NO: 266493 - DNA, 25 bp, Mus musculus
ggctctgcaggcaccgcactgcgca

SEQ ID NO: 266494 - DNA, 25 bp, Mus musculus
ttcctcttctttccgtgtccctatg

SEQ ID NO: 266495 - DNA, 25 bp, Mus musculus
tcttctttccgtgtccctatgcgca

SEQ ID NO: 266496 - DNA, 25 bp, Mus musculus
ctttccgtgtccctatgcgcaagcg

SEQ ID NO: 266497 - DNA, 25 bp, Mus musculus
ccgtgtccctatgcgcaagcgcgtt

SEQ ID NO: 266498 - DNA, 25 bp, Mus musculus
ccctatgcgcaagcgcgtttctaca

SEQ ID NO: 266499 - DNA, 25 bp, Mus musculus
agcgcgtttctacaaccacagccag

SEQ ID NO: 266500 - DNA, 25 bp, Mus musculus
tttctacaaccacagccagcgagcg

SEQ ID NO: 266501 - DNA, 25 bp, Mus musculus
caaccacagccagcgagcgggaagc

SEQ ID NO: 266502 - DNA, 25 bp, Mus musculus
gcagccctcgcgcttttttggtggg

SEQ ID NO: 266503 - DNA, 25 bp, Mus musculus
gcgcaagcgcgtttctacaaccaca

SEQ ID NO: 266504 - DNA, 25 bp, Mus musculus
gtcgtcttgttatagcggcgataag

SEQ ID NO: 266505 - DNA, 25 bp, Mus musculus
acctcgctgctaaagggcggtggcc

SEQ ID NO: 266506 - DNA, 25 bp, Mus musculus
gcttcggtgcccttgaccaacatgg

SEQ ID NO: 266507 - DNA, 25 bp, Mus musculus
cccttgaccaacatggcgaacgttc

SEQ ID NO: 266508 - DNA, 25 bp, Mus musculus
aacatggcgaacgttcgtgcccgcc

SEQ ID NO: 266509 - DNA, 25 bp, Mus musculus
tttttcttcgggagtaagtcgcaca

SEQ ID NO: 266510 - DNA, 25 bp, Mus musculus
agtaagtcgcacagctccggagctc

SEQ ID NO: 266511 - DNA, 25 bp, Mus musculus
ctccggagctccagaaatggctacc

SEQ ID NO: 266512 - DNA, 25 bp, Mus musculus
tccagaaatggctaccgcgatgaca

SEQ ID NO: 266513 - DNA, 25 bp, Mus musculus
gctaccgcgatgacagtttccagta

SEQ ID NO: 266514 - DNA, 25 bp, Mus musculus
ttccagtaaactccgcggcctgctg

SEQ ID NO: 266515 - DNA, 25 bp, Mus musculus
cggcctgctgatgcagcgtgagtta

SEQ ID NO: 266516 - DNA, 25 bp, Mus musculus
gaactaggtgggacctcgctgctaa

SEQ ID NO: 266517 - DNA, 25 bp, Mus musculus
ggctcgtttttgtgtcgtcttgtta

SEQ ID NO: 266518 - DNA, 25 bp, Mus musculus
caggagcgatctacctgcggcggcc

SEQ ID NO: 266519 - DNA, 25 bp, Mus musculus
aggtgagaaggggacaacttgcacc

SEQ ID NO: 266520 - DNA, 25 bp, Mus musculus
tccaacccgcccagaggaggtgaga

SEQ ID NO: 266521 - DNA, 25 bp, Mus musculus
accgcggcaactccggacgctccaa

SEQ ID NO: 266522 - DNA, 25 bp, Mus musculus
gcaccgggctcagttcgggagcatt

SEQ ID NO: 266523 - DNA, 25 bp, Mus musculus
tcgggagcattggagcaaagctgtc

SEQ ID NO: 266524 - DNA, 25 bp, Mus musculus
gcaaagctgtcagaaacgacggaag

SEQ ID NO: 266525 - DNA, 25 bp, Mus musculus
ggagaggttcaagtcccgtgccttc

SEQ ID NO: 266526 - DNA, 25 bp, Mus musculus
gtcctgcgggaacatccctgctgtc

SEQ ID NO: 266527 - DNA, 25 bp, Mus musculus
ctcaactggaaacggcgctggccca

SEQ ID NO: 266528 - DNA, 25 bp, Mus musculus
gaaagcagccggcagtcagcgctcc

SEQ ID NO: 266529 - DNA, 25 bp, Mus musculus
gccgccatctctcaactggaaacgg

SEQ ID NO: 266530 - DNA, 25 bp, Mus musculus
ggacaacttgcaccgggctcagttc

SEQ ID NO: 266531 - DNA, 25 bp, Mus musculus
ctcaccgtccggtgctgctggtgcg

SEQ ID NO: 266532 - DNA, 25 bp, Mus musculus
tggaacttcacatcctagagcaccg

SEQ ID NO: 266533 - DNA, 25 bp, Mus musculus
ggtgcttctttaagcccggcgccac

SEQ ID NO: 266534 - DNA, 25 bp, Mus musculus
gcgtggccacttcacagtggctgtg

SEQ ID NO: 266535 - DNA, 25 bp, Mus musculus
gccgccgaagtgtggatccctggct

SEQ ID NO: 266536 - DNA, 25 bp, Mus musculus
tagcgggcggtgcttctttaagccc

SEQ ID NO: 266537 - DNA, 25 bp, Mus musculus
gcagtcggtgcgcacccgggttcac

SEQ ID NO: 266538 - DNA, 25 bp, Mus musculus
ctgcctaggtctcgctggcggccag

SEQ ID NO: 266539 - DNA, 25 bp, Mus musculus
cgcacccgggttcacgagcgcaggt

SEQ ID NO: 266540 - DNA, 25 bp, Mus musculus
tcttcctgccctgtcgcagtcggtg

SEQ ID NO: 266541 - DNA, 25 bp, Mus musculus
tgagcattgcccgtccgggcctctg

SEQ ID NO: 266542 - DNA, 25 bp, Mus musculus
gtgcgagtactgagcattgcccgtc

SEQ ID NO: 266543 - DNA, 25 bp, Mus musculus
catcctagagcaccgggtgcgagta

SEQ ID NO: 266544 - DNA, 25 bp, Mus musculus
gctgccgtatctgcgatggaacttc

SEQ ID NO: 266545 - DNA, 25 bp, Mus musculus
gggacgctagccactctggccatca

SEQ ID NO: 266546 - DNA, 25 bp, Mus musculus
ctgttcgggccgtactggtacgcct

SEQ ID NO: 266547 - DNA, 25 bp, Mus musculus
tgacgcctgcgcagttcacttgccg

SEQ ID NO: 266548 - DNA, 25 bp, Mus musculus
gcccaagactgacgcctgcgcagtt

SEQ ID NO: 266549 - DNA, 25 bp, Mus musculus
tcagctgctttcagcccgcccaaga

SEQ ID NO: 266550 - DNA, 25 bp, Mus musculus
cattccgccgcctttcgctagcccg

SEQ ID NO: 266551 - DNA, 25 bp, Mus musculus
tgcgtggtagtccaccattccgccg

SEQ ID NO: 266552 - DNA, 25 bp, Mus musculus
ttctagcgggaacgcgcgcgtcacc

SEQ ID NO: 266553 - DNA, 25 bp, Mus musculus
tactggtacgcctggttcgctgcgt

SEQ ID NO: 266554 - DNA, 25 bp, Mus musculus
gggccatgtagtcgcccatgcttcc

SEQ ID NO: 266555 - DNA, 25 bp, Mus musculus
agtcatcctcctgggccatgtagtc

SEQ ID NO: 266556 - DNA, 25 bp, Mus musculus
aggccgggtccaacagcaggtcccg

SEQ ID NO: 266557 - DNA, 25 bp, Mus musculus
cgaacccgccaattgtctcccagga

SEQ ID NO: 266558 - DNA, 25 bp, Mus musculus
agcccaggcgcttctagcgggaacg

SEQ ID NO: 266559 - DNA, 25 bp, Mus musculus
gttcgctgcgtggtagtccaccatt

SEQ ID NO: 266560 - DNA, 25 bp, Mus musculus
cgcttggccagagagcgcccttcag

SEQ ID NO: 266561 - DNA, 25 bp, Mus musculus
agagcgcccttcagcggaattcaga

SEQ ID NO: 266562 - DNA, 25 bp, Mus musculus
tcagcggaattcagacctgtcgata

SEQ ID NO: 266563 - DNA, 25 bp, Mus musculus
tcagacctgtcgatacccttgagca

SEQ ID NO: 266564 - DNA, 25 bp, Mus musculus
cctgtcgatacccttgagcaacttg

SEQ ID NO: 266565 - DNA, 25 bp, Mus musculus
tacccttgagcaacttgcccacgtt

SEQ ID NO: 266566 - DNA, 25 bp, Mus musculus
acgttcgctctcatctgctcaaaca

SEQ ID NO: 266567 - DNA, 25 bp, Mus musculus
catctgctcaaacatcgccatgatc

SEQ ID NO: 266568 - DNA, 25 bp, Mus musculus
tcgccatgatcactgttgccttcgg

SEQ ID NO: 266569 - DNA, 25 bp, Mus musculus
atcactgttgccttcggcagcctca

SEQ ID NO: 266570 - DNA, 25 bp, Mus musculus
ttgccttcggcagcctcagctggag

SEQ ID NO: 266571 - DNA, 25 bp, Mus musculus
ctcagctggagtcgaacaccaggca

SEQ ID NO: 266572 - DNA, 25 bp, Mus musculus
tgcttagcactagaggaccggaaga

SEQ ID NO: 266573 - DNA, 25 bp, Mus musculus
tcgaacaccaggcacggtgcttagc

SEQ ID NO: 266574 - DNA, 25 bp, Mus musculus
ggagctccgtcactgtcaccttctt

SEQ ID NO: 266575 - DNA, 25 bp, Mus musculus
tcaccacgtcgaagatgaactggcg

SEQ ID NO: 266576 - DNA, 25 bp, Mus musculus
gccctcgttcaccacgtcgaagatg

SEQ ID NO: 266577 - DNA, 25 bp, Mus musculus
gaacatctccatcttctcggactcg

SEQ ID NO: 266578 - DNA, 25 bp, Mus musculus
gtcctcgcagaaactcacgaacatc

SEQ ID NO: 266579 - DNA, 25 bp, Mus musculus
gcatctcaaagatcgtgtcctcgca

SEQ ID NO: 266580 - DNA, 25 bp, Mus musculus
gatctgagctgcgatctgcatctca

SEQ ID NO: 266581 - DNA, 25 bp, Mus musculus
ctcgccctcaggctcggagatctga

SEQ ID NO: 266582 - DNA, 25 bp, Mus musculus
tgtcaccttcttggcgctgtctacc

SEQ ID NO: 266583 - DNA, 25 bp, Mus musculus
ggtccggcatgcctgccaggagctc

SEQ ID NO: 266584 - DNA, 25 bp, Mus musculus
ggaagggactcccatctgccacggc

SEQ ID NO: 266585 - DNA, 25 bp, Mus musculus
ccttctggccggaagggactcccat

SEQ ID NO: 266586 - DNA, 25 bp, Mus musculus
tccactggcgtcgtgtcacccatat

SEQ ID NO: 266587 - DNA, 25 bp, Mus musculus
tcgccgcaggctccggtagctcaga

SEQ ID NO: 266588 - DNA, 25 bp, Mus musculus
tctttaagccgaaaggagccgaagc

SEQ ID NO: 266589 - DNA, 25 bp, Mus musculus
aatcgggcttaatctctagaggggc

SEQ ID NO: 266590 - DNA, 25 bp, Mus musculus
ttggaagtgactgaccgcttggaca

SEQ ID NO: 266591 - DNA, 25 bp, Mus musculus
ggcgtgagaccttcccgaagcagtg

SEQ ID NO: 266592 - DNA, 25 bp, Mus musculus
agccgaacttccctcctgggcgtga

SEQ ID NO: 266593 - DNA, 25 bp, Mus musculus
gccttccgcgaggtcagttttttca

SEQ ID NO: 266594 - DNA, 25 bp, Mus musculus
tggctgctactgtcccacacacttt

SEQ ID NO: 266595 - DNA, 25 bp, Mus musculus
cgtccgagaacagccgacaggcttc

SEQ ID NO: 266596 - DNA, 25 bp, Mus musculus
gcaggcgtcccaagctgagctaaca

SEQ ID NO: 266597 - DNA, 25 bp, Mus musculus
gaatcctccgaacgttgaaacgcta

SEQ ID NO: 266598 - DNA, 25 bp, Mus musculus
ccgaaactcgggcagccggcataat

SEQ ID NO: 266599 - DNA, 25 bp, Mus musculus
ccggcataatcctcgcttcgggtga

SEQ ID NO: 266600 - DNA, 25 bp, Mus musculus
cgaacaccctttgtcgcactggctg

SEQ ID NO: 266601 - DNA, 25 bp, Mus musculus
cgagcgctggaaaccttcggaaaga

SEQ ID NO: 266602 - DNA, 25 bp, Mus musculus
agtactccaggatgctctcagccag

SEQ ID NO: 266603 - DNA, 25 bp, Mus musculus
cctggaagcggttcgcaaactcttc

SEQ ID NO: 266604 - DNA, 25 bp, Mus musculus
gctggttcctggaagcggttcgcaa

SEQ ID NO: 266605 - DNA, 25 bp, Mus musculus
ccaatgtcccgtgctggttcctgga

SEQ ID NO: 266606 - DNA, 25 bp, Mus musculus
cgttgaagccaatgtcccgtgctgg

SEQ ID NO: 266607 - DNA, 25 bp, Mus musculus
aagcagcaccgccacgttgaagcca

SEQ ID NO: 266608 - DNA, 25 bp, Mus musculus
ctctgacaggttggtaagcagcacc

SEQ ID NO: 266609 - DNA, 25 bp, Mus musculus
tcgtggggcacatgctctgacaggt

SEQ ID NO: 266610 - DNA, 25 bp, Mus musculus
aggatgctctcagccagctccagga

SEQ ID NO: 266611 - DNA, 25 bp, Mus musculus
caggtaaggccggaagtactccagg

SEQ ID NO: 266612 - DNA, 25 bp, Mus musculus
catgatttcgatgcggcccaggtaa

SEQ ID NO: 266613 - DNA, 25 bp, Mus musculus
acgcgatgcgcccatgatttcgatg

SEQ ID NO: 266614 - DNA, 25 bp, Mus musculus
cgttctatgcgacgcgatgcgccca

SEQ ID NO: 266615 - DNA, 25 bp, Mus musculus
gccagctccaggaagttgcgcaggc

SEQ ID NO: 266616 - DNA, 25 bp, Mus musculus
ctttacgatctcagggcccgatttc

SEQ ID NO: 266617 - DNA, 25 bp, Mus musculus
taggtgaggttctggcccacgccct

SEQ ID NO: 266618 - DNA, 25 bp, Mus musculus
agccaccgtggtgtaggtgaggttc

SEQ ID NO: 266619 - DNA, 25 bp, Mus musculus
tctccgaactggtgctgggcgatgt

SEQ ID NO: 266620 - DNA, 25 bp, Mus musculus
tcctcggaggcactctcgaagaagg

SEQ ID NO: 266621 - DNA, 25 bp, Mus musculus
atctcagggcccgatttcatcaccg

SEQ ID NO: 266622 - DNA, 25 bp, Mus musculus
ccttcacctgcgtgcgcgcctgcga

SEQ ID NO: 266623 - DNA, 25 bp, Mus musculus
gcagacccgcctttacgatctcagg

SEQ ID NO: 266624 - DNA, 25 bp, Mus musculus
aaggagcgcagacccgcctttacga

SEQ ID NO: 266625 - DNA, 25 bp, Mus musculus
accatcttctcaatgtcctcggagg

SEQ ID NO: 266626 - DNA, 25 bp, Mus musculus
tctcgaagaaggagcgcagacccgc

SEQ ID NO: 266627 - DNA, 25 bp, Mus musculus
ggatgacatcgtctccgaactggtg

SEQ ID NO: 266628 - DNA, 25 bp, Mus musculus
tgcgacacctttcctagccgcaggt

SEQ ID NO: 266629 - DNA, 25 bp, Mus musculus
ctagccgcaggttctccaccatctt

SEQ ID NO: 266630 - DNA, 25 bp, Mus musculus
agtccaccatgatggcgcggtgctc

SEQ ID NO: 266631 - DNA, 25 bp, Mus musculus
cacagccagacagaggtagcggttc

SEQ ID NO: 266632 - DNA, 25 bp, Mus musculus
tcgaagcaggtgctgcagcatggac

SEQ ID NO: 266633 - DNA, 25 bp, Mus musculus
ctgcagcatggacgggcggatatac

SEQ ID NO: 266634 - DNA, 25 bp, Mus musculus
tatacctgaggaggacaaggccaga

SEQ ID NO: 266635 - DNA, 25 bp, Mus musculus
gccagagagggcagagatattacgc

SEQ ID NO: 266636 - DNA, 25 bp, Mus musculus
tgcacagcgccatgaggcagtcctc

SEQ ID NO: 266637 - DNA, 25 bp, Mus musculus
gcagtcctcgatgacgtcgcgctgt

SEQ ID NO: 266638 - DNA, 25 bp, Mus musculus
tagcggttcagtgccagcgccatct

SEQ ID NO: 266639 - DNA, 25 bp, Mus musculus
cgcgacagccggtacactgtgtgta

SEQ ID NO: 266640 - DNA, 25 bp, Mus musculus
cactgtgtgtagcatggagtccacc

SEQ ID NO: 266641 - DNA, 25 bp, Mus musculus
cgaacaccaggcgtcgaagcaggtg

SEQ ID NO: 266642 - DNA, 25 bp, Mus musculus
tgcccgcaaagagtggcgcgcactt

SEQ ID NO: 266643 - DNA, 25 bp, Mus musculus
cgcacttggtgatgagcggcagcac

SEQ ID NO: 266644 - DNA, 25 bp, Mus musculus
atgaggaggtcgtagtagcctgctc

SEQ ID NO: 266645 - DNA, 25 bp, Mus musculus
gggacgaactggaactccacagagc

SEQ ID NO: 266646 - DNA, 25 bp, Mus musculus
gccttgtctcgcagagcctccagag

SEQ ID NO: 266647 - DNA, 25 bp, Mus musculus
ctggcagggcgaccacaaaacacgg

SEQ ID NO: 266648 - DNA, 25 bp, Mus musculus
agtggcacgatgtactcagagagca

SEQ ID NO: 266649 - DNA, 25 bp, Mus musculus
gtcgcgagcatgctgtcctccatca

SEQ ID NO: 266650 - DNA, 25 bp, Mus musculus
tagtagcctgctcgcagaggacctg

SEQ ID NO: 266651 - DNA, 25 bp, Mus musculus
agaggacctggcaagcgcgcatcct

SEQ ID NO: 266652 - DNA, 25 bp, Mus musculus
tcctccagcgcatgcaacagctgtg

SEQ ID NO: 266653 - DNA, 25 bp, Mus musculus
tgtgcctggtccacgtggctgcaca

SEQ ID NO: 266654 - DNA, 25 bp, Mus musculus
tgcacagggcatgagccacgcggtt

SEQ ID NO: 266655 - DNA, 25 bp, Mus musculus
cacgcggttgttgcccagggcacac

SEQ ID NO: 266656 - DNA, 25 bp, Mus musculus
cccagggcacacaccgagcggtaga

SEQ ID NO: 266657 - DNA, 25 bp, Mus musculus
ccgcacttcgcccaggtgggaaaag

SEQ ID NO: 266658 - DNA, 25 bp, Mus musculus
cccagtgtcagaaggtcacccgcta

SEQ ID NO: 266659 - DNA, 25 bp, Mus musculus
agtccagtctgagcgtcagagcccg

SEQ ID NO: 266660 - DNA, 25 bp, Mus musculus
acggtggcgcagtctccgccgcaga

SEQ ID NO: 266661 - DNA, 25 bp, Mus musculus
gatccgggcagtgcaacgcccgcag

SEQ ID NO: 266662 - DNA, 25 bp, Mus musculus
acacccacgggagtccagtctgagc

SEQ ID NO: 266663 - DNA, 25 bp, Mus musculus
agcgccctgaagtctgcacacgcgg

SEQ ID NO: 266664 - DNA, 25 bp, Mus musculus
gcacgcgtcagtgcgagtccctctg

SEQ ID NO: 266665 - DNA, 25 bp, Mus musculus
catccatggcaactccgtctgcgga

SEQ ID NO: 266666 - DNA, 25 bp, Mus musculus
gctgctatccaaccatattctcgtg

SEQ ID NO: 266667 - DNA, 25 bp, Mus musculus
atattctcgtgcgaaggcgcttcca

SEQ ID NO: 266668 - DNA, 25 bp, Mus musculus
cctattggcttggtcgcgcgccacg

SEQ ID NO: 266669 - DNA, 25 bp, Mus musculus
caaagctttggccacacccacggga

SEQ ID NO: 266670 - DNA, 25 bp, Mus musculus
gaggaagaagccatcaggaagcagc

SEQ ID NO: 266671 - DNA, 25 bp, Mus musculus
ggccttcaagctcgccgcaaagctt

SEQ ID NO: 266672 - DNA, 25 bp, Mus musculus
tgccagagacagagcagccagagca

SEQ ID NO: 266673 - DNA, 25 bp, Mus musculus
gagccggcgcactagcaggcgacct

SEQ ID NO: 266674 - DNA, 25 bp, Mus musculus
tctcggcacaccacaagcagctgag

SEQ ID NO: 266675 - DNA, 25 bp, Mus musculus
tggtacagcaagctctcggcacacc

SEQ ID NO: 266676 - DNA, 25 bp, Mus musculus
tgacaggcagtggtacagcaagctc

SEQ ID NO: 266677 - DNA, 25 bp, Mus musculus
gtcaccctcggcgtctgacaggcag

SEQ ID NO: 266678 - DNA, 25 bp, Mus musculus
agccacaacgtgctgcaacccagtg

SEQ ID NO: 266679 - DNA, 25 bp, Mus musculus
gctgcaacccagtgacaggcgcgca

SEQ ID NO: 266680 - DNA, 25 bp, Mus musculus
gcaggggcgcataacaacagagaca

SEQ ID NO: 266681 - DNA, 25 bp, Mus musculus
cgcataacaacagagacagggcact

SEQ ID NO: 266682 - DNA, 25 bp, Mus musculus
acagggcactgccagagacagagca

SEQ ID NO: 266683 - DNA, 25 bp, Mus musculus
acacgggtccgagaagtcaccctcg

SEQ ID NO: 266684 - DNA, 25 bp, Mus musculus
tggcctggctcacaagcacacgggt

SEQ ID NO: 266685 - DNA, 25 bp, Mus musculus
aagagtgctcggcagtgcacacagc

SEQ ID NO: 266686 - DNA, 25 bp, Mus musculus
tttttcttgggtgcccgccgtgtgc

SEQ ID NO: 266687 - DNA, 25 bp, Mus musculus
ctttttcttgggtgcccgccgtgtg

SEQ ID NO: 266688 - DNA, 25 bp, Mus musculus
ctggcctggggttcaccgctggccc

SEQ ID NO: 266689 - DNA, 25 bp, Mus musculus
cacactgtgcctgagggccggcctg

SEQ ID NO: 266690 - DNA, 25 bp, Mus musculus
cactgtgcctgagggccggcctgct

SEQ ID NO: 266691 - DNA, 25 bp, Mus musculus
tgctgccgcccaaaaagaactgaac

SEQ ID NO: 266692 - DNA, 25 bp, Mus musculus
gctgccgcccaaaaagaactgaacc

SEQ ID NO: 266693 - DNA, 25 bp, Mus musculus
tgcccctggccggtggtcttgagcc

SEQ ID NO: 266694 - DNA, 25 bp, Mus musculus
ttgagccgggccgttagaagagctt

SEQ ID NO: 266695 - DNA, 25 bp, Mus musculus
tgagccgggccgttagaagagcttt

SEQ ID NO: 266696 - DNA, 25 bp, Mus musculus
tagaagagctttttcttgggtgccc

SEQ ID NO: 266697 - DNA, 25 bp, Mus musculus
gaagagctttttcttgggtgcccgc

SEQ ID NO: 266698 - DNA, 25 bp, Mus musculus
agagctttttcttgggtgcccgccg

SEQ ID NO: 266699 - DNA, 25 bp, Mus musculus
tgccgcccaaaaagaactgaaccga

SEQ ID NO: 266700 - DNA, 25 bp, Mus musculus
cgtctggttccctggcagttccggg

SEQ ID NO: 266701 - DNA, 25 bp, Mus musculus
cccacagaaagtcaggtcagacaca

SEQ ID NO: 266702 - DNA, 25 bp, Mus musculus
tgagccgcagaatcactctggcctc

SEQ ID NO: 266703 - DNA, 25 bp, Mus musculus
agcaccatcaacttgcgatccgcag

SEQ ID NO: 266704 - DNA, 25 bp, Mus musculus
tggtcagggtgaccctccaagcctc

SEQ ID NO: 266705 - DNA, 25 bp, Mus musculus
ttctggaggcgagccatcgtggtca

SEQ ID NO: 266706 - DNA, 25 bp, Mus musculus
gggcacttcagtgcctcggatccgc

SEQ ID NO: 266707 - DNA, 25 bp, Mus musculus
gtggcgaaaacccacgggcacttca

SEQ ID NO: 266708 - DNA, 25 bp, Mus musculus
cgccgactgactggtgaaagttttt

SEQ ID NO: 266709 - DNA, 25 bp, Mus musculus
gaccttagaactgccctcgccagtg

SEQ ID NO: 266710 - DNA, 25 bp, Mus musculus
acgcctctagtggagcccgaggtga

SEQ ID NO: 266711 - DNA, 25 bp, Mus musculus
caggtcagacacagcagcgagggtc

SEQ ID NO: 266712 - DNA, 25 bp, Mus musculus
gctgcctgcgccatctaagtggcga

SEQ ID NO: 266713 - DNA, 25 bp, Mus musculus
gcagaacccgccgactgactggtga

SEQ ID NO: 266714 - DNA, 25 bp, Mus musculus
cagcaaggcactggccgcctttcga

SEQ ID NO: 266715 - DNA, 25 bp, Mus musculus
gttatccgtgaagaagggacttctg

SEQ ID NO: 266716 - DNA, 25 bp, Mus musculus
tggccctcgagaaccgaatacggct

SEQ ID NO: 266717 - DNA, 25 bp, Mus musculus
cggtggtagcaacggaacctccaca

SEQ ID NO: 266718 - DNA, 25 bp, Mus musculus
ggaacctccacagctggggcctcta

SEQ ID NO: 266719 - DNA, 25 bp, Mus musculus
agctggggcctctaacaagggaaca

SEQ ID NO: 266720 - DNA, 25 bp, Mus musculus
gacttctggagatggccctcgagaa

SEQ ID NO: 266721 - DNA, 25 bp, Mus musculus
cccaagactcgtacacgcaggaaca

SEQ ID NO: 266722 - DNA, 25 bp, Mus musculus
tgcaagtgctactgccgccatcaac

SEQ ID NO: 266723 - DNA, 25 bp, Mus musculus
ggccgcctttcgaggtgcttaattc

SEQ ID NO: 266724 - DNA, 25 bp, Mus musculus
tgcttaattcctgtccctgcaagtg

SEQ ID NO: 266725 - DNA, 25 bp, Mus musculus
ccgaatacggctccggtgactgaca

SEQ ID NO: 266726 - DNA, 25 bp, Mus musculus
ggctccggtgactgacagcagcagt

SEQ ID NO: 266727 - DNA, 25 bp, Mus musculus
tctaacaagggaacagcaaggcact

SEQ ID NO: 266728 - DNA, 25 bp, Mus musculus
cgcagcccgacccttaatgaacatg

SEQ ID NO: 266729 - DNA, 25 bp, Mus musculus
attcaaaatggcgaacggaagtccg

SEQ ID NO: 266730 - DNA, 25 bp, Mus musculus
aggcggagctaccactgccagtttc

SEQ ID NO: 266731 - DNA, 25 bp, Mus musculus
ccttaatgaacatgccgcagctccg

SEQ ID NO: 266732 - DNA, 25 bp, Mus musculus
tccgcctctgctgtcattcaaaatg

SEQ ID NO: 266733 - DNA, 25 bp, Mus musculus
tcctcggggtgtcttcgcagcccga

SEQ ID NO: 266734 - DNA, 25 bp, Mus musculus
cgggcaatggactcccggcggaaat

SEQ ID NO: 266735 - DNA, 25 bp, Mus musculus
atcttccgtgatgcggcaagccgcc

SEQ ID NO: 266736 - DNA, 25 bp, Mus musculus
cgctgtggccgccatcttccgtgat

SEQ ID NO: 266737 - DNA, 25 bp, Mus musculus
gacccgttcaccgtagccgctgtgg

SEQ ID NO: 266738 - DNA, 25 bp, Mus musculus
ctcgagacggtggtcgacccgttca

SEQ ID NO: 266739 - DNA, 25 bp, Mus musculus
ctgcctgcaggatcccgaccgaggt

SEQ ID NO: 266740 - DNA, 25 bp, Mus musculus
ccttgagttgctcgtacatgccggc

SEQ ID NO: 266741 - DNA, 25 bp, Mus musculus
tccggttccactcgtccttgagttg

SEQ ID NO: 266742 - DNA, 25 bp, Mus musculus
ctaaagcatgcacgcgacaggtttg

SEQ ID NO: 266743 - DNA, 25 bp, Mus musculus
tctcggccgtggcatctaaagcatg

SEQ ID NO: 266744 - DNA, 25 bp, Mus musculus
cgagatcccggacctggagtttcta

SEQ ID NO: 266745 - DNA, 25 bp, Mus musculus
gtcgacttcgggctcaacaatagga

SEQ ID NO: 266746 - DNA, 25 bp, Mus musculus
aggaacgtttccttcctgcctgaag

SEQ ID NO: 266747 - DNA, 25 bp, Mus musculus
ctgcctgaagtcttctcctcctaga

SEQ ID NO: 266748 - DNA, 25 bp, Mus musculus
tgctgccgctaaggtacggcctctt

SEQ ID NO: 266749 - DNA, 25 bp, Mus musculus
ttggcctcagttcccgcctcttatg

SEQ ID NO: 266750 - DNA, 25 bp, Mus musculus
cttatgtaagccgacgcccactcaa

SEQ ID NO: 266751 - DNA, 25 bp, Mus musculus
cttgcgctatcgtgagacctattgg

SEQ ID NO: 266752 - DNA, 25 bp, Mus musculus
ttgggtctctcgatactactggggc

SEQ ID NO: 266753 - DNA, 25 bp, Mus musculus
acggcctcttcccttacgtcattgg

SEQ ID NO: 266754 - DNA, 25 bp, Mus musculus
gcgggcccattccaaactgcggctg

SEQ ID NO: 266755 - DNA, 25 bp, Mus musculus
tttctaggtgtgcacagcccaggga

SEQ ID NO: 266756 - DNA, 25 bp, Mus musculus
cggggcacgtgagttcatttccgct

SEQ ID NO: 266757 - DNA, 25 bp, Mus musculus
tttgcctgccggtgtgtgtcttttt

SEQ ID NO: 266758 - DNA, 25 bp, Mus musculus
gctgcttttgtaccgctgtgcccgg

SEQ ID NO: 266759 - DNA, 25 bp, Mus musculus
gatggcttgtggctgcttttgtacc

SEQ ID NO: 266760 - DNA, 25 bp, Mus musculus
gtgttccagccgctgatggcttgtg

SEQ ID NO: 266761 - DNA, 25 bp, Mus musculus
tccgtcgcggcaagtccggtgttcc

SEQ ID NO: 266762 - DNA, 25 bp, Mus musculus
gcaatgctggcctccgtcgcggcaa

SEQ ID NO: 266763 - DNA, 25 bp, Mus musculus
tgcgcacgtgcgcacttctgcttcc

SEQ ID NO: 266764 - DNA, 25 bp, Mus musculus
cacgtgagttcatttccgcttccgg

SEQ ID NO: 266765 - DNA, 25 bp, Mus musculus
ataaggacgcgcagtcccgtgcgcc

SEQ ID NO: 266766 - DNA, 25 bp, Mus musculus
cgcaagggcataaggacgcgcagtc

SEQ ID NO: 266767 - DNA, 25 bp, Mus musculus
actgctgcgtagatgcggaagtgac

SEQ ID NO: 266768 - DNA, 25 bp, Mus musculus
gcgtctccactgctgcgtagatgcg

SEQ ID NO: 266769 - DNA, 25 bp, Mus musculus
ctgccaccttcggttgcttcccgtc

SEQ ID NO: 266770 - DNA, 25 bp, Mus musculus
tgcacacccgcaacaataaacctga

SEQ ID NO: 266771 - DNA, 25 bp, Mus musculus
ccagctgcgcatgtacctgactatg

SEQ ID NO: 266772 - DNA, 25 bp, Mus musculus
gcggctcaagatcctggcccaggca

SEQ ID NO: 266773 - DNA, 25 bp, Mus musculus
ggcgcggaaccagctgcgcatgtac

SEQ ID NO: 266774 - DNA, 25 bp, Mus musculus
cggacactgcggctcaagatcctgg

SEQ ID NO: 266775 - DNA, 25 bp, Mus musculus
agcctccacttctgaccggcagagg

SEQ ID NO: 266776 - DNA, 25 bp, Mus musculus
caataaacctgatgggctcggcgca

SEQ ID NO: 266777 - DNA, 25 bp, Mus musculus
aggtgctcatgtcgcctactgcaca

SEQ ID NO: 266778 - DNA, 25 bp, Mus musculus
tcctagccaaggtgctcatgtcgcc

SEQ ID NO: 266779 - DNA, 25 bp, Mus musculus
acactcatctcgcttgaccagggct

SEQ ID NO: 266780 - DNA, 25 bp, Mus musculus
ccaccttgtacggtgagctgcggcc

SEQ ID NO: 266781 - DNA, 25 bp, Mus musculus
gtactggctcaccttccaccttgta

SEQ ID NO: 266782 - DNA, 25 bp, Mus musculus
tgcgcagccggtactcatgtactgg

SEQ ID NO: 266783 - DNA, 25 bp, Mus musculus
tgtacctgactatggcagtggcagc

SEQ ID NO: 266784 - DNA, 25 bp, Mus musculus
cttttcggaaacctgtggctgtctg

SEQ ID NO: 266785 - DNA, 25 bp, Mus musculus
gtgactatggcgagagaaacttttc

SEQ ID NO: 266786 - DNA, 25 bp, Mus musculus
gctgtctgcccgctctgctttagcg

SEQ ID NO: 266787 - DNA, 25 bp, Mus musculus
gccttcgtgcttgcgctgtgactat

SEQ ID NO: 266788 - DNA, 25 bp, Mus musculus
gttggccacgacgtccttgcgcctt

SEQ ID NO: 266789 - DNA, 25 bp, Mus musculus
cagggacacaagagaaggtggcacc

SEQ ID NO: 266790 - DNA, 25 bp, Mus musculus
tccgaggagtactacggcgaatggc

SEQ ID NO: 266791 - DNA, 25 bp, Mus musculus
gtgcgacgccttagttgcctcccaa

SEQ ID NO: 266792 - DNA, 25 bp, Mus musculus
ccttttttctggcttttggcgcgtg

SEQ ID NO: 266793 - DNA, 25 bp, Mus musculus
gctcacaaagctgcgccatgacctg

SEQ ID NO: 266794 - DNA, 25 bp, Mus musculus
agcagcgaagctaccaaggcgagga

SEQ ID NO: 266795 - DNA, 25 bp, Mus musculus
acgtctagttctcggctggccacct

SEQ ID NO: 266796 - DNA, 25 bp, Mus musculus
gccctcaccgtggacgtctagttct

SEQ ID NO: 266797 - DNA, 25 bp, Mus musculus
ctgcgatcactctgcgcaccgagta

SEQ ID NO: 266798 - DNA, 25 bp, Mus musculus
gcgcgagtcacggtcaagtacgacc

SEQ ID NO: 266799 - DNA, 25 bp, Mus musculus
cggccattaagatcccggagcgcga

SEQ ID NO: 266800 - DNA, 25 bp, Mus musculus
ctgcagaagcggcacgcgcgagtca

SEQ ID NO: 266801 - DNA, 25 bp, Mus musculus
aagtacgaccgacgggagctgcagc

SEQ ID NO: 266802 - DNA, 25 bp, Mus musculus
gacggaggtagcctaagaccctgca

SEQ ID NO: 266803 - DNA, 25 bp, Mus musculus
ggtagcctaagaccctgcaaccctg

SEQ ID NO: 266804 - DNA, 25 bp, Mus musculus
ctgcgacctcggtgaccctagtact

SEQ ID NO: 266805 - DNA, 25 bp, Mus musculus
ctcggtgcttagaggcatccagctc

SEQ ID NO: 266806 - DNA, 25 bp, Mus musculus
gtacttgctcgctggtgcaccgact

SEQ ID NO: 266807 - DNA, 25 bp, Mus musculus
accgactgcggcctttgctaggatt

SEQ ID NO: 266808 - DNA, 25 bp, Mus musculus
tttgctaggattcatggcccgaggc

SEQ ID NO: 266809 - DNA, 25 bp, Mus musculus
cccgaggcgctggtctcggtgctta

SEQ ID NO: 266810 - DNA, 25 bp, Mus musculus
cggtgaccctagtacttgctcgctg

SEQ ID NO: 266811 - DNA, 25 bp, Mus musculus
cgcgtgctgagcaagctgcagtccc

SEQ ID NO: 266812 - DNA, 25 bp, Mus musculus
gtcgggttggaccactgtattcctc

SEQ ID NO: 266813 - DNA, 25 bp, Mus musculus
tcctagctttttgccacccgatgtc

SEQ ID NO: 266814 - DNA, 25 bp, Mus musculus
tcccagacctaaaagtcccgatgtc

SEQ ID NO: 266815 - DNA, 25 bp, Mus musculus
ctgcagagtggaagctaaggctctc

SEQ ID NO: 266816 - DNA, 25 bp, Mus musculus
ctccctttgggtttgtgctctactc

SEQ ID NO: 266817 - DNA, 25 bp, Mus musculus
gggcgcctcttctttgtcgctgtca

SEQ ID NO: 266818 - DNA, 25 bp, Mus musculus
tctactctcctcagagcgctggctg

SEQ ID NO: 266819 - DNA, 25 bp, Mus musculus
cccgctcaagtcgtgagtgtccctt

SEQ ID NO: 266820 - DNA, 25 bp, Mus musculus
caaagcagcatcctcttgtcgggtc

SEQ ID NO: 266821 - DNA, 25 bp, Mus musculus
acccgatgtcagcttcacctcttta

SEQ ID NO: 266822 - DNA, 25 bp, Mus musculus
taggggcttcactcgcctactcatc

SEQ ID NO: 266823 - DNA, 25 bp, Mus musculus
cgctgtcagtgaaggaatgtgccgc

SEQ ID NO: 266824 - DNA, 25 bp, Mus musculus
ttaggtaccggagcccttctggatc

SEQ ID NO: 266825 - DNA, 25 bp, Mus musculus
cagcgcgtggatggtataaatggta

SEQ ID NO: 266826 - DNA, 25 bp, Mus musculus
accgacccggcagggacctgctggg

SEQ ID NO: 266827 - DNA, 25 bp, Mus musculus
agggtgtttagcaagaatgatgtcc

SEQ ID NO: 266828 - DNA, 25 bp, Mus musculus
tgactgagggtgtttagcaagaatg

SEQ ID NO: 266829 - DNA, 25 bp, Mus musculus
tgtatgtgactgagggtgtttagca

SEQ ID NO: 266830 - DNA, 25 bp, Mus musculus
gaccgctgggaggaccgacccggca

SEQ ID NO: 266831 - DNA, 25 bp, Mus musculus
ggagcaagatggccacggtcatccc

SEQ ID NO: 266832 - DNA, 25 bp, Mus musculus
caggacccggggagcaagatggcca

SEQ ID NO: 266833 - DNA, 25 bp, Mus musculus
tttagcaagaatgatgtccgacgcg

SEQ ID NO: 266834 - DNA, 25 bp, Mus musculus
attggctgagatcctcgtgctcccg

SEQ ID NO: 266835 - DNA, 25 bp, Mus musculus
cccgccccctgggaatgaatggatg

SEQ ID NO: 266836 - DNA, 25 bp, Mus musculus
ctgattggctgagatcctcgtgctc

SEQ ID NO: 266837 - DNA, 25 bp, Mus musculus
ggcccgccctgccatcctgattggc

SEQ ID NO: 266838 - DNA, 25 bp, Mus musculus
gaatgaatggatgggcggcctcagc

SEQ ID NO: 266839 - DNA, 25 bp, Mus musculus
gggactaccactcccggcatggcct

SEQ ID NO: 266840 - DNA, 25 bp, Mus musculus
tgagcgcgcgtatccctggaaatag

SEQ ID NO: 266841 - DNA, 25 bp, Mus musculus
agtccggccagagttacctgagttg

SEQ ID NO: 266842 - DNA, 25 bp, Mus musculus
actagcaagcccagtgcagccatcg

SEQ ID NO: 266843 - DNA, 25 bp, Mus musculus
agccatctgaagagcgcagtccgta

SEQ ID NO: 266844 - DNA, 25 bp, Mus musculus
tcggcaggagcatctggagccatct

SEQ ID NO: 266845 - DNA, 25 bp, Mus musculus
tccagttctgctgattcggagggcc

SEQ ID NO: 266846 - DNA, 25 bp, Mus musculus
cccagcgttttgttcgaagatctcc

SEQ ID NO: 266847 - DNA, 25 bp, Mus musculus
tcacctgtagggagaagtaggctgc

SEQ ID NO: 266848 - DNA, 25 bp, Mus musculus
cggcgacacgtggaaagcccttcgt

SEQ ID NO: 266849 - DNA, 25 bp, Mus musculus
gcccttcgtgcagagatcacctgta

SEQ ID NO: 266850 - DNA, 25 bp, Mus musculus
gtggttcaccttggctgacacccga

SEQ ID NO: 266851 - DNA, 25 bp, Mus musculus
gtactcgctgcagtttaccctgcga

SEQ ID NO: 266852 - DNA, 25 bp, Mus musculus
cccgcaccttcgtggaagaagatgc

SEQ ID NO: 266853 - DNA, 25 bp, Mus musculus
acaggtagaacagtccgcacagggc

SEQ ID NO: 266854 - DNA, 25 bp, Mus musculus
tctcgcagggatgccctcaaccgtg

SEQ ID NO: 266855 - DNA, 25 bp, Mus musculus
agggatgccctcaaccgtggctgac

SEQ ID NO: 266856 - DNA, 25 bp, Mus musculus
gccctcaaccgtggctgaccaaaga

SEQ ID NO: 266857 - DNA, 25 bp, Mus musculus
ccgtggctgaccaaagacgttcttt

SEQ ID NO: 266858 - DNA, 25 bp, Mus musculus
tggctgaccaaagacgttctttgcg

SEQ ID NO: 266859 - DNA, 25 bp, Mus musculus
ggaggtctcgcagggatgccctcaa

SEQ ID NO: 266860 - DNA, 25 bp, Mus musculus
ctgctctggccccaggttgtccatg

SEQ ID NO: 266861 - DNA, 25 bp, Mus musculus
ggttgtccatgacgatgagcttctt

SEQ ID NO: 266862 - DNA, 25 bp, Mus musculus
ccatgacgatgagcttctttaggtc

SEQ ID NO: 266863 - DNA, 25 bp, Mus musculus
cgatgagcttctttaggtcgtcctc

SEQ ID NO: 266864 - DNA, 25 bp, Mus musculus
ggtcgtcctcgatggtcgacttgta

SEQ ID NO: 266865 - DNA, 25 bp, Mus musculus
ctcgatggtcgacttgtagttcttc

SEQ ID NO: 266866 - DNA, 25 bp, Mus musculus
gatggtcgacttgtagttcttccgt

SEQ ID NO: 266867 - DNA, 25 bp, Mus musculus
gagcttctttaggtcgtcctcgatg

SEQ ID NO: 266868 - DNA, 25 bp, Mus musculus
tggggtcctcccacatcgttttcaa

SEQ ID NO: 266869 - DNA, 25 bp, Mus musculus
tttctccctaagaagcagcgcgctg

SEQ ID NO: 266870 - DNA, 25 bp, Mus musculus
tccgggtccgagcagctatcaaatc

SEQ ID NO: 266871 - DNA, 25 bp, Mus musculus
taagtctgttcgtctccataggagc

SEQ ID NO: 266872 - DNA, 25 bp, Mus musculus
cgagtgacttccaggctgcccactt

SEQ ID NO: 266873 - DNA, 25 bp, Mus musculus
tcctgcccgaaggaggtggacacac

SEQ ID NO: 266874 - DNA, 25 bp, Mus musculus
atcgtagtctactggtcggtcggtg

SEQ ID NO: 266875 - DNA, 25 bp, Mus musculus
tcggctcgcggaacctttagccgtc

SEQ ID NO: 266876 - DNA, 25 bp, Mus musculus
gagtctactactccgagcctgcgag

SEQ ID NO: 266877 - DNA, 25 bp, Mus musculus
ggctgcgggactaaccgttctgtta

SEQ ID NO: 266878 - DNA, 25 bp, Mus musculus
atcgttttcaaggtagcttcccagg

SEQ ID NO: 266879 - DNA, 25 bp, Mus musculus
tcccttctcgggagtcctgtcacag

SEQ ID NO: 266880 - DNA, 25 bp, Mus musculus
ctgtcacaggtaacaggcgcggctc

SEQ ID NO: 266881 - DNA, 25 bp, Mus musculus
accaggagccacgtacctaggcgta

SEQ ID NO: 266882 - DNA, 25 bp, Mus musculus
gctgcagcgctgaccgcgctggcaa

SEQ ID NO: 266883 - DNA, 25 bp, Mus musculus
ggatacccgtcagctgggtggtccc

SEQ ID NO: 266884 - DNA, 25 bp, Mus musculus
ccctgggactcaggtggcccgttcg

SEQ ID NO: 266885 - DNA, 25 bp, Mus musculus
acagctgccgtgctgacgcgctgca

SEQ ID NO: 266886 - DNA, 25 bp, Mus musculus
gtcccgtccgtagcactttggtgcc

SEQ ID NO: 266887 - DNA, 25 bp, Mus musculus
gccgcgacttgcacggtggagatac

SEQ ID NO: 266888 - DNA, 25 bp, Mus musculus
tgcggcctacgctcttctccgggga

SEQ ID NO: 266889 - DNA, 25 bp, Mus musculus
gtggagataccctgtgcagaacctt

SEQ ID NO: 266890 - DNA, 25 bp, Mus musculus
gcagaaccttagattcccggcgggc

SEQ ID NO: 266891 - DNA, 25 bp, Mus musculus
gacacctcggacctaaggctgggca

SEQ ID NO: 266892 - DNA, 25 bp, Mus musculus
ccggactggtaactggtgaagcaga

SEQ ID NO: 266893 - DNA, 25 bp, Mus musculus
agtggccgaagcagcaaactcgggc

SEQ ID NO: 266894 - DNA, 25 bp, Mus musculus
cccggcctggctgtggacaaggacc

SEQ ID NO: 266895 - DNA, 25 bp, Mus musculus
gcccgttcgtgggtacagctgccgt

SEQ ID NO: 266896 - DNA, 25 bp, Mus musculus
ccctacgcatgcacggagtgcggca

SEQ ID NO: 266897 - DNA, 25 bp, Mus musculus
aagagcttccggcaggtagcgcacc

SEQ ID NO: 266898 - DNA, 25 bp, Mus musculus
gtagcgcacctcactcggcatcaga

SEQ ID NO: 266899 - DNA, 25 bp, Mus musculus
agctcggaccttcgagggcatcaga

SEQ ID NO: 266900 - DNA, 25 bp, Mus musculus
catcagaggtctcacgtgggcgaga

SEQ ID NO: 266901 - DNA, 25 bp, Mus musculus
ggacagctcatgctccaccagagga

SEQ ID NO: 266902 - DNA, 25 bp, Mus musculus
agtgccgcaagttcttccgccggta

SEQ ID NO: 266903 - DNA, 25 bp, Mus musculus
aagcccttcgactgcaaggagtgcg

SEQ ID NO: 266904 - DNA, 25 bp, Mus musculus
agctcaccctgcacgagaggatcca

SEQ ID NO: 266905 - DNA, 25 bp, Mus musculus
catcacaaactgcacacgggagaga

SEQ ID NO: 266906 - DNA, 25 bp, Mus musculus
gggcctccggctgcatcacaaactg

SEQ ID NO: 266907 - DNA, 25 bp, Mus musculus
gcagctcacgccacgagtgtaagga

SEQ ID NO: 266908 - DNA, 25 bp, Mus musculus
cggcatcagaggctcaacagtggca

SEQ ID NO: 266909 - DNA, 25 bp, Mus musculus
aaggcctttcgagtccgtggacagc

SEQ ID NO: 266910 - DNA, 25 bp, Mus musculus
tggaggatctcctaagcatcccata

SEQ ID NO: 266911 - DNA, 25 bp, Mus musculus
aggtggcggtgtctcccgtgtatac

SEQ ID NO: 266912 - DNA, 25 bp, Mus musculus
tctggaggacgtgtctgtggcatta

SEQ ID NO: 266913 - DNA, 25 bp, Mus musculus
gcgtgctgaggaacgtctggaggac

SEQ ID NO: 266914 - DNA, 25 bp, Mus musculus
ccctgagcttccctcggaggtgagc

SEQ ID NO: 266915 - DNA, 25 bp, Mus musculus
caggaggcgggaccctgagcttccc

SEQ ID NO: 266916 - DNA, 25 bp, Mus musculus
catagagcaggctgcctgtagtgga

SEQ ID NO: 266917 - DNA, 25 bp, Mus musculus
tctcctaagcatcccatagagcagg

SEQ ID NO: 266918 - DNA, 25 bp, Mus musculus
gttgtgtctggaggatctcctaagc

SEQ ID NO: 266919 - DNA, 25 bp, Mus musculus
acttgcgtcacgagagggttgtgtc

SEQ ID NO: 266920 - DNA, 25 bp, Mus musculus
cgagagttcggggtacttgcgtcac

SEQ ID NO: 266921 - DNA, 25 bp, Mus musculus
cgccgtttccgtttcctggcgagag

SEQ ID NO: 266922 - DNA, 25 bp, Mus musculus
gcatcccatagagcaggctgcctgt

SEQ ID NO: 266923 - DNA, 25 bp, Mus musculus
agcagaacgccgtttccgtttcctg

SEQ ID NO: 266924 - DNA, 25 bp, Mus musculus
ccgagtcccgcctgagacttgcgta

SEQ ID NO: 266925 - DNA, 25 bp, Mus musculus
agcgagcaccgggcgacgaacagcc

SEQ ID NO: 266926 - DNA, 25 bp, Mus musculus
ccgcctgagacttgcgtagctatcg

SEQ ID NO: 266927 - DNA, 25 bp, Mus musculus
gtcccgcctgagacttgcgtagcta

SEQ ID NO: 266928 - DNA, 25 bp, Mus musculus
tgggtaaccgagtcccgcctgagac

SEQ ID NO: 266929 - DNA, 25 bp, Mus musculus
ctctgggtaaccgagtcccgcctga

SEQ ID NO: 266930 - DNA, 25 bp, Mus musculus
cggcgccgacccaaagccctctggg

SEQ ID NO: 266931 - DNA, 25 bp, Mus musculus
cgtcacggcgccgacccaaagccct

SEQ ID NO: 266932 - DNA, 25 bp, Mus musculus
ctcggtatattgacgtcacggcgcc

SEQ ID NO: 266933 - DNA, 25 bp, Mus musculus
cccgctcggtatattgacgtcacgg

SEQ ID NO: 266934 - DNA, 25 bp, Mus musculus
aagcaccgcccagaagctcgcccag

SEQ ID NO: 266935 - DNA, 25 bp, Mus musculus
gaaccgccgcgcgacaagcaccgcc

SEQ ID NO: 266936 - DNA, 25 bp, Mus musculus
gggcgacgaacagccgccacccgcc

SEQ ID NO: 266937 - DNA, 25 bp, Mus musculus
cccgcctgagacttgcgtagctatc

SEQ ID NO: 266938 - DNA, 25 bp, Mus musculus
tgcacgtgcgccctctaaaggcagc

SEQ ID NO: 266939 - DNA, 25 bp, Mus musculus
catgaatgtcgtctttccggggccg

SEQ ID NO: 266940 - DNA, 25 bp, Mus musculus
cccaccaggacgaccgtgaactgga

SEQ ID NO: 266941 - DNA, 25 bp, Mus musculus
gtcaagtcggcgcttcatgaatgtc

SEQ ID NO: 266942 - DNA, 25 bp, Mus musculus
catcgcggcgatcctgccggagaga

SEQ ID NO: 266943 - DNA, 25 bp, Mus musculus
ggctgctgcacgtgcgccctctaaa

SEQ ID NO: 266944 - DNA, 25 bp, Mus musculus
gccctctaaaggcagcggccgggaa

SEQ ID NO: 266945 - DNA, 25 bp, Mus musculus
gcgcgggaaggcagactctgtacca

SEQ ID NO: 266946 - DNA, 25 bp, Mus musculus
ggaaggcagactctgtaccagactg

SEQ ID NO: 266947 - DNA, 25 bp, Mus musculus
cggcgcttcatgaatgtcgtctttc

SEQ ID NO: 266948 - DNA, 25 bp, Mus musculus
cccgccgctgcggtgcccacccgaa

SEQ ID NO: 266949 - DNA, 25 bp, Mus musculus
cgaaggacaaccaaccctcgtgttg

SEQ ID NO: 266950 - DNA, 25 bp, Mus musculus
ggacaaccaaccctcgtgttgcgct

SEQ ID NO: 266951 - DNA, 25 bp, Mus musculus
gcagactctgtaccagactgtgggg

SEQ ID NO: 266952 - DNA, 25 bp, Mus musculus
gcgggttttgtagcagcggctaccc

SEQ ID NO: 266953 - DNA, 25 bp, Mus musculus
aaggctcacagcctccgggctacgg

SEQ ID NO: 266954 - DNA, 25 bp, Mus musculus
cgagcaaattatagtcacatcacgg

SEQ ID NO: 266955 - DNA, 25 bp, Mus musculus
cacaaacctgggtccgctaggcgca

SEQ ID NO: 266956 - DNA, 25 bp, Mus musculus
gcacataaaggataacgagcaaatt

SEQ ID NO: 266957 - DNA, 25 bp, Mus musculus
agggtagcacttcccagagggccgc

SEQ ID NO: 266958 - DNA, 25 bp, Mus musculus
ttatagtcacatcacggctgctgca

SEQ ID NO: 266959 - DNA, 25 bp, Mus musculus
acggctgctgcaaaccgcaggcatc

SEQ ID NO: 266960 - DNA, 25 bp, Mus musculus
tggcttccacccagcacaaagagtc

SEQ ID NO: 266961 - DNA, 25 bp, Mus musculus
gcttccgggactcaacgctgagccg

SEQ ID NO: 266962 - DNA, 25 bp, Mus musculus
tgagccgggccacgggtctcgatcc

SEQ ID NO: 266963 - DNA, 25 bp, Mus musculus
tgctgctaggctgggaaagaagacc

SEQ ID NO: 266964 - DNA, 25 bp, Mus musculus
gctaggcgcagggtagcacttccca

SEQ ID NO: 266965 - DNA, 25 bp, Mus musculus
cgttcgtaaaggcacataaaggata

SEQ ID NO: 266966 - DNA, 25 bp, Mus musculus
cctggggagaaacgaaggactgctt

SEQ ID NO: 266967 - DNA, 25 bp, Mus musculus
tgaatcactcacataataacaattg

SEQ ID NO: 266968 - DNA, 25 bp, Mus musculus
ctgaattaaacctggtgtgttatca

SEQ ID NO: 266969 - DNA, 25 bp, Mus musculus
gtagtaaatgatgctgaattaaacc

SEQ ID NO: 266970 - DNA, 25 bp, Mus musculus
tcatgggtaactgttgtagtaaatg

SEQ ID NO: 266971 - DNA, 25 bp, Mus musculus
agctttctgagaggacattttcatg

SEQ ID NO: 266972 - DNA, 25 bp, Mus musculus
gcccacactcagctttctgagagga

SEQ ID NO: 266973 - DNA, 25 bp, Mus musculus
tgtccacactcagctttcttttctt

SEQ ID NO: 266974 - DNA, 25 bp, Mus musculus
agggttatgtccacactcagctttc

SEQ ID NO: 266975 - DNA, 25 bp, Mus musculus
ctcagccagggttatgtccacactc

SEQ ID NO: 266976 - DNA, 25 bp, Mus musculus
gcccaaactgcctcagccagggtta

SEQ ID NO: 266977 - DNA, 25 bp, Mus musculus
tttgttgtagtaaatacctctccca

SEQ ID NO: 266978 - DNA, 25 bp, Mus musculus
cgaaggactgctttgttgtagtaaa

SEQ ID NO: 266979 - DNA, 25 bp, Mus musculus
ctggtgtgttatcattaaatgaatc

SEQ ID NO: 266980 - DNA, 25 bp, Mus musculus
acctctccacgggagaggcacgggt

SEQ ID NO: 266981 - DNA, 25 bp, Mus musculus
ggctcggagtatcccgggtcacagc

SEQ ID NO: 266982 - DNA, 25 bp, Mus musculus
cgggtcacagctttgcggagagctc

SEQ ID NO: 266983 - DNA, 25 bp, Mus musculus
ccagccgagctctgaccggaagttg

SEQ ID NO: 266984 - DNA, 25 bp, Mus musculus
catgactcctgtccctagcacagga

SEQ ID NO: 266985 - DNA, 25 bp, Mus musculus
ctagcacaggaaacgccagccgagc

SEQ ID NO: 266986 - DNA, 25 bp, Mus musculus
gtccttctgggagcacctgtgctct

SEQ ID NO: 266987 - DNA, 25 bp, Mus musculus
gggagcacctgtgctctgggacata

SEQ ID NO: 266988 - DNA, 25 bp, Mus musculus
ctctgggacataacgggcgcgcgct

SEQ ID NO: 266989 - DNA, 25 bp, Mus musculus
atgccgcgtctctgaggttgcgtct

SEQ ID NO: 266990 - DNA, 25 bp, Mus musculus
gcgcctcctctggttgttccggaaa

SEQ ID NO: 266991 - DNA, 25 bp, Mus musculus
gcgctaatgggctcagccacctcgg

SEQ ID NO: 266992 - DNA, 25 bp, Mus musculus
cgtctcgccgcgctaatgggctcag

SEQ ID NO: 266993 - DNA, 25 bp, Mus musculus
cagaaggcgggactcaagcctgttc

SEQ ID NO: 266994 - DNA, 25 bp, Mus musculus
caagcacgtcaggaattttcgggta

SEQ ID NO: 266995 - DNA, 25 bp, Mus musculus
gcagcgcgaactccgccatggggca

SEQ ID NO: 266996 - DNA, 25 bp, Mus musculus
acttcgggttcctccgcttctgacg

SEQ ID NO: 266997 - DNA, 25 bp, Mus musculus
ggcgaactctgcgtcactgctgatg

SEQ ID NO: 266998 - DNA, 25 bp, Mus musculus
aatcaaaggaaacccgctgcccgag

SEQ ID NO: 266999 - DNA, 25 bp, Mus musculus
gaggcgctccatgaccgcgctgtgc

SEQ ID NO: 267000 - DNA, 25 bp, Mus musculus
tcgggtatttaaactgaacactctg

SEQ ID NO: 267001 - DNA, 25 bp, Mus musculus
gtgaactgtgactgacgggaaccta

SEQ ID NO: 267002 - DNA, 25 bp, Mus musculus
gaagagccacgttttctgaacaccg

SEQ ID NO: 267003 - DNA, 25 bp, Mus musculus
aagcagtcccttccgggttcgtgag

SEQ ID NO: 267004 - DNA, 25 bp, Mus musculus
cgttttcgggagtgagtattgctgt

SEQ ID NO: 267005 - DNA, 25 bp, Mus musculus
atccgcgccggaagaggcgttttcg

SEQ ID NO: 267006 - DNA, 25 bp, Mus musculus
tgatggaccgaagctctagccaatc

SEQ ID NO: 267007 - DNA, 25 bp, Mus musculus
agacacagcctcgtagcgggcctca

SEQ ID NO: 267008 - DNA, 25 bp, Mus musculus
gccaactaaagacaaacctacgctg

SEQ ID NO: 267009 - DNA, 25 bp, Mus musculus
tgtctttttgtacggagggccctca

SEQ ID NO: 267010 - DNA, 25 bp, Mus musculus
gagggccctcactctgaggttcaca

SEQ ID NO: 267011 - DNA, 25 bp, Mus musculus
agaactcagagccatgctgggcctc

SEQ ID NO: 267012 - DNA, 25 bp, Mus musculus
gactccaagtctctcaagccaacta

SEQ ID NO: 267013 - DNA, 25 bp, Mus musculus
ggagcgcgtacaaagcagccctgcg

SEQ ID NO: 267014 - DNA, 25 bp, Mus musculus
cccgcgacaatttcctcagtgcaag

SEQ ID NO: 267015 - DNA, 25 bp, Mus musculus
ggaccaactcacctctcagagcgga

SEQ ID NO: 267016 - DNA, 25 bp, Mus musculus
tctcagagcggaccggcgctaagca

SEQ ID NO: 267017 - DNA, 25 bp, Mus musculus
ccatggtgggaaagactgggccaac

SEQ ID NO: 267018 - DNA, 25 bp, Mus musculus
ccaacgcagcggagtgcgcaagcgt

SEQ ID NO: 267019 - DNA, 25 bp, Mus musculus
ggtacgcggtgtccactcagcgtca

SEQ ID NO: 267020 - DNA, 25 bp, Mus musculus
gtggcagctgcgctgtctttttgta

SEQ ID NO: 267021 - DNA, 25 bp, Mus musculus
gcaggtttgacaggcgacggccacc

SEQ ID NO: 267022 - DNA, 25 bp, Mus musculus
aagccgaggcgcggacccagtatga

SEQ ID NO: 267023 - DNA, 25 bp, Mus musculus
ggcaacctcgctcacacaaccgctc

SEQ ID NO: 267024 - DNA, 25 bp, Mus musculus
attcactcgcacaaatgccatcacg

SEQ ID NO: 267025 - DNA, 25 bp, Mus musculus
tcgcacaaatgccatcacgccgtgg

SEQ ID NO: 267026 - DNA, 25 bp, Mus musculus
acaaatgccatcacgccgtggcttc

SEQ ID NO: 267027 - DNA, 25 bp, Mus musculus
ttccgggccgcactcagtcgcggtg

SEQ ID NO: 267028 - DNA, 25 bp, Mus musculus
cccgagagcctacagggcgttgcgc

SEQ ID NO: 267029 - DNA, 25 bp, Mus musculus
gtggtccccacgcagcaagccgagg

SEQ ID NO: 267030 - DNA, 25 bp, Mus musculus
gcagcaccttcactaagttcacgga

SEQ ID NO: 267031 - DNA, 25 bp, Mus musculus
agttcacggaactgggacccaggct

SEQ ID NO: 267032 - DNA, 25 bp, Mus musculus
gggacccaggctcggctcagttgcc

SEQ ID NO: 267033 - DNA, 25 bp, Mus musculus
cccacgcgctgaggtgacagtggct

SEQ ID NO: 267034 - DNA, 25 bp, Mus musculus
tgacagtggctgcatctccagaccc

SEQ ID NO: 267035 - DNA, 25 bp, Mus musculus
gcaggcacagctcgccactgtggtc

SEQ ID NO: 267036 - DNA, 25 bp, Mus musculus
gaacgcggcagacaagatggctccc

SEQ ID NO: 267037 - DNA, 25 bp, Mus musculus
ttccttgcaagctgccaaagccctg

SEQ ID NO: 267038 - DNA, 25 bp, Mus musculus
caaagccctgcaatccttcagtgca

SEQ ID NO: 267039 - DNA, 25 bp, Mus musculus
ctcttgccagcaaagctctgaagtc

SEQ ID NO: 267040 - DNA, 25 bp, Mus musculus
aagctctgaagtcacgccaggcgcg

SEQ ID NO: 267041 - DNA, 25 bp, Mus musculus
caggcgcgtgatcttcccgcgagaa

SEQ ID NO: 267042 - DNA, 25 bp, Mus musculus
tcttcccgcgagaagccagggagcc

SEQ ID NO: 267043 - DNA, 25 bp, Mus musculus
gcaccaaaggccttccttgcaagct

SEQ ID NO: 267044 - DNA, 25 bp, Mus musculus
aacggtccctcagtgtggtggacga

SEQ ID NO: 267045 - DNA, 25 bp, Mus musculus
cagacaagatggctcccgatgggcg

SEQ ID NO: 267046 - DNA, 25 bp, Mus musculus
aaattagccgcacaattccgactcc

SEQ ID NO: 267047 - DNA, 25 bp, Mus musculus
tcactgttcacaaattagccgcaca

SEQ ID NO: 267048 - DNA, 25 bp, Mus musculus
gggcttctaacggtccctcagtgtg

SEQ ID NO: 267049 - DNA, 25 bp, Mus musculus
tcagtccgagggaacgcggcagaca

SEQ ID NO: 267050 - DNA, 25 bp, Mus musculus
aaaccgctcggtccgcgttcaatca

SEQ ID NO: 267051 - DNA, 25 bp, Mus musculus
gacactcaacggctgcacagggcct

SEQ ID NO: 267052 - DNA, 25 bp, Mus musculus
gttcaatcacccaaacctaatcaga

SEQ ID NO: 267053 - DNA, 25 bp, Mus musculus
gccacagaccgtagcaggcagctga

SEQ ID NO: 267054 - DNA, 25 bp, Mus musculus
cccagccaaggggacgctggtgcaa

SEQ ID NO: 267055 - DNA, 25 bp, Mus musculus
aggaccgcagtggatgctccggatc

SEQ ID NO: 267056 - DNA, 25 bp, Mus musculus
gggcgaccgagagatcgaatccaga

SEQ ID NO: 267057 - DNA, 25 bp, Mus musculus
atcgaatccagatgggaagaccggg

SEQ ID NO: 267058 - DNA, 25 bp, Mus musculus
taaggaagcgggaccgggacactca

SEQ ID NO: 267059 - DNA, 25 bp, Mus musculus
accgaggatgactgccggtgacccg

SEQ ID NO: 267060 - DNA, 25 bp, Mus musculus
tcgtgttaaactcgaggacactctg

SEQ ID NO: 267061 - DNA, 25 bp, Mus musculus
acactctgtcgctgggaacaggtcc

SEQ ID NO: 267062 - DNA, 25 bp, Mus musculus
gaacaggtccctgggcatcacgagc

SEQ ID NO: 267063 - DNA, 25 bp, Mus musculus
gccgagccaggcctggtaattttgg

SEQ ID NO: 267064 - DNA, 25 bp, Mus musculus
ttctaaccagcggtcggaggtgatc

SEQ ID NO: 267065 - DNA, 25 bp, Mus musculus
cagcgagcggagagaatgtagccag

SEQ ID NO: 267066 - DNA, 25 bp, Mus musculus
agcccaggcagtagaggcagcgagc

SEQ ID NO: 267067 - DNA, 25 bp, Mus musculus
gctgggttagggtagacaaagaaga

SEQ ID NO: 267068 - DNA, 25 bp, Mus musculus
gcgagcccggctgggcaagctgaag

SEQ ID NO: 267069 - DNA, 25 bp, Mus musculus
aagtgggcgggtattgagcgagccc

SEQ ID NO: 267070 - DNA, 25 bp, Mus musculus
accagcggtcggaggtgatcccaat

SEQ ID NO: 267071 - DNA, 25 bp, Mus musculus
cacagttctaaccagcggtcggagg

SEQ ID NO: 267072 - DNA, 25 bp, Mus musculus
cgcacagttctaaccagcggtcgga

SEQ ID NO: 267073 - DNA, 25 bp, Mus musculus
aggcgcacagttctaaccagcggtc

SEQ ID NO: 267074 - DNA, 25 bp, Mus musculus
cgcgcaggcgcacagttctaaccag

SEQ ID NO: 267075 - DNA, 25 bp, Mus musculus
ccgggatagaacgagcgcgcctccc

SEQ ID NO: 267076 - DNA, 25 bp, Mus musculus
ggtgatcccaatgggtctgggtgaa

SEQ ID NO: 267077 - DNA, 25 bp, Mus musculus
gcgcaggcgcacagttctaaccagc

SEQ ID NO: 267078 - DNA, 25 bp, Mus musculus
cttgaactctgcgatggtgaggcta

SEQ ID NO: 267079 - DNA, 25 bp, Mus musculus
tccactcggagttgggaagcaggtt

SEQ ID NO: 267080 - DNA, 25 bp, Mus musculus
atagtcccagcccttgtcctagatc

SEQ ID NO: 267081 - DNA, 25 bp, Mus musculus
tgcggatgacatcgcgcatcatagt

SEQ ID NO: 267082 - DNA, 25 bp, Mus musculus
cacgctcagcgccttgcggatgaca

SEQ ID NO: 267083 - DNA, 25 bp, Mus musculus
gagcagcggattctctcgttcacgc

SEQ ID NO: 267084 - DNA, 25 bp, Mus musculus
aaccaatcccgagaggccttccgtg

SEQ ID NO: 267085 - DNA, 25 bp, Mus musculus
gcggattctcgggtacgtccaacca

SEQ ID NO: 267086 - DNA, 25 bp, Mus musculus
tttctccacggacaggcggattctc

SEQ ID NO: 267087 - DNA, 25 bp, Mus musculus
cccttgttctggagctgaccaatgc

SEQ ID NO: 267088 - DNA, 25 bp, Mus musculus
gccgctgcttctgggatataggtcc

SEQ ID NO: 267089 - DNA, 25 bp, Mus musculus
aaccatcacggtgggcgccgatatc

SEQ ID NO: 267090 - DNA, 25 bp, Mus musculus
gagggagctgctgatgaaaaccatc

SEQ ID NO: 267091 - DNA, 25 bp, Mus musculus
cgactgtatcgcttctccgaacgga

SEQ ID NO: 267092 - DNA, 25 bp, Mus musculus
ctgcagtgccggaattgcgattacc

SEQ ID NO: 267093 - DNA, 25 bp, Mus musculus
atcatcgcagacgtgtcccaggacc

SEQ ID NO: 267094 - DNA, 25 bp, Mus musculus
tgacccagatcatcgcagacgtgtc

SEQ ID NO: 267095 - DNA, 25 bp, Mus musculus
ctgcagcgagctgacccagatcatc

SEQ ID NO: 267096 - DNA, 25 bp, Mus musculus
ttacttccctatgcctgcagcgagc

SEQ ID NO: 267097 - DNA, 25 bp, Mus musculus
ggcctgaccgctaattacttcccta

SEQ ID NO: 267098 - DNA, 25 bp, Mus musculus
ggacacccggcctgaccgctaatta

SEQ ID NO: 267099 - DNA, 25 bp, Mus musculus
ggcacgggtcacctcttaggacacc

SEQ ID NO: 267100 - DNA, 25 bp, Mus musculus
ctcgcttggggcacgggtcacctct

SEQ ID NO: 267101 - DNA, 25 bp, Mus musculus
aatcacgcacgaagtggagtgagtg

SEQ ID NO: 267102 - DNA, 25 bp, Mus musculus
cgtcaacaaaatcacgcacgaagtg

SEQ ID NO: 267103 - DNA, 25 bp, Mus musculus
cagctgcatctacgtcaacaaaatc

SEQ ID NO: 267104 - DNA, 25 bp, Mus musculus
aggaagccgacaacagctgcatcta

SEQ ID NO: 267105 - DNA, 25 bp, Mus musculus
attgcgattaccagcaggaagccga

SEQ ID NO: 267106 - DNA, 25 bp, Mus musculus
ctccacgcagatgtgtgcaggctcc

SEQ ID NO: 267107 - DNA, 25 bp, Mus musculus
gatgcgccggtgctgcaccaaatgc

SEQ ID NO: 267108 - DNA, 25 bp, Mus musculus
actctgagcaggcatatggcttctc

SEQ ID NO: 267109 - DNA, 25 bp, Mus musculus
gttggagctccagctaaagcgcttg

SEQ ID NO: 267110 - DNA, 25 bp, Mus musculus
agtcggggcaagtataaggcttctc

SEQ ID NO: 267111 - DNA, 25 bp, Mus musculus
tggctaggctcttgctctgtgtgaa

SEQ ID NO: 267112 - DNA, 25 bp, Mus musculus
ttaaaccactgtgggagcgccggtg

SEQ ID NO: 267113 - DNA, 25 bp, Mus musculus
gcgcggacacacgaagggctttaaa

SEQ ID NO: 267114 - DNA, 25 bp, Mus musculus
tggccctgacagctctgggtgcaac

SEQ ID NO: 267115 - DNA, 25 bp, Mus musculus
tagaaactctgtccgcagctgctgc

SEQ ID NO: 267116 - DNA, 25 bp, Mus musculus
gcactccatgcacacatacggcttg

SEQ ID NO: 267117 - DNA, 25 bp, Mus musculus
atcttcttgtgtctccgcagtgcgg

SEQ ID NO: 267118 - DNA, 25 bp, Mus musculus
tcttgccgcagtcggtacaggcatt

SEQ ID NO: 267119 - DNA, 25 bp, Mus musculus
gcccactgggatagcgatttcgccg

SEQ ID NO: 267120 - DNA, 25 bp, Mus musculus
catccggccgagagctggtgaagcc

SEQ ID NO: 267121 - DNA, 25 bp, Mus musculus
ggtgaaagctttcccacaggctccg

SEQ ID NO: 267122 - DNA, 25 bp, Mus musculus
tgaagccacagtcttcacacacgtg

SEQ ID NO: 267123 - DNA, 25 bp, Mus musculus
tcctgttaagatgagcagagagggc

SEQ ID NO: 267124 - DNA, 25 bp, Mus musculus
ctccgcagcggaatggccgtattcc

SEQ ID NO: 267125 - DNA, 25 bp, Mus musculus
cgagagctggtgaagccacagtctt

SEQ ID NO: 267126 - DNA, 25 bp, Mus musculus
gcgctgggtgaaagctttcccacag

SEQ ID NO: 267127 - DNA, 25 bp, Mus musculus
cttccagggaacagcgctgggtgaa

SEQ ID NO: 267128 - DNA, 25 bp, Mus musculus
tggcaaggtgagcttccagggaaca

SEQ ID NO: 267129 - DNA, 25 bp, Mus musculus
gctgcccgtgcaccttggcaaggtg

SEQ ID NO: 267130 - DNA, 25 bp, Mus musculus
tcccggtaagcgtagctggctggct

SEQ ID NO: 267131 - DNA, 25 bp, Mus musculus
cctgcgctcccggtaagcgtagctg

SEQ ID NO: 267132 - DNA, 25 bp, Mus musculus
agtcttcacacacgtgcagcttctc

SEQ ID NO: 267133 - DNA, 25 bp, Mus musculus
ggccgtattcctgttaagatgagca

SEQ ID NO: 267134 - DNA, 25 bp, Mus musculus
ttgggtaaacaggacgaccagcctc

SEQ ID NO: 267135 - DNA, 25 bp, Mus musculus
gccgcctgagggagcaaataaagaa

SEQ ID NO: 267136 - DNA, 25 bp, Mus musculus
ctgtagccagcacccactcgaatag

SEQ ID NO: 267137 - DNA, 25 bp, Mus musculus
agaggacagcttttctatcgtgtca

SEQ ID NO: 267138 - DNA, 25 bp, Mus musculus
cccgccatgacagaggacagctttt

SEQ ID NO: 267139 - DNA, 25 bp, Mus musculus
ctatcgtgtcactccgcgtataacc

SEQ ID NO: 267140 - DNA, 25 bp, Mus musculus
ttacgcttcttaacagccgcctgta

SEQ ID NO: 267141 - DNA, 25 bp, Mus musculus
ctcgaatagcgaatggccgcgggaa

SEQ ID NO: 267142 - DNA, 25 bp, Mus musculus
gaggactggtttctccgcgccggaa

SEQ ID NO: 267143 - DNA, 25 bp, Mus musculus
atcatgctgtcggagaccagtgtcc

SEQ ID NO: 267144 - DNA, 25 bp, Mus musculus
gccgctaaggcagccatcatgctgt

SEQ ID NO: 267145 - DNA, 25 bp, Mus musculus
cgcgtataacctccggccgctaagg

SEQ ID NO: 267146 - DNA, 25 bp, Mus musculus
ccggttctgcacagtgtcctcggga

SEQ ID NO: 267147 - DNA, 25 bp, Mus musculus
gaccagtgtccgttacgcttcttaa

SEQ ID NO: 267148 - DNA, 25 bp, Mus musculus
ttattggtagatacagccatcgctc

SEQ ID NO: 267149 - DNA, 25 bp, Mus musculus
ccgcagaactaagaggcctcggcta

SEQ ID NO: 267150 - DNA, 25 bp, Mus musculus
actaagaggcctcggctacggccgc

SEQ ID NO: 267151 - DNA, 25 bp, Mus musculus
ccctcgttcctgagtggctaaaacg

SEQ ID NO: 267152 - DNA, 25 bp, Mus musculus
tggctaaaacgaacgtcagatcccg

SEQ ID NO: 267153 - DNA, 25 bp, Mus musculus
ccctttgcgcaagatctaagaattt

SEQ ID NO: 267154 - DNA, 25 bp, Mus musculus
ccctagggctattcttcgtggagcg

SEQ ID NO: 267155 - DNA, 25 bp, Mus musculus
ctattcttcgtggagcgtggtgatt

SEQ ID NO: 267156 - DNA, 25 bp, Mus musculus
tgattggtcaatagcgaggcaggaa

SEQ ID NO: 267157 - DNA, 25 bp, Mus musculus
acggatctggcacgcgttctcgcgt

SEQ ID NO: 267158 - DNA, 25 bp, Mus musculus
gtgggtcgccctagtccctcagggc

SEQ ID NO: 267159 - DNA, 25 bp, Mus musculus
gttggacatccagaagacggctttc

SEQ ID NO: 267160 - DNA, 25 bp, Mus musculus
cgaccgtcacgtgccgcagaactaa

SEQ ID NO: 267161 - DNA, 25 bp, Mus musculus
atacagccatcgctcgaagcgcctt

SEQ ID NO: 267162 - DNA, 25 bp, Mus musculus
cgcttgcaagtcagcgctgcccgga

SEQ ID NO: 267163 - DNA, 25 bp, Mus musculus
caatgccaccgcttgcaagtcagcg

SEQ ID NO: 267164 - DNA, 25 bp, Mus musculus
ttacacacgcctgctccacggcatc

SEQ ID NO: 267165 - DNA, 25 bp, Mus musculus
acctcgctgccacccaatgccaccg

SEQ ID NO: 267166 - DNA, 25 bp, Mus musculus
gtgctccggggcacagcttacacac

SEQ ID NO: 267167 - DNA, 25 bp, Mus musculus
tggatgagctggacgccacctcgct

SEQ ID NO: 267168 - DNA, 25 bp, Mus musculus
tggaaccacggagcctgctggtgct

SEQ ID NO: 267169 - DNA, 25 bp, Mus musculus
catcacctcgctgctggtggaacca

SEQ ID NO: 267170 - DNA, 25 bp, Mus musculus
acctcgctgctggtggaaccacgga

SEQ ID NO: 267171 - DNA, 25 bp, Mus musculus
agctacccgtgtggatgagctggac

SEQ ID NO: 267172 - DNA, 25 bp, Mus musculus
acggcatctcagctacccgtgtgga

SEQ ID NO: 267173 - DNA, 25 bp, Mus musculus
tgtctcactgaccattcgccgcgtg

SEQ ID NO: 267174 - DNA, 25 bp, Mus musculus
tggtgcgcggcacccgtgtctcact

SEQ ID NO: 267175 - DNA, 25 bp, Mus musculus
tctcagctacccgtgtggatgagct

SEQ ID NO: 267176 - DNA, 25 bp, Mus musculus
ctgagaagctaacgggcagggctac

SEQ ID NO: 267177 - DNA, 25 bp, Mus musculus
ggcgcacgaaggtacccatggccgt

SEQ ID NO: 267178 - DNA, 25 bp, Mus musculus
acccatggccgtggcgtggcccgaa

SEQ ID NO: 267179 - DNA, 25 bp, Mus musculus
tggcccgaacgcagcagctgtagct

SEQ ID NO: 267180 - DNA, 25 bp, Mus musculus
gcagcagctgtagctggcgccgacc

SEQ ID NO: 267181 - DNA, 25 bp, Mus musculus
cccggcgatacagatactcgatacg

SEQ ID NO: 267182 - DNA, 25 bp, Mus musculus
tactcgatacgcagcacgtcggttc

SEQ ID NO: 267183 - DNA, 25 bp, Mus musculus
tacgcagcacgtcggttcgcggaag

SEQ ID NO: 267184 - DNA, 25 bp, Mus musculus
tacaggctcagaacttgcctctgca

SEQ ID NO: 267185 - DNA, 25 bp, Mus musculus
aacttgcctctgcaaccggctgggc

SEQ ID NO: 267186 - DNA, 25 bp, Mus musculus
cccgacacacagtgctgagaagcta

SEQ ID NO: 267187 - DNA, 25 bp, Mus musculus
cagggctactggcacgtctgccaga

SEQ ID NO: 267188 - DNA, 25 bp, Mus musculus
caagaattctttggggcaccaccat

SEQ ID NO: 267189 - DNA, 25 bp, Mus musculus
ttctttggggcaccaccatcatcca

SEQ ID NO: 267190 - DNA, 25 bp, Mus musculus
gcccttcgggcggtggcaacacaca

SEQ ID NO: 267191 - DNA, 25 bp, Mus musculus
tgttgagtctgagtgaacccggagc

SEQ ID NO: 267192 - DNA, 25 bp, Mus musculus
cgcagctgttgagtctgagtgaacc

SEQ ID NO: 267193 - DNA, 25 bp, Mus musculus
cccacaaacgcagctgttgagtctg

SEQ ID NO: 267194 - DNA, 25 bp, Mus musculus
tagaaacccacaaacgcagctgttg

SEQ ID NO: 267195 - DNA, 25 bp, Mus musculus
taagcggcggccctagaaacccaca

SEQ ID NO: 267196 - DNA, 25 bp, Mus musculus
acacagccggaagtcgggtttctca

SEQ ID NO: 267197 - DNA, 25 bp, Mus musculus
gctcattggtactgacagtagcacc

SEQ ID NO: 267198 - DNA, 25 bp, Mus musculus
cgccggctcattggtactgacagta

SEQ ID NO: 267199 - DNA, 25 bp, Mus musculus
tcctcagcagccctcgggcactggg

SEQ ID NO: 267200 - DNA, 25 bp, Mus musculus
aggctcgcccacgtggattcctcag

SEQ ID NO: 267201 - DNA, 25 bp, Mus musculus
atcaccgcgagcgcccagcaggtgg

SEQ ID NO: 267202 - DNA, 25 bp, Mus musculus
cgtagccgcggcatcaccgcgagcg

SEQ ID NO: 267203 - DNA, 25 bp, Mus musculus
aagctgtgattaagcggcggcccta

SEQ ID NO: 267204 - DNA, 25 bp, Mus musculus
agcacaaggccgaagtgcgggctcc

SEQ ID NO: 267205 - DNA, 25 bp, Mus musculus
gacgatgacacctcccagcgctatg

SEQ ID NO: 267206 - DNA, 25 bp, Mus musculus
tgcgagcacacatagatcataggta

SEQ ID NO: 267207 - DNA, 25 bp, Mus musculus
cataggtacggcctgacgccagatc

SEQ ID NO: 267208 - DNA, 25 bp, Mus musculus
gctccgtggagaaccgagcgcagcc

SEQ ID NO: 267209 - DNA, 25 bp, Mus musculus
acgccagatcggtcagcaggaagga

SEQ ID NO: 267210 - DNA, 25 bp, Mus musculus
tcccagcgctatgatcatggtgccg

SEQ ID NO: 267211 - DNA, 25 bp, Mus musculus
cagcacgaagatgaagaccagaaca

SEQ ID NO: 267212 - DNA, 25 bp, Mus musculus
accttgtaacgtagaagcagcacga

SEQ ID NO: 267213 - DNA, 25 bp, Mus musculus
tggcctccgtgcaccttgtaacgta

SEQ ID NO: 267214 - DNA, 25 bp, Mus musculus
aaacgctgctgacaggtgccgtagc

SEQ ID NO: 267215 - DNA, 25 bp, Mus musculus
agcgctccgttggtctgggagcaaa

SEQ ID NO: 267216 - DNA, 25 bp, Mus musculus
accagaacagaagcgacgatgacac

SEQ ID NO: 267217 - DNA, 25 bp, Mus musculus
tgtcctcatagactgcgagcacaca

SEQ ID NO: 267218 - DNA, 25 bp, Mus musculus
attaccatctaggtgcagggcacgc

SEQ ID NO: 267219 - DNA, 25 bp, Mus musculus
cgatccagtgatggcggtacgaata

SEQ ID NO: 267220 - DNA, 25 bp, Mus musculus
agttgtctgccaggcgcagttctgc

SEQ ID NO: 267221 - DNA, 25 bp, Mus musculus
cactgccgcgatgaagttgtctgcc

SEQ ID NO: 267222 - DNA, 25 bp, Mus musculus
aggtctcgacgacgcactgccgcga

SEQ ID NO: 267223 - DNA, 25 bp, Mus musculus
aggcctgtcatgttggccaggtctc

SEQ ID NO: 267224 - DNA, 25 bp, Mus musculus
tagacaagctcagatgcagcaggcc

SEQ ID NO: 267225 - DNA, 25 bp, Mus musculus
cgcaagttgactaagccgcgcaact

SEQ ID NO: 267226 - DNA, 25 bp, Mus musculus
tgccacatggcggatggtgtttcta

SEQ ID NO: 267227 - DNA, 25 bp, Mus musculus
ctcgcccagcgaggtcagtctatta

SEQ ID NO: 267228 - DNA, 25 bp, Mus musculus
catcgactgggtctggcagcggcaa

SEQ ID NO: 267229 - DNA, 25 bp, Mus musculus
acaacacgcttaggggcatcgactg

SEQ ID NO: 267230 - DNA, 25 bp, Mus musculus
cggatggtgtttctagacaagctca

SEQ ID NO: 267231 - DNA, 25 bp, Mus musculus
cctgggcacaacacgcttaggggca

SEQ ID NO: 267232 - DNA, 25 bp, Mus musculus
gttctctaagaggacgaagtgaccc

SEQ ID NO: 267233 - DNA, 25 bp, Mus musculus
gactccttcacccaaggaggggctg

SEQ ID NO: 267234 - DNA, 25 bp, Mus musculus
tccttgggagtgttggacatccttg

SEQ ID NO: 267235 - DNA, 25 bp, Mus musculus
agctgggccctgagaattgattctg

SEQ ID NO: 267236 - DNA, 25 bp, Mus musculus
gaggaacgcgcctttctggatgctt

SEQ ID NO: 267237 - DNA, 25 bp, Mus musculus
ggggcccacagtctgcatccaagaa

SEQ ID NO: 267238 - DNA, 25 bp, Mus musculus
gggctgcattgcatccttgaaattg

SEQ ID NO: 267239 - DNA, 25 bp, Mus musculus
gacctcaggagtccactctggtaga

SEQ ID NO: 267240 - DNA, 25 bp, Mus musculus
tgaaccgggcgtggccaaaagacga

SEQ ID NO: 267241 - DNA, 25 bp, Mus musculus
gggacttcccagagcaccactggtg

SEQ ID NO: 267242 - DNA, 25 bp, Mus musculus
agattcccttgcgttagtcgccgtg

SEQ ID NO: 267243 - DNA, 25 bp, Mus musculus
cgtctcgagggtttccgagtcagtc

SEQ ID NO: 267244 - DNA, 25 bp, Mus musculus
tgcaaggactgagaggcctgatacc

SEQ ID NO: 267245 - DNA, 25 bp, Mus musculus
tccaagaatcctcgaggtaagagct

SEQ ID NO: 267246 - DNA, 25 bp, Mus musculus
aagtggcatctgcaacgacctccaa

SEQ ID NO: 267247 - DNA, 25 bp, Mus musculus
cggagacagggacgttattaatgtc

SEQ ID NO: 267248 - DNA, 25 bp, Mus musculus
tgtaacaccgccaaacccagttcta

SEQ ID NO: 267249 - DNA, 25 bp, Mus musculus
aaacccagttctacacctgtcctag

SEQ ID NO: 267250 - DNA, 25 bp, Mus musculus
cccgccttcttgtaggccacgccca

SEQ ID NO: 267251 - DNA, 25 bp, Mus musculus
acacaacacttccagcgcggtgctg

SEQ ID NO: 267252 - DNA, 25 bp, Mus musculus
tgcggttggcgcttccgaccgcgtt

SEQ ID NO: 267253 - DNA, 25 bp, Mus musculus
accgcgttgctgacctcgcaggaca

SEQ ID NO: 267254 - DNA, 25 bp, Mus musculus
tgacctcgcaggacaccggctcagt

SEQ ID NO: 267255 - DNA, 25 bp, Mus musculus
cggctcagtcaggaaagtggcatct

SEQ ID NO: 267256 - DNA, 25 bp, Mus musculus
cccacctgcggagacagggacgtta

SEQ ID NO: 267257 - DNA, 25 bp, Mus musculus
cccgcttcgcttcgatcttgtaaca

SEQ ID NO: 267258 - DNA, 25 bp, Mus musculus
gcttcgatcttgtaacaccgccaaa

SEQ ID NO: 267259 - DNA, 25 bp, Mus musculus
gcaggacaccggctcagtcaggaaa

SEQ ID NO: 267260 - DNA, 25 bp, Mus musculus
gcagtctccggtgttctctaccgct

SEQ ID NO: 267261 - DNA, 25 bp, Mus musculus
cattgagaaactcccgcgccttgtg

SEQ ID NO: 267262 - DNA, 25 bp, Mus musculus
tctctaccgctcaagggttgcaacc

SEQ ID NO: 267263 - DNA, 25 bp, Mus musculus
gctcaagggttgcaaccctaggact

SEQ ID NO: 267264 - DNA, 25 bp, Mus musculus
ccctaggactgcgagggacccacta

SEQ ID NO: 267265 - DNA, 25 bp, Mus musculus
cccactaggcgggaggaatcctatt

SEQ ID NO: 267266 - DNA, 25 bp, Mus musculus
taggcgggaggaatcctattcgccc

SEQ ID NO: 267267 - DNA, 25 bp, Mus musculus
cggtgttctctaccgctcaagggtt

SEQ ID NO: 267268 - DNA, 25 bp, Mus musculus
agtcccggcctcttcccattgagaa

SEQ ID NO: 267269 - DNA, 25 bp, Mus musculus
ctcagggtagctgtccgcgcagcag

SEQ ID NO: 267270 - DNA, 25 bp, Mus musculus
aaactcccgcgccttgtgtgcggac

SEQ ID NO: 267271 - DNA, 25 bp, Mus musculus
ccgcgccttgtgtgcggacggctac

SEQ ID NO: 267272 - DNA, 25 bp, Mus musculus
ctacggatgctcagggtagctgtcc

SEQ ID NO: 267273 - DNA, 25 bp, Mus musculus
tagagtcccggcctcttcccattga

SEQ ID NO: 267274 - DNA, 25 bp, Mus musculus
ccaggcgactcgatttgaggaagga

SEQ ID NO: 267275 - DNA, 25 bp, Mus musculus
ggccatgaccggctgcaagtccagt

SEQ ID NO: 267276 - DNA, 25 bp, Mus musculus
gaacttgggccgagactgaccatgg

SEQ ID NO: 267277 - DNA, 25 bp, Mus musculus
aagtccctggcacttccggccatga

SEQ ID NO: 267278 - DNA, 25 bp, Mus musculus
accggttggataacccaggtgcctg

SEQ ID NO: 267279 - DNA, 25 bp, Mus musculus
ccggagtagcgcacgcgcattgtcc

SEQ ID NO: 267280 - DNA, 25 bp, Mus musculus
taacacgacacgcacgcgcactagt

SEQ ID NO: 267281 - DNA, 25 bp, Mus musculus
ctcgccactctaggcagaggagctc

SEQ ID NO: 267282 - DNA, 25 bp, Mus musculus
ctccggctctatggtacggaaaggc

SEQ ID NO: 267283 - DNA, 25 bp, Mus musculus
tccggaattatctaggacccaggtc

SEQ ID NO: 267284 - DNA, 25 bp, Mus musculus
gacccaggtcctccgttttgctcta

SEQ ID NO: 267285 - DNA, 25 bp, Mus musculus
gttttgctctatggcgcctcgctcc

SEQ ID NO: 267286 - DNA, 25 bp, Mus musculus
cccgttaggcgcacacttccgggtg

SEQ ID NO: 267287 - DNA, 25 bp, Mus musculus
attactcgctggatcaaaggccagc

SEQ ID NO: 267288 - DNA, 25 bp, Mus musculus
agaagtccggcagcactttctcccg

SEQ ID NO: 267289 - DNA, 25 bp, Mus musculus
ctacgcagctggtggtgcagtgtga

SEQ ID NO: 267290 - DNA, 25 bp, Mus musculus
cagctcagtgcgtctacgcagctgg

SEQ ID NO: 267291 - DNA, 25 bp, Mus musculus
gggtcagctcagtgcgtctacgcag

SEQ ID NO: 267292 - DNA, 25 bp, Mus musculus
gttctcctgcaaggcgggtcagctc

SEQ ID NO: 267293 - DNA, 25 bp, Mus musculus
ccaagttctcctgcaaggcgggtca

SEQ ID NO: 267294 - DNA, 25 bp, Mus musculus
ggacaacctagccaagttctcctgc

SEQ ID NO: 267295 - DNA, 25 bp, Mus musculus
gtgctgatcataggcccgccggaca

SEQ ID NO: 267296 - DNA, 25 bp, Mus musculus
tttctcccgcgagctggtgctgatc

SEQ ID NO: 267297 - DNA, 25 bp, Mus musculus
cagtgtggagaagtccggcagcact

SEQ ID NO: 267298 - DNA, 25 bp, Mus musculus
acgatcctcggcagtctcaggagcc

SEQ ID NO: 267299 - DNA, 25 bp, Mus musculus
cggtgaacgatcctcggcagtctca

SEQ ID NO: 267300 - DNA, 25 bp, Mus musculus
cgcccggtgaacgatcctcggcagt

SEQ ID NO: 267301 - DNA, 25 bp, Mus musculus
tcccgcgagctggtgctgatcatag

SEQ ID NO: 267302 - DNA, 25 bp, Mus musculus
gtacttataatccagccgcgcgctc

SEQ ID NO: 267303 - DNA, 25 bp, Mus musculus
tgaggcaattctgggtcgaccactt

SEQ ID NO: 267304 - DNA, 25 bp, Mus musculus
gacaggccgaactggggctcaacta

SEQ ID NO: 267305 - DNA, 25 bp, Mus musculus
actgagcgacgaggccttcgttttc

SEQ ID NO: 267306 - DNA, 25 bp, Mus musculus
atcccggcctggaagccacaagtgc

SEQ ID NO: 267307 - DNA, 25 bp, Mus musculus
ctacctgaagctgcagcaagaactg

SEQ ID NO: 267308 - DNA, 25 bp, Mus musculus
gctaacagagactacggcgcgcatg

SEQ ID NO: 267309 - DNA, 25 bp, Mus musculus
gcgcgcatgcaactgctggagaaga

SEQ ID NO: 267310 - DNA, 25 bp, Mus musculus
cttcaccctggaggcctttgagtgc

SEQ ID NO: 267311 - DNA, 25 bp, Mus musculus
cgctcctggaagagaaagatgccca

SEQ ID NO: 267312 - DNA, 25 bp, Mus musculus
tctggagtcgcggtgatgcaataaa

SEQ ID NO: 267313 - DNA, 25 bp, Mus musculus
gggtggtccacttcccttgagcatc

SEQ ID NO: 267314 - DNA, 25 bp, Mus musculus
agttgtacctaaagcagggccgcga

SEQ ID NO: 267315 - DNA, 25 bp, Mus musculus
aggtggacgcggataacaaccctgc

SEQ ID NO: 267316 - DNA, 25 bp, Mus musculus
gtcgctcctcggacgtgcttcattg

SEQ ID NO: 267317 - DNA, 25 bp, Mus musculus
gcttcattgggttcgcctacgacta

SEQ ID NO: 267318 - DNA, 25 bp, Mus musculus
accctgtattctttatgctccgctg

SEQ ID NO: 267319 - DNA, 25 bp, Mus musculus
tccagttttggcctgagggctacgc

SEQ ID NO: 267320 - DNA, 25 bp, Mus musculus
tggctttgagtgctgctctacttcc

SEQ ID NO: 267321 - DNA, 25 bp, Mus musculus
cgaagtttgacagcgccacgcccat

SEQ ID NO: 267322 - DNA, 25 bp, Mus musculus
ccacgcccatggatggttggcattg

SEQ ID NO: 267323 - DNA, 25 bp, Mus musculus
ttggcattggctgtcagggccctcc

SEQ ID NO: 267324 - DNA, 25 bp, Mus musculus
ggccctcctgagataaaaccctgta

SEQ ID NO: 267325 - DNA, 25 bp, Mus musculus
tccgccgccatggtgacacaaaggg

SEQ ID NO: 267326 - DNA, 25 bp, Mus musculus
cccacaagcagccttttcgaaatgc

SEQ ID NO: 267327 - DNA, 25 bp, Mus musculus
ggctttcgagccctcgttcgcagtc

SEQ ID NO: 267328 - DNA, 25 bp, Mus musculus
accatggtcgcggtagcctcctcag

SEQ ID NO: 267329 - DNA, 25 bp, Mus musculus
ccttctcattggctccagttttggc

SEQ ID NO: 267330 - DNA, 25 bp, Mus musculus
ctgcgcctactctcctcgctaagca

SEQ ID NO: 267331 - DNA, 25 bp, Mus musculus
tcctcgctaagcaacgccgtcagcc

SEQ ID NO: 267332 - DNA, 25 bp, Mus musculus
ccctttctggctgtgcagagtagga

SEQ ID NO: 267333 - DNA, 25 bp, Mus musculus
agcgcggcctccaaagcgaccaatg

SEQ ID NO: 267334 - DNA, 25 bp, Mus musculus
gcggcctccaaagcgaccaatgata

SEQ ID NO: 267335 - DNA, 25 bp, Mus musculus
ctccaaagcgaccaatgatagacta

SEQ ID NO: 267336 - DNA, 25 bp, Mus musculus
tctcttgacgaactgggagagcgtg

SEQ ID NO: 267337 - DNA, 25 bp, Mus musculus
ggcgttctctcttgacgaactggga

SEQ ID NO: 267338 - DNA, 25 bp, Mus musculus
cgaggggcgttctctcttgacgaac

SEQ ID NO: 267339 - DNA, 25 bp, Mus musculus
gcgaccaatgatagactagaaaata

SEQ ID NO: 267340 - DNA, 25 bp, Mus musculus
agcttcttcgcggaacaaccctgcg

SEQ ID NO: 267341 - DNA, 25 bp, Mus musculus
agccttagcgccagcggagcttctt

SEQ ID NO: 267342 - DNA, 25 bp, Mus musculus
ggcatttaccgcagccttagcgcca

SEQ ID NO: 267343 - DNA, 25 bp, Mus musculus
cagcggagcttcttcgcggaacaac

SEQ ID NO: 267344 - DNA, 25 bp, Mus musculus
ataaatcggagccagcgtgcgtttg

SEQ ID NO: 267345 - DNA, 25 bp, Mus musculus
aggcagagctggcttcactgtgccc

SEQ ID NO: 267346 - DNA, 25 bp, Mus musculus
ttgaccagcgtttcggcgaagggct

SEQ ID NO: 267347 - DNA, 25 bp, Mus musculus
cctctttgaccagcgtttcggcgaa

SEQ ID NO: 267348 - DNA, 25 bp, Mus musculus
ccgggacgcctctttgaccagcgtt

SEQ ID NO: 267349 - DNA, 25 bp, Mus musculus
gtgcttcagctcctttaccaggttt

SEQ ID NO: 267350 - DNA, 25 bp, Mus musculus
cagccttcttggctgcgccgtgctt

SEQ ID NO: 267351 - DNA, 25 bp, Mus musculus
ggcggcacagggcacagtataaatc

SEQ ID NO: 267352 - DNA, 25 bp, Mus musculus
cagcgtaggaacaggatggagatcc

SEQ ID NO: 267353 - DNA, 25 bp, Mus musculus
gcacagtataaatcggagccagcgt

SEQ ID NO: 267354 - DNA, 25 bp, Mus musculus
taccaggtttctctgctccgggacg

SEQ ID NO: 267355 - DNA, 25 bp, Mus musculus
tggcttcactgtgccctgctgcgat

SEQ ID NO: 267356 - DNA, 25 bp, Mus musculus
ccgtgcctgtgcagccttcttggct

SEQ ID NO: 267357 - DNA, 25 bp, Mus musculus
gctgcgccgtgcttcagctccttta

SEQ ID NO: 267358 - DNA, 25 bp, Mus musculus
cgctcccagaaaaacacgcgcttga

SEQ ID NO: 267359 - DNA, 25 bp, Mus musculus
gacggacagtgttcgtgggataccc

SEQ ID NO: 267360 - DNA, 25 bp, Mus musculus
gcacttgggtccctacgggctggac

SEQ ID NO: 267361 - DNA, 25 bp, Mus musculus
gaatggtgaagggagtagcctctca

SEQ ID NO: 267362 - DNA, 25 bp, Mus musculus
tattcgggactgagaaggacaagtg

SEQ ID NO: 267363 - DNA, 25 bp, Mus musculus
tatttagcttcgatattcgggactg

SEQ ID NO: 267364 - DNA, 25 bp, Mus musculus
tcgggtaaaaatggctgaatattta

SEQ ID NO: 267365 - DNA, 25 bp, Mus musculus
ccaacgctcctaagcaacggaagtg

SEQ ID NO: 267366 - DNA, 25 bp, Mus musculus
taccacaggcagaaactacacttcc

SEQ ID NO: 267367 - DNA, 25 bp, Mus musculus
cgcgtgcgcagtagtaccacaggca

SEQ ID NO: 267368 - DNA, 25 bp, Mus musculus
aaaacacgcgcttgacggtcgagga

SEQ ID NO: 267369 - DNA, 25 bp, Mus musculus
gtacgcatgcgctcccagaaaaaca

SEQ ID NO: 267370 - DNA, 25 bp, Mus musculus
tccgctacgttgtacgcatgcgctc

SEQ ID NO: 267371 - DNA, 25 bp, Mus musculus
tggcctctaacacgcgtgcgcagta

SEQ ID NO: 267372 - DNA, 25 bp, Mus musculus
tcagtcagtgcctgcaccatccgtt

SEQ ID NO: 267373 - DNA, 25 bp, Mus musculus
agtagagggttcacgtgcccgtgcc

SEQ ID NO: 267374 - DNA, 25 bp, Mus musculus
tagagggttcacgtgcccgtgcccg

SEQ ID NO: 267375 - DNA, 25 bp, Mus musculus
ttgggaccgccggagaagttcagtc

SEQ ID NO: 267376 - DNA, 25 bp, Mus musculus
gaccgccggagaagttcagtcagtg

SEQ ID NO: 267377 - DNA, 25 bp, Mus musculus
ccgccggagaagttcagtcagtgcc

SEQ ID NO: 267378 - DNA, 25 bp, Mus musculus
agaagttcagtcagtgcctgcacca

SEQ ID NO: 267379 - DNA, 25 bp, Mus musculus
cagtgcctgcaccatccgttctgtg

SEQ ID NO: 267380 - DNA, 25 bp, Mus musculus
caccatccgttctgtgccctcctca

SEQ ID NO: 267381 - DNA, 25 bp, Mus musculus
gggacaggagtcacatctgctaggc

SEQ ID NO: 267382 - DNA, 25 bp, Mus musculus
aggagtcacatctgctaggcgagga

SEQ ID NO: 267383 - DNA, 25 bp, Mus musculus
tcacatctgctaggcgaggaggaag

SEQ ID NO: 267384 - DNA, 25 bp, Mus musculus
ggtcgtcttatgcttgcggccccga

SEQ ID NO: 267385 - DNA, 25 bp, Mus musculus
cggagaagttcagtcagtgcctgca

SEQ ID NO: 267386 - DNA, 25 bp, Mus musculus
ccctacccggcgctagagacacctc

SEQ ID NO: 267387 - DNA, 25 bp, Mus musculus
gcaaacggagcagggccgtgtcctc

SEQ ID NO: 267388 - DNA, 25 bp, Mus musculus
ccagcaaacggagcagggccgtgtc

SEQ ID NO: 267389 - DNA, 25 bp, Mus musculus
acccagcaaacggagcagggccgtg

SEQ ID NO: 267390 - DNA, 25 bp, Mus musculus
agacccagcaaacggagcagggccg

SEQ ID NO: 267391 - DNA, 25 bp, Mus musculus
ggcgaagacccagcaaacggagcag

SEQ ID NO: 267392 - DNA, 25 bp, Mus musculus
cggcgaagacccagcaaacggagca

SEQ ID NO: 267393 - DNA, 25 bp, Mus musculus
tcggcctcgctgaactcgcgcacca

SEQ ID NO: 267394 - DNA, 25 bp, Mus musculus
catgcagcctcggttcgggccccag

SEQ ID NO: 267395 - DNA, 25 bp, Mus musculus
actgctctcttcctccggcatgcag

SEQ ID NO: 267396 - DNA, 25 bp, Mus musculus
gtcactgctctcttcctccggcatg

SEQ ID NO: 267397 - DNA, 25 bp, Mus musculus
agacacctccgaccgcctcacctcc

SEQ ID NO: 267398 - DNA, 25 bp, Mus musculus
gctagagacacctccgaccgcctca

SEQ ID NO: 267399 - DNA, 25 bp, Mus musculus
tacccggcgctagagacacctccga

SEQ ID NO: 267400 - DNA, 25 bp, Mus musculus
ggagaggctagtcttccgtccctta

SEQ ID NO: 267401 - DNA, 25 bp, Mus musculus
cgacagagaccaggagaaccagttc

SEQ ID NO: 267402 - DNA, 25 bp, Mus musculus
gactcctcccattgttctagtcgga

SEQ ID NO: 267403 - DNA, 25 bp, Mus musculus
cggaactagcgacctgcatggacta

SEQ ID NO: 267404 - DNA, 25 bp, Mus musculus
cgacggacacacagtagacgaagtt

SEQ ID NO: 267405 - DNA, 25 bp, Mus musculus
agctattgcgctaggcgttggctga

SEQ ID NO: 267406 - DNA, 25 bp, Mus musculus
tccgtcccttactcggaggagagca

SEQ ID NO: 267407 - DNA, 25 bp, Mus musculus
gtcgaaatccggacctcagtctgcg

SEQ ID NO: 267408 - DNA, 25 bp, Mus musculus
agccctagactacgcgcgcggtaga

SEQ ID NO: 267409 - DNA, 25 bp, Mus musculus
aaccagagtcttggggcgcctcaaa

SEQ ID NO: 267410 - DNA, 25 bp, Mus musculus
tttcctctcccgcagggtctggagc

SEQ ID NO: 267411 - DNA, 25 bp, Mus musculus
ctgccctcgggaattatacgaagcc

SEQ ID NO: 267412 - DNA, 25 bp, Mus musculus
aggcgcaacccggtagccgcattgc

SEQ ID NO: 267413 - DNA, 25 bp, Mus musculus
gcggcgctggattagtctcacttcc

SEQ ID NO: 267414 - DNA, 25 bp, Mus musculus
ccggagtagcgttacttcaatgtga

SEQ ID NO: 267415 - DNA, 25 bp, Mus musculus
aggcgtgcccagaaaccgctttggc

SEQ ID NO: 267416 - DNA, 25 bp, Mus musculus
tcctccgggctgctagattggcctc

SEQ ID NO: 267417 - DNA, 25 bp, Mus musculus
ggaattccgactggccggaagctgc

SEQ ID NO: 267418 - DNA, 25 bp, Mus musculus
tgtcagacgggaagcggaattccga

SEQ ID NO: 267419 - DNA, 25 bp, Mus musculus
gcaaagacgccaatgtcagacggga

SEQ ID NO: 267420 - DNA, 25 bp, Mus musculus
ttcaatgtgacccttagcaaagacg

SEQ ID NO: 267421 - DNA, 25 bp, Mus musculus
attgtcccggagtagcgttacttca

SEQ ID NO: 267422 - DNA, 25 bp, Mus musculus
ctcacctaaagattgtcccggagta

SEQ ID NO: 267423 - DNA, 25 bp, Mus musculus
gacccttcacactcacctaaagatt

SEQ ID NO: 267424 - DNA, 25 bp, Mus musculus
ccggaagtttctgcttggcgtcagg

SEQ ID NO: 267425 - DNA, 25 bp, Mus musculus
ccgtggccgccggaagtttctgctt

SEQ ID NO: 267426 - DNA, 25 bp, Mus musculus
gtgacccttagcaaagacgccaatg

SEQ ID NO: 267427 - DNA, 25 bp, Mus musculus
cgcttctctgcaacggacaaggttc

SEQ ID NO: 267428 - DNA, 25 bp, Mus musculus
acggtcgagtccctgtcgtctcagg

SEQ ID NO: 267429 - DNA, 25 bp, Mus musculus
tccagcagccgcagcgggttctacg

SEQ ID NO: 267430 - DNA, 25 bp, Mus musculus
agccggccgatgacgtatggactac

SEQ ID NO: 267431 - DNA, 25 bp, Mus musculus
acgtatggactaccgcgacggatgc

SEQ ID NO: 267432 - DNA, 25 bp, Mus musculus
cgctgcgtgaggacgtagtttaaga

SEQ ID NO: 267433 - DNA, 25 bp, Mus musculus
aacaggggctgagacttggccacac

SEQ ID NO: 267434 - DNA, 25 bp, Mus musculus
ttagagtgtcggaaagtcagggccc

SEQ ID NO: 267435 - DNA, 25 bp, Mus musculus
ccggaagggcctctaatctgacaga

SEQ ID NO: 267436 - DNA, 25 bp, Mus musculus
acagacgcggctgtacggataggcc

SEQ ID NO: 267437 - DNA, 25 bp, Mus musculus
ccctcgtagagaaaggtgggcgaat

SEQ ID NO: 267438 - DNA, 25 bp, Mus musculus
tgagagcgaagcaacgtcactttga

SEQ ID NO: 267439 - DNA, 25 bp, Mus musculus
cccgctgtggaagccggaactttga

SEQ ID NO: 267440 - DNA, 25 bp, Mus musculus
gcgagcaaaagccaattagagtgtc

SEQ ID NO: 267441 - DNA, 25 bp, Mus musculus
tgctccggccatcgctgatgccata

SEQ ID NO: 267442 - DNA, 25 bp, Mus musculus
gtcacacgttcacacgcacttctgt

SEQ ID NO: 267443 - DNA, 25 bp, Mus musculus
ccgcctcattagcttgtcgcgagag

SEQ ID NO: 267444 - DNA, 25 bp, Mus musculus
cctcttcgaaaaggattgcgggaag

SEQ ID NO: 267445 - DNA, 25 bp, Mus musculus
tatccaggggcaccgtgccatagca

SEQ ID NO: 267446 - DNA, 25 bp, Mus musculus
tgccatagcagcgtagaccggtgca

SEQ ID NO: 267447 - DNA, 25 bp, Mus musculus
tggctagtcctgtgtgctggtcaca

SEQ ID NO: 267448 - DNA, 25 bp, Mus musculus
agcgtatccgcctcattagcttgtc

SEQ ID NO: 267449 - DNA, 25 bp, Mus musculus
cctgtgtgctggtcacacgttcaca

SEQ ID NO: 267450 - DNA, 25 bp, Mus musculus
tttcttcattacaagcgtatccgcc

SEQ ID NO: 267451 - DNA, 25 bp, Mus musculus
cacacgcacttctgtcgagttgagg

SEQ ID NO: 267452 - DNA, 25 bp, Mus musculus
acttctgtcgagttgaggttctgga

SEQ ID NO: 267453 - DNA, 25 bp, Mus musculus
tgaggttctggaggataagtatttc

SEQ ID NO: 267454 - DNA, 25 bp, Mus musculus
ctggaggataagtatttcttcatta

SEQ ID NO: 267455 - DNA, 25 bp, Mus musculus
cctctaacctcttcgaaaaggattg

SEQ ID NO: 267456 - DNA, 25 bp, Mus musculus
aatctctctgtgacgcaagtggggc

SEQ ID NO: 267457 - DNA, 25 bp, Mus musculus
tttcctcgtctcaaccgtggctgtg

SEQ ID NO: 267458 - DNA, 25 bp, Mus musculus
caggccgcgccgctttctattgtgt

SEQ ID NO: 267459 - DNA, 25 bp, Mus musculus
tgacgattgcttgtcgctgagctta

SEQ ID NO: 267460 - DNA, 25 bp, Mus musculus
agctctccacggacacctctttggg

SEQ ID NO: 267461 - DNA, 25 bp, Mus musculus
cctgcaaacctgaacgaactctgga

SEQ ID NO: 267462 - DNA, 25 bp, Mus musculus
agtgactttccgtcttcgactgctg

SEQ ID NO: 267463 - DNA, 25 bp, Mus musculus
cggggtttcttaatacgcatgcgtc

SEQ ID NO: 267464 - DNA, 25 bp, Mus musculus
cgctgagacgccaagcgcaataatt

SEQ ID NO: 267465 - DNA, 25 bp, Mus musculus
agccgcatgcgcattaagtaaaaca

SEQ ID NO: 267466 - DNA, 25 bp, Mus musculus
gggcatggcttccttttcttcgtgg

SEQ ID NO: 267467 - DNA, 25 bp, Mus musculus
ggtcttattagcttggcgcctcggc

SEQ ID NO: 267468 - DNA, 25 bp, Mus musculus
gctgcggattaagggtagaactacc

SEQ ID NO: 267469 - DNA, 25 bp, Mus musculus
tggattactacccagtccctgcggg

SEQ ID NO: 267470 - DNA, 25 bp, Mus musculus
gggtctctctgtaccgggccgctac

SEQ ID NO: 267471 - DNA, 25 bp, Mus musculus
ggcgagctgctaggggcacctccat

SEQ ID NO: 267472 - DNA, 25 bp, Mus musculus
tcttcagcagcccagcgactcagtt

SEQ ID NO: 267473 - DNA, 25 bp, Mus musculus
ctcagttcccgctctttctgcgtta

SEQ ID NO: 267474 - DNA, 25 bp, Mus musculus
tttctgcgttagttccatggctgtc

SEQ ID NO: 267475 - DNA, 25 bp, Mus musculus
ttccatggctgtcacagagctcagc

SEQ ID NO: 267476 - DNA, 25 bp, Mus musculus
agagctcagctgcagtcgcagcttc

SEQ ID NO: 267477 - DNA, 25 bp, Mus musculus
gcagcttcccgcactctctttaagt

SEQ ID NO: 267478 - DNA, 25 bp, Mus musculus
actctctttaagtatggcgcccatc

SEQ ID NO: 267479 - DNA, 25 bp, Mus musculus
ggcgcccatctatgacgtcaggagc

SEQ ID NO: 267480 - DNA, 25 bp, Mus musculus
tcaggagcgcgacgctgagatgtca

SEQ ID NO: 267481 - DNA, 25 bp, Mus musculus
cgctgagatgtcaccggttgccaag

SEQ ID NO: 267482 - DNA, 25 bp, Mus musculus
caggtcccggctgacgggtctctct

SEQ ID NO: 267483 - DNA, 25 bp, Mus musculus
ttgccaagcagacagcaggtcccgg

SEQ ID NO: 267484 - DNA, 25 bp, Mus musculus
tgtgccgcgtgctcaccctgtgcaa

SEQ ID NO: 267485 - DNA, 25 bp, Mus musculus
atcagtcgtcggagacatggcgagc

SEQ ID NO: 267486 - DNA, 25 bp, Mus musculus
ccaaggtaagagacggggcattcca

SEQ ID NO: 267487 - DNA, 25 bp, Mus musculus
ccagagggtgatgtctggaatctcc

SEQ ID NO: 267488 - DNA, 25 bp, Mus musculus
gtgatgtctggaatctccggtttca

SEQ ID NO: 267489 - DNA, 25 bp, Mus musculus
tctccggtttcaatcctcacactgg

SEQ ID NO: 267490 - DNA, 25 bp, Mus musculus
gtttcaatcctcacactggacctgc

SEQ ID NO: 267491 - DNA, 25 bp, Mus musculus
gctcacagcgcatcgtgatcggaga

SEQ ID NO: 267492 - DNA, 25 bp, Mus musculus
tcgtgatcggagacgcgtcagagac

SEQ ID NO: 267493 - DNA, 25 bp, Mus musculus
agacgcgtcagagactgcgctgctc

SEQ ID NO: 267494 - DNA, 25 bp, Mus musculus
agactgcgctgctcaagttttcgga

SEQ ID NO: 267495 - DNA, 25 bp, Mus musculus
agttttcggagctgacgttgggcaa

SEQ ID NO: 267496 - DNA, 25 bp, Mus musculus
tggacctgctcacagcgcatcgtga

SEQ ID NO: 267497 - DNA, 25 bp, Mus musculus
cgttcgatcagtcgtcggagacatg

SEQ ID NO: 267498 - DNA, 25 bp, Mus musculus
cacaggccgctgcatttgtacgtga

SEQ ID NO: 267499 - DNA, 25 bp, Mus musculus
tattcgttgtcgtacctgaggaggc

SEQ ID NO: 267500 - DNA, 25 bp, Mus musculus
cgaccactcggttactgtagccata

SEQ ID NO: 267501 - DNA, 25 bp, Mus musculus
aaacatgtagcggaggaggtcgacc

SEQ ID NO: 267502 - DNA, 25 bp, Mus musculus
gtgttacttctctcggctaaacatg

SEQ ID NO: 267503 - DNA, 25 bp, Mus musculus
atttcattgttgacccggtggcggc

SEQ ID NO: 267504 - DNA, 25 bp, Mus musculus
aaagctgtgcgcattctcgttttta

SEQ ID NO: 267505 - DNA, 25 bp, Mus musculus
ttgtgttcagacagcgctttccctc

SEQ ID NO: 267506 - DNA, 25 bp, Mus musculus
agagccttgcttacaccgttgaaga

SEQ ID NO: 267507 - DNA, 25 bp, Mus musculus
ttcccgaagtggaacagggtcatga

SEQ ID NO: 267508 - DNA, 25 bp, Mus musculus
ttccagaaggcgttgtattcagacc

SEQ ID NO: 267509 - DNA, 25 bp, Mus musculus
tgtatacgtgtacgcactcgcgcgc

SEQ ID NO: 267510 - DNA, 25 bp, Mus musculus
ttcagacctgaagaagccggcggtg

SEQ ID NO: 267511 - DNA, 25 bp, Mus musculus
ctgtgttgcagggacttccagagcc

SEQ ID NO: 267512 - DNA, 25 bp, Mus musculus
atggcggccgccctgttgcccagat

SEQ ID NO: 267513 - DNA, 25 bp, Mus musculus
cagctgccgccgctttctatcaccc

SEQ ID NO: 267514 - DNA, 25 bp, Mus musculus
ttttcaacagggccctgcccggatg

SEQ ID NO: 267515 - DNA, 25 bp, Mus musculus
acccgggtccaccatgtccatgggg

SEQ ID NO: 267516 - DNA, 25 bp, Mus musculus
gaagcgggatccagacccgggtcca

SEQ ID NO: 267517 - DNA, 25 bp, Mus musculus
cccagaggccgctcgggatcatggc

SEQ ID NO: 267518 - DNA, 25 bp, Mus musculus
gcctccattttgagccgggcccaga

SEQ ID NO: 267519 - DNA, 25 bp, Mus musculus
ggacactggcgatggccaccgccgt

SEQ ID NO: 267520 - DNA, 25 bp, Mus musculus
cgccgcctgctggacactggcgatg

SEQ ID NO: 267521 - DNA, 25 bp, Mus musculus
ctggatattgtggtcgccgaacgcc

SEQ ID NO: 267522 - DNA, 25 bp, Mus musculus
tacggaactggtactggatattgtg

SEQ ID NO: 267523 - DNA, 25 bp, Mus musculus
cattactctctgtacggaactggta

SEQ ID NO: 267524 - DNA, 25 bp, Mus musculus
ctggcctccattactctctgtacgg

SEQ ID NO: 267525 - DNA, 25 bp, Mus musculus
ttcctcctttactggagctgcgcgc

SEQ ID NO: 267526 - DNA, 25 bp, Mus musculus
cattttcctcgcactgggggagttc

SEQ ID NO: 267527 - DNA, 25 bp, Mus musculus
aatggaaccgcccaggtacacaagg

SEQ ID NO: 267528 - DNA, 25 bp, Mus musculus
cggtggctctctgggtcactctacc

SEQ ID NO: 267529 - DNA, 25 bp, Mus musculus
gaagacaactgacccggcgcgcggt

SEQ ID NO: 267530 - DNA, 25 bp, Mus musculus
ttcggcttcccgaagacaactgacc

SEQ ID NO: 267531 - DNA, 25 bp, Mus musculus
aagctcatgccttcggcttcccgaa

SEQ ID NO: 267532 - DNA, 25 bp, Mus musculus
ttctaacctacaaaatgaacttgga

SEQ ID NO: 267533 - DNA, 25 bp, Mus musculus
ctattccaagtccattttcctcgca

SEQ ID NO: 267534 - DNA, 25 bp, Mus musculus
ccaggtacacaagggtgggagcccg

SEQ ID NO: 267535 - DNA, 25 bp, Mus musculus
tgaacttggacgaagctcatgcctt

SEQ ID NO: 267536 - DNA, 25 bp, Mus musculus
ctgcgcactcccgggaatggaaccg

SEQ ID NO: 267537 - DNA, 25 bp, Mus musculus
caagtccattttcctcgcactgggg

SEQ ID NO: 267538 - DNA, 25 bp, Mus musculus
ccctcccaagtatccagagagtagg

SEQ ID NO: 267539 - DNA, 25 bp, Mus musculus
atcgcggccgtctagcagcgacggt

SEQ ID NO: 267540 - DNA, 25 bp, Mus musculus
atatgaacgcggtccgtcagaaaca

SEQ ID NO: 267541 - DNA, 25 bp, Mus musculus
gatggagctgcggaaagttccctcc

SEQ ID NO: 267542 - DNA, 25 bp, Mus musculus
cccgaactcacggcggatggagctg

SEQ ID NO: 267543 - DNA, 25 bp, Mus musculus
agccccctaatgcaggccttatttc

SEQ ID NO: 267544 - DNA, 25 bp, Mus musculus
cccaccgtggacttgatatgaacgc

SEQ ID NO: 267545 - DNA, 25 bp, Mus musculus
ccgtggacttgatatgaacgcggtc

SEQ ID NO: 267546 - DNA, 25 bp, Mus musculus
accaggagaggcagccgcttccgag

SEQ ID NO: 267547 - DNA, 25 bp, Mus musculus
cagttctaaaaaggaacagatagag

SEQ ID NO: 267548 - DNA, 25 bp, Mus musculus
aacgcggtccgtcagaaacaagagc

SEQ ID NO: 267549 - DNA, 25 bp, Mus musculus
tcagaaacaagagcgcccggctgct

SEQ ID NO: 267550 - DNA, 25 bp, Mus musculus
ggtccgtcagaaacaagagcgcccg

SEQ ID NO: 267551 - DNA, 25 bp, Mus musculus
gacttgatatgaacgcggtccgtca

SEQ ID NO: 267552 - DNA, 25 bp, Mus musculus
cagatagaggaattcggatggacca

SEQ ID NO: 267553 - DNA, 25 bp, Mus musculus
gctgcggaaagttccctcctcttcg

SEQ ID NO: 267554 - DNA, 25 bp, Mus musculus
cctggcaccgcgataccgatgcgga

SEQ ID NO: 267555 - DNA, 25 bp, Mus musculus
acccacgccagagcctgcacgcctg

SEQ ID NO: 267556 - DNA, 25 bp, Mus musculus
ctcaacggctgctgcgacccaatga

SEQ ID NO: 267557 - DNA, 25 bp, Mus musculus
gctgctgcgacccaatgatgccgag

SEQ ID NO: 267558 - DNA, 25 bp, Mus musculus
tgcgacccaatgatgccgagctcct

SEQ ID NO: 267559 - DNA, 25 bp, Mus musculus
aatgatgccgagctcctctggctgg

SEQ ID NO: 267560 - DNA, 25 bp, Mus musculus
agctcctctggctggatgggcagcc

SEQ ID NO: 267561 - DNA, 25 bp, Mus musculus
ctctggctggatgggcagccctgct

SEQ ID NO: 267562 - DNA, 25 bp, Mus musculus
cagccctgcttcgtggtggctgatg

SEQ ID NO: 267563 - DNA, 25 bp, Mus musculus
cgtggtggctgatgcctccaaggct

SEQ ID NO: 267564 - DNA, 25 bp, Mus musculus
gctggcagcaccacgctgctgtgtc

SEQ ID NO: 267565 - DNA, 25 bp, Mus musculus
accacgctgctgtgtcgtgatgggc

SEQ ID NO: 267566 - DNA, 25 bp, Mus musculus
tgatgggccgggcttctacccacgc

SEQ ID NO: 267567 - DNA, 25 bp, Mus musculus
ataccgatgcggaggccctggagct

SEQ ID NO: 267568 - DNA, 25 bp, Mus musculus
ttatcgaggcgcctgccacccgagg

SEQ ID NO: 267569 - DNA, 25 bp, Mus musculus
acccgaggcaacaccgggcttgctg

SEQ ID NO: 267570 - DNA, 25 bp, Mus musculus
tggtctcactacgacgcttacagga

SEQ ID NO: 267571 - DNA, 25 bp, Mus musculus
ctacgacgcttacaggagatgcaca

SEQ ID NO: 267572 - DNA, 25 bp, Mus musculus
cgcttacaggagatgcacaggattt

SEQ ID NO: 267573 - DNA, 25 bp, Mus musculus
gcacaggattttgaaggtcatccca

SEQ ID NO: 267574 - DNA, 25 bp, Mus musculus
ggtcatcccatacacagcctcggta

SEQ ID NO: 267575 - DNA, 25 bp, Mus musculus
acacagcctcggtatcggaatccac

SEQ ID NO: 267576 - DNA, 25 bp, Mus musculus
ccaggctgaggatactgcggacaca

SEQ ID NO: 267577 - DNA, 25 bp, Mus musculus
ctgcggacacagtggactccggtta

SEQ ID NO: 267578 - DNA, 25 bp, Mus musculus
acacagtggactccggttatcgagg

SEQ ID NO: 267579 - DNA, 25 bp, Mus musculus
actccggttatcgaggcgcctgcca

SEQ ID NO: 267580 - DNA, 25 bp, Mus musculus
ccactccgtgaaggtttcggcggtg

SEQ ID NO: 267581 - DNA, 25 bp, Mus musculus
gtttcggcggtggtctcactacgac

SEQ ID NO: 267582 - DNA, 25 bp, Mus musculus
cgcgcgcgccacagggcgcatccag

SEQ ID NO: 267583 - DNA, 25 bp, Mus musculus
ttcccaggccgggacttggcgcggc

SEQ ID NO: 267584 - DNA, 25 bp, Mus musculus
acttggcgcggctccggccacttgg

SEQ ID NO: 267585 - DNA, 25 bp, Mus musculus
tcccgagcgccgacggcgcgtgtcc

SEQ ID NO: 267586 - DNA, 25 bp, Mus musculus
gcaacactcacccagcgccgcgccc

SEQ ID NO: 267587 - DNA, 25 bp, Mus musculus
agcgccgcgcccaccacgagagcca

SEQ ID NO: 267588 - DNA, 25 bp, Mus musculus
ccgcgcccaccacgagagccagcag

SEQ ID NO: 267589 - DNA, 25 bp, Mus musculus
cccatggccgcgcaaggcggtgggt

SEQ ID NO: 267590 - DNA, 25 bp, Mus musculus
cagagcgcggcgacaggcgatgggc

SEQ ID NO: 267591 - DNA, 25 bp, Mus musculus
gaggctcgggatgctgcgtgcgcgc

SEQ ID NO: 267592 - DNA, 25 bp, Mus musculus
agggcgcatccaggctgcggcgacc

SEQ ID NO: 267593 - DNA, 25 bp, Mus musculus
tggctccggacgttgctcgcgctcg

SEQ ID NO: 267594 - DNA, 25 bp, Mus musculus
tccggacgttgctcgcgctcgggct

SEQ ID NO: 267595 - DNA, 25 bp, Mus musculus
gctcggagagcaggcatccccgccg

SEQ ID NO: 267596 - DNA, 25 bp, Mus musculus
tgcccatatgcgtcccaggccggta

SEQ ID NO: 267597 - DNA, 25 bp, Mus musculus
cccgccgagatctcaggctcaaaga

SEQ ID NO: 267598 - DNA, 25 bp, Mus musculus
cggaccctgccacccgcacaaaagg

SEQ ID NO: 267599 - DNA, 25 bp, Mus musculus
cgaggcccggtgcttactcgaacat

SEQ ID NO: 267600 - DNA, 25 bp, Mus musculus
ttactcgaacatggatgcggcgccc

SEQ ID NO: 267601 - DNA, 25 bp, Mus musculus
gccaggttgcaatccctcacgtgta

SEQ ID NO: 267602 - DNA, 25 bp, Mus musculus
ccggtgcttactcgaacatggatgc

SEQ ID NO: 267603 - DNA, 25 bp, Mus musculus
ctcaggctcaaagaagctccttttc

SEQ ID NO: 267604 - DNA, 25 bp, Mus musculus
atctgcggggcctgcccagtaatgg

SEQ ID NO: 267605 - DNA, 25 bp, Mus musculus
gccctttcatctgggtgttgggtca

SEQ ID NO: 267606 - DNA, 25 bp, Mus musculus
atatgcgtcccaggccggtagtgac

SEQ ID NO: 267607 - DNA, 25 bp, Mus musculus
ggtcgctcctacatgcaccagcttg

SEQ ID NO: 267608 - DNA, 25 bp, Mus musculus
atgcaccagcttggaaacccagctc

SEQ ID NO: 267609 - DNA, 25 bp, Mus musculus
gccggctgctctgagatgggcctcc

SEQ ID NO: 267610 - DNA, 25 bp, Mus musculus
gaccgacgaccttaagccgctgcgg

SEQ ID NO: 267611 - DNA, 25 bp, Mus musculus
agctgtcggccactcgaggccgcga

SEQ ID NO: 267612 - DNA, 25 bp, Mus musculus
acgcactccgcagctcgccgggact

SEQ ID NO: 267613 - DNA, 25 bp, Mus musculus
cccggtgggtgacaccaattgcaga

SEQ ID NO: 267614 - DNA, 25 bp, Mus musculus
gtgggtgacaccaattgcagagccc

SEQ ID NO: 267615 - DNA, 25 bp, Mus musculus
gctgccgcagctcgccgacaggttc

SEQ ID NO: 267616 - DNA, 25 bp, Mus musculus
acaggttcccggtggctctgcgcgc

SEQ ID NO: 267617 - DNA, 25 bp, Mus musculus
ccagcgtcaggatgggcgccgacca

SEQ ID NO: 267618 - DNA, 25 bp, Mus musculus
tggctccggtccacgatctcgaacg

SEQ ID NO: 267619 - DNA, 25 bp, Mus musculus
atgggcgccgaccagctgtcggcca

SEQ ID NO: 267620 - DNA, 25 bp, Mus musculus
tctaggcctgcttggggctcaggct

SEQ ID NO: 267621 - DNA, 25 bp, Mus musculus
ccatgttgttaggtcacgtgacccg

SEQ ID NO: 267622 - DNA, 25 bp, Mus musculus
gttaggtcacgtgacccgccgctgc

SEQ ID NO: 267623 - DNA, 25 bp, Mus musculus
ctggaccgacgaccttaagccgctg

SEQ ID NO: 267624 - DNA, 25 bp, Mus musculus
tcaccagcgtatccatggccgggcg

SEQ ID NO: 267625 - DNA, 25 bp, Mus musculus
cggagtgcgggaagtctcccttgaa

SEQ ID NO: 267626 - DNA, 25 bp, Mus musculus
agccactccggtgagaagccgcacg

SEQ ID NO: 267627 - DNA, 25 bp, Mus musculus
tgaagccggcgcatctactgcgcca

SEQ ID NO: 267628 - DNA, 25 bp, Mus musculus
gtaaggagcacctgcggcgccaccg

SEQ ID NO: 267629 - DNA, 25 bp, Mus musculus
aagccgcacgcgtgctgcgaatgcg

SEQ ID NO: 267630 - DNA, 25 bp, Mus musculus
cgcgtgctgcgaatgcggcaagacc

SEQ ID NO: 267631 - DNA, 25 bp, Mus musculus
ttctactggcgcgagcacctggtgc

SEQ ID NO: 267632 - DNA, 25 bp, Mus musculus
gcgacctttcgcctgctgggaatgt

SEQ ID NO: 267633 - DNA, 25 bp, Mus musculus
ctttcgcctgctgggaatgtggcaa

SEQ ID NO: 267634 - DNA, 25 bp, Mus musculus
ggcgtgagcatgtgctccgtcacca

SEQ ID NO: 267635 - DNA, 25 bp, Mus musculus
gtgctccgtcaccagcgtatccatg

SEQ ID NO: 267636 - DNA, 25 bp, Mus musculus
aagtctcccttgaagccggcgcatc

SEQ ID NO: 267637 - DNA, 25 bp, Mus musculus
aggcattccggcgtaaggagcacct

SEQ ID NO: 267638 - DNA, 25 bp, Mus musculus
tcggtcattcttgagtctcagacta

SEQ ID NO: 267639 - DNA, 25 bp, Mus musculus
agcaccaatggttcccatagcgacg

SEQ ID NO: 267640 - DNA, 25 bp, Mus musculus
ggcctcagcaccaatggttcccata

SEQ ID NO: 267641 - DNA, 25 bp, Mus musculus
ctgcacacttttcggggcctcagca

SEQ ID NO: 267642 - DNA, 25 bp, Mus musculus
cgtgctcttcttcgcggcctagcag

SEQ ID NO: 267643 - DNA, 25 bp, Mus musculus
tccaagcgagccgtgctcttcttcg

SEQ ID NO: 267644 - DNA, 25 bp, Mus musculus
gacctcgaggacagagggcccactc

SEQ ID NO: 267645 - DNA, 25 bp, Mus musculus
tcctgtgaatcgagggtagcgaacg

SEQ ID NO: 267646 - DNA, 25 bp, Mus musculus
gccgcactgggcagaaacagggtcc

SEQ ID NO: 267647 - DNA, 25 bp, Mus musculus
tggttcgccgcactgggcagaaaca

SEQ ID NO: 267648 - DNA, 25 bp, Mus musculus
ctagtcttcccagtggttcgccgca

SEQ ID NO: 267649 - DNA, 25 bp, Mus musculus
ctcagactagtcttcccagtggttc

SEQ ID NO: 267650 - DNA, 25 bp, Mus musculus
acattatgtcggtcattcttgagtc

SEQ ID NO: 267651 - DNA, 25 bp, Mus musculus
ggggcgggacttccgacattatgtc

SEQ ID NO: 267652 - DNA, 25 bp, Mus musculus
gctcaccaaagtagtctcgcgccgt

SEQ ID NO: 267653 - DNA, 25 bp, Mus musculus
cgacccagaccctggcccgcgcacg

SEQ ID NO: 267654 - DNA, 25 bp, Mus musculus
cccgtcaggaatgtgaggaaggaga

SEQ ID NO: 267655 - DNA, 25 bp, Mus musculus
aggaaggagactgcgcagcggcctc

SEQ ID NO: 267656 - DNA, 25 bp, Mus musculus
gcgcacgctcaccaaagtagtctcg

SEQ ID NO: 267657 - DNA, 25 bp, Mus musculus
accaaagtagtctcgcgccgtgcgc

SEQ ID NO: 267658 - DNA, 25 bp, Mus musculus
tccagttcccgcgtgagcgcctcca

SEQ ID NO: 267659 - DNA, 25 bp, Mus musculus
acaggcgcccgctgagccacgggaa

SEQ ID NO: 267660 - DNA, 25 bp, Mus musculus
aacccaggctggacacgctggagcg

SEQ ID NO: 267661 - DNA, 25 bp, Mus musculus
gagggactcctttgccccgtcagga

SEQ ID NO: 267662 - DNA, 25 bp, Mus musculus
cccaggctgataccgctcgagcgcg

SEQ ID NO: 267663 - DNA, 25 bp, Mus musculus
agccacccttgcctcggcggcccga

SEQ ID NO: 267664 - DNA, 25 bp, Mus musculus
cggcagcaggtctgcacaggcgccc

SEQ ID NO: 267665 - DNA, 25 bp, Mus musculus
tcggctccgactcgcgcaggcccag

SEQ ID NO: 267666 - DNA, 25 bp, Mus musculus
gctcggccgcgggatcgttatttta

SEQ ID NO: 267667 - DNA, 25 bp, Mus musculus
agtgtaactggggaaactgcctcgg

SEQ ID NO: 267668 - DNA, 25 bp, Mus musculus
ctcttcttgcatcccagtgtaactg

SEQ ID NO: 267669 - DNA, 25 bp, Mus musculus
acagcatctacagggtctcttcttg

SEQ ID NO: 267670 - DNA, 25 bp, Mus musculus
atgaatgcacgtgtgcacgcccggc

SEQ ID NO: 267671 - DNA, 25 bp, Mus musculus
gttggagaatatttgaattaaagtc

SEQ ID NO: 267672 - DNA, 25 bp, Mus musculus
agcccgggcctcaccaggtcgatgt

SEQ ID NO: 267673 - DNA, 25 bp, Mus musculus
ggacgtctacgagccgcctcacagt

SEQ ID NO: 267674 - DNA, 25 bp, Mus musculus
ttaaagtcacagcatctacagggtc

SEQ ID NO: 267675 - DNA, 25 bp, Mus musculus
gaagccagtgagcaccaggttcttg

SEQ ID NO: 267676 - DNA, 25 bp, Mus musculus
cgacagtgccatggcgggacgtcta

SEQ ID NO: 267677 - DNA, 25 bp, Mus musculus
cctcacagtcggaggcgggagaacc

SEQ ID NO: 267678 - DNA, 25 bp, Mus musculus
caccaggtcgatgtgggagaagcca

SEQ ID NO: 267679 - DNA, 25 bp, Mus musculus
gtgagcaccaggttcttgagcagct

SEQ ID NO: 267680 - DNA, 25 bp, Mus musculus
gcgaacacgtacagaagccgatgga

SEQ ID NO: 267681 - DNA, 25 bp, Mus musculus
ctggacgagcacaggcgaacacgta

SEQ ID NO: 267682 - DNA, 25 bp, Mus musculus
agagagtgttatctgcgcacgcgcg

SEQ ID NO: 267683 - DNA, 25 bp, Mus musculus
tacggtggccgacagagagtgttat

SEQ ID NO: 267684 - DNA, 25 bp, Mus musculus
ggctcccacgtgacagcgcgagcta

SEQ ID NO: 267685 - DNA, 25 bp, Mus musculus
ctgacggccgccataactactgggc

SEQ ID NO: 267686 - DNA, 25 bp, Mus musculus
cagcagtacaggcttcctgacggcc

SEQ ID NO: 267687 - DNA, 25 bp, Mus musculus
ccgtgtctcgaagtcccagcagtac

SEQ ID NO: 267688 - DNA, 25 bp, Mus musculus
ttggggcagcccttcaccgccgtgt

SEQ ID NO: 267689 - DNA, 25 bp, Mus musculus
acccagcttgctagaggtccaggcg

SEQ ID NO: 267690 - DNA, 25 bp, Mus musculus
cggaacgccacccagcttgctagag

SEQ ID NO: 267691 - DNA, 25 bp, Mus musculus
tgaggagcaggctgcagctcagacc

SEQ ID NO: 267692 - DNA, 25 bp, Mus musculus
gcagtacacctgcacgacgagcgtg

SEQ ID NO: 267693 - DNA, 25 bp, Mus musculus
gcctacctgcgcgtctggctgttgc

SEQ ID NO: 267694 - DNA, 25 bp, Mus musculus
cgcggtgccactccaggagcttctg

SEQ ID NO: 267695 - DNA, 25 bp, Mus musculus
ctccgcgtccgctaggcgaccttgc

SEQ ID NO: 267696 - DNA, 25 bp, Mus musculus
cgtgcgtgcacctgaagttgttgaa

SEQ ID NO: 267697 - DNA, 25 bp, Mus musculus
tgaagttgttgaagcgctccggatc

SEQ ID NO: 267698 - DNA, 25 bp, Mus musculus
tgaagcgctccggatccgcctcaaa

SEQ ID NO: 267699 - DNA, 25 bp, Mus musculus
ctccggatccgcctcaaaaagttcg

SEQ ID NO: 267700 - DNA, 25 bp, Mus musculus
cgcctcaaaaagttcgcgcagcttg

SEQ ID NO: 267701 - DNA, 25 bp, Mus musculus
gcagcttgaggttggcagagttcgc

SEQ ID NO: 267702 - DNA, 25 bp, Mus musculus
agagttcgcgcggtgccactccagg

SEQ ID NO: 267703 - DNA, 25 bp, Mus musculus
gagcttctggaactgcgggttccgg

SEQ ID NO: 267704 - DNA, 25 bp, Mus musculus
agcaggacgtgctcggaagaggaag

SEQ ID NO: 267705 - DNA, 25 bp, Mus musculus
gcaagtcggtaccagtgcgcgcagc

SEQ ID NO: 267706 - DNA, 25 bp, Mus musculus
acccgagaggtacacggagcaggac

SEQ ID NO: 267707 - DNA, 25 bp, Mus musculus
gctttatggcgcaggcgtccgaccc

SEQ ID NO: 267708 - DNA, 25 bp, Mus musculus
cgacgggtgtgggtccttcctcagt

SEQ ID NO: 267709 - DNA, 25 bp, Mus musculus
tgccagtcgcccttgcgacccgccg

SEQ ID NO: 267710 - DNA, 25 bp, Mus musculus
cccgccgacccgagcccgctggcga

SEQ ID NO: 267711 - DNA, 25 bp, Mus musculus
tggcgaccgtacctcacctgcgaag

SEQ ID NO: 267712 - DNA, 25 bp, Mus musculus
gcccggaccggctgtgtacaccgga

SEQ ID NO: 267713 - DNA, 25 bp, Mus musculus
cggctgtgtacaccggaagtgacgt

SEQ ID NO: 267714 - DNA, 25 bp, Mus musculus
ccctcagggtctcgtcccgggcgcg

SEQ ID NO: 267715 - DNA, 25 bp, Mus musculus
gcagccgcgtccttcagcgccaacg

SEQ ID NO: 267716 - DNA, 25 bp, Mus musculus
cggcccaaggcagccgcgtccttca

SEQ ID NO: 267717 - DNA, 25 bp, Mus musculus
acccaggtcgcccacaggccgccag

SEQ ID NO: 267718 - DNA, 25 bp, Mus musculus
tgcccgtggacccaggtcgcccaca

SEQ ID NO: 267719 - DNA, 25 bp, Mus musculus
gcgcccacgggctcagagggagcca

SEQ ID NO: 267720 - DNA, 25 bp, Mus musculus
tgtgggtccttcctcagtcctagcc

SEQ ID NO: 267721 - DNA, 25 bp, Mus musculus
ccgcgagctcgcctcgatgccagtc

SEQ ID NO: 267722 - DNA, 25 bp, Mus musculus
cggctaggaccagcccacgtgggca

SEQ ID NO: 267723 - DNA, 25 bp, Mus musculus
tcagactcaggaaagtcatcagctc

SEQ ID NO: 267724 - DNA, 25 bp, Mus musculus
gtcatcagctctgcagggcactcga

SEQ ID NO: 267725 - DNA, 25 bp, Mus musculus
ggcactcgagcccatactggaacca

SEQ ID NO: 267726 - DNA, 25 bp, Mus musculus
cacagcaggatgatcagagcccggc

SEQ ID NO: 267727 - DNA, 25 bp, Mus musculus
ctgcgctcagcagagggacaaagca

SEQ ID NO: 267728 - DNA, 25 bp, Mus musculus
gggccgagtgactttctcggaattg

SEQ ID NO: 267729 - DNA, 25 bp, Mus musculus
ctcggaattgcagccactttgggaa

SEQ ID NO: 267730 - DNA, 25 bp, Mus musculus
ggtctcgtcctggagttactttctc

SEQ ID NO: 267731 - DNA, 25 bp, Mus musculus
aaaaccagccggtagcctgtgcgcc

SEQ ID NO: 267732 - DNA, 25 bp, Mus musculus
gcccggattgcaaagggcagcgatc

SEQ ID NO: 267733 - DNA, 25 bp, Mus musculus
ggcagcgatccggttccaaattacc

SEQ ID NO: 267734 - DNA, 25 bp, Mus musculus
ttagagtcgcaattagctccgcgcg

SEQ ID NO: 267735 - DNA, 25 bp, Mus musculus
tggacgcatattccgcacagcagga

SEQ ID NO: 267736 - DNA, 25 bp, Mus musculus
ttccggactggtggtcctgtcaacg

SEQ ID NO: 267737 - DNA, 25 bp, Mus musculus
cttcctcaagcatcgtccgaggcga

SEQ ID NO: 267738 - DNA, 25 bp, Mus musculus
ccgaggcgacttgggcaaactctgt

SEQ ID NO: 267739 - DNA, 25 bp, Mus musculus
gccttggaacgcaaggagcctcgga

SEQ ID NO: 267740 - DNA, 25 bp, Mus musculus
cctctctcgagatgcagagtgtggc

SEQ ID NO: 267741 - DNA, 25 bp, Mus musculus
ccctgagcattggatgggttgtccc

SEQ ID NO: 267742 - DNA, 25 bp, Mus musculus
ccggagattagtgggaccctgctcc

SEQ ID NO: 267743 - DNA, 25 bp, Mus musculus
aggccgcctatgaacctggttgctc

SEQ ID NO: 267744 - DNA, 25 bp, Mus musculus
ccggaggccaatggtgaggacattt

SEQ ID NO: 267745 - DNA, 25 bp, Mus musculus
cactttgatggggtcgctctttagg

SEQ ID NO: 267746 - DNA, 25 bp, Mus musculus
tctttagggtaactgcgaggtgtcc

SEQ ID NO: 267747 - DNA, 25 bp, Mus musculus
tccgaggaacctcaattgggaatcc

SEQ ID NO: 267748 - DNA, 25 bp, Mus musculus
ttttgctggcttggtcctctagagg

SEQ ID NO: 267749 - DNA, 25 bp, Mus musculus
aatccactggggcagctcttttgct

SEQ ID NO: 267750 - DNA, 25 bp, Mus musculus
gcaggcttctcgcatcacacgcttg

SEQ ID NO: 267751 - DNA, 25 bp, Mus musculus
tgagcaccctcttccagttggagca

SEQ ID NO: 267752 - DNA, 25 bp, Mus musculus
tgaggctaaccctgccagcaccatg

SEQ ID NO: 267753 - DNA, 25 bp, Mus musculus
ccggtcaaaagtatccaggcgctta

SEQ ID NO: 267754 - DNA, 25 bp, Mus musculus
gtgcactatgccctgccggtcaaaa

SEQ ID NO: 267755 - DNA, 25 bp, Mus musculus
gggttcccggacaaagagcatcttg

SEQ ID NO: 267756 - DNA, 25 bp, Mus musculus
accgggccaggatagccttgccaaa

SEQ ID NO: 267757 - DNA, 25 bp, Mus musculus
tactggacgaactcggggaactgca

SEQ ID NO: 267758 - DNA, 25 bp, Mus musculus
acagccggctaacatggtcccagtg

SEQ ID NO: 267759 - DNA, 25 bp, Mus musculus
ccctgcggctggcatctttttgatg

SEQ ID NO: 267760 - DNA, 25 bp, Mus musculus
tgctgctggccctgtatttagcgca

SEQ ID NO: 267761 - DNA, 25 bp, Mus musculus
tgcaggctgacccaacgactgtcca

SEQ ID NO: 267762 - DNA, 25 bp, Mus musculus
agcagcctgccttgggtacttcaca

SEQ ID NO: 267763 - DNA, 25 bp, Mus musculus
agtgcctgtccttgaacctcgggaa

SEQ ID NO: 267764 - DNA, 25 bp, Mus musculus
cggggttctgcgactgcagcgtcta

SEQ ID NO: 267765 - DNA, 25 bp, Mus musculus
gcactggcctgcgtccttctggagg

SEQ ID NO: 267766 - DNA, 25 bp, Mus musculus
gactgcagcgtctagttgcgtgtca

SEQ ID NO: 267767 - DNA, 25 bp, Mus musculus
gctgtctccggggttctgcgactgc

SEQ ID NO: 267768 - DNA, 25 bp, Mus musculus
ccaaattattgagggcgtggcctcg

SEQ ID NO: 267769 - DNA, 25 bp, Mus musculus
cggcagaatagccaaccaaattatt

SEQ ID NO: 267770 - DNA, 25 bp, Mus musculus
cacacgggtcggcagaatagccaac

SEQ ID NO: 267771 - DNA, 25 bp, Mus musculus
cttagaaaagcgcttagcgtaggag

SEQ ID NO: 267772 - DNA, 25 bp, Mus musculus
gcatgctgaatggactctaacggga

SEQ ID NO: 267773 - DNA, 25 bp, Mus musculus
tcccggaaaggacgcatgctgaatg

SEQ ID NO: 267774 - DNA, 25 bp, Mus musculus
ctaggagaagcatcccggaaaggac

SEQ ID NO: 267775 - DNA, 25 bp, Mus musculus
tccgaggtgtggaacgctaggagaa

SEQ ID NO: 267776 - DNA, 25 bp, Mus musculus
aagctcgcggttgcgcacggcgtaa

SEQ ID NO: 267777 - DNA, 25 bp, Mus musculus
gactctaacgggagcttggccgaac

SEQ ID NO: 267778 - DNA, 25 bp, Mus musculus
ctcccagcgaagtgcgagcgaagcc

SEQ ID NO: 267779 - DNA, 25 bp, Mus musculus
ctccggcaaggctggaaatagcgcc

SEQ ID NO: 267780 - DNA, 25 bp, Mus musculus
tggcctctaagtcccagttccaagc

SEQ ID NO: 267781 - DNA, 25 bp, Mus musculus
gggagccaaggtcgcttgtaacttc

SEQ ID NO: 267782 - DNA, 25 bp, Mus musculus
cctattggatcttctgcaccgggtg

SEQ ID NO: 267783 - DNA, 25 bp, Mus musculus
aggctgcgtctttttcccggtgtag

SEQ ID NO: 267784 - DNA, 25 bp, Mus musculus
cttgggaagcaagaaggatctccgc

SEQ ID NO: 267785 - DNA, 25 bp, Mus musculus
gagaatcttccctccggagctcttg

SEQ ID NO: 267786 - DNA, 25 bp, Mus musculus
caacccttcgggtgaactatcaaca

SEQ ID NO: 267787 - DNA, 25 bp, Mus musculus
tcccggcatcatcctgggatttcca

SEQ ID NO: 267788 - DNA, 25 bp, Mus musculus
ttgcgctcagaacagtcccggcatc

SEQ ID NO: 267789 - DNA, 25 bp, Mus musculus
ttaggactctgaaccacgtctagtg

SEQ ID NO: 267790 - DNA, 25 bp, Mus musculus
ttacacgcacccagcatccagggtt

SEQ ID NO: 267791 - DNA, 25 bp, Mus musculus
accttgcgtctcctggtagggagcc

SEQ ID NO: 267792 - DNA, 25 bp, Mus musculus
ctgaacagtgggtgacagcctccga

SEQ ID NO: 267793 - DNA, 25 bp, Mus musculus
cttctctggggcaccggaaccgaga

SEQ ID NO: 267794 - DNA, 25 bp, Mus musculus
ccacgtgacgctagcgccgagtgaa

SEQ ID NO: 267795 - DNA, 25 bp, Mus musculus
gctgcgcgcttcttctctggggcac

SEQ ID NO: 267796 - DNA, 25 bp, Mus musculus
tgacgctgcactccacgtgacgcta

SEQ ID NO: 267797 - DNA, 25 bp, Mus musculus
agctggttcagctgacgctgcactc

SEQ ID NO: 267798 - DNA, 25 bp, Mus musculus
ctgactggagttgctctgtggccgc

SEQ ID NO: 267799 - DNA, 25 bp, Mus musculus
tagaggtggcctgcctcggtattcc

SEQ ID NO: 267800 - DNA, 25 bp, Mus musculus
agtgctgagcttgtcccttgccctg

SEQ ID NO: 267801 - DNA, 25 bp, Mus musculus
tccactgtgcggtgagtgctgagct

SEQ ID NO: 267802 - DNA, 25 bp, Mus musculus
gtgaacatggcgtccactgtgcggt

SEQ ID NO: 267803 - DNA, 25 bp, Mus musculus
gacgctagcgccgagtgaacatggc

SEQ ID NO: 267804 - DNA, 25 bp, Mus musculus
cctcggtattcctagctgaacagtg

SEQ ID NO: 267805 - DNA, 25 bp, Mus musculus
tcctcagaggaaccctagctggttc

SEQ ID NO: 267806 - DNA, 25 bp, Mus musculus
ccgtgaccaatagaagcgctgcttg

SEQ ID NO: 267807 - DNA, 25 bp, Mus musculus
aatcacaggccgtgtgccggcgaga

SEQ ID NO: 267808 - DNA, 25 bp, Mus musculus
tcgcctctagagatgggcagctcca

SEQ ID NO: 267809 - DNA, 25 bp, Mus musculus
gcgctgcttggagaacgacgcgctc

SEQ ID NO: 267810 - DNA, 25 bp, Mus musculus
gccgccgtgaccaatagaagcgctg

SEQ ID NO: 267811 - DNA, 25 bp, Mus musculus
tccgagctacaacccgcggcctcct

SEQ ID NO: 267812 - DNA, 25 bp, Mus musculus
caacctgccgaatcgggcagggccg

SEQ ID NO: 267813 - DNA, 25 bp, Mus musculus
gcaggttgcatcagacgccgctccg

SEQ ID NO: 267814 - DNA, 25 bp, Mus musculus
gtgttgcccgcaggttgcatcagac

SEQ ID NO: 267815 - DNA, 25 bp, Mus musculus
ttctggagggaccacctggtactcc

SEQ ID NO: 267816 - DNA, 25 bp, Mus musculus
tcacgctgcacgtcgccgaggggca

SEQ ID NO: 267817 - DNA, 25 bp, Mus musculus
gcgccaggcttgtcacgctgcacgt

SEQ ID NO: 267818 - DNA, 25 bp, Mus musculus
gatgggcagctccaccagccaatca

SEQ ID NO: 267819 - DNA, 25 bp, Mus musculus
agaacgacgcgctcgcctctagaga

SEQ ID NO: 267820 - DNA, 25 bp, Mus musculus
ctacggtagctcaaaaccaacattc

SEQ ID NO: 267821 - DNA, 25 bp, Mus musculus
gcggtgactttgactacccgggagc

SEQ ID NO: 267822 - DNA, 25 bp, Mus musculus
ttcaacgacgagttcctggccgacc

SEQ ID NO: 267823 - DNA, 25 bp, Mus musculus
tctatagacatcagcgcctacatcg

SEQ ID NO: 267824 - DNA, 25 bp, Mus musculus
tgcgagcacgagacgtctatagaca

SEQ ID NO: 267825 - DNA, 25 bp, Mus musculus
cggccgacttctacgaggtggagcc

SEQ ID NO: 267826 - DNA, 25 bp, Mus musculus
cgccatgccgggagaactctaactc

SEQ ID NO: 267827 - DNA, 25 bp, Mus musculus
ggcgatgcccgaccctctataaaag

SEQ ID NO: 267828 - DNA, 25 bp, Mus musculus
atccgagacccgtttggacaccagg

SEQ ID NO: 267829 - DNA, 25 bp, Mus musculus
tcctactggcgccttcgatccgaga

SEQ ID NO: 267830 - DNA, 25 bp, Mus musculus
gcgggctctaagacccagcaggcac

SEQ ID NO: 267831 - DNA, 25 bp, Mus musculus
ctcaccgccttggaaagtcacagga

SEQ ID NO: 267832 - DNA, 25 bp, Mus musculus
acgatctctctccactagcactatg

SEQ ID NO: 267833 - DNA, 25 bp, Mus musculus
ggcgcctaaccacggaccacgtgtg

SEQ ID NO: 267834 - DNA, 25 bp, Mus musculus
agtggcctcatcctcatgcagggga

SEQ ID NO: 267835 - DNA, 25 bp, Mus musculus
tggcctcatcctcatgcaggggacg

SEQ ID NO: 267836 - DNA, 25 bp, Mus musculus
ccgagtggcctcatcctcatgcagg

SEQ ID NO: 267837 - DNA, 25 bp, Mus musculus
tcgccagcaacacacaaaagctgtt

SEQ ID NO: 267838 - DNA, 25 bp, Mus musculus
acacaaaagctgttccgccgtcggc

SEQ ID NO: 267839 - DNA, 25 bp, Mus musculus
ctcatcctcatgcaggggacggcgc

SEQ ID NO: 267840 - DNA, 25 bp, Mus musculus
gacggcgcgacgcagctatcgccag

SEQ ID NO: 267841 - DNA, 25 bp, Mus musculus
ggcgcgacgcagctatcgccagcaa

SEQ ID NO: 267842 - DNA, 25 bp, Mus musculus
acaaaagctgttccgccgtcggcca

SEQ ID NO: 267843 - DNA, 25 bp, Mus musculus
gcagctatcgccagcaacacacaaa

SEQ ID NO: 267844 - DNA, 25 bp, Mus musculus
tcggccacaccgtgccagcctcgct

SEQ ID NO: 267845 - DNA, 25 bp, Mus musculus
tggccctgctccctcgcaccacccg

SEQ ID NO: 267846 - DNA, 25 bp, Mus musculus
gcaccacccgcgcatgaatttgccc

SEQ ID NO: 267847 - DNA, 25 bp, Mus musculus
aatttgccccgcgatctgggctgca

SEQ ID NO: 267848 - DNA, 25 bp, Mus musculus
gctggtgagcgcttgcaccatcatc

SEQ ID NO: 267849 - DNA, 25 bp, Mus musculus
cgggacagcgacatggcaagccaca

SEQ ID NO: 267850 - DNA, 25 bp, Mus musculus
gccgcgagcgcaccgacagacgaaa

SEQ ID NO: 267851 - DNA, 25 bp, Mus musculus
gagcgcaccgacagacgaaaccgac

SEQ ID NO: 267852 - DNA, 25 bp, Mus musculus
ggcaagccacatacaacagccaggc

SEQ ID NO: 267853 - DNA, 25 bp, Mus musculus
gccacatacaacagccaggcgggca

SEQ ID NO: 267854 - DNA, 25 bp, Mus musculus
cctcggagcgggtggcactcaagaa

SEQ ID NO: 267855 - DNA, 25 bp, Mus musculus
gcgggtggcactcaagaaagagatc

SEQ ID NO: 267856 - DNA, 25 bp, Mus musculus
cactcaagaaagagatcgggctggt

SEQ ID NO: 267857 - DNA, 25 bp, Mus musculus
acagacggaggtagcgcagggaact

SEQ ID NO: 267858 - DNA, 25 bp, Mus musculus
catcggtgagtagggcgtacatagc

SEQ ID NO: 267859 - DNA, 25 bp, Mus musculus
tcatcatcggtgagtagggcgtaca

SEQ ID NO: 267860 - DNA, 25 bp, Mus musculus
tgagcgcttgcaccatcatcatcgg

SEQ ID NO: 267861 - DNA, 25 bp, Mus musculus
cttgcaccatcatcatcggtgagta

SEQ ID NO: 267862 - DNA, 25 bp, Mus musculus
gtgcagtgaaggtccgaaggcccac

SEQ ID NO: 267863 - DNA, 25 bp, Mus musculus
gcgaaggaaccgtaaaagctgccca

SEQ ID NO: 267864 - DNA, 25 bp, Mus musculus
cagcactgcgagcacgagcatggta

SEQ ID NO: 267865 - DNA, 25 bp, Mus musculus
taacccagtcgtagctccagctgca

SEQ ID NO: 267866 - DNA, 25 bp, Mus musculus
atcagagccgtcaccgcagtcctga

SEQ ID NO: 267867 - DNA, 25 bp, Mus musculus
gccacatgctaggtcggggcagcca

SEQ ID NO: 267868 - DNA, 25 bp, Mus musculus
gttgaagccgtgaccagcactgcga

SEQ ID NO: 267869 - DNA, 25 bp, Mus musculus
cacgggcggcgccaaacaagtctgg

SEQ ID NO: 267870 - DNA, 25 bp, Mus musculus
gtgtccaccagccacgtgcagtgaa

SEQ ID NO: 267871 - DNA, 25 bp, Mus musculus
tggacatagtcatcataacccagtc

SEQ ID NO: 267872 - DNA, 25 bp, Mus musculus
ggccttcatacacctggacatagtc

SEQ ID NO: 267873 - DNA, 25 bp, Mus musculus
ttgctgcggtaggaaagcgtttgca

SEQ ID NO: 267874 - DNA, 25 bp, Mus musculus
gcacgagcatggtaggccacagtga

SEQ ID NO: 267875 - DNA, 25 bp, Mus musculus
gggcagccagcctcatcagagccgt

SEQ ID NO: 267876 - DNA, 25 bp, Mus musculus
agtgcagtgcacaagcctctccagc

SEQ ID NO: 267877 - DNA, 25 bp, Mus musculus
tgtcgcccacgtgctggactctcag

SEQ ID NO: 267878 - DNA, 25 bp, Mus musculus
agcgtgttccctgtgcccacagcga

SEQ ID NO: 267879 - DNA, 25 bp, Mus musculus
cgagcccagacccaggacgagatgt

SEQ ID NO: 267880 - DNA, 25 bp, Mus musculus
aggacgagatgtcgctgtcgcccac

SEQ ID NO: 267881 - DNA, 25 bp, Mus musculus
ggactctcagcctgcgcccttcaga

SEQ ID NO: 267882 - DNA, 25 bp, Mus musculus
gcccttcagacaccgccggccatcg

SEQ ID NO: 267883 - DNA, 25 bp, Mus musculus
gacccgcaccttcgtccagaggctc

SEQ ID NO: 267884 - DNA, 25 bp, Mus musculus
ggctccaggcccgttccatagctga

SEQ ID NO: 267885 - DNA, 25 bp, Mus musculus
agctgatcagatcctcgtcgctgtc

SEQ ID NO: 267886 - DNA, 25 bp, Mus musculus
aacgcggcgcccaagtgcagtgcac

SEQ ID NO: 267887 - DNA, 25 bp, Mus musculus
agatcctcgtcgctgtcactgtcca

SEQ ID NO: 267888 - DNA, 25 bp, Mus musculus
ggcccgttccatagctgatcagatc

SEQ ID NO: 267889 - DNA, 25 bp, Mus musculus
gtgcacaagcctctccagcgtgttc

SEQ ID NO: 267890 - DNA, 25 bp, Mus musculus
cgcttcgtggagggccaaacccgca

SEQ ID NO: 267891 - DNA, 25 bp, Mus musculus
ccaggcgcgttctgaaagctgagtc

SEQ ID NO: 267892 - DNA, 25 bp, Mus musculus
ttctgactacacctcccagaaggca

SEQ ID NO: 267893 - DNA, 25 bp, Mus musculus
gcctgaggtcttttctgactacacc

SEQ ID NO: 267894 - DNA, 25 bp, Mus musculus
tcccggcatgcctgaggtcttttct

SEQ ID NO: 267895 - DNA, 25 bp, Mus musculus
ccagagaactactactcccggcatg

SEQ ID NO: 267896 - DNA, 25 bp, Mus musculus
cagtcaggatcacctccaccaggag

SEQ ID NO: 267897 - DNA, 25 bp, Mus musculus
gctctctcctagcacagtcaggatc

SEQ ID NO: 267898 - DNA, 25 bp, Mus musculus
agacgctctctcctagcacagtcag

SEQ ID NO: 267899 - DNA, 25 bp, Mus musculus
acgagcagtctcgaggatgtcggcc

SEQ ID NO: 267900 - DNA, 25 bp, Mus musculus
cactctcagcacgagcagtctcgag

SEQ ID NO: 267901 - DNA, 25 bp, Mus musculus
ggcgctcgctcccaccactctcagc

SEQ ID NO: 267902 - DNA, 25 bp, Mus musculus
cccactcacggacgccggcgctcgc

SEQ ID NO: 267903 - DNA, 25 bp, Mus musculus
cgcgttctgaaagctgagtcgggtc

SEQ ID NO: 267904 - DNA, 25 bp, Mus musculus
tcccaagtgctttcagcgttggccc

SEQ ID NO: 267905 - DNA, 25 bp, Mus musculus
gtgcacaggcaagccacacgcaggt

SEQ ID NO: 267906 - DNA, 25 bp, Mus musculus
aaaggaccagctcctggccacgctg

SEQ ID NO: 267907 - DNA, 25 bp, Mus musculus
ggtcggtccctctgcacttataccg

SEQ ID NO: 267908 - DNA, 25 bp, Mus musculus
agctcagtttccacccgagcgctta

SEQ ID NO: 267909 - DNA, 25 bp, Mus musculus
gttttgctcttttgcctcccaagtg

SEQ ID NO: 267910 - DNA, 25 bp, Mus musculus
ttcgtttgtcctcgcccaagagagc

SEQ ID NO: 267911 - DNA, 25 bp, Mus musculus
ccaagagagccagagaaccggagtc

SEQ ID NO: 267912 - DNA, 25 bp, Mus musculus
ccggagtctcactcttccaaagtgg

SEQ ID NO: 267913 - DNA, 25 bp, Mus musculus
tctgtatttggttgtccgagagacc

SEQ ID NO: 267914 - DNA, 25 bp, Mus musculus
gtcttggcgctcctgggcaattaat

SEQ ID NO: 267915 - DNA, 25 bp, Mus musculus
tgggcaattaatgcgactgcctttc

SEQ ID NO: 267916 - DNA, 25 bp, Mus musculus
tgcctttcgccctggaactcagttc

SEQ ID NO: 267917 - DNA, 25 bp, Mus musculus
agcgcttagccatggtgcatctgga

SEQ ID NO: 267918 - DNA, 25 bp, Mus musculus
gaaggctagaaagcacatgcgcacc

SEQ ID NO: 267919 - DNA, 25 bp, Mus musculus
gtcactcacttaatcggaacgcaag

SEQ ID NO: 267920 - DNA, 25 bp, Mus musculus
ttaatcggaacgcaagctgacggca

SEQ ID NO: 267921 - DNA, 25 bp, Mus musculus
gcaagctgacggcacccgagttttg

SEQ ID NO: 267922 - DNA, 25 bp, Mus musculus
cgaggaaggcctcgggcactcctca

SEQ ID NO: 267923 - DNA, 25 bp, Mus musculus
agcaccaggacctcgaacatcctgg

SEQ ID NO: 267924 - DNA, 25 bp, Mus musculus
cctggcccttctctcacagaggaga

SEQ ID NO: 267925 - DNA, 25 bp, Mus musculus
ctcacagaggagatcacagcacaca

SEQ ID NO: 267926 - DNA, 25 bp, Mus musculus
acagcacacagacggggagacagca

SEQ ID NO: 267927 - DNA, 25 bp, Mus musculus
tgagagtgagcgtccctcaccaccg

SEQ ID NO: 267928 - DNA, 25 bp, Mus musculus
cgcacagggctccagaaggctagaa

SEQ ID NO: 267929 - DNA, 25 bp, Mus musculus
cacatgcgcaccaacggcctggata

SEQ ID NO: 267930 - DNA, 25 bp, Mus musculus
aacggcctggataatggcctggctg

SEQ ID NO: 267931 - DNA, 25 bp, Mus musculus
accaccgacaaaaagacctggcctg

SEQ ID NO: 267932 - DNA, 25 bp, Mus musculus
tgtctcttcccttccggtcgtcaga

SEQ ID NO: 267933 - DNA, 25 bp, Mus musculus
cgtggtctcgcacggtcactctgca

SEQ ID NO: 267934 - DNA, 25 bp, Mus musculus
cactttctcccacgcggtaccttga

SEQ ID NO: 267935 - DNA, 25 bp, Mus musculus
ggtaccttgatcctcaccgagcgtc

SEQ ID NO: 267936 - DNA, 25 bp, Mus musculus
gtagagctcacaaaggcgcggctgc

SEQ ID NO: 267937 - DNA, 25 bp, Mus musculus
actgcgcttgactggagcggcgtaa

SEQ ID NO: 267938 - DNA, 25 bp, Mus musculus
atctccgctgaattctgtctcttcc

SEQ ID NO: 267939 - DNA, 25 bp, Mus musculus
ttccggtcgtcagaaccagaactca

SEQ ID NO: 267940 - DNA, 25 bp, Mus musculus
tcgtcagaaccagaactcactcagg

SEQ ID NO: 267941 - DNA, 25 bp, Mus musculus
actcactcaggctgcgcaggagctg

SEQ ID NO: 267942 - DNA, 25 bp, Mus musculus
caggagctgcttgctctcctcggtc

SEQ ID NO: 267943 - DNA, 25 bp, Mus musculus
tgcttgctctcctcggtctcttaga

SEQ ID NO: 267944 - DNA, 25 bp, Mus musculus
cctcggtctcttagacgaggagtcg

SEQ ID NO: 267945 - DNA, 25 bp, Mus musculus
ggggtcctagaatctccgctgaatt

SEQ ID NO: 267946 - DNA, 25 bp, Mus musculus
ttgagagcctaaagcaaggtcacgc

SEQ ID NO: 267947 - DNA, 25 bp, Mus musculus
ccgcttagggtgagagttgagtcct

SEQ ID NO: 267948 - DNA, 25 bp, Mus musculus
tacttgtgggaggagcgtgattccc

SEQ ID NO: 267949 - DNA, 25 bp, Mus musculus
gagtggtgtccagaagccctataaa

SEQ ID NO: 267950 - DNA, 25 bp, Mus musculus
cgccagctgctcgagctgctcatgg

SEQ ID NO: 267951 - DNA, 25 bp, Mus musculus
tgggtccagcctgctgccaacatca

SEQ ID NO: 267952 - DNA, 25 bp, Mus musculus
aagcgctggttttgtgctcgctgga

SEQ ID NO: 267953 - DNA, 25 bp, Mus musculus
gatggcacagatgcgcagcgctacg

SEQ ID NO: 267954 - DNA, 25 bp, Mus musculus
cgcctttggtctggggtaaggctca

SEQ ID NO: 267955 - DNA, 25 bp, Mus musculus
cgaaacggcggatggttcgcccata

SEQ ID NO: 267956 - DNA, 25 bp, Mus musculus
gcccagatgtcaggcgtgcagtcta

SEQ ID NO: 267957 - DNA, 25 bp, Mus musculus
tgcagtctaggtgcgcacacagctg

SEQ ID NO: 267958 - DNA, 25 bp, Mus musculus
ctcctgagaagctggagccgcgtcc

SEQ ID NO: 267959 - DNA, 25 bp, Mus musculus
cgcgaacagacgcacccagtcgggt

SEQ ID NO: 267960 - DNA, 25 bp, Mus musculus
cggagccgcccacagtaagcactaa

SEQ ID NO: 267961 - DNA, 25 bp, Mus musculus
cggctccctgagaagcccagagtga

SEQ ID NO: 267962 - DNA, 25 bp, Mus musculus
ggtcacgcgtagtgtctttgcacca

SEQ ID NO: 267963 - DNA, 25 bp, Mus musculus
tgtcctcgccgctgttctcaacaga

SEQ ID NO: 267964 - DNA, 25 bp, Mus musculus
gggcggactgaaagctcctcatgtc

SEQ ID NO: 267965 - DNA, 25 bp, Mus musculus
ggcggtaccctacttgcaaccttca

SEQ ID NO: 267966 - DNA, 25 bp, Mus musculus
cttgtcgcgcctgtacagtccagcg

SEQ ID NO: 267967 - DNA, 25 bp, Mus musculus
tcttctgcagctcttcgcgtaggtc

SEQ ID NO: 267968 - DNA, 25 bp, Mus musculus
gcgctcctcggtagctaagctccgg

SEQ ID NO: 267969 - DNA, 25 bp, Mus musculus
ctgcatgtcggcttcgagcaggtcc

SEQ ID NO: 267970 - DNA, 25 bp, Mus musculus
tccaactggggcagatcggcgacat

SEQ ID NO: 267971 - DNA, 25 bp, Mus musculus
agcggggcacgttgactttcatttc

SEQ ID NO: 267972 - DNA, 25 bp, Mus musculus
tgcaccactttctttttcacggcgg

SEQ ID NO: 267973 - DNA, 25 bp, Mus musculus
ttcaacgtcgtaggtcgcctccagc

SEQ ID NO: 267974 - DNA, 25 bp, Mus musculus
gcctctcgaattctgggcacgcgca

SEQ ID NO: 267975 - DNA, 25 bp, Mus musculus
tccactaggtccagagggatgccta

SEQ ID NO: 267976 - DNA, 25 bp, Mus musculus
gcgcacgttgtccactaggtccaga

SEQ ID NO: 267977 - DNA, 25 bp, Mus musculus
cctactctggggaacgccgaggtcg

SEQ ID NO: 267978 - DNA, 25 bp, Mus musculus
taagtgtcttctgcgggtatcctcc

SEQ ID NO: 267979 - DNA, 25 bp, Mus musculus
ggtgaaactatgtagcctcttaagt

SEQ ID NO: 267980 - DNA, 25 bp, Mus musculus
ctgtcgtagcacagaggtgaaacta

SEQ ID NO: 267981 - DNA, 25 bp, Mus musculus
taggctgaagagtggagccaccgca

SEQ ID NO: 267982 - DNA, 25 bp, Mus musculus
cagactggagcagggttccgcccaa

SEQ ID NO: 267983 - DNA, 25 bp, Mus musculus
acgacctcttattggacagactgga

SEQ ID NO: 267984 - DNA, 25 bp, Mus musculus
cagtctcgactaaaacgacctctta

SEQ ID NO: 267985 - DNA, 25 bp, Mus musculus
tgctctgtttacgtgtcagtctcga

SEQ ID NO: 267986 - DNA, 25 bp, Mus musculus
acctccgactgaactagacttaatg

SEQ ID NO: 267987 - DNA, 25 bp, Mus musculus
ggcacgcgcactccctggttctggg

SEQ ID NO: 267988 - DNA, 25 bp, Mus musculus
tgctcaggcatcaaaagtcgagtgc

SEQ ID NO: 267989 - DNA, 25 bp, Mus musculus
ggtcccacgagcaaacgccgagagc

SEQ ID NO: 267990 - DNA, 25 bp, Mus musculus
gggctgagcaccatctctggagtcc

SEQ ID NO: 267991 - DNA, 25 bp, Mus musculus
tcgacggcagcgaaaaccgagactt

SEQ ID NO: 267992 - DNA, 25 bp, Mus musculus
cacacacgttgccatggggtacgcg

SEQ ID NO: 267993 - DNA, 25 bp, Mus musculus
gcctcaagttcttcgtccgccatgg

SEQ ID NO: 267994 - DNA, 25 bp, Mus musculus
cctccggtacactcggttggaatcg

SEQ ID NO: 267995 - DNA, 25 bp, Mus musculus
ccaggctctgaactgcgcgttaaca

SEQ ID NO: 267996 - DNA, 25 bp, Mus musculus
cagacgcgagtgatgctcaggcatc

SEQ ID NO: 267997 - DNA, 25 bp, Mus musculus
gtgccttgcagaggaccgatcctgc

SEQ ID NO: 267998 - DNA, 25 bp, Mus musculus
aggaccgatcctgcgatgggaaaag

SEQ ID NO: 267999 - DNA, 25 bp, Mus musculus
ggcagaacctctaagagggcgcttg

SEQ ID NO: 268000 - DNA, 25 bp, Mus musculus
cttgtgggttcccaggctctgaact

SEQ ID NO: 268001 - DNA, 25 bp, Mus musculus
gttggaatcgcttcggccggagact

SEQ ID NO: 268002 - DNA, 25 bp, Mus musculus
ccacttcacgggctacagcgaggtg

SEQ ID NO: 268003 - DNA, 25 bp, Mus musculus
cggcagctgttcgtcaacgcaaggc

SEQ ID NO: 268004 - DNA, 25 bp, Mus musculus
gcattcattggtcccggcagctgtt

SEQ ID NO: 268005 - DNA, 25 bp, Mus musculus
ggccgctaccgctgcattcattggt

SEQ ID NO: 268006 - DNA, 25 bp, Mus musculus
tgttcccggctctgtgcggcgcgct

SEQ ID NO: 268007 - DNA, 25 bp, Mus musculus
ggaggacccagctgttcccggctct

SEQ ID NO: 268008 - DNA, 25 bp, Mus musculus
acgggctacagcgaggtgaagacta

SEQ ID NO: 268009 - DNA, 25 bp, Mus musculus
agggacgcgcccacttcacgggcta

SEQ ID NO: 268010 - DNA, 25 bp, Mus musculus
gagcacccaggccttagggacgcgc

SEQ ID NO: 268011 - DNA, 25 bp, Mus musculus
ctcagcagtcctcaggggcggctcg

SEQ ID NO: 268012 - DNA, 25 bp, Mus musculus
ctgcggcctcagcagtcctcagggg

SEQ ID NO: 268013 - DNA, 25 bp, Mus musculus
gtcccgtagacactgcgcgtccagt

SEQ ID NO: 268014 - DNA, 25 bp, Mus musculus
gcgacactcgctcccgctctgagac

SEQ ID NO: 268015 - DNA, 25 bp, Mus musculus
tgaagactaggaggacccagctgtt

SEQ ID NO: 268016 - DNA, 25 bp, Mus musculus
tcctgcgagcctcctttggccggcc

SEQ ID NO: 268017 - DNA, 25 bp, Mus musculus
aggcaaaggcgcttcagcgggacct

SEQ ID NO: 268018 - DNA, 25 bp, Mus musculus
cttcagcgggacctggggagcaacg

SEQ ID NO: 268019 - DNA, 25 bp, Mus musculus
ctccacaggcccgacagagggacga

SEQ ID NO: 268020 - DNA, 25 bp, Mus musculus
cccgacagagggacgacagtacaca

SEQ ID NO: 268021 - DNA, 25 bp, Mus musculus
cgacagagggacgacagtacacaca

SEQ ID NO: 268022 - DNA, 25 bp, Mus musculus
gggacgacagtacacacagggccct

SEQ ID NO: 268023 - DNA, 25 bp, Mus musculus
gcgtcaccagcgaggccgcacatgg

SEQ ID NO: 268024 - DNA, 25 bp, Mus musculus
cgtccgcctcgctcccgactccttt

SEQ ID NO: 268025 - DNA, 25 bp, Mus musculus
cctcggccgtggctccaagatggcg

SEQ ID NO: 268026 - DNA, 25 bp, Mus musculus
cggcgccgagacagatcacgtgagc

SEQ ID NO: 268027 - DNA, 25 bp, Mus musculus
agacagatcacgtgagcggcgagcc

SEQ ID NO: 268028 - DNA, 25 bp, Mus musculus
gtctccagaaggcaaaggcgcttca

SEQ ID NO: 268029 - DNA, 25 bp, Mus musculus
cttcctcggccgtggctccaagatg

SEQ ID NO: 268030 - DNA, 25 bp, Mus musculus
agtaagtgagcccacgtcgccctgt

SEQ ID NO: 268031 - DNA, 25 bp, Mus musculus
gccttggcaacctccgacgcagtgg

SEQ ID NO: 268032 - DNA, 25 bp, Mus musculus
ccatcccaactaggggagcgctctg

SEQ ID NO: 268033 - DNA, 25 bp, Mus musculus
gacggtgatcgtcccaaagtcagta

SEQ ID NO: 268034 - DNA, 25 bp, Mus musculus
tcagtaaaggaaacttggaggtgcc

SEQ ID NO: 268035 - DNA, 25 bp, Mus musculus
aaggaggtagccactgtaggtccca

SEQ ID NO: 268036 - DNA, 25 bp, Mus musculus
taggtcccaggagggaagacccaga

SEQ ID NO: 268037 - DNA, 25 bp, Mus musculus
cctggcatctttgataggggtacca

SEQ ID NO: 268038 - DNA, 25 bp, Mus musculus
agatatagtgctgctcccgggagct

SEQ ID NO: 268039 - DNA, 25 bp, Mus musculus
ttcccggcctaagagctggcccagg

SEQ ID NO: 268040 - DNA, 25 bp, Mus musculus
ccagggagacgcaatcgagcccgca

SEQ ID NO: 268041 - DNA, 25 bp, Mus musculus
agggtcgcccgcgtgaattccagcc

SEQ ID NO: 268042 - DNA, 25 bp, Mus musculus
ggcacatcggccgagtctgcccgga

SEQ ID NO: 268043 - DNA, 25 bp, Mus musculus
gcgccctcaccaccagagtaagtga

SEQ ID NO: 268044 - DNA, 25 bp, Mus musculus
tgcgtctctatggttgtcagaggtg

SEQ ID NO: 268045 - DNA, 25 bp, Mus musculus
cggcattctccgagttgctgctaaa

SEQ ID NO: 268046 - DNA, 25 bp, Mus musculus
tgagatccggccacttttcaggtcc

SEQ ID NO: 268047 - DNA, 25 bp, Mus musculus
tggctctgagatccggccacttttc

SEQ ID NO: 268048 - DNA, 25 bp, Mus musculus
agcctttcgtgtggctctgagatcc

SEQ ID NO: 268049 - DNA, 25 bp, Mus musculus
cgcattttggggacgagcctttcgt

SEQ ID NO: 268050 - DNA, 25 bp, Mus musculus
atctgatcgcctggaggcgagttta

SEQ ID NO: 268051 - DNA, 25 bp, Mus musculus
tgagtgtgaggaatctgatcgcctg

SEQ ID NO: 268052 - DNA, 25 bp, Mus musculus
cccggcatttgcgtctctatggttg

SEQ ID NO: 268053 - DNA, 25 bp, Mus musculus
caggcccagcggctaagggagtcac

SEQ ID NO: 268054 - DNA, 25 bp, Mus musculus
tttcatcaagatcccggcaggccca

SEQ ID NO: 268055 - DNA, 25 bp, Mus musculus
ggttcctccctgctacgtttcatca

SEQ ID NO: 268056 - DNA, 25 bp, Mus musculus
cggcattcccgcctaaacagcgagg

SEQ ID NO: 268057 - DNA, 25 bp, Mus musculus
ttgctgctaaagctggagcgcggac

SEQ ID NO: 268058 - DNA, 25 bp, Mus musculus
ggctgctcgacacctgctcgcggga

SEQ ID NO: 268059 - DNA, 25 bp, Mus musculus
gtcgccaatgtcttgcgcctgtttg

SEQ ID NO: 268060 - DNA, 25 bp, Mus musculus
tccgtgtccatcatggtcgccaatg

SEQ ID NO: 268061 - DNA, 25 bp, Mus musculus
aatgtcttgcgcctgtttgcggtga

SEQ ID NO: 268062 - DNA, 25 bp, Mus musculus
tcagctagctccgtgtccatcatgg

SEQ ID NO: 268063 - DNA, 25 bp, Mus musculus
cgcgggacacctacgctctggagca

SEQ ID NO: 268064 - DNA, 25 bp, Mus musculus
agctcctgcccggtgtgcgactagg

SEQ ID NO: 268065 - DNA, 25 bp, Mus musculus
atgctctacgcgctggaccgcatca

SEQ ID NO: 268066 - DNA, 25 bp, Mus musculus
gctctcaaggcgtcccggtaacttc

SEQ ID NO: 268067 - DNA, 25 bp, Mus musculus
gccagaatcccgaagtggcagctga

SEQ ID NO: 268068 - DNA, 25 bp, Mus musculus
cggtgtccggccagaatcccgaagt

SEQ ID NO: 268069 - DNA, 25 bp, Mus musculus
acttttcctgcgctctcggtgtccg

SEQ ID NO: 268070 - DNA, 25 bp, Mus musculus
gcgagtcaccaacttttcctgcgct

SEQ ID NO: 268071 - DNA, 25 bp, Mus musculus
ctgagcttcgtgcaggcgctcatcc

SEQ ID NO: 268072 - DNA, 25 bp, Mus musculus
cgcgatgacaaccacgagaccgaca

SEQ ID NO: 268073 - DNA, 25 bp, Mus musculus
gcaccgtgcagctgtaccgccagag

SEQ ID NO: 268074 - DNA, 25 bp, Mus musculus
cagctgtaccgccagagcagcaagc

SEQ ID NO: 268075 - DNA, 25 bp, Mus musculus
agcagcaagctgtacggctccattt

SEQ ID NO: 268076 - DNA, 25 bp, Mus musculus
ggctccattttcaccggggccagca

SEQ ID NO: 268077 - DNA, 25 bp, Mus musculus
agcgctggtccaagcctcgcaaacg

SEQ ID NO: 268078 - DNA, 25 bp, Mus musculus
cggggccagcaagttccgttgcaaa

SEQ ID NO: 268079 - DNA, 25 bp, Mus musculus
gttgcaaagactgtagcgccgccta

SEQ ID NO: 268080 - DNA, 25 bp, Mus musculus
gcctacgacaccctggtagagctga

SEQ ID NO: 268081 - DNA, 25 bp, Mus musculus
gtagagctgaccgtgcacatgaatg

SEQ ID NO: 268082 - DNA, 25 bp, Mus musculus
ccgtgcacatgaatgagacaggtca

SEQ ID NO: 268083 - DNA, 25 bp, Mus musculus
tgagacaggtcactatcgcgatgac

SEQ ID NO: 268084 - DNA, 25 bp, Mus musculus
cgaatgctgccggagcccagcctgt

SEQ ID NO: 268085 - DNA, 25 bp, Mus musculus
gacaaccacgagaccgacaacaaca

SEQ ID NO: 268086 - DNA, 25 bp, Mus musculus
ccggcctcttttagcgtgtagctgc

SEQ ID NO: 268087 - DNA, 25 bp, Mus musculus
tgtagctgcgcccaccttgtgaacc

SEQ ID NO: 268088 - DNA, 25 bp, Mus musculus
ctttcaatcttgtaaggagctggga

SEQ ID NO: 268089 - DNA, 25 bp, Mus musculus
tcgggtctggggctctgtcacccgc

SEQ ID NO: 268090 - DNA, 25 bp, Mus musculus
tctgtcacccgccagcagttgtaac

SEQ ID NO: 268091 - DNA, 25 bp, Mus musculus
tcacccgccagcagttgtaacagct

SEQ ID NO: 268092 - DNA, 25 bp, Mus musculus
cagttgtaacagctgcgaagcgctc

SEQ ID NO: 268093 - DNA, 25 bp, Mus musculus
taacagctgcgaagcgctcgtttca

SEQ ID NO: 268094 - DNA, 25 bp, Mus musculus
cgaagcgctcgtttcagtgcaggcg

SEQ ID NO: 268095 - DNA, 25 bp, Mus musculus
ctcgtttcagtgcaggcggcaagga

SEQ ID NO: 268096 - DNA, 25 bp, Mus musculus
caaggagagatgtgacggatttcgc

SEQ ID NO: 268097 - DNA, 25 bp, Mus musculus
cggatttcgcccatggcagaatggc

SEQ ID NO: 268098 - DNA, 25 bp, Mus musculus
ttcgcccatggcagaatggcgttcc

SEQ ID NO: 268099 - DNA, 25 bp, Mus musculus
cttttagcgtgtagctgcgcccacc

SEQ ID NO: 268100 - DNA, 25 bp, Mus musculus
gtgcagagcgtcctcatcgctcttg

SEQ ID NO: 268101 - DNA, 25 bp, Mus musculus
gagcgtcctcatcgctcttgcggtc

SEQ ID NO: 268102 - DNA, 25 bp, Mus musculus
cacgaccacctggtggtaggttcgg

SEQ ID NO: 268103 - DNA, 25 bp, Mus musculus
gactcgagaatgcacgaccacctgg

SEQ ID NO: 268104 - DNA, 25 bp, Mus musculus
cttgtggactcgagaatgcacgacc

SEQ ID NO: 268105 - DNA, 25 bp, Mus musculus
atcgctcttgcggtcccgcttgtgg

SEQ ID NO: 268106 - DNA, 25 bp, Mus musculus
tcctccaggcccacacccacgtgca

SEQ ID NO: 268107 - DNA, 25 bp, Mus musculus
ccactctcctcagtcacgttagagg

SEQ ID NO: 268108 - DNA, 25 bp, Mus musculus
tcccgcttgtggactcgagaatgca

SEQ ID NO: 268109 - DNA, 25 bp, Mus musculus
gggactcctggtcgctgcctgagcc

SEQ ID NO: 268110 - DNA, 25 bp, Mus musculus
tcactgactgggactcctggtcgct

SEQ ID NO: 268111 - DNA, 25 bp, Mus musculus
gagcggctcactgactgggactcct

SEQ ID NO: 268112 - DNA, 25 bp, Mus musculus
ctcagtcacgttagaggagccaggt

SEQ ID NO: 268113 - DNA, 25 bp, Mus musculus
cagtcacgttagaggagccaggtgt

SEQ ID NO: 268114 - DNA, 25 bp, Mus musculus
gctgcgcttgcgcacacatagcttg

SEQ ID NO: 268115 - DNA, 25 bp, Mus musculus
cgtagtacccgcttctcatcgcaga

SEQ ID NO: 268116 - DNA, 25 bp, Mus musculus
ttgacagcgtctgggtaaggcagct

SEQ ID NO: 268117 - DNA, 25 bp, Mus musculus
agatcctcgtggtccctgtgttttc

SEQ ID NO: 268118 - DNA, 25 bp, Mus musculus
gcttgtaggaaacctcccagcgttc

SEQ ID NO: 268119 - DNA, 25 bp, Mus musculus
tgcgcacacatagcttgtaggaaac

SEQ ID NO: 268120 - DNA, 25 bp, Mus musculus
ctgtgttttctgtctggaggtaggc

SEQ ID NO: 268121 - DNA, 25 bp, Mus musculus
ggcacgaaagctcagacgactgggc

SEQ ID NO: 268122 - DNA, 25 bp, Mus musculus
cccagcgttcctcggttgacagcgt

SEQ ID NO: 268123 - DNA, 25 bp, Mus musculus
gaaagctcagacgactgggcgtccg

SEQ ID NO: 268124 - DNA, 25 bp, Mus musculus
acctttctcagattaagctcttagg

SEQ ID NO: 268125 - DNA, 25 bp, Mus musculus
cgcttctcatcgcagacttcgctga

SEQ ID NO: 268126 - DNA, 25 bp, Mus musculus
tcgcagacttcgctgagtacacgcc

SEQ ID NO: 268127 - DNA, 25 bp, Mus musculus
aagctcttaggtcgtcgctggcaga

SEQ ID NO: 268128 - DNA, 25 bp, Mus musculus
tgcagcagacggttctcctcacgta

SEQ ID NO: 268129 - DNA, 25 bp, Mus musculus
gttctcctcacgtacccgcccgcgc

SEQ ID NO: 268130 - DNA, 25 bp, Mus musculus
ggatgctattgaaccggaaacgctt

SEQ ID NO: 268131 - DNA, 25 bp, Mus musculus
acacaggggacacggatacttccgg

SEQ ID NO: 268132 - DNA, 25 bp, Mus musculus
tgccacacaggggacacggatactt

SEQ ID NO: 268133 - DNA, 25 bp, Mus musculus
ggaaacgcttgccacacaggggaca

SEQ ID NO: 268134 - DNA, 25 bp, Mus musculus
gaaccggaaacgcttgccacacagg

SEQ ID NO: 268135 - DNA, 25 bp, Mus musculus
cccaagttgcccagcttgtgggtcc

SEQ ID NO: 268136 - DNA, 25 bp, Mus musculus
gctattgaaccggaaacgcttgcca

SEQ ID NO: 268137 - DNA, 25 bp, Mus musculus
ttgcccagcttgtgggtccgcaggt

SEQ ID NO: 268138 - DNA, 25 bp, Mus musculus
ggagaggatgctattgaaccggaaa

SEQ ID NO: 268139 - DNA, 25 bp, Mus musculus
tcaccggtgtgagtgcgcatgtgca

SEQ ID NO: 268140 - DNA, 25 bp, Mus musculus
cttctcaccggtgtgagtgcgcatg

SEQ ID NO: 268141 - DNA, 25 bp, Mus musculus
gtggtcgcagtaggggcacttgaat

SEQ ID NO: 268142 - DNA, 25 bp, Mus musculus
tgcgaggcacccgttagacaaaaca

SEQ ID NO: 268143 - DNA, 25 bp, Mus musculus
cttccaggcttgcatccttccagga

SEQ ID NO: 268144 - DNA, 25 bp, Mus musculus
tagcccgctagtcctaaagccggtg

SEQ ID NO: 268145 - DNA, 25 bp, Mus musculus
gccgccgttattttccgctcaagtg

SEQ ID NO: 268146 - DNA, 25 bp, Mus musculus
cctgtccctagagaaaccttgcggg

SEQ ID NO: 268147 - DNA, 25 bp, Mus musculus
tttctccgaagagttggtctctctc

SEQ ID NO: 268148 - DNA, 25 bp, Mus musculus
ccttcatgtatgtggagataatcta

SEQ ID NO: 268149 - DNA, 25 bp, Mus musculus
gagcatcgagatctggacacttcta

SEQ ID NO: 268150 - DNA, 25 bp, Mus musculus
tcaagtcccgcctacgactgttttc

SEQ ID NO: 268151 - DNA, 25 bp, Mus musculus
gacgttcattctcgctccagccttg

SEQ ID NO: 268152 - DNA, 25 bp, Mus musculus
gacgaatcacgtctcctgcgaggca

SEQ ID NO: 268153 - DNA, 25 bp, Mus musculus
cttgagtgtgcgctcaccaagaggc

SEQ ID NO: 268154 - DNA, 25 bp, Mus musculus
tccaggaaagaactcggggacttga

SEQ ID NO: 268155 - DNA, 25 bp, Mus musculus
ggcggacaaacaggaaggactcaca

SEQ ID NO: 268156 - DNA, 25 bp, Mus musculus
agggcaggctcgcttttcatcaagc

SEQ ID NO: 268157 - DNA, 25 bp, Mus musculus
agcccggccaagtgctctcagccca

SEQ ID NO: 268158 - DNA, 25 bp, Mus musculus
gccaagtgctctcagcccagcccga

SEQ ID NO: 268159 - DNA, 25 bp, Mus musculus
tgctctcagcccagcccgagcaggg

SEQ ID NO: 268160 - DNA, 25 bp, Mus musculus
gcctcagtcgcccactcgccagagc

SEQ ID NO: 268161 - DNA, 25 bp, Mus musculus
gggcaggctcgcttttcatcaagct

SEQ ID NO: 268162 - DNA, 25 bp, Mus musculus
ggcaggctcgcttttcatcaagctc

SEQ ID NO: 268163 - DNA, 25 bp, Mus musculus
gcaggctcgcttttcatcaagctca

SEQ ID NO: 268164 - DNA, 25 bp, Mus musculus
catcaagctcatttcagaatcgccc

SEQ ID NO: 268165 - DNA, 25 bp, Mus musculus
cccactcgccagagcccggccaagt

SEQ ID NO: 268166 - DNA, 25 bp, Mus musculus
ttcatcaagctcatttcagaatcgc

SEQ ID NO: 268167 - DNA, 25 bp, Mus musculus
tcatcaagctcatttcagaatcgcc

SEQ ID NO: 268168 - DNA, 25 bp, Mus musculus
tcaagctcatttcagaatcgccccg

SEQ ID NO: 268169 - DNA, 25 bp, Mus musculus
caggctcgcttttcatcaagctcat

SEQ ID NO: 268170 - DNA, 25 bp, Mus musculus
tgaataatgaaacatgtccacatga

SEQ ID NO: 268171 - DNA, 25 bp, Mus musculus
ttgacttgatcattttccggggctg

SEQ ID NO: 268172 - DNA, 25 bp, Mus musculus
gacttgatcattttccggggctgag

SEQ ID NO: 268173 - DNA, 25 bp, Mus musculus
cttgatcattttccggggctgaggg

SEQ ID NO: 268174 - DNA, 25 bp, Mus musculus
gtccacatgattgacttgatcattt

SEQ ID NO: 268175 - DNA, 25 bp, Mus musculus
gaaacatgtccacatgattgacttg

SEQ ID NO: 268176 - DNA, 25 bp, Mus musculus
ccgagcgttgtaaaagattgtgttc

SEQ ID NO: 268177 - DNA, 25 bp, Mus musculus
gttcaatgaataatgaaacatgtcc

SEQ ID NO: 268178 - DNA, 25 bp, Mus musculus
gcgttgtaaaagattgtgttcaatg

SEQ ID NO: 268179 - DNA, 25 bp, Mus musculus
cgagcgttgtaaaagattgtgttca

SEQ ID NO: 268180 - DNA, 25 bp, Mus musculus
gattgacttgatcattttccggggc

SEQ ID NO: 268181 - DNA, 25 bp, Mus musculus
gcaaactcgggcacgtaaaccgagc

SEQ ID NO: 268182 - DNA, 25 bp, Mus musculus
tcgggcacgtaaaccgagcgttgta

SEQ ID NO: 268183 - DNA, 25 bp, Mus musculus
catgtccacatgattgacttgatca

SEQ ID NO: 268184 - DNA, 25 bp, Mus musculus
aaataaggccgttatgttgccaatc

SEQ ID NO: 268185 - DNA, 25 bp, Mus musculus
gaatcagtcacagcccgggcgttta

SEQ ID NO: 268186 - DNA, 25 bp, Mus musculus
gcccgggcgtttaagggagtcatca

SEQ ID NO: 268187 - DNA, 25 bp, Mus musculus
cgtttaagggagtcatcagcgatca

SEQ ID NO: 268188 - DNA, 25 bp, Mus musculus
agtcatcagcgatcaaatgacgttg

SEQ ID NO: 268189 - DNA, 25 bp, Mus musculus
aaacaccgagaggtcctcagcctcg

SEQ ID NO: 268190 - DNA, 25 bp, Mus musculus
cgttgatccgcgctgtaaccttgtg

SEQ ID NO: 268191 - DNA, 25 bp, Mus musculus
ccttgtggcgtatttaatgtaaata

SEQ ID NO: 268192 - DNA, 25 bp, Mus musculus
gccgcgatacaaacaccgagaggtc

SEQ ID NO: 268193 - DNA, 25 bp, Mus musculus
acagcgggacgtggagaatcagtca

SEQ ID NO: 268194 - DNA, 25 bp, Mus musculus
taagggagtcatcagcgatcaaatg

SEQ ID NO: 268195 - DNA, 25 bp, Mus musculus
atccgcgctgtaaccttgtggcgta

SEQ ID NO: 268196 - DNA, 25 bp, Mus musculus
caaatgacgttgatccgcgctgtaa

SEQ ID NO: 268197 - DNA, 25 bp, Mus musculus
cgttatgttgccaatcgccgcgata

SEQ ID NO: 268198 - DNA, 25 bp, Mus musculus
cactgcacgcctctctctgaagagg

SEQ ID NO: 268199 - DNA, 25 bp, Mus musculus
cgacaaaagacaacaaatgcacgtg

SEQ ID NO: 268200 - DNA, 25 bp, Mus musculus
ctggccgcattagaggttgctcaga

SEQ ID NO: 268201 - DNA, 25 bp, Mus musculus
gttgctcagagtgtcgcggccacat

SEQ ID NO: 268202 - DNA, 25 bp, Mus musculus
aagcgcggcctgttaccttttcctg

SEQ ID NO: 268203 - DNA, 25 bp, Mus musculus
gccgcagcctcagcgaggcgaacaa

SEQ ID NO: 268204 - DNA, 25 bp, Mus musculus
gaggcgaacaagtcctaaacaagtg

SEQ ID NO: 268205 - DNA, 25 bp, Mus musculus
aacaagtgtttatggagacggcgtg

SEQ ID NO: 268206 - DNA, 25 bp, Mus musculus
gaagaggccgcgctcactttcgccg

SEQ ID NO: 268207 - DNA, 25 bp, Mus musculus
agcacgccgggaagctctcaagctc

SEQ ID NO: 268208 - DNA, 25 bp, Mus musculus
atagtgggtcccaattcgcttggcg

SEQ ID NO: 268209 - DNA, 25 bp, Mus musculus
cgcgtggggatctcggtttcacgca

SEQ ID NO: 268210 - DNA, 25 bp, Mus musculus
gtttcacgcagagggctggccgcat

SEQ ID NO: 268211 - DNA, 25 bp, Mus musculus
atgcacgtgacaaaagtttctcccg

SEQ ID NO: 268212 - DNA, 25 bp, Mus musculus
atcccgtgaccgtaagggagcgctg

SEQ ID NO: 268213 - DNA, 25 bp, Mus musculus
ctgccgaagcgcagccaccagatgg

SEQ ID NO: 268214 - DNA, 25 bp, Mus musculus
cagcagatgccttgtgatcccgtga

SEQ ID NO: 268215 - DNA, 25 bp, Mus musculus
atgccttgtgatcccgtgaccgtaa

SEQ ID NO: 268216 - DNA, 25 bp, Mus musculus
gccaccagatggcagcagatgcctt

SEQ ID NO: 268217 - DNA, 25 bp, Mus musculus
ccctgcgatctgcccgtttttaacg

SEQ ID NO: 268218 - DNA, 25 bp, Mus musculus
tggcccgccggtgtgctacccgaga

SEQ ID NO: 268219 - DNA, 25 bp, Mus musculus
ctgtagctagggagccgagcaatca

SEQ ID NO: 268220 - DNA, 25 bp, Mus musculus
agctagggagccgagcaatcagccc

SEQ ID NO: 268221 - DNA, 25 bp, Mus musculus
ccgccagagtgactggattgtccta

SEQ ID NO: 268222 - DNA, 25 bp, Mus musculus
tggattgtcctacccaggcggatta

SEQ ID NO: 268223 - DNA, 25 bp, Mus musculus
ctacccaggcggattagaacgttct

SEQ ID NO: 268224 - DNA, 25 bp, Mus musculus
gattagaacgttctctccctcctta

SEQ ID NO: 268225 - DNA, 25 bp, Mus musculus
gttcgacttccgacgggtggcacag

SEQ ID NO: 268226 - DNA, 25 bp, Mus musculus
gcaggtaaatccatgcgccgggcgc

SEQ ID NO: 268227 - DNA, 25 bp, Mus musculus
acttctccgctgtcgcctagattta

SEQ ID NO: 268228 - DNA, 25 bp, Mus musculus
tctgctagtccctggaaagctgtga

SEQ ID NO: 268229 - DNA, 25 bp, Mus musculus
cgatttaagagtcccggctgcgggc

SEQ ID NO: 268230 - DNA, 25 bp, Mus musculus
gcgtagccttgctccaccgccttct

SEQ ID NO: 268231 - DNA, 25 bp, Mus musculus
actgctctcctgtgctgctcttact

SEQ ID NO: 268232 - DNA, 25 bp, Mus musculus
gtgctgctcttacttctccgctgtc

SEQ ID NO: 268233 - DNA, 25 bp, Mus musculus
gcgccgggcgccgatttaagagtcc

SEQ ID NO: 268234 - DNA, 25 bp, Mus musculus
tttccgctttctcttttccaactgc

SEQ ID NO: 268235 - DNA, 25 bp, Mus musculus
aggcggctgagcagcttgcaaactc

SEQ ID NO: 268236 - DNA, 25 bp, Mus musculus
tgagcagcttgcaaactccggccag

SEQ ID NO: 268237 - DNA, 25 bp, Mus musculus
aaactccggccaggaccggcgcagg

SEQ ID NO: 268238 - DNA, 25 bp, Mus musculus
ggcttccgtctgctagtccctggaa

SEQ ID NO: 268239 - DNA, 25 bp, Mus musculus
accggcgcaggtgcggcttccgtct

SEQ ID NO: 268240 - DNA, 25 bp, Mus musculus
gcgctttgcgttagctcgacgccgc

SEQ ID NO: 268241 - DNA, 25 bp, Mus musculus
ccagagatccacctacgctttggct

SEQ ID NO: 268242 - DNA, 25 bp, Mus musculus
gagatccacctacgctttggctctg

SEQ ID NO: 268243 - DNA, 25 bp, Mus musculus
tgcctagagcctgcgctcacacttg

SEQ ID NO: 268244 - DNA, 25 bp, Mus musculus
cgctttggctctgttacagaggcgc

SEQ ID NO: 268245 - DNA, 25 bp, Mus musculus
cgtgtgtaaacacgccgcacgtgga

SEQ ID NO: 268246 - DNA, 25 bp, Mus musculus
ctctgttacagaggcgctttgcgtt

SEQ ID NO: 268247 - DNA, 25 bp, Mus musculus
ggccctggagtcacgtgtgtaaaca

SEQ ID NO: 268248 - DNA, 25 bp, Mus musculus
acagaggcgctttgcgttagctcga

SEQ ID NO: 268249 - DNA, 25 bp, Mus musculus
cgaggaagccacgaggaggcccaaa

SEQ ID NO: 268250 - DNA, 25 bp, Mus musculus
ttgcgttagctcgacgccgcgcagc

SEQ ID NO: 268251 - DNA, 25 bp, Mus musculus
caaagtcccgcctacccagagatcc

SEQ ID NO: 268252 - DNA, 25 bp, Mus musculus
ccgcccacgcgacgccctgcctaga

SEQ ID NO: 268253 - DNA, 25 bp, Mus musculus
cgcacgtggagctcagcctgagcca

SEQ ID NO: 268254 - DNA, 25 bp, Mus musculus
ggctgcctcagtgtccctttctaca

SEQ ID NO: 268255 - DNA, 25 bp, Mus musculus
agcgcctgaaggattctgagcgtgc

SEQ ID NO: 268256 - DNA, 25 bp, Mus musculus
aatcttggcgcgagcgcctgaagga

SEQ ID NO: 268257 - DNA, 25 bp, Mus musculus
cgtgttcttttacgggcgtggcatg

SEQ ID NO: 268258 - DNA, 25 bp, Mus musculus
gcccggcttcgagcgggacatttaa

SEQ ID NO: 268259 - DNA, 25 bp, Mus musculus
ggagtccaggcagcccgtacccgaa

SEQ ID NO: 268260 - DNA, 25 bp, Mus musculus
cccgagctgatacctcaggggaccg

SEQ ID NO: 268261 - DNA, 25 bp, Mus musculus
ggcccagccgcccttcaagaggacc

SEQ ID NO: 268262 - DNA, 25 bp, Mus musculus
atgggccgcccaagtggaatgtcag

SEQ ID NO: 268263 - DNA, 25 bp, Mus musculus
ttttacgggcgtggcatgcactaaa

SEQ ID NO: 268264 - DNA, 25 bp, Mus musculus
agtcccgggagtccaggcagcccgt

SEQ ID NO: 268265 - DNA, 25 bp, Mus musculus
gtcagcagggcagatcgcaatgatc

SEQ ID NO: 268266 - DNA, 25 bp, Mus musculus
acatttaaaaatcccagcgcgcggc

SEQ ID NO: 268267 - DNA, 25 bp, Mus musculus
ccaagtggaatgtcagcagggcaga

SEQ ID NO: 268268 - DNA, 25 bp, Mus musculus
atccacagacacgatttcctgggtg

SEQ ID NO: 268269 - DNA, 25 bp, Mus musculus
ttagaggccgagacacagagagccg

SEQ ID NO: 268270 - DNA, 25 bp, Mus musculus
ttttagaggccgagacacagagagc

SEQ ID NO: 268271 - DNA, 25 bp, Mus musculus
cttttgttttagaggccgagacaca

SEQ ID NO: 268272 - DNA, 25 bp, Mus musculus
ggcttttgttttagaggccgagaca

SEQ ID NO: 268273 - DNA, 25 bp, Mus musculus
gcacagatgccgcccggcttttgtt

SEQ ID NO: 268274 - DNA, 25 bp, Mus musculus
cgcggtcctcattcgtttcaaatcc

SEQ ID NO: 268275 - DNA, 25 bp, Mus musculus
ctcattcgtttcaaatccacagaca

SEQ ID NO: 268276 - DNA, 25 bp, Mus musculus
acagacacgatttcctgggtgtata

SEQ ID NO: 268277 - DNA, 25 bp, Mus musculus
acacgatttcctgggtgtataattg

SEQ ID NO: 268278 - DNA, 25 bp, Mus musculus
ctctgctgcgtggaaccggtgccgt

SEQ ID NO: 268279 - DNA, 25 bp, Mus musculus
cgaggctgggccctttgtttccctg

SEQ ID NO: 268280 - DNA, 25 bp, Mus musculus
cctggctctgctgcgtggaaccggt

SEQ ID NO: 268281 - DNA, 25 bp, Mus musculus
ggtcctcattcgtttcaaatccaca

SEQ ID NO: 268282 - DNA, 25 bp, Mus musculus
agtgccttggcggtcccagactcca

SEQ ID NO: 268283 - DNA, 25 bp, Mus musculus
ctgagacactgaaggcctaagctgc

SEQ ID NO: 268284 - DNA, 25 bp, Mus musculus
aaggcctaagctgcagcgccgaggt

SEQ ID NO: 268285 - DNA, 25 bp, Mus musculus
aggcccagtgctagagctgttcatc

SEQ ID NO: 268286 - DNA, 25 bp, Mus musculus
tagtcagcagctccgtgcgcttcca

SEQ ID NO: 268287 - DNA, 25 bp, Mus musculus
accctacggtgtcaggcccagtgct

SEQ ID NO: 268288 - DNA, 25 bp, Mus musculus
actccagctcggtaaaggtgcgcgc

SEQ ID NO: 268289 - DNA, 25 bp, Mus musculus
tgttcatctcaatgcaaaggacctg

SEQ ID NO: 268290 - DNA, 25 bp, Mus musculus
ctggcagagcagagccggcctcagt

SEQ ID NO: 268291 - DNA, 25 bp, Mus musculus
ctgtgaacgcctctctggagctggc

SEQ ID NO: 268292 - DNA, 25 bp, Mus musculus
gacccagactcatggggacccagag

SEQ ID NO: 268293 - DNA, 25 bp, Mus musculus
gcctgtcccatcttgaggacccaga

SEQ ID NO: 268294 - DNA, 25 bp, Mus musculus
ccgcaacctggatgcttgggagtgc

SEQ ID NO: 268295 - DNA, 25 bp, Mus musculus
cgaggttggagtagtcagcagctcc

SEQ ID NO: 268296 - DNA, 25 bp, Mus musculus
actgttttgaatttcgcgggactcg

SEQ ID NO: 268297 - DNA, 25 bp, Mus musculus
aggatttctccgctggggactacac

SEQ ID NO: 268298 - DNA, 25 bp, Mus musculus
cctctgcacaaaggccaggcctggt

SEQ ID NO: 268299 - DNA, 25 bp, Mus musculus
cgagtgtagtgtcatgcgaaccctg

SEQ ID NO: 268300 - DNA, 25 bp, Mus musculus
tccaattgtcaccaggactcccaga

SEQ ID NO: 268301 - DNA, 25 bp, Mus musculus
gcggttctcccacagggtcttgtaa

SEQ ID NO: 268302 - DNA, 25 bp, Mus musculus
ggtcttgtaaaaaccagctgggctc

SEQ ID NO: 268303 - DNA, 25 bp, Mus musculus
actgcctgagggtccgatcttttag

SEQ ID NO: 268304 - DNA, 25 bp, Mus musculus
tccacttccggtgcgttccggagga

SEQ ID NO: 268305 - DNA, 25 bp, Mus musculus
tgtgctcaagcaaagtccacttccg

SEQ ID NO: 268306 - DNA, 25 bp, Mus musculus
gctgcactcgtacgctccaattgtc

SEQ ID NO: 268307 - DNA, 25 bp, Mus musculus
cggccttgaagggtgtctgcagcct

SEQ ID NO: 268308 - DNA, 25 bp, Mus musculus
cctcgcgtgacatgcagggaatggc

SEQ ID NO: 268309 - DNA, 25 bp, Mus musculus
ccagctgggctctaaaggatttctc

SEQ ID NO: 268310 - DNA, 25 bp, Mus musculus
atgcaaatgtccgtggccttgtccg

SEQ ID NO: 268311 - DNA, 25 bp, Mus musculus
ctgcgtgcagcgcatgcaaatgtcc

SEQ ID NO: 268312 - DNA, 25 bp, Mus musculus
aaacccgcatttgcggcagtggtga

SEQ ID NO: 268313 - DNA, 25 bp, Mus musculus
ctctcggtagcacaggctgcagacg

SEQ ID NO: 268314 - DNA, 25 bp, Mus musculus
cggtagcacaggctgcagacgcgaa

SEQ ID NO: 268315 - DNA, 25 bp, Mus musculus
agacgtggcaacaggaaacgctccc

SEQ ID NO: 268316 - DNA, 25 bp, Mus musculus
ctggaacactcagcacagaccacaa

SEQ ID NO: 268317 - DNA, 25 bp, Mus musculus
ccttgtccgggatccagggagctgc

SEQ ID NO: 268318 - DNA, 25 bp, Mus musculus
ggaaacgctccctggaacactcagc

SEQ ID NO: 268319 - DNA, 25 bp, Mus musculus
tgtggccagtagctgcctccgcaca

SEQ ID NO: 268320 - DNA, 25 bp, Mus musculus
cgcacacactcttcgatgtggctta

SEQ ID NO: 268321 - DNA, 25 bp, Mus musculus
agcacagaccacaaacccgcatttg

SEQ ID NO: 268322 - DNA, 25 bp, Mus musculus
cttatccattcctggcgctccgtgg

SEQ ID NO: 268323 - DNA, 25 bp, Mus musculus
tcgatgtggcttatccattcctggc

SEQ ID NO: 268324 - DNA, 25 bp, Mus musculus
ctctggaccaatcgaagccctggca

SEQ ID NO: 268325 - DNA, 25 bp, Mus musculus
cgtagcctgcttacctcccgtagga

SEQ ID NO: 268326 - DNA, 25 bp, Mus musculus
ccgctggaccgtaaacgggtcagca

SEQ ID NO: 268327 - DNA, 25 bp, Mus musculus
tggtcgccacactcaagactgagtc

SEQ ID NO: 268328 - DNA, 25 bp, Mus musculus
acgcctccgggttccaattctctgg

SEQ ID NO: 268329 - DNA, 25 bp, Mus musculus
cccttcgagggactctggaccaatc

SEQ ID NO: 268330 - DNA, 25 bp, Mus musculus
cagctttgctggtcgccacactcaa

SEQ ID NO: 268331 - DNA, 25 bp, Mus musculus
gttggagtccggttcccagctttgc

SEQ ID NO: 268332 - DNA, 25 bp, Mus musculus
atgggctgattcctggttggagtcc

SEQ ID NO: 268333 - DNA, 25 bp, Mus musculus
accgtaaacgggtcagcagcggttg

SEQ ID NO: 268334 - DNA, 25 bp, Mus musculus
aatcgaagccctggcacgcaggcgg

SEQ ID NO: 268335 - DNA, 25 bp, Mus musculus
ttctccagaaatgtgcgcgggcgta

SEQ ID NO: 268336 - DNA, 25 bp, Mus musculus
gcgcgggcgtaattaaaccgctgga

SEQ ID NO: 268337 - DNA, 25 bp, Mus musculus
cgggttccaattctctggtcacgcc

SEQ ID NO: 268338 - DNA, 25 bp, Mus musculus
accagatttcggatcgggcgcctct

SEQ ID NO: 268339 - DNA, 25 bp, Mus musculus
ttacccttcattgtcggccagcttc

SEQ ID NO: 268340 - DNA, 25 bp, Mus musculus
ttaacaaagtgcacggacttgctcc

SEQ ID NO: 268341 - DNA, 25 bp, Mus musculus
ggcgcctctctgacgtcattgacgc

SEQ ID NO: 268342 - DNA, 25 bp, Mus musculus
ggacttgctccaccctgcgtcaggg

SEQ ID NO: 268343 - DNA, 25 bp, Mus musculus
caccctgcgtcaggggatggcgacc

SEQ ID NO: 268344 - DNA, 25 bp, Mus musculus
atgtctccttcaggcctcactcatt

SEQ ID NO: 268345 - DNA, 25 bp, Mus musculus
gtcattgacgcgacggcatctgtgt

SEQ ID NO: 268346 - DNA, 25 bp, Mus musculus
agcttccggagctctctggcgatgt

SEQ ID NO: 268347 - DNA, 25 bp, Mus musculus
tcctttcttcgctttgttcagcggc

SEQ ID NO: 268348 - DNA, 25 bp, Mus musculus
ttgttcagcggctttctcccgccgg

SEQ ID NO: 268349 - DNA, 25 bp, Mus musculus
tccactggaaaaatccgataagccc

SEQ ID NO: 268350 - DNA, 25 bp, Mus musculus
agcccaagagacaattaacaaagtg

SEQ ID NO: 268351 - DNA, 25 bp, Mus musculus
ctggcgatgtctccttcaggcctca

SEQ ID NO: 268352 - DNA, 25 bp, Mus musculus
caccggactgaaggaggtacagacc

SEQ ID NO: 268353 - DNA, 25 bp, Mus musculus
cagggtcacttagtagctggggaca

SEQ ID NO: 268354 - DNA, 25 bp, Mus musculus
gaactttgctggagcctctcgccca

SEQ ID NO: 268355 - DNA, 25 bp, Mus musculus
ctttgcagctgctccctgaactttg

SEQ ID NO: 268356 - DNA, 25 bp, Mus musculus
aggcctgcagcaagccagagttggc

SEQ ID NO: 268357 - DNA, 25 bp, Mus musculus
tctccagcaattcgggtgtgcaacc

SEQ ID NO: 268358 - DNA, 25 bp, Mus musculus
cggcaggctttacggtctccagcaa

SEQ ID NO: 268359 - DNA, 25 bp, Mus musculus
ctttgctaaggccacggaagtctgc

SEQ ID NO: 268360 - DNA, 25 bp, Mus musculus
atgggctcaggggaccctttgctaa

SEQ ID NO: 268361 - DNA, 25 bp, Mus musculus
ggtacagaccgaaggatcctcctgg

SEQ ID NO: 268362 - DNA, 25 bp, Mus musculus
tccgcttagggagtcctttcaccca

SEQ ID NO: 268363 - DNA, 25 bp, Mus musculus
cggatccctattctcctgtggagca

SEQ ID NO: 268364 - DNA, 25 bp, Mus musculus
ccagagtctgaactgcggatcccta

SEQ ID NO: 268365 - DNA, 25 bp, Mus musculus
cggatacctgctacctctgctactg

SEQ ID NO: 268366 - DNA, 25 bp, Mus musculus
tacgattgcaggacgaaggtgttta

SEQ ID NO: 268367 - DNA, 25 bp, Mus musculus
tgtcagctccaacaacgcaggcgct

SEQ ID NO: 268368 - DNA, 25 bp, Mus musculus
ccgcccaacatgcaagctgcagagg

SEQ ID NO: 268369 - DNA, 25 bp, Mus musculus
gaggcagtgtcccacattcagagca

SEQ ID NO: 268370 - DNA, 25 bp, Mus musculus
cacggagcctccagtgctgtcagct

SEQ ID NO: 268371 - DNA, 25 bp, Mus musculus
aaggtgtttatgaatgtcgcgtttc

SEQ ID NO: 268372 - DNA, 25 bp, Mus musculus
ccaggcattgctgcgtgtgctatcg

SEQ ID NO: 268373 - DNA, 25 bp, Mus musculus
tgcgtgtgctatcgcgcttcgcgcc

SEQ ID NO: 268374 - DNA, 25 bp, Mus musculus
ctcaggagcacaaggcccaggcatt

SEQ ID NO: 268375 - DNA, 25 bp, Mus musculus
aatgacatctcacaccggcttcggc

SEQ ID NO: 268376 - DNA, 25 bp, Mus musculus
cgcgtttcggactacagcgatgatg

SEQ ID NO: 268377 - DNA, 25 bp, Mus musculus
ggcttcggctgtccgccgtacgatt

SEQ ID NO: 268378 - DNA, 25 bp, Mus musculus
cgtgcgagtccagggcaatgacatc

SEQ ID NO: 268379 - DNA, 25 bp, Mus musculus
agcgatgatgacactcaggagcaca

SEQ ID NO: 268380 - DNA, 25 bp, Mus musculus
ccgcatctaccgcattttcgagcaa

SEQ ID NO: 268381 - DNA, 25 bp, Mus musculus
tttcgagcaagggaagcgctctgtc

SEQ ID NO: 268382 - DNA, 25 bp, Mus musculus
gcagccgtctgtgcttcccgaagac

SEQ ID NO: 268383 - DNA, 25 bp, Mus musculus
ttgggtaccacgctcagctactctg

SEQ ID NO: 268384 - DNA, 25 bp, Mus musculus
tcccgaagactcttgctcggcttgg

SEQ ID NO: 268385 - DNA, 25 bp, Mus musculus
ggcatcttcctgatctacgccatca

SEQ ID NO: 268386 - DNA, 25 bp, Mus musculus
cgagttcacgtgtgaggcctgtcca

SEQ ID NO: 268387 - DNA, 25 bp, Mus musculus
cagggcacatgagaccgacacccaa

SEQ ID NO: 268388 - DNA, 25 bp, Mus musculus
gggcatcatggccaccacaactatc

SEQ ID NO: 268389 - DNA, 25 bp, Mus musculus
ttgctaccttcatgcgacacaacga

SEQ ID NO: 268390 - DNA, 25 bp, Mus musculus
tgcgacacaacgacactcccatagt

SEQ ID NO: 268391 - DNA, 25 bp, Mus musculus
cgcctctggccgtgagcttagctat

SEQ ID NO: 268392 - DNA, 25 bp, Mus musculus
cttagctatgtgctgctcaccggca

SEQ ID NO: 268393 - DNA, 25 bp, Mus musculus
ttcctcatggtagccgagccttgtg

SEQ ID NO: 268394 - DNA, 25 bp, Mus musculus
ggcgtgtaagccgtgataaccatta

SEQ ID NO: 268395 - DNA, 25 bp, Mus musculus
ggaggcgtgtaagccgtgataacca

SEQ ID NO: 268396 - DNA, 25 bp, Mus musculus
taagccgtgataaccattacaaaac

SEQ ID NO: 268397 - DNA, 25 bp, Mus musculus
tgataaccattacaaaacaaccgga

SEQ ID NO: 268398 - DNA, 25 bp, Mus musculus
caacttcttggatccagatgtagtt

SEQ ID NO: 268399 - DNA, 25 bp, Mus musculus
cttcttggatccagatgtagtttcc

SEQ ID NO: 268400 - DNA, 25 bp, Mus musculus
ttggatccagatgtagtttcctgct

SEQ ID NO: 268401 - DNA, 25 bp, Mus musculus
ggtggacttggtgccccacgtgctt

SEQ ID NO: 268402 - DNA, 25 bp, Mus musculus
ccacgtgctttgtgccgggctctgt

SEQ ID NO: 268403 - DNA, 25 bp, Mus musculus
tttgtgccgggctctgtgagttgca

SEQ ID NO: 268404 - DNA, 25 bp, Mus musculus
ctctgtgagttgcagcgtgaggtga

SEQ ID NO: 268405 - DNA, 25 bp, Mus musculus
tgcagcgtgaggtgagtgaccgtca

SEQ ID NO: 268406 - DNA, 25 bp, Mus musculus
tgaccgtcaggctggcaggacaccg

SEQ ID NO: 268407 - DNA, 25 bp, Mus musculus
gttgtgcatgtctgcgggtggactt

SEQ ID NO: 268408 - DNA, 25 bp, Mus musculus
accgcacattgatcgcaggctcgga

SEQ ID NO: 268409 - DNA, 25 bp, Mus musculus
acaagcaccgcacattgatcgcagg

SEQ ID NO: 268410 - DNA, 25 bp, Mus musculus
cacaagcaccgcacattgatcgcag

SEQ ID NO: 268411 - DNA, 25 bp, Mus musculus
caagcaccgcacattgatcgcaggc

SEQ ID NO: 268412 - DNA, 25 bp, Mus musculus
aagcaccgcacattgatcgcaggct

SEQ ID NO: 268413 - DNA, 25 bp, Mus musculus
agcaccgcacattgatcgcaggctc

SEQ ID NO: 268414 - DNA, 25 bp, Mus musculus
caccgcacattgatcgcaggctcgg

SEQ ID NO: 268415 - DNA, 25 bp, Mus musculus
tcacaagcaccgcacattgatcgca

SEQ ID NO: 268416 - DNA, 25 bp, Mus musculus
ccgcacattgatcgcaggctcggat

SEQ ID NO: 268417 - DNA, 25 bp, Mus musculus
cgcacattgatcgcaggctcggatc

SEQ ID NO: 268418 - DNA, 25 bp, Mus musculus
caacacaaaccgcggcgggacagct

SEQ ID NO: 268419 - DNA, 25 bp, Mus musculus
aacacaaaccgcggcgggacagctc

SEQ ID NO: 268420 - DNA, 25 bp, Mus musculus
acacaaaccgcggcgggacagctcg

SEQ ID NO: 268421 - DNA, 25 bp, Mus musculus
gcaccgcacattgatcgcaggctcg

SEQ ID NO: 268422 - DNA, 25 bp, Mus musculus
tggttatcacggcttacacgcctcc

SEQ ID NO: 268423 - DNA, 25 bp, Mus musculus
tgtccctgaacacacaacgttctcg

SEQ ID NO: 268424 - DNA, 25 bp, Mus musculus
cgttctcgaacgatgtggcaaaatc

SEQ ID NO: 268425 - DNA, 25 bp, Mus musculus
ggcaaaatcccacagcagagcatat

SEQ ID NO: 268426 - DNA, 25 bp, Mus musculus
cagcagagcatatcggtaagtgaca

SEQ ID NO: 268427 - DNA, 25 bp, Mus musculus
aacagggctgatgcccacctgcagc

SEQ ID NO: 268428 - DNA, 25 bp, Mus musculus
ggtgtcctgccagcctgacggtcac

SEQ ID NO: 268429 - DNA, 25 bp, Mus musculus
tgcaactcacagagcccggcacaaa

SEQ ID NO: 268430 - DNA, 25 bp, Mus musculus
ccggcacaaagcacgtggggcacca

SEQ ID NO: 268431 - DNA, 25 bp, Mus musculus
gtggggcaccaagtccacccgcaga

SEQ ID NO: 268432 - DNA, 25 bp, Mus musculus
gcaggaaactacatctggatccaag

SEQ ID NO: 268433 - DNA, 25 bp, Mus musculus
tccggttgttttgtaatggttatca

SEQ ID NO: 268434 - DNA, 25 bp, Mus musculus
aggctcggatcctgcagcgcccatg

SEQ ID NO: 268435 - DNA, 25 bp, Mus musculus
tgcccaaactgtgtccctgaacaca

SEQ ID NO: 268436 - DNA, 25 bp, Mus musculus
agggtgaaagcgcaccacgcgaccc

SEQ ID NO: 268437 - DNA, 25 bp, Mus musculus
taacgaccagagtcgccctcacaag

SEQ ID NO: 268438 - DNA, 25 bp, Mus musculus
tcgcggacccgccagcgaagtaaca

SEQ ID NO: 268439 - DNA, 25 bp, Mus musculus
tgacggcgacttccgcccacggaag

SEQ ID NO: 268440 - DNA, 25 bp, Mus musculus
ccctcgggaacagggtgaaagcgca

SEQ ID NO: 268441 - DNA, 25 bp, Mus musculus
agtgacaaaacacccaagatacggg

SEQ ID NO: 268442 - DNA, 25 bp, Mus musculus
ccacaggagagcacattgggaagtg

SEQ ID NO: 268443 - DNA, 25 bp, Mus musculus
gacaactttcatggacgactgcgtg

SEQ ID NO: 268444 - DNA, 25 bp, Mus musculus
ctaatggcctcagctgacaactttc

SEQ ID NO: 268445 - DNA, 25 bp, Mus musculus
acctcaaagtcttcgcccttaagct

SEQ ID NO: 268446 - DNA, 25 bp, Mus musculus
ccaatcacggcttgagtggggcaca

SEQ ID NO: 268447 - DNA, 25 bp, Mus musculus
ccctacgccaatcacggcttgagtg

SEQ ID NO: 268448 - DNA, 25 bp, Mus musculus
cacggaagccgaagagtcccggatg

SEQ ID NO: 268449 - DNA, 25 bp, Mus musculus
cgactgcgtgaaaacccacaggaga

SEQ ID NO: 268450 - DNA, 25 bp, Mus musculus
cgcagagacagatacggggcggagt

SEQ ID NO: 268451 - DNA, 25 bp, Mus musculus
cgctcgtggctgtcaagagggtcat

SEQ ID NO: 268452 - DNA, 25 bp, Mus musculus
gtgactgctgcaggaagatggcgga

SEQ ID NO: 268453 - DNA, 25 bp, Mus musculus
ggagcaacctgacccggccagtgac

SEQ ID NO: 268454 - DNA, 25 bp, Mus musculus
ctccacccagcggtccgccgtggac

SEQ ID NO: 268455 - DNA, 25 bp, Mus musculus
ttaggagcaacctgacccggccagt

SEQ ID NO: 268456 - DNA, 25 bp, Mus musculus
tctggattaggagcaacctgacccg

SEQ ID NO: 268457 - DNA, 25 bp, Mus musculus
gactatctggattaggagcaacctg

SEQ ID NO: 268458 - DNA, 25 bp, Mus musculus
gctgtcaagagggtcatcgacttcg

SEQ ID NO: 268459 - DNA, 25 bp, Mus musculus
gcggagtgtgtgactatctggatta

SEQ ID NO: 268460 - DNA, 25 bp, Mus musculus
ctgaattccgcttcctattggcttt

SEQ ID NO: 268461 - DNA, 25 bp, Mus musculus
tttctgagttgtgcgacggttgatt

SEQ ID NO: 268462 - DNA, 25 bp, Mus musculus
tcctattggctttttctgagttgtg

SEQ ID NO: 268463 - DNA, 25 bp, Mus musculus
tggctttttctgagttgtgcgacgg

SEQ ID NO: 268464 - DNA, 25 bp, Mus musculus
cagctgacgtcagtgttttctgtga

SEQ ID NO: 268465 - DNA, 25 bp, Mus musculus
tggccacaccgaagctgcagctgac

SEQ ID NO: 268466 - DNA, 25 bp, Mus musculus
ctcagaccctgaaggcgcagagcca

SEQ ID NO: 268467 - DNA, 25 bp, Mus musculus
cacagaacgggaccagctgctcatc

SEQ ID NO: 268468 - DNA, 25 bp, Mus musculus
agctgctcatctcacgtccggtacg

SEQ ID NO: 268469 - DNA, 25 bp, Mus musculus
gcccggtacacttgccaggtccgaa

SEQ ID NO: 268470 - DNA, 25 bp, Mus musculus
aagtgagcccaatgtctgtgagttc

SEQ ID NO: 268471 - DNA, 25 bp, Mus musculus
aatgtgaccttgcattgctcggccc

SEQ ID NO: 268472 - DNA, 25 bp, Mus musculus
ctctacgtcactgcgggcagcaatg

SEQ ID NO: 268473 - DNA, 25 bp, Mus musculus
gatgccagtcctgcgctctacgtca

SEQ ID NO: 268474 - DNA, 25 bp, Mus musculus
tcattagggtctcctcggaccggga

SEQ ID NO: 268475 - DNA, 25 bp, Mus musculus
gcccggacgctcctgtcattagggt

SEQ ID NO: 268476 - DNA, 25 bp, Mus musculus
tgtgagttctttaacagtccaaccc

SEQ ID NO: 268477 - DNA, 25 bp, Mus musculus
tgtcacctgaggattcgagtcttga

SEQ ID NO: 268478 - DNA, 25 bp, Mus musculus
gcgctcgctataagcgttcctcaga

SEQ ID NO: 268479 - DNA, 25 bp, Mus musculus
atgtcccagaaggtctcacgccgtc

SEQ ID NO: 268480 - DNA, 25 bp, Mus musculus
tccagcctgaggctccaggctatgg

SEQ ID NO: 268481 - DNA, 25 bp, Mus musculus
atgccgcgggatgactttcaaaacc

SEQ ID NO: 268482 - DNA, 25 bp, Mus musculus
tccgcactcgcctccaggcaccgca

SEQ ID NO: 268483 - DNA, 25 bp, Mus musculus
ttggttatccgtccgtccgcactcg

SEQ ID NO: 268484 - DNA, 25 bp, Mus musculus
gcgcttggttatccgtccgtccgca

SEQ ID NO: 268485 - DNA, 25 bp, Mus musculus
gcctctcgtcctcgcgcttggttat

SEQ ID NO: 268486 - DNA, 25 bp, Mus musculus
aggtctcacgccgtccagcctgagg

SEQ ID NO: 268487 - DNA, 25 bp, Mus musculus
acaggactacatgtcccagaaggtc

SEQ ID NO: 268488 - DNA, 25 bp, Mus musculus
cgcgggatgactttcaaaacccaag

SEQ ID NO: 268489 - DNA, 25 bp, Mus musculus
cagcaagatgcgctcgctataagcg

SEQ ID NO: 268490 - DNA, 25 bp, Mus musculus
gctccaggctatggagcgcccagca

SEQ ID NO: 268491 - DNA, 25 bp, Mus musculus
gggcaccgcccacaggactacatgt

SEQ ID NO: 268492 - DNA, 25 bp, Mus musculus
gtgccatctacgctcctggtgactg

SEQ ID NO: 268493 - DNA, 25 bp, Mus musculus
ggccacacgtacatgcacgatcatc

SEQ ID NO: 268494 - DNA, 25 bp, Mus musculus
ggtggccacacgtacatgcacgatc

SEQ ID NO: 268495 - DNA, 25 bp, Mus musculus
ctggtggccacacgtacatgcacga

SEQ ID NO: 268496 - DNA, 25 bp, Mus musculus
cacctggtggccacacgtacatgca

SEQ ID NO: 268497 - DNA, 25 bp, Mus musculus
gtccctgccgcctccctgcagttcc

SEQ ID NO: 268498 - DNA, 25 bp, Mus musculus
cctgcagttccagggtcttcccgaa

SEQ ID NO: 268499 - DNA, 25 bp, Mus musculus
cagttccagggtcttcccgaaggcg

SEQ ID NO: 268500 - DNA, 25 bp, Mus musculus
cagggtcttcccgaaggcgtccgag

SEQ ID NO: 268501 - DNA, 25 bp, Mus musculus
gaccggtgccatctacgctcctggt

SEQ ID NO: 268502 - DNA, 25 bp, Mus musculus
agctcagcggcgtcgccgtcacctg

SEQ ID NO: 268503 - DNA, 25 bp, Mus musculus
gccatctacgctcctggtgactgtc

SEQ ID NO: 268504 - DNA, 25 bp, Mus musculus
gctttcgctgctcctggcctggcgg

SEQ ID NO: 268505 - DNA, 25 bp, Mus musculus
agcgggaccggtgccatctacgctc

SEQ ID NO: 268506 - DNA, 25 bp, Mus musculus
aagtggtctcgagcggtcatatccg

SEQ ID NO: 268507 - DNA, 25 bp, Mus musculus
cgtcacaaatagtagcgcgcatgcg

SEQ ID NO: 268508 - DNA, 25 bp, Mus musculus
atctccgcgcagatcagttctgtta

SEQ ID NO: 268509 - DNA, 25 bp, Mus musculus
tgcccgcactccaggagagtttgga

SEQ ID NO: 268510 - DNA, 25 bp, Mus musculus
tccgcttaaatctccgcgcagatca

SEQ ID NO: 268511 - DNA, 25 bp, Mus musculus
gcagatcagttctgttattgttgcc

SEQ ID NO: 268512 - DNA, 25 bp, Mus musculus
tattgttgcccgcactccaggagag

SEQ ID NO: 268513 - DNA, 25 bp, Mus musculus
agtagcgcgcatgcgcttcgccagc

SEQ ID NO: 268514 - DNA, 25 bp, Mus musculus
agggtggcgaagaacactgattcgc

SEQ ID NO: 268515 - DNA, 25 bp, Mus musculus
agaacactgattcgcagtaaacgga

SEQ ID NO: 268516 - DNA, 25 bp, Mus musculus
attcgcagtaaacggaagtggtctc

SEQ ID NO: 268517 - DNA, 25 bp, Mus musculus
tggattctaacactgagggcccggg

SEQ ID NO: 268518 - DNA, 25 bp, Mus musculus
tcgagcggtcatatccgcttaaatc

SEQ ID NO: 268519 - DNA, 25 bp, Mus musculus
agtttggattctaacactgagggcc

SEQ ID NO: 268520 - DNA, 25 bp, Mus musculus
atgcgcgccacccagggctacgtgg

SEQ ID NO: 268521 - DNA, 25 bp, Mus musculus
tagagtgatcacatccgctcagatc

SEQ ID NO: 268522 - DNA, 25 bp, Mus musculus
tagcgtgggtgtttggaatccgaac

SEQ ID NO: 268523 - DNA, 25 bp, Mus musculus
ttcaaatcggaagtggcctagagtg

SEQ ID NO: 268524 - DNA, 25 bp, Mus musculus
cccagggctacgtggtagtgaactg

SEQ ID NO: 268525 - DNA, 25 bp, Mus musculus
ctgtgggcggaagtctcgcagtcct

SEQ ID NO: 268526 - DNA, 25 bp, Mus musculus
ttggaatccgaacccatggaattgt

SEQ ID NO: 268527 - DNA, 25 bp, Mus musculus
tctcctgtcgttgccagggtagcgt

SEQ ID NO: 268528 - DNA, 25 bp, Mus musculus
agtagttcgcctctcctgtcgttgc

SEQ ID NO: 268529 - DNA, 25 bp, Mus musculus
ccgctcagatcttaaagtagttcgc

SEQ ID NO: 268530 - DNA, 25 bp, Mus musculus
agtggcctagagtgatcacatccgc

SEQ ID NO: 268531 - DNA, 25 bp, Mus musculus
tgagggaacccttattcaaatcgga

SEQ ID NO: 268532 - DNA, 25 bp, Mus musculus
tggtagtgaactgagggaaccctta

SEQ ID NO: 268533 - DNA, 25 bp, Mus musculus
acccatggaattgtgggtgtctgtg

SEQ ID NO: 268534 - DNA, 25 bp, Mus musculus
ttctcctgtcacaagacccgtgctg

SEQ ID NO: 268535 - DNA, 25 bp, Mus musculus
ctgcctttgaggctgaggtgctaca

SEQ ID NO: 268536 - DNA, 25 bp, Mus musculus
cacacgtgctgcgtgagcttgcgcc

SEQ ID NO: 268537 - DNA, 25 bp, Mus musculus
tgaggtgctacatacagtgcttgcc

SEQ ID NO: 268538 - DNA, 25 bp, Mus musculus
acatacagtgcttgccgggcacctg

SEQ ID NO: 268539 - DNA, 25 bp, Mus musculus
tgcctctggtggcaaggactccaca

SEQ ID NO: 268540 - DNA, 25 bp, Mus musculus
ggactccacagtgctggcacacgtg

SEQ ID NO: 268541 - DNA, 25 bp, Mus musculus
tgggcatcaccctgcacctggtggc

SEQ ID NO: 268542 - DNA, 25 bp, Mus musculus
gggagctgccgctcaccatcgtggc

SEQ ID NO: 268543 - DNA, 25 bp, Mus musculus
catcgtggcctacgaagatctcttc

SEQ ID NO: 268544 - DNA, 25 bp, Mus musculus
acgatggacgccgtggcccgcagca

SEQ ID NO: 268545 - DNA, 25 bp, Mus musculus
ctgctgcaccttctgcggggtgctg

SEQ ID NO: 268546 - DNA, 25 bp, Mus musculus
ccgacgtgcttctcctgtcacaaga

SEQ ID NO: 268547 - DNA, 25 bp, Mus musculus
gctcctgcttctgtgctgcctttga

SEQ ID NO: 268548 - DNA, 25 bp, Mus musculus
ccgtgccctgccaagcttcagagag

SEQ ID NO: 268549 - DNA, 25 bp, Mus musculus
aaccagagctgctcggccaggtaga

SEQ ID NO: 268550 - DNA, 25 bp, Mus musculus
ttcatagtgcataccgaaccagagc

SEQ ID NO: 268551 - DNA, 25 bp, Mus musculus
caagcttcagagagcgggtctacca

SEQ ID NO: 268552 - DNA, 25 bp, Mus musculus
gcgggtctaccacgcattcatagtg

SEQ ID NO: 268553 - DNA, 25 bp, Mus musculus
gtgagctgcgcacctgcgacttcgt

SEQ ID NO: 268554 - DNA, 25 bp, Mus musculus
ccttgcggacgaaggatcacctttc

SEQ ID NO: 268555 - DNA, 25 bp, Mus musculus
agcagcggtgcacacaatggccaga

SEQ ID NO: 268556 - DNA, 25 bp, Mus musculus
cgaaggatcacctttctgtctggcc

SEQ ID NO: 268557 - DNA, 25 bp, Mus musculus
ctggccggctctgctcttttggcac

SEQ ID NO: 268558 - DNA, 25 bp, Mus musculus
ccacagtcactgaagaagccagagg

SEQ ID NO: 268559 - DNA, 25 bp, Mus musculus
cacaagaccatgagccctcgacagg

SEQ ID NO: 268560 - DNA, 25 bp, Mus musculus
cctcgacagggcttccagttgcgca

SEQ ID NO: 268561 - DNA, 25 bp, Mus musculus
gcgacttcgtgctccttgcggacga

SEQ ID NO: 268562 - DNA, 25 bp, Mus musculus
cttttccgaggagtgcgtgtatgcc

SEQ ID NO: 268563 - DNA, 25 bp, Mus musculus
catcagccgtgctggacctcgtgca

SEQ ID NO: 268564 - DNA, 25 bp, Mus musculus
tgctgtatgcgcacttccgccatct

SEQ ID NO: 268565 - DNA, 25 bp, Mus musculus
aggcctgtgccctcctggatggcct

SEQ ID NO: 268566 - DNA, 25 bp, Mus musculus
cacaacgctgacgacatggctgaga

SEQ ID NO: 268567 - DNA, 25 bp, Mus musculus
tcgtgcactcggcagagcgcctagc

SEQ ID NO: 268568 - DNA, 25 bp, Mus musculus
cttaagctcctggaggcggccagac

SEQ ID NO: 268569 - DNA, 25 bp, Mus musculus
gtcatgcccgggacctgcttaagct

SEQ ID NO: 268570 - DNA, 25 bp, Mus musculus
ctgaggccttccgtggtcatgcccg

SEQ ID NO: 268571 - DNA, 25 bp, Mus musculus
gccatctccgctacttttccgagga

SEQ ID NO: 268572 - DNA, 25 bp, Mus musculus
ctgcagtttgcctcgcagaaggagg

SEQ ID NO: 268573 - DNA, 25 bp, Mus musculus
aacttcctgcgtggtgatgctggga

SEQ ID NO: 268574 - DNA, 25 bp, Mus musculus
agacggtgctcatgaacttcctgcg

SEQ ID NO: 268575 - DNA, 25 bp, Mus musculus
gcctagctctggctccggcagcaaa

SEQ ID NO: 268576 - DNA, 25 bp, Mus musculus
tcttgtacccgacacaccgaaggga

SEQ ID NO: 268577 - DNA, 25 bp, Mus musculus
tcacctcggtttccgaggctccagt

SEQ ID NO: 268578 - DNA, 25 bp, Mus musculus
gcaaaatcttgtacccgacacaccg

SEQ ID NO: 268579 - DNA, 25 bp, Mus musculus
aggctgcaaaatcttgtacccgaca

SEQ ID NO: 268580 - DNA, 25 bp, Mus musculus
gcttcctcgttaaaaggctgcaaaa

SEQ ID NO: 268581 - DNA, 25 bp, Mus musculus
gtccctcctcctaaagtcactccag

SEQ ID NO: 268582 - DNA, 25 bp, Mus musculus
ggggcttcctcgttaaaaggctgca

SEQ ID NO: 268583 - DNA, 25 bp, Mus musculus
tcagccgcaccgcagcaaggtgcgg

SEQ ID NO: 268584 - DNA, 25 bp, Mus musculus
ggttcagccgcaccgcagcaaggtg

SEQ ID NO: 268585 - DNA, 25 bp, Mus musculus
gcttgcgggttcagccgcaccgcag

SEQ ID NO: 268586 - DNA, 25 bp, Mus musculus
gggcctcttccaccgagtccgagtg

SEQ ID NO: 268587 - DNA, 25 bp, Mus musculus
tcctaaagtcactccagcccgtgcc

SEQ ID NO: 268588 - DNA, 25 bp, Mus musculus
tctagtcctcacctcggtttccgag

SEQ ID NO: 268589 - DNA, 25 bp, Mus musculus
cctcctcgagcgcttgcgggttcag

SEQ ID NO: 268590 - DNA, 25 bp, Mus musculus
tgggaacaacgtaccttatcacctg

SEQ ID NO: 268591 - DNA, 25 bp, Mus musculus
tctgcagcaaaaacgagctagcctg

SEQ ID NO: 268592 - DNA, 25 bp, Mus musculus
cctttgtcttgccttagccgggcta

SEQ ID NO: 268593 - DNA, 25 bp, Mus musculus
ctaagagctgcctgacggaagtaac

SEQ ID NO: 268594 - DNA, 25 bp, Mus musculus
cgggctacgccatttctgctgctca

SEQ ID NO: 268595 - DNA, 25 bp, Mus musculus
atgtcctaagggcaacagacgttta

SEQ ID NO: 268596 - DNA, 25 bp, Mus musculus
gacgtttattctttctgccaccgtg

SEQ ID NO: 268597 - DNA, 25 bp, Mus musculus
cagcgcgcgctataaatggggacac

SEQ ID NO: 268598 - DNA, 25 bp, Mus musculus
tgagtttttccacggtgttggcctc

SEQ ID NO: 268599 - DNA, 25 bp, Mus musculus
tttgcaccctgggaagcacgtgtcc

SEQ ID NO: 268600 - DNA, 25 bp, Mus musculus
tcgggctggaaccagggtttctctc

SEQ ID NO: 268601 - DNA, 25 bp, Mus musculus
tgcgggtactttcgggacaatgcct

SEQ ID NO: 268602 - DNA, 25 bp, Mus musculus
cctttcgccaggtttgtggagcttg

SEQ ID NO: 268603 - DNA, 25 bp, Mus musculus
ccctctccttgggagctgtctaaga

SEQ ID NO: 268604 - DNA, 25 bp, Mus musculus
cgcggtgtacggtgcaaaatgtgca

SEQ ID NO: 268605 - DNA, 25 bp, Mus musculus
ctcctgggcagagaccggttctcta

SEQ ID NO: 268606 - DNA, 25 bp, Mus musculus
cggttctctagaaggggaactcgca

SEQ ID NO: 268607 - DNA, 25 bp, Mus musculus
aactcgcagacgaagtagaggcgcc

SEQ ID NO: 268608 - DNA, 25 bp, Mus musculus
tagaggcgccgctcacagtcatggt

SEQ ID NO: 268609 - DNA, 25 bp, Mus musculus
tggtcccaccaagaaccgtcgtctg

SEQ ID NO: 268610 - DNA, 25 bp, Mus musculus
ctgggccacgcagttctccaggacg

SEQ ID NO: 268611 - DNA, 25 bp, Mus musculus
gctgagtggatgtgttgccgcacta

SEQ ID NO: 268612 - DNA, 25 bp, Mus musculus
actccaggctgaatgcgcggtgcca

SEQ ID NO: 268613 - DNA, 25 bp, Mus musculus
aaagacacgcgctggccgttctcga

SEQ ID NO: 268614 - DNA, 25 bp, Mus musculus
aaaatgtgcactagagctcctgggc

SEQ ID NO: 268615 - DNA, 25 bp, Mus musculus
gtccgcaggctgtgctaagctccca

SEQ ID NO: 268616 - DNA, 25 bp, Mus musculus
cgcatccatttgctggcggtccgca

SEQ ID NO: 268617 - DNA, 25 bp, Mus musculus
cgtaagtaccggcttagcgcatcca

SEQ ID NO: 268618 - DNA, 25 bp, Mus musculus
ggctcctggccacgccagccgtccc

SEQ ID NO: 268619 - DNA, 25 bp, Mus musculus
caggcgtctgtagttcctttccacc

SEQ ID NO: 268620 - DNA, 25 bp, Mus musculus
ttccacccgcgcctcgcgtgcccat

SEQ ID NO: 268621 - DNA, 25 bp, Mus musculus
tgcccatcgcgcctcaggttccttc

SEQ ID NO: 268622 - DNA, 25 bp, Mus musculus
gccgattcctcagcccgtctcggta

SEQ ID NO: 268623 - DNA, 25 bp, Mus musculus
cctcaggttccttctccgcaggccg

SEQ ID NO: 268624 - DNA, 25 bp, Mus musculus
cgacccagggctattctttcaccaa

SEQ ID NO: 268625 - DNA, 25 bp, Mus musculus
tagccgccgagcttttgattcatgc

SEQ ID NO: 268626 - DNA, 25 bp, Mus musculus
tgccagctattcttagccgccgagc

SEQ ID NO: 268627 - DNA, 25 bp, Mus musculus
gctgcgtgccagctattcttagccg

SEQ ID NO: 268628 - DNA, 25 bp, Mus musculus
cccttccaggcgtctgtagttcctt

SEQ ID NO: 268629 - DNA, 25 bp, Mus musculus
ggctattctttcaccaacctccctg

SEQ ID NO: 268630 - DNA, 25 bp, Mus musculus
gccgagcttttgattcatgccgccc

SEQ ID NO: 268631 - DNA, 25 bp, Mus musculus
ctcggtaccagctgcgtgccagcta

SEQ ID NO: 268632 - DNA, 25 bp, Mus musculus
cagctccccagacgggccaggaaga

SEQ ID NO: 268633 - DNA, 25 bp, Mus musculus
gacgctccatgtctgtccctgacga

SEQ ID NO: 268634 - DNA, 25 bp, Mus musculus
cccgcgacaagcgaggacgaggaaa

SEQ ID NO: 268635 - DNA, 25 bp, Mus musculus
acaagcgaggacgaggaaagacaca

SEQ ID NO: 268636 - DNA, 25 bp, Mus musculus
ggcctctacccgaggcctccaggga

SEQ ID NO: 268637 - DNA, 25 bp, Mus musculus
tggtaacctggcctctacccgaggc

SEQ ID NO: 268638 - DNA, 25 bp, Mus musculus
cgaggcagcggagcacctggtaacc

SEQ ID NO: 268639 - DNA, 25 bp, Mus musculus
gggggctcagaatcggacagctccc

SEQ ID NO: 268640 - DNA, 25 bp, Mus musculus
cacagtgccagcgagtgtcccgagg

SEQ ID NO: 268641 - DNA, 25 bp, Mus musculus
aagacacagtgccagcgagtgtccc

SEQ ID NO: 268642 - DNA, 25 bp, Mus musculus
aggaaagacacagtgccagcgagtg

SEQ ID NO: 268643 - DNA, 25 bp, Mus musculus
ggacgaggaaagacacagtgccagc

SEQ ID NO: 268644 - DNA, 25 bp, Mus musculus
cgaggacgaggaaagacacagtgcc

SEQ ID NO: 268645 - DNA, 25 bp, Mus musculus
ggagcacctggtaacctggcctcta

SEQ ID NO: 268646 - DNA, 25 bp, Mus musculus
tgcagaattgcaccgagagccgacg

SEQ ID NO: 268647 - DNA, 25 bp, Mus musculus
gcaagcgccctccagtcacagggaa

SEQ ID NO: 268648 - DNA, 25 bp, Mus musculus
tcaccaccgagcttcgacgagttcg

SEQ ID NO: 268649 - DNA, 25 bp, Mus musculus
tcgtcgcgaaaaagtaggcgcactc

SEQ ID NO: 268650 - DNA, 25 bp, Mus musculus
taggcgcactcgttccaccgcagag

SEQ ID NO: 268651 - DNA, 25 bp, Mus musculus
aagtcgccgcgggttacacactgac

SEQ ID NO: 268652 - DNA, 25 bp, Mus musculus
gctttactgtcacccgaagcggctg

SEQ ID NO: 268653 - DNA, 25 bp, Mus musculus
gttgccaatgttctctccctgaata

SEQ ID NO: 268654 - DNA, 25 bp, Mus musculus
ctgaataaacctagagggcccagtg

SEQ ID NO: 268655 - DNA, 25 bp, Mus musculus
tgtgactacattccaaaatccgctg

SEQ ID NO: 268656 - DNA, 25 bp, Mus musculus
ccgctgaatattcggttctaggatc

SEQ ID NO: 268657 - DNA, 25 bp, Mus musculus
tgcttttgttcagtcgggttcgtcc

SEQ ID NO: 268658 - DNA, 25 bp, Mus musculus
cgtcctcacgcgaagctggttgctt

SEQ ID NO: 268659 - DNA, 25 bp, Mus musculus
tttcgccctgaaagctaccttcgga

SEQ ID NO: 268660 - DNA, 25 bp, Mus musculus
cctgcgcggcaaatccgcggtcatt

SEQ ID NO: 268661 - DNA, 25 bp, Mus musculus
tgcgcggcaaatccgcggtcatttc

SEQ ID NO: 268662 - DNA, 25 bp, Mus musculus
gcaaatccgcggtcatttcaagatg

SEQ ID NO: 268663 - DNA, 25 bp, Mus musculus
aaatccgcggtcatttcaagatggc

SEQ ID NO: 268664 - DNA, 25 bp, Mus musculus
atccgcggtcatttcaagatggcgc

SEQ ID NO: 268665 - DNA, 25 bp, Mus musculus
tttcaagatggcgccaagcgggctg

SEQ ID NO: 268666 - DNA, 25 bp, Mus musculus
tgggcctgctgagtccgccatggcc

SEQ ID NO: 268667 - DNA, 25 bp, Mus musculus
ccataggcagccaatcaggataagc

SEQ ID NO: 268668 - DNA, 25 bp, Mus musculus
taggcagccaatcaggataagcctg

SEQ ID NO: 268669 - DNA, 25 bp, Mus musculus
ggcagccaatcaggataagcctgtg

SEQ ID NO: 268670 - DNA, 25 bp, Mus musculus
cagccaatcaggataagcctgtgca

SEQ ID NO: 268671 - DNA, 25 bp, Mus musculus
ccaatcaggataagcctgtgcagca

SEQ ID NO: 268672 - DNA, 25 bp, Mus musculus
ggataagcctgtgcagcaaacctgt

SEQ ID NO: 268673 - DNA, 25 bp, Mus musculus
tcaggataagcctgtgcagcaaacc

SEQ ID NO: 268674 - DNA, 25 bp, Mus musculus
gccgaaaagtatctcacagcttctg

SEQ ID NO: 268675 - DNA, 25 bp, Mus musculus
gccagacgacctggcgatcgggtta

SEQ ID NO: 268676 - DNA, 25 bp, Mus musculus
tgccagccagacgacctggcgatcg

SEQ ID NO: 268677 - DNA, 25 bp, Mus musculus
tgcgaagaccctgccagccagacga

SEQ ID NO: 268678 - DNA, 25 bp, Mus musculus
ctagattgcgaagaccctgccagcc

SEQ ID NO: 268679 - DNA, 25 bp, Mus musculus
gtagatggctagattgcgaagaccc

SEQ ID NO: 268680 - DNA, 25 bp, Mus musculus
ccgcgcttagcggtagatggctaga

SEQ ID NO: 268681 - DNA, 25 bp, Mus musculus
cccaagaacagtgccgcgcttagcg

SEQ ID NO: 268682 - DNA, 25 bp, Mus musculus
ccctccaagatggcgccaactgggt

SEQ ID NO: 268683 - DNA, 25 bp, Mus musculus
ctgggtggagccgaaaagtatctca

SEQ ID NO: 268684 - DNA, 25 bp, Mus musculus
aagtatctcacagcttctgctttag

SEQ ID NO: 268685 - DNA, 25 bp, Mus musculus
tctcacagcttctgctttagtcccg

SEQ ID NO: 268686 - DNA, 25 bp, Mus musculus
ccactgcggcaaaacaagacccgcc

SEQ ID NO: 268687 - DNA, 25 bp, Mus musculus
caactgggtggagccgaaaagtatc

SEQ ID NO: 268688 - DNA, 25 bp, Mus musculus
catcttatgtgatgtgtggcgctgc

SEQ ID NO: 268689 - DNA, 25 bp, Mus musculus
acatttacaggtaaccgcgcaccgc

SEQ ID NO: 268690 - DNA, 25 bp, Mus musculus
ctggtacatttacaggtaaccgcgc

SEQ ID NO: 268691 - DNA, 25 bp, Mus musculus
gcagcgtctggtacatttacaggta

SEQ ID NO: 268692 - DNA, 25 bp, Mus musculus
aggcgcagcgtctggtacatttaca

SEQ ID NO: 268693 - DNA, 25 bp, Mus musculus
ctgcgctatcctccagctggcccgc

SEQ ID NO: 268694 - DNA, 25 bp, Mus musculus
tggcgatggctttgtctgcggtcgg

SEQ ID NO: 268695 - DNA, 25 bp, Mus musculus
ttcagccgagcaacgacgcggcggc

SEQ ID NO: 268696 - DNA, 25 bp, Mus musculus
ccgaacaagggggttcagccgagca

SEQ ID NO: 268697 - DNA, 25 bp, Mus musculus
atgtgtggcgctgcgtccttctccc

SEQ ID NO: 268698 - DNA, 25 bp, Mus musculus
cgtgccatcttatgtgatgtgtggc

SEQ ID NO: 268699 - DNA, 25 bp, Mus musculus
cgatggcgtgccatcttatgtgatg

SEQ ID NO: 268700 - DNA, 25 bp, Mus musculus
gcacgcgatggcgtgccatcttatg

SEQ ID NO: 268701 - DNA, 25 bp, Mus musculus
ctcccggcgcgggtcagcatgaggc

SEQ ID NO: 268702 - DNA, 25 bp, Mus musculus
tatgtacgtaccagcccgctccggc

SEQ ID NO: 268703 - DNA, 25 bp, Mus musculus
cttcccaccacagtagcagcggagg

SEQ ID NO: 268704 - DNA, 25 bp, Mus musculus
gcgaggtggaggacccagcccgacc

SEQ ID NO: 268705 - DNA, 25 bp, Mus musculus
cagcccagccttcgaggctggcgag

SEQ ID NO: 268706 - DNA, 25 bp, Mus musculus
tcccgccctgcgctacttccagctg

SEQ ID NO: 268707 - DNA, 25 bp, Mus musculus
gcagtagcggtcctgctcaggctcc

SEQ ID NO: 268708 - DNA, 25 bp, Mus musculus
cgccctgcgctacttccagctgccc

SEQ ID NO: 268709 - DNA, 25 bp, Mus musculus
cggccagtgcggctatgtacgtacc

SEQ ID NO: 268710 - DNA, 25 bp, Mus musculus
gccagtgcggctatgtacgtaccag

SEQ ID NO: 268711 - DNA, 25 bp, Mus musculus
ccagtgcggctatgtacgtaccagc

SEQ ID NO: 268712 - DNA, 25 bp, Mus musculus
aggcagtagcggtcctgctcaggct

SEQ ID NO: 268713 - DNA, 25 bp, Mus musculus
gcggctatgtacgtaccagcccgct

SEQ ID NO: 268714 - DNA, 25 bp, Mus musculus
cccacctcgattggctctgggaccc

SEQ ID NO: 268715 - DNA, 25 bp, Mus musculus
agtgcggctatgtacgtaccagccc

SEQ ID NO: 268716 - DNA, 25 bp, Mus musculus
tgaaggctcgatatgttcggacgtc

SEQ ID NO: 268717 - DNA, 25 bp, Mus musculus
agccttcgcgggtcttagggcgtct

SEQ ID NO: 268718 - DNA, 25 bp, Mus musculus
ccttcgcgggtcttagggcgtctgt

SEQ ID NO: 268719 - DNA, 25 bp, Mus musculus
ggctcgaggctaggggccaaggtcc

SEQ ID NO: 268720 - DNA, 25 bp, Mus musculus
ccaaggtccccgtgcagagtcctta

SEQ ID NO: 268721 - DNA, 25 bp, Mus musculus
tgcagagtccttacccgcggcggct

SEQ ID NO: 268722 - DNA, 25 bp, Mus musculus
agtccttacccgcggcggctcagag

SEQ ID NO: 268723 - DNA, 25 bp, Mus musculus
aaggtgagtgaaggctcgatatgtt

SEQ ID NO: 268724 - DNA, 25 bp, Mus musculus
aggctcgatatgttcggacgtcaga

SEQ ID NO: 268725 - DNA, 25 bp, Mus musculus
gctcgatatgttcggacgtcagaca

SEQ ID NO: 268726 - DNA, 25 bp, Mus musculus
tcgatatgttcggacgtcagacagg

SEQ ID NO: 268727 - DNA, 25 bp, Mus musculus
tatgttcggacgtcagacaggggct

SEQ ID NO: 268728 - DNA, 25 bp, Mus musculus
gctgggtttggctcggcggcctcct

SEQ ID NO: 268729 - DNA, 25 bp, Mus musculus
gctcagagcatatgtgaggcgcggc

SEQ ID NO: 268730 - DNA, 25 bp, Mus musculus
ttccttgaaaattgccaggcccggc

SEQ ID NO: 268731 - DNA, 25 bp, Mus musculus
acggcgagttcttgtttgcggagcc

SEQ ID NO: 268732 - DNA, 25 bp, Mus musculus
gagaacggccttccgctactggtcc

SEQ ID NO: 268733 - DNA, 25 bp, Mus musculus
atgaaggcatgttctccgccgagcc

SEQ ID NO: 268734 - DNA, 25 bp, Mus musculus
gtcctccactgaagatgggcctggg

SEQ ID NO: 268735 - DNA, 25 bp, Mus musculus
tcctccagctggcacgagagggtcc

SEQ ID NO: 268736 - DNA, 25 bp, Mus musculus
cggctgcgccattccaaatccattg

SEQ ID NO: 268737 - DNA, 25 bp, Mus musculus
gcctctgcatgtgcgattccttgaa

SEQ ID NO: 268738 - DNA, 25 bp, Mus musculus
tgagcaaggcctggcgcacagcagc

SEQ ID NO: 268739 - DNA, 25 bp, Mus musculus
ctcctgcttcaactggggccggagc

SEQ ID NO: 268740 - DNA, 25 bp, Mus musculus
ggagaaggcccttaccgctagtcca

SEQ ID NO: 268741 - DNA, 25 bp, Mus musculus
cgtcatgagccagtgttgcgcctct

SEQ ID NO: 268742 - DNA, 25 bp, Mus musculus
cattcgccacatgcgcgtcatgagc

SEQ ID NO: 268743 - DNA, 25 bp, Mus musculus
ggtgcatccgctgaccggcaaagcc

SEQ ID NO: 268744 - DNA, 25 bp, Mus musculus
atcacaaggtcagcccagcgcccag

SEQ ID NO: 268745 - DNA, 25 bp, Mus musculus
tcgctccctatcacccacccgcctg

SEQ ID NO: 268746 - DNA, 25 bp, Mus musculus
ttgtctggggcctctcgctccctat

SEQ ID NO: 268747 - DNA, 25 bp, Mus musculus
aggagccttgtctggggcctctcgc

SEQ ID NO: 268748 - DNA, 25 bp, Mus musculus
tcgctcccgtctttgtgccaccaca

SEQ ID NO: 268749 - DNA, 25 bp, Mus musculus
ccgtagctctccgaccggaggggca

SEQ ID NO: 268750 - DNA, 25 bp, Mus musculus
acatccgtagctctccgaccggagg

SEQ ID NO: 268751 - DNA, 25 bp, Mus musculus
ttctttgcccatcctgccttcagga

SEQ ID NO: 268752 - DNA, 25 bp, Mus musculus
tcggatcacaaggtcagcccagcgc

SEQ ID NO: 268753 - DNA, 25 bp, Mus musculus
tgcctcggatcacaaggtcagccca

SEQ ID NO: 268754 - DNA, 25 bp, Mus musculus
tgcctgcctcggatcacaaggtcag

SEQ ID NO: 268755 - DNA, 25 bp, Mus musculus
tgctgcctgcctcggatcacaaggt

SEQ ID NO: 268756 - DNA, 25 bp, Mus musculus
gctgctgcctgcctcggatcacaag

SEQ ID NO: 268757 - DNA, 25 bp, Mus musculus
gggcctcttcgacatccgtagctct

SEQ ID NO: 268758 - DNA, 25 bp, Mus musculus
gaagtgaaggcccagagacgtcttt

SEQ ID NO: 268759 - DNA, 25 bp, Mus musculus
tcacctgggaatgcgccaggtcccg

SEQ ID NO: 268760 - DNA, 25 bp, Mus musculus
gggaggccacgccttctcgtttcgc

SEQ ID NO: 268761 - DNA, 25 bp, Mus musculus
gctggatcgttcacctcacctggga

SEQ ID NO: 268762 - DNA, 25 bp, Mus musculus
agagacgtctttgggttcaccctgg

SEQ ID NO: 268763 - DNA, 25 bp, Mus musculus
atgagccacctgtgggcgaagtgaa

SEQ ID NO: 268764 - DNA, 25 bp, Mus musculus
aagtctgtgacggtgatgagccacc

SEQ ID NO: 268765 - DNA, 25 bp, Mus musculus
cgcaccagtgggtacgcggttccac

SEQ ID NO: 268766 - DNA, 25 bp, Mus musculus
agcagtaaatcgtcgtggcgcacca

SEQ ID NO: 268767 - DNA, 25 bp, Mus musculus
cggcgcaggtgcaaacggtagtccc

SEQ ID NO: 268768 - DNA, 25 bp, Mus musculus
agcatgcgccttcggaccagagagc

SEQ ID NO: 268769 - DNA, 25 bp, Mus musculus
gtcaatcttcgtcggcaggctccgc

SEQ ID NO: 268770 - DNA, 25 bp, Mus musculus
cccgctgtgcgtcaatcttcgtcgg

SEQ ID NO: 268771 - DNA, 25 bp, Mus musculus
gcggtcttctcagctggatcgttca

SEQ ID NO: 268772 - DNA, 25 bp, Mus musculus
tggagccacccacagacctcaatgt

SEQ ID NO: 268773 - DNA, 25 bp, Mus musculus
ggtggccttctacaagctgcgcaag

SEQ ID NO: 268774 - DNA, 25 bp, Mus musculus
ggccgctacattggcgagctagacc

SEQ ID NO: 268775 - DNA, 25 bp, Mus musculus
gaccagtcgcacttcacctgctatg

SEQ ID NO: 268776 - DNA, 25 bp, Mus musculus
caggcacatccatgacgtcggtcaa

SEQ ID NO: 268777 - DNA, 25 bp, Mus musculus
cgtcggtcaactggctgacacctaa

SEQ ID NO: 268778 - DNA, 25 bp, Mus musculus
gcacgctcatgacgcacggttccta

SEQ ID NO: 268779 - DNA, 25 bp, Mus musculus
cggttcctatcgtgtgcgcatttca

SEQ ID NO: 268780 - DNA, 25 bp, Mus musculus
gctgcacgatggcacactcaacttc

SEQ ID NO: 268781 - DNA, 25 bp, Mus musculus
catggtgacaaactcggctggcaac

SEQ ID NO: 268782 - DNA, 25 bp, Mus musculus
aggctttcacggtgcccatcacgga

SEQ ID NO: 268783 - DNA, 25 bp, Mus musculus
cgctggagcgagaccacctcaatca

SEQ ID NO: 268784 - DNA, 25 bp, Mus musculus
acgcgcactgtggagatcatcaacg

SEQ ID NO: 268785 - DNA, 25 bp, Mus musculus
tgcttcgtggccatcaccttcatgg

SEQ ID NO: 268786 - DNA, 25 bp, Mus musculus
tttcgcctgctcagtcagcgtgcta

SEQ ID NO: 268787 - DNA, 25 bp, Mus musculus
ctcagtcagcgtgctaccacccggt

SEQ ID NO: 268788 - DNA, 25 bp, Mus musculus
ggacttccggactgcgcgtcctatt

SEQ ID NO: 268789 - DNA, 25 bp, Mus musculus
cgggagctgtagtccctttcgcctg

SEQ ID NO: 268790 - DNA, 25 bp, Mus musculus
aatcgcagttcggcgcgcgcaagtc

SEQ ID NO: 268791 - DNA, 25 bp, Mus musculus
cttcgggaatcgcagttcggcgcgc

SEQ ID NO: 268792 - DNA, 25 bp, Mus musculus
ccggtcgctgcctagggaatgcgaa

SEQ ID NO: 268793 - DNA, 25 bp, Mus musculus
cctacggaggccttcgggaatcgca

SEQ ID NO: 268794 - DNA, 25 bp, Mus musculus
ccggactgcgcgtcctatttagacg

SEQ ID NO: 268795 - DNA, 25 bp, Mus musculus
ctgcctagggaatgcgaaagcggtc

SEQ ID NO: 268796 - DNA, 25 bp, Mus musculus
gcgtcctatttagacgccctacgga

SEQ ID NO: 268797 - DNA, 25 bp, Mus musculus
cccggaggacttccggactgcgcgt

SEQ ID NO: 268798 - DNA, 25 bp, Mus musculus
accacccggtcgctgcctagggaat

SEQ ID NO: 268799 - DNA, 25 bp, Mus musculus
aggccttcgggaatcgcagttcggc

SEQ ID NO: 268800 - DNA, 25 bp, Mus musculus
gccaccatacgggagcgttgagaaa

SEQ ID NO: 268801 - DNA, 25 bp, Mus musculus
agcaagagcactagcagccgggtca

SEQ ID NO: 268802 - DNA, 25 bp, Mus musculus
gccgcggctaccatcagcaagagca

SEQ ID NO: 268803 - DNA, 25 bp, Mus musculus
cagcccgctaggaaacacagggttc

SEQ ID NO: 268804 - DNA, 25 bp, Mus musculus
cacagggttcatcctgaggctcacg

SEQ ID NO: 268805 - DNA, 25 bp, Mus musculus
ggccatttctccatccgggtctcta

SEQ ID NO: 268806 - DNA, 25 bp, Mus musculus
tctagggctcacgttcccggtgaca

SEQ ID NO: 268807 - DNA, 25 bp, Mus musculus
cgccgggcaccctattgtaaagtca

SEQ ID NO: 268808 - DNA, 25 bp, Mus musculus
tcgagatcttaaggccgctcggggc

SEQ ID NO: 268809 - DNA, 25 bp, Mus musculus
tgcgccctcggtcagagttcatgta

SEQ ID NO: 268810 - DNA, 25 bp, Mus musculus
tcatgtacctggcatcctgggatgg

SEQ ID NO: 268811 - DNA, 25 bp, Mus musculus
agctgcgcgactttcccatctttga

SEQ ID NO: 268812 - DNA, 25 bp, Mus musculus
ttgaaagcaacttcgtgcaggtgtg

SEQ ID NO: 268813 - DNA, 25 bp, Mus musculus
ccacctgggagagaagtgacgtcgt

SEQ ID NO: 268814 - DNA, 25 bp, Mus musculus
ctggtaggtgagtttgcgtttgacc

SEQ ID NO: 268815 - DNA, 25 bp, Mus musculus
agcgcgctgtcaaactggtaggtga

SEQ ID NO: 268816 - DNA, 25 bp, Mus musculus
caactccttgtgcttggaggagaac

SEQ ID NO: 268817 - DNA, 25 bp, Mus musculus
tttgcgtttgaccttgcggatttcg

SEQ ID NO: 268818 - DNA, 25 bp, Mus musculus
tgcggatttcgcctgtcttggcata

SEQ ID NO: 268819 - DNA, 25 bp, Mus musculus
gtcttggcatagttgcgcagcgctc

SEQ ID NO: 268820 - DNA, 25 bp, Mus musculus
cagcgctcgggccagcttctgatac

SEQ ID NO: 268821 - DNA, 25 bp, Mus musculus
tcgggccagcttctgatacgtcatg

SEQ ID NO: 268822 - DNA, 25 bp, Mus musculus
gcttctgatacgtcatgcgcttgcg

SEQ ID NO: 268823 - DNA, 25 bp, Mus musculus
acgtcatgcgcttgcggttgccctt

SEQ ID NO: 268824 - DNA, 25 bp, Mus musculus
agcggcgagccaacaactccttgtg

SEQ ID NO: 268825 - DNA, 25 bp, Mus musculus
gagccaacaactccttgtgcttgga

SEQ ID NO: 268826 - DNA, 25 bp, Mus musculus
gcagcagcgcgctgtcaaactggta

SEQ ID NO: 268827 - DNA, 25 bp, Mus musculus
aggagaactggaagacgccggcacc

SEQ ID NO: 268828 - DNA, 25 bp, Mus musculus
cccaggtcctaagctccaggggatc

SEQ ID NO: 268829 - DNA, 25 bp, Mus musculus
tcctggctcttaggggtttggcaac

SEQ ID NO: 268830 - DNA, 25 bp, Mus musculus
ccagcatcctggctcttaggggttt

SEQ ID NO: 268831 - DNA, 25 bp, Mus musculus
tgacgctaacggaacaaggacacgc

SEQ ID NO: 268832 - DNA, 25 bp, Mus musculus
ttgggcgatcaaaccacgtcccact

SEQ ID NO: 268833 - DNA, 25 bp, Mus musculus
gcccgcttgggcgatcaaaccacgt

SEQ ID NO: 268834 - DNA, 25 bp, Mus musculus
tacttaccgcctcaaacagcttttc

SEQ ID NO: 268835 - DNA, 25 bp, Mus musculus
gagcactctgctcgaggcgtcagct

SEQ ID NO: 268836 - DNA, 25 bp, Mus musculus
ctgcagacattctgcgagcactctg

SEQ ID NO: 268837 - DNA, 25 bp, Mus musculus
ccaggggatctgtcctttgcattgc

SEQ ID NO: 268838 - DNA, 25 bp, Mus musculus
tcctggctagcgtgcacgccgctga

SEQ ID NO: 268839 - DNA, 25 bp, Mus musculus
tcgaacagcggaacaggcaccaacg

SEQ ID NO: 268840 - DNA, 25 bp, Mus musculus
gtcgccttgtctctcgaacagcgga

SEQ ID NO: 268841 - DNA, 25 bp, Mus musculus
tttgcattgccagccttgctctatc

SEQ ID NO: 268842 - DNA, 25 bp, Mus musculus
tcggcagtctagtgcacccacactg

SEQ ID NO: 268843 - DNA, 25 bp, Mus musculus
tctctccgcttctcctccgatgctc

SEQ ID NO: 268844 - DNA, 25 bp, Mus musculus
accagggtcggcagtctagtgcacc

SEQ ID NO: 268845 - DNA, 25 bp, Mus musculus
gaccagggtcggcagtctagtgcac

SEQ ID NO: 268846 - DNA, 25 bp, Mus musculus
cccgaccagggtcggcagtctagtg

SEQ ID NO: 268847 - DNA, 25 bp, Mus musculus
ctctacgcacacaccccgaccaggg

SEQ ID NO: 268848 - DNA, 25 bp, Mus musculus
tccgcttctcctccgatgctcgtcc

SEQ ID NO: 268849 - DNA, 25 bp, Mus musculus
cagggtcggcagtctagtgcaccca

SEQ ID NO: 268850 - DNA, 25 bp, Mus musculus
gggtcggcagtctagtgcacccaca

SEQ ID NO: 268851 - DNA, 25 bp, Mus musculus
gtcggcagtctagtgcacccacact

SEQ ID NO: 268852 - DNA, 25 bp, Mus musculus
cggcagtctagtgcacccacactga

SEQ ID NO: 268853 - DNA, 25 bp, Mus musculus
ggcggcgccaccagcccagggtgga

SEQ ID NO: 268854 - DNA, 25 bp, Mus musculus
cacccacactgaaccgggcgcccgg

SEQ ID NO: 268855 - DNA, 25 bp, Mus musculus
ggtcggcagtctagtgcacccacac

SEQ ID NO: 268856 - DNA, 25 bp, Mus musculus
ctaagagggtgcatgctgcagagca

SEQ ID NO: 268857 - DNA, 25 bp, Mus musculus
tctgcagccttgtcagttacccttg

SEQ ID NO: 268858 - DNA, 25 bp, Mus musculus
ttcccgaaggcgcagtctgcagcct

SEQ ID NO: 268859 - DNA, 25 bp, Mus musculus
cccggagcacagcactctacgcaca

SEQ ID NO: 268860 - DNA, 25 bp, Mus musculus
agccaggtggccggctgactcacct

SEQ ID NO: 268861 - DNA, 25 bp, Mus musculus
tcagttacccttgggagccgtgata

SEQ ID NO: 268862 - DNA, 25 bp, Mus musculus
cggtatctaagagggtgcatgctgc

SEQ ID NO: 268863 - DNA, 25 bp, Mus musculus
tgaactctgcagacggtatctaaga

SEQ ID NO: 268864 - DNA, 25 bp, Mus musculus
ccatctgaactctgcagacggtatc

SEQ ID NO: 268865 - DNA, 25 bp, Mus musculus
ccaaacaccatctgaactctgcaga

SEQ ID NO: 268866 - DNA, 25 bp, Mus musculus
ggagccgtgatatggtctgccgccc

SEQ ID NO: 268867 - DNA, 25 bp, Mus musculus
ttacccttgggagccgtgatatggt

SEQ ID NO: 268868 - DNA, 25 bp, Mus musculus
agccttgtcagttacccttgggagc

SEQ ID NO: 268869 - DNA, 25 bp, Mus musculus
cggctgactcacctcccggagcaca

SEQ ID NO: 268870 - DNA, 25 bp, Mus musculus
ctcatgactgcaccggcgatcggga

SEQ ID NO: 268871 - DNA, 25 bp, Mus musculus
cagggcgccaccgactgtgaggcct

SEQ ID NO: 268872 - DNA, 25 bp, Mus musculus
agcaacagcgcttgctgagcgaaaa

SEQ ID NO: 268873 - DNA, 25 bp, Mus musculus
aaaggtgacagacttccggtctgcc

SEQ ID NO: 268874 - DNA, 25 bp, Mus musculus
ctgagcgaaaagcaaaagtaacttc

SEQ ID NO: 268875 - DNA, 25 bp, Mus musculus
aggcctcggccggaagtggcacacc

SEQ ID NO: 268876 - DNA, 25 bp, Mus musculus
agagtcacgcccaccttgttccagg

SEQ ID NO: 268877 - DNA, 25 bp, Mus musculus
ggggtctccgactctgttgccctgg

SEQ ID NO: 268878 - DNA, 25 bp, Mus musculus
cgcgctaagcgggacccacggcgat

SEQ ID NO: 268879 - DNA, 25 bp, Mus musculus
cctctgtgtccgcaccggtgattgt

SEQ ID NO: 268880 - DNA, 25 bp, Mus musculus
gattgtgcctccacagcactttgga

SEQ ID NO: 268881 - DNA, 25 bp, Mus musculus
ttggaagtaacttcagaagcctggg

SEQ ID NO: 268882 - DNA, 25 bp, Mus musculus
agcctgggagtagctcgaagcaaca

SEQ ID NO: 268883 - DNA, 25 bp, Mus musculus
agtaacttcgccacttcttccggca

SEQ ID NO: 268884 - DNA, 25 bp, Mus musculus
tgttcagctctaagggccctggcca

SEQ ID NO: 268885 - DNA, 25 bp, Mus musculus
gccgcagacttaaggcgggcttcca

SEQ ID NO: 268886 - DNA, 25 bp, Mus musculus
gcttccaggttcacctaagaacaga

SEQ ID NO: 268887 - DNA, 25 bp, Mus musculus
gcctgacaagcggacagaacctcgt

SEQ ID NO: 268888 - DNA, 25 bp, Mus musculus
acgccattttgtcggtgtctgtcgc

SEQ ID NO: 268889 - DNA, 25 bp, Mus musculus
gcggtttggcgacatttctcggcca

SEQ ID NO: 268890 - DNA, 25 bp, Mus musculus
tctcggccaaaaggccgcttgcttt

SEQ ID NO: 268891 - DNA, 25 bp, Mus musculus
gacaacacccgagctgccgcggttt

SEQ ID NO: 268892 - DNA, 25 bp, Mus musculus
ttgtcaaggcctcggccgtccatcg

SEQ ID NO: 268893 - DNA, 25 bp, Mus musculus
ctagtgccgtccagagtcgaagtca

SEQ ID NO: 268894 - DNA, 25 bp, Mus musculus
ggcctcggccgtttgcataaccgga

SEQ ID NO: 268895 - DNA, 25 bp, Mus musculus
gtccgctattcgctctgttgttcag

SEQ ID NO: 268896 - DNA, 25 bp, Mus musculus
aaactcttcgagagcccgacgcgcg

SEQ ID NO: 268897 - DNA, 25 bp, Mus musculus
gagccttttccaaagtccgctattc

SEQ ID NO: 268898 - DNA, 25 bp, Mus musculus
cccgcgtaaagcctgcagaggaagg

SEQ ID NO: 268899 - DNA, 25 bp, Mus musculus
aacccgcgtaaagcctgcagaggaa

SEQ ID NO: 268900 - DNA, 25 bp, Mus musculus
cgaacccgcgtaaagcctgcagagg

SEQ ID NO: 268901 - DNA, 25 bp, Mus musculus
ctggagacgggaatacgaacccgcg

SEQ ID NO: 268902 - DNA, 25 bp, Mus musculus
gtgacccgccctcttcgttcccgca

SEQ ID NO: 268903 - DNA, 25 bp, Mus musculus
tacgaacccgcgtaaagcctgcaga

SEQ ID NO: 268904 - DNA, 25 bp, Mus musculus
ctgcgcctaagaccgcccagagggc

SEQ ID NO: 268905 - DNA, 25 bp, Mus musculus
tctggagacgggaatacgaacccgc

SEQ ID NO: 268906 - DNA, 25 bp, Mus musculus
aggcgaggagccagcgaccgccgca

SEQ ID NO: 268907 - DNA, 25 bp, Mus musculus
ttcgttcccgcaggcgcctcctccc

SEQ ID NO: 268908 - DNA, 25 bp, Mus musculus
ccgcagccactgcactcgcgcactg

SEQ ID NO: 268909 - DNA, 25 bp, Mus musculus
agccactgcactcgcgcactgccgg

SEQ ID NO: 268910 - DNA, 25 bp, Mus musculus
gcactgccggccctgcgcctaagac

SEQ ID NO: 268911 - DNA, 25 bp, Mus musculus
ccgcgtaaagcctgcagaggaaggc

SEQ ID NO: 268912 - DNA, 25 bp, Mus musculus
gctttgactacgacccgggcacgga

SEQ ID NO: 268913 - DNA, 25 bp, Mus musculus
cggcgacagcggtaagatcgtgatc

SEQ ID NO: 268914 - DNA, 25 bp, Mus musculus
cagcggtaagatcgtgatcaacgtg

SEQ ID NO: 268915 - DNA, 25 bp, Mus musculus
gtgcgccatgagacgtaccgctcca

SEQ ID NO: 268916 - DNA, 25 bp, Mus musculus
gagacgtaccgctccacgttgcgca

SEQ ID NO: 268917 - DNA, 25 bp, Mus musculus
ggcggccgcgcgctttgactacgac

SEQ ID NO: 268918 - DNA, 25 bp, Mus musculus
ggcgtcttcgcctacgtgctcaact

SEQ ID NO: 268919 - DNA, 25 bp, Mus musculus
aggaggcactggactctttcgaggc

SEQ ID NO: 268920 - DNA, 25 bp, Mus musculus
gcgagctcaagcgtctgtgttttca

SEQ ID NO: 268921 - DNA, 25 bp, Mus musculus
caagcgtctgtgttttcaggacgcg

SEQ ID NO: 268922 - DNA, 25 bp, Mus musculus
ctgccagggtgagcgcgctctccga

SEQ ID NO: 268923 - DNA, 25 bp, Mus musculus
gcgctctccgagcactcctaattat

SEQ ID NO: 268924 - DNA, 25 bp, Mus musculus
tcctaattatcccaaccgctctgtt

SEQ ID NO: 268925 - DNA, 25 bp, Mus musculus
gttgcgcaccctgccagggaccaga

SEQ ID NO: 268926 - DNA, 25 bp, Mus musculus
gggttctgacgtctcctgacacctg

SEQ ID NO: 268927 - DNA, 25 bp, Mus musculus
agcgccctatggcatagctccttta

SEQ ID NO: 268928 - DNA, 25 bp, Mus musculus
tatggcatagctcctttatcccgcg

SEQ ID NO: 268929 - DNA, 25 bp, Mus musculus
gcatagctcctttatcccgcggatc

SEQ ID NO: 268930 - DNA, 25 bp, Mus musculus
ggatcccgaggctacctgggcgcct

SEQ ID NO: 268931 - DNA, 25 bp, Mus musculus
gatggggaggcctccgagtccagat

SEQ ID NO: 268932 - DNA, 25 bp, Mus musculus
agatcctctccagcacccaggtgag

SEQ ID NO: 268933 - DNA, 25 bp, Mus musculus
tgaggccggctctgcggtccagcaa

SEQ ID NO: 268934 - DNA, 25 bp, Mus musculus
ccggctctgcggtccagcaagaggt

SEQ ID NO: 268935 - DNA, 25 bp, Mus musculus
tccagcaagaggtggggcctctccc

SEQ ID NO: 268936 - DNA, 25 bp, Mus musculus
ggcctctcccgtcaggaaggcagga

SEQ ID NO: 268937 - DNA, 25 bp, Mus musculus
gcaggaccgggttctgacgtctcct

SEQ ID NO: 268938 - DNA, 25 bp, Mus musculus
gtctcctgacacctgccgggctggg

SEQ ID NO: 268939 - DNA, 25 bp, Mus musculus
ctctcccgtcaggaaggcaggaccg

SEQ ID NO: 268940 - DNA, 25 bp, Mus musculus
aggcctcggcctggacagaaaagga

SEQ ID NO: 268941 - DNA, 25 bp, Mus musculus
acctggccgagaatgtgcggcagta

SEQ ID NO: 268942 - DNA, 25 bp, Mus musculus
tgggaaaagaacctggccgagaatg

SEQ ID NO: 268943 - DNA, 25 bp, Mus musculus
cgtgccaggcgtgggaaaagaacct

SEQ ID NO: 268944 - DNA, 25 bp, Mus musculus
agaagttggcaaagcgtgccaggcg

SEQ ID NO: 268945 - DNA, 25 bp, Mus musculus
cggctggcgcgccaggccaatcaga

SEQ ID NO: 268946 - DNA, 25 bp, Mus musculus
caatcaaaaagagcggctggcgcgc

SEQ ID NO: 268947 - DNA, 25 bp, Mus musculus
tgcccaatcaaaaagagcggctggc

SEQ ID NO: 268948 - DNA, 25 bp, Mus musculus
tcagtgctgcccaatcaaaaagagc

SEQ ID NO: 268949 - DNA, 25 bp, Mus musculus
cctcggcctggacagaaaaggaggc

SEQ ID NO: 268950 - DNA, 25 bp, Mus musculus
gtccagaggcctcggcctggacaga

SEQ ID NO: 268951 - DNA, 25 bp, Mus musculus
cccacccacaggtaggcattacaga

SEQ ID NO: 268952 - DNA, 25 bp, Mus musculus
ggcattacagaccaatcagcacttg

SEQ ID NO: 268953 - DNA, 25 bp, Mus musculus
agaccaatcagcacttgctgcggcc

SEQ ID NO: 268954 - DNA, 25 bp, Mus musculus
tgctcgctgctgtcgcacggccggt

SEQ ID NO: 268955 - DNA, 25 bp, Mus musculus
gcgtctgctcgctgctgtcgcacgg

SEQ ID NO: 268956 - DNA, 25 bp, Mus musculus
cccggaagtttctgcggggcaactg

SEQ ID NO: 268957 - DNA, 25 bp, Mus musculus
tttctgcggggcaactgtaaaggtg

SEQ ID NO: 268958 - DNA, 25 bp, Mus musculus
cggggcaactgtaaaggtgagtcca

SEQ ID NO: 268959 - DNA, 25 bp, Mus musculus
taaaggtgagtccaagtttctgctc

SEQ ID NO: 268960 - DNA, 25 bp, Mus musculus
gtccaagtttctgctccggatcgga

SEQ ID NO: 268961 - DNA, 25 bp, Mus musculus
tgtgacgtcactgcctgaggaaggc

SEQ ID NO: 268962 - DNA, 25 bp, Mus musculus
tgagagtccgggccgtgagaaaccc

SEQ ID NO: 268963 - DNA, 25 bp, Mus musculus
ggcgcccacggctttttcacaagta

SEQ ID NO: 268964 - DNA, 25 bp, Mus musculus
ccacggctttttcacaagtacagtg

SEQ ID NO: 268965 - DNA, 25 bp, Mus musculus
cacaagtacagtgatgaggagccgc

SEQ ID NO: 268966 - DNA, 25 bp, Mus musculus
ggcagcctgtgacgtcactgcctga

SEQ ID NO: 268967 - DNA, 25 bp, Mus musculus
tctgctccggatcggagtgagagtc

SEQ ID NO: 268968 - DNA, 25 bp, Mus musculus
cgactagcgacgaggcgcaagctca

SEQ ID NO: 268969 - DNA, 25 bp, Mus musculus
ggcgcgcgagccgaccttaaaagcc

SEQ ID NO: 268970 - DNA, 25 bp, Mus musculus
tgaattagcgcgcaggcgcaacggc

SEQ ID NO: 268971 - DNA, 25 bp, Mus musculus
cagagggtctgtgaattagcgcgca

SEQ ID NO: 268972 - DNA, 25 bp, Mus musculus
cgcaacaggttgtggggttgtctcc

SEQ ID NO: 268973 - DNA, 25 bp, Mus musculus
aatgcgcatgcgcaacaggttgtgg

SEQ ID NO: 268974 - DNA, 25 bp, Mus musculus
ggggaataagacaatgcgcatgcgc

SEQ ID NO: 268975 - DNA, 25 bp, Mus musculus
tgtttagccaatgaccggccgcccg

SEQ ID NO: 268976 - DNA, 25 bp, Mus musculus
gaccagtgcgcgtgtttagccaatg

SEQ ID NO: 268977 - DNA, 25 bp, Mus musculus
caggacccgatccattgttacgcca

SEQ ID NO: 268978 - DNA, 25 bp, Mus musculus
cgctgctggctcgactagcgacgag

SEQ ID NO: 268979 - DNA, 25 bp, Mus musculus
cgcaactcgagcctagtgcgcttgc

SEQ ID NO: 268980 - DNA, 25 bp, Mus musculus
cctagtgcgcttgctcagcggatgc

SEQ ID NO: 268981 - DNA, 25 bp, Mus musculus
attgttacgccactaccctcctggg

SEQ ID NO: 268982 - DNA, 25 bp, Mus musculus
accgcgagataacgcttcccaagta

SEQ ID NO: 268983 - DNA, 25 bp, Mus musculus
tccaggcagcaaccgcgagataacg

SEQ ID NO: 268984 - DNA, 25 bp, Mus musculus
cgagataacgcttcccaagtacttg

SEQ ID NO: 268985 - DNA, 25 bp, Mus musculus
agtacttgtagagcgctgtatacgc

SEQ ID NO: 268986 - DNA, 25 bp, Mus musculus
ccaagtacttgtagagcgctgtata

SEQ ID NO: 268987 - DNA, 25 bp, Mus musculus
agttccaggcagcaaccgcgagata

SEQ ID NO: 268988 - DNA, 25 bp, Mus musculus
gcagcaaccgcgagataacgcttcc

SEQ ID NO: 268989 - DNA, 25 bp, Mus musculus
agcaaccgcgagataacgcttccca

SEQ ID NO: 268990 - DNA, 25 bp, Mus musculus
cgcgagataacgcttcccaagtact

SEQ ID NO: 268991 - DNA, 25 bp, Mus musculus
gataacgcttcccaagtacttgtag

SEQ ID NO: 268992 - DNA, 25 bp, Mus musculus
aacgcttcccaagtacttgtagagc

SEQ ID NO: 268993 - DNA, 25 bp, Mus musculus
cttcccaagtacttgtagagcgctg

SEQ ID NO: 268994 - DNA, 25 bp, Mus musculus
tcccaagtacttgtagagcgctgta

SEQ ID NO: 268995 - DNA, 25 bp, Mus musculus
ggcttcatagaggagttccaggcag

SEQ ID NO: 268996 - DNA, 25 bp, Mus musculus
ggctcggtctcctgaatcggtcaga

SEQ ID NO: 268997 - DNA, 25 bp, Mus musculus
cgccgaatggcgcaagctagcttag

SEQ ID NO: 268998 - DNA, 25 bp, Mus musculus
ggtcagatccgatgtgtctttcaca

SEQ ID NO: 268999 - DNA, 25 bp, Mus musculus
tccgatgtgtctttcacacccgaaa

SEQ ID NO: 269000 - DNA, 25 bp, Mus musculus
gtgtctttcacacccgaaaccagct

SEQ ID NO: 269001 - DNA, 25 bp, Mus musculus
gaaaccagctcgtctcgttctctct

SEQ ID NO: 269002 - DNA, 25 bp, Mus musculus
tgcttcacgaatttgccacccgaga

SEQ ID NO: 269003 - DNA, 25 bp, Mus musculus
ttgccacccgagacctcgtgggtta

SEQ ID NO: 269004 - DNA, 25 bp, Mus musculus
agctagcttaggcttcatagaggag

SEQ ID NO: 269005 - DNA, 25 bp, Mus musculus
ccgagacctcgtgggttaagcccat

SEQ ID NO: 269006 - DNA, 25 bp, Mus musculus
tctcctgaatcggtcagatccgatg

SEQ ID NO: 269007 - DNA, 25 bp, Mus musculus
gcccatcgccgaatggcgcaagcta

SEQ ID NO: 269008 - DNA, 25 bp, Mus musculus
ggcgcaagctagcttaggcttcata

SEQ ID NO: 269009 - DNA, 25 bp, Mus musculus
tgggttaagcccatcgccgaatggc

SEQ ID NO: 269010 - DNA, 25 bp, Mus musculus
agctctgctgagctcactgtccggg

SEQ ID NO: 269011 - DNA, 25 bp, Mus musculus
gccctgtaggtacagccgcatcgta

SEQ ID NO: 269012 - DNA, 25 bp, Mus musculus
cgctgctactgaacgcgcctgtggt

SEQ ID NO: 269013 - DNA, 25 bp, Mus musculus
tgcgcgcgcttcactacgtagcagc

SEQ ID NO: 269014 - DNA, 25 bp, Mus musculus
tacgtagcagccagcaaggtttttc

SEQ ID NO: 269015 - DNA, 25 bp, Mus musculus
ttctgagtttccgtcggcccttctg

SEQ ID NO: 269016 - DNA, 25 bp, Mus musculus
ccttctggcacgaggagcacatcga

SEQ ID NO: 269017 - DNA, 25 bp, Mus musculus
agggctcactgcttctggcctccta

SEQ ID NO: 269018 - DNA, 25 bp, Mus musculus
tctggcctcctacacgtggtcggac

SEQ ID NO: 269019 - DNA, 25 bp, Mus musculus
tgagcaccgaccagaccctgcgttt

SEQ ID NO: 269020 - DNA, 25 bp, Mus musculus
accctgcgtttggtgctccaggacg

SEQ ID NO: 269021 - DNA, 25 bp, Mus musculus
cgaggctgaggactatgactggtca

SEQ ID NO: 269022 - DNA, 25 bp, Mus musculus
tctcccgcatggctgggtagagacc

SEQ ID NO: 269023 - DNA, 25 bp, Mus musculus
ctcatattctatcccgcgcagggcg

SEQ ID NO: 269024 - DNA, 25 bp, Mus musculus
agcgagtctggatcctggtgtttcc

SEQ ID NO: 269025 - DNA, 25 bp, Mus musculus
ttcaaacaccacctagtgaaagcca

SEQ ID NO: 269026 - DNA, 25 bp, Mus musculus
aaacaccacctagtgaaagccaagg

SEQ ID NO: 269027 - DNA, 25 bp, Mus musculus
gcaggtacacgcctcccttttcaaa

SEQ ID NO: 269028 - DNA, 25 bp, Mus musculus
ccgggcgctggtgtgcaggtacacg

SEQ ID NO: 269029 - DNA, 25 bp, Mus musculus
ctggatcctggtgtttccgggcgct

SEQ ID NO: 269030 - DNA, 25 bp, Mus musculus
ccggcgatgagcgagtctggatcct

SEQ ID NO: 269031 - DNA, 25 bp, Mus musculus
agtctggatcctggtgtttccgggc

SEQ ID NO: 269032 - DNA, 25 bp, Mus musculus
tatgacgccggcgatgagcgagtct

SEQ ID NO: 269033 - DNA, 25 bp, Mus musculus
atgagcgagtctggatcctggtgtt

SEQ ID NO: 269034 - DNA, 25 bp, Mus musculus
gcgagtctggatcctggtgtttccg

SEQ ID NO: 269035 - DNA, 25 bp, Mus musculus
tgagcgagtctggatcctggtgttt

SEQ ID NO: 269036 - DNA, 25 bp, Mus musculus
ttttcaaacaccacctagtgaaagc

SEQ ID NO: 269037 - DNA, 25 bp, Mus musculus
cgagtctggatcctggtgtttccgg

SEQ ID NO: 269038 - DNA, 25 bp, Mus musculus
ccgcggtctcgagtccagccagttt

SEQ ID NO: 269039 - DNA, 25 bp, Mus musculus
cacggataatccgactatggtggcc

SEQ ID NO: 269040 - DNA, 25 bp, Mus musculus
ccgcccacggataatccgactatgg

SEQ ID NO: 269041 - DNA, 25 bp, Mus musculus
tgaggtctgcaaggcgctccgtcca

SEQ ID NO: 269042 - DNA, 25 bp, Mus musculus
ttttcctgaggtctgcaaggcgctc

SEQ ID NO: 269043 - DNA, 25 bp, Mus musculus
gaggttttcctgaggtctgcaaggc

SEQ ID NO: 269044 - DNA, 25 bp, Mus musculus
gggccgcgacctctaagccctcgtc

SEQ ID NO: 269045 - DNA, 25 bp, Mus musculus
tcgagtccagccagtttccctgtca

SEQ ID NO: 269046 - DNA, 25 bp, Mus musculus
atctccacggaaggtcccgcggtct

SEQ ID NO: 269047 - DNA, 25 bp, Mus musculus
agtggtttaccatctccacggaagg

SEQ ID NO: 269048 - DNA, 25 bp, Mus musculus
gcagccaagggtagttagtggttta

SEQ ID NO: 269049 - DNA, 25 bp, Mus musculus
gtcctttagtctgcagcagccaagg

SEQ ID NO: 269050 - DNA, 25 bp, Mus musculus
agccctcgtcctttagtctgcagca

SEQ ID NO: 269051 - DNA, 25 bp, Mus musculus
tgtcaccaagccaaggccggacagg

SEQ ID NO: 269052 - DNA, 25 bp, Mus musculus
gtacagaggctcgcgctccgggacc

SEQ ID NO: 269053 - DNA, 25 bp, Mus musculus
aggaactgcccgcagtggccgctga

SEQ ID NO: 269054 - DNA, 25 bp, Mus musculus
aacgcacctggagcgcctgttacgg

SEQ ID NO: 269055 - DNA, 25 bp, Mus musculus
cgaaacgcacctggagcgcctgtta

SEQ ID NO: 269056 - DNA, 25 bp, Mus musculus
atgtcccgcttcacgagggggtgta

SEQ ID NO: 269057 - DNA, 25 bp, Mus musculus
actgcccgcagtggccgctgagtct

SEQ ID NO: 269058 - DNA, 25 bp, Mus musculus
cgcctgggccgaaacgcacctggag

SEQ ID NO: 269059 - DNA, 25 bp, Mus musculus
tgcatagaaggaactgcccgcagtg

SEQ ID NO: 269060 - DNA, 25 bp, Mus musculus
tatttgcatagaaggaactgcccgc

SEQ ID NO: 269061 - DNA, 25 bp, Mus musculus
ttctggcggggtctatttgcataga

SEQ ID NO: 269062 - DNA, 25 bp, Mus musculus
gactgcgaggagctgatgagcgcca

SEQ ID NO: 269063 - DNA, 25 bp, Mus musculus
cgcatagggtgcctcgggtggcacc

SEQ ID NO: 269064 - DNA, 25 bp, Mus musculus
ccgcgccttttctggcggggtctat

SEQ ID NO: 269065 - DNA, 25 bp, Mus musculus
cgcagccgccgacctggagccgccc

SEQ ID NO: 269066 - DNA, 25 bp, Mus musculus
cggtcatagttgttgcgggcaattc

SEQ ID NO: 269067 - DNA, 25 bp, Mus musculus
agccatgttaatgcggggcactacc

SEQ ID NO: 269068 - DNA, 25 bp, Mus musculus
agccatactaactgccacgtcggga

SEQ ID NO: 269069 - DNA, 25 bp, Mus musculus
actaccatctctttgcggggcacga

SEQ ID NO: 269070 - DNA, 25 bp, Mus musculus
agtgctcctggaaacgaagctgccc

SEQ ID NO: 269071 - DNA, 25 bp, Mus musculus
caagaagccgccatgccttttgagg

SEQ ID NO: 269072 - DNA, 25 bp, Mus musculus
gccgcttgcctacgcttgtgtgagc

SEQ ID NO: 269073 - DNA, 25 bp, Mus musculus
acgtcatgccgcttgcgtgtgagca

SEQ ID NO: 269074 - DNA, 25 bp, Mus musculus
cgcgacgaagtgtagacgagcttca

SEQ ID NO: 269075 - DNA, 25 bp, Mus musculus
cccatgtgtctgactcgcgacgaag

SEQ ID NO: 269076 - DNA, 25 bp, Mus musculus
tcaccgtggaaagaggactgcacca

SEQ ID NO: 269077 - DNA, 25 bp, Mus musculus
ggactgcaccaccatcttgaaactg

SEQ ID NO: 269078 - DNA, 25 bp, Mus musculus
tcctggccgactgctgaaagagctc

SEQ ID NO: 269079 - DNA, 25 bp, Mus musculus
tattttccatccgtgggcacccttg

SEQ ID NO: 269080 - DNA, 25 bp, Mus musculus
gcccgcactggcacagagctggtat

SEQ ID NO: 269081 - DNA, 25 bp, Mus musculus
cacagagctggtattactgactgca

SEQ ID NO: 269082 - DNA, 25 bp, Mus musculus
ctggcacagagctggtattactgac

SEQ ID NO: 269083 - DNA, 25 bp, Mus musculus
aggaactgtgggaagccgtcgtggg

SEQ ID NO: 269084 - DNA, 25 bp, Mus musculus
ttcaggcccgcactggcacagagct

SEQ ID NO: 269085 - DNA, 25 bp, Mus musculus
ccgcactggcacagagctggtatta

SEQ ID NO: 269086 - DNA, 25 bp, Mus musculus
cactggcacagagctggtattactg

SEQ ID NO: 269087 - DNA, 25 bp, Mus musculus
ctggtattactgactgcagcgccac

SEQ ID NO: 269088 - DNA, 25 bp, Mus musculus
gtattactgactgcagcgccaccgc

SEQ ID NO: 269089 - DNA, 25 bp, Mus musculus
ccgccctggaccctgtgcctatgcc

SEQ ID NO: 269090 - DNA, 25 bp, Mus musculus
accctgtgcctatgccgcccatggc

SEQ ID NO: 269091 - DNA, 25 bp, Mus musculus
cagaggcggcccgacgctgcctcca

SEQ ID NO: 269092 - DNA, 25 bp, Mus musculus
cgctgcctccacgacatcgcacagg

SEQ ID NO: 269093 - DNA, 25 bp, Mus musculus
ctttcaggcccgcactggcacagag

SEQ ID NO: 269094 - DNA, 25 bp, Mus musculus
ggccgcggctcaataccagcgactt

SEQ ID NO: 269095 - DNA, 25 bp, Mus musculus
gaacaattctttccgggattggctg

SEQ ID NO: 269096 - DNA, 25 bp, Mus musculus
aagctttgcccgcacagccttgact

SEQ ID NO: 269097 - DNA, 25 bp, Mus musculus
tcttgcctagcaaacgaagctttgc

SEQ ID NO: 269098 - DNA, 25 bp, Mus musculus
ggtcaactctgtttcttgcctagca

SEQ ID NO: 269099 - DNA, 25 bp, Mus musculus
ttctaaacgctccaagggtcaactc

SEQ ID NO: 269100 - DNA, 25 bp, Mus musculus
ctcagccagtgtcgggaagagttgc

SEQ ID NO: 269101 - DNA, 25 bp, Mus musculus
gacacccaggtcttcggggatcttc

SEQ ID NO: 269102 - DNA, 25 bp, Mus musculus
tcgcccgacctagaccgaatagcgg

SEQ ID NO: 269103 - DNA, 25 bp, Mus musculus
tgacagtttccttctctacagccct

SEQ ID NO: 269104 - DNA, 25 bp, Mus musculus
gcgggccctgcacactgacagtttc

SEQ ID NO: 269105 - DNA, 25 bp, Mus musculus
cggttcgcagcctgcaggacagaca

SEQ ID NO: 269106 - DNA, 25 bp, Mus musculus
attaagcgaacagaaagccttggcc

SEQ ID NO: 269107 - DNA, 25 bp, Mus musculus
ctcggcccagcaagagaacaattct

SEQ ID NO: 269108 - DNA, 25 bp, Mus musculus
tattcctgccgtcggatggccaagc

SEQ ID NO: 269109 - DNA, 25 bp, Mus musculus
cgcattggaaccgttgtggtagctt

SEQ ID NO: 269110 - DNA, 25 bp, Mus musculus
ttgtggtagcttgggaaacgtcgaa

SEQ ID NO: 269111 - DNA, 25 bp, Mus musculus
cggaatttccggtgtggctcgcatt

SEQ ID NO: 269112 - DNA, 25 bp, Mus musculus
ttgggaaagcagaacttccggtggc

SEQ ID NO: 269113 - DNA, 25 bp, Mus musculus
ttgccggctgctgagcaagctccac

SEQ ID NO: 269114 - DNA, 25 bp, Mus musculus
agcaagctccactgtgattctgttc

SEQ ID NO: 269115 - DNA, 25 bp, Mus musculus
ccctatattcctgccgtcggatggc

SEQ ID NO: 269116 - DNA, 25 bp, Mus musculus
tcgaacccgcccatgggcaaggggc

SEQ ID NO: 269117 - DNA, 25 bp, Mus musculus
cctgacccaagtgacggaccggaag

SEQ ID NO: 269118 - DNA, 25 bp, Mus musculus
cccaagtgacggaccggaagtgctc

SEQ ID NO: 269119 - DNA, 25 bp, Mus musculus
tgctcccgaaaccaaggtgggcacg

SEQ ID NO: 269120 - DNA, 25 bp, Mus musculus
atgtcacagcttggatcccggggcc

SEQ ID NO: 269121 - DNA, 25 bp, Mus musculus
gctcgcattgggaaagcagaacttc

SEQ ID NO: 269122 - DNA, 25 bp, Mus musculus
agtcaggatactcactcaccctcgg

SEQ ID NO: 269123 - DNA, 25 bp, Mus musculus
cgcacctcacacgatgccttgtagg

SEQ ID NO: 269124 - DNA, 25 bp, Mus musculus
caggagcatgagcacacgcacctca

SEQ ID NO: 269125 - DNA, 25 bp, Mus musculus
cttctccgaggagtacaggagcatg

SEQ ID NO: 269126 - DNA, 25 bp, Mus musculus
tgaagatcttcttctccgaggagta

SEQ ID NO: 269127 - DNA, 25 bp, Mus musculus
tgaggccgatgaagatcttcttctc

SEQ ID NO: 269128 - DNA, 25 bp, Mus musculus
caaagttgctctggtcgtgcgggat

SEQ ID NO: 269129 - DNA, 25 bp, Mus musculus
acggatgccgttgacaaagttgctc

SEQ ID NO: 269130 - DNA, 25 bp, Mus musculus
gatgacgcgacggatgccgttgaca

SEQ ID NO: 269131 - DNA, 25 bp, Mus musculus
tccaggcttcgctgcaggacctgct

SEQ ID NO: 269132 - DNA, 25 bp, Mus musculus
tcctgctccaggcttcgctgcagga

SEQ ID NO: 269133 - DNA, 25 bp, Mus musculus
cgcctaacagcaggcccgagtcagg

SEQ ID NO: 269134 - DNA, 25 bp, Mus musculus
ccttgtaggagaagtgcacgcagcc

SEQ ID NO: 269135 - DNA, 25 bp, Mus musculus
caggcccgagtcaggatactcactc

SEQ ID NO: 269136 - DNA, 25 bp, Mus musculus
actcaccatgggaggggccgaacga

SEQ ID NO: 269137 - DNA, 25 bp, Mus musculus
ggctggcgcctaccaacgtggaaga

SEQ ID NO: 269138 - DNA, 25 bp, Mus musculus
cggcgccaaccaacgcgaagctggg

SEQ ID NO: 269139 - DNA, 25 bp, Mus musculus
ggccgaaccactgcagcgaacaggg

SEQ ID NO: 269140 - DNA, 25 bp, Mus musculus
agggactgtccacaatcgccatctg

SEQ ID NO: 269141 - DNA, 25 bp, Mus musculus
tcgaggaccgccaggccaggaacgt

SEQ ID NO: 269142 - DNA, 25 bp, Mus musculus
aggccgaggaccaactttgcaattg

SEQ ID NO: 269143 - DNA, 25 bp, Mus musculus
gaaacaggccgtgggactcaccatg

SEQ ID NO: 269144 - DNA, 25 bp, Mus musculus
gcgcccagagccgatcaaggactga

SEQ ID NO: 269145 - DNA, 25 bp, Mus musculus
agcccgccgcgcaacaaaggggagc

SEQ ID NO: 269146 - DNA, 25 bp, Mus musculus
agtcagcagtaattcgaacccgccc

SEQ ID NO: 269147 - DNA, 25 bp, Mus musculus
ggccgcgcagtcagcagtaattcga

SEQ ID NO: 269148 - DNA, 25 bp, Mus musculus
caattggaaaaacaagcgtgcaccc

SEQ ID NO: 269149 - DNA, 25 bp, Mus musculus
cgggtatgcaaatagagggactgtc

SEQ ID NO: 269150 - DNA, 25 bp, Mus musculus
gggcattttgcgagccgtggtttta

SEQ ID NO: 269151 - DNA, 25 bp, Mus musculus
gacgagaggtctcgctcactcactc

SEQ ID NO: 269152 - DNA, 25 bp, Mus musculus
ctcactctatggcaggcagcaggta

SEQ ID NO: 269153 - DNA, 25 bp, Mus musculus
gtgcttgcggagctcctcgaagtac

SEQ ID NO: 269154 - DNA, 25 bp, Mus musculus
tcccgggacgaacagaagtgcgctt

SEQ ID NO: 269155 - DNA, 25 bp, Mus musculus
gctgatgctgatacggccatgtttg

SEQ ID NO: 269156 - DNA, 25 bp, Mus musculus
gtcggcacgagctttaggttagcta

SEQ ID NO: 269157 - DNA, 25 bp, Mus musculus
ggttttatctctaccctggggcata

SEQ ID NO: 269158 - DNA, 25 bp, Mus musculus
ggggcataccaacaacacgaaactc

SEQ ID NO: 269159 - DNA, 25 bp, Mus musculus
cgaaactctcagaatgggcacaacg

SEQ ID NO: 269160 - DNA, 25 bp, Mus musculus
gggcctcttgaaatcgagcaaactt

SEQ ID NO: 269161 - DNA, 25 bp, Mus musculus
gttgctaggcaacgcgtacccatcc

SEQ ID NO: 269162 - DNA, 25 bp, Mus musculus
cggtcaccatcttggagtcgaaatc

SEQ ID NO: 269163 - DNA, 25 bp, Mus musculus
ggacgtctggcagcttctgctgatg

SEQ ID NO: 269164 - DNA, 25 bp, Mus musculus
tgctcctagatccacaccgagagtc

SEQ ID NO: 269165 - DNA, 25 bp, Mus musculus
ctcccgtcaacaggtgggggcattc

SEQ ID NO: 269166 - DNA, 25 bp, Mus musculus
cctgttttgtcggagtagcagcggc

SEQ ID NO: 269167 - DNA, 25 bp, Mus musculus
gctgtgcctcgcagcctctagcggg

SEQ ID NO: 269168 - DNA, 25 bp, Mus musculus
atctgctgtgcctcgcagcctctag

SEQ ID NO: 269169 - DNA, 25 bp, Mus musculus
aagcccggtgcatctgctgtgcctc

SEQ ID NO: 269170 - DNA, 25 bp, Mus musculus
agatccacaccgagagtctccaggg

SEQ ID NO: 269171 - DNA, 25 bp, Mus musculus
tttcactacccgcatgctcctagat

SEQ ID NO: 269172 - DNA, 25 bp, Mus musculus
ggctccaaacggcaggccgacttgc

SEQ ID NO: 269173 - DNA, 25 bp, Mus musculus
acggcaggccgacttgctttcacta

SEQ ID NO: 269174 - DNA, 25 bp, Mus musculus
ggcaggccgacttgctttcactacc

SEQ ID NO: 269175 - DNA, 25 bp, Mus musculus
gacttgctttcactacccgcatgct

SEQ ID NO: 269176 - DNA, 25 bp, Mus musculus
gcatgctcctagatccacaccgaga

SEQ ID NO: 269177 - DNA, 25 bp, Mus musculus
ccgggaagcccggtgcatctgctgt

SEQ ID NO: 269178 - DNA, 25 bp, Mus musculus
taccgggctatttccgttcggagca

SEQ ID NO: 269179 - DNA, 25 bp, Mus musculus
ccacgcatgccatcgcctttggata

SEQ ID NO: 269180 - DNA, 25 bp, Mus musculus
cctttggatacagccggcatgatgg

SEQ ID NO: 269181 - DNA, 25 bp, Mus musculus
tgtcatccgggaacgtacgccactt

SEQ ID NO: 269182 - DNA, 25 bp, Mus musculus
tacgccacttgttagctgagagccc

SEQ ID NO: 269183 - DNA, 25 bp, Mus musculus
gccctgtcagttagctgaactgcga

SEQ ID NO: 269184 - DNA, 25 bp, Mus musculus
agcgtcatacttccgccctcgaagg

SEQ ID NO: 269185 - DNA, 25 bp, Mus musculus
gccgattcgccggaagcgtcatact

SEQ ID NO: 269186 - DNA, 25 bp, Mus musculus
tcttcgcaaggctctgccgattcgc

SEQ ID NO: 269187 - DNA, 25 bp, Mus musculus
ccaatgggtgaggagattgctcttc

SEQ ID NO: 269188 - DNA, 25 bp, Mus musculus
cgctaattggatggactaccagctc

SEQ ID NO: 269189 - DNA, 25 bp, Mus musculus
gaacggccgagaccaacgctaattg

SEQ ID NO: 269190 - DNA, 25 bp, Mus musculus
gctgagagccctgccgctcacaata

SEQ ID NO: 269191 - DNA, 25 bp, Mus musculus
ttcgatgacacactctgggaccgcc

SEQ ID NO: 269192 - DNA, 25 bp, Mus musculus
tggtgcgtgcaacctcaggaagtca

SEQ ID NO: 269193 - DNA, 25 bp, Mus musculus
cgcgcgttggaagctgaagagcctc

SEQ ID NO: 269194 - DNA, 25 bp, Mus musculus
ctcctgcgccgagggcactggctgt

SEQ ID NO: 269195 - DNA, 25 bp, Mus musculus
ttgcgcacggtctcctgcgccgagg

SEQ ID NO: 269196 - DNA, 25 bp, Mus musculus
actacaggcagacgaggaccggagc

SEQ ID NO: 269197 - DNA, 25 bp, Mus musculus
ctctaggtactacaggcagacgagg

SEQ ID NO: 269198 - DNA, 25 bp, Mus musculus
gggcgtacagactctaggtactaca

SEQ ID NO: 269199 - DNA, 25 bp, Mus musculus
gcacagggcgtacagactctaggta

SEQ ID NO: 269200 - DNA, 25 bp, Mus musculus
tctccgagcacagggcgtacagact

SEQ ID NO: 269201 - DNA, 25 bp, Mus musculus
gtcgaaagcgtcgtctccgagcaca

SEQ ID NO: 269202 - DNA, 25 bp, Mus musculus
tagcgcggtcgaaagcgtcgtctcc

SEQ ID NO: 269203 - DNA, 25 bp, Mus musculus
tgccagcgctgtagcgcggtcgaaa

SEQ ID NO: 269204 - DNA, 25 bp, Mus musculus
caggaagtcatttgccagcgctgta

SEQ ID NO: 269205 - DNA, 25 bp, Mus musculus
aagctgaagagcctcgggtgcctcc

SEQ ID NO: 269206 - DNA, 25 bp, Mus musculus
agacagcaacctgctcgggcgtgcc

SEQ ID NO: 269207 - DNA, 25 bp, Mus musculus
tccacctggcggtctggggacacat

SEQ ID NO: 269208 - DNA, 25 bp, Mus musculus
gaagggcgaagtccgaccatggatc

SEQ ID NO: 269209 - DNA, 25 bp, Mus musculus
cgaccatggatcagcggagagtatc

SEQ ID NO: 269210 - DNA, 25 bp, Mus musculus
tatccgcccgtgatgacgtgaactg

SEQ ID NO: 269211 - DNA, 25 bp, Mus musculus
tgacgtgaactgcaagctatctcgc

SEQ ID NO: 269212 - DNA, 25 bp, Mus musculus
caaggccgtcactctggacctgaga

SEQ ID NO: 269213 - DNA, 25 bp, Mus musculus
agctatctcgcttgcaagttccgta

SEQ ID NO: 269214 - DNA, 25 bp, Mus musculus
cgttatcagcgcagagacagcaacc

SEQ ID NO: 269215 - DNA, 25 bp, Mus musculus
agcatctgggtactggctgaccgct

SEQ ID NO: 269216 - DNA, 25 bp, Mus musculus
ctgagacgtcggctgctcaggtacc

SEQ ID NO: 269217 - DNA, 25 bp, Mus musculus
tgggctccgaaagcgcgtatagcgc

SEQ ID NO: 269218 - DNA, 25 bp, Mus musculus
ctcagcctactagaagcggccgtga

SEQ ID NO: 269219 - DNA, 25 bp, Mus musculus
cgcttgcaagttccgtaaacgcccg

SEQ ID NO: 269220 - DNA, 25 bp, Mus musculus
ggccaaagcagatgacaccagtttt

SEQ ID NO: 269221 - DNA, 25 bp, Mus musculus
agttacaaagaacctccagcacgca

SEQ ID NO: 269222 - DNA, 25 bp, Mus musculus
atccgcactcgaagcctggatcaga

SEQ ID NO: 269223 - DNA, 25 bp, Mus musculus
cctggatcagatcacacgagctgtc

SEQ ID NO: 269224 - DNA, 25 bp, Mus musculus
cacacgagctgtcgcaaacctcaga

SEQ ID NO: 269225 - DNA, 25 bp, Mus musculus
agctgtcgcaaacctcagatccgtc

SEQ ID NO: 269226 - DNA, 25 bp, Mus musculus
cctcagatccgtctctgtgacgggg

SEQ ID NO: 269227 - DNA, 25 bp, Mus musculus
tgccggctttcctgccatggccaaa

SEQ ID NO: 269228 - DNA, 25 bp, Mus musculus
tgccatggccaaagcagatgacacc

SEQ ID NO: 269229 - DNA, 25 bp, Mus musculus
tgacaccagttttctgtgagccata

SEQ ID NO: 269230 - DNA, 25 bp, Mus musculus
tttctgtgagccatactgacgggtc

SEQ ID NO: 269231 - DNA, 25 bp, Mus musculus
tgacgggtccaggaagttacaaaga

SEQ ID NO: 269232 - DNA, 25 bp, Mus musculus
acctccagcacgcaaagccaaaagt

SEQ ID NO: 269233 - DNA, 25 bp, Mus musculus
ccatactgacgggtccaggaagtta

SEQ ID NO: 269234 - DNA, 25 bp, Mus musculus
ttggtctgtaaagccgtccatctga

SEQ ID NO: 269235 - DNA, 25 bp, Mus musculus
ccctcgttgatattggctgagccaa

SEQ ID NO: 269236 - DNA, 25 bp, Mus musculus
ccgcgctaagcggacgtctagaaac

SEQ ID NO: 269237 - DNA, 25 bp, Mus musculus
cacgtgtgacgattgggtaaaattc

SEQ ID NO: 269238 - DNA, 25 bp, Mus musculus
ctgtctgtctcacccagcacgtgtg

SEQ ID NO: 269239 - DNA, 25 bp, Mus musculus
tgtccgctaggaagagaacaactgc

SEQ ID NO: 269240 - DNA, 25 bp, Mus musculus
ttcaattggatgacagacacgccta

SEQ ID NO: 269241 - DNA, 25 bp, Mus musculus
cgccataagttctcattggtctgta

SEQ ID NO: 269242 - DNA, 25 bp, Mus musculus
cgccttttaccagagggtcctcagc

SEQ ID NO: 269243 - DNA, 25 bp, Mus musculus
acctccatgatgcagttcgcggcct

SEQ ID NO: 269244 - DNA, 25 bp, Mus musculus
aaagccgagatctctcccgtcacga

SEQ ID NO: 269245 - DNA, 25 bp, Mus musculus
tgcgggtcccaaagcaccgaaagcc

SEQ ID NO: 269246 - DNA, 25 bp, Mus musculus
acgctactctgcgagaccacgtgcg

SEQ ID NO: 269247 - DNA, 25 bp, Mus musculus
caaaggtgacgttcgcggctctaac

SEQ ID NO: 269248 - DNA, 25 bp, Mus musculus
gactttatttcgtcaatgttgagaa

SEQ ID NO: 269249 - DNA, 25 bp, Mus musculus
gtcgcactggcgtacacgctttctc

SEQ ID NO: 269250 - DNA, 25 bp, Mus musculus
gaagttcaactttcccacgcctgcg

SEQ ID NO: 269251 - DNA, 25 bp, Mus musculus
tggagccttcttttgcggtcatttg

SEQ ID NO: 269252 - DNA, 25 bp, Mus musculus
cggtcatttgcatatggcgttccca

SEQ ID NO: 269253 - DNA, 25 bp, Mus musculus
ccagcatgcctgtaggcggaaggcc

SEQ ID NO: 269254 - DNA, 25 bp, Mus musculus
agttaggcctgctaagccgaagtgc

SEQ ID NO: 269255 - DNA, 25 bp, Mus musculus
ctgtcgctcagaagctcggctaccg

SEQ ID NO: 269256 - DNA, 25 bp, Mus musculus
tgcgctccgggatttcttgacttta

SEQ ID NO: 269257 - DNA, 25 bp, Mus musculus
agcgctcggaggcttagctgacaaa

SEQ ID NO: 269258 - DNA, 25 bp, Mus musculus
tctcagaactactgtttgggagccc

SEQ ID NO: 269259 - DNA, 25 bp, Mus musculus
gcaggatcgggcaaacctgtcgctc

SEQ ID NO: 269260 - DNA, 25 bp, Mus musculus
gcgtggctgcgagtctcagaactac

SEQ ID NO: 269261 - DNA, 25 bp, Mus musculus
ctaagccgaagtgcgctccgggatt

SEQ ID NO: 269262 - DNA, 25 bp, Mus musculus
ggagtgtgaaccaagcttgcgctca

SEQ ID NO: 269263 - DNA, 25 bp, Mus musculus
tgggctcctcctcaggctgcacaat

SEQ ID NO: 269264 - DNA, 25 bp, Mus musculus
aggaagtcatcaccctcaggggcac

SEQ ID NO: 269265 - DNA, 25 bp, Mus musculus
ccctcgccatcagagtcagcatgta

SEQ ID NO: 269266 - DNA, 25 bp, Mus musculus
ggctcacctaggtccacttgcagtg

SEQ ID NO: 269267 - DNA, 25 bp, Mus musculus
gcgctcacgtcgctgtgttaggatc

SEQ ID NO: 269268 - DNA, 25 bp, Mus musculus
ccgtctagccttcttccgagcagga

SEQ ID NO: 269269 - DNA, 25 bp, Mus musculus
cggtgcttcttagcttcccaggagg

SEQ ID NO: 269270 - DNA, 25 bp, Mus musculus
gcgctcacgtgaacggtgcttctta

SEQ ID NO: 269271 - DNA, 25 bp, Mus musculus
tcgtgcagcacggaacagtgaaact

SEQ ID NO: 269272 - DNA, 25 bp, Mus musculus
agagtcatacaggacctcccgcttc

SEQ ID NO: 269273 - DNA, 25 bp, Mus musculus
cgacctactgtgatggtccgtttga

SEQ ID NO: 269274 - DNA, 25 bp, Mus musculus
ccgtttgatggcgaacaggtcgtga

SEQ ID NO: 269275 - DNA, 25 bp, Mus musculus
ggagcgtgagcgcttcttcttcttc

SEQ ID NO: 269276 - DNA, 25 bp, Mus musculus
gaagtgatgtaaaaaaggcgctccg

SEQ ID NO: 269277 - DNA, 25 bp, Mus musculus
tcggagacgactagcgacccgactc

SEQ ID NO: 269278 - DNA, 25 bp, Mus musculus
cggaaccaaattgccgcggcgcttg

SEQ ID NO: 269279 - DNA, 25 bp, Mus musculus
cgcttgccgggatttcaagtaccca

SEQ ID NO: 269280 - DNA, 25 bp, Mus musculus
ctgggtttccgaaaggccggcagca

SEQ ID NO: 269281 - DNA, 25 bp, Mus musculus
ttcccagaaatcaatgcgtcacatg

SEQ ID NO: 269282 - DNA, 25 bp, Mus musculus
atacgggcgacactcggagacgact

SEQ ID NO: 269283 - DNA, 25 bp, Mus musculus
tgtagtccgtgtgaagactccgtca

SEQ ID NO: 269284 - DNA, 25 bp, Mus musculus
aaggtgccacgctacgctctccagg

SEQ ID NO: 269285 - DNA, 25 bp, Mus musculus
tactcagagactgccttggccgctg

SEQ ID NO: 269286 - DNA, 25 bp, Mus musculus
ggtcgcacataaaaaccatctacgg

SEQ ID NO: 269287 - DNA, 25 bp, Mus musculus
catctacggcgcctgcagacgtgtc

SEQ ID NO: 269288 - DNA, 25 bp, Mus musculus
cagacgtgtccaggctcagcaatgg

SEQ ID NO: 269289 - DNA, 25 bp, Mus musculus
gtccaggccatacgaaagccctctg

SEQ ID NO: 269290 - DNA, 25 bp, Mus musculus
tggggaaatacacgaagtcaggcgt

SEQ ID NO: 269291 - DNA, 25 bp, Mus musculus
agccatctttgcacaaggcggcagg

SEQ ID NO: 269292 - DNA, 25 bp, Mus musculus
cccacaatcccgtgcaaatgtaaaa

SEQ ID NO: 269293 - DNA, 25 bp, Mus musculus
gcacagcgcctgtacacagagattc

SEQ ID NO: 269294 - DNA, 25 bp, Mus musculus
cagagattcagttccaccgcgcgca

SEQ ID NO: 269295 - DNA, 25 bp, Mus musculus
ccgcgcgcaaatgcgcccagaaagg

SEQ ID NO: 269296 - DNA, 25 bp, Mus musculus
gggtttttaagcagagggcagctca

SEQ ID NO: 269297 - DNA, 25 bp, Mus musculus
ccgagtcacgtctgatccgagtttc

SEQ ID NO: 269298 - DNA, 25 bp, Mus musculus
caccagtggagtgacagccgagtca

SEQ ID NO: 269299 - DNA, 25 bp, Mus musculus
tttacccgggtgcaacacaagcgtg

SEQ ID NO: 269300 - DNA, 25 bp, Mus musculus
caagggcctggttccctgcgcgtac

SEQ ID NO: 269301 - DNA, 25 bp, Mus musculus
gcccatgtgcccgactggggaaata

SEQ ID NO: 269302 - DNA, 25 bp, Mus musculus
tactggattacaaaccgcccatgtg

SEQ ID NO: 269303 - DNA, 25 bp, Mus musculus
gggcagctcagatcaactccattta

SEQ ID NO: 269304 - DNA, 25 bp, Mus musculus
gctcaccggaaccttcgagtagtca

SEQ ID NO: 269305 - DNA, 25 bp, Mus musculus
cgagtagtcactcacgtttccgggg

SEQ ID NO: 269306 - DNA, 25 bp, Mus musculus
gagaagaagaaagcacttaccaagc

SEQ ID NO: 269307 - DNA, 25 bp, Mus musculus
aagcacttaccaagccaggcgaagc

SEQ ID NO: 269308 - DNA, 25 bp, Mus musculus
caggcgaagcgcctccgcgactagg

SEQ ID NO: 269309 - DNA, 25 bp, Mus musculus
gcctccgcgactaggggcagaatta

SEQ ID NO: 269310 - DNA, 25 bp, Mus musculus
cgcgactaggggcagaattatttcc

SEQ ID NO: 269311 - DNA, 25 bp, Mus musculus
gggcagaattatttccggtctcctc

SEQ ID NO: 269312 - DNA, 25 bp, Mus musculus
tatttccggtctcctcctgtcgggc

SEQ ID NO: 269313 - DNA, 25 bp, Mus musculus
gtctcctcctgtcgggcggaagtag

SEQ ID NO: 269314 - DNA, 25 bp, Mus musculus
gttcgggacgtagttgaagcaacga

SEQ ID NO: 269315 - DNA, 25 bp, Mus musculus
tgaagcaacgacaagccggataacc

SEQ ID NO: 269316 - DNA, 25 bp, Mus musculus
accgctcttgaggtaagctgcaggc

SEQ ID NO: 269317 - DNA, 25 bp, Mus musculus
ccggataaccgctcttgaggtaagc

SEQ ID NO: 269318 - DNA, 25 bp, Mus musculus
tttgcgcagtgacccgagacagtct

SEQ ID NO: 269319 - DNA, 25 bp, Mus musculus
cgatgtccgggaagccactgcgcat

SEQ ID NO: 269320 - DNA, 25 bp, Mus musculus
aagccactgcgcatgtcggacctga

SEQ ID NO: 269321 - DNA, 25 bp, Mus musculus
tcggacctgacgtcagtgcgcttca

SEQ ID NO: 269322 - DNA, 25 bp, Mus musculus
cgtcagtgcgcttcacgcagctgga

SEQ ID NO: 269323 - DNA, 25 bp, Mus musculus
cttcacgcagctggacgactctgtg

SEQ ID NO: 269324 - DNA, 25 bp, Mus musculus
agctggacgactctgtggaccgcgt

SEQ ID NO: 269325 - DNA, 25 bp, Mus musculus
tggaccgcgtgggactcatcacacg

SEQ ID NO: 269326 - DNA, 25 bp, Mus musculus
tgagcgctacgtttgcgcagtgacc

SEQ ID NO: 269327 - DNA, 25 bp, Mus musculus
cgagacagtctgagcaatgccacgc

SEQ ID NO: 269328 - DNA, 25 bp, Mus musculus
tctgagcaatgccacgccgtgcgca

SEQ ID NO: 269329 - DNA, 25 bp, Mus musculus
gaggctcgagggtccgagattccac

SEQ ID NO: 269330 - DNA, 25 bp, Mus musculus
gcacggtgacctgcccgatgtccgg

SEQ ID NO: 269331 - DNA, 25 bp, Mus musculus
tcacacgcagtgagcgctacgtttg

SEQ ID NO: 269332 - DNA, 25 bp, Mus musculus
cgggcctcagtctccatcaagggga

SEQ ID NO: 269333 - DNA, 25 bp, Mus musculus
agctgcgctcacactgaaaactaca

SEQ ID NO: 269334 - DNA, 25 bp, Mus musculus
agcagccagcgtcgaccgaatagtc

SEQ ID NO: 269335 - DNA, 25 bp, Mus musculus
ccatacgatgtcaggagcagccagc

SEQ ID NO: 269336 - DNA, 25 bp, Mus musculus
aacacgtgctgggattcagtttcca

SEQ ID NO: 269337 - DNA, 25 bp, Mus musculus
cgcgagatttcaggagcacgatgtg

SEQ ID NO: 269338 - DNA, 25 bp, Mus musculus
aggggcgggaagatcctatcatctc

SEQ ID NO: 269339 - DNA, 25 bp, Mus musculus
ttccttattcaccacgcgaggtcgg

SEQ ID NO: 269340 - DNA, 25 bp, Mus musculus
aacgctcgaacctgaatgtccgcca

SEQ ID NO: 269341 - DNA, 25 bp, Mus musculus
aggacgccaagggatacgctccaca

SEQ ID NO: 269342 - DNA, 25 bp, Mus musculus
ccgagccgcctgagacgaaggcatt

SEQ ID NO: 269343 - DNA, 25 bp, Mus musculus
tcctcgcttcagctaatgcgtaaga

SEQ ID NO: 269344 - DNA, 25 bp, Mus musculus
cattactgcgtagagcccggatttc

SEQ ID NO: 269345 - DNA, 25 bp, Mus musculus
cgtcaccaaggtcgcatgtcctttg

SEQ ID NO: 269346 - DNA, 25 bp, Mus musculus
ggatcgctcttctccgttccggtgt

SEQ ID NO: 269347 - DNA, 25 bp, Mus musculus
cctcgcgtgagacgtttgctaagtc

SEQ ID NO: 269348 - DNA, 25 bp, Mus musculus
ttgctaagtcccatcgcacaagcgg

SEQ ID NO: 269349 - DNA, 25 bp, Mus musculus
aggtcttgtcgcagggtttcttatc

SEQ ID NO: 269350 - DNA, 25 bp, Mus musculus
cagacggctcgaaccgaagagtttc

SEQ ID NO: 269351 - DNA, 25 bp, Mus musculus
gccgccatatttgaagggatcgctc

SEQ ID NO: 269352 - DNA, 25 bp, Mus musculus
cgcggcttgttacgcccgttacaca

SEQ ID NO: 269353 - DNA, 25 bp, Mus musculus
gtgcagcgccattactcccatcaag

SEQ ID NO: 269354 - DNA, 25 bp, Mus musculus
cccatcaagtgatggcggctgcaga

SEQ ID NO: 269355 - DNA, 25 bp, Mus musculus
gcggctgcagaacatgtggtgtcca

SEQ ID NO: 269356 - DNA, 25 bp, Mus musculus
gcatagtccctgtcggcccttcaga

SEQ ID NO: 269357 - DNA, 25 bp, Mus musculus
gaccatcgctggctgtcctgaacct

SEQ ID NO: 269358 - DNA, 25 bp, Mus musculus
ccaaaggcctttgtttccgtgactg

SEQ ID NO: 269359 - DNA, 25 bp, Mus musculus
gagtttccgtcttctaattggtcga

SEQ ID NO: 269360 - DNA, 25 bp, Mus musculus
tcaccattgtcctagcatcttattg

SEQ ID NO: 269361 - DNA, 25 bp, Mus musculus
accgcctgacaatgccaactcgtgg

SEQ ID NO: 269362 - DNA, 25 bp, Mus musculus
ctcgttcttgctggcgttgatctgg

SEQ ID NO: 269363 - DNA, 25 bp, Mus musculus
gggctcgtccgcagccactgactat

SEQ ID NO: 269364 - DNA, 25 bp, Mus musculus
cgccgccgtacactgccgataaaga

SEQ ID NO: 269365 - DNA, 25 bp, Mus musculus
gagcggcccagatcggcctcacagt

SEQ ID NO: 269366 - DNA, 25 bp, Mus musculus
atcttattggctgcttctgcgcgcg

SEQ ID NO: 269367 - DNA, 25 bp, Mus musculus
cctcattttagaacgcgcgcgagtc

SEQ ID NO: 269368 - DNA, 25 bp, Mus musculus
aacggatactctcattgggcaaagc

SEQ ID NO: 269369 - DNA, 25 bp, Mus musculus
ggcgggctttgtcctcattttagaa

SEQ ID NO: 269370 - DNA, 25 bp, Mus musculus
gggcaccacctcgtaacaacggata

SEQ ID NO: 269371 - DNA, 25 bp, Mus musculus
ctttataatgccgaagccgggcacc

SEQ ID NO: 269372 - DNA, 25 bp, Mus musculus
ccaactcgtggagctctttataatg

SEQ ID NO: 269373 - DNA, 25 bp, Mus musculus
gaggcccgaagtagcccaagcaccg

SEQ ID NO: 269374 - DNA, 25 bp, Mus musculus
gcctactttagagccgcgcgatgcg

SEQ ID NO: 269375 - DNA, 25 bp, Mus musculus
gggccacaaggaaccacgatctagc

SEQ ID NO: 269376 - DNA, 25 bp, Mus musculus
ggatttagtgaccacccgttcctga

SEQ ID NO: 269377 - DNA, 25 bp, Mus musculus
acgaaaaccgcgaggacaaccatcg

SEQ ID NO: 269378 - DNA, 25 bp, Mus musculus
cccaggcttccgcactgtaggggaa

SEQ ID NO: 269379 - DNA, 25 bp, Mus musculus
cactgtaggggaaatcacgcgctca

SEQ ID NO: 269380 - DNA, 25 bp, Mus musculus
aagccctcaccagtgcgcatgcgtg

SEQ ID NO: 269381 - DNA, 25 bp, Mus musculus
cggtccgtactccagcgtcgtgaaa

SEQ ID NO: 269382 - DNA, 25 bp, Mus musculus
cagcgtcgtgaaaatctcccgggta

SEQ ID NO: 269383 - DNA, 25 bp, Mus musculus
aatctcccgggtactgggctgtaca

SEQ ID NO: 269384 - DNA, 25 bp, Mus musculus
ggctgtacacgcgtagccgccatcg

SEQ ID NO: 269385 - DNA, 25 bp, Mus musculus
ctggacggtctacctagaggaactt

SEQ ID NO: 269386 - DNA, 25 bp, Mus musculus
cgagctatataggacgtgacccgcc

SEQ ID NO: 269387 - DNA, 25 bp, Mus musculus
ccacgatctagcaaggtgaagactc

SEQ ID NO: 269388 - DNA, 25 bp, Mus musculus
tcgatccgtacacctctggacaaag

SEQ ID NO: 269389 - DNA, 25 bp, Mus musculus
cgatgaatattacgcccttagaacc

SEQ ID NO: 269390 - DNA, 25 bp, Mus musculus
tacgcccttagaaccgctcctttga

SEQ ID NO: 269391 - DNA, 25 bp, Mus musculus
tgagattcttcgatccgtacacctc

SEQ ID NO: 269392 - DNA, 25 bp, Mus musculus
gacgagggacctggacaatactgcc

SEQ ID NO: 269393 - DNA, 25 bp, Mus musculus
ctggacaatactgccactgtcagtg

SEQ ID NO: 269394 - DNA, 25 bp, Mus musculus
cacgatctggaaggagggacccaaa

SEQ ID NO: 269395 - DNA, 25 bp, Mus musculus
gagcgccacagagcgcagccggaaa

SEQ ID NO: 269396 - DNA, 25 bp, Mus musculus
gaaccgctcctttgagattcttcga

SEQ ID NO: 269397 - DNA, 25 bp, Mus musculus
accgctaaaatgagcgccacagagc

SEQ ID NO: 269398 - DNA, 25 bp, Mus musculus
cctctggacaaaggggtcttgcaca

SEQ ID NO: 269399 - DNA, 25 bp, Mus musculus
aaggggtcttgcacacgatctggaa

SEQ ID NO: 269400 - DNA, 25 bp, Mus musculus
gccggggctgcgatgaatattacgc

SEQ ID NO: 269401 - DNA, 25 bp, Mus musculus
aatactgccactgtcagtgccgggg

SEQ ID NO: 269402 - DNA, 25 bp, Mus musculus
cccgcccgccactcgatcggcttcg

SEQ ID NO: 269403 - DNA, 25 bp, Mus musculus
acggcccgggatttggcagccgcag

SEQ ID NO: 269404 - DNA, 25 bp, Mus musculus
tctgcgcggctcagcctgctgccct

SEQ ID NO: 269405 - DNA, 25 bp, Mus musculus
cccggggacttgtcaatcagagaca

SEQ ID NO: 269406 - DNA, 25 bp, Mus musculus
ccgggactccatggccaccaggtgg

SEQ ID NO: 269407 - DNA, 25 bp, Mus musculus
acctccgcacgcagtccgggactcc

SEQ ID NO: 269408 - DNA, 25 bp, Mus musculus
tcctccctcacacctggccgcgagc

SEQ ID NO: 269409 - DNA, 25 bp, Mus musculus
gagacagagctgagacccaccatcc

SEQ ID NO: 269410 - DNA, 25 bp, Mus musculus
cgaagattgggtgcgttcttccttt

SEQ ID NO: 269411 - DNA, 25 bp, Mus musculus
tcctttctccgtcgccatggtgatg

SEQ ID NO: 269412 - DNA, 25 bp, Mus musculus
ttgtcaatcagagacagagctgaga

SEQ ID NO: 269413 - DNA, 25 bp, Mus musculus
gttcttcctttctccgtcgccatgg

SEQ ID NO: 269414 - DNA, 25 bp, Mus musculus
attgggtgcgttcttcctttctccg

SEQ ID NO: 269415 - DNA, 25 bp, Mus musculus
ttctccgtcgccatggtgatggtgc

SEQ ID NO: 269416 - DNA, 25 bp, Mus musculus
cagtgacgaaagtgaaatggaggac

SEQ ID NO: 269417 - DNA, 25 bp, Mus musculus
ggggccacacacagcacagtgcagc

SEQ ID NO: 269418 - DNA, 25 bp, Mus musculus
ggagtggcagtacgtgttcctcata

SEQ ID NO: 269419 - DNA, 25 bp, Mus musculus
tacgtgttcctcatagcctccctgg

SEQ ID NO: 269420 - DNA, 25 bp, Mus musculus
tgcactacggcggtgtcatcttcta

SEQ ID NO: 269421 - DNA, 25 bp, Mus musculus
cggtgtcatcttctatggggtcttt

SEQ ID NO: 269422 - DNA, 25 bp, Mus musculus
atcttctatggggtctttgcttcgg

SEQ ID NO: 269423 - DNA, 25 bp, Mus musculus
tctttgcttcgggagagaagcagcc

SEQ ID NO: 269424 - DNA, 25 bp, Mus musculus
agtgtggctttgttggccacgacca

SEQ ID NO: 269425 - DNA, 25 bp, Mus musculus
ctttgttggccacgaccagctggct

SEQ ID NO: 269426 - DNA, 25 bp, Mus musculus
gaccagctggctggcagtgacgaaa

SEQ ID NO: 269427 - DNA, 25 bp, Mus musculus
ctggctggcagtgacgaaagtgaaa

SEQ ID NO: 269428 - DNA, 25 bp, Mus musculus
ctacggggccacacacagcacagtg

SEQ ID NO: 269429 - DNA, 25 bp, Mus musculus
tcatagcctccctggtgcactacgg

SEQ ID NO: 269430 - DNA, 25 bp, Mus musculus
ctctaaggcattgaagctgggccgg

SEQ ID NO: 269431 - DNA, 25 bp, Mus musculus
ctgaggcacagattccaatggtggg

SEQ ID NO: 269432 - DNA, 25 bp, Mus musculus
cacagattccaatggtgggcgaggt

SEQ ID NO: 269433 - DNA, 25 bp, Mus musculus
tctggggtccctctaaggcattgaa

SEQ ID NO: 269434 - DNA, 25 bp, Mus musculus
tgcggcgcggtcctcagaagaagtt

SEQ ID NO: 269435 - DNA, 25 bp, Mus musculus
gcacccacgcatcgggggcgtagaa

SEQ ID NO: 269436 - DNA, 25 bp, Mus musculus
cgtagaagtagagatccagcgggtc

SEQ ID NO: 269437 - DNA, 25 bp, Mus musculus
agatccagcgggtccttcggggcat

SEQ ID NO: 269438 - DNA, 25 bp, Mus musculus
cttcggggcatcgaggtgcaagact

SEQ ID NO: 269439 - DNA, 25 bp, Mus musculus
tgcaagactgcaaggacgagggact

SEQ ID NO: 269440 - DNA, 25 bp, Mus musculus
gactgcaaggacgagggactcgtca

SEQ ID NO: 269441 - DNA, 25 bp, Mus musculus
ccatgggagggcttgcaatgtccgt

SEQ ID NO: 269442 - DNA, 25 bp, Mus musculus
cttgcaatgtccgtgcgtgcaggcg

SEQ ID NO: 269443 - DNA, 25 bp, Mus musculus
tttattgggaagttctgcctggctc

SEQ ID NO: 269444 - DNA, 25 bp, Mus musculus
gggcctagcgcgcaatcacatctct

SEQ ID NO: 269445 - DNA, 25 bp, Mus musculus
cgctggctggactcttacatgcaga

SEQ ID NO: 269446 - DNA, 25 bp, Mus musculus
agaagctgttgctactggacgcgcc

SEQ ID NO: 269447 - DNA, 25 bp, Mus musculus
ggacgcgccctgagcctaataaaga

SEQ ID NO: 269448 - DNA, 25 bp, Mus musculus
ctaataaagagcctgtcgcactgcg

SEQ ID NO: 269449 - DNA, 25 bp, Mus musculus
tgggtcatctgcctcgagactcttg

SEQ ID NO: 269450 - DNA, 25 bp, Mus musculus
gggtccctgatccagctctgttttg

SEQ ID NO: 269451 - DNA, 25 bp, Mus musculus
aggcgcacacagaaatccgggtttc

SEQ ID NO: 269452 - DNA, 25 bp, Mus musculus
cccacctgtttattcggagagcccg

SEQ ID NO: 269453 - DNA, 25 bp, Mus musculus
cggaccgagccctcattggctttta

SEQ ID NO: 269454 - DNA, 25 bp, Mus musculus
gagaccgccctccaaaatttgcatt

SEQ ID NO: 269455 - DNA, 25 bp, Mus musculus
aatttgcattttctggaggcggacc

SEQ ID NO: 269456 - DNA, 25 bp, Mus musculus
cggtctaccgcgcagaagcagaagc

SEQ ID NO: 269457 - DNA, 25 bp, Mus musculus
ctgctgggtcgggatttcataacct

SEQ ID NO: 269458 - DNA, 25 bp, Mus musculus
gcgtacctggagtcgggactcagtt

SEQ ID NO: 269459 - DNA, 25 bp, Mus musculus
gacgaacggcggttgcgaatgtcac

SEQ ID NO: 269460 - DNA, 25 bp, Mus musculus
cgaatgtcacggaagaggcgtgttc

SEQ ID NO: 269461 - DNA, 25 bp, Mus musculus
aggcgtgttcacacgcgccttttcc

SEQ ID NO: 269462 - DNA, 25 bp, Mus musculus
ttcccgccagaaatgcaaatgagcc

SEQ ID NO: 269463 - DNA, 25 bp, Mus musculus
tctcaggctcttgtactcacgcaag

SEQ ID NO: 269464 - DNA, 25 bp, Mus musculus
ctcacgcaagcgcactccgagtgga

SEQ ID NO: 269465 - DNA, 25 bp, Mus musculus
gcgcccgggtctctccttacgaaga

SEQ ID NO: 269466 - DNA, 25 bp, Mus musculus
cttacgaagacccttgagctggcgc

SEQ ID NO: 269467 - DNA, 25 bp, Mus musculus
atgcgtagagcttctcgggaggata

SEQ ID NO: 269468 - DNA, 25 bp, Mus musculus
actcagttgagggacaccagcgacg

SEQ ID NO: 269469 - DNA, 25 bp, Mus musculus
cgatattatcggcagctttcttctg

SEQ ID NO: 269470 - DNA, 25 bp, Mus musculus
gctagcggtgatggcgcgatattat

SEQ ID NO: 269471 - DNA, 25 bp, Mus musculus
acctgaggatcgagtgcatgcgcac

SEQ ID NO: 269472 - DNA, 25 bp, Mus musculus
gcgaccacgggtcttctgttagttc

SEQ ID NO: 269473 - DNA, 25 bp, Mus musculus
ggagctggaactttctccggagtta

SEQ ID NO: 269474 - DNA, 25 bp, Mus musculus
agcgaaggagcgaccacgggtcttc

SEQ ID NO: 269475 - DNA, 25 bp, Mus musculus
agtgtggagctggaactttctccgg

SEQ ID NO: 269476 - DNA, 25 bp, Mus musculus
gaccacgggtcttctgttagttcga

SEQ ID NO: 269477 - DNA, 25 bp, Mus musculus
ttctgttagttcgacccctgggcca

SEQ ID NO: 269478 - DNA, 25 bp, Mus musculus
cctgggccatccttcgtgcaagtat

SEQ ID NO: 269479 - DNA, 25 bp, Mus musculus
gggccatccttcgtgcaagtatccg

SEQ ID NO: 269480 - DNA, 25 bp, Mus musculus
agctggaactttctccggagttagg

SEQ ID NO: 269481 - DNA, 25 bp, Mus musculus
aatcgggatcctgcttggggtttgt

SEQ ID NO: 269482 - DNA, 25 bp, Mus musculus
aagttccgcgcgatgaggtgaggcg

SEQ ID NO: 269483 - DNA, 25 bp, Mus musculus
cgtgttcctgagatcgcgtgggaac

SEQ ID NO: 269484 - DNA, 25 bp, Mus musculus
tcctgagatcgcgtgggaactgccc

SEQ ID NO: 269485 - DNA, 25 bp, Mus musculus
cgcgtgggaactgcccggagccctt

SEQ ID NO: 269486 - DNA, 25 bp, Mus musculus
gggttcgaaccctcggctcctgaca

SEQ ID NO: 269487 - DNA, 25 bp, Mus musculus
ataacgcctccgctaagtatgcgcg

SEQ ID NO: 269488 - DNA, 25 bp, Mus musculus
tgcttgataaataacgcctccgcta

SEQ ID NO: 269489 - DNA, 25 bp, Mus musculus
cccatgctattgcttgataaataac

SEQ ID NO: 269490 - DNA, 25 bp, Mus musculus
gtttagagaagccaggcctccgccc

SEQ ID NO: 269491 - DNA, 25 bp, Mus musculus
tcagagtttagagaagccaggcctc

SEQ ID NO: 269492 - DNA, 25 bp, Mus musculus
tgcgagtacagccattcagagttta

SEQ ID NO: 269493 - DNA, 25 bp, Mus musculus
ggcagcactgcgagtacagccattc

SEQ ID NO: 269494 - DNA, 25 bp, Mus musculus
ctcggcgctgtagctgcagacacag

SEQ ID NO: 269495 - DNA, 25 bp, Mus musculus
gcccgctgctgccttcagagttcag

SEQ ID NO: 269496 - DNA, 25 bp, Mus musculus
tgacagcggcagcacgtgctctcta

SEQ ID NO: 269497 - DNA, 25 bp, Mus musculus
gccttcagagttcagccctggggta

SEQ ID NO: 269498 - DNA, 25 bp, Mus musculus
tccgctaagtatgcgcgttacctcg

SEQ ID NO: 269499 - DNA, 25 bp, Mus musculus
gcacgtgctctctagcgagagctcg

SEQ ID NO: 269500 - DNA, 25 bp, Mus musculus
tcgctaagcttccatgccgaggcct

SEQ ID NO: 269501 - DNA, 25 bp, Mus musculus
ctgctctattgggaaggcgcctaag

SEQ ID NO: 269502 - DNA, 25 bp, Mus musculus
cagtcagaagctgcgagcacgtgta

SEQ ID NO: 269503 - DNA, 25 bp, Mus musculus
cagcaaactccttcgcgtgggtaga

SEQ ID NO: 269504 - DNA, 25 bp, Mus musculus
acgggagcaatagcgcagagacaca

SEQ ID NO: 269505 - DNA, 25 bp, Mus musculus
acacagaaagggcagggaaggcctc

SEQ ID NO: 269506 - DNA, 25 bp, Mus musculus
cgcaactcttgacggctgctctatt

SEQ ID NO: 269507 - DNA, 25 bp, Mus musculus
ggttcacgatgtgggaactgccttc

SEQ ID NO: 269508 - DNA, 25 bp, Mus musculus
gagagtcaacctcccgcaactcttg

SEQ ID NO: 269509 - DNA, 25 bp, Mus musculus
ccagacagccgctggagagttcagc

SEQ ID NO: 269510 - DNA, 25 bp, Mus musculus
gctctccacaggacgccaggaagga

SEQ ID NO: 269511 - DNA, 25 bp, Mus musculus
tcgcgaggtcaaggtcaccgtgccc

SEQ ID NO: 269512 - DNA, 25 bp, Mus musculus
tctccgtcagaacccggaaaactgc

SEQ ID NO: 269513 - DNA, 25 bp, Mus musculus
agcacgtgtatgtgcacgcgcaccg

SEQ ID NO: 269514 - DNA, 25 bp, Mus musculus
ctgcagcgaggagcgcacgtacaaa

SEQ ID NO: 269515 - DNA, 25 bp, Mus musculus
tctctctctttgtagctgtgaagca

SEQ ID NO: 269516 - DNA, 25 bp, Mus musculus
cggctcacgcttctctctctttgta

SEQ ID NO: 269517 - DNA, 25 bp, Mus musculus
cctcgtgagcgaggtgtcggctcac

SEQ ID NO: 269518 - DNA, 25 bp, Mus musculus
ctctacaagtgcatcaagaagggtg

SEQ ID NO: 269519 - DNA, 25 bp, Mus musculus
cgcctgacgcgcaagctctacaagt

SEQ ID NO: 269520 - DNA, 25 bp, Mus musculus
tttgtagctgtgaagcagaagcaga

SEQ ID NO: 269521 - DNA, 25 bp, Mus musculus
cgctcccgaagagtccgaggcgcag

SEQ ID NO: 269522 - DNA, 25 bp, Mus musculus
tgaccaaagtaaaggccgctcccga

SEQ ID NO: 269523 - DNA, 25 bp, Mus musculus
tgtagttgctaagatgaccaaagta

SEQ ID NO: 269524 - DNA, 25 bp, Mus musculus
tctatgccgggacggagttgtagtt

SEQ ID NO: 269525 - DNA, 25 bp, Mus musculus
ccgcgtggttcctctatgccgggac

SEQ ID NO: 269526 - DNA, 25 bp, Mus musculus
cgcacgtacaaagagctgctggtca

SEQ ID NO: 269527 - DNA, 25 bp, Mus musculus
aaagagctgctggtcaatctgaacc

SEQ ID NO: 269528 - DNA, 25 bp, Mus musculus
ccgccgtttccttcctggccgcgcg

SEQ ID NO: 269529 - DNA, 25 bp, Mus musculus
gcgacgacgtgggactctccgccca

SEQ ID NO: 269530 - DNA, 25 bp, Mus musculus
gaggttcacgcgctgaggcgggtac

SEQ ID NO: 269531 - DNA, 25 bp, Mus musculus
gcgggtacggaccactgagtcagtc

SEQ ID NO: 269532 - DNA, 25 bp, Mus musculus
cgggtacggaccactgagtcagtcc

SEQ ID NO: 269533 - DNA, 25 bp, Mus musculus
gtacggaccactgagtcagtcccga

SEQ ID NO: 269534 - DNA, 25 bp, Mus musculus
tacggaccactgagtcagtcccgac

SEQ ID NO: 269535 - DNA, 25 bp, Mus musculus
tgagtcagtcccgaccgctagccct

SEQ ID NO: 269536 - DNA, 25 bp, Mus musculus
cgaccgctagccctgcccacttgga

SEQ ID NO: 269537 - DNA, 25 bp, Mus musculus
acttggaagcccgtccacggcgagg

SEQ ID NO: 269538 - DNA, 25 bp, Mus musculus
ttggaagcccgtccacggcgaggcc

SEQ ID NO: 269539 - DNA, 25 bp, Mus musculus
gcttcccgcgcgggttctcggacca

SEQ ID NO: 269540 - DNA, 25 bp, Mus musculus
gcgaggccgccgtttccttcctggc

SEQ ID NO: 269541 - DNA, 25 bp, Mus musculus
cggggctgtctcgatttaggaagcc

SEQ ID NO: 269542 - DNA, 25 bp, Mus musculus
agcccgcgacgcagaaggtcctgca

SEQ ID NO: 269543 - DNA, 25 bp, Mus musculus
caccaccaagtttggggcacgaaag

SEQ ID NO: 269544 - DNA, 25 bp, Mus musculus
gcggcccaggacagacagttcccaa

SEQ ID NO: 269545 - DNA, 25 bp, Mus musculus
tcacctgtgctctgggcggctctca

SEQ ID NO: 269546 - DNA, 25 bp, Mus musculus
gtcctgcagccaggtctggagcacg

SEQ ID NO: 269547 - DNA, 25 bp, Mus musculus
cagcaccgacaccaccaagtttggg

SEQ ID NO: 269548 - DNA, 25 bp, Mus musculus
caccgacaccaccaagtttggggca

SEQ ID NO: 269549 - DNA, 25 bp, Mus musculus
cacagtggccggatccgtgcggtca

SEQ ID NO: 269550 - DNA, 25 bp, Mus musculus
actgtacacagtggccggatccgtg

SEQ ID NO: 269551 - DNA, 25 bp, Mus musculus
cgagactgtacacagtggccggatc

SEQ ID NO: 269552 - DNA, 25 bp, Mus musculus
gcgggtaacgagactgtacacagtg

SEQ ID NO: 269553 - DNA, 25 bp, Mus musculus
agagcgggtaacgagactgtacaca

SEQ ID NO: 269554 - DNA, 25 bp, Mus musculus
cccaagagcgggtaacgagactgta

SEQ ID NO: 269555 - DNA, 25 bp, Mus musculus
cccgtggtcacctgtgctctgggcg

SEQ ID NO: 269556 - DNA, 25 bp, Mus musculus
ggtctgggtgcgctgtttctacaga

SEQ ID NO: 269557 - DNA, 25 bp, Mus musculus
tctacagactgggaaaggccggccc

SEQ ID NO: 269558 - DNA, 25 bp, Mus musculus
acagaagccagacgctcggtgcagc

SEQ ID NO: 269559 - DNA, 25 bp, Mus musculus
cagctcagccgcagtgcaatcaggg

SEQ ID NO: 269560 - DNA, 25 bp, Mus musculus
taaggcgggaagcttgctgaaacca

SEQ ID NO: 269561 - DNA, 25 bp, Mus musculus
gcgcgtctctttgaaactacaactc

SEQ ID NO: 269562 - DNA, 25 bp, Mus musculus
cgttgtctcggtgcaggacagaagc

SEQ ID NO: 269563 - DNA, 25 bp, Mus musculus
tagcagcgagaagcgcgtctctttg

SEQ ID NO: 269564 - DNA, 25 bp, Mus musculus
tcccaatagtcctcgcggtgtgtcc

SEQ ID NO: 269565 - DNA, 25 bp, Mus musculus
attccggaccgaagggctaccgatg

SEQ ID NO: 269566 - DNA, 25 bp, Mus musculus
accgatgtcgttgtcacggagagcc

SEQ ID NO: 269567 - DNA, 25 bp, Mus musculus
ttgctgaaaccagcgcctggagcga

SEQ ID NO: 269568 - DNA, 25 bp, Mus musculus
tgcaacgggtgccttctcttctctc

SEQ ID NO: 269569 - DNA, 25 bp, Mus musculus
tgtccgcggccaaagtaaggcctta

SEQ ID NO: 269570 - DNA, 25 bp, Mus musculus
gaacccacgcagctcggtctgggaa

SEQ ID NO: 269571 - DNA, 25 bp, Mus musculus
cctgaggctccgtgtatttcctcca

SEQ ID NO: 269572 - DNA, 25 bp, Mus musculus
gggaactcctggtccagccactgca

SEQ ID NO: 269573 - DNA, 25 bp, Mus musculus
gcgaacctacgctgccaggtcagca

SEQ ID NO: 269574 - DNA, 25 bp, Mus musculus
gcgcccacgggacacactgggaact

SEQ ID NO: 269575 - DNA, 25 bp, Mus musculus
gacccacaggattcgaagacaaccc

SEQ ID NO: 269576 - DNA, 25 bp, Mus musculus
ggagtcgagtcagacccacaggatt

SEQ ID NO: 269577 - DNA, 25 bp, Mus musculus
tctgagaaccggaacaagaagggca

SEQ ID NO: 269578 - DNA, 25 bp, Mus musculus
tcttagggatccagctctgagaacc

SEQ ID NO: 269579 - DNA, 25 bp, Mus musculus
ttcctgaagatcttagggatccagc

SEQ ID NO: 269580 - DNA, 25 bp, Mus musculus
gtcgtgcacaccttcttcctgaaga

SEQ ID NO: 269581 - DNA, 25 bp, Mus musculus
aggtccactatgaacgtcgtgcaca

SEQ ID NO: 269582 - DNA, 25 bp, Mus musculus
cccgcatcatcggagaggtccacta

SEQ ID NO: 269583 - DNA, 25 bp, Mus musculus
tgtgcgatacctgctccttctccgg

SEQ ID NO: 269584 - DNA, 25 bp, Mus musculus
cagggaaccccgcttgcagatgacc

SEQ ID NO: 269585 - DNA, 25 bp, Mus musculus
cagatgacccggaggactggcgaca

SEQ ID NO: 269586 - DNA, 25 bp, Mus musculus
atgacccggaggactggcgacaaga

SEQ ID NO: 269587 - DNA, 25 bp, Mus musculus
acccggaggactggcgacaagacgc

SEQ ID NO: 269588 - DNA, 25 bp, Mus musculus
aggactggcgacaagacgcagcggg

SEQ ID NO: 269589 - DNA, 25 bp, Mus musculus
cgaggcttgtagcagcgagtctccc

SEQ ID NO: 269590 - DNA, 25 bp, Mus musculus
ccctcctagcggacggagaaggaag

SEQ ID NO: 269591 - DNA, 25 bp, Mus musculus
cctagcggacggagaaggaagactt

SEQ ID NO: 269592 - DNA, 25 bp, Mus musculus
ttgggccccgcgactgggcaataga

SEQ ID NO: 269593 - DNA, 25 bp, Mus musculus
ccgcgactgggcaatagaaagggga

SEQ ID NO: 269594 - DNA, 25 bp, Mus musculus
ggtgcagggcgcctgactcccattc

SEQ ID NO: 269595 - DNA, 25 bp, Mus musculus
cagggcgcctgactcccattcgaaa

SEQ ID NO: 269596 - DNA, 25 bp, Mus musculus
gggcgcctgactcccattcgaaacg

SEQ ID NO: 269597 - DNA, 25 bp, Mus musculus
agggtcagggaaccccgcttgcaga

SEQ ID NO: 269598 - DNA, 25 bp, Mus musculus
accatctcctgaatggcgaggcgta

SEQ ID NO: 269599 - DNA, 25 bp, Mus musculus
ccgctcttgacattggcccggcagg

SEQ ID NO: 269600 - DNA, 25 bp, Mus musculus
cgagggtgatgtgagcgacaccatc

SEQ ID NO: 269601 - DNA, 25 bp, Mus musculus
gcatgcccacccagagctgaggtca

SEQ ID NO: 269602 - DNA, 25 bp, Mus musculus
attggcgggcactcacagtgcgtga

SEQ ID NO: 269603 - DNA, 25 bp, Mus musculus
atgatggcgccgctcttgacattgg

SEQ ID NO: 269604 - DNA, 25 bp, Mus musculus
tgtctgacaggttggccatgatggc

SEQ ID NO: 269605 - DNA, 25 bp, Mus musculus
ccctctggatctccgtgtctgacag

SEQ ID NO: 269606 - DNA, 25 bp, Mus musculus
tggattgctgatgccgatctccctc

SEQ ID NO: 269607 - DNA, 25 bp, Mus musculus
ttgagcctgtgcagtggattgctga

SEQ ID NO: 269608 - DNA, 25 bp, Mus musculus
tcctgaatggcgaggcgtagcttga

SEQ ID NO: 269609 - DNA, 25 bp, Mus musculus
tgtgagcgacaccatctcctgaatg

SEQ ID NO: 269610 - DNA, 25 bp, Mus musculus
gctgatgccgatctccctctggatc

SEQ ID NO: 269611 - DNA, 25 bp, Mus musculus
acccagagctgaggtcaccggaagg

SEQ ID NO: 269612 - DNA, 25 bp, Mus musculus
tcacctccttgaggtcgcgctgcag

SEQ ID NO: 269613 - DNA, 25 bp, Mus musculus
tccagctggctcatctgacggcaca

SEQ ID NO: 269614 - DNA, 25 bp, Mus musculus
tcgcggtgagcagtgcccagctcct

SEQ ID NO: 269615 - DNA, 25 bp, Mus musculus
ccagctcgcggtgagcagtgcccag

SEQ ID NO: 269616 - DNA, 25 bp, Mus musculus
ccttacccagctcgcggtgagcagt

SEQ ID NO: 269617 - DNA, 25 bp, Mus musculus
agttagcttcctcggccttacccag

SEQ ID NO: 269618 - DNA, 25 bp, Mus musculus
tggagttagcttcctcggccttacc

SEQ ID NO: 269619 - DNA, 25 bp, Mus musculus
cctccttgaggtcgcgctgcagctt

SEQ ID NO: 269620 - DNA, 25 bp, Mus musculus
tggctcatctgacggcacagcaccg

SEQ ID NO: 269621 - DNA, 25 bp, Mus musculus
agcttcctccagctcggccgtgcgc

SEQ ID NO: 269622 - DNA, 25 bp, Mus musculus
cttggagttagcttcctcggcctta

SEQ ID NO: 269623 - DNA, 25 bp, Mus musculus
aggcgttcccgcagctggcacacct

SEQ ID NO: 269624 - DNA, 25 bp, Mus musculus
tggcacacctctgcacgctgccgtt

SEQ ID NO: 269625 - DNA, 25 bp, Mus musculus
tgacggcacagcaccgccaggcgtt

SEQ ID NO: 269626 - DNA, 25 bp, Mus musculus
tgtcgccaacccgtcctgcgcctct

SEQ ID NO: 269627 - DNA, 25 bp, Mus musculus
ctcgcacatcatggcggcggtgccg

SEQ ID NO: 269628 - DNA, 25 bp, Mus musculus
gtaggcatcacctcgcacatcatgg

SEQ ID NO: 269629 - DNA, 25 bp, Mus musculus
tcctcgctgatggtaggcatcacct

SEQ ID NO: 269630 - DNA, 25 bp, Mus musculus
cgccggccatcctcgctgatggtag

SEQ ID NO: 269631 - DNA, 25 bp, Mus musculus
tcgtgaccatgaggcgctccagctc

SEQ ID NO: 269632 - DNA, 25 bp, Mus musculus
agcatcgtgaccatgaggcgctcca

SEQ ID NO: 269633 - DNA, 25 bp, Mus musculus
caggcgctcgcgctctgtgagcatc

SEQ ID NO: 269634 - DNA, 25 bp, Mus musculus
gcagtcgtagctgcgctgtcgccaa

SEQ ID NO: 269635 - DNA, 25 bp, Mus musculus
gccgagctcgcgcagtcgtagctgc

SEQ ID NO: 269636 - DNA, 25 bp, Mus musculus
agtccttctcgtggccgagctcgcg

SEQ ID NO: 269637 - DNA, 25 bp, Mus musculus
tgccgctgcagcgagtccttctcgt

SEQ ID NO: 269638 - DNA, 25 bp, Mus musculus
ttcgggacagccctcctctttaggc

SEQ ID NO: 269639 - DNA, 25 bp, Mus musculus
cgctctgtgagcatcgtgaccatga

SEQ ID NO: 269640 - DNA, 25 bp, Mus musculus
tcactggagaccttgccaggccttg

SEQ ID NO: 269641 - DNA, 25 bp, Mus musculus
tggcgagtgcgtgttactctgcacc

SEQ ID NO: 269642 - DNA, 25 bp, Mus musculus
cgcccgtctagggtactgcatgcgc

SEQ ID NO: 269643 - DNA, 25 bp, Mus musculus
aacccgactcctacgcagacggtgg

SEQ ID NO: 269644 - DNA, 25 bp, Mus musculus
actcctacgcagacggtggcacggc

SEQ ID NO: 269645 - DNA, 25 bp, Mus musculus
acagaggcaatgatcaggcggcttc

SEQ ID NO: 269646 - DNA, 25 bp, Mus musculus
aggcggcttctgctggtttcaagac

SEQ ID NO: 269647 - DNA, 25 bp, Mus musculus
ctgctggtttcaagactcccgcgtc

SEQ ID NO: 269648 - DNA, 25 bp, Mus musculus
ggcagtggtctttagtggtgctccc

SEQ ID NO: 269649 - DNA, 25 bp, Mus musculus
tcacatagacgcagccttgggtcgg

SEQ ID NO: 269650 - DNA, 25 bp, Mus musculus
tagtctctgggacaccggccagcct

SEQ ID NO: 269651 - DNA, 25 bp, Mus musculus
agcctccgccttcagagctgcgcga

SEQ ID NO: 269652 - DNA, 25 bp, Mus musculus
aattcaacattcaaggtgggatttt

SEQ ID NO: 269653 - DNA, 25 bp, Mus musculus
tggcgctcacatagacgcagccttg

SEQ ID NO: 269654 - DNA, 25 bp, Mus musculus
ccagcgtgtcatagagctgttcata

SEQ ID NO: 269655 - DNA, 25 bp, Mus musculus
ccgcgagagcatacgccggcagcaa

SEQ ID NO: 269656 - DNA, 25 bp, Mus musculus
catacacctgggaagtcggggacac

SEQ ID NO: 269657 - DNA, 25 bp, Mus musculus
gcaacgtcagagagctgccagtcca

SEQ ID NO: 269658 - DNA, 25 bp, Mus musculus
aaccaagatgctcacctcgcggatg

SEQ ID NO: 269659 - DNA, 25 bp, Mus musculus
agaagcgactctgcaggacccgctg

SEQ ID NO: 269660 - DNA, 25 bp, Mus musculus
cgggacacgtctgcagaaagcggca

SEQ ID NO: 269661 - DNA, 25 bp, Mus musculus
agactggaagcgatccacgtgcctc

SEQ ID NO: 269662 - DNA, 25 bp, Mus musculus
tgccagtgatgtccagcgtgtcata

SEQ ID NO: 269663 - DNA, 25 bp, Mus musculus
caagaagggcaatcgaggtcagact

SEQ ID NO: 269664 - DNA, 25 bp, Mus musculus
tgcaaagcctgtcgcaacccaacgg

SEQ ID NO: 269665 - DNA, 25 bp, Mus musculus
gtgcagccatatcgcctctaatgca

SEQ ID NO: 269666 - DNA, 25 bp, Mus musculus
cggactggaccctcggagcgcttac

SEQ ID NO: 269667 - DNA, 25 bp, Mus musculus
agcggctccaccagtgcagccatat

SEQ ID NO: 269668 - DNA, 25 bp, Mus musculus
tcgttcactgcactcccagcgccgc

SEQ ID NO: 269669 - DNA, 25 bp, Mus musculus
gcagcgccgcccaaggagacgcgcc

SEQ ID NO: 269670 - DNA, 25 bp, Mus musculus
cctggggcatctggcccgccaagtt

SEQ ID NO: 269671 - DNA, 25 bp, Mus musculus
atctggcccgccaagttgcggccca

SEQ ID NO: 269672 - DNA, 25 bp, Mus musculus
agccgcgcccgccacacataccttt

SEQ ID NO: 269673 - DNA, 25 bp, Mus musculus
caagttgcggcccacgcccgacgag

SEQ ID NO: 269674 - DNA, 25 bp, Mus musculus
cacgcccgacgagcgctcgcccgcc

SEQ ID NO: 269675 - DNA, 25 bp, Mus musculus
ctctgttctgcgctccgcgtgcggg

SEQ ID NO: 269676 - DNA, 25 bp, Mus musculus
tccccttgcctagatgagcggatcc

SEQ ID NO: 269677 - DNA, 25 bp, Mus musculus
acttctcagaggtcgtggcgggcag

SEQ ID NO: 269678 - DNA, 25 bp, Mus musculus
cgttgactgcgggaacaacgcgagg

SEQ ID NO: 269679 - DNA, 25 bp, Mus musculus
aacaacgcgagggatcgggtcggag

SEQ ID NO: 269680 - DNA, 25 bp, Mus musculus
atacctttactcgttcactgcactc

SEQ ID NO: 269681 - DNA, 25 bp, Mus musculus
cacatacctttactcgttcactgca

SEQ ID NO: 269682 - DNA, 25 bp, Mus musculus
ccctcactcaaatcccgggaaggag

SEQ ID NO: 269683 - DNA, 25 bp, Mus musculus
tcgggttccgccatggaatccaaca

SEQ ID NO: 269684 - DNA, 25 bp, Mus musculus
ccctttcttaggagacatacggtag

SEQ ID NO: 269685 - DNA, 25 bp, Mus musculus
tacgattcacagatagtcggactgg

SEQ ID NO: 269686 - DNA, 25 bp, Mus musculus
gtctgacaatcggtaaacatctgta

SEQ ID NO: 269687 - DNA, 25 bp, Mus musculus
tgaagccgagcgctgtatcagcatc

SEQ ID NO: 269688 - DNA, 25 bp, Mus musculus
acccgacgccacgagtcagcggtga

SEQ ID NO: 269689 - DNA, 25 bp, Mus musculus
agggttatgtcatccttccgcgccg

SEQ ID NO: 269690 - DNA, 25 bp, Mus musculus
agacatacggtagggcttccgcccg

SEQ ID NO: 269691 - DNA, 25 bp, Mus musculus
acttcagcatttgcgctctagagcg

SEQ ID NO: 269692 - DNA, 25 bp, Mus musculus
gcgcgcacactcaacttcagcattt

SEQ ID NO: 269693 - DNA, 25 bp, Mus musculus
gcagaggctaccacccgaacgtgcg

SEQ ID NO: 269694 - DNA, 25 bp, Mus musculus
tagtcggactggaacgcagaggcta

SEQ ID NO: 269695 - DNA, 25 bp, Mus musculus
gctgtatcagcatcgccctcaaggc

SEQ ID NO: 269696 - DNA, 25 bp, Mus musculus
ctttgcaaggaatgccgaatgaatc

SEQ ID NO: 269697 - DNA, 25 bp, Mus musculus
tctcgcccgcggctttgcaaggaat

SEQ ID NO: 269698 - DNA, 25 bp, Mus musculus
tgtcacctagtcttgcagctcagcc

SEQ ID NO: 269699 - DNA, 25 bp, Mus musculus
cggcaggctgtcacctagtcttgca

SEQ ID NO: 269700 - DNA, 25 bp, Mus musculus
cgccgctgtcatcggaaccggaagg

SEQ ID NO: 269701 - DNA, 25 bp, Mus musculus
gccgacgactgctccaggctttggt

SEQ ID NO: 269702 - DNA, 25 bp, Mus musculus
ttcgccggagccaggcaacagttag

SEQ ID NO: 269703 - DNA, 25 bp, Mus musculus
ctggcctctgcgatccggagcaaac

SEQ ID NO: 269704 - DNA, 25 bp, Mus musculus
gcaaacctgggtttccgcgcgtcag

SEQ ID NO: 269705 - DNA, 25 bp, Mus musculus
caccgacgggttgtcacgagtttct

SEQ ID NO: 269706 - DNA, 25 bp, Mus musculus
tcacgagtttctaccggaagtatta

SEQ ID NO: 269707 - DNA, 25 bp, Mus musculus
cggaagtattagctggcgcacctgc

SEQ ID NO: 269708 - DNA, 25 bp, Mus musculus
ccgaatgaatcgttcgccggagcca

SEQ ID NO: 269709 - DNA, 25 bp, Mus musculus
cgcgcgtcagaaccaccgacgggtt

SEQ ID NO: 269710 - DNA, 25 bp, Mus musculus
ccggtcccggtctctgtgtggaagc

SEQ ID NO: 269711 - DNA, 25 bp, Mus musculus
ggagctccatcaccagcttcagagg

SEQ ID NO: 269712 - DNA, 25 bp, Mus musculus
aggcccatcatcaggagctccatca

SEQ ID NO: 269713 - DNA, 25 bp, Mus musculus
ggccatcagggccttcagggccaag

SEQ ID NO: 269714 - DNA, 25 bp, Mus musculus
atcacggtctcggtcccgacgacgt

SEQ ID NO: 269715 - DNA, 25 bp, Mus musculus
ggctccgactgcttcgtcgctttcg

SEQ ID NO: 269716 - DNA, 25 bp, Mus musculus
cttcgtcgctttcggtctcggtcct

SEQ ID NO: 269717 - DNA, 25 bp, Mus musculus
acgcttgtgctctcgatcccgatca

SEQ ID NO: 269718 - DNA, 25 bp, Mus musculus
tctcggtccttgtccttgctacgct

SEQ ID NO: 269719 - DNA, 25 bp, Mus musculus
gctcatccttgtctcgactccggga

SEQ ID NO: 269720 - DNA, 25 bp, Mus musculus
gagagcgggagcgtctcctttctct

SEQ ID NO: 269721 - DNA, 25 bp, Mus musculus
ttctctctccttgtctcgttctcgg

SEQ ID NO: 269722 - DNA, 25 bp, Mus musculus
gcttcagagggttcagccatgtcgc

SEQ ID NO: 269723 - DNA, 25 bp, Mus musculus
ttgtctcgttctcggcttctttctc

SEQ ID NO: 269724 - DNA, 25 bp, Mus musculus
ggcgctctcctcagcctgacgttag

SEQ ID NO: 269725 - DNA, 25 bp, Mus musculus
cgcatgcgccgtacgagtcaaacga

SEQ ID NO: 269726 - DNA, 25 bp, Mus musculus
agtcaaacgacaccctcacagcagt

SEQ ID NO: 269727 - DNA, 25 bp, Mus musculus
tcacagcagtccaggccttaccagg

SEQ ID NO: 269728 - DNA, 25 bp, Mus musculus
ctgcgcatgcgccaaaactgtactc

SEQ ID NO: 269729 - DNA, 25 bp, Mus musculus
tctgaaatggctaaacatccgcggc

SEQ ID NO: 269730 - DNA, 25 bp, Mus musculus
tcggacctaggtcggtctcagcctc

SEQ ID NO: 269731 - DNA, 25 bp, Mus musculus
tcgcgctctagctaaccgcctatga

SEQ ID NO: 269732 - DNA, 25 bp, Mus musculus
gcctatgaccgcgagacacttatgg

SEQ ID NO: 269733 - DNA, 25 bp, Mus musculus
agacacttatggaaggtccgccctt

SEQ ID NO: 269734 - DNA, 25 bp, Mus musculus
acacttcccggaccttgtgcgcatg

SEQ ID NO: 269735 - DNA, 25 bp, Mus musculus
tgcgcatgcgtctaagtgatgcacc

SEQ ID NO: 269736 - DNA, 25 bp, Mus musculus
tgatgcaccacgtcgcatatccttc

SEQ ID NO: 269737 - DNA, 25 bp, Mus musculus
actgggagtggagacgactcgaatc

SEQ ID NO: 269738 - DNA, 25 bp, Mus musculus
cctttgcgcgtcagctctggctgct

SEQ ID NO: 269739 - DNA, 25 bp, Mus musculus
agacactgccagacttccgcgacga

SEQ ID NO: 269740 - DNA, 25 bp, Mus musculus
tcctggtctccatcgtggtcttttg

SEQ ID NO: 269741 - DNA, 25 bp, Mus musculus
tggtctccgtactcgtcatcctggt

SEQ ID NO: 269742 - DNA, 25 bp, Mus musculus
tggtcttttgcctcgagacactgcc

SEQ ID NO: 269743 - DNA, 25 bp, Mus musculus
tcttcgaatttcctgagagctcgca

SEQ ID NO: 269744 - DNA, 25 bp, Mus musculus
ccctcgacgtcttcctggaggaggt

SEQ ID NO: 269745 - DNA, 25 bp, Mus musculus
ctactactaccagtcgggcggccgg

SEQ ID NO: 269746 - DNA, 25 bp, Mus musculus
gagtatttcttcgaccgacaccggc

SEQ ID NO: 269747 - DNA, 25 bp, Mus musculus
gcgcgccgcgagtatttcttcgacc

SEQ ID NO: 269748 - DNA, 25 bp, Mus musculus
atgctatttttacccgccgacaccg

SEQ ID NO: 269749 - DNA, 25 bp, Mus musculus
ggccggactttccatgctattttta

SEQ ID NO: 269750 - DNA, 25 bp, Mus musculus
agcgccgggtggcagtgtttccaca

SEQ ID NO: 269751 - DNA, 25 bp, Mus musculus
gcttcgatgcggtgctctactacta

SEQ ID NO: 269752 - DNA, 25 bp, Mus musculus
tcagaaaaggctgtctccgcttcgc

SEQ ID NO: 269753 - DNA, 25 bp, Mus musculus
cgacccacctgctgcgcagcgatgc

SEQ ID NO: 269754 - DNA, 25 bp, Mus musculus
gatggcggcccgctgcaatacgcgt

SEQ ID NO: 269755 - DNA, 25 bp, Mus musculus
tagaaggctgccaggcggcccgacc

SEQ ID NO: 269756 - DNA, 25 bp, Mus musculus
tcacttgcgcagtctcgaacaccga

SEQ ID NO: 269757 - DNA, 25 bp, Mus musculus
ctgtacaccagccaaacacctacgg

SEQ ID NO: 269758 - DNA, 25 bp, Mus musculus
tgcgcggcctgcagcgccgtaaact

SEQ ID NO: 269759 - DNA, 25 bp, Mus musculus
ggcgaagctgctgtgaccgcaccgc

SEQ ID NO: 269760 - DNA, 25 bp, Mus musculus
tctcgaacaccgagcgccgatggcg

SEQ ID NO: 269761 - DNA, 25 bp, Mus musculus
cgcaccgccagtcaatcagaaaagg

SEQ ID NO: 269762 - DNA, 25 bp, Mus musculus
ctgcaatacgcgtgcgcggcctgca

SEQ ID NO: 269763 - DNA, 25 bp, Mus musculus
gtcacttccgatgccatggcaacgg

SEQ ID NO: 269764 - DNA, 25 bp, Mus musculus
cgcgtcacttccgatgccatggcaa

SEQ ID NO: 269765 - DNA, 25 bp, Mus musculus
tgctgtgaccgcaccgccagtcaat

SEQ ID NO: 269766 - DNA, 25 bp, Mus musculus
tcccaagcgcaaacggcgagcagcc

SEQ ID NO: 269767 - DNA, 25 bp, Mus musculus
cgagcttccaaggtgccggcccgcg

SEQ ID NO: 269768 - DNA, 25 bp, Mus musculus
aggccctcccaagcgcaaacggcga

SEQ ID NO: 269769 - DNA, 25 bp, Mus musculus
aggccgagcttccaaggtgccggcc

SEQ ID NO: 269770 - DNA, 25 bp, Mus musculus
aaacggcgagcagccggcgagcagc

SEQ ID NO: 269771 - DNA, 25 bp, Mus musculus
tccgagctgccagcgagccggagga

SEQ ID NO: 269772 - DNA, 25 bp, Mus musculus
gaagggcgccccaggtaagagctcc

SEQ ID NO: 269773 - DNA, 25 bp, Mus musculus
cccaggtaagagctcctcgcctcct

SEQ ID NO: 269774 - DNA, 25 bp, Mus musculus
agagctcctcgcctcctctggcaga

SEQ ID NO: 269775 - DNA, 25 bp, Mus musculus
tcctctggcagactacacggtccgg

SEQ ID NO: 269776 - DNA, 25 bp, Mus musculus
ctctggcagactacacggtccgggt

SEQ ID NO: 269777 - DNA, 25 bp, Mus musculus
tggcagactacacggtccgggtcgc

SEQ ID NO: 269778 - DNA, 25 bp, Mus musculus
gacccaggccctcccaagcgcaaac

SEQ ID NO: 269779 - DNA, 25 bp, Mus musculus
gcccgcgcgtgctaggcgggatccg

SEQ ID NO: 269780 - DNA, 25 bp, Mus musculus
tggcgctggattcggatcgacacag

SEQ ID NO: 269781 - DNA, 25 bp, Mus musculus
tggattcggatcgacacagcttgcg

SEQ ID NO: 269782 - DNA, 25 bp, Mus musculus
accgaccggcggacagctgtggact

SEQ ID NO: 269783 - DNA, 25 bp, Mus musculus
ggcgttgactgcagactcccagggc

SEQ ID NO: 269784 - DNA, 25 bp, Mus musculus
agcagtcctatgtgcgggcgttgac

SEQ ID NO: 269785 - DNA, 25 bp, Mus musculus
tgcaaggctaagcagtcctatgtgc

SEQ ID NO: 269786 - DNA, 25 bp, Mus musculus
tggctctcagaatgcaaggctaagc

SEQ ID NO: 269787 - DNA, 25 bp, Mus musculus
tcgacacagcttgcgtctgcacgct

SEQ ID NO: 269788 - DNA, 25 bp, Mus musculus
gacgcgctgcaaggccgaaagcgct

SEQ ID NO: 269789 - DNA, 25 bp, Mus musculus
agtacttcttcgagacgcgctgcaa

SEQ ID NO: 269790 - DNA, 25 bp, Mus musculus
tgagtgagaccgcacccgcaagccg

SEQ ID NO: 269791 - DNA, 25 bp, Mus musculus
ccctgcgtcagtacttcttcgagac

SEQ ID NO: 269792 - DNA, 25 bp, Mus musculus
cggaggcactggctctcagaatgca

SEQ ID NO: 269793 - DNA, 25 bp, Mus musculus
tgcacgctcctcagccgaacaggcc

SEQ ID NO: 269794 - DNA, 25 bp, Mus musculus
ttccagttttggtgctcgaagtccc

SEQ ID NO: 269795 - DNA, 25 bp, Mus musculus
agtagccatgcctctcagccgcagt

SEQ ID NO: 269796 - DNA, 25 bp, Mus musculus
cgccaataagtagacgcaatagccc

SEQ ID NO: 269797 - DNA, 25 bp, Mus musculus
ggccaacaagggtgagaacgtcagc

SEQ ID NO: 269798 - DNA, 25 bp, Mus musculus
ctgtgtcctcgcttccaggattgga

SEQ ID NO: 269799 - DNA, 25 bp, Mus musculus
aacgtcagcgttggtcccttgacca

SEQ ID NO: 269800 - DNA, 25 bp, Mus musculus
cagccgatctctctggtttccagtt

SEQ ID NO: 269801 - DNA, 25 bp, Mus musculus
accggtcaccaagtctgctgcgttc

SEQ ID NO: 269802 - DNA, 25 bp, Mus musculus
aagcggagcgccttgcaagcttccc

SEQ ID NO: 269803 - DNA, 25 bp, Mus musculus
accctacctgagtcggagcgctctg

SEQ ID NO: 269804 - DNA, 25 bp, Mus musculus
cgattcagtgtctcagctcacccta

SEQ ID NO: 269805 - DNA, 25 bp, Mus musculus
gcggccacgaggcttcactgcagct

SEQ ID NO: 269806 - DNA, 25 bp, Mus musculus
gccgaccaatcgtgctagaccagca

SEQ ID NO: 269807 - DNA, 25 bp, Mus musculus
cccgagaacgcagtgcttttcgagg

SEQ ID NO: 269808 - DNA, 25 bp, Mus musculus
acgcatgcgcggatcgaccttaatc

SEQ ID NO: 269809 - DNA, 25 bp, Mus musculus
ccgcaggactagtcacgtgatcatc

SEQ ID NO: 269810 - DNA, 25 bp, Mus musculus
cgggtactaaatgaacgcatgcgcg

SEQ ID NO: 269811 - DNA, 25 bp, Mus musculus
gggccgcgggtactaaatgaacgca

SEQ ID NO: 269812 - DNA, 25 bp, Mus musculus
gatcatcatcgctcgctgcaggggc

SEQ ID NO: 269813 - DNA, 25 bp, Mus musculus
cgtgatcatcatcgctcgctgcagg

SEQ ID NO: 269814 - DNA, 25 bp, Mus musculus
ggactagtcacgtgatcatcatcgc

SEQ ID NO: 269815 - DNA, 25 bp, Mus musculus
gatcgtggacgtgcggccctcacgt

SEQ ID NO: 269816 - DNA, 25 bp, Mus musculus
tcacgtgactgatcgtggacgtgcg

SEQ ID NO: 269817 - DNA, 25 bp, Mus musculus
tgcggcgcaccacggtcacgtgact

SEQ ID NO: 269818 - DNA, 25 bp, Mus musculus
cggacccgtccatcactgccgctgc

SEQ ID NO: 269819 - DNA, 25 bp, Mus musculus
cctcaccgccgctcccaagctgctc

SEQ ID NO: 269820 - DNA, 25 bp, Mus musculus
cgccagcgacaagcccgggcctgcc

SEQ ID NO: 269821 - DNA, 25 bp, Mus musculus
cgcgcacgcggatgtccgctctcgg

SEQ ID NO: 269822 - DNA, 25 bp, Mus musculus
gcagtgagctcagcacggtggtaaa

SEQ ID NO: 269823 - DNA, 25 bp, Mus musculus
gctccctcgttcctcggactaggga

SEQ ID NO: 269824 - DNA, 25 bp, Mus musculus
gacgtgcacctggtgctccgaggaa

SEQ ID NO: 269825 - DNA, 25 bp, Mus musculus
tgtcttccaagggacgtgcacctgg

SEQ ID NO: 269826 - DNA, 25 bp, Mus musculus
cacggtggtaaagtcgttggcaatt

SEQ ID NO: 269827 - DNA, 25 bp, Mus musculus
ctcaggacacgacctcaggacgtga

SEQ ID NO: 269828 - DNA, 25 bp, Mus musculus
ggcaattaagccagccgacacgatg

SEQ ID NO: 269829 - DNA, 25 bp, Mus musculus
tgctccgaggaaggcagtgagctca

SEQ ID NO: 269830 - DNA, 25 bp, Mus musculus
ttgaccctcaggacacgacctcagg

SEQ ID NO: 269831 - DNA, 25 bp, Mus musculus
ggactctttcttagaccctcggctc

SEQ ID NO: 269832 - DNA, 25 bp, Mus musculus
ctcggactagggactctttcttaga

SEQ ID NO: 269833 - DNA, 25 bp, Mus musculus
ctcggacccagtgtcttccaaggga

SEQ ID NO: 269834 - DNA, 25 bp, Mus musculus
gcgcagcgccattttgcacgtcttc

SEQ ID NO: 269835 - DNA, 25 bp, Mus musculus
tcaggacgtgaaaccgcaatctctc

SEQ ID NO: 269836 - DNA, 25 bp, Mus musculus
tggacaagtatcacgcgctccagcc

SEQ ID NO: 269837 - DNA, 25 bp, Mus musculus
tttcctggagcgcaatccgcagacc

SEQ ID NO: 269838 - DNA, 25 bp, Mus musculus
ggaacccaggatgccaggcctctaa

SEQ ID NO: 269839 - DNA, 25 bp, Mus musculus
agcgtttagtcacctggaacccagg

SEQ ID NO: 269840 - DNA, 25 bp, Mus musculus
gcacgccacccgatttgcaaaaatg

SEQ ID NO: 269841 - DNA, 25 bp, Mus musculus
ttccggctccctgagtaggggaatc

SEQ ID NO: 269842 - DNA, 25 bp, Mus musculus
cgaggcctgacactggacaagtatc

SEQ ID NO: 269843 - DNA, 25 bp, Mus musculus
ctccagtgctgagggcgttttttaa

SEQ ID NO: 269844 - DNA, 25 bp, Mus musculus
tttaaggccagcaacctccgccagg

SEQ ID NO: 269845 - DNA, 25 bp, Mus musculus
ctggcgatttctctcctaagtcacg

SEQ ID NO: 269846 - DNA, 25 bp, Mus musculus
actgattggtccacgctgactctga

SEQ ID NO: 269847 - DNA, 25 bp, Mus musculus
gactctgagcttccgcccgcgttaa

SEQ ID NO: 269848 - DNA, 25 bp, Mus musculus
ccggttttcttggacgctcacagtc

SEQ ID NO: 269849 - DNA, 25 bp, Mus musculus
gctcacagtcttcaacgcaacattt

SEQ ID NO: 269850 - DNA, 25 bp, Mus musculus
ggtgtccgagaacgacctcagcgac

SEQ ID NO: 269851 - DNA, 25 bp, Mus musculus
ccacttaccatgctggctccgtgaa

SEQ ID NO: 269852 - DNA, 25 bp, Mus musculus
atcggggcgatgctccacggaaaat

SEQ ID NO: 269853 - DNA, 25 bp, Mus musculus
gctccacggaaaatgcatttacagg

SEQ ID NO: 269854 - DNA, 25 bp, Mus musculus
acgaggctctagagcgcgcgccgca

SEQ ID NO: 269855 - DNA, 25 bp, Mus musculus
ccagcccggacgaggctctagagcg

SEQ ID NO: 269856 - DNA, 25 bp, Mus musculus
tccgtgaatcctagggcgcgctgca

SEQ ID NO: 269857 - DNA, 25 bp, Mus musculus
agctcggtctcgaacctttctcttc

SEQ ID NO: 269858 - DNA, 25 bp, Mus musculus
ttcccaggctcttcgggaacgcgcg

SEQ ID NO: 269859 - DNA, 25 bp, Mus musculus
gcactgggcgacactcgtccgctgg

SEQ ID NO: 269860 - DNA, 25 bp, Mus musculus
ctagccgcgcatggtgcagcggcca

SEQ ID NO: 269861 - DNA, 25 bp, Mus musculus
taccatgctggctccgtgaatccta

SEQ ID NO: 269862 - DNA, 25 bp, Mus musculus
gttcgctcgctcacgtgcagcagct

SEQ ID NO: 269863 - DNA, 25 bp, Mus musculus
atttacaggtcagcctcgtgcgcgg

SEQ ID NO: 269864 - DNA, 25 bp, Mus musculus
gcgaaccttatctggcagtcacgta

SEQ ID NO: 269865 - DNA, 25 bp, Mus musculus
tttccgagcaagtacgcgaacctta

SEQ ID NO: 269866 - DNA, 25 bp, Mus musculus
agagccgtcgatctcacgtaatttc

SEQ ID NO: 269867 - DNA, 25 bp, Mus musculus
aggcgtgccctaggctcaatcgaga

SEQ ID NO: 269868 - DNA, 25 bp, Mus musculus
tctgtgaggtcaccgcagcttctca

SEQ ID NO: 269869 - DNA, 25 bp, Mus musculus
caacactgaacttctcgcggagact

SEQ ID NO: 269870 - DNA, 25 bp, Mus musculus
ggcttttataccctgacgcggcgct

SEQ ID NO: 269871 - DNA, 25 bp, Mus musculus
gccaacatcgtccacgcggctttta

SEQ ID NO: 269872 - DNA, 25 bp, Mus musculus
cgcgggatatcgcatgtaatcttcc

SEQ ID NO: 269873 - DNA, 25 bp, Mus musculus
ttcacaggctgtagcaaaggctgtc

SEQ ID NO: 269874 - DNA, 25 bp, Mus musculus
gaagccagcgggttcatgtcgccct

SEQ ID NO: 269875 - DNA, 25 bp, Mus musculus
ccaaaagcgatcgtgggtccggact

SEQ ID NO: 269876 - DNA, 25 bp, Mus musculus
agcgccggttctggttgccaaaagc

SEQ ID NO: 269877 - DNA, 25 bp, Mus musculus
ctcggggacgcaatgtttcacaggc

SEQ ID NO: 269878 - DNA, 25 bp, Mus musculus
cagcctttccggcttggcgtcattc

SEQ ID NO: 269879 - DNA, 25 bp, Mus musculus
cagaactaaggacggcctggcagaa

SEQ ID NO: 269880 - DNA, 25 bp, Mus musculus
cctggcagaagtgaggctcgacaca

SEQ ID NO: 269881 - DNA, 25 bp, Mus musculus
tgaggctcgacacagcagccatctg

SEQ ID NO: 269882 - DNA, 25 bp, Mus musculus
cgacacagcagccatctgcgggagg

SEQ ID NO: 269883 - DNA, 25 bp, Mus musculus
cggggcccgaatgcctttcaccagg

SEQ ID NO: 269884 - DNA, 25 bp, Mus musculus
acacaccggatcatggctgcagcca

SEQ ID NO: 269885 - DNA, 25 bp, Mus musculus
cgcacttccgggtggaccactggcg

SEQ ID NO: 269886 - DNA, 25 bp, Mus musculus
tccctgtggtcccagaactaaggac

SEQ ID NO: 269887 - DNA, 25 bp, Mus musculus
tggcgtcattcctctgtgcctcggg

SEQ ID NO: 269888 - DNA, 25 bp, Mus musculus
ggctgcagccacactaggacaggtg

SEQ ID NO: 269889 - DNA, 25 bp, Mus musculus
attcctctgtgcctcgggttccgct

SEQ ID NO: 269890 - DNA, 25 bp, Mus musculus
gtcgggaccgttcccgcgcaggatc

SEQ ID NO: 269891 - DNA, 25 bp, Mus musculus
cgcgcaggatcttcacagcagagcc

SEQ ID NO: 269892 - DNA, 25 bp, Mus musculus
cgtcctccgacacggggagccgaag

SEQ ID NO: 269893 - DNA, 25 bp, Mus musculus
atctcgcagctgtttcggggctcag

SEQ ID NO: 269894 - DNA, 25 bp, Mus musculus
cgtggacgcctacgcgctttgcgac

SEQ ID NO: 269895 - DNA, 25 bp, Mus musculus
agaagaagctgcctgaactggcggc

SEQ ID NO: 269896 - DNA, 25 bp, Mus musculus
tacgcgctttgcgacgctctgggcc

SEQ ID NO: 269897 - DNA, 25 bp, Mus musculus
cccgggagtgctcaagatcttcgct

SEQ ID NO: 269898 - DNA, 25 bp, Mus musculus
acagcggctgcgtggacgcctacgc

SEQ ID NO: 269899 - DNA, 25 bp, Mus musculus
agatcttcgcttctgggctggcgtc

SEQ ID NO: 269900 - DNA, 25 bp, Mus musculus
tacggagcgatccaccgcgcgcgag

SEQ ID NO: 269901 - DNA, 25 bp, Mus musculus
tgctggctacggagcgatccaccgc

SEQ ID NO: 269902 - DNA, 25 bp, Mus musculus
actacaagagcgtgctggctacgga

SEQ ID NO: 269903 - DNA, 25 bp, Mus musculus
gtcgggcgccaactacaagagcgtg

SEQ ID NO: 269904 - DNA, 25 bp, Mus musculus
cgccctctgctggtgcaggacctgt

SEQ ID NO: 269905 - DNA, 25 bp, Mus musculus
gagccaagcgcatctcgcagctgtt

SEQ ID NO: 269906 - DNA, 25 bp, Mus musculus
agacatcctgcctcgacattgcacg

SEQ ID NO: 269907 - DNA, 25 bp, Mus musculus
ctgcctcgacattgcacggtgcgcg

SEQ ID NO: 269908 - DNA, 25 bp, Mus musculus
cccgtcacacacaatggctgtcttt

SEQ ID NO: 269909 - DNA, 25 bp, Mus musculus
cacaatggctgtcttttgctgcggg

SEQ ID NO: 269910 - DNA, 25 bp, Mus musculus
ccggagacctgttaggcctaggaga

SEQ ID NO: 269911 - DNA, 25 bp, Mus musculus
ctgggccttttcttgtcgtttgtgt

SEQ ID NO: 269912 - DNA, 25 bp, Mus musculus
tgcggttcagaccacgagaggaaga

SEQ ID NO: 269913 - DNA, 25 bp, Mus musculus
cgagatcgtgcgagctgcagcctcg

SEQ ID NO: 269914 - DNA, 25 bp, Mus musculus
cctaggagagcatttcctgttcatg

SEQ ID NO: 269915 - DNA, 25 bp, Mus musculus
tgttcatgtacaaggacccccgctc

SEQ ID NO: 269916 - DNA, 25 bp, Mus musculus
cctgttaggcctaggagagcatttc

SEQ ID NO: 269917 - DNA, 25 bp, Mus musculus
gttctgggcccgctcggccatcttg

SEQ ID NO: 269918 - DNA, 25 bp, Mus musculus
cttgtcgtttgtgtggccgtggcct

SEQ ID NO: 269919 - DNA, 25 bp, Mus musculus
cgagccggtgctgcggttcagacca

SEQ ID NO: 269920 - DNA, 25 bp, Mus musculus
agggctctgcttcgcctctgcggaa

SEQ ID NO: 269921 - DNA, 25 bp, Mus musculus
ggacgaagacaccacctaagaacca

SEQ ID NO: 269922 - DNA, 25 bp, Mus musculus
ctaagaaccagggagtcgcccactc

SEQ ID NO: 269923 - DNA, 25 bp, Mus musculus
ttgggctcaactcccacgtgggacg

SEQ ID NO: 269924 - DNA, 25 bp, Mus musculus
cctgagctgcctgacgtcactaaaa

SEQ ID NO: 269925 - DNA, 25 bp, Mus musculus
gataaccagatccaaggccgcaaga

SEQ ID NO: 269926 - DNA, 25 bp, Mus musculus
ggacgcttccttttccgttgctgtc

SEQ ID NO: 269927 - DNA, 25 bp, Mus musculus
ctcccggatgaggtgttcctgagct

SEQ ID NO: 269928 - DNA, 25 bp, Mus musculus
gacacgcaggtctagggctctgctt

SEQ ID NO: 269929 - DNA, 25 bp, Mus musculus
gccgcaagagcggacgcttcctttt

SEQ ID NO: 269930 - DNA, 25 bp, Mus musculus
ttacgcacaacaaaaggccgccagc

SEQ ID NO: 269931 - DNA, 25 bp, Mus musculus
ccgaggacgcacgtgacattacgca

SEQ ID NO: 269932 - DNA, 25 bp, Mus musculus
tcccaagatgcccagacacgcaggt

SEQ ID NO: 269933 - DNA, 25 bp, Mus musculus
gctgagtgaggctatcccggataac

SEQ ID NO: 269934 - DNA, 25 bp, Mus musculus
catcgcttcttaaaagggagcccgc

SEQ ID NO: 269935 - DNA, 25 bp, Mus musculus
gatgacgcattgcatagagaactgc

SEQ ID NO: 269936 - DNA, 25 bp, Mus musculus
gccctgtgacagatgacgcattgca

SEQ ID NO: 269937 - DNA, 25 bp, Mus musculus
ccgtcgcctcctctgggatcttgaa

SEQ ID NO: 269938 - DNA, 25 bp, Mus musculus
gcctcaccggccctgtgacagatga

SEQ ID NO: 269939 - DNA, 25 bp, Mus musculus
gcagctcacgcctgcgcctcaccgg

SEQ ID NO: 269940 - DNA, 25 bp, Mus musculus
cattgcatagagaactgcgcaggct

SEQ ID NO: 269941 - DNA, 25 bp, Mus musculus
cagcttgaaactgcatcgcttctta

SEQ ID NO: 269942 - DNA, 25 bp, Mus musculus
gctgccagccaatcatcgccatgga

SEQ ID NO: 269943 - DNA, 25 bp, Mus musculus
agcaggagctgccagccaatcatcg

SEQ ID NO: 269944 - DNA, 25 bp, Mus musculus
ccaatgagaaaggaacgcgcgcagc

SEQ ID NO: 269945 - DNA, 25 bp, Mus musculus
ttcgacaccttgaaaaccaatgaga

SEQ ID NO: 269946 - DNA, 25 bp, Mus musculus
ggtggcttcgacaccttgaaaacca

SEQ ID NO: 269947 - DNA, 25 bp, Mus musculus
aacgcgcgcagcttgaaactgcatc

SEQ ID NO: 269948 - DNA, 25 bp, Mus musculus
agggatgaaggcaagccgtccattc

SEQ ID NO: 269949 - DNA, 25 bp, Mus musculus
cgggtatcccgtgaaacgcacatac

SEQ ID NO: 269950 - DNA, 25 bp, Mus musculus
ccagtgcaaacagcgtggcatattc

SEQ ID NO: 269951 - DNA, 25 bp, Mus musculus
agccgtccattcatccgggccagtg

SEQ ID NO: 269952 - DNA, 25 bp, Mus musculus
tgtcgctatgcaacaccgggaggct

SEQ ID NO: 269953 - DNA, 25 bp, Mus musculus
cgctagtgtgctgtgcatggacgca

SEQ ID NO: 269954 - DNA, 25 bp, Mus musculus
ctgatcctgaagatgggcgctagtg

SEQ ID NO: 269955 - DNA, 25 bp, Mus musculus
aacaccgggaggctgatcctgaaga

SEQ ID NO: 269956 - DNA, 25 bp, Mus musculus
tatcccgtgaaacgcacatactgcc

SEQ ID NO: 269957 - DNA, 25 bp, Mus musculus
acgctcctccatccagtcgttgagg

SEQ ID NO: 269958 - DNA, 25 bp, Mus musculus
gtaattctgccacgggatccttttg

SEQ ID NO: 269959 - DNA, 25 bp, Mus musculus
ccagtcgttgaggtggtaattctgc

SEQ ID NO: 269960 - DNA, 25 bp, Mus musculus
gatccttttggctgtgtcgctatgc

SEQ ID NO: 269961 - DNA, 25 bp, Mus musculus
atgtggcggtaacgctcctccatcc

SEQ ID NO: 269962 - DNA, 25 bp, Mus musculus
atcctgaaccgccacggcctcgcgc

SEQ ID NO: 269963 - DNA, 25 bp, Mus musculus
gaccctgcgcgcctcatcctgaacc

SEQ ID NO: 269964 - DNA, 25 bp, Mus musculus
gacgacgacaactatgaccctgcgc

SEQ ID NO: 269965 - DNA, 25 bp, Mus musculus
agacccacgacgacgacaactatga

SEQ ID NO: 269966 - DNA, 25 bp, Mus musculus
gtgctgcgcagacccacgacgacga

SEQ ID NO: 269967 - DNA, 25 bp, Mus musculus
ctggcgctgactacctcctgctggg

SEQ ID NO: 269968 - DNA, 25 bp, Mus musculus
tgttcaaacagcgtgcgtggcccgt

SEQ ID NO: 269969 - DNA, 25 bp, Mus musculus
ctgacctaatctgcggctgcctgcg

SEQ ID NO: 269970 - DNA, 25 bp, Mus musculus
ccaggtttcagcgtcgtcgtcgcag

SEQ ID NO: 269971 - DNA, 25 bp, Mus musculus
acgtgctgacctaatctgcggctgc

SEQ ID NO: 269972 - DNA, 25 bp, Mus musculus
cagcgtcgtcgtcgcagccgtctga

SEQ ID NO: 269973 - DNA, 25 bp, Mus musculus
cgctgccctggagaccacgatgggc

SEQ ID NO: 269974 - DNA, 25 bp, Mus musculus
tgcacgtgctggctgtgttcaaaca

SEQ ID NO: 269975 - DNA, 25 bp, Mus musculus
tgggtgccacgtgctgacctaatct

SEQ ID NO: 269976 - DNA, 25 bp, Mus musculus
tcccgttctggtgacagccaggctg

SEQ ID NO: 269977 - DNA, 25 bp, Mus musculus
agggtcgctccgaggcctcttggat

SEQ ID NO: 269978 - DNA, 25 bp, Mus musculus
gccgggttcgctggttgagagcgaa

SEQ ID NO: 269979 - DNA, 25 bp, Mus musculus
tgagagcgaagaaggggtgtgcatt

SEQ ID NO: 269980 - DNA, 25 bp, Mus musculus
tgtgcattggcaccgagagggaccc

SEQ ID NO: 269981 - DNA, 25 bp, Mus musculus
tcgcagcttcgggaggtagagcgag

SEQ ID NO: 269982 - DNA, 25 bp, Mus musculus
ggctctggggtacacggtcccagcc

SEQ ID NO: 269983 - DNA, 25 bp, Mus musculus
gggctcccgttctggtgacagccag

SEQ ID NO: 269984 - DNA, 25 bp, Mus musculus
tctggtgacagccaggctggaagtc

SEQ ID NO: 269985 - DNA, 25 bp, Mus musculus
agccaggctggaagtcccaagagga

SEQ ID NO: 269986 - DNA, 25 bp, Mus musculus
gaaagggtcgctccgaggcctcttg

SEQ ID NO: 269987 - DNA, 25 bp, Mus musculus
aagcgctggtactctgggccgcact

SEQ ID NO: 269988 - DNA, 25 bp, Mus musculus
cctcaagcgctggtactctgggccg

SEQ ID NO: 269989 - DNA, 25 bp, Mus musculus
aggagtgagcgtcaaacgggctctg

SEQ ID NO: 269990 - DNA, 25 bp, Mus musculus
cgggtgactgacatatcatctcatc

SEQ ID NO: 269991 - DNA, 25 bp, Mus musculus
cgcagcgctcttaggatttgaagcg

SEQ ID NO: 269992 - DNA, 25 bp, Mus musculus
cttaggatttgaagcgtcctgatcc

SEQ ID NO: 269993 - DNA, 25 bp, Mus musculus
tttgaagcgtcctgatcctggaggc

SEQ ID NO: 269994 - DNA, 25 bp, Mus musculus
atcctggaggcttgcacgccgcgct

SEQ ID NO: 269995 - DNA, 25 bp, Mus musculus
cgactctgggacacattcgcccgaa

SEQ ID NO: 269996 - DNA, 25 bp, Mus musculus
gtgtgcgggtgactgacatatcatc

SEQ ID NO: 269997 - DNA, 25 bp, Mus musculus
gacatatcatctcatctcttcgact

SEQ ID NO: 269998 - DNA, 25 bp, Mus musculus
ctcttcgactctccatgagctcatg

SEQ ID NO: 269999 - DNA, 25 bp, Mus musculus
gactctccatgagctcatgaacctg

SEQ ID NO: 270000 - DNA, 25 bp, Mus musculus
tcatgaacctgggagcaggtccacg

SEQ ID NO: 270001 - DNA, 25 bp, Mus musculus
caggtccacggcaatggcgcggcct

SEQ ID NO: 270002 - DNA, 25 bp, Mus musculus
caatggcgcggcctctgagcgacag

SEQ ID NO: 270003 - DNA, 25 bp, Mus musculus
attcgcccgaaccactggagtgtgc

SEQ ID NO: 270004 - DNA, 25 bp, Mus musculus
taaggactcccacggtctcgaccag

SEQ ID NO: 270005 - DNA, 25 bp, Mus musculus
ggcttcttaccaggcggcaggacat

SEQ ID NO: 270006 - DNA, 25 bp, Mus musculus
cttaccaggcggcaggacatggcga

SEQ ID NO: 270007 - DNA, 25 bp, Mus musculus
tctcacaaccacaacaacatggcgg

SEQ ID NO: 270008 - DNA, 25 bp, Mus musculus
agcgcgctcccgagaccgatcggag

SEQ ID NO: 270009 - DNA, 25 bp, Mus musculus
cccgagaccgatcggagctgagagc

SEQ ID NO: 270010 - DNA, 25 bp, Mus musculus
actccgagtgttacccaccgccagg

SEQ ID NO: 270011 - DNA, 25 bp, Mus musculus
ggccacacgctcacctcccggaggc

SEQ ID NO: 270012 - DNA, 25 bp, Mus musculus
cgggcctcggtgctccattctgaga

SEQ ID NO: 270013 - DNA, 25 bp, Mus musculus
ccggcctctcgccactaaggactcc

SEQ ID NO: 270014 - DNA, 25 bp, Mus musculus
tggtttccaacagcacgacctccgg

SEQ ID NO: 270015 - DNA, 25 bp, Mus musculus
tcgcccgtggtttccaacagcacga

SEQ ID NO: 270016 - DNA, 25 bp, Mus musculus
caccgccaggttcaggatggccgcc

SEQ ID NO: 270017 - DNA, 25 bp, Mus musculus
gccgcagctcccaacactccgagtg

SEQ ID NO: 270018 - DNA, 25 bp, Mus musculus
ctttttgcgccgctgctgtgggaac

SEQ ID NO: 270019 - DNA, 25 bp, Mus musculus
ctgtcgccggcaccctctccagcgc

SEQ ID NO: 270020 - DNA, 25 bp, Mus musculus
tggagcacgggctaccgccgagccc

SEQ ID NO: 270021 - DNA, 25 bp, Mus musculus
tggacgccttcttgctggagcacgg

SEQ ID NO: 270022 - DNA, 25 bp, Mus musculus
acctggacgccttcttgctggagca

SEQ ID NO: 270023 - DNA, 25 bp, Mus musculus
acgtggaatacgtggacctggacgc

SEQ ID NO: 270024 - DNA, 25 bp, Mus musculus
gcactttgcctttcggggacgtgga

SEQ ID NO: 270025 - DNA, 25 bp, Mus musculus
acgcactttgcctttcggggacgtg

SEQ ID NO: 270026 - DNA, 25 bp, Mus musculus
tggctggcccgagtctttttgcgcc

SEQ ID NO: 270027 - DNA, 25 bp, Mus musculus
ctgctgtgggaacgcactttgcctt

SEQ ID NO: 270028 - DNA, 25 bp, Mus musculus
ggcccggctcttgcagctcctcttc

SEQ ID NO: 270029 - DNA, 25 bp, Mus musculus
ccgagtctttttgcgccgctgctgt

SEQ ID NO: 270030 - DNA, 25 bp, Mus musculus
tgtgggaacgcactttgcctttcgg

SEQ ID NO: 270031 - DNA, 25 bp, Mus musculus
cctggaaacggcgggcccagccgat

SEQ ID NO: 270032 - DNA, 25 bp, Mus musculus
tgtcctcggggctacggctctgcag

SEQ ID NO: 270033 - DNA, 25 bp, Mus musculus
agactagaccatctcggggccgggc

SEQ ID NO: 270034 - DNA, 25 bp, Mus musculus
tcgctgtatgtgtagggcttgtgtt

SEQ ID NO: 270035 - DNA, 25 bp, Mus musculus
tccagagagactagaccatctcggg

SEQ ID NO: 270036 - DNA, 25 bp, Mus musculus
cctcatccagagagactagaccatc

SEQ ID NO: 270037 - DNA, 25 bp, Mus musculus
cccgagacctcatccagagagacta

SEQ ID NO: 270038 - DNA, 25 bp, Mus musculus
tctgcagggtgccacagcccgagac

SEQ ID NO: 270039 - DNA, 25 bp, Mus musculus
cgtagtcgctgtatgtgtagggctt

SEQ ID NO: 270040 - DNA, 25 bp, Mus musculus
taggctgcagtgtcctcggggctac

SEQ ID NO: 270041 - DNA, 25 bp, Mus musculus
cacgtgggtaggtgtagatgcagaa

SEQ ID NO: 270042 - DNA, 25 bp, Mus musculus
ctggctttgggcgtagtcgctgtat

SEQ ID NO: 270043 - DNA, 25 bp, Mus musculus
aaggtccgcgtagctctgcgccggc

SEQ ID NO: 270044 - DNA, 25 bp, Mus musculus
cgcccggaaggtccgcgtagctctg

SEQ ID NO: 270045 - DNA, 25 bp, Mus musculus
cagcccgagacctcatccagagaga

SEQ ID NO: 270046 - DNA, 25 bp, Mus musculus
gatctgagtctctatcccggggcca

SEQ ID NO: 270047 - DNA, 25 bp, Mus musculus
ctatcccggggccagacctggttgc

SEQ ID NO: 270048 - DNA, 25 bp, Mus musculus
gccagacctggttgccgttcccaga

SEQ ID NO: 270049 - DNA, 25 bp, Mus musculus
cctggttgccgttcccagatttctc

SEQ ID NO: 270050 - DNA, 25 bp, Mus musculus
agatttctcccagtacttcgcacca

SEQ ID NO: 270051 - DNA, 25 bp, Mus musculus
tacttcgcaccaggcctgagtgtcc

SEQ ID NO: 270052 - DNA, 25 bp, Mus musculus
gcaacctgcgtgcacgctgcgtcgt

SEQ ID NO: 270053 - DNA, 25 bp, Mus musculus
gtgcgtccgtccagccaatggctgc

SEQ ID NO: 270054 - DNA, 25 bp, Mus musculus
gaatccgagccgcaccaatgagagg

SEQ ID NO: 270055 - DNA, 25 bp, Mus musculus
cgagccgcaccaatgagaggacagg

SEQ ID NO: 270056 - DNA, 25 bp, Mus musculus
gaggcatccgccttcataactacgc

SEQ ID NO: 270057 - DNA, 25 bp, Mus musculus
ccttcataactacgcgccggggcta

SEQ ID NO: 270058 - DNA, 25 bp, Mus musculus
ggccgcaacgcaggaccagatctga

SEQ ID NO: 270059 - DNA, 25 bp, Mus musculus
acgcaggaccagatctgagtctcta

SEQ ID NO: 270060 - DNA, 25 bp, Mus musculus
ctctttggttctggaagcctcggtt

SEQ ID NO: 270061 - DNA, 25 bp, Mus musculus
tcggtttactcggtcctcccacata

SEQ ID NO: 270062 - DNA, 25 bp, Mus musculus
ccaaattgtggtagagctccgcgtc

SEQ ID NO: 270063 - DNA, 25 bp, Mus musculus
tcctcaggctgacttctctttggtt

SEQ ID NO: 270064 - DNA, 25 bp, Mus musculus
tgtctctgattctccggtcccttta

SEQ ID NO: 270065 - DNA, 25 bp, Mus musculus
tcgtccagcaagctccgatcatgtc

SEQ ID NO: 270066 - DNA, 25 bp, Mus musculus
tcgcgctcatgtgacgtcacccgtg

SEQ ID NO: 270067 - DNA, 25 bp, Mus musculus
ccagttccggatagagtgtcccgca

SEQ ID NO: 270068 - DNA, 25 bp, Mus musculus
tcccgcattgcgtcacgagtgcgtc

SEQ ID NO: 270069 - DNA, 25 bp, Mus musculus
atcatggtaagctcgctgagcggtc

SEQ ID NO: 270070 - DNA, 25 bp, Mus musculus
caagtcccgctcgtagcgcgacgga

SEQ ID NO: 270071 - DNA, 25 bp, Mus musculus
ggctagggccttcgatcagaacttg

SEQ ID NO: 270072 - DNA, 25 bp, Mus musculus
gtgcaccacagagacgccagttccg

SEQ ID NO: 270073 - DNA, 25 bp, Mus musculus
tgcggccagagagtcaccacgcgac

SEQ ID NO: 270074 - DNA, 25 bp, Mus musculus
accaacgggtctgcagggccaggga

SEQ ID NO: 270075 - DNA, 25 bp, Mus musculus
gcgcactcatcctcctggcggccgt

SEQ ID NO: 270076 - DNA, 25 bp, Mus musculus
cacccgggtgagtatgtccagccgt

SEQ ID NO: 270077 - DNA, 25 bp, Mus musculus
tgagtatgtccagccgtccgcggcc

SEQ ID NO: 270078 - DNA, 25 bp, Mus musculus
acctgtgcgcagtccctggggacca

SEQ ID NO: 270079 - DNA, 25 bp, Mus musculus
tccctggggaccaacgggtctgcag

SEQ ID NO: 270080 - DNA, 25 bp, Mus musculus
cgagtgcgtgcttgtgagcgtgcat

SEQ ID NO: 270081 - DNA, 25 bp, Mus musculus
cacgcgagtgcacacgggtgcgcgg

SEQ ID NO: 270082 - DNA, 25 bp, Mus musculus
gagcgtgcatgtgagctcatgtgca

SEQ ID NO: 270083 - DNA, 25 bp, Mus musculus
tgcatgtgagctcatgtgcacgcga

SEQ ID NO: 270084 - DNA, 25 bp, Mus musculus
gtgagctcatgtgcacgcgagtgca

SEQ ID NO: 270085 - DNA, 25 bp, Mus musculus
gagctcatgtgcacgcgagtgcaca

SEQ ID NO: 270086 - DNA, 25 bp, Mus musculus
cagcgcacccgggtgagtatgtcca

SEQ ID NO: 270087 - DNA, 25 bp, Mus musculus
tgtgcgcagtccctggggaccaacg

SEQ ID NO: 270088 - DNA, 25 bp, Mus musculus
cgcggaaggactcactacaggatgc

SEQ ID NO: 270089 - DNA, 25 bp, Mus musculus
cgggtgcccaaaggatctcggcaaa

SEQ ID NO: 270090 - DNA, 25 bp, Mus musculus
aacctccgagaacagcggggctcga

SEQ ID NO: 270091 - DNA, 25 bp, Mus musculus
gctcgagacaaggacgccctaagta

SEQ ID NO: 270092 - DNA, 25 bp, Mus musculus
aggacgccctaagtaacgagcagga

SEQ ID NO: 270093 - DNA, 25 bp, Mus musculus
acgagcaggaaagagggacagcctc

SEQ ID NO: 270094 - DNA, 25 bp, Mus musculus
agcagcgcggagagcatctacacca

SEQ ID NO: 270095 - DNA, 25 bp, Mus musculus
gcgtgaaacccaaacgctctgcacg

SEQ ID NO: 270096 - DNA, 25 bp, Mus musculus
cactcagaggggaagctaaggaaca

SEQ ID NO: 270097 - DNA, 25 bp, Mus musculus
gagggacagcctcacccgacagcag

SEQ ID NO: 270098 - DNA, 25 bp, Mus musculus
cggccatggtcgcaacaactgcgca

SEQ ID NO: 270099 - DNA, 25 bp, Mus musculus
gcagatcctggtcctgcgacgcgca

SEQ ID NO: 270100 - DNA, 25 bp, Mus musculus
cctcccgcaagacactcagagggga

SEQ ID NO: 270101 - DNA, 25 bp, Mus musculus
agcatctacaccagccagtcaggga

SEQ ID NO: 270102 - DNA, 25 bp, Mus musculus
cccaggagaagccaacctttgtagt

SEQ ID NO: 270103 - DNA, 25 bp, Mus musculus
ccaggctccggcctatcgtctccgg

SEQ ID NO: 270104 - DNA, 25 bp, Mus musculus
ccagtccaggctccggcctatcgtc

SEQ ID NO: 270105 - DNA, 25 bp, Mus musculus
cctggccagtccaggctccggccta

SEQ ID NO: 270106 - DNA, 25 bp, Mus musculus
tcggccctggccagtccaggctccg

SEQ ID NO: 270107 - DNA, 25 bp, Mus musculus
cccgtcggccctggccagtccaggc

SEQ ID NO: 270108 - DNA, 25 bp, Mus musculus
cggcctatcgtctccgggccccaag

SEQ ID NO: 270109 - DNA, 25 bp, Mus musculus
gggacagcggctacgagaccgagac

SEQ ID NO: 270110 - DNA, 25 bp, Mus musculus
ctcccagggtcccaggagaagccaa

SEQ ID NO: 270111 - DNA, 25 bp, Mus musculus
tcccagggtcccaggagaagccaac

SEQ ID NO: 270112 - DNA, 25 bp, Mus musculus
ccagggtcccaggagaagccaacct

SEQ ID NO: 270113 - DNA, 25 bp, Mus musculus
aggctccggcctatcgtctccgggc

SEQ ID NO: 270114 - DNA, 25 bp, Mus musculus
cagggtcccaggagaagccaacctt

SEQ ID NO: 270115 - DNA, 25 bp, Mus musculus
gtcccaggagaagccaacctttgta

SEQ ID NO: 270116 - DNA, 25 bp, Mus musculus
cgggaggatgtgacaaagaacctcc

SEQ ID NO: 270117 - DNA, 25 bp, Mus musculus
agcagctgctgatgtccctacggga

SEQ ID NO: 270118 - DNA, 25 bp, Mus musculus
cgagcagctgctgatgtccctacgg

SEQ ID NO: 270119 - DNA, 25 bp, Mus musculus
tgtccctacgggaggatgtgacaaa

SEQ ID NO: 270120 - DNA, 25 bp, Mus musculus
ccctacgggaggatgtgacaaagaa

SEQ ID NO: 270121 - DNA, 25 bp, Mus musculus
ctacgggaggatgtgacaaagaacc

SEQ ID NO: 270122 - DNA, 25 bp, Mus musculus
ctgatgtccctacgggaggatgtga

SEQ ID NO: 270123 - DNA, 25 bp, Mus musculus
tgacaaagaacctcctaggggacaa

SEQ ID NO: 270124 - DNA, 25 bp, Mus musculus
caccgagcagctgctgatgtcccta

SEQ ID NO: 270125 - DNA, 25 bp, Mus musculus
tgagcaccgagcagctgctgatgtc

SEQ ID NO: 270126 - DNA, 25 bp, Mus musculus
ttcaggtgagcaccgagcagctgct

SEQ ID NO: 270127 - DNA, 25 bp, Mus musculus
tgtagttcaggtgagcaccgagcag

SEQ ID NO: 270128 - DNA, 25 bp, Mus musculus
ctgctgatgtccctacgggaggatg

SEQ ID NO: 270129 - DNA, 25 bp, Mus musculus
agctgctgatgtccctacgggagga

SEQ ID NO: 270130 - DNA, 25 bp, Mus musculus
ccgggaccgagtggagagtccacga

SEQ ID NO: 270131 - DNA, 25 bp, Mus musculus
caaaggccggatgggtagacaactc

SEQ ID NO: 270132 - DNA, 25 bp, Mus musculus
gcaaaggccggatgggtagacaact

SEQ ID NO: 270133 - DNA, 25 bp, Mus musculus
acgcaaaggccggatgggtagacaa

SEQ ID NO: 270134 - DNA, 25 bp, Mus musculus
cgcaagcgccgtggacgcaaaggcc

SEQ ID NO: 270135 - DNA, 25 bp, Mus musculus
cccgcaagcgccgtggacgcaaagg

SEQ ID NO: 270136 - DNA, 25 bp, Mus musculus
accgagtggagagtccacgagagtg

SEQ ID NO: 270137 - DNA, 25 bp, Mus musculus
ttggcccagcccccaagagcgggaa

SEQ ID NO: 270138 - DNA, 25 bp, Mus musculus
gagatggcccctggccagcttggcc

SEQ ID NO: 270139 - DNA, 25 bp, Mus musculus
gccttgccccagaacggcttggaga

SEQ ID NO: 270140 - DNA, 25 bp, Mus musculus
gagaccctgctggatcgagcccctg

SEQ ID NO: 270141 - DNA, 25 bp, Mus musculus
ggtctagctcccgagaccctgctgg

SEQ ID NO: 270142 - DNA, 25 bp, Mus musculus
ccgagactgggggtctagctcccga

SEQ ID NO: 270143 - DNA, 25 bp, Mus musculus
ggctgggaagctggacctcgggagt

SEQ ID NO: 270144 - DNA, 25 bp, Mus musculus
gtcccgcgcgctgaaagaagcctcg

SEQ ID NO: 270145 - DNA, 25 bp, Mus musculus
tgaaagaagcctcgccactgccctg

SEQ ID NO: 270146 - DNA, 25 bp, Mus musculus
gcctcgcccggcctaccgtagacac

SEQ ID NO: 270147 - DNA, 25 bp, Mus musculus
accgtcctccatggcggctaggaag

SEQ ID NO: 270148 - DNA, 25 bp, Mus musculus
cccggctctcgaccgcgccggaagc

SEQ ID NO: 270149 - DNA, 25 bp, Mus musculus
gggctcgagtgagcccgctcaaacg

SEQ ID NO: 270150 - DNA, 25 bp, Mus musculus
ctccatggcggctaggaaggcccgc

SEQ ID NO: 270151 - DNA, 25 bp, Mus musculus
cggaagcgggctcggcccaaacaat

SEQ ID NO: 270152 - DNA, 25 bp, Mus musculus
caggaagaaagccaggccgccgctc

SEQ ID NO: 270153 - DNA, 25 bp, Mus musculus
aggtccgcaggaagaaagccaggcc

SEQ ID NO: 270154 - DNA, 25 bp, Mus musculus
cgttaagcctaggtccgcaggaaga

SEQ ID NO: 270155 - DNA, 25 bp, Mus musculus
agactctcccttcacggcccaaccg

SEQ ID NO: 270156 - DNA, 25 bp, Mus musculus
gcgcccgtcctcagcgccgaaaaga

SEQ ID NO: 270157 - DNA, 25 bp, Mus musculus
ggacggcgttaagcctaggtccgca

SEQ ID NO: 270158 - DNA, 25 bp, Mus musculus
ggaagctggccacttgcgagaaaca

SEQ ID NO: 270159 - DNA, 25 bp, Mus musculus
gtgacgctgcgcacaccatagccta

SEQ ID NO: 270160 - DNA, 25 bp, Mus musculus
acacatgtggtgaacaggtcactta

SEQ ID NO: 270161 - DNA, 25 bp, Mus musculus
atcttttttgacgaagcgcccgcgg

SEQ ID NO: 270162 - DNA, 25 bp, Mus musculus
gcgcacattgcagtgcccatctttt

SEQ ID NO: 270163 - DNA, 25 bp, Mus musculus
catagcctatggacgtctgtgtctc

SEQ ID NO: 270164 - DNA, 25 bp, Mus musculus
cgtcgagcacacagcctgcgatgca

SEQ ID NO: 270165 - DNA, 25 bp, Mus musculus
ttggccataactgcacccacgacga

SEQ ID NO: 270166 - DNA, 25 bp, Mus musculus
gcgtttcttgggcttggccatcttg

SEQ ID NO: 270167 - DNA, 25 bp, Mus musculus
gactagtgtctcgttgcgtttcttg

SEQ ID NO: 270168 - DNA, 25 bp, Mus musculus
gccaccactgcgttctcactgaaga

SEQ ID NO: 270169 - DNA, 25 bp, Mus musculus
cagagacggtggtctcgcagagcca

SEQ ID NO: 270170 - DNA, 25 bp, Mus musculus
tgagcttccaccaggtgactgcgtc

SEQ ID NO: 270171 - DNA, 25 bp, Mus musculus
gccagcgcacgtccacacatgtggt

SEQ ID NO: 270172 - DNA, 25 bp, Mus musculus
cgccatcttgggtcaaggcctcatg

SEQ ID NO: 270173 - DNA, 25 bp, Mus musculus
gagcatgctcagtaacgcgctaagc

SEQ ID NO: 270174 - DNA, 25 bp, Mus musculus
ggctcttagagcaatccttgccttc

SEQ ID NO: 270175 - DNA, 25 bp, Mus musculus
accgcacgcgtacttgcttatgttg

SEQ ID NO: 270176 - DNA, 25 bp, Mus musculus
gcttatgttgtcactgacgttcgcc

SEQ ID NO: 270177 - DNA, 25 bp, Mus musculus
tgtggaccagactgccaagtgaggc

SEQ ID NO: 270178 - DNA, 25 bp, Mus musculus
ccaagtgaggcggagcttttaacta

SEQ ID NO: 270179 - DNA, 25 bp, Mus musculus
cgctaagggttttgtccgccatctt

SEQ ID NO: 270180 - DNA, 25 bp, Mus musculus
tgcgcacatgcgtctctgagcaagg

SEQ ID NO: 270181 - DNA, 25 bp, Mus musculus
cttggatcagggcagctcagtcgac

SEQ ID NO: 270182 - DNA, 25 bp, Mus musculus
ctgccgacctgacgcaagtgacgga

SEQ ID NO: 270183 - DNA, 25 bp, Mus musculus
tagccgagactgctcactgcgcatg

SEQ ID NO: 270184 - DNA, 25 bp, Mus musculus
aagtgacggaagactgagcatgctc

SEQ ID NO: 270185 - DNA, 25 bp, Mus musculus
actgcgcatgcgtacatgttcccgc

SEQ ID NO: 270186 - DNA, 25 bp, Mus musculus
cggacgcgaagtgagagcgtcactt

SEQ ID NO: 270187 - DNA, 25 bp, Mus musculus
caggtttcagcctccatgggttctc

SEQ ID NO: 270188 - DNA, 25 bp, Mus musculus
gactccggcccttgcgcgccgccat

SEQ ID NO: 270189 - DNA, 25 bp, Mus musculus
tccggtttcacacgtgcgactccgg

SEQ ID NO: 270190 - DNA, 25 bp, Mus musculus
atgggttctccggtttcacacgtgc

SEQ ID NO: 270191 - DNA, 25 bp, Mus musculus
cctccatgggttctccggtttcaca

SEQ ID NO: 270192 - DNA, 25 bp, Mus musculus
ttcctgggtcgcaggtttcagcctc

SEQ ID NO: 270193 - DNA, 25 bp, Mus musculus
atgggccttcggttcctgggtcgca

SEQ ID NO: 270194 - DNA, 25 bp, Mus musculus
ccctctgccgggcaggtagacctgg

SEQ ID NO: 270195 - DNA, 25 bp, Mus musculus
cagcacgtaggcctcttcatccatt

SEQ ID NO: 270196 - DNA, 25 bp, Mus musculus
cgcacgatggtacagcacgtaggcc

SEQ ID NO: 270197 - DNA, 25 bp, Mus musculus
ctctccctcgctcagtggcggccct

SEQ ID NO: 270198 - DNA, 25 bp, Mus musculus
atggtacagcacgtaggcctcttca

SEQ ID NO: 270199 - DNA, 25 bp, Mus musculus
tagacctgggatgggccttcggttc

SEQ ID NO: 270200 - DNA, 25 bp, Mus musculus
gaagtcggcgaaccaccagggctcc

SEQ ID NO: 270201 - DNA, 25 bp, Mus musculus
tgcggtcgcggacaaccacagcgcg

SEQ ID NO: 270202 - DNA, 25 bp, Mus musculus
cctcggagtccgaaggctaaggctc

SEQ ID NO: 270203 - DNA, 25 bp, Mus musculus
ggctctcctaatcctcggagtccga

SEQ ID NO: 270204 - DNA, 25 bp, Mus musculus
agggctccaggccaccgagcgacgc

SEQ ID NO: 270205 - DNA, 25 bp, Mus musculus
gcccgaggcgctccgcatacgggta

SEQ ID NO: 270206 - DNA, 25 bp, Mus musculus
tcaaccgaccagtagcggccgggcg

SEQ ID NO: 270207 - DNA, 25 bp, Mus musculus
ttgtcaaccgaccagtagcggccgg

SEQ ID NO: 270208 - DNA, 25 bp, Mus musculus
cccgagcttgtcaaccgaccagtag

SEQ ID NO: 270209 - DNA, 25 bp, Mus musculus
gcaggtagtcccagctaccagcgcg

SEQ ID NO: 270210 - DNA, 25 bp, Mus musculus
tctaggccgtcgtgcgagcagctga

SEQ ID NO: 270211 - DNA, 25 bp, Mus musculus
agccaccgtctaggccgtcgtgcga

SEQ ID NO: 270212 - DNA, 25 bp, Mus musculus
gaggcgcccaccagccaccgtctag

SEQ ID NO: 270213 - DNA, 25 bp, Mus musculus
ccgagcgacgctccgcccaggctct

SEQ ID NO: 270214 - DNA, 25 bp, Mus musculus
ctcgcgcacgatggcgaagtaggaa

SEQ ID NO: 270215 - DNA, 25 bp, Mus musculus
ccctgtgcccttggcccggcgccag

SEQ ID NO: 270216 - DNA, 25 bp, Mus musculus
gaagccgtcggctagcgctgcgccc

SEQ ID NO: 270217 - DNA, 25 bp, Mus musculus
tagtatcggtggaagccgtcggcta

SEQ ID NO: 270218 - DNA, 25 bp, Mus musculus
ctgcggctcgatggggccgtagtat

SEQ ID NO: 270219 - DNA, 25 bp, Mus musculus
cgaagtaggaaggtggtggcttctg

SEQ ID NO: 270220 - DNA, 25 bp, Mus musculus
cttgctcgcgcacgatggcgaagta

SEQ ID NO: 270221 - DNA, 25 bp, Mus musculus
ggccggctcttgctcgcgcacgatg

SEQ ID NO: 270222 - DNA, 25 bp, Mus musculus
cctcgaaagccaggcggcacagtgg

SEQ ID NO: 270223 - DNA, 25 bp, Mus musculus
tcgtcctcgaaagccaggcggcaca

SEQ ID NO: 270224 - DNA, 25 bp, Mus musculus
gctctcgtcctcgaaagccaggcgg

SEQ ID NO: 270225 - DNA, 25 bp, Mus musculus
ggcgggctctcgtcctcgaaagcca

SEQ ID NO: 270226 - DNA, 25 bp, Mus musculus
ggctctcggggtcagaacgcggcca

SEQ ID NO: 270227 - DNA, 25 bp, Mus musculus
acagtgggcgtccggctgcgcctct

SEQ ID NO: 270228 - DNA, 25 bp, Mus musculus
cctcgacgaacctcccgcctcaagt

SEQ ID NO: 270229 - DNA, 25 bp, Mus musculus
cacctcctccgggaacgggctggcg

SEQ ID NO: 270230 - DNA, 25 bp, Mus musculus
agtcaatcaaaactacgtccgatcc

SEQ ID NO: 270231 - DNA, 25 bp, Mus musculus
tcaaaactacgtccgatccaagacc

SEQ ID NO: 270232 - DNA, 25 bp, Mus musculus
tcgcgcgcaccttgggtgtgagtac

SEQ ID NO: 270233 - DNA, 25 bp, Mus musculus
ctgcgccgacaggaagtcgagaatg

SEQ ID NO: 270234 - DNA, 25 bp, Mus musculus
agtcgtcctcgaacaccacgccgtg

SEQ ID NO: 270235 - DNA, 25 bp, Mus musculus
cagcaggtcgcagagctgcagcaca

SEQ ID NO: 270236 - DNA, 25 bp, Mus musculus
tcgcagagctgcagcacaaggctgc

SEQ ID NO: 270237 - DNA, 25 bp, Mus musculus
tcggagccgttgagcaccagcgcca

SEQ ID NO: 270238 - DNA, 25 bp, Mus musculus
agccgttgagcaccagcgccacggg

SEQ ID NO: 270239 - DNA, 25 bp, Mus musculus
tcccgcctcaagtcaatcaaaacta

SEQ ID NO: 270240 - DNA, 25 bp, Mus musculus
aagaccagcgccacgttgagcggcc

SEQ ID NO: 270241 - DNA, 25 bp, Mus musculus
gtacgccgggccagagaagaccagc

SEQ ID NO: 270242 - DNA, 25 bp, Mus musculus
tccttgaagggtcgaggctcagaga

SEQ ID NO: 270243 - DNA, 25 bp, Mus musculus
cgtttgggtccacccaccaggagcg

SEQ ID NO: 270244 - DNA, 25 bp, Mus musculus
ctatgtcgaggatgcgtttgggtcc

SEQ ID NO: 270245 - DNA, 25 bp, Mus musculus
agctccaccgctatgtcgaggatgc

SEQ ID NO: 270246 - DNA, 25 bp, Mus musculus
gtgtgcccttgcaggagctccaccg

SEQ ID NO: 270247 - DNA, 25 bp, Mus musculus
cgctctctgaggctggtgtgccctt

SEQ ID NO: 270248 - DNA, 25 bp, Mus musculus
gcagtgctgtttggtcgctctgtgc

SEQ ID NO: 270249 - DNA, 25 bp, Mus musculus
tatcccagtagtccttgaagggtcg

SEQ ID NO: 270250 - DNA, 25 bp, Mus musculus
ggtgagcgatatcccagtagtcctt

SEQ ID NO: 270251 - DNA, 25 bp, Mus musculus
tgtgtttttggggtgagcgatatcc

SEQ ID NO: 270252 - DNA, 25 bp, Mus musculus
agtctgagtcaagccgcagggtcca

SEQ ID NO: 270253 - DNA, 25 bp, Mus musculus
agggaccgagtctgagtcaagccgc

SEQ ID NO: 270254 - DNA, 25 bp, Mus musculus
cgctctgtgcgctggcttgcgctct

SEQ ID NO: 270255 - DNA, 25 bp, Mus musculus
ccgcagggtccagattgtgtgtttt

SEQ ID NO: 270256 - DNA, 25 bp, Mus musculus
cagagtcctccaggacgccagaggc

SEQ ID NO: 270257 - DNA, 25 bp, Mus musculus
aggctctcggctgctctgcactctt

SEQ ID NO: 270258 - DNA, 25 bp, Mus musculus
ctggatgacccttggccaggctctc

SEQ ID NO: 270259 - DNA, 25 bp, Mus musculus
actactcgctcatcgaggtgagccc

SEQ ID NO: 270260 - DNA, 25 bp, Mus musculus
tggagatcaactactcgctcatcga

SEQ ID NO: 270261 - DNA, 25 bp, Mus musculus
ttcgtgaagtcggacgtggagatca

SEQ ID NO: 270262 - DNA, 25 bp, Mus musculus
ctccgaggacatcgtggtaggctgc

SEQ ID NO: 270263 - DNA, 25 bp, Mus musculus
atcggctccgaggacatcgtggtag

SEQ ID NO: 270264 - DNA, 25 bp, Mus musculus
gcgcgcgatcggctccgaggacatc

SEQ ID NO: 270265 - DNA, 25 bp, Mus musculus
cgggtcctgggcttgtcagcccagc

SEQ ID NO: 270266 - DNA, 25 bp, Mus musculus
atcgcgtgtcgcgtcggtctttctt

SEQ ID NO: 270267 - DNA, 25 bp, Mus musculus
tcattccgggcggatcgcgtgtcgc

SEQ ID NO: 270268 - DNA, 25 bp, Mus musculus
aagcggccatcattccgggcggatc

SEQ ID NO: 270269 - DNA, 25 bp, Mus musculus
cgccagaggcgcaagcggccatcat

SEQ ID NO: 270270 - DNA, 25 bp, Mus musculus
gcgccacttctacggacccgggaga

SEQ ID NO: 270271 - DNA, 25 bp, Mus musculus
ggggcagcacccatcttctgtttta

SEQ ID NO: 270272 - DNA, 25 bp, Mus musculus
cccatcttctgttttatttgcaacc

SEQ ID NO: 270273 - DNA, 25 bp, Mus musculus
tccgcaatcgtagcgctgcgtgaaa

SEQ ID NO: 270274 - DNA, 25 bp, Mus musculus
tgtctttccgcaatcgtagcgctgc

SEQ ID NO: 270275 - DNA, 25 bp, Mus musculus
agcgccattgtgtctttccgcaatc

SEQ ID NO: 270276 - DNA, 25 bp, Mus musculus
accgacgggcgagcgccattgtgtc

SEQ ID NO: 270277 - DNA, 25 bp, Mus musculus
gtccgaacaaatcctaaggaagaca

SEQ ID NO: 270278 - DNA, 25 bp, Mus musculus
agctggcgcagttcgggacaagacc

SEQ ID NO: 270279 - DNA, 25 bp, Mus musculus
caacaggacaaacgccgcctaactg

SEQ ID NO: 270280 - DNA, 25 bp, Mus musculus
acctctggaacccagtgtcggcttc

SEQ ID NO: 270281 - DNA, 25 bp, Mus musculus
tatttgcaacctctggaacccagtg

SEQ ID NO: 270282 - DNA, 25 bp, Mus musculus
cgtttgtggcgccacttctacggac

SEQ ID NO: 270283 - DNA, 25 bp, Mus musculus
agttgtagtccggactcgtgagctg

SEQ ID NO: 270284 - DNA, 25 bp, Mus musculus
tagaggtgggcctagacgcaagccc

SEQ ID NO: 270285 - DNA, 25 bp, Mus musculus
gctcccgagagcgagtgcagcctcc

SEQ ID NO: 270286 - DNA, 25 bp, Mus musculus
cgggttgctcactcccggccggctt

SEQ ID NO: 270287 - DNA, 25 bp, Mus musculus
cttccctggcgtgtgtctgtgagcc

SEQ ID NO: 270288 - DNA, 25 bp, Mus musculus
cggccggcttccctggcgtgtgtct

SEQ ID NO: 270289 - DNA, 25 bp, Mus musculus
ccctggcgtgtgtctgtgagcccgt

SEQ ID NO: 270290 - DNA, 25 bp, Mus musculus
gcgtgtgtctgtgagcccgtcctca

SEQ ID NO: 270291 - DNA, 25 bp, Mus musculus
gtgtgtctgtgagcccgtcctcagg

SEQ ID NO: 270292 - DNA, 25 bp, Mus musculus
ctgtgagcccgtcctcaggcaccga

SEQ ID NO: 270293 - DNA, 25 bp, Mus musculus
gccagagggcgccagatcggctcct

SEQ ID NO: 270294 - DNA, 25 bp, Mus musculus
cagagggcgccagatcggctcctga

SEQ ID NO: 270295 - DNA, 25 bp, Mus musculus
cgccagatcggctcctgagaggtag

SEQ ID NO: 270296 - DNA, 25 bp, Mus musculus
ccagatcggctcctgagaggtagag

SEQ ID NO: 270297 - DNA, 25 bp, Mus musculus
ctcaggcaccgacccgtgcgcggtg

SEQ ID NO: 270298 - DNA, 25 bp, Mus musculus
cgcgcgctcaccgatgaagaggatg

SEQ ID NO: 270299 - DNA, 25 bp, Mus musculus
tggggtctcacccaatgcgcacgtg

SEQ ID NO: 270300 - DNA, 25 bp, Mus musculus
ccgagtggttctcggtgccgcagaa

SEQ ID NO: 270301 - DNA, 25 bp, Mus musculus
agccgttgttgaggacaccttggtc

SEQ ID NO: 270302 - DNA, 25 bp, Mus musculus
gcgtccacgaagcagccgttgttga

SEQ ID NO: 270303 - DNA, 25 bp, Mus musculus
tgaagagcaggaagacatgtggcac

SEQ ID NO: 270304 - DNA, 25 bp, Mus musculus
acccaggaagaccagcaagccggtg

SEQ ID NO: 270305 - DNA, 25 bp, Mus musculus
cccatcgtgtctggcgcgagttcaa

SEQ ID NO: 270306 - DNA, 25 bp, Mus musculus
ggatccctaaggtcgctagcgccca

SEQ ID NO: 270307 - DNA, 25 bp, Mus musculus
tcaggctctgcggtagcaaaacttg

SEQ ID NO: 270308 - DNA, 25 bp, Mus musculus
aaccaagatgatccgggtgagcccg

SEQ ID NO: 270309 - DNA, 25 bp, Mus musculus
catgtggcactacgttgagcgcgtc

SEQ ID NO: 270310 - DNA, 25 bp, Mus musculus
gtcactcagggtgaggccgattccc

SEQ ID NO: 270311 - DNA, 25 bp, Mus musculus
aggccgattccctcgcgtgcagagc

SEQ ID NO: 270312 - DNA, 25 bp, Mus musculus
cgcccgacaactggctccctcccgc

SEQ ID NO: 270313 - DNA, 25 bp, Mus musculus
ggccagggattaggggcagtggccg

SEQ ID NO: 270314 - DNA, 25 bp, Mus musculus
ccgcagggctaatgctgtgtgaccg

SEQ ID NO: 270315 - DNA, 25 bp, Mus musculus
gcagggctaatgctgtgtgaccgct

SEQ ID NO: 270316 - DNA, 25 bp, Mus musculus
agggctaatgctgtgtgaccgctgt

SEQ ID NO: 270317 - DNA, 25 bp, Mus musculus
gctaatgctgtgtgaccgctgtcgc

SEQ ID NO: 270318 - DNA, 25 bp, Mus musculus
tcaggccgggcttagcagggcgggc

SEQ ID NO: 270319 - DNA, 25 bp, Mus musculus
taatgctgtgtgaccgctgtcgccc

SEQ ID NO: 270320 - DNA, 25 bp, Mus musculus
cagctgtggcattgctcaggccggg

SEQ ID NO: 270321 - DNA, 25 bp, Mus musculus
tagggctgtgggctcgttagccctc

SEQ ID NO: 270322 - DNA, 25 bp, Mus musculus
ctgtgggctcgttagccctcgccgg

SEQ ID NO: 270323 - DNA, 25 bp, Mus musculus
gctcgttagccctcgccggcgtgtg

SEQ ID NO: 270324 - DNA, 25 bp, Mus musculus
gggcgcacgtgtgccacggaggccc

SEQ ID NO: 270325 - DNA, 25 bp, Mus musculus
ctgttgctgatggccaccggctgcg

SEQ ID NO: 270326 - DNA, 25 bp, Mus musculus
ctcttccgggattctctgaggatta

SEQ ID NO: 270327 - DNA, 25 bp, Mus musculus
tgaggattacctgagacgaccgatg

SEQ ID NO: 270328 - DNA, 25 bp, Mus musculus
atacccggcgtggagaacgtcacct

SEQ ID NO: 270329 - DNA, 25 bp, Mus musculus
gtagacctggctgggacttgtccct

SEQ ID NO: 270330 - DNA, 25 bp, Mus musculus
gaccgatgtcctcggctaccgctgg

SEQ ID NO: 270331 - DNA, 25 bp, Mus musculus
acgtcaccttgctgacagtcccagg

SEQ ID NO: 270332 - DNA, 25 bp, Mus musculus
tgtcaccactgcgaaaatacccggc

SEQ ID NO: 270333 - DNA, 25 bp, Mus musculus
gccggaagtagcctgtgtcaccact

SEQ ID NO: 270334 - DNA, 25 bp, Mus musculus
cgtgcggcactcaccgttggtgtag

SEQ ID NO: 270335 - DNA, 25 bp, Mus musculus
cacagtggggacacgtggcacttcc

SEQ ID NO: 270336 - DNA, 25 bp, Mus musculus
cgtcaaagtagaggcatggcgtgtc

SEQ ID NO: 270337 - DNA, 25 bp, Mus musculus
gcccagcctaagagctccaacagga

SEQ ID NO: 270338 - DNA, 25 bp, Mus musculus
atctcagggtaagacggagccgtcg

SEQ ID NO: 270339 - DNA, 25 bp, Mus musculus
agggcacctgacagtcccgtgtccg

SEQ ID NO: 270340 - DNA, 25 bp, Mus musculus
cgacttctatgatgacccgtgtttc

SEQ ID NO: 270341 - DNA, 25 bp, Mus musculus
ctacagtggcgactcagatgcatcc

SEQ ID NO: 270342 - DNA, 25 bp, Mus musculus
tgaaaccggaggagcacgcacactt

SEQ ID NO: 270343 - DNA, 25 bp, Mus musculus
tgcaaggcgtgcaagcgcaagacca

SEQ ID NO: 270344 - DNA, 25 bp, Mus musculus
gccgccgcctgagcaaagtgaatga

SEQ ID NO: 270345 - DNA, 25 bp, Mus musculus
aatgaggccttcgagacgctcaagc

SEQ ID NO: 270346 - DNA, 25 bp, Mus musculus
aaccagcggctacccaaggtggaga

SEQ ID NO: 270347 - DNA, 25 bp, Mus musculus
gacggctctctctgctcctttgaga

SEQ ID NO: 270348 - DNA, 25 bp, Mus musculus
ccatccgctacatcgaaggtctgca

SEQ ID NO: 270349 - DNA, 25 bp, Mus musculus
acatgggagccctcctgaaaccgga

SEQ ID NO: 270350 - DNA, 25 bp, Mus musculus
tgtttcgactcaccagacctgcgct

SEQ ID NO: 270351 - DNA, 25 bp, Mus musculus
gctcctttgagacagcagacgactt

SEQ ID NO: 270352 - DNA, 25 bp, Mus musculus
ctgcgcttttttgaggacctggacc

SEQ ID NO: 270353 - DNA, 25 bp, Mus musculus
ctccgggacatagacttgacaggcc

SEQ ID NO: 270354 - DNA, 25 bp, Mus musculus
cgcggaagcctgagtcccaacgcag

SEQ ID NO: 270355 - DNA, 25 bp, Mus musculus
cagctcccatgggtgtcgctgggcc

SEQ ID NO: 270356 - DNA, 25 bp, Mus musculus
agaccctagggagcccgtgcacaca

SEQ ID NO: 270357 - DNA, 25 bp, Mus musculus
cactaggcgccttaaagaccctagg

SEQ ID NO: 270358 - DNA, 25 bp, Mus musculus
ccgctgagatgataccgggagcccg

SEQ ID NO: 270359 - DNA, 25 bp, Mus musculus
gtcggtttctccattttcccgctga

SEQ ID NO: 270360 - DNA, 25 bp, Mus musculus
cccagctggggctggtctatcggtc

SEQ ID NO: 270361 - DNA, 25 bp, Mus musculus
cgagagcgagcgcatcgtgatcaac

SEQ ID NO: 270362 - DNA, 25 bp, Mus musculus
agccaagcgcggatttctcgtaacc

SEQ ID NO: 270363 - DNA, 25 bp, Mus musculus
ggaggagagcaagccgcatccgtcc

SEQ ID NO: 270364 - DNA, 25 bp, Mus musculus
cttcacccgccaccgaggggagtag

SEQ ID NO: 270365 - DNA, 25 bp, Mus musculus
ggaggtcaggcagcttcacccgcca

SEQ ID NO: 270366 - DNA, 25 bp, Mus musculus
cagcccgagcgcacaaggtgctgcg

SEQ ID NO: 270367 - DNA, 25 bp, Mus musculus
tgagtcccaacgcagcccagcggaa

SEQ ID NO: 270368 - DNA, 25 bp, Mus musculus
cgcatcctgcgcatcttcaagctga

SEQ ID NO: 270369 - DNA, 25 bp, Mus musculus
tcgagaacgttcgaaacggcaccca

SEQ ID NO: 270370 - DNA, 25 bp, Mus musculus
ccaagtgcggtactaccgggaagca

SEQ ID NO: 270371 - DNA, 25 bp, Mus musculus
gagacggaggccttcctcacctaca

SEQ ID NO: 270372 - DNA, 25 bp, Mus musculus
ctcacctacatcgagggcgtctgcg

SEQ ID NO: 270373 - DNA, 25 bp, Mus musculus
gtctggttcaccttcgagttcctca

SEQ ID NO: 270374 - DNA, 25 bp, Mus musculus
agttcctcatgcgtgtcgtcttctg

SEQ ID NO: 270375 - DNA, 25 bp, Mus musculus
cccaacaaggtggaattcatcaaga

SEQ ID NO: 270376 - DNA, 25 bp, Mus musculus
tatcattgactttgtggccattctc

SEQ ID NO: 270377 - DNA, 25 bp, Mus musculus
cttctacctggaggtgggcctaagc

SEQ ID NO: 270378 - DNA, 25 bp, Mus musculus
gcctaagcggcctgtcctcaaaagc

SEQ ID NO: 270379 - DNA, 25 bp, Mus musculus
cccatcgtgaacaagaccgaaatcg

SEQ ID NO: 270380 - DNA, 25 bp, Mus musculus
ccaaggacgttctgggcttcctgcg

SEQ ID NO: 270381 - DNA, 25 bp, Mus musculus
ctcaaaagccgccaaggacgttctg

SEQ ID NO: 270382 - DNA, 25 bp, Mus musculus
tccctgccacccacgcagacgccgg

SEQ ID NO: 270383 - DNA, 25 bp, Mus musculus
cagacgccgggagctcccgggtctc

SEQ ID NO: 270384 - DNA, 25 bp, Mus musculus
ctcgccccttcgtctctgccctagc

SEQ ID NO: 270385 - DNA, 25 bp, Mus musculus
gcggagccacgtacccaggcgaaga

SEQ ID NO: 270386 - DNA, 25 bp, Mus musculus
gagccacgtacccaggcgaagagca

SEQ ID NO: 270387 - DNA, 25 bp, Mus musculus
gccacgtacccaggcgaagagcaca

SEQ ID NO: 270388 - DNA, 25 bp, Mus musculus
ccacccacgcagacgccgggagctc

SEQ ID NO: 270389 - DNA, 25 bp, Mus musculus
acgtacccaggcgaagagcacagca

SEQ ID NO: 270390 - DNA, 25 bp, Mus musculus
tacccaggcgaagagcacagcagcg

SEQ ID NO: 270391 - DNA, 25 bp, Mus musculus
ccaggcgaagagcacagcagcggca

SEQ ID NO: 270392 - DNA, 25 bp, Mus musculus
agacagtctcggaggcgcaggactc

SEQ ID NO: 270393 - DNA, 25 bp, Mus musculus
gacagtctcggaggcgcaggactcc

SEQ ID NO: 270394 - DNA, 25 bp, Mus musculus
ggactcccgcgccatgcacacgctc

SEQ ID NO: 270395 - DNA, 25 bp, Mus musculus
ccgcgccatgcacacgctcagccgg

SEQ ID NO: 270396 - DNA, 25 bp, Mus musculus
tgaggacgccgaagagccagtgctt

SEQ ID NO: 270397 - DNA, 25 bp, Mus musculus
caacagtaccggaagccgcggagga

SEQ ID NO: 270398 - DNA, 25 bp, Mus musculus
gacgcgccagagagcccaaggcaca

SEQ ID NO: 270399 - DNA, 25 bp, Mus musculus
atccatgccgatgcgcgccaacagt

SEQ ID NO: 270400 - DNA, 25 bp, Mus musculus
ggagacgggtttcgatccatgccga

SEQ ID NO: 270401 - DNA, 25 bp, Mus musculus
tcctccgaaccacaggtaggcggcg

SEQ ID NO: 270402 - DNA, 25 bp, Mus musculus
ccagtgcttgctgtagaccgtgctc

SEQ ID NO: 270403 - DNA, 25 bp, Mus musculus
aagttagtccatcggcacccgcgag

SEQ ID NO: 270404 - DNA, 25 bp, Mus musculus
tgtggttctggcaagttagtccatc

SEQ ID NO: 270405 - DNA, 25 bp, Mus musculus
cccagtaaagtacgtgcgcggtgtg

SEQ ID NO: 270406 - DNA, 25 bp, Mus musculus
taggaagtagaagcccagtaaagta

SEQ ID NO: 270407 - DNA, 25 bp, Mus musculus
tctcgacttcgtacgtgacagtggg

SEQ ID NO: 270408 - DNA, 25 bp, Mus musculus
acacgaatggtagggtctcgacttc

SEQ ID NO: 270409 - DNA, 25 bp, Mus musculus
gagtctccgcacctggatgagcccg

SEQ ID NO: 270410 - DNA, 25 bp, Mus musculus
gcgatcgctttcaccgagcaggctc

SEQ ID NO: 270411 - DNA, 25 bp, Mus musculus
ggcgtttccggtcacgtgccctcag

SEQ ID NO: 270412 - DNA, 25 bp, Mus musculus
ctggcaacgtcatccaggggcgcca

SEQ ID NO: 270413 - DNA, 25 bp, Mus musculus
gagcccttcgctgtagtcgtctcca

SEQ ID NO: 270414 - DNA, 25 bp, Mus musculus
ccacctggtaagttgagaccgaaga

SEQ ID NO: 270415 - DNA, 25 bp, Mus musculus
cagagaccgtagctcccacctggta

SEQ ID NO: 270416 - DNA, 25 bp, Mus musculus
agcgccctcgcagccagcgatggag

SEQ ID NO: 270417 - DNA, 25 bp, Mus musculus
tctagggagaaaggcgagccaagcc

SEQ ID NO: 270418 - DNA, 25 bp, Mus musculus
cggaccggatgctctctagggagaa

SEQ ID NO: 270419 - DNA, 25 bp, Mus musculus
gacgcaccacggagccggaccggat

SEQ ID NO: 270420 - DNA, 25 bp, Mus musculus
acggcacttcctcgtcacgtgacga

SEQ ID NO: 270421 - DNA, 25 bp, Mus musculus
aggaaagcgctgttaacggcacttc

SEQ ID NO: 270422 - DNA, 25 bp, Mus musculus
gagcaggctccacagacactcaaca

SEQ ID NO: 270423 - DNA, 25 bp, Mus musculus
aggcagatccgacgggacgcgcttc

SEQ ID NO: 270424 - DNA, 25 bp, Mus musculus
agcagccgtgcggtttgcattttcc

SEQ ID NO: 270425 - DNA, 25 bp, Mus musculus
gtcagcgcggagcttccatttaagg

SEQ ID NO: 270426 - DNA, 25 bp, Mus musculus
cgcattttgttaagaggctcgctcc

SEQ ID NO: 270427 - DNA, 25 bp, Mus musculus
tgctctgcgtgctggagccactgtc

SEQ ID NO: 270428 - DNA, 25 bp, Mus musculus
cccatcgtgcactagcggtacggtt

SEQ ID NO: 270429 - DNA, 25 bp, Mus musculus
cctgaaggttgggagccaccgaacg

SEQ ID NO: 270430 - DNA, 25 bp, Mus musculus
gcggtgcgaaacttgagctcccgta

SEQ ID NO: 270431 - DNA, 25 bp, Mus musculus
agccactcttgcagggacatcgtgc

SEQ ID NO: 270432 - DNA, 25 bp, Mus musculus
agctcccgtaactcgagcccatggg

SEQ ID NO: 270433 - DNA, 25 bp, Mus musculus
tgcattttcctttgcgtgggctcgg

SEQ ID NO: 270434 - DNA, 25 bp, Mus musculus
tcctgcagattatagggcgctcttg

SEQ ID NO: 270435 - DNA, 25 bp, Mus musculus
ggcgctcttgccctaaacgcatttt

SEQ ID NO: 270436 - DNA, 25 bp, Mus musculus
taagaggctcgctcctggtgtgact

SEQ ID NO: 270437 - DNA, 25 bp, Mus musculus
tggagtggttgtttcctgcagatta

SEQ ID NO: 270438 - DNA, 25 bp, Mus musculus
gcactcacctctgcacacgcctcga

SEQ ID NO: 270439 - DNA, 25 bp, Mus musculus
actccatccgcaacagcttcctggg

SEQ ID NO: 270440 - DNA, 25 bp, Mus musculus
ggctcaactccatccgcaacagctt

SEQ ID NO: 270441 - DNA, 25 bp, Mus musculus
gaagtcggctcaactccatccgcaa

SEQ ID NO: 270442 - DNA, 25 bp, Mus musculus
agaagtcggctcaactccatccgca

SEQ ID NO: 270443 - DNA, 25 bp, Mus musculus
gagaagtcggctcaactccatccgc

SEQ ID NO: 270444 - DNA, 25 bp, Mus musculus
cacctcccagcccaggcggtggcgt

SEQ ID NO: 270445 - DNA, 25 bp, Mus musculus
cccaggaacgacgccacctcccagc

SEQ ID NO: 270446 - DNA, 25 bp, Mus musculus
gctcctccggcggaacccccttgca

SEQ ID NO: 270447 - DNA, 25 bp, Mus musculus
ctgcacacgcctcgagccagcccta

SEQ ID NO: 270448 - DNA, 25 bp, Mus musculus
cggcggaacccccttgcactcacct

SEQ ID NO: 270449 - DNA, 25 bp, Mus musculus
atccgcaacagcttcctgggctccc

SEQ ID NO: 270450 - DNA, 25 bp, Mus musculus
cgagccagccctacggggaccccag

SEQ ID NO: 270451 - DNA, 25 bp, Mus musculus
ttccacgcccttgcctggaccacca

SEQ ID NO: 270452 - DNA, 25 bp, Mus musculus
gagggctgcgaacgcccacggcaaa

SEQ ID NO: 270453 - DNA, 25 bp, Mus musculus
gaaggcgcatgtgtgtgcgtcacca

SEQ ID NO: 270454 - DNA, 25 bp, Mus musculus
tcaccaggacgcctttggaagtgtc

SEQ ID NO: 270455 - DNA, 25 bp, Mus musculus
tgtccgctgggagttctggagaccc

SEQ ID NO: 270456 - DNA, 25 bp, Mus musculus
cggcaaacctaacggcctgtgagta

SEQ ID NO: 270457 - DNA, 25 bp, Mus musculus
ctgtgagtacaggacagagtgtgtc

SEQ ID NO: 270458 - DNA, 25 bp, Mus musculus
tgtcacggctgatggagtgtaagtc

SEQ ID NO: 270459 - DNA, 25 bp, Mus musculus
tgatggagtgtaagtctgacaaacc

SEQ ID NO: 270460 - DNA, 25 bp, Mus musculus
ctgacaaaccaaaagcgggactggc

SEQ ID NO: 270461 - DNA, 25 bp, Mus musculus
gccgaccggttgtatgtgtccgaca

SEQ ID NO: 270462 - DNA, 25 bp, Mus musculus
tgtgtccgacaggttgtgctacgtc

SEQ ID NO: 270463 - DNA, 25 bp, Mus musculus
caggttgtgctacgtctgatgcgtc

SEQ ID NO: 270464 - DNA, 25 bp, Mus musculus
ctgatgcgtcgtggccttggatatc

SEQ ID NO: 270465 - DNA, 25 bp, Mus musculus
acgcctttggaagtgtccgctggga

SEQ ID NO: 270466 - DNA, 25 bp, Mus musculus
tttgttactgcagtttaaacgctcg

SEQ ID NO: 270467 - DNA, 25 bp, Mus musculus
ctctgattatcacatccgtttttgt

SEQ ID NO: 270468 - DNA, 25 bp, Mus musculus
tgcgcccgaggcacctctgattatc

SEQ ID NO: 270469 - DNA, 25 bp, Mus musculus
cccgcttttgtttatggaggcgaag

SEQ ID NO: 270470 - DNA, 25 bp, Mus musculus
gcgggctcaccttggacatcatctt

SEQ ID NO: 270471 - DNA, 25 bp, Mus musculus
catcttcttcagctgactctcggac

SEQ ID NO: 270472 - DNA, 25 bp, Mus musculus
agctgactctcggacaccgccatgg

SEQ ID NO: 270473 - DNA, 25 bp, Mus musculus
gcaggaagccggcacgttgtgcttc

SEQ ID NO: 270474 - DNA, 25 bp, Mus musculus
agatcaggtccggtccacgggtgcc

SEQ ID NO: 270475 - DNA, 25 bp, Mus musculus
tggtgcggttgtttgcaagcctttc

SEQ ID NO: 270476 - DNA, 25 bp, Mus musculus
ttgcaagcctttcgcggtcccgaag

SEQ ID NO: 270477 - DNA, 25 bp, Mus musculus
gcgtcgctcacagaactagctcgtg

SEQ ID NO: 270478 - DNA, 25 bp, Mus musculus
ctcgtggacactctagacactttta

SEQ ID NO: 270479 - DNA, 25 bp, Mus musculus
gacacttttaggtgactgcgcccga

SEQ ID NO: 270480 - DNA, 25 bp, Mus musculus
cgttctctgaagtcgcaggtgagtg

SEQ ID NO: 270481 - DNA, 25 bp, Mus musculus
cagtgccctcgtcgggcaagagagc

SEQ ID NO: 270482 - DNA, 25 bp, Mus musculus
cagggttgcgttctctgaagtcgca

SEQ ID NO: 270483 - DNA, 25 bp, Mus musculus
acggagcagggttgcgttctctgaa

SEQ ID NO: 270484 - DNA, 25 bp, Mus musculus
ttgcacagccggcttggagcgtgta

SEQ ID NO: 270485 - DNA, 25 bp, Mus musculus
catagcgctttgcacagccggcttg

SEQ ID NO: 270486 - DNA, 25 bp, Mus musculus
cagccatagcgctttgcacagccgg

SEQ ID NO: 270487 - DNA, 25 bp, Mus musculus
ggactgtcactagcgaggcacccgc

SEQ ID NO: 270488 - DNA, 25 bp, Mus musculus
ggccctggcagccatagcgctttgc

SEQ ID NO: 270489 - DNA, 25 bp, Mus musculus
cccggaaggagctgagaagagctgg

SEQ ID NO: 270490 - DNA, 25 bp, Mus musculus
tctctgaagtcgcaggtgagtggca

SEQ ID NO: 270491 - DNA, 25 bp, Mus musculus
ctgggacctgcggactgtcactagc

SEQ ID NO: 270492 - DNA, 25 bp, Mus musculus
cctgcggactgtcactagcgaggca

SEQ ID NO: 270493 - DNA, 25 bp, Mus musculus
cctggcagccatagcgctttgcaca

SEQ ID NO: 270494 - DNA, 25 bp, Mus musculus
tcaaaacacgctgggaacggaggcc

SEQ ID NO: 270495 - DNA, 25 bp, Mus musculus
gcgccctgcgaggtggaaaaatacc

SEQ ID NO: 270496 - DNA, 25 bp, Mus musculus
ccctaaactagagactgacagccgc

SEQ ID NO: 270497 - DNA, 25 bp, Mus musculus
ggttctgcatctacctttaccctaa

SEQ ID NO: 270498 - DNA, 25 bp, Mus musculus
ggactcccgcgggttctgcatctac

SEQ ID NO: 270499 - DNA, 25 bp, Mus musculus
cgactagacccggagaccagatctc

SEQ ID NO: 270500 - DNA, 25 bp, Mus musculus
ccgtcagtcaggtatcgactagacc

SEQ ID NO: 270501 - DNA, 25 bp, Mus musculus
ctcgggtaggatgcatccagacgcc

SEQ ID NO: 270502 - DNA, 25 bp, Mus musculus
cacgggcccaaacttccgcagagga

SEQ ID NO: 270503 - DNA, 25 bp, Mus musculus
gcagtcactgggcttgtttcaaaac

SEQ ID NO: 270504 - DNA, 25 bp, Mus musculus
gggcgcgttcttcggccgcagtcac

SEQ ID NO: 270505 - DNA, 25 bp, Mus musculus
acagtcgaactccatggtcagcagg

SEQ ID NO: 270506 - DNA, 25 bp, Mus musculus
acgagaatgctaggtcccgtccgcc

SEQ ID NO: 270507 - DNA, 25 bp, Mus musculus
cgccttctgcagtaggcggagctcg

SEQ ID NO: 270508 - DNA, 25 bp, Mus musculus
gcgcaacttccgctttcggagataa

SEQ ID NO: 270509 - DNA, 25 bp, Mus musculus
acaccttgtcctttggaagcgatca

SEQ ID NO: 270510 - DNA, 25 bp, Mus musculus
atctcggtttcgtttcgctggagcc

SEQ ID NO: 270511 - DNA, 25 bp, Mus musculus
cggtattccaacagctggtgcgaca

SEQ ID NO: 270512 - DNA, 25 bp, Mus musculus
gtcacgcgtggatgtacagattcca

SEQ ID NO: 270513 - DNA, 25 bp, Mus musculus
cgtgcgtagttcaggctttcccgag

SEQ ID NO: 270514 - DNA, 25 bp, Mus musculus
cgctgccgccgaatacgaagtatgt

SEQ ID NO: 270515 - DNA, 25 bp, Mus musculus
aaagcctacttttcagggcacagga

SEQ ID NO: 270516 - DNA, 25 bp, Mus musculus
cacacacgaacttgacgcccgggtt

SEQ ID NO: 270517 - DNA, 25 bp, Mus musculus
tcaccggtacgtggttgacaccttg

SEQ ID NO: 270518 - DNA, 25 bp, Mus musculus
gatttccctgaagtccatgtctggc

SEQ ID NO: 270519 - DNA, 25 bp, Mus musculus
gagtcttgcctctcgctgagcctaa

SEQ ID NO: 270520 - DNA, 25 bp, Mus musculus
ggcgccttctaatgccgtgtaccgc

SEQ ID NO: 270521 - DNA, 25 bp, Mus musculus
acagtattcagtcaggcgcggctta

SEQ ID NO: 270522 - DNA, 25 bp, Mus musculus
gaaaacattgtgcacgtgactcgga

SEQ ID NO: 270523 - DNA, 25 bp, Mus musculus
gggaggatctccttttcaacgcaga

SEQ ID NO: 270524 - DNA, 25 bp, Mus musculus
gcgcgggaggtattgtgcttcaccc

SEQ ID NO: 270525 - DNA, 25 bp, Mus musculus
cacggtttttagctcctcactcttg

SEQ ID NO: 270526 - DNA, 25 bp, Mus musculus
agcggctgctgtcacggtttttagc

SEQ ID NO: 270527 - DNA, 25 bp, Mus musculus
ccgccatggtgtctccggtcactgt

SEQ ID NO: 270528 - DNA, 25 bp, Mus musculus
cagctttgttcggtcgtctgctcac

SEQ ID NO: 270529 - DNA, 25 bp, Mus musculus
agacagtactctgagcgcccagcgc

SEQ ID NO: 270530 - DNA, 25 bp, Mus musculus
tgacgtcgtcgggttcacagacagt

SEQ ID NO: 270531 - DNA, 25 bp, Mus musculus
cccgttcattggctgggtctgtggt

SEQ ID NO: 270532 - DNA, 25 bp, Mus musculus
tccctaagaggcgtggcctgaaggc

SEQ ID NO: 270533 - DNA, 25 bp, Mus musculus
agggctccgcccatacgaggcttcg

SEQ ID NO: 270534 - DNA, 25 bp, Mus musculus
gtcacgttccgggatgccctggcac

SEQ ID NO: 270535 - DNA, 25 bp, Mus musculus
catacgaggcttcggcccgttcatt

SEQ ID NO: 270536 - DNA, 25 bp, Mus musculus
tccgtctgtcggtctgtccgcggag

SEQ ID NO: 270537 - DNA, 25 bp, Mus musculus
tctagaggggcggaccacagaccct

SEQ ID NO: 270538 - DNA, 25 bp, Mus musculus
ggcggaccacagacccttaacatgg

SEQ ID NO: 270539 - DNA, 25 bp, Mus musculus
tcggggctgcgcgactacggcaacc

SEQ ID NO: 270540 - DNA, 25 bp, Mus musculus
ttaacatgggatcccatctccagtg

SEQ ID NO: 270541 - DNA, 25 bp, Mus musculus
cccatgccaaggttgcctggactga

SEQ ID NO: 270542 - DNA, 25 bp, Mus musculus
gggagcgccgcatccatttcattca

SEQ ID NO: 270543 - DNA, 25 bp, Mus musculus
gccgcatccatttcattcatgattt

SEQ ID NO: 270544 - DNA, 25 bp, Mus musculus
cagcatcgcctagggctctagaggg

SEQ ID NO: 270545 - DNA, 25 bp, Mus musculus
ccaaatgcgcctgaactgcagagtc

SEQ ID NO: 270546 - DNA, 25 bp, Mus musculus
ggagctccagcatcgcctagggctc

SEQ ID NO: 270547 - DNA, 25 bp, Mus musculus
cctgaactgcagagtcgcgggtgca

SEQ ID NO: 270548 - DNA, 25 bp, Mus musculus
ggagatgtcaatttcgctgccgccc

SEQ ID NO: 270549 - DNA, 25 bp, Mus musculus
gtggattggaggagatgtcaatttc

SEQ ID NO: 270550 - DNA, 25 bp, Mus musculus
tcctgtaaggttggatgtgcgctgc

SEQ ID NO: 270551 - DNA, 25 bp, Mus musculus
cctcctgtaaggttggatgtgcgct

SEQ ID NO: 270552 - DNA, 25 bp, Mus musculus
ctgcgcgcctcctgtaaggttggat

SEQ ID NO: 270553 - DNA, 25 bp, Mus musculus
ccatcgtaccgcctcctgcgcctgc

SEQ ID NO: 270554 - DNA, 25 bp, Mus musculus
gcgcctcctgtaaggttggatgtgc

SEQ ID NO: 270555 - DNA, 25 bp, Mus musculus
ttcgctgcgcgcctcctgtaaggtt

SEQ ID NO: 270556 - DNA, 25 bp, Mus musculus
gcgcgcctcctgtaaggttggatgt

SEQ ID NO: 270557 - DNA, 25 bp, Mus musculus
agcgcagcgccaagcatctggcttc

SEQ ID NO: 270558 - DNA, 25 bp, Mus musculus
ccaggatttggcgaacgctgctgct

SEQ ID NO: 270559 - DNA, 25 bp, Mus musculus
caggatttggcgaacgctgctgctg

SEQ ID NO: 270560 - DNA, 25 bp, Mus musculus
ctgctgctggggggctgtaatattc

SEQ ID NO: 270561 - DNA, 25 bp, Mus musculus
tgttcggggtgcacgggtacacgcc

SEQ ID NO: 270562 - DNA, 25 bp, Mus musculus
agagcgcagcgccaagcatctggct

SEQ ID NO: 270563 - DNA, 25 bp, Mus musculus
gggaagagcgcagcgccaagcatct

SEQ ID NO: 270564 - DNA, 25 bp, Mus musculus
gattgacagccctaggatgcgcgca

SEQ ID NO: 270565 - DNA, 25 bp, Mus musculus
gcgtcacgcaccggtgcctaagtcg

SEQ ID NO: 270566 - DNA, 25 bp, Mus musculus
gatgaccggcagttctctagaggtg

SEQ ID NO: 270567 - DNA, 25 bp, Mus musculus
ctctagaggtgagaaagtcccgccc

SEQ ID NO: 270568 - DNA, 25 bp, Mus musculus
tctcgtggcggattgacagccctag

SEQ ID NO: 270569 - DNA, 25 bp, Mus musculus
acagccctaggatgcgcgcagttag

SEQ ID NO: 270570 - DNA, 25 bp, Mus musculus
cggttccgcgaggacagcaggatct

SEQ ID NO: 270571 - DNA, 25 bp, Mus musculus
aggatctgggccttggccacactaa

SEQ ID NO: 270572 - DNA, 25 bp, Mus musculus
ggccttggccacactaagaaagatg

SEQ ID NO: 270573 - DNA, 25 bp, Mus musculus
gccacactaagaaagatgctgcttg

SEQ ID NO: 270574 - DNA, 25 bp, Mus musculus
aagatgctgcttgtcctttgcggtg

SEQ ID NO: 270575 - DNA, 25 bp, Mus musculus
tgcttgtcctttgcggtggccgcag

SEQ ID NO: 270576 - DNA, 25 bp, Mus musculus
ctgtcgcctccattcggcggctggg

SEQ ID NO: 270577 - DNA, 25 bp, Mus musculus
attggcttctcgtggcggattgaca

SEQ ID NO: 270578 - DNA, 25 bp, Mus musculus
gctgaagtttctcgcctgacacaca

SEQ ID NO: 270579 - DNA, 25 bp, Mus musculus
gaaggattccctaggtgccgaaatc

SEQ ID NO: 270580 - DNA, 25 bp, Mus musculus
cgagccaatcagtaagcccggtgaa

SEQ ID NO: 270581 - DNA, 25 bp, Mus musculus
agacagcatctcacggtttccaggg

SEQ ID NO: 270582 - DNA, 25 bp, Mus musculus
gatgccaaagcgcaccgtacgctgc

SEQ ID NO: 270583 - DNA, 25 bp, Mus musculus
gtgccgaaatcaccgcgatgccaaa

SEQ ID NO: 270584 - DNA, 25 bp, Mus musculus
tttcaatacacgaagtactggggcg

SEQ ID NO: 270585 - DNA, 25 bp, Mus musculus
tacaaagggctttgggatcttgacc

SEQ ID NO: 270586 - DNA, 25 bp, Mus musculus
tctaagcgcacgaccgggcatttac

SEQ ID NO: 270587 - DNA, 25 bp, Mus musculus
aattcagcctctgcgctctaagcgc

SEQ ID NO: 270588 - DNA, 25 bp, Mus musculus
ttgtgaagtggcctgagaacaaccc

SEQ ID NO: 270589 - DNA, 25 bp, Mus musculus
cctgtcaatcctccttcagagctga

SEQ ID NO: 270590 - DNA, 25 bp, Mus musculus
cgcgtctcagggagactcgcttagc

SEQ ID NO: 270591 - DNA, 25 bp, Mus musculus
cacacacgtgcacaggctcagaagg

SEQ ID NO: 270592 - DNA, 25 bp, Mus musculus
gagcttctgaacaggcctcccgctg

SEQ ID NO: 270593 - DNA, 25 bp, Mus musculus
ctcggtttcccaggagaagaattgc

SEQ ID NO: 270594 - DNA, 25 bp, Mus musculus
acaagttaatatgggcgtccacgcc

SEQ ID NO: 270595 - DNA, 25 bp, Mus musculus
aaggagccttctcacttcggagacg

SEQ ID NO: 270596 - DNA, 25 bp, Mus musculus
ttgctccaaggttcacacccgcagg

SEQ ID NO: 270597 - DNA, 25 bp, Mus musculus
agccgcttcgcggttgatacgtctt

SEQ ID NO: 270598 - DNA, 25 bp, Mus musculus
gagatcgcccagagtctgcctaggc

SEQ ID NO: 270599 - DNA, 25 bp, Mus musculus
agctcgctttgtacttgcggccaag

SEQ ID NO: 270600 - DNA, 25 bp, Mus musculus
agcatcggtgatcggctgtcacgcc

SEQ ID NO: 270601 - DNA, 25 bp, Mus musculus
tggtccgcggctaaccaataggcgc

SEQ ID NO: 270602 - DNA, 25 bp, Mus musculus
ttcttccactgttggtgggcgcctc

SEQ ID NO: 270603 - DNA, 25 bp, Mus musculus
tcggagacgcaatgacaagttaata

SEQ ID NO: 270604 - DNA, 25 bp, Mus musculus
acagacctgtctgcggagatcgccc

SEQ ID NO: 270605 - DNA, 25 bp, Mus musculus
cgtagccggtgtctcttcctaagga

SEQ ID NO: 270606 - DNA, 25 bp, Mus musculus
cggattcgtgaatgttgtacgcctc

SEQ ID NO: 270607 - DNA, 25 bp, Mus musculus
attcgtgaatgttgtacgcctcgca

SEQ ID NO: 270608 - DNA, 25 bp, Mus musculus
cgtgaatgttgtacgcctcgcaacc

SEQ ID NO: 270609 - DNA, 25 bp, Mus musculus
ctgaaccagagcgtaaccccgaggg

SEQ ID NO: 270610 - DNA, 25 bp, Mus musculus
actggaacgggctgtccagcccgga

SEQ ID NO: 270611 - DNA, 25 bp, Mus musculus
agagacctacctgggaaataggagg

SEQ ID NO: 270612 - DNA, 25 bp, Mus musculus
ctacctgggaaataggaggatctga

SEQ ID NO: 270613 - DNA, 25 bp, Mus musculus
ctgggaaataggaggatctgataaa

SEQ ID NO: 270614 - DNA, 25 bp, Mus musculus
atctgataaagggttggaacgagcc

SEQ ID NO: 270615 - DNA, 25 bp, Mus musculus
gttggaacgagccttcgaagtatgg

SEQ ID NO: 270616 - DNA, 25 bp, Mus musculus
ggaacgagccttcgaagtatggaaa

SEQ ID NO: 270617 - DNA, 25 bp, Mus musculus
cgaagtatggaaaggcgaacgtctt

SEQ ID NO: 270618 - DNA, 25 bp, Mus musculus
agcaaagcgggcgaagtttctggta

SEQ ID NO: 270619 - DNA, 25 bp, Mus musculus
cgcgacggattcgtgaatgttgtac

SEQ ID NO: 270620 - DNA, 25 bp, Mus musculus
gtgcgccgactcagaagcctagcta

SEQ ID NO: 270621 - DNA, 25 bp, Mus musculus
tctactgtccgcgattgaacctgag

SEQ ID NO: 270622 - DNA, 25 bp, Mus musculus
ttgccctagctaagaatccaccgtc

SEQ ID NO: 270623 - DNA, 25 bp, Mus musculus
gttcctgggttttgcagcctaatta

SEQ ID NO: 270624 - DNA, 25 bp, Mus musculus
gtggactggacgtcagcactactta

SEQ ID NO: 270625 - DNA, 25 bp, Mus musculus
ggcgtcggtctcaccaaagtttctg

SEQ ID NO: 270626 - DNA, 25 bp, Mus musculus
gctagtacttcagaggtccgccaga

SEQ ID NO: 270627 - DNA, 25 bp, Mus musculus
gtgcgcatgctttacccggctcaaa

SEQ ID NO: 270628 - DNA, 25 bp, Mus musculus
cgcctctcatcctagcgcttgattg

SEQ ID NO: 270629 - DNA, 25 bp, Mus musculus
gtgcgtctctacctctgacccggaa

SEQ ID NO: 270630 - DNA, 25 bp, Mus musculus
gacccggaagttttcgctttgcata

SEQ ID NO: 270631 - DNA, 25 bp, Mus musculus
cgcggcctcttcctgtctgtatcag

SEQ ID NO: 270632 - DNA, 25 bp, Mus musculus
tggatctcaccgtttctctgcgaaa

SEQ ID NO: 270633 - DNA, 25 bp, Mus musculus
ctacttagatatggcggcgtcggtc

SEQ ID NO: 270634 - DNA, 25 bp, Mus musculus
ttaataaagaaggtcgccaggctca

SEQ ID NO: 270635 - DNA, 25 bp, Mus musculus
gacttccttgtgatctctttagagg

SEQ ID NO: 270636 - DNA, 25 bp, Mus musculus
atagcctccaactgcgatggccgcg

SEQ ID NO: 270637 - DNA, 25 bp, Mus musculus
tgggcgcaaagtaactccatggacg

SEQ ID NO: 270638 - DNA, 25 bp, Mus musculus
cagctcagagctggtgccactagga

SEQ ID NO: 270639 - DNA, 25 bp, Mus musculus
cctgctgggaagatggtcagccctc

SEQ ID NO: 270640 - DNA, 25 bp, Mus musculus
gctggctcttaccttgctccgcggt

SEQ ID NO: 270641 - DNA, 25 bp, Mus musculus
gagcactggcagatctgttgaaaaa

SEQ ID NO: 270642 - DNA, 25 bp, Mus musculus
ccgcgctggcttcctagaacaggca

SEQ ID NO: 270643 - DNA, 25 bp, Mus musculus
aggctcacccttccaaaagttgttg

SEQ ID NO: 270644 - DNA, 25 bp, Mus musculus
ggcgctttgccgcagtcattaataa

SEQ ID NO: 270645 - DNA, 25 bp, Mus musculus
cttcccagttgtttggctccggcga

SEQ ID NO: 270646 - DNA, 25 bp, Mus musculus
gccacttttttctaattcactcgga

SEQ ID NO: 270647 - DNA, 25 bp, Mus musculus
acacggctgaccaacatgcgcaatc

SEQ ID NO: 270648 - DNA, 25 bp, Mus musculus
ttctactaggaaactagagtggccg

SEQ ID NO: 270649 - DNA, 25 bp, Mus musculus
agatggttttatagtggcccgcccg

SEQ ID NO: 270650 - DNA, 25 bp, Mus musculus
ctctccggtccaggagatggtttta

SEQ ID NO: 270651 - DNA, 25 bp, Mus musculus
gcgtctgcgagtcttctgtggctct

SEQ ID NO: 270652 - DNA, 25 bp, Mus musculus
aaccgtcctacttgggcgtctgcga

SEQ ID NO: 270653 - DNA, 25 bp, Mus musculus
ttacctcttctaggcgccgaggaaa

SEQ ID NO: 270654 - DNA, 25 bp, Mus musculus
gctcagtatcctggtaaccgtccta

SEQ ID NO: 270655 - DNA, 25 bp, Mus musculus
ccgatgccctctttggctcagtatc

SEQ ID NO: 270656 - DNA, 25 bp, Mus musculus
tctggcagtagctccctttccctgg

SEQ ID NO: 270657 - DNA, 25 bp, Mus musculus
ccggaaaatgcggattgaagggact

SEQ ID NO: 270658 - DNA, 25 bp, Mus musculus
cggctgatgcggatcaaatcttcta

SEQ ID NO: 270659 - DNA, 25 bp, Mus musculus
cttcagaaacgtgggctcgctggca

SEQ ID NO: 270660 - DNA, 25 bp, Mus musculus
gggcacggctgtatcttacctcttc

SEQ ID NO: 270661 - DNA, 25 bp, Mus musculus
acatcatggttagagcgggtctggc

SEQ ID NO: 270662 - DNA, 25 bp, Mus musculus
acgtcgcggccggtaggctccggct

SEQ ID NO: 270663 - DNA, 25 bp, Mus musculus
tggttcgagccctgggtgcagctcc

SEQ ID NO: 270664 - DNA, 25 bp, Mus musculus
cccgcgctcagctccagccctcggt

SEQ ID NO: 270665 - DNA, 25 bp, Mus musculus
gcgagcgcgctgtcacccggaagac

SEQ ID NO: 270666 - DNA, 25 bp, Mus musculus
agcgcgctgtcacccggaagacgtc

SEQ ID NO: 270667 - DNA, 25 bp, Mus musculus
tccggctggacctcttggggctcct

SEQ ID NO: 270668 - DNA, 25 bp, Mus musculus
acctcttggggctccttgccgggag

SEQ ID NO: 270669 - DNA, 25 bp, Mus musculus
ctccttgccgggaggggagacagcg

SEQ ID NO: 270670 - DNA, 25 bp, Mus musculus
caggcggcgagatgctcggtcccac

SEQ ID NO: 270671 - DNA, 25 bp, Mus musculus
gcgagatgctcggtcccacggtgct

SEQ ID NO: 270672 - DNA, 25 bp, Mus musculus
atgctcggtcccacggtgctgggca

SEQ ID NO: 270673 - DNA, 25 bp, Mus musculus
cacggtgctgggcacggtcgtagcc

SEQ ID NO: 270674 - DNA, 25 bp, Mus musculus
tgtcacccggaagacgtcgcggccg

SEQ ID NO: 270675 - DNA, 25 bp, Mus musculus
gctggacctcttggggctccttgcc

SEQ ID NO: 270676 - DNA, 25 bp, Mus musculus
ggcgcctcggttgcgcaagcgtcca

SEQ ID NO: 270677 - DNA, 25 bp, Mus musculus
tgctcaaccttgtaagcgccggcgc

SEQ ID NO: 270678 - DNA, 25 bp, Mus musculus
cgctgcgataagtcggtgctcaacc

SEQ ID NO: 270679 - DNA, 25 bp, Mus musculus
tgcgcaagcgtccaagccggagagc

SEQ ID NO: 270680 - DNA, 25 bp, Mus musculus
ccggaagcgctctccggacggttca

SEQ ID NO: 270681 - DNA, 25 bp, Mus musculus
tcacgctccgcgtgtggatcgcttt

SEQ ID NO: 270682 - DNA, 25 bp, Mus musculus
ttggtcggcggccatgtgttcgcta

SEQ ID NO: 270683 - DNA, 25 bp, Mus musculus
aactgtcggacagcggagacgacgc

SEQ ID NO: 270684 - DNA, 25 bp, Mus musculus
acgaggacgcggacactgagcccgc

SEQ ID NO: 270685 - DNA, 25 bp, Mus musculus
acacaccctgcctgttctgtgacag

SEQ ID NO: 270686 - DNA, 25 bp, Mus musculus
tgttctgtgacaggttcgtgccggt

SEQ ID NO: 270687 - DNA, 25 bp, Mus musculus
acggttgattgacaaggggctgctc

SEQ ID NO: 270688 - DNA, 25 bp, Mus musculus
tgacaaggggctgctcacgtggtcc

SEQ ID NO: 270689 - DNA, 25 bp, Mus musculus
tctcggtgctgaccgtgtgtgctct

SEQ ID NO: 270690 - DNA, 25 bp, Mus musculus
cccagcagtccggagtagggttttg

SEQ ID NO: 270691 - DNA, 25 bp, Mus musculus
gggcacgctggagcacaacaatacc

SEQ ID NO: 270692 - DNA, 25 bp, Mus musculus
ccataccggtaagcaggtcacaagc

SEQ ID NO: 270693 - DNA, 25 bp, Mus musculus
gggcagcgtggccaccactaccata

SEQ ID NO: 270694 - DNA, 25 bp, Mus musculus
tgttgggaaccgatggcatcgcgtc

SEQ ID NO: 270695 - DNA, 25 bp, Mus musculus
ctgggtgaatatgagccagagcaca

SEQ ID NO: 270696 - DNA, 25 bp, Mus musculus
tgctgctcaccaaccgcgcgtgaag

SEQ ID NO: 270697 - DNA, 25 bp, Mus musculus
ctgcaagattccagctctgcgtggc

SEQ ID NO: 270698 - DNA, 25 bp, Mus musculus
gctggcaacgctctgcactgcaaga

SEQ ID NO: 270699 - DNA, 25 bp, Mus musculus
aagggcacagcgcacaggccaatcc

SEQ ID NO: 270700 - DNA, 25 bp, Mus musculus
tccgggacttaagcgaagggcacag

SEQ ID NO: 270701 - DNA, 25 bp, Mus musculus
gtagggttttgtaatctcagcagcc

SEQ ID NO: 270702 - DNA, 25 bp, Mus musculus
gcccaaactttccagtctgcggatg

SEQ ID NO: 270703 - DNA, 25 bp, Mus musculus
ccagagcacagtagtgttgggaacc

SEQ ID NO: 270704 - DNA, 25 bp, Mus musculus
acccggcctggatgaactgttgcaa

SEQ ID NO: 270705 - DNA, 25 bp, Mus musculus
gggatccttgcatctccggagtcca

SEQ ID NO: 270706 - DNA, 25 bp, Mus musculus
cctgccgcccgctagtaagtttggc

SEQ ID NO: 270707 - DNA, 25 bp, Mus musculus
taagtttggccgcttcgagcccaca

SEQ ID NO: 270708 - DNA, 25 bp, Mus musculus
agagccgcggctttctgaagcattg

SEQ ID NO: 270709 - DNA, 25 bp, Mus musculus
tgatgatagtgctgctcccgactgc

SEQ ID NO: 270710 - DNA, 25 bp, Mus musculus
taacccgggattactctgtctagga

SEQ ID NO: 270711 - DNA, 25 bp, Mus musculus
ctcggaacctatctctgacgggcta

SEQ ID NO: 270712 - DNA, 25 bp, Mus musculus
ttgggttctgattgcccagcacagc

SEQ ID NO: 270713 - DNA, 25 bp, Mus musculus
cacagctcggggtaaaagcgctaga

SEQ ID NO: 270714 - DNA, 25 bp, Mus musculus
actgttgcaacttgggcagcccgca

SEQ ID NO: 270715 - DNA, 25 bp, Mus musculus
cgtggccagagatcctacatccttg

SEQ ID NO: 270716 - DNA, 25 bp, Mus musculus
agcaagcagcttcccggttctaagg

SEQ ID NO: 270717 - DNA, 25 bp, Mus musculus
tcgcagccttgtgtggctagcaagc

SEQ ID NO: 270718 - DNA, 25 bp, Mus musculus
ccgacctgctggagatggtggagca

SEQ ID NO: 270719 - DNA, 25 bp, Mus musculus
aggtaatgggagacattctgcgccc

SEQ ID NO: 270720 - DNA, 25 bp, Mus musculus
gccaggcaggtaatgggagacattc

SEQ ID NO: 270721 - DNA, 25 bp, Mus musculus
tgcgccatgcctgccaggcaggtaa

SEQ ID NO: 270722 - DNA, 25 bp, Mus musculus
cgggaacgttcttagtgtcgtgagc

SEQ ID NO: 270723 - DNA, 25 bp, Mus musculus
ggacgttggcagctgtaggtttctg

SEQ ID NO: 270724 - DNA, 25 bp, Mus musculus
agcgggcgcgcgaaccttcttcgca

SEQ ID NO: 270725 - DNA, 25 bp, Mus musculus
tgccttcaacgagctggcaaagcta

SEQ ID NO: 270726 - DNA, 25 bp, Mus musculus
gccgcctgtcacagaggtccttcaa

SEQ ID NO: 270727 - DNA, 25 bp, Mus musculus
aggaggcagacgatccgcttcagcc

SEQ ID NO: 270728 - DNA, 25 bp, Mus musculus
ctgaaaaccaggaggcagacgatcc

SEQ ID NO: 270729 - DNA, 25 bp, Mus musculus
ggcaaagctaggtgaccccgacctg

SEQ ID NO: 270730 - DNA, 25 bp, Mus musculus
accttcttcgcatggggtttctgcg

SEQ ID NO: 270731 - DNA, 25 bp, Mus musculus
agaggtccttcaatgccttcaacga

SEQ ID NO: 270732 - DNA, 25 bp, Mus musculus
ttgattatgtgtgccctcctcgggc

SEQ ID NO: 270733 - DNA, 25 bp, Mus musculus
ctgcttgattatgtgtgccctcctc

SEQ ID NO: 270734 - DNA, 25 bp, Mus musculus
cggaggcctgcttgattatgtgtgc

SEQ ID NO: 270735 - DNA, 25 bp, Mus musculus
cgcctgtgcggaggcctgcttgatt

SEQ ID NO: 270736 - DNA, 25 bp, Mus musculus
cccacctccgcacacctcggcgccg

SEQ ID NO: 270737 - DNA, 25 bp, Mus musculus
gccgcgctgagcagccgactccgct

SEQ ID NO: 270738 - DNA, 25 bp, Mus musculus
cagagccctccggtagactcactcc

SEQ ID NO: 270739 - DNA, 25 bp, Mus musculus
cgcggcctcttcctcatgcgcgccc

SEQ ID NO: 270740 - DNA, 25 bp, Mus musculus
ttcaggtaggttcccggcgccacga

SEQ ID NO: 270741 - DNA, 25 bp, Mus musculus
cacaggccttcaggtaggttcccgg

SEQ ID NO: 270742 - DNA, 25 bp, Mus musculus
aggcacaggccttcaggtaggttcc

SEQ ID NO: 270743 - DNA, 25 bp, Mus musculus
ttctcgaggcacaggccttcaggta

SEQ ID NO: 270744 - DNA, 25 bp, Mus musculus
gccagttctcgaggcacaggccttc

SEQ ID NO: 270745 - DNA, 25 bp, Mus musculus
ggtagactcactccggccgcgctga

SEQ ID NO: 270746 - DNA, 25 bp, Mus musculus
cccacgttgtgagcaggtccaggta

SEQ ID NO: 270747 - DNA, 25 bp, Mus musculus
agcggccaatacctcgggactttcg

SEQ ID NO: 270748 - DNA, 25 bp, Mus musculus
ttcgagaagccagcgcagtagtttc

SEQ ID NO: 270749 - DNA, 25 bp, Mus musculus
tcttcctcgcgtagcagcagcgctt

SEQ ID NO: 270750 - DNA, 25 bp, Mus musculus
gcttcggcagtcacgtcgagcacgt

SEQ ID NO: 270751 - DNA, 25 bp, Mus musculus
cagtagtttctgtgtctcatccgca

SEQ ID NO: 270752 - DNA, 25 bp, Mus musculus
cgtcggtacacgtggagcagataac

SEQ ID NO: 270753 - DNA, 25 bp, Mus musculus
gacacggccaacagctcggagaatc

SEQ ID NO: 270754 - DNA, 25 bp, Mus musculus
ctcggagaatcgctcggtttgctgc

SEQ ID NO: 270755 - DNA, 25 bp, Mus musculus
gtttgctgcacaagcggctccatgg

SEQ ID NO: 270756 - DNA, 25 bp, Mus musculus
cgcctcagcgtgctgtgccattgga

SEQ ID NO: 270757 - DNA, 25 bp, Mus musculus
tcgcaccatggtttccggggcacat

SEQ ID NO: 270758 - DNA, 25 bp, Mus musculus
cgtccacaacgtgtccaggagtttg

SEQ ID NO: 270759 - DNA, 25 bp, Mus musculus
gacggccgtgtcagtctcgcaccat

SEQ ID NO: 270760 - DNA, 25 bp, Mus musculus
gccgtctactcaccgggctcgggga

SEQ ID NO: 270761 - DNA, 25 bp, Mus musculus
aacggccgccgcgtgcaagacttgc

SEQ ID NO: 270762 - DNA, 25 bp, Mus musculus
gactccgcgggacaagggaagcaca

SEQ ID NO: 270763 - DNA, 25 bp, Mus musculus
ctccgcgggacaagggaagcacagc

SEQ ID NO: 270764 - DNA, 25 bp, Mus musculus
acaagggaagcacagccccatgggg

SEQ ID NO: 270765 - DNA, 25 bp, Mus musculus
ccatggggacgcaggcacccagggc

SEQ ID NO: 270766 - DNA, 25 bp, Mus musculus
gaacccgaatcctcgctgggggctg

SEQ ID NO: 270767 - DNA, 25 bp, Mus musculus
ggccgccgcgtgcaagacttgcacg

SEQ ID NO: 270768 - DNA, 25 bp, Mus musculus
acttgcacggggaggccgtctactc

SEQ ID NO: 270769 - DNA, 25 bp, Mus musculus
ggaggccgtctactcaccgggctcg

SEQ ID NO: 270770 - DNA, 25 bp, Mus musculus
gcagtaagacccaccccatctgagg

SEQ ID NO: 270771 - DNA, 25 bp, Mus musculus
cgaatcctcgctgggggctgcagca

SEQ ID NO: 270772 - DNA, 25 bp, Mus musculus
cgactgcactgcaacggccgccgcg

SEQ ID NO: 270773 - DNA, 25 bp, Mus musculus
cacggggaggccgtctactcaccgg

SEQ ID NO: 270774 - DNA, 25 bp, Mus musculus
gatcgcggctacgagctgaagtcgc

SEQ ID NO: 270775 - DNA, 25 bp, Mus musculus
ccaacttcaggtgtgggatcgcggc

SEQ ID NO: 270776 - DNA, 25 bp, Mus musculus
ctggtccaacttcaggtgtgggatc

SEQ ID NO: 270777 - DNA, 25 bp, Mus musculus
tggccctggacttcgtctggtccaa

SEQ ID NO: 270778 - DNA, 25 bp, Mus musculus
agcatgatgtgtgcgagctcgtccg

SEQ ID NO: 270779 - DNA, 25 bp, Mus musculus
cagacagctggagcatgatgtgtgc

SEQ ID NO: 270780 - DNA, 25 bp, Mus musculus
caatggcccggcctaagtcgtccgg

SEQ ID NO: 270781 - DNA, 25 bp, Mus musculus
atcctgataggtacgccgcggcaat

SEQ ID NO: 270782 - DNA, 25 bp, Mus musculus
tagcagagatcctgataggtacgcc

SEQ ID NO: 270783 - DNA, 25 bp, Mus musculus
agtcgccacttagcagagatcctga

SEQ ID NO: 270784 - DNA, 25 bp, Mus musculus
ctctcgcgagaacagtcgccactta

SEQ ID NO: 270785 - DNA, 25 bp, Mus musculus
gcggaaacatcctccacatctcgaa

SEQ ID NO: 270786 - DNA, 25 bp, Mus musculus
ggctgccggaactctcgcggaaaca

SEQ ID NO: 270787 - DNA, 25 bp, Mus musculus
ggaactctcgcggaaacatcctcca

SEQ ID NO: 270788 - DNA, 25 bp, Mus musculus
gagcagtttcgttcctactcggaga

SEQ ID NO: 270789 - DNA, 25 bp, Mus musculus
cccgcgagggcgctccagataagtc

SEQ ID NO: 270790 - DNA, 25 bp, Mus musculus
gggcgctccagataagtcctccaga

SEQ ID NO: 270791 - DNA, 25 bp, Mus musculus
agataagtcctccagagcactcgcc

SEQ ID NO: 270792 - DNA, 25 bp, Mus musculus
ctcagccgtggtcgctctagccgtg

SEQ ID NO: 270793 - DNA, 25 bp, Mus musculus
cgccgcggtggagaagctagtttcc

SEQ ID NO: 270794 - DNA, 25 bp, Mus musculus
agaagctagtttccggcgtgcggca

SEQ ID NO: 270795 - DNA, 25 bp, Mus musculus
acttcgccgagcagtttcgttccta

SEQ ID NO: 270796 - DNA, 25 bp, Mus musculus
tgcgccacctgcctgactaccgaga

SEQ ID NO: 270797 - DNA, 25 bp, Mus musculus
gtttcgttcctactcggagagcgag

SEQ ID NO: 270798 - DNA, 25 bp, Mus musculus
cgagaagcaatggaaagcgcgcatg

SEQ ID NO: 270799 - DNA, 25 bp, Mus musculus
tggaaagcgcgcatggagttcatcc

SEQ ID NO: 270800 - DNA, 25 bp, Mus musculus
atggagttcatcctgcgccacctgc

SEQ ID NO: 270801 - DNA, 25 bp, Mus musculus
ggccgccgacttcgccgagcagttt

SEQ ID NO: 270802 - DNA, 25 bp, Mus musculus
tcaagctgcctaaacgcctggactg

SEQ ID NO: 270803 - DNA, 25 bp, Mus musculus
ctggactgcggtcacgtattctgtc

SEQ ID NO: 270804 - DNA, 25 bp, Mus musculus
ctggcacgcctgtcgctggctactg

SEQ ID NO: 270805 - DNA, 25 bp, Mus musculus
agcccggtttgctgcctcgcgatgc

SEQ ID NO: 270806 - DNA, 25 bp, Mus musculus
acgccagggttctgtgcgctttgac

SEQ ID NO: 270807 - DNA, 25 bp, Mus musculus
tgtcacgtcgcctgtccctgagcag

SEQ ID NO: 270808 - DNA, 25 bp, Mus musculus
ccctgagcagtccagcatgggcttt

SEQ ID NO: 270809 - DNA, 25 bp, Mus musculus
catgggctttcaacgcagcagtggc

SEQ ID NO: 270810 - DNA, 25 bp, Mus musculus
ggtgtgtacatctttttcctcattc

SEQ ID NO: 270811 - DNA, 25 bp, Mus musculus
tcctcatgtcaccaattccggtgtg

SEQ ID NO: 270812 - DNA, 25 bp, Mus musculus
accaattccggtgtgcggcctcaga

SEQ ID NO: 270813 - DNA, 25 bp, Mus musculus
aaaatgacttctgggtttcaccgcg

SEQ ID NO: 270814 - DNA, 25 bp, Mus musculus
gtgtcacccttcgacggcattttca

SEQ ID NO: 270815 - DNA, 25 bp, Mus musculus
tattctgtctcgagtgcctggcacg

SEQ ID NO: 270816 - DNA, 25 bp, Mus musculus
gtccttgctccactgtagtccggtg

SEQ ID NO: 270817 - DNA, 25 bp, Mus musculus
cctggatactaggatcccagatctc

SEQ ID NO: 270818 - DNA, 25 bp, Mus musculus
gcgctgcacaacttgcactccggtg

SEQ ID NO: 270819 - DNA, 25 bp, Mus musculus
tgggctctcgagtctcccggtctct

SEQ ID NO: 270820 - DNA, 25 bp, Mus musculus
cggcttgacgggtggagcccaccaa

SEQ ID NO: 270821 - DNA, 25 bp, Mus musculus
gtggagcccaccaagcaaatcccgg

SEQ ID NO: 270822 - DNA, 25 bp, Mus musculus
aatcccggcttcctttgctgcggtg

SEQ ID NO: 270823 - DNA, 25 bp, Mus musculus
tgctgcggtgacctgagcagcaagc

SEQ ID NO: 270824 - DNA, 25 bp, Mus musculus
gctggcctagaggagccggacccaa

SEQ ID NO: 270825 - DNA, 25 bp, Mus musculus
ggtgtttcctggtgcattcccgacc

SEQ ID NO: 270826 - DNA, 25 bp, Mus musculus
cgacccgcccaagtgactcattggg

SEQ ID NO: 270827 - DNA, 25 bp, Mus musculus
tgactcattggggtaggaaagctcc

SEQ ID NO: 270828 - DNA, 25 bp, Mus musculus
aggatcccagatctcgcgcttccgg

SEQ ID NO: 270829 - DNA, 25 bp, Mus musculus
cctggacaaccgaaggcggcgcaga

SEQ ID NO: 270830 - DNA, 25 bp, Mus musculus
ggacagggccaaccagccagacttc

SEQ ID NO: 270831 - DNA, 25 bp, Mus musculus
tcactgcggatcaccagggaagctg

SEQ ID NO: 270832 - DNA, 25 bp, Mus musculus
cccagaacacgcgaaaaagcaagtc

SEQ ID NO: 270833 - DNA, 25 bp, Mus musculus
gaatggcaatcaatccgactcactg

SEQ ID NO: 270834 - DNA, 25 bp, Mus musculus
ccctggagctcgcttacaggaagta

SEQ ID NO: 270835 - DNA, 25 bp, Mus musculus
aagtagctaccttagggccgtcgca

SEQ ID NO: 270836 - DNA, 25 bp, Mus musculus
gcgggaagttcgtgcatccgagact

SEQ ID NO: 270837 - DNA, 25 bp, Mus musculus
catccgagactgcagtgagcgccgc

SEQ ID NO: 270838 - DNA, 25 bp, Mus musculus
aggagcctacctcggacagccttcg

SEQ ID NO: 270839 - DNA, 25 bp, Mus musculus
agcaccagaagagccgccgagaacc

SEQ ID NO: 270840 - DNA, 25 bp, Mus musculus
gaacctgccgggaaacctgggcgca

SEQ ID NO: 270841 - DNA, 25 bp, Mus musculus
ctgggcgcagactagtgacgtaaac

SEQ ID NO: 270842 - DNA, 25 bp, Mus musculus
actagtgacgtaaaccgcgcgcgct

SEQ ID NO: 270843 - DNA, 25 bp, Mus musculus
agccagacttctgccggattgaatg

SEQ ID NO: 270844 - DNA, 25 bp, Mus musculus
ttcactaggctggacaccacagcca

SEQ ID NO: 270845 - DNA, 25 bp, Mus musculus
gcccttcttctgcagcacgaacgtg

SEQ ID NO: 270846 - DNA, 25 bp, Mus musculus
tctgcagcacgaacgtggacccgtt

SEQ ID NO: 270847 - DNA, 25 bp, Mus musculus
agacagaaggagaccgcgtagaatg

SEQ ID NO: 270848 - DNA, 25 bp, Mus musculus
tggacccgttcactaggctggacac

SEQ ID NO: 270849 - DNA, 25 bp, Mus musculus
acaatgcccttcttctgcagcacga

SEQ ID NO: 270850 - DNA, 25 bp, Mus musculus
tagcgcgcacaatgcccttcttctg

SEQ ID NO: 270851 - DNA, 25 bp, Mus musculus
acctcgccttttagcgcgcacaatg

SEQ ID NO: 270852 - DNA, 25 bp, Mus musculus
acagacaccggcagacgcgtggtgc

SEQ ID NO: 270853 - DNA, 25 bp, Mus musculus
tgtgcacagacaccggcagacgcgt

SEQ ID NO: 270854 - DNA, 25 bp, Mus musculus
tgctctgtgcacagacaccggcaga

SEQ ID NO: 270855 - DNA, 25 bp, Mus musculus
agccggcccgtgctctgtgcacaga

SEQ ID NO: 270856 - DNA, 25 bp, Mus musculus
accgcgtagaatgcggaggtgatgc

SEQ ID NO: 270857 - DNA, 25 bp, Mus musculus
gacaccacagccacgcccaggccga

SEQ ID NO: 270858 - DNA, 25 bp, Mus musculus
tctcaagaaggaagctgagtcgtgc

SEQ ID NO: 270859 - DNA, 25 bp, Mus musculus
gtgcgcacaagtcccacctcccggc

SEQ ID NO: 270860 - DNA, 25 bp, Mus musculus
ctcctgcagggagtgttccctcagc

SEQ ID NO: 270861 - DNA, 25 bp, Mus musculus
tcgctgagcgggtgagtctcaagaa

SEQ ID NO: 270862 - DNA, 25 bp, Mus musculus
agtgttccctcagccggctggcgga

SEQ ID NO: 270863 - DNA, 25 bp, Mus musculus
ctgagtcgtgctgaaggaagcggaa

SEQ ID NO: 270864 - DNA, 25 bp, Mus musculus
gcgacgctgctcgtccattggctga

SEQ ID NO: 270865 - DNA, 25 bp, Mus musculus
cgctgctcgtccattggctgaagcc

SEQ ID NO: 270866 - DNA, 25 bp, Mus musculus
ttggctgaagccgtctctcaccctt

SEQ ID NO: 270867 - DNA, 25 bp, Mus musculus
tctctcacccttgcgctattgggcg

SEQ ID NO: 270868 - DNA, 25 bp, Mus musculus
acccttgcgctattgggcgggcgca

SEQ ID NO: 270869 - DNA, 25 bp, Mus musculus
cgcagccatgcgtcagcgtgcgctt

SEQ ID NO: 270870 - DNA, 25 bp, Mus musculus
tcagcgtgcgcttcgggccgcagac

SEQ ID NO: 270871 - DNA, 25 bp, Mus musculus
ccggcgtctgcggttggctctcgct

SEQ ID NO: 270872 - DNA, 25 bp, Mus musculus
gcctactagactcccacgggctgca

SEQ ID NO: 270873 - DNA, 25 bp, Mus musculus
tacttgctccggcgcctactagact

SEQ ID NO: 270874 - DNA, 25 bp, Mus musculus
tggtctctacttgctccggcgccta

SEQ ID NO: 270875 - DNA, 25 bp, Mus musculus
gcagggcttggtctctacttgctcc

SEQ ID NO: 270876 - DNA, 25 bp, Mus musculus
cctctgcagggcttggtctctactt

SEQ ID NO: 270877 - DNA, 25 bp, Mus musculus
taacacgcttggcaatgccaggcga

SEQ ID NO: 270878 - DNA, 25 bp, Mus musculus
cttggcaatgccaggcgaaggcagc

SEQ ID NO: 270879 - DNA, 25 bp, Mus musculus
agctgcgctccgaagcgtggcggga

SEQ ID NO: 270880 - DNA, 25 bp, Mus musculus
agggacaggtgtctgctccgagcgc

SEQ ID NO: 270881 - DNA, 25 bp, Mus musculus
cgcccagggttctgcggactgggag

SEQ ID NO: 270882 - DNA, 25 bp, Mus musculus
gtgcgtccgctctcgggagcgatca

SEQ ID NO: 270883 - DNA, 25 bp, Mus musculus
aaggcagcgaggtttgaatggactc

SEQ ID NO: 270884 - DNA, 25 bp, Mus musculus
tccgctctcgggagcgatcagcacg

SEQ ID NO: 270885 - DNA, 25 bp, Mus musculus
acacgagctggggtgcgtccgctct

SEQ ID NO: 270886 - DNA, 25 bp, Mus musculus
tgcgctcttcctgattctgaggccg

SEQ ID NO: 270887 - DNA, 25 bp, Mus musculus
aaaacccgggcggtgccttctgctg

SEQ ID NO: 270888 - DNA, 25 bp, Mus musculus
agctcaccagtgctggcgcacagcg

SEQ ID NO: 270889 - DNA, 25 bp, Mus musculus
ttcttcctctgctgcgcgcggtgca

SEQ ID NO: 270890 - DNA, 25 bp, Mus musculus
gacggccgcaagcagcagctctctg

SEQ ID NO: 270891 - DNA, 25 bp, Mus musculus
tgtccaccgcgaaccaggaggcgct

SEQ ID NO: 270892 - DNA, 25 bp, Mus musculus
aaagtttgcactgcgggatccgaga

SEQ ID NO: 270893 - DNA, 25 bp, Mus musculus
ggtttgaggaacgtccctctgccta

SEQ ID NO: 270894 - DNA, 25 bp, Mus musculus
catactgccggagcgaacttgcccg

SEQ ID NO: 270895 - DNA, 25 bp, Mus musculus
acagcgagactgctctccctggggc

SEQ ID NO: 270896 - DNA, 25 bp, Mus musculus
tccaaagcgccacatgtcgtctctg

SEQ ID NO: 270897 - DNA, 25 bp, Mus musculus
cacatgtcgtctctgggtttgagga

SEQ ID NO: 270898 - DNA, 25 bp, Mus musculus
agattccggtgcgagctcaccagtg

SEQ ID NO: 270899 - DNA, 25 bp, Mus musculus
gcagtctccgggcaaagtttgcact

SEQ ID NO: 270900 - DNA, 25 bp, Mus musculus
gaccgctgcgggaagcgcgatccac

SEQ ID NO: 270901 - DNA, 25 bp, Mus musculus
cattcgcctgagacccgacttcggg

SEQ ID NO: 270902 - DNA, 25 bp, Mus musculus
ctgaccctgttctctgtgccatgtg

SEQ ID NO: 270903 - DNA, 25 bp, Mus musculus
ccctgctggagcctggctgatcacg

SEQ ID NO: 270904 - DNA, 25 bp, Mus musculus
ctggaggcccgaaccggccttggct

SEQ ID NO: 270905 - DNA, 25 bp, Mus musculus
cccgggaacatgtcctttgtgaagg

SEQ ID NO: 270906 - DNA, 25 bp, Mus musculus
aggaaggcttttcggcatcttctcg

SEQ ID NO: 270907 - DNA, 25 bp, Mus musculus
gctgttgaaaggctacgacattcgc

SEQ ID NO: 270908 - DNA, 25 bp, Mus musculus
gcgcgatccaccgtgttggcggtct

SEQ ID NO: 270909 - DNA, 25 bp, Mus musculus
ctgatcacggtgtgctgcgcttccc

SEQ ID NO: 270910 - DNA, 25 bp, Mus musculus
ctgcgtggggatgaacatcgacatc

SEQ ID NO: 270911 - DNA, 25 bp, Mus musculus
atcgccagcatcgacatggtttctg

SEQ ID NO: 270912 - DNA, 25 bp, Mus musculus
atcgacatggtttctgaagtcaaca

SEQ ID NO: 270913 - DNA, 25 bp, Mus musculus
aaggagacggtcgacaagctgttga

SEQ ID NO: 270914 - DNA, 25 bp, Mus musculus
acgctgactgtggtgtctgtgcgtc

SEQ ID NO: 270915 - DNA, 25 bp, Mus musculus
cgaagagtccgcatcctcgggatgg

SEQ ID NO: 270916 - DNA, 25 bp, Mus musculus
gggcaccgaggactccacgatcgga

SEQ ID NO: 270917 - DNA, 25 bp, Mus musculus
caagaccaccaagtacacgctgctg

SEQ ID NO: 270918 - DNA, 25 bp, Mus musculus
acgctgctgtccttcttgcccaaga

SEQ ID NO: 270919 - DNA, 25 bp, Mus musculus
cctgtgctcttcattctggcggtca

SEQ ID NO: 270920 - DNA, 25 bp, Mus musculus
actttgtgccggctgtgaacgcctt

SEQ ID NO: 270921 - DNA, 25 bp, Mus musculus
tgtgtacttcgtcttcatcgcgctg

SEQ ID NO: 270922 - DNA, 25 bp, Mus musculus
atgatcacctaggaggctggcgcga

SEQ ID NO: 270923 - DNA, 25 bp, Mus musculus
agttccaccgcctagccaatgtgta

SEQ ID NO: 270924 - DNA, 25 bp, Mus musculus
ctggcggtcacagccatcaaagacc

SEQ ID NO: 270925 - DNA, 25 bp, Mus musculus
gctctttttgtttcccgctatccgc

SEQ ID NO: 270926 - DNA, 25 bp, Mus musculus
tcatcgcgctgctcaactttgtgcc

SEQ ID NO: 270927 - DNA, 25 bp, Mus musculus
caatctgaatctgggcgctgagtga

SEQ ID NO: 270928 - DNA, 25 bp, Mus musculus
gggcctcatctaagcagagatcgga

SEQ ID NO: 270929 - DNA, 25 bp, Mus musculus
ccactgtggacagatcgcgacagca

SEQ ID NO: 270930 - DNA, 25 bp, Mus musculus
tccttctgcttctcttcggagttgc

SEQ ID NO: 270931 - DNA, 25 bp, Mus musculus
cgcttcagcgccgacttcaaggttg

SEQ ID NO: 270932 - DNA, 25 bp, Mus musculus
gacttcaaggttgcccaggcgcctg

SEQ ID NO: 270933 - DNA, 25 bp, Mus musculus
ggctgctgcagccttaactgtcagt

SEQ ID NO: 270934 - DNA, 25 bp, Mus musculus
gttacgcttctcttccgtcgacctg

SEQ ID NO: 270935 - DNA, 25 bp, Mus musculus
acagggcctttcgtctttgccagca

SEQ ID NO: 270936 - DNA, 25 bp, Mus musculus
tgactccaggagacgacagggcctt

SEQ ID NO: 270937 - DNA, 25 bp, Mus musculus
gcgctcctctttgggtgactccagg

SEQ ID NO: 270938 - DNA, 25 bp, Mus musculus
atccgtatttctcccaagatggtgg

SEQ ID NO: 270939 - DNA, 25 bp, Mus musculus
ctgcgttcgcgagatccgtatttct

SEQ ID NO: 270940 - DNA, 25 bp, Mus musculus
agtcctctcgtccagtgctgcgttc

SEQ ID NO: 270941 - DNA, 25 bp, Mus musculus
ctcggcctcggtttcctgaggagaa

SEQ ID NO: 270942 - DNA, 25 bp, Mus musculus
gacgtcaagtcacgtgaccgccagc

SEQ ID NO: 270943 - DNA, 25 bp, Mus musculus
cccgcggtcagtctgaaagaaaaga

SEQ ID NO: 270944 - DNA, 25 bp, Mus musculus
atccggagcctgagatttcggagga

SEQ ID NO: 270945 - DNA, 25 bp, Mus musculus
gtcgctagtttcaagttcggccgga

SEQ ID NO: 270946 - DNA, 25 bp, Mus musculus
aggatccgctccgtgctcacgctga

SEQ ID NO: 270947 - DNA, 25 bp, Mus musculus
cgggcttgttgcttgcgggcaacta

SEQ ID NO: 270948 - DNA, 25 bp, Mus musculus
cagcggccgaatcactgtgggtcgc

SEQ ID NO: 270949 - DNA, 25 bp, Mus musculus
tgaaatcccgcatgagcctcctacg

SEQ ID NO: 270950 - DNA, 25 bp, Mus musculus
ccttaccgcttgaaatcccgcatga

SEQ ID NO: 270951 - DNA, 25 bp, Mus musculus
tattgggctaagacgagggccctta

SEQ ID NO: 270952 - DNA, 25 bp, Mus musculus
ggcttcgggaagaggccgtcatatt

SEQ ID NO: 270953 - DNA, 25 bp, Mus musculus
cgccctacagtccatggcttcggga

SEQ ID NO: 270954 - DNA, 25 bp, Mus musculus
tcagggtcaccaggaggaagatatc

SEQ ID NO: 270955 - DNA, 25 bp, Mus musculus
agactgcacaaacaaccctgcaatg

SEQ ID NO: 270956 - DNA, 25 bp, Mus musculus
agatgcaggacagcgatgccgttcc

SEQ ID NO: 270957 - DNA, 25 bp, Mus musculus
ggacctgagcgaccctaactttgca

SEQ ID NO: 270958 - DNA, 25 bp, Mus musculus
ggcgcagacatgtcggaacaaagta

SEQ ID NO: 270959 - DNA, 25 bp, Mus musculus
gttgaccctaaaatcctgcagcagg

SEQ ID NO: 270960 - DNA, 25 bp, Mus musculus
ggtcctgctctgatccgaaggcgca

SEQ ID NO: 270961 - DNA, 25 bp, Mus musculus
tgcccagctggtgcagaaggcgcac

SEQ ID NO: 270962 - DNA, 25 bp, Mus musculus
tccaagagctccaagccgcatcggt

SEQ ID NO: 270963 - DNA, 25 bp, Mus musculus
tgctggtctccaccgagggagtgcc

SEQ ID NO: 270964 - DNA, 25 bp, Mus musculus
tcagtaaagcgcacttcctctgctg

SEQ ID NO: 270965 - DNA, 25 bp, Mus musculus
cggaaggcgcagtgctcagtaaagc

SEQ ID NO: 270966 - DNA, 25 bp, Mus musculus
cgaaggccctatggcagcccaacag

SEQ ID NO: 270967 - DNA, 25 bp, Mus musculus
tcgccaccgcccgaagaacggatag

SEQ ID NO: 270968 - DNA, 25 bp, Mus musculus
gaacggatagaagatgttgacccta

SEQ ID NO: 270969 - DNA, 25 bp, Mus musculus
aaggcgcacgagctcatgtggtacg

SEQ ID NO: 270970 - DNA, 25 bp, Mus musculus
aaggcctggccgactctgcaaatct

SEQ ID NO: 270971 - DNA, 25 bp, Mus musculus
aaccttggctcggtacacgtcggca

SEQ ID NO: 270972 - DNA, 25 bp, Mus musculus
tgatcccgattggtgcacgaaaggc

SEQ ID NO: 270973 - DNA, 25 bp, Mus musculus
tggcttaaggccacacgggtgatcc

SEQ ID NO: 270974 - DNA, 25 bp, Mus musculus
tggggacccaagactagagcaaata

SEQ ID NO: 270975 - DNA, 25 bp, Mus musculus
tcgcagttgcccgattctaaccttg

SEQ ID NO: 270976 - DNA, 25 bp, Mus musculus
agctctgcctccaagcctcagtatt

SEQ ID NO: 270977 - DNA, 25 bp, Mus musculus
tccctgttggctcataggctgcagc

SEQ ID NO: 270978 - DNA, 25 bp, Mus musculus
ggttgtgccgaagccacgaactctc

SEQ ID NO: 270979 - DNA, 25 bp, Mus musculus
gccaggagtcctctgggcgtacaac

SEQ ID NO: 270980 - DNA, 25 bp, Mus musculus
ctctgcaaatctcgaggaggttctg

SEQ ID NO: 270981 - DNA, 25 bp, Mus musculus
catccgtgctgtgcattgggccaac

SEQ ID NO: 270982 - DNA, 25 bp, Mus musculus
gcggtctgggttgtcactttgcaga

SEQ ID NO: 270983 - DNA, 25 bp, Mus musculus
taaggatagtactcgcagttgcccg

SEQ ID NO: 270984 - DNA, 25 bp, Mus musculus
agctgcggagagaaccgcggaacac

SEQ ID NO: 270985 - DNA, 25 bp, Mus musculus
ttctgatgcgggctccgcctgcttc

SEQ ID NO: 270986 - DNA, 25 bp, Mus musculus
atagccgccctacggttctgatgcg

SEQ ID NO: 270987 - DNA, 25 bp, Mus musculus
gaaccgcggaacacgccagtctgca

SEQ ID NO: 270988 - DNA, 25 bp, Mus musculus
agtctgcaccggcttcctattcagc

SEQ ID NO: 270989 - DNA, 25 bp, Mus musculus
cctattcagccttcaagctggaggg

SEQ ID NO: 270990 - DNA, 25 bp, Mus musculus
ggatcctggacagccacgtcggcat

SEQ ID NO: 270991 - DNA, 25 bp, Mus musculus
tcagcactggaagaaaaagcgcagc

SEQ ID NO: 270992 - DNA, 25 bp, Mus musculus
aaaagcgcagcaaccggagacgggc

SEQ ID NO: 270993 - DNA, 25 bp, Mus musculus
ggagacgggccaccaccagtcaagc

SEQ ID NO: 270994 - DNA, 25 bp, Mus musculus
ccagtcaagcaagggacatgtcgca

SEQ ID NO: 270995 - DNA, 25 bp, Mus musculus
gcaagggacatgtcgcagctaagta

SEQ ID NO: 270996 - DNA, 25 bp, Mus musculus
tgtcgcagctaagtacgaatctggg

SEQ ID NO: 270997 - DNA, 25 bp, Mus musculus
cacgtcggcatgctcagcactggaa

SEQ ID NO: 270998 - DNA, 25 bp, Mus musculus
agcgacagttatcgccctccttgca

SEQ ID NO: 270999 - DNA, 25 bp, Mus musculus
ggccgagctgactcccgcagaagct

SEQ ID NO: 271000 - DNA, 25 bp, Mus musculus
tcaccaggagcggtgccagacccga

SEQ ID NO: 271001 - DNA, 25 bp, Mus musculus
agctccagcagcctcaaactgagga

SEQ ID NO: 271002 - DNA, 25 bp, Mus musculus
cttcggctggcgctggcctcaaact

SEQ ID NO: 271003 - DNA, 25 bp, Mus musculus
tgttgcgctccggaccagaccgggc

SEQ ID NO: 271004 - DNA, 25 bp, Mus musculus
ttgcttcgtccagctgccactgttg

SEQ ID NO: 271005 - DNA, 25 bp, Mus musculus
tacctgcagaggatttgcttcgtcc

SEQ ID NO: 271006 - DNA, 25 bp, Mus musculus
cgccgcccagaaaggtcgtgagagt

SEQ ID NO: 271007 - DNA, 25 bp, Mus musculus
ccttgcactgcccatgcagataata

SEQ ID NO: 271008 - DNA, 25 bp, Mus musculus
ggtcgtgagagtagcgacagttatc

SEQ ID NO: 271009 - DNA, 25 bp, Mus musculus
gccagacccgatgcctgctgcagag

SEQ ID NO: 271010 - DNA, 25 bp, Mus musculus
tgcccatgcagataatacctgcaga

SEQ ID NO: 271011 - DNA, 25 bp, Mus musculus
cctggagtcaccaggagcggtgcca

SEQ ID NO: 271012 - DNA, 25 bp, Mus musculus
tgagcgggaagctttgcctgtagct

SEQ ID NO: 271013 - DNA, 25 bp, Mus musculus
agctgtagccctcgcgaatgaagtc

SEQ ID NO: 271014 - DNA, 25 bp, Mus musculus
gctttgcctgtagctgtagccctcg

SEQ ID NO: 271015 - DNA, 25 bp, Mus musculus
agccctcgcgaatgaagtctccgca

SEQ ID NO: 271016 - DNA, 25 bp, Mus musculus
ggtcgccgtcactcgtgcgggtctc

SEQ ID NO: 271017 - DNA, 25 bp, Mus musculus
actcgtgcgggtctccgactgagat

SEQ ID NO: 271018 - DNA, 25 bp, Mus musculus
ggctgcgggatgcttactttgccca

SEQ ID NO: 271019 - DNA, 25 bp, Mus musculus
cccggggatacctcaaggccgagct

SEQ ID NO: 271020 - DNA, 25 bp, Mus musculus
tccgctgatgctgctctccgtagca

SEQ ID NO: 271021 - DNA, 25 bp, Mus musculus
tgatgctgctctccgtagcagccgc

SEQ ID NO: 271022 - DNA, 25 bp, Mus musculus
atgagccggtccacgtcggcagagc

SEQ ID NO: 271023 - DNA, 25 bp, Mus musculus
cgtcactggcggctcggttgaccgc

SEQ ID NO: 271024 - DNA, 25 bp, Mus musculus
acaaaggcccgaggaacgagtgagc

SEQ ID NO: 271025 - DNA, 25 bp, Mus musculus
tttcccgaaagaaggagctgctgca

SEQ ID NO: 271026 - DNA, 25 bp, Mus musculus
caccggcctctccagcgggttgtag

SEQ ID NO: 271027 - DNA, 25 bp, Mus musculus
cgaagcgcaacctggtccgggacag

SEQ ID NO: 271028 - DNA, 25 bp, Mus musculus
agactcaccacatccatgatctgca

SEQ ID NO: 271029 - DNA, 25 bp, Mus musculus
gctgcgagtcgttggccaccggcct

SEQ ID NO: 271030 - DNA, 25 bp, Mus musculus
ctccagcgggttgtagttcttgacc

SEQ ID NO: 271031 - DNA, 25 bp, Mus musculus
agctccttgtacagcctcctctgga

SEQ ID NO: 271032 - DNA, 25 bp, Mus musculus
ttgtacagcctcctctggaactcgc

SEQ ID NO: 271033 - DNA, 25 bp, Mus musculus
ggaactcgccttgcagggacactta

SEQ ID NO: 271034 - DNA, 25 bp, Mus musculus
cacttaggaagcagagcgcccagcg

SEQ ID NO: 271035 - DNA, 25 bp, Mus musculus
agccgcgctgaggttaccgtgcagc

SEQ ID NO: 271036 - DNA, 25 bp, Mus musculus
tgaggttaccgtgcagcagcgccgc

SEQ ID NO: 271037 - DNA, 25 bp, Mus musculus
ccgcctccgcgcctttaaagcgctg

SEQ ID NO: 271038 - DNA, 25 bp, Mus musculus
cagggacacttaggaagcagagcgc

SEQ ID NO: 271039 - DNA, 25 bp, Mus musculus
atccatgatctgcaggaggctcagg

SEQ ID NO: 271040 - DNA, 25 bp, Mus musculus
tccgcactggaacgtgatggcaagc

SEQ ID NO: 271041 - DNA, 25 bp, Mus musculus
tctgcattgcgggaacagttcggga

SEQ ID NO: 271042 - DNA, 25 bp, Mus musculus
cattgcgggaacagttcgggatctc

SEQ ID NO: 271043 - DNA, 25 bp, Mus musculus
acagttcgggatctcgtgggcgcca

SEQ ID NO: 271044 - DNA, 25 bp, Mus musculus
accggctccggcttcagccgggcga

SEQ ID NO: 271045 - DNA, 25 bp, Mus musculus
gcccttttcgcggttccgcactgga

SEQ ID NO: 271046 - DNA, 25 bp, Mus musculus
cttgcacaggggctatggctacgtg

SEQ ID NO: 271047 - DNA, 25 bp, Mus musculus
agggctcacactgcgcgtctgcatt

SEQ ID NO: 271048 - DNA, 25 bp, Mus musculus
cactggaacgtgatggcaagcgcgc

SEQ ID NO: 271049 - DNA, 25 bp, Mus musculus
gtccgaagggcagggttagctcaga

SEQ ID NO: 271050 - DNA, 25 bp, Mus musculus
agggttagctcagagcggcgcctga

SEQ ID NO: 271051 - DNA, 25 bp, Mus musculus
agcggcgcctgaggcggcttgcaca

SEQ ID NO: 271052 - DNA, 25 bp, Mus musculus
ctatggctacgtgggtcacggtggc

SEQ ID NO: 271053 - DNA, 25 bp, Mus musculus
ttcgcggttccgcactggaacgtga

SEQ ID NO: 271054 - DNA, 25 bp, Mus musculus
taagatgggtcgtgccaactctgcc

SEQ ID NO: 271055 - DNA, 25 bp, Mus musculus
agcacctcgccgtcggagaagacca

SEQ ID NO: 271056 - DNA, 25 bp, Mus musculus
tgcctggaagtacagcacggacgta

SEQ ID NO: 271057 - DNA, 25 bp, Mus musculus
aagctgagcctcaacatcctgcgcg

SEQ ID NO: 271058 - DNA, 25 bp, Mus musculus
gccatgcaaggcgagcgcaaattca

SEQ ID NO: 271059 - DNA, 25 bp, Mus musculus
caaattcatcttcgccggcctgctg

SEQ ID NO: 271060 - DNA, 25 bp, Mus musculus
gccaccggcaccagtttcacgagga

SEQ ID NO: 271061 - DNA, 25 bp, Mus musculus
ggagatgatcggctactacctgacc

SEQ ID NO: 271062 - DNA, 25 bp, Mus musculus
cgctttagcgcggagcaagaacagc

SEQ ID NO: 271063 - DNA, 25 bp, Mus musculus
cagctggtgctcaagctcaaggagc

SEQ ID NO: 271064 - DNA, 25 bp, Mus musculus
tgcgcaccgtcaatacagtggagtc

SEQ ID NO: 271065 - DNA, 25 bp, Mus musculus
tctgccaacggcaaaaacggcgaca

SEQ ID NO: 271066 - DNA, 25 bp, Mus musculus
gtcgcagacctacagcaacggcttc

SEQ ID NO: 271067 - DNA, 25 bp, Mus musculus
ccgcggagcacaagtcgcagaccta

SEQ ID NO: 271068 - DNA, 25 bp, Mus musculus
atggggcagctgaacttcttctcgc

SEQ ID NO: 271069 - DNA, 25 bp, Mus musculus
agctgaacttcttctcgcccgtgtg

SEQ ID NO: 271070 - DNA, 25 bp, Mus musculus
tgcgtgcgatagtgccgtgccagct

SEQ ID NO: 271071 - DNA, 25 bp, Mus musculus
tagtgccgtgccagctcgtccgagc

SEQ ID NO: 271072 - DNA, 25 bp, Mus musculus
ccgcatgaagcgcttctcacagatg

SEQ ID NO: 271073 - DNA, 25 bp, Mus musculus
gtcgctccgcatgaagcgcttctca

SEQ ID NO: 271074 - DNA, 25 bp, Mus musculus
ctgctggcatcggagcggctgtagt

SEQ ID NO: 271075 - DNA, 25 bp, Mus musculus
ctgtagtcgctgagcgagccggtcc

SEQ ID NO: 271076 - DNA, 25 bp, Mus musculus
agtcgctgagcgagccggtcctcga

SEQ ID NO: 271077 - DNA, 25 bp, Mus musculus
gctgcagcatgcctgggtggaagtt

SEQ ID NO: 271078 - DNA, 25 bp, Mus musculus
tggtcgctccgcatgaagcgcttct

SEQ ID NO: 271079 - DNA, 25 bp, Mus musculus
tgcgatagtgccgtgccagctcgtc

SEQ ID NO: 271080 - DNA, 25 bp, Mus musculus
atgaagcgcttctcacagatggggc

SEQ ID NO: 271081 - DNA, 25 bp, Mus musculus
gcgcttctcacagatggggcagctg

SEQ ID NO: 271082 - DNA, 25 bp, Mus musculus
gcgcgccagagacacggttacataa

SEQ ID NO: 271083 - DNA, 25 bp, Mus musculus
agggaacacaacgtcccatatgctc

SEQ ID NO: 271084 - DNA, 25 bp, Mus musculus
aacgtcccatatgctcttgcccaag

SEQ ID NO: 271085 - DNA, 25 bp, Mus musculus
caagccacaggcttgggcgggaaca

SEQ ID NO: 271086 - DNA, 25 bp, Mus musculus
cttgggcgggaacagcatgttctca

SEQ ID NO: 271087 - DNA, 25 bp, Mus musculus
gaacagcatgttctcagtgaagccg

SEQ ID NO: 271088 - DNA, 25 bp, Mus musculus
cgccaaagccctcaccgggattgaa

SEQ ID NO: 271089 - DNA, 25 bp, Mus musculus
agccctcaccgggattgaatgcgca

SEQ ID NO: 271090 - DNA, 25 bp, Mus musculus
cacggttacataaatgttccctggc

SEQ ID NO: 271091 - DNA, 25 bp, Mus musculus
cgctggtagcagcaagcagtgcatg

SEQ ID NO: 271092 - DNA, 25 bp, Mus musculus
cgggctgagcgtgattgcctcatct

SEQ ID NO: 271093 - DNA, 25 bp, Mus musculus
cgtgattgcctcatcttatcaggga

SEQ ID NO: 271094 - DNA, 25 bp, Mus musculus
caccgggattgaatgcgcactgtcc

SEQ ID NO: 271095 - DNA, 25 bp, Mus musculus
ctcatcttatcagggaacacaacgt

SEQ ID NO: 271096 - DNA, 25 bp, Mus musculus
tgggtctatcttccgcttcgtgtca

SEQ ID NO: 271097 - DNA, 25 bp, Mus musculus
tggttctcaggacgaggtcgacagc

SEQ ID NO: 271098 - DNA, 25 bp, Mus musculus
cgacagcgcggcgagacgggccact

SEQ ID NO: 271099 - DNA, 25 bp, Mus musculus
actgtgctcggaacgcggcagtgcc

SEQ ID NO: 271100 - DNA, 25 bp, Mus musculus
ttgcgtactgtgctcggaacgcggc

SEQ ID NO: 271101 - DNA, 25 bp, Mus musculus
ccagtcttgcgtactgtgctcggaa

SEQ ID NO: 271102 - DNA, 25 bp, Mus musculus
gcaatttccagtcttgcgtactgtg

SEQ ID NO: 271103 - DNA, 25 bp, Mus musculus
cctcagcaatttccagtcttgcgta

SEQ ID NO: 271104 - DNA, 25 bp, Mus musculus
gtcaggacctcagcaatttccagtc

SEQ ID NO: 271105 - DNA, 25 bp, Mus musculus
cgggtcaggacctcagcaatttcca

SEQ ID NO: 271106 - DNA, 25 bp, Mus musculus
gctgggacttgcacgcagccgggcc

SEQ ID NO: 271107 - DNA, 25 bp, Mus musculus
tatcttccgcttcgtgtcactttcc

SEQ ID NO: 271108 - DNA, 25 bp, Mus musculus
ccttgggtctatcttccgcttcgtg

SEQ ID NO: 271109 - DNA, 25 bp, Mus musculus
cttccgggtcaggacctcagcaatt

SEQ ID NO: 271110 - DNA, 25 bp, Mus musculus
cccactgacctgtgtgagttctcag

SEQ ID NO: 271111 - DNA, 25 bp, Mus musculus
ggtcgcagttccaccgtgcattgtg

SEQ ID NO: 271112 - DNA, 25 bp, Mus musculus
ccctgcaagttgtggtcgcagttcc

SEQ ID NO: 271113 - DNA, 25 bp, Mus musculus
cggcgtcagagtcggcctgtcttag

SEQ ID NO: 271114 - DNA, 25 bp, Mus musculus
tgctctcgcaggagtcgtcagcggc

SEQ ID NO: 271115 - DNA, 25 bp, Mus musculus
aaagtggtccacataggcggcggct

SEQ ID NO: 271116 - DNA, 25 bp, Mus musculus
gcactcggcggcaaagtggtccaca

SEQ ID NO: 271117 - DNA, 25 bp, Mus musculus
ctggacatggacacgaggcactcgg

SEQ ID NO: 271118 - DNA, 25 bp, Mus musculus
aaaagcgaggcgctgtccttgccgt

SEQ ID NO: 271119 - DNA, 25 bp, Mus musculus
atccgagccaccacgaaaagcgagg

SEQ ID NO: 271120 - DNA, 25 bp, Mus musculus
ttgaggtccgctaggatccgagcca

SEQ ID NO: 271121 - DNA, 25 bp, Mus musculus
cagcccgcgtagtggcacttgtgct

SEQ ID NO: 271122 - DNA, 25 bp, Mus musculus
ccttgaggtgcgaagatttcccgta

SEQ ID NO: 271123 - DNA, 25 bp, Mus musculus
cgtaaactttctcgcagcccgcgta

SEQ ID NO: 271124 - DNA, 25 bp, Mus musculus
tgaaggtcccttgagcacagagctg

SEQ ID NO: 271125 - DNA, 25 bp, Mus musculus
gcgggtgttacaggcactcaactga

SEQ ID NO: 271126 - DNA, 25 bp, Mus musculus
agagcaaactcgtgcgctactaccc

SEQ ID NO: 271127 - DNA, 25 bp, Mus musculus
cctctgcgggagagcaaactcgtgc

SEQ ID NO: 271128 - DNA, 25 bp, Mus musculus
tgactgtcgaaagcaccgattccca

SEQ ID NO: 271129 - DNA, 25 bp, Mus musculus
cggctcgcccttgaaggtcccttga

SEQ ID NO: 271130 - DNA, 25 bp, Mus musculus
acagagctgagacctggatcggacc

SEQ ID NO: 271131 - DNA, 25 bp, Mus musculus
tggatcggaccctggcatctccgca

SEQ ID NO: 271132 - DNA, 25 bp, Mus musculus
atctccgcaggcgagttcgatccgc

SEQ ID NO: 271133 - DNA, 25 bp, Mus musculus
atccgcgggcggatttcaagagcac

SEQ ID NO: 271134 - DNA, 25 bp, Mus musculus
gcggatttcaagagcacggaagctg

SEQ ID NO: 271135 - DNA, 25 bp, Mus musculus
acggaagctgcaccaagtctgaacg

SEQ ID NO: 271136 - DNA, 25 bp, Mus musculus
caagtctgaacgcagcgggtgttac

SEQ ID NO: 271137 - DNA, 25 bp, Mus musculus
ggcactcaactgactgtcgaaagca

SEQ ID NO: 271138 - DNA, 25 bp, Mus musculus
cctctgtggcgcagcctttagtcaa

SEQ ID NO: 271139 - DNA, 25 bp, Mus musculus
agaagcccttcgtgtgcacgcagtg

SEQ ID NO: 271140 - DNA, 25 bp, Mus musculus
gccacaggcgtatccacacgggtga

SEQ ID NO: 271141 - DNA, 25 bp, Mus musculus
cgcagtgttgctcagccacaggcgt

SEQ ID NO: 271142 - DNA, 25 bp, Mus musculus
aggcctttgccaagggcgcagtgtt

SEQ ID NO: 271143 - DNA, 25 bp, Mus musculus
gcatcagctgctgcacacgggcgaa

SEQ ID NO: 271144 - DNA, 25 bp, Mus musculus
tcgctcttcaagcaccagcgtgtgc

SEQ ID NO: 271145 - DNA, 25 bp, Mus musculus
tatgcctgctccctctgtggcgcag

SEQ ID NO: 271146 - DNA, 25 bp, Mus musculus
cttattcagcacgaacgcacgcaca

SEQ ID NO: 271147 - DNA, 25 bp, Mus musculus
gcttctgccgcaactcacatcttat

SEQ ID NO: 271148 - DNA, 25 bp, Mus musculus
ggccctatgcctgcgcacagtgcgg

SEQ ID NO: 271149 - DNA, 25 bp, Mus musculus
ctttagtcaaggctcctcgctcttc

SEQ ID NO: 271150 - DNA, 25 bp, Mus musculus
tgtccacactgtggccgtgccttca

SEQ ID NO: 271151 - DNA, 25 bp, Mus musculus
agaagcctttctcttgtccacactg

SEQ ID NO: 271152 - DNA, 25 bp, Mus musculus
ggcatgaccctcgtgagtcgcagta

SEQ ID NO: 271153 - DNA, 25 bp, Mus musculus
aaccgtccggagctgcatttctttc

SEQ ID NO: 271154 - DNA, 25 bp, Mus musculus
cctagtcctgccgtgtgacgagatc

SEQ ID NO: 271155 - DNA, 25 bp, Mus musculus
attctctggccgaagtcctgcggtc

SEQ ID NO: 271156 - DNA, 25 bp, Mus musculus
gtagaaacttgtagcgctccgcggc

SEQ ID NO: 271157 - DNA, 25 bp, Mus musculus
agccacgggcgcagtagaaacttgt

SEQ ID NO: 271158 - DNA, 25 bp, Mus musculus
ggcggcaccatgttctctctcaagc

SEQ ID NO: 271159 - DNA, 25 bp, Mus musculus
acgctgaaccgggagacttctgacc

SEQ ID NO: 271160 - DNA, 25 bp, Mus musculus
agctttgactgcagctccgcgcgag

SEQ ID NO: 271161 - DNA, 25 bp, Mus musculus
accgcctagagactgaaagctttga

SEQ ID NO: 271162 - DNA, 25 bp, Mus musculus
gcgctccgtgacagtaccgcctaga

SEQ ID NO: 271163 - DNA, 25 bp, Mus musculus
cgctctcaagatggcctctcgggtc

SEQ ID NO: 271164 - DNA, 25 bp, Mus musculus
ggcctccgtagaagcgcgctctcaa

SEQ ID NO: 271165 - DNA, 25 bp, Mus musculus
gtcgcagtaggcctgtgaaatcctc

SEQ ID NO: 271166 - DNA, 25 bp, Mus musculus
ctctcaaagggccacaaggcgggca

SEQ ID NO: 271167 - DNA, 25 bp, Mus musculus
cagagcaaggcgctacaggcatccc

SEQ ID NO: 271168 - DNA, 25 bp, Mus musculus
catgctctgtgtccctcgcttcgga

SEQ ID NO: 271169 - DNA, 25 bp, Mus musculus
atacagatcggagcggacctgcagc

SEQ ID NO: 271170 - DNA, 25 bp, Mus musculus
agaaccctgaagtggatacagatcg

SEQ ID NO: 271171 - DNA, 25 bp, Mus musculus
gcaacttctggaacgagaaccctga

SEQ ID NO: 271172 - DNA, 25 bp, Mus musculus
ctgaaacgtagaatggcaacttctg

SEQ ID NO: 271173 - DNA, 25 bp, Mus musculus
ggtcggccgacaactgaaacgtaga

SEQ ID NO: 271174 - DNA, 25 bp, Mus musculus
tgcacttactttcagggcctttcta

SEQ ID NO: 271175 - DNA, 25 bp, Mus musculus
cgtttgtcttaaaaagaggacgctg

SEQ ID NO: 271176 - DNA, 25 bp, Mus musculus
agaggacgctgactcgctcagactc

SEQ ID NO: 271177 - DNA, 25 bp, Mus musculus
ctgaactcactgcagcggaacaggc

SEQ ID NO: 271178 - DNA, 25 bp, Mus musculus
cggaacaggctgagtcgctctcaaa

SEQ ID NO: 271179 - DNA, 25 bp, Mus musculus
cttcggaaggaccaagctgcactta

SEQ ID NO: 271180 - DNA, 25 bp, Mus musculus
cattggtcatctcaagcgccttggc

SEQ ID NO: 271181 - DNA, 25 bp, Mus musculus
gttggtggctttcctgatttccctc

SEQ ID NO: 271182 - DNA, 25 bp, Mus musculus
gatttccctcagacaccgttccaga

SEQ ID NO: 271183 - DNA, 25 bp, Mus musculus
ttccagagtctgtcgacgaaacacg

SEQ ID NO: 271184 - DNA, 25 bp, Mus musculus
cgcgaggcgccatagctacacacta

SEQ ID NO: 271185 - DNA, 25 bp, Mus musculus
cgccttatgcaacctgaagctcaga

SEQ ID NO: 271186 - DNA, 25 bp, Mus musculus
gctcagagcctaaagttccgccaca

SEQ ID NO: 271187 - DNA, 25 bp, Mus musculus
caaacacttctattgggcatgcgta

SEQ ID NO: 271188 - DNA, 25 bp, Mus musculus
ctacaggtgaatacggggcaccatc

SEQ ID NO: 271189 - DNA, 25 bp, Mus musculus
cggtctagctccctgaagggtattg

SEQ ID NO: 271190 - DNA, 25 bp, Mus musculus
gtttccacgcccacttcagctttga

SEQ ID NO: 271191 - DNA, 25 bp, Mus musculus
gcaagcctgtagcttctggacatga

SEQ ID NO: 271192 - DNA, 25 bp, Mus musculus
ccagacctggatctgtacttacgtg

SEQ ID NO: 271193 - DNA, 25 bp, Mus musculus
tcccagttgtctctgccctaggtcg

SEQ ID NO: 271194 - DNA, 25 bp, Mus musculus
cttgattccctaaggtctctttaga

SEQ ID NO: 271195 - DNA, 25 bp, Mus musculus
agcgctccctttcggaccttgtggg

SEQ ID NO: 271196 - DNA, 25 bp, Mus musculus
atgctgtggtcccagcgctcccttt

SEQ ID NO: 271197 - DNA, 25 bp, Mus musculus
gcgcgggctcacaaagagctgctgc

SEQ ID NO: 271198 - DNA, 25 bp, Mus musculus
atcagctggccgctaggttatcagg

SEQ ID NO: 271199 - DNA, 25 bp, Mus musculus
cagcttcccgggctcattagcagtc

SEQ ID NO: 271200 - DNA, 25 bp, Mus musculus
agcatctttgtctgcgctttgcgcg

SEQ ID NO: 271201 - DNA, 25 bp, Mus musculus
cgctgggcgccgaagcatctttgtc

SEQ ID NO: 271202 - DNA, 25 bp, Mus musculus
tcgcggagcctatctcagcccgtat

SEQ ID NO: 271203 - DNA, 25 bp, Mus musculus
aacctgtgtgctcctcaaggggcca

SEQ ID NO: 271204 - DNA, 25 bp, Mus musculus
cagctcactcccaggaacctgtgtg

SEQ ID NO: 271205 - DNA, 25 bp, Mus musculus
gcccaggaccagactgttaaggctc

SEQ ID NO: 271206 - DNA, 25 bp, Mus musculus
tcattagcagtctcggtgtgcggct

SEQ ID NO: 271207 - DNA, 25 bp, Mus musculus
ccgcgcggtcttgaatcccttgatt

SEQ ID NO: 271208 - DNA, 25 bp, Mus musculus
ggtagtcgcccaccacgtgcttcag

SEQ ID NO: 271209 - DNA, 25 bp, Mus musculus
cgaacacgtattgcaggcgctcggc

SEQ ID NO: 271210 - DNA, 25 bp, Mus musculus
gcttcagaaggttggggtacacgtc

SEQ ID NO: 271211 - DNA, 25 bp, Mus musculus
accacgtgcttcaggatgtccgtcc

SEQ ID NO: 271212 - DNA, 25 bp, Mus musculus
tgcttcaggatgtccgtccgcttga

SEQ ID NO: 271213 - DNA, 25 bp, Mus musculus
gtccgtccgcttgatcgggatcttc

SEQ ID NO: 271214 - DNA, 25 bp, Mus musculus
cttctggtccttgatcagcaggaac

SEQ ID NO: 271215 - DNA, 25 bp, Mus musculus
gatcagcaggaactgcaccagctcg

SEQ ID NO: 271216 - DNA, 25 bp, Mus musculus
gacgtgctgggtccttcctcgccag

SEQ ID NO: 271217 - DNA, 25 bp, Mus musculus
cgggagcagcaaccgccagaagact

SEQ ID NO: 271218 - DNA, 25 bp, Mus musculus
cggggactcttcatagctactgcgc

SEQ ID NO: 271219 - DNA, 25 bp, Mus musculus
ggactcttcatagctactgcgcatg

SEQ ID NO: 271220 - DNA, 25 bp, Mus musculus
cttgatcgggatcttcttctggtcc

SEQ ID NO: 271221 - DNA, 25 bp, Mus musculus
ggcttctgcaacatgtccccggtcg

SEQ ID NO: 271222 - DNA, 25 bp, Mus musculus
tctccagactgacccacagccctgc

SEQ ID NO: 271223 - DNA, 25 bp, Mus musculus
aactccgggcgcaacgctttggagc

SEQ ID NO: 271224 - DNA, 25 bp, Mus musculus
ggcccggacttggaaactgctagcc

SEQ ID NO: 271225 - DNA, 25 bp, Mus musculus
aaactgctagccgagccgcagctgc

SEQ ID NO: 271226 - DNA, 25 bp, Mus musculus
agcggggaccagtcggtcctctcca

SEQ ID NO: 271227 - DNA, 25 bp, Mus musculus
ccgccgcagacactcaccgagaagc

SEQ ID NO: 271228 - DNA, 25 bp, Mus musculus
cgactgctacccaccaggtggcgaa

SEQ ID NO: 271229 - DNA, 25 bp, Mus musculus
caggcaggcaccagccaccgactgc

SEQ ID NO: 271230 - DNA, 25 bp, Mus musculus
cgccttggtcacagtcgcccgctgc

SEQ ID NO: 271231 - DNA, 25 bp, Mus musculus
cacagcgggtactgcaccgggctcg

SEQ ID NO: 271232 - DNA, 25 bp, Mus musculus
gagccgtgcacagcgggtactgcac

SEQ ID NO: 271233 - DNA, 25 bp, Mus musculus
gcgcctggctgttttcccctcagaa

SEQ ID NO: 271234 - DNA, 25 bp, Mus musculus
cctcagaaaagtaactccgggcgca

SEQ ID NO: 271235 - DNA, 25 bp, Mus musculus
aaccgcagcgaagggagccgtgcac

SEQ ID NO: 271236 - DNA, 25 bp, Mus musculus
accgggcgcacgttcgcaacgttct

SEQ ID NO: 271237 - DNA, 25 bp, Mus musculus
tagcaccagcgagcagcagcctata

SEQ ID NO: 271238 - DNA, 25 bp, Mus musculus
agcccaagggccaaggacactaccg

SEQ ID NO: 271239 - DNA, 25 bp, Mus musculus
cttgtttattataggggcgcgttgc

SEQ ID NO: 271240 - DNA, 25 bp, Mus musculus
actaccgggcgcacaactggatgcc

SEQ ID NO: 271241 - DNA, 25 bp, Mus musculus
ggagtgtggcccacctcagccaata

SEQ ID NO: 271242 - DNA, 25 bp, Mus musculus
ccagctagcgcggtcagcgaagatt

SEQ ID NO: 271243 - DNA, 25 bp, Mus musculus
cgttgcacaggattgagggctctga

SEQ ID NO: 271244 - DNA, 25 bp, Mus musculus
cgctggctgctaaggtccgaatgaa

SEQ ID NO: 271245 - DNA, 25 bp, Mus musculus
ggacgagaaacgatcccagaggcta

SEQ ID NO: 271246 - DNA, 25 bp, Mus musculus
caaggccctcttctctggctgcaga

SEQ ID NO: 271247 - DNA, 25 bp, Mus musculus
agccactgttgctgctgtccaggga

SEQ ID NO: 271248 - DNA, 25 bp, Mus musculus
ctgcctctcgaagggtgagcgaact

SEQ ID NO: 271249 - DNA, 25 bp, Mus musculus
acggcccgtgactgcactgaaaaga

SEQ ID NO: 271250 - DNA, 25 bp, Mus musculus
ccaggattaaccagcactgcgcttg

SEQ ID NO: 271251 - DNA, 25 bp, Mus musculus
cggcatcatggacgagaagttgttc

SEQ ID NO: 271252 - DNA, 25 bp, Mus musculus
gccattacagaaagccgagtcccga

SEQ ID NO: 271253 - DNA, 25 bp, Mus musculus
acgagaagttgttcaccaaggagct

SEQ ID NO: 271254 - DNA, 25 bp, Mus musculus
gctccctgacgctggcgtgacgtca

SEQ ID NO: 271255 - DNA, 25 bp, Mus musculus
tgaacgagtgcaagcagctctccga

SEQ ID NO: 271256 - DNA, 25 bp, Mus musculus
actgcgcttgctcggactcgcttct

SEQ ID NO: 271257 - DNA, 25 bp, Mus musculus
aacgggttccggactcatggagtca

SEQ ID NO: 271258 - DNA, 25 bp, Mus musculus
aagagcgaagccacttccttcggca

SEQ ID NO: 271259 - DNA, 25 bp, Mus musculus
caacatggcggcacggaggccagac

SEQ ID NO: 271260 - DNA, 25 bp, Mus musculus
ctcatggagtcaaagcattgcgctt

SEQ ID NO: 271261 - DNA, 25 bp, Mus musculus
attgcgcttgcactcgggcttgctt

SEQ ID NO: 271262 - DNA, 25 bp, Mus musculus
cagctctccgagtcccaggtcaaga

SEQ ID NO: 271263 - DNA, 25 bp, Mus musculus
agcctctgcgagaaggtgagctgct

SEQ ID NO: 271264 - DNA, 25 bp, Mus musculus
acctccagttaataagcctagccgc

SEQ ID NO: 271265 - DNA, 25 bp, Mus musculus
gtggcgacctccagttaataagcct

SEQ ID NO: 271266 - DNA, 25 bp, Mus musculus
cgtggcgacctccagttaataagcc

SEQ ID NO: 271267 - DNA, 25 bp, Mus musculus
gcgtggcgacctccagttaataagc

SEQ ID NO: 271268 - DNA, 25 bp, Mus musculus
ggcgtggcgacctccagttaataag

SEQ ID NO: 271269 - DNA, 25 bp, Mus musculus
aggcgtggcgacctccagttaataa

SEQ ID NO: 271270 - DNA, 25 bp, Mus musculus
ccaggcgtggcgacctccagttaat

SEQ ID NO: 271271 - DNA, 25 bp, Mus musculus
cccaggcgtggcgacctccagttaa

SEQ ID NO: 271272 - DNA, 25 bp, Mus musculus
ctccagttaataagcctagccgcct

SEQ ID NO: 271273 - DNA, 25 bp, Mus musculus
gacctccagttaataagcctagccg

SEQ ID NO: 271274 - DNA, 25 bp, Mus musculus
gcgacctccagttaataagcctagc

SEQ ID NO: 271275 - DNA, 25 bp, Mus musculus
tccagttaataagcctagccgcctt

SEQ ID NO: 271276 - DNA, 25 bp, Mus musculus
tggcgacctccagttaataagccta

SEQ ID NO: 271277 - DNA, 25 bp, Mus musculus
cagttaataagcctagccgccttcg

SEQ ID NO: 271278 - DNA, 25 bp, Mus musculus
aaagggcttggatgtcgatttcctg

SEQ ID NO: 271279 - DNA, 25 bp, Mus musculus
ccgagtcggatactggggagaggac

SEQ ID NO: 271280 - DNA, 25 bp, Mus musculus
ctctgaaagggcttggatgtcgatt

SEQ ID NO: 271281 - DNA, 25 bp, Mus musculus
acctgaggctctgaaagggcttgga

SEQ ID NO: 271282 - DNA, 25 bp, Mus musculus
accctttggccaaggcgtgggagcg

SEQ ID NO: 271283 - DNA, 25 bp, Mus musculus
ggactccgagaggaccctttggcca

SEQ ID NO: 271284 - DNA, 25 bp, Mus musculus
cagaggactccgagaggaccctttg

SEQ ID NO: 271285 - DNA, 25 bp, Mus musculus
cctggacaccggcaaggacagagga

SEQ ID NO: 271286 - DNA, 25 bp, Mus musculus
tcctcctgggccgagtcggatactg

SEQ ID NO: 271287 - DNA, 25 bp, Mus musculus
gtcctccgcgttggtgcctcctcct

SEQ ID NO: 271288 - DNA, 25 bp, Mus musculus
ggagcgagcctagccgctgtgcgcc

SEQ ID NO: 271289 - DNA, 25 bp, Mus musculus
gatgtcgatttcctgcgctgagccc

SEQ ID NO: 271290 - DNA, 25 bp, Mus musculus
cttggatgtcgatttcctgcgctga

SEQ ID NO: 271291 - DNA, 25 bp, Mus musculus
caaggacagaggactccgagaggac

SEQ ID NO: 271292 - DNA, 25 bp, Mus musculus
agaggttctcaccttagcggccgcg

SEQ ID NO: 271293 - DNA, 25 bp, Mus musculus
ctgccattgcgcataccgcagcggg

SEQ ID NO: 271294 - DNA, 25 bp, Mus musculus
aggcggccacgcaaaacctgccgga

SEQ ID NO: 271295 - DNA, 25 bp, Mus musculus
gcgggcaactcaggcggccacgcaa

SEQ ID NO: 271296 - DNA, 25 bp, Mus musculus
cgcataaacatctcccggggacgag

SEQ ID NO: 271297 - DNA, 25 bp, Mus musculus
gccctggcggacatcttgtctctct

SEQ ID NO: 271298 - DNA, 25 bp, Mus musculus
ctggccgagaggttctcaccttagc

SEQ ID NO: 271299 - DNA, 25 bp, Mus musculus
gtcgggtaccaaccactcctccaga

SEQ ID NO: 271300 - DNA, 25 bp, Mus musculus
ataccgcagcgggtgacatcagatc

SEQ ID NO: 271301 - DNA, 25 bp, Mus musculus
cgggtgacatcagatcgaaactata

SEQ ID NO: 271302 - DNA, 25 bp, Mus musculus
catcagatcgaaactatagggtttc

SEQ ID NO: 271303 - DNA, 25 bp, Mus musculus
acctgagaatcctcacccggggcga

SEQ ID NO: 271304 - DNA, 25 bp, Mus musculus
tccaggcgcgggacctgttgcacgt

SEQ ID NO: 271305 - DNA, 25 bp, Mus musculus
cgtccgcataaacatctcccgggga

SEQ ID NO: 271306 - DNA, 25 bp, Mus musculus
tcggcggctgcgtgcaattcccagc

SEQ ID NO: 271307 - DNA, 25 bp, Mus musculus
acgctgggcgatggctgctccacca

SEQ ID NO: 271308 - DNA, 25 bp, Mus musculus
tctcgaagccgcccgcaggagcgag

SEQ ID NO: 271309 - DNA, 25 bp, Mus musculus
ccgcgcgttctcgaagccgcccgca

SEQ ID NO: 271310 - DNA, 25 bp, Mus musculus
agtccgagcgagaatgcggggcgca

SEQ ID NO: 271311 - DNA, 25 bp, Mus musculus
gagaaggagagtccgagcgagaatg

SEQ ID NO: 271312 - DNA, 25 bp, Mus musculus
cgaggcgcccaggagaaggagagtc

SEQ ID NO: 271313 - DNA, 25 bp, Mus musculus
aaggagagtccaagcgaggcgccca

SEQ ID NO: 271314 - DNA, 25 bp, Mus musculus
gctgggcgatggctgctccaccagc

SEQ ID NO: 271315 - DNA, 25 bp, Mus musculus
gccggcgcccaggagaaggagagtc

SEQ ID NO: 271316 - DNA, 25 bp, Mus musculus
agcactcgccggcgcccaggagaag

SEQ ID NO: 271317 - DNA, 25 bp, Mus musculus
ttcccagccagcactcgccggcgcc

SEQ ID NO: 271318 - DNA, 25 bp, Mus musculus
gctgcgtgcaattcccagccagcac

SEQ ID NO: 271319 - DNA, 25 bp, Mus musculus
agagctcggcggctgcgtgcaattc

SEQ ID NO: 271320 - DNA, 25 bp, Mus musculus
cgggcgcagcttcataatccggctc

SEQ ID NO: 271321 - DNA, 25 bp, Mus musculus
tcagaggtgagctcactcctagctg

SEQ ID NO: 271322 - DNA, 25 bp, Mus musculus
ctctcccacgcgtcagaggtgagct

SEQ ID NO: 271323 - DNA, 25 bp, Mus musculus
cagtgggacgtgctcggtgtcactt

SEQ ID NO: 271324 - DNA, 25 bp, Mus musculus
tcacgggagacgtagtccgagcgaa

SEQ ID NO: 271325 - DNA, 25 bp, Mus musculus
ctgtcgttcttgctgaggctcacgg

SEQ ID NO: 271326 - DNA, 25 bp, Mus musculus
gccttggaagcgtgctgtcgttctt

SEQ ID NO: 271327 - DNA, 25 bp, Mus musculus
gcaagagaagaacggctgccaagtc

SEQ ID NO: 271328 - DNA, 25 bp, Mus musculus
cctacggctgcggttgcaagagaag

SEQ ID NO: 271329 - DNA, 25 bp, Mus musculus
gtcctacgtgagtcctacggctgcg

SEQ ID NO: 271330 - DNA, 25 bp, Mus musculus
acagtcggctccgtcctacgtgagt

SEQ ID NO: 271331 - DNA, 25 bp, Mus musculus
tgcgcacatgcgtaaggaggctaac

SEQ ID NO: 271332 - DNA, 25 bp, Mus musculus
gcagcttcataatccggctcctcgg

SEQ ID NO: 271333 - DNA, 25 bp, Mus musculus
taaggaggctaacccacagtcggct

SEQ ID NO: 271334 - DNA, 25 bp, Mus musculus
ccatgcagggatacccagctccagc

SEQ ID NO: 271335 - DNA, 25 bp, Mus musculus
acagggaagctaccatggcggccca

SEQ ID NO: 271336 - DNA, 25 bp, Mus musculus
gtctccttgtcactctggctgggct

SEQ ID NO: 271337 - DNA, 25 bp, Mus musculus
ggaagctaccatggcggcccaggcc

SEQ ID NO: 271338 - DNA, 25 bp, Mus musculus
aggacatccgctggctgtgcgcgga

SEQ ID NO: 271339 - DNA, 25 bp, Mus musculus
cgcctgacacgcgaggtggcacagc

SEQ ID NO: 271340 - DNA, 25 bp, Mus musculus
cacgcgaggtggcacagctccaggc

SEQ ID NO: 271341 - DNA, 25 bp, Mus musculus
taaccggcggcccaggagtacgcac

SEQ ID NO: 271342 - DNA, 25 bp, Mus musculus
ccaggagtacgcactcagcgggttc

SEQ ID NO: 271343 - DNA, 25 bp, Mus musculus
gcactcagcgggttccaattctgca

SEQ ID NO: 271344 - DNA, 25 bp, Mus musculus
ggttccaattctgcacccgggtgcg

SEQ ID NO: 271345 - DNA, 25 bp, Mus musculus
tgcccactgcccacggcctggggaa

SEQ ID NO: 271346 - DNA, 25 bp, Mus musculus
ctcaggtggcacagggaagctacca

SEQ ID NO: 271347 - DNA, 25 bp, Mus musculus
tgcaccagcgcctgtgtggcctgcg

SEQ ID NO: 271348 - DNA, 25 bp, Mus musculus
agccgctgcggtctgtccgccacct

SEQ ID NO: 271349 - DNA, 25 bp, Mus musculus
ggcgacaaggagaccacccaacctc

SEQ ID NO: 271350 - DNA, 25 bp, Mus musculus
ccaacctccgagctgggaagcaatg

SEQ ID NO: 271351 - DNA, 25 bp, Mus musculus
ctccgagctgggaagcaatgacacc

SEQ ID NO: 271352 - DNA, 25 bp, Mus musculus
agcgacaaaaatggaggctgcggcc

SEQ ID NO: 271353 - DNA, 25 bp, Mus musculus
tccgccacctgtcccgcgtgctgct

SEQ ID NO: 271354 - DNA, 25 bp, Mus musculus
cttttcctgtcccagtgctacattc

SEQ ID NO: 271355 - DNA, 25 bp, Mus musculus
cccagtgctacattctgtcgggaga

SEQ ID NO: 271356 - DNA, 25 bp, Mus musculus
cattctgtcgggagatggtgagttc

SEQ ID NO: 271357 - DNA, 25 bp, Mus musculus
gaggccgcagcactgcgctccagcc

SEQ ID NO: 271358 - DNA, 25 bp, Mus musculus
tgttccctgagtcggtagcccagaa

SEQ ID NO: 271359 - DNA, 25 bp, Mus musculus
gtcggtagcccagaaccccagtcga

SEQ ID NO: 271360 - DNA, 25 bp, Mus musculus
cccgtcatttccgtttcttgagccg

SEQ ID NO: 271361 - DNA, 25 bp, Mus musculus
tgggaagcaatgacacccgccggcg

SEQ ID NO: 271362 - DNA, 25 bp, Mus musculus
cggcgcacggctacctcaacttggg

SEQ ID NO: 271363 - DNA, 25 bp, Mus musculus
actctctgggagagccgtgggacac

SEQ ID NO: 271364 - DNA, 25 bp, Mus musculus
gcgatgtcgccgagcattcgcactc

SEQ ID NO: 271365 - DNA, 25 bp, Mus musculus
ttcgcactcggaagtgtgtggcctc

SEQ ID NO: 271366 - DNA, 25 bp, Mus musculus
ggaagcccaggtcgggcgcctacac

SEQ ID NO: 271367 - DNA, 25 bp, Mus musculus
cagccgcgttcgagtgggcgcctaa

SEQ ID NO: 271368 - DNA, 25 bp, Mus musculus
taaggggtcgctgcgctctgcccac

SEQ ID NO: 271369 - DNA, 25 bp, Mus musculus
atcatcgtgtacctatttccctgtg

SEQ ID NO: 271370 - DNA, 25 bp, Mus musculus
cttcgagccttagctccgtctcggg

SEQ ID NO: 271371 - DNA, 25 bp, Mus musculus
aaccactgggcagtgcaagtgctgg

SEQ ID NO: 271372 - DNA, 25 bp, Mus musculus
gttggctgcttctgctcgcgctgcc

SEQ ID NO: 271373 - DNA, 25 bp, Mus musculus
tcaacttgggccaggtgagtacggc

SEQ ID NO: 271374 - DNA, 25 bp, Mus musculus
cgagagacccgaagtctcgagcctc

SEQ ID NO: 271375 - DNA, 25 bp, Mus musculus
acctatttccctgtggccttcgagc

SEQ ID NO: 271376 - DNA, 25 bp, Mus musculus
tcgattgctttagcctggcggtcga

SEQ ID NO: 271377 - DNA, 25 bp, Mus musculus
agcaggcggcgcagtacacaaatgc

SEQ ID NO: 271378 - DNA, 25 bp, Mus musculus
ggcggcgcagtacacaaatgccgta

SEQ ID NO: 271379 - DNA, 25 bp, Mus musculus
cacaaatgccgtacgggaccgtgaa

SEQ ID NO: 271380 - DNA, 25 bp, Mus musculus
tgaactggacctccggggtgagtta

SEQ ID NO: 271381 - DNA, 25 bp, Mus musculus
gcgcctccgatccaccgtcccgcag

SEQ ID NO: 271382 - DNA, 25 bp, Mus musculus
cggcgttccggctagcaaacacggc

SEQ ID NO: 271383 - DNA, 25 bp, Mus musculus
ggctagcaaacacggcgcctcgatt

SEQ ID NO: 271384 - DNA, 25 bp, Mus musculus
cccggaccgtactcactaggcattg

SEQ ID NO: 271385 - DNA, 25 bp, Mus musculus
cggaccgtactcactaggcattgcc

SEQ ID NO: 271386 - DNA, 25 bp, Mus musculus
gtgcactgtgggacacggcactggc

SEQ ID NO: 271387 - DNA, 25 bp, Mus musculus
ggggctacgtcttcgattgctttag

SEQ ID NO: 271388 - DNA, 25 bp, Mus musculus
tacgtcttcgattgctttagcctgg

SEQ ID NO: 271389 - DNA, 25 bp, Mus musculus
tttgttaccggcgttccggctagca

SEQ ID NO: 271390 - DNA, 25 bp, Mus musculus
ggttatccgagctatgccgagttga

SEQ ID NO: 271391 - DNA, 25 bp, Mus musculus
tcctccctgaaagtcaaacgcgctt

SEQ ID NO: 271392 - DNA, 25 bp, Mus musculus
agtcaaacgcgcttccgcctgggca

SEQ ID NO: 271393 - DNA, 25 bp, Mus musculus
tcagtaccgccacggcagtgagcgc

SEQ ID NO: 271394 - DNA, 25 bp, Mus musculus
cgatgaggaacctctgtccgcgagg

SEQ ID NO: 271395 - DNA, 25 bp, Mus musculus
tcgagccacgataggtcagtaccgc

SEQ ID NO: 271396 - DNA, 25 bp, Mus musculus
gagagcctgcgattcctgcacgtga

SEQ ID NO: 271397 - DNA, 25 bp, Mus musculus
ttcctgcacgtgacaggtcaggggc

SEQ ID NO: 271398 - DNA, 25 bp, Mus musculus
cctccaggaggcttggcgttaacgc

SEQ ID NO: 271399 - DNA, 25 bp, Mus musculus
cggagctcacctttctcgaagtcgc

SEQ ID NO: 271400 - DNA, 25 bp, Mus musculus
ttggctcacgggagtccctttaaca

SEQ ID NO: 271401 - DNA, 25 bp, Mus musculus
ttccttttgcagtggagtcctccgc

SEQ ID NO: 271402 - DNA, 25 bp, Mus musculus
tacatagggccgaaccggaagcgca

SEQ ID NO: 271403 - DNA, 25 bp, Mus musculus
gcagtgagcgccacgtgtacatagg

SEQ ID NO: 271404 - DNA, 25 bp, Mus musculus
gcgtcccgcgcgacaggaactttct

SEQ ID NO: 271405 - DNA, 25 bp, Mus musculus
ctcgtgctgggcttcgtgctggcct

SEQ ID NO: 271406 - DNA, 25 bp, Mus musculus
ccgctgtcgtcgatgctatcccacg

SEQ ID NO: 271407 - DNA, 25 bp, Mus musculus
taaactttggccacgtgaactgccc

SEQ ID NO: 271408 - DNA, 25 bp, Mus musculus
ccattcacttttgcgccaatcacga

SEQ ID NO: 271409 - DNA, 25 bp, Mus musculus
cgccaatcacgaggcgcggacggat

SEQ ID NO: 271410 - DNA, 25 bp, Mus musculus
cctggctcagcatgctgctcgggct

SEQ ID NO: 271411 - DNA, 25 bp, Mus musculus
gctcctttgcaatggcgcgctaagc

SEQ ID NO: 271412 - DNA, 25 bp, Mus musculus
ctaagccggaggatgtgcagctgca

SEQ ID NO: 271413 - DNA, 25 bp, Mus musculus
gccgcttcttaacgcgcggtgcgtg

SEQ ID NO: 271414 - DNA, 25 bp, Mus musculus
tcttaacgcgcggtgcgtgacgtga

SEQ ID NO: 271415 - DNA, 25 bp, Mus musculus
tgacgtgaggggctcctttgcaatg

SEQ ID NO: 271416 - DNA, 25 bp, Mus musculus
ggagccggtcaactcagtccacgtg

SEQ ID NO: 271417 - DNA, 25 bp, Mus musculus
actcagtccacgtgcggtgccggac

SEQ ID NO: 271418 - DNA, 25 bp, Mus musculus
ggttgggctgtggaggagtccaagg

SEQ ID NO: 271419 - DNA, 25 bp, Mus musculus
cggccacagctcccggctgggagtg

SEQ ID NO: 271420 - DNA, 25 bp, Mus musculus
gaggttgggctgtggaggagtccaa

SEQ ID NO: 271421 - DNA, 25 bp, Mus musculus
ttgggctgtggaggagtccaaggca

SEQ ID NO: 271422 - DNA, 25 bp, Mus musculus
aggttgggctgtggaggagtccaag

SEQ ID NO: 271423 - DNA, 25 bp, Mus musculus
gttgggctgtggaggagtccaaggc

SEQ ID NO: 271424 - DNA, 25 bp, Mus musculus
gcggccacagctcccggctgggagt

SEQ ID NO: 271425 - DNA, 25 bp, Mus musculus
cgcggccacagctcccggctgggag

SEQ ID NO: 271426 - DNA, 25 bp, Mus musculus
tgtggaggagtccaaggcagagcca

SEQ ID NO: 271427 - DNA, 25 bp, Mus musculus
ctgtggaggagtccaaggcagagcc

SEQ ID NO: 271428 - DNA, 25 bp, Mus musculus
gctgtggaggagtccaaggcagagc

SEQ ID NO: 271429 - DNA, 25 bp, Mus musculus
ggctgtggaggagtccaaggcagag

SEQ ID NO: 271430 - DNA, 25 bp, Mus musculus
gggctgtggaggagtccaaggcaga

SEQ ID NO: 271431 - DNA, 25 bp, Mus musculus
tgggctgtggaggagtccaaggcag

SEQ ID NO: 271432 - DNA, 25 bp, Mus musculus
cccggctcccatgacttccctggtt

SEQ ID NO: 271433 - DNA, 25 bp, Mus musculus
ccatgacttccctggttccagcggg

SEQ ID NO: 271434 - DNA, 25 bp, Mus musculus
atgacttccctggttccagcgggcg

SEQ ID NO: 271435 - DNA, 25 bp, Mus musculus
gacttccctggttccagcgggcgtc

SEQ ID NO: 271436 - DNA, 25 bp, Mus musculus
cccgtcggtgcggtctcaccacagg

SEQ ID NO: 271437 - DNA, 25 bp, Mus musculus
gtcggtgcggtctcaccacaggccc

SEQ ID NO: 271438 - DNA, 25 bp, Mus musculus
accacaggcccctggtgcgcagcgg

SEQ ID NO: 271439 - DNA, 25 bp, Mus musculus
aggcagagccacaggcgcaggttca

SEQ ID NO: 271440 - DNA, 25 bp, Mus musculus
gagccacaggcgcaggttcagcgca

SEQ ID NO: 271441 - DNA, 25 bp, Mus musculus
gccacaggcgcaggttcagcgcagc

SEQ ID NO: 271442 - DNA, 25 bp, Mus musculus
cacaggcgcaggttcagcgcagcgc

SEQ ID NO: 271443 - DNA, 25 bp, Mus musculus
acaggcgcaggttcagcgcagcgcc

SEQ ID NO: 271444 - DNA, 25 bp, Mus musculus
ccctgggcgcgggtgggacctgcgc

SEQ ID NO: 271445 - DNA, 25 bp, Mus musculus
agtcctcacccattctttcctgctc

SEQ ID NO: 271446 - DNA, 25 bp, Mus musculus
ctacttttgtttctgaactcggctc

SEQ ID NO: 271447 - DNA, 25 bp, Mus musculus
agctcccgggttctagctctgcact

SEQ ID NO: 271448 - DNA, 25 bp, Mus musculus
tgcactcgctttaacccttcaaggg

SEQ ID NO: 271449 - DNA, 25 bp, Mus musculus
ttccagacgcccaccggagctgtga

SEQ ID NO: 271450 - DNA, 25 bp, Mus musculus
accggagctgtgacctgcgggtccc

SEQ ID NO: 271451 - DNA, 25 bp, Mus musculus
tggtgcgggcaaagcttggatctaa

SEQ ID NO: 271452 - DNA, 25 bp, Mus musculus
agcttggatctaaggtgcgggcttc

SEQ ID NO: 271453 - DNA, 25 bp, Mus musculus
cttcgctcgggtcctcggacagggc

SEQ ID NO: 271454 - DNA, 25 bp, Mus musculus
agcagcacttacctgcggcggcagg

SEQ ID NO: 271455 - DNA, 25 bp, Mus musculus
cactcccaagttaaaagtcaggctt

SEQ ID NO: 271456 - DNA, 25 bp, Mus musculus
cgcaaaagaactttgtagtctccct

SEQ ID NO: 271457 - DNA, 25 bp, Mus musculus
gtactctgccctgcaatgctctggc

SEQ ID NO: 271458 - DNA, 25 bp, Mus musculus
aagagcctcgctgggcctttgcctc

SEQ ID NO: 271459 - DNA, 25 bp, Mus musculus
gaagccgcggatcggcgacatcaga

SEQ ID NO: 271460 - DNA, 25 bp, Mus musculus
agtcccaggccgtcgagtcgacagc

SEQ ID NO: 271461 - DNA, 25 bp, Mus musculus
ttgacctccaagttgcggatggggc

SEQ ID NO: 271462 - DNA, 25 bp, Mus musculus
cccgttggtggtagccataactggt

SEQ ID NO: 271463 - DNA, 25 bp, Mus musculus
ataactggttcgcactctccggtcc

SEQ ID NO: 271464 - DNA, 25 bp, Mus musculus
ctcaccttggtgaacttgacctcca

SEQ ID NO: 271465 - DNA, 25 bp, Mus musculus
cagaccgacctaggctgcggccaga

SEQ ID NO: 271466 - DNA, 25 bp, Mus musculus
ccagagagctctgtctgcgcatcgc

SEQ ID NO: 271467 - DNA, 25 bp, Mus musculus
agtaggctgcccttctgcgaacttg

SEQ ID NO: 271468 - DNA, 25 bp, Mus musculus
attcccaagggtcggacatccgtca

SEQ ID NO: 271469 - DNA, 25 bp, Mus musculus
agccggctcgtagcgatcgcagtaa

SEQ ID NO: 271470 - DNA, 25 bp, Mus musculus
gcgatcgcagtaacaggcctctctc

SEQ ID NO: 271471 - DNA, 25 bp, Mus musculus
ctcgagattttgtcagaggcacctg

SEQ ID NO: 271472 - DNA, 25 bp, Mus musculus
ccgcctaattggctgcaggacggag

SEQ ID NO: 271473 - DNA, 25 bp, Mus musculus
aggcctctctctgggcaatctcgag

SEQ ID NO: 271474 - DNA, 25 bp, Mus musculus
gcggttgctaagagacactgtacta

SEQ ID NO: 271475 - DNA, 25 bp, Mus musculus
cactgtactacgaatggggcttcta

SEQ ID NO: 271476 - DNA, 25 bp, Mus musculus
gaatggggcttctacgcctgctgag

SEQ ID NO: 271477 - DNA, 25 bp, Mus musculus
cttcttggaagcgagtggcgatgtt

SEQ ID NO: 271478 - DNA, 25 bp, Mus musculus
tactcgtcgtcgctctgcggtgctt

SEQ ID NO: 271479 - DNA, 25 bp, Mus musculus
tgagacccggttagcttccaggctg

SEQ ID NO: 271480 - DNA, 25 bp, Mus musculus
cagcctgcgagagagcacgctcttt

SEQ ID NO: 271481 - DNA, 25 bp, Mus musculus
gttcaagggcttgcctgcgaggata

SEQ ID NO: 271482 - DNA, 25 bp, Mus musculus
tggcagccaggtaagcaggagccca

SEQ ID NO: 271483 - DNA, 25 bp, Mus musculus
gcctggagactctaagcggttgcta

SEQ ID NO: 271484 - DNA, 25 bp, Mus musculus
tgtctccgattggtcgctctccctt

SEQ ID NO: 271485 - DNA, 25 bp, Mus musculus
ctaatagaggctgggacttgtctcc

SEQ ID NO: 271486 - DNA, 25 bp, Mus musculus
tgcccgcggattcgcgacagttaga

SEQ ID NO: 271487 - DNA, 25 bp, Mus musculus
ttggtgcatctgtcggtctctgaga

SEQ ID NO: 271488 - DNA, 25 bp, Mus musculus
tgcatcgcgacctgcgtttcctgtc

SEQ ID NO: 271489 - DNA, 25 bp, Mus musculus
gtgcgatcgagtggcttcgccagct

SEQ ID NO: 271490 - DNA, 25 bp, Mus musculus
gatacccacggagccttgcgagtca

SEQ ID NO: 271491 - DNA, 25 bp, Mus musculus
ccgaggacgtgcacctgcagttgct

SEQ ID NO: 271492 - DNA, 25 bp, Mus musculus
acctgcagttgctgccgggagcagc

SEQ ID NO: 271493 - DNA, 25 bp, Mus musculus
agcatctccaggtggccatcgagca

SEQ ID NO: 271494 - DNA, 25 bp, Mus musculus
tctggttccctctcggcacgcggat

SEQ ID NO: 271495 - DNA, 25 bp, Mus musculus
ggcgcgacctatacctgcagctgca

SEQ ID NO: 271496 - DNA, 25 bp, Mus musculus
atcctgccgagctgtgcttctactc

SEQ ID NO: 271497 - DNA, 25 bp, Mus musculus
ttctactccggacgagtcctgggcc

SEQ ID NO: 271498 - DNA, 25 bp, Mus musculus
ataggtggaccgctgacagcatccc

SEQ ID NO: 271499 - DNA, 25 bp, Mus musculus
ggcacaggtagcgttcctagctctc

SEQ ID NO: 271500 - DNA, 25 bp, Mus musculus
gccggagaactggtctctggttccc

SEQ ID NO: 271501 - DNA, 25 bp, Mus musculus
tgctactgcacctgccggcctttgg

SEQ ID NO: 271502 - DNA, 25 bp, Mus musculus
aagcaccgacgctgcagtgagtacc

SEQ ID NO: 271503 - DNA, 25 bp, Mus musculus
aatgacggtctggatgcgaagcacc

SEQ ID NO: 271504 - DNA, 25 bp, Mus musculus
ctgtgtgcactcgtcaatgacggtc

SEQ ID NO: 271505 - DNA, 25 bp, Mus musculus
cacgagcgatgatctgtgtgcactc

SEQ ID NO: 271506 - DNA, 25 bp, Mus musculus
aggcaccactggtggcacacgaatc

SEQ ID NO: 271507 - DNA, 25 bp, Mus musculus
cacacgaatctctgagtggccgagc

SEQ ID NO: 271508 - DNA, 25 bp, Mus musculus
tcttcacctctgtcttcaggcgcgg

SEQ ID NO: 271509 - DNA, 25 bp, Mus musculus
accttcttcagcgtcggtttcttca

SEQ ID NO: 271510 - DNA, 25 bp, Mus musculus
cagtgagtacctgcagcgcttcgcc

SEQ ID NO: 271511 - DNA, 25 bp, Mus musculus
ccaacgagccgctgtaaaggaactc

SEQ ID NO: 271512 - DNA, 25 bp, Mus musculus
taaaggaactcgaccagctggcgca

SEQ ID NO: 271513 - DNA, 25 bp, Mus musculus
tttatcctgaaagaagggtgagcca

SEQ ID NO: 271514 - DNA, 25 bp, Mus musculus
gtggccgagcagcagtttatcctga

SEQ ID NO: 271515 - DNA, 25 bp, Mus musculus
agcacgcagagaagcctcacggatg

SEQ ID NO: 271516 - DNA, 25 bp, Mus musculus
atactggtcacttgatgagggcctg

SEQ ID NO: 271517 - DNA, 25 bp, Mus musculus
gagagccgcgccttctcaacagcta

SEQ ID NO: 271518 - DNA, 25 bp, Mus musculus
tcatggacaagacgagggactagtc

SEQ ID NO: 271519 - DNA, 25 bp, Mus musculus
tatttctgctctcggtgggtcctga

SEQ ID NO: 271520 - DNA, 25 bp, Mus musculus
ctccttttagggtatatttctgctc

SEQ ID NO: 271521 - DNA, 25 bp, Mus musculus
gccaggccggaactcgttcttcgcg

SEQ ID NO: 271522 - DNA, 25 bp, Mus musculus
ctatttttaggagtcaggcctcggc

SEQ ID NO: 271523 - DNA, 25 bp, Mus musculus
ctgggaactccgtcaactttcaggg

SEQ ID NO: 271524 - DNA, 25 bp, Mus musculus
ccgagatccgcgacgctggaggaat

SEQ ID NO: 271525 - DNA, 25 bp, Mus musculus
cacaaggacaagaggggcggactat

SEQ ID NO: 271526 - DNA, 25 bp, Mus musculus
ggcgacagatcacccggcacaggaa

SEQ ID NO: 271527 - DNA, 25 bp, Mus musculus
cgcttccctctttgaaggaccgtgt

SEQ ID NO: 271528 - DNA, 25 bp, Mus musculus
cagctagcgctgtggcacaaggaca

SEQ ID NO: 271529 - DNA, 25 bp, Mus musculus
ggaccgtgttctcctggaagggata

SEQ ID NO: 271530 - DNA, 25 bp, Mus musculus
tgcgctggtaggcagtctaaaaaca

SEQ ID NO: 271531 - DNA, 25 bp, Mus musculus
cgctgtcctacaataggcgggatga

SEQ ID NO: 271532 - DNA, 25 bp, Mus musculus
ggttgtttagatggcgccagcctca

SEQ ID NO: 271533 - DNA, 25 bp, Mus musculus
gcctcagcgtctccagtcagttctt

SEQ ID NO: 271534 - DNA, 25 bp, Mus musculus
tcgacgtcgagcgattaaatccctg

SEQ ID NO: 271535 - DNA, 25 bp, Mus musculus
atcgccctgtgtagccttgcatctg

SEQ ID NO: 271536 - DNA, 25 bp, Mus musculus
ggctactgttccaccgccagtctga

SEQ ID NO: 271537 - DNA, 25 bp, Mus musculus
cgtcgggcttaggtaacgcaagtca

SEQ ID NO: 271538 - DNA, 25 bp, Mus musculus
aacgctcactgatcgctgccgaagg

SEQ ID NO: 271539 - DNA, 25 bp, Mus musculus
ctgccgaaggtggtgtctaccttta

SEQ ID NO: 271540 - DNA, 25 bp, Mus musculus
cttattggctgagagcgcgacttcc

SEQ ID NO: 271541 - DNA, 25 bp, Mus musculus
gcttcgacctgtgagcctggagacc

SEQ ID NO: 271542 - DNA, 25 bp, Mus musculus
gttcgcctcagttctcgctgtccta

SEQ ID NO: 271543 - DNA, 25 bp, Mus musculus
gccagggcaacgaaacctcgcgata

SEQ ID NO: 271544 - DNA, 25 bp, Mus musculus
actcggccaccagcagggcgtagct

SEQ ID NO: 271545 - DNA, 25 bp, Mus musculus
ggaccctttcgattagccgcttgcc

SEQ ID NO: 271546 - DNA, 25 bp, Mus musculus
acagcatcttgctgggtgtgccgga

SEQ ID NO: 271547 - DNA, 25 bp, Mus musculus
gtctgcagccgccaggacagcatct

SEQ ID NO: 271548 - DNA, 25 bp, Mus musculus
cacgtagtcgtaaagccgggcgttg

SEQ ID NO: 271549 - DNA, 25 bp, Mus musculus
tcgcacccggcacacgtagtcgtaa

SEQ ID NO: 271550 - DNA, 25 bp, Mus musculus
tccagtagcaggttctcgcgctcca

SEQ ID NO: 271551 - DNA, 25 bp, Mus musculus
agtgcctgatcctcagcccagcggt

SEQ ID NO: 271552 - DNA, 25 bp, Mus musculus
tcctcggcgtagagtgcctgatcct

SEQ ID NO: 271553 - DNA, 25 bp, Mus musculus
atctagctgctgtcgtaggctgcgc

SEQ ID NO: 271554 - DNA, 25 bp, Mus musculus
tgtggaccagttcagttcatctagc

SEQ ID NO: 271555 - DNA, 25 bp, Mus musculus
agtcgcggcgctcagtttccagccg

SEQ ID NO: 271556 - DNA, 25 bp, Mus musculus
ggctcgtagatctcgcacttggcgt

SEQ ID NO: 271557 - DNA, 25 bp, Mus musculus
aggcccttggactggcgcaccgact

SEQ ID NO: 271558 - DNA, 25 bp, Mus musculus
atgcctgcggcgttgggtcatcagc

SEQ ID NO: 271559 - DNA, 25 bp, Mus musculus
ggcgccttatgagtccgcacgtgga

SEQ ID NO: 271560 - DNA, 25 bp, Mus musculus
gatccaatgccctagggtggggacc

SEQ ID NO: 271561 - DNA, 25 bp, Mus musculus
cgcaggatccaatgccctagggtgg

SEQ ID NO: 271562 - DNA, 25 bp, Mus musculus
aacccgcaggatccaatgccctagg

SEQ ID NO: 271563 - DNA, 25 bp, Mus musculus
gtaaacaacccgcaggatccaatgc

SEQ ID NO: 271564 - DNA, 25 bp, Mus musculus
cagctggtaaacaacccgcaggatc

SEQ ID NO: 271565 - DNA, 25 bp, Mus musculus
atggccagctggtaaacaacccgca

SEQ ID NO: 271566 - DNA, 25 bp, Mus musculus
gggagatggccagctggtaaacaac

SEQ ID NO: 271567 - DNA, 25 bp, Mus musculus
tgcagttcagtctcccaccggcagg

SEQ ID NO: 271568 - DNA, 25 bp, Mus musculus
cgcacccgcgggtgcagttcagtct

SEQ ID NO: 271569 - DNA, 25 bp, Mus musculus
agcccgcagttgctggcccgcaccc

SEQ ID NO: 271570 - DNA, 25 bp, Mus musculus
gttgggtcatcagcccgcagttgct

SEQ ID NO: 271571 - DNA, 25 bp, Mus musculus
ttatgagtccgcacgtggacagtga

SEQ ID NO: 271572 - DNA, 25 bp, Mus musculus
ttagcatcggatgtcactggaggtg

SEQ ID NO: 271573 - DNA, 25 bp, Mus musculus
tgaagcctcgtgaacgctccgaccg

SEQ ID NO: 271574 - DNA, 25 bp, Mus musculus
tacccacggtgaagcctcgtgaacg

SEQ ID NO: 271575 - DNA, 25 bp, Mus musculus
aaagctcgcgagtacccacggtgaa

SEQ ID NO: 271576 - DNA, 25 bp, Mus musculus
ggcagcagttacacaaaagctcgcg

SEQ ID NO: 271577 - DNA, 25 bp, Mus musculus
agtctcctgtgaagggcagcagtta

SEQ ID NO: 271578 - DNA, 25 bp, Mus musculus
ccgagtgtcactcagtctcctgtga

SEQ ID NO: 271579 - DNA, 25 bp, Mus musculus
ctgtcctccgtgatcccgagtgtca

SEQ ID NO: 271580 - DNA, 25 bp, Mus musculus
ctgacctgtcacgtggctcgacatc

SEQ ID NO: 271581 - DNA, 25 bp, Mus musculus
agccaactcagtcatctgacctgtc

SEQ ID NO: 271582 - DNA, 25 bp, Mus musculus
tgaccctgagataattacccgcact

SEQ ID NO: 271583 - DNA, 25 bp, Mus musculus
cactggaggtgaccctgagataatt

SEQ ID NO: 271584 - DNA, 25 bp, Mus musculus
gccgggctgccatttcctcggcttg

SEQ ID NO: 271585 - DNA, 25 bp, Mus musculus
ctcggcttgctcctggttagcatcg

SEQ ID NO: 271586 - DNA, 25 bp, Mus musculus
gcctgcgtcccgctgctataaaagg

SEQ ID NO: 271587 - DNA, 25 bp, Mus musculus
cgctcgagtggccttgttctcgata

SEQ ID NO: 271588 - DNA, 25 bp, Mus musculus
cgatacttcgttgtggttgtgaact

SEQ ID NO: 271589 - DNA, 25 bp, Mus musculus
gttgtgaactctgtccggcagcctc

SEQ ID NO: 271590 - DNA, 25 bp, Mus musculus
cgagccggacacgttcctcgaggga

SEQ ID NO: 271591 - DNA, 25 bp, Mus musculus
gtcaggccttcaagggtctcccatc

SEQ ID NO: 271592 - DNA, 25 bp, Mus musculus
ctgccgctttgcaggcgacgtcagt

SEQ ID NO: 271593 - DNA, 25 bp, Mus musculus
agcaccgtgagtagcaacccgcgag

SEQ ID NO: 271594 - DNA, 25 bp, Mus musculus
actggaaggcccaggcttcgtaccg

SEQ ID NO: 271595 - DNA, 25 bp, Mus musculus
cctgccttagcgacaggcttgctgc

SEQ ID NO: 271596 - DNA, 25 bp, Mus musculus
atcctttcggcgctcgctcagggaa

SEQ ID NO: 271597 - DNA, 25 bp, Mus musculus
aggcgacctggcctcgtatcctgag

SEQ ID NO: 271598 - DNA, 25 bp, Mus musculus
ccggagtccgctttgaaggagagca

SEQ ID NO: 271599 - DNA, 25 bp, Mus musculus
tttcgactgccgtcaggcgatctca

SEQ ID NO: 271600 - DNA, 25 bp, Mus musculus
gtgaggctgaggttcttgtttacca

SEQ ID NO: 271601 - DNA, 25 bp, Mus musculus
ttcggaccagtctcgccaactgcgt

SEQ ID NO: 271602 - DNA, 25 bp, Mus musculus
cgggacttcggaccagtctcgccaa

SEQ ID NO: 271603 - DNA, 25 bp, Mus musculus
ggggaaccgctcattcatttccact

SEQ ID NO: 271604 - DNA, 25 bp, Mus musculus
gccgctttgtgtgtgtcctggattt

SEQ ID NO: 271605 - DNA, 25 bp, Mus musculus
gctttgaccttcagcgagccggagc

SEQ ID NO: 271606 - DNA, 25 bp, Mus musculus
cgtgctcggctttgaccttcagcga

SEQ ID NO: 271607 - DNA, 25 bp, Mus musculus
gtgcctgcgagagctccacggcacg

SEQ ID NO: 271608 - DNA, 25 bp, Mus musculus
agggaagctgcctgcgagcctgtcc

SEQ ID NO: 271609 - DNA, 25 bp, Mus musculus
ccgggcattgttttttggagtcctg

SEQ ID NO: 271610 - DNA, 25 bp, Mus musculus
ctgaggttcttgtttaccagcatta

SEQ ID NO: 271611 - DNA, 25 bp, Mus musculus
gatcgggtggcgtttgtcctcgcct

SEQ ID NO: 271612 - DNA, 25 bp, Mus musculus
tgcgatcccgaactccggctcttgg

SEQ ID NO: 271613 - DNA, 25 bp, Mus musculus
accagcattaactccgctgagcgga

SEQ ID NO: 271614 - DNA, 25 bp, Mus musculus
agaacaacgagtgctgccacccgga

SEQ ID NO: 271615 - DNA, 25 bp, Mus musculus
acgagtgctgccacccggagtgcct

SEQ ID NO: 271616 - DNA, 25 bp, Mus musculus
acctacaggttcgagggctggcgct

SEQ ID NO: 271617 - DNA, 25 bp, Mus musculus
tggcgctgtgtggatcgcgatttct

SEQ ID NO: 271618 - DNA, 25 bp, Mus musculus
gatcgcgatttctgcgccaacatcc

SEQ ID NO: 271619 - DNA, 25 bp, Mus musculus
tccccaacgctgagagcagtgactc

SEQ ID NO: 271620 - DNA, 25 bp, Mus musculus
actcggatggcttcgttatccacga

SEQ ID NO: 271621 - DNA, 25 bp, Mus musculus
ccgcctggcacctacaggttcgagg

SEQ ID NO: 271622 - DNA, 25 bp, Mus musculus
tgggcagctgccacacaccggacga

SEQ ID NO: 271623 - DNA, 25 bp, Mus musculus
cgagcctgcaccgagaacaacgagt

SEQ ID NO: 271624 - DNA, 25 bp, Mus musculus
accggacgacaacacaacctgcgtg

SEQ ID NO: 271625 - DNA, 25 bp, Mus musculus
gcctgcagacactactactacaaag

SEQ ID NO: 271626 - DNA, 25 bp, Mus musculus
tactactacaaaggcgtgtgtgtgc

SEQ ID NO: 271627 - DNA, 25 bp, Mus musculus
ggaagcgagcctgcaccgagaacaa

SEQ ID NO: 271628 - DNA, 25 bp, Mus musculus
gccgcttgagtagcagcccttgctc

SEQ ID NO: 271629 - DNA, 25 bp, Mus musculus
gtctcgccgcttgagtagcagccct

SEQ ID NO: 271630 - DNA, 25 bp, Mus musculus
agcagcccttgctctcatcttcgaa

SEQ ID NO: 271631 - DNA, 25 bp, Mus musculus
ttgctctcatcttcgaacactagcc

SEQ ID NO: 271632 - DNA, 25 bp, Mus musculus
caagctcttgacacggccccgagga

SEQ ID NO: 271633 - DNA, 25 bp, Mus musculus
cccgaggaccatcggctcccgcctc

SEQ ID NO: 271634 - DNA, 25 bp, Mus musculus
cccgcctcgcctcccattccgccag

SEQ ID NO: 271635 - DNA, 25 bp, Mus musculus
gcgatgcggctctgccaccaagatc

SEQ ID NO: 271636 - DNA, 25 bp, Mus musculus
gctctgccaccaagatccgcagtgg

SEQ ID NO: 271637 - DNA, 25 bp, Mus musculus
gctccgcgacgctgctgtcacgggc

SEQ ID NO: 271638 - DNA, 25 bp, Mus musculus
ggccgcacacccagggccactacgg

SEQ ID NO: 271639 - DNA, 25 bp, Mus musculus
ggccacagcgcccagccgggtgaaa

SEQ ID NO: 271640 - DNA, 25 bp, Mus musculus
attccgccaggcgatgcggctctgc

SEQ ID NO: 271641 - DNA, 25 bp, Mus musculus
cggccactgtctcgccgcttgagta

SEQ ID NO: 271642 - DNA, 25 bp, Mus musculus
tcagccggtagaaataactcgcagc

SEQ ID NO: 271643 - DNA, 25 bp, Mus musculus
gctctcaagagctctgtgcccgaaa

SEQ ID NO: 271644 - DNA, 25 bp, Mus musculus
ttttggaaacctggcgctctcaaga

SEQ ID NO: 271645 - DNA, 25 bp, Mus musculus
aggaggcacccgaaccactgctatc

SEQ ID NO: 271646 - DNA, 25 bp, Mus musculus
tggagttcgttaacacacgcgcttg

SEQ ID NO: 271647 - DNA, 25 bp, Mus musculus
ctctgataatcgactgcccggatgg

SEQ ID NO: 271648 - DNA, 25 bp, Mus musculus
ccgctccaaggcctaaactctgata

SEQ ID NO: 271649 - DNA, 25 bp, Mus musculus
tcccgactgagaaaaggctgcgctt

SEQ ID NO: 271650 - DNA, 25 bp, Mus musculus
tgatggctacgtttgcctacgcgca

SEQ ID NO: 271651 - DNA, 25 bp, Mus musculus
aattctggatcgttctcagccggta

SEQ ID NO: 271652 - DNA, 25 bp, Mus musculus
ctcgggacaccatcggccttcagaa

SEQ ID NO: 271653 - DNA, 25 bp, Mus musculus
gtgacagccgatctcctaacaagtg

SEQ ID NO: 271654 - DNA, 25 bp, Mus musculus
aggtctcctaagtgctgtcggtaca

SEQ ID NO: 271655 - DNA, 25 bp, Mus musculus
gctgctggaagaactactggatctc

SEQ ID NO: 271656 - DNA, 25 bp, Mus musculus
taacgccaggcatgctcagcgagtg

SEQ ID NO: 271657 - DNA, 25 bp, Mus musculus
ccaaacgctgccttcaggcttgaga

SEQ ID NO: 271658 - DNA, 25 bp, Mus musculus
caggcttgagaaggaaacactttgg

SEQ ID NO: 271659 - DNA, 25 bp, Mus musculus
gacgagttttgaaagtcttccgata

SEQ ID NO: 271660 - DNA, 25 bp, Mus musculus
gtcttccgatactgcaccgggtgaa

SEQ ID NO: 271661 - DNA, 25 bp, Mus musculus
cgaaggaggagtctccaccgacctc

SEQ ID NO: 271662 - DNA, 25 bp, Mus musculus
gacgcaccgctagcggagctctggc

SEQ ID NO: 271663 - DNA, 25 bp, Mus musculus
cctgatttatggaaacgctcgggcg

SEQ ID NO: 271664 - DNA, 25 bp, Mus musculus
cctgccagcggcctgatttatggaa

SEQ ID NO: 271665 - DNA, 25 bp, Mus musculus
gccggagctaattagcagcctgcca

SEQ ID NO: 271666 - DNA, 25 bp, Mus musculus
ctctcattcttttcggccggagcta

SEQ ID NO: 271667 - DNA, 25 bp, Mus musculus
accgtgtgctacagaactctcattc

SEQ ID NO: 271668 - DNA, 25 bp, Mus musculus
ggaattctgatctcccacctactgg

SEQ ID NO: 271669 - DNA, 25 bp, Mus musculus
tttctgcgggtcgttccaaacgctg

SEQ ID NO: 271670 - DNA, 25 bp, Mus musculus
cgccctcttgtgttcgcaacgtgca

SEQ ID NO: 271671 - DNA, 25 bp, Mus musculus
gatccgagcgagctgtcaatcactc

SEQ ID NO: 271672 - DNA, 25 bp, Mus musculus
ctaggcagtcgttgagcagaacttc

SEQ ID NO: 271673 - DNA, 25 bp, Mus musculus
gccacaaccaaaatcgcagaagctg

SEQ ID NO: 271674 - DNA, 25 bp, Mus musculus
ccagccttctctgggactctgaggc

SEQ ID NO: 271675 - DNA, 25 bp, Mus musculus
tccgtcgtctccaggctgatccgag

SEQ ID NO: 271676 - DNA, 25 bp, Mus musculus
cctcagtactctcagcgggtctgga

SEQ ID NO: 271677 - DNA, 25 bp, Mus musculus
ccggtgttcctctttagactaggca

SEQ ID NO: 271678 - DNA, 25 bp, Mus musculus
acgatagtcgggagcacgtttccgg

SEQ ID NO: 271679 - DNA, 25 bp, Mus musculus
tagcctcggcacaggcggaacgata

SEQ ID NO: 271680 - DNA, 25 bp, Mus musculus
gcgctgaagcggaacagatagcctc

SEQ ID NO: 271681 - DNA, 25 bp, Mus musculus
tgtcaacttgaaggccgcacttccg

SEQ ID NO: 271682 - DNA, 25 bp, Mus musculus
caggtcctcctgcttgtcaacttga

SEQ ID NO: 271683 - DNA, 25 bp, Mus musculus
gactcctcaggcagcaggtcctgca

SEQ ID NO: 271684 - DNA, 25 bp, Mus musculus
ctgcaggcggagagctgtaaaaatc

SEQ ID NO: 271685 - DNA, 25 bp, Mus musculus
cgggatcaagcgctgcagccaagtt

SEQ ID NO: 271686 - DNA, 25 bp, Mus musculus
cggcaacagcttcacgaagaaggga

SEQ ID NO: 271687 - DNA, 25 bp, Mus musculus
ccacgcctgcgatttggtccgggat

SEQ ID NO: 271688 - DNA, 25 bp, Mus musculus
caggcggagagctgtaaaaatccac

SEQ ID NO: 271689 - DNA, 25 bp, Mus musculus
tcaagcgctgcagccaagttcctgg

SEQ ID NO: 271690 - DNA, 25 bp, Mus musculus
cagccaagttcctggccgccagaaa

SEQ ID NO: 271691 - DNA, 25 bp, Mus musculus
ctggccgccagaaagcaggaggctc

SEQ ID NO: 271692 - DNA, 25 bp, Mus musculus
aaagcaggaggctccgcgcatcgcg

SEQ ID NO: 271693 - DNA, 25 bp, Mus musculus
atgccctgtcgcggccacgagggct

SEQ ID NO: 271694 - DNA, 25 bp, Mus musculus
agcttcacgaagaagggaagagccc

SEQ ID NO: 271695 - DNA, 25 bp, Mus musculus
cgcatcgcgggccatgccctgtcgc

SEQ ID NO: 271696 - DNA, 25 bp, Mus musculus
cctgcgatttggtccgggatcaagc

SEQ ID NO: 271697 - DNA, 25 bp, Mus musculus
tgtaaaaatccacgtgagccgcccc

SEQ ID NO: 271698 - DNA, 25 bp, Mus musculus
ggaccaagtcaaaagcgagcttaca

SEQ ID NO: 271699 - DNA, 25 bp, Mus musculus
aatgggagacgccatgttggctcag

SEQ ID NO: 271700 - DNA, 25 bp, Mus musculus
taggaccaagtcaaaagcgagctta

SEQ ID NO: 271701 - DNA, 25 bp, Mus musculus
gctcggtgcacatcccgggagagca

SEQ ID NO: 271702 - DNA, 25 bp, Mus musculus
gagagcagctgggcgctctccgcac

SEQ ID NO: 271703 - DNA, 25 bp, Mus musculus
ccgatgctacaccaggccgtcgcca

SEQ ID NO: 271704 - DNA, 25 bp, Mus musculus
caaaagcgagcttacaggcagagtt

SEQ ID NO: 271705 - DNA, 25 bp, Mus musculus
agcgagcttacaggcagagttttca

SEQ ID NO: 271706 - DNA, 25 bp, Mus musculus
ggcagagttttcacacgctcaggct

SEQ ID NO: 271707 - DNA, 25 bp, Mus musculus
ctcgcggtgcaatgggagacgccat

SEQ ID NO: 271708 - DNA, 25 bp, Mus musculus
gccgctcggtgcacatcccgggaga

SEQ ID NO: 271709 - DNA, 25 bp, Mus musculus
tgcaatgggagacgccatgttggct

SEQ ID NO: 271710 - DNA, 25 bp, Mus musculus
agagttttcacacgctcaggctccc

SEQ ID NO: 271711 - DNA, 25 bp, Mus musculus
agccgctgccaactccggaccctgt

SEQ ID NO: 271712 - DNA, 25 bp, Mus musculus
ttaggctgcatgcactgactgccga

SEQ ID NO: 271713 - DNA, 25 bp, Mus musculus
agcactgggccgcattcaacacgaa

SEQ ID NO: 271714 - DNA, 25 bp, Mus musculus
ggccgcattcaacacgaacagctcg

SEQ ID NO: 271715 - DNA, 25 bp, Mus musculus
cactcaacggcgctgaagagcatcc

SEQ ID NO: 271716 - DNA, 25 bp, Mus musculus
tgaagagcatccgtgcggccagttc

SEQ ID NO: 271717 - DNA, 25 bp, Mus musculus
ggccagttcgcaaatgttctcgatg

SEQ ID NO: 271718 - DNA, 25 bp, Mus musculus
cactgactgccgaagcgcgacgtgg

SEQ ID NO: 271719 - DNA, 25 bp, Mus musculus
ccgtgcggccagttcgcaaatgttc

SEQ ID NO: 271720 - DNA, 25 bp, Mus musculus
tctccacttgctcttggaagatccg

SEQ ID NO: 271721 - DNA, 25 bp, Mus musculus
taaaagcgaccacccggtcggctga

SEQ ID NO: 271722 - DNA, 25 bp, Mus musculus
ccgtatgtggtccataaaagcgacc

SEQ ID NO: 271723 - DNA, 25 bp, Mus musculus
ctcttggaagatccgtatgtggtcc

SEQ ID NO: 271724 - DNA, 25 bp, Mus musculus
gcagggaaatatatccggacaggta

SEQ ID NO: 271725 - DNA, 25 bp, Mus musculus
cacccggtcggctgacatgggtgaa

SEQ ID NO: 271726 - DNA, 25 bp, Mus musculus
atcgatacggagtgattagaagccc

SEQ ID NO: 271727 - DNA, 25 bp, Mus musculus
cctctgccctcgacggaaaaggtgg

SEQ ID NO: 271728 - DNA, 25 bp, Mus musculus
tgcctggctttgcaaatagggctga

SEQ ID NO: 271729 - DNA, 25 bp, Mus musculus
ctcgaacgattttcctctgtgagga

SEQ ID NO: 271730 - DNA, 25 bp, Mus musculus
ctccgggctggagtgttttaagatg

SEQ ID NO: 271731 - DNA, 25 bp, Mus musculus
gcgcagagagcagggtaaatcattt

SEQ ID NO: 271732 - DNA, 25 bp, Mus musculus
gctgaggatgtcaccgcactaaata

SEQ ID NO: 271733 - DNA, 25 bp, Mus musculus
tcgatccgacgcctagctgaggatg

SEQ ID NO: 271734 - DNA, 25 bp, Mus musculus
tcccgcccgggctgtaaatctgcgg

SEQ ID NO: 271735 - DNA, 25 bp, Mus musculus
tagcgcgtctcacgagctccggaaa

SEQ ID NO: 271736 - DNA, 25 bp, Mus musculus
tgcgtggctacgcaggactctgata

SEQ ID NO: 271737 - DNA, 25 bp, Mus musculus
tctccacctcttttcggccttagga

SEQ ID NO: 271738 - DNA, 25 bp, Mus musculus
tccgactggcagcaggaacaagatg

SEQ ID NO: 271739 - DNA, 25 bp, Mus musculus
ggcagatctctagcgcagcagcagc

SEQ ID NO: 271740 - DNA, 25 bp, Mus musculus
gaagctgtggtgttttgcagctgaa

SEQ ID NO: 271741 - DNA, 25 bp, Mus musculus
ggttggcttcctttctgcgcctacg

SEQ ID NO: 271742 - DNA, 25 bp, Mus musculus
ccaggaccgtgcttcgggcgccctc

SEQ ID NO: 271743 - DNA, 25 bp, Mus musculus
ggcgccctcggcaccctccagccca

SEQ ID NO: 271744 - DNA, 25 bp, Mus musculus
ccctccagcccacgggcttcgcggc

SEQ ID NO: 271745 - DNA, 25 bp, Mus musculus
agctgaacatctcgggtgtggagcc

SEQ ID NO: 271746 - DNA, 25 bp, Mus musculus
tgcagctgaacatctcgggtgtgga

SEQ ID NO: 271747 - DNA, 25 bp, Mus musculus
ctgtggtgttttgcagctgaacatc

SEQ ID NO: 271748 - DNA, 25 bp, Mus musculus
ctcgggaggagccaggaccgtgctt

SEQ ID NO: 271749 - DNA, 25 bp, Mus musculus
cggaagtgctggatctgtggaagct

SEQ ID NO: 271750 - DNA, 25 bp, Mus musculus
gaatcgcagtttgaccccggaagtg

SEQ ID NO: 271751 - DNA, 25 bp, Mus musculus
cgcctacggaatcgcagtttgaccc

SEQ ID NO: 271752 - DNA, 25 bp, Mus musculus
tggcttcctttctgcgcctacggaa

SEQ ID NO: 271753 - DNA, 25 bp, Mus musculus
gttttgcagctgaacatctcgggtg

SEQ ID NO: 271754 - DNA, 25 bp, Mus musculus
cagtccggaccgagggagagccacc

SEQ ID NO: 271755 - DNA, 25 bp, Mus musculus
actgatcgccaacctccgcttaccg

SEQ ID NO: 271756 - DNA, 25 bp, Mus musculus
ccgcaggcattaccgcccacactga

SEQ ID NO: 271757 - DNA, 25 bp, Mus musculus
ggcgaggaccgcaggcattaccgcc

SEQ ID NO: 271758 - DNA, 25 bp, Mus musculus
agccattgtctgcaagcggccctgc

SEQ ID NO: 271759 - DNA, 25 bp, Mus musculus
aggcctgtgagcagcgataaggatg

SEQ ID NO: 271760 - DNA, 25 bp, Mus musculus
caccaagcgtttccggccgtccgcg

SEQ ID NO: 271761 - DNA, 25 bp, Mus musculus
cgccgacgcgccatcccaccaagcg

SEQ ID NO: 271762 - DNA, 25 bp, Mus musculus
ggccgcacacatcccgcctttgttt

SEQ ID NO: 271763 - DNA, 25 bp, Mus musculus
tttccggactcttggccgcacacat

SEQ ID NO: 271764 - DNA, 25 bp, Mus musculus
caggatgcgctagctcgccctgggc

SEQ ID NO: 271765 - DNA, 25 bp, Mus musculus
catctcagggaaggtcgggcaggat

SEQ ID NO: 271766 - DNA, 25 bp, Mus musculus
gcagccagcgcaggcaggcatctca

SEQ ID NO: 271767 - DNA, 25 bp, Mus musculus
taaggatggggagccattgtctgca

SEQ ID NO: 271768 - DNA, 25 bp, Mus musculus
cctcacttgcgtgggatccagcgtt

SEQ ID NO: 271769 - DNA, 25 bp, Mus musculus
gtttgggctgttcgctaggctagct

SEQ ID NO: 271770 - DNA, 25 bp, Mus musculus
tgacacgaaggagtttgggctgttc

SEQ ID NO: 271771 - DNA, 25 bp, Mus musculus
ggtgactcttccaggtgtgacacga

SEQ ID NO: 271772 - DNA, 25 bp, Mus musculus
ggatccagcgttgctgtcccttatg

SEQ ID NO: 271773 - DNA, 25 bp, Mus musculus
aatcattcgcttggattggctcacg

SEQ ID NO: 271774 - DNA, 25 bp, Mus musculus
cgtgcagagcgcgattactccgaaa

SEQ ID NO: 271775 - DNA, 25 bp, Mus musculus
aagagccgcgggacttcctcggcca

SEQ ID NO: 271776 - DNA, 25 bp, Mus musculus
acacaggagcttcccaagagccgcg

SEQ ID NO: 271777 - DNA, 25 bp, Mus musculus
ctgatgcaaaggacacaggagcttc

SEQ ID NO: 271778 - DNA, 25 bp, Mus musculus
gagaacaccaagtatccctgatgca

SEQ ID NO: 271779 - DNA, 25 bp, Mus musculus
gtggtcactgctcgggagaacacca

SEQ ID NO: 271780 - DNA, 25 bp, Mus musculus
tgtcccttatggctgtggtcactgc

SEQ ID NO: 271781 - DNA, 25 bp, Mus musculus
agcgcgattactccgaaatcattcg

SEQ ID NO: 271782 - DNA, 25 bp, Mus musculus
cgtctcggaactgcaagctacgccg

SEQ ID NO: 271783 - DNA, 25 bp, Mus musculus
gagtgtgcgctttctgcaggctcac

SEQ ID NO: 271784 - DNA, 25 bp, Mus musculus
cgctgacccacggtgaaaccggatt

SEQ ID NO: 271785 - DNA, 25 bp, Mus musculus
gccctactctgcaggcgtctcggaa

SEQ ID NO: 271786 - DNA, 25 bp, Mus musculus
accggattctctcacttaacccagg

SEQ ID NO: 271787 - DNA, 25 bp, Mus musculus
ggggctcatgcagccgccaaggtaa

SEQ ID NO: 271788 - DNA, 25 bp, Mus musculus
gctccgccgcctcactgattagtgg

SEQ ID NO: 271789 - DNA, 25 bp, Mus musculus
ggtgtctcatctcacacacttaggg

SEQ ID NO: 271790 - DNA, 25 bp, Mus musculus
acacttagggttttgcctcggatga

SEQ ID NO: 271791 - DNA, 25 bp, Mus musculus
ggatgactcgccttcgcacttggca

SEQ ID NO: 271792 - DNA, 25 bp, Mus musculus
tcgcacttggcagcaggaaagtttt

SEQ ID NO: 271793 - DNA, 25 bp, Mus musculus
actgtgtaccgcctggagctctctc

SEQ ID NO: 271794 - DNA, 25 bp, Mus musculus
tgacccacagagctcttgacagatc

SEQ ID NO: 271795 - DNA, 25 bp, Mus musculus
cccactagcgcggatcagcaagggt

SEQ ID NO: 271796 - DNA, 25 bp, Mus musculus
cgaacttccgtctgcctttgcggac

SEQ ID NO: 271797 - DNA, 25 bp, Mus musculus
gggagataaacacggggccaacagc

SEQ ID NO: 271798 - DNA, 25 bp, Mus musculus
gggccaacagcctgaagatcacaga

SEQ ID NO: 271799 - DNA, 25 bp, Mus musculus
atcacagagaaggtgtcgggccagc

SEQ ID NO: 271800 - DNA, 25 bp, Mus musculus
cgtggagatccaggccaagtacatc

SEQ ID NO: 271801 - DNA, 25 bp, Mus musculus
aagtacatcggcaccaccatcgtgg

SEQ ID NO: 271802 - DNA, 25 bp, Mus musculus
caccaccatcgtggtgcgacaggtg

SEQ ID NO: 271803 - DNA, 25 bp, Mus musculus
tgggccgctacctgacctttgccgt

SEQ ID NO: 271804 - DNA, 25 bp, Mus musculus
tccggatgcccgaggaggtagtcaa

SEQ ID NO: 271805 - DNA, 25 bp, Mus musculus
tagtcaacgccgtggaggaccgtga

SEQ ID NO: 271806 - DNA, 25 bp, Mus musculus
ctgcctttgcggacggctccaaaaa

SEQ ID NO: 271807 - DNA, 25 bp, Mus musculus
tgccaacgctgaaagccctcgcagg

SEQ ID NO: 271808 - DNA, 25 bp, Mus musculus
tccaggctttccgtgccaacgctga

SEQ ID NO: 271809 - DNA, 25 bp, Mus musculus
ccagcagatcgacttccaggctttc

SEQ ID NO: 271810 - DNA, 25 bp, Mus musculus
ggcgccaccgttgaccctgctgtta

SEQ ID NO: 271811 - DNA, 25 bp, Mus musculus
cgggaccagcccgacggcgccaccg

SEQ ID NO: 271812 - DNA, 25 bp, Mus musculus
gcccactccgtctgacgtcaagggg

SEQ ID NO: 271813 - DNA, 25 bp, Mus musculus
acgcgtcaccgcgttctcccgccca

SEQ ID NO: 271814 - DNA, 25 bp, Mus musculus
accgacgcacgaggccacgcgtcac

SEQ ID NO: 271815 - DNA, 25 bp, Mus musculus
agcagcagaccgacgcacgaggcca

SEQ ID NO: 271816 - DNA, 25 bp, Mus musculus
agaggaagcagcagaccgacgcacg

SEQ ID NO: 271817 - DNA, 25 bp, Mus musculus
caccgttgaccctgctgttaccagg

SEQ ID NO: 271818 - DNA, 25 bp, Mus musculus
ggcgctagccgagcccatagaggaa

SEQ ID NO: 271819 - DNA, 25 bp, Mus musculus
agccaatcagcactcgccgcaagcg

SEQ ID NO: 271820 - DNA, 25 bp, Mus musculus
tgaccctgctgttaccaggcgctca

SEQ ID NO: 271821 - DNA, 25 bp, Mus musculus
gttaccaggcgctcacacagccaat

SEQ ID NO: 271822 - DNA, 25 bp, Mus musculus
ctgctgttaccaggcgctcacacag

SEQ ID NO: 271823 - DNA, 25 bp, Mus musculus
tagccgagcccatagaggaagcagc

SEQ ID NO: 271824 - DNA, 25 bp, Mus musculus
ttcctcccaaggacaaaggacaata

SEQ ID NO: 271825 - DNA, 25 bp, Mus musculus
aggacgtcgtgcttttcctcccaag

SEQ ID NO: 271826 - DNA, 25 bp, Mus musculus
ccgcgctcaaggacgtcgtgctttt

SEQ ID NO: 271827 - DNA, 25 bp, Mus musculus
aataaagggagcaggggagctactc

SEQ ID NO: 271828 - DNA, 25 bp, Mus musculus
cgcggcagaccgtcctgacagctgg

SEQ ID NO: 271829 - DNA, 25 bp, Mus musculus
caggggagctactcaccgggtcgaa

SEQ ID NO: 271830 - DNA, 25 bp, Mus musculus
gctcttcctcgcgtgtccaggacgg

SEQ ID NO: 271831 - DNA, 25 bp, Mus musculus
gcatcacgcacttcgttcgtacctt

SEQ ID NO: 271832 - DNA, 25 bp, Mus musculus
atcttgtgcagtgtgtggtgtctct

SEQ ID NO: 271833 - DNA, 25 bp, Mus musculus
tgtggtgtctctcccgtctcctcgg

SEQ ID NO: 271834 - DNA, 25 bp, Mus musculus
acacaacatggcctcttcgctgcgg

SEQ ID NO: 271835 - DNA, 25 bp, Mus musculus
cattggctgggctagcttcctgccc

SEQ ID NO: 271836 - DNA, 25 bp, Mus musculus
tgcctctccggccatcttgtgcagt

SEQ ID NO: 271837 - DNA, 25 bp, Mus musculus
ggagcggcatcacgcacttcgttcg

SEQ ID NO: 271838 - DNA, 25 bp, Mus musculus
tgggagacgtcaagcacgcactctg

SEQ ID NO: 271839 - DNA, 25 bp, Mus musculus
ggctgctgccctgtctacattcggc

SEQ ID NO: 271840 - DNA, 25 bp, Mus musculus
tctgcgggtgaattcctcaccagca

SEQ ID NO: 271841 - DNA, 25 bp, Mus musculus
cagcagcattgctactctggatcta

SEQ ID NO: 271842 - DNA, 25 bp, Mus musculus
gtcgtcggcgccagatatttctgtc

SEQ ID NO: 271843 - DNA, 25 bp, Mus musculus
ctaaggttcggctctgcaggacctg

SEQ ID NO: 271844 - DNA, 25 bp, Mus musculus
acacccgccgcagcgaataattcgg

SEQ ID NO: 271845 - DNA, 25 bp, Mus musculus
ttcgcaagtcttgcggcgcgagtgt

SEQ ID NO: 271846 - DNA, 25 bp, Mus musculus
tcgtctgtacagaggcccgcagcca

SEQ ID NO: 271847 - DNA, 25 bp, Mus musculus
agaagcgtccggctgcttcctcagc

SEQ ID NO: 271848 - DNA, 25 bp, Mus musculus
acattcggcctgcagtgcctgcctg

SEQ ID NO: 271849 - DNA, 25 bp, Mus musculus
acctgcgcgctcaagcacgcgggtt

SEQ ID NO: 271850 - DNA, 25 bp, Mus musculus
tgcagacgtcgccacgcctgctgag

SEQ ID NO: 271851 - DNA, 25 bp, Mus musculus
agatatttctgtcccgcctccaggc

SEQ ID NO: 271852 - DNA, 25 bp, Mus musculus
ccctaggaggtcgacaacgctcaga

SEQ ID NO: 271853 - DNA, 25 bp, Mus musculus
tccagactagcatttctcgggtgtg

SEQ ID NO: 271854 - DNA, 25 bp, Mus musculus
cgttagcgtttcattccagactagc

SEQ ID NO: 271855 - DNA, 25 bp, Mus musculus
tgctttctatgtggatttctcgtta

SEQ ID NO: 271856 - DNA, 25 bp, Mus musculus
cctgtcctgggtattctgctttcta

SEQ ID NO: 271857 - DNA, 25 bp, Mus musculus
cagagacgggcgcttggtgtaaaaa

SEQ ID NO: 271858 - DNA, 25 bp, Mus musculus
tccggagtgatcagaaggtcgctgc

SEQ ID NO: 271859 - DNA, 25 bp, Mus musculus
tgggaacgcctctcttccggagtga

SEQ ID NO: 271860 - DNA, 25 bp, Mus musculus
ggcgccatcttgttgttttcgtgca

SEQ ID NO: 271861 - DNA, 25 bp, Mus musculus
ctcagaggacaaatgcaaagcggac

SEQ ID NO: 271862 - DNA, 25 bp, Mus musculus
ttggcctcgccctgatctaatcgct

SEQ ID NO: 271863 - DNA, 25 bp, Mus musculus
ttttcctgctcttgctcgctgttgg

SEQ ID NO: 271864 - DNA, 25 bp, Mus musculus
gggtccacggtcagcatttttcctg

SEQ ID NO: 271865 - DNA, 25 bp, Mus musculus
agcaaattaaggaaaggcgccgcga

SEQ ID NO: 271866 - DNA, 25 bp, Mus musculus
tggtgacccgcatctccagtctgct

SEQ ID NO: 271867 - DNA, 25 bp, Mus musculus
ggggaagctccaacagcagcgtcga

SEQ ID NO: 271868 - DNA, 25 bp, Mus musculus
gcttcgtgacctgcctaccctgaag

SEQ ID NO: 271869 - DNA, 25 bp, Mus musculus
tgctcatcgcctgtctgctgctgcg

SEQ ID NO: 271870 - DNA, 25 bp, Mus musculus
gcctaccctgaaggcgacggtgatc

SEQ ID NO: 271871 - DNA, 25 bp, Mus musculus
caggcgcgcacttttctgctctctg

SEQ ID NO: 271872 - DNA, 25 bp, Mus musculus
atcgtggcatgtgccttcagcgcgc

SEQ ID NO: 271873 - DNA, 25 bp, Mus musculus
aatgactctgtgcaacgtgttggtg

SEQ ID NO: 271874 - DNA, 25 bp, Mus musculus
gggctctgcagcttcctgccgagca

SEQ ID NO: 271875 - DNA, 25 bp, Mus musculus
tccgcaccgtgcgtgcgcatagtgc

SEQ ID NO: 271876 - DNA, 25 bp, Mus musculus
cgcatagtgcaccatgagcgccctg

SEQ ID NO: 271877 - DNA, 25 bp, Mus musculus
cggtcccgggaatgctacccagctg

SEQ ID NO: 271878 - DNA, 25 bp, Mus musculus
ctacccagctgggatccggcatggc

SEQ ID NO: 271879 - DNA, 25 bp, Mus musculus
ggccgaagcccgtcgaatgactctg

SEQ ID NO: 271880 - DNA, 25 bp, Mus musculus
cccactttgccaaggcgagaaaacg

SEQ ID NO: 271881 - DNA, 25 bp, Mus musculus
tttgacagctttgctccgcgccttg

SEQ ID NO: 271882 - DNA, 25 bp, Mus musculus
tccaggcgcagtttgacagctttgc

SEQ ID NO: 271883 - DNA, 25 bp, Mus musculus
caacagacaagggttgctctggcgc

SEQ ID NO: 271884 - DNA, 25 bp, Mus musculus
gctccggaactgcagctgcatggtg

SEQ ID NO: 271885 - DNA, 25 bp, Mus musculus
cgagcagcgtaagcgcggccagcat

SEQ ID NO: 271886 - DNA, 25 bp, Mus musculus
atgaggaagaccacgagcagcgtaa

SEQ ID NO: 271887 - DNA, 25 bp, Mus musculus
tcgatctctgagatgtctgcgaaga

SEQ ID NO: 271888 - DNA, 25 bp, Mus musculus
acccgatttcttcttcgatctctga

SEQ ID NO: 271889 - DNA, 25 bp, Mus musculus
tcagggaggctatttacccgatttc

SEQ ID NO: 271890 - DNA, 25 bp, Mus musculus
gcccaggggaagaagagatcccgcc

SEQ ID NO: 271891 - DNA, 25 bp, Mus musculus
agacaaagaaactcctgcctgcctc

SEQ ID NO: 271892 - DNA, 25 bp, Mus musculus
gccgagccggagacaaagaaactcc

SEQ ID NO: 271893 - DNA, 25 bp, Mus musculus
tgccaaggcgagaaaacggccgagc

SEQ ID NO: 271894 - DNA, 25 bp, Mus musculus
tgttcctcgccttcgtcttggaagg

SEQ ID NO: 271895 - DNA, 25 bp, Mus musculus
aaagtctctgcgaagtgtgctcccg

SEQ ID NO: 271896 - DNA, 25 bp, Mus musculus
ccgtcctctagggactctggaagtt

SEQ ID NO: 271897 - DNA, 25 bp, Mus musculus
gcgcaaaaactcaccgtcctctagg

SEQ ID NO: 271898 - DNA, 25 bp, Mus musculus
tccagagatgggacccacgaggacc

SEQ ID NO: 271899 - DNA, 25 bp, Mus musculus
gggtccgcacgctaccaactcggga

SEQ ID NO: 271900 - DNA, 25 bp, Mus musculus
ttctccatgtactcggacgccggga

SEQ ID NO: 271901 - DNA, 25 bp, Mus musculus
gcgccttcggactcattcaccagtg

SEQ ID NO: 271902 - DNA, 25 bp, Mus musculus
ttcaccagtgaggacttgagctctg

SEQ ID NO: 271903 - DNA, 25 bp, Mus musculus
gacttgagctctgccaggtcccgct

SEQ ID NO: 271904 - DNA, 25 bp, Mus musculus
gtcccagggcctgcagagcgaagca

SEQ ID NO: 271905 - DNA, 25 bp, Mus musculus
gcgattcttatcgtcctgttcctcg

SEQ ID NO: 271906 - DNA, 25 bp, Mus musculus
ggcgggtcggaacatcaaaggcacc

SEQ ID NO: 271907 - DNA, 25 bp, Mus musculus
gcccacagcgctgtcgcgattctta

SEQ ID NO: 271908 - DNA, 25 bp, Mus musculus
tacgaagagaatcagcgccaggttg

SEQ ID NO: 271909 - DNA, 25 bp, Mus musculus
agggcgcccagtgccatgacaattc

SEQ ID NO: 271910 - DNA, 25 bp, Mus musculus
ctcatcactgctggacccattggtg

SEQ ID NO: 271911 - DNA, 25 bp, Mus musculus
caccacagccgatgaggcgcggtcg

SEQ ID NO: 271912 - DNA, 25 bp, Mus musculus
tgcccacgtgctccgaagtaactta

SEQ ID NO: 271913 - DNA, 25 bp, Mus musculus
tggacccattggtggcacagacatc

SEQ ID NO: 271914 - DNA, 25 bp, Mus musculus
ccattggtggcacagacatcgcggc

SEQ ID NO: 271915 - DNA, 25 bp, Mus musculus
tgacaattccaccacagccgatgag

SEQ ID NO: 271916 - DNA, 25 bp, Mus musculus
tccgaagtaacttacgaagagaatc

SEQ ID NO: 271917 - DNA, 25 bp, Mus musculus
gtgaggaactcaggcagtgccgaaa

SEQ ID NO: 271918 - DNA, 25 bp, Mus musculus
cgccaggttgccgatctcaaagctg

SEQ ID NO: 271919 - DNA, 25 bp, Mus musculus
tctcaaagctgctggcgatcacacc

SEQ ID NO: 271920 - DNA, 25 bp, Mus musculus
tggctgtccggttacggcagattag

SEQ ID NO: 271921 - DNA, 25 bp, Mus musculus
cgccagcctcgtacttgtactggtg

SEQ ID NO: 271922 - DNA, 25 bp, Mus musculus
ctcagacaccaggaagatcttgatg

SEQ ID NO: 271923 - DNA, 25 bp, Mus musculus
agcatcaaggcgcactcagacacca

SEQ ID NO: 271924 - DNA, 25 bp, Mus musculus
actcaccaggtaggcgcccaccgta

SEQ ID NO: 271925 - DNA, 25 bp, Mus musculus
gaagcaggacaccttctttttcttc

SEQ ID NO: 271926 - DNA, 25 bp, Mus musculus
gtccgccgcagagttggcacccgga

SEQ ID NO: 271927 - DNA, 25 bp, Mus musculus
gcccggcttctttccctgcatcctt

SEQ ID NO: 271928 - DNA, 25 bp, Mus musculus
gtgccgcgaggctgcgtactgtccc

SEQ ID NO: 271929 - DNA, 25 bp, Mus musculus
tcctgccgcggctagagaggttgaa

SEQ ID NO: 271930 - DNA, 25 bp, Mus musculus
agaggttgaaggctccgctcctcgc

SEQ ID NO: 271931 - DNA, 25 bp, Mus musculus
cgggctgtgccaatcacagggactc

SEQ ID NO: 271932 - DNA, 25 bp, Mus musculus
gtgccaatcacagggactcctcgcg

SEQ ID NO: 271933 - DNA, 25 bp, Mus musculus
tagcctctctcggactctcgccgtt

SEQ ID NO: 271934 - DNA, 25 bp, Mus musculus
cttgatgttggagaagcaggacacc

SEQ ID NO: 271935 - DNA, 25 bp, Mus musculus
gcagagttggcacccggactcacca

SEQ ID NO: 271936 - DNA, 25 bp, Mus musculus
tgcctccgctgtgcagagcctctgt

SEQ ID NO: 271937 - DNA, 25 bp, Mus musculus
cgcaccaccgcgagaatcgccgtcc

SEQ ID NO: 271938 - DNA, 25 bp, Mus musculus
ccgctgtgcagagcctctgtgcagc

SEQ ID NO: 271939 - DNA, 25 bp, Mus musculus
gggcacacctgcatcgccgcgccct

SEQ ID NO: 271940 - DNA, 25 bp, Mus musculus
aaccgaggcaggctctccctagggc

SEQ ID NO: 271941 - DNA, 25 bp, Mus musculus
tggtaatcccaaccgaggcaggctc

SEQ ID NO: 271942 - DNA, 25 bp, Mus musculus
caggctaacgcggttggtaatccca

SEQ ID NO: 271943 - DNA, 25 bp, Mus musculus
cagctcaggctaacgcggttggtaa

SEQ ID NO: 271944 - DNA, 25 bp, Mus musculus
acaccgtaagtctgggcggcagctc

SEQ ID NO: 271945 - DNA, 25 bp, Mus musculus
gtcagcagccgaacaccgtaagtct

SEQ ID NO: 271946 - DNA, 25 bp, Mus musculus
agccggtcagcagccgaacaccgta

SEQ ID NO: 271947 - DNA, 25 bp, Mus musculus
aaaatccgcagcgagccggtcagca

SEQ ID NO: 271948 - DNA, 25 bp, Mus musculus
gtggaaaatccgcagcgagccggtc

SEQ ID NO: 271949 - DNA, 25 bp, Mus musculus
aagtctgggcggcagctcaggctaa

SEQ ID NO: 271950 - DNA, 25 bp, Mus musculus
gaacggtggcgcattcgactcctct

SEQ ID NO: 271951 - DNA, 25 bp, Mus musculus
ggagcggccgcctattgtccttctc

SEQ ID NO: 271952 - DNA, 25 bp, Mus musculus
ccgcacggtgagagcgcaacttagt

SEQ ID NO: 271953 - DNA, 25 bp, Mus musculus
cactgcttttcgtaaataggctcgc

SEQ ID NO: 271954 - DNA, 25 bp, Mus musculus
tggcggacccttcttagcatcggca

SEQ ID NO: 271955 - DNA, 25 bp, Mus musculus
cggctgcggctctcctctgagggac

SEQ ID NO: 271956 - DNA, 25 bp, Mus musculus
ccctcgagctctagtgcaagcactt

SEQ ID NO: 271957 - DNA, 25 bp, Mus musculus
tcaagccgggtaaacactgcgcgcc

SEQ ID NO: 271958 - DNA, 25 bp, Mus musculus
ccttcttagcatcggcagccagggg

SEQ ID NO: 271959 - DNA, 25 bp, Mus musculus
cgctcgaacagagagtgcggctccg

SEQ ID NO: 271960 - DNA, 25 bp, Mus musculus
tgctgctgctaagctcttgggctcg

SEQ ID NO: 271961 - DNA, 25 bp, Mus musculus
caagcactttgagaactagcgaatc

SEQ ID NO: 271962 - DNA, 25 bp, Mus musculus
ataggctcgctgacacttaactggg

SEQ ID NO: 271963 - DNA, 25 bp, Mus musculus
gagaccgccgtgcttgctccttgct

SEQ ID NO: 271964 - DNA, 25 bp, Mus musculus
atcagatgcaaaatccttcagcgtc

SEQ ID NO: 271965 - DNA, 25 bp, Mus musculus
tgcaaaatccttcagcgtcggaaac

SEQ ID NO: 271966 - DNA, 25 bp, Mus musculus
aatccttcagcgtcggaaaccatcg

SEQ ID NO: 271967 - DNA, 25 bp, Mus musculus
tcagcgtcggaaaccatcgcggccg

SEQ ID NO: 271968 - DNA, 25 bp, Mus musculus
cttgcggggtccagaagctctggaa

SEQ ID NO: 271969 - DNA, 25 bp, Mus musculus
cagacggtgggaaggcaaaaataat

SEQ ID NO: 271970 - DNA, 25 bp, Mus musculus
ctctggaaacgaggcgcgctctccg

SEQ ID NO: 271971 - DNA, 25 bp, Mus musculus
aagctctggaaacgaggcgcgctct

SEQ ID NO: 271972 - DNA, 25 bp, Mus musculus
ttgtaacaacagacggtgggaaggc

SEQ ID NO: 271973 - DNA, 25 bp, Mus musculus
ctttgcagggttgtaacaacagacg

SEQ ID NO: 271974 - DNA, 25 bp, Mus musculus
tccgagactttgcagggttgtaaca

SEQ ID NO: 271975 - DNA, 25 bp, Mus musculus
tccgactccgagactttgcagggtt

SEQ ID NO: 271976 - DNA, 25 bp, Mus musculus
ctctccgactccgagactttgcagg

SEQ ID NO: 271977 - DNA, 25 bp, Mus musculus
tccagaagctctggaaacgaggcgc

SEQ ID NO: 271978 - DNA, 25 bp, Mus musculus
tgctgcccggttttgctgcaatctc

SEQ ID NO: 271979 - DNA, 25 bp, Mus musculus
ttggcaagctgactgagcaacacga

SEQ ID NO: 271980 - DNA, 25 bp, Mus musculus
tgactgagcaacacgaaaggcgttc

SEQ ID NO: 271981 - DNA, 25 bp, Mus musculus
agcaacacgaaaggcgttctccctt

SEQ ID NO: 271982 - DNA, 25 bp, Mus musculus
cttccactttttggccctcgtgctg

SEQ ID NO: 271983 - DNA, 25 bp, Mus musculus
actttttggccctcgtgctgcccgg

SEQ ID NO: 271984 - DNA, 25 bp, Mus musculus
ggctcacggacagtgacgggaatca

SEQ ID NO: 271985 - DNA, 25 bp, Mus musculus
cgagacggaaaggaaaagttgcagt

SEQ ID NO: 271986 - DNA, 25 bp, Mus musculus
tgctgcaatctcctccgcaggagga

SEQ ID NO: 271987 - DNA, 25 bp, Mus musculus
cgaaatgagcgtggcccaggtgacc

SEQ ID NO: 271988 - DNA, 25 bp, Mus musculus
cgggatgctccccagcctgagtgag

SEQ ID NO: 271989 - DNA, 25 bp, Mus musculus
aaaagttgcagttgggattccgagg

SEQ ID NO: 271990 - DNA, 25 bp, Mus musculus
cagtgacgggaatcaggagcgcaca

SEQ ID NO: 271991 - DNA, 25 bp, Mus musculus
cgggaatcaggagcgcacaggaacc

SEQ ID NO: 271992 - DNA, 25 bp, Mus musculus
tgtcttcccacaaggtaccgcggcg

SEQ ID NO: 271993 - DNA, 25 bp, Mus musculus
gtggccgctgcagacacaaggcgcc

SEQ ID NO: 271994 - DNA, 25 bp, Mus musculus
ttcccatgaggcaacgcgggccggc

SEQ ID NO: 271995 - DNA, 25 bp, Mus musculus
cccaggttcccatgaggcaacgcgg

SEQ ID NO: 271996 - DNA, 25 bp, Mus musculus
gctgcagacacaaggcgcccgacaa

SEQ ID NO: 271997 - DNA, 25 bp, Mus musculus
aggcgcccgacaagcgccatggaga

SEQ ID NO: 271998 - DNA, 25 bp, Mus musculus
ccggctgcttgaggacgcagcctca

SEQ ID NO: 271999 - DNA, 25 bp, Mus musculus
acgcagcctcaagggacaagccacg

SEQ ID NO: 272000 - DNA, 25 bp, Mus musculus
gggacaagccacgagaactacctgc

SEQ ID NO: 272001 - DNA, 25 bp, Mus musculus
agccacgagaactacctgcccagaa

SEQ ID NO: 272002 - DNA, 25 bp, Mus musculus
tacctgcccagaacctgtcaagctg

SEQ ID NO: 272003 - DNA, 25 bp, Mus musculus
cagcctctagccagccctaaaagag

SEQ ID NO: 272004 - DNA, 25 bp, Mus musculus
gccagccctaaaagagtacgcccta

SEQ ID NO: 272005 - DNA, 25 bp, Mus musculus
gccatctttctgtcttcccacaagg

SEQ ID NO: 272006 - DNA, 25 bp, Mus musculus
tctcaggctcaggacgtgacagaca

SEQ ID NO: 272007 - DNA, 25 bp, Mus musculus
cgaagccttgagactccaccaacga

SEQ ID NO: 272008 - DNA, 25 bp, Mus musculus
cgagagaacgatgggtttccgcttc

SEQ ID NO: 272009 - DNA, 25 bp, Mus musculus
cagagaccactcaccggagccgaga

SEQ ID NO: 272010 - DNA, 25 bp, Mus musculus
caaacgggacctgcggctcagcaga

SEQ ID NO: 272011 - DNA, 25 bp, Mus musculus
ggaagtgctaggacgcacgcgcaca

SEQ ID NO: 272012 - DNA, 25 bp, Mus musculus
tacgctgcctaccaaacgggacctg

SEQ ID NO: 272013 - DNA, 25 bp, Mus musculus
caggaagaggtgaagacctcgatgt

SEQ ID NO: 272014 - DNA, 25 bp, Mus musculus
gccgtttccggattaagcgacctga

SEQ ID NO: 272015 - DNA, 25 bp, Mus musculus
cgtgacagacactgaacaggtcttg

SEQ ID NO: 272016 - DNA, 25 bp, Mus musculus
aggagtgacgttctcaggctcagga

SEQ ID NO: 272017 - DNA, 25 bp, Mus musculus
accctctccgggaatgctgggaagt

SEQ ID NO: 272018 - DNA, 25 bp, Mus musculus
ttaagcgacctgacgtcacacgacc

SEQ ID NO: 272019 - DNA, 25 bp, Mus musculus
cttggagatgttgagcctgcgtacc

SEQ ID NO: 272020 - DNA, 25 bp, Mus musculus
gccgcaaagggcaagtcctcacctg

SEQ ID NO: 272021 - DNA, 25 bp, Mus musculus
tcgccctagcctgctccgcgcacac

SEQ ID NO: 272022 - DNA, 25 bp, Mus musculus
caccctggcgtccggaggagagatc

SEQ ID NO: 272023 - DNA, 25 bp, Mus musculus
ccatgcagctaaggagcggcgcagc

SEQ ID NO: 272024 - DNA, 25 bp, Mus musculus
tcgagacgccatgcagctaaggagc

SEQ ID NO: 272025 - DNA, 25 bp, Mus musculus
ggaagatcgagacgccatgcagcta

SEQ ID NO: 272026 - DNA, 25 bp, Mus musculus
gagctcctgagacccggcgagcatg

SEQ ID NO: 272027 - DNA, 25 bp, Mus musculus
cccgctaccggaagcgctgcgcagc

SEQ ID NO: 272028 - DNA, 25 bp, Mus musculus
gccagggcaagggtcgccctagcct

SEQ ID NO: 272029 - DNA, 25 bp, Mus musculus
ctgtcgagtcctggctcatggggcc

SEQ ID NO: 272030 - DNA, 25 bp, Mus musculus
ctcacctgtcgagtcctggctcatg

SEQ ID NO: 272031 - DNA, 25 bp, Mus musculus
agggcaagtcctcacctgtcgagtc

SEQ ID NO: 272032 - DNA, 25 bp, Mus musculus
tctcgcgggccgcaaagggcaagtc

SEQ ID NO: 272033 - DNA, 25 bp, Mus musculus
ggaagatcggaagatcgagacgcca

SEQ ID NO: 272034 - DNA, 25 bp, Mus musculus
ttgcggtggacagcacagacgaccg

SEQ ID NO: 272035 - DNA, 25 bp, Mus musculus
tacctcctctcggtgtgaacattgc

SEQ ID NO: 272036 - DNA, 25 bp, Mus musculus
ttcctacctcctctcggtgtgaaca

SEQ ID NO: 272037 - DNA, 25 bp, Mus musculus
gagtgtgccgggaccttcctacctc

SEQ ID NO: 272038 - DNA, 25 bp, Mus musculus
ccgtgtccacgtctgggagtgtgcc

SEQ ID NO: 272039 - DNA, 25 bp, Mus musculus
cccgctcgctttcaggatgacatca

SEQ ID NO: 272040 - DNA, 25 bp, Mus musculus
gcagccaccgtgtccacgtctggga

SEQ ID NO: 272041 - DNA, 25 bp, Mus musculus
tctcggctttaaagcagctgtgccc

SEQ ID NO: 272042 - DNA, 25 bp, Mus musculus
ggctggtctcggctttaaagcagct

SEQ ID NO: 272043 - DNA, 25 bp, Mus musculus
gcgtccctgacaggccacccgcagg

SEQ ID NO: 272044 - DNA, 25 bp, Mus musculus
ggatgacatcacagacgtccgcgtc

SEQ ID NO: 272045 - DNA, 25 bp, Mus musculus
tgaacattgcggtggacagcacaga

SEQ ID NO: 272046 - DNA, 25 bp, Mus musculus
cgctcgctttcaggatgacatcaca

SEQ ID NO: 272047 - DNA, 25 bp, Mus musculus
ctcggtgtgaacattgcggtggaca

SEQ ID NO: 272048 - DNA, 25 bp, Mus musculus
gccaccgagcattctcagcagcaga

SEQ ID NO: 272049 - DNA, 25 bp, Mus musculus
taaaagctgtggtcgctttgtcccg

SEQ ID NO: 272050 - DNA, 25 bp, Mus musculus
taaacgtgcgataaaagctgtggtc

SEQ ID NO: 272051 - DNA, 25 bp, Mus musculus
acgccaccttcataaacgtgcgata

SEQ ID NO: 272052 - DNA, 25 bp, Mus musculus
tgtgtgcgccctctgaaaccatagg

SEQ ID NO: 272053 - DNA, 25 bp, Mus musculus
cgagacgtagtattcccaccacacg

SEQ ID NO: 272054 - DNA, 25 bp, Mus musculus
ccgcaaccgcaaggcccggtgtgtg

SEQ ID NO: 272055 - DNA, 25 bp, Mus musculus
ctcagcagcagacccgagacgtagt

SEQ ID NO: 272056 - DNA, 25 bp, Mus musculus
cgccctctgaaaccataggtaaaga

SEQ ID NO: 272057 - DNA, 25 bp, Mus musculus
cggcagtttccatccaccgttttgt

SEQ ID NO: 272058 - DNA, 25 bp, Mus musculus
ttttttgttcaaaggccaccgagca

SEQ ID NO: 272059 - DNA, 25 bp, Mus musculus
gttcaaaggccaccgagcattctca

SEQ ID NO: 272060 - DNA, 25 bp, Mus musculus
taaagacaattaccggcagtttcca

SEQ ID NO: 272061 - DNA, 25 bp, Mus musculus
cagcaagaaatagcgcccgcaaccg

SEQ ID NO: 272062 - DNA, 25 bp, Mus musculus
cgcggacgttgagcgtcctctggac

SEQ ID NO: 272063 - DNA, 25 bp, Mus musculus
cacgtgaaacctgggaaagcgcggc

SEQ ID NO: 272064 - DNA, 25 bp, Mus musculus
cgcacccggcaagggttccacgtga

SEQ ID NO: 272065 - DNA, 25 bp, Mus musculus
ttgtccgggcaaggagcttccgcac

SEQ ID NO: 272066 - DNA, 25 bp, Mus musculus
acaggtagccgaagccgggcttgtc

SEQ ID NO: 272067 - DNA, 25 bp, Mus musculus
cccagagaaccaatagacaggtagc

SEQ ID NO: 272068 - DNA, 25 bp, Mus musculus
agaagagtccttaggcgggcgctac

SEQ ID NO: 272069 - DNA, 25 bp, Mus musculus
gcaggatcaaccaatcagaagagtc

SEQ ID NO: 272070 - DNA, 25 bp, Mus musculus
ttactgaggaggagcaggatcaacc

SEQ ID NO: 272071 - DNA, 25 bp, Mus musculus
ttccagttggcacacttactgagga

SEQ ID NO: 272072 - DNA, 25 bp, Mus musculus
ttatgctaacctcctaaacgctgcc

SEQ ID NO: 272073 - DNA, 25 bp, Mus musculus
ggacgttccattcggttttatgcta

SEQ ID NO: 272074 - DNA, 25 bp, Mus musculus
tcctctggacgcctcagctggtgag

SEQ ID NO: 272075 - DNA, 25 bp, Mus musculus
ttcactaggcgtcgggtcagaaacc

SEQ ID NO: 272076 - DNA, 25 bp, Mus musculus
gcaagcggcacgtccccctaatggg

SEQ ID NO: 272077 - DNA, 25 bp, Mus musculus
cacaaccggagccttcaggacgctg

SEQ ID NO: 272078 - DNA, 25 bp, Mus musculus
ctgagctcagggcagcatcagagga

SEQ ID NO: 272079 - DNA, 25 bp, Mus musculus
gacaagggcaggctttgtgcgcagc

SEQ ID NO: 272080 - DNA, 25 bp, Mus musculus
cggcgggactgtgagtcccctaaca

SEQ ID NO: 272081 - DNA, 25 bp, Mus musculus
ctaacagggtcctagccctgccctg

SEQ ID NO: 272082 - DNA, 25 bp, Mus musculus
tcctgcggtgcatcctggcagcgat

SEQ ID NO: 272083 - DNA, 25 bp, Mus musculus
ggcagcgatggcttcaccacagccc

SEQ ID NO: 272084 - DNA, 25 bp, Mus musculus
atggcttcaccacagcccgcgtccg

SEQ ID NO: 272085 - DNA, 25 bp, Mus musculus
tttctcctggagcagacgaaaagtc

SEQ ID NO: 272086 - DNA, 25 bp, Mus musculus
tctcctggagcagacgaaaagtcga

SEQ ID NO: 272087 - DNA, 25 bp, Mus musculus
ctggagcagacgaaaagtcgagatg

SEQ ID NO: 272088 - DNA, 25 bp, Mus musculus
agatgggagagaagcgcgctaacct

SEQ ID NO: 272089 - DNA, 25 bp, Mus musculus
ggcgtggtccggacaccggactcca

SEQ ID NO: 272090 - DNA, 25 bp, Mus musculus
ttcgggcacctttctgtgtcccttc

SEQ ID NO: 272091 - DNA, 25 bp, Mus musculus
tgccttcggcactctgcgggcgcag

SEQ ID NO: 272092 - DNA, 25 bp, Mus musculus
accggactgctaccctgacagcagg

SEQ ID NO: 272093 - DNA, 25 bp, Mus musculus
ctaccctgacagcaggagccgggtg

SEQ ID NO: 272094 - DNA, 25 bp, Mus musculus
acgcgtgcggaacggctcaaggtcc

SEQ ID NO: 272095 - DNA, 25 bp, Mus musculus
gagccgggtgccttcggcactctgc

SEQ ID NO: 272096 - DNA, 25 bp, Mus musculus
tgccgagggagttcgggcacctttc

SEQ ID NO: 272097 - DNA, 25 bp, Mus musculus
tggactgcggagctgccgaccgcaa

SEQ ID NO: 272098 - DNA, 25 bp, Mus musculus
cggagctgccgaccgcaatgcagac

SEQ ID NO: 272099 - DNA, 25 bp, Mus musculus
tgcgcgctccggacgtttctgcctt

SEQ ID NO: 272100 - DNA, 25 bp, Mus musculus
ggaacggctcaaggtccctcactct

SEQ ID NO: 272101 - DNA, 25 bp, Mus musculus
ctcgccggctagcatctgacgcagg

SEQ ID NO: 272102 - DNA, 25 bp, Mus musculus
gaccctgctccgaaacctagtcagc

SEQ ID NO: 272103 - DNA, 25 bp, Mus musculus
ggctagcatctgacgcaggtgccga

SEQ ID NO: 272104 - DNA, 25 bp, Mus musculus
agggactcaccagacgcggcgaaga

SEQ ID NO: 272105 - DNA, 25 bp, Mus musculus
ccagaggcgcagagtagcatgccgc

SEQ ID NO: 272106 - DNA, 25 bp, Mus musculus
gcagagtagcatgccgcacagcgcg

SEQ ID NO: 272107 - DNA, 25 bp, Mus musculus
agcacacgggagacctgcatgctgc

SEQ ID NO: 272108 - DNA, 25 bp, Mus musculus
cgcgggaaaaggtccacgcgctctg

SEQ ID NO: 272109 - DNA, 25 bp, Mus musculus
ggaaaaggtccacgcgctctgatgc

SEQ ID NO: 272110 - DNA, 25 bp, Mus musculus
tctgatgctgggactcgagagttcc

SEQ ID NO: 272111 - DNA, 25 bp, Mus musculus
gactcgagagttcctgcgtccgctc

SEQ ID NO: 272112 - DNA, 25 bp, Mus musculus
gctcctctcactccggaataaatca

SEQ ID NO: 272113 - DNA, 25 bp, Mus musculus
tccggaataaatcaggcgcctcagc

SEQ ID NO: 272114 - DNA, 25 bp, Mus musculus
cgcccactggcccaagggctccgcc

SEQ ID NO: 272115 - DNA, 25 bp, Mus musculus
cgtcgctgagaacttccgagcggcg

SEQ ID NO: 272116 - DNA, 25 bp, Mus musculus
tccacgcgctctgatgctgggactc

SEQ ID NO: 272117 - DNA, 25 bp, Mus musculus
aggccagagggactcaccagacgcg

SEQ ID NO: 272118 - DNA, 25 bp, Mus musculus
ctgctggagtcaatgagagaaggta

SEQ ID NO: 272119 - DNA, 25 bp, Mus musculus
ccgcagcttgagtgctccggatccg

SEQ ID NO: 272120 - DNA, 25 bp, Mus musculus
atcgcgccgcagcttgagtgctccg

SEQ ID NO: 272121 - DNA, 25 bp, Mus musculus
ccttggatgcgtcgggccagaaccc

SEQ ID NO: 272122 - DNA, 25 bp, Mus musculus
ccaaacagggatcgcgccttggatg

SEQ ID NO: 272123 - DNA, 25 bp, Mus musculus
ttccaccaaacagggatcgcgcctt

SEQ ID NO: 272124 - DNA, 25 bp, Mus musculus
gggcgagttccaccaaacagggatc

SEQ ID NO: 272125 - DNA, 25 bp, Mus musculus
ctcggctgggcgagttccaccaaac

SEQ ID NO: 272126 - DNA, 25 bp, Mus musculus
gtcaatgagagaaggtaagacctcg

SEQ ID NO: 272127 - DNA, 25 bp, Mus musculus
ttggactgctggagtcaatgagaga

SEQ ID NO: 272128 - DNA, 25 bp, Mus musculus
gtatttctatgagcgcagccggcag

SEQ ID NO: 272129 - DNA, 25 bp, Mus musculus
ttccggctgtatttctatgagcgca

SEQ ID NO: 272130 - DNA, 25 bp, Mus musculus
aggggttccggctgtatttctatga

SEQ ID NO: 272131 - DNA, 25 bp, Mus musculus
taagacctcggctgggcgagttcca

SEQ ID NO: 272132 - DNA, 25 bp, Mus musculus
tgcactgacttcaactacagagctc

SEQ ID NO: 272133 - DNA, 25 bp, Mus musculus
attggttcaatctcttctgcactga

SEQ ID NO: 272134 - DNA, 25 bp, Mus musculus
tgactgttcagggtctgtgcttaca

SEQ ID NO: 272135 - DNA, 25 bp, Mus musculus
tctaagaaagcttaacccggccata

SEQ ID NO: 272136 - DNA, 25 bp, Mus musculus
taacgcgcatgctactctgaggttc

SEQ ID NO: 272137 - DNA, 25 bp, Mus musculus
cccaaagcgtgtgagccggttgcac

SEQ ID NO: 272138 - DNA, 25 bp, Mus musculus
tctcccgcgaatttgggccatcatc

SEQ ID NO: 272139 - DNA, 25 bp, Mus musculus
gtacgccctacagagttaggaagtc

SEQ ID NO: 272140 - DNA, 25 bp, Mus musculus
cgcgaggtgcttccgatgcaaaaga

SEQ ID NO: 272141 - DNA, 25 bp, Mus musculus
ttaggaagtcggaagtgcacctcgg

SEQ ID NO: 272142 - DNA, 25 bp, Mus musculus
gaattttggaaggatcccgagctga

SEQ ID NO: 272143 - DNA, 25 bp, Mus musculus
atcccgagctgaggttgaggtgact

SEQ ID NO: 272144 - DNA, 25 bp, Mus musculus
tgggccatcatctccgcaaagattc

SEQ ID NO: 272145 - DNA, 25 bp, Mus musculus
gacctgaccctccatcaattggttc

SEQ ID NO: 272146 - DNA, 25 bp, Mus musculus
gccagagcggagtagggacattttt

SEQ ID NO: 272147 - DNA, 25 bp, Mus musculus
tctggctctccaactgcgtgacctt

SEQ ID NO: 272148 - DNA, 25 bp, Mus musculus
ttaagaactctagagccacgggcca

SEQ ID NO: 272149 - DNA, 25 bp, Mus musculus
ggagacgcagacagaccagggttct

SEQ ID NO: 272150 - DNA, 25 bp, Mus musculus
gggacatttttctgttacgcctcca

SEQ ID NO: 272151 - DNA, 25 bp, Mus musculus
attctcggaggagggcatttgcgac

SEQ ID NO: 272152 - DNA, 25 bp, Mus musculus
gctgcgtgccaaacaagcattttct

SEQ ID NO: 272153 - DNA, 25 bp, Mus musculus
gtcacggacttgaacaaaccgctta

SEQ ID NO: 272154 - DNA, 25 bp, Mus musculus
tgaaataggtctcaccatgcctgcc

SEQ ID NO: 272155 - DNA, 25 bp, Mus musculus
cctctctgtgctcctgtcagtgaaa

SEQ ID NO: 272156 - DNA, 25 bp, Mus musculus
actgcttttagtggccgaaagactc

SEQ ID NO: 272157 - DNA, 25 bp, Mus musculus
ttgggctccagcttgactgctttta

SEQ ID NO: 272158 - DNA, 25 bp, Mus musculus
cttcttccagagcaggcggctcatg

SEQ ID NO: 272159 - DNA, 25 bp, Mus musculus
acaccggctcggcagttaacttggg

SEQ ID NO: 272160 - DNA, 25 bp, Mus musculus
gtccgaagtctagatttgtcaccta

SEQ ID NO: 272161 - DNA, 25 bp, Mus musculus
ttgagtccgattggtcgcgcccacc

SEQ ID NO: 272162 - DNA, 25 bp, Mus musculus
tgacagcggtcgagagccttgtccc

SEQ ID NO: 272163 - DNA, 25 bp, Mus musculus
gtcccggatggagagtggagcaaac

SEQ ID NO: 272164 - DNA, 25 bp, Mus musculus
tggagcaaacggagcacgtgccgtc

SEQ ID NO: 272165 - DNA, 25 bp, Mus musculus
agcacgtgccgtccgaagtctagat

SEQ ID NO: 272166 - DNA, 25 bp, Mus musculus
gtgccgtccgaagtctagatttgtc

SEQ ID NO: 272167 - DNA, 25 bp, Mus musculus
ttgtcacctatggaccgcaaaggct

SEQ ID NO: 272168 - DNA, 25 bp, Mus musculus
ggaccgcaaaggctaagcctcgatg

SEQ ID NO: 272169 - DNA, 25 bp, Mus musculus
ggctaagcctcgatggagtctcctc

SEQ ID NO: 272170 - DNA, 25 bp, Mus musculus
tcctatcccggacaatgatgctggg

SEQ ID NO: 272171 - DNA, 25 bp, Mus musculus
ttgatgctgttgagtccgattggtc

SEQ ID NO: 272172 - DNA, 25 bp, Mus musculus
cccaccgggcacagctgaagcacgt

SEQ ID NO: 272173 - DNA, 25 bp, Mus musculus
ctagatttgtcacctatggaccgca

SEQ ID NO: 272174 - DNA, 25 bp, Mus musculus
cagcttgcgcgccaggcgggcaatc

SEQ ID NO: 272175 - DNA, 25 bp, Mus musculus
atgcccgccacgtccaaggccacgg

SEQ ID NO: 272176 - DNA, 25 bp, Mus musculus
agctgcgcgaacacgccggtcagca

SEQ ID NO: 272177 - DNA, 25 bp, Mus musculus
ccagagtagatgagcaggtccccga

SEQ ID NO: 272178 - DNA, 25 bp, Mus musculus
gtaccagagaatccagcccagcagg

SEQ ID NO: 272179 - DNA, 25 bp, Mus musculus
tgccggtgtaccagagaatccagcc

SEQ ID NO: 272180 - DNA, 25 bp, Mus musculus
cgagatctcgatgttgccggtgtac

SEQ ID NO: 272181 - DNA, 25 bp, Mus musculus
gctcctggcgcgagatctcgatgtt

SEQ ID NO: 272182 - DNA, 25 bp, Mus musculus
tcgctctgcgtgctgagcggagacc

SEQ ID NO: 272183 - DNA, 25 bp, Mus musculus
caatcgccgagggtcgtaggccgta

SEQ ID NO: 272184 - DNA, 25 bp, Mus musculus
gccgaccagcgacgggacagcttgc

SEQ ID NO: 272185 - DNA, 25 bp, Mus musculus
tgcgagccgcacaccggtgacgctg

SEQ ID NO: 272186 - DNA, 25 bp, Mus musculus
gtaggccgtagtcacgctccagctc

SEQ ID NO: 272187 - DNA, 25 bp, Mus musculus
ccgcctcaagcgtggcgagctgcag

SEQ ID NO: 272188 - DNA, 25 bp, Mus musculus
tgacctcgaacgcagggtcccgacc

SEQ ID NO: 272189 - DNA, 25 bp, Mus musculus
gtccctaacactccaggcccgagta

SEQ ID NO: 272190 - DNA, 25 bp, Mus musculus
tccaggcccgagtatcccaacgccc

SEQ ID NO: 272191 - DNA, 25 bp, Mus musculus
aatctatgaccctccctagtgaccg

SEQ ID NO: 272192 - DNA, 25 bp, Mus musculus
cccgcatcacaaccctcgaaacctg

SEQ ID NO: 272193 - DNA, 25 bp, Mus musculus
tcgaaacctgaccaccaataccaaa

SEQ ID NO: 272194 - DNA, 25 bp, Mus musculus
tgaccaccaataccaaatatcaggg

SEQ ID NO: 272195 - DNA, 25 bp, Mus musculus
ccaataccaaatatcaggggccgca

SEQ ID NO: 272196 - DNA, 25 bp, Mus musculus
taccaaatatcaggggccgcatttt

SEQ ID NO: 272197 - DNA, 25 bp, Mus musculus
gggccgcattttctcgccacggtcc

SEQ ID NO: 272198 - DNA, 25 bp, Mus musculus
ggtccctgacctcgaacgcagggtc

SEQ ID NO: 272199 - DNA, 25 bp, Mus musculus
tacccttctgaatccggagctgcgc

SEQ ID NO: 272200 - DNA, 25 bp, Mus musculus
ctgcgccgccgacgccttcttgctg

SEQ ID NO: 272201 - DNA, 25 bp, Mus musculus
acggtccctgacctcgaacgcaggg

SEQ ID NO: 272202 - DNA, 25 bp, Mus musculus
gtgccagagtgcacgcaggccttta

SEQ ID NO: 272203 - DNA, 25 bp, Mus musculus
ggacgaactccaggcacggccatgc

SEQ ID NO: 272204 - DNA, 25 bp, Mus musculus
cacatgatcacagagccgcagaggg

SEQ ID NO: 272205 - DNA, 25 bp, Mus musculus
cgcagagcggatctcccagattcta

SEQ ID NO: 272206 - DNA, 25 bp, Mus musculus
ccagattctagctcgagcgttcaga

SEQ ID NO: 272207 - DNA, 25 bp, Mus musculus
agcgttcagagcacctgcatttgga

SEQ ID NO: 272208 - DNA, 25 bp, Mus musculus
ctctggctctagatcccgtcggtgt

SEQ ID NO: 272209 - DNA, 25 bp, Mus musculus
tttacgcgcggccacacatgatcac

SEQ ID NO: 272210 - DNA, 25 bp, Mus musculus
gaaccagggacgatcattgcgggcc

SEQ ID NO: 272211 - DNA, 25 bp, Mus musculus
gacactatccgctgaggtccctagg

SEQ ID NO: 272212 - DNA, 25 bp, Mus musculus
tccaagggcctgtgcagacccagct

SEQ ID NO: 272213 - DNA, 25 bp, Mus musculus
gaggctgcaacagtgacccgcgtgt

SEQ ID NO: 272214 - DNA, 25 bp, Mus musculus
tggatctggtagagaccctcccacg

SEQ ID NO: 272215 - DNA, 25 bp, Mus musculus
ttcccaaatgcttccagcagcctgg

SEQ ID NO: 272216 - DNA, 25 bp, Mus musculus
cgtgtcaccgcccactccacttaag

SEQ ID NO: 272217 - DNA, 25 bp, Mus musculus
atagacctagaagcgggcgtgtcac

SEQ ID NO: 272218 - DNA, 25 bp, Mus musculus
ctccacttaagcagagagcctttcc

SEQ ID NO: 272219 - DNA, 25 bp, Mus musculus
cacttaagcagagagcctttcccgc

SEQ ID NO: 272220 - DNA, 25 bp, Mus musculus
gccaggccaggcttggtgcgcactt

SEQ ID NO: 272221 - DNA, 25 bp, Mus musculus
gtgcgcacttgcagccgagtagaag

SEQ ID NO: 272222 - DNA, 25 bp, Mus musculus
ttgcagccgagtagaaggtccggca

SEQ ID NO: 272223 - DNA, 25 bp, Mus musculus
cagagggcgctgttggacaacgcgc

SEQ ID NO: 272224 - DNA, 25 bp, Mus musculus
gacaacgcgcggagccgcgtcagca

SEQ ID NO: 272225 - DNA, 25 bp, Mus musculus
cgtcagcacgccagagccgctaggt

SEQ ID NO: 272226 - DNA, 25 bp, Mus musculus
acgccagagccgctaggtcaggaca

SEQ ID NO: 272227 - DNA, 25 bp, Mus musculus
cgctaggtcaggacagcggaccaca

SEQ ID NO: 272228 - DNA, 25 bp, Mus musculus
gtcaggacagcggaccacaggaccc

SEQ ID NO: 272229 - DNA, 25 bp, Mus musculus
cgtcgctatagacctagaagcgggc

SEQ ID NO: 272230 - DNA, 25 bp, Mus musculus
cgaaacacgttcctgcgagctaaag

SEQ ID NO: 272231 - DNA, 25 bp, Mus musculus
aaagaatcccttccgagccctcatt

SEQ ID NO: 272232 - DNA, 25 bp, Mus musculus
ttcctgcgagctaaagaatcccttc

SEQ ID NO: 272233 - DNA, 25 bp, Mus musculus
acccagactgtcaacgaaacacgtt

SEQ ID NO: 272234 - DNA, 25 bp, Mus musculus
tggaacgcaacccagactgtcaacg

SEQ ID NO: 272235 - DNA, 25 bp, Mus musculus
agcgtgatccaggttggaacgcaac

SEQ ID NO: 272236 - DNA, 25 bp, Mus musculus
tttgcaggtgcaccgccctggatga

SEQ ID NO: 272237 - DNA, 25 bp, Mus musculus
gcggcccaaagagtttgcaggtgca

SEQ ID NO: 272238 - DNA, 25 bp, Mus musculus
cggtttgcggcccaaagagtttgca

SEQ ID NO: 272239 - DNA, 25 bp, Mus musculus
ggaggccggattcagcatttggaca

SEQ ID NO: 272240 - DNA, 25 bp, Mus musculus
ggacaatgccgagcgcgatgcagcc

SEQ ID NO: 272241 - DNA, 25 bp, Mus musculus
ccctgtggacaatgccgagcgcgat

SEQ ID NO: 272242 - DNA, 25 bp, Mus musculus
gacactctgggtctcggaggagcgt

SEQ ID NO: 272243 - DNA, 25 bp, Mus musculus
tgcgagctaaagaatcccttccgag

SEQ ID NO: 272244 - DNA, 25 bp, Mus musculus
cctcccgggtccgtaagtgtcactg

SEQ ID NO: 272245 - DNA, 25 bp, Mus musculus
ctcccgggtccgtaagtgtcactgc

SEQ ID NO: 272246 - DNA, 25 bp, Mus musculus
gcggccgaaccaccatcaccacaac

SEQ ID NO: 272247 - DNA, 25 bp, Mus musculus
ggccgaaccaccatcaccacaaccg

SEQ ID NO: 272248 - DNA, 25 bp, Mus musculus
tcccgggtccgtaagtgtcactgcc

SEQ ID NO: 272249 - DNA, 25 bp, Mus musculus
cgaaccaccatcaccacaaccgccc

SEQ ID NO: 272250 - DNA, 25 bp, Mus musculus
cccgggtccgtaagtgtcactgcct

SEQ ID NO: 272251 - DNA, 25 bp, Mus musculus
ccgggtccgtaagtgtcactgcctt

SEQ ID NO: 272252 - DNA, 25 bp, Mus musculus
tcccgggcggccgaaccaccatcac

SEQ ID NO: 272253 - DNA, 25 bp, Mus musculus
agctctcggccacgcgaccgtgcgg

SEQ ID NO: 272254 - DNA, 25 bp, Mus musculus
tctcggccacgcgaccgtgcggtca

SEQ ID NO: 272255 - DNA, 25 bp, Mus musculus
tcggccacgcgaccgtgcggtcagc

SEQ ID NO: 272256 - DNA, 25 bp, Mus musculus
tggagactcgcctgatcccgggcgg

SEQ ID NO: 272257 - DNA, 25 bp, Mus musculus
gactcgcctgatcccgggcggccga

SEQ ID NO: 272258 - DNA, 25 bp, Mus musculus
ctgggatttgaatggaagcccgtga

SEQ ID NO: 272259 - DNA, 25 bp, Mus musculus
tcctcgcggcgcagaagccgtgaac

SEQ ID NO: 272260 - DNA, 25 bp, Mus musculus
aatgggaggcccgtttctctctttg

SEQ ID NO: 272261 - DNA, 25 bp, Mus musculus
ccgcgcacgcactggacggggaact

SEQ ID NO: 272262 - DNA, 25 bp, Mus musculus
tgcccaagcgcagagcgccggttac

SEQ ID NO: 272263 - DNA, 25 bp, Mus musculus
ggccacgccgggaccaggtatccga

SEQ ID NO: 272264 - DNA, 25 bp, Mus musculus
gccgtgaacgccgaggccattgtaa

SEQ ID NO: 272265 - DNA, 25 bp, Mus musculus
gcccgtttctctctttggttatcta

SEQ ID NO: 272266 - DNA, 25 bp, Mus musculus
ctagctgtatgagtgccacagagcc

SEQ ID NO: 272267 - DNA, 25 bp, Mus musculus
gccacagagccgtcataaagctaga

SEQ ID NO: 272268 - DNA, 25 bp, Mus musculus
accgaaagtagaaatgactctcaca

SEQ ID NO: 272269 - DNA, 25 bp, Mus musculus
tctcacaacttctgcgtgcgatggc

SEQ ID NO: 272270 - DNA, 25 bp, Mus musculus
cacccagggattccagctcgacgga

SEQ ID NO: 272271 - DNA, 25 bp, Mus musculus
tggaagcccgtgataggccgatccc

SEQ ID NO: 272272 - DNA, 25 bp, Mus musculus
acgctgaaaagcatgaagggtcgga

SEQ ID NO: 272273 - DNA, 25 bp, Mus musculus
ccgctgtcggacctcccgggaaatg

SEQ ID NO: 272274 - DNA, 25 bp, Mus musculus
agcgagcgttactaatccgaagtta

SEQ ID NO: 272275 - DNA, 25 bp, Mus musculus
ggcttgcggcgccattttaatcgcc

SEQ ID NO: 272276 - DNA, 25 bp, Mus musculus
gctctagactggttcgggagttctc

SEQ ID NO: 272277 - DNA, 25 bp, Mus musculus
aatgggaacagagcacgaagcagcc

SEQ ID NO: 272278 - DNA, 25 bp, Mus musculus
cccaggacccagtgcgacgctgaaa

SEQ ID NO: 272279 - DNA, 25 bp, Mus musculus
agggtcggaattaggcgctcattta

SEQ ID NO: 272280 - DNA, 25 bp, Mus musculus
ttacagcgctaattccctgatcccg

SEQ ID NO: 272281 - DNA, 25 bp, Mus musculus
cggcacagtcttgcccggattgatg

SEQ ID NO: 272282 - DNA, 25 bp, Mus musculus
ttgcccggattgatgcgccctcaag

SEQ ID NO: 272283 - DNA, 25 bp, Mus musculus
gttttctcccatccgggtgtctaca

SEQ ID NO: 272284 - DNA, 25 bp, Mus musculus
tacacccagaacagcggccctttgg

SEQ ID NO: 272285 - DNA, 25 bp, Mus musculus
agtcctcacggaaacgcacggtgca

SEQ ID NO: 272286 - DNA, 25 bp, Mus musculus
ctcgctctcggagcccgtgcggtag

SEQ ID NO: 272287 - DNA, 25 bp, Mus musculus
gtgcgccgagctcctcctcgcgcca

SEQ ID NO: 272288 - DNA, 25 bp, Mus musculus
caccgtgcctttccgggctgttgac

SEQ ID NO: 272289 - DNA, 25 bp, Mus musculus
tgaggccaccgtgcctttccgggct

SEQ ID NO: 272290 - DNA, 25 bp, Mus musculus
ctggcgccaagtattccagggtccc

SEQ ID NO: 272291 - DNA, 25 bp, Mus musculus
tctgcagtgggctggcgccaagtat

SEQ ID NO: 272292 - DNA, 25 bp, Mus musculus
cctcgcgccagcagggccgagccaa

SEQ ID NO: 272293 - DNA, 25 bp, Mus musculus
gagcacacacactggacgcccggga

SEQ ID NO: 272294 - DNA, 25 bp, Mus musculus
aggccctcggagcacggcctgagca

SEQ ID NO: 272295 - DNA, 25 bp, Mus musculus
ccgactgggcaaggccctcggagca

SEQ ID NO: 272296 - DNA, 25 bp, Mus musculus
gcgaagccgactgggcaaggccctc

SEQ ID NO: 272297 - DNA, 25 bp, Mus musculus
ctccgcacgcacctcgagtcccagg

SEQ ID NO: 272298 - DNA, 25 bp, Mus musculus
cggtaggagcttaggcagagattcc

SEQ ID NO: 272299 - DNA, 25 bp, Mus musculus
aggagcttaggcagagattcccttg

SEQ ID NO: 272300 - DNA, 25 bp, Mus musculus
tgtgtgagaaaagccagctccggtg

SEQ ID NO: 272301 - DNA, 25 bp, Mus musculus
cgcacctgccattaacgttcaatta

SEQ ID NO: 272302 - DNA, 25 bp, Mus musculus
agccctggagcactaggcagtttgg

SEQ ID NO: 272303 - DNA, 25 bp, Mus musculus
gacgagtcctgtcccggctcagaca

SEQ ID NO: 272304 - DNA, 25 bp, Mus musculus
ccttccggacaaagtgtcaagtaca

SEQ ID NO: 272305 - DNA, 25 bp, Mus musculus
agctgcctttgttctccgggataag

SEQ ID NO: 272306 - DNA, 25 bp, Mus musculus
ttctccgggataagcgctctcacgt

SEQ ID NO: 272307 - DNA, 25 bp, Mus musculus
tcctcagggccaccgaaaggtcttg

SEQ ID NO: 272308 - DNA, 25 bp, Mus musculus
atgcccgcgcagaggtaaggaccct

SEQ ID NO: 272309 - DNA, 25 bp, Mus musculus
cgacctggactagcagcgcgaacca

SEQ ID NO: 272310 - DNA, 25 bp, Mus musculus
agcgcgaaccactgcatgctgcaaa

SEQ ID NO: 272311 - DNA, 25 bp, Mus musculus
tgctgcaaaacctctcccgatgagc

SEQ ID NO: 272312 - DNA, 25 bp, Mus musculus
cgggcggcacaaagagctttttatt

SEQ ID NO: 272313 - DNA, 25 bp, Mus musculus
ctgccgacgcgacgtgcagagaatc

SEQ ID NO: 272314 - DNA, 25 bp, Mus musculus
cgaggttgttcgcaccgccagaggt

SEQ ID NO: 272315 - DNA, 25 bp, Mus musculus
gtcccacgaccttggcgccagtaaa

SEQ ID NO: 272316 - DNA, 25 bp, Mus musculus
gatcgagtttgtcccacgaccttgg

SEQ ID NO: 272317 - DNA, 25 bp, Mus musculus
cgagggcaagatcgagtttgtccca

SEQ ID NO: 272318 - DNA, 25 bp, Mus musculus
ttcttagggattctgtagccgcggc

SEQ ID NO: 272319 - DNA, 25 bp, Mus musculus
taaagccagtggttcttagggattc

SEQ ID NO: 272320 - DNA, 25 bp, Mus musculus
cgaggcgaggacgtcactaaagcca

SEQ ID NO: 272321 - DNA, 25 bp, Mus musculus
tctcactaccgaggcgaggacgtca

SEQ ID NO: 272322 - DNA, 25 bp, Mus musculus
cgtcaagctctcactaccgaggcga

SEQ ID NO: 272323 - DNA, 25 bp, Mus musculus
taaagcacggagaagcctgcgctcg

SEQ ID NO: 272324 - DNA, 25 bp, Mus musculus
gtgtctaaagcacggagaagcctgc

SEQ ID NO: 272325 - DNA, 25 bp, Mus musculus
tggagttgaaacaaaacctgaaagc

SEQ ID NO: 272326 - DNA, 25 bp, Mus musculus
gtaaactggagaatgagacagaccc

SEQ ID NO: 272327 - DNA, 25 bp, Mus musculus
acctgaaagcccgaggttgttcgca

SEQ ID NO: 272328 - DNA, 25 bp, Mus musculus
agacgcttaaaggaccgggacactg

SEQ ID NO: 272329 - DNA, 25 bp, Mus musculus
gcatcggcttggatgtcgtagcgca

SEQ ID NO: 272330 - DNA, 25 bp, Mus musculus
tcgggctctacccaaccggcgagag

SEQ ID NO: 272331 - DNA, 25 bp, Mus musculus
gtagcgatagtaaaactcgttctca

SEQ ID NO: 272332 - DNA, 25 bp, Mus musculus
ctcgttctcaacgtcgctggagatg

SEQ ID NO: 272333 - DNA, 25 bp, Mus musculus
gctggagatgttcttgcgcttcttc

SEQ ID NO: 272334 - DNA, 25 bp, Mus musculus
ttctccaaccaccagtgagcatcgg

SEQ ID NO: 272335 - DNA, 25 bp, Mus musculus
tcgtagcgcacgaacacgccaaaga

SEQ ID NO: 272336 - DNA, 25 bp, Mus musculus
cacgccaaagagaaccaccatggtc

SEQ ID NO: 272337 - DNA, 25 bp, Mus musculus
caccatggtcacttgcaggatcagg

SEQ ID NO: 272338 - DNA, 25 bp, Mus musculus
cccgaaggttggtgttccaggccat

SEQ ID NO: 272339 - DNA, 25 bp, Mus musculus
tgctctgaacgctgggctccgagac

SEQ ID NO: 272340 - DNA, 25 bp, Mus musculus
acgcggaacagctgaccatggtgcc

SEQ ID NO: 272341 - DNA, 25 bp, Mus musculus
cactgctggccgcttgctctgaacg

SEQ ID NO: 272342 - DNA, 25 bp, Mus musculus
ccaatagctgcagctgtcggagagc

SEQ ID NO: 272343 - DNA, 25 bp, Mus musculus
cacacgcacggtgccctgatggaga

SEQ ID NO: 272344 - DNA, 25 bp, Mus musculus
ctcactcgcagagggagctgcttca

SEQ ID NO: 272345 - DNA, 25 bp, Mus musculus
ctgcagccaataggagccgagtttg

SEQ ID NO: 272346 - DNA, 25 bp, Mus musculus
agacgctgctcgactaccagtggga

SEQ ID NO: 272347 - DNA, 25 bp, Mus musculus
ggtccactggaccttcaagttcttc

SEQ ID NO: 272348 - DNA, 25 bp, Mus musculus
tcacttacctgagctgccgcttcgg

SEQ ID NO: 272349 - DNA, 25 bp, Mus musculus
ccgagatggcctgctgtcacaaagt

SEQ ID NO: 272350 - DNA, 25 bp, Mus musculus
caatggcgctggttctctgaagaga

SEQ ID NO: 272351 - DNA, 25 bp, Mus musculus
agccgagtttgggtaccagctcctc

SEQ ID NO: 272352 - DNA, 25 bp, Mus musculus
acgtaacttacgttcagcctgcagc

SEQ ID NO: 272353 - DNA, 25 bp, Mus musculus
atcaagcggaggtcttccacacgcc

SEQ ID NO: 272354 - DNA, 25 bp, Mus musculus
ggctcaggccaatgagaactacatt

SEQ ID NO: 272355 - DNA, 25 bp, Mus musculus
caccaagccgatcctgcggagtagc

SEQ ID NO: 272356 - DNA, 25 bp, Mus musculus
ctctggtaatgaacgcagggagacg

SEQ ID NO: 272357 - DNA, 25 bp, Mus musculus
gagcgccgccgactcacggtggttc

SEQ ID NO: 272358 - DNA, 25 bp, Mus musculus
gcccgtcctgtgctctggtaatgaa

SEQ ID NO: 272359 - DNA, 25 bp, Mus musculus
gggctgcacgagagaagctgtctcc

SEQ ID NO: 272360 - DNA, 25 bp, Mus musculus
gggccgagtccgttatggccgcctc

SEQ ID NO: 272361 - DNA, 25 bp, Mus musculus
aacctagcaacagcgcaggctcggg

SEQ ID NO: 272362 - DNA, 25 bp, Mus musculus
gacgtcacctcgcagaacctagcaa

SEQ ID NO: 272363 - DNA, 25 bp, Mus musculus
cgcttcggacgcgtatctgacgtca

SEQ ID NO: 272364 - DNA, 25 bp, Mus musculus
acgtagctgcttcgggagtgcgctt

SEQ ID NO: 272365 - DNA, 25 bp, Mus musculus
tcatcacgccgggacgtagctgctt

SEQ ID NO: 272366 - DNA, 25 bp, Mus musculus
ggttcagagatgcaacgtcatcacg

SEQ ID NO: 272367 - DNA, 25 bp, Mus musculus
ctaacctttcgggttcagagatgca

SEQ ID NO: 272368 - DNA, 25 bp, Mus musculus
gcccgagttgggaagcgctcccagt

SEQ ID NO: 272369 - DNA, 25 bp, Mus musculus
cgcgatctctggtgctggcgttgct

SEQ ID NO: 272370 - DNA, 25 bp, Mus musculus
gaaccgggctagactggatctttgc

SEQ ID NO: 272371 - DNA, 25 bp, Mus musculus
tacttcctgggacgcgcacccagta

SEQ ID NO: 272372 - DNA, 25 bp, Mus musculus
agactggatctttgctctctgagga

SEQ ID NO: 272373 - DNA, 25 bp, Mus musculus
tgaggattcagcaaacgcagggcct

SEQ ID NO: 272374 - DNA, 25 bp, Mus musculus
caatcttacacttacgcggagcgca

SEQ ID NO: 272375 - DNA, 25 bp, Mus musculus
agcagtgcttgcgaccatttttgag

SEQ ID NO: 272376 - DNA, 25 bp, Mus musculus
actattcggcggtctagcgggtact

SEQ ID NO: 272377 - DNA, 25 bp, Mus musculus
tttccgtttgtggaggtgactattc

SEQ ID NO: 272378 - DNA, 25 bp, Mus musculus
cattgtagtttgaggttcggtcttt

SEQ ID NO: 272379 - DNA, 25 bp, Mus musculus
cctggttcctcctcattgtagtttg

SEQ ID NO: 272380 - DNA, 25 bp, Mus musculus
acttcggtttttcctgcctcagctg

SEQ ID NO: 272381 - DNA, 25 bp, Mus musculus
cccagtagagtaggaagcagtgctt

SEQ ID NO: 272382 - DNA, 25 bp, Mus musculus
tggctctcggtggttccattcaatc

SEQ ID NO: 272383 - DNA, 25 bp, Mus musculus
cgaccatttttgagcgaggcgggta

SEQ ID NO: 272384 - DNA, 25 bp, Mus musculus
cgcgattgcggatgttctgagcacg

SEQ ID NO: 272385 - DNA, 25 bp, Mus musculus
ctgtgccgcctggtcctcggctgga

SEQ ID NO: 272386 - DNA, 25 bp, Mus musculus
ctgaagctctcgcaggaggctgtag

SEQ ID NO: 272387 - DNA, 25 bp, Mus musculus
ctcggcctctggacgccagttgact

SEQ ID NO: 272388 - DNA, 25 bp, Mus musculus
gcctgttcctcagggacgcgctcgg

SEQ ID NO: 272389 - DNA, 25 bp, Mus musculus
atgatgcgcgtttccgagcggtgtc

SEQ ID NO: 272390 - DNA, 25 bp, Mus musculus
gccgcgatggatgatgcgcgtttcc

SEQ ID NO: 272391 - DNA, 25 bp, Mus musculus
cggcctgaagctctcgcaggaggct

SEQ ID NO: 272392 - DNA, 25 bp, Mus musculus
agtcccgcactttgcgggcggcagc

SEQ ID NO: 272393 - DNA, 25 bp, Mus musculus
gctggagcgctttcgatgccgctgt

SEQ ID NO: 272394 - DNA, 25 bp, Mus musculus
ttctgagcacggctggcgtagttta

SEQ ID NO: 272395 - DNA, 25 bp, Mus musculus
agtttagggtgttgagggtctcatc

SEQ ID NO: 272396 - DNA, 25 bp, Mus musculus
agagctcaaggtgctgcgctcgccc

SEQ ID NO: 272397 - DNA, 25 bp, Mus musculus
cgccagttgactgtggcgcgattgc

SEQ ID NO: 272398 - DNA, 25 bp, Mus musculus
tacaaacgtggaccctcgcaggctg

SEQ ID NO: 272399 - DNA, 25 bp, Mus musculus
gcctccaagtcggtccgcagacggg

SEQ ID NO: 272400 - DNA, 25 bp, Mus musculus
gcgcgctccgatgccgtcatcggga

SEQ ID NO: 272401 - DNA, 25 bp, Mus musculus
ggacgcgcagccaagctcggcgccc

SEQ ID NO: 272402 - DNA, 25 bp, Mus musculus
cacctgccagagtgcgagcgcagtc

SEQ ID NO: 272403 - DNA, 25 bp, Mus musculus
gggtgagccctgtctagccctccat

SEQ ID NO: 272404 - DNA, 25 bp, Mus musculus
ctcgcagtaagctgaggggcacaga

SEQ ID NO: 272405 - DNA, 25 bp, Mus musculus
cgcccagtgagggagctcgcagtaa

SEQ ID NO: 272406 - DNA, 25 bp, Mus musculus
aaacgtggaccctcgcaggctgctc

SEQ ID NO: 272407 - DNA, 25 bp, Mus musculus
gtgattacaaacgtggaccctcgca

SEQ ID NO: 272408 - DNA, 25 bp, Mus musculus
gcaaaagtgattacaaacgtggacc

SEQ ID NO: 272409 - DNA, 25 bp, Mus musculus
atcggcctctgggaacaggccctcc

SEQ ID NO: 272410 - DNA, 25 bp, Mus musculus
ctgacaactccacccgcgcgatcgg

SEQ ID NO: 272411 - DNA, 25 bp, Mus musculus
gagcctcaaaggcgccctgacaact

SEQ ID NO: 272412 - DNA, 25 bp, Mus musculus
gcaggcttctctctgggcatagcca

SEQ ID NO: 272413 - DNA, 25 bp, Mus musculus
ctcttcttgcgcagctggctgtact

SEQ ID NO: 272414 - DNA, 25 bp, Mus musculus
gctcaggccaccctaaaggaaaggc

SEQ ID NO: 272415 - DNA, 25 bp, Mus musculus
aggaaaggcccttgacgagaagcga

SEQ ID NO: 272416 - DNA, 25 bp, Mus musculus
ttgacgagaagcgaccttcccgtgg

SEQ ID NO: 272417 - DNA, 25 bp, Mus musculus
gcgcagtctgctcagctcttcttgc

SEQ ID NO: 272418 - DNA, 25 bp, Mus musculus
agctggctgtactgcgcgcggccca

SEQ ID NO: 272419 - DNA, 25 bp, Mus musculus
cgcggcccaggatgggctccatgac

SEQ ID NO: 272420 - DNA, 25 bp, Mus musculus
gctccatgacgctgggccggaagaa

SEQ ID NO: 272421 - DNA, 25 bp, Mus musculus
aagctgtcgctgactctgcgcgcag

SEQ ID NO: 272422 - DNA, 25 bp, Mus musculus
gggtcgtggctcaggccaccctaaa

SEQ ID NO: 272423 - DNA, 25 bp, Mus musculus
catagccaggaagccgggacgcgct

SEQ ID NO: 272424 - DNA, 25 bp, Mus musculus
gctgacgcctcggttttgtcgtcca

SEQ ID NO: 272425 - DNA, 25 bp, Mus musculus
gccggaagaagctgtcgctgactct

SEQ ID NO: 272426 - DNA, 25 bp, Mus musculus
cctggctttggttggcgactcggat

SEQ ID NO: 272427 - DNA, 25 bp, Mus musculus
cctcccgagacaccgaggtggctga

SEQ ID NO: 272428 - DNA, 25 bp, Mus musculus
cacaccttcggaaacgcggcttttg

SEQ ID NO: 272429 - DNA, 25 bp, Mus musculus
gggtgggacttcgtctctccgccca

SEQ ID NO: 272430 - DNA, 25 bp, Mus musculus
gacagcgggaacagattagttgcca

SEQ ID NO: 272431 - DNA, 25 bp, Mus musculus
cgactcggatgaaggcgtccatggc

SEQ ID NO: 272432 - DNA, 25 bp, Mus musculus
gcggaggccgacagcacctgactca

SEQ ID NO: 272433 - DNA, 25 bp, Mus musculus
gggctgtgacctctttctccgagaa

SEQ ID NO: 272434 - DNA, 25 bp, Mus musculus
cgtgcctcgatttaccgggctgtga

SEQ ID NO: 272435 - DNA, 25 bp, Mus musculus
caactcctcagtgggagctggccgc

SEQ ID NO: 272436 - DNA, 25 bp, Mus musculus
gaggggctcggctcgcaactcctca

SEQ ID NO: 272437 - DNA, 25 bp, Mus musculus
aggtggctgacacgcacagtccctc

SEQ ID NO: 272438 - DNA, 25 bp, Mus musculus
tgactcacctgaaaagtcggtcccg

SEQ ID NO: 272439 - DNA, 25 bp, Mus musculus
cagtccctccgggttcacagggagg

SEQ ID NO: 272440 - DNA, 25 bp, Mus musculus
tcatccgctccacgctcaaggttaa

SEQ ID NO: 272441 - DNA, 25 bp, Mus musculus
actcaggatccaggactcggagcgc

SEQ ID NO: 272442 - DNA, 25 bp, Mus musculus
aggttgtcctcgctgagtcccagca

SEQ ID NO: 272443 - DNA, 25 bp, Mus musculus
ttcccatcggaaggcatcggtggct

SEQ ID NO: 272444 - DNA, 25 bp, Mus musculus
ggagcagacgctgttcccatcggaa

SEQ ID NO: 272445 - DNA, 25 bp, Mus musculus
agtgtgcgcatacgtagcttctccc

SEQ ID NO: 272446 - DNA, 25 bp, Mus musculus
gcacagccgacaggtggccaatgta

SEQ ID NO: 272447 - DNA, 25 bp, Mus musculus
gcttaaacggggaccgagcgactgc

SEQ ID NO: 272448 - DNA, 25 bp, Mus musculus
atgggtcccacgattctgcggcgac

SEQ ID NO: 272449 - DNA, 25 bp, Mus musculus
tctgcgtacaggaacgatgggtccc

SEQ ID NO: 272450 - DNA, 25 bp, Mus musculus
tcctgggatgctgtttctgcgtaca

SEQ ID NO: 272451 - DNA, 25 bp, Mus musculus
gggctccatttcctgcctttcctgg

SEQ ID NO: 272452 - DNA, 25 bp, Mus musculus
gcgagcaagcaaagcgtccttaatc

SEQ ID NO: 272453 - DNA, 25 bp, Mus musculus
cccaagggagatcctgagtgcagca

SEQ ID NO: 272454 - DNA, 25 bp, Mus musculus
agtgcggacgcggcgttctctcacc

SEQ ID NO: 272455 - DNA, 25 bp, Mus musculus
cgttctctcaccgatgccctcaatg

SEQ ID NO: 272456 - DNA, 25 bp, Mus musculus
ccttgctacgccacccgtcggccct

SEQ ID NO: 272457 - DNA, 25 bp, Mus musculus
attcgtccggttcctgcccttgcta

SEQ ID NO: 272458 - DNA, 25 bp, Mus musculus
gtcctcagattcgtccggttcctgc

SEQ ID NO: 272459 - DNA, 25 bp, Mus musculus
ggcctcgtcctcagattcgtccggt

SEQ ID NO: 272460 - DNA, 25 bp, Mus musculus
cggactccacgtctccggcctcgtc

SEQ ID NO: 272461 - DNA, 25 bp, Mus musculus
tagcacgcgcactacccaggcgacg

SEQ ID NO: 272462 - DNA, 25 bp, Mus musculus
gctgcaagaactgcgccgcttcctg

SEQ ID NO: 272463 - DNA, 25 bp, Mus musculus
cttcctgccgccgtcggtggcacct

SEQ ID NO: 272464 - DNA, 25 bp, Mus musculus
tacatcggccacctgtcagccctgc

SEQ ID NO: 272465 - DNA, 25 bp, Mus musculus
cctgctgggcctcagcgaggacagt

SEQ ID NO: 272466 - DNA, 25 bp, Mus musculus
gcccggcccgtagcacgcgcactac

SEQ ID NO: 272467 - DNA, 25 bp, Mus musculus
ctgggcctcagcgaggacagtctgc

SEQ ID NO: 272468 - DNA, 25 bp, Mus musculus
aagaacgcaccttcttccggcacaa

SEQ ID NO: 272469 - DNA, 25 bp, Mus musculus
gctgtagaagcccaggagcacggtc

SEQ ID NO: 272470 - DNA, 25 bp, Mus musculus
caccctgagaggtcggcgcgctttc

SEQ ID NO: 272471 - DNA, 25 bp, Mus musculus
agcactaaagtgtcctgccgctctg

SEQ ID NO: 272472 - DNA, 25 bp, Mus musculus
tgggcaccgagcactaaagtgtcct

SEQ ID NO: 272473 - DNA, 25 bp, Mus musculus
tgctcccggaaacttagtctcggta

SEQ ID NO: 272474 - DNA, 25 bp, Mus musculus
cgctgaaagctgctcccggaaactt

SEQ ID NO: 272475 - DNA, 25 bp, Mus musculus
cggcacaacacgaacacttcctgtt

SEQ ID NO: 272476 - DNA, 25 bp, Mus musculus
gcctgaatcatctttgccggtcccg

SEQ ID NO: 272477 - DNA, 25 bp, Mus musculus
gttgttgaaaaccagaatcgcctga

SEQ ID NO: 272478 - DNA, 25 bp, Mus musculus
gccgcggttttccatggttgttgaa

SEQ ID NO: 272479 - DNA, 25 bp, Mus musculus
gctgcactcacaaaacgctggtaga

SEQ ID NO: 272480 - DNA, 25 bp, Mus musculus
acttcctgttggtgtcccgctgaaa

SEQ ID NO: 272481 - DNA, 25 bp, Mus musculus
tagaagcggaccagccgcggttttc

SEQ ID NO: 272482 - DNA, 25 bp, Mus musculus
tcagcgaacgaccacgcctcggcgc

SEQ ID NO: 272483 - DNA, 25 bp, Mus musculus
gaggaggccaggctatgccgaaccc

SEQ ID NO: 272484 - DNA, 25 bp, Mus musculus
tctttactgttgagggctctgcggc

SEQ ID NO: 272485 - DNA, 25 bp, Mus musculus
aaaggctctttactgttgagggctc

SEQ ID NO: 272486 - DNA, 25 bp, Mus musculus
cgaacagctgtttaaaggctcttta

SEQ ID NO: 272487 - DNA, 25 bp, Mus musculus
cagggctctgcgaacagctgtttaa

SEQ ID NO: 272488 - DNA, 25 bp, Mus musculus
caagggcccagacctcagcgaacga

SEQ ID NO: 272489 - DNA, 25 bp, Mus musculus
ctcggcgccctccagcagtgcaccc

SEQ ID NO: 272490 - DNA, 25 bp, Mus musculus
attcgcacccgggtcccggtgatag

SEQ ID NO: 272491 - DNA, 25 bp, Mus musculus
acccgggtcccggtgatagcagccg

SEQ ID NO: 272492 - DNA, 25 bp, Mus musculus
agccggggccgttccctcgagtctg

SEQ ID NO: 272493 - DNA, 25 bp, Mus musculus
gttccctcgagtctgaccgtccagg

SEQ ID NO: 272494 - DNA, 25 bp, Mus musculus
tctgaccgtccagggctctgcgaac

SEQ ID NO: 272495 - DNA, 25 bp, Mus musculus
gtacccgcccatgcgtcggagtcga

SEQ ID NO: 272496 - DNA, 25 bp, Mus musculus
ctgcggacttgctaactcgtgcgta

SEQ ID NO: 272497 - DNA, 25 bp, Mus musculus
gtctccgacctgttgaaggcgcacc

SEQ ID NO: 272498 - DNA, 25 bp, Mus musculus
acggcagatctcgagcctcccgtgg

SEQ ID NO: 272499 - DNA, 25 bp, Mus musculus
cggacttgctaactcgtgcgtagcg

SEQ ID NO: 272500 - DNA, 25 bp, Mus musculus
ctcctcgcggtcattttcctaattg

SEQ ID NO: 272501 - DNA, 25 bp, Mus musculus
gcggtcattttcctaattggacgga

SEQ ID NO: 272502 - DNA, 25 bp, Mus musculus
tttcctaattggacggagctgtggg

SEQ ID NO: 272503 - DNA, 25 bp, Mus musculus
atcgtcggcgtcagacggaggagcc

SEQ ID NO: 272504 - DNA, 25 bp, Mus musculus
atcgggtggtcttccctccacgact

SEQ ID NO: 272505 - DNA, 25 bp, Mus musculus
cccagctgcggacttgctaactcgt

SEQ ID NO: 272506 - DNA, 25 bp, Mus musculus
ccgtctccgacctgttgaaggcgca

SEQ ID NO: 272507 - DNA, 25 bp, Mus musculus
ccggtgggcagatccccacggcaga

SEQ ID NO: 272508 - DNA, 25 bp, Mus musculus
gaatcgggtggtcttccctccacga

SEQ ID NO: 272509 - DNA, 25 bp, Mus musculus
agatctcgagcctcccgtggctcgg

SEQ ID NO: 272510 - DNA, 25 bp, Mus musculus
tcccggcggcagaaatagggcagcc

SEQ ID NO: 272511 - DNA, 25 bp, Mus musculus
cgccacgcagaactgctctggctga

SEQ ID NO: 272512 - DNA, 25 bp, Mus musculus
agagctggagcttggactatctcta

SEQ ID NO: 272513 - DNA, 25 bp, Mus musculus
ggactatctctagcacgccagggga

SEQ ID NO: 272514 - DNA, 25 bp, Mus musculus
tctagcacgccaggggaccagccga

SEQ ID NO: 272515 - DNA, 25 bp, Mus musculus
ggaccagccgacagccggagacgac

SEQ ID NO: 272516 - DNA, 25 bp, Mus musculus
atgcgggtgtccgagtcgtgccacc

SEQ ID NO: 272517 - DNA, 25 bp, Mus musculus
catggggtttgacacccggggatca

SEQ ID NO: 272518 - DNA, 25 bp, Mus musculus
gttctcactgcccacgcctggagag

SEQ ID NO: 272519 - DNA, 25 bp, Mus musculus
cccacgcctggagagccaagtttgc

SEQ ID NO: 272520 - DNA, 25 bp, Mus musculus
agagccaagtttgcgcgcctggcta

SEQ ID NO: 272521 - DNA, 25 bp, Mus musculus
agggccaccctggatgcgctaggac

SEQ ID NO: 272522 - DNA, 25 bp, Mus musculus
cgggcgttcgcaggttctcactgcc

SEQ ID NO: 272523 - DNA, 25 bp, Mus musculus
aacggagtgatccttataggcgcgc

SEQ ID NO: 272524 - DNA, 25 bp, Mus musculus
tcgaggctgacacggcgggttccac

SEQ ID NO: 272525 - DNA, 25 bp, Mus musculus
ctcctacctagtggaggcgggtgac

SEQ ID NO: 272526 - DNA, 25 bp, Mus musculus
gtgaccgccagaaacgctggcagtg

SEQ ID NO: 272527 - DNA, 25 bp, Mus musculus
agaaacgctggcagtgtcgcatgtg

SEQ ID NO: 272528 - DNA, 25 bp, Mus musculus
gtcgcatgtgcgagaagtcctacac

SEQ ID NO: 272529 - DNA, 25 bp, Mus musculus
ggttccacagtggagcgccacaaga

SEQ ID NO: 272530 - DNA, 25 bp, Mus musculus
gcgagaagtcctacacatctaagta

SEQ ID NO: 272531 - DNA, 25 bp, Mus musculus
cacatctaagtataacctcgtgacg

SEQ ID NO: 272532 - DNA, 25 bp, Mus musculus
ccggctggacatcaatgtgcagatc

SEQ ID NO: 272533 - DNA, 25 bp, Mus musculus
cagctggaccggctggacatcaatg

SEQ ID NO: 272534 - DNA, 25 bp, Mus musculus
gcgccacaagaaggcacagctggac

SEQ ID NO: 272535 - DNA, 25 bp, Mus musculus
cgacgacagaactcgtcaaaccaga

SEQ ID NO: 272536 - DNA, 25 bp, Mus musculus
tgtgcagatcgatgactcctaccta

SEQ ID NO: 272537 - DNA, 25 bp, Mus musculus
actcgtcaaaccagagcagggcttc

SEQ ID NO: 272538 - DNA, 25 bp, Mus musculus
agattagagcgctgccggaagcttt

SEQ ID NO: 272539 - DNA, 25 bp, Mus musculus
agcagattgcttcgctggctgaaca

SEQ ID NO: 272540 - DNA, 25 bp, Mus musculus
ggatcttctggtgccgcagcagatt

SEQ ID NO: 272541 - DNA, 25 bp, Mus musculus
aaaggccgttcctcagtatgcgtga

SEQ ID NO: 272542 - DNA, 25 bp, Mus musculus
agtcgcggcacacgaaaggccgttc

SEQ ID NO: 272543 - DNA, 25 bp, Mus musculus
tgccgaaagctctggccacactctg

SEQ ID NO: 272544 - DNA, 25 bp, Mus musculus
gcactccacgcatccgaaggacttg

SEQ ID NO: 272545 - DNA, 25 bp, Mus musculus
ccttgccacattcgggacacgcgta

SEQ ID NO: 272546 - DNA, 25 bp, Mus musculus
ggaaggtcttgccacattcggcgca

SEQ ID NO: 272547 - DNA, 25 bp, Mus musculus
ttctcacccgtatgcacacgcaggt

SEQ ID NO: 272548 - DNA, 25 bp, Mus musculus
actcaccgcagcagtagggcttctc

SEQ ID NO: 272549 - DNA, 25 bp, Mus musculus
agccgagacacctgcgtgaagccga

SEQ ID NO: 272550 - DNA, 25 bp, Mus musculus
tgcaccgcctggtgctctagcagca

SEQ ID NO: 272551 - DNA, 25 bp, Mus musculus
ctgccggaaactctggccacattcg

SEQ ID NO: 272552 - DNA, 25 bp, Mus musculus
aggagcctgctcgacacccttgggc

SEQ ID NO: 272553 - DNA, 25 bp, Mus musculus
tttagctgaccgacggacctgaggc

SEQ ID NO: 272554 - DNA, 25 bp, Mus musculus
ccctgcgtcctttgcgtttagctga

SEQ ID NO: 272555 - DNA, 25 bp, Mus musculus
cagctgcagacacgtcgccttagtc

SEQ ID NO: 272556 - DNA, 25 bp, Mus musculus
cttccgttagaatgtcagctgcaga

SEQ ID NO: 272557 - DNA, 25 bp, Mus musculus
tcctcaaagcatcaggtaccgggga

SEQ ID NO: 272558 - DNA, 25 bp, Mus musculus
gggagcctccatatatcctcaaagc

SEQ ID NO: 272559 - DNA, 25 bp, Mus musculus
cttgggcctgttccagagctcaggc

SEQ ID NO: 272560 - DNA, 25 bp, Mus musculus
cccattgggtctcacccgggagaag

SEQ ID NO: 272561 - DNA, 25 bp, Mus musculus
agagcgagctcacagcccgcaggta

SEQ ID NO: 272562 - DNA, 25 bp, Mus musculus
ctgagcccgaggctctgcagagcga

SEQ ID NO: 272563 - DNA, 25 bp, Mus musculus
tgcgacactcacagtggcgccgcgg

SEQ ID NO: 272564 - DNA, 25 bp, Mus musculus
gagctcggtgtaaggccacctcccg

SEQ ID NO: 272565 - DNA, 25 bp, Mus musculus
cgcgctttctgggagcctccatata

SEQ ID NO: 272566 - DNA, 25 bp, Mus musculus
tcagagctgttggaatccggctagg

SEQ ID NO: 272567 - DNA, 25 bp, Mus musculus
aggctgcccagcatttccggggaca

SEQ ID NO: 272568 - DNA, 25 bp, Mus musculus
cgaggaaggcgcctttggacaattc

SEQ ID NO: 272569 - DNA, 25 bp, Mus musculus
ggtagcatcgtattcagagctgttg

SEQ ID NO: 272570 - DNA, 25 bp, Mus musculus
cgacgtgggtagcatcgtattcaga

SEQ ID NO: 272571 - DNA, 25 bp, Mus musculus
agcatttccggggacaccgcgctgg

SEQ ID NO: 272572 - DNA, 25 bp, Mus musculus
gaaggcgcctttggacaattcccga

SEQ ID NO: 272573 - DNA, 25 bp, Mus musculus
gaggtagtcctatcgtgggacgtaa

SEQ ID NO: 272574 - DNA, 25 bp, Mus musculus
tcggagtcctgtcggacttcccgga

SEQ ID NO: 272575 - DNA, 25 bp, Mus musculus
gccagtcggagtcctgtcggacttc

SEQ ID NO: 272576 - DNA, 25 bp, Mus musculus
gtgttcacgggatactccaggtccc

SEQ ID NO: 272577 - DNA, 25 bp, Mus musculus
caattcccgaaaacgcgagcaggcg

SEQ ID NO: 272578 - DNA, 25 bp, Mus musculus
acaccgcgctgggtgttcacgggat

SEQ ID NO: 272579 - DNA, 25 bp, Mus musculus
atcgtgggacgtaactccttccagg

SEQ ID NO: 272580 - DNA, 25 bp, Mus musculus
gtccgtgcggctttgcgagctcctc

SEQ ID NO: 272581 - DNA, 25 bp, Mus musculus
cctcgtacttcagcgcccaggaagg

SEQ ID NO: 272582 - DNA, 25 bp, Mus musculus
aaggaccagctaggaggcccgccta

SEQ ID NO: 272583 - DNA, 25 bp, Mus musculus
gcggggctttcacccgcagcactgg

SEQ ID NO: 272584 - DNA, 25 bp, Mus musculus
gcggcccacgtgaccaccttccctg

SEQ ID NO: 272585 - DNA, 25 bp, Mus musculus
ctgcgattccacttgagcaacctga

SEQ ID NO: 272586 - DNA, 25 bp, Mus musculus
cacttgagcaacctgagccggagga

SEQ ID NO: 272587 - DNA, 25 bp, Mus musculus
cccaagtcgggtgactcgatccagc

SEQ ID NO: 272588 - DNA, 25 bp, Mus musculus
cccggatcagtgtgccgctgggtaa

SEQ ID NO: 272589 - DNA, 25 bp, Mus musculus
cagtgtgccgctgggtaagtgctat

SEQ ID NO: 272590 - DNA, 25 bp, Mus musculus
ggggctccagcctgcgattccactt

SEQ ID NO: 272591 - DNA, 25 bp, Mus musculus
ctttgcgagctcctcggtctccggg

SEQ ID NO: 272592 - DNA, 25 bp, Mus musculus
tacttcagcgcccaggaaggaggaa

SEQ ID NO: 272593 - DNA, 25 bp, Mus musculus
agtcgggtgactcgatccagcgccc

SEQ ID NO: 272594 - DNA, 25 bp, Mus musculus
gtgcgcgcacagctaggccaactct

SEQ ID NO: 272595 - DNA, 25 bp, Mus musculus
ggccagcagctccttagacaggcga

SEQ ID NO: 272596 - DNA, 25 bp, Mus musculus
tcgcacgcgagctccgcgagaactg

SEQ ID NO: 272597 - DNA, 25 bp, Mus musculus
ccgcgcacctggtactcggccagca

SEQ ID NO: 272598 - DNA, 25 bp, Mus musculus
gcggaacgagccatgcgcacgtgat

SEQ ID NO: 272599 - DNA, 25 bp, Mus musculus
tcacgcgtttgctgagttccgggac

SEQ ID NO: 272600 - DNA, 25 bp, Mus musculus
gtcgcggtcttcacgcgtttgctga

SEQ ID NO: 272601 - DNA, 25 bp, Mus musculus
ttctcacttccgtcctcggggccgc

SEQ ID NO: 272602 - DNA, 25 bp, Mus musculus
cccgccacccttagcgccgctcagc

SEQ ID NO: 272603 - DNA, 25 bp, Mus musculus
cagactgcgcctgcgtcgcggtctt

SEQ ID NO: 272604 - DNA, 25 bp, Mus musculus
acgtgatgcagactgcgcctgcgtc

SEQ ID NO: 272605 - DNA, 25 bp, Mus musculus
cccgaacctcccatcgccgcggtgc

SEQ ID NO: 272606 - DNA, 25 bp, Mus musculus
ttagacaggcgactgcccgaacctc

SEQ ID NO: 272607 - DNA, 25 bp, Mus musculus
agccatgcgcacgtgatgcagactg

SEQ ID NO: 272608 - DNA, 25 bp, Mus musculus
agcgtaggataccgtctaacttccg

SEQ ID NO: 272609 - DNA, 25 bp, Mus musculus
cacttccggtgctttccggtcgcga

SEQ ID NO: 272610 - DNA, 25 bp, Mus musculus
tctctgagcctctttttgggcggtc

SEQ ID NO: 272611 - DNA, 25 bp, Mus musculus
tgggcggtcgtgtccgcacctctct

SEQ ID NO: 272612 - DNA, 25 bp, Mus musculus
gcacctctctcgctcgctgtgggtt

SEQ ID NO: 272613 - DNA, 25 bp, Mus musculus
cgctcgctgtgggttcgcgtcccag

SEQ ID NO: 272614 - DNA, 25 bp, Mus musculus
ttccggtcgcgagctgtagatacca

SEQ ID NO: 272615 - DNA, 25 bp, Mus musculus
ttcgcgtcccaggtcatggcgggcc

SEQ ID NO: 272616 - DNA, 25 bp, Mus musculus
gtagataccacctcgcgtcgcaatg

SEQ ID NO: 272617 - DNA, 25 bp, Mus musculus
tggcgagccctcagcctggagttag

SEQ ID NO: 272618 - DNA, 25 bp, Mus musculus
gtcgcaatggcgctctctctgagcc

SEQ ID NO: 272619 - DNA, 25 bp, Mus musculus
aggtacctgcttcgtggcgagccct

SEQ ID NO: 272620 - DNA, 25 bp, Mus musculus
tcagcctggagttaggcttcgcgcc

SEQ ID NO: 272621 - DNA, 25 bp, Mus musculus
gttctgtcagctgcgagccggaccc

SEQ ID NO: 272622 - DNA, 25 bp, Mus musculus
tgcggatgtcgttgggaatcctgct

SEQ ID NO: 272623 - DNA, 25 bp, Mus musculus
cccttctagtgctctaatcgctaac

SEQ ID NO: 272624 - DNA, 25 bp, Mus musculus
tgctctaatcgctaactgggagacc

SEQ ID NO: 272625 - DNA, 25 bp, Mus musculus
tcgctaactgggagacccggacttc

SEQ ID NO: 272626 - DNA, 25 bp, Mus musculus
gagacccggacttccgggatgtcta

SEQ ID NO: 272627 - DNA, 25 bp, Mus musculus
ctaggaagtggcttttctctgggta

SEQ ID NO: 272628 - DNA, 25 bp, Mus musculus
gtcgttgggaatcctgctgacaggc

SEQ ID NO: 272629 - DNA, 25 bp, Mus musculus
cctgctgacaggctgagtggactcg

SEQ ID NO: 272630 - DNA, 25 bp, Mus musculus
actcgggcgggaccagtgactatag

SEQ ID NO: 272631 - DNA, 25 bp, Mus musculus
cagtgactataggtctccaaggaga

SEQ ID NO: 272632 - DNA, 25 bp, Mus musculus
tccaaggagagtcgcctgagcctgt

SEQ ID NO: 272633 - DNA, 25 bp, Mus musculus
aggtggtcggtcattcatccgtcga

SEQ ID NO: 272634 - DNA, 25 bp, Mus musculus
catccgtcgagtacggcagaggagc

SEQ ID NO: 272635 - DNA, 25 bp, Mus musculus
cgggatgtctaggaagtggcttttc

SEQ ID NO: 272636 - DNA, 25 bp, Mus musculus
acagcgcggggttgacacgcttcct

SEQ ID NO: 272637 - DNA, 25 bp, Mus musculus
gggcataggtgcacgcatgcgcata

SEQ ID NO: 272638 - DNA, 25 bp, Mus musculus
cggtctctgtatcccaggcctaggc

SEQ ID NO: 272639 - DNA, 25 bp, Mus musculus
aggcctaggcagcagcccttcgcag

SEQ ID NO: 272640 - DNA, 25 bp, Mus musculus
tggcggacgcggtaaccaattgtca

SEQ ID NO: 272641 - DNA, 25 bp, Mus musculus
caattgtcatttggcaccgcctctg

SEQ ID NO: 272642 - DNA, 25 bp, Mus musculus
accgcctctggctcggtttgaattc

SEQ ID NO: 272643 - DNA, 25 bp, Mus musculus
tcgattctggacagcttggagcgtc

SEQ ID NO: 272644 - DNA, 25 bp, Mus musculus
cttggagcgtccaccatgaggagaa

SEQ ID NO: 272645 - DNA, 25 bp, Mus musculus
cccattactgaggtgcgggtctggt

SEQ ID NO: 272646 - DNA, 25 bp, Mus musculus
gtctggtaccaggttcgacaagctg

SEQ ID NO: 272647 - DNA, 25 bp, Mus musculus
gcatctgtgcccgaggccactagcg

SEQ ID NO: 272648 - DNA, 25 bp, Mus musculus
tgcgcatattgaggcccgcacgctc

SEQ ID NO: 272649 - DNA, 25 bp, Mus musculus
ttcgccggtcttcaggcaccgatgt

SEQ ID NO: 272650 - DNA, 25 bp, Mus musculus
tgaagtctcctgtgcgcgccaacag

SEQ ID NO: 272651 - DNA, 25 bp, Mus musculus
ggcacgagcggtgacgtcaccactg

SEQ ID NO: 272652 - DNA, 25 bp, Mus musculus
ttcggagccaatcgcaggcacgagc

SEQ ID NO: 272653 - DNA, 25 bp, Mus musculus
gtgcgccagcttttcggagccaatc

SEQ ID NO: 272654 - DNA, 25 bp, Mus musculus
agcaacgcggtcattcggtgcgcca

SEQ ID NO: 272655 - DNA, 25 bp, Mus musculus
tttttaagggcctccgcgccaagca

SEQ ID NO: 272656 - DNA, 25 bp, Mus musculus
atggccggcggagtaaagcactttt

SEQ ID NO: 272657 - DNA, 25 bp, Mus musculus
caccaggcagtaggctgaagtctcc

SEQ ID NO: 272658 - DNA, 25 bp, Mus musculus
cgcgccaacagcagtggacgcggtt

SEQ ID NO: 272659 - DNA, 25 bp, Mus musculus
tggacgcggttggaaccactgaatg

SEQ ID NO: 272660 - DNA, 25 bp, Mus musculus
ccactgaatgaatggatactcttga

SEQ ID NO: 272661 - DNA, 25 bp, Mus musculus
tactcttgacgatccgagggaaacg

SEQ ID NO: 272662 - DNA, 25 bp, Mus musculus
tgaccggcacacatgcgccgggtta

SEQ ID NO: 272663 - DNA, 25 bp, Mus musculus
gccgggttacctgccaccaggcagt

SEQ ID NO: 272664 - DNA, 25 bp, Mus musculus
ggccacagcgacatagcagctctga

SEQ ID NO: 272665 - DNA, 25 bp, Mus musculus
tggcgtcacgtcctggcacaggaac

SEQ ID NO: 272666 - DNA, 25 bp, Mus musculus
gctcaaagccttcgtttggcccgcg

SEQ ID NO: 272667 - DNA, 25 bp, Mus musculus
agggcgcctcccatccagaagtcag

SEQ ID NO: 272668 - DNA, 25 bp, Mus musculus
ggctcctcccgtctgacgaagtctg

SEQ ID NO: 272669 - DNA, 25 bp, Mus musculus
cgagaactgcgctgaaacgaaacgt

SEQ ID NO: 272670 - DNA, 25 bp, Mus musculus
ctcgaaggctctcgttgcaacagga

SEQ ID NO: 272671 - DNA, 25 bp, Mus musculus
gcagctctgaaagcccaggtctatg

SEQ ID NO: 272672 - DNA, 25 bp, Mus musculus
tgcagcggtcgctatactcgttagc

SEQ ID NO: 272673 - DNA, 25 bp, Mus musculus
agcaagccctggacctcgtttcaga

SEQ ID NO: 272674 - DNA, 25 bp, Mus musculus
ctctattggattcgacgagctcagc

SEQ ID NO: 272675 - DNA, 25 bp, Mus musculus
cgtgggccgagtttgaacctctatt

SEQ ID NO: 272676 - DNA, 25 bp, Mus musculus
ttttattaaatgctcgccgtgggcc

SEQ ID NO: 272677 - DNA, 25 bp, Mus musculus
ccgatcagagtaccggctcaaagcc

SEQ ID NO: 272678 - DNA, 25 bp, Mus musculus
ccagcaatgcgtcagtgttacgcta

SEQ ID NO: 272679 - DNA, 25 bp, Mus musculus
tcccactggaacctgtagagggcgc

SEQ ID NO: 272680 - DNA, 25 bp, Mus musculus
tgttacgctaaacaaggcgaggcca

SEQ ID NO: 272681 - DNA, 25 bp, Mus musculus
ccaagaagtggttgggtctgtgcaa

SEQ ID NO: 272682 - DNA, 25 bp, Mus musculus
tcaggctcagggctgcttcacgagc

SEQ ID NO: 272683 - DNA, 25 bp, Mus musculus
cgcagtctttagagcaaaggtgtcc

SEQ ID NO: 272684 - DNA, 25 bp, Mus musculus
gagcgcctagtctgttcccactgga

SEQ ID NO: 272685 - DNA, 25 bp, Mus musculus
ccgagtcccgtgaagggctagaata

SEQ ID NO: 272686 - DNA, 25 bp, Mus musculus
ctctaaaggaaaggcggcggcagcc

SEQ ID NO: 272687 - DNA, 25 bp, Mus musculus
aaaggtgtccctgggatccgcgaga

SEQ ID NO: 272688 - DNA, 25 bp, Mus musculus
ccaagagccagtgcaggcgcagtct

SEQ ID NO: 272689 - DNA, 25 bp, Mus musculus
tcacagtcatcacgaagctaagctc

SEQ ID NO: 272690 - DNA, 25 bp, Mus musculus
tggcacaggagaatcagtacgcacc

SEQ ID NO: 272691 - DNA, 25 bp, Mus musculus
ggctagaataaggtgacggcgacca

SEQ ID NO: 272692 - DNA, 25 bp, Mus musculus
aggctgctgacttcgccgctcacaa

SEQ ID NO: 272693 - DNA, 25 bp, Mus musculus
ctaactgggacgggaacacaaagcg

SEQ ID NO: 272694 - DNA, 25 bp, Mus musculus
cgcgccagttgggaagcagccctcg

SEQ ID NO: 272695 - DNA, 25 bp, Mus musculus
gaagggactccctacattaatcacc

SEQ ID NO: 272696 - DNA, 25 bp, Mus musculus
gaaaagatcctgaagggactcccta

SEQ ID NO: 272697 - DNA, 25 bp, Mus musculus
tcacaaacaccgacagcagcgacga

SEQ ID NO: 272698 - DNA, 25 bp, Mus musculus
tccgaagcgccaggcggcgctatag

SEQ ID NO: 272699 - DNA, 25 bp, Mus musculus
caatgggctcggaggcagctcagct

SEQ ID NO: 272700 - DNA, 25 bp, Mus musculus
gcgccaccagcgcaatgggctcgga

SEQ ID NO: 272701 - DNA, 25 bp, Mus musculus
tgttcggactccgaagcttcagtcc

SEQ ID NO: 272702 - DNA, 25 bp, Mus musculus
tataggtgatttgttcggactccga

SEQ ID NO: 272703 - DNA, 25 bp, Mus musculus
aggcggcgctataggtgatttgttc

SEQ ID NO: 272704 - DNA, 25 bp, Mus musculus
cagttgggaagcagccctcgcggcc

SEQ ID NO: 272705 - DNA, 25 bp, Mus musculus
ccgacagcagcgacgaaaagatcct

SEQ ID NO: 272706 - DNA, 25 bp, Mus musculus
agctggaatcccagagtccactcta

SEQ ID NO: 272707 - DNA, 25 bp, Mus musculus
ctccatggcaacgacgggttcgaaa

SEQ ID NO: 272708 - DNA, 25 bp, Mus musculus
cttccagggatttgcagggttctgc

SEQ ID NO: 272709 - DNA, 25 bp, Mus musculus
gtcagttctctaccggccttccagg

SEQ ID NO: 272710 - DNA, 25 bp, Mus musculus
gggcaacggattcaagcaccacctt

SEQ ID NO: 272711 - DNA, 25 bp, Mus musculus
gacgacgtgcacaatcctctcgggg

SEQ ID NO: 272712 - DNA, 25 bp, Mus musculus
tcccggccacgaattcaggcgtcag

SEQ ID NO: 272713 - DNA, 25 bp, Mus musculus
taatcagctcgcactcctggacgtc

SEQ ID NO: 272714 - DNA, 25 bp, Mus musculus
tcttcccgtccctaggggattgcgc

SEQ ID NO: 272715 - DNA, 25 bp, Mus musculus
tacatatcccagactgctttgcgcg

SEQ ID NO: 272716 - DNA, 25 bp, Mus musculus
actctcgttcgcttgctccatatca

SEQ ID NO: 272717 - DNA, 25 bp, Mus musculus
cctcgtgaacatgcgcactctcgtt

SEQ ID NO: 272718 - DNA, 25 bp, Mus musculus
agccttccttcaatgctccgaggga

SEQ ID NO: 272719 - DNA, 25 bp, Mus musculus
gactcctccctaggccttgaggtga

SEQ ID NO: 272720 - DNA, 25 bp, Mus musculus
agtgtacgccgagcttccgtcagaa

SEQ ID NO: 272721 - DNA, 25 bp, Mus musculus
gaagaggcccagtgtacgccgagct

SEQ ID NO: 272722 - DNA, 25 bp, Mus musculus
ggcagccgaccacccgatcacccaa

SEQ ID NO: 272723 - DNA, 25 bp, Mus musculus
aaccacgcagccgttctttgacatg

SEQ ID NO: 272724 - DNA, 25 bp, Mus musculus
ccgttctttgacatggcgagggaaa

SEQ ID NO: 272725 - DNA, 25 bp, Mus musculus
gaaacgggctggctcctacctgacc

SEQ ID NO: 272726 - DNA, 25 bp, Mus musculus
tagtctaccactactgcctccttgg

SEQ ID NO: 272727 - DNA, 25 bp, Mus musculus
cttccgtcagaagagcaaaatcaga

SEQ ID NO: 272728 - DNA, 25 bp, Mus musculus
ttcccgtgatggcatcgtggtgctg

SEQ ID NO: 272729 - DNA, 25 bp, Mus musculus
gccgagcttccgtcagaagagcaaa

SEQ ID NO: 272730 - DNA, 25 bp, Mus musculus
gagcaaaatcagacagcgggtactg

SEQ ID NO: 272731 - DNA, 25 bp, Mus musculus
atcagacagcgggtactggccggcc

SEQ ID NO: 272732 - DNA, 25 bp, Mus musculus
tactggccggccagtccagaacggc

SEQ ID NO: 272733 - DNA, 25 bp, Mus musculus
ttggcggttcccgtgatggcatcgt

SEQ ID NO: 272734 - DNA, 25 bp, Mus musculus
tgcgatctgattccgctcaggagcc

SEQ ID NO: 272735 - DNA, 25 bp, Mus musculus
tagcggaagccaggcacagcggctc

SEQ ID NO: 272736 - DNA, 25 bp, Mus musculus
acagcggctccgaaacggggcaact

SEQ ID NO: 272737 - DNA, 25 bp, Mus musculus
gggcaactcgagacgacccacagtg

SEQ ID NO: 272738 - DNA, 25 bp, Mus musculus
aggacgctagctgctgaacgcgcgt

SEQ ID NO: 272739 - DNA, 25 bp, Mus musculus
accgctctctggagtctgctcttcg

SEQ ID NO: 272740 - DNA, 25 bp, Mus musculus
agcctgcgtcctacttaatgcgatc

SEQ ID NO: 272741 - DNA, 25 bp, Mus musculus
gagcctccgggcaatatttttagtc

SEQ ID NO: 272742 - DNA, 25 bp, Mus musculus
ggcaatatttttagtccctggagat

SEQ ID NO: 272743 - DNA, 25 bp, Mus musculus
tccctggagattgggtccgggccaa

SEQ ID NO: 272744 - DNA, 25 bp, Mus musculus
tcaccgtggggcaattacctgccga

SEQ ID NO: 272745 - DNA, 25 bp, Mus musculus
aggctaagagggacgcctggccacc

SEQ ID NO: 272746 - DNA, 25 bp, Mus musculus
ctgtgcgcagccgttgacccggcag

SEQ ID NO: 272747 - DNA, 25 bp, Mus musculus
gccctggtgctgaaaagctcagtca

SEQ ID NO: 272748 - DNA, 25 bp, Mus musculus
aacggcggcaccgagcagactagtg

SEQ ID NO: 272749 - DNA, 25 bp, Mus musculus
ggcctgtgcgcgcacgcgaaatccg

SEQ ID NO: 272750 - DNA, 25 bp, Mus musculus
cgctccggccgtacaggtgtgccag

SEQ ID NO: 272751 - DNA, 25 bp, Mus musculus
cgggagcacccagagtccgaggaat

SEQ ID NO: 272752 - DNA, 25 bp, Mus musculus
agcacccagagtccgaggaatgctc

SEQ ID NO: 272753 - DNA, 25 bp, Mus musculus
gaggaatgctctgcctagcccgccc

SEQ ID NO: 272754 - DNA, 25 bp, Mus musculus
ccgccggcgcttcctgaggtcatag

SEQ ID NO: 272755 - DNA, 25 bp, Mus musculus
gcttcctgaggtcatagggctcgcc

SEQ ID NO: 272756 - DNA, 25 bp, Mus musculus
cctcggctagccacccgatggatgg

SEQ ID NO: 272757 - DNA, 25 bp, Mus musculus
gacctgtatggcaagcaggccgccc

SEQ ID NO: 272758 - DNA, 25 bp, Mus musculus
ctgctgtcagacctgtatggcaagc

SEQ ID NO: 272759 - DNA, 25 bp, Mus musculus
cagactagtgtctgctgtcagacct

SEQ ID NO: 272760 - DNA, 25 bp, Mus musculus
gcggcaccgagcagactagtgtctg

SEQ ID NO: 272761 - DNA, 25 bp, Mus musculus
cggcggccgagaatccgcgaccaga

SEQ ID NO: 272762 - DNA, 25 bp, Mus musculus
tccactctcaggtcggatctcacag

SEQ ID NO: 272763 - DNA, 25 bp, Mus musculus
ggcaactccactctcaggtcggatc

SEQ ID NO: 272764 - DNA, 25 bp, Mus musculus
tggggcaactccactctcaggtcgg

SEQ ID NO: 272765 - DNA, 25 bp, Mus musculus
aagcgccctgggatggcggacctgg

SEQ ID NO: 272766 - DNA, 25 bp, Mus musculus
atagtcaagggaagcgccctgggat

SEQ ID NO: 272767 - DNA, 25 bp, Mus musculus
tgccttgcccgaggttcctgggtcc

SEQ ID NO: 272768 - DNA, 25 bp, Mus musculus
agctggccctgccttgcccgaggtt

SEQ ID NO: 272769 - DNA, 25 bp, Mus musculus
agagtccaagctggccctgccttgc

SEQ ID NO: 272770 - DNA, 25 bp, Mus musculus
tttggggagagtccaagctggccct

SEQ ID NO: 272771 - DNA, 25 bp, Mus musculus
cagatggtttcggagacccggactg

SEQ ID NO: 272772 - DNA, 25 bp, Mus musculus
ctcccgggcagatggtttcggagac

SEQ ID NO: 272773 - DNA, 25 bp, Mus musculus
caaactcccgggcagatggtttcgg

SEQ ID NO: 272774 - DNA, 25 bp, Mus musculus
actctcaggtcggatctcacagcgg

SEQ ID NO: 272775 - DNA, 25 bp, Mus musculus
tcaggtcggatctcacagcggcagg

SEQ ID NO: 272776 - DNA, 25 bp, Mus musculus
agtcacacatttgtgccgccagtac

SEQ ID NO: 272777 - DNA, 25 bp, Mus musculus
tgacgttagacggaatcaaggaccg

SEQ ID NO: 272778 - DNA, 25 bp, Mus musculus
cactgacgttagacggaatcaagga

SEQ ID NO: 272779 - DNA, 25 bp, Mus musculus
cccactgacgttagacggaatcaag

SEQ ID NO: 272780 - DNA, 25 bp, Mus musculus
gtgacgcacccccactgacgttaga

SEQ ID NO: 272781 - DNA, 25 bp, Mus musculus
tgtgccgccagtacagtgacgcacc

SEQ ID NO: 272782 - DNA, 25 bp, Mus musculus
tttgtgccgccagtacagtgacgca

SEQ ID NO: 272783 - DNA, 25 bp, Mus musculus
tcacacatttgtgccgccagtacag

SEQ ID NO: 272784 - DNA, 25 bp, Mus musculus
ggtgcctggaacagtcacacatttg

SEQ ID NO: 272785 - DNA, 25 bp, Mus musculus
caggtgcctggaacagtcacacatt

SEQ ID NO: 272786 - DNA, 25 bp, Mus musculus
cgcaggtgcctggaacagtcacaca

SEQ ID NO: 272787 - DNA, 25 bp, Mus musculus
cgcgcaggtgcctggaacagtcaca

SEQ ID NO: 272788 - DNA, 25 bp, Mus musculus
cgctcgcgcaggtgcctggaacagt

SEQ ID NO: 272789 - DNA, 25 bp, Mus musculus
atttgtgccgccagtacagtgacgc

SEQ ID NO: 272790 - DNA, 25 bp, Mus musculus
caaggccttaaggaaagtgtggaca

SEQ ID NO: 272791 - DNA, 25 bp, Mus musculus
gtctgagctcctgcttctccgatta

SEQ ID NO: 272792 - DNA, 25 bp, Mus musculus
tctccgattaaaaacagggcacctc

SEQ ID NO: 272793 - DNA, 25 bp, Mus musculus
tctggcgtctcgaaagcatgcattg

SEQ ID NO: 272794 - DNA, 25 bp, Mus musculus
gcatgcattgctacgaggggtcgtt

SEQ ID NO: 272795 - DNA, 25 bp, Mus musculus
aggggtcgttgcagcactacacaaa

SEQ ID NO: 272796 - DNA, 25 bp, Mus musculus
tacgggaagcagatgagctaatttc

SEQ ID NO: 272797 - DNA, 25 bp, Mus musculus
ctcgcgtatgacaatcaaggcctta

SEQ ID NO: 272798 - DNA, 25 bp, Mus musculus
gtgtggacagtgagactcgagcctc

SEQ ID NO: 272799 - DNA, 25 bp, Mus musculus
gtcaccaggtctctactccggtctg

SEQ ID NO: 272800 - DNA, 25 bp, Mus musculus
ccacaagcgaggctcggagaacctg

SEQ ID NO: 272801 - DNA, 25 bp, Mus musculus
tgactggtgaaatggccaaggcctc

SEQ ID NO: 272802 - DNA, 25 bp, Mus musculus
ccctttcggcaaacgaggtctgagc

SEQ ID NO: 272803 - DNA, 25 bp, Mus musculus
acatggccttttctgggtcaccagg

SEQ ID NO: 272804 - DNA, 25 bp, Mus musculus
gcgatttcctctcggggtcatcctc

SEQ ID NO: 272805 - DNA, 25 bp, Mus musculus
aagccgcattcggtgtcgccaggcc

SEQ ID NO: 272806 - DNA, 25 bp, Mus musculus
tcggtcatgagctgctcgaaggccc

SEQ ID NO: 272807 - DNA, 25 bp, Mus musculus
tgtgcagggcgatcttctcactgaa

SEQ ID NO: 272808 - DNA, 25 bp, Mus musculus
tctcactgaacttccgcgggttggc

SEQ ID NO: 272809 - DNA, 25 bp, Mus musculus
cctcggggaggatgtgcgaccctcc

SEQ ID NO: 272810 - DNA, 25 bp, Mus musculus
cgaggccttctacgccgacagtcaa

SEQ ID NO: 272811 - DNA, 25 bp, Mus musculus
tacgccgacagtcaagggctcgctg

SEQ ID NO: 272812 - DNA, 25 bp, Mus musculus
tgggtgtccacggagaagccgcacc

SEQ ID NO: 272813 - DNA, 25 bp, Mus musculus
tcggtccggcctctgagctgcagct

SEQ ID NO: 272814 - DNA, 25 bp, Mus musculus
cgtcgattcgcttgtgcgtgcacca

SEQ ID NO: 272815 - DNA, 25 bp, Mus musculus
gtccaccgagatagcaagccgcatt

SEQ ID NO: 272816 - DNA, 25 bp, Mus musculus
gctgcagctgcgtgcgatttcctct

SEQ ID NO: 272817 - DNA, 25 bp, Mus musculus
tctcggggtcatcctcccgcttagg

SEQ ID NO: 272818 - DNA, 25 bp, Mus musculus
ttgcgttggtgctgtctgctccgcc

SEQ ID NO: 272819 - DNA, 25 bp, Mus musculus
ggccacttacctcagcagcttgtgc

SEQ ID NO: 272820 - DNA, 25 bp, Mus musculus
ccacgcatgctcagtcggatgacgc

SEQ ID NO: 272821 - DNA, 25 bp, Mus musculus
tcccagttagtcctggcaggtagga

SEQ ID NO: 272822 - DNA, 25 bp, Mus musculus
ctggaaggttctcggccacttacct

SEQ ID NO: 272823 - DNA, 25 bp, Mus musculus
gcagcttgtgcactttgactgacag

SEQ ID NO: 272824 - DNA, 25 bp, Mus musculus
ttggacgaagccgtgcggcctcgct

SEQ ID NO: 272825 - DNA, 25 bp, Mus musculus
ctcgccacgacgtagacggcggcgt

SEQ ID NO: 272826 - DNA, 25 bp, Mus musculus
cccgcctgagctgtgggagtttgat

SEQ ID NO: 272827 - DNA, 25 bp, Mus musculus
acgctgcctttgcatacggccggcg

SEQ ID NO: 272828 - DNA, 25 bp, Mus musculus
tccgagaacacttccgggtcgctgt

SEQ ID NO: 272829 - DNA, 25 bp, Mus musculus
agtcggatgacgctgcctttgcata

SEQ ID NO: 272830 - DNA, 25 bp, Mus musculus
gccagaccgagctttccgagaacac

SEQ ID NO: 272831 - DNA, 25 bp, Mus musculus
ggtctcttcctacgctcccagttag

SEQ ID NO: 272832 - DNA, 25 bp, Mus musculus
gatggcgactcccatgcatcggctc

SEQ ID NO: 272833 - DNA, 25 bp, Mus musculus
cctgtccgctagctagtgagcgggc

SEQ ID NO: 272834 - DNA, 25 bp, Mus musculus
tgcagacgcctgtccgctagctagt

SEQ ID NO: 272835 - DNA, 25 bp, Mus musculus
aagtgagatgcttgtggggtgtgca

SEQ ID NO: 272836 - DNA, 25 bp, Mus musculus
tcgaaggaaagcgtaagtgagatgc

SEQ ID NO: 272837 - DNA, 25 bp, Mus musculus
cccaggaccgcagaggtttctaagg

SEQ ID NO: 272838 - DNA, 25 bp, Mus musculus
ggctcatagctcgaaggaaagcgta

SEQ ID NO: 272839 - DNA, 25 bp, Mus musculus
atcggctcatagctcgaaggaaagc

SEQ ID NO: 272840 - DNA, 25 bp, Mus musculus
tcccaaaaacccgtgcggcagactc

SEQ ID NO: 272841 - DNA, 25 bp, Mus musculus
ggcgactcccatgcatcggctcata

SEQ ID NO: 272842 - DNA, 25 bp, Mus musculus
gactccagccgctccaagatggcga

SEQ ID NO: 272843 - DNA, 25 bp, Mus musculus
gacgcctgtccgctagctagtgagc

SEQ ID NO: 272844 - DNA, 25 bp, Mus musculus
gcagaggtttctaaggacccgccca

SEQ ID NO: 272845 - DNA, 25 bp, Mus musculus
cccatgcatcggctcatagctcgaa

SEQ ID NO: 272846 - DNA, 25 bp, Mus musculus
cagagaccttgaagacgcgggcgac

SEQ ID NO: 272847 - DNA, 25 bp, Mus musculus
tagcgaaggcagaggcctccaggtt

SEQ ID NO: 272848 - DNA, 25 bp, Mus musculus
cgcctccggagctcgagaaggctcg

SEQ ID NO: 272849 - DNA, 25 bp, Mus musculus
ttgctaccagccatacagccagctg

SEQ ID NO: 272850 - DNA, 25 bp, Mus musculus
atacagccagctgctcttccgggtc

SEQ ID NO: 272851 - DNA, 25 bp, Mus musculus
tcggcactcacagccatagtgcggc

SEQ ID NO: 272852 - DNA, 25 bp, Mus musculus
ctccggtgaggaagcgcagagacct

SEQ ID NO: 272853 - DNA, 25 bp, Mus musculus
gaccgtagcagcagtaactcctgcc

SEQ ID NO: 272854 - DNA, 25 bp, Mus musculus
taactcctgcccagtgcgcgggctg

SEQ ID NO: 272855 - DNA, 25 bp, Mus musculus
gtggtcagtattacaggacccgccc

SEQ ID NO: 272856 - DNA, 25 bp, Mus musculus
cgctctccacttgcggaagcgagga

SEQ ID NO: 272857 - DNA, 25 bp, Mus musculus
tagcgagtccctaggccggcttggt

SEQ ID NO: 272858 - DNA, 25 bp, Mus musculus
cggcttggtccgttgtcccgacact

SEQ ID NO: 272859 - DNA, 25 bp, Mus musculus
atagtgcggccggaccacacccagg

SEQ ID NO: 272860 - DNA, 25 bp, Mus musculus
tggttcttcggagccctcgaggctc

SEQ ID NO: 272861 - DNA, 25 bp, Mus musculus
gcctaggaacgcaggctttacactg

SEQ ID NO: 272862 - DNA, 25 bp, Mus musculus
cacaccagagcgctgggtacgcgca

SEQ ID NO: 272863 - DNA, 25 bp, Mus musculus
gcgcagcctaggaacgcaggcttta

SEQ ID NO: 272864 - DNA, 25 bp, Mus musculus
tccgctcacaccagagcgctgggta

SEQ ID NO: 272865 - DNA, 25 bp, Mus musculus
gaacgcaggctttacactgggaagg

SEQ ID NO: 272866 - DNA, 25 bp, Mus musculus
tttacactgggaagggatgctcgac

SEQ ID NO: 272867 - DNA, 25 bp, Mus musculus
tgggaagggatgctcgacgacatcc

SEQ ID NO: 272868 - DNA, 25 bp, Mus musculus
ggatgctcgacgacatcccaccgag

SEQ ID NO: 272869 - DNA, 25 bp, Mus musculus
cccgcggggaacagccagagagaca

SEQ ID NO: 272870 - DNA, 25 bp, Mus musculus
cagagagacagcgagtaacgggcct

SEQ ID NO: 272871 - DNA, 25 bp, Mus musculus
gctggacgcgcagctctgcgtcctg

SEQ ID NO: 272872 - DNA, 25 bp, Mus musculus
cagctctgcgtcctggttcttcgga

SEQ ID NO: 272873 - DNA, 25 bp, Mus musculus
ctgggtacgcgcagcctaggaacgc

SEQ ID NO: 272874 - DNA, 25 bp, Mus musculus
ctcgtggtgcaccagcggacgcaca

SEQ ID NO: 272875 - DNA, 25 bp, Mus musculus
agccagcgctcgcagctcgtggtgc

SEQ ID NO: 272876 - DNA, 25 bp, Mus musculus
aagccctacagatgcggcgactgtg

SEQ ID NO: 272877 - DNA, 25 bp, Mus musculus
gcgagaagccctacagatgcggcga

SEQ ID NO: 272878 - DNA, 25 bp, Mus musculus
catcaagcaccagcggacgcacacc

SEQ ID NO: 272879 - DNA, 25 bp, Mus musculus
cctacgagtgcctcacgtgcggcga

SEQ ID NO: 272880 - DNA, 25 bp, Mus musculus
agaagccctatcagtgcggcgagtg

SEQ ID NO: 272881 - DNA, 25 bp, Mus musculus
cgctcattacgcaccggagaacgca

SEQ ID NO: 272882 - DNA, 25 bp, Mus musculus
gatcgcgcaccagggcacgcacacc

SEQ ID NO: 272883 - DNA, 25 bp, Mus musculus
agccgcagctccaacctggccactc

SEQ ID NO: 272884 - DNA, 25 bp, Mus musculus
agagctccagcctgatcgcgcacca

SEQ ID NO: 272885 - DNA, 25 bp, Mus musculus
aagccgtacaagtgcgggctgtgcg

SEQ ID NO: 272886 - DNA, 25 bp, Mus musculus
accggcgcacccacctggtggagaa

SEQ ID NO: 272887 - DNA, 25 bp, Mus musculus
ctcacgtgcggcgagagcttcagct

SEQ ID NO: 272888 - DNA, 25 bp, Mus musculus
agcacaggcatccaggtcacgggtt

SEQ ID NO: 272889 - DNA, 25 bp, Mus musculus
caggagcgctttgcagcagggaaac

SEQ ID NO: 272890 - DNA, 25 bp, Mus musculus
tgagcgcgacagatctgcacacgtg

SEQ ID NO: 272891 - DNA, 25 bp, Mus musculus
gcgcactcggcctttgacatcagga

SEQ ID NO: 272892 - DNA, 25 bp, Mus musculus
aggcacggaaacgtacccacatgtc

SEQ ID NO: 272893 - DNA, 25 bp, Mus musculus
ggcgcccagttgtgctcaaaatatc

SEQ ID NO: 272894 - DNA, 25 bp, Mus musculus
ggagcctgggaacgcaactcagcca

SEQ ID NO: 272895 - DNA, 25 bp, Mus musculus
ccagcgcctcgctgtaagcagtata

SEQ ID NO: 272896 - DNA, 25 bp, Mus musculus
cctgtgccttactgaagagcgtctc

SEQ ID NO: 272897 - DNA, 25 bp, Mus musculus
tactgccatcaggtccagggtgccc

SEQ ID NO: 272898 - DNA, 25 bp, Mus musculus
ggtagccggtccaccaataggatgc

SEQ ID NO: 272899 - DNA, 25 bp, Mus musculus
agggaaaccagcatgaatctcagta

SEQ ID NO: 272900 - DNA, 25 bp, Mus musculus
aggattttgaatctgctaggcggca

SEQ ID NO: 272901 - DNA, 25 bp, Mus musculus
tgcacacggcaacagctggcgaact

SEQ ID NO: 272902 - DNA, 25 bp, Mus musculus
gacttcctgggcaggcgcgcgctct

SEQ ID NO: 272903 - DNA, 25 bp, Mus musculus
ccgtgcctgggcactgcccacgagc

SEQ ID NO: 272904 - DNA, 25 bp, Mus musculus
cccacgagcccacaaccgcacgcgc

SEQ ID NO: 272905 - DNA, 25 bp, Mus musculus
gcgccctctcccattgcccatcaga

SEQ ID NO: 272906 - DNA, 25 bp, Mus musculus
gcccacgggccaatttacaatcgca

SEQ ID NO: 272907 - DNA, 25 bp, Mus musculus
cgggccaatttacaatcgcaaagac

SEQ ID NO: 272908 - DNA, 25 bp, Mus musculus
atcgcaaagactccacgagccagtc

SEQ ID NO: 272909 - DNA, 25 bp, Mus musculus
cagtcctcagcgagctccatagcaa

SEQ ID NO: 272910 - DNA, 25 bp, Mus musculus
ctcagcgagctccatagcaactgtg

SEQ ID NO: 272911 - DNA, 25 bp, Mus musculus
cgagctccatagcaactgtggcttc

SEQ ID NO: 272912 - DNA, 25 bp, Mus musculus
ctccatagcaactgtggcttccgtc

SEQ ID NO: 272913 - DNA, 25 bp, Mus musculus
agcaactgtggcttccgtcgctcca

SEQ ID NO: 272914 - DNA, 25 bp, Mus musculus
ggcttccgtcgctccacttccgcca

SEQ ID NO: 272915 - DNA, 25 bp, Mus musculus
acttccgccagccagacttcctggg

SEQ ID NO: 272916 - DNA, 25 bp, Mus musculus
cccgagggtgcactcgaatcttgct

SEQ ID NO: 272917 - DNA, 25 bp, Mus musculus
atactagttctcgaagcccgccttc

SEQ ID NO: 272918 - DNA, 25 bp, Mus musculus
tcgaatcttgcttgctcggctgcgg

SEQ ID NO: 272919 - DNA, 25 bp, Mus musculus
ttaaactacagtcgggagcggagcc

SEQ ID NO: 272920 - DNA, 25 bp, Mus musculus
accacactcgcgtgcttatggcatc

SEQ ID NO: 272921 - DNA, 25 bp, Mus musculus
gcgacgccggaagcgaacaatgcga

SEQ ID NO: 272922 - DNA, 25 bp, Mus musculus
cgccttccagccttttaaactacag

SEQ ID NO: 272923 - DNA, 25 bp, Mus musculus
ggcactctcaggatactagttctcg

SEQ ID NO: 272924 - DNA, 25 bp, Mus musculus
atcccagttgaagggagcgacgccg

SEQ ID NO: 272925 - DNA, 25 bp, Mus musculus
aggctcttctctggcactctcagga

SEQ ID NO: 272926 - DNA, 25 bp, Mus musculus
ctgtgccaaacaggctcttctctgg

SEQ ID NO: 272927 - DNA, 25 bp, Mus musculus
ggagccaagagctccctgcttgccg

SEQ ID NO: 272928 - DNA, 25 bp, Mus musculus
acaatgcgaagagcaggagaccacg

SEQ ID NO: 272929 - DNA, 25 bp, Mus musculus
cttgcatcccggtttctcctagaaa

SEQ ID NO: 272930 - DNA, 25 bp, Mus musculus
tcccgaagacagtgaccctaggtta

SEQ ID NO: 272931 - DNA, 25 bp, Mus musculus
cgccgcacatcgtctagaaagtcta

SEQ ID NO: 272932 - DNA, 25 bp, Mus musculus
ccgcaacggcaaagagaccagagga

SEQ ID NO: 272933 - DNA, 25 bp, Mus musculus
agagcgcgacaactagcagccaaga

SEQ ID NO: 272934 - DNA, 25 bp, Mus musculus
ccaagagggcgcgatagaaccacca

SEQ ID NO: 272935 - DNA, 25 bp, Mus musculus
tagaaccaccaagagggaccgctgc

SEQ ID NO: 272936 - DNA, 25 bp, Mus musculus
aggcgaagctcctcccttctgagca

SEQ ID NO: 272937 - DNA, 25 bp, Mus musculus
cagggcctggccttgtcaaaaaagg

SEQ ID NO: 272938 - DNA, 25 bp, Mus musculus
gttagctaagcccacagcgtgcgga

SEQ ID NO: 272939 - DNA, 25 bp, Mus musculus
gccagcgcgaagtcggtgtcttcct

SEQ ID NO: 272940 - DNA, 25 bp, Mus musculus
gacgtggtgccttgctgtttgttct

SEQ ID NO: 272941 - DNA, 25 bp, Mus musculus
tttgttctcaggtggagcacgctgc

SEQ ID NO: 272942 - DNA, 25 bp, Mus musculus
gaaccggctgaaggctgctttctgt

SEQ ID NO: 272943 - DNA, 25 bp, Mus musculus
gaccgtagccttctccggccgagaa

SEQ ID NO: 272944 - DNA, 25 bp, Mus musculus
ccatttaaggcgcacctgagtgccc

SEQ ID NO: 272945 - DNA, 25 bp, Mus musculus
ggccggggcagctctatagccgcac

SEQ ID NO: 272946 - DNA, 25 bp, Mus musculus
agccagggtcgcaccagcctgaggc

SEQ ID NO: 272947 - DNA, 25 bp, Mus musculus
agtcagcgtagccagggtcgcacca

SEQ ID NO: 272948 - DNA, 25 bp, Mus musculus
agccagcccaggtcggagtcccggt

SEQ ID NO: 272949 - DNA, 25 bp, Mus musculus
aaggtacaacgcgtccctccggcag

SEQ ID NO: 272950 - DNA, 25 bp, Mus musculus
ggtcggcccatagccgcgaaggtac

SEQ ID NO: 272951 - DNA, 25 bp, Mus musculus
acgacttcttccgagctcttgaggc

SEQ ID NO: 272952 - DNA, 25 bp, Mus musculus
cagctctccgcgaagacgacttctt

SEQ ID NO: 272953 - DNA, 25 bp, Mus musculus
tgcttcctttcacttagcagtgctg

SEQ ID NO: 272954 - DNA, 25 bp, Mus musculus
ccaggcagggataacggtgcacttc

SEQ ID NO: 272955 - DNA, 25 bp, Mus musculus
aacggtgcacttcaccaggctggga

SEQ ID NO: 272956 - DNA, 25 bp, Mus musculus
cgtcgccatgttgtggctcccgcag

SEQ ID NO: 272957 - DNA, 25 bp, Mus musculus
tagcagtgctgcctaggcccgactc

SEQ ID NO: 272958 - DNA, 25 bp, Mus musculus
gagatctattcagcgatggtcgacc

SEQ ID NO: 272959 - DNA, 25 bp, Mus musculus
gccgtttgctgaccggatcgcggct

SEQ ID NO: 272960 - DNA, 25 bp, Mus musculus
gagcatccacacttccgaaaaccga

SEQ ID NO: 272961 - DNA, 25 bp, Mus musculus
aaccgaacgtttagccacagcgacg

SEQ ID NO: 272962 - DNA, 25 bp, Mus musculus
cgtttagccacagcgacggcgagga

SEQ ID NO: 272963 - DNA, 25 bp, Mus musculus
ccgcgccgagatctattcagcgatg

SEQ ID NO: 272964 - DNA, 25 bp, Mus musculus
gagtcagttttctcccagcggggtg

SEQ ID NO: 272965 - DNA, 25 bp, Mus musculus
agcctcgggataacggcgcctcgaa

SEQ ID NO: 272966 - DNA, 25 bp, Mus musculus
cggcgcctcgaaggtgagccgcact

SEQ ID NO: 272967 - DNA, 25 bp, Mus musculus
aggcagccgccctggcgttgaccga

SEQ ID NO: 272968 - DNA, 25 bp, Mus musculus
gcggaccgaggcttaacagggctat

SEQ ID NO: 272969 - DNA, 25 bp, Mus musculus
cgccgcgaccgcagcgcaataaaag

SEQ ID NO: 272970 - DNA, 25 bp, Mus musculus
gacgcggcgagtcagttttctccca

SEQ ID NO: 272971 - DNA, 25 bp, Mus musculus
cttaacagggctatgacgcggcgcc

SEQ ID NO: 272972 - DNA, 25 bp, Mus musculus
ctgccttcagctaccgtaaggagcc

SEQ ID NO: 272973 - DNA, 25 bp, Mus musculus
cgactggtcttatccgtcgtacgga

SEQ ID NO: 272974 - DNA, 25 bp, Mus musculus
gtcgtacggacacaacactgctatt

SEQ ID NO: 272975 - DNA, 25 bp, Mus musculus
ttttttgcacaacacggccatagtg

SEQ ID NO: 272976 - DNA, 25 bp, Mus musculus
ccatagtggtaaaatgcgggaagca

SEQ ID NO: 272977 - DNA, 25 bp, Mus musculus
cagtaaggttttgaggccggagctc

SEQ ID NO: 272978 - DNA, 25 bp, Mus musculus
aggagcccgaactaagaccacgtcg

SEQ ID NO: 272979 - DNA, 25 bp, Mus musculus
ggcgcgcacgacttcatgcggaagc

SEQ ID NO: 272980 - DNA, 25 bp, Mus musculus
cagagccctgggagccaaacaccta

SEQ ID NO: 272981 - DNA, 25 bp, Mus musculus
caaacacctaccatgttggcgggtc

SEQ ID NO: 272982 - DNA, 25 bp, Mus musculus
cacaagagaggcctataaagcgcgg

SEQ ID NO: 272983 - DNA, 25 bp, Mus musculus
gccgtcttggtttccactccaaata

SEQ ID NO: 272984 - DNA, 25 bp, Mus musculus
aatagttccgtgcttctcttgggcg

SEQ ID NO: 272985 - DNA, 25 bp, Mus musculus
gcagagaccacagcagtaaggtttt

SEQ ID NO: 272986 - DNA, 25 bp, Mus musculus
tgagaagccgcctgactgcctgcct

SEQ ID NO: 272987 - DNA, 25 bp, Mus musculus
actggaggtgagaagccgcctgact

SEQ ID NO: 272988 - DNA, 25 bp, Mus musculus
gcccgaatgcgcgtccggtgaaggt

SEQ ID NO: 272989 - DNA, 25 bp, Mus musculus
cctcagtcacccgtccggggctcgg

SEQ ID NO: 272990 - DNA, 25 bp, Mus musculus
tcccagtcccggctgcgggagtcga

SEQ ID NO: 272991 - DNA, 25 bp, Mus musculus
atgggccgcggccactgcgtcagtc

SEQ ID NO: 272992 - DNA, 25 bp, Mus musculus
agcagcccggccctggtcacatggg

SEQ ID NO: 272993 - DNA, 25 bp, Mus musculus
cctggtcacgtgacgctcgcagcag

SEQ ID NO: 272994 - DNA, 25 bp, Mus musculus
aacctgctgcgacccgcgcttcgca

SEQ ID NO: 272995 - DNA, 25 bp, Mus musculus
cagggcctgggccttcacctgcacc

SEQ ID NO: 272996 - DNA, 25 bp, Mus musculus
tactcctgcggtgcgctgcgggaca

SEQ ID NO: 272997 - DNA, 25 bp, Mus musculus
ctgcggacctccacgtcatccttcc

SEQ ID NO: 272998 - DNA, 25 bp, Mus musculus
cagtggacgacgtcgctgcggacct

SEQ ID NO: 272999 - DNA, 25 bp, Mus musculus
ctggatccggcttcgccctacgttt

SEQ ID NO: 273000 - DNA, 25 bp, Mus musculus
tctcccgtgcgacggctgcggaaaa

SEQ ID NO: 273001 - DNA, 25 bp, Mus musculus
cctgacgaggagcacctgtgtcggc

SEQ ID NO: 273002 - DNA, 25 bp, Mus musculus
ggctcctgtctggacgtatgttcga

SEQ ID NO: 273003 - DNA, 25 bp, Mus musculus
gaggctcgagccaagacagaccacc

SEQ ID NO: 273004 - DNA, 25 bp, Mus musculus
ggctcaggcctgagcaagtccctcg

SEQ ID NO: 273005 - DNA, 25 bp, Mus musculus
tttaagcccaaaggcctgagtcacg

SEQ ID NO: 273006 - DNA, 25 bp, Mus musculus
ggacgtatgttcgaggccaccgaga

SEQ ID NO: 273007 - DNA, 25 bp, Mus musculus
cactatttttgcagcgagcagcgca

SEQ ID NO: 273008 - DNA, 25 bp, Mus musculus
gcgcacacacgtgggcactattttt

SEQ ID NO: 273009 - DNA, 25 bp, Mus musculus
taccagagagaaagccatggggtcc

SEQ ID NO: 273010 - DNA, 25 bp, Mus musculus
cccggcggctcttaccagagagaaa

SEQ ID NO: 273011 - DNA, 25 bp, Mus musculus
cctgagtcacgaggaagctccctgc

SEQ ID NO: 273012 - DNA, 25 bp, Mus musculus
ccaccgagagttgtgcaagtgcagc

SEQ ID NO: 273013 - DNA, 25 bp, Mus musculus
cggcttataaagctccgcggcgctg

SEQ ID NO: 273014 - DNA, 25 bp, Mus musculus
gctgtccatggtgcctgcgcgccag

SEQ ID NO: 273015 - DNA, 25 bp, Mus musculus
aggcagcgcgcagattcagcaatca

SEQ ID NO: 273016 - DNA, 25 bp, Mus musculus
agctctgcggagctgcaatctgcgc

SEQ ID NO: 273017 - DNA, 25 bp, Mus musculus
gaatgggatgcacgcctagctctgc

SEQ ID NO: 273018 - DNA, 25 bp, Mus musculus
agcggccgacatggatctgcgctga

SEQ ID NO: 273019 - DNA, 25 bp, Mus musculus
cccttgtcttcgctgtaggccggag

SEQ ID NO: 273020 - DNA, 25 bp, Mus musculus
gggaccggctgagccgcccttgtct

SEQ ID NO: 273021 - DNA, 25 bp, Mus musculus
cgggtcgtggccatattctggctcc

SEQ ID NO: 273022 - DNA, 25 bp, Mus musculus
aagataccgccgctcgccgggtcgt

SEQ ID NO: 273023 - DNA, 25 bp, Mus musculus
gtccgaggagaagataccgccgctc

SEQ ID NO: 273024 - DNA, 25 bp, Mus musculus
caccgcttgtagtccgaggagaaga

SEQ ID NO: 273025 - DNA, 25 bp, Mus musculus
gcgctcgctagctcaccgcttgtag

SEQ ID NO: 273026 - DNA, 25 bp, Mus musculus
ttcgtagctaaaggcgaagtggccc

SEQ ID NO: 273027 - DNA, 25 bp, Mus musculus
agggctgagcgctaaggttcttaaa

SEQ ID NO: 273028 - DNA, 25 bp, Mus musculus
gcttctgcgcctctgactgacagta

SEQ ID NO: 273029 - DNA, 25 bp, Mus musculus
aatgtcgtggcctgtcgcagtctaa

SEQ ID NO: 273030 - DNA, 25 bp, Mus musculus
cagtctaagggtgtgcggctgccat

SEQ ID NO: 273031 - DNA, 25 bp, Mus musculus
gacactcgtgatgcgcaccgggcgt

SEQ ID NO: 273032 - DNA, 25 bp, Mus musculus
acccggctgcaccaggtatgaggcc

SEQ ID NO: 273033 - DNA, 25 bp, Mus musculus
cagctggagcactacctgggcctgg

SEQ ID NO: 273034 - DNA, 25 bp, Mus musculus
accctggcgactcggcgctgcagga

SEQ ID NO: 273035 - DNA, 25 bp, Mus musculus
gcgaagggccagttcgccgtcacct

SEQ ID NO: 273036 - DNA, 25 bp, Mus musculus
catcagctgcgtttcctggtggcct

SEQ ID NO: 273037 - DNA, 25 bp, Mus musculus
agcccgagcgccatcagctgcgttt

SEQ ID NO: 273038 - DNA, 25 bp, Mus musculus
ctgcgtgaggacctcttcccggagc

SEQ ID NO: 273039 - DNA, 25 bp, Mus musculus
tggacagcgagcagcccgacagcct

SEQ ID NO: 273040 - DNA, 25 bp, Mus musculus
tgacagtagcggctcccggaaaatg

SEQ ID NO: 273041 - DNA, 25 bp, Mus musculus
gctcccggaaaatgtcgtggcctgt

SEQ ID NO: 273042 - DNA, 25 bp, Mus musculus
aaggagaccgcggaatggccgaggc

SEQ ID NO: 273043 - DNA, 25 bp, Mus musculus
ctgccgcgcagtcgccgcttcttcc

SEQ ID NO: 273044 - DNA, 25 bp, Mus musculus
cgcccgctccttacgtaacctcgtg

SEQ ID NO: 273045 - DNA, 25 bp, Mus musculus
cgccgttccattccgccggctgcgc

SEQ ID NO: 273046 - DNA, 25 bp, Mus musculus
gctctccgcccgctcggcagctgct

SEQ ID NO: 273047 - DNA, 25 bp, Mus musculus
ccatctccggcgctgctcgtgcggc

SEQ ID NO: 273048 - DNA, 25 bp, Mus musculus
gggcgctccgcgagctcactcaccc

SEQ ID NO: 273049 - DNA, 25 bp, Mus musculus
agctcccgccgcagcacgcgaccgg

SEQ ID NO: 273050 - DNA, 25 bp, Mus musculus
tccaggcgcaaagtccgcgcccagg

SEQ ID NO: 273051 - DNA, 25 bp, Mus musculus
gccgtgggctccaggcgcaaagtcc

SEQ ID NO: 273052 - DNA, 25 bp, Mus musculus
cccggctggctgagacgggaagggc

SEQ ID NO: 273053 - DNA, 25 bp, Mus musculus
ccctgccaagcttggcgccgcgcct

SEQ ID NO: 273054 - DNA, 25 bp, Mus musculus
cggaatggccgaggcgccgagacca

SEQ ID NO: 273055 - DNA, 25 bp, Mus musculus
ccgccaggtgtctccgcgcccggct

SEQ ID NO: 273056 - DNA, 25 bp, Mus musculus
ggatttcgggtttgcgtctctgagc

SEQ ID NO: 273057 - DNA, 25 bp, Mus musculus
agcctccgggcgatagttgcggcac

SEQ ID NO: 273058 - DNA, 25 bp, Mus musculus
atagttgcggcacgcgctactcgca

SEQ ID NO: 273059 - DNA, 25 bp, Mus musculus
aaagtgcgcgcgaaatctgtgtggc

SEQ ID NO: 273060 - DNA, 25 bp, Mus musculus
cgcgaaatctgtgtggcgcgaattt

SEQ ID NO: 273061 - DNA, 25 bp, Mus musculus
tccggcaaagtgatttggagaggca

SEQ ID NO: 273062 - DNA, 25 bp, Mus musculus
tcatccacagggaggacaggcttgg

SEQ ID NO: 273063 - DNA, 25 bp, Mus musculus
tcccagcatgctgtgcgggacagcg

SEQ ID NO: 273064 - DNA, 25 bp, Mus musculus
tctgtcccatttctaggctgcctca

SEQ ID NO: 273065 - DNA, 25 bp, Mus musculus
aggctcaccggctcatccacaggga

SEQ ID NO: 273066 - DNA, 25 bp, Mus musculus
cgcttgtcgccagtgagctttgcag

SEQ ID NO: 273067 - DNA, 25 bp, Mus musculus
gctgcctcacgctctagagactaca

SEQ ID NO: 273068 - DNA, 25 bp, Mus musculus
cgagagtgccgagcgcttgtcgcca

SEQ ID NO: 273069 - DNA, 25 bp, Mus musculus
ccagtgagctttgcaggttccgggt

SEQ ID NO: 273070 - DNA, 25 bp, Mus musculus
agttctggaaggagccgctttgtcc

SEQ ID NO: 273071 - DNA, 25 bp, Mus musculus
ccgcacatggcggatgaatctccca

SEQ ID NO: 273072 - DNA, 25 bp, Mus musculus
tcccatgaagggtgagtaccgcaca

SEQ ID NO: 273073 - DNA, 25 bp, Mus musculus
cctgagcgtttgtttaccttggaga

SEQ ID NO: 273074 - DNA, 25 bp, Mus musculus
agacttggcacgagactccgcctta

SEQ ID NO: 273075 - DNA, 25 bp, Mus musculus
gcgtgggttcgtctctgcaaacaca

SEQ ID NO: 273076 - DNA, 25 bp, Mus musculus
gcatcgcccaagcagagcagtctcg

SEQ ID NO: 273077 - DNA, 25 bp, Mus musculus
atagacaacggtgcgcaggagcctt

SEQ ID NO: 273078 - DNA, 25 bp, Mus musculus
atgcgcagtggttagtcagtcatcc

SEQ ID NO: 273079 - DNA, 25 bp, Mus musculus
ggcactgccagttcgagggatttta

SEQ ID NO: 273080 - DNA, 25 bp, Mus musculus
agacttcccgtaccagtgcaccagg

SEQ ID NO: 273081 - DNA, 25 bp, Mus musculus
aggcaaagctctgtgcggttctcta

SEQ ID NO: 273082 - DNA, 25 bp, Mus musculus
ccgtgcctgacctagcttgtagctg

SEQ ID NO: 273083 - DNA, 25 bp, Mus musculus
ccggctttggggtctccattgacaa

SEQ ID NO: 273084 - DNA, 25 bp, Mus musculus
cctcagcccgcttggtggatgagct

SEQ ID NO: 273085 - DNA, 25 bp, Mus musculus
gaccttcccaagcatcgcctgcctg

SEQ ID NO: 273086 - DNA, 25 bp, Mus musculus
ccaccgccgggaatggcgacactga

SEQ ID NO: 273087 - DNA, 25 bp, Mus musculus
gacagcacccttcaacggcaaagcg

SEQ ID NO: 273088 - DNA, 25 bp, Mus musculus
tggaatgtgacagcacccttcaacg

SEQ ID NO: 273089 - DNA, 25 bp, Mus musculus
acaattccgctactggaatgtgaca

SEQ ID NO: 273090 - DNA, 25 bp, Mus musculus
actcgcccagcccaaggtcactcgg

SEQ ID NO: 273091 - DNA, 25 bp, Mus musculus
ggcgacagacaattccgctactgga

SEQ ID NO: 273092 - DNA, 25 bp, Mus musculus
gcccgggcgacagacaattccgcta

SEQ ID NO: 273093 - DNA, 25 bp, Mus musculus
cgtcttctagtctgcccactcgatt

SEQ ID NO: 273094 - DNA, 25 bp, Mus musculus
tagtctgcccactcgattatgaagc

SEQ ID NO: 273095 - DNA, 25 bp, Mus musculus
tgccagttgtacagcggctcgcgct

SEQ ID NO: 273096 - DNA, 25 bp, Mus musculus
actcgattatgaagcccgggcgaca

SEQ ID NO: 273097 - DNA, 25 bp, Mus musculus
ctgccttccgggaaaggcgcttccg

SEQ ID NO: 273098 - DNA, 25 bp, Mus musculus
ttgcgttcgttagcaggagcctggt

SEQ ID NO: 273099 - DNA, 25 bp, Mus musculus
tccttttcccattaaagcaagcgtc

SEQ ID NO: 273100 - DNA, 25 bp, Mus musculus
cccattaaagcaagcgtcctggggc

SEQ ID NO: 273101 - DNA, 25 bp, Mus musculus
gtcctggggcgcttgtctcctcgcg

SEQ ID NO: 273102 - DNA, 25 bp, Mus musculus
ctgagcccttgcgttcgttagcagg

SEQ ID NO: 273103 - DNA, 25 bp, Mus musculus
tgggtagcttccagaaacgccacgc

SEQ ID NO: 273104 - DNA, 25 bp, Mus musculus
ctctggggatcgtacagcggcccta

SEQ ID NO: 273105 - DNA, 25 bp, Mus musculus
cgatgcggtgaaagaagagcgaccc

SEQ ID NO: 273106 - DNA, 25 bp, Mus musculus
acccggaggtggcaatgagtgcctc

SEQ ID NO: 273107 - DNA, 25 bp, Mus musculus
gggggtttttgtgctgtccctctca

SEQ ID NO: 273108 - DNA, 25 bp, Mus musculus
acctggcggcccagcacgagtgagt

SEQ ID NO: 273109 - DNA, 25 bp, Mus musculus
gacaagagcccgcaacttttccgcg

SEQ ID NO: 273110 - DNA, 25 bp, Mus musculus
cggctttgggactgggtagcttcca

SEQ ID NO: 273111 - DNA, 25 bp, Mus musculus
tcctcgcggtggctgctgagccctt

SEQ ID NO: 273112 - DNA, 25 bp, Mus musculus
tgcgcagcacagctcgcggttcagc

SEQ ID NO: 273113 - DNA, 25 bp, Mus musculus
caggtctcccgctttgtactcgcgg

SEQ ID NO: 273114 - DNA, 25 bp, Mus musculus
agcttctgggttccgtgcgagctcc

SEQ ID NO: 273115 - DNA, 25 bp, Mus musculus
ggcctcgcgcctcctccgaattcct

SEQ ID NO: 273116 - DNA, 25 bp, Mus musculus
ctcgggcagcgaccgcaaacacgat

SEQ ID NO: 273117 - DNA, 25 bp, Mus musculus
ccgccggcttccatgaggaaggcga

SEQ ID NO: 273118 - DNA, 25 bp, Mus musculus
tttctcggagaaaccgcgcgcgccg

SEQ ID NO: 273119 - DNA, 25 bp, Mus musculus
ccgccttcgaacgtgggcgtcagga

SEQ ID NO: 273120 - DNA, 25 bp, Mus musculus
cgaagaccaggtctcccgctttgta

SEQ ID NO: 273121 - DNA, 25 bp, Mus musculus
gcacggccggctttctcggagaaac

SEQ ID NO: 273122 - DNA, 25 bp, Mus musculus
taattcctaggtgcacggccggctt

SEQ ID NO: 273123 - DNA, 25 bp, Mus musculus
gccggccggttaattcctaggtgca

SEQ ID NO: 273124 - DNA, 25 bp, Mus musculus
gatcttattattgttctcgcgcgcg

SEQ ID NO: 273125 - DNA, 25 bp, Mus musculus
ggcgcgccatcatgaagggaaaatg

SEQ ID NO: 273126 - DNA, 25 bp, Mus musculus
aacgcactccttcagcgcggttcaa

SEQ ID NO: 273127 - DNA, 25 bp, Mus musculus
cacggcttgaaataccagacagatg

SEQ ID NO: 273128 - DNA, 25 bp, Mus musculus
cacaggctgcgaggaactgcagttc

SEQ ID NO: 273129 - DNA, 25 bp, Mus musculus
agggcgaaacgctctctgaagttcc

SEQ ID NO: 273130 - DNA, 25 bp, Mus musculus
agacagacgtgtcggtgtttgcctc

SEQ ID NO: 273131 - DNA, 25 bp, Mus musculus
acgcagagtcgcctcggttgaggcc

SEQ ID NO: 273132 - DNA, 25 bp, Mus musculus
acagatggacgtccctgcgccaaca

SEQ ID NO: 273133 - DNA, 25 bp, Mus musculus
aagcaaggatttgtccctcagggga

SEQ ID NO: 273134 - DNA, 25 bp, Mus musculus
ctcctcccgggatgaccgaaggtca

SEQ ID NO: 273135 - DNA, 25 bp, Mus musculus
cgcggttcaactgcgagcatccgtc

SEQ ID NO: 273136 - DNA, 25 bp, Mus musculus
gcggcgcttttggtcttttgtctct

SEQ ID NO: 273137 - DNA, 25 bp, Mus musculus
tctaactaagctgacggtttgcggc

SEQ ID NO: 273138 - DNA, 25 bp, Mus musculus
gagcatccgtcctcttcagacacgt

SEQ ID NO: 273139 - DNA, 25 bp, Mus musculus
cgggcttgaaggcacttgttgagaa

SEQ ID NO: 273140 - DNA, 25 bp, Mus musculus
aggatcggtcacctctacctccaga

SEQ ID NO: 273141 - DNA, 25 bp, Mus musculus
tccagagctctgagccggctttcgc

SEQ ID NO: 273142 - DNA, 25 bp, Mus musculus
cctggggatcttaggtggatacgtc

SEQ ID NO: 273143 - DNA, 25 bp, Mus musculus
gggcttattagccaccctggggatc

SEQ ID NO: 273144 - DNA, 25 bp, Mus musculus
ttagaggcgcttctagcgacacgtg

SEQ ID NO: 273145 - DNA, 25 bp, Mus musculus
gcctgaccttcgtgtagccggaaag

SEQ ID NO: 273146 - DNA, 25 bp, Mus musculus
accattttctttcgatctcaagggg

SEQ ID NO: 273147 - DNA, 25 bp, Mus musculus
cgtggctcagtctcgcgaaaaacct

SEQ ID NO: 273148 - DNA, 25 bp, Mus musculus
ggacagaagatagacgcgtggctca

SEQ ID NO: 273149 - DNA, 25 bp, Mus musculus
aggttcccaaactcgcggcccatgg

SEQ ID NO: 273150 - DNA, 25 bp, Mus musculus
agatcacgtgccgtatccgcgccag

SEQ ID NO: 273151 - DNA, 25 bp, Mus musculus
cgcgctgctcaaagggcgacaagct

SEQ ID NO: 273152 - DNA, 25 bp, Mus musculus
tggggatgcctttgctgaaatagct

SEQ ID NO: 273153 - DNA, 25 bp, Mus musculus
cgagcctagagaacgtgaagtcatt

SEQ ID NO: 273154 - DNA, 25 bp, Mus musculus
aagaccgtggtaggcctccctcctg

SEQ ID NO: 273155 - DNA, 25 bp, Mus musculus
cccggaatctctcgtctgtccgttg

SEQ ID NO: 273156 - DNA, 25 bp, Mus musculus
atggactcggggtcttcatcggctt

SEQ ID NO: 273157 - DNA, 25 bp, Mus musculus
catcggcttccttcggactgggttt

SEQ ID NO: 273158 - DNA, 25 bp, Mus musculus
cgccctggcggttgtaaatctgagc

SEQ ID NO: 273159 - DNA, 25 bp, Mus musculus
caacaatgaagcgtgggcggtccta

SEQ ID NO: 273160 - DNA, 25 bp, Mus musculus
aatctgagcagttcggctggcaagg

SEQ ID NO: 273161 - DNA, 25 bp, Mus musculus
gaggagagcttttgggaccaagacc

SEQ ID NO: 273162 - DNA, 25 bp, Mus musculus
agcgcctgtgccagtgtgacagcgc

SEQ ID NO: 273163 - DNA, 25 bp, Mus musculus
acacggtgttgctatctgcgcgagc

SEQ ID NO: 273164 - DNA, 25 bp, Mus musculus
ggggcctcgaaacacggtgttgcta

SEQ ID NO: 273165 - DNA, 25 bp, Mus musculus
cgaggctcgaccaatgggctgcgtt

SEQ ID NO: 273166 - DNA, 25 bp, Mus musculus
ggcggtcctagaagcttcatttgca

SEQ ID NO: 273167 - DNA, 25 bp, Mus musculus
aggacgctcttcttgcgccctggct

SEQ ID NO: 273168 - DNA, 25 bp, Mus musculus
ccatttaactttggcggcggcgcga

SEQ ID NO: 273169 - DNA, 25 bp, Mus musculus
gggatccagggattcatctctctga

SEQ ID NO: 273170 - DNA, 25 bp, Mus musculus
gccaggccttaatgctttctccaga

SEQ ID NO: 273171 - DNA, 25 bp, Mus musculus
ataaggtcttggttgagcactgccc

SEQ ID NO: 273172 - DNA, 25 bp, Mus musculus
ctgcgactccggattggaaacaccc

SEQ ID NO: 273173 - DNA, 25 bp, Mus musculus
tgccctatggggcttagacagctcc

SEQ ID NO: 273174 - DNA, 25 bp, Mus musculus
cgcgctacaggatccgggaatgttg

SEQ ID NO: 273175 - DNA, 25 bp, Mus musculus
cggactacgggctgatcttagcttg

SEQ ID NO: 273176 - DNA, 25 bp, Mus musculus
cttagcttgcagtgtttgaaggtcc

SEQ ID NO: 273177 - DNA, 25 bp, Mus musculus
ctactgagtgaggttcgcatgcttg

SEQ ID NO: 273178 - DNA, 25 bp, Mus musculus
tcgcatgcttgaagcgcagagaaac

SEQ ID NO: 273179 - DNA, 25 bp, Mus musculus
caggtcggaaacagcagcacatttg

SEQ ID NO: 273180 - DNA, 25 bp, Mus musculus
tgcggatcgcattaagccaggcctt

SEQ ID NO: 273181 - DNA, 25 bp, Mus musculus
ttgatgggaacgctactggaaaata

SEQ ID NO: 273182 - DNA, 25 bp, Mus musculus
agacaccagttcctcatgctctgcg

SEQ ID NO: 273183 - DNA, 25 bp, Mus musculus
acagcgtccgccgtcgtcaaggcga

SEQ ID NO: 273184 - DNA, 25 bp, Mus musculus
gtgcaaatctggcacagacaccagt

SEQ ID NO: 273185 - DNA, 25 bp, Mus musculus
cggacgtttcttacccgcaggtgca

SEQ ID NO: 273186 - DNA, 25 bp, Mus musculus
cgcaggcttaggctggcacacttca

SEQ ID NO: 273187 - DNA, 25 bp, Mus musculus
tgtcccgagcggctgcactttatag

SEQ ID NO: 273188 - DNA, 25 bp, Mus musculus
ctcctgcgacttccggtctgagcta

SEQ ID NO: 273189 - DNA, 25 bp, Mus musculus
gtcagaggtcacaggcccacaggcc

SEQ ID NO: 273190 - DNA, 25 bp, Mus musculus
ttccggtgatgttctagatgcgcgc

SEQ ID NO: 273191 - DNA, 25 bp, Mus musculus
ctccaagttgaagggaaacgacgtg

SEQ ID NO: 273192 - DNA, 25 bp, Mus musculus
atagggacccggtactctcagcggc

SEQ ID NO: 273193 - DNA, 25 bp, Mus musculus
ggcgaccgcggaactccaagttgaa

SEQ ID NO: 273194 - DNA, 25 bp, Mus musculus
ggctgcactttatagggacccggta

SEQ ID NO: 273195 - DNA, 25 bp, Mus musculus
tggcacacttcagagcagctacagc

SEQ ID NO: 273196 - DNA, 25 bp, Mus musculus
gggctatttattcctcgagcgtttc

SEQ ID NO: 273197 - DNA, 25 bp, Mus musculus
ggctgcaccttctagctgccgagca

SEQ ID NO: 273198 - DNA, 25 bp, Mus musculus
gcccagctcgctgtttgcagacctg

SEQ ID NO: 273199 - DNA, 25 bp, Mus musculus
tggatgaccaaagagccctgcagct

SEQ ID NO: 273200 - DNA, 25 bp, Mus musculus
ttgcgctcgatcagctctccctgtt

SEQ ID NO: 273201 - DNA, 25 bp, Mus musculus
tctccctgttgggactggacagtga

SEQ ID NO: 273202 - DNA, 25 bp, Mus musculus
gggcgcctctttgtacgacagcgaa

SEQ ID NO: 273203 - DNA, 25 bp, Mus musculus
ttccgaacacgtcgcggagatcgta

SEQ ID NO: 273204 - DNA, 25 bp, Mus musculus
ggccggcgcactagacaaagaaagt

SEQ ID NO: 273205 - DNA, 25 bp, Mus musculus
cgggatgcactttctcctgctaaaa

SEQ ID NO: 273206 - DNA, 25 bp, Mus musculus
ctccagagtctagggatcgcggctt

SEQ ID NO: 273207 - DNA, 25 bp, Mus musculus
caatcagtgtgctcagttggatacc

SEQ ID NO: 273208 - DNA, 25 bp, Mus musculus
gctttgcttgggacgactgcagtta

SEQ ID NO: 273209 - DNA, 25 bp, Mus musculus
ggccaggcagccaatgggctattta

SEQ ID NO: 273210 - DNA, 25 bp, Mus musculus
aatggacccgtcctgggccacgcaa

SEQ ID NO: 273211 - DNA, 25 bp, Mus musculus
agctttcctcccagcagaacctgtg

SEQ ID NO: 273212 - DNA, 25 bp, Mus musculus
ctcccagcagaacctgtgtggcaca

SEQ ID NO: 273213 - DNA, 25 bp, Mus musculus
cagaacctgtgtggcacagctggga

SEQ ID NO: 273214 - DNA, 25 bp, Mus musculus
agcctgcacgttggcggaatggacc

SEQ ID NO: 273215 - DNA, 25 bp, Mus musculus
cacgttggcggaatggacccgtcct

SEQ ID NO: 273216 - DNA, 25 bp, Mus musculus
aaaaccaattcagaaagagaggcgg

SEQ ID NO: 273217 - DNA, 25 bp, Mus musculus
aaggacggaattgtctgagagcgaa

SEQ ID NO: 273218 - DNA, 25 bp, Mus musculus
gccaatatcaagaaaggacggaatt

SEQ ID NO: 273219 - DNA, 25 bp, Mus musculus
ttgtctgagagcgaaaaccaattca

SEQ ID NO: 273220 - DNA, 25 bp, Mus musculus
acgcttactgcgcagggcgggccaa

SEQ ID NO: 273221 - DNA, 25 bp, Mus musculus
cgcccagagatgacgcttactgcgc

SEQ ID NO: 273222 - DNA, 25 bp, Mus musculus
cgtcctgggccacgcaagagagtga

SEQ ID NO: 273223 - DNA, 25 bp, Mus musculus
cagggcgggccaatatcaagaaagg

SEQ ID NO: 273224 - DNA, 25 bp, Mus musculus
cccgcttcagcgctgcgcgcacaca

SEQ ID NO: 273225 - DNA, 25 bp, Mus musculus
cggcggagcgtttccgtccgaccag

SEQ ID NO: 273226 - DNA, 25 bp, Mus musculus
cgccacatagcgagccgacaataaa

SEQ ID NO: 273227 - DNA, 25 bp, Mus musculus
catctcactgaacgacatggcgcgc

SEQ ID NO: 273228 - DNA, 25 bp, Mus musculus
gcggttcatctcactgaacgacatg

SEQ ID NO: 273229 - DNA, 25 bp, Mus musculus
aatgcaccggggtagcagtaaccgc

SEQ ID NO: 273230 - DNA, 25 bp, Mus musculus
gccgacaataaagccggcggagcgt

SEQ ID NO: 273231 - DNA, 25 bp, Mus musculus
aacaacggaccgtgcgcccacaatg

SEQ ID NO: 273232 - DNA, 25 bp, Mus musculus
gccggctcggccaggacaaacagct

SEQ ID NO: 273233 - DNA, 25 bp, Mus musculus
tggcaaatgaacaacggaccgtgcg

SEQ ID NO: 273234 - DNA, 25 bp, Mus musculus
cacgacttcacctgggactccagga

SEQ ID NO: 273235 - DNA, 25 bp, Mus musculus
acctgggactccaggagtaagtgcg

SEQ ID NO: 273236 - DNA, 25 bp, Mus musculus
tggccgtgcccgaggaagtgaactt

SEQ ID NO: 273237 - DNA, 25 bp, Mus musculus
gcggaggtcgaatggcaaatgaaca

SEQ ID NO: 273238 - DNA, 25 bp, Mus musculus
gcaggtcggccaccagctgcatctt

SEQ ID NO: 273239 - DNA, 25 bp, Mus musculus
gagaagccgcctcgccagtgggctt

SEQ ID NO: 273240 - DNA, 25 bp, Mus musculus
caagcccgcggcaagctcttcgggg

SEQ ID NO: 273241 - DNA, 25 bp, Mus musculus
gggcacggcagactcctagtccgcg

SEQ ID NO: 273242 - DNA, 25 bp, Mus musculus
agatagataccagcctcttccgcgg

SEQ ID NO: 273243 - DNA, 25 bp, Mus musculus
cttgcccttgcagtgatcacagata

SEQ ID NO: 273244 - DNA, 25 bp, Mus musculus
gaaggactccgcaccagcgccaggg

SEQ ID NO: 273245 - DNA, 25 bp, Mus musculus
tcctgctccggctcttaaggcgctg

SEQ ID NO: 273246 - DNA, 25 bp, Mus musculus
cctcgctagacagcagcagcaggtc

SEQ ID NO: 273247 - DNA, 25 bp, Mus musculus
ggctatccggctcagcagcgcacgt

SEQ ID NO: 273248 - DNA, 25 bp, Mus musculus
gctttgctgtcagccgctgcgctgc

SEQ ID NO: 273249 - DNA, 25 bp, Mus musculus
gaaatcaaaatcctctgctcctaga

SEQ ID NO: 273250 - DNA, 25 bp, Mus musculus
gctgtcgccaccttcctgggcatgg

SEQ ID NO: 273251 - DNA, 25 bp, Mus musculus
ttcactagcctaccagaaaagtccc

SEQ ID NO: 273252 - DNA, 25 bp, Mus musculus
tcctaatgcctacgcggcggacact

SEQ ID NO: 273253 - DNA, 25 bp, Mus musculus
caagtactgggtttagttctgcgca

SEQ ID NO: 273254 - DNA, 25 bp, Mus musculus
tccacggaaaaagaaggacatccgc

SEQ ID NO: 273255 - DNA, 25 bp, Mus musculus
cgcggttctactgtttctgtgtgcc

SEQ ID NO: 273256 - DNA, 25 bp, Mus musculus
aggctgctaacatggctgcctccag

SEQ ID NO: 273257 - DNA, 25 bp, Mus musculus
ccgcgattacaacgatgccgacatg

SEQ ID NO: 273258 - DNA, 25 bp, Mus musculus
cagtccgttacgctaggctgctaac

SEQ ID NO: 273259 - DNA, 25 bp, Mus musculus
gtgccttacgctgggcagtccgtta

SEQ ID NO: 273260 - DNA, 25 bp, Mus musculus
gtctgcgcaggctcattgtgcctta

SEQ ID NO: 273261 - DNA, 25 bp, Mus musculus
tgtgcctcggaccttctgttgctcc

SEQ ID NO: 273262 - DNA, 25 bp, Mus musculus
gttctgcgcagaacacgcttaggga

SEQ ID NO: 273263 - DNA, 25 bp, Mus musculus
tgcggtaggctacggactcctcgga

SEQ ID NO: 273264 - DNA, 25 bp, Mus musculus
gtccggacaggaggaaccagaacga

SEQ ID NO: 273265 - DNA, 25 bp, Mus musculus
aacacgcttagggactggattggaa

SEQ ID NO: 273266 - DNA, 25 bp, Mus musculus
ctccggtcctcttacctcaggttga

SEQ ID NO: 273267 - DNA, 25 bp, Mus musculus
aggttgatgaccgagaccctgccac

SEQ ID NO: 273268 - DNA, 25 bp, Mus musculus
ccacgcctcggggatctggagtgca

SEQ ID NO: 273269 - DNA, 25 bp, Mus musculus
gtgcagcatcccgtagtctagtatc

SEQ ID NO: 273270 - DNA, 25 bp, Mus musculus
gtctagtatctgatcccacgcgttg

SEQ ID NO: 273271 - DNA, 25 bp, Mus musculus
cccacgcgttgagctcctgagcgta

SEQ ID NO: 273272 - DNA, 25 bp, Mus musculus
ctcctgagcgtaagcaagtgggacg

SEQ ID NO: 273273 - DNA, 25 bp, Mus musculus
aaagtggggtgcagattccgacctc

SEQ ID NO: 273274 - DNA, 25 bp, Mus musculus
gattccgacctcactcggcacagtg

SEQ ID NO: 273275 - DNA, 25 bp, Mus musculus
cgcgcgctcactggcttagtagcta

SEQ ID NO: 273276 - DNA, 25 bp, Mus musculus
ccagcccgagccgacgctttttata

SEQ ID NO: 273277 - DNA, 25 bp, Mus musculus
ttttatagtcgccttccgggcctga

SEQ ID NO: 273278 - DNA, 25 bp, Mus musculus
cctaggacgaaagctgcggacctcc

SEQ ID NO: 273279 - DNA, 25 bp, Mus musculus
gcttagtagctagctcggagctgcc

SEQ ID NO: 273280 - DNA, 25 bp, Mus musculus
cgagcccaggccgatgtagaagcta

SEQ ID NO: 273281 - DNA, 25 bp, Mus musculus
cccgagtagtcgtaagagaagatgt

SEQ ID NO: 273282 - DNA, 25 bp, Mus musculus
ctcgagcgaatgcaacaatccggga

SEQ ID NO: 273283 - DNA, 25 bp, Mus musculus
gcgtcgatgtcagcgtagagattct

SEQ ID NO: 273284 - DNA, 25 bp, Mus musculus
atctggcccaagtccacggcgttgc

SEQ ID NO: 273285 - DNA, 25 bp, Mus musculus
cggagctcacaccatagcccgagta

SEQ ID NO: 273286 - DNA, 25 bp, Mus musculus
atgttgcagttgatgcgcgagccca

SEQ ID NO: 273287 - DNA, 25 bp, Mus musculus
gtagaagctacacatctggcccaag

SEQ ID NO: 273288 - DNA, 25 bp, Mus musculus
gagaagaagacctcgacggcgtcca

SEQ ID NO: 273289 - DNA, 25 bp, Mus musculus
ccagttcgcgctgcgagtactgcca

SEQ ID NO: 273290 - DNA, 25 bp, Mus musculus
gggcagcagaagagccagcacagct

SEQ ID NO: 273291 - DNA, 25 bp, Mus musculus
gctcgccgagcgagaagccgttcat

SEQ ID NO: 273292 - DNA, 25 bp, Mus musculus
aacatgcagcccagccggttgtcgc

SEQ ID NO: 273293 - DNA, 25 bp, Mus musculus
agagattcttttcggagggcttgcc

SEQ ID NO: 273294 - DNA, 25 bp, Mus musculus
cgcgaagcagcctgactgaccgtca

SEQ ID NO: 273295 - DNA, 25 bp, Mus musculus
agcgcgtggtccacagatctgcttc

SEQ ID NO: 273296 - DNA, 25 bp, Mus musculus
gacacacagcgcgtggtccacagat

SEQ ID NO: 273297 - DNA, 25 bp, Mus musculus
atcgccggcgccctgaagtgcgtct

SEQ ID NO: 273298 - DNA, 25 bp, Mus musculus
gctcggatgtcactgagggatcgcc

SEQ ID NO: 273299 - DNA, 25 bp, Mus musculus
cacgtacagaatcgcaagaggaagg

SEQ ID NO: 273300 - DNA, 25 bp, Mus musculus
gactagggccacgtacagaatcgca

SEQ ID NO: 273301 - DNA, 25 bp, Mus musculus
ttctctgcggtggttagaggtccag

SEQ ID NO: 273302 - DNA, 25 bp, Mus musculus
gaggatttcgatcgccctccggctc

SEQ ID NO: 273303 - DNA, 25 bp, Mus musculus
gactgaccgtcattctgtctggacc

SEQ ID NO: 273304 - DNA, 25 bp, Mus musculus
cagtgcttggaggatttcgatcgcc

SEQ ID NO: 273305 - DNA, 25 bp, Mus musculus
gatccggcagtgcttggaggatttc

SEQ ID NO: 273306 - DNA, 25 bp, Mus musculus
ccgtcattctgtctggaccttccga

SEQ ID NO: 273307 - DNA, 25 bp, Mus musculus
tggaccttccgacccggagtccaga

SEQ ID NO: 273308 - DNA, 25 bp, Mus musculus
ataggcgaaagagtcccaggagttc

SEQ ID NO: 273309 - DNA, 25 bp, Mus musculus
gacacatcgccgagaggcgctgtcc

SEQ ID NO: 273310 - DNA, 25 bp, Mus musculus
ccaggtatcagggacacatcgccga

SEQ ID NO: 273311 - DNA, 25 bp, Mus musculus
ggttagaggcctcggcgcactccct

SEQ ID NO: 273312 - DNA, 25 bp, Mus musculus
cgcaggtgcccaggttagaggcctc

SEQ ID NO: 273313 - DNA, 25 bp, Mus musculus
tccgagccgtagcaccgcgagactt

SEQ ID NO: 273314 - DNA, 25 bp, Mus musculus
ctcctccgggttcagcctttgtggt

SEQ ID NO: 273315 - DNA, 25 bp, Mus musculus
ggccgcgccacacaaaggaaggtgc

SEQ ID NO: 273316 - DNA, 25 bp, Mus musculus
ctactcacccggagggttgacggcg

SEQ ID NO: 273317 - DNA, 25 bp, Mus musculus
attcgagaacgaggatgccacggcc

SEQ ID NO: 273318 - DNA, 25 bp, Mus musculus
ccaggttgagcaccattcgagaacg

SEQ ID NO: 273319 - DNA, 25 bp, Mus musculus
gccgtcaggaccaggttgagcacca

SEQ ID NO: 273320 - DNA, 25 bp, Mus musculus
gcatctagttacacgcagcagcggc

SEQ ID NO: 273321 - DNA, 25 bp, Mus musculus
cccgcgggcgagcatctagttacac

SEQ ID NO: 273322 - DNA, 25 bp, Mus musculus
acccggagcatccttccggatgggc

SEQ ID NO: 273323 - DNA, 25 bp, Mus musculus
tttctccctgccgtttccgcttgaa

SEQ ID NO: 273324 - DNA, 25 bp, Mus musculus
tccgcttgaacagcgtccaagtctc

SEQ ID NO: 273325 - DNA, 25 bp, Mus musculus
gcgtccaagtctcgcctttaaaatg

SEQ ID NO: 273326 - DNA, 25 bp, Mus musculus
ctttaaaatgccagggcggcctcgg

SEQ ID NO: 273327 - DNA, 25 bp, Mus musculus
agcctgcctggagccacccgaggag

SEQ ID NO: 273328 - DNA, 25 bp, Mus musculus
acccgaggagcaccgcagcgcttga

SEQ ID NO: 273329 - DNA, 25 bp, Mus musculus
accgcagcgcttgagccgcgggctt

SEQ ID NO: 273330 - DNA, 25 bp, Mus musculus
ggcccgtttaggtccctgagcgcat

SEQ ID NO: 273331 - DNA, 25 bp, Mus musculus
tccctgagcgcatcggactcgcttg

SEQ ID NO: 273332 - DNA, 25 bp, Mus musculus
tcggactcgcttggccaggtaagac

SEQ ID NO: 273333 - DNA, 25 bp, Mus musculus
ccaggtaagactgcaggagcatcac

SEQ ID NO: 273334 - DNA, 25 bp, Mus musculus
tgcaggagcatcacccggagcatcc

SEQ ID NO: 273335 - DNA, 25 bp, Mus musculus
tcccggagcaggaggcactgcaccg

SEQ ID NO: 273336 - DNA, 25 bp, Mus musculus
ggtccaccctccgtactatccagca

SEQ ID NO: 273337 - DNA, 25 bp, Mus musculus
atgtgcccggagtcctggggtcacc

SEQ ID NO: 273338 - DNA, 25 bp, Mus musculus
gatgtgcccggagccctgggatctt

SEQ ID NO: 273339 - DNA, 25 bp, Mus musculus
tcatcctccctagatgtgcccggag

SEQ ID NO: 273340 - DNA, 25 bp, Mus musculus
tctggatatacaagacattctcctc

SEQ ID NO: 273341 - DNA, 25 bp, Mus musculus
gcctcatcggtctggatatacaaga

SEQ ID NO: 273342 - DNA, 25 bp, Mus musculus
tcttctcgggcgacctctacgagtc

SEQ ID NO: 273343 - DNA, 25 bp, Mus musculus
ctagtgattcttttagcacccgccc

SEQ ID NO: 273344 - DNA, 25 bp, Mus musculus
cccaccctagtgattcttttagcac

SEQ ID NO: 273345 - DNA, 25 bp, Mus musculus
gagggcctttagattcagggaccgc

SEQ ID NO: 273346 - DNA, 25 bp, Mus musculus
tgcttagggcaaggatcagactagc

SEQ ID NO: 273347 - DNA, 25 bp, Mus musculus
tggctaacgggactatgcttagggc

SEQ ID NO: 273348 - DNA, 25 bp, Mus musculus
tacgagtccaggaccgcctcatcgg

SEQ ID NO: 273349 - DNA, 25 bp, Mus musculus
atcagactagccgagggcctttaga

SEQ ID NO: 273350 - DNA, 25 bp, Mus musculus
ccctctccgccggacgcgctgccgc

SEQ ID NO: 273351 - DNA, 25 bp, Mus musculus
ggaccgcgccctccgctcgccactg

SEQ ID NO: 273352 - DNA, 25 bp, Mus musculus
gctcgccactgcgaggccacctgct

SEQ ID NO: 273353 - DNA, 25 bp, Mus musculus
attggctctcaacgcgcgctgacgc

SEQ ID NO: 273354 - DNA, 25 bp, Mus musculus
tgcccgcactcctcacctggcggcg

SEQ ID NO: 273355 - DNA, 25 bp, Mus musculus
gccgccgctgagagtgaggacaggt

SEQ ID NO: 273356 - DNA, 25 bp, Mus musculus
gaggacaggtgaggccgccaaaccc

SEQ ID NO: 273357 - DNA, 25 bp, Mus musculus
ttaaacttttctgtttggctgctcg

SEQ ID NO: 273358 - DNA, 25 bp, Mus musculus
aaacttttctgtttggctgctcggc

SEQ ID NO: 273359 - DNA, 25 bp, Mus musculus
cggcctcaagggagcgcccgcgatt

SEQ ID NO: 273360 - DNA, 25 bp, Mus musculus
gagcgcccgcgattggctctcaacg

SEQ ID NO: 273361 - DNA, 25 bp, Mus musculus
cgcgattggctctcaacgcgcgctg

SEQ ID NO: 273362 - DNA, 25 bp, Mus musculus
gcgctgacgcggcagtcccagcccg

SEQ ID NO: 273363 - DNA, 25 bp, Mus musculus
ccgcccggaggctgcgcccaccgct

SEQ ID NO: 273364 - DNA, 25 bp, Mus musculus
gccacaacaacaggctcgcgcgaga

SEQ ID NO: 273365 - DNA, 25 bp, Mus musculus
ggacgtcctgaaccgccgccacaac

SEQ ID NO: 273366 - DNA, 25 bp, Mus musculus
atgtctgcagctggacaggcccggc

SEQ ID NO: 273367 - DNA, 25 bp, Mus musculus
cattctcgcatctggggcatgtctg

SEQ ID NO: 273368 - DNA, 25 bp, Mus musculus
ggatgcaaagaacgtccccaagctt

SEQ ID NO: 273369 - DNA, 25 bp, Mus musculus
aagcttccgattcccattctcgcat

SEQ ID NO: 273370 - DNA, 25 bp, Mus musculus
agactcagtacagcctttgaccctc

SEQ ID NO: 273371 - DNA, 25 bp, Mus musculus
cactgatcgctcctttcggtcctga

SEQ ID NO: 273372 - DNA, 25 bp, Mus musculus
agccaggcctccagactcagtacag

SEQ ID NO: 273373 - DNA, 25 bp, Mus musculus
atctggggcatgtctgcagctggac

SEQ ID NO: 273374 - DNA, 25 bp, Mus musculus
ttcggtcctgagcaccgagcagggc

SEQ ID NO: 273375 - DNA, 25 bp, Mus musculus
gcctccagactcagtacagcctttg

SEQ ID NO: 273376 - DNA, 25 bp, Mus musculus
cgggtggagacctccagccaggcct

SEQ ID NO: 273377 - DNA, 25 bp, Mus musculus
caacaacaggctcgcgcgagacaaa

SEQ ID NO: 273378 - DNA, 25 bp, Mus musculus
ctcatcccagggctcgctcatggag

SEQ ID NO: 273379 - DNA, 25 bp, Mus musculus
aagagacgcccgcaggagctgaagc

SEQ ID NO: 273380 - DNA, 25 bp, Mus musculus
gctcatggagcagattagcagcgtg

SEQ ID NO: 273381 - DNA, 25 bp, Mus musculus
agggccatcacctgcccaagagacg

SEQ ID NO: 273382 - DNA, 25 bp, Mus musculus
tcagtacgctgagccacctggcagg

SEQ ID NO: 273383 - DNA, 25 bp, Mus musculus
agctcagccggcgacagggccatca

SEQ ID NO: 273384 - DNA, 25 bp, Mus musculus
atgcacagcgacaggcggcccagag

SEQ ID NO: 273385 - DNA, 25 bp, Mus musculus
cgctttatgatgtcgcagaggcaga

SEQ ID NO: 273386 - DNA, 25 bp, Mus musculus
tgacgaccttcgcagagatccagcc

SEQ ID NO: 273387 - DNA, 25 bp, Mus musculus
ttagcagcgtggtgacgcgcttcac

SEQ ID NO: 273388 - DNA, 25 bp, Mus musculus
agagatccagctgcccacgaccatg

SEQ ID NO: 273389 - DNA, 25 bp, Mus musculus
actccatgatgttgtccaccgcggc

SEQ ID NO: 273390 - DNA, 25 bp, Mus musculus
tgcactcggagaccgctgcacgcag

SEQ ID NO: 273391 - DNA, 25 bp, Mus musculus
tctgccggccatcgaggtgaccgga

SEQ ID NO: 273392 - DNA, 25 bp, Mus musculus
agttgtcaccgggattccagcatcg

SEQ ID NO: 273393 - DNA, 25 bp, Mus musculus
cccacaggcggatctgtcggtcata

SEQ ID NO: 273394 - DNA, 25 bp, Mus musculus
tgtcggtcatactgcgctgcctcct

SEQ ID NO: 273395 - DNA, 25 bp, Mus musculus
gatctggatcgagttgtcaccggga

SEQ ID NO: 273396 - DNA, 25 bp, Mus musculus
cggtcatttatgaagcggatctgga

SEQ ID NO: 273397 - DNA, 25 bp, Mus musculus
atgtccacgcggtcatttatgaagc

SEQ ID NO: 273398 - DNA, 25 bp, Mus musculus
attcctcgaggatgtccacgcggtc

SEQ ID NO: 273399 - DNA, 25 bp, Mus musculus
cgggtgttttgattcctcgaggatg

SEQ ID NO: 273400 - DNA, 25 bp, Mus musculus
tggagacgccaatcaatcccggaga

SEQ ID NO: 273401 - DNA, 25 bp, Mus musculus
ccatcacgtgatggagacgccaatc

SEQ ID NO: 273402 - DNA, 25 bp, Mus musculus
gataccgaagactccaaggcccgct

SEQ ID NO: 273403 - DNA, 25 bp, Mus musculus
agaccacgtggataccgaagactcc

SEQ ID NO: 273404 - DNA, 25 bp, Mus musculus
ctttgcgggagaccacgtggatacc

SEQ ID NO: 273405 - DNA, 25 bp, Mus musculus
tccttctctaccatggcgccggctt

SEQ ID NO: 273406 - DNA, 25 bp, Mus musculus
cctgactgccatcgagtggtgttcc

SEQ ID NO: 273407 - DNA, 25 bp, Mus musculus
tttgggagtctgcaccgtgcgctcc

SEQ ID NO: 273408 - DNA, 25 bp, Mus musculus
gtgcttttgggagtctgcaccgtgc

SEQ ID NO: 273409 - DNA, 25 bp, Mus musculus
tgctggtgcttttgggagtctgcac

SEQ ID NO: 273410 - DNA, 25 bp, Mus musculus
ttgcgcgccgtcctgctgctggtgc

SEQ ID NO: 273411 - DNA, 25 bp, Mus musculus
tccctggacccactccttgcgcgcc

SEQ ID NO: 273412 - DNA, 25 bp, Mus musculus
cgccgtcagcatgggtccctggacc

SEQ ID NO: 273413 - DNA, 25 bp, Mus musculus
agttgaacttgctttctctgccatc

SEQ ID NO: 273414 - DNA, 25 bp, Mus musculus
ccatcgagtggtgttccagttgaac

SEQ ID NO: 273415 - DNA, 25 bp, Mus musculus
actagggtcgcctgactgccatcga

SEQ ID NO: 273416 - DNA, 25 bp, Mus musculus
cgggagccactagggtcgcctgact

SEQ ID NO: 273417 - DNA, 25 bp, Mus musculus
tcattctgttctcaccaccctgtaa

SEQ ID NO: 273418 - DNA, 25 bp, Mus musculus
cgtcctcacagcctcgccgctcctc

SEQ ID NO: 273419 - DNA, 25 bp, Mus musculus
tggtgttccagttgaacttgctttc

SEQ ID NO: 273420 - DNA, 25 bp, Mus musculus
agcaccttcaccctccgaataggag

SEQ ID NO: 273421 - DNA, 25 bp, Mus musculus
tcagagaagcacaaccgggagcgtg

SEQ ID NO: 273422 - DNA, 25 bp, Mus musculus
cgccatgacgagtggcggtggcagc

SEQ ID NO: 273423 - DNA, 25 bp, Mus musculus
acgactcagagaagcacaaccggga

SEQ ID NO: 273424 - DNA, 25 bp, Mus musculus
cctccgaataggagcacgactcaga

SEQ ID NO: 273425 - DNA, 25 bp, Mus musculus
aaaggaagcgagcaccttcaccctc

SEQ ID NO: 273426 - DNA, 25 bp, Mus musculus
acgggcaaaggaagcgagcaccttc

SEQ ID NO: 273427 - DNA, 25 bp, Mus musculus
tcctcggatgttggccgtccgcgta

SEQ ID NO: 273428 - DNA, 25 bp, Mus musculus
tactcaaggccggagtcctcggatg

SEQ ID NO: 273429 - DNA, 25 bp, Mus musculus
agcaggttactcaaggccggagtcc

SEQ ID NO: 273430 - DNA, 25 bp, Mus musculus
tcacgggagcaggttactcaaggcc

SEQ ID NO: 273431 - DNA, 25 bp, Mus musculus
aaaggtcacgggagcaggttactca

SEQ ID NO: 273432 - DNA, 25 bp, Mus musculus
aaccgggagcgtgatggtggatccc

SEQ ID NO: 273433 - DNA, 25 bp, Mus musculus
taggagcacgactcagagaagcaca

SEQ ID NO: 273434 - DNA, 25 bp, Mus musculus
gagaagcacggagcgtcccggcctc

SEQ ID NO: 273435 - DNA, 25 bp, Mus musculus
tcgcttcgagtgcacaggtcaagcc

SEQ ID NO: 273436 - DNA, 25 bp, Mus musculus
gtgcgccttcctcgcttcgagtgca

SEQ ID NO: 273437 - DNA, 25 bp, Mus musculus
gccttcctcgcttcgagtgcacagg

SEQ ID NO: 273438 - DNA, 25 bp, Mus musculus
ttcctcgcttcgagtgcacaggtca

SEQ ID NO: 273439 - DNA, 25 bp, Mus musculus
cctcgcttcgagtgcacaggtcaag

SEQ ID NO: 273440 - DNA, 25 bp, Mus musculus
cttcgagtgcacaggtcaagcctct

SEQ ID NO: 273441 - DNA, 25 bp, Mus musculus
tcgagtgcacaggtcaagcctcttc

SEQ ID NO: 273442 - DNA, 25 bp, Mus musculus
cgagtgcacaggtcaagcctcttcc

SEQ ID NO: 273443 - DNA, 25 bp, Mus musculus
agtgcacaggtcaagcctcttccct

SEQ ID NO: 273444 - DNA, 25 bp, Mus musculus
tccctcccgcgctcttaccctccca

SEQ ID NO: 273445 - DNA, 25 bp, Mus musculus
gcgtccttggggcttgtgcgccttc

SEQ ID NO: 273446 - DNA, 25 bp, Mus musculus
tagaaaccgtgtccccgagacagga

SEQ ID NO: 273447 - DNA, 25 bp, Mus musculus
agcacggagcgtcccggcctcattt

SEQ ID NO: 273448 - DNA, 25 bp, Mus musculus
tggaacggcatcttggaggctccgc

SEQ ID NO: 273449 - DNA, 25 bp, Mus musculus
caatgggcacccgtccgggacctag

SEQ ID NO: 273450 - DNA, 25 bp, Mus musculus
ccgcaaactttgaggccggggctca

SEQ ID NO: 273451 - DNA, 25 bp, Mus musculus
ccgtcaccgggtggaacggcatctt

SEQ ID NO: 273452 - DNA, 25 bp, Mus musculus
tcctcagggatatccaccgggcgct

SEQ ID NO: 273453 - DNA, 25 bp, Mus musculus
cctctagctcgtcctcagggatatc

SEQ ID NO: 273454 - DNA, 25 bp, Mus musculus
gtagccgctcatccgagtcgcgcag

SEQ ID NO: 273455 - DNA, 25 bp, Mus musculus
ttggattctcaacgcgacacgagcg

SEQ ID NO: 273456 - DNA, 25 bp, Mus musculus
cactgccggagcagattggattctc

SEQ ID NO: 273457 - DNA, 25 bp, Mus musculus
aagagcggggcagtcgccctctctc

SEQ ID NO: 273458 - DNA, 25 bp, Mus musculus
tgcacccagcaagagcggggcagtc

SEQ ID NO: 273459 - DNA, 25 bp, Mus musculus
atccggccacttgttgtcgccaacg

SEQ ID NO: 273460 - DNA, 25 bp, Mus musculus
caggcttttgctatcgcgaccgagc

SEQ ID NO: 273461 - DNA, 25 bp, Mus musculus
cacgagcggaatgtcaataggagcg

SEQ ID NO: 273462 - DNA, 25 bp, Mus musculus
ggggcctgacccttacagcaggaga

SEQ ID NO: 273463 - DNA, 25 bp, Mus musculus
cacgagctgcagacagacgccgagc

SEQ ID NO: 273464 - DNA, 25 bp, Mus musculus
ccaacttagtgggacacgagctgca

SEQ ID NO: 273465 - DNA, 25 bp, Mus musculus
cctcggctacaacgtgaccaagatg

SEQ ID NO: 273466 - DNA, 25 bp, Mus musculus
tcgccatgtgccagaacctcggcta

SEQ ID NO: 273467 - DNA, 25 bp, Mus musculus
ggtgtctgctagatcagcctctgcc

SEQ ID NO: 273468 - DNA, 25 bp, Mus musculus
taccgcattccctatccggagttgg

SEQ ID NO: 273469 - DNA, 25 bp, Mus musculus
tacaactgctggagaggcgactgct

SEQ ID NO: 273470 - DNA, 25 bp, Mus musculus
tatcccgcacattctcgtacaactg

SEQ ID NO: 273471 - DNA, 25 bp, Mus musculus
ggctccggacgtctgatatcccgca

SEQ ID NO: 273472 - DNA, 25 bp, Mus musculus
tgggatcgccgcctgcagccatgac

SEQ ID NO: 273473 - DNA, 25 bp, Mus musculus
ttggacagtcgcgttgtccgtcccg

SEQ ID NO: 273474 - DNA, 25 bp, Mus musculus
ggggctttcattggacagtcgcgtt

SEQ ID NO: 273475 - DNA, 25 bp, Mus musculus
cgccgagctgcagctgacaactttc

SEQ ID NO: 273476 - DNA, 25 bp, Mus musculus
agcgtcaccctgctattcagaggtc

SEQ ID NO: 273477 - DNA, 25 bp, Mus musculus
ttcagaggtccagaaccctcgggcc

SEQ ID NO: 273478 - DNA, 25 bp, Mus musculus
ccgcgcgcacccgactctttgtccg

SEQ ID NO: 273479 - DNA, 25 bp, Mus musculus
cagcgcgtcaccaccagcgggtccc

SEQ ID NO: 273480 - DNA, 25 bp, Mus musculus
ccctgctattcagaggtccagaacc

SEQ ID NO: 273481 - DNA, 25 bp, Mus musculus
gccagcgtcaccctgctattcagag

SEQ ID NO: 273482 - DNA, 25 bp, Mus musculus
tggccgagtgcgagcctgaggtcca

SEQ ID NO: 273483 - DNA, 25 bp, Mus musculus
cctgctccgcagagtggccgagtgc

SEQ ID NO: 273484 - DNA, 25 bp, Mus musculus
atgcctgctccgcagagtggccgag

SEQ ID NO: 273485 - DNA, 25 bp, Mus musculus
ccgtgcgccgctcagacaggtgtgg

SEQ ID NO: 273486 - DNA, 25 bp, Mus musculus
ctggtccttcggacccagcgggaga

SEQ ID NO: 273487 - DNA, 25 bp, Mus musculus
ggctccggcacacgcctggtccttc

SEQ ID NO: 273488 - DNA, 25 bp, Mus musculus
cccgactctttgtccggctccggca

SEQ ID NO: 273489 - DNA, 25 bp, Mus musculus
tgctattcagaggtccagaaccctc

SEQ ID NO: 273490 - DNA, 25 bp, Mus musculus
gacctggcttgcctagagggcaccc

SEQ ID NO: 273491 - DNA, 25 bp, Mus musculus
tgaagaagcgcggatacgatgtcac

SEQ ID NO: 273492 - DNA, 25 bp, Mus musculus
ccctgggcttgggacgaaacctatg

SEQ ID NO: 273493 - DNA, 25 bp, Mus musculus
tcccgtggttagcagggaaagacgc

SEQ ID NO: 273494 - DNA, 25 bp, Mus musculus
taggacgttggatcccgtggttagc

SEQ ID NO: 273495 - DNA, 25 bp, Mus musculus
tctcaacaaggtaatggtccgggta

SEQ ID NO: 273496 - DNA, 25 bp, Mus musculus
cgcggatacgatgtcaccaggaacc

SEQ ID NO: 273497 - DNA, 25 bp, Mus musculus
ccactccaagtctggcccgcctcga

SEQ ID NO: 273498 - DNA, 25 bp, Mus musculus
tgcagcagtcttcggcgccaggcac

SEQ ID NO: 273499 - DNA, 25 bp, Mus musculus
tagcctgcagcagtcttcggcgcca

SEQ ID NO: 273500 - DNA, 25 bp, Mus musculus
gtgcctcgcatagcctgcagcagtc

SEQ ID NO: 273501 - DNA, 25 bp, Mus musculus
ttccaggtctgtgccagggctatgg

SEQ ID NO: 273502 - DNA, 25 bp, Mus musculus
tgaccttggtctcgccctggttcca

SEQ ID NO: 273503 - DNA, 25 bp, Mus musculus
tcgccctggttccaggtctgtgcca

SEQ ID NO: 273504 - DNA, 25 bp, Mus musculus
accgcccgggccatcctcaccagcc

SEQ ID NO: 273505 - DNA, 25 bp, Mus musculus
gtcccattgcccgtccgtcgcacac

SEQ ID NO: 273506 - DNA, 25 bp, Mus musculus
gtccgtcgcacacgcccaggaaaaa

SEQ ID NO: 273507 - DNA, 25 bp, Mus musculus
cgcccaggaaaaaaagcacaatgac

SEQ ID NO: 273508 - DNA, 25 bp, Mus musculus
cacaatgaccaggtttccccgcgtt

SEQ ID NO: 273509 - DNA, 25 bp, Mus musculus
cccgcgttccaagcgccgtgcaccg

SEQ ID NO: 273510 - DNA, 25 bp, Mus musculus
accacccagctctcagtcaccgacc

SEQ ID NO: 273511 - DNA, 25 bp, Mus musculus
caccaggcagccaaacatggcagcg

SEQ ID NO: 273512 - DNA, 25 bp, Mus musculus
aggcagccaaacatggcagcgccct

SEQ ID NO: 273513 - DNA, 25 bp, Mus musculus
ccaaacatggcagcgccctcggcgc

SEQ ID NO: 273514 - DNA, 25 bp, Mus musculus
tctgctaggccagcgggcacctcag

SEQ ID NO: 273515 - DNA, 25 bp, Mus musculus
cacctcaggccggacaccaggaatt

SEQ ID NO: 273516 - DNA, 25 bp, Mus musculus
ctcaggccggacaccaggaattccg

SEQ ID NO: 273517 - DNA, 25 bp, Mus musculus
gtgcaccgtgccaccacccagctct

SEQ ID NO: 273518 - DNA, 25 bp, Mus musculus
aatctataggctgttccctgctcgc

SEQ ID NO: 273519 - DNA, 25 bp, Mus musculus
tctcgacactttgcaccgaggcgtc

SEQ ID NO: 273520 - DNA, 25 bp, Mus musculus
attggctcaatccttcgatctccga

SEQ ID NO: 273521 - DNA, 25 bp, Mus musculus
aacttctgcttcttggccgcgggca

SEQ ID NO: 273522 - DNA, 25 bp, Mus musculus
cgaccgcagttaccaaagaacctga

SEQ ID NO: 273523 - DNA, 25 bp, Mus musculus
tgtttacggaacttctcacagccta

SEQ ID NO: 273524 - DNA, 25 bp, Mus musculus
tccgacccgctgcaaacgaacgaaa

SEQ ID NO: 273525 - DNA, 25 bp, Mus musculus
ggccaagacgtttcatccgcaattg

SEQ ID NO: 273526 - DNA, 25 bp, Mus musculus
aggcggaactcaaagggctgctccc

SEQ ID NO: 273527 - DNA, 25 bp, Mus musculus
cacactgctgaaaaaggggcgcgca

SEQ ID NO: 273528 - DNA, 25 bp, Mus musculus
ggttgctgttctcgtcgctgctcaa

SEQ ID NO: 273529 - DNA, 25 bp, Mus musculus
cggggctgcactcacattttcgtct

SEQ ID NO: 273530 - DNA, 25 bp, Mus musculus
tgaaacttctactccacagtcccgg

SEQ ID NO: 273531 - DNA, 25 bp, Mus musculus
cgaacgaaagtctgtggcctggatc

SEQ ID NO: 273532 - DNA, 25 bp, Mus musculus
gctccgcggtatctaagacagtatg

SEQ ID NO: 273533 - DNA, 25 bp, Mus musculus
gcgccaaattgagcgaggcgaagcc

SEQ ID NO: 273534 - DNA, 25 bp, Mus musculus
cacagtgtcactggctccgcggtat

SEQ ID NO: 273535 - DNA, 25 bp, Mus musculus
gccagagcctgacggaccgaatcac

SEQ ID NO: 273536 - DNA, 25 bp, Mus musculus
agacagtatgcaaggccacgaccca

SEQ ID NO: 273537 - DNA, 25 bp, Mus musculus
ccgcagagatgtctggccagagcct

SEQ ID NO: 273538 - DNA, 25 bp, Mus musculus
ttcggggtgaaaactacgcacaggc

SEQ ID NO: 273539 - DNA, 25 bp, Mus musculus
tgacctaggggcagcccggaaagct

SEQ ID NO: 273540 - DNA, 25 bp, Mus musculus
tttgtcaagcccacggcgtcagcct

SEQ ID NO: 273541 - DNA, 25 bp, Mus musculus
cccaggcacctccagttcggggtga

SEQ ID NO: 273542 - DNA, 25 bp, Mus musculus
gcggaacccgagtcacgtgacctag

SEQ ID NO: 273543 - DNA, 25 bp, Mus musculus
gcgtcctcgcctccggggtgaaaga

SEQ ID NO: 273544 - DNA, 25 bp, Mus musculus
acggcgtcagcctctgacacgaggg

SEQ ID NO: 273545 - DNA, 25 bp, Mus musculus
gcagctgcctcacctctttgtcaag

SEQ ID NO: 273546 - DNA, 25 bp, Mus musculus
ctccgacttgctgcagaggctgttg

SEQ ID NO: 273547 - DNA, 25 bp, Mus musculus
ctagctcgcctgctgagccgactga

SEQ ID NO: 273548 - DNA, 25 bp, Mus musculus
tcctggccaacgagaccggactagc

SEQ ID NO: 273549 - DNA, 25 bp, Mus musculus
agagtcgctacctacgggccgtcct

SEQ ID NO: 273550 - DNA, 25 bp, Mus musculus
aagcactgcaggaggagagtcgcta

SEQ ID NO: 273551 - DNA, 25 bp, Mus musculus
tgggcaagcgcgtgcaagcactgca

SEQ ID NO: 273552 - DNA, 25 bp, Mus musculus
tcggctcaagaagaaggagtacgtg

SEQ ID NO: 273553 - DNA, 25 bp, Mus musculus
acgacggcaaccaggcggcgaccaa

SEQ ID NO: 273554 - DNA, 25 bp, Mus musculus
cgagatgcagcgcttctccgacttg

SEQ ID NO: 273555 - DNA, 25 bp, Mus musculus
atctgctggaccctcggcaaccgga

SEQ ID NO: 273556 - DNA, 25 bp, Mus musculus
agccggaggacatggactttctctc

SEQ ID NO: 273557 - DNA, 25 bp, Mus musculus
tgaccgcgagcaacctcacggggac

SEQ ID NO: 273558 - DNA, 25 bp, Mus musculus
ccatgaggcacagcctgaccaagct

SEQ ID NO: 273559 - DNA, 25 bp, Mus musculus
gctgcccgtcttaatcggctcaaga

SEQ ID NO: 273560 - DNA, 25 bp, Mus musculus
agtgacctagatcttccctcggctc

SEQ ID NO: 273561 - DNA, 25 bp, Mus musculus
tccggcttttttcagagtctcgtta

SEQ ID NO: 273562 - DNA, 25 bp, Mus musculus
agtctcgttaatctcagctgtgttc

SEQ ID NO: 273563 - DNA, 25 bp, Mus musculus
tctcagctgtgttcggctctttccg

SEQ ID NO: 273564 - DNA, 25 bp, Mus musculus
cggctgtgccgccattttgtgtgaa

SEQ ID NO: 273565 - DNA, 25 bp, Mus musculus
tttgtgtgaattcctgaccgcggcg

SEQ ID NO: 273566 - DNA, 25 bp, Mus musculus
ggaaggggacctctcgtcccgatga

SEQ ID NO: 273567 - DNA, 25 bp, Mus musculus
gctcagaggtgactccgaaaccgaa

SEQ ID NO: 273568 - DNA, 25 bp, Mus musculus
tatgtatctatatgcccagttccca

SEQ ID NO: 273569 - DNA, 25 bp, Mus musculus
gccacgcccaagcagtcctttttgg

SEQ ID NO: 273570 - DNA, 25 bp, Mus musculus
cagtcctttttggtgcattaacatc

SEQ ID NO: 273571 - DNA, 25 bp, Mus musculus
ctcaaaggaacgatggaggccgtgc

SEQ ID NO: 273572 - DNA, 25 bp, Mus musculus
tcctttaggtgggtctctgatccgc

SEQ ID NO: 273573 - DNA, 25 bp, Mus musculus
ccgcgttgctgcagtgacctagatc

SEQ ID NO: 273574 - DNA, 25 bp, Mus musculus
ttcggcagaatgaaggcagctaatg

SEQ ID NO: 273575 - DNA, 25 bp, Mus musculus
gagtctaccgcaaccttcgctaggg

SEQ ID NO: 273576 - DNA, 25 bp, Mus musculus
ttcgctagggtcgtctgagctccat

SEQ ID NO: 273577 - DNA, 25 bp, Mus musculus
gagctccatctttggctcacacgtg

SEQ ID NO: 273578 - DNA, 25 bp, Mus musculus
tggctcacacgtgactctgtctccg

SEQ ID NO: 273579 - DNA, 25 bp, Mus musculus
ttccggtccaggagacgctaaactg

SEQ ID NO: 273580 - DNA, 25 bp, Mus musculus
taaactgtggactagcggtgaggac

SEQ ID NO: 273581 - DNA, 25 bp, Mus musculus
ggactggcgagtccgctatagccca

SEQ ID NO: 273582 - DNA, 25 bp, Mus musculus
ccatcccgggtacagcctgcagaaa

SEQ ID NO: 273583 - DNA, 25 bp, Mus musculus
cagcctgcagaaacagcggtgtggc

SEQ ID NO: 273584 - DNA, 25 bp, Mus musculus
ggttgcatggcagccgctaggctac

SEQ ID NO: 273585 - DNA, 25 bp, Mus musculus
gcacagctactcaccattcggcaga

SEQ ID NO: 273586 - DNA, 25 bp, Mus musculus
ctaggctacgggctgatgaaggcaa

SEQ ID NO: 273587 - DNA, 25 bp, Mus musculus
tcccagcgcgacattggcacagcta

SEQ ID NO: 273588 - DNA, 25 bp, Mus musculus
tgtctgacagctcgtacctttagtc

SEQ ID NO: 273589 - DNA, 25 bp, Mus musculus
gctgtggtttctaaggttcctcctc

SEQ ID NO: 273590 - DNA, 25 bp, Mus musculus
ggaccaacttggtcgctgggacgcc

SEQ ID NO: 273591 - DNA, 25 bp, Mus musculus
gcgggacttgcagctgtctgacagc

SEQ ID NO: 273592 - DNA, 25 bp, Mus musculus
tttctaaggttcctcctcagagcct

SEQ ID NO: 273593 - DNA, 25 bp, Mus musculus
gacagctcgtacctttagtccggta

SEQ ID NO: 273594 - DNA, 25 bp, Mus musculus
cgcagaagtgcgatctctcattggc

SEQ ID NO: 273595 - DNA, 25 bp, Mus musculus
tgcgatctctcattggctccgagga

SEQ ID NO: 273596 - DNA, 25 bp, Mus musculus
ccttgccttgtcctctgccaaattg

SEQ ID NO: 273597 - DNA, 25 bp, Mus musculus
tgccaaattgtcagcctggccaacc

SEQ ID NO: 273598 - DNA, 25 bp, Mus musculus
caggcctgttgctgcgcgccttctt

SEQ ID NO: 273599 - DNA, 25 bp, Mus musculus
tgcgcgccttcttctcagggcggct

SEQ ID NO: 273600 - DNA, 25 bp, Mus musculus
tcggtgtgttaaggctgtggtttct

SEQ ID NO: 273601 - DNA, 25 bp, Mus musculus
cgcctcacgtgactgacaggagggc

SEQ ID NO: 273602 - DNA, 25 bp, Mus musculus
tacctagactgggactacgtgcgag

SEQ ID NO: 273603 - DNA, 25 bp, Mus musculus
cgaaaggagtttcgcatgagcctgc

SEQ ID NO: 273604 - DNA, 25 bp, Mus musculus
cgggagacgtccttccagcgaaagg

SEQ ID NO: 273605 - DNA, 25 bp, Mus musculus
ccgcggaggctgaagctacagctca

SEQ ID NO: 273606 - DNA, 25 bp, Mus musculus
gcagtcgctgggcacagtgacccac

SEQ ID NO: 273607 - DNA, 25 bp, Mus musculus
aacgactcagcgacctgtgcaggca

SEQ ID NO: 273608 - DNA, 25 bp, Mus musculus
aggacgctgtcctttcaacgactca

SEQ ID NO: 273609 - DNA, 25 bp, Mus musculus
ggcagccaatctcctacctcgaagg

SEQ ID NO: 273610 - DNA, 25 bp, Mus musculus
gcccgggaccactaaacagacaaga

SEQ ID NO: 273611 - DNA, 25 bp, Mus musculus
gagcgcctcccttacctagactggg

SEQ ID NO: 273612 - DNA, 25 bp, Mus musculus
gtgatcctgagacgcgcactccgtc

SEQ ID NO: 273613 - DNA, 25 bp, Mus musculus
gctgcttctctgagccaggcaaatt

SEQ ID NO: 273614 - DNA, 25 bp, Mus musculus
agctctttctccacggcgtctggtg

SEQ ID NO: 273615 - DNA, 25 bp, Mus musculus
caggcaaattacatcgcgtaggttg

SEQ ID NO: 273616 - DNA, 25 bp, Mus musculus
tcagcagcaaggactgcgggtccca

SEQ ID NO: 273617 - DNA, 25 bp, Mus musculus
gtgtgtgatacgctttggacttcca

SEQ ID NO: 273618 - DNA, 25 bp, Mus musculus
gatacgctttggacttccacgggca

SEQ ID NO: 273619 - DNA, 25 bp, Mus musculus
ccacgggcactggtcgatgctacaa

SEQ ID NO: 273620 - DNA, 25 bp, Mus musculus
tggtcgatgctacaacgcggtctca

SEQ ID NO: 273621 - DNA, 25 bp, Mus musculus
ccacaatcctcagcagcaaggactg

SEQ ID NO: 273622 - DNA, 25 bp, Mus musculus
cgggtcccatgatgctatgctgcta

SEQ ID NO: 273623 - DNA, 25 bp, Mus musculus
tgctatgctgctacgctggattcgg

SEQ ID NO: 273624 - DNA, 25 bp, Mus musculus
acgctggattcggtctgggaagctt

SEQ ID NO: 273625 - DNA, 25 bp, Mus musculus
tctgggaagcttgctgcgggactaa

SEQ ID NO: 273626 - DNA, 25 bp, Mus musculus
agcttgctgcgggactaactcgccg

SEQ ID NO: 273627 - DNA, 25 bp, Mus musculus
atgggcgccagaaggttctccaaga

SEQ ID NO: 273628 - DNA, 25 bp, Mus musculus
cgcgaaactgcaagtgtgtgatacg

SEQ ID NO: 273629 - DNA, 25 bp, Mus musculus
gactaactcgccgcccgcaaatggg

SEQ ID NO: 273630 - DNA, 25 bp, Mus musculus
cctcctctcggcttgagttggtggg

SEQ ID NO: 273631 - DNA, 25 bp, Mus musculus
gggcttccttcctcctagacccagc

SEQ ID NO: 273632 - DNA, 25 bp, Mus musculus
ggcttccttcctcctagacccagcc

SEQ ID NO: 273633 - DNA, 25 bp, Mus musculus
gcttccttcctcctagacccagccc

SEQ ID NO: 273634 - DNA, 25 bp, Mus musculus
tccttcctcctagacccagcccctg

SEQ ID NO: 273635 - DNA, 25 bp, Mus musculus
ccttcctcctagacccagcccctgc

SEQ ID NO: 273636 - DNA, 25 bp, Mus musculus
cttcctcctagacccagcccctgcg

SEQ ID NO: 273637 - DNA, 25 bp, Mus musculus
tcctcctagacccagcccctgcgga

SEQ ID NO: 273638 - DNA, 25 bp, Mus musculus
ctcctagacccagcccctgcggacc

SEQ ID NO: 273639 - DNA, 25 bp, Mus musculus
gcctcctctcggcttgagttggtgg

SEQ ID NO: 273640 - DNA, 25 bp, Mus musculus
ctcctctcggcttgagttggtgggg

SEQ ID NO: 273641 - DNA, 25 bp, Mus musculus
tctcggcttgagttggtgggggcgc

SEQ ID NO: 273642 - DNA, 25 bp, Mus musculus
cctctcggcttgagttggtgggggc

SEQ ID NO: 273643 - DNA, 25 bp, Mus musculus
cccctgcggacctgcgcctcctctc

SEQ ID NO: 273644 - DNA, 25 bp, Mus musculus
gtcttgggcgttccagacagggtct

SEQ ID NO: 273645 - DNA, 25 bp, Mus musculus
gaaagcctcagcgaaaatcaacgcg

SEQ ID NO: 273646 - DNA, 25 bp, Mus musculus
gaaaatcaacgcgtattccgcttcc

SEQ ID NO: 273647 - DNA, 25 bp, Mus musculus
agccgctggatttggcggttcctgc

SEQ ID NO: 273648 - DNA, 25 bp, Mus musculus
atttggcggttcctgcgccctgacg

SEQ ID NO: 273649 - DNA, 25 bp, Mus musculus
cggcggaatccgctggacttcaact

SEQ ID NO: 273650 - DNA, 25 bp, Mus musculus
tggacttcaactcctcatgggcgtc

SEQ ID NO: 273651 - DNA, 25 bp, Mus musculus
tcaactcctcatgggcgtctgtcac

SEQ ID NO: 273652 - DNA, 25 bp, Mus musculus
tctgtcacccgccctgcggagaggt

SEQ ID NO: 273653 - DNA, 25 bp, Mus musculus
gagaggtgagacgaagactcgctca

SEQ ID NO: 273654 - DNA, 25 bp, Mus musculus
aagactcgctcagggagaaggttcg

SEQ ID NO: 273655 - DNA, 25 bp, Mus musculus
tgtgcccgctcaggcgtccgcgaga

SEQ ID NO: 273656 - DNA, 25 bp, Mus musculus
agagccacccgcgagctccggggat

SEQ ID NO: 273657 - DNA, 25 bp, Mus musculus
aggcgtccgcgagagtgacacaccc

SEQ ID NO: 273658 - DNA, 25 bp, Mus musculus
ttcacctaagctcgcgtcgctcttg

SEQ ID NO: 273659 - DNA, 25 bp, Mus musculus
cggtcacttccgtatcctttatgca

SEQ ID NO: 273660 - DNA, 25 bp, Mus musculus
acgagtacacttccggcgtgcggtc

SEQ ID NO: 273661 - DNA, 25 bp, Mus musculus
agtcgttttccagcgtctcagttcc

SEQ ID NO: 273662 - DNA, 25 bp, Mus musculus
ttgtggcaacaggatgcctgctctc

SEQ ID NO: 273663 - DNA, 25 bp, Mus musculus
aactcctgccaaagagatcctggtg

SEQ ID NO: 273664 - DNA, 25 bp, Mus musculus
tggctcttctcgagtcccttcggga

SEQ ID NO: 273665 - DNA, 25 bp, Mus musculus
tgctgccctaggtcttcactggctc

SEQ ID NO: 273666 - DNA, 25 bp, Mus musculus
gtggccatgctgttccctaattctc

SEQ ID NO: 273667 - DNA, 25 bp, Mus musculus
tgcgagccagcgacttcacctaagc

SEQ ID NO: 273668 - DNA, 25 bp, Mus musculus
gctgctctggtaccgagtggttttc

SEQ ID NO: 273669 - DNA, 25 bp, Mus musculus
gtggccgtcaccttggaaacgagta

SEQ ID NO: 273670 - DNA, 25 bp, Mus musculus
tctctcctgagagacgcagcggtgc

SEQ ID NO: 273671 - DNA, 25 bp, Mus musculus
agaccacagtctccggtttcctggg

SEQ ID NO: 273672 - DNA, 25 bp, Mus musculus
cgaaaggctgtccccgatgcgtgga

SEQ ID NO: 273673 - DNA, 25 bp, Mus musculus
atgcgtggagcgtggggacgtagtc

SEQ ID NO: 273674 - DNA, 25 bp, Mus musculus
ggacgtagtcagaggtggcctaaat

SEQ ID NO: 273675 - DNA, 25 bp, Mus musculus
gacgtagtcagaggtggcctaaata

SEQ ID NO: 273676 - DNA, 25 bp, Mus musculus
acgtagtcagaggtggcctaaatag

SEQ ID NO: 273677 - DNA, 25 bp, Mus musculus
cgtagtcagaggtggcctaaatagg

SEQ ID NO: 273678 - DNA, 25 bp, Mus musculus
tcagaggtggcctaaatagggagtt

SEQ ID NO: 273679 - DNA, 25 bp, Mus musculus
tggcctaaatagggagttggtaagc

SEQ ID NO: 273680 - DNA, 25 bp, Mus musculus
gttggtaagcggaaatggggctcca

SEQ ID NO: 273681 - DNA, 25 bp, Mus musculus
cgctccctcccgaaagaggcccacg

SEQ ID NO: 273682 - DNA, 25 bp, Mus musculus
tccctcccgaaagaggcccacgctc

SEQ ID NO: 273683 - DNA, 25 bp, Mus musculus
cgaaagaggcccacgctcccagccg

SEQ ID NO: 273684 - DNA, 25 bp, Mus musculus
aagaggcccacgctcccagccgggg

SEQ ID NO: 273685 - DNA, 25 bp, Mus musculus
cagccggggccaaagaccaagcccg

SEQ ID NO: 273686 - DNA, 25 bp, Mus musculus
gtcgagtctcggctttcgcaacacc

SEQ ID NO: 273687 - DNA, 25 bp, Mus musculus
gggcttctttctccacagacacaaa

SEQ ID NO: 273688 - DNA, 25 bp, Mus musculus
tccagctccgaaaatgtctgtgttc

SEQ ID NO: 273689 - DNA, 25 bp, Mus musculus
aatgtctgtgttcccaaccgctgcg

SEQ ID NO: 273690 - DNA, 25 bp, Mus musculus
ccaaccgctgcgtcgtgcgaaatga

SEQ ID NO: 273691 - DNA, 25 bp, Mus musculus
ctgcgtcgtgcgaaatgaactaggg

SEQ ID NO: 273692 - DNA, 25 bp, Mus musculus
ccgttggaaacaccaggcgggattg

SEQ ID NO: 273693 - DNA, 25 bp, Mus musculus
aacaccaggcgggattggctggccc

SEQ ID NO: 273694 - DNA, 25 bp, Mus musculus
tggccaattcgtaagggactgttcg

SEQ ID NO: 273695 - DNA, 25 bp, Mus musculus
ttcttcctcggtcgagtctcggctt

SEQ ID NO: 273696 - DNA, 25 bp, Mus musculus
tttcgcaacacctccggctcggaga

SEQ ID NO: 273697 - DNA, 25 bp, Mus musculus
tgcaaaggacggtcggctctcattg

SEQ ID NO: 273698 - DNA, 25 bp, Mus musculus
ctctcattggccaattcgtaaggga

SEQ ID NO: 273699 - DNA, 25 bp, Mus musculus
ggcccttccgcaatacgtccaagca

SEQ ID NO: 273700 - DNA, 25 bp, Mus musculus
tctggctcgacagccctgaaggtcc

SEQ ID NO: 273701 - DNA, 25 bp, Mus musculus
cagctccagggctccaacatggcgg

SEQ ID NO: 273702 - DNA, 25 bp, Mus musculus
agttctacatcctagcctcaccatt

SEQ ID NO: 273703 - DNA, 25 bp, Mus musculus
gtgcgcgaggctatcaagttctaca

SEQ ID NO: 273704 - DNA, 25 bp, Mus musculus
ccagtgtagcctccgttcagtccta

SEQ ID NO: 273705 - DNA, 25 bp, Mus musculus
cgcgagcttttcgtcttacaggcgc

SEQ ID NO: 273706 - DNA, 25 bp, Mus musculus
cgatggcatttctggctcgacagcc

SEQ ID NO: 273707 - DNA, 25 bp, Mus musculus
actccgactcgcgatggcatttctg

SEQ ID NO: 273708 - DNA, 25 bp, Mus musculus
cagcgggttgcggttcactccgact

SEQ ID NO: 273709 - DNA, 25 bp, Mus musculus
ttctccacgctcagtaaagcgactc

SEQ ID NO: 273710 - DNA, 25 bp, Mus musculus
tctaagggtttctccacgctcagta

SEQ ID NO: 273711 - DNA, 25 bp, Mus musculus
acacattttgcccagagagtctccc

SEQ ID NO: 273712 - DNA, 25 bp, Mus musculus
ttttcgtcttacaggcgcgaggccc

SEQ ID NO: 273713 - DNA, 25 bp, Mus musculus
agcctccgttcagtcctagccggtg

SEQ ID NO: 273714 - DNA, 25 bp, Mus musculus
ctgcttaggcgggaacaacagaggc

SEQ ID NO: 273715 - DNA, 25 bp, Mus musculus
accgaggcttagagaaggcttagtc

SEQ ID NO: 273716 - DNA, 25 bp, Mus musculus
acggccagaagtcctgaaatcaatc

SEQ ID NO: 273717 - DNA, 25 bp, Mus musculus
tccatacggagtgcaaggttacagc

SEQ ID NO: 273718 - DNA, 25 bp, Mus musculus
aggttacagcgcctcgtcaggagtc

SEQ ID NO: 273719 - DNA, 25 bp, Mus musculus
cgtctcacctgaggcaaaggacaca

SEQ ID NO: 273720 - DNA, 25 bp, Mus musculus
ctcttccgccggaaggaccgtcttg

SEQ ID NO: 273721 - DNA, 25 bp, Mus musculus
agccaatcagaaaacgccctgcagg

SEQ ID NO: 273722 - DNA, 25 bp, Mus musculus
gggcaagcgacccttcttgtaaagc

SEQ ID NO: 273723 - DNA, 25 bp, Mus musculus
ttcttcatcgactggtggagcggta

SEQ ID NO: 273724 - DNA, 25 bp, Mus musculus
ctcgtagccggcgtttacggccaga

SEQ ID NO: 273725 - DNA, 25 bp, Mus musculus
catcgcggagcatggatggattacc

SEQ ID NO: 273726 - DNA, 25 bp, Mus musculus
gaaggcttagtctgcgcgcaacacc

SEQ ID NO: 273727 - DNA, 25 bp, Mus musculus
tgacggactttcaggagagccaatc

SEQ ID NO: 273728 - DNA, 25 bp, Mus musculus
tgcagatgctccagccaaacggcct

SEQ ID NO: 273729 - DNA, 25 bp, Mus musculus
cgcaagtacttgcagaagcagatta

SEQ ID NO: 273730 - DNA, 25 bp, Mus musculus
gactcggcgtccagcaacatcaagc

SEQ ID NO: 273731 - DNA, 25 bp, Mus musculus
aaaggctgctgtttcgaagacgatg

SEQ ID NO: 273732 - DNA, 25 bp, Mus musculus
gacctgctcagcttcatagactcgg

SEQ ID NO: 273733 - DNA, 25 bp, Mus musculus
tggctgctcttttcgactctctgcg

SEQ ID NO: 273734 - DNA, 25 bp, Mus musculus
tcttcactgaaccatcccgggtggg

SEQ ID NO: 273735 - DNA, 25 bp, Mus musculus
tgagttctttgagttgctggcgcca

SEQ ID NO: 273736 - DNA, 25 bp, Mus musculus
cagacttcggcagtggcaacgattc

SEQ ID NO: 273737 - DNA, 25 bp, Mus musculus
gagcgccttcggaagtctggacaaa

SEQ ID NO: 273738 - DNA, 25 bp, Mus musculus
gcgatggtggggaacctactatacc

SEQ ID NO: 273739 - DNA, 25 bp, Mus musculus
tcatacccttcggtttcggaggctc

SEQ ID NO: 273740 - DNA, 25 bp, Mus musculus
ccgagctgtcctcagaccaagaagc

SEQ ID NO: 273741 - DNA, 25 bp, Mus musculus
caacgattcgggtgtcttgatggcc

SEQ ID NO: 273742 - DNA, 25 bp, Mus musculus
ctccagtgtccgagctggatcgcgc

SEQ ID NO: 273743 - DNA, 25 bp, Mus musculus
aggcacatgagacaggtcagtggca

SEQ ID NO: 273744 - DNA, 25 bp, Mus musculus
ccattgcgagccatgggaggcggct

SEQ ID NO: 273745 - DNA, 25 bp, Mus musculus
gccgcctccagtgtccgagctggat

SEQ ID NO: 273746 - DNA, 25 bp, Mus musculus
tgtcgcggccccattgcgagccatg

SEQ ID NO: 273747 - DNA, 25 bp, Mus musculus
tccgagctggatcgcgcggacgctt

SEQ ID NO: 273748 - DNA, 25 bp, Mus musculus
tggatcgcgcggacgcttggctcct

SEQ ID NO: 273749 - DNA, 25 bp, Mus musculus
ggacgcttggctcctccgcaaggca

SEQ ID NO: 273750 - DNA, 25 bp, Mus musculus
tggctcctccgcaaggcacatgaga

SEQ ID NO: 273751 - DNA, 25 bp, Mus musculus
gctcctccgcaaggcacatgagaca

SEQ ID NO: 273752 - DNA, 25 bp, Mus musculus
tcctccgcaaggcacatgagacagg

SEQ ID NO: 273753 - DNA, 25 bp, Mus musculus
tccgcaaggcacatgagacaggtca

SEQ ID NO: 273754 - DNA, 25 bp, Mus musculus
cgcaaggcacatgagacaggtcagt

SEQ ID NO: 273755 - DNA, 25 bp, Mus musculus
ccacgcgcgggagcgtcgccgcctc

SEQ ID NO: 273756 - DNA, 25 bp, Mus musculus
gctccgtcttgggtgcctcaataca

SEQ ID NO: 273757 - DNA, 25 bp, Mus musculus
ggagggaagctattaaacacacaca

SEQ ID NO: 273758 - DNA, 25 bp, Mus musculus
cgcgagtgtgtctcgctcgctcact

SEQ ID NO: 273759 - DNA, 25 bp, Mus musculus
actcgctcgccctgtgtgtaagaga

SEQ ID NO: 273760 - DNA, 25 bp, Mus musculus
gcctcgggattgcagctgttacatg

SEQ ID NO: 273761 - DNA, 25 bp, Mus musculus
ccgcgggagctattgttggtctcac

SEQ ID NO: 273762 - DNA, 25 bp, Mus musculus
tcagaaccgggacctgctccgtctt

SEQ ID NO: 273763 - DNA, 25 bp, Mus musculus
cctcaatacaactcgcggagcggcg

SEQ ID NO: 273764 - DNA, 25 bp, Mus musculus
tcagctctacggaaaaagcgccttg

SEQ ID NO: 273765 - DNA, 25 bp, Mus musculus
tctctgcattcgcaggtccgggcag

SEQ ID NO: 273766 - DNA, 25 bp, Mus musculus
gtccgggcagctcaagcagcttgct

SEQ ID NO: 273767 - DNA, 25 bp, Mus musculus
ggagatgctagcctgcttccctgct

SEQ ID NO: 273768 - DNA, 25 bp, Mus musculus
tcgatccaggttcgtgtgctacgcc

SEQ ID NO: 273769 - DNA, 25 bp, Mus musculus
tggtctcaccggagctgagctcaga

SEQ ID NO: 273770 - DNA, 25 bp, Mus musculus
aagcaacggtgttcactgcgccctc

SEQ ID NO: 273771 - DNA, 25 bp, Mus musculus
ggggaccgccgcagactggacccaa

SEQ ID NO: 273772 - DNA, 25 bp, Mus musculus
aacggagctctagaggctgctgtga

SEQ ID NO: 273773 - DNA, 25 bp, Mus musculus
gttccgccggttcatgactgatcta

SEQ ID NO: 273774 - DNA, 25 bp, Mus musculus
atgactgatctagagcgtgtgcttg

SEQ ID NO: 273775 - DNA, 25 bp, Mus musculus
ctaggcagtcgcctggtccgtgtaa

SEQ ID NO: 273776 - DNA, 25 bp, Mus musculus
gtccgtgtaaacctcgccttggcta

SEQ ID NO: 273777 - DNA, 25 bp, Mus musculus
tctgctgcagcgactccaacttctg

SEQ ID NO: 273778 - DNA, 25 bp, Mus musculus
cggatcatccgggaagcaacggtgt

SEQ ID NO: 273779 - DNA, 25 bp, Mus musculus
gcgaccctgatgagagggtaaaata

SEQ ID NO: 273780 - DNA, 25 bp, Mus musculus
ctggacccaacgcaacggagctcta

SEQ ID NO: 273781 - DNA, 25 bp, Mus musculus
cgggctcaaacagcgaccctgatga

SEQ ID NO: 273782 - DNA, 25 bp, Mus musculus
tcgccttggctagggcgggctcaaa

SEQ ID NO: 273783 - DNA, 25 bp, Mus musculus
agcaaaccctgcgtcaggtgttgga

SEQ ID NO: 273784 - DNA, 25 bp, Mus musculus
tgtgctgagctgtacggccgtgctc

SEQ ID NO: 273785 - DNA, 25 bp, Mus musculus
agatcaccctgctgctttgtagagg

SEQ ID NO: 273786 - DNA, 25 bp, Mus musculus
ttgcgggcatctgagcgcactattg

SEQ ID NO: 273787 - DNA, 25 bp, Mus musculus
agtcagcccgggttttgcgggcatc

SEQ ID NO: 273788 - DNA, 25 bp, Mus musculus
tataaggacgcagagtcagcccggg

SEQ ID NO: 273789 - DNA, 25 bp, Mus musculus
acgcagctataaggacgcagagtca

SEQ ID NO: 273790 - DNA, 25 bp, Mus musculus
gtaagccaccaacgcagctataagg

SEQ ID NO: 273791 - DNA, 25 bp, Mus musculus
cgcactattggcgtttgattagccc

SEQ ID NO: 273792 - DNA, 25 bp, Mus musculus
tggcgtttgattagccctggagatc

SEQ ID NO: 273793 - DNA, 25 bp, Mus musculus
cctgctgctttgtagaggcgctggt

SEQ ID NO: 273794 - DNA, 25 bp, Mus musculus
agggtgtccctgtgctgagctgtac

SEQ ID NO: 273795 - DNA, 25 bp, Mus musculus
tggtggggcatgctcgtgatcccca

SEQ ID NO: 273796 - DNA, 25 bp, Mus musculus
gcatctgagcgcactattggcgttt

SEQ ID NO: 273797 - DNA, 25 bp, Mus musculus
attagccctggagatcaccctgctg

SEQ ID NO: 273798 - DNA, 25 bp, Mus musculus
ctccggtcccatgtacggtgtgaca

SEQ ID NO: 273799 - DNA, 25 bp, Mus musculus
gacactgaccgctgtgttccgtgta

SEQ ID NO: 273800 - DNA, 25 bp, Mus musculus
gagctcccggacacaatcacgcatg

SEQ ID NO: 273801 - DNA, 25 bp, Mus musculus
tgctcagactccacccagcgtgatg

SEQ ID NO: 273802 - DNA, 25 bp, Mus musculus
acccagcgtgatgacggaagagcga

SEQ ID NO: 273803 - DNA, 25 bp, Mus musculus
cgtagctcagttgcaacgtgcttta

SEQ ID NO: 273804 - DNA, 25 bp, Mus musculus
ctttaagtctgggtctgcactccgg

SEQ ID NO: 273805 - DNA, 25 bp, Mus musculus
aaccttctgtgctttcgggagcggg

SEQ ID NO: 273806 - DNA, 25 bp, Mus musculus
gactgcgcggctgaaaaaggctgct

SEQ ID NO: 273807 - DNA, 25 bp, Mus musculus
tgaaaaaggctgctctcggggactg

SEQ ID NO: 273808 - DNA, 25 bp, Mus musculus
gacgtagcccggcatcccgtggaac

SEQ ID NO: 273809 - DNA, 25 bp, Mus musculus
ttccgtgtagtcgaaccttctgtgc

SEQ ID NO: 273810 - DNA, 25 bp, Mus musculus
acgccctcagggtccaggacgcgag

SEQ ID NO: 273811 - DNA, 25 bp, Mus musculus
gtctgccaaaatgcgcgtgcgggac

SEQ ID NO: 273812 - DNA, 25 bp, Mus musculus
cccgagaagaagttgaggcgctatg

SEQ ID NO: 273813 - DNA, 25 bp, Mus musculus
acctgtcacaggtgcgccgccgagg

SEQ ID NO: 273814 - DNA, 25 bp, Mus musculus
ggctccagtttagccggcgacatga

SEQ ID NO: 273815 - DNA, 25 bp, Mus musculus
tgtgtaccggctggctgaggaaatc

SEQ ID NO: 273816 - DNA, 25 bp, Mus musculus
ggctgaggaaatcgcctcccgagaa

SEQ ID NO: 273817 - DNA, 25 bp, Mus musculus
aaatcgcctcccgagaagaagttga

SEQ ID NO: 273818 - DNA, 25 bp, Mus musculus
agtggggcgcctcacacctgtcaca

SEQ ID NO: 273819 - DNA, 25 bp, Mus musculus
tcctcgctcgccgagccgaagtttg

SEQ ID NO: 273820 - DNA, 25 bp, Mus musculus
agccgaagtttggagcgattgttcc

SEQ ID NO: 273821 - DNA, 25 bp, Mus musculus
tttggagcgattgttccgggcgacc

SEQ ID NO: 273822 - DNA, 25 bp, Mus musculus
tccttccagtctgcggccactacat

SEQ ID NO: 273823 - DNA, 25 bp, Mus musculus
ggccactacatcacgggcagcgtca

SEQ ID NO: 273824 - DNA, 25 bp, Mus musculus
tggggtccaggctaactggcctctg

SEQ ID NO: 273825 - DNA, 25 bp, Mus musculus
ctacatcacgggcagcgtcagcggc

SEQ ID NO: 273826 - DNA, 25 bp, Mus musculus
gtctcgtgtgcaacccaccacagtg

SEQ ID NO: 273827 - DNA, 25 bp, Mus musculus
tacaggagatgacagcgaacagctc

SEQ ID NO: 273828 - DNA, 25 bp, Mus musculus
cgaacagctccttgaggcagggaag

SEQ ID NO: 273829 - DNA, 25 bp, Mus musculus
cggaagcgaccgaggcagcgcacca

SEQ ID NO: 273830 - DNA, 25 bp, Mus musculus
cgaggcagcgcaccagctgctggca

SEQ ID NO: 273831 - DNA, 25 bp, Mus musculus
gcacgcggcgcgcactgaagaactc

SEQ ID NO: 273832 - DNA, 25 bp, Mus musculus
cactgaagaactcggcgaagacgtc

SEQ ID NO: 273833 - DNA, 25 bp, Mus musculus
ccttgcttcacactcgcagggtagg

SEQ ID NO: 273834 - DNA, 25 bp, Mus musculus
ctcgcagggtaggacgaagtcacca

SEQ ID NO: 273835 - DNA, 25 bp, Mus musculus
agtcaccacggcctccaggatcttg

SEQ ID NO: 273836 - DNA, 25 bp, Mus musculus
caggatcttgtccatgacggccgca

SEQ ID NO: 273837 - DNA, 25 bp, Mus musculus
gggacagggactgcgccacccacaa

SEQ ID NO: 273838 - DNA, 25 bp, Mus musculus
ggtcccggttgcacacgcacctgta

SEQ ID NO: 273839 - DNA, 25 bp, Mus musculus
tgcacacgcacctgtacaggagatg

SEQ ID NO: 273840 - DNA, 25 bp, Mus musculus
tcccagaccgcagggatgctgctgc

SEQ ID NO: 273841 - DNA, 25 bp, Mus musculus
ctgctactttgtgatgtccaactcc

SEQ ID NO: 273842 - DNA, 25 bp, Mus musculus
ggcagtgcaactgcgcggtctcaga

SEQ ID NO: 273843 - DNA, 25 bp, Mus musculus
gggttaccctgcgagctcccagtcg

SEQ ID NO: 273844 - DNA, 25 bp, Mus musculus
tggctctccgcgtagcctcctggga

SEQ ID NO: 273845 - DNA, 25 bp, Mus musculus
cacgcggcacaggaaggaacgcaga

SEQ ID NO: 273846 - DNA, 25 bp, Mus musculus
gaacgcagaggggactacaagtccc

SEQ ID NO: 273847 - DNA, 25 bp, Mus musculus
tggacccagcggacgcatacatgtc

SEQ ID NO: 273848 - DNA, 25 bp, Mus musculus
gcatacatgtctttccgggcacctg

SEQ ID NO: 273849 - DNA, 25 bp, Mus musculus
gtcctgccgtgaaaggtcatctgtc

SEQ ID NO: 273850 - DNA, 25 bp, Mus musculus
aaggtcatctgtcgcagcctcgctg

SEQ ID NO: 273851 - DNA, 25 bp, Mus musculus
gcagcctcgctgttctcatctgtga

SEQ ID NO: 273852 - DNA, 25 bp, Mus musculus
cggactagactaggctgggccagtc

SEQ ID NO: 273853 - DNA, 25 bp, Mus musculus
tccgcacaaccctagatggacctgg

SEQ ID NO: 273854 - DNA, 25 bp, Mus musculus
gtacgcaatgcccttcagcctagag

SEQ ID NO: 273855 - DNA, 25 bp, Mus musculus
tctacatgggcttgttgggctactg

SEQ ID NO: 273856 - DNA, 25 bp, Mus musculus
acgacccgcggcttgtctacatggg

SEQ ID NO: 273857 - DNA, 25 bp, Mus musculus
acctctcgtggaacctgcctcaaga

SEQ ID NO: 273858 - DNA, 25 bp, Mus musculus
cctcaagatgatgaacggccggccg

SEQ ID NO: 273859 - DNA, 25 bp, Mus musculus
gccgggccatgagcccttaaaattc

SEQ ID NO: 273860 - DNA, 25 bp, Mus musculus
tggagtcgaggtcaaacctctcgtg

SEQ ID NO: 273861 - DNA, 25 bp, Mus musculus
tgagcccttaaaattcttgccggac

SEQ ID NO: 273862 - DNA, 25 bp, Mus musculus
cttcacgcgttgtgggccacttaga

SEQ ID NO: 273863 - DNA, 25 bp, Mus musculus
ttagaagcccggaacctcgcgtgca

SEQ ID NO: 273864 - DNA, 25 bp, Mus musculus
ctcgcgtgcagaggttgctaaggct

SEQ ID NO: 273865 - DNA, 25 bp, Mus musculus
ttgctaaggctgagcgcacagggaa

SEQ ID NO: 273866 - DNA, 25 bp, Mus musculus
acgggcctgatggacaacatgctgc

SEQ ID NO: 273867 - DNA, 25 bp, Mus musculus
acagggaagcttttgggtgctgcac

SEQ ID NO: 273868 - DNA, 25 bp, Mus musculus
gccggtgttgcctccagttcttacc

SEQ ID NO: 273869 - DNA, 25 bp, Mus musculus
taactcagttctcgactgctccggg

SEQ ID NO: 273870 - DNA, 25 bp, Mus musculus
aagtgaagggcccagagtgcctctc

SEQ ID NO: 273871 - DNA, 25 bp, Mus musculus
cctgtcacacgaggcagtagcgacc

SEQ ID NO: 273872 - DNA, 25 bp, Mus musculus
cccattggctatcgttcttagaaag

SEQ ID NO: 273873 - DNA, 25 bp, Mus musculus
tccatcctccagttcaaaatggcgg

SEQ ID NO: 273874 - DNA, 25 bp, Mus musculus
cgccgtagtctgctccttcttggaa

SEQ ID NO: 273875 - DNA, 25 bp, Mus musculus
ctccttcttggaacgctacgggccg

SEQ ID NO: 273876 - DNA, 25 bp, Mus musculus
ccgagttgccgttcccagagctgga

SEQ ID NO: 273877 - DNA, 25 bp, Mus musculus
gttccggccagctttgcgcttttct

SEQ ID NO: 273878 - DNA, 25 bp, Mus musculus
ccagacatcggcaacggagaaggta

SEQ ID NO: 273879 - DNA, 25 bp, Mus musculus
gagaaggtaagcgatcggcccgaaa

SEQ ID NO: 273880 - DNA, 25 bp, Mus musculus
gcgcctcctgtcgtccgtaaagcta

SEQ ID NO: 273881 - DNA, 25 bp, Mus musculus
ggcgcgctttagctctccatagata

SEQ ID NO: 273882 - DNA, 25 bp, Mus musculus
accggcacgctttacatcgcggaga

SEQ ID NO: 273883 - DNA, 25 bp, Mus musculus
tagctcagattgtgacgggttacga

SEQ ID NO: 273884 - DNA, 25 bp, Mus musculus
ccctgcgtggaatatgtagctcaga

SEQ ID NO: 273885 - DNA, 25 bp, Mus musculus
gtcaactagacgatttccctgcgtg

SEQ ID NO: 273886 - DNA, 25 bp, Mus musculus
gctttcggaatggtcgtgtcaacta

SEQ ID NO: 273887 - DNA, 25 bp, Mus musculus
tctgcagagcctcggttagtttttc

SEQ ID NO: 273888 - DNA, 25 bp, Mus musculus
gtttctccctaacgacctgtgcgaa

SEQ ID NO: 273889 - DNA, 25 bp, Mus musculus
cccggcaatgagcttcctcaaaagc

SEQ ID NO: 273890 - DNA, 25 bp, Mus musculus
tgttcttccgggctacgactactgc

SEQ ID NO: 273891 - DNA, 25 bp, Mus musculus
aaccgcatgctaaggccctcgctga

SEQ ID NO: 273892 - DNA, 25 bp, Mus musculus
tcccgtctctatggtcaaccgcatg

SEQ ID NO: 273893 - DNA, 25 bp, Mus musculus
ggacctctgagttgcctagaacatc

SEQ ID NO: 273894 - DNA, 25 bp, Mus musculus
ccgatgccacgtgacaaaagccagc

SEQ ID NO: 273895 - DNA, 25 bp, Mus musculus
cgttgagttttgagtctgcagagcc

SEQ ID NO: 273896 - DNA, 25 bp, Mus musculus
gacatggctccctcaccgctgggga

SEQ ID NO: 273897 - DNA, 25 bp, Mus musculus
accacgggcctgtgtagctgttgcc

SEQ ID NO: 273898 - DNA, 25 bp, Mus musculus
tgtgtagctgttgccgggcgatcac

SEQ ID NO: 273899 - DNA, 25 bp, Mus musculus
cacgaacagcacgaacagcagcatt

SEQ ID NO: 273900 - DNA, 25 bp, Mus musculus
acagcacgaacagcagcattagccc

SEQ ID NO: 273901 - DNA, 25 bp, Mus musculus
cagcgagatgcaggtgtcctgcacc

SEQ ID NO: 273902 - DNA, 25 bp, Mus musculus
cagtagcgcggacatggctccctca

SEQ ID NO: 273903 - DNA, 25 bp, Mus musculus
ctccctcaccgctggggatggctga

SEQ ID NO: 273904 - DNA, 25 bp, Mus musculus
gctgcgctgtgcagatgtgacctga

SEQ ID NO: 273905 - DNA, 25 bp, Mus musculus
ggacaacggtctgtagagccccacg

SEQ ID NO: 273906 - DNA, 25 bp, Mus musculus
tggcgcccgagctctgggctctcag

SEQ ID NO: 273907 - DNA, 25 bp, Mus musculus
agcctaagaccgcaccacgctggtg

SEQ ID NO: 273908 - DNA, 25 bp, Mus musculus
caccacgctggtgctagagcatgtg

SEQ ID NO: 273909 - DNA, 25 bp, Mus musculus
caggtgtcctgcacctcgggccgga

SEQ ID NO: 273910 - DNA, 25 bp, Mus musculus
tcacggtacgcaccgcgagaactcg

SEQ ID NO: 273911 - DNA, 25 bp, Mus musculus
gttagctcggcctgcctcctttgct

SEQ ID NO: 273912 - DNA, 25 bp, Mus musculus
ttcctcggccgtgtaaagctcttgc

SEQ ID NO: 273913 - DNA, 25 bp, Mus musculus
agctcttgctcgctttttcccaacg

SEQ ID NO: 273914 - DNA, 25 bp, Mus musculus
tttttcccaacggtgctgccgctta

SEQ ID NO: 273915 - DNA, 25 bp, Mus musculus
cggcctgcttctttctgacatcttt

SEQ ID NO: 273916 - DNA, 25 bp, Mus musculus
cactgtggctcttttgcgtatcgga

SEQ ID NO: 273917 - DNA, 25 bp, Mus musculus
ctccgggccttaacttaacatcgtg

SEQ ID NO: 273918 - DNA, 25 bp, Mus musculus
cgcagatccggtgagcctttgcaca

SEQ ID NO: 273919 - DNA, 25 bp, Mus musculus
gggctttctctccttgtacccaagc

SEQ ID NO: 273920 - DNA, 25 bp, Mus musculus
gcgttgccattttaaaggtgtcgtc

SEQ ID NO: 273921 - DNA, 25 bp, Mus musculus
ttcagacgaagagctccgaaggttc

SEQ ID NO: 273922 - DNA, 25 bp, Mus musculus
agaactcgccgggaccttcagacga

SEQ ID NO: 273923 - DNA, 25 bp, Mus musculus
cccttctaagtctccgcggtgttag

SEQ ID NO: 273924 - DNA, 25 bp, Mus musculus
gctgagcctgatggcgcctcaacct

SEQ ID NO: 273925 - DNA, 25 bp, Mus musculus
ggtcccgcaagagcaacccgtgcag

SEQ ID NO: 273926 - DNA, 25 bp, Mus musculus
caacccgtgcagctggtgactccaa

SEQ ID NO: 273927 - DNA, 25 bp, Mus musculus
ggtgactccaacgaccgctggccgt

SEQ ID NO: 273928 - DNA, 25 bp, Mus musculus
cgcaccggcagcatgcaaggcttct

SEQ ID NO: 273929 - DNA, 25 bp, Mus musculus
gcgcctcaacctgggtgacctctga

SEQ ID NO: 273930 - DNA, 25 bp, Mus musculus
agtcctccggcggttctcctgatcg

SEQ ID NO: 273931 - DNA, 25 bp, Mus musculus
ttctttctcagcaccacgaacttga

SEQ ID NO: 273932 - DNA, 25 bp, Mus musculus
ccacggccacgttgttgacgaactg

SEQ ID NO: 273933 - DNA, 25 bp, Mus musculus
gacgaactgcttgaagcggtcccta

SEQ ID NO: 273934 - DNA, 25 bp, Mus musculus
tccagcagcggcttgaagcggctca

SEQ ID NO: 273935 - DNA, 25 bp, Mus musculus
gccggacatgaagtcgcgcttggca

SEQ ID NO: 273936 - DNA, 25 bp, Mus musculus
ggcacagttgtcctccgctgggaca

SEQ ID NO: 273937 - DNA, 25 bp, Mus musculus
tctaccgaaagcctccgcaggagca

SEQ ID NO: 273938 - DNA, 25 bp, Mus musculus
ggctagctcgaagaactccagattt

SEQ ID NO: 273939 - DNA, 25 bp, Mus musculus
acgcacgatggacgccttgtccagc

SEQ ID NO: 273940 - DNA, 25 bp, Mus musculus
taagacgcacgatggacgccttgtc

SEQ ID NO: 273941 - DNA, 25 bp, Mus musculus
cgctaagacgcacgatggacgcctt

SEQ ID NO: 273942 - DNA, 25 bp, Mus musculus
aggtaggtgacgctaagacgcacga

SEQ ID NO: 273943 - DNA, 25 bp, Mus musculus
ccagcgcggcaaaacgacgcaggcg

SEQ ID NO: 273944 - DNA, 25 bp, Mus musculus
cgtgagcatgcgcactcaccgaggc

SEQ ID NO: 273945 - DNA, 25 bp, Mus musculus
ggagcagcttggctagctcgaagaa

SEQ ID NO: 273946 - DNA, 25 bp, Mus musculus
agaactccagattttccttcccgcg

SEQ ID NO: 273947 - DNA, 25 bp, Mus musculus
cagattttccttcccgcgtcgccag

SEQ ID NO: 273948 - DNA, 25 bp, Mus musculus
agcgttgcgggacttctctttgcgc

SEQ ID NO: 273949 - DNA, 25 bp, Mus musculus
cgggacttctctttgcgctgcgcct

SEQ ID NO: 273950 - DNA, 25 bp, Mus musculus
cagcgcgcagcgttgcgggacttct

SEQ ID NO: 273951 - DNA, 25 bp, Mus musculus
tgtccagctggctggagatggcacc

SEQ ID NO: 273952 - DNA, 25 bp, Mus musculus
agcctctggcgtcaagtgctgatga

SEQ ID NO: 273953 - DNA, 25 bp, Mus musculus
tgagacgctaaaactggcccgcgac

SEQ ID NO: 273954 - DNA, 25 bp, Mus musculus
gaacttcggggtcctgagacgctaa

SEQ ID NO: 273955 - DNA, 25 bp, Mus musculus
atgcgaccgcgggttcccgaagtcg

SEQ ID NO: 273956 - DNA, 25 bp, Mus musculus
atgtgtcagctcctatgcgaccgcg

SEQ ID NO: 273957 - DNA, 25 bp, Mus musculus
tccacagtgtcctcagggaaggctc

SEQ ID NO: 273958 - DNA, 25 bp, Mus musculus
ctgcgcggagtcctgtccgctatca

SEQ ID NO: 273959 - DNA, 25 bp, Mus musculus
aaggtaccgccgcacggtgggcact

SEQ ID NO: 273960 - DNA, 25 bp, Mus musculus
acaatagcaaggctgcgaccggggc

SEQ ID NO: 273961 - DNA, 25 bp, Mus musculus
gtgctgatgacgtcatcccggcgcc

SEQ ID NO: 273962 - DNA, 25 bp, Mus musculus
cagccaggtgattccctagcctctg

SEQ ID NO: 273963 - DNA, 25 bp, Mus musculus
cactgcacctctaggctgcgcggag

SEQ ID NO: 273964 - DNA, 25 bp, Mus musculus
gccagcccggctacatacaatagca

SEQ ID NO: 273965 - DNA, 25 bp, Mus musculus
cgctatcaccggcttttcgcagtcg

SEQ ID NO: 273966 - DNA, 25 bp, Mus musculus
gtagccggcgggcaatcatgcctcg

SEQ ID NO: 273967 - DNA, 25 bp, Mus musculus
gcctggaactctattatgcgctgtc

SEQ ID NO: 273968 - DNA, 25 bp, Mus musculus
tctattatgcgctgtctggccaggc

SEQ ID NO: 273969 - DNA, 25 bp, Mus musculus
tatgcgctgtctggccaggcggtac

SEQ ID NO: 273970 - DNA, 25 bp, Mus musculus
caggcggtactgcttgtgcagcttc

SEQ ID NO: 273971 - DNA, 25 bp, Mus musculus
tactgcttgtgcagcttccgggagc

SEQ ID NO: 273972 - DNA, 25 bp, Mus musculus
ggcagcgggcctggaactctattat

SEQ ID NO: 273973 - DNA, 25 bp, Mus musculus
ttgcgcaccagataggcccggcagc

SEQ ID NO: 273974 - DNA, 25 bp, Mus musculus
gcggaaggccttgcgcaccagatag

SEQ ID NO: 273975 - DNA, 25 bp, Mus musculus
tgcacggtgatcacggcccagaggc

SEQ ID NO: 273976 - DNA, 25 bp, Mus musculus
cataggcctgcacggtgatcacggc

SEQ ID NO: 273977 - DNA, 25 bp, Mus musculus
tcatgcctcgggcataggcctgcac

SEQ ID NO: 273978 - DNA, 25 bp, Mus musculus
cagcgggcctggaactctattatgc

SEQ ID NO: 273979 - DNA, 25 bp, Mus musculus
ggcgggcaatcatgcctcgggcata

SEQ ID NO: 273980 - DNA, 25 bp, Mus musculus
ctaaacccggccatctgccaggggc

SEQ ID NO: 273981 - DNA, 25 bp, Mus musculus
gagcgtttggttcaagtttcgcacc

SEQ ID NO: 273982 - DNA, 25 bp, Mus musculus
gttcaagtttcgcaccagagcccac

SEQ ID NO: 273983 - DNA, 25 bp, Mus musculus
aagtttcgcaccagagcccacttgc

SEQ ID NO: 273984 - DNA, 25 bp, Mus musculus
tgcctcgcctgggtcagcagggctt

SEQ ID NO: 273985 - DNA, 25 bp, Mus musculus
cttccgggggactccatggtgcgct

SEQ ID NO: 273986 - DNA, 25 bp, Mus musculus
atctgccaggggcccatggcaacgg

SEQ ID NO: 273987 - DNA, 25 bp, Mus musculus
tggcctcacgacacgaagcgggctc

SEQ ID NO: 273988 - DNA, 25 bp, Mus musculus
cgctgggtctggtggcctcacgaca

SEQ ID NO: 273989 - DNA, 25 bp, Mus musculus
gcacgccacccgcttgggaacccta

SEQ ID NO: 273990 - DNA, 25 bp, Mus musculus
agcgggctcctaattcacctaatcc

SEQ ID NO: 273991 - DNA, 25 bp, Mus musculus
tcacgacacgaagcgggctcctaat

SEQ ID NO: 273992 - DNA, 25 bp, Mus musculus
cgaagcgggctcctaattcacctaa

SEQ ID NO: 273993 - DNA, 25 bp, Mus musculus
gcgaaggtcttgagcgtttggttca

SEQ ID NO: 273994 - DNA, 25 bp, Mus musculus
cgggcttgtccagaaccacgttcca

SEQ ID NO: 273995 - DNA, 25 bp, Mus musculus
gtcggagtcttccttgcgccagaag

SEQ ID NO: 273996 - DNA, 25 bp, Mus musculus
cccgtgatggtgaccttgccgggct

SEQ ID NO: 273997 - DNA, 25 bp, Mus musculus
gtgatcgaactgcagcttctgctgc

SEQ ID NO: 273998 - DNA, 25 bp, Mus musculus
gttccagtgatcgaactgcagcttc

SEQ ID NO: 273999 - DNA, 25 bp, Mus musculus
tgtccagaaccacgttccagtgatc

SEQ ID NO: 274000 - DNA, 25 bp, Mus musculus
gaaccacgttccagtgatcgaactg

SEQ ID NO: 274001 - DNA, 25 bp, Mus musculus
cttgccgggcttgtccagaaccacg

SEQ ID NO: 274002 - DNA, 25 bp, Mus musculus
tcttccttgcgccagaagatggcgg

SEQ ID NO: 274003 - DNA, 25 bp, Mus musculus
ccagcagctggcgtgtcatgaggtt

SEQ ID NO: 274004 - DNA, 25 bp, Mus musculus
tccagttctgcgaggtgcccgtgat

SEQ ID NO: 274005 - DNA, 25 bp, Mus musculus
cttctgctgctggatgaaatcgagg

SEQ ID NO: 274006 - DNA, 25 bp, Mus musculus
gaaatcgaggcggtagacggactca

SEQ ID NO: 274007 - DNA, 25 bp, Mus musculus
atcgaggcggtagacggactcagcc

SEQ ID NO: 274008 - DNA, 25 bp, Mus musculus
cactggagcggaggctagaccagcc

SEQ ID NO: 274009 - DNA, 25 bp, Mus musculus
ttcgtgctcccaaggcacgcactgg

SEQ ID NO: 274010 - DNA, 25 bp, Mus musculus
cctcccattggaggccagaggcgtg

SEQ ID NO: 274011 - DNA, 25 bp, Mus musculus
agcctcctcccattggaggccagag

SEQ ID NO: 274012 - DNA, 25 bp, Mus musculus
ggaggctagaccagcccgcgccaca

SEQ ID NO: 274013 - DNA, 25 bp, Mus musculus
tgctcggattcgtgctcccaaggca

SEQ ID NO: 274014 - DNA, 25 bp, Mus musculus
gcacactaatgtgcgctcgcacacg

SEQ ID NO: 274015 - DNA, 25 bp, Mus musculus
gcgggatgtacaacccctgctcgga

SEQ ID NO: 274016 - DNA, 25 bp, Mus musculus
actcccgggatgcagagcacagtgc

SEQ ID NO: 274017 - DNA, 25 bp, Mus musculus
cggattcgtgctcccaaggcacgca

SEQ ID NO: 274018 - DNA, 25 bp, Mus musculus
ctggactcccgggatgcagagcaca

SEQ ID NO: 274019 - DNA, 25 bp, Mus musculus
acacccaaacgcacactaatgtgcg

SEQ ID NO: 274020 - DNA, 25 bp, Mus musculus
tccctccgcgcagcgcctcctacct

SEQ ID NO: 274021 - DNA, 25 bp, Mus musculus
cctacctgccgcgtcgccgcagctg

SEQ ID NO: 274022 - DNA, 25 bp, Mus musculus
cttggatcctagcaggcagcagctg

SEQ ID NO: 274023 - DNA, 25 bp, Mus musculus
cggtagcgcaggaagtcttggatcc

SEQ ID NO: 274024 - DNA, 25 bp, Mus musculus
gcgacgacttcacggccagcagcaa

SEQ ID NO: 274025 - DNA, 25 bp, Mus musculus
aaggtgtcactgaagtcccactgca

SEQ ID NO: 274026 - DNA, 25 bp, Mus musculus
ccgtgtgcacgaagacgtcgtcgtc

SEQ ID NO: 274027 - DNA, 25 bp, Mus musculus
aagctcagtacgttggccgtgtgca

SEQ ID NO: 274028 - DNA, 25 bp, Mus musculus
cgggcgactgcacctctaggaagct

SEQ ID NO: 274029 - DNA, 25 bp, Mus musculus
ggcacgaagtacttgctcccgcttt

SEQ ID NO: 274030 - DNA, 25 bp, Mus musculus
cccgctttcgcgaacaggcacagaa

SEQ ID NO: 274031 - DNA, 25 bp, Mus musculus
catgcccatgtaggcatcgtcgatg

SEQ ID NO: 274032 - DNA, 25 bp, Mus musculus
ctcgcggtacatgcagggatccaag

SEQ ID NO: 274033 - DNA, 25 bp, Mus musculus
atccaaggataagcgctgcacattg

SEQ ID NO: 274034 - DNA, 25 bp, Mus musculus
gcacattgggcagctgcacgccgaa

SEQ ID NO: 274035 - DNA, 25 bp, Mus musculus
ccaaccatgagctgcccggtgaaga

SEQ ID NO: 274036 - DNA, 25 bp, Mus musculus
ggtaagaactcctattcccagcggc

SEQ ID NO: 274037 - DNA, 25 bp, Mus musculus
ggccgcgctcaggtaagaactccta

SEQ ID NO: 274038 - DNA, 25 bp, Mus musculus
tctcatccgaggtccgggcgcggct

SEQ ID NO: 274039 - DNA, 25 bp, Mus musculus
gcaaatgacccatcctgatcgtgcg

SEQ ID NO: 274040 - DNA, 25 bp, Mus musculus
tcacagaactcagcgacgaacaagg

SEQ ID NO: 274041 - DNA, 25 bp, Mus musculus
gcgacgaacaaggtcaccacatagt

SEQ ID NO: 274042 - DNA, 25 bp, Mus musculus
tagttctcctcacaccagtccaatg

SEQ ID NO: 274043 - DNA, 25 bp, Mus musculus
caccagtccaatgtggaggtcgtgg

SEQ ID NO: 274044 - DNA, 25 bp, Mus musculus
tttgcggtccacagccggagccatc

SEQ ID NO: 274045 - DNA, 25 bp, Mus musculus
ggctcaggcaaagcgcgctctccgg

SEQ ID NO: 274046 - DNA, 25 bp, Mus musculus
agagccgtcactgaacctgcccaga

SEQ ID NO: 274047 - DNA, 25 bp, Mus musculus
ggtagcagcattcgggccctcccgg

SEQ ID NO: 274048 - DNA, 25 bp, Mus musculus
cagaagccagtccaggcaccactgg

SEQ ID NO: 274049 - DNA, 25 bp, Mus musculus
ggggcaggcgcaaatgacccatcct

SEQ ID NO: 274050 - DNA, 25 bp, Mus musculus
agcgagatagccatgcaaagccacg

SEQ ID NO: 274051 - DNA, 25 bp, Mus musculus
tgcagttgtcgcctcggcacgctca

SEQ ID NO: 274052 - DNA, 25 bp, Mus musculus
cccacctggcaggtctgcagttgtc

SEQ ID NO: 274053 - DNA, 25 bp, Mus musculus
gactctatggctcggtgtcccggaa

SEQ ID NO: 274054 - DNA, 25 bp, Mus musculus
cccaggcagagcctttgtctcctga

SEQ ID NO: 274055 - DNA, 25 bp, Mus musculus
ttcttacaaagaccctggaggcgcc

SEQ ID NO: 274056 - DNA, 25 bp, Mus musculus
gtgagatgcacgtgttcttacaaag

SEQ ID NO: 274057 - DNA, 25 bp, Mus musculus
caaaagacccagtaccgtgagatgc

SEQ ID NO: 274058 - DNA, 25 bp, Mus musculus
cgcacacacaaaggcaaggcagatg

SEQ ID NO: 274059 - DNA, 25 bp, Mus musculus
aaaacggggacactggagcgagata

SEQ ID NO: 274060 - DNA, 25 bp, Mus musculus
cgcaaggctgcaaaacggggacact

SEQ ID NO: 274061 - DNA, 25 bp, Mus musculus
cgtcgacaagcatagaccacgtatg

SEQ ID NO: 274062 - DNA, 25 bp, Mus musculus
cgtatgcggacactaggagcgccca

SEQ ID NO: 274063 - DNA, 25 bp, Mus musculus
ggcagatgctggcttccgaacccaa

SEQ ID NO: 274064 - DNA, 25 bp, Mus musculus
cctcggcctagcttcttttgtgatc

SEQ ID NO: 274065 - DNA, 25 bp, Mus musculus
acctgcggctccctgcacccaagac

SEQ ID NO: 274066 - DNA, 25 bp, Mus musculus
tgcacgtgcggctgcctcggcctag

SEQ ID NO: 274067 - DNA, 25 bp, Mus musculus
tggcgccaggatttcctccgcggac

SEQ ID NO: 274068 - DNA, 25 bp, Mus musculus
ggcctagcttcttttgtgatccttc

SEQ ID NO: 274069 - DNA, 25 bp, Mus musculus
cttttgtgatccttctccctccagt

SEQ ID NO: 274070 - DNA, 25 bp, Mus musculus
tttcggtttcaagcgccgccctagc

SEQ ID NO: 274071 - DNA, 25 bp, Mus musculus
ccctagctgggtccgggcgattcca

SEQ ID NO: 274072 - DNA, 25 bp, Mus musculus
cagaggcgatgctcggttcctaggt

SEQ ID NO: 274073 - DNA, 25 bp, Mus musculus
gatgctcggttcctaggtccgcacg

SEQ ID NO: 274074 - DNA, 25 bp, Mus musculus
ttcctaggtccgcacggctggcagg

SEQ ID NO: 274075 - DNA, 25 bp, Mus musculus
tgctatttaaaaggcgggcgccgcc

SEQ ID NO: 274076 - DNA, 25 bp, Mus musculus
cctagagagctagggccggaccctc

SEQ ID NO: 274077 - DNA, 25 bp, Mus musculus
cacccaagacctcgcgggcccacgg

SEQ ID NO: 274078 - DNA, 25 bp, Mus musculus
ccaggaagtggccatattggatcca

SEQ ID NO: 274079 - DNA, 25 bp, Mus musculus
acttggaacgcgtctcggtgaggcc

SEQ ID NO: 274080 - DNA, 25 bp, Mus musculus
ggccaccgacttggaacgcgtctcg

SEQ ID NO: 274081 - DNA, 25 bp, Mus musculus
cgccatggcggccaccgacttggaa

SEQ ID NO: 274082 - DNA, 25 bp, Mus musculus
agggtgtctcagagtgttgggcttc

SEQ ID NO: 274083 - DNA, 25 bp, Mus musculus
cttcgcgcgatgtgagctctttcgc

SEQ ID NO: 274084 - DNA, 25 bp, Mus musculus
cgatgtgagctctttcgcgggaaga

SEQ ID NO: 274085 - DNA, 25 bp, Mus musculus
tgtgagctctttcgcgggaagaagc

SEQ ID NO: 274086 - DNA, 25 bp, Mus musculus
agtggccatattggatccattcagc

SEQ ID NO: 274087 - DNA, 25 bp, Mus musculus
gagtttccaggaagtggccatattg

SEQ ID NO: 274088 - DNA, 25 bp, Mus musculus
agacaagactcgtgtccagagggga

SEQ ID NO: 274089 - DNA, 25 bp, Mus musculus
caggtgtgaagacaagactcgtgtc

SEQ ID NO: 274090 - DNA, 25 bp, Mus musculus
gaagaagccaagatctgggctgatc

SEQ ID NO: 274091 - DNA, 25 bp, Mus musculus
attggatccattcagccgcagccgc

SEQ ID NO: 274092 - DNA, 25 bp, Mus musculus
ttcggcttctacattaccctccagt

SEQ ID NO: 274093 - DNA, 25 bp, Mus musculus
ccagcagccagtcttgggaaccctg

SEQ ID NO: 274094 - DNA, 25 bp, Mus musculus
tcctcagcggagacgacaacggaga

SEQ ID NO: 274095 - DNA, 25 bp, Mus musculus
agacagtcagacaacccggagtcgc

SEQ ID NO: 274096 - DNA, 25 bp, Mus musculus
cggagtcgccctcagtccacttgag

SEQ ID NO: 274097 - DNA, 25 bp, Mus musculus
accctggatagcctgccagcttttc

SEQ ID NO: 274098 - DNA, 25 bp, Mus musculus
tcggggctcatctaaaaggctcctc

SEQ ID NO: 274099 - DNA, 25 bp, Mus musculus
aggctcctccgccaagactagggga

SEQ ID NO: 274100 - DNA, 25 bp, Mus musculus
ccgagcgggttccaatgtcaagccc

SEQ ID NO: 274101 - DNA, 25 bp, Mus musculus
aattaggtttgtttgcggtgcctca

SEQ ID NO: 274102 - DNA, 25 bp, Mus musculus
tcccgccttttgagaaacgagcact

SEQ ID NO: 274103 - DNA, 25 bp, Mus musculus
ctgtcccttttcctctgccttttga

SEQ ID NO: 274104 - DNA, 25 bp, Mus musculus
tggtcacatgcgcaaggaagtctgg

SEQ ID NO: 274105 - DNA, 25 bp, Mus musculus
tctcttgctgcttgctggtcacatg

SEQ ID NO: 274106 - DNA, 25 bp, Mus musculus
caccactttctggatcccggcggta

SEQ ID NO: 274107 - DNA, 25 bp, Mus musculus
tcacgattaggcgtccaggccgacc

SEQ ID NO: 274108 - DNA, 25 bp, Mus musculus
agtcctgcccaggaagcactcaagc

SEQ ID NO: 274109 - DNA, 25 bp, Mus musculus
cgtggcctccaggttaccaagactc

SEQ ID NO: 274110 - DNA, 25 bp, Mus musculus
tcgcatcccagcaggacccagaagt

SEQ ID NO: 274111 - DNA, 25 bp, Mus musculus
acccgcaggactcccgacatggtta

SEQ ID NO: 274112 - DNA, 25 bp, Mus musculus
ctggttctttcctcttcacgattag

SEQ ID NO: 274113 - DNA, 25 bp, Mus musculus
cagggacgtgtccatctggttcttt

SEQ ID NO: 274114 - DNA, 25 bp, Mus musculus
agaccctggtctatgacaccgctgg

SEQ ID NO: 274115 - DNA, 25 bp, Mus musculus
tgcgtgccaagcatgcccaagctgc

SEQ ID NO: 274116 - DNA, 25 bp, Mus musculus
tgccttagatgcgttcctcagtttc

SEQ ID NO: 274117 - DNA, 25 bp, Mus musculus
acccggttgctaaatatccctaatg

SEQ ID NO: 274118 - DNA, 25 bp, Mus musculus
gggcccaggtactggaatccagatc

SEQ ID NO: 274119 - DNA, 25 bp, Mus musculus
tccagatcctttagagccagggacg

SEQ ID NO: 274120 - DNA, 25 bp, Mus musculus
acaacttttacacaagccgggcaga

SEQ ID NO: 274121 - DNA, 25 bp, Mus musculus
tggacgcatgaaccgtgacaacttt

SEQ ID NO: 274122 - DNA, 25 bp, Mus musculus
cggtgactcacgcaatggacgcatg

SEQ ID NO: 274123 - DNA, 25 bp, Mus musculus
ggtcatcccgaatctgttgccttta

SEQ ID NO: 274124 - DNA, 25 bp, Mus musculus
acgcagtctgacctggccttcttca

SEQ ID NO: 274125 - DNA, 25 bp, Mus musculus
ctggatctgcaggaacccgcacaca

SEQ ID NO: 274126 - DNA, 25 bp, Mus musculus
tcaaagcaatcgcaagggtcatccc

SEQ ID NO: 274127 - DNA, 25 bp, Mus musculus
cagcgcatgcgcaattccttccttg

SEQ ID NO: 274128 - DNA, 25 bp, Mus musculus
gttgtgcgcatgtgcattgagacta

SEQ ID NO: 274129 - DNA, 25 bp, Mus musculus
attgagactacgcagctggcccgac

SEQ ID NO: 274130 - DNA, 25 bp, Mus musculus
tcaacccgcgagttgtttcaaagca

SEQ ID NO: 274131 - DNA, 25 bp, Mus musculus
gccggacgaccatgccgaacttctg

SEQ ID NO: 274132 - DNA, 25 bp, Mus musculus
tgcacacggaagagcacgcagtctg

SEQ ID NO: 274133 - DNA, 25 bp, Mus musculus
gacgcagccgtgaagtaacgttcta

SEQ ID NO: 274134 - DNA, 25 bp, Mus musculus
ggtgcttcgcgtggccctcaccgag

SEQ ID NO: 274135 - DNA, 25 bp, Mus musculus
actctgcctggcgagctgcgcaggc

SEQ ID NO: 274136 - DNA, 25 bp, Mus musculus
gggacacacttacttcttcaccgca

SEQ ID NO: 274137 - DNA, 25 bp, Mus musculus
cgtggctcaccaagggacacactta

SEQ ID NO: 274138 - DNA, 25 bp, Mus musculus
tccaattcgcgcgtggctcaccaag

SEQ ID NO: 274139 - DNA, 25 bp, Mus musculus
ttacggactccaattcgcgcgtggc

SEQ ID NO: 274140 - DNA, 25 bp, Mus musculus
ggccacttacggactccaattcgcg

SEQ ID NO: 274141 - DNA, 25 bp, Mus musculus
gggcacagtggaccagggcaaactc

SEQ ID NO: 274142 - DNA, 25 bp, Mus musculus
gctcttctgggacgcgcagggcaca

SEQ ID NO: 274143 - DNA, 25 bp, Mus musculus
gaaagatgctcttctgggacgcgca

SEQ ID NO: 274144 - DNA, 25 bp, Mus musculus
ctgccgcaggccgagagcttcagga

SEQ ID NO: 274145 - DNA, 25 bp, Mus musculus
tccatctgccgcaggccgagagctt

SEQ ID NO: 274146 - DNA, 25 bp, Mus musculus
agcggctggtaagggtccatctgcc

SEQ ID NO: 274147 - DNA, 25 bp, Mus musculus
ctcaccgaggccaagacgcacgggg

SEQ ID NO: 274148 - DNA, 25 bp, Mus musculus
tggaagaagctatcctcgccgctcc

SEQ ID NO: 274149 - DNA, 25 bp, Mus musculus
aatagggtgcaaagtgtcccggagc

SEQ ID NO: 274150 - DNA, 25 bp, Mus musculus
ggggaccgcactcgcaactcctggg

SEQ ID NO: 274151 - DNA, 25 bp, Mus musculus
cttccgtacagcaatagggtgcaaa

SEQ ID NO: 274152 - DNA, 25 bp, Mus musculus
ggcgagcaaattcccttccgtacag

SEQ ID NO: 274153 - DNA, 25 bp, Mus musculus
ctaaccgtggcgagcaaattccctt

SEQ ID NO: 274154 - DNA, 25 bp, Mus musculus
tgcgtctggaagaagctatcctcgc

SEQ ID NO: 274155 - DNA, 25 bp, Mus musculus
cgctggcactcaacaggcatgcttt

SEQ ID NO: 274156 - DNA, 25 bp, Mus musculus
ggccggagagccgagcacaactgac

SEQ ID NO: 274157 - DNA, 25 bp, Mus musculus
gcgtccgcgcccgagttgccaggat

SEQ ID NO: 274158 - DNA, 25 bp, Mus musculus
gagcacaactgaccgccttggcgtc

SEQ ID NO: 274159 - DNA, 25 bp, Mus musculus
ggatcaaagcgacggtccgcgcctt

SEQ ID NO: 274160 - DNA, 25 bp, Mus musculus
ggcatgctttcaacactaaccgtgg

SEQ ID NO: 274161 - DNA, 25 bp, Mus musculus
tccgcgccttataaaacgcttgggc

SEQ ID NO: 274162 - DNA, 25 bp, Mus musculus
aggctcggccaatcctcgccggtta

SEQ ID NO: 274163 - DNA, 25 bp, Mus musculus
tcgcaggtaaccttgaagctgtcgc

SEQ ID NO: 274164 - DNA, 25 bp, Mus musculus
aaccttgaagctgtcgctcggcgtc

SEQ ID NO: 274165 - DNA, 25 bp, Mus musculus
gaagctgtcgctcggcgtccctgtc

SEQ ID NO: 274166 - DNA, 25 bp, Mus musculus
ctttttgttttgagtgctgcgcggc

SEQ ID NO: 274167 - DNA, 25 bp, Mus musculus
gttttgagtgctgcgcggccagcct

SEQ ID NO: 274168 - DNA, 25 bp, Mus musculus
agcagcccatttggtcattatagtc

SEQ ID NO: 274169 - DNA, 25 bp, Mus musculus
caatcctcgccggttagcctgagcg

SEQ ID NO: 274170 - DNA, 25 bp, Mus musculus
cccatttggtcattatagtcggtca

SEQ ID NO: 274171 - DNA, 25 bp, Mus musculus
tagtcggtcaattgcggacattgtc

SEQ ID NO: 274172 - DNA, 25 bp, Mus musculus
attgcggacattgtcccggcgcaca

SEQ ID NO: 274173 - DNA, 25 bp, Mus musculus
ccggcgcacagcaccaaagctggag

SEQ ID NO: 274174 - DNA, 25 bp, Mus musculus
cgcaacctcgcaggtaaccttgaag

SEQ ID NO: 274175 - DNA, 25 bp, Mus musculus
caaagctggagccagcatagcacac

SEQ ID NO: 274176 - DNA, 25 bp, Mus musculus
ggccgcgctagggtctcacctaatc

SEQ ID NO: 274177 - DNA, 25 bp, Mus musculus
agagagcggactccttcctcgctca

SEQ ID NO: 274178 - DNA, 25 bp, Mus musculus
gccctgttctccgtgattgcaggcg

SEQ ID NO: 274179 - DNA, 25 bp, Mus musculus
tgcgaggctctgctctttgccttgg

SEQ ID NO: 274180 - DNA, 25 bp, Mus musculus
acaccggcgtgtgctatggcatcaa

SEQ ID NO: 274181 - DNA, 25 bp, Mus musculus
catcaagtggctgtaagtaggactc

SEQ ID NO: 274182 - DNA, 25 bp, Mus musculus
aggactccgttttcactccaatggg

SEQ ID NO: 274183 - DNA, 25 bp, Mus musculus
ccaatgggccattgggcgagaagct

SEQ ID NO: 274184 - DNA, 25 bp, Mus musculus
gaggttgggtgagcccaccaaaatc

SEQ ID NO: 274185 - DNA, 25 bp, Mus musculus
ccaccaaaatctgcgaggctaagtt

SEQ ID NO: 274186 - DNA, 25 bp, Mus musculus
ggtctcacctaatccgagcctgacg

SEQ ID NO: 274187 - DNA, 25 bp, Mus musculus
atatgctgttcttaccctccgcggg

SEQ ID NO: 274188 - DNA, 25 bp, Mus musculus
cggcgacttcttctgtgatatgctg

SEQ ID NO: 274189 - DNA, 25 bp, Mus musculus
gagccgttcttagctcggcgacttc

SEQ ID NO: 274190 - DNA, 25 bp, Mus musculus
tcattggttccgtttctgagagggc

SEQ ID NO: 274191 - DNA, 25 bp, Mus musculus
ccaagggacgtgctattggccagtg

SEQ ID NO: 274192 - DNA, 25 bp, Mus musculus
ctacagcctagaaaccgggcaccga

SEQ ID NO: 274193 - DNA, 25 bp, Mus musculus
gcgtgctcattggttccgtttctga

SEQ ID NO: 274194 - DNA, 25 bp, Mus musculus
ctgctgagacggcagctccacatgc

SEQ ID NO: 274195 - DNA, 25 bp, Mus musculus
tcccgagctgtgattcgcagagccc

SEQ ID NO: 274196 - DNA, 25 bp, Mus musculus
tgcctcccgagctgtgattcgcaga

SEQ ID NO: 274197 - DNA, 25 bp, Mus musculus
gcagtcctcccgcatcggccgctgc

SEQ ID NO: 274198 - DNA, 25 bp, Mus musculus
ctattggccagtgggcccgtccgtc

SEQ ID NO: 274199 - DNA, 25 bp, Mus musculus
agacggcagctccacatgcagggcc

SEQ ID NO: 274200 - DNA, 25 bp, Mus musculus
ccagagctggcgtgctcattggttc

SEQ ID NO: 274201 - DNA, 25 bp, Mus musculus
caccgccgctggctaaggaagagcc

SEQ ID NO: 274202 - DNA, 25 bp, Mus musculus
cgctggctaaggaagagccatatta

SEQ ID NO: 274203 - DNA, 25 bp, Mus musculus
agagccatattaccgcagtgcaacc

SEQ ID NO: 274204 - DNA, 25 bp, Mus musculus
ccctagatgagcagaaagccagcga

SEQ ID NO: 274205 - DNA, 25 bp, Mus musculus
cgcgtgacagggcagatcctttatt

SEQ ID NO: 274206 - DNA, 25 bp, Mus musculus
atgctgaagccaatgcacgtcacgg

SEQ ID NO: 274207 - DNA, 25 bp, Mus musculus
gtagccgctgccaccctagatgagc

SEQ ID NO: 274208 - DNA, 25 bp, Mus musculus
cggcgatgagggtcttcatgctgaa

SEQ ID NO: 274209 - DNA, 25 bp, Mus musculus
gctgcgcgcgcactttataacctca

SEQ ID NO: 274210 - DNA, 25 bp, Mus musculus
cccggactgtgccatgttcttgtag

SEQ ID NO: 274211 - DNA, 25 bp, Mus musculus
gagactcccggcgataaactatgca

SEQ ID NO: 274212 - DNA, 25 bp, Mus musculus
aactatgcacagagcccaggaaggc

SEQ ID NO: 274213 - DNA, 25 bp, Mus musculus
cagcatggcctgaactgtacggttc

SEQ ID NO: 274214 - DNA, 25 bp, Mus musculus
gtcccggtgtatgaaactactcctg

SEQ ID NO: 274215 - DNA, 25 bp, Mus musculus
caagcctctctctcagacgttagta

SEQ ID NO: 274216 - DNA, 25 bp, Mus musculus
acgttagtacggtccagcagctgga

SEQ ID NO: 274217 - DNA, 25 bp, Mus musculus
gtcacggccgtgcagaaagccgcct

SEQ ID NO: 274218 - DNA, 25 bp, Mus musculus
gtcgtgacagccatcactgagtctc

SEQ ID NO: 274219 - DNA, 25 bp, Mus musculus
ttttgcatctccagtgccaccatca

SEQ ID NO: 274220 - DNA, 25 bp, Mus musculus
tccacatgtttttgcatctccagtg

SEQ ID NO: 274221 - DNA, 25 bp, Mus musculus
tcagatatccacatgtttttgcatc

SEQ ID NO: 274222 - DNA, 25 bp, Mus musculus
ttgctttgcaaaccagactggcttc

SEQ ID NO: 274223 - DNA, 25 bp, Mus musculus
tctatgtagctttctctgtcctgga

SEQ ID NO: 274224 - DNA, 25 bp, Mus musculus
gacaagatttttctatgtagctttc

SEQ ID NO: 274225 - DNA, 25 bp, Mus musculus
ggcggctcgactaccgcttagggtc

SEQ ID NO: 274226 - DNA, 25 bp, Mus musculus
tccggtcgtgacagccatcactgag

SEQ ID NO: 274227 - DNA, 25 bp, Mus musculus
agaatacttaagtgcctgtaaaaca

SEQ ID NO: 274228 - DNA, 25 bp, Mus musculus
tctttgaagaatacttaagtgcctg

SEQ ID NO: 274229 - DNA, 25 bp, Mus musculus
atcaccactactggggtgactcttt

SEQ ID NO: 274230 - DNA, 25 bp, Mus musculus
ctgtgatcaccactactggggtgac

SEQ ID NO: 274231 - DNA, 25 bp, Mus musculus
ctaccgcttagggtcggctagggca

SEQ ID NO: 274232 - DNA, 25 bp, Mus musculus
accatgccggtgaggatggacagtc

SEQ ID NO: 274233 - DNA, 25 bp, Mus musculus
atggtcttgcggatgctcggaaccc

SEQ ID NO: 274234 - DNA, 25 bp, Mus musculus
tcaagagcccaggacacccgagatt

SEQ ID NO: 274235 - DNA, 25 bp, Mus musculus
actgccctctgtagctgtgtgagcc

SEQ ID NO: 274236 - DNA, 25 bp, Mus musculus
gcggaaaggccttgcgcatgcgtac

SEQ ID NO: 274237 - DNA, 25 bp, Mus musculus
tgagccgcagtctctggagcgctaa

SEQ ID NO: 274238 - DNA, 25 bp, Mus musculus
ccaaacccggtgttgttgggctgca

SEQ ID NO: 274239 - DNA, 25 bp, Mus musculus
ttgcgcatgcgtacttcaagagccc

SEQ ID NO: 274240 - DNA, 25 bp, Mus musculus
ttcggctcatcgtgtcggccctgct

SEQ ID NO: 274241 - DNA, 25 bp, Mus musculus
cgcggccgttgccatagaagcgcgc

SEQ ID NO: 274242 - DNA, 25 bp, Mus musculus
gaacgcgttgcatctcgccaggcct

SEQ ID NO: 274243 - DNA, 25 bp, Mus musculus
tctgccagacagaaaagcaccgcgc

SEQ ID NO: 274244 - DNA, 25 bp, Mus musculus
tggccaccatggtcttgcggatgct

SEQ ID NO: 274245 - DNA, 25 bp, Mus musculus
cccagtctagcgtccatggagatgg

SEQ ID NO: 274246 - DNA, 25 bp, Mus musculus
ggactcggtgatgcgacaggactac

SEQ ID NO: 274247 - DNA, 25 bp, Mus musculus
ccgtgcatcacaagggcctgctgca

SEQ ID NO: 274248 - DNA, 25 bp, Mus musculus
ctaacatggcgtggccgtgcatcac

SEQ ID NO: 274249 - DNA, 25 bp, Mus musculus
cggtgccgctggttttcaccaagta

SEQ ID NO: 274250 - DNA, 25 bp, Mus musculus
ccagcgcgacacacgtaggaaggca

SEQ ID NO: 274251 - DNA, 25 bp, Mus musculus
cctcgcgtgctgtcgccatagagac

SEQ ID NO: 274252 - DNA, 25 bp, Mus musculus
aactttctgctgatgcccgggaccc

SEQ ID NO: 274253 - DNA, 25 bp, Mus musculus
gactaccgcgcctggaaagtgcagc

SEQ ID NO: 274254 - DNA, 25 bp, Mus musculus
tcgagcgcgagacccagtaccagaa

SEQ ID NO: 274255 - DNA, 25 bp, Mus musculus
agccggtgcaaatccctgcgacttc

SEQ ID NO: 274256 - DNA, 25 bp, Mus musculus
ccaagcgtcggcctcagagccaaga

SEQ ID NO: 274257 - DNA, 25 bp, Mus musculus
tcgcccgcttctggaaccagctgga

SEQ ID NO: 274258 - DNA, 25 bp, Mus musculus
gcgggcccatgcaactttctgctga

SEQ ID NO: 274259 - DNA, 25 bp, Mus musculus
ttcaccaagtactcggaggccaccg

SEQ ID NO: 274260 - DNA, 25 bp, Mus musculus
cgcacgaagtcatcggcgaagctca

SEQ ID NO: 274261 - DNA, 25 bp, Mus musculus
gtcatcggcgaagctcacggagctg

SEQ ID NO: 274262 - DNA, 25 bp, Mus musculus
tgtgcacctcctcatcgcgcagctt

SEQ ID NO: 274263 - DNA, 25 bp, Mus musculus
tcacgttgcgcgcagtggagttgct

SEQ ID NO: 274264 - DNA, 25 bp, Mus musculus
cgaggcccactcgttgatggactgc

SEQ ID NO: 274265 - DNA, 25 bp, Mus musculus
agtttccaggtcacgttgcgcgcag

SEQ ID NO: 274266 - DNA, 25 bp, Mus musculus
gctgcccagtttccaggtcacgttg

SEQ ID NO: 274267 - DNA, 25 bp, Mus musculus
gtacaggcggctgcccagtttccag

SEQ ID NO: 274268 - DNA, 25 bp, Mus musculus
ttgcttgctgctgcgcacgaagtca

SEQ ID NO: 274269 - DNA, 25 bp, Mus musculus
tcgcagttgtagtgttgcttgctgc

SEQ ID NO: 274270 - DNA, 25 bp, Mus musculus
tgatcttggagtgttcgcagttgta

SEQ ID NO: 274271 - DNA, 25 bp, Mus musculus
ctcggaagttgatcttggagtgttc

SEQ ID NO: 274272 - DNA, 25 bp, Mus musculus
tccgtggtctgcgaggcccactcgt

SEQ ID NO: 274273 - DNA, 25 bp, Mus musculus
cgctgcgcttgtctcggaagttgat

SEQ ID NO: 274274 - DNA, 25 bp, Mus musculus
ccctagcgactcgttcctgaggcgg

SEQ ID NO: 274275 - DNA, 25 bp, Mus musculus
gacacccgcgaactggcacaggagg

SEQ ID NO: 274276 - DNA, 25 bp, Mus musculus
gcgccagatttacacagcgcgagga

SEQ ID NO: 274277 - DNA, 25 bp, Mus musculus
gcgcgggacctcactaaccaatgga

SEQ ID NO: 274278 - DNA, 25 bp, Mus musculus
gcgcctgaggaaaacgccgctacct

SEQ ID NO: 274279 - DNA, 25 bp, Mus musculus
ccctctcgcaagtgcgcgtgcgttt

SEQ ID NO: 274280 - DNA, 25 bp, Mus musculus
tgcgcgtactggagaccctctcgca

SEQ ID NO: 274281 - DNA, 25 bp, Mus musculus
gtcgcgcgttccaggctgcagtacc

SEQ ID NO: 274282 - DNA, 25 bp, Mus musculus
gggacttagggctccatcccgctcg

SEQ ID NO: 274283 - DNA, 25 bp, Mus musculus
agggagcgtacccagcgagtgaacc

SEQ ID NO: 274284 - DNA, 25 bp, Mus musculus
agccatctctgagaggcttggcccg

SEQ ID NO: 274285 - DNA, 25 bp, Mus musculus
gctgcagcctgcgaagccaccgaag

SEQ ID NO: 274286 - DNA, 25 bp, Mus musculus
gcgccggctccaagagaaagccatc

SEQ ID NO: 274287 - DNA, 25 bp, Mus musculus
agcgcgaggacggacacccgcgaac

SEQ ID NO: 274288 - DNA, 25 bp, Mus musculus
cccagctctgggacttgagtgtaga

SEQ ID NO: 274289 - DNA, 25 bp, Mus musculus
ccagctcctggagaaccaaatcttc

SEQ ID NO: 274290 - DNA, 25 bp, Mus musculus
acacgggcagagagtgaactgttta

SEQ ID NO: 274291 - DNA, 25 bp, Mus musculus
ggcgagtcgaagctgccacctttct

SEQ ID NO: 274292 - DNA, 25 bp, Mus musculus
gggtcccaagcaggcagaacagtcg

SEQ ID NO: 274293 - DNA, 25 bp, Mus musculus
ttgaaactgtactggcaccgcccgg

SEQ ID NO: 274294 - DNA, 25 bp, Mus musculus
actgacccatctctgctggagtgtc

SEQ ID NO: 274295 - DNA, 25 bp, Mus musculus
aactgctccggacttgaaactgtac

SEQ ID NO: 274296 - DNA, 25 bp, Mus musculus
tcagctgccttggaccgaactgctc

SEQ ID NO: 274297 - DNA, 25 bp, Mus musculus
gcattccgcgcctggactttcctag

SEQ ID NO: 274298 - DNA, 25 bp, Mus musculus
ggcagacttcttcgccttgctccgg

SEQ ID NO: 274299 - DNA, 25 bp, Mus musculus
cacaggtccgcccagatttgcagag

SEQ ID NO: 274300 - DNA, 25 bp, Mus musculus
gaccggcctagcagtgtctctcacg

SEQ ID NO: 274301 - DNA, 25 bp, Mus musculus
tctccgccctaggttaaggatcttg

SEQ ID NO: 274302 - DNA, 25 bp, Mus musculus
cgcctcctggagcacgtgcgcctgc

SEQ ID NO: 274303 - DNA, 25 bp, Mus musculus
gaagcccgcgcctgcttcatcctgg

SEQ ID NO: 274304 - DNA, 25 bp, Mus musculus
gcgcccgcctacttcctggagaagg

SEQ ID NO: 274305 - DNA, 25 bp, Mus musculus
tctccctgcaggatgagggagaccc

SEQ ID NO: 274306 - DNA, 25 bp, Mus musculus
cgcgtcctgccacgcgcagcgcatc

SEQ ID NO: 274307 - DNA, 25 bp, Mus musculus
gcatcctgcagacgctcaacgcgta

SEQ ID NO: 274308 - DNA, 25 bp, Mus musculus
ggagcggcaccctcaccgacgtggt

SEQ ID NO: 274309 - DNA, 25 bp, Mus musculus
cgcgacttcccgtgccaccgcgcgg

SEQ ID NO: 274310 - DNA, 25 bp, Mus musculus
cagcgcccacttccgcggcctgttc

SEQ ID NO: 274311 - DNA, 25 bp, Mus musculus
ccctggccgtggtgctcgactacgt

SEQ ID NO: 274312 - DNA, 25 bp, Mus musculus
ccttcgtggaggtgacgcgccacgc

SEQ ID NO: 274313 - DNA, 25 bp, Mus musculus
aacagtctggcgctgcgacgcgtcg

SEQ ID NO: 274314 - DNA, 25 bp, Mus musculus
tggtgctcgactacgtgtacggcgc

SEQ ID NO: 274315 - DNA, 25 bp, Mus musculus
cgccacgccgacttcctggagctcg

SEQ ID NO: 274316 - DNA, 25 bp, Mus musculus
cttcttggaaatctgcaccgccatc

SEQ ID NO: 274317 - DNA, 25 bp, Mus musculus
agacgcttaccttcctcttcttgga

SEQ ID NO: 274318 - DNA, 25 bp, Mus musculus
tatatagggcgggagcaatgacgcc

SEQ ID NO: 274319 - DNA, 25 bp, Mus musculus
ccgctgaaaggaaaggaagtggctc

SEQ ID NO: 274320 - DNA, 25 bp, Mus musculus
ccggtgttcgagtcggtccagaact

SEQ ID NO: 274321 - DNA, 25 bp, Mus musculus
agtcggtccagaactcgaggagttt

SEQ ID NO: 274322 - DNA, 25 bp, Mus musculus
gcacttgtagaacccgcggcggact

SEQ ID NO: 274323 - DNA, 25 bp, Mus musculus
ccgcgcgccgctgaaaggaaaggaa

SEQ ID NO: 274324 - DNA, 25 bp, Mus musculus
ggactgatcacggagccacaggcct

SEQ ID NO: 274325 - DNA, 25 bp, Mus musculus
cggctccggcccaatacacaatcta

SEQ ID NO: 274326 - DNA, 25 bp, Mus musculus
acaatctacggccatccgaggctcg

SEQ ID NO: 274327 - DNA, 25 bp, Mus musculus
tacggccatccgaggctcgaagaga

SEQ ID NO: 274328 - DNA, 25 bp, Mus musculus
gacgctccacaggactgatcacgga

SEQ ID NO: 274329 - DNA, 25 bp, Mus musculus
cagaactcgaggagtttgtccctcc

SEQ ID NO: 274330 - DNA, 25 bp, Mus musculus
gcggaggttccagtcagcgtcaccc

SEQ ID NO: 274331 - DNA, 25 bp, Mus musculus
cggaccatgggcgacaaagggacac

SEQ ID NO: 274332 - DNA, 25 bp, Mus musculus
tggccgccctgtcccacgcgcgcgt

SEQ ID NO: 274333 - DNA, 25 bp, Mus musculus
accatgggcgacaaagggacacggt

SEQ ID NO: 274334 - DNA, 25 bp, Mus musculus
ctgacgccgcggacctccctgcggc

SEQ ID NO: 274335 - DNA, 25 bp, Mus musculus
ttttccagcctggacgctgacgccg

SEQ ID NO: 274336 - DNA, 25 bp, Mus musculus
ggattttccagcctggacgctgacg

SEQ ID NO: 274337 - DNA, 25 bp, Mus musculus
acggaggcatacacgcgcgctcaca

SEQ ID NO: 274338 - DNA, 25 bp, Mus musculus
cagagccgcgcacggaggcatacac

SEQ ID NO: 274339 - DNA, 25 bp, Mus musculus
agccctcactctctgggcgcgcaca

SEQ ID NO: 274340 - DNA, 25 bp, Mus musculus
cacgcgctcccgtggaccagccgcg

SEQ ID NO: 274341 - DNA, 25 bp, Mus musculus
accagcactggcacgcgcttgcgtg

SEQ ID NO: 274342 - DNA, 25 bp, Mus musculus
gcgcgcacagccgtgcacacgcacc

SEQ ID NO: 274343 - DNA, 25 bp, Mus musculus
tggcacgcgcttgcgtgcacgcgct

SEQ ID NO: 274344 - DNA, 25 bp, Mus musculus
cgatggagactggataacagcgaca

SEQ ID NO: 274345 - DNA, 25 bp, Mus musculus
agcagcgtctgggtgtcaacctccc

SEQ ID NO: 274346 - DNA, 25 bp, Mus musculus
cgccagaggactgagagcagcgtct

SEQ ID NO: 274347 - DNA, 25 bp, Mus musculus
gacaaatatcccaggagcagaagga

SEQ ID NO: 274348 - DNA, 25 bp, Mus musculus
ctggcagtaatgagacaaatatccc

SEQ ID NO: 274349 - DNA, 25 bp, Mus musculus
ccgctgcgcaagaactggcagtaat

SEQ ID NO: 274350 - DNA, 25 bp, Mus musculus
cgaacccagtgaccgctgcgcaaga

SEQ ID NO: 274351 - DNA, 25 bp, Mus musculus
tcggaagaaggcctgaagctgagct

SEQ ID NO: 274352 - DNA, 25 bp, Mus musculus
ctcccgtggagtctcggaagaaggc

SEQ ID NO: 274353 - DNA, 25 bp, Mus musculus
ctctctgggctctcccgtggagtct

SEQ ID NO: 274354 - DNA, 25 bp, Mus musculus
tcaccggctccggaggctctctggg

SEQ ID NO: 274355 - DNA, 25 bp, Mus musculus
cggccgaattccgggtgactctcac

SEQ ID NO: 274356 - DNA, 25 bp, Mus musculus
cacagacgctgaaacgaacccagtg

SEQ ID NO: 274357 - DNA, 25 bp, Mus musculus
taacagcgacagaaaccacagacgc

SEQ ID NO: 274358 - DNA, 25 bp, Mus musculus
atcctcgcggttactaaggagtggg

SEQ ID NO: 274359 - DNA, 25 bp, Mus musculus
ctgctcatgtgataggcagcgcaga

SEQ ID NO: 274360 - DNA, 25 bp, Mus musculus
cgcagagcccatcgggatccgtagt

SEQ ID NO: 274361 - DNA, 25 bp, Mus musculus
gatccgtagtctggtgtgctgatga

SEQ ID NO: 274362 - DNA, 25 bp, Mus musculus
acgggacttgtagttagaatctgcc

SEQ ID NO: 274363 - DNA, 25 bp, Mus musculus
ttagaatctgccgtcgccggttgcc

SEQ ID NO: 274364 - DNA, 25 bp, Mus musculus
gttgctagccacatcctcgcggtta

SEQ ID NO: 274365 - DNA, 25 bp, Mus musculus
ccaccgtggagcgactccgagattc

SEQ ID NO: 274366 - DNA, 25 bp, Mus musculus
tacgacttgtccgaagccgattggc

SEQ ID NO: 274367 - DNA, 25 bp, Mus musculus
aggcttgcaggcgtgcactccgcct

SEQ ID NO: 274368 - DNA, 25 bp, Mus musculus
tgcactccgcctgacagggacatcg

SEQ ID NO: 274369 - DNA, 25 bp, Mus musculus
agggacatcgcctccgcgggctctt

SEQ ID NO: 274370 - DNA, 25 bp, Mus musculus
aagccgattggctgaagctgctcat

SEQ ID NO: 274371 - DNA, 25 bp, Mus musculus
tccgagattcccgtgaggcttgcag

SEQ ID NO: 274372 - DNA, 25 bp, Mus musculus
ctcattcctgtaggcactgtgttgc

SEQ ID NO: 274373 - DNA, 25 bp, Mus musculus
aggagttccgcgcacgctaccggca

SEQ ID NO: 274374 - DNA, 25 bp, Mus musculus
gccaagaggctgctcaaggagttcc

SEQ ID NO: 274375 - DNA, 25 bp, Mus musculus
gcctagtgaaccagaagcaataccg

SEQ ID NO: 274376 - DNA, 25 bp, Mus musculus
gcacagcagcgcctagtgaaccaga

SEQ ID NO: 274377 - DNA, 25 bp, Mus musculus
cactgtgttgcagcggcgcgcacag

SEQ ID NO: 274378 - DNA, 25 bp, Mus musculus
tcgagttcatggacgagttctgcca

SEQ ID NO: 274379 - DNA, 25 bp, Mus musculus
acgcagctcgctgcggactgtgttc

SEQ ID NO: 274380 - DNA, 25 bp, Mus musculus
ggcgctgtcctttctcattcctgta

SEQ ID NO: 274381 - DNA, 25 bp, Mus musculus
tgcggactgtgttcgctgccagccc

SEQ ID NO: 274382 - DNA, 25 bp, Mus musculus
aagttgggccgcttcctcgagttca

SEQ ID NO: 274383 - DNA, 25 bp, Mus musculus
gccgcttcctcgagttcatggacga

SEQ ID NO: 274384 - DNA, 25 bp, Mus musculus
atggacgagttctgccaggagccca

SEQ ID NO: 274385 - DNA, 25 bp, Mus musculus
gctaccggcagctggtacgcagctc

SEQ ID NO: 274386 - DNA, 25 bp, Mus musculus
ttcctggaccaagctcggcggtgaa

SEQ ID NO: 274387 - DNA, 25 bp, Mus musculus
agcggcaagattaagcactggaacc

SEQ ID NO: 274388 - DNA, 25 bp, Mus musculus
cgacttaaccttgggcaaagctttg

SEQ ID NO: 274389 - DNA, 25 bp, Mus musculus
cccatccttggtccggtgggcatga

SEQ ID NO: 274390 - DNA, 25 bp, Mus musculus
gcagctctgtttacccgcacctgta

SEQ ID NO: 274391 - DNA, 25 bp, Mus musculus
agccaggccaggtaggctggttttc

SEQ ID NO: 274392 - DNA, 25 bp, Mus musculus
cacagtgaaaatgcccgaggcgctc

SEQ ID NO: 274393 - DNA, 25 bp, Mus musculus
ccgggtgaatgctgcagactgcaca

SEQ ID NO: 274394 - DNA, 25 bp, Mus musculus
agaacatgctctaggggcgcacgct

SEQ ID NO: 274395 - DNA, 25 bp, Mus musculus
tcccggagtgtcctagacgagaaca

SEQ ID NO: 274396 - DNA, 25 bp, Mus musculus
gtggccaccagctttgggaccttca

SEQ ID NO: 274397 - DNA, 25 bp, Mus musculus
tgccaggctaactacgccaagtgta

SEQ ID NO: 274398 - DNA, 25 bp, Mus musculus
tggctgtcgtccatctcgcagtaca

SEQ ID NO: 274399 - DNA, 25 bp, Mus musculus
agaagcccgccgcaagccgacttaa

SEQ ID NO: 274400 - DNA, 25 bp, Mus musculus
cgcctcctccttggtctccgggaag

SEQ ID NO: 274401 - DNA, 25 bp, Mus musculus
ccgcgcgtgggagaaggcgcactgg

SEQ ID NO: 274402 - DNA, 25 bp, Mus musculus
cgatggcccgcggagatagaggcgc

SEQ ID NO: 274403 - DNA, 25 bp, Mus musculus
atagaggcgcggccttatgtaacgg

SEQ ID NO: 274404 - DNA, 25 bp, Mus musculus
atggggtcgataagaggacgcccgc

SEQ ID NO: 274405 - DNA, 25 bp, Mus musculus
acggtcccggctggaccgctggatc

SEQ ID NO: 274406 - DNA, 25 bp, Mus musculus
gctggaccgctggatcagtgtccca

SEQ ID NO: 274407 - DNA, 25 bp, Mus musculus
ggaccgctggatcagtgtcccaagc

SEQ ID NO: 274408 - DNA, 25 bp, Mus musculus
ctggatcagtgtcccaagcgccttt

SEQ ID NO: 274409 - DNA, 25 bp, Mus musculus
ggatcagtgtcccaagcgcctttgc

SEQ ID NO: 274410 - DNA, 25 bp, Mus musculus
tcagtgtcccaagcgcctttgcgca

SEQ ID NO: 274411 - DNA, 25 bp, Mus musculus
agcgcctttgcgcacccttgaacat

SEQ ID NO: 274412 - DNA, 25 bp, Mus musculus
tttgcgcacccttgaacatcgcacg

SEQ ID NO: 274413 - DNA, 25 bp, Mus musculus
cttatgtaacgggagatggggtcga

SEQ ID NO: 274414 - DNA, 25 bp, Mus musculus
tggctgcacggcagggccgccactt

SEQ ID NO: 274415 - DNA, 25 bp, Mus musculus
acgcgtacagttcgctccaaagttc

SEQ ID NO: 274416 - DNA, 25 bp, Mus musculus
ttcaccaacacatactgcgcctggg

SEQ ID NO: 274417 - DNA, 25 bp, Mus musculus
agaactctccacacccgcggcagca

SEQ ID NO: 274418 - DNA, 25 bp, Mus musculus
agttcgctccaaagttcaaccttca

SEQ ID NO: 274419 - DNA, 25 bp, Mus musculus
gccgtggcgctgaccgcaacactaa

SEQ ID NO: 274420 - DNA, 25 bp, Mus musculus
ggcgctgaccgcaacactaacaacg

SEQ ID NO: 274421 - DNA, 25 bp, Mus musculus
gcaacactaacaacgcggggctgga

SEQ ID NO: 274422 - DNA, 25 bp, Mus musculus
tttcgctgccgccatctcgtcacag

SEQ ID NO: 274423 - DNA, 25 bp, Mus musculus
ccgcagcggaagaagcccgagtgct

SEQ ID NO: 274424 - DNA, 25 bp, Mus musculus
agaagcccgagtgctcggacctgcc

SEQ ID NO: 274425 - DNA, 25 bp, Mus musculus
cgccatcttgtttcccgtttgaagg

SEQ ID NO: 274426 - DNA, 25 bp, Mus musculus
cctccaaattcaacacgcgtacagt

SEQ ID NO: 274427 - DNA, 25 bp, Mus musculus
ccaacacatactgcgcctgggcaga

SEQ ID NO: 274428 - DNA, 25 bp, Mus musculus
gcaaagtacaaatgcgcccgagcgc

SEQ ID NO: 274429 - DNA, 25 bp, Mus musculus
cacgagctcgcggtgcctcagagga

SEQ ID NO: 274430 - DNA, 25 bp, Mus musculus
cgccgccaccgagggtcttgtcgcc

SEQ ID NO: 274431 - DNA, 25 bp, Mus musculus
acaaatgcgcccgagcgcggcgtct

SEQ ID NO: 274432 - DNA, 25 bp, Mus musculus
tcccgcggcaaagtacaaatgcgcc

SEQ ID NO: 274433 - DNA, 25 bp, Mus musculus
ggcttcccgcggcaaagtacaaatg

SEQ ID NO: 274434 - DNA, 25 bp, Mus musculus
cactcggcgccttgcctggagcgaa

SEQ ID NO: 274435 - DNA, 25 bp, Mus musculus
gttcccagccctgcactaaagggga

SEQ ID NO: 274436 - DNA, 25 bp, Mus musculus
cccagccctgcactaaaggggaggg

SEQ ID NO: 274437 - DNA, 25 bp, Mus musculus
gaaatgggcttgtttctcgtggcca

SEQ ID NO: 274438 - DNA, 25 bp, Mus musculus
gggcttgtttctcgtggccaatcca

SEQ ID NO: 274439 - DNA, 25 bp, Mus musculus
tggccaatccacgagctcgcggtgc

SEQ ID NO: 274440 - DNA, 25 bp, Mus musculus
gccttgcctggagcgaaggttccca

SEQ ID NO: 274441 - DNA, 25 bp, Mus musculus
gtgcacagcggcagcgctcaacctc

SEQ ID NO: 274442 - DNA, 25 bp, Mus musculus
cgcagaagaacacgggctttgattc

SEQ ID NO: 274443 - DNA, 25 bp, Mus musculus
tttttgctcgtaaagcacagcggcc

SEQ ID NO: 274444 - DNA, 25 bp, Mus musculus
cgtgtttgtttttgctcgtaaagca

SEQ ID NO: 274445 - DNA, 25 bp, Mus musculus
ccaggcttgtgggacgtgtttgttt

SEQ ID NO: 274446 - DNA, 25 bp, Mus musculus
aagcccgctttgacctggcggcaca

SEQ ID NO: 274447 - DNA, 25 bp, Mus musculus
gctaattaaaatcgcctgggccgcg

SEQ ID NO: 274448 - DNA, 25 bp, Mus musculus
cggcgtggacccagacgctaattaa

SEQ ID NO: 274449 - DNA, 25 bp, Mus musculus
ttgattcgtgactccggcgtggacc

SEQ ID NO: 274450 - DNA, 25 bp, Mus musculus
aacacgggctttgattcgtgactcc

SEQ ID NO: 274451 - DNA, 25 bp, Mus musculus
accggcgcagaagaacacgggcttt

SEQ ID NO: 274452 - DNA, 25 bp, Mus musculus
gggcgggcacaaagcccgctttgac

SEQ ID NO: 274453 - DNA, 25 bp, Mus musculus
ttgctcgtaaagcacagcggcccag

SEQ ID NO: 274454 - DNA, 25 bp, Mus musculus
gggctttgattcgtgactccggcgt

SEQ ID NO: 274455 - DNA, 25 bp, Mus musculus
tggacccagacgctaattaaaatcg

SEQ ID NO: 274456 - DNA, 25 bp, Mus musculus
tggcgatgctcggacgtattcagtc

SEQ ID NO: 274457 - DNA, 25 bp, Mus musculus
agaaagccggttctcgctaaagctg

SEQ ID NO: 274458 - DNA, 25 bp, Mus musculus
gtctacccgcggagccgagaaagcc

SEQ ID NO: 274459 - DNA, 25 bp, Mus musculus
gtcgatgatcctacagcgccgtcta

SEQ ID NO: 274460 - DNA, 25 bp, Mus musculus
tgaccaagaggtcgatgatcctaca

SEQ ID NO: 274461 - DNA, 25 bp, Mus musculus
cagggctgatcctgaccaagaggtc

SEQ ID NO: 274462 - DNA, 25 bp, Mus musculus
tcggaaccagggctgatcctgacca

SEQ ID NO: 274463 - DNA, 25 bp, Mus musculus
gacgtattcagtccctattccggag

SEQ ID NO: 274464 - DNA, 25 bp, Mus musculus
tttgcataaaaattggcgatgctcg

SEQ ID NO: 274465 - DNA, 25 bp, Mus musculus
gattgacacgaccacaaaagttttg

SEQ ID NO: 274466 - DNA, 25 bp, Mus musculus
acgcgaattgcagaaatggatggtg

SEQ ID NO: 274467 - DNA, 25 bp, Mus musculus
ggtctggacgcgaattgcagaaatg

SEQ ID NO: 274468 - DNA, 25 bp, Mus musculus
cgcgcttcaggtctggacgcgaatt

SEQ ID NO: 274469 - DNA, 25 bp, Mus musculus
cctattccggagaattaaagagagg

SEQ ID NO: 274470 - DNA, 25 bp, Mus musculus
gtgaccagtggccacctcagccggt

SEQ ID NO: 274471 - DNA, 25 bp, Mus musculus
ctacgcgggtttcgcggtgaccagt

SEQ ID NO: 274472 - DNA, 25 bp, Mus musculus
gtcctagctcctcacgatcttgttc

SEQ ID NO: 274473 - DNA, 25 bp, Mus musculus
ttctggtccgtgacgaactcgtcta

SEQ ID NO: 274474 - DNA, 25 bp, Mus musculus
cgaactcgtctatgttttctagata

SEQ ID NO: 274475 - DNA, 25 bp, Mus musculus
tctagatacagctgttccgccatgg

SEQ ID NO: 274476 - DNA, 25 bp, Mus musculus
ttccgccatggtggtgcggcttcga

SEQ ID NO: 274477 - DNA, 25 bp, Mus musculus
cggcgggaaacagcttcgctcactc

SEQ ID NO: 274478 - DNA, 25 bp, Mus musculus
ctcactctcgggtcacaggtcgtct

SEQ ID NO: 274479 - DNA, 25 bp, Mus musculus
aggtcgtctcccagggcaaccaagg

SEQ ID NO: 274480 - DNA, 25 bp, Mus musculus
ccaaactagtgagaggccagccagg

SEQ ID NO: 274481 - DNA, 25 bp, Mus musculus
tgtcggtgtgcacctgagaacgttg

SEQ ID NO: 274482 - DNA, 25 bp, Mus musculus
cagggcgtgtctccctacgcgggtt

SEQ ID NO: 274483 - DNA, 25 bp, Mus musculus
cgatcttgttctggtccgtgacgaa

SEQ ID NO: 274484 - DNA, 25 bp, Mus musculus
tgtgctcttggtctgcgagccagcg

SEQ ID NO: 274485 - DNA, 25 bp, Mus musculus
tgcgccgtgcgactgtgcgaacttc

SEQ ID NO: 274486 - DNA, 25 bp, Mus musculus
cgatgtcgctgcctgtggtccggct

SEQ ID NO: 274487 - DNA, 25 bp, Mus musculus
gtttggcttggtcgggtgcactact

SEQ ID NO: 274488 - DNA, 25 bp, Mus musculus
gtgcactactcggagctgctggcgt

SEQ ID NO: 274489 - DNA, 25 bp, Mus musculus
ctggcgttgcaggagcattggctac

SEQ ID NO: 274490 - DNA, 25 bp, Mus musculus
tacggcggctacaggcagaccctcg

SEQ ID NO: 274491 - DNA, 25 bp, Mus musculus
accaaagcgggtgtgctcttggtct

SEQ ID NO: 274492 - DNA, 25 bp, Mus musculus
ctacgcggtggcctgacacccgagg

SEQ ID NO: 274493 - DNA, 25 bp, Mus musculus
acacccgaggagactacgcggctga

SEQ ID NO: 274494 - DNA, 25 bp, Mus musculus
cttgacttgcggctcctaggcctgc

SEQ ID NO: 274495 - DNA, 25 bp, Mus musculus
actgtgcgaacttcggggcctgcag

SEQ ID NO: 274496 - DNA, 25 bp, Mus musculus
caagatctgcgcgatcggtgagcgc

SEQ ID NO: 274497 - DNA, 25 bp, Mus musculus
tctgccacccggtgcttgacttgcg

SEQ ID NO: 274498 - DNA, 25 bp, Mus musculus
gcccgcctcagtcagttcgagctga

SEQ ID NO: 274499 - DNA, 25 bp, Mus musculus
gttggtctccgatgcccttcgtcaa

SEQ ID NO: 274500 - DNA, 25 bp, Mus musculus
ttcgagctgagatccggagctagtc

SEQ ID NO: 274501 - DNA, 25 bp, Mus musculus
tttgggctcccaagcgagaccaagc

SEQ ID NO: 274502 - DNA, 25 bp, Mus musculus
ggactgttgttgttctctcgcctca

SEQ ID NO: 274503 - DNA, 25 bp, Mus musculus
gcgacccagacatctgggactgttg

SEQ ID NO: 274504 - DNA, 25 bp, Mus musculus
gtcgcctcagcggacagcaaacgct

SEQ ID NO: 274505 - DNA, 25 bp, Mus musculus
aagccagctgtgcactgtcgcctca

SEQ ID NO: 274506 - DNA, 25 bp, Mus musculus
ttctggaccctggtgagcgcaccta

SEQ ID NO: 274507 - DNA, 25 bp, Mus musculus
ctgcttgagacgacggggacaccag

SEQ ID NO: 274508 - DNA, 25 bp, Mus musculus
cggggactctcctagtgagtgcaga

SEQ ID NO: 274509 - DNA, 25 bp, Mus musculus
tacaactcccgtgaggcgtcacgcg

SEQ ID NO: 274510 - DNA, 25 bp, Mus musculus
agacagctgaggaacggcattaaaa

SEQ ID NO: 274511 - DNA, 25 bp, Mus musculus
gactgaacagctcgcggttggtctc

SEQ ID NO: 274512 - DNA, 25 bp, Mus musculus
ggaggcgcggctgcgcgacttgacc

SEQ ID NO: 274513 - DNA, 25 bp, Mus musculus
gggaggacacgttctccgcgctgac

SEQ ID NO: 274514 - DNA, 25 bp, Mus musculus
gaggacacgttctccgcgctgacca

SEQ ID NO: 274515 - DNA, 25 bp, Mus musculus
aggacacgttctccgcgctgaccag

SEQ ID NO: 274516 - DNA, 25 bp, Mus musculus
acgttctccgcgctgaccagcgtgg

SEQ ID NO: 274517 - DNA, 25 bp, Mus musculus
gttctccgcgctgaccagcgtggcg

SEQ ID NO: 274518 - DNA, 25 bp, Mus musculus
ctgctggggacactgaggcgctacc

SEQ ID NO: 274519 - DNA, 25 bp, Mus musculus
ctggggacactgaggcgctacctgc

SEQ ID NO: 274520 - DNA, 25 bp, Mus musculus
acactgaggcgctacctgcgcggcg

SEQ ID NO: 274521 - DNA, 25 bp, Mus musculus
cgtctccagggagccgggatgctca

SEQ ID NO: 274522 - DNA, 25 bp, Mus musculus
cttgaccaggtgagggcgtctccag

SEQ ID NO: 274523 - DNA, 25 bp, Mus musculus
acttgaccaggtgagggcgtctcca

SEQ ID NO: 274524 - DNA, 25 bp, Mus musculus
cgacttgaccaggtgagggcgtctc

SEQ ID NO: 274525 - DNA, 25 bp, Mus musculus
gacactgaggcgctacctgcgcggc

SEQ ID NO: 274526 - DNA, 25 bp, Mus musculus
cacgatacgtgcagtacaaccggtc

SEQ ID NO: 274527 - DNA, 25 bp, Mus musculus
tctaacgacgcccagtcgcctttgg

SEQ ID NO: 274528 - DNA, 25 bp, Mus musculus
gcggccgaggtgcatgcttttttca

SEQ ID NO: 274529 - DNA, 25 bp, Mus musculus
cgcaacagccttcgcacaaaggaaa

SEQ ID NO: 274530 - DNA, 25 bp, Mus musculus
tccaccggaagtgcgcaacagcctt

SEQ ID NO: 274531 - DNA, 25 bp, Mus musculus
gcagcgcttccaccggaagtgcgca

SEQ ID NO: 274532 - DNA, 25 bp, Mus musculus
tttggacagcaaccagccaccggca

SEQ ID NO: 274533 - DNA, 25 bp, Mus musculus
acgcccagtcgcctttggacagcaa

SEQ ID NO: 274534 - DNA, 25 bp, Mus musculus
gcagtacaaccggtcacagctctct

SEQ ID NO: 274535 - DNA, 25 bp, Mus musculus
ggtccgtcccacgatacgtgcagta

SEQ ID NO: 274536 - DNA, 25 bp, Mus musculus
gtggcccaaggtccgtcccacgata

SEQ ID NO: 274537 - DNA, 25 bp, Mus musculus
gcacgtcgacaacagtggcccaagg

SEQ ID NO: 274538 - DNA, 25 bp, Mus musculus
cgacatcaaagggaggccgcacgtc

SEQ ID NO: 274539 - DNA, 25 bp, Mus musculus
catgcttttttcaagggccgacatc

SEQ ID NO: 274540 - DNA, 25 bp, Mus musculus
tctagacttaagttctgtaggcgcg

SEQ ID NO: 274541 - DNA, 25 bp, Mus musculus
tggctccgcctcgtcacgccacgcc

SEQ ID NO: 274542 - DNA, 25 bp, Mus musculus
ctgtaggcgcgggttcgcagctact

SEQ ID NO: 274543 - DNA, 25 bp, Mus musculus
cgggttcgcagctactgtcagttcc

SEQ ID NO: 274544 - DNA, 25 bp, Mus musculus
agctactgtcagttccgccctcggt

SEQ ID NO: 274545 - DNA, 25 bp, Mus musculus
ctactgtcagttccgccctcggtgt

SEQ ID NO: 274546 - DNA, 25 bp, Mus musculus
tcagttccgccctcggtgtcgtcgg

SEQ ID NO: 274547 - DNA, 25 bp, Mus musculus
cggtgtcgtcgggtcgccagcttcc

SEQ ID NO: 274548 - DNA, 25 bp, Mus musculus
cagccaccactctcccgccgtcgga

SEQ ID NO: 274549 - DNA, 25 bp, Mus musculus
ctcccgccgtcggacacagccttct

SEQ ID NO: 274550 - DNA, 25 bp, Mus musculus
acagccttctgcactcctgtgttct

SEQ ID NO: 274551 - DNA, 25 bp, Mus musculus
tgttctcctgcggtccggtgagcgt

SEQ ID NO: 274552 - DNA, 25 bp, Mus musculus
cgaccacgccctctagacttaagtt

SEQ ID NO: 274553 - DNA, 25 bp, Mus musculus
acgccctctagacttaagttctgta

SEQ ID NO: 274554 - DNA, 25 bp, Mus musculus
aaagttccgaacacgcgctgcgagc

SEQ ID NO: 274555 - DNA, 25 bp, Mus musculus
gccagcaaccgtaagctcgcacatt

SEQ ID NO: 274556 - DNA, 25 bp, Mus musculus
cgagagtctgctacgcttccggaac

SEQ ID NO: 274557 - DNA, 25 bp, Mus musculus
aacgagatgccagagcggagcgcac

SEQ ID NO: 274558 - DNA, 25 bp, Mus musculus
ttccgacactccgagttgctgggcc

SEQ ID NO: 274559 - DNA, 25 bp, Mus musculus
cccagaaaagccaagcgagccagca

SEQ ID NO: 274560 - DNA, 25 bp, Mus musculus
agggcgacgccctaaacaccttctg

SEQ ID NO: 274561 - DNA, 25 bp, Mus musculus
cccattgggtccaaccaaaattgtg

SEQ ID NO: 274562 - DNA, 25 bp, Mus musculus
gctcatcttttcgatccgggacatg

SEQ ID NO: 274563 - DNA, 25 bp, Mus musculus
gtgccaggggcgagttttaacctca

SEQ ID NO: 274564 - DNA, 25 bp, Mus musculus
ccgggacatgtttgcaccacgttcc

SEQ ID NO: 274565 - DNA, 25 bp, Mus musculus
gtgggagtcctaagcaacacgagca

SEQ ID NO: 274566 - DNA, 25 bp, Mus musculus
cacgttcctttactcagtgccaggg

SEQ ID NO: 274567 - DNA, 25 bp, Mus musculus
tcgcacgcccagaatgctcatcttt

SEQ ID NO: 274568 - DNA, 25 bp, Mus musculus
ggggcgtccttattgcctacgaatc

SEQ ID NO: 274569 - DNA, 25 bp, Mus musculus
ctacaccggatgcacagtggggacg

SEQ ID NO: 274570 - DNA, 25 bp, Mus musculus
atccctacaccggatgcacagtggg

SEQ ID NO: 274571 - DNA, 25 bp, Mus musculus
gcgggtgagcactgcgcacgcatcc

SEQ ID NO: 274572 - DNA, 25 bp, Mus musculus
tcttctgcacctgcgggtgagcact

SEQ ID NO: 274573 - DNA, 25 bp, Mus musculus
cacgctcttctgcacctgcgggtga

SEQ ID NO: 274574 - DNA, 25 bp, Mus musculus
gggcggaacgcgctcgcacgctctt

SEQ ID NO: 274575 - DNA, 25 bp, Mus musculus
gggtcggcttcctgcggagagaaca

SEQ ID NO: 274576 - DNA, 25 bp, Mus musculus
gttcttccgcgtgtgtgctcccgct

SEQ ID NO: 274577 - DNA, 25 bp, Mus musculus
tgcagagggctctgttcttccgcgt

SEQ ID NO: 274578 - DNA, 25 bp, Mus musculus
caccaatgggaattgcagagggctc

SEQ ID NO: 274579 - DNA, 25 bp, Mus musculus
ctacacggagagttcaccaatggga

SEQ ID NO: 274580 - DNA, 25 bp, Mus musculus
ggcgggctctacacggagagttcac

SEQ ID NO: 274581 - DNA, 25 bp, Mus musculus
cggtctccattggtccgctccttcc

SEQ ID NO: 274582 - DNA, 25 bp, Mus musculus
atcctaccgagacgctttctgctca

SEQ ID NO: 274583 - DNA, 25 bp, Mus musculus
aaagaattgacagtgaggcgccgca

SEQ ID NO: 274584 - DNA, 25 bp, Mus musculus
cgtgcgtggaatctgcgttaccttt

SEQ ID NO: 274585 - DNA, 25 bp, Mus musculus
cgaagatccaccctagcaatcacga

SEQ ID NO: 274586 - DNA, 25 bp, Mus musculus
ctgagcaaaccgaagatccacccta

SEQ ID NO: 274587 - DNA, 25 bp, Mus musculus
cgaccacagcggcttctgagcaaac

SEQ ID NO: 274588 - DNA, 25 bp, Mus musculus
ttctgctcacgcagcatcttggttc

SEQ ID NO: 274589 - DNA, 25 bp, Mus musculus
agggttccgctcattctcgaccaca

SEQ ID NO: 274590 - DNA, 25 bp, Mus musculus
gaaaggtcttcatcacgtccgtcca

SEQ ID NO: 274591 - DNA, 25 bp, Mus musculus
ttcctcagctccctacgtgcgtgga

SEQ ID NO: 274592 - DNA, 25 bp, Mus musculus
cgtggcacgagactggcaagctcgc

SEQ ID NO: 274593 - DNA, 25 bp, Mus musculus
aggcctaaacgtccgcacgcaaaca

SEQ ID NO: 274594 - DNA, 25 bp, Mus musculus
tcgcagagtcctaggcctaaacgtc

SEQ ID NO: 274595 - DNA, 25 bp, Mus musculus
ggaaaggcctgttcgcagagtccta

SEQ ID NO: 274596 - DNA, 25 bp, Mus musculus
gcctgccctccgctttttctgattg

SEQ ID NO: 274597 - DNA, 25 bp, Mus musculus
gcgtcgccacctcagttagcagctg

SEQ ID NO: 274598 - DNA, 25 bp, Mus musculus
attggctcgatttgtcactgacgta

SEQ ID NO: 274599 - DNA, 25 bp, Mus musculus
cggcttctccagacgccagtcgaaa

SEQ ID NO: 274600 - DNA, 25 bp, Mus musculus
tttctccaccgcacgggaggagccg

SEQ ID NO: 274601 - DNA, 25 bp, Mus musculus
tgctggcgaaaccaggaaagcactg

SEQ ID NO: 274602 - DNA, 25 bp, Mus musculus
agcactgcgcgtgccgagacccaga

SEQ ID NO: 274603 - DNA, 25 bp, Mus musculus
tcggtggaggcactctcccttcagc

SEQ ID NO: 274604 - DNA, 25 bp, Mus musculus
ccctcttcgttagcgggttggagct

SEQ ID NO: 274605 - DNA, 25 bp, Mus musculus
gctccatcatgtccgcgggcggaga

SEQ ID NO: 274606 - DNA, 25 bp, Mus musculus
ttcgggaatccgctgaggaaattca

SEQ ID NO: 274607 - DNA, 25 bp, Mus musculus
ttcaagctggtgttcctgggagagc

SEQ ID NO: 274608 - DNA, 25 bp, Mus musculus
taggctagcgaagcccgagcgcacc

SEQ ID NO: 274609 - DNA, 25 bp, Mus musculus
gccacacttcctatggctgccagaa

SEQ ID NO: 274610 - DNA, 25 bp, Mus musculus
ccgcggttttcgtctgcagcagctc

SEQ ID NO: 274611 - DNA, 25 bp, Mus musculus
tcagatctgagtagctgaggagaag

SEQ ID NO: 274612 - DNA, 25 bp, Mus musculus
accaccctactggacacggacgagg

SEQ ID NO: 274613 - DNA, 25 bp, Mus musculus
gaacgagagcgtcgccgctgtagcc

SEQ ID NO: 274614 - DNA, 25 bp, Mus musculus
gccgctgtagcctccagagaagaca

SEQ ID NO: 274615 - DNA, 25 bp, Mus musculus
tccagagaagacaagggcatcgccg

SEQ ID NO: 274616 - DNA, 25 bp, Mus musculus
agacaagggcatcgccgcttcagtt

SEQ ID NO: 274617 - DNA, 25 bp, Mus musculus
tgcagaggattcagatctgagtagc

SEQ ID NO: 274618 - DNA, 25 bp, Mus musculus
ctctcttgcctgcagccgagcgtcc

SEQ ID NO: 274619 - DNA, 25 bp, Mus musculus
ttgtagttcaagagctcggaggctg

SEQ ID NO: 274620 - DNA, 25 bp, Mus musculus
ggcatcgccgcttcagttgcggccg

SEQ ID NO: 274621 - DNA, 25 bp, Mus musculus
gcggctactgcagaggattcagatc

SEQ ID NO: 274622 - DNA, 25 bp, Mus musculus
ttctccgcggctactgcagaggatt

SEQ ID NO: 274623 - DNA, 25 bp, Mus musculus
acgtgtcgggacagcgcgccgactc

SEQ ID NO: 274624 - DNA, 25 bp, Mus musculus
ctgggccccacaactgcaagcagag

SEQ ID NO: 274625 - DNA, 25 bp, Mus musculus
ggaggtgacaagcttcctcctgctg

SEQ ID NO: 274626 - DNA, 25 bp, Mus musculus
ttggaggtgacaagcttcctcctgc

SEQ ID NO: 274627 - DNA, 25 bp, Mus musculus
acccgggcctctggggtccagacag

SEQ ID NO: 274628 - DNA, 25 bp, Mus musculus
ctgttacagcgggacccgggcctct

SEQ ID NO: 274629 - DNA, 25 bp, Mus musculus
ccggagccgccctgttacagcggga

SEQ ID NO: 274630 - DNA, 25 bp, Mus musculus
ggaagtcagttctagccctgggccc

SEQ ID NO: 274631 - DNA, 25 bp, Mus musculus
ctgccggaagtcagttctagccctg

SEQ ID NO: 274632 - DNA, 25 bp, Mus musculus
tctcctgccggaagtcagttctagc

SEQ ID NO: 274633 - DNA, 25 bp, Mus musculus
cacccttgccaacgcgtgcgtttaa

SEQ ID NO: 274634 - DNA, 25 bp, Mus musculus
cttgccaacgcgtgcgtttaaacta

SEQ ID NO: 274635 - DNA, 25 bp, Mus musculus
cttcctcctgctgcgggtgatccgg

SEQ ID NO: 274636 - DNA, 25 bp, Mus musculus
aggcgggttctcctgccggaagtca

SEQ ID NO: 274637 - DNA, 25 bp, Mus musculus
caacgcgtgcgtttaaactacaact

SEQ ID NO: 274638 - DNA, 25 bp, Mus musculus
aagggctcacgattctcccgccagg

SEQ ID NO: 274639 - DNA, 25 bp, Mus musculus
ccgacgtcagagctccgacttgcgg

SEQ ID NO: 274640 - DNA, 25 bp, Mus musculus
cctctgcgggccaagggctcacgat

SEQ ID NO: 274641 - DNA, 25 bp, Mus musculus
agcctgcgcgccttttgaatgaatc

SEQ ID NO: 274642 - DNA, 25 bp, Mus musculus
ttttgaatgaatcgccggcctggcc

SEQ ID NO: 274643 - DNA, 25 bp, Mus musculus
gggctgacgcatccgccgctcagga

SEQ ID NO: 274644 - DNA, 25 bp, Mus musculus
gctccgggacgcgtagacagcacca

SEQ ID NO: 274645 - DNA, 25 bp, Mus musculus
ttctgacagactgcgccgcgcgcgg

SEQ ID NO: 274646 - DNA, 25 bp, Mus musculus
aagttccgctgcttcctctcgcgca

SEQ ID NO: 274647 - DNA, 25 bp, Mus musculus
cagccggcctttggtgtcagtccaa

SEQ ID NO: 274648 - DNA, 25 bp, Mus musculus
taggctcggcgtcaccgcccagtgt

SEQ ID NO: 274649 - DNA, 25 bp, Mus musculus
gtgtcacccacagtcactggctgac

SEQ ID NO: 274650 - DNA, 25 bp, Mus musculus
tcactggctgacaccgttcagaaca

SEQ ID NO: 274651 - DNA, 25 bp, Mus musculus
ctttggtgtcagtccaagtttcccg

SEQ ID NO: 274652 - DNA, 25 bp, Mus musculus
tgggccagggtcttcaccatctgaa

SEQ ID NO: 274653 - DNA, 25 bp, Mus musculus
aggctcagtgcctcgggacctcgca

SEQ ID NO: 274654 - DNA, 25 bp, Mus musculus
ggacacaagtcacacacactcgcgg

SEQ ID NO: 274655 - DNA, 25 bp, Mus musculus
acacacactcgcggataaagacgcg

SEQ ID NO: 274656 - DNA, 25 bp, Mus musculus
gccgagcccagatcgcgcatgtctt

SEQ ID NO: 274657 - DNA, 25 bp, Mus musculus
cgcatgtcttccagcgcgatggtga

SEQ ID NO: 274658 - DNA, 25 bp, Mus musculus
tgaactgggccagggtcttcaccat

SEQ ID NO: 274659 - DNA, 25 bp, Mus musculus
agggtcttcaccatctgaagcatgc

SEQ ID NO: 274660 - DNA, 25 bp, Mus musculus
ttcaccatctgaagcatgcggccgg

SEQ ID NO: 274661 - DNA, 25 bp, Mus musculus
catctgaagcatgcggccgggctgc

SEQ ID NO: 274662 - DNA, 25 bp, Mus musculus
tactgcgcagagtcggagggccccc

SEQ ID NO: 274663 - DNA, 25 bp, Mus musculus
cccttctcccgcaacaggctcagtg

SEQ ID NO: 274664 - DNA, 25 bp, Mus musculus
cggcttgagtagcagcgtcagtgag

SEQ ID NO: 274665 - DNA, 25 bp, Mus musculus
ttccagcgcgatggtgaactgggcc

SEQ ID NO: 274666 - DNA, 25 bp, Mus musculus
tccatactgggtcgtctggagctcg

SEQ ID NO: 274667 - DNA, 25 bp, Mus musculus
cccagccttagcctctgcgggagag

SEQ ID NO: 274668 - DNA, 25 bp, Mus musculus
ccgcggctacaaaaggcaggagttc

SEQ ID NO: 274669 - DNA, 25 bp, Mus musculus
tcagtcgaagatcaagtttccgcgg

SEQ ID NO: 274670 - DNA, 25 bp, Mus musculus
cggagacgtgagcagaggtttatca

SEQ ID NO: 274671 - DNA, 25 bp, Mus musculus
cgccatggttggtgctagtcactcc

SEQ ID NO: 274672 - DNA, 25 bp, Mus musculus
gcagtttaaacgagacgctgcgata

SEQ ID NO: 274673 - DNA, 25 bp, Mus musculus
accagtggagtcgtcgtccagaccc

SEQ ID NO: 274674 - DNA, 25 bp, Mus musculus
cggaccgccgaagagtttgcgcatc

SEQ ID NO: 274675 - DNA, 25 bp, Mus musculus
agggcctcagagtccatactgggtc

SEQ ID NO: 274676 - DNA, 25 bp, Mus musculus
ccacgaaactctgtcggggctggtc

SEQ ID NO: 274677 - DNA, 25 bp, Mus musculus
gccagccagaggaaagcacgttcga

SEQ ID NO: 274678 - DNA, 25 bp, Mus musculus
agaatgtaaaccatccgccggacgc

SEQ ID NO: 274679 - DNA, 25 bp, Mus musculus
cttccgcagcttcttctgtggtgcc

SEQ ID NO: 274680 - DNA, 25 bp, Mus musculus
tcttgcggtactaagcaggatgacc

SEQ ID NO: 274681 - DNA, 25 bp, Mus musculus
accaggcttcttgcggtactaagca

SEQ ID NO: 274682 - DNA, 25 bp, Mus musculus
ctgcctgcccttggtgggacaagga

SEQ ID NO: 274683 - DNA, 25 bp, Mus musculus
gtcccgcccagcctggatagggctg

SEQ ID NO: 274684 - DNA, 25 bp, Mus musculus
gccttggcacccagcgttggagtcc

SEQ ID NO: 274685 - DNA, 25 bp, Mus musculus
gtcccaagagtaccaggcttcttgc

SEQ ID NO: 274686 - DNA, 25 bp, Mus musculus
tggtgcttcagctctggtcccaaga

SEQ ID NO: 274687 - DNA, 25 bp, Mus musculus
agcgaaccctccacttaaatgaagg

SEQ ID NO: 274688 - DNA, 25 bp, Mus musculus
gtccagaatcaaggctgcggctctg

SEQ ID NO: 274689 - DNA, 25 bp, Mus musculus
accagcccgcgtgggtccagaatca

SEQ ID NO: 274690 - DNA, 25 bp, Mus musculus
gaggcggcgatagattgttaaacac

SEQ ID NO: 274691 - DNA, 25 bp, Mus musculus
tgttaaacacgccacgccatgctgc

SEQ ID NO: 274692 - DNA, 25 bp, Mus musculus
gccatgctgcagaggacgactccga

SEQ ID NO: 274693 - DNA, 25 bp, Mus musculus
acgactccgagggtggaagcatgtc

SEQ ID NO: 274694 - DNA, 25 bp, Mus musculus
ccgaggtgtcatggcaagtgatccg

SEQ ID NO: 274695 - DNA, 25 bp, Mus musculus
cgggcaacagcacgtacttgaagtc

SEQ ID NO: 274696 - DNA, 25 bp, Mus musculus
acgacgttcaggcacaacccgagca

SEQ ID NO: 274697 - DNA, 25 bp, Mus musculus
aagatatagagagccacgacgttca

SEQ ID NO: 274698 - DNA, 25 bp, Mus musculus
cgttccaggttttgaggcggcatag

SEQ ID NO: 274699 - DNA, 25 bp, Mus musculus
ccgaaactgccaggtgaaacatgta

SEQ ID NO: 274700 - DNA, 25 bp, Mus musculus
cgctgcgtagagagagtccgaaact

SEQ ID NO: 274701 - DNA, 25 bp, Mus musculus
cgggcgtagtaataaaccaacagcg

SEQ ID NO: 274702 - DNA, 25 bp, Mus musculus
caccgtgctaaatggccagtggtca

SEQ ID NO: 274703 - DNA, 25 bp, Mus musculus
caccagcttgcagagcaccgtgcta

SEQ ID NO: 274704 - DNA, 25 bp, Mus musculus
accacgccataggacacgggcaaca

SEQ ID NO: 274705 - DNA, 25 bp, Mus musculus
caccggtgcacgctgatgcaggtga

SEQ ID NO: 274706 - DNA, 25 bp, Mus musculus
cgtacttgaagtcctcgttgaaacg

SEQ ID NO: 274707 - DNA, 25 bp, Mus musculus
tagaagaggaaacgcaccagcttgc

SEQ ID NO: 274708 - DNA, 25 bp, Mus musculus
gcaccgacgggtgccgtggaacaaa

SEQ ID NO: 274709 - DNA, 25 bp, Mus musculus
cgaggtaggacgtgctttcacagtc

SEQ ID NO: 274710 - DNA, 25 bp, Mus musculus
tgtttagatttcttcgcggcgccgc

SEQ ID NO: 274711 - DNA, 25 bp, Mus musculus
ttcacagtctaagccgaaccgaacc

SEQ ID NO: 274712 - DNA, 25 bp, Mus musculus
atctcgggcatctttcgcttcgtgc

SEQ ID NO: 274713 - DNA, 25 bp, Mus musculus
ttcgtgcgcgcatcgcgtacctaca

SEQ ID NO: 274714 - DNA, 25 bp, Mus musculus
cagcaaaggtgagctcgccggagct

SEQ ID NO: 274715 - DNA, 25 bp, Mus musculus
acaaaaggcgcacgggacaccagga

SEQ ID NO: 274716 - DNA, 25 bp, Mus musculus
ttggctcccagctcttgctttcgga

SEQ ID NO: 274717 - DNA, 25 bp, Mus musculus
ctcttgctttcggacgcgcagtgtt

SEQ ID NO: 274718 - DNA, 25 bp, Mus musculus
gctcgctgccttgactggctggacc

SEQ ID NO: 274719 - DNA, 25 bp, Mus musculus
gccgcttagctctacaacagcctga

SEQ ID NO: 274720 - DNA, 25 bp, Mus musculus
tgcgcaccactccttcgtcgaggta

SEQ ID NO: 274721 - DNA, 25 bp, Mus musculus
tgcgaatcgctcctgcagcaaaggt

SEQ ID NO: 274722 - DNA, 25 bp, Mus musculus
tggctgagcagaggtcacctgctta

SEQ ID NO: 274723 - DNA, 25 bp, Mus musculus
gtgcccgagtcccatgccgagtggc

SEQ ID NO: 274724 - DNA, 25 bp, Mus musculus
cccttctaaacagatgcttccagtc

SEQ ID NO: 274725 - DNA, 25 bp, Mus musculus
tcacttggcgacctctcttggtgtc

SEQ ID NO: 274726 - DNA, 25 bp, Mus musculus
cagactctgggcagacgccggagcc

SEQ ID NO: 274727 - DNA, 25 bp, Mus musculus
ctctccctgtttggcgctgactcga

SEQ ID NO: 274728 - DNA, 25 bp, Mus musculus
tcacgtaatgggctctccctgtttg

SEQ ID NO: 274729 - DNA, 25 bp, Mus musculus
gagccctcgggacagtcacgtaatg

SEQ ID NO: 274730 - DNA, 25 bp, Mus musculus
accgcccagttttgcgcagtacaag

SEQ ID NO: 274731 - DNA, 25 bp, Mus musculus
tccgccacggctgttgagcaaggag

SEQ ID NO: 274732 - DNA, 25 bp, Mus musculus
tcacgctctagaggaaacaaagttc

SEQ ID NO: 274733 - DNA, 25 bp, Mus musculus
cacctgcttagctcaccgattttca

SEQ ID NO: 274734 - DNA, 25 bp, Mus musculus
cagggtcccacgtgcctggaagcgc

SEQ ID NO: 274735 - DNA, 25 bp, Mus musculus
caaagttcatcagcgcaccggcagc

SEQ ID NO: 274736 - DNA, 25 bp, Mus musculus
cctccactctgaagcaggcggtgtg

SEQ ID NO: 274737 - DNA, 25 bp, Mus musculus
gagaactggggtagttctcgagtcc

SEQ ID NO: 274738 - DNA, 25 bp, Mus musculus
acctcctcgcggcatgagtggttgg

SEQ ID NO: 274739 - DNA, 25 bp, Mus musculus
tcttggcttgtcagagttgccgccc

SEQ ID NO: 274740 - DNA, 25 bp, Mus musculus
gaagcgtccggaacgttccatcgtc

SEQ ID NO: 274741 - DNA, 25 bp, Mus musculus
tccatcgtcggagagaactggggta

SEQ ID NO: 274742 - DNA, 25 bp, Mus musculus
tgcgtcggagcagagtcctctccct

SEQ ID NO: 274743 - DNA, 25 bp, Mus musculus
tcggccgaacaatccgtgaagtttc

SEQ ID NO: 274744 - DNA, 25 bp, Mus musculus
ggccggacctcctcgcggcatgagt

SEQ ID NO: 274745 - DNA, 25 bp, Mus musculus
gcggaggattgatgtcccttcagca

SEQ ID NO: 274746 - DNA, 25 bp, Mus musculus
atgtcccttcagcatcatgcagccg

SEQ ID NO: 274747 - DNA, 25 bp, Mus musculus
ccgcaagggaccgtgaccactctag

SEQ ID NO: 274748 - DNA, 25 bp, Mus musculus
gtgaccactctagcttcttggcttg

SEQ ID NO: 274749 - DNA, 25 bp, Mus musculus
ccggaacgttccatcgtcggagaga

SEQ ID NO: 274750 - DNA, 25 bp, Mus musculus
tgctccagcaagtcgcgtgcctctt

SEQ ID NO: 274751 - DNA, 25 bp, Mus musculus
ctgtgctgcgttctccgcttgccgt

SEQ ID NO: 274752 - DNA, 25 bp, Mus musculus
taggcttctctctgtgctgcgttct

SEQ ID NO: 274753 - DNA, 25 bp, Mus musculus
gcagcgtctcataggcttctctctg

SEQ ID NO: 274754 - DNA, 25 bp, Mus musculus
tggagcagcgtctcataggcttctc

SEQ ID NO: 274755 - DNA, 25 bp, Mus musculus
cagcttgctggagcagcgtctcata

SEQ ID NO: 274756 - DNA, 25 bp, Mus musculus
gctcattacgtagattgcgctcagc

SEQ ID NO: 274757 - DNA, 25 bp, Mus musculus
tcctggtgcacagcttgctggagca

SEQ ID NO: 274758 - DNA, 25 bp, Mus musculus
attacgtagattgcgctcagcggcg

SEQ ID NO: 274759 - DNA, 25 bp, Mus musculus
caagtcgcgtgcctcttcctggagc

SEQ ID NO: 274760 - DNA, 25 bp, Mus musculus
ttacgctgcacaagctgctccagca

SEQ ID NO: 274761 - DNA, 25 bp, Mus musculus
tccagctgccgggactgctgagccc

SEQ ID NO: 274762 - DNA, 25 bp, Mus musculus
tcttcctggagcctgcgcagtgccg

SEQ ID NO: 274763 - DNA, 25 bp, Mus musculus
tccgcttgccgttcctccagctgcc

SEQ ID NO: 274764 - DNA, 25 bp, Mus musculus
gttccaagacgcaaagccctcggga

SEQ ID NO: 274765 - DNA, 25 bp, Mus musculus
cgggctgtaccaagcgcttttgtcg

SEQ ID NO: 274766 - DNA, 25 bp, Mus musculus
actccatgacgtcagggcggcagca

SEQ ID NO: 274767 - DNA, 25 bp, Mus musculus
ctcccggggactccatgacgtcagg

SEQ ID NO: 274768 - DNA, 25 bp, Mus musculus
cacgatgtggcgcttccagacagcg

SEQ ID NO: 274769 - DNA, 25 bp, Mus musculus
ttttgcgtgcggtcccgatgccgca

SEQ ID NO: 274770 - DNA, 25 bp, Mus musculus
aagagcgccttttgcgtgcggtccc

SEQ ID NO: 274771 - DNA, 25 bp, Mus musculus
gctccaggaagagcgccttttgcgt

SEQ ID NO: 274772 - DNA, 25 bp, Mus musculus
caagccggcactagctccaggaaga

SEQ ID NO: 274773 - DNA, 25 bp, Mus musculus
ggacgcactcacaagccggcactag

SEQ ID NO: 274774 - DNA, 25 bp, Mus musculus
agcggggagtcccacctcctcaaag

SEQ ID NO: 274775 - DNA, 25 bp, Mus musculus
tcgagtggcgggacaagccctctcc

SEQ ID NO: 274776 - DNA, 25 bp, Mus musculus
tcacaagtcgagtggcgggacaagc

SEQ ID NO: 274777 - DNA, 25 bp, Mus musculus
gctgccctgagtcacaagtcgagtg

SEQ ID NO: 274778 - DNA, 25 bp, Mus musculus
agcaatcctactgccgctccaggga

SEQ ID NO: 274779 - DNA, 25 bp, Mus musculus
gggccagtacctgcccttttcaagc

SEQ ID NO: 274780 - DNA, 25 bp, Mus musculus
ccgtgaaagtgtccaggtgcccgat

SEQ ID NO: 274781 - DNA, 25 bp, Mus musculus
ttttcaagctgtccgctggtccggg

SEQ ID NO: 274782 - DNA, 25 bp, Mus musculus
tcccaggaaggtggcgtcagcatct

SEQ ID NO: 274783 - DNA, 25 bp, Mus musculus
agccgcgtcgacgttgtctgagcct

SEQ ID NO: 274784 - DNA, 25 bp, Mus musculus
cccaagtgactgtcctgtgccggtg

SEQ ID NO: 274785 - DNA, 25 bp, Mus musculus
tggaaaagccagctgcctcaacaga

SEQ ID NO: 274786 - DNA, 25 bp, Mus musculus
gtgcccgatgaccaggacttccgca

SEQ ID NO: 274787 - DNA, 25 bp, Mus musculus
aggacttccgcagtttccggtcaga

SEQ ID NO: 274788 - DNA, 25 bp, Mus musculus
cggcttgctgctgagttagttgtgc

SEQ ID NO: 274789 - DNA, 25 bp, Mus musculus
ctccagggaagtatgaggtcgctcc

SEQ ID NO: 274790 - DNA, 25 bp, Mus musculus
gtgcacaaccgcctggggccagtac

SEQ ID NO: 274791 - DNA, 25 bp, Mus musculus
acccaggagagtcggactaggacca

SEQ ID NO: 274792 - DNA, 25 bp, Mus musculus
cgtttgtgtctgtcctgttcgagaa

SEQ ID NO: 274793 - DNA, 25 bp, Mus musculus
atttccgtttgtgtctgtcctgttc

SEQ ID NO: 274794 - DNA, 25 bp, Mus musculus
ggagcgttccaggttctgcgtgttt

SEQ ID NO: 274795 - DNA, 25 bp, Mus musculus
gttctgcgtgtttcatttccgtttg

SEQ ID NO: 274796 - DNA, 25 bp, Mus musculus
ccaggttctgcgtgtttcatttccg

SEQ ID NO: 274797 - DNA, 25 bp, Mus musculus
cgttccaggttctgcgtgtttcatt

SEQ ID NO: 274798 - DNA, 25 bp, Mus musculus
agcgttccaggttctgcgtgtttca

SEQ ID NO: 274799 - DNA, 25 bp, Mus musculus
ggtcatgtctcgcttgaccctcttc

SEQ ID NO: 274800 - DNA, 25 bp, Mus musculus
acttcggtcatgtctcgcttgaccc

SEQ ID NO: 274801 - DNA, 25 bp, Mus musculus
ccaggcgcccggttgtccttacgtg

SEQ ID NO: 274802 - DNA, 25 bp, Mus musculus
tcgcgtggttctcgtggatgcgcca

SEQ ID NO: 274803 - DNA, 25 bp, Mus musculus
acacttctcgcagtggttcgcgtgg

SEQ ID NO: 274804 - DNA, 25 bp, Mus musculus
ctgcgcacacttctcgcagtggttc

SEQ ID NO: 274805 - DNA, 25 bp, Mus musculus
tggtgttgcggttgcataccgtctg

SEQ ID NO: 274806 - DNA, 25 bp, Mus musculus
accgctgccgcgagttggctgcggc

SEQ ID NO: 274807 - DNA, 25 bp, Mus musculus
gagtcccacctcgtggagttctctt

SEQ ID NO: 274808 - DNA, 25 bp, Mus musculus
gtcccacctcgtggagttctcttcg

SEQ ID NO: 274809 - DNA, 25 bp, Mus musculus
ctgcggccgcgtgtgacagacggta

SEQ ID NO: 274810 - DNA, 25 bp, Mus musculus
attgaagatccggactaggctgggg

SEQ ID NO: 274811 - DNA, 25 bp, Mus musculus
ggtattgaagatccggactaggctg

SEQ ID NO: 274812 - DNA, 25 bp, Mus musculus
agggtattgaagatccggactaggc

SEQ ID NO: 274813 - DNA, 25 bp, Mus musculus
cctagggtattgaagatccggacta

SEQ ID NO: 274814 - DNA, 25 bp, Mus musculus
tgcctagggtattgaagatccggac

SEQ ID NO: 274815 - DNA, 25 bp, Mus musculus
tctgcctagggtattgaagatccgg

SEQ ID NO: 274816 - DNA, 25 bp, Mus musculus
ggtctgcctagggtattgaagatcc

SEQ ID NO: 274817 - DNA, 25 bp, Mus musculus
gtccggtctgcctagggtattgaag

SEQ ID NO: 274818 - DNA, 25 bp, Mus musculus
gcgtgtgacagacggtaccgggacc

SEQ ID NO: 274819 - DNA, 25 bp, Mus musculus
ccggtctgcctagggtattgaagat

SEQ ID NO: 274820 - DNA, 25 bp, Mus musculus
gctactgaagtccaagtgatgggga

SEQ ID NO: 274821 - DNA, 25 bp, Mus musculus
ggtcttcctcaagccggacgagccg

SEQ ID NO: 274822 - DNA, 25 bp, Mus musculus
ccgacccgctgcaggagacttgaga

SEQ ID NO: 274823 - DNA, 25 bp, Mus musculus
agtgggagccctcgtagccgacccg

SEQ ID NO: 274824 - DNA, 25 bp, Mus musculus
ctaccacataggaggagtgacaatg

SEQ ID NO: 274825 - DNA, 25 bp, Mus musculus
gccagcaggtcttcctcaagccgga

SEQ ID NO: 274826 - DNA, 25 bp, Mus musculus
ctgggaggggccctaccacatagga

SEQ ID NO: 274827 - DNA, 25 bp, Mus musculus
gtgttgcaccacatcctcatcgctg

SEQ ID NO: 274828 - DNA, 25 bp, Mus musculus
gctgttgtccaattcctcaggcggg

SEQ ID NO: 274829 - DNA, 25 bp, Mus musculus
catcctcatcgctgttgtccaattc

SEQ ID NO: 274830 - DNA, 25 bp, Mus musculus
ggtccgatctttggaaggcgttgaa

SEQ ID NO: 274831 - DNA, 25 bp, Mus musculus
cgagcatggtcctggtgttgcacca

SEQ ID NO: 274832 - DNA, 25 bp, Mus musculus
aagctgttgcggacgcgctgaccga

SEQ ID NO: 274833 - DNA, 25 bp, Mus musculus
ttggaaggcgttgaagtgctgtccc

SEQ ID NO: 274834 - DNA, 25 bp, Mus musculus
atcccggcggaccaaggcatcgcgg

SEQ ID NO: 274835 - DNA, 25 bp, Mus musculus
cggaccaaggcatcgcgggccacgt

SEQ ID NO: 274836 - DNA, 25 bp, Mus musculus
atgcatatgcccatccgcttttcta

SEQ ID NO: 274837 - DNA, 25 bp, Mus musculus
atccgcttttctatcgcggcgtaga

SEQ ID NO: 274838 - DNA, 25 bp, Mus musculus
ctatcgcggcgtagatgacagcact

SEQ ID NO: 274839 - DNA, 25 bp, Mus musculus
gatgacagcactggcttccgcacgc

SEQ ID NO: 274840 - DNA, 25 bp, Mus musculus
tccgcacgcgcaacattctctgctt

SEQ ID NO: 274841 - DNA, 25 bp, Mus musculus
ttctctgcttccctatcaagaacga

SEQ ID NO: 274842 - DNA, 25 bp, Mus musculus
acgagaaccagggtgccgactcgtg

SEQ ID NO: 274843 - DNA, 25 bp, Mus musculus
tcctgaacatcccagatgcatatgc

SEQ ID NO: 274844 - DNA, 25 bp, Mus musculus
ggccagatcctgaacatcccagatg

SEQ ID NO: 274845 - DNA, 25 bp, Mus musculus
gactacgggccagatcctgaacatc

SEQ ID NO: 274846 - DNA, 25 bp, Mus musculus
gccacgtggcgactacgggccagat

SEQ ID NO: 274847 - DNA, 25 bp, Mus musculus
gcttccctatcaagaacgagaacca

SEQ ID NO: 274848 - DNA, 25 bp, Mus musculus
aggtagtgcgcagtcccaccttata

SEQ ID NO: 274849 - DNA, 25 bp, Mus musculus
tgtccgcggtgttgaggagaaccac

SEQ ID NO: 274850 - DNA, 25 bp, Mus musculus
gactgccgcctcgtcggaacgcggt

SEQ ID NO: 274851 - DNA, 25 bp, Mus musculus
gaacgcaccgagatcccatacctga

SEQ ID NO: 274852 - DNA, 25 bp, Mus musculus
tgcgccctggagcatcttctacctt

SEQ ID NO: 274853 - DNA, 25 bp, Mus musculus
ccgcagcggttgagagctgccgctt

SEQ ID NO: 274854 - DNA, 25 bp, Mus musculus
ccgtggcgttgtcaccggagaccgc

SEQ ID NO: 274855 - DNA, 25 bp, Mus musculus
ctagggttaatcaaatctccatctc

SEQ ID NO: 274856 - DNA, 25 bp, Mus musculus
gcgcctcggctcttcctagggttaa

SEQ ID NO: 274857 - DNA, 25 bp, Mus musculus
aaatctccatctctccaaagccggg

SEQ ID NO: 274858 - DNA, 25 bp, Mus musculus
ccagcgggttttagaagcaggtgtc

SEQ ID NO: 274859 - DNA, 25 bp, Mus musculus
cccaccttataagcggcgtcttcga

SEQ ID NO: 274860 - DNA, 25 bp, Mus musculus
agcaggtgtcatgatgttgtccgcg

SEQ ID NO: 274861 - DNA, 25 bp, Mus musculus
agccatgttgatcgtggctagcaca

SEQ ID NO: 274862 - DNA, 25 bp, Mus musculus
gagcgcaccatgagcgaacacagcc

SEQ ID NO: 274863 - DNA, 25 bp, Mus musculus
gcagtgcacacgcacgagcccgcgt

SEQ ID NO: 274864 - DNA, 25 bp, Mus musculus
cgaacacagcccacgggcgggcgct

SEQ ID NO: 274865 - DNA, 25 bp, Mus musculus
atgagcgaacacagcccacgggcgg

SEQ ID NO: 274866 - DNA, 25 bp, Mus musculus
catgagcgaacacagcccacgggcg

SEQ ID NO: 274867 - DNA, 25 bp, Mus musculus
accatgagcgaacacagcccacggg

SEQ ID NO: 274868 - DNA, 25 bp, Mus musculus
ccgagcgcaccatgagcgaacacag

SEQ ID NO: 274869 - DNA, 25 bp, Mus musculus
ggcccgagcgcaccatgagcgaaca

SEQ ID NO: 274870 - DNA, 25 bp, Mus musculus
tggcccgagcgcaccatgagcgaac

SEQ ID NO: 274871 - DNA, 25 bp, Mus musculus
cgtgacagtcgaccgtcgtggccgc

SEQ ID NO: 274872 - DNA, 25 bp, Mus musculus
acctccgagcccatcacccgtcgtg

SEQ ID NO: 274873 - DNA, 25 bp, Mus musculus
cccgtcgtgacagtcgaccgtcgtg

SEQ ID NO: 274874 - DNA, 25 bp, Mus musculus
atcacccgtcgtgacagtcgaccgt

SEQ ID NO: 274875 - DNA, 25 bp, Mus musculus
gtcgtgacagtcgaccgtcgtggcc

SEQ ID NO: 274876 - DNA, 25 bp, Mus musculus
gcacgagcccgcgttcacagagcag

SEQ ID NO: 274877 - DNA, 25 bp, Mus musculus
cgaaaactaggggaggcaggactgg

SEQ ID NO: 274878 - DNA, 25 bp, Mus musculus
aggcgtccctgtaacccgcgtggat

SEQ ID NO: 274879 - DNA, 25 bp, Mus musculus
gtaacccgcgtggatccagagcttg

SEQ ID NO: 274880 - DNA, 25 bp, Mus musculus
cgtggatccagagcttggcaccagc

SEQ ID NO: 274881 - DNA, 25 bp, Mus musculus
gatccagagcttggcaccagcaccg

SEQ ID NO: 274882 - DNA, 25 bp, Mus musculus
cttggcaccagcaccgcaaggagga

SEQ ID NO: 274883 - DNA, 25 bp, Mus musculus
ccggggctgcgcttacctctcttgt

SEQ ID NO: 274884 - DNA, 25 bp, Mus musculus
gctgcgcttacctctcttgtgggcc

SEQ ID NO: 274885 - DNA, 25 bp, Mus musculus
cgcttacctctcttgtgggcccggg

SEQ ID NO: 274886 - DNA, 25 bp, Mus musculus
ggccgccgctttgtttctcttcgga

SEQ ID NO: 274887 - DNA, 25 bp, Mus musculus
agcaaaagcgaaagcgaaaactagg

SEQ ID NO: 274888 - DNA, 25 bp, Mus musculus
acgagcccgcgttcacagagcaggg

SEQ ID NO: 274889 - DNA, 25 bp, Mus musculus
cgccgctttgtttctcttcggagaa

SEQ ID NO: 274890 - DNA, 25 bp, Mus musculus
ctggagctcgaatctccatcccgaa

SEQ ID NO: 274891 - DNA, 25 bp, Mus musculus
cagcctggaggcttccaatacagtc

SEQ ID NO: 274892 - DNA, 25 bp, Mus musculus
cctcaattcgtacgattcgtgcgtg

SEQ ID NO: 274893 - DNA, 25 bp, Mus musculus
gctcagagccggtctcaggtcctct

SEQ ID NO: 274894 - DNA, 25 bp, Mus musculus
cacttgcgttgcaccggggcagagt

SEQ ID NO: 274895 - DNA, 25 bp, Mus musculus
ggctggcagcactgcacttgcgttg

SEQ ID NO: 274896 - DNA, 25 bp, Mus musculus
tgcacctcgggagccctaagaggga

SEQ ID NO: 274897 - DNA, 25 bp, Mus musculus
ggactctcggattggggtcccacga

SEQ ID NO: 274898 - DNA, 25 bp, Mus musculus
attgggacaggataagggactctcg

SEQ ID NO: 274899 - DNA, 25 bp, Mus musculus
agagatcgaaggtctaggccggatt

SEQ ID NO: 274900 - DNA, 25 bp, Mus musculus
cctcctgctgggcatgttgtgtaga

SEQ ID NO: 274901 - DNA, 25 bp, Mus musculus
gggccgatggactactcctacctca

SEQ ID NO: 274902 - DNA, 25 bp, Mus musculus
caggaacgaggtcgggaccctcctg

SEQ ID NO: 274903 - DNA, 25 bp, Mus musculus
aggcgtccgcctacggtgacttcgg

SEQ ID NO: 274904 - DNA, 25 bp, Mus musculus
tgcgtggatacacgtgctgtgcacg

SEQ ID NO: 274905 - DNA, 25 bp, Mus musculus
tccggcctgcatgagaagcgcaagc

SEQ ID NO: 274906 - DNA, 25 bp, Mus musculus
ggcgcatccgcacaacgttcacgag

SEQ ID NO: 274907 - DNA, 25 bp, Mus musculus
acaacgttcacgagtgctcagctca

SEQ ID NO: 274908 - DNA, 25 bp, Mus musculus
cacgagtgctcagctcaaggagttg

SEQ ID NO: 274909 - DNA, 25 bp, Mus musculus
gctcaaggagttggagcgcgtcttc

SEQ ID NO: 274910 - DNA, 25 bp, Mus musculus
tggagcgcgtcttcgccgagaccca

SEQ ID NO: 274911 - DNA, 25 bp, Mus musculus
cccgacatttacactcgcgaggaac

SEQ ID NO: 274912 - DNA, 25 bp, Mus musculus
cctgcatgagaagcgcaagcagcgg

SEQ ID NO: 274913 - DNA, 25 bp, Mus musculus
ttacactcgcgaggaactggcgctc

SEQ ID NO: 274914 - DNA, 25 bp, Mus musculus
ctcgcgaggaactggcgctcaagat

SEQ ID NO: 274915 - DNA, 25 bp, Mus musculus
tggcgctcaagatcgacctcactga

SEQ ID NO: 274916 - DNA, 25 bp, Mus musculus
tcgacctcactgaggctcgcgtgca

SEQ ID NO: 274917 - DNA, 25 bp, Mus musculus
ctcgcgtgcaggtgcgtggatacac

SEQ ID NO: 274918 - DNA, 25 bp, Mus musculus
cgccgggccaagttccgcaaacagg

SEQ ID NO: 274919 - DNA, 25 bp, Mus musculus
gagttctgtcctcctttcaccggaa

SEQ ID NO: 274920 - DNA, 25 bp, Mus musculus
ttccgcaaacaggagcgcgcggcca

SEQ ID NO: 274921 - DNA, 25 bp, Mus musculus
cgccctgaagacaaacctcttctag

SEQ ID NO: 274922 - DNA, 25 bp, Mus musculus
ccaaaaagggcgaggcgcgttgctc

SEQ ID NO: 274923 - DNA, 25 bp, Mus musculus
ttgctcgtcggaggacgacgactcc

SEQ ID NO: 274924 - DNA, 25 bp, Mus musculus
gactccaaggagtccacgtgcagcc

SEQ ID NO: 274925 - DNA, 25 bp, Mus musculus
acgcccgacagcaccgcgtcgctgc

SEQ ID NO: 274926 - DNA, 25 bp, Mus musculus
cccagccgctcaagggagcgttgtg

SEQ ID NO: 274927 - DNA, 25 bp, Mus musculus
cagcggagctgcttaaggcctggca

SEQ ID NO: 274928 - DNA, 25 bp, Mus musculus
gggccaggtcccttctctggagttc

SEQ ID NO: 274929 - DNA, 25 bp, Mus musculus
aggtcccttctctggagttctgtcc

SEQ ID NO: 274930 - DNA, 25 bp, Mus musculus
gacaaacctcttctagccgcgggcg

SEQ ID NO: 274931 - DNA, 25 bp, Mus musculus
cggaggacgacgactccaaggagtc

SEQ ID NO: 274932 - DNA, 25 bp, Mus musculus
cacaggacgcagagtgcgaaggccc

SEQ ID NO: 274933 - DNA, 25 bp, Mus musculus
gctctcgctatctcgcaccaggaag

SEQ ID NO: 274934 - DNA, 25 bp, Mus musculus
cgcggctcaggtcacggtgatacca

SEQ ID NO: 274935 - DNA, 25 bp, Mus musculus
cgggactcggtgtcccacacactga

SEQ ID NO: 274936 - DNA, 25 bp, Mus musculus
cgccctactcacaggacgcagagtg

SEQ ID NO: 274937 - DNA, 25 bp, Mus musculus
gtgtcccacacactgaggccatggc

SEQ ID NO: 274938 - DNA, 25 bp, Mus musculus
aggccatggcccacgcagggctcag

SEQ ID NO: 274939 - DNA, 25 bp, Mus musculus
gtcccgggactaaggatccaccagc

SEQ ID NO: 274940 - DNA, 25 bp, Mus musculus
actaaggatccaccagcccgagaga

SEQ ID NO: 274941 - DNA, 25 bp, Mus musculus
ccagcccgagagaacccagtatgtg

SEQ ID NO: 274942 - DNA, 25 bp, Mus musculus
aacccagtatgtgggttccacgctt

SEQ ID NO: 274943 - DNA, 25 bp, Mus musculus
gcagcgccggcctcaacttgaagag

SEQ ID NO: 274944 - DNA, 25 bp, Mus musculus
gccggcctcaacttgaagagaaaga

SEQ ID NO: 274945 - DNA, 25 bp, Mus musculus
tcaggtcacggtgataccaggctgg

SEQ ID NO: 274946 - DNA, 25 bp, Mus musculus
ctcgctttcgataactggggtaacg

SEQ ID NO: 274947 - DNA, 25 bp, Mus musculus
cacccgcaggcccaggttttgcagt

SEQ ID NO: 274948 - DNA, 25 bp, Mus musculus
gttttgcagtcccagaccaggagga

SEQ ID NO: 274949 - DNA, 25 bp, Mus musculus
agttccctcaagtctcagagcctca

SEQ ID NO: 274950 - DNA, 25 bp, Mus musculus
acctctagggcgactcgggttgact

SEQ ID NO: 274951 - DNA, 25 bp, Mus musculus
gacctcgggacagccttggctcttc

SEQ ID NO: 274952 - DNA, 25 bp, Mus musculus
ggctcattggggctctgcctgtaaa

SEQ ID NO: 274953 - DNA, 25 bp, Mus musculus
tgcctgtaaagctcagggcctggca

SEQ ID NO: 274954 - DNA, 25 bp, Mus musculus
actgtaaagcgcgactggggactga

SEQ ID NO: 274955 - DNA, 25 bp, Mus musculus
tgaacgggtattattagcaccgccc

SEQ ID NO: 274956 - DNA, 25 bp, Mus musculus
aacaaacttgcgcttccgtgggcca

SEQ ID NO: 274957 - DNA, 25 bp, Mus musculus
ggagctcctaagactctggctgcta

SEQ ID NO: 274958 - DNA, 25 bp, Mus musculus
gcgcccgagcttctcgctttcgata

SEQ ID NO: 274959 - DNA, 25 bp, Mus musculus
ttggctcttcagtgcgcccgagctt

SEQ ID NO: 274960 - DNA, 25 bp, Mus musculus
gctcggtgttgaagcgggaaacaaa

SEQ ID NO: 274961 - DNA, 25 bp, Mus musculus
aaccctgccgctggagattcaagga

SEQ ID NO: 274962 - DNA, 25 bp, Mus musculus
atgcgttagtgagtcccggattctg

SEQ ID NO: 274963 - DNA, 25 bp, Mus musculus
cgcaagacgcatgcgttagtgagtc

SEQ ID NO: 274964 - DNA, 25 bp, Mus musculus
ggaaacaaaaggagacgcaagacgc

SEQ ID NO: 274965 - DNA, 25 bp, Mus musculus
taagtgcggaaacgagactgctgcc

SEQ ID NO: 274966 - DNA, 25 bp, Mus musculus
ctcttggcgcggtaagtgcggaaac

SEQ ID NO: 274967 - DNA, 25 bp, Mus musculus
tccgctcagacctggggaaacgctt

SEQ ID NO: 274968 - DNA, 25 bp, Mus musculus
attctggtgggttcttccgctcaga

SEQ ID NO: 274969 - DNA, 25 bp, Mus musculus
agattcaaggaggagctgacaggta

SEQ ID NO: 274970 - DNA, 25 bp, Mus musculus
ttaacacgcaaacaccgccgagtgg

SEQ ID NO: 274971 - DNA, 25 bp, Mus musculus
cgaggagattaacacgcaaacaccg

SEQ ID NO: 274972 - DNA, 25 bp, Mus musculus
cgaggggctagcctggagaaaccct

SEQ ID NO: 274973 - DNA, 25 bp, Mus musculus
catcaacatcacttccggctcggtg

SEQ ID NO: 274974 - DNA, 25 bp, Mus musculus
ccagagaggaccagagtgcgaaagc

SEQ ID NO: 274975 - DNA, 25 bp, Mus musculus
gcgtctgctgaagatgatcatcctg

SEQ ID NO: 274976 - DNA, 25 bp, Mus musculus
tttttcctggtcaccacactgctcg

SEQ ID NO: 274977 - DNA, 25 bp, Mus musculus
gcgctgctctttttcctggtcacca

SEQ ID NO: 274978 - DNA, 25 bp, Mus musculus
gcgcctgggcgctgctctttttcct

SEQ ID NO: 274979 - DNA, 25 bp, Mus musculus
agcttggaccctagcgcgctcggtc

SEQ ID NO: 274980 - DNA, 25 bp, Mus musculus
agcctgatcggaggtgcagccagct

SEQ ID NO: 274981 - DNA, 25 bp, Mus musculus
ctgctgcgtctgctgaagatgatca

SEQ ID NO: 274982 - DNA, 25 bp, Mus musculus
tgaccgctttcgccttcccgggaga

SEQ ID NO: 274983 - DNA, 25 bp, Mus musculus
tgctggtgctgctcacggtgactgc

SEQ ID NO: 274984 - DNA, 25 bp, Mus musculus
gcgccaacttgctggtgctgctcac

SEQ ID NO: 274985 - DNA, 25 bp, Mus musculus
ctgcattcgcgccaacttgctggtg

SEQ ID NO: 274986 - DNA, 25 bp, Mus musculus
aaagcaggtggttgctgcggttccc

SEQ ID NO: 274987 - DNA, 25 bp, Mus musculus
ccgtgaccgggtgcgccgctgcatt

SEQ ID NO: 274988 - DNA, 25 bp, Mus musculus
tccgctcacgtaggacgcacttttc

SEQ ID NO: 274989 - DNA, 25 bp, Mus musculus
cggaaaggctcctgacggacgccgt

SEQ ID NO: 274990 - DNA, 25 bp, Mus musculus
cccgccatggggtgctgctatagca

SEQ ID NO: 274991 - DNA, 25 bp, Mus musculus
gctatagcagcgaaaacgaggactc

SEQ ID NO: 274992 - DNA, 25 bp, Mus musculus
acgaggactcggaccaggtgcgaca

SEQ ID NO: 274993 - DNA, 25 bp, Mus musculus
cctcagactgggttctcgggaaaca

SEQ ID NO: 274994 - DNA, 25 bp, Mus musculus
ggcccagaataaagcccgcagtggc

SEQ ID NO: 274995 - DNA, 25 bp, Mus musculus
agccggactgcaggctcaccgagta

SEQ ID NO: 274996 - DNA, 25 bp, Mus musculus
acagattacagagaggacggccagc

SEQ ID NO: 274997 - DNA, 25 bp, Mus musculus
ggctcctaccctcttaaagatccta

SEQ ID NO: 274998 - DNA, 25 bp, Mus musculus
tcttacttctgcctagggttgcggc

SEQ ID NO: 274999 - DNA, 25 bp, Mus musculus
tttccattggttggcgattgtcacg

SEQ ID NO: 275000 - DNA, 25 bp, Mus musculus
gtatctcaccactcgaatcctcaga

SEQ ID NO: 275001 - DNA, 25 bp, Mus musculus
tgccttcctatcacgtgccgcgggt

SEQ ID NO: 275002 - DNA, 25 bp, Mus musculus
ccatttcccttaacagtggcccttg

SEQ ID NO: 275003 - DNA, 25 bp, Mus musculus
tgcgagagaaaggtctccgtaaccg

SEQ ID NO: 275004 - DNA, 25 bp, Mus musculus
tgctgaccacgtcgatgcgagagaa

SEQ ID NO: 275005 - DNA, 25 bp, Mus musculus
tcttcaccgtgcgagaaacaagttg

SEQ ID NO: 275006 - DNA, 25 bp, Mus musculus
ttaaactaatcgtgtcttcaccgtg

SEQ ID NO: 275007 - DNA, 25 bp, Mus musculus
cagcgtctcactacctgaagagtta

SEQ ID NO: 275008 - DNA, 25 bp, Mus musculus
gtccgctagagtgcccggcaaacaa

SEQ ID NO: 275009 - DNA, 25 bp, Mus musculus
ccgggatccggaagtagtatcactc

SEQ ID NO: 275010 - DNA, 25 bp, Mus musculus
tttgtagttcaaggcgagtccggga

SEQ ID NO: 275011 - DNA, 25 bp, Mus musculus
acttgttgttcatcagggctggacg

SEQ ID NO: 275012 - DNA, 25 bp, Mus musculus
gccctagacggctcagttgaacgtg

SEQ ID NO: 275013 - DNA, 25 bp, Mus musculus
taccttagtcaacacgccctagacg

SEQ ID NO: 275014 - DNA, 25 bp, Mus musculus
cctgaagagttactcagcgcaaccc

SEQ ID NO: 275015 - DNA, 25 bp, Mus musculus
aacaacagccgactggggccaatga

SEQ ID NO: 275016 - DNA, 25 bp, Mus musculus
gtgtgtttacgccacagcctccagc

SEQ ID NO: 275017 - DNA, 25 bp, Mus musculus
gttgctcccagaccgcgcggaagct

SEQ ID NO: 275018 - DNA, 25 bp, Mus musculus
gcaggcttcacctgggtcctcctgg

SEQ ID NO: 275019 - DNA, 25 bp, Mus musculus
ctgctcagtttttagggcacgggca

SEQ ID NO: 275020 - DNA, 25 bp, Mus musculus
ccgcacgtcctgctcagtttttagg

SEQ ID NO: 275021 - DNA, 25 bp, Mus musculus
cgcgtgctctcccttcagcaatgga

SEQ ID NO: 275022 - DNA, 25 bp, Mus musculus
cctgtacaaggcctgcgccgtgcgg

SEQ ID NO: 275023 - DNA, 25 bp, Mus musculus
atctcaggttggtgaggccggccac

SEQ ID NO: 275024 - DNA, 25 bp, Mus musculus
gagtgtcctggccatctcaggttgg

SEQ ID NO: 275025 - DNA, 25 bp, Mus musculus
ctgccttaagccctgctggaaagca

SEQ ID NO: 275026 - DNA, 25 bp, Mus musculus
ggccgtcactgctactgccttaagc

SEQ ID NO: 275027 - DNA, 25 bp, Mus musculus
tctcggaggtggacaggccgtcact

SEQ ID NO: 275028 - DNA, 25 bp, Mus musculus
agctcttggcttcgctgttgctccc

SEQ ID NO: 275029 - DNA, 25 bp, Mus musculus
cttcagcaatggagcctgcgggctt

SEQ ID NO: 275030 - DNA, 25 bp, Mus musculus
ccacagcgcccgtatgggaataagg

SEQ ID NO: 275031 - DNA, 25 bp, Mus musculus
tagttccgcccagactggaagactg

SEQ ID NO: 275032 - DNA, 25 bp, Mus musculus
gttgggtgaacacttctagttccgc

SEQ ID NO: 275033 - DNA, 25 bp, Mus musculus
ctccatagtctctacggggcccggg

SEQ ID NO: 275034 - DNA, 25 bp, Mus musculus
gtgtggcttcattcgaccacgcctc

SEQ ID NO: 275035 - DNA, 25 bp, Mus musculus
aaccgggcttcagaactgtcagcga

SEQ ID NO: 275036 - DNA, 25 bp, Mus musculus
ctcagaactagctgggcggtacaga

SEQ ID NO: 275037 - DNA, 25 bp, Mus musculus
ggagccgagctaggactcagaacta

SEQ ID NO: 275038 - DNA, 25 bp, Mus musculus
tcggccaccgccaactttacatagg

SEQ ID NO: 275039 - DNA, 25 bp, Mus musculus
cgctgagagcctctgcgtgcaaggc

SEQ ID NO: 275040 - DNA, 25 bp, Mus musculus
tcaggttcacggtgtgaggcacaag

SEQ ID NO: 275041 - DNA, 25 bp, Mus musculus
ggctacaaccgtcgccgcgatgtca

SEQ ID NO: 275042 - DNA, 25 bp, Mus musculus
tgcaaggctcgtgagttcccaccga

SEQ ID NO: 275043 - DNA, 25 bp, Mus musculus
tgaggcacaaggcaacggtgctccg

SEQ ID NO: 275044 - DNA, 25 bp, Mus musculus
ccgtctacctgctccttcggaatta

SEQ ID NO: 275045 - DNA, 25 bp, Mus musculus
ctgtgaggaacctagagaccgtcta

SEQ ID NO: 275046 - DNA, 25 bp, Mus musculus
cgactcgtgcgctgccaagcttcag

SEQ ID NO: 275047 - DNA, 25 bp, Mus musculus
acatggcaccagtccgcactgtgga

SEQ ID NO: 275048 - DNA, 25 bp, Mus musculus
tttcgcgacactccctcgcttagga

SEQ ID NO: 275049 - DNA, 25 bp, Mus musculus
tcgcttaggacacgagcagagacgc

SEQ ID NO: 275050 - DNA, 25 bp, Mus musculus
cgcgtgtgcactaagaactacattt

SEQ ID NO: 275051 - DNA, 25 bp, Mus musculus
ttaagtcccactcgctaagggcgga

SEQ ID NO: 275052 - DNA, 25 bp, Mus musculus
gtaactgctgtatttcctcttggaa

SEQ ID NO: 275053 - DNA, 25 bp, Mus musculus
cctcttggaagtcgtctttcagaaa

SEQ ID NO: 275054 - DNA, 25 bp, Mus musculus
tcctacagtagaaaggcttggggcc

SEQ ID NO: 275055 - DNA, 25 bp, Mus musculus
gctgaggctaccacgacgtaaagtt

SEQ ID NO: 275056 - DNA, 25 bp, Mus musculus
gcactgagtccgacccggaaattta

SEQ ID NO: 275057 - DNA, 25 bp, Mus musculus
tgcttccgccgctcaagcgcttgta

SEQ ID NO: 275058 - DNA, 25 bp, Mus musculus
acgttgccgcccaacaatttggcga

SEQ ID NO: 275059 - DNA, 25 bp, Mus musculus
agaccctccacttcctgctcaccga

SEQ ID NO: 275060 - DNA, 25 bp, Mus musculus
tctgcgtccctcaagaacgttgccg

SEQ ID NO: 275061 - DNA, 25 bp, Mus musculus
ggtgcacggcctgcgctttcggcca

SEQ ID NO: 275062 - DNA, 25 bp, Mus musculus
tctcgcgggtgccagcaggtgtaca

SEQ ID NO: 275063 - DNA, 25 bp, Mus musculus
ggagccaccgatctcgcgggtgcca

SEQ ID NO: 275064 - DNA, 25 bp, Mus musculus
aggccctgcaactgctccggagcca

SEQ ID NO: 275065 - DNA, 25 bp, Mus musculus
ggctttgcttctgcgtccctcaaga

SEQ ID NO: 275066 - DNA, 25 bp, Mus musculus
gcgctgctggcctacaccgccaaca

SEQ ID NO: 275067 - DNA, 25 bp, Mus musculus
aacagccccctgcacaaggagttca

SEQ ID NO: 275068 - DNA, 25 bp, Mus musculus
gttctcgggcccattacctccacca

SEQ ID NO: 275069 - DNA, 25 bp, Mus musculus
gcccaacaatttggcgaggacacct

SEQ ID NO: 275070 - DNA, 25 bp, Mus musculus
caatttggcgaggacaccttcttcg

SEQ ID NO: 275071 - DNA, 25 bp, Mus musculus
ctcaagaacgttgccgcccaacaat

SEQ ID NO: 275072 - DNA, 25 bp, Mus musculus
cgccattcaacgttctccacgaagt

SEQ ID NO: 275073 - DNA, 25 bp, Mus musculus
agcagccgtaggtgagcacgcgcct

SEQ ID NO: 275074 - DNA, 25 bp, Mus musculus
tctccacgaagtcggccagactggc

SEQ ID NO: 275075 - DNA, 25 bp, Mus musculus
ccgaggtcgcacatccagctggtgc

SEQ ID NO: 275076 - DNA, 25 bp, Mus musculus
ctggtgcccgccgtgcgtccatgag

SEQ ID NO: 275077 - DNA, 25 bp, Mus musculus
cgtccatgagccgaaggtcaggcca

SEQ ID NO: 275078 - DNA, 25 bp, Mus musculus
ccacagcgctgagcgtcaaatggga

SEQ ID NO: 275079 - DNA, 25 bp, Mus musculus
cgtcaaatgggaaggcagagacatc

SEQ ID NO: 275080 - DNA, 25 bp, Mus musculus
gcagagacatccacacggcacgagc

SEQ ID NO: 275081 - DNA, 25 bp, Mus musculus
tccacacggcacgagctgcgtgtga

SEQ ID NO: 275082 - DNA, 25 bp, Mus musculus
gtcgtgccgcacaaccacgttggtg

SEQ ID NO: 275083 - DNA, 25 bp, Mus musculus
acaaccacgttggtgctggccgagg

SEQ ID NO: 275084 - DNA, 25 bp, Mus musculus
cgaaggtcaggccacagcgctgagc

SEQ ID NO: 275085 - DNA, 25 bp, Mus musculus
cagcagcagagtgaaggtcacgtct

SEQ ID NO: 275086 - DNA, 25 bp, Mus musculus
gagaggaagatctacccgcccagcc

SEQ ID NO: 275087 - DNA, 25 bp, Mus musculus
tgggtgacgatccttttgaaaccga

SEQ ID NO: 275088 - DNA, 25 bp, Mus musculus
accgttattcattgggtgacgatcc

SEQ ID NO: 275089 - DNA, 25 bp, Mus musculus
tcgaggcccacaccgttattcattg

SEQ ID NO: 275090 - DNA, 25 bp, Mus musculus
gtccaccgtcagagatcggctccgg

SEQ ID NO: 275091 - DNA, 25 bp, Mus musculus
cgcagaggcctgactgcgtcacacg

SEQ ID NO: 275092 - DNA, 25 bp, Mus musculus
gagtgagagcccaggtccgcccgtc

SEQ ID NO: 275093 - DNA, 25 bp, Mus musculus
cctccacccagcgaatgaatgagta

SEQ ID NO: 275094 - DNA, 25 bp, Mus musculus
ggcagcgctcccgacttacagcggt

SEQ ID NO: 275095 - DNA, 25 bp, Mus musculus
tccagcgcagatgccggtacagaga

SEQ ID NO: 275096 - DNA, 25 bp, Mus musculus
ttcactcaatgtgggctgcgacccg

SEQ ID NO: 275097 - DNA, 25 bp, Mus musculus
ccggagaaagcgaggttcactcaat

SEQ ID NO: 275098 - DNA, 25 bp, Mus musculus
tgaatgagtagcaccggagaaagcg

SEQ ID NO: 275099 - DNA, 25 bp, Mus musculus
acttacagcggtgcgtctggagtga

SEQ ID NO: 275100 - DNA, 25 bp, Mus musculus
ccgcctcacgccgttgctgctgcga

SEQ ID NO: 275101 - DNA, 25 bp, Mus musculus
tggaccacagggtaacgccacttcg

SEQ ID NO: 275102 - DNA, 25 bp, Mus musculus
cctccgcaggcctgcggtctaggcg

SEQ ID NO: 275103 - DNA, 25 bp, Mus musculus
cacagggtaacgccacttcgggagc

SEQ ID NO: 275104 - DNA, 25 bp, Mus musculus
ccctatccaccagtacttgggtgag

SEQ ID NO: 275105 - DNA, 25 bp, Mus musculus
ttggaccacagggtaacgccacttc

SEQ ID NO: 275106 - DNA, 25 bp, Mus musculus
cagtttggaccacagggtaacgcca

SEQ ID NO: 275107 - DNA, 25 bp, Mus musculus
gccagtttggaccacagggtaacgc

SEQ ID NO: 275108 - DNA, 25 bp, Mus musculus
agtaaggagggaatggccagtttgg

SEQ ID NO: 275109 - DNA, 25 bp, Mus musculus
ccaccagtacttgggtgagtaagga

SEQ ID NO: 275110 - DNA, 25 bp, Mus musculus
atccaccagtacttgggtgagtaag

SEQ ID NO: 275111 - DNA, 25 bp, Mus musculus
ctatccaccagtacttgggtgagta

SEQ ID NO: 275112 - DNA, 25 bp, Mus musculus
acgccgttgctgctgcgacccgccc

SEQ ID NO: 275113 - DNA, 25 bp, Mus musculus
ccggcctccgcaggcctgcggtcta

SEQ ID NO: 275114 - DNA, 25 bp, Mus musculus
tgcgtctccatgtccgggttaccgc

SEQ ID NO: 275115 - DNA, 25 bp, Mus musculus
ggcgtttctgcattggcctgcactc

SEQ ID NO: 275116 - DNA, 25 bp, Mus musculus
ttctgcattggcctgcactcggcac

SEQ ID NO: 275117 - DNA, 25 bp, Mus musculus
cgcttcttgacagccttcgcctatt

SEQ ID NO: 275118 - DNA, 25 bp, Mus musculus
cagccttcgcctattggaaccacta

SEQ ID NO: 275119 - DNA, 25 bp, Mus musculus
tattggaaccactacctcagctgtg

SEQ ID NO: 275120 - DNA, 25 bp, Mus musculus
tacctcagctgtgcgtctccatgtc

SEQ ID NO: 275121 - DNA, 25 bp, Mus musculus
cttctctgccgcattaacttcagtc

SEQ ID NO: 275122 - DNA, 25 bp, Mus musculus
tgccgcattaacttcagtctcaatg

SEQ ID NO: 275123 - DNA, 25 bp, Mus musculus
ttcagtctcaatgtggtggagaacc

SEQ ID NO: 275124 - DNA, 25 bp, Mus musculus
gagaacctcgcgctgctcgtgctca

SEQ ID NO: 275125 - DNA, 25 bp, Mus musculus
ctacgtgtggcgtttctgcattggc

SEQ ID NO: 275126 - DNA, 25 bp, Mus musculus
ctcctccgaggacttcagtgggtgc

SEQ ID NO: 275127 - DNA, 25 bp, Mus musculus
tcacctacgtctcctcctccgagga

SEQ ID NO: 275128 - DNA, 25 bp, Mus musculus
agcttgaactcctcttcccaggacc

SEQ ID NO: 275129 - DNA, 25 bp, Mus musculus
acttccgagcctctcacggttcgga

SEQ ID NO: 275130 - DNA, 25 bp, Mus musculus
gcccgcccaacttgcagtgaacgaa

SEQ ID NO: 275131 - DNA, 25 bp, Mus musculus
agtccgggccagcttgaactcctct

SEQ ID NO: 275132 - DNA, 25 bp, Mus musculus
ttgcagtgaacgaaaacctcccgcc

SEQ ID NO: 275133 - DNA, 25 bp, Mus musculus
ccaacttgcagtgaacgaaaacctc

SEQ ID NO: 275134 - DNA, 25 bp, Mus musculus
ccgcccaacttgcagtgaacgaaaa

SEQ ID NO: 275135 - DNA, 25 bp, Mus musculus
aacccggccaccagcgatcgggtcg

SEQ ID NO: 275136 - DNA, 25 bp, Mus musculus
tcggatcccaccctcaacccggcca

SEQ ID NO: 275137 - DNA, 25 bp, Mus musculus
caggagctcgcgctgtccctcggat

SEQ ID NO: 275138 - DNA, 25 bp, Mus musculus
tcagtggtccctcgcggacagcagg

SEQ ID NO: 275139 - DNA, 25 bp, Mus musculus
ggatctcagtggtccctcgcggaca

SEQ ID NO: 275140 - DNA, 25 bp, Mus musculus
ctcacggttcggatctcagtggtcc

SEQ ID NO: 275141 - DNA, 25 bp, Mus musculus
acggttcggatctcagtggtccctc

SEQ ID NO: 275142 - DNA, 25 bp, Mus musculus
tcccgcaggctgacgttcagagcta

SEQ ID NO: 275143 - DNA, 25 bp, Mus musculus
gctccatcaggcactagagccacaa

SEQ ID NO: 275144 - DNA, 25 bp, Mus musculus
tccagcggccctcatacaggtaggc

SEQ ID NO: 275145 - DNA, 25 bp, Mus musculus
aaagccgcgttcatccactaccgag

SEQ ID NO: 275146 - DNA, 25 bp, Mus musculus
attcccgaatcaggacggtgactcg

SEQ ID NO: 275147 - DNA, 25 bp, Mus musculus
ctgggtcctgctgcaaaaaggaatc

SEQ ID NO: 275148 - DNA, 25 bp, Mus musculus
ccgcgttgtcaaaagcctcaaattc

SEQ ID NO: 275149 - DNA, 25 bp, Mus musculus
acgttcagagctaggcaccgcgctt

SEQ ID NO: 275150 - DNA, 25 bp, Mus musculus
agacggattcccaacgagcgcagca

SEQ ID NO: 275151 - DNA, 25 bp, Mus musculus
tggcgagctgcacccagcagcgagc

SEQ ID NO: 275152 - DNA, 25 bp, Mus musculus
tctacgtcgtagtcccaagggatga

SEQ ID NO: 275153 - DNA, 25 bp, Mus musculus
tcctccaggtagatgcccagatcta

SEQ ID NO: 275154 - DNA, 25 bp, Mus musculus
gttgcccacgtcctccaggtagatg

SEQ ID NO: 275155 - DNA, 25 bp, Mus musculus
atccactagctctggcaccgcgttg

SEQ ID NO: 275156 - DNA, 25 bp, Mus musculus
agacgtgatcagcagagatgcaggc

SEQ ID NO: 275157 - DNA, 25 bp, Mus musculus
tcttcttgttccctgatctcgccct

SEQ ID NO: 275158 - DNA, 25 bp, Mus musculus
gaaaagacgtgatcagcagagatgc

SEQ ID NO: 275159 - DNA, 25 bp, Mus musculus
cccgggaaaagacgtgatcagcaga

SEQ ID NO: 275160 - DNA, 25 bp, Mus musculus
agaccggcgagtggacggcctcgag

SEQ ID NO: 275161 - DNA, 25 bp, Mus musculus
ctgtttggagcggtaggaccgcgcc

SEQ ID NO: 275162 - DNA, 25 bp, Mus musculus
cgtgggaagacgtggggctcttctt

SEQ ID NO: 275163 - DNA, 25 bp, Mus musculus
cgtgtcgtggttccgcacctcgcag

SEQ ID NO: 275164 - DNA, 25 bp, Mus musculus
atgtcgtgtcgtggttccgcacctc

SEQ ID NO: 275165 - DNA, 25 bp, Mus musculus
aaacaggatgtcgtgtcgtggttcc

SEQ ID NO: 275166 - DNA, 25 bp, Mus musculus
cccaaaacaggatgtcgtgtcgtgg

SEQ ID NO: 275167 - DNA, 25 bp, Mus musculus
atcagcagagatgcaggcggagccg

SEQ ID NO: 275168 - DNA, 25 bp, Mus musculus
tgaggtccggcttgggccctggaga

SEQ ID NO: 275169 - DNA, 25 bp, Mus musculus
cgcgcccaggcctgaggtccggctt

SEQ ID NO: 275170 - DNA, 25 bp, Mus musculus
ctgcgtccaaacttggggcacttga

SEQ ID NO: 275171 - DNA, 25 bp, Mus musculus
tgagttacctgagcaactgcgtgtc

SEQ ID NO: 275172 - DNA, 25 bp, Mus musculus
cttggccaaacctagcaggaccata

SEQ ID NO: 275173 - DNA, 25 bp, Mus musculus
aggcggctccaggtttgtcatccta

SEQ ID NO: 275174 - DNA, 25 bp, Mus musculus
ttgtcatcctagtgcggagtttctg

SEQ ID NO: 275175 - DNA, 25 bp, Mus musculus
ggagtttctgtccaacctgacttta

SEQ ID NO: 275176 - DNA, 25 bp, Mus musculus
cgggcgctctccaacaggttattcc

SEQ ID NO: 275177 - DNA, 25 bp, Mus musculus
tgacctcggcctaggagtcttagga

SEQ ID NO: 275178 - DNA, 25 bp, Mus musculus
ttaggatcccggagacatccgtgtc

SEQ ID NO: 275179 - DNA, 25 bp, Mus musculus
tagctgctgaggctcaccgctgttt

SEQ ID NO: 275180 - DNA, 25 bp, Mus musculus
tgctcaaactctccggaagcagata

SEQ ID NO: 275181 - DNA, 25 bp, Mus musculus
ggagactccgatccttctgcgtcca

SEQ ID NO: 275182 - DNA, 25 bp, Mus musculus
gggcacttgaccttcgcttatcgga

SEQ ID NO: 275183 - DNA, 25 bp, Mus musculus
ggacctacagttggaccggagactc

SEQ ID NO: 275184 - DNA, 25 bp, Mus musculus
ccagccagcgcggtgtcatagagcc

SEQ ID NO: 275185 - DNA, 25 bp, Mus musculus
acgcaacaccggaggagccgcagcg

SEQ ID NO: 275186 - DNA, 25 bp, Mus musculus
gctgcgccttttacctcggcttcga

SEQ ID NO: 275187 - DNA, 25 bp, Mus musculus
tcggcttcgatctccgcgatcttcg

SEQ ID NO: 275188 - DNA, 25 bp, Mus musculus
gatcttcgctaaggtcccgctcatg

SEQ ID NO: 275189 - DNA, 25 bp, Mus musculus
cggagggcttaaggccacaccagcc

SEQ ID NO: 275190 - DNA, 25 bp, Mus musculus
acaccagcctccacactggttaggt

SEQ ID NO: 275191 - DNA, 25 bp, Mus musculus
tgctaagctcgcgacacggttccgc

SEQ ID NO: 275192 - DNA, 25 bp, Mus musculus
atgcgccgaaaaccggagcaagtgc

SEQ ID NO: 275193 - DNA, 25 bp, Mus musculus
taaacccggcgaccatcagagtgcg

SEQ ID NO: 275194 - DNA, 25 bp, Mus musculus
agtccgcgccgacgctctcggagat

SEQ ID NO: 275195 - DNA, 25 bp, Mus musculus
tcatagagcccgcagtgaggtgacc

SEQ ID NO: 275196 - DNA, 25 bp, Mus musculus
cagagcggtcgctcgggccaacttc

SEQ ID NO: 275197 - DNA, 25 bp, Mus musculus
acacggttccgcgagaagtccgcgc

SEQ ID NO: 275198 - DNA, 25 bp, Mus musculus
cgggctttgcccacactcaatatgg

SEQ ID NO: 275199 - DNA, 25 bp, Mus musculus
aagggactcgtgtgctgtctgtcta

SEQ ID NO: 275200 - DNA, 25 bp, Mus musculus
tactgctcagtttccgcccattcaa

SEQ ID NO: 275201 - DNA, 25 bp, Mus musculus
cggcgttgaaacgtcaagaacgtca

SEQ ID NO: 275202 - DNA, 25 bp, Mus musculus
attcgaattccgtccgtcgcgttgc

SEQ ID NO: 275203 - DNA, 25 bp, Mus musculus
tcgtaattcggttagtctgctctgg

SEQ ID NO: 275204 - DNA, 25 bp, Mus musculus
agtgctgtctatcgcgcagcttcca

SEQ ID NO: 275205 - DNA, 25 bp, Mus musculus
ggagtccaacccttcacatctgaca

SEQ ID NO: 275206 - DNA, 25 bp, Mus musculus
ttcttcgcctcggagctgctaactg

SEQ ID NO: 275207 - DNA, 25 bp, Mus musculus
gctgctaactggtctcgaacctctc

SEQ ID NO: 275208 - DNA, 25 bp, Mus musculus
tcagcacttcagcttctagcggcga

SEQ ID NO: 275209 - DNA, 25 bp, Mus musculus
ctagcggcgatgcatgtgatcaagc

SEQ ID NO: 275210 - DNA, 25 bp, Mus musculus
caggagaactcgttcccgccaggtc

SEQ ID NO: 275211 - DNA, 25 bp, Mus musculus
gccaggtccgctttcacccaatgtg

SEQ ID NO: 275212 - DNA, 25 bp, Mus musculus
gcggtgcctggtggctctgtcacca

SEQ ID NO: 275213 - DNA, 25 bp, Mus musculus
tgagcgcgaaactggaagacacccg

SEQ ID NO: 275214 - DNA, 25 bp, Mus musculus
tccacggaacgagcctgtagggtga

SEQ ID NO: 275215 - DNA, 25 bp, Mus musculus
cccgagtccacggaacgagcctgta

SEQ ID NO: 275216 - DNA, 25 bp, Mus musculus
ggaagacacccgtgcgctcagtttc

SEQ ID NO: 275217 - DNA, 25 bp, Mus musculus
catgctctgacgaggcccgtgggaa

SEQ ID NO: 275218 - DNA, 25 bp, Mus musculus
ggcgatctcgtaaacattaagtccc

SEQ ID NO: 275219 - DNA, 25 bp, Mus musculus
ggagcctggcgatctcgtaaacatt

SEQ ID NO: 275220 - DNA, 25 bp, Mus musculus
caggcttgcgccaggttgccaaagc

SEQ ID NO: 275221 - DNA, 25 bp, Mus musculus
agcttgcttgcaggcggccacggca

SEQ ID NO: 275222 - DNA, 25 bp, Mus musculus
acctcggcttccgtgggtggcactg

SEQ ID NO: 275223 - DNA, 25 bp, Mus musculus
tgtggctgtggcgacctcggcttcc

SEQ ID NO: 275224 - DNA, 25 bp, Mus musculus
ccctggccactcgttggtgtggctg

SEQ ID NO: 275225 - DNA, 25 bp, Mus musculus
tagattcggtctccctggccactcg

SEQ ID NO: 275226 - DNA, 25 bp, Mus musculus
cccacagcggactagcaagaattct

SEQ ID NO: 275227 - DNA, 25 bp, Mus musculus
tccgtttgagatttgctcaggaaaa

SEQ ID NO: 275228 - DNA, 25 bp, Mus musculus
aatggttgctcttcctcttttcacg

SEQ ID NO: 275229 - DNA, 25 bp, Mus musculus
gttgctcttcctcttttcacgcaca

SEQ ID NO: 275230 - DNA, 25 bp, Mus musculus
cgcacatccgtttgagatttgctca

SEQ ID NO: 275231 - DNA, 25 bp, Mus musculus
cctcttttcacgcacatccgtttga

SEQ ID NO: 275232 - DNA, 25 bp, Mus musculus
ttgctcaggaaaattgtgcttgccc

SEQ ID NO: 275233 - DNA, 25 bp, Mus musculus
aaaattgtgcttgccctcgggtggt

SEQ ID NO: 275234 - DNA, 25 bp, Mus musculus
gtttgattccaaagctagatcttcg

SEQ ID NO: 275235 - DNA, 25 bp, Mus musculus
ttccaaagctagatcttcgggcatc

SEQ ID NO: 275236 - DNA, 25 bp, Mus musculus
gggcagggctccagcctcagacgca

SEQ ID NO: 275237 - DNA, 25 bp, Mus musculus
ggaaaattgtgcttgccctcgggtg

SEQ ID NO: 275238 - DNA, 25 bp, Mus musculus
acagcggactagcaagaattctttg

SEQ ID NO: 275239 - DNA, 25 bp, Mus musculus
aaagctagatcttcgggcatctctc

SEQ ID NO: 275240 - DNA, 25 bp, Mus musculus
ccagccagagcgtcgacgcccgttt

SEQ ID NO: 275241 - DNA, 25 bp, Mus musculus
aaccgcccagtgacgcacggctggg

SEQ ID NO: 275242 - DNA, 25 bp, Mus musculus
ggtctccgtccgcattccaagaaag

SEQ ID NO: 275243 - DNA, 25 bp, Mus musculus
gggacagaggagagaaattcgaacc

SEQ ID NO: 275244 - DNA, 25 bp, Mus musculus
ctggcgttttataggggacgactga

SEQ ID NO: 275245 - DNA, 25 bp, Mus musculus
cgctcctcaggcgaaccagccgcgc

SEQ ID NO: 275246 - DNA, 25 bp, Mus musculus
agcggcgtgccagctcattggtccg

SEQ ID NO: 275247 - DNA, 25 bp, Mus musculus
tgccagctcattggtccggccaggc

SEQ ID NO: 275248 - DNA, 25 bp, Mus musculus
cgtttcctggcaacggccgagcgca

SEQ ID NO: 275249 - DNA, 25 bp, Mus musculus
gcattccaagaaaggagcggctcca

SEQ ID NO: 275250 - DNA, 25 bp, Mus musculus
aaggagcggctccacactctcaggc

SEQ ID NO: 275251 - DNA, 25 bp, Mus musculus
gactccgcccttctgaggattctgg

SEQ ID NO: 275252 - DNA, 25 bp, Mus musculus
cccttctgaggattctggcgtttta

SEQ ID NO: 275253 - DNA, 25 bp, Mus musculus
cccacgcgtctctttcacttgcacc

SEQ ID NO: 275254 - DNA, 25 bp, Mus musculus
ctggagtgcagtcacccaggagcgc

SEQ ID NO: 275255 - DNA, 25 bp, Mus musculus
ggtgtctccctcctcaacagcagta

SEQ ID NO: 275256 - DNA, 25 bp, Mus musculus
aaggaggcgcgccaagagtcacctg

SEQ ID NO: 275257 - DNA, 25 bp, Mus musculus
caaaagccgcccagagcttgggacc

SEQ ID NO: 275258 - DNA, 25 bp, Mus musculus
aaccggtgctggagctagcttagtt

SEQ ID NO: 275259 - DNA, 25 bp, Mus musculus
ttagttggagctgagtgggacttca

SEQ ID NO: 275260 - DNA, 25 bp, Mus musculus
tgggacttcacaggagccatggatc

SEQ ID NO: 275261 - DNA, 25 bp, Mus musculus
gccatggatctgctcaagctgaacc

SEQ ID NO: 275262 - DNA, 25 bp, Mus musculus
agcgccggcaacctcagctgcgaga

SEQ ID NO: 275263 - DNA, 25 bp, Mus musculus
gctgaaccgcagcttgcagggacca

SEQ ID NO: 275264 - DNA, 25 bp, Mus musculus
gcgcacggaactctggagccaagga

SEQ ID NO: 275265 - DNA, 25 bp, Mus musculus
ggtcagggtcttctttgtgccgccc

SEQ ID NO: 275266 - DNA, 25 bp, Mus musculus
tcctcaacagcagtagcgccggcaa

SEQ ID NO: 275267 - DNA, 25 bp, Mus musculus
cttgcagggaccaggacccgggtca

SEQ ID NO: 275268 - DNA, 25 bp, Mus musculus
ttttttcgtgtgttggctgccagtg

SEQ ID NO: 275269 - DNA, 25 bp, Mus musculus
tgcctggacacatgtgcccgctgtt

SEQ ID NO: 275270 - DNA, 25 bp, Mus musculus
cgccaggcctgcctggacacatgtg

SEQ ID NO: 275271 - DNA, 25 bp, Mus musculus
actgtttcatgcaccgccgattccg

SEQ ID NO: 275272 - DNA, 25 bp, Mus musculus
ccctggtctactgtttcatgcaccg

SEQ ID NO: 275273 - DNA, 25 bp, Mus musculus
gagctacacctctgcttgtgccaac

SEQ ID NO: 275274 - DNA, 25 bp, Mus musculus
acttgctgagctacacctctgcttg

SEQ ID NO: 275275 - DNA, 25 bp, Mus musculus
cctatctctttcatccacttgctga

SEQ ID NO: 275276 - DNA, 25 bp, Mus musculus
tgccagtgtacagcgccaacacgtg

SEQ ID NO: 275277 - DNA, 25 bp, Mus musculus
cgaatgctgctggtgattgttttgc

SEQ ID NO: 275278 - DNA, 25 bp, Mus musculus
ccaaccaggccaagctgctggctaa

SEQ ID NO: 275279 - DNA, 25 bp, Mus musculus
gagatgacaacgctgaccacgccca

SEQ ID NO: 275280 - DNA, 25 bp, Mus musculus
tccgcgttcccgactggagatgaca

SEQ ID NO: 275281 - DNA, 25 bp, Mus musculus
ccaacacgtggcgtgccttcgatgg

SEQ ID NO: 275282 - DNA, 25 bp, Mus musculus
tgtcgtggctgcgactcagcgcacc

SEQ ID NO: 275283 - DNA, 25 bp, Mus musculus
ggcctccaaccgctgcacctgagca

SEQ ID NO: 275284 - DNA, 25 bp, Mus musculus
tccctgagaccgatggctgcgatct

SEQ ID NO: 275285 - DNA, 25 bp, Mus musculus
caggccactctgtatgcgacgcacg

SEQ ID NO: 275286 - DNA, 25 bp, Mus musculus
tgtatgcgacgcacggagcccgcca

SEQ ID NO: 275287 - DNA, 25 bp, Mus musculus
tgcctctcagccaggccgccttgcc

SEQ ID NO: 275288 - DNA, 25 bp, Mus musculus
atggtggccaatttctccagcaagg

SEQ ID NO: 275289 - DNA, 25 bp, Mus musculus
ttctccagcaaggtcaccacggtga

SEQ ID NO: 275290 - DNA, 25 bp, Mus musculus
gtcaccacggtgactgcgtgcaccg

SEQ ID NO: 275291 - DNA, 25 bp, Mus musculus
ccctgcgggcgtctcaggcacaggt

SEQ ID NO: 275292 - DNA, 25 bp, Mus musculus
acaggtccgggctccagtgcgctct

SEQ ID NO: 275293 - DNA, 25 bp, Mus musculus
ggcctgctctccctgagaccgatgg

SEQ ID NO: 275294 - DNA, 25 bp, Mus musculus
agttggcatcttccgcggtgggaaa

SEQ ID NO: 275295 - DNA, 25 bp, Mus musculus
ccagcagcccgtggttggcctccaa

SEQ ID NO: 275296 - DNA, 25 bp, Mus musculus
accgacgccgggagacgcgcctaga

SEQ ID NO: 275297 - DNA, 25 bp, Mus musculus
cgagcgagtgcgagccgcactggct

SEQ ID NO: 275298 - DNA, 25 bp, Mus musculus
ggctggagacggagcagcacctacc

SEQ ID NO: 275299 - DNA, 25 bp, Mus musculus
cccaggtggcgaaggtagctcaagc

SEQ ID NO: 275300 - DNA, 25 bp, Mus musculus
gcgcctagagcacggagtctgatcc

SEQ ID NO: 275301 - DNA, 25 bp, Mus musculus
ggctcccgcaacaccgcagcttctc

SEQ ID NO: 275302 - DNA, 25 bp, Mus musculus
ccagccgcaccctgcagacccttga

SEQ ID NO: 275303 - DNA, 25 bp, Mus musculus
tgcagacccttgaccctcgcaagcc

SEQ ID NO: 275304 - DNA, 25 bp, Mus musculus
ctcgcaagccctgcgtcccaggcct

SEQ ID NO: 275305 - DNA, 25 bp, Mus musculus
gctgcacccaactcccaggaccctg

SEQ ID NO: 275306 - DNA, 25 bp, Mus musculus
catgccaccgtggactcacctccgc

SEQ ID NO: 275307 - DNA, 25 bp, Mus musculus
actcacctccgcgtcggtcctgcac

SEQ ID NO: 275308 - DNA, 25 bp, Mus musculus
agacgcgcctagagcacggagtctg

SEQ ID NO: 275309 - DNA, 25 bp, Mus musculus
gcgaaggtagctcaagctgcaaggc

SEQ ID NO: 275310 - DNA, 25 bp, Mus musculus
cctccatgatggaggagcgagcggc

SEQ ID NO: 275311 - DNA, 25 bp, Mus musculus
cttcgaagccgagaaggcccgctgg

SEQ ID NO: 275312 - DNA, 25 bp, Mus musculus
gcacgcttcgaagccgagaaggccc

SEQ ID NO: 275313 - DNA, 25 bp, Mus musculus
agtgggcacgcttcgaagccgagaa

SEQ ID NO: 275314 - DNA, 25 bp, Mus musculus
aacacgagtgggcacgcttcgaagc

SEQ ID NO: 275315 - DNA, 25 bp, Mus musculus
tatccaacacgagtgggcacgcttc

SEQ ID NO: 275316 - DNA, 25 bp, Mus musculus
ctgcactttatccaacacgagtggg

SEQ ID NO: 275317 - DNA, 25 bp, Mus musculus
gatcctgcactttatccaacacgag

SEQ ID NO: 275318 - DNA, 25 bp, Mus musculus
cggggatcctgcactttatccaaca

SEQ ID NO: 275319 - DNA, 25 bp, Mus musculus
tgccggggatcctgcactttatcca

SEQ ID NO: 275320 - DNA, 25 bp, Mus musculus
cagcctgccggggatcctgcacttt

SEQ ID NO: 275321 - DNA, 25 bp, Mus musculus
gctcgggcacggctcccaacccgac

SEQ ID NO: 275322 - DNA, 25 bp, Mus musculus
ccgcggtcgcatcggccgcctcctc

SEQ ID NO: 275323 - DNA, 25 bp, Mus musculus
aggtgagcgccaccgctgccctccc

SEQ ID NO: 275324 - DNA, 25 bp, Mus musculus
ccggcgcttcacatcatctggggaa

SEQ ID NO: 275325 - DNA, 25 bp, Mus musculus
ttcgtcttcaattggattgtccttc

SEQ ID NO: 275326 - DNA, 25 bp, Mus musculus
attgtccttccgtttgccaccagtg

SEQ ID NO: 275327 - DNA, 25 bp, Mus musculus
ccgtttgccaccagtgctgtacatg

SEQ ID NO: 275328 - DNA, 25 bp, Mus musculus
gccaccagtgctgtacatggagctc

SEQ ID NO: 275329 - DNA, 25 bp, Mus musculus
ctgtacatggagctcggcctacgaa

SEQ ID NO: 275330 - DNA, 25 bp, Mus musculus
agctcggcctacgaactgccttctg

SEQ ID NO: 275331 - DNA, 25 bp, Mus musculus
acgaactgccttctggcgcacatga

SEQ ID NO: 275332 - DNA, 25 bp, Mus musculus
tggcgcacatgactgccaggaccac

SEQ ID NO: 275333 - DNA, 25 bp, Mus musculus
cgcacacgaaaagggctgccacgca

SEQ ID NO: 275334 - DNA, 25 bp, Mus musculus
ccgggagacttgacccggcgcttca

SEQ ID NO: 275335 - DNA, 25 bp, Mus musculus
caggtcgaagggcacgcacacgaaa

SEQ ID NO: 275336 - DNA, 25 bp, Mus musculus
gacgagttcgtcttcaattggattg

SEQ ID NO: 275337 - DNA, 25 bp, Mus musculus
tgactgccaggaccaccgggagact

SEQ ID NO: 275338 - DNA, 25 bp, Mus musculus
ggaggcctactccaccaattgaaag

SEQ ID NO: 275339 - DNA, 25 bp, Mus musculus
tgccaccagacaggcagagattccg

SEQ ID NO: 275340 - DNA, 25 bp, Mus musculus
gaaacctgtagaggccgggactgca

SEQ ID NO: 275341 - DNA, 25 bp, Mus musculus
caccgtgaatgtcttgggctgcttc

SEQ ID NO: 275342 - DNA, 25 bp, Mus musculus
ggctgcttcctcttgagtgagctga

SEQ ID NO: 275343 - DNA, 25 bp, Mus musculus
ccctggagtagctgcacaggcctca

SEQ ID NO: 275344 - DNA, 25 bp, Mus musculus
agaaatcctagacggctgcggcgcc

SEQ ID NO: 275345 - DNA, 25 bp, Mus musculus
cggccggttacctcgcagttgaact

SEQ ID NO: 275346 - DNA, 25 bp, Mus musculus
actcctactctagcaagactggttg

SEQ ID NO: 275347 - DNA, 25 bp, Mus musculus
cgagcgcttttgttcctaaagtata

SEQ ID NO: 275348 - DNA, 25 bp, Mus musculus
aaagttgcactgaacgagggccgcc

SEQ ID NO: 275349 - DNA, 25 bp, Mus musculus
catctcggcgtccatggtgacgatc

SEQ ID NO: 275350 - DNA, 25 bp, Mus musculus
ccagggacgcctttggacagaaatc

SEQ ID NO: 275351 - DNA, 25 bp, Mus musculus
tagatgcggtcactccgagcgcttt

SEQ ID NO: 275352 - DNA, 25 bp, Mus musculus
cccgatacacaggtggaccagacgc

SEQ ID NO: 275353 - DNA, 25 bp, Mus musculus
cgcagctttcggtaccctccgccaa

SEQ ID NO: 275354 - DNA, 25 bp, Mus musculus
aacccgcgctcctaaaatgaaccat

SEQ ID NO: 275355 - DNA, 25 bp, Mus musculus
aacacggacctcacgtgagcagcca

SEQ ID NO: 275356 - DNA, 25 bp, Mus musculus
cgctgctctcacagacacggacacg

SEQ ID NO: 275357 - DNA, 25 bp, Mus musculus
cacggacacgcctcacgtggacaga

SEQ ID NO: 275358 - DNA, 25 bp, Mus musculus
cagcttttgaaaagcatccgcgccc

SEQ ID NO: 275359 - DNA, 25 bp, Mus musculus
gtggaccagacgcacccttggggcc

SEQ ID NO: 275360 - DNA, 25 bp, Mus musculus
aaggcccggactgcagccactcgga

SEQ ID NO: 275361 - DNA, 25 bp, Mus musculus
ggctcttggctctccctctgcggtg

SEQ ID NO: 275362 - DNA, 25 bp, Mus musculus
cggatcccggatcctagatcctaga

SEQ ID NO: 275363 - DNA, 25 bp, Mus musculus
cctctggctcacgaggcctaagggc

SEQ ID NO: 275364 - DNA, 25 bp, Mus musculus
tagatcctagatccgggatcctcgc

SEQ ID NO: 275365 - DNA, 25 bp, Mus musculus
cgtggacagagacaggaacagcttt

SEQ ID NO: 275366 - DNA, 25 bp, Mus musculus
agtgacatgctctctgggcagaaga

SEQ ID NO: 275367 - DNA, 25 bp, Mus musculus
tgtttccaggggtacacgcaagaac

SEQ ID NO: 275368 - DNA, 25 bp, Mus musculus
agtatgtccttctcacctgggccgg

SEQ ID NO: 275369 - DNA, 25 bp, Mus musculus
ctcgggttccagttctcgtcgcgat

SEQ ID NO: 275370 - DNA, 25 bp, Mus musculus
tcgtcgcgatcctagcagcaggtca

SEQ ID NO: 275371 - DNA, 25 bp, Mus musculus
cctagcagcaggtcagagatttggc

SEQ ID NO: 275372 - DNA, 25 bp, Mus musculus
agccggccacgtcgcagagaaaaag

SEQ ID NO: 275373 - DNA, 25 bp, Mus musculus
acgagcctggagctacgccttcaag

SEQ ID NO: 275374 - DNA, 25 bp, Mus musculus
cgccttcaagctcttggggagtagt

SEQ ID NO: 275375 - DNA, 25 bp, Mus musculus
tgagagtttacttccggggcgactc

SEQ ID NO: 275376 - DNA, 25 bp, Mus musculus
gggcgactctgagagctctaacctc

SEQ ID NO: 275377 - DNA, 25 bp, Mus musculus
ctctctgggttagacgtgcagtttg

SEQ ID NO: 275378 - DNA, 25 bp, Mus musculus
gtgcgttcaacttcccttcgtccaa

SEQ ID NO: 275379 - DNA, 25 bp, Mus musculus
agcgcagttgctctctgggttagac

SEQ ID NO: 275380 - DNA, 25 bp, Mus musculus
caccatagagcgtagccgctggcga

SEQ ID NO: 275381 - DNA, 25 bp, Mus musculus
ggacgctgctatggacgacattttc

SEQ ID NO: 275382 - DNA, 25 bp, Mus musculus
attttcactcagtgccgggagggca

SEQ ID NO: 275383 - DNA, 25 bp, Mus musculus
atcctagggctggagtcggaccaaa

SEQ ID NO: 275384 - DNA, 25 bp, Mus musculus
cttcgcggagcagagcaccatagag

SEQ ID NO: 275385 - DNA, 25 bp, Mus musculus
ggctcttcgaacataccacccgtag

SEQ ID NO: 275386 - DNA, 25 bp, Mus musculus
acgctgtcttgcaaacccgtctctg

SEQ ID NO: 275387 - DNA, 25 bp, Mus musculus
atctctgcagcagttctgagccggg

SEQ ID NO: 275388 - DNA, 25 bp, Mus musculus
cggctgacaccaactcgggaaacta

SEQ ID NO: 275389 - DNA, 25 bp, Mus musculus
cctgctcctcgagccaaggggtcgt

SEQ ID NO: 275390 - DNA, 25 bp, Mus musculus
cgaagcccttcatagacaaccactg

SEQ ID NO: 275391 - DNA, 25 bp, Mus musculus
gcactgacacctctgtcctgaggga

SEQ ID NO: 275392 - DNA, 25 bp, Mus musculus
cctgagggaactcacacagagagtc

SEQ ID NO: 275393 - DNA, 25 bp, Mus musculus
aaattctgtggtagctagagcggcc

SEQ ID NO: 275394 - DNA, 25 bp, Mus musculus
aaaggcggcgaacagagccgcttcc

SEQ ID NO: 275395 - DNA, 25 bp, Mus musculus
agaatcaacagcacaggtgagaggc

SEQ ID NO: 275396 - DNA, 25 bp, Mus musculus
gagccgacaccaggggtgccggacc

SEQ ID NO: 275397 - DNA, 25 bp, Mus musculus
tgaaggagaatcaacagcacaggtg

SEQ ID NO: 275398 - DNA, 25 bp, Mus musculus
ccggcacctagtccgagatgccctc

SEQ ID NO: 275399 - DNA, 25 bp, Mus musculus
cgcacgctgcgtgacgttacagttc

SEQ ID NO: 275400 - DNA, 25 bp, Mus musculus
cgagatgccctcctccctcacccgg

SEQ ID NO: 275401 - DNA, 25 bp, Mus musculus
tgtagacttcaaggcggaggcgagc

SEQ ID NO: 275402 - DNA, 25 bp, Mus musculus
tgttagtggatgaggtgtagacttc

SEQ ID NO: 275403 - DNA, 25 bp, Mus musculus
agttcccgcccaccactctaagctg

SEQ ID NO: 275404 - DNA, 25 bp, Mus musculus
gcggcgaacagagccgcttccgctt

SEQ ID NO: 275405 - DNA, 25 bp, Mus musculus
tgcgtgacgttacagttcccgccca

SEQ ID NO: 275406 - DNA, 25 bp, Mus musculus
agctgtgtgagatgtggctgccacc

SEQ ID NO: 275407 - DNA, 25 bp, Mus musculus
ccgaagctgaaggagaatcaacagc

SEQ ID NO: 275408 - DNA, 25 bp, Mus musculus
cctccagccgcaaggcgataggaca

SEQ ID NO: 275409 - DNA, 25 bp, Mus musculus
tcgatccagaccacgaggagcgctg

SEQ ID NO: 275410 - DNA, 25 bp, Mus musculus
agtaacagcgcaggtgtggtctctc

SEQ ID NO: 275411 - DNA, 25 bp, Mus musculus
tcggtggcttccacgagcagtaaca

SEQ ID NO: 275412 - DNA, 25 bp, Mus musculus
tttcatctgtgacaaagacgcgcgc

SEQ ID NO: 275413 - DNA, 25 bp, Mus musculus
tggatcccgagctaccacgtgcagt

SEQ ID NO: 275414 - DNA, 25 bp, Mus musculus
catcggcgtctgatgcgcggaaagt

SEQ ID NO: 275415 - DNA, 25 bp, Mus musculus
cgcggaaagtgtatagcgtggcacc

SEQ ID NO: 275416 - DNA, 25 bp, Mus musculus
agaccggggcgttgtcattttcatc

SEQ ID NO: 275417 - DNA, 25 bp, Mus musculus
aggcggtatcgcacctcactgttgg

SEQ ID NO: 275418 - DNA, 25 bp, Mus musculus
tggcccagcctcgaagtccaaggga

SEQ ID NO: 275419 - DNA, 25 bp, Mus musculus
aagtccaagggacgcgccaagtaca

SEQ ID NO: 275420 - DNA, 25 bp, Mus musculus
ccaagtacaggcgaccggaggctga

SEQ ID NO: 275421 - DNA, 25 bp, Mus musculus
aaaagttggcgcgtgctcgttctcg

SEQ ID NO: 275422 - DNA, 25 bp, Mus musculus
tgtctgcgctcgctcgaccgtcggt

SEQ ID NO: 275423 - DNA, 25 bp, Mus musculus
gcgccgtcccttctccaggctacta

SEQ ID NO: 275424 - DNA, 25 bp, Mus musculus
tgcgctcgctcgaccgtcggtcggt

SEQ ID NO: 275425 - DNA, 25 bp, Mus musculus
tccaggctactaccgcgccagatcc

SEQ ID NO: 275426 - DNA, 25 bp, Mus musculus
tggctcgggctcacagtgccctcgg

SEQ ID NO: 275427 - DNA, 25 bp, Mus musculus
gctttgactggctcgggctcacagt

SEQ ID NO: 275428 - DNA, 25 bp, Mus musculus
atcgtccgctttgactggctcgggc

SEQ ID NO: 275429 - DNA, 25 bp, Mus musculus
gggccgcgcatcgtccgctttgact

SEQ ID NO: 275430 - DNA, 25 bp, Mus musculus
ctcgcccagtgttggggcgcagtcc

SEQ ID NO: 275431 - DNA, 25 bp, Mus musculus
ggtgcgggctccctcgcccagtgtt

SEQ ID NO: 275432 - DNA, 25 bp, Mus musculus
cactgacctcgatgcggtgcgggct

SEQ ID NO: 275433 - DNA, 25 bp, Mus musculus
acgggccggtcactgacctcgatgc

SEQ ID NO: 275434 - DNA, 25 bp, Mus musculus
cgccagatcctttcgtcccgtcccg

SEQ ID NO: 275435 - DNA, 25 bp, Mus musculus
ccaccccgcggaggatgcaagatgc

SEQ ID NO: 275436 - DNA, 25 bp, Mus musculus
ccggaaagggaaactccgagctgtg

SEQ ID NO: 275437 - DNA, 25 bp, Mus musculus
ctgccgggtttctcttgcactgcgt

SEQ ID NO: 275438 - DNA, 25 bp, Mus musculus
ggcccgacgtgttgacgtttctgga

SEQ ID NO: 275439 - DNA, 25 bp, Mus musculus
cgtgcgcatcagagcctgcctagct

SEQ ID NO: 275440 - DNA, 25 bp, Mus musculus
gctaccgcgtttgcgcgtgcgcatc

SEQ ID NO: 275441 - DNA, 25 bp, Mus musculus
tgcgcagtaactcggcgcgtggcta

SEQ ID NO: 275442 - DNA, 25 bp, Mus musculus
cacgtctcagaggacgcatgcgcag

SEQ ID NO: 275443 - DNA, 25 bp, Mus musculus
tagcggcagccagcgacaacctcat

SEQ ID NO: 275444 - DNA, 25 bp, Mus musculus
ccgcagcagatggatgcgggactcc

SEQ ID NO: 275445 - DNA, 25 bp, Mus musculus
cccgtgagcaagttccgcagcagat

SEQ ID NO: 275446 - DNA, 25 bp, Mus musculus
gcctcgatgcgttcgtggcgaacta

SEQ ID NO: 275447 - DNA, 25 bp, Mus musculus
cggcggtgaatagcttggctctcac

SEQ ID NO: 275448 - DNA, 25 bp, Mus musculus
gaattcgctaccgtggaaagttctc

SEQ ID NO: 275449 - DNA, 25 bp, Mus musculus
ggaaagttctcccagcgtggcccta

SEQ ID NO: 275450 - DNA, 25 bp, Mus musculus
cgaccgtccagggaagctcttcatc

SEQ ID NO: 275451 - DNA, 25 bp, Mus musculus
tcttcatcggcggtctcaacctcga

SEQ ID NO: 275452 - DNA, 25 bp, Mus musculus
cgaaaccgctttcggcaagtatggc

SEQ ID NO: 275453 - DNA, 25 bp, Mus musculus
tatggccgcatcatcgaggtgctcc

SEQ ID NO: 275454 - DNA, 25 bp, Mus musculus
tcctgatgaaggaccgggaaacctc

SEQ ID NO: 275455 - DNA, 25 bp, Mus musculus
ggcttcgccttcgtcaccttcgaga

SEQ ID NO: 275456 - DNA, 25 bp, Mus musculus
gccaaggccgcagcccgagacatga

SEQ ID NO: 275457 - DNA, 25 bp, Mus musculus
ccgagacatgaacggcaagtccctg

SEQ ID NO: 275458 - DNA, 25 bp, Mus musculus
caagtccctggatggtaaggccatc

SEQ ID NO: 275459 - DNA, 25 bp, Mus musculus
tggcccaagccaccaagccggtgtt

SEQ ID NO: 275460 - DNA, 25 bp, Mus musculus
ggagagctattcgagccgcgactac

SEQ ID NO: 275461 - DNA, 25 bp, Mus musculus
actatggccactcgagcgcgcgaga

SEQ ID NO: 275462 - DNA, 25 bp, Mus musculus
ctgctgccgacatggttgaagccga

SEQ ID NO: 275463 - DNA, 25 bp, Mus musculus
cctcgagaccgacgagaagggcctc

SEQ ID NO: 275464 - DNA, 25 bp, Mus musculus
ggaatcaggcgcttctcctgcagtg

SEQ ID NO: 275465 - DNA, 25 bp, Mus musculus
ttcgctccatacaaccgagaacgtg

SEQ ID NO: 275466 - DNA, 25 bp, Mus musculus
actcgagggccctgaaatggggact

SEQ ID NO: 275467 - DNA, 25 bp, Mus musculus
aagatttcatctaccacctgcggga

SEQ ID NO: 275468 - DNA, 25 bp, Mus musculus
ggagcacgacagctgccaagatttc

SEQ ID NO: 275469 - DNA, 25 bp, Mus musculus
gagaaagcccgagcgagcggctctc

SEQ ID NO: 275470 - DNA, 25 bp, Mus musculus
tgagcccaagtaggtctccacaacc

SEQ ID NO: 275471 - DNA, 25 bp, Mus musculus
agctcgtacttcctgatcctgggcg

SEQ ID NO: 275472 - DNA, 25 bp, Mus musculus
aagagcgtctagcacgcgcaccagc

SEQ ID NO: 275473 - DNA, 25 bp, Mus musculus
ctaggtttgcatctgggcggagaaa

SEQ ID NO: 275474 - DNA, 25 bp, Mus musculus
agccctgagggatgctaggtttgca

SEQ ID NO: 275475 - DNA, 25 bp, Mus musculus
ccgagaacgtgctttggacccacgc

SEQ ID NO: 275476 - DNA, 25 bp, Mus musculus
accacggcctgatgctggaacccgg

SEQ ID NO: 275477 - DNA, 25 bp, Mus musculus
gctctccgagagctgcatgcaaccg

SEQ ID NO: 275478 - DNA, 25 bp, Mus musculus
tgagacttccttctgggccgccgct

SEQ ID NO: 275479 - DNA, 25 bp, Mus musculus
tgatccaactttcctccgactttca

SEQ ID NO: 275480 - DNA, 25 bp, Mus musculus
cgccgctgccgacttaaactttgaa

SEQ ID NO: 275481 - DNA, 25 bp, Mus musculus
gctgtgccatcgctcctgagacttc

SEQ ID NO: 275482 - DNA, 25 bp, Mus musculus
cacggtgccctgctttgattggcca

SEQ ID NO: 275483 - DNA, 25 bp, Mus musculus
ccctgtgatgtcacggtgccctgct

SEQ ID NO: 275484 - DNA, 25 bp, Mus musculus
gtctgacagctcactccttcaatga

SEQ ID NO: 275485 - DNA, 25 bp, Mus musculus
gaaaaatagagctacccgcgctgtg

SEQ ID NO: 275486 - DNA, 25 bp, Mus musculus
ggatgcgtgccagtctgacagctca

SEQ ID NO: 275487 - DNA, 25 bp, Mus musculus
aactttccaggctggactgtgcaga

SEQ ID NO: 275488 - DNA, 25 bp, Mus musculus
actccttcaatgacaaagcgcctgc

SEQ ID NO: 275489 - DNA, 25 bp, Mus musculus
ccgcggtgaactgcggcgaaaagtc

SEQ ID NO: 275490 - DNA, 25 bp, Mus musculus
gaactgcggcgaaaagtcaactttc

SEQ ID NO: 275491 - DNA, 25 bp, Mus musculus
aaagtcaactttccaggctggactg

SEQ ID NO: 275492 - DNA, 25 bp, Mus musculus
tcacggtgtctggtatccggcaacg

SEQ ID NO: 275493 - DNA, 25 bp, Mus musculus
caggaacacggctgacaacccagta

SEQ ID NO: 275494 - DNA, 25 bp, Mus musculus
cacctcgtcgtagtcaagcatagag

SEQ ID NO: 275495 - DNA, 25 bp, Mus musculus
tcaagcatagagtcggcagcccacg

SEQ ID NO: 275496 - DNA, 25 bp, Mus musculus
cggagcaccagtcactcgtcgaaga

SEQ ID NO: 275497 - DNA, 25 bp, Mus musculus
ggtaaagtccttcccagtcgagagc

SEQ ID NO: 275498 - DNA, 25 bp, Mus musculus
agaagctcgtgagttcctcccgccg

SEQ ID NO: 275499 - DNA, 25 bp, Mus musculus
ggagtcccttgcctactactctgag

SEQ ID NO: 275500 - DNA, 25 bp, Mus musculus
agacaccgaggacgtgaggccatga

SEQ ID NO: 275501 - DNA, 25 bp, Mus musculus
cggagtctggcctagactgcaaggc

SEQ ID NO: 275502 - DNA, 25 bp, Mus musculus
atggagcctggcttcagaactgcgc

SEQ ID NO: 275503 - DNA, 25 bp, Mus musculus
ctactctgagctgttcgctgaggaa

SEQ ID NO: 275504 - DNA, 25 bp, Mus musculus
ggagacgttttccacacggagaagc

SEQ ID NO: 275505 - DNA, 25 bp, Mus musculus
ctgaggaacgccctgaggtaaagtc

SEQ ID NO: 275506 - DNA, 25 bp, Mus musculus
ttaccgacgccggaaaagatggagc

SEQ ID NO: 275507 - DNA, 25 bp, Mus musculus
gtgacctggtttgtcccgaatcgga

SEQ ID NO: 275508 - DNA, 25 bp, Mus musculus
tccagccgacaatcagtgggtgacc

SEQ ID NO: 275509 - DNA, 25 bp, Mus musculus
gcgctagaacccaggaaaggccgta

SEQ ID NO: 275510 - DNA, 25 bp, Mus musculus
agatcctcggactaccacttcgcgg

SEQ ID NO: 275511 - DNA, 25 bp, Mus musculus
tatccagagtcagagctcaggcgcg

SEQ ID NO: 275512 - DNA, 25 bp, Mus musculus
gtacccatggcctcggatatccaga

SEQ ID NO: 275513 - DNA, 25 bp, Mus musculus
ccagagctaccagcatgaattcacg

SEQ ID NO: 275514 - DNA, 25 bp, Mus musculus
ctaacgcgcgtgctcaaagaagatg

SEQ ID NO: 275515 - DNA, 25 bp, Mus musculus
gaagatgagcttctcccggtacctc

SEQ ID NO: 275516 - DNA, 25 bp, Mus musculus
cagccgctggagctacgacaggtaa

SEQ ID NO: 275517 - DNA, 25 bp, Mus musculus
taagcagtctagttgccgcagccgc

SEQ ID NO: 275518 - DNA, 25 bp, Mus musculus
ctggcaagacttgcacctggaagtc

SEQ ID NO: 275519 - DNA, 25 bp, Mus musculus
cgggcatcctaacacctgagggaca

SEQ ID NO: 275520 - DNA, 25 bp, Mus musculus
tggattccttacaggtacgcgggcc

SEQ ID NO: 275521 - DNA, 25 bp, Mus musculus
catcctccgagtcgggatgcagcgt

SEQ ID NO: 275522 - DNA, 25 bp, Mus musculus
gccagggcacccaccatcctccgag

SEQ ID NO: 275523 - DNA, 25 bp, Mus musculus
tccagggcatgttcggacccccatt

SEQ ID NO: 275524 - DNA, 25 bp, Mus musculus
tccgactggattccttacaggtacg

SEQ ID NO: 275525 - DNA, 25 bp, Mus musculus
agccgcattccgactggattcctta

SEQ ID NO: 275526 - DNA, 25 bp, Mus musculus
acatgacttccaagccgcattccga

SEQ ID NO: 275527 - DNA, 25 bp, Mus musculus
cccgggagacatgacttccaagccg

SEQ ID NO: 275528 - DNA, 25 bp, Mus musculus
cccgagagttgagcagggtccccgc

SEQ ID NO: 275529 - DNA, 25 bp, Mus musculus
ggtgcggactgcctctcccgcctca

SEQ ID NO: 275530 - DNA, 25 bp, Mus musculus
cagacaaccgttctgggagcccgcg

SEQ ID NO: 275531 - DNA, 25 bp, Mus musculus
accgcgcacagacaaccgttctggg

SEQ ID NO: 275532 - DNA, 25 bp, Mus musculus
cgcctctcccgagcgctgcaccgcg

SEQ ID NO: 275533 - DNA, 25 bp, Mus musculus
cccattccaacgctgagggcgggga

SEQ ID NO: 275534 - DNA, 25 bp, Mus musculus
ggaaccggaaccgcagcgcgcaatc

SEQ ID NO: 275535 - DNA, 25 bp, Mus musculus
cgacacgcaagtcactgaggggaag

SEQ ID NO: 275536 - DNA, 25 bp, Mus musculus
aggctgcccagtcggcgctcacctt

SEQ ID NO: 275537 - DNA, 25 bp, Mus musculus
tcgcttcccgcgagacaagaaggcc

SEQ ID NO: 275538 - DNA, 25 bp, Mus musculus
cttcccgcgagacaagaaggccttg

SEQ ID NO: 275539 - DNA, 25 bp, Mus musculus
caagaaggccttgggcagcagcagc

SEQ ID NO: 275540 - DNA, 25 bp, Mus musculus
gcgccactctctgcaccgtggagta

SEQ ID NO: 275541 - DNA, 25 bp, Mus musculus
gagcgccctccactctaccaaagtg

SEQ ID NO: 275542 - DNA, 25 bp, Mus musculus
tacgccatggctgcgtaccgcagga

SEQ ID NO: 275543 - DNA, 25 bp, Mus musculus
cgcgcaatccggctcacactcgacc

SEQ ID NO: 275544 - DNA, 25 bp, Mus musculus
actcgaccggcgagctgcacggacg

SEQ ID NO: 275545 - DNA, 25 bp, Mus musculus
tctctgcaccgtggagtacgccatg

SEQ ID NO: 275546 - DNA, 25 bp, Mus musculus
ggacaagatgagagcgccctccact

SEQ ID NO: 275547 - DNA, 25 bp, Mus musculus
gctgcgtaccgcaggacccaggagt

SEQ ID NO: 275548 - DNA, 25 bp, Mus musculus
cgactgtccggagaccgagagacca

SEQ ID NO: 275549 - DNA, 25 bp, Mus musculus
cgggctctaattacccgcttgtccg

SEQ ID NO: 275550 - DNA, 25 bp, Mus musculus
ggctggctccacaacctggcgtggc

SEQ ID NO: 275551 - DNA, 25 bp, Mus musculus
aaagctcagcgccaagcgccagggc

SEQ ID NO: 275552 - DNA, 25 bp, Mus musculus
tgctgatttgctgggcactcagtgc

SEQ ID NO: 275553 - DNA, 25 bp, Mus musculus
ggcactcagtgcctctcgggttacg

SEQ ID NO: 275554 - DNA, 25 bp, Mus musculus
gcagcaagcgggctctaattacccg

SEQ ID NO: 275555 - DNA, 25 bp, Mus musculus
tgagcaaggagcagccgcagagacc

SEQ ID NO: 275556 - DNA, 25 bp, Mus musculus
gtcctccttgtccagcaccatcatc

SEQ ID NO: 275557 - DNA, 25 bp, Mus musculus
tctatccagttcctttctccctgaa

SEQ ID NO: 275558 - DNA, 25 bp, Mus musculus
aagctctctatccagttcctttctc

SEQ ID NO: 275559 - DNA, 25 bp, Mus musculus
cagccgcagagaccaaaagctcagc

SEQ ID NO: 275560 - DNA, 25 bp, Mus musculus
gcaccatcatctcgggcgctccgtg

SEQ ID NO: 275561 - DNA, 25 bp, Mus musculus
gaccagagggcacactgaacctcca

SEQ ID NO: 275562 - DNA, 25 bp, Mus musculus
cgtccagcttccgagcttccgggaa

SEQ ID NO: 275563 - DNA, 25 bp, Mus musculus
ggagacttcctcatcccggcgagga

SEQ ID NO: 275564 - DNA, 25 bp, Mus musculus
ctgagcaactgggacccggcccgag

SEQ ID NO: 275565 - DNA, 25 bp, Mus musculus
acagggcacacgtccagcttccgag

SEQ ID NO: 275566 - DNA, 25 bp, Mus musculus
agcctgaacccgagctagggccgga

SEQ ID NO: 275567 - DNA, 25 bp, Mus musculus
cgggaagccgccaacaggctccaag

SEQ ID NO: 275568 - DNA, 25 bp, Mus musculus
aacaggctccaagcagcggtcgaga

SEQ ID NO: 275569 - DNA, 25 bp, Mus musculus
agaccggtgcctgggcctctgtcac

SEQ ID NO: 275570 - DNA, 25 bp, Mus musculus
tctgtcaccgggatggaggtagcct

SEQ ID NO: 275571 - DNA, 25 bp, Mus musculus
cgctgttcccaagtgtccctgagca

SEQ ID NO: 275572 - DNA, 25 bp, Mus musculus
gtcctcttggtccaaaaccatagtc

SEQ ID NO: 275573 - DNA, 25 bp, Mus musculus
agggactcgcggctcggactgtcac

SEQ ID NO: 275574 - DNA, 25 bp, Mus musculus
tcggactgtcacctacggggcgact

SEQ ID NO: 275575 - DNA, 25 bp, Mus musculus
ctcatcccggcgaggaacacggggc

SEQ ID NO: 275576 - DNA, 25 bp, Mus musculus
ctgaacttttctaaggcccgggatg

SEQ ID NO: 275577 - DNA, 25 bp, Mus musculus
caccgggacaaagcgcgacagcaaa

SEQ ID NO: 275578 - DNA, 25 bp, Mus musculus
cctgcctcgagcaccgtgtcaagta

SEQ ID NO: 275579 - DNA, 25 bp, Mus musculus
cagcactgtcgctatcgtgacggga

SEQ ID NO: 275580 - DNA, 25 bp, Mus musculus
cgtgacgggatgttccgacttattc

SEQ ID NO: 275581 - DNA, 25 bp, Mus musculus
ttattctcagtcatggcccaggcgg

SEQ ID NO: 275582 - DNA, 25 bp, Mus musculus
cggttgtcatagcaacggggctcga

SEQ ID NO: 275583 - DNA, 25 bp, Mus musculus
gcccgtttgcctgcggttgtcatag

SEQ ID NO: 275584 - DNA, 25 bp, Mus musculus
ggggctcgaaggctgcctaaccctc

SEQ ID NO: 275585 - DNA, 25 bp, Mus musculus
ctgacagaggcacacacttggaccc

SEQ ID NO: 275586 - DNA, 25 bp, Mus musculus
cgaacgccacacctaaagaagctga

SEQ ID NO: 275587 - DNA, 25 bp, Mus musculus
gttgcgaggccactcaccacaacgg

SEQ ID NO: 275588 - DNA, 25 bp, Mus musculus
ttttccctcagggtagggcgagtca

SEQ ID NO: 275589 - DNA, 25 bp, Mus musculus
gcctcatacgatgtgaacgtggtca

SEQ ID NO: 275590 - DNA, 25 bp, Mus musculus
ccgcccatccacacggaaaggaaga

SEQ ID NO: 275591 - DNA, 25 bp, Mus musculus
gaagtcttgccgatgctctgagcca

SEQ ID NO: 275592 - DNA, 25 bp, Mus musculus
cgcatcggtaagtgtgcgcctcctc

SEQ ID NO: 275593 - DNA, 25 bp, Mus musculus
gaacagtgcactccgacgatgaccg

SEQ ID NO: 275594 - DNA, 25 bp, Mus musculus
cctcctggccggaaatgaagcattg

SEQ ID NO: 275595 - DNA, 25 bp, Mus musculus
tgctacctcgcgagacttcgtgagc

SEQ ID NO: 275596 - DNA, 25 bp, Mus musculus
tgccaccgccatggtaggtcttctc

SEQ ID NO: 275597 - DNA, 25 bp, Mus musculus
cttgctatggtcctagtgggtctcc

SEQ ID NO: 275598 - DNA, 25 bp, Mus musculus
gcgtgttccgaccagagctgggatc

SEQ ID NO: 275599 - DNA, 25 bp, Mus musculus
ccggtgctccagaaggcaagtcctc

SEQ ID NO: 275600 - DNA, 25 bp, Mus musculus
gcaagtcctcgtgtgcaggcctgat

SEQ ID NO: 275601 - DNA, 25 bp, Mus musculus
gcaggcctaaccactttgctgtttt

SEQ ID NO: 275602 - DNA, 25 bp, Mus musculus
cagactgaggaagacccggaaactc

SEQ ID NO: 275603 - DNA, 25 bp, Mus musculus
tgctgcccggagacaaaaaccaacc

SEQ ID NO: 275604 - DNA, 25 bp, Mus musculus
cccgcttcgcgtctgaagctgatta

SEQ ID NO: 275605 - DNA, 25 bp, Mus musculus
acatggaatactgtctggcggccgc

SEQ ID NO: 275606 - DNA, 25 bp, Mus musculus
cctgaatacggtccgcatgcaccta

SEQ ID NO: 275607 - DNA, 25 bp, Mus musculus
gcacctactctcacaaatgttttta

SEQ ID NO: 275608 - DNA, 25 bp, Mus musculus
ttttagcgcaacgagtcacgggatc

SEQ ID NO: 275609 - DNA, 25 bp, Mus musculus
tcacgggatccacactgacctgtcg

SEQ ID NO: 275610 - DNA, 25 bp, Mus musculus
cctgtcgcggcaagaaagtcctcga

SEQ ID NO: 275611 - DNA, 25 bp, Mus musculus
aagtcctcgaacgacaacaagcgcc

SEQ ID NO: 275612 - DNA, 25 bp, Mus musculus
agctgattaaggctgggcccacgtg

SEQ ID NO: 275613 - DNA, 25 bp, Mus musculus
ttagcttggcaactggcgcgaaaga

SEQ ID NO: 275614 - DNA, 25 bp, Mus musculus
cccacttggattgcgcgatgcaggc

SEQ ID NO: 275615 - DNA, 25 bp, Mus musculus
ggcgcgcagcagttagcttggcaac

SEQ ID NO: 275616 - DNA, 25 bp, Mus musculus
gtctgtgtatgtgtccagggagaca

SEQ ID NO: 275617 - DNA, 25 bp, Mus musculus
gatccgggcctagttgacttgtctg

SEQ ID NO: 275618 - DNA, 25 bp, Mus musculus
acctgaccagaagagcccgagcgtc

SEQ ID NO: 275619 - DNA, 25 bp, Mus musculus
aggtttccgcaccataggctcgcca

SEQ ID NO: 275620 - DNA, 25 bp, Mus musculus
agcccacccggcgatggaggctcga

SEQ ID NO: 275621 - DNA, 25 bp, Mus musculus
caccgacagcgccaggcaggacatg

SEQ ID NO: 275622 - DNA, 25 bp, Mus musculus
taggctcgccatcgcgggagccagc

SEQ ID NO: 275623 - DNA, 25 bp, Mus musculus
cgccgggtcagctgcgagaaagcct

SEQ ID NO: 275624 - DNA, 25 bp, Mus musculus
ggttccgggtgcacaaggcccgcca

SEQ ID NO: 275625 - DNA, 25 bp, Mus musculus
ggagcaggccatgcggatctagtcc

SEQ ID NO: 275626 - DNA, 25 bp, Mus musculus
atctagtcccgcaggccgggtgaac

SEQ ID NO: 275627 - DNA, 25 bp, Mus musculus
ttcagtacgaacctgcggtccgtgc

SEQ ID NO: 275628 - DNA, 25 bp, Mus musculus
cgagcgtccttagatcggaagccca

SEQ ID NO: 275629 - DNA, 25 bp, Mus musculus
tccgcaccggggcttcagtacgaac

SEQ ID NO: 275630 - DNA, 25 bp, Mus musculus
gggtgctgttcaggagacctgacca

SEQ ID NO: 275631 - DNA, 25 bp, Mus musculus
gcgcctgtcagctgcgcgagcagca

SEQ ID NO: 275632 - DNA, 25 bp, Mus musculus
tttactccatcacccatcctgagga

SEQ ID NO: 275633 - DNA, 25 bp, Mus musculus
tgtccttggacgagcccagcttttt

SEQ ID NO: 275634 - DNA, 25 bp, Mus musculus
tgtggatgaactgcaccgcctgctt

SEQ ID NO: 275635 - DNA, 25 bp, Mus musculus
gggacgccgcttcccgcatgtctgt

SEQ ID NO: 275636 - DNA, 25 bp, Mus musculus
ccctcggtgaggagtcctgagtaaa

SEQ ID NO: 275637 - DNA, 25 bp, Mus musculus
cctgagtaaaacatcgctgaaacgc

SEQ ID NO: 275638 - DNA, 25 bp, Mus musculus
gccctgcacgcattgcatagaatgg

SEQ ID NO: 275639 - DNA, 25 bp, Mus musculus
ttcaacctcgagctcctggacagcg

SEQ ID NO: 275640 - DNA, 25 bp, Mus musculus
gtggggtctatcagcgtcaaccacc

SEQ ID NO: 275641 - DNA, 25 bp, Mus musculus
cggagcagcctacggccgacagact

SEQ ID NO: 275642 - DNA, 25 bp, Mus musculus
gcccagctttttgaggccgtccagg

SEQ ID NO: 275643 - DNA, 25 bp, Mus musculus
tagcggaaccgcttcgcccaactgt

SEQ ID NO: 275644 - DNA, 25 bp, Mus musculus
agtcggctccttcgggctctcagct

SEQ ID NO: 275645 - DNA, 25 bp, Mus musculus
ccgcgccttttatatccgagcgtga

SEQ ID NO: 275646 - DNA, 25 bp, Mus musculus
gttaatcaagtctgcgctcccaaga

SEQ ID NO: 275647 - DNA, 25 bp, Mus musculus
atcttcctaggtggctgcgtgcaaa

SEQ ID NO: 275648 - DNA, 25 bp, Mus musculus
aaaggattcagcgattgcggcgcgc

SEQ ID NO: 275649 - DNA, 25 bp, Mus musculus
tcaggaaccaggcaacggtgctcgg

SEQ ID NO: 275650 - DNA, 25 bp, Mus musculus
cagcgtgggaactcacttatgaacc

SEQ ID NO: 275651 - DNA, 25 bp, Mus musculus
gggaagccgagtcctctggaccaca

SEQ ID NO: 275652 - DNA, 25 bp, Mus musculus
gtgcagctaggagctccggctttct

SEQ ID NO: 275653 - DNA, 25 bp, Mus musculus
agcaggagttcgttgctccacaatc

SEQ ID NO: 275654 - DNA, 25 bp, Mus musculus
ggcggaccggtcagttaatcaagtc

SEQ ID NO: 275655 - DNA, 25 bp, Mus musculus
ctcttcacacacaccagcgtgggaa

SEQ ID NO: 275656 - DNA, 25 bp, Mus musculus
cgccgtgggtgctgcaaaactccca

SEQ ID NO: 275657 - DNA, 25 bp, Mus musculus
taggcagcgaaaggccactgcactc

SEQ ID NO: 275658 - DNA, 25 bp, Mus musculus
atcccagcctggattatgagcaggc

SEQ ID NO: 275659 - DNA, 25 bp, Mus musculus
tatgaaccttagcatggccgtagtc

SEQ ID NO: 275660 - DNA, 25 bp, Mus musculus
cggcgggatgtcttgctccttaaaa

SEQ ID NO: 275661 - DNA, 25 bp, Mus musculus
gcatgggtccactactggttccagg

SEQ ID NO: 275662 - DNA, 25 bp, Mus musculus
acgcgcacgcgactaacggttaggc

SEQ ID NO: 275663 - DNA, 25 bp, Mus musculus
tgctccttaaaacacccatgggcgg

SEQ ID NO: 275664 - DNA, 25 bp, Mus musculus
ccgcaccgtttgttgaaaggccctg

SEQ ID NO: 275665 - DNA, 25 bp, Mus musculus
aacgttacgtctgctcctcggtaga

SEQ ID NO: 275666 - DNA, 25 bp, Mus musculus
cgcacttttatagctactcgcaggc

SEQ ID NO: 275667 - DNA, 25 bp, Mus musculus
ctgggcggtcaacgctcttttctct

SEQ ID NO: 275668 - DNA, 25 bp, Mus musculus
gtagcagaagttcgaacccagtttg

SEQ ID NO: 275669 - DNA, 25 bp, Mus musculus
cgctcgttaagacgcgcatgggtcc

SEQ ID NO: 275670 - DNA, 25 bp, Mus musculus
acccagtttgtgaggagtgctatca

SEQ ID NO: 275671 - DNA, 25 bp, Mus musculus
aaaagcttctacgtggctcagcgta

SEQ ID NO: 275672 - DNA, 25 bp, Mus musculus
tggccgctgattggaccgtttgaat

SEQ ID NO: 275673 - DNA, 25 bp, Mus musculus
ccgtttgaatgagacgccgccacga

SEQ ID NO: 275674 - DNA, 25 bp, Mus musculus
cccgggcaccaacccacactgcttc

SEQ ID NO: 275675 - DNA, 25 bp, Mus musculus
tgatgcccgttatcctccaagatgc

SEQ ID NO: 275676 - DNA, 25 bp, Mus musculus
atccgccaggcactgatgcccgtta

SEQ ID NO: 275677 - DNA, 25 bp, Mus musculus
tgggagacagccatccgccaggcac

SEQ ID NO: 275678 - DNA, 25 bp, Mus musculus
gccaagtggacagggaacagaggcc

SEQ ID NO: 275679 - DNA, 25 bp, Mus musculus
tgtcacctactttgtgggcgaaacc

SEQ ID NO: 275680 - DNA, 25 bp, Mus musculus
cggccaatgtcacctactttgtggg

SEQ ID NO: 275681 - DNA, 25 bp, Mus musculus
atcacggccaatgtcacctactttg

SEQ ID NO: 275682 - DNA, 25 bp, Mus musculus
ttcgagatcatcacggccaatgtca

SEQ ID NO: 275683 - DNA, 25 bp, Mus musculus
cggtggaaccggctcagaacttcag

SEQ ID NO: 275684 - DNA, 25 bp, Mus musculus
ccacactgcttcgagatcatcacgg

SEQ ID NO: 275685 - DNA, 25 bp, Mus musculus
ttatcctccaagatgcgcccagtgc

SEQ ID NO: 275686 - DNA, 25 bp, Mus musculus
accggctcagaacttcagcctcgta

SEQ ID NO: 275687 - DNA, 25 bp, Mus musculus
tgcttcgagatcatcacggccaatg

SEQ ID NO: 275688 - DNA, 25 bp, Mus musculus
aaggggactcaggagtccctgtcct

SEQ ID NO: 275689 - DNA, 25 bp, Mus musculus
taccagggcgggaaaggtcaacagc

SEQ ID NO: 275690 - DNA, 25 bp, Mus musculus
ttttcacacggtcttcagtgccgcc

SEQ ID NO: 275691 - DNA, 25 bp, Mus musculus
cggcctcattttcacacggtcttca

SEQ ID NO: 275692 - DNA, 25 bp, Mus musculus
cagcgcagagccgcgtagagcctgc

SEQ ID NO: 275693 - DNA, 25 bp, Mus musculus
gcacactcaccctcggacggcccgt

SEQ ID NO: 275694 - DNA, 25 bp, Mus musculus
gggaaaggtcaacagcccttcgatg

SEQ ID NO: 275695 - DNA, 25 bp, Mus musculus
actaggcaaggggactcaggagtcc

SEQ ID NO: 275696 - DNA, 25 bp, Mus musculus
atcgagagactaggcaaggggactc

SEQ ID NO: 275697 - DNA, 25 bp, Mus musculus
ctccggatcgagagactaggcaagg

SEQ ID NO: 275698 - DNA, 25 bp, Mus musculus
gagggctctccggatcgagagacta

SEQ ID NO: 275699 - DNA, 25 bp, Mus musculus
acagcccttcgatggcagggacaga

SEQ ID NO: 275700 - DNA, 25 bp, Mus musculus
aggtcaacagcccttcgatggcagg

SEQ ID NO: 275701 - DNA, 25 bp, Mus musculus
tcccgaggccgaccgcaacccgcga

SEQ ID NO: 275702 - DNA, 25 bp, Mus musculus
ggatgacgtgatgctctttgggccc

SEQ ID NO: 275703 - DNA, 25 bp, Mus musculus
ctgctcgcccgaccctcactgggct

SEQ ID NO: 275704 - DNA, 25 bp, Mus musculus
gcgcactcacccgacagctcgtccg

SEQ ID NO: 275705 - DNA, 25 bp, Mus musculus
ccagcccgcagatgacaaaatagtc

SEQ ID NO: 275706 - DNA, 25 bp, Mus musculus
aaaatagtcggcgaagcgactgggc

SEQ ID NO: 275707 - DNA, 25 bp, Mus musculus
atcctggacgctgtcctctgcaccg

SEQ ID NO: 275708 - DNA, 25 bp, Mus musculus
ccgcggcctgagcaagcctgaggaa

SEQ ID NO: 275709 - DNA, 25 bp, Mus musculus
gcgcaaaggatgacgtgatgctctt

SEQ ID NO: 275710 - DNA, 25 bp, Mus musculus
cagagcagccaccacagagtggcca

SEQ ID NO: 275711 - DNA, 25 bp, Mus musculus
acagagtggccagcggtcagctgct

SEQ ID NO: 275712 - DNA, 25 bp, Mus musculus
gtcagctgctgggatcccgcgactg

SEQ ID NO: 275713 - DNA, 25 bp, Mus musculus
ccctttagagaaatcggatgcggtg

SEQ ID NO: 275714 - DNA, 25 bp, Mus musculus
tgcgacaccctttagagaaatcgga

SEQ ID NO: 275715 - DNA, 25 bp, Mus musculus
acgcgactgcgacaccctttagaga

SEQ ID NO: 275716 - DNA, 25 bp, Mus musculus
gcctaaggtccgacttctccgcgta

SEQ ID NO: 275717 - DNA, 25 bp, Mus musculus
cgcgactagttggtgttggagattc

SEQ ID NO: 275718 - DNA, 25 bp, Mus musculus
cccagtaaccgcgagacaagtcagg

SEQ ID NO: 275719 - DNA, 25 bp, Mus musculus
cgcgtagctttcgtcacacggaagt

SEQ ID NO: 275720 - DNA, 25 bp, Mus musculus
tcgcattggcaagtcatgggtctgc

SEQ ID NO: 275721 - DNA, 25 bp, Mus musculus
tagggcgcatgagcaatatcgcatt

SEQ ID NO: 275722 - DNA, 25 bp, Mus musculus
cgaggcacaactacttccggcacga

SEQ ID NO: 275723 - DNA, 25 bp, Mus musculus
tcggcggagccttccagagatatca

SEQ ID NO: 275724 - DNA, 25 bp, Mus musculus
gcaggtccactcaccgttcagatga

SEQ ID NO: 275725 - DNA, 25 bp, Mus musculus
tcagatgatctttgctgccaggcgc

SEQ ID NO: 275726 - DNA, 25 bp, Mus musculus
caacatttcggtgggcgatcgatca

SEQ ID NO: 275727 - DNA, 25 bp, Mus musculus
agctttctttcaacacccaggcgcg

SEQ ID NO: 275728 - DNA, 25 bp, Mus musculus
tcgaaaacttgacactcggcggagc

SEQ ID NO: 275729 - DNA, 25 bp, Mus musculus
cagactctttgttccgccaaccgga

SEQ ID NO: 275730 - DNA, 25 bp, Mus musculus
ttctctttcctttcgcgccggttgc

SEQ ID NO: 275731 - DNA, 25 bp, Mus musculus
cgtgtccgcgtttggggactacatt

SEQ ID NO: 275732 - DNA, 25 bp, Mus musculus
tccgccggagacttgacaggaagtg

SEQ ID NO: 275733 - DNA, 25 bp, Mus musculus
cgagaaggttctatccggggccttg

SEQ ID NO: 275734 - DNA, 25 bp, Mus musculus
cagtgagtggcgctatttctgcctc

SEQ ID NO: 275735 - DNA, 25 bp, Mus musculus
tttctgcctcagtagcaccggtgtc

SEQ ID NO: 275736 - DNA, 25 bp, Mus musculus
tggatcccaacaccatcatcgaggc

SEQ ID NO: 275737 - DNA, 25 bp, Mus musculus
gctgagcgccagctcaatgaagtaa

SEQ ID NO: 275738 - DNA, 25 bp, Mus musculus
tcaatgaagtaaggacggccggcta

SEQ ID NO: 275739 - DNA, 25 bp, Mus musculus
tccgacgagcccatttggagaggtt

SEQ ID NO: 275740 - DNA, 25 bp, Mus musculus
acggtctggacacatggccggctcc

SEQ ID NO: 275741 - DNA, 25 bp, Mus musculus
tggctgtctcccagtttgctctcgg

SEQ ID NO: 275742 - DNA, 25 bp, Mus musculus
tgtagagatgtgtcccagaccagtc

SEQ ID NO: 275743 - DNA, 25 bp, Mus musculus
ccacgccgaggcgagaaggttctat

SEQ ID NO: 275744 - DNA, 25 bp, Mus musculus
tcagctgcgctaggcacagagaccc

SEQ ID NO: 275745 - DNA, 25 bp, Mus musculus
ccctgtagggaaaatggcgcccatc

SEQ ID NO: 275746 - DNA, 25 bp, Mus musculus
ttgctacaaaatggcgcctcccgct

SEQ ID NO: 275747 - DNA, 25 bp, Mus musculus
ataattcactcgtccgtggggcgga

SEQ ID NO: 275748 - DNA, 25 bp, Mus musculus
gagcagtttcgccatccagtcaggc

SEQ ID NO: 275749 - DNA, 25 bp, Mus musculus
cgggagctccatgggttccacatta

SEQ ID NO: 275750 - DNA, 25 bp, Mus musculus
agctttgattccgtacctggcgcca

SEQ ID NO: 275751 - DNA, 25 bp, Mus musculus
ttcctgcccgtcagctaaatctaga

SEQ ID NO: 275752 - DNA, 25 bp, Mus musculus
tccagtgagtgacgtaaagacagcc

SEQ ID NO: 275753 - DNA, 25 bp, Mus musculus
actcagaattgctatgcgggttgcg

SEQ ID NO: 275754 - DNA, 25 bp, Mus musculus
agtgtgcattattctccgcccggcc

SEQ ID NO: 275755 - DNA, 25 bp, Mus musculus
agctgcttatgctggtcctcaggcc

SEQ ID NO: 275756 - DNA, 25 bp, Mus musculus
gcccgggcagaatcggagtttatta

SEQ ID NO: 275757 - DNA, 25 bp, Mus musculus
cagtcaggcacagaagctttgattc

SEQ ID NO: 275758 - DNA, 25 bp, Mus musculus
gcgtaggagccgcttacagtctgcg

SEQ ID NO: 275759 - DNA, 25 bp, Mus musculus
tgagcttcctgagccgacagcagcc

SEQ ID NO: 275760 - DNA, 25 bp, Mus musculus
cagtctgcggcagaagctcatcttc

SEQ ID NO: 275761 - DNA, 25 bp, Mus musculus
gaagctcatcttctcgccgggcagc

SEQ ID NO: 275762 - DNA, 25 bp, Mus musculus
tcggccttccaggaaccggattcgc

SEQ ID NO: 275763 - DNA, 25 bp, Mus musculus
ttcgaccgcctactttctgagcagc

SEQ ID NO: 275764 - DNA, 25 bp, Mus musculus
caggctccggtcctctaaacataga

SEQ ID NO: 275765 - DNA, 25 bp, Mus musculus
aggcccactcattggcccgggatgc

SEQ ID NO: 275766 - DNA, 25 bp, Mus musculus
cggagtcagcgagttcccgccaaaa

SEQ ID NO: 275767 - DNA, 25 bp, Mus musculus
tcccgccaaaatcgcgtagctggtt

SEQ ID NO: 275768 - DNA, 25 bp, Mus musculus
aacttgcggacgaacttgcggagcc

SEQ ID NO: 275769 - DNA, 25 bp, Mus musculus
tttcgccagcactggaccggccagt

SEQ ID NO: 275770 - DNA, 25 bp, Mus musculus
ctgcagccgggaaatgagcttcctg

SEQ ID NO: 275771 - DNA, 25 bp, Mus musculus
aacatagactctgggtggggttctg

SEQ ID NO: 275772 - DNA, 25 bp, Mus musculus
aggggcttgaaagacgaactgctca

SEQ ID NO: 275773 - DNA, 25 bp, Mus musculus
tccgggacgctgagcagagcctccc

SEQ ID NO: 275774 - DNA, 25 bp, Mus musculus
gctcttcctgtagggcacgggaccc

SEQ ID NO: 275775 - DNA, 25 bp, Mus musculus
ctgccggcgctcttcctgtagggca

SEQ ID NO: 275776 - DNA, 25 bp, Mus musculus
tccaagtcgcaactcaaggtgagcc

SEQ ID NO: 275777 - DNA, 25 bp, Mus musculus
aaggtctccaagtcgcaactcaagg

SEQ ID NO: 275778 - DNA, 25 bp, Mus musculus
aaagccatttggcacgccttcaccg

SEQ ID NO: 275779 - DNA, 25 bp, Mus musculus
gccatgaggggcttgaaagacgaac

SEQ ID NO: 275780 - DNA, 25 bp, Mus musculus
ctgaccaggtctgttagggcagcgc

SEQ ID NO: 275781 - DNA, 25 bp, Mus musculus
ctgagttgccgactgggctgaccag

SEQ ID NO: 275782 - DNA, 25 bp, Mus musculus
cgagtcttctgtggggatcctgcag

SEQ ID NO: 275783 - DNA, 25 bp, Mus musculus
agacgaactgctcaaagccatttgg

SEQ ID NO: 275784 - DNA, 25 bp, Mus musculus
ggaccgcagcggcaaggtctccaag

SEQ ID NO: 275785 - DNA, 25 bp, Mus musculus
gctcgacctggaccgcagcggcaag

SEQ ID NO: 275786 - DNA, 25 bp, Mus musculus
caactccacaggcacgagggcgcgg

SEQ ID NO: 275787 - DNA, 25 bp, Mus musculus
gcgcaggactctcggcacttccttt

SEQ ID NO: 275788 - DNA, 25 bp, Mus musculus
cggcacttcctttccgggaggactg

SEQ ID NO: 275789 - DNA, 25 bp, Mus musculus
cccagcgtcactcctattcaggatg

SEQ ID NO: 275790 - DNA, 25 bp, Mus musculus
atccctaggagcctcgtacagtgtg

SEQ ID NO: 275791 - DNA, 25 bp, Mus musculus
ccttacctggcttctcgtggtcgta

SEQ ID NO: 275792 - DNA, 25 bp, Mus musculus
ggtcgtagcctaccacaatgaagta

SEQ ID NO: 275793 - DNA, 25 bp, Mus musculus
ccacaatgaagtagtcggccagccg

SEQ ID NO: 275794 - DNA, 25 bp, Mus musculus
ccgggcgagctcagcattttccctt

SEQ ID NO: 275795 - DNA, 25 bp, Mus musculus
gcattttcccttcggcggctgtagc

SEQ ID NO: 275796 - DNA, 25 bp, Mus musculus
tagcagcggcgcttcagccatgttt

SEQ ID NO: 275797 - DNA, 25 bp, Mus musculus
ccatgtttgacaaccgaggcgctca

SEQ ID NO: 275798 - DNA, 25 bp, Mus musculus
cccgaaagggctcgacgacccagtg

SEQ ID NO: 275799 - DNA, 25 bp, Mus musculus
ttcaggatgcaggacacagtgtatc

SEQ ID NO: 275800 - DNA, 25 bp, Mus musculus
gcgcaaggaggtgtgcatcgcatac

SEQ ID NO: 275801 - DNA, 25 bp, Mus musculus
tcctgccggtactgttaggccgggc

SEQ ID NO: 275802 - DNA, 25 bp, Mus musculus
ggtgcccttcctgccggtactgtta

SEQ ID NO: 275803 - DNA, 25 bp, Mus musculus
tgaggtcagcggtgcccttcctgcc

SEQ ID NO: 275804 - DNA, 25 bp, Mus musculus
ccctgattctgcacccgcctgggtt

SEQ ID NO: 275805 - DNA, 25 bp, Mus musculus
cttctgcgcgtgttcaggtgagcgc

SEQ ID NO: 275806 - DNA, 25 bp, Mus musculus
aggttctggaaacgccggcttctgc

SEQ ID NO: 275807 - DNA, 25 bp, Mus musculus
cgaaggctccagtggctcggagcca

SEQ ID NO: 275808 - DNA, 25 bp, Mus musculus
cttcccgaaggctccagtggctcgg

SEQ ID NO: 275809 - DNA, 25 bp, Mus musculus
gtgcatcgcatacgtgcagcgcgtg

SEQ ID NO: 275810 - DNA, 25 bp, Mus musculus
cggacaggacacttggcgggctccc

SEQ ID NO: 275811 - DNA, 25 bp, Mus musculus
aaacgccggcttctgcgcgtgttca

SEQ ID NO: 275812 - DNA, 25 bp, Mus musculus
tcgggccttcccgaaggctccagtg

SEQ ID NO: 275813 - DNA, 25 bp, Mus musculus
ctcaagcgggcggagactgtgacga

SEQ ID NO: 275814 - DNA, 25 bp, Mus musculus
ccagcgcctcgggtagcttcgggtc

SEQ ID NO: 275815 - DNA, 25 bp, Mus musculus
gtagtgcgcgatcccgctgcacagg

SEQ ID NO: 275816 - DNA, 25 bp, Mus musculus
cctcgggtagcttcgggtcctccag

SEQ ID NO: 275817 - DNA, 25 bp, Mus musculus
caggtagtgcgcgatcccgctgcac

SEQ ID NO: 275818 - DNA, 25 bp, Mus musculus
cgccaccgggccctgccgcacagcg

SEQ ID NO: 275819 - DNA, 25 bp, Mus musculus
actcgcttccggccgaggacaggga

SEQ ID NO: 275820 - DNA, 25 bp, Mus musculus
cgcccgggtgcttaggtttcctgct

SEQ ID NO: 275821 - DNA, 25 bp, Mus musculus
ccagctccacgtaccgggccgcgca

SEQ ID NO: 275822 - DNA, 25 bp, Mus musculus
cggcctggtcgggtccagctccacg

SEQ ID NO: 275823 - DNA, 25 bp, Mus musculus
ccgcgcaggcgtcagtgcgctgctg

SEQ ID NO: 275824 - DNA, 25 bp, Mus musculus
cccggcgcggcacctgcgctccagc

SEQ ID NO: 275825 - DNA, 25 bp, Mus musculus
catggccctgccctccgaatccggt

SEQ ID NO: 275826 - DNA, 25 bp, Mus musculus
gatgctgcgccgctgaccttgggcc

SEQ ID NO: 275827 - DNA, 25 bp, Mus musculus
gccgcacagcgctcagcctggtccc

SEQ ID NO: 275828 - DNA, 25 bp, Mus musculus
cgccaagattcaaaaccgctcgagc

SEQ ID NO: 275829 - DNA, 25 bp, Mus musculus
tcagtgacgtaaggccacgccctcg

SEQ ID NO: 275830 - DNA, 25 bp, Mus musculus
gcaaaccagtcgcacctcagtgacg

SEQ ID NO: 275831 - DNA, 25 bp, Mus musculus
tgcttagctaaacccgctaggcggc

SEQ ID NO: 275832 - DNA, 25 bp, Mus musculus
cgcctcggctgctgcttagctaaac

SEQ ID NO: 275833 - DNA, 25 bp, Mus musculus
agttcaaggcatcgctctcctcgca

SEQ ID NO: 275834 - DNA, 25 bp, Mus musculus
gcgctgcaaggctcacccagttcaa

SEQ ID NO: 275835 - DNA, 25 bp, Mus musculus
agcccggtttcacaccctggtgctg

SEQ ID NO: 275836 - DNA, 25 bp, Mus musculus
ctagctcctctgaagcccggtttca

SEQ ID NO: 275837 - DNA, 25 bp, Mus musculus
gccgaggccctgacaaggggcccta

SEQ ID NO: 275838 - DNA, 25 bp, Mus musculus
ggaatcggtgcccaaagcccgcagc

SEQ ID NO: 275839 - DNA, 25 bp, Mus musculus
agaaggcggacccagagtctccacc

SEQ ID NO: 275840 - DNA, 25 bp, Mus musculus
accgcgaaggcggacccagagtctc

SEQ ID NO: 275841 - DNA, 25 bp, Mus musculus
accgctcgagctgatctctgaaagc

SEQ ID NO: 275842 - DNA, 25 bp, Mus musculus
cccgtaggtagtcctgggcatgcgt

SEQ ID NO: 275843 - DNA, 25 bp, Mus musculus
ggggcggaaccagctccagaaccaa

SEQ ID NO: 275844 - DNA, 25 bp, Mus musculus
cagaaccaagcgactggcaccaatg

SEQ ID NO: 275845 - DNA, 25 bp, Mus musculus
agcgactggcaccaatgaaattgga

SEQ ID NO: 275846 - DNA, 25 bp, Mus musculus
accaatgaaattggagcaagggcgg

SEQ ID NO: 275847 - DNA, 25 bp, Mus musculus
gcgggcttgcttcattgtgattata

SEQ ID NO: 275848 - DNA, 25 bp, Mus musculus
ttgtgattataaagaaggcgtggcc

SEQ ID NO: 275849 - DNA, 25 bp, Mus musculus
ggcgagtctgatacccccgtaggta

SEQ ID NO: 275850 - DNA, 25 bp, Mus musculus
ctgggcatgcgttgttaaggaaaaa

SEQ ID NO: 275851 - DNA, 25 bp, Mus musculus
agccctgcgtcacggaaggcaacaa

SEQ ID NO: 275852 - DNA, 25 bp, Mus musculus
tcacggaaggcaacaaccaatagta

SEQ ID NO: 275853 - DNA, 25 bp, Mus musculus
accaatagtaggtcgttgtcgtgcc

SEQ ID NO: 275854 - DNA, 25 bp, Mus musculus
tagtaggtcgttgtcgtgccttcag

SEQ ID NO: 275855 - DNA, 25 bp, Mus musculus
tataaagaaggcgtggccacagccc

SEQ ID NO: 275856 - DNA, 25 bp, Mus musculus
gcctgcagcctgctccttgttgaca

SEQ ID NO: 275857 - DNA, 25 bp, Mus musculus
cccgcccatagaggcgtggtttcgc

SEQ ID NO: 275858 - DNA, 25 bp, Mus musculus
ctgtgaggagctcagtttggacacc

SEQ ID NO: 275859 - DNA, 25 bp, Mus musculus
tttggacaccttagcggcagatgcc

SEQ ID NO: 275860 - DNA, 25 bp, Mus musculus
gctcggtcacctacggctgacacaa

SEQ ID NO: 275861 - DNA, 25 bp, Mus musculus
tttccaaagaaggacgcatcagagc

SEQ ID NO: 275862 - DNA, 25 bp, Mus musculus
ccctactggtagtgcttccgggaca

SEQ ID NO: 275863 - DNA, 25 bp, Mus musculus
aagctcgttgtttcagcggcggaca

SEQ ID NO: 275864 - DNA, 25 bp, Mus musculus
gcgcctgctttcagagctcaccatg

SEQ ID NO: 275865 - DNA, 25 bp, Mus musculus
cttggacgatcccagcgccgatttt

SEQ ID NO: 275866 - DNA, 25 bp, Mus musculus
cgccgattttgctccgcttggtttt

SEQ ID NO: 275867 - DNA, 25 bp, Mus musculus
acttcgggaaagttcgcctgcagcc

SEQ ID NO: 275868 - DNA, 25 bp, Mus musculus
caaggcaccgcccatagaattcgtc

SEQ ID NO: 275869 - DNA, 25 bp, Mus musculus
cctttctggccgcaaggacttcggg

SEQ ID NO: 275870 - DNA, 25 bp, Mus musculus
tgaccagccgtccagaaagagaagg

SEQ ID NO: 275871 - DNA, 25 bp, Mus musculus
cgattctgatgacgacgagaggccc

SEQ ID NO: 275872 - DNA, 25 bp, Mus musculus
gacgagaggcccaacagacgcgcct

SEQ ID NO: 275873 - DNA, 25 bp, Mus musculus
acgcgcctcatctgagagcgactca

SEQ ID NO: 275874 - DNA, 25 bp, Mus musculus
gagcgactcagatgacaaccagaac

SEQ ID NO: 275875 - DNA, 25 bp, Mus musculus
atgaggattccgacagtgaccagcc

SEQ ID NO: 275876 - DNA, 25 bp, Mus musculus
aaagagaaggcgctccggctctgag

SEQ ID NO: 275877 - DNA, 25 bp, Mus musculus
ccggctctgagcagtcggacaatga

SEQ ID NO: 275878 - DNA, 25 bp, Mus musculus
gtcggacaatgagtctgtgcagtca

SEQ ID NO: 275879 - DNA, 25 bp, Mus musculus
agtctgtgcagtcagggagaagccc

SEQ ID NO: 275880 - DNA, 25 bp, Mus musculus
ccctccggagcttctgagaacgaga

SEQ ID NO: 275881 - DNA, 25 bp, Mus musculus
acgagaacgattctcgcccggcttc

SEQ ID NO: 275882 - DNA, 25 bp, Mus musculus
cgcccggcttctccaagtgcagaat

SEQ ID NO: 275883 - DNA, 25 bp, Mus musculus
tgacaaccagaacaagtctggcagc

SEQ ID NO: 275884 - DNA, 25 bp, Mus musculus
gagcgcggaggccatagatttctaa

SEQ ID NO: 275885 - DNA, 25 bp, Mus musculus
cggccggcttgaaagtctcagctca

SEQ ID NO: 275886 - DNA, 25 bp, Mus musculus
catattcgcgaaggctctggggcca

SEQ ID NO: 275887 - DNA, 25 bp, Mus musculus
gccgcagtgcgcaaagccatattcg

SEQ ID NO: 275888 - DNA, 25 bp, Mus musculus
tatccaatcagcagccgggcttccg

SEQ ID NO: 275889 - DNA, 25 bp, Mus musculus
cgagtggctccttcgctatccaatc

SEQ ID NO: 275890 - DNA, 25 bp, Mus musculus
aggcgtgtctgaagcccaacttatc

SEQ ID NO: 275891 - DNA, 25 bp, Mus musculus
ttccactcgacaagaagcggccagg

SEQ ID NO: 275892 - DNA, 25 bp, Mus musculus
gcccacaaagggaccgagactcgct

SEQ ID NO: 275893 - DNA, 25 bp, Mus musculus
tcagcctagctcttcggtcgacaca

SEQ ID NO: 275894 - DNA, 25 bp, Mus musculus
ctgttcccggatcccacgtcaggat

SEQ ID NO: 275895 - DNA, 25 bp, Mus musculus
tgggacatcccgcagtagggccaca

SEQ ID NO: 275896 - DNA, 25 bp, Mus musculus
agctgcctcctctggatccggtcgt

SEQ ID NO: 275897 - DNA, 25 bp, Mus musculus
accttcaccgagaactcagcagctg

SEQ ID NO: 275898 - DNA, 25 bp, Mus musculus
cggcgcggcctgaagtctgaattca

SEQ ID NO: 275899 - DNA, 25 bp, Mus musculus
ccaggcgtgcactgctcgcagagca

SEQ ID NO: 275900 - DNA, 25 bp, Mus musculus
cctaccagtgggtgacacaggattc

SEQ ID NO: 275901 - DNA, 25 bp, Mus musculus
cccaggaatgtcgactgtgccatcg

SEQ ID NO: 275902 - DNA, 25 bp, Mus musculus
tgtgccatcgacatgaagtcgtgtc

SEQ ID NO: 275903 - DNA, 25 bp, Mus musculus
gccgagcacgagaccgccattttag

SEQ ID NO: 275904 - DNA, 25 bp, Mus musculus
gaccgccattttagacagctcaagg

SEQ ID NO: 275905 - DNA, 25 bp, Mus musculus
tcagctcaccttcagcgagggtcta

SEQ ID NO: 275906 - DNA, 25 bp, Mus musculus
ggataccgcctaagccacctcaaag

SEQ ID NO: 275907 - DNA, 25 bp, Mus musculus
gactcttagagctccactgcggcca

SEQ ID NO: 275908 - DNA, 25 bp, Mus musculus
caggagcgacttcgccgctgtccaa

SEQ ID NO: 275909 - DNA, 25 bp, Mus musculus
tgtccaatcagcgacagagctcatc

SEQ ID NO: 275910 - DNA, 25 bp, Mus musculus
gcgggcgaagccattgttttctgaa

SEQ ID NO: 275911 - DNA, 25 bp, Mus musculus
tgatgctgtcaactcagggataccg

SEQ ID NO: 275912 - DNA, 25 bp, Mus musculus
agcaggtgtgatggcgtgcgttcca

SEQ ID NO: 275913 - DNA, 25 bp, Mus musculus
tcacctcaggtaggctgtcggggaa

SEQ ID NO: 275914 - DNA, 25 bp, Mus musculus
atgaacacgatgctcacctcaggta

SEQ ID NO: 275915 - DNA, 25 bp, Mus musculus
gttgacgaagatgaacacgatgctc

SEQ ID NO: 275916 - DNA, 25 bp, Mus musculus
agcgcctcgttgacgaagatgaaca

SEQ ID NO: 275917 - DNA, 25 bp, Mus musculus
actgagagcgcctcgttgacgaaga

SEQ ID NO: 275918 - DNA, 25 bp, Mus musculus
tccatggccgagtggatggaacgca

SEQ ID NO: 275919 - DNA, 25 bp, Mus musculus
accaggatgatctccttgagcaggt

SEQ ID NO: 275920 - DNA, 25 bp, Mus musculus
gtcgtccaccaggatgatctccttg

SEQ ID NO: 275921 - DNA, 25 bp, Mus musculus
ctgctgttgtcgtccaccaggatga

SEQ ID NO: 275922 - DNA, 25 bp, Mus musculus
acactcaccgttgctgctgttgtcg

SEQ ID NO: 275923 - DNA, 25 bp, Mus musculus
gggagacggacactcaccgttgctg

SEQ ID NO: 275924 - DNA, 25 bp, Mus musculus
ctcagctccggggagacggacactc

SEQ ID NO: 275925 - DNA, 25 bp, Mus musculus
aacgcaggagcactgagagcgcctc

SEQ ID NO: 275926 - DNA, 25 bp, Mus musculus
tgccagggcccagccgcgttgcttt

SEQ ID NO: 275927 - DNA, 25 bp, Mus musculus
tgggaaactttgtcactgccagggc

SEQ ID NO: 275928 - DNA, 25 bp, Mus musculus
tccgagcgacaagcgccgccaccaa

SEQ ID NO: 275929 - DNA, 25 bp, Mus musculus
agccgcgttgctttccatctccagt

SEQ ID NO: 275930 - DNA, 25 bp, Mus musculus
gcgttgctttccatctccagtgctg

SEQ ID NO: 275931 - DNA, 25 bp, Mus musculus
ttccatctccagtgctggctgcctg

SEQ ID NO: 275932 - DNA, 25 bp, Mus musculus
tggctgcctgggagatgccaccagc
